United States Patent
Reyon et al.

(10) Patent No.: US 11,028,394 B2
(45) Date of Patent: Jun. 8, 2021

(54) CRISPR/CAS-RELATED METHODS AND COMPOSITIONS FOR TREATING CYSTIC FIBROSIS

(71) Applicant: EDITAS MEDICINE, INC., Cambridge, MA (US)

(72) Inventors: Deepak Reyon, Malden, MA (US); Morgan L. Maeder, Jamaica Plain, MA (US); Ari E. Friedland, Boston, MA (US); G. Grant Welstead, Cambridge, MA (US); David A. Bumcrot, Blemont, MA (US)

(73) Assignee: EDITAS MEDICINE, INC., Cambridge, MA (US)

(\*) Notice: Subject to any disclaimer, the term of this patent is extended or adjusted under 35 U.S.C. 154(b) by 764 days.

(21) Appl. No.: 15/288,475

(22) Filed: Oct. 7, 2016

(65) Prior Publication Data

US 2017/0022507 A1    Jan. 26, 2017

Related U.S. Application Data

(63) Continuation of application No. PCT/US2015/023960, filed on Apr. 1, 2015.

(60) Provisional application No. 61/977,488, filed on Apr. 9, 2014.

(51) Int. Cl.
*C12N 15/113* (2010.01)
*C12N 9/22* (2006.01)

(52) U.S. Cl.
CPC ............ *C12N 15/1138* (2013.01); *C12N 9/22* (2013.01); *C12N 2310/10* (2013.01); *C12N 2310/20* (2017.05); *C12N 2320/34* (2013.01)

(58) Field of Classification Search
CPC ....... C12N 15/907; C12N 15/63; A61K 48/00
See application file for complete search history.

(56) References Cited

U.S. PATENT DOCUMENTS

2015/0291966 A1\* 10/2015 Zhang ................. C12N 15/635
  435/320.1
2016/0168594 A1\*  6/2016 Zhang ................ A01K 67/0275

OTHER PUBLICATIONS

Hollywood, "Cystic fibrosis gene repair: correction of ΔF508 using ZFN and CRISPR/Cas9 guide RNA gene editing tools," Jan. 2013, pp. 1-193 Retrieved from the Internet: URL: https://cora.ucc.ie/bitstream/handle/10468/1407/JHthesis.pdf? sequence=3 [Retrieved on Mar. 28, 2017].

Ikpa et al., "Cystic fibrosis: Toward personalized therapies," The International Journal of Biochemistry & Cell Biology, 52:192-200 (2014).

International Search Report and Written Opinion dated Nov. 11, 2015 in International Application No. PCT/US2015/023960.

Schwank et al., "Functional Repair of CFTR by CRISPR/Cas9 in Intestinal Stem Cell Organoids of Cystic Fibrosis Patients," Cell Stem Cell, 13(6):653-658 (2013).

Li et al., "RNA interference for CFTR attenuates lung fluid absorption at birth in rats," Respiratory Research 9:55 (2008).

Partial European Search Report dated Sep. 19, 2019 in EP Application No. 19157864.

\* cited by examiner

*Primary Examiner* — Antonio Galisteo Gonzalez
(74) *Attorney, Agent, or Firm* — Baker Botts L.L.P.

(57) ABSTRACT

Disclosed herein are genome editing systems and compositions that target a cystic fibrosis transmembrane conductance regulator (CFTR) gene and a sodium channel epithelial 1 alpha (SCNN1A) gene, comprising a Cas9 molecule, and a gRNA molecule comprising a targeting domain that is complementary with a target sequence of a CFTR gene or a SCNN1A gene, and cells comprising such genome editing systems and compositions. Also provided are methods for using the genome editing systems, compositions, and cells for genome engineering (e.g., altering a CFTR gene and/or a SCNN1A gene), and for preventing or treating Cystic Fibrosis (CF) and CF-like disease.

9 Claims, 27 Drawing Sheets

Specification includes a Sequence Listing.

```
CLUSTAL format alignment by MAFFT (v7.058b)
                                                                                    Y
SM           KKPYSIGLDIGTNSVGWAV VTDDYKVPAKMKVLGNTDKSHIEKNLLGALLFDSGNTAED
SP           DKKYSIGLDIGTNSVGWAVITDEYKVPSKKFKVLGNTDRHSIKKNLIGALLFDSGETAEA
ST           TKPYSIGLDIGTNSVGWAVITDNYKVPSKKMKVLGNTSKKYIKKNLLGVLLFDSGITAEG
LI           KKPYTIGLDIGTNSVGWAVLTDQYDLVKRKMKIAGDSERKQIKKNFWGVRLFDEGQTAAD
             * *:****:******** :**: .  *:::: **::  *.  *:**:  *:** . **
Motif:       -K--Y*IGLDIGTNSVGWAV-TD*Y-*--*K*K*-G*-*--I*KN*-G--LFD-G-TA--

SM           RRLKRTARRRYTRRRNRILYLQEIFSEEMGKVDDSFFHRLEDSFLVTEDKRGERHPIFGN
SP           TRLKRTARRRVTRRANRICYLQEIFSNEMAKVDDSFFHRLEESFLVEEDKKHERHPIFGN
ST           RRLKRTARRRYTRRRNRILYLQEIFSTEMATLDDAFFQRLDDSFLVPDDKKRDSKYPIFGN
LI           RRMARTARRRIERRRNRISYLQGIFAEEMSKTDANFFCRLSDSFYVDNEKRNSRHPFFAT
             *:  ******  :* ***  ** ** :**  .*:*:**::** :  :: :.. : *  .
Motif:       -R*--RTARRR--RR*NRI--YLQ--IF*--EM---D--FF-RL-*SF-V-K--.P*F--

SM           LEEEVKYHENFPTIYHLRQYLADNPEKVDLRLVYLALAHIIKFRGHFLIEGKFDTRNNDV
SP           IVDBVAYHEKVPTIYHLRKKLVDSTDKADLRLIYLALAHMIKFRGHFLIEGDLNPDNSDV
ST           LVEEKAYHDEFPTIYHLRKYLADSTKADLRLVYLALAHMIKYRGHFLIEGEFNSKNNDI
LI           IEEEVEYHKNVPTIYHLREELVMSSEKADLRLYLREELVNSSEKADLRL*YLALAH*IKYRGNFLIEGALDTQNTSV
             :   * **::::*****:: :::**::*::::*:********::*:*:***::    :
Motif:       *--*E--YH--**PTIYHLR*--L*---K--DLRL*YLALAH*-IK*RGNFLIEG-**--N--*
```

SM      LQEMRAIIRRQAEFYPFLADNQDRIEKLLTFRIPYYVGPLARGKSDFAWLSRKSADKITP
SP      LGELHAILRRQEDFYPFLKDNREKIEKILTFRIPYYVGPLARGNSRPAWMTRKSEETITP
ST      LQEMRAILDKQAKFYPFLAKNKERIEKILTFRIPYYVGPLARGNSDFAWSIRKRNEKITP
LI      LEELEAILHQQAKYYPFLKENYDKIKSLVTFRIPYFVGPLANGQSEFAWLTRKADGEIRP
         *   ***: :*     *  :  :.*:.:. ::***: *  :  .  
Motif:  L-E*--AI*--*Q---*YPFL---N-I-TFRIPY*VGPLA-G*S-FAW--RK----I-P SM      WNFDEIVDKESSAEAFINRMTNYDLYLPNQKVLPKHSLLYEKFTVYNELTKVKYKTE-QG
SP      WNFEEVVDKGASAQSFIERMTNFDKNLPNEKVLPKHSLLYEYFTVYNELTKVKYVTEGMR
ST      WNFEDVIDKESSAEAFINRMTSFDLYLPEEKVLPKHSLLYETFNVYNELTKVRFIAESMR
LI      WNIEEKVDFGKSAVDFIEKMTNKDTVLPKENVLPKHSLCYQKYLVYNELTKVRYIND-QG
        **:::  *.  :*::::.: * ***.* :  . .** *:* :. *:: .  .
Motif:  WN****-*D----SA--FIMT---D--LP*VLPKHSL-Y*-*-VYNELTKV**----

SM      KTAFFDDANMKQEIFDGVFRKVYRKVTKDKLMDFLBKEFDEFRIVDLTGLDKENKVFNASYG
SP      KPAFLSGEQKKAIVDLLFKTNRKVTVKQLKEDYFKKIECFDSVEISGVEDR---FNASLG
ST      DYQFLDSKQKKDIVRLYFKDKRKKVTDKDIIEYL-HAIYGYDGIELKGIEKQ----FNSSLS
LI      KTSYFPSGQEKEQIFNDLFKQRKRKVKKKDLELFL-RNMSHVESPTIEGLEDS----FNSSYS
         :.: . ..::: :. :::. :*    .. :   :        :   :*
Motif:  ---*----*-K*--I---FK--RKV----*-------G**-----FN*S--

SM      TYHDLCKIL-DKDFLDNSKINEKILEDIVLTLTLFEDREMIKRKRLENYSDLLTKEQVKKLE
SP      TYHDLLKIIIKDKDFLDNEENEDILEDIVLTLTLFEDREMIEERLKTYAHLFDDKVMKQLK
ST      TYHDLLNIINDKEFLDDSSINEAIIEEIHTLTIFEDREMIKQRLSKPENIFDKSVLKKLS
LI      TYHDLLKVGIKQEILDNPVNTEMLENIVKILTVFEDKRMIKEQLQQFSDVLDGVLKKLE
        *****.   :       ::     *.: * *:*.:..     .:::  *:**
Motif:  TYHDL-----*LD--N---**E*I*--LT*FED*-MI-**L-----*K-*L-

Fig. 2C

```
SM        RRHYTGWGRLSAELIHGIRNKESRKTILDYLIDDGNSRNFMQLINDDALSFKEEIAKAQ
SP        RRRYTGWGRLSRKLINGIRDKQSGKTILDFLKSDGFANRNFMQLIHDDSLTFKEDIQKAQ
ST        RRHYTGWGKLSAKLINGIRDEKSGNTILDYLIDDGISNRNFMQLIHDDALSFKKIQKAQ
LI        RRHYTGWGRLSAKLLMGIRDKQSHZTILDYLMNDDGLNRRMLMQLINDSNLSFKSIEKEQ
          **:****:**  **:  ***::*    *.  * ::   *  . :. : *.  :  *
Motif:    RR*VTGWG*LS-*L*-GIR***S--TILD*L--D---NRN*MQLI*D--L*FK--I-K-Q SM        VIGETD--NLNQVVSDIAGSPAIKKGILQSLKIVDELVKIMG-HQPENIVVEMARENQFT
SP        VSGQGD--SLHEHIANLAGSPAIKKGILQTVKVVDELVKVMGRHKPENIVIEMARENQTT
ST        IIGDEDKGNIKEVVKSLPGSPAIKKGILQSIKIVDELVKVMGGRKPESIVVEMARENQYT
LI        VTTADK--DIQSIVADLAGSPAIKKGILQSLKIVDELVSVMG-YPPQTIVVEMARENQTT
          :    .    : : :.* ********:*:*****. **  : *:..:********.*
Motif:    *------------GSPAIKKGILQ**K*VDELV-*MG---P*--IV*EMARENQ-T SM        NQGRRNSQQRLKGLITDSIKEFGSQILKEH------PVENSQLQNDRLFLYYLQNGRDMYT
SP        QKGQKNSRERMKRIEEGIKELGSQILKEH------PVENTQLQNEKLYLYYLQNGRDMYV
ST        NQGKSMSQQRLKRLEKSLKELGSSKILKENIPAKLSKIDNNALQNDRLYLYYLQNGKDMYT
LI        GKGKNMSRPRYKSLEKAIKEFGSQILKEH------PTDNQRLRNNRLYLYYLQNGKDMYT
           .* :.* :  :  :.. **:**.:****:            :**:*:****** ***
Motif:    -*G--NS*-R-K-*----*KE*GS*ILKE*------N--L*N**L*LYYLQNG-DMY- SM        GEELDIDYLSQYDIDHIIPQAFIKDNSIDNRVLTSSKEARGKSDDVFSKDVVRKMKSYMS
SP        DQELDINRLSDYDVDHIVPQSFLKDDSIDNKVLTRSDKARGKSDNVPSEBVVKKMKNYWR
ST        GDDLDIDRLSNYDIDHIVPQAFLKDNSIDNKVLVSSASNRGKSDDVPSLEVVKKRKTFWY
LI        GQDLDIHNLSNYDIDHIVPQSFITDNSIDNLVLTSSAGMREKGDDVPPLEIVRKRKVFWE
           ::::* .**:** ***:**:*  *:**** ** .*.  *:*.*:* * :*:* *.:
Motif:    -**LDI--LS*-YD*DHI*PQ*F*-D*SIDN-VL--S--2R-K-D*VP---**V*-K-K-*-W-
```

```
SM      GNSDK-LIPRKTKKFYWDTKKYGGEDSPIVAYSILVIADIEKGKSKKLKTVKALVGVTIM
SP      RMSDK-LIARKKD---WDPKKYGGFDSPTVAYSVLVAKVEKGKSKKLKSVKELLGITIM
ST      PNSMENLVGAKEY---LDPKKYGGYAGISNSFTVLVKGTIEKGAKKKITNVLEFQGISIL
LI      GNSSK-LIPRKTN---WDPMKYGGLDSPNMAYAVVI---EYAKGKN-KLVEKKIIRVTIM
        *  * ;   *   *   ;;;;;    *     *     ;;     *   ;;  **I*
Motif:  -MS-*-L*--K------D--KYGG---------*****-----KG--K*----**L*

SM      EKMTFERDPVAFLERKGYRNVQEBNIIKLPKYSLFKLEMGRKRLLAS------ARELQK
SP      ERSSFEKNPIDFLEAKGYKEVKKDLIIKLPKYSLFELENGRKRMLAS------AGELQK
ST      DRINYRKDKLNFLLEKGYKDI--ELIIELPKYSLFELSDGSRPMLASILSTNNKRGEIHK
LI      ERKAFEKDEKAFLEEOGYRQP--KVLAKLPKYTLYECEEGRRRMLAS------ANEAQK
        ;; ;;;;   ** ;;**     ;     *****;*;; ;;*  ;;***      *  ;*
Motif:  **--*--**---FL*---*GY**-----*-*LPKY*L**--*--*G--*R*LAS------B-*K SM      GNEIVLPNHLGTLLYHAKNIHKV-----DEPKHLDYVDKHKDEFKELLDVVSNFSKKYT
SP      GNELALPSKYVNFLYLASHYEKLKGSPEDNEOKQL-FVEOHKHYLDEIIEOISEFSKRVI
ST      GMQIFLSQKFVKLLYHAKRISMT-----INEMHRKYVENHKKEFEELFYYILEFMENYV
LI      GNQQVLPNHLVTLLHHAANCEVS-----DGKSLDYIESNREMFAELLAHVSEFAKRYT
        *  ; ;  ;   ** ;    ;           ; ;;     ** ;  ;  ;;  ; ;
Motif:  GN*----L*-*---L*--A--------------*-------*------*--E*-*-*--*F*----

SM      LAEGNLEKIKELYAONNGEDLKELASSFI--------NLLTFTAIGAPATFKFFDKNIDR
SP      LADANLDKVLSAYNKHRDKPIREQAENII--------HLFTLTNLGAPAAFKYFDTTIDR
ST      GAKKNGKLLNSAPOSWOMHSIDELCSSFIGPTGSERKGLFELTSRGSAADFEFLGVKIPR
LI      LAEANLNKINQLFEONKEGDIKAIAQSFV----------DLMAFNAMGAPASFKFFETTIER
        *     ;  ; ;       ;  ;     *  ;   ;     *   ; ;; ** ;     ; *
Motif:  -A--N--*-----*-----------*---------L-*--*---G*-A-F***---I-R
```

Fig. 2F

```
           SM
           SP
           ST
           LI
        Motif:

SM
           SP
           ST
           LI
        Motif:

SM
           SP
           ST
           LI
        Motif:

SM
           SP
           ST
           LI
        Motif:
```

```
SM  KR-YTSTTEILNATLIHQSITGLYETRIDLNKLGGD      (SEQ ID NO:1)
SP  KR-YTSTKEVLDATLIHQSITGLYETRIDLSQLGGD      (SEQ ID NO:2)
ST  YRDYTPSSLLKDATLIHQSVTGLYETRIDLAKLGEG      (SEQ ID NO:3)
LI  KR-YNNLKELLMSTIIYQSITGLYESRKRLD----D      (SEQ ID NO:4)
     *  *.   .  :  *.:.*:*:.:.******.:*:    *

Motif: -R-Y-----*--*T*I*QS*TGLYE*R--L------
```

Fig. 2G

Alignment of the N terminal RuvC-like Domains disclosed in Chylinski et al.
(excluding sequence outliers).
(CLUSTAL format alignment by MAFFT (v7.058b))

```
1   DIGTNSVGWAVT  (SEQ ID NO:54)
12  DIGTNSVGWAVT  (SEQ ID NO:55)
3   DVGTNSVGWAVT  (SEQ ID NO:56)
20  DVGTNSVGWAVT  (SEQ ID NO:57)
15  DMGTNSVGWAVT  (SEQ ID NO:58)
4   DVGTSSVGWAVT  (SEQ ID NO:59)
7   DIGTASVGWAVT  (SEQ ID NO:60)
6   DVCTGSVGWAVT  (SEQ ID NO:61)
9   DIGTNSVGWAVV  (SEQ ID NO:62)
10  DIGTNSVGWAVI  (SEQ ID NO:63)
11  DIGTNSVGWAVL  (SEQ ID NO:64)
42  DLGTNSIGWAVV  (SEQ ID NO:65)
48  DLGTNSIGWAI-  (SEQ ID NO:66)
43  DLGTNSIGWALV  (SEQ ID NO:67)
2   DIGTNSVGWCVT  (SEQ ID NO:68)
14  DIGTNSVGYAVT  (SEQ ID NO:69)
5   DMGTGSLGWAVT  (SEQ ID NO:70)
16  DIGTSSVGWAAI  (SEQ ID NO:71)
8   DLGTGSVGWAVV  (SEQ ID NO:72)
22  DLGVGSVGWAIV  (SEQ ID NO:73)
23  DLGIASIGWAII  (SEQ ID NO:74)
24  DLGIASVGWAIV  (SEQ ID NO:75)
25  DLGVASVGWSIV  (SEQ ID NO:76)
26  DIGIASVGWAIL  (SEQ ID NO:77)
28  DIGISSVGWSVI  (SEQ ID NO:78)
32  DLGISSVGWSVI  (SEQ ID NO:79)
33  DVGIGSIGWAVI  (SEQ ID NO:80)
39  DVGIGSIGFAIV  (SEQ ID NO:81)
34  DLGVGSIGWAVI  (SEQ ID NO:82)
47  DIGYASIGWAVI  (SEQ ID NO:83)
50  DTGTNSLGWAIV  (SEQ ID NO:84)
49  DLGTNSIGWCLL  (SEQ ID NO:85)
18  DIGTDSLGWAVF  (SEQ ID NO:86)
41  DIGSNSIGFAVV  (SEQ ID NO:87)
45  DLGVGSIGVAVA  (SEQ ID NO:88)
    DLGIASCGWGVV
```

Fig. 3A

| | | |
|---|---|---|
| 21 | DLGIASVGWCLT | (SEQ ID NO:89) |
| 27 | DIGIGSVGVGIL | (SEQ ID NO:90) |
| 29 | DIGITSVGYGLI | (SEQ ID NO:91) |
| 30 | DIGITSVGFGII | (SEQ ID NO:92) |
| 31 | DVGITSTGYAVL | (SEQ ID NO:93) |
| 40 | DLGITSFGYAIL | (SEQ ID NO:94) |
| 17 | DIGNASVGWSAF | (SEQ ID NO:95) |
| 19 | DVGTNSCGWVAM | (SEQ ID NO:96) |
| 35 | DVGERSIGLAAV | (SEQ ID NO:97) |
| 36 | DVGLNSVGLAAV | (SEQ ID NO:98) |
| 37 | DVGLMSVGLAAI | (SEQ ID NO:99) |
| 38 | DVGTFSVGLAAI | (SEQ ID NO:100) |
| 13 | DIGTGSVGYACM | (SEQ ID NO:101) |
| 44 | DLGTTSIGFAHI | (SEQ ID NO:102) |
| 46 | DLGTNSIGSSVR | (SEQ ID NO:103) |
| | * * * * | |

Fig. 3B

Alignment of the N terminal RuvC-like Domains disclosed in Chylinski et al.
(CLUSTAL format alignment by MAFFT (v7.058b))

```
1    D----IGTNSVGWAVT    (SEQ ID NO:104)
12   D----IGTNSVGWAVT    (SEQ ID NO:105)
3    D----VGTNSVGWAVT    (SEQ ID NO:106)
20   D----VGTNSVGWAVT    (SEQ ID NO:107)
15   D----MGTNSVGWAVT    (SEQ ID NO:108)
4    D----VGTSSVGWAVT    (SEQ ID NO:109)
7    D----IGTASVGWAVT    (SEQ ID NO:110)
6    D----VGTGSVGWAVT    (SEQ ID NO:111)
9    D----IGTNSVGWAVT    (SEQ ID NO:112)
10   D----IGTNSVGWAVI    (SEQ ID NO:113)
52   D----IGTNSIGWAVI    (SEQ ID NO:114)
11   D----IGTNSVGWAVI    (SEQ ID NO:115)
42   D----LGTNSIGWAVL    (SEQ ID NO:116)
48   D----LGTNSIGWAVV    (SEQ ID NO:117)
43   D----LGTNSIGWAI-    (SEQ ID NO:118)
2    D----LGTNSIGWALV    (SEQ ID NO:119)
14   D----IGTNSVGWCVT    (SEQ ID NO:120)
5    D----IGTNSVGYAVT    (SEQ ID NO:121)
16   D----MGTGSLGWAVT    (SEQ ID NO:122)
8    D----IGTSSVGWAAI    (SEQ ID NO:123)
22   D----LGTCSVGWAVV    (SEQ ID NO:124)
23   D----LGVGSVGWAIV    (SEQ ID NO:125)
24   D----LGIASIGWAII    (SEQ ID NO:126)
68   D----LGIASVGWAIV    (SEQ ID NO:127)
25   D----LGIASVGWAVV    (SEQ ID NO:128)
26   D----LGVASVGWSIV    (SEQ ID NO:129)
66   D----IGIASVGWAIL    (SEQ ID NO:130)
59   D----LGIASVGWAVL    (SEQ ID NO:131)
61   D----IGIASVGWAVI    (SEQ ID NO:132)
64   D----IGIASVGWAII    (SEQ ID NO:133)
62   D----VGIASVGWAVI    (SEQ ID NO:134)
67   D----IGIASVGWAL-    (SEQ ID NO:135)
32   D----IGIASVGWAMV    (SEQ ID NO:136)
28   D----LGIASVGWSVI    (SEQ ID NO:137)
63   D----IGITSVGWAVI    (SEQ ID NO:138)
```

Fig. 4A

| | Sequence | SEQ ID |
|---|---|---|
| 33 | D---VGIGSIGWAVI | (SEQ ID NO:139) |
| 57 | D---LGISSLGWAIV | (SEQ ID NO:140) |
| 39 | D---LGVGSIGFAIV | (SEQ ID NO:141) |
| 40 | D---IGYASIGWAVI | (SEQ ID NO:142) |
| 50 | D---LGTNSIGWCLL | (SEQ ID NO:143) |
| 47 | D---LGTNSIGWGLL | (SEQ ID NO:144) |
| 49 | D---LGTNSLGWAIV | (SEQ ID NO:145) |
| 51 | D---TGTNSLGWAVP | (SEQ ID NO:146) |
| 58 | D---IGTDSLGWAIF | (SEQ ID NO:147) |
| 45 | D---LGSTSLGWAIV | (SEQ ID NO:148) |
| 18 | D---LGISSIGWAFS | (SEQ ID NO:149) |
| 65 | D---LGIASVGWCLT | (SEQ ID NO:150) |
| 29 | D---LGIASCGWGVV | (SEQ ID NO:151) |
| 30 | D---IGSNSIGFAVV | (SEQ ID NO:152) |
| 44 | D---IGTTSIGFSVI | (SEQ ID NO:153) |
| 27 | D---IGITSVGYGLI | (SEQ ID NO:154) |
| 41 | D---IGITSVGFGII | (SEQ ID NO:155) |
| 31 | D---LGTTSIGPAHI | (SEQ ID NO:156) |
| 40 | D---IGIGSVGVGIL | (SEQ ID NO:157) |
| 53 | D---LGVGSIGVAVA | (SEQ ID NO:158) |
| 55 | D---VGITSIGYAVL | (SEQ ID NO:159) |
| 17 | D---LGITSFGYAIL | (SEQ ID NO:160) |
| 19 | D---IGTSSIGWMLY | (SEQ ID NO:161) |
| 35 | D---LGSNSLGWFVT | (SEQ ID NO:162) |
| 36 | D---LGANSLGWFVV | (SEQ ID NO:163) |
| 37 | D---IGNASVGWSAF | (SEQ ID NO:164) |
| 38 | D---VGTNSCGWVAM | (SEQ ID NO:165) |
| 13 | D---VGERSIGLAAV | (SEQ ID NO:166) |
| 46 | D---VGLNSVGLAAV | (SEQ ID NO:167) |
| 60 | D---VGLMSVGLAAI | (SEQ ID NO:168) |
| 69 | D---VGTFSVGLAAI | (SEQ ID NO:169) |
| 73 | D---IGTGSVGYACM | (SEQ ID NO:170) |
| 74 | D---LGTNSIGSSVR | (SEQ ID NO:171) |
| 70 | DIGLRIGITSCGWSI- | (SEQ ID NO:172) |
| 71 | D---MGAKYTGVFYA | (SEQ ID NO:173) |
| 72 | D---LGGKNTGFFSF | (SEQ ID NO:174) |
| | D---LGVRNTGVFSA | (SEQ ID NO:175) |
| | D---LGAKFTGVALY | (SEQ ID NO:176) |
| | D---LGGKFTGVCLS | (SEQ ID NO:177) |
| | D---LGGTYTGTFIT | |

Fig. 4B

Alignment of the HNH-like Domains disclosed in Chylinski et al.
(CLUSTAL format alignment by MAFFT (v7.058b))

```
1   YDIDHIYPRS-LTKD------DSF-DNLVLCERTAN   (SEQ ID NO:178)
2   -DIDHIYPRSKVIKD------DSF-DNLVLVLKNEM   (SEQ ID NO:179)
3   -DRDHIYPQS-KIKD------DSI-DNLVLVNKTYN   (SEQ ID NO:180)
4   -DIDHIYPRS-KIKD------DSI-TNRVLVEKDIN   (SEQ ID NO:181)
6   -DIDHIYPQS-KIKD------DSI-SNRVLVCSSCN   (SEQ ID NO:182)
5   -DIDHIYPQS-KTMD------DSL-NNRVLVKKNYN   (SEQ ID NO:183)
7   -DQDHIYPKS-KIYD------DSL-ENRVLVKKNLN   (SEQ ID NO:184)
8   -QIDHIVPQS-LVKD------DSF-DNRVLVVPSEN   (SEQ ID NO:185)
9   -DIDHIIPQA-FIKD------NSI-DNRVLTSSKEN   (SEQ ID NO:186)
12  -DIDHIIPQA-FLKD------NSI-DNKVLVSSASN   (SEQ ID NO:187)
16  -DIDHIIPQA-YTKD------NSL-DNRVLVSNITN   (SEQ ID NO:188)
11  -DIDHIVPQS-FITD------NSI-DNLVLTSSAGM   (SEQ ID NO:189)
10  -DVDHIVPQS-FLKD------DSI-DNKVLTRSDKN   (SEQ ID NO:190)
14  -NIDHIYPQS-MVKD------DSL-DNKVLVQSEIN   (SEQ ID NO:191)
18  -DIDHILPQS-LIKD------DSL-DNRVLVNATIN   (SEQ ID NO:192)
19  -DIDHILPQS-FIKD------DSL-ENRVLVKKAVN   (SEQ ID NO:193)
13  -EVDHIFPRS-FIKD------DSI-DNKVLVIKKMN   (SEQ ID NO:194)
15  -EVDHIIPRS-YIKD------DSF-ENKVLVYREEN   (SEQ ID NO:195)
17  -DIDHIIPQA-VTQN------DSI-DNRVLVARAEN   (SEQ ID NO:196)
22  -EIDHIIPYS-ISFD------DSS-SNKLLVLAESN   (SEQ ID NO:197)
24  -EIDHIIPYS-LCFD------DSS-ANKVLVHKQSN   (SEQ ID NO:198)
32  -DIDHIIPYS-RSMD------DSY-SNKVLVLSGEN   (SEQ ID NO:199)
63  -DIDHIIPYS-KSMD------DSF-NNKVLCLAEEN   (SEQ ID NO:200)
59  -EIDHIIPYS-RSFD------DSY-MNKVLVFTKQN   (SEQ ID NO:201)
65  -QIDHIIPYS-RSMD------DSY-MNKVLVLTDEN   (SEQ ID NO:202)
64  -EIDHIIPFS-RSFD------DSL-SNKILVLGSEN   (SEQ ID NO:203)
68  -EIDHALPFS-RTWD------DSF-MNKVLVLGSEN   (SEQ ID NO:204)
69  -EIDHALPFS-RTWD------DSP-NNKVLVLASEN   (SEQ ID NO:205)
28  -EVDHIIPFS-ISLD------DSI-NNKVLVLSKAN   (SEQ ID NO:206)
30  -EVDHIIPIS-ISLD------DSI-TNKVLVTHREN   (SEQ ID NO:207)
62  -QVDHALPYS-RSYD------DSK-NNKVLVLTHEN   (SEQ ID NO:208)
27  -EVDHILPLS-ITFD------DSL-ANKVLVYATAN   (SEQ ID NO:209)
26  -EIDHIIPRS-ISFD------DAR-SNKVLVYRSEN   (SEQ ID NO:210)
```

Fig. 5A

```
29  -EVDHIIPRS-VSFD------MSY-HNKVLVKQSEN   (SEQ ID NO:211)
67  -DIDHILPYS-ITFD------DSF-RNKVLVTSQEN   (SEQ ID NO:212)
58  -EIDHILPRS-RSAD------DSF-ANKVLCLARAN   (SEQ ID NO:213)
51  -EIEHLLPFS-LTLD------DSM-AAKTVCFRQAN   (SEQ ID NO:214)
55  -DIDHILPFS-VSLD------DSA-ANKVVCLREAN   (SEQ ID NO:215)
57  -DIDHLIPFS-ISWD------DSA-ANKVVCMRYAN   (SEQ ID NO:216)
56  -DIDHILPVA-MTLD------DSP-ANKIICMRYAN   (SEQ ID NO:217)
54  -DVDHILPYS-RTLD------DSF-PNRTLCLREAN   (SEQ ID NO:218)
52  -EIEHILPFS-RTLD------DSL-NNRTVAMRRAN   (SEQ ID NO:219)
31  -EVDHIIPYS-ISWD------DSY-TNKVLTSAKCN   (SEQ ID NO:220)
45  -QVDHILPWS-RFGD------DSY-LNKTLCTARSN   (SEQ ID NO:221)
53  -QVDHILPFS-KTLD------DSP-ANKVLAQHDAN   (SEQ ID NO:222)
60  -QIDHAFPLS-RSLD------DSQ-SNKVLCLTSSN   (SEQ ID NO:223)
21  -DIDHIVPRS-ISFD------DSF-SNLVIVNKLDN   (SEQ ID NO:224)
23  -EIEHIIPYS-MSYD------NSQ-ANKILTEKAEN   (SEQ ID NO:225)
25  -DIDHIVPYS-KSAD------DSW-FNKLLVKKSTN   (SEQ ID NO:226)
49  -EMDHILPRS-RSLD------NGW-HNRVLVHGKDN   (SEQ ID NO:227)
33  -EVDHIVPYS-LILD------NTI-NNKALVTAEEN   (SEQ ID NO:228)
42  -EIEHVIPQS-LYFD------DSF-SNKVICEAEVN   (SEQ ID NO:229)
43  -DIEHIIPQA-RLFD------DSF-SNKTLEARSVN   (SEQ ID NO:230)
44  -EIEHIVPKA-RVFD------DSF-SNKTLTFHRIN   (SEQ ID NO:231)
20  -DKDHIIPQS-MKKD------DSIINNLVLVNKNAN   (SEQ ID NO:232)
66  -EVEHIWPRS-RSFD------NSP-RNKTLCRKDVN   (SEQ ID NO:233)
61  -IVNHIIPYN-RSFD------DTY-HNRVLTLTETK   (SEQ ID NO:234)
46  -DMEHTIPKS-ISFD------NSD-QNLTLCESYVN   (SEQ ID NO:235)
47  -DIEHTIPRS-AGGD------STK-MNLTLCSSRFN   (SEQ ID NO:236)
48  -DIEHTIPRS-ISQD------MSQ-MNKTLCSLKFN   (SEQ ID NO:237)
50  -DIDHVIPLA-RGGR------DSL-DNMVLCQSDAN   (SEQ ID NO:238)
39  -DIEHLFPIA-ESED------NGR-NNLVISHSACN   (SEQ ID NO:239)
41  -DVDHIFPRD-DTAD------RSY-GNKVVAHRQCN   (SEQ ID NO:240)
40  -DIEHIVPQS-LGGL------STD-YNTIVTLKSVN   (SEQ ID NO:241)
35  -ELDHIVPRT-DGGS------NRH-ENLAITCGACN   (SEQ ID NO:242)
36  -EMDHIVPRKGVGST-----NTR-TNFAAVCAECN    (SEQ ID NO:243)
37  -EMDHIVPRKGVGST-----NTR-VNLAAACAACN    (SEQ ID NO:244)
38  -EMDHIVPRAGQGST-----NTR-ENLVAVCHRCN    (SEQ ID NO:245)
70  -EIDHILPRS-LIKDARGIVFNAE-PNLIYASSRGN   (SEQ ID NO:246)
71  -EIDHIIPRS-LTGRTKKTVFNSE-ANLIYCSSKGN   (SEQ ID NO:247)
73  -EIDHIIPRS-LTLKKSESIYNSE-VNLIFVSAQGN   (SEQ ID NO:248)
```

Fig. 5B

```
72  -EIDHIYPRS-LSKKHEGVIFNSE-VNLIYCSSQGN  (SEQ ID NO:249)
74  -EIDHILPRS-HTLKIYGTVFNPE-GNLIYVHQKCN  (SEQ ID NO:250)
75  -ELDHIIPRS-HKKY---GTLNDE-ANLICVTRGDN  (SEQ ID NO:251)
34  -ELEHIVPHS-FRQS-----NAL-SSLVLTWFGVN   (SEQ ID NO:252)
     *   :*  .           .             :
```

Fig. 5C

Alignment of the HNH-like Domains disclosed in Chylinski et al. (excluding sequence outliers).
(CLUSTAL format alignment by MAFFT (v7.058b))

```
 1   YDIDHIYPRS-LTKDDS-FDNLVLCERTAN    (SEQ ID NO:253)
 2   -DIDHIYPRSKVIKDDS-FDMLVLVLKNEN    (SEQ ID NO:254)
 3   -DRDHIYPQS-KIKDDS-IDMLVLVNKTYN    (SEQ ID NO:255)
 4   -DIDHIYPRS-KIKDDS-ITNRVLVEKDIN    (SEQ ID NO:256)
 6   -DIDHIYPQS-KIKDDS-ISNRVLVCSSCN    (SEQ ID NO:257)
 5   -DIDHIYPQS-KTWDDS-LNNRVLVKKNYN    (SEQ ID NO:258)
 7   -DQDHIYPKS-KIYDDS-LEMRVLVKKNLN    (SEQ ID NO:259)
 8   -QIDHIVPQS-LVKDDS-FDNRVLVVPSEN    (SEQ ID NO:260)
 9   -DIDHIIPQA-FIKDNS-IDNRVLTSSKEN    (SEQ ID NO:261)
12   -DIDHIIPQA-FLKDNS-IDNKVLVSSASN    (SEQ ID NO:262)
16   -DIDHIIPQA-YTKDNS-LDNRVLVSNITN    (SEQ ID NO:263)
11   -DIDHIVPQS-FITDNS-IDNLVLTSSAGN    (SEQ ID NO:264)
10   -DVDHIVPQS-FLKDDS-IDNKVLTRSDKN    (SEQ ID NO:265)
14   -NIDHIYPQS-MVKDDS-LDNKVLVQSEIN    (SEQ ID NO:266)
18   -DIDHILPQS-LIKDDS-LDNRVLVNATIN    (SEQ ID NO:267)
19   -DIDHILPQS-PIKDDS-LENRVLVKKAVN    (SEQ ID NO:268)
13   -EVDHIFPRS-FIKDDS-IDNKVLVIKKMN    (SEQ ID NO:269)
15   -EVDHIIPRS-YIKDDS-FENKVLVYREEN    (SEQ ID NO:270)
17   -DIDHIIPQA-VTQNDS-IDNRVLVARAEN    (SEQ ID NO:271)
21   -DIDHIVPRS-ISFDDS-FSNLVTVNKLDN    (SEQ ID NO:272)
22   -EIDHIIPYS-ISFDDS-SSNKLLVLAESN    (SEQ ID NO:273)
24   -EIDHIIPYS-LCFDDS-SANKVLVHKQSN    (SEQ ID NO:274)
28   -EIDHIIPIS-ISLDDS-INNKVLVLSKAN    (SEQ ID NO:275)
20   -EVDHIIPIS-ISLDDS-ITNKVLVTHREN    (SEQ ID NO:276)
27   -EVDHILPLS-ITFDDS-LANKVLVYATAN    (SEQ ID NO:277)
26   -EIDHIIPRS-ISFDDA-RSNKVLVYRSEN    (SEQ ID NO:278)
29   -EVDHIIPRS-VSFDNS-YHNKVLVKQSEN    (SEQ ID NO:279)
31   -EVDHIIPYS-ISWDDS-YTNKVLTSAKCN    (SEQ ID NO:280)
32   -DIDHIIPYS-RSMDDS-YSNKVLVLSGEN    (SEQ ID NO:281)
23   -EIEHIIPYS-MSYDNS-QANKILTEKAEN    (SEQ ID NO:282)
33   -EVDHIVPYS-LILDNT-INNKALVYAEEN    (SEQ ID NO:283)
25   -EIDHIIPYS-KSADDS-WFNKLLVKKSTN    (SEQ ID NO:284)
49   -EMDHILPYS-RSLDNG-WHMRVLVHGKDN    (SEQ ID NO:285)
42   -EIEHVIPQS-LYFDDS-FSNKVICEAEVN    (SEQ ID NO:286)
43   -DIEHIIPQA-RLFDDS-FSNKTLEARSVN    (SEQ ID NO:287)
```

Fig. 6A

| | | |
|---|---|---|
| 44 | -EIEHIVPKA-RVFDDS-FSNKTLTFHRIN | (SEQ ID NO:288) |
| 20 | :DKDHIIPQS-MKKDDSIINNLVLVNKNAN | (SEQ ID NO:289) |
| 45 | -QVDHILPWS-RFGDDS-YLNKTLCTARSN | (SEQ ID NO:290) |
| 50 | -DIDHVIPLA-RGGRDS-LDNMVLCQSDAN | (SEQ ID NO:291) |
| 46 | -DMEHTIPKS-ISFDNS-DQNLTLCESYYN | (SEQ ID NO:292) |
| 47 | -DIEHTIPRS-AGGDST-KMNLTLCSSRPN | (SEQ ID NO:293) |
| 48 | -DIEHTIPRS-ISQDNS-QMNIKTLCSLKFN | (SEQ ID NO:294) |
| 39 | -DIEHLFPIA-ESEDNG-RNNLVISHSACN | (SEQ ID NO:295) |
| 41 | ··DVDHIFPRD-DTADNS-YGNIKVVAHRQCN | (SEQ ID NO:296) |
| 40 | -DIEHIVPQS-LGGLST-DYNTIVTLKSVN | (SEQ ID NO:297) |
| 35 | -ELDHIVPRT-DGGSNR-HENLAITCGACN | (SEQ ID NO:298) |
| 36 | -EMDHIVPRKGVGSTNT-RTNFAAVCAECN | (SEQ ID NO:299) |
| 37 | -EMDHIVPRKGVGSTNT-RVNLAAACAACN | (SEQ ID NO:300) |
| 38 | -EMDHIVPRAGQGSTNT-RENLVAVCHRCN | (SEQ ID NO:301) |
| 34 | -ELEHIVPHS-FRQSNA-LSSLVLTWPGVN | (SEQ ID NO:302) |
| | * * *: . | |

Fig. 6B

Sequence alignment between SpCas9 and NmCas9

```
                                                              Y
NmCas9    MAAFKPNSINYILGL DIGIASVGWAMV EIDEEENPIRLID------------LGVRVFE
SpCas9    -------MDKKYSIGL DIGTNSVGWAVI TDEYKVPSKKFKVLGNTDRHSIKKNLIGALLFD
          ----------*Y-*GL DIG--SVGWA** -*--*-----**---------------*G---*F*

NmCas9    RAEVPKTGDSLAMARRLARSVRRLTRRAHRLLRTRRLLKREGVLQAA-------------
SpCas9    SGET-------AEATRLKRTARRRYTRRKNRICYLQEIFSNEMAKVDDSFFHRLEESFLV
          --E--------A-A-RL-R*-RR---RR--R*----*--**--E----------------

NmCas9    ---------------NFDENGLIKSLPNTPWQLRAAALDRK---LTPLEWSAVLLHLIKHR
SpCas9    EEDKKHERHPIFGNIVDEVAYHEKYP-TIYHLRKKLVDSTDKADLRLI-YLALAHMIKFR
          ---------------DE----*---P-T **LR----*D---------L-----L-H*IK-R

NmCas9    GYLSQRKNE----------------------------GETA---------DKEL----
SpCas9    GHFLIEGDLNPDNSDVDKLFIQLVQTYNQLFEENPINASGVDAKAILSARLSKSRRLENL
          G**----*---------------------G---A-----------*--L---

NmCas9    -----GALLKGVAGNAHALQTG---DFRTPAE------LAL--NKFEKESGHIRNQ-RSD
SpCas9    IAQLPGEKKNGLFGNLIALSLGLTPNFKSNFDLAEDAKLQLSKDTYDDDLDNLLAQIGDQ
          ------G---*G*-GN--AL--G----*F**--*--L-L--*--**--*---Q---*

NmCas9    YSHTFSR-------------------------------------------KDLQA
SpCas9    YADLFLAAKNLSDAILLSDILRVNTEITKAPLSASMIKRYDEHHQDLTLLKALVRQQLPE
          Y*--F-----------------------------------------**L--

NmCas9    ELILLFEKQKEFGN-PHVSGGLK---------------EGIETL---------LMTQRPA
SpCas9    KYKEIFFDQSKNGYAGYIDGGASQEEFYKFIKPILEKMDGTEELLVKLNREDLLRKQRTF
          *----*F--Q-*-G---**--GG-----------*G-E-L-------L---QR--

NmCas9    LSGDAV-QKMLGH---------CTFEPAEP-------------KAAKNTYTAERFIWL
SpCas9    DNGSIPHQIHLGELHAILRRQEDFYPFLKDNREKIEKILTFRIPYYVGPLARGNSRFAWM
          --G----Q---LG-----------F-P---------------*----RF-W*

NmCas9    TKLNNLRILEQGSERPLTD--------TERATLMDEPY------RKSKLTYAQAR------
SpCas9    TRKSEETITPWNFEEVVDKGASAQSFIERMTNFDKNLPNEKVLPKHSLLYEYFTVYNELT
          T*--**--I-----E---*--------ER-T-*D*--------K--L-Y---------

NmCas9    ----KLLGLEDTAPFKGLRY-------GKDN------------------AEA
SpCas9    KVKYVTEGMRKPAPLSGEQKKAIVDLLFKTNRKVTVKQLKEDYFKKIECFDSVEISGVED
          -------G*---AF*-G-*-----------*---------------------E-

NmCas9    STLMEMKAYHAISRALEKEGLKDKKSPLNLSPELQDEIGTAFSLFKTDEDITGRLKDRIQ
SpCas9    RFNASLGTYHDLLKIIKDKDFLDNEE----NEDILEDIVLTLTLFEDREMIEERLKTYAH
          ---*-*-YH-*-*-*-*-D**-------*-I---*LF*--E-I--RLK---*

NmCas9    P--EILEALLKHISFDKFVQISLKALRRIVPLMEQGKRYDEACAE----IYGDHYGKKNT
SpCas9    LFDDKVMKQLKRRYTGWGRLSRKLI--------NGIRDKQSGKTILDFLKSDGFANRNF
          ---*-*---LK*---*--*-**S-K-*--------*G-R--**-------*--D-*-**N-

NmCas9    EEKI------Y-----------LPPIPADEIRNPVVLRALSQARKVINGVVRRYG-
SpCas9    MQLIHDDSLTFKEDIQKAQVSGQGDSLHEHIANLAGSPAIKKGILQTVKVVDELVKVMGR
          -*-I---------------L-----A*---P-*-*-*-Q*-KV**-*V*---G-

NmCas9    -SPAR HIETARE VGKSFKDRKEIEKRQEENRKDREKAAAKFREYFPNF----VGEPKSK
SpCas9    HKPEN IVIEMAREN QTTQKGQKNSRER-------MKRIEEGIKELGSQILKEHPVENTQL
          --P-- E-IE-ARE ---*-K-*K*---R----------E-----------E----
        B↓                                       G↓
NmCas9    DILKLRLYEQQHGKCLYSGKEINLGRLNEKGY VSIDHALPFSRTWDDSFNNKVLVLGSEN
SpCas9    QNEKLYLYYLQNGRDMYVDQELDINRLSD---V DVDHIVPQSFLKDDSIDNKVLTRSDKN
          *--KL--LY--Q-G--*-Y--*E*** RL-*---- **DH-*P-S---DDS**NKVL-----*N

NmCas9    QNKGNQTPYEYFNGKDNSREWQEFKA-RVET-SRFP-ESKKQRILLQKFDEDGFKERNLN
SpCas9    RGKSDNVPSEEVVKKM-KNYWRQLLNAKLITQRKFDNLTKAERGGLSELDKAGFIKRQLV
          * K--P-E----K------W*---**-T--*F----*K-*R--L-**D*-GF-*R*L-
```

Fig. 7A

```
NmCas9  DTRYVNRFLCQFVADRMRLTGKGKKRVF------ASNGQITNLLRGFWGLRKVRAENDRH
SpCas9  ETRQITKHVAQILDSRMNTKYDENDKLIREVKVITLKSKLVSDFRKDFQFYKVREINNYH
        *TR-*-*-*-Q**--RM------*-***------*-*-**---*R---*-*-KVR--N*-H

NmCas9     HALDAVVVACSTVAMQQKI---TRFVRYKEMNAFDGKTID----KETGEVLHQKTHFPQP
SpCas9   B HAHDAYLNAVVGTALIKKYPKLESEFVYGDYKVYDVRKMIAKSEQEIGKATAKYFFYSNI
           HH-AD-*-A----A*-*K---------Y-*-*-*D-*-*------*E-G*---*---*-

NmCas9  MEFFAQEVMIRVFGKPDGKPE-----------FEEADTLEKLRTLLAEKLSSRPEAVHEY
SpCas9  MNFFKTEITLA-NGEIRKRPLIETNGETGEIVWDKGRDFATVRKVLS-----MPQ-----
        -*FF--E*-*---G*----*P--------***---*---R-*L*------P*-----

NmCas9  VTPLFVSRAPNRKMSGQGHMETVKSAKRLDEGVSVLRVPLTQLKLKDLEKMVN--REREP
SpCas9  -------------------VNIVKKTEVQTGGFSKES----ILPKRNSDKLIARKKDWDP
                           -VK------G-S--------L--**-*K----*P

NmCas9  KLYEALKARLEAHKDDPAKAFAEPFYKYDKAGNRTQQVKAVR---VEQVQKTGVWVRNH-
SpCas9  KKYGGFD-------SPTVAYSVLVVAKVEKGK-SKKLKSVKELLGITIMERSSFEKNPI
        K-Y--*---------P*-A**--------*-G*-****K*V*------*-*---*-*N--

NmCas9  -----NGIAD-----------------NATMVRVDVFEKGDKYYLVPIY--------
SpCas9  DFLEAKGYKEVKKDLIIKLPKYSLFELENGRKRMLASAGELQKGNELALPSKYVNFLYLA
        -----*G---*-----------------KG---L---Y--------

NmCas9  -SWQVAKGILPDRAVVQGKDEEDWQLIDDS------FNFKFSLHPNDLVEVI---------
SpCas9  SHYEKLKGSPEDNEQKQLPVEQHKHYLDEIIEQISEPSKRVILADANLDKVLSAYNKHRD
        --**--KG---D----Q---E*--*-*D*-------F-*--L----*L-*V*---------

NmCas9  -------------------TKKARMFGYFASCHRGTGNINIRIHDLDHKIGKNGILEGIGV
SpCas9  KPIREQAENIIHLFTLTNLGAPAAFKYFDTTIDRKRYTS-TKEVLDATLIHQSI------
        -------------------F-YF-*---------------LD--*-***-I-------

NmCas9  KTALSFQKYQIDELGKEIRPCRLKKRPPVR    (SEQ ID NO:6)
SpCas9  -TGLYETRIDLSQLGGD-------------    (SEQ ID NO:7)
        -T-L---*-*-**-*LG-*-----------
```

Percent Identity Matrix - created by Clustal2.1

Fig. 7B

Sequence of the NmCas9 ORF with dual NLS and HA tags

```
atg[gtgcctaagaagaagagaaaggtg]ctgccttcaaacctaattcaatcaactacatcctcggcctcgat
atcggcatcgcatccgtccgctgggcgatggtagaaattgacgaagaagaaaaccccatccgctgattgat
tgggcgtgcgcgtatttgagcgtgccgaagtaccgaaaacaggcgactcccttgccatggcaaggcgtttg
gcgcgcagtgttcgccgctgaccgcgtcgcgccacgcctgcttcggaccgccgcctattgaaacgc
gaaggcgtattacaagccgccaattttgacgaaaacggcttgattaaatccttaccgaatacaccatggcaa
cttcgcgcagccgcattagaccgcaaactgacgcctttagagtggtcggcagtcttgttgcatttaatcaaa
catcgcggctatttatcgcaacggaaaaacgagggcgaaactgccgataaggagcttggcgctttgcttaaa
ggcgtagccggcaatgcccatgccttacagacaggcgatttccgcacaccggccgaattggctttaaataaa
tttgagaaagaaagcggccatatccgcaatcagcgcagcgattattcgcatacgttcagccgcaaagattta
caggcggagctgattttgctgtttgaaaaacaaaaagaatttggcaatccgcatgtttcaggcggccttaaa
gaaggtattgaaaccctactgatgacgcaacgcctgccctgtccggcgatgccgtcaaaaaatgttgggg
cattgcaccttcgaaccggcagagccgaaagccgctaaaaacacctacacagccgaacgtttcatctggctg
accaagctgaacaacctgcgtatttagagcaaggcagcgagcggccattgaccgataccgaacgcgccacg
cttatggacgagccatacagaaaatccaaactgacttacgcacaagcccgtaagctgctgggtttagaagat
accgcctttttcaaaggcttgcgctatggtaaagacaatgccgaagcctcaacattgatggaaatgaaggcc
taccatgccatcagccgtgcactggaaaaagaaggattgaaagacaaaaaatccccattaaacctttctccc
gaattacaagacgaaatccggcacggcattctccctgttcaaaaccgatgaagacattacaggccgtctgaaa
gaccgtatacagcccgaaatcttagaagcgctgttgaaacacatcagcttcgataagttcgtccaaatttcc
ttgaaagcattgcgccgaattgtgcctctaatggaacaaggcaaacgttacgatgaagcctgccgaaatc
tacggagaccattacggcaagaagaatacggaagaaaagatttatctgccgccgattcccgccgacgaaatc
cgcaacccgtcgtcttgcgcgccttatctcaagcacgtaaggtcattaacggcgtggtaccgccgttacggc
tccccagctcgtatccatattgaaactgcaagggaagtaggtaaatcgtttaaagaccgcaaagaaattgag
aaacgccaagaagaaaaccgcaagaccgggaaaaagccgccgccaaattccgagagtatttcccaattttt
gtcggagaacccaaatccaaagatattctgaaactgcgcctgtacgagcaacaacacggcaaatgcctgtat
tcgggcaaagaaatcaacttaggccgtctgaacgaaaaagctatgtcgaaatcgaccatgccctgccgttc
tcgcgcacatgggacgacagtttcaacaataaagtactggtattgggcagcgaaaaccaaaacaaaggcaat
caaaccccttacgaatacttcaacggcaaagacaacagccgcgaatggcaggaatttaaagcgcgtgtcgaa
accagccgtttcccgcgcagtaaaaaacaacggattctgctgcaaaaattcgatgaagacggctttaaagaa
cgcaatctgaacgacacgcgctacgtcaaccgtttcctgtgtcaatttgttgccgaccgtatgcggctgaca
ggtaaaggcaagaaacgtgtctttgcatccaacggacaaattaccaatctgttgcgcggcttttggggattg
cgcaaagtgcgtgcggaaaacgaccgccatcacgccttggacgccgtcgtcgttgcctgctcgaccgttgcc
atgcagcagaaaattacccgttttgtacgctataaagagatgaacgcgtttgacggtaaaaccatagacaaa
gaaacaggagaagtgctgcatcaaaaaacacacttcccacaaccttgggaattttcgcacaagaagtcatg
attcgcgtcttcggcaaaccggacggcaaacccgaattcgaagaagccgataccctagaaaaactgcgcacg
ttgcttgccgaaaaattatcatctcgccccgaagccgtacacgaatacgttacgccactgtttgtttcacgc
gcgcccaatcggaagatgagcgggcaagggcatatggagaccgtcaaatccgccaaacgactggacgaaggc
gtcagcgtgttgcgcgtaccgctgacacagttaaaactgaaagacttggaaaaaatggtcaatcgggagcgc
gaacctaagctatacgaagcactgaaagcacggctggaagcacataagacgatcctgccaaagcctttgcc
gagccgttttacaaataccataaagcaggcaaccgcacccaacaggtaaaagccgtacgcgtagagcaagta
cagaaaaccggcgtatggctgcgcaaccataacgtattgccgacaacgcaaccatggtgcgcgtagatgtg
tttgagaaaggcgacaagtattatctggtaccgatttacagttggcaggtagcgaaagggatttgccggat
agggctgttgtacaaggaaaagatgaagaagattggcaacttattgatgatagtttcaactttaaattctca
ttacaccctaatgatttagtcgaggttataacaaaaaagctagaatgtttggttactttgccagctgccat
cgaggcacaggtaatatcaatatacgcattcatgatcttgatcataaaattggcaaaaatgaatactggaa
ggtatcggcgtcaaaaccgcccttcattccaaaaataccaaattgacgaactgggcaaagaaatcagacca
tgccgtctgaaaaaacgccgcctgtcgt[tacccatacgatgttccagattacgct][gcagctccagcagcg
aagaaaaagaagctggattaa]                                              (SEQ ID NO:303)
```

R: SV40 NLS, G: HA tag, O: synthetic NLS (1); all else NmCas9

Fig. 8

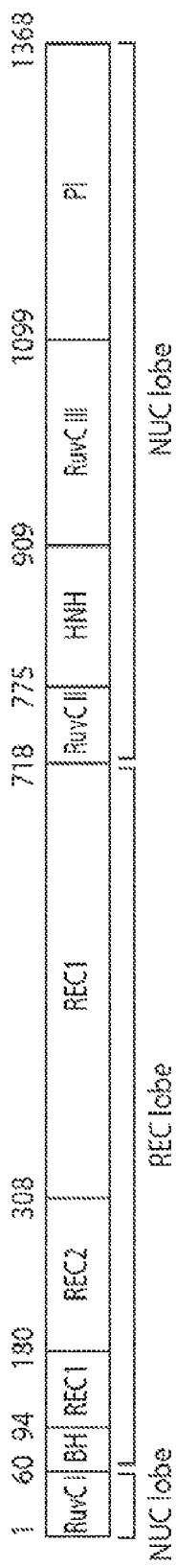
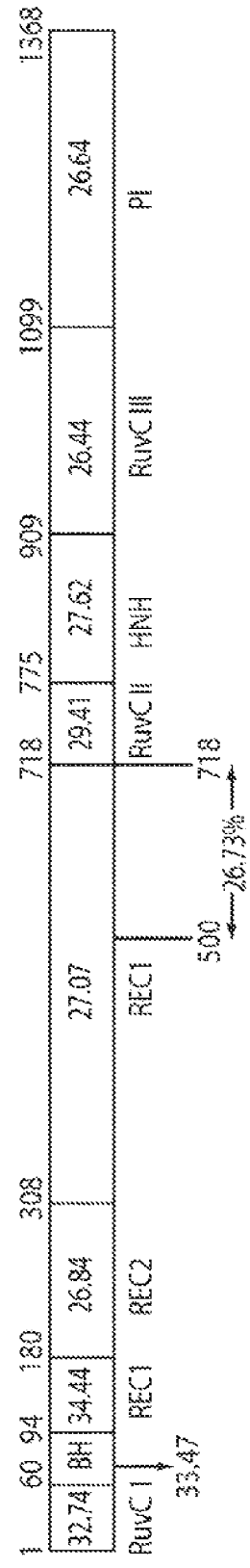
Fig. 9A
Fig. 9B

CRISPR/CAS-RELATED METHODS AND COMPOSITIONS FOR TREATING CYSTIC FIBROSIS

REFERENCE TO RELATED APPLICATIONS

This application is a continuation of PCT International Patent Application No. PCT/US2015/023960, filed on Apr. 1, 2015, which claims the benefit of U.S. Provisional Application No. 61/977,488, filed Apr. 9, 2014, the contents of each of which are hereby incorporated by reference in their entirety herein, and to each of which priority is claimed.

SEQUENCE LISTING

The specification further incorporates by reference the Sequence Listing submitted herewith via EFS on Oct. 7, 2016. Pursuant to 37 C.F.R. § 1.52(e)(5), the Sequence Listing text file, identified as 084177.0104USSEQ.txt, is 6,269,299 bytes and was created on Oct. 7, 2016. The Sequence Listing, electronically filed herewith, does not extend beyond the scope of the specification and thus does not contain new matter.

FIELD OF THE INVENTION

The invention relates to CRISPR/CAS-related methods and components for editing of a target nucleic acid sequence, and applications thereof in connection with Cystic Fibrosis (CF) or CF-like disease.

BACKGROUND

Cystic fibrosis (CF) is an autosomal recessive, hereditary disease caused by defects in the cystic fibrosis transmembrane conductance regulator (CFTR) gene. The CFTR gene encodes a cAMP-gated channel that is involved in chloride and bicarbonate transport. It regulates sodium transport through inhibition of the epithelial sodium channel, which is encoded by the SCNN1A gene. CFTR is expressed on the apical surface of epithelial cells in the airway, gastrointestinal tract, reproductive tract, sweat glands and submucosal glands.

CF affects one in 3,500 children born in the United States. It is the most common fatal autosomal recessive disease in individuals of European descent (Tobias 2011; *Essential Medical Genetics*, John Wiley & Sons, ed. p. 312). There are approximately 30,000 subjects in the United States with the disease (From The Cystic Fibrosis Foundation; cff.org, accessed on Mar. 19, 2015).

The most common mutation in the CFTR gene is a deletion of the three nucleotides encoding Phenylalanine (F) at position 508 of the CFTR protein (also sometime referred to herein as "F508del"). This mutation is the causative mutation in approximately two-thirds of CF cases. The remaining cases are caused by at least 1000 different mutations, many of which cause a less severe form of the disease.

Subjects having CF can present at birth or in early infancy with pancreatic insufficiency. Pancreatic dysfunction leads to malabsorption of fat and fat-soluble vitamins, which causes poor growth as well as gallstones and biliary disease. The lung manifestations of the disease can be more severe but may present slightly after pancreatic manifestations, in infancy or early childhood. Aberrant chloride and sodium transport due to decreased CFTR activity causes lowered apical surface fluid levels in the lungs, which leads to "sticky" mucous and lower airway obstruction. Subjects having CF or CF-like disease suffer from frequent infections due to inability to clear mucous. Local inflammatory mediators try to clear the infection but have difficulty. The triad of inflammation, infection and obstruction leads to progressive destruction of the lung parenchyma. Eventually, many subjects having CF or CF-like disease die in their late 30's due to respiratory failure.

Current treatments for CF or CF-like disease delay lung destruction and slow disease progression. Treatments for the pulmonary manifestations of CF or CF-like disease include: antibiotics (oral, inhaled and intravenous), CFTR modulators (including CFTR potentiators), DNase, chest physiotherapy to loosen secretions and anti-inflammatory therapeutics. Treatment of the gastrointestinal manifestations includes supplemental gut soluble vitamins, high calorie diet and oral pancreatic enzymes. Subjects who develop diabetes are treated with insulin injections or an insulin pump. At the end stage, patients may benefit from lung transplant. Lung transplant may be combined with liver and/or pancreatic transplant.

Current treatments do not reverse the damage to the lungs or cure CF or CF-like disease. The average life expectancy for subjects having CF or CF-like disease is 37 years of age (MacKenzie et al., 2014; Annals of Internal Medicine 161 (4):233-41). 80% of patients with CF or CF-like disease die from end-stage lung disease.

In spite of current therapies, there is a need for a therapy that prevents or delays the progression of disease in CF or CF-like disease.

SUMMARY OF THE INVENTION

Methods and compositions discussed herein provide for the treatment and prevention of Cystic Fibrosis (CF) and CF-like disease. The approach described herein aims to restore CFTR channel function, restore chloride, bicarbonate and/or sodium balance, and/or decrease mucous viscosity within the lungs, airways, gastrointestinal tract and reproductive tract.

CFTR modulators (both approved and in development) improve the functioning of mutant CFTR. These therapeutics improve CFTR functioning but do not return functionality to wild type levels. The approach described herein is expected to restore CFTR function through complete correction of the gene.

Gene therapy approaches are in development that deliver the CFTR channel gene to the lungs of CF or CF-like disease patients. However, gene therapy may require constant readministration over the course of the lifetime of a subject due to high cell turnover in target epithelial cells. The approach described herein is expected to restore CFTR function and/or ameliorate SCNN1A disinhibition permanently through one, two or several doses.

The CFTR gene encodes a 180-kDA cAMP-gated chloride (Cl—) channel. The channel has six transmembrane spanning domains and is expressed by epithelial cells, lymphocytes and cardiac myocytes. The CFTR regulates the viscosity of mucous through its activity in the epithelial cells of the lungs, gastrointestinal tract and reproductive tract. Mutations in the CFTR result in decreased CFTR activity. Decreased CFTR activity can lead to aberrant ion transport, which gives rise to various disease symptoms in the lungs and other tissues, such as accumulation of sticky mucus, airway obstruction, infection and inflammation. Correction of CFTR mutations will ameliorate or cure lung, gastrointestinal and/or reproductive symptoms of CF or CF-like disease.

The SCNN1A gene encodes the alpha subunit of the epithelial sodium channel (ENaC). The channel, comprised of alpha, beta and gamma subunits, regulates sodium transport into epithelial cells, including the epithelium of the lungs, sweat glands and kidneys. Mutations in the SCNN1A gene, (e.g. Val114ILE) have been shown to cause CF-like disease, characterized by pulmonary disease, including bronchiectasis. Mutations in SCNN1A also cause pseudo-hypoaldosteronism, a severe disease of the kidney. Pseudo-hypoaldosteronism is due to defective sodium transport within kidney epithelial cells; it is not caused by defective sodium transport in other tissues. The methods described herein include the targeted knockout of SCNN1A in the lung, gastrointestinal tract and/or reproductive tract. The methods described herein will not target kidney epithelium and will avoid the negative consequences of SCNN1A mutations within the kidney epithelium. One mutation in the SCNN1A gene, a 1477T>G substitution (W493R) has been identified in subjects who also have a mutation in CFTR. This mutation is associated with a severe CF or CF-like disease phenotype, including severe bronchiectasis, chronic bronchitis and/or severe gastrointestinal symptoms. This mutation has been found to be associated with 4-fold overactivity of the ENaC channel (Azad et al., 2009; Human Mutation 30: 1093-1103). Overactivity of the SCNN1A-encoded ENaC channel can contribute to CF and CF-like disease. In all subjects, the CFTR is involved in inhibition of ENaC. CFTR mutations in subjects with CF or CF-like disease leads to ENaC disinhibition, leading to overactivity of the ENaC channel. ENaC overactivity can lead to further reduction in viscosity of mucous in CF or CF-like disease subjects, as more sodium is absorbed at the apical surface of epithelial cells, followed by increased fluid absorption from the mucous layer within the lung (Baker et al., 2012; Medicine & Science in Sports and Exercise 44(12): 2315-2321). Increased fluid absorption from the mucous layer reduces mucous viscosity. Inhibition of ENaC through SCNN1A knockout and/or knockdown in subjects with CF or CF-like disease can ameliorate the symptoms of CF or CF-like disease. Mutations in the CFTR gene (also known as ABC35, ATP-binding cassette sub-family C, member 7, CFTR/MRP, dJ76C5.1, MRP7 and TNR-CFTR) have been shown to cause CF and/or CF-like disease. Mutations in the CFTR gene leading to CF and/or CF-like disease can be described based on their target position in the CFTR protein. In an embodiment, the target position is F508, e.g., F508del (also sometimes referred to herein as "ΔF508"), in the CFTR protein, which corresponds to a deletion of three nucleotides c.1521_1523delCTT in the CFTR gene (e.g., c.1521_1523delCTT (p.Phe508delPhe)). In an embodiment, the target position is G551, e.g., G551D, in the CFTR protein, which corresponds to c.1652G>A in the CFTR gene. In an embodiment, the target position is G542, e.g., G542X, in the CFTR protein, which corresponds to c.1624G>T in the CFTR gene. In an embodiment, the target position is N1303, e.g., N1303K, in the CFTR protein, which corresponds to c.3909C>G in the CFTR gene. In an embodiment, the target position is R117, e.g., R117H, in the CFTR protein, which corresponds to c.350G>A in the CFTR gene. In an embodiment, the target position is W1282, e.g., W1282X, in the CFTR protein, which corresponds to c. c.3846G>A in the CFTR gene. In an embodiment, the target position is R553, e.g., R553X, in the CFTR protein, which corresponds to c.1657C>T in the CFTR gene. In an embodiment, the target position is c.3717+12191, also known as c.3849+10 kb, which corresponds to 3717+12191C>T in the CFTR gene. In an embodiment, the target position is c.2657+5, also known as c.2789+5, which corresponds to 2657+5G>A in the CFTR gene. In an embodiment, the target position is c.3140-26, also known as c.3272-26, which corresponds to c.3140-26A>G in the CFTR gene.

Overactivity of the SCNN1A gene has been shown to contribute to bronchiectasis, bronchitis, and gastrointestinal symptoms in subjects with CF and in subjects with CF-like disease. In another aspect, methods and compositions discussed herein may be used to alter the SCNN1A gene (also known as sodium channel, non-voltage-gated 1 alpha subunit; amiloride-sensitive epithelial sodium channel alpha subunit; BESC2; ENaCa; SCNEA; SCNN1; ENaCalpha) to treat or prevent CF or CF-like disease, by targeting the SCNN1A gene, e.g., the non-coding or coding regions, e.g., a promoter region, or a transcribed sequence, e.g., intronic or exonic sequence. In an embodiment, the target position is V114, which corresponds to V114I in the SCNN1A gene. SCNN1A encodes an epithelial sodium channel, ENaC, that is negatively regulated by CFTR. In subjects with CFTR mutations, knocking out or knocking down the SCNN1A gene in certain cells will reduce or reverse the effect of defective CFTR. In subjects with no CFTR mutations but CF-like disease caused by SCNN1A mutations or other mechanisms, knocking out or knocking down the SCNN1A gene in certain cells will improve the viscosity of mucous and ameliorate disease.

Methods and compositions disclosed herein provide a number of approaches for treating or preventing CF and/or CF-like disease. As is discussed in more detail below, methods described herein provide for treating or preventing CF or CF-like disease by correcting a target position in the CFTR gene to provide corrected, or functional, e.g., wild type, CFTR. Other methods described herein allow for treating or preventing CF or CF-like disease by inducing or introducing a mutation that reduces the level of functional SCNN1A gene product.

In one aspect, methods and compositions discussed herein, provide for the correction of the underlying cause of CF or CF-like disease, e.g., the correction of a mutation at a target position in the CFTR gene, e.g., correction of a mutation in the CFTR gene that corresponds to amino acid position 508, e.g., an F508 deletion (F508del), in CFTR protein.

"CF target mutant position", as used herein, refers to a target position in the CFTR gene, which, if mutated, can result in a mutant protein and give rise to CF or CF-like disease. In an embodiment, the target position comprises one, two, or three nucleotides. In an embodiment, the CF target mutant position is a position in the CFTR gene at which a change can give rise to a mutant protein having a mutation at F508, e.g., F508del. In an embodiment, the CF target mutant position is a position in the CFTR gene at which a change can give rise to a mutant protein having a mutation at G551, e.g., G551D. In an embodiment, the CF target mutant position is a position in the CFTR gene at which a change can give rise to a mutant protein having a mutation at G542, e.g., G542X, in the CFTR protein, which corresponds to c.1624G>T in the CFTR gene. In an embodiment, the CF target mutant position is a position in the CFTR gene at which a change can give rise to a mutant protein having a mutation at N1303, e.g., N1303K, in the CFTR protein, which corresponds to c.3909C>G in the CFTR gene. In an embodiment, the CF target mutant position is a position in the CFTR gene at which a change can give rise to a mutant protein having a mutation at R117, e.g., R117H, in the CFTR protein, which corresponds to c.350G>A in the CFTR gene. In an embodiment, the CF target mutant position is a position in the CFTR gene at which a change can give rise to a mutant protein having a mutation at W1282, e.g., W1282X, in the CFTR protein, which corresponds to c. c.3846G>A in the CFTR gene. In an embodiment, the CF target mutant position is a position in the CFTR gene at which a change can give rise to a mutant protein having a mutation at R553, e.g., R553X, in the CFTR protein, which corresponds to c.1657C>T in the CFTR gene. In an embodiment, the CF target mutant position is c.3717+12191, also known as c.3849+10 kb, which corresponds to 3717+12191C>T in the CFTR gene. In an embodiment, the CF target mutant position is c.2657+5, also known as c.2789+5, which corresponds to 2657+5G>A in the CFTR gene. In an embodiment, the CF target mutant position is c.3140-26, also known as c.3272-26, which corresponds to c.3140-26A>G in the CFTR gene. In an embodiment, the CF target mutant position is a position in the SCNN1A gene at which a change can give rise to a mutant protein having a mutation at V114, which corresponds to V114I in the SCNN1A gene.

While some of the disclosure herein is presented in the context of the mutation in the CFTR gene that gives rise to an F508 mutant protein (e.g., a F508del mutant protein), a G551 mutant protein (e.g., a G551D mutant protein), a G542 mutant protein (e.g., G542X mutant protein), a N1303 mutant protein (e.g., a N1303K mutant protein), a R117 mutant protein (e.g., an R117H mutant protein), a W1282 mutant protein (e.g., a W1282X mutant protein), an R553 mutant protein (e.g., an R553X mutant protein), a c.2789+5 bp intronic mutant (e.g., a c.2789+5 bp G>A mutant), or a c.3272-26 bp intronic mutant (e.g., a c.3272-26 bp A>G mutant), the methods and compositions herein are broadly applicable to any mutation, e.g., a point mutation or a deletion, in the CFTR gene that gives rise to CF or CF-like disease.

While not wishing to be bound by theory, it is believed that, in an embodiment, a mutation at a CF target mutant position is corrected by homology directed repair (HDR), as described herein.

In another aspect, methods and compositions discussed herein may be used to alter the SCNN1A gene (also known as sodium channel, non-voltage-gated 1 alpha subunit) to treat or prevent CF or CF-like disease, by targeting the SCNN1A gene, e.g., the non-coding or coding regions, e.g., a promoter region, or a transcribed sequence, e.g., intronic or exonic sequence. SCNN1A encodes an epithelial sodium channel that is negatively regulated by CFTR. By knocking out the SCNN1A gene in certain cells, the effect of defective CFTR can be reduced or reversed.

In another aspect, the methods and compositions discussed herein may be used to alter the SCNN1A gene to treat or prevent CF or CF-like disease by targeting the coding sequence of the SCNN1A gene. In one embodiment, the gene, e.g., the coding sequence of the SCNN1A gene, is targeted to knockout the gene, e.g., to eliminate expression of the gene, e.g., to knockout one or both alleles of the SCNN1A gene, e.g., by induction of an alteration comprising a deletion or mutation in the SCNN1A gene. In an embodiment, the method provides an alteration that comprises an insertion or deletion.

In an embodiment, coding region, e.g., an early coding region, of the SCNN1A gene, is targeted for alteration and knockout. In one embodiment, an early coding region of the SCNN1A gene is targeted to knockout the SCNN1A gene. In an embodiment, targeting affects both alleles of the SCNN1A gene. In an embodiment, targeting affects one allele of the SCNN1A gene. In an embodiment, a targeted knockout approach reduces or eliminates expression of functional SCNN1A gene product. In an embodiment, the method provides an alteration in the SCNN1A gene that comprises an insertion or deletion.

In another aspect, the methods and compositions discussed herein may be used to alter the SCNN1A gene to treat or prevent CF or CF-like disease by targeting non-coding sequence of the SCNN1A gene, e.g., promoter, an enhancer, an intron, 3'UTR, and/or polyadenylation signal. In an embodiment, the gene, e.g., the non-coding sequence of the SCNN1A gene, is targeted to knockout the gene, e.g., to eliminate expression of the gene, e.g., to knockout one or both alleles of the SCNN1A gene, e.g., by induction of an alteration comprising a deletion or mutation in the SCNN1A gene. In an embodiment, the method provides an alteration that comprises an insertion or deletion.

As described herein, in an embodiment, a targeted knockout approach is mediated by non-homologous end joining (NHEJ) using a CRISPR/Cas system comprising an enzymatically active Cas9 (eaCas9).

"CF target knockout position", as used herein, refers to a position in the SCNN1A gene, which if altered by NHEJ-mediated alteration, results in alleviation of a symptom of CF or CF-like disease. In an embodiment, the alteration results in reduction or elimination of expression of functional SCNN1A gene product. In an embodiment, the position is in the SCNN1A coding region, e.g., an early coding region.

In an embodiment, the promoter region of the SCNN1A gene is targeted to knock down the expression of the SCNN1A gene. This type of alteration is also sometimes referred to as "knocking down" the SCNN1A gene. While not wishing to be bound by theory, in an embodiment, a targeted knockdown approach is mediated by a CRISPR/Cas system comprising a Cas9 molecule, e.g., an enzymatically inactive Cas9 (eiCas9) molecule or an eiCas9 fusion protein (e.g., an eiCas9 fused to a transcription repressor domain or chromatin modifying protein), as described herein. In an embodiment, the SCNN1A gene is targeted to alter (e.g., to block, reduce, or decrease) the transcription of the SCNN1A gene. In another embodiment, the SCNN1A gene is targeted to alter the chromatin structure (e.g., one or more histone and/or DNA modifications) of the SCNN1A gene. In an embodiment, a CF target knockdown position is targeted by genome editing using the CRISPR/Cas9 system. In an embodiment, one or more gRNA molecules comprising a targeting domain are configured to target an enzymatically inactive Cas9 (eiCas9) or an eiCas9 fusion protein (e.g., an eiCas9 fused to a transcription repressor domain), sufficiently close to a CF target knockdown position to reduce, decrease or repress expression of the SCNN1A gene.

"CF target knockdown position", as used herein, refers to a position in the SCNN1A gene, which if targeted, e.g., by an eiCas9 molecule or an eiCas9 fusion described herein, results in reduction or elimination of expression of functional SCNN1A gene product. In an embodiment, the transcription of the SCNN1A gene is reduced or eliminated. In another embodiment, the chromatin structure of the SCNN1A gene is altered.

"CF target knockin position", as used herein, refers to a sequence, which if modified by the insertion of CFTR sequence, results in an optimization of CFTR activity, e.g., by resulting in a CFTR sequence that encodes a protein having wild type activity. Exemplary CF target knockin position include: CFTR sequence within intron 2, into which, e.g., can be introduced CFTR sequence that codes for CFTR exons 3-27; and sequence within CFTR intron 10, into which sequence that codes for CFTR exons 11-27 can be introduced. In an embodiment, a CF target knockin position includes CFTR intronic sequence between a second and a third exon (e.g., intron 2), and CFTR sequence encoding the third exon through the final exon (exon 27), is introduced, resulting in a CFTR sequence that is free of one or more cryptic splice sites and that encodes a CFTR protein having wild type activity. In an embodiment, a CF target knockin position, is a position which is upstream of a mutation, or upstream of an intron having a mutation, and introduction of wild-type CFTR sequence results in a CFTR sequence that is free of the mutation. In an embodiment the CF target knockin position is in CFTR intronic sequence: between exon2 and exon 3; or between exon10 and exon 11. In an embodiment, the resulting CFTR sequence comprises subject sequence upstream from the CF target knockin position and newly introduced sequence downstream from the CF target knockin position, which taken together, encode a CFTR protein having wild type activity. In an embodiment, the point of insertion is 3' to a splice donor site and 5' from a splice acceptor site. In an embodiment, CFTR sequence encoding exons 3-27 is inserted under control of the promoter, e.g., at the transcription start site. In an embodiment, CFTR sequence introduced can exclude introns, e.g., a sequence encoding exons, but without introns, is inserted, e.g., CFTR CDNA sequence is introduced.

"CF target position", as used herein, refers to a CF target mutant position, CF target knockout position, CF target knockdown position, and/or CF target knockin position, as described herein.

In one aspect, disclosed herein is a gRNA molecule, e.g., an isolated or non-naturally occurring gRNA molecule, comprising a targeting domain which is complementary with a target domain from the CFTR gene or SCNN1A gene.

In an embodiment, the targeting domain of the gRNA molecule is configured to provide a cleavage event, e.g., a double strand break or a single strand break, sufficiently close to a CF target position in the CFTR gene or SCNN1A gene to allow alteration, e.g., alteration associated with, respectively, HDR or NHEJ, of a CF target position in the CFTR gene or SCNN1A gene. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 225, 250, or 300 nucleotides of a CF target position. The break, e.g., a double strand or single strand break, can be positioned upstream or downstream of a CF target position in the CFTR gene or SCNN1A gene.

In an embodiment, a second gRNA molecule comprising a second targeting domain is configured to provide a cleavage event, e.g., a double strand break or a single strand break, sufficiently close to the CF target position in the CFTR gene or SCNN1A gene, to allow alteration, e.g., alteration associated with, respectively, HDR or NHEJ, of the CF target position in the CFTR gene or SCNN1A gene, either alone or in combination with the break positioned by said first gRNA molecule. In an embodiment, the targeting domains of the first and second gRNA molecules are configured such that a cleavage event, e.g., a double strand or single strand break, is positioned, independently for each of the gRNA molecules, within 1, 2, 3, 4, 5, 10, 15, 20, 25, 30, 35, 40, 45, 50, 60, 70, 80, 90, 100, 150, 200, 225, 250, or 300 nucleotides of the target position. In an embodiment, the breaks, e.g., double strand or single strand breaks, are positioned on both sides of a nucleotide of a CF target position in the CFTR gene or SCNN1A gene. In an embodiment, the breaks, e.g., double strand or single strand breaks, are positioned on one side, e.g., upstream or downstream, of a nucleotide of a CF target position in the CFTR gene or SCNN1A gene.

In an embodiment, a single strand break is accompanied by an additional single strand break, positioned by a second gRNA molecule, as discussed below. For example, the targeting domains are configured such that a cleavage event, e.g., the two single strand breaks, are positioned within 1, 2, 3, 4, 5, 10, 15, 20, 25, 30, 35, 40, 45, 50, 60, 70, 80, 90, 100, 150, 200, 225, 250, or 300 nucleotides of a CF target position. In an embodiment, the first and second gRNA molecules are configured such, that when guiding a Cas9 molecule, e.g., a Cas9 nickase, a single strand break will be accompanied by an additional single strand break, positioned by a second gRNA, sufficiently close to one another to result in alteration of a CF target position in the CFTR gene or SCNN1A gene. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 molecule is a nickase. In an embodiment, the two gRNA molecules are configured to position cuts at the same position, or within a few nucleotides of one another, on different strands, e.g., essentially mimicking a double strand break.

In an embodiment, a double strand break can be accompanied by an additional double strand break, positioned by a second gRNA molecule, as is discussed below. For example, the targeting domain of a first gRNA molecule is configured such that a double strand break is positioned upstream of a CF target position in the CFTR gene or SCNN1A gene, e.g., within 1, 2, 3, 4, 5, 10, 15, 20, 25, 30, 35, 40, 45, 50, 60, 70, 80, 90, 100, 150, 200, 225, 250, or 300 nucleotides of the target position; and the targeting domain of a second gRNA molecule is configured such that a double strand break is positioned downstream of a CF target position in the CFTR gene or SCNN1A gene, e.g., within 1, 2, 3, 4, 5, 10, 15, 20, 25, 30, 35, 40, 45, 50, 60, 70, 80, 90, 100, 150, 200, 225, 250, or 300 nucleotides of the target position.

In an embodiment, a double strand break can be accompanied by two additional single strand breaks, positioned by a second gRNA molecule and a third gRNA molecule. For example, the targeting domain of a first gRNA molecule is configured such that a double strand break is positioned upstream of a CF target position in the CFTR gene or SCNN1A gene, e.g., within 1, 2, 3, 4, 5, 10, 15, 20, 25, 30, 35, 40, 45, 50, 60, 70, 80, 90, 100, 150, 200, 225, 250, or 300 nucleotides of the target position; and the targeting domains of a second and third gRNA molecule are configured such that two single strand breaks are positioned downstream of a CF target position in the CFTR gene or SCNN1A gene, e.g., within 1, 2, 3, 4, 5, 10, 15, 20, 25, 30, 35, 40, 45, 50, 60, 70, 80, 90, 100, 150, 200, 225, 250, or 300 nucleotides of the target position. In an embodiment, the targeting domain of the first, second and third gRNA molecules are configured such that a cleavage event, e.g., a double strand or single strand break, is positioned, independently for each of the gRNA molecules.

In an embodiment, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of a CF target position in the CFTR gene or SCNN1A gene, e.g., within 1, 2, 3, 4, 5, 10, 15, 20, 25, 30, 35, 40, 45, 50, 60, 70, 80, 90, 100, 150, 200, 225, 250, or 300 nucleotides of the target position; and the targeting domains of a third and fourth gRNA molecule are configured such that two single strand breaks are positioned downstream of a CF target position in the CFTR gene or SCNN1A gene, e.g., within 1, 2, 3, 4, 5, 10, 15, 20, 25, 30, 35, 40, 45, 50, 60, 70, 80, 90, 100, 150, 200, 225, 250, or 300 nucleotides of the target position.

It is contemplated herein that, in an embodiment, when multiple gRNAs are used to generate (1) two single stranded breaks in close proximity, (2) two double stranded breaks, e.g., flanking a CF target position, e.g., a mutation (e.g., to remove a piece of DNA, e.g., to introduce a deletion mutation) or to create more than one indel in the gene, e.g., in a coding region, e.g., an early coding region, (3) one double stranded break and two paired nicks flanking a CF target position, e.g., a mutation (e.g., to remove a piece of DNA, e.g., to introduce a deletion mutation) or (4) four single stranded breaks, two on each side of a position, e.g., a mutation, that they are targeting the same CF target position. It is further contemplated herein that multiple gRNAs may be used to target more than one CF target position (e.g., mutation) in the same gene.

In an embodiment, the targeting domain of the first gRNA molecule and the targeting domain of the second gRNA molecules are complementary to opposite strands of the target nucleic acid molecule. In an embodiment, the gRNA molecule and the second gRNA molecule are configured such that the PAMs are oriented outward.

In an embodiment, the targeting domain of a gRNA molecule is configured to avoid unwanted target chromosome elements, such as repeat elements, e.g., Alu repeats, in the target domain. The gRNA molecule may be a first, second, third and/or fourth gRNA molecule, as described herein.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In an embodiment, a CF target mutant position, e.g., a deletion in the CFTR gene, e.g., at F508, e.g., F508del, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 1A-1E, 10A-10C, 11A-11E or 12A-12C. In some embodiments, the targeting domain is independently selected from those in Tables 1A-1E, 10A-10C, 11A-11E or 12A-12C. For example, in certain embodiments, the targeting domain is independently selected from:

GAGGGUAAAAUUAAGCACAG; (SEQ ID NO: 387)

AGUUUCUUACCUCUUCUAGU; (SEQ ID NO: 388)

AAUGGUGCCAGGCAUAAUCC; (SEQ ID NO: 389)

GGUAAAAUUAAGCACAG; (SEQ ID NO: 390)

AGCAUGCCAACUAGAAG; (SEQ ID NO: 391)
or

GUAUCUAUAUUCAUCAU. (SEQ ID NO: 392)

In an embodiment, when the CF target mutant position is F508, e.g., F508del, and two gRNAs are used to position two breaks, e.g., two single stranded breaks, in the target nucleic acid sequence, each guide RNA is independently selected from one of Tables 1A-1E, 10A-10C, 11A-11E or 12A-12C.

In an embodiment, a CF target mutant position, e.g., a mutation in the CFTR gene, e.g., at G551, e.g., G551D, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 2A-2E, 16A-16D, 17A-17E, or 18A-18C. In some embodiments, the targeting domain is independently selected from those in Tables 2A-2E, 16A-16D, 17A-17E, or 18A-18C. For example, in certain embodiments, the targeting domain is independently selected from:

GAGAAAGACAAUAUAGUUCU; (SEQ ID NO: 453)

GGUGGAAUCACACUGAGUGG; (SEQ ID NO: 454)

CCCACUAGCCAUAAAACCCC; (SEQ ID NO: 455)

GGUGGAAUCACACUGAG; (SEQ ID NO: 456)

GGAAUCACACUGAGUGG; (SEQ ID NO: 457)

GGGGUUUUAUGGCUAGU; (SEQ ID NO: 458)
or

ACUAGCCAUAAAACCCC. (SEQ ID NO: 459)

In an embodiment, more than one gRNA is used to position breaks, e.g., two single stranded breaks or two double stranded breaks, or a combination of single strand and double strand breaks, e.g., to create one or more indels, in the target nucleic acid sequence. In an embodiment, the targeting domain of each guide RNA is independently selected from one of Tables 2A-2E, 16A-16D, 17A-17E, or 18A-18C.

In an embodiment, a mutation in the CFTR gene, e.g., at N1303, e.g., N1303K, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 19A-19D, 20A-20E, or 21A-21B. In some embodiments, the targeting domain is independently selected from those in Tables 19A-19D, 20A-20E, or 21A-21B. For example, in certain embodiments, the targeting domain is selected from:

GGAGUGAUCAAGAAAUA; (SEQ ID NO: 2223)

GAGUACCCUAACAUACC; (SEQ ID NO: 2224)

```
                                    (SEQ ID NO: 2225)
GUGUGUGCACAACUUUAAAA;

(SEQ ID NO: 2226)
GGAAAGUUGCAGAUGAGGUA;

(SEQ ID NO: 2227)
GAACUUGAUGGUAAGUACAU;
or (SEQ ID NO: 2228)
GCUAUAUCAGCCAUUUGUGU.
```

In an embodiment, when the CF target mutant position is N1303, e.g., N1303K, and two gRNAs are used to position two breaks, e.g., two single stranded breaks, in the target nucleic acid sequence, each guide RNA is independently selected from one of Tables 19A-19D, 20A-20E, or 21A-21B.

In an embodiment, a mutation in the CFTR gene, e.g., at W1282, e.g., W1282X, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 28A-28D, 29A-29E, or 30A-30B. In some embodiments, the targeting domain is independently selected from those in Tables 28A-28D, 29A-29E, or 30A-30B. For example, in certain embodiments, the targeting domain is selected from:

```
                                    (SEQ ID NO: 2993)
GAAUUAUGUUUAUGGCA;

(SEQ ID NO: 2994)
GGAGAAAUCCAGAUCGA;

(SEQ ID NO: 2995)
GGCCUCUUGGGAAGAAC;

(SEQ ID NO: 2996)
GUCCUUUUGCUCACCUG;

(SEQ ID NO: 2997)
GAUCGAUGGUGUGUCUU;

(SEQ ID NO: 2998)
GAAGGAGAAAUCCAGAUCGA;

(SEQ ID NO: 2999)
GUGGGCCUCUUGGGAAGAAC.
```

In an embodiment, when the CF target mutant position is W1282, e.g., W1282X, and two gRNAs are used to position two breaks, e.g., two single stranded breaks, in the target nucleic acid sequence, each guide RNA is independently selected from one of Tables 28A-28D, 29A-29E, or 30A-30B.

In an embodiment, a mutation in the CFTR gene, e.g., at R553, e.g., R553X, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 25A-25D, 26A-26E, or 27A-27D. In some embodiments, the targeting domain is independently selected from those in Tables 25A-25D, 26A-26E, or 27A-27D. For example, in certain embodiments, the targeting domain is selected from:

```
                                    (SEQ ID NO: 466)
GCUUUAUAUUCUGUUUC;

(SEQ ID NO: 456)
GGUGGAAUCACACUGAG;

(SEQ ID NO: 457)
GGAAUCACACUGAGUGG;

(SEQ ID NO: 464)
GUUCAAAAUUUCAACUG;

(SEQ ID NO: 465)
GGUGAAUAACUAAUUAU;

(SEQ ID NO: 458)
GGGGUUUUAUGGCUAGU;

(SEQ ID NO: 462)
GAGCAAGAAUUUCUUUAGCA;

(SEQ ID NO: 460)
GACAAUAUAGUUCUUGGAGA;

(SEQ ID NO: 461)
GAAGGUGGAAUCACACUGAG;

(SEQ ID NO: 454)
GGUGGAAUCACACUGAGUGG;
or (SEQ ID NO: 453)
GAGAAAGACAAUAUAGUUCU.
```

In an embodiment, when the CF target mutant position is R553, e.g., R553X, and two gRNAs are used to position two breaks, e.g., two single stranded breaks, in the target nucleic acid sequence, each guide RNA is independently selected from one of Tables 25A-25D, 26A-26E, or 27A-27D.

In an embodiment, a mutation in the CFTR gene, e.g., at 3717+12191C>T, also known as 3849+10 kbC>T is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 34A-34D, 35A-35D, or 36A-36D. In some embodiments, the targeting domain is independently selected from those in Tables 34A-34D, 35A-35D, or 36A-36D. For example, in certain embodiments, the targeting domain is selected from:

```
                                    (SEQ ID NO: 3344)
GAGUAAGACACCCUGAA;

(SEQ ID NO: 3345)
GAUUUCUGGAGACCACA;

(SEQ ID NO: 3346)
GGUUUUAGCUAUUACUC;

(SEQ ID NO: 3347)
GUAGUUGAAUCAUUCAG;

(SEQ ID NO: 3348)
GAACUCAGUUUUUAGGU;

(SEQ ID NO: 3349)
GAAAGGAAAUGUUCUAUUCA;

(SEQ ID NO: 3350)
GUUUUUAGGUUGGGAAAGAC;

(SEQ ID NO: 3351)
GCACAUAAUAAUUAGUUUCC;
```

-continued

GAGAACUCAGUUUUUAGGUU; (SEQ ID NO: 3352)

or

GAAAACACUGACUUAGAUUU. (SEQ ID NO: 3353)

In an embodiment, when the CF target mutant position is 3717+12191C>T and two gRNAs are used to position two breaks, e.g., two single stranded breaks, in the target nucleic acid sequence, each guide RNA is independently selected from one of Tables 34A-34D, 35A-35D, or 36A-36D.

In an embodiment, a mutation in the CFTR gene, e.g., at 2657+5G>A, also known as 2789+5G>A is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 4A-4D, 5A-5E, or 6A-6C. In some embodiments, the targeting domain is independently selected from those in Tables 4A-4D, 5A-5E, or 6A-6C. For example, in certain embodiments, the targeting domain is selected from:

GAAGCAGCCACCUGGAA; (SEQ ID NO: 937)

GGAAUAUUCACUUUCCA; (SEQ ID NO: 938)

GAAUUUAGAUGUGGGCA; (SEQ ID NO: 939)

GUGUCUUGUUCCAUUCC; (SEQ ID NO: 940)

GUGGGCAUGGGAGGAAU; (SEQ ID NO: 941)

GUUGUGCUGUGGCUCCU; (SEQ ID NO: 942)

GAUGUGAAUUUAGAUGU; (SEQ ID NO: 943)

GACCCAGGAACACAAAGCAA; (SEQ ID NO: 944)

GUGUCACCUCACCCAACUAA; (SEQ ID NO: 945)

GUGUCUUGUUCCAUUCCAGG; (SEQ ID NO: 946)

GAUGUGGGCAUGGGAGGAAU; (SEQ ID NO: 947)

GUGAAUUUAGAUGUGGGCAU. (SEQ ID NO: 948)

In an embodiment, when the CF target mutant position is 2657+5G>A and two gRNAs are used to position two breaks, e.g., two single stranded breaks, in the target nucleic acid sequence, each guide RNA is independently selected from one of Tables 4A-4D, 5A-5E, or 6A-6C.

In an embodiment, a mutation in the CFTR gene, e.g., at 3140-26A>G, also known as 3272-26A>G, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 7A-7D, 8A-8E, or 9A-9B. In some embodiments, the targeting domain is independently selected from those in Tables 7A-7D, 8A-8E, or 9A-9B. For example, in certain embodiments, the targeting domain is selected from:

GUAAGGCUGCCGUCCGA; (SEQ ID NO: 1282)

GGAAAUAUUUCACAGGC; (SEQ ID NO: 1283)

GUAAAUUCAGAGCUUUG; (SEQ ID NO: 1284)

GGACACUUCGUGCCUUCGGA; (SEQ ID NO: 1285)

GGAACCAGCGCAGUGUUGAC; (SEQ ID NO: 1286)

GUAACAAGAUGAGUGAAAAU. (SEQ ID NO: 1287)

In an embodiment, when the CF target mutant position is 3140-26A>G and two gRNAs are used to position two breaks, e.g., two single stranded breaks, in the target nucleic acid sequence, each guide RNA is independently selected from one of Tables 7A-7D, 8A-8E, or 9A-9B.

In another embodiment, a CF target knockout position, e.g., a position in the coding region, e.g., the early coding region, of the SCNN1A gene is targeted, e.g., for knockout. In an embodiment, the targeting domain comprises a sequence that is the same as, or differs by no more than 1, 2, 3, 4, or 5 nucleotides from, a targeting domain sequence from any one of Tables 3A-3D, 43A-43E, 44A-44G, or 45A-45E. In an embodiment, the targeting domain is independently selected from those in Tables 3A-3D, 43A-43E, 44A-44G, or 45A-45E. In another embodiment, the targeting domain is independently selected from:

GCCCAUACCAGGUCUCAUGG; (SEQ ID NO: 497)

CCAUACCAGGUCUCAUGGAG; (SEQ ID NO: 498)

GCCCUCCACAGUCCACUCCA; (SEQ ID NO: 499)

CCCCUCCAUGAGACCUGGUA; (SEQ ID NO: 500)

AUACCAGGUCUCAUGGA; (SEQ ID NO: 501)

or

CUCCAUGAGACCUGGUA. (SEQ ID NO: 502)

In an embodiment, when the CF target knockout position is the SCNN1A coding region, e.g., early coding region, and more than one gRNA is used to position breaks, e.g., two single stranded breaks or two double stranded breaks, or a combination of single strand and double strand breaks, e.g., to create one or more indels, in the target nucleic acid sequence, each guide RNA is independently selected from one of Tables 3A-3D, 43A-43E, 44A-44G, or 45A-45E.

In an embodiment, the targeting domain of the gRNA molecule is configured to target an enzymatically inactive Cas9 (eiCas9) molecule or an eiCas9 fusion protein (e.g., an eiCas9 fused to a transcription repressor domain), sufficiently close to a SCNN1A transcription start site (TSS) to reduce (e.g., block) transcription, e.g., transcription initiation or elongation, binding of one or more transcription enhancers or activators, and/or RNA polymerase. In an embodiment, the targeting domain is configured to target between 1000 bp upstream and 1000 bp downstream (e.g., between 500 bp upstream and 1000 bp downstream, between 1000 bp upstream and 500 bp downstream, between 500 bp upstream and 500 bp downstream, within 500 bp upstream, or within 500 bp downstream) of the TSS of the SCNN1A gene. One or more gRNAs may be used to target an eiCas9 to the promoter region of the SCNN1A gene.

In an embodiment, when the SCNN1A promoter region is targeted, e.g., for knockdown, the targeting domain can comprise a sequence that is the same as, or differs by no more than 1, 2, 3, 4, or 5 nucleotides from, a targeting domain sequence from any one of Tables 46A-46E, 47A-47G, or 48A-48E. In an embodiment, the targeting domain is independently selected from those in Tables 46A-46E, 47A-47G, or 48A-48E.

In an embodiment, the targeting domain is independently selected from those in Table 46A. In an embodiment, the targeting domain is independently selected from those in Table 47A. In an embodiment, the targeting domain is independently selected from those in Table 48A.

In an embodiment, when the CF target knockdown position is the SCNN1A promoter region and more than one gRNA is used to position an eiCas9 molecule or an eiCas9-fusion protein (e.g., an eiCas9-transcription repressor domain fusion protein), in the target nucleic acid sequence, the targeting domain for each guide RNA is independently selected from one of Tables 46A-46E, 47A-47G, or 48A-48E.

In an embodiment, the gRNA, e.g., a gRNA comprising a targeting domain, which is complementary with the CFTR gene or SCNN1A gene, is a modular gRNA. In other embodiments, the gRNA is a unimolecular or chimeric gRNA.

In an embodiment, the targeting domain which is complementary with a target domain from the CF target position in the CFTR gene or SCNN1A gene is 16 nucleotides or more in length. In an embodiment, the targeting domain is 16 nucleotides in length. In an embodiment, the targeting domain is 17 nucleotides in length. In another embodiment, the targeting domain is 18 nucleotides in length. In still another embodiment, the targeting domain is 19 nucleotides in length. In still another embodiment, the targeting domain is 20 nucleotides in length. In still another embodiment, the targeting domain is 21 nucleotides in length. In still another embodiment, the targeting domain is 22 nucleotides in length. In still another embodiment, the targeting domain is 23 nucleotides in length. In still another embodiment, the targeting domain is 24 nucleotides in length. In still another embodiment, the targeting domain is 25 nucleotides in length. In still another embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

A gRNA as described herein may comprise from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a gRNA comprises a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 35 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

A cleavage event, e.g., a double strand or single strand break, is generated by a Cas9 molecule. The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule).

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In this case, the eaCas9 molecule is an HNH-like domain nickase, e.g., the eaCas9 molecule comprises a mutation at D10, e.g., D10A. In other embodiments, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase, e.g., the eaCas9 molecule comprises a mutation at H840, e.g., H840A. In an embodiment, the eaCas9 molecule is an N-terminal RuvC-like domain nickase, e.g., the eaCas9 molecule comprises a mutation at N863, e.g., an N863A mutation.

In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In another aspect, disclosed herein is a nucleic acid, e.g., an isolated or non-naturally occurring nucleic acid, e.g., DNA, that comprises (a) a sequence that encodes a gRNA molecule comprising a targeting domain that is complementary with a target domain, e.g., with a CF target position, in the CFTR gene or SCNN1A gene as disclosed herein.

In an embodiment, the nucleic acid encodes a gRNA molecule, e.g., a first gRNA molecule, comprising a targeting domain configured to provide a cleavage event, e.g., a double strand break or a single strand break, sufficiently close to a CF target position in the CFTR gene or SCNN1A gene to allow alteration, e.g., alteration associated with, respectively, HDR or NHEJ, of a CF target position in the CFTR gene or SCNN1A gene.

In an embodiment, the nucleic acid encodes a gRNA molecule, e.g., a first gRNA molecule, comprising a targeting domain configured to target an enzymatically inactive Cas9 (eiCas9) molecule or an eiCas9 fusion protein (e.g., an eiCas9 fused to a transcription repressor domain), sufficiently close to a CF knockdown target position to reduce, decrease or repress expression of the SCNN1A gene.

In an embodiment, the nucleic acid encodes a gRNA molecule, e.g., the first gRNA molecule, comprising a targeting domain comprising a sequence that is the same as, or differs by no more than 1, 2, 3, 4, or 5 nucleotides from, a targeting domain sequence as described herein, e.g., from any one of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E. In an embodiment, the nucleic acid encodes a gRNA molecule comprising a targeting domain as described herein, e.g., that is selected from those in Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E.

In an embodiment, the nucleic acid encodes a modular gRNA, e.g., one or more nucleic acids encode a modular gRNA. In another embodiment, the nucleic acid encodes a chimeric gRNA. The nucleic acid may encode a gRNA, e.g., the first gRNA molecule, comprising a targeting domain comprising 16 nucleotides or more in length. In an embodiment, the nucleic acid encodes a gRNA, e.g., the first gRNA molecule, comprising a targeting domain that is 16 nucleotides in length. In another embodiment, the nucleic acid encodes a gRNA, e.g., the first gRNA molecule, comprising a targeting domain that is 17 nucleotides in length. In yet another embodiment, the nucleic acid encodes a gRNA, e.g., the first gRNA molecule, comprising a targeting domain that is 18 nucleotides in length. In still another embodiment, the nucleic acid encodes a gRNA, e.g., the first gRNA molecule, comprising a targeting domain that is 19 nucleotides in length. In still another embodiment, the nucleic acid encodes a gRNA, e.g., the first gRNA molecule, comprising a targeting domain that is 20 nucleotides in length. In still another embodiment, the nucleic acid encodes a gRNA, e.g., the first gRNA molecule, comprising a targeting domain that is 21 nucleotides in length. In still another embodiment, the nucleic acid encodes a gRNA, e.g., the first gRNA molecule, comprising a targeting domain that is 22 nucleotides in length. In still another embodiment, the nucleic acid encodes a gRNA, e.g., the first gRNA molecule, comprising a targeting domain that is 23 nucleotides in length. In still another embodiment, the nucleic acid encodes a gRNA, e.g., the first gRNA molecule, comprising a targeting domain that is 24 nucleotides in length. In still another embodiment, the nucleic acid encodes a gRNA, e.g., the first gRNA molecule, comprising a targeting domain that is 25 nucleotides in length. In still another embodiment, the nucleic acid encodes a gRNA, e.g., the first gRNA molecule, comprising a targeting domain that is 26 nucleotides in length. In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a gRNA comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a gRNA e.g., the first gRNA molecule, comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 35 nucleotides in length; and a targeting domain equal to or greater than 16, 17, 18, 19, 20, 21, 22, 23, 24, 25 or 26 nucleotides in length.

In an embodiment, a nucleic acid encodes a gRNA comprising e.g., the first gRNA molecule, a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, a nucleic acid comprises (a) a sequence that encodes a gRNA molecule, e.g., the first gRNA molecule, comprising a targeting domain that is complementary with a target domain in the CFTR gene or SCNN1A gene as disclosed herein, and further comprising (b) a sequence that encodes a Cas9 molecule.

The Cas9 molecule may be a nickase molecule, an enzymatically activating Cas9 (eaCas9) molecule, e.g., an eaCas9 molecule that forms a double strand break in a target nucleic acid and/or an eaCas9 molecule forms a single strand break in a target nucleic acid. In an embodiment, a single strand break is formed in the strand of the target nucleic acid to which the targeting domain of said gRNA is complementary. In another embodiment, a single strand break is formed in the strand of the target nucleic acid other than the strand to which to which the targeting domain of said gRNA is complementary.

In an embodiment, the eaCas9 molecule catalyzes a double strand break.

In an embodiment, the eaCas9 molecule comprises HNH-like domain cleavage activity but has no, or no significant, N-terminal RuvC-like domain cleavage activity. In another embodiment, the said eaCas9 molecule is an HNH-like domain nickase, e.g., the eaCas9 molecule comprises a mutation at D10, e.g., D10A. In another embodiment, the eaCas9 molecule comprises N-terminal RuvC-like domain cleavage activity but has no, or no significant, HNH-like domain cleavage activity. In another embodiment, the eaCas9 molecule is an N-terminal RuvC-like domain nickase, e.g., the eaCas9 molecule comprises a mutation at H840, e.g., H840A. In another embodiment, the eaCas9 molecule is an N-terminal RuvC-like domain nickase, e.g., the eaCas9 molecule comprises a mutation at N863, e.g., an N863A mutation.

A nucleic acid disclosed herein may comprise (a) a sequence that encodes a gRNA molecule comprising a targeting domain that is complementary with a target domain in the CFTR and/or SCNN1A gene as disclosed herein; (b) a sequence that encodes a Cas9 molecule.

In an embodiment, the Cas9 molecule is an enzymatically active Cas9 (eaCas9) molecule. In an embodiment, the Cas9 molecule is an enzymatically inactive Cas9 (eiCas9) molecule or a modified eiCas9 molecule, e.g., the eiCas9 molecule is fused to Krüppel-associated box (KRAB) to generate an eiCas9-KRAB fusion protein molecule.

A nucleic acid disclosed herein may comprise (a) a sequence that encodes a gRNA molecule comprising a targeting domain that is complementary with a target domain in the CFTR gene or SCNN1A gene as disclosed herein; (b) a sequence that encodes a Cas9 molecule; and further may comprise (c)(i) a sequence that encodes a second gRNA molecule described herein having a targeting domain that is complementary to a second target domain of the CFTR gene or SCNN1A gene, and optionally, (c)(ii) a sequence that encodes a third gRNA molecule described herein having a targeting domain that is complementary to a third target domain of the CFTR gene or SCNN1A gene; and optionally, (c)(iii) a sequence that encodes a fourth gRNA molecule described herein having a targeting domain that is complementary to a fourth target domain of the CFTR gene or SCNN1A gene.

In an embodiment, a nucleic acid encodes a second gRNA molecule comprising a targeting domain configured to provide a cleavage event, e.g., a double strand break or a single strand break, sufficiently close to a CF target position in the CFTR gene or SCNN1A gene, to allow alteration, e.g., alteration associated with, respectively, HDR or NHEJ, of a CF target position in the CFTR gene or SCNN1A gene, either alone or in combination with the break positioned by said first gRNA molecule.

In an embodiment, a nucleic acid encodes a second gRNA molecule comprising a targeting domain configured to target an enzymatically inactive Cas9 (eiCas9) molecule or an eiCas9 fusion protein (e.g., an eiCas9 fused to a transcription repressor domain), sufficiently close to a CF knockdown target position to reduce, decrease or repress expression of the SCNN1A gene.

In an embodiment, a nucleic acid encodes a third gRNA molecule comprising a targeting domain configured to provide a cleavage event, e.g., a double strand break or a single strand break, sufficiently close to a CF target position in the CFTR gene or SCNN1A gene to allow alteration, e.g., alteration associated with, respectively, HDR or NHEJ, of a CF target position in the CFTR gene or SCNN1A gene, either alone or in combination with the break positioned by the first and/or second gRNA molecule.

In an embodiment, a nucleic acid encodes a third gRNA molecule comprising a targeting domain configured to target an enzymatically inactive Cas9 (eiCas9) molecule or an eiCas9 fusion protein (e.g., an eiCas9 fused to a transcription repressor domain), sufficiently close to a CF knockdown target position to reduce, decrease or repress expression of the SCNN1A gene.

In an embodiment, a nucleic acid encodes a fourth gRNA molecule comprising a targeting domain configured to provide a cleavage event, e.g., a double strand break or a single strand break, sufficiently close to a CF target position in the CFTR gene or SCNN1A gene to allow alteration, e.g., alteration associated with, respectively, HDR or NHEJ, of a CF target position in the CFTR gene or SCNN1A gene, either alone or in combination with the break positioned by the first gRNA molecule, the second gRNA molecule and/or the third gRNA molecule.

In an embodiment, the nucleic acid encodes a second gRNA molecule. The second gRNA is selected to target the same CF target position as the first gRNA molecule. Optionally, the nucleic acid may encode a third gRNA, and further optionally, the nucleic acid may encode a fourth gRNA molecule. The third gRNA molecule and the fourth gRNA molecule are selected to target the same CF target position as the first and second gRNA molecules.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from one of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E. In an embodiment, the nucleic acid encodes a second gRNA molecule comprising a targeting domain selected from those in Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E. In an embodiment, when a third or fourth gRNA molecule are present, the third and fourth gRNA molecules may independently comprise a targeting domain comprising a sequence that is the same as, or differs by no more than 1, 2, 3, 4, or 5 nucleotides from, a targeting domain sequence from one of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E. In a further embodiment, when a third or fourth gRNA molecule are present, the third and fourth gRNA molecules may independently comprise a targeting domain selected from those in Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E.

In an embodiment, the nucleic acid encodes a second gRNA which is a modular gRNA, e.g., wherein one or more nucleic acid molecules encode a modular gRNA. In another embodiment, the nucleic acid encoding a second gRNA is a chimeric gRNA. In another embodiment, when a nucleic acid encodes a third or fourth gRNA, the third and fourth gRNA may be a modular gRNA or a chimeric gRNA. When multiple gRNAs are used, any combination of modular or chimeric gRNAs may be used.

A nucleic acid may encode a second, a third, and/or a fourth gRNA, each independently, comprising a targeting domain comprising 16 nucleotides or more in length. In an embodiment, the nucleic acid encodes a second gRNA comprising a targeting domain that is 16 nucleotides in length. In an embodiment, the nucleic acid encodes a second gRNA comprising a targeting domain that is 17 nucleotides in length. In another embodiment, the nucleic acid encodes a second gRNA comprising a targeting domain that is 18 nucleotides in length. In still another embodiment, the nucleic acid encodes a second gRNA comprising a targeting domain that is 19 nucleotides in length. In still another embodiment, the nucleic acid encodes a second gRNA comprising a targeting domain that is 20 nucleotides in length. In still another embodiment, the nucleic acid encodes a second gRNA comprising a targeting domain that is 21 nucleotides in length. In still another embodiment, the nucleic acid encodes a second gRNA comprising a targeting domain that is 22 nucleotides in length. In still another embodiment, the nucleic acid encodes a second gRNA comprising a targeting domain that is 23 nucleotides in length. In still another embodiment, the nucleic acid encodes a second gRNA comprising a targeting domain that is 24 nucleotides in length. In still another embodiment, the nucleic acid encodes a second gRNA comprising a targeting domain that is 25 nucleotides in length. In still another embodiment, the nucleic acid encodes a second gRNA comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a second, a third, and/or a fourth gRNA, each independently, comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a second, a third, and/or a fourth gRNA comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 35 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, when the CFTR gene is corrected by HDR, the nucleic acid encodes (a) a sequence that encodes a gRNA molecule comprising a targeting domain that is complementary with a target domain in the CFTR gene as disclosed herein; (b) a sequence that encodes a Cas9 molecule; optionally, (c)(i) a sequence that encodes a second gRNA molecule described herein having a targeting domain that is complementary to a second target domain of the CFTR gene, and further optionally, (c)(ii) a sequence that encodes a third gRNA molecule described herein having a targeting domain that is complementary to a third target domain of the CFTR gene; and still further optionally, (c)(iii) a sequence that encodes a fourth gRNA molecule described herein having a targeting domain that is complementary to a fourth target domain of the CFTR gene; and further may comprise (d) a template nucleic acid, e.g., a template nucleic acid described herein.

In an embodiment, the template nucleic acid is a single stranded nucleic acid. In another embodiment, the template nucleic acid is a double stranded nucleic acid. In an embodiment, the template nucleic acid comprises a nucleotide sequence, e.g., of one or more nucleotides, that will be added to or will template a change in the target nucleic acid. In another embodiment, the template nucleic acid comprises a nucleotide sequence that may be used to modify the target position. In another embodiment, the template nucleic acid comprises a nucleotide sequence, e.g., of one or more nucleotides, that corresponds to wild type sequence of the target nucleic acid, e.g., of the target position.

The template nucleic acid may comprise a replacement sequence, e.g., a replacement sequence from the Table 49. In some embodiments, the template nucleic acid comprises a 5' homology arm, e.g., a 5' homology arm from Table 49. In other embodiments, the template nucleic acid comprises a 3' homology arm, e.g., a 3' homology arm from Table 49.

In an embodiment, a nucleic acid encodes (a) a sequence that encodes a gRNA molecule comprising a targeting domain that is complementary with a target domain in the CFTR gene or SCNN1A gene as disclosed herein, and (b) a sequence that encodes a Cas9 molecule, e.g., a Cas9 molecule described herein. In an embodiment, (a) and (b) are present on the same nucleic acid molecule, e.g., the same vector, e.g., the same viral vector, e.g., the same adeno-associated virus (AAV) vector. In an embodiment, the nucleic acid molecule is an AAV vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector.

In another embodiment, (a) is present on a first nucleic acid molecule, e.g. a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors.

In another embodiment, the nucleic acid may further comprise (c) a sequence that encodes a second, third and/or fourth gRNA molecule as described herein. In another embodiment, the nucleic acid comprises (a), (b) and (c)(i). Each of (a) and (c)(i) may be present on the same nucleic acid molecule, e.g., the same vector, e.g., the same viral vector, e.g., the same adeno-associated virus (AAV) vector. In an embodiment, the nucleic acid molecule is an AAV vector.

In another embodiment, (a) and (c)(i) are on different vectors. For example, (a) may be present on a first nucleic acid molecule, e.g. a first vector, e.g., a first viral vector, e.g., a first AAV vector; and (c)(i) may be present on a second nucleic acid molecule, e.g., a second vector, e.g., a second vector, e.g., a second AAV vector. In an embodiment, the first and second nucleic acid molecules are AAV vectors.

In another embodiment, each of (a), (b), and (c)(i) are present on the same nucleic acid molecule, e.g., the same vector, e.g., the same viral vector, e.g., an AAV vector. In an embodiment, the nucleic acid molecule is an AAV vector. In an alternate embodiment, one of (a), (b), and (c)(i) is encoded on a first nucleic acid molecule, e.g., a first vector, e.g., a first viral vector, e.g., a first AAV vector; and a second and third of (a), (b), and (c)(i) is encoded on a second nucleic acid molecule, e.g., a second vector, e.g., a second vector, e.g., a second AAV vector. The first and second nucleic acid molecule may be AAV vectors.

In an embodiment, (a) is present on a first nucleic acid molecule, e.g., a first vector, e.g., a first viral vector, a first AAV vector; and (b) and (c)(i) are present on a second nucleic acid molecule, e.g., a second vector, e.g., a second vector, e.g., a second AAV vector. The first and second nucleic acid molecule may be AAV vectors.

In another embodiment, (b) is present on a first nucleic acid molecule, e.g., a first vector, e.g., a first viral vector, e.g., a first AAV vector; and (a) and (c)(i) are present on a second nucleic acid molecule, e.g., a second vector, e.g., a second vector, e.g., a second AAV vector. The first and second nucleic acid molecule may be AAV vectors.

In another embodiment, (c)(i) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors.

In another embodiment, each of (a), (b) and (c)(i) are present on different nucleic acid molecules, e.g., different vectors, e.g., different viral vectors, e.g., different AAV vector. For example, (a) may be on a first nucleic acid molecule, (b) on a second nucleic acid molecule, and (c)(i) on a third nucleic acid molecule. The first, second and third nucleic acid molecule may be AAV vectors.

In another embodiment, when a third and/or fourth gRNA molecule are present, each of (a), (b), (c)(i), (c)(ii) and (c)(iii) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (c)(iii) may be present on the different nucleic acid molecules, e.g., different vectors, e.g., the different viral vectors, e.g., different AAV vectors. In a further embodiment, each of (a), (b), (c)(i), (c)(ii) and (c)(iii) may be present on more than one nucleic acid molecule, but fewer than five nucleic acid molecules, e.g., AAV vectors.

In another embodiment, when (d) a template nucleic acid is present, each of (a), (b), and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), and (d) may be present on the different nucleic acid molecules, e.g., different vectors, e.g., the different viral vectors, e.g., different AAV vectors. In a further embodiment, each of (a), (b), and (d) may be present on more than one nucleic acid molecule, but fewer than three nucleic acid molecules, e.g., AAV vectors.

In another embodiment, when (d) a template nucleic acid is present, each of (a), (b), (c)(i) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i) and (d) may be present on the different nucleic acid molecules, e.g., different vectors, e.g., the different viral vectors, e.g., different AAV vectors. In a further embodiment, each of (a), (b), (c)(i) and (d) may be present on more than one nucleic acid molecule, but fewer than four nucleic acid molecules, e.g., AAV vectors.

In another embodiment, when (d) a template nucleic acid is present, each of (a), (b), (c)(i), (c)(ii) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (d) may be present on the different nucleic acid molecules, e.g., different vectors, e.g., the different viral vectors, e.g., different AAV vectors. In a further embodiment, each of (a), (b), (c)(i), (c)(ii) and (d) may be present on more than one nucleic acid molecule, but fewer than five nucleic acid molecules, e.g., AAV vectors.

In another embodiment, when (d) a template nucleic acid is present, each of (a), (b), (c)(i), (c)(ii), (c)(iii) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii), (c)(iii) and (d) may be present on the different nucleic acid molecules, e.g., different vectors, e.g., the different viral vectors, e.g., different AAV vectors. In a further embodiment, each of (a), (b), (c)(i), (c)(ii), (c)(iii) and (d) may be present on more than one nucleic acid molecule, but fewer than six nucleic acid molecules, e.g., AAV vectors.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (c), e.g., a promoter described herein. The promoter and second promoter differ from one another. In some embodiments, the promoter and second promoter are the same.

The nucleic acids described herein may further comprise a promoter operably linked to the sequence that encodes the Cas9 molecule of (b), e.g., a promoter described herein.

In another aspect, disclosed herein is a composition comprising (a) a gRNA molecule comprising a targeting domain that is complementary with a target domain in the CFTR gene or SCNN1A gene, as described herein. The composition of (a) may further comprise (b) a Cas9 molecule, e.g., a Cas9 molecule as described herein. A composition of (a) and (b) may further comprise (c) a second, third and/or fourth gRNA molecule, e.g., a second, third and/or fourth gRNA molecule described herein. A composition of (a), (b) and (c) may further comprise (d) a template nucleic acid, e.g., a template nucleic acid described herein. In an embodiment, the composition is a pharmaceutical composition. The compositions described herein, e.g., pharmaceutical compositions described herein, can be used in the treatment or prevention of CF or CF-like disease in a subject, e.g., in accordance with a method disclosed herein.

In another aspect, disclosed herein is a method of altering a cell, e.g., altering the structure, e.g., altering the sequence, of a target nucleic acid of a cell, comprising contacting said cell with: (a) a gRNA that targets the CFTR gene or SCNN1A gene, e.g., a gRNA as described herein; (b) a Cas9 molecule, e.g., a Cas9 molecule as described herein; and optionally, (c) a second, third and/or fourth gRNA that targets CFTR gene or SCNN1A gene, e.g., a second, third and/or fourth gRNA as described herein; and optionally, (d) a template nucleic acid, e.g., a template nucleic acid as described herein.

In an embodiment, the method comprises contacting said cell with (a) and (b).

In an embodiment, the method comprises contacting said cell with (a), (b), and (c).

In an embodiment, the method comprises contacting said cell with (a), (b), (c) and (d).

The gRNA of (a) and optionally (c) may be selected from any of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E, or a gRNA that differs by no more than 1, 2, 3, 4, or 5 nucleotides from, a targeting domain sequence from any of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E.

In an embodiment, the method comprises contacting a cell from a subject suffering from or likely to develop CF or CF-like disease. The cell may be from a subject having a mutation at a CF target position in the CFTR gene or a subject which would benefit from having a mutation at a CF target position in the SCNN1A gene.

In an embodiment, the cell being contacted in the disclosed method is an epithelial cell, e.g., a pulmonary epithelial cell, e.g., a bronchial epithelial cell or an alveolar epithelial cell. The contacting may be performed ex vivo and the contacted cell may be returned to the subject's body after the contacting step. In other embodiments, the contacting step may be performed in vivo.

In an embodiment, the method of altering a cell as described herein comprises acquiring knowledge of the sequence at a CF target position in said cell, prior to the contacting step. Acquiring knowledge of the sequence at a CF target position in the cell may be by sequencing the CFTR gene or SCNN1A gene, or a portion of the CFTR gene or SCNN1A gene.

In an embodiment, the contacting step of the method comprises contacting the cell with a nucleic acid, e.g., a vector, e.g., an AAV vector, that expresses at least one of (a), (b), and (c). In an embodiment, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b) and a nucleic acid which encodes a gRNA of (a) and optionally, a second gRNA (c)(i) and further optionally, a third gRNA (c)(ii) and/or fourth gRNA (c)(iii)).

In an embodiment, the contacting step of the method comprises contacting the cell with a nucleic acid, e.g., a vector, e.g., an AAV vector, that expresses at least one of (a), (b), (c) and (d). In an embodiment, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b), a nucleic acid which encodes a gRNA of (a) and a template nucleic acid of (d), and optionally, a second gRNA (c)(i) and further optionally, a third gRNA (c)(ii) and/or fourth gRNA (c)(iii).

In an embodiment, contacting comprises contacting the cell with a nucleic acid, e.g., a vector, e.g., an AAV vector, e.g., an AAV2 vector, a modified AAV2 vector, an AAV3 vector, a modified AAV3 vector, an AAV6 vector, a modified AAV6 vector, an AAV8 vector or an AAV9 vector, as described herein.

In an embodiment, contacting comprises delivering to the cell a Cas9 molecule of (b), as a protein or an mRNA, and a nucleic acid which encodes a gRNA of (a) and optionally a second, third and/or fourth gRNA of (c).

In an embodiment, contacting comprises delivering to the cell a Cas9 molecule of (b), as a protein or an mRNA, said gRNA of (a), as an RNA, and optionally said second, third and/or fourth gRNA of (c), as an RNA.

In an embodiment, contacting comprises delivering to the cell a gRNA of (a) as an RNA, optionally the second, third and/or fourth gRNA of (c) as an RNA, and a nucleic acid that encodes the Cas9 molecule of (b).

In another aspect, disclosed herein is a method of treating or preventing a subject suffering from or likely to develop CF or CF-like disease, e.g., altering the structure, e.g., sequence, of a target nucleic acid of the subject, comprising contacting the subject (or a cell from the subject) with:

(a) a gRNA that targets the CFTR gene or SCNN1A gene, e.g., a gRNA disclosed herein;

(b) a Cas9 molecule, e.g., a Cas9 molecule disclosed herein; and optionally, (c)(i) a second gRNA that targets the CFTR gene or SCNN1A gene, e.g., a second gRNA disclosed herein, and further optionally, (c)(ii) a third gRNA, and still further optionally, (c)(iii) a fourth gRNA that target the CFTR gene or SCNN1A gene, e.g., a third and fourth gRNA disclosed herein.

The method of treating a subject may further comprise contacting the subject (or a cell from the subject) with (d) a template nucleic acid, e.g., a template nucleic acid disclosed herein. A template nucleic acid is used when the method of treating a subject uses HDR to alter the sequence of the target nucleic acid of the subject.

In some embodiments, contacting comprises contacting with (a) and (b).

In some embodiments, contacting comprises contacting with (a), (b), and (c)(i).

In some embodiments, contacting comprises contacting with (a), (b), (c)(i) and (c)(ii).

In some embodiments, contacting comprises contacting with (a), (b), (c)(i), (c)(ii) and (c)(iii).

In some embodiments, contacting comprises contacting with (a), (b), (c)(i) and (d).

In some embodiments, contacting comprises contacting with (a), (b), (c)(i), (c)(ii) and (d).

In some embodiments, contacting comprises contacting with (a), (b), (c)(i), (c)(ii), (c)(iii) and (d).

The gRNA of (a) or (c) (e.g., (c)(i), (c)(ii), or (c)(iii)) may be selected from any of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E, or a gRNA that differs by no more than 1, 2, 3, 4, or 5 nucleotides from, a targeting domain sequence from any of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A- 16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E.

In an embodiment, the method comprises acquiring knowledge of the sequence (e.g., a mutation) of a CF target position in said subject.

In an embodiment, the method comprises acquiring knowledge of the sequence (e.g., a mutation) of a CF target position in said subject by sequencing the CFTR gene or SCNN1A gene or a portion of the CFTR gene or SCNN1A gene.

In an embodiment, the method comprises correcting a mutation at a CF target position in the CFTR gene.

In an embodiment, the method comprises correcting a mutation at a CF target position in the CFTR gene by HDR.

In an embodiment, the method comprises introducing a mutation at a CF target position in the SCNN1A gene.

In an embodiment, the method comprises introducing a mutation at a CF target position in the SCNN1A gene by NHEJ.

When the method comprises correcting the mutation at a CF target position by HDR, a Cas9 of (b), at least one guide RNA, e.g., a guide RNA of (a) and a template nucleic acid of (d) are included in the contacting step.

In an embodiment, a cell of the subject is contacted ex vivo with (a), (b), (d) and optionally (c). In an embodiment, said cell is returned to the subject's body.

In an embodiment, a cell of the subject is contacted is in vivo with (a), (b) (d) and optionally (c)(i), further optionally (c)(ii), and still further optionally (c)(iii).

In an embodiment, the cell of the subject is contacted in vivo by inhalation delivery, e.g., via nebulizer, of (a), (b), (d) and optionally (c)(i), further optionally (c)(ii), and still further optionally (c)(iii).

In an embodiment, the cell of the subject is contacted in vivo by intravenous delivery of (a), (b), (d) and optionally (c)(i), further optionally (c)(ii), and still further optionally (c)(iii).

In an embodiment, the cell of the subject is contacted in vivo by intraparenchymal delivery of (a), (b), (d) and optionally (c)(i), further optionally (c)(ii), and still further optionally (c)(iii), e.g., to lung tissue or bronchial tree.

In an embodiment, the contacting step comprises contacting the subject with a nucleic acid, e.g., a vector, e.g., an AAV vector, described herein, e.g., a nucleic acid that encodes at least one of (a), (b), (d) and optionally (c)(i), further optionally (c)(ii), and still further optionally (c)(iii).

In an embodiment, the contacting step comprises delivering to said subject said Cas9 molecule of (b), as a protein or mRNA, and a nucleic acid which encodes (a), a nucleic acid of (d) and optionally (c)(i), further optionally (c)(ii), and still further optionally (c)(iii).

In an embodiment, the contacting step comprises delivering to the subject the Cas9 molecule of (b), as a protein or mRNA, the gRNA of (a), as an RNA, a nucleic acid of (d) and optionally the second gRNA of (c)(i), further optionally said third gRNA of (c)(ii), and still further optionally said fourth gRNA of (c)(iii), as an RNA.

In an embodiment, the contacting step comprises delivering to the subject the gRNA of (a), as an RNA, optionally said second gRNA of (c)(i), further optionally said third gRNA of (c)(ii), and still further optionally said fourth gRNA of (c)(iii), as an RNA, a nucleic acid that encodes the Cas9 molecule of (b), and a nucleic acid of (d).

When the method comprises (1) introducing a mutation at a CF target position by NHEJ or (2) knocking down expression of the SCNN1A gene by targeting the promoter region, a Cas9 of (b) and at least one guide RNA, e.g., a guide RNA of (a) are included in the contacting step.

In an embodiment, a cell of the subject is contacted ex vivo with (a), (b) and optionally (c)(i), further optionally (c)(ii), and still further optionally (c)(iii). In an embodiment, said cell is returned to the subject's body.

In an embodiment, a population of cells from a subject is contacted ex vivo with (a), (b) and optionally (c)(i), further optionally (c)(ii), and still further optionally (c)(iii) and/or (d) to correct the F508del or G551D mutation in the CFTR gene and a second population of cells from the subject is contacted ex vivo with (a), (b) and optionally (c)(i), further optionally (c)(ii), and still further optionally (c)(iii), to introduce a mutation in the SCNN1A gene to knockout the SCNN1A gene. A mixture of the two cell populations may be returned to the subject's body to treat or prevent CF or CF-like disease.

In an embodiment, a cell of the subject is contacted is in vivo with (a), (b) and optionally (c)(i), further optionally (c)(ii), and still further optionally (c)(iii) and/or (d). In an embodiment, the cell of the subject is contacted in vivo by inhalation delivery, e.g., via nebulizer, of (a), (b) and optionally (c)(i), further optionally (c)(ii), and still further optionally (c)(iii) and/or (d). In an embodiment, the cell of the subject is contacted in vivo by intravenous delivery of (a), (b) and optionally (c)(i), further optionally (c)(ii), and still further optionally (c)(iii) and/or (d). In an embodiment, the cell of the subject is contacted in vivo by intraparenchymal delivery of (a), (b) and optionally (c)(i), further optionally (c)(ii), and still further optionally (c)(iii) and/or (d), e.g., to lung tissue or bronchial tree.

In an embodiment, contacting comprises contacting the subject with a nucleic acid, e.g., a vector, e.g., an AAV vector, described herein, e.g., a nucleic acid that encodes at least one of (a), (b), and optionally (c)(i), further optionally (c)(ii), and still further optionally (c)(iii) and/or (d).

In an embodiment, contacting comprises delivering to said subject said Cas9 molecule of (b), as a protein or mRNA, and a nucleic acid which encodes (a) and optionally (c)(i), further optionally (c)(ii), and still further optionally (c)(iii) and/or (d).

In an embodiment, contacting comprises delivering to the subject the Cas9 molecule of (b), as a protein or mRNA, the gRNA of (a), as an RNA, and optionally the second gRNA of (c)(i), further optionally said third gRNA of (c)(ii), and still further optionally said fourth gRNA of (c)(iii), as an RNA, and further optionally the template nucleic acid of (d) as a DNA.

In an embodiment, contacting comprises delivering to the subject the gRNA of (a), as an RNA, optionally said second gRNA of (c)(i), further optionally said third gRNA of (c)(ii), and still further optionally said fourth gRNA of (c)(iii), as an RNA, and a nucleic acid that encodes the Cas9 molecule of (b), and optionally a nucleic acid that encodes the template nucleic acid of (d).

In another aspect, disclosed herein is a reaction mixture comprising a gRNA molecule, a nucleic acid, or a composition described herein, and a cell, e.g., a cell from a subject having, or likely to develop CF or CF-like disease, or a subject having a mutation at a CF target position in the CFTR gene, or a cell from a subject which would benefit from having a mutation at a CF target position in the SCNN1A gene.

In another aspect, disclosed herein is a kit comprising, (a) a gRNA molecule described herein, or nucleic acid that encodes the gRNA, and one or more of the following:

(b) a Cas9 molecule, e.g., a Cas9 molecule described herein, or a nucleic acid or mRNA that encodes the Cas9;

(c)(i) a second gRNA molecule, e.g., a second gRNA molecule described herein or a nucleic acid that encodes (c)(i);

(c)(ii) a third gRNA molecule, e.g., a second gRNA molecule described herein or a nucleic acid that encodes (c)(ii);

(c)(iii) a fourth gRNA molecule, e.g., a second gRNA molecule described herein or a nucleic acid that encodes (c)(iii); and (d) a template nucleic acid, e.g., a template nucleic acid described herein.

In an embodiment, the kit comprises nucleic acid, e.g., an AAV vector, that encodes one or more of (a), (b), (c)(i), (c)(ii), (c)(iii) and (d).

In another aspect, disclosed herein is non-naturally occurring template nucleic acid described herein.

In yet another aspect, disclosed herein is a gRNA molecule, e.g., a gRNA molecule described herein, for use in treating or preventing CF or CF-like disease in a subject, e.g., in accordance with a method of treating or preventing CF or CF-like disease as described herein.

In an embodiment, the gRNA molecule in used in combination with a Cas9 molecule, e.g., a Cas9 molecule described herein. Additionally or alternatively, in an embodiment, the gRNA molecule is used in combination with a second, third and/or fourth gRNA molecule, e.g., a second, third and/or fourth gRNA molecule described herein.

In still another aspect, disclosed herein is use of a gRNA molecule, e.g., a gRNA molecule described herein, in the manufacture of a medicament for treating or preventing CF or CF-like disease in a subject, e.g., in accordance with a method of treating or preventing CF or CF-like disease as described herein.

In an embodiment, the medicament comprises a Cas9 molecule, e.g., a Cas9 molecule described herein. Additionally or alternatively, in an embodiment, the medicament comprises a second, third and/or fourth gRNA molecule, e.g., a second, third and/or fourth gRNA molecule described herein.

The gRNA molecules and methods, as disclosed herein, can be used in combination with a governing gRNA molecule. As used herein, a governing gRNA molecule refers to a gRNA molecule comprising a targeting domain which is complementary to a target domain on a nucleic acid that encodes a component of the CRISPR/Cas system introduced into a cell or subject. For example, the methods described herein can further include contacting a cell or subject with a governing gRNA molecule or a nucleic acid encoding a governing molecule. In an embodiment, the governing gRNA molecule targets a nucleic acid that encodes a Cas9 molecule or a nucleic acid that encodes a target gene gRNA molecule. In an embodiment, the governing gRNA comprises a targeting domain that is complementary to a target domain in a sequence that encodes a Cas9 component, e.g., a Cas9 molecule or target gene gRNA molecule. In an embodiment, the target domain is designed with, or has, minimal homology to other nucleic acid sequences in the cell, e.g., to minimize off-target cleavage. For example, the targeting domain on the governing gRNA can be selected to reduce or minimize off-target effects. In an embodiment, a target domain for a governing gRNA can be disposed in the control or coding region of a Cas9 molecule or disposed between a control region and a transcribed region. In an embodiment, a target domain for a governing gRNA can be disposed in the control or coding region of a target gene gRNA molecule or disposed between a control region and a transcribed region for a target gene gRNA. While not wishing to be bound by theory, in an embodiment, it is believed that altering, e.g., inactivating, a nucleic acid that encodes a Cas9 molecule or a nucleic acid that encodes a target gene gRNA molecule can be effected by cleavage of the targeted nucleic acid sequence or by binding of a Cas9 molecule/governing gRNA molecule complex to the targeted nucleic acid sequence.

The compositions, reaction mixtures and kits, as disclosed herein, can also include a governing gRNA molecule, e.g., a governing gRNA molecule disclosed herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

FIGS. 1A-1I are representations of several exemplary gRNAs.

FIG. 1A depicts a modular gRNA molecule derived in part (or modeled on a sequence in part) from *Streptococcus pyogenes* (*S. pyogenes*) as a duplexed structure (SEQ ID NOS: 42 and 43, respectively, in order of appearance);

FIG. 1B depicts a unimolecular (or chimeric) gRNA molecule derived in part from *S. pyogenes* as a duplexed structure (SEQ ID NO: 44);

FIG. 1C depicts a unimolecular gRNA molecule derived in part from *S. pyogenes* as a duplexed structure (SEQ ID NO: 45);

FIG. 1D depicts a unimolecular gRNA molecule derived in part from *S. pyogenes* as a duplexed structure (SEQ ID NO: 46);

FIG. 1E depicts a unimolecular gRNA molecule derived in part from *S. pyogenes* as a duplexed structure (SEQ ID NO: 47);

FIG. 1F depicts a modular gRNA molecule derived in part from *Streptococcus thermophilus* (*S. thermophilus*) as a duplexed structure (SEQ ID NOS: 48 and 49, respectively, in order of appearance);

FIG. 1G depicts an alignment of modular gRNA molecules of *S. pyogenes* and *S. thermophilus* (SEQ ID NOS: 50-53, respectively, in order of appearance).

FIGS. 1H-1I depicts additional exemplary structures of unimolecular gRNA molecules. FIG. 1H shows an exemplary structure of a unimolecular gRNA molecule derived in part from *S. pyogenes* as a duplexed structure (SEQ ID NO: 45). FIG. 1I shows an exemplary structure of a unimolecular gRNA molecule derived in part from *S. aureus* as a duplexed structure (SEQ ID NO: 40).

FIGS. 2A-2G depict an alignment of Cas9 sequences from Chylinski et al. (RNA Biol. 2013; 10(5): 726-737). The N-terminal RuvC-like domain is boxed and indicated with a "Y". The other two RuvC-like domains are boxed and indicated with a "B". The HNH-like domain is boxed and indicated by a "G". Sm: *S. mutans* (SEQ ID NO: 1); Sp: *S. pyogenes* (SEQ ID NO: 2); St: *S. thermophilus* (SEQ ID NO: 3); Li: *L. innocua* (SEQ ID NO: 4). Motif: this is a motif based on the four sequences: residues conserved in all four sequences are indicated by single letter amino acid abbreviation; "*" indicates any amino acid found in the corresponding position of any of the four sequences; and "-" indicates any amino acid, e.g., any of the 20 naturally occurring amino acids, or absent.

FIGS. 3A-3B show an alignment of the N-terminal RuvC-like domain from the Cas9 molecules disclosed in Chylinski et al (SEQ ID NOS: 54-103, respectively, in order of appearance). The last line of FIG. 3B identifies 4 highly conserved residues.

FIGS. 4A-4B show an alignment of the N-terminal RuvC-like domain from the Cas9 molecules disclosed in Chylinski et al. with sequence outliers removed (SEQ ID NOS: 104-177, respectively, in order of appearance). The last line of FIG. 4B identifies 3 highly conserved residues.

FIGS. 5A-5C show an alignment of the HNH-like domain from the Cas9 molecules disclosed in Chylinski et al (SEQ ID NOS: 178-252, respectively, in order of appearance). The last line of FIG. 5C identifies conserved residues.

FIGS. 6A-6B show an alignment of the HNH-like domain from the Cas9 molecules disclosed in Chylinski et al. with sequence outliers removed (SEQ ID NOS: 253-302, respectively, in order of appearance). The last line of FIG. 6B identifies 3 highly conserved residues.

FIGS. 7A-7B depict an alignment of Cas9 sequences from *S. pyogenes* and *Neisseria meningitidis* (*N. meningitidis*). The N-terminal RuvC-like domain is boxed and indicated with a "Y". The other two RuvC-like domains are boxed and indicated with a "B". The HNH-like domain is boxed and indicated with a "G". Sp: *S. pyogenes*; Nm: *N. meningitidis*. Motif: this is a motif based on the two sequences: residues conserved in both sequences are indicated by a single amino acid designation; "*" indicates any amino acid found in the corresponding position of any of the two sequences; "-" indicates any amino acid, e.g., any of the 20 naturally occurring amino acids, and "-" indicates any amino acid, e.g., any of the 20 naturally occurring amino acids, or absent.

FIG. 8 shows a nucleic acid sequence encoding Cas9 of *N. meningitidis* (SEQ ID NO: 303). Sequence indicated by an "R" is an SV40 NLS; sequence indicated as "G" is an HA tag; and sequence indicated by an "O" is a synthetic NLS sequence; the remaining (unmarked) sequence is the open reading frame (ORF).

FIGS. 9A and 9B are schematic representations of the domain organization of *S. pyogenes* Cas 9. FIG. 9A shows the organization of the Cas9 domains, including amino acid positions, in reference to the two lobes of Cas9 (recognition (REC) and nuclease (NUC) lobes). FIG. 9B shows the percent homology of each domain across 83 Cas9 orthologs.

DETAILED DESCRIPTION

Definitions

Figure 1A:
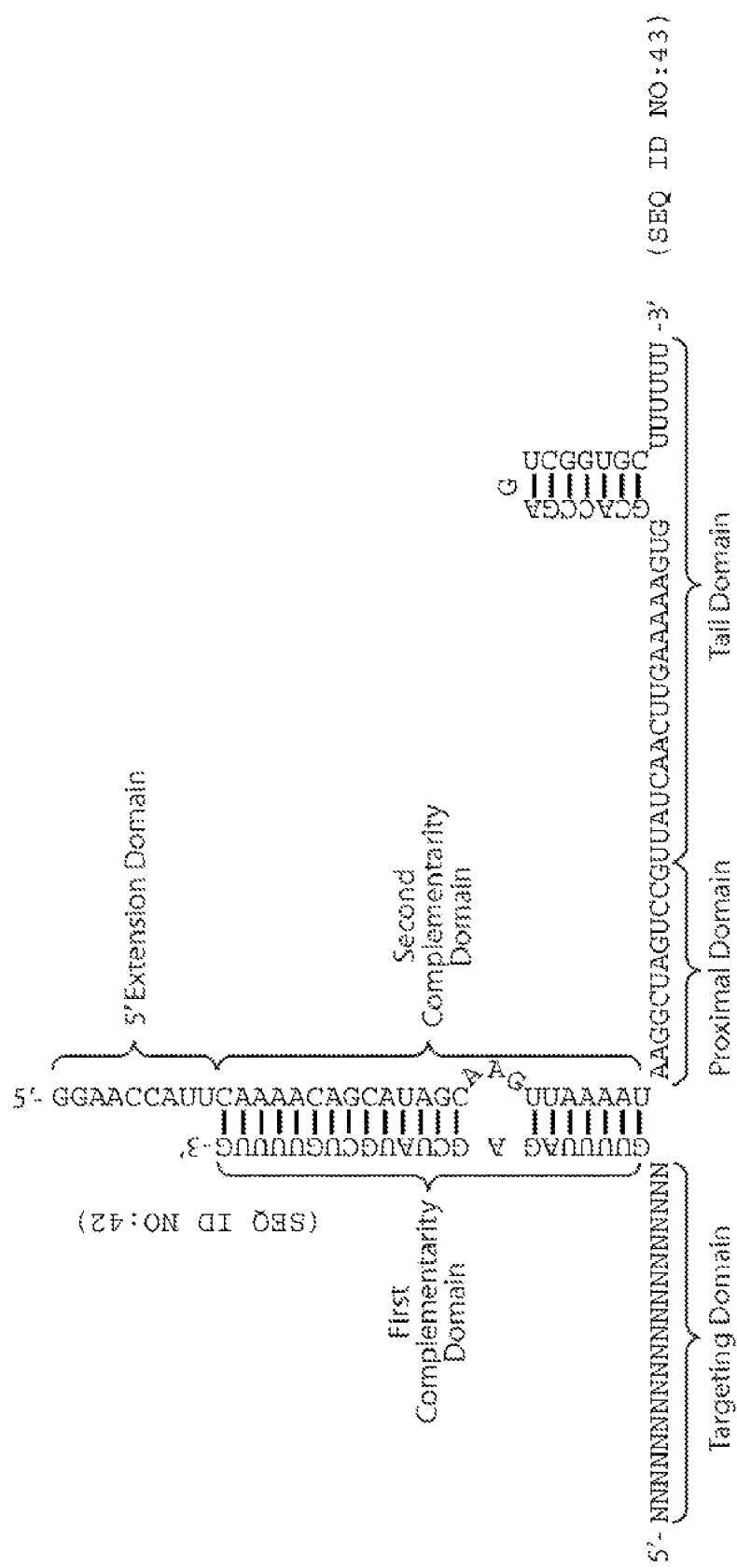

"CF target mutant position", as used herein, refers to a target position in the CFTR gene, which, if mutated, can result in a mutant protein and give rise to CF or CF-like disease. In an embodiment, the target position comprises one, two, or three nucleotides. In an embodiment, the CF target mutant position is a position in the CFTR gene at which a change can give rise to a mutant protein having a mutation at F508, e.g., F508del. In an embodiment, the CF target mutant position is a position in the CFTR gene at which a change can give rise to a mutant protein having a mutation at G551, e.g., G551D. In an embodiment, the CF target mutant position is a position in the CFTR gene at which a change can give rise to a mutant protein having a mutation at G542, e.g., G542X, in the CFTR protein, which corresponds to c.1624G>T in the CFTR gene. In an embodiment, the CF target mutant position is a position in the CFTR gene at which a change can give rise to a mutant protein having a mutation at N1303, e.g., N1303K, in the CFTR protein, which corresponds to c.3909C>G in the CFTR gene. In an embodiment, the CF target mutant position is a position in the CFTR gene at which a change can give rise to a mutant protein having a mutation at R117, e.g., R117H, in the CFTR protein, which corresponds to c.350G>A in the CFTR gene. In an embodiment, the CF target mutant position is a position in the CFTR gene at which a change can give rise to a mutant protein having a mutation at W1282, e.g., W1282X, in the CFTR protein, which corresponds to c. c.3846G>A in the CFTR gene. In an embodiment, the CF target mutant position is a position in the CFTR gene at which a change can give rise to a mutant protein having a mutation at R553, e.g., R553X, in the CFTR protein, which corresponds to c.1657C>T in the CFTR gene. In an embodiment, the CF target mutant position is c.3717+12191, also known as c.3849+10 kb, which corresponds to 3717+12191C>T in the CFTR gene. In an embodiment, the CF target mutant position is c.2657+5, also known as c.2789+5, which corresponds to 2657+5G>A in the CFTR gene. In an embodiment, the CF target mutant position is c.3140-26, also known as c.3272-26, which corresponds to c.3140-26A>G in the CFTR gene. In an embodiment, the CF target mutant position is a position in the SCNN1A gene at which a change can give rise to a mutant protein having a mutation at V114, which corresponds to V114I in the SCNN1A gene.

"CF target knockout position", as used herein, refers to a position in the CFTR and/or SCNN1A gene, which if altered by NHEJ-mediated alteration, results in alleviation of a symptom of CF or CF-like disease. In an embodiment, the alteration restores expression of functional CFTR gene product. In an embodiment, the position is in the CFTR non-coding region, e.g., an intronic region (e.g., the alternation corrects a cryptic splice site). In an embodiment, the alteration results in reduction or elimination of expression of functional SCNN1A gene product. In an embodiment, the position is in the SCNN1A coding region, e.g., an early coding region.

"CF target knockdown position", as used herein, refers to a position in the SCNN1A gene, which if targeted, e.g., by an eiCas9 molecule or an eiCas9 fusion described herein, results in reduction or elimination of expression of functional SCNN1A gene product. In an embodiment, the transcription of the SCNN1A gene is reduced or eliminated. In another embodiment, the chromatin structure of the SCNN1A gene is altered. In an embodiment, the position is in the SCNN1A early coding region sequence. In an embodiment, a position in early coding region of the SCNN1A gene is targeted by an enzymatically inactive Cas9 (eiCas9) molecule or an eiCas9-fusion protein, as described herein.

"CF target knockin position", as used herein, refers to a sequence, which if modified by the insertion of CFTR sequence, results in an optimization of CFTR activity, e.g., by resulting in a CFTR sequence that encodes a protein having wild type activity. Exemplary CF target knockin position include: CFTR sequence within intron 2, into which, e.g., can be introduced CFTR sequence that codes for CFTR exons 3-27; and sequence within CFTR intron 10, into which sequence that codes for CFTR exons 11-27 can be introduced. In an embodiment, a CF target knockin position includes CFTR intronic sequence between a second and a third exon (e.g., intron 2), and CFTR sequence encoding the third exon through the final exon (exon 27), is introduced, resulting in a CFTR sequence that is free of one or more cryptic splice sites and that encodes a CFTR protein having wild type activity. In an embodiment, a CF target knockin position, is a position which is upstream of a mutation, or upstream of an intron having a mutation, and introduction of wild-type CFTR sequence results in a CFTR sequence that is free of the mutation. In an embodiment the CF target knockin position is in CFTR intronic sequence: between exon2 and exon 3; or between exon10 and exon 11. In an embodiment, the resulting CFTR sequence comprises subject sequence upstream from the CF target knockin position and newly introduced sequence downstream from the CF target knockin position, which taken together, encode a CFTR protein having wild type activity. In an embodiment, the point of insertion is 3' to a splice donor site and 5' from a splice acceptor site. In an embodiment, CFTR sequence encoding exons 3-27 is inserted under control of the promoter, e.g., at the transcription start site. In an embodiment, CFTR sequence introduced can exclude introns, e.g., a sequence encoding exons, but without introns, is inserted, e.g., CFTR CDNA sequence is introduced.

"CF target position", as used herein, refers to a CF target mutant position, CF target knockout position, CF target knockdown position, and/or CF target knockin position, as described herein.

"Domain", as used herein, is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Governing gRNA molecule", as used herein, refers to a gRNA molecule that comprises a targeting domain that is complementary to a target domain on a nucleic acid that comprises a sequence that encodes a component of the CRISPR/Cas system that is introduced into a cell or subject. A governing gRNA does not target an endogenous cell or subject sequence. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the CFTR or SCNN1A gene (a target gene gRNA); or on more than one nucleic acid that encodes a CRISPR/Cas component, e.g., both (a) and (b). In an embodiment, a nucleic acid molecule that encodes a CRISPR/Cas component, e.g., that encodes a Cas9 molecule or a target gene gRNA, comprises more than one target domain that is complementary with a governing gRNA targeting domain. While not wishing to be bound by theory, in an embodiment, it is believed that a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In an embodiment, the Cas9 molecule forms two complexes: a complex comprising a Cas9 molecule with a target gene gRNA, which complex will alter the CFTR or SCNN1A gene; and a complex comprising a Cas9 molecule with a governing gRNA molecule, which complex will act to prevent further production of a CRISPR/Cas system component, e.g., a Cas9 molecule or a target gene gRNA molecule. In an embodiment, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In an embodiment, a governing gRNA molecule/Cas9 molecule complex binds to or promotes cleavage of a control region sequence, e.g., a promoter, operably linked to a gRNA molecule, or a sequence that encodes the gRNA molecule. In an embodiment, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In an embodiment, a governing gRNA places temporal, level of expression, or other limits, on activity of the Cas9 molecule/target gene gRNA molecule complex. In an embodiment, a governing gRNA reduces off-target or other unwanted activity. In an embodiment, a governing gRNA molecule inhibits, e.g., entirely or substantially entirely inhibits, the production of a component of the Cas9 system and thereby limits, or governs, its activity.

"Modulator", as used herein, refers to an entity, e.g., a drug, that can alter the activity (e.g., enzymatic activity, transcriptional activity, or translational activity), amount, distribution, or structure of a subject molecule or genetic sequence. In an embodiment, modulation comprises cleavage, e.g., breaking of a covalent or non-covalent bond, or the forming of a covalent or non-covalent bond, e.g., the attachment of a moiety, to the subject molecule. In an embodiment, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

"Polypeptide", as used herein, refers to a polymer of amino acids having less than 100 amino acid residues. In an embodiment, it has less than 50, 20, or 10 amino acid residues.

"Reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of *S. pyogenes, S. aureus* or *S. thermophilus*. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment, the subject is a human. In other embodiments, the subject is poultry.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"X" as used herein in the context of an amino acid sequence, refers to any amino acid (e.g., any of the twenty natural amino acids) unless otherwise specified.

Cystic Fibrosis and CF-Like Disease

Cystic fibrosis (CF) is an autosomal recessive hereditary disease caused by defects in the cystic fibrosis transmembrane conductance regulator (CFTR) gene. The CFTR gene encodes a cAMP-gated channel that is involved in chloride and bicarbonate transport. It regulates sodium transport through inhibition of the epithelial sodium channel, which is encoded by the SCNN1A gene. CFTR is expressed on the apical surface of epithelial cells in the airway, gastrointestinal tract, reproductive tract, sweat glands and submucosal glands.

Subjects having CF or CF-like disease may present at birth or in early infancy with pancreatic insufficiency. Pancreatic dysfunction leads to malabsorption of fat and fat-soluble vitamins, which causes poor growth as well as gallstones and biliary disease. The lung manifestations of the disease can be more severe but may present slightly after pancreatic manifestations, in infancy or early childhood. Aberrant chloride and sodium transport due to decreased CFTR activity causes lowered apical surface fluid levels in the lungs, which leads to "sticky" mucous and lower airway obstruction. Subjects having CF or CF-like disease suffer from frequent infections due to inability to clear mucous. Local inflammatory mediators try to clear the infection but have difficulty. The triad of inflammation, infection and obstruction leads to progressive destruction of the lung parenchyma. Eventually, many subjects having CF or CF-like disease die in their late 30's due to respiratory failure.

Current treatments for CF or CF-like disease can increase the life expectancy of subjects with CF or CF-like disease. These treatments delay lung destruction and slow disease progression. These treatments do not reverse the damage to the lungs or cure CF or CF-like disease. Subjects having CF or CF-like disease eventually suffer from end-stage lung disease.

Treatments for the pulmonary manifestations of CF or CF-like disease include: antibiotics (oral, inhaled and intravenous), CFTR modulators (including CFTR potentiators), DNase, chest physiotherapy to loosen secretions and anti-inflammatory therapeutics. Treatment of the gastrointestinal manifestations includes supplemental gut soluble vitamins, high calorie diet and oral pancreatic enzymes. Subjects who develop diabetes are treated with insulin injections or an insulin pump. At the end stage, patients may benefit from lung transplant. Lung transplant may be combined with liver and/or pancreatic transplant. The average life expectancy for subjects having CF or CF-like disease is nearing 40 years of age.

Methods and compositions discussed herein provide for the treatment and prevention of Cystic Fibrosis (CF) and CF-like disease. The approach described herein aims to restore CFTR channel function, restore chloride, bicarbonate and/or sodium balance, and/or decrease mucous viscosity within the lungs, airways, gastrointestinal tract and reproductive tract.

CFTR modulators (both approved and in development) improve the functioning of mutant CFTR. These therapeutics improve CFTR functioning but do not return functionality to wild type levels. The approach described herein is expected to restore CFTR function through complete correction of the gene.

Gene therapy approaches are in development that deliver the CFTR channel gene to the lungs of CF patients. However, gene therapy may require constant readministration over the course of the lifetime of a subject due to high cell turnover in target epithelial cells. The approach described herein is expected to restore CFTR function and/or ameliorate SCNN1A disinhibition permanently through one, two or several doses.

The CFTR gene encodes a 180-kDA cAMP-gated chloride (Cl—) channel. The channel has six transmembrane spanning domains and is expressed by epithelial cells, lymphocytes and cardiac myocytes. The CFTR regulates the viscosity of mucous through its activity in the epithelial cells of the lungs, gastrointestinal tract and reproductive tract. Mutations in the CFTR result in decreased CFTR activity. Decreased CFTR activity can lead to aberrant ion transport, which gives rise to various disease symptoms in the lungs and other tissues, such as accumulation of sticky mucus, airway obstruction, infection and inflammation. Correction of CFTR mutations will ameliorate or cure lung, gastrointestinal and/or reproductive symptoms of CF.

The SCNN1A gene encodes the alpha subunit of the epithelial sodium channel (ENaC). The channel, comprised of alpha, beta and gamma subunits, regulates sodium transport into epithelial cells, including the epithelium of the lungs, sweat glands and kidneys. Mutations in the SCNN1A gene, (e.g. Val114ILE) have been shown to cause CF-like disease, characterized by pulmonary disease, including bronchiectasis. Mutations in SCNN1A also cause pseudohypoaldosteronism, a severe disease of the kidney. Pseudohypoaldosteronism is due to defective sodium transport within kidney epithelial cells; it is not caused by defective sodium transport in other tissues. The methods described herein include the targeted knockout of SCNN1A in the lung, gastrointestinal tract and/or reproductive tract. The methods described herein will not target kidney epithelium and will avoid the negative consequences of SCNN1A mutations within the kidney epithelium. One mutation in the SCNN1A gene, a 1477T>G substitution (W493R) has been identified in subjects who also have a mutation in CFTR. This mutation is associated with a severe CF phenotype, including severe bronchiectasis, chronic bronchitis and/or severe gastrointestinal symptoms. This mutation has been found to be associated with 4-fold overactivity of the ENaC channel (Azad et al., 2009; Human Mutation 30: 1093-1103). Overactivity of the SCNN1A-encoded ENaC channel can contribute to CF and CF-like disease. In all subjects, the CFTR is involved in inhibition of ENaC. CFTR mutations in subjects with CF or CF-like disease leads to ENaC disinhibition, leading to overactivity of the ENaC channel. ENaC overactivity can lead to further reduction in viscosity of mucous in CF or CF-like disease subjects, as more sodium is absorbed at the apical surface of epithelial cells, followed by increased fluid absorption from the mucous layer within the lung (Baker et al., 2012; Medicine & Science in Sports and Exercise 44(12): 2315-2321). Increased fluid absorption from the mucous layer reduces mucous viscosity. Inhibition of ENaC through SCNN1A knockout and/or knockdown in subjects with CF or CF-like disease can ameliorate the symptoms of CF or CF-like disease.

One common mutation in the CFTR gene is a deletion of the three nucleotides encoding Phenylalanine (F) at position 508 of the CFTR protein F508del (also sometime referred to herein as "F508del" or "delF508"). This mutation is the causative mutation in approximately two-thirds of CF cases. The remaining cases are caused by at least 1000 different mutations, many of which cause a less severe form of the disease.

Overactivity of the SCNN1A gene has been shown to contribute to bronchiectasis, bronchitis, and gastrointestinal symptoms in subjects with CF and in subjects with CF-like disease. In another aspect, methods and compositions discussed herein may be used to alter the SCNN1A gene (also known as sodium channel, non-voltage-gated 1 alpha subunit; amiloride-sensitive epithelial sodium channel alpha subunit; BESC2; ENaCa; SCNEA; SCNN1; ENaCalpha) to treat or prevent CF or CF-like disease, by targeting the SCNN1A gene, e.g., the non-coding or coding regions, e.g., a promoter region, or a transcribed sequence, e.g., intronic or exonic sequence. In an embodiment, the target position is V114, which corresponds to V114I in the SCNN1A gene. SCNN1A encodes an epithelial sodium channel, ENaC, that is negatively regulated by CFTR. In subjects with CFTR mutations, knocking out or knocking down the SCNN1A gene in certain cells will reduce or reverse the effect of defective CFTR. In subjects with no CFTR mutations but CF-like disease caused by SCNN1A mutations or other mechanisms, knocking out or knocking down the SCNN1A gene in certain cells will improve the viscosity of mucous and ameliorate disease.

Methods to Treat or Prevent Cystic Fibrosis and Cystic Fibrosis-Like Disease

Correction of the CFTR mutation (e.g., F508 deletion, e.g., G551D substitution, e.g., G542X nonsense mutation, e.g., N1303K substitution, e.g., R117H substitution, e.g., W1282X nonsense mutation, e.g., R553X nonsense mutation, e.g., 3849+10 kbC>T substitution, e.g., 2789+5G>A substitution, e.g., 3273-26A>G substitution) or inactivation or knockdown of the SCNN1A gene, e.g., using the methods disclosed herein, can ameliorate the disease. In an embodiment, the method leads to normalized ion transport, less viscous mucous, and/or reduced mucous plugging and inflammation, e.g., early in the disease course. In an embodiment, the method results in fewer infections, decreased lung tissue destruction, and/or slowing in progression of disease.

In an embodiment, the method improves mucous production and/or reduce frequency and/or length of infections, e.g., in later stages of the disease. In an embodiment, the method reduces or prevents further damage by ameliorating the triad of inflammation, infection and obstruction. In an embodiment, the method delays progression of the disease. In an embodiment, the method reduces or prevents further damage by ameliorating the triad of inflammation, infection and obstruction. In an embodiment, the method leads to normalized ion transport, and restoration of fertility. In an embodiment, the method leads to normalized ion transport, and improved gastrointestinal motility, absorption, and/or function.

Disclosed herein are the approaches to treat or prevent CF or CF-like disease, using the compositions and methods described herein.

While not wishing to be bound by theory, it is believed that, in an embodiment described herein, the CFTR channel is corrected and chloride and bicarbonate balance restored, e.g., within the lung, e.g., within the airway, e.g., within the gastrointestinal tract, e.g., within the reproductive tract, e.g., in the hepatobiliary epithelium, e.g. in the pancreas. CFTR modulators (both approved and in development) improve the functioning of mutant CFTR. These therapeutics improve CFTR functioning but do not return functionality to wild type levels.

In an embodiment, the approach described herein restores CFTR function through complete correction of the CFTR gene. In another embodiment, the approach described herein inactivates the SCNN1A gene, e.g., in the pulmonary epithelium, e.g., in the airway epithelium, e.g., in the gastrointestinal epithelium, e.g. in the reproductive epithelium, e.g., in the hepatobiliary epithelium, e.g. in the pancreatic ducts, in order to inhibit the abnormal sodium ion transport associated with reduced CFTR activity and/or in order to inhibit abnormal sodium ion transport associated with overactive ENaC activity. In an embodiment, these two approaches are combined to treat or prevent CF or CF-like disease. In an embodiment, the approaches described herein provide advantages over CFTR modulators.

It is contemplated that the compositions disclosed herein may be administered once or more than once (e.g., 2, 3, 4, 5, or more times) to correct a mutation in the CFTR gene or to inactivate or knock-down the SCNN1A gene. It is further contemplated that when the compositions disclosed herein are administered more than one time that the multiple administrations are intended to increase the number of cells (e.g., the number of cells in the subject) containing the corrected form of the CFTR gene and/or the inactivated/knocked-down form of the SCNN1A gene, thereby increasing the effectiveness of the treatment.

The methods of treatment described herein can be initiated for subjects at all stages of the disease. In an embodiment, the treatment is initiated after disease onset, e.g., as the subject presents with lung infections, wheezing and obstructed airways, and/or pancreatic insufficiency, decreased gastrointestinal function, malabsorption, and/or infertility. While not wishing to be bound by theory, in an embodiment, repair of the CFTR gene or inactivation/knock-down of the SCNN1A gene after disease onset but early in the disease course reduces or prevents progression of the disease. In an embodiment, the method comprises treating a subject with advanced disease. In an embodiment, the method reduces or prevents further progression of symptoms, with or without reversing pathology.

In an embodiment, the treatment is initiated prior to disease onset. In another embodiment, the treatment is initiated at an early stage of the disease, e.g., before the subject has noticed any decline in function or symptoms.

In an embodiment, treatment is initiated in utero.

In an embodiment, treatment is initiated after birth.

In an embodiment, treatment is initiated prior to the age of 1.

In an embodiment, treatment is initiated prior to the age of 2.

In an embodiment, treatment is initiated prior to the age of 5.

In an embodiment, treatment is initiated prior to the age of 10.

In an embodiment, the subject has tested positive for a mutation in the CFTR gene, e.g., a mutation described herein.

In an embodiment, the subject has tested positive for a mutation in the SCNN1A gene, e.g., a mutation described herein.

In an embodiment, the treatment is initiated at appearance of a symptom of CF or CF-like disease, e.g., any of the following symptoms: frequent lung infections, chronic cough, sputum production, or chronic wheeze. In an embodiment, the subject has a positive "sweat test" or elevated sweat Chloride indicating dysfunction of the CFTR channel and/or overactivity of the SCNN1A channel. In an embodiment, the subject has an elevated sweat Chloride, bronchiectasis and is found to have no mutation in the CFTR gene.

In an embodiment, the treatment is initiated if the subject is tested positive for a defect, e.g., a genetic defect, in the CFTR gene.

In an embodiment, the treatment is initiated if the subject is tested positive for a defect, e.g., a genetic defect, in the SCNN1A gene.

In an embodiment, the treatment is initiated if a family member of the subject has been diagnosed with CF or CF-like disease. In an embodiment, the subject has a symptom or sign of CF or CF-like disease. In an embodiment, the subject has a mutation in the CFTR gene, e.g., a mutation described herein.

In an embodiment, the treatment is initiated at the appearance of any of the following findings consistent with CF or CF-like disease, including but not limited to, obstructive lung disease on lung function tests; persistent colonization with *B. cepacia*, *P. aeruginosa* and *S. aureus* and other CF-related pathogens; chronic radiologic abnormalities on chest x-ray; or chronic sinusitis.

In an embodiment, the method comprises initiating treatment at the appearance of any of the following gastrointestinal findings consistent with CF or CF-like disease, including but not limited to: failure to thrive, steatorrhea, hypoproteinemia, vitamin deficiency due to fat-soluble vitamin malabsorption, meconium ileus, rectal prolapse, malabsorption, pancreatic insufficiency, pancreatitis, or chronic hepatobiliary disease. Evidence of chronic hepatobiliary disease can include, e.g., elevated transaminases and/or hyperbilirubinemia.

In an embodiment, a cell is treated ex vivo. In an embodiment, the cell is returned to the subject.

In an embodiment, it is contemplated herein that a population of cells from a subject may be contacted ex vivo to correct a mutation in the CFTR gene, e.g., F508del, e.g., G542X, e.g., G551D, e.g., N1303K, e.g., R117H, e.g., W1282X, e.g., R553X, e.g., 3849+10 kbC>T, e.g., 2789+5G>A, e.g., 3273-26A>G, and a second population of cells from the subject is contacted ex vivo to introduce a mutation in the SCNN1A gene to knockout or knockdown SCNN1A.

A mixture of the two cell populations may be returned to the subject's body to prevent or treat CF or CF-like disease.

In an embodiment, the cell is harvested from epidermis, pulmonary tree, hepatobiliary tree, gastrointestinal tract, reproductive tract, or other organ. In an embodiment, the cell is reprogrammed to an induced pluripotent stem (iPS) cell. In an embodiment, the iPS cell is differentiated into airway epithelium, pulmonary epithelium, submucosal glands, submucosal ducts, biliary epithelium, gastrointestinal epithelium, pancreatic duct cells, reproductive epithelium, epidydimal cells, and/or cells of the hepatobiliary tree, e.g., clara cells, e.g., ciliated cells, e.g., goblet cells, e.g., basal cells, e.g., acinus cells, e.g., bronchioalveolar stem cell e.g., lung epithelial cells, e.g., nasal epithelial cells, e.g., tracheal epithelial cells, e.g., bronchial epithelial cells, e.g., enteroendocrine cells, e.g., Brunner's gland cells, e.g., epididymal epithelium. In an embodiment, the CFTR gene in the cell is corrected with the method described herein. In an embodiment, the SCNN1A gene in the cell is corrected with the method described herein. In an embodiment, the CFTR gene and the SCNN1A gene in the cell is corrected with the method described herein. In an embodiment, the cell is re-introduced into an appropriate location in the subject, e.g., airway, pulmonary tree, bile duct system, gastrointestinal tract, pancreas, hepatobiliary tree, and/or reproductive tract.

In an embodiment, an autologous stem cell can be treated ex vivo, differentiated into airway epithelium, pulmonary epithelium, submucosal glands, submucosal ducts, biliary epithelium, gastrointestinal epithelium, pancreatic duct cells, reproductive epithelium, epidydimal cells, and/or cells of the hepatobiliary tree, e.g., clara cells, e.g., ciliated cells, e.g., goblet cells, e.g., basal cells, e.g., acinus cells, e.g., bronchioalveolar stem cell e.g., lung epithelial cells, e.g., nasal epithelial cells, e.g., tracheal epithelial cells, e.g., bronchial epithelial cells, e.g., enteroendocrine cells, e.g., Brunner's gland cells, e.g., epididymal epithelium, and transplanted into the subject.

In an embodiment, a heterologous stem cell can be treated ex vivo, differentiated into airway epithelium, pulmonary epithelium, submucosal glands, submucosal ducts, biliary epithelium, gastrointestinal epithelium, pancreatic duct cells, reproductive epithelium, epidydimal cells, and/or cells of the hepatobiliary tree, e.g., clara cells, e.g., ciliated cells, e.g., goblet cells, e.g., basal cells, e.g., acinus cells, e.g., bronchioalveolar stem cell e.g., lung epithelial cells, e.g., nasal epithelial cells, e.g., tracheal epithelial cells, e.g., bronchial epithelial cells, e.g., enteroendocrine cells, e.g., Brunner's gland cells, e.g., epididymal epithelium, and transplanted into the subject.

In an embodiment, the method described herein comprises delivery of gRNA or other components described herein, e.g., a Cas9 molecule and a template nucleic acid, by inhalation, e.g., via nebulizer. In an embodiment, the method described herein comprises delivery of gRNA or other components described herein, e.g., a Cas9 molecule and a template nucleic acid by intravenous administration. In an embodiment, the method described herein comprises delivery of gRNA or other components described herein, e.g., a Cas9 molecule and a template nucleic acid by intraparenchymal injection into lung tissue. In an embodiment, the method described herein comprises delivery of gRNA or other components described herein, e.g., a Cas9 molecule and a template nucleic acid, by intraparenchymal, intralveolar, intrabronchial, intratracheal injection into the trachea, bronchial tree and/or alveoli. In an embodiment, the method described herein comprises delivery of gRNA or other components described herein, e.g., a Cas9 molecule and a template nucleic acid, by intravenous, intraparenchymal or other directed injection or administration to any of the following locations: the portal circulation, liver parenchyma, pancreas, pancreatic duct, bile duct, jejunum, ileum, duodenum, stomach, upper intestine, lower intestine, gastrointestinal tract, epididymis, or reproductive tract.

In an embodiment, a gRNA or other components described herein, e.g., a Cas9 molecule and a template nucleic acid are delivered, e.g., to a subject, by AAV, e.g., via nebulizer, or via nasal spray or inhaled, with or without accelerants to aid in absorption. In an embodiment, a gRNA or other components described herein, e.g., a Cas9 molecule and a template nucleic acid are delivered, e.g., to a subject, by Sendai virus, adenovirus, lentivirus or other modified or unmodified viral delivery particle.

In an embodiment, a gRNA or other components described herein, e.g., a Cas9 molecule and a template nucleic acid are delivered, e.g., to a subject, via nebulizer or jet nebulizer, nasal spray, or inhalation. In an embodiment, a gRNA or other components described herein, e.g., a Cas9 molecule and a template nucleic acid, is formulated in an aerosolized cationic liposome, lipid nanoparticle, lipoplex, non-lipid polymer complex or dry powder, e.g., for delivery via nebulizer, with or without accelerants to aid in absorption.

In an embodiment, a gRNA or other components described herein, e.g., a Cas9 molecule and a template nucleic acid are delivered, e.g., to a subject, via liposome GL67A. GL67A is described, e.g., www.cfgenetherapy.org.uk/clinical/product.html; Eastman et al., Hum Gene Ther. 1997 Apr. 10; 8(6):765-73.

Disclosed herein are methods for altering the CF target position in the CFTR and/or SCNN1A genes.

Methods and compositions disclosed herein provide a number of approaches for treating or preventing CF and CF-like disease. In an embodiment, methods described herein provide for treating or preventing CF and CF-like disease by correcting a target position in the CFTR gene to provide corrected, or functional, e.g., wild type, CFTR. In an embodiment, methods described herein allow for treating or preventing CF and CF-like disease by inducing or introducing a mutation that reduces the level of functional SCNN1A gene product. In subjects with CF or CF-like disease, these methods can be used alone, e.g. CFTR correction, e.g., SCNN1A knockout or knockdown, or in combination, e.g., CFTR correction with SCNN1A knockout or knockdown.

Several approaches are detailed in the following, including target positions and mutations amenable to approach. In the description below, approaches 1, 2 and 3 (e.g., 3A and 3B) correspond to methods to alter CFTR. In the description below, approach 4 and 6 correspond to methods to alter SCNN1A. One or more of the approaches can be used alone or in combination. For example, approaches 1, 2, and 3 can be used alone or approach 1 can be combined with approach 4, or approach 2 can be combined with approach 4 or approach 3 (e.g., 3A or 3B) can be combined with approach 4.

Methods to Alter CFTR

In one aspect, methods and compositions discussed herein, provide for the correction of the underlying cause of CF or CF-like disease, e.g., the correction of a mutation at a target position in the CFTR gene.

As disclosed herein, the CFTR gene can be altered by gene editing, e.g., using CRISPR-Cas9 mediated methods as described herein. Methods and compositions discussed herein, provide for altering a CF target position in the CFTR gene. A CF target position can be altered by gene editing, e.g., using CRISPR-Cas9 mediated methods to alter the CFTR gene.

In an embodiment, while some of the disclosure herein is presented in the context of the mutation in the CFTR gene that gives rise to an F508 mutant protein (e.g., F508del mutant protein) or a G551 mutant protein (e.g., G551D mutant protein), or a G542 mutant protein (e.g., G542X mutant protein), or a mutant protein (e.g., mutant protein), or a N1303 mutant protein (e.g., N1303K mutant protein), or a R117 mutant protein (e.g., R117H mutant protein), or a W1282 mutant protein (e.g., W1282X mutant protein), or a R553 mutant protein (e.g., R553X mutant protein), or a c.3717+12191 mutant protein (e.g., c.3717+12191C>T mutant protein), or a c.2657+5 mutant protein (e.g., c.2657+5G>A mutant protein), or a c.3140-26 mutant protein (e.g., c.3140-26A>G mutant protein), the methods and compositions herein are broadly applicable to any mutation, e.g., a point mutation or a deletion, in the CFTR gene that gives rise to CF or CF-like disease.

The alteration of the CFTR gene can be mediated by any mechanism. Exemplary mechanisms that can be associated with the alteration of the CFTR gene include, but are not limited to, non-homologous end joining (e.g., classical or alternative), microhomology-mediated end joining (MMEJ), homology-directed repair (e.g., endogenous donor template mediated), SDSA (synthesis dependent strand annealing) or single strand annealing or single strand invasion, all with or without the addition of an endogenous-promoter driven cDNA encoding the CFTR gene.

Approach 1:

In an embodiment, one approach to treat or prevent CF or CF-like disease is to repair (i.e., correct) one or more mutations in the CFTR gene, e.g., by HDR. While not wishing to be bound by theory, it is believed that correction of the mutation(s) (e.g., mediated by HDR) restore the mutant CFTR gene to its wild type state. In an embodiment, single stranded oligonucleotides (ssODNs) are used as a donor template. In another embodiment, double stranded DNA donor is used as a donor template. Donor templates contain DNA sequence which, upon incorporation, result in the expression of a functional version of the CFTR protein. In an embodiment, one CFTR allele is repaired in the subject. In another embodiment, both CFTR alleles are repaired in the subject. In one aspect, methods and compositions discussed herein, provide for the correction of the underlying genetic cause of CF or CF-like disease, e.g., the correction of a mutation at a target position in the CFTR gene, e.g., correction of a mutation (e.g., delF508, G551DG542X, N1303K, R117H, W1282X, or R553X) in the CFTR gene.

Mutations in the CFTR gene amenable to the approach described herein include, but are not limited to any of the following mutations, e.g., F508del, G551D, G542X, N1303K, R117H, W1282X, or R553X.

In an embodiment, the homology-directed repair of genomic sequence including the mutation at the CF target position (e.g., F508del, G551D, G542X, N1303K, R117H, W1282X, or R553X) gives rise to alteration of the CFTR gene. This approach leads to the cessation of production of mutant CFTR channel and results in the production of wild-type CFTR channel. This approach will prevent the development or progression of lung, gastrointestinal and/or reproductive disease in subjects with CFTR mutations.

In an embodiment, the method provides for the correction of a mutation at a target position in the CFTR gene, e.g., correction of a mutation, e.g., an F508del, G551D, G542X, N1303K, R117H, W1282X, or R553X substitution in the CFTR gene. As described herein, in an embodiment, the method comprises the introduction of one or more breaks (e.g., single strand breaks or double strand breaks) sufficiently close to (e.g., either 5' or 3' to) the target position in the CFTR gene, e.g., F508del, G551D, G542X, N1303K, R117H, W1282X, or R553X.

In an embodiment, the targeting domain of the gRNA molecule is configured to provide a cleavage event, e.g., a double strand break or a single strand break, sufficiently close to (e.g., either 5' or 3' to) the target position in the CFTR gene, e.g., F508del, G551D, G542X, N1303K, R117H, W1282X, or R553X to allow correction, e.g., an alteration in the CFTR gene, e.g., an alternation associated with HDR. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the CFTR gene, e.g., F508del, G551D, G542X, N1303K, R117H, W1282X, or R553X. The break, e.g., a double strand or single strand break, can be positioned upstream or downstream of the target position in the CFTR gene, e.g., F508del, G551D, G542X, N1303K, R117H, W1282X, or R553X.

In an embodiment, a second, third and/or fourth gRNA molecule is configured to provide a cleavage event, e.g., a double strand break or a single strand break, sufficiently close to (e.g., either 5' or 3' to) the target position in the CFTR gene, e.g., F508del, G551D, G542X, N1303K, R117H, W1282X, or R553X to allow correction, e.g., an alteration associated with HDR in the CFTR gene. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the CFTR gene, e.g., F508del, G551D, G542X, N1303K, R117H, W1282X, or R553X. The break, e.g., a double strand or single strand break, can be positioned upstream or downstream of the target position in the CFTR gene, e.g., F508del, G551D, G542X, N1303K, R117H, W1282X, or R553X.

In an embodiment, a single strand break is accompanied by an additional single strand break, positioned by a second, third and/or fourth gRNA molecule, as discussed below. For example, The targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the CFTR gene, e.g., F508del, G551D, G542X, N1303K, R117H, W1282X, or R553X. In an embodiment, the first and second gRNA molecules are configured such, that when guiding a Cas9 nickase, a single strand break will be accompanied by an additional single strand break, positioned by a second gRNA, sufficiently close to one another to result in an alteration of the target position in the CFTR gene, e.g., F508del, G551D, G542X, N1303K, R117H, W1282X, or R553X. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In an embodiment, a double strand break can be accompanied by an additional double strand break, positioned by a second, third and/or fourth gRNA molecule, as is discussed below. For example, the targeting domain of a first gRNA molecule is configured such that a double strand break is positioned upstream of the target position in the CFTR gene, e.g., F508del, G551D, G542X, N1303K, R117H, W1282X, or R553X, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domain of a second gRNA molecule is configured such that a double strand break is positioned downstream the target position in the CFTR gene, e.g., F508del, G551D, G542X, N1303K, R117H, W1282X, or R553X, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position.

In an embodiment, a double strand break can be accompanied by two additional single strand breaks, positioned by a second gRNA molecule and a third gRNA molecule. For example, the targeting domain of a first gRNA molecule is configured such that a double strand break is positioned upstream of the target position in the CFTR gene, e.g., F508del, G551D, G542X, N1303K, R117H, W1282X, or R553X, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domains of a second and third gRNA molecule are configured such that two single strand breaks are positioned downstream of the target position in the CFTR gene, e.g., F508del, G551D, G542X, N1303K, R117H, W1282X, or R553X, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position. In an embodiment, the targeting domain of the first, second and third gRNA molecules are configured such that a cleavage event, e.g., a double strand or single strand break, is positioned, independently for each of the gRNA molecules.

In an embodiment, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of the target position in the CFTR gene, e.g., F508del, G551D, G542X, N1303K, R117H, W1282X, or R553X, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the CFTR gene, e.g., F508del, G551D, G542X, N1303K, R117H, W1282X, or R553X; and the targeting domains of a third and fourth gRNA molecule are configured such that two single strand breaks are positioned downstream of the target position in the CFTR gene, e.g., F508del, G551D, G542X, N1303K, R117H, W1282X, or R553X, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the CFTR gene, e.g., F508del, G551D, G542X, N1303K, R117H, W1282X, or R553X.

In an embodiment, a single strand break is introduced (e.g., positioned by one gRNA molecule) at or in close proximity to a CF target position in the CFTR gene. In an embodiment, a single gRNA molecule (e.g., with a Cas9 nickase) is used to create a single strand break at or in close proximity to the CF target position, e.g., the gRNA is configured such that the single strand break is positioned either upstream (e.g., within 200 bp upstream) or downstream (e.g., within 200 bp downstream) of the CF target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a CF target position in the CFTR gene. In an embodiment, a single gRNA molecule (e.g., with a Cas9 nuclease other than a Cas9 nickase) is used to create a double strand break at or in close proximity to the CF target position, e.g., the gRNA molecule is configured such that the double strand break is positioned either upstream (e.g., within 200 bp upstream) or downstream of (e.g., within 200 bp downstream) of a CF target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a CF target position in the CFTR gene. In an embodiment, two gRNA molecules (e.g., with one or two Cas9 nickcases) are used to create two single strand breaks at or in close proximity to the CF target position, e.g., the gRNAs molecules are configured such that both of the single strand breaks are positioned upstream (e.g., within 200 bp upstream) or downstream (e.g., within 200 bp downstream) of the CF target position. In another embodiment, two gRNA molecules (e.g., with two Cas9 nickcases) are used to create two single strand breaks at or in close proximity to the CF target position, e.g., the gRNAs molecules are configured such that one single strand break is positioned upstream (e.g., within 200 bp upstream) and a second single strand break is positioned downstream (e.g., within 200 bp downstream) of the CF target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a CF target position in the CFTR gene. In an embodiment, two gRNA molecules (e.g., with one or two Cas9 nucleases that are not Cas9 nickases) are used to create two double strand breaks to flank a CF target position, e.g., the gRNA molecules are configured such that one double strand break is positioned upstream (e.g., within 200 bp upstream) and a second double strand break is positioned downstream (e.g., within 200 bp downstream) of the CF target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a CF target position in the CFTR gene. In an embodiment, three gRNA molecules (e.g., with a Cas9 nuclease other than a Cas9 nickase and one or two Cas9 nickases) to create one double strand break and two single strand breaks to flank an CF target position, e.g., the gRNA molecules are configured such that the double strand break is positioned upstream or downstream of (e.g., within 200 bp upstream or downstream) of the CF target position, and the two single strand breaks are positioned at the opposite site, e.g., downstream or upstream (within 200 bp downstream or upstream), of the CF target position. In an embodiment, the breaks are positioned to avoid unwanted target chromosome elements, such as repeat elements, e.g., an Alu repeat.

In an embodiment, four single strand breaks are introduced (e.g., positioned by four gRNA molecules) at or in close proximity to a CF target position in the CFTR gene. In an embodiment, four gRNA molecule (e.g., with one or more Cas9 nickases are used to create four single strand breaks to flank an CF target position in the CFTR gene, e.g., the gRNA molecules are configured such that a first and second single strand breaks are positioned upstream (e.g., within 200 bp upstream) of the CF target position, and a third and a fourth single stranded breaks are positioned downstream (e.g., within 200 bp downstream) of the CF target position. In an embodiment, the breaks are positioned to avoid unwanted target chromosome elements, such as repeat elements, e.g., an Alu repeat.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

Approach 2:

HDR-mediated knockin of cDNA to alter the CFTR gene. In an embodiment, a CF target knockin position is altered. Altering the CF target knockin position refers to homology-directed knockin of genomic sequence, including the delivery of cDNA template of contiguous exons (X+1) through exon 27 of CFTR gene, wherein exon X is any exon between exon 1 and exon 27. Targeted knockin of CFTR cDNA leads to the cessation of production of mutant or truncated CFTR protein and results in the production of functional CFTR protein. In an embodiment, a donor template is provided to mediate HDR-mediated knockin. In an embodiment, said donor template comprise homology arms, splice acceptor, contiguous coding sequence of exons (X+1) through exon 27 of CFTR gene and polyadenylation signal. While not wishing to be bound by theory, it is believed that correction of the mutation(s) (e.g., mediated by HDR) restore the mutant CFTR gene to its wild type state. In another embodiment, double stranded DNA donor is used as a donor template. Donor templates contain DNA sequence which, upon incorporation, would result in the expression of a functional version of the CFTR protein. In an embodiment, one CFTR allele is repaired in the subject. In another embodiment, both CFTR alleles are repaired in the subject. In one aspect, methods and compositions discussed herein, provide for the correction of the underlying genetic cause of CF or CF-like disease, e.g., the correction of a mutation at a CF target position in the CFTR gene, e.g., correction of a mutation. This approach leads to the cessation of production of mutant or truncated CFTR protein and results in the production of functional CFTR protein. This approach prevents the development or progression of lung, gastrointestinal and/or reproductive disease in a subject due to the cessation of production of mutant CFTR protein and restoration of functional CFTR protein production. This approach cures and/or prevents the progression of lung, gastrointestinal and/or reproductive disease in any subject with CF or CF-like disease deficiency who has a mutation in exon (X+1) through exon 27 of the CFTR gene, or in any subject who has a mutation in an intronic or exonic region of the CFTR gene that is after exon X.

In an embodiment, homology-directed repair of the CFTR gene in any subjects with CF mutations in exons 3 through 27 and introns 2 through 26 by targeting intronic region between exons 2 and 3 and with delivery of a homology-directed repair template including homology arms, splice acceptor, coding sequence of contiguous exons 3-27 of CFTR gene and polyadenylation signal.

In an embodiment, the CF target position is the intronic region between exons 2 and 3. Altering the CF target position refers to homology-directed repair of genomic sequence including the delivery of cDNA template of exons 3-27 of CFTR gene. This approach cures and/or prevents the progression of lung, gastrointestinal and/or reproductive disease in any subject with CF or CF-like disease deficiency who has a mutation in exons 3-27 of the CFTR gene, or in any subject who has a mutation in an intronic or exonic region of the CFTR gene that is on or after the second intron, including but not limited to the following mutations: e.g., F508del, G551D, G542X, N1303K, R117H, W1282X, R553X, c.3717+12191C>T, 2657+5G>A, or c.3140-26A>G.

In an embodiment, the CF target position is the intronic region between exons 10 and 11. Altering the CF target position refers to homology-directed repair of genomic sequence including the delivery of cDNA template of exons 11-27 of CFTR gene. This approach cures and/or prevents the progression of lung, gastrointestinal and/or reproductive disease in any subject with CF or CF-like disease deficiency who has a mutation in exons 11-27 of the CFTR gene, or in any subject who has a mutation in an intronic or exonic region of the CFTR gene that is on or after the second intron, including but not limited to the following mutations: e.g., F508del.

In an embodiment, the method provides for the correction of a mutation at a target position in the CFTR gene, e.g., F508del, G551D, G542X, N1303K, R117H, W1282X, R553X, c.3717+12191C>T, 2657+5G>A, or c.3140-26A>G. As described herein, in one embodiment, the method comprises the introduction of one or more breaks (e.g., single strand breaks or double strand breaks) sufficiently close to (e.g., either 5' or 3' to) the target position in the CFTR gene, e.g., intron 2 or intron 10.

In an embodiment, the targeting domain of the gRNA molecule is configured to provide a cleavage event, e.g., a double strand break or a single strand break, sufficiently close to (e.g., either 5' or 3' to) the target position e.g., intron 2 or intron 10 allow correction, e.g., an alteration in the CFTR gene, e.g., an alternation associated with HDR. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, or 200 nucleotides of the target position in the CFTR gene, e.g., intron 2 or intron 10. The break, e.g., a double strand or single strand break, can be positioned upstream or downstream of the target position in the CFTR gene, e.g., intron 2 or intron 10.

In an embodiment, a second, third and/or fourth gRNA molecule is configured to provide a cleavage event, e.g., a double strand break or a single strand break, sufficiently close to (e.g., either 5' or 3' to) the target position e.g., intron 2 or intron 10 to allow correction, e.g., an alteration associated with HDR in the CFTR gene. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, or 200 nucleotides of the target position in the CFTR gene, e.g., intron 2 or intron 10. The break, e.g., a double strand or single strand break, can be positioned upstream or downstream of the target position in the CFTR gene, e.g., intron 2 or intron 10.

In an embodiment, a single strand break is accompanied by an additional single strand break, positioned by a second, third and/or fourth gRNA molecule, as discussed below. For example, The targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150, or 200 nucleotides of the target position in the CFTR gene, e.g., intron 2 or intron 10. In an embodiment, the first and second gRNA molecules are configured such, that when guiding a Cas9 nickase, a single strand break will be accompanied by an additional single strand break, positioned by a second gRNA, sufficiently close to one another to result in an alteration of the target position in the CFTR gene, e.g., intron 2 or intron 10. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In an embodiment, a double strand break can be accompanied by an additional double strand break, positioned by a second, third and/or fourth gRNA molecule, as is discussed below. For example, the targeting domain of a first gRNA molecule is configured such that a double strand break is positioned upstream of the target position in the CFTR gene, e.g., intron 2 or intron 10, e.g., within 1, 2, 3, 4, 5, 10, 15, 20, 25, 30, 35, 40, 45, 50, 60, 70, 80, 90, 100, 150, or 200 nucleotides of the target position; and the targeting domain of a second gRNA molecule is configured such that a double strand break is positioned downstream the target position in the CFTR gene, e.g., intron 2 or intron 10, e.g., within 1, 2, 3, 4, 5, 10, 15, 20, 25, 30, 35, 40, 45, 50, 60, 70, 80, 90, 100, 150, or 200 nucleotides of the target position.

In an embodiment, a double strand break can be accompanied by two additional single strand breaks, positioned by a second gRNA molecule and a third gRNA molecule. For example, the targeting domain of a first gRNA molecule is configured such that a double strand break is positioned upstream of the target position in the CFTR gene, e.g., intron 2 or intron 10 e.g., within 1, 2, 3, 4, 5, 10, 15, 20, 25, 30, 35, 40, 45, 50, 60, 70, 80, 90, 100, 150, or 200 nucleotides of the target position; and the targeting domains of a second and third gRNA molecule are configured such that two single strand breaks are positioned downstream of the target position in the CFTR gene, e.g., intron 2 or intron 10, e.g., within 1, 2, 3, 4, 5, 10, 15, 20, 25, 30, 35, 40, 45, 50, 60, 70, 80, 90, 100, 150, or 200 nucleotides of the target position. In an embodiment, the targeting domain of the first, second and third gRNA molecules are configured such that a cleavage event, e.g., a double strand or single strand break, is positioned, independently for each of the gRNA molecules.

In an embodiment, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of the target position in the CFTR gene, e.g., intron 2 or intron 10, e.g., within 1, 2, 3, 4, 5, 10, 15, 20, 25, 30, 35, 40, 45, 50, 60, 70, 80, 90, 100, 150, or 200 nucleotides of the target position in the CFTR gene, e.g., intron 2 or intron 10; and the targeting domains of a third and fourth gRNA molecule are configured such that two single strand breaks are positioned downstream of the target position in the CFTR gene, e.g., intron 2 or intron 10, within 1, 2, 3, 4, 5, 10, 15, 20, 25, 30, 35, 40, 45, 50, 60, 70, 80, 90, 100, 150, or 200 nucleotides of the target position in the CFTR gene, e.g., intron 2 or intron 10.

In an embodiment, a single strand break is introduced (e.g., positioned by one gRNA molecule) at or in close proximity to a CF target position in the CFTR gene. In an embodiment, a single gRNA molecule (e.g., with a Cas9 nickase) is used to create a single strand break at or in close proximity to the CF target position, e.g., the gRNA is configured such that the single strand break is positioned either upstream (e.g., within 200 bp upstream) or downstream (e.g., within 200 bp downstream) of the CF target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a CF target position in the CFTR gene. In an embodiment, a single gRNA molecule (e.g., with a Cas9 nuclease other than a Cas9 nickase) is used to create a double strand break at or in close proximity to the CF target position, e.g., the gRNA molecule is configured such that the double strand break is positioned either upstream (e.g., within 200 bp upstream) or downstream of (e.g., within 200 bp downstream) of a CF target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a CF target position in the CFTR gene. In an embodiment, two gRNA molecules (e.g., with one or two Cas9 nickcases) are used to create two single strand breaks at or in close proximity to the CF target position, e.g., the gRNAs molecules are configured such that both of the single strand breaks are positioned upstream (e.g., within 200 bp upstream) or downstream (e.g., within 200 bp downstream) of the CF target position. In another embodiment, two gRNA molecules (e.g., with two Cas9 nickcases) are used to create two single strand breaks at or in close proximity to the CF target position, e.g., the gRNAs molecules are configured such that one single strand break is positioned upstream (e.g., within 200 bp upstream) and a second single strand break is positioned downstream (e.g., within 200 bp downstream) of the CF target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a CF target position in the CFTR gene. In an embodiment, two gRNA molecules (e.g., with one or two Cas9 nucleases that are not Cas9 nickases) are used to create two double strand breaks to flank a CF target position, e.g., the gRNA molecules are configured such that one double strand break is positioned upstream (e.g., within 200 bp upstream) and a second double strand break is positioned downstream (e.g., within 200 bp downstream) of the CF target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a CF target position in the CFTR gene. In an embodiment, three gRNA molecules (e.g., with a Cas9 nuclease other than a Cas9 nickase and one or two Cas9 nickases) to create one double strand break and two single strand breaks to flank an CF target position, e.g., the gRNA molecules are configured such that the double strand break is positioned upstream or downstream of (e.g., within 200 bp upstream or downstream) of the CF target position, and the two single strand breaks are positioned at the opposite site, e.g., downstream or upstream (within 200 bp downstream or upstream), of the CF target position. In an embodiment, the breaks are positioned to avoid unwanted target chromosome elements, such as repeat elements, e.g., an Alu repeat.

In an embodiment, four single strand breaks are introduced (e.g., positioned by four gRNA molecules) at or in close proximity to a CF target position in the CFTR gene. In an embodiment, four gRNA molecule (e.g., with one or more Cas9 nickases are used to create four single strand breaks to flank an CF target position in the CFTR gene, e.g., the gRNA molecules are configured such that a first and second single strand breaks are positioned upstream (e.g., within 200 bp upstream) of the CF target position, and a third and a fourth single stranded breaks are positioned downstream (e.g., within 200 bp downstream) of the CF target position. In an embodiment, the breaks are positioned to avoid unwanted target chromosome elements, such as repeat elements, e.g., an Alu repeat.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

Approach 3A:

In an embodiment, Cas9-mediated removal and/or disruption of an intronic segment of DNA, within a CFTR intron, to restore post-transcriptional processing accuracy, e.g., without the use of homology-directed repair. CFTR mutations (e.g., c.3717+12191C>T, e.g., 2657+5G>A, e.g., c.3140-26A>G) can cause aberrant post-transcriptional processing, such as missplicing by the creation of novel splice sites which can lead to the early truncation of non-functional CFTR protein resulting in aberrant CFTR channel formation. In one aspect, methods and compositions discussed herein, provide for altering the CF target position in the CFTR gene. The CF target position (e.g. c.3717+12191, also known as c.3849+10 kb, e.g., c.2657+5, also known as c.2789+5, e.g., c.3140-26A, also known as c.3272-26) can be altered, e.g., by non-homologous end-joining mediated removal and/or disruption of a splice site mutation. In the case of a subject with a 3717+12191C>T mutation, the CF target position is 500 bp upstream and/or downstream of c.3717+12191 within intron 22. In the case of a subject with a c.2657+5G>A mutation, the CF target position is 200 bp upstream within exon 16, and intron 16 and intron 15 and/or downstream of c.2657+5 within intron 16. In the case of a subject with a c.3140-26A>G mutation, the CF target position is 200 bp upstream and/or downstream of c.3140-26 within intron 19 and exon 20. The removal, disruption and/or repair of a splice site mutation will restore accurate splicing and cease production of aberrant truncation of CFTR protein. This approach will lead to the cessation of production of truncated non-functional CFTR channel and will lead to the production of wild-type CFTR channel. This approach will prevent the development or progression of lung, gastrointestinal and/or reproductive disease in subjects with CFTR mutations.

In an embodiment, methods and compositions discussed herein, provide for altering the CF target position in the CFTR gene. The alteration can be achieved by (1) break-induced introduction of an indel (also referred to herein as NHEJ-mediated introduction of an indel) in close proximity to or including a CF target position (e.g., c.3717+12191C>T, 2657+5G>A, or c.3140-26A>G), or (2) break-induced deletion (also referred to herein as NHEJ-mediated deletion) of genomic sequence including the mutation at a CF target position (e.g., c.3717+12191C>T, 2657+5G>A, or c.3140-26A>G). Both approaches give rise to the loss or destruction of the aberrant post-transcriptional processing.

In an embodiment, the method comprises introducing a break-induced indel in close proximity to or including the CF target position (e.g., c.3717+12191C>T, 2657+5G>A, or c.3140-26A>G). As described herein, in one embodiment, the method comprises the introduction of a double strand break sufficiently close to (e.g., either 5' or 3' to) the CF target position (e.g., c.3717+12191C>T, 2657+5G>A, or c.3140-26A>G), such that the break-induced indel could be reasonably expected to span the mutation. A single gRNAs, e.g., unimolecular (or chimeric) or modular gRNA molecules, is configured to position a double strand break sufficiently close to the CF target position in the CFTR gene. The double strand break may be positioned within 500 nucleotides (e.g., within 1, 2, 3, 4, 5, 10, 15, 16, 17, 18, 19, 20, 25, 30, 35, 40, 100, 200, 300, 400 or 500 nucleotides) upstream of the CF target position, or within 500 nucleotides (e.g., within 1, 2, 3, 4, 5, 10, 15, 16, 17, 18, 19, 20, 25, 30, 35, 40, 100, 200, 300, 400 or 500 nucleotides) downstream of the CF target position. While not wishing to be bound by theory, in an embodiment, it is believed that NHEJ-mediated repair of the double strand break allows for the NHEJ-mediated introduction of an indel in close proximity to or including the CF target position.

In another embodiment, the method comprises the introduction of a pair of single strand breaks sufficiently close to (either 5' or 3' to, respectively) the mutation at the CF target position (e.g., c.3717+12191C>T, 2657+5G>A, or c.3140-26A>G), such that the break-induced indel could be reasonably expected to span the mutation. Two gRNAs, e.g., unimolecular (or chimeric) or modular gRNA molecules, are configured to position the two single strand breaks sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, 200, 300, 400 or 500 nucleotides) upstream of the CF target position, or within 500 nucleotides (e.g., within 1, 2, 3, 4, 5, 10, 15, 16, 17, 18, 19, 20, 25, 30, 35, 40, 100, 200, 300, 400 or 500 nucleotides) downstream of the CF target position. While not wishing to be bound by theory, in an embodiment, it is believed that NHEJ mediated repair of the pair of single strand breaks allows for the NHEJ-mediated introduction of an indel in close proximity to or including the CF target position. In an embodiment, the pair of single strand breaks may be accompanied by an additional double strand break, positioned by a third gRNA molecule, as is discussed below. In another embodiment, the pair of single strand breaks may be accompanied by two additional single strand breaks positioned by a third gRNA molecule and a fourth gRNA molecule, as is discussed below.

In another embodiment, the method comprises the introduction of two sets of breaks (e.g., a pair of double strand breaks targeted by two gRNAs) sufficiently close to (either 5' or 3' to, respectively) the mutation at the CF target position (e.g., c.3717+12191C>T, 2657+5G>A, or c.3140-

26A>G). such that the break-induced indel could be reasonably expected to span the mutation. Two gRNAs, e.g., unimolecular (or chimeric) or modular gRNA molecules, are configured to position the two sets of breaks (e.g., a pair of double strand breaks) sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, 200, 300, 400 or 500 nucleotides) upstream of the CF target position, or within 500 nucleotides (e.g., within 1, 2, 3, 4, 5, 10, 15, 16, 17, 18, 19, 20, 25, 30, 35, 40, 100, 200, 300, 400 or 500 nucleotides) downstream of the CF target position. While not wishing to be bound by theory, in an embodiment, it is believed that NHEJ mediated repair of two sets of breaks (e.g., a pair of double strand breaks) allows for the NHEJ-mediated introduction of an indel in close proximity to or including the CF target position.

In another embodiment, the method comprises the introduction of two sets of breaks (e.g., one double strand break and a pair of single strand breaks targeted by three gRNAs) sufficiently close to (either 5' or 3' to, respectively) the mutation at the CF target position (e.g., c.3717+12191C>T, 2657+5G>A, or c.3140-26A>G). such that the break-induced indel could be reasonably expected to span the mutation. Two gRNAs, e.g., unimolecular (or chimeric) or modular gRNA molecules, are configured to position the two sets of breaks (e.g., one double strand break and a pair of single strand breaks) sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, 200, 300, 400 or 500 nucleotides) upstream of the CF target position, or within 500 nucleotides (e.g., within 1, 2, 3, 4, 5, 10, 15, 16, 17, 18, 19, 20, 25, 30, 35, 40, 100, 200, 300, 400 or 500 nucleotides) downstream of the CF target position. While not wishing to be bound by theory, in an embodiment, it is believed that NHEJ mediated repair of two sets of breaks (e.g., one double strand break and a pair of single strand breaks) allows for the NHEJ-mediated introduction of an indel in close proximity to or including the CF target position.

In another embodiment, the method comprises the introduction of two sets of breaks (e.g., two pairs of single strand breaks targeted by four gRNAs) sufficiently close to (either 5' or 3' to, respectively) the mutation at the CF target position (e.g., c.3717+12191C>T, 2657+5G>A, or c.3140-26A>G). such that the break-induced indel could be reasonably expected to span the mutation. Two gRNAs, e.g., unimolecular (or chimeric) or modular gRNA molecules, are configured to position the two sets of breaks (e.g., two pairs of single strand breaks s) sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, 200, 300, 400 or 500 nucleotides) upstream of the CF target position, or within 500 nucleotides (e.g., within 1, 2, 3, 4, 5, 10, 15, 16, 17, 18, 19, 20, 25, 30, 35, 40, 100, 200, 300, 400 or 500 nucleotides) downstream of the CF target position. While not wishing to be bound by theory, in an embodiment, it is believed that NHEJ mediated repair of two sets of breaks (e.g., two pairs of single strand breaks) allows for the NHEJ-mediated introduction of an indel in close proximity to or including the CF target position.

In an embodiment, a single strand break is introduced (e.g., positioned by one gRNA molecule) at or in close proximity to a CF target position in the CFTR gene. In an embodiment, a single gRNA molecule (e.g., with a Cas9 nickase) is used to create a single strand break at or in close proximity to the CF target position, e.g., the gRNA is configured such that the single strand break is positioned either upstream (e.g., within 500 bp, e.g., within 200 bp upstream) or downstream (e.g., within 500 bp, e.g., within 200 bp downstream) of the CF target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a CF target position in the CFTR gene. In an embodiment, a single gRNA molecule (e.g., with a Cas9 nuclease other than a Cas9 nickase) is used to create a double strand break at or in close proximity to the CF target position, e.g., the gRNA molecule is configured such that the double strand break is positioned either upstream (e.g., within 500 bp, e.g., within 200 bp upstream) or downstream of (e.g., within 500 bp, e.g., within 200 bp downstream) of a CF target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a CF target position in the CFTR gene. In an embodiment, two gRNA molecules (e.g., with one or two Cas9 nickcases) are used to create two single strand breaks at or in close proximity to the CF target position, e.g., the gRNAs molecules are configured such that both of the single strand breaks are positioned upstream (e.g., within 500 bp, e.g., within 200 bp upstream) or downstream (e.g., within 500 bp, e.g., within 200 bp downstream) of the CF target position. In another embodiment, two gRNA molecules (e.g., with two Cas9 nickcases) are used to create two single strand breaks at or in close proximity to the CF target position, e.g., the gRNAs molecules are configured such that one single strand break is positioned upstream (e.g., within 500 bp, e.g., within 200 bp upstream) and a second single strand break is positioned downstream (e.g., within 500 bp, e.g., within 200 bp downstream) of the CF target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a CF target position in the CFTR gene. In an embodiment, two gRNA molecules (e.g., with one or two Cas9 nucleases that are not Cas9 nickases) are used to create two double strand breaks to flank a CF target position, e.g., the gRNA molecules are configured such that one double strand break is positioned upstream (e.g., within 500 bp, e.g., within 200 bp upstream) and a second double strand break is positioned downstream (e.g., within 500 bp, e.g., within 200 bp downstream) of the CF target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a CF target position in the CFTR gene. In an embodiment, three gRNA molecules (e.g., with a Cas9 nuclease other than a Cas9 nickase and one or two Cas9 nickases) to create one double strand break and two single strand breaks to flank an CF target position, e.g., the gRNA molecules are configured such that the double strand break is positioned upstream or downstream of (e.g., within 500 bp, e.g., within 200 bp upstream or downstream)

of the CF target position, and the two single strand breaks are positioned at the opposite site, e.g., downstream or upstream (within 200 bp downstream or upstream), of the CF target position. In an embodiment, the breaks are positioned to avoid unwanted target chromosome elements, such as repeat elements, e.g., an Alu repeat.

In an embodiment, four single strand breaks are introduced (e.g., positioned by four gRNA molecules) at or in close proximity to a CF target position in the CFTR gene. In an embodiment, four gRNA molecule (e.g., with one or more Cas9 nickases are used to create four single strand breaks to flank an CF target position in the CFTR gene, e.g., the gRNA molecules are configured such that a first and second single strand breaks are positioned upstream (e.g., within 500 bp, e.g., within 200 bp upstream) of the CF target position, and a third and a fourth single stranded breaks are positioned downstream (e.g., within 500 bp, e.g., within 200 bp downstream) of the CF target position. In an embodiment, the breaks are positioned to avoid unwanted target chromosome elements, such as repeat elements, e.g., an Alu repeat.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

In an embodiment, a single strand break is introduced (e.g., positioned by one gRNA molecule) at or in close proximity to a CF target position in the CFTR gene. In an embodiment, a single gRNA molecule (e.g., with a Cas9 nickase) is used to create a single strand break at or in close proximity to the CF target position, e.g., the gRNA is configured such that the single strand break is positioned either upstream (e.g., within 500 bp upstream) or downstream (e.g., within 500 bp downstream) of the CF target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a CF target position in the CFTR gene. In an embodiment, a single gRNA molecule (e.g., with a Cas9 nuclease other than a Cas9 nickase) is used to create a double strand break at or in close proximity to the CF target position, e.g., the gRNA molecule is configured such that the double strand break is positioned either upstream (e.g., within 500 bp upstream) or downstream of (e.g., within 500 bp downstream) of a CF target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a CF target position in the CFTR gene. In an embodiment, two gRNA molecules (e.g., with one or two Cas9 nickcases) are used to create two single strand breaks at or in close proximity to the CF target position, e.g., the gRNAs molecules are configured such that both of the single strand breaks are positioned upstream (e.g., within 500 bp upstream) or downstream (e.g., within 500 bp downstream) of the CF target position. In another embodiment, two gRNA molecules (e.g., with two Cas9 nickcases) are used to create two single strand breaks at or in close proximity to the CF target position, e.g., the gRNAs molecules are configured such that one single strand break is positioned upstream (e.g., within 500 bp upstream) and a second single strand break is positioned downstream (e.g., within 500 bp downstream) of the CF target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a CF target position in the CFTR gene. In an embodiment, two gRNA molecules (e.g., with one or two Cas9 nucleases that are not Cas9 nickases) are used to create two double strand breaks to flank a CF target position, e.g., the gRNA molecules are configured such that one double strand break is positioned upstream (e.g., within 500 bp upstream) and a second double strand break is positioned downstream (e.g., within 500 bp downstream) of the CF target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a CF target position in the CFTR gene. In an embodiment, three gRNA molecules (e.g., with a Cas9 nuclease other than a Cas9 nickase and one or two Cas9 nickases) to create one double strand break and two single strand breaks to flank an CF target position, e.g., the gRNA molecules are configured such that the double strand break is positioned upstream or downstream of (e.g., within 500 bp upstream or downstream) of the CF target position, and the two single strand breaks are positioned at the opposite site, e.g., downstream or upstream (within 500 bp downstream or upstream), of the CF target position. In an embodiment, the breaks are positioned to avoid unwanted target chromosome elements, such as repeat elements, e.g., an Alu repeat.

In an embodiment, four single strand breaks are introduced (e.g., positioned by four gRNA molecules) at or in close proximity to a CF target position in the CFTR gene. In an embodiment, four gRNA molecule (e.g., with one or more Cas9 nickases are used to create four single strand breaks to flank an CF target position in the CFTR gene, e.g., the gRNA molecules are configured such that a first and second single strand breaks are positioned upstream (e.g., within 500 bp upstream) of the CF target position, and a third and a fourth single stranded breaks are positioned downstream (e.g., within 500 bp downstream) of the CF target position. In an embodiment, the breaks are positioned to avoid unwanted target chromosome elements, such as repeat elements, e.g., an Alu repeat.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

Approach 3B:

In an embodiment, Cas9-mediated removal and/or disruption of an intronic segment of DNA, within a CFTR intron, to restore post-transcriptional processing accuracy, e.g., with the use of homology-directed repair. CFTR mutations e.g., c.2657+5 (also known as c.2789+5), or c.3140-26A (also known as c.3272-26) can cause aberrant post-transcriptional processing, such as missplicing by the creation of novel splice sites which can lead to production of non-functional CFTR protein resulting in aberrant CFTR channel formation. In one aspect, methods and compositions discussed herein, provide for altering the CF target position in the CFTR gene. The CF target position (e.g., c.2657+5, e.g., c.3140-26A) can be altered by non-homologous end-joining mediated removal of a splice site mutation. In the case of a subject with a c.2657+5G>A mutation, the CF target position is 200 bp upstream and/or downstream of c.2657+5 within within exon 16, and intron 16 and intron 15. In the case of a subject with a c.3140-26A>G mutation, the CF target position is 200 bp upstream and/or downstream of c.3140-26 within exon 20 and intron 19. In an embodiment, in a subject with a target mutation in close proximity to an exon (including, but not limited to the mutations, e.g., 2789+5G>A, e.g., 3272-26A>G), approach may include Cas-9 mediated removal and/or disruption of an intronic segment at or near the target site with homology-directed repair with delivery of Cas9 nuclease (or nickase, or dead-Cas9), CRISPR-gRNAs, and homology-directed repair donor templates. In an embodiment, the donor template will be comprised of a single-strand oligonucleotide donor of 50 NT to 200 NT (or more as the technology becomes available). In an embodiment, the donor template will be comprised of a double-strand DNA donor with homology arms of length 700 bps to 1200 bps. The repair of a splice site mutation will restore accurate splicing and cease aberrant truncation of CFTR transcript. This approach will lead to the cessation of production of truncated CFTR channel and will lead to the production of wild-type CFTR channel. This approach will prevent the development or progression of lung, gastrointestinal and/or reproductive disease in subjects with CFTR mutations.

In an embodiment, the method comprises the introduction of a double strand break sufficiently close to (e.g., either 5' or 3' to) the CF target position (e.g., c2657+5G>A, or c.3140-26A>G), such that the break-induced indel could be reasonably expected to span the mutation. A single gRNAs, e.g., unimolecular (or chimeric) or modular gRNA molecules, is configured to position a double strand break sufficiently close to the CF target position in the CFTR gene (e.g., 2657+5G>A, or c.3140-26A>G). The double strand break may be positioned within 200 nucleotides (e.g., within 1, 2, 3, 4, 5, 10, 15, 16, 17, 18, 19, 20, 25, 30, 35, 40, 100, or 200 nucleotides) upstream of the CF target position, or within 500 nucleotides (e.g., within 1, 2, 3, 4, 5, 10, 15, 16, 17, 18, 19, 20, 25, 30, 35, 40, 100, or 200 nucleotides) downstream of the CF target position. While not wishing to be bound by theory, in an embodiment, it is believed that HDR mediated repair of the break(s) restores the functional CFTR protein.

In another embodiment, the method comprises the introduction of a pair of single strand breaks sufficiently close to (either 5' or 3' to, respectively) the mutation at the CF target position (e.g., c2657+5G>A, or c.3140-26A>G), such that the break-induced indel could be reasonably expected to span the mutation. Two gRNAs, e.g., unimolecular (or chimeric) or modular gRNA molecules, are configured to position the two single strand breaks sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, or 200 nucleotides) upstream of the CF target position, or within 500 nucleotides (e.g., within 1, 2, 3, 4, 5, 10, 15, 16, 17, 18, 19, 20, 25, 30, 35, 40, 100, or 200 nucleotides) downstream of the CF target position. While not wishing to be bound by theory, in an embodiment, it is believed that HDR mediated repair of the break(s) restores the functional CFTR protein. In an embodiment, the pair of single strand breaks may be accompanied by an additional double strand break, positioned by a third gRNA molecule, as is discussed below. In another embodiment, the pair of single strand breaks may be accompanied by two additional single strand breaks positioned by a third gRNA molecule and a fourth gRNA molecule, as is discussed below.

In another embodiment, the method comprises the introduction of two sets of breaks (e.g., a pair of double strand breaks targeted by two gRNAs) sufficiently close to (either 5' or 3' to, respectively) the mutation at the CF target position (e.g., c2657+5G>A, or c.3140-26A>G), such that the break-induced indel could be reasonably expected to span the mutation. Two gRNAs, e.g., unimolecular (or chimeric) or modular gRNA molecules, are configured to position the two sets of breaks (e.g., a pair of double strand breaks) sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, or 200 nucleotides) upstream of the CF target position, or within 500 nucleotides (e.g., within 1, 2, 3, 4, 5, 10, 15, 16, 17, 18, 19, 20, 25, 30, 35, 40, 100, or 200 nucleotides) downstream of the CF target position. While not wishing to be bound by theory, in an embodiment, it is believed that HDR mediated repair of the break(s) restores the functional CFTR protein.

In another embodiment, the method comprises the introduction of two sets of breaks (e.g., one double strand break and a pair of single strand breaks targeted by three gRNAs) sufficiently close to (either 5' or 3' to, respectively) the mutation at the CF target position (e.g., c2657+5G>A, or c.3140-26A>G), such that the break-induced indel could be reasonably expected to span the mutation. Two gRNAs, e.g., unimolecular (or chimeric) or modular gRNA molecules, are configured to position the two sets of breaks (e.g., one double strand break and a pair of single strand breaks) sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, or 200 nucleotides) upstream of the CF target position, or within 500 nucleotides (e.g., within 1, 2, 3, 4, 5, 10, 15, 16, 17, 18, 19, 20, 25, 30, 35, 40, 100, or 200 nucleotides) downstream of the CF target position. While not wishing to be bound by theory, in an embodiment, it is believed that HDR mediated repair of the break(s) restores the functional CFTR protein.

In another embodiment, the method comprises the introduction of two sets of breaks (e.g., two pairs of single strand breaks targeted by four gRNAs) sufficiently close to (either 5' or 3' to, respectively) the mutation at the CF target position (e.g., c2657+5G>A, or c.3140-26A>G), such that the break-induced indel could be reasonably expected to span the mutation. Two gRNAs, e.g., unimolecular (or chimeric) or modular gRNA molecules, are configured to position the two sets of breaks (e.g., two pairs of single strand breaks s) sufficiently close to the CF target position in the CFTR gene. In an embodiment, the pair of single strand breaks is positioned within 500 nucleotides (e.g., within 1, 2, 3, 4, 5, 10, 15, 16, 17, 18, 19, 20, 25, 30, 35, 40, 100, or 200 nucleotides) upstream of the CF target position, or within 500 nucleotides (e.g., within 1, 2, 3, 4, 5, 10, 15, 16, 17, 18, 19, 20, 25, 30, 35, 40, 100, or 200 nucleotides) downstream of the CF target position. While not wishing to be bound by theory, in an embodiment, it is believed that HDR mediated repair of the break(s) restores the functional CFTR protein.

In an embodiment, a single strand break is introduced (e.g., positioned by one gRNA molecule) at or in close proximity to a CF target position in the CFTR gene. In an embodiment, a single gRNA molecule (e.g., with a Cas9 nickase) is used to create a single strand break at or in close proximity to the CF target position, e.g., the gRNA is configured such that the single strand break is positioned either upstream (e.g., within 200 bp upstream) or downstream (e.g., within 200 bp downstream) of the CF target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a CF target position in the CFTR gene. In an embodiment, a single gRNA molecule (e.g., with a Cas9 nuclease other than a Cas9 nickase) is used to create a double strand break at or in close proximity to the CF target position, e.g., the gRNA molecule is configured such that the double strand break is positioned either upstream (e.g., within 200 bp upstream) or downstream of (e.g., within 200 bp downstream) of a CF target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a CF target position in the CFTR gene. In an embodiment, two gRNA molecules (e.g., with one or two Cas9 nickcases) are used to create two single strand breaks at or in close proximity to the CF target position, e.g., the gRNAs molecules are configured such that both of the single strand breaks are positioned upstream (e.g., within 200 bp upstream) or downstream (e.g., within 200 bp downstream) of the CF target position. In another embodiment, two gRNA molecules (e.g., with two Cas9 nickcases) are used to create two single strand breaks at or in close proximity to the CF target position, e.g., the gRNAs molecules are configured such that one single strand break is positioned upstream (e.g., within 200 bp upstream) and a second single strand break is positioned downstream (e.g., within 200 bp downstream) of the CF target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a CF target position in the CFTR gene. In an embodiment, two gRNA molecules (e.g., with one or two Cas9 nucleases that are not Cas9 nickases) are used to create two double strand breaks to flank a CF target position, e.g., the gRNA molecules are configured such that one double strand break is positioned upstream (e.g., within 200 bp upstream) and a second double strand break is positioned downstream (e.g., within 200 bp downstream) of the CF target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a CF target position in the CFTR gene. In an embodiment, three gRNA molecules (e.g., with a Cas9 nuclease other than a Cas9 nickase and one or two Cas9 nickases) to create one double strand break and two single strand breaks to flank an CF target position, e.g., the gRNA molecules are configured such that the double strand break is positioned upstream or downstream of (e.g., within 200 bp upstream or downstream) of the CF target position, and the two single strand breaks are positioned at the opposite site, e.g., downstream or upstream (within 200 bp downstream or upstream), of the CF target position. In an embodiment, the breaks are positioned to avoid unwanted target chromosome elements, such as repeat elements, e.g., an Alu repeat.

In an embodiment, four single strand breaks are introduced (e.g., positioned by four gRNA molecules) at or in close proximity to a CF target position in the CFTR gene. In an embodiment, four gRNA molecule (e.g., with one or more Cas9 nickases are used to create four single strand breaks to flank an CF target position in the CFTR gene, e.g., the gRNA molecules are configured such that a first and second single strand breaks are positioned upstream (e.g., within 200 bp upstream) of the CF target position, and a third and a fourth single stranded breaks are positioned downstream (e.g., within 200 bp downstream) of the CF target position. In an embodiment, the breaks are positioned to avoid unwanted target chromosome elements, such as repeat elements, e.g., an Alu repeat.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

When two or more gRNAs are used to position two or more cleavage events, e.g., double strand or single strand breaks, in a target nucleic acid, it is contemplated that the two or more cleavage events may be made by the same or different Cas9 proteins. For example, when two gRNAs are used to position two double strand breaks, a single Cas9 nuclease may be used to create both double strand breaks. When two or more gRNAs are used to position two or more single stranded breaks (single strand breaks), a single Cas9 nickase may be used to create the two or more single strand breaks. When two or more gRNAs are used to position at least one double strand break and at least one single strand break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double strand versus a single strand break at the desired position in the target nucleic acid.

In some embodiments, the targeting domain of the first gRNA molecule and the targeting domain of the second gRNA molecule hybridize to the target domain through complementary base pairing to opposite strands of the target nucleic acid molecule. In some embodiments, the gRNA molecule and the second gRNA molecule are configured such that the PAMs are oriented outward.

In an embodiment, the targeting domain of a gRNA molecule is configured to avoid unwanted target chromosome elements, such as repeat elements, e.g., an Alu repeat, or the endogenous CFTR splice sites, in the target domain. The gRNA molecule may be a first, second, third and/or fourth gRNA molecule.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In an embodiment, the targeting domain of said gRNA molecule is configured to position a cleavage event sufficiently far from a preselected nucleotide, e.g., the nucleotide of a coding region, such that the nucleotide is not be altered. In an embodiment, the targeting domain of said gRNA molecule is configured to position an intronic cleavage event sufficiently far from an intron/exon border, or naturally occurring splice signal, to avoid alteration of the exonic sequence or unwanted splicing events.

Methods to Alter SCNN1A

As disclosed herein, the SCNN1A gene can be altered by gene editing, e.g., using CRISPR-Cas9 mediated methods as described herein. A CF or CF-like target position can be altered by gene editing, e.g., using CRISPR-Cas9 mediated methods to alter the SCNN1A gene. The alteration of the SCNN1A gene can be mediated by any mechanism. In an embodiment, CRISPR-Cas9 mediated methods to knockdown or knockout the SCNN1A gene may be applied to any subject with any CF mutation, including but not limited to, e.g., F508del, e.g., G551D, e.g., G542X, e.g., N1303K, e.g., R117H, e.g., W1282X, e.g., R553X, e.g., c.3717+12191, e.g., c.2657+5, e.g., c.3140-26A and/or any subject with any CF-like mutation, including but not limited to a SCNN1A mutation, e.g., V114I. Exemplary mechanisms that can be associated with the alteration of the SCNNA1 gene include, but are not limited to, non-homologous end joining (e.g., classical or alternative), microhomology-mediated end joining (MMEJ), SDSA (synthesis dependent strand annealing) or single strand annealing or single strand invasion, all with or without the alteration of the CFTR gene, including but not limited to the addition of an endogenous-promoter driven cDNA encoding the CFTR gene, or homology-directed repair mediated correction of mutations within the CFTR gene or CRISPR-cas9 mediated repair of splice mutations within the CFTR gene.

As disclosed herein, the SCNN1A gene can be targeted (e.g., altered) by gene editing, e.g., using CRISPR-Cas9 mediated methods as described herein.

Methods and compositions discussed herein, provide for targeting (e.g., altering) a CF target position in the SCNN1A gene. A CF target position can be targeted (e.g., altered) by gene editing, e.g., using CRISPR-Cas9 mediated methods to target (e.g. alter) the SCNN1A gene.

Disclosed herein are methods for targeting (e.g., altering) a SCNN1A target position in the SCNN1A gene. Targeting (e.g., altering) the CF target position is achieved, e.g., by:

(1) knocking out the SCNN1A gene by insertion or deletion (e.g., NHEJ-mediated insertion or deletion) of one or more nucleotides in close proximity to or within the early coding region of the SCNN1A gene, or (2) knocking down the SCNN1A gene mediated by enzymatically inactive Cas9 (eiCas9) molecule or an eiCas9-fusion protein by targeting non-coding region, e.g., a promoter region, of the gene.

All approaches give rise to targeting (e.g., alteration) of the SCNN1A gene.

In an embodiment, methods described herein introduce one or more breaks near the early coding region in at least one allele of the SCNN1A gene. In another embodiment, methods described herein introduce two or more breaks to flank at least a portion of the SCNN1A gene. The two or more breaks remove (e.g., delete) a genomic sequence including at least a portion of the SCNN1A gene. In another embodiment, methods described herein comprise knocking down the SCNN1A gene mediated by enzymatically inactive Cas9 (eiCas9) molecule or an eiCas9-fusion protein by targeting the promoter region of SCNN1A target knockdown position. All methods described herein result in targeting (e.g., alteration) of the SCNN1A gene.

The targeting (e.g., alteration) of the SCNN1A gene can be mediated by any mechanism. Exemplary mechanisms that can be associated with the alteration of the SCNN1A gene include, but are not limited to, non-homologous end joining (e.g., classical or alternative), microhomology-mediated end joining (MMEJ), homology-directed repair (e.g., endogenous donor template mediated), SDSA (synthesis dependent strand annealing), single strand annealing or single strand invasion.

Approach 4: Knocking Out SCNN1A by Introducing an Indel or a Deletion in the SCNN1A Gene In an embodiment, the method comprises introducing an insertion or deletion of one more nucleotides in close proximity to the SCNN1A target knockout position (e.g., the early coding region) of the SCNN1A gene. As described herein, in one embodiment, the method comprises the introduction of one or more breaks (e.g., single strand breaks or double strand breaks) sufficiently close to (e.g., either 5' or 3' to) the early coding region of the CF target knockout position, such that the break-induced indel could be reasonably expected to span the CF target knockout position (e.g., the early coding region in the SCNN1A gene). While not wishing to be bound by theory, it is believed that NHEJ-mediated repair of the break(s) allows for the NHEJ-mediated introduction of an indel in close proximity to within the early coding region of the CF target knockout position.

In an embodiment, the method comprises introducing a deletion of a genomic sequence comprising at least a portion of the SCNN1A gene. As described herein, in an embodiment, the method comprises the introduction of two double stand breaks—one 5' and the other 3' to (i.e., flanking) the CF target position. In an embodiment, two gRNAs, e.g., unimolecular (or chimeric) or modular gRNA molecules, are configured to position the two double strand breaks on opposite sides of the CF target knockout position in the SCNN1A gene.

In an embodiment, a single strand break is introduced (e.g., positioned by one gRNA molecule) at or in close proximity to a CF target position in the SCNN1A gene. In an embodiment, a single gRNA molecule (e.g., with a Cas9 nickase) is used to create a single strand break at or in close proximity to the CF target position, e.g., the gRNA is configured such that the single strand break is positioned either upstream (e.g., within 500 bp upstream, e.g., within 200 bp upstream) or downstream (e.g., within 500 bp downstream, e.g., within 200 bp downstream) of the CF target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a CF target position in the SCNN1A gene. In an embodiment, a single gRNA molecule (e.g., with a Cas9 nuclease other than a Cas9 nickase) is used to create a double strand break at or in close proximity to the CF target position, e.g., the gRNA molecule is configured such that the double strand break is positioned either upstream (e.g., within 500 bp upstream, upstream) or downstream of (e.g., within 500 bp downstream) of a CF target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a CF target position in the SCNN1A gene. In an embodiment, two gRNA molecules (e.g., with one or two Cas9 nickcases) are used to create two single strand breaks at or in close proximity to the CF target position, e.g., the gRNAs molecules are configured such that both of the single strand breaks are positioned e.g., within 500 bp upstream, upstream) or downstream (e.g., within 500 bp downstream downstream) of the CF target position. In another embodiment, two gRNA molecules (e.g., with two Cas9 nickcases) are used to create two single strand breaks at or in close proximity to the SCNN1A target position, e.g., the gRNAs molecules are configured such that one single strand break is positioned upstream (e.g., within 500 bp upstream) and a second single strand break is positioned downstream (e.g., within 500 bp downstream) of the SCNN1A target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a CF target position in the SCNN1A gene. In an embodiment, two gRNA molecules (e.g., with one or two Cas9 nucleases that are not Cas9 nickases) are used to create two double strand breaks to flank a CF target position, e.g., the gRNA molecules are configured such that one double strand break is positioned upstream (e.g., within 500 bp upstream) and a second double strand break is positioned downstream (e.g., within 500 bp downstream) of the SCNN1A target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a CF target position in the SCNN1A gene. In an embodiment, three gRNA molecules (e.g., with a Cas9 nuclease other than a Cas9 nickase and one or two Cas9 nickases) to create one double strand break and two single strand breaks to flank a CF target position, e.g., the gRNA molecules are configured such that the double strand break is positioned upstream or downstream of (e.g., within 500 bp upstream or downstream) of the SCNN1A target position, and the two single strand breaks are positioned at the opposite site, e.g., downstream or upstream (e.g., within 500 bp downstream or upstream), of the CF target position. In an embodiment, the breaks are positioned to avoid unwanted target chromosome elements, such as repeat elements, e.g., an Alu repeat.

In an embodiment, four single strand breaks are introduced (e.g., positioned by four gRNA molecules) at or in close proximity to a CF target position in the SCNN1A gene. In an embodiment, four gRNA molecule (e.g., with one or more Cas9 nickases are used to create four single strand breaks to flank a CF target position in the SCNN1A gene, e.g., the gRNA molecules are configured such that a first and second single strand breaks are positioned upstream (e.g., within 500 bp upstream) of the CF target position, and a third and a fourth single stranded breaks are positioned downstream (e.g., within 500 bp downstream) of the CF target position. In an embodiment, the breaks are positioned to avoid unwanted target chromosome elements, such as repeat elements, e.g., an Alu repeat.

In an embodiment, two or more (e.g., three or four) gRNA molecules are used with one Cas9 molecule. In another embodiment, when two ore more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

Approach 5: Knocking Down SCNN1A Mediated by an Enzymatically Inactive Cas9 (eiCas9) Molecule A targeted knockdown approach reduces or eliminates expression of functional SCNN1A gene product. As described herein, in an embodiment, a targeted knockdown is mediated by targeting an enzymatically inactive Cas9 (eiCas9) molecule or an eiCas9 fused to a transcription repressor domain or chromatin modifying protein to alter transcription, e.g., to block, reduce, or decrease transcription, of the SCNN1A gene.

Methods and compositions discussed herein may be used to alter the expression of the SCNN1A gene to treat or prevent CF or CF-like disease by targeting a promoter region of the SCNN1A gene. In an embodiment, the promoter region is targeted to knock down expression of the SCNN1A gene. A targeted knockdown approach reduces or eliminates expression of functional SCNN1A gene product. As described herein, in an embodiment, a targeted knockdown is mediated by targeting an enzymatically inactive Cas9 (eiCas9) or an eiCas9 fused to a transcription repressor domain or chromatin modifying protein to alter transcription, e.g., to block, reduce, or decrease transcription, of the SCNN1A gene. In an embodiment, one or more eiCas9 molecules may be used to block binding of one or more endogenous transcription factors. In another embodiment, an eiCas9 molecule can be fused to a chromatin modifying protein. Altering chromatin status can result in decreased expression of the target gene. One or more eiCas9 molecules fused to one or more chromatin modifying proteins may be used to alter chromatin status.

An eiCas9mediated knock down of one of two SCNN1A allele/s by targeting the transcription start site of SCNN1A gene in exon I of all transcripts (including 500 bp upstream and downstream of transcription start site on all transcripts). This approach is performed in any subject with CF or CF-like disease, with or without a CFTR mutation and a WT or mutant SCNN1A. The CF or CF-like target position is at or near the transcription start site of the SCNN1A gene. Or, altering the CF or CF-like target position refers to delivering a dCas9 that sterically hinders transcription of either or both SCNN1A allele/s. This approach gives rise to the loss or destruction of transcription of the SCNN1A gene. This approach will lead to the reduction or cessation of production of ENaC. This approach will prevent the disinhibition of the ENaC channel in subjects with CF or CF-like disease. The viscosity of lung, gastrointestinal and reproductive tract mucous in subjects with CF or CF-like disease will not be further increased. This will lead to a reduction in viscosity of mucous within the lung, gastrointestinal and reproductive tract mucous in subjects with CF or CF-like disease. This approach will prevent the progression of CF and CF-like disease.

I. gRNA Molecules

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule), sometimes referred to herein as "chimeric" gRNAs, or modular (comprising more than one, and typically two, separate RNA molecules). A gRNA molecule comprises a number of domains. The gRNA molecule domains are described in more detail below.

Several exemplary gRNA structures, with domains indicated thereon, are provided in FIGS. 1A-1G. While not wishing to be bound by theory, in an embodiment, with regard to the three dimensional form, or intra- or inter-strand interactions of an active form of a gRNA, regions of high complementarity are sometimes shown as duplexes in FIGS. 1A-1G and other depictions provided herein.

In an embodiment, a unimolecular, or chimeric, gRNA comprises, preferably from 5' to 3':
  a targeting domain (which is complementary to a target nucleic acid in the CFTR gene or SCNN1A gene, e.g., a targeting domain as described herein, e.g., a targeting domain from any of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, and 48A-48E;
  a first complementarity domain;
  a linking domain;
  a second complementarity domain (which is complementary to the first complementarity domain);
  a proximal domain; and
  optionally, a tail domain.

In an embodiment, a modular gRNA comprises:
  a first strand comprising, preferably from 5' to 3';
    a targeting domain (which is complementary to a target nucleic acid in the CFTR gene or SCNN1A gene, e.g., a targeting domain as described herein, e.g., a targeting domain from any of Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E); and
    a first complementarity domain; and
  a second strand, comprising, preferably from 5' to 3':
    optionally, a 5' extension domain;
    a second complementarity domain;
    a proximal domain; and
    optionally, a tail domain.
    The domains are discussed briefly below.

The Targeting Domain

FIGS. 1A-1G provide examples of the placement of targeting domains.

The targeting domain comprises a nucleotide sequence that is complementary, e.g., at least 80, 85, 90, or 95% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises in the 5' to 3' direction, an optional secondary domain, and a core domain. In an embodiment, the core domain is fully complementary with the target sequence. In an embodiment, the targeting domain is 5 to 50 nucleotides in length. The strand of the target nucleic acid with which the targeting domain is complementary is referred to herein as the complementary strand. Some or all of the nucleotides of the domain can have a modification, e.g., a modification found in Section VIII herein.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

Targeting domains are discussed in more detail below.

The First Complementarity Domain

FIGS. 1A-1G provide examples of first complementarity domains.

The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complementary domain comprises 3 subdomains, which, in the 5' to 3' direction are: a 5' subdomain, a central subdomain, and a 3' subdomain. In an embodiment, the 5' subdomain is 4 to 9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length.

The first complementarity domain can share homology with, or be derived from, a naturally occurring first complementary domain. In an embodiment, it has at least 50% homology with a first complementary domain disclosed herein, e.g., an *S. pyogenes, S. aureus* or *S. thermophilus*, first complementary domain.

Some or all of the nucleotides of the domain can have a modification, e.g., a modification found in Section VIII herein.

First complementarity domains are discussed in more detail below.

The Linking Domain

FIGS. 1A-1G provide examples of linking domains.

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains, see, e.g., FIGS. 1B-1E. In an embodiment, the linking domain is, or comprises, a covalent bond interposed between the first complementary domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains see e.g., FIG. 1A.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., a modification found in Section VIII herein.

Linking domains are discussed in more detail below.

The 5' Extension Domain

In an embodiment, a modular gRNA can comprise additional sequence, 5' to the second complementarity domain, referred to herein as the 5' extension domain, see, e.g., FIG. 1A. In an embodiment, the 5' extension domain is, 2 to 10, 2 to 9, 2 to 8, 2 to 7, 2 to 6, 2 to 5, 2 to 4 nucleotides in length. In an embodiment, the 5' extension domain is 2, 3, 4, 5, 6, 7, 8, 9, or 10 or more nucleotides in length.

The Second Complementarity Domain

FIGS. 1A-1G provide examples of second complementarity domains.

Figure 1B:
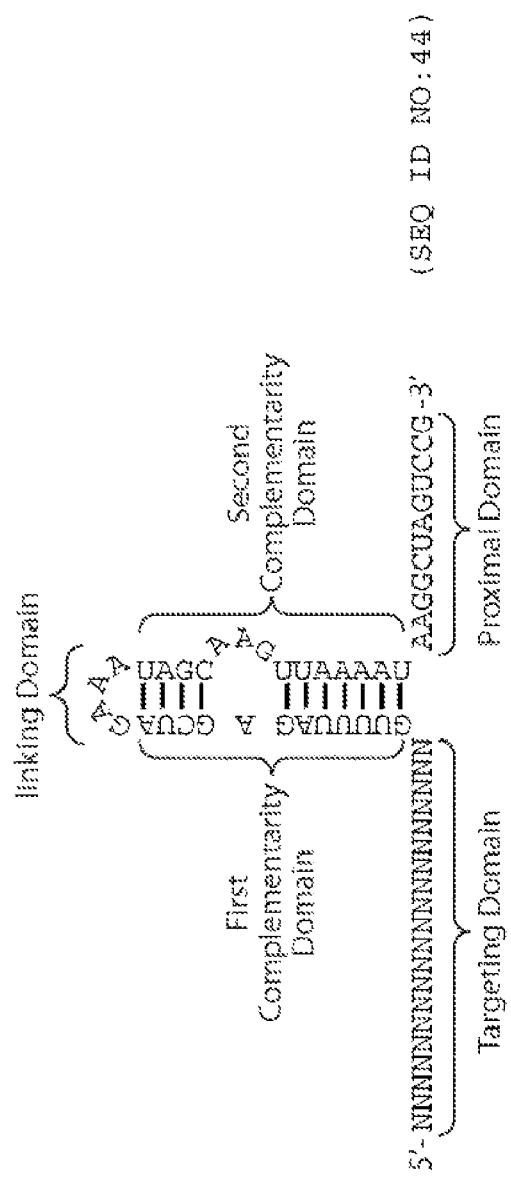
Figure 1C:
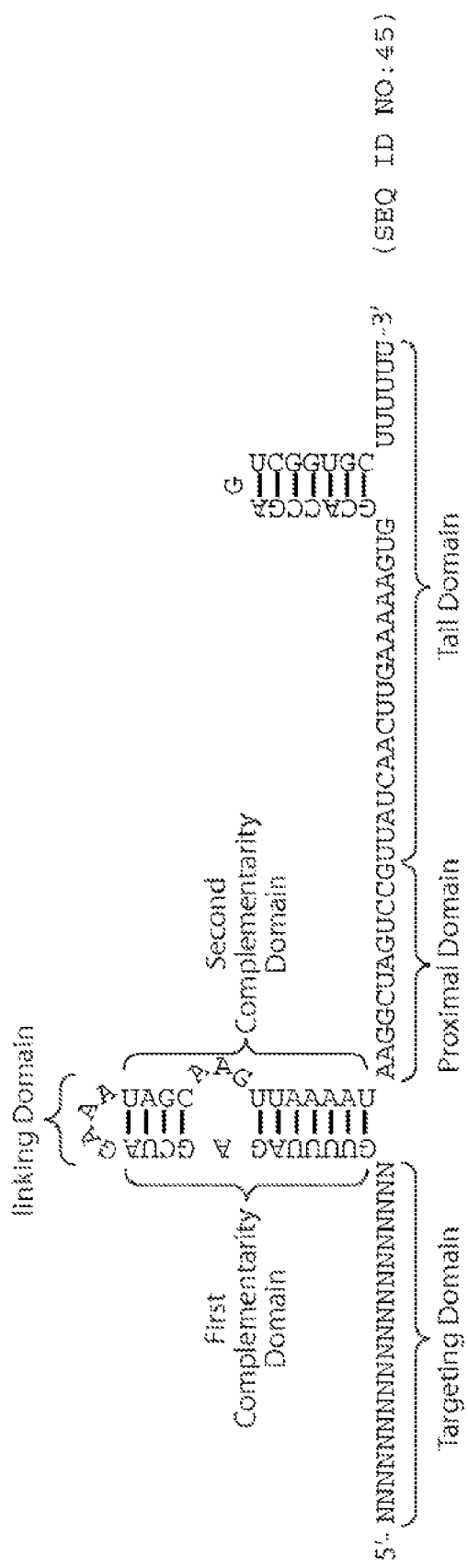
Figure 1D:
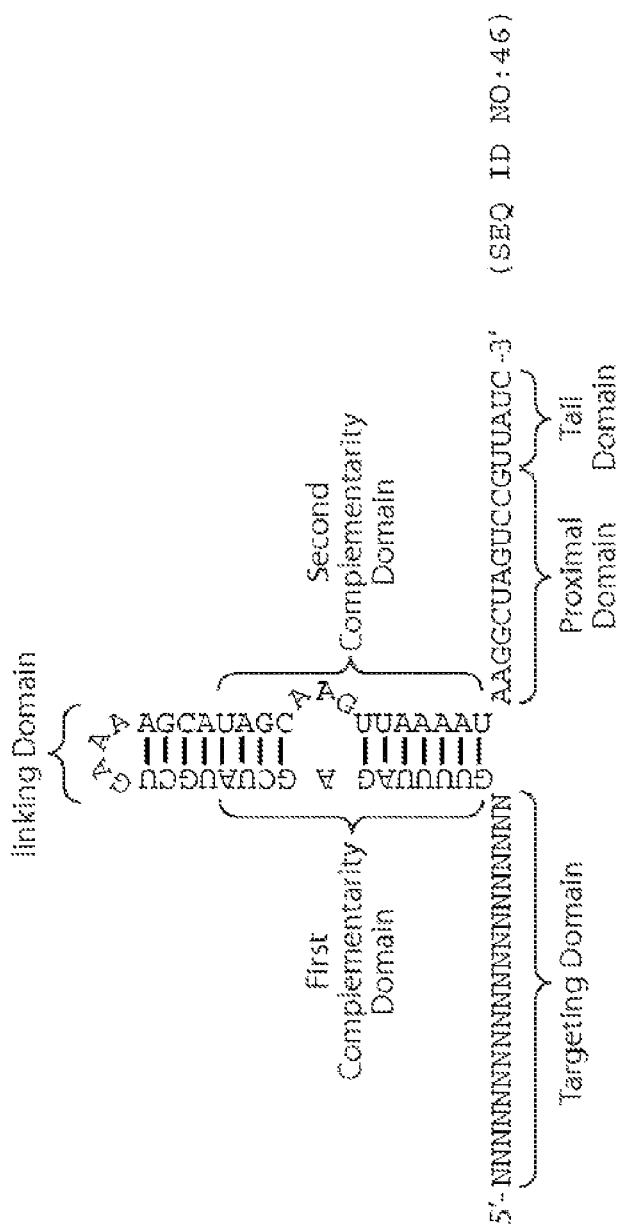
Figure 1E:
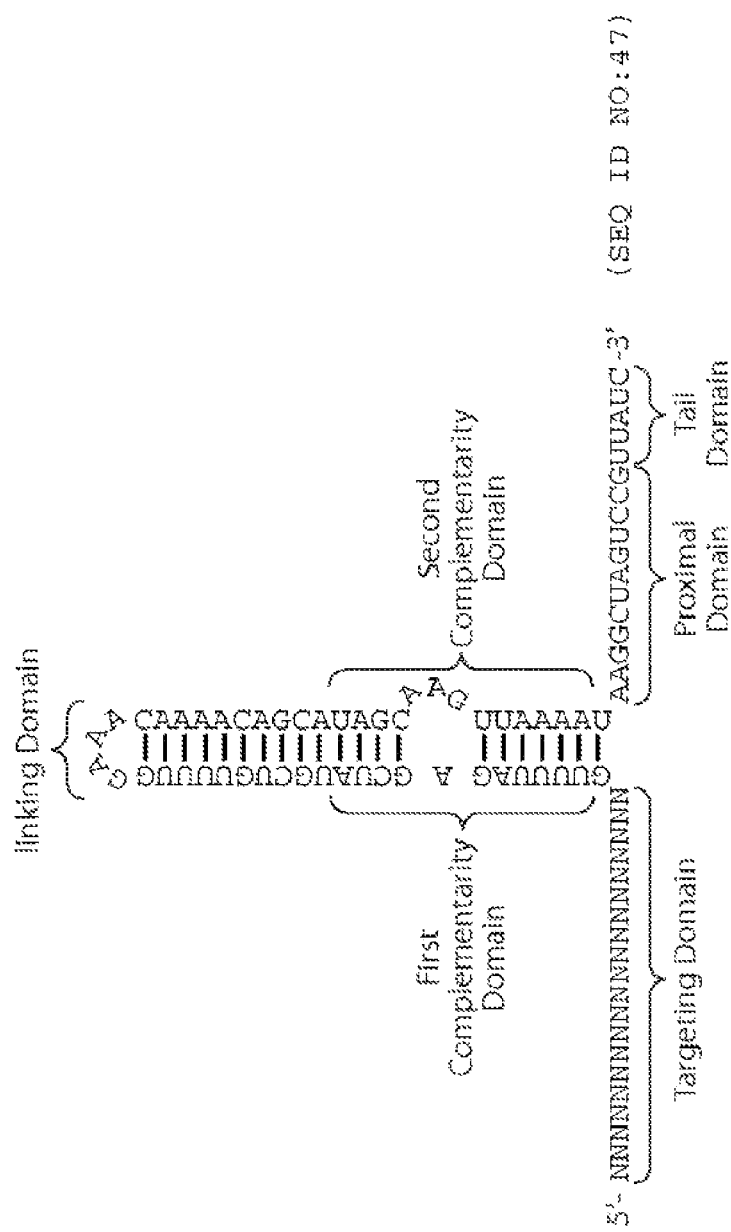
Figure 1H:
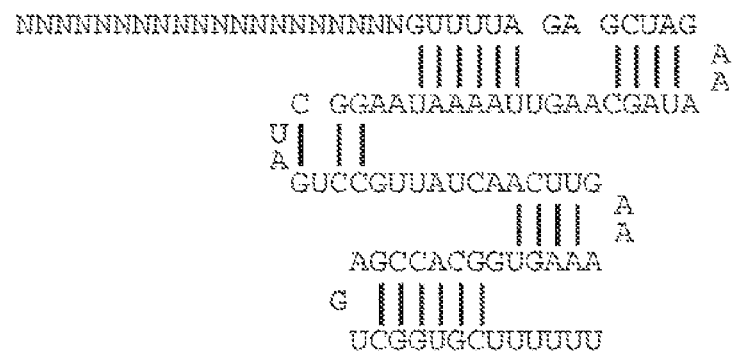
Figure 1I:
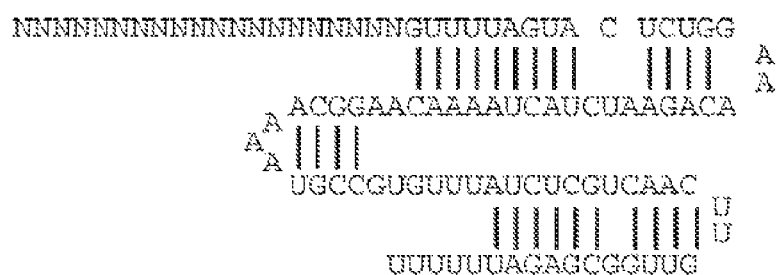

The second complementarity domain is complementary with the first complementarity domain, and in an embodiment, has sufficient complementarity to the second complementarity domain to form a duplexed region under at least some physiological conditions. In an embodiment, e.g., as shown in FIGS. 1A-1B, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementarity region. In an embodiment the second complementary domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24 or 25 nucleotides in length.

In an embodiment, the second complementarity domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an *S. pyogenes, S. aureus* or *S. thermophilus*, first complementarity domain.

Some or all of the nucleotides of the domain can have a modification, e.g., a modification found in Section VIII herein.

A Proximal Domain

FIGS. 1A-1G provide examples of proximal domains.

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus* or *S. thermophilus*, proximal domain. Some or all of the nucleotides of the domain can have a modification, e.g., a modification found in Section VIII herein.

A Tail Domain

FIGS. 1A-1G provide examples of tail domains.

As can be seen by inspection of the tail domains in FIGS. 1A-1E, a broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain, see e.g., FIG. 1D or FIG. 1E. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus* or *S. thermophilus*, tail domain.

In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

The domains of gRNA molecules are described in more detail below.

The Targeting Domain

The "targeting domain" of the gRNA is complementary to the "target domain" on the target nucleic acid. The strand of the target nucleic acid comprising the nucleotide sequence complementary to the core domain of the gRNA is referred to herein as the "complementary strand" of the target nucleic acid. Guidance on the selection of targeting domains can be found, e.g., in Fu Y et al., Nat Biotechnol 2014 (doi: 10.1038/nbt.2808) and Sternberg S H et al., Nature 2014 (doi: 10.1038/nature13011).

In an embodiment, the targeting domain is 16, 17, 18, 19, 20, 21, 22, 23, 24, 25 or 26 nucleotides in length.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the targeting domain is 20+/−5 nucleotides in length.

In an embodiment, the targeting domain is 20+/−10, 30+/−10, 40+/−10, 50+/−10, 60+/−10, 70+/−10, 80+/−10, 90+/−10, or 100+/−10 nucleotides, in length.

In an embodiment, the targeting domain is 30+/−10 nucleotides in length.

In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length. In another embodiment, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In an embodiment the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 molecule to the target nucleic acid.

In an embodiment, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no noncomplementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section VIII. However, in an embodiment, the targeting domain comprises one or more modifications, e.g., modifications that it render it less susceptible to degradation or more bio-compatible, e.g., less immunogenic. By way of example, the backbone of the targeting domain can be modified with a phosphorothioate, or other modification(s) from Section VIII. In an embodiment, a nucleotide of the targeting domain can comprise a 2' modification, e.g., a 2-acetylation, e.g., a 2' methylation, or other modification(s) from Section VIII.

In an embodiment, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In an embodiment, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected so as to not interfere with targeting efficacy, which can be evaluated by testing a candidate modification in the system described in Section IV. gRNAs having a candidate targeting domain having a selected length, sequence, degree of complementarity, or degree of modification, can be evaluated in a system in Section IV. The candidate targeting domain can be placed, either alone, or with one or more other candidate changes in a gRNA molecule/Cas9 molecule system known to be functional with a selected target and evaluated.

In an embodiment, all of the modified nucleotides are complementary to and capable of hybridizing to corresponding nucleotides present in the target domain. In another embodiment, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'-3' direction: a secondary domain and a core domain. These domains are discussed in more detail below.

The Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain).

In an embodiment, the core domain and targeting domain, are independently, 6+/−2, 7+/−2, 8+/−2, 9+/−2, 10+/−2, 11+/−2, 12+/−2, 13+/−2, 14+/−2, 15+/−2, or 16+−2, nucleotides in length.

In an embodiment, the core domain and targeting domain, are independently, 10+/−2 nucleotides in length.

In an embodiment, the core domain and targeting domain, are independently, 10+/−4 nucleotides in length.

In an embodiment, the core domain and targeting domain are independently 6, 7, 8, 9, 10, 11, 12, 13, 14, 15, 16, 17, or 18 nucleotides in length.

In an embodiment, the core domain and targeting domain are independently 3 to 20, 4 to 20, 5 to 20, 6 to 20, 7 to 20, 8 to 20, 9 to 20 10 to 20 or 15 to 20 nucleotides in length.

In an embodiment, the core domain and targeting domain are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain is complementary with the core domain target. Typically the core domain has exact complementarity with the core domain target. In some embodiments, the core domain can have 1, 2, 3, 4 or 5 nucleotides that are not complementary with the corresponding nucleotide of the core domain. In an embodiment, the degree of complementarity, together with other properties of the gRNA, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 12 to 17 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14 or 15 nucleotides in length.

The secondary domain is complementary with the secondary domain target. Typically the secondary domain has exact complementarity with the secondary domain target. In an embodiment, the secondary domain can have 1, 2, 3, 4 or 5 nucleotides that are not complementary with the corresponding nucleotide of the secondary domain. In an embodiment, the degree of complementarity, together with other properties of the gRNA, is sufficient to allow targeting of a Cas9 molecule to the target nucleic acid.

In an embodiment, the core domain nucleotides do not comprise modifications, e.g., modifications of the type provided in Section VIII. However, in an embodiment, the core domain comprises one or more modifications, e.g., modifications that it render it less susceptible to degradation or more bio-compatible, e.g., less immunogenic. By way of example, the backbone of the core domain can be modified with a phosphorothioate, or other modification(s) from Section VIII. In an embodiment a nucleotide of the core domain can comprise a 2' modification, e.g., a 2-acetylation, e.g., a 2' methylation, or other modification(s) from Section VIII. Typically, a core domain will contain no more than 1, 2, or 3 modifications.

Modifications in the core domain can be selected so as to not interfere with targeting efficacy, which can be evaluated by testing a candidate modification in the system described in Section IV. gRNAs having a candidate core domain having a selected length, sequence, degree of complementarity, or degree of modification, can be evaluated in the system described at Section IV. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section VIII. However, in an embodiment, the secondary domain comprises one or more modifications, e.g., modifications that render it less susceptible to degradation or more bio-compatible, e.g., less immunogenic. By way of example, the backbone of the secondary domain can be modified with a phosphorothioate, or other modification(s) from Section VIII. In an embodiment a nucleotide of the secondary domain can comprise a 2' modification, e.g., a 2-acetylation, e.g., a 2' methylation, or other modification(s) from Section VIII. Typically, a secondary domain will contain no more than 1, 2, or 3 modifications.

Modifications in the secondary domain can be selected so as to not interfere with targeting efficacy, which can be evaluated by testing a candidate modification in the system described in Section IV. gRNAs having a candidate secondary domain having a selected length, sequence, degree of complementarity, or degree of modification, can be evaluated in the system described at Section IV. The candidate secondary domain can be placed, either alone, or with one or more other candidate changes in a gRNA molecule/Cas9 molecule system known to be functional with a selected target and evaluated.

In an embodiment, (1) the degree of complementarity between the core domain and its target, and (2) the degree of complementarity between the secondary domain and its target, may differ. In an embodiment, (1) may be greater than (2). In an embodiment, (1) may be less than (2). In an embodiment, (1) and (2) are the same, e.g., each may be completely complementary with its target.

In an embodiment, (1) the number of modifications (e.g., modifications from Section VIII) of the nucleotides of the core domain and (2) the number of modifications (e.g., modifications from Section VIII) of the nucleotides of the secondary domain may differ. In an embodiment, (1) may be less than (2). In an embodiment, (1) may be greater than (2). In an embodiment, (1) and (2) may be the same, e.g., each may be free of modifications.

The First and Second Complementarity Domains

The first complementarity domain is complementary with the second complementarity domain.

Typically the first domain does not have exact complementarity with the second complementarity domain target. In some embodiments, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, will not pair in the duplex, and, e.g., form a non-duplexed or looped-out region. In an embodiment, an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;

independently, 6, 7, 8, 9, 10, 11, 12, 13, 14, 14, 16, 17, 18, 19, 20, 21, 22, 23, 24, 25, or 26, nucleotides in length; or independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section VIII.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section VIII. In an embodiment a nucleotide of the domain can comprise a 2' modification, e.g., a 2-acetylation, e.g., a 2' methylation, or other modification(s) from Section VIII.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected so as to not interfere with targeting efficacy, which can be evaluated by testing a candidate modification in the system described in Section IV. gRNAs having a candidate complementarity domain having a selected length, sequence, degree of complementarity, or degree of modification, can be evaluated in the system described in Section IV. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 85%, 90% or 95% homology with, or differs by no more than 1, 2, 3, 4, 5, or 6 nucleotides from, a reference first complementarity domain, e.g., a naturally occurring, e.g., an *S. pyogenes*, *S. aureus* or *S. thermophilus*, first complementarity domain, or a first complementarity domain described herein, e.g., from FIGS. 1A-1G.

In an embodiment, the second complementarity domain has at least 60, 70, 80, 85%, 90%, or 95% homology with, or differs by no more than 1, 2, 3, 4, 5, or 6 nucleotides from, a reference second complementarity domain, e.g., a naturally occurring, e.g., an *S. pyogenes*, *S. aureus* or *S. thermophilus*, second complementarity domain, or a second complementarity domain described herein, e.g., from FIGS. 1A-1G.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In some embodiments, the first and second complementarity domains, when duplexed, comprise 11 paired nucleotides, for example in the gRNA sequence (one paired strand underlined, one bolded):

(SEQ ID NO: 5)
NNNNNNNNNNNNNNNNNNNNNNNGUUUUAGAGCUAGAAAUAGCAAGUUAAAAU

AAGGCUAGUCCGUUAUCAACUUGAAAAAGUGGCACCGAGUCGGUGC.

In some embodiments, the first and second complementarity domains, when duplexed, comprise 15 paired nucleotides, for example in the gRNA sequence (one paired strand underlined, one bolded):

(SEQ ID NO: 27)
NNNNNNNNNNNNNNNNNNNNNNNGUUUUAGAGCUAUGCUGAAAAGCAUAGCAA

GUUAAAAUAAGGCUAGUCCGUUAUCAACUUGAAAAAGUGGCACCGAGUCG

GUGC.

In some embodiments the first and second complementarity domains, when duplexed, comprise 16 paired nucleotides, for example in the gRNA sequence (one paired strand underlined, one bolded):

(SEQ ID NO: 28)
NNNNNNNNNNNNNNNNNNNNNNNGUUUUAGAGCUAUGCUGGAAACAGCAUAGC

AAGUUAAAAUAAGGCUAGUCCGUUAUCAACUUGAAAAAGUGGCACCGA

GUCGGUGC.

In some embodiments the first and second complementarity domains, when duplexed, comprise 21 paired nucleotides, for example in the gRNA sequence (one paired strand underlined, one bolded):

(SEQ ID NO: 29)
NNNNNNNNNNNNNNNNNNNNNNNGUUUUAGAGCUAUGCUGUUUUGGAAACAAA

ACAGCAUAGCAAGUUAAAAUAAGGCUAGUCCGUUAUCAACUUGAAAAAG

UGGCACCGAGUCGGUGC.

In some embodiments, nucleotides are exchanged to remove poly-U tracts, for example in the gRNA sequences (exchanged nucleotides underlined):

(SEQ ID NO: 30)
NNNNNNNNNNNNNNNNNNNNNNNGUAUUAGAGCUAGAAAUAGCAAGUUAAUAU

AAGGCUAGUCCGUUAUCAACUUGAAAAAGUGGCACCGAGUCGGUGC;

(SEQ ID NO: 31)
NNNNNNNNNNNNNNNNNNNNNNNGUUUAAGAGCUAGAAAUAGCAAGUUUAAAU

AAGGCUAGUCCGUUAUCAACUUGAAAAAGUGGCACCGAGUCGGUGC;
or (SEQ ID NO: 32)
NNNNNNNNNNNNNNNNNNNNNNNGUAUUAGAGCUAUGCUGUAUUGGAAACAAU

ACAGCAUAGCAAGUUAAUAUAAGGCUAGUCCGUUAUCAACUUGAAAAAGU

GGCACCGAGUCGGUGC.

The 5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section VIII. However, in an embodiment, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) from Section VIII. In an embodiment, a nucleotide of the 5' extension domain can comprise a 2' modification, e.g., a 2-acetylation, e.g., a 2' methylation, or other modification(s) from Section VIII.

In an embodiment, the 5' extension domain can comprise as many as 1, 2, 3, 4, 5, 6, 7 or 8 modifications. In an embodiment, the 5' extension domain comprises as many as 1, 2, 3, or 4 modifications within 5 nucleotides of its 5' end, e.g., in a modular gRNA molecule. In an embodiment, the 5' extension domain comprises as many as 1, 2, 3, or 4 modifications within 5 nucleotides of its 3' end, e.g., in a modular gRNA molecule.

In an embodiment, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in the system described in Section IV. gRNAs having a candidate 5' extension domain having a selected length, sequence, degree of complementarity, or degree of modification, can be evaluated in the system described at Section IV. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 85, 90 or 95% homology with, or differs by no more than 1, 2, 3, 4, 5, or 6 nucleotides from, a reference 5' extension domain, e.g., a naturally occurring, e.g., an *S. pyogenes*, or *S. aureus S. thermophilus*, 5' extension domain, or a 5' extension domain described herein, e.g., from FIGS. 1A-1G.

The Linking Domain

In a unimolecular gRNA molecule the linking domain is disposed between the first and second complementarity domains. In a modular gRNA molecule, the two molecules are associated with one another by the complementarity domains.

In an embodiment, the linking domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the linking domain is 20+/−10, 30+/−10, 40+/−10, 50+/−10, 60+/−10, 70+/−10, 80+/−10, 90+/−10, or 100+/−10 nucleotides, in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In an embodiment, the linking domain is a covalent bond.

In an embodiment, the linking domain comprises a duplexed region, typically adjacent to or within 1, 2, or 3 nucleotides of the 3' end of the first complementarity domain and/or the 5-end of the second complementarity domain. In an embodiment, the duplexed region can be 20+/−10 base pairs in length. In an embodiment, the duplexed region can be 10+/−5, 15+/−5, 20+/−5, or 30+/−5 base pairs in length. In an embodiment, the duplexed region can be 1, 2, 3, 4, 5, 6, 7, 8, 9, 10, 11, 12, 13, 14, or 15 base pairs in length.

Typically the sequences forming the duplexed region have exact complementarity with one another, though in some embodiments as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section VIII. However, in an embodiment, the linking domain comprises one or more modifications, e.g., modifications that it render it less susceptible to degradation or more bio-compatible, e.g., less immunogenic. By way of example, the backbone of the linking domain can be modified with a phosphorothioate, or other modification(s) from Section VIII. In an embodiment a nucleotide of the linking domain can comprise a 2' modification, e.g., a 2-acetylation, e.g., a 2' methylation, or other modification(s) from Section VIII. In some embodiments, the linking domain can comprise as many as 1, 2, 3, 4, 5, 6, 7 or 8 modifications.

Modifications in a linking domain can be selected so as to not interfere with targeting efficacy, which can be evaluated by testing a candidate modification in the system described in Section IV. gRNAs having a candidate linking domain having a selected length, sequence, degree of complementarity, or degree of modification, can be evaluated a system described in Section IV. A candidate linking domain can be placed, either alone, or with one or more other candidate changes in a gRNA molecule/Cas9 molecule system known to be functional with a selected target and evaluated.

In an embodiment, the linking domain has at least 60, 70, 80, 85, 90 or 95% homology with, or differs by no more than 1, 2, 3, 4, 5, or 6 nucleotides from, a reference linking domain, e.g., a linking domain described herein, e.g., from FIGS. 1A-1G.

The Proximal Domain

In an embodiment, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length.

In an embodiment, the proximal domain is 6, 7, 8, 9, 10, 11, 12, 13, 14, 15, 16, 17, 18, 19, 20, 21, 22, 23, 24, 25 or 26 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section VIII. However, in an embodiment, the proximal domain comprises one or more modifications, e.g., modifications that it render it less susceptible to degradation or more bio-compatible, e.g., less immunogenic. By way of example, the backbone of the proximal domain can be modified with a phosphorothioate, or other modification(s) from Section VIII. In an embodiment a nucleotide of the proximal domain can comprise a 2' modification, e.g., a 2-acetylation, e.g., a 2' methylation, or other modification(s) from Section VIII.

In an embodiment, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In an embodiment, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected so as to not interfere with gRNA molecule efficacy, which can be evaluated by testing a candidate modification in the system described in Section IV. gRNAs having a candidate proximal domain having a selected length, sequence, degree of complementarity, or degree of modification, can be evaluated in the system described at Section IV. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 85 90 or 95% homology with, or differs by no more than 1, 2, 3, 4, 5, or 6 nucleotides from, a reference proximal domain, e.g., a naturally occurring, e.g., an S. pyogenes, S. aureus or S. thermophilus, proximal domain, or a proximal domain described herein, e.g., from FIGS. 1A-1G.

The Tail Domain

In an embodiment, the tail domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length.

In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In other embodiments, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 15, 1 to 10, or 1 to 5 nucleotides in length.

In an embodiment, the tail domain nucleotides do not comprise modifications, e.g., modifications of the type provided in Section VIII. However, in an embodiment, the tail domain comprises one or more modifications, e.g., modifications that it render it less susceptible to degradation or more bio-compatible, e.g., less immunogenic. By way of example, the backbone of the tail domain can be modified with a phosphorothioate, or other modification(s) from Section VIII. In an embodiment a nucleotide of the tail domain can comprise a 2' modification, e.g., a 2-acetylation, e.g., a 2' methylation, or other modification(s) from Section VIII.

In some embodiments, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment it is 4 to 6 nucleotides in length.

In an embodiment, the tail domain has at least 60, 70, 80, or 90% homology with, or differs by no more than 1, 2, 3, 4, 5, or 6 nucleotides from, a reference tail domain, e.g., a naturally occurring, e.g., an S. pyogenes, S. aureus or S. thermophilus, tail domain, or a tail domain described herein, e.g., from FIGS. 1A-1G.

In an embodiment, the proximal and tail domain, taken together, comprise the following sequences:

```
                                         (SEQ ID NO: 33)
AAGGCUAGUCCGUUAUCAACUUGAAAAAGUGGCACCGAGUCGGUGCU,
or (SEQ ID NO: 34)
AAGGCUAGUCCGUUAUCAACUUGAAAAAGUGGCACCGAGUCGGUGGUGC,
or (SEQ ID NO: 35)
AAGGCUAGUCCGUUAUCAACUUGAAAAAGUGGCACCGAGUCGGUGCGG
AUC, or (SEQ ID NO: 36)
AAGGCUAGUCCGUUAUCAACUUGAAAAAGUG,
or (SEQ ID NO: 37)
AAGGCUAGUCCGUUAUCA,
or (SEQ ID NO: 38)
AAGGCUAGUCCG.
```

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e., if a pol-II promoter is used to drive transcription.

Modifications in the tail domain can be selected so as to not interfere with targeting efficacy, which can be evaluated by testing a candidate modification in the system described in Section IV. gRNAs having a candidate tail domain having a selected length, sequence, degree of complementarity, or degree of modification, can be evaluated in the system described in Section IV. The candidate tail domain can be placed, either alone, or with one or more other candidate changes in a gRNA molecule/Cas9 molecule system known to be functional with a selected target and evaluated.

In an embodiment, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment a gRNA has the following structure:

5' [targeting domain]-[first complementarity domain]-[linking domain]-[second complementarity domain]-[proximal domain]-[tail domain]-3' wherein, the targeting domain comprises a core domain and optionally a secondary domain, and is 10 to 50 nucleotides in length;

the first complementarity domain is 5 to 25 nucleotides in length and, In an embodiment has at least 50, 60, 70, 80, 85, 90 or 95% homology with a reference first complementarity domain disclosed herein;

the linking domain is 1 to 5 nucleotides in length;

the second complementarity domain is 5 to 27 nucleotides in length and, in an embodiment has at least 50, 60, 70, 80, 85, 90 or 95% homology with a reference second complementarity domain disclosed herein;

the proximal domain is 5 to 20 nucleotides in length and, in an embodiment has at least 50, 60, 70, 80, 85, 90 or 95% homology with a reference proximal domain disclosed herein; and the tail domain is absent or a nucleotide sequence is 1 to 50 nucleotides in length and, in an embodiment has at least 50, 60, 70, 80, 85, 90 or 95% homology with a reference tail domain disclosed herein.

Exemplary Chimeric gRNAs

In an embodiment, a unimolecular, or chimeric, gRNA comprises, preferably from 5' to 3':

a targeting domain (which is complementary to a target nucleic acid);
a first complementarity domain, e.g., comprising 15, 16, 17, 18, 19, 20, 21, 22, 23, 24, 25, or 26 nucleotides;
a linking domain;
a second complementarity domain (which is complementary to the first complementarity domain);
a proximal domain; and
a tail domain,
wherein,
(a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNN NNNGUUUUAGAGCUAGAAAUAGCAAGUTJAA- AAUAAGG CUAGUCCGUUAUCAACUUGAAAA- AGUGGCACCGAGUCGGUGCUUUUUU (SEQ ID NO: 45). In an embodiment, the unimolecular, or chimeric, gRNA molecule is a S. pyogenes gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGUACU-CUGGAAACAGAAUCUACUAAAAC AAGGCAAAAU-GCCGUGUUUAUCUCGUCAACUUGUUGGCGAG-AUUUUUU (SEQ ID NO: 40). In an embodiment, the unimolecular, or chimeric, gRNA molecule is a *S. aureus* gRNA molecule.

Exemplary Modular gRNAs

In an embodiment, a modular gRNA comprises:
a first strand comprising, preferably from 5' to 3';
   a targeting domain, e.g., comprising 15, 16, 17, 18, 19, 20, 21, 22, 23, 24, 25, or 26 nucleotides;
   a first complementarity domain; and
a second strand, comprising, preferably from 5' to 3';
   optionally a 5' extension domain;
   a second complementarity domain;
   a proximal domain; and
   a tail domain,
wherein:
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

II. Methods for Designing gRNAs

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali et al., 2013 SCIENCE 339(6121): 823-826; Hsu et al. NAT BIOTECHNOL, 31(9): 827-32; Fu et al., 2014 NAT BIOTECHNOL, doi: 10.1038/nbt.2808. PubMed PMID: 24463574; Heigwer et al., 2014 NAT METHODS 11(2):122-3. doi: 10.1038/nmeth.2812. PubMed PMID: 24481216; Bae et al., 2014 BIOINFORMATICS PubMed PMID: 24463181; Xiao A et al., 2014 BIOINFORMATICS PubMed PMID: 24389662.

For example, a software tool can be used to optimize the choice of gRNA within a user's target sequence, e.g., to minimize total off-target activity across the genome. Off target activity may be other than cleavage. For each possible gRNA choice using *S. pyogenes* Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described in Section IV herein.

The Targeting Domains discussed herein can be incorporated into the gRNAs described herein.

Strategies to Identify gRNAs for *S. pyogenes*, *S. Aureus*, and *N. meningitidis* to Knock Out the SCNN1A Gene As an example, three strategies were utilized to identify gRNAs for use with *S. pyogenes*, *S. aureus* and *N. meningitidis* Cas9 enzymes.

In the first strategy, guide RNAs (gRNAs) for use with the *S. pyogenes* Cas9 (Tables 3A-3C) were identified using the publically available web-based ZiFiT server (Fu et al., Improving CRISPR-Cas nuclease specificity using truncated guide RNAs. Nat Biotechnol. 2014 Jan. 26. doi: 10.1038/nbt.2808. PubMed PMID: 24463574, for the original references see Sander et al., 2007, NAR 35:W599-605; Sander et al., 2010, NAR 38: W462-8). In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available Repeat- Masker program. RepeatMmasker searches input DNA sequences for repeated elements and regions of low complexity. The output is a detailed annotation of the repeats present in a given query sequence. Following identification, gRNAs for use with a *S. pyogenes* Cas9 were ranked into 3 or 4 tiers, as described below.

The gRNAs in tier 1 were selected based on their distance to the target site and their orthogonality in the genome (based on the ZiFiT identification of close matches in the human genome containing an NGG PAM). As an example, for all targets, both 17-mer and 20-mer gRNAs were designed. gRNAs were also selected both for single-gRNA nuclease cutting and for the dual gRNA nickase strategy. Criteria for selecting gRNAs and the determination for which gRNAs can be used for which strategy is based on several considerations:
1. For the dual nickase strategy, gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, it will also often result in indel mutations at the site of only one of the gRNAs. Candidate pair members can be tested for how efficiently they remove the entire sequence versus just causing indel mutations at the site of one gRNA.

While it can be desirable to have gRNAs start with a 5' G, this requirement was relaxed for some gRNAs in tier 1 in order to identify guides in the correct orientation, within a reasonable distance to the mutation and with a high level of orthogonality. In order to find a pair for the dual-nickase strategy it was necessary to either extend the distance from the mutation or remove the requirement for the 5'G. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

As discussed above, gRNAs were identified for single-gRNA nuclease cleavage as well as for a dual-gRNA paired "nickase" strategy, as indicated.

gRNAs for use with the *S. aureus* (Tables 3D) Cas9s were identified manually by scanning genomic DNA sequence for the presence of PAM sequences. These gRNAs were not separated into tiers, but are provided in single lists for each species.

In a second strategy, Guide RNAs (gRNAs) for use with *S. pyogenes*, *S. aureus* and *N. meningitidis* Cas9s were identified using a DNA sequence searching algorithm. Guide RNA design was carried out using a custom guide RNA design software based on the public tool cas-offinder (reference:Cas-OFFinder: a fast and versatile algorithm that searches for potential off-target sites of Cas9 RNA-guided endonucleases., Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 43A-43E, 44A-44G or 45A-45E, e.g., the targeting domains of 18 or more nucleotides may comprise the 17-mer gRNAs described in Tables 43A-43E, 44A-44G or 45A-45E. Targeting domains, disclosed herein, may comprises the 18-mer described in Tables 43A-43E, 44A-44G or 45A-45E, e.g., the targeting domains of 19 or more nucleotides may comprise the 18-mer gRNAs described in Tables 43A-43E, 44A-44G or 45A-45E. Targeting domains, disclosed herein, may comprises the 19-mer described in Tables 43A-43E, 44A-44G or 45A-45E, e.g., the targeting domains of 20 or more nucleotides may comprise the 19-mer gRNAs described in Tables 43A-43E, 44A-44G or 45A-45E. Targeting domains, disclosed herein, may comprise the 20-mer gRNAs described in Tables 43A-43E, 44A-44G or 45A-45E, e.g., the targeting domains of 21 or more nucleotides may comprise the 20-mer gRNAs described in Tables 43A-43E, 44A-44G or 45A-45E. Targeting domains, disclosed herein, may comprises the 21-mer described in Tables 43A-43E, 44A-44G or 45A-45E, e.g., the targeting domains of 22 or more nucleotides may comprise the 21-mer gRNAs described in Tables 43A-43E, 44A-44G or 45A-45E. Targeting domains, disclosed herein, may comprises the 22-mer described in Tables 43A-43E, 44A-44G or 45A-45E, e.g., the targeting domains of 23 or more nucleotides may comprise the 22-mer gRNAs described in Tables 43A-43E, 44A-44G or 45A-45E. Targeting domains, disclosed herein, may comprises the 23-mer described in Tables 43A-43E, 44A-44G or 45A-45E, e.g., the targeting domains of 24 or more nucleotides may comprise the 23-mer gRNAs described in Tables 43A-43E, 44A-44G or 45A-45E. Targeting domains, disclosed herein, may comprises the 24-mer described in Tables 43A-43E, 44A-44G or 45A-45E, e.g., the targeting domains of 25 or more nucleotides may comprise the 24-mer gRNAs described in Tables 43A-43E, 44A-44G or 45A-45E. gRNAs were identified for both single-gRNA nuclease cleavage and for a dual-gRNA paired "nickase" strategy.

Criteria for selecting gRNAs and the determination for which gRNAs can be used for the dual-gRNA paired "nickase" strategy is based on two considerations:
1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

gRNAs were identified and ranked into 5 tiers for *S. pyogenes* (Tables 43A-43E), and *N. meningitidis* (Tables 45A-45E); and 7 tiers for *S. aureus* (Tables 44A-44G). For *S. pyogenes*, and *N. meningitidis*, the targeting domain for tier 1 gRNA molecules were selected based on (1) distance to a target site (e.g., start codon), e.g., within 500 bp (e.g., downstream) of the target site (e.g., start codon), (2) a high level of orthogonality and (3) the presence of 5'G. The targeting domain for tier 2 gRNA molecules were selected based on (1) distance to a target site (e.g., start codon), e.g., within 500 bp (e.g., downstream) of the target site (e.g., start codon) and (2) a high level of orthogonality. The targeting domain for tier 3 gRNA molecules were selected based on (1) distance to a target site (e.g., start codon), e.g., within 500 bp (e.g., downstream) of the target site (e.g., start codon) and (2) the presence of 5'G. The targeting domain for tier 4 gRNA molecules were selected based on distance to a target site (e.g., start codon), e.g., within 500 bp (e.g., downstream) of the target site (e.g., start codon). The targeting domain for tier 5 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon). For *S. aureus*, the targeting domain for tier 1 gRNA molecules were selected based on (1) distance to a target site (e.g., start codon), e.g., within 500 bp (e.g., downstream) of the target site (e.g., start codon), (2) a high level of orthogonality, (3) the presence of 5'G and (4) PAM is NNGRRT. The targeting domain for tier 2 gRNA molecules were selected based on (1) distance to a target site (e.g., start codon), e.g., within 500 bp (e.g., downstream) of the target site (e.g., start codon), (2) a high level of orthogonality, and (3) PAM is NNGRRT. The targeting domain for tier 3 gRNA molecules were selected based on (1) distance to a target site (e.g., start codon), e.g., within 500 bp (e.g., downstream) of the target site (e.g., start codon) and (2) PAM is NNGRRT. The targeting domain for tier 4 gRNA molecules were selected based on (1) distance to a target site (e.g., start codon), e.g., within 500 bp (e.g., downstream) of the target site (e.g., start codon) and (2) PAM is NNGRRV. The targeting domain for tier 5 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), (2) the presence of 5'G and (3) PAM is NNGRRT. The targeting domain for tier 6 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) PAM is NNGRRT. The targeting domain for tier 7 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes*, *S. Aureus*, and *N. meningitidis* to Knock Down the SCNN1A Gene As an example, three strategies were utilized to identify gRNAs for use with *S. pyogenes*, *S. aureus* and *N. meningitidis* Cas9 enzymes.

Guide RNAs (gRNAs) for use with *S. pyogenes*, *S. aureus* and *N. meningitidis* Cas9s were identified using a DNA sequence searching algorithm. Guide RNA design was carried out using a custom guide RNA design software based on the public tool cas-offinder (reference:Cas-OFFinder: a fast and versatile algorithm that searches for potential off-target sites of Cas9 RNA-guided endonucleases., Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 46A-46E, 47A-47G or 48A-48E, e.g., the targeting domains of 18 or more nucleotides may comprise the 17-mer gRNAs described in Tables 46A-46E, 47A-47G or 48A-48E. Targeting domains, disclosed herein, may comprises the 18-mer described in Tables 46A-46E, 47A-47G or 48A-48E, e.g., the targeting domains of 19 or more nucleotides may comprise the 18-mer gRNAs described in Tables 46A-46E, 47A-47G or 48A-48E. Targeting domains, disclosed herein, may comprises the 19-mer described in Tables 46A-46E, 47A-47G or 48A-48E, e.g., the targeting domains of 20 or more nucleotides may comprise the 19-mer gRNAs described in Tables 46A-46E, 47A-47G or 48A-48E. Targeting domains, disclosed herein, may comprises the 20-mer gRNAs described in Tables 46A-46E, 47A-47G or 48A-48E, e.g., the targeting domains of 21 or more nucleotides may comprise the 20-mer gRNAs described in Tables 46A-46E, 47A-47G or 48A-48E. Targeting domains, disclosed herein, may comprises the 21-mer described in Tables 46A-46E, 47A-47G or 48A-48E, e.g., the targeting domains of 22 or more nucleotides may comprise the 21-mer gRNAs described in Tables 46A-46E, 47A-47G or 48A-48E. Targeting domains, disclosed herein, may comprises the 22-mer described in Tables 46A-46E, 47A-47G or 48A-48E, e.g., the targeting domains of 23 or more nucleotides may comprise the 22-mer gRNAs described in Tables 46A-46E, 47A-47G or 48A-48E. Targeting domains, disclosed herein, may comprises the 23-mer described in Tables 46A-46E, 47A-47G or 48A-48E, e.g., the targeting domains of 24 or more nucleotides may comprise the 23-mer gRNAs described in Tables 46A-46E, 47A-47G or 48A-48E. Targeting domains, disclosed herein, may comprises the 24-mer described in Tables 46A-46E, 47A-47G or 48A-48E, e.g., the targeting domains of 25 or more nucleotides may comprise the 24-mer gRNAs described in Tables 46A-46E, 47A-47G or 48A-48E.

The targeting domains discussed herein can be incorporated into the gRNAs described herein.

gRNAs were identified and ranked into 5 tiers for *S. pyogenes* (Tables 46A-46E), and *N. meningitidis* (Tables 48A-48E); and 7 tiers for *S. aureus* (Tables 47A-47G). For *S. pyogenes*, and *N. meningitidis*, the targeting domain for tier 1 gRNA molecules were selected based on (1) distance to a target site, e.g., within 500 bp (e.g., upstream or downstream) of a transcription start site (TSS), (2) a high level of orthogonality and (3) the presence of 5'G. The targeting domain for tier 2 gRNA molecules were selected based on (1) distance to a target site, e.g., within 500 bp (e.g., upstream or downstream) of a transcription start site (TSS) and (2) a high level of orthogonality. The targeting domain for tier 3 gRNA molecules were selected based on (1) distance to a target site, e.g., within 500 bp (e.g., upstream or downstream) of a transcription start site (TSS) and (2) the presence of 5'G. The targeting domain for tier 4 gRNA molecules were selected based on distance to a target site, e.g., within 500 bp (e.g., upstream or downstream) of a transcription start site (TSS). The targeting domain for tier 5 gRNA molecules were selected based on distance to the target site, e.g., within the additional 500 bp (e.g., upstream or downstream) of a transcription start site (TSS), e.g., extending to 1 kb upstream and downstream of a TSS. For *S. aureus*, the targeting domain for tier 1 gRNA molecules were selected based on (1) distance to a target site, e.g., within 500 bp (e.g., upstream or downstream) of a transcription start site (TSS), (2) a high level of orthogonality, (3) the presence of 5'G and (4) PAM is NNGRRT. The targeting domain for tier 2 gRNA molecules were selected based on (1) distance to a target site, e.g., within 500 bp (e.g., upstream or downstream) of a transcription start site (TSS), (2) a high level of orthogonality, and (3) PAM is NNGRRT. The targeting domain for tier 3 gRNA molecules were selected based on (1) distance to a target site, e.g., within 500 bp (e.g., upstream or downstream) of a transcription start site (TSS) and (2) PAM is NNGRRT. The targeting domain for tier 4 gRNA molecules were selected based on (1) distance to a target site, e.g., within 500 bp (e.g., upstream or downstream) of a transcription start site (TSS) and (2) PAM is NNGRRV. The targeting domain for tier 5 gRNA molecules were selected based on (1) distance to the target site, e.g., within the additional 500 bp (e.g., upstream or downstream) of a transcription start site (TSS), e.g., extending to 1 kb upstream and downstream of a TSS, (2) the presence of 5'G and (3) PAM is NNGRRT. The targeting domain for tier 6 gRNA molecules were selected based on (1) distance to the target site, e.g., within the additional 500 bp (e.g., upstream or downstream) of a transcription start site (TSS), e.g., extending to 1 kb upstream and downstream of a TSS and (2) PAM is NNGRRT. The targeting domain for tier 7 gRNA molecules were selected based on (1) distance to the target site, e.g., within the additional 500 bp (e.g., upstream or downstream) of a transcription start site (TSS), e.g., extending to 1 kb upstream and downstream of a TSS and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes*, *S. Aureus*, and N. For Correcting a Mutation (e.g., delF508, G551D, G542X, N1303K, R117H, W1282X, R553X, 2789+5G→A, or 3272-26A→G) in the CFTR Gene As an example, three strategies were utilized to identify gRNAs for use with *S. pyogenes*, *S. aureus* and *N. meningitidis* Cas9 enzymes.

In the first strategy, guide RNAs (gRNAs) for use with the *S. pyogenes* Cas9 (Tables 1A-1C or 2A-2C) were identified using the publically available web-based ZiFiT server (Fu et al., Improving CRISPR-Cas nuclease specificity using truncated guide RNAs. Nat Biotechnol. 2014 Jan. 26. doi: 10.1038/nbt.2808. PubMed PMID: 24463574, for the original references see Sander et al., 2007, NAR 35:W599-605; Sander et al., 2010, NAR 38: W462-8). In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available Repeat-Masker program. RepeatMasker searches input DNA sequences for repeated elements and regions of low complexity. The output is a detailed annotation of the repeats present in a given query sequence. Following identification, gRNAs for use with a *S. pyogenes* Cas9 were ranked into 3 or 4 tiers, as described below.

The gRNAs in tier 1 were selected based on their distance to the target site and their orthogonality in the genome (based on the ZiFiT identification of close matches in the human genome containing an NGG PAM). As an example, for all targets, both 17-mer and 20-mer gRNAs were designed. gRNAs were also selected both for single-gRNA nuclease cutting and for the dual gRNA nickase strategy. Criteria for selecting gRNAs and the determination for which gRNAs can be used for which strategy is based on several considerations:

3. For the dual nickase strategy, gRNA pairs should be oriented on the DNA such that PAMs are facing out and cutting with the D10A Cas9 nickase will result in 5' overhangs.

4. An assumption that cleaving with dual nickase pairs will result in deletion of the entire intervening sequence at a reasonable frequency. However, it will also often result in indel mutations at the site of only one of the gRNAs. Candidate pair members can be tested for how efficiently they remove the entire sequence versus just causing indel mutations at the site of one gRNA.

While it can be desirable to have gRNAs start with a 5' G, this requirement was relaxed for some gRNAs in tier 1 in order to identify guides in the correct orientation, within a reasonable distance to the mutation and with a high level of orthogonality. In order to find a pair for the dual-nickase strategy it was necessary to either extend the distance from the mutation or remove the requirement for the 5'G. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

As discussed above, gRNAs were identified for single-gRNA nuclease cleavage as well as for a dual-gRNA paired "nickase" strategy, as indicated.

gRNAs for use with the *N. meningitidis* (Tables 1E or 2E) and *S. aureus* (Tables 1D or 2D) Cas9s were identified manually by scanning genomic DNA sequence for the presence of PAM sequences. These gRNAs were not separated into tiers, but are provided in single lists for each species.

In a second strategy, Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference:Cas-OFFinder: a fast and versatile algorithm that searches for potential off-target sites of Cas9 RNA-guided endonucleases., Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 18 or more nucleotides may comprise the 17-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. Targeting domains, disclosed herein, may comprises the 18-mer described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 19 or more nucleotides may comprise the 18-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. Targeting domains, disclosed herein, may comprises the 19-mer described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 20 or more nucleotides may comprise the 19-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. Targeting domains, disclosed herein, may comprises the 20-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 21 or more nucleotides may comprise the 20-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. Targeting domains, disclosed herein, may comprises the 21-mer described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 22 or more nucleotides may comprise the 21-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. Targeting domains, disclosed herein, may comprises the 22-mer described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 23 or more nucleotides may comprise the 22-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. Targeting domains, disclosed herein, may comprises the 23-mer described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 24 or more nucleotides may comprise the 23-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. Targeting domains, disclosed herein, may comprises the 24-mer described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B, e.g., the targeting domains of 25 or more nucleotides may comprise the 24-mer gRNAs described in Tables 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, or 30A-30B. gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, gRNAs were identified and ranked into 4 tiers for *S. pyogenes* (Tables 4A-4D, 7A-7D, 10A-10C, 13A-13D, 16A-16D, 19A-19D, 12A-12D, 22A-22D, 25A-25D or 28A-28D), and *N. meningitidis* (Tables 6A-6C, 9A-9B, 12A-12C, 15A-15C, 18A-18C, 21A-21B, 24A-24D, 27A-27D, or 30A-30B); and 5 tiers for *S. aureus* (Tables 5A-5E, 8A-8E, 11A-11E, 14A-14E, 17A-17E, 20A-20E, 23A-23E, 26A-26E, or 29A-29E). For *S. pyogenes*, and *N. meningitidis*, the targeting domain or tier 1 gRNA molecules were selected based on (1) distance to a target site, e.g., within 200 bp from a mutation (e.g., delF508, G551D, G542X, N1303K, R117H, W1282X, R553X, 2789+5G→A, or 3272-26A→G), (2) a high level of orthogonality and (3) the presence of 5'G. The targeting domain for tier 2 gRNA molecules were selected based on (1) distance to a target site, e.g., within 200 bp from a mutation (e.g., delF508, G551D, G542X, N1303K, R117H, W1282X, R553X, 2789+5G→A, or 3272-26A→G) and (2) a high level of orthogonality. The targeting domain for tier 3 gRNA molecules were selected based on (1) distance to a target site, e.g., within 200 bp from a mutation (e.g., delF508, G551D, G542X, N1303K, R117H, W1282X, R553X, 2789+5G→A, or 3272-26A→G) and (2) the presence of 5'G. The targeting domain for tier 4 gRNA molecules were selected based on distance to a target site, e.g., within 200 bp from a mutation (e.g., delF508, G551D, G542X, N1303K, R117H, W1282X, R553X, 2789+5G→A, or 3272-26A→G). For *S. aureus*, the targeting domain for tier 1 gRNA molecules were selected based on (1) distance to a target site, e.g., within 200 bp from a mutation (e.g., delF508, G551D, G542X, N1303K, R117H, W1282X, R553X, 2789+5G→A, or 3272-26A→G), (2) a high level of orthogonality, (3) the presence of 5'G and (4) PAM is NNGRRT. The targeting domain for tier 2 gRNA molecules were selected based on (1) distance to a target site, e.g., within 200 bp from a mutation (e.g., delF508, G551D, G542X, N1303K, R117H, W1282X, R553X, 2789+5G→A, or 3272-26A→G), (2) a high level of orthogonality, and (3) PAM is NNGRRT. The targeting domain for tier 3 gRNA molecules were selected based on (1) distance to a target site, e.g., within 200 bp from a mutation (e.g., delF508, G551D, G542X, N1303K, R117H, W1282X, R553X, 2789+5G→A, or 3272-26A→G), (2) the presence of a 5'G and (2) PAM is NNGRRT. The targeting domain for tier 4 gRNA molecules were selected based on (1) distance to a target site, e.g., within 200 bp from a mutation (e.g., delF508, G551D, G542X, N1303K, R117H, W1282X, R553X, 2789+5G→A, or 3272-26A→G) and (2) PAM is NNGRRT. The targeting domain for tier 5 gRNA molecules were selected based on (1) (1) distance to a target site, e.g., within 200 bp from a mutation (e.g., delF508, G551D, G542X, N1303K, R117H, W1282X, R553X, 2789+5G→A, or 3272-26A→G) and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes*, *S. Aureus*, and *N. meningitidis* for Targeting an Intronic Mutation (e.g., 3849+10 kbC→T or 3272-26A→G) Regions of the CFTR Gene (e.g., Mediated by NHEJ)

As an example, three strategies were utilized to identify gRNAs for use with *S. pyogenes, S. aureus* and *N. meningitidis* Cas9 enzymes.

Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference:Cas-OFFinder: a fast and versatile algorithm that searches for potential off-target sites of Cas9 RNA-guided endonucleases., Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 31A-31D, 32A-32D, 33A-33B, 34A-34D, 35A-35D, 36A-36D, e.g., the targeting domains of 18 or more nucleotides may comprise the 17-mer gRNAs described in Tables 31A-31D, 32A-32D, 33A-33B, 34A-34D, 35A-35D, 36A-36D. Targeting domains, disclosed herein, may comprises the 18-mer described in Tables 31A-31D, 32A-32D, 33A-33B, 34A-34D, 35A-35D, 36A-36D, e.g., the targeting domains of 19 or more nucleotides may comprise the 18-mer gRNAs described in Tables 31A-31D, 32A-32D, 33A-33B, 34A-34D, 35A-35D, 36A-36D. Targeting domains, disclosed herein, may comprises the 19-mer described in Tables 31A-31D, 32A-32D, 33A-33B, 34A-34D, 35A-35D, 36A-36D, e.g., the targeting domains of 20 or more nucleotides may comprise the 19-mer gRNAs described in Tables 31A-31D, 32A-32D, 33A-33B, 34A-34D, 35A-35D, 36A-36D. Targeting domains, disclosed herein, may comprises the 20-mer gRNAs described in Tables 31A-31D, 32A-32D, 33A-33B, 34A-34D, 35A-35D, 36A-36D, e.g., the targeting domains of 21 or more nucleotides may comprise the 20-mer gRNAs described in Tables 31A-31D, 32A-32D, 33A-33B, 34A-34D, 35A-35D, 36A-36D. Targeting domains, disclosed herein, may comprises the 21-mer described in Tables 31A-31D, 32A-32D, 33A-33B, 34A-34D, 35A-35D, 36A-36D, e.g., the targeting domains of 22 or more nucleotides may comprise the 21-mer gRNAs described in Tables 31A-31D, 32A-32D, 33A-33B, 34A-34D, 35A-35D, 36A-36D. Targeting domains, disclosed herein, may comprises the 22-mer described in Tables 31A-31D, 32A-32D, 33A-33B, 34A-34D, 35A-35D, 36A-36D, e.g., the targeting domains of 23 or more nucleotides may comprise the 22-mer gRNAs described in Tables 31A-31D, 32A-32D, 33A-33B, 34A-34D, 35A-35D, 36A-36D. Targeting domains, disclosed herein, may comprises the 23-mer described in Tables 31A-31D, 32A-32D, 33A-33B, 34A-34D, 35A-35D, 36A-36D, e.g., the targeting domains of 24 or more nucleotides may comprise the 23-mer gRNAs described in Tables 31A-31D, 32A-32D, 33A-33B, 34A-34D, 35A-35D, 36A-36D. Targeting domains, disclosed herein, may comprises the 24-mer described in Tables 31A-31D, 32A-32D, 33A-33B, 34A-34D, 35A-35D, 36A-36D, e.g., the targeting domains of 25 or more nucleotides may comprise the 24-mer gRNAs described in Tables 31A-31D, 32A-32D, 33A-33B, 34A-34D, 35A-35D, 36A-36D. gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, gRNAs were identified and ranked into 4 tiers for *S. pyogenes* (Tables 31A-31D or 34A-34D), and *N. meningitidis* (Tables 33A-33B or 36A-36D); and 4 tiers for *S. aureus* (Tables 32A-32D or 35A-35D). For *S. pyogenes*, and *N. meningitidis*, the targeting domain for tier 1 gRNA molecules were selected based on (1) distance to a target site, e.g., within 500 bp, e.g., within 200 bp from a mutation (e.g., 3849+10 kbC→T or 3272-26A→G), (2) a high level of orthogonality and (3) the presence of 5'G. The targeting domain for tier 2 gRNA molecules were selected based on (1) distance to a target site, e.g., within 500 bp, e.g., within 200 bp from a mutation (e.g., 3849+10 kbC→T or 3272-26A→G) and (2) a high level of orthogonality. The targeting domain for tier 3 gRNA molecules were selected based on (1) distance to a target site, e.g., within 500 bp, e.g., within 200 bp from a mutation (e.g., 3849+10 kbC→T or 3272-26A→G) and (2) the presence of 5'G. The targeting domain for tier 4 gRNA molecules were selected based on distance to a target site, e.g., within 500 bp, e.g., within 200 bp from a mutation (e.g., 3849+10 kbC→T or 3272-26A→G). For *S. aureus*, the targeting domain for tier 1 gRNA molecules were selected based on (1) distance to a target site, e.g., within 500 bp, e.g., within 200 bp from a mutation (e.g., 3849+10 kbC→T or 3272-26A→G), (2) a high level of orthogonality, (3) the presence of 5'G and (4) PAM is NNGRRT. The targeting domain for tier 2 gRNA molecules were selected based on (1) distance to a target site, e.g., within 500 bp, e.g., within 200 bp from a mutation (e.g., 3849+10 kbC→T or 3272-26A→G), (2) a high level of orthogonality, and (3) PAM is NNGRRT. The targeting domain for tier 3 gRNA molecules were selected based on (1) distance to a target site, e.g., within 500 bp, e.g., within 200 bp from a mutation (e.g., 3849+10 kbC→T or 3272-26A→G) and (2) PAM is NNGRRT. The targeting domain for tier 4 gRNA molecules were selected based on (1) (1) distance to a target site, e.g., within 500 bp, e.g., within 200 bp from a mutation (e.g., 3849+10 kbC→T or 3272-26A→G) and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes, S. Aureus,* and *N.* for Targeting an Intronic Region (e.g., Intron 2 or Intron 10) of the CFTR Gene (e.g., Mediated by cDNA)

Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference:Cas-OFFinder: a fast and versatile algorithm that searches for potential off-target sites of Cas9 RNA-guided endonucleases., Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 37A-37D, 38A-38E, 39A-39D, 40A-40D, 41A-41E, or 42A-42D, e.g., the targeting domains of 18 or more nucleotides may comprise the 17-mer gRNAs described in Tables 37A-37D, 38A-38E, 39A-39D, 40A-40D, 41A-41E, or 42A-42D. Targeting domains, disclosed herein, may comprises the 18-mer described in Tables 37A-37D, 38A-38E, 39A-39D, 40A-40D, 41A-41E, or 42A-42D, e.g., the targeting domains of 19 or more nucleotides may comprise the 18-mer gRNAs described in Tables 37A-37D, 38A-38E, 39A-39D, 40A-40D, 41A-41E, or 42A-42D. Targeting domains, disclosed herein, may comprises the 19-mer described in Tables 37A-37D, 38A-38E, 39A-39D, 40A-40D, 41A-41E, or 42A-42D, e.g., the targeting domains of 20 or more nucleotides may comprise the 19-mer gRNAs described in Tables 37A-37D, 38A-38E, 39A-39D, 40A-40D, 41A-41E, or 42A-42D. Targeting domains, disclosed herein, may comprises the 20-mer described in Tables 37A-37D, 38A-38E, 39A-39D, 40A-40D, 41A-41E, or 42A-42D, e.g., the targeting domains of 21 or more nucleotides may comprise the 20-mer gRNAs described in Tables 37A-37D, 38A-38E, 39A-39D, 40A-40D, 41A-41E, or 42A-42D. Targeting domains, disclosed herein, may comprises the 21-mer described in Tables 37A-37D, 38A-38E, 39A-39D, 40A-40D, 41A-41E, or 42A-42D, e.g., the targeting domains of 22 or more nucleotides may comprise the 21-mer gRNAs described in Tables 37A-37D, 38A-38E, 39A-39D, 40A-40D, 41A-41E, or 42A-42D. Targeting domains, disclosed herein, may comprises the 22-mer described in Tables 37A-37D, 38A-38E, 39A-39D, 40A-40D, 41A-41E, or 42A-42D, e.g., the targeting domains of 23 or more nucleotides may comprise the 22-mer gRNAs described in Tables 37A-37D, 38A-38E, 39A-39D, 40A-40D, 41A-41E, or 42A-42D. Targeting domains, disclosed herein, may comprises the 23-mer described in Tables 37A-37D, 38A-38E, 39A-39D, 40A-40D, 41A-41E, or 42A-42D, e.g., the targeting domains of 24 or more nucleotides may comprise the 23-mer gRNAs described in Tables 37A-37D, 38A-38E, 39A-39D, 40A-40D, 41A-41E, or 42A-42D. Targeting domains, disclosed herein, may comprises the 24-mer described in Tables 37A-37D, 38A-38E, 39A-39D, 40A-40D, 41A-41E, or 42A-42D, e.g., the targeting domains of 25 or more nucleotides may comprise the 24-mer gRNAs described in Tables 37A-37D, 38A-38E, 39A-39D, 40A-40D, 41A-41E, or 42A-42D. gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, gRNAs were identified and ranked into 4 tiers for *S. pyogenes* (Tables 37A-37D or 40A-40D), and *N. meningitidis* (Tables 39A-39D or 42A-42D); and 4 tiers for *S. aureus* (Tables 38A-38E or 41A-41E). For *S. pyogenes,* and *N. meningitidis*, the targeting domain for tier 1 gRNA molecules were selected based on (1) target position, e.g., intron 2 or intron 10, (2) a high level of orthogonality and (3) the presence of 5'G. The targeting domain for tier 2 gRNA molecules were selected based on (1) target position, e.g., intron 2 or intron 10 and (2) a high level of orthogonality. The targeting domain for tier 3 gRNA molecules were selected based on (1) target position, e.g., intron 2 or intron 10 and (2) the presence of 5'G. The targeting domain for tier 4 gRNA molecules were selected based on target position, e.g., intron 2 or intron 10. For *S. aureus*, the targeting domain for tier 1 gRNA molecules were selected based on (1) target position, e.g., intron 2 or intron 10, (2) a high level of orthogonality, (3) the presence of 5'G and (4) PAM is NNGRRT. The targeting domain for tier 2 gRNA molecules were selected based on (1) target position, e.g., intron 2 or intron 10, (2) a high level of orthogonality, and (3) PAM is NNGRRT. The targeting domain for tier 3 gRNA molecules were selected based on (1) target position, e.g., intron 2 or intron 10, (2) the presence of a 5'G and (2) PAM is NNGRRT. The targeting domain for tier 4 gRNA molecules were selected based on (1) target position, e.g., intron 2 or intron 10 and (2) PAM is NNGRRT. The targeting domain for tier 5 gRNA molecules were selected based on (1) (1) target position, e.g., intron 2 or intron 10 and (2) PAM is NNGRRV. Note that tiers are non-inclusive (each gRNA is listed only once for the strategy). In certain instances, no gRNA was identified based on the criteria of the particular tier.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

Any of the targeting domains in the tables described herein can be used with a Cas9 nickase molecule to generate a single strand break.

Any of the targeting domains in the tables described herein can be used with a Cas9 nuclease molecule to generate a double strand break.

When two gRNAs designed for use to target two Cas9 molecules, one Cas9 can be one species, the second Cas9 can be from a different species. Both Cas9 species are used to generate a single or double-strand break, as desired.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

Exemplary Targeting Domains

Table 1A provides exemplary targeting domains for the F508del target position in the CFTR gene selected according to the first tier parameters. The targeting domains are selected based on close proximity to mutation and orthogonality in the human genome. It is contemplated herein that the targeting domain hybridizes to the target domain through complementary base pairing. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. In an embodiment, two 17-mer RNAs are used to target two Cas9 nucleases or two Cas9 nickases, e.g., CFTR-18 and CFTR-16 are used.

TABLE 1A

| gRNA Name | DNA Strand | Targeting Domain | Target Site Length | Seq ID |
|---|---|---|---|---|
| CFTR-1 | − | GAGGGUAAAAUUAAGCACAG | 20 | 387 |
| CFTR-6 | + | AGUUUCUUACCUCUUCUAGU | 20 | 388 |
| CFTR-10 | + | AAUGGUGCCAGGCAUAAUCC | 20 | 389 |

TABLE 1A-continued

| gRNA Name | DNA Strand | Targeting Domain | Target Site Length | Seq ID |
|---|---|---|---|---|
| CFTR-12 | − | GGUAAAAUUAAGCACAG | 17 | 390 |
| CFTR-16 | − | AGCAUGCCAACUAGAAG | 17 | 391 |
| CFTR-18 | + | GUAUCUAUAUUCAUCAU | 17 | 392 |

Table 1B provides exemplary targeting domains for the F508del target position in the CFTR gene selected according to the second tier parameters. The targeting domains are selected based on the presence of a 5' G and reasonable proximity to mutation. It is contemplated herein that the targeting domain hybridizes to the target domain through complementary base pairing. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 1B

| gRNA Name | DNA Strand | Targeting Domain | Target Site Length | Seq ID |
|---|---|---|---|---|
| CFTR-19 | + | GAUGAUAUUUCUUUAA | 17 | 393 |
| CFTR-21 | + | GGUGCCAGGCAUAAUCC | 17 | 394 |
| CFTR-24 | − | GAUAAUGACCUAAUAAUGAU | 20 | 395 |
| CFTR-29 | − | GGGAGAACUGGAGCCUUCAG | 20 | 396 |
| CFTR-30 | − | GGAGAACUGGAGCCUUCAGA | 20 | 397 |
| CFTR-37 | + | GUAGACUAACCGAUUGAAUA | 20 | 398 |
| CFTR-44 | + | GUCAUUAUCAAAUCACGCUC | 20 | 399 |
| CFTR-50 | − | GGUGAUUAUGGGAGAAC | 17 | 400 |
| CFTR-52 | − | GAACUGGAGCCUUCAGA | 17 | 401 |
| CFTR-57 | − | GGGUAAGCUACUGUGAA | 17 | 402 |
| CFTR-59 | + | GACUAACCGAUUGAAUA | 17 | 403 |
| CFTR-60 | + | GAGCCAAAUAUAUAAUU | 17 | 404 |

Table 1C provides exemplary targeting domains for the F508del target position in the CFTR gene selected according to the third tier parameters. The targeting domains are selected based on reasonable proximity to mutation. It is contemplated herein that the targeting domain hybridizes to the target domain through complementary base pairing. Any of the targeting domains in the table can be used with a *S.*

*pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 1C

| gRNA Name | DNA Strand | Targeting Domain | Target Site Length | Seq ID |
|---|---|---|---|---|
| CFTR-2 | − | CAUUCUGUUCUCAGUUUUCC | 20 | 405 |
| CFTR-3 | − | CAGUUUUCCUGGAUUAUGCC | 20 | 406 |
| CFTR-4 | − | AUUAAAGAAAAUAUCAUCUU | 20 | 407 |
| CFTR-5 | − | CAAAGCAUGCCAACUAGAAG | 20 | 408 |
| CFTR-6 | + | AGUUUCUUACCUCUUCUAGU | 20 | 388 |
| CFTR-7 | + | UCUGUAUCUAUAUUCAUCAU | 20 | 409 |
| CFTR-8 | + | AAAGAUGAUAUUUUCUUUAA | 20 | 410 |
| CFTR-9 | + | AUAUUUCUUUAAUGGUGCC | 20 | 411 |
| CFTR-10 | + | AAUGGUGCCAGGCAUAAUCC | 20 | 389 |
| CFTR-11 | + | UGCUUAAUUUUACCCUCUGA | 20 | 412 |
| CFTR-13 | − | UCUGUUCUCAGUUUUCC | 17 | 413 |
| CFTR-14 | − | UUUUCCUGGAUUAUGCC | 17 | 414 |
| CFTR-15 | − | AAAGAAAAUAUCAUCUU | 17 | 415 |
| CFTR-16 | − | AGCAUGCCAACUAGAAG | 17 | 391 |
| CFTR-17 | + | UUCUUACCUCUUCUAGU | 17 | 416 |
| CFTR-20 | + | UUUUCUUUAAUGGUGCC | 17 | 417 |
| CFTR-22 | + | UUAAUUUUACCCUCUGA | 17 | 418 |
| CFTR-23 | − | UGAUAAUGACCUAAUAAUGA | 20 | 419 |
| CFTR-25 | − | UUUCCAGACUUCACUUCUAA | 20 | 420 |
| CFTR-26 | − | UUCACUUCUAAUGGUGAUUA | 20 | 421 |
| CFTR-27 | − | UCACUUCUAAUGGUGAUUAU | 20 | 422 |
| CFTR-28 | − | AAUGGUGAUUAUGGGAGAAC | 20 | 423 |
| CFTR-31 | − | CACUACCCAAAUUAUAUAUU | 20 | 424 |
| CFTR-32 | − | UAUUUGGCUCCAUAUUCAAU | 20 | 425 |
| CFTR-33 | − | AUAUAUUUAUGUUUCCUCUA | 20 | 426 |
| CFTR-34 | − | UAUAUUUAUGUUUCCUCUAU | 20 | 427 |
| CFTR-35 | − | UAUGGGUAAGCUACUGUGAA | 20 | 428 |
| CFTR-36 | + | UCACAGUAGCUUACCCAUAG | 20 | 429 |
| CFTR-38 | + | AUGGAGCCAAAUAUAUAAUU | 20 | 430 |
| CFTR-39 | + | UGGAGCCAAAUAUAUAAUUU | 20 | 431 |

TABLE 1C-continued

| gRNA Name | DNA Strand | Targeting Domain | Target Site Length | Seq ID |
|---|---|---|---|---|
| CFTR-40 | + | AUAUAAUUUGGGUAGUGUGA | 20 | 432 |
| CFTR-41 | + | UAUAAUUUGGGUAGUGUGAA | 20 | 433 |
| CFTR-42 | + | UCACCAUUAGAAGUGAAGUC | 20 | 434 |
| CFTR-43 | + | AAAUAAAACCCAUCAUUAUU | 20 | 435 |
| CFTR-45 | − | UAAUGACCUAAUAAUGA | 17 | 436 |
| CFTR-46 | − | AAUGACCUAAUAAUGAU | 17 | 437 |
| CFTR-47 | − | CCAGACUUCACUUCUAA | 17 | 438 |
| CFTR-48 | − | ACUUCUAAUGGUGAUUA | 17 | 439 |
| CFTR-49 | − | CUUCUAAUGGUGAUUAU | 17 | 440 |
| CFTR-51 | − | AGAACUGGAGCCUUCAG | 17 | 441 |
| CFTR-53 | − | UACCCAAAUUAUAUAUU | 17 | 442 |
| CFTR-54 | − | UUGGCUCCAUAUUCAAU | 17 | 443 |
| CFTR-55 | − | UAUUUAUGUUUCCUCUA | 17 | 444 |
| CFTR-56 | − | AUUUAUGUUUCCUCUAU | 17 | 445 |
| CFTR-58 | + | CAGUAGCUUACCCAUAG | 17 | 446 |
| CFTR-61 | + | AGCCAAAUAUAUAAUUU | 17 | 447 |
| CFTR-62 | + | UAAUUUGGGUAGUGUGA | 17 | 448 |
| CFTR-63 | + | AAUUUGGGUAGUGUGAA | 17 | 449 |
| CFTR-64 | + | CCAUUAGAAGUGAAGUC | 17 | 450 |
| CFTR-65 | + | UAAAACCCAUCAUUAUU | 17 | 451 |
| CFTR-66 | + | AUUAUCAAAUCACGCUC | 17 | 452 |

Table 1D provides exemplary targeting domains for the F508del target position in the CFTR gene selected based on reasonable proximity to mutation. It is contemplated herein that the targeting domain hybridizes to the target domain through complementary base pairing. Any of the targeting domains in the table can be used with a *S. aureus* Cas9 molecule that gives double stranded cleavage. Any of the targeting domains in the table can be used with a *S. aureus* Cas9 single-stranded break nucleases (nickases). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 1D

| gRNA Name | DNA Strand | Targeting Domain | Target Site Length | Seq ID |
|---|---|---|---|---|
| CFTR-111 | − | UAAUUGGAGGCAAGUGAAUC | 20 | 655 |
| CFTR-112 | − | UUGAUAAUGACCUAAUAAUG | 20 | 656 |

TABLE 1D-continued

| gRNA Name | DNA Strand | Targeting Domain | Target Site Length | Seq ID |
|---|---|---|---|---|
| CFTR-113 | - | CUUCACUUCUAAUGGUGAUU | 20 | 657 |
| CFTR-26 | - | UUCACUUCUAAUGGUGAUUA | 20 | 421 |
| CFTR-27 | - | UCACUUCUAAUGGUGAUUAU | 20 | 422 |
| CFTR-116 | - | ACUUCUAAUGGUGAUUAUGG | 20 | 658 |
| CFTR-117 | - | UAAUGGUGAUUAUGGGAGAA | 20 | 659 |
| CFTR-28 | - | AAUGGUGAUUAUGGGAGAAC | 20 | 423 |
| CFTR-119 | - | UAUGGGAGAACUGGAGCCUU | 20 | 660 |
| CFTR-120 | - | UGGGAGAACUGGAGCCUUCA | 20 | 661 |
| CFTR-121 | - | AGAGGGUAAAAUUAAGCACA | 20 | 662 |
| CFTR-1 | - | GAGGGUAAAAUUAAGCACAG | 20 | 387 |
| CFTR-123 | - | GGUAAAAUUAAGCACAGUGG | 20 | 663 |
| CFTR-124 | - | UCAUUCUGUUCUCAGUUUUC | 20 | 664 |
| CFTR-125 | - | GAUUAUGCCUGGCACCAUUA | 20 | 665 |
| CFTR-126 | - | CAUCUUUGGUGUUUCCUAUG | 20 | 666 |
| CFTR-127 | - | UCCUAUGAUGAAUAUAGAUA | 20 | 667 |
| CFTR-128 | - | CGUCAUCAAAGCAUGCCAAC | 20 | 668 |
| CFTR-129 | - | CAUCAAAGCAUGCCAACUAG | 20 | 669 |
| CFTR-130 | - | GCAUGCCAACUAGAAGAGGU | 20 | 670 |
| CFTR-131 | - | UAGAAGAGGUAAGAAACUAU | 20 | 671 |
| CFTR-132 | - | AAAACUUUUUGAUUAUGCAU | 20 | 672 |
| CFTR-133 | - | CAUAUAUUUAUGUUUCCUCU | 20 | 673 |
| CFTR-134 | - | UCCUCUAUGGGUAAGCUACU | 20 | 674 |
| CFTR-135 | - | CUAUGGGUAAGCUACUGUGA | 20 | 675 |
| CFTR-136 | + | GGUCAUUAUCAAAUCACGCU | 20 | 676 |
| CFTR-42 | + | UCACCAUUAGAAGUGAAGUC | 20 | 434 |
| CFTR-138 | + | AUCACCAUUAGAAGUGAAGU | 20 | 677 |
| CFTR-139 | + | UCCCAUAAUCACCAUUAGAA | 20 | 678 |
| CFTR-140 | + | AGUUCUCCCAUAAUCACCAU | 20 | 679 |
| CFTR-141 | + | ACUGUGCUUAAUUUUACCCU | 20 | 680 |
| CFTR-142 | + | CCAGGAAAACUGAGAACAGA | 20 | 681 |
| CFTR-143 | + | UAAUCCAGGAAAACUGAGAA | 20 | 682 |
| CFTR-144 | + | AGGCAUAAUCCAGGAAAACU | 20 | 683 |
| CFTR-145 | + | CCAGGCAUAAUCCAGGAAAA | 20 | 684 |
| CFTR-10 | + | AAUGGUGCCAGGCAUAAUCC | 20 | 389 |
| CFTR-147 | + | UAAUGGUGCCAGGCAUAAUC | 20 | 685 |
| CFTR-7 | + | UCUGUAUCUAUAUUCAUCAU | 20 | 409 |
| CFTR-149 | + | UUCUGUAUCUAUAUUCAUCA | 20 | 686 |
| CFTR-150 | + | UAUAUAAUUUGGGUAGUGUG | 20 | 687 |
| CFTR-151 | + | AAAUAUAUAAUUUGGGUAGU | 20 | 688 |
| CFTR-152 | + | UAUGGAGCCAAAUAUAUAAU | 20 | 689 |
| CFTR-37 | + | GUAGACUAACCGAUUGAAUA | 20 | 398 |
| CFTR-154 | + | UGUAGACUAACCGAUUGAAU | 20 | 690 |
| CFTR-155 | + | AAUAUAUGUAGACUAACCGA | 20 | 691 |
| CFTR-36 | + | UCACAGUAGCUUACCCAUAG | 20 | 429 |
| CFTR-157 | + | UUCACAGUAGCUUACCCAUA | 20 | 692 |
| CFTR-158 | + | CAUUCACAGUAGCUUACCCA | 20 | 693 |
| CFTR-159 | - | UUGGAGGCAAGUGAAUC | 17 | 694 |
| CFTR-160 | - | AUAAUGACCUAAUAAUG | 17 | 695 |
| CFTR-161 | - | CACUUCUAAUGGUGAUU | 17 | 696 |
| CFTR-48 | - | ACUUCUAAUGGUGAUUA | 17 | 439 |
| CFTR-49 | - | CUUCUAAUGGUGAUUAU | 17 | 440 |
| CFTR-164 | - | UCUAAUGGUGAUUAUGG | 17 | 697 |
| CFTR-165 | - | UGGUGAUUAUGGGAGAA | 17 | 698 |
| CFTR-50 | - | GGUGAUUAUGGGAGAAC | 17 | 400 |
| CFTR-167 | - | GGGAGAACUGGAGCCUU | 17 | 699 |
| CFTR-168 | - | GAGAACUGGAGCCUUCA | 17 | 700 |
| CFTR-169 | - | GGGUAAAAUUAAGCACA | 17 | 701 |
| CFTR-12 | - | GGUAAAAUUAAGCACAG | 17 | 390 |
| CFTR-171 | - | AAAAUUAAGCACAGUGG | 17 | 702 |
| CFTR-172 | - | UUCUGUUCUCAGUUUUC | 17 | 703 |
| CFTR-173 | - | UAUGCCUGGCACCAUUA | 17 | 704 |
| CFTR-174 | - | CUUUGGUGUUUCCUAUG | 17 | 705 |
| CFTR-175 | - | UAUGAUGAAUAUAGAUA | 17 | 706 |
| CFTR-176 | - | CAUCAAAGCAUGCCAAC | 17 | 707 |
| CFTR-177 | - | CAAAGCAUGCCAACUAG | 17 | 708 |
| CFTR-178 | - | UGCCAACUAGAAGAGGU | 17 | 709 |
| CFTR-179 | - | AAGAGGUAAGAAACUAU | 17 | 710 |
| CFTR-180 | - | ACUUUUUGAUUAUGCAU | 17 | 711 |
| CFTR-181 | - | AUAUUUAUGUUUCCUCU | 17 | 712 |
| CFTR-182 | - | UCUAUGGGUAAGCUACU | 17 | 713 |
| CFTR-183 | - | UGGGUAAGCUACUGUGA | 17 | 714 |
| CFTR-184 | + | CAUUAUCAAAUCACGCU | 17 | 715 |
| CFTR-64 | + | CCAUUAGAAGUGAAGUC | 17 | 450 |
| CFTR-186 | + | ACCAUUAGAAGUGAAGU | 17 | 716 |
| CFTR-187 | + | CAUAAUCACCAUUAGAA | 17 | 717 |
| CFTR-188 | + | UCUCCCAUAAUCACCAU | 17 | 718 |

TABLE 1D-continued

| gRNA Name | DNA Strand | Targeting Domain | Target Site Length | Seq ID |
|---|---|---|---|---|
| CFTR-189 | + | GUGCUUAAUUUUACCCU | 17 | 719 |
| CFTR-190 | + | GGAAAACUGAGAACAGA | 17 | 720 |
| CFTR-191 | + | UCCAGGAAAACUGAGAA | 17 | 721 |
| CFTR-192 | + | CAUAAUCCAGGAAAACU | 17 | 722 |
| CFTR-193 | + | GGCAUAAUCCAGGAAAA | 17 | 723 |
| CFTR-21 | + | GGUGCCAGGCAUAAUCC | 17 | 394 |
| CFTR-195 | + | UGGUGCCAGGCAUAAUC | 17 | 724 |
| CFTR-18 | + | GUAUCUAUAUUCAUCAU | 17 | 392 |
| CFTR-197 | + | UGUAUCUAUAUUCAUCA | 17 | 725 |
| CFTR-198 | + | AUAAUUUGGGUAGUGUG | 17 | 726 |
| CFTR-199 | + | UAUAUAAUUUGGGUAGU | 17 | 727 |
| CFTR-200 | + | GGAGCCAAAUAUAUAAU | 17 | 728 |
| CFTR-59 | + | GACUAACCGAUUGAAUA | 17 | 403 |
| CFTR-202 | + | AGACUAACCGAUUGAAU | 17 | 729 |
| CFTR-203 | + | AUAUGUAGACUAACCGA | 17 | 730 |
| CFTR-58 | + | CAGUAGCUUACCCAUAG | 17 | 446 |
| CFTR-205 | + | ACAGUAGCUUACCCAUA | 17 | 731 |
| CFTR-206 | + | UCACAGUAGCUUACCCA | 17 | 732 |

Table 1E provides exemplary targeting domains for the F508del target position in the CFTR gene selected based on reasonable proximity to mutation. It is contemplated herein that the targeting domain hybridizes to the target domain through complementary base pairing. Any of the targeting domains in the table can be used with a *N. meningitidis* Cas9 molecule that gives double stranded cleavage. Any of the targeting domains in the table can be used with a *N. meningitidis* Cas9 single-stranded break nucleases (nickases). In an embodiment, dual targeting is used to create two nicks on opposite DNA strands by using *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 1E

| gRNA Name | DNA Strand | Targeting Domain | Target Site Length | Seq ID |
|---|---|---|---|---|
| CFTR-207 | – | UGGAGGCAAGUGAAUCCUGA | 20 | 917 |
| CFTR-25 | – | UUUCCAGACUUCACUUCUAA | 20 | 420 |
| CFTR-209 | – | UUCAUUCUGUUCUCAGUUUU | 20 | 918 |
| CFTR-210 | – | UAAGAAACUAUGUGAAAACU | 20 | 919 |
| CFTR-211 | + | AGGUCAUUAUCAAAUCACGC | 20 | 920 |

TABLE 1E-continued

| gRNA Name | DNA Strand | Targeting Domain | Target Site Length | Seq ID |
|---|---|---|---|---|
| CFTR-212 | + | AACAUAAAUAUAUGUAGACU | 20 | 921 |
| CFTR-213 | – | AGGCAAGUGAAUCCUGA | 17 | 922 |
| CFTR-47 | – | CCAGACUUCACUUCUAA | 17 | 438 |
| CFTR-215 | – | AUUCUGUUCUCAGUUUU | 17 | 923 |
| CFTR-216 | – | GAAACUAUGUGAAAACU | 17 | 924 |
| CFTR-217 | + | UCAUUAUCAAAUCACGC | 17 | 925 |
| CFTR-218 | + | AUAAAUAUAUGUAGACU | 17 | 926 |

Table 2A provides exemplary targeting domains for the G551D target position in the CFTR gene selected according to the first tier parameters. The targeting domains are selected based close proximity to mutation and orthogonality in the human genome. It is contemplated herein that the targeting domain hybridizes to the target domain through complementary base pairing. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2A

| gRNA Name | DNA Strand | Targeting Domain | Target Site Length | Seq ID |
|---|---|---|---|---|
| CFTR-71 | – | GAGAAAGACAAUAUAGUUCU | 20 | 453 |
| CFTR-75 | – | GGUGGAAUCACACUGAGUGG | 20 | 454 |
| CFTR-86 | + | CCCACUAGCCAUAAAACCCC | 20 | 455 |
| CFTR-96 | – | GGUGGAAUCACACUGAG | 17 | 456 |
| CFTR-97 | – | GGAAUCACACUGAGUGG | 17 | 457 |
| CFTR-106 | – | GGGGUUUUAUGGCUAGU | 17 | 458 |
| CFTR-108 | + | ACUAGCCAUAAAACCCC | 17 | 459 |

Table 2B provides exemplary targeting domains for the G551D target position in the CFTR gene selected according to the second tier parameters. The targeting domains are selected based on the presence of a 5' G and reasonable proximity to mutation. It is contemplated herein that the targeting domain hybridizes to the target domain through complementary base pairing. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2B

| gRNA Name | DNA Strand | Targeting Domain | Target Site Length | Seq ID |
|---|---|---|---|---|
| CFTR-72 | - | GACAAUAUAGUUCUUGGAGA | 20 | 460 |
| CFTR-74 | - | GAAGGUGGAAUCACACUGAG | 20 | 461 |
| CFTR-76 | - | GAGCAAGAAUUUCUUUAGCA | 20 | 462 |
| CFTR-82 | - | GAAAAAAUCCUGGGGUUUUA | 20 | 463 |
| CFTR-89 | - | GUUCAAAAUUUCAACUG | 17 | 464 |
| CFTR-99 | - | GGUGAAUAACUAAUUAU | 17 | 465 |
| CFTR-100 | - | GCUUUAUAUUCUGUUUC | 17 | 466 |
| CFTR-102 | - | GGAAUUGAAAAAAUCCU | 17 | 467 |
| CFTR-103 | - | GAAUUGAAAAAAUCCUG | 17 | 468 |
| CFTR-109 | + | GUCUUUCUCUGCAAACU | 17 | 469 |

Table 2C provides exemplary targeting domains for the G551D target position in the CFTR gene selected according to the third tier parameters. The targeting domains are selected based on reasonable proximity to mutation. It is contemplated herein that the targeting domain hybridizes to the target domain through complementary base pairing. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2C

| gRNA Name | DNA Strand | Targeting Domain | Target Site Length | Seq ID |
|---|---|---|---|---|
| CFTR-67 | - | AAUGUUCAAAAUUUCAACUG | 20 | 470 |
| CFTR-68 | - | UGAUAUAUGAUUACAUUAGA | 20 | 471 |
| CFTR-69 | - | ACUCUCUAAUUUUCUAUUUU | 20 | 472 |
| CFTR-70 | - | AAUUUUCUAUUUUUGGUAAU | 20 | 473 |
| CFTR-73 | - | AAUAUAGUUCUUGGAGAAGG | 20 | 474 |
| CFTR-77 | - | CAAGGUGAAUAACUAAUUAU | 20 | 475 |
| CFTR-78 | - | AUUGCUUUAUAUUCUGUUUC | 20 | 476 |

TABLE 2C-continued

| gRNA Name | DNA Strand | Targeting Domain | Target Site Length | Seq ID |
|---|---|---|---|---|
| CFTR-79 | - | UUCUGGAAUUGAAAAAAUCC | 20 | 477 |
| CFTR-80 | - | UCUGGAAUUGAAAAAAUCCU | 20 | 478 |
| CFTR-81 | - | CUGGAAUUGAAAAAAUCCUG | 20 | 479 |
| CFTR-83 | - | UCCUGGGGUUUUAUGGCUAG | 20 | 480 |
| CFTR-84 | - | CCUGGGGUUUUAUGGCUAGU | 20 | 481 |
| CFTR-85 | - | CAUUUAAGAACUAUAAAUAA | 20 | 482 |
| CFTR-87 | + | AUUGUCUUUCUCUGCAAACU | 20 | 483 |
| CFTR-88 | + | AUGCUCAAUCUGAAUUUGAA | 20 | 484 |
| CFTR-90 | - | UAUAUGAUUACAUUAGA | 17 | 485 |
| CFTR-91 | - | CUCUAAUUUUCUAUUUU | 17 | 486 |
| CFTR-92 | - | UUUCUAUUUUUGGUAAU | 17 | 487 |
| CFTR-93 | - | AAAGACAAUAUAGUUCU | 17 | 488 |
| CFTR-94 | - | AAUAUAGUUCUUGGAGA | 17 | 489 |
| CFTR-95 | - | AUAGUUCUUGGAGAAGG | 17 | 490 |
| CFTR-98 | - | CAAGAAUUUCUUUAGCA | 17 | 491 |
| CFTR-101 | - | UGGAAUUGAAAAAAUCC | 17 | 492 |
| CFTR-104 | - | AAAAUCCUGGGGUUUUA | 17 | 493 |
| CFTR-105 | - | UGGGGUUUUAUGGCUAG | 17 | 494 |
| CFTR-107 | - | UUAAGAACUAUAAAUAA | 17 | 495 |
| CFTR-110 | + | CUCAAUCUGAAUUUGAA | 17 | 496 |

Table 2D provides exemplary targeting domains for the G551D target position in the CFTR gene selected based on reasonable proximity to mutation. It is contemplated herein that the targeting domain hybridizes to the target domain through complementary base pairing. Any of the targeting domains in the table can be used with a *S. aureus* Cas9 molecule that gives double stranded cleavage. Any of the targeting domains in the table can be used with a *S. aureus* Cas9 single-stranded break nucleases (nickases). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2D

| gRNA Name | DNA Strand | Targeting Domain | Target Site Length | Seq ID |
|---|---|---|---|---|
| CFTR-219 | - | AGUGUGAUAUAUGAUUACAU | 20 | 733 |
| CFTR-220 | - | GUGAUAUAUGAUUACAUUAG | 20 | 734 |
| CFTR-68 | - | UGAUAUAUGAUUACAUUAGA | 20 | 471 |

TABLE 2D-continued

| gRNA Name | DNA Strand | Targeting Domain | Target Site Length | Seq ID |
|---|---|---|---|---|
| CFTR-222 | − | AUGUGCCUUUCAAAUUCAGA | 20 | 735 |
| CFTR-223 | − | UAAUUUCUAUUUUUGGUAA | 20 | 736 |
| CFTR-224 | − | AUAGGACAUCUCCAAGUUUG | 20 | 737 |
| CFTR-225 | − | AGGACAUCUCCAAGUUUGCA | 20 | 738 |
| CFTR-226 | − | AGAGAAAGACAAUAUAGUUC | 20 | 739 |
| CFTR-71 | − | GAGAAAGACAAUAUAGUUCU | 20 | 453 |
| CFTR-228 | − | GAAAGACAAUAUAGUUCUUG | 20 | 740 |
| CFTR-229 | − | CAAUAUAGUUCUUGGAGAAG | 20 | 741 |
| CFTR-73 | − | AAUAUAGUUCUUGGAGAAGG | 20 | 474 |
| CFTR-231 | − | UUGGAGAAGGUGGAAUCACA | 20 | 742 |
| CFTR-232 | − | AGAAGGUGGAAUCACACUGA | 20 | 743 |
| CFTR-74 | − | GAAGGUGGAAUCACACUGAG | 20 | 461 |
| CFTR-234 | − | AUCACACUGAGUGGAGGUCA | 20 | 744 |
| CFTR-235 | − | CUGAGUGGAGGUCAACGAGC | 20 | 745 |
| CFTR-236 | − | GCAAGAAUUUCUUUAGCAAG | 20 | 746 |
| CFTR-237 | − | UAUUGCUUUAUAUUCUGUUU | 20 | 747 |
| CFTR-78 | − | AUUGCUUUAUAUUCUGUUUC | 20 | 476 |
| CFTR-239 | − | UUUUAUAUUCUGUUUCUGGAA | 20 | 748 |
| CFTR-240 | − | UUUCUGGAAUUGAAAAAAUC | 20 | 749 |
| CFTR-79 | − | UUCUGGAAUUGAAAAAAUCC | 20 | 477 |
| CFTR-242 | − | AUCCUGGGGUUUUAUGGCUA | 20 | 750 |
| CFTR-243 | − | GGUUUUAUGGCUAGUGGGUU | 20 | 751 |
| CFTR-244 | − | GUGGGUUAAGAAUCACAUUU | 20 | 752 |
| CFTR-245 | + | CUUUAACCACAGUUGAAAUU | 20 | 753 |
| CFTR-246 | + | CACUAUUGCUUUAACCACAG | 20 | 754 |
| CFTR-247 | + | UUAGUAUGCUCAAUCUGAAU | 20 | 755 |
| CFTR-248 | + | UCACUUUAGUAUGCUCAAU | 20 | 756 |
| CFTR-249 | + | UUACCAAAAAUAGAAAAUUA | 20 | 757 |
| CFTR-250 | + | UAUUACCAAAAAUAGAAAAU | 20 | 758 |
| CFTR-251 | + | AGAUGUCCAUUACCAAAAA | 20 | 759 |
| CFTR-87 | + | AUUGUCUUUCUCUGCAAACU | 20 | 483 |
| CFTR-253 | + | UAUUGUCUUUCUCUGCAAAC | 20 | 760 |
| CFTR-254 | + | AGUGUGAUUCCACCUUCUCC | 20 | 761 |
| CFTR-255 | + | AUUAGUUAUUCACCUUGCUA | 20 | 762 |
| CFTR-256 | + | AAUGUCUGUAAUUUUUUAC | 20 | 763 |
| CFTR-257 | + | AAACAGAAUAUAAAGCAAUA | 20 | 764 |
| CFTR-258 | + | AGAAACAGAAUAUAAAGCAA | 20 | 765 |
| CFTR-259 | + | GAUUUUUUCAAUUCCAGAAA | 20 | 766 |
| CFTR-260 | + | CCCCAGGAUUUUUUCAAUUC | 20 | 767 |
| CFTR-261 | − | GUGAUAUAUGAUUACAU | 17 | 768 |
| CFTR-262 | − | AUAUAUGAUUACAUUAG | 17 | 769 |
| CFTR-90 | − | UAUAUGAUUACAUUAGA | 17 | 485 |
| CFTR-264 | − | UGCCUUUCAAAUUCAGA | 17 | 770 |
| CFTR-265 | − | UUUUCUAUUUUUGGUAA | 17 | 771 |
| CFTR-266 | − | GGACAUCUCCAAGUUUG | 17 | 772 |
| CFTR-267 | − | ACAUCUCCAAGUUUGCA | 17 | 773 |
| CFTR-268 | − | GAAAGACAAUAUAGUUC | 17 | 774 |
| CFTR-93 | − | AAAGACAAUAUAGUUCU | 17 | 488 |
| CFTR-270 | − | AGACAAUAUAGUUCUUG | 17 | 775 |
| CFTR-271 | − | UAUAGUUCUUGGAGAAG | 17 | 776 |
| CFTR-95 | − | AUAGUUCUUGGAGAAGG | 17 | 490 |
| CFTR-273 | − | GAGAAGGUGGAAUCACA | 17 | 777 |
| CFTR-274 | − | AGGUGGAAUCACACUGA | 17 | 778 |
| CFTR-96 | − | GGUGGAAUCACACUGAG | 17 | 456 |
| CFTR-276 | − | ACACUGAGUGGAGGUCA | 17 | 779 |
| CFTR-277 | − | AGUGGAGGUCAACGAGC | 17 | 780 |
| CFTR-278 | − | AGAAUUUCUUUAGCAAG | 17 | 781 |
| CFTR-279 | − | UGCUUUAUAUUCUGUUU | 17 | 782 |
| CFTR-100 | − | GCUUUAUAUUCUGUUUC | 17 | 466 |
| CFTR-281 | − | AUAUUCUGUUUCUGGAA | 17 | 783 |
| CFTR-282 | − | CUGGAAUUGAAAAAAUC | 17 | 784 |
| CFTR-101 | − | UGGAAUUGAAAAAAUCC | 17 | 492 |
| CFTR-284 | − | CUGGGGUUUUAUGGCUA | 17 | 785 |
| CFTR-285 | − | UUUUAUGGCUAGUGGGUU | 17 | 786 |
| CFTR-286 | − | GGUUAAGAAUCACAUUU | 17 | 787 |
| CFTR-287 | + | UAACCACAGUUGAAAUU | 17 | 788 |
| CFTR-288 | + | UAUUGCUUUAACCACAG | 17 | 789 |
| CFTR-289 | + | GUAUGCUCAAUCUGAAU | 17 | 790 |
| CFTR-290 | + | CUUUAGUAUGCUCAAU | 17 | 791 |
| CFTR-291 | + | CCAAAAAUAGAAAAUUA | 17 | 792 |
| CFTR-292 | + | UACCAAAAAUAGAAAAU | 17 | 793 |
| CFTR-293 | + | UGUCCAUUACCAAAAA | 17 | 794 |
| CFTR-109 | + | GUCUUUCUCUGCAAACU | 17 | 469 |
| CFTR-295 | + | UGUCUUUCUCUGCAAAC | 17 | 795 |
| CFTR-296 | + | GUGAUUCCACCUUCUCC | 17 | 796 |
| CFTR-297 | + | AGUUAUUCACCUUGCUA | 17 | 797 |

TABLE 2D-continued

| gRNA Name | DNA Strand | Targeting Domain | Target Site Length | Seq ID |
|---|---|---|---|---|
| CFTR-298 | + | GUCUGUAAUUUUUUUAC | 17 | 798 |
| CFTR-299 | + | CAGAAUAUAAAGCAAUA | 17 | 799 |
| CFTR-300 | + | AACAGAAUAUAAAGCAA | 17 | 800 |
| CFTR-301 | + | UUUUUCAAUUCCAGAAA | 17 | 801 |
| CFTR-302 | + | CAGGAUUUUUUCAAUUC | 17 | 802 |

Table 2E provides exemplary targeting domains for the G551D target position in the CFTR gene selected based on reasonable proximity to mutation. It is contemplated herein that the targeting domain hybridizes to the target domain through complementary base pairing. Any of the targeting domains in the table can be used with a N. meningitidis Cas9 molecule that gives double stranded cleavage. Any of the targeting domains in the table can be used with a N. meningitidis Cas9 single-stranded break nucleases (nickases). In an embodiment, dual targeting is used to create two nicks on opposite DNA strands by using N. meningitidis Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2E

| gRNA Name | DNA Strand | Targeting Domain | Target Site Length | Seq ID |
|---|---|---|---|---|
| CFTR-303 | − | GGUUAAAGCAAUAGUGUGAU | 20 | 927 |
| CFTR-304 | − | AGGAAGAUGUGCCUUUCAAA | 20 | 928 |
| CFTR-305 | + | UGCUCGUUGACCUCCACUCA | 20 | 929 |
| CFTR-306 | + | AACCCACUAGCCAUAAAACC | 20 | 930 |
| CFTR-307 | + | CCAUUAUUUAUAGUUCUUAA | 20 | 931 |
| CFTR-308 | − | UAAAGCAAUAGUGUGAU | 17 | 932 |
| CFTR-309 | − | AAGAUGUGCCUUUCAAA | 17 | 933 |
| CFTR-310 | + | UCGUUGACCUCCACUCA | 17 | 934 |
| CFTR-311 | + | CCACUAGCCAUAAAACC | 17 | 935 |
| CFTR-312 | + | UUAUUUAUAGUUCUUAA | 17 | 936 |

Table 3A provides exemplary targeting domains for knocking out the SCNN1A gene selected according to the first tier parameters. The targeting domains are selected based close proximity to start codon and orthogonality in the human genome. It is contemplated herein that the targeting domain hybridizes to the target domain through complementary base pairing. Any of the targeting domains in the table can be used with a S. pyogenes Cas9 molecule that gives double stranded cleavage. Any of the targeting domains in the table can be used with a S. pyogenes Cas9 single-stranded break nucleases (nickases). In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. In an embodiment, two 20-mer RNAs are used to target two Cas9 nucleases or two Cas9 nickases, e.g., SCNN1A-78 and SCNN1A-9 are used.

TABLE 3A

| gRNA Name | DNA Strand | Targeting Domain | Target Site Length | Seq ID |
|---|---|---|---|---|
| SCNN1A-2 | − | GCCCAUACCAGGUCUCAUGG | 20 | 497 |
| SCNN1A-4 | − | CCAUACCAGGUCUCAUGGAG | 20 | 498 |
| SCNN1A-9 | − | GCCCUCCACAGUCCACUCCA | 20 | 499 |
| SCNN1A-78 | + | CCCCUCCAUGAGACCUGGUA | 20 | 500 |
| SCNN1A-82 | − | AUACCAGGUCUCAUGGA | 17 | 501 |
| SCNN1A-157 | + | CUCCAUGAGACCUGGUA | 17 | 502 |

Table 3B provides exemplary targeting domains for knocking out the SCNN1A gene selected according to the second tier parameters. The targeting domains are selected based on the presence of a 5' G and reasonable proximity to start codon. It is contemplated herein that the targeting domain hybridizes to the target domain through complementary base pairing. Any of the targeting domains in the table can be used with a S. pyogenes Cas9 molecule that gives double stranded cleavage. Any of the targeting domains in the table can be used with a S. pyogenes Cas9 single-stranded break nucleases (nickases). In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. In an embodiment, two 20-mer RNAs are used to target two Cas9 nucleases or two Cas9 nickases, e.g., SCNN1A-78 and SCNN1A-9 are used.

TABLE 3B

| gRNA Name | DNA Strand | Targeting Domain | Target Site Length | Seq ID |
|---|---|---|---|---|
| SCNN1A-1 | − | GCAGCCCAUACCAGGUCUCA | 20 | 503 |
| SCNN1A-7 | − | GGGGAACAAGCUGGAGGAGC | 20 | 504 |
| SCNN1A-10 | − | GUCCACUCCAGGGCUCAUGA | 20 | 505 |
| SCNN1A-14 | − | GGGGAACAAGCGUGAGGAGC | 20 | 506 |
| SCNN1A-15 | − | GGGAACAAGCGUGAGGAGCA | 20 | 507 |
| SCNN1A-16 | − | GGAACAAGCGUGAGGAGCAG | 20 | 508 |
| SCNN1A-19 | − | GGGGCUGGGCCCCGAACCUG | 20 | 509 |

TABLE 3B-continued

| gRNA Name | DNA Strand | Targeting Domain | Target Site Length | Seq ID |
|---|---|---|---|---|
| SCNN1A-21 | - | GGCGCCCCAGCAGCCCACGG | 20 | 510 |
| SCNN1A-22 | - | GCCCCAGCAGCCCACGGCGG | 20 | 511 |
| SCNN1A-24 | - | GCAGCCCACGGCGGAGGAGG | 20 | 512 |
| SCNN1A-31 | - | GUGCUGUGGCUCUGCACCUU | 20 | 513 |
| SCNN1A-32 | - | GCACCUUUGGCAUGAUGUAC | 20 | 514 |
| SCNN1A-33 | - | GGCAUGAUGUACUGGCAAUU | 20 | 515 |
| SCNN1A-36 | + | GUAGGGAUUGAGGGUGCAGA | 20 | 516 |
| SCNN1A-37 | + | GAGGGUGCAGAUGGUCACUG | 20 | 517 |
| SCNN1A-39 | + | GGGUGCAGAUGGUCACUGCG | 20 | 518 |
| SCNN1A-42 | + | GAGGUUGAUGUUGAGGCUGA | 20 | 519 |
| SCNN1A-44 | + | GGUUGAUGUUGAGGCUGACG | 20 | 520 |
| SCNN1A-47 | + | GAGCCACAGCACUGCCCAGA | 20 | 521 |
| SCNN1A-51 | + | GGUUGUGCUGGGAGCACACC | 20 | 522 |
| SCNN1A-56 | + | GCGGAUGGCGCCGUGGAUGG | 20 | 523 |
| SCNN1A-58 | + | GAACUCGAAGAGCUCUCGGU | 20 | 524 |
| SCNN1A-62 | + | GGAGCGGUGGAACUCGAUCA | 20 | 525 |
| SCNN1A-68 | + | GUGGGCUGCUGGGGCGCCGC | 20 | 526 |
| SCNN1A-71 | + | GCUGGGGCGCCGCAGGUUCG | 20 | 527 |
| SCNN1A-76 | + | GCCCUGGAGUGGACUGUGGA | 20 | 528 |
| SCNN1A-80 | - | GCCCAUACCAGGUCUCA | 17 | 529 |
| SCNN1A-85 | - | GGAGGGGAACAAGCUGG | 17 | 530 |
| SCNN1A-86 | - | GAACAAGCUGGAGGAGC | 17 | 531 |
| SCNN1A-92 | - | GAAGGGAACAAGCGUG | 17 | 532 |
| SCNN1A-93 | - | GAACAAGCGUGAGGAGC | 17 | 533 |
| SCNN1A-96 | - | GCGUGAGGAGCAGGGGC | 17 | 534 |
| SCNN1A-98 | - | GCUGGGCCCCGAACCUG | 17 | 535 |
| SCNN1A-99 | - | GGCGCCCCAGCAGCCCA | 17 | 536 |
| SCNN1A-100 | - | GCCCCAGCAGCCCACGG | 17 | 537 |
| SCNN1A-102 | - | GCAGCCCACGGCGGAGG | 17 | 538 |
| SCNN1A-103 | - | GCCCACGGCGGAGGAGG | 17 | 539 |
| SCNN1A-106 | - | GCACAACCGCAUGAAGA | 17 | 540 |
| SCNN1A-107 | - | GCAUGAAGACGGCCUUC | 17 | 541 |
| SCNN1A-115 | + | GGGAUUGAGGGUGCAGA | 17 | 542 |
| SCNN1A-116 | + | GGUGCAGAUGGUCACUG | 17 | 543 |
| SCNN1A-117 | + | GUGCAGAUGGUCACUGC | 17 | 544 |
| SCNN1A-121 | + | GUUGAUGUUGAGGCUGA | 17 | 545 |
| SCNN1A-131 | + | GCUGGGAGCACACCAGG | 17 | 546 |
| SCNN1A-132 | + | GGAGCACACCAGGCGGA | 17 | 547 |
| SCNN1A-134 | + | GCGGAUGGCGCCGUGGA | 17 | 548 |
| SCNN1A-135 | + | GAUGGCGCCGUGGAUGG | 17 | 549 |
| SCNN1A-139 | + | GCUCUCGGUAGGAGCGG | 17 | 550 |
| SCNN1A-141 | + | GCGGUGGAACUCGAUCA | 17 | 551 |
| SCNN1A-142 | + | GGCCUCCUCCUCCGCCG | 17 | 552 |
| SCNN1A-143 | + | GCCUCCUCCUCCGCCGU | 17 | 553 |
| SCNN1A-147 | + | GGCUGCUGGGGCGCCGC | 17 | 554 |
| SCNN1A-150 | + | GGGGCGCCGCAGGUUCG | 17 | 555 |

Table 3C provides exemplary targeting domains for knocking out the SCNN1A gene selected according to the third tier parameters. The targeting domains are selected based on reasonable proximity to start codon. It is contemplated herein that the targeting domain hybridizes to the target domain through complementary base pairing. Any of the targeting domains in the table can be used with a S. pyogenes Cas9 molecule that gives double stranded cleavage. Any of the targeting domains in the table can be used with a S. pyogenes Cas9 single-stranded break nucleases (nickases). In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. In an embodiment, two 20-mer RNAs are used to target two Cas9 nucleases or two Cas9 nickases, e.g., SCNN1A-78 and SCNN1A-9 are used.

TABLE 3C

| gRNA Name | DNA Strand | Targeting Domain | Target Site Length | Seq ID |
|---|---|---|---|---|
| SCNN1A-3 | - | CCCAUACCAGGUCUCAUGGA | 20 | 556 |
| SCNN1A-5 | - | UCUCAUGGAGGGGAACAAGC | 20 | 557 |
| SCNN1A-6 | - | CAUGGAGGGGAACAAGCUGG | 20 | 558 |
| SCNN1A-8 | - | AGCCCUCCACAGUCCACUCC | 20 | 559 |
| SCNN1A-11 | - | UCCACUCCAGGGCUCAUGAA | 20 | 560 |
| SCNN1A-12 | - | CCACUCCAGGGCUCAUGAAG | 20 | 561 |
| SCNN1A-13 | - | CAUGAAGGGGAACAAGCGUG | 20 | 562 |
| SCNN1A-17 | - | CAAGCGUGAGGAGCAGGGGC | 20 | 563 |
| SCNN1A-18 | - | AAGCGUGAGGAGCAGGGGCU | 20 | 564 |
| SCNN1A-20 | - | UGCGGCGCCCAGCAGCCCA | 20 | 565 |
| SCNN1A-23 | - | CCAGCAGCCCACGGCGGAGG | 20 | 566 |
| SCNN1A-25 | - | UGCAACAACACCACCAUCCA | 20 | 567 |
| SCNN1A-26 | - | CAUCCACGGCGCCAUCCGCC | 20 | 568 |

TABLE 3C-continued

| gRNA Name | DNA Strand | Targeting Domain | Target Site Length | Seq ID |
|---|---|---|---|---|
| SCNN1A-27 | − | CCAGCACAACCGCAUGAAGA | 20 | 569 |
| SCNN1A-28 | − | ACCGCAUGAAGACGGCCUUC | 20 | 570 |
| SCNN1A-29 | − | CCGCAUGAAGACGGCCUUCU | 20 | 571 |
| SCNN1A-30 | − | CGGCCUUCUGGGCAGUGCUG | 20 | 572 |
| SCNN1A-34 | − | UGGCAAUUCGGCCUGCUUUU | 20 | 573 |
| SCNN1A-35 | − | CCUCAACAUCAACCUCAACU | 20 | 574 |
| SCNN1A-38 | + | AGGGUGCAGAUGGUCACUGC | 20 | 575 |
| SCNN1A-40 | + | AGACGAGCUUGUCCGAGUUG | 20 | 576 |
| SCNN1A-41 | + | CCGAGUUGAGGUUGAUGUUG | 20 | 577 |
| SCNN1A-43 | + | AGGUUGAUGUUGAGGCUGAC | 20 | 578 |
| SCNN1A-45 | + | UGAAGUACUCUCCGAAAAGC | 20 | 579 |
| SCNN1A-46 | + | UUGCCAGUACAUCAUGCCAA | 20 | 580 |
| SCNN1A-48 | + | CCCAGAAGGCCGUCUUCAUG | 20 | 581 |
| SCNN1A-49 | + | CCGUCUUCAUGCGGUUGUGC | 20 | 582 |
| SCNN1A-50 | + | CGUCUUCAUGCGGUUGUGCU | 20 | 583 |
| SCNN1A-52 | + | UGUGCUGGGAGCACACCAGG | 20 | 584 |
| SCNN1A-53 | + | CUGGGAGCACACCAGGCGGA | 20 | 585 |
| SCNN1A-54 | + | ACACCAGGCGGAUGGCGCCG | 20 | 586 |
| SCNN1A-55 | + | CAGGCGGAUGGCGCCGUGGA | 20 | 587 |
| SCNN1A-57 | + | AGAAGAACUCGAAGAGCUCU | 20 | 588 |
| SCNN1A-59 | + | CGAAGAGCUCUCGGUAGGAG | 20 | 589 |
| SCNN1A-60 | + | AGAGCUCUCGGUAGGAGCGG | 20 | 590 |
| SCNN1A-61 | + | AGGAGCGGUGGAACUCGAUC | 20 | 591 |
| SCNN1A-63 | + | CAGGGCCUCCUCCUCCGCCG | 20 | 592 |
| SCNN1A-64 | + | AGGGCCUCCUCCUCCGCCGU | 20 | 593 |
| SCNN1A-65 | + | CCUCCUCCGCCGUGGGCUGC | 20 | 594 |
| SCNN1A-66 | + | CUCCUCCGCCGUGGGCUGCU | 20 | 595 |
| SCNN1A-67 | + | UCCUCCGCCGUGGGCUGCUG | 20 | 596 |
| SCNN1A-69 | + | CUGCUGGGGCGCCGCAGGUU | 20 | 597 |
| SCNN1A-70 | + | UGCUGGGGCGCCGCAGGUUC | 20 | 598 |
| SCNN1A-72 | + | UUGUUCCCCUUCAUGAGCCC | 20 | 599 |
| SCNN1A-73 | + | CCCCUUCAUGAGCCCUGGAG | 20 | 600 |
| SCNN1A-74 | + | AUGAGCCCUGGAGUGGACUG | 20 | 601 |
| SCNN1A-75 | + | AGCCCUGGAGUGGACUGUGG | 20 | 602 |
| SCNN1A-77 | + | UUGUUCCCCUCCAUGAGACC | 20 | 603 |
| SCNN1A-79 | + | CCCUCCAUGAGACCUGGUAU | 20 | 604 |
| SCNN1A-81 | − | CAUACCAGGUCUCAUGG | 17 | 605 |
| SCNN1A-83 | − | UACCAGGUCUCAUGGAG | 17 | 606 |
| SCNN1A-84 | − | CAUGGAGGGGAACAAGC | 17 | 607 |
| SCNN1A-87 | − | CCUCCACAGUCCACUCC | 17 | 608 |
| SCNN1A-88 | − | CUCCACAGUCCACUCCA | 17 | 609 |
| SCNN1A-89 | − | CACUCCAGGGCUCAUGA | 17 | 610 |
| SCNN1A-90 | − | ACUCCAGGGCUCAUGAA | 17 | 611 |
| SCNN1A-91 | − | CUCCAGGGCUCAUGAAG | 17 | 612 |
| SCNN1A-94 | − | AACAAGCGUGAGGAGCA | 17 | 613 |
| SCNN1A-95 | − | ACAAGCGUGAGGAGCAG | 17 | 614 |
| SCNN1A-97 | − | CGUGAGGAGCAGGGGCU | 17 | 615 |
| SCNN1A-101 | − | CCAGCAGCCCACGGCGG | 17 | 616 |
| SCNN1A-104 | − | AACAACACCACCAUCCA | 17 | 617 |
| SCNN1A-105 | − | CCACGGCGCCAUCCGCC | 17 | 618 |
| SCNN1A-108 | − | CAUGAAGACGGCCUUCU | 17 | 619 |
| SCNN1A-109 | − | CCUUCUGGGCAGUGCUG | 17 | 620 |
| SCNN1A-110 | − | CUGUGGCUCUGCACCUU | 17 | 621 |
| SCNN1A-111 | − | CCUUUGGCAUGAUGUAC | 17 | 622 |
| SCNN1A-112 | − | AUGAUGUACUGGCAAUU | 17 | 623 |
| SCNN1A-113 | − | CAAUUCGCCUGCUUUU | 17 | 624 |
| SCNN1A-114 | − | CAACAUCAACCUCAACU | 17 | 625 |
| SCNN1A-118 | + | UGCAGAUGGUCACUGCG | 17 | 626 |
| SCNN1A-119 | + | CGAGCUUGUCCGAGUUG | 17 | 627 |
| SCNN1A-120 | + | AGUUGAGGUUGAUGUUG | 17 | 628 |
| SCNN1A-122 | + | UUGAUGUUGAGGCUGAC | 17 | 629 |
| SCNN1A-123 | + | UGAUGUUGAGGCUGACG | 17 | 630 |
| SCNN1A-124 | + | AGUACUCUCCGAAAAGC | 17 | 631 |
| SCNN1A-125 | + | CCAGUACAUCAUGCCAA | 17 | 632 |
| SCNN1A-126 | + | CCACAGCACUGCCCAGA | 17 | 633 |
| SCNN1A-127 | + | AGAAGGCCGUCUUCAUG | 17 | 634 |
| SCNN1A-128 | + | UCUUCAUGCGGUUGUGC | 17 | 635 |
| SCNN1A-129 | + | CUUCAUGCGGUUGUGCU | 17 | 636 |
| SCNN1A-130 | + | UGUGCUGGGAGCACACC | 17 | 637 |
| SCNN1A-133 | + | CCAGGCGGAUGGCGCCG | 17 | 638 |
| SCNN1A-136 | + | AGAACUCGAAGAGCUCU | 17 | 639 |
| SCNN1A-137 | + | CUCGAAGAGCUCUCGGU | 17 | 640 |
| SCNN1A-138 | + | AGAGCUCUCGGUAGGAG | 17 | 641 |
| SCNN1A-140 | + | AGCGGUGGAACUCGAUC | 17 | 642 |
| SCNN1A-144 | + | CCUCCGCCGUGGGCUGC | 17 | 643 |
| SCNN1A-145 | + | CUCCGCCGUGGGCUGCU | 17 | 644 |

TABLE 3C-continued

| gRNA Name | DNA Strand | Targeting Domain | Target Site Length | Seq ID |
|---|---|---|---|---|
| SCNN1A-146 | + | UCCGCCGUGGGCUGCUG | 17 | 645 |
| SCNN1A-148 | + | CUGGGGCGCCGCAGGUU | 17 | 646 |
| SCNN1A-149 | + | UGGGGCGCCGCAGGUUC | 17 | 647 |
| SCNN1A-151 | + | UUCCCCUUCAUGAGCCC | 17 | 648 |
| SCNN1A-152 | + | CUUCAUGAGCCCUGGAG | 17 | 649 |
| SCNN1A-153 | + | AGCCCUGGAGUGGACUG | 17 | 650 |
| SCNN1A-154 | + | CCUGGAGUGGACUGUGG | 17 | 651 |
| SCNN1A-155 | + | CUGGAGUGGACUGUGGA | 17 | 652 |
| SCNN1A-156 | + | UUCCCCUCCAUGAGACC | 17 | 653 |
| SCNN1A-158 | + | UCCAUGAGACCUGGUAU | 17 | 654 |

Table 3D provides exemplary targeting domains for knocking out the SCNN1A gene selected based on reasonable proximity to the start codon. It is contemplated herein that the targeting domain hybridizes to the target domain through complementary base pairing. Any of the targeting domains in the table can be used with a *S. aureus* Cas9 molecule that gives double stranded cleavage. Any of the targeting domains in the table can be used with a *S. aureus* Cas9 single-stranded break nucleases (nickases). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 3D

| gRNA Name | DNA Strand | Targeting Domain | Target Site Length | Seq ID |
|---|---|---|---|---|
| SCNN1A-159 | − | UGCAGCCCAUACCAGGUCUC | 20 | 803 |
| SCNN1A-1 | − | GCAGCCCAUACCAGGUCUCA | 20 | 503 |
| SCNN1A-161 | − | AGCCCAUACCAGGUCUCAUG | 20 | 804 |
| SCNN1A-2 | − | GCCCAUACCAGGUCUCAUGG | 20 | 497 |
| SCNN1A-3 | − | CCCAUACCAGGUCUCAUGGA | 20 | 556 |
| SCNN1A-4 | − | CCAUACCAGGUCUCAUGGAG | 20 | 498 |
| SCNN1A-165 | − | GUCUCAUGGAGGGGAACAAG | 20 | 805 |
| SCNN1A-5 | − | UCUCAUGGAGGGGAACAAGC | 20 | 557 |
| SCNN1A-167 | − | UCAUGGAGGGGAACAAGCUG | 20 | 806 |
| SCNN1A-6 | − | CAUGGAGGGGAACAAGCUGG | 20 | 558 |
| SCNN1A-169 | − | AGGGGAACAAGCUGGAGGAG | 20 | 807 |
| SCNN1A-170 | − | UAGCCCUCCACAGUCCACUC | 20 | 808 |
| SCNN1A-171 | − | CACAGUCCACUCCAGGGCUC | 20 | 809 |
| SCNN1A-172 | − | AGUCCACUCCAGGGCUCAUG | 20 | 810 |
| SCNN1A-10 | − | GUCCACUCCAGGGCUCAUGA | 20 | 505 |
| SCNN1A-11 | − | UCCACUCCAGGGCUCAUGAA | 20 | 560 |
| SCNN1A-12 | − | CCACUCCAGGGCUCAUGAAG | 20 | 561 |
| SCNN1A-176 | − | GCUCAUGAAGGGGAACAAGC | 20 | 811 |
| SCNN1A-177 | − | UCAUGAAGGGGAACAAGCGU | 20 | 812 |
| SCNN1A-13 | − | CAUGAAGGGGAACAAGCGUG | 20 | 562 |
| SCNN1A-179 | − | AGGGGAACAAGCGUGAGGAG | 20 | 813 |
| SCNN1A-14 | − | GGGGAACAAGCGUGAGGAGC | 20 | 506 |
| SCNN1A-181 | − | ACAAGCGUGAGGAGCAGGGG | 20 | 814 |
| SCNN1A-182 | − | UGAGGAGCAGGGGCUGGGCC | 20 | 815 |
| SCNN1A-183 | − | CGGCGCCCCAGCAGCCCACG | 20 | 816 |
| SCNN1A-21 | − | GGCGCCCCAGCAGCCCACGG | 20 | 510 |
| SCNN1A-185 | − | CGCCCCAGCAGCCCACGGCG | 20 | 817 |
| SCNN1A-22 | − | GCCCCAGCAGCCCACGGCGG | 20 | 511 |
| SCNN1A-187 | − | CCCAGCAGCCCACGGCGGAG | 20 | 818 |
| SCNN1A-23 | − | CCAGCAGCCCACGGCGGAGG | 20 | 566 |
| SCNN1A-189 | − | GGCGGAGGAGGAGGCCCUGA | 20 | 819 |
| SCNN1A-190 | − | AUCGAGUUCCACCGCUCCUA | 20 | 820 |
| SCNN1A-191 | − | CGAGUUCCACCGCUCCUACC | 20 | 821 |
| SCNN1A-192 | − | CCGCUCCUACCGAGAGCUCU | 20 | 822 |
| SCNN1A-193 | − | UGUGCUCCCAGCACAACCGC | 20 | 823 |
| SCNN1A-194 | − | AACCGCAUGAAGACGGCCUU | 20 | 824 |
| SCNN1A-195 | − | CUGGCAAUUCGGCCUGCUUU | 20 | 825 |
| SCNN1A-34 | − | UGGCAAUUCGGCCUGCUUUU | 20 | 573 |
| SCNN1A-197 | − | GCAAUUCGGCCUGCUUUUCG | 20 | 826 |
| SCNN1A-198 | − | GCCUCAACAUCAACCUCAAC | 20 | 827 |
| SCNN1A-199 | + | UCCCCUCCAUGAGACCUGGU | 20 | 828 |
| SCNN1A-200 | + | CCUCCAGCUUGUUCCCCUCC | 20 | 829 |
| SCNN1A-201 | + | UGGAGUGGACUGUGGAGGGC | 20 | 830 |
| SCNN1A-202 | + | GAGCCCUGGAGUGGACUGUG | 20 | 831 |
| SCNN1A-74 | + | AUGAGCCCUGGAGUGGACUG | 20 | 601 |
| SCNN1A-204 | + | CAUGAGCCCUGGAGUGGACU | 20 | 832 |
| SCNN1A-205 | + | UCCCCUUCAUGAGCCCUGGA | 20 | 833 |
| SCNN1A-72 | + | UUGUUCCCUUCAUGAGCCC | 20 | 599 |
| SCNN1A-207 | + | CUUGUUCCCUUCAUGAGCC | 20 | 834 |
| SCNN1A-208 | + | CCUCACGCUUGUUCCCCUUC | 20 | 835 |
| SCNN1A-69 | + | CUGCUGGGGCGCCGCAGGUU | 20 | 597 |

TABLE 3D-continued

| gRNA Name | DNA Strand | Targeting Domain | Target Site Length | Seq ID |
|---|---|---|---|---|
| SCNN1A-210 | + | GCUGCUGGGGCGCCGCAGGU | 20 | 836 |
| SCNN1A-65 | + | CCUCCUCCGCCGUGGGCUGC | 20 | 594 |
| SCNN1A-212 | + | UCCUCCUCCGCCGUGGGCUG | 20 | 837 |
| SCNN1A-213 | + | UCAGGGCCUCCUCCUCCGCC | 20 | 838 |
| SCNN1A-214 | + | UAGGAGCGGUGGAACUCGAU | 20 | 839 |
| SCNN1A-60 | + | AGAGCUCUCGGUAGGAGCGG | 20 | 590 |
| SCNN1A-216 | + | AAGAGCUCUCGGUAGGAGCG | 20 | 840 |
| SCNN1A-58 | + | GAACUCGAAGAGCUCUCGGU | 20 | 524 |
| SCNN1A-218 | + | AGAACUCGAAGAGCUCUCGG | 20 | 841 |
| SCNN1A-219 | + | UGUUGUUGCAGAAGAACUCG | 20 | 842 |
| SCNN1A-220 | + | UGGUGUUGUUGCAGAAGAAC | 20 | 843 |
| SCNN1A-221 | + | GGAUGGUGGUGUUGUUGCAG | 20 | 844 |
| SCNN1A-222 | + | CGUGGAUGGUGGUGUUGUUG | 20 | 845 |
| SCNN1A-223 | + | CACACCAGGCGGAUGGCGCC | 20 | 846 |
| SCNN1A-224 | + | UUGUGCUGGGAGCACACCAG | 20 | 847 |
| SCNN1A-50 | + | CGUCUUCAUGCGGUUGUGCU | 20 | 583 |
| SCNN1A-49 | + | CCGUCUUCAUGCGGUUGUGC | 20 | 582 |
| SCNN1A-227 | + | GCCGUCUUCAUGCGGUUGUG | 20 | 848 |
| SCNN1A-228 | + | UGCAGAGCCACAGCACUGCC | 20 | 849 |
| SCNN1A-229 | + | AGUACAUCAUGCCAAAGGUG | 20 | 850 |
| SCNN1A-230 | + | AGUACUCUCCGAAAAGCAGG | 20 | 851 |
| SCNN1A-231 | + | CGGGGUAGCUGAAGUACUCU | 20 | 852 |
| SCNN1A-232 | + | UGUUGAGGCUGACGGGGUAG | 20 | 853 |
| SCNN1A-42 | + | GAGGUUGAUGUUGAGGCUGA | 20 | 519 |
| SCNN1A-234 | + | UGAGGUUGAUGUUGAGGCUG | 20 | 854 |
| SCNN1A-235 | + | UGUCCGAGUUGAGGUUGAUG | 20 | 855 |
| SCNN1A-236 | + | GGAAGACGAGCUUGUCCGAG | 20 | 856 |
| SCNN1A-237 | + | UGCGGGAAGACGAGCUUGU | 20 | 857 |
| SCNN1A-238 | + | AGAUGGUCACUGCGGGGAAG | 20 | 858 |
| SCNN1A-39 | + | GGGUGCAGAUGGUCACUGCG | 20 | 518 |
| SCNN1A-38 | + | AGGGUGCAGAUGGUCACUGC | 20 | 575 |
| SCNN1A-37 | + | GAGGGUGCAGAUGGUCACUG | 20 | 517 |
| SCNN1A-242 | + | UGAGGGUGCAGAUGGUCACU | 20 | 859 |
| SCNN1A-243 | − | AGCCCAUACCAGGUCUC | 17 | 860 |
| SCNN1A-80 | − | GCCCAUACCAGGUCUCA | 17 | 529 |
| SCNN1A-245 | − | CCAUACCAGGUCUCAUG | 17 | 861 |
| SCNN1A-81 | − | CAUACCAGGUCUCAUGG | 17 | 605 |
| SCNN1A-82 | − | AUACCAGGUCUCAUGGA | 17 | 501 |
| SCNN1A-83 | − | UACCAGGUCUCAUGGAG | 17 | 606 |
| SCNN1A-249 | − | UCAUGGAGGGGAACAAG | 17 | 862 |
| SCNN1A-84 | − | CAUGGAGGGGAACAAGC | 17 | 607 |
| SCNN1A-251 | − | UGGAGGGGAACAAGCUG | 17 | 863 |
| SCNN1A-85 | − | GGAGGGGAACAAGCUGG | 17 | 530 |
| SCNN1A-253 | − | GGAACAAGCUGGAGGAG | 17 | 864 |
| SCNN1A-254 | − | CCCUCCACAGUCCACUC | 17 | 865 |
| SCNN1A-255 | − | AGUCCACUCCAGGGCUC | 17 | 866 |
| SCNN1A-256 | − | CCACUCCAGGGCUCAUG | 17 | 867 |
| SCNN1A-89 | − | CACUCCAGGGCUCAUGA | 17 | 610 |
| SCNN1A-90 | − | ACUCCAGGGCUCAUGAA | 17 | 611 |
| SCNN1A-91 | − | CUCCAGGGCUCAUGAAG | 17 | 612 |
| SCNN1A-260 | − | CAUGAAGGGGAACAAGC | 17 | 868 |
| SCNN1A-261 | − | UGAAGGGGAACAAGCGU | 17 | 869 |
| SCNN1A-92 | − | GAAGGGGAACAAGCGUG | 17 | 532 |
| SCNN1A-263 | − | GGAACAAGCGUGAGGAG | 17 | 870 |
| SCNN1A-93 | − | GAACAAGCGUGAGGAGC | 17 | 533 |
| SCNN1A-265 | − | AGCGUGAGGAGCAGGGG | 17 | 871 |
| SCNN1A-266 | − | GGAGCAGGGGCUGGGCC | 17 | 872 |
| SCNN1A-267 | − | CGCCCCAGCAGCCCACG | 17 | 873 |
| SCNN1A-100 | − | GCCCCAGCAGCCCACGG | 17 | 537 |
| SCNN1A-269 | − | CCCAGCAGCCCACGGCG | 17 | 874 |
| SCNN1A-101 | − | CCAGCAGCCCACGGCGG | 17 | 616 |
| SCNN1A-271 | − | AGCAGCCCACGGCGGAG | 17 | 875 |
| SCNN1A-102 | − | GCAGCCCACGGCGGAGG | 17 | 538 |
| SCNN1A-273 | − | GGAGGAGGAGGCCCUGA | 17 | 876 |
| SCNN1A-274 | − | GAGUUCCACCGCUCCUA | 17 | 877 |
| SCNN1A-275 | − | GUUCCACCGCUCCUACC | 17 | 878 |
| SCNN1A-276 | − | CUCCUACCGAGAGCUCU | 17 | 879 |
| SCNN1A-277 | − | GCUCCAGCACAACCGC | 17 | 880 |
| SCNN1A-278 | − | CGCAUGAAGACGGCCUU | 17 | 881 |
| SCNN1A-279 | − | GCAAUUCGGCCUGCUUU | 17 | 882 |
| SCNN1A-113 | − | CAAUUCGCCUGCUUUU | 17 | 624 |
| SCNN1A-281 | − | AUUCGGCCUGCUUUUCG | 17 | 883 |
| SCNN1A-282 | − | UCAACAUCAACCUCAAC | 17 | 884 |
| SCNN1A-283 | + | CCUCCAUGAGACCUGGU | 17 | 885 |
| SCNN1A-284 | + | CCAGCUUGUUCCCCUCC | 17 | 886 |
| SCNN1A-285 | + | AGUGGACUGUGGAGGGC | 17 | 887 |

TABLE 3D-continued

| gRNA Name | DNA Strand | Targeting Domain | Target Site Length | Seq ID |
|---|---|---|---|---|
| SCNN1A-286 | + | CCCUGGAGUGGACUGUG | 17 | 888 |
| SCNN1A-153 | + | AGCCCUGGAGUGGACUG | 17 | 650 |
| SCNN1A-288 | + | GAGCCCUGGAGUGGACU | 17 | 889 |
| SCNN1A-289 | + | CCUUCAUGAGCCCUGGA | 17 | 890 |
| SCNN1A-151 | + | UUCCCCUUCAUGAGCCC | 17 | 648 |
| SCNN1A-291 | + | GUUCCCCUUCAUGAGCC | 17 | 891 |
| SCNN1A-292 | + | CACGCUUGUUCCCCUUC | 17 | 892 |
| SCNN1A-148 | + | CUGGGGCGCCGCAGGUU | 17 | 646 |
| SCNN1A-294 | + | GCUGGGGCGCCGCAGGU | 17 | 893 |
| SCNN1A-144 | + | CCUCCGCCGUGGGCUGC | 17 | 643 |
| SCNN1A-296 | + | UCCUCCGCCGUGGGCUG | 17 | 894 |
| SCNN1A-297 | + | GGGCCUCCUCCUCCGCC | 17 | 895 |
| SCNN1A-298 | + | GAGCGGUGGAACUCGAU | 17 | 896 |
| SCNN1A-139 | + | GCUCUCGGUAGGAGCGG | 17 | 550 |
| SCNN1A-300 | + | AGCUCUCGGUAGGAGCG | 17 | 897 |
| SCNN1A-137 | + | CUCGAAGAGCUCUCGGU | 17 | 640 |
| SCNN1A-302 | + | ACUCGAAGAGCUCUCGG | 17 | 898 |
| SCNN1A-303 | + | UGUUGCAGAAGAACUCG | 17 | 899 |
| SCNN1A-304 | + | UGUUGUUGCAGAAGAAC | 17 | 900 |
| SCNN1A-305 | + | UGGUGGUGUUGUUGCAG | 17 | 901 |
| SCNN1A-306 | + | GGAUGGUGGUGUUGUUG | 17 | 902 |
| SCNN1A-307 | + | ACCAGGCGGAUGGCGCC | 17 | 903 |
| SCNN1A-308 | + | UGCUGGGAGCACACCAG | 17 | 904 |
| SCNN1A-129 | + | CUUCAUGCGGUUGUGCU | 17 | 636 |
| SCNN1A-128 | + | UCUUCAUGCGGUUGUGC | 17 | 635 |
| SCNN1A-311 | + | GUCUUCAUGCGGUUGUG | 17 | 905 |
| SCNN1A-312 | + | AGAGCCACAGCACUGCC | 17 | 906 |
| SCNN1A-313 | + | ACAUCAUGCCAAAGGUG | 17 | 907 |
| SCNN1A-314 | + | ACUCUCCGAAAAGCAGG | 17 | 908 |
| SCNN1A-315 | + | GGUAGCUGAAGUACUCU | 17 | 909 |
| SCNN1A-316 | + | UGAGGCUGACGGGGUAG | 17 | 910 |
| SCNN1A-121 | + | GUUGAUGUUGAGGCUGA | 17 | 545 |
| SCNN1A-318 | + | GGUUGAUGUUGAGGCUG | 17 | 911 |
| SCNN1A-319 | + | CCGAGUUGAGGUUGAUG | 17 | 912 |
| SCNN1A-320 | + | AGACGAGCUUGUCCGAG | 17 | 913 |
| SCNN1A-321 | + | GGGGAAGACGAGCUUGU | 17 | 914 |
| SCNN1A-322 | + | UGGUCACUGCGGGGAAG | 17 | 915 |
| SCNN1A-118 | + | UGCAGAUGGUCACUGCG | 17 | 626 |
| SCNN1A-117 | + | GUGCAGAUGGUCACUGC | 17 | 544 |
| SCNN1A-116 | + | GGUGCAGAUGGUCACUG | 17 | 543 |
| SCNN1A-326 | + | GGGUGCAGAUGGUCACU | 17 | 916 |

Table 4A provides exemplary targeting domains for correcting a mutation (e.g., 2789+5G) in the CFTR gene selected according to the first tier parameters. The targeting domains bind within 200 bp from a mutation (e.g., 2789+5G), have a high level of orthogonality and start with a 5'G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 4A

1st Tier

| gRNA Name | DNA Strand | Targeting Domain | Target Site Length | Seq ID |
|---|---|---|---|---|
| CFTR-2789-1 | + | GAAGCAGCCACCUGGAA | 17 | 937 |
| CFTR-2789-2 | + | GGAAUAUUCACUUUCCA | 17 | 938 |
| CFTR-2789-3 | − | GAAUUUAGAUGUGGGCA | 17 | 939 |
| CFTR-2789-4 | − | GUGUCUUGUUCCAUUCC | 17 | 940 |
| CFTR-2789-5 | − | GUGGGCAUGGGAGGAAU | 17 | 941 |
| CFTR-2789-6 | − | GUUGUGCUGUGGCUCCU | 17 | 942 |
| CFTR-2789-7 | − | GAUGUGAAUUUAGAUGU | 17 | 943 |
| CFTR-2789-8 | − | GACCCAGGAACACAAAGCAA | 20 | 944 |
| CFTR-2789-9 | + | GUGUCACCUCACCCAACUAA | 20 | 945 |
| CFTR-2789-10 | − | GUGUCUUGUUCCAUUCCAGG | 20 | 946 |
| CFTR-2789-11 | − | GAUGUGGGCAUGGGAGGAAU | 20 | 947 |
| CFTR-2789-12 | − | GUGAAUUUAGAUGUGGGCAU | 20 | 948 |

Table 4B provides exemplary targeting domains for correcting a mutation (e.g., 2789+5G) in the CFTR gene selected according to the second tier parameters. The targeting domains bind within 200 bp from a mutation (e.g., 2789+5G) and have a high level of orthogonality. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 4B

2nd Tier

| gRNA Name | DNA Strand | Targeting Domain | Target Site Length | Seq ID |
|---|---|---|---|---|
| CFTR-2789-13 | − | UUGGUACACACAUCAAA | 17 | 949 |
| CFTR-2789-14 | + | UCACCUCACCCAACUAA | 17 | 950 |
| CFTR-2789-15 | + | AUCUACACAAUAGGACA | 17 | 951 |
| CFTR-2789-16 | + | UGUGUGUACCAAUAUCA | 17 | 952 |
| CFTR-2789-17 | − | AUGGUAGUGGAAAGAUA | 17 | 953 |
| CFTR-2789-18 | − | AUUUCUCCCAAGCAUUA | 17 | 954 |
| CFTR-2789-19 | + | CCAAAGAAGCAGCCACC | 17 | 955 |
| CFTR-2789-20 | + | CCUUUGCUUUGUGUUCC | 17 | 956 |
| CFTR-2789-21 | − | CCCAAGCAUUAUGGUAG | 17 | 957 |
| CFTR-2789-22 | − | UUAGAUGUGGGCAUGGG | 17 | 958 |
| CFTR-2789-23 | − | CUUCUUUGGUUGUGCUG | 17 | 959 |
| CFTR-2789-24 | − | UGACCAUUAGUUGGGUG | 17 | 960 |
| CFTR-2789-25 | − | AAUUUAGAUGUGGGCAU | 17 | 961 |
| CFTR-2789-26 | − | UGUGUGUACCUUGAUAU | 17 | 962 |
| CFTR-2789-27 | + | UCCACUACCAUAAUGCU | 17 | 963 |
| CFTR-2789-28 | − | AAAUGAUGACCAUUAGU | 17 | 964 |
| CFTR-2789-29 | + | CCACUACCAUAAUGCUU | 17 | 965 |
| CFTR-2789-30 | − | CCAGGUGGCUGCUUCUU | 17 | 966 |
| CFTR-2789-31 | − | AUAUUGGUACACACAUCAAA | 20 | 967 |
| CFTR-2789-32 | + | AAAGAAGCAGCCACCUGGAA | 20 | 968 |
| CFTR-2789-33 | + | ACAAUCUACACAAUAGGACA | 20 | 969 |
| CFTR-2789-34 | − | UGUGAAUUUAGAUGUGGGCA | 20 | 970 |
| CFTR-2789-35 | + | UGAUGUGUGUACCAAUAUCA | 20 | 971 |
| CFTR-2789-36 | − | AUUAUGGUAGUGGAAAGAUA | 20 | 972 |
| CFTR-2789-37 | − | UUCAUUUCUCCCAAGCAUUA | 20 | 973 |
| CFTR-2789-38 | + | CAACCAAAGAAGCAGCCACC | 20 | 974 |
| CFTR-2789-39 | + | ACUGUGUCUUGUUCCAUUCC | 20 | 975 |
| CFTR-2789-40 | + | CUUCCUUUGCUUUGUGUUCC | 20 | 976 |
| CFTR-2789-41 | + | UACAAUACAUACAAACAUAG | 20 | 977 |
| CFTR-2789-42 | − | UCUCCCAAGCAUUAUGGUAG | 20 | 978 |
| CFTR-2789-43 | − | AAUUUAGAUGUGGGCAUGGG | 20 | 979 |
| CFTR-2789-44 | − | CUGCUUCUUUGGUUGUGCUG | 20 | 980 |
| CFTR-2789-45 | − | UGAUGACCAUUAGUUGGGUG | 20 | 981 |
| CFTR-2789-46 | − | AAUUGUGUGUACCUUGAUAU | 20 | 982 |
| CFTR-2789-47 | − | UUGGUUGUGCUGUGGCUCCU | 20 | 983 |
| CFTR-2789-48 | + | CUUUCCACUACCAUAAUGCU | 20 | 984 |
| CFTR-2789-49 | − | UUUAAAUGAUGACCAUUAGU | 20 | 985 |
| CFTR-2789-50 | − | UGUGAUGUGAAUUUAGAUGU | 20 | 986 |
| CFTR-2789-51 | + | UUUCCACUACCAUAAUGCUU | 20 | 987 |
| CFTR-2789-52 | − | AUUCCAGGUGGCUGCUUCUU | 20 | 988 |
| CFTR-2789-53 | − | UUAAAUGAUGACCAUUAGUU | 20 | 989 |

Table 4C provides exemplary targeting domains for correcting a mutation (e.g., 2789+5G) in the CFTR gene selected according to the third tier parameters. The targeting domains bind within 200 bp from a mutation (e.g., 2789+5G) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 4C

3rd Tier

| gRNA Name | DNA Strand | Targeting Domain | Target Site Length | Seq ID |
|---|---|---|---|---|
| CFTR-2789-54 | + | GGAGGAGCUAGGACUAC | 17 | 990 |
| CFTR-2789-55 | + | GGAGAAAUGAAACAAAG | 17 | 991 |
| CFTR-2789-56 | − | GUGUGAUGUGAAUUUAGAUG | 20 | 992 |

Table 4D provides exemplary targeting domains for correcting a mutation (e.g., 2789+5G) in the CFTR gene selected according to the fourth tier parameters. The targeting domains bind within 200 bp from a mutation (e.g., 2789+5G). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 4D

4th Tier

| gRNA Name | DNA Strand | Targeting Domain | Target Site Length | Seq ID |
|---|---|---|---|---|
| CFTR-2789-57 | − | CCAGGAACACAAAGCAA | 17 | 993 |
| CFTR-2789-58 | − | AGUCCUAGCUCCUCCAC | 17 | 994 |
| CFTR-2789-59 | + | AAUACAUACAAACAUAG | 17 | 995 |
| CFTR-2789-60 | − | UCUUGUUCCAUUCCAGG | 17 | 996 |
| CFTR-2789-61 | − | UGAUGUGAAUUUAGAUG | 17 | 997 |
| CFTR-2789-62 | + | AACACAAUCUACACAAU | 17 | 998 |
| CFTR-2789-63 | + | CUUUGCUUUGUGUUCCU | 17 | 999 |

TABLE 4D-continued

4th Tier

| gRNA Name | DNA Strand | Targeting Domain | Target Site Length | Seq ID |
|---|---|---|---|---|
| CFTR-2789-64 | − | AAUGAUGACCAUUAGUU | 17 | 1000 |
| CFTR-2789-65 | + | CAUGGAAUAUUCACUUUCCA | 20 | 1001 |
| CFTR-2789-66 | − | UGUAGUCCUAGCUCCUCCAC | 20 | 1002 |
| CFTR-2789-67 | + | UGUGGAGGAGCUAGGACUAC | 20 | 1003 |
| CFTR-2789-68 | + | UUGGGAGAAAUGAAACAAAG | 20 | 1004 |
| CFTR-2789-69 | + | UAAAACACAAUCUACACAAU | 20 | 1005 |
| CFTR-2789-70 | + | UUCCUUUGCUUUGUGUUCCU | 20 | 1006 |

Table 5A provides exemplary targeting domains for correcting a mutation (e.g., 2789+5G) in the CFTR gene selected according to the first tier parameters. The targeting domains bind within 200 bp from a mutation (e.g., 2789+5G), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 5A

1st Tier

| gRNA Name | DNA Strand | Targeting Domain | Target Site Length | Seq ID |
|---|---|---|---|---|
| CFTR-2789-71 | + | GAUUACAAUACAUACAAACAUA | 22 | 1007 |
| CFTR-2789-72 | + | GGAUUACAAUACAUACAAACAUA | 23 | 1008 |
| CFTR-2789-73 | − | GCUGUGGCUCCUUGGAAA | 18 | 1009 |
| CFTR-2789-74 | − | GUGCUGUGGCUCCUUGGAAA | 20 | 1010 |
| CFTR-2789-75 | − | GUUGUGCUGUGGCUCCUUGGAAA | 23 | 1011 |
| CFTR-2789-76 | − | GGUUGUGCUGUGGCUCCUUGGAAA | 24 | 1012 |
| CFTR-2789-77 | − | GUUUAAAUGAUGACCAUUAG | 20 | 1013 |
| CFTR-2789-78 | − | GUACACACAUCAAAUGGUGUGAU | 23 | 1014 |
| CFTR-2789-79 | − | GGUACACACAUCAAAUGGUGUGAU | 24 | 1015 |

Table 5B provides exemplary targeting domains for correcting a mutation (e.g., 2789+5G) in the CFTR gene selected according to the second tier parameters. The targeting domains bind within 200 bp from a mutation (e.g., 2789+5G), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 5B

2nd Tier

| gRNA Name | DNA Strand | Targeting Domain | Target Site Length | Seq ID |
|---|---|---|---|---|
| CFTR-2789-80 | + | UGGGAGAAAUGAAACAAA | 18 | 1016 |
| CFTR-2789-81 | + | UUGGGAGAAAUGAAACAAA | 19 | 1017 |
| CFTR-2789-82 | + | CUUGGGAGAAAUGAAACAAA | 20 | 1018 |
| CFTR-2789-83 | + | ACAAUACAUACAAACAUA | 18 | 1019 |
| CFTR-2789-84 | + | UACAAUACAUACAAACAUA | 19 | 1020 |
| CFTR-2789-85 | + | UUACAAUACAUACAAACAUA | 20 | 1021 |
| CFTR-2789-86 | + | AUUACAAUACAUACAAACAUA | 21 | 1022 |
| CFTR-2789-87 | + | UGGAUUACAAUACAUACAAACAUA | 24 | 1023 |
| CFTR-2789-88 | + | ACCAAAGAAGCAGCCACC | 18 | 1024 |
| CFTR-2789-89 | + | AACCAAAGAAGCAGCCACC | 19 | 1025 |
| CFTR-2789-38 | + | CAACCAAAGAAGCAGCCACC | 20 | 974 |
| CFTR-2789-90 | + | UUCCUUUGCUUUGUGUUC | 18 | 1026 |
| CFTR-2789-91 | + | CUUCCUUUGCUUUGUGUUC | 19 | 1027 |
| CFTR-2789-92 | + | UCUUCCUUUGCUUUGUGUUC | 20 | 1028 |
| CFTR-2789-93 | − | UGCUGUGGCUCCUUGGAAA | 19 | 1029 |
| CFTR-2789-94 | − | UGUGCUGUGGCUCCUUGGAAA | 21 | 1030 |
| CFTR-2789-95 | − | UUGUGCUGUGGCUCCUUGGAAA | 22 | 1031 |
| CFTR-2789-96 | − | UUAAAUGAUGACCAUUAG | 18 | 1032 |
| CFTR-2789-97 | − | UUUAAAUGAUGACCAUUAG | 19 | 1033 |
| CFTR-2789-98 | − | UGUUUAAAUGAUGACCAUUAG | 21 | 1034 |
| CFTR-2789-99 | − | UUGUUUAAAUGAUGACCAUUAG | 22 | 1035 |
| CFTR-2789-100 | − | UUUGUUUAAAUGAUGACCAUUAG | 23 | 1036 |
| CFTR-2789-101 | − | UUUUGUUUAAAUGAUGACCAUUAG | 24 | 1037 |

TABLE 5B-continued

2nd Tier

| gRNA Name | DNA Strand | Targeting Domain | Target Site Length | Seq ID |
|---|---|---|---|---|
| CFTR-2789-102 | - | UUUAGAUGUGGGCAUGGG | 18 | 1038 |
| CFTR-2789-103 | - | AUUUAGAUGUGGGCAUGGG | 19 | 1039 |
| CFTR-2789-43 | - | AAUUUAGAUGUGGGCAUGGG | 20 | 979 |
| CFTR-2789-104 | - | CACAUCAAAUGGUGUGAU | 18 | 1040 |
| CFTR-2789-105 | - | ACACAUCAAAUGGUGUGAU | 19 | 1041 |
| CFTR-2789-106 | - | CACACAUCAAAUGGUGUGAU | 20 | 1042 |
| CFTR-2789-107 | - | ACACACAUCAAAUGGUGUGAU | 21 | 1043 |
| CFTR-2789-108 | - | UACACACAUCAAAUGGUGUGAU | 22 | 1044 |

Table 5C provides exemplary targeting domains for correcting a mutation (e.g., 2789+5G) in the CFTR gene selected according to the third tier parameters. The targeting domains bind within 200 bp from a mutation (e.g., 2789+5G), starts with a 5'G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 5C

3rd Tier

| gRNA Name | DNA Strand | Targeting Domain | Target Site Length | Seq ID |
|---|---|---|---|---|
| CFTR-2789-109 | + | GCUUGGGAGAAAUGAAACAAA | 21 | 1045 |
| CFTR-2789-110 | + | GUGGAGGAGCUAGGACUAC | 19 | 1046 |
| CFTR-2789-111 | + | GCACAACCAAAGAAGCAGCCACC | 23 | 1047 |
| CFTR-2789-112 | - | GAAUUUAGAUGUGGGCAUGGG | 21 | 1048 |
| CFTR-2789-113 | - | GUGAAUUUAGAUGUGGGCAUGGG | 23 | 1049 |

Table 5D provides exemplary targeting domains for correcting a mutation (e.g., 2789+5G) in the CFTR gene selected according to the fourth tier parameters. The targeting domains bind within 200 bp from a mutation (e.g., 2789+5G), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 5D

4th Tier

| gRNA Name | DNA Strand | Targeting Domain | Target Site Length | Seq ID |
|---|---|---|---|---|
| CFTR-2789-114 | + | UGCUUGGGAGAAAUGAAACAAA | 22 | 1050 |
| CFTR-2789-115 | + | AUGCUUGGGAGAAAUGAAACAAA | 23 | 1051 |
| CFTR-2789-116 | + | AAUGCUUGGGAGAAAUGAAACAAA | 24 | 1052 |
| CFTR-2789-117 | + | AAUCUACACAAUAGGACA | 18 | 1053 |
| CFTR-2789-118 | + | CAAUCUACACAAUAGGACA | 19 | 1054 |
| CFTR-2789-33 | + | ACAAUCUACACAAUAGGACA | 20 | 969 |
| CFTR-2789-119 | + | CACAAUCUACACAAUAGGACA | 21 | 1055 |
| CFTR-2789-120 | + | ACACAAUCUACACAAUAGGACA | 22 | 1056 |
| CFTR-2789-121 | + | AACACAAUCUACACAAUAGGACA | 23 | 1057 |
| CFTR-2789-122 | + | AAACACAAUCUACACAAUAGGACA | 24 | 1058 |
| CFTR-2789-123 | + | UGGAGGAGCUAGGACUAC | 18 | 1059 |
| CFTR-2789-67 | + | UGUGGAGGAGCUAGGACUAC | 20 | 1003 |
| CFTR-2789-124 | + | ACAACCAAAGAAGCAGCCACC | 21 | 1060 |
| CFTR-2789-125 | + | CACAACCAAAGAAGCAGCCACC | 22 | 1061 |
| CFTR-2789-126 | + | AGCACAACCAAAGAAGCAGCCACC | 24 | 1062 |
| CFTR-2789-127 | + | AUCUUCCUUUGCUUUGUGUUC | 21 | 1063 |
| CFTR-2789-128 | + | CAUCUUCCUUUGCUUUGUGUUC | 22 | 1064 |
| CFTR-2789-129 | + | UCAUCUUCCUUUGCUUUGUGUUC | 23 | 1065 |
| CFTR-2789-130 | + | UUCAUCUUCCUUUGCUUUGUGUUC | 24 | 1066 |
| CFTR-2789-131 | - | UGAAUUUAGAUGUGGGCAUGGG | 22 | 1067 |
| CFTR-2789-132 | - | UGUGAAUUUAGAUGUGGGCAUGGG | 24 | 1068 |

Table 5E provides exemplary targeting domains for correcting a mutation (e.g., 2789+5G) in the CFTR gene selected according to the fifth tier parameters. The targeting domains bind within 200 bp from a mutation (e.g., 2789+5G), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 5E

| gRNA Name | DNA Strand | Targeting Domain | Target Site Length | Seq ID |
|---|---|---|---|---|
| | | 5th Tier | | |
| CFTR-2789-133 | + | AAAACACAAUCUACACAA | 18 | 1069 |
| CFTR-2789-134 | + | UAAAACACAAUCUACACAA | 19 | 1070 |
| CFTR-2789-135 | + | AUAAAACACAAUCUACACAA | 20 | 1071 |
| CFTR-2789-136 | + | AAUAAAACACAAUCUACACAA | 21 | 1072 |
| CFTR-2789-137 | + | AAAUAAAACACAAUCUACACAA | 22 | 1073 |
| CFTR-2789-138 | + | GAAAUAAAACACAAUCUACACAA | 23 | 1074 |
| CFTR-2789-139 | + | AGAAAUAAAACACAAUCUACACAA | 24 | 1075 |
| CFTR-2789-140 | + | AUUACAAUAUUUAAUCAA | 18 | 1076 |
| CFTR-2789-141 | + | GAUUACAAUAUUUAAUCAA | 19 | 1077 |
| CFTR-2789-142 | + | GGAUUACAAUAUUUAAUCAA | 20 | 1078 |
| CFTR-2789-143 | + | UGGAUUACAAUAUUUAAUCAA | 21 | 1079 |
| CFTR-2789-144 | + | GUGGAUUACAAUAUUUAAUCAA | 22 | 1080 |
| CFTR-2789-145 | + | AGUGGAUUACAAUAUUUAAUCAA | 23 | 1081 |
| CFTR-2789-146 | + | UAGUGGAUUACAAUAUUUAAUCAA | 24 | 1082 |
| CFTR-2789-147 | + | CCAUAAUGCUUGGGAGAA | 18 | 1083 |
| CFTR-2789-148 | + | ACCAUAAUGCUUGGGAGAA | 19 | 1084 |
| CFTR-2789-149 | + | UACCAUAAUGCUUGGGAGAA | 20 | 1085 |
| CFTR-2789-150 | + | CUACCAUAAUGCUUGGGAGAA | 21 | 1086 |
| CFTR-2789-151 | + | ACUACCAUAAUGCUUGGGAGAA | 22 | 1087 |
| CFTR-2789-152 | + | CACUACCAUAAUGCUUGGGAGAA | 23 | 1088 |
| CFTR-2789-153 | + | CCACUACCAUAAUGCUUGGGAGAA | 24 | 1089 |
| CFTR-2789-154 | + | AGAAGCAGCCACCUGGAA | 18 | 1090 |
| CFTR-2789-155 | + | AAGAAGCAGCCACCUGGAA | 19 | 1091 |
| CFTR-2789-32 | + | AAAGAAGCAGCCACCUGGAA | 20 | 968 |

TABLE 5E-continued

5th Tier

| gRNA Name | DNA Strand | Targeting Domain | Target Site Length | Seq ID |
|---|---|---|---|---|
| CFTR-2789-156 | + | CAAAGAAGCAGCCACCUGGAA | 21 | 1092 |
| CFTR-2789-157 | + | CCAAAGAAGCAGCCACCUGGAA | 22 | 1093 |
| CFTR-2789-158 | + | ACCAAAGAAGCAGCCACCUGGAA | 23 | 1094 |
| CFTR-2789-159 | + | AACCAAAGAAGCAGCCACCUGGAA | 24 | 1095 |
| CFTR-2789-160 | + | GGAGCCACAGCACAACCA | 18 | 1096 |
| CFTR-2789-161 | + | AGGAGCCACAGCACAACCA | 19 | 1097 |
| CFTR-2789-162 | + | AAGGAGCCACAGCACAACCA | 20 | 1098 |
| CFTR-2789-163 | + | CAAGGAGCCACAGCACAACCA | 21 | 1099 |
| CFTR-2789-164 | + | CCAAGGAGCCACAGCACAACCA | 22 | 1100 |
| CFTR-2789-165 | + | UCCAAGGAGCCACAGCACAACCA | 23 | 1101 |
| CFTR-2789-166 | + | UUCCAAGGAGCCACAGCACAACCA | 24 | 1102 |
| CFTR-2789-167 | + | UGGAAUAUUCACUUUCCA | 18 | 1103 |
| CFTR-2789-168 | + | AUGGAAUAUUCACUUUCCA | 19 | 1104 |
| CFTR-2789-65 | + | CAUGGAAUAUUCACUUUCCA | 20 | 1001 |
| CFTR-2789-169 | + | ACAUGGAAUAUUCACUUUCCA | 21 | 1105 |
| CFTR-2789-170 | + | GACAUGGAAUAUUCACUUUCCA | 22 | 1106 |
| CFTR-2789-171 | + | GGACAUGGAAUAUUCACUUUCCA | 23 | 1107 |
| CFTR-2789-172 | + | AGGACAUGGAAUAUUCACUUUCCA | 24 | 1108 |
| CFTR-2789-173 | + | AAGAAGCAGCCACCUGGA | 18 | 1109 |
| CFTR-2789-174 | + | AAAGAAGCAGCCACCUGGA | 19 | 1110 |
| CFTR-2789-175 | + | CAAAGAAGCAGCCACCUGGA | 20 | 1111 |
| CFTR-2789-176 | + | CCAAAGAAGCAGCCACCUGGA | 21 | 1112 |
| CFTR-2789-177 | + | ACCAAAGAAGCAGCCACCUGGA | 22 | 1113 |
| CFTR-2789-178 | + | AACCAAAGAAGCAGCCACCUGGA | 23 | 1114 |
| CFTR-2789-179 | + | CAACCAAAGAAGCAGCCACCUGGA | 24 | 1115 |

TABLE 5E-continued

| | 5th Tier | | | |
|---|---|---|---|---|
| gRNA Name | DNA Strand | Targeting Domain | Target Site Length | Seq ID |
| CFTR-2789-180 | + | GUGGAGGAGCUAGGACUA | 18 | 1116 |
| CFTR-2789-181 | + | UGUGGAGGAGCUAGGACUA | 19 | 1117 |
| CFTR-2789-182 | + | CUGUGGAGGAGCUAGGACUA | 20 | 1118 |
| CFTR-2789-183 | + | AACCAAAGAAGCAGCCAC | 18 | 1119 |
| CFTR-2789-184 | + | CAACCAAAGAAGCAGCCAC | 19 | 1120 |
| CFTR-2789-185 | + | ACAACCAAAGAAGCAGCCAC | 20 | 1121 |
| CFTR-2789-186 | + | CACAACCAAAGAAGCAGCCAC | 21 | 1122 |
| CFTR-2789-187 | + | GCACAACCAAAGAAGCAGCCAC | 22 | 1123 |
| CFTR-2789-188 | + | AGCACAACCAAAGAAGCAGCCAC | 23 | 1124 |
| CFTR-2789-189 | + | CAGCACAACCAAAGAAGCAGCCAC | 24 | 1125 |
| CFTR-2789-190 | + | CAAUCUACACAAUAGGAC | 18 | 1126 |
| CFTR-2789-191 | + | ACAAUCUACACAAUAGGAC | 19 | 1127 |
| CFTR-2789-192 | + | CACAAUCUACACAAUAGGAC | 20 | 1128 |
| CFTR-2789-193 | + | ACACAAUCUACACAAUAGGAC | 21 | 1129 |
| CFTR-2789-194 | + | AACACAAUCUACACAAUAGGAC | 22 | 1130 |
| CFTR-2789-195 | + | AAACACAAUCUACACAAUAGGAC | 23 | 1131 |
| CFTR-2789-196 | + | AAAACACAAUCUACACAAUAGGAC | 24 | 1132 |
| CFTR-2789-197 | + | AUGGAAUAUUCACUUUCC | 18 | 1133 |
| CFTR-2789-198 | + | CAUGGAAUAUUCACUUUCC | 19 | 1134 |
| CFTR-2789-199 | + | ACAUGGAAUAUUCACUUUCC | 20 | 1135 |
| CFTR-2789-200 | + | GACAUGGAAUAUUCACUUUCC | 21 | 1136 |
| CFTR-2789-201 | + | GGACAUGGAAUAUUCACUUUCC | 22 | 1137 |
| CFTR-2789-202 | + | AGGACAUGGAAUAUUCACUUUCC | 23 | 1138 |
| CFTR-2789-203 | + | UAGGACAUGGAAUAUUCACUUUCC | 24 | 1139 |
| CFTR-2789-204 | + | UUUCCACUACCAUAAUGC | 18 | 1140 |

TABLE 5E-continued

5th Tier

| gRNA Name | DNA Strand | Targeting Domain | Target Site Length | Seq ID |
|---|---|---|---|---|
| CFTR-2789-205 | + | CUUUCCACUACCAUAAUGC | 19 | 1141 |
| CFTR-2789-206 | + | UCUUUCCACUACCAUAAUGC | 20 | 1142 |
| CFTR-2789-207 | + | AUCUUUCCACUACCAUAAUGC | 21 | 1143 |
| CFTR-2789-208 | + | UAUCUUUCCACUACCAUAAUGC | 22 | 1144 |
| CFTR-2789-209 | + | UUAUCUUUCCACUACCAUAAUGC | 23 | 1145 |
| CFTR-2789-210 | + | CUUAUCUUUCCACUACCAUAAUGC | 24 | 1146 |
| CFTR-2789-211 | + | CACUACCAUAAUGCUUGG | 18 | 1147 |
| CFTR-2789-212 | + | CCACUACCAUAAUGCUUGG | 19 | 1148 |
| CFTR-2789-213 | + | UCCACUACCAUAAUGCUUGG | 20 | 1149 |
| CFTR-2789-214 | + | UUCCACUACCAUAAUGCUUGG | 21 | 1150 |
| CFTR-2789-215 | + | UUUCCACUACCAUAAUGCUUGG | 22 | 1151 |
| CFTR-2789-216 | + | CUUUCCACUACCAUAAUGCUUGG | 23 | 1152 |
| CFTR-2789-217 | + | UCUUUCCACUACCAUAAUGCUUGG | 24 | 1153 |
| CFTR-2789-218 | + | UUCCACUACCAUAAUGCU | 18 | 1154 |
| CFTR-2789-219 | + | UUUCCACUACCAUAAUGCU | 19 | 1155 |
| CFTR-2789-48 | + | CUUUCCACUACCAUAAUGCU | 20 | 984 |
| CFTR-2789-220 | + | UCUUUCCACUACCAUAAUGCU | 21 | 1156 |
| CFTR-2789-221 | + | AUCUUUCCACUACCAUAAUGCU | 22 | 1157 |
| CFTR-2789-222 | + | UAUCUUUCCACUACCAUAAUGCU | 23 | 1158 |
| CFTR-2789-223 | + | UUAUCUUUCCACUACCAUAAUGCU | 24 | 1159 |
| CFTR-2789-224 | + | UCCACUACCAUAAUGCUU | 18 | 1160 |
| CFTR-2789-225 | + | UUCCACUACCAUAAUGCUU | 19 | 1161 |
| CFTR-2789-51 | + | UUUCCACUACCAUAAUGCUU | 20 | 987 |
| CFTR-2789-226 | + | CUUUCCACUACCAUAAUGCUU | 21 | 1162 |
| CFTR-2789-227 | + | UCUUUCCACUACCAUAAUGCUU | 22 | 1163 |

TABLE 5E-continued

5th Tier

| gRNA Name | DNA Strand | Targeting Domain | Target Site Length | Seq ID |
|---|---|---|---|---|
| CFTR-2789-228 | + | AUCUUUCCACUACCAUAAUGCUU | 23 | 1164 |
| CFTR-2789-229 | + | UAUCUUUCCACUACCAUAAUGCUU | 24 | 1165 |
| CFTR-2789-230 | − | CCCAGGAACACAAAGCAA | 18 | 1166 |
| CFTR-2789-231 | − | ACCCAGGAACACAAAGCAA | 19 | 1167 |
| CFTR-2789-8 | − | GACCCAGGAACACAAAGCAA | 20 | 944 |
| CFTR-2789-232 | − | GGACCCAGGAACACAAAGCAA | 21 | 1168 |
| CFTR-2789-233 | − | UGGACCCAGGAACACAAAGCAA | 22 | 1169 |
| CFTR-2789-234 | − | CUGGACCCAGGAACACAAAGCAA | 23 | 1170 |
| CFTR-2789-235 | − | GCUGGACCCAGGAACACAAAGCAA | 24 | 1171 |
| CFTR-2789-236 | − | ACCCAGGAACACAAAGCA | 18 | 1172 |
| CFTR-2789-237 | − | GACCCAGGAACACAAAGCA | 19 | 1173 |
| CFTR-2789-238 | − | GGACCCAGGAACACAAAGCA | 20 | 1174 |
| CFTR-2789-239 | − | UGGACCCAGGAACACAAAGCA | 21 | 1175 |
| CFTR-2789-240 | − | CUGGACCCAGGAACACAAAGCA | 22 | 1176 |
| CFTR-2789-241 | − | GCUGGACCCAGGAACACAAAGCA | 23 | 1177 |
| CFTR-2789-242 | − | UGCUGGACCCAGGAACACAAAGCA | 24 | 1178 |
| CFTR-2789-243 | − | UGAAUUUAGAUGUGGGCA | 18 | 1179 |
| CFTR-2789-244 | − | GUGAAUUUAGAUGUGGGCA | 19 | 1180 |
| CFTR-2789-34 | − | UGUGAAUUUAGAUGUGGGCA | 20 | 970 |
| CFTR-2789-245 | − | AUGUGAAUUUAGAUGUGGGCA | 21 | 1181 |
| CFTR-2789-246 | − | GAUGUGAAUUUAGAUGUGGGCA | 22 | 1182 |
| CFTR-2789-247 | − | UGAUGUGAAUUUAGAUGUGGGCA | 23 | 1183 |
| CFTR-2789-248 | − | GUGAUGUGAAUUUAGAUGUGGGCA | 24 | 1184 |
| CFTR-2789-249 | − | CUCCCAAGCAUUAUGGUA | 18 | 1185 |
| CFTR-2789-250 | − | UCUCCCAAGCAUUAUGGUA | 19 | 1186 |

TABLE 5E-continued

5th Tier

| gRNA Name | DNA Strand | Targeting Domain | Target Site Length | Seq ID |
|---|---|---|---|---|
| CFTR-2789-251 | − | UUCUCCCAAGCAUUAUGGUA | 20 | 1187 |
| CFTR-2789-252 | − | UUUCUCCCAAGCAUUAUGGUA | 21 | 1188 |
| CFTR-2789-253 | − | AUUUCUCCCAAGCAUUAUGGUA | 22 | 1189 |
| CFTR-2789-254 | − | CAUUUCUCCCAAGCAUUAUGGUA | 23 | 1190 |
| CFTR-2789-255 | − | UCAUUUCUCCCAAGCAUUAUGGUA | 24 | 1191 |
| CFTR-2789-256 | − | UGGUUGUGCUGUGGCUCC | 18 | 1192 |
| CFTR-2789-257 | − | UUGGUUGUGCUGUGGCUCC | 19 | 1193 |
| CFTR-2789-258 | − | UUUGGUUGUGCUGUGGCUCC | 20 | 1194 |
| CFTR-2789-259 | − | CUUUGGUUGUGCUGUGGCUCC | 21 | 1195 |
| CFTR-2789-260 | − | UCUUUGGUUGUGCUGUGGCUCC | 22 | 1196 |
| CFTR-2789-261 | − | UUCUUUGGUUGUGCUGUGGCUCC | 23 | 1197 |
| CFTR-2789-262 | − | CUUCUUUGGUUGUGCUGUGGCUCC | 24 | 1198 |
| CFTR-2789-263 | − | GUGAAUUUAGAUGUGGGC | 18 | 1199 |
| CFTR-2789-264 | − | UGUGAAUUUAGAUGUGGGC | 19 | 1200 |
| CFTR-2789-265 | − | AUGUGAAUUUAGAUGUGGGC | 20 | 1201 |
| CFTR-2789-266 | − | GAUGUGAAUUUAGAUGUGGGC | 21 | 1202 |
| CFTR-2789-267 | − | UGAUGUGAAUUUAGAUGUGGGC | 22 | 1203 |
| CFTR-2789-268 | − | GUGAUGUGAAUUUAGAUGUGGGC | 23 | 1204 |
| CFTR-2789-269 | − | UGUGAUGUGAAUUUAGAUGUGGGC | 24 | 1205 |
| CFTR-2789-270 | − | AACACAAAGCAAAGGAAG | 18 | 1206 |
| CFTR-2789-271 | − | GAACACAAAGCAAAGGAAG | 19 | 1207 |
| CFTR-2789-272 | − | GGAACACAAAGCAAAGGAAG | 20 | 1208 |
| CFTR-2789-273 | − | AGGAACACAAAGCAAAGGAAG | 21 | 1209 |
| CFTR-2789-274 | − | CAGGAACACAAAGCAAAGGAAG | 22 | 1210 |
| CFTR-2789-275 | − | CCAGGAACACAAAGCAAAGGAAG | 23 | 1211 |

TABLE 5E-continued

5th Tier

| gRNA Name | DNA Strand | Targeting Domain | Target Site Length | Seq ID |
|---|---|---|---|---|
| CFTR-2789-276 | − | CCCAGGAACACAAAGCAAAGGAAG | 24 | 1212 |
| CFTR-2789-277 | − | UGGGCAUGGGAGGAAUAG | 18 | 1213 |
| CFTR-2789-278 | − | GUGGGCAUGGGAGGAAUAG | 19 | 1214 |
| CFTR-2789-279 | − | UGUGGGCAUGGGAGGAAUAG | 20 | 1215 |
| CFTR-2789-280 | − | AUGUGGGCAUGGGAGGAAUAG | 21 | 1216 |
| CFTR-2789-281 | − | GAUGUGGGCAUGGGAGGAAUAG | 22 | 1217 |
| CFTR-2789-282 | − | AGAUGUGGGCAUGGGAGGAAUAG | 23 | 1218 |
| CFTR-2789-283 | − | UAGAUGUGGGCAUGGGAGGAAUAG | 24 | 1219 |
| CFTR-2789-284 | − | UCCCAAGCAUUAUGGUAG | 18 | 1220 |
| CFTR-2789-285 | − | CUCCCAAGCAUUAUGGUAG | 19 | 1221 |
| CFTR-2789-42 | − | UCUCCCAAGCAUUAUGGUAG | 20 | 978 |
| CFTR-2789-286 | − | UUCUCCCAAGCAUUAUGGUAG | 21 | 1222 |
| CFTR-2789-287 | − | UUUCUCCCAAGCAUUAUGGUAG | 22 | 1223 |
| CFTR-2789-288 | − | AUUUCUCCCAAGCAUUAUGGUAG | 23 | 1224 |
| CFTR-2789-289 | − | CAUUUCUCCCAAGCAUUAUGGUAG | 24 | 1225 |
| CFTR-2789-290 | − | AUUUAGAUGUGGGCAUGG | 18 | 1226 |
| CFTR-2789-291 | − | AAUUUAGAUGUGGGCAUGG | 19 | 1227 |
| CFTR-2789-292 | − | GAAUUUAGAUGUGGGCAUGG | 20 | 1228 |
| CFTR-2789-293 | − | UGAAUUUAGAUGUGGGCAUGG | 21 | 1229 |
| CFTR-2789-294 | − | GUGAAUUUAGAUGUGGGCAUGG | 22 | 1230 |
| CFTR-2789-295 | − | UGUGAAUUUAGAUGUGGGCAUGG | 23 | 1231 |
| CFTR-2789-296 | − | AUGUGAAUUUAGAUGUGGGCAUGG | 24 | 1232 |
| CFTR-2789-297 | − | AUGAUGACCAUUAGUUGG | 18 | 1233 |
| CFTR-2789-298 | − | AAUGAUGACCAUUAGUUGG | 19 | 1234 |
| CFTR-2789-299 | − | AAAUGAUGACCAUUAGUUGG | 20 | 1235 |

TABLE 5E-continued

| 5th Tier | | | | |
|---|---|---|---|---|
| gRNA Name | DNA Strand | Targeting Domain | Target Site Length | Seq ID |
| CFTR-2789-300 | − | UAAAUGAUGACCAUUAGUUGG | 21 | 1236 |
| CFTR-2789-301 | − | UUAAAUGAUGACCAUUAGUUGG | 22 | 1237 |
| CFTR-2789-302 | − | UUUAAAUGAUGACCAUUAGUUGG | 23 | 1238 |
| CFTR-2789-303 | − | GUUUAAAUGAUGACCAUUAGUUGG | 24 | 1239 |
| CFTR-2789-304 | − | GAAUUUAGAUGUGGGCAU | 18 | 1240 |
| CFTR-2789-305 | − | UGAAUUUAGAUGUGGGCAU | 19 | 1241 |
| CFTR-2789-12 | − | GUGAAUUUAGAUGUGGGCAU | 20 | 948 |
| CFTR-2789-306 | − | UGUGAAUUUAGAUGUGGGCAU | 21 | 1242 |
| CFTR-2789-307 | − | AUGUGAAUUUAGAUGUGGGCAU | 22 | 1243 |
| CFTR-2789-308 | − | GAUGUGAAUUUAGAUGUGGGCAU | 23 | 1244 |
| CFTR-2789-309 | − | UGAUGUGAAUUUAGAUGUGGGCAU | 24 | 1245 |
| CFTR-2789-310 | − | UGUGAUGUGAAUUUAGAU | 18 | 1246 |
| CFTR-2789-311 | − | GUGUGAUGUGAAUUUAGAU | 19 | 1247 |
| CFTR-2789-312 | − | GGUGUGAUGUGAAUUUAGAU | 20 | 1248 |
| CFTR-2789-313 | − | UGGUGUGAUGUGAAUUUAGAU | 21 | 1249 |
| CFTR-2789-314 | − | AUGGUGUGAUGUGAAUUUAGAU | 22 | 1250 |
| CFTR-2789-315 | − | AAUGGUGUGAUGUGAAUUUAGAU | 23 | 1251 |
| CFTR-2789-316 | − | AAAUGGUGUGAUGUGAAUUUAGAU | 24 | 1252 |
| CFTR-2789-317 | − | GGUUGUGCUGUGGCUCCU | 18 | 1253 |
| CFTR-2789-318 | − | UGGUUGUGCUGUGGCUCCU | 19 | 1254 |
| CFTR-2789-47 | − | UUGGUUGUGCUGUGGCUCCU | 20 | 983 |
| CFTR-2789-319 | − | UUUGGUUGUGCUGUGGCUCCU | 21 | 1255 |
| CFTR-2789-320 | − | CUUUGGUUGUGCUGUGGCUCCU | 22 | 1256 |
| CFTR-2789-321 | − | UCUUUGGUUGUGCUGUGGCUCCU | 23 | 1257 |
| CFTR-2789-322 | − | UUCUUUGGUUGUGCUGUGGCUCCU | 24 | 1258 |

TABLE 5E-continued

5th Tier

| gRNA Name | DNA Strand | Targeting Domain | Target Site Length | Seq ID |
|---|---|---|---|---|
| CFTR-2789-323 | − | AGGAAUAGGUGAAGAUGU | 18 | 1259 |
| CFTR-2789-324 | − | GAGGAAUAGGUGAAGAUGU | 19 | 1260 |
| CFTR-2789-325 | − | GGAGGAAUAGGUGAAGAUGU | 20 | 1261 |
| CFTR-2789-326 | − | GGGAGGAAUAGGUGAAGAUGU | 21 | 1262 |
| CFTR-2789-327 | − | UGGGAGGAAUAGGUGAAGAUGU | 22 | 1263 |
| CFTR-2789-328 | − | AUGGGAGGAAUAGGUGAAGAUGU | 23 | 1264 |
| CFTR-2789-329 | − | CAUGGGAGGAAUAGGUGAAGAUGU | 24 | 1265 |

Table 6A provides exemplary targeting domains for correcting a mutation (e.g., 2789+5G) in the CFTR gene selected according to the first tier parameters. The targeting domains bind within 200 bp from a mutation (e.g., 2789+5G), have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 6A

1st Tier

| gRNA Name | DNA Strand | Targeting Domain | Target Site Length | Seq ID |
|---|---|---|---|---|
| CFTR-2789-330 | + | GGAAUGGAACAAGACAC | 17 | 1266 |
| CFTR-2789-331 | + | GCUUGGGAGAAAUGAAACAA | 20 | 1267 |

TABLE 6A-continued

1st Tier

| gRNA Name | DNA Strand | Targeting Domain | Target Site Length | Seq ID |
|---|---|---|---|---|
| CFTR-2789-332 | + | GUACACACAAUUUCAUCUUC | 20 | 1268 |

Table 6B provides exemplary targeting domains for correcting a mutation (e.g., 2789+5G) in the CFTR gene selected according to the second tier parameters. The targeting domains bind within 200 bp from a mutation (e.g., 2789+5G) and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 6B

2nd Tier

| gRNA Name | DNA Strand | Targeting Domain | Target Site Length | Seq ID |
|---|---|---|---|---|
| CFTR-2789-333 | + | UGGGAGAAAUGAAACAA | 17 | 1269 |
| CFTR-2789-334 | + | UUAUCUUUCCACUACCA | 17 | 1270 |
| CFTR-2789-335 | + | CACACAAUUUCAUCUUC | 17 | 1271 |
| CFTR-2789-336 | − | AGAUUGUGUUUUAUUUC | 17 | 1272 |
| CFTR-2789-337 | − | UAUUCCAUGUCCUAUUG | 17 | 1273 |
| CFTR-2789-338 | − | CUUGUUCCAUUCCAGGU | 17 | 1274 |
| CFTR-2789-339 | + | ACCUUAUCUUUCCACUACCA | 20 | 1275 |

TABLE 6B-continued

2nd Tier

| gRNA Name | DNA Strand | Targeting Domain | Target Site Length | Seq ID |
|---|---|---|---|---|
| CFTR-2789-340 | + | CCUGGAAUGGAACAAGACAC | 20 | 1276 |
| CFTR-2789-341 | – | UGUAGAUUGUGUUUUAUUUC | 20 | 1277 |
| CFTR-2789-342 | + | AUUACAAUACAUACAAACAU | 20 | 1278 |

Table 6C provides exemplary targeting domains for correcting a mutation (e.g., 2789+5G) in the CFTR gene selected according to the third tier parameters. The targeting domains bind within 200 bp from a mutation (e.g., 2789+5G) and start with a 5'G. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 6C

3rd Tier

| gRNA Name | DNA Strand | Targeting Domain | Target Site Length | Seq ID |
|---|---|---|---|---|
| CFTR-2789-343 | – | GAAUAUUCCAUGUCCUAUUG | 20 | 1279 |

Table 6D provides exemplary targeting domains for correcting a mutation (e.g., 2789+5G) in the CFTR gene selected according to the fourth tier parameters. The targeting domains bind within 200 bp from a mutation (e.g., 2789+5G). It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 6D

4th Tier

| gRNA Name | DNA Strand | Targeting Domain | Target Site Length | Seq ID |
|---|---|---|---|---|
| CFTR-2789-344 | + | ACAAUACAUACAAACAU | 17 | 1280 |
| CFTR-2789-345 | – | UGUCUUGUUCCAUUCCAGGU | 20 | 1281 |

Table 7A provides exemplary targeting domains for correcting a mutation (e.g., 3272-26A→G) in the CFTR gene selected according to the first tier parameters. The targeting domains bind within 200 bp from a mutation (e.g., 3272-26A→G), have a high level of orthogonality and start with a 5'G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 7A

1st Tier

| gRNA Name | DNA Strand | Targeting Domain | Target Site Length | Seq ID |
|---|---|---|---|---|
| CFTR-3272-1 | + | GUAAGGCUGCCGUCCGA | 17 | 1282 |
| CFTR-3272-2 | – | GGAAAUAUUUCACAGGC | 17 | 1283 |
| CFTR-3272-3 | + | GUAAAUUCAGAGCUUUG | 17 | 1284 |
| CFTR-3272-4 | – | GGACACUUCGUGCCUUCGGA | 20 | 1285 |
| CFTR-3272-5 | + | GGAACCAGCGCAGUGUUGAC | 20 | 1286 |
| CFTR-3272-6 | + | GUAACAAGAUGAGUGAAAAU | 20 | 1287 |

Table 7B provides exemplary targeting domains for correcting a mutation (e.g., 3272-26A→G) in the CFTR gene selected according to the second tier parameters. The targeting domains bind within 200 bp from a mutation (e.g., 3272-26A→G) and have a high level of orthogonality. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 7B

2nd Tier

| gRNA Name | DNA Strand | Targeting Domain | Target Site Length | Seq ID |
|---|---|---|---|---|
| CFTR-3272-7 | – | CUUGUUACAAGCUUAAA | 17 | 1288 |
| CFTR-3272-8 | – | CAUAUCUAUUCAAAGAA | 17 | 1289 |

TABLE 7B-continued

| gRNA Name | DNA Strand | Targeting Domain | Target Site Length | Seq ID |
|---|---|---|---|---|
| 2nd Tier | | | | |
| CFTR-3272-9 | + | UACUUGGCUACCAGAGA | 17 | 1290 |
| CFTR-3272-10 | − | CACUUCGUGCCUUCGGA | 17 | 1291 |
| CFTR-3272-11 | − | CAAGCUUAAAAGGACUA | 17 | 1292 |
| CFTR-3272-12 | − | AUUUACAUACUGCCAAC | 17 | 1293 |
| CFTR-3272-13 | + | AAAGCUUUUUUCACAC | 17 | 1294 |
| CFTR-3272-14 | − | CUAUGGAAAUAUUUCAC | 17 | 1295 |
| CFTR-3272-15 | + | ACCAGCGCAGUGUUGAC | 17 | 1296 |
| CFTR-3272-16 | − | ACCUGUCAACACUGCGC | 17 | 1297 |
| CFTR-3272-17 | − | CUAAUUUAGUCUUUUUC | 17 | 1298 |
| CFTR-3272-18 | + | CAUAUCACAAAUGUCAU | 17 | 1299 |
| CFTR-3272-19 | + | ACUUGGCUACCAGAGAU | 17 | 1300 |
| CFTR-3272-20 | + | UACCCUCUUUUUUUACU | 17 | 1301 |
| CFTR-3272-21 | + | CAGGUACAAGAACCAGU | 17 | 1302 |
| CFTR-3272-22 | − | UGGACACUUCGUGCCUU | 17 | 1303 |
| CFTR-3272-23 | − | CAUCUUGUUACAAGCUUAAA | 20 | 1304 |
| CFTR-3272-24 | − | AAUCAUAUCUAUUCAAAGAA | 20 | 1305 |
| CFTR-3272-25 | + | UUUUACUUGGCUACCAGAGA | 20 | 1306 |
| CFTR-3272-26 | + | AAAGUAAGGCUGCCGUCCGA | 20 | 1307 |
| CFTR-3272-27 | − | UUACAAGCUUAAAAGGACUA | 20 | 1308 |
| CFTR-3272-28 | + | UGGAACAGAGUUUCAAAGUA | 20 | 1309 |
| CFTR-3272-29 | − | UGAAUUUACAUACUGCCAAC | 20 | 1310 |
| CFTR-3272-30 | + | UAAAAAGCUUUUUUCACAC | 20 | 1311 |
| CFTR-3272-31 | − | UUUCUAUGGAAAUAUUUCAC | 20 | 1312 |
| CFTR-3272-32 | − | UGUACCUGUCAACACUGCGC | 20 | 1313 |
| CFTR-3272-33 | − | UAUGGAAAUAUUUCACAGGC | 20 | 1314 |
| CFTR-3272-34 | − | UGGUAGCCAAGUAAAAAAAG | 20 | 1315 |
| CFTR-3272-35 | + | UAUGUAAAUUCAGAGCUUUG | 20 | 1316 |
| CFTR-3272-36 | + | AAUCAUAUCACAAAUGUCAU | 20 | 1317 |
| CFTR-3272-37 | + | UUUACUUGGCUACCAGAGAU | 20 | 1318 |
| CFTR-3272-38 | + | AGUUACCCUCUUUUUUUACU | 20 | 1319 |
| CFTR-3272-39 | + | UGACAGGUACAAGAACCAGU | 20 | 1320 |
| CFTR-3272-40 | − | CUAUGGACACUUCGUGCCUU | 20 | 1321 |

Table 7C provides exemplary targeting domains for correcting a mutation (e.g., 3272-26A→G) in the CFTR gene selected according to the third tier parameters. The targeting domains bind within 200 bp from a mutation (e.g., 3272-26A→G) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 7C

3rd Tier

| gRNA Name | DNA Strand | Targeting Domain | Target Site Length | Seq ID |
|---|---|---|---|---|
| CFTR-3272-41 | − | GGUAGCCAAGUAAAAAAGA | 20 | 1322 |
| CFTR-3272-42 | − | GUUAUUUGCAGUGUUUUCUA | 20 | 1323 |

Table 7D provides exemplary targeting domains for correcting a mutation (e.g., 3272-26A→G) in the CFTR gene selected according to the fourth tier parameters. The targeting domains bind within 200 bp from a mutation (e.g., 3272-26A→G). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 7D

4th Tier

| gRNA Name | DNA Strand | Targeting Domain | Target Site Length | Seq ID |
|---|---|---|---|---|
| CFTR-3272-43 | − | AGCCAAGUAAAAAAGA | 17 | 1324 |
| CFTR-3272-44 | − | AUUUGCAGUGUUUUCUA | 17 | 1325 |
| CFTR-3272-45 | + | AACAGAGUUUCAAAGUA | 17 | 1326 |
| CFTR-3272-46 | − | UAGCCAAGUAAAAAAG | 17 | 1327 |
| CFTR-3272-47 | + | ACAAGAUGAGUGAAAAU | 17 | 1328 |
| CFTR-3272-48 | − | AUUCUAAUUUAGUCUUUUC | 20 | 1329 |

Table 8A provides exemplary targeting domains for correcting a mutation (e.g., 3272-26A→G) in the CFTR gene selected according to the first tier parameters. The targeting domains bind within 200 bp from a mutation (e.g., 3272-26A→G), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 8A

1st Tier

| gRNA Name | DNA Strand | Targeting Domain | Target Site Length | Seq ID |
|---|---|---|---|---|
| CFTR-3272-49 | + | GUCCUUUUAAGCUUGUAACAAG | 22 | 1330 |
| CFTR-3272-50 | + | GUACCUGAAAAAGACUAAAU | 20 | 1331 |
| CFTR-3272-51 | − | GUCAACACUGCGCUGGUUCCAAAU | 24 | 1332 |

Table 8B provides exemplary targeting domains for correcting a mutation (e.g., 3272-26A→G) in the CFTR gene selected according to the second tier parameters. The targeting domains bind within 200 bp from a mutation (e.g., 3272-26A→G), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 8B

| | 2nd Tier | | | |
|---|---|---|---|---|
| gRNA Name | DNA Strand | Targeting Domain | Target Site Length | Seq ID |
| CFTR-3272-52 | + | UUUUAAGCUUGUAACAAG | 18 | 1333 |
| CFTR-3272-53 | + | CUUUUAAGCUUGUAACAAG | 19 | 1334 |
| CFTR-3272-54 | + | CCUUUUAAGCUUGUAACAAG | 20 | 1335 |
| CFTR-3272-55 | + | UCCUUUUAAGCUUGUAACAAG | 21 | 1336 |
| CFTR-3272-56 | + | AGUCCUUUUAAGCUUGUAACAAG | 23 | 1337 |
| CFTR-3272-57 | + | UAGUCCUUUUAAGCUUGUAACAAG | 24 | 1338 |
| CFTR-3272-58 | + | ACCUGAAAAGACUAAAU | 18 | 1339 |
| CFTR-3272-59 | + | UACCUGAAAAGACUAAAU | 19 | 1340 |
| CFTR-3272-60 | + | UGUACCUGAAAAGACUAAAU | 21 | 1341 |
| CFTR-3272-61 | + | UUGUACCUGAAAAGACUAAAU | 22 | 1342 |
| CFTR-3272-62 | + | CUUGUACCUGAAAAGACUAAAU | 23 | 1343 |
| CFTR-3272-63 | + | UCUUGUACCUGAAAAGACUAAAU | 24 | 1344 |
| CFTR-3272-64 | + | UCACACUGGUGCCAUUCU | 18 | 1345 |
| CFTR-3272-65 | + | UUCACACUGGUGCCAUUCU | 19 | 1346 |
| CFTR-3272-66 | + | UUUCACACUGGUGCCAUUCU | 20 | 1347 |
| CFTR-3272-67 | + | UUUUCACACUGGUGCCAUUCU | 21 | 1348 |
| CFTR-3272-68 | + | UUUUUCACACUGGUGCCAUUCU | 22 | 1349 |
| CFTR-3272-69 | + | UUUUUUCACACUGGUGCCAUUCU | 23 | 1350 |
| CFTR-3272-70 | + | UUUUUUUCACACUGGUGCCAUUCU | 24 | 1351 |
| CFTR-3272-71 | − | ACAAAUCAUAUCUAUUCA | 18 | 1352 |
| CFTR-3272-72 | − | AACAAAUCAUAUCUAUUCA | 19 | 1353 |
| CFTR-3272-73 | − | UAACAAAUCAUAUCUAUUCA | 20 | 1354 |
| CFTR-3272-74 | − | AUAACAAAUCAUAUCUAUUCA | 21 | 1355 |
| CFTR-3272-75 | − | AAUAACAAAUCAUAUCUAUUCA | 22 | 1356 |
| CFTR-3272-76 | − | AAAUAACAAAUCAUAUCUAUUCA | 23 | 1357 |
| CFTR-3272-77 | − | AAAAUAACAAAUCAUAUCUAUUCA | 24 | 1358 |
| CFTR-3272-78 | − | UGGAAAUAUUUCACAGGC | 18 | 1359 |
| CFTR-3272-79 | − | AUGGAAAUAUUUCACAGGC | 19 | 1360 |
| CFTR-3272-33 | − | UAUGGAAAUAUUUCACAGGC | 20 | 1314 |
| CFTR-3272-80 | − | ACUGCGCUGGUUCCAAAU | 18 | 1361 |
| CFTR-3272-81 | − | CACUGCGCUGGUUCCAAAU | 19 | 1362 |
| CFTR-3272-82 | − | ACACUGCGCUGGUUCCAAAU | 20 | 1363 |
| CFTR-3272-83 | − | AACACUGCGCUGGUUCCAAAU | 21 | 1364 |
| CFTR-3272-84 | − | CAACACUGCGCUGGUUCCAAAU | 22 | 1365 |
| CFTR-3272-85 | − | UCAACACUGCGCUGGUUCCAAAU | 23 | 1366 |
| CFTR-3272-86 | − | ACUCUGUUCCACAAAGCU | 18 | 1367 |

TABLE 8B-continued

2nd Tier

| gRNA Name | DNA Strand | Targeting Domain | Target Site Length | Seq ID |
|---|---|---|---|---|
| CFTR-3272-87 | – | AACUCUGUUCCACAAAGCU | 19 | 1368 |
| CFTR-3272-88 | – | AAACUCUGUUCCACAAAGCU | 20 | 1369 |

Table 8C provides exemplary targeting domains for correcting a mutation (e.g., 3272-26A→G) in the CFTR gene selected according to the third tier parameters. The targeting domains bind within 200 bp from a mutation (e.g., 3272-26A→G), start with a 5'G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 8C

3rd Tier

| gRNA Name | DNA Strand | Targeting Domain | Target Site Length | Seq ID |
|---|---|---|---|---|
| CFTR-3272-89 | + | GUAAAUUCAGAGCUUUGUGGAA | 22 | 1370 |
| CFTR-3272-90 | + | GAUAUGAUUUGUUAUUUAUUA | 22 | 1371 |

TABLE 8C-continued

3rd Tier

| gRNA Name | DNA Strand | Targeting Domain | Target Site Length | Seq ID |
|---|---|---|---|---|
| CFTR-3272-91 | – | GGUAGCCAAGUAAAAAAA | 18 | 1372 |
| CFTR-3272-92 | – | GAAACUCUGUUCCACAAAGCU | 21 | 1373 |

Table 8D provides exemplary targeting domains for correcting a mutation (e.g., 3272-26A→G) in the CFTR gene selected according to the fourth tier parameters. The targeting domains bind within 200 bp from a mutation (e.g., 3272-26A→G), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 8D

4th Tier

| gRNA Name | DNA Strand | Targeting Domain | Target Site Length | Seq ID |
|---|---|---|---|---|
| CFTR-3272-93 | + | AUUCAGAGCUUUGUGGAA | 18 | 1374 |
| CFTR-3272-94 | + | AAUUCAGAGCUUUGUGGAA | 19 | 1375 |
| CFTR-3272-95 | + | AAAUUCAGAGCUUUGUGGAA | 20 | 1376 |
| CFTR-3272-96 | + | UAAAUUCAGAGCUUUGUGGAA | 21 | 1377 |
| CFTR-3272-97 | + | UGUAAAUUCAGAGCUUUGUGGAA | 23 | 1378 |
| CFTR-3272-98 | + | AUGUAAAUUCAGAGCUUUGUGGAA | 24 | 1379 |
| CFTR-3272-99 | + | UGAUUUGUUAUUUAUUA | 18 | 1380 |
| CFTR-3272-100 | + | AUGAUUUGUUAUUUAUUA | 19 | 1381 |
| CFTR-3272-101 | + | UAUGAUUUGUUAUUUAUUA | 20 | 1382 |
| CFTR-3272-102 | + | AUAUGAUUUGUUAUUUAUUA | 21 | 1383 |

TABLE 8D-continued

4th Tier

| gRNA Name | DNA Strand | Targeting Domain | Target Site Length | Seq ID |
|---|---|---|---|---|
| CFTR-3272-103 | + | AGAUAUGAUUUGUUAUUUUAUUA | 23 | 1384 |
| CFTR-3272-104 | + | UAGAUAUGAUUUGUUAUUUUAUUA | 24 | 1385 |
| CFTR-3272-105 | - | UGGUAGCCAAGUAAAAAAA | 19 | 1386 |
| CFTR-3272-106 | - | CUGGUAGCCAAGUAAAAAAA | 20 | 1387 |
| CFTR-3272-107 | - | UCUGGUAGCCAAGUAAAAAAA | 21 | 1388 |
| CFTR-3272-108 | - | CUCUGGUAGCCAAGUAAAAAAA | 22 | 1389 |
| CFTR-3272-109 | - | UCUCUGGUAGCCAAGUAAAAAAA | 23 | 1390 |
| CFTR-3272-110 | - | AUCUCUGGUAGCCAAGUAAAAAAA | 24 | 1391 |
| CFTR-3272-111 | - | CUAUGGAAAUAUUUCACAGGC | 21 | 1392 |
| CFTR-3272-112 | - | UCUAUGGAAAUAUUUCACAGGC | 22 | 1393 |
| CFTR-3272-113 | - | UUCUAUGGAAAUAUUUCACAGGC | 23 | 1394 |
| CFTR-3272-114 | - | UUUCUAUGGAAAUAUUUCACAGGC | 24 | 1395 |
| CFTR-3272-115 | - | UGAAACUCUGUUCCACAAAGCU | 22 | 1396 |
| CFTR-3272-116 | - | UUGAAACUCUGUUCCACAAAGCU | 23 | 1397 |
| CFTR-3272-117 | - | UUUGAAACUCUGUUCCACAAAGCU | 24 | 1398 |

Table 8E provides exemplary targeting domains for correcting a mutation (e.g., 3272-26A→G) in the CFTR gene selected according to the fifth tier parameters. The targeting domains bind within 200 bp from a mutation (e.g., 3272-26A→G), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 8E

5th Tier

| gRNA Name | DNA Strand | Targeting Domain | Target Site Length | Seq ID |
|---|---|---|---|---|
| CFTR-3272-118 | + | UAACAAGAUGAGUGAAAA | 18 | 1399 |
| CFTR-3272-119 | + | GUAACAAGAUGAGUGAAAA | 19 | 1400 |
| CFTR-3272-120 | + | UGUAACAAGAUGAGUGAAAA | 20 | 1401 |
| CFTR-3272-121 | + | UUGUAACAAGAUGAGUGAAAA | 21 | 1402 |
| CFTR-3272-122 | + | CUUGUAACAAGAUGAGUGAAAA | 22 | 1403 |
| CFTR-3272-123 | + | GCUUGUAACAAGAUGAGUGAAAA | 23 | 1404 |
| CFTR-3272-124 | + | AGCUUGUAACAAGAUGAGUGAAAA | 24 | 1405 |

TABLE 8E-continued

5th Tier

| gRNA Name | DNA Strand | Targeting Domain | Target Site Length | Seq ID |
|---|---|---|---|---|
| CFTR-3272-125 | + | GCCUGUGAAAUAUUUCCA | 18 | 1406 |
| CFTR-3272-126 | + | UGCCUGUGAAAUAUUUCCA | 19 | 1407 |
| CFTR-3272-127 | + | CUGCCUGUGAAAUAUUUCCA | 20 | 1408 |
| CFTR-3272-128 | + | CCUGCCUGUGAAAUAUUUCCA | 21 | 1409 |
| CFTR-3272-129 | + | UCCUGCCUGUGAAAUAUUUCCA | 22 | 1410 |
| CFTR-3272-130 | + | CUCCUGCCUGUGAAAUAUUUCCA | 23 | 1411 |
| CFTR-3272-131 | + | ACUCCUGCCUGUGAAAUAUUUCCA | 24 | 1412 |
| CFTR-3272-132 | + | UUACUUGGCUACCAGAGA | 18 | 1413 |
| CFTR-3272-133 | + | UUUACUUGGCUACCAGAGA | 19 | 1414 |
| CFTR-3272-25 | + | UUUUACUUGGCUACCAGAGA | 20 | 1306 |
| CFTR-3272-134 | + | UUUUUACUUGGCUACCAGAGA | 21 | 1415 |
| CFTR-3272-135 | + | UUUUUUACUUGGCUACCAGAGA | 22 | 1416 |
| CFTR-3272-136 | + | UUUUUUUACUUGGCUACCAGAGA | 23 | 1417 |
| CFTR-3272-137 | + | CUUUUUUUACUUGGCUACCAGAGA | 24 | 1418 |
| CFTR-3272-138 | + | AAGCUUGUAACAAGAUGA | 18 | 1419 |
| CFTR-3272-139 | + | UAAGCUUGUAACAAGAUGA | 19 | 1420 |
| CFTR-3272-140 | + | UUAAGCUUGUAACAAGAUGA | 20 | 1421 |
| CFTR-3272-141 | + | UUUAAGCUUGUAACAAGAUGA | 21 | 1422 |
| CFTR-3272-142 | + | UUUUAAGCUUGUAACAAGAUGA | 22 | 1423 |
| CFTR-3272-143 | + | CUUUUAAGCUUGUAACAAGAUGA | 23 | 1424 |
| CFTR-3272-144 | + | CCUUUUAAGCUUGUAACAAGAUGA | 24 | 1425 |
| CFTR-3272-145 | + | CUUUUUUUACUUGGCUAC | 18 | 1426 |
| CFTR-3272-146 | + | UCUUUUUUUACUUGGCUAC | 19 | 1427 |
| CFTR-3272-147 | + | CUCUUUUUUUACUUGGCUAC | 20 | 1428 |
| CFTR-3272-148 | + | CCUCUUUUUUUACUUGGCUAC | 21 | 1429 |
| CFTR-3272-149 | + | CCCUCUUUUUUUACUUGGCUAC | 22 | 1430 |
| CFTR-3272-150 | + | ACCCUCUUUUUUUACUUGGCUAC | 23 | 1431 |
| CFTR-3272-151 | + | UACCCUCUUUUUUUACUUGGCUAC | 24 | 1432 |
| CFTR-3272-152 | + | CGCAGUGUUGACAGGUAC | 18 | 1433 |
| CFTR-3272-153 | + | GCGCAGUGUUGACAGGUAC | 19 | 1434 |
| CFTR-3272-154 | + | AGCGCAGUGUUGACAGGUAC | 20 | 1435 |
| CFTR-3272-155 | + | CAGCGCAGUGUUGACAGGUAC | 21 | 1436 |
| CFTR-3272-156 | + | CCAGCGCAGUGUUGACAGGUAC | 22 | 1437 |
| CFTR-3272-157 | + | ACCAGCGCAGUGUUGACAGGUAC | 23 | 1438 |
| CFTR-3272-158 | + | AACCAGCGCAGUGUUGACAGGUAC | 24 | 1439 |
| CFTR-3272-159 | + | UUUCAUAAUAUCUUGUAC | 18 | 1440 |
| CFTR-3272-160 | + | AUUUCAUAAUAUCUUGUAC | 19 | 1441 |
| CFTR-3272-161 | + | AAUUUCAUAAUAUCUUGUAC | 20 | 1442 |

TABLE 8E-continued

5th Tier

| gRNA Name | DNA Strand | Targeting Domain | Target Site Length | Seq ID |
|---|---|---|---|---|
| CFTR-3272-162 | + | UAAUUUCAUAAUAUCUUGUAC | 21 | 1443 |
| CFTR-3272-163 | + | GUAAUUUCAUAAUAUCUUGUAC | 22 | 1444 |
| CFTR-3272-164 | + | UGUAAUUUCAUAAUAUCUUGUAC | 23 | 1445 |
| CFTR-3272-165 | + | AUGUAAUUUCAUAAUAUCUUGUAC | 24 | 1446 |
| CFTR-3272-166 | + | AGGCUGCCGUCCGAAGGC | 18 | 1447 |
| CFTR-3272-167 | + | AAGGCUGCCGUCCGAAGGC | 19 | 1448 |
| CFTR-3272-168 | + | UAAGGCUGCCGUCCGAAGGC | 20 | 1449 |
| CFTR-3272-169 | + | GUAAGGCUGCCGUCCGAAGGC | 21 | 1450 |
| CFTR-3272-170 | + | AGUAAGGCUGCCGUCCGAAGGC | 22 | 1451 |
| CFTR-3272-171 | + | AAGUAAGGCUGCCGUCCGAAGGC | 23 | 1452 |
| CFTR-3272-172 | + | AAAGUAAGGCUGCCGUCCGAAGGC | 24 | 1453 |
| CFTR-3272-173 | + | UUUACUUGGCUACCAGAG | 18 | 1454 |
| CFTR-3272-174 | + | UUUUACUUGGCUACCAGAG | 19 | 1455 |
| CFTR-3272-175 | + | UUUUUACUUGGCUACCAGAG | 20 | 1456 |
| CFTR-3272-176 | + | UUUUUUACUUGGCUACCAGAG | 21 | 1457 |
| CFTR-3272-177 | + | UUUUUUUACUUGGCUACCAGAG | 22 | 1458 |
| CFTR-3272-178 | + | CUUUUUUUACUUGGCUACCAGAG | 23 | 1459 |
| CFTR-3272-179 | + | UCUUUUUUUACUUGGCUACCAGAG | 24 | 1460 |
| CFTR-3272-180 | + | UGUAAAUUCAGAGCUUUG | 18 | 1461 |
| CFTR-3272-181 | + | AUGUAAAUUCAGAGCUUUG | 19 | 1462 |
| CFTR-3272-35 | + | UAUGUAAAUUCAGAGCUUUG | 20 | 1316 |
| CFTR-3272-182 | + | GUAUGUAAAUUCAGAGCUUUG | 21 | 1463 |
| CFTR-3272-183 | + | AGUAUGUAAAUUCAGAGCUUUG | 22 | 1464 |
| CFTR-3272-184 | + | CAGUAUGUAAAUUCAGAGCUUUG | 23 | 1465 |
| CFTR-3272-185 | + | GCAGUAUGUAAAUUCAGAGCUUUG | 24 | 1466 |
| CFTR-3272-186 | + | UACUUGGCUACCAGAGAU | 18 | 1467 |
| CFTR-3272-187 | + | UUACUUGGCUACCAGAGAU | 19 | 1468 |
| CFTR-3272-37 | + | UUUACUUGGCUACCAGAGAU | 20 | 1318 |
| CFTR-3272-188 | + | UUUUACUUGGCUACCAGAGAU | 21 | 1469 |
| CFTR-3272-189 | + | UUUUUACUUGGCUACCAGAGAU | 22 | 1470 |
| CFTR-3272-190 | + | UUUUUUACUUGGCUACCAGAGAU | 23 | 1471 |
| CFTR-3272-191 | + | UUUUUUUACUUGGCUACCAGAGAU | 24 | 1472 |
| CFTR-3272-192 | + | AAAAUUGGACUCCUGCCU | 18 | 1473 |
| CFTR-3272-193 | + | GAAAAUUGGACUCCUGCCU | 19 | 1474 |
| CFTR-3272-194 | + | UGAAAAUUGGACUCCUGCCU | 20 | 1475 |
| CFTR-3272-195 | + | GUGAAAAUUGGACUCCUGCCU | 21 | 1476 |
| CFTR-3272-196 | + | AGUGAAAAUUGGACUCCUGCCU | 22 | 1477 |

TABLE 8E-continued

5th Tier

| gRNA Name | DNA Strand | Targeting Domain | Target Site Length | Seq ID |
|---|---|---|---|---|
| CFTR-3272-197 | + | GAGUGAAAAUUGGACUCCUGCCU | 23 | 1478 |
| CFTR-3272-198 | + | UGAGUGAAAAUUGGACUCCUGCCU | 24 | 1479 |
| CFTR-3272-199 | + | UCAAAGUAAGGCUGCCGU | 18 | 1480 |
| CFTR-3272-200 | + | UUCAAAGUAAGGCUGCCGU | 19 | 1481 |
| CFTR-3272-201 | + | UUUCAAAGUAAGGCUGCCGU | 20 | 1482 |
| CFTR-3272-202 | + | GUUUCAAAGUAAGGCUGCCGU | 21 | 1483 |
| CFTR-3272-203 | + | AGUUUCAAAGUAAGGCUGCCGU | 22 | 1484 |
| CFTR-3272-204 | + | GAGUUUCAAAGUAAGGCUGCCGU | 23 | 1485 |
| CFTR-3272-205 | + | AGAGUUUCAAAGUAAGGCUGCCGU | 24 | 1486 |
| CFTR-3272-206 | + | GUUGGCAGUAUGUAAAUU | 18 | 1487 |
| CFTR-3272-207 | + | AGUUGGCAGUAUGUAAAUU | 19 | 1488 |
| CFTR-3272-208 | + | CAGUUGGCAGUAUGUAAAUU | 20 | 1489 |
| CFTR-3272-209 | + | CCAGUUGGCAGUAUGUAAAUU | 21 | 1490 |
| CFTR-3272-210 | + | ACCAGUUGGCAGUAUGUAAAUU | 22 | 1491 |
| CFTR-3272-211 | + | AACCAGUUGGCAGUAUGUAAAUU | 23 | 1492 |
| CFTR-3272-212 | + | GAACCAGUUGGCAGUAUGUAAAUU | 24 | 1493 |
| CFTR-3272-213 | + | AUGUAAAUUCAGAGCUUU | 18 | 1494 |
| CFTR-3272-214 | + | UAUGUAAAUUCAGAGCUUU | 19 | 1495 |
| CFTR-3272-215 | + | GUAUGUAAAUUCAGAGCUUU | 20 | 1496 |
| CFTR-3272-216 | + | AGUAUGUAAAUUCAGAGCUUU | 21 | 1497 |
| CFTR-3272-217 | + | CAGUAUGUAAAUUCAGAGCUUU | 22 | 1498 |
| CFTR-3272-218 | + | GCAGUAUGUAAAUUCAGAGCUUU | 23 | 1499 |
| CFTR-3272-219 | + | GGCAGUAUGUAAAUUCAGAGCUUU | 24 | 1500 |
| CFTR-3272-220 | − | CUGGUAGCCAAGUAAAAA | 18 | 1501 |
| CFTR-3272-221 | − | UCUGGUAGCCAAGUAAAAA | 19 | 1502 |
| CFTR-3272-222 | − | CUCUGGUAGCCAAGUAAAAA | 20 | 1503 |
| CFTR-3272-223 | − | UCUCUGGUAGCCAAGUAAAAA | 21 | 1504 |
| CFTR-3272-224 | − | AUCUCUGGUAGCCAAGUAAAAA | 22 | 1505 |
| CFTR-3272-225 | − | CAUCUCUGGUAGCCAAGUAAAAA | 23 | 1506 |
| CFTR-3272-226 | − | CCAUCUCUGGUAGCCAAGUAAAAA | 24 | 1507 |
| CFTR-3272-227 | − | ACACUGCGCUGGUUCCAA | 18 | 1508 |
| CFTR-3272-228 | − | AACACUGCGCUGGUUCCAA | 19 | 1509 |
| CFTR-3272-229 | − | CAACACUGCGCUGGUUCCAA | 20 | 1510 |
| CFTR-3272-230 | − | UCAACACUGCGCUGGUUCCAA | 21 | 1511 |
| CFTR-3272-231 | − | GUCAACACUGCGCUGGUUCCAA | 22 | 1512 |
| CFTR-3272-232 | − | UGUCAACACUGCGCUGGUUCCAA | 23 | 1513 |
| CFTR-3272-233 | − | CUGUCAACACUGCGCUGGUUCCAA | 24 | 1514 |
| CFTR-3272-234 | − | GCUGGUUCCAAAUGAGAA | 18 | 1515 |

TABLE 8E-continued

| | | 5th Tier | | |
|---|---|---|---|---|
| gRNA Name | DNA Strand | Targeting Domain | Target Site Length | Seq ID |
| CFTR-3272-235 | - | CGCUGGUUCCAAAUGAGAA | 19 | 1516 |
| CFTR-3272-236 | - | GCGCUGGUUCCAAAUGAGAA | 20 | 1517 |
| CFTR-3272-237 | - | UGCGCUGGUUCCAAAUGAGAA | 21 | 1518 |
| CFTR-3272-238 | - | CUGCGCUGGUUCCAAAUGAGAA | 22 | 1519 |
| CFTR-3272-239 | - | ACUGCGCUGGUUCCAAAUGAGAA | 23 | 1520 |
| CFTR-3272-240 | - | CACUGCGCUGGUUCCAAAUGAGAA | 24 | 1521 |
| CFTR-3272-241 | - | AUCUUGUUACAAGCUUAA | 18 | 1522 |
| CFTR-3272-242 | - | CAUCUUGUUACAAGCUUAA | 19 | 1523 |
| CFTR-3272-243 | - | UCAUCUUGUUACAAGCUUAA | 20 | 1524 |
| CFTR-3272-244 | - | CUCAUCUUGUUACAAGCUUAA | 21 | 1525 |
| CFTR-3272-245 | - | ACUCAUCUUGUUACAAGCUUAA | 22 | 1526 |
| CFTR-3272-246 | - | CACUCAUCUUGUUACAAGCUUAA | 23 | 1527 |
| CFTR-3272-247 | - | UCACUCAUCUUGUUACAAGCUUAA | 24 | 1528 |
| CFTR-3272-248 | - | UAUUUGCAGUGUUUUCUA | 18 | 1529 |
| CFTR-3272-249 | - | UUAUUUGCAGUGUUUUCUA | 19 | 1530 |
| CFTR-3272-42 | - | GUUAUUUGCAGUGUUUUCUA | 20 | 1323 |
| CFTR-3272-250 | - | UGUUAUUUGCAGUGUUUUCUA | 21 | 1531 |
| CFTR-3272-251 | - | AUGUUAUUUGCAGUGUUUUCUA | 22 | 1532 |
| CFTR-3272-252 | - | UAUGUUAUUUGCAGUGUUUUCUA | 23 | 1533 |
| CFTR-3272-253 | - | UUAUGUUAUUUGCAGUGUUUUCUA | 24 | 1534 |
| CFTR-3272-254 | - | AUGGAAAUAUUUCACAGG | 18 | 1535 |
| CFTR-3272-255 | - | UAUGGAAAUAUUUCACAGG | 19 | 1536 |
| CFTR-3272-256 | - | CUAUGGAAAUAUUUCACAGG | 20 | 1537 |
| CFTR-3272-257 | - | UCUAUGGAAAUAUUUCACAGG | 21 | 1538 |
| CFTR-3272-258 | - | UUCUAUGGAAAUAUUUCACAGG | 22 | 1539 |
| CFTR-3272-259 | - | UUUCUAUGGAAAUAUUUCACAGG | 23 | 1540 |
| CFTR-3272-260 | - | UUUUCUAUGGAAAUAUUUCACAGG | 24 | 1541 |
| CFTR-3272-261 | - | UACAAGCUUAAAAGGACU | 18 | 1542 |
| CFTR-3272-262 | - | UUACAAGCUUAAAAGGACU | 19 | 1543 |
| CFTR-3272-263 | - | GUUACAAGCUUAAAAGGACU | 20 | 1544 |
| CFTR-3272-264 | - | UGUUACAAGCUUAAAAGGACU | 21 | 1545 |
| CFTR-3272-265 | - | UUGUUACAAGCUUAAAAGGACU | 22 | 1546 |
| CFTR-3272-266 | - | CUUGUUACAAGCUUAAAAGGACU | 23 | 1547 |
| CFTR-3272-267 | - | UCUUGUUACAAGCUUAAAAGGACU | 24 | 1548 |
| CFTR-3272-268 | - | UCGGACGGCAGCCUUACU | 18 | 1549 |
| CFTR-3272-269 | - | UUCGGACGGCAGCCUUACU | 19 | 1550 |
| CFTR-3272-270 | - | CUUCGGACGGCAGCCUUACU | 20 | 1551 |

TABLE 8E-continued

5th Tier

| gRNA Name | DNA Strand | Targeting Domain | Target Site Length | Seq ID |
|---|---|---|---|---|
| CFTR-3272-271 | - | CCUUCGGACGGCAGCCUUACU | 21 | 1552 |
| CFTR-3272-272 | - | GCCUUCGGACGGCAGCCUUACU | 22 | 1553 |
| CFTR-3272-273 | - | UGCCUUCGGACGGCAGCCUUACU | 23 | 1554 |
| CFTR-3272-274 | - | GUGCCUUCGGACGGCAGCCUUACU | 24 | 1555 |
| CFTR-3272-275 | - | UAUGGACACUUCGUGCCU | 18 | 1556 |
| CFTR-3272-276 | - | CUAUGGACACUUCGUGCCU | 19 | 1557 |
| CFTR-3272-277 | - | ACUAUGGACACUUCGUGCCU | 20 | 1558 |
| CFTR-3272-278 | - | GACUAUGGACACUUCGUGCCU | 21 | 1559 |
| CFTR-3272-279 | - | GGACUAUGGACACUUCGUGCCU | 22 | 1560 |
| CFTR-3272-280 | - | AGGACUAUGGACACUUCGUGCCU | 23 | 1561 |
| CFTR-3272-281 | - | AAGGACUAUGGACACUUCGUGCCU | 24 | 1562 |
| CFTR-3272-282 | - | UUAUUUGCAGUGUUUUCU | 18 | 1563 |
| CFTR-3272-283 | - | GUUAUUUGCAGUGUUUUCU | 19 | 1564 |
| CFTR-3272-284 | - | UGUUAUUUGCAGUGUUUUCU | 20 | 1565 |
| CFTR-3272-285 | - | AUGUUAUUUGCAGUGUUUUCU | 21 | 1566 |
| CFTR-3272-286 | - | UAUGUUAUUUGCAGUGUUUUCU | 22 | 1567 |
| CFTR-3272-287 | - | UUAUGUUAUUUGCAGUGUUUUCU | 23 | 1568 |
| CFTR-3272-288 | - | UUUAUGUUAUUUGCAGUGUUUUCU | 24 | 1569 |
| CFTR-3272-289 | - | UCAAAGAAUGGCACCAGU | 18 | 1570 |
| CFTR-3272-290 | - | UUCAAAGAAUGGCACCAGU | 19 | 1571 |
| CFTR-3272-291 | - | AUUCAAAGAAUGGCACCAGU | 20 | 1572 |
| CFTR-3272-292 | - | UAUUCAAAGAAUGGCACCAGU | 21 | 1573 |
| CFTR-3272-293 | - | CUAUUCAAAGAAUGGCACCAGU | 22 | 1574 |
| CFTR-3272-294 | - | UCUAUUCAAAGAAUGGCACCAGU | 23 | 1575 |
| CFTR-3272-295 | - | AUCUAUUCAAAGAAUGGCACCAGU | 24 | 1576 |
| CFTR-3272-296 | - | UUUCAGGUACAAGAUAUU | 18 | 1577 |
| CFTR-3272-297 | - | UUUUCAGGUACAAGAUAUU | 19 | 1578 |
| CFTR-3272-298 | - | UUUUUCAGGUACAAGAUAUU | 20 | 1579 |
| CFTR-3272-299 | - | CUUUUUCAGGUACAAGAUAUU | 21 | 1580 |
| CFTR-3272-300 | - | UCUUUUUCAGGUACAAGAUAUU | 22 | 1581 |
| CFTR-3272-301 | - | GUCUUUUUCAGGUACAAGAUAUU | 23 | 1582 |
| CFTR-3272-302 | - | AGUCUUUUUCAGGUACAAGAUAUU | 24 | 1583 |

Table 9A provides exemplary targeting domains for correcting a mutation (e.g., 3272-26A→G) in the CFTR gene selected according to the second tier parameters. The targeting domains bind within 200 bp from a mutation (e.g., 3272-26A→G) and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 9A

2nd Tier

| gRNA Name | DNA Strand | Targeting Domain | Target Site Length | Seq ID |
|---|---|---|---|---|
| CFTR-3272-303 | − | AUGGCACCAGUGUGAAA | 17 | 1584 |
| CFTR-3272-304 | + | UGCCAUUCUUUGAAUAG | 17 | 1585 |
| CFTR-3272-305 | + | UUGGCAGUAUGUAAAUU | 17 | 1586 |
| CFTR-3272-306 | + | AAGUGUCCAUAGUCCUU | 17 | 1587 |
| CFTR-3272-307 | − | AGAAUGGCACCAGUGUGAAA | 20 | 1588 |
| CFTR-3272-308 | + | UGGUGCCAUUCUUUGAAUAG | 20 | 1589 |
| CFTR-3272-309 | + | ACGAAGUGUCCAUAGUCCUU | 20 | 1590 |

TABLE 9B

4th Tier

| gRNA Name | DNA Strand | Targeting Domain | Target Site Length | Seq ID |
|---|---|---|---|---|
| CFTR-3272-310 | + | ACAAAUGUCAUUGGUUA | 17 | 1591 |
| CFTR-3272-311 | − | AACCAAUGACAUUUGUG | 17 | 1592 |
| CFTR-3272-312 | − | UUUUCACUCAUCUUGUU | 17 | 1593 |
| CFTR-3272-313 | + | AUCACAAAUGUCAUUGGUUA | 20 | 1594 |
| CFTR-3272-314 | − | UUUAACCAAUGACAUUUGUG | 20 | 1595 |
| CFTR-3272-208 | + | CAGUUGGCAGUAUGUAAAUU | 20 | 1489 |
| CFTR-3272-315 | − | CAAUUUUCACUCAUCUUGUU | 20 | 1596 |

Table 9B provides exemplary targeting domains for correcting a mutation (e.g., 3272-26A→G) in the CFTR gene selected according to the fourth tier parameters. The targeting domains bind within 200 bp from a mutation (e.g., 3272-26A→G). It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

Table 10A provides exemplary targeting domains for correcting a mutation (e.g., deltaF508) in the CFTR gene selected according to the first tier parameters. The targeting domains bind within 200 bp from a mutation (e.g., deltaF508), have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 10A

1st Tier

| gRNA Name | DNA Strand | Targeting Domain | Target Site Length | Seq ID |
|---|---|---|---|---|
| CFTR-DeltaF508-1 | − | GGGUAAGCUACUGUGAA | 17 | 402 |
| CFTR-DeltaF508-2 | − | GAACUGGAGCCUUCAGA | 17 | 401 |
| CFTR-DeltaF508-3 | + | GACUAACCGAUUGAAUA | 17 | 403 |
| CFTR-DeltaF508-4 | − | GGUGAUUAUGGGAGAAC | 17 | 400 |
| CFTR-DeltaF508-5 | + | GGUGCCAGGCAUAAUCC | 17 | 394 |
| CFTR-DeltaF508-6 | − | GGUAAAAUUAAGCACAG | 17 | 390 |
| CFTR-DeltaF508-7 | + | GUAUCUAUAUUCAUCAU | 17 | 392 |
| CFTR-DeltaF508-8 | + | GAGCCAAAUAUAUAAUU | 17 | 404 |
| CFTR-DeltaF508-9 | − | GGAGAACUGGAGCCUUCAGA | 20 | 397 |
| CFTR-DeltaF508-10 | + | GUAGACUAACCGAUUGAAUA | 20 | 398 |
| CFTR-DeltaF508-11 | + | GUCAUUAUCAAAUCACGCUC | 20 | 399 |
| CFTR-DeltaF508-12 | − | GAGGGUAAAAUUAAGCACAG | 20 | 387 |
| CFTR-DeltaF508-13 | − | GGGAGAACUGGAGCCUUCAG | 20 | 396 |
| CFTR-DeltaF508-14 | − | GAUAAUGACCUAAUAAUGAU | 20 | 395 |

Table 10B provides exemplary targeting domains for correcting a mutation (e.g., deltaF508) in the CFTR gene selected according to the second tier parameters. The targeting domains bind within 200 bp from a mutation (e.g., deltaF508) and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 10B

2nd Tier

| gRNA Name | DNA Strand | Targeting Domain | Target Site Length | Seq ID |
|---|---|---|---|---|
| CFTR-DeltaF508-15 | + | AAUUUGGGUAGUGUGAA | 17 | 449 |
| CFTR-DeltaF508-16 | − | CCAGACUUCACUUCUAA | 17 | 438 |
| CFTR-DeltaF508-17 | − | UAAUGACCUAAUAAUGA | 17 | 436 |
| CFTR-DeltaF508-18 | + | UUAAUUUUACCCUCUGA | 17 | 418 |
| CFTR-DeltaF508-19 | + | UAAUUUGGGUAGUGUGA | 17 | 448 |
| CFTR-DeltaF508-20 | − | UUUUCCUGGAUUAUGCC | 17 | 414 |
| CFTR-DeltaF508-21 | + | UUUUCUUUAAUGGUGCC | 17 | 417 |
| CFTR-DeltaF508-22 | − | UCUGUUCUCAGUUUUCC | 17 | 413 |
| CFTR-DeltaF508-23 | + | AUUAUCAAAUCACGCUC | 17 | 452 |
| CFTR-DeltaF508-24 | + | CCAUUAGAAGUGAAGUC | 17 | 450 |
| CFTR-DeltaF508-25 | − | AGCAUGCCAACUAGAAG | 17 | 391 |
| CFTR-DeltaF508-26 | − | AGAACUGGAGCCUUCAG | 17 | 441 |
| CFTR-DeltaF508-27 | + | CAGUAGCUUACCCAUAG | 17 | 446 |
| CFTR-DeltaF508-28 | − | UUGGCUCCAUAUUCAAU | 17 | 443 |
| CFTR-DeltaF508-29 | − | CUUCUAAUGGUGAUUAU | 17 | 440 |
| CFTR-DeltaF508-30 | + | UUCUUACCUCUUCUAGU | 17 | 416 |
| CFTR-DeltaF508-31 | − | UACCCAAAUUAUAUAUU | 17 | 442 |
| CFTR-DeltaF508-32 | − | UAUGGGUAAGCUACUGUGAA | 20 | 428 |
| CFTR-DeltaF508-33 | + | UAUAAUUUGGGUAGUGUGAA | 20 | 433 |
| CFTR-DeltaF508-34 | − | UUUCCAGACUUCACUUCUAA | 20 | 420 |
| CFTR-DeltaF508-35 | + | ACCAAUGAUAUUUCUUUAA | 20 | 1597 |
| CFTR-DeltaF508-36 | − | UGAUAAUGACCUAAUAAUGA | 20 | 419 |
| CFTR-DeltaF508-37 | + | UGCUUAAUUUUACCCUCUGA | 20 | 412 |
| CFTR-DeltaF508-38 | + | AUAUAAUUUGGGUAGUGUGA | 20 | 432 |
| CFTR-DeltaF508-39 | − | UUCACUUCUAAUGGUGAUUA | 20 | 421 |
| CFTR-DeltaF508-40 | − | AAUGGUGAUUAUGGGAGAAC | 20 | 423 |
| CFTR-DeltaF508-41 | − | CAGUUUUCCUGGAUUAUGCC | 20 | 406 |
| CFTR-DeltaF508-42 | + | AUAUUUUCUUUAAUGGUGCC | 20 | 411 |
| CFTR-DeltaF508-43 | + | AAUGGUGCCAGGCAUAAUCC | 20 | 389 |
| CFTR-DeltaF508-44 | − | CAUUCUGUUCUCAGUUUUCC | 20 | 405 |
| CFTR-DeltaF508-45 | + | UCACCAUUAGAAGUGAAGUC | 20 | 434 |
| CFTR-DeltaF508-46 | − | CAAAGCAUGCCAACUAGAAG | 20 | 408 |
| CFTR-DeltaF508-47 | + | UCACAGUAGCUUACCCAUAG | 20 | 429 |
| CFTR-DeltaF508-48 | − | UAUUUGGCUCCAUAUUCAAU | 20 | 425 |

TABLE 10B-continued

2nd Tier

| gRNA Name | DNA Strand | Targeting Domain | Target Site Length | Seq ID |
|---|---|---|---|---|
| CFTR-DeltaF508-49 | + | UCUGUAUCUAUAUUCAUCAU | 20 | 409 |
| CFTR-DeltaF508-50 | - | ACCAUUAAAGAAAAUAUCAU | 20 | 1598 |
| CFTR-DeltaF508-51 | - | UCACUUCUAAUGGUGAUUAU | 20 | 422 |
| CFTR-DeltaF508-52 | + | AGUUUCUUACCUCUUCUAGU | 20 | 388 |
| CFTR-DeltaF508-53 | + | AUGGAGCCAAAUAUAUAAUU | 20 | 430 |
| CFTR-DeltaF508-54 | - | CACUACCCAAAUUAUAUAUU | 20 | 424 |

Table 10C provides exemplary targeting domains for correcting a mutation (e.g., deltaF508) in the CFTR gene selected according to the fourth tier parameters. The targeting domains bind within 200 bp from a mutation (e.g., deltaF508). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 10C

4th Tier

| gRNA Name | DNA Strand | Targeting Domain | Target Site Length | Seq ID |
|---|---|---|---|---|
| CFTR-DeltaF508-55 | + | AAUGAUAUUUCUUUAA | 17 | 1599 |
| CFTR-DeltaF508-56 | - | UAUUUAUGUUUCCUCUA | 17 | 444 |
| CFTR-DeltaF508-57 | - | ACUUCUAAUGGUGAUUA | 17 | 439 |
| CFTR-DeltaF508-58 | - | AUUAAAGAAAAUAUCAU | 17 | 1600 |
| CFTR-DeltaF508-59 | - | AAUGACCUAAUAAUGAU | 17 | 437 |
| CFTR-DeltaF508-60 | - | AUUUAUGUUUCCUCUAU | 17 | 445 |
| CFTR-DeltaF508-61 | + | UAAAACCCAUCAUUAUU | 17 | 451 |
| CFTR-DeltaF508-62 | + | AGCCAAAUAUAUAAUUU | 17 | 447 |
| CFTR-DeltaF508-63 | - | AUAUAUUUAUGUUUCCUCUA | 20 | 426 |
| CFTR-DeltaF508-64 | - | UAUAUUUAUGUUUCCUCUAU | 20 | 427 |
| CFTR-DeltaF508-65 | + | AAAUAAAACCCAUCAUUAUU | 20 | 435 |
| CFTR-DeltaF508-66 | + | UGGAGCCAAAUAUAUAAUUU | 20 | 431 |

Table 11A provides exemplary targeting domains for correcting a mutation (e.g., deltaF508) in the CFTR gene selected according to the first tier parameters. The targeting domains bind within 200 bp from a mutation (e.g., deltaF508), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 11A

1st Tier

| gRNA Name | DNA Strand | Targeting Domain | Target Site Length | Seq ID |
|---|---|---|---|---|
| CFTR-DeltaF508-67 | + | GAAUAUGGAGCCAAAUAUAUAAU | 23 | 1601 |
| CFTR-DeltaF508-68 | + | GUCAUUAUCAAAUCACGCU | 19 | 1602 |
| CFTR-DeltaF508-69 | + | GGUCAUUAUCAAAUCACGCU | 20 | 676 |
| CFTR-DeltaF508-70 | − | GGAGAACUGGAGCCUUCA | 18 | 1603 |
| CFTR-DeltaF508-71 | − | GGGAGAACUGGAGCCUUCA | 19 | 1604 |
| CFTR-DeltaF508-72 | − | GUAAAAUUAAGCACAGUGG | 19 | 1605 |
| CFTR-DeltaF508-73 | − | GGUAAAAUUAAGCACAGUGG | 20 | 663 |
| CFTR-DeltaF508-74 | − | GGGUAAAAUUAAGCACAGUGG | 21 | 1606 |
| CFTR-DeltaF508-75 | − | GAGGGUAAAAUUAAGCACAGUGG | 23 | 1607 |
| CFTR-DeltaF508-76 | − | GAUAAUGACCUAAUAAUG | 18 | 1608 |
| CFTR-DeltaF508-77 | − | GAUUUGAUAAUGACCUAAUAAUG | 23 | 1609 |
| CFTR-DeltaF508-78 | − | GUUUCCUCUAUGGGUAAGCUACU | 23 | 1610 |

Table 11B provides exemplary targeting domains for correcting a mutation (e.g., deltaF508) in the CFTR gene selected according to the second tier parameters. The targeting domains bind within 200 bp from a mutation (e.g., deltaF508), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 11B

2nd Tier

| gRNA Name | DNA Strand | Targeting Domain | Target Site Length | Seq ID |
|---|---|---|---|---|
| CFTR-DeltaF508-79 | + | AUCCAGGAAAACUGAGAA | 18 | 1611 |
| CFTR-DeltaF508-80 | + | AAUCCAGGAAAACUGAGAA | 19 | 1612 |
| CFTR-DeltaF508-81 | + | UAAUCCAGGAAAACUGAGAA | 20 | 682 |
| CFTR-DeltaF508-82 | + | UAUAUGUAGACUAACCGA | 18 | 1613 |
| CFTR-DeltaF508-83 | + | AUAUAUGUAGACUAACCGA | 19 | 1614 |
| CFTR-DeltaF508-84 | + | AAUAUAUGUAGACUAACCGA | 20 | 691 |
| CFTR-DeltaF508-85 | + | AAAUAUAUGUAGACUAACCGA | 21 | 1615 |
| CFTR-DeltaF508-86 | + | UAAAUAUAUGUAGACUAACCGA | 22 | 1616 |
| CFTR-DeltaF508-87 | + | AUAAAUAUAUGUAGACUAACCGA | 23 | 1617 |
| CFTR-DeltaF508-88 | + | CAUAAAUAUAUGUAGACUAACCGA | 24 | 1618 |
| CFTR-DeltaF508-89 | + | UAUAAUUUGGGUAGUGUG | 18 | 1619 |
| CFTR-DeltaF508-90 | + | AUAUAAUUUGGGUAGUGUG | 19 | 1620 |
| CFTR-DeltaF508-91 | + | UAUAUAAUUUGGGUAGUGUG | 20 | 687 |
| CFTR-DeltaF508-92 | + | AUAUAUAAUUUGGGUAGUGUG | 21 | 1621 |
| CFTR-DeltaF508-93 | + | AAUAUAUAAUUUGGGUAGUGUG | 22 | 1622 |
| CFTR-DeltaF508-94 | + | AAAUAUAUAAUUUGGGUAGUGUG | 23 | 1623 |

TABLE 11B-continued

| | | 2nd Tier | | |
|---|---|---|---|---|
| gRNA Name | DNA Strand | Targeting Domain | Target Site Length | Seq ID |
| CFTR-DeltaF508-95 | + | CAAAUAUAUAAUUUGGGUAGUGUG | 24 | 1624 |
| CFTR-DeltaF508-96 | + | UGGAGCCAAAUAUAUAAU | 18 | 1625 |
| CFTR-DeltaF508-97 | + | AUGGAGCCAAAUAUAUAAU | 19 | 1626 |
| CFTR-DeltaF508-98 | + | UAUGGAGCCAAAUAUAUAAU | 20 | 689 |
| CFTR-DeltaF508-99 | + | AUAUGGAGCCAAAUAUAUAAU | 21 | 1627 |
| CFTR-DeltaF508-100 | + | AAUAUGGAGCCAAAUAUAUAAU | 22 | 1628 |
| CFTR-DeltaF508-101 | + | UGAAUAUGGAGCCAAAUAUAUAAU | 24 | 1629 |
| CFTR-DeltaF508-102 | + | UCAUUAUCAAAUCACGCU | 18 | 1630 |
| CFTR-DeltaF508-103 | + | AGGUCAUUAUCAAAUCACGCU | 21 | 1631 |
| CFTR-DeltaF508-104 | + | UAGGUCAUUAUCAAAUCACGCU | 22 | 1632 |
| CFTR-DeltaF508-105 | + | UUAGGUCAUUAUCAAAUCACGCU | 23 | 1633 |
| CFTR-DeltaF508-106 | + | AUUAGGUCAUUAUCAAAUCACGCU | 24 | 1634 |
| CFTR-DeltaF508-107 | − | UGGGAGAACUGGAGCCUUCA | 20 | 661 |
| CFTR-DeltaF508-108 | − | AUGGGUAAGCUACUGUGA | 18 | 1635 |
| CFTR-DeltaF508-109 | − | UAUGGGUAAGCUACUGUGA | 19 | 1636 |
| CFTR-DeltaF508-110 | − | CUAUGGGUAAGCUACUGUGA | 20 | 675 |
| CFTR-DeltaF508-111 | − | UCUAUGGGUAAGCUACUGUGA | 21 | 1637 |
| CFTR-DeltaF508-112 | − | CUCUAUGGGUAAGCUACUGUGA | 22 | 1638 |
| CFTR-DeltaF508-113 | − | CCUCUAUGGGUAAGCUACUGUGA | 23 | 1639 |
| CFTR-DeltaF508-114 | − | UCCUCUAUGGGUAAGCUACUGUGA | 24 | 1640 |
| CFTR-DeltaF508-115 | − | AUUCUGUUCUCAGUUUUC | 18 | 1641 |
| CFTR-DeltaF508-116 | − | CAUUCUGUUCUCAGUUUUC | 19 | 1642 |
| CFTR-DeltaF508-117 | − | UCAUUCUGUUCUCAGUUUUC | 20 | 664 |
| CFTR-DeltaF508-118 | − | UUCAUUCUGUUCUCAGUUUUC | 21 | 1643 |
| CFTR-DeltaF508-119 | − | UUUCAUUCUGUUCUCAGUUUUC | 22 | 1644 |
| CFTR-DeltaF508-120 | − | AUUUCAUUCUGUUCUCAGUUUUC | 23 | 1645 |
| CFTR-DeltaF508-121 | − | AAUUUCAUUCUGUUCUCAGUUUUC | 24 | 1646 |
| CFTR-DeltaF508-122 | − | UAAAAUUAAGCACAGUGG | 18 | 1647 |
| CFTR-DeltaF508-123 | − | AGGGUAAAAUUAAGCACAGUGG | 22 | 1648 |
| CFTR-DeltaF508-124 | − | AGAGGGUAAAAUUAAGCACAGUGG | 24 | 1649 |
| CFTR-DeltaF508-125 | − | UGAUAAUGACCUAAUAAUG | 19 | 1650 |
| CFTR-DeltaF508-126 | − | UUGAUAAUGACCUAAUAAUG | 20 | 656 |
| CFTR-DeltaF508-127 | − | UUUGAUAAUGACCUAAUAAUG | 21 | 1651 |
| CFTR-DeltaF508-128 | − | AUUUGAUAAUGACCUAAUAAUG | 22 | 1652 |
| CFTR-DeltaF508-129 | − | UGAUUUGAUAAUGACCUAAUAAUG | 24 | 1653 |
| CFTR-DeltaF508-130 | − | UCAUGGUGUUUCCUAUG | 18 | 1654 |
| CFTR-DeltaF508-131 | − | AUCAUUGGUGUUUCCUAUG | 19 | 1655 |
| CFTR-DeltaF508-132 | − | UAUCAUUGGUGUUUCCUAUG | 20 | 1656 |

TABLE 11B-continued

2nd Tier

| gRNA Name | DNA Strand | Targeting Domain | Target Site Length | Seq ID |
|---|---|---|---|---|
| CFTR-DeltaF508-133 | - | AUAUCAUUGGUGUUUCCUAUG | 21 | 1657 |
| CFTR-DeltaF508-134 | - | AAUAUCAUUGGUGUUUCCUAUG | 22 | 1658 |
| CFTR-DeltaF508-135 | - | AAAUAUCAUUGGUGUUUCCUAUG | 23 | 1659 |
| CFTR-DeltaF508-136 | - | AAAAUAUCAUUGGUGUUUCCUAUG | 24 | 1660 |
| CFTR-DeltaF508-137 | - | CUCUAUGGGUAAGCUACU | 18 | 1661 |
| CFTR-DeltaF508-138 | - | CCUCUAUGGGUAAGCUACU | 19 | 1662 |
| CFTR-DeltaF508-139 | - | UCCUCUAUGGGUAAGCUACU | 20 | 674 |
| CFTR-DeltaF508-140 | - | UUCCUCUAUGGGUAAGCUACU | 21 | 1663 |
| CFTR-DeltaF508-141 | - | UUUCCUCUAUGGGUAAGCUACU | 22 | 1664 |
| CFTR-DeltaF508-142 | - | UGUUUCCUCUAUGGGUAAGCUACU | 24 | 1665 |
| CFTR-DeltaF508-143 | - | UAUAUUUAUGUUUCCUCU | 18 | 1666 |
| CFTR-DeltaF508-144 | - | AUAUAUUUAUGUUUCCUCU | 19 | 1667 |
| CFTR-DeltaF508-145 | - | CAUAUAUUUAUGUUUCCUCU | 20 | 673 |
| CFTR-DeltaF508-146 | - | ACAUAUAUUUAUGUUUCCUCU | 21 | 1668 |
| CFTR-DeltaF508-147 | - | UACAUAUAUUUAUGUUUCCUCU | 22 | 1669 |
| CFTR-DeltaF508-148 | - | CUACAUAUAUUUAUGUUUCCUCU | 23 | 1670 |
| CFTR-DeltaF508-149 | - | UCUACAUAUAUUUAUGUUUCCUCU | 24 | 1671 |

Table 11C provides exemplary targeting domains for correcting a mutation (e.g., deltaF508) in the CFTR gene selected according to the third tier parameters. The targeting domains bind within 200 bp from a mutation (e.g., deltaF508), start with a 5'G and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 11C

3rd Tier

| gRNA Name | DNA Strand | Targeting Domain | Target Site Length | Seq ID |
|---|---|---|---|---|
| CFTR-DeltaF508-150 | + | GCAUAAUCCAGGAAAACUGAGAA | 23 | 1672 |
| CFTR-DeltaF508-151 | + | GGCAUAAUCCAGGAAAACUGAGAA | 24 | 1673 |

Table 11D provides exemplary targeting domains for correcting a mutation (e.g., deltaF508) in the CFTR gene selected according to the fourth tier parameters. The targeting domains bind within 200 bp from a mutation (e.g., deltaF508), and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 11D

4th Tier

| gRNA Name | DNA Strand | Targeting Domain | Target Site Length | Seq ID |
|---|---|---|---|---|
| CFTR-DeltaF508-152 | + | AUAAUCCAGGAAAACUGAGAA | 21 | 1674 |
| CFTR-DeltaF508-153 | + | CAUAAUCCAGGAAAACUGAGAA | 22 | 1675 |
| CFTR-DeltaF508-154 | − | AUGGGAGAACUGGAGCCUUCA | 21 | 1676 |
| CFTR-DeltaF508-155 | − | UAUGGGAGAACUGGAGCCUUCA | 22 | 1677 |
| CFTR-DeltaF508-156 | − | UUAUGGGAGAACUGGAGCCUUCA | 23 | 1678 |
| CFTR-DeltaF508-157 | − | AUUAUGGGAGAACUGGAGCCUUCA | 24 | 1679 |

Table 11E provides exemplary targeting domains for correcting a mutation (e.g., deltaF508) in the CFTR gene selected according to the fifth tier parameters. The targeting domains bind within 200 bp from a mutation (e.g., deltaF508), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 11E

5th Tier

| gRNA Name | DNA Strand | Targeting Domain | Target Site Length | Seq ID |
|---|---|---|---|---|
| CFTR-DeltaF508-158 | + | AGGCAUAAUCCAGGAAAA | 18 | 1680 |
| CFTR-DeltaF508-159 | + | CAGGCAUAAUCCAGGAAAA | 19 | 1681 |
| CFTR-DeltaF508-160 | + | CCAGGCAUAAUCCAGGAAAA | 20 | 684 |
| CFTR-DeltaF508-161 | + | GCCAGGCAUAAUCCAGGAAAA | 21 | 1682 |
| CFTR-DeltaF508-162 | + | UGCCAGGCAUAAUCCAGGAAAA | 22 | 1683 |
| CFTR-DeltaF508-163 | + | GUGCCAGGCAUAAUCCAGGAAAA | 23 | 1684 |
| CFTR-DeltaF508-164 | + | GGUGCCAGGCAUAAUCCAGGAAAA | 24 | 1685 |
| CFTR-DeltaF508-165 | + | CCAUAAUCACCAUUAGAA | 18 | 1686 |
| CFTR-DeltaF508-166 | + | CCCAUAAUCACCAUUAGAA | 19 | 1687 |
| CFTR-DeltaF508-167 | + | UCCCAUAAUCACCAUUAGAA | 20 | 678 |
| CFTR-DeltaF508-168 | + | CUCCCAUAAUCACCAUUAGAA | 21 | 1688 |
| CFTR-DeltaF508-169 | + | UCUCCCAUAAUCACCAUUAGAA | 22 | 1689 |
| CFTR-DeltaF508-170 | + | UUCUCCCAUAAUCACCAUUAGAA | 23 | 1690 |
| CFTR-DeltaF508-171 | + | GUUCUCCCAUAAUCACCAUUAGAA | 24 | 1691 |
| CFTR-DeltaF508-172 | + | UUCACAGUAGCUUACCCA | 18 | 1692 |
| CFTR-DeltaF508-173 | + | AUUCACAGUAGCUUACCCA | 19 | 1693 |
| CFTR-DeltaF508-174 | + | CAUUCACAGUAGCUUACCCA | 20 | 693 |
| CFTR-DeltaF508-175 | + | CCAUUCACAGUAGCUUACCCA | 21 | 1694 |
| CFTR-DeltaF508-176 | + | UCCAUUCACAGUAGCUUACCCA | 22 | 1695 |
| CFTR-DeltaF508-177 | + | AUCCAUUCACAGUAGCUUACCCA | 23 | 1696 |
| CFTR-DeltaF508-178 | + | GAUCCAUUCACAGUAGCUUACCCA | 24 | 1697 |
| CFTR-DeltaF508-179 | + | CUGUAUCUAUAUUCAUCA | 18 | 1698 |
| CFTR-DeltaF508-180 | + | UCUGUAUCUAUAUUCAUCA | 19 | 1699 |

TABLE 11E-continued

5th Tier

| gRNA Name | DNA Strand | Targeting Domain | Target Site Length | Seq ID |
|---|---|---|---|---|
| CFTR-DeltaF508-181 | + | UUCUGUAUCUAUAUUCAUCA | 20 | 686 |
| CFTR-DeltaF508-182 | + | CUUCUGUAUCUAUAUUCAUCA | 21 | 1700 |
| CFTR-DeltaF508-183 | + | GCUUCUGUAUCUAUAUUCAUCA | 22 | 1701 |
| CFTR-DeltaF508-184 | + | CGCUUCUGUAUCUAUAUUCAUCA | 23 | 1702 |
| CFTR-DeltaF508-185 | + | ACGCUUCUGUAUCUAUAUUCAUCA | 24 | 1703 |
| CFTR-DeltaF508-186 | + | AGGAAAACUGAGAACAGA | 18 | 1704 |
| CFTR-DeltaF508-187 | + | CAGGAAAACUGAGAACAGA | 19 | 1705 |
| CFTR-DeltaF508-188 | + | CCAGGAAAACUGAGAACAGA | 20 | 681 |
| CFTR-DeltaF508-189 | + | UCCAGGAAAACUGAGAACAGA | 21 | 1706 |
| CFTR-DeltaF508-190 | + | AUCCAGGAAAACUGAGAACAGA | 22 | 1707 |
| CFTR-DeltaF508-191 | + | AAUCCAGGAAAACUGAGAACAGA | 23 | 1708 |
| CFTR-DeltaF508-192 | + | UAAUCCAGGAAAACUGAGAACAGA | 24 | 1709 |
| CFTR-DeltaF508-193 | + | AGACUAACCGAUUGAAUA | 18 | 1710 |
| CFTR-DeltaF508-194 | + | UAGACUAACCGAUUGAAUA | 19 | 1711 |
| CFTR-DeltaF508-10 | + | GUAGACUAACCGAUUGAAUA | 20 | 398 |
| CFTR-DeltaF508-195 | + | UGUAGACUAACCGAUUGAAUA | 21 | 1712 |
| CFTR-DeltaF508-196 | + | AUGUAGACUAACCGAUUGAAUA | 22 | 1713 |
| CFTR-DeltaF508-197 | + | UAUGUAGACUAACCGAUUGAAUA | 23 | 1714 |
| CFTR-DeltaF508-198 | + | AUAUGUAGACUAACCGAUUGAAUA | 24 | 1715 |
| CFTR-DeltaF508-199 | + | CACAGUAGCUUACCCAUA | 18 | 1716 |
| CFTR-DeltaF508-200 | + | UCACAGUAGCUUACCCAUA | 19 | 1717 |
| CFTR-DeltaF508-201 | + | UUCACAGUAGCUUACCCAUA | 20 | 692 |
| CFTR-DeltaF508-202 | + | AUUCACAGUAGCUUACCCAUA | 21 | 1718 |
| CFTR-DeltaF508-203 | + | CAUUCACAGUAGCUUACCCAUA | 22 | 1719 |
| CFTR-DeltaF508-204 | + | CCAUUCACAGUAGCUUACCCAUA | 23 | 1720 |
| CFTR-DeltaF508-205 | + | UCCAUUCACAGUAGCUUACCCAUA | 24 | 1721 |
| CFTR-DeltaF508-206 | + | UGGUGCCAGGCAUAAUCC | 18 | 1722 |
| CFTR-DeltaF508-207 | + | AUGGUGCCAGGCAUAAUCC | 19 | 1723 |
| CFTR-DeltaF508-43 | + | AAUGGUGCCAGGCAUAAUCC | 20 | 389 |
| CFTR-DeltaF508-208 | + | UAAUGGUGCCAGGCAUAAUCC | 21 | 1724 |
| CFTR-DeltaF508-209 | + | UUAAUGGUGCCAGGCAUAAUCC | 22 | 1725 |
| CFTR-DeltaF508-210 | + | UUUAAUGGUGCCAGGCAUAAUCC | 23 | 1726 |
| CFTR-DeltaF508-211 | + | CUUUAAUGGUGCCAGGCAUAAUCC | 24 | 1727 |
| CFTR-DeltaF508-212 | + | AUGGUGCCAGGCAUAAUC | 18 | 1728 |
| CFTR-DeltaF508-213 | + | AAUGGUGCCAGGCAUAAUC | 19 | 1729 |
| CFTR-DeltaF508-214 | + | UAAUGGUGCCAGGCAUAAUC | 20 | 685 |
| CFTR-DeltaF508-215 | + | UUAAUGGUGCCAGGCAUAAUC | 21 | 1730 |

TABLE 11E-continued

5th Tier

| gRNA Name | DNA Strand | Targeting Domain | Target Site Length | Seq ID |
|---|---|---|---|---|
| CFTR-DeltaF508-216 | + | UUUAAUGGUGCCAGGCAUAAUC | 22 | 1731 |
| CFTR-DeltaF508-217 | + | CUUUAAUGGUGCCAGGCAUAAUC | 23 | 1732 |
| CFTR-DeltaF508-218 | + | UCUUUAAUGGUGCCAGGCAUAAUC | 24 | 1733 |
| CFTR-DeltaF508-219 | + | ACCAUUAGAAGUGAAGUC | 18 | 1734 |
| CFTR-DeltaF508-220 | + | CACCAUUAGAAGUGAAGUC | 19 | 1735 |
| CFTR-DeltaF508-45 | + | UCACCAUUAGAAGUGAAGUC | 20 | 434 |
| CFTR-DeltaF508-221 | + | AUCACCAUUAGAAGUGAAGUC | 21 | 1736 |
| CFTR-DeltaF508-222 | + | AAUCACCAUUAGAAGUGAAGUC | 22 | 1737 |
| CFTR-DeltaF508-223 | + | UAAUCACCAUUAGAAGUGAAGUC | 23 | 1738 |
| CFTR-DeltaF508-224 | + | AUAAUCACCAUUAGAAGUGAAGUC | 24 | 1739 |
| CFTR-DeltaF508-225 | + | ACAGUAGCUUACCCAUAG | 18 | 1740 |
| CFTR-DeltaF508-226 | + | CACAGUAGCUUACCCAUAG | 19 | 1741 |
| CFTR-DeltaF508-47 | + | UCACAGUAGCUUACCCAUAG | 20 | 429 |
| CFTR-DeltaF508-227 | + | UUCACAGUAGCUUACCCAUAG | 21 | 1742 |
| CFTR-DeltaF508-228 | + | AUUCACAGUAGCUUACCCAUAG | 22 | 1743 |
| CFTR-DeltaF508-229 | + | CAUUCACAGUAGCUUACCCAUAG | 23 | 1744 |
| CFTR-DeltaF508-230 | + | CCAUUCACAGUAGCUUACCCAUAG | 24 | 1745 |
| CFTR-DeltaF508-231 | + | UAGACUAACCGAUUGAAU | 18 | 1746 |
| CFTR-DeltaF508-232 | + | GUAGACUAACCGAUUGAAU | 19 | 1747 |
| CFTR-DeltaF508-233 | + | UGUAGACUAACCGAUUGAAU | 20 | 690 |
| CFTR-DeltaF508-234 | + | AUGUAGACUAACCGAUUGAAU | 21 | 1748 |
| CFTR-DeltaF508-235 | + | UAUGUAGACUAACCGAUUGAAU | 22 | 1749 |
| CFTR-DeltaF508-236 | + | AUAUGUAGACUAACCGAUUGAAU | 23 | 1750 |
| CFTR-DeltaF508-237 | + | UAUAUGUAGACUAACCGAUUGAAU | 24 | 1751 |
| CFTR-DeltaF508-238 | + | UUCUCCCAUAAUCACCAU | 18 | 1752 |
| CFTR-DeltaF508-239 | + | GUUCUCCCAUAAUCACCAU | 19 | 1753 |
| CFTR-DeltaF508-240 | + | AGUUCUCCCAUAAUCACCAU | 20 | 679 |
| CFTR-DeltaF508-241 | + | CAGUUCUCCCAUAAUCACCAU | 21 | 1754 |
| CFTR-DeltaF508-242 | + | CCAGUUCUCCCAUAAUCACCAU | 22 | 1755 |
| CFTR-DeltaF508-243 | + | UCCAGUUCUCCCAUAAUCACCAU | 23 | 1756 |
| CFTR-DeltaF508-244 | + | CUCCAGUUCUCCCAUAAUCACCAU | 24 | 1757 |
| CFTR-DeltaF508-245 | + | UGUAUCUAUAUUCAUCAU | 18 | 1758 |
| CFTR-DeltaF508-246 | + | CUGUAUCUAUAUUCAUCAU | 19 | 1759 |
| CFTR-DeltaF508-49 | + | UCUGUAUCUAUAUUCAUCAU | 20 | 409 |
| CFTR-DeltaF508-247 | + | UUCUGUAUCUAUAUUCAUCAU | 21 | 1760 |
| CFTR-DeltaF508-248 | + | CUUCUGUAUCUAUAUUCAUCAU | 22 | 1761 |
| CFTR-DeltaF508-249 | + | GCUUCUGUAUCUAUAUUCAUCAU | 23 | 1762 |

TABLE 11E-continued

5th Tier

| gRNA Name | DNA Strand | Targeting Domain | Target Site Length | Seq ID |
|---|---|---|---|---|
| CFTR-DeltaF508-250 | + | CGCUUCUGUAUCUAUAUUCAUCAU | 24 | 1763 |
| CFTR-DeltaF508-251 | + | GCAUAAUCCAGGAAAACU | 18 | 1764 |
| CFTR-DeltaF508-252 | + | GGCAUAAUCCAGGAAAACU | 19 | 1765 |
| CFTR-DeltaF508-253 | + | AGGCAUAAUCCAGGAAAACU | 20 | 683 |
| CFTR-DeltaF508-254 | + | CAGGCAUAAUCCAGGAAAACU | 21 | 1766 |
| CFTR-DeltaF508-255 | + | CCAGGCAUAAUCCAGGAAAACU | 22 | 1767 |
| CFTR-DeltaF508-256 | + | GCCAGGCAUAAUCCAGGAAAACU | 23 | 1768 |
| CFTR-DeltaF508-257 | + | UGCCAGGCAUAAUCCAGGAAAACU | 24 | 1769 |
| CFTR-DeltaF508-258 | + | UGUGCUUAAUUUUACCCU | 18 | 1770 |
| CFTR-DeltaF508-259 | + | CUGUGCUUAAUUUUACCCU | 19 | 1771 |
| CFTR-DeltaF508-260 | + | ACUGUGCUUAAUUUUACCCU | 20 | 680 |
| CFTR-DeltaF508-261 | + | CACUGUGCUUAAUUUUACCCU | 21 | 1772 |
| CFTR-DeltaF508-262 | + | CCACUGUGCUUAAUUUUACCCU | 22 | 1773 |
| CFTR-DeltaF508-263 | + | UCCACUGUGCUUAAUUUUACCCU | 23 | 1774 |
| CFTR-DeltaF508-264 | + | UUCCACUGUGCUUAAUUUUACCCU | 24 | 1775 |
| CFTR-DeltaF508-265 | + | CACCAUUAGAAGUGAAGU | 18 | 1776 |
| CFTR-DeltaF508-266 | + | UCACCAUUAGAAGUGAAGU | 19 | 1777 |
| CFTR-DeltaF508-267 | + | AUCACCAUUAGAAGUGAAGU | 20 | 677 |
| CFTR-DeltaF508-268 | + | AAUCACCAUUAGAAGUGAAGU | 21 | 1778 |
| CFTR-DeltaF508-269 | + | UAAUCACCAUUAGAAGUGAAGU | 22 | 1779 |
| CFTR-DeltaF508-270 | + | AUAAUCACCAUUAGAAGUGAAGU | 23 | 1780 |
| CFTR-DeltaF508-271 | + | CAUAAUCACCAUUAGAAGUGAAGU | 24 | 1781 |
| CFTR-DeltaF508-272 | + | AUAUAUAAUUUGGGUAGU | 18 | 1782 |
| CFTR-DeltaF508-273 | + | AAUAUAUAAUUUGGGUAGU | 19 | 1783 |
| CFTR-DeltaF508-274 | + | AAAUAUAUAAUUUGGGUAGU | 20 | 688 |
| CFTR-DeltaF508-275 | + | CAAAUAUAUAAUUUGGGUAGU | 21 | 1784 |
| CFTR-DeltaF508-276 | + | CCAAAUAUAUAAUUUGGGUAGU | 22 | 1785 |
| CFTR-DeltaF508-277 | + | GCCAAAUAUAUAAUUUGGGUAGU | 23 | 1786 |
| CFTR-DeltaF508-278 | + | AGCCAAAUAUAUAAUUUGGGUAGU | 24 | 1787 |
| CFTR-DeltaF508-279 | − | AUGGUGAUUAUGGGAGAA | 18 | 1788 |
| CFTR-DeltaF508-280 | − | AAUGGUGAUUAUGGGAGAA | 19 | 1789 |
| CFTR-DeltaF508-281 | − | UAAUGGUGAUUAUGGGAGAA | 20 | 659 |
| CFTR-DeltaF508-282 | − | CUAAUGGUGAUUAUGGGAGAA | 21 | 1790 |
| CFTR-DeltaF508-283 | − | UCUAAUGGUGAUUAUGGGAGAA | 22 | 1791 |
| CFTR-DeltaF508-284 | − | UUCUAAUGGUGAUUAUGGGAGAA | 23 | 1792 |
| CFTR-DeltaF508-285 | − | CUUCUAAUGGUGAUUAUGGGAGAA | 24 | 1793 |
| CFTR-DeltaF508-286 | − | AGGGUAAAAUUAAGCACA | 18 | 1794 |

TABLE 11E-continued

5th Tier

| gRNA Name | DNA Strand | Targeting Domain | Target Site Length | Seq ID |
|---|---|---|---|---|
| CFTR-DeltaF508-287 | - | GAGGGUAAAAUUAAGCACA | 19 | 1795 |
| CFTR-DeltaF508-288 | - | AGAGGGUAAAAUUAAGCACA | 20 | 662 |
| CFTR-DeltaF508-289 | - | CAGAGGGUAAAAUUAAGCACA | 21 | 1796 |
| CFTR-DeltaF508-290 | - | UCAGAGGGUAAAAUUAAGCACA | 22 | 1797 |
| CFTR-DeltaF508-291 | - | UUCAGAGGGUAAAAUUAAGCACA | 23 | 1798 |
| CFTR-DeltaF508-292 | - | CUUCAGAGGGUAAAAUUAAGCACA | 24 | 1799 |
| CFTR-DeltaF508-293 | - | CUAUGAUGAAUAUAGAUA | 18 | 1800 |
| CFTR-DeltaF508-294 | - | CCUAUGAUGAAUAUAGAUA | 19 | 1801 |
| CFTR-DeltaF508-295 | - | UCCUAUGAUGAAUAUAGAUA | 20 | 667 |
| CFTR-DeltaF508-296 | - | UUCCUAUGAUGAAUAUAGAUA | 21 | 1802 |
| CFTR-DeltaF508-297 | - | UUUCCUAUGAUGAAUAUAGAUA | 22 | 1803 |
| CFTR-DeltaF508-298 | - | GUUUCCUAUGAUGAAUAUAGAUA | 23 | 1804 |
| CFTR-DeltaF508-299 | - | UGUUUCCUAUGAUGAAUAUAGAUA | 24 | 1805 |
| CFTR-DeltaF508-300 | - | UUAUGCCUGGCACCAUUA | 18 | 1806 |
| CFTR-DeltaF508-301 | - | AUUAUGCCUGGCACCAUUA | 19 | 1807 |
| CFTR-DeltaF508-302 | - | GAUUAUGCCUGGCACCAUUA | 20 | 665 |
| CFTR-DeltaF508-303 | - | GGAUUAUGCCUGGCACCAUUA | 21 | 1808 |
| CFTR-DeltaF508-304 | - | UGGAUUAUGCCUGGCACCAUUA | 22 | 1809 |
| CFTR-DeltaF508-305 | - | CUGGAUUAUGCCUGGCACCAUUA | 23 | 1810 |
| CFTR-DeltaF508-306 | - | CCUGGAUUAUGCCUGGCACCAUUA | 24 | 1811 |
| CFTR-DeltaF508-307 | - | CACUUCUAAUGGUGAUUA | 18 | 1812 |
| CFTR-DeltaF508-308 | - | UCACUUCUAAUGGUGAUUA | 19 | 1813 |
| CFTR-DeltaF508-39 | - | UUCACUUCUAAUGGUGAUUA | 20 | 421 |
| CFTR-DeltaF508-309 | - | CUUCACUUCUAAUGGUGAUUA | 21 | 1814 |
| CFTR-DeltaF508-310 | - | ACUUCACUUCUAAUGGUGAUUA | 22 | 1815 |
| CFTR-DeltaF508-311 | - | GACUUCACUUCUAAUGGUGAUUA | 23 | 1816 |
| CFTR-DeltaF508-312 | - | AGACUUCACUUCUAAUGGUGAUUA | 24 | 1817 |
| CFTR-DeltaF508-313 | - | UCAUCAAAGCAUGCCAAC | 18 | 1818 |
| CFTR-DeltaF508-314 | - | GUCAUCAAAGCAUGCCAAC | 19 | 1819 |
| CFTR-DeltaF508-315 | - | CGUCAUCAAAGCAUGCCAAC | 20 | 668 |
| CFTR-DeltaF508-316 | - | GCGUCAUCAAAGCAUGCCAAC | 21 | 1820 |
| CFTR-DeltaF508-317 | - | AGCGUCAUCAAAGCAUGCCAAC | 22 | 1821 |
| CFTR-DeltaF508-318 | - | AAGCGUCAUCAAAGCAUGCCAAC | 23 | 1822 |
| CFTR-DeltaF508-319 | - | GAAGCGUCAUCAAAGCAUGCCAAC | 24 | 1823 |
| CFTR-DeltaF508-320 | - | UGGUGAUUAUGGGAGAAC | 18 | 1824 |
| CFTR-DeltaF508-321 | - | AUGGUGAUUAUGGGAGAAC | 19 | 1825 |
| CFTR-DeltaF508-40 | - | AAUGGUGAUUAUGGGAGAAC | 20 | 423 |

TABLE 11E-continued

5th Tier

| gRNA Name | DNA Strand | Targeting Domain | Target Site Length | Seq ID |
|---|---|---|---|---|
| CFTR-DeltaF508-322 | − | UAAUGGUGAUUAUGGGAGAAC | 21 | 1826 |
| CFTR-DeltaF508-323 | − | CUAAUGGUGAUUAUGGGAGAAC | 22 | 1827 |
| CFTR-DeltaF508-324 | − | UCUAAUGGUGAUUAUGGGAGAAC | 23 | 1828 |
| CFTR-DeltaF508-325 | − | UUCUAAUGGUGAUUAUGGGAGAAC | 24 | 1829 |
| CFTR-DeltaF508-326 | − | AUUGGAGGCAAGUGAAUC | 18 | 1830 |
| CFTR-DeltaF508-327 | − | AAUUGGAGGCAAGUGAAUC | 19 | 1831 |
| CFTR-DeltaF508-328 | − | UAAUUGGAGGCAAGUGAAUC | 20 | 655 |
| CFTR-DeltaF508-329 | − | GGGUAAAAUUAAGCACAG | 18 | 1832 |
| CFTR-DeltaF508-330 | − | AGGGUAAAAUUAAGCACAG | 19 | 1833 |
| CFTR-DeltaF508-12 | − | GAGGGUAAAAUUAAGCACAG | 20 | 387 |
| CFTR-DeltaF508-331 | − | AGAGGGUAAAAUUAAGCACAG | 21 | 1834 |
| CFTR-DeltaF508-332 | − | CAGAGGGUAAAAUUAAGCACAG | 22 | 1835 |
| CFTR-DeltaF508-333 | − | UCAGAGGGUAAAAUUAAGCACAG | 23 | 1836 |
| CFTR-DeltaF508-334 | − | UUCAGAGGGUAAAAUUAAGCACAG | 24 | 1837 |
| CFTR-DeltaF508-335 | − | UCAAAGCAUGCCAACUAG | 18 | 1838 |
| CFTR-DeltaF508-336 | − | AUCAAAGCAUGCCAACUAG | 19 | 1839 |
| CFTR-DeltaF508-337 | − | CAUCAAAGCAUGCCAACUAG | 20 | 669 |
| CFTR-DeltaF508-338 | − | UCAUCAAAGCAUGCCAACUAG | 21 | 1840 |
| CFTR-DeltaF508-339 | − | GUCAUCAAAGCAUGCCAACUAG | 22 | 1841 |
| CFTR-DeltaF508-340 | − | CGUCAUCAAAGCAUGCCAACUAG | 23 | 1842 |
| CFTR-DeltaF508-341 | − | GCGUCAUCAAAGCAUGCCAACUAG | 24 | 1843 |
| CFTR-DeltaF508-342 | − | UUCUAAUGGUGAUUAUGG | 18 | 1844 |
| CFTR-DeltaF508-343 | − | CUUCUAAUGGUGAUUAUGG | 19 | 1845 |
| CFTR-DeltaF508-344 | − | ACUUCUAAUGGUGAUUAUGG | 20 | 658 |
| CFTR-DeltaF508-345 | − | CACUUCUAAUGGUGAUUAUGG | 21 | 1846 |
| CFTR-DeltaF508-346 | − | UCACUUCUAAUGGUGAUUAUGG | 22 | 1847 |
| CFTR-DeltaF508-347 | − | UUCACUUCUAAUGGUGAUUAUGG | 23 | 1848 |
| CFTR-DeltaF508-348 | − | CUUCACUUCUAAUGGUGAUUAUGG | 24 | 1849 |
| CFTR-DeltaF508-349 | − | AACUUUUUGAUUAUGCAU | 18 | 1850 |
| CFTR-DeltaF508-350 | − | AAACUUUUUGAUUAUGCAU | 19 | 1851 |
| CFTR-DeltaF508-351 | − | AAAACUUUUUGAUUAUGCAU | 20 | 672 |
| CFTR-DeltaF508-352 | − | GAAAACUUUUUGAUUAUGCAU | 21 | 1852 |
| CFTR-DeltaF508-353 | − | UGAAAACUUUUUGAUUAUGCAU | 22 | 1853 |
| CFTR-DeltaF508-354 | − | GUGAAAACUUUUUGAUUAUGCAU | 23 | 1854 |
| CFTR-DeltaF508-355 | − | UGUGAAAACUUUUUGAUUAUGCAU | 24 | 1855 |
| CFTR-DeltaF508-356 | − | GAAGAGGUAAGAAACUAU | 18 | 1856 |
| CFTR-DeltaF508-357 | − | AGAAGAGGUAAGAAACUAU | 19 | 1857 |

TABLE 11E-continued

5th Tier

| gRNA Name | DNA Strand | Targeting Domain | Target Site Length | Seq ID |
|---|---|---|---|---|
| CFTR-DeltaF508-358 | - | UAGAAGAGGUAAGAAACUAU | 20 | 671 |
| CFTR-DeltaF508-359 | - | CUAGAAGAGGUAAGAAACUAU | 21 | 1858 |
| CFTR-DeltaF508-360 | - | ACUAGAAGAGGUAAGAAACUAU | 22 | 1859 |
| CFTR-DeltaF508-361 | - | AACUAGAAGAGGUAAGAAACUAU | 23 | 1860 |
| CFTR-DeltaF508-362 | - | CAACUAGAAGAGGUAAGAAACUAU | 24 | 1861 |
| CFTR-DeltaF508-363 | - | ACUUCUAAUGGUGAUUAU | 18 | 1862 |
| CFTR-DeltaF508-364 | - | CACUUCUAAUGGUGAUUAU | 19 | 1863 |
| CFTR-DeltaF508-51 | - | UCACUUCUAAUGGUGAUUAU | 20 | 422 |
| CFTR-DeltaF508-365 | - | UUCACUUCUAAUGGUGAUUAU | 21 | 1864 |
| CFTR-DeltaF508-366 | - | CUUCACUUCUAAUGGUGAUUAU | 22 | 1865 |
| CFTR-DeltaF508-367 | - | ACUUCACUUCUAAUGGUGAUUAU | 23 | 1866 |
| CFTR-DeltaF508-368 | - | GACUUCACUUCUAAUGGUGAUUAU | 24 | 1867 |
| CFTR-DeltaF508-369 | - | AUGCCAACUAGAAGAGGU | 18 | 1868 |
| CFTR-DeltaF508-370 | - | CAUGCCAACUAGAAGAGGU | 19 | 1869 |
| CFTR-DeltaF508-371 | - | GCAUGCCAACUAGAAGAGGU | 20 | 670 |
| CFTR-DeltaF508-372 | - | AGCAUGCCAACUAGAAGAGGU | 21 | 1870 |
| CFTR-DeltaF508-373 | - | AAGCAUGCCAACUAGAAGAGGU | 22 | 1871 |
| CFTR-DeltaF508-374 | - | AAAGCAUGCCAACUAGAAGAGGU | 23 | 1872 |
| CFTR-DeltaF508-375 | - | CAAAGCAUGCCAACUAGAAGAGGU | 24 | 1873 |
| CFTR-DeltaF508-376 | - | UCACUUCUAAUGGUGAUU | 18 | 1874 |
| CFTR-DeltaF508-377 | - | UUCACUUCUAAUGGUGAUU | 19 | 1875 |
| CFTR-DeltaF508-378 | - | CUUCACUUCUAAUGGUGAUU | 20 | 657 |
| CFTR-DeltaF508-379 | - | ACUUCACUUCUAAUGGUGAUU | 21 | 1876 |
| CFTR-DeltaF508-380 | - | GACUUCACUUCUAAUGGUGAUU | 22 | 1877 |
| CFTR-DeltaF508-381 | - | AGACUUCACUUCUAAUGGUGAUU | 23 | 1878 |
| CFTR-DeltaF508-382 | - | CAGACUUCACUUCUAAUGGUGAUU | 24 | 1879 |
| CFTR-DeltaF508-383 | - | UGGGAGAACUGGAGCCUU | 18 | 1880 |
| CFTR-DeltaF508-384 | - | AUGGGAGAACUGGAGCCUU | 19 | 1881 |
| CFTR-DeltaF508-385 | - | UAUGGGAGAACUGGAGCCUU | 20 | 660 |
| CFTR-DeltaF508-386 | - | UUAUGGGAGAACUGGAGCCUU | 21 | 1882 |
| CFTR-DeltaF508-387 | - | AUUAUGGGAGAACUGGAGCCUU | 22 | 1883 |
| CFTR-DeltaF508-388 | - | GAUUAUGGGAGAACUGGAGCCUU | 23 | 1884 |
| CFTR-DeltaF508-389 | - | UGAUUAUGGGAGAACUGGAGCCUU | 24 | 1885 |

Table 12A provides exemplary targeting domains for correcting a mutation (e.g., deltaF508) in the CFTR gene selected according to the first tier parameters. The targeting domains bind within 200 bp from a mutation (e.g., deltaF508), have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 12A

1st Tier

| gRNA Name | DNA Strand | Targeting Domain | Target Site Length | Seq ID |
|---|---|---|---|---|
| CFTR-DeltaF508-390 | − | GAAACUAUGUGAAAACU | 17 | 924 |

Table 12B provides exemplary targeting domains for correcting a mutation (e.g., deltaF508) in the CFTR gene selected according to the second tier parameters. The targeting domains bind within 200 bp from a mutation (e.g., deltaF508) and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 12B

2nd Tier

| gRNA Name | DNA Strand | Targeting Domain | Target Site Length | Seq ID |
|---|---|---|---|---|
| CFTR-DeltaF508-16 | − | CCAGACUUCACUUCUAA | 17 | 438 |
| CFTR-DeltaF508-391 | + | AGAAUGAAAUUCUUCCA | 17 | 1886 |
| CFTR-DeltaF508-392 | − | AGGCAAGUGAAUCCUGA | 17 | 922 |
| CFTR-DeltaF508-393 | + | UCAUUAUCAAAUCACGC | 17 | 925 |
| CFTR-DeltaF508-394 | + | CUUACCUCUUCUAGUUG | 17 | 1887 |
| CFTR-DeltaF508-34 | − | UUUCCAGACUUCACUUCUAA | 20 | 420 |
| CFTR-DeltaF508-395 | − | UGGAGGCAAGUGAAUCCUGA | 20 | 917 |
| CFTR-DeltaF508-396 | + | UUCUAGUUGGCAUGCUUUGA | 20 | 1888 |
| CFTR-DeltaF508-397 | + | AGGUCAUUAUCAAAUCACGC | 20 | 920 |
| CFTR-DeltaF508-398 | − | UAAGAAACUAUGUGAAAACU | 20 | 919 |

Table 12C provides exemplary targeting domains for correcting a mutation (e.g., deltaF508) in the CFTR gene selected according to the fourth tier parameters. The targeting domains bind within 200 bp from a mutation (e.g., deltaF508). It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 12C

4th Tier

| gRNA Name | DNA Strand | Targeting Domain | Target Site Length | Seq ID |
|---|---|---|---|---|
| CFTR-DeltaF508-399 | + | UAGUUGGCAUGCUUUGA | 17 | 1889 |
| CFTR-DeltaF508-400 | + | AUAAAUAUAUGUAGACU | 17 | 926 |
| CFTR-DeltaF508-401 | − | AUUCUGUUCUCAGUUUU | 17 | 923 |
| CFTR-DeltaF508-402 | + | AACAGAAUGAAAUUCUUCCA | 20 | 1890 |
| CFTR-DeltaF508-403 | + | UUUCUUACCUCUUCUAGUUG | 20 | 1891 |

TABLE 12C-continued

4th Tier

| gRNA Name | DNA Strand | Targeting Domain | Target Site Length | Seq ID |
|---|---|---|---|---|
| CFTR-DeltaF508-404 | + | AACAUAAAUAUAUGUAGACU | 20 | 921 |
| CFTR-DeltaF508-405 | − | UUCAUUCUGUUCUCAGUUUU | 20 | 918 |

Table 13A provides exemplary targeting domains for correcting a mutation (e.g., G542X) in the CFTR gene selected according to the first tier parameters. The targeting domains bind within 200 bp from a mutation (e.g., G542X), have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 13A

1st Tier

| gRNA Name | DNA Strand | Targeting Domain | Target Site Length | Seq ID |
|---|---|---|---|---|
| CFTR-G542X-1 | − | GCUUUAUAUUCUGUUUC | 17 | 466 |
| CFTR-G542X-2 | − | GGUGGAAUCACACUGAG | 17 | 456 |
| CFTR-G542X-3 | − | GGAAUCACACUGAGUGG | 17 | 457 |
| CFTR-G542X-4 | − | GUUCAAAAUUUCAACUG | 17 | 464 |
| CFTR-G542X-5 | − | GGUGAAUAACUAAUUAU | 17 | 465 |
| CFTR-G542X-6 | − | GGGGUUUUAUGGCUAGU | 17 | 458 |
| CFTR-G542X-7 | − | GAGCAAGAAUUUCUUUAGCA | 20 | 462 |
| CFTR-G542X-8 | − | GAAGGUGGAAUCACACUGAG | 20 | 461 |
| CFTR-G542X-9 | − | GGUGGAAUCACACUGAGUGG | 20 | 454 |

Table 13B provides exemplary targeting domains for correcting a mutation (e.g., G542X) in the CFTR gene selected according to the second tier parameters. The targeting domains bind within 200 bp from a mutation (e.g., G542X) and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 13B

2nd Tier

| gRNA Name | DNA Strand | Targeting Domain | Target Site Length | Seq ID |
|---|---|---|---|---|
| CFTR-G542X-10 | + | CUCAAUCUGAAUUUGAA | 17 | 496 |
| CFTR-G542X-11 | − | CAAGAAUUUCUUUAGCA | 17 | 491 |
| CFTR-G542X-12 | − | UAUAUGAUUACAUUAGA | 17 | 485 |
| CFTR-G542X-13 | − | AAAAUCCUGGGGUUUUA | 17 | 493 |
| CFTR-G542X-14 | + | ACUAGCCAUAAAACCCC | 17 | 459 |
| CFTR-G542X-15 | − | UGGGGUUUUAUGGCUAG | 17 | 494 |
| CFTR-G542X-16 | − | AUAGUUCUUUGAGAAGG | 17 | 1892 |
| CFTR-G542X-17 | + | AUGCUCAAUCUGAAUUUGAA | 20 | 484 |
| CFTR-G542X-18 | − | UGAUAUGAUUACAUUAGA | 20 | 471 |
| CFTR-G542X-19 | + | CCCACUAGCCAUAAAACCCC | 20 | 455 |
| CFTR-G542X-20 | − | UUCUGGAAUUGAAAAAAUCC | 20 | 477 |
| CFTR-G542X-21 | − | CUGGAAUUGAAAAAAUCCUG | 20 | 479 |
| CFTR-G542X-22 | − | CAAGGUGAAUAACUAAUUAU | 20 | 475 |
| CFTR-G542X-23 | − | CCUGGGGUUUUAUGGCUAGU | 20 | 481 |

Table 13C provides exemplary targeting domains for correcting a mutation (e.g., G542X) in the CFTR gene selected according to the third tier parameters. The targeting domains bind within 200 bp from a mutation (e.g., G542X) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 13C

3rd Tier

| gRNA Name | DNA Strand | Targeting Domain | Target Site Length | Seq ID |
|---|---|---|---|---|
| CFTR-G542X-24 | − | GAAUUGAAAAAAUCCUG | 17 | 468 |
| CFTR-G542X-25 | + | GUCUUUCUCUGCAAACU | 17 | 469 |
| CFTR-G542X-26 | − | GGAAUUGAAAAAAUCCU | 17 | 467 |
| CFTR-G542X-27 | − | GACAAUAUAGUUCUUUGAGA | 20 | 1893 |
| CFTR-G542X-28 | − | GAAAAAAUCCUGGGGUUUUA | 20 | 463 |

Table 13D provides exemplary targeting domains for correcting a mutation (e.g., G542X) in the CFTR gene selected according to the fourth tier parameters. The targeting domains bind within 200 bp from a mutation (e.g., G542X). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 13D

4th Tier

| gRNA Name | DNA Strand | Targeting Domain | Target Site Length | Seq ID |
|---|---|---|---|---|
| CFTR-G542X-29 | − | AAUUGCAUUUGAAAUAA | 17 | 1894 |
| CFTR-G542X-30 | − | AAUAUAGUUCUUUGAGA | 17 | 1895 |
| CFTR-G542X-31 | − | UGGAAUUGAAAAAAUCC | 17 | 492 |
| CFTR-G542X-32 | − | UUUCUAUUUUUGGUAAU | 17 | 487 |
| CFTR-G542X-33 | − | CUCUAAUUUUCUAUUUU | 17 | 486 |
| CFTR-G542X-34 | − | AUAAAUUGCAUUUGAAAUAA | 20 | 1896 |
| CFTR-G542X-35 | − | AUUGCUUUAUAUUCUGUUUC | 20 | 476 |
| CFTR-G542X-36 | − | UCCUGGGGUUUUAUGGCUAG | 20 | 480 |
| CFTR-G542X-37 | − | AAUAUAGUUCUUUGAGAAGG | 20 | 1897 |
| CFTR-G542X-38 | − | AAUGUUCAAAAUUUCAACUG | 20 | 470 |
| CFTR-G542X-39 | − | AAUUUUCUAUUUUUGGUAAU | 20 | 473 |
| CFTR-G542X-40 | + | AUUGUCUUUCUCUGCAAACU | 20 | 483 |
| CFTR-G542X-41 | − | UCUGGAAUUGAAAAAAUCCU | 20 | 478 |
| CFTR-G542X-42 | − | ACUCUCUAAUUUUCUAUUUU | 20 | 472 |

Table 14A provides exemplary targeting domains for correcting a mutation (e.g., G542X) in the CFTR gene selected according to the first tier parameters. The targeting domains bind within 200 bp from a mutation (e.g., G542X), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 14A

1st Tier

| gRNA Name | DNA Strand | Targeting Domain | Target Site Length | Seq ID |
|---|---|---|---|---|
| CFTR-G542X-43 | + | GAUUUUUCAAUUCCAGAAA | 20 | 766 |
| CFTR-G542X-44 | + | GGAUUUUUCAAUUCCAGAAA | 21 | 1898 |
| CFTR-G542X-45 | + | GUCACUUUUAGUAUGCUCAAU | 21 | 1899 |
| CFTR-G542X-46 | + | GAGUCACUUUUAGUAUGCUCAAU | 23 | 1900 |
| CFTR-G542X-47 | − | GAGUGGAGGUCAACGAGC | 18 | 1901 |
| CFTR-G542X-48 | − | GCAAGAAUUUCUUUAGCAAG | 20 | 746 |
| CFTR-G542X-49 | − | GAGCAAGAAUUUCUUUAGCAAG | 22 | 1902 |
| CFTR-G542X-50 | − | GUUUUAUGGCUAGUGGGUU | 19 | 1903 |
| CFTR-G542X-51 | − | GGUUUUAUGGCUAGUGGGUU | 20 | 751 |
| CFTR-G542X-52 | − | GGGUUUUAUGGCUAGUGGGUU | 21 | 1904 |
| CFTR-G542X-53 | − | GGGGUUUUAUGGCUAGUGGGUU | 22 | 1905 |

Table 14B provides exemplary targeting domains for correcting a mutation (e.g., G542X) in the CFTR gene selected according to the second tier parameters. The targeting domains bind within 200 bp from a mutation (e.g., G542X), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 14B

2nd Tier

| gRNA Name | DNA Strand | Targeting Domain | Target Site Length | Seq ID |
|---|---|---|---|---|
| CFTR-G542X-54 | + | UUUUUUCAAUUCCAGAAA | 18 | 1906 |
| CFTR-G542X-55 | + | AUUUUUUCAAUUCCAGAAA | 19 | 1907 |
| CFTR-G542X-56 | + | AGGAUUUUUUCAAUUCCAGAAA | 22 | 1908 |
| CFTR-G542X-57 | + | CAGGAUUUUUUCAAUUCCAGAAA | 23 | 1909 |
| CFTR-G542X-58 | + | CCAGGAUUUUUUCAAUUCCAGAAA | 24 | 1910 |
| CFTR-G542X-59 | + | UGUCUGUAAUUUUUUAC | 18 | 1911 |
| CFTR-G542X-60 | + | AUGUCUGUAAUUUUUUAC | 19 | 1912 |
| CFTR-G542X-61 | + | AAUGUCUGUAAUUUUUUAC | 20 | 763 |

TABLE 14B-continued

2nd Tier

| gRNA Name | DNA Strand | Targeting Domain | Target Site Length | Seq ID |
|---|---|---|---|---|
| CFTR-G542X-62 | + | CCACUAGCCAUAAAACCC | 18 | 1913 |
| CFTR-G542X-63 | + | CCCACUAGCCAUAAAACCC | 19 | 1914 |
| CFTR-G542X-64 | + | ACCCACUAGCCAUAAAACCC | 20 | 1915 |
| CFTR-G542X-65 | + | AACCCACUAGCCAUAAAACCC | 21 | 1916 |
| CFTR-G542X-66 | + | UAACCCACUAGCCAUAAAACCC | 22 | 1917 |
| CFTR-G542X-67 | + | UUAACCCACUAGCCAUAAAACCC | 23 | 1918 |
| CFTR-G542X-68 | + | CUUAACCCACUAGCCAUAAAACCC | 24 | 1919 |
| CFTR-G542X-69 | + | ACUUUUAGUAUGCUCAAU | 18 | 1920 |
| CFTR-G542X-70 | + | CACUUUUAGUAUGCUCAAU | 19 | 1921 |
| CFTR-G542X-71 | + | UCACUUUUAGUAUGCUCAAU | 20 | 756 |
| CFTR-G542X-72 | + | AGUCACUUUUAGUAUGCUCAAU | 22 | 1922 |
| CFTR-G542X-73 | + | AGAGUCACUUUUAGUAUGCUCAAU | 24 | 1923 |
| CFTR-G542X-74 | − | CCUGGGGUUUUAUGGCUA | 18 | 1924 |
| CFTR-G542X-75 | − | UCCUGGGGUUUUAUGGCUA | 19 | 1925 |
| CFTR-G542X-76 | − | AUCCUGGGGUUUUAUGGCUA | 20 | 750 |
| CFTR-G542X-77 | − | AAUCCUGGGGUUUUAUGGCUA | 21 | 1926 |
| CFTR-G542X-78 | − | AAAUCCUGGGGUUUUAUGGCUA | 22 | 1927 |
| CFTR-G542X-79 | − | AAAAUCCUGGGGUUUUAUGGCUA | 23 | 1928 |
| CFTR-G542X-80 | − | AAAAAUCCUGGGGUUUUAUGGCUA | 24 | 1929 |
| CFTR-G542X-81 | − | UGAGUGGAGGUCAACGAGC | 19 | 1930 |
| CFTR-G542X-82 | − | CUGAGUGGAGGUCAACGAGC | 20 | 745 |
| CFTR-G542X-83 | − | UGCUUUAUAUUCUGUUUC | 18 | 1931 |
| CFTR-G542X-84 | − | UUGCUUUAUAUUCUGUUUC | 19 | 1932 |
| CFTR-G542X-35 | − | AUUGCUUUAUAUUCUGUUUC | 20 | 476 |
| CFTR-G542X-85 | − | UAUUGCUUUAUAUUCUGUUUC | 21 | 1933 |
| CFTR-G542X-86 | − | CUAUUGCUUUAUAUUCUGUUUC | 22 | 1934 |
| CFTR-G542X-87 | − | UCUAUUGCUUUAUAUUCUGUUUC | 23 | 1935 |
| CFTR-G542X-88 | − | CUCUAUUGCUUUAUAUUCUGUUUC | 24 | 1936 |
| CFTR-G542X-89 | − | AAGAAUUUCUUUAGCAAG | 18 | 1937 |
| CFTR-G542X-90 | − | CAAGAAUUUCUUUAGCAAG | 19 | 1938 |
| CFTR-G542X-91 | − | AGCAAGAAUUUCUUUAGCAAG | 21 | 1939 |
| CFTR-G542X-92 | − | CGAGCAAGAAUUUCUUUAGCAAG | 23 | 1940 |
| CFTR-G542X-93 | − | ACGAGCAAGAAUUUCUUUAGCAAG | 24 | 1941 |
| CFTR-G542X-94 | − | UUUUAUGGCUAGUGGGUU | 18 | 1942 |
| CFTR-G542X-95 | − | UGGGGUUUUAUGGCUAGUGGGUU | 23 | 1943 |
| CFTR-G542X-96 | − | CUGGGGUUUUAUGGCUAGUGGGUU | 24 | 1944 |

Table 14C provides exemplary targeting domains for correcting a mutation (e.g., G542X) in the CFTR gene selected according to the third tier parameters. The targeting domains bind within 200 bp from a mutation (e.g., G542X), start with a 5'G and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 14C

3rd Tier

| gRNA Name | DNA Strand | Targeting Domain | Target Site Length | Seq ID |
|---|---|---|---|---|
| CFTR-G542X-97 | + | GAAAUGUCUGUAAUUUUUUAC | 22 | 1945 |
| CFTR-G542X-98 | + | GAGAAAUGUCUGUAAUUUUUUAC | 24 | 1946 |
| CFTR-G542X-99 | − | GUUCUUUGAGAAGGUGGAAUCACA | 24 | 1947 |
| CFTR-G542X-100 | − | GUUUCUGGAAUUGAAAAAAUCC | 22 | 1948 |
| CFTR-G542X-101 | − | GACAAUAUAGUUCUUUGAGAAGG | 23 | 1949 |

Table 14D provides exemplary targeting domains for correcting a mutation (e.g., G542X) in the CFTR gene selected according to the fourth tier parameters. The targeting domains bind within 200 bp from a mutation (e.g., G542X), and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 14D

4th Tier

| gRNA Name | DNA Strand | Targeting Domain | Target Site Length | Seq ID |
|---|---|---|---|---|
| CFTR-G542X-102 | + | ACCAAAAAUAGAAAAUUA | 18 | 1950 |
| CFTR-G542X-103 | + | UACCAAAAAUAGAAAAUUA | 19 | 1951 |
| CFTR-G542X-104 | + | UUACCAAAAAUAGAAAAUUA | 20 | 757 |
| CFTR-G542X-105 | + | AUUACCAAAAAUAGAAAAUUA | 21 | 1952 |
| CFTR-G542X-106 | + | UAUUACCAAAAAUAGAAAAUUA | 22 | 1953 |
| CFTR-G542X-107 | + | CUAUUACCAAAAAUAGAAAAUUA | 23 | 1954 |
| CFTR-G542X-108 | + | CCUAUUACCAAAAAUAGAAAAUUA | 24 | 1955 |
| CFTR-G542X-109 | + | AAAUGUCUGUAAUUUUUUAC | 21 | 1956 |
| CFTR-G542X-110 | + | AGAAAUGUCUGUAAUUUUUUAC | 23 | 1957 |
| CFTR-G542X-111 | − | UGAGAAGGUGGAAUCACA | 18 | 1958 |
| CFTR-G542X-112 | − | UUGAGAAGGUGGAAUCACA | 19 | 1959 |
| CFTR-G542X-113 | − | UUUGAGAAGGUGGAAUCACA | 20 | 1960 |
| CFTR-G542X-114 | − | CUUUGAGAAGGUGGAAUCACA | 21 | 1961 |
| CFTR-G542X-115 | − | UCUUUGAGAAGGUGGAAUCACA | 22 | 1962 |

TABLE 14D-continued

4th Tier

| gRNA Name | DNA Strand | Targeting Domain | Target Site Length | Seq ID |
|---|---|---|---|---|
| CFTR-G542X-116 | - | UUCUUUGAGAAGGUGGAAUCACA | 23 | 1963 |
| CFTR-G542X-117 | - | CUGGAAUUGAAAAAAUCC | 18 | 1964 |
| CFTR-G542X-118 | - | UCUGGAAUUGAAAAAAUCC | 19 | 1965 |
| CFTR-G542X-20 | - | UUCUGGAAUUGAAAAAAUCC | 20 | 477 |
| CFTR-G542X-119 | - | UUUCUGGAAUUGAAAAAAUCC | 21 | 1966 |
| CFTR-G542X-120 | - | UGUUUCUGGAAUUGAAAAAAUCC | 23 | 1967 |
| CFTR-G542X-121 | - | CUGUUUCUGGAAUUGAAAAAAUCC | 24 | 1968 |
| CFTR-G542X-122 | - | ACUGAGUGGAGGUCAACGAGC | 21 | 1969 |
| CFTR-G542X-123 | - | CACUGAGUGGAGGUCAACGAGC | 22 | 1970 |
| CFTR-G542X-124 | - | ACACUGAGUGGAGGUCAACGAGC | 23 | 1971 |
| CFTR-G542X-125 | - | CACACUGAGUGGAGGUCAACGAGC | 24 | 1972 |
| CFTR-G542X-126 | - | UAUAGUUCUUUGAGAAGG | 18 | 1973 |
| CFTR-G542X-127 | - | AUAUAGUUCUUUGAGAAGG | 19 | 1974 |
| CFTR-G542X-37 | - | AAUAUAGUUCUUUGAGAAGG | 20 | 1897 |
| CFTR-G542X-128 | - | CAAUAUAGUUCUUUGAGAAGG | 21 | 1975 |
| CFTR-G542X-129 | - | ACAAUAUAGUUCUUUGAGAAGG | 22 | 1976 |
| CFTR-G542X-130 | - | AGACAAUAUAGUUCUUUGAGAAGG | 24 | 1977 |

Table 14E provides exemplary targeting domains for correcting a mutation (e.g., G542X) in the CFTR gene selected according to the fifth tier parameters. The targeting domains bind within 200 bp from a mutation (e.g., G542X), and PAM is NNGRRV. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 14E

5th Tier

| gRNA Name | DNA Strand | Targeting Domain | Target Site Length | Seq ID |
|---|---|---|---|---|
| CFTR-G542X-131 | + | AUGUCCUAUUACCAAAAA | 18 | 1978 |
| CFTR-G542X-132 | + | GAUGUCCUAUUACCAAAAA | 19 | 1979 |
| CFTR-G542X-133 | + | AGAUGUCCUAUUACCAAAAA | 20 | 759 |
| CFTR-G542X-134 | + | GAGAUGUCCUAUUACCAAAAA | 21 | 1980 |
| CFTR-G542X-135 | + | GGAGAUGUCCUAUUACCAAAAA | 22 | 1981 |
| CFTR-G542X-136 | + | UGGAGAUGUCCUAUUACCAAAAA | 23 | 1982 |
| CFTR-G542X-137 | + | UUGGAGAUGUCCUAUUACCAAAAA | 24 | 1983 |
| CFTR-G542X-138 | + | AAACAGAAUAUAAAGCAA | 18 | 1984 |
| CFTR-G542X-139 | + | GAAACAGAAUAUAAAGCAA | 19 | 1985 |
| CFTR-G542X-140 | + | AGAAACAGAAUAUAAAGCAA | 20 | 765 |
| CFTR-G542X-141 | + | CAGAAACAGAAUAUAAAGCAA | 21 | 1986 |
| CFTR-G542X-142 | + | CCAGAAACAGAAUAUAAAGCAA | 22 | 1987 |

TABLE 14E-continued

| | | 5th Tier | | |
|---|---|---|---|---|
| gRNA Name | DNA Strand | Targeting Domain | Target Site Length | Seq ID |
| CFTR-G542X-143 | + | UCCAGAAACAGAAUAUAAAGCAA | 23 | 1988 |
| CFTR-G542X-144 | + | UUCCAGAAACAGAAUAUAAAGCAA | 24 | 1989 |
| CFTR-G542X-145 | + | UGUGAUUCCACCUUCUCA | 18 | 1990 |
| CFTR-G542X-146 | + | GUGUGAUUCCACCUUCUCA | 19 | 1991 |
| CFTR-G542X-147 | + | AGUGUGAUUCCACCUUCUCA | 20 | 1992 |
| CFTR-G542X-148 | + | CAGUGUGAUUCCACCUUCUCA | 21 | 1993 |
| CFTR-G542X-149 | + | UCAGUGUGAUUCCACCUUCUCA | 22 | 1994 |
| CFTR-G542X-150 | + | CUCAGUGUGAUUCCACCUUCUCA | 23 | 1995 |
| CFTR-G542X-151 | + | ACUCAGUGUGAUUCCACCUUCUCA | 24 | 1996 |
| CFTR-G542X-152 | + | ACAGAAUAUAAAGCAAUA | 18 | 1997 |
| CFTR-G542X-153 | + | AACAGAAUAUAAAGCAAUA | 19 | 1998 |
| CFTR-G542X-154 | + | AAACAGAAUAUAAAGCAAUA | 20 | 764 |
| CFTR-G542X-155 | + | GAAACAGAAUAUAAAGCAAUA | 21 | 1999 |
| CFTR-G542X-156 | + | AGAAACAGAAUAUAAAGCAAUA | 22 | 2000 |
| CFTR-G542X-157 | + | CAGAAACAGAAUAUAAAGCAAUA | 23 | 2001 |
| CFTR-G542X-158 | + | CCAGAAACAGAAUAUAAAGCAAUA | 24 | 2002 |
| CFTR-G542X-159 | + | UAGUUAUUCACCUUGCUA | 18 | 2003 |
| CFTR-G542X-160 | + | UUAGUUAUUCACCUUGCUA | 19 | 2004 |
| CFTR-G542X-161 | + | AUUAGUUAUUCACCUUGCUA | 20 | 762 |
| CFTR-G542X-162 | + | AAUUAGUUAUUCACCUUGCUA | 21 | 2005 |
| CFTR-G542X-163 | + | UAAUUAGUUAUUCACCUUGCUA | 22 | 2006 |
| CFTR-G542X-164 | + | AUAAUUAGUUAUUCACCUUGCUA | 23 | 2007 |
| CFTR-G542X-165 | + | AAUAAUUAGUUAUUCACCUUGCUA | 24 | 2008 |
| CFTR-G542X-166 | + | UUGUCUUUCUCUGCAAAC | 18 | 2009 |
| CFTR-G542X-167 | + | AUUGUCUUUCUCUGCAAAC | 19 | 2010 |
| CFTR-G542X-168 | + | UAUUGUCUUUCUCUGCAAAC | 20 | 760 |
| CFTR-G542X-169 | + | AUAUUGUCUUUCUCUGCAAAC | 21 | 2011 |
| CFTR-G542X-170 | + | UAUAUUGUCUUUCUCUGCAAAC | 22 | 2012 |

TABLE 14E-continued

| 5th Tier | | | | |
|---|---|---|---|---|
| gRNA Name | DNA Strand | Targeting Domain | Target Site Length | Seq ID |
| CFTR-G542X-171 | + | CUAUAUUGUCUUUCUCUGCAAAC | 23 | 2013 |
| CFTR-G542X-172 | + | ACUAUAUUGUCUUUCUCUGCAAAC | 24 | 2014 |
| CFTR-G542X-173 | + | CCAGGAUUUUUUCAAUUC | 18 | 2015 |
| CFTR-G542X-174 | + | CCCAGGAUUUUUUCAAUUC | 19 | 2016 |
| CFTR-G542X-175 | + | CCCCAGGAUUUUUUCAAUUC | 20 | 767 |
| CFTR-G542X-176 | + | ACCCCAGGAUUUUUUCAAUUC | 21 | 2017 |
| CFTR-G542X-177 | + | AACCCCAGGAUUUUUUCAAUUC | 22 | 2018 |
| CFTR-G542X-178 | + | AAACCCCAGGAUUUUUUCAAUUC | 23 | 2019 |
| CFTR-G542X-179 | + | AAAACCCCAGGAUUUUUUCAAUUC | 24 | 2020 |
| CFTR-G542X-180 | + | CUAUUGCUUUAACCACAG | 18 | 2021 |
| CFTR-G542X-181 | + | ACUAUUGCUUUAACCACAG | 19 | 2022 |
| CFTR-G542X-182 | + | CACUAUUGCUUUAACCACAG | 20 | 754 |
| CFTR-G542X-183 | + | ACACUAUUGCUUUAACCACAG | 21 | 2023 |
| CFTR-G542X-184 | + | CACACUAUUGCUUUAACCACAG | 22 | 2024 |
| CFTR-G542X-185 | + | UCACACUAUUGCUUUAACCACAG | 23 | 2025 |
| CFTR-G542X-186 | + | AUCACACUAUUGCUUUAACCACAG | 24 | 2026 |
| CFTR-G542X-187 | + | UUACCAAAAAUAGAAAAU | 18 | 2027 |
| CFTR-G542X-188 | + | AUUACCAAAAAUAGAAAAU | 19 | 2028 |
| CFTR-G542X-189 | + | UAUUACCAAAAAUAGAAAAU | 20 | 758 |
| CFTR-G542X-190 | + | CUAUUACCAAAAAUAGAAAAU | 21 | 2029 |
| CFTR-G542X-191 | + | CCUAUUACCAAAAAUAGAAAAU | 22 | 2030 |
| CFTR-G542X-192 | + | UCCUAUUACCAAAAAUAGAAAAU | 23 | 2031 |
| CFTR-G542X-193 | + | GUCCUAUUACCAAAAAUAGAAAAU | 24 | 2032 |
| CFTR-G542X-194 | + | AGUAUGCUCAAUCUGAAU | 18 | 2033 |
| CFTR-G542X-195 | + | UAGUAUGCUCAAUCUGAAU | 19 | 2034 |
| CFTR-G542X-196 | + | UUAGUAUGCUCAAUCUGAAU | 20 | 755 |
| CFTR-G542X-197 | + | UUUAGUAUGCUCAAUCUGAAU | 21 | 2035 |
| CFTR-G542X-198 | + | UUUUAGUAUGCUCAAUCUGAAU | 22 | 2036 |
| CFTR-G542X-199 | + | CUUUUAGUAUGCUCAAUCUGAAU | 23 | 2037 |
| CFTR-G542X-200 | + | ACUUUUAGUAUGCUCAAUCUGAAU | 24 | 2038 |
| CFTR-G542X-201 | + | UGUCUUUCUCUGCAAACU | 18 | 2039 |
| CFTR-G542X-202 | + | UUGUCUUUCUCUGCAAACU | 19 | 2040 |
| CFTR-G542X-40 | + | AUUGUCUUUCUCUGCAAACU | 20 | 483 |
| CFTR-G542X-203 | + | UAUUGUCUUUCUCUGCAAACU | 21 | 2041 |

TABLE 14E-continued

5th Tier

| gRNA Name | DNA Strand | Targeting Domain | Target Site Length | Seq ID |
|---|---|---|---|---|
| CFTR-G542X-204 | + | AUAUUGUCUUUCUCUGCAAACU | 22 | 2042 |
| CFTR-G542X-205 | + | UAUAUUGUCUUUCUCUGCAAACU | 23 | 2043 |
| CFTR-G542X-206 | + | CUAUAUUGUCUUUCUCUGCAAACU | 24 | 2044 |
| CFTR-G542X-207 | + | UUAACCACAGUUGAAAUU | 18 | 2045 |
| CFTR-G542X-208 | + | UUUAACCACAGUUGAAAUU | 19 | 2046 |
| CFTR-G542X-209 | + | CUUUAACCACAGUUGAAAUU | 20 | 753 |
| CFTR-G542X-210 | + | GCUUUAACCACAGUUGAAAUU | 21 | 2047 |
| CFTR-G542X-211 | + | UGCUUUAACCACAGUUGAAAUU | 22 | 2048 |
| CFTR-G542X-212 | + | UUGCUUUAACCACAGUUGAAAUU | 23 | 2049 |
| CFTR-G542X-213 | + | AUUGCUUUAACCACAGUUGAAAUU | 24 | 2050 |
| CFTR-G542X-214 | − | UAUAUUCUGUUUCUGGAA | 18 | 2051 |
| CFTR-G542X-215 | − | UUAUAUUCUGUUUCUGGAA | 19 | 2052 |
| CFTR-G542X-216 | − | UUUAUAUUCUGUUUCUGGAA | 20 | 748 |
| CFTR-G542X-217 | − | CUUUAUAUUCUGUUUCUGGAA | 21 | 2053 |
| CFTR-G542X-218 | − | GCUUUAUAUUCUGUUUCUGGAA | 22 | 2054 |
| CFTR-G542X-219 | − | UGCUUUAUAUUCUGUUUCUGGAA | 23 | 2055 |
| CFTR-G542X-220 | − | UUGCUUUAUAUUCUGUUUCUGGAA | 24 | 2056 |
| CFTR-G542X-221 | − | AAAUUGCAUUUGAAAUAA | 18 | 2057 |
| CFTR-G542X-222 | − | UAAAUUGCAUUUGAAAUAA | 19 | 2058 |
| CFTR-G542X-34 | − | AUAAAUUGCAUUUGAAAUAA | 20 | 1896 |
| CFTR-G542X-223 | − | AUUUUCUAUUUUUGGUAA | 18 | 2059 |
| CFTR-G542X-224 | − | AAUUUUCUAUUUUUGGUAA | 19 | 2060 |
| CFTR-G542X-225 | − | UAAUUUUCUAUUUUUGGUAA | 20 | 736 |
| CFTR-G542X-226 | − | CUAAUUUUCUAUUUUUGGUAA | 21 | 2061 |
| CFTR-G542X-227 | − | UCUAAUUUUCUAUUUUUGGUAA | 22 | 2062 |
| CFTR-G542X-228 | − | CUCUAAUUUUCUAUUUUUGGUAA | 23 | 2063 |
| CFTR-G542X-229 | − | UCUCUAAUUUUCUAUUUUUGGUAA | 24 | 2064 |
| CFTR-G542X-230 | − | GACAUCUCCAAGUUUGCA | 18 | 2065 |
| CFTR-G542X-231 | − | GGACAUCUCCAAGUUUGCA | 19 | 2066 |
| CFTR-G542X-232 | − | AGGACAUCUCCAAGUUUGCA | 20 | 738 |
| CFTR-G542X-233 | − | UAGGACAUCUCCAAGUUUGCA | 21 | 2067 |
| CFTR-G542X-234 | − | AUAGGACAUCUCCAAGUUUGCA | 22 | 2068 |
| CFTR-G542X-235 | − | AAUAGGACAUCUCCAAGUUUGCA | 23 | 2069 |
| CFTR-G542X-236 | − | UAAUAGGACAUCUCCAAGUUUGCA | 24 | 2070 |
| CFTR-G542X-237 | − | CACACUGAGUGGAGGUCA | 18 | 2071 |
| CFTR-G542X-238 | − | UCACACUGAGUGGAGGUCA | 19 | 2072 |
| CFTR-G542X-239 | − | AUCACACUGAGUGGAGGUCA | 20 | 744 |

TABLE 14E-continued

5th Tier

| gRNA Name | DNA Strand | Targeting Domain | Target Site Length | Seq ID |
|---|---|---|---|---|
| CFTR-G542X-240 | - | AAUCACACUGAGUGGAGGUCA | 21 | 2073 |
| CFTR-G542X-241 | - | GAAUCACACUGAGUGGAGGUCA | 22 | 2074 |
| CFTR-G542X-242 | - | GGAAUCACACUGAGUGGAGGUCA | 23 | 2075 |
| CFTR-G542X-243 | - | UGGAAUCACACUGAGUGGAGGUCA | 24 | 2076 |
| CFTR-G542X-244 | - | GUGCCUUUCAAAUUCAGA | 18 | 2077 |
| CFTR-G542X-245 | - | UGUGCCUUUCAAAUUCAGA | 19 | 2078 |
| CFTR-G542X-246 | - | AUGUGCCUUUCAAAUUCAGA | 20 | 735 |
| CFTR-G542X-247 | - | GAUGUGCCUUUCAAAUUCAGA | 21 | 2079 |
| CFTR-G542X-248 | - | AGAUGUGCCUUUCAAAUUCAGA | 22 | 2080 |
| CFTR-G542X-249 | - | AAGAUGUGCCUUUCAAAUUCAGA | 23 | 2081 |
| CFTR-G542X-250 | - | GAAGAUGUGCCUUUCAAAUUCAGA | 24 | 2082 |
| CFTR-G542X-251 | - | AUAUAUGAUUACAUUAGA | 18 | 2083 |
| CFTR-G542X-252 | - | GAUAUAUGAUUACAUUAGA | 19 | 2084 |
| CFTR-G542X-18 | - | UGAUAUAUGAUUACAUUAGA | 20 | 471 |
| CFTR-G542X-253 | - | GUGAUAUAUGAUUACAUUAGA | 21 | 2085 |
| CFTR-G542X-254 | - | UGUGAUAUAUGAUUACAUUAGA | 22 | 2086 |
| CFTR-G542X-255 | - | GUGUGAUAUAUGAUUACAUUAGA | 23 | 2087 |
| CFTR-G542X-256 | - | AGUGUGAUAUAUGAUUACAUUAGA | 24 | 2088 |
| CFTR-G542X-257 | - | AAGGUGGAAUCACACUGA | 18 | 2089 |
| CFTR-G542X-258 | - | GAAGGUGGAAUCACACUGA | 19 | 2090 |
| CFTR-G542X-259 | - | AGAAGGUGGAAUCACACUGA | 20 | 743 |
| CFTR-G542X-260 | - | GAGAAGGUGGAAUCACACUGA | 21 | 2091 |
| CFTR-G542X-261 | - | UGAGAAGGUGGAAUCACACUGA | 22 | 2092 |
| CFTR-G542X-262 | - | UUGAGAAGGUGGAAUCACACUGA | 23 | 2093 |
| CFTR-G542X-263 | - | UUUGAGAAGGUGGAAUCACACUGA | 24 | 2094 |
| CFTR-G542X-264 | - | UAAAUUGCAUUUGAAAUA | 18 | 2095 |
| CFTR-G542X-265 | - | AUAAAUUGCAUUUGAAAUA | 19 | 2096 |
| CFTR-G542X-266 | - | AAUAAAUUGCAUUUGAAAUA | 20 | 2097 |
| CFTR-G542X-267 | - | UCUGGAAUUGAAAAAAUC | 18 | 2098 |
| CFTR-G542X-268 | - | UUCUGGAAUUGAAAAAAUC | 19 | 2099 |
| CFTR-G542X-269 | - | UUUCUGGAAUUGAAAAAAUC | 20 | 749 |
| CFTR-G542X-270 | - | GUUUCUGGAAUUGAAAAAAUC | 21 | 2100 |
| CFTR-G542X-271 | - | UGUUUCUGGAAUUGAAAAAAUC | 22 | 2101 |
| CFTR-G542X-272 | - | CUGUUUCUGGAAUUGAAAAAAUC | 23 | 2102 |
| CFTR-G542X-273 | - | UCUGUUUCUGGAAUUGAAAAAAUC | 24 | 2103 |
| CFTR-G542X-274 | - | AUAUAGUUCUUUGAGAAG | 18 | 2104 |
| CFTR-G542X-275 | - | AAUAUAGUUCUUUGAGAAG | 19 | 2105 |

TABLE 14E-continued

5th Tier

| gRNA Name | DNA Strand | Targeting Domain | Target Site Length | Seq ID |
|---|---|---|---|---|
| CFTR-G542X-276 | - | CAAUAUAGUUCUUUGAGAAG | 20 | 2106 |
| CFTR-G542X-277 | - | ACAAUAUAGUUCUUUGAGAAG | 21 | 2107 |
| CFTR-G542X-278 | - | GACAAUAUAGUUCUUUGAGAAG | 22 | 2108 |
| CFTR-G542X-279 | - | AGACAAUAUAGUUCUUUGAGAAG | 23 | 2109 |
| CFTR-G542X-280 | - | AAGACAAUAUAGUUCUUUGAGAAG | 24 | 2110 |
| CFTR-G542X-281 | - | AGGUGGAAUCACACUGAG | 18 | 2111 |
| CFTR-G542X-282 | - | AAGGUGGAAUCACACUGAG | 19 | 2112 |
| CFTR-G542X-8 | - | GAAGGUGGAAUCACACUGAG | 20 | 461 |
| CFTR-G542X-283 | - | AGAAGGUGGAAUCACACUGAG | 21 | 2113 |
| CFTR-G542X-284 | - | GAGAAGGUGGAAUCACACUGAG | 22 | 2114 |
| CFTR-G542X-285 | - | UGAGAAGGUGGAAUCACACUGAG | 23 | 2115 |
| CFTR-G542X-286 | - | UUGAGAAGGUGGAAUCACACUGAG | 24 | 2116 |
| CFTR-G542X-287 | - | GAUAUAUGAUUACAUUAG | 18 | 2117 |
| CFTR-G542X-288 | - | UGAUAUAUGAUUACAUUAG | 19 | 2118 |
| CFTR-G542X-289 | - | GUGAUAUAUGAUUACAUUAG | 20 | 734 |
| CFTR-G542X-290 | - | UGUGAUAUAUGAUUACAUUAG | 21 | 2119 |
| CFTR-G542X-291 | - | GUGUGAUAUAUGAUUACAUUAG | 22 | 2120 |
| CFTR-G542X-292 | - | AGUGUGAUAUAUGAUUACAUUAG | 23 | 2121 |
| CFTR-G542X-293 | - | UAGUGUGAUAUAUGAUUACAUUAG | 24 | 2122 |
| CFTR-G542X-294 | - | AGGACAUCUCCAAGUUUG | 18 | 2123 |
| CFTR-G542X-295 | - | UAGGACAUCUCCAAGUUUG | 19 | 2124 |
| CFTR-G542X-296 | - | AUAGGACAUCUCCAAGUUUG | 20 | 737 |
| CFTR-G542X-297 | - | AAUAGGACAUCUCCAAGUUUG | 21 | 2125 |
| CFTR-G542X-298 | - | UAAUAGGACAUCUCCAAGUUUG | 22 | 2126 |
| CFTR-G542X-299 | - | GUAAUAGGACAUCUCCAAGUUUG | 23 | 2127 |
| CFTR-G542X-300 | - | GGUAAUAGGACAUCUCCAAGUUUG | 24 | 2128 |
| CFTR-G542X-301 | - | UGUGAUAUAUGAUUACAU | 18 | 2129 |
| CFTR-G542X-302 | - | GUGUGAUAUAUGAUUACAU | 19 | 2130 |
| CFTR-G542X-303 | - | AGUGUGAUAUAUGAUUACAU | 20 | 733 |
| CFTR-G542X-304 | - | UAGUGUGAUAUAUGAUUACAU | 21 | 2131 |
| CFTR-G542X-305 | - | AUAGUGUGAUAUAUGAUUACAU | 22 | 2132 |
| CFTR-G542X-306 | - | AAUAGUGUGAUAUAUGAUUACAU | 23 | 2133 |
| CFTR-G542X-307 | - | CAAUAGUGUGAUAUAUGAUUACAU | 24 | 2134 |
| CFTR-G542X-308 | - | GAAAGACAAUAUAGUUCU | 18 | 2135 |
| CFTR-G542X-309 | - | AGAAAGACAAUAUAGUUCU | 19 | 2136 |
| CFTR-G542X-310 | - | GAGAAAGACAAUAUAGUUCU | 20 | 453 |
| CFTR-G542X-311 | - | AGAGAAAGACAAUAUAGUUCU | 21 | 2137 |

TABLE 14E-continued

5th Tier

| gRNA Name | DNA Strand | Targeting Domain | Target Site Length | Seq ID |
|---|---|---|---|---|
| CFTR-G542X-312 | - | CAGAGAAAGACAAUAUAGUUCU | 22 | 2138 |
| CFTR-G542X-313 | - | GCAGAGAAAGACAAUAUAGUUCU | 23 | 2139 |
| CFTR-G542X-314 | - | UGCAGAGAAAGACAAUAUAGUUCU | 24 | 2140 |
| CFTR-G542X-315 | - | AAGACAAUAUAGUUCUUU | 18 | 2141 |
| CFTR-G542X-316 | - | AAAGACAAUAUAGUUCUUU | 19 | 2142 |
| CFTR-G542X-317 | - | GAAAGACAAUAUAGUUCUUU | 20 | 2143 |
| CFTR-G542X-318 | - | AGAAAGACAAUAUAGUUCUUU | 21 | 2144 |
| CFTR-G542X-319 | - | GAGAAAGACAAUAUAGUUCUUU | 22 | 2145 |
| CFTR-G542X-320 | - | AGAGAAAGACAAUAUAGUUCUUU | 23 | 2146 |
| CFTR-G542X-321 | - | CAGAGAAAGACAAUAUAGUUCUUU | 24 | 2147 |
| CFTR-G542X-322 | - | UUGCUUUAUAUUCUGUUU | 18 | 2148 |
| CFTR-G542X-323 | - | AUUGCUUUAUAUUCUGUUU | 19 | 2149 |
| CFTR-G542X-324 | - | UAUUGCUUUAUAUUCUGUUU | 20 | 747 |
| CFTR-G542X-325 | - | CUAUUGCUUUAUAUUCUGUUU | 21 | 2150 |
| CFTR-G542X-326 | - | UCUAUUGCUUUAUAUUCUGUUU | 22 | 2151 |
| CFTR-G542X-327 | - | CUCUAUUGCUUUAUAUUCUGUUU | 23 | 2152 |
| CFTR-G542X-328 | - | UCUCUAUUGCUUUAUAUUCUGUUU | 24 | 2153 |

Table 15A provides exemplary targeting domains for correcting a mutation (e.g., G542X) in the CFTR gene selected according to the first tier parameters. The targeting domains bind within 200 bp from a mutation (e.g., G542X), have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 15A

1st Tier

| gRNA Name | DNA Strand | Targeting Domain | Target Site Length | Seq ID |
|---|---|---|---|---|
| CFTR-G542X-329 | + | GUAAUCAUAUAUCACAC | 17 | 2154 |
| CFTR-G542X-330 | - | GGUUAAAGCAAUAGUGUGAU | 20 | 927 |

Table 15B provides exemplary targeting domains for correcting a mutation (e.g., G542X) in the CFTR gene selected according to the second tier parameters. The targeting domains bind within 200 bp from a mutation (e.g., G542X) and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 15B

2nd Tier

| gRNA Name | DNA Strand | Targeting Domain | Target Site Length | Seq ID |
|---|---|---|---|---|
| CFTR-G542X-331 | + | UCGUUGACCUCCACUCA | 17 | 934 |
| CFTR-G542X-332 | + | CCACUAGCCAUAAAACC | 17 | 935 |

TABLE 15B-continued

2nd Tier

| gRNA Name | DNA Strand | Targeting Domain | Target Site Length | Seq ID |
|---|---|---|---|---|
| CFTR-G542X-333 | + | UGAAUGACAUUUACAGC | 17 | 2155 |
| CFTR-G542X-334 | − | UAAAGCAAUAGUGUGAU | 17 | 932 |
| CFTR-G542X-335 | − | AGGAAGAUGUGCCUUUCAAA | 20 | 928 |
| CFTR-G542X-336 | + | UGCUCGUUGACCUCCACUCA | 20 | 929 |
| CFTR-G542X-337 | + | AAUGUAAUCAUAUAUCACAC | 20 | 2156 |
| CFTR-G542X-338 | + | AACCCACUAGCCAUAAAACC | 20 | 930 |
| CFTR-G542X-339 | + | ACAUGAAUGACAUUUACAGC | 20 | 2157 |

Table 15C provides exemplary targeting domains for correcting a mutation (e.g., G542X) in the CFTR gene selected according to the fourth tier parameters. The targeting domains bind within 200 bp from a mutation (e.g., G542X). It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 15C

4th Tier

| gRNA Name | DNA Strand | Targeting Domain | Target Site Length | Seq ID |
|---|---|---|---|---|
| CFTR-G542X-340 | − | AAGAUGUGCCUUUCAAA | 17 | 933 |
| CFTR-G542X-341 | − | AAUUACAGACAUUUCUC | 17 | 2158 |
| CFTR-G542X-342 | − | AAAAAUUACAGACAUUUCUC | 20 | 2159 |

Table 16A provides exemplary targeting domains for correcting a mutation (e.g., G551D) in the CFTR gene selected according to the first tier parameters. The targeting domains bind within 200 bp from a mutation (e.g., G551D), have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 16A

1st Tier

| gRNA Name | DNA Strand | Targeting Domain | Target Site Length | Seq ID |
|---|---|---|---|---|
| CFTR-G551D-1 | − | GCUUUAUAUUCUGUUUC | 17 | 466 |
| CFTR-G551D-2 | − | GGUGGAAUCACACUGAG | 17 | 456 |
| CFTR-G551D-3 | − | GUUCAAAAUUUCAACUG | 17 | 464 |
| CFTR-G551D-4 | − | GGUGAAUAACUAAUUAU | 17 | 465 |
| CFTR-G551D-5 | − | GGGGUUUUAUGGCUAGU | 17 | 458 |
| CFTR-G551D-6 | − | GAGCAAGAAUUUCUUUAGCA | 20 | 462 |
| CFTR-G551D-7 | − | GACAAUAUAGUUCUUGGAGA | 20 | 460 |
| CFTR-G551D-8 | − | GAAGGUGGAAUCACACUGAG | 20 | 461 |
| CFTR-G551D-9 | − | GAGAAAGACAAUAUAGUUCU | 20 | 453 |

Table 16B provides exemplary targeting domains for correcting a mutation (e.g., G551D) in the CFTR gene selected according to the second tier parameters. The targeting domains bind within 200 bp from a mutation (e.g., G551D) and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 16B

2nd Tier

| gRNA Name | DNA Strand | Targeting Domain | Target Site Length | Seq ID |
|---|---|---|---|---|
| CFTR-G551D-10 | + | CUCAAUCUGAAUUUGAA | 17 | 496 |
| CFTR-G551D-11 | − | CAAGAAUUUCUUUAGCA | 17 | 491 |
| CFTR-G551D-12 | − | AAUAUAGUUCUUGGAGA | 17 | 489 |
| CFTR-G551D-13 | − | UAUAUGAUUACAUUAGA | 17 | 485 |
| CFTR-G551D-14 | − | AAAAUCCUGGGGUUUUA | 17 | 493 |
| CFTR-G551D-15 | + | ACUAGCCAUAAAACCCC | 17 | 459 |
| CFTR-G551D-16 | − | UGGGGUUUUAUGGCUAG | 17 | 494 |
| CFTR-G551D-17 | − | AUAGUUCUUGGAGAAGG | 17 | 490 |
| CFTR-G551D-18 | − | AAAGACAAUAUAGUUCU | 17 | 488 |
| CFTR-G551D-19 | + | AUGCUCAAUCUGAAUUUGAA | 20 | 484 |
| CFTR-G551D-20 | − | UGAUAUAUGAUUACAUUAGA | 20 | 471 |
| CFTR-G551D-21 | + | CCCACUAGCCAUAAAACCCC | 20 | 455 |
| CFTR-G551D-22 | − | UUCUGGAAUUGAAAAAAUCC | 20 | 477 |
| CFTR-G551D-23 | − | AAUAUAGUUCUUGGAGAAGG | 20 | 474 |
| CFTR-G551D-24 | − | CUGGAAUUGAAAAAAUCCUG | 20 | 479 |
| CFTR-G551D-25 | − | CAAGGUGAAUAACUAAUUAU | 20 | 475 |
| CFTR-G551D-26 | − | CCUGGGGUUUUAUGGCUAGU | 20 | 481 |

Table 16C provides exemplary targeting domains for correcting a mutation (e.g., G551D) in the CFTR gene selected according to the third tier parameters. The targeting domains bind within 200 bp from a mutation (e.g., G551D) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 16C

3rd Tier

| gRNA Name | DNA Strand | Targeting Domain | Target Site Length | Seq ID |
|---|---|---|---|---|
| CFTR-G551D-27 | − | GAAUUGAAAAAAUCCUG | 17 | 468 |

TABLE 16C-continued

3rd Tier

| gRNA Name | DNA Strand | Targeting Domain | Target Site Length | Seq ID |
|---|---|---|---|---|
| CFTR-G551D-28 | + | GUCUUUCUCUGCAAACU | 17 | 469 |

TABLE 16C-continued

3rd Tier

| gRNA Name | DNA Strand | Targeting Domain | Target Site Length | Seq ID |
|---|---|---|---|---|
| CFTR-G551D-29 | − | GGAAUUGAAAAAAUCCU | 17 | 467 |
| CFTR-G551D-30 | − | GAAAAAAUCCUGGGGUUUUA | 20 | 463 |

Table 16D provides exemplary targeting domains for correcting a mutation (e.g., G551D) in the CFTR gene selected according to the fourth tier parameters. The targeting domains bind within 200 bp from a mutation (e.g., G551D). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 16D

4th Tier

| gRNA Name | DNA Strand | Targeting Domain | Target Site Length | Seq ID |
|---|---|---|---|---|
| CFTR-G551D-31 | − | UUAAGAACUAUAAAUAA | 17 | 495 |
| CFTR-G551D-32 | − | UGGAAUUGAAAAAAUCC | 17 | 492 |
| CFTR-G551D-33 | − | UUUCUAUUUUUGGUAAU | 17 | 487 |
| CFTR-G551D-34 | − | CUCUAAUUUUCUAUUUU | 17 | 486 |
| CFTR-G551D-35 | − | CAUUUAAGAACUAUAAAUAA | 20 | 482 |
| CFTR-G551D-36 | − | AUUGCUUUAUAUUCUGUUUC | 20 | 476 |
| CFTR-G551D-37 | − | UCCUGGGGUUUUAUGGCUAG | 20 | 480 |
| CFTR-G551D-38 | − | AAUGUUCAAAAUUUCAACUG | 20 | 470 |
| CFTR-G551D-39 | − | AAUUUUCUAUUUUUGGUAAU | 20 | 473 |
| CFTR-G551D-40 | + | AUUGUCUUUCUCUGCAAACU | 20 | 483 |
| CFTR-G551D-41 | − | UCUGGAAUUGAAAAAAUCCU | 20 | 478 |
| CFTR-G551D-42 | − | ACUCUCUAAUUUUCUAUUUU | 20 | 472 |

Table 17A provides exemplary targeting domains for correcting a mutation (e.g., G551D) in the CFTR gene selected according to the first tier parameters. The targeting domains bind within 200 bp from a mutation (e.g., G551D), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 17A

1st Tier

| gRNA Name | DNA Strand | Targeting Domain | Target Site Length | Seq ID |
|---|---|---|---|---|
| CFTR-G551D-43 | + | GAUUUUUUCAAUUCCAGAAA | 20 | 766 |
| CFTR-G551D-44 | + | GGAUUUUUUCAAUUCCAGAAA | 21 | 1898 |
| CFTR-G551D-45 | + | GUCACUUUUAGUAUGCUCAAU | 21 | 1899 |
| CFTR-G551D-46 | + | GAGUCACUUUUAGUAUGCUCAAU | 23 | 1900 |
| CFTR-G551D-47 | − | GGAGAAGGUGGAAUCACA | 18 | 2160 |
| CFTR-G551D-48 | − | GUUCUUGGAGAAGGUGGAAUCACA | 24 | 2161 |
| CFTR-G551D-49 | − | GCAAGAAUUUCUUUAGCAAG | 20 | 746 |
| CFTR-G551D-50 | − | GAGCAAGAAUUUCUUUAGCAAG | 22 | 1902 |
| CFTR-G551D-51 | − | GACAAUAUAGUUCUUGGAGAAGG | 23 | 2162 |
| CFTR-G551D-52 | − | GUUUUAUGGCUAGUGGGUU | 19 | 1903 |
| CFTR-G551D-53 | − | GGUUUUAUGGCUAGUGGGUU | 20 | 751 |
| CFTR-G551D-54 | − | GGGUUUUAUGGCUAGUGGGUU | 21 | 1904 |
| CFTR-G551D-55 | − | GGGGUUUUAUGGCUAGUGGGUU | 22 | 1905 |

Table 17B provides exemplary targeting domains for correcting a mutation (e.g., G551D) in the CFTR gene selected according to the second tier parameters. The targeting domains bind within 200 bp from a mutation (e.g., G551D), have a high level of orthogonality and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 17B

| | | | | |
|---|---|---|---|---|
| | | 2nd Tier | | |
| gRNA Name | DNA Strand | Targeting Domain | Target Site Length | Seq ID |
| CFTR-G551D-56 | + | UUUUUUCAAUUCCAGAAA | 18 | 1906 |
| CFTR-G551D-57 | + | AUUUUUUCAAUUCCAGAAA | 19 | 1907 |
| CFTR-G551D-58 | + | AGGAUUUUUUCAAUUCCAGAAA | 22 | 1908 |
| CFTR-G551D-59 | + | CAGGAUUUUUUCAAUUCCAGAAA | 23 | 1909 |
| CFTR-G551D-60 | + | CCAGGAUUUUUUCAAUUCCAGAAA | 24 | 1910 |
| CFTR-G551D-61 | + | UGUCUGUAAUUUUUUAC | 18 | 1911 |
| CFTR-G551D-62 | + | AUGUCUGUAAUUUUUUAC | 19 | 1912 |
| CFTR-G551D-63 | + | AAUGUCUGUAAUUUUUUAC | 20 | 763 |
| CFTR-G551D-64 | + | CCACUAGCCAUAAAACCC | 18 | 1913 |
| CFTR-G551D-65 | + | CCCACUAGCCAUAAAACCC | 19 | 1914 |
| CFTR-G551D-66 | + | ACCCACUAGCCAUAAAACCC | 20 | 1915 |
| CFTR-G551D-67 | + | AACCCACUAGCCAUAAAACCC | 21 | 1916 |
| CFTR-G551D-68 | + | UAACCCACUAGCCAUAAAACCC | 22 | 1917 |
| CFTR-G551D-69 | + | UUAACCCACUAGCCAUAAAACCC | 23 | 1918 |
| CFTR-G551D-70 | + | CUUAACCCACUAGCCAUAAAACCC | 24 | 1919 |
| CFTR-G551D-71 | + | ACUUUUAGUAUGCUCAAU | 18 | 1920 |
| CFTR-G551D-72 | + | CACUUUUAGUAUGCUCAAU | 19 | 1921 |
| CFTR-G551D-73 | + | UCACUUUUAGUAUGCUCAAU | 20 | 756 |
| CFTR-G551D-74 | + | AGUCACUUUUAGUAUGCUCAAU | 22 | 1922 |
| CFTR-G551D-75 | + | AGAGUCACUUUUAGUAUGCUCAAU | 24 | 1923 |
| CFTR-G551D-76 | − | UGGAGAAGGUGGAAUCACA | 19 | 2163 |
| CFTR-G551D-77 | − | UUGGAGAAGGUGGAAUCACA | 20 | 742 |
| CFTR-G551D-78 | − | CUUGGAGAAGGUGGAAUCACA | 21 | 2164 |
| CFTR-G551D-79 | − | UCUUGGAGAAGGUGGAAUCACA | 22 | 2165 |
| CFTR-G551D-80 | − | UUCUUGGAGAAGGUGGAAUCACA | 23 | 2166 |
| CFTR-G551D-81 | − | CCUGGGGUUUUAUGGCUA | 18 | 1924 |
| CFTR-G551D-82 | − | UCCUGGGGUUUUAUGGCUA | 19 | 1925 |
| CFTR-G551D-83 | − | AUCCUGGGGUUUUAUGGCUA | 20 | 750 |
| CFTR-G551D-84 | − | AAUCCUGGGGUUUUAUGGCUA | 21 | 1926 |
| CFTR-G551D-85 | − | AAAUCCUGGGGUUUUAUGGCUA | 22 | 1927 |
| CFTR-G551D-86 | − | AAAAUCCUGGGGUUUUAUGGCUA | 23 | 1928 |
| CFTR-G551D-87 | − | AAAAAUCCUGGGGUUUUAUGGCUA | 24 | 1929 |
| CFTR-G551D-88 | − | UGCUUUAUAUUCUGUUUC | 18 | 1931 |

TABLE 17B-continued

2nd Tier

| gRNA Name | DNA Strand | Targeting Domain | Target Site Length | Seq ID |
|---|---|---|---|---|
| CFTR-G551D-89 | − | UUGCUUUAUAUUCUGUUUC | 19 | 1932 |
| CFTR-G551D-36 | − | AUUGCUUUAUAUUCUGUUUC | 20 | 476 |
| CFTR-G551D-90 | − | UAUUGCUUUAUAUUCUGUUUC | 21 | 1933 |
| CFTR-G551D-91 | − | CUAUUGCUUUAUAUUCUGUUUC | 22 | 1934 |
| CFTR-G551D-92 | − | UCUAUUGCUUUAUAUUCUGUUUC | 23 | 1935 |
| CFTR-G551D-93 | − | CUCUAUUGCUUUAUAUUCUGUUUC | 24 | 1936 |
| CFTR-G551D-94 | − | AAGAAUUUCUUUAGCAAG | 18 | 1937 |
| CFTR-G551D-95 | − | CAAGAAUUUCUUUAGCAAG | 19 | 1938 |
| CFTR-G551D-96 | − | AGCAAGAAUUUCUUUAGCAAG | 21 | 1939 |
| CFTR-G551D-97 | − | CGAGCAAGAAUUUCUUUAGCAAG | 23 | 1940 |
| CFTR-G551D-98 | − | ACGAGCAAGAAUUUCUUUAGCAAG | 24 | 1941 |
| CFTR-G551D-99 | − | UAUAGUUCUUGGAGAAGG | 18 | 2167 |
| CFTR-G551D-100 | − | AUAUAGUUCUUGGAGAAGG | 19 | 2168 |
| CFTR-G551D-23 | − | AAUAUAGUUCUUGGAGAAGG | 20 | 474 |
| CFTR-G551D-101 | − | CAAUAUAGUUCUUGGAGAAGG | 21 | 2169 |
| CFTR-G551D-102 | − | ACAAUAUAGUUCUUGGAGAAGG | 22 | 2170 |
| CFTR-G551D-103 | − | AGACAAUAUAGUUCUUGGAGAAGG | 24 | 2171 |
| CFTR-G551D-104 | − | UUUUAUGGCUAGUGGGUU | 18 | 1942 |
| CFTR-G551D-105 | − | UGGGGUUUUAUGGCUAGUGGGUU | 23 | 1943 |
| CFTR-G551D-106 | − | CUGGGGUUUUAUGGCUAGUGGGUU | 24 | 1944 |

Table 17C provides exemplary targeting domains for correcting a mutation (e.g., G551D) in the CFTR gene selected according to the third tier parameters. The targeting domains bind within 200 bp from a mutation (e.g., G551D), start with a 5'G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

Table 17D provides exemplary targeting domains for correcting a mutation (e.g., G551D) in the CFTR gene selected according to the fourth tier parameters. The targeting domains bind within 200 bp from a mutation (e.g., G551D), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 17C

3rd Tier

| gRNA Name | DNA Strand | Targeting Domain | Target Site Length | Seq ID |
|---|---|---|---|---|
| CFTR-G551D-107 | + | GAAAUGUCUGUAAUUUUUUUAC | 22 | 1945 |
| CFTR-G551D-108 | + | GAGAAAUGUCUGUAAUUUUUUUAC | 24 | 1946 |
| CFTR-G551D-109 | − | GUUUCUGGAAUUGAAAAAAUCC | 22 | 1948 |
| CFTR-G551D-110 | − | GAGUGGAGAUCAACGAGC | 18 | 2172 |

TABLE 17D

4th Tier

| gRNA Name | DNA Strand | Targeting Domain | Target Site Length | Seq ID |
|---|---|---|---|---|
| CFTR-G551D-111 | + | ACCAAAAAUAGAAAAUUA | 18 | 1950 |
| CFTR-G551D-112 | + | UACCAAAAAUAGAAAAUUA | 19 | 1951 |
| CFTR-G551D-113 | + | UUACCAAAAAUAGAAAAUUA | 20 | 757 |
| CFTR-G551D-114 | + | AUUACCAAAAAUAGAAAAUUA | 21 | 1952 |
| CFTR-G551D-115 | + | UAUUACCAAAAAUAGAAAAUUA | 22 | 1953 |
| CFTR-G551D-116 | + | CUAUUACCAAAAAUAGAAAAUUA | 23 | 1954 |
| CFTR-G551D-117 | + | CCUAUUACCAAAAAUAGAAAAUUA | 24 | 1955 |
| CFTR-G551D-118 | + | AAAUGUCUGUAAUUUUUUUAC | 21 | 1956 |
| CFTR-G551D-119 | + | AGAAAUGUCUGUAAUUUUUUUAC | 23 | 1957 |
| CFTR-G551D-120 | − | CUGGAAUUGAAAAAAUCC | 18 | 1964 |
| CFTR-G551D-121 | − | UCUGGAAUUGAAAAAAUCC | 19 | 1965 |
| CFTR-G551D-22 | − | UUCUGGAAUUGAAAAAAUCC | 20 | 477 |
| CFTR-G551D-122 | − | UUUCUGGAAUUGAAAAAAUCC | 21 | 1966 |
| CFTR-G551D-123 | − | UGUUUCUGGAAUUGAAAAAAUCC | 23 | 1967 |
| CFTR-G551D-124 | − | CUGUUUCUGGAAUUGAAAAAAUCC | 24 | 1968 |
| CFTR-G551D-125 | − | UGAGUGGAGAUCAACGAGC | 19 | 2173 |
| CFTR-G551D-126 | − | CUGAGUGGAGAUCAACGAGC | 20 | 2174 |
| CFTR-G551D-127 | − | ACUGAGUGGAGAUCAACGAGC | 21 | 2175 |
| CFTR-G551D-128 | − | CACUGAGUGGAGAUCAACGAGC | 22 | 2176 |
| CFTR-G551D-129 | − | ACACUGAGUGGAGAUCAACGAGC | 23 | 2177 |
| CFTR-G551D-130 | − | CACACUGAGUGGAGAUCAACGAGC | 24 | 2178 |

Table 17E provides exemplary targeting domains for correcting a mutation (e.g., G551D) in the CFTR gene selected according to the fifth tier parameters. The targeting domains bind within 200 bp from a mutation (e.g., G551D), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 17E

5th Tier

| gRNA Name | DNA Strand | Targeting Domain | Target Site Length | Seq ID |
|---|---|---|---|---|
| CFTR-G551D-131 | + | AUGUCCUAUUACCAAAAA | 18 | 1978 |
| CFTR-G551D-132 | + | GAUGUCCUAUUACCAAAAA | 19 | 1979 |
| CFTR-G551D-133 | + | AGAUGUCCUAUUACCAAAAA | 20 | 759 |
| CFTR-G551D-134 | + | GAGAUGUCCUAUUACCAAAAA | 21 | 1980 |
| CFTR-G551D-135 | + | GGAGAUGUCCUAUUACCAAAAA | 22 | 1981 |
| CFTR-G551D-136 | + | UGGAGAUGUCCUAUUACCAAAAA | 23 | 1982 |
| CFTR-G551D-137 | + | UUGGAGAUGUCCUAUUACCAAAAA | 24 | 1983 |
| CFTR-G551D-138 | + | AAACAGAAUAUAAAGCAA | 18 | 1984 |
| CFTR-G551D-139 | + | GAAACAGAAUAUAAAGCAA | 19 | 1985 |

TABLE 17E-continued

| | | 5th Tier | | |
|---|---|---|---|---|
| gRNA Name | DNA Strand | Targeting Domain | Target Site Length | Seq ID |
| CFTR-G551D-140 | + | AGAAACAGAAUAUAAAGCAA | 20 | 765 |
| CFTR-G551D-141 | + | CAGAAACAGAAUAUAAAGCAA | 21 | 1986 |
| CFTR-G551D-142 | + | CCAGAAACAGAAUAUAAAGCAA | 22 | 1987 |
| CFTR-G551D-143 | + | UCCAGAAACAGAAUAUAAAGCAA | 23 | 1988 |
| CFTR-G551D-144 | + | UUCCAGAAACAGAAUAUAAAGCAA | 24 | 1989 |
| CFTR-G551D-145 | + | ACAGAAUAUAAAGCAAUA | 18 | 1997 |
| CFTR-G551D-146 | + | AACAGAAUAUAAAGCAAUA | 19 | 1998 |
| CFTR-G551D-147 | + | AAACAGAAUAUAAAGCAAUA | 20 | 764 |
| CFTR-G551D-148 | + | GAAACAGAAUAUAAAGCAAUA | 21 | 1999 |
| CFTR-G551D-149 | + | AGAAACAGAAUAUAAAGCAAUA | 22 | 2000 |
| CFTR-G551D-150 | + | CAGAAACAGAAUAUAAAGCAAUA | 23 | 2001 |
| CFTR-G551D-151 | + | CCAGAAACAGAAUAUAAAGCAAUA | 24 | 2002 |
| CFTR-G551D-152 | + | UAGUUAUUCACCUUGCUA | 18 | 2003 |
| CFTR-G551D-153 | + | UUAGUUAUUCACCUUGCUA | 19 | 2004 |
| CFTR-G551D-154 | + | AUUAGUUAUUCACCUUGCUA | 20 | 762 |
| CFTR-G551D-155 | + | AAUUAGUUAUUCACCUUGCUA | 21 | 2005 |
| CFTR-G551D-156 | + | UAAUUAGUUAUUCACCUUGCUA | 22 | 2006 |
| CFTR-G551D-157 | + | AUAAUUAGUUAUUCACCUUGCUA | 23 | 2007 |
| CFTR-G551D-158 | + | AAUAAUUAGUUAUUCACCUUGCUA | 24 | 2008 |
| CFTR-G551D-159 | + | UUGUCUUUCUCUGCAAAC | 18 | 2009 |
| CFTR-G551D-160 | + | AUUGUCUUUCUCUGCAAAC | 19 | 2010 |
| CFTR-G551D-161 | + | UAUUGUCUUUCUCUGCAAAC | 20 | 760 |
| CFTR-G551D-162 | + | AUAUUGUCUUUCUCUGCAAAC | 21 | 2011 |
| CFTR-G551D-163 | + | UAUAUUGUCUUUCUCUGCAAAC | 22 | 2012 |
| CFTR-G551D-164 | + | CUAUAUUGUCUUUCUCUGCAAAC | 23 | 2013 |
| CFTR-G551D-165 | + | ACUAUAUUGUCUUUCUCUGCAAAC | 24 | 2014 |
| CFTR-G551D-166 | + | UGUGAUUCCACCUUCUCC | 18 | 2179 |
| CFTR-G551D-167 | + | GUGUGAUUCCACCUUCUCC | 19 | 2180 |
| CFTR-G551D-168 | + | AGUGUGAUUCCACCUUCUCC | 20 | 761 |

TABLE 17E-continued

| | | 5th Tier | | |
|---|---|---|---|---|
| gRNA Name | DNA Strand | Targeting Domain | Target Site Length | Seq ID |
| CFTR-G551D-169 | + | CAGUGUGAUUCCACCUUCUCC | 21 | 2181 |
| CFTR-G551D-170 | + | UCAGUGUGAUUCCACCUUCUCC | 22 | 2182 |
| CFTR-G551D-171 | + | CUCAGUGUGAUUCCACCUUCUCC | 23 | 2183 |
| CFTR-G551D-172 | + | ACUCAGUGUGAUUCCACCUUCUCC | 24 | 2184 |
| CFTR-G551D-173 | + | CCAGGAUUUUUUCAAUUC | 18 | 2015 |
| CFTR-G551D-174 | + | CCCAGGAUUUUUUCAAUUC | 19 | 2016 |
| CFTR-G551D-175 | + | CCCCAGGAUUUUUUCAAUUC | 20 | 767 |
| CFTR-G551D-176 | + | ACCCCAGGAUUUUUUCAAUUC | 21 | 2017 |
| CFTR-G551D-177 | + | AACCCCAGGAUUUUUUCAAUUC | 22 | 2018 |
| CFTR-G551D-178 | + | AAACCCCAGGAUUUUUUCAAUUC | 23 | 2019 |
| CFTR-G551D-179 | + | AAAACCCCAGGAUUUUUUCAAUUC | 24 | 2020 |
| CFTR-G551D-180 | + | CUAUUGCUUUAACCACAG | 18 | 2021 |
| CFTR-G551D-181 | + | ACUAUUGCUUUAACCACAG | 19 | 2022 |
| CFTR-G551D-182 | + | CACUAUUGCUUUAACCACAG | 20 | 754 |
| CFTR-G551D-183 | + | ACACUAUUGCUUUAACCACAG | 21 | 2023 |
| CFTR-G551D-184 | + | CACACUAUUGCUUUAACCACAG | 22 | 2024 |
| CFTR-G551D-185 | + | UCACACUAUUGCUUUAACCACAG | 23 | 2025 |
| CFTR-G551D-186 | + | AUCACACUAUUGCUUUAACCACAG | 24 | 2026 |
| CFTR-G551D-187 | + | UUACCAAAAAUAGAAAAU | 18 | 2027 |
| CFTR-G551D-188 | + | AUUACCAAAAAUAGAAAAU | 19 | 2028 |
| CFTR-G551D-189 | + | UAUUACCAAAAAUAGAAAAU | 20 | 758 |
| CFTR-G551D-190 | + | CUAUUACCAAAAAUAGAAAAU | 21 | 2029 |
| CFTR-G551D-191 | + | CCUAUUACCAAAAAUAGAAAAU | 22 | 2030 |
| CFTR-G551D-192 | + | UCCUAUUACCAAAAAUAGAAAAU | 23 | 2031 |
| CFTR-G551D-193 | + | GUCCUAUUACCAAAAAUAGAAAAU | 24 | 2032 |
| CFTR-G551D-194 | + | AGUAUGCUCAAUCUGAAU | 18 | 2033 |
| CFTR-G551D-195 | + | UAGUAUGCUCAAUCUGAAU | 19 | 2034 |
| CFTR-G551D-196 | + | UUAGUAUGCUCAAUCUGAAU | 20 | 755 |
| CFTR-G551D-197 | + | UUUAGUAUGCUCAAUCUGAAU | 21 | 2035 |
| CFTR-G551D-198 | + | UUUUAGUAUGCUCAAUCUGAAU | 22 | 2036 |
| CFTR-G551D-199 | + | CUUUUAGUAUGCUCAAUCUGAAU | 23 | 2037 |
| CFTR-G551D-200 | + | ACUUUUAGUAUGCUCAAUCUGAAU | 24 | 2038 |
| CFTR-G551D-201 | + | UGUCUUUCUCUGCAAACU | 18 | 2039 |
| CFTR-G551D-202 | + | UUGUCUUUCUCUGCAAACU | 19 | 2040 |
| CFTR-G551D-40 | + | AUUGUCUUUCUCUGCAAACU | 20 | 483 |
| CFTR-G551D-203 | + | UAUUGUCUUUCUCUGCAAACU | 21 | 2041 |
| CFTR-G551D-204 | + | AUAUUGUCUUUCUCUGCAAACU | 22 | 2042 |

TABLE 17E-continued

5th Tier

| gRNA Name | DNA Strand | Targeting Domain | Target Site Length | Seq ID |
|---|---|---|---|---|
| CFTR-G551D-205 | + | UAUAUUGUCUUUCUCUGCAAACU | 23 | 2043 |
| CFTR-G551D-206 | + | CUAUAUUGUCUUUCUCUGCAAACU | 24 | 2044 |
| CFTR-G551D-207 | + | UUAACCACAGUUGAAAUU | 18 | 2045 |
| CFTR-G551D-208 | + | UUUAACCACAGUUGAAAUU | 19 | 2046 |
| CFTR-G551D-209 | + | CUUUAACCACAGUUGAAAUU | 20 | 753 |
| CFTR-G551D-210 | + | GCUUUAACCACAGUUGAAAUU | 21 | 2047 |
| CFTR-G551D-211 | + | UGCUUUAACCACAGUUGAAAUU | 22 | 2048 |
| CFTR-G551D-212 | + | UUGCUUUAACCACAGUUGAAAUU | 23 | 2049 |
| CFTR-G551D-213 | + | AUUGCUUUAACCACAGUUGAAAUU | 24 | 2050 |
| CFTR-G551D-214 | − | UAUAUUCUGUUUCUGGAA | 18 | 2051 |
| CFTR-G551D-215 | − | UUAUAUUCUGUUUCUGGAA | 19 | 2052 |
| CFTR-G551D-216 | − | UUUAUAUUCUGUUUCUGGAA | 20 | 748 |
| CFTR-G551D-217 | − | CUUUAUAUUCUGUUUCUGGAA | 21 | 2053 |
| CFTR-G551D-218 | − | GCUUUAUAUUCUGUUUCUGGAA | 22 | 2054 |
| CFTR-G551D-219 | − | UGCUUUAUAUUCUGUUUCUGGAA | 23 | 2055 |
| CFTR-G551D-220 | − | UUGCUUUAUAUUCUGUUUCUGGAA | 24 | 2056 |
| CFTR-G551D-221 | − | AUUUUCUAUUUUGGUAA | 18 | 2059 |
| CFTR-G551D-222 | − | AAUUUUCUAUUUUGGUAA | 19 | 2060 |
| CFTR-G551D-223 | − | UAAUUUUCUAUUUUGGUAA | 20 | 736 |
| CFTR-G551D-224 | − | CUAAUUUUCUAUUUUGGUAA | 21 | 2061 |
| CFTR-G551D-225 | − | UCUAAUUUUCUAUUUUGGUAA | 22 | 2062 |
| CFTR-G551D-226 | − | CUCUAAUUUUCUAUUUUGGUAA | 23 | 2063 |
| CFTR-G551D-227 | − | UCUCUAAUUUUCUAUUUUGGUAA | 24 | 2064 |
| CFTR-G551D-228 | − | GACAUCUCCAAGUUUGCA | 18 | 2065 |
| CFTR-G551D-229 | − | GGACAUCUCCAAGUUUGCA | 19 | 2066 |
| CFTR-G551D-230 | − | AGGACAUCUCCAAGUUUGCA | 20 | 738 |
| CFTR-G551D-231 | − | UAGGACAUCUCCAAGUUUGCA | 21 | 2067 |
| CFTR-G551D-232 | − | AUAGGACAUCUCCAAGUUUGCA | 22 | 2068 |
| CFTR-G551D-233 | − | AAUAGGACAUCUCCAAGUUUGCA | 23 | 2069 |
| CFTR-G551D-234 | − | UAAUAGGACAUCUCCAAGUUUGCA | 24 | 2070 |
| CFTR-G551D-235 | − | CACACUGAGUGGAGAUCA | 18 | 2185 |
| CFTR-G551D-236 | − | UCACACUGAGUGGAGAUCA | 19 | 2186 |
| CFTR-G551D-237 | − | AUCACACUGAGUGGAGAUCA | 20 | 2187 |
| CFTR-G551D-238 | − | AAUCACACUGAGUGGAGAUCA | 21 | 2188 |
| CFTR-G551D-239 | − | GAAUCACACUGAGUGGAGAUCA | 22 | 2189 |
| CFTR-G551D-240 | − | GGAAUCACACUGAGUGGAGAUCA | 23 | 2190 |
| CFTR-G551D-241 | − | UGGAAUCACACUGAGUGGAGAUCA | 24 | 2191 |
| CFTR-G551D-242 | − | GUGCCUUUCAAAUUCAGA | 18 | 2077 |

TABLE 17E-continued

| | | 5th Tier | | |
|---|---|---|---|---|
| gRNA Name | DNA Strand | Targeting Domain | Target Site Length | Seq ID |
| CFTR-G551D-243 | - | UGUGCCUUUCAAAUUCAGA | 19 | 2078 |
| CFTR-G551D-244 | - | AUGUGCCUUUCAAAUUCAGA | 20 | 735 |
| CFTR-G551D-245 | - | GAUGUGCCUUUCAAAUUCAGA | 21 | 2079 |
| CFTR-G551D-246 | - | AGAUGUGCCUUUCAAAUUCAGA | 22 | 2080 |
| CFTR-G551D-247 | - | AAGAUGUGCCUUUCAAAUUCAGA | 23 | 2081 |
| CFTR-G551D-248 | - | GAAGAUGUGCCUUUCAAAUUCAGA | 24 | 2082 |
| CFTR-G551D-249 | - | AUAUAUGAUUACAUUAGA | 18 | 2083 |
| CFTR-G551D-250 | - | GAUAUAUGAUUACAUUAGA | 19 | 2084 |
| CFTR-G551D-20 | - | UGAUAUAUGAUUACAUUAGA | 20 | 471 |
| CFTR-G551D-251 | - | GUGAUAUAUGAUUACAUUAGA | 21 | 2085 |
| CFTR-G551D-252 | - | UGUGAUAUAUGAUUACAUUAGA | 22 | 2086 |
| CFTR-G551D-253 | - | GUGUGAUAUAUGAUUACAUUAGA | 23 | 2087 |
| CFTR-G551D-254 | - | AGUGUGAUAUAUGAUUACAUUAGA | 24 | 2088 |
| CFTR-G551D-255 | - | AAGGUGGAAUCACACUGA | 18 | 2089 |
| CFTR-G551D-256 | - | GAAGGUGGAAUCACACUGA | 19 | 2090 |
| CFTR-G551D-257 | - | AGAAGGUGGAAUCACACUGA | 20 | 743 |
| CFTR-G551D-258 | - | GAGAAGGUGGAAUCACACUGA | 21 | 2091 |
| CFTR-G551D-259 | - | GGAGAAGGUGGAAUCACACUGA | 22 | 2192 |
| CFTR-G551D-260 | - | UGGAGAAGGUGGAAUCACACUGA | 23 | 2193 |
| CFTR-G551D-261 | - | UUGGAGAAGGUGGAAUCACACUGA | 24 | 2194 |
| CFTR-G551D-262 | - | UCUGGAAUUGAAAAAAUC | 18 | 2098 |
| CFTR-G551D-263 | - | UUCUGGAAUUGAAAAAAUC | 19 | 2099 |
| CFTR-G551D-264 | - | UUUCUGGAAUUGAAAAAAUC | 20 | 749 |
| CFTR-G551D-265 | - | GUUUCUGGAAUUGAAAAAAUC | 21 | 2100 |
| CFTR-G551D-266 | - | UGUUUCUGGAAUUGAAAAAAUC | 22 | 2101 |
| CFTR-G551D-267 | - | CUGUUUCUGGAAUUGAAAAAAUC | 23 | 2102 |
| CFTR-G551D-268 | - | UCUGUUUCUGGAAUUGAAAAAAUC | 24 | 2103 |
| CFTR-G551D-269 | - | AGAAAGACAAUAUAGUUC | 18 | 2195 |
| CFTR-G551D-270 | - | GAGAAAGACAAUAUAGUUC | 19 | 2196 |
| CFTR-G551D-271 | - | AGAGAAAGACAAUAUAGUUC | 20 | 739 |
| CFTR-G551D-272 | - | CAGAGAAAGACAAUAUAGUUC | 21 | 2197 |
| CFTR-G551D-273 | - | GCAGAGAAAGACAAUAUAGUUC | 22 | 2198 |
| CFTR-G551D-274 | - | UGCAGAGAAAGACAAUAUAGUUC | 23 | 2199 |
| CFTR-G551D-275 | - | UUGCAGAGAAAGACAAUAUAGUUC | 24 | 2200 |
| CFTR-G551D-276 | - | AUAUAGUUCUUGGAGAAG | 18 | 2201 |
| CFTR-G551D-277 | - | AAUAUAGUUCUUGGAGAAG | 19 | 2202 |
| CFTR-G551D-278 | - | CAAUAUAGUUCUUGGAGAAG | 20 | 741 |

TABLE 17E-continued

| | | 5th Tier | | |
|---|---|---|---|---|
| gRNA Name | DNA Strand | Targeting Domain | Target Site Length | Seq ID |
| CFTR-G551D-279 | - | ACAAUAUAGUUCUUGGAGAAG | 21 | 2203 |
| CFTR-G551D-280 | - | GACAAUAUAGUUCUUGGAGAAG | 22 | 2204 |
| CFTR-G551D-281 | - | AGACAAUAUAGUUCUUGGAGAAG | 23 | 2205 |
| CFTR-G551D-282 | - | AAGACAAUAUAGUUCUUGGAGAAG | 24 | 2206 |
| CFTR-G551D-283 | - | AGGUGGAAUCACACUGAG | 18 | 2111 |
| CFTR-G551D-284 | - | AAGGUGGAAUCACACUGAG | 19 | 2112 |
| CFTR-G551D-8 | - | GAAGGUGGAAUCACACUGAG | 20 | 461 |
| CFTR-G551D-285 | - | AGAAGGUGGAAUCACACUGAG | 21 | 2113 |
| CFTR-G551D-286 | - | GAGAAGGUGGAAUCACACUGAG | 22 | 2114 |
| CFTR-G551D-287 | - | GGAGAAGGUGGAAUCACACUGAG | 23 | 2207 |
| CFTR-G551D-288 | - | UGGAGAAGGUGGAAUCACACUGAG | 24 | 2208 |
| CFTR-G551D-289 | - | GAUAUAUGAUUACAUUAG | 18 | 2117 |
| CFTR-G551D-290 | - | UGAUAUAUGAUUACAUUAG | 19 | 2118 |
| CFTR-G551D-291 | - | GUGAUAUAUGAUUACAUUAG | 20 | 734 |
| CFTR-G551D-292 | - | UGUGAUAUAUGAUUACAUUAG | 21 | 2119 |
| CFTR-G551D-293 | - | GUGUGAUAUAUGAUUACAUUAG | 22 | 2120 |
| CFTR-G551D-294 | - | AGUGUGAUAUAUGAUUACAUUAG | 23 | 2121 |
| CFTR-G551D-295 | - | UAGUGUGAUAUAUGAUUACAUUAG | 24 | 2122 |
| CFTR-G551D-296 | - | AAGACAAUAUAGUUCUUG | 18 | 2209 |
| CFTR-G551D-297 | - | AAAGACAAUAUAGUUCUUG | 19 | 2210 |
| CFTR-G551D-298 | - | GAAAGACAAUAUAGUUCUUG | 20 | 740 |
| CFTR-G551D-299 | - | AGAAAGACAAUAUAGUUCUUG | 21 | 2211 |
| CFTR-G551D-300 | - | GAGAAAGACAAUAUAGUUCUUG | 22 | 2212 |
| CFTR-G551D-301 | - | AGAGAAAGACAAUAUAGUUCUUG | 23 | 2213 |
| CFTR-G551D-302 | - | CAGAGAAAGACAAUAUAGUUCUUG | 24 | 2214 |
| CFTR-G551D-303 | - | AGGACAUCUCCAAGUUUG | 18 | 2123 |
| CFTR-G551D-304 | - | UAGGACAUCUCCAAGUUUG | 19 | 2124 |
| CFTR-G551D-305 | - | AUAGGACAUCUCCAAGUUUG | 20 | 737 |
| CFTR-G551D-306 | - | AAUAGGACAUCUCCAAGUUUG | 21 | 2125 |
| CFTR-G551D-307 | - | UAAUAGGACAUCUCCAAGUUUG | 22 | 2126 |
| CFTR-G551D-308 | - | GUAAUAGGACAUCUCCAAGUUUG | 23 | 2127 |
| CFTR-G551D-309 | - | GGUAAUAGGACAUCUCCAAGUUUG | 24 | 2128 |
| CFTR-G551D-310 | - | UGUGAUAUAUGAUUACAU | 18 | 2129 |
| CFTR-G551D-311 | - | GUGUGAUAUAUGAUUACAU | 19 | 2130 |
| CFTR-G551D-312 | - | AGUGUGAUAUAUGAUUACAU | 20 | 733 |
| CFTR-G551D-313 | - | UAGUGUGAUAUAUGAUUACAU | 21 | 2131 |
| CFTR-G551D-314 | - | AUAGUGUGAUAUAUGAUUACAU | 22 | 2132 |
| CFTR-G551D-315 | - | AAUAGUGUGAUAUAUGAUUACAU | 23 | 2133 |

TABLE 17E-continued

5th Tier

| gRNA Name | DNA Strand | Targeting Domain | Target Site Length | Seq ID |
|---|---|---|---|---|
| CFTR-G551D-316 | - | CAAUAGUGUGAUAUAUGAUUACAU | 24 | 2134 |
| CFTR-G551D-317 | - | GAAAGACAAUAUAGUUCU | 18 | 2135 |
| CFTR-G551D-318 | - | AGAAAGACAAUAUAGUUCU | 19 | 2136 |
| CFTR-G551D-9 | - | GAGAAAGACAAUAUAGUUCU | 20 | 453 |
| CFTR-G551D-319 | - | AGAGAAAGACAAUAUAGUUCU | 21 | 2137 |
| CFTR-G551D-320 | - | CAGAGAAAGACAAUAUAGUUCU | 22 | 2138 |
| CFTR-G551D-321 | - | GCAGAGAAAGACAAUAUAGUUCU | 23 | 2139 |
| CFTR-G551D-322 | - | UGCAGAGAAAGACAAUAUAGUUCU | 24 | 2140 |
| CFTR-G551D-323 | - | GGGUUAAGAAUCACAUUU | 18 | 2215 |
| CFTR-G551D-324 | - | UGGGUUAAGAAUCACAUUU | 19 | 2216 |
| CFTR-G551D-325 | - | GUGGGUUAAGAAUCACAUUU | 20 | 752 |
| CFTR-G551D-326 | - | AGUGGGUUAAGAAUCACAUUU | 21 | 2217 |
| CFTR-G551D-327 | - | UAGUGGGUUAAGAAUCACAUUU | 22 | 2218 |
| CFTR-G551D-328 | - | CUAGUGGGUUAAGAAUCACAUUU | 23 | 2219 |
| CFTR-G551D-329 | - | GCUAGUGGGUUAAGAAUCACAUUU | 24 | 2220 |
| CFTR-G551D-330 | - | UUGCUUUAUAUUCUGUUU | 18 | 2148 |
| CFTR-G551D-331 | - | AUUGCUUUAUAUUCUGUUU | 19 | 2149 |
| CFTR-G551D-332 | - | UAUUGCUUUAUAUUCUGUUU | 20 | 747 |
| CFTR-G551D-333 | - | CUAUUGCUUUAUAUUCUGUUU | 21 | 2150 |
| CFTR-G551D-334 | - | UCUAUUGCUUUAUAUUCUGUUU | 22 | 2151 |
| CFTR-G551D-335 | - | CUCUAUUGCUUUAUAUUCUGUUU | 23 | 2152 |
| CFTR-G551D-336 | - | UCUCUAUUGCUUUAUAUUCUGUUU | 24 | 2153 |

Table 18A provides exemplary targeting domains for correcting a mutation (e.g., G551D) in the CFTR gene selected according to the first tier parameters. The targeting domains bind within 200 bp from a mutation (e.g., G551D), have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 18A

1st Tier

| gRNA Name | DNA Strand | Targeting Domain | Target Site Length | Seq ID |
|---|---|---|---|---|
| CFTR-G551D-337 | + | GUAAUCAUAUAUCACAC | 17 | 2154 |
| CFTR-G551D-338 | - | GGUUAAAGCAAUAGUGUGAU | 20 | 927 |

Table 18B provides exemplary targeting domains for correcting a mutation (e.g., G551D) in the CFTR gene selected according to the second tier parameters. The targeting domains bind within 200 bp from a mutation (e.g., G551D) and have a high level of orthogonality. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 18B

2nd Tier

| gRNA Name | DNA Strand | Targeting Domain | Target Site Length | Seq ID |
|---|---|---|---|---|
| CFTR-G551D-339 | + | CCACUAGCCAUAAAACC | 17 | 935 |
| CFTR-G551D-340 | + | UGAAUGACAUUUACAGC | 17 | 2155 |
| CFTR-G551D-341 | − | UAAAGCAAUAGUGUGAU | 17 | 932 |
| CFTR-G551D-342 | − | AGGAAGAUGUGCCUUUCAAA | 20 | 928 |
| CFTR-G551D-343 | + | AAUGUAAUCAUAUAUCACAC | 20 | 2156 |
| CFTR-G551D-344 | + | AACCCACUAGCCAUAAAACC | 20 | 930 |
| CFTR-G551D-345 | + | ACAUGAAUGACAUUUACAGC | 20 | 2157 |

Table 18C provides exemplary targeting domains for correcting a mutation (e.g., G551D) in the CFTR gene selected according to the fourth tier parameters. The targeting domains bind within 200 bp from a mutation (e.g., G551D). It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 18C

4th Tier

| gRNA Name | DNA Strand | Targeting Domain | Target Site Length | Seq ID |
|---|---|---|---|---|
| CFTR-G551D-346 | − | AAGAUGUGCCUUUCAAA | 17 | 933 |
| CFTR-G551D-347 | + | UUAUUUAUAGUUCUUAA | 17 | 936 |
| CFTR-G551D-348 | + | UCGUUGAUCUCCACUCA | 17 | 2221 |
| CFTR-G551D-349 | − | AAUUACAGACAUUUCUC | 17 | 2158 |
| CFTR-G551D-350 | + | CCAUUAUUUAUAGUUCUUAA | 20 | 931 |
| CFTR-G551D-351 | + | UGCUCGUUGAUCUCCACUCA | 20 | 2222 |
| CFTR-G551D-352 | − | AAAAAUUACAGACAUUUCUC | 20 | 2159 |

Table 19A provides exemplary targeting domains for correcting a mutation (e.g., N1303K) in the CFTR gene selected according to the first tier parameters. The targeting domains bind within 200 bp from a mutation (e.g., N1303K), have a high level of orthogonality and start with a 5'G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

Table 19B provides exemplary targeting domains for correcting a mutation (e.g., N1303K) in the CFTR gene selected according to the second tier parameters. The targeting domains bind within 200 bp from a mutation (e.g., N1303K) and have a high level of orthogonality. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 19B

2nd Tier

| gRNA Name | DNA Strand | Targeting Domain | Target Site Length | Seq ID |
|---|---|---|---|---|
| CFTR-N1303K-7 | − | UGUGCACAACUUUAAAA | 17 | 2229 |
| CFTR-N1303K-8 | − | ACUUGAUGGUAAGUACA | 17 | 2230 |
| CFTR-N1303K-9 | − | AAUUUGAGAGAACUUGA | 17 | 2231 |
| CFTR-N1303K-10 | + | UCACUCCACUGUUCAUA | 17 | 2232 |
| CFTR-N1303K-11 | − | AAGUUGCAGAUGAGGUA | 17 | 2233 |
| CFTR-N1303K-12 | − | UGGAUCCCUAUGAACAG | 17 | 2234 |
| CFTR-N1303K-13 | − | AUGGAAAGUUGCAGAUG | 17 | 2235 |
| CFTR-N1303K-14 | − | CUUGAUGGUAAGUACAU | 17 | 2236 |
| CFTR-N1303K-15 | + | AUCACUCCACUGUUCAU | 17 | 2237 |
| CFTR-N1303K-16 | + | AUAUCAGCCAUUUGUGU | 17 | 2238 |
| CFTR-N1303K-17 | − | AGAACUUGAUGGUAAGUACA | 20 | 2239 |
| CFTR-N1303K-18 | − | AGUGGAGUGAUCAAGAAAUA | 20 | 2240 |
| CFTR-N1303K-19 | + | UGAUCACUCCACUGUUCAUA | 20 | 2241 |
| CFTR-N1303K-20 | − | AAUAUGGAAAGUUGCAGAUG | 20 | 2242 |
| CFTR-N1303K-21 | + | UUGAUCACUCCACUGUUCAU | 20 | 2243 |

TABLE 19A

1st Tier

| gRNA Name | DNA Strand | Targeting Domain | Target Site Length | Seq ID |
|---|---|---|---|---|
| CFTR-N1303K-1 | − | GGAGUGAUCAAGAAAUA | 17 | 2223 |
| CFTR-N1303K-2 | − | GAGUACCCUAACAUACC | 17 | 2224 |
| CFTR-N1303K-3 | − | GUGUGUGCACAACUUUAAAA | 20 | 2225 |
| CFTR-N1303K-4 | − | GGAAAGUUGCAGAUGAGGUA | 20 | 2226 |
| CFTR-N1303K-5 | − | GAACUUGAUGGUAAGUACAU | 20 | 2227 |
| CFTR-N1303K-6 | + | GCUAUAUCAGCCAUUUGUGU | 20 | 2228 |

Table 19C provides exemplary targeting domains for correcting a mutation (e.g., N1303K) in the CFTR gene selected according to the third tier parameters. The targeting domains bind within 200 bp from a mutation (e.g., N1303K) and start with a 5'G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 19C

3rd Tier

| gRNA Name | DNA Strand | Targeting Domain | Target Site Length | Seq ID |
|---|---|---|---|---|
| CFTR-N1303K-22 | − | GUAACUCAUACCAACACAAA | 20 | 2244 |

Table 19D provides exemplary targeting domains for correcting a mutation (e.g., N1303K) in the CFTR gene selected according to the fourth tier parameters. The targeting domains bind within 200 bp from a mutation (e.g., N1303K). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 19D

4th Tier

| gRNA Name | DNA Strand | Targeting Domain | Target Site Length | Seq ID |
|---|---|---|---|---|
| CFTR-N1303K-23 | − | ACUCAUACCAACACAAA | 17 | 2245 |
| CFTR-N1303K-24 | − | CUGAAAUGAUUUUGAAA | 17 | 2246 |
| CFTR-N1303K-25 | − | ACUGAAAUGAUUUUGAA | 17 | 2247 |
| CFTR-N1303K-26 | − | AUUUUACAAUACAAUAA | 17 | 2248 |
| CFTR-N1303K-27 | − | UAUUUUACAAUACAAUA | 17 | 2249 |
| CFTR-N1303K-28 | + | UUGCUCCAGGUAUGUUA | 17 | 2250 |
| CFTR-N1303K-29 | − | AAAGUAUUUAUUUUUUC | 17 | 2251 |
| CFTR-N1303K-30 | − | UGAAAUGAUUUUGAAAG | 17 | 2252 |
| CFTR-N1303K-31 | − | AACAUUUAGAAAAAAGU | 17 | 2253 |
| CFTR-N1303K-32 | − | UAACUGAAAUGAUUUUGAAA | 20 | 2254 |
| CFTR-N1303K-33 | − | CUAACUGAAAUGAUUUUGAA | 20 | 2255 |
| CFTR-N1303K-34 | − | AAUAUUUUACAAUACAAUAA | 20 | 2256 |
| CFTR-N1303K-35 | − | UAAAAUUUGAGAGAACUUGA | 20 | 2257 |
| CFTR-N1303K-36 | − | AAAUAUUUUACAAUACAAUA | 20 | 2258 |
| CFTR-N1303K-37 | − | AUGGAGUACCCUAACAUACC | 20 | 2259 |
| CFTR-N1303K-38 | − | UAGAAAGUAUUUAUUUUUUC | 20 | 2260 |
| CFTR-N1303K-39 | − | AACUGAAAUGAUUUUGAAAG | 20 | 2261 |
| CFTR-N1303K-40 | − | AGUUGGAUCCCUAUGAACAG | 20 | 2262 |
| CFTR-N1303K-41 | − | UGGAACAUUUAGAAAAAAGU | 20 | 2263 |

Table 20A provides exemplary targeting domains for correcting a mutation (e.g., N1303K) in the CFTR gene selected according to the first tier parameters. The targeting domains bind within 200 bp from a mutation (e.g., N1303K), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 20A

1st Tier

| gRNA Name | DNA Strand | Targeting Domain | Target Site Length | Seq ID |
|---|---|---|---|---|
| CFTR-N1303K-42 | + | GAUCACUCCACUGUUCAU | 18 | 2264 |
| CFTR-N1303K-43 | − | GUGUGCACAACUUUAAAA | 18 | 2265 |
| CFTR-N1303K-3 | − | GUGUGUGCACAACUUUAAAA | 20 | 2225 |
| CFTR-N1303K-44 | − | GCUAACUGAAAUGAUUUUGAA | 21 | 2266 |
| CFTR-N1303K-45 | − | GCUGCUAACUGAAAUGAUUUUGAA | 24 | 2267 |
| CFTR-N1303K-46 | − | GAACUUGAUGGUAAGUAC | 18 | 2268 |

TABLE 20A-continued

1st Tier

| gRNA Name | DNA Strand | Targeting Domain | Target Site Length | Seq ID |
|---|---|---|---|---|
| CFTR-N1303K-47 | - | GAGAACUUGAUGGUAAGUAC | 20 | 2269 |
| CFTR-N1303K-48 | - | GAGAGAACUUGAUGGUAAGUAC | 22 | 2270 |

Table 20B provides exemplary targeting domains for correcting a mutation (e.g., N1303K) in the CFTR gene selected according to the second tier parameters. The targeting domains bind within 200 bp from a mutation (e.g., N1303K), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 20B

2nd Tier

| gRNA Name | DNA Strand | Targeting Domain | Target Site Length | Seq ID |
|---|---|---|---|---|
| CFTR-N1303K-49 | + | UGAUCACUCCACUGUUCAU | 19 | 2271 |
| CFTR-N1303K-21 | + | UUGAUCACUCCACUGUUCAU | 20 | 2243 |
| CFTR-N1303K-50 | + | CUUGAUCACUCCACUGUUCAU | 21 | 2272 |
| CFTR-N1303K-51 | + | UCUUGAUCACUCCACUGUUCAU | 22 | 2273 |
| CFTR-N1303K-52 | + | UUCUUGAUCACUCCACUGUUCAU | 23 | 2274 |
| CFTR-N1303K-53 | + | UUUCUUGAUCACUCCACUGUUCAU | 24 | 2275 |
| CFTR-N1303K-54 | - | UGUGUGCACAACUUUAAAA | 19 | 2276 |
| CFTR-N1303K-55 | - | UGCUAACUGAAAUGAUUUUGAA | 22 | 2277 |
| CFTR-N1303K-56 | - | CUGCUAACUGAAAUGAUUUUGAA | 23 | 2278 |
| CFTR-N1303K-57 | - | AGAACUUGAUGGUAAGUAC | 19 | 2279 |
| CFTR-N1303K-58 | - | AGAGAACUUGAUGGUAAGUAC | 21 | 2280 |
| CFTR-N1303K-59 | - | UGAGAGAACUUGAUGGUAAGUAC | 23 | 2281 |
| CFTR-N1303K-60 | - | UUGAGAGAACUUGAUGGUAAGUAC | 24 | 2282 |

Table 20C provides exemplary targeting domains for correcting a mutation (e.g., N1303K) in the CFTR gene selected according to the third tier parameters. The targeting domains bind within 200 bp from a mutation (e.g., N1303K), start with a 5'G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 20C

3rd Tier

| gRNA Name | DNA Strand | Targeting Domain | Target Site Length | Seq ID |
|---|---|---|---|---|
| CFTR-N1303K-61 | + | GCUAUAUCAGCCAUUUGUGUUGGU | 24 | 2283 |
| CFTR-N1303K-62 | - | GUAUGUGUGUGCACAACUUUAAAA | 24 | 2284 |

TABLE 20C-continued

3rd Tier

| gRNA Name | DNA Strand | Targeting Domain | Target Site Length | Seq ID |
|---|---|---|---|---|
| CFTR-N1303K-63 | - | GGAACAUUUAGAAAAAG | 18 | 2285 |
| CFTR-N1303K-64 | - | GUUGGAUCCCUAUGAACAG | 19 | 2286 |

Table 20D provides exemplary targeting domains for correcting a mutation (e.g., N1303K) in the CFTR gene selected according to the fourth tier parameters. The targeting domains bind within 200 bp from a mutation (e.g., N1303K), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 20D

4th Tier

| gRNA Name | DNA Strand | Targeting Domain | Target Site Length | Seq ID |
|---|---|---|---|---|
| CFTR-N1303K-65 | + | ACAUGCACACAAAGUGUG | 18 | 2287 |
| CFTR-N1303K-66 | + | UACAUGCACACAAAGUGUG | 19 | 2288 |
| CFTR-N1303K-67 | + | AUACAUGCACACAAAGUGUG | 20 | 2289 |
| CFTR-N1303K-68 | + | CAUACAUGCACACAAAGUGUG | 21 | 2290 |
| CFTR-N1303K-69 | + | ACAUACAUGCACACAAAGUGUG | 22 | 2291 |
| CFTR-N1303K-70 | + | CACAUACAUGCACACAAAGUGUG | 23 | 2292 |
| CFTR-N1303K-71 | + | ACACAUACAUGCACACAAAGUGUG | 24 | 2293 |
| CFTR-N1303K-72 | + | AGAAAAGAAGAAGAAAGU | 18 | 2294 |
| CFTR-N1303K-73 | + | AAGAAAAGAAGAAGAAAGU | 19 | 2295 |
| CFTR-N1303K-74 | + | AAAGAAAAGAAGAAGAAAGU | 20 | 2296 |
| CFTR-N1303K-75 | + | AAAAGAAAAGAAGAAGAAAGU | 21 | 2297 |
| CFTR-N1303K-76 | + | AAAAAGAAAAGAAGAAGAAAGU | 22 | 2298 |
| CFTR-N1303K-77 | + | AAAAAAGAAAAGAAGAAGAAAGU | 23 | 2299 |
| CFTR-N1303K-78 | + | CAAAAAAGAAAAGAAGAAGAAAGU | 24 | 2300 |
| CFTR-N1303K-79 | + | UCAGCCAUUUGUGUUGGU | 18 | 2301 |
| CFTR-N1303K-80 | + | AUCAGCCAUUUGUGUUGGU | 19 | 2302 |
| CFTR-N1303K-81 | + | UAUCAGCCAUUUGUGUUGGU | 20 | 2303 |
| CFTR-N1303K-82 | + | AUAUCAGCCAUUUGUGUUGGU | 21 | 2304 |
| CFTR-N1303K-83 | + | UAUAUCAGCCAUUUGUGUUGGU | 22 | 2305 |
| CFTR-N1303K-84 | + | CUAUAUCAGCCAUUUGUGUUGGU | 23 | 2306 |
| CFTR-N1303K-85 | − | UGUGUGUGCACAACUUUAAAA | 21 | 2307 |
| CFTR-N1303K-86 | − | AUGUGUGUGCACAACUUUAAAA | 22 | 2308 |
| CFTR-N1303K-87 | − | UAUGUGUGUGCACAACUUUAAAA | 23 | 2309 |
| CFTR-N1303K-88 | − | AACUGAAAUGAUUUUGAA | 18 | 2310 |
| CFTR-N1303K-89 | − | UAACUGAAAUGAUUUUGAA | 19 | 2311 |
| CFTR-N1303K-33 | − | CUAACUGAAAUGAUUUUGAA | 20 | 2255 |
| CFTR-N1303K-90 | − | UGGAACAUUUAGAAAAAAG | 19 | 2312 |
| CFTR-N1303K-91 | − | CUGGAACAUUUAGAAAAAAG | 20 | 2313 |
| CFTR-N1303K-92 | − | UCUGGAACAUUUAGAAAAAAG | 21 | 2314 |
| CFTR-N1303K-93 | − | UUCUGGAACAUUUAGAAAAAAG | 22 | 2315 |
| CFTR-N1303K-94 | − | UUUCUGGAACAUUUAGAAAAAAG | 23 | 2316 |
| CFTR-N1303K-95 | − | UUUUCUGGAACAUUUAGAAAAAAG | 24 | 2317 |
| CFTR-N1303K-96 | − | UUGGAUCCCUAUGAACAG | 18 | 2318 |
| CFTR-N1303K-40 | − | AGUUGGAUCCCUAUGAACAG | 20 | 2262 |
| CFTR-N1303K-97 | − | AAGUUGGAUCCCUAUGAACAG | 21 | 2319 |

TABLE 20D-continued

4th Tier

| gRNA Name | DNA Strand | Targeting Domain | Target Site Length | Seq ID |
|---|---|---|---|---|
| CFTR-N1303K-98 | − | AAAGUUGGAUCCCUAUGAACAG | 22 | 2320 |
| CFTR-N1303K-99 | − | AAAAGUUGGAUCCCUAUGAACAG | 23 | 2321 |
| CFTR-N1303K-100 | − | AAAAAGUUGGAUCCCUAUGAACAG | 24 | 2322 |

Table 20E provides exemplary targeting domains for correcting a mutation (e.g., N1303K) in the CFTR gene selected according to the fifth tier parameters. The targeting domains bind within 200 bp from a mutation (e.g., N1303K), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 20E

5th Tier

| gRNA Name | DNA Strand | Targeting Domain | Target Site Length | Seq ID |
|---|---|---|---|---|
| CFTR-N1303K-101 | + | AUACUUUCUAUAGCAAAA | 18 | 2323 |
| CFTR-N1303K-102 | + | AAUACUUUCUAUAGCAAAA | 19 | 2324 |
| CFTR-N1303K-103 | + | AAAUACUUUCUAUAGCAAAA | 20 | 2325 |
| CFTR-N1303K-104 | + | UAAAUACUUUCUAUAGCAAAA | 21 | 2326 |
| CFTR-N1303K-105 | + | AUAAAUACUUUCUAUAGCAAAA | 22 | 2327 |
| CFTR-N1303K-106 | + | AAUAAAUACUUUCUAUAGCAAAA | 23 | 2328 |
| CFTR-N1303K-107 | + | AAAUAAAUACUUUCUAUAGCAAAA | 24 | 2329 |
| CFTR-N1303K-108 | + | UUCUAUAGCAAAAAGAA | 18 | 2330 |
| CFTR-N1303K-109 | + | UUUCUAUAGCAAAAAGAA | 19 | 2331 |
| CFTR-N1303K-110 | + | CUUUCUAUAGCAAAAAGAA | 20 | 2332 |
| CFTR-N1303K-111 | + | ACUUUCUAUAGCAAAAAGAA | 21 | 2333 |
| CFTR-N1303K-112 | + | UACUUUCUAUAGCAAAAAGAA | 22 | 2334 |
| CFTR-N1303K-113 | + | AUACUUUCUAUAGCAAAAAGAA | 23 | 2335 |
| CFTR-N1303K-114 | + | AAUACUUUCUAUAGCAAAAAGAA | 24 | 2336 |
| CFTR-N1303K-115 | + | UGAUCACUCCACUGUUCA | 18 | 2337 |
| CFTR-N1303K-116 | + | UUGAUCACUCCACUGUUCA | 19 | 2338 |
| CFTR-N1303K-117 | + | CUUGAUCACUCCACUGUUCA | 20 | 2339 |
| CFTR-N1303K-118 | + | UCUUGAUCACUCCACUGUUCA | 21 | 2340 |
| CFTR-N1303K-119 | + | UUCUUGAUCACUCCACUGUUCA | 22 | 2341 |
| CFTR-N1303K-120 | + | UUUCUUGAUCACUCCACUGUUCA | 23 | 2342 |
| CFTR-N1303K-121 | + | AUUUCUUGAUCACUCCACUGUUCA | 24 | 2343 |
| CFTR-N1303K-122 | + | ACUUUUUUCUAAAUGUUC | 18 | 2344 |
| CFTR-N1303K-123 | + | AACUUUUUUCUAAAUGUUC | 19 | 2345 |
| CFTR-N1303K-124 | + | CAACUUUUUUCUAAAUGUUC | 20 | 2346 |
| CFTR-N1303K-125 | + | CCAACUUUUUUCUAAAUGUUC | 21 | 2347 |
| CFTR-N1303K-126 | + | UCCAACUUUUUUCUAAAUGUUC | 22 | 2348 |
| CFTR-N1303K-127 | + | AUCCAACUUUUUUCUAAAUGUUC | 23 | 2349 |

TABLE 20E-continued

5th Tier

| gRNA Name | DNA Strand | Targeting Domain | Target Site Length | Seq ID |
|---|---|---|---|---|
| CFTR-N1303K-128 | + | GAUCCAACUUUUUCUAAAUGUUC | 24 | 2350 |
| CFTR-N1303K-129 | + | UAUAGCAAAAAGAAAAG | 18 | 2351 |
| CFTR-N1303K-130 | + | CUAUAGCAAAAAGAAAAG | 19 | 2352 |
| CFTR-N1303K-131 | + | UCUAUAGCAAAAAGAAAAG | 20 | 2353 |
| CFTR-N1303K-132 | + | UUCUAUAGCAAAAAGAAAAG | 21 | 2354 |
| CFTR-N1303K-133 | + | UUUCUAUAGCAAAAAGAAAAG | 22 | 2355 |
| CFTR-N1303K-134 | + | CUUUCUAUAGCAAAAAGAAAAG | 23 | 2356 |
| CFTR-N1303K-135 | + | ACUUUCUAUAGCAAAAAGAAAAG | 24 | 2357 |
| CFTR-N1303K-136 | + | AUUGUAAAAUAUUUCAAG | 18 | 2358 |
| CFTR-N1303K-137 | + | UAUUGUAAAAUAUUUCAAG | 19 | 2359 |
| CFTR-N1303K-138 | + | GUAUUGUAAAAUAUUUCAAG | 20 | 2360 |
| CFTR-N1303K-139 | + | UGUAUUGUAAAAUAUUUCAAG | 21 | 2361 |
| CFTR-N1303K-140 | + | UUGUAUUGUAAAAUAUUUCAAG | 22 | 2362 |
| CFTR-N1303K-141 | + | AUUGUAUUGUAAAAUAUUUCAAG | 23 | 2363 |
| CFTR-N1303K-142 | + | UAUUGUAUUGUAAAAUAUUUCAAG | 24 | 2364 |
| CFTR-N1303K-143 | + | AGCAAAAAGAAAAGAAG | 18 | 2365 |
| CFTR-N1303K-144 | + | UAGCAAAAAGAAAAGAAG | 19 | 2366 |
| CFTR-N1303K-145 | + | AUAGCAAAAAGAAAAGAAG | 20 | 2367 |
| CFTR-N1303K-146 | + | UAUAGCAAAAAGAAAAGAAG | 21 | 2368 |
| CFTR-N1303K-147 | + | CUAUAGCAAAAAGAAAAGAAG | 22 | 2369 |
| CFTR-N1303K-148 | + | UCUAUAGCAAAAAGAAAAGAAG | 23 | 2370 |
| CFTR-N1303K-149 | + | UUCUAUAGCAAAAAGAAAAGAAG | 24 | 2371 |
| CFTR-N1303K-150 | + | GAAAAAUUAUUUUAAAAU | 18 | 2372 |
| CFTR-N1303K-151 | + | AGAAAAAUUAUUUUAAAAU | 19 | 2373 |
| CFTR-N1303K-152 | + | UAGAAAAAUUAUUUUAAAAU | 20 | 2374 |
| CFTR-N1303K-153 | + | GUAGAAAAAUUAUUUUAAAAU | 21 | 2375 |
| CFTR-N1303K-154 | + | AGUAGAAAAAUUAUUUUAAAAU | 22 | 2376 |
| CFTR-N1303K-155 | + | AAGUAGAAAAAUUAUUUUAAAAU | 23 | 2377 |
| CFTR-N1303K-156 | + | CAAGUAGAAAAAUUAUUUUAAAAU | 24 | 2378 |
| CFTR-N1303K-157 | − | UGUGUGCACAACUUUAAA | 18 | 2379 |
| CFTR-N1303K-158 | − | GUGUGUGCACAACUUUAAA | 19 | 2380 |
| CFTR-N1303K-159 | − | UGUGUGUGCACAACUUUAAA | 20 | 2381 |
| CFTR-N1303K-160 | − | AUGUGUGUGCACAACUUUAAA | 21 | 2382 |
| CFTR-N1303K-161 | − | UAUGUGUGUGCACAACUUUAAA | 22 | 2383 |
| CFTR-N1303K-162 | − | GUAUGUGUGUGCACAACUUUAAA | 23 | 2384 |
| CFTR-N1303K-163 | − | UGUAUGUGUGUGCACAACUUUAAA | 24 | 2385 |
| CFTR-N1303K-164 | − | UAUUUUACAAUACAAUAA | 18 | 2386 |

TABLE 20E-continued

| | | 5th Tier | | |
|---|---|---|---|---|
| gRNA Name | DNA Strand | Targeting Domain | Target Site Length | Seq ID |
| CFTR-N1303K-165 | - | AUAUUUACAAUACAAUAA | 19 | 2387 |
| CFTR-N1303K-34 | - | AAUAUUUACAAUACAAUAA | 20 | 2256 |
| CFTR-N1303K-166 | - | AAAUAUUUACAAUACAAUAA | 21 | 2388 |
| CFTR-N1303K-167 | - | GAAAUAUUUACAAUACAAUAA | 22 | 2389 |
| CFTR-N1303K-168 | - | UGAAAUAUUUACAAUACAAUAA | 23 | 2390 |
| CFTR-N1303K-169 | - | UUGAAAUAUUUACAAUACAAUAA | 24 | 2391 |
| CFTR-N1303K-170 | - | AUGAGGUAAGGCUGCUAA | 18 | 2392 |
| CFTR-N1303K-171 | - | GAUGAGGUAAGGCUGCUAA | 19 | 2393 |
| CFTR-N1303K-172 | - | AGAUGAGGUAAGGCUGCUAA | 20 | 2394 |
| CFTR-N1303K-173 | - | CAGAUGAGGUAAGGCUGCUAA | 21 | 2395 |
| CFTR-N1303K-174 | - | GCAGAUGAGGUAAGGCUGCUAA | 22 | 2396 |
| CFTR-N1303K-175 | - | UGCAGAUGAGGUAAGGCUGCUAA | 23 | 2397 |
| CFTR-N1303K-176 | - | UUGCAGAUGAGGUAAGGCUGCUAA | 24 | 2398 |
| CFTR-N1303K-177 | - | GUUGGAUCCCUAUGAACA | 18 | 2399 |
| CFTR-N1303K-178 | - | AGUUGGAUCCCUAUGAACA | 19 | 2400 |
| CFTR-N1303K-179 | - | AAGUUGGAUCCCUAUGAACA | 20 | 2401 |
| CFTR-N1303K-180 | - | AAAGUUGGAUCCCUAUGAACA | 21 | 2402 |
| CFTR-N1303K-181 | - | AAAAGUUGGAUCCCUAUGAACA | 22 | 2403 |
| CFTR-N1303K-182 | - | AAAAAGUUGGAUCCCUAUGAACA | 23 | 2404 |
| CFTR-N1303K-183 | - | AAAAAAGUUGGAUCCCUAUGAACA | 24 | 2405 |
| CFTR-N1303K-184 | - | UAAAAUAUUAAAAUUUGA | 18 | 2406 |
| CFTR-N1303K-185 | - | AUAAAAUAUUAAAAUUUGA | 19 | 2407 |
| CFTR-N1303K-186 | - | GAUAAAAUAUUAAAAUUUGA | 20 | 2408 |
| CFTR-N1303K-187 | - | UGAUAAAAUAUUAAAAUUUGA | 21 | 2409 |
| CFTR-N1303K-188 | - | AUGAUAAAAUAUUAAAAUUUGA | 22 | 2410 |
| CFTR-N1303K-189 | - | CAUGAUAAAAUAUUAAAAUUUGA | 23 | 2411 |
| CFTR-N1303K-190 | - | ACAUGAUAAAAUAUUAAAAUUUGA | 24 | 2412 |
| CFTR-N1303K-191 | - | UAACUGAAAUGAUUUGA | 18 | 2413 |
| CFTR-N1303K-192 | - | CUAACUGAAAUGAUUUGA | 19 | 2414 |
| CFTR-N1303K-193 | - | GCUAACUGAAAUGAUUUGA | 20 | 2415 |
| CFTR-N1303K-194 | - | UGCUAACUGAAAUGAUUUGA | 21 | 2416 |
| CFTR-N1303K-195 | - | CUGCUAACUGAAAUGAUUUGA | 22 | 2417 |
| CFTR-N1303K-196 | - | GCUGCUAACUGAAAUGAUUUGA | 23 | 2418 |
| CFTR-N1303K-197 | - | GGCUGCUAACUGAAAUGAUUUGA | 24 | 2419 |
| CFTR-N1303K-198 | - | UGGAGUGAUCAAGAAAUA | 18 | 2420 |
| CFTR-N1303K-199 | - | GUGGAGUGAUCAAGAAAUA | 19 | 2421 |
| CFTR-N1303K-18 | - | AGUGGAGUGAUCAAGAAAUA | 20 | 2240 |
| CFTR-N1303K-200 | - | CAGUGGAGUGAUCAAGAAAUA | 21 | 2422 |

TABLE 20E-continued

5th Tier

| gRNA Name | DNA Strand | Targeting Domain | Target Site Length | Seq ID |
|---|---|---|---|---|
| CFTR-N1303K-201 | - | ACAGUGGAGUGAUCAAGAAAUA | 22 | 2423 |
| CFTR-N1303K-202 | - | AACAGUGGAGUGAUCAAGAAAUA | 23 | 2424 |
| CFTR-N1303K-203 | - | GAACAGUGGAGUGAUCAAGAAAUA | 24 | 2425 |
| CFTR-N1303K-204 | - | AUAUUUUACAAUACAAUA | 18 | 2426 |
| CFTR-N1303K-205 | - | AAUAUUUUACAAUACAAUA | 19 | 2427 |
| CFTR-N1303K-36 | - | AAAUAUUUUACAAUACAAUA | 20 | 2258 |
| CFTR-N1303K-206 | - | GAAAUAUUUUACAAUACAAUA | 21 | 2428 |
| CFTR-N1303K-207 | - | UGAAAUAUUUUACAAUACAAUA | 22 | 2429 |
| CFTR-N1303K-208 | - | UUGAAAUAUUUUACAAUACAAUA | 23 | 2430 |
| CFTR-N1303K-209 | - | CUUGAAAUAUUUUACAAUACAAUA | 24 | 2431 |
| CFTR-N1303K-210 | - | UUCUUUUCUUUUUGCUA | 18 | 2432 |
| CFTR-N1303K-211 | - | CUUCUUUUCUUUUUGCUA | 19 | 2433 |
| CFTR-N1303K-212 | - | UCUUCUUUUCUUUUUGCUA | 20 | 2434 |
| CFTR-N1303K-213 | - | UUCUUCUUUUCUUUUUGCUA | 21 | 2435 |
| CFTR-N1303K-214 | - | CUUCUUCUUUUCUUUUUGCUA | 22 | 2436 |
| CFTR-N1303K-215 | - | UCUUCUUCUUUUCUUUUUGCUA | 23 | 2437 |
| CFTR-N1303K-216 | - | UUCUUCUUCUUUUCUUUUUGCUA | 24 | 2438 |
| CFTR-N1303K-217 | - | UGGAGUACCCUAACAUAC | 18 | 2439 |
| CFTR-N1303K-218 | - | AUGGAGUACCCUAACAUAC | 19 | 2440 |
| CFTR-N1303K-219 | - | AAUGGAGUACCCUAACAUAC | 20 | 2441 |
| CFTR-N1303K-220 | - | AAAUGGAGUACCCUAACAUAC | 21 | 2442 |
| CFTR-N1303K-221 | - | AAAAUGGAGUACCCUAACAUAC | 22 | 2443 |
| CFTR-N1303K-222 | - | UAAAAUGGAGUACCCUAACAUAC | 23 | 2444 |
| CFTR-N1303K-223 | - | UUAAAAUGGAGUACCCUAACAUAC | 24 | 2445 |
| CFTR-N1303K-224 | - | UUAAAAUAAUUUUUCUAC | 18 | 2446 |
| CFTR-N1303K-225 | - | UUUAAAAUAAUUUUUCUAC | 19 | 2447 |
| CFTR-N1303K-226 | - | UUUUAAAAUAAUUUUUCUAC | 20 | 2448 |
| CFTR-N1303K-227 | - | AUUUUAAAAUAAUUUUUCUAC | 21 | 2449 |
| CFTR-N1303K-228 | - | UAUUUUAAAAUAAUUUUUCUAC | 22 | 2450 |
| CFTR-N1303K-229 | - | UUAUUUUAAAAUAAUUUUUCUAC | 23 | 2451 |
| CFTR-N1303K-230 | - | CUUAUUUUAAAAUAAUUUUUCUAC | 24 | 2452 |
| CFTR-N1303K-231 | - | GGAGUACCCUAACAUACC | 18 | 2453 |
| CFTR-N1303K-232 | - | UGGAGUACCCUAACAUACC | 19 | 2454 |
| CFTR-N1303K-37 | - | AUGGAGUACCCUAACAUACC | 20 | 2259 |
| CFTR-N1303K-233 | - | AAUGGAGUACCCUAACAUACC | 21 | 2455 |
| CFTR-N1303K-234 | - | AAAUGGAGUACCCUAACAUACC | 22 | 2456 |
| CFTR-N1303K-235 | - | AAAAUGGAGUACCCUAACAUACC | 23 | 2457 |

TABLE 20E-continued

| | | 5th Tier | | |
|---|---|---|---|---|
| gRNA Name | DNA Strand | Targeting Domain | Target Site Length | Seq ID |
| CFTR-N1303K-236 | - | UAAAAUGGAGUACCCUAACAUACC | 24 | 2458 |
| CFTR-N1303K-237 | - | AUGAACAGUGGAGUGAUC | 18 | 2459 |
| CFTR-N1303K-238 | - | UAUGAACAGUGGAGUGAUC | 19 | 2460 |
| CFTR-N1303K-239 | - | CUAUGAACAGUGGAGUGAUC | 20 | 2461 |
| CFTR-N1303K-240 | - | CCUAUGAACAGUGGAGUGAUC | 21 | 2462 |
| CFTR-N1303K-241 | - | CCCUAUGAACAGUGGAGUGAUC | 22 | 2463 |
| CFTR-N1303K-242 | - | UCCCUAUGAACAGUGGAGUGAUC | 23 | 2464 |
| CFTR-N1303K-243 | - | AUCCCUAUGAACAGUGGAGUGAUC | 24 | 2465 |
| CFTR-N1303K-244 | - | GAAAGUAUUUAUUUUUC | 18 | 2466 |
| CFTR-N1303K-245 | - | AGAAAGUAUUUAUUUUUC | 19 | 2467 |
| CFTR-N1303K-38 | - | UAGAAAGUAUUUAUUUUUC | 20 | 2260 |
| CFTR-N1303K-246 | - | AUAGAAAGUAUUUAUUUUUC | 21 | 2468 |
| CFTR-N1303K-247 | - | UAUAGAAAGUAUUUAUUUUUC | 22 | 2469 |
| CFTR-N1303K-248 | - | CUAUAGAAAGUAUUUAUUUUUC | 23 | 2470 |
| CFTR-N1303K-249 | - | GCUAUAGAAAGUAUUUAUUUUUC | 24 | 2471 |
| CFTR-N1303K-250 | - | AAAUAUGGAAAGUUGCAG | 18 | 2472 |
| CFTR-N1303K-251 | - | GAAAUAUGGAAAGUUGCAG | 19 | 2473 |
| CFTR-N1303K-252 | - | AGAAAUAUGGAAAGUUGCAG | 20 | 2474 |
| CFTR-N1303K-253 | - | AAGAAAUAUGGAAAGUUGCAG | 21 | 2475 |
| CFTR-N1303K-254 | - | CAAGAAAUAUGGAAAGUUGCAG | 22 | 2476 |
| CFTR-N1303K-255 | - | UCAAGAAAUAUGGAAAGUUGCAG | 23 | 2477 |
| CFTR-N1303K-256 | - | AUCAAGAAAUAUGGAAAGUUGCAG | 24 | 2478 |
| CFTR-N1303K-257 | - | AUGAUAAAAUAUUAAAAU | 18 | 2479 |
| CFTR-N1303K-258 | - | CAUGAUAAAAUAUUAAAAU | 19 | 2480 |
| CFTR-N1303K-259 | - | ACAUGAUAAAAUAUUAAAAU | 20 | 2481 |
| CFTR-N1303K-260 | - | GUGGAGUGAUCAAGAAAU | 18 | 2482 |
| CFTR-N1303K-261 | - | AGUGGAGUGAUCAAGAAAU | 19 | 2483 |
| CFTR-N1303K-262 | - | CAGUGGAGUGAUCAAGAAAU | 20 | 2484 |
| CFTR-N1303K-263 | - | ACAGUGGAGUGAUCAAGAAAU | 21 | 2485 |
| CFTR-N1303K-264 | - | AACAGUGGAGUGAUCAAGAAAU | 22 | 2486 |
| CFTR-N1303K-265 | - | GAACAGUGGAGUGAUCAAGAAAU | 23 | 2487 |
| CFTR-N1303K-266 | - | UGAACAGUGGAGUGAUCAAGAAAU | 24 | 2488 |
| CFTR-N1303K-267 | - | AAUAUUUUACAAUACAAU | 18 | 2489 |
| CFTR-N1303K-268 | - | AAAUAUUUUACAAUACAAU | 19 | 2490 |
| CFTR-N1303K-269 | - | GAAAUAUUUUACAAUACAAU | 20 | 2491 |
| CFTR-N1303K-270 | - | UGAAAUAUUUUACAAUACAAU | 21 | 2492 |
| CFTR-N1303K-271 | - | UUGAAAUAUUUUACAAUACAAU | 22 | 2493 |
| CFTR-N1303K-272 | - | CUUGAAAUAUUUUACAAUACAAU | 23 | 2494 |

TABLE 20E-continued

| | | 5th Tier | | |
|---|---|---|---|---|
| gRNA Name | DNA Strand | Targeting Domain | Target Site Length | Seq ID |
| CFTR-N1303K-273 | − | ACUUGAAAUAUUUUACAAUACAAU | 24 | 2495 |
| CFTR-N1303K-274 | − | GAAAAAAGUUGGAUCCCU | 18 | 2496 |
| CFTR-N1303K-275 | − | AGAAAAAAGUUGGAUCCCU | 19 | 2497 |
| CFTR-N1303K-276 | − | UAGAAAAAAGUUGGAUCCCU | 20 | 2498 |
| CFTR-N1303K-277 | − | UUAGAAAAAAGUUGGAUCCCU | 21 | 2499 |
| CFTR-N1303K-278 | − | UUUAGAAAAAAGUUGGAUCCCU | 22 | 2500 |
| CFTR-N1303K-279 | − | AUUUAGAAAAAAGUUGGAUCCCU | 23 | 2501 |
| CFTR-N1303K-280 | − | CAUUUAGAAAAAAGUUGGAUCCCU | 24 | 2502 |
| CFTR-N1303K-281 | − | UAUUUUUUCUGGAACAUU | 18 | 2503 |
| CFTR-N1303K-282 | − | UUAUUUUUUCUGGAACAUU | 19 | 2504 |
| CFTR-N1303K-283 | − | UUUAUUUUUUCUGGAACAUU | 20 | 2505 |
| CFTR-N1303K-284 | − | AUUUAUUUUUUCUGGAACAUU | 21 | 2506 |
| CFTR-N1303K-285 | − | UAUUUAUUUUUUCUGGAACAUU | 22 | 2507 |
| CFTR-N1303K-286 | − | GUAUUUAUUUUUUCUGGAACAUU | 23 | 2508 |
| CFTR-N1303K-287 | − | AGUAUUUAUUUUUUCUGGAACAUU | 24 | 2509 |
| CFTR-N1303K-288 | − | CUGCUAACUGAAAUGAUU | 18 | 2510 |
| CFTR-N1303K-289 | − | GCUGCUAACUGAAAUGAUU | 19 | 2511 |
| CFTR-N1303K-290 | − | GGCUGCUAACUGAAAUGAUU | 20 | 2512 |
| CFTR-N1303K-291 | − | AGGCUGCUAACUGAAAUGAUU | 21 | 2513 |
| CFTR-N1303K-292 | − | AAGGCUGCUAACUGAAAUGAUU | 22 | 2514 |
| CFTR-N1303K-293 | − | UAAGGCUGCUAACUGAAAUGAUU | 23 | 2515 |
| CFTR-N1303K-294 | − | GUAAGGCUGCUAACUGAAAUGAUU | 24 | 2516 |
| CFTR-N1303K-295 | − | GAUAAAAUAUUAAAAUUU | 18 | 2517 |
| CFTR-N1303K-296 | − | UGAUAAAAUAUUAAAAUUU | 19 | 2518 |
| CFTR-N1303K-297 | − | AUGAUAAAAUAUUAAAAUUU | 20 | 2519 |
| CFTR-N1303K-298 | − | AGAAAGUAUUUAUUUUUU | 18 | 2520 |
| CFTR-N1303K-299 | − | UAGAAAGUAUUUAUUUUUU | 19 | 2521 |
| CFTR-N1303K-300 | − | AUAGAAAGUAUUUAUUUUUU | 20 | 2522 |
| CFTR-N1303K-301 | − | UAUAGAAAGUAUUUAUUUUUU | 21 | 2523 |
| CFTR-N1303K-302 | − | CUAUAGAAAGUAUUUAUUUUUU | 22 | 2524 |
| CFTR-N1303K-303 | − | GCUAUAGAAAGUAUUUAUUUUUU | 23 | 2525 |
| CFTR-N1303K-304 | − | UGCUAUAGAAAGUAUUUAUUUUUU | 24 | 2526 |

Table 21A provides exemplary targeting domains for correcting a mutation (e.g., N1303K) in the CFTR gene selected according to the first tier parameters. The targeting domains bind within 200 bp from a mutation (e.g., N1303K), have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 21A

1st Tier

| gRNA Name | DNA Strand | Targeting Domain | Target Site Length | Seq ID |
|---|---|---|---|---|
| CFTR-N1303K-305 | − | GGUAAGGCUGCUAACUG | 17 | 2527 |

Table 21B provides exemplary targeting domains for correcting a mutation (e.g., N1303K) in the CFTR gene selected according to the second tier parameters. The targeting domains bind within 200 bp from a mutation (e.g., N1303K) and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 21B

2nd Tier

| gRNA Name | DNA Strand | Targeting Domain | Target Site Length | Seq ID |
|---|---|---|---|---|
| CFTR-N1303K-306 | − | UGAGGUAAGGCUGCUAACUG | 20 | 2528 |

Table 22A provides exemplary targeting domains for correcting a mutation (e.g., R117H) in the CFTR gene selected according to the first tier parameters. The targeting domains bind within 200 bp from a mutation (e.g., R117H), have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 22A

1st Tier

| gRNA Name | DNA Strand | Targeting Domain | Target Site Length | Seq ID |
|---|---|---|---|---|
| CFTR-R117H-1 | + | GUGAUGAAGGCCAAAAA | 17 | 2529 |
| CFTR-R117H-2 | + | GGUGACUUCCUACAAAA | 17 | 2530 |
| CFTR-R117H-3 | + | GCCAUGGGGCCUGUGCA | 17 | 2531 |
| CFTR-R117H-4 | + | GCAUUCCAAUGUGAUGA | 17 | 2532 |
| CFTR-R117H-5 | − | GUAAUACUUCCUUGCAC | 17 | 2533 |
| CFTR-R117H-6 | + | GUGACUUCCUACAAAAG | 17 | 2534 |
| CFTR-R117H-7 | − | GCCUUCUCUUUAUUGUG | 17 | 2535 |
| CFTR-R117H-8 | − | GCGAUUUAUCUAGGCAU | 17 | 2536 |
| CFTR-R117H-9 | − | GUACAGCCUCUCUUACU | 17 | 2537 |
| CFTR-R117H-10 | + | GAAGGCCAAAAAUGGCU | 17 | 2538 |
| CFTR-R117H-11 | + | GAGAGGCUGUACUGCUU | 17 | 2539 |
| CFTR-R117H-12 | + | GAUACAGAAUAUAUGUGCCA | 20 | 2540 |
| CFTR-R117H-13 | − | GUCUUGUGUUGAAAUUCUCA | 20 | 2541 |
| CFTR-R117H-14 | + | GUGUCCUCACAAUAAAGAGA | 20 | 2542 |
| CFTR-R117H-15 | − | GCAGUACAGCCUCUCUUACU | 20 | 2543 |
| CFTR-R117H-16 | + | GAUGAAGGCCAAAAAUGGCU | 20 | 2544 |
| CFTR-R117H-17 | + | GGCCAAAAAUGGCUGGGUGU | 20 | 2545 |

Table 22B provides exemplary targeting domains for correcting a mutation (e.g., R117H) in the CFTR gene selected according to the second tier parameters. The targeting domains bind within 200 bp from a mutation (e.g., R117H) and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 22B

2nd Tier

| gRNA Name | DNA Strand | Targeting Domain | Target Site Length | Seq ID |
|---|---|---|---|---|
| CFTR-R117H-18 | + | UGGUGACUUCCUACAAA | 17 | 2546 |
| CFTR-R117H-19 | − | CUAUGACCCGGAUAACA | 17 | 2547 |
| CFTR-R117H-20 | − | UUGUGUUGAAAUUCUCA | 17 | 2548 |
| CFTR-R117H-21 | − | UAGUUUGAUUUAUAAGA | 17 | 2549 |
| CFTR-R117H-22 | + | UCCUCACAAUAAAGAGA | 17 | 2550 |
| CFTR-R117H-23 | − | AGUACAGCCUCUCUUAC | 17 | 2551 |
| CFTR-R117H-24 | − | CAUAGCUUCCUAUGACC | 17 | 2552 |
| CFTR-R117H-25 | + | UGAAGGCCAAAAAUGGC | 17 | 2553 |
| CFTR-R117H-26 | + | UGUUCCUCCUUGUUAUC | 17 | 2554 |
| CFTR-R117H-27 | − | CUUGUGUUGAAAUUCUC | 17 | 2555 |
| CFTR-R117H-28 | + | AUUCUUCCCAGUAAGAG | 17 | 2556 |
| CFTR-R117H-29 | + | AGACUUUUCAUCUUUAG | 17 | 2557 |
| CFTR-R117H-30 | − | UGACCCGGAUAACAAGG | 17 | 2558 |
| CFTR-R117H-31 | − | UUUGGCCUUCAUCACAU | 17 | 2559 |
| CFTR-R117H-32 | + | CAGAAUAUAUGUGCCAU | 17 | 2560 |

TABLE 22B-continued

2nd Tier

| gRNA Name | DNA Strand | Targeting Domain | Target Site Length | Seq ID |
|---|---|---|---|---|
| CFTR-R117H-33 | + | CUUGUUAUCCGGGUCAU | 17 | 2561 |
| CFTR-R117H-34 | - | UCUAUCGCGAUUUAUCU | 17 | 2562 |
| CFTR-R117H-35 | + | CAAAAAUGGCUGGGUGU | 17 | 2563 |
| CFTR-R117H-36 | - | CUACACCCAGCCAUUU | 17 | 2564 |
| CFTR-R117H-37 | + | AAUGUGAUGAAGGCCAAAAA | 20 | 2565 |
| CFTR-R117H-38 | + | UUUGGUGACUUCCUACAAAA | 20 | 2566 |
| CFTR-R117H-39 | + | CUUUGGUGACUUCCUACAAA | 20 | 2567 |
| CFTR-R117H-40 | - | UUCCUAUGACCCGGAUAACA | 20 | 2568 |
| CFTR-R117H-41 | - | ACUUCCUUGCACAGGCCCCA | 20 | 2569 |
| CFTR-R117H-42 | + | UGUGCCAUGGGGCCUGUGCA | 20 | 2570 |
| CFTR-R117H-43 | + | UCUGCAUUCCAAUGUGAUGA | 20 | 2571 |
| CFTR-R117H-44 | - | AAGGUAAUACUUCCUUGCAC | 20 | 2572 |
| CFTR-R117H-45 | - | AGCAGUACAGCCUCUCUUAC | 20 | 2573 |
| CFTR-R117H-46 | - | AAUCAUAGCUUCCUAUGACC | 20 | 2574 |
| CFTR-R117H-47 | + | UGAUGAAGGCCAAAAAUGGC | 20 | 2575 |
| CFTR-R117H-48 | - | AGUCUUGUGUUGAAAUUCUC | 20 | 2576 |
| CFTR-R117H-49 | + | UUGGUGACUUCCUACAAAAG | 20 | 2577 |
| CFTR-R117H-50 | + | AUGAUUCUUCCCAGUAAGAG | 20 | 2578 |
| CFTR-R117H-51 | + | CUUAAAAUGAGUUUAUAUAG | 20 | 2579 |
| CFTR-R117H-52 | + | ACAAGACUUUUCAUCUUUAG | 20 | 2580 |
| CFTR-R117H-53 | - | CUAUGACCCGGAUAACAAG | 20 | 2581 |
| CFTR-R117H-54 | + | UACAGAAUAUAUGUGCCAUG | 20 | 2582 |
| CFTR-R117H-55 | - | UAUGCCUUCUCUUUAUUGUG | 20 | 2583 |
| CFTR-R117H-56 | - | AUUUUUGGCCUUCAUCACAU | 20 | 2584 |
| CFTR-R117H-57 | + | AUACAGAAUAUAUGUGCCAU | 20 | 2585 |
| CFTR-R117H-58 | - | AUCGCGAUUUAUCUAGGCAU | 20 | 2586 |
| CFTR-R117H-59 | + | CUCCUUGUUAUCCGGGUCAU | 20 | 2587 |
| CFTR-R117H-60 | + | UAAGAGAGGCUGUACUGCUU | 20 | 2588 |
| CFTR-R117H-61 | - | CUCCUACACCCAGCCAUUUU | 20 | 2589 |

Table 22C provides exemplary targeting domains for correcting a mutation (e.g., R117H) in the CFTR gene selected according to the third tier parameters. The targeting domains bind within 200 bp from a mutation (e.g., R117H) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 22C

3rd Tier

| gRNA Name | DNA Strand | Targeting Domain | Target Site Length | Seq ID |
|---|---|---|---|---|
| CFTR-R117H-62 | + | GUUCCUCCUUGUUAUCC | 17 | 2590 |
| CFTR-R117H-63 | - | GUUUAGUUUGAUUUAUAAGA | 20 | 2591 |
| CFTR-R117H-64 | + | GAGUGUUCCUCCUUGUUAUC | 20 | 2592 |

Table 22D provides exemplary targeting domains for correcting a mutation (e.g., R117H) in the CFTR gene selected according to the fourth tier parameters. The targeting domains bind within 200 bp from a mutation (e.g., R117H). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 22D

4th Tier

| gRNA Name | DNA Strand | Targeting Domain | Target Site Length | Seq ID |
|---|---|---|---|---|
| CFTR-R117H-65 | - | UCCUUGCACAGGCCCCA | 17 | 2593 |
| CFTR-R117H-66 | + | ACAGAAUAUAUGUGCCA | 17 | 2594 |
| CFTR-R117H-67 | + | AAAUGAGUUUAUAUAGA | 17 | 2595 |
| CFTR-R117H-68 | + | AAAAUGAGUUUAUAUAG | 17 | 2596 |
| CFTR-R117H-69 | + | AGAAUAUAUGUGCCAUG | 17 | 2597 |

TABLE 22D-continued

4th Tier

| gRNA Name | DNA Strand | Targeting Domain | Target Site Length | Seq ID |
|---|---|---|---|---|
| CFTR-R117H-70 | − | UGUUUUCCCCUUUUGU | 17 | 2598 |
| CFTR-R117H-71 | + | UUAAAAUGAGUUUAUAUAGA | 20 | 2599 |
| CFTR-R117H-72 | + | AGUGUUCCUCCUUGUUAUCC | 20 | 2600 |
| CFTR-R117H-73 | − | CACUCUAUCGCGAUUUAUCU | 20 | 2601 |
| CFTR-R117H-74 | − | CUCUGUUUUUCCCCUUUUGU | 20 | 2602 |

Table 23A provides exemplary targeting domains for correcting a mutation (e.g., R117H) in the CFTR gene selected according to the first tier parameters. The targeting domains bind within 200 bp from a mutation (e.g., R117H), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 23A

1st Tier

| gRNA Name | DNA Strand | Targeting Domain | Target Site Length | Seq ID |
|---|---|---|---|---|
| CFTR-R117H-75 | + | GCCUAUGCCUAGAUAAAUCGCGA | 23 | 2603 |
| CFTR-R117H-76 | + | GAUGAAGGCCAAAAAUGG | 18 | 2604 |
| CFTR-R117H-77 | + | GUGAUGAAGGCCAAAAAUGG | 20 | 2605 |
| CFTR-R117H-78 | − | GAAUCAUAGCUUCCUAUGAC | 20 | 2606 |
| CFTR-R117H-79 | − | GAAGAAUCAUAGCUUCCUAUGAC | 23 | 2607 |
| CFTR-R117H-80 | − | GGAAGAAUCAUAGCUUCCUAUGAC | 24 | 2608 |
| CFTR-R117H-81 | − | GUACAGCCUCUCUUACUGGG | 20 | 2609 |
| CFTR-R117H-82 | − | GCAGUACAGCCUCUCUUACUGGG | 23 | 2610 |
| CFTR-R117H-83 | − | GCCAUUUUUGGCCUUCAUCACAU | 23 | 2611 |
| CFTR-R117H-84 | − | GUCUUGUGUUGAAAUUCU | 18 | 2612 |
| CFTR-R117H-85 | − | GAAAAGUCUUGUGUUGAAAUUCU | 23 | 2613 |

Table 23B provides exemplary targeting domains for correcting a mutation (e.g., R117H) in the CFTR gene selected according to the second tier parameters. The targeting domains bind within 200 bp from a mutation (e.g., R117H), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 23B

2nd Tier

| gRNA Name | DNA Strand | Targeting Domain | Target Site Length | Seq ID |
|---|---|---|---|---|
| CFTR-R117H-86 | + | CUUUAGAGGAGACUUAAA | 18 | 2614 |
| CFTR-R117H-87 | + | UCUUUAGAGGAGACUUAAA | 19 | 2615 |
| CFTR-R117H-88 | + | AUCUUUAGAGGAGACUUAAA | 20 | 2616 |
| CFTR-R117H-89 | + | CAUCUUUAGAGGAGACUUAAA | 21 | 2617 |
| CFTR-R117H-90 | + | UCAUCUUUAGAGGAGACUUAAA | 22 | 2618 |
| CFTR-R117H-91 | + | UUCAUCUUUAGAGGAGACUUAAA | 23 | 2619 |
| CFTR-R117H-92 | + | UUUCAUCUUUAGAGGAGACUUAAA | 24 | 2620 |
| CFTR-R117H-93 | + | UGCCUAGAUAAAUCGCGA | 18 | 2621 |
| CFTR-R117H-94 | + | AUGCCUAGAUAAAUCGCGA | 19 | 2622 |
| CFTR-R117H-95 | + | UAUGCCUAGAUAAAUCGCGA | 20 | 2623 |
| CFTR-R117H-96 | + | CUAUGCCUAGAUAAAUCGCGA | 21 | 2624 |
| CFTR-R117H-97 | + | CCUAUGCCUAGAUAAAUCGCGA | 22 | 2625 |

TABLE 23B-continued

2nd Tier

| gRNA Name | DNA Strand | Targeting Domain | Target Site Length | Seq ID |
|---|---|---|---|---|
| CFTR-R117H-98 | + | AGCCUAUGCCUAGAUAAAUCGCGA | 24 | 2626 |
| CFTR-R117H-99 | + | AUUAAAACAUGUACGAUA | 18 | 2627 |
| CFTR-R117H-100 | + | CAUUAAAACAUGUACGAUA | 19 | 2628 |
| CFTR-R117H-101 | + | ACAUUAAAACAUGUACGAUA | 20 | 2629 |
| CFTR-R117H-102 | + | UUAAAAUGAGUUUAUAUA | 18 | 2630 |
| CFTR-R117H-103 | + | CUUAAAAUGAGUUUAUAUA | 19 | 2631 |
| CFTR-R117H-104 | + | ACUUAAAAUGAGUUUAUAUA | 20 | 2632 |
| CFTR-R117H-105 | + | UGAUGAAGGCCAAAAAUGG | 19 | 2633 |
| CFTR-R117H-106 | + | UGUGAUGAAGGCCAAAAAUGG | 21 | 2634 |
| CFTR-R117H-107 | + | AUGUGAUGAAGGCCAAAAAUGG | 22 | 2635 |
| CFTR-R117H-108 | + | AAUGUGAUGAAGGCCAAAAAUGG | 23 | 2636 |
| CFTR-R117H-109 | + | CAAUGUGAUGAAGGCCAAAAAUGG | 24 | 2637 |
| CFTR-R117H-110 | + | UUUCUCAUAAAAUACCCU | 18 | 2638 |
| CFTR-R117H-111 | + | AUUUCUCAUAAAAUACCCU | 19 | 2639 |
| CFTR-R117H-112 | + | UAUUUCUCAUAAAAUACCCU | 20 | 2640 |
| CFTR-R117H-113 | − | AUCAUAGCUUCCUAUGAC | 18 | 2641 |
| CFTR-R117H-114 | − | AAUCAUAGCUUCCUAUGAC | 19 | 2642 |
| CFTR-R117H-115 | − | AGAAUCAUAGCUUCCUAUGAC | 21 | 2643 |
| CFTR-R117H-116 | − | AAGAAUCAUAGCUUCCUAUGAC | 22 | 2644 |
| CFTR-R117H-117 | − | ACAGCCUCUCUUACUGGG | 18 | 2645 |
| CFTR-R117H-118 | − | UACAGCCUCUCUUACUGGG | 19 | 2646 |
| CFTR-R117H-119 | − | AGUACAGCCUCUCUUACUGGG | 21 | 2647 |
| CFTR-R117H-120 | − | CAGUACAGCCUCUCUUACUGGG | 22 | 2648 |
| CFTR-R117H-121 | − | AGCAGUACAGCCUCUCUUACUGGG | 24 | 2649 |
| CFTR-R117H-122 | − | UUUUGGCCUUCAUCACAU | 18 | 2650 |
| CFTR-R117H-123 | − | UUUUUGGCCUUCAUCACAU | 19 | 2651 |
| CFTR-R117H-56 | − | AUUUUUGGCCUUCAUCACAU | 20 | 2584 |
| CFTR-R117H-124 | − | CAUUUUUGGCCUUCAUCACAU | 21 | 2652 |
| CFTR-R117H-125 | − | CCAUUUUUGGCCUUCAUCACAU | 22 | 2653 |
| CFTR-R117H-126 | − | AGCCAUUUUUGGCCUUCAUCACAU | 24 | 2654 |
| CFTR-R117H-127 | − | AGUCUUGUGUUGAAAUUCU | 19 | 2655 |
| CFTR-R117H-128 | − | AAGUCUUGUGUUGAAAUUCU | 20 | 2656 |
| CFTR-R117H-129 | − | AAAGUCUUGUGUUGAAAUUCU | 21 | 2657 |
| CFTR-R117H-130 | − | AAAAGUCUUGUGUUGAAAUUCU | 22 | 2658 |
| CFTR-R117H-131 | − | UGAAAAGUCUUGUGUUGAAAUUCU | 24 | 2659 |

Table 23C provides exemplary targeting domains for correcting a mutation (e.g., R117H) in the CFTR gene selected according to the third tier parameters. The targeting domains bind within 200 bp from a mutation (e.g., R117H), start with a 5'G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 23C

| | | | | |
|---|---|---|---|---|
| | | 3rd Tier | | |
| gRNA Name | DNA Strand | Targeting Domain | Target Site Length | Seq ID |
| CFTR-R117H-132 | + | GACUUAAAAUGAGUUUAUAUA | 21 | 2660 |
| CFTR-R117H-133 | + | GAGACUUAAAAUGAGUUUAUAUA | 23 | 2661 |
| CFTR-R117H-134 | + | GGAGACUUAAAAUGAGUUUAUAUA | 24 | 2662 |

TABLE 23C-continued

| | | | | |
|---|---|---|---|---|
| | | 3rd Tier | | |
| gRNA Name | DNA Strand | Targeting Domain | Target Site Length | Seq ID |
| CFTR-R117H-135 | + | GAGUGUUCCUCCUUGUUAU | 19 | 2663 |
| CFTR-R117H-136 | + | GAUAGAGUGUUCCUCCUUGUUAU | 23 | 2664 |

Table 23D provides exemplary targeting domains for correcting a mutation (e.g., R117H) in the CFTR gene selected according to the fourth tier parameters. The targeting domains bind within 200 bp from a mutation (e.g., R117H), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 23D

| | | | | |
|---|---|---|---|---|
| | | 4th Tier | | |
| gRNA Name | DNA Strand | Targeting Domain | Target Site Length | Seq ID |
| CFTR-R117H-137 | + | AGACUUAAAAUGAGUUUAUAUA | 22 | 2665 |
| CFTR-R117H-138 | + | AGUGUUCCUCCUUGUUAU | 18 | 2666 |
| CFTR-R117H-139 | + | AGAGUGUUCCUCCUUGUUAU | 20 | 2667 |
| CFTR-R117H-140 | + | UAGAGUGUUCCUCCUUGUUAU | 21 | 2668 |
| CFTR-R117H-141 | + | AUAGAGUGUUCCUCCUUGUUAU | 22 | 2669 |
| CFTR-R117H-142 | + | CGAUAGAGUGUUCCUCCUUGUUAU | 24 | 2670 |
| CFTR-R117H-143 | + | UUAUUUCUCAUAAAAUACCCU | 21 | 2671 |
| CFTR-R117H-144 | + | UUUAUUUCUCAUAAAAUACCCU | 22 | 2672 |
| CFTR-R117H-145 | + | AUUUAUUUCUCAUAAAAUACCCU | 23 | 2673 |
| CFTR-R117H-146 | + | CAUUUAUUUCUCAUAAAAUACCCU | 24 | 2674 |
| CFTR-R117H-147 | − | UCACAUUGGAAUGCAGAU | 18 | 2675 |
| CFTR-R117H-148 | − | AUCACAUUGGAAUGCAGAU | 19 | 2676 |
| CFTR-R117H-149 | − | CAUCACAUUGGAAUGCAGAU | 20 | 2677 |
| CFTR-R117H-150 | − | UCAUCACAUUGGAAUGCAGAU | 21 | 2678 |
| CFTR-R117H-151 | − | UUCAUCACAUUGGAAUGCAGAU | 22 | 2679 |
| CFTR-R117H-152 | − | CUUCAUCACAUUGGAAUGCAGAU | 23 | 2680 |
| CFTR-R117H-153 | − | CCUUCAUCACAUUGGAAUGCAGAU | 24 | 2681 |

Table 23E provides exemplary targeting domains for correcting a mutation (e.g., R117H) in the CFTR gene selected according to the fifth tier parameters. The targeting domains bind within 200 bp from a mutation (e.g., R117H), and PAM is NNGRRV. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 23E

5th Tier

| gRNA Name | DNA Strand | Targeting Domain | Target Site Length | Seq ID |
|---|---|---|---|---|
| CFTR-R117H-154 | + | CCUACAAAAGGGGAAAAA | 18 | 2682 |
| CFTR-R117H-155 | + | UCCUACAAAAGGGGAAAAA | 19 | 2683 |
| CFTR-R117H-156 | + | UUCCUACAAAAGGGGAAAAA | 20 | 2684 |
| CFTR-R117H-157 | + | CUUCCUACAAAAGGGGAAAAA | 21 | 2685 |
| CFTR-R117H-158 | + | ACUUCCUACAAAAGGGGAAAAA | 22 | 2686 |
| CFTR-R117H-159 | + | GACUUCCUACAAAAGGGGAAAAA | 23 | 2687 |
| CFTR-R117H-160 | + | UGACUUCCUACAAAAGGGGAAAAA | 24 | 2688 |
| CFTR-R117H-161 | + | UGGUGACUUCCUACAAAA | 18 | 2689 |
| CFTR-R117H-162 | + | UUGGUGACUUCCUACAAAA | 19 | 2690 |
| CFTR-R117H-38 | + | UUUGGUGACUUCCUACAAAA | 20 | 2566 |
| CFTR-R117H-163 | + | CUUUGGUGACUUCCUACAAAA | 21 | 2691 |
| CFTR-R117H-164 | + | GCUUUGGUGACUUCCUACAAAA | 22 | 2692 |
| CFTR-R117H-165 | + | UGCUUUGGUGACUUCCUACAAAA | 23 | 2693 |
| CFTR-R117H-166 | + | CUGCUUUGGUGACUUCCUACAAAA | 24 | 2694 |
| CFTR-R117H-167 | + | UUGGUGACUUCCUACAAA | 18 | 2695 |
| CFTR-R117H-168 | + | UUUGGUGACUUCCUACAAA | 19 | 2696 |
| CFTR-R117H-39 | + | CUUUGGUGACUUCCUACAAA | 20 | 2567 |
| CFTR-R117H-169 | + | GCUUUGGUGACUUCCUACAAA | 21 | 2697 |
| CFTR-R117H-170 | + | UGCUUUGGUGACUUCCUACAAA | 22 | 2698 |
| CFTR-R117H-171 | + | CUGCUUUGGUGACUUCCUACAAA | 23 | 2699 |
| CFTR-R117H-172 | + | ACUGCUUUGGUGACUUCCUACAAA | 24 | 2700 |
| CFTR-R117H-173 | + | CAGUGUCCUCACAAUAAA | 18 | 2701 |
| CFTR-R117H-174 | + | GCAGUGUCCUCACAAUAAA | 19 | 2702 |
| CFTR-R117H-175 | + | AGCAGUGUCCUCACAAUAAA | 20 | 2703 |
| CFTR-R117H-176 | + | GAGCAGUGUCCUCACAAUAAA | 21 | 2704 |
| CFTR-R117H-177 | + | GGAGCAGUGUCCUCACAAUAAA | 22 | 2705 |
| CFTR-R117H-178 | + | AGGAGCAGUGUCCUCACAAUAAA | 23 | 2706 |
| CFTR-R117H-179 | + | UAGGAGCAGUGUCCUCACAAUAAA | 24 | 2707 |
| CFTR-R117H-180 | + | UUUGGUGACUUCCUACAA | 18 | 2708 |
| CFTR-R117H-181 | + | CUUUGGUGACUUCCUACAA | 19 | 2709 |
| CFTR-R117H-182 | + | GCUUUGGUGACUUCCUACAA | 20 | 2710 |
| CFTR-R117H-183 | + | UGCUUUGGUGACUUCCUACAA | 21 | 2711 |
| CFTR-R117H-184 | + | CUGCUUUGGUGACUUCCUACAA | 22 | 2712 |
| CFTR-R117H-185 | + | ACUGCUUUGGUGACUUCCUACAA | 23 | 2713 |

TABLE 23E-continued

5th Tier

| gRNA Name | DNA Strand | Targeting Domain | Target Site Length | Seq ID |
|---|---|---|---|---|
| CFTR-R117H-186 | + | UACUGCUUUGGUGACUUCCUACAA | 24 | 2714 |
| CFTR-R117H-187 | + | UAUGAUUCUUCCCAGUAA | 18 | 2715 |
| CFTR-R117H-188 | + | CUAUGAUUCUUCCCAGUAA | 19 | 2716 |
| CFTR-R117H-189 | + | GCUAUGAUUCUUCCCAGUAA | 20 | 2717 |
| CFTR-R117H-190 | + | AGCUAUGAUUCUUCCCAGUAA | 21 | 2718 |
| CFTR-R117H-191 | + | AAGCUAUGAUUCUUCCCAGUAA | 22 | 2719 |
| CFTR-R117H-192 | + | GAAGCUAUGAUUCUUCCCAGUAA | 23 | 2720 |
| CFTR-R117H-193 | + | GGAAGCUAUGAUUCUUCCCAGUAA | 24 | 2721 |
| CFTR-R117H-194 | + | UACAAAAGGGGAAAAACA | 18 | 2722 |
| CFTR-R117H-195 | + | CUACAAAAGGGGAAAAACA | 19 | 2723 |
| CFTR-R117H-196 | + | CCUACAAAAGGGGAAAAACA | 20 | 2724 |
| CFTR-R117H-197 | + | UCCUACAAAAGGGGAAAAACA | 21 | 2725 |
| CFTR-R117H-198 | + | UUCCUACAAAAGGGGAAAAACA | 22 | 2726 |
| CFTR-R117H-199 | + | CUUCCUACAAAAGGGGAAAAACA | 23 | 2727 |
| CFTR-R117H-200 | + | ACUUCCUACAAAAGGGGAAAAACA | 24 | 2728 |
| CFTR-R117H-201 | + | UACAGAAUAUAUGUGCCA | 18 | 2729 |
| CFTR-R117H-202 | + | AUACAGAAUAUAUGUGCCA | 19 | 2730 |
| CFTR-R117H-12 | + | GAUACAGAAUAUAUGUGCCA | 20 | 2540 |
| CFTR-R117H-203 | + | CGAUACAGAAUAUAUGUGCCA | 21 | 2731 |
| CFTR-R117H-204 | + | ACGAUACAGAAUAUAUGUGCCA | 22 | 2732 |
| CFTR-R117H-205 | + | UACGAUACAGAAUAUAUGUGCCA | 23 | 2733 |
| CFTR-R117H-206 | + | GUACGAUACAGAAUAUAUGUGCCA | 24 | 2734 |
| CFTR-R117H-207 | + | UGCCAUGGGGCCUGUGCA | 18 | 2735 |
| CFTR-R117H-208 | + | GUGCCAUGGGGCCUGUGCA | 19 | 2736 |
| CFTR-R117H-42 | + | UGUGCCAUGGGGCCUGUGCA | 20 | 2570 |
| CFTR-R117H-209 | + | AUGUGCCAUGGGGCCUGUGCA | 21 | 2737 |
| CFTR-R117H-210 | + | UAUGUGCCAUGGGGCCUGUGCA | 22 | 2738 |
| CFTR-R117H-211 | + | AUAUGUGCCAUGGGGCCUGUGCA | 23 | 2739 |
| CFTR-R117H-212 | + | UAUAUGUGCCAUGGGGCCUGUGCA | 24 | 2740 |
| CFTR-R117H-213 | + | UCCUUGUUAUCCGGGUCA | 18 | 2741 |
| CFTR-R117H-214 | + | CUCCUUGUUAUCCGGGUCA | 19 | 2742 |
| CFTR-R117H-215 | + | CCUCCUUGUUAUCCGGGUCA | 20 | 2743 |
| CFTR-R117H-216 | + | UCCUCCUUGUUAUCCGGGUCA | 21 | 2744 |
| CFTR-R117H-217 | + | UUCCUCCUUGUUAUCCGGGUCA | 22 | 2745 |
| CFTR-R117H-218 | + | GUUCCUCCUUGUUAUCCGGGUCA | 23 | 2746 |
| CFTR-R117H-219 | + | UGUUCCUCCUUGUUAUCCGGGUCA | 24 | 2747 |
| CFTR-R117H-220 | + | AGCAGUGUCCUCACAAUA | 18 | 2748 |
| CFTR-R117H-221 | + | GAGCAGUGUCCUCACAAUA | 19 | 2749 |

TABLE 23E-continued

5th Tier

| gRNA Name | DNA Strand | Targeting Domain | Target Site Length | Seq ID |
|---|---|---|---|---|
| CFTR-R117H-222 | + | GGAGCAGUGUCCUCACAAUA | 20 | 2750 |
| CFTR-R117H-223 | + | AGGAGCAGUGUCCUCACAAUA | 21 | 2751 |
| CFTR-R117H-224 | + | UAGGAGCAGUGUCCUCACAAUA | 22 | 2752 |
| CFTR-R117H-225 | + | GUAGGAGCAGUGUCCUCACAAUA | 23 | 2753 |
| CFTR-R117H-226 | + | UGUAGGAGCAGUGUCCUCACAAUA | 24 | 2754 |
| CFTR-R117H-227 | + | ACUUAAAAUGAGUUUAUA | 18 | 2755 |
| CFTR-R117H-228 | + | GACUUAAAAUGAGUUUAUA | 19 | 2756 |
| CFTR-R117H-229 | + | AGACUUAAAAUGAGUUUAUA | 20 | 2757 |
| CFTR-R117H-230 | + | GAGACUUAAAAUGAGUUUAUA | 21 | 2758 |
| CFTR-R117H-231 | + | GGAGACUUAAAAUGAGUUUAUA | 22 | 2759 |
| CFTR-R117H-232 | + | AGGAGACUUAAAAUGAGUUUAUA | 23 | 2760 |
| CFTR-R117H-233 | + | GAGGAGACUUAAAAUGAGUUUAUA | 24 | 2761 |
| CFTR-R117H-234 | + | CAAGACUUUUCAUCUUUA | 18 | 2762 |
| CFTR-R117H-235 | + | ACAAGACUUUUCAUCUUUA | 19 | 2763 |
| CFTR-R117H-236 | + | CACAAGACUUUUCAUCUUUA | 20 | 2764 |
| CFTR-R117H-237 | + | ACACAAGACUUUUCAUCUUUA | 21 | 2765 |
| CFTR-R117H-238 | + | AACACAAGACUUUUCAUCUUUA | 22 | 2766 |
| CFTR-R117H-239 | + | CAACACAAGACUUUUCAUCUUUA | 23 | 2767 |
| CFTR-R117H-240 | + | UCAACACAAGACUUUUCAUCUUUA | 24 | 2768 |
| CFTR-R117H-241 | + | UAUUUCUCAUAAAAUACC | 18 | 2769 |
| CFTR-R117H-242 | + | UUAUUUCUCAUAAAAUACC | 19 | 2770 |
| CFTR-R117H-243 | + | UUUAUUUCUCAUAAAAUACC | 20 | 2771 |
| CFTR-R117H-244 | + | AUUUAUUUCUCAUAAAAUACC | 21 | 2772 |
| CFTR-R117H-245 | + | CAUUUAUUUCUCAUAAAAUACC | 22 | 2773 |
| CFTR-R117H-246 | + | UCAUUUAUUUCUCAUAAAAUACC | 23 | 2774 |
| CFTR-R117H-247 | + | UUCAUUUAUUUCUCAUAAAAUACC | 24 | 2775 |
| CFTR-R117H-248 | + | AUACAGAAUAUAUGUGCC | 18 | 2776 |
| CFTR-R117H-249 | + | GAUACAGAAUAUAUGUGCC | 19 | 2777 |
| CFTR-R117H-250 | + | CGAUACAGAAUAUAUGUGCC | 20 | 2778 |
| CFTR-R117H-251 | + | ACGAUACAGAAUAUAUGUGCC | 21 | 2779 |
| CFTR-R117H-252 | + | UACGAUACAGAAUAUAUGUGCC | 22 | 2780 |
| CFTR-R117H-253 | + | GUACGAUACAGAAUAUAUGUGCC | 23 | 2781 |
| CFTR-R117H-254 | + | UGUACGAUACAGAAUAUAUGUGCC | 24 | 2782 |
| CFTR-R117H-255 | + | GUGCCAUGGGGCCUGUGC | 18 | 2783 |
| CFTR-R117H-256 | + | UGUGCCAUGGGGCCUGUGC | 19 | 2784 |
| CFTR-R117H-257 | + | AUGUGCCAUGGGGCCUGUGC | 20 | 2785 |
| CFTR-R117H-258 | + | UAUGUGCCAUGGGGCCUGUGC | 21 | 2786 |

TABLE 23E-continued

5th Tier

| gRNA Name | DNA Strand | Targeting Domain | Target Site Length | Seq ID |
|---|---|---|---|---|
| CFTR-R117H-259 | + | AUAUGUGCCAUGGGGCCUGUGC | 22 | 2787 |
| CFTR-R117H-260 | + | UAUAUGUGCCAUGGGGCCUGUGC | 23 | 2788 |
| CFTR-R117H-261 | + | AUAUAUGUGCCAUGGGGCCUGUGC | 24 | 2789 |
| CFTR-R117H-262 | + | GGUGACUUCCUACAAAG | 18 | 2790 |
| CFTR-R117H-263 | + | UGGUGACUUCCUACAAAG | 19 | 2791 |
| CFTR-R117H-49 | + | UUGGUGACUUCCUACAAAG | 20 | 2577 |
| CFTR-R117H-264 | + | UUUGGUGACUUCCUACAAAG | 21 | 2792 |
| CFTR-R117H-265 | + | CUUUGGUGACUUCCUACAAAG | 22 | 2793 |
| CFTR-R117H-266 | + | GCUUUGGUGACUUCCUACAAAG | 23 | 2794 |
| CFTR-R117H-267 | + | UGCUUUGGUGACUUCCUACAAAG | 24 | 2795 |
| CFTR-R117H-268 | + | AAGACUUUCAUCUUUAG | 18 | 2796 |
| CFTR-R117H-269 | + | CAAGACUUUCAUCUUUAG | 19 | 2797 |
| CFTR-R117H-52 | + | ACAAGACUUUCAUCUUUAG | 20 | 2580 |
| CFTR-R117H-270 | + | CACAAGACUUUCAUCUUUAG | 21 | 2798 |
| CFTR-R117H-271 | + | ACACAAGACUUUCAUCUUUAG | 22 | 2799 |
| CFTR-R117H-272 | + | AACACAAGACUUUCAUCUUUAG | 23 | 2800 |
| CFTR-R117H-273 | + | CAACACAAGACUUUCAUCUUUAG | 24 | 2801 |
| CFTR-R117H-274 | + | GCCAAAAAUGGCUGGGUG | 18 | 2802 |
| CFTR-R117H-275 | + | GGCCAAAAAUGGCUGGGUG | 19 | 2803 |
| CFTR-R117H-276 | + | AGGCCAAAAAUGGCUGGGUG | 20 | 2804 |
| CFTR-R117H-277 | + | AAGGCCAAAAAUGGCUGGGUG | 21 | 2805 |
| CFTR-R117H-278 | + | GAAGGCCAAAAAUGGCUGGGUG | 22 | 2806 |
| CFTR-R117H-279 | + | UGAAGGCCAAAAAUGGCUGGGUG | 23 | 2807 |
| CFTR-R117H-280 | + | AUGAAGGCCAAAAAUGGCUGGGUG | 24 | 2808 |
| CFTR-R117H-281 | + | CAUCUGCAUUCCAAUGUG | 18 | 2809 |
| CFTR-R117H-282 | + | UCAUCUGCAUUCCAAUGUG | 19 | 2810 |
| CFTR-R117H-283 | + | CUCAUCUGCAUUCCAAUGUG | 20 | 2811 |
| CFTR-R117H-284 | + | UCUCAUCUGCAUUCCAAUGUG | 21 | 2812 |
| CFTR-R117H-285 | + | UUCUCAUCUGCAUUCCAAUGUG | 22 | 2813 |
| CFTR-R117H-286 | + | AUUCUCAUCUGCAUUCCAAUGUG | 23 | 2814 |
| CFTR-R117H-287 | + | UAUUCUCAUCUGCAUUCCAAUGUG | 24 | 2815 |
| CFTR-R117H-288 | + | CCUUGUUAUCCGGGUCAU | 18 | 2816 |
| CFTR-R117H-289 | + | UCCUUGUUAUCCGGGUCAU | 19 | 2817 |
| CFTR-R117H-59 | + | CUCCUUGUUAUCCGGGUCAU | 20 | 2587 |
| CFTR-R117H-290 | + | CCUCCUUGUUAUCCGGGUCAU | 21 | 2818 |
| CFTR-R117H-291 | + | UCCUCCUUGUUAUCCGGGUCAU | 22 | 2819 |
| CFTR-R117H-292 | + | UUCCUCCUUGUUAUCCGGGUCAU | 23 | 2820 |
| CFTR-R117H-293 | + | GUUCCUCCUUGUUAUCCGGGUCAU | 24 | 2821 |

TABLE 23E-continued

| | | 5th Tier | | |
|---|---|---|---|---|
| gRNA Name | DNA Strand | Targeting Domain | Target Site Length | Seq ID |
| CFTR-R117H-294 | + | GCUAUGAUUCUUCCCAGU | 18 | 2822 |
| CFTR-R117H-295 | + | AGCUAUGAUUCUUCCCAGU | 19 | 2823 |
| CFTR-R117H-296 | + | AAGCUAUGAUUCUUCCCAGU | 20 | 2824 |
| CFTR-R117H-297 | + | GAAGCUAUGAUUCUUCCCAGU | 21 | 2825 |
| CFTR-R117H-298 | + | GGAAGCUAUGAUUCUUCCCAGU | 22 | 2826 |
| CFTR-R117H-299 | + | AGGAAGCUAUGAUUCUUCCCAGU | 23 | 2827 |
| CFTR-R117H-300 | + | UAGGAAGCUAUGAUUCUUCCCAGU | 24 | 2828 |
| CFTR-R117H-301 | + | CCAAAAAUGGCUGGGUGU | 18 | 2829 |
| CFTR-R117H-302 | + | GCCAAAAAUGGCUGGGUGU | 19 | 2830 |
| CFTR-R117H-17 | + | GGCCAAAAAUGGCUGGGUGU | 20 | 2545 |
| CFTR-R117H-303 | + | AGGCCAAAAAUGGCUGGGUGU | 21 | 2831 |
| CFTR-R117H-304 | + | AAGGCCAAAAAUGGCUGGGUGU | 22 | 2832 |
| CFTR-R117H-305 | + | GAAGGCCAAAAAUGGCUGGGUGU | 23 | 2833 |
| CFTR-R117H-306 | + | UGAAGGCCAAAAAUGGCUGGGUGU | 24 | 2834 |
| CFTR-R117H-307 | + | CACAAGACUUUUCAUCUU | 18 | 2835 |
| CFTR-R117H-308 | + | ACACAAGACUUUUCAUCUU | 19 | 2836 |
| CFTR-R117H-309 | + | AACACAAGACUUUUCAUCUU | 20 | 2837 |
| CFTR-R117H-310 | + | CAACACAAGACUUUUCAUCUU | 21 | 2838 |
| CFTR-R117H-311 | + | UCAACACAAGACUUUUCAUCUU | 22 | 2839 |
| CFTR-R117H-312 | + | UUCAACACAAGACUUUUCAUCUU | 23 | 2840 |
| CFTR-R117H-313 | + | UUUCAACACAAGACUUUUCAUCUU | 24 | 2841 |
| CFTR-R117H-314 | − | GUAUUUUAUGAGAAAUAA | 18 | 2842 |
| CFTR-R117H-315 | − | GGUAUUUUAUGAGAAAUAA | 19 | 2843 |
| CFTR-R117H-316 | − | GGGUAUUUUAUGAGAAAUAA | 20 | 2844 |
| CFTR-R117H-317 | − | AGGGUAUUUUAUGAGAAAUAA | 21 | 2845 |
| CFTR-R117H-318 | − | CAGGGUAUUUUAUGAGAAAUAA | 22 | 2846 |
| CFTR-R117H-319 | − | UCAGGGUAUUUUAUGAGAAAUAA | 23 | 2847 |
| CFTR-R117H-320 | − | CUCAGGGUAUUUUAUGAGAAAUAA | 24 | 2848 |
| CFTR-R117H-321 | − | CCUAUGACCCGGAUAACA | 18 | 2849 |
| CFTR-R117H-322 | − | UCCUAUGACCCGGAUAACA | 19 | 2850 |
| CFTR-R117H-40 | − | UUCCUAUGACCCGGAUAACA | 20 | 2568 |
| CFTR-R117H-323 | − | CUUCCUAUGACCCGGAUAACA | 21 | 2851 |
| CFTR-R117H-324 | − | GCUUCCUAUGACCCGGAUAACA | 22 | 2852 |
| CFTR-R117H-325 | − | AGCUUCCUAUGACCCGGAUAACA | 23 | 2853 |
| CFTR-R117H-326 | − | UAGCUUCCUAUGACCCGGAUAACA | 24 | 2854 |
| CFTR-R117H-327 | − | UUUUUGGCCUUCAUCACA | 18 | 2855 |
| CFTR-R117H-328 | − | AUUUUUGGCCUUCAUCACA | 19 | 2856 |

TABLE 23E-continued

| | | 5th Tier | | |
|---|---|---|---|---|
| gRNA Name | DNA Strand | Targeting Domain | Target Site Length | Seq ID |
| CFTR-R117H-329 | - | CAUUUUUGGCCUUCAUCACA | 20 | 2857 |
| CFTR-R117H-330 | - | CCAUUUUUGGCCUUCAUCACA | 21 | 2858 |
| CFTR-R117H-331 | - | GCCAUUUUUGGCCUUCAUCACA | 22 | 2859 |
| CFTR-R117H-332 | - | AGCCAUUUUUGGCCUUCAUCACA | 23 | 2860 |
| CFTR-R117H-333 | - | CAGCCAUUUUUGGCCUUCAUCACA | 24 | 2861 |
| CFTR-R117H-334 | - | GCAGUACAGCCUCUCUUA | 18 | 2862 |
| CFTR-R117H-335 | - | AGCAGUACAGCCUCUCUUA | 19 | 2863 |
| CFTR-R117H-336 | - | AAGCAGUACAGCCUCUCUUA | 20 | 2864 |
| CFTR-R117H-337 | - | AAAGCAGUACAGCCUCUCUUA | 21 | 2865 |
| CFTR-R117H-338 | - | CAAAGCAGUACAGCCUCUCUUA | 22 | 2866 |
| CFTR-R117H-339 | - | CCAAAGCAGUACAGCCUCUCUUA | 23 | 2867 |
| CFTR-R117H-340 | - | ACCAAAGCAGUACAGCCUCUCUUA | 24 | 2868 |
| CFTR-R117H-341 | - | UCCUAUGACCCGGAUAAC | 18 | 2869 |
| CFTR-R117H-342 | - | UUCCUAUGACCCGGAUAAC | 19 | 2870 |
| CFTR-R117H-343 | - | CUUCCUAUGACCCGGAUAAC | 20 | 2871 |
| CFTR-R117H-344 | - | GCUUCCUAUGACCCGGAUAAC | 21 | 2872 |
| CFTR-R117H-345 | - | AGCUUCCUAUGACCCGGAUAAC | 22 | 2873 |
| CFTR-R117H-346 | - | UAGCUUCCUAUGACCCGGAUAAC | 23 | 2874 |
| CFTR-R117H-347 | - | AUAGCUUCCUAUGACCCGGAUAAC | 24 | 2875 |
| CFTR-R117H-348 | - | CAGUACAGCCUCUCUUAC | 18 | 2876 |
| CFTR-R117H-349 | - | GCAGUACAGCCUCUCUUAC | 19 | 2877 |
| CFTR-R117H-45 | - | AGCAGUACAGCCUCUCUUAC | 20 | 2573 |
| CFTR-R117H-350 | - | AAGCAGUACAGCCUCUCUUAC | 21 | 2878 |
| CFTR-R117H-351 | - | AAAGCAGUACAGCCUCUCUUAC | 22 | 2879 |
| CFTR-R117H-352 | - | CAAAGCAGUACAGCCUCUCUUAC | 23 | 2880 |
| CFTR-R117H-353 | - | CCAAAGCAGUACAGCCUCUCUUAC | 24 | 2881 |
| CFTR-R117H-354 | - | UUUAAGUCUCCUCUAAAG | 18 | 2882 |
| CFTR-R117H-355 | - | UUUUAAGUCUCCUCUAAAG | 19 | 2883 |
| CFTR-R117H-356 | - | AUUUUAAGUCUCCUCUAAAG | 20 | 2884 |
| CFTR-R117H-357 | - | CAUUUUAAGUCUCCUCUAAAG | 21 | 2885 |
| CFTR-R117H-358 | - | UCAUUUUAAGUCUCCUCUAAAG | 22 | 2886 |
| CFTR-R117H-359 | - | CUCAUUUUAAGUCUCCUCUAAAG | 23 | 2887 |
| CFTR-R117H-360 | - | ACUCAUUUUAAGUCUCCUCUAAAG | 24 | 2888 |
| CFTR-R117H-361 | - | UAUGACCCGGAUAACAAG | 18 | 2889 |
| CFTR-R117H-362 | - | CUAUGACCCGGAUAACAAG | 19 | 2890 |
| CFTR-R117H-363 | - | CCUAUGACCCGGAUAACAAG | 20 | 2891 |
| CFTR-R117H-364 | - | UCCUAUGACCCGGAUAACAAG | 21 | 2892 |
| CFTR-R117H-365 | - | UUCCUAUGACCCGGAUAACAAG | 22 | 2893 |

TABLE 23E-continued

| 5th Tier | | | | |
|---|---|---|---|---|
| gRNA Name | DNA Strand | Targeting Domain | Target Site Length | Seq ID |
| CFTR-R117H-366 | - | CUUCCUAUGACCCGGAUAACAAG | 23 | 2894 |
| CFTR-R117H-367 | - | GCUUCCUAUGACCCGGAUAACAAG | 24 | 2895 |
| CFTR-R117H-368 | - | CAUCACAUUGGAAUGCAG | 18 | 2896 |
| CFTR-R117H-369 | - | UCAUCACAUUGGAAUGCAG | 19 | 2897 |
| CFTR-R117H-370 | - | UUCAUCACAUUGGAAUGCAG | 20 | 2898 |
| CFTR-R117H-371 | - | CUUCAUCACAUUGGAAUGCAG | 21 | 2899 |
| CFTR-R117H-372 | - | CCUUCAUCACAUUGGAAUGCAG | 22 | 2900 |
| CFTR-R117H-373 | - | GCCUUCAUCACAUUGGAAUGCAG | 23 | 2901 |
| CFTR-R117H-374 | - | GGCCUUCAUCACAUUGGAAUGCAG | 24 | 2902 |
| CFTR-R117H-375 | - | AUGACCCGGAUAACAAGG | 18 | 2903 |
| CFTR-R117H-376 | - | UAUGACCCGGAUAACAAGG | 19 | 2904 |
| CFTR-R117H-53 | - | CUAUGACCCGGAUAACAAGG | 20 | 2581 |
| CFTR-R117H-377 | - | CCUAUGACCCGGAUAACAAGG | 21 | 2905 |
| CFTR-R117H-378 | - | UCCUAUGACCCGGAUAACAAGG | 22 | 2906 |
| CFTR-R117H-379 | - | UUCCUAUGACCCGGAUAACAAGG | 23 | 2907 |
| CFTR-R117H-380 | - | CUUCCUAUGACCCGGAUAACAAGG | 24 | 2908 |
| CFTR-R117H-381 | - | AAGAUGAAAAGUCUUGUG | 18 | 2909 |
| CFTR-R117H-382 | - | AAAGAUGAAAAGUCUUGUG | 19 | 2910 |
| CFTR-R117H-383 | - | UAAAGAUGAAAAGUCUUGUG | 20 | 2911 |
| CFTR-R117H-384 | - | CUAAAGAUGAAAAGUCUUGUG | 21 | 2912 |
| CFTR-R117H-385 | - | UCUAAAGAUGAAAAGUCUUGUG | 22 | 2913 |
| CFTR-R117H-386 | - | CUCUAAAGAUGAAAAGUCUUGUG | 23 | 2914 |
| CFTR-R117H-387 | - | CCUCUAAAGAUGAAAAGUCUUGUG | 24 | 2915 |
| CFTR-R117H-388 | - | UCUGUUUUCCCCUUUUG | 18 | 2916 |
| CFTR-R117H-389 | - | CUCUGUUUUCCCCUUUUG | 19 | 2917 |
| CFTR-R117H-390 | - | UCUCUGUUUUCCCCUUUUG | 20 | 2918 |
| CFTR-R117H-391 | - | UUCUCUGUUUUCCCCUUUUG | 21 | 2919 |
| CFTR-R117H-392 | - | UUUCUCUGUUUUCCCCUUUUG | 22 | 2920 |
| CFTR-R117H-393 | - | AUUUCUCUGUUUUCCCCUUUUG | 23 | 2921 |
| CFTR-R117H-394 | - | AAUUUCUCUGUUUUCCCCUUUUG | 24 | 2922 |
| CFTR-R117H-395 | - | AUGUUUAGUUUGAUUUAU | 18 | 2923 |
| CFTR-R117H-396 | - | UAUGUUUAGUUUGAUUUAU | 19 | 2924 |
| CFTR-R117H-397 | - | CUAUGUUUAGUUUGAUUUAU | 20 | 2925 |
| CFTR-R117H-398 | - | GCUAUGUUUAGUUUGAUUUAU | 21 | 2926 |
| CFTR-R117H-399 | - | AGCUAUGUUUAGUUUGAUUUAU | 22 | 2927 |
| CFTR-R117H-400 | - | UAGCUAUGUUUAGUUUGAUUUAU | 23 | 2928 |
| CFTR-R117H-401 | - | AUAGCUAUGUUUAGUUUGAUUUAU | 24 | 2929 |

TABLE 23E-continued

| | | 5th Tier | | |
|---|---|---|---|---|
| gRNA Name | DNA Strand | Targeting Domain | Target Site Length | Seq ID |
| CFTR-R117H-402 | - | AUUCUCAGGGUAUUUUAU | 18 | 2930 |
| CFTR-R117H-403 | - | AAUUCUCAGGGUAUUUUAU | 19 | 2931 |
| CFTR-R117H-404 | - | AAAUUCUCAGGGUAUUUUAU | 20 | 2932 |
| CFTR-R117H-405 | - | GAAAUUCUCAGGGUAUUUUAU | 21 | 2933 |
| CFTR-R117H-406 | - | UGAAAUUCUCAGGGUAUUUUAU | 22 | 2934 |
| CFTR-R117H-407 | - | UUGAAAUUCUCAGGGUAUUUUAU | 23 | 2935 |
| CFTR-R117H-408 | - | GUUGAAAUUCUCAGGGUAUUUUAU | 24 | 2936 |
| CFTR-R117H-409 | - | AGUACAGCCUCUCUUACU | 18 | 2937 |
| CFTR-R117H-410 | - | CAGUACAGCCUCUCUUACU | 19 | 2938 |
| CFTR-R117H-15 | - | GCAGUACAGCCUCUCUUACU | 20 | 2543 |
| CFTR-R117H-411 | - | AGCAGUACAGCCUCUCUUACU | 21 | 2939 |
| CFTR-R117H-412 | - | AAGCAGUACAGCCUCUCUUACU | 22 | 2940 |
| CFTR-R117H-413 | - | AAAGCAGUACAGCCUCUCUUACU | 23 | 2941 |
| CFTR-R117H-414 | - | CAAAGCAGUACAGCCUCUCUUACU | 24 | 2942 |
| CFTR-R117H-415 | - | AUGCCUUCUCUUUAUUGU | 18 | 2943 |
| CFTR-R117H-416 | - | UAUGCCUUCUCUUUAUUGU | 19 | 2944 |
| CFTR-R117H-417 | - | UUAUGCCUUCUCUUUAUUGU | 20 | 2945 |
| CFTR-R117H-418 | - | CUUAUGCCUUCUCUUUAUUGU | 21 | 2946 |
| CFTR-R117H-419 | - | GCUUAUGCCUUCUCUUUAUUGU | 22 | 2947 |
| CFTR-R117H-420 | - | GGCUUAUGCCUUCUCUUUAUUGU | 23 | 2948 |
| CFTR-R117H-421 | - | AGGCUUAUGCCUUCUCUUUAUUGU | 24 | 2949 |
| CFTR-R117H-422 | - | CUGUUUUCCCCUUUUGU | 18 | 2950 |
| CFTR-R117H-423 | - | UCUGUUUUCCCCUUUUGU | 19 | 2951 |
| CFTR-R117H-74 | - | CUCUGUUUUCCCCUUUUGU | 20 | 2602 |
| CFTR-R117H-424 | - | UCUCUGUUUUCCCCUUUUGU | 21 | 2952 |
| CFTR-R117H-425 | - | UUCUCUGUUUUCCCCUUUUGU | 22 | 2953 |
| CFTR-R117H-426 | - | UUUCUCUGUUUUCCCCUUUUGU | 23 | 2954 |
| CFTR-R117H-427 | - | AUUUCUCUGUUUUCCCCUUUUGU | 24 | 2955 |
| CFTR-R117H-428 | - | UUAUGCCUUCUCUUUAUU | 18 | 2956 |
| CFTR-R117H-429 | - | CUUAUGCCUUCUCUUUAUU | 19 | 2957 |
| CFTR-R117H-430 | - | GCUUAUGCCUUCUCUUUAUU | 20 | 2958 |
| CFTR-R117H-431 | - | GGCUUAUGCCUUCUCUUUAUU | 21 | 2959 |
| CFTR-R117H-432 | - | AGGCUUAUGCCUUCUCUUUAUU | 22 | 2960 |
| CFTR-R117H-433 | - | UAGGCUUAUGCCUUCUCUUUAUU | 23 | 2961 |
| CFTR-R117H-434 | - | AUAGGCUUAUGCCUUCUCUUUAUU | 24 | 2962 |
| CFTR-R117H-435 | - | AAAUUCUCAGGGUAUUUU | 18 | 2963 |
| CFTR-R117H-436 | - | GAAAUUCUCAGGGUAUUUU | 19 | 2964 |
| CFTR-R117H-437 | - | UGAAAUUCUCAGGGUAUUUU | 20 | 2965 |

TABLE 23E-continued

5th Tier

| gRNA Name | DNA Strand | Targeting Domain | Target Site Length | Seq ID |
|---|---|---|---|---|
| CFTR-R117H-438 | - | UUGAAAUUCUCAGGGUAUUUU | 21 | 2966 |
| CFTR-R117H-439 | - | GUUGAAAUUCUCAGGGUAUUUU | 22 | 2967 |
| CFTR-R117H-440 | - | UGUUGAAAUUCUCAGGGUAUUUU | 23 | 2968 |
| CFTR-R117H-441 | - | GUGUUGAAAUUCUCAGGGUAUUUU | 24 | 2969 |

Table 24A provides exemplary targeting domains for correcting a mutation (e.g., R117H) in the CFTR gene selected according to the first tier parameters. The targeting domains bind within 200 bp from a mutation (e.g., R117H), have a high level of orthogonality and start with a 5'G. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 24A

1st Tier

| gRNA Name | DNA Strand | Targeting Domain | Target Site Length | Seq ID |
|---|---|---|---|---|
| CFTR-R117H-442 | + | GUUAUCCGGGUCAUAGGAAG | 20 | 2970 |

Table 24B provides exemplary targeting domains for correcting a mutation (e.g., R117H) in the CFTR gene selected according to the second tier parameters. The targeting domains bind within 200 bp from a mutation (e.g., R117H) and have a high level of orthogonality. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 24B

2nd Tier

| gRNA Name | DNA Strand | Targeting Domain | Target Site Length | Seq ID |
|---|---|---|---|---|
| CFTR-R117H-443 | - | UCGCGAUUUAUCUAGGC | 17 | 2971 |
| CFTR-R117H-444 | + | AUCCGGGUCAUAGGAAG | 17 | 2972 |
| CFTR-R117H-445 | - | CUCUUACUGGGAAGAAU | 17 | 2973 |
| CFTR-R117H-446 | - | CUAUCGCGAUUUAUCUAGGC | 20 | 2974 |
| CFTR-R117H-447 | + | CUUCCCAGUAAGAGAGGCUG | 20 | 2975 |
| CFTR-R117H-448 | - | CCUCUCUUACUGGGAAGAAU | 20 | 2976 |

Table 24C provides exemplary targeting domains for correcting a mutation (e.g., R117H) in the CFTR gene selected according to the third tier parameters. The targeting domains bind within 200 bp from a mutation (e.g., R117H) and start with a 5'G. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 24C

3rd Tier

| gRNA Name | DNA Strand | Targeting Domain | Target Site Length | Seq ID |
|---|---|---|---|---|
| CFTR-R117H-449 | - | GAGAAUAGCUAUGUUUA | 17 | 2977 |
| CFTR-R117H-450 | - | GAUGAGAAUAGCUAUGUUUA | 20 | 2978 |

Table 24D provides exemplary targeting domains for correcting a mutation (e.g., R117H) in the CFTR gene selected according to the fourth tier parameters. The targeting domains bind within 200 bp from a mutation (e.g., R117H). It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 24D

4th Tier

| gRNA Name | DNA Strand | Targeting Domain | Target Site Length | Seq ID |
|---|---|---|---|---|
| CFTR-R117H-451 | - | CAAGGAGGAACACUCUA | 17 | 2979 |
| CFTR-R117H-452 | + | CCCAGUAAGAGAGGCUG | 17 | 2980 |

TABLE 24D-continued

4th Tier

| gRNA Name | DNA Strand | Targeting Domain | Target Site Length | Seq ID |
|---|---|---|---|---|
| CFTR-R117H-453 | − | UAACAAGGAGGAACACUCUA | 20 | 2981 |

Table 25A provides exemplary targeting domains for correcting a mutation (e.g., R553X) in the CFTR gene selected according to the first tier parameters. The targeting domains bind within 200 bp from a mutation (e.g., R553X), have a high level of orthogonality and start with a 5′G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 25A

1st Tier

| gRNA Name | DNA Strand | Targeting Domain | Target Site Length | Seq ID |
|---|---|---|---|---|
| CFTR-R553X-1 | − | GCUUUAUAUUCUGUUUC | 17 | 466 |
| CFTR-R553X-2 | − | GGUGGAAUCACACUGAG | 17 | 456 |
| CFTR-R553X-3 | − | GGAAUCACACUGAGUGG | 17 | 457 |
| CFTR-R553X-4 | − | GUUCAAAAUUUCAACUG | 17 | 464 |
| CFTR-R553X-5 | − | GGUGAAUAACUAAUUAU | 17 | 465 |
| CFTR-R553X-6 | − | GGGGUUUUAUGGCUAGU | 17 | 458 |
| CFTR-R553X-7 | − | GAGCAAGAAUUUCUUUAGCA | 20 | 462 |
| CFTR-R553X-8 | − | GACAAUAUAGUUCUUGGAGA | 20 | 460 |
| CFTR-R553X-9 | − | GAAGGUGGAAUCACACUGAG | 20 | 461 |
| CFTR-R553X-10 | − | GGUGGAAUCACACUGAGUGG | 20 | 454 |
| CFTR-R553X-11 | − | GAGAAAGACAAUAUAGUUCU | 20 | 453 |

Table 25B provides exemplary targeting domains for correcting a mutation (e.g., R553X) in the CFTR gene selected according to the second tier parameters. The targeting domains bind within 200 bp from a mutation (e.g., R553X) and have a high level of orthogonality. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 25B

2nd Tier

| gRNA Name | DNA Strand | Targeting Domain | Target Site Length | Seq ID |
|---|---|---|---|---|
| CFTR-R553X-12 | + | CUCAAUCUGAAUUGAA | 17 | 496 |
| CFTR-R553X-13 | − | CAAGAAUUUCUUUAGCA | 17 | 491 |
| CFTR-R553X-14 | − | AAUAUAGUUCUUGGAGA | 17 | 489 |
| CFTR-R553X-15 | − | UAUAUGAUUACAUUAGA | 17 | 485 |
| CFTR-R553X-16 | − | AAAAUCCUGGGGUUUUA | 17 | 493 |
| CFTR-R553X-17 | + | ACUAGCCAUAAAACCCC | 17 | 459 |
| CFTR-R553X-18 | − | UGGGGUUUUAUGGCUAG | 17 | 494 |
| CFTR-R553X-19 | − | AUAGUUCUUGGAGAAGG | 17 | 490 |
| CFTR-R553X-20 | − | AAAGACAAUAUAGUUCU | 17 | 488 |
| CFTR-R553X-21 | + | AUGCUCAAUCUGAAUUGAA | 20 | 484 |
| CFTR-R553X-22 | − | UGAUAUGAUUACAUUAGA | 20 | 471 |
| CFTR-R553X-23 | + | CCCACUAGCCAUAAAACCCC | 20 | 455 |
| CFTR-R553X-24 | − | UUCUGGAAUUGAAAAAUCC | 20 | 477 |
| CFTR-R553X-25 | − | AAUAUAGUUCUUGGAGAAGG | 20 | 474 |
| CFTR-R553X-26 | − | CUGGAAUUGAAAAAUCCUG | 20 | 479 |
| CFTR-R553X-27 | − | CAAGGUGAAUAACUAAUUAU | 20 | 475 |
| CFTR-R553X-28 | − | CCUGGGGUUUUAUGGCUAGU | 20 | 481 |

Table 25C provides exemplary targeting domains for correcting a mutation (e.g., R553X) in the CFTR gene selected according to the third tier parameters. The targeting domains bind within 200 bp from a mutation (e.g., R553X) and start with a 5′G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 25C

3rd Tier

| gRNA Name | DNA Strand | Targeting Domain | Target Site Length | Seq ID |
|---|---|---|---|---|
| CFTR-R553X-29 | − | GAAUUGAAAAAUCCUG | 17 | 468 |
| CFTR-R553X-30 | + | GUCUUUCUCUGCAAACU | 17 | 469 |
| CFTR-R553X-31 | − | GGAAUUGAAAAAUCCU | 17 | 467 |
| CFTR-R553X-32 | − | GAAAAAUCCUGGGGUUUUA | 20 | 463 |

Table 25D provides exemplary targeting domains for correcting a mutation (e.g., R553X) in the CFTR gene selected according to the fourth tier parameters. The targeting domains bind within 200 bp from a mutation (e.g., R553X). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 25D

| gRNA Name | DNA Strand | Targeting Domain | Target Site Length | Seq ID |
|---|---|---|---|---|
| 4th Tier | | | | |
| CFTR-R553X-33 | − | UUAAGAACUAUAAAUAA | 17 | 495 |
| CFTR-R553X-34 | − | UGGAAUUGAAAAAAUCC | 17 | 492 |
| CFTR-R553X-35 | − | UUUCUAUUUUUGGUAAU | 17 | 487 |
| CFTR-R553X-36 | − | CUCUAAUUUUCUAUUUU | 17 | 486 |
| CFTR-R553X-37 | − | CAUUUAAGAACUAUAAAUAA | 20 | 482 |
| CFTR-R553X-38 | − | AUUGCUUUAUAUUCUGUUUC | 20 | 476 |
| CFTR-R553X-39 | − | UCCUGGGGUUUUAUGGCUAG | 20 | 480 |
| CFTR-R553X-40 | − | AAUUUUCUAUUUUUGGUAAU | 20 | 473 |
| CFTR-R553X-41 | + | AUUGUCUUUCUCUGCAAACU | 20 | 483 |
| CFTR-R553X-42 | − | UCUGGAAUUGAAAAAAUCCU | 20 | 478 |
| CFTR-R553X-43 | − | ACUCUCUAAUUUUCUAUUUU | 20 | 472 |

Table 26A provides exemplary targeting domains for correcting a mutation (e.g., R553X) in the CFTR gene selected according to the first tier parameters. The targeting domains bind within 200 bp from a mutation (e.g., R553X), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 26A

| gRNA Name | DNA Strand | Targeting Domain | Target Site Length | Seq ID |
|---|---|---|---|---|
| 1st Tier | | | | |
| CFTR-R553X-44 | + | GAUUUUUUCAAUUCCAGAAA | 20 | 766 |
| CFTR-R553X-45 | + | GGAUUUUUUCAAUUCCAGAAA | 21 | 1898 |
| CFTR-R553X-46 | + | GUCACUUUUAGUAUGCUCAAU | 21 | 1899 |
| CFTR-R553X-47 | + | GAGUCACUUUUAGUAUGCUCAAU | 23 | 1900 |
| CFTR-R553X-48 | − | GGAGAAGGUGGAAUCACA | 18 | 2160 |
| CFTR-R553X-49 | − | GUUCUUGGAGAAGGUGGAAUCACA | 24 | 2161 |
| CFTR-R553X-50 | − | GCAAGAAUUUCUUUAGCAAG | 20 | 746 |
| CFTR-R553X-51 | − | GACAAUAUAGUUCUUGGAGAAGG | 23 | 2162 |
| CFTR-R553X-52 | − | GUUUUAUGGCUAGUGGGUU | 19 | 1903 |
| CFTR-R553X-53 | − | GGUUUUAUGGCUAGUGGGUU | 20 | 751 |
| CFTR-R553X-54 | − | GGGUUUUAUGGCUAGUGGGUU | 21 | 1904 |
| CFTR-R553X-55 | − | GGGGUUUUAUGGCUAGUGGGUU | 22 | 1905 |

Table 26B provides exemplary targeting domains for correcting a mutation (e.g., R553X) in the CFTR gene selected according to the second tier parameters. The targeting domains bind within 200 bp from a mutation (e.g., R553X), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 26B

2nd Tier

| gRNA Name | DNA Strand | Targeting Domain | Target Site Length | Seq ID |
|---|---|---|---|---|
| CFTR-R553X-56 | + | UUUUUUCAAUUCCAGAAA | 18 | 1906 |
| CFTR-R553X-57 | + | AUUUUUUCAAUUCCAGAAA | 19 | 1907 |
| CFTR-R553X-58 | + | AGGAUUUUUUCAAUUCCAGAAA | 22 | 1908 |
| CFTR-R553X-59 | + | CAGGAUUUUUUCAAUUCCAGAAA | 23 | 1909 |
| CFTR-R553X-60 | + | CCAGGAUUUUUUCAAUUCCAGAAA | 24 | 1910 |
| CFTR-R553X-61 | + | UGUCUGUAAUUUUUUAC | 18 | 1911 |
| CFTR-R553X-62 | + | AUGUCUGUAAUUUUUUAC | 19 | 1912 |
| CFTR-R553X-63 | + | AAUGUCUGUAAUUUUUUAC | 20 | 763 |
| CFTR-R553X-64 | + | CCACUAGCCAUAAAACCC | 18 | 1913 |
| CFTR-R553X-65 | + | CCCACUAGCCAUAAAACCC | 19 | 1914 |
| CFTR-R553X-66 | + | ACCCACUAGCCAUAAAACCC | 20 | 1915 |
| CFTR-R553X-67 | + | AACCCACUAGCCAUAAAACCC | 21 | 1916 |
| CFTR-R553X-68 | + | UAACCCACUAGCCAUAAAACCC | 22 | 1917 |
| CFTR-R553X-69 | + | UUAACCCACUAGCCAUAAAACCC | 23 | 1918 |
| CFTR-R553X-70 | + | CUUAACCCACUAGCCAUAAAACCC | 24 | 1919 |
| CFTR-R553X-71 | + | ACUUUUAGUAUGCUCAAU | 18 | 1920 |
| CFTR-R553X-72 | + | CACUUUUAGUAUGCUCAAU | 19 | 1921 |
| CFTR-R553X-73 | + | UCACUUUUAGUAUGCUCAAU | 20 | 756 |
| CFTR-R553X-74 | + | AGUCACUUUUAGUAUGCUCAAU | 22 | 1922 |
| CFTR-R553X-75 | + | AGAGUCACUUUUAGUAUGCUCAAU | 24 | 1923 |
| CFTR-R553X-76 | − | UGGAGAAGGUGGAAUCACA | 19 | 2163 |
| CFTR-R553X-77 | − | UUGGAGAAGGUGGAAUCACA | 20 | 742 |
| CFTR-R553X-78 | − | CUUGGAGAAGGUGGAAUCACA | 21 | 2164 |
| CFTR-R553X-79 | − | UCUUGGAGAAGGUGGAAUCACA | 22 | 2165 |
| CFTR-R553X-80 | − | UUCUUGGAGAAGGUGGAAUCACA | 23 | 2166 |
| CFTR-R553X-81 | − | CCUGGGGUUUUAUGGCUA | 18 | 1924 |
| CFTR-R553X-82 | − | UCCUGGGGUUUUAUGGCUA | 19 | 1925 |
| CFTR-R553X-83 | − | AUCCUGGGGUUUUAUGGCUA | 20 | 750 |
| CFTR-R553X-84 | − | AAUCCUGGGGUUUUAUGGCUA | 21 | 1926 |
| CFTR-R553X-85 | − | AAAUCCUGGGGUUUUAUGGCUA | 22 | 1927 |
| CFTR-R553X-86 | − | AAAAUCCUGGGGUUUUAUGGCUA | 23 | 1928 |
| CFTR-R553X-87 | − | AAAAAUCCUGGGGUUUUAUGGCUA | 24 | 1929 |
| CFTR-R553X-88 | − | UGCUUUAUAUUCUGUUUC | 18 | 1931 |
| CFTR-R553X-89 | − | UUGCUUUAUAUUCUGUUUC | 19 | 1932 |

TABLE 26B-continued

2nd Tier

| gRNA Name | DNA Strand | Targeting Domain | Target Site Length | Seq ID |
|---|---|---|---|---|
| CFTR-R553X-38 | − | AUUGCUUUAUAUUCUGUUUC | 20 | 476 |
| CFTR-R553X-90 | − | UAUUGCUUUAUAUUCUGUUUC | 21 | 1933 |
| CFTR-R553X-91 | − | CUAUUGCUUUAUAUUCUGUUUC | 22 | 1934 |
| CFTR-R553X-92 | − | UCUAUUGCUUUAUAUUCUGUUUC | 23 | 1935 |
| CFTR-R553X-93 | − | CUCUAUUGCUUUAUAUUCUGUUUC | 24 | 1936 |
| CFTR-R553X-94 | − | AAGAAUUUCUUUAGCAAG | 18 | 1937 |
| CFTR-R553X-95 | − | CAAGAAUUUCUUUAGCAAG | 19 | 1938 |
| CFTR-R553X-96 | − | UAUAGUUCUUGGAGAAGG | 18 | 2167 |
| CFTR-R553X-97 | − | AUAUAGUUCUUGGAGAAGG | 19 | 2168 |
| CFTR-R553X-25 | − | AAUAUAGUUCUUGGAGAAGG | 20 | 474 |
| CFTR-R553X-98 | − | CAAUAUAGUUCUUGGAGAAGG | 21 | 2169 |
| CFTR-R553X-99 | − | ACAAUAUAGUUCUUGGAGAAGG | 22 | 2170 |
| CFTR-R553X-100 | − | AGACAAUAUAGUUCUUGGAGAAGG | 24 | 2171 |
| CFTR-R553X-101 | − | UUUUAUGGCUAGUGGGUU | 18 | 1942 |
| CFTR-R553X-102 | − | UGGGGUUUUAUGGCUAGUGGGUU | 23 | 1943 |
| CFTR-R553X-103 | − | CUGGGGUUUUAUGGCUAGUGGGUU | 24 | 1944 |

Table 26C provides exemplary targeting domains for correcting a mutation (e.g., R553X) in the CFTR gene selected according to the third tier parameters. The targeting domains bind within 200 bp from a mutation (e.g., R553X), start with a 5'G and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

Table 26D provides exemplary targeting domains for correcting a mutation (e.g., R553X) in the CFTR gene selected according to the fourth tier parameters. The targeting domains bind within 200 bp from a mutation (e.g., R553X), and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 26C

3rd Tier

| gRNA Name | DNA Strand | Targeting Domain | Target Site Length | Seq ID |
|---|---|---|---|---|
| CFTR-R553X-104 | + | GAAAUGUCUGUAAUUUUUUUAC | 22 | 1945 |
| CFTR-R553X-105 | + | GAGAAAUGUCUGUAAUUUUUUUAC | 24 | 1946 |
| CFTR-R553X-106 | − | GUUUCUGGAAUUGAAAAAAUCC | 22 | 1948 |
| CFTR-R553X-107 | − | GAGUGGAGGUCAAUGAGC | 18 | 2982 |
| CFTR-R553X-108 | − | GAGCAAGAAUUUCUUUAGCAAG | 22 | 1902 |

TABLE 26D

4th Tier

| gRNA Name | DNA Strand | Targeting Domain | Target Site Length | Seq ID |
|---|---|---|---|---|
| CFTR-R553X-109 | + | ACCAAAAAUAGAAAAUUA | 18 | 1950 |
| CFTR-R553X-110 | + | UACCAAAAAUAGAAAAUUA | 19 | 1951 |
| CFTR-R553X-111 | + | UUACCAAAAAUAGAAAAUUA | 20 | 757 |
| CFTR-R553X-112 | + | AUUACCAAAAAUAGAAAAUUA | 21 | 1952 |
| CFTR-R553X-113 | + | UAUUACCAAAAAUAGAAAAUUA | 22 | 1953 |
| CFTR-R553X-114 | + | CUAUUACCAAAAAUAGAAAAUUA | 23 | 1954 |
| CFTR-R553X-115 | + | CCUAUUACCAAAAAUAGAAAAUUA | 24 | 1955 |
| CFTR-R553X-116 | + | AAAUGUCUGUAAUUUUUUUAC | 21 | 1956 |
| CFTR-R553X-117 | + | AGAAAUGUCUGUAAUUUUUUUAC | 23 | 1957 |
| CFTR-R553X-118 | − | CUGGAAUUGAAAAAAUCC | 18 | 1964 |
| CFTR-R553X-119 | − | UCUGGAAUUGAAAAAAUCC | 19 | 1965 |
| CFTR-R553X-24 | − | UUCUGGAAUUGAAAAAAUCC | 20 | 477 |
| CFTR-R553X-120 | − | UUUCUGGAAUUGAAAAAAUCC | 21 | 1966 |
| CFTR-R553X-121 | − | UGUUUCUGGAAUUGAAAAAAUCC | 23 | 1967 |
| CFTR-R553X-122 | − | CUGUUUCUGGAAUUGAAAAAAUCC | 24 | 1968 |
| CFTR-R553X-123 | − | UGAGUGGAGGUCAAUGAGC | 19 | 2983 |
| CFTR-R553X-124 | − | CUGAGUGGAGGUCAAUGAGC | 20 | 2984 |
| CFTR-R553X-125 | − | ACUGAGUGGAGGUCAAUGAGC | 21 | 2985 |
| CFTR-R553X-126 | − | CACUGAGUGGAGGUCAAUGAGC | 22 | 2986 |
| CFTR-R553X-127 | − | ACACUGAGUGGAGGUCAAUGAGC | 23 | 2987 |
| CFTR-R553X-128 | − | CACACUGAGUGGAGGUCAAUGAGC | 24 | 2988 |
| CFTR-R553X-129 | − | AGCAAGAAUUUCUUUAGCAAG | 21 | 1939 |
| CFTR-R553X-130 | − | UGAGCAAGAAUUUCUUUAGCAAG | 23 | 2989 |
| CFTR-R553X-131 | − | AUGAGCAAGAAUUUCUUUAGCAAG | 24 | 2990 |

Table 26E provides exemplary targeting domains for correcting a mutation (e.g., R553X) in the CFTR gene selected according to the fifth tier parameters. The targeting domains bind within 200 bp from a mutation (e.g., R553X), and PAM is NNGRRV. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 26E

5th Tier

| gRNA Name | DNA Strand | Targeting Domain | Target Site Length | Seq ID |
|---|---|---|---|---|
| CFTR-R553X-132 | + | AUGUCCUAUUACCAAAAA | 18 | 1978 |
| CFTR-R553X-133 | + | GAUGUCCUAUUACCAAAAA | 19 | 1979 |
| CFTR-R553X-134 | + | AGAUGUCCUAUUACCAAAAA | 20 | 759 |
| CFTR-R553X-135 | + | GAGAUGUCCUAUUACCAAAAA | 21 | 1980 |
| CFTR-R553X-136 | + | GGAGAUGUCCUAUUACCAAAAA | 22 | 1981 |
| CFTR-R553X-137 | + | UGGAGAUGUCCUAUUACCAAAAA | 23 | 1982 |

TABLE 26E-continued

5th Tier

| gRNA Name | DNA Strand | Targeting Domain | Target Site Length | Seq ID |
|---|---|---|---|---|
| CFTR-R553X-138 | + | UUGGAGAUGUCCUAUUACCAAAAA | 24 | 1983 |
| CFTR-R553X-139 | + | AAACAGAAUAUAAAGCAA | 18 | 1984 |
| CFTR-R553X-140 | + | GAAACAGAAUAUAAAGCAA | 19 | 1985 |
| CFTR-R553X-141 | + | AGAAACAGAAUAUAAAGCAA | 20 | 765 |
| CFTR-R553X-142 | + | CAGAAACAGAAUAUAAAGCAA | 21 | 1986 |
| CFTR-R553X-143 | + | CCAGAAACAGAAUAUAAAGCAA | 22 | 1987 |
| CFTR-R553X-144 | + | UCCAGAAACAGAAUAUAAAGCAA | 23 | 1988 |
| CFTR-R553X-145 | + | UUCCAGAAACAGAAUAUAAAGCAA | 24 | 1989 |
| CFTR-R553X-146 | + | ACAGAAUAUAAAGCAAUA | 18 | 1997 |
| CFTR-R553X-147 | + | AACAGAAUAUAAAGCAAUA | 19 | 1998 |
| CFTR-R553X-148 | + | AAACAGAAUAUAAAGCAAUA | 20 | 764 |
| CFTR-R553X-149 | + | GAAACAGAAUAUAAAGCAAUA | 21 | 1999 |
| CFTR-R553X-150 | + | AGAAACAGAAUAUAAAGCAAUA | 22 | 2000 |
| CFTR-R553X-151 | + | CAGAAACAGAAUAUAAAGCAAUA | 23 | 2001 |
| CFTR-R553X-152 | + | CCAGAAACAGAAUAUAAAGCAAUA | 24 | 2002 |
| CFTR-R553X-153 | + | UAGUUAUUCACCUUGCUA | 18 | 2003 |
| CFTR-R553X-154 | + | UUAGUUAUUCACCUUGCUA | 19 | 2004 |
| CFTR-R553X-155 | + | AUUAGUUAUUCACCUUGCUA | 20 | 762 |
| CFTR-R553X-156 | + | AAUUAGUUAUUCACCUUGCUA | 21 | 2005 |
| CFTR-R553X-157 | + | UAAUUAGUUAUUCACCUUGCUA | 22 | 2006 |
| CFTR-R553X-158 | + | AUAAUUAGUUAUUCACCUUGCUA | 23 | 2007 |
| CFTR-R553X-159 | + | AAUAAUUAGUUAUUCACCUUGCUA | 24 | 2008 |
| CFTR-R553X-160 | + | UUGUCUUUCUCUGCAAAC | 18 | 2009 |
| CFTR-R553X-161 | + | AUUGUCUUUCUCUGCAAAC | 19 | 2010 |
| CFTR-R553X-162 | + | UAUUGUCUUUCUCUGCAAAC | 20 | 760 |
| CFTR-R553X-163 | + | AUAUUGUCUUUCUCUGCAAAC | 21 | 2011 |
| CFTR-R553X-164 | + | UAUAUUGUCUUUCUCUGCAAAC | 22 | 2012 |
| CFTR-R553X-165 | + | CUAUAUUGUCUUUCUCUGCAAAC | 23 | 2013 |
| CFTR-R553X-166 | + | ACUAUAUUGUCUUUCUCUGCAAAC | 24 | 2014 |
| CFTR-R553X-167 | + | UGUGAUUCCACCUUCUCC | 18 | 2179 |
| CFTR-R553X-168 | + | GUGUGAUUCCACCUUCUCC | 19 | 2180 |
| CFTR-R553X-169 | + | AGUGUGAUUCCACCUUCUCC | 20 | 761 |

TABLE 26E-continued

5th Tier

| gRNA Name | DNA Strand | Targeting Domain | Target Site Length | Seq ID |
|---|---|---|---|---|
| CFTR-R553X-170 | + | CAGUGUGAUUCCACCUUCUCC | 21 | 2181 |
| CFTR-R553X-171 | + | UCAGUGUGAUUCCACCUUCUCC | 22 | 2182 |
| CFTR-R553X-172 | + | CUCAGUGUGAUUCCACCUUCUCC | 23 | 2183 |
| CFTR-R553X-173 | + | ACUCAGUGUGAUUCCACCUUCUCC | 24 | 2184 |
| CFTR-R553X-174 | + | CCAGGAUUUUUUCAAUUC | 18 | 2015 |
| CFTR-R553X-175 | + | CCCAGGAUUUUUUCAAUUC | 19 | 2016 |
| CFTR-R553X-176 | + | CCCCAGGAUUUUUUCAAUUC | 20 | 767 |
| CFTR-R553X-177 | + | ACCCCAGGAUUUUUUCAAUUC | 21 | 2017 |
| CFTR-R553X-178 | + | AACCCCAGGAUUUUUUCAAUUC | 22 | 2018 |
| CFTR-R553X-179 | + | AAACCCCAGGAUUUUUUCAAUUC | 23 | 2019 |
| CFTR-R553X-180 | + | AAAACCCCAGGAUUUUUUCAAUUC | 24 | 2020 |
| CFTR-R553X-181 | + | CUAUUGCUUUAACCACAG | 18 | 2021 |
| CFTR-R553X-182 | + | ACUAUUGCUUUAACCACAG | 19 | 2022 |
| CFTR-R553X-183 | + | CACUAUUGCUUUAACCACAG | 20 | 754 |
| CFTR-R553X-184 | + | ACACUAUUGCUUUAACCACAG | 21 | 2023 |
| CFTR-R553X-185 | + | CACACUAUUGCUUUAACCACAG | 22 | 2024 |
| CFTR-R553X-186 | + | UCACACUAUUGCUUUAACCACAG | 23 | 2025 |
| CFTR-R553X-187 | + | AUCACACUAUUGCUUUAACCACAG | 24 | 2026 |
| CFTR-R553X-188 | + | UUACCAAAAAUAGAAAAU | 18 | 2027 |
| CFTR-R553X-189 | + | AUUACCAAAAAUAGAAAAU | 19 | 2028 |
| CFTR-R553X-190 | + | UAUUACCAAAAAUAGAAAAU | 20 | 758 |
| CFTR-R553X-191 | + | CUAUUACCAAAAAUAGAAAAU | 21 | 2029 |
| CFTR-R553X-192 | + | CCUAUUACCAAAAAUAGAAAAU | 22 | 2030 |
| CFTR-R553X-193 | + | UCCUAUUACCAAAAAUAGAAAAU | 23 | 2031 |
| CFTR-R553X-194 | + | GUCCUAUUACCAAAAAUAGAAAAU | 24 | 2032 |
| CFTR-R553X-195 | + | AGUAUGCUCAAUCUGAAU | 18 | 2033 |
| CFTR-R553X-196 | + | UAGUAUGCUCAAUCUGAAU | 19 | 2034 |
| CFTR-R553X-197 | + | UUAGUAUGCUCAAUCUGAAU | 20 | 755 |
| CFTR-R553X-198 | + | UUUAGUAUGCUCAAUCUGAAU | 21 | 2035 |
| CFTR-R553X-199 | + | UUUUAGUAUGCUCAAUCUGAAU | 22 | 2036 |
| CFTR-R553X-200 | + | CUUUUAGUAUGCUCAAUCUGAAU | 23 | 2037 |
| CFTR-R553X-201 | + | ACUUUUAGUAUGCUCAAUCUGAAU | 24 | 2038 |
| CFTR-R553X-202 | + | UGUCUUUCUCUGCAAACU | 18 | 2039 |
| CFTR-R553X-203 | + | UUGUCUUUCUCUGCAAACU | 19 | 2040 |
| CFTR-R553X-41 | + | AUUGUCUUUCUCUGCAAACU | 20 | 483 |
| CFTR-R553X-204 | + | UAUUGUCUUUCUCUGCAAACU | 21 | 2041 |
| CFTR-R553X-205 | + | AUAUUGUCUUUCUCUGCAAACU | 22 | 2042 |

TABLE 26E-continued

5th Tier

| gRNA Name | DNA Strand | Targeting Domain | Target Site Length | Seq ID |
|---|---|---|---|---|
| CFTR-R553X-206 | + | UAUAUUGUCUUUCUCUGCAAACU | 23 | 2043 |
| CFTR-R553X-207 | + | CUAUAUUGUCUUUCUCUGCAAACU | 24 | 2044 |
| CFTR-R553X-208 | + | UUAACCACAGUUGAAAUU | 18 | 2045 |
| CFTR-R553X-209 | + | UUUAACCACAGUUGAAAUU | 19 | 2046 |
| CFTR-R553X-210 | + | CUUUAACCACAGUUGAAAUU | 20 | 753 |
| CFTR-R553X-211 | + | GCUUUAACCACAGUUGAAAUU | 21 | 2047 |
| CFTR-R553X-212 | + | UGCUUUAACCACAGUUGAAAUU | 22 | 2048 |
| CFTR-R553X-213 | + | UUGCUUUAACCACAGUUGAAAUU | 23 | 2049 |
| CFTR-R553X-214 | + | AUUGCUUUAACCACAGUUGAAAUU | 24 | 2050 |
| CFTR-R553X-215 | − | UAUAUUCUGUUUCUGGAA | 18 | 2051 |
| CFTR-R553X-216 | − | UUAUAUUCUGUUUCUGGAA | 19 | 2052 |
| CFTR-R553X-217 | − | UUUAUAUUCUGUUUCUGGAA | 20 | 748 |
| CFTR-R553X-218 | − | CUUUAUAUUCUGUUUCUGGAA | 21 | 2053 |
| CFTR-R553X-219 | − | GCUUUAUAUUCUGUUUCUGGAA | 22 | 2054 |
| CFTR-R553X-220 | − | UGCUUUAUAUUCUGUUUCUGGAA | 23 | 2055 |
| CFTR-R553X-221 | − | UUGCUUUAUAUUCUGUUUCUGGAA | 24 | 2056 |
| CFTR-R553X-222 | − | AUUUUCUAUUUUGGUAA | 18 | 2059 |
| CFTR-R553X-223 | − | AAUUUUCUAUUUUGGUAA | 19 | 2060 |
| CFTR-R553X-224 | − | UAAUUUUCUAUUUUGGUAA | 20 | 736 |
| CFTR-R553X-225 | − | CUAAUUUUCUAUUUUGGUAA | 21 | 2061 |
| CFTR-R553X-226 | − | UCUAAUUUUCUAUUUUGGUAA | 22 | 2062 |
| CFTR-R553X-227 | − | CUCUAAUUUUCUAUUUUGGUAA | 23 | 2063 |
| CFTR-R553X-228 | − | UCUCUAAUUUUCUAUUUUGGUAA | 24 | 2064 |
| CFTR-R553X-229 | − | GACAUCUCCAAGUUUGCA | 18 | 2065 |
| CFTR-R553X-230 | − | GGACAUCUCCAAGUUUGCA | 19 | 2066 |
| CFTR-R553X-231 | − | AGGACAUCUCCAAGUUUGCA | 20 | 738 |
| CFTR-R553X-232 | − | UAGGACAUCUCCAAGUUUGCA | 21 | 2067 |
| CFTR-R553X-233 | − | AUAGGACAUCUCCAAGUUUGCA | 22 | 2068 |
| CFTR-R553X-234 | − | AAUAGGACAUCUCCAAGUUUGCA | 23 | 2069 |
| CFTR-R553X-235 | − | UAAUAGGACAUCUCCAAGUUUGCA | 24 | 2070 |
| CFTR-R553X-236 | − | CACACUGAGUGGAGGUCA | 18 | 2071 |
| CFTR-R553X-237 | − | UCACACUGAGUGGAGGUCA | 19 | 2072 |
| CFTR-R553X-238 | − | AUCACACUGAGUGGAGGUCA | 20 | 744 |
| CFTR-R553X-239 | − | AAUCACACUGAGUGGAGGUCA | 21 | 2073 |
| CFTR-R553X-240 | − | GAAUCACACUGAGUGGAGGUCA | 22 | 2074 |
| CFTR-R553X-241 | − | GGAAUCACACUGAGUGGAGGUCA | 23 | 2075 |
| CFTR-R553X-242 | − | UGGAAUCACACUGAGUGGAGGUCA | 24 | 2076 |
| CFTR-R553X-243 | − | GUGCCUUUCAAAUUCAGA | 18 | 2077 |

TABLE 26E-continued

5th Tier

| gRNA Name | DNA Strand | Targeting Domain | Target Site Length | Seq ID |
|---|---|---|---|---|
| CFTR-R553X-244 | - | UGUGCCUUUCAAAUUCAGA | 19 | 2078 |
| CFTR-R553X-245 | - | AUGUGCCUUUCAAAUUCAGA | 20 | 735 |
| CFTR-R553X-246 | - | GAUGUGCCUUUCAAAUUCAGA | 21 | 2079 |
| CFTR-R553X-247 | - | AGAUGUGCCUUUCAAAUUCAGA | 22 | 2080 |
| CFTR-R553X-248 | - | AAGAUGUGCCUUUCAAAUUCAGA | 23 | 2081 |
| CFTR-R553X-249 | - | GAAGAUGUGCCUUUCAAAUUCAGA | 24 | 2082 |
| CFTR-R553X-250 | - | AUAUAUGAUUACAUUAGA | 18 | 2083 |
| CFTR-R553X-251 | - | GAUAUAUGAUUACAUUAGA | 19 | 2084 |
| CFTR-R553X-22 | - | UGAUAUAUGAUUACAUUAGA | 20 | 471 |
| CFTR-R553X-252 | - | GUGAUAUAUGAUUACAUUAGA | 21 | 2085 |
| CFTR-R553X-253 | - | UGUGAUAUAUGAUUACAUUAGA | 22 | 2086 |
| CFTR-R553X-254 | - | GUGUGAUAUAUGAUUACAUUAGA | 23 | 2087 |
| CFTR-R553X-255 | - | AGUGUGAUAUAUGAUUACAUUAGA | 24 | 2088 |
| CFTR-R553X-256 | - | AAGGUGGAAUCACACUGA | 18 | 2089 |
| CFTR-R553X-257 | - | GAAGGUGGAAUCACACUGA | 19 | 2090 |
| CFTR-R553X-258 | - | AGAAGGUGGAAUCACACUGA | 20 | 743 |
| CFTR-R553X-259 | - | GAGAAGGUGGAAUCACACUGA | 21 | 2091 |
| CFTR-R553X-260 | - | GGAGAAGGUGGAAUCACACUGA | 22 | 2192 |
| CFTR-R553X-261 | - | UGGAGAAGGUGGAAUCACACUGA | 23 | 2193 |
| CFTR-R553X-262 | - | UUGGAGAAGGUGGAAUCACACUGA | 24 | 2194 |
| CFTR-R553X-263 | - | UCUGGAAUUGAAAAAAUC | 18 | 2098 |
| CFTR-R553X-264 | - | UUCUGGAAUUGAAAAAAUC | 19 | 2099 |
| CFTR-R553X-265 | - | UUUCUGGAAUUGAAAAAAUC | 20 | 749 |
| CFTR-R553X-266 | - | GUUUCUGGAAUUGAAAAAAUC | 21 | 2100 |
| CFTR-R553X-267 | - | UGUUUCUGGAAUUGAAAAAAUC | 22 | 2101 |
| CFTR-R553X-268 | - | CUGUUUCUGGAAUUGAAAAAAUC | 23 | 2102 |
| CFTR-R553X-269 | - | UCUGUUUCUGGAAUUGAAAAAAUC | 24 | 2103 |
| CFTR-R553X-270 | - | AGAAAGACAAUAUAGUUC | 18 | 2195 |
| CFTR-R553X-271 | - | GAGAAAGACAAUAUAGUUC | 19 | 2196 |
| CFTR-R553X-272 | - | AGAGAAAGACAAUAUAGUUC | 20 | 739 |
| CFTR-R553X-273 | - | CAGAGAAAGACAAUAUAGUUC | 21 | 2197 |
| CFTR-R553X-274 | - | GCAGAGAAAGACAAUAUAGUUC | 22 | 2198 |
| CFTR-R553X-275 | - | UGCAGAGAAAGACAAUAUAGUUC | 23 | 2199 |
| CFTR-R553X-276 | - | UUGCAGAGAAAGACAAUAUAGUUC | 24 | 2200 |
| CFTR-R553X-277 | - | AUAUAGUUCUUGGAGAAG | 18 | 2201 |
| CFTR-R553X-278 | - | AAUAUAGUUCUUGGAGAAG | 19 | 2202 |
| CFTR-R553X-279 | - | CAAUAUAGUUCUUGGAGAAG | 20 | 741 |

TABLE 26E-continued

5th Tier

| gRNA Name | DNA Strand | Targeting Domain | Target Site Length | Seq ID |
|---|---|---|---|---|
| CFTR-R553X-280 | - | ACAAUAUAGUUCUUGGAGAAG | 21 | 2203 |
| CFTR-R553X-281 | - | GACAAUAUAGUUCUUGGAGAAG | 22 | 2204 |
| CFTR-R553X-282 | - | AGACAAUAUAGUUCUUGGAGAAG | 23 | 2205 |
| CFTR-R553X-283 | - | AAGACAAUAUAGUUCUUGGAGAAG | 24 | 2206 |
| CFTR-R553X-284 | - | AGGUGGAAUCACACUGAG | 18 | 2111 |
| CFTR-R553X-285 | - | AAGGUGGAAUCACACUGAG | 19 | 2112 |
| CFTR-R553X-9 | - | GAAGGUGGAAUCACACUGAG | 20 | 461 |
| CFTR-R553X-286 | - | AGAAGGUGGAAUCACACUGAG | 21 | 2113 |
| CFTR-R553X-287 | - | GAGAAGGUGGAAUCACACUGAG | 22 | 2114 |
| CFTR-R553X-288 | - | GGAGAAGGUGGAAUCACACUGAG | 23 | 2207 |
| CFTR-R553X-289 | - | UGGAGAAGGUGGAAUCACACUGAG | 24 | 2208 |
| CFTR-R553X-290 | - | GAUAUAUGAUUACAUUAG | 18 | 2117 |
| CFTR-R553X-291 | - | UGAUAUAUGAUUACAUUAG | 19 | 2118 |
| CFTR-R553X-292 | - | GUGAUAUAUGAUUACAUUAG | 20 | 734 |
| CFTR-R553X-293 | - | UGUGAUAUAUGAUUACAUUAG | 21 | 2119 |
| CFTR-R553X-294 | - | GUGUGAUAUAUGAUUACAUUAG | 22 | 2120 |
| CFTR-R553X-295 | - | AGUGUGAUAUAUGAUUACAUUAG | 23 | 2121 |
| CFTR-R553X-296 | - | UAGUGUGAUAUAUGAUUACAUUAG | 24 | 2122 |
| CFTR-R553X-297 | - | AAGACAAUAUAGUUCUUG | 18 | 2209 |
| CFTR-R553X-298 | - | AAAGACAAUAUAGUUCUUG | 19 | 2210 |
| CFTR-R553X-299 | - | GAAAGACAAUAUAGUUCUUG | 20 | 740 |
| CFTR-R553X-300 | - | AGAAAGACAAUAUAGUUCUUG | 21 | 2211 |
| CFTR-R553X-301 | - | GAGAAAGACAAUAUAGUUCUUG | 22 | 2212 |
| CFTR-R553X-302 | - | AGAGAAAGACAAUAUAGUUCUUG | 23 | 2213 |
| CFTR-R553X-303 | - | CAGAGAAAGACAAUAUAGUUCUUG | 24 | 2214 |
| CFTR-R553X-304 | - | AGGACAUCUCCAAGUUUG | 18 | 2123 |
| CFTR-R553X-305 | - | UAGGACAUCUCCAAGUUUG | 19 | 2124 |
| CFTR-R553X-306 | - | AUAGGACAUCUCCAAGUUUG | 20 | 737 |
| CFTR-R553X-307 | - | AAUAGGACAUCUCCAAGUUUG | 21 | 2125 |
| CFTR-R553X-308 | - | UAAUAGGACAUCUCCAAGUUUG | 22 | 2126 |
| CFTR-R553X-309 | - | GUAAUAGGACAUCUCCAAGUUUG | 23 | 2127 |
| CFTR-R553X-310 | - | GGUAAUAGGACAUCUCCAAGUUUG | 24 | 2128 |
| CFTR-R553X-311 | - | UGUGAUAUAUGAUUACAU | 18 | 2129 |
| CFTR-R553X-312 | - | GUGUGAUAUAUGAUUACAU | 19 | 2130 |
| CFTR-R553X-313 | - | AGUGUGAUAUAUGAUUACAU | 20 | 733 |
| CFTR-R553X-314 | - | UAGUGUGAUAUAUGAUUACAU | 21 | 2131 |
| CFTR-R553X-315 | - | AUAGUGUGAUAUAUGAUUACAU | 22 | 2132 |
| CFTR-R553X-316 | - | AAUAGUGUGAUAUAUGAUUACAU | 23 | 2133 |

TABLE 26E-continued

5th Tier

| gRNA Name | DNA Strand | Targeting Domain | Target Site Length | Seq ID |
|---|---|---|---|---|
| CFTR-R553X-317 | − | CAAUAGUGUGAUAUAUGAUUACAU | 24 | 2134 |
| CFTR-R553X-318 | − | GAAAGACAAUAUAGUUCU | 18 | 2135 |
| CFTR-R553X-319 | − | AGAAAGACAAUAUAGUUCU | 19 | 2136 |
| CFTR-R553X-11 | − | GAGAAAGACAAUAUAGUUCU | 20 | 453 |
| CFTR-R553X-320 | − | AGAGAAAGACAAUAUAGUUCU | 21 | 2137 |
| CFTR-R553X-321 | − | CAGAGAAAGACAAUAUAGUUCU | 22 | 2138 |
| CFTR-R553X-322 | − | GCAGAGAAAGACAAUAUAGUUCU | 23 | 2139 |
| CFTR-R553X-323 | − | UGCAGAGAAAGACAAUAUAGUUCU | 24 | 2140 |
| CFTR-R553X-324 | − | GGGUUAAGAAUCACAUUU | 18 | 2215 |
| CFTR-R553X-325 | − | UGGGUUAAGAAUCACAUUU | 19 | 2216 |
| CFTR-R553X-326 | − | GUGGGUUAAGAAUCACAUUU | 20 | 752 |
| CFTR-R553X-327 | − | AGUGGGUUAAGAAUCACAUUU | 21 | 2217 |
| CFTR-R553X-328 | − | UAGUGGGUUAAGAAUCACAUUU | 22 | 2218 |
| CFTR-R553X-329 | − | CUAGUGGGUUAAGAAUCACAUUU | 23 | 2219 |
| CFTR-R553X-330 | − | GCUAGUGGGUUAAGAAUCACAUUU | 24 | 2220 |
| CFTR-R553X-331 | − | UUGCUUUAUAUUCUGUUU | 18 | 2148 |
| CFTR-R553X-332 | − | AUUGCUUUAUAUUCUGUUU | 19 | 2149 |
| CFTR-R553X-333 | − | UAUUGCUUUAUAUUCUGUUU | 20 | 747 |
| CFTR-R553X-334 | − | CUAUUGCUUUAUAUUCUGUUU | 21 | 2150 |
| CFTR-R553X-335 | − | UCUAUUGCUUUAUAUUCUGUUU | 22 | 2151 |
| CFTR-R553X-336 | − | CUCUAUUGCUUUAUAUUCUGUUU | 23 | 2152 |
| CFTR-R553X-337 | − | UCUCUAUUGCUUUAUAUUCUGUUU | 24 | 2153 |

Table 27A provides exemplary targeting domains for correcting a mutation (e.g., R553X) in the CFTR gene selected according to the first tier parameters. The targeting domains bind within 200 bp from a mutation (e.g., R553X), have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 27A

1st Tier

| gRNA Name | DNA Strand | Targeting Domain | Target Site Length | Seq ID |
|---|---|---|---|---|
| CFTR-R553X-338 | + | GUAAUCAUAUAUCACAC | 17 | 2154 |
| CFTR-R553X-339 | − | GGUUAAAGCAAUAGUGUGAU | 20 | 927 |

Table 27B provides exemplary targeting domains for correcting a mutation (e.g., R553X) in the CFTR gene selected according to the second tier parameters. The targeting domains bind within 200 bp from a mutation (e.g., R553X) and have a high level of orthogonality. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 27B

2nd Tier

| gRNA Name | DNA Strand | Targeting Domain | Target Site Length | Seq ID |
|---|---|---|---|---|
| CFTR-R553X-340 | + | CCACUAGCCAUAAAACC | 17 | 935 |
| CFTR-R553X-341 | + | UGAAUGACAUUUACAGC | 17 | 2155 |
| CFTR-R553X-342 | – | UAAAGCAAUAGUGUGAU | 17 | 932 |
| CFTR-R553X-343 | – | AGGAAGAUGUGCCUUUCAAA | 20 | 928 |
| CFTR-R553X-344 | + | AAUGUAAUCAUAUAUCACAC | 20 | 2156 |
| CFTR-R553X-345 | + | AACCCACUAGCCAUAAAACC | 20 | 930 |
| CFTR-R553X-346 | + | ACAUGAAUGACAUUUACAGC | 20 | 2157 |

Table 27C provides exemplary targeting domains for correcting a mutation (e.g., R553X) in the CFTR gene selected according to the fourth tier parameters. The targeting domains bind within 200 bp from a mutation (e.g., R553X). It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 27C

4th Tier

| gRNA Name | DNA Strand | Targeting Domain | Target Site Length | Seq ID |
|---|---|---|---|---|
| CFTR-R553X-347 | – | AAGAUGUGCCUUUCAAA | 17 | 933 |
| CFTR-R553X-348 | + | UUAUUUAUAGUUCUUAA | 17 | 936 |
| CFTR-R553X-349 | + | UCAUUGACCUCCACUCA | 17 | 2991 |
| CFTR-R553X-350 | – | AAUUACAGACAUUUCUC | 17 | 2158 |
| CFTR-R553X-351 | + | CCAUUAUUUAUAGUUCUUAA | 20 | 931 |
| CFTR-R553X-352 | + | UGCUCAUUGACCUCCACUCA | 20 | 2992 |
| CFTR-R553X-353 | – | AAAAAUUACAGACAUUUCUC | 20 | 2159 |

Table 28A provides exemplary targeting domains for correcting a mutation (e.g., W1282X) in the CFTR gene selected according to the first tier parameters. The targeting domains bind within 200 bp from a mutation (e.g., W1282X), have a high level of orthogonality and start with a 5'G. It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 28A

1st Tier

| gRNA Name | DNA Strand | Targeting Domain | Target Site Length | Seq ID |
|---|---|---|---|---|
| CFTR-W1282X-1 | − | GAAUUAUGUUUAUGGCA | 17 | 2993 |
| CFTR-W1282X-2 | − | GGAGAAAUCCAGAUCGA | 17 | 2994 |
| CFTR-W1282X-3 | − | GGCCUCUUGGGAAGAAC | 17 | 2995 |
| CFTR-W1282X-4 | + | GUCCUUUUGCUCACCUG | 17 | 2996 |

TABLE 28A-continued

1st Tier

| gRNA Name | DNA Strand | Targeting Domain | Target Site Length | Seq ID |
|---|---|---|---|---|
| CFTR-W1282X-5 | − | GAUCGAUGGUGUGUCUU | 17 | 2997 |
| CFTR-W1282X-6 | − | GAAGGAGAAAUCCAGAUCGA | 20 | 2998 |
| CFTR-W1282X-7 | − | GUGGGCCUCUUGGGAAGAAC | 20 | 2999 |

Table 28B provides exemplary targeting domains for correcting a mutation (e.g., W1282X) in the CFTR gene selected according to the second tier parameters. The targeting domains bind within 200 bp from a mutation (e.g., W1282X) and have a high level of orthogonality. It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 28B

2nd Tier

| gRNA Name | DNA Strand | Targeting Domain | Target Site Length | Seq ID |
|---|---|---|---|---|
| CFTR-W1282X-8 | − | UACCACAGGUGAGCAAA | 17 | 3000 |
| CFTR-W1282X-9 | + | CUGUGGUAUCACUCCAA | 17 | 3001 |
| CFTR-W1282X-10 | − | AGACUACUGAACACUGA | 17 | 3002 |
| CFTR-W1282X-11 | + | CUAUAAGGUAAAAGUGA | 17 | 3003 |
| CFTR-W1282X-12 | − | UAACUUUGCAACAGUGA | 17 | 3004 |
| CFTR-W1282X-13 | + | CAAGAGGCCCACCUAUA | 17 | 3005 |
| CFTR-W1282X-14 | − | CUUUGGAGUGAUACCAC | 17 | 3006 |
| CFTR-W1282X-15 | + | CUAUGAGAAAACUGCAC | 17 | 3007 |
| CFTR-W1282X-16 | + | AAGACACACCAUCGAUC | 17 | 3008 |
| CFTR-W1282X-17 | − | UUGGGAAGAACUGGAUC | 17 | 3009 |
| CFTR-W1282X-18 | + | AUCCAGUUCUUCCCAAG | 17 | 3010 |
| CFTR-W1282X-19 | − | CACUUUUACCUUAUAGG | 17 | 3011 |
| CFTR-W1282X-20 | − | CAGUGCAGUUUUCUCAU | 17 | 3012 |
| CFTR-W1282X-21 | + | UAUAAGGUAAAAGUGAU | 17 | 3013 |
| CFTR-W1282X-22 | + | UCACUUCUGUGACAUAU | 17 | 3014 |
| CFTR-W1282X-23 | − | CAUCACUUUUACCUUAU | 17 | 3015 |
| CFTR-W1282X-24 | − | CUUAUAGGUGGGCCUCU | 17 | 3016 |
| CFTR-W1282X-25 | − | AGAUCGAUGGUGUGUCU | 17 | 3017 |
| CFTR-W1282X-26 | − | ACUUUUACCUUAUAGGU | 17 | 3018 |
| CFTR-W1282X-27 | − | UUAUAGGUGGGCCUCUU | 17 | 3019 |
| CFTR-W1282X-28 | − | AAAGGACUUAGCCAGAAAAA | 20 | 3020 |

TABLE 28B-continued

| | | 2nd Tier | | |
|---|---|---|---|---|
| gRNA Name | DNA Strand | Targeting Domain | Target Site Length | Seq ID |
| CFTR-W1282X-29 | + | CACCUGUGGUAUCACUCCAA | 20 | 3021 |
| CFTR-W1282X-30 | − | ACUGAAUUAUGUUUAUGGCA | 20 | 3022 |
| CFTR-W1282X-31 | − | UCUUGGGAAGAACUGGAUCA | 20 | 3023 |
| CFTR-W1282X-32 | − | UUGAGACUACUGAACACUGA | 20 | 3024 |
| CFTR-W1282X-33 | + | CACCUAUAAGGUAAAAGUGA | 20 | 3025 |
| CFTR-W1282X-34 | + | UCCCAAGAGGCCCACCUAUA | 20 | 3026 |
| CFTR-W1282X-35 | − | ACAAUACUGAAUUAUGUUUA | 20 | 3027 |
| CFTR-W1282X-36 | − | AGCCUUUGGAGUGAUACCAC | 20 | 3028 |
| CFTR-W1282X-37 | + | UGCCUAUGAGAAAACUGCAC | 20 | 3029 |
| CFTR-W1282X-38 | + | CCCAAGACACACCAUCGAUC | 20 | 3030 |
| CFTR-W1282X-39 | − | CUCUUGGGAAGAACUGGAUC | 20 | 3031 |
| CFTR-W1282X-40 | + | UAAUUUAGUUGCCUUUUUUC | 20 | 3032 |
| CFTR-W1282X-41 | + | CUGAUCCAGUUCUUCCCAAG | 20 | 3033 |
| CFTR-W1282X-42 | − | CAUCACUUUUACCUUAUAGG | 20 | 3034 |
| CFTR-W1282X-43 | + | UAAGUCCUUUUGCUCACCUG | 20 | 3035 |
| CFTR-W1282X-44 | − | CUCCAGUGCAGUUUUCUCAU | 20 | 3036 |
| CFTR-W1282X-45 | + | ACCUAUAAGGUAAAAGUGAU | 20 | 3037 |
| CFTR-W1282X-46 | − | UCCCAUCACUUUUACCUUAU | 20 | 3038 |
| CFTR-W1282X-47 | − | UACCUUAUAGGUGGGCCUCU | 20 | 3039 |
| CFTR-W1282X-48 | − | UCCAGAUCGAUGGUGUGUCU | 20 | 3040 |
| CFTR-W1282X-49 | − | AUCACUUUUACCUUAUAGGU | 20 | 3041 |
| CFTR-W1282X-50 | − | CCAGAUCGAUGGUGUGUCUU | 20 | 3042 |

Table 28C provides exemplary targeting domains for correcting a mutation (e.g., W1282X) in the CFTR gene selected according to the third tier parameters. The targeting domains bind within 200 bp from a mutation (e.g., W1282X) and start with a 5′G. It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 28C

| | | 3rd Tier | | |
|---|---|---|---|---|
| gRNA Name | DNA Strand | Targeting Domain | Target Site Length | Seq ID |
| CFTR-W1282X-51 | − | GGACUUAGCCAGAAAAA | 17 | 3043 |
| CFTR-W1282X-52 | + | GGAUCACUUCUGUGACA UAU | 20 | 3044 |

Table 28D provides exemplary targeting domains for correcting a mutation (e.g., W1282X) in the CFTR gene selected according to the fourth tier parameters. The targeting domains bind within 200 bp from a mutation (e.g., W1282X). It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 28D

4th Tier

| gRNA Name | DNA Strand | Targeting Domain | Target Site Length | Seq ID |
|---|---|---|---|---|
| CFTR-W1282X-53 | − | UGGGAAGAACUGGAUCA | 17 | 3045 |
| CFTR-W1282X-54 | − | AUACUGAAUUAUGUUUA | 17 | 3046 |
| CFTR-W1282X-55 | + | UUUAGUUGCCUUUUUUC | 17 | 3047 |
| CFTR-W1282X-56 | − | CAGUGAAGGAAAGCCUU | 17 | 3048 |
| CFTR-W1282X-57 | − | UGAUACCACAGGUGAGCAAA | 20 | 3049 |
| CFTR-W1282X-58 | − | CAAUAACUUUGCAACAGUGA | 20 | 3050 |
| CFTR-W1282X-59 | − | CAACAGUGAAGGAAAGCCUU | 20 | 3051 |
| CFTR-W1282X-60 | − | ACCUUAUAGGUGGGCCUCUU | 20 | 3052 |

Table 29A provides exemplary targeting domains for correcting a mutation (e.g., W1282X) in the CFTR gene selected according to the first tier parameters. The targeting domains bind within 200 bp from a mutation (e.g., W1282X), have a high level of orthogonality, start with a 5'G, and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 29A

1st Tier

| gRNA Name | DNA Strand | Targeting Domain | Target Site Length | Seq ID |
|---|---|---|---|---|
| CFTR-W1282X-61 | + | GCCCACCUAUAAGGUAAAAGUGA | 23 | 3053 |
| CFTR-W1282X-62 | + | GGCCCACCUAUAAGGUAAAAGUGA | 24 | 3054 |
| CFTR-W1282X-63 | + | GCAUAACAAAUAUAUUUUG | 19 | 3055 |
| CFTR-W1282X-64 | + | GAAUCCCAAGACACACCAUCGAU | 23 | 3056 |
| CFTR-W1282X-65 | − | GUGGGCCUCUUGGGAAGAA | 19 | 3057 |
| CFTR-W1282X-66 | − | GGUGGGCCUCUUGGGAAGAA | 20 | 3058 |
| CFTR-W1282X-67 | − | GGAAGAACUGGAUCAGGG | 18 | 3059 |
| CFTR-W1282X-68 | − | GGGAAGAACUGGAUCAGGG | 19 | 3060 |
| CFTR-W1282X-69 | − | GAAAUCCAGAUCGAUGGUGUGUCU | 24 | 3061 |

Table 29B provides exemplary targeting domains for correcting a mutation (e.g., W1282X) in the CFTR gene selected according to the second tier parameters. The targeting domains bind within 200 bp from a mutation (e.g., W1282X), have a high level of orthogonality and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 29B

| gRNA Name | DNA Strand | Targeting Domain | Target Site Length | Seq ID |
|---|---|---|---|---|
| | | 2nd Tier | | |
| CFTR-W1282X-70 | + | CCUAUAAGGUAAAAGUGA | 18 | 3062 |
| CFTR-W1282X-71 | + | ACCUAUAAGGUAAAAGUGA | 19 | 3063 |
| CFTR-W1282X-33 | + | CACCUAUAAGGUAAAAGUGA | 20 | 3025 |
| CFTR-W1282X-72 | + | CCACCUAUAAGGUAAAAGUGA | 21 | 3064 |
| CFTR-W1282X-73 | + | CCCACCUAUAAGGUAAAAGUGA | 22 | 3065 |
| CFTR-W1282X-74 | + | UUGCAGAGUAAUAUGAAUUUC | 21 | 3066 |
| CFTR-W1282X-75 | + | UUUGCAGAGUAAUAUGAAUUUC | 22 | 3067 |
| CFTR-W1282X-76 | + | UUUUGCAGAGUAAUAUGAAUUUC | 23 | 3068 |
| CFTR-W1282X-77 | + | AUUUUGCAGAGUAAUAUGAAUUUC | 24 | 3069 |
| CFTR-W1282X-78 | + | CAUAACAAAUAUAUUUUG | 18 | 3070 |
| CFTR-W1282X-79 | + | UGCAUAACAAAUAUAUUUUG | 20 | 3071 |
| CFTR-W1282X-80 | + | UAUAUUUGCAGAGUAAU | 18 | 3072 |
| CFTR-W1282X-81 | + | AUAUAUUUUGCAGAGUAAU | 19 | 3073 |
| CFTR-W1282X-82 | + | AAUAUAUUUUGCAGAGUAAU | 20 | 3074 |
| CFTR-W1282X-83 | + | CCAAGACACACCAUCGAU | 18 | 3075 |
| CFTR-W1282X-84 | + | CCCAAGACACACCAUCGAU | 19 | 3076 |
| CFTR-W1282X-85 | + | UCCCAAGACACACCAUCGAU | 20 | 3077 |
| CFTR-W1282X-86 | + | AUCCCAAGACACACCAUCGAU | 21 | 3078 |
| CFTR-W1282X-87 | + | AAUCCCAAGACACACCAUCGAU | 22 | 3079 |
| CFTR-W1282X-88 | + | UGAAUCCCAAGACACACCAUCGAU | 24 | 3080 |
| CFTR-W1282X-89 | − | UGGGCCUCUUGGGAAGAA | 18 | 3081 |
| CFTR-W1282X-90 | − | AGGUGGGCCUCUUGGGAAGAA | 21 | 3082 |
| CFTR-W1282X-91 | − | UAGGUGGGCCUCUUGGGAAGAA | 22 | 3083 |
| CFTR-W1282X-92 | − | AUAGGUGGGCCUCUUGGGAAGAA | 23 | 3084 |
| CFTR-W1282X-93 | − | UAUAGGUGGGCCUCUUGGGAAGAA | 24 | 3085 |
| CFTR-W1282X-94 | − | UGGGAAGAACUGGAUCAGGG | 20 | 3086 |
| CFTR-W1282X-95 | − | UUGGGAAGAACUGGAUCAGGG | 21 | 3087 |
| CFTR-W1282X-96 | − | CUUGGGAAGAACUGGAUCAGGG | 22 | 3088 |
| CFTR-W1282X-97 | − | UCUUGGGAAGAACUGGAUCAGGG | 23 | 3089 |
| CFTR-W1282X-98 | − | CUCUUGGGAAGAACUGGAUCAGGG | 24 | 3090 |
| CFTR-W1282X-99 | − | CAGAUCGAUGGUGUGUCU | 18 | 3091 |
| CFTR-W1282X-100 | − | CCAGAUCGAUGGUGUGUCU | 19 | 3092 |
| CFTR-W1282X-48 | − | UCCAGAUCGAUGGUGUGUCU | 20 | 3040 |
| CFTR-W1282X-101 | − | AUCCAGAUCGAUGGUGUGUCU | 21 | 3093 |

TABLE 29B-continued

2nd Tier

| gRNA Name | DNA Strand | Targeting Domain | Target Site Length | Seq ID |
|---|---|---|---|---|
| CFTR-W1282X-102 | - | AAUCCAGAUCGAUGGUGUGUCU | 22 | 3094 |
| CFTR-W1282X-103 | - | AAAUCCAGAUCGAUGGUGUGUCU | 23 | 3095 |

Table 29C provides exemplary targeting domains for correcting a mutation (e.g., W1282X) in the CFTR gene selected according to the third tier parameters. The targeting domains bind within 200 bp from a mutation (e.g., W1282X), start with a 5'G and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 29C

3rd Tier

| gRNA Name | DNA Strand | Targeting Domain | Target Site Length | Seq ID |
|---|---|---|---|---|
| CFTR-W1282X-104 | + | GCAGAGUAAUAUGAAUUUC | 19 | 3096 |
| CFTR-W1282X-105 | + | GCAAUGCAUAACAAAUAUAUUUUG | 24 | 3097 |
| CFTR-W1282X-106 | - | GCAACAGUGAAGGAAAGCCUU | 21 | 3098 |

Table 29D provides exemplary targeting domains for correcting a mutation (e.g., W1282X) in the CFTR gene selected according to the fourth tier parameters. The targeting domains bind within 200 bp from a mutation (e.g., W1282X), and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 29D

4th Tier

| gRNA Name | DNA Strand | Targeting Domain | Target Site Length | Seq ID |
|---|---|---|---|---|
| CFTR-W1282X-107 | + | UUCACUGUUGCAAAGUUA | 18 | 3099 |
| CFTR-W1282X-108 | + | CUUCACUGUUGCAAAGUUA | 19 | 3100 |
| CFTR-W1282X-109 | + | CCUUCACUGUUGCAAAGUUA | 20 | 3101 |
| CFTR-W1282X-110 | + | UCCUUCACUGUUGCAAAGUUA | 21 | 3102 |
| CFTR-W1282X-111 | + | UUCCUUCACUGUUGCAAAGUUA | 22 | 3103 |
| CFTR-W1282X-112 | + | UUUCCUUCACUGUUGCAAAGUUA | 23 | 3104 |
| CFTR-W1282X-113 | + | CUUUCCUUCACUGUUGCAAAGUUA | 24 | 3105 |
| CFTR-W1282X-114 | + | CAGAGUAAUAUGAAUUUC | 18 | 3106 |
| CFTR-W1282X-115 | + | UGCAGAGUAAUAUGAAUUUC | 20 | 3107 |
| CFTR-W1282X-116 | + | AUGCAUAACAAAUAUAUUUUG | 21 | 3108 |

TABLE 29D-continued

4th Tier

| gRNA Name | DNA Strand | Targeting Domain | Target Site Length | Seq ID |
|---|---|---|---|---|
| CFTR-W1282X-117 | + | AAUGCAUAACAAAUAUAUUUUG | 22 | 3109 |
| CFTR-W1282X-118 | + | CAAUGCAUAACAAAUAUAUUUUG | 23 | 3110 |
| CFTR-W1282X-119 | + | AAAUAUAUUUUGCAGAGUAAU | 21 | 3111 |
| CFTR-W1282X-120 | + | CAAAUAUAUUUUGCAGAGUAAU | 22 | 3112 |
| CFTR-W1282X-121 | + | ACAAAUAUAUUUUGCAGAGUAAU | 23 | 3113 |
| CFTR-W1282X-122 | + | AACAAAUAUAUUUUGCAGAGUAAU | 24 | 3114 |
| CFTR-W1282X-123 | – | ACAGUGAAGGAAAGCCUU | 18 | 3115 |
| CFTR-W1282X-124 | – | AACAGUGAAGGAAAGCCUU | 19 | 3116 |
| CFTR-W1282X-59 | – | CAACAGUGAAGGAAAGCCUU | 20 | 3051 |
| CFTR-W1282X-125 | – | UGCAACAGUGAAGGAAAGCCUU | 22 | 3117 |
| CFTR-W1282X-126 | – | UUGCAACAGUGAAGGAAAGCCUU | 23 | 3118 |
| CFTR-W1282X-127 | – | UUUGCAACAGUGAAGGAAAGCCUU | 24 | 3119 |

Table 29E provides exemplary targeting domains for correcting a mutation (e.g., W1282X) in the CFTR gene selected according to the fifth tier parameters. The targeting domains bind within 200 bp from a mutation (e.g., W1282X), and PAM is NNGRRV. It is contemplated herein that in an embodiment the targeting domain hybridizes to the target domain through complementary base pairing. Any of the targeting domains in the Table 1 can be used with a S. aureus Cas9 molecule that generates a double stranded break (Cas9 nuclease) or a single-stranded break (Cas9 nickase).

TABLE 29E

5th Tier

| gRNA Name | DNA Strand | Targeting Domain | Target Site Length | Seq ID |
|---|---|---|---|---|
| CFTR-W1282X-128 | + | GCCUAUGAGAAAACUGCA | 18 | 3120 |
| CFTR-W1282X-129 | + | UGCCUAUGAGAAAACUGCA | 19 | 3121 |
| CFTR-W1282X-130 | + | CUGCCUAUGAGAAAACUGCA | 20 | 3122 |
| CFTR-W1282X-131 | + | UCUGCCUAUGAGAAAACUGCA | 21 | 3123 |
| CFTR-W1282X-132 | + | UUCUGCCUAUGAGAAAACUGCA | 22 | 3124 |
| CFTR-W1282X-133 | + | UUUCUGCCUAUGAGAAAACUGCA | 23 | 3125 |
| CFTR-W1282X-134 | + | UUUUCUGCCUAUGAGAAAACUGCA | 24 | 3126 |
| CFTR-W1282X-135 | + | CCUAUGAGAAAACUGCAC | 18 | 3127 |
| CFTR-W1282X-136 | + | GCCUAUGAGAAAACUGCAC | 19 | 3128 |
| CFTR-W1282X-37 | + | UGCCUAUGAGAAAACUGCAC | 20 | 3029 |
| CFTR-W1282X-137 | + | CUGCCUAUGAGAAAACUGCAC | 21 | 3129 |
| CFTR-W1282X-138 | + | UCUGCCUAUGAGAAAACUGCAC | 22 | 3130 |
| CFTR-W1282X-139 | + | UUCUGCCUAUGAGAAAACUGCAC | 23 | 3131 |
| CFTR-W1282X-140 | + | UUUCUGCCUAUGAGAAAACUGCAC | 24 | 3132 |
| CFTR-W1282X-141 | + | CCUGAUCCAGUUCUUCCC | 18 | 3133 |
| CFTR-W1282X-142 | + | CCCUGAUCCAGUUCUUCCC | 19 | 3134 |
| CFTR-W1282X-143 | + | UCCCUGAUCCAGUUCUUCCC | 20 | 3135 |

TABLE 29E-continued

5th Tier

| gRNA Name | DNA Strand | Targeting Domain | Target Site Length | Seq ID |
|---|---|---|---|---|
| CFTR-W1282X-144 | + | UUCCCUGAUCCAGUUCUUCCC | 21 | 3136 |
| CFTR-W1282X-145 | + | CUUCCCUGAUCCAGUUCUUCCC | 22 | 3137 |
| CFTR-W1282X-146 | + | UCUUCCCUGAUCCAGUUCUUCCC | 23 | 3138 |
| CFTR-W1282X-147 | + | CUCUUCCCUGAUCCAGUUCUUCCC | 24 | 3139 |
| CFTR-W1282X-148 | + | UAUGAGAAAACUGCACUG | 18 | 3140 |
| CFTR-W1282X-149 | + | CUAUGAGAAAACUGCACUG | 19 | 3141 |
| CFTR-W1282X-150 | + | CCUAUGAGAAAACUGCACUG | 20 | 3142 |
| CFTR-W1282X-151 | + | GCCUAUGAGAAAACUGCACUG | 21 | 3143 |
| CFTR-W1282X-152 | + | UGCCUAUGAGAAAACUGCACUG | 22 | 3144 |
| CFTR-W1282X-153 | + | CUGCCUAUGAGAAAACUGCACUG | 23 | 3145 |
| CFTR-W1282X-154 | + | UCUGCCUAUGAGAAAACUGCACUG | 24 | 3146 |
| CFTR-W1282X-155 | + | ACCUAUAAGGUAAAAGUG | 18 | 3147 |
| CFTR-W1282X-156 | + | CACCUAUAAGGUAAAAGUG | 19 | 3148 |
| CFTR-W1282X-157 | + | CCACCUAUAAGGUAAAAGUG | 20 | 3149 |
| CFTR-W1282X-158 | + | CCCACCUAUAAGGUAAAAGUG | 21 | 3150 |
| CFTR-W1282X-159 | + | GCCCACCUAUAAGGUAAAAGUG | 22 | 3151 |
| CFTR-W1282X-160 | + | GGCCCACCUAUAAGGUAAAAGUG | 23 | 3152 |
| CFTR-W1282X-161 | + | AGGCCCACCUAUAAGGUAAAAGUG | 24 | 3153 |
| CFTR-W1282X-162 | + | GACAUCUUUUCUGCCUAU | 18 | 3154 |
| CFTR-W1282X-163 | + | AGACAUCUUUUCUGCCUAU | 19 | 3155 |
| CFTR-W1282X-164 | + | GAGACAUCUUUUCUGCCUAU | 20 | 3156 |
| CFTR-W1282X-165 | + | AGAGACAUCUUUUCUGCCUAU | 21 | 3157 |
| CFTR-W1282X-166 | + | UAGAGACAUCUUUUCUGCCUAU | 22 | 3158 |
| CFTR-W1282X-167 | + | UUAGAGACAUCUUUUCUGCCUAU | 23 | 3159 |
| CFTR-W1282X-168 | + | UUUAGAGACAUCUUUUCUGCCUAU | 24 | 3160 |
| CFTR-W1282X-169 | + | GAGACAUCUUUUCUGCCU | 18 | 3161 |
| CFTR-W1282X-170 | + | AGAGACAUCUUUUCUGCCU | 19 | 3162 |
| CFTR-W1282X-171 | + | UAGAGACAUCUUUUCUGCCU | 20 | 3163 |
| CFTR-W1282X-172 | + | UUAGAGACAUCUUUUCUGCCU | 21 | 3164 |
| CFTR-W1282X-173 | + | UUUAGAGACAUCUUUUCUGCCU | 22 | 3165 |
| CFTR-W1282X-174 | + | UUUUAGAGACAUCUUUUCUGCCU | 23 | 3166 |
| CFTR-W1282X-175 | + | CUUUUAGAGACAUCUUUUCUGCCU | 24 | 3167 |
| CFTR-W1282X-176 | − | GAUACCACAGGUGAGCAA | 18 | 3168 |
| CFTR-W1282X-177 | − | UGAUACCACAGGUGAGCAA | 19 | 3169 |
| CFTR-W1282X-178 | − | GUGAUACCACAGGUGAGCAA | 20 | 3170 |
| CFTR-W1282X-179 | − | AGUGAUACCACAGGUGAGCAA | 21 | 3171 |
| CFTR-W1282X-180 | − | GAGUGAUACCACAGGUGAGCAA | 22 | 3172 |
| CFTR-W1282X-181 | − | GGAGUGAUACCACAGGUGAGCAA | 23 | 3173 |

TABLE 29E-continued

5th Tier

| gRNA Name | DNA Strand | Targeting Domain | Target Site Length | Seq ID |
|---|---|---|---|---|
| CFTR-W1282X-182 | − | UGGAGUGAUACCACAGGUGAGCAA | 24 | 3174 |
| CFTR-W1282X-183 | − | UUCAAUAACUUUGCAACA | 18 | 3175 |
| CFTR-W1282X-184 | − | AUUCAAUAACUUUGCAACA | 19 | 3176 |
| CFTR-W1282X-185 | − | GAUUCAAUAACUUUGCAACA | 20 | 3177 |
| CFTR-W1282X-186 | − | GGAUUCAAUAACUUUGCAACA | 21 | 3178 |
| CFTR-W1282X-187 | − | GGGAUUCAAUAACUUUGCAACA | 22 | 3179 |
| CFTR-W1282X-188 | − | UGGGAUUCAAUAACUUUGCAACA | 23 | 3180 |
| CFTR-W1282X-189 | − | UUGGGAUUCAAUAACUUUGCAACA | 24 | 3181 |
| CFTR-W1282X-190 | − | UUUUGAGACUACUGAACA | 18 | 3182 |
| CFTR-W1282X-191 | − | UUUUUGAGACUACUGAACA | 19 | 3183 |
| CFTR-W1282X-192 | − | UUUUUUGAGACUACUGAACA | 20 | 3184 |
| CFTR-W1282X-193 | − | CUUUUUUGAGACUACUGAACA | 21 | 3185 |
| CFTR-W1282X-194 | − | GCUUUUUUGAGACUACUGAACA | 22 | 3186 |
| CFTR-W1282X-195 | − | AGCUUUUUUGAGACUACUGAACA | 23 | 3187 |
| CFTR-W1282X-196 | − | CAGCUUUUUUGAGACUACUGAACA | 24 | 3188 |
| CFTR-W1282X-197 | − | UUGGGAAGAACUGGAUCA | 18 | 3189 |
| CFTR-W1282X-198 | − | CUUGGGAAGAACUGGAUCA | 19 | 3190 |
| CFTR-W1282X-31 | − | UCUUGGGAAGAACUGGAUCA | 20 | 3023 |
| CFTR-W1282X-199 | − | CUCUUGGGAAGAACUGGAUCA | 21 | 3191 |
| CFTR-W1282X-200 | − | CCUCUUGGGAAGAACUGGAUCA | 22 | 3192 |
| CFTR-W1282X-201 | − | GCCUCUUGGGAAGAACUGGAUCA | 23 | 3193 |
| CFTR-W1282X-202 | − | GGCCUCUUGGGAAGAACUGGAUCA | 24 | 3194 |
| CFTR-W1282X-203 | − | CAUGGUACCUAUAUGUCA | 18 | 3195 |
| CFTR-W1282X-204 | − | GCAUGGUACCUAUAUGUCA | 19 | 3196 |
| CFTR-W1282X-205 | − | GGCAUGGUACCUAUAUGUCA | 20 | 3197 |
| CFTR-W1282X-206 | − | UGGCAUGGUACCUAUAUGUCA | 21 | 3198 |
| CFTR-W1282X-207 | − | AUGGCAUGGUACCUAUAUGUCA | 22 | 3199 |
| CFTR-W1282X-208 | − | UAUGGCAUGGUACCUAUAUGUCA | 23 | 3200 |
| CFTR-W1282X-209 | − | UUAUGGCAUGGUACCUAUAUGUCA | 24 | 3201 |
| CFTR-W1282X-210 | − | GAGACUACUGAACACUGA | 18 | 3202 |
| CFTR-W1282X-211 | − | UGAGACUACUGAACACUGA | 19 | 3203 |
| CFTR-W1282X-32 | − | UUGAGACUACUGAACACUGA | 20 | 3024 |
| CFTR-W1282X-212 | − | UUUGAGACUACUGAACACUGA | 21 | 3204 |
| CFTR-W1282X-213 | − | UUUUGAGACUACUGAACACUGA | 22 | 3205 |
| CFTR-W1282X-214 | − | UUUUUGAGACUACUGAACACUGA | 23 | 3206 |
| CFTR-W1282X-215 | − | UUUUUUGAGACUACUGAACACUGA | 24 | 3207 |
| CFTR-W1282X-216 | − | AUAACUUUGCAACAGUGA | 18 | 3208 |

TABLE 29E-continued

5th Tier

| gRNA Name | DNA Strand | Targeting Domain | Target Site Length | Seq ID |
|---|---|---|---|---|
| CFTR-W1282X-217 | - | AAUAACUUUGCAACAGUGA | 19 | 3209 |
| CFTR-W1282X-58 | - | CAAUAACUUUGCAACAGUGA | 20 | 3050 |
| CFTR-W1282X-218 | - | UCAAUAACUUUGCAACAGUGA | 21 | 3210 |
| CFTR-W1282X-219 | - | UUCAAUAACUUUGCAACAGUGA | 22 | 3211 |
| CFTR-W1282X-220 | - | AUUCAAUAACUUUGCAACAGUGA | 23 | 3212 |
| CFTR-W1282X-221 | - | GAUUCAAUAACUUUGCAACAGUGA | 24 | 3213 |
| CFTR-W1282X-222 | - | UCAGCUUUUUGAGACUA | 18 | 3214 |
| CFTR-W1282X-223 | - | AUCAGCUUUUUGAGACUA | 19 | 3215 |
| CFTR-W1282X-224 | - | UAUCAGCUUUUUGAGACUA | 20 | 3216 |
| CFTR-W1282X-225 | - | UUAUCAGCUUUUUGAGACUA | 21 | 3217 |
| CFTR-W1282X-226 | - | GUUAUCAGCUUUUUGAGACUA | 22 | 3218 |
| CFTR-W1282X-227 | - | UGUUAUCAGCUUUUUGAGACUA | 23 | 3219 |
| CFTR-W1282X-228 | - | UUGUUAUCAGCUUUUUGAGACUA | 24 | 3220 |
| CFTR-W1282X-229 | - | UGAGCAAAAGGACUUAGC | 18 | 3221 |
| CFTR-W1282X-230 | - | GUGAGCAAAAGGACUUAGC | 19 | 3222 |
| CFTR-W1282X-231 | - | GGUGAGCAAAAGGACUUAGC | 20 | 3223 |
| CFTR-W1282X-232 | - | AGGUGAGCAAAAGGACUUAGC | 21 | 3224 |
| CFTR-W1282X-233 | - | CAGGUGAGCAAAAGGACUUAGC | 22 | 3225 |
| CFTR-W1282X-234 | - | ACAGGUGAGCAAAAGGACUUAGC | 23 | 3226 |
| CFTR-W1282X-235 | - | CACAGGUGAGCAAAAGGACUUAGC | 24 | 3227 |
| CFTR-W1282X-236 | - | CUUGGGAAGAACUGGAUC | 18 | 3228 |
| CFTR-W1282X-237 | - | UCUUGGGAAGAACUGGAUC | 19 | 3229 |
| CFTR-W1282X-39 | - | CUCUUGGGAAGAACUGGAUC | 20 | 3031 |
| CFTR-W1282X-238 | - | CCUCUUGGGAAGAACUGGAUC | 21 | 3230 |
| CFTR-W1282X-239 | - | GCCUCUUGGGAAGAACUGGAUC | 22 | 3231 |
| CFTR-W1282X-240 | - | GGCCUCUUGGGAAGAACUGGAUC | 23 | 3232 |
| CFTR-W1282X-241 | - | GGGCCUCUUGGGAAGAACUGGAUC | 24 | 3233 |
| CFTR-W1282X-242 | - | UAUUUGAUACUUGUACUC | 18 | 3234 |
| CFTR-W1282X-243 | - | CUAUUUGAUACUUGUACUC | 19 | 3235 |
| CFTR-W1282X-244 | - | GCUAUUUGAUACUUGUACUC | 20 | 3236 |
| CFTR-W1282X-245 | - | UGCUAUUUGAUACUUGUACUC | 21 | 3237 |
| CFTR-W1282X-246 | - | CUGCUAUUUGAUACUUGUACUC | 22 | 3238 |
| CFTR-W1282X-247 | - | ACUGCUAUUUGAUACUUGUACUC | 23 | 3239 |
| CFTR-W1282X-248 | - | UACUGCUAUUUGAUACUUGUACUC | 24 | 3240 |
| CFTR-W1282X-249 | - | ACCUUAUAGGUGGGCCUC | 18 | 3241 |
| CFTR-W1282X-250 | - | UACCUUAUAGGUGGGCCUC | 19 | 3242 |
| CFTR-W1282X-251 | - | UUACCUUAUAGGUGGGCCUC | 20 | 3243 |
| CFTR-W1282X-252 | - | UUUACCUUAUAGGUGGGCCUC | 21 | 3244 |

TABLE 29E-continued

| | | 5th Tier | | |
|---|---|---|---|---|
| gRNA Name | DNA Strand | Targeting Domain | Target Site Length | Seq ID |
| CFTR-W1282X-253 | − | UUUUACCUUAUAGGUGGGCCUC | 22 | 3245 |
| CFTR-W1282X-254 | − | CUUUUACCUUAUAGGUGGGCCUC | 23 | 3246 |
| CFTR-W1282X-255 | − | ACUUUUACCUUAUAGGUGGGCCUC | 24 | 3247 |
| CFTR-W1282X-256 | − | CCAGAUCGAUGGUGUGUC | 18 | 3248 |
| CFTR-W1282X-257 | − | UCCAGAUCGAUGGUGUGUC | 19 | 3249 |
| CFTR-W1282X-258 | − | AUCCAGAUCGAUGGUGUGUC | 20 | 3250 |
| CFTR-W1282X-259 | − | AAUCCAGAUCGAUGGUGUGUC | 21 | 3251 |
| CFTR-W1282X-260 | − | AAAUCCAGAUCGAUGGUGUGUC | 22 | 3252 |
| CFTR-W1282X-261 | − | GAAAUCCAGAUCGAUGGUGUGUC | 23 | 3253 |
| CFTR-W1282X-262 | − | AGAAAUCCAGAUCGAUGGUGUGUC | 24 | 3254 |
| CFTR-W1282X-263 | − | GACUACUGAACACUGAAG | 18 | 3255 |
| CFTR-W1282X-264 | − | AGACUACUGAACACUGAAG | 19 | 3256 |
| CFTR-W1282X-265 | − | GAGACUACUGAACACUGAAG | 20 | 3257 |
| CFTR-W1282X-266 | − | UGAGACUACUGAACACUGAAG | 21 | 3258 |
| CFTR-W1282X-267 | − | UUGAGACUACUGAACACUGAAG | 22 | 3259 |
| CFTR-W1282X-268 | − | UUUGAGACUACUGAACACUGAAG | 23 | 3260 |
| CFTR-W1282X-269 | − | UUUUGAGACUACUGAACACUGAAG | 24 | 3261 |
| CFTR-W1282X-270 | − | UUUGGAGUGAUACCACAG | 18 | 3262 |
| CFTR-W1282X-271 | − | CUUUGGAGUGAUACCACAG | 19 | 3263 |
| CFTR-W1282X-272 | − | CCUUUGGAGUGAUACCACAG | 20 | 3264 |
| CFTR-W1282X-273 | − | GCCUUUGGAGUGAUACCACAG | 21 | 3265 |
| CFTR-W1282X-274 | − | AGCCUUUGGAGUGAUACCACAG | 22 | 3266 |
| CFTR-W1282X-275 | − | AAGCCUUUGGAGUGAUACCACAG | 23 | 3267 |
| CFTR-W1282X-276 | − | AAAGCCUUUGGAGUGAUACCACAG | 24 | 3268 |
| CFTR-W1282X-277 | − | AUCACUUUUACCUUAUAG | 18 | 3269 |
| CFTR-W1282X-278 | − | CAUCACUUUUACCUUAUAG | 19 | 3270 |
| CFTR-W1282X-279 | − | CCAUCACUUUUACCUUAUAG | 20 | 3271 |
| CFTR-W1282X-280 | − | CCCAUCACUUUUACCUUAUAG | 21 | 3272 |
| CFTR-W1282X-281 | − | UCCCAUCACUUUUACCUUAUAG | 22 | 3273 |
| CFTR-W1282X-282 | − | AUCCCAUCACUUUUACCUUAUAG | 23 | 3274 |
| CFTR-W1282X-283 | − | GAUCCCAUCACUUUUACCUUAUAG | 24 | 3275 |
| CFTR-W1282X-284 | − | GUGCAGUUUUCUCAUAGG | 18 | 3276 |
| CFTR-W1282X-285 | − | AGUGCAGUUUUCUCAUAGG | 19 | 3277 |
| CFTR-W1282X-286 | − | CAGUGCAGUUUUCUCAUAGG | 20 | 3278 |
| CFTR-W1282X-287 | − | CCAGUGCAGUUUUCUCAUAGG | 21 | 3279 |
| CFTR-W1282X-288 | − | UCCAGUGCAGUUUUCUCAUAGG | 22 | 3280 |
| CFTR-W1282X-289 | − | CUCCAGUGCAGUUUUCUCAUAGG | 23 | 3281 |

TABLE 29E-continued

| 5th Tier | | | | |
|---|---|---|---|---|
| gRNA Name | DNA Strand | Targeting Domain | Target Site Length | Seq ID |
| CFTR-W1282X-290 | - | UCUCCAGUGCAGUUUUCUCAUAGG | 24 | 3282 |
| CFTR-W1282X-291 | - | AUAGGUGGGCCUCUUGGG | 18 | 3283 |
| CFTR-W1282X-292 | - | UAUAGGUGGGCCUCUUGGG | 19 | 3284 |
| CFTR-W1282X-293 | - | UUAUAGGUGGGCCUCUUGGG | 20 | 3285 |
| CFTR-W1282X-294 | - | CUUAUAGGUGGGCCUCUUGGG | 21 | 3286 |
| CFTR-W1282X-295 | - | CCUUAUAGGUGGGCCUCUUGGG | 22 | 3287 |
| CFTR-W1282X-296 | - | ACCUUAUAGGUGGGCCUCUUGGG | 23 | 3288 |
| CFTR-W1282X-297 | - | UACCUUAUAGGUGGGCCUCUUGGG | 24 | 3289 |
| CFTR-W1282X-298 | - | UGAGACUACUGAACACUG | 18 | 3290 |
| CFTR-W1282X-299 | - | UUGAGACUACUGAACACUG | 19 | 3291 |
| CFTR-W1282X-300 | - | UUUGAGACUACUGAACACUG | 20 | 3292 |
| CFTR-W1282X-301 | - | UUUUGAGACUACUGAACACUG | 21 | 3293 |
| CFTR-W1282X-302 | - | UUUUUGAGACUACUGAACACUG | 22 | 3294 |
| CFTR-W1282X-303 | - | UUUUUUGAGACUACUGAACACUG | 23 | 3295 |
| CFTR-W1282X-304 | - | CUUUUUUGAGACUACUGAACACUG | 24 | 3296 |
| CFTR-W1282X-305 | - | AAUAACUUUGCAACAGUG | 18 | 3297 |
| CFTR-W1282X-306 | - | CAAUAACUUUGCAACAGUG | 19 | 3298 |
| CFTR-W1282X-307 | - | UCAAUAACUUUGCAACAGUG | 20 | 3299 |
| CFTR-W1282X-308 | - | UUCAAUAACUUUGCAACAGUG | 21 | 3300 |
| CFTR-W1282X-309 | - | AUUCAAUAACUUUGCAACAGUG | 22 | 3301 |
| CFTR-W1282X-310 | - | GAUUCAAUAACUUUGCAACAGUG | 23 | 3302 |
| CFTR-W1282X-311 | - | GGAUUCAAUAACUUUGCAACAGUG | 24 | 3303 |
| CFTR-W1282X-312 | - | UCUUGGGAAGAACUGGAU | 18 | 3304 |
| CFTR-W1282X-313 | - | CUCUUGGGAAGAACUGGAU | 19 | 3305 |
| CFTR-W1282X-314 | - | CCUCUUGGGAAGAACUGGAU | 20 | 3306 |
| CFTR-W1282X-315 | - | GCCUCUUGGGAAGAACUGGAU | 21 | 3307 |
| CFTR-W1282X-316 | - | GGCCUCUUGGGAAGAACUGGAU | 22 | 3308 |
| CFTR-W1282X-317 | - | GGGCCUCUUGGGAAGAACUGGAU | 23 | 3309 |
| CFTR-W1282X-318 | - | UGGGCCUCUUGGGAAGAACUGGAU | 24 | 3310 |
| CFTR-W1282X-319 | - | AACAGUGAAGGAAAGCCU | 18 | 3311 |
| CFTR-W1282X-320 | - | CAACAGUGAAGGAAAGCCU | 19 | 3312 |
| CFTR-W1282X-321 | - | GCAACAGUGAAGGAAAGCCU | 20 | 3313 |
| CFTR-W1282X-322 | - | UGCAACAGUGAAGGAAAGCCU | 21 | 3314 |
| CFTR-W1282X-323 | - | UUGCAACAGUGAAGGAAAGCCU | 22 | 3315 |
| CFTR-W1282X-324 | - | UUUGCAACAGUGAAGGAAAGCCU | 23 | 3316 |
| CFTR-W1282X-325 | - | CUUUGCAACAGUGAAGGAAAGCCU | 24 | 3317 |
| CFTR-W1282X-326 | - | CCUUAUAGGUGGGCCUCU | 18 | 3318 |
| CFTR-W1282X-327 | - | ACCUUAUAGGUGGGCCUCU | 19 | 3319 |

TABLE 29E-continued

5th Tier

| gRNA Name | DNA Strand | Targeting Domain | Target Site Length | Seq ID |
|---|---|---|---|---|
| CFTR-W1282X-47 | - | UACCUUAUAGGUGGGCCUCU | 20 | 3039 |
| CFTR-W1282X-328 | - | UUACCUUAUAGGUGGGCCUCU | 21 | 3320 |
| CFTR-W1282X-329 | - | UUUACCUUAUAGGUGGGCCUCU | 22 | 3321 |
| CFTR-W1282X-330 | - | UUUUACCUUAUAGGUGGGCCUCU | 23 | 3322 |
| CFTR-W1282X-331 | - | CUUUUACCUUAUAGGUGGGCCUCU | 24 | 3323 |
| CFTR-W1282X-332 | - | CUUAUAGGUGGGCCUCUU | 18 | 3324 |
| CFTR-W1282X-333 | - | CCUUAUAGGUGGGCCUCUU | 19 | 3325 |
| CFTR-W1282X-60 | - | ACCUUAUAGGUGGGCCUCUU | 20 | 3052 |
| CFTR-W1282X-334 | - | UACCUUAUAGGUGGGCCUCUU | 21 | 3326 |
| CFTR-W1282X-335 | - | UUACCUUAUAGGUGGGCCUCUU | 22 | 3327 |
| CFTR-W1282X-336 | - | UUUACCUUAUAGGUGGGCCUCUU | 23 | 3328 |
| CFTR-W1282X-337 | - | UUUUACCUUAUAGGUGGGCCUCUU | 24 | 3329 |
| CFTR-W1282X-338 | - | ACUUUGUUAUCAGCUUUU | 18 | 3330 |
| CFTR-W1282X-339 | - | UACUUUGUUAUCAGCUUUU | 19 | 3331 |
| CFTR-W1282X-340 | - | GUACUUUGUUAUCAGCUUUU | 20 | 3332 |
| CFTR-W1282X-341 | - | AGUACUUUGUUAUCAGCUUUU | 21 | 3333 |
| CFTR-W1282X-342 | - | GAGUACUUUGUUAUCAGCUUUU | 22 | 3334 |
| CFTR-W1282X-343 | - | AGAGUACUUUGUUAUCAGCUUUU | 23 | 3335 |
| CFTR-W1282X-344 | - | AAGAGUACUUUGUUAUCAGCUUUU | 24 | 3336 |

Table 30A provides exemplary targeting domains for correcting a mutation (e.g., W1282X) in the CFTR gene selected according to the first tier parameters. The targeting domains bind within 200 bp from a mutation (e.g., W1282X), have a high level of orthogonality and start with a 5'G. It is contemplated herein that in an embodiment the targeting domain hybridizes to the target domain through complementary base pairing. Any of the targeting domains in the Table 1 can be used with a *N. meningitidis* Cas9 molecule that generates a double stranded break (Cas9 nuclease) or a single-stranded break (Cas9 nickase).

TABLE 30A

1st Tier

| gRNA Name | DNA Strand | Targeting Domain | Target Site Length | Seq ID |
|---|---|---|---|---|
| CFTR-W1282X-345 | - | GGGAAGAGUACUUUGUU | 17 | 3337 |

Table 30B provides exemplary targeting domains for correcting a mutation (e.g., W1282X) in the CFTR gene selected according to the second tier parameters. The targeting domains bind within 200 bp from a mutation (e.g., W1282X) and have a high level of orthogonality. It is contemplated herein that in an embodiment the targeting domain hybridizes to the target domain through complementary base pairing. Any of the targeting domains in the Table 1 can be used with a *N. meningitidis* Cas9 molecule that generates a double stranded break (Cas9 nuclease) or a single-stranded break (Cas9 nickase).

TABLE 30B

| | 2nd Tier | | | |
|---|---|---|---|---|
| gRNA Name | DNA Strand | Targeting Domain | Target Site Length | Seq ID |
| CFTR-W1282X-346 | + | CCAAGACACACCAUCGA | 17 | 3338 |
| CFTR-W1282X-347 | + | ACCUGUGGUAUCACUCC | 17 | 3339 |
| CFTR-W1282X-348 | - | CAGAUCGAUGGUGUGUC | 17 | 3340 |
| CFTR-W1282X-349 | + | AUCCCAAGACACACCAUCGA | 20 | 3341 |
| CFTR-W1282X-350 | + | CUCACCUGUGGUAUCACUCC | 20 | 3342 |
| CFTR-W1282X-258 | - | AUCCAGAUCGAUGGUGUGUC | 20 | 3250 |
| CFTR-W1282X-351 | - | UCAGGGAAGAGUACUUUGUU | 20 | 3343 |

Table 31A provides exemplary targeting domains for correcting a mutation (e.g., 3272-26→G) in the CFTR gene selected according to the first tier parameters. The targeting domains bind within 200 bp from a mutation (e.g., 3272-26→G), have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 31A

| | 1st Tier | | | |
|---|---|---|---|---|
| gRNA Name | DNA Strand | Targeting Domain | Target Site Length | Seq ID |
| CFTR-3272-1 | + | GUAAGGCUGCCGUCCGA | 17 | 1282 |
| CFTR-3272-2 | - | GGAAAUAUUUCACAGGC | 17 | 1283 |
| CFTR-3272-3 | + | GUAAAUUCAGAGCUUUG | 17 | 1284 |
| CFTR-3272-4 | - | GGACACUUCGUGCCUUCGGA | 20 | 1285 |
| CFTR-3272-5 | + | GGAACCAGCGCAGUGUUGAC | 20 | 1286 |
| CFTR-3272-6 | + | GUAACAAGAUGAGUGAAAAU | 20 | 1287 |

Table 31B provides exemplary targeting domains for correcting a mutation (e.g., 3272-26→G) in the CFTR gene selected according to the second tier parameters. The targeting domains bind within 200 bp from a mutation (e.g., 3272-26→G) and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 31B

| | 2nd Tier | | | |
|---|---|---|---|---|
| gRNA Name | DNA Strand | Targeting Domain | Target Site Length | Seq ID |
| CFTR-3272-7 | - | CUUGUUACAAGCUUAAA | 17 | 1288 |
| CFTR-3272-8 | - | CAUAUCUAUUCAAAGAA | 17 | 1289 |

TABLE 31B-continued

| | 2nd Tier | | | |
|---|---|---|---|---|
| gRNA Name | DNA Strand | Targeting Domain | Target Site Length | Seq ID |
| CFTR-3272-9 | + | UACUUGGCUACCAGAGA | 17 | 1290 |
| CFTR-3272-10 | - | CACUUCGUGCCUUCGGA | 17 | 1291 |
| CFTR-3272-11 | - | CAAGCUUAAAAGGACUA | 17 | 1292 |
| CFTR-3272-12 | - | AUUUACAUACUGCCAAC | 17 | 1293 |
| CFTR-3272-13 | + | AAAGCUUUUUUUCACAC | 17 | 1294 |
| CFTR-3272-14 | - | CUAUGGAAAUAUUUCAC | 17 | 1295 |
| CFTR-3272-15 | + | ACCAGCGCAGUGUUGAC | 17 | 1296 |
| CFTR-3272-16 | - | ACCUGUCAACACUGCGC | 17 | 1297 |
| CFTR-3272-17 | - | CUAAUUUAGUCUUUUUC | 17 | 1298 |
| CFTR-3272-18 | + | CAUAUCACAAAUGUCAU | 17 | 1299 |
| CFTR-3272-19 | + | ACUUGGCUACCAGAGAU | 17 | 1300 |
| CFTR-3272-20 | - | UACCCUCUUUUUUUACU | 17 | 1301 |
| CFTR-3272-21 | + | CAGGUACAAGAACCAGU | 17 | 1302 |
| CFTR-3272-22 | - | UGGACACUUCGUGCCUU | 17 | 1303 |
| CFTR-3272-23 | - | CAUCUUGUUACAAGCUUAAA | 20 | 1304 |
| CFTR-3272-24 | - | AAUCAUAUCUAUUCAAAGAA | 20 | 1305 |

TABLE 31B-continued

2nd Tier

| gRNA Name | DNA Strand | Targeting Domain | Target Site Length | Seq ID |
|---|---|---|---|---|
| CFTR-3272-25 | + | UUUUACUUGGCUACCAGAGA | 20 | 1306 |
| CFTR-3272-26 | + | AAAGUAAGGCUGCCGUCCGA | 20 | 1307 |
| CFTR-3272-27 | − | UUACAAGCUUAAAAGGACUA | 20 | 1308 |
| CFTR-3272-28 | + | UGGAACAGAGUUUCAAAGUA | 20 | 1309 |
| CFTR-3272-29 | − | UGAAUUUACAUACUGCCAAC | 20 | 1310 |
| CFTR-3272-30 | + | UAAAAAGCUUUUUUUCACAC | 20 | 1311 |
| CFTR-3272-31 | − | UUUCUAUGGAAAUAUUUCAC | 20 | 1312 |
| CFTR-3272-32 | − | UGUACCUGUCAACACUGCGC | 20 | 1313 |
| CFTR-3272-33 | − | UAUGGAAAUAUUUCACAGGC | 20 | 1314 |
| CFTR-3272-34 | − | UGGUAGCCAAGUAAAAAAAG | 20 | 1315 |
| CFTR-3272-35 | + | UAUGUAAAUUCAGAGCUUUG | 20 | 1316 |
| CFTR-3272-36 | + | AAUCAUAUCACAAAUGUCAU | 20 | 1317 |
| CFTR-3272-37 | + | UUUACUUGGCUACCAGAGAU | 20 | 1318 |
| CFTR-3272-38 | + | AGUUACCCUCUUUUUUUACU | 20 | 1319 |
| CFTR-3272-39 | + | UGACAGGUACAAGAACCAGU | 20 | 1320 |
| CFTR-3272-40 | − | CUAUGGACACUUCGUGCCUU | 20 | 1321 |

Table 31C provides exemplary targeting domains for correcting a mutation (e.g., 3272-26→G) in the CFTR gene selected according to the third tier parameters. The targeting domains bind within 200 bp from a mutation (e.g., 3272-26→G) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 31C

3rd Tier

| gRNA Name | DNA Strand | Targeting Domain | Target Site Length | Seq ID |
|---|---|---|---|---|
| CFTR-3272-41 | − | GGUAGCCAAGUAAAAAAGA | 20 | 1322 |
| CFTR-3272-42 | − | GUUAUUUGCAGUGUUUUCUA | 20 | 1323 |

Table 31D provides exemplary targeting domains for correcting a mutation (e.g., 3272-26→G) in the CFTR gene selected according to the fourth tier parameters. The targeting domains bind within 200 bp from a mutation (e.g., 3272-26→G). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 31D

4th Tier

| gRNA Name | DNA Strand | Targeting Domain | Target Site Length | Seq ID |
|---|---|---|---|---|
| CFTR-3272-43 | − | AGCCAAGUAAAAAAGA | 17 | 1324 |
| CFTR-3272-44 | − | AUUUGCAGUGUUUUCUA | 17 | 1325 |
| CFTR-3272-45 | + | AACAGAGUUUCAAAGUA | 17 | 1326 |
| CFTR-3272-46 | − | UAGCCAAGUAAAAAAAG | 17 | 1327 |
| CFTR-3272-47 | + | ACAAGAUGAGUGAAAAU | 17 | 1328 |
| CFTR-3272-48 | − | AUUCUAAUUUAGUCUUUUUC | 20 | 1329 |

Table 32A provides exemplary targeting domains for correcting a mutation (e.g., 3272-26→G) in the CFTR gene selected according to the first tier parameters. The targeting domains bind within 200 bp from a mutation (e.g., 3272-26→G), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 32A

1st Tier

| gRNA Name | DNA Strand | Targeting Domain | Target Site Length | Seq ID |
|---|---|---|---|---|
| CFTR-3272-49 | + | GUCCUUUUAAGCUUGUAACAAG | 22 | 1330 |
| CFTR-3272-50 | + | GUACCUGAAAAAGACUAAAU | 20 | 1331 |
| CFTR-3272-51 | − | GUCAACACUGCGCUGGUUCCAAAU | 24 | 1332 |

Table 32B provides exemplary targeting domains for correcting a mutation (e.g., 3272-26→G) in the CFTR gene selected according to the second tier parameters. The targeting domains bind within 200 bp from a mutation (e.g., 3272-26→G), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 32B

2nd Tier

| gRNA Name | DNA Strand | Targeting Domain | Target Site Length | Seq ID |
|---|---|---|---|---|
| CFTR-3272-52 | + | UUUUAAGCUUGUAACAAG | 18 | 1333 |
| CFTR-3272-53 | + | CUUUUAAGCUUGUAACAAG | 19 | 1334 |
| CFTR-3272-54 | + | CCUUUUAAGCUUGUAACAAG | 20 | 1335 |
| CFTR-3272-55 | + | UCCUUUUAAGCUUGUAACAAG | 21 | 1336 |
| CFTR-3272-56 | + | AGUCCUUUUAAGCUUGUAACAAG | 23 | 1337 |
| CFTR-3272-57 | + | UAGUCCUUUUAAGCUUGUAACAAG | 24 | 1338 |
| CFTR-3272-58 | + | ACCUGAAAAAGACUAAAU | 18 | 1339 |
| CFTR-3272-59 | + | UACCUGAAAAAGACUAAAU | 19 | 1340 |
| CFTR-3272-60 | + | UGUACCUGAAAAAGACUAAAU | 21 | 1341 |
| CFTR-3272-61 | + | UUGUACCUGAAAAAGACUAAAU | 22 | 1342 |
| CFTR-3272-62 | + | CUUGUACCUGAAAAAGACUAAAU | 23 | 1343 |
| CFTR-3272-63 | + | UCUUGUACCUGAAAAAGACUAAAU | 24 | 1344 |
| CFTR-3272-64 | + | UCACACUGGUGCCAUUCU | 18 | 1345 |
| CFTR-3272-65 | + | UUCACACUGGUGCCAUUCU | 19 | 1346 |
| CFTR-3272-66 | + | UUUCACACUGGUGCCAUUCU | 20 | 1347 |
| CFTR-3272-67 | + | UUUUCACACUGGUGCCAUUCU | 21 | 1348 |
| CFTR-3272-68 | + | UUUUUCACACUGGUGCCAUUCU | 22 | 1349 |
| CFTR-3272-69 | + | UUUUUUCACACUGGUGCCAUUCU | 23 | 1350 |
| CFTR-3272-70 | + | UUUUUUUCACACUGGUGCCAUUCU | 24 | 1351 |
| CFTR-3272-71 | − | ACAAAUCAUAUCUAUUCA | 18 | 1352 |
| CFTR-3272-72 | − | AACAAAUCAUAUCUAUUCA | 19 | 1353 |
| CFTR-3272-73 | − | UAACAAAUCAUAUCUAUUCA | 20 | 1354 |
| CFTR-3272-74 | − | AUAACAAAUCAUAUCUAUUCA | 21 | 1355 |
| CFTR-3272-75 | − | AAUAACAAAUCAUAUCUAUUCA | 22 | 1356 |
| CFTR-3272-76 | − | AAAUAACAAAUCAUAUCUAUUCA | 23 | 1357 |
| CFTR-3272-77 | − | AAAAUAACAAAUCAUAUCUAUUCA | 24 | 1358 |

TABLE 32B-continued

2nd Tier

| gRNA Name | DNA Strand | Targeting Domain | Target Site Length | Seq ID |
|---|---|---|---|---|
| CFTR-3272-78 | − | UGGAAAUAUUUCACAGGC | 18 | 1359 |
| CFTR-3272-79 | − | AUGGAAAUAUUUCACAGGC | 19 | 1360 |
| CFTR-3272-33 | − | UAUGGAAAUAUUUCACAGGC | 20 | 1314 |
| CFTR-3272-80 | − | ACUGCGCUGGUUCCAAAU | 18 | 1361 |
| CFTR-3272-81 | − | CACUGCGCUGGUUCCAAAU | 19 | 1362 |
| CFTR-3272-82 | − | ACACUGCGCUGGUUCCAAAU | 20 | 1363 |
| CFTR-3272-83 | − | AACACUGCGCUGGUUCCAAAU | 21 | 1364 |
| CFTR-3272-84 | − | CAACACUGCGCUGGUUCCAAAU | 22 | 1365 |
| CFTR-3272-85 | − | UCAACACUGCGCUGGUUCCAAAU | 23 | 1366 |
| CFTR-3272-86 | − | ACUCUGUUCCACAAAGCU | 18 | 1367 |
| CFTR-3272-87 | − | AACUCUGUUCCACAAAGCU | 19 | 1368 |
| CFTR-3272-88 | − | AAACUCUGUUCCACAAAGCU | 20 | 1369 |

Table 32C provides exemplary targeting domains for correcting a mutation (e.g., 3272-26→G) in the CFTR gene selected according to the fourth tier parameters. The targeting domains bind within 200 bp from a mutation (e.g., 3272-26→G), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 32C

3rd Tier

| gRNA Name | DNA Strand | Targeting Domain | Target Site Length | Seq ID |
|---|---|---|---|---|
| CFTR-3272-89 | + | AUUCAGAGCUUUGUGGAA | 18 | 1374 |
| CFTR-3272-90 | + | AAUUCAGAGCUUUGUGGAA | 19 | 1375 |
| CFTR-3272-91 | + | AAAUUCAGAGCUUUGUGGAA | 20 | 1376 |
| CFTR-3272-92 | + | UAAAUUCAGAGCUUUGUGGAA | 21 | 1377 |
| CFTR-3272-93 | + | GUAAAUUCAGAGCUUUGUGGAA | 22 | 1370 |
| CFTR-3272-94 | + | UGUAAAUUCAGAGCUUUGUGGAA | 23 | 1378 |
| CFTR-3272-95 | + | AUGUAAAUUCAGAGCUUUGUGGAA | 24 | 1379 |
| CFTR-3272-96 | + | UGAUUUGUUAUUUUAUUA | 18 | 1380 |
| CFTR-3272-97 | + | AUGAUUUGUUAUUUUAUUA | 19 | 1381 |
| CFTR-3272-98 | + | UAUGAUUUGUUAUUUUAUUA | 20 | 1382 |
| CFTR-3272-99 | + | AUAUGAUUUGUUAUUUUAUUA | 21 | 1383 |
| CFTR-3272-100 | + | GAUAUGAUUUGUUAUUUUAUUA | 22 | 1371 |
| CFTR-3272-101 | + | AGAUAUGAUUUGUUAUUUUAUUA | 23 | 1384 |
| CFTR-3272-102 | + | UAGAUAUGAUUUGUUAUUUUAUUA | 24 | 1385 |
| CFTR-3272-103 | − | GGUAGCCAAGUAAAAAAA | 18 | 1372 |
| CFTR-3272-104 | − | UGGUAGCCAAGUAAAAAAA | 19 | 1386 |

TABLE 32C-continued

3rd Tier

| gRNA Name | DNA Strand | Targeting Domain | Target Site Length | Seq ID |
|---|---|---|---|---|
| CFTR-3272-105 | − | CUGGUAGCCAAGUAAAAAAA | 20 | 1387 |
| CFTR-3272-106 | − | UCUGGUAGCCAAGUAAAAAAA | 21 | 1388 |
| CFTR-3272-107 | − | CUCUGGUAGCCAAGUAAAAAAA | 22 | 1389 |
| CFTR-3272-108 | − | UCUCUGGUAGCCAAGUAAAAAAA | 23 | 1390 |
| CFTR-3272-109 | − | AUCUCUGGUAGCCAAGUAAAAAAA | 24 | 1391 |
| CFTR-3272-110 | − | CUAUGGAAAUAUUUCACAGGC | 21 | 1392 |
| CFTR-3272-111 | − | UCUAUGGAAAUAUUUCACAGGC | 22 | 1393 |
| CFTR-3272-112 | − | UUCUAUGGAAAUAUUUCACAGGC | 23 | 1394 |
| CFTR-3272-113 | − | UUUCUAUGGAAAUAUUUCACAGGC | 24 | 1395 |
| CFTR-3272-114 | − | GAAACUCUGUUCCACAAAGCU | 21 | 1373 |
| CFTR-3272-115 | − | UGAAACUCUGUUCCACAAAGCU | 22 | 1396 |
| CFTR-3272-116 | − | UUGAAACUCUGUUCCACAAAGCU | 23 | 1397 |
| CFTR-3272-117 | − | UUUGAAACUCUGUUCCACAAAGCU | 24 | 1398 |

Table 32D provides exemplary targeting domains for correcting a mutation (e.g., 3272-26→G) in the CFTR gene selected according to the fifth tier parameters. The targeting domains bind within 200 bp from a mutation (e.g., 3272-26→G), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 32D

4th Tier

| gRNA Name | DNA Strand | Targeting Domain | Target Site Length | Seq ID |
|---|---|---|---|---|
| CFTR-3272-118 | + | UAACAAGAUGAGUGAAAA | 18 | 1399 |
| CFTR-3272-119 | + | GUAACAAGAUGAGUGAAAA | 19 | 1400 |
| CFTR-3272-120 | + | UGUAACAAGAUGAGUGAAAA | 20 | 1401 |
| CFTR-3272-121 | + | UUGUAACAAGAUGAGUGAAAA | 21 | 1402 |
| CFTR-3272-122 | + | CUUGUAACAAGAUGAGUGAAAA | 22 | 1403 |
| CFTR-3272-123 | + | GCUUGUAACAAGAUGAGUGAAAA | 23 | 1404 |
| CFTR-3272-124 | + | AGCUUGUAACAAGAUGAGUGAAAA | 24 | 1405 |
| CFTR-3272-125 | + | GCCUGUGAAAUAUUUCCA | 18 | 1406 |
| CFTR-3272-126 | + | UGCCUGUGAAAUAUUUCCA | 19 | 1407 |
| CFTR-3272-127 | + | CUGCCUGUGAAAUAUUUCCA | 20 | 1408 |
| CFTR-3272-128 | + | CCUGCCUGUGAAAUAUUUCCA | 21 | 1409 |
| CFTR-3272-129 | + | UCCUGCCUGUGAAAUAUUUCCA | 22 | 1410 |
| CFTR-3272-130 | + | CUCCUGCCUGUGAAAUAUUUCCA | 23 | 1411 |
| CFTR-3272-131 | + | ACUCCUGCCUGUGAAAUAUUUCCA | 24 | 1412 |
| CFTR-3272-132 | + | UUACUUGGCUACCAGAGA | 18 | 1413 |
| CFTR-3272-133 | + | UUUACUUGGCUACCAGAGA | 19 | 1414 |
| CFTR-3272-25 | + | UUUUACUUGGCUACCAGAGA | 20 | 1306 |

TABLE 32D-continued

4th Tier

| gRNA Name | DNA Strand | Targeting Domain | Target Site Length | Seq ID |
|---|---|---|---|---|
| CFTR-3272-134 | + | UUUUUACUUGGCUACCAGAGA | 21 | 1415 |
| CFTR-3272-135 | + | UUUUUUACUUGGCUACCAGAGA | 22 | 1416 |
| CFTR-3272-136 | + | UUUUUUUACUUGGCUACCAGAGA | 23 | 1417 |
| CFTR-3272-137 | + | CUUUUUUUACUUGGCUACCAGAGA | 24 | 1418 |
| CFTR-3272-138 | + | AAGCUUGUAACAAGAUGA | 18 | 1419 |
| CFTR-3272-139 | + | UAAGCUUGUAACAAGAUGA | 19 | 1420 |
| CFTR-3272-140 | + | UUAAGCUUGUAACAAGAUGA | 20 | 1421 |
| CFTR-3272-141 | + | UUUAAGCUUGUAACAAGAUGA | 21 | 1422 |
| CFTR-3272-142 | + | UUUUAAGCUUGUAACAAGAUGA | 22 | 1423 |
| CFTR-3272-143 | + | CUUUUAAGCUUGUAACAAGAUGA | 23 | 1424 |
| CFTR-3272-144 | + | CCUUUUAAGCUUGUAACAAGAUGA | 24 | 1425 |
| CFTR-3272-145 | + | CUUUUUUUACUUGGCUAC | 18 | 1426 |
| CFTR-3272-146 | + | UCUUUUUUUACUUGGCUAC | 19 | 1427 |
| CFTR-3272-147 | + | CUCUUUUUUUACUUGGCUAC | 20 | 1428 |
| CFTR-3272-148 | + | CCUCUUUUUUUACUUGGCUAC | 21 | 1429 |
| CFTR-3272-149 | + | CCCUCUUUUUUUACUUGGCUAC | 22 | 1430 |
| CFTR-3272-150 | + | ACCCUCUUUUUUUACUUGGCUAC | 23 | 1431 |
| CFTR-3272-151 | + | UACCCUCUUUUUUUACUUGGCUAC | 24 | 1432 |
| CFTR-3272-152 | + | CGCAGUGUUGACAGGUAC | 18 | 1433 |
| CFTR-3272-153 | + | GCGCAGUGUUGACAGGUAC | 19 | 1434 |
| CFTR-3272-154 | + | AGCGCAGUGUUGACAGGUAC | 20 | 1435 |
| CFTR-3272-155 | + | CAGCGCAGUGUUGACAGGUAC | 21 | 1436 |
| CFTR-3272-156 | + | CCAGCGCAGUGUUGACAGGUAC | 22 | 1437 |
| CFTR-3272-157 | + | ACCAGCGCAGUGUUGACAGGUAC | 23 | 1438 |
| CFTR-3272-158 | + | AACCAGCGCAGUGUUGACAGGUAC | 24 | 1439 |
| CFTR-3272-159 | + | UUUCAUAAUAUCUUGUAC | 18 | 1440 |
| CFTR-3272-160 | + | AUUUCAUAAUAUCUUGUAC | 19 | 1441 |
| CFTR-3272-161 | + | AAUUUCAUAAUAUCUUGUAC | 20 | 1442 |
| CFTR-3272-162 | + | UAAUUUCAUAAUAUCUUGUAC | 21 | 1443 |
| CFTR-3272-163 | + | GUAAUUUCAUAAUAUCUUGUAC | 22 | 1444 |
| CFTR-3272-164 | + | UGUAAUUUCAUAAUAUCUUGUAC | 23 | 1445 |
| CFTR-3272-165 | + | AUGUAAUUUCAUAAUAUCUUGUAC | 24 | 1446 |
| CFTR-3272-166 | + | AGGCUGCCGUCCGAAGGC | 18 | 1447 |
| CFTR-3272-167 | + | AAGGCUGCCGUCCGAAGGC | 19 | 1448 |
| CFTR-3272-168 | + | UAAGGCUGCCGUCCGAAGGC | 20 | 1449 |
| CFTR-3272-169 | + | GUAAGGCUGCCGUCCGAAGGC | 21 | 1450 |
| CFTR-3272-170 | + | AGUAAGGCUGCCGUCCGAAGGC | 22 | 1451 |

TABLE 32D-continued

4th Tier

| gRNA Name | DNA Strand | Targeting Domain | Target Site Length | Seq ID |
|---|---|---|---|---|
| CFTR-3272-171 | + | AAGUAAGGCUGCCGUCCGAAGGC | 23 | 1452 |
| CFTR-3272-172 | + | AAAGUAAGGCUGCCGUCCGAAGGC | 24 | 1453 |
| CFTR-3272-173 | + | UUUACUUGGCUACCAGAG | 18 | 1454 |
| CFTR-3272-174 | + | UUUUACUUGGCUACCAGAG | 19 | 1455 |
| CFTR-3272-175 | + | UUUUUACUUGGCUACCAGAG | 20 | 1456 |
| CFTR-3272-176 | + | UUUUUUACUUGGCUACCAGAG | 21 | 1457 |
| CFTR-3272-177 | + | UUUUUUUACUUGGCUACCAGAG | 22 | 1458 |
| CFTR-3272-178 | + | CUUUUUUUACUUGGCUACCAGAG | 23 | 1459 |
| CFTR-3272-179 | + | UCUUUUUUUACUUGGCUACCAGAG | 24 | 1460 |
| CFTR-3272-180 | + | UGUAAAUUCAGAGCUUUG | 18 | 1461 |
| CFTR-3272-181 | + | AUGUAAAUUCAGAGCUUUG | 19 | 1462 |
| CFTR-3272-35 | + | UAUGUAAAUUCAGAGCUUUG | 20 | 1316 |
| CFTR-3272-182 | + | GUAUGUAAAUUCAGAGCUUUG | 21 | 1463 |
| CFTR-3272-183 | + | AGUAUGUAAAUUCAGAGCUUUG | 22 | 1464 |
| CFTR-3272-184 | + | CAGUAUGUAAAUUCAGAGCUUUG | 23 | 1465 |
| CFTR-3272-185 | + | GCAGUAUGUAAAUUCAGAGCUUUG | 24 | 1466 |
| CFTR-3272-186 | + | UACUUGGCUACCAGAGAU | 18 | 1467 |
| CFTR-3272-187 | + | UUACUUGGCUACCAGAGAU | 19 | 1468 |
| CFTR-3272-37 | + | UUUACUUGGCUACCAGAGAU | 20 | 1318 |
| CFTR-3272-188 | + | UUUUACUUGGCUACCAGAGAU | 21 | 1469 |
| CFTR-3272-189 | + | UUUUUACUUGGCUACCAGAGAU | 22 | 1470 |
| CFTR-3272-190 | + | UUUUUUACUUGGCUACCAGAGAU | 23 | 1471 |
| CFTR-3272-191 | + | UUUUUUUACUUGGCUACCAGAGAU | 24 | 1472 |
| CFTR-3272-192 | + | AAAAUUGGACUCCUGCCU | 18 | 1473 |
| CFTR-3272-193 | + | GAAAAUUGGACUCCUGCCU | 19 | 1474 |
| CFTR-3272-194 | + | UGAAAAUUGGACUCCUGCCU | 20 | 1475 |
| CFTR-3272-195 | + | GUGAAAAUUGGACUCCUGCCU | 21 | 1476 |
| CFTR-3272-196 | + | AGUGAAAAUUGGACUCCUGCCU | 22 | 1477 |
| CFTR-3272-197 | + | GAGUGAAAAUUGGACUCCUGCCU | 23 | 1478 |
| CFTR-3272-198 | + | UGAGUGAAAAUUGGACUCCUGCCU | 24 | 1479 |
| CFTR-3272-199 | + | UCAAAGUAAGGCUGCCGU | 18 | 1480 |
| CFTR-3272-200 | + | UUCAAAGUAAGGCUGCCGU | 19 | 1481 |
| CFTR-3272-201 | + | UUUCAAAGUAAGGCUGCCGU | 20 | 1482 |
| CFTR-3272-202 | + | GUUUCAAAGUAAGGCUGCCGU | 21 | 1483 |
| CFTR-3272-203 | + | AGUUUCAAAGUAAGGCUGCCGU | 22 | 1484 |
| CFTR-3272-204 | + | GAGUUUCAAAGUAAGGCUGCCGU | 23 | 1485 |
| CFTR-3272-205 | + | AGAGUUUCAAAGUAAGGCUGCCGU | 24 | 1486 |
| CFTR-3272-206 | + | GUUGGCAGUAUGUAAAUU | 18 | 1487 |

TABLE 32D-continued

4th Tier

| gRNA Name | DNA Strand | Targeting Domain | Target Site Length | Seq ID |
|---|---|---|---|---|
| CFTR-3272-207 | + | AGUUGGCAGUAUGUAAAUU | 19 | 1488 |
| CFTR-3272-208 | + | CAGUUGGCAGUAUGUAAAUU | 20 | 1489 |
| CFTR-3272-209 | + | CCAGUUGGCAGUAUGUAAAUU | 21 | 1490 |
| CFTR-3272-210 | + | ACCAGUUGGCAGUAUGUAAAUU | 22 | 1491 |
| CFTR-3272-211 | + | AACCAGUUGGCAGUAUGUAAAUU | 23 | 1492 |
| CFTR-3272-212 | + | GAACCAGUUGGCAGUAUGUAAAUU | 24 | 1493 |
| CFTR-3272-213 | + | AUGUAAAUUCAGAGCUUU | 18 | 1494 |
| CFTR-3272-214 | + | UAUGUAAAUUCAGAGCUUU | 19 | 1495 |
| CFTR-3272-215 | + | GUAUGUAAAUUCAGAGCUUU | 20 | 1496 |
| CFTR-3272-216 | + | AGUAUGUAAAUUCAGAGCUUU | 21 | 1497 |
| CFTR-3272-217 | + | CAGUAUGUAAAUUCAGAGCUUU | 22 | 1498 |
| CFTR-3272-218 | + | GCAGUAUGUAAAUUCAGAGCUUU | 23 | 1499 |
| CFTR-3272-219 | + | GGCAGUAUGUAAAUUCAGAGCUUU | 24 | 1500 |
| CFTR-3272-220 | − | CUGGUAGCCAAGUAAAAA | 18 | 1501 |
| CFTR-3272-221 | − | UCUGGUAGCCAAGUAAAAA | 19 | 1502 |
| CFTR-3272-222 | − | CUCUGGUAGCCAAGUAAAAA | 20 | 1503 |
| CFTR-3272-223 | − | UCUCUGGUAGCCAAGUAAAAA | 21 | 1504 |
| CFTR-3272-224 | − | AUCUCUGGUAGCCAAGUAAAAA | 22 | 1505 |
| CFTR-3272-225 | − | CAUCUCUGGUAGCCAAGUAAAAA | 23 | 1506 |
| CFTR-3272-226 | − | CCAUCUCUGGUAGCCAAGUAAAAA | 24 | 1507 |
| CFTR-3272-227 | − | ACACUGCGCUGGUUCCAA | 18 | 1508 |
| CFTR-3272-228 | − | AACACUGCGCUGGUUCCAA | 19 | 1509 |
| CFTR-3272-229 | − | CAACACUGCGCUGGUUCCAA | 20 | 1510 |
| CFTR-3272-230 | − | UCAACACUGCGCUGGUUCCAA | 21 | 1511 |
| CFTR-3272-231 | − | GUCAACACUGCGCUGGUUCCAA | 22 | 1512 |
| CFTR-3272-232 | − | UGUCAACACUGCGCUGGUUCCAA | 23 | 1513 |
| CFTR-3272-233 | − | CUGUCAACACUGCGCUGGUUCCAA | 24 | 1514 |
| CFTR-3272-234 | − | GCUGGUUCCAAAUGAGAA | 18 | 1515 |
| CFTR-3272-235 | − | CGCUGGUUCCAAAUGAGAA | 19 | 1516 |
| CFTR-3272-236 | − | GCGCUGGUUCCAAAUGAGAA | 20 | 1517 |
| CFTR-3272-237 | − | UGCGCUGGUUCCAAAUGAGAA | 21 | 1518 |
| CFTR-3272-238 | − | CUGCGCUGGUUCCAAAUGAGAA | 22 | 1519 |
| CFTR-3272-239 | − | ACUGCGCUGGUUCCAAAUGAGAA | 23 | 1520 |
| CFTR-3272-240 | − | CACUGCGCUGGUUCCAAAUGAGAA | 24 | 1521 |
| CFTR-3272-241 | − | AUCUUGUUACAAGCUUAA | 18 | 1522 |
| CFTR-3272-242 | − | CAUCUUGUUACAAGCUUAA | 19 | 1523 |
| CFTR-3272-243 | − | UCAUCUUGUUACAAGCUUAA | 20 | 1524 |

TABLE 32D-continued

4th Tier

| gRNA Name | DNA Strand | Targeting Domain | Target Site Length | Seq ID |
|---|---|---|---|---|
| CFTR-3272-244 | − | CUCAUCUUGUUACAAGCUUAA | 21 | 1525 |
| CFTR-3272-245 | − | ACUCAUCUUGUUACAAGCUUAA | 22 | 1526 |
| CFTR-3272-246 | − | CACUCAUCUUGUUACAAGCUUAA | 23 | 1527 |
| CFTR-3272-247 | − | UCACUCAUCUUGUUACAAGCUUAA | 24 | 1528 |
| CFTR-3272-248 | − | UAUUUGCAGUGUUUUCUA | 18 | 1529 |
| CFTR-3272-249 | − | UUAUUUGCAGUGUUUUCUA | 19 | 1530 |
| CFTR-3272-42 | − | GUUAUUUGCAGUGUUUUCUA | 20 | 1323 |
| CFTR-3272-250 | − | UGUUAUUUGCAGUGUUUUCUA | 21 | 1531 |
| CFTR-3272-251 | − | AUGUUAUUUGCAGUGUUUUCUA | 22 | 1532 |
| CFTR-3272-252 | − | UAUGUUAUUUGCAGUGUUUUCUA | 23 | 1533 |
| CFTR-3272-253 | − | UUAUGUUAUUUGCAGUGUUUUCUA | 24 | 1534 |
| CFTR-3272-254 | − | AUGGAAAUAUUUCACAGG | 18 | 1535 |
| CFTR-3272-255 | − | UAUGGAAAUAUUUCACAGG | 19 | 1536 |
| CFTR-3272-256 | − | CUAUGGAAAUAUUUCACAGG | 20 | 1537 |
| CFTR-3272-257 | − | UCUAUGGAAAUAUUUCACAGG | 21 | 1538 |
| CFTR-3272-258 | − | UUCUAUGGAAAUAUUUCACAGG | 22 | 1539 |
| CFTR-3272-259 | − | UUUCUAUGGAAAUAUUUCACAGG | 23 | 1540 |
| CFTR-3272-260 | − | UUUUCUAUGGAAAUAUUUCACAGG | 24 | 1541 |
| CFTR-3272-261 | − | UACAAGCUUAAAAGGACU | 18 | 1542 |
| CFTR-3272-262 | − | UUACAAGCUUAAAAGGACU | 19 | 1543 |
| CFTR-3272-263 | − | GUUACAAGCUUAAAAGGACU | 20 | 1544 |
| CFTR-3272-264 | − | UGUUACAAGCUUAAAAGGACU | 21 | 1545 |
| CFTR-3272-265 | − | UUGUUACAAGCUUAAAAGGACU | 22 | 1546 |
| CFTR-3272-266 | − | CUUGUUACAAGCUUAAAAGGACU | 23 | 1547 |
| CFTR-3272-267 | − | UCUUGUUACAAGCUUAAAAGGACU | 24 | 1548 |
| CFTR-3272-268 | − | UCGGACGGCAGCCUUACU | 18 | 1549 |
| CFTR-3272-269 | − | UUCGGACGGCAGCCUUACU | 19 | 1550 |
| CFTR-3272-270 | − | CUUCGGACGGCAGCCUUACU | 20 | 1551 |
| CFTR-3272-271 | − | CCUUCGGACGGCAGCCUUACU | 21 | 1552 |
| CFTR-3272-272 | − | GCCUUCGGACGGCAGCCUUACU | 22 | 1553 |
| CFTR-3272-273 | − | UGCCUUCGGACGGCAGCCUUACU | 23 | 1554 |
| CFTR-3272-274 | − | GUGCCUUCGGACGGCAGCCUUACU | 24 | 1555 |
| CFTR-3272-275 | − | UAUGGACACUUCGUGCCU | 18 | 1556 |
| CFTR-3272-276 | − | CUAUGGACACUUCGUGCCU | 19 | 1557 |
| CFTR-3272-277 | − | ACUAUGGACACUUCGUGCCU | 20 | 1558 |
| CFTR-3272-278 | − | GACUAUGGACACUUCGUGCCU | 21 | 1559 |
| CFTR-3272-279 | − | GGACUAUGGACACUUCGUGCCU | 22 | 1560 |
| CFTR-3272-280 | − | AGGACUAUGGACACUUCGUGCCU | 23 | 1561 |

TABLE 32D-continued

4th Tier

| gRNA Name | DNA Strand | Targeting Domain | Target Site Length | Seq ID |
|---|---|---|---|---|
| CFTR-3272-281 | - | AAGGACUAUGGACACUUCGUGCCU | 24 | 1562 |
| CFTR-3272-282 | - | UUAUUUGCAGUGUUUUCU | 18 | 1563 |
| CFTR-3272-283 | - | GUUAUUUGCAGUGUUUUCU | 19 | 1564 |
| CFTR-3272-284 | - | UGUUAUUUGCAGUGUUUUCU | 20 | 1565 |
| CFTR-3272-285 | - | AUGUUAUUUGCAGUGUUUUCU | 21 | 1566 |
| CFTR-3272-286 | - | UAUGUUAUUUGCAGUGUUUUCU | 22 | 1567 |
| CFTR-3272-287 | - | UUAUGUUAUUUGCAGUGUUUUCU | 23 | 1568 |
| CFTR-3272-288 | - | UUUAUGUUAUUUGCAGUGUUUUCU | 24 | 1569 |
| CFTR-3272-289 | - | UCAAAGAAUGGCACCAGU | 18 | 1570 |
| CFTR-3272-290 | - | UUCAAAGAAUGGCACCAGU | 19 | 1571 |
| CFTR-3272-291 | - | AUUCAAAGAAUGGCACCAGU | 20 | 1572 |
| CFTR-3272-292 | - | UAUUCAAAGAAUGGCACCAGU | 21 | 1573 |
| CFTR-3272-293 | - | CUAUUCAAAGAAUGGCACCAGU | 22 | 1574 |
| CFTR-3272-294 | - | UCUAUUCAAAGAAUGGCACCAGU | 23 | 1575 |
| CFTR-3272-295 | - | AUCUAUUCAAAGAAUGGCACCAGU | 24 | 1576 |
| CFTR-3272-296 | - | UUUCAGGUACAAGAUAUU | 18 | 1577 |
| CFTR-3272-297 | - | UUUUCAGGUACAAGAUAUU | 19 | 1578 |
| CFTR-3272-298 | - | UUUUUCAGGUACAAGAUAUU | 20 | 1579 |
| CFTR-3272-299 | - | CUUUUUCAGGUACAAGAUAUU | 21 | 1580 |
| CFTR-3272-300 | - | UCUUUUUCAGGUACAAGAUAUU | 22 | 1581 |
| CFTR-3272-301 | - | GUCUUUUUCAGGUACAAGAUAUU | 23 | 1582 |
| CFTR-3272-302 | - | AGUCUUUUUCAGGUACAAGAUAUU | 24 | 1583 |

Table 33A provides exemplary targeting domains for correcting a mutation (e.g., 3272-26→G) in the CFTR gene selected according to the second tier parameters. The targeting domains bind within 200 bp from a mutation (e.g., 3272-26→G) and have a high level of orthogonality. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 33A

2nd Tier

| gRNA Name | DNA Strand | Targeting Domain | Target Site Length | Seq ID |
|---|---|---|---|---|
| CFTR-3272-303 | - | AUGGCACCAGUGUGAAA | 17 | 1584 |
| CFTR-3272-304 | + | UGCCAUUCUUUGAAUAG | 17 | 1585 |
| CFTR-3272-305 | + | UUGGCAGUAUGUAAAUU | 17 | 1586 |
| CFTR-3272-306 | + | AAGUGUCCAUAGUCCUU | 17 | 1587 |
| CFTR-3272-307 | - | AGAAUGGCACCAGUGUGAAA | 20 | 1588 |

TABLE 33A-continued

2nd Tier

| gRNA Name | DNA Strand | Targeting Domain | Target Site Length | Seq ID |
|---|---|---|---|---|
| CFTR-3272-308 | + | UGGUGCCAUUCUUUGAAUAG | 20 | 1589 |
| CFTR-3272-309 | + | ACGAAGUGUCCAUAGUCCUU | 20 | 1590 |

Table 33B provides exemplary targeting domains for correcting a mutation (e.g., 3272-26→G) in the CFTR gene selected according to the fourth tier parameters. The targeting domains bind within 200 bp from a mutation (e.g., 3272-26→G). It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 33B

4th Tier

| gRNA Name | DNA Strand | Targeting Domain | Target Site Length | Seq ID |
|---|---|---|---|---|
| CFTR-3272-310 | + | ACAAAUGUCAUUGGUUA | 17 | 1591 |
| CFTR-3272-311 | – | AACCAAUGACAUUUGUG | 17 | 1592 |
| CFTR-3272-312 | – | UUUUCACUCAUCUUGUU | 17 | 1593 |
| CFTR-3272-313 | + | AUCACAAAUGUCAUUGGUUA | 20 | 1594 |
| CFTR-3272-314 | – | UUUAACCAAUGACAUUUGUG | 20 | 1595 |
| CFTR-3272-208 | + | CAGUUGGCAGUAUGUAAAUU | 20 | 1489 |
| CFTR-3272-315 | – | CAAUUUUCACUCAUCUUGUU | 20 | 1596 |

Table 34A provides exemplary targeting domains for correcting a mutation (e.g., 3849+10 kbC→T) in the CFTR gene selected according to the first tier parameters. The targeting domains bind within 500 bp from a mutation (e.g., 3849+10 kbC→T), have a high level of orthogonality and start with a 5'G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 34A

1st Tier

| gRNA Name | DNA Strand | Targeting Domain | Target Site Length | Seq ID |
|---|---|---|---|---|
| CFTR-3849-1 | – | GAGUAAGACACCCUGAA | 17 | 3344 |
| CFTR-3849-2 | – | GAUUUCUGGAGACCACA | 17 | 3345 |
| CFTR-3849-3 | + | GGUUUUAGCUAUUACUC | 17 | 3346 |
| CFTR-3849-4 | – | GUAGUUGAAUCAUUCAG | 17 | 3347 |
| CFTR-3849-5 | + | GAACUCAGUUUUUAGGU | 17 | 3348 |
| CFTR-3849-6 | – | GAAAGGAAAUGUUCUAUUCA | 20 | 3349 |
| CFTR-3849-7 | + | GUUUUUAGGUUGGGAAAGAC | 20 | 3350 |
| CFTR-3849-8 | + | GCACAUAAUAAUUAGUUUCC | 20 | 3351 |
| CFTR-3849-9 | + | GAGAACUCAGUUUUUAGGUU | 20 | 3352 |
| CFTR-3849-10 | – | GAAAACACUGACUUAGAUUU | 20 | 3353 |

Table 34B provides exemplary targeting domains for correcting a mutation (e.g., 3849+10 kbC→T) in the CFTR gene selected according to the second tier parameters. The targeting domains bind within 500 bp from a mutation (e.g., 3849+10 kbC→T) and have a high level of orthogonality. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 34B

2nd Tier

| gRNA Name | DNA Strand | Targeting Domain | Target Site Length | Seq ID |
|---|---|---|---|---|
| CFTR-3849-11 | + | UCUGACACAUUUUUCAA | 17 | 3354 |
| CFTR-3849-12 | + | CUUUGGUUUAGCUUUAA | 17 | 3355 |
| CFTR-3849-13 | + | UGAAAUUUAGAUCCACA | 17 | 3356 |

TABLE 34B-continued

| 2nd Tier | | | | |
|---|---|---|---|---|
| gRNA Name | DNA Strand | Targeting Domain | Target Site Length | Seq ID |
| CFTR-3849-14 | - | UUGAUCCAACAUUCUCA | 17 | 3357 |
| CFTR-3849-15 | - | AGGAAAUGUUCUAUUCA | 17 | 3358 |
| CFTR-3849-16 | + | UUUAAUACUGCAACAGA | 17 | 3359 |
| CFTR-3849-17 | + | CAGUGAUCUGUUGAAUA | 17 | 3360 |
| CFTR-3849-18 | - | AGCAGUUCAAUGAUAUA | 17 | 3361 |
| CFTR-3849-19 | - | ACACUGACUUAGAUUUA | 17 | 3362 |
| CFTR-3849-20 | + | CUUCUUGUUUAUAUAAC | 17 | 3363 |
| CFTR-3849-21 | + | CAAAGGCAAGGAAUCAC | 17 | 3364 |
| CFTR-3849-22 | + | UUUAGGUUGGGAAAGAC | 17 | 3365 |
| CFTR-3849-23 | - | UGUAUAUAUCACAGUAC | 17 | 3366 |
| CFTR-3849-24 | - | CAGAUCACUGAGAAGCC | 17 | 3367 |
| CFTR-3849-25 | + | CAUAAUAAUUAGUUUCC | 17 | 3368 |
| CFTR-3849-26 | + | CCGGGAUUUGUUUUUCC | 17 | 3369 |
| CFTR-3849-27 | + | UUAUAUCAUUGAACUGC | 17 | 3370 |
| CFTR-3849-28 | - | CUUAAAAGCUUAUUUGC | 17 | 3371 |
| CFTR-3849-29 | - | AUUCUUCAUGAUAAAUC | 17 | 3372 |
| CFTR-3849-30 | - | CUUGAUCCAACAUUCUC | 17 | 3373 |
| CFTR-3849-31 | + | AUAGAACAUUUCCUUUC | 17 | 3374 |
| CFTR-3849-32 | + | ACAUAAUAAUUAGUUUC | 17 | 3375 |
| CFTR-3849-33 | + | AAUAUCUAUUUAAUCAG | 17 | 3376 |
| CFTR-3849-34 | - | CAACAUUCUCAGGGAGG | 17 | 3377 |
| CFTR-3849-35 | - | AUCCAACAUUCUCAGGG | 17 | 3378 |
| CFTR-3849-36 | + | AUACAAUAUACCAUAUG | 17 | 3379 |
| CFTR-3849-37 | - | CAAUUAUAAUCACCUUG | 17 | 3380 |
| CFTR-3849-38 | - | UCUAUCUUGAUAAACAU | 17 | 3381 |
| CFTR-3849-39 | - | UAGUUGAAUCAUUCAGU | 17 | 3382 |
| CFTR-3849-40 | + | CUCCUCCCUGAGAAUGU | 17 | 3383 |
| CFTR-3849-41 | - | AAACAAGAAGACUUUGU | 17 | 3384 |
| CFTR-3849-42 | + | AACUCAGUUUUUAGGUU | 17 | 3385 |
| CFTR-3849-43 | - | AACAAGAAGACUUUGUU | 17 | 3386 |
| CFTR-3849-44 | - | AACACUGACUUAGAUUU | 17 | 3387 |
| CFTR-3849-45 | - | UUUAAGGUCUAUACUUU | 17 | 3388 |
| CFTR-3849-46 | - | CAUCUGUUGCAGUAUUAAAA | 20 | 3389 |
| CFTR-3849-47 | + | UAUUUUCAAGAGACUACAAA | 20 | 3390 |
| CFTR-3849-48 | + | AUAUCUGACACAUUUUUCAA | 20 | 3391 |
| CFTR-3849-49 | + | AAUCUUUGGUUUAGCUUUAA | 20 | 3392 |
| CFTR-3849-50 | - | CUUGAUUUCUGGAGACCACA | 20 | 3393 |

TABLE 34B-continued

2nd Tier

| gRNA Name | DNA Strand | Targeting Domain | Target Site Length | Seq ID |
|---|---|---|---|---|
| CFTR-3849-51 | + | UGACACAUUUUCAAAGGCA | 20 | 3394 |
| CFTR-3849-52 | − | AUCUUGAUCCAACAUUCUCA | 20 | 3395 |
| CFTR-3849-53 | + | CAUUUUAAUACUGCAACAGA | 20 | 3396 |
| CFTR-3849-54 | + | UCUCAGUGAUCUGUUGAAUA | 20 | 3397 |
| CFTR-3849-55 | − | CUUAAUCAAAAUUCCUCAUA | 20 | 3398 |
| CFTR-3849-56 | − | ACCAGCAGUUCAAUGAUAUA | 20 | 3399 |
| CFTR-3849-57 | − | AAAACACUGACUUAGAUUUA | 20 | 3400 |
| CFTR-3849-58 | − | AGAUAUUUGAUAGUACUUUA | 20 | 3401 |
| CFTR-3849-59 | + | UUUCAAAGGCAAGGAAUCAC | 20 | 3402 |
| CFTR-3849-60 | − | UAUUGUAUAUAUCACAGUAC | 20 | 3403 |
| CFTR-3849-61 | − | CAACAGAUCACUGAGAAGCC | 20 | 3404 |
| CFTR-3849-62 | − | AAGCCUGGAAAAACAAAUCC | 20 | 3405 |
| CFTR-3849-63 | + | UUUCCGGGAUUUGUUUUUCC | 20 | 3406 |
| CFTR-3849-64 | + | UCCUUAUAUCAUUGAACUGC | 20 | 3407 |
| CFTR-3849-65 | − | UGUCUUAAAAGCUUAUUUGC | 20 | 3408 |
| CFTR-3849-66 | + | AAAGGUUUUAGCUAUUACUC | 20 | 3409 |
| CFTR-3849-67 | − | UAUCUUGAUCCAACAUUCUC | 20 | 3410 |
| CFTR-3849-68 | − | UGACUUGUCAUCUUGAUUUC | 20 | 3411 |
| CFTR-3849-69 | + | UGAAUAGAACAUUUCCUUUC | 20 | 3412 |
| CFTR-3849-70 | + | UUGGGAAAGACUGGAUGAAG | 20 | 3413 |
| CFTR-3849-71 | + | UCAAAUAUCUAUUUAAUCAG | 20 | 3414 |
| CFTR-3849-72 | − | AAAGUAGUUGAAUCAUUCAG | 20 | 3415 |
| CFTR-3849-73 | − | AUCCAACAUUCUCAGGGAGG | 20 | 3416 |
| CFTR-3849-74 | − | UUGAUCCAACAUUCUCAGGG | 20 | 3417 |
| CFTR-3849-75 | − | AUUCAAUUAUAAUCACCUUG | 20 | 3418 |
| CFTR-3849-76 | − | AUGUCUUAAAAGCUUAUUUG | 20 | 3419 |
| CFTR-3849-77 | − | UUUUCUAUCUUGAUAAACAU | 20 | 3420 |
| CFTR-3849-78 | + | AGAGAACUCAGUUUUUAGGU | 20 | 3421 |
| CFTR-3849-79 | + | CACCUCCUCCCUGAGAAUGU | 20 | 3422 |
| CFTR-3849-80 | − | UAUAAACAAGAAGACUUUGU | 20 | 3423 |
| CFTR-3849-81 | + | AAGUUAAACAGUGUUGAAUU | 20 | 3424 |
| CFTR-3849-82 | − | AUAAACAAGAAGACUUUGUU | 20 | 3425 |
| CFTR-3849-83 | + | AACAAAGCAAACAAGUAUUU | 20 | 3426 |
| CFTR-3849-84 | − | UACUUUAAGGUCUAUACUUU | 20 | 3427 |

Table 34C provides exemplary targeting domains for correcting a mutation (e.g., 3849+10 kbC→T) in the CFTR gene selected according to the third tier parameters. The targeting domains bind within 500 bp from a mutation (e.g., 3849+10 kbC→T) and start with a 5'G. It is contemplated herein that in an embodiment the targeting domain hybridizes to the target domain through complementary base pairing. Any of the targeting domains in the Table can be

TABLE 34C

3rd Tier

| gRNA Name | DNA Strand | Targeting Domain | Target Site Length | Seq ID |
|---|---|---|---|---|
| CFTR-3849-85 | + | GGAAAGACUGGAUGAAG | 17 | 3428 |
| CFTR-3849-86 | + | GGCAAUUGUAAAUCUU | 17 | 3429 |
| CFTR-3849-87 | − | GUAUUUUUUCUGAAGAAAA | 20 | 3430 |
| CFTR-3849-88 | − | GGUGAGUAAGACACCCUGAA | 20 | 3431 |

TABLE 34C-continued

3rd Tier

| gRNA Name | DNA Strand | Targeting Domain | Target Site Length | Seq ID |
|---|---|---|---|---|
| CFTR-3849-89 | + | GAAUAGAACAUUUCCUUUCA | 20 | 3432 |
| CFTR-3849-90 | + | GGCACAUAAUAAUUAGUUUC | 20 | 3433 |

Table 34D provides exemplary targeting domains for correcting a mutation (e.g., 3849+10 kbC→T) in the CFTR gene selected according to the fourth tier parameters. The targeting domains bind within 500 bp from a mutation (e.g., 3849+10 kbC→T). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 34D

4th Tier

| gRNA Name | DNA Strand | Targeting Domain | Target Site Length | Seq ID |
|---|---|---|---|---|
| CFTR-3849-91 | − | UUUUUUUCUGAAGAAAA | 17 | 3434 |
| CFTR-3849-92 | + | UUUAUCAAGAUAGAAAA | 17 | 3435 |
| CFTR-3849-93 | − | CUGUUGCAGUAUUAAAA | 17 | 3436 |
| CFTR-3849-94 | + | UUUCAAGAGACUACAAA | 17 | 3437 |
| CFTR-3849-95 | − | AUUUUUUCUGAAGAAA | 17 | 3438 |
| CFTR-3849-96 | + | CACAUUUUCAAGGCA | 17 | 3439 |
| CFTR-3849-97 | − | AAUUUAUAAGAAUAUCA | 17 | 3440 |
| CFTR-3849-98 | + | UAGAACAUUUCCUUUCA | 17 | 3441 |
| CFTR-3849-99 | − | AAUCAAAAUUCCUCAUA | 17 | 3442 |
| CFTR-3849-100 | − | UAUUUGAUAGUACUUUA | 17 | 3443 |
| CFTR-3849-101 | − | CCUGGAAAAACAAAUCC | 17 | 3444 |
| CFTR-3849-102 | − | CUUGUCAUCUUGAUUUC | 17 | 3445 |
| CFTR-3849-103 | − | UUUUUUCUGAAGAAAAG | 17 | 3446 |
| CFTR-3849-104 | + | UAUUUUUCAUUACCUUG | 17 | 3447 |
| CFTR-3849-105 | − | UCUUAAAAGCUUAUUUG | 17 | 3448 |
| CFTR-3849-106 | + | UUAUCAAGAUAGAAAAU | 17 | 3449 |
| CFTR-3849-107 | + | UUAAACAGUGUUGAAUU | 17 | 3450 |
| CFTR-3849-108 | + | AAAGCAAACAAGUAUUU | 17 | 3451 |
| CFTR-3849-109 | + | UAGAGAACUCAGUUUUU | 17 | 3452 |
| CFTR-3849-110 | + | AUGUUUAUCAAGAUAGAAAA | 20 | 3453 |
| CFTR-3849-111 | − | AGUAUUUUUUCUGAAGAAA | 20 | 3454 |
| CFTR-3849-112 | + | AACUGAAAUUUAGAUCCACA | 20 | 3455 |
| CFTR-3849-113 | − | AAUAAUUUAUAAGAAUAUCA | 20 | 3456 |

TABLE 34D-continued

4th Tier

| gRNA Name | DNA Strand | Targeting Domain | Target Site Length | Seq ID |
|---|---|---|---|---|
| CFTR-3849-114 | + | AGUCUUCUUGUUUAUAUAAC | 20 | 3457 |
| CFTR-3849-115 | − | UAUUUUUUCUGAAGAAAAG | 20 | 3458 |
| CFTR-3849-116 | + | UAUAUACAAUAUACCAUAUG | 20 | 3459 |
| CFTR-3849-117 | + | AAUUAUUUUCAUUACCUUG | 20 | 3460 |
| CFTR-3849-118 | + | UGUUUAUCAAGAUAGAAAAU | 20 | 3461 |
| CFTR-3849-119 | − | AAGUAGUUGAAUCAUUCAGU | 20 | 3462 |
| CFTR-3849-120 | + | AGAGGCAAUUUGUAAAUCUU | 20 | 3463 |
| CFTR-3849-121 | + | UUUUAGAGAACUCAGUUUUU | 20 | 3464 |

Table 35A provides exemplary targeting domains for correcting a mutation (e.g., 3849+10 kbC→T) in the CFTR gene selected according to the first tier parameters. The targeting domains bind within 500 bp from a mutation (e.g., 3849+10 kbC→T), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 35A

1st Tier

| gRNA Name | DNA Strand | Targeting Domain | Target Site Length | Seq ID |
|---|---|---|---|---|
| CFTR-3849-122 | + | GUUUAUCAAGAUAGAAAA | 18 | 3465 |
| CFTR-3849-123 | + | GAUCCACAAGGUGAUUAUAA | 20 | 3466 |
| CFTR-3849-124 | + | GAAUAUGCUGCUUAUACCCA | 20 | 3467 |
| CFTR-3849-125 | + | GACACAUUUUCAAAGGCA | 19 | 3468 |
| CFTR-3849-126 | + | GUUUUUAGGUUGGGAAAGA | 19 | 3469 |
| CFTR-3849-127 | + | GCUGUAAUUGCAUUGUACC | 19 | 3470 |
| CFTR-3849-128 | + | GCUAGCUGUAAUUGCAUUGUACC | 23 | 3471 |
| CFTR-3849-129 | + | GUGAUCUGUUGAAUAAGGC | 19 | 3472 |
| CFTR-3849-130 | + | GCACAUAAUAAUUAGUUUC | 19 | 3473 |
| CFTR-3849-90 | + | GGCACAUAAUAAUUAGUUUC | 20 | 3433 |
| CFTR-3849-131 | + | GCACCUCCUCCCUGAGAAUG | 20 | 3474 |
| CFTR-3849-132 | + | GAUUAAGUCCAGAUUUAUCAUG | 22 | 3475 |
| CFTR-3849-133 | + | GAUAUAUACAAUAUACCAUAUG | 22 | 3476 |
| CFTR-3849-134 | + | GUGAUAUAUACAAUAUACCAUAUG | 24 | 3477 |
| CFTR-3849-135 | + | GUUGAAAGUUAAACAGUG | 18 | 3478 |
| CFTR-3849-136 | + | GUGUUUGUGCUGAUAUGAU | 19 | 3479 |
| CFTR-3849-137 | + | GGUGUUUGUGCUGAUAUGAU | 20 | 3480 |
| CFTR-3849-138 | − | GUCUUUCCCAACCUAAAAA | 19 | 3481 |
| CFTR-3849-139 | − | GUUCAAUGAUAUAAGGAAAC | 20 | 3482 |
| CFTR-3849-140 | − | GCAGUUCAAUGAUAUAAGGAAAC | 23 | 3483 |

TABLE 35A-continued

1st Tier

| gRNA Name | DNA Strand | Targeting Domain | Target Site Length | Seq ID |
|---|---|---|---|---|
| CFTR-3849-141 | - | GUAAUGAAAAAUAAUUAC | 18 | 3484 |
| CFTR-3849-142 | - | GGUAAUGAAAAAUAAUUAC | 19 | 3485 |
| CFTR-3849-143 | - | GAAAUAAUUUAUAAGAAUAUC | 21 | 3486 |
| CFTR-3849-144 | - | GAUAAACAUUGGUGUAAAGUAG | 22 | 3487 |
| CFTR-3849-145 | - | GUUAUAUAAACAAGAAGACUUUG | 23 | 3488 |
| CFTR-3849-146 | - | GAAAACACUGACUUAGAUU | 19 | 3489 |
| CFTR-3849-147 | - | GUACUUUAAGGUCUAUACUU | 20 | 3490 |
| CFTR-3849-148 | - | GAUAGUACUUUAAGGUCUAUACUU | 24 | 3491 |
| CFTR-3849-149 | - | GAUUCAAUUAUAAUCACCUU | 20 | 3492 |

Table 35B provides exemplary targeting domains for correcting a mutation (e.g., 3849+10 kbC→T) in the CFTR gene selected according to the second tier parameters. The targeting domains bind within 500 bp from a mutation (e.g., 3849+10 kbC→T), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 35B

2nd Tier

| gRNA Name | DNA Strand | Targeting Domain | Target Site Length | Seq ID |
|---|---|---|---|---|
| CFTR-3849-150 | + | UGUUUAUCAAGAUAGAAAA | 19 | 3493 |
| CFTR-3849-110 | + | AUGUUUAUCAAGAUAGAAAA | 20 | 3453 |
| CFTR-3849-151 | + | UCCACAAGGUGAUUAUAA | 18 | 3494 |
| CFTR-3849-152 | + | AUCCACAAGGUGAUUAUAA | 19 | 3495 |
| CFTR-3849-153 | + | AUAUGCUGCUUAUACCCA | 18 | 3496 |
| CFTR-3849-154 | + | AAUAUGCUGCUUAUACCCA | 19 | 3497 |
| CFTR-3849-155 | + | ACACAUUUUUCAAAGGCA | 18 | 3498 |
| CFTR-3849-51 | + | UGACACAUUUUUCAAAGGCA | 20 | 3394 |
| CFTR-3849-156 | + | CUGACACAUUUUUCAAAGGCA | 21 | 3499 |
| CFTR-3849-157 | + | UCUGACACAUUUUUCAAAGGCA | 22 | 3500 |
| CFTR-3849-158 | + | AUCUGACACAUUUUUCAAAGGCA | 23 | 3501 |
| CFTR-3849-159 | + | UAUCUGACACAUUUUUCAAAGGCA | 24 | 3502 |
| CFTR-3849-160 | + | UUUUUAGGUUGGGAAAGA | 18 | 3503 |
| CFTR-3849-161 | + | AGUUUUUAGGUUGGGAAAGA | 20 | 3504 |
| CFTR-3849-162 | + | CAGUUUUUAGGUUGGGAAAGA | 21 | 3505 |
| CFTR-3849-163 | + | UCAGUUUUUAGGUUGGGAAAGA | 22 | 3506 |
| CFTR-3849-164 | + | CUCAGUUUUUAGGUUGGGAAAGA | 23 | 3507 |
| CFTR-3849-165 | + | ACUCAGUUUUUAGGUUGGGAAAGA | 24 | 3508 |
| CFTR-3849-166 | + | CUGUAAUUGCAUUGUACC | 18 | 3509 |
| CFTR-3849-167 | + | AGCUGUAAUUGCAUUGUACC | 20 | 3510 |

TABLE 35B-continued

2nd Tier

| gRNA Name | DNA Strand | Targeting Domain | Target Site Length | Seq ID |
|---|---|---|---|---|
| CFTR-3849-168 | + | UAGCUGUAAUUGCAUUGUACC | 21 | 3511 |
| CFTR-3849-169 | + | CUAGCUGUAAUUGCAUUGUACC | 22 | 3512 |
| CFTR-3849-170 | + | UGCUAGCUGUAAUUGCAUUGUACC | 24 | 3513 |
| CFTR-3849-171 | + | UGAUCUGUUGAAUAAGGC | 18 | 3514 |
| CFTR-3849-172 | + | AGUGAUCUGUUGAAUAAGGC | 20 | 3515 |
| CFTR-3849-173 | + | CAGUGAUCUGUUGAAUAAGGC | 21 | 3516 |
| CFTR-3849-174 | + | UCAGUGAUCUGUUGAAUAAGGC | 22 | 3517 |
| CFTR-3849-175 | + | CUCAGUGAUCUGUUGAAUAAGGC | 23 | 3518 |
| CFTR-3849-176 | + | UCUCAGUGAUCUGUUGAAUAAGGC | 24 | 3519 |
| CFTR-3849-177 | + | CACAUAAUAAUUAGUUUC | 18 | 3520 |
| CFTR-3849-178 | + | UGGCACAUAAUAAUUAGUUUC | 21 | 3521 |
| CFTR-3849-179 | + | CUGGCACAUAAUAAUUAGUUUC | 22 | 3522 |
| CFTR-3849-180 | + | ACUGGCACAUAAUAAUUAGUUUC | 23 | 3523 |
| CFTR-3849-181 | + | AACUGGCACAUAAUAAUUAGUUUC | 24 | 3524 |
| CFTR-3849-182 | + | ACCUCCUCCCUGAGAAUG | 18 | 3525 |
| CFTR-3849-183 | + | CACCUCCUCCCUGAGAAUG | 19 | 3526 |
| CFTR-3849-184 | + | UGCACCUCCUCCCUGAGAAUG | 21 | 3527 |
| CFTR-3849-185 | + | AUGCACCUCCUCCCUGAGAAUG | 22 | 3528 |
| CFTR-3849-186 | + | AAUGCACCUCCUCCCUGAGAAUG | 23 | 3529 |
| CFTR-3849-187 | + | CAAUGCACCUCCUCCCUGAGAAUG | 24 | 3530 |
| CFTR-3849-188 | + | AAGUCCAGAUUUAUCAUG | 18 | 3531 |
| CFTR-3849-189 | + | UAAGUCCAGAUUUAUCAUG | 19 | 3532 |
| CFTR-3849-190 | + | UUAAGUCCAGAUUUAUCAUG | 20 | 3533 |
| CFTR-3849-191 | + | AUUAAGUCCAGAUUUAUCAUG | 21 | 3534 |
| CFTR-3849-192 | + | UGAUUAAGUCCAGAUUUAUCAUG | 23 | 3535 |
| CFTR-3849-193 | + | UUGAUUAAGUCCAGAUUUAUCAUG | 24 | 3536 |
| CFTR-3849-194 | + | UAUACAAUAUACCAUAUG | 18 | 3537 |
| CFTR-3849-195 | + | AUAUACAAUAUACCAUAUG | 19 | 3538 |
| CFTR-3849-116 | + | UAUAUACAAUAUACCAUAUG | 20 | 3459 |
| CFTR-3849-196 | + | AUAUAUACAAUAUACCAUAUG | 21 | 3539 |
| CFTR-3849-197 | + | UGAUAUAUACAAUAUACCAUAUG | 23 | 3540 |
| CFTR-3849-198 | + | AGGCUUCUCAGUGAUCUG | 18 | 3541 |
| CFTR-3849-199 | + | CAGGCUUCUCAGUGAUCUG | 19 | 3542 |
| CFTR-3849-200 | + | CCAGGCUUCUCAGUGAUCUG | 20 | 3543 |
| CFTR-3849-201 | + | UCCAGGCUUCUCAGUGAUCUG | 21 | 3544 |
| CFTR-3849-202 | + | UUCCAGGCUUCUCAGUGAUCUG | 22 | 3545 |
| CFTR-3849-203 | + | UUUCCAGGCUUCUCAGUGAUCUG | 23 | 3546 |

TABLE 35B-continued

2nd Tier

| gRNA Name | DNA Strand | Targeting Domain | Target Site Length | Seq ID |
|---|---|---|---|---|
| CFTR-3849-204 | + | UUUUCCAGGCUUCUCAGUGAUCUG | 24 | 3547 |
| CFTR-3849-205 | + | UGUUGAAAGUUAAACAGUG | 19 | 3548 |
| CFTR-3849-206 | + | AUGUUGAAAGUUAAACAGUG | 20 | 3549 |
| CFTR-3849-207 | + | UAUGUUGAAAGUUAAACAGUG | 21 | 3550 |
| CFTR-3849-208 | + | AUAUGUUGAAAGUUAAACAGUG | 22 | 3551 |
| CFTR-3849-209 | + | AAUAUGUUGAAAGUUAAACAGUG | 23 | 3552 |
| CFTR-3849-210 | + | UAAUAUGUUGAAAGUUAAACAGUG | 24 | 3553 |
| CFTR-3849-211 | + | UGUUUGUGCUGAUAUGAU | 18 | 3554 |
| CFTR-3849-212 | + | AGGUGUUUGUGCUGAUAUGAU | 21 | 3555 |
| CFTR-3849-213 | + | UAGGUGUUUGUGCUGAUAUGAU | 22 | 3556 |
| CFTR-3849-214 | + | UUAGGUGUUUGUGCUGAUAUGAU | 23 | 3557 |
| CFTR-3849-215 | + | UUUAGGUGUUUGUGCUGAUAUGAU | 24 | 3558 |
| CFTR-3849-216 | + | UCAAUGCACCUCCUCCCU | 18 | 3559 |
| CFTR-3849-217 | + | UUCAAUGCACCUCCUCCCU | 19 | 3560 |
| CFTR-3849-218 | + | CUUCAAUGCACCUCCUCCCU | 20 | 3561 |
| CFTR-3849-219 | + | ACUUCAAUGCACCUCCUCCCU | 21 | 3562 |
| CFTR-3849-220 | + | AACUUCAAUGCACCUCCUCCCU | 22 | 3563 |
| CFTR-3849-221 | + | UAACUUCAAUGCACCUCCUCCCU | 23 | 3564 |
| CFTR-3849-222 | + | AUAACUUCAAUGCACCUCCUCCCU | 24 | 3565 |
| CFTR-3849-223 | + | UUAAUGAAACAUAGUAUU | 18 | 3566 |
| CFTR-3849-224 | + | AUUAAUGAAACAUAGUAUU | 19 | 3567 |
| CFTR-3849-225 | + | UAUUAAUGAAACAUAGUAUU | 20 | 3568 |
| CFTR-3849-226 | + | UUAUUAAUGAAACAUAGUAUU | 21 | 3569 |
| CFTR-3849-227 | + | AUUAUUAAUGAAACAUAGUAUU | 22 | 3570 |
| CFTR-3849-228 | + | AAUUAUUAAUGAAACAUAGUAUU | 23 | 3571 |
| CFTR-3849-229 | + | UAAUUAUUAAUGAAACAUAGUAUU | 24 | 3572 |
| CFTR-3849-230 | + | CAUGAAUAGAACAUUUCCUUU | 21 | 3573 |
| CFTR-3849-231 | + | CCAUGAAUAGAACAUUUCCUUU | 22 | 3574 |
| CFTR-3849-232 | + | ACCAUGAAUAGAACAUUUCCUUU | 23 | 3575 |
| CFTR-3849-233 | + | UACCAUGAAUAGAACAUUUCCUUU | 24 | 3576 |
| CFTR-3849-234 | − | UCUUUCCCAACCUAAAAA | 18 | 3577 |
| CFTR-3849-235 | − | AGUCUUUCCCAACCUAAAAA | 20 | 3578 |
| CFTR-3849-236 | − | CAGUCUUUCCCAACCUAAAAA | 21 | 3579 |
| CFTR-3849-237 | − | CCAGUCUUUCCCAACCUAAAAA | 22 | 3580 |
| CFTR-3849-238 | − | UCCAGUCUUUCCCAACCUAAAAA | 23 | 3581 |
| CFTR-3849-239 | − | AUCCAGUCUUUCCCAACCUAAAAA | 24 | 3582 |
| CFTR-3849-240 | − | AAGUAGUUGAAUCAUUCA | 18 | 3583 |
| CFTR-3849-241 | − | AAAGUAGUUGAAUCAUUCA | 19 | 3584 |

TABLE 35B-continued

2nd Tier

| gRNA Name | DNA Strand | Targeting Domain | Target Site Length | Seq ID |
|---|---|---|---|---|
| CFTR-3849-242 | - | UAAAGUAGUUGAAUCAUUCA | 20 | 3585 |
| CFTR-3849-243 | - | AUUGUAUAUAUCACAGUA | 18 | 3586 |
| CFTR-3849-244 | - | UAUUGUAUAUAUCACAGUA | 19 | 3587 |
| CFTR-3849-245 | - | AUAUUGUAUAUAUCACAGUA | 20 | 3588 |
| CFTR-3849-246 | - | UCAAUGAUAUAAGGAAAC | 18 | 3589 |
| CFTR-3849-247 | - | UUCAAUGAUAUAAGGAAAC | 19 | 3590 |
| CFTR-3849-248 | - | AGUUCAAUGAUAUAAGGAAAC | 21 | 3591 |
| CFTR-3849-249 | - | CAGUUCAAUGAUAUAAGGAAAC | 22 | 3592 |
| CFTR-3849-250 | - | AGCAGUUCAAUGAUAUAAGGAAAC | 24 | 3593 |
| CFTR-3849-251 | - | AGGUAAUGAAAAUAAUUAC | 20 | 3594 |
| CFTR-3849-252 | - | AGAAAUAAUUUAUAAGAAUAUC | 22 | 3595 |
| CFTR-3849-253 | - | CAGAAAUAAUUUAUAAGAAUAUC | 23 | 3596 |
| CFTR-3849-254 | - | UCAGAAAUAAUUUAUAAGAAUAUC | 24 | 3597 |
| CFTR-3849-255 | - | AACAUUGGUGUAAAGUAG | 18 | 3598 |
| CFTR-3849-256 | - | AAACAUUGGUGUAAAGUAG | 19 | 3599 |
| CFTR-3849-257 | - | UAAACAUUGGUGUAAAGUAG | 20 | 3600 |
| CFTR-3849-258 | - | AUAAACAUUGGUGUAAAGUAG | 21 | 3601 |
| CFTR-3849-259 | - | UGAUAAACAUUGGUGUAAAGUAG | 23 | 3602 |
| CFTR-3849-260 | - | UUGAUAAACAUUGGUGUAAAGUAG | 24 | 3603 |
| CFTR-3849-261 | - | UGUUGCAGUAUUAAAAUG | 18 | 3604 |
| CFTR-3849-262 | - | CUGUUGCAGUAUUAAAAUG | 19 | 3605 |
| CFTR-3849-263 | - | UCUGUUGCAGUAUUAAAAUG | 20 | 3606 |
| CFTR-3849-264 | - | AUCUGUUGCAGUAUUAAAAUG | 21 | 3607 |
| CFTR-3849-265 | - | CAUCUGUUGCAGUAUUAAAAUG | 22 | 3608 |
| CFTR-3849-266 | - | CCAUCUGUUGCAGUAUUAAAAUG | 23 | 3609 |
| CFTR-3849-267 | - | UCCAUCUGUUGCAGUAUUAAAAUG | 24 | 3610 |
| CFTR-3849-268 | - | AUAAACAAGAAGACUUUG | 18 | 3611 |
| CFTR-3849-269 | - | UAUAAACAAGAAGACUUUG | 19 | 3612 |
| CFTR-3849-270 | - | AUAUAAACAAGAAGACUUUG | 20 | 3613 |
| CFTR-3849-271 | - | UAUAUAAACAAGAAGACUUUG | 21 | 3614 |
| CFTR-3849-272 | - | UUAUAUAAACAAGAAGACUUUG | 22 | 3615 |
| CFTR-3849-273 | - | AGUUAUAUAAACAAGAAGACUUUG | 24 | 3616 |
| CFTR-3849-274 | - | AAAACACUGACUUAGAUU | 18 | 3617 |
| CFTR-3849-275 | - | AGAAAACACUGACUUAGAUU | 20 | 3618 |
| CFTR-3849-276 | - | UAGAAAACACUGACUUAGAUU | 21 | 3619 |
| CFTR-3849-277 | - | UUAGAAAACACUGACUUAGAUU | 22 | 3620 |
| CFTR-3849-278 | - | AUUAGAAAACACUGACUUAGAUU | 23 | 3621 |

TABLE 35B-continued

2nd Tier

| gRNA Name | DNA Strand | Targeting Domain | Target Site Length | Seq ID |
|---|---|---|---|---|
| CFTR-3849-279 | − | UAUUAGAAAACACUGACUUAGAUU | 24 | 3622 |
| CFTR-3849-280 | − | ACUUUAAGGUCUAUACUU | 18 | 3623 |
| CFTR-3849-281 | − | UACUUUAAGGUCUAUACUU | 19 | 3624 |
| CFTR-3849-282 | − | AGUACUUUAAGGUCUAUACUU | 21 | 3625 |
| CFTR-3849-283 | − | UAGUACUUUAAGGUCUAUACUU | 22 | 3626 |
| CFTR-3849-284 | − | AUAGUACUUUAAGGUCUAUACUU | 23 | 3627 |
| CFTR-3849-285 | − | UUCAAUUAUAAUCACCUU | 18 | 3628 |
| CFTR-3849-286 | − | AUUCAAUUAUAAUCACCUU | 19 | 3629 |
| CFTR-3849-287 | − | AGAUUCAAUUAUAAUCACCUU | 21 | 3630 |
| CFTR-3849-288 | − | AAGAUUCAAUUAUAAUCACCUU | 22 | 3631 |
| CFTR-3849-289 | − | AAAGAUUCAAUUAUAAUCACCUU | 23 | 3632 |
| CFTR-3849-290 | − | AAAAGAUUCAAUUAUAAUCACCUU | 24 | 3633 |

Table 35C provides exemplary targeting domains for correcting a mutation (e.g., 3849+10 kbC→T) in the CFTR gene selected according to the fourth tier parameters. The targeting domains bind within 500 bp from a mutation (e.g., 3849+10 kbC→T), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 35C

3rd Tier

| gRNA Name | DNA Strand | Targeting Domain | Target Site Length | Seq ID |
|---|---|---|---|---|
| CFTR-3849-291 | + | AAUGUUUAUCAAGAUAGAAAA | 21 | 3634 |
| CFTR-3849-292 | + | CAAUGUUUAUCAAGAUAGAAAA | 22 | 3635 |
| CFTR-3849-293 | + | CCAAUGUUUAUCAAGAUAGAAAA | 23 | 3636 |
| CFTR-3849-294 | + | ACCAAUGUUUAUCAAGAUAGAAAA | 24 | 3637 |
| CFTR-3849-295 | + | AGAUCCACAAGGUGAUUAUAA | 21 | 3638 |
| CFTR-3849-296 | + | UAGAUCCACAAGGUGAUUAUAA | 22 | 3639 |
| CFTR-3849-297 | + | UUAGAUCCACAAGGUGAUUAUAA | 23 | 3640 |
| CFTR-3849-298 | + | UUUAGAUCCACAAGGUGAUUAUAA | 24 | 3641 |
| CFTR-3849-299 | + | AGAAUAUGCUGCUUAUACCCA | 21 | 3642 |
| CFTR-3849-300 | + | GAGAAUAUGCUGCUUAUACCCA | 22 | 3643 |
| CFTR-3849-301 | + | UGAGAAUAUGCUGCUUAUACCCA | 23 | 3644 |
| CFTR-3849-302 | + | UUGAGAAUAUGCUGCUUAUACCCA | 24 | 3645 |
| CFTR-3849-303 | + | GAAUAGAACAUUUCCUUU | 18 | 3646 |
| CFTR-3849-304 | + | UGAAUAGAACAUUUCCUUU | 19 | 3647 |
| CFTR-3849-305 | + | AUGAAUAGAACAUUUCCUUU | 20 | 3648 |
| CFTR-3849-306 | − | GUAAAGUAGUUGAAUCAUUCA | 21 | 3649 |
| CFTR-3849-307 | − | UGUAAAGUAGUUGAAUCAUUCA | 22 | 3650 |

TABLE 35C-continued

3rd Tier

| gRNA Name | DNA Strand | Targeting Domain | Target Site Length | Seq ID |
|---|---|---|---|---|
| CFTR-3849-308 | - | GUGUAAAGUAGUUGAAUCAUUCA | 23 | 3651 |
| CFTR-3849-309 | - | GGUGUAAAGUAGUUGAAUCAUUCA | 24 | 3652 |
| CFTR-3849-310 | - | UAUAUUGUAUAUAUCACAGUA | 21 | 3653 |
| CFTR-3849-311 | - | GUAUAUUGUAUAUAUCACAGUA | 22 | 3654 |
| CFTR-3849-312 | - | GGUAUAUUGUAUAUAUCACAGUA | 23 | 3655 |
| CFTR-3849-313 | - | UGGUAUAUUGUAUAUAUCACAGUA | 24 | 3656 |
| CFTR-3849-314 | - | AAGGUAAUGAAAAAUAAUUAC | 21 | 3657 |
| CFTR-3849-315 | - | CAAGGUAAUGAAAAAUAAUUAC | 22 | 3658 |
| CFTR-3849-316 | - | ACAAGGUAAUGAAAAAUAAUUAC | 23 | 3659 |
| CFTR-3849-317 | - | CACAAGGUAAUGAAAAAUAAUUAC | 24 | 3660 |
| CFTR-3849-318 | - | AUAAUUUAUAAGAAUAUC | 18 | 3661 |
| CFTR-3849-319 | - | AAUAAUUUAUAAGAAUAUC | 19 | 3662 |
| CFTR-3849-320 | - | AAAUAAUUUAUAAGAAUAUC | 20 | 3663 |
| CFTR-3849-321 | - | AUUUCAGAAAUAAUUUAU | 18 | 3664 |
| CFTR-3849-322 | - | AAUUUCAGAAAUAAUUUAU | 19 | 3665 |
| CFTR-3849-323 | - | AAAUUUCAGAAAUAAUUUAU | 20 | 3666 |
| CFTR-3849-324 | - | GAAAUUUCAGAAAUAAUUUAU | 21 | 3667 |
| CFTR-3849-325 | - | AGAAAUUUCAGAAAUAAUUUAU | 22 | 3668 |
| CFTR-3849-326 | - | CAGAAAUUUCAGAAAUAAUUUAU | 23 | 3669 |
| CFTR-3849-327 | - | ACAGAAAUUUCAGAAAUAAUUUAU | 24 | 3670 |

Table 35D provides exemplary targeting domains for correcting a mutation (e.g., 3849+10 kbC→T) in the CFTR gene selected according to the fifth tier parameters. The targeting domains bind within 500 bp from a mutation (e.g., 3849+10 kbC→T), and PAM is NNGRRV. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 35D

4th Tier

| gRNA Name | DNA Strand | Targeting Domain | Target Site Length | Seq ID |
|---|---|---|---|---|
| CFTR-3849-328 | + | UUUUCAAGAGACUACAAA | 18 | 3671 |
| CFTR-3849-329 | + | AUUUUCAAGAGACUACAAA | 19 | 3672 |
| CFTR-3849-47 | + | UAUUUUCAAGAGACUACAAA | 20 | 3390 |
| CFTR-3849-330 | + | GUAUUUUCAAGAGACUACAAA | 21 | 3673 |
| CFTR-3849-331 | + | UGUAUUUUCAAGAGACUACAAA | 22 | 3674 |
| CFTR-3849-332 | + | CUGUAUUUUCAAGAGACUACAAA | 23 | 3675 |
| CFTR-3849-333 | + | UCUGUAUUUUCAAGAGACUACAAA | 24 | 3676 |
| CFTR-3849-334 | + | UGUUUAUCAAGAUAGAAA | 18 | 3677 |

TABLE 35D-continued

4th Tier

| gRNA Name | DNA Strand | Targeting Domain | Target Site Length | Seq ID |
|---|---|---|---|---|
| CFTR-3849-335 | + | AUGUUUAUCAAGAUAGAAA | 19 | 3678 |
| CFTR-3849-336 | + | AAUGUUUAUCAAGAUAGAAA | 20 | 3679 |
| CFTR-3849-337 | + | CAAUGUUUAUCAAGAUAGAAA | 21 | 3680 |
| CFTR-3849-338 | + | CCAAUGUUUAUCAAGAUAGAAA | 22 | 3681 |
| CFTR-3849-339 | + | ACCAAUGUUUAUCAAGAUAGAAA | 23 | 3682 |
| CFTR-3849-340 | + | CACCAAUGUUUAUCAAGAUAGAAA | 24 | 3683 |
| CFTR-3849-341 | + | AUUUUCAAGAGACUACAA | 18 | 3684 |
| CFTR-3849-342 | + | UAUUUUCAAGAGACUACAA | 19 | 3685 |
| CFTR-3849-343 | + | GUAUUUUCAAGAGACUACAA | 20 | 3686 |
| CFTR-3849-344 | + | UGUAUUUUCAAGAGACUACAA | 21 | 3687 |
| CFTR-3849-345 | + | CUGUAUUUUCAAGAGACUACAA | 22 | 3688 |
| CFTR-3849-346 | + | UCUGUAUUUUCAAGAGACUACAA | 23 | 3689 |
| CFTR-3849-347 | + | UUCUGUAUUUUCAAGAGACUACAA | 24 | 3690 |
| CFTR-3849-348 | + | AUCAAGAUGACAAGUCAA | 18 | 3691 |
| CFTR-3849-349 | + | AAUCAAGAUGACAAGUCAA | 19 | 3692 |
| CFTR-3849-350 | + | AAAUCAAGAUGACAAGUCAA | 20 | 3693 |
| CFTR-3849-351 | + | GAAAUCAAGAUGACAAGUCAA | 21 | 3694 |
| CFTR-3849-352 | + | AGAAAUCAAGAUGACAAGUCAA | 22 | 3695 |
| CFTR-3849-353 | + | CAGAAAUCAAGAUGACAAGUCAA | 23 | 3696 |
| CFTR-3849-354 | + | CCAGAAAUCAAGAUGACAAGUCAA | 24 | 3697 |
| CFTR-3849-355 | + | AUUGCAUUGUACCAUGAA | 18 | 3698 |
| CFTR-3849-356 | + | AAUUGCAUUGUACCAUGAA | 19 | 3699 |
| CFTR-3849-357 | + | UAAUUGCAUUGUACCAUGAA | 20 | 3700 |
| CFTR-3849-358 | + | GUAAUUGCAUUGUACCAUGAA | 21 | 3701 |
| CFTR-3849-359 | + | UGUAAUUGCAUUGUACCAUGAA | 22 | 3702 |
| CFTR-3849-360 | + | CUGUAAUUGCAUUGUACCAUGAA | 23 | 3703 |
| CFTR-3849-361 | + | GCUGUAAUUGCAUUGUACCAUGAA | 24 | 3704 |
| CFTR-3849-362 | + | CAAAUAUCUAUUUAAUCA | 18 | 3705 |
| CFTR-3849-363 | + | UCAAAUAUCUAUUUAAUCA | 19 | 3706 |
| CFTR-3849-364 | + | AUCAAAUAUCUAUUUAAUCA | 20 | 3707 |
| CFTR-3849-365 | + | UAUCAAAUAUCUAUUUAAUCA | 21 | 3708 |
| CFTR-3849-366 | + | CUAUCAAAUAUCUAUUUAAUCA | 22 | 3709 |
| CFTR-3849-367 | + | ACUAUCAAAUAUCUAUUUAAUCA | 23 | 3710 |
| CFTR-3849-368 | + | UACUAUCAAAUAUCUAUUUAAUCA | 24 | 3711 |
| CFTR-3849-369 | + | UCUGGUUUCCUUAUAUCA | 18 | 3712 |
| CFTR-3849-370 | + | CUCUGGUUUCCUUAUAUCA | 19 | 3713 |
| CFTR-3849-371 | + | ACUCUGGUUUCCUUAUAUCA | 20 | 3714 |
| CFTR-3849-372 | + | UACUCUGGUUUCCUUAUAUCA | 21 | 3715 |

TABLE 35D-continued

4th Tier

| gRNA Name | DNA Strand | Targeting Domain | Target Site Length | Seq ID |
|---|---|---|---|---|
| CFTR-3849-373 | + | UUACUCUGGUUUCCUUAUAUCA | 22 | 3716 |
| CFTR-3849-374 | + | AUUACUCUGGUUUCCUUAUAUCA | 23 | 3717 |
| CFTR-3849-375 | + | UAUUACUCUGGUUUCCUUAUAUCA | 24 | 3718 |
| CFTR-3849-376 | + | CACCAAUGUUUAUCAAGA | 18 | 3719 |
| CFTR-3849-377 | + | ACACCAAUGUUUAUCAAGA | 19 | 3720 |
| CFTR-3849-378 | + | UACACCAAUGUUUAUCAAGA | 20 | 3721 |
| CFTR-3849-379 | + | UUACACCAAUGUUUAUCAAGA | 21 | 3722 |
| CFTR-3849-380 | + | UUUACACCAAUGUUUAUCAAGA | 22 | 3723 |
| CFTR-3849-381 | + | CUUUACACCAAUGUUUAUCAAGA | 23 | 3724 |
| CFTR-3849-382 | + | ACUUUACACCAAUGUUUAUCAAGA | 24 | 3725 |
| CFTR-3849-383 | + | UUUUAAUACUGCAACAGA | 18 | 3726 |
| CFTR-3849-384 | + | AUUUUAAUACUGCAACAGA | 19 | 3727 |
| CFTR-3849-53 | + | CAUUUUAAUACUGCAACAGA | 20 | 3396 |
| CFTR-3849-385 | + | CCAUUUUAAUACUGCAACAGA | 21 | 3728 |
| CFTR-3849-386 | + | ACCAUUUUAAUACUGCAACAGA | 22 | 3729 |
| CFTR-3849-387 | + | CACCAUUUUAAUACUGCAACAGA | 23 | 3730 |
| CFTR-3849-388 | + | UCACCAUUUUAAUACUGCAACAGA | 24 | 3731 |
| CFTR-3849-389 | + | UAUUAAUGAAACAUAGUA | 18 | 3732 |
| CFTR-3849-390 | + | UUAUUAAUGAAACAUAGUA | 19 | 3733 |
| CFTR-3849-391 | + | AUUAUUAAUGAAACAUAGUA | 20 | 3734 |
| CFTR-3849-392 | + | AAUUAUUAAUGAAACAUAGUA | 21 | 3735 |
| CFTR-3849-393 | + | UAAUUAUUAAUGAAACAUAGUA | 22 | 3736 |
| CFTR-3849-394 | + | UUAAUUAUUAAUGAAACAUAGUA | 23 | 3737 |
| CFTR-3849-395 | + | AUUAAUUAUUAAUGAAACAUAGUA | 24 | 3738 |
| CFTR-3849-396 | + | UAUCUCUAUUAAUUAUUA | 18 | 3739 |
| CFTR-3849-397 | + | AUAUCUCUAUUAAUUAUUA | 19 | 3740 |
| CFTR-3849-398 | + | UAUAUCUCUAUUAAUUAUUA | 20 | 3741 |
| CFTR-3849-399 | + | AUAUAUCUCUAUUAAUUAUUA | 21 | 3742 |
| CFTR-3849-400 | + | CAUAUAUCUCUAUUAAUUAUUA | 22 | 3743 |
| CFTR-3849-401 | + | UCAUAUAUCUCUAUUAAUUAUUA | 23 | 3744 |
| CFTR-3849-402 | + | UUCAUAUAUCUCUAUUAAUUAUUA | 24 | 3745 |
| CFTR-3849-403 | + | AAAAUACUAAAAUUUUUA | 18 | 3746 |
| CFTR-3849-404 | + | AAAAAUACUAAAAUUUUUA | 19 | 3747 |
| CFTR-3849-405 | + | AAAAAAUACUAAAAUUUUUA | 20 | 3748 |
| CFTR-3849-406 | + | AAAAAAAUACUAAAAUUUUUA | 21 | 3749 |
| CFTR-3849-407 | + | GAAAAAAAUACUAAAAUUUUUA | 22 | 3750 |
| CFTR-3849-408 | + | AGAAAAAAAUACUAAAAUUUUUA | 23 | 3751 |

TABLE 35D-continued

4th Tier

| gRNA Name | DNA Strand | Targeting Domain | Target Site Length | Seq ID |
|---|---|---|---|---|
| CFTR-3849-409 | + | CAGAAAAAAAUACUAAAAUUUUUA | 24 | 3752 |
| CFTR-3849-410 | + | CUUCAAUGCACCUCCUCC | 18 | 3753 |
| CFTR-3849-411 | + | ACUUCAAUGCACCUCCUCC | 19 | 3754 |
| CFTR-3849-412 | + | AACUUCAAUGCACCUCCUCC | 20 | 3755 |
| CFTR-3849-413 | + | UAACUUCAAUGCACCUCCUCC | 21 | 3756 |
| CFTR-3849-414 | + | AUAACUUCAAUGCACCUCCUCC | 22 | 3757 |
| CFTR-3849-415 | + | AAUAACUUCAAUGCACCUCCUCC | 23 | 3758 |
| CFTR-3849-416 | + | UAAUAACUUCAAUGCACCUCCUCC | 24 | 3759 |
| CFTR-3849-417 | + | GACACAUUUUUCAAAGGC | 18 | 3760 |
| CFTR-3849-418 | + | UGACACAUUUUUCAAAGGC | 19 | 3761 |
| CFTR-3849-419 | + | CUGACACAUUUUUCAAAGGC | 20 | 3762 |
| CFTR-3849-420 | + | UCUGACACAUUUUUCAAAGGC | 21 | 3763 |
| CFTR-3849-421 | + | AUCUGACACAUUUUUCAAAGGC | 22 | 3764 |
| CFTR-3849-422 | + | UAUCUGACACAUUUUUCAAAGGC | 23 | 3765 |
| CFTR-3849-423 | + | AUAUCUGACACAUUUUUCAAAGGC | 24 | 3766 |
| CFTR-3849-424 | + | AUUAAGUCCAGAUUUAUC | 18 | 3767 |
| CFTR-3849-425 | + | GAUUAAGUCCAGAUUUAUC | 19 | 3768 |
| CFTR-3849-426 | + | UGAUUAAGUCCAGAUUUAUC | 20 | 3769 |
| CFTR-3849-427 | + | UUGAUUAAGUCCAGAUUUAUC | 21 | 3770 |
| CFTR-3849-428 | + | UUUGAUUAAGUCCAGAUUUAUC | 22 | 3771 |
| CFTR-3849-429 | + | UUUUGAUUAAGUCCAGAUUUAUC | 23 | 3772 |
| CFTR-3849-430 | + | AUUUUGAUUAAGUCCAGAUUUAUC | 24 | 3773 |
| CFTR-3849-431 | + | UCAUUACCUUGUGGUCUC | 18 | 3774 |
| CFTR-3849-432 | + | UUCAUUACCUUGUGGUCUC | 19 | 3775 |
| CFTR-3849-433 | + | UUUCAUUACCUUGUGGUCUC | 20 | 3776 |
| CFTR-3849-434 | + | UUUUCAUUACCUUGUGGUCUC | 21 | 3777 |
| CFTR-3849-435 | + | UUUUUCAUUACCUUGUGGUCUC | 22 | 3778 |
| CFTR-3849-436 | + | AUUUUUCAUUACCUUGUGGUCUC | 23 | 3779 |
| CFTR-3849-437 | + | UAUUUUUCAUUACCUUGUGGUCUC | 24 | 3780 |
| CFTR-3849-438 | + | UGAAAUUUCUGUAUUUUC | 18 | 3781 |
| CFTR-3849-439 | + | CUGAAAUUUCUGUAUUUUC | 19 | 3782 |
| CFTR-3849-440 | + | UCUGAAAUUUCUGUAUUUUC | 20 | 3783 |
| CFTR-3849-441 | + | UUCUGAAAUUUCUGUAUUUUC | 21 | 3784 |
| CFTR-3849-442 | + | UUUCUGAAAUUUCUGUAUUUUC | 22 | 3785 |
| CFTR-3849-443 | + | AUUUCUGAAAUUUCUGUAUUUUC | 23 | 3786 |
| CFTR-3849-444 | + | UAUUUCUGAAAUUUCUGUAUUUUC | 24 | 3787 |
| CFTR-3849-445 | + | AUUUUAAUACUGCAACAG | 18 | 3788 |
| CFTR-3849-446 | + | CAUUUUAAUACUGCAACAG | 19 | 3789 |

TABLE 35D-continued

4th Tier

| gRNA Name | DNA Strand | Targeting Domain | Target Site Length | Seq ID |
|---|---|---|---|---|
| CFTR-3849-447 | + | CCAUUUUAAUACUGCAACAG | 20 | 3790 |
| CFTR-3849-448 | + | ACCAUUUUAAUACUGCAACAG | 21 | 3791 |
| CFTR-3849-449 | + | CACCAUUUUAAUACUGCAACAG | 22 | 3792 |
| CFTR-3849-450 | + | UCACCAUUUUAAUACUGCAACAG | 23 | 3793 |
| CFTR-3849-451 | + | CUCACCAUUUUAAUACUGCAACAG | 24 | 3794 |
| CFTR-3849-452 | + | GAGAACUCAGUUUUUAGG | 18 | 3795 |
| CFTR-3849-453 | + | AGAGAACUCAGUUUUUAGG | 19 | 3796 |
| CFTR-3849-454 | + | UAGAGAACUCAGUUUUUAGG | 20 | 3797 |
| CFTR-3849-455 | + | UUAGAGAACUCAGUUUUUAGG | 21 | 3798 |
| CFTR-3849-456 | + | UUUAGAGAACUCAGUUUUUAGG | 22 | 3799 |
| CFTR-3849-457 | + | UUUUAGAGAACUCAGUUUUUAGG | 23 | 3800 |
| CFTR-3849-458 | + | UUUUUAGAGAACUCAGUUUUUAGG | 24 | 3801 |
| CFTR-3849-459 | + | UAGGUUGGGAAAGACUGG | 18 | 3802 |
| CFTR-3849-460 | + | UUAGGUUGGGAAAGACUGG | 19 | 3803 |
| CFTR-3849-461 | + | UUUAGGUUGGGAAAGACUGG | 20 | 3804 |
| CFTR-3849-462 | + | UUUUAGGUUGGGAAAGACUGG | 21 | 3805 |
| CFTR-3849-463 | + | UUUUUAGGUUGGGAAAGACUGG | 22 | 3806 |
| CFTR-3849-464 | + | GUUUUUAGGUUGGGAAAGACUGG | 23 | 3807 |
| CFTR-3849-465 | + | AGUUUUUAGGUUGGGAAAGACUGG | 24 | 3808 |
| CFTR-3849-466 | + | UUCAAGAGACUACAAAUG | 18 | 3809 |
| CFTR-3849-467 | + | UUUCAAGAGACUACAAAUG | 19 | 3810 |
| CFTR-3849-468 | + | UUUUCAAGAGACUACAAAUG | 20 | 3811 |
| CFTR-3849-469 | + | AUUUUCAAGAGACUACAAAUG | 21 | 3812 |
| CFTR-3849-470 | + | UAUUUUCAAGAGACUACAAAUG | 22 | 3813 |
| CFTR-3849-471 | + | GUAUUUUCAAGAGACUACAAAUG | 23 | 3814 |
| CFTR-3849-472 | + | UGUAUUUUCAAGAGACUACAAAUG | 24 | 3815 |
| CFTR-3849-473 | + | GUUGGGAAAGACUGGAUG | 18 | 3816 |
| CFTR-3849-474 | + | GGUUGGGAAAGACUGGAUG | 19 | 3817 |
| CFTR-3849-475 | + | AGGUUGGGAAAGACUGGAUG | 20 | 3818 |
| CFTR-3849-476 | + | UAGGUUGGGAAAGACUGGAUG | 21 | 3819 |
| CFTR-3849-477 | + | UUAGGUUGGGAAAGACUGGAUG | 22 | 3820 |
| CFTR-3849-478 | + | UUUAGGUUGGGAAAGACUGGAUG | 23 | 3821 |
| CFTR-3849-479 | + | UUUUAGGUUGGGAAAGACUGGAUG | 24 | 3822 |
| CFTR-3849-480 | + | AUAAAUCAAAAUAAUAUG | 18 | 3823 |
| CFTR-3849-481 | + | GAUAAAUCAAAAUAAUAUG | 19 | 3824 |
| CFTR-3849-482 | + | AGAUAAAUCAAAAUAAUAUG | 20 | 3825 |
| CFTR-3849-483 | + | AAGAUAAAUCAAAAUAAUAUG | 21 | 3826 |

TABLE 35D-continued

| | | 4th Tier | | |
|---|---|---|---|---|
| gRNA Name | DNA Strand | Targeting Domain | Target Site Length | Seq ID |
| CFTR-3849-484 | + | CAAGAUAAAUCAAAAUAAUAUG | 22 | 3827 |
| CFTR-3849-485 | + | UCAAGAUAAAUCAAAAUAAUAUG | 23 | 3828 |
| CFTR-3849-486 | + | AUCAAGAUAAAUCAAAAUAAUAUG | 24 | 3829 |
| CFTR-3849-487 | + | AUCAAAUAUCUAUUUAAU | 18 | 3830 |
| CFTR-3849-488 | + | UAUCAAAUAUCUAUUUAAU | 19 | 3831 |
| CFTR-3849-489 | + | CUAUCAAAUAUCUAUUUAAU | 20 | 3832 |
| CFTR-3849-490 | + | ACUAUCAAAUAUCUAUUUAAU | 21 | 3833 |
| CFTR-3849-491 | + | UACUAUCAAAUAUCUAUUUAAU | 22 | 3834 |
| CFTR-3849-492 | + | GUACUAUCAAAUAUCUAUUUAAU | 23 | 3835 |
| CFTR-3849-493 | + | AGUACUAUCAAAUAUCUAUUUAAU | 24 | 3836 |
| CFTR-3849-494 | + | AUAUAUACAAUAUACCAU | 18 | 3837 |
| CFTR-3849-495 | + | GAUAUAUACAAUAUACCAU | 19 | 3838 |
| CFTR-3849-496 | + | UGAUAUAUACAAUAUACCAU | 20 | 3839 |
| CFTR-3849-497 | + | GUGAUAUAUACAAUAUACCAU | 21 | 3840 |
| CFTR-3849-498 | + | UGUGAUAUAUACAAUAUACCAU | 22 | 3841 |
| CFTR-3849-499 | + | CUGUGAUAUAUACAAUAUACCAU | 23 | 3842 |
| CFTR-3849-500 | + | ACUGUGAUAUAUACAAUAUACCAU | 24 | 3843 |
| CFTR-3849-501 | + | AUAUACAAUAUACCAUAU | 18 | 3844 |
| CFTR-3849-502 | + | UAUAUACAAUAUACCAUAU | 19 | 3845 |
| CFTR-3849-503 | + | AUAUAUACAAUAUACCAUAU | 20 | 3846 |
| CFTR-3849-504 | + | GAUAUAUACAAUAUACCAUAU | 21 | 3847 |
| CFTR-3849-505 | + | UGAUAUAUACAAUAUACCAUAU | 22 | 3848 |
| CFTR-3849-506 | + | GUGAUAUAUACAAUAUACCAUAU | 23 | 3849 |
| CFTR-3849-507 | + | UGUGAUAUAUACAAUAUACCAUAU | 24 | 3850 |
| CFTR-3849-508 | + | AGAACUCAGUUUUUAGGU | 18 | 3851 |
| CFTR-3849-509 | + | GAGAACUCAGUUUUUAGGU | 19 | 3852 |
| CFTR-3849-78 | + | AGAGAACUCAGUUUUUAGGU | 20 | 3421 |
| CFTR-3849-510 | + | UAGAGAACUCAGUUUUUAGGU | 21 | 3853 |
| CFTR-3849-511 | + | UUAGAGAACUCAGUUUUUAGGU | 22 | 3854 |
| CFTR-3849-512 | + | UUUAGAGAACUCAGUUUUUAGGU | 23 | 3855 |
| CFTR-3849-513 | + | UUUUAGAGAACUCAGUUUUUAGGU | 24 | 3856 |
| CFTR-3849-514 | + | GAACUCAGUUUUUAGGUU | 18 | 3857 |
| CFTR-3849-515 | + | AGAACUCAGUUUUUAGGUU | 19 | 3858 |
| CFTR-3849-9 | + | GAGAACUCAGUUUUUAGGUU | 20 | 3352 |
| CFTR-3849-516 | + | AGAGAACUCAGUUUUUAGGUU | 21 | 3859 |
| CFTR-3849-517 | + | UAGAGAACUCAGUUUUUAGGUU | 22 | 3860 |
| CFTR-3849-518 | + | UUAGAGAACUCAGUUUUUAGGUU | 23 | 3861 |
| CFTR-3849-519 | + | UUUAGAGAACUCAGUUUUUAGGUU | 24 | 3862 |

TABLE 35D-continued

4th Tier

| gRNA Name | DNA Strand | Targeting Domain | Target Site Length | Seq ID |
|---|---|---|---|---|
| CFTR-3849-520 | + | UAUUCUUAUAAAUUAUUU | 18 | 3863 |
| CFTR-3849-521 | + | AUAUUCUUAUAAAUUAUUU | 19 | 3864 |
| CFTR-3849-522 | + | GAUAUUCUUAUAAAUUAUUU | 20 | 3865 |
| CFTR-3849-523 | + | UGAUAUUCUUAUAAAUUAUUU | 21 | 3866 |
| CFTR-3849-524 | + | UUGAUAUUCUUAUAAAUUAUUU | 22 | 3867 |
| CFTR-3849-525 | + | CUUGAUAUUCUUAUAAAUUAUUU | 23 | 3868 |
| CFTR-3849-526 | + | CCUUGAUAUUCUUAUAAAUUAUUU | 24 | 3869 |
| CFTR-3849-527 | + | GCACAUAAUAAUUAGUUU | 18 | 3870 |
| CFTR-3849-528 | + | GGCACAUAAUAAUUAGUUU | 19 | 3871 |
| CFTR-3849-529 | + | UGGCACAUAAUAAUUAGUUU | 20 | 3872 |
| CFTR-3849-530 | + | CUGGCACAUAAUAAUUAGUUU | 21 | 3873 |
| CFTR-3849-531 | + | ACUGGCACAUAAUAAUUAGUUU | 22 | 3874 |
| CFTR-3849-532 | + | AACUGGCACAUAAUAAUUAGUUU | 23 | 3875 |
| CFTR-3849-533 | + | UAACUGGCACAUAAUAAUUAGUUU | 24 | 3876 |
| CFTR-3849-534 | + | AAAAAAUACUAAAAUUUU | 18 | 3877 |
| CFTR-3849-535 | + | AAAAAAAUACUAAAAUUUU | 19 | 3878 |
| CFTR-3849-536 | + | GAAAAAAAUACUAAAAUUUU | 20 | 3879 |
| CFTR-3849-537 | + | AGAAAAAAAUACUAAAAUUUU | 21 | 3880 |
| CFTR-3849-538 | + | CAGAAAAAAAUACUAAAAUUUU | 22 | 3881 |
| CFTR-3849-539 | + | UCAGAAAAAAAUACUAAAAUUUU | 23 | 3882 |
| CFTR-3849-540 | + | UUCAGAAAAAAAUACUAAAAUUUU | 24 | 3883 |
| CFTR-3849-541 | − | AUUUUUUCUGAAGAAAA | 18 | 3884 |
| CFTR-3849-542 | − | UAUUUUUUCUGAAGAAAA | 19 | 3885 |
| CFTR-3849-87 | − | GUAUUUUUUCUGAAGAAAA | 20 | 3430 |
| CFTR-3849-543 | − | AGUAUUUUUUCUGAAGAAAA | 21 | 3886 |
| CFTR-3849-544 | − | UAGUAUUUUUUCUGAAGAAAA | 22 | 3887 |
| CFTR-3849-545 | − | UUAGUAUUUUUUCUGAAGAAAA | 23 | 3888 |
| CFTR-3849-546 | − | UUUAGUAUUUUUUCUGAAGAAAA | 24 | 3889 |
| CFTR-3849-547 | − | UAUUUUUUCUGAAGAAA | 18 | 3890 |
| CFTR-3849-548 | − | GUAUUUUUUCUGAAGAAA | 19 | 3891 |
| CFTR-3849-111 | − | AGUAUUUUUUCUGAAGAAA | 20 | 3454 |
| CFTR-3849-549 | − | UAGUAUUUUUUCUGAAGAAA | 21 | 3892 |
| CFTR-3849-550 | − | UUAGUAUUUUUUCUGAAGAAA | 22 | 3893 |
| CFTR-3849-551 | − | UUUAGUAUUUUUUCUGAAGAAA | 23 | 3849 |
| CFTR-3849-552 | − | UUUUAGUAUUUUUUCUGAAGAAA | 24 | 3895 |
| CFTR-3849-553 | − | GUAUUUUUUCUGAAGAA | 18 | 3896 |
| CFTR-3849-554 | − | AGUAUUUUUUCUGAAGAA | 19 | 3897 |

TABLE 35D-continued

4th Tier

| gRNA Name | DNA Strand | Targeting Domain | Target Site Length | Seq ID |
|---|---|---|---|---|
| CFTR-3849-555 | - | UAGUAUUUUUUCUGAAGAA | 20 | 3898 |
| CFTR-3849-556 | - | UUAGUAUUUUUUCUGAAGAA | 21 | 3899 |
| CFTR-3849-557 | - | UUUAGUAUUUUUUCUGAAGAA | 22 | 3900 |
| CFTR-3849-558 | - | UUUUAGUAUUUUUUCUGAAGAA | 23 | 3901 |
| CFTR-3849-559 | - | AUUUUAGUAUUUUUUCUGAAGAA | 24 | 3902 |
| CFTR-3849-560 | - | UGAGUAAGACACCCUGAA | 18 | 3903 |
| CFTR-3849-561 | - | GUGAGUAAGACACCCUGAA | 19 | 3904 |
| CFTR-3849-88 | - | GGUGAGUAAGACACCCUGAA | 20 | 3431 |
| CFTR-3849-562 | - | UGGUGAGUAAGACACCCUGAA | 21 | 3905 |
| CFTR-3849-563 | - | AUGGUGAGUAAGACACCCUGAA | 22 | 3906 |
| CFTR-3849-564 | - | AAUGGUGAGUAAGACACCCUGAA | 23 | 3907 |
| CFTR-3849-565 | - | AAAUGGUGAGUAAGACACCCUGAA | 24 | 3908 |
| CFTR-3849-566 | - | UGUUUCAUUAAUAAUUAA | 18 | 3909 |
| CFTR-3849-567 | - | AUGUUUCAUUAAUAAUUAA | 19 | 3910 |
| CFTR-3849-568 | - | UAUGUUUCAUUAAUAAUUAA | 20 | 3911 |
| CFTR-3849-569 | - | CUAUGUUUCAUUAAUAAUUAA | 21 | 3912 |
| CFTR-3849-570 | - | ACUAUGUUUCAUUAAUAAUUAA | 22 | 3913 |
| CFTR-3849-571 | - | UACUAUGUUUCAUUAAUAAUUAA | 23 | 3914 |
| CFTR-3849-572 | - | AUACUAUGUUUCAUUAAUAAUUAA | 24 | 3915 |
| CFTR-3849-573 | - | UCUCAGGGAGGAGGUGCA | 18 | 3916 |
| CFTR-3849-574 | - | UUCUCAGGGAGGAGGUGCA | 19 | 3917 |
| CFTR-3849-575 | - | AUUCUCAGGGAGGAGGUGCA | 20 | 3918 |
| CFTR-3849-576 | - | CAUUCUCAGGGAGGAGGUGCA | 21 | 3919 |
| CFTR-3849-577 | - | ACAUUCUCAGGGAGGAGGUGCA | 22 | 3920 |
| CFTR-3849-578 | - | AACAUUCUCAGGGAGGAGGUGCA | 23 | 3921 |
| CFTR-3849-579 | - | CAACAUUCUCAGGGAGGAGGUGCA | 24 | 3922 |
| CFTR-3849-580 | - | GCCUUAUUCAACAGAUCA | 18 | 3923 |
| CFTR-3849-581 | - | AGCCUUAUUCAACAGAUCA | 19 | 3924 |
| CFTR-3849-582 | - | UAGCCUUAUUCAACAGAUCA | 20 | 3925 |
| CFTR-3849-583 | - | CUAGCCUUAUUCAACAGAUCA | 21 | 3926 |
| CFTR-3849-584 | - | UCUAGCCUUAUUCAACAGAUCA | 22 | 3927 |
| CFTR-3849-585 | - | CUCUAGCCUUAUUCAACAGAUCA | 23 | 3928 |
| CFTR-3849-586 | - | ACUCUAGCCUUAUUCAACAGAUCA | 24 | 3929 |
| CFTR-3849-587 | - | CUUGAUCCAACAUUCUCA | 18 | 3930 |
| CFTR-3849-588 | - | UCUUGAUCCAACAUUCUCA | 19 | 3931 |
| CFTR-3849-52 | - | AUCUUGAUCCAACAUUCUCA | 20 | 3395 |
| CFTR-3849-589 | - | UAUCUUGAUCCAACAUUCUCA | 21 | 3932 |
| CFTR-3849-590 | - | UUAUCUUGAUCCAACAUUCUCA | 22 | 3933 |

TABLE 35D-continued

| | | 4th Tier | | |
|---|---|---|---|---|
| gRNA Name | DNA Strand | Targeting Domain | Target Site Length | Seq ID |
| CFTR-3849-591 | - | UUUAUCUUGAUCCAACAUUCUCA | 23 | 3934 |
| CFTR-3849-592 | - | AUUUAUCUUGAUCCAACAUUCUCA | 24 | 3935 |
| CFTR-3849-593 | - | GUGAGUAAGACACCCUGA | 18 | 3936 |
| CFTR-3849-594 | - | GGUGAGUAAGACACCCUGA | 19 | 3937 |
| CFTR-3849-595 | - | UGGUGAGUAAGACACCCUGA | 20 | 3938 |
| CFTR-3849-596 | - | AUGGUGAGUAAGACACCCUGA | 21 | 3939 |
| CFTR-3849-597 | - | AAUGGUGAGUAAGACACCCUGA | 22 | 3940 |
| CFTR-3849-598 | - | AAAUGGUGAGUAAGACACCCUGA | 23 | 3941 |
| CFTR-3849-599 | - | AAAAUGGUGAGUAAGACACCCUGA | 24 | 3942 |
| CFTR-3849-600 | - | UGUAGUCUCUUGAAAAUA | 18 | 3943 |
| CFTR-3849-601 | - | UUGUAGUCUCUUGAAAAUA | 19 | 3944 |
| CFTR-3849-602 | - | UUUGUAGUCUCUUGAAAAUA | 20 | 3945 |
| CFTR-3849-603 | - | AUUUGUAGUCUCUUGAAAAUA | 21 | 3946 |
| CFTR-3849-604 | - | CAUUUGUAGUCUCUUGAAAAUA | 22 | 3947 |
| CFTR-3849-605 | - | CCAUUUGUAGUCUCUUGAAAAUA | 23 | 3948 |
| CFTR-3849-606 | - | UCCAUUUGUAGUCUCUUGAAAAUA | 24 | 3949 |
| CFTR-3849-607 | - | CAGCAGUUCAAUGAUAUA | 18 | 3950 |
| CFTR-3849-608 | - | CCAGCAGUUCAAUGAUAUA | 19 | 3951 |
| CFTR-3849-56 | - | ACCAGCAGUUCAAUGAUAUA | 20 | 3399 |
| CFTR-3849-609 | - | UACCAGCAGUUCAAUGAUAUA | 21 | 3952 |
| CFTR-3849-610 | - | UUACCAGCAGUUCAAUGAUAUA | 22 | 3953 |
| CFTR-3849-611 | - | AUUACCAGCAGUUCAAUGAUAUA | 23 | 3954 |
| CFTR-3849-612 | - | CAUUACCAGCAGUUCAAUGAUAUA | 24 | 3955 |
| CFTR-3849-613 | - | UCUGGAGACCACAAGGUA | 18 | 3956 |
| CFTR-3849-614 | - | UUCUGGAGACCACAAGGUA | 19 | 3957 |
| CFTR-3849-615 | - | UUUCUGGAGACCACAAGGUA | 20 | 3958 |
| CFTR-3849-616 | - | AUUUCUGGAGACCACAAGGUA | 21 | 3959 |
| CFTR-3849-617 | - | GAUUUCUGGAGACCACAAGGUA | 22 | 3960 |
| CFTR-3849-618 | - | UGAUUUCUGGAGACCACAAGGUA | 23 | 3961 |
| CFTR-3849-619 | - | UUGAUUUCUGGAGACCACAAGGUA | 24 | 3962 |
| CFTR-3849-620 | - | UGUGCCAGUUAUAUAAAC | 18 | 3963 |
| CFTR-3849-621 | - | AUGUGCCAGUUAUAUAAAC | 19 | 3964 |
| CFTR-3849-622 | - | UAUGUGCCAGUUAUAUAAAC | 20 | 3965 |
| CFTR-3849-623 | - | UUAUGUGCCAGUUAUAUAAAC | 21 | 3966 |
| CFTR-3849-624 | - | AUUAUGUGCCAGUUAUAUAAAC | 22 | 3967 |
| CFTR-3849-625 | - | UAUUAUGUGCCAGUUAUAUAAAC | 23 | 3968 |
| CFTR-3849-626 | - | UUAUUAUGUGCCAGUUAUAUAAAC | 24 | 3969 |

TABLE 35D-continued

4th Tier

| gRNA Name | DNA Strand | Targeting Domain | Target Site Length | Seq ID |
|---|---|---|---|---|
| CFTR-3849-627 | - | AAUGGUGAGUAAGACACC | 18 | 3970 |
| CFTR-3849-628 | - | AAAUGGUGAGUAAGACACC | 19 | 3971 |
| CFTR-3849-629 | - | AAAAUGGUGAGUAAGACACC | 20 | 3972 |
| CFTR-3849-630 | - | UAAAAUGGUGAGUAAGACACC | 21 | 3973 |
| CFTR-3849-631 | - | UUAAAAUGGUGAGUAAGACACC | 22 | 3974 |
| CFTR-3849-632 | - | AUUAAAAUGGUGAGUAAGACACC | 23 | 3975 |
| CFTR-3849-633 | - | UAUUAAAAUGGUGAGUAAGACACC | 24 | 3976 |
| CFTR-3849-634 | - | ACAGAUCACUGAGAAGCC | 18 | 3977 |
| CFTR-3849-635 | - | AACAGAUCACUGAGAAGCC | 19 | 3978 |
| CFTR-3849-61 | - | CAACAGAUCACUGAGAAGCC | 20 | 3404 |
| CFTR-3849-636 | - | UCAACAGAUCACUGAGAAGCC | 21 | 3979 |
| CFTR-3849-637 | - | UUCAACAGAUCACUGAGAAGCC | 22 | 3980 |
| CFTR-3849-638 | - | AUUCAACAGAUCACUGAGAAGCC | 23 | 3981 |
| CFTR-3849-639 | - | UAUUCAACAGAUCACUGAGAAGCC | 24 | 3982 |
| CFTR-3849-640 | - | GCCUGGAAAAACAAAUCC | 18 | 3983 |
| CFTR-3849-641 | - | AGCCUGGAAAAACAAAUCC | 19 | 3984 |
| CFTR-3849-62 | - | AAGCCUGGAAAAACAAAUCC | 20 | 3405 |
| CFTR-3849-642 | - | GAAGCCUGGAAAAACAAAUCC | 21 | 3985 |
| CFTR-3849-643 | - | AGAAGCCUGGAAAAACAAAUCC | 22 | 3986 |
| CFTR-3849-644 | - | GAGAAGCCUGGAAAAACAAAUCC | 23 | 3987 |
| CFTR-3849-645 | - | UGAGAAGCCUGGAAAAACAAAUCC | 24 | 3988 |
| CFTR-3849-646 | - | AACAGAUCACUGAGAAGC | 18 | 3989 |
| CFTR-3849-647 | - | CAACAGAUCACUGAGAAGC | 19 | 3990 |
| CFTR-3849-648 | - | UCAACAGAUCACUGAGAAGC | 20 | 3991 |
| CFTR-3849-649 | - | UUCAACAGAUCACUGAGAAGC | 21 | 3992 |
| CFTR-3849-650 | - | AUUCAACAGAUCACUGAGAAGC | 22 | 3993 |
| CFTR-3849-651 | - | UAUUCAACAGAUCACUGAGAAGC | 23 | 3994 |
| CFTR-3849-652 | - | UUAUUCAACAGAUCACUGAGAAGC | 24 | 3995 |
| CFTR-3849-653 | - | UCUUAAAAGCUUAUUUGC | 18 | 3996 |
| CFTR-3849-654 | - | GUCUUAAAAGCUUAUUUGC | 19 | 3997 |
| CFTR-3849-65 | - | UGUCUUAAAAGCUUAUUUGC | 20 | 3408 |
| CFTR-3849-655 | - | AUGUCUUAAAAGCUUAUUUGC | 21 | 3998 |
| CFTR-3849-656 | - | UAUGUCUUAAAAGCUUAUUUGC | 22 | 3999 |
| CFTR-3849-657 | - | GUAUGUCUUAAAAGCUUAUUUGC | 23 | 4000 |
| CFTR-3849-658 | - | GGUAUGUCUUAAAAGCUUAUUUGC | 24 | 4001 |
| CFTR-3849-659 | - | AGCCUGGAAAAACAAAUC | 18 | 4002 |
| CFTR-3849-660 | - | AAGCCUGGAAAAACAAAUC | 19 | 4003 |
| CFTR-3849-661 | - | GAAGCCUGGAAAAACAAAUC | 20 | 4004 |

TABLE 35D-continued

| | 4th Tier | | |
|---|---|---|---|
| gRNA Name | DNA Strand | Targeting Domain | Target Site Length | Seq ID |
| CFTR-3849-662 | - | AGAAGCCUGGAAAAACAAAUC | 21 | 4005 |
| CFTR-3849-663 | - | GAGAAGCCUGGAAAAACAAAUC | 22 | 4006 |
| CFTR-3849-664 | - | UGAGAAGCCUGGAAAAACAAAUC | 23 | 4007 |
| CFTR-3849-665 | - | CUGAGAAGCCUGGAAAAACAAAUC | 24 | 4008 |
| CFTR-3849-666 | - | UUCUCCAUUUGUAGUCUC | 18 | 4009 |
| CFTR-3849-667 | - | UUUCUCCAUUUGUAGUCUC | 19 | 4010 |
| CFTR-3849-668 | - | CUUUCUCCAUUUGUAGUCUC | 20 | 4011 |
| CFTR-3849-669 | - | GCUUUCUCCAUUUGUAGUCUC | 21 | 4012 |
| CFTR-3849-670 | - | UGCUUUCUCCAUUUGUAGUCUC | 22 | 4013 |
| CFTR-3849-671 | - | CUGCUUUCUCCAUUUGUAGUCUC | 23 | 4014 |
| CFTR-3849-672 | - | ACUGCUUUCUCCAUUUGUAGUCUC | 24 | 4015 |
| CFTR-3849-673 | - | UCUUGAUCCAACAUUCUC | 18 | 4016 |
| CFTR-3849-674 | - | AUCUUGAUCCAACAUUCUC | 19 | 4017 |
| CFTR-3849-67 | - | UAUCUUGAUCCAACAUUCUC | 20 | 3410 |
| CFTR-3849-675 | - | UUAUCUUGAUCCAACAUUCUC | 21 | 4018 |
| CFTR-3849-676 | - | UUUAUCUUGAUCCAACAUUCUC | 22 | 4019 |
| CFTR-3849-677 | - | AUUUAUCUUGAUCCAACAUUCUC | 23 | 4020 |
| CFTR-3849-678 | - | GAUUUAUCUUGAUCCAACAUUCUC | 24 | 4021 |
| CFTR-3849-679 | - | ACUUGUCAUCUUGAUUUC | 18 | 4022 |
| CFTR-3849-680 | - | GACUUGUCAUCUUGAUUUC | 19 | 4023 |
| CFTR-3849-68 | - | UGACUUGUCAUCUUGAUUUC | 20 | 3411 |
| CFTR-3849-681 | - | UUGACUUGUCAUCUUGAUUUC | 21 | 4024 |
| CFTR-3849-682 | - | GUUGACUUGUCAUCUUGAUUUC | 22 | 4025 |
| CFTR-3849-683 | - | AGUUGACUUGUCAUCUUGAUUUC | 23 | 4026 |
| CFTR-3849-684 | - | CAGUUGACUUGUCAUCUUGAUUUC | 24 | 4027 |
| CFTR-3849-685 | - | UUUUUUUCUGAAGAAAG | 18 | 4028 |
| CFTR-3849-686 | - | AUUUUUUUCUGAAGAAAG | 19 | 4029 |
| CFTR-3849-115 | - | UAUUUUUUUCUGAAGAAAG | 20 | 3458 |
| CFTR-3849-687 | - | GUAUUUUUUUCUGAAGAAAG | 21 | 4030 |
| CFTR-3849-688 | - | AGUAUUUUUUUCUGAAGAAAG | 22 | 4031 |
| CFTR-3849-689 | - | UAGUAUUUUUUUCUGAAGAAAG | 23 | 4032 |
| CFTR-3849-690 | - | UUAGUAUUUUUUUCUGAAGAAAG | 24 | 4033 |
| CFTR-3849-691 | - | UGAUCCAACAUUCUCAGG | 18 | 4034 |
| CFTR-3849-692 | - | UUGAUCCAACAUUCUCAGG | 19 | 4035 |
| CFTR-3849-693 | - | CUUGAUCCAACAUUCUCAGG | 20 | 4036 |
| CFTR-3849-694 | - | UCUUGAUCCAACAUUCUCAGG | 21 | 4037 |
| CFTR-3849-695 | - | AUCUUGAUCCAACAUUCUCAGG | 22 | 4038 |

TABLE 35D-continued

4th Tier

| gRNA Name | DNA Strand | Targeting Domain | Target Site Length | Seq ID |
|---|---|---|---|---|
| CFTR-3849-696 | - | UAUCUUGAUCCAACAUUCUCAGG | 23 | 4039 |
| CFTR-3849-697 | - | UUAUCUUGAUCCAACAUUCUCAGG | 24 | 4040 |
| CFTR-3849-698 | - | GAUCCAACAUUCUCAGGG | 18 | 4041 |
| CFTR-3849-699 | - | UGAUCCAACAUUCUCAGGG | 19 | 4042 |
| CFTR-3849-74 | - | UUGAUCCAACAUUCUCAGGG | 20 | 3417 |
| CFTR-3849-700 | - | CUUGAUCCAACAUUCUCAGGG | 21 | 4043 |
| CFTR-3849-701 | - | UCUUGAUCCAACAUUCUCAGGG | 22 | 4044 |
| CFTR-3849-702 | - | AUCUUGAUCCAACAUUCUCAGGG | 23 | 4045 |
| CFTR-3849-703 | - | UAUCUUGAUCCAACAUUCUCAGGG | 24 | 4046 |
| CFTR-3849-704 | - | UAAGGUCUAUACUUUUGG | 18 | 4047 |
| CFTR-3849-705 | - | UUAAGGUCUAUACUUUUGG | 19 | 4048 |
| CFTR-3849-706 | - | UUUAAGGUCUAUACUUUUGG | 20 | 4049 |
| CFTR-3849-707 | - | CUUUAAGGUCUAUACUUUUGG | 21 | 4050 |
| CFTR-3849-708 | - | ACUUUAAGGUCUAUACUUUUGG | 22 | 4051 |
| CFTR-3849-709 | - | UACUUUAAGGUCUAUACUUUUGG | 23 | 4052 |
| CFTR-3849-710 | - | GUACUUUAAGGUCUAUACUUUUGG | 24 | 4053 |
| CFTR-3849-711 | - | UUUUAGUAUUUUUUUCUG | 18 | 4054 |
| CFTR-3849-712 | - | AUUUUAGUAUUUUUUUCUG | 19 | 4055 |
| CFTR-3849-713 | - | AAUUUUAGUAUUUUUUUCUG | 20 | 4056 |
| CFTR-3849-714 | - | AAAUUUUAGUAUUUUUUUCUG | 21 | 4057 |
| CFTR-3849-715 | - | AAAAUUUUAGUAUUUUUUUCUG | 22 | 4058 |
| CFTR-3849-716 | - | AAAAAUUUUAGUAUUUUUUUCUG | 23 | 4059 |
| CFTR-3849-717 | - | UAAAAAUUUUAGUAUUUUUUUCUG | 24 | 4060 |
| CFTR-3849-718 | - | GUCUUAAAAGCUUAUUUG | 18 | 4061 |
| CFTR-3849-719 | - | UGUCUUAAAAGCUUAUUUG | 19 | 4062 |
| CFTR-3849-76 | - | AUGUCUUAAAAGCUUAUUUG | 20 | 3419 |
| CFTR-3849-720 | - | UAUGUCUUAAAAGCUUAUUUG | 21 | 4063 |
| CFTR-3849-721 | - | GUAUGUCUUAAAAGCUUAUUUG | 22 | 4064 |
| CFTR-3849-722 | - | GGUAUGUCUUAAAAGCUUAUUUG | 23 | 4065 |
| CFTR-3849-723 | - | GGGUAUGUCUUAAAAGCUUAUUUG | 24 | 4066 |
| CFTR-3849-724 | - | AAUAAUUAAUAGAGAUAU | 18 | 4067 |
| CFTR-3849-725 | - | UAAUAAUUAAUAGAGAUAU | 19 | 4068 |
| CFTR-3849-726 | - | UUAAUAAUUAAUAGAGAUAU | 20 | 4069 |
| CFTR-3849-727 | - | AUUAAUAAUUAAUAGAGAUAU | 21 | 4070 |
| CFTR-3849-728 | - | CAUUAAUAAUUAAUAGAGAUAU | 22 | 4071 |
| CFTR-3849-729 | - | UCAUUAAUAAUUAAUAGAGAUAU | 23 | 4072 |
| CFTR-3849-730 | - | UUCAUUAAUAAUUAAUAGAGAUAU | 24 | 4073 |
| CFTR-3849-731 | - | CCAGCAGUUCAAUGAUAU | 18 | 4074 |

TABLE 35D-continued

| | | 4th Tier | | |
|---|---|---|---|---|
| gRNA Name | DNA Strand | Targeting Domain | Target Site Length | Seq ID |
| CFTR-3849-732 | - | ACCAGCAGUUCAAUGAUAU | 19 | 4075 |
| CFTR-3849-733 | - | UACCAGCAGUUCAAUGAUAU | 20 | 4076 |
| CFTR-3849-734 | - | UUACCAGCAGUUCAAUGAUAU | 21 | 4077 |
| CFTR-3849-735 | - | AUUACCAGCAGUUCAAUGAUAU | 22 | 4078 |
| CFTR-3849-736 | - | CAUUACCAGCAGUUCAAUGAUAU | 23 | 4079 |
| CFTR-3849-737 | - | GCAUUACCAGCAGUUCAAUGAUAU | 24 | 4080 |
| CFTR-3849-738 | - | GAGGUGCAUUGAAGUUAU | 18 | 4081 |
| CFTR-3849-739 | - | GGAGGUGCAUUGAAGUUAU | 19 | 4082 |
| CFTR-3849-740 | - | AGGAGGUGCAUUGAAGUUAU | 20 | 4083 |
| CFTR-3849-741 | - | GAGGAGGUGCAUUGAAGUUAU | 21 | 4084 |
| CFTR-3849-742 | - | GGAGGAGGUGCAUUGAAGUUAU | 22 | 4085 |
| CFTR-3849-743 | - | GGGAGGAGGUGCAUUGAAGUUAU | 23 | 4086 |
| CFTR-3849-744 | - | AGGGAGGAGGUGCAUUGAAGUUAU | 24 | 4087 |
| CFTR-3849-745 | - | CUUAUUCAACAGAUCACU | 18 | 4088 |
| CFTR-3849-746 | - | CCUUAUUCAACAGAUCACU | 19 | 4089 |
| CFTR-3849-747 | - | GCCUUAUUCAACAGAUCACU | 20 | 4090 |
| CFTR-3849-748 | - | AGCCUUAUUCAACAGAUCACU | 21 | 4091 |
| CFTR-3849-749 | - | UAGCCUUAUUCAACAGAUCACU | 22 | 4092 |
| CFTR-3849-750 | - | CUAGCCUUAUUCAACAGAUCACU | 23 | 4093 |
| CFTR-3849-751 | - | UCUAGCCUUAUUCAACAGAUCACU | 24 | 4094 |
| CFTR-3849-752 | - | ACCAGUGAUUCCUUGCCU | 18 | 4095 |
| CFTR-3849-753 | - | AACCAGUGAUUCCUUGCCU | 19 | 4096 |
| CFTR-3849-754 | - | AAACCAGUGAUUCCUUGCCU | 20 | 4097 |
| CFTR-3849-755 | - | CAAACCAGUGAUUCCUUGCCU | 21 | 4098 |
| CFTR-3849-756 | - | ACAAACCAGUGAUUCCUUGCCU | 22 | 4099 |
| CFTR-3849-757 | - | UACAAACCAGUGAUUCCUUGCCU | 23 | 4100 |
| CFTR-3849-758 | - | GUACAAACCAGUGAUUCCUUGCCU | 24 | 4101 |
| CFTR-3849-759 | - | AUCUUGAUCCAACAUUCU | 18 | 4102 |
| CFTR-3849-760 | - | UAUCUUGAUCCAACAUUCU | 19 | 4103 |
| CFTR-3849-761 | - | UUAUCUUGAUCCAACAUUCU | 20 | 4104 |
| CFTR-3849-762 | - | UUUAUCUUGAUCCAACAUUCU | 21 | 4105 |
| CFTR-3849-763 | - | AUUUAUCUUGAUCCAACAUUCU | 22 | 4106 |
| CFTR-3849-764 | - | GAUUUAUCUUGAUCCAACAUUCU | 23 | 4107 |
| CFTR-3849-765 | - | UGAUUUAUCUUGAUCCAACAUUCU | 24 | 4108 |
| CFTR-3849-766 | - | UUGAAAAUACAGAAAUUU | 18 | 4109 |
| CFTR-3849-767 | - | CUUGAAAAUACAGAAAUUU | 19 | 4110 |
| CFTR-3849-768 | - | UCUUGAAAAUACAGAAAUUU | 20 | 4111 |

TABLE 35D-continued

4th Tier

| gRNA Name | DNA Strand | Targeting Domain | Target Site Length | Seq ID |
|---|---|---|---|---|
| CFTR-3849-769 | - | CUCUUGAAAAUACAGAAAUUU | 21 | 4112 |
| CFTR-3849-770 | - | UCUCUUGAAAAUACAGAAAUUU | 22 | 4113 |
| CFTR-3849-771 | - | GUCUCUUGAAAAUACAGAAAUUU | 23 | 4114 |
| CFTR-3849-772 | - | AGUCUCUUGAAAAUACAGAAAUUU | 24 | 4115 |
| CFTR-3849-773 | - | GACUUGUCAUCUUGAUUU | 18 | 4116 |
| CFTR-3849-774 | - | UGACUUGUCAUCUUGAUUU | 19 | 4117 |
| CFTR-3849-775 | - | UUGACUUGUCAUCUUGAUUU | 20 | 4118 |
| CFTR-3849-776 | - | GUUGACUUGUCAUCUUGAUUU | 21 | 4119 |
| CFTR-3849-777 | - | AGUUGACUUGUCAUCUUGAUUU | 22 | 4120 |
| CFTR-3849-778 | - | CAGUUGACUUGUCAUCUUGAUUU | 23 | 4121 |
| CFTR-3849-779 | - | UCAGUUGACUUGUCAUCUUGAUUU | 24 | 4122 |
| CFTR-3849-780 | - | UGUCUUAAAAGCUUAUUU | 18 | 4123 |
| CFTR-3849-781 | - | AUGUCUUAAAAGCUUAUUU | 19 | 4124 |
| CFTR-3849-782 | - | UAUGUCUUAAAAGCUUAUUU | 20 | 4125 |
| CFTR-3849-783 | - | GUAUGUCUUAAAAGCUUAUUU | 21 | 4126 |
| CFTR-3849-784 | - | GGUAUGUCUUAAAAGCUUAUUU | 22 | 4127 |
| CFTR-3849-785 | - | GGGUAUGUCUUAAAAGCUUAUUU | 23 | 4128 |
| CFTR-3849-786 | - | AGGGUAUGUCUUAAAAGCUUAUUU | 24 | 4129 |
| CFTR-3849-787 | - | AAAUUUUAGUAUUUUUUU | 18 | 4130 |
| CFTR-3849-788 | - | AAAAUUUUAGUAUUUUUUU | 19 | 4131 |
| CFTR-3849-789 | - | AAAAAUUUUAGUAUUUUUUU | 20 | 4132 |
| CFTR-3849-790 | - | UAAAAAUUUUAGUAUUUUUUU | 21 | 4133 |
| CFTR-3849-791 | - | CUAAAAAUUUUAGUAUUUUUUU | 22 | 4134 |
| CFTR-3849-792 | - | UCUAAAAAUUUUAGUAUUUUUUU | 23 | 4135 |
| CFTR-3849-793 | - | CUCUAAAAAUUUUAGUAUUUUUUU | 24 | 4136 |

Table 36A provides exemplary targeting domains for correcting a mutation (e.g., 3849+10 kbC→T) in the CFTR gene selected according to the first tier parameters. The targeting domains bind within 500 bp from a mutation (e.g., 3849+10 kbC→T), have a high level of orthogonality and start with a 5'G. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 36A

1st Tier

| gRNA Name | DNA Strand | Targeting Domain | Target Site Length | Seq ID |
|---|---|---|---|---|
| CFTR-3849-794 | + | GAGGAAUUUUGAUUAAG | 17 | 4137 |
| CFTR-3849-795 | - | GAGAUAUAUGAACACAU | 17 | 4138 |
| CFTR-3849-796 | - | GAUUUAGGGUAUGUCUU | 17 | 4139 |
| CFTR-3849-797 | + | GGCUAGAGUACUUCCCGCAA | 20 | 4140 |

TABLE 36A-continued

1st Tier

| gRNA Name | DNA Strand | Targeting Domain | Target Site Length | Seq ID |
|---|---|---|---|---|
| CFTR-3849-798 | + | GAAACAUAGUAUUGAGAAUA | 20 | 4141 |
| CFTR-3849-799 | − | GUUUAACUUUCAACAUAUUA | 20 | 4142 |
| CFTR-3849-800 | + | GGCAAUUUGUAAAUCUUUGG | 20 | 4143 |
| CFTR-3849-801 | + | GUAUUUAGGUGUUUGUGCUG | 20 | 4144 |
| CFTR-3849-802 | − | GCACAAACACCUAAAUACUU | 20 | 4145 |

Table 36B provides exemplary targeting domains for correcting a mutation (e.g., 3849+10 kbC→T) in the CFTR gene selected according to the second tier parameters. The targeting domains bind within 500 bp from a mutation (e.g., 3849+10 kbC→T) and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 36B

2nd Tier

| gRNA Name | DNA Strand | Targeting Domain | Target Site Length | Seq ID |
|---|---|---|---|---|
| CFTR-3849-803 | + | UAGAGUACUUCCCGCAA | 17 | 4146 |
| CFTR-3849-804 | + | AUAUACCAUAUGAGGAA | 17 | 4147 |
| CFTR-3849-13 | + | UGAAAUUUAGAUCCACA | 17 | 3356 |
| CFTR-3849-805 | − | UUUCAGUUGACUUGUCA | 17 | 4148 |
| CFTR-3849-806 | + | ACAUAGUAUUGAGAAUA | 17 | 4149 |
| CFTR-3849-807 | − | UAACUUUCAACAUAUUA | 17 | 4150 |
| CFTR-3849-808 | − | CUUUGUUGGGUACAAAC | 17 | 4151 |
| CFTR-3849-809 | − | AACCUUUAAAGCUAAAC | 17 | 4152 |
| CFTR-3849-810 | − | CACAGUACUGGAUAGUC | 17 | 4153 |
| CFTR-3849-811 | + | AAUUUGUAAAUCUUUGG | 17 | 4154 |
| CFTR-3849-812 | + | UUUAGGUGUUUGUGCUG | 17 | 4155 |
| CFTR-3849-813 | − | UACUUUUGGAUGAACUU | 17 | 4156 |
| CFTR-3849-814 | + | CACAUAAUAAUUAGUUU | 17 | 4157 |
| CFTR-3849-815 | + | ACAAUAUACCAUAUGAGGAA | 20 | 4158 |
| CFTR-3849-112 | + | AACUGAAAUUUAGAUCCACA | 20 | 3455 |
| CFTR-3849-816 | − | AAAUUUCAGUUGACUUGUCA | 20 | 4159 |
| CFTR-3849-817 | − | AGACUUUGUUGGGUACAAAC | 20 | 4160 |
| CFTR-3849-818 | − | UAAAACCUUUAAAGCUAAAC | 20 | 4161 |
| CFTR-3849-819 | − | UAUCACAGUACUGGAUAGUC | 20 | 4162 |
| CFTR-3849-820 | + | UAUGAGGAAUUUUGAUUAAG | 20 | 4163 |
| CFTR-3849-821 | − | AUAGAGAUAUAUGAACACAU | 20 | 4164 |
| CFTR-3849-822 | + | AUAUGCUGCUUAUACCCACU | 20 | 4165 |
| CFTR-3849-823 | − | CUAUACUUUUGGAUGAACUU | 20 | 4166 |

TABLE 36B-continued

| | 2nd Tier | | | |
|---|---|---|---|---|
| gRNA Name | DNA Strand | Targeting Domain | Target Site Length | Seq ID |
| CFTR-3849-824 | − | UUAGAUUUAGGGUAUGUCUU | 20 | 4167 |
| CFTR-3849-529 | + | UGGCACAUAAUAAUUAGUUU | 20 | 3872 |

Table 36C provides exemplary targeting domains for correcting a mutation (e.g., 3849+10 kbC→T) in the CFTR gene selected according to the third tier parameters. The targeting domains bind within 500 bp from a mutation (e.g., 3849+10 kbC→T) and start with a 5'G. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 36C

| | 3rd Tier | | | |
|---|---|---|---|---|
| gRNA Name | DNA Strand | Targeting Domain | Target Site Length | Seq ID |
| CFTR-3849-825 | − | GAAAUAAUUUAUAAGAAUAU | 20 | 4168 |

Table 36D provides exemplary targeting domains for correcting a mutation (e.g., 3849+10 kbC→T) in the CFTR gene selected according to the fourth tier parameters. The targeting domains bind within 500 bp from a mutation (e.g., 3849+10 kbC→T). It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 36D

| | 4th Tier | | | |
|---|---|---|---|---|
| gRNA Name | DNA Strand | Targeting Domain | Target Site Length | Seq ID |
| CFTR-3849-826 | − | UUAUUAGAAAACACUGA | 17 | 4169 |
| CFTR-3849-827 | − | AUAAUUUAUAAGAAUAU | 17 | 4170 |
| CFTR-3849-828 | + | UGCUGCUUAUACCCACU | 17 | 4171 |
| CFTR-3849-829 | − | CAAACACCUAAAUACUU | 17 | 4172 |
| CFTR-3849-830 | + | UUCCGGGAUUUGUUUU | 17 | 4173 |
| CFTR-3849-831 | − | AAGUUAUUAGAAAACACUGA | 20 | 4174 |
| CFTR-3849-832 | + | AGUUUCCGGGAUUUGUUUUU | 20 | 4175 |

Table 37A provides exemplary targeting domains for correcting a mutation (e.g., 3272-26→G) in the CFTR gene selected according to the first tier parameters. The targeting domains bind within intron 2, have a high level of orthogonality and start with a 5'G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 37A

1st Tier

| gRNA Name | DNA Strand | Targeting Domain | Target Site Length | Seq ID |
|---|---|---|---|---|
| CFTR-Intron2-1 | + | GUACAAAGUACCAAAAA | 17 | 15101 |
| CFTR-Intron2-2 | − | GCCUGAUGCCAGAUAAA | 17 | 15102 |
| CFTR-Intron2-3 | + | GGUAAACAAUUAGACAA | 17 | 15103 |
| CFTR-Intron2-4 | + | GACUAUGAGUGGCCCAA | 17 | 15104 |
| CFTR-Intron2-5 | − | GCCUUGCUCUCUAGGAA | 17 | 15105 |
| CFTR-Intron2-6 | + | GCUCUAAAUCACUCUAA | 17 | 15106 |
| CFTR-Intron2-7 | − | GGGAAGUCUUAAGGUAA | 17 | 15107 |
| CFTR-Intron2-8 | + | GUUACCAUAAGUAAACA | 17 | 15108 |
| CFTR-Intron2-9 | + | GCAAAGAGUUCUAACCA | 17 | 15109 |
| CFTR-Intron2-10 | − | GGAACUCAAUGGGACCA | 17 | 15110 |
| CFTR-Intron2-11 | − | GCUCAAUUUGUGACCA | 17 | 15111 |
| CFTR-Intron2-12 | + | GCCAGGGUCACUUCCCA | 17 | 15112 |
| CFTR-Intron2-13 | + | GUAGAGGAUUCAAUCCA | 17 | 15113 |
| CFTR-Intron2-14 | + | GACCUCAGCUGGAAUCA | 17 | 15114 |
| CFTR-Intron2-15 | + | GUAGUUACCUGAGGAGA | 17 | 15115 |
| CFTR-Intron2-16 | − | GGAGAAGCAUGUGGGGA | 17 | 15116 |
| CFTR-Intron2-17 | + | GUCCCAUUGAGUUCCUA | 17 | 15117 |
| CFTR-Intron2-18 | − | GCAAAUGCCAUGAGGUA | 17 | 15118 |
| CFTR-Intron2-19 | + | GAGGUCUCUAGUGACCC | 17 | 15119 |
| CFTR-Intron2-20 | + | GCAAUACAGACCUCAGC | 17 | 15120 |
| CFTR-Intron2-21 | − | GAAACCUGUAGCAUUGC | 17 | 15121 |
| CFTR-Intron2-22 | + | GAUUCAUGUUCUCUAUC | 17 | 15122 |
| CFTR-Intron2-23 | − | GAAUUUGCAGAAUUAUC | 17 | 15123 |
| CFTR-Intron2-24 | − | GACCUUGCCUUCUCCUC | 17 | 15124 |
| CFTR-Intron2-25 | − | GUUCCAAGAUUGUAGUC | 17 | 15125 |
| CFTR-Intron2-26 | + | GGUUCAAUGUGAAAAAG | 17 | 15126 |
| CFTR-Intron2-27 | + | GUAAUAGGCCGGGGCAG | 17 | 15127 |
| CFTR-Intron2-28 | + | GCUUUACGUUUCAUCAG | 17 | 15128 |
| CFTR-Intron2-29 | + | GAGAGAUUCUUUAUGGG | 17 | 15129 |
| CFTR-Intron2-30 | − | GAUCUGGGCCUGGUAUG | 17 | 15130 |
| CFTR-Intron2-31 | − | GGCCUUAGGAACUCAAU | 17 | 15131 |
| CFTR-Intron2-32 | − | GGUAACUUGACAGUAAU | 17 | 15132 |
| CFTR-Intron2-33 | + | GAUCCUAACCUUUUGAU | 17 | 15133 |
| CFTR-Intron2-34 | + | GUGAAACUUGAACAACU | 17 | 15134 |
| CFTR-Intron2-35 | − | GAACUAUGUGAAGACCU | 17 | 15135 |
| CFTR-Intron2-36 | + | GGUGGCAUUUGAGUCCU | 17 | 15136 |
| CFTR-Intron2-37 | − | GUAUUGCCUUGCUCUCU | 17 | 15137 |
| CFTR-Intron2-38 | − | GAAUGAUUAAUCAGAGU | 17 | 15138 |

TABLE 37A-continued

| | | 1st Tier | | |
|---|---|---|---|---|
| gRNA Name | DNA Strand | Targeting Domain | Target Site Length | Seq ID |
| CFTR-Intron2-39 | + | GGUGAUGUGGUUCUAGU | 17 | 15139 |
| CFTR-Intron2-40 | - | GGUGGAGAACUGGCCUU | 17 | 15140 |
| CFTR-Intron2-41 | - | GAGUGACAUACCAUUUU | 17 | 15141 |
| CFTR-Intron2-42 | + | GCCUUCAAAAUGCCAAAAAA | 20 | 15142 |
| CFTR-Intron2-43 | + | GAGGUACAAAGUACCAAAAA | 20 | 15143 |
| CFTR-Intron2-44 | + | GUGUACAUAAACCAACAAAA | 20 | 15144 |
| CFTR-Intron2-45 | - | GGUAAUUAGGCUUUAUAGAA | 20 | 15145 |
| CFTR-Intron2-46 | + | GCAAUGUAGUUUUAGGAACA | 20 | 15146 |
| CFTR-Intron2-47 | + | GGAGCAAAGAGUUCUAACCA | 20 | 15147 |
| CFTR-Intron2-48 | + | GAAGCCAGGGUCACUUCCCA | 20 | 15148 |
| CFTR-Intron2-49 | + | GGAUUUUCACAUUUAGCCA | 20 | 15149 |
| CFTR-Intron2-50 | - | GAUUCACACUUCUAAGAUCA | 20 | 15150 |
| CFTR-Intron2-51 | - | GCCCUCAAGUGGUUGCCAGA | 20 | 15151 |
| CFTR-Intron2-52 | + | GGGGUAGUUACCUGAGGAGA | 20 | 15152 |
| CFTR-Intron2-53 | - | GGUGGAGAAGCAUGUGGGGA | 20 | 15153 |
| CFTR-Intron2-54 | - | GAGUAACCAAAUGUUAUGGA | 20 | 15154 |
| CFTR-Intron2-55 | - | GGGAAUGAUUAAUCAGAGUA | 20 | 15155 |
| CFTR-Intron2-56 | - | GUACUCCCUGGGAAGUCUUA | 20 | 15156 |
| CFTR-Intron2-57 | + | GGAAACUGAGAGAUUCUUUA | 20 | 15157 |
| CFTR-Intron2-58 | - | GAGUCUCGUGCCAACAGCAC | 20 | 15158 |
| CFTR-Intron2-59 | + | GUAAAUUGGGUUUCUGUCAC | 20 | 15159 |
| CFTR-Intron2-60 | + | GAAAGUGAAGUAGAGAGACC | 20 | 15160 |
| CFTR-Intron2-61 | - | GCACCCUUGGGAAGUGACCC | 20 | 15161 |
| CFTR-Intron2-62 | - | GCUAACAUUCUCUGCUCUCC | 20 | 15162 |
| CFTR-Intron2-63 | + | GUUAAUGUUCUUCAACCAUC | 20 | 15163 |
| CFTR-Intron2-64 | - | GACCAGCUUUCUACAUAAAG | 20 | 15164 |
| CFTR-Intron2-65 | + | GUGUUGUUAUAUUUCAUAAG | 20 | 15165 |
| CFTR-Intron2-66 | + | GGAGUAAUAGGCCGGGGCAG | 20 | 15166 |
| CFTR-Intron2-67 | + | GUCACUUCCCAAGGGUGCAG | 20 | 15167 |
| CFTR-Intron2-68 | - | GAUAAAGGGUGAGUGAAGG | 20 | 15168 |
| CFTR-Intron2-69 | - | GAACUAUGUGAAGACCUAGG | 20 | 15169 |
| CFTR-Intron2-70 | - | GUUUACCUAGUUCUUCCUUG | 20 | 15170 |
| CFTR-Intron2-71 | + | GGUCGGGGAAUUUCUUUAAU | 20 | 15171 |
| CFTR-Intron2-72 | + | GUCACAAAAUUGAGCCAGAU | 20 | 15172 |
| CFTR-Intron2-73 | + | GAAACUGAGAGAUUCUUUAU | 20 | 15173 |
| CFTR-Intron2-74 | - | GAGUCAUAGUGCUUACCCCU | 20 | 15174 |
| CFTR-Intron2-75 | - | GCUCUCAUUAGCAAGCUUCU | 20 | 15175 |

TABLE 37A-continued

1st Tier

| gRNA Name | DNA Strand | Targeting Domain | Target Site Length | Seq ID |
|---|---|---|---|---|
| CFTR-Intron2-76 | + | GUAGGUGAUGUGGUUCUAGU | 20 | 15176 |
| CFTR-Intron2-77 | - | GAAGAGUGACAUACCAUUUU | 20 | 15177 |

Table 37B provides exemplary targeting domains for correcting a mutation (e.g., 3272-26→G) in the CFTR gene selected according to the second tier parameters. The targeting domains bind within intron 2 and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 37B

2nd Tier

| gRNA Name | DNA Strand | Targeting Domain | Target Site Length | Seq ID |
|---|---|---|---|---|
| CFTR-Intron2-78 | - | CCUGAUGCCAGAUAAAA | 17 | 15178 |
| CFTR-Intron2-79 | + | AUUUAGCCAAGGACAAA | 17 | 15179 |
| CFTR-Intron2-80 | + | CAUUUAGCCAAGGACAA | 17 | 15180 |
| CFTR-Intron2-81 | + | CCAGGGUCACUUCCCAA | 17 | 15181 |
| CFTR-Intron2-82 | + | UGUCAAUAUACCUGCAA | 17 | 15182 |
| CFTR-Intron2-83 | + | CUCACCUUCUCCAUCAA | 17 | 15183 |
| CFTR-Intron2-84 | - | CACACUUCUAAGAUCAA | 17 | 15184 |
| CFTR-Intron2-85 | - | UGGCCUUAGGAACUCAA | 17 | 15185 |
| CFTR-Intron2-86 | + | CCAGGCCCAGAUCAGAA | 17 | 15186 |
| CFTR-Intron2-87 | - | AAUUAGGCUUUAUAGAA | 17 | 15187 |
| CFTR-Intron2-88 | + | ACGGAAGUAAUGUAGAA | 17 | 15188 |
| CFTR-Intron2-89 | + | UAACCUUUUGAUUGGAA | 17 | 15189 |
| CFTR-Intron2-90 | + | UGACUACAAUCUUGGAA | 17 | 15190 |
| CFTR-Intron2-91 | + | CACGAUUUACUUCAUAA | 17 | 15191 |
| CFTR-Intron2-92 | - | UGGUAACUUGACAGUAA | 17 | 15192 |
| CFTR-Intron2-93 | + | UCGGGGAAUUUCUUUAA | 17 | 15193 |
| CFTR-Intron2-94 | + | AUGUAGUUUUAGGAACA | 17 | 15194 |
| CFTR-Intron2-95 | + | AAAUUUCAUGAACCACA | 17 | 15195 |
| CFTR-Intron2-96 | + | UGAAAAGUGGUCCACA | 17 | 15196 |
| CFTR-Intron2-97 | + | UGAGGGCCAUGGUCACA | 17 | 15197 |
| CFTR-Intron2-98 | - | UAACUGCCUUGUGACCA | 17 | 15198 |
| CFTR-Intron2-99 | + | AGACAUGAGUGGCCCA | 17 | 15199 |
| CFTR-Intron2-100 | - | UAAAACUACAUUGCCCA | 17 | 15200 |
| CFTR-Intron2-101 | + | UACCUUAAGACUUCCCA | 17 | 15201 |
| CFTR-Intron2-102 | + | UUUUUCACAUUUAGCCA | 17 | 15202 |
| CFTR-Intron2-103 | + | CAACCACUUGAGGGCCA | 17 | 15203 |
| CFTR-Intron2-104 | + | CUGGCAAUCUCUAAGCA | 17 | 15204 |
| CFTR-Intron2-105 | + | ACCAUUCCUAGAGAGCA | 17 | 15205 |

TABLE 37B-continued

| | | 2nd Tier | | |
|---|---|---|---|---|
| gRNA Name | DNA Strand | Targeting Domain | Target Site Length | Seq ID |
| CFTR-Intron2-106 | + | UACCUGAGGAGAAGGCA | 17 | 15206 |
| CFTR-Intron2-107 | − | UCACACUUCUAAGAUCA | 17 | 15207 |
| CFTR-Intron2-108 | + | AAAGUAUCCCUACCUCA | 17 | 15208 |
| CFTR-Intron2-109 | + | UCACAAAAUCCAUCUCA | 17 | 15209 |
| CFTR-Intron2-110 | − | UUAAGGACCACGAAAGA | 17 | 15210 |
| CFTR-Intron2-111 | − | CUCAAGUGGUUGCCAGA | 17 | 15211 |
| CFTR-Intron2-112 | + | ACCAGGCCCAGAUCAGA | 17 | 15212 |
| CFTR-Intron2-113 | − | UAAUUAGGCUUUAUAGA | 17 | 15213 |
| CFTR-Intron2-114 | − | UAACCAAAUGUUAUGGA | 17 | 15214 |
| CFTR-Intron2-115 | − | UGCCAGUUAAUGAAUGA | 17 | 15215 |
| CFTR-Intron2-116 | + | AUCUGGCAACCACUUGA | 17 | 15216 |
| CFTR-Intron2-117 | − | UCAUUAGCAAGCUUCUA | 17 | 15217 |
| CFTR-Intron2-118 | − | UCUCAGCUCCUGAAGUA | 17 | 15218 |
| CFTR-Intron2-119 | − | AAUGAUUAAUCAGAGUA | 17 | 15219 |
| CFTR-Intron2-120 | − | AGAGCCAUGUUUACUUA | 17 | 15220 |
| CFTR-Intron2-121 | − | CUCCCUGGGAAGUCUUA | 17 | 15221 |
| CFTR-Intron2-122 | − | UGAGUAACCAAAUGUUA | 17 | 15222 |
| CFTR-Intron2-123 | − | CUUUGCUCCUAUCUUUA | 17 | 15223 |
| CFTR-Intron2-124 | + | AACUGAGAGAUUCUUUA | 17 | 15224 |
| CFTR-Intron2-125 | + | UUAAAUAGUCUGAAAAC | 17 | 15225 |
| CFTR-Intron2-126 | − | AGACCUAGGUGGAGAAC | 17 | 15226 |
| CFTR-Intron2-127 | + | UCUACCUGGCAUGUAAC | 17 | 15227 |
| CFTR-Intron2-128 | + | CUCCAUCAUUCAUUAAC | 17 | 15228 |
| CFTR-Intron2-129 | − | UCUCGUGCCAACAGCAC | 17 | 15229 |
| CFTR-Intron2-130 | − | CUUAAGGUAAUGGCUAC | 17 | 15230 |
| CFTR-Intron2-131 | + | CUCUCCAGCAAUGCUAC | 17 | 15231 |
| CFTR-Intron2-132 | + | AACGUAUGGGUUUGUAC | 17 | 15232 |
| CFTR-Intron2-133 | + | AGCAAAGAGUUCUAACC | 17 | 15233 |
| CFTR-Intron2-134 | + | AUAAGGCAAAUGCCACC | 17 | 15234 |
| CFTR-Intron2-135 | − | AGGACUCAAAUGCCACC | 17 | 15235 |
| CFTR-Intron2-136 | + | AGUGAAGUAGAGAGACC | 17 | 15236 |
| CFTR-Intron2-137 | + | UAGUAGGACCACAUACC | 17 | 15237 |
| CFTR-Intron2-138 | + | AGAGGAGAUAUUCUACC | 17 | 15238 |
| CFTR-Intron2-139 | − | CCCUUGGGAAGUGACCC | 17 | 15239 |
| CFTR-Intron2-140 | − | CUAAAACUACAUUGCCC | 17 | 15240 |
| CFTR-Intron2-141 | − | AAUACAAAUGUACUCCC | 17 | 15241 |
| CFTR-Intron2-142 | − | UACAUAAAGUGGGUCCC | 17 | 15242 |

TABLE 37B-continued

2nd Tier

| gRNA Name | DNA Strand | Targeting Domain | Target Site Length | Seq ID |
|---|---|---|---|---|
| CFTR-Intron2-143 | + | UUACCUUAAGACUUCCC | 17 | 15243 |
| CFTR-Intron2-144 | + | UUAUGAAAUGUGAAGCC | 17 | 15244 |
| CFTR-Intron2-145 | + | UAAAGGAGUAAUAGGCC | 17 | 15245 |
| CFTR-Intron2-146 | − | CAUGCUUAGAGAUUGCC | 17 | 15246 |
| CFTR-Intron2-147 | + | ACUUAGAUAUUCAAAGC | 17 | 15247 |
| CFTR-Intron2-148 | + | CACUUUAUGUAGAAAGC | 17 | 15248 |
| CFTR-Intron2-149 | + | UGUUCAAUAAUAGAAGC | 17 | 15249 |
| CFTR-Intron2-150 | − | UAAUAAAUACAAUCAGC | 17 | 15250 |
| CFTR-Intron2-151 | + | CUAAAGGAGUAAUAGGC | 17 | 15251 |
| CFTR-Intron2-152 | − | AUUAAUCAGAGUAGGGC | 17 | 15252 |
| CFTR-Intron2-153 | − | UGGCAUUUGCCUUAUGC | 17 | 15253 |
| CFTR-Intron2-154 | − | UAAACAUAAUCCAUUGC | 17 | 15254 |
| CFTR-Intron2-155 | + | AAUGUUCUUCAACCAUC | 17 | 15255 |
| CFTR-Intron2-156 | + | CCCUUUUAUCUGGCAUC | 17 | 15256 |
| CFTR-Intron2-157 | − | AAGAACAUUAACCUAUC | 17 | 15257 |
| CFTR-Intron2-158 | + | UCACUCACCCUUUUAUC | 17 | 15258 |
| CFTR-Intron2-159 | + | UAUGACUCAAGAGUCUC | 17 | 15259 |
| CFTR-Intron2-160 | + | UAUGUAGAAAGCUGGUC | 17 | 15260 |
| CFTR-Intron2-161 | + | AGGUCUUCACAUAGUUC | 17 | 15261 |
| CFTR-Intron2-162 | − | CAGCUUUCUACAUAAAG | 17 | 15262 |
| CFTR-Intron2-163 | + | ACUAUGAGUGGCCCAAG | 17 | 15263 |
| CFTR-Intron2-164 | − | UGACCAUGGCCCUCAAG | 17 | 15264 |
| CFTR-Intron2-165 | + | UUGUUAUAUUUCAUAAG | 17 | 15265 |
| CFTR-Intron2-166 | + | ACUUCCCAAGGGUGCAG | 17 | 15266 |
| CFTR-Intron2-167 | + | AUGCUUUCCACUCAGAG | 17 | 15267 |
| CFTR-Intron2-168 | + | UCAUUCUAGACUAUGAG | 17 | 15268 |
| CFTR-Intron2-169 | − | UCAAAGAAUUAAGCUAG | 17 | 15269 |
| CFTR-Intron2-170 | − | CAUUAGCAAGCUUCUAG | 17 | 15270 |
| CFTR-Intron2-171 | + | ACACUGCAGUUAUGUAG | 17 | 15271 |
| CFTR-Intron2-172 | + | AAAGGAGUAAUAGGCCG | 17 | 15272 |
| CFTR-Intron2-173 | + | AGGAGAAGGCAAGGUCG | 17 | 15273 |
| CFTR-Intron2-174 | + | AAGGGCUCCUUCUUUCG | 17 | 15274 |
| CFTR-Intron2-175 | − | CUAUGUGAAGACCUAGG | 17 | 15275 |
| CFTR-Intron2-176 | + | AGAGAUUCUUUAUGGGG | 17 | 15276 |
| CFTR-Intron2-177 | − | UGGAGAAGCAUGUGGGG | 17 | 15277 |
| CFTR-Intron2-178 | − | CAAAUGUUAUGGAUGGG | 17 | 15278 |
| CFTR-Intron2-179 | + | UAGUUUUAGGAACAUGG | 17 | 15279 |
| CFTR-Intron2-180 | + | UGAGAGAUUCUUUAUGG | 17 | 15280 |

TABLE 37B-continued

2nd Tier

| gRNA Name | DNA Strand | Targeting Domain | Target Site Length | Seq ID |
|---|---|---|---|---|
| CFTR-Intron2-181 | − | ACUCAAAUGCCACCUGG | 17 | 15281 |
| CFTR-Intron2-182 | + | UAAAUUGAAUCAACAUG | 17 | 15282 |
| CFTR-Intron2-183 | − | UGUGUGCAAAUGCCAUG | 17 | 15283 |
| CFTR-Intron2-184 | − | AAAGGUGGAGAAGCAUG | 17 | 15284 |
| CFTR-Intron2-185 | + | AAUGGGGUAGUUACCUG | 17 | 15285 |
| CFTR-Intron2-186 | − | AGCCAUGAUUCCAGCUG | 17 | 15286 |
| CFTR-Intron2-187 | − | UCUACAUUACUUCCGUG | 17 | 15287 |
| CFTR-Intron2-188 | + | AUCUUGGAACGGAUGUG | 17 | 15288 |
| CFTR-Intron2-189 | + | CAUCUGGCAACCACUUG | 17 | 15289 |
| CFTR-Intron2-190 | + | CCUAUUCUAGGCACUUG | 17 | 15290 |
| CFTR-Intron2-191 | − | UACCUAGUUCUUCCUUG | 17 | 15291 |
| CFTR-Intron2-192 | − | UUGGUGCUAACAAUUUG | 17 | 15292 |
| CFTR-Intron2-193 | + | UACUUAAGCUAGUAAAU | 17 | 15293 |
| CFTR-Intron2-194 | − | CCCCAAGUGCCUAGAAU | 17 | 15294 |
| CFTR-Intron2-195 | + | CACUCUAAAGGAGUAAU | 17 | 15295 |
| CFTR-Intron2-196 | + | CGGGGAAUUUCUUUAAU | 17 | 15296 |
| CFTR-Intron2-197 | + | UCGUGGUCCUUAAAGAU | 17 | 15297 |
| CFTR-Intron2-198 | + | ACAAAAUUGAGCCAGAU | 17 | 15298 |
| CFTR-Intron2-199 | − | UGGGGAGGGAAAUAGAU | 17 | 15299 |
| CFTR-Intron2-200 | − | AACCAAAUGUUAUGGAU | 17 | 15300 |
| CFTR-Intron2-201 | + | AAAAUAAUAGAACGUAU | 17 | 15301 |
| CFTR-Intron2-202 | − | AAAAGGAACGAAUUUAU | 17 | 15302 |
| CFTR-Intron2-203 | + | ACUGAGAGAUUCUUUAU | 17 | 15303 |
| CFTR-Intron2-204 | + | AACCACAAGGAAGAACU | 17 | 15304 |
| CFTR-Intron2-205 | − | AUAGUCUAGAAUGAACU | 17 | 15305 |
| CFTR-Intron2-206 | + | AGGCCAGUUCUCCACCU | 17 | 15306 |
| CFTR-Intron2-207 | − | UUGUACCUCUGCACCCU | 17 | 15307 |
| CFTR-Intron2-208 | + | AGGUCUCUAGUGACCCU | 17 | 15308 |
| CFTR-Intron2-209 | − | UCAUAGUGCUUACCCCU | 17 | 15309 |
| CFTR-Intron2-210 | − | AUACAAAUGUACUCCCU | 17 | 15310 |
| CFTR-Intron2-211 | − | UGUACACACCCCUUCCU | 17 | 15311 |
| CFTR-Intron2-212 | + | CUUAGAUAUUCAAAGCU | 17 | 15312 |
| CFTR-Intron2-213 | − | UUAAUCAGAGUAGGGCU | 17 | 15313 |
| CFTR-Intron2-214 | + | UAUCCUGACUACAAUCU | 17 | 15314 |
| CFTR-Intron2-215 | + | UCUCUAAGCAUGGAUCU | 17 | 15315 |
| CFTR-Intron2-216 | − | ACCACAUCACCUACUCU | 17 | 15316 |
| CFTR-Intron2-217 | + | AUGACUCAAGAGUCUCU | 17 | 15317 |

TABLE 37B-continued

2nd Tier

| gRNA Name | DNA Strand | Targeting Domain | Target Site Length | Seq ID |
|---|---|---|---|---|
| CFTR-Intron2-218 | − | CUCAUUAGCAAGCUUCU | 17 | 15318 |
| CFTR-Intron2-219 | + | UUGUUAGCACCAAGAGU | 17 | 15319 |
| CFTR-Intron2-220 | − | CAAAGAAUUAAGCUAGU | 17 | 15320 |
| CFTR-Intron2-221 | − | AAGGUGGAGAAGCAUGU | 17 | 15321 |
| CFTR-Intron2-222 | + | CAUCAGGCCUGUGCUGU | 17 | 15322 |
| CFTR-Intron2-223 | − | CAUUGAACCCAUUUUGU | 17 | 15323 |
| CFTR-Intron2-224 | + | ACUUAAGCUAGUAAAUU | 17 | 15324 |
| CFTR-Intron2-225 | + | CUCCCAUCCAUAACAUU | 17 | 15325 |
| CFTR-Intron2-226 | − | UGUACCUCUGCACCCUU | 17 | 15326 |
| CFTR-Intron2-227 | − | CAUAGUGCUUACCCCUU | 17 | 15327 |
| CFTR-Intron2-228 | − | UUUCCAAUCAAAAGGUU | 17 | 15328 |
| CFTR-Intron2-229 | − | AGGCCUGAUGCCAGAUAAAA | 20 | 15329 |
| CFTR-Intron2-230 | + | CUUCUCCAUCAAAGGAGAAA | 20 | 15330 |
| CFTR-Intron2-231 | − | AUCCAUGAUGGAAUGUGAAA | 20 | 15331 |
| CFTR-Intron2-232 | − | CAGGCCUGAUGCCAGAUAAA | 20 | 15332 |
| CFTR-Intron2-233 | + | AGCCUUUUUUCUCUUCACAA | 20 | 15333 |
| CFTR-Intron2-234 | + | CUAGGUAAACAAUUAGACAA | 20 | 15334 |
| CFTR-Intron2-235 | + | UCACAUUUAGCCAAGGACAA | 20 | 15335 |
| CFTR-Intron2-236 | + | CUAGACUAUGAGUGGCCCAA | 20 | 15336 |
| CFTR-Intron2-237 | + | AAGCCAGGGUCACUUCCCAA | 20 | 15337 |
| CFTR-Intron2-238 | + | ACUUGUCAAUAUACCUGCAA | 20 | 15338 |
| CFTR-Intron2-239 | + | AGACUCACCUUCUCCAUCAA | 20 | 15339 |
| CFTR-Intron2-240 | − | AUUCACACUUCUAAGAUCAA | 20 | 15340 |
| CFTR-Intron2-241 | − | AACUGGCCUUAGGAACUCAA | 20 | 15341 |
| CFTR-Intron2-242 | + | AUACCAGGCCCAGAUCAGAA | 20 | 15342 |
| CFTR-Intron2-243 | − | UAGCUCUGUGUGUGAGAGAA | 20 | 15343 |
| CFTR-Intron2-244 | + | CACACGGAAGUAAUGUAGAA | 20 | 15344 |
| CFTR-Intron2-245 | − | AUUGCCUUGCUCUCUAGGAA | 20 | 15345 |
| CFTR-Intron2-246 | + | UCCUAACCUUUUGAUUGGAA | 20 | 15346 |
| CFTR-Intron2-247 | + | UCCUGACUACAAUCUUGGAA | 20 | 15347 |
| CFTR-Intron2-248 | − | CAGAUAAAGGGUGAGUGAA | 20 | 15348 |
| CFTR-Intron2-249 | + | AUACACGAUUUACUUCAUAA | 20 | 15349 |
| CFTR-Intron2-250 | + | AUGGCUCUAAAUCACUCUAA | 20 | 15350 |
| CFTR-Intron2-251 | − | UUAUGGUAACUUGACAGUAA | 20 | 15351 |
| CFTR-Intron2-252 | − | CCUGGGAAGUCUUAAGGUAA | 20 | 15352 |
| CFTR-Intron2-253 | + | CUACUAAAAUCAUGUAUUAA | 20 | 15353 |
| CFTR-Intron2-254 | + | AGGUCGGGAAUUUCUUUAA | 20 | 15354 |
| CFTR-Intron2-255 | + | CAAGUUACCAUAAGUAAACA | 20 | 15355 |

TABLE 37B-continued

2nd Tier

| gRNA Name | DNA Strand | Targeting Domain | Target Site Length | Seq ID |
|---|---|---|---|---|
| CFTR-Intron2-256 | + | AUGUGAAAAAGUGGUCCACA | 20 | 15356 |
| CFTR-Intron2-257 | + | ACUUGAGGGCCAUGGUCACA | 20 | 15357 |
| CFTR-Intron2-258 | − | UUAGGAACUCAAUGGGACCA | 20 | 15358 |
| CFTR-Intron2-259 | − | UCAUAACUGCCUUGUGACCA | 20 | 15359 |
| CFTR-Intron2-260 | − | CUGGCUCAAUUUUGUGACCA | 20 | 15360 |
| CFTR-Intron2-261 | + | UCUAGACUAUGAGUGGCCCA | 20 | 15361 |
| CFTR-Intron2-262 | − | UCCUAAAACUACAUUGCCCA | 20 | 15362 |
| CFTR-Intron2-263 | + | CAUUACCUUAAGACUUCCCA | 20 | 15363 |
| CFTR-Intron2-264 | + | AGUUAUGAAAUGUGAAGCCA | 20 | 15364 |
| CFTR-Intron2-265 | + | UGGCAACCACUUGAGGGCCA | 20 | 15365 |
| CFTR-Intron2-266 | + | UAUGUAGAGGAUUCAAUCCA | 20 | 15366 |
| CFTR-Intron2-267 | + | AGCCUGGCAAUCUCUAAGCA | 20 | 15367 |
| CFTR-Intron2-268 | + | ACUACCAUUCCUAGAGAGCA | 20 | 15368 |
| CFTR-Intron2-269 | + | AGUUACCUGAGGAGAAGGCA | 20 | 15369 |
| CFTR-Intron2-270 | + | ACAGACCUCAGCUGGAAUCA | 20 | 15370 |
| CFTR-Intron2-271 | + | AGCCAUUUCACAUUCCAUCA | 20 | 15371 |
| CFTR-Intron2-272 | + | AACAAAGUAUCCCUACCUCA | 20 | 15372 |
| CFTR-Intron2-273 | + | UUUUCACAAAAUCCAUCUCA | 20 | 15373 |
| CFTR-Intron2-274 | − | UCUUUAAGGACCACGAAAGA | 20 | 15374 |
| CFTR-Intron2-275 | + | CAUACCAGGCCCAGAUCAGA | 20 | 15375 |
| CFTR-Intron2-276 | + | CAAAGGAGAAAUGGAUCAGA | 20 | 15376 |
| CFTR-Intron2-277 | − | UCUUAUUAGAGACCAUGAGA | 20 | 15377 |
| CFTR-Intron2-278 | − | CAUGUGGGAGGGAAAUAGA | 20 | 15378 |
| CFTR-Intron2-279 | − | AGGUAAUUAGGCUUUAUAGA | 20 | 15379 |
| CFTR-Intron2-280 | + | UCAGAUGGGAAAGCCAAGGA | 20 | 15380 |
| CFTR-Intron2-281 | − | CUUUGCCAGUUAAUGAAUGA | 20 | 15381 |
| CFTR-Intron2-282 | − | AAGUUUUAAUUGGAUGCUGA | 20 | 15382 |
| CFTR-Intron2-283 | − | CCAGAUAAAAGGGUGAGUGA | 20 | 15383 |
| CFTR-Intron2-284 | + | ACCAUCUGGCAACCACUUGA | 20 | 15384 |
| CFTR-Intron2-285 | − | CUGAUCCAUUUCUCCUUUGA | 20 | 15385 |
| CFTR-Intron2-286 | − | UCCUUUUUUGGCAUUUUGA | 20 | 15386 |
| CFTR-Intron2-287 | + | UCAGAGUAAGAAGCUAAAUA | 20 | 15387 |
| CFTR-Intron2-288 | − | AUCCCCAAGUGCCUAGAAUA | 20 | 15388 |
| CFTR-Intron2-289 | + | UUGGUCCCAUUGAGUUCCUA | 20 | 15389 |
| CFTR-Intron2-290 | − | CUCUCAUUAGCAAGCUUCUA | 20 | 15390 |
| CFTR-Intron2-291 | − | ACAUCUCAGCUCCUGAAGUA | 20 | 15391 |
| CFTR-Intron2-292 | − | UGUGCAAAUGCCAUGAGGUA | 20 | 15392 |

TABLE 37B-continued

2nd Tier

| gRNA Name | DNA Strand | Targeting Domain | Target Site Length | Seq ID |
|---|---|---|---|---|
| CFTR-Intron2-293 | - | UUUAGAGCCAUGUUUACUUA | 20 | 15393 |
| CFTR-Intron2-294 | - | CUCUGAGUAACCAAAUGUUA | 20 | 15394 |
| CFTR-Intron2-295 | - | ACUCUUUGCUCCUAUCUUUA | 20 | 15395 |
| CFTR-Intron2-296 | + | ACAUUAAAUAGUCUGAAAAC | 20 | 15396 |
| CFTR-Intron2-297 | + | AUGGGGGAUACAGUGAAAAC | 20 | 15397 |
| CFTR-Intron2-298 | - | UGAAGACCUAGGUGGAGAAC | 20 | 15398 |
| CFTR-Intron2-299 | + | UAUUCUACCUGGCAUGUAAC | 20 | 15399 |
| CFTR-Intron2-300 | + | UGGCUCCAUCAUUCAUUAAC | 20 | 15400 |
| CFTR-Intron2-301 | - | CUGGUUUUAUUUUCUCAGAC | 20 | 15401 |
| CFTR-Intron2-302 | - | AGUCUUAAGGUAAUGGCUAC | 20 | 15402 |
| CFTR-Intron2-303 | + | UAUCUCUCCAGCAAUGCUAC | 20 | 15403 |
| CFTR-Intron2-304 | + | UAGAACGUAUGGGUUUGUAC | 20 | 15404 |
| CFTR-Intron2-305 | + | AGGAGCAAAGAGUUCUAACC | 20 | 15405 |
| CFTR-Intron2-306 | + | AGCAUAAGGCAAAUGCCACC | 20 | 15406 |
| CFTR-Intron2-307 | - | CCAAGGACUCAAAUGCCACC | 20 | 15407 |
| CFTR-Intron2-308 | + | UUCUAGUAGGACCACAUACC | 20 | 15408 |
| CFTR-Intron2-309 | + | CUGAGAGGAGAUAUUCUACC | 20 | 15409 |
| CFTR-Intron2-310 | + | UAAGAGGUCUCUAGUGACCC | 20 | 15410 |
| CFTR-Intron2-311 | - | UUCCUAAAACUACAUUGCCC | 20 | 15411 |
| CFTR-Intron2-312 | - | UUGAAUACAAAUGUACUCCC | 20 | 15412 |
| CFTR-Intron2-313 | - | UUCUACAUAAAGUGGGUCCC | 20 | 15413 |
| CFTR-Intron2-314 | + | CCAUUACCUUAAGACUUCCC | 20 | 15414 |
| CFTR-Intron2-315 | + | CAGUUAUGAAAUGUGAAGCC | 20 | 15415 |
| CFTR-Intron2-316 | - | CUUCCCUUCUGAUCUGGGCC | 20 | 15416 |
| CFTR-Intron2-317 | - | AUCCAUGCUUAGAGAUUGCC | 20 | 15417 |
| CFTR-Intron2-318 | + | AAAACUUAGAUAUUCAAAGC | 20 | 15418 |
| CFTR-Intron2-319 | + | ACCCACUUUAUGUAGAAAGC | 20 | 15419 |
| CFTR-Intron2-320 | + | AAGUGUUCAAUAAUAGAAGC | 20 | 15420 |
| CFTR-Intron2-321 | - | ACUUAAUAAAUACAAUCAGC | 20 | 15421 |
| CFTR-Intron2-322 | + | AAGGCAAUACAGACCUCAGC | 20 | 15422 |
| CFTR-Intron2-323 | - | AUGAUUAAUCAGAGUAGGGC | 20 | 15423 |
| CFTR-Intron2-324 | - | AUAUAAACAUAAUCCAUUGC | 20 | 15424 |
| CFTR-Intron2-325 | - | AUAGAAACCUGUAGCAUUGC | 20 | 15425 |
| CFTR-Intron2-326 | - | AAACUUCUUCCCUUCUGAUC | 20 | 15426 |
| CFTR-Intron2-327 | - | UUGAAGAACAUUAACCUAUC | 20 | 15427 |
| CFTR-Intron2-328 | + | UCAGAUUCAUGUUCUCUAUC | 20 | 15428 |
| CFTR-Intron2-329 | - | UCUGAAUUUGCAGAAUUAUC | 20 | 15429 |
| CFTR-Intron2-330 | - | CCCGACCUUGCCUUCUCCUC | 20 | 15430 |

TABLE 37B-continued

2nd Tier

| gRNA Name | DNA Strand | Targeting Domain | Target Site Length | Seq ID |
|---|---|---|---|---|
| CFTR-Intron2-331 | + | CACUAUGACUCAAGAGUCUC | 20 | 15431 |
| CFTR-Intron2-332 | − | UCCGUUCCAAGAUUGUAGUC | 20 | 15432 |
| CFTR-Intron2-333 | + | CCUGAGGAGAAGGCAAGGUC | 20 | 15433 |
| CFTR-Intron2-334 | + | CUUUAUGUAGAAAGCUGGUC | 20 | 15434 |
| CFTR-Intron2-335 | + | CCUAGGUCUUCACAUAGUUC | 20 | 15435 |
| CFTR-Intron2-336 | + | AUGGGUUCAAUGUGAAAAAG | 20 | 15436 |
| CFTR-Intron2-337 | + | UAGACUAUGAGUGGCCCAAG | 20 | 15437 |
| CFTR-Intron2-338 | − | UUGUGACCAUGGCCCUCAAG | 20 | 15438 |
| CFTR-Intron2-339 | − | CUUUCAUUAACAGAAAUCAG | 20 | 15439 |
| CFTR-Intron2-340 | + | AAGGCUUUACGUUUCAUCAG | 20 | 15440 |
| CFTR-Intron2-341 | + | AUGAUGCUUUCCACUCAGAG | 20 | 15441 |
| CFTR-Intron2-342 | + | AGUUCAUUCUAGACUAUGAG | 20 | 15442 |
| CFTR-Intron2-343 | + | UUCCACUCAGAGUGGCUGAG | 20 | 15443 |
| CFTR-Intron2-344 | − | CUCCUCUCAGCCACUCUGAG | 20 | 15444 |
| CFTR-Intron2-345 | − | UAUUCAAAGAAUUAAGCUAG | 20 | 15445 |
| CFTR-Intron2-346 | − | UCUCAUUAGCAAGCUUCUAG | 20 | 15446 |
| CFTR-Intron2-347 | + | UGCACACUGCAGUUAUGUAG | 20 | 15447 |
| CFTR-Intron2-348 | + | UCUAAAGGAGUAAUAGGCCG | 20 | 15448 |
| CFTR-Intron2-349 | + | CUGAGGAGAAGGCAAGGUCG | 20 | 15449 |
| CFTR-Intron2-350 | + | AUAAGGCAAAUGCCACCAGG | 20 | 15450 |
| CFTR-Intron2-351 | + | CUGAGAGAUUCUUUAUGGGG | 20 | 15451 |
| CFTR-Intron2-352 | − | AACCAAAUGUUAUGGAUGGG | 20 | 15452 |
| CFTR-Intron2-353 | + | ACUGAGAGAUUCUUUAUGGG | 20 | 15453 |
| CFTR-Intron2-354 | + | UUUAAAUUGAAUCAACAUGG | 20 | 15454 |
| CFTR-Intron2-355 | + | AUGUAGUUUUAGGAACAUGG | 20 | 15455 |
| CFTR-Intron2-356 | + | AACUGAGAGAUUCUUUAUGG | 20 | 15456 |
| CFTR-Intron2-357 | − | AGGACUCAAAUGCCACCUGG | 20 | 15457 |
| CFTR-Intron2-358 | + | UUUUAAAUUGAAUCAACAUG | 20 | 15458 |
| CFTR-Intron2-359 | + | AGCACCAAGAGUAGGUGAUG | 20 | 15459 |
| CFTR-Intron2-360 | − | UCUGAUCUGGGCCUGGUAUG | 20 | 15460 |
| CFTR-Intron2-361 | + | AAACUGAGAGAUUCUUUAUG | 20 | 15461 |
| CFTR-Intron2-362 | + | UAGAAUGGGGUAGUUACCUG | 20 | 15462 |
| CFTR-Intron2-363 | − | UGGAGCCAUGAUUCCAGCUG | 20 | 15463 |
| CFTR-Intron2-364 | − | UAAGUUUUAAUUGGAUGCUG | 20 | 15464 |
| CFTR-Intron2-365 | − | CUUUCUACAUUACUUCCGUG | 20 | 15465 |
| CFTR-Intron2-366 | + | ACAAUCUUGGAACGGAUGUG | 20 | 15466 |
| CFTR-Intron2-367 | + | AACCAUCUGGCAACCACUUG | 20 | 15467 |

TABLE 37B-continued

2nd Tier

| gRNA Name | DNA Strand | Targeting Domain | Target Site Length | Seq ID |
|---|---|---|---|---|
| CFTR-Intron2-368 | − | CUCUUGGUGCUAACAAUUUG | 20 | 15468 |
| CFTR-Intron2-369 | + | UGUACAUAAACCAACAAAAU | 20 | 15469 |
| CFTR-Intron2-370 | + | AUUUACUUAAGCUAGUAAAU | 20 | 15470 |
| CFTR-Intron2-371 | − | ACUGGCCUUAGGAACUCAAU | 20 | 15471 |
| CFTR-Intron2-372 | − | CAAGUUCAAAAUAAUAUAAU | 20 | 15472 |
| CFTR-Intron2-373 | − | UAUGGUAACUUGACAGUAAU | 20 | 15473 |
| CFTR-Intron2-374 | + | AAUCACUCUAAAGGAGUAAU | 20 | 15474 |
| CFTR-Intron2-375 | + | CUUUCGUGGUCCUUAAAGAU | 20 | 15475 |
| CFTR-Intron2-376 | + | AAAGGAGAAAUGGAUCAGAU | 20 | 15476 |
| CFTR-Intron2-377 | − | AUGUGGGGAGGGAAAUAGAU | 20 | 15477 |
| CFTR-Intron2-378 | − | AGUAACCAAAUGUUAUGGAU | 20 | 15478 |
| CFTR-Intron2-379 | + | AAGGAUCCUAACCUUUUGAU | 20 | 15479 |
| CFTR-Intron2-380 | + | ACAAAAAUAAUAGAACGUAU | 20 | 15480 |
| CFTR-Intron2-381 | − | AAUAAAAGGAACGAAUUUAU | 20 | 15481 |
| CFTR-Intron2-382 | + | UGGGUGAAACUUGAACAACU | 20 | 15482 |
| CFTR-Intron2-383 | + | AUGAACCACAAGGAAGAACU | 20 | 15483 |
| CFTR-Intron2-384 | − | CUCAUAGUCUAGAAUGAACU | 20 | 15484 |
| CFTR-Intron2-385 | − | AGCUUCUAUUAUUGAACACU | 20 | 15485 |
| CFTR-Intron2-386 | + | CUAAGGCCAGUUCUCCACCU | 20 | 15486 |
| CFTR-Intron2-387 | − | CCUGAACUAUGUGAAGACCU | 20 | 15487 |
| CFTR-Intron2-388 | + | AAGAGGUCUCUAGUGACCCU | 20 | 15488 |
| CFTR-Intron2-389 | − | UGAAUACAAAUGUACUCCCU | 20 | 15489 |
| CFTR-Intron2-390 | + | CCAGGUGGCAUUUGAGUCCU | 20 | 15490 |
| CFTR-Intron2-391 | − | AAGAAGGAGCCCUUUGUCCU | 20 | 15491 |
| CFTR-Intron2-392 | − | UUAUGUACACACCCCUUCCU | 20 | 15492 |
| CFTR-Intron2-393 | + | AAACUUAGAUAUUCAAAGCU | 20 | 15493 |
| CFTR-Intron2-394 | − | UGAUUAAUCAGAGUAGGGCU | 20 | 15494 |
| CFTR-Intron2-395 | + | UCAUAUCCUGACUACAAUCU | 20 | 15495 |
| CFTR-Intron2-396 | + | CAAUCUCUAAGCAUGGAUCU | 20 | 15496 |
| CFTR-Intron2-397 | − | AACUUCUUCCCUUCUGAUCU | 20 | 15497 |
| CFTR-Intron2-398 | − | AGAACCACAUCACCUACUCU | 20 | 15498 |
| CFTR-Intron2-399 | − | UCUGUAUUGCCUUGCUCUCU | 20 | 15499 |
| CFTR-Intron2-400 | + | ACUAUGACUCAAGAGUCUCU | 20 | 15500 |
| CFTR-Intron2-401 | − | ACCAGCUUUCUACAUAAAGU | 20 | 15501 |
| CFTR-Intron2-402 | + | AAAUUGUUAGCACCAAGAGU | 20 | 15502 |
| CFTR-Intron2-403 | − | AGGGAAUGAUUAAUCAGAGU | 20 | 15503 |
| CFTR-Intron2-404 | − | AUUCAAAGAAUUAAGCUAGU | 20 | 15504 |
| CFTR-Intron2-405 | + | ACCUGAGGAGAAGGCAAGGU | 20 | 15505 |

TABLE 37B-continued

2nd Tier

| gRNA Name | DNA Strand | Targeting Domain | Target Site Length | Seq ID |
|---|---|---|---|---|
| CFTR-Intron2-406 | - | AGAAAGGUGGAGAAGCAUGU | 20 | 15506 |
| CFTR-Intron2-407 | + | UGGCAUCAGGCCUGUGCUGU | 20 | 15507 |
| CFTR-Intron2-408 | - | UCACAUUGAACCCAUUUUGU | 20 | 15508 |
| CFTR-Intron2-409 | - | AUAGAUGGGAAAAGGUAAUU | 20 | 15509 |
| CFTR-Intron2-410 | + | AACCUCCCAUCCAUAACAUU | 20 | 15510 |
| CFTR-Intron2-411 | + | UCAACUCAAUGUUUUUACUU | 20 | 15511 |
| CFTR-Intron2-412 | - | CUUUGUACCUCUGCACCCUU | 20 | 15512 |
| CFTR-Intron2-413 | - | AGUCAUAGUGCUUACCCCUU | 20 | 15513 |
| CFTR-Intron2-414 | - | CUAGGUGGAGAACUGGCCUU | 20 | 15514 |
| CFTR-Intron2-415 | - | UCCUUUCCAAUCAAAAGGUU | 20 | 15515 |
| CFTR-Intron2-416 | + | ACCCUGGGCAAUGUAGUUUU | 20 | 15516 |

Table 37C provides exemplary targeting domains for correcting a mutation (e.g., 3272-26→G) in the CFTR gene selected according to the third tier parameters. The targeting domains bind within intron 2 and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 37C

3rd Tier

| gRNA Name | DNA Strand | Targeting Domain | Target Site Length | Seq ID |
|---|---|---|---|---|
| CFTR-Intron2-417 | - | GGGAAAUAGAUGGGAAA | 17 | 15517 |
| CFTR-Intron2-418 | + | GACCAGCCUGGCCAACA | 17 | 15518 |
| CFTR-Intron2-419 | - | GCUAAUUUUUGUAGAGA | 17 | 15519 |
| CFTR-Intron2-420 | - | GUGGGGAGGGAAAUAGA | 17 | 15520 |
| CFTR-Intron2-421 | + | GAUGGGAAAGCCAAGGA | 17 | 15521 |
| CFTR-Intron2-422 | - | GUUGAAUGAAUCCAUGA | 17 | 15522 |
| CFTR-Intron2-423 | - | GAUAAAAGGGUGAGUGA | 17 | 15523 |
| CFTR-Intron2-424 | + | GAGUAAGAAGCUAAAUA | 17 | 15524 |
| CFTR-Intron2-425 | - | GAAUAGGGCCUGGCAUA | 17 | 15525 |
| CFTR-Intron2-426 | + | GGGGAUACAGUGAAAAC | 17 | 15526 |
| CFTR-Intron2-427 | - | GUUUUAUUUUCUCAGAC | 17 | 15527 |
| CFTR-Intron2-428 | + | GAGAAUCACUUGAACCC | 17 | 15528 |
| CFTR-Intron2-429 | + | GAGAUUCGCUUGAACCC | 17 | 15529 |
| CFTR-Intron2-430 | - | GUCUCGCUGUGUCACCC | 17 | 15530 |
| CFTR-Intron2-431 | - | GGCGUGAGCCACUGCCC | 17 | 15531 |
| CFTR-Intron2-432 | - | GUCUUGCUCUGUUGCCC | 17 | 15532 |
| CFTR-Intron2-433 | + | GGAGUUCAAGACCAGCC | 17 | 15533 |
| CFTR-Intron2-434 | - | GCAUGCACCACCAGGCC | 17 | 15534 |

TABLE 37C-continued

3rd Tier

| gRNA Name | DNA Strand | Targeting Domain | Target Site Length | Seq ID |
|---|---|---|---|---|
| CFTR-Intron2-435 | − | GUGCCUAGAAUAGGGCC | 17 | 15535 |
| CFTR-Intron2-436 | − | GUUUUGCUAUGCUGGCC | 17 | 15536 |
| CFTR-Intron2-437 | − | GUUUCGCCAUGUUGGCC | 17 | 15537 |
| CFTR-Intron2-438 | − | GCACUCGCCACAAUGCC | 17 | 15538 |
| CFTR-Intron2-439 | + | GAGGAGAAGGCAAGGUC | 17 | 15539 |
| CFTR-Intron2-440 | + | GCAGAUCACUUGAGGUC | 17 | 15540 |
| CFTR-Intron2-441 | + | GGUGGAAACCAUACUUC | 17 | 15541 |
| CFTR-Intron2-442 | + | GAAAAGAAGUAACAGGG | 17 | 15542 |
| CFTR-Intron2-443 | − | GUUUUAAUUGGAUGCUG | 17 | 15543 |
| CFTR-Intron2-444 | + | GGCGGGCAGAUCACUUG | 17 | 15544 |
| CFTR-Intron2-445 | + | GGUGGGCAGAUCACUUG | 17 | 15545 |
| CFTR-Intron2-446 | + | GAAAGAAAAAAUAGAAU | 17 | 15546 |
| CFTR-Intron2-447 | − | GUUCAAAAUAAUAUAAU | 17 | 15547 |
| CFTR-Intron2-448 | + | GGAGAAAUGGAUCAGAU | 17 | 15548 |
| CFTR-Intron2-449 | + | GCCCUAUUCUAGGCACU | 17 | 15549 |
| CFTR-Intron2-450 | − | GUGGAGUUUCGCCAUGU | 17 | 15550 |
| CFTR-Intron2-451 | − | GAUGGGAAAAGGUAAUU | 17 | 15551 |
| CFTR-Intron2-452 | − | GUUUUUUAUUUUUUAUU | 17 | 15552 |
| CFTR-Intron2-453 | − | GUGUAAUGGUGCAAUUU | 17 | 15553 |
| CFTR-Intron2-454 | − | GGAGGGAAAUAGAUGGGAAA | 20 | 15554 |
| CFTR-Intron2-455 | + | GAAAAAUUUCAUGAACCACA | 20 | 15555 |
| CFTR-Intron2-456 | + | GAGAAAAUAAAACCAGCAUA | 20 | 15556 |
| CFTR-Intron2-457 | − | GACUACAGGCAUGCACCACC | 20 | 15557 |
| CFTR-Intron2-458 | − | GGGGUUUUGCUAUGCUGGCC | 20 | 15558 |
| CFTR-Intron2-459 | − | GGAGUUUCGCCAUGUUGGCC | 20 | 15559 |
| CFTR-Intron2-460 | − | GCCUCAGCCUCUCGAGUAGC | 20 | 15560 |
| CFTR-Intron2-461 | + | GCUACUCGAGAGGCUGAGGC | 20 | 15561 |
| CFTR-Intron2-462 | − | GAGACGGGGUUUUGCUAUGC | 20 | 15562 |
| CFTR-Intron2-463 | + | GCCUGUAGUCCCAGCUACUC | 20 | 15563 |
| CFTR-Intron2-464 | + | GACUUUGUUUUAAAAGUAG | 20 | 15564 |
| CFTR-Intron2-465 | − | GGCUAAUUUUUGUAGAGACG | 20 | 15565 |
| CFTR-Intron2-466 | + | GAGAUUCGCUUGAACCCAGG | 20 | 15566 |
| CFTR-Intron2-467 | − | GAGAAAGGUGGAGAAGCAUG | 20 | 15567 |
| CFTR-Intron2-468 | − | GAAAGGUGGAGAAGCAUGUG | 20 | 15568 |
| CFTR-Intron2-469 | + | GGCCCUAUUCUAGGCACUUG | 20 | 15569 |
| CFTR-Intron2-470 | + | GCACCAUUACACUCCAGCCU | 20 | 15570 |
| CFTR-Intron2-471 | + | GCAUUUGGGAGGCCAAGGU | 20 | 15571 |
| CFTR-Intron2-472 | − | GUGUGCAAAUGCCAUGAGGU | 20 | 15572 |

TABLE 37C-continued

3rd Tier

| gRNA Name | DNA Strand | Targeting Domain | Target Site Length | Seq ID |
|---|---|---|---|---|
| CFTR-Intron2-473 | − | GAUGUGGAGUUUCGCCAUGU | 20 | 15573 |
| CFTR-Intron2-474 | − | GCCUUGGCCUCCCAAAGUGU | 20 | 15574 |
| CFTR-Intron2-475 | − | GGAGUGUAAUGGUGCAAUUU | 20 | 15575 |
| CFTR-Intron2-476 | + | GCCACUAAUCCCAACACUUU | 20 | 15576 |

Table 37D provides exemplary targeting domains for correcting a mutation (e.g., 3272-26→G) in the CFTR gene selected according to the fourth tier parameters. The targeting domains bind within intron 2. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 37D

4th Tier

| gRNA Name | DNA Strand | Targeting Domain | Target Site Length | Seq ID |
|---|---|---|---|---|
| CFTR-Intron2-477 | + | UUCAAAAUGCCAAAAAA | 17 | 15577 |
| CFTR-Intron2-478 | − | CUUUGUGAAGAGAAAAA | 17 | 15578 |
| CFTR-Intron2-479 | + | UACAUAAACCAACAAAA | 17 | 15579 |
| CFTR-Intron2-480 | − | UUUCCUUUCCAAUCAAA | 17 | 15580 |
| CFTR-Intron2-481 | + | UGUCACUGGCAAUCAAA | 17 | 15581 |
| CFTR-Intron2-482 | + | CUCCAUCAAAGGAGAAA | 17 | 15582 |
| CFTR-Intron2-483 | − | CAUGAUGGAAUGUGAAA | 17 | 15583 |
| CFTR-Intron2-484 | − | UAGCUUAAGUAAAUAAA | 17 | 15584 |
| CFTR-Intron2-485 | + | CUUUUUUCUCUUCACAA | 17 | 15585 |
| CFTR-Intron2-486 | − | CUCUGUGUGUGAGAGAA | 17 | 15586 |
| CFTR-Intron2-487 | + | UGAAAGAAAAAUAGAA | 17 | 15587 |
| CFTR-Intron2-488 | + | AUGGGAAAGCCAAGGAA | 17 | 15588 |
| CFTR-Intron2-489 | − | AUAAAAGGGUGAGUGAA | 17 | 15589 |
| CFTR-Intron2-490 | + | ACAAACAAAAAACAUAA | 17 | 15590 |
| CFTR-Intron2-491 | + | UUUGUAUUCAAAUAUAA | 17 | 15591 |
| CFTR-Intron2-492 | − | AGUUCAAAAUAAUAUAA | 17 | 15592 |
| CFTR-Intron2-493 | − | CCCAGGCUGGAGUGUAA | 17 | 15593 |
| CFTR-Intron2-494 | + | CUAAAAUCAUGUAUUAA | 17 | 15594 |
| CFTR-Intron2-495 | + | UUUAAAUUGAAUCAACA | 17 | 15595 |
| CFTR-Intron2-496 | + | UAAGAAAAGAAGUAACA | 17 | 15596 |
| CFTR-Intron2-497 | + | AUCAGAUGGGAAAGCCA | 17 | 15597 |
| CFTR-Intron2-498 | + | UAUGAAAUGUGAAGCCA | 17 | 15598 |
| CFTR-Intron2-499 | + | AACACUUUGGGAGGCCA | 17 | 15599 |
| CFTR-Intron2-500 | + | AGCAUUUUGGGAGGCCA | 17 | 15600 |
| CFTR-Intron2-501 | + | CAUUUCACAUUCCAUCA | 17 | 15601 |

TABLE 37D-continued

4th Tier

| gRNA Name | DNA Strand | Targeting Domain | Target Site Length | Seq ID |
|---|---|---|---|---|
| CFTR-Intron2-502 | + | AGGAGAAAUGGAUCAGA | 17 | 15602 |
| CFTR-Intron2-503 | − | UUCUCCUUUGAUGGAGA | 17 | 15603 |
| CFTR-Intron2-504 | − | UAUUAGAGACCAUGAGA | 17 | 15604 |
| CFTR-Intron2-505 | − | UUUUAAUUGGAUGCUGA | 17 | 15605 |
| CFTR-Intron2-506 | − | AUCCAUUCUCCUUUGA | 17 | 15606 |
| CFTR-Intron2-507 | − | UUUUUUGGCAUUUUGA | 17 | 15607 |
| CFTR-Intron2-508 | − | CCCAAGUGCCUAGAAUA | 17 | 15608 |
| CFTR-Intron2-509 | + | AAAAUAAAACCAGCAUA | 17 | 15609 |
| CFTR-Intron2-510 | + | AAAAAUAAUAGAACGUA | 17 | 15610 |
| CFTR-Intron2-511 | − | UGAUACAUUUGUAUUUA | 17 | 15611 |
| CFTR-Intron2-512 | + | AUAAGAAAAGAAGUAAC | 17 | 15612 |
| CFTR-Intron2-513 | + | AAUUGGGUUUCUGUCAC | 17 | 15613 |
| CFTR-Intron2-514 | − | CUAAUUUUUGUAGAGAC | 17 | 15614 |
| CFTR-Intron2-515 | − | UGAGUAGCUGGGACUAC | 17 | 15615 |
| CFTR-Intron2-516 | − | CGAGUAGCUGGGUUUAC | 17 | 15616 |
| CFTR-Intron2-517 | − | UACAGGCAUGCACCACC | 17 | 15617 |
| CFTR-Intron2-518 | + | AGAUUUGAAGACAAGCC | 17 | 15618 |
| CFTR-Intron2-519 | + | ACCACUACACUCCAGCC | 17 | 15619 |
| CFTR-Intron2-520 | + | ACCAUUACACUCCAGCC | 17 | 15620 |
| CFTR-Intron2-521 | + | AAAUACAAAAAUUAGCC | 17 | 15621 |
| CFTR-Intron2-522 | + | CUCUACAAAAAUUAGCC | 17 | 15622 |
| CFTR-Intron2-523 | + | CAAAAAUUAGCCAGGCC | 17 | 15623 |
| CFTR-Intron2-524 | − | CCCUUCUGAUCUGGGCC | 17 | 15624 |
| CFTR-Intron2-525 | − | AGUACCUGUUACAUGCC | 17 | 15625 |
| CFTR-Intron2-526 | + | AGUAUAUACCAUAUGCC | 17 | 15626 |
| CFTR-Intron2-527 | − | CUGCAAACUCUGCCUCC | 17 | 15627 |
| CFTR-Intron2-528 | − | AACAUUCUCUGCUCUCC | 17 | 15628 |
| CFTR-Intron2-529 | − | CUGCAAACUUCGUCUCC | 17 | 15629 |
| CFTR-Intron2-530 | − | UCAGCCUCUCGAGUAGC | 17 | 15630 |
| CFTR-Intron2-531 | − | UCAGUCUCCUGAGUAGC | 17 | 15631 |
| CFTR-Intron2-532 | + | CUUUGGGAGGCCAAGGC | 17 | 15632 |
| CFTR-Intron2-533 | − | CGCUGUGUCACCCAGGC | 17 | 15633 |
| CFTR-Intron2-534 | − | UGCUCUGUUGCCCAGGC | 17 | 15634 |
| CFTR-Intron2-535 | − | UGCUAUGCUGGCCAGGC | 17 | 15635 |
| CFTR-Intron2-536 | − | CGCCAUGUUGGCCAGGC | 17 | 15636 |
| CFTR-Intron2-537 | + | ACUCGAGAGGCUGAGGC | 17 | 15637 |
| CFTR-Intron2-538 | − | UUGGCCUCCCAAAAUGC | 17 | 15638 |
| CFTR-Intron2-539 | − | ACGGGGUUUUGCUAUGC | 17 | 15639 |

TABLE 37D-continued

4th Tier

| gRNA Name | DNA Strand | Targeting Domain | Target Site Length | Seq ID |
|---|---|---|---|---|
| CFTR-Intron2-540 | − | CUUCUUCCCUUCUGAUC | 17 | 15640 |
| CFTR-Intron2-541 | + | UGUAGUCCCAGCUACUC | 17 | 15641 |
| CFTR-Intron2-542 | + | CCAAAUGUGUAUUUUUC | 17 | 15642 |
| CFTR-Intron2-543 | + | UGGGAAAGCCAAGGAAG | 17 | 15643 |
| CFTR-Intron2-544 | − | UAAAAGGGUGAGUGAAG | 17 | 15644 |
| CFTR-Intron2-545 | − | UCAUUAACAGAAAUCAG | 17 | 15645 |
| CFTR-Intron2-546 | + | AAACCCAGCUACUCGAG | 17 | 15646 |
| CFTR-Intron2-547 | + | CACUCAGAGUGGCUGAG | 17 | 15647 |
| CFTR-Intron2-548 | − | CUCUCAGCCACUCUGAG | 17 | 15648 |
| CFTR-Intron2-549 | + | UUCAAAGCUGGGCAUAG | 17 | 15649 |
| CFTR-Intron2-550 | + | UUUGUUUUUAAAAGUAG | 17 | 15650 |
| CFTR-Intron2-551 | − | CCCAGGCUGGAGUGUAG | 17 | 15651 |
| CFTR-Intron2-552 | − | CAAAGUGUUGGGAUUAG | 17 | 15652 |
| CFTR-Intron2-553 | − | UAAUUUUUGUAGAGACG | 17 | 15653 |
| CFTR-Intron2-554 | − | UGUGUGUGAGAGAAAGG | 17 | 15654 |
| CFTR-Intron2-555 | + | ACUUUGGGAGGCCAAGG | 17 | 15655 |
| CFTR-Intron2-556 | + | AUUUUGGGAGGCCAAGG | 17 | 15656 |
| CFTR-Intron2-557 | − | AAAAGGGUGAGUGAAGG | 17 | 15657 |
| CFTR-Intron2-558 | + | AGGCAAAUGCCACCAGG | 17 | 15658 |
| CFTR-Intron2-559 | + | AUUCGCUUGAACCCAGG | 17 | 15659 |
| CFTR-Intron2-560 | + | AAUCCCAACACUUUGGG | 17 | 15660 |
| CFTR-Intron2-561 | + | AAUCCCAGCAUUUUGGG | 17 | 15661 |
| CFTR-Intron2-562 | + | AAAUUGAAUCAACAUGG | 17 | 15662 |
| CFTR-Intron2-563 | + | AAAUUAGCCAGGCCUGG | 17 | 15663 |
| CFTR-Intron2-564 | + | AAAGAAAAAUAGAAUG | 17 | 15664 |
| CFTR-Intron2-565 | − | UUGUAUUUUAGUAGAUG | 17 | 15665 |
| CFTR-Intron2-566 | + | ACCAAGAGUAGGUGAUG | 17 | 15666 |
| CFTR-Intron2-567 | + | CUGAGAGAUUCUUUAUG | 17 | 15667 |
| CFTR-Intron2-568 | − | UACAGAAAAGCAAACUG | 17 | 15668 |
| CFTR-Intron2-569 | + | AGCUACUCGAGAGGCUG | 17 | 15669 |
| CFTR-Intron2-570 | − | AGGUGGAGAAGCAUGUG | 17 | 15670 |
| CFTR-Intron2-571 | + | AAAUUAGCCAGGCAUUG | 17 | 15671 |
| CFTR-Intron2-572 | + | ACAUAAACCAACAAAAU | 17 | 15672 |
| CFTR-Intron2-573 | − | UUCUUUUCUUAUAAAAU | 17 | 15673 |
| CFTR-Intron2-574 | + | UUGAAUUGAAGUAAAAU | 17 | 15674 |
| CFTR-Intron2-575 | − | AAUAUCUAAGUUUUAAU | 17 | 15675 |
| CFTR-Intron2-576 | + | UUAAAUUGAAUCAACAU | 17 | 15676 |

TABLE 37D-continued

4th Tier

| gRNA Name | DNA Strand | Targeting Domain | Target Site Length | Seq ID |
|---|---|---|---|---|
| CFTR-Intron2-577 | + | UUUCUUUUAAAUACUAU | 17 | 15677 |
| CFTR-Intron2-578 | − | CAAAAUGCUGGGAUUAU | 17 | 15678 |
| CFTR-Intron2-579 | − | UGUUUUUAUUUUUUAU | 17 | 15679 |
| CFTR-Intron2-580 | − | UUCUAUUAUUGAACACU | 17 | 15680 |
| CFTR-Intron2-581 | − | AAGUGAUCUGCCCACCU | 17 | 15681 |
| CFTR-Intron2-582 | + | CCACUACACUCCAGCCU | 17 | 15682 |
| CFTR-Intron2-583 | + | CCAUUACACUCCAGCCU | 17 | 15683 |
| CFTR-Intron2-584 | − | AAGUGAUCUGCCCGCCU | 17 | 15684 |
| CFTR-Intron2-585 | − | UGCAAACUCUGCCUCCU | 17 | 15685 |
| CFTR-Intron2-586 | − | UGCAAACUUCGUCUCCU | 17 | 15686 |
| CFTR-Intron2-587 | − | AAGGAGCCCUUUGUCCU | 17 | 15687 |
| CFTR-Intron2-588 | − | CAGCCUCUCGAGUAGCU | 17 | 15688 |
| CFTR-Intron2-589 | − | CAGUCUCCUGAGUAGCU | 17 | 15689 |
| CFTR-Intron2-590 | − | UGGCCUCCCAAAAUGCU | 17 | 15690 |
| CFTR-Intron2-591 | − | UUCUUCCCUUCUGAUCU | 17 | 15691 |
| CFTR-Intron2-592 | + | AUGCCAGGCCCUAUUCU | 17 | 15692 |
| CFTR-Intron2-593 | − | AGCUUUCUACAUAAAGU | 17 | 15693 |
| CFTR-Intron2-594 | + | UUUUGGGAGGCCAAGGU | 17 | 15694 |
| CFTR-Intron2-595 | + | UGAGGAGAAGGCAAGGU | 17 | 15695 |
| CFTR-Intron2-596 | − | UGCAAAUGCCAUGAGGU | 17 | 15696 |
| CFTR-Intron2-597 | − | UUGGCCUCCCAAAGUGU | 17 | 15697 |
| CFTR-Intron2-598 | − | CCUGAAAAAUACACAUU | 17 | 15698 |
| CFTR-Intron2-599 | + | CACUAAUCCCAACACUU | 17 | 15699 |
| CFTR-Intron2-600 | + | CCCUAUUCUAGGCACUU | 17 | 15700 |
| CFTR-Intron2-601 | + | ACUCAAUGUUUUUACUU | 17 | 15701 |
| CFTR-Intron2-602 | − | UGGCCUCCCAAAGUGUU | 17 | 15702 |
| CFTR-Intron2-603 | + | CUAUAAUCCCAGCAUUU | 17 | 15703 |
| CFTR-Intron2-604 | − | AAUUUAUUGAAAUAUUU | 17 | 15704 |
| CFTR-Intron2-605 | + | ACUAAUCCCAACACUUU | 17 | 15705 |
| CFTR-Intron2-606 | + | UAUAAUCCCAGCAUUUU | 17 | 15706 |
| CFTR-Intron2-607 | + | CUGGGCAAUGUAGUUUU | 17 | 15707 |
| CFTR-Intron2-608 | − | AAUUCAUUUCCUUUUUU | 17 | 15708 |
| CFTR-Intron2-609 | − | UUCCUUUGUGAAGAGAAAAA | 20 | 15709 |
| CFTR-Intron2-610 | + | CACAUUUAGCCAAGGACAAA | 20 | 15710 |
| CFTR-Intron2-611 | − | CAGUUUCCUUUCCAAUCAAA | 20 | 15711 |
| CFTR-Intron2-612 | + | UUCUGUCACUGGCAAUCAAA | 20 | 15712 |
| CFTR-Intron2-613 | − | UACUAGCUUAAGUAAAUAAA | 20 | 15713 |
| CFTR-Intron2-614 | + | CUAUGAAAGAAAAAAUAGAA | 20 | 15714 |

TABLE 37D-continued

4th Tier

| gRNA Name | DNA Strand | Targeting Domain | Target Site Length | Seq ID |
|---|---|---|---|---|
| CFTR-Intron2-615 | + | CAGAUGGGAAAGCCAAGGAA | 20 | 15715 |
| CFTR-Intron2-616 | + | CAAACAAACAAAAAACAUAA | 20 | 15716 |
| CFTR-Intron2-617 | + | ACAUUUGUAUUCAAAUAUAA | 20 | 15717 |
| CFTR-Intron2-618 | – | ACAAGUUCAAAAUAAUAUAA | 20 | 15718 |
| CFTR-Intron2-619 | – | UUGCCCAGGCUGGAGUGUAA | 20 | 15719 |
| CFTR-Intron2-620 | + | CAAGACCAGCCUGGCCAACA | 20 | 15720 |
| CFTR-Intron2-621 | + | UUUUUUAAAUUGAAUCAACA | 20 | 15721 |
| CFTR-Intron2-622 | + | UUAUAAGAAAAGAAGUAACA | 20 | 15722 |
| CFTR-Intron2-623 | + | UGGAUCAGAUGGGAAAGCCA | 20 | 15723 |
| CFTR-Intron2-624 | + | CCCAACACUUUGGGAGGCCA | 20 | 15724 |
| CFTR-Intron2-625 | + | CCCAGCAUUUUGGGAGGCCA | 20 | 15725 |
| CFTR-Intron2-626 | – | CUGGCUAAUUUUUGUAGAGA | 20 | 15726 |
| CFTR-Intron2-627 | – | CAUUUCUCCUUUGAUGGAGA | 20 | 15727 |
| CFTR-Intron2-628 | – | UUUGUUGAAUGAAUCCAUGA | 20 | 15728 |
| CFTR-Intron2-629 | – | CUAGAAUAGGGCCUGGCAUA | 20 | 15729 |
| CFTR-Intron2-630 | + | AACAAAAAUAAUAGAACGUA | 20 | 15730 |
| CFTR-Intron2-631 | – | AUGUGAUACAUUUGUAUUUA | 20 | 15731 |
| CFTR-Intron2-632 | + | UUUAUAAGAAAAGAAGUAAC | 20 | 15732 |
| CFTR-Intron2-633 | – | UGGCUAAUUUUUGUAGAGAC | 20 | 15733 |
| CFTR-Intron2-634 | – | UCCUGAGUAGCUGGGACUAC | 20 | 15734 |
| CFTR-Intron2-635 | – | UCUCGAGUAGCUGGGUUUAC | 20 | 15735 |
| CFTR-Intron2-636 | + | CAGGAGAAUCACUUGAACCC | 20 | 15736 |
| CFTR-Intron2-637 | + | ACUGAGAUUCGCUUGAACCC | 20 | 15737 |
| CFTR-Intron2-638 | – | AGAGUCUCGCUGUGUCACCC | 20 | 15738 |
| CFTR-Intron2-639 | – | AGUGGCGUGAGCCACUGCCC | 20 | 15739 |
| CFTR-Intron2-640 | – | AGAGUCUUGCUCUGUUGCCC | 20 | 15740 |
| CFTR-Intron2-641 | + | CUGAGAUUUGAAGACAAGCC | 20 | 15741 |
| CFTR-Intron2-642 | + | UCAGGAGUUCAAGACCAGCC | 20 | 15742 |
| CFTR-Intron2-643 | + | CACACCACUACACUCCAGCC | 20 | 15743 |
| CFTR-Intron2-644 | + | UGCACCAUUACACUCCAGCC | 20 | 15744 |
| CFTR-Intron2-645 | + | CUAAAAUACAAAAAUUAGCC | 20 | 15745 |
| CFTR-Intron2-646 | + | CGUCUCUACAAAAAUUAGCC | 20 | 15746 |
| CFTR-Intron2-647 | – | CAGGCAUGCACCACCAGGCC | 20 | 15747 |
| CFTR-Intron2-648 | + | CUACAAAAUUAGCCAGGCC | 20 | 15748 |
| CFTR-Intron2-649 | + | CUCUAAAGGAGUAAUAGGCC | 20 | 15749 |
| CFTR-Intron2-650 | – | CAAGUGCCUAGAAUAGGGCC | 20 | 15750 |
| CFTR-Intron2-651 | – | CAGGCACUCGCCACAAUGCC | 20 | 15751 |

TABLE 37D-continued

4th Tier

| gRNA Name | DNA Strand | Targeting Domain | Target Site Length | Seq ID |
|---|---|---|---|---|
| CFTR-Intron2-652 | − | UUGAGUACCUGUUACAUGCC | 20 | 15752 |
| CFTR-Intron2-653 | + | UUGAGUAUAUACCAUAUGCC | 20 | 15753 |
| CFTR-Intron2-654 | − | UCACUGCAAACUCUGCCUCC | 20 | 15754 |
| CFTR-Intron2-655 | − | UCACUGCAAACUUCGUCUCC | 20 | 15755 |
| CFTR-Intron2-656 | − | AUCUCAGUCUCCUGAGUAGC | 20 | 15756 |
| CFTR-Intron2-657 | + | ACACUUUGGGAGGCCAAGGC | 20 | 15757 |
| CFTR-Intron2-658 | − | UCUCGCUGUGUCACCCAGGC | 20 | 15758 |
| CFTR-Intron2-659 | − | UCUUGCUCUGUUGCCCAGGC | 20 | 15759 |
| CFTR-Intron2-660 | − | UUUUGCUAUGCUGGCCAGGC | 20 | 15760 |
| CFTR-Intron2-661 | − | UUUCGCCAUGUUGGCCAGGC | 20 | 15761 |
| CFTR-Intron2-662 | + | ACUCUAAAGGAGUAAUAGGC | 20 | 15762 |
| CFTR-Intron2-663 | − | ACCUUGGCCUCCCAAAAUGC | 20 | 15763 |
| CFTR-Intron2-664 | − | UGGUGGCAUUUGCCUUAUGC | 20 | 15764 |
| CFTR-Intron2-665 | + | UCACCCUUUUAUCUGGCAUC | 20 | 15765 |
| CFTR-Intron2-666 | + | CCUUCACUCACCCUUUUAUC | 20 | 15766 |
| CFTR-Intron2-667 | + | CGGGCAGAUCACUUGAGGUC | 20 | 15767 |
| CFTR-Intron2-668 | + | UGGGCAGAUCACUUGAGGUC | 20 | 15768 |
| CFTR-Intron2-669 | + | CAUGGUGGAAACCAUACUUC | 20 | 15769 |
| CFTR-Intron2-670 | + | AAACCAAAUGUGUAUUUUUC | 20 | 15770 |
| CFTR-Intron2-671 | + | AGAUGGGAAAGCCAAGGAAG | 20 | 15771 |
| CFTR-Intron2-672 | − | AGAUAAAAGGGUGAGUGAAG | 20 | 15772 |
| CFTR-Intron2-673 | + | UGUAAACCCAGCUACUCGAG | 20 | 15773 |
| CFTR-Intron2-674 | + | AUAUUCAAAGCUGGGCAUAG | 20 | 15774 |
| CFTR-Intron2-675 | − | UCACCCAGGCUGGAGUGUAG | 20 | 15775 |
| CFTR-Intron2-676 | − | UCCCAAAGUGUUGGGAUUAG | 20 | 15776 |
| CFTR-Intron2-677 | + | ACAAAGGGCUCCUUCUUUCG | 20 | 15777 |
| CFTR-Intron2-678 | − | CUCUGUGUGUGAGAGAAAGG | 20 | 15778 |
| CFTR-Intron2-679 | + | AACACUUUGGGAGGCCAAGG | 20 | 15779 |
| CFTR-Intron2-680 | + | AGCAUUUUGGGAGGCCAAGG | 20 | 15780 |
| CFTR-Intron2-681 | + | UAAGAAAAGAAGUAACAGGG | 20 | 15781 |
| CFTR-Intron2-682 | − | AGGUGGAGAAGCAUGUGGGG | 20 | 15782 |
| CFTR-Intron2-683 | + | ACUAAUCCCAACACUUUGGG | 20 | 15783 |
| CFTR-Intron2-684 | + | UAUAAUCCCAGCAUUUUGGG | 20 | 15784 |
| CFTR-Intron2-685 | + | CAAAAAUUAGCCAGGCCUGG | 20 | 15785 |
| CFTR-Intron2-686 | + | AUGAAAGAAAAAUAGAAUG | 20 | 15786 |
| CFTR-Intron2-687 | − | UGGUGUGUGCAAAUGCCAUG | 20 | 15787 |
| CFTR-Intron2-688 | − | UUUUUGUAUUUUAGUAGAUG | 20 | 15788 |
| CFTR-Intron2-689 | − | UUUUACAGAAAAGCAAACUG | 20 | 15789 |

TABLE 37D-continued

| | 4th Tier | | | |
|---|---|---|---|---|
| gRNA Name | DNA Strand | Targeting Domain | Target Site Length | Seq ID |
| CFTR-Intron2-690 | + | CCCAGCUACUCGAGAGGCUG | 20 | 15790 |
| CFTR-Intron2-691 | + | CAAAAAUUAGCCAGGCAUUG | 20 | 15791 |
| CFTR-Intron2-692 | + | CAAGGCGGGCAGAUCACUUG | 20 | 15792 |
| CFTR-Intron2-693 | + | CAAGGUGGGCAGAUCACUUG | 20 | 15793 |
| CFTR-Intron2-694 | − | UACUUCUUUUCUUAUAAAAU | 20 | 15794 |
| CFTR-Intron2-695 | + | UUGUUGAAUUGAAGUAAAAU | 20 | 15795 |
| CFTR-Intron2-696 | + | UAUGAAAGAAAAAAUAGAAU | 20 | 15796 |
| CFTR-Intron2-697 | − | UAUCCCCAAGUGCCUAGAAU | 20 | 15797 |
| CFTR-Intron2-698 | − | UUGAAUAUCUAAGUUUUAAU | 20 | 15798 |
| CFTR-Intron2-699 | + | UUUUUAAAUUGAAUCAACAU | 20 | 15799 |
| CFTR-Intron2-700 | + | UGUUUUCUUUUAAAUACUAU | 20 | 15800 |
| CFTR-Intron2-701 | − | UCCCAAAAUGCUGGGAUUAU | 20 | 15801 |
| CFTR-Intron2-702 | − | UUUUGUUUUUAUUUUUUAU | 20 | 15802 |
| CFTR-Intron2-703 | + | CAGGCCCUAUUCUAGGCACU | 20 | 15803 |
| CFTR-Intron2-704 | − | CUCAAGUGAUCUGCCCACCU | 20 | 15804 |
| CFTR-Intron2-705 | − | ACUUUGUACCUCUGCACCCU | 20 | 15805 |
| CFTR-Intron2-706 | + | ACACCACUACACUCCAGCCU | 20 | 15806 |
| CFTR-Intron2-707 | − | CUCAAGUGAUCUGCCCGCCU | 20 | 15807 |
| CFTR-Intron2-708 | − | CACUGCAAACUCUGCCUCCU | 20 | 15808 |
| CFTR-Intron2-709 | − | CACUGCAAACUUCGUCUCCU | 20 | 15809 |
| CFTR-Intron2-710 | − | CCUCAGCCUCUCGAGUAGCU | 20 | 15810 |
| CFTR-Intron2-711 | − | UCUCAGUCUCCUGAGUAGCU | 20 | 15811 |
| CFTR-Intron2-712 | − | CCUUGGCCUCCCAAAAUGCU | 20 | 15812 |
| CFTR-Intron2-713 | + | CAUAUGCCAGGCCCUAUUCU | 20 | 15813 |
| CFTR-Intron2-714 | + | UUUACUUAAGCUAGUAAAUU | 20 | 15814 |
| CFTR-Intron2-715 | − | UUUCCUGAAAAAUACACAUU | 20 | 15815 |
| CFTR-Intron2-716 | − | UUUGUUUUUAUUUUUUAUU | 20 | 15816 |
| CFTR-Intron2-717 | + | CGCCACUAAUCCCAACACUU | 20 | 15817 |
| CFTR-Intron2-718 | + | AGGCCCUAUUCUAGGCACUU | 20 | 15818 |
| CFTR-Intron2-719 | − | CCUUGGCCUCCCAAAGUGUU | 20 | 15819 |
| CFTR-Intron2-720 | + | CACCUAUAAUCCCAGCAUUU | 20 | 15820 |
| CFTR-Intron2-721 | − | UGAAAUUUAUUGAAAUAUUU | 20 | 15821 |
| CFTR-Intron2-722 | + | ACCUAUAAUCCCAGCAUUUU | 20 | 15822 |
| CFTR-Intron2-723 | − | UUAAAUUCAUUUCCUUUUUU | 20 | 15823 |

Table 38A provides exemplary targeting domains for correcting a mutation (e.g., 3272-26→G) in the CFTR gene selected according to the first tier parameters. The targeting domains bind within intron 2, have a high level of orthogonality, start with a 5'G, and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 38A

1st Tier

| gRNA Name | DNA Strand | Targeting Domain | Target Site Length | Seq ID |
|---|---|---|---|---|
| CFTR-Intron2-724 | + | GUUAGCUAUGAAAGAAAAAA | 20 | 15824 |
| CFTR-Intron2-725 | + | GUGUACAUAAACCAACAAA | 19 | 15825 |
| CFTR-Intron2-726 | + | GUGUGUACAUAAACCAACAAA | 21 | 15826 |
| CFTR-Intron2-727 | + | GGUGUGUACAUAAACCAACAAA | 22 | 15827 |
| CFTR-Intron2-728 | + | GGGUGUGUACAUAAACCAACAAA | 23 | 15828 |
| CFTR-Intron2-729 | + | GGGGUGUGUACAUAAACCAACAAA | 24 | 15829 |
| CFTR-Intron2-730 | + | GCCUUUUUUCUCUUCACAA | 19 | 15830 |
| CFTR-Intron2-731 | + | GAAAGCCUUUUUUCUCUUCACAA | 23 | 15831 |
| CFTR-Intron2-732 | + | GGCUCUAAAUCACUCUAA | 18 | 15832 |
| CFTR-Intron2-733 | + | GCAUUUGAGUCCUUGGUCCCA | 21 | 15833 |
| CFTR-Intron2-734 | + | GGCAUUUGAGUCCUUGGUCCCA | 22 | 15834 |
| CFTR-Intron2-735 | + | GUGGCAUUUGAGUCCUUGGUCCCA | 24 | 15835 |
| CFTR-Intron2-736 | + | GCCAUUACCUUAAGACUUCCCA | 22 | 15836 |
| CFTR-Intron2-737 | + | GUAGAGAGACCAGGAGAGCA | 20 | 15837 |
| CFTR-Intron2-738 | + | GUCCUUAAAGAUAGGAGCA | 19 | 15838 |
| CFTR-Intron2-739 | + | GGUCCUUAAAGAUAGGAGCA | 20 | 15839 |
| CFTR-Intron2-740 | + | GUGGUCCUUAAAGAUAGGAGCA | 22 | 15840 |
| CFTR-Intron2-741 | + | GAACUUGUCAAUAUACCUGCA | 21 | 15841 |
| CFTR-Intron2-742 | + | GCACACUGCAGUUAUGUA | 18 | 15842 |
| CFTR-Intron2-743 | + | GUUUGCACACUGCAGUUAUGUA | 22 | 15843 |
| CFTR-Intron2-744 | + | GGUUUGCACACUGCAGUUAUGUA | 23 | 15844 |
| CFTR-Intron2-745 | + | GGUCGGGGAAUUUCUUUA | 18 | 15845 |
| CFTR-Intron2-746 | + | GCAAGGUCGGGGAAUUUCUUUA | 22 | 15846 |
| CFTR-Intron2-747 | + | GGCAAGGUCGGGGAAUUUCUUUA | 23 | 15847 |
| CFTR-Intron2-748 | + | GCCACAAAUUGUUAGCACC | 19 | 15848 |
| CFTR-Intron2-749 | + | GUGCCACAAAUUGUUAGCACC | 21 | 15849 |
| CFTR-Intron2-750 | + | GGUGCCACAAAUUGUUAGCACC | 22 | 15850 |
| CFTR-Intron2-751 | + | GAAGCCAGGGUCACUUCCC | 19 | 15851 |
| CFTR-Intron2-752 | + | GUGAAGCCAGGGUCACUUCCC | 21 | 15852 |
| CFTR-Intron2-753 | + | GCAGUUAUGAAAUGUGAAGC | 20 | 15853 |
| CFTR-Intron2-754 | + | GGCAGUUAUGAAAUGUGAAGC | 21 | 15854 |
| CFTR-Intron2-755 | + | GCCUGGCAAUCUCUAAGC | 18 | 15855 |
| CFTR-Intron2-756 | + | GACAAGCCUGGCAAUCUCUAAGC | 23 | 15856 |
| CFTR-Intron2-757 | + | GGCAAUACAGACCUCAGC | 18 | 15857 |

TABLE 38A-continued

| | | 1st Tier | | |
|---|---|---|---|---|
| gRNA Name | DNA Strand | Targeting Domain | Target Site Length | Seq ID |
| CFTR-Intron2-758 | + | GCAAGGCAAUACAGACCUCAGC | 22 | 15858 |
| CFTR-Intron2-759 | + | GAGCAAGGCAAUACAGACCUCAGC | 24 | 15859 |
| CFTR-Intron2-760 | + | GCCAUUUCACAUUCCAUC | 18 | 15860 |
| CFTR-Intron2-761 | + | GCUAGCCAUUUCACAUUCCAUC | 22 | 15861 |
| CFTR-Intron2-762 | + | GGGUAAGCACUAUGACUC | 18 | 15862 |
| CFTR-Intron2-763 | + | GGGGUAAGCACUAUGACUC | 19 | 15863 |
| CFTR-Intron2-764 | + | GCACUAUGACUCAAGAGUCUC | 21 | 15864 |
| CFTR-Intron2-765 | + | GAGGAGAAGGCAAGGUCG | 18 | 15865 |
| CFTR-Intron2-766 | + | GUUUGUACUGGCAUAGCAUUG | 21 | 15866 |
| CFTR-Intron2-767 | + | GGUUUGUACUGGCAUAGCAUUG | 22 | 15867 |
| CFTR-Intron2-768 | + | GGGUUUGUACUGGCAUAGCAUUG | 23 | 15868 |
| CFTR-Intron2-769 | + | GCAAAUGCCACCAGGUGGCAU | 21 | 15869 |
| CFTR-Intron2-770 | + | GGCAAAUGCCACCAGGUGGCAU | 22 | 15870 |
| CFTR-Intron2-771 | + | GAUAAUGAUGCUUUCCACU | 19 | 15871 |
| CFTR-Intron2-772 | + | GCCAGUUCAUUCUAGACU | 19 | 15872 |
| CFTR-Intron2-773 | + | GCUACUCCCACUAGCUUAAUUCU | 23 | 15873 |
| CFTR-Intron2-774 | + | GCCCUUGAUCUUAGAAGU | 18 | 15874 |
| CFTR-Intron2-775 | + | GGCCCUUGAUCUUAGAAGU | 19 | 15875 |
| CFTR-Intron2-776 | + | GCUGGCCCUUGAUCUUAGAAGU | 22 | 15876 |
| CFTR-Intron2-777 | − | GACCAGCUUUCUACAUAAA | 19 | 15877 |
| CFTR-Intron2-778 | − | GGACCAGCUUUCUACAUAAA | 20 | 15878 |
| CFTR-Intron2-779 | − | GACCGGACCAGCUUUCUACAUAAA | 24 | 15879 |
| CFTR-Intron2-780 | − | GCACAGGCCUGAUGCCAGAUAA | 22 | 15880 |
| CFTR-Intron2-781 | − | GCUUUGAAUAUCUAAGUUUUAA | 22 | 15881 |
| CFTR-Intron2-782 | − | GAAAAAUACACAUUUGGUUUCA | 22 | 15882 |
| CFTR-Intron2-783 | − | GCUUAAGUAAAUAAAAGGA | 19 | 15883 |
| CFTR-Intron2-784 | − | GCUCAAUUUUGUGACCAUGGA | 21 | 15884 |
| CFTR-Intron2-785 | − | GGCUCAAUUUUGUGACCAUGGA | 22 | 15885 |
| CFTR-Intron2-786 | − | GUUUUAAUUGGAUGCUGA | 18 | 15886 |
| CFTR-Intron2-787 | − | GAAUGGUAGUCCCCCCCAUA | 20 | 15887 |
| CFTR-Intron2-788 | − | GGAAUGGUAGUCCCCCCCAUA | 21 | 15888 |
| CFTR-Intron2-789 | − | GACAAGUUCAAAAUAAUAUA | 20 | 15889 |
| CFTR-Intron2-790 | − | GCUCUCAUUAGCAAGCUUCUA | 21 | 15890 |
| CFTR-Intron2-791 | − | GGCUCUCAUUAGCAAGCUUCUA | 22 | 15891 |
| CFTR-Intron2-792 | − | GGGCUCUCAUUAGCAAGCUUCUA | 23 | 15892 |
| CFTR-Intron2-793 | − | GUUCAAAAUAAUAUAAUGGGUA | 22 | 15893 |
| CFTR-Intron2-794 | − | GAUAAUAUACUUUGCCAGUUA | 21 | 15894 |

TABLE 38A-continued

1st Tier

| gRNA Name | DNA Strand | Targeting Domain | Target Site Length | Seq ID |
|---|---|---|---|---|
| CFTR-Intron2-795 | - | GAGAUAAUAUACUUUGCCAGUUA | 23 | 15895 |
| CFTR-Intron2-796 | - | GUAUUUAUGGCCAGAUAGAGAAC | 23 | 15896 |
| CFTR-Intron2-797 | - | GAUGUAUCCCCAAGUGCC | 18 | 15897 |
| CFTR-Intron2-798 | - | GUUCCUAAAACUACAUUGCC | 20 | 15898 |
| CFTR-Intron2-799 | - | GAAAAAUCCCAGAGACUC | 18 | 15899 |
| CFTR-Intron2-800 | - | GUGAAAAAUCCCAGAGACUC | 20 | 15900 |
| CFTR-Intron2-801 | - | GCCAGAUAAAAGGGUGAGUGAAG | 23 | 15901 |
| CFTR-Intron2-802 | - | GUCUUAUUAGAGACCAUGAG | 20 | 15902 |
| CFTR-Intron2-803 | - | GCCUGAUGCCAGAUAAAAGG | 20 | 15903 |
| CFTR-Intron2-804 | - | GUACCUGUUACAUGCCAGG | 19 | 15904 |
| CFTR-Intron2-805 | - | GAGUACCUGUUACAUGCCAGG | 21 | 15905 |
| CFTR-Intron2-806 | - | GAAUGAUUAAUCAGAGUAGGG | 21 | 15906 |
| CFTR-Intron2-807 | - | GGAAUGAUUAAUCAGAGUAGGG | 22 | 15907 |
| CFTR-Intron2-808 | - | GGGAAUGAUUAAUCAGAGUAGGG | 23 | 15908 |
| CFTR-Intron2-809 | - | GAACAUGAAUCUGAAUUUG | 19 | 15909 |
| CFTR-Intron2-810 | - | GCCAGAUAGAGAACAUGAAU | 20 | 15910 |
| CFTR-Intron2-811 | - | GAUGCUGAGGGAAUGAUUAAU | 21 | 15911 |
| CFTR-Intron2-812 | - | GGAUGCUGAGGGAAUGAUUAAU | 22 | 15912 |
| CFTR-Intron2-813 | - | GCUUUCAAAACCUUUAUAU | 19 | 15913 |
| CFTR-Intron2-814 | - | GAAUAUCUCCUCUCAGCCACU | 21 | 15914 |
| CFTR-Intron2-815 | - | GUAGAAUAUCUCCUCUCAGCCACU | 24 | 15915 |
| CFTR-Intron2-816 | - | GCUCCAUAUUUAGCUUCUUACU | 22 | 15916 |
| CFTR-Intron2-817 | - | GUCUGUAUUGCCUUGCUCUCU | 21 | 15917 |
| CFTR-Intron2-818 | - | GGUCUGUAUUGCCUUGCUCUCU | 22 | 15918 |
| CFTR-Intron2-819 | - | GAGGUCUGUAUUGCCUUGCUCUCU | 24 | 15919 |
| CFTR-Intron2-820 | - | GUUUCCUUUCCAAUCAAAAGGU | 22 | 15920 |
| CFTR-Intron2-821 | - | GCCCCGGCCUAUUACUCCUU | 20 | 15921 |
| CFTR-Intron2-822 | - | GUCAGGAUAUGAACUUUUU | 19 | 15922 |
| CFTR-Intron2-823 | - | GUAGUCAGGAUAUGAACUUUUU | 22 | 15923 |

Table 38B provides exemplary targeting domains for correcting a mutation (e.g., 3272-26→G) in the CFTR gene selected according to the second tier parameters. The targeting domains bind within intron 2, have a high level of orthogonality and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 38B

| gRNA Name | DNA Strand | Targeting Domain | Target Site Length | Seq ID |
|---|---|---|---|---|
| | | 2nd Tier | | |
| CFTR-Intron2-824 | + | UAGCUAUGAAAGAAAAAA | 18 | 15924 |
| CFTR-Intron2-825 | + | UUAGCUAUGAAAGAAAAAA | 19 | 15925 |
| CFTR-Intron2-826 | + | UGUACAUAAACCAACAAA | 18 | 15926 |
| CFTR-Intron2-827 | + | UGUGUACAUAAACCAACAAA | 20 | 15927 |
| CFTR-Intron2-828 | + | UUAUUUACUUAAGCUAGUAAA | 21 | 15928 |
| CFTR-Intron2-829 | + | UUUAUUUACUUAAGCUAGUAAA | 22 | 15929 |
| CFTR-Intron2-830 | + | UUUUAUUUACUUAAGCUAGUAAA | 23 | 15930 |
| CFTR-Intron2-831 | + | CUUUUAUUUACUUAAGCUAGUAAA | 24 | 15931 |
| CFTR-Intron2-832 | + | CCUUUUUUCUCUUCACAA | 18 | 15932 |
| CFTR-Intron2-233 | + | AGCCUUUUUUCUCUUCACAA | 20 | 15333 |
| CFTR-Intron2-833 | + | AAGCCUUUUUUCUCUUCACAA | 21 | 15933 |
| CFTR-Intron2-834 | + | AAAGCCUUUUUUCUCUUCACAA | 22 | 15934 |
| CFTR-Intron2-835 | + | UGAAAGCCUUUUUUCUCUUCACAA | 24 | 15935 |
| CFTR-Intron2-836 | + | ACCUUCUCCAUCAAAGGAGAA | 21 | 15936 |
| CFTR-Intron2-837 | + | CACCUUCUCCAUCAAAGGAGAA | 22 | 15937 |
| CFTR-Intron2-838 | + | UCACCUUCUCCAUCAAAGGAGAA | 23 | 15938 |
| CFTR-Intron2-839 | + | CUCACCUUCUCCAUCAAAGGAGAA | 24 | 15939 |
| CFTR-Intron2-840 | + | UGGCUCUAAAUCACUCUAA | 19 | 15940 |
| CFTR-Intron2-250 | + | AUGGCUCUAAAUCACUCUAA | 20 | 15350 |
| CFTR-Intron2-841 | + | CAUGGCUCUAAAUCACUCUAA | 21 | 15941 |
| CFTR-Intron2-842 | + | ACAUGGCUCUAAAUCACUCUAA | 22 | 15942 |
| CFTR-Intron2-843 | + | AACAUGGCUCUAAAUCACUCUAA | 23 | 15943 |
| CFTR-Intron2-844 | + | AAACAUGGCUCUAAAUCACUCUAA | 24 | 15944 |
| CFTR-Intron2-845 | + | UAGACUAUGAGUGGCCCA | 18 | 15945 |
| CFTR-Intron2-846 | + | CUAGACUAUGAGUGGCCCA | 19 | 15946 |
| CFTR-Intron2-261 | + | UCUAGACUAUGAGUGGCCCA | 20 | 15361 |
| CFTR-Intron2-847 | + | UUCUAGACUAUGAGUGGCCCA | 21 | 15947 |
| CFTR-Intron2-848 | + | AUUCUAGACUAUGAGUGGCCCA | 22 | 15948 |
| CFTR-Intron2-849 | + | CAUUCUAGACUAUGAGUGGCCCA | 23 | 15949 |
| CFTR-Intron2-850 | + | UCAUUCUAGACUAUGAGUGGCCCA | 24 | 15950 |
| CFTR-Intron2-851 | + | UUUGAGUCCUUGGUCCCA | 18 | 15951 |
| CFTR-Intron2-852 | + | AUUUGAGUCCUUGGUCCCA | 19 | 15952 |
| CFTR-Intron2-853 | + | CAUUUGAGUCCUUGGUCCCA | 20 | 15953 |
| CFTR-Intron2-854 | + | UGGCAUUUGAGUCCUUGGUCCCA | 23 | 15954 |
| CFTR-Intron2-855 | + | UUACCUUAAGACUUCCCA | 18 | 15955 |
| CFTR-Intron2-856 | + | AUUACCUUAAGACUUCCCA | 19 | 15956 |
| CFTR-Intron2-263 | + | CAUUACCUUAAGACUUCCCA | 20 | 15363 |

TABLE 38B-continued

| | | 2nd Tier | | |
|---|---|---|---|---|
| gRNA Name | DNA Strand | Targeting Domain | Target Site Length | Seq ID |
| CFTR-Intron2-857 | + | CCAUUACCUUAAGACUUCCCA | 21 | 15957 |
| CFTR-Intron2-858 | + | AGCCAUUACCUUAAGACUUCCCA | 23 | 15958 |
| CFTR-Intron2-859 | + | UAGCCAUUACCUUAAGACUUCCCA | 24 | 15959 |
| CFTR-Intron2-860 | + | AGAGAGACCAGGAGAGCA | 18 | 15960 |
| CFTR-Intron2-861 | + | UAGAGAGACCAGGAGAGCA | 19 | 15961 |
| CFTR-Intron2-862 | + | UCCUUAAAGAUAGGAGCA | 18 | 15962 |
| CFTR-Intron2-863 | + | UGGUCCUUAAAGAUAGGAGCA | 21 | 15963 |
| CFTR-Intron2-864 | + | CGUGGUCCUUAAAGAUAGGAGCA | 23 | 15964 |
| CFTR-Intron2-865 | + | UCGUGGUCCUUAAAGAUAGGAGCA | 24 | 15965 |
| CFTR-Intron2-866 | + | CUUGUCAAUAUACCUGCA | 18 | 15966 |
| CFTR-Intron2-867 | + | ACUUGUCAAUAUACCUGCA | 19 | 15967 |
| CFTR-Intron2-868 | + | AACUUGUCAAUAUACCUGCA | 20 | 15968 |
| CFTR-Intron2-869 | + | UGAACUUGUCAAUAUACCUGCA | 22 | 15969 |
| CFTR-Intron2-870 | + | UUGAACUUGUCAAUAUACCUGCA | 23 | 15970 |
| CFTR-Intron2-871 | + | UUUGAACUUGUCAAUAUACCUGCA | 24 | 15971 |
| CFTR-Intron2-872 | + | AGAUGGGAAAGCCAAGGA | 18 | 15972 |
| CFTR-Intron2-873 | + | CAGAUGGGAAAGCCAAGGA | 19 | 15973 |
| CFTR-Intron2-280 | + | UCAGAUGGGAAAGCCAAGGA | 20 | 15380 |
| CFTR-Intron2-874 | + | CCUGACUACAAUCUUGGA | 18 | 15974 |
| CFTR-Intron2-875 | + | UCCUGACUACAAUCUUGGA | 19 | 15975 |
| CFTR-Intron2-876 | + | AUCCUGACUACAAUCUUGGA | 20 | 15976 |
| CFTR-Intron2-877 | + | UAUCCUGACUACAAUCUUGGA | 21 | 15977 |
| CFTR-Intron2-878 | + | AUAUCCUGACUACAAUCUUGGA | 22 | 15978 |
| CFTR-Intron2-879 | + | CAUAUCCUGACUACAAUCUUGGA | 23 | 15979 |
| CFTR-Intron2-880 | + | UCAUAUCCUGACUACAAUCUUGGA | 24 | 15980 |
| CFTR-Intron2-881 | + | UGCACACUGCAGUUAUGUA | 19 | 15981 |
| CFTR-Intron2-882 | + | UUGCACACUGCAGUUAUGUA | 20 | 15982 |
| CFTR-Intron2-883 | + | UUUGCACACUGCAGUUAUGUA | 21 | 15983 |
| CFTR-Intron2-884 | + | UGGUUUGCACACUGCAGUUAUGUA | 24 | 15984 |
| CFTR-Intron2-885 | + | AGGUCGGGGAAUUUCUUUA | 19 | 15985 |
| CFTR-Intron2-886 | + | AAGGUCGGGGAAUUUCUUUA | 20 | 15986 |
| CFTR-Intron2-887 | + | CAAGGUCGGGGAAUUUCUUUA | 21 | 15987 |
| CFTR-Intron2-888 | + | AGGCAAGGUCGGGGAAUUUCUUUA | 24 | 15988 |
| CFTR-Intron2-889 | + | CCACAAAUUGUUAGCACC | 18 | 15989 |
| CFTR-Intron2-890 | + | UGCCACAAAUUGUUAGCACC | 20 | 15990 |
| CFTR-Intron2-891 | + | UGGUGCCACAAAUUGUUAGCACC | 23 | 15991 |
| CFTR-Intron2-892 | + | UUGGUGCCACAAAUUGUUAGCACC | 24 | 15992 |

TABLE 38B-continued

| | | 2nd Tier | | |
|---|---|---|---|---|
| gRNA Name | DNA Strand | Targeting Domain | Target Site Length | Seq ID |
| CFTR-Intron2-893 | + | AAGCCAGGGUCACUUCCC | 18 | 15993 |
| CFTR-Intron2-894 | + | UGAAGCCAGGGUCACUUCCC | 20 | 15994 |
| CFTR-Intron2-895 | + | UGUGAAGCCAGGGUCACUUCCC | 22 | 15995 |
| CFTR-Intron2-896 | + | AUGUGAAGCCAGGGUCACUUCCC | 23 | 15996 |
| CFTR-Intron2-897 | + | AAUGUGAAGCCAGGGUCACUUCCC | 24 | 15997 |
| CFTR-Intron2-898 | + | AGUUAUGAAAUGUGAAGC | 18 | 15998 |
| CFTR-Intron2-899 | + | CAGUUAUGAAAUGUGAAGC | 19 | 15999 |
| CFTR-Intron2-900 | + | AGGCAGUUAUGAAAUGUGAAGC | 22 | 16000 |
| CFTR-Intron2-901 | + | AAGGCAGUUAUGAAAUGUGAAGC | 23 | 16001 |
| CFTR-Intron2-902 | + | CAAGGCAGUUAUGAAAUGUGAAGC | 24 | 16002 |
| CFTR-Intron2-903 | + | AGCCUGGCAAUCUCUAAGC | 19 | 16003 |
| CFTR-Intron2-904 | + | AAGCCUGGCAAUCUCUAAGC | 20 | 16004 |
| CFTR-Intron2-905 | + | CAAGCCUGGCAAUCUCUAAGC | 21 | 16005 |
| CFTR-Intron2-906 | + | ACAAGCCUGGCAAUCUCUAAGC | 22 | 16006 |
| CFTR-Intron2-907 | + | AGACAAGCCUGGCAAUCUCUAAGC | 24 | 16007 |
| CFTR-Intron2-908 | + | AGGCAAUACAGACCUCAGC | 19 | 16008 |
| CFTR-Intron2-322 | + | AAGGCAAUACAGACCUCAGC | 20 | 15422 |
| CFTR-Intron2-909 | + | CAAGGCAAUACAGACCUCAGC | 21 | 16009 |
| CFTR-Intron2-910 | + | AGCAAGGCAAUACAGACCUCAGC | 23 | 16010 |
| CFTR-Intron2-911 | + | AGCCAUUUCACAUUCCAUC | 19 | 16011 |
| CFTR-Intron2-912 | + | UAGCCAUUUCACAUUCCAUC | 20 | 16012 |
| CFTR-Intron2-913 | + | CUAGCCAUUUCACAUUCCAUC | 21 | 16013 |
| CFTR-Intron2-914 | + | UGCUAGCCAUUUCACAUUCCAUC | 23 | 16014 |
| CFTR-Intron2-915 | + | AUGCUAGCCAUUUCACAUUCCAUC | 24 | 16015 |
| CFTR-Intron2-916 | + | AGGGGUAAGCACUAUGACUC | 20 | 16016 |
| CFTR-Intron2-917 | + | AAGGGGUAAGCACUAUGACUC | 21 | 16017 |
| CFTR-Intron2-918 | + | CAAGGGGUAAGCACUAUGACUC | 22 | 16018 |
| CFTR-Intron2-919 | + | CCAAGGGGUAAGCACUAUGACUC | 23 | 16019 |
| CFTR-Intron2-920 | + | CCCAAGGGGUAAGCACUAUGACUC | 24 | 16020 |
| CFTR-Intron2-921 | + | CUAUGACUCAAGAGUCUC | 18 | 16021 |
| CFTR-Intron2-922 | + | ACUAUGACUCAAGAGUCUC | 19 | 16022 |
| CFTR-Intron2-331 | + | CACUAUGACUCAAGAGUCUC | 20 | 15431 |
| CFTR-Intron2-923 | + | AGCACUAUGACUCAAGAGUCUC | 22 | 16023 |
| CFTR-Intron2-924 | + | AAGCACUAUGACUCAAGAGUCUC | 23 | 16024 |
| CFTR-Intron2-925 | + | UAAGCACUAUGACUCAAGAGUCUC | 24 | 16025 |
| CFTR-Intron2-926 | + | UGAGGAGAAGGCAAGGUCG | 19 | 16026 |
| CFTR-Intron2-349 | + | CUGAGGAGAAGGCAAGGUCG | 20 | 15449 |

TABLE 38B-continued

| | | 2nd Tier | | |
|---|---|---|---|---|
| gRNA Name | DNA Strand | Targeting Domain | Target Site Length | Seq ID |
| CFTR-Intron2-927 | + | UUAAAUUGAAUCAACAUG | 18 | 16027 |
| CFTR-Intron2-928 | + | UUUAAAUUGAAUCAACAUG | 19 | 16028 |
| CFTR-Intron2-358 | + | UUUUAAAUUGAAUCAACAUG | 20 | 15458 |
| CFTR-Intron2-929 | + | UGUACUGGCAUAGCAUUG | 18 | 16029 |
| CFTR-Intron2-930 | + | UUGUACUGGCAUAGCAUUG | 19 | 16030 |
| CFTR-Intron2-931 | + | UUUGUACUGGCAUAGCAUUG | 20 | 16031 |
| CFTR-Intron2-932 | + | UGGGUUUGUACUGGCAUAGCAUUG | 24 | 16032 |
| CFTR-Intron2-933 | + | AGGCAAAUGCCACCAGGUGGCAU | 23 | 16033 |
| CFTR-Intron2-934 | + | AAGGCAAAUGCCACCAGGUGGCAU | 24 | 16034 |
| CFTR-Intron2-935 | + | AUAAUGAUGCUUUCCACU | 18 | 16035 |
| CFTR-Intron2-936 | + | AGAUAAUGAUGCUUUCCACU | 20 | 16036 |
| CFTR-Intron2-937 | + | CCUAGUUCAUUCUAGACU | 18 | 16037 |
| CFTR-Intron2-938 | + | AGCCUAGUUCAUUCUAGACU | 20 | 16038 |
| CFTR-Intron2-939 | + | CAGCCUAGUUCAUUCUAGACU | 21 | 16039 |
| CFTR-Intron2-940 | + | UCAGCCUAGUUCAUUCUAGACU | 22 | 16040 |
| CFTR-Intron2-941 | + | CUCAGCCUAGUUCAUUCUAGACU | 23 | 16041 |
| CFTR-Intron2-942 | + | ACUCAGCCUAGUUCAUUCUAGACU | 24 | 16042 |
| CFTR-Intron2-943 | + | CCAUAACAUUUGGUUACU | 18 | 16043 |
| CFTR-Intron2-944 | + | UCCAUAACAUUUGGUUACU | 19 | 16044 |
| CFTR-Intron2-945 | + | AUCCAUAACAUUUGGUUACU | 20 | 16045 |
| CFTR-Intron2-946 | + | CAUCCAUAACAUUUGGUUACU | 21 | 16046 |
| CFTR-Intron2-947 | + | CCAUCCAUAACAUUUGGUUACU | 22 | 16047 |
| CFTR-Intron2-948 | + | CCCAUCCAUAACAUUUGGUUACU | 23 | 16048 |
| CFTR-Intron2-949 | + | UCCCAUCCAUAACAUUUGGUUACU | 24 | 16049 |
| CFTR-Intron2-950 | + | UCCCACUAGCUUAAUUCU | 18 | 16050 |
| CFTR-Intron2-951 | + | CUCCCACUAGCUUAAUUCU | 19 | 16051 |
| CFTR-Intron2-952 | + | ACUCCCACUAGCUUAAUUCU | 20 | 16052 |
| CFTR-Intron2-953 | + | UACUCCCACUAGCUUAAUUCU | 21 | 16053 |
| CFTR-Intron2-954 | + | CUACUCCCACUAGCUUAAUUCU | 22 | 16054 |
| CFTR-Intron2-955 | + | UGCUACUCCCACUAGCUUAAUUCU | 24 | 16055 |
| CFTR-Intron2-956 | + | UGGCCCUUGAUCUUAGAAGU | 20 | 16056 |
| CFTR-Intron2-957 | + | CUGGCCCUUGAUCUUAGAAGU | 21 | 16057 |
| CFTR-Intron2-958 | + | AGCUGGCCCUUGAUCUUAGAAGU | 23 | 16058 |
| CFTR-Intron2-959 | + | AAGCUGGCCCUUGAUCUUAGAAGU | 24 | 16059 |
| CFTR-Intron2-960 | − | ACCAGCUUUCUACAUAAA | 18 | 16060 |
| CFTR-Intron2-961 | − | CGGACCAGCUUUCUACAUAAA | 21 | 16061 |
| CFTR-Intron2-962 | − | CCGGACCAGCUUUCUACAUAAA | 22 | 16062 |

TABLE 38B-continued

2nd Tier

| gRNA Name | DNA Strand | Targeting Domain | Target Site Length | Seq ID |
|---|---|---|---|---|
| CFTR-Intron2-963 | − | ACCGGACCAGCUUUCUACAUAAA | 23 | 16063 |
| CFTR-Intron2-964 | − | AGGCCUGAUGCCAGAUAA | 18 | 16064 |
| CFTR-Intron2-965 | − | CAGGCCUGAUGCCAGAUAA | 19 | 16065 |
| CFTR-Intron2-966 | − | ACAGGCCUGAUGCCAGAUAA | 20 | 16066 |
| CFTR-Intron2-967 | − | CACAGGCCUGAUGCCAGAUAA | 21 | 16067 |
| CFTR-Intron2-968 | − | AGCACAGGCCUGAUGCCAGAUAA | 23 | 16068 |
| CFTR-Intron2-969 | − | CAGCACAGGCCUGAUGCCAGAUAA | 24 | 16069 |
| CFTR-Intron2-970 | − | CUUUGAAUAUCUAAGUUUUAA | 21 | 16070 |
| CFTR-Intron2-971 | − | AGCUUUGAAUAUCUAAGUUUUAA | 23 | 16071 |
| CFTR-Intron2-972 | − | CAGCUUUGAAUAUCUAAGUUUUAA | 24 | 16072 |
| CFTR-Intron2-973 | − | UGCACCAAAGUAAAAACA | 18 | 16073 |
| CFTR-Intron2-974 | − | UUGCACCAAAGUAAAAACA | 19 | 16074 |
| CFTR-Intron2-975 | − | AUUGCACCAAAGUAAAAACA | 20 | 16075 |
| CFTR-Intron2-976 | − | UAUUGCACCAAAGUAAAAACA | 21 | 16076 |
| CFTR-Intron2-977 | − | UUAUUGCACCAAAGUAAAAACA | 22 | 16077 |
| CFTR-Intron2-978 | − | AUUAUUGCACCAAAGUAAAAACA | 23 | 16078 |
| CFTR-Intron2-979 | − | AAUUAUUGCACCAAAGUAAAAACA | 24 | 16079 |
| CFTR-Intron2-980 | − | AAAAAUACACAUUUGGUUUCA | 21 | 16080 |
| CFTR-Intron2-981 | − | UGAAAAAUACACAUUUGGUUUCA | 23 | 16081 |
| CFTR-Intron2-982 | − | CUGAAAAAUACACAUUUGGUUUCA | 24 | 16082 |
| CFTR-Intron2-983 | − | CUUAAGUAAAUAAAAGGA | 18 | 16083 |
| CFTR-Intron2-984 | − | AGCUUAAGUAAAUAAAAGGA | 20 | 16084 |
| CFTR-Intron2-985 | − | CAAUUUUGUGACCAUGGA | 18 | 16085 |
| CFTR-Intron2-986 | − | UCAAUUUUGUGACCAUGGA | 19 | 16086 |
| CFTR-Intron2-987 | − | CUCAAUUUUGUGACCAUGGA | 20 | 16087 |
| CFTR-Intron2-988 | − | UGGCUCAAUUUUGUGACCAUGGA | 23 | 16088 |
| CFTR-Intron2-989 | − | CUGGCUCAAUUUUGUGACCAUGGA | 24 | 16089 |
| CFTR-Intron2-990 | − | AGUUUUAAUUGGAUGCUGA | 19 | 16090 |
| CFTR-Intron2-282 | − | AAGUUUUAAUUGGAUGCUGA | 20 | 15382 |
| CFTR-Intron2-991 | − | UAAGUUUUAAUUGGAUGCUGA | 21 | 16091 |
| CFTR-Intron2-992 | − | CUAAGUUUUAAUUGGAUGCUGA | 22 | 16092 |
| CFTR-Intron2-993 | − | UCUAAGUUUUAAUUGGAUGCUGA | 23 | 16093 |
| CFTR-Intron2-994 | − | AUCUAAGUUUUAAUUGGAUGCUGA | 24 | 16094 |
| CFTR-Intron2-995 | − | AUGGUAGUCCCCCCCAUA | 18 | 16095 |
| CFTR-Intron2-996 | − | AAUGGUAGUCCCCCCCAUA | 19 | 16096 |
| CFTR-Intron2-997 | − | AGGAAUGGUAGUCCCCCCCAUA | 22 | 16097 |
| CFTR-Intron2-998 | − | UAGGAAUGGUAGUCCCCCCCAUA | 23 | 16098 |

TABLE 38B-continued

| | | 2nd Tier | | |
|---|---|---|---|---|
| gRNA Name | DNA Strand | Targeting Domain | Target Site Length | Seq ID |
| CFTR-Intron2-999 | − | CUAGGAAUGGUAGUCCCCCCAUA | 24 | 16099 |
| CFTR-Intron2-1000 | − | CAAGUUCAAAAUAAUAUA | 18 | 16100 |
| CFTR-Intron2-1001 | − | ACAAGUUCAAAAUAAUAUA | 19 | 16101 |
| CFTR-Intron2-1002 | − | UGACAAGUUCAAAAUAAUAUA | 21 | 16102 |
| CFTR-Intron2-1003 | − | UUGACAAGUUCAAAAUAAUAUA | 22 | 16103 |
| CFTR-Intron2-1004 | − | AUUGACAAGUUCAAAAUAAUAUA | 23 | 16104 |
| CFTR-Intron2-1005 | − | UAUUGACAAGUUCAAAAUAAUAUA | 24 | 16105 |
| CFTR-Intron2-1006 | − | CUCAUUAGCAAGCUUCUA | 18 | 16106 |
| CFTR-Intron2-1007 | − | UCUCAUUAGCAAGCUUCUA | 19 | 16107 |
| CFTR-Intron2-290 | − | CUCUCAUUAGCAAGCUUCUA | 20 | 15390 |
| CFTR-Intron2-1008 | − | AGGGCUCUCAUUAGCAAGCUUCUA | 24 | 16108 |
| CFTR-Intron2-1009 | − | AAAAUAAUAUAAUGGGUA | 18 | 16109 |
| CFTR-Intron2-1010 | − | CAAAAUAAUAUAAUGGGUA | 19 | 16110 |
| CFTR-Intron2-1011 | − | UCAAAAUAAUAUAAUGGGUA | 20 | 16111 |
| CFTR-Intron2-1012 | − | UUCAAAAUAAUAUAAUGGGUA | 21 | 16112 |
| CFTR-Intron2-1013 | − | AGUUCAAAAUAAUAUAAUGGGUA | 23 | 16113 |
| CFTR-Intron2-1014 | − | AAGUUCAAAAUAAUAUAAUGGGUA | 24 | 16114 |
| CFTR-Intron2-1015 | − | AAUAUACUUUGCCAGUUA | 18 | 16115 |
| CFTR-Intron2-1016 | − | UAAUAUACUUUGCCAGUUA | 19 | 16116 |
| CFTR-Intron2-1017 | − | AUAAUAUACUUUGCCAGUUA | 20 | 16117 |
| CFTR-Intron2-1018 | − | AGAUAAUAUACUUUGCCAGUUA | 22 | 16118 |
| CFTR-Intron2-1019 | − | AGAGAUAAUAUACUUUGCCAGUUA | 24 | 16119 |
| CFTR-Intron2-1020 | − | UAUGGCCAGAUAGAGAAC | 18 | 16120 |
| CFTR-Intron2-1021 | − | UUAUGGCCAGAUAGAGAAC | 19 | 16121 |
| CFTR-Intron2-1022 | − | UUUAUGGCCAGAUAGAGAAC | 20 | 16122 |
| CFTR-Intron2-1023 | − | AUUUAUGGCCAGAUAGAGAAC | 21 | 16123 |
| CFTR-Intron2-1024 | − | UAUUUAUGGCCAGAUAGAGAAC | 22 | 16124 |
| CFTR-Intron2-1025 | − | UGUAUUUAUGGCCAGAUAGAGAAC | 24 | 16125 |
| CFTR-Intron2-1026 | − | UGGCUCAAUUUUGUGACC | 18 | 16126 |
| CFTR-Intron2-1027 | − | CUGGCUCAAUUUUGUGACC | 19 | 16127 |
| CFTR-Intron2-1028 | − | UCUGGCUCAAUUUUGUGACC | 20 | 16128 |
| CFTR-Intron2-1029 | − | AUCUGGCUCAAUUUUGUGACC | 21 | 16129 |
| CFTR-Intron2-1030 | − | UAUCUGGCUCAAUUUUGUGACC | 22 | 16130 |
| CFTR-Intron2-1031 | − | CUAUCUGGCUCAAUUUUGUGACC | 23 | 16131 |
| CFTR-Intron2-1032 | − | CCUAUCUGGCUCAAUUUUGUGACC | 24 | 16132 |
| CFTR-Intron2-1033 | − | UGAUGUAUCCCCAAGUGCC | 19 | 16133 |
| CFTR-Intron2-1034 | − | AUGAUGUAUCCCCAAGUGCC | 20 | 16134 |

TABLE 38B-continued

| gRNA Name | DNA Strand | Targeting Domain | Target Site Length | Seq ID |
|---|---|---|---|---|
| | | 2nd Tier | | |
| CFTR-Intron2-1035 | − | UCCUAAAACUACAUUGCC | 18 | 16135 |
| CFTR-Intron2-1036 | − | UUCCUAAAACUACAUUGCC | 19 | 16136 |
| CFTR-Intron2-1037 | − | UGUUCCUAAAACUACAUUGCC | 21 | 16137 |
| CFTR-Intron2-1038 | − | AUGUUCCUAAAACUACAUUGCC | 22 | 16138 |
| CFTR-Intron2-1039 | − | CAUGUUCCUAAAACUACAUUGCC | 23 | 16139 |
| CFTR-Intron2-1040 | − | CCAUGUUCCUAAAACUACAUUGCC | 24 | 16140 |
| CFTR-Intron2-1041 | − | UGAAAAAUCCCAGAGACUC | 19 | 16141 |
| CFTR-Intron2-1042 | − | UGUGAAAAAUCCCAGAGACUC | 21 | 16142 |
| CFTR-Intron2-1043 | − | AUGUGAAAAAUCCCAGAGACUC | 22 | 16143 |
| CFTR-Intron2-1044 | − | AAUGUGAAAAAUCCCAGAGACUC | 23 | 16144 |
| CFTR-Intron2-1045 | − | AAAUGUGAAAAAUCCCAGAGACUC | 24 | 16145 |
| CFTR-Intron2-1046 | − | CUUGGGCCACUCAUAGUC | 18 | 16146 |
| CFTR-Intron2-1047 | − | CCUUGGGCCACUCAUAGUC | 19 | 16147 |
| CFTR-Intron2-1048 | − | CCCUUGGGCCACUCAUAGUC | 20 | 16148 |
| CFTR-Intron2-1049 | − | CCCCUUGGGCCACUCAUAGUC | 21 | 16149 |
| CFTR-Intron2-1050 | − | ACCCCUUGGGCCACUCAUAGUC | 22 | 16150 |
| CFTR-Intron2-1051 | − | UACCCCUUGGGCCACUCAUAGUC | 23 | 16151 |
| CFTR-Intron2-1052 | − | UUACCCCUUGGGCCACUCAUAGUC | 24 | 16152 |
| CFTR-Intron2-1053 | − | AUUUCUCCUUUGAUGGAGAAG | 21 | 16153 |
| CFTR-Intron2-1054 | − | CAUUUCUCCUUUGAUGGAGAAG | 22 | 16154 |
| CFTR-Intron2-1055 | − | CCAUUUCUCCUUUGAUGGAGAAG | 23 | 16155 |
| CFTR-Intron2-1056 | − | UCCAUUUCUCCUUUGAUGGAGAAG | 24 | 16156 |
| CFTR-Intron2-1057 | − | CAGAUAAAAGGGUGAGUGAAG | 21 | 16157 |
| CFTR-Intron2-1058 | − | CCAGAUAAAAGGGUGAGUGAAG | 22 | 16158 |
| CFTR-Intron2-1059 | − | UGCCAGAUAAAAGGGUGAGUGAAG | 24 | 16159 |
| CFTR-Intron2-1060 | − | CUUAUUAGAGACCAUGAG | 18 | 16160 |
| CFTR-Intron2-1061 | − | UCUUAUUAGAGACCAUGAG | 19 | 16161 |
| CFTR-Intron2-1062 | − | UGUCUUAUUAGAGACCAUGAG | 21 | 16162 |
| CFTR-Intron2-1063 | − | UUGUCUUAUUAGAGACCAUGAG | 22 | 16163 |
| CFTR-Intron2-1064 | − | UUUGUCUUAUUAGAGACCAUGAG | 23 | 16164 |
| CFTR-Intron2-1065 | − | AUUUGUCUUAUUAGAGACCAUGAG | 24 | 16165 |
| CFTR-Intron2-1066 | − | CUGAUGCCAGAUAAAAGG | 18 | 16166 |
| CFTR-Intron2-1067 | − | CCUGAUGCCAGAUAAAAGG | 19 | 16167 |
| CFTR-Intron2-1068 | − | UACCUGUUACAUGCCAGG | 18 | 16168 |
| CFTR-Intron2-1069 | − | AGUACCUGUUACAUGCCAGG | 20 | 16169 |
| CFTR-Intron2-1070 | − | UGAGUACCUGUUACAUGCCAGG | 22 | 16170 |
| CFTR-Intron2-1071 | − | UUGAGUACCUGUUACAUGCCAGG | 23 | 16171 |

TABLE 38B-continued

2nd Tier

| gRNA Name | DNA Strand | Targeting Domain | Target Site Length | Seq ID |
|---|---|---|---|---|
| CFTR-Intron2-1072 | – | UUUGAGUACCUGUUACAUGCCAGG | 24 | 16172 |
| CFTR-Intron2-1073 | – | AGUCUAGAAUGAACUAGG | 18 | 16173 |
| CFTR-Intron2-1074 | – | UAGUCUAGAAUGAACUAGG | 19 | 16174 |
| CFTR-Intron2-1075 | – | AUAGUCUAGAAUGAACUAGG | 20 | 16175 |
| CFTR-Intron2-1076 | – | CAUAGUCUAGAAUGAACUAGG | 21 | 16176 |
| CFTR-Intron2-1077 | – | UCAUAGUCUAGAAUGAACUAGG | 22 | 16177 |
| CFTR-Intron2-1078 | – | CUCAUAGUCUAGAAUGAACUAGG | 23 | 16178 |
| CFTR-Intron2-1079 | – | ACUCAUAGUCUAGAAUGAACUAGG | 24 | 16179 |
| CFTR-Intron2-1080 | – | UGAUUAAUCAGAGUAGGG | 18 | 16180 |
| CFTR-Intron2-1081 | – | AUGAUUAAUCAGAGUAGGG | 19 | 16181 |
| CFTR-Intron2-1082 | – | AAUGAUUAAUCAGAGUAGGG | 20 | 16182 |
| CFTR-Intron2-1083 | – | AGGGAAUGAUUAAUCAGAGUAGGG | 24 | 16183 |
| CFTR-Intron2-1084 | – | UUUAUUGAAAUAUUUUGG | 18 | 16184 |
| CFTR-Intron2-1085 | – | AUUUAUUGAAAUAUUUUGG | 19 | 16185 |
| CFTR-Intron2-1086 | – | AAUUUAUUGAAAUAUUUUGG | 20 | 16186 |
| CFTR-Intron2-1087 | – | AACAUGAAUCUGAAUUUG | 18 | 16187 |
| CFTR-Intron2-1088 | – | AGAACAUGAAUCUGAAUUUG | 20 | 16188 |
| CFTR-Intron2-1089 | – | CAGAUAGAGAACAUGAAU | 18 | 16189 |
| CFTR-Intron2-1090 | – | CCAGAUAGAGAACAUGAAU | 19 | 16190 |
| CFTR-Intron2-1091 | – | UGGUAACUUGACAGUAAU | 18 | 16191 |
| CFTR-Intron2-1092 | – | AUGGUAACUUGACAGUAAU | 19 | 16192 |
| CFTR-Intron2-373 | – | UAUGGUAACUUGACAGUAAU | 20 | 15473 |
| CFTR-Intron2-1093 | – | UUAUGGUAACUUGACAGUAAU | 21 | 16193 |
| CFTR-Intron2-1094 | – | CUUAUGGUAACUUGACAGUAAU | 22 | 16194 |
| CFTR-Intron2-1095 | – | ACUUAUGGUAACUUGACAGUAAU | 23 | 16195 |
| CFTR-Intron2-1096 | – | UACUUAUGGUAACUUGACAGUAAU | 24 | 16196 |
| CFTR-Intron2-1097 | – | UGGAUGCUGAGGGAAUGAUUAAU | 23 | 16197 |
| CFTR-Intron2-1098 | – | UUGGAUGCUGAGGGAAUGAUUAAU | 24 | 16198 |
| CFTR-Intron2-1099 | – | CUUUCAAAACCUUUAUAU | 18 | 16199 |
| CFTR-Intron2-1100 | – | UGCUUUCAAAACCUUUAUAU | 20 | 16200 |
| CFTR-Intron2-1101 | – | UAUCUCCUCUCAGCCACU | 18 | 16201 |
| CFTR-Intron2-1102 | – | AUAUCUCCUCUCAGCCACU | 19 | 16202 |
| CFTR-Intron2-1103 | – | AAUAUCUCCUCUCAGCCACU | 20 | 16203 |
| CFTR-Intron2-1104 | – | AGAAUAUCUCCUCUCAGCCACU | 22 | 16204 |
| CFTR-Intron2-1105 | – | UAGAAUAUCUCCUCUCAGCCACU | 23 | 16205 |
| CFTR-Intron2-1106 | – | CAUAUUUAGCUUCUUACU | 18 | 16206 |
| CFTR-Intron2-1107 | – | CCAUAUUUAGCUUCUUACU | 19 | 16207 |

TABLE 38B-continued

| | 2nd Tier | | | |
|---|---|---|---|---|
| gRNA Name | DNA Strand | Targeting Domain | Target Site Length | Seq ID |
| CFTR-Intron2-1108 | − | UCCAUAUUUAGCUUCUUACU | 20 | 16208 |
| CFTR-Intron2-1109 | − | CUCCAUAUUUAGCUUCUUACU | 21 | 16209 |
| CFTR-Intron2-1110 | − | UGCUCCAUAUUUAGCUUCUUACU | 23 | 16210 |
| CFTR-Intron2-1111 | − | CUGCUCCAUAUUUAGCUUCUUACU | 24 | 16211 |
| CFTR-Intron2-1112 | − | UGUAUUGCCUUGCUCUCU | 18 | 16212 |
| CFTR-Intron2-1113 | − | CUGUAUUGCCUUGCUCUCU | 19 | 16213 |
| CFTR-Intron2-399 | − | UCUGUAUUGCCUUGCUCUCU | 20 | 15499 |
| CFTR-Intron2-1114 | − | AGGUCUGUAUUGCCUUGCUCUCU | 23 | 16214 |
| CFTR-Intron2-1115 | − | UCAAAGAAUUAAGCUAGU | 18 | 16215 |
| CFTR-Intron2-1116 | − | UUCAAAGAAUUAAGCUAGU | 19 | 16216 |
| CFTR-Intron2-404 | − | AUUCAAAGAAUUAAGCUAGU | 20 | 15504 |
| CFTR-Intron2-1117 | − | UAUUCAAAGAAUUAAGCUAGU | 21 | 16217 |
| CFTR-Intron2-1118 | − | UUAUUCAAAGAAUUAAGCUAGU | 22 | 16218 |
| CFTR-Intron2-1119 | − | UUUAUUCAAAGAAUUAAGCUAGU | 23 | 16219 |
| CFTR-Intron2-1120 | − | UUUUAUUCAAAGAAUUAAGCUAGU | 24 | 16220 |
| CFTR-Intron2-1121 | − | CCGUUCCAAGAUUGUAGU | 18 | 16221 |
| CFTR-Intron2-1122 | − | UCCGUUCCAAGAUUGUAGU | 19 | 16222 |
| CFTR-Intron2-1123 | − | AUCCGUUCCAAGAUUGUAGU | 20 | 16223 |
| CFTR-Intron2-1124 | − | CAUCCGUUCCAAGAUUGUAGU | 21 | 16224 |
| CFTR-Intron2-1125 | − | ACAUCCGUUCCAAGAUUGUAGU | 22 | 16225 |
| CFTR-Intron2-1126 | − | CACAUCCGUUCCAAGAUUGUAGU | 23 | 16226 |
| CFTR-Intron2-1127 | − | ACACAUCCGUUCCAAGAUUGUAGU | 24 | 16227 |
| CFTR-Intron2-1128 | − | CCUUUCCAAUCAAAGGU | 18 | 16228 |
| CFTR-Intron2-1129 | − | UCCUUUCCAAUCAAAGGU | 19 | 16229 |
| CFTR-Intron2-1130 | − | UUCCUUUCCAAUCAAAGGU | 20 | 16230 |
| CFTR-Intron2-1131 | − | UUUCCUUUCCAAUCAAAGGU | 21 | 16231 |
| CFTR-Intron2-1132 | − | AGUUUCCUUUCCAAUCAAAGGU | 23 | 16232 |
| CFTR-Intron2-1133 | − | CAGUUUCCUUUCCAAUCAAAGGU | 24 | 16233 |
| CFTR-Intron2-1134 | − | CCCGGCCUAUUACUCCUU | 18 | 16234 |
| CFTR-Intron2-1135 | − | CCCCGGCCUAUUACUCCUU | 19 | 16235 |
| CFTR-Intron2-1136 | − | UGCCCCGGCCUAUUACUCCUU | 21 | 16236 |
| CFTR-Intron2-1137 | − | CUGCCCCGGCCUAUUACUCCUU | 22 | 16237 |
| CFTR-Intron2-1138 | − | ACUGCCCCGGCCUAUUACUCCUU | 23 | 16238 |
| CFTR-Intron2-1139 | − | CACUGCCCCGGCCUAUUACUCCUU | 24 | 16239 |
| CFTR-Intron2-1140 | − | UCUGAGUAACCAAAUGUU | 18 | 16240 |
| CFTR-Intron2-1141 | − | CUCUGAGUAACCAAAUGUU | 19 | 16241 |
| CFTR-Intron2-1142 | − | ACUCUGAGUAACCAAAUGUU | 20 | 16242 |

TABLE 38B-continued

2nd Tier

| gRNA Name | DNA Strand | Targeting Domain | Target Site Length | Seq ID |
|---|---|---|---|---|
| CFTR-Intron2-1143 | - | UACUCUGAGUAACCAAAUGUU | 21 | 16243 |
| CFTR-Intron2-1144 | - | UUACUCUGAGUAACCAAAUGUU | 22 | 16244 |
| CFTR-Intron2-1145 | - | CUUACUCUGAGUAACCAAAUGUU | 23 | 16245 |
| CFTR-Intron2-1146 | - | UCUUACUCUGAGUAACCAAAUGUU | 24 | 16246 |
| CFTR-Intron2-1147 | - | UCAGGAUAUGAACUUUUU | 18 | 16247 |
| CFTR-Intron2-1148 | - | AGUCAGGAUAUGAACUUUUU | 20 | 16248 |
| CFTR-Intron2-1149 | - | UAGUCAGGAUAUGAACUUUUU | 21 | 16249 |
| CFTR-Intron2-1150 | - | UGUAGUCAGGAUAUGAACUUUUU | 23 | 16250 |
| CFTR-Intron2-1151 | - | UUGUAGUCAGGAUAUGAACUUUUU | 24 | 16251 |

Table 38C provides exemplary targeting domains for correcting a mutation (e.g., 3272-26→G) in the CFTR gene selected according to the second tier parameters. The targeting domains bind within intron 2, start with a 5'G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 38C

3rd Tier

| gRNA Name | DNA Strand | Targeting Domain | Target Site Length | Seq ID |
|---|---|---|---|---|
| CFTR-Intron2-1152 | + | GAAUGUUAGCUAUGAAAGAAAAAA | 24 | 16252 |
| CFTR-Intron2-1153 | + | GUAAAAUAGGUAUAUUUUUUAAA | 23 | 16253 |
| CFTR-Intron2-1154 | + | GUUUCUGUCACUGGCAAUCAA | 21 | 16254 |
| CFTR-Intron2-1155 | + | GGUUUCUGUCACUGGCAAUCAA | 22 | 16255 |
| CFTR-Intron2-1156 | + | GGGUUUCUGUCACUGGCAAUCAA | 23 | 16256 |
| CFTR-Intron2-1157 | + | GCUAUGAAAGAAAAAAUAGAA | 21 | 16257 |
| CFTR-Intron2-1158 | + | GAAGUAGAGAGACCAGGAGAGCA | 23 | 16258 |
| CFTR-Intron2-1159 | + | GAUCAGAUGGGAAAGCCAAGGA | 22 | 16259 |
| CFTR-Intron2-1160 | + | GGAUCAGAUGGGAAAGCCAAGGA | 23 | 16260 |
| CFTR-Intron2-1161 | + | GAUUCAUUCAACAAAUAUUUA | 21 | 16261 |
| CFTR-Intron2-1162 | + | GGAUUCAUUCAACAAAUAUUUA | 22 | 16262 |
| CFTR-Intron2-1163 | + | GAUCACACCACUACACUCCAGC | 22 | 16263 |
| CFTR-Intron2-1164 | + | GAGAUCACACCACUACACUCCAGC | 24 | 16264 |
| CFTR-Intron2-1165 | + | GGCAGAUCACUUGAGGUC | 18 | 16265 |
| CFTR-Intron2-1166 | + | GGGCAGAUCACUUGAGGUC | 19 | 16266 |
| CFTR-Intron2-1167 | + | GCGGGCAGAUCACUUGAGGUC | 21 | 16267 |
| CFTR-Intron2-1168 | + | GGCGGGCAGAUCACUUGAGGUC | 22 | 16268 |
| CFTR-Intron2-1169 | + | GUGGGCAGAUCACUUGAGGUC | 21 | 16269 |
| CFTR-Intron2-1170 | + | GGUGGGCAGAUCACUUGAGGUC | 22 | 16270 |
| CFTR-Intron2-1171 | + | GCUACUCGAGAGGCUGAGGCAG | 22 | 16271 |

TABLE 38C-continued

3rd Tier

| gRNA Name | DNA Strand | Targeting Domain | Target Site Length | Seq ID |
|---|---|---|---|---|
| CFTR-Intron2-1172 | + | GAUUCGCUUGAACCCAGGAGG | 21 | 16272 |
| CFTR-Intron2-1173 | + | GAGAUUCGCUUGAACCCAGGAGG | 23 | 16273 |
| CFTR-Intron2-1174 | + | GAGAUAAUGAUGCUUUCCACU | 21 | 16274 |
| CFTR-Intron2-1175 | + | GCCCUAUUCUAGGCACUU | 18 | 16275 |
| CFTR-Intron2-1176 | + | GGCCCUAUUCUAGGCACUU | 19 | 16276 |
| CFTR-Intron2-1177 | + | GCCAGGCCCUAUUCUAGGCACUU | 23 | 16277 |
| CFTR-Intron2-1178 | − | GCAAACUCUGCCUCCUGGGUUCAA | 24 | 16278 |
| CFTR-Intron2-1179 | − | GGCUAAUUUUUGUAGAGA | 18 | 16279 |
| CFTR-Intron2-1180 | − | GCCUGGCUAAUUUUUGUAGAGA | 22 | 16280 |
| CFTR-Intron2-1181 | − | GGCCUGGCUAAUUUUUGUAGAGA | 23 | 16281 |
| CFTR-Intron2-1182 | − | GUUGCUGUUGUUUUUGAGA | 19 | 16282 |
| CFTR-Intron2-1183 | − | GUUGUUGCUGUUGUUUUUGAGA | 22 | 16283 |
| CFTR-Intron2-1184 | − | GUGUUGUUUGUUUUUGAGA | 19 | 16284 |
| CFTR-Intron2-1185 | − | GUUUGUGUUGUUUGUUUUUGAGA | 23 | 16285 |
| CFTR-Intron2-1186 | − | GUUUUGUUUUUUAUUUUUUA | 20 | 16286 |
| CFTR-Intron2-1187 | − | GUUUAUGAUGUAUCCCCAAGUGCC | 24 | 16287 |
| CFTR-Intron2-1188 | − | GUCUCGCUGUGUCACCCAGGC | 21 | 16288 |
| CFTR-Intron2-1189 | − | GAGUCUCGCUGUGUCACCCAGGC | 23 | 16289 |
| CFTR-Intron2-1190 | − | GUCUUGCUCUGUUGCCCAGGC | 21 | 16290 |
| CFTR-Intron2-1191 | − | GAGUCUUGCUCUGUUGCCCAGGC | 23 | 16291 |
| CFTR-Intron2-1192 | − | GCCCACCUUGGCCUCCCAAAAUGC | 24 | 16292 |
| CFTR-Intron2-1193 | − | GAUUCUCCUGCCUCAGCCUC | 20 | 16293 |
| CFTR-Intron2-1194 | − | GUGAUUCUCCUGCCUCAGCCUC | 22 | 16294 |
| CFTR-Intron2-1195 | − | GCUCACUGCAAACUCUGCCUC | 21 | 16295 |
| CFTR-Intron2-1196 | − | GUUCAAGCGAAUCUCAGUCUC | 21 | 16296 |
| CFTR-Intron2-1197 | − | GGUUCAAGCGAAUCUCAGUCUC | 22 | 16297 |
| CFTR-Intron2-1198 | − | GGGUUCAAGCGAAUCUCAGUCUC | 23 | 16298 |
| CFTR-Intron2-1199 | − | GCUCACUGCAAACUUCGUCUC | 21 | 16299 |
| CFTR-Intron2-1200 | − | GGCUCACUGCAAACUUCGUCUC | 22 | 16300 |
| CFTR-Intron2-1201 | − | GAUAAAGGGUGAGUGAAG | 19 | 16301 |
| CFTR-Intron2-1202 | − | GCCUCAGCCUCUCGAGUAG | 19 | 16302 |
| CFTR-Intron2-1203 | − | GGCCUGAUGCCAGAUAAAAGG | 21 | 16303 |
| CFTR-Intron2-1204 | − | GAAAUUUAUUGAAAUAUUUUGG | 22 | 16304 |
| CFTR-Intron2-1205 | − | GAGAACAUGAAUCUGAAUUUG | 21 | 16305 |
| CFTR-Intron2-1206 | − | GUAUAUACUCAAUAAAUAUUUG | 22 | 16306 |
| CFTR-Intron2-1207 | − | GGUAUAUACUCAAUAAAUAUUUG | 23 | 16307 |
| CFTR-Intron2-1208 | − | GGCCAGAUAGAGAACAUGAAU | 21 | 16308 |

TABLE 38C-continued

3rd Tier

| gRNA Name | DNA Strand | Targeting Domain | Target Site Length | Seq ID |
|---|---|---|---|---|
| CFTR-Intron2-1209 | - | GCUGAGGGAAUGAUUAAU | 18 | 16309 |
| CFTR-Intron2-1210 | - | GAGCCACUAUGCCCAGCU | 18 | 16310 |
| CFTR-Intron2-1211 | - | GUGAGCCACUAUGCCCAGCU | 20 | 16311 |
| CFTR-Intron2-1212 | - | GUGUGAGCCACUAUGCCCAGCU | 22 | 16312 |
| CFTR-Intron2-1213 | - | GGUGUGAGCCACUAUGCCCAGCU | 23 | 16313 |
| CFTR-Intron2-1214 | - | GUGCAAAUGCCAUGAGGU | 18 | 16314 |
| CFTR-Intron2-472 | - | GUGUGCAAAUGCCAUGAGGU | 20 | 15572 |
| CFTR-Intron2-1215 | - | GUGUGUGCAAAUGCCAUGAGGU | 22 | 16315 |
| CFTR-Intron2-1216 | - | GGUGUGUGCAAAUGCCAUGAGGU | 23 | 16316 |
| CFTR-Intron2-474 | - | GCCUUGGCCUCCCAAAGUGU | 20 | 15574 |
| CFTR-Intron2-1217 | - | GCCCGCCUUGGCCUCCCAAAGUGU | 24 | 16317 |

Table 38D provides exemplary targeting domains for correcting a mutation (e.g., 3272-26→G) in the CFTR gene selected according to the fourth tier parameters. The targeting domains bind within intron 2, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 38D

4th Tier

| gRNA Name | DNA Strand | Targeting Domain | Target Site Length | Seq ID |
|---|---|---|---|---|
| CFTR-Intron2-1218 | + | UGUUAGCUAUGAAAGAAAAA | 21 | 16318 |
| CFTR-Intron2-1219 | + | AUGUUAGCUAUGAAAGAAAAA | 22 | 16319 |
| CFTR-Intron2-1220 | + | AAUGUUAGCUAUGAAAGAAAAA | 23 | 16320 |
| CFTR-Intron2-1221 | + | UUUACUUAAGCUAGUAAA | 18 | 16321 |
| CFTR-Intron2-1222 | + | AUUUACUUAAGCUAGUAAA | 19 | 16322 |
| CFTR-Intron2-1223 | + | UAUUUACUUAAGCUAGUAAA | 20 | 16323 |
| CFTR-Intron2-1224 | + | AUAGGUAUAUUUUUUAAA | 18 | 16324 |
| CFTR-Intron2-1225 | + | AAUAGGUAUAUUUUUUAAA | 19 | 16325 |
| CFTR-Intron2-1226 | + | AAAUAGGUAUAUUUUUUAAA | 20 | 16326 |
| CFTR-Intron2-1227 | + | AAAAUAGGUAUAUUUUUUAAA | 21 | 16327 |
| CFTR-Intron2-1228 | + | UAAAAUAGGUAUAUUUUUUAAA | 22 | 16328 |
| CFTR-Intron2-1229 | + | AGUAAAAUAGGUAUAUUUUUUAAA | 24 | 16329 |
| CFTR-Intron2-1230 | + | UCUGUCACUGGCAAUCAA | 18 | 16330 |
| CFTR-Intron2-1231 | + | UUCUGUCACUGGCAAUCAA | 19 | 16331 |
| CFTR-Intron2-1232 | + | UUUCUGUCACUGGCAAUCAA | 20 | 16332 |
| CFTR-Intron2-1233 | + | UGGGUUUCUGUCACUGGCAAUCAA | 24 | 16333 |
| CFTR-Intron2-1234 | + | UUCUCCAUCAAAGGAGAA | 18 | 16334 |
| CFTR-Intron2-1235 | + | CUUCUCCAUCAAAGGAGAA | 19 | 16335 |

TABLE 38D-continued

4th Tier

| gRNA Name | DNA Strand | Targeting Domain | Target Site Length | Seq ID |
|---|---|---|---|---|
| CFTR-Intron2-1236 | + | CCUUCUCCAUCAAAGGAGAA | 20 | 16336 |
| CFTR-Intron2-1237 | + | AUGAAAGAAAAAAUAGAA | 18 | 16337 |
| CFTR-Intron2-1238 | + | UAUGAAAGAAAAAAUAGAA | 19 | 16338 |
| CFTR-Intron2-614 | + | CUAUGAAAGAAAAAAUAGAA | 20 | 15714 |
| CFTR-Intron2-1239 | + | AGCUAUGAAAGAAAAAAUAGAA | 22 | 16339 |
| CFTR-Intron2-1240 | + | UAGCUAUGAAAGAAAAAAUAGAA | 23 | 16340 |
| CFTR-Intron2-1241 | + | UUAGCUAUGAAAGAAAAAAUAGAA | 24 | 16341 |
| CFTR-Intron2-1242 | + | AAAUGCCAAAAAAGGAA | 18 | 16342 |
| CFTR-Intron2-1243 | + | AAAAUGCCAAAAAAGGAA | 19 | 16343 |
| CFTR-Intron2-1244 | + | CAAAAUGCCAAAAAAGGAA | 20 | 16344 |
| CFTR-Intron2-1245 | + | UCAAAAUGCCAAAAAAGGAA | 21 | 16345 |
| CFTR-Intron2-1246 | + | UUCAAAAUGCCAAAAAAGGAA | 22 | 16346 |
| CFTR-Intron2-1247 | + | CUUCAAAAUGCCAAAAAAGGAA | 23 | 16347 |
| CFTR-Intron2-1248 | + | CCUUCAAAAUGCCAAAAAAGGAA | 24 | 16348 |
| CFTR-Intron2-1249 | + | AACAAACAAAAAACAUAA | 18 | 16349 |
| CFTR-Intron2-1250 | + | AAACAAACAAAAAACAUAA | 19 | 16350 |
| CFTR-Intron2-616 | + | CAAACAAACAAAAAACAUAA | 20 | 15716 |
| CFTR-Intron2-1251 | + | ACAAACAAACAAAAAACAUAA | 21 | 16351 |
| CFTR-Intron2-1252 | + | CACAAACAAACAAAAAACAUAA | 22 | 16352 |
| CFTR-Intron2-1253 | + | ACACAAACAAACAAAAAACAUAA | 23 | 16353 |
| CFTR-Intron2-1254 | + | AACACAAACAAACAAAAAACAUAA | 24 | 16354 |
| CFTR-Intron2-1255 | + | UUAUAAGAAAAGAAGUAA | 18 | 16355 |
| CFTR-Intron2-1256 | + | UUUAUAAGAAAAGAAGUAA | 19 | 16356 |
| CFTR-Intron2-1257 | + | UUUUAUAAGAAAAGAAGUAA | 20 | 16357 |
| CFTR-Intron2-1258 | + | AUUUUAUAAGAAAAGAAGUAA | 21 | 16358 |
| CFTR-Intron2-1259 | + | AAUUUUAUAAGAAAAGAAGUAA | 22 | 16359 |
| CFTR-Intron2-1260 | + | CAAUUUUAUAAGAAAAGAAGUAA | 23 | 16360 |
| CFTR-Intron2-1261 | + | CCAAUUUUAUAAGAAAAGAAGUAA | 24 | 16361 |
| CFTR-Intron2-1262 | + | AGUAGAGAGACCAGGAGAGCA | 21 | 16362 |
| CFTR-Intron2-1263 | + | AAGUAGAGAGACCAGGAGAGCA | 22 | 16363 |
| CFTR-Intron2-1264 | + | UGAAGUAGAGAGACCAGGAGAGCA | 24 | 16364 |
| CFTR-Intron2-1265 | + | AUCAGAUGGGAAAGCCAAGGA | 21 | 16365 |
| CFTR-Intron2-1266 | + | UGGAUCAGAUGGGAAAGCCAAGGA | 24 | 16366 |
| CFTR-Intron2-1267 | + | UCAUUCAACAAAUAUUUA | 18 | 16367 |
| CFTR-Intron2-1268 | + | UUCAUUCAACAAAUAUUUA | 19 | 16368 |
| CFTR-Intron2-1269 | + | AUUCAUUCAACAAAUAUUUA | 20 | 16369 |
| CFTR-Intron2-1270 | + | UGGAUUCAUUCAACAAAUAUUUA | 23 | 16370 |

TABLE 38D-continued

| gRNA Name | DNA Strand | Targeting Domain | Target Site Length | Seq ID |
|---|---|---|---|---|
| CFTR-Intron2-1271 | + | AUGGAUUCAUUCAACAAAUAUUUA | 24 | 16371 |
| CFTR-Intron2-1272 | + | ACACCACUACACUCCAGC | 18 | 16372 |
| CFTR-Intron2-1273 | + | CACACCACUACACUCCAGC | 19 | 16373 |
| CFTR-Intron2-1274 | + | UCACACCACUACACUCCAGC | 20 | 16374 |
| CFTR-Intron2-1275 | + | AUCACACCACUACACUCCAGC | 21 | 16375 |
| CFTR-Intron2-1276 | + | AGAUCACACCACUACACUCCAGC | 23 | 16376 |
| CFTR-Intron2-667 | + | CGGGCAGAUCACUUGAGGUC | 20 | 15767 |
| CFTR-Intron2-1277 | + | AGGCGGGCAGAUCACUUGAGGUC | 23 | 16377 |
| CFTR-Intron2-1278 | + | AAGGCGGGCAGAUCACUUGAGGUC | 24 | 16378 |
| CFTR-Intron2-668 | + | UGGGCAGAUCACUUGAGGUC | 20 | 15768 |
| CFTR-Intron2-1279 | + | AGGUGGGCAGAUCACUUGAGGUC | 23 | 16379 |
| CFTR-Intron2-1280 | + | AAGGUGGGCAGAUCACUUGAGGUC | 24 | 16380 |
| CFTR-Intron2-1281 | + | CUCGAGAGGCUGAGGCAG | 18 | 16381 |
| CFTR-Intron2-1282 | + | ACUCGAGAGGCUGAGGCAG | 19 | 16382 |
| CFTR-Intron2-1283 | + | UACUCGAGAGGCUGAGGCAG | 20 | 16383 |
| CFTR-Intron2-1284 | + | CUACUCGAGAGGCUGAGGCAG | 21 | 16384 |
| CFTR-Intron2-1285 | + | AGCUACUCGAGAGGCUGAGGCAG | 23 | 16385 |
| CFTR-Intron2-1286 | + | CAGCUACUCGAGAGGCUGAGGCAG | 24 | 16386 |
| CFTR-Intron2-1287 | + | CCUGAGGAGAAGGCAAGGUCG | 21 | 16387 |
| CFTR-Intron2-1288 | + | ACCUGAGGAGAAGGCAAGGUCG | 22 | 16388 |
| CFTR-Intron2-1289 | + | UACCUGAGGAGAAGGCAAGGUCG | 23 | 16389 |
| CFTR-Intron2-1290 | + | UUACCUGAGGAGAAGGCAAGGUCG | 24 | 16390 |
| CFTR-Intron2-1291 | + | UCGCUUGAACCCAGGAGG | 18 | 16391 |
| CFTR-Intron2-1292 | + | UUCGCUUGAACCCAGGAGG | 19 | 16392 |
| CFTR-Intron2-1293 | + | AUUCGCUUGAACCCAGGAGG | 20 | 16393 |
| CFTR-Intron2-1294 | + | AGAUUCGCUUGAACCCAGGAGG | 22 | 16394 |
| CFTR-Intron2-1295 | + | UGAGAUUCGCUUGAACCCAGGAGG | 24 | 16395 |
| CFTR-Intron2-1296 | + | UUUUUAAAUUGAAUCAACAUG | 21 | 16396 |
| CFTR-Intron2-1297 | + | UUUUUUAAAUUGAAUCAACAUG | 22 | 16397 |
| CFTR-Intron2-1298 | + | AUUUUUUAAAUUGAAUCAACAUG | 23 | 16398 |
| CFTR-Intron2-1299 | + | UAUUUUUUAAAUUGAAUCAACAUG | 24 | 16399 |
| CFTR-Intron2-1300 | + | AAUUAGCCAGGCAUUGUG | 18 | 16400 |
| CFTR-Intron2-1301 | + | AAAUUAGCCAGGCAUUGUG | 19 | 16401 |
| CFTR-Intron2-1302 | + | AAAAUUAGCCAGGCAUUGUG | 20 | 16402 |
| CFTR-Intron2-1303 | + | AAAAAUUAGCCAGGCAUUGUG | 21 | 16403 |
| CFTR-Intron2-1304 | + | CAAAAAUUAGCCAGGCAUUGUG | 22 | 16404 |
| CFTR-Intron2-1305 | + | ACAAAAAUUAGCCAGGCAUUGUG | 23 | 16405 |
| CFTR-Intron2-1306 | + | UACAAAAAUUAGCCAGGCAUUGUG | 24 | 16406 |

TABLE 38D-continued

| 4th Tier | | | | |
|---|---|---|---|---|
| gRNA Name | DNA Strand | Targeting Domain | Target Site Length | Seq ID |
| CFTR-Intron2-1307 | + | AAUGCCACCAGGUGGCAU | 18 | 16407 |
| CFTR-Intron2-1308 | + | AAAUGCCACCAGGUGGCAU | 19 | 16408 |
| CFTR-Intron2-1309 | + | CAAAUGCCACCAGGUGGCAU | 20 | 16409 |
| CFTR-Intron2-1310 | + | AGAGAUAAUGAUGCUUUCCACU | 22 | 16410 |
| CFTR-Intron2-1311 | + | UAGAGAUAAUGAUGCUUUCCACU | 23 | 16411 |
| CFTR-Intron2-1312 | + | AUAGAGAUAAUGAUGCUUUCCACU | 24 | 16412 |
| CFTR-Intron2-1313 | + | UAUAUUUUCUAUUAUAGU | 18 | 16413 |
| CFTR-Intron2-1314 | + | AUAUAUUUUCUAUUAUAGU | 19 | 16414 |
| CFTR-Intron2-1315 | + | UAUAUAUUUUCUAUUAUAGU | 20 | 16415 |
| CFTR-Intron2-1316 | + | UUAUAUAUUUUCUAUUAUAGU | 21 | 16416 |
| CFTR-Intron2-1317 | + | AUUAUAUAUUUUCUAUUAUAGU | 22 | 16417 |
| CFTR-Intron2-1318 | + | AAUUAUAUAUUUUCUAUUAUAGU | 23 | 16418 |
| CFTR-Intron2-1319 | + | AAAUUAUAUAUUUUCUAUUAUAGU | 24 | 16419 |
| CFTR-Intron2-1320 | + | ACAAAAAUAAUAGAACGU | 18 | 16420 |
| CFTR-Intron2-1321 | + | AACAAAAAUAAUAGAACGU | 19 | 16421 |
| CFTR-Intron2-1322 | + | AAACAAAAAUAAUAGAACGU | 20 | 16422 |
| CFTR-Intron2-1323 | + | AAAACAAAAAUAAUAGAACGU | 21 | 16423 |
| CFTR-Intron2-1324 | + | CAAAACAAAAAUAAUAGAACGU | 22 | 16424 |
| CFTR-Intron2-1325 | + | ACAAAACAAAAAUAAUAGAACGU | 23 | 16425 |
| CFTR-Intron2-1326 | + | AACAAAACAAAAAUAAUAGAACGU | 24 | 16426 |
| CFTR-Intron2-718 | + | AGGCCCUAUUCUAGGCACUU | 20 | 15818 |
| CFTR-Intron2-1327 | + | CAGGCCCUAUUCUAGGCACUU | 21 | 16427 |
| CFTR-Intron2-1328 | + | CCAGGCCCUAUUCUAGGCACUU | 22 | 16428 |
| CFTR-Intron2-1329 | + | UGCCAGGCCCUAUUCUAGGCACUU | 24 | 16429 |
| CFTR-Intron2-1330 | − | UCUGCCUCCUGGGUUCAA | 18 | 16430 |
| CFTR-Intron2-1331 | − | CUCUGCCUCCUGGGUUCAA | 19 | 16431 |
| CFTR-Intron2-1332 | − | ACUCUGCCUCCUGGGUUCAA | 20 | 16432 |
| CFTR-Intron2-1333 | − | AACUCUGCCUCCUGGGUUCAA | 21 | 16433 |
| CFTR-Intron2-1334 | − | AAACUCUGCCUCCUGGGUUCAA | 22 | 16434 |
| CFTR-Intron2-1335 | − | CAAACUCUGCCUCCUGGGUUCAA | 23 | 16435 |
| CFTR-Intron2-1336 | − | UGAAUAUCUAAGUUUAA | 18 | 16436 |
| CFTR-Intron2-1337 | − | UUGAAUAUCUAAGUUUAA | 19 | 16437 |
| CFTR-Intron2-1338 | − | UUUGAAUAUCUAAGUUUAA | 20 | 16438 |
| CFTR-Intron2-1339 | − | UUUUAUUGAUUUUAUUCA | 18 | 16439 |
| CFTR-Intron2-1340 | − | UUUUUAUUGAUUUUAUUCA | 19 | 16440 |
| CFTR-Intron2-1341 | − | AUUUUUAUUGAUUUUAUUCA | 20 | 16441 |
| CFTR-Intron2-1342 | − | UAUUUUUAUUGAUUUUAUUCA | 21 | 16442 |

TABLE 38D-continued

4th Tier

| gRNA Name | DNA Strand | Targeting Domain | Target Site Length | Seq ID |
|---|---|---|---|---|
| CFTR-Intron2-1343 | − | UUAUUUUAUUGAUUUUAUUCA | 22 | 16443 |
| CFTR-Intron2-1344 | − | UUUAUUUUAUUGAUUUUAUUCA | 23 | 16444 |
| CFTR-Intron2-1345 | − | CUUUAUUUUAUUGAUUUUAUUCA | 24 | 16445 |
| CFTR-Intron2-1346 | − | AAUACACAUUUGGUUUCA | 18 | 16446 |
| CFTR-Intron2-1347 | − | AAAUACACAUUUGGUUUCA | 19 | 16447 |
| CFTR-Intron2-1348 | − | AAAAUACACAUUUGGUUUCA | 20 | 16448 |
| CFTR-Intron2-1349 | − | UGGCUAAUUUUUGUAGAGA | 19 | 16449 |
| CFTR-Intron2-626 | − | CUGGCUAAUUUUUGUAGAGA | 20 | 15726 |
| CFTR-Intron2-1350 | − | CCUGGCUAAUUUUUGUAGAGA | 21 | 16450 |
| CFTR-Intron2-1351 | − | AGGCCUGGCUAAUUUUUGUAGAGA | 24 | 16451 |
| CFTR-Intron2-1352 | − | UUGCUGUUGUUUUUGAGA | 18 | 16452 |
| CFTR-Intron2-1353 | − | UGUUGCUGUUGUUUUUGAGA | 20 | 16453 |
| CFTR-Intron2-1354 | − | UUGUUGCUGUUGUUUUUGAGA | 21 | 16454 |
| CFTR-Intron2-1355 | − | UGUUGUUGCUGUUGUUUUUGAGA | 23 | 16455 |
| CFTR-Intron2-1356 | − | UUGUUGUUGCUGUUGUUUUUGAGA | 24 | 16456 |
| CFTR-Intron2-1357 | − | UGUUGUUUGUUUUUGAGA | 18 | 16457 |
| CFTR-Intron2-1358 | − | UGUGUUGUUUGUUUUUGAGA | 20 | 16458 |
| CFTR-Intron2-1359 | − | UUGUGUUGUUUGUUUUUGAGA | 21 | 16459 |
| CFTR-Intron2-1360 | − | UUUGUGUUGUUUGUUUUUGAGA | 22 | 16460 |
| CFTR-Intron2-1361 | − | UGUUUGUGUUGUUUGUUUUUGAGA | 24 | 16461 |
| CFTR-Intron2-1362 | − | UAGCUUAAGUAAAUAAAAGGA | 21 | 16462 |
| CFTR-Intron2-1363 | − | CUAGCUUAAGUAAAUAAAAGGA | 22 | 16463 |
| CFTR-Intron2-1364 | − | ACUAGCUUAAGUAAAUAAAAGGA | 23 | 16464 |
| CFTR-Intron2-1365 | − | UACUAGCUUAAGUAAAUAAAAGGA | 24 | 16465 |
| CFTR-Intron2-1366 | − | UGUUGAAUGAAUCCAUGA | 18 | 16466 |
| CFTR-Intron2-1367 | − | UUGUUGAAUGAAUCCAUGA | 19 | 16467 |
| CFTR-Intron2-628 | − | UUUGUUGAAUGAAUCCAUGA | 20 | 15728 |
| CFTR-Intron2-1368 | − | AUUUGUUGAAUGAAUCCAUGA | 21 | 16468 |
| CFTR-Intron2-1369 | − | UAUUUGUUGAAUGAAUCCAUGA | 22 | 16469 |
| CFTR-Intron2-1370 | − | AUAUUUGUUGAAUGAAUCCAUGA | 23 | 16470 |
| CFTR-Intron2-1371 | − | AAUAUUUGUUGAAUGAAUCCAUGA | 24 | 16471 |
| CFTR-Intron2-1372 | − | UCAAUAAAUAUUUGUUGA | 18 | 16472 |
| CFTR-Intron2-1373 | − | CUCAAUAAAUAUUUGUUGA | 19 | 16473 |
| CFTR-Intron2-1374 | − | ACUCAAUAAAUAUUUGUUGA | 20 | 16474 |
| CFTR-Intron2-1375 | − | UACUCAAUAAAUAUUUGUUGA | 21 | 16475 |
| CFTR-Intron2-1376 | − | AUACUCAAUAAAUAUUUGUUGA | 22 | 16476 |
| CFTR-Intron2-1377 | − | UAUACUCAAUAAAUAUUUGUUGA | 23 | 16477 |
| CFTR-Intron2-1378 | − | AUAUACUCAAUAAAUAUUUGUUGA | 24 | 16478 |

TABLE 38D-continued

| | | 4th Tier | | |
|---|---|---|---|---|
| gRNA Name | DNA Strand | Targeting Domain | Target Site Length | Seq ID |
| CFTR-Intron2-1379 | − | UUUGUUUUUAUUUUUA | 18 | 16479 |
| CFTR-Intron2-1380 | − | UUUUGUUUUUAUUUUUA | 19 | 16480 |
| CFTR-Intron2-1381 | − | UGUUUUGUUUUUAUUUUUA | 21 | 16481 |
| CFTR-Intron2-1382 | − | UUGUUUUGUUUUUAUUUUUA | 22 | 16482 |
| CFTR-Intron2-1383 | − | UUUGUUUUGUUUUUAUUUUUA | 23 | 16483 |
| CFTR-Intron2-1384 | − | CUUUGUUUUGUUUUUAUUUUUA | 24 | 16484 |
| CFTR-Intron2-1385 | − | UAUGAUGUAUCCCCAAGUGCC | 21 | 16485 |
| CFTR-Intron2-1386 | − | UUAUGAUGUAUCCCCAAGUGCC | 22 | 16486 |
| CFTR-Intron2-1387 | − | UUUAUGAUGUAUCCCCAAGUGCC | 23 | 16487 |
| CFTR-Intron2-1388 | − | UCGCUGUGUCACCCAGGC | 18 | 16488 |
| CFTR-Intron2-1389 | − | CUCGCUGUGUCACCCAGGC | 19 | 16489 |
| CFTR-Intron2-658 | − | UCUCGCUGUGUCACCCAGGC | 20 | 15758 |
| CFTR-Intron2-1390 | − | AGUCUCGCUGUGUCACCCAGGC | 22 | 16490 |
| CFTR-Intron2-1391 | − | AGAGUCUCGCUGUGUCACCCAGGC | 24 | 16491 |
| CFTR-Intron2-1392 | − | UUGCUCUGUUGCCCAGGC | 18 | 16492 |
| CFTR-Intron2-1393 | − | CUUGCUCUGUUGCCCAGGC | 19 | 16493 |
| CFTR-Intron2-659 | − | UCUUGCUCUGUUGCCCAGGC | 20 | 15759 |
| CFTR-Intron2-1394 | − | AGUCUUGCUCUGUUGCCCAGGC | 22 | 16494 |
| CFTR-Intron2-1395 | − | AGAGUCUUGCUCUGUUGCCCAGGC | 24 | 16495 |
| CFTR-Intron2-1396 | − | CUUGGCCUCCCAAAAUGC | 18 | 16496 |
| CFTR-Intron2-1397 | − | CCUUGGCCUCCCAAAAUGC | 19 | 16497 |
| CFTR-Intron2-663 | − | ACCUUGGCCUCCCAAAAUGC | 20 | 15763 |
| CFTR-Intron2-1398 | − | CACCUUGGCCUCCCAAAAUGC | 21 | 16498 |
| CFTR-Intron2-1399 | − | CCACCUUGGCCUCCCAAAAUGC | 22 | 16499 |
| CFTR-Intron2-1400 | − | CCCACCUUGGCCUCCCAAAAUGC | 23 | 16500 |
| CFTR-Intron2-1401 | − | UUCUCCUGCCUCAGCCUC | 18 | 16501 |
| CFTR-Intron2-1402 | − | AUUCUCCUGCCUCAGCCUC | 19 | 16502 |
| CFTR-Intron2-1403 | − | UGAUUCUCCUGCCUCAGCCUC | 21 | 16503 |
| CFTR-Intron2-1404 | − | AGUGAUUCUCCUGCCUCAGCCUC | 23 | 16504 |
| CFTR-Intron2-1405 | − | AAGUGAUUCUCCUGCCUCAGCCUC | 24 | 16505 |
| CFTR-Intron2-1406 | − | CACUGCAAACUCUGCCUC | 18 | 16506 |
| CFTR-Intron2-1407 | − | UCACUGCAAACUCUGCCUC | 19 | 16507 |
| CFTR-Intron2-1408 | − | CUCACUGCAAACUCUGCCUC | 20 | 16508 |
| CFTR-Intron2-1409 | − | AGCUCACUGCAAACUCUGCCUC | 22 | 16509 |
| CFTR-Intron2-1410 | − | CAGCUCACUGCAAACUCUGCCUC | 23 | 16510 |
| CFTR-Intron2-1411 | − | UCAGCUCACUGCAAACUCUGCCUC | 24 | 16511 |
| CFTR-Intron2-1412 | − | CAAGCGAAUCUCAGUCUC | 18 | 16512 |

TABLE 38D-continued

| | | 4th Tier | | |
|---|---|---|---|---|
| gRNA Name | DNA Strand | Targeting Domain | Target Site Length | Seq ID |
| CFTR-Intron2-1413 | − | UCAAGCGAAUCUCAGUCUC | 19 | 16513 |
| CFTR-Intron2-1414 | − | UUCAAGCGAAUCUCAGUCUC | 20 | 16514 |
| CFTR-Intron2-1415 | − | UGGGUUCAAGCGAAUCUCAGUCUC | 24 | 16515 |
| CFTR-Intron2-1416 | − | CACUGCAAACUUCGUCUC | 18 | 16516 |
| CFTR-Intron2-1417 | − | UCACUGCAAACUUCGUCUC | 19 | 16517 |
| CFTR-Intron2-1418 | − | CUCACUGCAAACUUCGUCUC | 20 | 16518 |
| CFTR-Intron2-1419 | − | UGGCUCACUGCAAACUUCGUCUC | 23 | 16519 |
| CFTR-Intron2-1420 | − | UUGGCUCACUGCAAACUUCGUCUC | 24 | 16520 |
| CFTR-Intron2-1421 | − | UCUCCUUUGAUGGAGAAG | 18 | 16521 |
| CFTR-Intron2-1422 | − | UUCUCCUUUGAUGGAGAAG | 19 | 16522 |
| CFTR-Intron2-1423 | − | UUUCUCCUUUGAUGGAGAAG | 20 | 16523 |
| CFTR-Intron2-1424 | − | AUAAAAGGGUGAGUGAAG | 18 | 16524 |
| CFTR-Intron2-672 | − | AGAUAAAAGGGUGAGUGAAG | 20 | 15772 |
| CFTR-Intron2-1425 | − | CCUCAGCCUCUCGAGUAG | 18 | 16525 |
| CFTR-Intron2-1426 | − | UGCCUCAGCCUCUCGAGUAG | 20 | 16526 |
| CFTR-Intron2-1427 | − | CUGCCUCAGCCUCUCGAGUAG | 21 | 16527 |
| CFTR-Intron2-1428 | − | CCUGCCUCAGCCUCUCGAGUAG | 22 | 16528 |
| CFTR-Intron2-1429 | − | UCCUGCCUCAGCCUCUCGAGUAG | 23 | 16529 |
| CFTR-Intron2-1430 | − | CUCCUGCCUCAGCCUCUCGAGUAG | 24 | 16530 |
| CFTR-Intron2-1431 | − | AGGCCUGAUGCCAGAUAAAAGG | 22 | 16531 |
| CFTR-Intron2-1432 | − | CAGGCCUGAUGCCAGAUAAAAGG | 23 | 16532 |
| CFTR-Intron2-1433 | − | ACAGGCCUGAUGCCAGAUAAAAGG | 24 | 16533 |
| CFTR-Intron2-1434 | − | AAAUUUAUUGAAAUAUUUGG | 21 | 16534 |
| CFTR-Intron2-1435 | − | UGAAAUUUAUUGAAAUAUUUGG | 23 | 16535 |
| CFTR-Intron2-1436 | − | UUGAAAUUUAUUGAAAUAUUUGG | 24 | 16536 |
| CFTR-Intron2-1437 | − | UUUGUAUUUUAGUAGAUG | 18 | 16537 |
| CFTR-Intron2-1438 | − | UUUUGUAUUUUAGUAGAUG | 19 | 16538 |
| CFTR-Intron2-688 | − | UUUUUGUAUUUUAGUAGAUG | 20 | 15788 |
| CFTR-Intron2-1439 | − | AUUUUUGUAUUUUAGUAGAUG | 21 | 16539 |
| CFTR-Intron2-1440 | − | AAUUUUUGUAUUUUAGUAGAUG | 22 | 16540 |
| CFTR-Intron2-1441 | − | UAAUUUUUGUAUUUUAGUAGAUG | 23 | 16541 |
| CFTR-Intron2-1442 | − | CUAAUUUUUGUAUUUUAGUAGAUG | 24 | 16542 |
| CFTR-Intron2-1443 | − | AGAGAACAUGAAUCUGAAUUUG | 22 | 16543 |
| CFTR-Intron2-1444 | − | UAGAGAACAUGAAUCUGAAUUUG | 23 | 16544 |
| CFTR-Intron2-1445 | − | AUAGAGAACAUGAAUCUGAAUUUG | 24 | 16545 |
| CFTR-Intron2-1446 | − | AUACUCAAUAAAUAUUUG | 18 | 16546 |
| CFTR-Intron2-1447 | − | UAUACUCAAUAAAUAUUUG | 19 | 16547 |
| CFTR-Intron2-1448 | − | AUAUACUCAAUAAAUAUUUG | 20 | 16548 |

TABLE 38D-continued

4th Tier

| gRNA Name | DNA Strand | Targeting Domain | Target Site Length | Seq ID |
|---|---|---|---|---|
| CFTR-Intron2-1449 | - | UAUAUACUCAAUAAAUAUUUG | 21 | 16549 |
| CFTR-Intron2-1450 | - | UGGUAUAUACUCAAUAAAUAUUUG | 24 | 16550 |
| CFTR-Intron2-1451 | - | UGGCCAGAUAGAGAACAUGAAU | 22 | 16551 |
| CFTR-Intron2-1452 | - | AUGGCCAGAUAGAGAACAUGAAU | 23 | 16552 |
| CFTR-Intron2-1453 | - | UAUGGCCAGAUAGAGAACAUGAAU | 24 | 16553 |
| CFTR-Intron2-1454 | - | UGCUGAGGGAAUGAUUAAU | 19 | 16554 |
| CFTR-Intron2-1455 | - | AUGCUGAGGGAAUGAUUAAU | 20 | 16555 |
| CFTR-Intron2-1456 | - | UUGCUUUCAAAACCUUUAUAU | 21 | 16556 |
| CFTR-Intron2-1457 | - | UUUGCUUUCAAAACCUUUAUAU | 22 | 16557 |
| CFTR-Intron2-1458 | - | AUUUGCUUUCAAAACCUUUAUAU | 23 | 16558 |
| CFTR-Intron2-1459 | - | UAUUUGCUUUCAAAACCUUUAUAU | 24 | 16559 |
| CFTR-Intron2-1460 | - | UGAGCCACUAUGCCCAGCU | 19 | 16560 |
| CFTR-Intron2-1461 | - | UGUGAGCCACUAUGCCCAGCU | 21 | 16561 |
| CFTR-Intron2-1462 | - | AGGUGUGAGCCACUAUGCCCAGCU | 24 | 16562 |
| CFTR-Intron2-1463 | - | UGUGCAAAUGCCAUGAGGU | 19 | 16563 |
| CFTR-Intron2-1464 | - | UGUGUGCAAAUGCCAUGAGGU | 21 | 16564 |
| CFTR-Intron2-1465 | - | UGGUGUGUGCAAAUGCCAUGAGGU | 24 | 16565 |
| CFTR-Intron2-1466 | - | CUUGGCCUCCCAAAGUGU | 18 | 16566 |
| CFTR-Intron2-1467 | - | CCUUGGCCUCCCAAAGUGU | 19 | 16567 |
| CFTR-Intron2-1468 | - | CGCCUUGGCCUCCCAAAGUGU | 21 | 16568 |
| CFTR-Intron2-1469 | - | CCGCCUUGGCCUCCCAAAGUGU | 22 | 16569 |
| CFTR-Intron2-1470 | - | CCCGCCUUGGCCUCCCAAAGUGU | 23 | 16570 |
| CFTR-Intron2-1471 | - | UGUAAAAUUGUAUAUUU | 18 | 16571 |
| CFTR-Intron2-1472 | - | AUGUAAAAUUGUAUAUUU | 19 | 16572 |
| CFTR-Intron2-1473 | - | AAUGUAAAAUUGUAUAUUU | 20 | 16573 |
| CFTR-Intron2-1474 | - | AAAUGUAAAAUUGUAUAUUU | 21 | 16574 |
| CFTR-Intron2-1475 | - | CAAAUGUAAAAUUGUAUAUUU | 22 | 16575 |
| CFTR-Intron2-1476 | - | ACAAAUGUAAAAUUGUAUAUUU | 23 | 16576 |
| CFTR-Intron2-1477 | - | AACAAAUGUAAAAUUGUAUAUUU | 24 | 16577 |

Table 38E provides exemplary targeting domains for correcting a mutation (e.g., 3272-26→G) in the CFTR gene selected according to the fifth tier parameters. The targeting domains bind within intron 2, and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 38E

5th Tier

| gRNA Name | DNA Strand | Targeting Domain | Target Site Length | Seq ID |
|---|---|---|---|---|
| CFTR-Intron2-1478 | + | CUUCAAAAUGCCAAAAA | 18 | 16578 |
| CFTR-Intron2-1479 | + | CCUUCAAAAUGCCAAAAA | 19 | 16579 |
| CFTR-Intron2-42 | + | GCCUUCAAAAUGCCAAAAA | 20 | 15142 |
| CFTR-Intron2-1480 | + | UGCCUUCAAAAUGCCAAAAA | 21 | 16580 |
| CFTR-Intron2-1481 | + | UUGCCUUCAAAAUGCCAAAAA | 22 | 16581 |
| CFTR-Intron2-1482 | + | UUUGCCUUCAAAAUGCCAAAAA | 23 | 16582 |
| CFTR-Intron2-1483 | + | CUUUGCCUUCAAAAUGCCAAAAA | 24 | 16583 |
| CFTR-Intron2-1484 | + | CCUUCAAAAUGCCAAAAA | 18 | 16584 |
| CFTR-Intron2-1485 | + | GCCUUCAAAAUGCCAAAAA | 19 | 16585 |
| CFTR-Intron2-1486 | + | UGCCUUCAAAAUGCCAAAAA | 20 | 16586 |
| CFTR-Intron2-1487 | + | UUGCCUUCAAAAUGCCAAAAA | 21 | 16587 |
| CFTR-Intron2-1488 | + | UUUGCCUUCAAAAUGCCAAAAA | 22 | 16588 |
| CFTR-Intron2-1489 | + | CUUUGCCUUCAAAAUGCCAAAAA | 23 | 16589 |
| CFTR-Intron2-1490 | + | ACUUUGCCUUCAAAAUGCCAAAAA | 24 | 16590 |
| CFTR-Intron2-1491 | + | CAAUCCAUGGUCACAAAA | 18 | 16591 |
| CFTR-Intron2-1492 | + | UCAAUCCAUGGUCACAAAA | 19 | 16592 |
| CFTR-Intron2-1493 | + | UUCAAUCCAUGGUCACAAAA | 20 | 16593 |
| CFTR-Intron2-1494 | + | AUUCAAUCCAUGGUCACAAAA | 21 | 16594 |
| CFTR-Intron2-1495 | + | GAUUCAAUCCAUGGUCACAAAA | 22 | 16595 |
| CFTR-Intron2-1496 | + | GGAUUCAAUCCAUGGUCACAAAA | 23 | 16596 |
| CFTR-Intron2-1497 | + | AGGAUUCAAUCCAUGGUCACAAAA | 24 | 16597 |
| CFTR-Intron2-1498 | + | UGGGGGAUACAGUGAAAA | 18 | 16598 |
| CFTR-Intron2-1499 | + | AUGGGGGAUACAGUGAAAA | 19 | 16599 |
| CFTR-Intron2-1500 | + | CAUGGGGGAUACAGUGAAAA | 20 | 16600 |
| CFTR-Intron2-1501 | + | ACAUGGGGGAUACAGUGAAAA | 21 | 16601 |
| CFTR-Intron2-1502 | + | AACAUGGGGGAUACAGUGAAAA | 22 | 16602 |
| CFTR-Intron2-1503 | + | CAACAUGGGGGAUACAGUGAAAA | 23 | 16603 |
| CFTR-Intron2-1504 | + | UCAACAUGGGGGAUACAGUGAAAA | 24 | 16604 |
| CFTR-Intron2-1505 | + | AUUAAAGGUCUUUGAAAA | 18 | 16605 |
| CFTR-Intron2-1506 | + | UAUUAAAGGUCUUUGAAAA | 19 | 16606 |
| CFTR-Intron2-1507 | + | GUAUUAAAGGUCUUUGAAAA | 20 | 16607 |
| CFTR-Intron2-1508 | + | UGUAUUAAAGGUCUUUGAAAA | 21 | 16608 |
| CFTR-Intron2-1509 | + | AUGUAUUAAAGGUCUUUGAAAA | 22 | 16609 |
| CFTR-Intron2-1510 | + | CAUGUAUUAAAGGUCUUUGAAAA | 23 | 16610 |
| CFTR-Intron2-1511 | + | UCAUGUAUUAAAGGUCUUUGAAAA | 24 | 16611 |
| CFTR-Intron2-1512 | + | GUUUGCUUUUCUGUAAAA | 18 | 16612 |
| CFTR-Intron2-1513 | + | AGUUUGCUUUUCUGUAAAA | 19 | 16613 |

TABLE 38E-continued

5th Tier

| gRNA Name | DNA Strand | Targeting Domain | Target Site Length | Seq ID |
|---|---|---|---|---|
| CFTR-Intron2-1514 | + | CAGUUUGCUUUUCUGUAAAA | 20 | 16614 |
| CFTR-Intron2-1515 | + | UCAGUUUGCUUUUCUGUAAAA | 21 | 16615 |
| CFTR-Intron2-1516 | + | CUCAGUUUGCUUUUCUGUAAAA | 22 | 16616 |
| CFTR-Intron2-1517 | + | CCUCAGUUUGCUUUUCUGUAAAA | 23 | 16617 |
| CFTR-Intron2-1518 | + | GCCUCAGUUUGCUUUUCUGUAAAA | 24 | 16618 |
| CFTR-Intron2-1519 | + | UUUUGAUUGGAAAGGAAA | 18 | 16619 |
| CFTR-Intron2-1520 | + | CUUUUGAUUGGAAAGGAAA | 19 | 16620 |
| CFTR-Intron2-1521 | + | CCUUUUGAUUGGAAAGGAAA | 20 | 16621 |
| CFTR-Intron2-1522 | + | ACCUUUUGAUUGGAAAGGAAA | 21 | 16622 |
| CFTR-Intron2-1523 | + | AACCUUUUGAUUGGAAAGGAAA | 22 | 16623 |
| CFTR-Intron2-1524 | + | UAACCUUUUGAUUGGAAAGGAAA | 23 | 16624 |
| CFTR-Intron2-1525 | + | CUAACCUUUUGAUUGGAAAGGAAA | 24 | 16625 |
| CFTR-Intron2-1526 | + | GCUGAGAUGUAAAUGAAA | 18 | 16626 |
| CFTR-Intron2-1527 | + | AGCUGAGAUGUAAAUGAAA | 19 | 16627 |
| CFTR-Intron2-1528 | + | GAGCUGAGAUGUAAAUGAAA | 20 | 16628 |
| CFTR-Intron2-1529 | + | GGAGCUGAGAUGUAAAUGAAA | 21 | 16629 |
| CFTR-Intron2-1530 | + | AGGAGCUGAGAUGUAAAUGAAA | 22 | 16630 |
| CFTR-Intron2-1531 | + | CAGGAGCUGAGAUGUAAAUGAAA | 23 | 16631 |
| CFTR-Intron2-1532 | + | UCAGGAGCUGAGAUGUAAAUGAAA | 24 | 16632 |
| CFTR-Intron2-1533 | + | GGGAUACAUCAUAAACAA | 18 | 16633 |
| CFTR-Intron2-1534 | + | GGGGAUACAUCAUAAACAA | 19 | 16634 |
| CFTR-Intron2-1535 | + | UGGGGAUACAUCAUAAACAA | 20 | 16635 |
| CFTR-Intron2-1536 | + | UUGGGGAUACAUCAUAAACAA | 21 | 16636 |
| CFTR-Intron2-1537 | + | CUUGGGGAUACAUCAUAAACAA | 22 | 16637 |
| CFTR-Intron2-1538 | + | ACUUGGGGAUACAUCAUAAACAA | 23 | 16638 |
| CFTR-Intron2-1539 | + | CACUUGGGGAUACAUCAUAAACAA | 24 | 16639 |
| CFTR-Intron2-1540 | + | ACACUCCAGCCUGGGCAA | 18 | 16640 |
| CFTR-Intron2-1541 | + | UACACUCCAGCCUGGGCAA | 19 | 16641 |
| CFTR-Intron2-1542 | + | UUACACUCCAGCCUGGGCAA | 20 | 16642 |
| CFTR-Intron2-1543 | + | AUUACACUCCAGCCUGGGCAA | 21 | 16643 |
| CFTR-Intron2-1544 | + | CAUUACACUCCAGCCUGGGCAA | 22 | 16644 |
| CFTR-Intron2-1545 | + | CCAUUACACUCCAGCCUGGGCAA | 23 | 16645 |
| CFTR-Intron2-1546 | + | ACCAUUACACUCCAGCCUGGGCAA | 24 | 16646 |
| CFTR-Intron2-1547 | + | ACUCACCUUCUCCAUCAA | 18 | 16647 |
| CFTR-Intron2-1548 | + | GACUCACCUUCUCCAUCAA | 19 | 16648 |
| CFTR-Intron2-239 | + | AGACUCACCUUCUCCAUCAA | 20 | 15339 |
| CFTR-Intron2-1549 | + | CAGACUCACCUUCUCCAUCAA | 21 | 16649 |

TABLE 38E-continued

5th Tier

| gRNA Name | DNA Strand | Targeting Domain | Target Site Length | Seq ID |
|---|---|---|---|---|
| CFTR-Intron2-1550 | + | GCAGACUCACCUUCUCCAUCAA | 22 | 16650 |
| CFTR-Intron2-1551 | + | AGCAGACUCACCUUCUCCAUCAA | 23 | 16651 |
| CFTR-Intron2-1552 | + | GAGCAGACUCACCUUCUCCAUCAA | 24 | 16652 |
| CFTR-Intron2-1553 | + | AUACCAAUUUUAUAAGAA | 18 | 16653 |
| CFTR-Intron2-1554 | + | AAUACCAAUUUUAUAAGAA | 19 | 16654 |
| CFTR-Intron2-1555 | + | AAAUACCAAUUUUAUAAGAA | 20 | 16655 |
| CFTR-Intron2-1556 | + | CAAAUACCAAUUUUAUAAGAA | 21 | 16656 |
| CFTR-Intron2-1557 | + | UCAAAUACCAAUUUUAUAAGAA | 22 | 16657 |
| CFTR-Intron2-1558 | + | UUCAAAUACCAAUUUUAUAAGAA | 23 | 16658 |
| CFTR-Intron2-1559 | + | UUUCAAAUACCAAUUUUAUAAGAA | 24 | 16659 |
| CFTR-Intron2-1560 | + | ACCAGGCCCAGAUCAGAA | 18 | 16660 |
| CFTR-Intron2-1561 | + | UACCAGGCCCAGAUCAGAA | 19 | 16661 |
| CFTR-Intron2-242 | + | AUACCAGGCCCAGAUCAGAA | 20 | 15342 |
| CFTR-Intron2-1562 | + | CAUACCAGGCCCAGAUCAGAA | 21 | 16662 |
| CFTR-Intron2-1563 | + | ACAUACCAGGCCCAGAUCAGAA | 22 | 16663 |
| CFTR-Intron2-1564 | + | CACAUACCAGGCCCAGAUCAGAA | 23 | 16664 |
| CFTR-Intron2-1565 | + | CCACAUACCAGGCCCAGAUCAGAA | 24 | 16665 |
| CFTR-Intron2-1566 | + | CUAACCUUUUGAUUGGAA | 18 | 16666 |
| CFTR-Intron2-1567 | + | CCUAACCUUUUGAUUGGAA | 19 | 16667 |
| CFTR-Intron2-246 | + | UCCUAACCUUUUGAUUGGAA | 20 | 15346 |
| CFTR-Intron2-1568 | + | AUCCUAACCUUUUGAUUGGAA | 21 | 16668 |
| CFTR-Intron2-1569 | + | GAUCCUAACCUUUUGAUUGGAA | 22 | 16669 |
| CFTR-Intron2-1570 | + | GGAUCCUAACCUUUUGAUUGGAA | 23 | 16670 |
| CFTR-Intron2-1571 | + | AGGAUCCUAACCUUUUGAUUGGAA | 24 | 16671 |
| CFTR-Intron2-1572 | + | UGGCAUAGCAUUGUUGAA | 18 | 16672 |
| CFTR-Intron2-1573 | + | CUGGCAUAGCAUUGUUGAA | 19 | 16673 |
| CFTR-Intron2-1574 | + | ACUGGCAUAGCAUUGUUGAA | 20 | 16674 |
| CFTR-Intron2-1575 | + | UACUGGCAUAGCAUUGUUGAA | 21 | 16675 |
| CFTR-Intron2-1576 | + | GUACUGGCAUAGCAUUGUUGAA | 22 | 16676 |
| CFTR-Intron2-1577 | + | UGUACUGGCAUAGCAUUGUUGAA | 23 | 16677 |
| CFTR-Intron2-1578 | + | UUGUACUGGCAUAGCAUUGUUGAA | 24 | 16678 |
| CFTR-Intron2-1579 | + | AAAACAAAACAAAAAUAA | 18 | 16679 |
| CFTR-Intron2-1580 | + | CAAAACAAAACAAAAAUAA | 19 | 16680 |
| CFTR-Intron2-1581 | + | ACAAAACAAAACAAAAAUAA | 20 | 16681 |
| CFTR-Intron2-1582 | + | AACAAAACAAAACAAAAAUAA | 21 | 16682 |
| CFTR-Intron2-1583 | + | AAACAAAACAAAACAAAAAUAA | 22 | 16683 |
| CFTR-Intron2-1584 | + | AAAACAAAACAAAACAAAAAUAA | 23 | 16684 |

TABLE 38E-continued

| | | 5th Tier | | |
|---|---|---|---|---|
| gRNA Name | DNA Strand | Targeting Domain | Target Site Length | Seq ID |
| CFTR-Intron2-1585 | + | AAAAACAAAACAAAACAAAAAUAA | 24 | 16685 |
| CFTR-Intron2-1586 | + | ACACCAAGUGUUCAAUAA | 18 | 16686 |
| CFTR-Intron2-1587 | + | CACACCAAGUGUUCAAUAA | 19 | 16687 |
| CFTR-Intron2-1588 | + | ACACACCAAGUGUUCAAUAA | 20 | 16688 |
| CFTR-Intron2-1589 | + | CACACACCAAGUGUUCAAUAA | 21 | 16689 |
| CFTR-Intron2-1590 | + | GCACACACCAAGUGUUCAAUAA | 22 | 16690 |
| CFTR-Intron2-1591 | + | UGCACACACCAAGUGUUCAAUAA | 23 | 16691 |
| CFTR-Intron2-1592 | + | UUGCACACACCAAGUGUUCAAUAA | 24 | 16692 |
| CFTR-Intron2-1593 | + | UCAGGAGCUGAGAUGUAA | 18 | 16693 |
| CFTR-Intron2-1594 | + | UUCAGGAGCUGAGAUGUAA | 19 | 16694 |
| CFTR-Intron2-1595 | + | CUUCAGGAGCUGAGAUGUAA | 20 | 16695 |
| CFTR-Intron2-1596 | + | ACUUCAGGAGCUGAGAUGUAA | 21 | 16696 |
| CFTR-Intron2-1597 | + | UACUUCAGGAGCUGAGAUGUAA | 22 | 16697 |
| CFTR-Intron2-1598 | + | AUACUUCAGGAGCUGAGAUGUAA | 23 | 16698 |
| CFTR-Intron2-1599 | + | CAUACUUCAGGAGCUGAGAUGUAA | 24 | 16699 |
| CFTR-Intron2-1600 | + | GGAAAUGAAUUUAAUUAA | 18 | 16700 |
| CFTR-Intron2-1601 | + | AGGAAAUGAAUUUAAUUAA | 19 | 16701 |
| CFTR-Intron2-1602 | + | AAGGAAAUGAAUUUAAUUAA | 20 | 16702 |
| CFTR-Intron2-1603 | + | AAAGGAAAUGAAUUUAAUUAA | 21 | 16703 |
| CFTR-Intron2-1604 | + | AAAAGGAAAUGAAUUUAAUUAA | 22 | 16704 |
| CFTR-Intron2-1605 | + | AAAAAGGAAAUGAAUUUAAUUAA | 23 | 16705 |
| CFTR-Intron2-1606 | + | AAAAAAGGAAAUGAAUUUAAUUAA | 24 | 16706 |
| CFTR-Intron2-1607 | + | UUUUAAAUUGAAUCAACA | 18 | 16707 |
| CFTR-Intron2-1608 | + | UUUUUAAAUUGAAUCAACA | 19 | 16708 |
| CFTR-Intron2-621 | + | UUUUUUAAAUUGAAUCAACA | 20 | 15721 |
| CFTR-Intron2-1609 | + | AUUUUUUAAAUUGAAUCAACA | 21 | 16709 |
| CFTR-Intron2-1610 | + | UAUUUUUUAAAUUGAAUCAACA | 22 | 16710 |
| CFTR-Intron2-1611 | + | AUAUUUUUUAAAUUGAAUCAACA | 23 | 16711 |
| CFTR-Intron2-1612 | + | UAUAUUUUUUAAAUUGAAUCAACA | 24 | 16712 |
| CFTR-Intron2-1613 | + | CCACCUUUCUCUCACACA | 18 | 16713 |
| CFTR-Intron2-1614 | + | UCCACCUUUCUCUCACACA | 19 | 16714 |
| CFTR-Intron2-1615 | + | CUCCACCUUUCUCUCACACA | 20 | 16715 |
| CFTR-Intron2-1616 | + | UCUCCACCUUUCUCUCACACA | 21 | 16716 |
| CFTR-Intron2-1617 | + | UUCUCCACCUUUCUCUCACACA | 22 | 16717 |
| CFTR-Intron2-1618 | + | CUUCUCCACCUUUCUCUCACACA | 23 | 16718 |
| CFTR-Intron2-1619 | + | GCUUCUCCACCUUUCUCUCACACA | 24 | 16719 |
| CFTR-Intron2-1620 | + | UCCAGCCUGGGUGACACA | 18 | 16720 |

TABLE 38E-continued

5th Tier

| gRNA Name | DNA Strand | Targeting Domain | Target Site Length | Seq ID |
|---|---|---|---|---|
| CFTR-Intron2-1621 | + | CUCCAGCCUGGGUGACACA | 19 | 16721 |
| CFTR-Intron2-1622 | + | ACUCCAGCCUGGGUGACACA | 20 | 16722 |
| CFTR-Intron2-1623 | + | CACUCCAGCCUGGGUGACACA | 21 | 16723 |
| CFTR-Intron2-1624 | + | ACACUCCAGCCUGGGUGACACA | 22 | 16724 |
| CFTR-Intron2-1625 | + | UACACUCCAGCCUGGGUGACACA | 23 | 16725 |
| CFTR-Intron2-1626 | + | CUACACUCCAGCCUGGGUGACACA | 24 | 16726 |
| CFTR-Intron2-1627 | + | AAAAUUUCAUGAACCACA | 18 | 16727 |
| CFTR-Intron2-1628 | + | AAAAAUUUCAUGAACCACA | 19 | 16728 |
| CFTR-Intron2-455 | + | GAAAAAUUUCAUGAACCACA | 20 | 15555 |
| CFTR-Intron2-1629 | + | UGAAAAAUUUCAUGAACCACA | 21 | 16729 |
| CFTR-Intron2-1630 | + | AUGAAAAAUUUCAUGAACCACA | 22 | 16730 |
| CFTR-Intron2-1631 | + | GAUGAAAAAUUUCAUGAACCACA | 23 | 16731 |
| CFTR-Intron2-1632 | + | AGAUGAAAAAUUUCAUGAACCACA | 24 | 16732 |
| CFTR-Intron2-1633 | + | GUGAAAAGUGGUCCACA | 18 | 16733 |
| CFTR-Intron2-1634 | + | UGUGAAAAGUGGUCCACA | 19 | 16734 |
| CFTR-Intron2-256 | + | AUGUGAAAAGUGGUCCACA | 20 | 15356 |
| CFTR-Intron2-1635 | + | AAUGUGAAAAGUGGUCCACA | 21 | 16735 |
| CFTR-Intron2-1636 | + | CAAUGUGAAAAGUGGUCCACA | 22 | 16736 |
| CFTR-Intron2-1637 | + | UCAAUGUGAAAAGUGGUCCACA | 23 | 16737 |
| CFTR-Intron2-1638 | + | UUCAAUGUGAAAAGUGGUCCACA | 24 | 16738 |
| CFTR-Intron2-1639 | + | GCCUUUUUCUCUUCACA | 18 | 16739 |
| CFTR-Intron2-1640 | + | AGCCUUUUUCUCUUCACA | 19 | 16740 |
| CFTR-Intron2-1641 | + | AAGCCUUUUUCUCUUCACA | 20 | 16741 |
| CFTR-Intron2-1642 | + | AAAGCCUUUUUCUCUUCACA | 21 | 16742 |
| CFTR-Intron2-1643 | + | GAAAGCCUUUUUCUCUUCACA | 22 | 16743 |
| CFTR-Intron2-1644 | + | UGAAAGCCUUUUUCUCUUCACA | 23 | 16744 |
| CFTR-Intron2-1645 | + | AUGAAAGCCUUUUUCUCUUCACA | 24 | 16745 |
| CFTR-Intron2-1646 | + | CACAUUUAGCCAAGGACA | 18 | 16746 |
| CFTR-Intron2-1647 | + | UCACAUUUAGCCAAGGACA | 19 | 16747 |
| CFTR-Intron2-1648 | + | UUCACAUUUAGCCAAGGACA | 20 | 16748 |
| CFTR-Intron2-1649 | + | UUUCACAUUUAGCCAAGGACA | 21 | 16749 |
| CFTR-Intron2-1650 | + | UUUUCACAUUUAGCCAAGGACA | 22 | 16750 |
| CFTR-Intron2-1651 | + | UUUUUCACAUUUAGCCAAGGACA | 23 | 16751 |
| CFTR-Intron2-1652 | + | AUUUUUCACAUUUAGCCAAGGACA | 24 | 16752 |
| CFTR-Intron2-1653 | + | AUCAACAUGGGGGAUACA | 18 | 16753 |
| CFTR-Intron2-1654 | + | AAUCAACAUGGGGGAUACA | 19 | 16754 |
| CFTR-Intron2-1655 | + | GAAUCAACAUGGGGGAUACA | 20 | 16755 |

TABLE 38E-continued

5th Tier

| gRNA Name | DNA Strand | Targeting Domain | Target Site Length | Seq ID |
|---|---|---|---|---|
| CFTR-Intron2-1656 | + | UGAAUCAACAUGGGGAUACA | 21 | 16756 |
| CFTR-Intron2-1657 | + | UUGAAUCAACAUGGGGAUACA | 22 | 16757 |
| CFTR-Intron2-1658 | + | AUUGAAUCAACAUGGGGAUACA | 23 | 16758 |
| CFTR-Intron2-1659 | + | AAUUGAAUCAACAUGGGGAUACA | 24 | 16759 |
| CFTR-Intron2-1660 | + | GAUCAGAUGGGAAAGCCA | 18 | 16760 |
| CFTR-Intron2-1661 | + | GGAUCAGAUGGGAAAGCCA | 19 | 16761 |
| CFTR-Intron2-623 | + | UGGAUCAGAUGGGAAAGCCA | 20 | 15723 |
| CFTR-Intron2-1662 | + | AUGGAUCAGAUGGGAAAGCCA | 21 | 16762 |
| CFTR-Intron2-1663 | + | AAUGGAUCAGAUGGGAAAGCCA | 22 | 16763 |
| CFTR-Intron2-1664 | + | AAAUGGAUCAGAUGGGAAAGCCA | 23 | 16764 |
| CFTR-Intron2-1665 | + | GAAAUGGAUCAGAUGGGAAAGCCA | 24 | 16765 |
| CFTR-Intron2-1666 | + | CAGGAGACGAAGUUUGCA | 18 | 16766 |
| CFTR-Intron2-1667 | + | CCAGGAGACGAAGUUUGCA | 19 | 16767 |
| CFTR-Intron2-1668 | + | CCCAGGAGACGAAGUUUGCA | 20 | 16768 |
| CFTR-Intron2-1669 | + | ACCCAGGAGACGAAGUUUGCA | 21 | 16769 |
| CFTR-Intron2-1670 | + | AACCCAGGAGACGAAGUUUGCA | 22 | 16770 |
| CFTR-Intron2-1671 | + | GAACCCAGGAGACGAAGUUUGCA | 23 | 16771 |
| CFTR-Intron2-1672 | + | UGAACCCAGGAGACGAAGUUUGCA | 24 | 16772 |
| CFTR-Intron2-1673 | + | CAGGAGGCAGAGUUUGCA | 18 | 16773 |
| CFTR-Intron2-1674 | + | CCAGGAGGCAGAGUUUGCA | 19 | 16774 |
| CFTR-Intron2-1675 | + | CCCAGGAGGCAGAGUUUGCA | 20 | 16775 |
| CFTR-Intron2-1676 | + | ACCCAGGAGGCAGAGUUUGCA | 21 | 16776 |
| CFTR-Intron2-1677 | + | AACCCAGGAGGCAGAGUUUGCA | 22 | 16777 |
| CFTR-Intron2-1678 | + | GAACCCAGGAGGCAGAGUUUGCA | 23 | 16778 |
| CFTR-Intron2-1679 | + | UGAACCCAGGAGGCAGAGUUUGCA | 24 | 16779 |
| CFTR-Intron2-1680 | + | GACUCACCUUCUCCAUCA | 18 | 16780 |
| CFTR-Intron2-1681 | + | AGACUCACCUUCUCCAUCA | 19 | 16781 |
| CFTR-Intron2-1682 | + | CAGACUCACCUUCUCCAUCA | 20 | 16782 |
| CFTR-Intron2-1683 | + | GCAGACUCACCUUCUCCAUCA | 21 | 16783 |
| CFTR-Intron2-1684 | + | AGCAGACUCACCUUCUCCAUCA | 22 | 16784 |
| CFTR-Intron2-1685 | + | GAGCAGACUCACCUUCUCCAUCA | 23 | 16785 |
| CFTR-Intron2-1686 | + | GGAGCAGACUCACCUUCUCCAUCA | 24 | 16786 |
| CFTR-Intron2-1687 | + | UUUCGUGGUCCUUAAAGA | 18 | 16787 |
| CFTR-Intron2-1688 | + | CUUUCGUGGUCCUUAAAGA | 19 | 16788 |
| CFTR-Intron2-1689 | + | UCUUUCGUGGUCCUUAAAGA | 20 | 16789 |
| CFTR-Intron2-1690 | + | UUCUUUCGUGGUCCUUAAAGA | 21 | 16790 |
| CFTR-Intron2-1691 | + | CUUCUUUCGUGGUCCUUAAAGA | 22 | 16791 |

TABLE 38E-continued

5th Tier

| gRNA Name | DNA Strand | Targeting Domain | Target Site Length | Seq ID |
|---|---|---|---|---|
| CFTR-Intron2-1692 | + | CCUUCUUUCGUGGUCCUUAAAGA | 23 | 16792 |
| CFTR-Intron2-1693 | + | UCCUUCUUUCGUGGUCCUUAAAGA | 24 | 16793 |
| CFTR-Intron2-1694 | + | UACCAGGCCCAGAUCAGA | 18 | 16794 |
| CFTR-Intron2-1695 | + | AUACCAGGCCCAGAUCAGA | 19 | 16795 |
| CFTR-Intron2-275 | + | CAUACCAGGCCCAGAUCAGA | 20 | 15375 |
| CFTR-Intron2-1696 | + | ACAUACCAGGCCCAGAUCAGA | 21 | 16796 |
| CFTR-Intron2-1697 | + | CACAUACCAGGCCCAGAUCAGA | 22 | 16797 |
| CFTR-Intron2-1698 | + | CCACAUACCAGGCCCAGAUCAGA | 23 | 16798 |
| CFTR-Intron2-1699 | + | ACCACAUACCAGGCCCAGAUCAGA | 24 | 16799 |
| CFTR-Intron2-1700 | + | AAGGAGAAAUGGAUCAGA | 18 | 16800 |
| CFTR-Intron2-1701 | + | AAAGGAGAAAUGGAUCAGA | 19 | 16801 |
| CFTR-Intron2-276 | + | CAAAGGAGAAAUGGAUCAGA | 20 | 15376 |
| CFTR-Intron2-1702 | + | UCAAAGGAGAAAUGGAUCAGA | 21 | 16802 |
| CFTR-Intron2-1703 | + | AUCAAAGGAGAAAUGGAUCAGA | 22 | 16803 |
| CFTR-Intron2-1704 | + | CAUCAAAGGAGAAAUGGAUCAGA | 23 | 16804 |
| CFTR-Intron2-1705 | + | CCAUCAAAGGAGAAAUGGAUCAGA | 24 | 16805 |
| CFTR-Intron2-1706 | + | CAUCAUAAACAAAGAGA | 18 | 16806 |
| CFTR-Intron2-1707 | + | ACAUCAUAAACAAAGAGA | 19 | 16807 |
| CFTR-Intron2-1708 | + | UACAUCAUAAACAAAGAGA | 20 | 16808 |
| CFTR-Intron2-1709 | + | AUACAUCAUAAACAAAGAGA | 21 | 16809 |
| CFTR-Intron2-1710 | + | GAUACAUCAUAAACAAAGAGA | 22 | 16810 |
| CFTR-Intron2-1711 | + | GGAUACAUCAUAAACAAAGAGA | 23 | 16811 |
| CFTR-Intron2-1712 | + | GGGAUACAUCAUAAACAAAGAGA | 24 | 16812 |
| CFTR-Intron2-1713 | + | UCCCAGCUACUCAGGAGA | 18 | 16813 |
| CFTR-Intron2-1714 | + | GUCCCAGCUACUCAGGAGA | 19 | 16814 |
| CFTR-Intron2-1715 | + | AGUCCCAGCUACUCAGGAGA | 20 | 16815 |
| CFTR-Intron2-1716 | + | UAGUCCCAGCUACUCAGGAGA | 21 | 16816 |
| CFTR-Intron2-1717 | + | GUAGUCCCAGCUACUCAGGAGA | 22 | 16817 |
| CFTR-Intron2-1718 | + | UGUAGUCCCAGCUACUCAGGAGA | 23 | 16818 |
| CFTR-Intron2-1719 | + | CUGUAGUCCCAGCUACUCAGGAGA | 24 | 16819 |
| CFTR-Intron2-1720 | + | UAUGAAAGAAAAAUAGA | 18 | 16820 |
| CFTR-Intron2-1721 | + | CUAUGAAAGAAAAAUAGA | 19 | 16821 |
| CFTR-Intron2-1722 | + | GCUAUGAAAGAAAAAUAGA | 20 | 16822 |
| CFTR-Intron2-1723 | + | AGCUAUGAAAGAAAAAUAGA | 21 | 16823 |
| CFTR-Intron2-1724 | + | UAGCUAUGAAAGAAAAAUAGA | 22 | 16824 |
| CFTR-Intron2-1725 | + | UUAGCUAUGAAAGAAAAAUAGA | 23 | 16825 |
| CFTR-Intron2-1726 | + | GUUAGCUAUGAAAGAAAAAUAGA | 24 | 16826 |

TABLE 38E-continued

5th Tier

| gRNA Name | DNA Strand | Targeting Domain | Target Site Length | Seq ID |
|---|---|---|---|---|
| CFTR-Intron2-1727 | + | GAUACAGUGAAAACUGGA | 18 | 16827 |
| CFTR-Intron2-1728 | + | GGAUACAGUGAAAACUGGA | 19 | 16828 |
| CFTR-Intron2-1729 | + | GGGAUACAGUGAAAACUGGA | 20 | 16829 |
| CFTR-Intron2-1730 | + | GGGGAUACAGUGAAAACUGGA | 21 | 16830 |
| CFTR-Intron2-1731 | + | GGGGGAUACAGUGAAAACUGGA | 22 | 16831 |
| CFTR-Intron2-1732 | + | UGGGGGAUACAGUGAAAACUGGA | 23 | 16832 |
| CFTR-Intron2-1733 | + | AUGGGGGAUACAGUGAAAACUGGA | 24 | 16833 |
| CFTR-Intron2-1734 | + | CCUAACCUUUUGAUUGGA | 18 | 16834 |
| CFTR-Intron2-1735 | + | UCCUAACCUUUUGAUUGGA | 19 | 16835 |
| CFTR-Intron2-1736 | + | AUCCUAACCUUUUGAUUGGA | 20 | 16836 |
| CFTR-Intron2-1737 | + | GAUCCUAACCUUUUGAUUGGA | 21 | 16837 |
| CFTR-Intron2-1738 | + | GGAUCCUAACCUUUUGAUUGGA | 22 | 16838 |
| CFTR-Intron2-1739 | + | AGGAUCCUAACCUUUUGAUUGGA | 23 | 16839 |
| CFTR-Intron2-1740 | + | AAGGAUCCUAACCUUUUGAUUGGA | 24 | 16840 |
| CFTR-Intron2-1741 | + | AGAGAAUGUUAGCUAUGA | 18 | 16841 |
| CFTR-Intron2-1742 | + | CAGAGAAUGUUAGCUAUGA | 19 | 16842 |
| CFTR-Intron2-1743 | + | GCAGAGAAUGUUAGCUAUGA | 20 | 16843 |
| CFTR-Intron2-1744 | + | AGCAGAGAAUGUUAGCUAUGA | 21 | 16844 |
| CFTR-Intron2-1745 | + | GAGCAGAGAAUGUUAGCUAUGA | 22 | 16845 |
| CFTR-Intron2-1746 | + | AGAGCAGAGAAUGUUAGCUAUGA | 23 | 16846 |
| CFTR-Intron2-1747 | + | GAGAGCAGAGAAUGUUAGCUAUGA | 24 | 16847 |
| CFTR-Intron2-1748 | + | UCCACUCAGAGUGGCUGA | 18 | 16848 |
| CFTR-Intron2-1749 | + | UUCCACUCAGAGUGGCUGA | 19 | 16849 |
| CFTR-Intron2-1750 | + | UUUCCACUCAGAGUGGCUGA | 20 | 16850 |
| CFTR-Intron2-1751 | + | CUUUCCACUCAGAGUGGCUGA | 21 | 16851 |
| CFTR-Intron2-1752 | + | GCUUUCCACUCAGAGUGGCUGA | 22 | 16852 |
| CFTR-Intron2-1753 | + | UGCUUUCCACUCAGAGUGGCUGA | 23 | 16853 |
| CFTR-Intron2-1754 | + | AUGCUUUCCACUCAGAGUGGCUGA | 24 | 16854 |
| CFTR-Intron2-1755 | + | AGGAUCCUAACCUUUUGA | 18 | 16855 |
| CFTR-Intron2-1756 | + | AAGGAUCCUAACCUUUUGA | 19 | 16856 |
| CFTR-Intron2-1757 | + | AAAGGAUCCUAACCUUUUGA | 20 | 16857 |
| CFTR-Intron2-1758 | + | AAAAGGAUCCUAACCUUUUGA | 21 | 16858 |
| CFTR-Intron2-1759 | + | CAAAAGGAUCCUAACCUUUUGA | 22 | 16859 |
| CFTR-Intron2-1760 | + | UCAAAAGGAUCCUAACCUUUUGA | 23 | 16860 |
| CFTR-Intron2-1761 | + | AUCAAAAGGAUCCUAACCUUUUGA | 24 | 16861 |
| CFTR-Intron2-1762 | + | AGAGUAAGAAGCUAAAUA | 18 | 16862 |
| CFTR-Intron2-1763 | + | CAGAGUAAGAAGCUAAAUA | 19 | 16863 |

TABLE 38E-continued

5th Tier

| gRNA Name | DNA Strand | Targeting Domain | Target Site Length | Seq ID |
|---|---|---|---|---|
| CFTR-Intron2-287 | + | UCAGAGUAAGAAGCUAAAUA | 20 | 15387 |
| CFTR-Intron2-1764 | + | CUCAGAGUAAGAAGCUAAAUA | 21 | 16864 |
| CFTR-Intron2-1765 | + | ACUCAGAGUAAGAAGCUAAAUA | 22 | 16865 |
| CFTR-Intron2-1766 | + | UACUCAGAGUAAGAAGCUAAAUA | 23 | 16866 |
| CFTR-Intron2-1767 | + | UUACUCAGAGUAAGAAGCUAAAUA | 24 | 16867 |
| CFTR-Intron2-1768 | + | AAACAAACAAAAACAUA | 18 | 16868 |
| CFTR-Intron2-1769 | + | CAAACAAACAAAAACAUA | 19 | 16869 |
| CFTR-Intron2-1770 | + | ACAAACAAACAAAAACAUA | 20 | 16870 |
| CFTR-Intron2-1771 | + | CACAAACAAACAAAAACAUA | 21 | 16871 |
| CFTR-Intron2-1772 | + | ACACAAACAAACAAAAACAUA | 22 | 16872 |
| CFTR-Intron2-1773 | + | AACACAAACAAACAAAAACAUA | 23 | 16873 |
| CFTR-Intron2-1774 | + | CAACACAAACAAACAAAAACAUA | 24 | 16874 |
| CFTR-Intron2-1775 | + | GUUUUCUUUUAAAUACUA | 18 | 16875 |
| CFTR-Intron2-1776 | + | UGUUUUCUUUUAAAUACUA | 19 | 16876 |
| CFTR-Intron2-1777 | + | CUGUUUUCUUUUAAAUACUA | 20 | 16877 |
| CFTR-Intron2-1778 | + | UCUGUUUUCUUUUAAAUACUA | 21 | 16878 |
| CFTR-Intron2-1779 | + | UUCUGUUUUCUUUUAAAUACUA | 22 | 16879 |
| CFTR-Intron2-1780 | + | UUUCUGUUUUCUUUUAAAUACUA | 23 | 16880 |
| CFTR-Intron2-1781 | + | CUUUCUGUUUUCUUUUAAAUACUA | 24 | 16881 |
| CFTR-Intron2-1782 | + | GGGGGACUACCAUUCCUA | 18 | 16882 |
| CFTR-Intron2-1783 | + | GGGGGGACUACCAUUCCUA | 19 | 16883 |
| CFTR-Intron2-1784 | + | GGGGGGGACUACCAUUCCUA | 20 | 16884 |
| CFTR-Intron2-1785 | + | UGGGGGGGACUACCAUUCCUA | 21 | 16885 |
| CFTR-Intron2-1786 | + | AUGGGGGGGACUACCAUUCCUA | 22 | 16886 |
| CFTR-Intron2-1787 | + | UAUGGGGGGGACUACCAUUCCUA | 23 | 16887 |
| CFTR-Intron2-1788 | + | UUAUGGGGGGGACUACCAUUCCUA | 24 | 16888 |
| CFTR-Intron2-1789 | + | UCCCCUAGAAGCUUGCUA | 18 | 16889 |
| CFTR-Intron2-1790 | + | AUCCCCUAGAAGCUUGCUA | 19 | 16890 |
| CFTR-Intron2-1791 | + | CAUCCCCUAGAAGCUUGCUA | 20 | 16891 |
| CFTR-Intron2-1792 | + | GCAUCCCCUAGAAGCUUGCUA | 21 | 16892 |
| CFTR-Intron2-1793 | + | GGCAUCCCCUAGAAGCUUGCUA | 22 | 16893 |
| CFTR-Intron2-1794 | + | UGGCAUCCCCUAGAAGCUUGCUA | 23 | 16894 |
| CFTR-Intron2-1795 | + | UUGGCAUCCCCUAGAAGCUUGCUA | 24 | 16895 |
| CFTR-Intron2-1796 | + | UGGCUCUAAAUCACUCUA | 18 | 16896 |
| CFTR-Intron2-1797 | + | AUGGCUCUAAAUCACUCUA | 19 | 16897 |
| CFTR-Intron2-1798 | + | CAUGGCUCUAAAUCACUCUA | 20 | 16898 |
| CFTR-Intron2-1799 | + | ACAUGGCUCUAAAUCACUCUA | 21 | 16899 |

TABLE 38E-continued

5th Tier

| gRNA Name | DNA Strand | Targeting Domain | Target Site Length | Seq ID |
|---|---|---|---|---|
| CFTR-Intron2-1800 | + | AACAUGGCUCUAAAUCACUCUA | 22 | 16900 |
| CFTR-Intron2-1801 | + | AAACAUGGCUCUAAAUCACUCUA | 23 | 16901 |
| CFTR-Intron2-1802 | + | UAAACAUGGCUCUAAAUCACUCUA | 24 | 16902 |
| CFTR-Intron2-1803 | + | GUAAAUGAAAGUGAAGUA | 18 | 16903 |
| CFTR-Intron2-1804 | + | UGUAAAUGAAAGUGAAGUA | 19 | 16904 |
| CFTR-Intron2-1805 | + | AUGUAAAUGAAAGUGAAGUA | 20 | 16905 |
| CFTR-Intron2-1806 | + | GAUGUAAAUGAAAGUGAAGUA | 21 | 16906 |
| CFTR-Intron2-1807 | + | AGAUGUAAAUGAAAGUGAAGUA | 22 | 16907 |
| CFTR-Intron2-1808 | + | GAGAUGUAAAUGAAAGUGAAGUA | 23 | 16908 |
| CFTR-Intron2-1809 | + | UGAGAUGUAAAUGAAAGUGAAGUA | 24 | 16909 |
| CFTR-Intron2-1810 | + | CUUAAUUUUCAAACUGUA | 18 | 16910 |
| CFTR-Intron2-1811 | + | UCUUAAUUUUCAAACUGUA | 19 | 16911 |
| CFTR-Intron2-1812 | + | AUCUUAAUUUUCAAACUGUA | 20 | 16912 |
| CFTR-Intron2-1813 | + | CAUCUUAAUUUUCAAACUGUA | 21 | 16913 |
| CFTR-Intron2-1814 | + | UCAUCUUAAUUUUCAAACUGUA | 22 | 16914 |
| CFTR-Intron2-1815 | + | AUCAUCUUAAUUUUCAAACUGUA | 23 | 16915 |
| CFTR-Intron2-1816 | + | UAUCAUCUUAAUUUUCAAACUGUA | 24 | 16916 |
| CFTR-Intron2-1817 | + | UGCCACUGAUUUCUGUUA | 18 | 16917 |
| CFTR-Intron2-1818 | + | UUGCCACUGAUUUCUGUUA | 19 | 16918 |
| CFTR-Intron2-1819 | + | AUUGCCACUGAUUUCUGUUA | 20 | 16919 |
| CFTR-Intron2-1820 | + | UAUUGCCACUGAUUUCUGUUA | 21 | 16920 |
| CFTR-Intron2-1821 | + | UUAUUGCCACUGAUUUCUGUUA | 22 | 16921 |
| CFTR-Intron2-1822 | + | GUUAUUGCCACUGAUUUCUGUUA | 23 | 16922 |
| CFTR-Intron2-1823 | + | AGUUAUUGCCACUGAUUUCUGUUA | 24 | 16923 |
| CFTR-Intron2-1824 | + | AAACUGAGAGAUUCUUUA | 18 | 16924 |
| CFTR-Intron2-1825 | + | GAAACUGAGAGAUUCUUUA | 19 | 16925 |
| CFTR-Intron2-57 | + | GGAAACUGAGAGAUUCUUUA | 20 | 15157 |
| CFTR-Intron2-1826 | + | AGGAAACUGAGAGAUUCUUUA | 21 | 16926 |
| CFTR-Intron2-1827 | + | AAGGAAACUGAGAGAUUCUUUA | 22 | 16927 |
| CFTR-Intron2-1828 | + | AAAGGAAACUGAGAGAUUCUUUA | 23 | 16928 |
| CFTR-Intron2-1829 | + | GAAAGGAAACUGAGAGAUUCUUUA | 24 | 16929 |
| CFTR-Intron2-1830 | + | GGGGGAUACAGUGAAAC | 18 | 16930 |
| CFTR-Intron2-1831 | + | UGGGGGAUACAGUGAAAC | 19 | 16931 |
| CFTR-Intron2-297 | + | AUGGGGGAUACAGUGAAAC | 20 | 15397 |
| CFTR-Intron2-1832 | + | CAUGGGGGAUACAGUGAAAC | 21 | 16932 |
| CFTR-Intron2-1833 | + | ACAUGGGGGAUACAGUGAAAC | 22 | 16933 |
| CFTR-Intron2-1834 | + | AACAUGGGGGAUACAGUGAAAC | 23 | 16934 |

TABLE 38E-continued

5th Tier

| gRNA Name | DNA Strand | Targeting Domain | Target Site Length | Seq ID |
|---|---|---|---|---|
| CFTR-Intron2-1835 | + | CAACAUGGGGGAUACAGUGAAAAC | 24 | 16935 |
| CFTR-Intron2-1836 | + | UUCUUUAAUGGGUGAAAC | 18 | 16936 |
| CFTR-Intron2-1837 | + | UUUCUUUAAUGGGUGAAAC | 19 | 16937 |
| CFTR-Intron2-1838 | + | AUUUCUUUAAUGGGUGAAAC | 20 | 16938 |
| CFTR-Intron2-1839 | + | AAUUUCUUUAAUGGGUGAAAC | 21 | 16939 |
| CFTR-Intron2-1840 | + | GAAUUUCUUUAAUGGGUGAAAC | 22 | 16940 |
| CFTR-Intron2-1841 | + | GGAAUUUCUUUAAUGGGUGAAAC | 23 | 16941 |
| CFTR-Intron2-1842 | + | GGGAAUUUCUUUAAUGGGUGAAAC | 24 | 16942 |
| CFTR-Intron2-1843 | + | UUUUUAAAUUGAAUCAAC | 18 | 16943 |
| CFTR-Intron2-1844 | + | UUUUUUAAAUUGAAUCAAC | 19 | 16944 |
| CFTR-Intron2-1845 | + | AUUUUUUAAAUUGAAUCAAC | 20 | 16945 |
| CFTR-Intron2-1846 | + | UAUUUUUUAAAUUGAAUCAAC | 21 | 16946 |
| CFTR-Intron2-1847 | + | AUAUUUUUUAAAUUGAAUCAAC | 22 | 16947 |
| CFTR-Intron2-1848 | + | UAUAUUUUUUAAAUUGAAUCAAC | 23 | 16948 |
| CFTR-Intron2-1849 | + | GUAUAUUUUUUAAAUUGAAUCAAC | 24 | 16949 |
| CFTR-Intron2-1850 | + | GGAGCAAAGAGUUCUAAC | 18 | 16950 |
| CFTR-Intron2-1851 | + | AGGAGCAAAGAGUUCUAAC | 19 | 16951 |
| CFTR-Intron2-1852 | + | UAGGAGCAAAGAGUUCUAAC | 20 | 16952 |
| CFTR-Intron2-1853 | + | AUAGGAGCAAAGAGUUCUAAC | 21 | 16953 |
| CFTR-Intron2-1854 | + | GAUAGGAGCAAAGAGUUCUAAC | 22 | 16954 |
| CFTR-Intron2-1855 | + | AGAUAGGAGCAAAGAGUUCUAAC | 23 | 16955 |
| CFTR-Intron2-1856 | + | AAGAUAGGAGCAAAGAGUUCUAAC | 24 | 16956 |
| CFTR-Intron2-1857 | + | CAACCAUCUGGCAACCAC | 18 | 16957 |
| CFTR-Intron2-1858 | + | UCAACCAUCUGGCAACCAC | 19 | 16958 |
| CFTR-Intron2-1859 | + | UUCAACCAUCUGGCAACCAC | 20 | 16959 |
| CFTR-Intron2-1860 | + | CUUCAACCAUCUGGCAACCAC | 21 | 16960 |
| CFTR-Intron2-1861 | + | UCUUCAACCAUCUGGCAACCAC | 22 | 16961 |
| CFTR-Intron2-1862 | + | UUCUUCAACCAUCUGGCAACCAC | 23 | 16962 |
| CFTR-Intron2-1863 | + | GUUCUUCAACCAUCUGGCAACCAC | 24 | 16963 |
| CFTR-Intron2-1864 | + | AAAAAUUUCAUGAACCAC | 18 | 16964 |
| CFTR-Intron2-1865 | + | GAAAAAUUUCAUGAACCAC | 19 | 16965 |
| CFTR-Intron2-1866 | + | UGAAAAAUUUCAUGAACCAC | 20 | 16966 |
| CFTR-Intron2-1867 | + | AUGAAAAAUUUCAUGAACCAC | 21 | 16967 |
| CFTR-Intron2-1868 | + | GAUGAAAAAUUUCAUGAACCAC | 22 | 16968 |
| CFTR-Intron2-1869 | + | AGAUGAAAAAUUUCAUGAACCAC | 23 | 16969 |
| CFTR-Intron2-1870 | + | GAGAUGAAAAAUUUCAUGAACCAC | 24 | 16970 |
| CFTR-Intron2-1871 | + | UGUGAAAAAGUGGUCCAC | 18 | 16971 |

TABLE 38E-continued

5th Tier

| gRNA Name | DNA Strand | Targeting Domain | Target Site Length | Seq ID |
|---|---|---|---|---|
| CFTR-Intron2-1872 | + | AUGUGAAAAGUGGUCCAC | 19 | 16972 |
| CFTR-Intron2-1873 | + | AAUGUGAAAAGUGGUCCAC | 20 | 16973 |
| CFTR-Intron2-1874 | + | CAAUGUGAAAAGUGGUCCAC | 21 | 16974 |
| CFTR-Intron2-1875 | + | UCAAUGUGAAAAGUGGUCCAC | 22 | 16975 |
| CFTR-Intron2-1876 | + | UUCAAUGUGAAAAGUGGUCCAC | 23 | 16976 |
| CFTR-Intron2-1877 | + | GUUCAAUGUGAAAAGUGGUCCAC | 24 | 16977 |
| CFTR-Intron2-1878 | + | AGGCCCUAUUCUAGGCAC | 18 | 16978 |
| CFTR-Intron2-1879 | + | CAGGCCCUAUUCUAGGCAC | 19 | 16979 |
| CFTR-Intron2-1880 | + | CCAGGCCCUAUUCUAGGCAC | 20 | 16980 |
| CFTR-Intron2-1881 | + | GCCAGGCCCUAUUCUAGGCAC | 21 | 16981 |
| CFTR-Intron2-1882 | + | UGCCAGGCCCUAUUCUAGGCAC | 22 | 16982 |
| CFTR-Intron2-1883 | + | AUGCCAGGCCCUAUUCUAGGCAC | 23 | 16983 |
| CFTR-Intron2-1884 | + | UAUGCCAGGCCCUAUUCUAGGCAC | 24 | 16984 |
| CFTR-Intron2-1885 | + | CUGAGGCAGGAGAAUCAC | 18 | 16985 |
| CFTR-Intron2-1886 | + | GCUGAGGCAGGAGAAUCAC | 19 | 16986 |
| CFTR-Intron2-1887 | + | GGCUGAGGCAGGAGAAUCAC | 20 | 16987 |
| CFTR-Intron2-1888 | + | AGGCUGAGGCAGGAGAAUCAC | 21 | 16988 |
| CFTR-Intron2-1889 | + | GAGGCUGAGGCAGGAGAAUCAC | 22 | 16989 |
| CFTR-Intron2-1890 | + | AGAGGCUGAGGCAGGAGAAUCAC | 23 | 16990 |
| CFTR-Intron2-1891 | + | GAGAGGCUGAGGCAGGAGAAUCAC | 24 | 16991 |
| CFTR-Intron2-1892 | + | CCAAGGCGGGCAGAUCAC | 18 | 16992 |
| CFTR-Intron2-1893 | + | GCCAAGGCGGGCAGAUCAC | 19 | 16993 |
| CFTR-Intron2-1894 | + | GGCCAAGGCGGGCAGAUCAC | 20 | 16994 |
| CFTR-Intron2-1895 | + | AGGCCAAGGCGGGCAGAUCAC | 21 | 16995 |
| CFTR-Intron2-1896 | + | GAGGCCAAGGCGGGCAGAUCAC | 22 | 16996 |
| CFTR-Intron2-1897 | + | GGAGGCCAAGGCGGGCAGAUCAC | 23 | 16997 |
| CFTR-Intron2-1898 | + | GGGAGGCCAAGGCGGGCAGAUCAC | 24 | 16998 |
| CFTR-Intron2-1899 | + | CCAAGGUGGGCAGAUCAC | 18 | 16999 |
| CFTR-Intron2-1900 | + | GCCAAGGUGGGCAGAUCAC | 19 | 17000 |
| CFTR-Intron2-1901 | + | GGCCAAGGUGGGCAGAUCAC | 20 | 17001 |
| CFTR-Intron2-1902 | + | AGGCCAAGGUGGGCAGAUCAC | 21 | 17002 |
| CFTR-Intron2-1903 | + | GAGGCCAAGGUGGGCAGAUCAC | 22 | 17003 |
| CFTR-Intron2-1904 | + | GGAGGCCAAGGUGGGCAGAUCAC | 23 | 17004 |
| CFTR-Intron2-1905 | + | GGGAGGCCAAGGUGGGCAGAUCAC | 24 | 17005 |
| CFTR-Intron2-1906 | + | AAAGUGAAGUAGAGAGAC | 18 | 17006 |
| CFTR-Intron2-1907 | + | GAAAGUGAAGUAGAGAGAC | 19 | 17007 |
| CFTR-Intron2-1908 | + | UGAAAGUGAAGUAGAGAGAC | 20 | 17008 |

TABLE 38E-continued

5th Tier

| gRNA Name | DNA Strand | Targeting Domain | Target Site Length | Seq ID |
|---|---|---|---|---|
| CFTR-Intron2-1909 | + | AUGAAAGUGAAGUAGAGAGAC | 21 | 17009 |
| CFTR-Intron2-1910 | + | AAUGAAAGUGAAGUAGAGAGAC | 22 | 17010 |
| CFTR-Intron2-1911 | + | AAAUGAAAGUGAAGUAGAGAGAC | 23 | 17011 |
| CFTR-Intron2-1912 | + | UAAAUGAAAGUGAAGUAGAGAGAC | 24 | 17012 |
| CFTR-Intron2-1913 | + | GCCUGUAAACCCAGCUAC | 18 | 17013 |
| CFTR-Intron2-1914 | + | UGCCUGUAAACCCAGCUAC | 19 | 17014 |
| CFTR-Intron2-1915 | + | GUGCCUGUAAACCCAGCUAC | 20 | 17015 |
| CFTR-Intron2-1916 | + | AGUGCCUGUAAACCCAGCUAC | 21 | 17016 |
| CFTR-Intron2-1917 | + | GAGUGCCUGUAAACCCAGCUAC | 22 | 17017 |
| CFTR-Intron2-1918 | + | CGAGUGCCUGUAAACCCAGCUAC | 23 | 17018 |
| CFTR-Intron2-1919 | + | GCGAGUGCCUGUAAACCCAGCUAC | 24 | 17019 |
| CFTR-Intron2-1920 | + | AUAGAAUGGGGUAGUUAC | 18 | 17020 |
| CFTR-Intron2-1921 | + | AAUAGAAUGGGGUAGUUAC | 19 | 17021 |
| CFTR-Intron2-1922 | + | AAAUAGAAUGGGGUAGUUAC | 20 | 17022 |
| CFTR-Intron2-1923 | + | AAAAUAGAAUGGGGUAGUUAC | 21 | 17023 |
| CFTR-Intron2-1924 | + | AAAAAUAGAAUGGGGUAGUUAC | 22 | 17024 |
| CFTR-Intron2-1925 | + | AAAAAAUAGAAUGGGGUAGUUAC | 23 | 17025 |
| CFTR-Intron2-1926 | + | GAAAAAAUAGAAUGGGGUAGUUAC | 24 | 17026 |
| CFTR-Intron2-1927 | + | AGGAGAAUCACUUGAACC | 18 | 17027 |
| CFTR-Intron2-1928 | + | CAGGAGAAUCACUUGAACC | 19 | 17028 |
| CFTR-Intron2-1929 | + | GCAGGAGAAUCACUUGAACC | 20 | 17029 |
| CFTR-Intron2-1930 | + | GGCAGGAGAAUCACUUGAACC | 21 | 17030 |
| CFTR-Intron2-1931 | + | AGGCAGGAGAAUCACUUGAACC | 22 | 17031 |
| CFTR-Intron2-1932 | + | GAGGCAGGAGAAUCACUUGAACC | 23 | 17032 |
| CFTR-Intron2-1933 | + | UGAGGCAGGAGAAUCACUUGAACC | 24 | 17033 |
| CFTR-Intron2-1934 | + | CUGAGAUUCGCUUGAACC | 18 | 17034 |
| CFTR-Intron2-1935 | + | ACUGAGAUUCGCUUGAACC | 19 | 17035 |
| CFTR-Intron2-1936 | + | GACUGAGAUUCGCUUGAACC | 20 | 17036 |
| CFTR-Intron2-1937 | + | AGACUGAGAUUCGCUUGAACC | 21 | 17037 |
| CFTR-Intron2-1938 | + | GAGACUGAGAUUCGCUUGAACC | 22 | 17038 |
| CFTR-Intron2-1939 | + | GGAGACUGAGAUUCGCUUGAACC | 23 | 17039 |
| CFTR-Intron2-1940 | + | AGGAGACUGAGAUUCGCUUGAACC | 24 | 17040 |
| CFTR-Intron2-1941 | + | GAGCAAAGAGUUCUAACC | 18 | 17041 |
| CFTR-Intron2-1942 | + | GGAGCAAAGAGUUCUAACC | 19 | 17042 |
| CFTR-Intron2-305 | + | AGGAGCAAAGAGUUCUAACC | 20 | 15405 |
| CFTR-Intron2-1943 | + | UAGGAGCAAAGAGUUCUAACC | 21 | 17043 |
| CFTR-Intron2-1944 | + | AUAGGAGCAAAGAGUUCUAACC | 22 | 17044 |

TABLE 38E-continued

5th Tier

| gRNA Name | DNA Strand | Targeting Domain | Target Site Length | Seq ID |
|---|---|---|---|---|
| CFTR-Intron2-1945 | + | GAUAGGAGCAAAGAGUUCUAACC | 23 | 17045 |
| CFTR-Intron2-1946 | + | AGAUAGGAGCAAAGAGUUCUAACC | 24 | 17046 |
| CFTR-Intron2-1947 | + | AAGUGAAGUAGAGAGACC | 18 | 17047 |
| CFTR-Intron2-1948 | + | AAAGUGAAGUAGAGAGACC | 19 | 17048 |
| CFTR-Intron2-60 | + | GAAAGUGAAGUAGAGAGACC | 20 | 15160 |
| CFTR-Intron2-1949 | + | UGAAAGUGAAGUAGAGAGACC | 21 | 17049 |
| CFTR-Intron2-1950 | + | AUGAAAGUGAAGUAGAGAGACC | 22 | 17050 |
| CFTR-Intron2-1951 | + | AAUGAAAGUGAAGUAGAGAGACC | 23 | 17051 |
| CFTR-Intron2-1952 | + | AAAUGAAAGUGAAGUAGAGAGACC | 24 | 17052 |
| CFTR-Intron2-1953 | + | AAGAGGUCUCUAGUGACC | 18 | 17053 |
| CFTR-Intron2-1954 | + | UAAGAGGUCUCUAGUGACC | 19 | 17054 |
| CFTR-Intron2-1955 | + | AUAAGAGGUCUCUAGUGACC | 20 | 17055 |
| CFTR-Intron2-1956 | + | CAUAAGAGGUCUCUAGUGACC | 21 | 17056 |
| CFTR-Intron2-1957 | + | UCAUAAGAGGUCUCUAGUGACC | 22 | 17057 |
| CFTR-Intron2-1958 | + | UUCAUAAGAGGUCUCUAGUGACC | 23 | 17058 |
| CFTR-Intron2-1959 | + | UUUCAUAAGAGGUCUCUAGUGACC | 24 | 17059 |
| CFTR-Intron2-1960 | + | GGAGAAUCACUUGAACCC | 18 | 17060 |
| CFTR-Intron2-1961 | + | AGGAGAAUCACUUGAACCC | 19 | 17061 |
| CFTR-Intron2-636 | + | CAGGAGAAUCACUUGAACCC | 20 | 15736 |
| CFTR-Intron2-1962 | + | GCAGGAGAAUCACUUGAACCC | 21 | 17062 |
| CFTR-Intron2-1963 | + | GGCAGGAGAAUCACUUGAACCC | 22 | 17063 |
| CFTR-Intron2-1964 | + | AGGCAGGAGAAUCACUUGAACCC | 23 | 17064 |
| CFTR-Intron2-1965 | + | GAGGCAGGAGAAUCACUUGAACCC | 24 | 17065 |
| CFTR-Intron2-1966 | + | UGAGAUUCGCUUGAACCC | 18 | 17066 |
| CFTR-Intron2-1967 | + | CUGAGAUUCGCUUGAACCC | 19 | 17067 |
| CFTR-Intron2-637 | + | ACUGAGAUUCGCUUGAACCC | 20 | 15737 |
| CFTR-Intron2-1968 | + | GACUGAGAUUCGCUUGAACCC | 21 | 17068 |
| CFTR-Intron2-1969 | + | AGACUGAGAUUCGCUUGAACCC | 22 | 17069 |
| CFTR-Intron2-1970 | + | GAGACUGAGAUUCGCUUGAACCC | 23 | 17070 |
| CFTR-Intron2-1971 | + | GGAGACUGAGAUUCGCUUGAACCC | 24 | 17071 |
| CFTR-Intron2-1972 | + | AUGGAUCUUGGCAUCCCC | 18 | 17072 |
| CFTR-Intron2-1973 | + | CAUGGAUCUUGGCAUCCCC | 19 | 17073 |
| CFTR-Intron2-1974 | + | GCAUGGAUCUUGGCAUCCCC | 20 | 17074 |
| CFTR-Intron2-1975 | + | AGCAUGGAUCUUGGCAUCCCC | 21 | 17075 |
| CFTR-Intron2-1976 | + | AAGCAUGGAUCUUGGCAUCCCC | 22 | 17076 |
| CFTR-Intron2-1977 | + | UAAGCAUGGAUCUUGGCAUCCCC | 23 | 17077 |
| CFTR-Intron2-1978 | + | CUAAGCAUGGAUCUUGGCAUCCCC | 24 | 17078 |

TABLE 38E-continued

| | | 5th Tier | | |
|---|---|---|---|---|
| gRNA Name | DNA Strand | Targeting Domain | Target Site Length | Seq ID |
| CFTR-Intron2-1979 | + | CUAGACUAUGAGUGGCCC | 18 | 17079 |
| CFTR-Intron2-1980 | + | UCUAGACUAUGAGUGGCCC | 19 | 17080 |
| CFTR-Intron2-1981 | + | UUCUAGACUAUGAGUGGCCC | 20 | 17081 |
| CFTR-Intron2-1982 | + | AUUCUAGACUAUGAGUGGCCC | 21 | 17082 |
| CFTR-Intron2-1983 | + | CAUUCUAGACUAUGAGUGGCCC | 22 | 17083 |
| CFTR-Intron2-1984 | + | UCAUUCUAGACUAUGAGUGGCCC | 23 | 17084 |
| CFTR-Intron2-1985 | + | UUCAUUCUAGACUAUGAGUGGCCC | 24 | 17085 |
| CFTR-Intron2-1986 | + | AUUACCUUAAGACUUCCC | 18 | 17086 |
| CFTR-Intron2-1987 | + | CAUUACCUUAAGACUUCCC | 19 | 17087 |
| CFTR-Intron2-314 | + | CCAUUACCUUAAGACUUCCC | 20 | 15414 |
| CFTR-Intron2-1988 | + | GCCAUUACCUUAAGACUUCCC | 21 | 17088 |
| CFTR-Intron2-1989 | + | AGCCAUUACCUUAAGACUUCCC | 22 | 17089 |
| CFTR-Intron2-1990 | + | UAGCCAUUACCUUAAGACUUCCC | 23 | 17090 |
| CFTR-Intron2-1991 | + | GUAGCCAUUACCUUAAGACUUCCC | 24 | 17091 |
| CFTR-Intron2-1992 | + | GGAUCAGAUGGGAAAGCC | 18 | 17092 |
| CFTR-Intron2-1993 | + | UGGAUCAGAUGGGAAAGCC | 19 | 17093 |
| CFTR-Intron2-1994 | + | AUGGAUCAGAUGGGAAAGCC | 20 | 17094 |
| CFTR-Intron2-1995 | + | AAUGGAUCAGAUGGGAAAGCC | 21 | 17095 |
| CFTR-Intron2-1996 | + | AAAUGGAUCAGAUGGGAAAGCC | 22 | 17096 |
| CFTR-Intron2-1997 | + | GAAAUGGAUCAGAUGGGAAAGCC | 23 | 17097 |
| CFTR-Intron2-1998 | + | AGAAAUGGAUCAGAUGGGAAAGCC | 24 | 17098 |
| CFTR-Intron2-1999 | + | GAUUUUUCACAUUUAGCC | 18 | 17099 |
| CFTR-Intron2-2000 | + | GGAUUUUUCACAUUUAGCC | 19 | 17100 |
| CFTR-Intron2-2001 | + | GGGAUUUUUCACAUUUAGCC | 20 | 17101 |
| CFTR-Intron2-2002 | + | UGGGAUUUUUCACAUUUAGCC | 21 | 17102 |
| CFTR-Intron2-2003 | + | CUGGGAUUUUUCACAUUUAGCC | 22 | 17103 |
| CFTR-Intron2-2004 | + | UCUGGGAUUUUUCACAUUUAGCC | 23 | 17104 |
| CFTR-Intron2-2005 | + | CUCUGGGAUUUUUCACAUUUAGCC | 24 | 17105 |
| CFTR-Intron2-2006 | + | GGGGGGGACUACCAUUCC | 18 | 17106 |
| CFTR-Intron2-2007 | + | UGGGGGGGACUACCAUUCC | 19 | 17107 |
| CFTR-Intron2-2008 | + | AUGGGGGGGACUACCAUUCC | 20 | 17108 |
| CFTR-Intron2-2009 | + | UAUGGGGGGGACUACCAUUCC | 21 | 17109 |
| CFTR-Intron2-2010 | + | UUAUGGGGGGGACUACCAUUCC | 22 | 17110 |
| CFTR-Intron2-2011 | + | UUUAUGGGGGGGACUACCAUUCC | 23 | 17111 |
| CFTR-Intron2-2012 | + | CUUUAUGGGGGGGACUACCAUUCC | 24 | 17112 |
| CFTR-Intron2-2013 | + | CAUUACCUUAAGACUUCC | 18 | 17113 |
| CFTR-Intron2-2014 | + | CCAUUACCUUAAGACUUCC | 19 | 17114 |

TABLE 38E-continued

5th Tier

| gRNA Name | DNA Strand | Targeting Domain | Target Site Length | Seq ID |
|---|---|---|---|---|
| CFTR-Intron2-2015 | + | GCCAUUACCUUAAGACUUCC | 20 | 17115 |
| CFTR-Intron2-2016 | + | AGCCAUUACCUUAAGACUUCC | 21 | 17116 |
| CFTR-Intron2-2017 | + | UAGCCAUUACCUUAAGACUUCC | 22 | 17117 |
| CFTR-Intron2-2018 | + | GUAGCCAUUACCUUAAGACUUCC | 23 | 17118 |
| CFTR-Intron2-2019 | + | AGUAGCCAUUACCUUAAGACUUCC | 24 | 17119 |
| CFTR-Intron2-2020 | + | GCACCAUUACACUCCAGC | 18 | 17120 |
| CFTR-Intron2-2021 | + | UGCACCAUUACACUCCAGC | 19 | 17121 |
| CFTR-Intron2-2022 | + | UUGCACCAUUACACUCCAGC | 20 | 17122 |
| CFTR-Intron2-2023 | + | AUUGCACCAUUACACUCCAGC | 21 | 17123 |
| CFTR-Intron2-2024 | + | AAUUGCACCAUUACACUCCAGC | 22 | 17124 |
| CFTR-Intron2-2025 | + | AAAUUGCACCAUUACACUCCAGC | 23 | 17125 |
| CFTR-Intron2-2026 | + | AAAAUUGCACCAUUACACUCCAGC | 24 | 17126 |
| CFTR-Intron2-2027 | + | CAGGAGACUGAGAUUCGC | 18 | 17127 |
| CFTR-Intron2-2028 | + | UCAGGAGACUGAGAUUCGC | 19 | 17128 |
| CFTR-Intron2-2029 | + | CUCAGGAGACUGAGAUUCGC | 20 | 17129 |
| CFTR-Intron2-2030 | + | ACUCAGGAGACUGAGAUUCGC | 21 | 17130 |
| CFTR-Intron2-2031 | + | UACUCAGGAGACUGAGAUUCGC | 22 | 17131 |
| CFTR-Intron2-2032 | + | CUACUCAGGAGACUGAGAUUCGC | 23 | 17132 |
| CFTR-Intron2-2033 | + | GCUACUCAGGAGACUGAGAUUCGC | 24 | 17133 |
| CFTR-Intron2-2034 | + | UACUCGAGAGGCUGAGGC | 18 | 17134 |
| CFTR-Intron2-2035 | + | CUACUCGAGAGGCUGAGGC | 19 | 17135 |
| CFTR-Intron2-461 | + | GCUACUCGAGAGGCUGAGGC | 20 | 15561 |
| CFTR-Intron2-2036 | + | AGCUACUCGAGAGGCUGAGGC | 21 | 17136 |
| CFTR-Intron2-2037 | + | CAGCUACUCGAGAGGCUGAGGC | 22 | 17137 |
| CFTR-Intron2-2038 | + | CCAGCUACUCGAGAGGCUGAGGC | 23 | 17138 |
| CFTR-Intron2-2039 | + | CCCAGCUACUCGAGAGGCUGAGGC | 24 | 17139 |
| CFTR-Intron2-2040 | + | UCUAAAGGAGUAAUAGGC | 18 | 17140 |
| CFTR-Intron2-2041 | + | CUCUAAAGGAGUAAUAGGC | 19 | 17141 |
| CFTR-Intron2-662 | + | ACUCUAAAGGAGUAAUAGGC | 20 | 15762 |
| CFTR-Intron2-2042 | + | CACUCUAAAGGAGUAAUAGGC | 21 | 17142 |
| CFTR-Intron2-2043 | + | UCACUCUAAAGGAGUAAUAGGC | 22 | 17143 |
| CFTR-Intron2-2044 | + | AUCACUCUAAAGGAGUAAUAGGC | 23 | 17144 |
| CFTR-Intron2-2045 | + | AAUCACUCUAAAGGAGUAAUAGGC | 24 | 17145 |
| CFTR-Intron2-2046 | + | CAGGCCUGUGCUGUUGGC | 18 | 17146 |
| CFTR-Intron2-2047 | + | UCAGGCCUGUGCUGUUGGC | 19 | 17147 |
| CFTR-Intron2-2048 | + | AUCAGGCCUGUGCUGUUGGC | 20 | 17148 |
| CFTR-Intron2-2049 | + | CAUCAGGCCUGUGCUGUUGGC | 21 | 17149 |

TABLE 38E-continued

5th Tier

| gRNA Name | DNA Strand | Targeting Domain | Target Site Length | Seq ID |
|---|---|---|---|---|
| CFTR-Intron2-2050 | + | GCAUCAGGCCUGUGCUGUUGGC | 22 | 17150 |
| CFTR-Intron2-2051 | + | GGCAUCAGGCCUGUGCUGUUGGC | 23 | 17151 |
| CFTR-Intron2-2052 | + | UGGCAUCAGGCCUGUGCUGUUGGC | 24 | 17152 |
| CFTR-Intron2-2053 | + | CAUAUCCUGACUACAAUC | 18 | 17153 |
| CFTR-Intron2-2054 | + | UCAUAUCCUGACUACAAUC | 19 | 17154 |
| CFTR-Intron2-2055 | + | UUCAUAUCCUGACUACAAUC | 20 | 17155 |
| CFTR-Intron2-2056 | + | GUUCAUAUCCUGACUACAAUC | 21 | 17156 |
| CFTR-Intron2-2057 | + | AGUUCAUAUCCUGACUACAAUC | 22 | 17157 |
| CFTR-Intron2-2058 | + | AAGUUCAUAUCCUGACUACAAUC | 23 | 17158 |
| CFTR-Intron2-2059 | + | AAAGUUCAUAUCCUGACUACAAUC | 24 | 17159 |
| CFTR-Intron2-2060 | + | CUGUAAACCCAGCUACUC | 18 | 17160 |
| CFTR-Intron2-2061 | + | CCUGUAAACCCAGCUACUC | 19 | 17161 |
| CFTR-Intron2-2062 | + | GCCUGUAAACCCAGCUACUC | 20 | 17162 |
| CFTR-Intron2-2063 | + | UGCCUGUAAACCCAGCUACUC | 21 | 17163 |
| CFTR-Intron2-2064 | + | GUGCCUGUAAACCCAGCUACUC | 22 | 17164 |
| CFTR-Intron2-2065 | + | AGUGCCUGUAAACCCAGCUACUC | 23 | 17165 |
| CFTR-Intron2-2066 | + | GAGUGCCUGUAAACCCAGCUACUC | 24 | 17166 |
| CFTR-Intron2-2067 | + | CUGUAGUCCCAGCUACUC | 18 | 17167 |
| CFTR-Intron2-2068 | + | CCUGUAGUCCCAGCUACUC | 19 | 17168 |
| CFTR-Intron2-463 | + | GCCUGUAGUCCCAGCUACUC | 20 | 15563 |
| CFTR-Intron2-2069 | + | UGCCUGUAGUCCCAGCUACUC | 21 | 17169 |
| CFTR-Intron2-2070 | + | AUGCCUGUAGUCCCAGCUACUC | 22 | 17170 |
| CFTR-Intron2-2071 | + | CAUGCCUGUAGUCCCAGCUACUC | 23 | 17171 |
| CFTR-Intron2-2072 | + | GCAUGCCUGUAGUCCCAGCUACUC | 24 | 17172 |
| CFTR-Intron2-2073 | + | UGAGGAGAAGGCAAGGUC | 18 | 17173 |
| CFTR-Intron2-2074 | + | CUGAGGAGAAGGCAAGGUC | 19 | 17174 |
| CFTR-Intron2-333 | + | CCUGAGGAGAAGGCAAGGUC | 20 | 15433 |
| CFTR-Intron2-2075 | + | ACCUGAGGAGAAGGCAAGGUC | 21 | 17175 |
| CFTR-Intron2-2076 | + | UACCUGAGGAGAAGGCAAGGUC | 22 | 17176 |
| CFTR-Intron2-2077 | + | UUACCUGAGGAGAAGGCAAGGUC | 23 | 17177 |
| CFTR-Intron2-2078 | + | GUUACCUGAGGAGAAGGCAAGGUC | 24 | 17178 |
| CFTR-Intron2-2079 | + | UGGUGGAAACCAUACUUC | 18 | 17179 |
| CFTR-Intron2-2080 | + | AUGGUGGAAACCAUACUUC | 19 | 17180 |
| CFTR-Intron2-669 | + | CAUGGUGGAAACCAUACUUC | 20 | 15769 |
| CFTR-Intron2-2081 | + | ACAUGGUGGAAACCAUACUUC | 21 | 17181 |
| CFTR-Intron2-2082 | + | AACAUGGUGGAAACCAUACUUC | 22 | 17182 |
| CFTR-Intron2-2083 | + | GAACAUGGUGGAAACCAUACUUC | 23 | 17183 |

TABLE 38E-continued

| 5th Tier | | | | |
|---|---|---|---|---|
| gRNA Name | DNA Strand | Targeting Domain | Target Site Length | Seq ID |
| CFTR-Intron2-2084 | + | GGAACAUGGUGGAAACCAUACUUC | 24 | 17184 |
| CFTR-Intron2-2085 | + | UCACAUAGUUCAGGCUUC | 18 | 17185 |
| CFTR-Intron2-2086 | + | UUCACAUAGUUCAGGCUUC | 19 | 17186 |
| CFTR-Intron2-2087 | + | CUUCACAUAGUUCAGGCUUC | 20 | 17187 |
| CFTR-Intron2-2088 | + | UCUUCACAUAGUUCAGGCUUC | 21 | 17188 |
| CFTR-Intron2-2089 | + | GUCUUCACAUAGUUCAGGCUUC | 22 | 17189 |
| CFTR-Intron2-2090 | + | GGUCUUCACAUAGUUCAGGCUUC | 23 | 17190 |
| CFTR-Intron2-2091 | + | AGGUCUUCACAUAGUUCAGGCUUC | 24 | 17191 |
| CFTR-Intron2-2092 | + | ACAGAGAUGAAAAAUUUC | 18 | 17192 |
| CFTR-Intron2-2093 | + | UACAGAGAUGAAAAAUUUC | 19 | 17193 |
| CFTR-Intron2-2094 | + | GUACAGAGAUGAAAAAUUUC | 20 | 17194 |
| CFTR-Intron2-2095 | + | UGUACAGAGAUGAAAAAUUUC | 21 | 17195 |
| CFTR-Intron2-2096 | + | CUGUACAGAGAUGAAAAAUUUC | 22 | 17196 |
| CFTR-Intron2-2097 | + | ACUGUACAGAGAUGAAAAAUUUC | 23 | 17197 |
| CFTR-Intron2-2098 | + | AACUGUACAGAGAUGAAAAAUUUC | 24 | 17198 |
| CFTR-Intron2-2099 | + | ACCAAAUGUGUAUUUUUC | 18 | 17199 |
| CFTR-Intron2-2100 | + | AACCAAAUGUGUAUUUUUC | 19 | 17200 |
| CFTR-Intron2-670 | + | AAACCAAAUGUGUAUUUUUC | 20 | 15770 |
| CFTR-Intron2-2101 | + | GAAACCAAAUGUGUAUUUUUC | 21 | 17201 |
| CFTR-Intron2-2102 | + | UGAAACCAAAUGUGUAUUUUUC | 22 | 17202 |
| CFTR-Intron2-2103 | + | CUGAAACCAAAUGUGUAUUUUUC | 23 | 17203 |
| CFTR-Intron2-2104 | + | UCUGAAACCAAAUGUGUAUUUUUC | 24 | 17204 |
| CFTR-Intron2-2105 | + | UCACCUUCUCCAUCAAAG | 18 | 17205 |
| CFTR-Intron2-2106 | + | CUCACCUUCUCCAUCAAAG | 19 | 17206 |
| CFTR-Intron2-2107 | + | ACUCACCUUCUCCAUCAAAG | 20 | 17207 |
| CFTR-Intron2-2108 | + | GACUCACCUUCUCCAUCAAAG | 21 | 17208 |
| CFTR-Intron2-2109 | + | AGACUCACCUUCUCCAUCAAAG | 22 | 17209 |
| CFTR-Intron2-2110 | + | CAGACUCACCUUCUCCAUCAAAG | 23 | 17210 |
| CFTR-Intron2-2111 | + | GCAGACUCACCUUCUCCAUCAAAG | 24 | 17211 |
| CFTR-Intron2-2112 | + | AAACUUAGAUAUUCAAAG | 18 | 17212 |
| CFTR-Intron2-2113 | + | AAAACUUAGAUAUUCAAAG | 19 | 17213 |
| CFTR-Intron2-2114 | + | UAAAACUUAGAUAUUCAAAG | 20 | 17214 |
| CFTR-Intron2-2115 | + | UUAAAACUUAGAUAUUCAAAG | 21 | 17215 |
| CFTR-Intron2-2116 | + | AUUAAAACUUAGAUAUUCAAAG | 22 | 17216 |
| CFTR-Intron2-2117 | + | AAUUAAAACUUAGAUAUUCAAAG | 23 | 17217 |
| CFTR-Intron2-2118 | + | CAAUUAAAACUUAGAUAUUCAAAG | 24 | 17218 |
| CFTR-Intron2-2119 | + | ACACUUUGGGAGGCCAAG | 18 | 17219 |

TABLE 38E-continued

5th Tier

| gRNA Name | DNA Strand | Targeting Domain | Target Site Length | Seq ID |
|---|---|---|---|---|
| CFTR-Intron2-2120 | + | AACACUUUGGGAGGCCAAG | 19 | 17220 |
| CFTR-Intron2-2121 | + | CAACACUUUGGGAGGCCAAG | 20 | 17221 |
| CFTR-Intron2-2122 | + | CCAACACUUUGGGAGGCCAAG | 21 | 17222 |
| CFTR-Intron2-2123 | + | CCCAACACUUUGGGAGGCCAAG | 22 | 17223 |
| CFTR-Intron2-2124 | + | UCCCAACACUUUGGGAGGCCAAG | 23 | 17224 |
| CFTR-Intron2-2125 | + | AUCCCAACACUUUGGGAGGCCAAG | 24 | 17225 |
| CFTR-Intron2-2126 | + | GCAUUUUGGGAGGCCAAG | 18 | 17226 |
| CFTR-Intron2-2127 | + | AGCAUUUUGGGAGGCCAAG | 19 | 17227 |
| CFTR-Intron2-2128 | + | CAGCAUUUUGGGAGGCCAAG | 20 | 17228 |
| CFTR-Intron2-2129 | + | CCAGCAUUUUGGGAGGCCAAG | 21 | 17229 |
| CFTR-Intron2-2130 | + | CCCAGCAUUUUGGGAGGCCAAG | 22 | 17230 |
| CFTR-Intron2-2131 | + | UCCCAGCAUUUUGGGAGGCCAAG | 23 | 17231 |
| CFTR-Intron2-2132 | + | AUCCCAGCAUUUUGGGAGGCCAAG | 24 | 17232 |
| CFTR-Intron2-2133 | + | AUGUAAAUGAAAGUGAAG | 18 | 17233 |
| CFTR-Intron2-2134 | + | GAUGUAAAUGAAAGUGAAG | 19 | 17234 |
| CFTR-Intron2-2135 | + | AGAUGUAAAUGAAAGUGAAG | 20 | 17235 |
| CFTR-Intron2-2136 | + | GAGAUGUAAAUGAAAGUGAAG | 21 | 17236 |
| CFTR-Intron2-2137 | + | UGAGAUGUAAAUGAAAGUGAAG | 22 | 17237 |
| CFTR-Intron2-2138 | + | CUGAGAUGUAAAUGAAAGUGAAG | 23 | 17238 |
| CFTR-Intron2-2139 | + | GCUGAGAUGUAAAUGAAAGUGAAG | 24 | 17239 |
| CFTR-Intron2-2140 | + | UAAAGGAGUAAUACACAG | 18 | 17240 |
| CFTR-Intron2-2141 | + | AUAAAGGAGUAAUACACAG | 19 | 17241 |
| CFTR-Intron2-2142 | + | CAUAAAGGAGUAAUACACAG | 20 | 17242 |
| CFTR-Intron2-2143 | + | ACAUAAAGGAGUAAUACACAG | 21 | 17243 |
| CFTR-Intron2-2144 | + | AACAUAAAGGAGUAAUACACAG | 22 | 17244 |
| CFTR-Intron2-2145 | + | AAACAUAAAGGAGUAAUACACAG | 23 | 17245 |
| CFTR-Intron2-2146 | + | AAAACAUAAAGGAGUAAUACACAG | 24 | 17246 |
| CFTR-Intron2-2147 | + | GUGAAGUAGAGAGACCAG | 18 | 17247 |
| CFTR-Intron2-2148 | + | AGUGAAGUAGAGAGACCAG | 19 | 17248 |
| CFTR-Intron2-2149 | + | AAGUGAAGUAGAGAGACCAG | 20 | 17249 |
| CFTR-Intron2-2150 | + | AAAGUGAAGUAGAGAGACCAG | 21 | 17250 |
| CFTR-Intron2-2151 | + | GAAAGUGAAGUAGAGAGACCAG | 22 | 17251 |
| CFTR-Intron2-2152 | + | UGAAAGUGAAGUAGAGAGACCAG | 23 | 17252 |
| CFTR-Intron2-2153 | + | AUGAAAGUGAAGUAGAGAGACCAG | 24 | 17253 |
| CFTR-Intron2-2154 | + | AUACCAGGCCCAGAUCAG | 18 | 17254 |
| CFTR-Intron2-2155 | + | CAUACCAGGCCCAGAUCAG | 19 | 17255 |
| CFTR-Intron2-2156 | + | ACAUACCAGGCCCAGAUCAG | 20 | 17256 |

TABLE 38E-continued

5th Tier

| gRNA Name | DNA Strand | Targeting Domain | Target Site Length | Seq ID |
|---|---|---|---|---|
| CFTR-Intron2-2157 | + | CACAUACCAGGCCCAGAUCAG | 21 | 17257 |
| CFTR-Intron2-2158 | + | CCACAUACCAGGCCCAGAUCAG | 22 | 17258 |
| CFTR-Intron2-2159 | + | ACCACAUACCAGGCCCAGAUCAG | 23 | 17259 |
| CFTR-Intron2-2160 | + | GACCACAUACCAGGCCCAGAUCAG | 24 | 17260 |
| CFTR-Intron2-2161 | + | AAAGGAGAAAUGGAUCAG | 18 | 17261 |
| CFTR-Intron2-2162 | + | CAAAGGAGAAAUGGAUCAG | 19 | 17262 |
| CFTR-Intron2-2163 | + | UCAAAGGAGAAAUGGAUCAG | 20 | 17263 |
| CFTR-Intron2-2164 | + | AUCAAAGGAGAAAUGGAUCAG | 21 | 17264 |
| CFTR-Intron2-2165 | + | CAUCAAAGGAGAAAUGGAUCAG | 22 | 17265 |
| CFTR-Intron2-2166 | + | CCAUCAAAGGAGAAAUGGAUCAG | 23 | 17266 |
| CFTR-Intron2-2167 | + | UCCAUCAAAGGAGAAAUGGAUCAG | 24 | 17267 |
| CFTR-Intron2-2168 | + | AGGCAAUACAGACCUCAG | 18 | 17268 |
| CFTR-Intron2-2169 | + | AAGGCAAUACAGACCUCAG | 19 | 17269 |
| CFTR-Intron2-2170 | + | CAAGGCAAUACAGACCUCAG | 20 | 17270 |
| CFTR-Intron2-2171 | + | GCAAGGCAAUACAGACCUCAG | 21 | 17271 |
| CFTR-Intron2-2172 | + | AGCAAGGCAAUACAGACCUCAG | 22 | 17272 |
| CFTR-Intron2-2173 | + | GAGCAAGGCAAUACAGACCUCAG | 23 | 17273 |
| CFTR-Intron2-2174 | + | AGAGCAAGGCAAUACAGACCUCAG | 24 | 17274 |
| CFTR-Intron2-2175 | + | UUUUCAAACUGUACAGAG | 18 | 17275 |
| CFTR-Intron2-2176 | + | AUUUUCAAACUGUACAGAG | 19 | 17276 |
| CFTR-Intron2-2177 | + | AAUUUUCAAACUGUACAGAG | 20 | 17277 |
| CFTR-Intron2-2178 | + | UAAUUUUCAAACUGUACAGAG | 21 | 17278 |
| CFTR-Intron2-2179 | + | UUAAUUUUCAAACUGUACAGAG | 22 | 17279 |
| CFTR-Intron2-2180 | + | CUUAAUUUUCAAACUGUACAGAG | 23 | 17280 |
| CFTR-Intron2-2181 | + | UCUUAAUUUUCAAACUGUACAGAG | 24 | 17281 |
| CFTR-Intron2-2182 | + | GUAGAGAGACCAGGAGAG | 18 | 17282 |
| CFTR-Intron2-2183 | + | AGUAGAGAGACCAGGAGAG | 19 | 17283 |
| CFTR-Intron2-2184 | + | AAGUAGAGAGACCAGGAGAG | 20 | 17284 |
| CFTR-Intron2-2185 | + | GAAGUAGAGAGACCAGGAGAG | 21 | 17285 |
| CFTR-Intron2-2186 | + | UGAAGUAGAGAGACCAGGAGAG | 22 | 17286 |
| CFTR-Intron2-2187 | + | GUGAAGUAGAGAGACCAGGAGAG | 23 | 17287 |
| CFTR-Intron2-2188 | + | AGUGAAGUAGAGAGACCAGGAGAG | 24 | 17288 |
| CFTR-Intron2-2189 | + | AUCACUUGAACCCAGGAG | 18 | 17289 |
| CFTR-Intron2-2190 | + | AAUCACUUGAACCCAGGAG | 19 | 17290 |
| CFTR-Intron2-2191 | + | GAAUCACUUGAACCCAGGAG | 20 | 17291 |
| CFTR-Intron2-2192 | + | AGAAUCACUUGAACCCAGGAG | 21 | 17292 |
| CFTR-Intron2-2193 | + | GAGAAUCACUUGAACCCAGGAG | 22 | 17293 |

TABLE 38E-continued

5th Tier

| gRNA Name | DNA Strand | Targeting Domain | Target Site Length | Seq ID |
|---|---|---|---|---|
| CFTR-Intron2-2194 | + | GGAGAAUCACUUGAACCCAGGAG | 23 | 17294 |
| CFTR-Intron2-2195 | + | AGGAGAAUCACUUGAACCCAGGAG | 24 | 17295 |
| CFTR-Intron2-2196 | + | GAAACCAUACUUCAGGAG | 18 | 17296 |
| CFTR-Intron2-2197 | + | GGAAACCAUACUUCAGGAG | 19 | 17297 |
| CFTR-Intron2-2198 | + | UGGAAACCAUACUUCAGGAG | 20 | 17298 |
| CFTR-Intron2-2199 | + | GUGGAAACCAUACUUCAGGAG | 21 | 17299 |
| CFTR-Intron2-2200 | + | GGUGGAAACCAUACUUCAGGAG | 22 | 17300 |
| CFTR-Intron2-2201 | + | UGGUGGAAACCAUACUUCAGGAG | 23 | 17301 |
| CFTR-Intron2-2202 | + | AUGGUGGAAACCAUACUUCAGGAG | 24 | 17302 |
| CFTR-Intron2-2203 | + | AUGGGGUAGUUACCUGAG | 18 | 17303 |
| CFTR-Intron2-2204 | + | AAUGGGGUAGUUACCUGAG | 19 | 17304 |
| CFTR-Intron2-2205 | + | GAAUGGGGUAGUUACCUGAG | 20 | 17305 |
| CFTR-Intron2-2206 | + | AGAAUGGGGUAGUUACCUGAG | 21 | 17306 |
| CFTR-Intron2-2207 | + | UAGAAUGGGGUAGUUACCUGAG | 22 | 17307 |
| CFTR-Intron2-2208 | + | AUAGAAUGGGGUAGUUACCUGAG | 23 | 17308 |
| CFTR-Intron2-2209 | + | AAUAGAAUGGGGUAGUUACCUGAG | 24 | 17309 |
| CFTR-Intron2-2210 | + | CCACUCAGAGUGGCUGAG | 18 | 17310 |
| CFTR-Intron2-2211 | + | UCCACUCAGAGUGGCUGAG | 19 | 17311 |
| CFTR-Intron2-343 | + | UUCCACUCAGAGUGGCUGAG | 20 | 15443 |
| CFTR-Intron2-2212 | + | UUUCCACUCAGAGUGGCUGAG | 21 | 17312 |
| CFTR-Intron2-2213 | + | CUUUCCACUCAGAGUGGCUGAG | 22 | 17313 |
| CFTR-Intron2-2214 | + | GCUUUCCACUCAGAGUGGCUGAG | 23 | 17314 |
| CFTR-Intron2-2215 | + | UGCUUUCCACUCAGAGUGGCUGAG | 24 | 17315 |
| CFTR-Intron2-2216 | + | GGCAGAGUUUGCAGUGAG | 18 | 17316 |
| CFTR-Intron2-2217 | + | AGGCAGAGUUUGCAGUGAG | 19 | 17317 |
| CFTR-Intron2-2218 | + | GAGGCAGAGUUUGCAGUGAG | 20 | 17318 |
| CFTR-Intron2-2219 | + | GGAGGCAGAGUUUGCAGUGAG | 21 | 17319 |
| CFTR-Intron2-2220 | + | AGGAGGCAGAGUUUGCAGUGAG | 22 | 17320 |
| CFTR-Intron2-2221 | + | CAGGAGGCAGAGUUUGCAGUGAG | 23 | 17321 |
| CFTR-Intron2-2222 | + | CCAGGAGGCAGAGUUUGCAGUGAG | 24 | 17322 |
| CFTR-Intron2-2223 | + | UAGGUGAUGUGGUUCUAG | 18 | 17323 |
| CFTR-Intron2-2224 | + | GUAGGUGAUGUGGUUCUAG | 19 | 17324 |
| CFTR-Intron2-2225 | + | AGUAGGUGAUGUGGUUCUAG | 20 | 17325 |
| CFTR-Intron2-2226 | + | GAGUAGGUGAUGUGGUUCUAG | 21 | 17326 |
| CFTR-Intron2-2227 | + | AGAGUAGGUGAUGUGGUUCUAG | 22 | 17327 |
| CFTR-Intron2-2228 | + | AAGAGUAGGUGAUGUGGUUCUAG | 23 | 17328 |
| CFTR-Intron2-2229 | + | CAAGAGUAGGUGAUGUGGUUCUAG | 24 | 17329 |

TABLE 38E-continued

5th Tier

| gRNA Name | DNA Strand | Targeting Domain | Target Site Length | Seq ID |
|---|---|---|---|---|
| CFTR-Intron2-2230 | + | AUUUCAUGAACCACAAGG | 18 | 17330 |
| CFTR-Intron2-2231 | + | AAUUUCAUGAACCACAAGG | 19 | 17331 |
| CFTR-Intron2-2232 | + | AAAUUUCAUGAACCACAAGG | 20 | 17332 |
| CFTR-Intron2-2233 | + | AAAAUUUCAUGAACCACAAGG | 21 | 17333 |
| CFTR-Intron2-2234 | + | AAAAAUUUCAUGAACCACAAGG | 22 | 17334 |
| CFTR-Intron2-2235 | + | GAAAAAUUUCAUGAACCACAAGG | 23 | 17335 |
| CFTR-Intron2-2236 | + | UGAAAAAUUUCAUGAACCACAAGG | 24 | 17336 |
| CFTR-Intron2-2237 | + | CAGAUGGGAAAGCCAAGG | 18 | 17337 |
| CFTR-Intron2-2238 | + | UCAGAUGGGAAAGCCAAGG | 19 | 17338 |
| CFTR-Intron2-2239 | + | AUCAGAUGGGAAAGCCAAGG | 20 | 17339 |
| CFTR-Intron2-2240 | + | GAUCAGAUGGGAAAGCCAAGG | 21 | 17340 |
| CFTR-Intron2-2241 | + | GGAUCAGAUGGGAAAGCCAAGG | 22 | 17341 |
| CFTR-Intron2-2242 | + | UGGAUCAGAUGGGAAAGCCAAGG | 23 | 17342 |
| CFTR-Intron2-2243 | + | AUGGAUCAGAUGGGAAAGCCAAGG | 24 | 17343 |
| CFTR-Intron2-2244 | + | CCUGAGGAGAAGGCAAGG | 18 | 17344 |
| CFTR-Intron2-2245 | + | ACCUGAGGAGAAGGCAAGG | 19 | 17345 |
| CFTR-Intron2-2246 | + | UACCUGAGGAGAAGGCAAGG | 20 | 17346 |
| CFTR-Intron2-2247 | + | UUACCUGAGGAGAAGGCAAGG | 21 | 17347 |
| CFTR-Intron2-2248 | + | GUUACCUGAGGAGAAGGCAAGG | 22 | 17348 |
| CFTR-Intron2-2249 | + | AGUUACCUGAGGAGAAGGCAAGG | 23 | 17349 |
| CFTR-Intron2-2250 | + | UAGUUACCUGAGGAGAAGGCAAGG | 24 | 17350 |
| CFTR-Intron2-2251 | + | AAGAAAAGAAGUAACAGG | 18 | 17351 |
| CFTR-Intron2-2252 | + | UAAGAAAAGAAGUAACAGG | 19 | 17352 |
| CFTR-Intron2-2253 | + | AUAAGAAAAGAAGUAACAGG | 20 | 17353 |
| CFTR-Intron2-2254 | + | UAUAAGAAAAGAAGUAACAGG | 21 | 17354 |
| CFTR-Intron2-2255 | + | UUAUAAGAAAAGAAGUAACAGG | 22 | 17355 |
| CFTR-Intron2-2256 | + | UUUAUAAGAAAAGAAGUAACAGG | 23 | 17356 |
| CFTR-Intron2-2257 | + | UUUUAUAAGAAAAGAAGUAACAGG | 24 | 17357 |
| CFTR-Intron2-2258 | + | ACCCAGCUACUCGAGAGG | 18 | 17358 |
| CFTR-Intron2-2259 | + | AACCCAGCUACUCGAGAGG | 19 | 17359 |
| CFTR-Intron2-2260 | + | AAACCCAGCUACUCGAGAGG | 20 | 17360 |
| CFTR-Intron2-2261 | + | UAAACCCAGCUACUCGAGAGG | 21 | 17361 |
| CFTR-Intron2-2262 | + | GUAAACCCAGCUACUCGAGAGG | 22 | 17362 |
| CFTR-Intron2-2263 | + | UGUAAACCCAGCUACUCGAGAGG | 23 | 17363 |
| CFTR-Intron2-2264 | + | CUGUAAACCCAGCUACUCGAGAGG | 24 | 17364 |
| CFTR-Intron2-2265 | + | CUACUCGAGAGGCUGAGG | 18 | 17365 |
| CFTR-Intron2-2266 | + | GCUACUCGAGAGGCUGAGG | 19 | 17366 |

TABLE 38E-continued

5th Tier

| gRNA Name | DNA Strand | Targeting Domain | Target Site Length | Seq ID |
|---|---|---|---|---|
| CFTR-Intron2-2267 | + | AGCUACUCGAGAGGCUGAGG | 20 | 17367 |
| CFTR-Intron2-2268 | + | CAGCUACUCGAGAGGCUGAGG | 21 | 17368 |
| CFTR-Intron2-2269 | + | CCAGCUACUCGAGAGGCUGAGG | 22 | 17369 |
| CFTR-Intron2-2270 | + | CCCAGCUACUCGAGAGGCUGAGG | 23 | 17370 |
| CFTR-Intron2-2271 | + | ACCCAGCUACUCGAGAGGCUGAGG | 24 | 17371 |
| CFTR-Intron2-2272 | + | CUCUAAAGGAGUAAUAGG | 18 | 17372 |
| CFTR-Intron2-2273 | + | ACUCUAAAGGAGUAAUAGG | 19 | 17373 |
| CFTR-Intron2-2274 | + | CACUCUAAAGGAGUAAUAGG | 20 | 17374 |
| CFTR-Intron2-2275 | + | UCACUCUAAAGGAGUAAUAGG | 21 | 17375 |
| CFTR-Intron2-2276 | + | AUCACUCUAAAGGAGUAAUAGG | 22 | 17376 |
| CFTR-Intron2-2277 | + | AAUCACUCUAAAGGAGUAAUAGG | 23 | 17377 |
| CFTR-Intron2-2278 | + | AAAUCACUCUAAAGGAGUAAUAGG | 24 | 17378 |
| CFTR-Intron2-2279 | + | AGGCCCAGAUCAGAAGGG | 18 | 17379 |
| CFTR-Intron2-2280 | + | CAGGCCCAGAUCAGAAGGG | 19 | 17380 |
| CFTR-Intron2-2281 | + | CCAGGCCCAGAUCAGAAGGG | 20 | 17381 |
| CFTR-Intron2-2282 | + | ACCAGGCCCAGAUCAGAAGGG | 21 | 17382 |
| CFTR-Intron2-2283 | + | UACCAGGCCCAGAUCAGAAGGG | 22 | 17383 |
| CFTR-Intron2-2284 | + | AUACCAGGCCCAGAUCAGAAGGG | 23 | 17384 |
| CFTR-Intron2-2285 | + | CAUACCAGGCCCAGAUCAGAAGGG | 24 | 17385 |
| CFTR-Intron2-2286 | + | AGAAAAGAAGUAACAGGG | 18 | 17386 |
| CFTR-Intron2-2287 | + | AAGAAAAGAAGUAACAGGG | 19 | 17387 |
| CFTR-Intron2-681 | + | UAAGAAAAGAAGUAACAGGG | 20 | 15781 |
| CFTR-Intron2-2288 | + | AUAAGAAAAGAAGUAACAGGG | 21 | 17388 |
| CFTR-Intron2-2289 | + | UAUAAGAAAAGAAGUAACAGGG | 22 | 17389 |
| CFTR-Intron2-2290 | + | UUAUAAGAAAAGAAGUAACAGGG | 23 | 17390 |
| CFTR-Intron2-2291 | + | UUUAUAAGAAAAGAAGUAACAGGG | 24 | 17391 |
| CFTR-Intron2-2292 | + | UGAGAGAUUCUUUAUGGG | 18 | 17392 |
| CFTR-Intron2-2293 | + | CUGAGAGAUUCUUUAUGGG | 19 | 17393 |
| CFTR-Intron2-353 | + | ACUGAGAGAUUCUUUAUGGG | 20 | 15453 |
| CFTR-Intron2-2294 | + | AACUGAGAGAUUCUUUAUGGG | 21 | 17394 |
| CFTR-Intron2-2295 | + | AAACUGAGAGAUUCUUUAUGGG | 22 | 17395 |
| CFTR-Intron2-2296 | + | GAAACUGAGAGAUUCUUUAUGGG | 23 | 17396 |
| CFTR-Intron2-2297 | + | GGAAACUGAGAGAUUCUUUAUGGG | 24 | 17397 |
| CFTR-Intron2-2298 | + | GGGGAAUUUCUUUAAUGG | 18 | 17398 |
| CFTR-Intron2-2299 | + | CGGGGAAUUUCUUUAAUGG | 19 | 17399 |
| CFTR-Intron2-2300 | + | UCGGGGAAUUUCUUUAAUGG | 20 | 17400 |
| CFTR-Intron2-2301 | + | GUCGGGGAAUUUCUUUAAUGG | 21 | 17401 |

TABLE 38E-continued

5th Tier

| gRNA Name | DNA Strand | Targeting Domain | Target Site Length | Seq ID |
|---|---|---|---|---|
| CFTR-Intron2-2302 | + | GGUCGGGGAAUUUCUUUAAUGG | 22 | 17402 |
| CFTR-Intron2-2303 | + | AGGUCGGGGAAUUUCUUUAAUGG | 23 | 17403 |
| CFTR-Intron2-2304 | + | AAGGUCGGGGAAUUUCUUUAAUGG | 24 | 17404 |
| CFTR-Intron2-2305 | + | GUAGUUUUAGGAACAUGG | 18 | 17405 |
| CFTR-Intron2-2306 | + | UGUAGUUUUAGGAACAUGG | 19 | 17406 |
| CFTR-Intron2-355 | + | AUGUAGUUUUAGGAACAUGG | 20 | 15455 |
| CFTR-Intron2-2307 | + | AAUGUAGUUUUAGGAACAUGG | 21 | 17407 |
| CFTR-Intron2-2308 | + | CAAUGUAGUUUUAGGAACAUGG | 22 | 17408 |
| CFTR-Intron2-2309 | + | GCAAUGUAGUUUUAGGAACAUGG | 23 | 17409 |
| CFTR-Intron2-2310 | + | GGCAAUGUAGUUUUAGGAACAUGG | 24 | 17410 |
| CFTR-Intron2-2311 | + | CUGAGAGAUUCUUUAUGG | 18 | 17411 |
| CFTR-Intron2-2312 | + | ACUGAGAGAUUCUUUAUGG | 19 | 17412 |
| CFTR-Intron2-356 | + | AACUGAGAGAUUCUUUAUGG | 20 | 15456 |
| CFTR-Intron2-2313 | + | AAACUGAGAGAUUCUUUAUGG | 21 | 17413 |
| CFTR-Intron2-2314 | + | GAAACUGAGAGAUUCUUUAUGG | 22 | 17414 |
| CFTR-Intron2-2315 | + | GGAAACUGAGAGAUUCUUUAUGG | 23 | 17415 |
| CFTR-Intron2-2316 | + | AGGAAACUGAGAGAUUCUUUAUGG | 24 | 17416 |
| CFTR-Intron2-2317 | + | AAAUAGUCUGAAAACUGG | 18 | 17417 |
| CFTR-Intron2-2318 | + | UAAAUAGUCUGAAAACUGG | 19 | 17418 |
| CFTR-Intron2-2319 | + | UUAAAUAGUCUGAAAACUGG | 20 | 17419 |
| CFTR-Intron2-2320 | + | AUUAAAUAGUCUGAAAACUGG | 21 | 17420 |
| CFTR-Intron2-2321 | + | CAUUAAAUAGUCUGAAAACUGG | 22 | 17421 |
| CFTR-Intron2-2322 | + | ACAUUAAAUAGUCUGAAAACUGG | 23 | 17422 |
| CFTR-Intron2-2323 | + | GACAUUAAAUAGUCUGAAAACUGG | 24 | 17423 |
| CFTR-Intron2-2324 | + | GCUUUCCACUCAGAGUGG | 18 | 17424 |
| CFTR-Intron2-2325 | + | UGCUUUCCACUCAGAGUGG | 19 | 17425 |
| CFTR-Intron2-2326 | + | AUGCUUUCCACUCAGAGUGG | 20 | 17426 |
| CFTR-Intron2-2327 | + | GAUGCUUUCCACUCAGAGUGG | 21 | 17427 |
| CFTR-Intron2-2328 | + | UGAUGCUUUCCACUCAGAGUGG | 22 | 17428 |
| CFTR-Intron2-2329 | + | AUGAUGCUUUCCACUCAGAGUGG | 23 | 17429 |
| CFTR-Intron2-2330 | + | AAUGAUGCUUUCCACUCAGAGUGG | 24 | 17430 |
| CFTR-Intron2-2331 | + | GUCCACACGGAAGUAAUG | 18 | 17431 |
| CFTR-Intron2-2332 | + | GGUCCACACGGAAGUAAUG | 19 | 17432 |
| CFTR-Intron2-2333 | + | UGGUCCACACGGAAGUAAUG | 20 | 17433 |
| CFTR-Intron2-2334 | + | GUGGUCCACACGGAAGUAAUG | 21 | 17434 |
| CFTR-Intron2-2335 | + | AGUGGUCCACACGGAAGUAAUG | 22 | 17435 |
| CFTR-Intron2-2336 | + | AAGUGGUCCACACGGAAGUAAUG | 23 | 17436 |

TABLE 38E-continued

5th Tier

| gRNA Name | DNA Strand | Targeting Domain | Target Site Length | Seq ID |
|---|---|---|---|---|
| CFTR-Intron2-2337 | + | AAAGUGGUCCACACGGAAGUAAUG | 24 | 17437 |
| CFTR-Intron2-2338 | + | ACCAGCCUGGCCAACAUG | 18 | 17438 |
| CFTR-Intron2-2339 | + | GACCAGCCUGGCCAACAUG | 19 | 17439 |
| CFTR-Intron2-2340 | + | AGACCAGCCUGGCCAACAUG | 20 | 17440 |
| CFTR-Intron2-2341 | + | AAGACCAGCCUGGCCAACAUG | 21 | 17441 |
| CFTR-Intron2-2342 | + | CAAGACCAGCCUGGCCAACAUG | 22 | 17442 |
| CFTR-Intron2-2343 | + | UCAAGACCAGCCUGGCCAACAUG | 23 | 17443 |
| CFTR-Intron2-2344 | + | UUCAAGACCAGCCUGGCCAACAUG | 24 | 17444 |
| CFTR-Intron2-2345 | + | UGUAGUUUUAGGAACAUG | 18 | 17445 |
| CFTR-Intron2-2346 | + | AUGUAGUUUUAGGAACAUG | 19 | 17446 |
| CFTR-Intron2-2347 | + | AAUGUAGUUUUAGGAACAUG | 20 | 17447 |
| CFTR-Intron2-2348 | + | CAAUGUAGUUUUAGGAACAUG | 21 | 17448 |
| CFTR-Intron2-2349 | + | GCAAUGUAGUUUUAGGAACAUG | 22 | 17449 |
| CFTR-Intron2-2350 | + | GGCAAUGUAGUUUUAGGAACAUG | 23 | 17450 |
| CFTR-Intron2-2351 | + | GGGCAAUGUAGUUUUAGGAACAUG | 24 | 17451 |
| CFTR-Intron2-2352 | + | UUGCACACUGCAGUUAUG | 18 | 17452 |
| CFTR-Intron2-2353 | + | UUUGCACACUGCAGUUAUG | 19 | 17453 |
| CFTR-Intron2-2354 | + | GUUUGCACACUGCAGUUAUG | 20 | 17454 |
| CFTR-Intron2-2355 | + | GGUUUGCACACUGCAGUUAUG | 21 | 17455 |
| CFTR-Intron2-2356 | + | UGGUUUGCACACUGCAGUUAUG | 22 | 17456 |
| CFTR-Intron2-2357 | + | GUGGUUUGCACACUGCAGUUAUG | 23 | 17457 |
| CFTR-Intron2-2358 | + | UGUGGUUUGCACACUGCAGUUAUG | 24 | 17458 |
| CFTR-Intron2-2359 | + | CCAGGGACCCACUUUAUG | 18 | 17459 |
| CFTR-Intron2-2360 | + | ACCAGGGACCCACUUUAUG | 19 | 17460 |
| CFTR-Intron2-2361 | + | AACCAGGGACCCACUUUAUG | 20 | 17461 |
| CFTR-Intron2-2362 | + | UAACCAGGGACCCACUUUAUG | 21 | 17462 |
| CFTR-Intron2-2363 | + | CUAACCAGGGACCCACUUUAUG | 22 | 17463 |
| CFTR-Intron2-2364 | + | UCUAACCAGGGACCCACUUUAUG | 23 | 17464 |
| CFTR-Intron2-2365 | + | UUCUAACCAGGGACCCACUUUAUG | 24 | 17465 |
| CFTR-Intron2-2366 | + | ACUGAGAGAUUCUUUAUG | 18 | 17466 |
| CFTR-Intron2-2367 | + | AACUGAGAGAUUCUUUAUG | 19 | 17467 |
| CFTR-Intron2-361 | + | AAACUGAGAGAUUCUUUAUG | 20 | 15461 |
| CFTR-Intron2-2368 | + | GAAACUGAGAGAUUCUUUAUG | 21 | 17468 |
| CFTR-Intron2-2369 | + | GGAAACUGAGAGAUUCUUUAUG | 22 | 17469 |
| CFTR-Intron2-2370 | + | AGGAAACUGAGAGAUUCUUUAUG | 23 | 17470 |
| CFTR-Intron2-2371 | + | AAGGAAACUGAGAGAUUCUUUAUG | 24 | 17471 |
| CFTR-Intron2-2372 | + | GAAUGGGGUAGUUACCUG | 18 | 17472 |

TABLE 38E-continued

5th Tier

| gRNA Name | DNA Strand | Targeting Domain | Target Site Length | Seq ID |
|---|---|---|---|---|
| CFTR-Intron2-2373 | + | AGAAUGGGGUAGUUACCUG | 19 | 17473 |
| CFTR-Intron2-362 | + | UAGAAUGGGGUAGUUACCUG | 20 | 15462 |
| CFTR-Intron2-2374 | + | AUAGAAUGGGGUAGUUACCUG | 21 | 17474 |
| CFTR-Intron2-2375 | + | AAUAGAAUGGGGUAGUUACCUG | 22 | 17475 |
| CFTR-Intron2-2376 | + | AAAUAGAAUGGGGUAGUUACCUG | 23 | 17476 |
| CFTR-Intron2-2377 | + | AAAAUAGAAUGGGGUAGUUACCUG | 24 | 17477 |
| CFTR-Intron2-2378 | + | GGUCACUUCCCAAGGGUG | 18 | 17478 |
| CFTR-Intron2-2379 | + | GGGUCACUUCCCAAGGGUG | 19 | 17479 |
| CFTR-Intron2-2380 | + | AGGGUCACUUCCCAAGGGUG | 20 | 17480 |
| CFTR-Intron2-2381 | + | CAGGGUCACUUCCCAAGGGUG | 21 | 17481 |
| CFTR-Intron2-2382 | + | CCAGGGUCACUUCCCAAGGGUG | 22 | 17482 |
| CFTR-Intron2-2383 | + | GCCAGGGUCACUUCCCAAGGGUG | 23 | 17483 |
| CFTR-Intron2-2384 | + | AGCCAGGGUCACUUCCCAAGGGUG | 24 | 17484 |
| CFTR-Intron2-2385 | + | UAAAGGUCUUUGAAAAAU | 18 | 17485 |
| CFTR-Intron2-2386 | + | UUAAAGGUCUUUGAAAAAU | 19 | 17486 |
| CFTR-Intron2-2387 | + | AUUAAAGGUCUUUGAAAAAU | 20 | 17487 |
| CFTR-Intron2-2388 | + | UAUUAAAGGUCUUUGAAAAAU | 21 | 17488 |
| CFTR-Intron2-2389 | + | GUAUUAAAGGUCUUUGAAAAAU | 22 | 17489 |
| CFTR-Intron2-2390 | + | UGUAUUAAAGGUCUUUGAAAAAU | 23 | 17490 |
| CFTR-Intron2-2391 | + | AUGUAUUAAAGGUCUUUGAAAAAU | 24 | 17491 |
| CFTR-Intron2-2392 | + | ACAAGGCAGUUAUGAAAU | 18 | 17492 |
| CFTR-Intron2-2393 | + | CACAAGGCAGUUAUGAAAU | 19 | 17493 |
| CFTR-Intron2-2394 | + | UCACAAGGCAGUUAUGAAAU | 20 | 17494 |
| CFTR-Intron2-2395 | + | GUCACAAGGCAGUUAUGAAAU | 21 | 17495 |
| CFTR-Intron2-2396 | + | GGUCACAAGGCAGUUAUGAAAU | 22 | 17496 |
| CFTR-Intron2-2397 | + | UGGUCACAAGGCAGUUAUGAAAU | 23 | 17497 |
| CFTR-Intron2-2398 | + | AUGGUCACAAGGCAGUUAUGAAAU | 24 | 17498 |
| CFTR-Intron2-2399 | + | CAGAGUAAGAAGCUAAAU | 18 | 17499 |
| CFTR-Intron2-2400 | + | UCAGAGUAAGAAGCUAAAU | 19 | 17500 |
| CFTR-Intron2-2401 | + | CUCAGAGUAAGAAGCUAAAU | 20 | 17501 |
| CFTR-Intron2-2402 | + | ACUCAGAGUAAGAAGCUAAAU | 21 | 17502 |
| CFTR-Intron2-2403 | + | UACUCAGAGUAAGAAGCUAAAU | 22 | 17503 |
| CFTR-Intron2-2404 | + | UUACUCAGAGUAAGAAGCUAAAU | 23 | 17504 |
| CFTR-Intron2-2405 | + | GUUACUCAGAGUAAGAAGCUAAAU | 24 | 17505 |
| CFTR-Intron2-2406 | + | CAACAAAAUGGGUUCAAU | 18 | 17506 |
| CFTR-Intron2-2407 | + | CCAACAAAAUGGGUUCAAU | 19 | 17507 |
| CFTR-Intron2-2408 | + | ACCAACAAAAUGGGUUCAAU | 20 | 17508 |

TABLE 38E-continued

5th Tier

| gRNA Name | DNA Strand | Targeting Domain | Target Site Length | Seq ID |
|---|---|---|---|---|
| CFTR-Intron2-2409 | + | AACCAACAAAAUGGGUUCAAU | 21 | 17509 |
| CFTR-Intron2-2410 | + | AAACCAACAAAAUGGGUUCAAU | 22 | 17510 |
| CFTR-Intron2-2411 | + | UAAACCAACAAAAUGGGUUCAAU | 23 | 17511 |
| CFTR-Intron2-2412 | + | AUAAACCAACAAAAUGGGUUCAAU | 24 | 17512 |
| CFTR-Intron2-2413 | + | CCCUAGAAGCUUGCUAAU | 18 | 17513 |
| CFTR-Intron2-2414 | + | CCCCUAGAAGCUUGCUAAU | 19 | 17514 |
| CFTR-Intron2-2415 | + | UCCCCUAGAAGCUUGCUAAU | 20 | 17515 |
| CFTR-Intron2-2416 | + | AUCCCCUAGAAGCUUGCUAAU | 21 | 17516 |
| CFTR-Intron2-2417 | + | CAUCCCCUAGAAGCUUGCUAAU | 22 | 17517 |
| CFTR-Intron2-2418 | + | GCAUCCCCUAGAAGCUUGCUAAU | 23 | 17518 |
| CFTR-Intron2-2419 | + | GGCAUCCCCUAGAAGCUUGCUAAU | 24 | 17519 |
| CFTR-Intron2-2420 | + | UUUAAAUUGAAUCAACAU | 18 | 17520 |
| CFTR-Intron2-2421 | + | UUUUAAAUUGAAUCAACAU | 19 | 17521 |
| CFTR-Intron2-699 | + | UUUUUAAAUUGAAUCAACAU | 20 | 15799 |
| CFTR-Intron2-2422 | + | UUUUUUAAAUUGAAUCAACAU | 21 | 17522 |
| CFTR-Intron2-2423 | + | AUUUUUUAAAUUGAAUCAACAU | 22 | 17523 |
| CFTR-Intron2-2424 | + | UAUUUUUUAAAUUGAAUCAACAU | 23 | 17524 |
| CFTR-Intron2-2425 | + | AUAUUUUUUAAAUUGAAUCAACAU | 24 | 17525 |
| CFTR-Intron2-2426 | + | GGUGUUGUUAUAUUUCAU | 18 | 17526 |
| CFTR-Intron2-2427 | + | AGGUGUUGUUAUAUUUCAU | 19 | 17527 |
| CFTR-Intron2-2428 | + | AAGGUGUUGUUAUAUUUCAU | 20 | 17528 |
| CFTR-Intron2-2429 | + | AAAGGUGUUGUUAUAUUUCAU | 21 | 17529 |
| CFTR-Intron2-2430 | + | GAAAGGUGUUGUUAUAUUUCAU | 22 | 17530 |
| CFTR-Intron2-2431 | + | AGAAAGGUGUUGUUAUAUUUCAU | 23 | 17531 |
| CFTR-Intron2-2432 | + | UAGAAAGGUGUUGUUAUAUUUCAU | 24 | 17532 |
| CFTR-Intron2-2433 | + | UUCGUGGUCCUUAAAGAU | 18 | 17533 |
| CFTR-Intron2-2434 | + | UUUCGUGGUCCUUAAAGAU | 19 | 17534 |
| CFTR-Intron2-375 | + | CUUUCGUGGUCCUUAAAGAU | 20 | 15475 |
| CFTR-Intron2-2435 | + | UCUUUCGUGGUCCUUAAAGAU | 21 | 17535 |
| CFTR-Intron2-2436 | + | UUCUUUCGUGGUCCUUAAAGAU | 22 | 17536 |
| CFTR-Intron2-2437 | + | CUUCUUUCGUGGUCCUUAAAGAU | 23 | 17537 |
| CFTR-Intron2-2438 | + | CCUUCUUUCGUGGUCCUUAAAGAU | 24 | 17538 |
| CFTR-Intron2-2439 | + | CACAUACCAGGCCCAGAU | 18 | 17539 |
| CFTR-Intron2-2440 | + | CCACAUACCAGGCCCAGAU | 19 | 17540 |
| CFTR-Intron2-2441 | + | ACCACAUACCAGGCCCAGAU | 20 | 17541 |
| CFTR-Intron2-2442 | + | GACCACAUACCAGGCCCAGAU | 21 | 17542 |
| CFTR-Intron2-2443 | + | GGACCACAUACCAGGCCCAGAU | 22 | 17543 |

TABLE 38E-continued

5th Tier

| gRNA Name | DNA Strand | Targeting Domain | Target Site Length | Seq ID |
|---|---|---|---|---|
| CFTR-Intron2-2444 | + | AGGACCACAUACCAGGCCCAGAU | 23 | 17544 |
| CFTR-Intron2-2445 | + | UAGGACCACAUACCAGGCCCAGAU | 24 | 17545 |
| CFTR-Intron2-2446 | + | AGGAGAAAUGGAUCAGAU | 18 | 17546 |
| CFTR-Intron2-2447 | + | AAGGAGAAAUGGAUCAGAU | 19 | 17547 |
| CFTR-Intron2-376 | + | AAAGGAGAAAUGGAUCAGAU | 20 | 15476 |
| CFTR-Intron2-2448 | + | CAAAGGAGAAAUGGAUCAGAU | 21 | 17548 |
| CFTR-Intron2-2449 | + | UCAAAGGAGAAAUGGAUCAGAU | 22 | 17549 |
| CFTR-Intron2-2450 | + | AUCAAAGGAGAAAUGGAUCAGAU | 23 | 17550 |
| CFTR-Intron2-2451 | + | CAUCAAAGGAGAAAUGGAUCAGAU | 24 | 17551 |
| CFTR-Intron2-2452 | + | GUAAUACACAGCUGAGAU | 18 | 17552 |
| CFTR-Intron2-2453 | + | AGUAAUACACAGCUGAGAU | 19 | 17553 |
| CFTR-Intron2-2454 | + | GAGUAAUACACAGCUGAGAU | 20 | 17554 |
| CFTR-Intron2-2455 | + | GGAGUAAUACACAGCUGAGAU | 21 | 17555 |
| CFTR-Intron2-2456 | + | AGGAGUAAUACACAGCUGAGAU | 22 | 17556 |
| CFTR-Intron2-2457 | + | AAGGAGUAAUACACAGCUGAGAU | 23 | 17557 |
| CFTR-Intron2-2458 | + | AAAGGAGUAAUACACAGCUGAGAU | 24 | 17558 |
| CFTR-Intron2-2459 | + | GGAUCCUAACCUUUUGAU | 18 | 17559 |
| CFTR-Intron2-2460 | + | AGGAUCCUAACCUUUUGAU | 19 | 17560 |
| CFTR-Intron2-379 | + | AAGGAUCCUAACCUUUUGAU | 20 | 15479 |
| CFTR-Intron2-2461 | + | AAAGGAUCCUAACCUUUUGAU | 21 | 17561 |
| CFTR-Intron2-2462 | + | AAAAGGAUCCUAACCUUUUGAU | 22 | 17562 |
| CFTR-Intron2-2463 | + | CAAAAGGAUCCUAACCUUUUGAU | 23 | 17563 |
| CFTR-Intron2-2464 | + | UCAAAAGGAUCCUAACCUUUUGAU | 24 | 17564 |
| CFTR-Intron2-2465 | + | UUUUCUUUUAAAUACUAU | 18 | 17565 |
| CFTR-Intron2-2466 | + | GUUUUCUUUUAAAUACUAU | 19 | 17566 |
| CFTR-Intron2-700 | + | UGUUUUCUUUUAAAUACUAU | 20 | 15800 |
| CFTR-Intron2-2467 | + | CUGUUUUCUUUUAAAUACUAU | 21 | 17567 |
| CFTR-Intron2-2468 | + | UCUGUUUUCUUUUAAAUACUAU | 22 | 17568 |
| CFTR-Intron2-2469 | + | UUCUGUUUUCUUUUAAAUACUAU | 23 | 17569 |
| CFTR-Intron2-2470 | + | UUUCUGUUUUCUUUUAAAUACUAU | 24 | 17570 |
| CFTR-Intron2-2471 | + | AACUGAGAGAUUCUUUAU | 18 | 17571 |
| CFTR-Intron2-2472 | + | AAACUGAGAGAUUCUUUAU | 19 | 17572 |
| CFTR-Intron2-73 | + | GAAACUGAGAGAUUCUUUAU | 20 | 15173 |
| CFTR-Intron2-2473 | + | GGAAACUGAGAGAUUCUUUAU | 21 | 17573 |
| CFTR-Intron2-2474 | + | AGGAAACUGAGAGAUUCUUUAU | 22 | 17574 |
| CFTR-Intron2-2475 | + | AAGGAAACUGAGAGAUUCUUUAU | 23 | 17575 |
| CFTR-Intron2-2476 | + | AAAGGAAACUGAGAGAUUCUUUAU | 24 | 17576 |

TABLE 38E-continued

5th Tier

| gRNA Name | DNA Strand | Targeting Domain | Target Site Length | Seq ID |
|---|---|---|---|---|
| CFTR-Intron2-2477 | + | UUCAAAUACCAAUUUUAU | 18 | 17577 |
| CFTR-Intron2-2478 | + | UUUCAAAUACCAAUUUUAU | 19 | 17578 |
| CFTR-Intron2-2479 | + | AUUUCAAAUACCAAUUUUAU | 20 | 17579 |
| CFTR-Intron2-2480 | + | AAUUUCAAAUACCAAUUUUAU | 21 | 17580 |
| CFTR-Intron2-2481 | + | AAAUUUCAAAUACCAAUUUUAU | 22 | 17581 |
| CFTR-Intron2-2482 | + | UAAAUUUCAAAUACCAAUUUUAU | 23 | 17582 |
| CFTR-Intron2-2483 | + | AUAAAUUUCAAAUACCAAUUUUAU | 24 | 17583 |
| CFTR-Intron2-2484 | + | UUGAUUGGAAAGGAAACU | 18 | 17584 |
| CFTR-Intron2-2485 | + | UUUGAUUGGAAAGGAAACU | 19 | 17585 |
| CFTR-Intron2-2486 | + | UUUUGAUUGGAAAGGAAACU | 20 | 17586 |
| CFTR-Intron2-2487 | + | CUUUUGAUUGGAAAGGAAACU | 21 | 17587 |
| CFTR-Intron2-2488 | + | CCUUUUGAUUGGAAAGGAAACU | 22 | 17588 |
| CFTR-Intron2-2489 | + | ACCUUUUGAUUGGAAAGGAAACU | 23 | 17589 |
| CFTR-Intron2-2490 | + | AACCUUUUGAUUGGAAAGGAAACU | 24 | 17590 |
| CFTR-Intron2-2491 | + | GCCACUAAUCCCAACACU | 18 | 17591 |
| CFTR-Intron2-2492 | + | CGCCACUAAUCCCAACACU | 19 | 17592 |
| CFTR-Intron2-2493 | + | ACGCCACUAAUCCCAACACU | 20 | 17593 |
| CFTR-Intron2-2494 | + | CACGCCACUAAUCCCAACACU | 21 | 17594 |
| CFTR-Intron2-2495 | + | UCACGCCACUAAUCCCAACACU | 22 | 17595 |
| CFTR-Intron2-2496 | + | CUCACGCCACUAAUCCCAACACU | 23 | 17596 |
| CFTR-Intron2-2497 | + | GCUCACGCCACUAAUCCCAACACU | 24 | 17597 |
| CFTR-Intron2-2498 | + | GGCCCUAUUCUAGGCACU | 18 | 17598 |
| CFTR-Intron2-2499 | + | AGGCCCUAUUCUAGGCACU | 19 | 17599 |
| CFTR-Intron2-703 | + | CAGGCCCUAUUCUAGGCACU | 20 | 15803 |
| CFTR-Intron2-2500 | + | CCAGGCCCUAUUCUAGGCACU | 21 | 17600 |
| CFTR-Intron2-2501 | + | GCCAGGCCCUAUUCUAGGCACU | 22 | 17601 |
| CFTR-Intron2-2502 | + | UGCCAGGCCCUAUUCUAGGCACU | 23 | 17602 |
| CFTR-Intron2-2503 | + | AUGCCAGGCCCUAUUCUAGGCACU | 24 | 17603 |
| CFTR-Intron2-2504 | + | CCUGUAGUCCCAGCUACU | 18 | 17604 |
| CFTR-Intron2-2505 | + | GCCUGUAGUCCCAGCUACU | 19 | 17605 |
| CFTR-Intron2-2506 | + | UGCCUGUAGUCCCAGCUACU | 20 | 17606 |
| CFTR-Intron2-2507 | + | AUGCCUGUAGUCCCAGCUACU | 21 | 17607 |
| CFTR-Intron2-2508 | + | CAUGCCUGUAGUCCCAGCUACU | 22 | 17608 |
| CFTR-Intron2-2509 | + | GCAUGCCUGUAGUCCCAGCUACU | 23 | 17609 |
| CFTR-Intron2-2510 | + | UGCAUGCCUGUAGUCCCAGCUACU | 24 | 17610 |
| CFTR-Intron2-2511 | + | AGAAUGGGGUAGUUACCU | 18 | 17611 |
| CFTR-Intron2-2512 | + | UAGAAUGGGGUAGUUACCU | 19 | 17612 |

TABLE 38E-continued

5th Tier

| gRNA Name | DNA Strand | Targeting Domain | Target Site Length | Seq ID |
|---|---|---|---|---|
| CFTR-Intron2-2513 | + | AUAGAAUGGGGUAGUUACCU | 20 | 17613 |
| CFTR-Intron2-2514 | + | AAUAGAAUGGGGUAGUUACCU | 21 | 17614 |
| CFTR-Intron2-2515 | + | AAAUAGAAUGGGGUAGUUACCU | 22 | 17615 |
| CFTR-Intron2-2516 | + | AAAAUAGAAUGGGGUAGUUACCU | 23 | 17616 |
| CFTR-Intron2-2517 | + | AAAAAUAGAAUGGGGUAGUUACCU | 24 | 17617 |
| CFTR-Intron2-2518 | + | GAGCAGAGAAUGUUAGCU | 18 | 17618 |
| CFTR-Intron2-2519 | + | AGAGCAGAGAAUGUUAGCU | 19 | 17619 |
| CFTR-Intron2-2520 | + | GAGAGCAGAGAAUGUUAGCU | 20 | 17620 |
| CFTR-Intron2-2521 | + | GGAGAGCAGAGAAUGUUAGCU | 21 | 17621 |
| CFTR-Intron2-2522 | + | AGGAGAGCAGAGAAUGUUAGCU | 22 | 17622 |
| CFTR-Intron2-2523 | + | CAGGAGAGCAGAGAAUGUUAGCU | 23 | 17623 |
| CFTR-Intron2-2524 | + | CCAGGAGAGCAGAGAAUGUUAGCU | 24 | 17624 |
| CFTR-Intron2-2525 | + | UUUCCACUCAGAGUGGCU | 18 | 17625 |
| CFTR-Intron2-2526 | + | CUUUCCACUCAGAGUGGCU | 19 | 17626 |
| CFTR-Intron2-2527 | + | GCUUUCCACUCAGAGUGGCU | 20 | 17627 |
| CFTR-Intron2-2528 | + | UGCUUUCCACUCAGAGUGGCU | 21 | 17628 |
| CFTR-Intron2-2529 | + | AUGCUUUCCACUCAGAGUGGCU | 22 | 17629 |
| CFTR-Intron2-2530 | + | GAUGCUUUCCACUCAGAGUGGCU | 23 | 17630 |
| CFTR-Intron2-2531 | + | UGAUGCUUUCCACUCAGAGUGGCU | 24 | 17631 |
| CFTR-Intron2-2532 | + | AUAUCCUGACUACAAUCU | 18 | 17632 |
| CFTR-Intron2-2533 | + | CAUAUCCUGACUACAAUCU | 19 | 17633 |
| CFTR-Intron2-395 | + | UCAUAUCCUGACUACAAUCU | 20 | 15495 |
| CFTR-Intron2-2534 | + | UUCAUAUCCUGACUACAAUCU | 21 | 17634 |
| CFTR-Intron2-2535 | + | GUUCAUAUCCUGACUACAAUCU | 22 | 17635 |
| CFTR-Intron2-2536 | + | AGUUCAUAUCCUGACUACAAUCU | 23 | 17636 |
| CFTR-Intron2-2537 | + | AAGUUCAUAUCCUGACUACAAUCU | 24 | 17637 |
| CFTR-Intron2-2538 | + | GAAGCUGGCCCUUGAUCU | 18 | 17638 |
| CFTR-Intron2-2539 | + | AGAAGCUGGCCCUUGAUCU | 19 | 17639 |
| CFTR-Intron2-2540 | + | UAGAAGCUGGCCCUUGAUCU | 20 | 17640 |
| CFTR-Intron2-2541 | + | AUAGAAGCUGGCCCUUGAUCU | 21 | 17641 |
| CFTR-Intron2-2542 | + | AAUAGAAGCUGGCCCUUGAUCU | 22 | 17642 |
| CFTR-Intron2-2543 | + | UAAUAGAAGCUGGCCCUUGAUCU | 23 | 17643 |
| CFTR-Intron2-2544 | + | AUAAUAGAAGCUGGCCCUUGAUCU | 24 | 17644 |
| CFTR-Intron2-2545 | + | GCAAAGUAUAUUAUCUCU | 18 | 17645 |
| CFTR-Intron2-2546 | + | GGCAAAGUAUAUUAUCUCU | 19 | 17646 |
| CFTR-Intron2-2547 | + | UGGCAAAGUAUAUUAUCUCU | 20 | 17647 |
| CFTR-Intron2-2548 | + | CUGGCAAAGUAUAUUAUCUCU | 21 | 17648 |

TABLE 38E-continued

| | | | Target | |
| | DNA | | Site | |
| gRNA Name | Strand | Targeting Domain | Length | Seq ID |
|---|---|---|---|---|
| CFTR-Intron2-2549 | + | ACUGGCAAAGUAUAUUAUCUCU | 22 | 17649 |
| CFTR-Intron2-2550 | + | AACUGGCAAAGUAUAUUAUCUCU | 23 | 17650 |
| CFTR-Intron2-2551 | + | UAACUGGCAAAGUAUAUUAUCUCU | 24 | 17651 |
| CFTR-Intron2-2552 | + | ACUAUGACUCAAGAGUCU | 18 | 17652 |
| CFTR-Intron2-2553 | + | CACUAUGACUCAAGAGUCU | 19 | 17653 |
| CFTR-Intron2-2554 | + | GCACUAUGACUCAAGAGUCU | 20 | 17654 |
| CFTR-Intron2-2555 | + | AGCACUAUGACUCAAGAGUCU | 21 | 17655 |
| CFTR-Intron2-2556 | + | AAGCACUAUGACUCAAGAGUCU | 22 | 17656 |
| CFTR-Intron2-2557 | + | UAAGCACUAUGACUCAAGAGUCU | 23 | 17657 |
| CFTR-Intron2-2558 | + | GUAAGCACUAUGACUCAAGAGUCU | 24 | 17658 |
| CFTR-Intron2-2559 | + | AUCAUGUAUUAAAGGUCU | 18 | 17659 |
| CFTR-Intron2-2560 | + | AAUCAUGUAUUAAAGGUCU | 19 | 17660 |
| CFTR-Intron2-2561 | + | AAAUCAUGUAUUAAAGGUCU | 20 | 17661 |
| CFTR-Intron2-2562 | + | AAAAUCAUGUAUUAAAGGUCU | 21 | 17662 |
| CFTR-Intron2-2563 | + | UAAAAUCAUGUAUUAAAGGUCU | 22 | 17663 |
| CFTR-Intron2-2564 | + | CUAAAAUCAUGUAUUAAAGGUCU | 23 | 17664 |
| CFTR-Intron2-2565 | + | ACUAAAAUCAUGUAUUAAAGGUCU | 24 | 17665 |
| CFTR-Intron2-2566 | + | AGAAAGCUGGUCCGGUCU | 18 | 17666 |
| CFTR-Intron2-2567 | + | UAGAAAGCUGGUCCGGUCU | 19 | 17667 |
| CFTR-Intron2-2568 | + | GUAGAAAGCUGGUCCGGUCU | 20 | 17668 |
| CFTR-Intron2-2569 | + | UGUAGAAAGCUGGUCCGGUCU | 21 | 17669 |
| CFTR-Intron2-2570 | + | AUGUAGAAAGCUGGUCCGGUCU | 22 | 17670 |
| CFTR-Intron2-2571 | + | UAUGUAGAAAGCUGGUCCGGUCU | 23 | 17671 |
| CFTR-Intron2-2572 | + | UUAUGUAGAAAGCUGGUCCGGUCU | 24 | 17672 |
| CFTR-Intron2-2573 | + | UCUAAUAAGACAAAUUCU | 18 | 17673 |
| CFTR-Intron2-2574 | + | CUCUAAUAAGACAAAUUCU | 19 | 17674 |
| CFTR-Intron2-2575 | + | UCUCUAAUAAGACAAAUUCU | 20 | 17675 |
| CFTR-Intron2-2576 | + | GUCUCUAAUAAGACAAAUUCU | 21 | 17676 |
| CFTR-Intron2-2577 | + | GGUCUCUAAUAAGACAAAUUCU | 22 | 17677 |
| CFTR-Intron2-2578 | + | UGGUCUCUAAUAAGACAAAUUCU | 23 | 17678 |
| CFTR-Intron2-2579 | + | AUGGUCUCUAAUAAGACAAAUUCU | 24 | 17679 |
| CFTR-Intron2-2580 | + | CAUUUGGUUACUCAGAGU | 18 | 17680 |
| CFTR-Intron2-2581 | + | ACAUUUGGUUACUCAGAGU | 19 | 17681 |
| CFTR-Intron2-2582 | + | AACAUUUGGUUACUCAGAGU | 20 | 17682 |
| CFTR-Intron2-2583 | + | UAACAUUUGGUUACUCAGAGU | 21 | 17683 |
| CFTR-Intron2-2584 | + | AUAACAUUUGGUUACUCAGAGU | 22 | 17684 |
| CFTR-Intron2-2585 | + | CAUAACAUUUGGUUACUCAGAGU | 23 | 17685 |

TABLE 38E-continued

5th Tier

| gRNA Name | DNA Strand | Targeting Domain | Target Site Length | Seq ID |
|---|---|---|---|---|
| CFTR-Intron2-2586 | + | CCAUAACAUUUGGUUACUCAGAGU | 24 | 17686 |
| CFTR-Intron2-2587 | + | GAAUAGACAUUAAAUAGU | 18 | 17687 |
| CFTR-Intron2-2588 | + | AGAAUAGACAUUAAAUAGU | 19 | 17688 |
| CFTR-Intron2-2589 | + | AAGAAUAGACAUUAAAUAGU | 20 | 17689 |
| CFTR-Intron2-2590 | + | UAAGAAUAGACAUUAAAUAGU | 21 | 17690 |
| CFTR-Intron2-2591 | + | GUAAGAAUAGACAUUAAAUAGU | 22 | 17691 |
| CFTR-Intron2-2592 | + | AGUAAGAAUAGACAUUAAAUAGU | 23 | 17692 |
| CFTR-Intron2-2593 | + | UAGUAAGAAUAGACAUUAAAUAGU | 24 | 17693 |
| CFTR-Intron2-2594 | + | CUGAGGAGAAGGCAAGGU | 18 | 17694 |
| CFTR-Intron2-2595 | + | CCUGAGGAGAAGGCAAGGU | 19 | 17695 |
| CFTR-Intron2-405 | + | ACCUGAGGAGAAGGCAAGGU | 20 | 15505 |
| CFTR-Intron2-2596 | + | UACCUGAGGAGAAGGCAAGGU | 21 | 17696 |
| CFTR-Intron2-2597 | + | UUACCUGAGGAGAAGGCAAGGU | 22 | 17697 |
| CFTR-Intron2-2598 | + | GUUACCUGAGGAGAAGGCAAGGU | 23 | 17698 |
| CFTR-Intron2-2599 | + | AGUUACCUGAGGAGAAGGCAAGGU | 24 | 17699 |
| CFTR-Intron2-2600 | + | GGGCAGAUCACUUGAGGU | 18 | 17700 |
| CFTR-Intron2-2601 | + | CGGGCAGAUCACUUGAGGU | 19 | 17701 |
| CFTR-Intron2-2602 | + | GCGGGCAGAUCACUUGAGGU | 20 | 17702 |
| CFTR-Intron2-2603 | + | GGCGGGCAGAUCACUUGAGGU | 21 | 17703 |
| CFTR-Intron2-2604 | + | AGGCGGGCAGAUCACUUGAGGU | 22 | 17704 |
| CFTR-Intron2-2605 | + | AAGGCGGGCAGAUCACUUGAGGU | 23 | 17705 |
| CFTR-Intron2-2606 | + | CAAGGCGGGCAGAUCACUUGAGGU | 24 | 17706 |
| CFTR-Intron2-2607 | + | UGGGCAGAUCACUUGAGGU | 19 | 17707 |
| CFTR-Intron2-2608 | + | GUGGGCAGAUCACUUGAGGU | 20 | 17708 |
| CFTR-Intron2-2609 | + | GGUGGGCAGAUCACUUGAGGU | 21 | 17709 |
| CFTR-Intron2-2610 | + | AGGUGGGCAGAUCACUUGAGGU | 22 | 17710 |
| CFTR-Intron2-2611 | + | AAGGUGGGCAGAUCACUUGAGGU | 23 | 17711 |
| CFTR-Intron2-2612 | + | CAAGGUGGGCAGAUCACUUGAGGU | 24 | 17712 |
| CFTR-Intron2-2613 | + | GUAGAAAGCUGGUCCGGU | 18 | 17713 |
| CFTR-Intron2-2614 | + | UGUAGAAAGCUGGUCCGGU | 19 | 17714 |
| CFTR-Intron2-2615 | + | AUGUAGAAAGCUGGUCCGGU | 20 | 17715 |
| CFTR-Intron2-2616 | + | UAUGUAGAAAGCUGGUCCGGU | 21 | 17716 |
| CFTR-Intron2-2617 | + | UUAUGUAGAAAGCUGGUCCGGU | 22 | 17717 |
| CFTR-Intron2-2618 | + | UUUAUGUAGAAAGCUGGUCCGGU | 23 | 17718 |
| CFTR-Intron2-2619 | + | CUUUAUGUAGAAAGCUGGUCCGGU | 24 | 17719 |
| CFTR-Intron2-2620 | + | ACCUAUAAUCCCAGCAUU | 18 | 17720 |
| CFTR-Intron2-2621 | + | CACCUAUAAUCCCAGCAUU | 19 | 17721 |

TABLE 38E-continued

5th Tier

| gRNA Name | DNA Strand | Targeting Domain | Target Site Length | Seq ID |
|---|---|---|---|---|
| CFTR-Intron2-2622 | + | ACACCUAUAAUCCCAGCAUU | 20 | 17722 |
| CFTR-Intron2-2623 | + | CACACCUAUAAUCCCAGCAUU | 21 | 17723 |
| CFTR-Intron2-2624 | + | UCACACCUAUAAUCCCAGCAUU | 22 | 17724 |
| CFTR-Intron2-2625 | + | CUCACACCUAUAAUCCCAGCAUU | 23 | 17725 |
| CFTR-Intron2-2626 | + | GCUCACACCUAUAAUCCCAGCAUU | 24 | 17726 |
| CFTR-Intron2-2627 | + | AAUACCCAUUAUAUUAUU | 18 | 17727 |
| CFTR-Intron2-2628 | + | CAAUACCCAUUAUAUUAUU | 19 | 17728 |
| CFTR-Intron2-2629 | + | UCAAUACCCAUUAUAUUAUU | 20 | 17729 |
| CFTR-Intron2-2630 | + | UUCAAUACCCAUUAUAUUAUU | 21 | 17730 |
| CFTR-Intron2-2631 | + | AUUCAAUACCCAUUAUAUUAUU | 22 | 17731 |
| CFTR-Intron2-2632 | + | UAUUCAAUACCCAUUAUAUUAUU | 23 | 17732 |
| CFTR-Intron2-2633 | + | AUAUUCAAUACCCAUUAUAUUAUU | 24 | 17733 |
| CFTR-Intron2-2634 | + | CCACUAAUCCCAACACUU | 18 | 17734 |
| CFTR-Intron2-2635 | + | GCCACUAAUCCCAACACUU | 19 | 17735 |
| CFTR-Intron2-717 | + | CGCCACUAAUCCCAACACUU | 20 | 15817 |
| CFTR-Intron2-2636 | + | ACGCCACUAAUCCCAACACUU | 21 | 17736 |
| CFTR-Intron2-2637 | + | CACGCCACUAAUCCCAACACUU | 22 | 17737 |
| CFTR-Intron2-2638 | + | UCACGCCACUAAUCCCAACACUU | 23 | 17738 |
| CFTR-Intron2-2639 | + | CUCACGCCACUAAUCCCAACACUU | 24 | 17739 |
| CFTR-Intron2-2640 | + | ACCAUCUGGCAACCACUU | 18 | 17740 |
| CFTR-Intron2-2641 | + | AACCAUCUGGCAACCACUU | 19 | 17741 |
| CFTR-Intron2-2642 | + | CAACCAUCUGGCAACCACUU | 20 | 17742 |
| CFTR-Intron2-2643 | + | UCAACCAUCUGGCAACCACUU | 21 | 17743 |
| CFTR-Intron2-2644 | + | UUCAACCAUCUGGCAACCACUU | 22 | 17744 |
| CFTR-Intron2-2645 | + | CUUCAACCAUCUGGCAACCACUU | 23 | 17745 |
| CFTR-Intron2-2646 | + | UCUUCAACCAUCUGGCAACCACUU | 24 | 17746 |
| CFTR-Intron2-2647 | + | AUGGUGGAAACCAUACUU | 18 | 17747 |
| CFTR-Intron2-2648 | + | CAUGGUGGAAACCAUACUU | 19 | 17748 |
| CFTR-Intron2-2649 | + | ACAUGGUGGAAACCAUACUU | 20 | 17749 |
| CFTR-Intron2-2650 | + | AACAUGGUGGAAACCAUACUU | 21 | 17750 |
| CFTR-Intron2-2651 | + | GAACAUGGUGGAAACCAUACUU | 22 | 17751 |
| CFTR-Intron2-2652 | + | GGAACAUGGUGGAAACCAUACUU | 23 | 17752 |
| CFTR-Intron2-2653 | + | AGGAACAUGGUGGAAACCAUACUU | 24 | 17753 |
| CFTR-Intron2-2654 | + | CAUGGUCACAAGGCAGUU | 18 | 17754 |
| CFTR-Intron2-2655 | + | CCAUGGUCACAAGGCAGUU | 19 | 17755 |
| CFTR-Intron2-2656 | + | GCCAUGGUCACAAGGCAGUU | 20 | 17756 |
| CFTR-Intron2-2657 | + | GGCCAUGGUCACAAGGCAGUU | 21 | 17757 |

TABLE 38E-continued

5th Tier

| gRNA Name | DNA Strand | Targeting Domain | Target Site Length | Seq ID |
|---|---|---|---|---|
| CFTR-Intron2-2658 | + | GGGCCAUGGUCACAAGGCAGUU | 22 | 17758 |
| CFTR-Intron2-2659 | + | AGGGCCAUGGUCACAAGGCAGUU | 23 | 17759 |
| CFTR-Intron2-2660 | + | GAGGGCCAUGGUCACAAGGCAGUU | 24 | 17760 |
| CFTR-Intron2-2661 | + | UAUUCAAAUAUAAAGGUU | 18 | 17761 |
| CFTR-Intron2-2662 | + | GUAUUCAAAUAUAAAGGUU | 19 | 17762 |
| CFTR-Intron2-2663 | + | UGUAUUCAAAUAUAAAGGUU | 20 | 17763 |
| CFTR-Intron2-2664 | + | UUGUAUUCAAAUAUAAAGGUU | 21 | 17764 |
| CFTR-Intron2-2665 | + | UUUGUAUUCAAAUAUAAAGGUU | 22 | 17765 |
| CFTR-Intron2-2666 | + | AUUUGUAUUCAAAUAUAAAGGUU | 23 | 17766 |
| CFTR-Intron2-2667 | + | CAUUUGUAUUCAAAUAUAAAGGUU | 24 | 17767 |
| CFTR-Intron2-2668 | + | CCUAUAAUCCCAGCAUUU | 18 | 17768 |
| CFTR-Intron2-2669 | + | ACCUAUAAUCCCAGCAUUU | 19 | 17769 |
| CFTR-Intron2-720 | + | CACCUAUAAUCCCAGCAUUU | 20 | 15820 |
| CFTR-Intron2-2670 | + | ACACCUAUAAUCCCAGCAUUU | 21 | 17770 |
| CFTR-Intron2-2671 | + | CACACCUAUAAUCCCAGCAUUU | 22 | 17771 |
| CFTR-Intron2-2672 | + | UCACACCUAUAAUCCCAGCAUUU | 23 | 17772 |
| CFTR-Intron2-2673 | + | CUCACACCUAUAAUCCCAGCAUUU | 24 | 17773 |
| CFTR-Intron2-2674 | + | CACUAAUCCCAACACUUU | 18 | 17774 |
| CFTR-Intron2-2675 | + | CCACUAAUCCCAACACUUU | 19 | 17775 |
| CFTR-Intron2-476 | + | GCCACUAAUCCCAACACUUU | 20 | 15576 |
| CFTR-Intron2-2676 | + | CGCCACUAAUCCCAACACUUU | 21 | 17776 |
| CFTR-Intron2-2677 | + | ACGCCACUAAUCCCAACACUUU | 22 | 17777 |
| CFTR-Intron2-2678 | + | CACGCCACUAAUCCCAACACUUU | 23 | 17778 |
| CFTR-Intron2-2679 | + | UCACGCCACUAAUCCCAACACUUU | 24 | 17779 |
| CFTR-Intron2-2680 | + | GAAACUGAGAGAUUCUUU | 18 | 17780 |
| CFTR-Intron2-2681 | + | GGAAACUGAGAGAUUCUUU | 19 | 17781 |
| CFTR-Intron2-2682 | + | AGGAAACUGAGAGAUUCUUU | 20 | 17782 |
| CFTR-Intron2-2683 | + | AAGGAAACUGAGAGAUUCUUU | 21 | 17783 |
| CFTR-Intron2-2684 | + | AAAGGAAACUGAGAGAUUCUUU | 22 | 17784 |
| CFTR-Intron2-2685 | + | GAAAGGAAACUGAGAGAUUCUUU | 23 | 17785 |
| CFTR-Intron2-2686 | + | GGAAAGGAAACUGAGAGAUUCUUU | 24 | 17786 |
| CFTR-Intron2-2687 | + | CCCUGGGCAAUGUAGUUU | 18 | 17787 |
| CFTR-Intron2-2688 | + | ACCCUGGGCAAUGUAGUUU | 19 | 17788 |
| CFTR-Intron2-2689 | + | GACCCUGGGCAAUGUAGUUU | 20 | 17789 |
| CFTR-Intron2-2690 | + | UGACCCUGGGCAAUGUAGUUU | 21 | 17790 |
| CFTR-Intron2-2691 | + | GUGACCCUGGGCAAUGUAGUUU | 22 | 17791 |
| CFTR-Intron2-2692 | + | AGUGACCCUGGGCAAUGUAGUUU | 23 | 17792 |

TABLE 38E-continued

5th Tier

| gRNA Name | DNA Strand | Targeting Domain | Target Site Length | Seq ID |
|---|---|---|---|---|
| CFTR-Intron2-2693 | + | UAGUGACCCUGGGCAAUGUAGUUUU | 24 | 17793 |
| CFTR-Intron2-2694 | + | CUAUAAUCCCAGCAUUUU | 18 | 17794 |
| CFTR-Intron2-2695 | + | CCUAUAAUCCCAGCAUUUU | 19 | 17795 |
| CFTR-Intron2-722 | + | ACCUAUAAUCCCAGCAUUUU | 20 | 15822 |
| CFTR-Intron2-2696 | + | CACCUAUAAUCCCAGCAUUUU | 21 | 17796 |
| CFTR-Intron2-2697 | + | ACACCUAUAAUCCCAGCAUUUU | 22 | 17797 |
| CFTR-Intron2-2698 | + | CACACCUAUAAUCCCAGCAUUUU | 23 | 17798 |
| CFTR-Intron2-2699 | + | UCACACCUAUAAUCCCAGCAUUUU | 24 | 17799 |
| CFTR-Intron2-2700 | + | CCUGGGCAAUGUAGUUUU | 18 | 17800 |
| CFTR-Intron2-2701 | + | CCCUGGGCAAUGUAGUUUU | 19 | 17801 |
| CFTR-Intron2-416 | + | ACCCUGGGCAAUGUAGUUUU | 20 | 15516 |
| CFTR-Intron2-2702 | + | GACCCUGGGCAAUGUAGUUUU | 21 | 17802 |
| CFTR-Intron2-2703 | + | UGACCCUGGGCAAUGUAGUUUU | 22 | 17803 |
| CFTR-Intron2-2704 | + | GUGACCCUGGGCAAUGUAGUUUU | 23 | 17804 |
| CFTR-Intron2-2705 | + | AGUGACCCUGGGCAAUGUAGUUUU | 24 | 17805 |
| CFTR-Intron2-2706 | + | AACCAAAUGUGUAUUUUU | 18 | 17806 |
| CFTR-Intron2-2707 | + | AAACCAAAUGUGUAUUUUU | 19 | 17807 |
| CFTR-Intron2-2708 | + | GAAACCAAAUGUGUAUUUUU | 20 | 17808 |
| CFTR-Intron2-2709 | + | UGAAACCAAAUGUGUAUUUUU | 21 | 17809 |
| CFTR-Intron2-2710 | + | CUGAAACCAAAUGUGUAUUUUU | 22 | 17810 |
| CFTR-Intron2-2711 | + | UCUGAAACCAAAUGUGUAUUUUU | 23 | 17811 |
| CFTR-Intron2-2712 | + | CUCUGAAACCAAAUGUGUAUUUUU | 24 | 17812 |
| CFTR-Intron2-2713 | − | AUAGUAUUUAAAAGAAAA | 18 | 17813 |
| CFTR-Intron2-2714 | − | UAUAGUAUUUAAAAGAAAA | 19 | 17814 |
| CFTR-Intron2-2715 | − | CUAUAGUAUUUAAAAGAAAA | 20 | 17815 |
| CFTR-Intron2-2716 | − | CCUAUAGUAUUUAAAAGAAAA | 21 | 17816 |
| CFTR-Intron2-2717 | − | UCCUAUAGUAUUUAAAAGAAAA | 22 | 17817 |
| CFTR-Intron2-2718 | − | UUCCUAUAGUAUUUAAAAGAAAA | 23 | 17818 |
| CFTR-Intron2-2719 | − | GUUCCUAUAGUAUUUAAAAGAAAA | 24 | 17819 |
| CFTR-Intron2-2720 | − | AUUUUACAGAAAAGCAAA | 18 | 17820 |
| CFTR-Intron2-2721 | − | UAUUUUACAGAAAAGCAAA | 19 | 17821 |
| CFTR-Intron2-2722 | − | CUAUUUUACAGAAAAGCAAA | 20 | 17822 |
| CFTR-Intron2-2723 | − | UCUAUUUUACAGAAAAGCAAA | 21 | 17823 |
| CFTR-Intron2-2724 | − | CUCUAUUUUACAGAAAAGCAAA | 22 | 17824 |
| CFTR-Intron2-2725 | − | UCUCUAUUUUACAGAAAAGCAAA | 23 | 17825 |
| CFTR-Intron2-2726 | − | AUCUCUAUUUUACAGAAAAGCAAA | 24 | 17826 |
| CFTR-Intron2-2727 | − | UGAUUUAGUAGUUGAAA | 18 | 17827 |

TABLE 38E-continued

5th Tier

| gRNA Name | DNA Strand | Targeting Domain | Target Site Length | Seq ID |
|---|---|---|---|---|
| CFTR-Intron2-2728 | − | AUGAUUUUAGUAGUUGAAA | 19 | 17828 |
| CFTR-Intron2-2729 | − | CAUGAUUUUAGUAGUUGAAA | 20 | 17829 |
| CFTR-Intron2-2730 | − | ACAUGAUUUUAGUAGUUGAAA | 21 | 17830 |
| CFTR-Intron2-2731 | − | UACAUGAUUUUAGUAGUUGAAA | 22 | 17831 |
| CFTR-Intron2-2732 | − | AUACAUGAUUUUAGUAGUUGAAA | 23 | 17832 |
| CFTR-Intron2-2733 | − | AAUACAUGAUUUUAGUAGUUGAAA | 24 | 17833 |
| CFTR-Intron2-2734 | − | CUAGCUUAAGUAAAUAAA | 18 | 17834 |
| CFTR-Intron2-2735 | − | ACUAGCUUAAGUAAAUAAA | 19 | 17835 |
| CFTR-Intron2-613 | − | UACUAGCUUAAGUAAAUAAA | 20 | 15713 |
| CFTR-Intron2-2736 | − | UUACUAGCUUAAGUAAAUAAA | 21 | 17836 |
| CFTR-Intron2-2737 | − | UUUACUAGCUUAAGUAAAUAAA | 22 | 17837 |
| CFTR-Intron2-2738 | − | AUUUACUAGCUUAAGUAAAUAAA | 23 | 17838 |
| CFTR-Intron2-2739 | − | AAUUUACUAGCUUAAGUAAAUAAA | 24 | 17839 |
| CFTR-Intron2-2740 | − | CUGGCCUUAGGAACUCAA | 18 | 17840 |
| CFTR-Intron2-2741 | − | ACUGGCCUUAGGAACUCAA | 19 | 17841 |
| CFTR-Intron2-241 | − | AACUGGCCUUAGGAACUCAA | 20 | 15341 |
| CFTR-Intron2-2742 | − | GAACUGGCCUUAGGAACUCAA | 21 | 17842 |
| CFTR-Intron2-2743 | − | AGAACUGGCCUUAGGAACUCAA | 22 | 17843 |
| CFTR-Intron2-2744 | − | GAGAACUGGCCUUAGGAACUCAA | 23 | 17844 |
| CFTR-Intron2-2745 | − | GGAGAACUGGCCUUAGGAACUCAA | 24 | 17845 |
| CFTR-Intron2-2746 | − | AUCCCCAAGUGCCUAGAA | 18 | 17846 |
| CFTR-Intron2-2747 | − | UAUCCCCAAGUGCCUAGAA | 19 | 17847 |
| CFTR-Intron2-2748 | − | GUAUCCCCAAGUGCCUAGAA | 20 | 17848 |
| CFTR-Intron2-2749 | − | UGUAUCCCCAAGUGCCUAGAA | 21 | 17849 |
| CFTR-Intron2-2750 | − | AUGUAUCCCCAAGUGCCUAGAA | 22 | 17850 |
| CFTR-Intron2-2751 | − | GAUGUAUCCCCAAGUGCCUAGAA | 23 | 17851 |
| CFTR-Intron2-2752 | − | UGAUGUAUCCCCAAGUGCCUAGAA | 24 | 17852 |
| CFTR-Intron2-2753 | − | GAUAAAGGGUGAGUGAA | 18 | 17853 |
| CFTR-Intron2-2754 | − | AGAUAAAGGGUGAGUGAA | 19 | 17854 |
| CFTR-Intron2-248 | − | CAGAUAAAGGGUGAGUGAA | 20 | 15348 |
| CFTR-Intron2-2755 | − | CCAGAUAAAGGGUGAGUGAA | 21 | 17855 |
| CFTR-Intron2-2756 | − | GCCAGAUAAAGGGUGAGUGAA | 22 | 17856 |
| CFTR-Intron2-2757 | − | UGCCAGAUAAAGGGUGAGUGAA | 23 | 17857 |
| CFTR-Intron2-2758 | − | AUGCCAGAUAAAGGGUGAGUGAA | 24 | 17858 |
| CFTR-Intron2-2759 | − | AUUUUAUUCCUUUGUGAA | 18 | 17859 |
| CFTR-Intron2-2760 | − | UAUUUUAUUCCUUUGUGAA | 19 | 17860 |
| CFTR-Intron2-2761 | − | AUAUUUUAUUCCUUUGUGAA | 20 | 17861 |

TABLE 38E-continued

| | | 5th Tier | | |
|---|---|---|---|---|
| gRNA Name | DNA Strand | Targeting Domain | Target Site Length | Seq ID |
| CFTR-Intron2-2762 | − | GAUAUUUUAUUCCUUUGUGAA | 21 | 17862 |
| CFTR-Intron2-2763 | − | AGAUAUUUUAUUCCUUUGUGAA | 22 | 17863 |
| CFTR-Intron2-2764 | − | GAGAUAUUUUAUUCCUUUGUGAA | 23 | 17864 |
| CFTR-Intron2-2765 | − | AGAGAUAUUUUAUUCCUUUGUGAA | 24 | 17865 |
| CFTR-Intron2-2766 | − | ACUAGCUUAAGUAAAUAA | 18 | 17866 |
| CFTR-Intron2-2767 | − | UACUAGCUUAAGUAAAUAA | 19 | 17867 |
| CFTR-Intron2-2768 | − | UUACUAGCUUAAGUAAAUAA | 20 | 17868 |
| CFTR-Intron2-2769 | − | UUUACUAGCUUAAGUAAAUAA | 21 | 17869 |
| CFTR-Intron2-2770 | − | AUUUACUAGCUUAAGUAAAUAA | 22 | 17870 |
| CFTR-Intron2-2771 | − | AAUUUACUAGCUUAAGUAAAUAA | 23 | 17871 |
| CFTR-Intron2-2772 | − | CAAUUUACUAGCUUAAGUAAAUAA | 24 | 17872 |
| CFTR-Intron2-2773 | − | UGUCUAUUCUUACUAUAA | 18 | 17873 |
| CFTR-Intron2-2774 | − | AUGUCUAUUCUUACUAUAA | 19 | 17874 |
| CFTR-Intron2-2775 | − | AAUGUCUAUUCUUACUAUAA | 20 | 17875 |
| CFTR-Intron2-2776 | − | UAAUGUCUAUUCUUACUAUAA | 21 | 17876 |
| CFTR-Intron2-2777 | − | UUAAUGUCUAUUCUUACUAUAA | 22 | 17877 |
| CFTR-Intron2-2778 | − | UUUAAUGUCUAUUCUUACUAUAA | 23 | 17878 |
| CFTR-Intron2-2779 | − | AUUUAAUGUCUAUUCUUACUAUAA | 24 | 17879 |
| CFTR-Intron2-2780 | − | AUGGUAACUUGACAGUAA | 18 | 17880 |
| CFTR-Intron2-2781 | − | UAUGGUAACUUGACAGUAA | 19 | 17881 |
| CFTR-Intron2-251 | − | UUAUGGUAACUUGACAGUAA | 20 | 15351 |
| CFTR-Intron2-2782 | − | CUUAUGGUAACUUGACAGUAA | 21 | 17882 |
| CFTR-Intron2-2783 | − | ACUUAUGGUAACUUGACAGUAA | 22 | 17883 |
| CFTR-Intron2-2784 | − | UACUUAUGGUAACUUGACAGUAA | 23 | 17884 |
| CFTR-Intron2-2785 | − | UUACUUAUGGUAACUUGACAGUAA | 24 | 17885 |
| CFTR-Intron2-2786 | − | AAAAAAGGCUUUCAUUAA | 18 | 17886 |
| CFTR-Intron2-2787 | − | GAAAAAAGGCUUUCAUUAA | 19 | 17887 |
| CFTR-Intron2-2788 | − | AGAAAAAAGGCUUUCAUUAA | 20 | 17888 |
| CFTR-Intron2-2789 | − | GAGAAAAAAGGCUUUCAUUAA | 21 | 17889 |
| CFTR-Intron2-2790 | − | AGAGAAAAAAGGCUUUCAUUAA | 22 | 17890 |
| CFTR-Intron2-2791 | − | AAGAGAAAAAAGGCUUUCAUUAA | 23 | 17891 |
| CFTR-Intron2-2792 | − | GAAGAGAAAAAAGGCUUUCAUUAA | 24 | 17892 |
| CFTR-Intron2-2793 | − | AGAGUAGGGCUGGGUUAA | 18 | 17893 |
| CFTR-Intron2-2794 | − | CAGAGUAGGGCUGGGUUAA | 19 | 17894 |
| CFTR-Intron2-2795 | − | UCAGAGUAGGGCUGGGUUAA | 20 | 17895 |
| CFTR-Intron2-2796 | − | AUCAGAGUAGGGCUGGGUUAA | 21 | 17896 |
| CFTR-Intron2-2797 | − | AAUCAGAGUAGGGCUGGGUUAA | 22 | 17897 |

TABLE 38E-continued

5th Tier

| gRNA Name | DNA Strand | Targeting Domain | Target Site Length | Seq ID |
|---|---|---|---|---|
| CFTR-Intron2-2798 | - | UAAUCAGAGUAGGGCUGGGUUAA | 23 | 17898 |
| CFTR-Intron2-2799 | - | UUAAUCAGAGUAGGGCUGGGUUAA | 24 | 17899 |
| CFTR-Intron2-2800 | - | UGUUCCUAUAGUAUUUAA | 18 | 17900 |
| CFTR-Intron2-2801 | - | GUGUUCCUAUAGUAUUUAA | 19 | 17901 |
| CFTR-Intron2-2802 | - | GGUGUUCCUAUAGUAUUUAA | 20 | 17902 |
| CFTR-Intron2-2803 | - | UGGUGUUCCUAUAGUAUUUAA | 21 | 17903 |
| CFTR-Intron2-2804 | - | CUGGUGUUCCUAUAGUAUUUAA | 22 | 17904 |
| CFTR-Intron2-2805 | - | GCUGGUGUUCCUAUAGUAUUUAA | 23 | 17905 |
| CFTR-Intron2-2806 | - | AGCUGGUGUUCCUAUAGUAUUUAA | 24 | 17906 |
| CFTR-Intron2-2807 | - | GUGGACCACUUUUUCACA | 18 | 17907 |
| CFTR-Intron2-2808 | - | UGUGGACCACUUUUUCACA | 19 | 17908 |
| CFTR-Intron2-2809 | - | GUGUGGACCACUUUUUCACA | 20 | 17909 |
| CFTR-Intron2-2810 | - | CGUGUGGACCACUUUUUCACA | 21 | 17910 |
| CFTR-Intron2-2811 | - | CCGUGUGGACCACUUUUUCACA | 22 | 17911 |
| CFTR-Intron2-2812 | - | UCCGUGUGGACCACUUUUUCACA | 23 | 17912 |
| CFTR-Intron2-2813 | - | UUCCGUGUGGACCACUUUUUCACA | 24 | 17913 |
| CFTR-Intron2-2814 | - | GAAAUGGCUAGCAUUACA | 18 | 17914 |
| CFTR-Intron2-2815 | - | UGAAAUGGCUAGCAUUACA | 19 | 17915 |
| CFTR-Intron2-2816 | - | GUGAAAUGGCUAGCAUUACA | 20 | 17916 |
| CFTR-Intron2-2817 | - | UGUGAAAUGGCUAGCAUUACA | 21 | 17917 |
| CFTR-Intron2-2818 | - | AUGUGAAAUGGCUAGCAUUACA | 22 | 17918 |
| CFTR-Intron2-2819 | - | AAUGUGAAAUGGCUAGCAUUACA | 23 | 17919 |
| CFTR-Intron2-2820 | - | GAAUGUGAAAUGGCUAGCAUUACA | 24 | 17920 |
| CFTR-Intron2-2821 | - | ACUGGCCUUAGGAACUCA | 18 | 17921 |
| CFTR-Intron2-2822 | - | AACUGGCCUUAGGAACUCA | 19 | 17922 |
| CFTR-Intron2-2823 | - | GAACUGGCCUUAGGAACUCA | 20 | 17923 |
| CFTR-Intron2-2824 | - | AGAACUGGCCUUAGGAACUCA | 21 | 17924 |
| CFTR-Intron2-2825 | - | GAGAACUGGCCUUAGGAACUCA | 22 | 17925 |
| CFTR-Intron2-2826 | - | GGAGAACUGGCCUUAGGAACUCA | 23 | 17926 |
| CFTR-Intron2-2827 | - | UGGAGAACUGGCCUUAGGAACUCA | 24 | 17927 |
| CFTR-Intron2-2828 | - | AAAGCAAACUGAGGCUCA | 18 | 17928 |
| CFTR-Intron2-2829 | - | AAAAGCAAACUGAGGCUCA | 19 | 17929 |
| CFTR-Intron2-2830 | - | GAAAAGCAAACUGAGGCUCA | 20 | 17930 |
| CFTR-Intron2-2831 | - | AGAAAAGCAAACUGAGGCUCA | 21 | 17931 |
| CFTR-Intron2-2832 | - | CAGAAAAGCAAACUGAGGCUCA | 22 | 17932 |
| CFTR-Intron2-2833 | - | ACAGAAAAGCAAACUGAGGCUCA | 23 | 17933 |
| CFTR-Intron2-2834 | - | UACAGAAAAGCAAACUGAGGCUCA | 24 | 17934 |

TABLE 38E-continued

5th Tier

| gRNA Name | DNA Strand | Targeting Domain | Target Site Length | Seq ID |
|---|---|---|---|---|
| CFTR-Intron2-2835 | − | UUUAAGGACCACGAAAGA | 18 | 17935 |
| CFTR-Intron2-2836 | − | CUUUAAGGACCACGAAAGA | 19 | 17936 |
| CFTR-Intron2-274 | − | UCUUUAAGGACCACGAAAGA | 20 | 15374 |
| CFTR-Intron2-2837 | − | AUCUUUAAGGACCACGAAAGA | 21 | 17937 |
| CFTR-Intron2-2838 | − | UAUCUUUAAGGACCACGAAAGA | 22 | 17938 |
| CFTR-Intron2-2839 | − | CUAUCUUUAAGGACCACGAAAGA | 23 | 17939 |
| CFTR-Intron2-2840 | − | CCUAUCUUUAAGGACCACGAAAGA | 24 | 17940 |
| CFTR-Intron2-2841 | − | UUUGUAUUUAUGGCCAGA | 18 | 17941 |
| CFTR-Intron2-2842 | − | AUUUGUAUUUAUGGCCAGA | 19 | 17942 |
| CFTR-Intron2-2843 | − | CAUUUGUAUUUAUGGCCAGA | 20 | 17943 |
| CFTR-Intron2-2844 | − | ACAUUUGUAUUUAUGGCCAGA | 21 | 17944 |
| CFTR-Intron2-2845 | − | UACAUUUGUAUUUAUGGCCAGA | 22 | 17945 |
| CFTR-Intron2-2846 | − | AUACAUUUGUAUUUAUGGCCAGA | 23 | 17946 |
| CFTR-Intron2-2847 | − | GAUACAUUUGUAUUUAUGGCCAGA | 24 | 17947 |
| CFTR-Intron2-2848 | − | UGGUUUUAUUUUCUCAGA | 18 | 17948 |
| CFTR-Intron2-2849 | − | CUGGUUUUAUUUUCUCAGA | 19 | 17949 |
| CFTR-Intron2-2850 | − | GCUGGUUUUAUUUUCUCAGA | 20 | 17950 |
| CFTR-Intron2-2851 | − | UGCUGGUUUUAUUUUCUCAGA | 21 | 17951 |
| CFTR-Intron2-2852 | − | AUGCUGGUUUUAUUUUCUCAGA | 22 | 17952 |
| CFTR-Intron2-2853 | − | UAUGCUGGUUUUAUUUUCUCAGA | 23 | 17953 |
| CFTR-Intron2-2854 | − | UUAUGCUGGUUUUAUUUUCUCAGA | 24 | 17954 |
| CFTR-Intron2-2855 | − | UGUGGGGAGGGAAAUAGA | 18 | 17955 |
| CFTR-Intron2-2856 | − | AUGUGGGGAGGGAAAUAGA | 19 | 17956 |
| CFTR-Intron2-278 | − | CAUGUGGGGAGGGAAAUAGA | 20 | 15378 |
| CFTR-Intron2-2857 | − | GCAUGUGGGGAGGGAAAUAGA | 21 | 17957 |
| CFTR-Intron2-2858 | − | AGCAUGUGGGGAGGGAAAUAGA | 22 | 17958 |
| CFTR-Intron2-2859 | − | AAGCAUGUGGGGAGGGAAAUAGA | 23 | 17959 |
| CFTR-Intron2-2860 | − | GAAGCAUGUGGGGAGGGAAAUAGA | 24 | 17960 |
| CFTR-Intron2-2861 | − | GGCCACUCAUAGUCUAGA | 18 | 17961 |
| CFTR-Intron2-2862 | − | GGGCCACUCAUAGUCUAGA | 19 | 17962 |
| CFTR-Intron2-2863 | − | UGGGCCACUCAUAGUCUAGA | 20 | 17963 |
| CFTR-Intron2-2864 | − | UUGGGCCACUCAUAGUCUAGA | 21 | 17964 |
| CFTR-Intron2-2865 | − | CUUGGGCCACUCAUAGUCUAGA | 22 | 17965 |
| CFTR-Intron2-2866 | − | CCUUGGGCCACUCAUAGUCUAGA | 23 | 17966 |
| CFTR-Intron2-2867 | − | CCCUUGGGCCACUCAUAGUCUAGA | 24 | 17967 |
| CFTR-Intron2-2868 | − | UAUCUUUAAGGACCACGA | 18 | 17968 |
| CFTR-Intron2-2869 | − | CUAUCUUUAAGGACCACGA | 19 | 17969 |

TABLE 38E-continued

5th Tier

| gRNA Name | DNA Strand | Targeting Domain | Target Site Length | Seq ID |
|---|---|---|---|---|
| CFTR-Intron2-2870 | - | CCUAUCUUUAAGGACCACGA | 20 | 17970 |
| CFTR-Intron2-2871 | - | UCCUAUCUUUAAGGACCACGA | 21 | 17971 |
| CFTR-Intron2-2872 | - | CUCCUAUCUUUAAGGACCACGA | 22 | 17972 |
| CFTR-Intron2-2873 | - | GCUCCUAUCUUUAAGGACCACGA | 23 | 17973 |
| CFTR-Intron2-2874 | - | UGCUCCUAUCUUUAAGGACCACGA | 24 | 17974 |
| CFTR-Intron2-2875 | - | UGGAGAAGCAUGUGGGA | 18 | 17975 |
| CFTR-Intron2-2876 | - | GUGGAGAAGCAUGUGGGA | 19 | 17976 |
| CFTR-Intron2-53 | - | GGUGGAGAAGCAUGUGGGA | 20 | 15153 |
| CFTR-Intron2-2877 | - | AGGUGGAGAAGCAUGUGGGA | 21 | 17977 |
| CFTR-Intron2-2878 | - | AAGGUGGAGAAGCAUGUGGGA | 22 | 17978 |
| CFTR-Intron2-2879 | - | AAAGGUGGAGAAGCAUGUGGGA | 23 | 17979 |
| CFTR-Intron2-2880 | - | GAAAGGUGGAGAAGCAUGUGGGA | 24 | 17980 |
| CFTR-Intron2-2881 | - | GUAACCAAAUGUUAUGGA | 18 | 17981 |
| CFTR-Intron2-2882 | - | AGUAACCAAAUGUUAUGGA | 19 | 17982 |
| CFTR-Intron2-54 | - | GAGUAACCAAAUGUUAUGGA | 20 | 15154 |
| CFTR-Intron2-2883 | - | UGAGUAACCAAAUGUUAUGGA | 21 | 17983 |
| CFTR-Intron2-2884 | - | CUGAGUAACCAAAUGUUAUGGA | 22 | 17984 |
| CFTR-Intron2-2885 | - | UCUGAGUAACCAAAUGUUAUGGA | 23 | 17985 |
| CFTR-Intron2-2886 | - | CUCUGAGUAACCAAAUGUUAUGGA | 24 | 17986 |
| CFTR-Intron2-2887 | - | UUGCCAGUUAAUGAAUGA | 18 | 17987 |
| CFTR-Intron2-2888 | - | UUUGCCAGUUAAUGAAUGA | 19 | 17988 |
| CFTR-Intron2-281 | - | CUUUGCCAGUUAAUGAAUGA | 20 | 15381 |
| CFTR-Intron2-2889 | - | ACUUUGCCAGUUAAUGAAUGA | 21 | 17989 |
| CFTR-Intron2-2890 | - | UACUUUGCCAGUUAAUGAAUGA | 22 | 17990 |
| CFTR-Intron2-2891 | - | AUACUUUGCCAGUUAAUGAAUGA | 23 | 17991 |
| CFTR-Intron2-2892 | - | UAUACUUUGCCAGUUAAUGAAUGA | 24 | 17992 |
| CFTR-Intron2-2893 | - | UCCUCUCAGCCACUCUGA | 18 | 17993 |
| CFTR-Intron2-2894 | - | CUCCUCUCAGCCACUCUGA | 19 | 17994 |
| CFTR-Intron2-2895 | - | UCUCCUCUCAGCCACUCUGA | 20 | 17995 |
| CFTR-Intron2-2896 | - | AUCUCCUCUCAGCCACUCUGA | 21 | 17996 |
| CFTR-Intron2-2897 | - | UAUCUCCUCUCAGCCACUCUGA | 22 | 17997 |
| CFTR-Intron2-2898 | - | AUAUCUCCUCUCAGCCACUCUGA | 23 | 17998 |
| CFTR-Intron2-2899 | - | AAUAUCUCCUCUCAGCCACUCUGA | 24 | 17999 |
| CFTR-Intron2-2900 | - | CCUUUUGAUUGCCAGUGA | 18 | 18000 |
| CFTR-Intron2-2901 | - | UCCUUUUGAUUGCCAGUGA | 19 | 18001 |
| CFTR-Intron2-2902 | - | AUCCUUUUGAUUGCCAGUGA | 20 | 18002 |
| CFTR-Intron2-2903 | - | GAUCCUUUUGAUUGCCAGUGA | 21 | 18003 |

TABLE 38E-continued

| | | 5th Tier | | |
|---|---|---|---|---|
| gRNA Name | DNA Strand | Targeting Domain | Target Site Length | Seq ID |
| CFTR-Intron2-2904 | - | GGAUCCUUUUGAUUGCCAGUGA | 22 | 18004 |
| CFTR-Intron2-2905 | - | AGGAUCCUUUUGAUUGCCAGUGA | 23 | 18005 |
| CFTR-Intron2-2906 | - | UAGGAUCCUUUUGAUUGCCAGUGA | 24 | 18006 |
| CFTR-Intron2-2907 | - | AGAUAAAGGGUGAGUGA | 18 | 18007 |
| CFTR-Intron2-2908 | - | CAGAUAAAAGGGUGAGUGA | 19 | 18008 |
| CFTR-Intron2-283 | - | CCAGAUAAAAGGGUGAGUGA | 20 | 15383 |
| CFTR-Intron2-2909 | - | GCCAGAUAAAAGGGUGAGUGA | 21 | 18009 |
| CFTR-Intron2-2910 | - | UGCCAGAUAAAAGGGUGAGUGA | 22 | 18010 |
| CFTR-Intron2-2911 | - | AUGCCAGAUAAAAGGGUGAGUGA | 23 | 18011 |
| CFTR-Intron2-2912 | - | GAUGCCAGAUAAAAGGGUGAGUGA | 24 | 18012 |
| CFTR-Intron2-2913 | - | UGCCAGAUAAAAGGGUGA | 18 | 18013 |
| CFTR-Intron2-2914 | - | AUGCCAGAUAAAAGGGUGA | 19 | 18014 |
| CFTR-Intron2-2915 | - | GAUGCCAGAUAAAAGGGUGA | 20 | 18015 |
| CFTR-Intron2-2916 | - | UGAUGCCAGAUAAAAGGGUGA | 21 | 18016 |
| CFTR-Intron2-2917 | - | CUGAUGCCAGAUAAAAGGGUGA | 22 | 18017 |
| CFTR-Intron2-2918 | - | CCUGAUGCCAGAUAAAAGGGUGA | 23 | 18018 |
| CFTR-Intron2-2919 | - | GCCUGAUGCCAGAUAAAAGGGUGA | 24 | 18019 |
| CFTR-Intron2-2920 | - | GGUUAGCUCUGUGUGUGA | 18 | 18020 |
| CFTR-Intron2-2921 | - | AGGUUAGCUCUGUGUGUGA | 19 | 18021 |
| CFTR-Intron2-2922 | - | GAGGUUAGCUCUGUGUGUGA | 20 | 18022 |
| CFTR-Intron2-2923 | - | GGAGGUUAGCUCUGUGUGUGA | 21 | 18023 |
| CFTR-Intron2-2924 | - | GGGAGGUUAGCUCUGUGUGUGA | 22 | 18024 |
| CFTR-Intron2-2925 | - | UGGGAGGUUAGCUCUGUGUGUGA | 23 | 18025 |
| CFTR-Intron2-2926 | - | AUGGGAGGUUAGCUCUGUGUGUGA | 24 | 18026 |
| CFTR-Intron2-2927 | - | GAUCCAUUUCUCCUUUGA | 18 | 18027 |
| CFTR-Intron2-2928 | - | UGAUCCAUUUCUCCUUUGA | 19 | 18028 |
| CFTR-Intron2-285 | - | CUGAUCCAUUUCUCCUUUGA | 20 | 15385 |
| CFTR-Intron2-2929 | - | UCUGAUCCAUUUCUCCUUUGA | 21 | 18029 |
| CFTR-Intron2-2930 | - | AUCUGAUCCAUUUCUCCUUUGA | 22 | 18030 |
| CFTR-Intron2-2931 | - | CAUCUGAUCCAUUUCUCCUUUGA | 23 | 18031 |
| CFTR-Intron2-2932 | - | CCAUCUGAUCCAUUUCUCCUUUGA | 24 | 18032 |
| CFTR-Intron2-2933 | - | UGUAUUUAUGGCCAGAUA | 18 | 18033 |
| CFTR-Intron2-2934 | - | UUGUAUUUAUGGCCAGAUA | 19 | 18034 |
| CFTR-Intron2-2935 | - | UUUGUAUUUAUGGCCAGAUA | 20 | 18035 |
| CFTR-Intron2-2936 | - | AUUUGUAUUUAUGGCCAGAUA | 21 | 18036 |
| CFTR-Intron2-2937 | - | CAUUUGUAUUUAUGGCCAGAUA | 22 | 18037 |
| CFTR-Intron2-2938 | - | ACAUUUGUAUUUAUGGCCAGAUA | 23 | 18038 |

TABLE 38E-continued

5th Tier

| gRNA Name | DNA Strand | Targeting Domain | Target Site Length | Seq ID |
|---|---|---|---|---|
| CFTR-Intron2-2939 | - | UACAUUUGUAUUUAUGGCCAGAUA | 24 | 18039 |
| CFTR-Intron2-2940 | - | AUUCAAAGAAUUAAGCUA | 18 | 18040 |
| CFTR-Intron2-2941 | - | UAUUCAAAGAAUUAAGCUA | 19 | 18041 |
| CFTR-Intron2-2942 | - | UUAUUCAAAGAAUUAAGCUA | 20 | 18042 |
| CFTR-Intron2-2943 | - | UUUAUUCAAAGAAUUAAGCUA | 21 | 18043 |
| CFTR-Intron2-2944 | - | UUUUAUUCAAAGAAUUAAGCUA | 22 | 18044 |
| CFTR-Intron2-2945 | - | AUUUUAUUCAAAGAAUUAAGCUA | 23 | 18045 |
| CFTR-Intron2-2946 | - | GAUUUUAUUCAAAGAAUUAAGCUA | 24 | 18046 |
| CFTR-Intron2-2947 | - | UAUGGUAACUUGACAGUA | 18 | 18047 |
| CFTR-Intron2-2948 | - | UUAUGGUAACUUGACAGUA | 19 | 18048 |
| CFTR-Intron2-2949 | - | CUUAUGGUAACUUGACAGUA | 20 | 18049 |
| CFTR-Intron2-2950 | - | ACUUAUGGUAACUUGACAGUA | 21 | 18050 |
| CFTR-Intron2-2951 | - | UACUUAUGGUAACUUGACAGUA | 22 | 18051 |
| CFTR-Intron2-2952 | - | UUACUUAUGGUAACUUGACAGUA | 23 | 18052 |
| CFTR-Intron2-2953 | - | UUUACUUAUGGUAACUUGACAGUA | 24 | 18053 |
| CFTR-Intron2-2954 | - | UUCAAGUUUCACCCAUUA | 18 | 18054 |
| CFTR-Intron2-2955 | - | GUUCAAGUUUCACCCAUUA | 19 | 18055 |
| CFTR-Intron2-2956 | - | UGUUCAAGUUUCACCCAUUA | 20 | 18056 |
| CFTR-Intron2-2957 | - | UUGUUCAAGUUUCACCCAUUA | 21 | 18057 |
| CFTR-Intron2-2958 | - | GUUGUUCAAGUUUCACCCAUUA | 22 | 18058 |
| CFTR-Intron2-2959 | - | AGUUGUUCAAGUUUCACCCAUUA | 23 | 18059 |
| CFTR-Intron2-2960 | - | AAGUUGUUCAAGUUUCACCCAUUA | 24 | 18060 |
| CFTR-Intron2-2961 | - | AAGGGCCAGCUUCUAUUA | 18 | 18061 |
| CFTR-Intron2-2962 | - | CAAGGGCCAGCUUCUAUUA | 19 | 18062 |
| CFTR-Intron2-2963 | - | UCAAGGGCCAGCUUCUAUUA | 20 | 18063 |
| CFTR-Intron2-2964 | - | AUCAAGGGCCAGCUUCUAUUA | 21 | 18064 |
| CFTR-Intron2-2965 | - | GAUCAAGGGCCAGCUUCUAUUA | 22 | 18065 |
| CFTR-Intron2-2966 | - | AGAUCAAGGGCCAGCUUCUAUUA | 23 | 18066 |
| CFTR-Intron2-2967 | - | AAGAUCAAGGGCCAGCUUCUAUUA | 24 | 18067 |
| CFTR-Intron2-2968 | - | AUGGUAUUUGAAAUUUA | 18 | 18068 |
| CFTR-Intron2-2969 | - | AAUUGGUAUUUGAAAUUUA | 19 | 18069 |
| CFTR-Intron2-2970 | - | AAAUGGUAUUUGAAAUUUA | 20 | 18070 |
| CFTR-Intron2-2971 | - | AAAAUGGUAUUUGAAAUUUA | 21 | 18071 |
| CFTR-Intron2-2972 | - | UAAAAUGGUAUUUGAAAUUUA | 22 | 18072 |
| CFTR-Intron2-2973 | - | AUAAAAUGGUAUUUGAAAUUUA | 23 | 18073 |
| CFTR-Intron2-2974 | - | UAUAAAAUGGUAUUUGAAAUUUA | 24 | 18074 |
| CFTR-Intron2-2975 | - | AAAGGUAAUUAGGCUUUA | 18 | 18075 |

TABLE 38E-continued

5th Tier

| gRNA Name | DNA Strand | Targeting Domain | Target Site Length | Seq ID |
|---|---|---|---|---|
| CFTR-Intron2-2976 | − | AAAAGGUAAUUAGGCUUUA | 19 | 18076 |
| CFTR-Intron2-2977 | − | GAAAAGGUAAUUAGGCUUUA | 20 | 18077 |
| CFTR-Intron2-2978 | − | GGAAAAGGUAAUUAGGCUUUA | 21 | 18078 |
| CFTR-Intron2-2979 | − | GGGAAAAGGUAAUUAGGCUUUA | 22 | 18079 |
| CFTR-Intron2-2980 | − | UGGGAAAAGGUAAUUAGGCUUUA | 23 | 18080 |
| CFTR-Intron2-2981 | − | AUGGGAAAAGGUAAUUAGGCUUUA | 24 | 18081 |
| CFTR-Intron2-2982 | − | AUCAUUAUCUCUAUUUUA | 18 | 18082 |
| CFTR-Intron2-2983 | − | CAUCAUUAUCUCUAUUUUA | 19 | 18083 |
| CFTR-Intron2-2984 | − | GCAUCAUUAUCUCUAUUUUA | 20 | 18084 |
| CFTR-Intron2-2985 | − | AGCAUCAUUAUCUCUAUUUUA | 21 | 18085 |
| CFTR-Intron2-2986 | − | AAGCAUCAUUAUCUCUAUUUUA | 22 | 18086 |
| CFTR-Intron2-2987 | − | AAAGCAUCAUUAUCUCUAUUUUA | 23 | 18087 |
| CFTR-Intron2-2988 | − | GAAAGCAUCAUUAUCUCUAUUUUA | 24 | 18088 |
| CFTR-Intron2-2989 | − | UACAUUGCCCAGGGUCAC | 18 | 18089 |
| CFTR-Intron2-2990 | − | CUACAUUGCCCAGGGUCAC | 19 | 18090 |
| CFTR-Intron2-2991 | − | ACUACAUUGCCCAGGGUCAC | 20 | 18091 |
| CFTR-Intron2-2992 | − | AACUACAUUGCCCAGGGUCAC | 21 | 18092 |
| CFTR-Intron2-2993 | − | AAACUACAUUGCCCAGGGUCAC | 22 | 18093 |
| CFTR-Intron2-2994 | − | AAAACUACAUUGCCCAGGGUCAC | 23 | 18094 |
| CFTR-Intron2-2995 | − | UAAAACUACAUUGCCCAGGGUCAC | 24 | 18095 |
| CFTR-Intron2-2996 | − | CCUGGUAUGUGGUCCUAC | 18 | 18096 |
| CFTR-Intron2-2997 | − | GCCUGGUAUGUGGUCCUAC | 19 | 18097 |
| CFTR-Intron2-2998 | − | GGCCUGGUAUGUGGUCCUAC | 20 | 18098 |
| CFTR-Intron2-2999 | − | GGGCCUGGUAUGUGGUCCUAC | 21 | 18099 |
| CFTR-Intron2-3000 | − | UGGGCCUGGUAUGUGGUCCUAC | 22 | 18100 |
| CFTR-Intron2-3001 | − | CUGGGCCUGGUAUGUGGUCCUAC | 23 | 18101 |
| CFTR-Intron2-3002 | − | UCUGGGCCUGGUAUGUGGUCCUAC | 24 | 18102 |
| CFTR-Intron2-3003 | − | UUUGUCUUAUUAGAGACC | 18 | 18103 |
| CFTR-Intron2-3004 | − | AUUUGUCUUAUUAGAGACC | 19 | 18104 |
| CFTR-Intron2-3005 | − | AAUUUGUCUUAUUAGAGACC | 20 | 18105 |
| CFTR-Intron2-3006 | − | GAAUUUGUCUUAUUAGAGACC | 21 | 18106 |
| CFTR-Intron2-3007 | − | AGAAUUUGUCUUAUUAGAGACC | 22 | 18107 |
| CFTR-Intron2-3008 | − | GAGAAUUUGUCUUAUUAGAGACC | 23 | 18108 |
| CFTR-Intron2-3009 | − | AGAGAAUUUGUCUUAUUAGAGACC | 24 | 18109 |
| CFTR-Intron2-3010 | − | CUCCUAUCUUUAAGGACC | 18 | 18110 |
| CFTR-Intron2-3011 | − | GCUCCUAUCUUUAAGGACC | 19 | 18111 |
| CFTR-Intron2-3012 | − | UGCUCCUAUCUUUAAGGACC | 20 | 18112 |

TABLE 38E-continued

5th Tier

| gRNA Name | DNA Strand | Targeting Domain | Target Site Length | Seq ID |
|---|---|---|---|---|
| CFTR-Intron2-3013 | − | UUGCUCCUAUCUUUAAGGACC | 21 | 18113 |
| CFTR-Intron2-3014 | − | UUUGCUCCUAUCUUUAAGGACC | 22 | 18114 |
| CFTR-Intron2-3015 | − | CUUUGCUCCUAUCUUUAAGGACC | 23 | 18115 |
| CFTR-Intron2-3016 | − | UCUUUGCUCCUAUCUUUAAGGACC | 24 | 18116 |
| CFTR-Intron2-3017 | − | UAGGAACUCAAUGGGACC | 18 | 18117 |
| CFTR-Intron2-3018 | − | UUAGGAACUCAAUGGGACC | 19 | 18118 |
| CFTR-Intron2-3019 | − | CUUAGGAACUCAAUGGGACC | 20 | 18119 |
| CFTR-Intron2-3020 | − | CCUUAGGAACUCAAUGGGACC | 21 | 18120 |
| CFTR-Intron2-3021 | − | GCCUUAGGAACUCAAUGGGACC | 22 | 18121 |
| CFTR-Intron2-3022 | − | GGCCUUAGGAACUCAAUGGGACC | 23 | 18122 |
| CFTR-Intron2-3023 | − | UGGCCUUAGGAACUCAAUGGGACC | 24 | 18123 |
| CFTR-Intron2-3024 | − | CUUUGUACCUCUGCACCC | 18 | 18124 |
| CFTR-Intron2-3025 | − | ACUUUGUACCUCUGCACCC | 19 | 18125 |
| CFTR-Intron2-3026 | − | UACUUUGUACCUCUGCACCC | 20 | 18126 |
| CFTR-Intron2-3027 | − | GUACUUUGUACCUCUGCACCC | 21 | 18127 |
| CFTR-Intron2-3028 | − | GGUACUUUGUACCUCUGCACCC | 22 | 18128 |
| CFTR-Intron2-3029 | − | UGGUACUUUGUACCUCUGCACCC | 23 | 18129 |
| CFTR-Intron2-3030 | − | UUGGUACUUUGUACCUCUGCACCC | 24 | 18130 |
| CFTR-Intron2-3031 | − | AGUCAUAGUGCUUACCCC | 18 | 18131 |
| CFTR-Intron2-3032 | − | GAGUCAUAGUGCUUACCCC | 19 | 18132 |
| CFTR-Intron2-3033 | − | UGAGUCAUAGUGCUUACCCC | 20 | 18133 |
| CFTR-Intron2-3034 | − | UUGAGUCAUAGUGCUUACCCC | 21 | 18134 |
| CFTR-Intron2-3035 | − | CUUGAGUCAUAGUGCUUACCCC | 22 | 18135 |
| CFTR-Intron2-3036 | − | UCUUGAGUCAUAGUGCUUACCCC | 23 | 18136 |
| CFTR-Intron2-3037 | − | CUCUUGAGUCAUAGUGCUUACCCC | 24 | 18137 |
| CFTR-Intron2-3038 | − | GAAUACAAAUGUACUCCC | 18 | 18138 |
| CFTR-Intron2-3039 | − | UGAAUACAAAUGUACUCCC | 19 | 18139 |
| CFTR-Intron2-312 | − | UUGAAUACAAAUGUACUCCC | 20 | 15412 |
| CFTR-Intron2-3040 | − | UUUGAAUACAAAUGUACUCCC | 21 | 18140 |
| CFTR-Intron2-3041 | − | AUUUGAAUACAAAUGUACUCCC | 22 | 18141 |
| CFTR-Intron2-3042 | − | UAUUUGAAUACAAAUGUACUCCC | 23 | 18142 |
| CFTR-Intron2-3043 | − | AUAUUUGAAUACAAAUGUACUCCC | 24 | 18143 |
| CFTR-Intron2-3044 | − | UUGGUGUGUGCAAAUGCC | 18 | 18144 |
| CFTR-Intron2-3045 | − | CUUGGUGUGUGCAAAUGCC | 19 | 18145 |
| CFTR-Intron2-3046 | − | ACUUGGUGUGUGCAAAUGCC | 20 | 18146 |
| CFTR-Intron2-3047 | − | CACUUGGUGUGUGCAAAUGCC | 21 | 18147 |
| CFTR-Intron2-3048 | − | ACACUUGGUGUGUGCAAAUGCC | 22 | 18148 |

TABLE 38E-continued

| gRNA Name | DNA Strand | Targeting Domain | Target Site Length | Seq ID |
|---|---|---|---|---|
| CFTR-Intron2-3049 | − | AACACUUGGUGUGUGCAAAUGCC | 23 | 18149 |
| CFTR-Intron2-3050 | − | GAACACUUGGUGUGUGCAAAUGCC | 24 | 18150 |
| CFTR-Intron2-3051 | − | GCUAAAUGUGAAAAAUCC | 18 | 18151 |
| CFTR-Intron2-3052 | − | GGCUAAAUGUGAAAAAUCC | 19 | 18152 |
| CFTR-Intron2-3053 | − | UGGCUAAAUGUGAAAAAUCC | 20 | 18153 |
| CFTR-Intron2-3054 | − | UUGGCUAAAUGUGAAAAAUCC | 21 | 18154 |
| CFTR-Intron2-3055 | − | CUUGGCUAAAUGUGAAAAAUCC | 22 | 18155 |
| CFTR-Intron2-3056 | − | CCUUGGCUAAAUGUGAAAAAUCC | 23 | 18156 |
| CFTR-Intron2-3057 | − | UCCUUGGCUAAAUGUGAAAAAUCC | 24 | 18157 |
| CFTR-Intron2-3058 | − | UGAAUACAAAUGUACUCC | 18 | 18158 |
| CFTR-Intron2-3059 | − | UUGAAUACAAAUGUACUCC | 19 | 18159 |
| CFTR-Intron2-3060 | − | UUUGAAUACAAAUGUACUCC | 20 | 18160 |
| CFTR-Intron2-3061 | − | AUUUGAAUACAAAUGUACUCC | 21 | 18161 |
| CFTR-Intron2-3062 | − | UAUUUGAAUACAAAUGUACUCC | 22 | 18162 |
| CFTR-Intron2-3063 | − | AUAUUUGAAUACAAAUGUACUCC | 23 | 18163 |
| CFTR-Intron2-3064 | − | UAUAUUUGAAUACAAAUGUACUCC | 24 | 18164 |
| CFTR-Intron2-3065 | − | UUUAUUGGCUCAUGAAGC | 18 | 18165 |
| CFTR-Intron2-3066 | − | AUUUAUUGGCUCAUGAAGC | 19 | 18166 |
| CFTR-Intron2-3067 | − | AAUUUAUUGGCUCAUGAAGC | 20 | 18167 |
| CFTR-Intron2-3068 | − | GAAUUUAUUGGCUCAUGAAGC | 21 | 18168 |
| CFTR-Intron2-3069 | − | CGAAUUUAUUGGCUCAUGAAGC | 22 | 18169 |
| CFTR-Intron2-3070 | − | ACGAAUUUAUUGGCUCAUGAAGC | 23 | 18170 |
| CFTR-Intron2-3071 | − | AACGAAUUUAUUGGCUCAUGAAGC | 24 | 18171 |
| CFTR-Intron2-3072 | − | CUCAGUCUCCUGAGUAGC | 18 | 18172 |
| CFTR-Intron2-3073 | − | UCUCAGUCUCCUGAGUAGC | 19 | 18173 |
| CFTR-Intron2-656 | − | AUCUCAGUCUCCUGAGUAGC | 20 | 15756 |
| CFTR-Intron2-3074 | − | AAUCUCAGUCUCCUGAGUAGC | 21 | 18174 |
| CFTR-Intron2-3075 | − | GAAUCUCAGUCUCCUGAGUAGC | 22 | 18175 |
| CFTR-Intron2-3076 | − | CGAAUCUCAGUCUCCUGAGUAGC | 23 | 18176 |
| CFTR-Intron2-3077 | − | GCGAAUCUCAGUCUCCUGAGUAGC | 24 | 18177 |
| CFTR-Intron2-3078 | − | AGUGUUGGGAUUAGUGGC | 18 | 18178 |
| CFTR-Intron2-3079 | − | AAGUGUUGGGAUUAGUGGC | 19 | 18179 |
| CFTR-Intron2-3080 | − | AAAGUGUUGGGAUUAGUGGC | 20 | 18180 |
| CFTR-Intron2-3081 | − | CAAAGUGUUGGGAUUAGUGGC | 21 | 18181 |
| CFTR-Intron2-3082 | − | CCAAAGUGUUGGGAUUAGUGGC | 22 | 18182 |
| CFTR-Intron2-3083 | − | CCCAAAGUGUUGGGAUUAGUGGC | 23 | 18183 |
| CFTR-Intron2-3084 | − | UCCCAAAGUGUUGGGAUUAGUGGC | 24 | 18184 |

TABLE 38E-continued

5th Tier

| gRNA Name | DNA Strand | Targeting Domain | Target Site Length | Seq ID |
|---|---|---|---|---|
| CFTR-Intron2-3085 | – | AGAAACCUGUAGCAUUGC | 18 | 18185 |
| CFTR-Intron2-3086 | – | UAGAAACCUGUAGCAUUGC | 19 | 18186 |
| CFTR-Intron2-325 | – | AUAGAAACCUGUAGCAUUGC | 20 | 15425 |
| CFTR-Intron2-3087 | – | CAUAGAAACCUGUAGCAUUGC | 21 | 18187 |
| CFTR-Intron2-3088 | – | ACAUAGAAACCUGUAGCAUUGC | 22 | 18188 |
| CFTR-Intron2-3089 | – | UACAUAGAAACCUGUAGCAUUGC | 23 | 18189 |
| CFTR-Intron2-3090 | – | UUACAUAGAAACCUGUAGCAUUGC | 24 | 18190 |
| CFTR-Intron2-3091 | – | AUUCACACUUCUAAGAUC | 18 | 18191 |
| CFTR-Intron2-3092 | – | GAUUCACACUUCUAAGAUC | 19 | 18192 |
| CFTR-Intron2-3093 | – | AGAUUCACACUUCUAAGAUC | 20 | 18193 |
| CFTR-Intron2-3094 | – | CAGAUUCACACUUCUAAGAUC | 21 | 18194 |
| CFTR-Intron2-3095 | – | GCAGAUUCACACUUCUAAGAUC | 22 | 18195 |
| CFTR-Intron2-3096 | – | AGCAGAUUCACACUUCUAAGAUC | 23 | 18196 |
| CFTR-Intron2-3097 | – | UAGCAGAUUCACACUUCUAAGAUC | 24 | 18197 |
| CFTR-Intron2-3098 | – | UCAUUUACAUCUCAGCUC | 18 | 18198 |
| CFTR-Intron2-3099 | – | UUCAUUUACAUCUCAGCUC | 19 | 18199 |
| CFTR-Intron2-3100 | – | UUUCAUUUACAUCUCAGCUC | 20 | 18200 |
| CFTR-Intron2-3101 | – | CUUUCAUUUACAUCUCAGCUC | 21 | 18201 |
| CFTR-Intron2-3102 | – | ACUUUCAUUUACAUCUCAGCUC | 22 | 18202 |
| CFTR-Intron2-3103 | – | CACUUUCAUUUACAUCUCAGCUC | 23 | 18203 |
| CFTR-Intron2-3104 | – | UCACUUUCAUUUACAUCUCAGCUC | 24 | 18204 |
| CFTR-Intron2-3105 | – | GAACGAAUUUAUUGGCUC | 18 | 18205 |
| CFTR-Intron2-3106 | – | GGAACGAAUUUAUUGGCUC | 19 | 18206 |
| CFTR-Intron2-3107 | – | AGGAACGAAUUUAUUGGCUC | 20 | 18207 |
| CFTR-Intron2-3108 | – | AAGGAACGAAUUUAUUGGCUC | 21 | 18208 |
| CFTR-Intron2-3109 | – | AAAGGAACGAAUUUAUUGGCUC | 22 | 18209 |
| CFTR-Intron2-3110 | – | AAAAGGAACGAAUUUAUUGGCUC | 23 | 18210 |
| CFTR-Intron2-3111 | – | UAAAAGGAACGAAUUUAUUGGCUC | 24 | 18211 |
| CFTR-Intron2-3112 | – | CUGUAUUGCCUUGCUCUC | 18 | 18212 |
| CFTR-Intron2-3113 | – | UCUGUAUUGCCUUGCUCUC | 19 | 18213 |
| CFTR-Intron2-3114 | – | GUCUGUAUUGCCUUGCUCUC | 20 | 18214 |
| CFTR-Intron2-3115 | – | GGUCUGUAUUGCCUUGCUCUC | 21 | 18215 |
| CFTR-Intron2-3116 | – | AGGUCUGUAUUGCCUUGCUCUC | 22 | 18216 |
| CFTR-Intron2-3117 | – | GAGGUCUGUAUUGCCUUGCUCUC | 23 | 18217 |
| CFTR-Intron2-3118 | – | UGAGGUCUGUAUUGCCUUGCUCUC | 24 | 18218 |
| CFTR-Intron2-3119 | – | AUGCUGGCCAGGCUGGUC | 18 | 18219 |
| CFTR-Intron2-3120 | – | UAUGCUGGCCAGGCUGGUC | 19 | 18220 |

TABLE 38E-continued

5th Tier

| gRNA Name | DNA Strand | Targeting Domain | Target Site Length | Seq ID |
|---|---|---|---|---|
| CFTR-Intron2-3121 | - | CUAUGCUGGCCAGGCUGGUC | 20 | 18221 |
| CFTR-Intron2-3122 | - | GCUAUGCUGGCCAGGCUGGUC | 21 | 18222 |
| CFTR-Intron2-3123 | - | UGCUAUGCUGGCCAGGCUGGUC | 22 | 18223 |
| CFTR-Intron2-3124 | - | UUGCUAUGCUGGCCAGGCUGGUC | 23 | 18224 |
| CFTR-Intron2-3125 | - | UUUGCUAUGCUGGCCAGGCUGGUC | 24 | 18225 |
| CFTR-Intron2-3126 | - | AUGUUGGCCAGGCUGGUC | 18 | 18226 |
| CFTR-Intron2-3127 | - | CAUGUUGGCCAGGCUGGUC | 19 | 18227 |
| CFTR-Intron2-3128 | - | CCAUGUUGGCCAGGCUGGUC | 20 | 18228 |
| CFTR-Intron2-3129 | - | GCCAUGUUGGCCAGGCUGGUC | 21 | 18229 |
| CFTR-Intron2-3130 | - | CGCCAUGUUGGCCAGGCUGGUC | 22 | 18230 |
| CFTR-Intron2-3131 | - | UCGCCAUGUUGGCCAGGCUGGUC | 23 | 18231 |
| CFTR-Intron2-3132 | - | UUCGCCAUGUUGGCCAGGCUGGUC | 24 | 18232 |
| CFTR-Intron2-3133 | - | CUCUCAUUAGCAAGCUUC | 18 | 18233 |
| CFTR-Intron2-3134 | - | GCUCUCAUUAGCAAGCUUC | 19 | 18234 |
| CFTR-Intron2-3135 | - | GGCUCUCAUUAGCAAGCUUC | 20 | 18235 |
| CFTR-Intron2-3136 | - | GGGCUCUCAUUAGCAAGCUUC | 21 | 18236 |
| CFTR-Intron2-3137 | - | AGGGCUCUCAUUAGCAAGCUUC | 22 | 18237 |
| CFTR-Intron2-3138 | - | AAGGGCUCUCAUUAGCAAGCUUC | 23 | 18238 |
| CFTR-Intron2-3139 | - | GAAGGGCUCUCAUUAGCAAGCUUC | 24 | 18239 |
| CFTR-Intron2-3140 | - | AGUUCUUCCUUGUGGUUC | 18 | 18240 |
| CFTR-Intron2-3141 | - | UAGUUCUUCCUUGUGGUUC | 19 | 18241 |
| CFTR-Intron2-3142 | - | CUAGUUCUUCCUUGUGGUUC | 20 | 18242 |
| CFTR-Intron2-3143 | - | CCUAGUUCUUCCUUGUGGUUC | 21 | 18243 |
| CFTR-Intron2-3144 | - | ACCUAGUUCUUCCUUGUGGUUC | 22 | 18244 |
| CFTR-Intron2-3145 | - | UACCUAGUUCUUCCUUGUGGUUC | 23 | 18245 |
| CFTR-Intron2-3146 | - | UUACCUAGUUCUUCCUUGUGGUUC | 24 | 18246 |
| CFTR-Intron2-3147 | - | UCUGUGUGUGAGAGAAAG | 18 | 18247 |
| CFTR-Intron2-3148 | - | CUCUGUGUGUGAGAGAAAG | 19 | 18248 |
| CFTR-Intron2-3149 | - | GCUCUGUGUGUGAGAGAAAG | 20 | 18249 |
| CFTR-Intron2-3150 | - | AGCUCUGUGUGUGAGAGAAAG | 21 | 18250 |
| CFTR-Intron2-3151 | - | UAGCUCUGUGUGUGAGAGAAAG | 22 | 18251 |
| CFTR-Intron2-3152 | - | UUAGCUCUGUGUGUGAGAGAAAG | 23 | 18252 |
| CFTR-Intron2-3153 | - | GUUAGCUCUGUGUGUGAGAGAAAG | 24 | 18253 |
| CFTR-Intron2-3154 | - | CUUUAAGGACCACGAAAG | 18 | 18254 |
| CFTR-Intron2-3155 | - | UCUUUAAGGACCACGAAAG | 19 | 18255 |
| CFTR-Intron2-3156 | - | AUCUUUAAGGACCACGAAAG | 20 | 18256 |
| CFTR-Intron2-3157 | - | UAUCUUUAAGGACCACGAAAG | 21 | 18257 |

TABLE 38E-continued

5th Tier

| gRNA Name | DNA Strand | Targeting Domain | Target Site Length | Seq ID |
|---|---|---|---|---|
| CFTR-Intron2-3158 | - | CUAUCUUUAAGGACCACGAAAG | 22 | 18258 |
| CFTR-Intron2-3159 | - | CCUAUCUUUAAGGACCACGAAAG | 23 | 18259 |
| CFTR-Intron2-3160 | - | UCCUAUCUUUAAGGACCACGAAAG | 24 | 18260 |
| CFTR-Intron2-3161 | - | AUGGAGCCAUGAUUCCAG | 18 | 18261 |
| CFTR-Intron2-3162 | - | GAUGGAGCCAUGAUUCCAG | 19 | 18262 |
| CFTR-Intron2-3163 | - | UGAUGGAGCCAUGAUUCCAG | 20 | 18263 |
| CFTR-Intron2-3164 | - | AUGAUGGAGCCAUGAUUCCAG | 21 | 18264 |
| CFTR-Intron2-3165 | - | AAUGAUGGAGCCAUGAUUCCAG | 22 | 18265 |
| CFTR-Intron2-3166 | - | GAAUGAUGGAGCCAUGAUUCCAG | 23 | 18266 |
| CFTR-Intron2-3167 | - | UGAAUGAUGGAGCCAUGAUUCCAG | 24 | 18267 |
| CFTR-Intron2-3168 | - | GGGAAUGAUUAAUCAGAG | 18 | 18268 |
| CFTR-Intron2-3169 | - | AGGGAAUGAUUAAUCAGAG | 19 | 18269 |
| CFTR-Intron2-3170 | - | GAGGGAAUGAUUAAUCAGAG | 20 | 18270 |
| CFTR-Intron2-3171 | - | UGAGGGAAUGAUUAAUCAGAG | 21 | 18271 |
| CFTR-Intron2-3172 | - | CUGAGGGAAUGAUUAAUCAGAG | 22 | 18272 |
| CFTR-Intron2-3173 | - | GCUGAGGGAAUGAUUAAUCAGAG | 23 | 18273 |
| CFTR-Intron2-3174 | - | UGCUGAGGGAAUGAUUAAUCAGAG | 24 | 18274 |
| CFTR-Intron2-3175 | - | UGGCUAAUUUUUGUAGAG | 18 | 18275 |
| CFTR-Intron2-3176 | - | CUGGCUAAUUUUUGUAGAG | 19 | 18276 |
| CFTR-Intron2-3177 | - | CCUGGCUAAUUUUUGUAGAG | 20 | 18277 |
| CFTR-Intron2-3178 | - | GCCUGGCUAAUUUUUGUAGAG | 21 | 18278 |
| CFTR-Intron2-3179 | - | GGCCUGGCUAAUUUUUGUAGAG | 22 | 18279 |
| CFTR-Intron2-3180 | - | AGGCCUGGCUAAUUUUUGUAGAG | 23 | 18280 |
| CFTR-Intron2-3181 | - | CAGGCCUGGCUAAUUUUUGUAGAG | 24 | 18281 |
| CFTR-Intron2-3182 | - | CCUCUCAGCCACUCUGAG | 18 | 18282 |
| CFTR-Intron2-3183 | - | UCCUCUCAGCCACUCUGAG | 19 | 18283 |
| CFTR-Intron2-344 | - | CUCCUCUCAGCCACUCUGAG | 20 | 15444 |
| CFTR-Intron2-3184 | - | UCUCCUCUCAGCCACUCUGAG | 21 | 18284 |
| CFTR-Intron2-3185 | - | AUCUCCUCUCAGCCACUCUGAG | 22 | 18285 |
| CFTR-Intron2-3186 | - | UAUCUCCUCUCAGCCACUCUGAG | 23 | 18286 |
| CFTR-Intron2-3187 | - | AUAUCUCCUCUCAGCCACUCUGAG | 24 | 18287 |
| CFTR-Intron2-3188 | - | AUGUGGGGAGGGAAAUAG | 18 | 18288 |
| CFTR-Intron2-3189 | - | CAUGUGGGGAGGGAAAUAG | 19 | 18289 |
| CFTR-Intron2-3190 | - | GCAUGUGGGGAGGGAAAUAG | 20 | 18290 |
| CFTR-Intron2-3191 | - | AGCAUGUGGGGAGGGAAAUAG | 21 | 18291 |
| CFTR-Intron2-3192 | - | AAGCAUGUGGGGAGGGAAAUAG | 22 | 18292 |
| CFTR-Intron2-3193 | - | GAAGCAUGUGGGGAGGGAAAUAG | 23 | 18293 |

TABLE 38E-continued

5th Tier

| gRNA Name | DNA Strand | Targeting Domain | Target Site Length | Seq ID |
|---|---|---|---|---|
| CFTR-Intron2-3194 | - | AGAAGCAUGUGGGGAGGGAAAUAG | 24 | 18294 |
| CFTR-Intron2-3195 | - | GGUAAUUAGGCUUUAUAG | 18 | 18295 |
| CFTR-Intron2-3196 | - | AGGUAAUUAGGCUUUAUAG | 19 | 18296 |
| CFTR-Intron2-3197 | - | AAGGUAAUUAGGCUUUAUAG | 20 | 18297 |
| CFTR-Intron2-3198 | - | AAAGGUAAUUAGGCUUUAUAG | 21 | 18298 |
| CFTR-Intron2-3199 | - | AAAAGGUAAUUAGGCUUUAUAG | 22 | 18299 |
| CFTR-Intron2-3200 | - | GAAAAGGUAAUUAGGCUUUAUAG | 23 | 18300 |
| CFTR-Intron2-3201 | - | GGAAAAGGUAAUUAGGCUUUAUAG | 24 | 18301 |
| CFTR-Intron2-3202 | - | AACUAUGUGAAGACCUAG | 18 | 18302 |
| CFTR-Intron2-3203 | - | GAACUAUGUGAAGACCUAG | 19 | 18303 |
| CFTR-Intron2-3204 | - | UGAACUAUGUGAAGACCUAG | 20 | 18304 |
| CFTR-Intron2-3205 | - | CUGAACUAUGUGAAGACCUAG | 21 | 18305 |
| CFTR-Intron2-3206 | - | CCUGAACUAUGUGAAGACCUAG | 22 | 18306 |
| CFTR-Intron2-3207 | - | GCCUGAACUAUGUGAAGACCUAG | 23 | 18307 |
| CFTR-Intron2-3208 | - | AGCCUGAACUAUGUGAAGACCUAG | 24 | 18308 |
| CFTR-Intron2-3209 | - | UUCAAAGAAUUAAGCUAG | 18 | 18309 |
| CFTR-Intron2-3210 | - | AUUCAAAGAAUUAAGCUAG | 19 | 18310 |
| CFTR-Intron2-345 | - | UAUUCAAAGAAUUAAGCUAG | 20 | 15445 |
| CFTR-Intron2-3211 | - | UUAUUCAAAGAAUUAAGCUAG | 21 | 18311 |
| CFTR-Intron2-3212 | - | UUUAUUCAAAGAAUUAAGCUAG | 22 | 18312 |
| CFTR-Intron2-3213 | - | UUUUAUUCAAAGAAUUAAGCUAG | 23 | 18313 |
| CFTR-Intron2-3214 | - | AUUUUAUUCAAAGAAUUAAGCUAG | 24 | 18314 |
| CFTR-Intron2-3215 | - | UCUCAGUCUCCUGAGUAG | 18 | 18315 |
| CFTR-Intron2-3216 | - | AUCUCAGUCUCCUGAGUAG | 19 | 18316 |
| CFTR-Intron2-3217 | - | AAUCUCAGUCUCCUGAGUAG | 20 | 18317 |
| CFTR-Intron2-3218 | - | GAAUCUCAGUCUCCUGAGUAG | 21 | 18318 |
| CFTR-Intron2-3219 | - | CGAAUCUCAGUCUCCUGAGUAG | 22 | 18319 |
| CFTR-Intron2-3220 | - | GCGAAUCUCAGUCUCCUGAGUAG | 23 | 18320 |
| CFTR-Intron2-3221 | - | AGCGAAUCUCAGUCUCCUGAGUAG | 24 | 18321 |
| CFTR-Intron2-3222 | - | AAUACAUGAUUUUAGUAG | 18 | 18322 |
| CFTR-Intron2-3223 | - | UAAUACAUGAUUUUAGUAG | 19 | 18323 |
| CFTR-Intron2-3224 | - | UUAAUACAUGAUUUUAGUAG | 20 | 18324 |
| CFTR-Intron2-3225 | - | UUUAAUACAUGAUUUUAGUAG | 21 | 18325 |
| CFTR-Intron2-3226 | - | CUUUAAUACAUGAUUUUAGUAG | 22 | 18326 |
| CFTR-Intron2-3227 | - | CCUUUAAUACAUGAUUUUAGUAG | 23 | 18327 |
| CFTR-Intron2-3228 | - | ACCUUUAAUACAUGAUUUUAGUAG | 24 | 18328 |
| CFTR-Intron2-3229 | - | CUGUGUGUGAGAGAAAGG | 18 | 18329 |

TABLE 38E-continued

5th Tier

| gRNA Name | DNA Strand | Targeting Domain | Target Site Length | Seq ID |
|---|---|---|---|---|
| CFTR-Intron2-3230 | - | UCUGUGUGUGAGAGAAAGG | 19 | 18330 |
| CFTR-Intron2-678 | - | CUCUGUGUGUGAGAGAAAGG | 20 | 15778 |
| CFTR-Intron2-3231 | - | GCUCUGUGUGUGAGAGAAAGG | 21 | 18331 |
| CFTR-Intron2-3232 | - | AGCUCUGUGUGUGAGAGAAAGG | 22 | 18332 |
| CFTR-Intron2-3233 | - | UAGCUCUGUGUGUGAGAGAAAGG | 23 | 18333 |
| CFTR-Intron2-3234 | - | UUAGCUCUGUGUGUGAGAGAAAGG | 24 | 18334 |
| CFTR-Intron2-3235 | - | CUCGCUGUGUCACCCAGG | 18 | 18335 |
| CFTR-Intron2-3236 | - | UCUCGCUGUGUCACCCAGG | 19 | 18336 |
| CFTR-Intron2-3237 | - | GUCUCGCUGUGUCACCCAGG | 20 | 18337 |
| CFTR-Intron2-3238 | - | AGUCUCGCUGUGUCACCCAGG | 21 | 18338 |
| CFTR-Intron2-3239 | - | GAGUCUCGCUGUGUCACCCAGG | 22 | 18339 |
| CFTR-Intron2-3240 | - | AGAGUCUCGCUGUGUCACCCAGG | 23 | 18340 |
| CFTR-Intron2-3241 | - | CAGAGUCUCGCUGUGUCACCCAGG | 24 | 18341 |
| CFTR-Intron2-3242 | - | CUUGCUCUGUUGCCCAGG | 18 | 18342 |
| CFTR-Intron2-3243 | - | UCUUGCUCUGUUGCCCAGG | 19 | 18343 |
| CFTR-Intron2-3244 | - | GUCUUGCUCUGUUGCCCAGG | 20 | 18344 |
| CFTR-Intron2-3245 | - | AGUCUUGCUCUGUUGCCCAGG | 21 | 18345 |
| CFTR-Intron2-3246 | - | GAGUCUUGCUCUGUUGCCCAGG | 22 | 18346 |
| CFTR-Intron2-3247 | - | AGAGUCUUGCUCUGUUGCCCAGG | 23 | 18347 |
| CFTR-Intron2-3248 | - | CAGAGUCUUGCUCUGUUGCCCAGG | 24 | 18348 |
| CFTR-Intron2-3249 | - | UGUGCAAAUGCCAUGAGG | 18 | 18349 |
| CFTR-Intron2-3250 | - | GUGUGCAAAUGCCAUGAGG | 19 | 18350 |
| CFTR-Intron2-3251 | - | UGUGUGCAAAUGCCAUGAGG | 20 | 18351 |
| CFTR-Intron2-3252 | - | GUGUGUGCAAAUGCCAUGAGG | 21 | 18352 |
| CFTR-Intron2-3253 | - | GGUGUGUGCAAAUGCCAUGAGG | 22 | 18353 |
| CFTR-Intron2-3254 | - | UGGUGUGUGCAAAUGCCAUGAGG | 23 | 18354 |
| CFTR-Intron2-3255 | - | UUGGUGUGUGCAAAUGCCAUGAGG | 24 | 18355 |
| CFTR-Intron2-3256 | - | ACUAUGUGAAGACCUAGG | 18 | 18356 |
| CFTR-Intron2-3257 | - | AACUAUGUGAAGACCUAGG | 19 | 18357 |
| CFTR-Intron2-69 | - | GAACUAUGUGAAGACCUAGG | 20 | 15169 |
| CFTR-Intron2-3258 | - | UGAACUAUGUGAAGACCUAGG | 21 | 18358 |
| CFTR-Intron2-3259 | - | CUGAACUAUGUGAAGACCUAGG | 22 | 18359 |
| CFTR-Intron2-3260 | - | CCUGAACUAUGUGAAGACCUAGG | 23 | 18360 |
| CFTR-Intron2-3261 | - | GCCUGAACUAUGUGAAGACCUAGG | 24 | 18361 |
| CFTR-Intron2-3262 | - | GUGGAGAAGCAUGUGGGG | 18 | 18362 |
| CFTR-Intron2-3263 | - | GGUGGAGAAGCAUGUGGGG | 19 | 18363 |
| CFTR-Intron2-682 | - | AGGUGGAGAAGCAUGUGGGG | 20 | 15782 |

TABLE 38E-continued

5th Tier

| gRNA Name | DNA Strand | Targeting Domain | Target Site Length | Seq ID |
|---|---|---|---|---|
| CFTR-Intron2-3264 | - | AAGGUGGAGAAGCAUGUGGGG | 21 | 18364 |
| CFTR-Intron2-3265 | - | AAAGGUGGAGAAGCAUGUGGGG | 22 | 18365 |
| CFTR-Intron2-3266 | - | GAAAGGUGGAGAAGCAUGUGGGG | 23 | 18366 |
| CFTR-Intron2-3267 | - | AGAAAGGUGGAGAAGCAUGUGGGG | 24 | 18367 |
| CFTR-Intron2-3268 | - | GGUGGAGAAGCAUGUGGG | 18 | 18368 |
| CFTR-Intron2-3269 | - | AGGUGGAGAAGCAUGUGGG | 19 | 18369 |
| CFTR-Intron2-3270 | - | AAGGUGGAGAAGCAUGUGGG | 20 | 18370 |
| CFTR-Intron2-3271 | - | AAAGGUGGAGAAGCAUGUGGG | 21 | 18371 |
| CFTR-Intron2-3272 | - | GAAAGGUGGAGAAGCAUGUGGG | 22 | 18372 |
| CFTR-Intron2-3273 | - | AGAAAGGUGGAGAAGCAUGUGGG | 23 | 18373 |
| CFTR-Intron2-3274 | - | GAGAAAGGUGGAGAAGCAUGUGGG | 24 | 18374 |
| CFTR-Intron2-3275 | - | CAAGUGGUUGCCAGAUGG | 18 | 18375 |
| CFTR-Intron2-3276 | - | UCAAGUGGUUGCCAGAUGG | 19 | 18376 |
| CFTR-Intron2-3277 | - | CUCAAGUGGUUGCCAGAUGG | 20 | 18377 |
| CFTR-Intron2-3278 | - | CCUCAAGUGGUUGCCAGAUGG | 21 | 18378 |
| CFTR-Intron2-3279 | - | CCCUCAAGUGGUUGCCAGAUGG | 22 | 18379 |
| CFTR-Intron2-3280 | - | GCCCUCAAGUGGUUGCCAGAUGG | 23 | 18380 |
| CFTR-Intron2-3281 | - | GGCCCUCAAGUGGUUGCCAGAUGG | 24 | 18381 |
| CFTR-Intron2-3282 | - | AGUAACCAAAUGUUAUGG | 18 | 18382 |
| CFTR-Intron2-3283 | - | GAGUAACCAAAUGUUAUGG | 19 | 18383 |
| CFTR-Intron2-3284 | - | UGAGUAACCAAAUGUUAUGG | 20 | 18384 |
| CFTR-Intron2-3285 | - | CUGAGUAACCAAAUGUUAUGG | 21 | 18385 |
| CFTR-Intron2-3286 | - | UCUGAGUAACCAAAUGUUAUGG | 22 | 18386 |
| CFTR-Intron2-3287 | - | CUCUGAGUAACCAAAUGUUAUGG | 23 | 18387 |
| CFTR-Intron2-3288 | - | ACUCUGAGUAACCAAAUGUUAUGG | 24 | 18388 |
| CFTR-Intron2-3289 | - | CCUUGGCCUCCCAAAAUG | 18 | 18389 |
| CFTR-Intron2-3290 | - | ACCUUGGCCUCCCAAAAUG | 19 | 18390 |
| CFTR-Intron2-3291 | - | CACCUUGGCCUCCCAAAAUG | 20 | 18391 |
| CFTR-Intron2-3292 | - | CCACCUUGGCCUCCCAAAAUG | 21 | 18392 |
| CFTR-Intron2-3293 | - | CCCACCUUGGCCUCCCAAAAUG | 22 | 18393 |
| CFTR-Intron2-3294 | - | GCCCACCUUGGCCUCCCAAAAUG | 23 | 18394 |
| CFTR-Intron2-3295 | - | UGCCCACCUUGGCCUCCCAAAAUG | 24 | 18395 |
| CFTR-Intron2-3296 | - | UUUGCCAGUUAAUGAAUG | 18 | 18396 |
| CFTR-Intron2-3297 | - | CUUUGCCAGUUAAUGAAUG | 19 | 18397 |
| CFTR-Intron2-3298 | - | ACUUUGCCAGUUAAUGAAUG | 20 | 18398 |
| CFTR-Intron2-3299 | - | UACUUUGCCAGUUAAUGAAUG | 21 | 18399 |
| CFTR-Intron2-3300 | - | AUACUUUGCCAGUUAAUGAAUG | 22 | 18400 |

TABLE 38E-continued

5th Tier

| gRNA Name | DNA Strand | Targeting Domain | Target Site Length | Seq ID |
|---|---|---|---|---|
| CFTR-Intron2-3301 | - | UAUACUUUGCCAGUUAAUGAAUG | 23 | 18401 |
| CFTR-Intron2-3302 | - | AUAUACUUUGCCAGUUAAUGAAUG | 24 | 18402 |
| CFTR-Intron2-3303 | - | UUGUUGAAUGAAUCCAUG | 18 | 18403 |
| CFTR-Intron2-3304 | - | UUUGUUGAAUGAAUCCAUG | 19 | 18404 |
| CFTR-Intron2-3305 | - | AUUUGUUGAAUGAAUCCAUG | 20 | 18405 |
| CFTR-Intron2-3306 | - | UAUUUGUUGAAUGAAUCCAUG | 21 | 18406 |
| CFTR-Intron2-3307 | - | AUAUUUGUUGAAUGAAUCCAUG | 22 | 18407 |
| CFTR-Intron2-3308 | - | AAUAUUUGUUGAAUGAAUCCAUG | 23 | 18408 |
| CFTR-Intron2-3309 | - | AAAUAUUUGUUGAAUGAAUCCAUG | 24 | 18409 |
| CFTR-Intron2-3310 | - | GAAAGGUGGAGAAGCAUG | 18 | 18410 |
| CFTR-Intron2-3311 | - | AGAAAGGUGGAGAAGCAUG | 19 | 18411 |
| CFTR-Intron2-467 | - | GAGAAAGGUGGAGAAGCAUG | 20 | 15567 |
| CFTR-Intron2-3312 | - | AGAGAAAGGUGGAGAAGCAUG | 21 | 18412 |
| CFTR-Intron2-3313 | - | GAGAGAAAGGUGGAGAAGCAUG | 22 | 18413 |
| CFTR-Intron2-3314 | - | UGAGAGAAAGGUGGAGAAGCAUG | 23 | 18414 |
| CFTR-Intron2-3315 | - | GUGAGAGAAAGGUGGAGAAGCAUG | 24 | 18415 |
| CFTR-Intron2-3316 | - | CUAAGUUUUAAUUGGAUG | 18 | 18416 |
| CFTR-Intron2-3317 | - | UCUAAGUUUUAAUUGGAUG | 19 | 18417 |
| CFTR-Intron2-3318 | - | AUCUAAGUUUUAAUUGGAUG | 20 | 18418 |
| CFTR-Intron2-3319 | - | UAUCUAAGUUUUAAUUGGAUG | 21 | 18419 |
| CFTR-Intron2-3320 | - | AUAUCUAAGUUUUAAUUGGAUG | 22 | 18420 |
| CFTR-Intron2-3321 | - | AAUAUCUAAGUUUUAAUUGGAUG | 23 | 18421 |
| CFTR-Intron2-3322 | - | GAAUAUCUAAGUUUUAAUUGGAUG | 24 | 18422 |
| CFTR-Intron2-3323 | - | UCCAUUUCUCCUUUGAUG | 18 | 18423 |
| CFTR-Intron2-3324 | - | AUCCAUUUCUCCUUUGAUG | 19 | 18424 |
| CFTR-Intron2-3325 | - | GAUCCAUUUCUCCUUUGAUG | 20 | 18425 |
| CFTR-Intron2-3326 | - | UGAUCCAUUUCUCCUUUGAUG | 21 | 18426 |
| CFTR-Intron2-3327 | - | CUGAUCCAUUUCUCCUUUGAUG | 22 | 18427 |
| CFTR-Intron2-3328 | - | UCUGAUCCAUUUCUCCUUUGAUG | 23 | 18428 |
| CFTR-Intron2-3329 | - | AUCUGAUCCAUUUCUCCUUUGAUG | 24 | 18429 |
| CFTR-Intron2-3330 | - | UAAUGGGAAUAACCACUG | 18 | 18430 |
| CFTR-Intron2-3331 | - | GUAAUGGGAAUAACCACUG | 19 | 18431 |
| CFTR-Intron2-3332 | - | AGUAAUGGGAAUAACCACUG | 20 | 18432 |
| CFTR-Intron2-3333 | - | CAGUAAUGGGAAUAACCACUG | 21 | 18433 |
| CFTR-Intron2-3334 | - | ACAGUAAUGGGAAUAACCACUG | 22 | 18434 |
| CFTR-Intron2-3335 | - | GACAGUAAUGGGAAUAACCACUG | 23 | 18435 |
| CFTR-Intron2-3336 | - | UGACAGUAAUGGGAAUAACCACUG | 24 | 18436 |

TABLE 38E-continued

| | | 5th Tier | | |
|---|---|---|---|---|
| gRNA Name | DNA Strand | Targeting Domain | Target Site Length | Seq ID |
| CFTR-Intron2-3337 | - | AGUUUUAAUUGGAUGCUG | 18 | 18437 |
| CFTR-Intron2-3338 | - | AAGUUUUAAUUGGAUGCUG | 19 | 18438 |
| CFTR-Intron2-364 | - | UAAGUUUUAAUUGGAUGCUG | 20 | 15464 |
| CFTR-Intron2-3339 | - | CUAAGUUUUAAUUGGAUGCUG | 21 | 18439 |
| CFTR-Intron2-3340 | - | UCUAAGUUUUAAUUGGAUGCUG | 22 | 18440 |
| CFTR-Intron2-3341 | - | AUCUAAGUUUUAAUUGGAUGCUG | 23 | 18441 |
| CFTR-Intron2-3342 | - | UAUCUAAGUUUUAAUUGGAUGCUG | 24 | 18442 |
| CFTR-Intron2-3343 | - | AAACCUGUAGCAUUGCUG | 18 | 18443 |
| CFTR-Intron2-3344 | - | GAAACCUGUAGCAUUGCUG | 19 | 18444 |
| CFTR-Intron2-3345 | - | AGAAACCUGUAGCAUUGCUG | 20 | 18445 |
| CFTR-Intron2-3346 | - | UAGAAACCUGUAGCAUUGCUG | 21 | 18446 |
| CFTR-Intron2-3347 | - | AUAGAAACCUGUAGCAUUGCUG | 22 | 18447 |
| CFTR-Intron2-3348 | - | CAUAGAAACCUGUAGCAUUGCUG | 23 | 18448 |
| CFTR-Intron2-3349 | - | ACAUAGAAACCUGUAGCAUUGCUG | 24 | 18449 |
| CFTR-Intron2-3350 | - | CCUUGGCCUCCCAAAGUG | 18 | 18450 |
| CFTR-Intron2-3351 | - | GCCUUGGCCUCCCAAAGUG | 19 | 18451 |
| CFTR-Intron2-3352 | - | CGCCUUGGCCUCCCAAAGUG | 20 | 18452 |
| CFTR-Intron2-3353 | - | CCGCCUUGGCCUCCCAAAGUG | 21 | 18453 |
| CFTR-Intron2-3354 | - | CCCGCCUUGGCCUCCCAAAGUG | 22 | 18454 |
| CFTR-Intron2-3355 | - | GCCCGCCUUGGCCUCCCAAAGUG | 23 | 18455 |
| CFTR-Intron2-3356 | - | UGCCCGCCUUGGCCUCCCAAAGUG | 24 | 18456 |
| CFTR-Intron2-3357 | - | CAGAUAAAAGGGUGAGUG | 18 | 18457 |
| CFTR-Intron2-3358 | - | CCAGAUAAAAGGGUGAGUG | 19 | 18458 |
| CFTR-Intron2-3359 | - | GCCAGAUAAAAGGGUGAGUG | 20 | 18459 |
| CFTR-Intron2-3360 | - | UGCCAGAUAAAAGGGUGAGUG | 21 | 18460 |
| CFTR-Intron2-3361 | - | AUGCCAGAUAAAAGGGUGAGUG | 22 | 18461 |
| CFTR-Intron2-3362 | - | GAUGCCAGAUAAAAGGGUGAGUG | 23 | 18462 |
| CFTR-Intron2-3363 | - | UGAUGCCAGAUAAAAGGGUGAGUG | 24 | 18463 |
| CFTR-Intron2-3364 | - | GUGUGUGAGAGAAAGGUG | 18 | 18464 |
| CFTR-Intron2-3365 | - | UGUGUGUGAGAGAAAGGUG | 19 | 18465 |
| CFTR-Intron2-3366 | - | CUGUGUGUGAGAGAAAGGUG | 20 | 18466 |
| CFTR-Intron2-3367 | - | UCUGUGUGUGAGAGAAAGGUG | 21 | 18467 |
| CFTR-Intron2-3368 | - | CUCUGUGUGUGAGAGAAAGGUG | 22 | 18468 |
| CFTR-Intron2-3369 | - | GCUCUGUGUGUGAGAGAAAGGUG | 23 | 18469 |
| CFTR-Intron2-3370 | - | AGCUCUGUGUGUGAGAGAAAGGUG | 24 | 18470 |
| CFTR-Intron2-3371 | - | UAUGUGAAGACCUAGGUG | 18 | 18471 |
| CFTR-Intron2-3372 | - | CUAUGUGAAGACCUAGGUG | 19 | 18472 |

TABLE 38E-continued

5th Tier

| gRNA Name | DNA Strand | Targeting Domain | Target Site Length | Seq ID |
|---|---|---|---|---|
| CFTR-Intron2-3373 | – | ACUAUGUGAAGACCUAGGUG | 20 | 18473 |
| CFTR-Intron2-3374 | – | AACUAUGUGAAGACCUAGGUG | 21 | 18474 |
| CFTR-Intron2-3375 | – | GAACUAUGUGAAGACCUAGGUG | 22 | 18475 |
| CFTR-Intron2-3376 | – | UGAACUAUGUGAAGACCUAGGUG | 23 | 18476 |
| CFTR-Intron2-3377 | – | CUGAACUAUGUGAAGACCUAGGUG | 24 | 18477 |
| CFTR-Intron2-3378 | – | AAGGUGGAGAAGCAUGUG | 18 | 18478 |
| CFTR-Intron2-3379 | – | AAAGGUGGAGAAGCAUGUG | 19 | 18479 |
| CFTR-Intron2-468 | – | GAAAGGUGGAGAAGCAUGUG | 20 | 15568 |
| CFTR-Intron2-3380 | – | AGAAAGGUGGAGAAGCAUGUG | 21 | 18480 |
| CFTR-Intron2-3381 | – | GAGAAAGGUGGAGAAGCAUGUG | 22 | 18481 |
| CFTR-Intron2-3382 | – | AGAGAAAGGUGGAGAAGCAUGUG | 23 | 18482 |
| CFTR-Intron2-3383 | – | GAGAGAAAGGUGGAGAAGCAUGUG | 24 | 18483 |
| CFTR-Intron2-3384 | – | AUAUUUUAUUCCUUUGUG | 18 | 18484 |
| CFTR-Intron2-3385 | – | GAUAUUUUAUUCCUUUGUG | 19 | 18485 |
| CFTR-Intron2-3386 | – | AGAUAUUUUAUUCCUUUGUG | 20 | 18486 |
| CFTR-Intron2-3387 | – | GAGAUAUUUUAUUCCUUUGUG | 21 | 18487 |
| CFTR-Intron2-3388 | – | AGAGAUAUUUUAUUCCUUUGUG | 22 | 18488 |
| CFTR-Intron2-3389 | – | UAGAGAUAUUUUAUUCCUUUGUG | 23 | 18489 |
| CFTR-Intron2-3390 | – | UUAGAGAUAUUUUAUUCCUUUGUG | 24 | 18490 |
| CFTR-Intron2-3391 | – | UAGAAACCUGUAGCAUUG | 18 | 18491 |
| CFTR-Intron2-3392 | – | AUAGAAACCUGUAGCAUUG | 19 | 18492 |
| CFTR-Intron2-3393 | – | CAUAGAAACCUGUAGCAUUG | 20 | 18493 |
| CFTR-Intron2-3394 | – | ACAUAGAAACCUGUAGCAUUG | 21 | 18494 |
| CFTR-Intron2-3395 | – | UACAUAGAAACCUGUAGCAUUG | 22 | 18495 |
| CFTR-Intron2-3396 | – | UUACAUAGAAACCUGUAGCAUUG | 23 | 18496 |
| CFTR-Intron2-3397 | – | AUUACAUAGAAACCUGUAGCAUUG | 24 | 18497 |
| CFTR-Intron2-3398 | – | GUGGUUGCCAGAUGGUUG | 18 | 18498 |
| CFTR-Intron2-3399 | – | AGUGGUUGCCAGAUGGUUG | 19 | 18499 |
| CFTR-Intron2-3400 | – | AAGUGGUUGCCAGAUGGUUG | 20 | 18500 |
| CFTR-Intron2-3401 | – | CAAGUGGUUGCCAGAUGGUUG | 21 | 18501 |
| CFTR-Intron2-3402 | – | UCAAGUGGUUGCCAGAUGGUUG | 22 | 18502 |
| CFTR-Intron2-3403 | – | CUCAAGUGGUUGCCAGAUGGUUG | 23 | 18503 |
| CFTR-Intron2-3404 | – | CCUCAAGUGGUUGCCAGAUGGUUG | 24 | 18504 |
| CFTR-Intron2-3405 | – | UGAUCCAUUUCUCCUUUG | 18 | 18505 |
| CFTR-Intron2-3406 | – | CUGAUCCAUUUCUCCUUUG | 19 | 18506 |
| CFTR-Intron2-3407 | – | UCUGAUCCAUUUCUCCUUUG | 20 | 18507 |
| CFTR-Intron2-3408 | – | AUCUGAUCCAUUUCUCCUUUG | 21 | 18508 |

TABLE 38E-continued

5th Tier

| gRNA Name | DNA Strand | Targeting Domain | Target Site Length | Seq ID |
|---|---|---|---|---|
| CFTR-Intron2-3409 | - | CAUCUGAUCCAUUUCUCCUUUG | 22 | 18509 |
| CFTR-Intron2-3410 | - | CCAUCUGAUCCAUUUCUCCUUUG | 23 | 18510 |
| CFTR-Intron2-3411 | - | CCCAUCUGAUCCAUUUCUCCUUUG | 24 | 18511 |
| CFTR-Intron2-3412 | - | AGGCCUGGCUAAUUUUG | 18 | 18512 |
| CFTR-Intron2-3413 | - | CAGGCCUGGCUAAUUUUG | 19 | 18513 |
| CFTR-Intron2-3414 | - | CCAGGCCUGGCUAAUUUUG | 20 | 18514 |
| CFTR-Intron2-3415 | - | ACCAGGCCUGGCUAAUUUUG | 21 | 18515 |
| CFTR-Intron2-3416 | - | CACCAGGCCUGGCUAAUUUUG | 22 | 18516 |
| CFTR-Intron2-3417 | - | CCACCAGGCCUGGCUAAUUUUG | 23 | 18517 |
| CFTR-Intron2-3418 | - | ACCACCAGGCCUGGCUAAUUUUG | 24 | 18518 |
| CFTR-Intron2-3419 | - | CUUUGUCCUUGGCUAAAU | 18 | 18519 |
| CFTR-Intron2-3420 | - | CCUUUGUCCUUGGCUAAAU | 19 | 18520 |
| CFTR-Intron2-3421 | - | CCCUUUGUCCUUGGCUAAAU | 20 | 18521 |
| CFTR-Intron2-3422 | - | GCCCUUUGUCCUUGGCUAAAU | 21 | 18522 |
| CFTR-Intron2-3423 | - | AGCCCUUUGUCCUUGGCUAAAU | 22 | 18523 |
| CFTR-Intron2-3424 | - | GAGCCCUUUGUCCUUGGCUAAAU | 23 | 18524 |
| CFTR-Intron2-3425 | - | GGAGCCCUUUGUCCUUGGCUAAAU | 24 | 18525 |
| CFTR-Intron2-3426 | - | AUGAAUCCAUGAUGGAAU | 18 | 18526 |
| CFTR-Intron2-3427 | - | AAUGAAUCCAUGAUGGAAU | 19 | 18527 |
| CFTR-Intron2-3428 | - | GAAUGAAUCCAUGAUGGAAU | 20 | 18528 |
| CFTR-Intron2-3429 | - | UGAAUGAAUCCAUGAUGGAAU | 21 | 18529 |
| CFTR-Intron2-3430 | - | UUGAAUGAAUCCAUGAUGGAAU | 22 | 18530 |
| CFTR-Intron2-3431 | - | GUUGAAUGAAUCCAUGAUGGAAU | 23 | 18531 |
| CFTR-Intron2-3432 | - | UGUUGAAUGAAUCCAUGAUGGAAU | 24 | 18532 |
| CFTR-Intron2-3433 | - | AGAAAGGUGGAGAAGCAU | 18 | 18533 |
| CFTR-Intron2-3434 | - | GAGAAAGGUGGAGAAGCAU | 19 | 18534 |
| CFTR-Intron2-3435 | - | AGAGAAAGGUGGAGAAGCAU | 20 | 18535 |
| CFTR-Intron2-3436 | - | GAGAGAAAGGUGGAGAAGCAU | 21 | 18536 |
| CFTR-Intron2-3437 | - | UGAGAGAAAGGUGGAGAAGCAU | 22 | 18537 |
| CFTR-Intron2-3438 | - | GUGAGAGAAAGGUGGAGAAGCAU | 23 | 18538 |
| CFTR-Intron2-3439 | - | UGUGAGAGAAAGGUGGAGAAGCAU | 24 | 18539 |
| CFTR-Intron2-3440 | - | GUGGGGAGGGAAAUAGAU | 18 | 18540 |
| CFTR-Intron2-3441 | - | UGUGGGGAGGGAAAUAGAU | 19 | 18541 |
| CFTR-Intron2-377 | - | AUGUGGGGAGGGAAAUAGAU | 20 | 15477 |
| CFTR-Intron2-3442 | - | CAUGUGGGGAGGGAAAUAGAU | 21 | 18542 |
| CFTR-Intron2-3443 | - | GCAUGUGGGGAGGGAAAUAGAU | 22 | 18543 |
| CFTR-Intron2-3444 | - | AGCAUGUGGGGAGGGAAAUAGAU | 23 | 18544 |

TABLE 38E-continued

5th Tier

| gRNA Name | DNA Strand | Targeting Domain | Target Site Length | Seq ID |
|---|---|---|---|---|
| CFTR-Intron2-3445 | − | AAGCAUGUGGGGAGGGAAAUAGAU | 24 | 18545 |
| CFTR-Intron2-3446 | − | UUUUGUAUUUUAGUAGAU | 18 | 18546 |
| CFTR-Intron2-3447 | − | UUUUUGUAUUUUAGUAGAU | 19 | 18547 |
| CFTR-Intron2-3448 | − | AUUUUUGUAUUUUAGUAGAU | 20 | 18548 |
| CFTR-Intron2-3449 | − | AAUUUUUGUAUUUUAGUAGAU | 21 | 18549 |
| CFTR-Intron2-3450 | − | UAAUUUUUGUAUUUUAGUAGAU | 22 | 18550 |
| CFTR-Intron2-3451 | − | CUAAUUUUUGUAUUUUAGUAGAU | 23 | 18551 |
| CFTR-Intron2-3452 | − | GCUAAUUUUUGUAUUUUAGUAGAU | 24 | 18552 |
| CFTR-Intron2-3453 | − | CAAGAUUGUAGUCAGGAU | 18 | 18553 |
| CFTR-Intron2-3454 | − | CCAAGAUUGUAGUCAGGAU | 19 | 18554 |
| CFTR-Intron2-3455 | − | UCCAAGAUUGUAGUCAGGAU | 20 | 18555 |
| CFTR-Intron2-3456 | − | UUCCAAGAUUGUAGUCAGGAU | 21 | 18556 |
| CFTR-Intron2-3457 | − | GUUCCAAGAUUGUAGUCAGGAU | 22 | 18557 |
| CFTR-Intron2-3458 | − | CGUUCCAAGAUUGUAGUCAGGAU | 23 | 18558 |
| CFTR-Intron2-3459 | − | CCGUUCCAAGAUUGUAGUCAGGAU | 24 | 18559 |
| CFTR-Intron2-3460 | − | UAACCAAAUGUUAUGGAU | 18 | 18560 |
| CFTR-Intron2-3461 | − | GUAACCAAAUGUUAUGGAU | 19 | 18561 |
| CFTR-Intron2-378 | − | AGUAACCAAAUGUUAUGGAU | 20 | 15478 |
| CFTR-Intron2-3462 | − | GAGUAACCAAAUGUUAUGGAU | 21 | 18562 |
| CFTR-Intron2-3463 | − | UGAGUAACCAAAUGUUAUGGAU | 22 | 18563 |
| CFTR-Intron2-3464 | − | CUGAGUAACCAAAUGUUAUGGAU | 23 | 18564 |
| CFTR-Intron2-3465 | − | UCUGAGUAACCAAAUGUUAUGGAU | 24 | 18565 |
| CFTR-Intron2-3466 | − | AACUUCUUCCCUUCUGAU | 18 | 18566 |
| CFTR-Intron2-3467 | − | AAACUUCUUCCCUUCUGAU | 19 | 18567 |
| CFTR-Intron2-3468 | − | AAAACUUCUUCCCUUCUGAU | 20 | 18568 |
| CFTR-Intron2-3469 | − | UAAAACUUCUUCCCUUCUGAU | 21 | 18569 |
| CFTR-Intron2-3470 | − | AUAAAACUUCUUCCCUUCUGAU | 22 | 18570 |
| CFTR-Intron2-3471 | − | AAUAAAACUUCUUCCCUUCUGAU | 23 | 18571 |
| CFTR-Intron2-3472 | − | GAAUAAAACUUCUUCCCUUCUGAU | 24 | 18572 |
| CFTR-Intron2-3473 | − | UCAUGAAGCCUGAACUAU | 18 | 18573 |
| CFTR-Intron2-3474 | − | CUCAUGAAGCCUGAACUAU | 19 | 18574 |
| CFTR-Intron2-3475 | − | GCUCAUGAAGCCUGAACUAU | 20 | 18575 |
| CFTR-Intron2-3476 | − | GGCUCAUGAAGCCUGAACUAU | 21 | 18576 |
| CFTR-Intron2-3477 | − | UGGCUCAUGAAGCCUGAACUAU | 22 | 18577 |
| CFTR-Intron2-3478 | − | UUGGCUCAUGAAGCCUGAACUAU | 23 | 18578 |
| CFTR-Intron2-3479 | − | AUUGGCUCAUGAAGCCUGAACUAU | 24 | 18579 |
| CFTR-Intron2-3480 | − | UUCUUAUAAAAUUGGUAU | 18 | 18580 |

TABLE 38E-continued

5th Tier

| gRNA Name | DNA Strand | Targeting Domain | Target Site Length | Seq ID |
|---|---|---|---|---|
| CFTR-Intron2-3481 | − | UUUCUUAUAAAAUUGGUAU | 19 | 18581 |
| CFTR-Intron2-3482 | − | UUUUCUUAUAAAAUUGGUAU | 20 | 18582 |
| CFTR-Intron2-3483 | − | CUUUUCUUAUAAAAUUGGUAU | 21 | 18583 |
| CFTR-Intron2-3484 | − | UCUUUUCUUAUAAAAUUGGUAU | 22 | 18584 |
| CFTR-Intron2-3485 | − | UUCUUUUCUUAUAAAAUUGGUAU | 23 | 18585 |
| CFTR-Intron2-3486 | − | CUUCUUUUCUUAUAAAAUUGGUAU | 24 | 18586 |
| CFTR-Intron2-3487 | − | UCAGAGAAUUUGUCUUAU | 18 | 18587 |
| CFTR-Intron2-3488 | − | UUCAGAGAAUUUGUCUUAU | 19 | 18588 |
| CFTR-Intron2-3489 | − | UUUCAGAGAAUUUGUCUUAU | 20 | 18589 |
| CFTR-Intron2-3490 | − | GUUUCAGAGAAUUUGUCUUAU | 21 | 18590 |
| CFTR-Intron2-3491 | − | GGUUUCAGAGAAUUUGUCUUAU | 22 | 18591 |
| CFTR-Intron2-3492 | − | UGGUUUCAGAGAAUUUGUCUUAU | 23 | 18592 |
| CFTR-Intron2-3493 | − | UUGGUUUCAGAGAAUUUGUCUUAU | 24 | 18593 |
| CFTR-Intron2-3494 | − | UUUGUACCUCUGCACCCU | 18 | 18594 |
| CFTR-Intron2-3495 | − | CUUUGUACCUCUGCACCCU | 19 | 18595 |
| CFTR-Intron2-705 | − | ACUUUGUACCUCUGCACCCU | 20 | 15805 |
| CFTR-Intron2-3496 | − | UACUUUGUACCUCUGCACCCU | 21 | 18596 |
| CFTR-Intron2-3497 | − | GUACUUUGUACCUCUGCACCCU | 22 | 18597 |
| CFTR-Intron2-3498 | − | GGUACUUUGUACCUCUGCACCCU | 23 | 18598 |
| CFTR-Intron2-3499 | − | UGGUACUUUGUACCUCUGCACCCU | 24 | 18599 |
| CFTR-Intron2-3500 | − | AAUACAAAUGUACUCCCU | 18 | 18600 |
| CFTR-Intron2-3501 | − | GAAUACAAAUGUACUCCCU | 19 | 18601 |
| CFTR-Intron2-389 | − | UGAAUACAAAUGUACUCCCU | 20 | 15489 |
| CFTR-Intron2-3502 | − | UUGAAUACAAAUGUACUCCCU | 21 | 18602 |
| CFTR-Intron2-3503 | − | UUUGAAUACAAAUGUACUCCCU | 22 | 18603 |
| CFTR-Intron2-3504 | − | AUUUGAAUACAAAUGUACUCCCU | 23 | 18604 |
| CFTR-Intron2-3505 | − | UAUUUGAAUACAAAUGUACUCCCU | 24 | 18605 |
| CFTR-Intron2-3506 | − | UAGGUGGAGAACUGGCCU | 18 | 18606 |
| CFTR-Intron2-3507 | − | CUAGGUGGAGAACUGGCCU | 19 | 18607 |
| CFTR-Intron2-3508 | − | CCUAGGUGGAGAACUGGCCU | 20 | 18608 |
| CFTR-Intron2-3509 | − | ACCUAGGUGGAGAACUGGCCU | 21 | 18609 |
| CFTR-Intron2-3510 | − | GACCUAGGUGGAGAACUGGCCU | 22 | 18610 |
| CFTR-Intron2-3511 | − | AGACCUAGGUGGAGAACUGGCCU | 23 | 18611 |
| CFTR-Intron2-3512 | − | AAGACCUAGGUGGAGAACUGGCCU | 24 | 18612 |
| CFTR-Intron2-3513 | − | GAAAAGCAAACUGAGGCU | 18 | 18613 |
| CFTR-Intron2-3514 | − | AGAAAAGCAAACUGAGGCU | 19 | 18614 |
| CFTR-Intron2-3515 | − | CAGAAAAGCAAACUGAGGCU | 20 | 18615 |

TABLE 38E-continued

5th Tier

| gRNA Name | DNA Strand | Targeting Domain | Target Site Length | Seq ID |
|---|---|---|---|---|
| CFTR-Intron2-3516 | - | ACAGAAAAGCAAACUGAGGCU | 21 | 18616 |
| CFTR-Intron2-3517 | - | UACAGAAAAGCAAACUGAGGCU | 22 | 18617 |
| CFTR-Intron2-3518 | - | UUACAGAAAAGCAAACUGAGGCU | 23 | 18618 |
| CFTR-Intron2-3519 | - | UUUACAGAAAAGCAAACUGAGGCU | 24 | 18619 |
| CFTR-Intron2-3520 | - | GAUGCCAAGAUCCAUGCU | 18 | 18620 |
| CFTR-Intron2-3521 | - | GGAUGCCAAGAUCCAUGCU | 19 | 18621 |
| CFTR-Intron2-3522 | - | GGGAUGCCAAGAUCCAUGCU | 20 | 18622 |
| CFTR-Intron2-3523 | - | GGGGAUGCCAAGAUCCAUGCU | 21 | 18623 |
| CFTR-Intron2-3524 | - | AGGGGAUGCCAAGAUCCAUGCU | 22 | 18624 |
| CFTR-Intron2-3525 | - | UAGGGGAUGCCAAGAUCCAUGCU | 23 | 18625 |
| CFTR-Intron2-3526 | - | CUAGGGGAUGCCAAGAUCCAUGCU | 24 | 18626 |
| CFTR-Intron2-3527 | - | AAGUUUUAAUUGGAUGCU | 18 | 18627 |
| CFTR-Intron2-3528 | - | UAAGUUUUAAUUGGAUGCU | 19 | 18628 |
| CFTR-Intron2-3529 | - | CUAAGUUUUAAUUGGAUGCU | 20 | 18629 |
| CFTR-Intron2-3530 | - | UCUAAGUUUUAAUUGGAUGCU | 21 | 18630 |
| CFTR-Intron2-3531 | - | AUCUAAGUUUUAAUUGGAUGCU | 22 | 18631 |
| CFTR-Intron2-3532 | - | UAUCUAAGUUUUAAUUGGAUGCU | 23 | 18632 |
| CFTR-Intron2-3533 | - | AUAUCUAAGUUUUAAUUGGAUGCU | 24 | 18633 |
| CFTR-Intron2-3534 | - | UCUCAUUAGCAAGCUUCU | 18 | 18634 |
| CFTR-Intron2-3535 | - | CUCUCAUUAGCAAGCUUCU | 19 | 18635 |
| CFTR-Intron2-75 | - | GCUCUCAUUAGCAAGCUUCU | 20 | 15175 |
| CFTR-Intron2-3536 | - | GGCUCUCAUUAGCAAGCUUCU | 21 | 18636 |
| CFTR-Intron2-3537 | - | GGGCUCUCAUUAGCAAGCUUCU | 22 | 18637 |
| CFTR-Intron2-3538 | - | AGGGCUCUCAUUAGCAAGCUUCU | 23 | 18638 |
| CFTR-Intron2-3539 | - | AAGGGCUCUCAUUAGCAAGCUUCU | 24 | 18639 |
| CFTR-Intron2-3540 | - | UUUUCAUCUCUGUACAGU | 18 | 18640 |
| CFTR-Intron2-3541 | - | UUUUUCAUCUCUGUACAGU | 19 | 18641 |
| CFTR-Intron2-3542 | - | AUUUUUCAUCUCUGUACAGU | 20 | 18642 |
| CFTR-Intron2-3543 | - | AAUUUUUCAUCUCUGUACAGU | 21 | 18643 |
| CFTR-Intron2-3544 | - | AAAUUUUUCAUCUCUGUACAGU | 22 | 18644 |
| CFTR-Intron2-3545 | - | GAAAUUUUUCAUCUCUGUACAGU | 23 | 18645 |
| CFTR-Intron2-3546 | - | UGAAAUUUUUCAUCUCUGUACAGU | 24 | 18646 |
| CFTR-Intron2-3547 | - | UUUCUACAUUACUUCCGU | 18 | 18647 |
| CFTR-Intron2-3548 | - | CUUUCUACAUUACUUCCGU | 19 | 18648 |
| CFTR-Intron2-3549 | - | CCUUUCUACAUUACUUCCGU | 20 | 18649 |
| CFTR-Intron2-3550 | - | ACCUUUCUACAUUACUUCCGU | 21 | 18650 |
| CFTR-Intron2-3551 | - | CACCUUUCUACAUUACUUCCGU | 22 | 18651 |

TABLE 38E-continued

5th Tier

| gRNA Name | DNA Strand | Targeting Domain | Target Site Length | Seq ID |
|---|---|---|---|---|
| CFTR-Intron2-3552 | − | ACACCUUUCUACAUUACUUCCGU | 23 | 18652 |
| CFTR-Intron2-3553 | − | AACACCUUUCUACAUUACUUCCGU | 24 | 18653 |
| CFTR-Intron2-3554 | − | AAUGCUGGGAUUAUAGGU | 18 | 18654 |
| CFTR-Intron2-3555 | − | AAAUGCUGGGAUUAUAGGU | 19 | 18655 |
| CFTR-Intron2-3556 | − | AAAAUGCUGGGAUUAUAGGU | 20 | 18656 |
| CFTR-Intron2-3557 | − | CAAAAUGCUGGGAUUAUAGGU | 21 | 18657 |
| CFTR-Intron2-3558 | − | CCAAAAUGCUGGGAUUAUAGGU | 22 | 18658 |
| CFTR-Intron2-3559 | − | CCCAAAAUGCUGGGAUUAUAGGU | 23 | 18659 |
| CFTR-Intron2-3560 | − | UCCCAAAAUGCUGGGAUUAUAGGU | 24 | 18660 |
| CFTR-Intron2-3561 | − | AUAAAGUGGGUCCCUGGU | 18 | 18661 |
| CFTR-Intron2-3562 | − | CAUAAAGUGGGUCCCUGGU | 19 | 18662 |
| CFTR-Intron2-3563 | − | ACAUAAAGUGGGUCCCUGGU | 20 | 18663 |
| CFTR-Intron2-3564 | − | UACAUAAAGUGGGUCCCUGGU | 21 | 18664 |
| CFTR-Intron2-3565 | − | CUACAUAAAGUGGGUCCCUGGU | 22 | 18665 |
| CFTR-Intron2-3566 | − | UCUACAUAAAGUGGGUCCCUGGU | 23 | 18666 |
| CFTR-Intron2-3567 | − | UUCUACAUAAAGUGGGUCCCUGGU | 24 | 18667 |
| CFTR-Intron2-3568 | − | AAAGGUGGAGAAGCAUGU | 18 | 18668 |
| CFTR-Intron2-3569 | − | GAAAGGUGGAGAAGCAUGU | 19 | 18669 |
| CFTR-Intron2-406 | − | AGAAAGGUGGAGAAGCAUGU | 20 | 15506 |
| CFTR-Intron2-3570 | − | GAGAAAGGUGGAGAAGCAUGU | 21 | 18670 |
| CFTR-Intron2-3571 | − | AGAGAAAGGUGGAGAAGCAUGU | 22 | 18671 |
| CFTR-Intron2-3572 | − | GAGAGAAAGGUGGAGAAGCAUGU | 23 | 18672 |
| CFTR-Intron2-3573 | − | UGAGAGAAAGGUGGAGAAGCAUGU | 24 | 18673 |
| CFTR-Intron2-3574 | − | GGGAGGUUAGCUCUGUGU | 18 | 18674 |
| CFTR-Intron2-3575 | − | UGGGAGGUUAGCUCUGUGU | 19 | 18675 |
| CFTR-Intron2-3576 | − | AUGGGAGGUUAGCUCUGUGU | 20 | 18676 |
| CFTR-Intron2-3577 | − | GAUGGGAGGUUAGCUCUGUGU | 21 | 18677 |
| CFTR-Intron2-3578 | − | GGAUGGGAGGUUAGCUCUGUGU | 22 | 18678 |
| CFTR-Intron2-3579 | − | UGGAUGGGAGGUUAGCUCUGUGU | 23 | 18679 |
| CFTR-Intron2-3580 | − | AUGGAUGGGAGGUUAGCUCUGUGU | 24 | 18680 |
| CFTR-Intron2-3581 | − | GAGGUUAGCUCUGUGUGU | 18 | 18681 |
| CFTR-Intron2-3582 | − | GGAGGUUAGCUCUGUGUGU | 19 | 18682 |
| CFTR-Intron2-3583 | − | GGGAGGUUAGCUCUGUGUGU | 20 | 18683 |
| CFTR-Intron2-3584 | − | UGGGAGGUUAGCUCUGUGUGU | 21 | 18684 |
| CFTR-Intron2-3585 | − | AUGGGAGGUUAGCUCUGUGUGU | 22 | 18685 |
| CFTR-Intron2-3586 | − | GAUGGGAGGUUAGCUCUGUGUGU | 23 | 18686 |
| CFTR-Intron2-3587 | − | GGAUGGGAGGUUAGCUCUGUGUGU | 24 | 18687 |

TABLE 38E-continued

5th Tier

| gRNA Name | DNA Strand | Targeting Domain | Target Site Length | Seq ID |
|---|---|---|---|---|
| CFTR-Intron2-3588 | - | AACUAAAGUAACACCAUU | 18 | 18688 |
| CFTR-Intron2-3589 | - | AAACUAAAGUAACACCAUU | 19 | 18689 |
| CFTR-Intron2-3590 | - | AAAACUAAAGUAACACCAUU | 20 | 18690 |
| CFTR-Intron2-3591 | - | GAAAACUAAAGUAACACCAUU | 21 | 18691 |
| CFTR-Intron2-3592 | - | UGAAAACUAAAGUAACACCAUU | 22 | 18692 |
| CFTR-Intron2-3593 | - | GUGAAAACUAAAGUAACACCAUU | 23 | 18693 |
| CFTR-Intron2-3594 | - | UGUGAAAACUAAAGUAACACCAUU | 24 | 18694 |
| CFTR-Intron2-3595 | - | UUUCCUUUUUUGGCAUU | 18 | 18695 |
| CFTR-Intron2-3596 | - | AUUUCCUUUUUUGGCAUU | 19 | 18696 |
| CFTR-Intron2-3597 | - | CAUUUCCUUUUUUGGCAUU | 20 | 18697 |
| CFTR-Intron2-3598 | - | UCAUUUCCUUUUUUGGCAUU | 21 | 18698 |
| CFTR-Intron2-3599 | - | UUCAUUUCCUUUUUUGGCAUU | 22 | 18699 |
| CFTR-Intron2-3600 | - | AUUCAUUUCCUUUUUUGGCAUU | 23 | 18700 |
| CFTR-Intron2-3601 | - | AAUUCAUUUCCUUUUUUGGCAUU | 24 | 18701 |
| CFTR-Intron2-3602 | - | UACUCCUUUAGAGUGAUU | 18 | 18702 |
| CFTR-Intron2-3603 | - | UUACUCCUUUAGAGUGAUU | 19 | 18703 |
| CFTR-Intron2-3604 | - | AUUACUCCUUUAGAGUGAUU | 20 | 18704 |
| CFTR-Intron2-3605 | - | UAUUACUCCUUUAGAGUGAUU | 21 | 18705 |
| CFTR-Intron2-3606 | - | CUAUUACUCCUUUAGAGUGAUU | 22 | 18706 |
| CFTR-Intron2-3607 | - | CCUAUUACUCCUUUAGAGUGAUU | 23 | 18707 |
| CFTR-Intron2-3608 | - | GCCUAUUACUCCUUUAGAGUGAUU | 24 | 18708 |
| CFTR-Intron2-3609 | - | GAAAUUUAUUGAAAUAUU | 18 | 18709 |
| CFTR-Intron2-3610 | - | UGAAAUUUAUUGAAAUAUU | 19 | 18710 |
| CFTR-Intron2-3611 | - | UUGAAAUUUAUUGAAAUAUU | 20 | 18711 |
| CFTR-Intron2-3612 | - | UUUGAAAUUUAUUGAAAUAUU | 21 | 18712 |
| CFTR-Intron2-3613 | - | AUUUGAAAUUUAUUGAAAUAUU | 22 | 18713 |
| CFTR-Intron2-3614 | - | UAUUUGAAAUUUAUUGAAAUAUU | 23 | 18714 |
| CFTR-Intron2-3615 | - | GUAUUUGAAAUUUAUUGAAAUAUU | 24 | 18715 |
| CFTR-Intron2-3616 | - | AAUUAAGAUGAUAAUAUU | 18 | 18716 |
| CFTR-Intron2-3617 | - | AAAUUAAGAUGAUAAUAUU | 19 | 18717 |
| CFTR-Intron2-3618 | - | AAAAUUAAGAUGAUAAUAUU | 20 | 18718 |
| CFTR-Intron2-3619 | - | GAAAAUUAAGAUGAUAAUAUU | 21 | 18719 |
| CFTR-Intron2-3620 | - | UGAAAAUUAAGAUGAUAAUAUU | 22 | 18720 |
| CFTR-Intron2-3621 | - | UUGAAAAUUAAGAUGAUAAUAUU | 23 | 18721 |
| CFTR-Intron2-3622 | - | UUUGAAAAUUAAGAUGAUAAUAUU | 24 | 18722 |
| CFTR-Intron2-3623 | - | UUGUACCUCUGCACCCUU | 18 | 18723 |
| CFTR-Intron2-3624 | - | UUUGUACCUCUGCACCCUU | 19 | 18724 |

TABLE 38E-continued

5th Tier

| gRNA Name | DNA Strand | Targeting Domain | Target Site Length | Seq ID |
|---|---|---|---|---|
| CFTR-Intron2-412 | - | CUUUGUACCUCUGCACCCUU | 20 | 15512 |
| CFTR-Intron2-3625 | - | ACUUUGUACCUCUGCACCCUU | 21 | 18725 |
| CFTR-Intron2-3626 | - | UACUUUGUACCUCUGCACCCUU | 22 | 18726 |
| CFTR-Intron2-3627 | - | GUACUUUGUACCUCUGCACCCUU | 23 | 18727 |
| CFTR-Intron2-3628 | - | GGUACUUUGUACCUCUGCACCCUU | 24 | 18728 |
| CFTR-Intron2-3629 | - | AGGUGGAGAACUGGCCUU | 18 | 18729 |
| CFTR-Intron2-3630 | - | UAGGUGGAGAACUGGCCUU | 19 | 18730 |
| CFTR-Intron2-414 | - | CUAGGUGGAGAACUGGCCUU | 20 | 15514 |
| CFTR-Intron2-3631 | - | CCUAGGUGGAGAACUGGCCUU | 21 | 18731 |
| CFTR-Intron2-3632 | - | ACCUAGGUGGAGAACUGGCCUU | 22 | 18732 |
| CFTR-Intron2-3633 | - | GACCUAGGUGGAGAACUGGCCUU | 23 | 18733 |
| CFTR-Intron2-3634 | - | AGACCUAGGUGGAGAACUGGCCUU | 24 | 18734 |
| CFTR-Intron2-3635 | - | GGUCACUAGAGACCUCUU | 18 | 18735 |
| CFTR-Intron2-3636 | - | GGGUCACUAGAGACCUCUU | 19 | 18736 |
| CFTR-Intron2-3637 | - | AGGGUCACUAGAGACCUCUU | 20 | 18737 |
| CFTR-Intron2-3638 | - | CAGGGUCACUAGAGACCUCUU | 21 | 18738 |
| CFTR-Intron2-3639 | - | CCAGGGUCACUAGAGACCUCUU | 22 | 18739 |
| CFTR-Intron2-3640 | - | CCCAGGGUCACUAGAGACCUCUU | 23 | 18740 |
| CFTR-Intron2-3641 | - | GCCCAGGGUCACUAGAGACCUCUU | 24 | 18741 |
| CFTR-Intron2-3642 | - | AAAUUUAUUGAAAUAUUU | 18 | 18742 |
| CFTR-Intron2-3643 | - | GAAAUUUAUUGAAAUAUUU | 19 | 18743 |
| CFTR-Intron2-721 | - | UGAAAUUUAUUGAAAUAUUU | 20 | 15821 |
| CFTR-Intron2-3644 | - | UUGAAAUUUAUUGAAAUAUUU | 21 | 18744 |
| CFTR-Intron2-3645 | - | UUUGAAAUUUAUUGAAAUAUUU | 22 | 18745 |
| CFTR-Intron2-3646 | - | AUUUGAAAUUUAUUGAAAUAUUU | 23 | 18746 |
| CFTR-Intron2-3647 | - | UAUUUGAAAUUUAUUGAAAUAUUU | 24 | 18747 |
| CFTR-Intron2-3648 | - | GAGAUAUUUUAUUCCUUU | 18 | 18748 |
| CFTR-Intron2-3649 | - | AGAGAUAUUUUAUUCCUUU | 19 | 18749 |
| CFTR-Intron2-3650 | - | UAGAGAUAUUUUAUUCCUUU | 20 | 18750 |
| CFTR-Intron2-3651 | - | UUAGAGAUAUUUUAUUCCUUU | 21 | 18751 |
| CFTR-Intron2-3652 | - | UUUAGAGAUAUUUUAUUCCUUU | 22 | 18752 |
| CFTR-Intron2-3653 | - | AUUUAGAGAUAUUUUAUUCCUUU | 23 | 18753 |
| CFTR-Intron2-3654 | - | UAUUUAGAGAUAUUUUAUUCCUUU | 24 | 18754 |
| CFTR-Intron2-3655 | - | CUCUUUGCUCCUAUCUUU | 18 | 18755 |
| CFTR-Intron2-3656 | - | ACUCUUUGCUCCUAUCUUU | 19 | 18756 |
| CFTR-Intron2-3657 | - | AACUCUUUGCUCCUAUCUUU | 20 | 18757 |
| CFTR-Intron2-3658 | - | GAACUCUUUGCUCCUAUCUUU | 21 | 18758 |

TABLE 38E-continued

| | | 5th Tier | | |
|---|---|---|---|---|
| gRNA Name | DNA Strand | Targeting Domain | Target Site Length | Seq ID |
| CFTR-Intron2-3659 | - | AGAACUCUUUGCUCCUAUCUUU | 22 | 18759 |
| CFTR-Intron2-3660 | - | UAGAACUCUUUGCUCCUAUCUUU | 23 | 18760 |
| CFTR-Intron2-3661 | - | UUAGAACUCUUUGCUCCUAUCUUU | 24 | 18761 |
| CFTR-Intron2-3662 | - | AAAAUACACAUUUGGUUU | 18 | 18762 |
| CFTR-Intron2-3663 | - | AAAAAUACACAUUUGGUUU | 19 | 18763 |
| CFTR-Intron2-3664 | - | GAAAAAUACACAUUUGGUUU | 20 | 18764 |
| CFTR-Intron2-3665 | - | UGAAAAAUACACAUUUGGUUU | 21 | 18765 |
| CFTR-Intron2-3666 | - | CUGAAAAAUACACAUUUGGUUU | 22 | 18766 |
| CFTR-Intron2-3667 | - | CCUGAAAAAUACACAUUUGGUUU | 23 | 18767 |
| CFTR-Intron2-3668 | - | UCCUGAAAAAUACACAUUUGGUUU | 24 | 18768 |
| CFTR-Intron2-3669 | - | UUGUUGUUGCUGUUGUUU | 18 | 18769 |
| CFTR-Intron2-3670 | - | GUUGUUGUUGCUGUUGUUU | 19 | 18770 |
| CFTR-Intron2-3671 | - | UGUUGUUGUUGCUGUUGUUU | 20 | 18771 |
| CFTR-Intron2-3672 | - | UUGUUGUUGUUGCUGUUGUUU | 21 | 18772 |
| CFTR-Intron2-3673 | - | GUUGUUGUUGUUGCUGUUGUUU | 22 | 18773 |
| CFTR-Intron2-3674 | - | UGUUGUUGUUGUUGCUGUUGUUU | 23 | 18774 |
| CFTR-Intron2-3675 | - | UUGUUGUUGUUGUUGCUGUUGUUU | 24 | 18775 |
| CFTR-Intron2-3676 | - | UGUUUGUGUUGUUUGUUU | 18 | 18776 |
| CFTR-Intron2-3677 | - | UUGUUUGUGUUGUUUGUUU | 19 | 18777 |
| CFTR-Intron2-3678 | - | UUUGUUUGUGUUGUUUGUUU | 20 | 18778 |
| CFTR-Intron2-3679 | - | GUUUGUUUGUGUUGUUUGUUU | 21 | 18779 |
| CFTR-Intron2-3680 | - | UGUUUGUUUGUGUUGUUUGUUU | 22 | 18780 |
| CFTR-Intron2-3681 | - | UUGUUUGUUUGUGUUGUUUGUUU | 23 | 18781 |
| CFTR-Intron2-3682 | - | UUUGUUUGUUUGUGUUGUUUGUUU | 24 | 18782 |
| CFTR-Intron2-3683 | - | GACCAUGAGAUGGAUUUU | 18 | 18783 |
| CFTR-Intron2-3684 | - | AGACCAUGAGAUGGAUUUU | 19 | 18784 |
| CFTR-Intron2-3685 | - | GAGACCAUGAGAUGGAUUUU | 20 | 18785 |
| CFTR-Intron2-3686 | - | AGAGACCAUGAGAUGGAUUUU | 21 | 18786 |
| CFTR-Intron2-3687 | - | UAGAGACCAUGAGAUGGAUUUU | 22 | 18787 |
| CFTR-Intron2-3688 | - | UUAGAGACCAUGAGAUGGAUUUU | 23 | 18788 |
| CFTR-Intron2-3689 | - | AUUAGAGACCAUGAGAUGGAUUUU | 24 | 18789 |

Table 39A provides exemplary targeting domains for correcting a mutation (e.g., 3272-26→G) in the CFTR gene selected according to the first tier parameters. The targeting domains bind within intron 2, have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 39A

1st Tier

| gRNA Name | DNA Strand | Targeting Domain | Target Site Length | Seq ID |
|---|---|---|---|---|
| CFTR-Intron2-3690 | − | GGUGAGUCUGCUCCAUA | 17 | 18790 |
| CFTR-Intron2-3691 | − | GGCCUAUUACUCCUUUA | 17 | 18791 |
| CFTR-Intron2-3692 | + | GUGAAUCUGCUACUCCC | 17 | 18792 |
| CFTR-Intron2-3693 | + | GUUUUGAAAGCAAAUAU | 17 | 18793 |
| CFTR-Intron2-3694 | + | GGAUCUUGGCAUCCCCU | 17 | 18794 |
| CFTR-Intron2-3695 | + | GCACACUGCAGUUAUGU | 17 | 18795 |
| CFTR-Intron2-3696 | − | GAAGGUGAGUCUGCUCCAUA | 20 | 18796 |
| CFTR-Intron2-3697 | + | GAACUUGUCAAUAUACCUGC | 20 | 18797 |
| CFTR-Intron2-3698 | − | GUUUAUGUACACACCCCUUC | 20 | 18798 |
| CFTR-Intron2-3699 | − | GUUUUAAUUGGAUGCUGAGG | 20 | 18799 |
| CFTR-Intron2-3700 | − | GUUUUAUUUCUCAGACCGG | 20 | 18800 |
| CFTR-Intron2-3522 | − | GGGAUGCCAAGAUCCAUGCU | 20 | 18622 |
| CFTR-Intron2-2554 | + | GCACUAUGACUCAAGAGUCU | 20 | 17654 |
| CFTR-Intron2-3701 | − | GUGCAAACCACACAUCCGUU | 20 | 18801 |

Table 39B provides exemplary targeting domains for correcting a mutation (e.g., 3272-26→G) in the CFTR gene selected according to the second tier parameters. The targeting domains bind within intron 2 and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 39B

2nd Tier

| gRNA Name | DNA Strand | Targeting Domain | Target Site Length | Seq ID |
|---|---|---|---|---|
| CFTR-Intron2-3702 | − | UAGAUGGGAAAAGGUAA | 17 | 18802 |
| CFTR-Intron2-3703 | − | CUUAUUAGAGACCAUGA | 17 | 18803 |
| CFTR-Intron2-3704 | + | CAAUUAACCCAGCCCUA | 17 | 18804 |
| CFTR-Intron2-3705 | − | CUGAAUUUGCAGAAUUA | 17 | 18805 |
| CFTR-Intron2-3706 | + | UAGGUAAACAAUUAGAC | 17 | 18806 |
| CFTR-Intron2-3707 | − | CACCCUUGGGAAGUGAC | 17 | 18807 |
| CFTR-Intron2-3708 | − | UGGCUCAAUUUUGUGAC | 17 | 18808 |
| CFTR-Intron2-3709 | + | UCAAAAGGAUCCUAACC | 17 | 18809 |
| CFTR-Intron2-3710 | + | AAUACUAUAGGAACACC | 17 | 18810 |
| CFTR-Intron2-3711 | + | CAUCUAUUUCCCUCCCC | 17 | 18811 |
| CFTR-Intron2-3712 | − | UCAAAGGUUAGGAUCC | 17 | 18812 |
| CFTR-Intron2-3713 | + | CUUGUCAAUAUACCUGC | 17 | 18813 |
| CFTR-Intron2-3714 | + | AUUUAUUAAGUUAUUGC | 17 | 18814 |
| CFTR-Intron2-3715 | − | UAUGUACACACCCCUUC | 17 | 18815 |
| CFTR-Intron2-3716 | + | AAAGGAGUAAUACACAG | 17 | 18816 |
| CFTR-Intron2-3717 | − | CACUUCUAAGAUCAAGG | 17 | 18817 |

TABLE 39B-continued

| | | 2nd Tier | | |
|---|---|---|---|---|
| gRNA Name | DNA Strand | Targeting Domain | Target Site Length | Seq ID |
| CFTR-Intron2-3718 | − | UUAAUUGGAUGCUGAGG | 17 | 18818 |
| CFTR-Intron2-3719 | − | UUAUUUCUCAGACCGG | 17 | 18819 |
| CFTR-Intron2-3720 | − | UCCAUGCUUAGAGAUUG | 17 | 18820 |
| CFTR-Intron2-3721 | − | UUUCAAAGACCUUUAAU | 17 | 18821 |
| CFTR-Intron2-3722 | − | CUAGGGGAUGCCAAGAU | 17 | 18822 |
| CFTR-Intron2-3723 | − | UGAAGUAAAUCGUGUAU | 17 | 18823 |
| CFTR-Intron2-3724 | + | UGAUUGGAAAGGAAACU | 17 | 18824 |
| CFTR-Intron2-3725 | − | AUGCCAAGAUCCAUGCU | 17 | 18825 |
| CFTR-Intron2-3726 | − | AUUAAGCUAGUGGGAGU | 17 | 18826 |
| CFTR-Intron2-3727 | + | CUAGGUCUUCACAUAGU | 17 | 18827 |
| CFTR-Intron2-3728 | − | CAAACCACACAUCCGUU | 17 | 18828 |
| CFTR-Intron2-3729 | − | AAAUAGAUGGGAAAAGGUAA | 20 | 18829 |
| CFTR-Intron2-3730 | − | AGUUUUCACUGUAUCCCCCA | 20 | 18830 |
| CFTR-Intron2-3731 | − | UCCCAGAGACUCUUGAGUCA | 20 | 18831 |
| CFTR-Intron2-3732 | − | UGUCUUAUUAGAGACCAUGA | 20 | 18832 |
| CFTR-Intron2-3733 | + | UUUCAAUUAACCCAGCCCUA | 20 | 18833 |
| CFTR-Intron2-3734 | − | AAUCUGAAUUUGCAGAAUUA | 20 | 18834 |
| CFTR-Intron2-3735 | − | CCCGGCCUAUUACUCCUUUA | 20 | 18835 |
| CFTR-Intron2-3736 | + | AACUAGGUAAACAAUUAGAC | 20 | 18836 |
| CFTR-Intron2-3737 | − | CUGCACCCUUGGGAAGUGAC | 20 | 18837 |
| CFTR-Intron2-3738 | − | AUCUGGCUCAAUUUUGUGAC | 20 | 18838 |
| CFTR-Intron2-3739 | + | CAAUCAAAAGGAUCCUAACC | 20 | 18839 |
| CFTR-Intron2-3740 | + | UUAAAUACUAUAGGAACACC | 20 | 18840 |
| CFTR-Intron2-3741 | + | AGUGUGAAUCUGCUACUCCC | 20 | 18841 |
| CFTR-Intron2-3742 | − | CAAUCAAAAGGUUAGGAUCC | 20 | 18842 |
| CFTR-Intron2-2142 | + | CAUAAAGGAGUAAUACACAG | 20 | 17242 |
| CFTR-Intron2-3743 | − | UCACACUUCUAAGAUCAAGG | 20 | 18843 |
| CFTR-Intron2-3744 | + | CUAGCCAUUUCACAUUCCAU | 20 | 18844 |
| CFTR-Intron2-3745 | − | CUUCUAGGGGAUGCCAAGAU | 20 | 18845 |
| CFTR-Intron2-2486 | + | UUUUGAUUGGAAAGGAAACU | 20 | 17586 |
| CFTR-Intron2-3746 | + | CAUGGAUCUUGGCAUCCCCU | 20 | 18846 |
| CFTR-Intron2-3747 | − | AGAAUUAAGCUAGUGGGAGU | 20 | 18847 |
| CFTR-Intron2-3748 | + | CACCUAGGUCUUCACAUAGU | 20 | 18848 |
| CFTR-Intron2-3749 | + | UUUGCACACUGCAGUUAUGU | 20 | 18849 |
| CFTR-Intron2-3750 | − | CAGUGACAGAAACCCAAUUU | 20 | 18850 |

Table 39C provides exemplary targeting domains for correcting a mutation (e.g., 3272-26→G) in the CFTR gene selected according to the third tier parameters. The targeting domains bind within intron 2 and start with a 5'G. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 39C

| | 3rd Tier | | | |
|---|---|---|---|---|
| gRNA Name | DNA Strand | Targeting Domain | Target Site Length | Seq ID |
| CFTR-Intron2-3751 | − | GUUAAUGAAUGAUGGAG | 17 | 18851 |

TABLE 39C-continued

| | 3rd Tier | | | |
|---|---|---|---|---|
| gRNA Name | DNA Strand | Targeting Domain | Target Site Length | Seq ID |
| CFTR-Intron2-3752 | + | GCCAUUUCACAUUCCAU | 17 | 18852 |

Table 39D provides exemplary targeting domains for correcting a mutation (e.g., 3272-26→G) in the CFTR gene selected according to the fourth tier parameters. The targeting domains bind within intron 2. It is contemplated herein that in an embodiment the targeting domain hybridizes to the target domain through complementary base pairing. Any of the targeting domains in the Table can be used with a N. meningitidis Cas9 molecule that generates a double stranded break (Cas9 nuclease) or a single-stranded break (Cas9 nickase).

TABLE 39D

| | 4th Tier | | | |
|---|---|---|---|---|
| gRNA Name | DNA Strand | Targeting Domain | Target Site Length | Seq ID |
| CFTR-Intron2-3753 | + | CCAGAUAAUUCUGCAAA | 17 | 18853 |
| CFTR-Intron2-3754 | − | UCCUUUGUGAAGAGAAA | 17 | 18854 |
| CFTR-Intron2-3755 | + | CUGUAAAAUAGAGAUAA | 17 | 18855 |
| CFTR-Intron2-3756 | − | UUUCACUGUAUCCCCCA | 17 | 18856 |
| CFTR-Intron2-3757 | + | UAUCUCUCUGAGCCUCA | 17 | 18857 |
| CFTR-Intron2-3758 | − | CAGAGACUCUUGAGUCA | 17 | 18858 |
| CFTR-Intron2-3759 | + | CCCAGCUACUCAGGAGA | 17 | 18859 |
| CFTR-Intron2-3760 | − | UAGAAGGGCUCUCAUUA | 17 | 18860 |
| CFTR-Intron2-3761 | − | CUUCGUCUCCUGGGUUC | 17 | 18861 |
| CFTR-Intron2-3762 | + | CUACUCAGGAGACUGAG | 17 | 18862 |
| CFTR-Intron2-3763 | − | CUUGGCCUCCCAAAAUG | 17 | 18863 |
| CFTR-Intron2-3764 | − | AGGUGUGAGCCACUAUG | 17 | 18864 |
| CFTR-Intron2-3765 | − | CUUGGCCUCCCAAAGUG | 17 | 18865 |
| CFTR-Intron2-3766 | + | CUAUGACUCAAGAGUCU | 17 | 18866 |
| CFTR-Intron2-3767 | − | UGACAGAAACCCAAUUU | 17 | 18867 |
| CFTR-Intron2-3768 | − | AAGAAAACAGAAAGUUU | 17 | 18868 |
| CFTR-Intron2-3769 | − | AUAUUAAACUUUAUUUU | 17 | 18869 |
| CFTR-Intron2-3770 | + | AAGCCAGAUAAUUCUGCAAA | 20 | 18870 |
| CFTR-Intron2-3771 | − | UAUUCCUUUGUGAAGAGAAA | 20 | 18871 |
| CFTR-Intron2-3772 | + | UUUCUGUAAAAUAGAGAUAA | 20 | 18872 |
| CFTR-Intron2-3773 | + | UAUUAUCUCUCUGAGCCUCA | 20 | 18873 |
| CFTR-Intron2-1715 | + | AGUCCCAGCUACUCAGGAGA | 20 | 16815 |
| CFTR-Intron2-3774 | − | UUAUAGAAGGGCUCUCAUUA | 20 | 18874 |
| CFTR-Intron2-3775 | + | UCCCAUCUAUUUCCUCCCC | 20 | 18875 |
| CFTR-Intron2-3776 | + | UGUAUUUAUUAAGUUAUUGC | 20 | 18876 |

TABLE 39D-continued

4th Tier

| gRNA Name | DNA Strand | Targeting Domain | Target Site Length | Seq ID |
|---|---|---|---|---|
| CFTR-Intron2-3777 | - | AAACUUCGUCUCCUGGGUUC | 20 | 18877 |
| CFTR-Intron2-3778 | - | CCAGUUAAUGAAUGAUGGAG | 20 | 18878 |
| CFTR-Intron2-3779 | + | CAGCUACUCAGGAGACUGAG | 20 | 18879 |
| CFTR-Intron2-3291 | - | CACCUUGGCCUCCCAAAAUG | 20 | 18391 |
| CFTR-Intron2-3780 | - | UAUAGGUGUGAGCCACUAUG | 20 | 18880 |
| CFTR-Intron2-3352 | - | CGCCUUGGCCUCCCAAAGUG | 20 | 18452 |
| CFTR-Intron2-3781 | - | AGAUCCAUGCUUAGAGAUUG | 20 | 18881 |
| CFTR-Intron2-3782 | - | AUUUUUCAAAGACCUUUAAU | 20 | 18882 |
| CFTR-Intron2-3783 | + | AAGGUUUUGAAAGCAAAUAU | 20 | 18883 |
| CFTR-Intron2-3784 | - | UUAUGAAGUAAAUCGUGUAU | 20 | 18884 |
| CFTR-Intron2-3785 | - | UAAAAGAAAACAGAAAGUUU | 20 | 18885 |
| CFTR-Intron2-3786 | - | AAGAUAUUAAACUUUAUUUU | 20 | 18886 |

Table 40A provides exemplary targeting domains for correcting a mutation (e.g., 3272-26→G) in the CFTR gene selected according to the first tier parameters. The targeting domains bind within intron 10, have a high level of orthogonality and start with a 5'G. It is contemplated herein that in an embodiment the targeting domain hybridizes to the target domain through complementary base pairing. Any of the targeting domains in the Table can be used with a S. pyogenes Cas9 molecule that generates a double stranded break (Cas9 nuclease) or a single-stranded break (Cas9 nickase).

TABLE 40A

1st Tier

| gRNA Name | DNA Strand | Targeting Domain | Target Site Length | Seq ID |
|---|---|---|---|---|
| CFTR-Intron10-1 | - | GCUUUCUAGUAUUAGAA | 17 | 18887 |
| CFTR-Intron10-2 | - | GGCCUUUAAACAUUGAA | 17 | 18888 |
| CFTR-Intron10-3 | - | GUAGUAUUAAACCAUAA | 17 | 18889 |
| CFTR-Intron10-4 | - | GUUUACUAGAAAGAUAA | 17 | 18890 |
| CFTR-Intron10-5 | - | GACCUAAGAUAUCCUAA | 17 | 18891 |
| CFTR-Intron10-6 | - | GUAUUAGAAUGGGCUAA | 17 | 18892 |
| CFTR-Intron10-7 | - | GCUGGAUAAGAUUCUAA | 17 | 18893 |
| CFTR-Intron10-8 | + | GAUCAAUAAUAGAGACA | 17 | 18894 |
| CFTR-Intron10-9 | + | GUGUUUAAAUAUUCCCA | 17 | 18895 |
| CFTR-Intron10-10 | - | GUGCCACUAGUGAUGCA | 17 | 18896 |
| CFTR-Intron10-11 | - | GUACAAGUCUAGUUUCA | 17 | 18897 |
| CFTR-Intron10-12 | - | GGCUGGUAGUGUGAAGA | 17 | 18898 |
| CFTR-Intron10-13 | + | GUGAUGCAGACAACAGA | 17 | 18899 |
| CFTR-Intron10-14 | + | GACUAAAACUGAGUAGA | 17 | 18900 |
| CFTR-Intron10-15 | + | GGUACAAAUUUCAGGGA | 17 | 18901 |
| CFTR-Intron10-16 | + | GUCUCUCUAAGGUGUGA | 17 | 18902 |

TABLE 40A-continued

| | | 1st Tier | | |
|---|---|---|---|---|
| gRNA Name | DNA Strand | Targeting Domain | Target Site Length | Seq ID |
| CFTR-Intron10-17 | + | GUUCUUAGGGUGGGAUA | 17 | 18903 |
| CFTR-Intron10-18 | − | GUGUAGGGGUUAGCCUA | 17 | 18904 |
| CFTR-Intron10-19 | + | GCCUAUCACCUAGGCUA | 17 | 18905 |
| CFTR-Intron10-20 | + | GUGUGAGGGUCUCUCUA | 17 | 18906 |
| CFTR-Intron10-21 | − | GACUGAAAGCUGGCUUA | 17 | 18907 |
| CFTR-Intron10-22 | + | GUAUGUAGGAAAACAAC | 17 | 18908 |
| CFTR-Intron10-23 | + | GUAUUAAGUAUAGCCAC | 17 | 18909 |
| CFTR-Intron10-24 | − | GUGAGAUUAGAGGCCAC | 17 | 18910 |
| CFTR-Intron10-25 | − | GAUGAGCAGAUAAUUAC | 17 | 18911 |
| CFTR-Intron10-26 | + | GUAUCUCCAAAUAUGCC | 17 | 18912 |
| CFTR-Intron10-27 | − | GAAUGAAUGUGGUAUCC | 17 | 18913 |
| CFTR-Intron10-28 | + | GACAUCAGUUGGGUUCC | 17 | 18914 |
| CFTR-Intron10-29 | + | GUUGGAUGAGGGAAUGC | 17 | 18915 |
| CFTR-Intron10-30 | + | GCUAUUUAAACAGAAUC | 17 | 18916 |
| CFTR-Intron10-31 | − | GACUGACUAUACCUGUC | 17 | 18917 |
| CFTR-Intron10-32 | − | GUCUAUUGUGCCAGUUC | 17 | 18918 |
| CFTR-Intron10-33 | + | GAAUUGGUACAAAUUUC | 17 | 18919 |
| CFTR-Intron10-34 | − | GAUGAUUCCAAGCUUUC | 17 | 18920 |
| CFTR-Intron10-35 | + | GAUAUCUUAGGUCAAAG | 17 | 18921 |
| CFTR-Intron10-36 | − | GUCUAGUUUCAAGGAAG | 17 | 18922 |
| CFTR-Intron10-37 | + | GCUAAAGUAUUACCCAG | 17 | 18923 |
| CFTR-Intron10-38 | − | GGCAUUCUAAGUAUUAG | 17 | 18924 |
| CFTR-Intron10-39 | − | GUCAGAGAAGUAAUCGG | 17 | 18925 |
| CFTR-Intron10-40 | − | GAAGUAAUCGGCGGUGG | 17 | 18926 |
| CFTR-Intron10-41 | + | GCUACCUUGGUUGGAUG | 17 | 18927 |
| CFTR-Intron10-42 | − | GAUUGUCAUUUUAGCUG | 17 | 18928 |
| CFTR-Intron10-43 | + | GAAAUGGGGUAUAAGUG | 17 | 18929 |
| CFTR-Intron10-44 | − | GAUGGUAUUGCAGGGUG | 17 | 18930 |
| CFTR-Intron10-45 | − | GAGCCAAAAAUUGGGUG | 17 | 18931 |
| CFTR-Intron10-46 | − | GGCAUCUCACCAGUGUG | 17 | 18932 |
| CFTR-Intron10-47 | + | GGUCUCUCUAAGGUGUG | 17 | 18933 |
| CFTR-Intron10-48 | − | GGUAAGCUCAAGCAUUG | 17 | 18934 |
| CFTR-Intron10-49 | − | GUAUUUACCAUAUAUUG | 17 | 18935 |
| CFTR-Intron10-50 | − | GGUUUCCACUCAACAAU | 17 | 18936 |
| CFTR-Intron10-51 | − | GCUGGUAGUGUGAAGAU | 17 | 18937 |
| CFTR-Intron10-52 | − | GUGCAAAGCUUUCAGAU | 17 | 18938 |
| CFTR-Intron10-53 | − | GAAGGGUGUUAUCAACU | 17 | 18939 |
| CFTR-Intron10-54 | − | GAAUUGAAUAUGAGACU | 17 | 18940 |

TABLE 40A-continued

| | 1st Tier | | | |
|---|---|---|---|---|
| gRNA Name | DNA Strand | Targeting Domain | Target Site Length | Seq ID |
| CFTR-Intron10-55 | − | GGAAGGCAGUGGUCCCU | 17 | 18941 |
| CFTR-Intron10-56 | − | GUGAAAAUAUCACUUCU | 17 | 18942 |
| CFTR-Intron10-57 | − | GGAGCCAAAAAUUGGGU | 17 | 18943 |
| CFTR-Intron10-58 | + | GGAUUGGCUACCUUGGU | 17 | 18944 |
| CFTR-Intron10-59 | − | GUCACUGUAUUGUCUGU | 17 | 18945 |
| CFTR-Intron10-60 | − | GCAUCUCACCAGUGUGU | 17 | 18946 |
| CFTR-Intron10-61 | + | GAAGUAGAAGAACUAUU | 17 | 18947 |
| CFTR-Intron10-62 | + | GUUUGUCUUAGAUUAUU | 17 | 18948 |
| CFTR-Intron10-63 | − | GAUUAGCUUAUAUACUU | 17 | 18949 |
| CFTR-Intron10-64 | − | GAAGGCAGUGGUCCCUU | 17 | 18950 |
| CFTR-Intron10-65 | + | GAGUGCAUAAAGGUUGAAAA | 20 | 18951 |
| CFTR-Intron10-66 | − | GCUAUUCUGUAGGGAGACAA | 20 | 18952 |
| CFTR-Intron10-67 | − | GAUACUAAAUAAGUUAGCAA | 20 | 18953 |
| CFTR-Intron10-68 | − | GAGGGUUGAUAAGAAGAGAA | 20 | 18954 |
| CFTR-Intron10-69 | − | GCCGUUUACUAGAAAGAUAA | 20 | 18955 |
| CFTR-Intron10-70 | − | GGGUGUAGGGGUUAGCCUAA | 20 | 18956 |
| CFTR-Intron10-71 | − | GGGGCUGGAUAAGAUUCUAA | 20 | 18957 |
| CFTR-Intron10-72 | + | GGUAUAAGUGUGGAGUGUAA | 20 | 18958 |
| CFTR-Intron10-73 | − | GGAAGAUCCAAUAGGAUUAA | 20 | 18959 |
| CFTR-Intron10-74 | − | GGCUGGCAUAGAGUAAGACA | 20 | 18960 |
| CFTR-Intron10-75 | − | GGCUAUUCUGUAGGGAGACA | 20 | 18961 |
| CFTR-Intron10-76 | + | GAAGUGUUUAAAUAUUCCCA | 20 | 18962 |
| CFTR-Intron10-77 | + | GUGCUAUUUAAACAGAAUCA | 20 | 18963 |
| CFTR-Intron10-78 | + | GGAUUGCUUGAUGUUAUUCA | 20 | 18964 |
| CFTR-Intron10-79 | − | GAUGUACAAGUCUAGUUUCA | 20 | 18965 |
| CFTR-Intron10-80 | − | GGGGGCUGGUAGUGUGAAGA | 20 | 18966 |
| CFTR-Intron10-81 | + | GCUGUGAUGCAGACAACAGA | 20 | 18967 |
| CFTR-Intron10-82 | − | GCAAGUGCAAAGCUUUCAGA | 20 | 18968 |
| CFTR-Intron10-83 | − | GGCAUAGAGUAAGACAGGGA | 20 | 18969 |
| CFTR-Intron10-84 | + | GUUGUUCUUAGGGUGGGAUA | 20 | 18970 |
| CFTR-Intron10-85 | − | GGGGUGUAGGGGUUAGCCUA | 20 | 18971 |
| CFTR-Intron10-86 | − | GUCUGGUUUGAAGAACAGUA | 20 | 18972 |
| CFTR-Intron10-87 | + | GCCAGGUUAAGUUGUUCUUA | 20 | 18973 |
| CFTR-Intron10-88 | − | GAGUUUUAAACAGAAGUAAC | 20 | 18974 |
| CFTR-Intron10-89 | + | GACUGAAACUCCCCACACAC | 20 | 18975 |
| CFTR-Intron10-90 | + | GCUAAGAGACUCCUGAAUCC | 20 | 18976 |
| CFTR-Intron10-91 | + | GUUUUAGUAGAAACCUAAUC | 20 | 18977 |

TABLE 40A-continued

| | | 1st Tier | | |
|---|---|---|---|---|
| gRNA Name | DNA Strand | Targeting Domain | Target Site Length | Seq ID |
| CFTR-Intron10-92 | - | GGAUUAGGGAAUGCAGACUC | 20 | 18978 |
| CFTR-Intron10-93 | - | GGAGUCUAUUGUGCCAGUUC | 20 | 18979 |
| CFTR-Intron10-94 | + | GCUUGACAUCAGUUGGGUUC | 20 | 18980 |
| CFTR-Intron10-95 | - | GAUAAGAUUCUAAAGGAAAG | 20 | 18981 |
| CFTR-Intron10-96 | + | GGGUCAAUUGUAUUAGCAAG | 20 | 18982 |
| CFTR-Intron10-97 | + | GGCUUAACCCAUCUAUUAAG | 20 | 18983 |
| CFTR-Intron10-98 | + | GCAUAUUGGACCAGACACAG | 20 | 18984 |
| CFTR-Intron10-99 | - | GCAUAUGAGAAAAGUCACAG | 20 | 18985 |
| CFTR-Intron10-100 | + | GCCUAGAUGAUUAUUAAUAG | 20 | 18986 |
| CFTR-Intron10-101 | - | GUAAUCGGCGGUGGAGGUAG | 20 | 18987 |
| CFTR-Intron10-102 | + | GAUCAAUAAUAGAGACAAGG | 20 | 18988 |
| CFTR-Intron10-103 | - | GUCUAGUUUCAAGGAAGAGG | 20 | 18989 |
| CFTR-Intron10-104 | - | GUUUACUAACUCAAUCUAGG | 20 | 18990 |
| CFTR-Intron10-105 | - | GUCAGAGAAGUAAUCGGCGG | 20 | 18991 |
| CFTR-Intron10-106 | - | GGGCUGGUAGUGUGAAGAUG | 20 | 18992 |
| CFTR-Intron10-107 | + | GUUACAUAAAAAGAGAGGUG | 20 | 18993 |
| CFTR-Intron10-108 | + | GAGGGUCUCUCUAAGGUGUG | 20 | 18994 |
| CFTR-Intron10-109 | - | GCUUUGAAGGAAGAUCCAAU | 20 | 18995 |
| CFTR-Intron10-110 | - | GAGCUUUCUAGUAUUAGAAU | 20 | 18996 |
| CFTR-Intron10-111 | - | GGGGCUGGUAGUGUGAAGAU | 20 | 18997 |
| CFTR-Intron10-112 | - | GUCUUUUCCUCUUAAUAGAU | 20 | 18998 |
| CFTR-Intron10-113 | - | GCAGAAGGGUGUUAUCAACU | 20 | 18999 |
| CFTR-Intron10-114 | - | GAAGAAUUGAAUAUGAGACU | 20 | 19000 |
| CFTR-Intron10-115 | + | GUUACAACAGUCUUUAUACU | 20 | 19001 |
| CFTR-Intron10-116 | + | GUUACCUGGAUUGGCUACCU | 20 | 19002 |
| CFTR-Intron10-117 | + | GUUACUCAGUCCAGAAAGCU | 20 | 19003 |
| CFTR-Intron10-118 | - | GGAGUUUACUAACUCAAUCU | 20 | 19004 |
| CFTR-Intron10-119 | - | GAUUAGGGAAUGCAGACUCU | 20 | 19005 |
| CFTR-Intron10-120 | + | GGAAAGUUGUCCAAGAUAGU | 20 | 19006 |
| CFTR-Intron10-121 | - | GUAUUAGAGGUUAAGGAGGU | 20 | 19007 |
| CFTR-Intron10-122 | - | GGAAGCAGUGCUGCUGCUGU | 20 | 19008 |
| CFTR-Intron10-123 | - | GAAGUCACUGUAUUGUCUGU | 20 | 19009 |
| CFTR-Intron10-124 | - | GUUACCCAAUAAAAAAAAUU | 20 | 19010 |
| CFTR-Intron10-125 | - | GCUUUCAGGAGCCAAAAAUU | 20 | 19011 |
| CFTR-Intron10-126 | - | GGCUGCCUUUUAGUAGUAUU | 20 | 19012 |
| CFTR-Intron10-127 | - | GAGGAAGGCAGUGGUCCCUU | 20 | 19013 |
| CFTR-Intron10-128 | - | GUUUGGAUGGAGCUUGGUU | 20 | 19014 |
| CFTR-Intron10-129 | - | GGGUUUGAUUAGAUAAAUUU | 20 | 19015 |

TABLE 40A-continued

1st Tier

| gRNA Name | DNA Strand | Targeting Domain | Target Site Length | Seq ID |
|---|---|---|---|---|
| CFTR-Intron10-130 | − | GUUGUUAUCUCUGAAAUUUU | 20 | 19016 |
| CFTR-Intron10-131 | + | GGGCUCCCCCACCCAAUUUU | 20 | 19017 |

Table 40B provides exemplary targeting domains for correcting a mutation (e.g., 3272-26→G) in the CFTR gene selected according to the second tier parameters. The targeting domains bind within intron 10 and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 40B

2nd Tier

| gRNA Name | DNA Strand | Targeting Domain | Target Site Length | Seq ID |
|---|---|---|---|---|
| CFTR-Intron10-132 | + | AGCUAUGCCCUUAAAAA | 17 | 19018 |
| CFTR-Intron10-133 | − | AUCAUCUAGGCUGCAAA | 17 | 19019 |
| CFTR-Intron10-134 | − | ACCUUCAUGUUGAUAAA | 17 | 19020 |
| CFTR-Intron10-135 | + | UUCCUAAUACUACUAAA | 17 | 19021 |
| CFTR-Intron10-136 | − | UAUUAGAAUGGGCUAAA | 17 | 19022 |
| CFTR-Intron10-137 | + | UCACGUGGUGUUUUAAA | 17 | 19023 |
| CFTR-Intron10-138 | + | UACCAUUAUCUACACAA | 17 | 19024 |
| CFTR-Intron10-139 | − | AUUCUGUAGGGAGACAA | 17 | 19025 |
| CFTR-Intron10-140 | − | ACUAAAUAAGUUAGCAA | 17 | 19026 |
| CFTR-Intron10-141 | + | AGCCAGCUUUCAGUCAA | 17 | 19027 |
| CFTR-Intron10-142 | − | UGUUGAUAAAGGGUCAA | 17 | 19028 |
| CFTR-Intron10-143 | − | ACUGAUGUCAAGCAGAA | 17 | 19029 |
| CFTR-Intron10-144 | − | UUUAGUAGUAUUAGGAA | 17 | 19030 |
| CFTR-Intron10-145 | − | UAAGAAAGACUCCUGAA | 17 | 19031 |
| CFTR-Intron10-146 | + | AAGCAAAGAGUGCAUAA | 17 | 19032 |
| CFTR-Intron10-147 | − | ACCCAUUGUGUAGAUAA | 17 | 19033 |
| CFTR-Intron10-148 | − | AACCUUCAUGUUGAUAA | 17 | 19034 |
| CFTR-Intron10-149 | − | UUGGUGUAGUUCUAUAA | 17 | 19035 |
| CFTR-Intron10-150 | − | UGUAGGGGUUAGCCUAA | 17 | 19036 |
| CFTR-Intron10-151 | + | AUAAGUGUGGAGUGUAA | 17 | 19037 |
| CFTR-Intron10-152 | − | AGAUCCAAUAGGAUUAA | 17 | 19038 |
| CFTR-Intron10-153 | + | UCAACUUUAUCUGUUAA | 17 | 19039 |
| CFTR-Intron10-154 | + | UACCUUUCAAUGUUUAA | 17 | 19040 |
| CFTR-Intron10-155 | − | UAGCAAUGGUCUAAACA | 17 | 19041 |
| CFTR-Intron10-156 | + | ACAAUCAAAUGGGAACA | 17 | 19042 |
| CFTR-Intron10-157 | + | ACCUAUAAGGAAUAACA | 17 | 19043 |
| CFTR-Intron10-158 | − | UGGCAUAGAGUAAGACA | 17 | 19044 |

TABLE 40B-continued

2nd Tier

| gRNA Name | DNA Strand | Targeting Domain | Target Site Length | Seq ID |
|---|---|---|---|---|
| CFTR-Intron10-159 | − | UAUUCUGUAGGGAGACA | 17 | 19045 |
| CFTR-Intron10-160 | + | UUACAAUUCUUAUUACA | 17 | 19046 |
| CFTR-Intron10-161 | − | AUUCCCUCAUCCAACCA | 17 | 19047 |
| CFTR-Intron10-162 | + | UAAAGACUUCACCCUCA | 17 | 19048 |
| CFTR-Intron10-163 | + | AAGCCAGCUUUCAGUCA | 17 | 19049 |
| CFTR-Intron10-164 | + | AUCUAAAAGCUAAUUCA | 17 | 19050 |
| CFTR-Intron10-165 | + | UUGCUUGAUGUUAUUCA | 17 | 19051 |
| CFTR-Intron10-166 | − | UCUAGUUUCAAGGAAGA | 17 | 19052 |
| CFTR-Intron10-167 | − | AACUGAUGUCAAGCAGA | 17 | 19053 |
| CFTR-Intron10-168 | − | AGUGCAAAGCUUUCAGA | 17 | 19054 |
| CFTR-Intron10-169 | + | ACCCUUUAUCAACAUGA | 17 | 19055 |
| CFTR-Intron10-170 | + | CUACCUUGGUUGGAUGA | 17 | 19056 |
| CFTR-Intron10-171 | − | AUGAAAAGCAGCUAUGA | 17 | 19057 |
| CFTR-Intron10-172 | − | UUAAGAAUGACUGUGA | 17 | 19058 |
| CFTR-Intron10-173 | − | CGGUGUCUUCUGAAAUA | 17 | 19059 |
| CFTR-Intron10-174 | + | CUAGAUGAUUAUUAAUA | 17 | 19060 |
| CFTR-Intron10-175 | − | ACUAAUUGUAGUACAUA | 17 | 19061 |
| CFTR-Intron10-176 | + | AAAUUACAGAACCUAUA | 17 | 19062 |
| CFTR-Intron10-177 | − | UGAUCAUUGCCUCACUA | 17 | 19063 |
| CFTR-Intron10-178 | − | AGUGCUCGUAAAGACUA | 17 | 19064 |
| CFTR-Intron10-179 | − | UGACCUAAGAUAUCCUA | 17 | 19065 |
| CFTR-Intron10-180 | − | AAUCGGCGGUGGAGGUA | 17 | 19066 |
| CFTR-Intron10-181 | + | ACUCUAUUUAGAGUGUA | 17 | 19067 |
| CFTR-Intron10-182 | + | AGGUUAAGUUGUUCUUA | 17 | 19068 |
| CFTR-Intron10-183 | + | UAUCAACAUGAAGGUUA | 17 | 19069 |
| CFTR-Intron10-184 | − | CUAAGUAUUAGAGGUUA | 17 | 19070 |
| CFTR-Intron10-185 | + | CUAUUAUUCAACAUUUA | 17 | 19071 |
| CFTR-Intron10-186 | + | UCUUUACGAGCACUUUA | 17 | 19072 |
| CFTR-Intron10-187 | + | CAAGCCUGUAUUGUUUA | 17 | 19073 |
| CFTR-Intron10-188 | + | CUUACCGUAAUAGCAAC | 17 | 19074 |
| CFTR-Intron10-189 | + | UCAUCACUUGCCUGAAC | 17 | 19075 |
| CFTR-Intron10-190 | + | AACCUAUAAGGAAUAAC | 17 | 19076 |
| CFTR-Intron10-191 | − | CUUAUUCUUGUAAUAAC | 17 | 19077 |
| CFTR-Intron10-192 | − | UUUCUGGACUGAGUAAC | 17 | 19078 |
| CFTR-Intron10-193 | + | UGAACUCCCCACACAC | 17 | 19079 |
| CFTR-Intron10-194 | + | CGUAUUUCAGAAGACAC | 17 | 19080 |
| CFTR-Intron10-195 | − | CAUUUCAACUUAUACAC | 17 | 19081 |
| CFTR-Intron10-196 | − | UUCUGUUUAAAUAGCAC | 17 | 19082 |

TABLE 40B-continued

| | | 2nd Tier | | |
|---|---|---|---|---|
| gRNA Name | DNA Strand | Targeting Domain | Target Site Length | Seq ID |
| CFTR-Intron10-197 | − | AUAGAAUUUUGCAUCAC | 17 | 19083 |
| CFTR-Intron10-198 | − | CUGGCAUAGAGUAAGAC | 17 | 19084 |
| CFTR-Intron10-199 | + | UGUUCUUCAAACCAGAC | 17 | 19085 |
| CFTR-Intron10-200 | − | AGUGCCUAGCACUUGAC | 17 | 19086 |
| CFTR-Intron10-201 | + | UACAACAGUCUUUAUAC | 17 | 19087 |
| CFTR-Intron10-202 | − | CAAAUUCCAAGACUUAC | 17 | 19088 |
| CFTR-Intron10-203 | − | CUAAGAACAACUUAACC | 17 | 19089 |
| CFTR-Intron10-204 | + | CUACUUCCACUACUACC | 17 | 19090 |
| CFTR-Intron10-205 | − | CUAACACCUACCCUACC | 17 | 19091 |
| CFTR-Intron10-206 | + | UUACUGUGAAUGGUGCC | 17 | 19092 |
| CFTR-Intron10-207 | − | ACCAAGGUAGCCAAUCC | 17 | 19093 |
| CFTR-Intron10-208 | + | AAGAGACUCCUGAAUCC | 17 | 19094 |
| CFTR-Intron10-209 | + | UAUAGCUCUGAUAAUCC | 17 | 19095 |
| CFTR-Intron10-210 | − | AAGACAGCUGGCUAUCC | 17 | 19096 |
| CFTR-Intron10-211 | + | AUUAGCAAGUGGACUCC | 17 | 19097 |
| CFTR-Intron10-212 | − | UUCUUUUGAUAUACUCC | 17 | 19098 |
| CFTR-Intron10-213 | − | UGCCCUUGACUGAAAGC | 17 | 19099 |
| CFTR-Intron10-214 | − | UAAAUUUGGUGUCAGGC | 17 | 19100 |
| CFTR-Intron10-215 | − | UAGUGUGAAGAUGGGGC | 17 | 19101 |
| CFTR-Intron10-216 | + | UCAUGUUAGACAUAUGC | 17 | 19102 |
| CFTR-Intron10-217 | + | CAAGACUUCACACCUGC | 17 | 19103 |
| CFTR-Intron10-218 | − | AGCAGACCCAAAUCUGC | 17 | 19104 |
| CFTR-Intron10-219 | + | AUUUAUCUCGAAAUUGC | 17 | 19105 |
| CFTR-Intron10-220 | + | UUAGUAGAAACCUAAUC | 17 | 19106 |
| CFTR-Intron10-221 | − | UUAGGGAAUGCAGACUC | 17 | 19107 |
| CFTR-Intron10-222 | − | AGCUGUGCAUUUUCCUC | 17 | 19108 |
| CFTR-Intron10-223 | − | ACUAAGGCUUAUUUCUC | 17 | 19109 |
| CFTR-Intron10-224 | − | UAACUUUUCUUAUUGUC | 17 | 19110 |
| CFTR-Intron10-225 | − | ACCAAAACUUUAUUGUC | 17 | 19111 |
| CFTR-Intron10-226 | − | CUGGCUAUCCAGGAUUC | 17 | 19112 |
| CFTR-Intron10-227 | + | UGACAUCAGUUGGGUUC | 17 | 19113 |
| CFTR-Intron10-228 | + | UCAAUUGUAUUAGCAAG | 17 | 19114 |
| CFTR-Intron10-229 | − | AGUAGGCUUCCUAUAAG | 17 | 19115 |
| CFTR-Intron10-230 | + | UUAACCCAUCUAUUAAG | 17 | 19116 |
| CFTR-Intron10-231 | + | UAUUGGACCAGACACAG | 17 | 19117 |
| CFTR-Intron10-232 | − | CUAGUUUCAAGGAAGAG | 17 | 19118 |
| CFTR-Intron10-233 | + | UACCAAAUUGUAUUGAG | 17 | 19119 |

TABLE 40B-continued

2nd Tier

| gRNA Name | DNA Strand | Targeting Domain | Target Site Length | Seq ID |
|---|---|---|---|---|
| CFTR-Intron10-234 | + | ACACCAAAUUUAUUGAG | 17 | 19120 |
| CFTR-Intron10-235 | + | AAAGUUGUCCAAGAUAG | 17 | 19121 |
| CFTR-Intron10-236 | + | UUUCCGUGCAUCACUAG | 17 | 19122 |
| CFTR-Intron10-237 | − | CUUGAUCCAGGUAGUAG | 17 | 19123 |
| CFTR-Intron10-238 | − | AUCGGCGGUGGAGGUAG | 17 | 19124 |
| CFTR-Intron10-239 | − | AAGAGAAAGGGGUGUAG | 17 | 19125 |
| CFTR-Intron10-240 | − | UCUCUGGGUGAGAUUAG | 17 | 19126 |
| CFTR-Intron10-241 | + | AUCAACAUGAAGGUUAG | 17 | 19127 |
| CFTR-Intron10-242 | − | UGUGAGAAAAAGUUUAG | 17 | 19128 |
| CFTR-Intron10-243 | − | AAAUCAGUGCUUUUUCG | 17 | 19129 |
| CFTR-Intron10-244 | + | CAAUAAUAGAGACAAGG | 17 | 19130 |
| CFTR-Intron10-245 | − | AGUAUUAGAGGUUAAGG | 17 | 19131 |
| CFTR-Intron10-246 | − | UUCAACUUAUACACAGG | 17 | 19132 |
| CFTR-Intron10-247 | − | AUUAGAGGUUAAGGAGG | 17 | 19133 |
| CFTR-Intron10-248 | − | UACUAACUCAAUCUAGG | 17 | 19134 |
| CFTR-Intron10-249 | − | UCGGCGGUGGAGGUAGG | 17 | 19135 |
| CFTR-Intron10-250 | − | AGAGAAGUAAUCGGCGG | 17 | 19136 |
| CFTR-Intron10-251 | − | CAUAGAGUAAGACAGGG | 17 | 19137 |
| CFTR-Intron10-252 | + | UUAAGUUGUUCUUAGGG | 17 | 19138 |
| CFTR-Intron10-253 | − | AGGAGCCAAAAAUUGGG | 17 | 19139 |
| CFTR-Intron10-254 | − | AGCCAAAAAUUGGGUGG | 17 | 19140 |
| CFTR-Intron10-255 | − | CUGGUAGUGUGAAGAUG | 17 | 19141 |
| CFTR-Intron10-256 | − | UAUCAAUAUCUAAGAUG | 17 | 19142 |
| CFTR-Intron10-257 | + | AUCUGUUAGUAAUGCUG | 17 | 19143 |
| CFTR-Intron10-258 | − | UUAAGGGCAUAGCUCUG | 17 | 19144 |
| CFTR-Intron10-259 | + | AACUCAGUACCAUAGUG | 17 | 19145 |
| CFTR-Intron10-260 | + | CUGUUAGUAAUGCUGUG | 17 | 19146 |
| CFTR-Intron10-261 | − | CAUCUCACCAGUGUGUG | 17 | 19147 |
| CFTR-Intron10-262 | − | CUCUCUUUUAACUAUUG | 17 | 19148 |
| CFTR-Intron10-263 | + | UGAGUGGAAAUUUUUUG | 17 | 19149 |
| CFTR-Intron10-264 | − | UUUCAGGAGCCAAAAAU | 17 | 19150 |
| CFTR-Intron10-265 | + | ACCAUUAUCUACACAAU | 17 | 19151 |
| CFTR-Intron10-266 | − | AUGGGCUAAAGGGCAAU | 17 | 19152 |
| CFTR-Intron10-267 | − | CUUUCUAGUAUUAGAAU | 17 | 19153 |
| CFTR-Intron10-268 | + | AUGGCAUGAGUACGAAU | 17 | 19154 |
| CFTR-Intron10-269 | + | CCUAGAUGAUUAUUAAU | 17 | 19155 |
| CFTR-Intron10-270 | − | UUUUCCUCUUAAUAGAU | 17 | 19156 |
| CFTR-Intron10-271 | + | AAAAAGUUACCUGGAU | 17 | 19157 |

TABLE 40B-continued

| | | 2nd Tier | | |
|---|---|---|---|---|
| gRNA Name | DNA Strand | Targeting Domain | Target Site Length | Seq ID |
| CFTR-Intron10-272 | + | UUAUCCAUUAAUCCUAU | 17 | 19158 |
| CFTR-Intron10-273 | + | AAUGCUUGACCACUUAU | 17 | 19159 |
| CFTR-Intron10-274 | - | UCCCUGUUAUUCCUUAU | 17 | 19160 |
| CFTR-Intron10-275 | + | ACAACAGUCUUUAUACU | 17 | 19161 |
| CFTR-Intron10-276 | + | UUGCUUCACCUGCUACU | 17 | 19162 |
| CFTR-Intron10-277 | + | AUCUUAUAGAGAUUACU | 17 | 19163 |
| CFTR-Intron10-278 | + | UUUUGAGCCUAUCACCU | 17 | 19164 |
| CFTR-Intron10-279 | + | ACCUGGAUUGGCUACCU | 17 | 19165 |
| CFTR-Intron10-280 | + | CACUUGUUGACAGUCCU | 17 | 19166 |
| CFTR-Intron10-281 | + | ACUCAGUCCAGAAAGCU | 17 | 19167 |
| CFTR-Intron10-282 | + | ACUCAUAAGGGACCGCU | 17 | 19168 |
| CFTR-Intron10-283 | - | AAAUUUGGUGUCAGGCU | 17 | 19169 |
| CFTR-Intron10-284 | + | AGCCUAUCACCUAGGCU | 17 | 19170 |
| CFTR-Intron10-285 | + | UAUACCUGUCAAGUGCU | 17 | 19171 |
| CFTR-Intron10-286 | - | CCUAUUAAUAAUCAUCU | 17 | 19172 |
| CFTR-Intron10-287 | - | UAGGGAAUGCAGACUCU | 17 | 19173 |
| CFTR-Intron10-288 | + | UAGAGAGAAACAUCUCU | 17 | 19174 |
| CFTR-Intron10-289 | - | CUAAGGCUUAUUUCUCU | 17 | 19175 |
| CFTR-Intron10-290 | + | UAAUUGCCAGUAAGUCU | 17 | 19176 |
| CFTR-Intron10-291 | + | AUUUUCUCGGUAUUUCU | 17 | 19177 |
| CFTR-Intron10-292 | - | AUUUUUGACUAUACAGU | 17 | 19178 |
| CFTR-Intron10-293 | + | UUCUGCUUGACAUCAGU | 17 | 19179 |
| CFTR-Intron10-294 | + | ACCAAAUUGUAUUGAGU | 17 | 19180 |
| CFTR-Intron10-295 | + | AAGUUGUCCAAGAUAGU | 17 | 19181 |
| CFTR-Intron10-296 | - | CAAAUAGAGAUGUUAGU | 17 | 19182 |
| CFTR-Intron10-297 | + | UGUGAAUGGUGCCAGGU | 17 | 19183 |
| CFTR-Intron10-298 | - | UAAUCGGCGGUGGAGGU | 17 | 19184 |
| CFTR-Intron10-299 | - | UGAUGGUAUUGCAGGGU | 17 | 19185 |
| CFTR-Intron10-300 | + | AUGGUGCCAGGUAGGGU | 17 | 19186 |
| CFTR-Intron10-301 | + | UAAGUUGUUCUUAGGGU | 17 | 19187 |
| CFTR-Intron10-302 | - | UUGACUAUACAGUGGGU | 17 | 19188 |
| CFTR-Intron10-303 | + | AAAGCUGUUUCGUAUGU | 17 | 19189 |
| CFTR-Intron10-304 | + | UCUGUUAGUAAUGCUGU | 17 | 19190 |
| CFTR-Intron10-305 | - | AGCAGUGCUGCUGCUGU | 17 | 19191 |
| CFTR-Intron10-306 | - | UUUUUAGGCUAUUCUGU | 17 | 19192 |
| CFTR-Intron10-307 | - | UUCAGGAGCCAAAAAUU | 17 | 19193 |
| CFTR-Intron10-308 | - | ACCCACUCAAUACAAUU | 17 | 19194 |

TABLE 40B-continued

2nd Tier

| gRNA Name | DNA Strand | Targeting Domain | Target Site Length | Seq ID |
|---|---|---|---|---|
| CFTR-Intron10-309 | − | AUGCUAAUAAUACAAUU | 17 | 19195 |
| CFTR-Intron10-310 | − | AAUAUCACCAACUCAUU | 17 | 19196 |
| CFTR-Intron10-311 | + | AUCUCUGCAAACAUAUU | 17 | 19197 |
| CFTR-Intron10-312 | − | ACUUAACCUGGCAUAUU | 17 | 19198 |
| CFTR-Intron10-313 | + | CAACUAACAUCUCUAUU | 17 | 19199 |
| CFTR-Intron10-314 | − | UGCCUUUUAGUAGUAUU | 17 | 19200 |
| CFTR-Intron10-315 | + | CAAUGGUUGUCUGUAUU | 17 | 19201 |
| CFTR-Intron10-316 | + | AUACUUAGAAUGCCCUU | 17 | 19202 |
| CFTR-Intron10-317 | − | UUGCAGGGUGGGGCCUU | 17 | 19203 |
| CFTR-Intron10-318 | − | AUGUGCAAAAAUAGCUU | 17 | 19204 |
| CFTR-Intron10-319 | + | CAGGUUAAGUUGUUCUU | 17 | 19205 |
| CFTR-Intron10-320 | − | UUAGUUAGCAUAAAGUU | 17 | 19206 |
| CFTR-Intron10-321 | + | UCUGCUUGACAUCAGUU | 17 | 19207 |
| CFTR-Intron10-322 | + | UUAUCAACAUGAAGGUU | 17 | 19208 |
| CFTR-Intron10-323 | − | AGUGCUUUUUCGAGGUU | 17 | 19209 |
| CFTR-Intron10-324 | − | UUGGAUGGAGCUUGGUU | 17 | 19210 |
| CFTR-Intron10-325 | + | UUCAUGGAAAGCUUGUU | 17 | 19211 |
| CFTR-Intron10-326 | − | UUGUGUACUUGUGAUUU | 17 | 19212 |
| CFTR-Intron10-327 | − | UAUGCACUCUUUGCUUU | 17 | 19213 |
| CFTR-Intron10-328 | + | UCCUGACAAUAAAGUUU | 17 | 19214 |
| CFTR-Intron10-329 | − | UGGAUGGAGCUUGGUUU | 17 | 19215 |
| CFTR-Intron10-330 | − | AGAGCUAUAUUGUGUUU | 17 | 19216 |
| CFTR-Intron10-331 | + | CUCCCCCACCCAAUUUU | 17 | 19217 |
| CFTR-Intron10-332 | + | CAGAGCUAUGCCCUUAAAAA | 20 | 19218 |
| CFTR-Intron10-333 | − | UGCUUCAGAAGUCUAUAAAA | 20 | 19219 |
| CFTR-Intron10-334 | − | AUAAUCAUCUAGGCUGCAAA | 20 | 19220 |
| CFTR-Intron10-335 | + | CAGCUAAAAUGACAAUCAAA | 20 | 19221 |
| CFTR-Intron10-336 | − | CGUGUUAUUCAGCCAAUAAA | 20 | 19222 |
| CFTR-Intron10-337 | − | CUAACCUUCAUGUUGAUAAA | 20 | 19223 |
| CFTR-Intron10-338 | + | CCAUUCCUAAUACUACUAAA | 20 | 19224 |
| CFTR-Intron10-339 | − | UAGUAUUAGAAUGGGCUAAA | 20 | 19225 |
| CFTR-Intron10-340 | + | CCCAUUAUCUUUCUAGUAAA | 20 | 19226 |
| CFTR-Intron10-341 | − | UUAAUGGAUAAGUUGAACAA | 20 | 19227 |
| CFTR-Intron10-342 | + | UUUUACCAUUAUCUACACAA | 20 | 19228 |
| CFTR-Intron10-343 | − | CUAGGUUUAAUUUGUACAA | 20 | 19229 |
| CFTR-Intron10-344 | + | AAGUGUUUAAAUAUUCCCAA | 20 | 19230 |
| CFTR-Intron10-345 | + | UCAAAAGAAUAAGGCAUCAA | 20 | 19231 |
| CFTR-Intron10-346 | + | AUAAGCCAGCUUUCAGUCAA | 20 | 19232 |

TABLE 40B-continued

| | | 2nd Tier | | |
|---|---|---|---|---|
| gRNA Name | DNA Strand | Targeting Domain | Target Site Length | Seq ID |
| CFTR-Intron10-347 | − | CCAACUGAUGUCAAGCAGAA | 20 | 19233 |
| CFTR-Intron10-348 | − | AGAGCUUUCUAGUAUUAGAA | 20 | 19234 |
| CFTR-Intron10-349 | + | CUAAAACUGAGUAGAAGGAA | 20 | 19235 |
| CFTR-Intron10-350 | − | CCUUUUAGUAGUAUUAGGAA | 20 | 19236 |
| CFTR-Intron10-351 | − | AAUUAAGAAAGACUCCUGAA | 20 | 19237 |
| CFTR-Intron10-352 | − | AGUGGCCUUUAAACAUUGAA | 20 | 19238 |
| CFTR-Intron10-353 | − | AAUGUAGUAUUAAACCAUAA | 20 | 19239 |
| CFTR-Intron10-354 | + | CUAAAGCAAAGAGUGCAUAA | 20 | 19240 |
| CFTR-Intron10-355 | − | AUAACCCAUUGUGUAGAUAA | 20 | 19241 |
| CFTR-Intron10-356 | − | CCUAACCUUCAUGUUGAUAA | 20 | 19242 |
| CFTR-Intron10-357 | − | AUUUGGUGUAGUUCUAUAA | 20 | 19243 |
| CFTR-Intron10-358 | − | UUUGACCUAAGAUAUCCUAA | 20 | 19244 |
| CFTR-Intron10-359 | − | CUAGUAUUAGAAUGGGCUAA | 20 | 19245 |
| CFTR-Intron10-360 | + | UUGGGUAACAAUAAUAUUAA | 20 | 19246 |
| CFTR-Intron10-361 | + | AAUUCAACUUUAUCUGUUAA | 20 | 19247 |
| CFTR-Intron10-362 | − | AGUUAGCAAUGGUCUAAACA | 20 | 19248 |
| CFTR-Intron10-363 | + | AUGACAAUCAAAUGGGAACA | 20 | 19249 |
| CFTR-Intron10-364 | + | AGAACCUAUAAGGAAUAACA | 20 | 19250 |
| CFTR-Intron10-365 | − | AGUUUUAAACAGAAGUAACA | 20 | 19251 |
| CFTR-Intron10-366 | − | UGCAUUCCCUCAUCCAACCA | 20 | 19252 |
| CFTR-Intron10-367 | + | UACUAAAGACUUCACCCUCA | 20 | 19253 |
| CFTR-Intron10-368 | + | CAUAAGCCAGCUUUCAGUCA | 20 | 19254 |
| CFTR-Intron10-369 | + | UAAAUCUAAAAGCUAAUUCA | 20 | 19255 |
| CFTR-Intron10-370 | + | ACGAAUUGGUACAAAUUUCA | 20 | 19256 |
| CFTR-Intron10-371 | − | AUAAGAUUCUAAAGGAAAGA | 20 | 19257 |
| CFTR-Intron10-372 | − | AAGUCUAGUUUCAAGGAAGA | 20 | 19258 |
| CFTR-Intron10-373 | − | CCCAACUGAUGUCAAGCAGA | 20 | 19259 |
| CFTR-Intron10-374 | + | ACUGACUAAAACUGAGUAGA | 20 | 19260 |
| CFTR-Intron10-375 | + | UGGCUACCUUGGUUGGAUGA | 20 | 19261 |
| CFTR-Intron10-376 | − | CCAGUUCAGGCAAGUGAUGA | 20 | 19262 |
| CFTR-Intron10-377 | − | CUUAUGAAAAGCAGCUAUGA | 20 | 19263 |
| CFTR-Intron10-378 | − | UUGUUAAAGAAUGACUGUGA | 20 | 19264 |
| CFTR-Intron10-379 | + | AGGGUCUCUCUAAGGUGUGA | 20 | 19265 |
| CFTR-Intron10-380 | − | AACCGGUGUCUUCUGAAAUA | 20 | 19266 |
| CFTR-Intron10-381 | + | AGGAGUAUAUCAAAAGAAUA | 20 | 19267 |
| CFTR-Intron10-382 | + | AGUCCUCUGUGCUUUGAAUA | 20 | 19268 |
| CFTR-Intron10-383 | − | CCCAUAAAUGUUGAAUAAUA | 20 | 19269 |

TABLE 40B-continued

| | | 2nd Tier | | |
|---|---|---|---|---|
| gRNA Name | DNA Strand | Targeting Domain | Target Site Length | Seq ID |
| CFTR-Intron10-384 | + | AGCCUAGAUGAUUAUUAAUA | 20 | 19270 |
| CFTR-Intron10-385 | − | UAUUGAUCAUUGCCUCACUA | 20 | 19271 |
| CFTR-Intron10-386 | − | UAAAGUGCUCGUAAAGACUA | 20 | 19272 |
| CFTR-Intron10-387 | − | CUUUGACCUAAGAUAUCCUA | 20 | 19273 |
| CFTR-Intron10-388 | + | UGAGCCUAUCACCUAGGCUA | 20 | 19274 |
| CFTR-Intron10-389 | − | AGUAAUCGGCGGUGGAGGUA | 20 | 19275 |
| CFTR-Intron10-390 | − | UGUUUUUAGGCUAUUCUGUA | 20 | 19276 |
| CFTR-Intron10-391 | + | AGCACUCUAUUUAGAGUGUA | 20 | 19277 |
| CFTR-Intron10-392 | − | UAAGAAGAGAAAGGGGUGUA | 20 | 19278 |
| CFTR-Intron10-393 | + | CAAUUAGUUUUAUGCCAUUA | 20 | 19279 |
| CFTR-Intron10-394 | − | UUGCAGGAGGUGAGGGAUUA | 20 | 19280 |
| CFTR-Intron10-395 | − | CUUGACUGAAAGCUGGCUUA | 20 | 19281 |
| CFTR-Intron10-396 | + | CUUUAUCAACAUGAAGGUUA | 20 | 19282 |
| CFTR-Intron10-397 | − | AUUCUAAGUAUUAGAGGUUA | 20 | 19283 |
| CFTR-Intron10-398 | + | CCCCUAUUAUUCAACAUUUA | 20 | 19284 |
| CFTR-Intron10-399 | + | UAGUCUUUACGAGCACUUUA | 20 | 19285 |
| CFTR-Intron10-400 | − | AGAAAGAUAAUGGGAGAAAC | 20 | 19286 |
| CFTR-Intron10-401 | + | UACGAUAUAAGAAAUGAAAC | 20 | 19287 |
| CFTR-Intron10-402 | + | UUCGUAUGUAGGAAAACAAC | 20 | 19288 |
| CFTR-Intron10-403 | + | CAGAACCUAUAAGGAAUAAC | 20 | 19289 |
| CFTR-Intron10-404 | − | UAGCUUAUUCUUGUAAUAAC | 20 | 19290 |
| CFTR-Intron10-405 | − | AUGAAACUGUUAUAAUUAAC | 20 | 19291 |
| CFTR-Intron10-406 | + | CUCCGUAUUUCAGAAGACAC | 20 | 19292 |
| CFTR-Intron10-407 | − | UAUCAUUUCAACUUAUACAC | 20 | 19293 |
| CFTR-Intron10-408 | + | UUAGUAUUAAGUAUAGCCAC | 20 | 19294 |
| CFTR-Intron10-409 | − | UGGGUGAGAUUAGAGGCCAC | 20 | 19295 |
| CFTR-Intron10-410 | − | UGAUUCUGUUUAAAUAGCAC | 20 | 19296 |
| CFTR-Intron10-411 | − | AGUAUAGAAUUUUGCAUCAC | 20 | 19297 |
| CFTR-Intron10-412 | − | AGGCUGGCAUAGAGUAAGAC | 20 | 19298 |
| CFTR-Intron10-413 | + | UACUGUUCUUCAAACCAGAC | 20 | 19299 |
| CFTR-Intron10-414 | + | UGUUACAACAGUCUUUAUAC | 20 | 19300 |
| CFTR-Intron10-415 | − | AUUGAUGAGCAGAUAAUUAC | 20 | 19301 |
| CFTR-Intron10-416 | − | UUACAAAUUCCAAGACUUAC | 20 | 19302 |
| CFTR-Intron10-417 | + | UACAAAUAUUGACUAUUUAC | 20 | 19303 |
| CFTR-Intron10-418 | − | ACCCUAAGAACAACUUAACC | 20 | 19304 |
| CFTR-Intron10-419 | + | AUACUACUUCCACUACUACC | 20 | 19305 |
| CFTR-Intron10-420 | − | ACACUAACACCUACCCUACC | 20 | 19306 |
| CFTR-Intron10-421 | + | AGAUACUAAAAAAAGUUACC | 20 | 19307 |

TABLE 40B-continued

2nd Tier

| gRNA Name | DNA Strand | Targeting Domain | Target Site Length | Seq ID |
|---|---|---|---|---|
| CFTR-Intron10-422 | + | UCUUUACUGUGAAUGGUGCC | 20 | 19308 |
| CFTR-Intron10-423 | − | CCAACCAAGGUAGCCAAUCC | 20 | 19309 |
| CFTR-Intron10-424 | + | CAAUAUAGCUCUGAUAAUCC | 20 | 19310 |
| CFTR-Intron10-425 | − | AGUGAAUGAAUGUGGUAUCC | 20 | 19311 |
| CFTR-Intron10-426 | + | UGUAUUAGCAAGUGGACUCC | 20 | 19312 |
| CFTR-Intron10-427 | + | CUUGACAUCAGUUGGGUUCC | 20 | 19313 |
| CFTR-Intron10-428 | − | AGUAAGGAGGUCACUGAGGC | 20 | 19314 |
| CFTR-Intron10-429 | − | AGUUUCAAGGAAGAGGGGGC | 20 | 19315 |
| CFTR-Intron10-430 | − | UGGUAGUGUGAAGAUGGGGC | 20 | 19316 |
| CFTR-Intron10-431 | + | UUGGUUGGAUGAGGGAAUGC | 20 | 19317 |
| CFTR-Intron10-432 | + | UUUUCAUGUUAGACAUAUGC | 20 | 19318 |
| CFTR-Intron10-433 | + | AGUGCUAUUUAAACAGAAUC | 20 | 19319 |
| CFTR-Intron10-434 | − | AAAAGCUGUGCAUUUUCCUC | 20 | 19320 |
| CFTR-Intron10-435 | − | AAGACUAAGGCUUAUUUCUC | 20 | 19321 |
| CFTR-Intron10-436 | − | UGGGACUGACUAUACCUGUC | 20 | 19322 |
| CFTR-Intron10-437 | + | AAUAGAGACAAGGUGGUGUC | 20 | 19323 |
| CFTR-Intron10-438 | − | CACUCAAUAAAUUUGGUGUC | 20 | 19324 |
| CFTR-Intron10-439 | − | UUCUAACUUUUCUUAUUGUC | 20 | 19325 |
| CFTR-Intron10-440 | − | AGGACCAAAACUUUAUUGUC | 20 | 19326 |
| CFTR-Intron10-441 | − | CAGCUGGCUAUCCAGGAUUC | 20 | 19327 |
| CFTR-Intron10-442 | + | UAUUAAGAGGAAAAGACUUC | 20 | 19328 |
| CFTR-Intron10-443 | + | UACGAAUUGGUACAAAUUUC | 20 | 19329 |
| CFTR-Intron10-444 | − | CUUACUGGCAAUUAAAUUUC | 20 | 19330 |
| CFTR-Intron10-445 | + | UUGAUAAAUAAUUGCCUUUC | 20 | 19331 |
| CFTR-Intron10-446 | + | CCUAAAAACAUUAGCCAAAG | 20 | 19332 |
| CFTR-Intron10-447 | + | UAGGAUAUCUUAGGUCAAAG | 20 | 19333 |
| CFTR-Intron10-448 | + | UAGGGUGGGAUAUGGAGAAG | 20 | 19334 |
| CFTR-Intron10-449 | − | CAAGUCUAGUUUCAAGGAAG | 20 | 19335 |
| CFTR-Intron10-450 | − | UUUCCAUAUUCAAAGCACAG | 20 | 19336 |
| CFTR-Intron10-451 | + | ACAGCUAAAGUAUUACCCAG | 20 | 19337 |
| CFTR-Intron10-452 | − | AGUCUAUAUUUGUUUUCCAG | 20 | 19338 |
| CFTR-Intron10-453 | + | UGCUAUUUAAACAGAAUCAG | 20 | 19339 |
| CFTR-Intron10-454 | + | AUAUUGUUACAUAAAAAGAG | 20 | 19340 |
| CFTR-Intron10-455 | − | AGUCUAGUUUCAAGGAAGAG | 20 | 19341 |
| CFTR-Intron10-456 | + | AAUUACCAAAUUGUAUUGAG | 20 | 19342 |
| CFTR-Intron10-457 | + | CUGACACCAAAUUUAUUGAG | 20 | 19343 |
| CFTR-Intron10-458 | − | CCAUAAAUGUUGAAUAAUAG | 20 | 19344 |

TABLE 40B-continued

2nd Tier

| gRNA Name | DNA Strand | Targeting Domain | Target Site Length | Seq ID |
|---|---|---|---|---|
| CFTR-Intron10-459 | + | UGGAAAGUUGUCCAAGAUAG | 20 | 19345 |
| CFTR-Intron10-460 | + | ACUUUUCCGUGCAUCACUAG | 20 | 19346 |
| CFTR-Intron10-461 | − | UGGCUUGAUCCAGGUAGUAG | 20 | 19347 |
| CFTR-Intron10-462 | − | AUUUCUCUGGGUGAGAUUAG | 20 | 19348 |
| CFTR-Intron10-463 | − | AAGGGCAUUCUAAGUAUUAG | 20 | 19349 |
| CFTR-Intron10-464 | − | AGCUAUGAAGGCAGAGUUAG | 20 | 19350 |
| CFTR-Intron10-465 | + | UUUAUCAACAUGAAGGUUAG | 20 | 19351 |
| CFTR-Intron10-466 | − | AUAAAAUCAGUGCUUUUUCG | 20 | 19352 |
| CFTR-Intron10-467 | − | CUAAGUAUUAGAGGUUAAGG | 20 | 19353 |
| CFTR-Intron10-468 | − | CAUUUCAACUUAUACACAGG | 20 | 19354 |
| CFTR-Intron10-469 | + | UUGUUACAUAAAAAGAGAGG | 20 | 19355 |
| CFTR-Intron10-470 | − | AGUAUUAGAGGUUAAGGAGG | 20 | 19356 |
| CFTR-Intron10-471 | − | UAAUCGGCGGUGGAGGUAGG | 20 | 19357 |
| CFTR-Intron10-472 | − | ACUGUCAGAGAAGUAAUCGG | 20 | 19358 |
| CFTR-Intron10-473 | − | AUUCUGUAGGGAGACAAGGG | 20 | 19359 |
| CFTR-Intron10-474 | − | UGGCAUAGAGUAAGACAGGG | 20 | 19360 |
| CFTR-Intron10-475 | + | AGGUUAAGUUGUUCUUAGGG | 20 | 19361 |
| CFTR-Intron10-476 | − | UUCAGGAGCCAAAAAUUGGG | 20 | 19362 |
| CFTR-Intron10-477 | − | AGAGAAGUAAUCGGCGGUGG | 20 | 19363 |
| CFTR-Intron10-478 | − | AGGAGCCAAAAAUUGGGUGG | 20 | 19364 |
| CFTR-Intron10-479 | − | ACAAAGCUAGUGAAUGAAUG | 20 | 19365 |
| CFTR-Intron10-480 | − | AUUUAUCAAUAUCUAAGAUG | 20 | 19366 |
| CFTR-Intron10-481 | + | UUGGCUACCUUGGUUGGAUG | 20 | 19367 |
| CFTR-Intron10-482 | + | CCUAUUAUUCAACAUUUAUG | 20 | 19368 |
| CFTR-Intron10-483 | + | CACGAAUAUAUUCUUUUAUG | 20 | 19369 |
| CFTR-Intron10-484 | − | UUUGAUUGUCAUUUUAGCUG | 20 | 19370 |
| CFTR-Intron10-485 | + | AUCAUCUGUUAGUAAUGCUG | 20 | 19371 |
| CFTR-Intron10-486 | − | UUUUUAAGGGCAUAGCUCUG | 20 | 19372 |
| CFTR-Intron10-487 | + | AAGGAAAUGGGGUAUAAGUG | 20 | 19373 |
| CFTR-Intron10-488 | + | UAAAACUCAGUACCAUAGUG | 20 | 19374 |
| CFTR-Intron10-489 | − | CAGGAGCCAAAAAUUGGGUG | 20 | 19375 |
| CFTR-Intron10-490 | + | CAUCUGUUAGUAAUGCUGUG | 20 | 19376 |
| CFTR-Intron10-491 | − | UAUGGCAUCUCACCAGUGUG | 20 | 19377 |
| CFTR-Intron10-492 | − | UGGCAUCUCACCAGUGUGUG | 20 | 19378 |
| CFTR-Intron10-493 | − | UACGGUAAGCUCAAGCAUUG | 20 | 19379 |
| CFTR-Intron10-494 | − | UUGGUAUUUACCAUAUAUUG | 20 | 19380 |
| CFTR-Intron10-495 | − | UUGCUCUCUUUUAACUAUUG | 20 | 19381 |
| CFTR-Intron10-496 | + | UAUUGAGUGGAAAUUUUUUG | 20 | 19382 |

TABLE 40B-continued

| | | 2nd Tier | | |
|---|---|---|---|---|
| gRNA Name | DNA Strand | Targeting Domain | Target Site Length | Seq ID |
| CFTR-Intron10-497 | − | UGCUUUCAGGAGCCAAAAAU | 20 | 19383 |
| CFTR-Intron10-498 | + | AGCUAAAAUGACAAUCAAAU | 20 | 19384 |
| CFTR-Intron10-499 | − | AGAAUGGGCUAAAGGGCAAU | 20 | 19385 |
| CFTR-Intron10-500 | + | UGUAUGGCAUGAGUACGAAU | 20 | 19386 |
| CFTR-Intron10-501 | − | CCGUUUACUAGAAAGAUAAU | 20 | 19387 |
| CFTR-Intron10-502 | − | AAUACUGUCAGAGAAGUAAU | 20 | 19388 |
| CFTR-Intron10-503 | + | CAGCCUAGAUGAUUAUUAAU | 20 | 19389 |
| CFTR-Intron10-504 | − | CAAGUGCAAAGCUUUCAGAU | 20 | 19390 |
| CFTR-Intron10-505 | + | CUAAAAAAGUUACCUGGAU | 20 | 19391 |
| CFTR-Intron10-506 | + | UCUUUGUGUUAACAAAAUAU | 20 | 19392 |
| CFTR-Intron10-507 | + | AACUUAUCCAUUAAUCCUAU | 20 | 19393 |
| CFTR-Intron10-508 | + | ACAAAUGCUUGACCACUUAU | 20 | 19394 |
| CFTR-Intron10-509 | + | CCCUAUUAUUCAACAUUUAU | 20 | 19395 |
| CFTR-Intron10-510 | + | UUCUUUAACAAACCUUUUAU | 20 | 19396 |
| CFTR-Intron10-511 | − | AGCUAUUCUUGUAAUAACU | 20 | 19397 |
| CFTR-Intron10-512 | + | CACUUGCUUCACCUGCUACU | 20 | 19398 |
| CFTR-Intron10-513 | + | AAAAUCUUAUAGAGAUUACU | 20 | 19399 |
| CFTR-Intron10-514 | + | UUUUUUUGAGCCUAUCACCU | 20 | 19400 |
| CFTR-Intron10-515 | − | AGAGGAAGGCAGUGGUCCCU | 20 | 19401 |
| CFTR-Intron10-516 | + | AGGCACUUGUUGACAGUCCU | 20 | 19402 |
| CFTR-Intron10-517 | − | AACAGGUUUUGGAUGGAGCU | 20 | 19403 |
| CFTR-Intron10-518 | + | AAAACUCAUAAGGGACCGCU | 20 | 19404 |
| CFTR-Intron10-519 | − | AAUAAAUUUGGUGUCAGGCU | 20 | 19405 |
| CFTR-Intron10-520 | + | UUGAGCCUAUCACCUAGGCU | 20 | 19406 |
| CFTR-Intron10-521 | − | UUCAAAUUAUUUCUACUGCU | 20 | 19407 |
| CFTR-Intron10-522 | + | UAAUAUACCUGUCAAGUGCU | 20 | 19408 |
| CFTR-Intron10-523 | − | UCCCCUAUUAAUAAUCAUCU | 20 | 19409 |
| CFTR-Intron10-524 | − | UCUUGCUUUCCCACUAUCU | 20 | 19410 |
| CFTR-Intron10-525 | − | AGACUAAGGCUUAUUUCUCU | 20 | 19411 |
| CFTR-Intron10-526 | + | AUUUAAUUGCCAGUAAGUCU | 20 | 19412 |
| CFTR-Intron10-527 | + | AAUAAUUUGAACAACAUUCU | 20 | 19413 |
| CFTR-Intron10-528 | − | UAUGUGAAAAUAUCACUUCU | 20 | 19414 |
| CFTR-Intron10-529 | + | CCCUUCUGCUUGACAUCAGU | 20 | 19415 |
| CFTR-Intron10-530 | + | AGUCAGUUUUAUUUUUCAGU | 20 | 19416 |
| CFTR-Intron10-531 | + | UGUACAUUUUCCUAAUGAGU | 20 | 19417 |
| CFTR-Intron10-532 | + | AUUACCAAAUUGUAUUGAGU | 20 | 19418 |
| CFTR-Intron10-533 | − | AGUAGUGGAAGUAGUAUAGU | 20 | 19419 |

TABLE 40B-continued

2nd Tier

| gRNA Name | DNA Strand | Targeting Domain | Target Site Length | Seq ID |
|---|---|---|---|---|
| CFTR-Intron10-534 | + | UACUGUGAAUGGUGCCAGGU | 20 | 19420 |
| CFTR-Intron10-535 | + | UGUUACAUAAAAAGAGAGGU | 20 | 19421 |
| CFTR-Intron10-536 | − | AAGUAAUCGGCGGUGGAGGU | 20 | 19422 |
| CFTR-Intron10-537 | − | UCAGGAGCCAAAAAUUGGGU | 20 | 19423 |
| CFTR-Intron10-538 | + | CCUGGAUUGGCUACCUUGGU | 20 | 19424 |
| CFTR-Intron10-539 | + | UUAAAAGCUGUUUCGUAUGU | 20 | 19425 |
| CFTR-Intron10-540 | + | UCAUCUGUUAGUAAUGCUGU | 20 | 19426 |
| CFTR-Intron10-541 | − | AUGUUUUUAGGCUAUUCUGU | 20 | 19427 |
| CFTR-Intron10-542 | − | AUGGCAUCUCACCAGUGUGU | 20 | 19428 |
| CFTR-Intron10-543 | − | CUUACCCACUCAAUACAAUU | 20 | 19429 |
| CFTR-Intron10-544 | − | AAAAAUAUCACCAACUCAUU | 20 | 19430 |
| CFTR-Intron10-545 | + | AAGAUCUCUGCAAACAUAUU | 20 | 19431 |
| CFTR-Intron10-546 | − | ACAACUUAACCUGGCAUAUU | 20 | 19432 |
| CFTR-Intron10-547 | + | AUCCAACUAACAUCUCUAUU | 20 | 19433 |
| CFTR-Intron10-548 | + | CAUCAAUGGUUGUCUGUAUU | 20 | 19434 |
| CFTR-Intron10-549 | − | CAGAAGUAACAGGGCCACUU | 20 | 19435 |
| CFTR-Intron10-550 | − | AUAGAUUAGCUUAUAUACUU | 20 | 19436 |
| CFTR-Intron10-551 | + | CUAAUACUUAGAAUGCCCUU | 20 | 19437 |
| CFTR-Intron10-552 | − | UAGAUGUGCAAAAAUAGCUU | 20 | 19438 |
| CFTR-Intron10-553 | + | UGCCAGGUUAAGUUGUUCUU | 20 | 19439 |
| CFTR-Intron10-554 | + | CCUUCUGCUUGACAUCAGUU | 20 | 19440 |
| CFTR-Intron10-555 | + | CCUUUAUCAACAUGAAGGUU | 20 | 19441 |
| CFTR-Intron10-556 | − | AUCAGUGCUUUUUCGAGGUU | 20 | 19442 |
| CFTR-Intron10-557 | + | UAAUUCAUGGAAAGCUUGUU | 20 | 19443 |
| CFTR-Intron10-558 | − | CAUUUGUGUACUUGUGAUUU | 20 | 19444 |
| CFTR-Intron10-559 | + | AGAUCUCUGCAAACAUAUUU | 20 | 19445 |
| CFTR-Intron10-560 | − | CUUUAUGCACUCUUUGCUUU | 20 | 19446 |
| CFTR-Intron10-561 | + | UUCUCCUGACAAUAAAGUUU | 20 | 19447 |
| CFTR-Intron10-562 | − | AUAAUGGGAGAAACAGGUUU | 20 | 19448 |
| CFTR-Intron10-563 | − | UUUUGGAUGGAGCUUGGUUU | 20 | 19449 |
| CFTR-Intron10-564 | − | AUCAGAGCUAUAUUGUGUUU | 20 | 19450 |
| CFTR-Intron10-565 | − | CCACUUUGGCUAAUGUUUUU | 20 | 19451 |

Table 40C provides exemplary targeting domains for correcting a mutation (e.g., 3272-26→G) in the CFTR gene selected according to the third tier parameters. The targeting domains bind within intron 10 and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 40C

3rd Tier

| gRNA Name | DNA Strand | Targeting Domain | Target Site Length | Seq ID |
|---|---|---|---|---|
| CFTR-Intron10-566 | + | GACCAUCCCGGCUAAAA | 17 | 19452 |
| CFTR-Intron10-567 | − | GUUGAUAAGAAGAGAAA | 17 | 19453 |
| CFTR-Intron10-568 | − | GAUGUUUAUUUAUGAAA | 17 | 19454 |
| CFTR-Intron10-569 | − | GUUAUUCAGCCAAUAAA | 17 | 19455 |
| CFTR-Intron10-570 | − | GGUUUAAUUUUGUACAA | 17 | 19456 |
| CFTR-Intron10-571 | + | GACUAAUCACCUCCCAA | 17 | 19457 |
| CFTR-Intron10-572 | + | GUUCUCACAUGGCAGAA | 17 | 19458 |
| CFTR-Intron10-573 | − | GGUUGAUAAGAAGAGAA | 17 | 19459 |
| CFTR-Intron10-574 | + | GAGGGAAUGCAGGAGAA | 17 | 19460 |
| CFTR-Intron10-575 | + | GGGAGGCUGAAGCGGAA | 17 | 19461 |
| CFTR-Intron10-576 | + | GGAUUUCAACAUAUGAA | 17 | 19462 |
| CFTR-Intron10-577 | + | GGUAACAAUAAUAUUAA | 17 | 19463 |
| CFTR-Intron10-578 | − | GACCAGCGUGGGCAACA | 17 | 19464 |
| CFTR-Intron10-579 | + | GUACAGUGGUGCAAUCA | 17 | 19465 |
| CFTR-Intron10-580 | − | GAAGGAAGGAAGUAAGA | 17 | 19466 |
| CFTR-Intron10-581 | − | GAAAGCAAUAGUAGAGA | 17 | 19467 |
| CFTR-Intron10-582 | − | GUAGGAGGAAGGAAGGA | 17 | 19468 |
| CFTR-Intron10-583 | − | GGAAGUAGGAGGAAGGA | 17 | 19469 |
| CFTR-Intron10-584 | − | GAAAAGAAAGAGAGGA | 17 | 19470 |
| CFTR-Intron10-585 | − | GAAAGGAAGUAGGAGGA | 17 | 19471 |
| CFTR-Intron10-586 | + | GUCCCAGCUACUUGGGA | 17 | 19472 |
| CFTR-Intron10-587 | − | GUAUUCUAUCAUAUGGA | 17 | 19473 |
| CFTR-Intron10-588 | − | GAGAAACAGGUUUUGGA | 17 | 19474 |
| CFTR-Intron10-589 | − | GUUCAGGCAAGUGAUGA | 17 | 19475 |
| CFTR-Intron10-590 | + | GGGUGAGGGUCUCUCUA | 17 | 19476 |
| CFTR-Intron10-591 | + | GUGAAUGGUGCCAGGUA | 17 | 19477 |
| CFTR-Intron10-592 | − | GAAGAGAAAGGGGUGUA | 17 | 19478 |
| CFTR-Intron10-593 | + | GAAAAAAAAUUCAAAAC | 17 | 19479 |
| CFTR-Intron10-594 | + | GAUAUAAGAAAUGAAAC | 17 | 19480 |
| CFTR-Intron10-595 | − | GUAUUUUUAGUAGAGAC | 17 | 19481 |
| CFTR-Intron10-596 | + | GGAGAAUGGCGUGAACC | 17 | 19482 |
| CFTR-Intron10-597 | + | GAGAAUGGCGUGAACCC | 17 | 19483 |
| CFTR-Intron10-598 | + | GUCUCACUCUGUCACCC | 17 | 19484 |
| CFTR-Intron10-599 | − | GUCUUACUCUGUCACCC | 17 | 19485 |
| CFTR-Intron10-600 | + | GAGAAUUGCUUGAGCCC | 17 | 19486 |
| CFTR-Intron10-601 | − | GUCUCGCUCUGUCGCCC | 17 | 19487 |
| CFTR-Intron10-602 | + | GCCACUGCACUCCAGCC | 17 | 19488 |

TABLE 40C-continued

3rd Tier

| gRNA Name | DNA Strand | Targeting Domain | Target Site Length | Seq ID |
|---|---|---|---|---|
| CFTR-Intron10-603 | + | GGAGAAUUGCUUGAGCC | 17 | 19489 |
| CFTR-Intron10-604 | − | GCCACUGCACUCUAGCC | 17 | 19490 |
| CFTR-Intron10-605 | + | GUUUCACUGUGUUAGCC | 17 | 19491 |
| CFTR-Intron10-606 | − | GUUUCACCGUUUUAGCC | 17 | 19492 |
| CFTR-Intron10-607 | − | GCGCCCGCCACUACGCC | 17 | 19493 |
| CFTR-Intron10-608 | − | GCGUGAGCCACCGCGCC | 17 | 19494 |
| CFTR-Intron10-609 | − | GUUUCACCAUGUUGGCC | 17 | 19495 |
| CFTR-Intron10-610 | − | GGAGAUCAAGACCAUCC | 17 | 19496 |
| CFTR-Intron10-611 | + | GGAGAUCGAGACCAUCC | 17 | 19497 |
| CFTR-Intron10-612 | − | GUGAAUUGCUUGAGUCC | 17 | 19498 |
| CFTR-Intron10-613 | − | GGUUUCACCGUUUUAGC | 17 | 19499 |
| CFTR-Intron10-614 | − | GGCUGGAGUGCAGUGGC | 17 | 19500 |
| CFTR-Intron10-615 | + | GCACCCGCCAUCACGUC | 17 | 19501 |
| CFTR-Intron10-616 | + | GGGCGGAUCACGAGGUC | 17 | 19502 |
| CFTR-Intron10-617 | − | GCAUGAGCCACUGUGUC | 17 | 19503 |
| CFTR-Intron10-618 | + | GGUGGGAUAUGGAGAAG | 17 | 19504 |
| CFTR-Intron10-619 | + | GUAAUAGCAACAGGAAG | 17 | 19505 |
| CFTR-Intron10-620 | − | GAUUUUUGACUAUACAG | 17 | 19506 |
| CFTR-Intron10-621 | − | GAGUUAGAGGAAGGCAG | 17 | 19507 |
| CFTR-Intron10-622 | + | GUUUGUGUUUUUUGUAG | 17 | 19508 |
| CFTR-Intron10-623 | + | GAGGCGGGCGGAUCACG | 17 | 19509 |
| CFTR-Intron10-624 | − | GAGUCAAAAUUAUACG | 17 | 19510 |
| CFTR-Intron10-625 | − | GGAGUUUGAGACCAGCG | 17 | 19511 |
| CFTR-Intron10-626 | − | GAACAAAGACUUGCAGG | 17 | 19512 |
| CFTR-Intron10-627 | + | GGCGUGAACCCGGGAGG | 17 | 19513 |
| CFTR-Intron10-628 | − | GGAAGAAAGGAAGUAGG | 17 | 19514 |
| CFTR-Intron10-629 | − | GUGAUGGUAUUGCAGGG | 17 | 19515 |
| CFTR-Intron10-630 | − | GAAGAAAGAAGGAAAUG | 17 | 19516 |
| CFTR-Intron10-631 | − | GAGGUGAUUAGUCCAUG | 17 | 19517 |
| CFTR-Intron10-632 | + | GAGGCAGGCAGAUCAUG | 17 | 19518 |
| CFTR-Intron10-633 | + | GAAUAUAUUCUUUUAUG | 17 | 19519 |
| CFTR-Intron10-634 | + | GUAGCAAAUGAUAAAAU | 17 | 19520 |
| CFTR-Intron10-635 | − | GUUUACUAACUCAAUCU | 17 | 19521 |
| CFTR-Intron10-636 | + | GUGCAGUGGCGCGAUCU | 17 | 19522 |
| CFTR-Intron10-637 | − | GCACAGUGGUGCGAUCU | 17 | 19523 |
| CFTR-Intron10-638 | − | GUGCAGUGGCGGGAUCU | 17 | 19524 |
| CFTR-Intron10-639 | − | GCUGUGCAUUUUCCUCU | 17 | 19525 |

TABLE 40C-continued

3rd Tier

| gRNA Name | DNA Strand | Targeting Domain | Target Site Length | Seq ID |
|---|---|---|---|---|
| CFTR-Intron10-640 | − | GAGUUUGAGACCAGCGU | 17 | 19526 |
| CFTR-Intron10-641 | + | GUGUUUUUGUAGAGGU | 17 | 19527 |
| CFTR-Intron10-642 | − | GUACUACUGUAAUAAUU | 17 | 19528 |
| CFTR-Intron10-643 | − | GCAGGAGGUGAGGGAUU | 17 | 19529 |
| CFTR-Intron10-644 | − | GUUAUCUCUGAAAUUUU | 17 | 19530 |
| CFTR-Intron10-645 | + | GAAUGCAGGAGAAUGGAAAA | 20 | 19531 |
| CFTR-Intron10-646 | + | GUGUUCUCACAUGGCAGAAA | 20 | 19532 |
| CFTR-Intron10-647 | + | GCAUCACGUGGUGUUUUAAA | 20 | 19533 |
| CFTR-Intron10-648 | + | GGGAGGCUGAGGCAGGAGAA | 20 | 19534 |
| CFTR-Intron10-649 | + | GAUGAGGGAAUGCAGGAGAA | 20 | 19535 |
| CFTR-Intron10-650 | − | GGGAGACAAGGGAGGAAGCA | 20 | 19536 |
| CFTR-Intron10-651 | + | GGCUGGGAAGUCCAAGAUCA | 20 | 19537 |
| CFTR-Intron10-652 | − | GAAGUAGGAGGAAGGAAGGA | 20 | 19538 |
| CFTR-Intron10-653 | − | GAAGAAAGGAAGUAGGAGGA | 20 | 19539 |
| CFTR-Intron10-654 | + | GUAGUCCCAGCUACUUGGGA | 20 | 19540 |
| CFTR-Intron10-655 | − | GGGAGGUGAUUAGUCCAUGA | 20 | 19541 |
| CFTR-Intron10-656 | − | GACUGUUUAUGUUAUCUGUA | 20 | 19542 |
| CFTR-Intron10-657 | − | GCCACUUCCUGUUGCUAUUA | 20 | 19543 |
| CFTR-Intron10-658 | − | GUGUGUAUAUGUGUGUAUUA | 20 | 19544 |
| CFTR-Intron10-659 | + | GUUCAAGCCUGUAUUGUUUA | 20 | 19545 |
| CFTR-Intron10-660 | + | GAGCUUACCGUAAUAGCAAC | 20 | 19546 |
| CFTR-Intron10-661 | + | GCAGGAGAAUGGCGUGAACC | 20 | 19547 |
| CFTR-Intron10-662 | − | GCAUAUAUAUAUUUUUAACC | 20 | 19548 |
| CFTR-Intron10-663 | − | GACAGAGUCUUACUGUCACC | 20 | 19549 |
| CFTR-Intron10-664 | − | GGAGUCUCGCUCUGUCGCCC | 20 | 19550 |
| CFTR-Intron10-665 | + | GCAGGAGAAUUGCUUGAGCC | 20 | 19551 |
| CFTR-Intron10-666 | + | GGAGUUUCACUGUGUUAGCC | 20 | 19552 |
| CFTR-Intron10-667 | − | GGGGUUUCACCGUUUUAGCC | 20 | 19553 |
| CFTR-Intron10-668 | − | GGGGUUUCACCAUGUUGGCC | 20 | 19554 |
| CFTR-Intron10-669 | + | GAUGUAUCUCCAAAUAUGCC | 20 | 19555 |
| CFTR-Intron10-670 | − | GGAUGCCCUUGACUGAAAGC | 20 | 19556 |
| CFTR-Intron10-671 | − | GAACACAGCAGGAAGACAGC | 20 | 19557 |
| CFTR-Intron10-672 | − | GCCUCACCCUCCCAAGUAGC | 20 | 19558 |
| CFTR-Intron10-673 | − | GCCUCAGCCUCCCAAGUAGC | 20 | 19559 |
| CFTR-Intron10-674 | − | GGAAGAGUCUUCCAAGUAGC | 20 | 19560 |
| CFTR-Intron10-675 | + | GCCUCAGCCUCCCGAGUAGC | 20 | 19561 |
| CFTR-Intron10-676 | + | GUUUGCCAUGUUGCCCACGC | 20 | 19562 |

TABLE 40C-continued

3rd Tier

| gRNA Name | DNA Strand | Targeting Domain | Target Site Length | Seq ID |
|---|---|---|---|---|
| CFTR-Intron10-677 | − | GAGUCUUACUGUCACCAGGC | 20 | 19563 |
| CFTR-Intron10-678 | − | GCACUUUUGGAGGCAGAGGC | 20 | 19564 |
| CFTR-Intron10-679 | + | GCACUUUGGGAGGCCGAGGC | 20 | 19565 |
| CFTR-Intron10-680 | − | GCUACUCGGGAGGCUGAGGC | 20 | 19566 |
| CFTR-Intron10-681 | + | GCUACUUGGGAGGCUGAGGC | 20 | 19567 |
| CFTR-Intron10-682 | + | GCUACUUGGGAGGGUGAGGC | 20 | 19568 |
| CFTR-Intron10-683 | + | GAUUUCAACAUAUGAAUGGC | 20 | 19569 |
| CFTR-Intron10-684 | + | GUGCAAGACUUCACACCUGC | 20 | 19570 |
| CFTR-Intron10-685 | − | GCUUCAGCCUCCCAAAGUGC | 20 | 19571 |
| CFTR-Intron10-686 | − | GCCUCGGCCUCCCAAAGUGC | 20 | 19572 |
| CFTR-Intron10-687 | − | GCCCGUAGUCCCAGCUACUC | 20 | 19573 |
| CFTR-Intron10-688 | + | GGCGGGCGGAUCACGAGGUC | 20 | 19574 |
| CFTR-Intron10-689 | + | GAAUUUAUUUCUCACAGUUC | 20 | 19575 |
| CFTR-Intron10-690 | + | GUGUGUGUGUGUCCUUGUUC | 20 | 19576 |
| CFTR-Intron10-691 | − | GGGUUGAUAAGAAGAGAAAG | 20 | 19577 |
| CFTR-Intron10-692 | − | GAUCACCUGAGCCUGAGAAG | 20 | 19578 |
| CFTR-Intron10-693 | − | GAAAGAAGGAAGGAAGUAAG | 20 | 19579 |
| CFTR-Intron10-694 | − | GUCACCAGGCUGGAGCACAG | 20 | 19580 |
| CFTR-Intron10-695 | − | GUGGAUUUUUGACUAUACAG | 20 | 19581 |
| CFTR-Intron10-696 | − | GCAGAGUUAGAGGAAGGCAG | 20 | 19582 |
| CFTR-Intron10-697 | + | GCCGAGGCGGGCGGAUCACG | 20 | 19583 |
| CFTR-Intron10-698 | − | GUGGAGUCAAAAAUUAUACG | 20 | 19584 |
| CFTR-Intron10-699 | + | GAAAUGAAACAGGCCGGGCG | 20 | 19585 |
| CFTR-Intron10-700 | − | GAGAAUGGCGUGAACCCAGG | 20 | 19586 |
| CFTR-Intron10-701 | + | GUUUGUGUUUUUUGUAGAGG | 20 | 19587 |
| CFTR-Intron10-702 | + | GAGAAUGGCGUGAACCCGGG | 20 | 19588 |
| CFTR-Intron10-703 | + | GAGAAUUGCUUGAGCCCGGG | 20 | 19589 |
| CFTR-Intron10-704 | − | GUUCAGGCAAGUGAUGAUGG | 20 | 19590 |
| CFTR-Intron10-705 | + | GCCGAGGCAGGCAGAUCAUG | 20 | 19591 |
| CFTR-Intron10-706 | − | GAACAGUAAGGAGGUCACUG | 20 | 19592 |
| CFTR-Intron10-707 | − | GGUGAUGGUAUUGCAGGGUG | 20 | 19593 |
| CFTR-Intron10-708 | − | GGCUCAAAAAAAAAAAAAAU | 20 | 19594 |
| CFTR-Intron10-709 | − | GCACCACUGUACCCUAGCCU | 20 | 19595 |
| CFTR-Intron10-710 | − | GCGCCACUGCACUCUAGCCU | 20 | 19596 |
| CFTR-Intron10-711 | − | GGAGCACAGUGGUGCGAUCU | 20 | 19597 |
| CFTR-Intron10-712 | − | GGAGUGCAGUGGCGGGAUCU | 20 | 19598 |
| CFTR-Intron10-713 | − | GCUACUUGGGAGGCUGAGGU | 20 | 19599 |

TABLE 40C-continued

3rd Tier

| gRNA Name | DNA Strand | Targeting Domain | Target Site Length | Seq ID |
|---|---|---|---|---|
| CFTR-Intron10-714 | + | GGUUAAGUUGUUCUUAGGGU | 20 | 19600 |
| CFTR-Intron10-715 | − | GAGACGGGGUUUCACCAUGU | 20 | 19601 |
| CFTR-Intron10-716 | − | GCCUCGGCCUCCCAAAGUGU | 20 | 19602 |
| CFTR-Intron10-717 | − | GCAAUGCUAAUAAUACAAUU | 20 | 19603 |
| CFTR-Intron10-718 | + | GAUCAAGGUGCCAGCAGAUU | 20 | 19604 |
| CFTR-Intron10-719 | + | GUUUCCAAAUUUUUUUUAUU | 20 | 19605 |
| CFTR-Intron10-720 | + | GCCUGUAGUCCCAGCUACUU | 20 | 19606 |
| CFTR-Intron10-721 | − | GUAUUGCAGGGUGGGGCCUU | 20 | 19607 |
| CFTR-Intron10-722 | + | GCCUGUAAUCCCAACACUUU | 20 | 19608 |
| CFTR-Intron10-723 | + | GCCUAUAAACCCAGCACUUU | 20 | 19609 |
| CFTR-Intron10-724 | + | GCCUGUAAUCCCAGCACUUU | 20 | 19610 |
| CFTR-Intron10-725 | − | GAACACUUUAUAGUUUUUUU | 20 | 19611 |

Table 40D provides exemplary targeting domains for correcting a mutation (e.g., 3272-26→G) in the CFTR gene selected according to the fourth tier parameters. The targeting domains bind within intron 10. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 40D

4th Tier

| gRNA Name | DNA Strand | Targeting Domain | Target Site Length | Seq ID |
|---|---|---|---|---|
| CFTR-Intron10-726 | + | AACAAAGAAACAAAAAA | 17 | 19612 |
| CFTR-Intron10-727 | + | UAUGAUUUUAUGAAAAA | 17 | 19613 |
| CFTR-Intron10-728 | + | UGCAGGAGAAUGGAAAA | 17 | 19614 |
| CFTR-Intron10-729 | + | UGCAUAAAGGUUGAAAA | 17 | 19615 |
| CFTR-Intron10-730 | − | UUCAGAAGUCUAUAAAA | 17 | 19616 |
| CFTR-Intron10-731 | − | AAAGAAAAAACAGCAAA | 17 | 19617 |
| CFTR-Intron10-732 | + | AGUAAAAAAAAAUCAAA | 17 | 19618 |
| CFTR-Intron10-733 | + | CUAAAAUGACAAUCAAA | 17 | 19619 |
| CFTR-Intron10-734 | + | AAAAGCUGAAAGUCAAA | 17 | 19620 |
| CFTR-Intron10-735 | + | AUUCAAUGAAAAAGAAA | 17 | 19621 |
| CFTR-Intron10-736 | + | UUCUCACAUGGCAGAAA | 17 | 19622 |
| CFTR-Intron10-737 | − | UAAACACUUCUGAGAAA | 17 | 19623 |
| CFTR-Intron10-738 | + | UAAACAAACAAAGGAAA | 17 | 19624 |
| CFTR-Intron10-739 | + | AUUAUCUUUCUAGUAAA | 17 | 19625 |
| CFTR-Intron10-740 | + | ACCAAAUAAACAAACAA | 17 | 19626 |
| CFTR-Intron10-741 | − | AUGGAUAAGUUGAACAA | 17 | 19627 |
| CFTR-Intron10-742 | − | AUUAGGAAAAUGUACAA | 17 | 19628 |

TABLE 40D-continued

4th Tier

| gRNA Name | DNA Strand | Targeting Domain | Target Site Length | Seq ID |
|---|---|---|---|---|
| CFTR-Intron10-743 | + | UGUUUAAAUAUUCCCAA | 17 | 19629 |
| CFTR-Intron10-744 | + | AAAGAAUAAGGCAUCAA | 17 | 19630 |
| CFTR-Intron10-745 | + | AAAUAUAUUCAAAAGAA | 17 | 19631 |
| CFTR-Intron10-746 | + | UGAGAGACAGUAAAGAA | 17 | 19632 |
| CFTR-Intron10-747 | − | AAGGAAAUGAGGAAGAA | 17 | 19633 |
| CFTR-Intron10-748 | + | AGGCUGAGGCAGGAGAA | 17 | 19634 |
| CFTR-Intron10-749 | + | AAACUGAGUAGAAGGAA | 17 | 19635 |
| CFTR-Intron10-750 | + | UUUCUCUUUACUGUGAA | 17 | 19636 |
| CFTR-Intron10-751 | + | AAGAAAAGUAUCAAUAA | 17 | 19637 |
| CFTR-Intron10-752 | + | CAGUGACUUCAUAAUAA | 17 | 19638 |
| CFTR-Intron10-753 | + | AUAGAGAAAACUCAUAA | 17 | 19639 |
| CFTR-Intron10-754 | + | ACAAAAAUUAAAACUAA | 17 | 19640 |
| CFTR-Intron10-755 | + | UCUAGAAAACAAUGUAA | 17 | 19641 |
| CFTR-Intron10-756 | − | AGAUAAAGUUGAAUUAA | 17 | 19642 |
| CFTR-Intron10-757 | + | AAGCCUGUAUUGUUUAA | 17 | 19643 |
| CFTR-Intron10-758 | − | AUUUGACCAUUUUUAA | 17 | 19644 |
| CFTR-Intron10-759 | + | UACCAUCCUGGCCAACA | 17 | 19645 |
| CFTR-Intron10-760 | − | UUAUAGCAGCCUGAACA | 17 | 19646 |
| CFTR-Intron10-761 | − | UUUAAACAGAAGUAACA | 17 | 19647 |
| CFTR-Intron10-762 | + | AGAGAGAACUGCUCACA | 17 | 19648 |
| CFTR-Intron10-763 | + | CCUGCUGUGUUCUCACA | 17 | 19649 |
| CFTR-Intron10-764 | − | UGAAAUCCUAAUUCCCA | 17 | 19650 |
| CFTR-Intron10-765 | − | UUUAUUUUUAUAUUCCA | 17 | 19651 |
| CFTR-Intron10-766 | − | AGACAAGGGAGGAAGCA | 17 | 19652 |
| CFTR-Intron10-767 | + | UCAACAUAUGAAUGGCA | 17 | 19653 |
| CFTR-Intron10-768 | − | UACAGGCUUGAACUGCA | 17 | 19654 |
| CFTR-Intron10-769 | − | AAGGUGAUGGUAUUGCA | 17 | 19655 |
| CFTR-Intron10-770 | + | CUAUUUAAACAGAAUCA | 17 | 19656 |
| CFTR-Intron10-771 | + | UGGGAAGUCCAAGAUCA | 17 | 19657 |
| CFTR-Intron10-772 | + | UUCACUAAAAUAAUUCA | 17 | 19658 |
| CFTR-Intron10-773 | + | UAUAUUUUAUGCAUUCA | 17 | 19659 |
| CFTR-Intron10-774 | − | AUAAGCCACACAGUUCA | 17 | 19660 |
| CFTR-Intron10-775 | + | UUGAGCCCAGGAGUUCA | 17 | 19661 |
| CFTR-Intron10-776 | + | AAUUGGUACAAAUUUCA | 17 | 19662 |
| CFTR-Intron10-777 | − | AGAGGAAGGAAGAAAGA | 17 | 19663 |
| CFTR-Intron10-778 | − | AGAUUCUAAAGGAAAGA | 17 | 19664 |
| CFTR-Intron10-779 | − | AAGGAAGGAAGGAAAGA | 17 | 19665 |
| CFTR-Intron10-780 | + | UGUAUUUUUAGUAGAGA | 17 | 19666 |

TABLE 40D-continued

4th Tier

| gRNA Name | DNA Strand | Targeting Domain | Target Site Length | Seq ID |
|---|---|---|---|---|
| CFTR-Intron10-781 | - | UUUUUUUUUUUUUGAGA | 17 | 19667 |
| CFTR-Intron10-782 | - | CUUUUCCUCUUAAUAGA | 17 | 19668 |
| CFTR-Intron10-783 | + | AUAUUCAAAAGAAAGGA | 17 | 19669 |
| CFTR-Intron10-784 | - | AAGGAAGGAAAGAAGGA | 17 | 19670 |
| CFTR-Intron10-785 | + | CACUGUGUUAGCCAGGA | 17 | 19671 |
| CFTR-Intron10-786 | - | CACCAUGUUGGCCAGGA | 17 | 19672 |
| CFTR-Intron10-787 | - | AAGGCAGAGUUAGAGGA | 17 | 19673 |
| CFTR-Intron10-788 | - | AAAAUUAUACUAUAGGA | 17 | 19674 |
| CFTR-Intron10-789 | - | AUAGAGUAAGACAGGGA | 17 | 19675 |
| CFTR-Intron10-790 | - | CACCGUUUUAGCCGGGA | 17 | 19676 |
| CFTR-Intron10-791 | - | UGGACUGAGUAACUGGA | 17 | 19677 |
| CFTR-Intron10-792 | - | AUAUAUGUGUGUCUGGA | 17 | 19678 |
| CFTR-Intron10-793 | - | AGGUGAUUAGUCCAUGA | 17 | 19679 |
| CFTR-Intron10-794 | + | UGGCAUAGCUGCACUGA | 17 | 19680 |
| CFTR-Intron10-795 | - | AAAUUAGCCAGACGUGA | 17 | 19681 |
| CFTR-Intron10-796 | - | CCUAAUUCCCAAGGUGA | 17 | 19682 |
| CFTR-Intron10-797 | - | AGACUUGCAGGAGGUGA | 17 | 19683 |
| CFTR-Intron10-798 | + | AUGGCAGAAAGGGGUGA | 17 | 19684 |
| CFTR-Intron10-799 | - | UUCAGGACAUGCUUUGA | 17 | 19685 |
| CFTR-Intron10-800 | + | UUCAAUUCUUCAAAAUA | 17 | 19686 |
| CFTR-Intron10-801 | + | AGUAUAUCAAAAGAAUA | 17 | 19687 |
| CFTR-Intron10-802 | + | CCUCUGUGCUUUGAAUA | 17 | 19688 |
| CFTR-Intron10-803 | - | AUAAAUGUUGAAUAAUA | 17 | 19689 |
| CFTR-Intron10-804 | - | CAUAGUAUUCUAUCAUA | 17 | 19690 |
| CFTR-Intron10-805 | + | CAUAGAGAAAACUCAUA | 17 | 19691 |
| CFTR-Intron10-806 | + | CUGCAGACCUCAAUAUA | 17 | 19692 |
| CFTR-Intron10-807 | - | AAGUUUCUCAUCUUAUA | 17 | 19693 |
| CFTR-Intron10-808 | + | CCGAGUAGCUGGGACUA | 17 | 19694 |
| CFTR-Intron10-809 | - | UGGUUUGAAGAACAGUA | 17 | 19695 |
| CFTR-Intron10-810 | - | UGUUUAUGUUAUCUGUA | 17 | 19696 |
| CFTR-Intron10-811 | - | UUUUAGGCUAUUCUGUA | 17 | 19697 |
| CFTR-Intron10-812 | + | ACUAGUGGCACUUUGUA | 17 | 19698 |
| CFTR-Intron10-813 | + | UUAGUUUUAUGCCAUUA | 17 | 19699 |
| CFTR-Intron10-814 | - | CAGGAGGUGAGGGAUUA | 17 | 19700 |
| CFTR-Intron10-815 | - | ACUUCCUGUUGCUAUUA | 17 | 19701 |
| CFTR-Intron10-816 | - | UGUAUAUGUGUGUAUUA | 17 | 19702 |
| CFTR-Intron10-817 | + | AUGUUAUUCAAGGUUUA | 17 | 19703 |

TABLE 40D-continued

| 4th Tier | | | | |
|---|---|---|---|---|
| gRNA Name | DNA Strand | Targeting Domain | Target Site Length | Seq ID |
| CFTR-Intron10-818 | − | CAUUUUGACCAUUUUUA | 17 | 19704 |
| CFTR-Intron10-819 | − | AAGAUAAUGGGAGAAAC | 17 | 19705 |
| CFTR-Intron10-820 | + | UGUGGCUUAUAAACAAC | 17 | 19706 |
| CFTR-Intron10-821 | − | UUUUAAACAGAAGUAAC | 17 | 19707 |
| CFTR-Intron10-822 | − | AAACUGUUAUAAUUAAC | 17 | 19708 |
| CFTR-Intron10-823 | − | UGACCCUUAAACAAUAC | 17 | 19709 |
| CFTR-Intron10-824 | + | CAAGUAGCUGGGACUAC | 17 | 19710 |
| CFTR-Intron10-825 | + | CGAGUAGCUGGGACUAC | 17 | 19711 |
| CFTR-Intron10-826 | − | CAAAGUGCUGGGAUUAC | 17 | 19712 |
| CFTR-Intron10-827 | − | CAAAGUGUUGGGAUUAC | 17 | 19713 |
| CFTR-Intron10-828 | + | UGCAAUAUGCAAUUUAC | 17 | 19714 |
| CFTR-Intron10-829 | + | AAAUAUUGACUAUUUAC | 17 | 19715 |
| CFTR-Intron10-830 | − | UAUAUAUAUUUUUAACC | 17 | 19716 |
| CFTR-Intron10-831 | − | AGAGUCUUACUGUCACC | 17 | 19717 |
| CFTR-Intron10-832 | + | UACUAAAAAAAGUUACC | 17 | 19718 |
| CFTR-Intron10-833 | + | AAAGGUCAAUUGAGCCC | 17 | 19719 |
| CFTR-Intron10-834 | − | UGCAAGCUCCGCCUCCC | 17 | 19720 |
| CFTR-Intron10-835 | − | UGCAACCUCUGCCUCCC | 17 | 19721 |
| CFTR-Intron10-836 | + | ACCACUGUGCUCCAGCC | 17 | 19722 |
| CFTR-Intron10-837 | + | ACCACUGAAGUUCAGCC | 17 | 19723 |
| CFTR-Intron10-838 | + | AAUACAAAAAAUUAGCC | 17 | 19724 |
| CFTR-Intron10-839 | + | AAGAAAUGAAACAGGCC | 17 | 19725 |
| CFTR-Intron10-840 | + | AGAGAUCAAUACCAUCC | 17 | 19726 |
| CFTR-Intron10-841 | − | UGAUGGUGGCUUGAUCC | 17 | 19727 |
| CFTR-Intron10-842 | + | CGCUGGUCUCAAACUCC | 17 | 19728 |
| CFTR-Intron10-843 | − | CUGUAACCUUGAACUCC | 17 | 19729 |
| CFTR-Intron10-844 | − | CUGCAAGCUCCGCCUCC | 17 | 19730 |
| CFTR-Intron10-845 | − | CUGCAACCUCUGCCUCC | 17 | 19731 |
| CFTR-Intron10-846 | + | CUGCAAGUUCUGCCUCC | 17 | 19732 |
| CFTR-Intron10-847 | − | CCAUGUGAGAACACAGC | 17 | 19733 |
| CFTR-Intron10-848 | − | CACAGCAGGAAGACAGC | 17 | 19734 |
| CFTR-Intron10-849 | − | AGUGCAGCUAUGCCAGC | 17 | 19735 |
| CFTR-Intron10-850 | − | UUUUAAAACAAAAUAGC | 17 | 19736 |
| CFTR-Intron10-851 | − | AAACAAAAGAAAAUAGC | 17 | 19737 |
| CFTR-Intron10-852 | − | UCACCCUCCCAAGUAGC | 17 | 19738 |
| CFTR-Intron10-853 | + | UCAGCCUCCCAAGUAGC | 17 | 19739 |
| CFTR-Intron10-854 | − | AGAGUCUUCCAAGUAGC | 17 | 19740 |
| CFTR-Intron10-855 | + | UCAGCCUCCCGAGUAGC | 17 | 19741 |

TABLE 40D-continued

4th Tier

| gRNA Name | DNA Strand | Targeting Domain | Target Site Length | Seq ID |
|---|---|---|---|---|
| CFTR-Intron10-856 | + | AAAUACAAAAAAUUAGC | 17 | 19742 |
| CFTR-Intron10-857 | + | UGCCAUGUUGCCCACGC | 17 | 19743 |
| CFTR-Intron10-858 | + | UAAGAAAUGAAACAGGC | 17 | 19744 |
| CFTR-Intron10-859 | − | UCUUACUGUCACCAGGC | 17 | 19745 |
| CFTR-Intron10-860 | − | CGCUCUGUCGCCCAGGC | 17 | 19746 |
| CFTR-Intron10-861 | − | CUUUUGGAGGCAGAGGC | 17 | 19747 |
| CFTR-Intron10-862 | + | CUUUGGGAGGCCGAGGC | 17 | 19748 |
| CFTR-Intron10-863 | + | CUCACAGUUCUGGAGGC | 17 | 19749 |
| CFTR-Intron10-864 | − | AAGGAGGUCACUGAGGC | 17 | 19750 |
| CFTR-Intron10-865 | − | ACUCGGGAGGCUGAGGC | 17 | 19751 |
| CFTR-Intron10-866 | + | ACUUGGGAGGCUGAGGC | 17 | 19752 |
| CFTR-Intron10-867 | + | ACUUGGGAGGGUGAGGC | 17 | 19753 |
| CFTR-Intron10-868 | − | UUCAAGGAAGAGGGGGC | 17 | 19754 |
| CFTR-Intron10-869 | + | UUCAACAUAUGAAUGGC | 17 | 19755 |
| CFTR-Intron10-870 | − | UAGCCAGACGUGAUGGC | 17 | 19756 |
| CFTR-Intron10-871 | + | UAGCCGGGCGUAGUGGC | 17 | 19757 |
| CFTR-Intron10-872 | − | UCAGCCUCCCAAAGUGC | 17 | 19758 |
| CFTR-Intron10-873 | − | UCGGCCUCCCAAAGUGC | 17 | 19759 |
| CFTR-Intron10-874 | − | CAAGGUGAUGGUAUUGC | 17 | 19760 |
| CFTR-Intron10-875 | − | UUUGAACAAAGACUUGC | 17 | 19761 |
| CFTR-Intron10-876 | − | CGUAGUCCCAGCUACUC | 17 | 19762 |
| CFTR-Intron10-877 | + | CUCCACUUCUCAGGCUC | 17 | 19763 |
| CFTR-Intron10-878 | + | AUAGAGAGAAACAUCUC | 17 | 19764 |
| CFTR-Intron10-879 | + | UGCAGCCUCCACUUCUC | 17 | 19765 |
| CFTR-Intron10-880 | + | AGAGACAAGGUGGUGUC | 17 | 19766 |
| CFTR-Intron10-881 | − | UCAAUAAAUUUGGUGUC | 17 | 19767 |
| CFTR-Intron10-882 | − | AUGUAUAUAUGUGUGUC | 17 | 19768 |
| CFTR-Intron10-883 | + | UCUUUCUAAUUUCAUUC | 17 | 19769 |
| CFTR-Intron10-884 | − | AGGAAGUGAUCAGAUUC | 17 | 19770 |
| CFTR-Intron10-885 | + | UAAGAGGAAAAGACUUC | 17 | 19771 |
| CFTR-Intron10-886 | + | UUUAUUUCUCACAGUUC | 17 | 19772 |
| CFTR-Intron10-887 | + | UGUGUGUGUCCUUGUUC | 17 | 19773 |
| CFTR-Intron10-888 | − | ACUGGCAAUUAAAUUUC | 17 | 19774 |
| CFTR-Intron10-889 | − | UCUUUUGAAUAUAUUUC | 17 | 19775 |
| CFTR-Intron10-890 | + | AUAAAUAAUUGCCUUUC | 17 | 19776 |
| CFTR-Intron10-891 | − | AUUAUAACACUGCUUUC | 17 | 19777 |
| CFTR-Intron10-892 | + | AAAAUUUGUUUUCUUUC | 17 | 19778 |

TABLE 40D-continued

4th Tier

| gRNA Name | DNA Strand | Targeting Domain | Target Site Length | Seq ID |
|---|---|---|---|---|
| CFTR-Intron10-893 | + | AAAAACAUUAGCCAAAG | 17 | 19779 |
| CFTR-Intron10-894 | + | UCUCACAUGGCAGAAAG | 17 | 19780 |
| CFTR-Intron10-895 | − | UUGAUAAGAAGAGAAAG | 17 | 19781 |
| CFTR-Intron10-896 | − | AAGAUUCUAAAGGAAAG | 17 | 19782 |
| CFTR-Intron10-897 | − | UGAAUUUUUUUUCCAAG | 17 | 19783 |
| CFTR-Intron10-898 | − | CACCUGAGCCUGAGAAG | 17 | 19784 |
| CFTR-Intron10-899 | + | ACUUUGGGAGGCUGAAG | 17 | 19785 |
| CFTR-Intron10-900 | + | AAAAAUUCACAAAUAAG | 17 | 19786 |
| CFTR-Intron10-901 | − | AAAUUAGAAAGAAUAAG | 17 | 19787 |
| CFTR-Intron10-902 | − | AAAAAUAAAAAUAUAAG | 17 | 19788 |
| CFTR-Intron10-903 | − | AGAAGGAAGGAAGUAAG | 17 | 19789 |
| CFTR-Intron10-904 | − | CCAUAUUCAAAGCACAG | 17 | 19790 |
| CFTR-Intron10-905 | − | ACCAGGCUGGAGCACAG | 17 | 19791 |
| CFTR-Intron10-906 | + | UUAAUGGCUGUGCACAG | 17 | 19792 |
| CFTR-Intron10-907 | − | UAUGAGAAAAGUCACAG | 17 | 19793 |
| CFTR-Intron10-908 | + | CCUAGGCUAGGGUACAG | 17 | 19794 |
| CFTR-Intron10-909 | + | UGUUUAAAACUCUCCAG | 17 | 19795 |
| CFTR-Intron10-910 | − | CUAUAUUUGUUUUCCAG | 17 | 19796 |
| CFTR-Intron10-911 | + | AGGAAAGGAGGUAGCAG | 17 | 19797 |
| CFTR-Intron10-912 | + | UUGAGCCCGGGAGGCAG | 17 | 19798 |
| CFTR-Intron10-913 | − | AGCACUUUUGGAGGCAG | 17 | 19799 |
| CFTR-Intron10-914 | + | CAACAUAUGAAUGGCAG | 17 | 19800 |
| CFTR-Intron10-915 | + | CCCAGGCUAGAGUGCAG | 17 | 19801 |
| CFTR-Intron10-916 | − | CCCAGGCUGGAGUGCAG | 17 | 19802 |
| CFTR-Intron10-917 | − | UGUCAGGCUGGGUGCAG | 17 | 19803 |
| CFTR-Intron10-918 | + | UAUUUAAACAGAAUCAG | 17 | 19804 |
| CFTR-Intron10-919 | − | AAUGUUAAUUUAUUCAG | 17 | 19805 |
| CFTR-Intron10-920 | − | CCCAGGCUGAACUUCAG | 17 | 19806 |
| CFTR-Intron10-921 | + | UUGUUACAUAAAAAGAG | 17 | 19807 |
| CFTR-Intron10-922 | − | AACAGAAAAAGAAAGAG | 17 | 19808 |
| CFTR-Intron10-923 | − | AAAUUAUACUAUAGGAG | 17 | 19809 |
| CFTR-Intron10-924 | + | AAUAGCCUAUUGUUGAG | 17 | 19810 |
| CFTR-Intron10-925 | − | UAAAUGUUGAAUAAUAG | 17 | 19811 |
| CFTR-Intron10-926 | + | UAGAUGAUUAUUAAUAG | 17 | 19812 |
| CFTR-Intron10-927 | − | UAAAAGUGAUCUCUAG | 17 | 19813 |
| CFTR-Intron10-928 | + | AAAUUAGCCGGGCGUAG | 17 | 19814 |
| CFTR-Intron10-929 | − | UAUGAAGGCAGAGUUAG | 17 | 19815 |
| CFTR-Intron10-930 | + | AGAUGAUUAGCAUCACG | 17 | 19816 |

TABLE 40D-continued

4th Tier

| gRNA Name | DNA Strand | Targeting Domain | Target Site Length | Seq ID |
|---|---|---|---|---|
| CFTR-Intron10-931 | − | UAUUUUAGUAGAGACG | 17 | 19817 |
| CFTR-Intron10-932 | + | AACACUUUGGGAGGCCG | 17 | 19818 |
| CFTR-Intron10-933 | + | AGCACUUUGGGAGGCCG | 17 | 19819 |
| CFTR-Intron10-934 | + | AUGAAACAGGCCGGGCG | 17 | 19820 |
| CFTR-Intron10-935 | + | AAAAAAAAAUCAAAAGG | 17 | 19821 |
| CFTR-Intron10-936 | + | CUGAGUAGAAGGAAAGG | 17 | 19822 |
| CFTR-Intron10-937 | − | UUUGAAGAACAGUAAGG | 17 | 19823 |
| CFTR-Intron10-938 | − | AAUGGCGUGAACCCAGG | 17 | 19824 |
| CFTR-Intron10-939 | − | UAGUUUCAAGGAAGAGG | 17 | 19825 |
| CFTR-Intron10-940 | + | UUACAUAAAAGAGAGG | 17 | 19826 |
| CFTR-Intron10-941 | + | UGUGUUUUUGUAGAGG | 17 | 19827 |
| CFTR-Intron10-942 | + | ACUUGGGAGGCCGAGG | 17 | 19828 |
| CFTR-Intron10-943 | − | UACUUGGGAGGCUGAGG | 17 | 19829 |
| CFTR-Intron10-944 | − | AAAAAUUAUACUAUAGG | 17 | 19830 |
| CFTR-Intron10-945 | + | AAACAGGCCGGGCGCGG | 17 | 19831 |
| CFTR-Intron10-946 | − | CUGUAGGGAGACAAGGG | 17 | 19832 |
| CFTR-Intron10-947 | + | AAUGGCGUGAACCCGGG | 17 | 19833 |
| CFTR-Intron10-948 | + | AAUUGCUUGAGCCCGGG | 17 | 19834 |
| CFTR-Intron10-949 | + | UGGGAGGCCGAGGCGGG | 17 | 19835 |
| CFTR-Intron10-950 | − | AGUCCCAGCUACUCGGG | 17 | 19836 |
| CFTR-Intron10-951 | − | UGGGAGGCUGAGGUGGG | 17 | 19837 |
| CFTR-Intron10-952 | + | AGUCCCAGCUACUUGGG | 17 | 19838 |
| CFTR-Intron10-953 | + | AAUCCCAACACUUUGGG | 17 | 15660 |
| CFTR-Intron10-954 | + | AAACCCAGCACUUUGGG | 17 | 19839 |
| CFTR-Intron10-955 | + | AAUCCCAGCACUUUGGG | 17 | 19840 |
| CFTR-Intron10-956 | − | AGGGUGGGGCCUUUGGG | 17 | 19841 |
| CFTR-Intron10-957 | − | CAGGCAAGUGAUGAUGG | 17 | 19842 |
| CFTR-Intron10-958 | − | UUAGCCAGACGUGAUGG | 17 | 19843 |
| CFTR-Intron10-959 | + | AUUUCUCACAGUUCUGG | 17 | 19844 |
| CFTR-Intron10-960 | − | CUGAGCCUGAGAAGUGG | 17 | 19845 |
| CFTR-Intron10-961 | − | AGGCUGGAGUGCAGUGG | 17 | 19846 |
| CFTR-Intron10-962 | + | UUAGCCGGGCGUAGUGG | 17 | 19847 |
| CFTR-Intron10-963 | − | AAAAUAGCUGGGUGUGG | 17 | 19848 |
| CFTR-Intron10-964 | + | UCAAAAAAUAUUUGUGG | 17 | 19849 |
| CFTR-Intron10-965 | − | AAUCCUAGCACUUUUGG | 17 | 19850 |
| CFTR-Intron10-966 | − | AAUUUUAUAUAGAAAUG | 17 | 19851 |
| CFTR-Intron10-967 | + | AACAAACAAAGGAAAUG | 17 | 19852 |

TABLE 40D-continued

4th Tier

| gRNA Name | DNA Strand | Targeting Domain | Target Site Length | Seq ID |
|---|---|---|---|---|
| CFTR-Intron10-968 | − | AAGCUAGUGAAUGAAUG | 17 | 19853 |
| CFTR-Intron10-969 | + | AUUAUUCAACAUUUAUG | 17 | 19854 |
| CFTR-Intron10-970 | − | CAGUAAGGAGGUCACUG | 17 | 19855 |
| CFTR-Intron10-971 | − | AGCUACUCGGGAGGCUG | 17 | 19856 |
| CFTR-Intron10-972 | + | AGCUACUUGGGAGGCUG | 17 | 19857 |
| CFTR-Intron10-973 | + | CAAAAAUUAGCUGAGUG | 17 | 19858 |
| CFTR-Intron10-974 | + | ACAUAAAAAGAGAGGUG | 17 | 19859 |
| CFTR-Intron10-975 | + | UGUUUUUUGUAGAGGUG | 17 | 19860 |
| CFTR-Intron10-976 | − | AAGACUUGCAGGAGGUG | 17 | 19861 |
| CFTR-Intron10-977 | + | AGCUACUUGGGAGGGUG | 17 | 19862 |
| CFTR-Intron10-978 | + | CAUGGCAGAAAGGGGUG | 17 | 19863 |
| CFTR-Intron10-979 | − | AAGAAAAUAGCUGGGUG | 17 | 19864 |
| CFTR-Intron10-980 | + | AAAUACCAUGAACUGUG | 17 | 19865 |
| CFTR-Intron10-981 | − | UUUAUAAAAAUAAUUG | 17 | 19866 |
| CFTR-Intron10-982 | + | UAUUCAAAAAUAUUUG | 17 | 19867 |
| CFTR-Intron10-983 | − | ACAUGGAAAAUUUUUG | 17 | 19868 |
| CFTR-Intron10-984 | − | UAGUAGUUAAGUUUUG | 17 | 19869 |
| CFTR-Intron10-985 | − | UCAAAAAAAAAAAAAU | 17 | 19870 |
| CFTR-Intron10-986 | + | UAAAAUGACAAUCAAAU | 17 | 19871 |
| CFTR-Intron10-987 | + | CUAUUUGGAUGUCAAAU | 17 | 19872 |
| CFTR-Intron10-988 | + | AAACAAACAAAGGAAAU | 17 | 19873 |
| CFTR-Intron10-989 | − | UUGAAGGAAGAUCCAAU | 17 | 19874 |
| CFTR-Intron10-990 | − | CAUAAAUGUUGAAUAAU | 17 | 19875 |
| CFTR-Intron10-991 | − | UUUACUAGAAAGAUAAU | 17 | 19876 |
| CFTR-Intron10-992 | − | ACUGUCAGAGAAGUAAU | 17 | 19877 |
| CFTR-Intron10-993 | − | UUUUUCAGUUAAUACAU | 17 | 19878 |
| CFTR-Intron10-994 | + | UACAAUUCUUAUUACAU | 17 | 19879 |
| CFTR-Intron10-995 | − | ACAGGCUUGAACUGCAU | 17 | 19880 |
| CFTR-Intron10-996 | − | ACCCUAGCCUAGGUGAU | 17 | 19881 |
| CFTR-Intron10-997 | + | UUGUGUUAACAAAAUAU | 17 | 19882 |
| CFTR-Intron10-998 | + | AAUAUAUAUAUGCAUAU | 17 | 19883 |
| CFTR-Intron10-999 | − | UUAAAAAUUAUACUAU | 17 | 19884 |
| CFTR-Intron10-1000 | − | AAAGUUUCUCAUCUUAU | 17 | 19885 |
| CFTR-Intron10-1001 | + | UAUUAUUCAACAUUUAU | 17 | 19886 |
| CFTR-Intron10-1002 | − | CAAAGUGCUGGGUUUAU | 17 | 19887 |
| CFTR-Intron10-1003 | + | UCAGACUUUUAUUUUAU | 17 | 19888 |
| CFTR-Intron10-1004 | + | UUUAACAAACCUUUUAU | 17 | 19889 |
| CFTR-Intron10-1005 | + | UUCCAAAUUUUUUUUAU | 17 | 19890 |

TABLE 40D-continued

4th Tier

| gRNA Name | DNA Strand | Targeting Domain | Target Site Length | Seq ID |
|---|---|---|---|---|
| CFTR-Intron10-1006 | − | UUAUUCUUGUAAUAACU | 17 | 19891 |
| CFTR-Intron10-1007 | − | CCGUAGUCCCAGCUACU | 17 | 19892 |
| CFTR-Intron10-1008 | + | CUGUAGUCCCAGCUACU | 17 | 19893 |
| CFTR-Intron10-1009 | + | CUGCAAUACCAUCACCU | 17 | 19894 |
| CFTR-Intron10-1010 | + | CCACUGCACUCCAGCCU | 17 | 19895 |
| CFTR-Intron10-1011 | + | CCACUGAAGUUCAGCCU | 17 | 19896 |
| CFTR-Intron10-1012 | − | CCACUGUACCCUAGCCU | 17 | 19897 |
| CFTR-Intron10-1013 | − | CCACUGCACUCUAGCCU | 17 | 19898 |
| CFTR-Intron10-1014 | − | UCGUGAUCCGCCCGCCU | 17 | 19899 |
| CFTR-Intron10-1015 | − | UCAUGAUCUGCCUGCCU | 17 | 19900 |
| CFTR-Intron10-1016 | − | UGUAACCUUGAACUCCU | 17 | 19901 |
| CFTR-Intron10-1017 | + | UGCAAGUUCUGCCUCCU | 17 | 19902 |
| CFTR-Intron10-1018 | − | AGGUUUUGGAUGGAGCU | 17 | 19903 |
| CFTR-Intron10-1019 | − | AACAAAGAAAAUAGCU | 17 | 19904 |
| CFTR-Intron10-1020 | − | CACCCUCCCAAGUAGCU | 17 | 19905 |
| CFTR-Intron10-1021 | + | CAGCCUCCCAAGUAGCU | 17 | 19906 |
| CFTR-Intron10-1022 | + | CAGCCUCCCGAGUAGCU | 17 | 19907 |
| CFTR-Intron10-1023 | + | UCACAGUUCUGGAGGCU | 17 | 19908 |
| CFTR-Intron10-1024 | − | AAAUUAUUUCUACUGCU | 17 | 19909 |
| CFTR-Intron10-1025 | + | CUGCCUCCAAAAGUGCU | 17 | 19910 |
| CFTR-Intron10-1026 | − | CAGCCUCCCAAAGUGCU | 17 | 19911 |
| CFTR-Intron10-1027 | − | CGGCCUCCCAAAGUGCU | 17 | 19912 |
| CFTR-Intron10-1028 | − | AAAAAGUUGAGUUGCU | 17 | 19913 |
| CFTR-Intron10-1029 | − | UGCUGGCACCUUGAUCU | 17 | 19914 |
| CFTR-Intron10-1030 | − | UGCUUUUCCCACUAUCU | 17 | 19915 |
| CFTR-Intron10-1031 | + | AAUUGAACAACAUUCU | 17 | 19916 |
| CFTR-Intron10-1032 | + | UUUUUCAUUAUGAUUCU | 17 | 19917 |
| CFTR-Intron10-1033 | + | CUUUUUCUUAAUUUUCU | 17 | 19918 |
| CFTR-Intron10-1034 | − | UGAGGAAGAAAGGAAGU | 17 | 19919 |
| CFTR-Intron10-1035 | − | UCUGCAAUUGUAUCAGU | 17 | 19920 |
| CFTR-Intron10-1036 | + | CAGUUUAUUUUUCAGU | 17 | 19921 |
| CFTR-Intron10-1037 | + | ACAUUUCCUAAUGAGU | 17 | 19922 |
| CFTR-Intron10-1038 | − | AGUGGAAGUAGUAUAGU | 17 | 19923 |
| CFTR-Intron10-1039 | + | UACAUAAAAAGAGAGGU | 17 | 19924 |
| CFTR-Intron10-1040 | − | UUAGAGGUUAAGGAGGU | 17 | 19925 |
| CFTR-Intron10-1041 | − | ACUUGGGAGGCUGAGGU | 17 | 19926 |
| CFTR-Intron10-1042 | − | ACGGGGUUUCACCAUGU | 17 | 19927 |

TABLE 40D-continued

| | | 4th Tier | | |
|---|---|---|---|---|
| gRNA Name | DNA Strand | Targeting Domain | Target Site Length | Seq ID |
| CFTR-Intron10-1043 | − | UCGGCCUCCCAAAGUGU | 17 | 19928 |
| CFTR-Intron10-1044 | − | AGAAGAGAAAGGGGUGU | 17 | 19929 |
| CFTR-Intron10-1045 | − | ACCCAAUAAAAAAAAUU | 17 | 19930 |
| CFTR-Intron10-1046 | − | UUUCCACUCAAUAAAUU | 17 | 19931 |
| CFTR-Intron10-1047 | + | CCAUCACCUUGGGAAUU | 17 | 19932 |
| CFTR-Intron10-1048 | − | CACUAUUGAUUGACAUU | 17 | 19933 |
| CFTR-Intron10-1049 | + | CAAGGUGCCAGCAGAUU | 17 | 19934 |
| CFTR-Intron10-1050 | − | UAUUCUUUUAGAGAUU | 17 | 19935 |
| CFTR-Intron10-1051 | − | UACUUUCUUCCUGAUU | 17 | 19936 |
| CFTR-Intron10-1052 | − | UUUUCAUUGAAUGUAUU | 17 | 19937 |
| CFTR-Intron10-1053 | − | UCCUUUGUUUGUUUAUU | 17 | 19938 |
| CFTR-Intron10-1054 | + | CAGACUUUUAUUUUAUU | 17 | 19939 |
| CFTR-Intron10-1055 | + | UCCAAAUUUUUUUUAUU | 17 | 19940 |
| CFTR-Intron10-1056 | + | CUGUAAUCCCAACACUU | 17 | 19941 |
| CFTR-Intron10-1057 | − | AAGUAACAGGGCCACUU | 17 | 19942 |
| CFTR-Intron10-1058 | + | CUAUAAACCCAGCACUU | 17 | 19943 |
| CFTR-Intron10-1059 | + | CUGUAAUCCCAGCACUU | 17 | 19944 |
| CFTR-Intron10-1060 | − | AAUUGAAUAUGAGACUU | 17 | 19945 |
| CFTR-Intron10-1061 | + | UGUAGUCCCAGCUACUU | 17 | 19946 |
| CFTR-Intron10-1062 | + | UGCAAUACCAUCACCUU | 17 | 19947 |
| CFTR-Intron10-1063 | + | AUGUUAAAUUUUCCCUU | 17 | 19948 |
| CFTR-Intron10-1064 | + | UUCCCUUAGGAUAUCUU | 17 | 19949 |
| CFTR-Intron10-1065 | − | AAGCAAGGAGAUGAGUU | 17 | 19950 |
| CFTR-Intron10-1066 | − | CGGCCUCCCAAAGUGUU | 17 | 19951 |
| CFTR-Intron10-1067 | − | UGUUAUCUCUGAAAUUU | 17 | 19952 |
| CFTR-Intron10-1068 | − | UUUGAUUAGAUAAAUUU | 17 | 19953 |
| CFTR-Intron10-1069 | − | UCAAUAUUUUGGAAUUU | 17 | 19954 |
| CFTR-Intron10-1070 | − | ACUAUUGAUUGACAUUU | 17 | 19955 |
| CFTR-Intron10-1071 | + | AAGGUGCCAGCAGAUUU | 17 | 19956 |
| CFTR-Intron10-1072 | − | UAGUUUUAUCAAUAUUU | 17 | 19957 |
| CFTR-Intron10-1073 | + | UCUCUGCAAACAUAUUU | 17 | 19958 |
| CFTR-Intron10-1074 | − | CAUUAUUCAUGAUAUUU | 17 | 19959 |
| CFTR-Intron10-1075 | − | UUUCAUUGAAUGUAUUU | 17 | 19960 |
| CFTR-Intron10-1076 | + | UGUAAUCCCAACACUUU | 17 | 19961 |
| CFTR-Intron10-1077 | + | UAUAAACCCAGCACUUU | 17 | 19962 |
| CFTR-Intron10-1078 | + | UGUAAUCCCAGCACUUU | 17 | 19963 |
| CFTR-Intron10-1079 | − | UGUAAUCCUAGCACUUU | 17 | 19964 |
| CFTR-Intron10-1080 | − | UGCAGGGUGGGGCCUUU | 17 | 19965 |

TABLE 40D-continued

4th Tier

| gRNA Name | DNA Strand | Targeting Domain | Target Site Length | Seq ID |
|---|---|---|---|---|
| CFTR-Intron10-1081 | - | UUUAACUGAAUAUCUUU | 17 | 19966 |
| CFTR-Intron10-1082 | - | AUGGGAGAAACAGGUUU | 17 | 19967 |
| CFTR-Intron10-1083 | - | AUACAUUGGAAAAUUUU | 17 | 19968 |
| CFTR-Intron10-1084 | - | CAAUAUUUGGAAUUUU | 17 | 19969 |
| CFTR-Intron10-1085 | - | UACAUUGGAAAAUUUUU | 17 | 19970 |
| CFTR-Intron10-1086 | - | CUUUGGCUAAUGUUUUU | 17 | 19971 |
| CFTR-Intron10-1087 | - | CACUUUAUAGUUUUUUU | 17 | 19972 |
| CFTR-Intron10-1088 | + | ACAAACAAAGAAACAAAAAA | 20 | 19973 |
| CFTR-Intron10-1089 | + | ACAUAUGAUUUUAUGAAAAA | 20 | 19974 |
| CFTR-Intron10-1090 | + | CGAGACCAUCCCGGCUAAAA | 20 | 19975 |
| CFTR-Intron10-1091 | - | UAGAAAGAAAAAACAGCAAA | 20 | 19976 |
| CFTR-Intron10-1092 | + | AUUAGUAAAAAAAAAUCAAA | 20 | 19977 |
| CFTR-Intron10-1093 | + | AAGAAAAGCUGAAAGUCAAA | 20 | 19978 |
| CFTR-Intron10-1094 | + | UACAUUCAAUGAAAAAGAAA | 20 | 19979 |
| CFTR-Intron10-1095 | - | AGGGUUGAUAAGAAGAGAAA | 20 | 19980 |
| CFTR-Intron10-1096 | - | AUUUAAACACUUCUGAGAAA | 20 | 19981 |
| CFTR-Intron10-1097 | + | AAAUAAACAAACAAAGGAAA | 20 | 19982 |
| CFTR-Intron10-1098 | - | AAGGAUGUUUAUUUAUGAAA | 20 | 19983 |
| CFTR-Intron10-1099 | + | AAAACCAAAUAAACAAACAA | 20 | 19984 |
| CFTR-Intron10-1100 | - | CUCAUUAGGAAAAUGUACAA | 20 | 19985 |
| CFTR-Intron10-1101 | + | AUGGACUAAUCACCUCCCAA | 20 | 19986 |
| CFTR-Intron10-1102 | - | UCAUGUUGAUAAAGGGUCAA | 20 | 19987 |
| CFTR-Intron10-1103 | + | CUGAAAUAUAUUCAAAAGAA | 20 | 19988 |
| CFTR-Intron10-1104 | + | AGAUGAGAGACAGUAAAGAA | 20 | 19989 |
| CFTR-Intron10-1105 | - | AAGAAGGAAAUGAGGAAGAA | 20 | 19990 |
| CFTR-Intron10-1106 | + | UGUGUUCUCACAUGGCAGAA | 20 | 19991 |
| CFTR-Intron10-1107 | + | UUUGGGAGGCUGAAGCGGAA | 20 | 19992 |
| CFTR-Intron10-1108 | + | UUAGGAUUUCAACAUAUGAA | 20 | 19993 |
| CFTR-Intron10-1109 | + | ACAUUUCUCUUUACUGUGAA | 20 | 19994 |
| CFTR-Intron10-1110 | + | AGGAAGAAAAGUAUCAAUAA | 20 | 19995 |
| CFTR-Intron10-1111 | + | AUACAGUGACUUCAUAAUAA | 20 | 19996 |
| CFTR-Intron10-1112 | + | AACAUAGAGAAAACUCAUAA | 20 | 19997 |
| CFTR-Intron10-1113 | + | UGAACAAAAUUAAAACUAA | 20 | 19998 |
| CFTR-Intron10-1114 | + | UUUUCUAGAAAACAAUGUAA | 20 | 19999 |
| CFTR-Intron10-1115 | - | AACAGAUAAAGUUGAAUUAA | 20 | 20000 |
| CFTR-Intron10-1116 | + | UGUUACCUUUCAAUGUUUAA | 20 | 20001 |
| CFTR-Intron10-1117 | + | UUCAAGCCUGUAUUGUUUAA | 20 | 20002 |

TABLE 40D-continued

4th Tier

| gRNA Name | DNA Strand | Targeting Domain | Target Site Length | Seq ID |
|---|---|---|---|---|
| CFTR-Intron10-1118 | − | AUCAUUUUGACCAUUUUUAA | 20 | 20003 |
| CFTR-Intron10-1119 | + | CAAUACCAUCCUGGCCAACA | 20 | 20004 |
| CFTR-Intron10-1120 | − | UGAGACCAGCGUGGGCAACA | 20 | 20005 |
| CFTR-Intron10-1121 | − | UUGUUAUAGCAGCCUGAACA | 20 | 20006 |
| CFTR-Intron10-1122 | + | UGGAGAGAGAACUGCUCACA | 20 | 20007 |
| CFTR-Intron10-1123 | + | CUUCCUGCUGUGUUCUCACA | 20 | 20008 |
| CFTR-Intron10-1124 | + | AAUGAUCAAUAAUAGAGACA | 20 | 20009 |
| CFTR-Intron10-1125 | + | AUUUUACAAUUCUUAUUACA | 20 | 20010 |
| CFTR-Intron10-1126 | − | UGUUGAAAUCCUAAUUCCCA | 20 | 20011 |
| CFTR-Intron10-1127 | − | UUCUUUAUUUUUAUAUUCCA | 20 | 20012 |
| CFTR-Intron10-1128 | + | AUUUCAACAUAUGAAUGGCA | 20 | 20013 |
| CFTR-Intron10-1129 | − | AAAGUGCCACUAGUGAUGCA | 20 | 20014 |
| CFTR-Intron10-1130 | − | CAAUACAGGCUUGAACUGCA | 20 | 20015 |
| CFTR-Intron10-1131 | − | CCCAAGGUGAUGGUAUUGCA | 20 | 20016 |
| CFTR-Intron10-1132 | + | AGGGUACAGUGGUGCAAUCA | 20 | 20017 |
| CFTR-Intron10-1133 | + | UGCUUCACUAAAAUAAUUCA | 20 | 20018 |
| CFTR-Intron10-1134 | + | ACAUAUAUUUUAUGCAUUCA | 20 | 20019 |
| CFTR-Intron10-1135 | − | UUUAUAAGCCACACAGUUCA | 20 | 20020 |
| CFTR-Intron10-1136 | + | CAAUUGAGCCCAGGAGUUCA | 20 | 20021 |
| CFTR-Intron10-1137 | − | AAGAGAGGAAGGAAGAAAGA | 20 | 20022 |
| CFTR-Intron10-1138 | − | AGGAAGGAAGGAAGGAAAGA | 20 | 20023 |
| CFTR-Intron10-1139 | − | AAAGAAGGAAGGAAGUAAGA | 20 | 20024 |
| CFTR-Intron10-1140 | − | AAUGAAAGCAAUAGUAGAGA | 20 | 20025 |
| CFTR-Intron10-1141 | + | UUUUGUAUUUUUAGUAGAGA | 20 | 20026 |
| CFTR-Intron10-1142 | − | UUUUUUUUUUUUUUUGAGA | 20 | 20027 |
| CFTR-Intron10-1143 | − | AGUCUUUUCCUCUUAAUAGA | 20 | 20028 |
| CFTR-Intron10-1144 | + | AAUAUAUUCAAAAGAAAGGA | 20 | 20029 |
| CFTR-Intron10-1145 | − | AGGAAGGAAGGAAAGAAGGA | 20 | 20030 |
| CFTR-Intron10-1146 | − | AAAGGAAGUAGGAGGAAGGA | 20 | 20031 |
| CFTR-Intron10-1147 | + | UUUCACUGUGUUAGCCAGGA | 20 | 20032 |
| CFTR-Intron10-1148 | − | UUUCACCAUGUUGGCCAGGA | 20 | 20033 |
| CFTR-Intron10-1149 | − | ACAGAAAAAGAAAGAGAGGA | 20 | 20034 |
| CFTR-Intron10-1150 | − | AUGAAGGCAGAGUUAGAGGA | 20 | 20035 |
| CFTR-Intron10-1151 | − | UAAAAAUUAUACUAUAGGA | 20 | 20036 |
| CFTR-Intron10-1152 | + | AUGGUACAAAUUUCAGGGA | 20 | 20037 |
| CFTR-Intron10-1153 | − | UUUCACCGUUUUAGCCGGGA | 20 | 20038 |
| CFTR-Intron10-1154 | − | AUAGUAUUCUAUCAUAUGGA | 20 | 20039 |
| CFTR-Intron10-1155 | − | UUCUGGACUGAGUAACUGGA | 20 | 20040 |

TABLE 40D-continued

4th Tier

| gRNA Name | DNA Strand | Targeting Domain | Target Site Length | Seq ID |
|---|---|---|---|---|
| CFTR-Intron10-1156 | − | UGUAUAUAUGUGUGUCUGGA | 20 | 20041 |
| CFTR-Intron10-1157 | − | UGGGAGAAACAGGUUUUGGA | 20 | 20042 |
| CFTR-Intron10-1158 | + | UUGACCCUUUAUCAACAUGA | 20 | 20043 |
| CFTR-Intron10-1159 | + | UGCUGGCAUAGCUGCACUGA | 20 | 20044 |
| CFTR-Intron10-1160 | − | AAAAAAUUAGCCAGACGUGA | 20 | 20045 |
| CFTR-Intron10-1161 | − | AAUCCUAAUUCCCAAGGUGA | 20 | 20046 |
| CFTR-Intron10-1162 | − | CAAAGACUUGCAGGAGGUGA | 20 | 20047 |
| CFTR-Intron10-1163 | + | CACAUGGCAGAAAGGGGUGA | 20 | 20048 |
| CFTR-Intron10-1164 | − | AGAUUCAGGACAUGCUUUGA | 20 | 20049 |
| CFTR-Intron10-1165 | + | AUAUUCAAUUCUUCAAAAUA | 20 | 20050 |
| CFTR-Intron10-1166 | − | AAAACUAAUUGUAGUACAUA | 20 | 20051 |
| CFTR-Intron10-1167 | − | AUGCAUAGUAUUCUAUCAUA | 20 | 20052 |
| CFTR-Intron10-1168 | + | AAACAUAGAGAAAACUCAUA | 20 | 20053 |
| CFTR-Intron10-1169 | + | UAGCUGCAGACCUCAAUAUA | 20 | 20054 |
| CFTR-Intron10-1170 | + | CAAAAAUUACAGAACCUAUA | 20 | 20055 |
| CFTR-Intron10-1171 | − | AAAAAGUUUCUCAUCUUAUA | 20 | 20056 |
| CFTR-Intron10-1172 | + | CUCCCGAGUAGCUGGGACUA | 20 | 20057 |
| CFTR-Intron10-1173 | + | AAGGGGUGAGGGUCUCUCUA | 20 | 20058 |
| CFTR-Intron10-1174 | + | AAGGUGUGAGGGUCUCUCUA | 20 | 20059 |
| CFTR-Intron10-1175 | + | ACUGUGAAUGGUGCCAGGUA | 20 | 20060 |
| CFTR-Intron10-1176 | + | AUCACUAGUGGCACUUUGUA | 20 | 20061 |
| CFTR-Intron10-1177 | + | UUGAUGUUAUUCAAGGUUUA | 20 | 20062 |
| CFTR-Intron10-1178 | − | UAUCAUUUUGACCAUUUUUA | 20 | 20063 |
| CFTR-Intron10-1179 | + | UUGGAAAAAAAAUUCAAAAC | 20 | 20064 |
| CFTR-Intron10-1180 | + | CUGUGUGGCUUAUAAACAAC | 20 | 20065 |
| CFTR-Intron10-1181 | + | CCAUCAUCACUUGCCUGAAC | 20 | 20066 |
| CFTR-Intron10-1182 | − | AGCUUUCUGGACUGAGUAAC | 20 | 20067 |
| CFTR-Intron10-1183 | − | UUUGUAUUUUUAGUAGAGAC | 20 | 20068 |
| CFTR-Intron10-1184 | − | ACAAGUGCCUAGCACUUGAC | 20 | 20069 |
| CFTR-Intron10-1185 | − | AAUUGACCCUUAAACAAUAC | 20 | 20070 |
| CFTR-Intron10-1186 | + | UCCCAAGUAGCUGGGACUAC | 20 | 20071 |
| CFTR-Intron10-1187 | + | UCCCGAGUAGCUGGGACUAC | 20 | 20072 |
| CFTR-Intron10-1188 | − | UCCCAAAGUGCUGGGAUUAC | 20 | 20073 |
| CFTR-Intron10-1189 | − | UCCCAAAGUGUUGGGAUUAC | 20 | 20074 |
| CFTR-Intron10-1190 | + | UACUGCAAUAUGCAAUUUAC | 20 | 20075 |
| CFTR-Intron10-1191 | + | CAGGAGAAUGGCGUGAACCC | 20 | 20076 |
| CFTR-Intron10-1192 | + | AGAGUCUCACUCUGUCACCC | 20 | 20077 |

TABLE 40D-continued

| | | 4th Tier | | |
|---|---|---|---|---|
| gRNA Name | DNA Strand | Targeting Domain | Target Site Length | Seq ID |
| CFTR-Intron10-1193 | − | UAGGUCUUACUCUGUCACCC | 20 | 20078 |
| CFTR-Intron10-1194 | + | CGGAAAGGUCAAUUGAGCCC | 20 | 20079 |
| CFTR-Intron10-1195 | + | CAGGAGAAUUGCUUGAGCCC | 20 | 20080 |
| CFTR-Intron10-1196 | − | CACUGCAAGCUCCGCCUCCC | 20 | 20081 |
| CFTR-Intron10-1197 | − | CACUGCAACCUCUGCCUCCC | 20 | 20082 |
| CFTR-Intron10-1198 | + | CCCGCCACUGCACUCCAGCC | 20 | 20083 |
| CFTR-Intron10-1199 | + | CGCACCACUGUGCUCCAGCC | 20 | 20084 |
| CFTR-Intron10-1200 | + | CACACCACUGAAGUUCAGCC | 20 | 20085 |
| CFTR-Intron10-1201 | − | CGCGCCACUGCACUCUAGCC | 20 | 20086 |
| CFTR-Intron10-1202 | + | AAAAAUACAAAAAAUUAGCC | 20 | 20087 |
| CFTR-Intron10-1203 | − | CAGGCGCCCGCCACUACGCC | 20 | 20088 |
| CFTR-Intron10-1204 | − | CAGGCGUGAGCCACCGCGCC | 20 | 20089 |
| CFTR-Intron10-1205 | + | UAUAAGAAAUGAAACAGGCC | 20 | 20090 |
| CFTR-Intron10-1206 | − | UUAGGAGAUCAAGACCAUCC | 20 | 20091 |
| CFTR-Intron10-1207 | + | UCAGGAGAUCGAGACCAUCC | 20 | 20092 |
| CFTR-Intron10-1208 | + | UCAAGAGAUCAAUACCAUCC | 20 | 20093 |
| CFTR-Intron10-1209 | − | UGAUGAUGGUGGCUUGAUCC | 20 | 20094 |
| CFTR-Intron10-1210 | − | AGGAAGACAGCUGGCUAUCC | 20 | 20095 |
| CFTR-Intron10-1211 | + | CCACGCUGGUCUCAAACUCC | 20 | 20096 |
| CFTR-Intron10-1212 | − | UCACUGUAACCUUGAACUCC | 20 | 20097 |
| CFTR-Intron10-1213 | − | UUAUUCUUUUGAUAUACUCC | 20 | 20098 |
| CFTR-Intron10-1214 | − | UCACUGCAAGCUCCGCCUCC | 20 | 20099 |
| CFTR-Intron10-1215 | − | UCACUGCAACCUCUGCCUCC | 20 | 20100 |
| CFTR-Intron10-1216 | + | UCACUGCAAGUUCUGCCUCC | 20 | 20101 |
| CFTR-Intron10-1217 | − | CAGGUGAAUUGCUUGAGUCC | 20 | 20102 |
| CFTR-Intron10-1218 | − | CUGCCAUGUGAGAACACAGC | 20 | 20103 |
| CFTR-Intron10-1219 | − | AUCAGUGCAGCUAUGCCAGC | 20 | 20104 |
| CFTR-Intron10-1220 | − | AGCUUUAAAACAAAAUAGC | 20 | 20105 |
| CFTR-Intron10-1221 | − | CACAAACAAAAGAAAAUAGC | 20 | 20106 |
| CFTR-Intron10-1222 | + | ACCUCAGCCUCCCAAGUAGC | 20 | 20107 |
| CFTR-Intron10-1223 | + | UAAAAUACAAAAAAUUAGC | 20 | 20108 |
| CFTR-Intron10-1224 | − | CGGGGUUUCACCGUUUUAGC | 20 | 20109 |
| CFTR-Intron10-1225 | + | AUAUAAGAAAUGAAACAGGC | 20 | 20110 |
| CFTR-Intron10-1226 | − | UCUCGCUCUGUCGCCCAGGC | 20 | 20111 |
| CFTR-Intron10-1227 | − | CAAUAAAUUUGGUGUCAGGC | 20 | 20112 |
| CFTR-Intron10-1228 | + | ACACUUGGGAGGCCGAGGC | 20 | 20113 |
| CFTR-Intron10-1229 | + | UUUCUCACAGUUCUGGAGGC | 20 | 20114 |
| CFTR-Intron10-1230 | − | AAUUAGCCAGACGUGAUGGC | 20 | 20115 |

TABLE 40D-continued

4th Tier

| gRNA Name | DNA Strand | Targeting Domain | Target Site Length | Seq ID |
|---|---|---|---|---|
| CFTR-Intron10-1231 | − | CCAGGCUGGAGUGCAGUGGC | 20 | 20116 |
| CFTR-Intron10-1232 | + | AAUUAGCCGGGCGUAGUGGC | 20 | 20117 |
| CFTR-Intron10-1233 | − | CUUAGCAGACCCAAAUCUGC | 20 | 20118 |
| CFTR-Intron10-1234 | + | UUCAUUUAUCUCGAAAUUGC | 20 | 20119 |
| CFTR-Intron10-1235 | − | UCCCAAGGUGAUGGUAUUGC | 20 | 20120 |
| CFTR-Intron10-1236 | − | ACAUUUGAACAAAGACUUGC | 20 | 20121 |
| CFTR-Intron10-1237 | + | AGCCUCCACUUCUCAGGCUC | 20 | 20122 |
| CFTR-Intron10-1238 | + | UAUAUAGAGAGAAACAUCUC | 20 | 20123 |
| CFTR-Intron10-1239 | + | CACUGCAGCCUCCACUUCUC | 20 | 20124 |
| CFTR-Intron10-1240 | + | CGGGCACCCGCCAUCACGUC | 20 | 20125 |
| CFTR-Intron10-1241 | − | UAGGCAUGAGCCACUGUGUC | 20 | 20126 |
| CFTR-Intron10-1242 | − | UGUAUGUAUAUAUGUGUGUC | 20 | 20127 |
| CFTR-Intron10-1243 | + | UAUUCUUUCUAAUUUCAUUC | 20 | 20128 |
| CFTR-Intron10-1244 | − | AGUAGGAAGUGAUCAGAUUC | 20 | 20129 |
| CFTR-Intron10-1245 | − | CUUUCUUUUGAAUAUAUUUC | 20 | 20130 |
| CFTR-Intron10-1246 | − | AAAGAUGAUUCCAAGCUUUC | 20 | 20131 |
| CFTR-Intron10-1247 | − | UUCAUUAUAACACUGCUUUC | 20 | 20132 |
| CFTR-Intron10-1248 | + | AAGAAAAUUUGUUUUCUUUC | 20 | 20133 |
| CFTR-Intron10-1249 | + | UGUUCUCACAUGGCAGAAAG | 20 | 20134 |
| CFTR-Intron10-1250 | − | UUUUGAAUUUUUUUUCCAAG | 20 | 20135 |
| CFTR-Intron10-1251 | + | ACCGUAAUAGCAACAGGAAG | 20 | 20136 |
| CFTR-Intron10-1252 | + | AGCACUUUGGGAGGCUGAAG | 20 | 20137 |
| CFTR-Intron10-1253 | + | AAAAAAAAUUCACAAAUAAG | 20 | 20138 |
| CFTR-Intron10-1254 | − | AUGAAAUUAGAAAGAAUAAG | 20 | 20139 |
| CFTR-Intron10-1255 | − | AUCAAAAUAAAAAUAUAAG | 20 | 20140 |
| CFTR-Intron10-1256 | − | AUCAGUAGGCUUCCUAUAAG | 20 | 20141 |
| CFTR-Intron10-1257 | + | AUAUUAAUGGCUGUGCACAG | 20 | 20142 |
| CFTR-Intron10-1258 | + | UCACCUAGGCUAGGGUACAG | 20 | 20143 |
| CFTR-Intron10-1259 | + | UUCUGUUUAAAACUCUCCAG | 20 | 20144 |
| CFTR-Intron10-1260 | + | AGAAGGAAAGGAGGUAGCAG | 20 | 20145 |
| CFTR-Intron10-1261 | + | UGCUUGAGCCCGGGAGGCAG | 20 | 20146 |
| CFTR-Intron10-1262 | − | CCUAGCACUUUUGGAGGCAG | 20 | 20147 |
| CFTR-Intron10-1263 | + | UUUCAACAUAUGAAUGGCAG | 20 | 20148 |
| CFTR-Intron10-1264 | + | UCACCCAGGCUAGAGUGCAG | 20 | 20149 |
| CFTR-Intron10-1265 | − | UCGCCCAGGCUGGAGUGCAG | 20 | 20150 |
| CFTR-Intron10-1266 | − | UGGUGUCAGGCUGGGUGCAG | 20 | 20151 |
| CFTR-Intron10-1267 | − | AGGAAUGUUAAUUUAUUCAG | 20 | 20152 |

TABLE 40D-continued

4th Tier

| gRNA Name | DNA Strand | Targeting Domain | Target Site Length | Seq ID |
|---|---|---|---|---|
| CFTR-Intron10-1268 | − | UCACCCAGGCUGAACUUCAG | 20 | 20153 |
| CFTR-Intron10-1269 | − | ACAAACAGAAAAAGAAAGAG | 20 | 20154 |
| CFTR-Intron10-1270 | − | AAAAAAUUAUACUAUAGGAG | 20 | 20155 |
| CFTR-Intron10-1271 | + | ACUAAUAGCCUAUUGUUGAG | 20 | 20156 |
| CFTR-Intron10-1272 | − | CAGUAAAAGUGAUCUCUAG | 20 | 20157 |
| CFTR-Intron10-1273 | + | AAAAAAUUAGCCGGGCGUAG | 20 | 20158 |
| CFTR-Intron10-1274 | − | AAGAAGAGAAAGGGGUGUAG | 20 | 20159 |
| CFTR-Intron10-1275 | + | UUUGUUUGUGUUUUUUGUAG | 20 | 20160 |
| CFTR-Intron10-1276 | − | AAAUGUGAGAAAAAGUUUAG | 20 | 20161 |
| CFTR-Intron10-1277 | + | CGGAGAUGAUUAGCAUCACG | 20 | 20162 |
| CFTR-Intron10-1278 | − | UUGUAUUUUUAGUAGAGACG | 20 | 20163 |
| CFTR-Intron10-1279 | + | CCCAACACUUUGGGAGGCCG | 20 | 20164 |
| CFTR-Intron10-1280 | + | CCCAGCACUUUGGGAGGCCG | 20 | 20165 |
| CFTR-Intron10-1281 | − | CCAGGAGUUUGAGACCAGCG | 20 | 20166 |
| CFTR-Intron10-1282 | + | AGUAAAAAAAAUCAAAAGG | 20 | 20167 |
| CFTR-Intron10-1283 | + | AAACUGAGUAGAAGGAAAGG | 20 | 20168 |
| CFTR-Intron10-1284 | − | UGGUUUGAAGAACAGUAAGG | 20 | 20169 |
| CFTR-Intron10-1285 | − | UUUGAACAAAGACUUGCAGG | 20 | 20170 |
| CFTR-Intron10-1286 | + | AGCACUUUGGGAGGCCGAGG | 20 | 20171 |
| CFTR-Intron10-1287 | + | AAUGGCGUGAACCCGGGAGG | 20 | 20172 |
| CFTR-Intron10-1288 | − | AGCUACUUGGGAGGCUGAGG | 20 | 20173 |
| CFTR-Intron10-1289 | − | UUAAAAAAUUAUACUAUAGG | 20 | 20174 |
| CFTR-Intron10-1290 | − | UGAGGAAGAAAGGAAGUAGG | 20 | 20175 |
| CFTR-Intron10-1291 | + | AUGAAACAGGCCGGGCGCGG | 20 | 20176 |
| CFTR-Intron10-1292 | − | AAGGUGAUGGUAUUGCAGGG | 20 | 20177 |
| CFTR-Intron10-1293 | + | CUUUGGGAGGCCGAGGCGGG | 20 | 20178 |
| CFTR-Intron10-1294 | − | CGUAGUCCCAGCUACUCGGG | 20 | 20179 |
| CFTR-Intron10-1295 | − | ACUUGGGAGGCUGAGGUGGG | 20 | 20180 |
| CFTR-Intron10-1296 | + | UGUAGUCCCAGCUACUUGGG | 20 | 20181 |
| CFTR-Intron10-1297 | + | UGUAAUCCCAACACUUUGGG | 20 | 20182 |
| CFTR-Intron10-1298 | + | UAUAACCCAGCACUUUGGG | 20 | 20183 |
| CFTR-Intron10-1299 | + | UGUAAUCCCAGCACUUUGGG | 20 | 20184 |
| CFTR-Intron10-1300 | − | UGCAGGGUGGGGCCUUUGGG | 20 | 20185 |
| CFTR-Intron10-1301 | − | AAAUUAGCCAGACGUGAUGG | 20 | 20186 |
| CFTR-Intron10-1302 | + | UUUAUUUCUCACAGUUCUGG | 20 | 20187 |
| CFTR-Intron10-1303 | − | CACCUGAGCCUGAGAAGUGG | 20 | 20188 |
| CFTR-Intron10-1304 | − | CCCAGGCUGGAGUGCAGUGG | 20 | 20189 |
| CFTR-Intron10-1305 | + | AAAUUAGCCGGGCGUAGUGG | 20 | 20190 |

TABLE 40D-continued

| 4th Tier | | | | |
|---|---|---|---|---|
| gRNA Name | DNA Strand | Targeting Domain | Target Site Length | Seq ID |
| CFTR-Intron10-1306 | - | AAGAAAAUAGCUGGGUGUGG | 20 | 20191 |
| CFTR-Intron10-1307 | + | UAUUCAAAAAAUAUUGUGG | 20 | 20192 |
| CFTR-Intron10-1308 | - | UGUAAUCCUAGCACUUUUGG | 20 | 20193 |
| CFTR-Intron10-1309 | - | AGGAAUUUUAUAUAGAAAUG | 20 | 20194 |
| CFTR-Intron10-1310 | + | AUAAACAAACAAAGGAAAUG | 20 | 20195 |
| CFTR-Intron10-1311 | - | AAGGAAGAAAGAAGGAAAUG | 20 | 20196 |
| CFTR-Intron10-1312 | - | UGGGAGGUGAUUAGUCCAUG | 20 | 20197 |
| CFTR-Intron10-1313 | - | CCCAGCUACUCGGGAGGCUG | 20 | 20198 |
| CFTR-Intron10-1314 | + | CCCAGCUACUUGGGAGGCUG | 20 | 20199 |
| CFTR-Intron10-1315 | + | AUACAAAAAUUAGCUGAGUG | 20 | 20200 |
| CFTR-Intron10-1316 | + | UUGUGUUUUUUGUAGAGGUG | 20 | 20201 |
| CFTR-Intron10-1317 | - | ACAAAGACUUGCAGGAGGUG | 20 | 20202 |
| CFTR-Intron10-1318 | + | CCCAGCUACUUGGGAGGGUG | 20 | 20203 |
| CFTR-Intron10-1319 | + | UCACAUGGCAGAAAGGGGUG | 20 | 20204 |
| CFTR-Intron10-1320 | - | CAAAAGAAAAUAGCUGGGUG | 20 | 20205 |
| CFTR-Intron10-1321 | + | ACAAAAUACCAUGAACUGUG | 20 | 20206 |
| CFTR-Intron10-1322 | - | AUUUUUAUAAAAAAUAAUUG | 20 | 20207 |
| CFTR-Intron10-1323 | + | AUCUAUUCAAAAAAUAUUUG | 20 | 20208 |
| CFTR-Intron10-1324 | - | AAUACAUUGGAAAAUUUUUG | 20 | 20209 |
| CFTR-Intron10-1325 | - | UAUUAGUAGUUAAGUUUUUG | 20 | 20210 |
| CFTR-Intron10-1326 | + | AUAGUAGCAAAUGAUAAAAU | 20 | 20211 |
| CFTR-Intron10-1327 | + | UCUCUAUUUGGAUGUCAAAU | 20 | 20212 |
| CFTR-Intron10-1328 | + | AAUAAACAAACAAAGGAAAU | 20 | 20213 |
| CFTR-Intron10-1329 | - | UAAGGUUUCCACUCAACAAU | 20 | 20214 |
| CFTR-Intron10-1330 | + | UUUACCAUUAUCUACACAAU | 20 | 20215 |
| CFTR-Intron10-1331 | - | CCCCAUAAAUGUUGAAUAAU | 20 | 20216 |
| CFTR-Intron10-1332 | - | UUUUUUUUCAGUUAAUACAU | 20 | 20217 |
| CFTR-Intron10-1333 | + | UUUUACAAUUCUUAUUACAU | 20 | 20218 |
| CFTR-Intron10-1334 | - | AAUACAGGCUUGAACUGCAU | 20 | 20219 |
| CFTR-Intron10-1335 | - | UGUACCCUAGCCUAGGUGAU | 20 | 20220 |
| CFTR-Intron10-1336 | + | AAAAAUAUAUAUAUGCAUAU | 20 | 20221 |
| CFTR-Intron10-1337 | - | CUAUUAAAAAAUUAUACUAU | 20 | 20222 |
| CFTR-Intron10-1338 | - | UUCUCCCUGUUAUUCCUUAU | 20 | 20223 |
| CFTR-Intron10-1339 | - | UAAAAGUUUCUCAUCUUAU | 20 | 20224 |
| CFTR-Intron10-1340 | - | UCCCAAAGUGCUGGGUUUAU | 20 | 20225 |
| CFTR-Intron10-1341 | + | UUCUCAGACUUUUAUUUUAU | 20 | 20226 |
| CFTR-Intron10-1342 | + | AGUUUCCAAAUUUUUUUUAU | 20 | 20227 |

TABLE 40D-continued

4th Tier

| gRNA Name | DNA Strand | Targeting Domain | Target Site Length | Seq ID |
|---|---|---|---|---|
| CFTR-Intron10-1343 | − | UGCCCGUAGUCCCAGCUACU | 20 | 20228 |
| CFTR-Intron10-1344 | + | CGCCUGUAGUCCCAGCUACU | 20 | 20229 |
| CFTR-Intron10-1345 | + | UGCCUGUAGUCCCAGCUACU | 20 | 17606 |
| CFTR-Intron10-1346 | + | ACCCUGCAAUACCAUCACCU | 20 | 20230 |
| CFTR-Intron10-1347 | + | CCGCCACUGCACUCCAGCCU | 20 | 20231 |
| CFTR-Intron10-1348 | + | ACACCACUGAAGUUCAGCCU | 20 | 20232 |
| CFTR-Intron10-1349 | − | ACCUCGUGAUCCGCCCGCCU | 20 | 20233 |
| CFTR-Intron10-1350 | − | ACCUCAUGAUCUGCCUGCCU | 20 | 20234 |
| CFTR-Intron10-1351 | − | CACUGUAACCUUGAACUCCU | 20 | 20235 |
| CFTR-Intron10-1352 | + | CACUGCAAGUUCUGCCUCCU | 20 | 20236 |
| CFTR-Intron10-1353 | − | ACAAACAAAGAAAAUAGCU | 20 | 20237 |
| CFTR-Intron10-1354 | − | CCUCACCCUCCCAAGUAGCU | 20 | 20238 |
| CFTR-Intron10-1355 | + | CCUCAGCCUCCCAAGUAGCU | 20 | 20239 |
| CFTR-Intron10-1356 | + | CCUCAGCCUCCCGAGUAGCU | 20 | 20240 |
| CFTR-Intron10-1357 | + | UUCUCACAGUUCUGGAGGCU | 20 | 20241 |
| CFTR-Intron10-1358 | + | CCUCUGCCUCCAAAAGUGCU | 20 | 20242 |
| CFTR-Intron10-1359 | − | CUUCAGCCUCCCAAAGUGCU | 20 | 20243 |
| CFTR-Intron10-1360 | − | CCUCGGCCUCCCAAAGUGCU | 20 | 20244 |
| CFTR-Intron10-1361 | − | AAGAAAAAGUUGAGUUGCU | 20 | 20245 |
| CFTR-Intron10-1362 | + | AGAGUGCAGUGGCGCGAUCU | 20 | 20246 |
| CFTR-Intron10-1363 | − | AUCUGCUGGCACCUUGAUCU | 20 | 20247 |
| CFTR-Intron10-1364 | − | AAAGCUGUGCAUUUUCCUCU | 20 | 20248 |
| CFTR-Intron10-1365 | + | AUAUAGAGAGAAACAUCUCU | 20 | 20249 |
| CFTR-Intron10-1366 | + | AUAUUUUUCAUUAUGAUUCU | 20 | 20250 |
| CFTR-Intron10-1367 | + | UUAAUUUUCUCGGUAUUUCU | 20 | 20251 |
| CFTR-Intron10-1368 | + | UUACUUUUCUUAAUUUUCU | 20 | 20252 |
| CFTR-Intron10-1369 | − | AAAUGAGGAAGAAAGGAAGU | 20 | 20253 |
| CFTR-Intron10-1370 | − | UGGAUUUUUGACUAUACAGU | 20 | 20254 |
| CFTR-Intron10-1371 | − | ACAUCUGCAAUUGUAUCAGU | 20 | 20255 |
| CFTR-Intron10-1372 | − | AUCCAAAUAGAGAUGUUAGU | 20 | 20256 |
| CFTR-Intron10-1373 | − | CAGGAGUUUGAGACCAGCGU | 20 | 20257 |
| CFTR-Intron10-1374 | + | UUUGUGUUUUUUGUAGAGGU | 20 | 20258 |
| CFTR-Intron10-1375 | − | AGGUGAUGGUAUUGCAGGGU | 20 | 20259 |
| CFTR-Intron10-1376 | + | UGAAUGGUGCCAGGUAGGGU | 20 | 20260 |
| CFTR-Intron10-1377 | − | UUUUUGACUAUACAGUGGGU | 20 | 20261 |
| CFTR-Intron10-1378 | − | AUAAGAAGAGAAAGGGUGU | 20 | 20262 |
| CFTR-Intron10-1379 | − | AAAUUUCCACUCAAUAAAUU | 20 | 20263 |
| CFTR-Intron10-1380 | + | AUACCAUCACCUUGGGAAUU | 20 | 20264 |

TABLE 40D-continued

4th Tier

| gRNA Name | DNA Strand | Targeting Domain | Target Site Length | Seq ID |
|---|---|---|---|---|
| CFTR-Intron10-1381 | - | AUGGUACUACUGUAAUAAUU | 20 | 20265 |
| CFTR-Intron10-1382 | - | AAUCACUAUUGAUUGACAUU | 20 | 20266 |
| CFTR-Intron10-1383 | - | UUUUAUUCUUUUUAGAGAUU | 20 | 20267 |
| CFTR-Intron10-1384 | - | CUUGCAGGAGGUGAGGGAUU | 20 | 20268 |
| CFTR-Intron10-1385 | - | UGAUACUUUUCUUCCUGAUU | 20 | 20269 |
| CFTR-Intron10-1386 | + | AUAGAAGUAGAAGAACUAUU | 20 | 20270 |
| CFTR-Intron10-1387 | - | UCUUUUUCAUUGAAUGUAUU | 20 | 20271 |
| CFTR-Intron10-1388 | + | UCUGUUUGUCUUAGAUUAUU | 20 | 20272 |
| CFTR-Intron10-1389 | - | AUUUCCUUUGUUUGUUUAUU | 20 | 20273 |
| CFTR-Intron10-1390 | + | UCUCAGACUUUUAUUUUAUU | 20 | 20274 |
| CFTR-Intron10-1391 | + | UGCCUGUAAUCCCAACACUU | 20 | 20275 |
| CFTR-Intron10-1392 | + | UGCCUAUAAACCCAGCACUU | 20 | 20276 |
| CFTR-Intron10-1393 | + | CGCCUGUAAUCCCAGCACUU | 20 | 20277 |
| CFTR-Intron10-1394 | - | AAGAAUUGAAUAUGAGACUU | 20 | 20278 |
| CFTR-Intron10-1395 | + | CCCUGCAAUACCAUCACCUU | 20 | 20279 |
| CFTR-Intron10-1396 | + | AAAAUGUUAAAUUUUCCCUU | 20 | 20280 |
| CFTR-Intron10-1397 | + | AUUUCCCUUAGGAUAUCUU | 20 | 20281 |
| CFTR-Intron10-1398 | - | CUUUUAGUUAGCAUAAAGUU | 20 | 20282 |
| CFTR-Intron10-1399 | - | AGGAAGCAAGGAGAUGAGUU | 20 | 20283 |
| CFTR-Intron10-1400 | - | CCUCGGCCUCCCAAAGUGUU | 20 | 20284 |
| CFTR-Intron10-1401 | - | AGUUGUUAUCUCUGAAAUUU | 20 | 20285 |
| CFTR-Intron10-1402 | - | UUAUCAAUAUUUUGGAAUUU | 20 | 20286 |
| CFTR-Intron10-1403 | - | AUCACUAUUGAUUGACAUUU | 20 | 20287 |
| CFTR-Intron10-1404 | + | AUCAAGGUGCCAGCAGAUUU | 20 | 20288 |
| CFTR-Intron10-1405 | - | AAAUAGUUUUAUCAAUAUUU | 20 | 20289 |
| CFTR-Intron10-1406 | - | CAUCAUUAUUCAUGAUAUUU | 20 | 20290 |
| CFTR-Intron10-1407 | - | CUUUUUCAUUGAAUGUAUUU | 20 | 20291 |
| CFTR-Intron10-1408 | - | ACUUGUAAUCCUAGCACUUU | 20 | 20292 |
| CFTR-Intron10-1409 | - | UAUUGCAGGGUGGGGCCUUU | 20 | 20293 |
| CFTR-Intron10-1410 | - | AAAUUUAACUGAAUAUCUUU | 20 | 20294 |
| CFTR-Intron10-1411 | - | UUAAUACAUUGGAAAAUUUU | 20 | 20295 |
| CFTR-Intron10-1412 | - | UAUCAAUAUUUUGGAAUUUU | 20 | 20296 |
| CFTR-Intron10-1413 | - | UAAUACAUUGGAAAAUUUUU | 20 | 20297 |

Table 41A provides exemplary targeting domains for correcting a mutation (e.g., 3272-26→G) in the CFTR gene selected according to the first tier parameters. The targeting domains bind within intron 10, have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 41A

1st Tier

| gRNA Name | DNA Strand | Targeting Domain | Target Site Length | Seq ID |
|---|---|---|---|---|
| CFTR-Intron10-1414 | + | GAUAAUACUACUGACUAAAA | 20 | 20298 |
| CFTR-Intron10-1415 | + | GUAACUCCAGUGCUAUUUAAA | 21 | 20299 |
| CFTR-Intron10-1416 | + | GGUAACUCCAGUGCUAUUUAAA | 22 | 20300 |
| CFTR-Intron10-1417 | + | GACUCCAGGAGUAUAUCAA | 19 | 20301 |
| CFTR-Intron10-1418 | + | GGACUCCAGGAGUAUAUCAA | 20 | 20302 |
| CFTR-Intron10-1419 | + | GUGGACUCCAGGAGUAUAUCAA | 22 | 20303 |
| CFTR-Intron10-1420 | + | GAUGAGAGACAGUAAAGAA | 19 | 20304 |
| CFTR-Intron10-1421 | + | GCUAUUUUUGCACAUCUAUCA | 21 | 20305 |
| CFTR-Intron10-1422 | + | GCUACCUUGGUUGGAUGA | 18 | 20306 |
| CFTR-Intron10-1423 | + | GGCUACCUUGGUUGGAUGA | 19 | 20307 |
| CFTR-Intron10-1424 | + | GAUUGGCUACCUUGGUUGGAUGA | 23 | 20308 |
| CFTR-Intron10-1425 | + | GGAUUGGCUACCUUGGUUGGAUGA | 24 | 20309 |
| CFTR-Intron10-1426 | + | GAAUAUCCAUCCAUAUGA | 18 | 20310 |
| CFTR-Intron10-1427 | + | GUUACAACAGUCUUUAUA | 18 | 20311 |
| CFTR-Intron10-1428 | + | GUUCAACUUAUCCAUUAAUCCUA | 23 | 20312 |
| CFTR-Intron10-1429 | + | GAUACAAAUUACCAAAUUGUA | 21 | 20313 |
| CFTR-Intron10-1430 | + | GCACCCAGCCUGACACCAAAUUUA | 24 | 20314 |
| CFTR-Intron10-1431 | + | GUACAAAUAUUGACUAUUUA | 20 | 20315 |
| CFTR-Intron10-1432 | + | GCAAGUACAAAUAUUGACUAUUUA | 24 | 20316 |
| CFTR-Intron10-1433 | + | GAGCUCAUAUUAGUGAAC | 18 | 20317 |
| CFTR-Intron10-1434 | + | GAUACUAAAAAAGUUAC | 18 | 20318 |
| CFTR-Intron10-1435 | + | GUAUUAGCAAGUGGACUCC | 19 | 20319 |
| CFTR-Intron10-1436 | + | GCACUCUAUUUAGAGUGUAUGGC | 23 | 20320 |
| CFTR-Intron10-1437 | + | GAAAAGGCUCUUUAUAAUGC | 20 | 20321 |
| CFTR-Intron10-1438 | + | GCUAAGAGACUCCUGAAUC | 19 | 20322 |
| CFTR-Intron10-1439 | + | GUCUGCUAAGAGACUCCUGAAUC | 23 | 20323 |
| CFTR-Intron10-1440 | + | GGUCUGCUAAGAGACUCCUGAAUC | 24 | 20324 |
| CFTR-Intron10-1441 | + | GUAGAAGACCUAAAUAUC | 18 | 20325 |
| CFTR-Intron10-1442 | + | GAUGUAGAAGACCUAAAUAUC | 21 | 20326 |
| CFTR-Intron10-1443 | + | GAAGAUGUAGAAGACCUAAAUAUC | 24 | 20327 |
| CFTR-Intron10-1444 | + | GGGUCUGCUAAGAGACUC | 18 | 20328 |
| CFTR-Intron10-1445 | + | GAUUUGGGUCUGCUAAGAGACUC | 23 | 20329 |
| CFTR-Intron10-1446 | + | GAUAUUUUCAUUAUGAUUC | 20 | 20330 |
| CFTR-Intron10-94 | + | GCUUGACAUCAGUUGGGUUC | 20 | 18980 |
| CFTR-Intron10-1447 | + | GAUAAAUAAUUGCCUUUC | 18 | 20331 |
| CFTR-Intron10-1448 | + | GAUAUUGAUAAAUAAUUGCCUUUC | 24 | 20332 |
| CFTR-Intron10-1449 | + | GUUGGAUGAGGGAAUGCAG | 19 | 20333 |

TABLE 41A-continued

| | | 1st Tier | | |
|---|---|---|---|---|
| gRNA Name | DNA Strand | Targeting Domain | Target Site Length | Seq ID |
| CFTR-Intron10-1450 | + | GGUUGGAUGAGGGAAUGCAG | 20 | 20334 |
| CFTR-Intron10-1451 | + | GAAUUGAUCUUGAAGACAUACG | 22 | 20335 |
| CFTR-Intron10-1452 | + | GCCUAGAUGAUUAUUAAUAGGG | 22 | 20336 |
| CFTR-Intron10-1453 | + | GUUAAGUUGUUCUUAGGG | 18 | 20337 |
| CFTR-Intron10-1454 | + | GGUUAAGUUGUUCUUAGGG | 19 | 20338 |
| CFTR-Intron10-1455 | + | GCCAGGUUAAGUUGUUCUUAGGG | 23 | 20339 |
| CFTR-Intron10-1456 | + | GUUACCUGGAUUGGCUACCUUGG | 23 | 20340 |
| CFTR-Intron10-1457 | + | GGAAAUGGGGUAUAAGUG | 18 | 20341 |
| CFTR-Intron10-107 | + | GUUACAUAAAAAGAGAGGUG | 20 | 18993 |
| CFTR-Intron10-1458 | + | GCUAAUAGCUUAUUCUAUACAU | 22 | 20342 |
| CFTR-Intron10-1459 | + | GAGCUAAUAGCUUAUUCUAUACAU | 24 | 20343 |
| CFTR-Intron10-1460 | + | GAAUAAUGAUGUACAUUUAAUAU | 23 | 20344 |
| CFTR-Intron10-1461 | + | GUAAUGGAAACACUAUAUAU | 20 | 20345 |
| CFTR-Intron10-1462 | + | GUACAUCCAACUAACAUCUCUAU | 23 | 20346 |
| CFTR-Intron10-1463 | + | GGAAAAUGUUAAAUUUUCCCU | 21 | 20347 |
| CFTR-Intron10-1464 | + | GCACUUGUUGACAGUCCU | 18 | 20348 |
| CFTR-Intron10-1465 | + | GGCACUUGUUGACAGUCCU | 19 | 20349 |
| CFTR-Intron10-1466 | + | GCUAGGCACUUGUUGACAGUCCU | 23 | 20350 |
| CFTR-Intron10-117 | + | GUUACUCAGUCCAGAAAGCU | 20 | 19003 |
| CFTR-Intron10-1467 | + | GUGCAAGUCCUCUGUGCU | 18 | 20351 |
| CFTR-Intron10-1468 | + | GCCAGGUUAAGUUGUUCU | 18 | 20352 |
| CFTR-Intron10-1469 | + | GAGGGUCUCUCUAAGGUGU | 19 | 20353 |
| CFTR-Intron10-1470 | + | GUGAGGGUCUCUCUAAGGUGU | 21 | 20354 |
| CFTR-Intron10-1471 | + | GGUGAGGGUCUCUCUAAGGUGU | 22 | 20355 |
| CFTR-Intron10-1472 | + | GGGUGAGGGUCUCUCUAAGGUGU | 23 | 20356 |
| CFTR-Intron10-1473 | + | GGGGUGAGGGUCUCUCUAAGGUGU | 24 | 20357 |
| CFTR-Intron10-1474 | + | GGAAAUCAGCACUCUAUU | 18 | 20358 |
| CFTR-Intron10-1475 | + | GGGAAAUCAGCACUCUAUU | 19 | 20359 |
| CFTR-Intron10-1476 | + | GGGGAAAUCAGCACUCUAUU | 20 | 20360 |
| CFTR-Intron10-1477 | + | GUGGGGAAAUCAGCACUCUAUU | 22 | 20361 |
| CFTR-Intron10-1478 | + | GUAACUCUUUAUUCACUU | 18 | 20362 |
| CFTR-Intron10-1479 | − | GCUUUCAGGAGCCAAAAA | 18 | 20363 |
| CFTR-Intron10-1480 | − | GAUAAGAUUCUAAAGGAAA | 19 | 20364 |
| CFTR-Intron10-1481 | − | GGAUAAGAUUCUAAAGGAAA | 20 | 20365 |
| CFTR-Intron10-1482 | − | GCUGGAUAAGAUUCUAAAGGAAA | 23 | 20366 |
| CFTR-Intron10-1483 | − | GGCUGGAUAAGAUUCUAAAGGAAA | 24 | 20367 |
| CFTR-Intron10-1484 | − | GUACUCAUGCCAUACACUCUAAA | 23 | 20368 |

TABLE 41A-continued

| | 1st Tier | | | |
|---|---|---|---|---|
| gRNA Name | DNA Strand | Targeting Domain | Target Site Length | Seq ID |
| CFTR-Intron10-1485 | - | GCUUUGAAGGAAGAUCCAA | 19 | 20369 |
| CFTR-Intron10-1486 | - | GGAGAACCAUAUUUUGAAGAA | 21 | 20370 |
| CFTR-Intron10-1487 | - | GAGGAGAACCAUAUUUUGAAGAA | 23 | 20371 |
| CFTR-Intron10-1488 | - | GGGUUGAUAAGAAGAGAA | 18 | 20372 |
| CFTR-Intron10-68 | - | GAGGGUUGAUAAGAAGAGAA | 20 | 18954 |
| CFTR-Intron10-1489 | - | GAAAGAGGGUUGAUAAGAAGAGAA | 24 | 20373 |
| CFTR-Intron10-1490 | - | GUACUUGCUCUCUGACCACAUAA | 23 | 20374 |
| CFTR-Intron10-1491 | - | GUAUAUGAUAUACUCUUAA | 19 | 20375 |
| CFTR-Intron10-1492 | - | GAUGUAUAUGAUAUACUCUUAA | 22 | 20376 |
| CFTR-Intron10-1493 | - | GGAUGUAUAUGAUAUACUCUUAA | 23 | 20377 |
| CFTR-Intron10-1494 | - | GUAUAGAAUUUUGCAUCA | 18 | 20378 |
| CFTR-Intron10-1495 | - | GGUAGUAAUUGUGUUUCA | 18 | 20379 |
| CFTR-Intron10-1496 | - | GAAAAGGUAGUAAUUGUGUUUCA | 23 | 20380 |
| CFTR-Intron10-1497 | - | GAUCUAGCUAAAAUAUAAGA | 20 | 20381 |
| CFTR-Intron10-1498 | - | GAUUCCAAGCUUUCUGGA | 18 | 20382 |
| CFTR-Intron10-1499 | - | GAUAUACUCUUAAGUGAAUA | 20 | 20383 |
| CFTR-Intron10-1500 | - | GAUGGAUAUUCUAUGAUAUA | 20 | 20384 |
| CFTR-Intron10-1501 | - | GGAUGGAUAUUCUAUGAUAUA | 21 | 20385 |
| CFTR-Intron10-1502 | - | GUUUUUGCUUGCUUUUUAUA | 20 | 20386 |
| CFTR-Intron10-1503 | - | GUCUGAGAAGACAAAGCUA | 19 | 20387 |
| CFTR-Intron10-1504 | - | GUAAUCGGCGGUGGAGGUA | 19 | 20388 |
| CFTR-Intron10-1505 | - | GAAGUAAUCGGCGGUGGAGGUA | 22 | 20389 |
| CFTR-Intron10-1506 | - | GAGAAGUAAUCGGCGGUGGAGGUA | 24 | 20390 |
| CFTR-Intron10-1507 | - | GAUCAUUGCCUCACUAUGGUA | 21 | 20391 |
| CFTR-Intron10-1508 | - | GUAAUAACUGGGACUCAUAUGUA | 23 | 20392 |
| CFTR-Intron10-1509 | - | GAAGAUCCAAUAGGAUUA | 18 | 20393 |
| CFTR-Intron10-1510 | - | GGAAGAUCCAAUAGGAUUA | 19 | 20394 |
| CFTR-Intron10-1511 | - | GAAGGAAGAUCCAAUAGGAUUA | 22 | 20395 |
| CFTR-Intron10-1512 | - | GCAGGAGGUGAGGGAUUA | 18 | 20396 |
| CFTR-Intron10-1513 | - | GUUAGCAAUGGUCUAAAC | 18 | 20397 |
| CFTR-Intron10-1514 | - | GAUUCUGUUUAAAUAGCAC | 19 | 20398 |
| CFTR-Intron10-1515 | - | GAGAAGGUCAAACUUGAC | 18 | 20399 |
| CFTR-Intron10-1516 | - | GUAGAGAAGGUCAAACUUGAC | 21 | 20400 |
| CFTR-Intron10-1517 | - | GCCUUAUUCUUUUGAUAUACCC | 23 | 20401 |
| CFTR-Intron10-1518 | - | GUCUUGCGCUUAUGAAACUUCC | 22 | 20402 |
| CFTR-Intron10-1519 | - | GCUUUUAAAACAAAAUAGC | 19 | 20403 |
| CFTR-Intron10-1520 | - | GGAAGACAGCUGGCUAUC | 18 | 20404 |

TABLE 41A-continued

1st Tier

| gRNA Name | DNA Strand | Targeting Domain | Target Site Length | Seq ID |
|---|---|---|---|---|
| CFTR-Intron10-1521 | - | GCAGGAAGACAGCUGGCUAUC | 21 | 20405 |
| CFTR-Intron10-1522 | - | GCUGGCUAUCCAGGAUUC | 18 | 20406 |
| CFTR-Intron10-1523 | - | GACAGCUGGCUAUCCAGGAUUC | 22 | 20407 |
| CFTR-Intron10-1524 | - | GUUCUGUAAUUUUUGCUUC | 19 | 20408 |
| CFTR-Intron10-1525 | - | GGUUCUGUAAUUUUUGCUUC | 20 | 20409 |
| CFTR-Intron10-1526 | - | GACUUUGUAGUGAUCUUC | 18 | 20410 |
| CFTR-Intron10-1527 | - | GAAGACUUUGUAGUGAUCUUC | 21 | 20411 |
| CFTR-Intron10-1528 | - | GAGAAGACUUUGUAGUGAUCUUC | 23 | 20412 |
| CFTR-Intron10-1529 | - | GGAGAAGACUUUGUAGUGAUCUUC | 24 | 20413 |
| CFTR-Intron10-1530 | - | GCUUUUCAAAAUACUUUC | 18 | 20414 |
| CFTR-Intron10-1531 | - | GAAGCUUUUCAAAAUACUUUC | 21 | 20415 |
| CFTR-Intron10-1532 | - | GUAACAGUACAAGAAAAAG | 20 | 20416 |
| CFTR-Intron10-99 | - | GCAUAUGAGAAAAGUCACAG | 20 | 18985 |
| CFTR-Intron10-1533 | - | GGCAUAUGAGAAAAGUCACAG | 21 | 20417 |
| CFTR-Intron10-1534 | - | GAACCCAACUGAUGUCAAGCAG | 22 | 20418 |
| CFTR-Intron10-1535 | - | GGAACCCAACUGAUGUCAAGCAG | 23 | 20419 |
| CFTR-Intron10-1536 | - | GUAUUAGAGGUUAAGGAG | 18 | 20420 |
| CFTR-Intron10-1537 | - | GUCUUUUCCUCUUAAUAG | 18 | 20421 |
| CFTR-Intron10-1538 | - | GAAGUCUUUUCCUCUUAAUAG | 21 | 20422 |
| CFTR-Intron10-1539 | - | GAAAAGCAGCUAUGAAGG | 18 | 20423 |
| CFTR-Intron10-1540 | - | GCUUAUGAAAAGCAGCUAUGAAGG | 24 | 20424 |
| CFTR-Intron10-1541 | - | GGCAUAGAGUAAGACAGG | 18 | 20425 |
| CFTR-Intron10-1542 | - | GCUGGCAUAGAGUAAGACAGG | 21 | 20426 |
| CFTR-Intron10-1543 | - | GGCUGGCAUAGAGUAAGACAGG | 22 | 20427 |
| CFTR-Intron10-1544 | - | GAGGCUGGCAUAGAGUAAGACAGG | 24 | 20428 |
| CFTR-Intron10-1545 | - | GGUAGUGUGAAGAUGGGG | 18 | 20429 |
| CFTR-Intron10-1546 | - | GCUGGUAGUGUGAAGAUGGGG | 21 | 20430 |
| CFTR-Intron10-1547 | - | GGCUGGUAGUGUGAAGAUGGGG | 22 | 20431 |
| CFTR-Intron10-1548 | - | GGGCUGGUAGUGUGAAGAUGGGG | 23 | 20432 |
| CFTR-Intron10-1549 | - | GGGGCUGGUAGUGUGAAGAUGGGG | 24 | 20433 |
| CFTR-Intron10-1550 | - | GGGAAUGCAGACUCUGGG | 18 | 20434 |
| CFTR-Intron10-1551 | - | GAUUAGGGAAUGCAGACUCUGGG | 23 | 20435 |
| CFTR-Intron10-1552 | - | GGAUUAGGGAAUGCAGACUCUGGG | 24 | 20436 |
| CFTR-Intron10-1553 | - | GGGGGAGCCCCAUAAAUG | 18 | 20437 |
| CFTR-Intron10-1554 | - | GUGGGGGAGCCCCAUAAAUG | 20 | 20438 |
| CFTR-Intron10-1555 | - | GUGAGAUUAGAGGCCACUG | 19 | 20439 |
| CFTR-Intron10-1556 | - | GGUGAGAUUAGAGGCCACUG | 20 | 20440 |

TABLE 41A-continued

| | 1st Tier | | | |
|---|---|---|---|---|
| gRNA Name | DNA Strand | Targeting Domain | Target Site Length | Seq ID |
| CFTR-Intron10-1557 | - | GCACAUAUGUUCAGACUG | 18 | 20441 |
| CFTR-Intron10-1558 | - | GACUUGCACAUAUGUUCAGACUG | 23 | 20442 |
| CFTR-Intron10-1559 | - | GGACUUGCACAUAUGUUCAGACUG | 24 | 20443 |
| CFTR-Intron10-1560 | - | GCAUCUCACCAGUGUGUG | 18 | 20444 |
| CFTR-Intron10-1561 | - | GGCAUCUCACCAGUGUGUG | 19 | 20445 |
| CFTR-Intron10-1562 | - | GAGGAGAACCAUAUUUG | 18 | 20446 |
| CFTR-Intron10-1563 | - | GAUGAGGAGAACCAUAUUUG | 21 | 20447 |
| CFTR-Intron10-1564 | - | GCCCCAUAAAUGUUGAAUAAU | 21 | 20448 |
| CFTR-Intron10-1565 | - | GAGCCCCAUAAAUGUUGAAUAAU | 23 | 20449 |
| CFTR-Intron10-1566 | - | GGAGCCCCAUAAAUGUUGAAUAAU | 24 | 20450 |
| CFTR-Intron10-1567 | - | GAUUUUUUCCCAUGUAAU | 18 | 20451 |
| CFTR-Intron10-1568 | - | GAAUCACUAUUGAUUGACAU | 20 | 20452 |
| CFTR-Intron10-1569 | - | GUAGUUUCUAUUAAUAGAU | 19 | 20453 |
| CFTR-Intron10-1570 | - | GUGUAGUUUCUAUUAAUAGAU | 21 | 20454 |
| CFTR-Intron10-1571 | - | GAAAGAGCUUUCUAGUAU | 18 | 20455 |
| CFTR-Intron10-1572 | - | GAGAAAGAGCUUUCUAGUAU | 20 | 20456 |
| CFTR-Intron10-1573 | - | GUUCAAAUUAUUUCUACUGCU | 21 | 20457 |
| CFTR-Intron10-1574 | - | GUUGUUCAAAUUAUUUCUACUGCU | 24 | 20458 |
| CFTR-Intron10-1575 | - | GUAAAGACUAAGGCUUAUUUCU | 22 | 20459 |
| CFTR-Intron10-1576 | - | GAUAAGAAGAGAAAGGGGUGU | 21 | 20460 |
| CFTR-Intron10-1577 | - | GUUGAUAAGAAGAGAAAGGGGUGU | 24 | 20461 |
| CFTR-Intron10-1578 | - | GUUGUUAUCUCUGAAAUU | 18 | 20462 |
| CFTR-Intron10-1579 | - | GCUAUUACGGUAAGCUCAAGCAUU | 24 | 20463 |
| CFTR-Intron10-1580 | - | GCUGCCUUUUAGUAGUAUU | 19 | 20464 |
| CFTR-Intron10-126 | - | GGCUGCCUUUUAGUAGUAUU | 20 | 19012 |
| CFTR-Intron10-1581 | - | GAGGCUGCCUUUUAGUAGUAUU | 22 | 20465 |
| CFTR-Intron10-1582 | - | GGAGGCUGCCUUUUAGUAGUAUU | 23 | 20466 |
| CFTR-Intron10-1583 | - | GAAUAGAUUAGCUUAUAUACUU | 22 | 20467 |
| CFTR-Intron10-1584 | - | GUUAGAGGAAGGCAGUGGUCCCUU | 24 | 20468 |
| CFTR-Intron10-1585 | - | GAUGUGCAAAAAUAGCUU | 18 | 20469 |
| CFTR-Intron10-1586 | - | GAUAGAUGUGCAAAAAUAGCUU | 22 | 20470 |
| CFTR-Intron10-1587 | - | GUUACAUGACCUUCCUUUCUU | 21 | 20471 |
| CFTR-Intron10-1588 | - | GAUAAUGGGAGAAACAGGUU | 20 | 20472 |
| CFTR-Intron10-1589 | - | GCACUGGAGUUACCUGUU | 18 | 20473 |
| CFTR-Intron10-1590 | - | GCAAAUAGUUUUAUCAAUAUUU | 22 | 20474 |
| CFTR-Intron10-1591 | - | GUUUUGGAUGGAGCUUGGUUU | 21 | 20475 |

TABLE 41A-continued

1st Tier

| gRNA Name | DNA Strand | Targeting Domain | Target Site Length | Seq ID |
|---|---|---|---|---|
| CFTR-Intron10-1592 | − | GGUUUUGGAUGGAGCUUGGUUU | 22 | 20476 |
| CFTR-Intron10-1593 | − | GUCCUCCACAAAUAUUUU | 18 | 20477 |

Table 41B provides exemplary targeting domains for correcting a mutation (e.g., 3272-26→G) in the CFTR gene selected according to the second tier parameters. The targeting domains bind within intron 10, have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 41B

2nd Tier

| gRNA Name | DNA Strand | Targeting Domain | Target Site Length | Seq ID |
|---|---|---|---|---|
| CFTR-Intron10-1594 | + | CAUAUGAUUUUAUGAAAA | 18 | 20478 |
| CFTR-Intron10-1595 | + | ACAUAUGAUUUUAUGAAAA | 19 | 20479 |
| CFTR-Intron10-1596 | + | UACAUAUGAUUUUAUGAAAA | 20 | 20480 |
| CFTR-Intron10-1597 | + | UAAUACUACUGACUAAAA | 18 | 20481 |
| CFTR-Intron10-1598 | + | AUAAUACUACUGACUAAAA | 19 | 20482 |
| CFTR-Intron10-1599 | + | ACUCCAGUGCUAUUUAAA | 18 | 20483 |
| CFTR-Intron10-1600 | + | AACUCCAGUGCUAUUUAAA | 19 | 20484 |
| CFTR-Intron10-1601 | + | UAACUCCAGUGCUAUUUAAA | 20 | 20485 |
| CFTR-Intron10-1602 | + | AGGUAACUCCAGUGCUAUUUAAA | 23 | 20486 |
| CFTR-Intron10-1603 | + | CAGGUAACUCCAGUGCUAUUUAAA | 24 | 20487 |
| CFTR-Intron10-1604 | + | ACUCCAGGAGUAUAUCAA | 18 | 20488 |
| CFTR-Intron10-1605 | + | UGGACUCCAGGAGUAUAUCAA | 21 | 20489 |
| CFTR-Intron10-1606 | + | AGUGGACUCCAGGAGUAUAUCAA | 23 | 20490 |
| CFTR-Intron10-1607 | + | AAGUGGACUCCAGGAGUAUAUCAA | 24 | 20491 |
| CFTR-Intron10-1608 | + | AUGAGAGACAGUAAAGAA | 18 | 20492 |
| CFTR-Intron10-1104 | + | AGAUGAGAGACAGUAAAGAA | 20 | 19989 |
| CFTR-Intron10-1609 | + | AGGGUGGGAUAUGGAGAA | 18 | 20493 |
| CFTR-Intron10-1610 | + | UAGGGUGGGAUAUGGAGAA | 19 | 20494 |
| CFTR-Intron10-1611 | + | UUAGGGUGGGAUAUGGAGAA | 20 | 20495 |
| CFTR-Intron10-1612 | + | UUUACCAUUAUCUACACA | 18 | 20496 |
| CFTR-Intron10-1613 | + | UUUUACCAUUAUCUACACA | 19 | 20497 |
| CFTR-Intron10-1614 | + | UUUUUACCAUUAUCUACACA | 20 | 20498 |
| CFTR-Intron10-1615 | + | UAGUGAACUAGAGUCACA | 18 | 20499 |
| CFTR-Intron10-1616 | + | UUAGUGAACUAGAGUCACA | 19 | 20500 |
| CFTR-Intron10-1617 | + | AUUAGUGAACUAGAGUCACA | 20 | 20501 |

TABLE 41B-continued

2nd Tier

| gRNA Name | DNA Strand | Targeting Domain | Target Site Length | Seq ID |
|---|---|---|---|---|
| CFTR-Intron10-1618 | + | UAUUAGUGAACUAGAGUCACA | 21 | 20502 |
| CFTR-Intron10-1619 | + | AUAUUAGUGAACUAGAGUCACA | 22 | 20503 |
| CFTR-Intron10-1620 | + | CAUAUUAGUGAACUAGAGUCACA | 23 | 20504 |
| CFTR-Intron10-1621 | + | UCAUAUUAGUGAACUAGAGUCACA | 24 | 20505 |
| CFTR-Intron10-1622 | + | UGGAGAAGAGGAUGACCA | 18 | 20506 |
| CFTR-Intron10-1623 | + | AUGGAGAAGAGGAUGACCA | 19 | 20507 |
| CFTR-Intron10-1624 | + | UAUGGAGAAGAGGAUGACCA | 20 | 20508 |
| CFTR-Intron10-1625 | + | AGAGACACACCUAAAGCA | 18 | 20509 |
| CFTR-Intron10-1626 | + | AAGAGACACACCUAAAGCA | 19 | 20510 |
| CFTR-Intron10-1627 | + | AAAGAGACACACCUAAAGCA | 20 | 20511 |
| CFTR-Intron10-1628 | + | UAGUGAUUCAUUAUAUCA | 18 | 20512 |
| CFTR-Intron10-1629 | + | AUAGUGAUUCAUUAUAUCA | 19 | 20513 |
| CFTR-Intron10-1630 | + | AAUAGUGAUUCAUUAUAUCA | 20 | 20514 |
| CFTR-Intron10-1631 | + | AUUUUUGCACAUCUAUCA | 18 | 20515 |
| CFTR-Intron10-1632 | + | UAUUUUUGCACAUCUAUCA | 19 | 20516 |
| CFTR-Intron10-1633 | + | CUAUUUUUGCACAUCUAUCA | 20 | 20517 |
| CFTR-Intron10-1634 | + | AGCUAUUUUUGCACAUCUAUCA | 22 | 20518 |
| CFTR-Intron10-1635 | + | AAGCUAUUUUUGCACAUCUAUCA | 23 | 20519 |
| CFTR-Intron10-1636 | + | AAAGCUAUUUUUGCACAUCUAUCA | 24 | 20520 |
| CFTR-Intron10-1637 | + | AAAAGGCAGCCUCCUAGA | 18 | 20521 |
| CFTR-Intron10-1638 | + | UAAAAGGCAGCCUCCUAGA | 19 | 20522 |
| CFTR-Intron10-1639 | + | CUAAAAGGCAGCCUCCUAGA | 20 | 20523 |
| CFTR-Intron10-375 | + | UGGCUACCUUGGUUGGAUGA | 20 | 19261 |
| CFTR-Intron10-1640 | + | UUGGCUACCUUGGUUGGAUGA | 21 | 20524 |
| CFTR-Intron10-1641 | + | AUUGGCUACCUUGGUUGGAUGA | 22 | 20525 |
| CFTR-Intron10-1642 | + | AGAAUAUCCAUCCAUAUGA | 19 | 20526 |
| CFTR-Intron10-1643 | + | UAGAAUAUCCAUCCAUAUGA | 20 | 20527 |
| CFTR-Intron10-1644 | + | AUAGAAUAUCCAUCCAUAUGA | 21 | 20528 |
| CFTR-Intron10-1645 | + | CAUAGAAUAUCCAUCCAUAUGA | 22 | 20529 |
| CFTR-Intron10-1646 | + | UCAUAGAAUAUCCAUCCAUAUGA | 23 | 20530 |
| CFTR-Intron10-1647 | + | AUCAUAGAAUAUCCAUCCAUAUGA | 24 | 20531 |
| CFTR-Intron10-1648 | + | AUUACCAAAUUGUAUUGA | 18 | 20532 |
| CFTR-Intron10-1649 | + | AAUUACCAAAUUGUAUUGA | 19 | 20533 |
| CFTR-Intron10-1650 | + | AAAUUACCAAAUUGUAUUGA | 20 | 20534 |
| CFTR-Intron10-1651 | + | AAAAUUACAGAACCUAUA | 18 | 20535 |
| CFTR-Intron10-1652 | + | AAAAAUUACAGAACCUAUA | 19 | 20536 |
| CFTR-Intron10-1170 | + | CAAAAAUUACAGAACCUAUA | 20 | 20055 |

TABLE 41B-continued

| | | 2nd Tier | | |
|---|---|---|---|---|
| gRNA Name | DNA Strand | Targeting Domain | Target Site Length | Seq ID |
| CFTR-Intron10-1653 | + | UGUUACAACAGUCUUUAUA | 19 | 20537 |
| CFTR-Intron10-1654 | + | UUGUUACAACAGUCUUUAUA | 20 | 20538 |
| CFTR-Intron10-1655 | + | UCCUCCCUUGUCUCCCUA | 18 | 20539 |
| CFTR-Intron10-1656 | + | UUCCUCCCUUGUCUCCCUA | 19 | 20540 |
| CFTR-Intron10-1657 | + | CUUCCUCCCUUGUCUCCCUA | 20 | 20541 |
| CFTR-Intron10-1658 | + | ACUUAUCCAUUAAUCCUA | 18 | 20542 |
| CFTR-Intron10-1659 | + | AACUUAUCCAUUAAUCCUA | 19 | 20543 |
| CFTR-Intron10-1660 | + | CAACUUAUCCAUUAAUCCUA | 20 | 20544 |
| CFTR-Intron10-1661 | + | UCAACUUAUCCAUUAAUCCUA | 21 | 20545 |
| CFTR-Intron10-1662 | + | UUCAACUUAUCCAUUAAUCCUA | 22 | 20546 |
| CFTR-Intron10-1663 | + | UGUUCAACUUAUCCAUUAAUCCUA | 24 | 20547 |
| CFTR-Intron10-1664 | + | ACAAAUUACCAAAUUGUA | 18 | 20548 |
| CFTR-Intron10-1665 | + | UACAAAUUACCAAAUUGUA | 19 | 20549 |
| CFTR-Intron10-1666 | + | AUACAAAUUACCAAAUUGUA | 20 | 20550 |
| CFTR-Intron10-1667 | + | UGAUACAAAUUACCAAAUUGUA | 22 | 20551 |
| CFTR-Intron10-1668 | + | CUGAUACAAAUUACCAAAUUGUA | 23 | 20552 |
| CFTR-Intron10-1669 | + | UCUGAUACAAAUUACCAAAUUGUA | 24 | 20553 |
| CFTR-Intron10-1670 | + | AGCCUGACACCAAAUUUA | 18 | 20554 |
| CFTR-Intron10-1671 | + | CAGCCUGACACCAAAUUUA | 19 | 20555 |
| CFTR-Intron10-1672 | + | CCAGCCUGACACCAAAUUUA | 20 | 20556 |
| CFTR-Intron10-1673 | + | CCCAGCCUGACACCAAAUUUA | 21 | 20557 |
| CFTR-Intron10-1674 | + | ACCCAGCCUGACACCAAAUUUA | 22 | 20558 |
| CFTR-Intron10-1675 | + | CACCCAGCCUGACACCAAAUUUA | 23 | 20559 |
| CFTR-Intron10-1676 | + | ACAAAUAUUGACUAUUUA | 18 | 20560 |
| CFTR-Intron10-1677 | + | UACAAAUAUUGACUAUUUA | 19 | 20561 |
| CFTR-Intron10-1678 | + | AGUACAAAUAUUGACUAUUUA | 21 | 20562 |
| CFTR-Intron10-1679 | + | AAGUACAAAUAUUGACUAUUUA | 22 | 20563 |
| CFTR-Intron10-1680 | + | CAAGUACAAAUAUUGACUAUUUA | 23 | 20564 |
| CFTR-Intron10-1681 | + | AGAGCUCAUAUUAGUGAAC | 19 | 20565 |
| CFTR-Intron10-1682 | + | CAGAGCUCAUAUUAGUGAAC | 20 | 20566 |
| CFTR-Intron10-1683 | + | UCAGAGCUCAUAUUAGUGAAC | 21 | 20567 |
| CFTR-Intron10-1684 | + | AUCAGAGCUCAUAUUAGUGAAC | 22 | 20568 |
| CFTR-Intron10-1685 | + | UAUCAGAGCUCAUAUUAGUGAAC | 23 | 20569 |
| CFTR-Intron10-1686 | + | UUAUCAGAGCUCAUAUUAGUGAAC | 24 | 20570 |
| CFTR-Intron10-1687 | + | UCUAUUAAUAGAAACUAC | 18 | 20571 |
| CFTR-Intron10-1688 | + | AUCUAUUAAUAGAAACUAC | 19 | 20572 |
| CFTR-Intron10-1689 | + | AAUCUAUUAAUAGAAACUAC | 20 | 20573 |

TABLE 41B-continued

2nd Tier

| gRNA Name | DNA Strand | Targeting Domain | Target Site Length | Seq ID |
|---|---|---|---|---|
| CFTR-Intron10-1690 | + | UAAUCUAUUAAUAGAAACUAC | 21 | 20574 |
| CFTR-Intron10-1691 | + | CUAAUCUAUUAAUAGAAACUAC | 22 | 20575 |
| CFTR-Intron10-1692 | + | UCUAAUCUAUUAAUAGAAACUAC | 23 | 20576 |
| CFTR-Intron10-1693 | + | CUCUAAUCUAUUAAUAGAAACUAC | 24 | 20577 |
| CFTR-Intron10-1694 | + | UACUACUUCCACUACUAC | 18 | 20578 |
| CFTR-Intron10-1695 | + | AUACUACUUCCACUACUAC | 19 | 20579 |
| CFTR-Intron10-1696 | + | UAUACUACUUCCACUACUAC | 20 | 20580 |
| CFTR-Intron10-1697 | + | CUAUACUACUUCCACUACUAC | 21 | 20581 |
| CFTR-Intron10-1698 | + | ACUAUACUACUUCCACUACUAC | 22 | 20582 |
| CFTR-Intron10-1699 | + | UACUAUACUACUUCCACUACUAC | 23 | 20583 |
| CFTR-Intron10-1700 | + | CUACUAUACUACUUCCACUACUAC | 24 | 20584 |
| CFTR-Intron10-1701 | + | AUGAGUCCCAGUUAUUAC | 18 | 20585 |
| CFTR-Intron10-1702 | + | UAUGAGUCCCAGUUAUUAC | 19 | 20586 |
| CFTR-Intron10-1703 | + | AUAUGAGUCCCAGUUAUUAC | 20 | 20587 |
| CFTR-Intron10-1704 | + | CAUAUGAGUCCCAGUUAUUAC | 21 | 20588 |
| CFTR-Intron10-1705 | + | ACAUAUGAGUCCCAGUUAUUAC | 22 | 20589 |
| CFTR-Intron10-1706 | + | UACAUAUGAGUCCCAGUUAUUAC | 23 | 20590 |
| CFTR-Intron10-1707 | + | AUACAUAUGAGUCCCAGUUAUUAC | 24 | 20591 |
| CFTR-Intron10-1708 | + | AGAUACUAAAAAAAGUUAC | 19 | 20592 |
| CFTR-Intron10-1709 | + | AAGAUACUAAAAAAAGUUAC | 20 | 20593 |
| CFTR-Intron10-1710 | + | UAUUAGCAAGUGGACUCC | 18 | 20594 |
| CFTR-Intron10-426 | + | UGUAUUAGCAAGUGGACUCC | 20 | 19312 |
| CFTR-Intron10-1711 | + | UUGUAUUAGCAAGUGGACUCC | 21 | 20595 |
| CFTR-Intron10-1712 | + | AUUGUAUUAGCAAGUGGACUCC | 22 | 20596 |
| CFTR-Intron10-1713 | + | AAUUGUAUUAGCAAGUGGACUCC | 23 | 20597 |
| CFTR-Intron10-1714 | + | CAAUUGUAUUAGCAAGUGGACUCC | 24 | 20598 |
| CFTR-Intron10-1715 | + | UGAGCCUAUCACCUAGGC | 18 | 20599 |
| CFTR-Intron10-1716 | + | UUGAGCCUAUCACCUAGGC | 19 | 20600 |
| CFTR-Intron10-1717 | + | UUUGAGCCUAUCACCUAGGC | 20 | 20601 |
| CFTR-Intron10-1718 | + | CUAUUUAGAGUGUAUGGC | 18 | 20602 |
| CFTR-Intron10-1719 | + | UCUAUUUAGAGUGUAUGGC | 19 | 20603 |
| CFTR-Intron10-1720 | + | CUCUAUUUAGAGUGUAUGGC | 20 | 20604 |
| CFTR-Intron10-1721 | + | ACUCUAUUUAGAGUGUAUGGC | 21 | 20605 |
| CFTR-Intron10-1722 | + | CACUCUAUUUAGAGUGUAUGGC | 22 | 20606 |
| CFTR-Intron10-1723 | + | AGCACUCUAUUUAGAGUGUAUGGC | 24 | 20607 |
| CFTR-Intron10-1724 | + | AAAGGCUCUUUAUAAUGC | 18 | 20608 |
| CFTR-Intron10-1725 | + | AAAAGGCUCUUUAUAAUGC | 19 | 20609 |

TABLE 41B-continued

2nd Tier

| gRNA Name | DNA Strand | Targeting Domain | Target Site Length | Seq ID |
|---|---|---|---|---|
| CFTR-Intron10-1726 | + | AGAAAAGGCUCUUUAUAAUGC | 21 | 20610 |
| CFTR-Intron10-1727 | + | AAGAAAAGGCUCUUUAUAAUGC | 22 | 20611 |
| CFTR-Intron10-1728 | + | AAAGAAAAGGCUCUUUAUAAUGC | 23 | 20612 |
| CFTR-Intron10-1729 | + | AAAAGAAAAGGCUCUUUAUAAUGC | 24 | 20613 |
| CFTR-Intron10-1730 | + | CUAAGAGACUCCUGAAUC | 18 | 20614 |
| CFTR-Intron10-1731 | + | UGCUAAGAGACUCCUGAAUC | 20 | 20615 |
| CFTR-Intron10-1732 | + | CUGCUAAGAGACUCCUGAAUC | 21 | 20616 |
| CFTR-Intron10-1733 | + | UCUGCUAAGAGACUCCUGAAUC | 22 | 20617 |
| CFTR-Intron10-1734 | + | UGUAGAAGACCUAAAUAUC | 19 | 20618 |
| CFTR-Intron10-1735 | + | AUGUAGAAGACCUAAAUAUC | 20 | 20619 |
| CFTR-Intron10-1736 | + | AGAUGUAGAAGACCUAAAUAUC | 22 | 20620 |
| CFTR-Intron10-1737 | + | AAGAUGUAGAAGACCUAAAUAUC | 23 | 20621 |
| CFTR-Intron10-1738 | + | UGGGUCUGCUAAGAGACUC | 19 | 20622 |
| CFTR-Intron10-1739 | + | UUGGGUCUGCUAAGAGACUC | 20 | 20623 |
| CFTR-Intron10-1740 | + | UUUGGGUCUGCUAAGAGACUC | 21 | 20624 |
| CFTR-Intron10-1741 | + | AUUUGGGUCUGCUAAGAGACUC | 22 | 20625 |
| CFTR-Intron10-1742 | + | AGAUUUGGGUCUGCUAAGAGACUC | 24 | 20626 |
| CFTR-Intron10-1743 | + | UACUAUUGCUUUCAUUAAGUC | 21 | 20627 |
| CFTR-Intron10-1744 | + | CUACUAUUGCUUUCAUUAAGUC | 22 | 20628 |
| CFTR-Intron10-1745 | + | UCUACUAUUGCUUUCAUUAAGUC | 23 | 20629 |
| CFTR-Intron10-1746 | + | CUCUACUAUUGCUUUCAUUAAGUC | 24 | 20630 |
| CFTR-Intron10-1747 | + | UAGAGACAAGGUGGUGUC | 18 | 20631 |
| CFTR-Intron10-1748 | + | AUAGAGACAAGGUGGUGUC | 19 | 20632 |
| CFTR-Intron10-437 | + | AAUAGAGACAAGGUGGUGUC | 20 | 19323 |
| CFTR-Intron10-1749 | + | UAAUAGAGACAAGGUGGUGUC | 21 | 20633 |
| CFTR-Intron10-1750 | + | AUAAUAGAGACAAGGUGGUGUC | 22 | 20634 |
| CFTR-Intron10-1751 | + | AAUAAUAGAGACAAGGUGGUGUC | 23 | 20635 |
| CFTR-Intron10-1752 | + | CAAUAAUAGAGACAAGGUGGUGUC | 24 | 20636 |
| CFTR-Intron10-1753 | + | UAUUUUUCAUUAUGAUUC | 18 | 20637 |
| CFTR-Intron10-1754 | + | AUAUUUUUCAUUAUGAUUC | 19 | 20638 |
| CFTR-Intron10-1755 | + | UUGACAUCAGUUGGGUUC | 18 | 20639 |
| CFTR-Intron10-1756 | + | CUUGACAUCAGUUGGGUUC | 19 | 20640 |
| CFTR-Intron10-1757 | + | UGCUUGACAUCAGUUGGGUUC | 21 | 20641 |
| CFTR-Intron10-1758 | + | CUGCUUGACAUCAGUUGGGUUC | 22 | 20642 |
| CFTR-Intron10-1759 | + | UCUGCUUGACAUCAGUUGGGUUC | 23 | 20643 |
| CFTR-Intron10-1760 | + | UUCUGCUUGACAUCAGUUGGGUUC | 24 | 20644 |
| CFTR-Intron10-1761 | + | UGAUAAAUAAUUGCCUUUC | 19 | 20645 |

TABLE 41B-continued

2nd Tier

| gRNA Name | DNA Strand | Targeting Domain | Target Site Length | Seq ID |
|---|---|---|---|---|
| CFTR-Intron10-445 | + | UUGAUAAAUAAUUGCCUUUC | 20 | 19331 |
| CFTR-Intron10-1762 | + | AUUGAUAAAUAAUUGCCUUUC | 21 | 20646 |
| CFTR-Intron10-1763 | + | UAUUGAUAAAUAAUUGCCUUUC | 22 | 20647 |
| CFTR-Intron10-1764 | + | AUAUUGAUAAAUAAUUGCCUUUC | 23 | 20648 |
| CFTR-Intron10-1765 | + | UUGGAUGAGGGAAUGCAG | 18 | 20649 |
| CFTR-Intron10-1766 | + | UGGUUGGAUGAGGGAAUGCAG | 21 | 20650 |
| CFTR-Intron10-1767 | + | UUGGUUGGAUGAGGGAAUGCAG | 22 | 20651 |
| CFTR-Intron10-1768 | + | CUUGGUUGGAUGAGGGAAUGCAG | 23 | 20652 |
| CFTR-Intron10-1769 | + | CCUUGGUUGGAUGAGGGAAUGCAG | 24 | 20653 |
| CFTR-Intron10-1770 | + | CCUUCUGCUUGACAUCAG | 18 | 20654 |
| CFTR-Intron10-1771 | + | CCCUUCUGCUUGACAUCAG | 19 | 20655 |
| CFTR-Intron10-1772 | + | ACCCUUCUGCUUGACAUCAG | 20 | 20656 |
| CFTR-Intron10-1773 | + | CACCCUUCUGCUUGACAUCAG | 21 | 20657 |
| CFTR-Intron10-1774 | + | ACACCCUUCUGCUUGACAUCAG | 22 | 20658 |
| CFTR-Intron10-1775 | + | AACACCCUUCUGCUUGACAUCAG | 23 | 20659 |
| CFTR-Intron10-1776 | + | UAACACCCUUCUGCUUGACAUCAG | 24 | 20660 |
| CFTR-Intron10-1777 | + | AAUUGAUCUUGAAGACAUACG | 21 | 20661 |
| CFTR-Intron10-1778 | + | AGAAUUGAUCUUGAAGACAUACG | 23 | 20662 |
| CFTR-Intron10-1779 | + | UAGAAUUGAUCUUGAAGACAUACG | 24 | 20663 |
| CFTR-Intron10-1780 | + | ACUGUGAAUGGUGCCAGG | 18 | 20664 |
| CFTR-Intron10-1781 | + | UACUGUGAAUGGUGCCAGG | 19 | 20665 |
| CFTR-Intron10-1782 | + | UUACUGUGAAUGGUGCCAGG | 20 | 20666 |
| CFTR-Intron10-1783 | + | UUUACUGUGAAUGGUGCCAGG | 21 | 20667 |
| CFTR-Intron10-1784 | + | CUUUACUGUGAAUGGUGCCAGG | 22 | 20668 |
| CFTR-Intron10-1785 | + | UCUUUACUGUGAAUGGUGCCAGG | 23 | 20669 |
| CFTR-Intron10-1786 | + | CUCUUUACUGUGAAUGGUGCCAGG | 24 | 20670 |
| CFTR-Intron10-1787 | + | AGAUGAUUAUUAAUAGGG | 18 | 20671 |
| CFTR-Intron10-1788 | + | UAGAUGAUUAUUAAUAGGG | 19 | 20672 |
| CFTR-Intron10-1789 | + | CUAGAUGAUUAUUAAUAGGG | 20 | 20673 |
| CFTR-Intron10-1790 | + | CCUAGAUGAUUAUUAAUAGGG | 21 | 20674 |
| CFTR-Intron10-1791 | + | AGCCUAGAUGAUUAUUAAUAGGG | 23 | 20675 |
| CFTR-Intron10-1792 | + | CAGCCUAGAUGAUUAUUAAUAGGG | 24 | 20676 |
| CFTR-Intron10-475 | + | AGGUUAAGUUGUUCUUAGGG | 20 | 19361 |
| CFTR-Intron10-1793 | + | CAGGUUAAGUUGUUCUUAGGG | 21 | 20677 |
| CFTR-Intron10-1794 | + | CCAGGUUAAGUUGUUCUUAGGG | 22 | 20678 |
| CFTR-Intron10-1795 | + | UGCCAGGUUAAGUUGUUCUUAGGG | 24 | 20679 |
| CFTR-Intron10-1796 | + | UAACAAACCUUUUAUUGG | 18 | 20680 |

TABLE 41B-continued

2nd Tier

| gRNA Name | DNA Strand | Targeting Domain | Target Site Length | Seq ID |
|---|---|---|---|---|
| CFTR-Intron10-1797 | + | UUAACAAACCUUUUAUUGG | 19 | 20681 |
| CFTR-Intron10-1798 | + | UUUAACAAACCUUUUAUUGG | 20 | 20682 |
| CFTR-Intron10-1799 | + | CUGGAUUGGCUACCUUGG | 18 | 20683 |
| CFTR-Intron10-1800 | + | CCUGGAUUGGCUACCUUGG | 19 | 20684 |
| CFTR-Intron10-1801 | + | ACCUGGAUUGGCUACCUUGG | 20 | 20685 |
| CFTR-Intron10-1802 | + | UACCUGGAUUGGCUACCUUGG | 21 | 20686 |
| CFTR-Intron10-1803 | + | UUACCUGGAUUGGCUACCUUGG | 22 | 20687 |
| CFTR-Intron10-1804 | + | AGUUACCUGGAUUGGCUACCUUGG | 24 | 20688 |
| CFTR-Intron10-1805 | + | AGGAAAUGGGGUAUAAGUG | 19 | 20689 |
| CFTR-Intron10-487 | + | AAGGAAAUGGGGUAUAAGUG | 20 | 19373 |
| CFTR-Intron10-1806 | + | UACAUAAAAAGAGAGGUG | 18 | 20690 |
| CFTR-Intron10-1807 | + | UUACAUAAAAAGAGAGGUG | 19 | 20691 |
| CFTR-Intron10-1808 | + | UGUUACAUAAAAAGAGAGGUG | 21 | 20692 |
| CFTR-Intron10-1809 | + | UUGUUACAUAAAAAGAGAGGUG | 22 | 20693 |
| CFTR-Intron10-1810 | + | AUUGUUACAUAAAAAGAGAGGUG | 23 | 20694 |
| CFTR-Intron10-1811 | + | UAUUGUUACAUAAAAAGAGAGGUG | 24 | 20695 |
| CFTR-Intron10-1812 | + | ACAGUUUCAUCUUACUUG | 18 | 20696 |
| CFTR-Intron10-1813 | + | AACAGUUUCAUCUUACUUG | 19 | 20697 |
| CFTR-Intron10-1814 | + | UAACAGUUUCAUCUUACUUG | 20 | 20698 |
| CFTR-Intron10-1815 | + | AUAACAGUUUCAUCUUACUUG | 21 | 20699 |
| CFTR-Intron10-1816 | + | UAUAACAGUUUCAUCUUACUUG | 22 | 20700 |
| CFTR-Intron10-1817 | + | UUAUAACAGUUUCAUCUUACUUG | 23 | 20701 |
| CFTR-Intron10-1818 | + | AUUAUAACAGUUUCAUCUUACUUG | 24 | 20702 |
| CFTR-Intron10-1819 | + | UAUUACAUGGGAAAAAU | 18 | 20703 |
| CFTR-Intron10-1820 | + | UUAUUACAUGGGAAAAAU | 19 | 20704 |
| CFTR-Intron10-1821 | + | CUUAUUACAUGGGAAAAAU | 20 | 20705 |
| CFTR-Intron10-1822 | + | UCUUAUUACAUGGGAAAAAU | 21 | 20706 |
| CFTR-Intron10-1823 | + | UUCUUAUUACAUGGGAAAAAU | 22 | 20707 |
| CFTR-Intron10-1824 | + | AUUCUUAUUACAUGGGAAAAAU | 23 | 20708 |
| CFTR-Intron10-1825 | + | AAUUCUUAUUACAUGGGAAAAAU | 24 | 20709 |
| CFTR-Intron10-1826 | + | AUAGCUUAUUCUAUACAU | 18 | 20710 |
| CFTR-Intron10-1827 | + | AAUAGCUUAUUCUAUACAU | 19 | 20711 |
| CFTR-Intron10-1828 | + | UAAUAGCUUAUUCUAUACAU | 20 | 20712 |
| CFTR-Intron10-1829 | + | CUAAUAGCUUAUUCUAUACAU | 21 | 20713 |
| CFTR-Intron10-1830 | + | AGCUAAUAGCUUAUUCUAUACAU | 23 | 20714 |
| CFTR-Intron10-1831 | + | AUGAUGUACAUUUAAUAU | 18 | 20715 |
| CFTR-Intron10-1832 | + | AAUGAUGUACAUUUAAUAU | 19 | 20716 |

TABLE 41B-continued

2nd Tier

| gRNA Name | DNA Strand | Targeting Domain | Target Site Length | Seq ID |
|---|---|---|---|---|
| CFTR-Intron10-1833 | + | UAAUGAUGUACAUUUAAUAU | 20 | 20717 |
| CFTR-Intron10-1834 | + | AUAAUGAUGUACAUUUAAUAU | 21 | 20718 |
| CFTR-Intron10-1835 | + | AAUAAUGAUGUACAUUUAAUAU | 22 | 20719 |
| CFTR-Intron10-1836 | + | UGAAUAAUGAUGUACAUUUAAUAU | 24 | 20720 |
| CFTR-Intron10-1837 | + | AGAUCUCUGCAAACAUAU | 18 | 20721 |
| CFTR-Intron10-1838 | + | AAGAUCUCUGCAAACAUAU | 19 | 20722 |
| CFTR-Intron10-1839 | + | UAAGAUCUCUGCAAACAUAU | 20 | 20723 |
| CFTR-Intron10-1840 | + | AUAAGAUCUCUGCAAACAUAU | 21 | 20724 |
| CFTR-Intron10-1841 | + | CAUAAGAUCUCUGCAAACAUAU | 22 | 20725 |
| CFTR-Intron10-1842 | + | ACAUAAGAUCUCUGCAAACAUAU | 23 | 20726 |
| CFTR-Intron10-1843 | + | UACAUAAGAUCUCUGCAAACAUAU | 24 | 20727 |
| CFTR-Intron10-1844 | + | AAUGGAAACACUAUAUAU | 18 | 20728 |
| CFTR-Intron10-1845 | + | UAAUGGAAACACUAUAUAU | 19 | 20729 |
| CFTR-Intron10-1846 | + | UGUAAUGGAAACACUAUAUAU | 21 | 20730 |
| CFTR-Intron10-1847 | + | AUGUAAUGGAAACACUAUAUAU | 22 | 20731 |
| CFTR-Intron10-1848 | + | AAUGUAAUGGAAACACUAUAUAU | 23 | 20732 |
| CFTR-Intron10-1849 | + | CAAUGUAAUGGAAACACUAUAUAU | 24 | 20733 |
| CFTR-Intron10-1850 | + | UCCAACUAACAUCUCUAU | 18 | 20734 |
| CFTR-Intron10-1851 | + | AUCCAACUAACAUCUCUAU | 19 | 20735 |
| CFTR-Intron10-1852 | + | CAUCCAACUAACAUCUCUAU | 20 | 20736 |
| CFTR-Intron10-1853 | + | ACAUCCAACUAACAUCUCUAU | 21 | 20737 |
| CFTR-Intron10-1854 | + | UACAUCCAACUAACAUCUCUAU | 22 | 20738 |
| CFTR-Intron10-1855 | + | UGUACAUCCAACUAACAUCUCUAU | 24 | 20739 |
| CFTR-Intron10-1856 | + | UCCUUAACCUCUAAUACU | 18 | 20740 |
| CFTR-Intron10-1857 | + | CUCCUUAACCUCUAAUACU | 19 | 20741 |
| CFTR-Intron10-1858 | + | CCUCCUUAACCUCUAAUACU | 20 | 20742 |
| CFTR-Intron10-1859 | + | ACCUCCUUAACCUCUAAUACU | 21 | 20743 |
| CFTR-Intron10-1860 | + | CACCUCCUUAACCUCUAAUACU | 22 | 20744 |
| CFTR-Intron10-1861 | + | CCACCUCCUUAACCUCUAAUACU | 23 | 20745 |
| CFTR-Intron10-1862 | + | CCCACCUCCUUAACCUCUAAUACU | 24 | 20746 |
| CFTR-Intron10-1863 | + | UGGAAAAUGUUAAAUUUUCCCU | 22 | 20747 |
| CFTR-Intron10-1864 | + | CUGGAAAAUGUUAAAUUUUCCCU | 23 | 20748 |
| CFTR-Intron10-1865 | + | UCUGGAAAAUGUUAAAUUUUCCCU | 24 | 20749 |
| CFTR-Intron10-516 | + | AGGCACUUGUUGACAGUCCU | 20 | 19402 |
| CFTR-Intron10-1866 | + | UAGGCACUUGUUGACAGUCCU | 21 | 20750 |
| CFTR-Intron10-1867 | + | CUAGGCACUUGUUGACAGUCCU | 22 | 20751 |
| CFTR-Intron10-1868 | + | UGCUAGGCACUUGUUGACAGUCCU | 24 | 20752 |

TABLE 41B-continued

| | | 2nd Tier | | |
|---|---|---|---|---|
| gRNA Name | DNA Strand | Targeting Domain | Target Site Length | Seq ID |
| CFTR-Intron10-1869 | + | UACUCAGUCCAGAAAGCU | 18 | 20753 |
| CFTR-Intron10-1870 | + | UUACUCAGUCCAGAAAGCU | 19 | 20754 |
| CFTR-Intron10-1871 | + | UGUGCAAGUCCUCUGUGCU | 19 | 20755 |
| CFTR-Intron10-1872 | + | AUGUGCAAGUCCUCUGUGCU | 20 | 20756 |
| CFTR-Intron10-1873 | + | UAUGUGCAAGUCCUCUGUGCU | 21 | 20757 |
| CFTR-Intron10-1874 | + | AUAUGUGCAAGUCCUCUGUGCU | 22 | 20758 |
| CFTR-Intron10-1875 | + | CAUAUGUGCAAGUCCUCUGUGCU | 23 | 20759 |
| CFTR-Intron10-1876 | + | ACAUAUGUGCAAGUCCUCUGUGCU | 24 | 20760 |
| CFTR-Intron10-1877 | + | UUAAUUGCCAGUAAGUCU | 18 | 20761 |
| CFTR-Intron10-1878 | + | UUUAAUUGCCAGUAAGUCU | 19 | 20762 |
| CFTR-Intron10-526 | + | AUUUAAUUGCCAGUAAGUCU | 20 | 19412 |
| CFTR-Intron10-1879 | + | UGCCAGGUUAAGUUGUUCU | 19 | 20763 |
| CFTR-Intron10-1880 | + | AUGCCAGGUUAAGUUGUUCU | 20 | 20764 |
| CFTR-Intron10-1881 | + | AGAGUGUAUGGCAUGAGU | 18 | 20765 |
| CFTR-Intron10-1882 | + | UAGAGUGUAUGGCAUGAGU | 19 | 20766 |
| CFTR-Intron10-1883 | + | UUAGAGUGUAUGGCAUGAGU | 20 | 20767 |
| CFTR-Intron10-1884 | + | UUUAGAGUGUAUGGCAUGAGU | 21 | 20768 |
| CFTR-Intron10-1885 | + | AUUUAGAGUGUAUGGCAUGAGU | 22 | 20769 |
| CFTR-Intron10-1886 | + | UAUUUAGAGUGUAUGGCAUGAGU | 23 | 20770 |
| CFTR-Intron10-1887 | + | CUAUUUAGAGUGUAUGGCAUGAGU | 24 | 20771 |
| CFTR-Intron10-1888 | + | AGGGUCUCUCUAAGGUGU | 18 | 20772 |
| CFTR-Intron10-1889 | + | UGAGGGUCUCUCUAAGGUGU | 20 | 20773 |
| CFTR-Intron10-1890 | + | UGGGGAAAUCAGCACUCUAUU | 21 | 20774 |
| CFTR-Intron10-1891 | + | UGUGGGGAAAUCAGCACUCUAUU | 23 | 20775 |
| CFTR-Intron10-1892 | + | CUGUGGGGAAAUCAGCACUCUAUU | 24 | 20776 |
| CFTR-Intron10-1893 | + | UGUAACUCUUUAUUCACUU | 19 | 20777 |
| CFTR-Intron10-1894 | + | UUGUAACUCUUUAUUCACUU | 20 | 20778 |
| CFTR-Intron10-1895 | + | UUUGUAACUCUUUAUUCACUU | 21 | 20779 |
| CFTR-Intron10-1896 | + | UUUUGUAACUCUUUAUUCACUU | 22 | 20780 |
| CFTR-Intron10-1897 | + | AUUUUGUAACUCUUUAUUCACUU | 23 | 20781 |
| CFTR-Intron10-1898 | + | CAUUUUGUAACUCUUUAUUCACUU | 24 | 20782 |
| CFTR-Intron10-1899 | + | UAUCAACCCUCUUUCCUU | 18 | 20783 |
| CFTR-Intron10-1900 | + | UUAUCAACCCUCUUUCCUU | 19 | 20784 |
| CFTR-Intron10-1901 | + | CUUAUCAACCCUCUUUCCUU | 20 | 20785 |
| CFTR-Intron10-1902 | + | UCUUAUCAACCCUCUUUCCUU | 21 | 20786 |
| CFTR-Intron10-1903 | + | UUCUUAUCAACCCUCUUUCCUU | 22 | 20787 |
| CFTR-Intron10-1904 | + | CUUCUUAUCAACCCUCUUUCCUU | 23 | 20788 |

TABLE 41B-continued

2nd Tier

| gRNA Name | DNA Strand | Targeting Domain | Target Site Length | Seq ID |
|---|---|---|---|---|
| CFTR-Intron10-1905 | + | UCUUCUUAUCAACCCUCUUUCCUU | 24 | 20789 |
| CFTR-Intron10-1906 | + | UUUAUCAACAUGAAGGUU | 18 | 20790 |
| CFTR-Intron10-1907 | + | CUUUAUCAACAUGAAGGUU | 19 | 20791 |
| CFTR-Intron10-555 | + | CCUUUAUCAACAUGAAGGUU | 20 | 19441 |
| CFTR-Intron10-1908 | − | UGCUUUCAGGAGCCAAAAA | 19 | 20792 |
| CFTR-Intron10-1909 | − | CUGCUUUCAGGAGCCAAAAA | 20 | 20793 |
| CFTR-Intron10-1910 | − | ACUGCUUUCAGGAGCCAAAAA | 21 | 20794 |
| CFTR-Intron10-1911 | − | CACUGCUUUCAGGAGCCAAAAA | 22 | 20795 |
| CFTR-Intron10-1912 | − | ACACUGCUUUCAGGAGCCAAAAA | 23 | 20796 |
| CFTR-Intron10-1913 | − | AACACUGCUUUCAGGAGCCAAAAA | 24 | 20797 |
| CFTR-Intron10-1914 | − | UUAAACACUUCUGAGAAA | 18 | 20798 |
| CFTR-Intron10-1915 | − | UUUAAACACUUCUGAGAAA | 19 | 20799 |
| CFTR-Intron10-1096 | − | AUUUAAACACUUCUGAGAAA | 20 | 19981 |
| CFTR-Intron10-1916 | − | AUAAGAUUCUAAAGGAAA | 18 | 20800 |
| CFTR-Intron10-1917 | − | UGGAUAAGAUUCUAAAGGAAA | 21 | 20801 |
| CFTR-Intron10-1918 | − | CUGGAUAAGAUUCUAAAGGAAA | 22 | 20802 |
| CFTR-Intron10-1919 | − | CAUGCCAUACACUCUAAA | 18 | 20803 |
| CFTR-Intron10-1920 | − | UCAUGCCAUACACUCUAAA | 19 | 20804 |
| CFTR-Intron10-1921 | − | CUCAUGCCAUACACUCUAAA | 20 | 20805 |
| CFTR-Intron10-1922 | − | ACUCAUGCCAUACACUCUAAA | 21 | 20806 |
| CFTR-Intron10-1923 | − | UACUCAUGCCAUACACUCUAAA | 22 | 20807 |
| CFTR-Intron10-1924 | − | CGUACUCAUGCCAUACACUCUAAA | 24 | 20808 |
| CFTR-Intron10-1925 | − | AGGUUUAAUUUUGUACAA | 18 | 20809 |
| CFTR-Intron10-1926 | − | UAGGUUUAAUUUUGUACAA | 19 | 20810 |
| CFTR-Intron10-343 | − | CUAGGUUUAAUUUUGUACAA | 20 | 19229 |
| CFTR-Intron10-1927 | − | UCUAGGUUUAAUUUUGUACAA | 21 | 20811 |
| CFTR-Intron10-1928 | − | UUCUAGGUUUAAUUUUGUACAA | 22 | 20812 |
| CFTR-Intron10-1929 | − | CUUCUAGGUUUAAUUUUGUACAA | 23 | 20813 |
| CFTR-Intron10-1930 | − | ACUUCUAGGUUUAAUUUUGUACAA | 24 | 20814 |
| CFTR-Intron10-1931 | − | CUUUGAAGGAAGAUCCAA | 18 | 20815 |
| CFTR-Intron10-1932 | − | UGCUUUGAAGGAAGAUCCAA | 20 | 20816 |
| CFTR-Intron10-1933 | − | UAAUCAUCUAGGCUGCAA | 18 | 20817 |
| CFTR-Intron10-1934 | − | AUAAUCAUCUAGGCUGCAA | 19 | 20818 |
| CFTR-Intron10-1935 | − | AAUAAUCAUCUAGGCUGCAA | 20 | 20819 |
| CFTR-Intron10-1936 | − | UAAUAAUCAUCUAGGCUGCAA | 21 | 20820 |
| CFTR-Intron10-1937 | − | UUAAUAAUCAUCUAGGCUGCAA | 22 | 20821 |
| CFTR-Intron10-1938 | − | AUUAAUAAUCAUCUAGGCUGCAA | 23 | 20822 |

TABLE 41B-continued

2nd Tier

| gRNA Name | DNA Strand | Targeting Domain | Target Site Length | Seq ID |
|---|---|---|---|---|
| CFTR-Intron10-1939 | − | UAUUAAUAAUCAUCUAGGCUGCAA | 24 | 20823 |
| CFTR-Intron10-1940 | − | AGGAGAACCAUAUUUUGAAGAA | 22 | 20824 |
| CFTR-Intron10-1941 | − | UGAGGAGAACCAUAUUUUGAAGAA | 24 | 20825 |
| CFTR-Intron10-1942 | − | AGGGUUGAUAAGAAGAGAA | 19 | 20826 |
| CFTR-Intron10-1943 | − | AGAGGGUUGAUAAGAAGAGAA | 21 | 20827 |
| CFTR-Intron10-1944 | − | AAGAGGGUUGAUAAGAAGAGAA | 22 | 20828 |
| CFTR-Intron10-1945 | − | AAAGAGGGUUGAUAAGAAGAGAA | 23 | 20829 |
| CFTR-Intron10-1946 | − | UGCUCUCUGACCACAUAA | 18 | 20830 |
| CFTR-Intron10-1947 | − | UUGCUCUCUGACCACAUAA | 19 | 20831 |
| CFTR-Intron10-1948 | − | CUUGCUCUCUGACCACAUAA | 20 | 20832 |
| CFTR-Intron10-1949 | − | ACUUGCUCUCUGACCACAUAA | 21 | 20833 |
| CFTR-Intron10-1950 | − | UACUUGCUCUCUGACCACAUAA | 22 | 20834 |
| CFTR-Intron10-1951 | − | UGUACUUGCUCUCUGACCACAUAA | 24 | 20835 |
| CFTR-Intron10-1952 | − | UAUAUGAUAUACUCUUAA | 18 | 20836 |
| CFTR-Intron10-1953 | − | UGUAUAUGAUAUACUCUUAA | 20 | 20837 |
| CFTR-Intron10-1954 | − | AUGUAUAUGAUAUACUCUUAA | 21 | 20838 |
| CFTR-Intron10-1955 | − | CGGAUGUAUAUGAUAUACUCUUAA | 24 | 20839 |
| CFTR-Intron10-1956 | − | AACUCAUUAGGAAAAUGUACA | 21 | 20840 |
| CFTR-Intron10-1957 | − | CAACUCAUUAGGAAAAUGUACA | 22 | 20841 |
| CFTR-Intron10-1958 | − | CCAACUCAUUAGGAAAAUGUACA | 23 | 20842 |
| CFTR-Intron10-1959 | − | ACCAACUCAUUAGGAAAAUGUACA | 24 | 20843 |
| CFTR-Intron10-1960 | − | AUGAAGUUAAAAACAUCA | 18 | 20844 |
| CFTR-Intron10-1961 | − | UAUGAAGUUAAAAACAUCA | 19 | 20845 |
| CFTR-Intron10-1962 | − | AUAUGAAGUUAAAAACAUCA | 20 | 20846 |
| CFTR-Intron10-1963 | − | AGUAUAGAAUUUUGCAUCA | 19 | 20847 |
| CFTR-Intron10-1964 | − | UAGUAUAGAAUUUUGCAUCA | 20 | 20848 |
| CFTR-Intron10-1965 | − | AGGUAGUAAUUGUGUUUCA | 19 | 20849 |
| CFTR-Intron10-1966 | − | AAGGUAGUAAUUGUGUUUCA | 20 | 20850 |
| CFTR-Intron10-1967 | − | AAAGGUAGUAAUUGUGUUUCA | 21 | 20851 |
| CFTR-Intron10-1968 | − | AAAAGGUAGUAAUUGUGUUUCA | 22 | 20852 |
| CFTR-Intron10-1969 | − | UGAAAAGGUAGUAAUUGUGUUUCA | 24 | 20853 |
| CFTR-Intron10-1970 | − | AGAGCCUUUUCUUUUUCA | 18 | 20854 |
| CFTR-Intron10-1971 | − | AAGAGCCUUUUCUUUUUCA | 19 | 20855 |
| CFTR-Intron10-1972 | − | AAAGAGCCUUUUCUUUUUCA | 20 | 20856 |
| CFTR-Intron10-1973 | − | UCUAGCUAAAAUAUAAGA | 18 | 20857 |
| CFTR-Intron10-1974 | − | AUCUAGCUAAAAUAUAAGA | 19 | 20858 |
| CFTR-Intron10-1975 | − | CUUGACCAGAAUGAAUUAGA | 21 | 20859 |

TABLE 41B-continued

| | | 2nd Tier | | |
|---|---|---|---|---|
| gRNA Name | DNA Strand | Targeting Domain | Target Site Length | Seq ID |
| CFTR-Intron10-1976 | - | ACUUGACCAGAAUGAAAUUAGA | 22 | 20860 |
| CFTR-Intron10-1977 | - | AACUUGACCAGAAUGAAAUUAGA | 23 | 20861 |
| CFTR-Intron10-1978 | - | AAACUUGACCAGAAUGAAAUUAGA | 24 | 20862 |
| CFTR-Intron10-1979 | - | AGGAAAAUGUACAAAGGA | 18 | 20863 |
| CFTR-Intron10-1980 | - | UAGGAAAAUGUACAAAGGA | 19 | 20864 |
| CFTR-Intron10-1981 | - | UUAGGAAAAUGUACAAAGGA | 20 | 20865 |
| CFTR-Intron10-1982 | - | UGAUUCCAAGCUUUCUGGA | 19 | 20866 |
| CFTR-Intron10-1983 | - | AUGAUUCCAAGCUUUCUGGA | 20 | 20867 |
| CFTR-Intron10-1984 | - | UAUACUCUUAAGUGAAUA | 18 | 20868 |
| CFTR-Intron10-1985 | - | AUAUACUCUUAAGUGAAUA | 19 | 20869 |
| CFTR-Intron10-1986 | - | UGAUAUACUCUUAAGUGAAUA | 21 | 20870 |
| CFTR-Intron10-1987 | - | AUGAUAUACUCUUAAGUGAAUA | 22 | 20871 |
| CFTR-Intron10-1988 | - | UAUGAUAUACUCUUAAGUGAAUA | 23 | 20872 |
| CFTR-Intron10-1989 | - | AUAUGAUAUACUCUUAAGUGAAUA | 24 | 20873 |
| CFTR-Intron10-1990 | - | CUAACCUUCAUGUUGAUA | 18 | 20874 |
| CFTR-Intron10-1991 | - | CCUAACCUUCAUGUUGAUA | 19 | 20875 |
| CFTR-Intron10-1992 | - | CCCUAACCUUCAUGUUGAUA | 20 | 20876 |
| CFTR-Intron10-1993 | - | UGGAUAUUCUAUGAUAUA | 18 | 20877 |
| CFTR-Intron10-1994 | - | AUGGAUAUUCUAUGAUAUA | 19 | 20878 |
| CFTR-Intron10-1995 | - | UGGAUGGAUAUUCUAUGAUAUA | 22 | 20879 |
| CFTR-Intron10-1996 | - | AUGGAUGGAUAUUCUAUGAUAUA | 23 | 20880 |
| CFTR-Intron10-1997 | - | UAUGGAUGGAUAUUCUAUGAUAUA | 24 | 20881 |
| CFTR-Intron10-1998 | - | AUACUUUCUAGAAUUAUA | 18 | 20882 |
| CFTR-Intron10-1999 | - | AAUACUUUCUAGAAUUAUA | 19 | 20883 |
| CFTR-Intron10-2000 | - | AAAUACUUUCUAGAAUUAUA | 20 | 20884 |
| CFTR-Intron10-2001 | - | UUUUGCUUGCUUUUUAUA | 18 | 20885 |
| CFTR-Intron10-2002 | - | UUUUUGCUUGCUUUUUAUA | 19 | 20886 |
| CFTR-Intron10-2003 | - | UCUGAGAAGACAAAGCUA | 18 | 20887 |
| CFTR-Intron10-2004 | - | AGUCUGAGAAGACAAAGCUA | 20 | 20888 |
| CFTR-Intron10-2005 | - | AAGUCUGAGAAGACAAAGCUA | 21 | 20889 |
| CFTR-Intron10-2006 | - | AAAGUCUGAGAAGACAAAGCUA | 22 | 20890 |
| CFTR-Intron10-2007 | - | AAAAGUCUGAGAAGACAAAGCUA | 23 | 20891 |
| CFTR-Intron10-2008 | - | UAAAAGUCUGAGAAGACAAAGCUA | 24 | 20892 |
| CFTR-Intron10-2009 | - | AGUGAAGCAAUAUUAGUA | 18 | 20893 |
| CFTR-Intron10-2010 | - | UAGUGAAGCAAUAUUAGUA | 19 | 20894 |
| CFTR-Intron10-2011 | - | UUAGUGAAGCAAUAUUAGUA | 20 | 20895 |
| CFTR-Intron10-2012 | - | UUUAGUGAAGCAAUAUUAGUA | 21 | 20896 |

TABLE 41B-continued

2nd Tier

| gRNA Name | DNA Strand | Targeting Domain | Target Site Length | Seq ID |
|---|---|---|---|---|
| CFTR-Intron10-2013 | − | UUUUAGUGAAGCAAUAUUAGUA | 22 | 20897 |
| CFTR-Intron10-2014 | − | AUUUUAGUGAAGCAAUAUUAGUA | 23 | 20898 |
| CFTR-Intron10-2015 | − | UAUUUUAGUGAAGCAAUAUUAGUA | 24 | 20899 |
| CFTR-Intron10-2016 | − | UAAUCGGCGGUGGAGGUA | 18 | 20900 |
| CFTR-Intron10-389 | − | AGUAAUCGGCGGUGGAGGUA | 20 | 19275 |
| CFTR-Intron10-2017 | − | AAGUAAUCGGCGGUGGAGGUA | 21 | 20901 |
| CFTR-Intron10-2018 | − | AGAAGUAAUCGGCGGUGGAGGUA | 23 | 20902 |
| CFTR-Intron10-2019 | − | CAUUGCCUCACUAUGGUA | 18 | 20903 |
| CFTR-Intron10-2020 | − | UCAUUGCCUCACUAUGGUA | 19 | 20904 |
| CFTR-Intron10-2021 | − | AUCAUUGCCUCACUAUGGUA | 20 | 20905 |
| CFTR-Intron10-2022 | − | UGAUCAUUGCCUCACUAUGGUA | 22 | 20906 |
| CFTR-Intron10-2023 | − | UUGAUCAUUGCCUCACUAUGGUA | 23 | 20907 |
| CFTR-Intron10-2024 | − | AUUGAUCAUUGCCUCACUAUGGUA | 24 | 20908 |
| CFTR-Intron10-2025 | − | AACUGGGACUCAUAUGUA | 18 | 20909 |
| CFTR-Intron10-2026 | − | UAACUGGGACUCAUAUGUA | 19 | 20910 |
| CFTR-Intron10-2027 | − | AUAACUGGGACUCAUAUGUA | 20 | 20911 |
| CFTR-Intron10-2028 | − | AAUAACUGGGACUCAUAUGUA | 21 | 20912 |
| CFTR-Intron10-2029 | − | UAAUAACUGGGACUCAUAUGUA | 22 | 20913 |
| CFTR-Intron10-2030 | − | UGUAAUAACUGGGACUCAUAUGUA | 24 | 20914 |
| CFTR-Intron10-2031 | − | AGGAAGAUCCAAUAGGAUUA | 20 | 20915 |
| CFTR-Intron10-2032 | − | AAGGAAGAUCCAAUAGGAUUA | 21 | 20916 |
| CFTR-Intron10-2033 | − | UGAAGGAAGAUCCAAUAGGAUUA | 23 | 20917 |
| CFTR-Intron10-2034 | − | UUGAAGGAAGAUCCAAUAGGAUUA | 24 | 20918 |
| CFTR-Intron10-2035 | − | UGCAGGAGGUGAGGGAUUA | 19 | 20919 |
| CFTR-Intron10-394 | − | UUGCAGGAGGUGAGGGAUUA | 20 | 19280 |
| CFTR-Intron10-2036 | − | CAGCCAAUAAAAGGUUUGUUA | 21 | 20920 |
| CFTR-Intron10-2037 | − | UCAGCCAAUAAAAGGUUUGUUA | 22 | 20921 |
| CFTR-Intron10-2038 | − | UUCAGCCAAUAAAAGGUUUGUUA | 23 | 20922 |
| CFTR-Intron10-2039 | − | AUUCAGCCAAUAAAAGGUUUGUUA | 24 | 20923 |
| CFTR-Intron10-2040 | − | AGUUAGCAAUGGUCUAAAC | 19 | 20924 |
| CFTR-Intron10-2041 | − | AAGUUAGCAAUGGUCUAAAC | 20 | 20925 |
| CFTR-Intron10-2042 | − | AUUCUGUUUAAAUAGCAC | 18 | 20926 |
| CFTR-Intron10-410 | − | UGAUUCUGUUUAAAUAGCAC | 20 | 19296 |
| CFTR-Intron10-2043 | − | CUGAUUCUGUUUAAAUAGCAC | 21 | 20927 |
| CFTR-Intron10-2044 | − | CCUGAUUCUGUUUAAAUAGCAC | 22 | 20928 |
| CFTR-Intron10-2045 | − | CCCUGAUUCUGUUUAAAUAGCAC | 23 | 20929 |
| CFTR-Intron10-2046 | − | CCCCUGAUUCUGUUUAAAUAGCAC | 24 | 20930 |

TABLE 41B-continued

| | | 2nd Tier | | |
|---|---|---|---|---|
| gRNA Name | DNA Strand | Targeting Domain | Target Site Length | Seq ID |
| CFTR-Intron10-2047 | - | AGAGAAGGUCAAACUUGAC | 19 | 20931 |
| CFTR-Intron10-2048 | - | UAGAGAAGGUCAAACUUGAC | 20 | 20932 |
| CFTR-Intron10-2049 | - | AGUAGAGAAGGUCAAACUUGAC | 22 | 20933 |
| CFTR-Intron10-2050 | - | UAGUAGAGAAGGUCAAACUUGAC | 23 | 20934 |
| CFTR-Intron10-2051 | - | AUAGUAGAGAAGGUCAAACUUGAC | 24 | 20935 |
| CFTR-Intron10-2052 | - | CUCUAUAUAAAGUGAUCC | 18 | 20936 |
| CFTR-Intron10-2053 | - | UCUCUAUAUAAAGUGAUCC | 19 | 20937 |
| CFTR-Intron10-2054 | - | CUCUCUAUAUAAAGUGAUCC | 20 | 20938 |
| CFTR-Intron10-2055 | - | UCUCUCUAUAUAAAGUGAUCC | 21 | 20939 |
| CFTR-Intron10-2056 | - | UUCUCUCUAUAUAAAGUGAUCC | 22 | 20940 |
| CFTR-Intron10-2057 | - | UUUCUCUCUAUAUAAAGUGAUCC | 23 | 20941 |
| CFTR-Intron10-2058 | - | AUUUCUCUCUAUAUAAAGUGAUCC | 24 | 20942 |
| CFTR-Intron10-2059 | - | AUUCUUUUGAUAUACUCC | 18 | 20943 |
| CFTR-Intron10-2060 | - | UAUUCUUUUGAUAUACUCC | 19 | 20944 |
| CFTR-Intron10-1213 | - | UUAUUCUUUUGAUAUACUCC | 20 | 20098 |
| CFTR-Intron10-2061 | - | CUUAUUCUUUUGAUAUACUCC | 21 | 20945 |
| CFTR-Intron10-2062 | - | CCUUAUUCUUUUGAUAUACUCC | 22 | 20946 |
| CFTR-Intron10-2063 | - | UGCCUUAUUCUUUUGAUAUACUCC | 24 | 20947 |
| CFTR-Intron10-2064 | - | UGCGCUUAUGAAACUUCC | 18 | 20948 |
| CFTR-Intron10-2065 | - | UUGCGCUUAUGAAACUUCC | 19 | 20949 |
| CFTR-Intron10-2066 | - | CUUGCGCUUAUGAAACUUCC | 20 | 20950 |
| CFTR-Intron10-2067 | - | UCUUGCGCUUAUGAAACUUCC | 21 | 20951 |
| CFTR-Intron10-2068 | - | UGUCUUGCGCUUAUGAAACUUCC | 23 | 20952 |
| CFTR-Intron10-2069 | - | AUGUCUUGCGCUUAUGAAACUUCC | 24 | 20953 |
| CFTR-Intron10-2070 | - | AAACCAAACAAGCUUUCC | 18 | 20954 |
| CFTR-Intron10-2071 | - | AAAACCAAACAAGCUUUCC | 19 | 20955 |
| CFTR-Intron10-2072 | - | UAAAACCAAACAAGCUUUCC | 20 | 20956 |
| CFTR-Intron10-2073 | - | CUUUAAAACAAAAUAGC | 18 | 20957 |
| CFTR-Intron10-1220 | - | AGCUUUUAAAACAAAAUAGC | 20 | 20105 |
| CFTR-Intron10-2074 | - | AGGAAGACAGCUGGCUAUC | 19 | 20958 |
| CFTR-Intron10-2075 | - | CAGGAAGACAGCUGGCUAUC | 20 | 20959 |
| CFTR-Intron10-2076 | - | AGCAGGAAGACAGCUGGCUAUC | 22 | 20960 |
| CFTR-Intron10-2077 | - | CAGCAGGAAGACAGCUGGCUAUC | 23 | 20961 |
| CFTR-Intron10-2078 | - | ACAGCAGGAAGACAGCUGGCUAUC | 24 | 20962 |
| CFTR-Intron10-2079 | - | AGCUGGCUAUCCAGGAUUC | 19 | 20963 |
| CFTR-Intron10-441 | - | CAGCUGGCUAUCCAGGAUUC | 20 | 19327 |
| CFTR-Intron10-2080 | - | ACAGCUGGCUAUCCAGGAUUC | 21 | 20964 |

TABLE 41B-continued

| gRNA Name | DNA Strand | Targeting Domain | Target Site Length | Seq ID |
|---|---|---|---|---|
| CFTR-Intron10-2081 | - | AGACAGCUGGCUAUCCAGGAUUC | 23 | 20965 |
| CFTR-Intron10-2082 | - | AAGACAGCUGGCUAUCCAGGAUUC | 24 | 20966 |
| CFTR-Intron10-2083 | - | UUCUGUAAUUUUUGCUUC | 18 | 20967 |
| CFTR-Intron10-2084 | - | AGACUUUGUAGUGAUCUUC | 19 | 20968 |
| CFTR-Intron10-2085 | - | AAGACUUUGUAGUGAUCUUC | 20 | 20969 |
| CFTR-Intron10-2086 | - | AGAAGACUUUGUAGUGAUCUUC | 22 | 20970 |
| CFTR-Intron10-2087 | - | AGCUUUUCAAAAUACUUUC | 19 | 20971 |
| CFTR-Intron10-2088 | - | AAGCUUUUCAAAAUACUUUC | 20 | 20972 |
| CFTR-Intron10-2089 | - | UGAAGCUUUUCAAAAUACUUUC | 22 | 20973 |
| CFTR-Intron10-2090 | - | UUGAAGCUUUUCAAAAUACUUUC | 23 | 20974 |
| CFTR-Intron10-2091 | - | CUUGAAGCUUUUCAAAAUACUUUC | 24 | 20975 |
| CFTR-Intron10-2092 | - | AACAGUACAAGAAAAAG | 18 | 20976 |
| CFTR-Intron10-2093 | - | UAACAGUACAAGAAAAAG | 19 | 20977 |
| CFTR-Intron10-2094 | - | UGCCAUUAACAGAUAAAG | 18 | 20978 |
| CFTR-Intron10-2095 | - | UUGCCAUUAACAGAUAAAG | 19 | 20979 |
| CFTR-Intron10-2096 | - | UUUGCCAUUAACAGAUAAAG | 20 | 20980 |
| CFTR-Intron10-2097 | - | AUAUGAGAAAAGUCACAG | 18 | 20981 |
| CFTR-Intron10-2098 | - | CAUAUGAGAAAAGUCACAG | 19 | 20982 |
| CFTR-Intron10-2099 | - | UGGCAUAUGAGAAAAGUCACAG | 22 | 20983 |
| CFTR-Intron10-2100 | - | AUGGCAUAUGAGAAAAGUCACAG | 23 | 20984 |
| CFTR-Intron10-2101 | - | AAUGGCAUAUGAGAAAAGUCACAG | 24 | 20985 |
| CFTR-Intron10-2102 | - | CCAACUGAUGUCAAGCAG | 18 | 20986 |
| CFTR-Intron10-2103 | - | CCCAACUGAUGUCAAGCAG | 19 | 20987 |
| CFTR-Intron10-2104 | - | ACCCAACUGAUGUCAAGCAG | 20 | 20988 |
| CFTR-Intron10-2105 | - | AACCCAACUGAUGUCAAGCAG | 21 | 20989 |
| CFTR-Intron10-2106 | - | CGGAACCCAACUGAUGUCAAGCAG | 24 | 20990 |
| CFTR-Intron10-2107 | - | AGUAUUAGAGGUUAAGGAG | 19 | 20991 |
| CFTR-Intron10-2108 | - | AAGUAUUAGAGGUUAAGGAG | 20 | 20992 |
| CFTR-Intron10-2109 | - | UAAGUAUUAGAGGUUAAGGAG | 21 | 20993 |
| CFTR-Intron10-2110 | - | CUAAGUAUUAGAGGUUAAGGAG | 22 | 20994 |
| CFTR-Intron10-2111 | - | UCUAAGUAUUAGAGGUUAAGGAG | 23 | 20995 |
| CFTR-Intron10-2112 | - | UUCUAAGUAUUAGAGGUUAAGGAG | 24 | 20996 |
| CFTR-Intron10-2113 | - | AGUCUUUUCCUCUUAAUAG | 19 | 20997 |
| CFTR-Intron10-2114 | - | AAGUCUUUUCCUCUUAAUAG | 20 | 20998 |
| CFTR-Intron10-2115 | - | UGAAGUCUUUUCCUCUUAAUAG | 22 | 20999 |
| CFTR-Intron10-2116 | - | CUGAAGUCUUUUCCUCUUAAUAG | 23 | 21000 |
| CFTR-Intron10-2117 | - | CCUGAAGUCUUUUCCUCUUAAUAG | 24 | 21001 |

TABLE 41B-continued

2nd Tier

| gRNA Name | DNA Strand | Targeting Domain | Target Site Length | Seq ID |
|---|---|---|---|---|
| CFTR-Intron10-2118 | − | UGAAAAGCAGCUAUGAAGG | 19 | 21002 |
| CFTR-Intron10-2119 | − | AUGAAAAGCAGCUAUGAAGG | 20 | 21003 |
| CFTR-Intron10-2120 | − | UAUGAAAAGCAGCUAUGAAGG | 21 | 21004 |
| CFTR-Intron10-2121 | − | UUAUGAAAAGCAGCUAUGAAGG | 22 | 21005 |
| CFTR-Intron10-2122 | − | CUUAUGAAAAGCAGCUAUGAAGG | 23 | 21006 |
| CFTR-Intron10-2123 | − | UUUCAACUUAUACACAGG | 18 | 21007 |
| CFTR-Intron10-2124 | − | AUUUCAACUUAUACACAGG | 19 | 21008 |
| CFTR-Intron10-468 | − | CAUUUCAACUUAUACACAGG | 20 | 19354 |
| CFTR-Intron10-2125 | − | UCAUUUCAACUUAUACACAGG | 21 | 21009 |
| CFTR-Intron10-2126 | − | AUCAUUUCAACUUAUACACAGG | 22 | 21010 |
| CFTR-Intron10-2127 | − | UAUCAUUUCAACUUAUACACAGG | 23 | 21011 |
| CFTR-Intron10-2128 | − | AUAUCAUUUCAACUUAUACACAGG | 24 | 21012 |
| CFTR-Intron10-2129 | − | UGGCAUAGAGUAAGACAGG | 19 | 21013 |
| CFTR-Intron10-2130 | − | CUGGCAUAGAGUAAGACAGG | 20 | 21014 |
| CFTR-Intron10-2131 | − | AGGCUGGCAUAGAGUAAGACAGG | 23 | 21015 |
| CFTR-Intron10-2132 | − | AAUAAAUUUGGUGUCAGG | 18 | 21016 |
| CFTR-Intron10-2133 | − | CAAUAAAUUUGGUGUCAGG | 19 | 21017 |
| CFTR-Intron10-2134 | − | UCAAUAAAUUUGGUGUCAGG | 20 | 21018 |
| CFTR-Intron10-2135 | − | CUCAAUAAAUUUGGUGUCAGG | 21 | 21019 |
| CFTR-Intron10-2136 | − | ACUCAAUAAAUUUGGUGUCAGG | 22 | 21020 |
| CFTR-Intron10-2137 | − | CACUCAAUAAAUUUGGUGUCAGG | 23 | 21021 |
| CFTR-Intron10-2138 | − | CCACUCAAUAAAUUUGGUGUCAGG | 24 | 21022 |
| CFTR-Intron10-2139 | − | UGGUAGUGUGAAGAUGGGG | 19 | 21023 |
| CFTR-Intron10-2140 | − | CUGGUAGUGUGAAGAUGGGG | 20 | 21024 |
| CFTR-Intron10-2141 | − | AGGGAAUGCAGACUCUGGG | 19 | 21025 |
| CFTR-Intron10-2142 | − | UAGGGAAUGCAGACUCUGGG | 20 | 21026 |
| CFTR-Intron10-2143 | − | UUAGGGAAUGCAGACUCUGGG | 21 | 21027 |
| CFTR-Intron10-2144 | − | AUUAGGGAAUGCAGACUCUGGG | 22 | 21028 |
| CFTR-Intron10-2145 | − | UGGGGGAGCCCCAUAAAUG | 19 | 21029 |
| CFTR-Intron10-2146 | − | UUUUUAUGUAACAAUAUG | 18 | 21030 |
| CFTR-Intron10-2147 | − | CUUUUUAUGUAACAAUAUG | 19 | 21031 |
| CFTR-Intron10-2148 | − | UCUUUUUAUGUAACAAUAUG | 20 | 21032 |
| CFTR-Intron10-2149 | − | CUCUUUUUAUGUAACAAUAUG | 21 | 21033 |
| CFTR-Intron10-2150 | − | UCUCUUUUUAUGUAACAAUAUG | 22 | 21034 |
| CFTR-Intron10-2151 | − | CUCUCUUUUUAUGUAACAAUAUG | 23 | 21035 |
| CFTR-Intron10-2152 | − | CCUCUCUUUUUAUGUAACAAUAUG | 24 | 21036 |
| CFTR-Intron10-2153 | − | UGAGAUUAGAGGCCACUG | 18 | 21037 |

TABLE 41B-continued

| | | 2nd Tier | | |
|---|---|---|---|---|
| gRNA Name | DNA Strand | Targeting Domain | Target Site Length | Seq ID |
| CFTR-Intron10-2154 | - | UGCACAUAUGUUCAGACUG | 19 | 21038 |
| CFTR-Intron10-2155 | - | UUGCACAUAUGUUCAGACUG | 20 | 21039 |
| CFTR-Intron10-2156 | - | CUUGCACAUAUGUUCAGACUG | 21 | 21040 |
| CFTR-Intron10-2157 | - | ACUUGCACAUAUGUUCAGACUG | 22 | 21041 |
| CFTR-Intron10-2158 | - | UGUUAAAGAAUGACUGUG | 18 | 21042 |
| CFTR-Intron10-2159 | - | UUGUUAAAGAAUGACUGUG | 19 | 21043 |
| CFTR-Intron10-2160 | - | UUUGUUAAAGAAUGACUGUG | 20 | 21044 |
| CFTR-Intron10-492 | - | UGGCAUCUCACCAGUGUGUG | 20 | 19378 |
| CFTR-Intron10-2161 | - | AUGGCAUCUCACCAGUGUGUG | 21 | 21045 |
| CFTR-Intron10-2162 | - | UAUGGCAUCUCACCAGUGUGUG | 22 | 21046 |
| CFTR-Intron10-2163 | - | UUAUGGCAUCUCACCAGUGUGUG | 23 | 21047 |
| CFTR-Intron10-2164 | - | CUUAUGGCAUCUCACCAGUGUGUG | 24 | 21048 |
| CFTR-Intron10-2165 | - | UGAGGAGAACCAUAUUUUG | 19 | 21049 |
| CFTR-Intron10-2166 | - | AUGAGGAGAACCAUAUUUUG | 20 | 21050 |
| CFTR-Intron10-2167 | - | AGAUGAGGAGAACCAUAUUUUG | 22 | 21051 |
| CFTR-Intron10-2168 | - | AAGAUGAGGAGAACCAUAUUUUG | 23 | 21052 |
| CFTR-Intron10-2169 | - | UAAGAUGAGGAGAACCAUAUUUUG | 24 | 21053 |
| CFTR-Intron10-2170 | - | CCAUAAAUGUUGAAUAAU | 18 | 21054 |
| CFTR-Intron10-2171 | - | CCCAUAAAUGUUGAAUAAU | 19 | 21055 |
| CFTR-Intron10-1331 | - | CCCCAUAAAUGUUGAAUAAU | 20 | 20216 |
| CFTR-Intron10-2172 | - | AGCCCCAUAAAUGUUGAAUAAU | 22 | 21056 |
| CFTR-Intron10-2173 | - | AGAUUUUUUCCCAUGUAAU | 19 | 21057 |
| CFTR-Intron10-2174 | - | CAGAUUUUUUCCCAUGUAAU | 20 | 21058 |
| CFTR-Intron10-2175 | - | AUCACUAUUGAUUGACAU | 18 | 21059 |
| CFTR-Intron10-2176 | - | AAUCACUAUUGAUUGACAU | 19 | 21060 |
| CFTR-Intron10-2177 | - | UGAAUCACUAUUGAUUGACAU | 21 | 21061 |
| CFTR-Intron10-2178 | - | AUGAAUCACUAUUGAUUGACAU | 22 | 21062 |
| CFTR-Intron10-2179 | - | AAUGAAUCACUAUUGAUUGACAU | 23 | 21063 |
| CFTR-Intron10-2180 | - | UAAUGAAUCACUAUUGAUUGACAU | 24 | 21064 |
| CFTR-Intron10-2181 | - | UAGUUUCUAUUAAUAGAU | 18 | 21065 |
| CFTR-Intron10-2182 | - | UGUAGUUUCUAUUAAUAGAU | 20 | 21066 |
| CFTR-Intron10-2183 | - | CGUGUAGUUUCUAUUAAUAGAU | 22 | 21067 |
| CFTR-Intron10-2184 | - | UCGUGUAGUUUCUAUUAAUAGAU | 23 | 21068 |
| CFTR-Intron10-2185 | - | UUCGUGUAGUUUCUAUUAAUAGAU | 24 | 21069 |
| CFTR-Intron10-2186 | - | AGAAAGAGCUUUCUAGUAU | 19 | 21070 |
| CFTR-Intron10-2187 | - | AAAGCUGUGCAUUUUCCU | 18 | 21071 |
| CFTR-Intron10-2188 | - | AAAAGCUGUGCAUUUUCCU | 19 | 21072 |

TABLE 41B-continued

| | | 2nd Tier | | |
|---|---|---|---|---|
| gRNA Name | DNA Strand | Targeting Domain | Target Site Length | Seq ID |
| CFTR-Intron10-2189 | − | AAAAAGCUGUGCAUUUUCCU | 20 | 21073 |
| CFTR-Intron10-2190 | − | UGUUCAAAUUAUUUCUACUGCU | 22 | 21074 |
| CFTR-Intron10-2191 | − | UUGUUCAAAUUAUUUCUACUGCU | 23 | 21075 |
| CFTR-Intron10-2192 | − | UGUAGGCUAUAUGUAUCU | 18 | 21076 |
| CFTR-Intron10-2193 | − | CUGUAGGCUAUAUGUAUCU | 19 | 21077 |
| CFTR-Intron10-2194 | − | UCUGUAGGCUAUAUGUAUCU | 20 | 21078 |
| CFTR-Intron10-2195 | − | AGACUAAGGCUUAUUUCU | 18 | 21079 |
| CFTR-Intron10-2196 | − | AAGACUAAGGCUUAUUUCU | 19 | 21080 |
| CFTR-Intron10-2197 | − | AAAGACUAAGGCUUAUUUCU | 20 | 21081 |
| CFTR-Intron10-2198 | − | UAAAGACUAAGGCUUAUUUCU | 21 | 21082 |
| CFTR-Intron10-2199 | − | CGUAAAGACUAAGGCUUAUUUCU | 23 | 21083 |
| CFTR-Intron10-2200 | − | UCGUAAAGACUAAGGCUUAUUUCU | 24 | 21084 |
| CFTR-Intron10-2201 | − | AAGAAGAGAAAGGGGUGU | 18 | 21085 |
| CFTR-Intron10-2202 | − | UAAGAAGAGAAAGGGGUGU | 19 | 21086 |
| CFTR-Intron10-1378 | − | AUAAGAAGAGAAAGGGGUGU | 20 | 20262 |
| CFTR-Intron10-2203 | − | UGAUAAGAAGAGAAAGGGGUGU | 22 | 21087 |
| CFTR-Intron10-2204 | − | UUGAUAAGAAGAGAAAGGGGUGU | 23 | 21088 |
| CFTR-Intron10-2205 | − | AGUUGUUAUCUCUGAAAUU | 19 | 21089 |
| CFTR-Intron10-2206 | − | AAGUUGUUAUCUCUGAAAUU | 20 | 21090 |
| CFTR-Intron10-2207 | − | CAAGUUGUUAUCUCUGAAAUU | 21 | 21091 |
| CFTR-Intron10-2208 | − | UCAAGUUGUUAUCUCUGAAAUU | 22 | 21092 |
| CFTR-Intron10-2209 | − | AUCAAGUUGUUAUCUCUGAAAUU | 23 | 21093 |
| CFTR-Intron10-2210 | − | UAUCAAGUUGUUAUCUCUGAAAUU | 24 | 21094 |
| CFTR-Intron10-2211 | − | ACGGUAAGCUCAAGCAUU | 18 | 21095 |
| CFTR-Intron10-2212 | − | UACGGUAAGCUCAAGCAUU | 19 | 21096 |
| CFTR-Intron10-2213 | − | UUACGGUAAGCUCAAGCAUU | 20 | 21097 |
| CFTR-Intron10-2214 | − | AUUACGGUAAGCUCAAGCAUU | 21 | 21098 |
| CFTR-Intron10-2215 | − | UAUUACGGUAAGCUCAAGCAUU | 22 | 21099 |
| CFTR-Intron10-2216 | − | CUAUUACGGUAAGCUCAAGCAUU | 23 | 21100 |
| CFTR-Intron10-2217 | − | CUGCCUUUUAGUAGUAUU | 18 | 21101 |
| CFTR-Intron10-2218 | − | AGGCUGCCUUUUAGUAGUAUU | 21 | 21102 |
| CFTR-Intron10-2219 | − | AGGAGGCUGCCUUUUAGUAGUAUU | 24 | 21103 |
| CFTR-Intron10-2220 | − | AGAUUAGCUUAUAUACUU | 18 | 21104 |
| CFTR-Intron10-2221 | − | UAGAUUAGCUUAUAUACUU | 19 | 21105 |
| CFTR-Intron10-550 | − | AUAGAUUAGCUUAUAUACUU | 20 | 19436 |
| CFTR-Intron10-2222 | − | AAUAGAUUAGCUUAUAUACUU | 21 | 21106 |
| CFTR-Intron10-2223 | − | UGAAUAGAUUAGCUUAUAUACUU | 23 | 21107 |

TABLE 41B-continued

2nd Tier

| gRNA Name | DNA Strand | Targeting Domain | Target Site Length | Seq ID |
|---|---|---|---|---|
| CFTR-Intron10-2224 | − | UUGAAUAGAUUAGCUUAUAUACUU | 24 | 21108 |
| CFTR-Intron10-2225 | − | UUUUCCAAGCGGUCCCUU | 18 | 21109 |
| CFTR-Intron10-2226 | − | UUUUUCCAAGCGGUCCCUU | 19 | 21110 |
| CFTR-Intron10-2227 | − | UUUUUUCCAAGCGGUCCCUU | 20 | 21111 |
| CFTR-Intron10-2228 | − | UUUUUUUCCAAGCGGUCCCUU | 21 | 21112 |
| CFTR-Intron10-2229 | − | UUUUUUUUCCAAGCGGUCCCUU | 22 | 21113 |
| CFTR-Intron10-2230 | − | AUUUUUUUUCCAAGCGGUCCCUU | 23 | 21114 |
| CFTR-Intron10-2231 | − | AAUUUUUUUUCCAAGCGGUCCCUU | 24 | 21115 |
| CFTR-Intron10-2232 | − | AGAGGAAGGCAGUGGUCCCUU | 21 | 21116 |
| CFTR-Intron10-2233 | − | UAGAGGAAGGCAGUGGUCCCUU | 22 | 21117 |
| CFTR-Intron10-2234 | − | UUAGAGGAAGGCAGUGGUCCCUU | 23 | 21118 |
| CFTR-Intron10-2235 | − | AGAUGUGCAAAAAUAGCUU | 19 | 21119 |
| CFTR-Intron10-552 | − | UAGAUGUGCAAAAAUAGCUU | 20 | 19438 |
| CFTR-Intron10-2236 | − | AUAGAUGUGCAAAAAUAGCUU | 21 | 21120 |
| CFTR-Intron10-2237 | − | UGAUAGAUGUGCAAAAAUAGCUU | 23 | 21121 |
| CFTR-Intron10-2238 | − | AUGAUAGAUGUGCAAAAAUAGCUU | 24 | 21122 |
| CFTR-Intron10-2239 | − | ACAUGACCUUCCUUUCUU | 18 | 21123 |
| CFTR-Intron10-2240 | − | UACAUGACCUUCCUUUCUU | 19 | 21124 |
| CFTR-Intron10-2241 | − | UUACAUGACCUUCCUUUCUU | 20 | 21125 |
| CFTR-Intron10-2242 | − | UGUUACAUGACCUUCCUUUCUU | 22 | 21126 |
| CFTR-Intron10-2243 | − | CUGUUACAUGACCUUCCUUUCUU | 23 | 21127 |
| CFTR-Intron10-2244 | − | UCUGUUACAUGACCUUCCUUUCUU | 24 | 21128 |
| CFTR-Intron10-2245 | − | UAAUGGGAGAAACAGGUU | 18 | 21129 |
| CFTR-Intron10-2246 | − | AUAAUGGGAGAAACAGGUU | 19 | 21130 |
| CFTR-Intron10-2247 | − | AGCACUGGAGUUACCUGUU | 19 | 21131 |
| CFTR-Intron10-2248 | − | UAGCACUGGAGUUACCUGUU | 20 | 21132 |
| CFTR-Intron10-2249 | − | AUAGCACUGGAGUUACCUGUU | 21 | 21133 |
| CFTR-Intron10-2250 | − | AAUAGCACUGGAGUUACCUGUU | 22 | 21134 |
| CFTR-Intron10-2251 | − | AAAUAGCACUGGAGUUACCUGUU | 23 | 21135 |
| CFTR-Intron10-2252 | − | UAAAUAGCACUGGAGUUACCUGUU | 24 | 21136 |
| CFTR-Intron10-2253 | − | CAAAUAGUUUUAUCAAUAUUU | 21 | 21137 |
| CFTR-Intron10-2254 | − | UGCAAAUAGUUUUAUCAAUAUUU | 23 | 21138 |
| CFTR-Intron10-2255 | − | CUGCAAAUAGUUUUAUCAAUAUUU | 24 | 21139 |
| CFTR-Intron10-2256 | − | UUGGAUGGAGCUUGGUUU | 18 | 21140 |
| CFTR-Intron10-2257 | − | UUUGGAUGGAGCUUGGUUU | 19 | 21141 |
| CFTR-Intron10-563 | − | UUUUGGAUGGAGCUUGGUUU | 20 | 19449 |
| CFTR-Intron10-2258 | − | AGGUUUUGGAUGGAGCUUGGUUU | 23 | 21142 |

TABLE 41B-continued

2nd Tier

| gRNA Name | DNA Strand | Targeting Domain | Target Site Length | Seq ID |
|---|---|---|---|---|
| CFTR-Intron10-2259 | - | CAGGUUUUGGAUGGAGCUUGGUUU | 24 | 21143 |
| CFTR-Intron10-2260 | - | UGUCCUCCACAAAUAUUUU | 19 | 21144 |
| CFTR-Intron10-2261 | - | AUGUCCUCCACAAAUAUUUU | 20 | 21145 |

Table 41C provides exemplary targeting domains for correcting a mutation (e.g., 3272-26→G) in the CFTR gene selected according to the second tier parameters. The targeting domains bind within intron 10, start with a 5′G and PAM is NNGRRT. It is contemplated herein that in an embodiment the targeting domain hybridizes to the target domain through complementary base pairing. Any of the targeting domains in the Table can be used with a S. aureus Cas9 molecule that generates a double stranded break (Cas9 nuclease) or a single-stranded break (Cas9 nickase).

TABLE 41C

3rd Tier

| gRNA Name | DNA Strand | Targeting Domain | Target Site Length | Seq ID |
|---|---|---|---|---|
| CFTR-Intron10-2262 | + | GUAAGACCUAAUCUCUAAA | 19 | 21146 |
| CFTR-Intron10-2263 | + | GAGUAAGACCUAAUCUCUAAA | 21 | 21147 |
| CFTR-Intron10-2264 | + | GACAGAUGAGAGACAGUAAAGAA | 23 | 21148 |
| CFTR-Intron10-2265 | + | GGACAGAUGAGAGACAGUAAAGAA | 24 | 21149 |
| CFTR-Intron10-2266 | + | GUGUUCUCACAUGGCAGAA | 19 | 21150 |
| CFTR-Intron10-2267 | + | GCUGUGUUCUCACAUGGCAGAA | 22 | 21151 |
| CFTR-Intron10-2268 | + | GUUCUUAGGGUGGGAUAUGGAGAA | 24 | 21152 |
| CFTR-Intron10-2269 | + | GAAGAAAAGUAUCAAUAA | 18 | 21153 |
| CFTR-Intron10-2270 | + | GGAAGAAAAGUAUCAAUAA | 19 | 21154 |
| CFTR-Intron10-2271 | + | GUUUUUACCAUUAUCUACACA | 21 | 21155 |
| CFTR-Intron10-2272 | + | GAUAUGGAGAAGAGGAUGACCA | 22 | 21156 |
| CFTR-Intron10-2273 | + | GGAUAUGGAGAAGAGGAUGACCA | 23 | 21157 |
| CFTR-Intron10-2274 | + | GGGAUAUGGAGAAGAGGAUGACCA | 24 | 21158 |
| CFTR-Intron10-2275 | + | GAAGUUCAGCCUGGGUGA | 18 | 21159 |
| CFTR-Intron10-2276 | + | GCAAAAUUACAGAACCUAUA | 21 | 21160 |
| CFTR-Intron10-2277 | + | GAAGCAAAAUUACAGAACCUAUA | 24 | 21161 |
| CFTR-Intron10-2278 | + | GCUUCCUCCCUUGUCUCCCUA | 21 | 21162 |
| CFTR-Intron10-2279 | + | GUCUUCUCAGACUUUUAUUUUA | 22 | 21163 |
| CFTR-Intron10-2280 | + | GUUUCCAAAUUUUUUUUA | 18 | 21164 |
| CFTR-Intron10-2281 | + | GACAAGUUUCCAAAUUUUUUUUA | 23 | 21165 |
| CFTR-Intron10-2282 | + | GUGUGGCUUAUAAACAAC | 18 | 21166 |
| CFTR-Intron10-2283 | + | GAACUGUGUGGCUUAUAAACAAC | 23 | 21167 |
| CFTR-Intron10-2284 | + | GAAGAUACUAAAAAAAGUUAC | 21 | 21168 |
| CFTR-Intron10-2285 | + | GGAAGAUACUAAAAAAAGUUAC | 22 | 21169 |
| CFTR-Intron10-2286 | + | GGGAAGAUACUAAAAAAAGUUAC | 23 | 21170 |
| CFTR-Intron10-2287 | + | GAAAGGUCAAUUGAGCCC | 18 | 21171 |

TABLE 41C-continued

| 3rd Tier | | | | |
|---|---|---|---|---|
| gRNA Name | DNA Strand | Targeting Domain | Target Site Length | Seq ID |
| CFTR-Intron10-2288 | + | GGAAAGGUCAAUUGAGCCC | 19 | 21172 |
| CFTR-Intron10-2289 | + | GCGGAAAGGUCAAUUGAGCCC | 21 | 21173 |
| CFTR-Intron10-2290 | + | GAAGCGGAAAGGUCAAUUGAGCCC | 24 | 21174 |
| CFTR-Intron10-2291 | + | GCUACUUGGAAGACUCUUCC | 20 | 21175 |
| CFTR-Intron10-2292 | + | GAUCACACCACUGAAGUUCAGC | 22 | 21176 |
| CFTR-Intron10-2293 | + | GAGUUUCACUGUGUUAGC | 18 | 21177 |
| CFTR-Intron10-2294 | + | GGAGUUUCACUGUGUUAGC | 19 | 21178 |
| CFTR-Intron10-2295 | + | GACGGAGUUUCACUGUGUUAGC | 22 | 21179 |
| CFTR-Intron10-2296 | + | GAGACGGAGUUUCACUGUGUUAGC | 24 | 21180 |
| CFTR-Intron10-2297 | + | GUCUCACUCUGUCACCCAGGC | 21 | 21181 |
| CFTR-Intron10-2298 | + | GAGUCUCACUCUGUCACCCAGGC | 23 | 21182 |
| CFTR-Intron10-2299 | + | GCCUCUGCCUCCAAAAGUGC | 20 | 21183 |
| CFTR-Intron10-2300 | + | GCCAUUCUCCUGCCUCAGCCUC | 22 | 21184 |
| CFTR-Intron10-2301 | + | GCUCACUGCAAGUUCUGCCUC | 21 | 21185 |
| CFTR-Intron10-2302 | + | GGCUCACUGCAAGUUCUGCCUC | 22 | 21186 |
| CFTR-Intron10-2303 | + | GAUCUUCCUUCAAAGCAUGUC | 21 | 21187 |
| CFTR-Intron10-2304 | + | GGAUCUUCCUUCAAAGCAUGUC | 22 | 21188 |
| CFTR-Intron10-2305 | + | GUGAUAUUUUUCAUUAUGAUUC | 22 | 21189 |
| CFTR-Intron10-2306 | + | GGUGAUAUUUUUCAUUAUGAUUC | 23 | 21190 |
| CFTR-Intron10-2307 | + | GCUACUUGGGAGGCUGAGGCAG | 22 | 21191 |
| CFTR-Intron10-2308 | + | GCUACUUGGGAGGGUGAGGCAG | 22 | 21192 |
| CFTR-Intron10-701 | + | GUUUGUGUUUUUUGUAGAGG | 20 | 19587 |
| CFTR-Intron10-2309 | + | GCACUUUGGGAGGCCGAGGCGG | 22 | 21193 |
| CFTR-Intron10-2310 | + | GAACAAAAAUUAAAACUAAUGG | 22 | 21194 |
| CFTR-Intron10-2311 | + | GUGAACAAAAAUUAAAACUAAUGG | 24 | 21195 |
| CFTR-Intron10-2312 | + | GUAGUCCCAGCUACUUGG | 18 | 21196 |
| CFTR-Intron10-2313 | + | GCCUGUAGUCCCAGCUACUUGG | 22 | 21197 |
| CFTR-Intron10-2314 | + | GUGCCUGUAGUCCCAGCUACUUGG | 24 | 21198 |
| CFTR-Intron10-2315 | + | GCAAUACCAUCACCUUGGGAAU | 22 | 21199 |
| CFTR-Intron10-2316 | + | GAAUUAGGAUUUCAACAU | 18 | 21200 |
| CFTR-Intron10-2317 | + | GGAAUUAGGAUUUCAACAU | 19 | 21201 |
| CFTR-Intron10-2318 | + | GGGAAUUAGGAUUUCAACAU | 20 | 21202 |
| CFTR-Intron10-2319 | + | GAUCAAGGUGCCAGCAGAU | 19 | 21203 |
| CFTR-Intron10-2320 | + | GUGAUAGUUGCACAACUAU | 19 | 21204 |
| CFTR-Intron10-2321 | + | GGUGAUAGUUGCACAACUAU | 20 | 21205 |
| CFTR-Intron10-2322 | + | GAGGUGAUAGUUGCACAACUAU | 22 | 21206 |
| CFTR-Intron10-2323 | + | GGAGGUGAUAGUUGCACAACUAU | 23 | 21207 |
| CFTR-Intron10-2324 | + | GUUUAUUUACAUUUCUCUUUACU | 23 | 21208 |

TABLE 41C-continued

3rd Tier

| gRNA Name | DNA Strand | Targeting Domain | Target Site Length | Seq ID |
|---|---|---|---|---|
| CFTR-Intron10-2325 | + | GAAAAUGUUAAAUUUUCCCU | 20 | 21209 |
| CFTR-Intron10-2326 | + | GAAAUUUAAUUGCCAGUAAGUCU | 23 | 21210 |
| CFTR-Intron10-2327 | + | GUUCUCACAUGGCAGAAAGGGGU | 23 | 21211 |
| CFTR-Intron10-2328 | + | GCAUCACUAGUGGCACUUUGU | 21 | 21212 |
| CFTR-Intron10-2329 | + | GUGCAUCACUAGUGGCACUUUGU | 23 | 21213 |
| CFTR-Intron10-2330 | + | GACCCUUUAUCAACAUGAAGGUU | 23 | 21214 |
| CFTR-Intron10-2331 | + | GAAAUAUAGAUUUAAUCUUAUUU | 23 | 21215 |
| CFTR-Intron10-2332 | + | GGAAAUAUAGAUUUAAUCUUAUUU | 24 | 21216 |
| CFTR-Intron10-2333 | + | GUAUUUCUAGGCUAGACAGUUU | 22 | 21217 |
| CFTR-Intron10-2334 | + | GGUAUUUCUAGGCUAGACAGUUU | 23 | 21218 |
| CFTR-Intron10-2335 | + | GUUCAAGCCUGUAUUGUUU | 19 | 21219 |
| CFTR-Intron10-2336 | + | GCAGUUCAAGCCUGUAUUGUUU | 22 | 21220 |
| CFTR-Intron10-2337 | − | GAAUAUUUAAACACUUCUGAGAAA | 24 | 21221 |
| CFTR-Intron10-2338 | − | GACAUGCUUUGAAGGAAGAUCCAA | 24 | 21222 |
| CFTR-Intron10-2339 | − | GAACCAUAUUUUGAAGAA | 18 | 21223 |
| CFTR-Intron10-2340 | − | GAGAACCAUAUUUUGAAGAA | 20 | 21224 |
| CFTR-Intron10-2341 | − | GUAUAUUAUAGAAAUUUAA | 19 | 21225 |
| CFTR-Intron10-2342 | − | GGUAUAUUAUAGAAAUUUAA | 20 | 21226 |
| CFTR-Intron10-2343 | − | GACAGGUAUAUUAUAGAAAUUUAA | 24 | 21227 |
| CFTR-Intron10-2344 | − | GUGGAUUUUUGACUAUACA | 19 | 21228 |
| CFTR-Intron10-2345 | − | GAGGUCACUGAGGCUGGCA | 19 | 21229 |
| CFTR-Intron10-2346 | − | GGAGGUCACUGAGGCUGGCA | 20 | 21230 |
| CFTR-Intron10-2347 | − | GUAAGGAGGUCACUGAGGCUGGCA | 24 | 21231 |
| CFTR-Intron10-2348 | − | GAUAUGAAGUUAAAAACAUCA | 21 | 21232 |
| CFTR-Intron10-2349 | − | GAGAUAUGAAGUUAAAAACAUCA | 23 | 21233 |
| CFTR-Intron10-2350 | − | GGAGAUAUGAAGUUAAAAACAUCA | 24 | 21234 |
| CFTR-Intron10-2351 | − | GACCAGAAUGAAAUUAGA | 18 | 21235 |
| CFTR-Intron10-2352 | − | GAUGAUUCCAAGCUUUCUGGA | 21 | 21236 |
| CFTR-Intron10-2353 | − | GAAAUAAAUUUAAAGACAUGA | 21 | 21237 |
| CFTR-Intron10-2354 | − | GGAAAUAAAUUUAAAGACAUGA | 22 | 21238 |
| CFTR-Intron10-2355 | − | GAGGAAAUAAAUUUAAAGACAUGA | 24 | 21239 |
| CFTR-Intron10-2356 | − | GAGAAGACAAAGCUAGUGA | 19 | 21240 |
| CFTR-Intron10-2357 | − | GUCUGAGAAGACAAAGCUAGUGA | 23 | 21241 |
| CFTR-Intron10-2358 | − | GCACUCUAGCCUGGGUGA | 18 | 21242 |
| CFTR-Intron10-2359 | − | GCCACUGCACUCUAGCCUGGGUGA | 24 | 21243 |
| CFTR-Intron10-2360 | − | GCACCCCUAACCUUCAUGUUGAUA | 24 | 21244 |
| CFTR-Intron10-2361 | − | GACUUGCAGGAGGUGAGGGAUUA | 23 | 21245 |

TABLE 41C-continued

3rd Tier

| gRNA Name | DNA Strand | Targeting Domain | Target Site Length | Seq ID |
|---|---|---|---|---|
| CFTR-Intron10-2362 | - | GCCAAUAAAAGGUUUGUUA | 19 | 21246 |
| CFTR-Intron10-2363 | - | GCAUAUAUAUAUUUUUAAC | 19 | 21247 |
| CFTR-Intron10-2364 | - | GUGGAGUCAAAAAUUAUAC | 19 | 21248 |
| CFTR-Intron10-2365 | - | GUUUAGUGCAAUGCCAUAAACC | 22 | 21249 |
| CFTR-Intron10-2366 | - | GAAAAAGUAAGAUAUGCC | 18 | 21250 |
| CFTR-Intron10-2367 | - | GGUGAAUUGCUUGAGUCC | 18 | 21251 |
| CFTR-Intron10-2368 | - | GCAGGUGAAUUGCUUGAGUCC | 21 | 21252 |
| CFTR-Intron10-2369 | - | GGCAGGUGAAUUGCUUGAGUCC | 22 | 21253 |
| CFTR-Intron10-2370 | - | GAGGCAGGUGAAUUGCUUGAGUCC | 24 | 21254 |
| CFTR-Intron10-2371 | - | GAAAACAAAUUUUCUUUGUUUUCC | 24 | 21255 |
| CFTR-Intron10-2372 | - | GCGCCACUGCACUCUAGC | 18 | 21256 |
| CFTR-Intron10-2373 | - | GAUCGCGCCACUGCACUCUAGC | 22 | 21257 |
| CFTR-Intron10-2374 | - | GAGAUCGCGCCACUGCACUCUAGC | 24 | 21258 |
| CFTR-Intron10-2375 | - | GGGUUUCACCGUUUUAGC | 18 | 21259 |
| CFTR-Intron10-2376 | - | GGGGUUUCACCGUUUUAGC | 19 | 21260 |
| CFTR-Intron10-2377 | - | GACGGGGUUUCACCGUUUUAGC | 22 | 21261 |
| CFTR-Intron10-2378 | - | GAGACGGGGUUUCACCGUUUUAGC | 24 | 21262 |
| CFTR-Intron10-2379 | - | GUCUCGCUCUGUCGCCCAGGC | 21 | 21263 |
| CFTR-Intron10-2380 | - | GAGUCUCGCUCUGUCGCCCAGGC | 23 | 21264 |
| CFTR-Intron10-2381 | - | GGAGUCUCGCUCUGUCGCCCAGGC | 24 | 21265 |
| CFTR-Intron10-2382 | - | GGGUUUCACCAUGUUGGC | 18 | 21266 |
| CFTR-Intron10-2383 | - | GGGGUUUCACCAUGUUGGC | 19 | 21267 |
| CFTR-Intron10-2384 | - | GACGGGGUUUCACCAUGUUGGC | 22 | 21268 |
| CFTR-Intron10-2385 | - | GAGACGGGGUUUCACCAUGUUGGC | 24 | 21269 |
| CFTR-Intron10-686 | - | GCCUCGGCCUCCCAAAGUGC | 20 | 19572 |
| CFTR-Intron10-2386 | - | GCCCGCCUCGGCCUCCCAAAGUGC | 24 | 21270 |
| CFTR-Intron10-2387 | - | GCAGAGGCAGGUGAAUUGC | 19 | 21271 |
| CFTR-Intron10-2388 | - | GGCAGAGGCAGGUGAAUUGC | 20 | 21272 |
| CFTR-Intron10-2389 | - | GAGGCAGAGGCAGGUGAAUUGC | 22 | 21273 |
| CFTR-Intron10-2390 | - | GGAGGCAGAGGCAGGUGAAUUGC | 23 | 21274 |
| CFTR-Intron10-2391 | - | GCUCACUGCAAGCUCCGCCUC | 21 | 21275 |
| CFTR-Intron10-2392 | - | GGCUCACUGCAAGCUCCGCCUC | 22 | 21276 |
| CFTR-Intron10-2393 | - | GUUGUAACAGUACAAGAAAAAG | 23 | 21277 |
| CFTR-Intron10-2394 | - | GCUUUGCCAUUAACAGAUAAAG | 22 | 21278 |
| CFTR-Intron10-2395 | - | GCACUUUUGGAGGCAGAGGCAG | 22 | 21279 |
| CFTR-Intron10-2396 | - | GCUACUCGGGAGGCUGAGGCAG | 22 | 21280 |
| CFTR-Intron10-2397 | - | GACAAGGGAGGAAGCAAGGAG | 21 | 21281 |
| CFTR-Intron10-2398 | - | GAGACAAGGGAGGAAGCAAGGAG | 23 | 21282 |

TABLE 41C-continued

3rd Tier

| gRNA Name | DNA Strand | Targeting Domain | Target Site Length | Seq ID |
|---|---|---|---|---|
| CFTR-Intron10-2399 | - | GGAGACAAGGGAGGAAGCAAGGAG | 24 | 21283 |
| CFTR-Intron10-2400 | - | GACAUCCAAAUAGAGAUGUUAG | 22 | 21284 |
| CFTR-Intron10-2401 | - | GCAUAGAGUAAGACAGGGAGGG | 22 | 21285 |
| CFTR-Intron10-2402 | - | GGCAUAGAGUAAGACAGGGAGGG | 23 | 21286 |
| CFTR-Intron10-2403 | - | GCAUAGUAUUCUAUCAUAUGG | 21 | 21287 |
| CFTR-Intron10-2404 | - | GAUGCAUAGUAUUCUAUCAUAUGG | 24 | 21288 |
| CFTR-Intron10-2405 | - | GCUUUCUGGACUGAGUAACUGG | 22 | 21289 |
| CFTR-Intron10-2406 | - | GUAUAUAUGUGUGUCUGG | 18 | 21290 |
| CFTR-Intron10-2407 | - | GUAUGUAUAUAUGUGUGUCUGG | 22 | 21291 |
| CFTR-Intron10-2408 | - | GCCCAGGCUGGAGUGCAGUGG | 21 | 21292 |
| CFTR-Intron10-2409 | - | GUCGCCCAGGCUGGAGUGCAGUGG | 24 | 21293 |
| CFTR-Intron10-2410 | - | GCUACUUGGGAGGCUGAGGUGG | 22 | 21294 |
| CFTR-Intron10-2411 | - | GGUGGGGAGCCCCAUAAAUG | 21 | 21295 |
| CFTR-Intron10-2412 | - | GGGUGGGGAGCCCCAUAAAUG | 22 | 21296 |
| CFTR-Intron10-2413 | - | GGGUGAGAUUAGAGGCCACUG | 21 | 21297 |
| CFTR-Intron10-2414 | - | GCUUCAGCCUCCCAAAGUG | 19 | 21298 |
| CFTR-Intron10-2415 | - | GAACAAAGACUUGCAGGAGGUG | 22 | 21299 |
| CFTR-Intron10-2416 | - | GUUUGUUAAAGAAUGACUGUG | 21 | 21300 |
| CFTR-Intron10-2417 | - | GGUUUGUUAAAGAAUGACUGUG | 22 | 21301 |
| CFTR-Intron10-2418 | - | GCUAUUAGUAGUUAAGUUUUUG | 22 | 21302 |
| CFTR-Intron10-2419 | - | GGCUAUUAGUAGUUAAGUUUUUG | 23 | 21303 |
| CFTR-Intron10-2420 | - | GGGAGGUGAUUAGUCCAU | 18 | 21304 |
| CFTR-Intron10-2421 | - | GCCUUUGGGAGGUGAUUAGUCCAU | 24 | 21305 |
| CFTR-Intron10-2422 | - | GAUGCAUAGUAUUCUAUCAU | 20 | 21306 |
| CFTR-Intron10-2423 | - | GAUGAGAAAGAGCUUUCUAGUAU | 23 | 21307 |
| CFTR-Intron10-2424 | - | GUCUGUAGGCUAUAUGUAUCU | 21 | 21308 |
| CFTR-Intron10-716 | - | GCCUCGGCCUCCCAAAGUGU | 20 | 19602 |
| CFTR-Intron10-2425 | - | GCCUGCCUCGGCCUCCCAAAGUGU | 24 | 21309 |
| CFTR-Intron10-2426 | - | GGAAGGCAGUGGUCCCUU | 18 | 21310 |
| CFTR-Intron10-127 | - | GAGGAAGGCAGUGGUCCCUU | 20 | 19013 |
| CFTR-Intron10-2427 | - | GAAGCAAGGAGAUGAGUU | 18 | 21311 |
| CFTR-Intron10-2428 | - | GGAAGCAAGGAGAUGAGUU | 19 | 21312 |
| CFTR-Intron10-2429 | - | GAGGAAGCAAGGAGAUGAGUU | 21 | 21313 |
| CFTR-Intron10-2430 | - | GGAGGAAGCAAGGAGAUGAGUU | 22 | 21314 |
| CFTR-Intron10-2431 | - | GGGAGGAAGCAAGGAGAUGAGUU | 23 | 21315 |
| CFTR-Intron10-2432 | - | GAAAGAUAAUGGGAGAAACAGGUU | 24 | 21316 |
| CFTR-Intron10-2433 | - | GCAUGGGUCCACUUAUUU | 18 | 21317 |

TABLE 41C-continued

3rd Tier

| gRNA Name | DNA Strand | Targeting Domain | Target Site Length | Seq ID |
|---|---|---|---|---|
| CFTR-Intron10-2434 | − | GAACUGCAUGGGUCCACUUAUUU | 23 | 21318 |
| CFTR-Intron10-2435 | − | GCUUUUUGUUGUUUUUCUAGUUU | 24 | 21319 |
| CFTR-Intron10-2436 | − | GUUAAUACAUUGGAAAAUUUU | 21 | 21320 |
| CFTR-Intron10-2437 | − | GUAUGUCCUCCACAAAUAUUUU | 22 | 21321 |

Table 41D provides exemplary targeting domains for correcting a mutation (e.g., 3272-26→G) in the CFTR gene selected according to the fourth tier parameters. The targeting domains bind within intron 10, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 41D

4th Tier

| gRNA Name | DNA Strand | Targeting Domain | Target Site Length | Seq ID |
|---|---|---|---|---|
| CFTR-Intron10-2438 | + | CAAAAAAGCGAAGAAAAA | 18 | 21322 |
| CFTR-Intron10-2439 | + | ACAAAAAAGCGAAGAAAAA | 19 | 21323 |
| CFTR-Intron10-2440 | + | AACAAAAAAGCGAAGAAAAA | 20 | 21324 |
| CFTR-Intron10-2441 | + | CAACAAAAAAGCGAAGAAAAA | 21 | 21325 |
| CFTR-Intron10-2442 | + | ACAACAAAAAAGCGAAGAAAAA | 22 | 21326 |
| CFTR-Intron10-2443 | + | AACAACAAAAAAGCGAAGAAAAA | 23 | 21327 |
| CFTR-Intron10-2444 | + | AAACAACAAAAAAGCGAAGAAAAA | 24 | 21328 |
| CFTR-Intron10-2445 | + | AUACAUAUGAUUUUAUGAAAA | 21 | 21329 |
| CFTR-Intron10-2446 | + | CAUACAUAUGAUUUUAUGAAAA | 22 | 21330 |
| CFTR-Intron10-2447 | + | ACAUACAUAUGAUUUUAUGAAAA | 23 | 21331 |
| CFTR-Intron10-2448 | + | UACAUACAUAUGAUUUUAUGAAAA | 24 | 21332 |
| CFTR-Intron10-2449 | + | AGAUAAUACUACUGACUAAAA | 21 | 21333 |
| CFTR-Intron10-2450 | + | AAGAUAAUACUACUGACUAAAA | 22 | 21334 |
| CFTR-Intron10-2451 | + | AAAGAUAAUACUACUGACUAAAA | 23 | 21335 |
| CFTR-Intron10-2452 | + | AAAAGAUAAUACUACUGACUAAAA | 24 | 21336 |
| CFTR-Intron10-2453 | + | AUAAACAAACAAAGGAAA | 18 | 21337 |
| CFTR-Intron10-2454 | + | AAUAAACAAACAAAGGAAA | 19 | 21338 |
| CFTR-Intron10-1097 | + | AAAUAAACAAACAAAGGAAA | 20 | 19982 |
| CFTR-Intron10-2455 | + | CAAAUAAACAAACAAAGGAAA | 21 | 21339 |
| CFTR-Intron10-2456 | + | CCAAAUAAACAAACAAAGGAAA | 22 | 21340 |
| CFTR-Intron10-2457 | + | ACCAAAUAAACAAACAAAGGAAA | 23 | 21341 |
| CFTR-Intron10-2458 | + | AACCAAAUAAACAAACAAAGGAAA | 24 | 21342 |
| CFTR-Intron10-2459 | + | UAAGACCUAAUCUCUAAA | 18 | 21343 |
| CFTR-Intron10-2460 | + | AGUAAGACCUAAUCUCUAAA | 20 | 21344 |
| CFTR-Intron10-2461 | + | AGAGUAAGACCUAAUCUCUAAA | 22 | 21345 |

TABLE 41D-continued

4th Tier

| gRNA Name | DNA Strand | Targeting Domain | Target Site Length | Seq ID |
| --- | --- | --- | --- | --- |
| CFTR-Intron10-2462 | + | CAGAGUAAGACCUAAUCUCUAAA | 23 | 21346 |
| CFTR-Intron10-2463 | + | ACAGAGUAAGACCUAAUCUCUAAA | 24 | 21347 |
| CFTR-Intron10-2464 | + | CAGAUGAGAGACAGUAAAGAA | 21 | 21348 |
| CFTR-Intron10-2465 | + | ACAGAUGAGAGACAGUAAAGAA | 22 | 21349 |
| CFTR-Intron10-2466 | + | UGUUCUCACAUGGCAGAA | 18 | 21350 |
| CFTR-Intron10-1106 | + | UGUGUUCUCACAUGGCAGAA | 20 | 19991 |
| CFTR-Intron10-2467 | + | CUGUGUUCUCACAUGGCAGAA | 21 | 21351 |
| CFTR-Intron10-2468 | + | UGCUGUGUUCUCACAUGGCAGAA | 23 | 21352 |
| CFTR-Intron10-2469 | + | CUGCUGUGUUCUCACAUGGCAGAA | 24 | 21353 |
| CFTR-Intron10-2470 | + | CUUAGGGUGGGAUAUGGAGAA | 21 | 21354 |
| CFTR-Intron10-2471 | + | UCUUAGGGUGGGAUAUGGAGAA | 22 | 21355 |
| CFTR-Intron10-2472 | + | UUCUUAGGGUGGGAUAUGGAGAA | 23 | 21356 |
| CFTR-Intron10-1110 | + | AGGAAGAAAAGUAUCAAUAA | 20 | 19995 |
| CFTR-Intron10-2473 | + | CAGGAAGAAAAGUAUCAAUAA | 21 | 21357 |
| CFTR-Intron10-2474 | + | UCAGGAAGAAAAGUAUCAAUAA | 22 | 21358 |
| CFTR-Intron10-2475 | + | AUCAGGAAGAAAAGUAUCAAUAA | 23 | 21359 |
| CFTR-Intron10-2476 | + | AAUCAGGAAGAAAAGUAUCAAUAA | 24 | 21360 |
| CFTR-Intron10-2477 | + | AGUUUUUACCAUUAUCUACACA | 22 | 21361 |
| CFTR-Intron10-2478 | + | AAGUUUUUACCAUUAUCUACACA | 23 | 21362 |
| CFTR-Intron10-2479 | + | CAAGUUUUUACCAUUAUCUACACA | 24 | 21363 |
| CFTR-Intron10-2480 | + | AUAUGGAGAAGAGGAUGACCA | 21 | 21364 |
| CFTR-Intron10-2481 | + | AAAAGAGACACACCUAAAGCA | 21 | 21365 |
| CFTR-Intron10-2482 | + | UAAAAGAGACACACCUAAAGCA | 22 | 21366 |
| CFTR-Intron10-2483 | + | CUAAAAGAGACACACCUAAAGCA | 23 | 21367 |
| CFTR-Intron10-2484 | + | ACUAAAAGAGACACACCUAAAGCA | 24 | 21368 |
| CFTR-Intron10-2485 | + | CAAUAGUGAUUCAUUAUAUCA | 21 | 21369 |
| CFTR-Intron10-2486 | + | UCAAUAGUGAUUCAUUAUAUCA | 22 | 21370 |
| CFTR-Intron10-2487 | + | AUCAAUAGUGAUUCAUUAUAUCA | 23 | 21371 |
| CFTR-Intron10-2488 | + | AAUCAAUAGUGAUUCAUUAUAUCA | 24 | 21372 |
| CFTR-Intron10-2489 | + | UUGUAUUUUAGUAGAGA | 18 | 21373 |
| CFTR-Intron10-2490 | + | UUUGUAUUUUAGUAGAGA | 19 | 21374 |
| CFTR-Intron10-1141 | + | UUUUGUAUUUUAGUAGAGA | 20 | 20026 |
| CFTR-Intron10-2491 | + | UUUUUGUAUUUUAGUAGAGA | 21 | 21375 |
| CFTR-Intron10-2492 | + | UUUUUUGUAUUUUAGUAGAGA | 22 | 21376 |
| CFTR-Intron10-2493 | + | AUUUUUUGUAUUUUAGUAGAGA | 23 | 21377 |
| CFTR-Intron10-2494 | + | AAUUUUUUGUAUUUUAGUAGAGA | 24 | 21378 |
| CFTR-Intron10-2495 | + | UAUUUAUUUAUUUAGAGA | 18 | 21379 |

TABLE 41D-continued

4th Tier

| gRNA Name | DNA Strand | Targeting Domain | Target Site Length | Seq ID |
|---|---|---|---|---|
| CFTR-Intron10-2496 | + | UUAUUUAUUUAUUUAGAGA | 19 | 21380 |
| CFTR-Intron10-2497 | + | UUUAUUUAUUUAUUUAGAGA | 20 | 21381 |
| CFTR-Intron10-2498 | + | AUUUAUUUAUUUAUUUAGAGA | 21 | 21382 |
| CFTR-Intron10-2499 | + | UAUUUAUUUAUUUAUUUAGAGA | 22 | 21383 |
| CFTR-Intron10-2500 | + | UUAUUUAUUUAUUUAUUUAGAGA | 23 | 21384 |
| CFTR-Intron10-2501 | + | UUUAUUUAUUUAUUUAUUUAGAGA | 24 | 21385 |
| CFTR-Intron10-2502 | + | ACUAAAAGGCAGCCUCCUAGA | 21 | 21386 |
| CFTR-Intron10-2503 | + | UACUAAAAGGCAGCCUCCUAGA | 22 | 21387 |
| CFTR-Intron10-2504 | + | CUACUAAAAGGCAGCCUCCUAGA | 23 | 21388 |
| CFTR-Intron10-2505 | + | ACUACUAAAAGGCAGCCUCCUAGA | 24 | 21389 |
| CFTR-Intron10-2506 | + | UGAAGUUCAGCCUGGGUGA | 19 | 21390 |
| CFTR-Intron10-2507 | + | CUGAAGUUCAGCCUGGGUGA | 20 | 21391 |
| CFTR-Intron10-2508 | + | ACUGAAGUUCAGCCUGGGUGA | 21 | 21392 |
| CFTR-Intron10-2509 | + | CACUGAAGUUCAGCCUGGGUGA | 22 | 21393 |
| CFTR-Intron10-2510 | + | CCACUGAAGUUCAGCCUGGGUGA | 23 | 21394 |
| CFTR-Intron10-2511 | + | ACCACUGAAGUUCAGCCUGGGUGA | 24 | 21395 |
| CFTR-Intron10-2512 | + | CAAAUUACCAAAUUGUAUUGA | 21 | 21396 |
| CFTR-Intron10-2513 | + | ACAAAUUACCAAAUUGUAUUGA | 22 | 21397 |
| CFTR-Intron10-2514 | + | UACAAAUUACCAAAUUGUAUUGA | 23 | 21398 |
| CFTR-Intron10-2515 | + | AUACAAAUUACCAAAUUGUAUUGA | 24 | 21399 |
| CFTR-Intron10-2516 | + | AGCAAAAAUUACAGAACCUAUA | 22 | 21400 |
| CFTR-Intron10-2517 | + | AAGCAAAAAUUACAGAACCUAUA | 23 | 21401 |
| CFTR-Intron10-2518 | + | UUUGUUACAACAGUCUUUAUA | 21 | 21402 |
| CFTR-Intron10-2519 | + | UUUUGUUACAACAGUCUUUAUA | 22 | 21403 |
| CFTR-Intron10-2520 | + | CUUUUGUUACAACAGUCUUUAUA | 23 | 21404 |
| CFTR-Intron10-2521 | + | UCUUUUGUUACAACAGUCUUUAUA | 24 | 21405 |
| CFTR-Intron10-2522 | + | UGCUUCCUCCCUUGUCUCCCUA | 22 | 21406 |
| CFTR-Intron10-2523 | + | UUGCUUCCUCCCUUGUCUCCCUA | 23 | 21407 |
| CFTR-Intron10-2524 | + | CUUGCUUCCUCCCUUGUCUCCCUA | 24 | 21408 |
| CFTR-Intron10-2525 | + | CCUUUGUACAUUUCCUA | 18 | 21409 |
| CFTR-Intron10-2526 | + | UCCUUUGUACAUUUCCUA | 19 | 21410 |
| CFTR-Intron10-2527 | + | AUCCUUUGUACAUUUCCUA | 20 | 21411 |
| CFTR-Intron10-2528 | + | AAUCCUUUGUACAUUUCCUA | 21 | 21412 |
| CFTR-Intron10-2529 | + | CAAUCCUUUGUACAUUUCCUA | 22 | 21413 |
| CFTR-Intron10-2530 | + | UCAAUCCUUUGUACAUUUCCUA | 23 | 21414 |
| CFTR-Intron10-2531 | + | UUCAAUCCUUUGUACAUUUCCUA | 24 | 21415 |
| CFTR-Intron10-2532 | + | AGAUAAAAUUAUAAAUUA | 18 | 21416 |

TABLE 41D-continued

4th Tier

| gRNA Name | DNA Strand | Targeting Domain | Target Site Length | Seq ID |
|---|---|---|---|---|
| CFTR-Intron10-2533 | + | AAGAUAAAAUUAUAAAUUA | 19 | 21417 |
| CFTR-Intron10-2534 | + | AAAGAUAAAAUUAUAAAUUA | 20 | 21418 |
| CFTR-Intron10-2535 | + | UAAAGAUAAAAUUAUAAAUUA | 21 | 21419 |
| CFTR-Intron10-2536 | + | AUAAAGAUAAAAUUAUAAAUUA | 22 | 21420 |
| CFTR-Intron10-2537 | + | AAUAAAGAUAAAAUUAUAAAUUA | 23 | 21421 |
| CFTR-Intron10-2538 | + | UAAUAAAGAUAAAAUUAUAAAUUA | 24 | 21422 |
| CFTR-Intron10-2539 | + | UCUCAGACUUUUAUUUUA | 18 | 21423 |
| CFTR-Intron10-2540 | + | UUCUCAGACUUUUAUUUUA | 19 | 21424 |
| CFTR-Intron10-2541 | + | CUUCUCAGACUUUUAUUUUA | 20 | 21425 |
| CFTR-Intron10-2542 | + | UCUUCUCAGACUUUUAUUUUA | 21 | 21426 |
| CFTR-Intron10-2543 | + | UGUCUUCUCAGACUUUUAUUUUA | 23 | 21427 |
| CFTR-Intron10-2544 | + | UUGUCUUCUCAGACUUUUAUUUUA | 24 | 21428 |
| CFTR-Intron10-2545 | + | AGUUUCCAAAUUUUUUUUA | 19 | 21429 |
| CFTR-Intron10-2546 | + | AAGUUUCCAAAUUUUUUUUA | 20 | 21430 |
| CFTR-Intron10-2547 | + | CAAGUUUCCAAAUUUUUUUUA | 21 | 21431 |
| CFTR-Intron10-2548 | + | ACAAGUUUCCAAAUUUUUUUUA | 22 | 21432 |
| CFTR-Intron10-2549 | + | AGACAAGUUUCCAAAUUUUUUUUA | 24 | 21433 |
| CFTR-Intron10-2550 | + | UGUGUGGCUUAUAAACAAC | 19 | 21434 |
| CFTR-Intron10-1180 | + | CUGUGUGGCUUAUAAACAAC | 20 | 20065 |
| CFTR-Intron10-2551 | + | ACUGUGUGGCUUAUAAACAAC | 21 | 21435 |
| CFTR-Intron10-2552 | + | AACUGUGUGGCUUAUAAACAAC | 22 | 21436 |
| CFTR-Intron10-2553 | + | UGAACUGUGUGGCUUAUAAACAAC | 24 | 21437 |
| CFTR-Intron10-2554 | + | UGGGAAGAUACUAAAAAAAGUUAC | 24 | 21438 |
| CFTR-Intron10-1194 | + | CGGAAAGGUCAAUUGAGCCC | 20 | 20079 |
| CFTR-Intron10-2555 | + | AGCGGAAAGGUCAAUUGAGCCC | 22 | 21439 |
| CFTR-Intron10-2556 | + | AAGCGGAAAGGUCAAUUGAGCCC | 23 | 21440 |
| CFTR-Intron10-2557 | + | UACUUGGAAGACUCUUCC | 18 | 21441 |
| CFTR-Intron10-2558 | + | CUACUUGGAAGACUCUUCC | 19 | 21442 |
| CFTR-Intron10-2559 | + | UGCUACUUGGAAGACUCUUCC | 21 | 21443 |
| CFTR-Intron10-2560 | + | CUGCUACUUGGAAGACUCUUCC | 22 | 21444 |
| CFTR-Intron10-2561 | + | CCUGCUACUUGGAAGACUCUUCC | 23 | 21445 |
| CFTR-Intron10-2562 | + | ACCUGCUACUUGGAAGACUCUUCC | 24 | 21446 |
| CFTR-Intron10-2563 | + | ACACCACUGAAGUUCAGC | 18 | 21447 |
| CFTR-Intron10-2564 | + | CACACCACUGAAGUUCAGC | 19 | 21448 |
| CFTR-Intron10-2565 | + | UCACACCACUGAAGUUCAGC | 20 | 21449 |
| CFTR-Intron10-2566 | + | AUCACACCACUGAAGUUCAGC | 21 | 21450 |
| CFTR-Intron10-2567 | + | UGAUCACACCACUGAAGUUCAGC | 23 | 21451 |

TABLE 41D-continued

4th Tier

| gRNA Name | DNA Strand | Targeting Domain | Target Site Length | Seq ID |
|---|---|---|---|---|
| CFTR-Intron10-2568 | + | AUGAUCACACCACUGAAGUUCAGC | 24 | 21452 |
| CFTR-Intron10-2569 | + | CGGAGUUUCACUGUGUUAGC | 20 | 21453 |
| CFTR-Intron10-2570 | + | ACGGAGUUUCACUGUGUUAGC | 21 | 21454 |
| CFTR-Intron10-2571 | + | AGACGGAGUUUCACUGUGUUAGC | 23 | 21455 |
| CFTR-Intron10-2572 | + | UCACUCUGUCACCCAGGC | 18 | 21456 |
| CFTR-Intron10-2573 | + | CUCACUCUGUCACCCAGGC | 19 | 21457 |
| CFTR-Intron10-2574 | + | UCUCACUCUGUCACCCAGGC | 20 | 21458 |
| CFTR-Intron10-2575 | + | AGUCUCACUCUGUCACCCAGGC | 22 | 21459 |
| CFTR-Intron10-2576 | + | AGAGUCUCACUCUGUCACCCAGGC | 24 | 21460 |
| CFTR-Intron10-2577 | + | UUUUGAGCCUAUCACCUAGGC | 21 | 21461 |
| CFTR-Intron10-2578 | + | UUUUUGAGCCUAUCACCUAGGC | 22 | 21462 |
| CFTR-Intron10-2579 | + | UUUUUUGAGCCUAUCACCUAGGC | 23 | 21463 |
| CFTR-Intron10-2580 | + | UUUUUUUGAGCCUAUCACCUAGGC | 24 | 21464 |
| CFTR-Intron10-2581 | + | CUCUGCCUCCAAAAGUGC | 18 | 21465 |
| CFTR-Intron10-2582 | + | CCUCUGCCUCCAAAAGUGC | 19 | 21466 |
| CFTR-Intron10-2583 | + | UGCCUCUGCCUCCAAAAGUGC | 21 | 21467 |
| CFTR-Intron10-2584 | + | CUGCCUCUGCCUCCAAAAGUGC | 22 | 21468 |
| CFTR-Intron10-2585 | + | CCUGCCUCUGCCUCCAAAAGUGC | 23 | 21469 |
| CFTR-Intron10-2586 | + | ACCUGCCUCUGCCUCCAAAAGUGC | 24 | 21470 |
| CFTR-Intron10-2587 | + | UUCUCCUGCCUCAGCCUC | 18 | 16501 |
| CFTR-Intron10-2588 | + | AUUCUCCUGCCUCAGCCUC | 19 | 16502 |
| CFTR-Intron10-2589 | + | CAUUCUCCUGCCUCAGCCUC | 20 | 21471 |
| CFTR-Intron10-2590 | + | CCAUUCUCCUGCCUCAGCCUC | 21 | 21472 |
| CFTR-Intron10-2591 | + | CGCCAUUCUCCUGCCUCAGCCUC | 23 | 21473 |
| CFTR-Intron10-2592 | + | ACGCCAUUCUCCUGCCUCAGCCUC | 24 | 21474 |
| CFTR-Intron10-2593 | + | CACUGCAAGUUCUGCCUC | 18 | 21475 |
| CFTR-Intron10-2594 | + | UCACUGCAAGUUCUGCCUC | 19 | 21476 |
| CFTR-Intron10-2595 | + | CUCACUGCAAGUUCUGCCUC | 20 | 21477 |
| CFTR-Intron10-2596 | + | CGGCUCACUGCAAGUUCUGCCUC | 23 | 21478 |
| CFTR-Intron10-2597 | + | UCGGCUCACUGCAAGUUCUGCCUC | 24 | 21479 |
| CFTR-Intron10-2598 | + | UAUUGCUUUCAUUAAGUC | 18 | 21480 |
| CFTR-Intron10-2599 | + | CUAUUGCUUUCAUUAAGUC | 19 | 21481 |
| CFTR-Intron10-2600 | + | ACUAUUGCUUUCAUUAAGUC | 20 | 21482 |
| CFTR-Intron10-2601 | + | CUUCCUUCAAAGCAUGUC | 18 | 21483 |
| CFTR-Intron10-2602 | + | UCUUCCUUCAAAGCAUGUC | 19 | 21484 |
| CFTR-Intron10-2603 | + | AUCUUCCUUCAAAGCAUGUC | 20 | 21485 |
| CFTR-Intron10-2604 | + | UGGAUCUUCCUUCAAAGCAUGUC | 23 | 21486 |

TABLE 41D-continued

4th Tier

| gRNA Name | DNA Strand | Targeting Domain | Target Site Length | Seq ID |
|---|---|---|---|---|
| CFTR-Intron10-2605 | + | UUGGAUCUUCCUUCAAAGCAUGUC | 24 | 21487 |
| CFTR-Intron10-2606 | + | UGAUAUUUUCAUUAUGAUUC | 21 | 21488 |
| CFTR-Intron10-2607 | + | UGGUGAUAUUUUCAUUAUGAUUC | 24 | 21489 |
| CFTR-Intron10-2608 | + | CUUGGGAGGCUGAGGCAG | 18 | 21490 |
| CFTR-Intron10-2609 | + | ACUUGGGAGGCUGAGGCAG | 19 | 21491 |
| CFTR-Intron10-2610 | + | UACUUGGGAGGCUGAGGCAG | 20 | 21492 |
| CFTR-Intron10-2611 | + | CUACUUGGGAGGCUGAGGCAG | 21 | 21493 |
| CFTR-Intron10-2612 | + | AGCUACUUGGGAGGCUGAGGCAG | 23 | 21494 |
| CFTR-Intron10-2613 | + | CAGCUACUUGGGAGGCUGAGGCAG | 24 | 21495 |
| CFTR-Intron10-2614 | + | CUUGGGAGGGUGAGGCAG | 18 | 21496 |
| CFTR-Intron10-2615 | + | ACUUGGGAGGGUGAGGCAG | 19 | 21497 |
| CFTR-Intron10-2616 | + | UACUUGGGAGGGUGAGGCAG | 20 | 21498 |
| CFTR-Intron10-2617 | + | CUACUUGGGAGGGUGAGGCAG | 21 | 21499 |
| CFTR-Intron10-2618 | + | AGCUACUUGGGAGGGUGAGGCAG | 23 | 21500 |
| CFTR-Intron10-2619 | + | CAGCUACUUGGGAGGGUGAGGCAG | 24 | 21501 |
| CFTR-Intron10-2620 | + | UAAAAAUACAAAAAUUAG | 18 | 21502 |
| CFTR-Intron10-2621 | + | CUAAAAAUACAAAAAUUAG | 19 | 21503 |
| CFTR-Intron10-2622 | + | ACUAAAAAUACAAAAAUUAG | 20 | 21504 |
| CFTR-Intron10-2623 | + | UACUAAAAAUACAAAAAUUAG | 21 | 21505 |
| CFTR-Intron10-2624 | + | CUACUAAAAAUACAAAAAUUAG | 22 | 21506 |
| CFTR-Intron10-2625 | + | UCUACUAAAAAUACAAAAAUUAG | 23 | 21507 |
| CFTR-Intron10-2626 | + | CUCUACUAAAAAUACAAAAAUUAG | 24 | 21508 |
| CFTR-Intron10-2627 | + | UGAUCUUGAAGACAUACG | 18 | 21509 |
| CFTR-Intron10-2628 | + | UUGAUCUUGAAGACAUACG | 19 | 21510 |
| CFTR-Intron10-2629 | + | AUUGAUCUUGAAGACAUACG | 20 | 21511 |
| CFTR-Intron10-2630 | + | UUGUGUUUUUGUAGAGG | 18 | 21512 |
| CFTR-Intron10-2631 | + | UUUGUGUUUUUGUAGAGG | 19 | 21513 |
| CFTR-Intron10-2632 | + | UGUUUGUGUUUUUGUAGAGG | 21 | 21514 |
| CFTR-Intron10-2633 | + | UUGUUUGUGUUUUUGUAGAGG | 22 | 21515 |
| CFTR-Intron10-2634 | + | UUUGUUUGUGUUUUUGUAGAGG | 23 | 21516 |
| CFTR-Intron10-2635 | + | UUUUGUUUGUGUUUUUGUAGAGG | 24 | 21517 |
| CFTR-Intron10-2636 | + | UUUGGGAGGCCGAGGCGG | 18 | 21518 |
| CFTR-Intron10-2637 | + | CUUUGGGAGGCCGAGGCGG | 19 | 21519 |
| CFTR-Intron10-2638 | + | ACUUUGGGAGGCCGAGGCGG | 20 | 21520 |
| CFTR-Intron10-2639 | + | CACUUUGGGAGGCCGAGGCGG | 21 | 21521 |
| CFTR-Intron10-2640 | + | AGCACUUUGGGAGGCCGAGGCGG | 23 | 21522 |
| CFTR-Intron10-2641 | + | CAGCACUUUGGGAGGCCGAGGCGG | 24 | 21523 |

TABLE 41D-continued

4th Tier

| gRNA Name | DNA Strand | Targeting Domain | Target Site Length | Seq ID |
|---|---|---|---|---|
| CFTR-Intron10-2642 | + | AAAAAUUAAAACUAAUGG | 18 | 21524 |
| CFTR-Intron10-2643 | + | CAAAAAUUAAAACUAAUGG | 19 | 21525 |
| CFTR-Intron10-2644 | + | ACAAAAAUUAAAACUAAUGG | 20 | 21526 |
| CFTR-Intron10-2645 | + | AACAAAAAUUAAAACUAAUGG | 21 | 21527 |
| CFTR-Intron10-2646 | + | UGAACAAAAAUUAAAACUAAUGG | 23 | 21528 |
| CFTR-Intron10-2647 | + | CUUUAACAAACCUUUUAUUGG | 21 | 21529 |
| CFTR-Intron10-2648 | + | UCUUUAACAAACCUUUUAUUGG | 22 | 21530 |
| CFTR-Intron10-2649 | + | UUCUUUAACAAACCUUUUAUUGG | 23 | 21531 |
| CFTR-Intron10-2650 | + | AUUCUUUAACAAACCUUUUAUUGG | 24 | 21532 |
| CFTR-Intron10-2651 | + | UGUAGUCCCAGCUACUUGG | 19 | 21533 |
| CFTR-Intron10-2652 | + | CUGUAGUCCCAGCUACUUGG | 20 | 21534 |
| CFTR-Intron10-2653 | + | CCUGUAGUCCCAGCUACUUGG | 21 | 21535 |
| CFTR-Intron10-2654 | + | UGCCUGUAGUCCCAGCUACUUGG | 23 | 21536 |
| CFTR-Intron10-2655 | + | AAAGGAAAUGGGGUAUAAGUG | 21 | 21537 |
| CFTR-Intron10-2656 | + | CAAAGGAAAUGGGGUAUAAGUG | 22 | 21538 |
| CFTR-Intron10-2657 | + | ACAAAGGAAAUGGGGUAUAAGUG | 23 | 21539 |
| CFTR-Intron10-2658 | + | AACAAAGGAAAUGGGGUAUAAGUG | 24 | 21540 |
| CFTR-Intron10-2659 | + | ACUACUAAUAGCCUAUUG | 18 | 21541 |
| CFTR-Intron10-2660 | + | AACUACUAAUAGCCUAUUG | 19 | 21542 |
| CFTR-Intron10-2661 | + | UAACUACUAAUAGCCUAUUG | 20 | 21543 |
| CFTR-Intron10-2662 | + | UUAACUACUAAUAGCCUAUUG | 21 | 21544 |
| CFTR-Intron10-2663 | + | CUUAACUACUAAUAGCCUAUUG | 22 | 21545 |
| CFTR-Intron10-2664 | + | ACUUAACUACUAAUAGCCUAUUG | 23 | 21546 |
| CFTR-Intron10-2665 | + | AACUUAACUACUAAUAGCCUAUUG | 24 | 21547 |
| CFTR-Intron10-2666 | + | UAAAACUAAUGGCAGAAU | 18 | 21548 |
| CFTR-Intron10-2667 | + | UUAAAACUAAUGGCAGAAU | 19 | 21549 |
| CFTR-Intron10-2668 | + | AUUAAAACUAAUGGCAGAAU | 20 | 21550 |
| CFTR-Intron10-2669 | + | AAUUAAAACUAAUGGCAGAAU | 21 | 21551 |
| CFTR-Intron10-2670 | + | AAAUUAAAACUAAUGGCAGAAU | 22 | 21552 |
| CFTR-Intron10-2671 | + | AAAAUUAAAACUAAUGGCAGAAU | 23 | 21553 |
| CFTR-Intron10-2672 | + | AAAAAUUAAAACUAAUGGCAGAAU | 24 | 21554 |
| CFTR-Intron10-2673 | + | UACCAUCACCUUGGGAAU | 18 | 21555 |
| CFTR-Intron10-2674 | + | AUACCAUCACCUUGGGAAU | 19 | 21556 |
| CFTR-Intron10-2675 | + | AAUACCAUCACCUUGGGAAU | 20 | 21557 |
| CFTR-Intron10-2676 | + | CAAUACCAUCACCUUGGGAAU | 21 | 21558 |
| CFTR-Intron10-2677 | + | UGCAAUACCAUCACCUUGGGAAU | 23 | 21559 |
| CFTR-Intron10-2678 | + | CUGCAAUACCAUCACCUUGGGAAU | 24 | 21560 |

TABLE 41D-continued

4th Tier

| gRNA Name | DNA Strand | Targeting Domain | Target Site Length | Seq ID |
|---|---|---|---|---|
| CFTR-Intron10-2679 | + | UGGGAAUUAGGAUUUCAACAU | 21 | 21561 |
| CFTR-Intron10-2680 | + | UUGGGAAUUAGGAUUUCAACAU | 22 | 21562 |
| CFTR-Intron10-2681 | + | CUUGGGAAUUAGGAUUUCAACAU | 23 | 21563 |
| CFTR-Intron10-2682 | + | CCUUGGGAAUUAGGAUUUCAACAU | 24 | 21564 |
| CFTR-Intron10-2683 | + | AUCAAGGUGCCAGCAGAU | 18 | 21565 |
| CFTR-Intron10-2684 | + | AGAUCAAGGUGCCAGCAGAU | 20 | 21566 |
| CFTR-Intron10-2685 | + | AAGAUCAAGGUGCCAGCAGAU | 21 | 21567 |
| CFTR-Intron10-2686 | + | CAAGAUCAAGGUGCCAGCAGAU | 22 | 21568 |
| CFTR-Intron10-2687 | + | CCAAGAUCAAGGUGCCAGCAGAU | 23 | 21569 |
| CFTR-Intron10-2688 | + | UCCAAGAUCAAGGUGCCAGCAGAU | 24 | 21570 |
| CFTR-Intron10-2689 | + | UGAUAGUUGCACAACUAU | 18 | 21571 |
| CFTR-Intron10-2690 | + | AGGUGAUAGUUGCACAACUAU | 21 | 21572 |
| CFTR-Intron10-2691 | + | AGGAGGUGAUAGUUGCACAACUAU | 24 | 21573 |
| CFTR-Intron10-2692 | + | UUUACAUUUCUCUUUACU | 18 | 21574 |
| CFTR-Intron10-2693 | + | AUUUACAUUUCUCUUUACU | 19 | 21575 |
| CFTR-Intron10-2694 | + | UAUUUACAUUUCUCUUUACU | 20 | 21576 |
| CFTR-Intron10-2695 | + | UUAUUUACAUUUCUCUUUACU | 21 | 21577 |
| CFTR-Intron10-2696 | + | UUUAUUUACAUUUCUCUUUACU | 22 | 21578 |
| CFTR-Intron10-2697 | + | UGUUUAUUUACAUUUCUCUUUACU | 24 | 21579 |
| CFTR-Intron10-2698 | + | AAAUGUUAAAUUUUCCCU | 18 | 21580 |
| CFTR-Intron10-2699 | + | AAAAUGUUAAAUUUUCCCU | 19 | 21581 |
| CFTR-Intron10-2700 | + | AGUUACUCAGUCCAGAAAGCU | 21 | 21582 |
| CFTR-Intron10-2701 | + | CAGUUACUCAGUCCAGAAAGCU | 22 | 21583 |
| CFTR-Intron10-2702 | + | CCAGUUACUCAGUCCAGAAAGCU | 23 | 21584 |
| CFTR-Intron10-2703 | + | UCCAGUUACUCAGUCCAGAAAGCU | 24 | 21585 |
| CFTR-Intron10-2704 | + | AAUUUAAUUGCCAGUAAGUCU | 21 | 21586 |
| CFTR-Intron10-2705 | + | AAAUUUAAUUGCCAGUAAGUCU | 22 | 21587 |
| CFTR-Intron10-2706 | + | UGAAAUUUAAUUGCCAGUAAGUCU | 24 | 21588 |
| CFTR-Intron10-2707 | + | UAUGCCAGGUUAAGUUGUUCU | 21 | 21589 |
| CFTR-Intron10-2708 | + | AUAUGCCAGGUUAAGUUGUUCU | 22 | 21590 |
| CFTR-Intron10-2709 | + | AAUAUGCCAGGUUAAGUUGUUCU | 23 | 21591 |
| CFTR-Intron10-2710 | + | AAAUAUGCCAGGUUAAGUUGUUCU | 24 | 21592 |
| CFTR-Intron10-2711 | + | CACAUGGCAGAAAGGGGU | 18 | 21593 |
| CFTR-Intron10-2712 | + | UCACAUGGCAGAAAGGGGU | 19 | 21594 |
| CFTR-Intron10-2713 | + | CUCACAUGGCAGAAAGGGGU | 20 | 21595 |
| CFTR-Intron10-2714 | + | UCUCACAUGGCAGAAAGGGGU | 21 | 21596 |
| CFTR-Intron10-2715 | + | UUCUCACAUGGCAGAAAGGGGU | 22 | 21597 |

TABLE 41D-continued

4th Tier

| gRNA Name | DNA Strand | Targeting Domain | Target Site Length | Seq ID |
|---|---|---|---|---|
| CFTR-Intron10-2716 | + | UGUUCUCACAUGGCAGAAAGGGGU | 24 | 21598 |
| CFTR-Intron10-2717 | + | UCACUAGUGGCACUUUGU | 18 | 21599 |
| CFTR-Intron10-2718 | + | AUCACUAGUGGCACUUUGU | 19 | 21600 |
| CFTR-Intron10-2719 | + | CAUCACUAGUGGCACUUUGU | 20 | 21601 |
| CFTR-Intron10-2720 | + | UGCAUCACUAGUGGCACUUUGU | 22 | 21602 |
| CFTR-Intron10-2721 | + | CGUGCAUCACUAGUGGCACUUUGU | 24 | 21603 |
| CFTR-Intron10-2722 | + | CUGCAAUACCAUCACCUU | 18 | 21604 |
| CFTR-Intron10-2723 | + | CCUGCAAUACCAUCACCUU | 19 | 21605 |
| CFTR-Intron10-1395 | + | CCCUGCAAUACCAUCACCUU | 20 | 20279 |
| CFTR-Intron10-2724 | + | ACCCUGCAAUACCAUCACCUU | 21 | 21606 |
| CFTR-Intron10-2725 | + | CACCCUGCAAUACCAUCACCUU | 22 | 21607 |
| CFTR-Intron10-2726 | + | CCACCCUGCAAUACCAUCACCUU | 23 | 21608 |
| CFTR-Intron10-2727 | + | CCCACCCUGCAAUACCAUCACCUU | 24 | 21609 |
| CFTR-Intron10-2728 | + | AUAAAAGAAAUGCAAGUU | 18 | 21610 |
| CFTR-Intron10-2729 | + | AAUAAAAGAAAUGCAAGUU | 19 | 21611 |
| CFTR-Intron10-2730 | + | UAAUAAAAGAAAUGCAAGUU | 20 | 21612 |
| CFTR-Intron10-2731 | + | AUAAUAAAAGAAAUGCAAGUU | 21 | 21613 |
| CFTR-Intron10-2732 | + | UAUAAUAAAAGAAAUGCAAGUU | 22 | 21614 |
| CFTR-Intron10-2733 | + | UUAUAAUAAAAGAAAUGCAAGUU | 23 | 21615 |
| CFTR-Intron10-2734 | + | CUUAUAAUAAAAGAAAUGCAAGUU | 24 | 21616 |
| CFTR-Intron10-2735 | + | CCCUUUAUCAACAUGAAGGUU | 21 | 21617 |
| CFTR-Intron10-2736 | + | ACCCUUUAUCAACAUGAAGGUU | 22 | 21618 |
| CFTR-Intron10-2737 | + | UGACCCUUUAUCAACAUGAAGGUU | 24 | 21619 |
| CFTR-Intron10-2738 | + | AUAGAUUUAAUCUUAUUU | 18 | 21620 |
| CFTR-Intron10-2739 | + | UAUAGAUUUAAUCUUAUUU | 19 | 21621 |
| CFTR-Intron10-2740 | + | AUAUAGAUUUAAUCUUAUUU | 20 | 21622 |
| CFTR-Intron10-2741 | + | AAUAUAGAUUUAAUCUUAUUU | 21 | 21623 |
| CFTR-Intron10-2742 | + | AAAUAUAGAUUUAAUCUUAUUU | 22 | 21624 |
| CFTR-Intron10-2743 | + | UUCUAGGCUAGACAGUUU | 18 | 21625 |
| CFTR-Intron10-2744 | + | UUUCUAGGCUAGACAGUUU | 19 | 21626 |
| CFTR-Intron10-2745 | + | AUUUCUAGGCUAGACAGUUU | 20 | 21627 |
| CFTR-Intron10-2746 | + | UAUUUCUAGGCUAGACAGUUU | 21 | 21628 |
| CFTR-Intron10-2747 | + | CGGUAUUUCUAGGCUAGACAGUUU | 24 | 21629 |
| CFTR-Intron10-2748 | + | UUCAAGCCUGUAUUGUUU | 18 | 21630 |
| CFTR-Intron10-2749 | + | AGUUCAAGCCUGUAUUGUUU | 20 | 21631 |
| CFTR-Intron10-2750 | + | CAGUUCAAGCCUGUAUUGUUU | 21 | 21632 |
| CFTR-Intron10-2751 | + | UGCAGUUCAAGCCUGUAUUGUUU | 23 | 21633 |

TABLE 41D-continued

| | | 4th Tier | | |
|---|---|---|---|---|
| gRNA Name | DNA Strand | Targeting Domain | Target Site Length | Seq ID |
| CFTR-Intron10-2752 | + | AUGCAGUUCAAGCCUGUAUUGUUU | 24 | 21634 |
| CFTR-Intron10-2753 | − | UAUUUAAACACUUCUGAGAAA | 21 | 21635 |
| CFTR-Intron10-2754 | − | AUAUUUAAACACUUCUGAGAAA | 22 | 21636 |
| CFTR-Intron10-2755 | − | AAUAUUUAAACACUUCUGAGAAA | 23 | 21637 |
| CFTR-Intron10-2756 | − | AUGCUUUGAAGGAAGAUCCAA | 21 | 21638 |
| CFTR-Intron10-2757 | − | CAUGCUUUGAAGGAAGAUCCAA | 22 | 21639 |
| CFTR-Intron10-2758 | − | ACAUGCUUUGAAGGAAGAUCCAA | 23 | 21640 |
| CFTR-Intron10-2759 | − | AGAACCAUAUUUUGAAGAA | 19 | 21641 |
| CFTR-Intron10-2760 | − | UAUAUUAUAGAAAUUUAA | 18 | 21642 |
| CFTR-Intron10-2761 | − | AGGUAUAUUAUAGAAAUUUAA | 21 | 21643 |
| CFTR-Intron10-2762 | − | CAGGUAUAUUAUAGAAAUUUAA | 22 | 21644 |
| CFTR-Intron10-2763 | − | ACAGGUAUAUUAUAGAAAUUUAA | 23 | 21645 |
| CFTR-Intron10-2764 | − | UGGAUUUUUGACUAUACA | 18 | 21646 |
| CFTR-Intron10-2765 | − | CGUGGAUUUUUGACUAUACA | 20 | 21647 |
| CFTR-Intron10-2766 | − | ACGUGGAUUUUUGACUAUACA | 21 | 21648 |
| CFTR-Intron10-2767 | − | UACGUGGAUUUUUGACUAUACA | 22 | 21649 |
| CFTR-Intron10-2768 | − | AUACGUGGAUUUUUGACUAUACA | 23 | 21650 |
| CFTR-Intron10-2769 | − | UAUACGUGGAUUUUUGACUAUACA | 24 | 21651 |
| CFTR-Intron10-2770 | − | UCAUUAGGAAAAUGUACA | 18 | 21652 |
| CFTR-Intron10-2771 | − | CUCAUUAGGAAAAUGUACA | 19 | 21653 |
| CFTR-Intron10-2772 | − | ACUCAUUAGGAAAAUGUACA | 20 | 21654 |
| CFTR-Intron10-2773 | − | AGGUCACUGAGGCUGGCA | 18 | 21655 |
| CFTR-Intron10-2774 | − | AGGAGGUCACUGAGGCUGGCA | 21 | 21656 |
| CFTR-Intron10-2775 | − | AAGGAGGUCACUGAGGCUGGCA | 22 | 21657 |
| CFTR-Intron10-2776 | − | UAAGGAGGUCACUGAGGCUGGCA | 23 | 21658 |
| CFTR-Intron10-2777 | − | AGAUAUGAAGUUAAAAACAUCA | 22 | 21659 |
| CFTR-Intron10-2778 | − | UUAGUAUAGAAUUUUGCAUCA | 21 | 21660 |
| CFTR-Intron10-2779 | − | AUUAGUAUAGAAUUUUGCAUCA | 22 | 21661 |
| CFTR-Intron10-2780 | − | UAUUAGUAUAGAAUUUUGCAUCA | 23 | 21662 |
| CFTR-Intron10-2781 | − | AUAUUAGUAUAGAAUUUUGCAUCA | 24 | 21663 |
| CFTR-Intron10-2782 | − | UAAAGAGCCUUUUCUUUUCA | 21 | 21664 |
| CFTR-Intron10-2783 | − | AUAAAGAGCCUUUUCUUUUCA | 22 | 21665 |
| CFTR-Intron10-2784 | − | UAUAAAGAGCCUUUUCUUUUCA | 23 | 21666 |
| CFTR-Intron10-2785 | − | UUAUAAAGAGCCUUUUCUUUUCA | 24 | 21667 |
| CFTR-Intron10-2786 | − | AGAUCUAGCUAAAAUAUAAGA | 21 | 21668 |
| CFTR-Intron10-2787 | − | AAGAUCUAGCUAAAAUAUAAGA | 22 | 21669 |
| CFTR-Intron10-2788 | − | AAAGAUCUAGCUAAAAUAUAAGA | 23 | 21670 |

TABLE 41D-continued

4th Tier

| gRNA Name | DNA Strand | Targeting Domain | Target Site Length | Seq ID |
|---|---|---|---|---|
| CFTR-Intron10-2789 | - | AAAAGAUCUAGCUAAAAUAUAAGA | 24 | 21671 |
| CFTR-Intron10-2790 | - | AUUUUUGUAUUUUUAGUAGAGA | 22 | 21672 |
| CFTR-Intron10-2791 | - | AAUUUUUGUAUUUUUAGUAGAGA | 23 | 21673 |
| CFTR-Intron10-2792 | - | UAAUUUUUGUAUUUUUAGUAGAGA | 24 | 21674 |
| CFTR-Intron10-2793 | - | UUACUAUUAUUUUUGAGA | 18 | 21675 |
| CFTR-Intron10-2794 | - | AUUACUAUUAUUUUUGAGA | 19 | 21676 |
| CFTR-Intron10-2795 | - | UAUUACUAUUAUUUUUGAGA | 20 | 21677 |
| CFTR-Intron10-2796 | - | AUAUUACUAUUAUUUUUGAGA | 21 | 21678 |
| CFTR-Intron10-2797 | - | AAUAUUACUAUUAUUUUUGAGA | 22 | 21679 |
| CFTR-Intron10-2798 | - | UAAUAUUACUAUUAUUUUUGAGA | 23 | 21680 |
| CFTR-Intron10-2799 | - | UUAAUAUUACUAUUAUUUUUGAGA | 24 | 21681 |
| CFTR-Intron10-2800 | - | UUUUUUUUUUUUUGAGA | 18 | 21682 |
| CFTR-Intron10-2801 | - | UUUUUUUUUUUUUUGAGA | 19 | 21683 |
| CFTR-Intron10-1142 | - | UUUUUUUUUUUUUUUGAGA | 20 | 20027 |
| CFTR-Intron10-2802 | - | UUUUUUUUUUUUUUUUGAGA | 21 | 21684 |
| CFTR-Intron10-2803 | - | UUUUUUUUUUUUUUUUUGAGA | 22 | 21685 |
| CFTR-Intron10-2804 | - | UUUUUUUUUUUUUUUUUUGAGA | 23 | 21686 |
| CFTR-Intron10-2805 | - | UUUUUUUUUUUUUUUUUUUGAGA | 24 | 21687 |
| CFTR-Intron10-2806 | - | UGACCAGAAUGAAAUUAGA | 19 | 21688 |
| CFTR-Intron10-2807 | - | UUGACCAGAAUGAAAUUAGA | 20 | 21689 |
| CFTR-Intron10-2808 | - | AUUAGGAAAAUGUACAAAGGA | 21 | 21690 |
| CFTR-Intron10-2809 | - | CAUUAGGAAAAUGUACAAAGGA | 22 | 21691 |
| CFTR-Intron10-2810 | - | UCAUUAGGAAAAUGUACAAAGGA | 23 | 21692 |
| CFTR-Intron10-2811 | - | CUCAUUAGGAAAAUGUACAAAGGA | 24 | 21693 |
| CFTR-Intron10-2812 | - | AGAUGAUUCCAAGCUUUCUGGA | 22 | 21694 |
| CFTR-Intron10-2813 | - | AAGAUGAUUCCAAGCUUUCUGGA | 23 | 21695 |
| CFTR-Intron10-2814 | - | AAAGAUGAUUCCAAGCUUUCUGGA | 24 | 21696 |
| CFTR-Intron10-2815 | - | AUAAAUUUAAAGACAUGA | 18 | 21697 |
| CFTR-Intron10-2816 | - | AAUAAAUUUAAAGACAUGA | 19 | 21698 |
| CFTR-Intron10-2817 | - | AAAUAAAUUUAAAGACAUGA | 20 | 21699 |
| CFTR-Intron10-2818 | - | AGGAAAUAAAUUUAAAGACAUGA | 23 | 21700 |
| CFTR-Intron10-2819 | - | AGAAGACAAAGCUAGUGA | 18 | 21701 |
| CFTR-Intron10-2820 | - | UGAGAAGACAAAGCUAGUGA | 20 | 21702 |
| CFTR-Intron10-2821 | - | CUGAGAAGACAAAGCUAGUGA | 21 | 21703 |
| CFTR-Intron10-2822 | - | UCUGAGAAGACAAAGCUAGUGA | 22 | 21704 |
| CFTR-Intron10-2823 | - | AGUCUGAGAAGACAAAGCUAGUGA | 24 | 21705 |
| CFTR-Intron10-2824 | - | UGCACUCUAGCCUGGGUGA | 19 | 21706 |

TABLE 41D-continued

| | | 4th Tier | | |
|---|---|---|---|---|
| gRNA Name | DNA Strand | Targeting Domain | Target Site Length | Seq ID |
| CFTR-Intron10-2825 | - | CUGCACUCUAGCCUGGGUGA | 20 | 21707 |
| CFTR-Intron10-2826 | - | ACUGCACUCUAGCCUGGGUGA | 21 | 21708 |
| CFTR-Intron10-2827 | - | CACUGCACUCUAGCCUGGGUGA | 22 | 21709 |
| CFTR-Intron10-2828 | - | CCACUGCACUCUAGCCUGGGUGA | 23 | 21710 |
| CFTR-Intron10-2829 | - | CCCCUAACCUUCAUGUUGAUA | 21 | 21711 |
| CFTR-Intron10-2830 | - | ACCCCUAACCUUCAUGUUGAUA | 22 | 21712 |
| CFTR-Intron10-2831 | - | CACCCCUAACCUUCAUGUUGAUA | 23 | 21713 |
| CFTR-Intron10-2832 | - | AAAAUACUUUCUAGAAUUAUA | 21 | 21714 |
| CFTR-Intron10-2833 | - | CAAAAUACUUUCUAGAAUUAUA | 22 | 21715 |
| CFTR-Intron10-2834 | - | UCAAAAUACUUUCUAGAAUUAUA | 23 | 21716 |
| CFTR-Intron10-2835 | - | UUCAAAAUACUUUCUAGAAUUAUA | 24 | 21717 |
| CFTR-Intron10-2836 | - | CGUUUUUGCUUGCUUUUUAUA | 21 | 21718 |
| CFTR-Intron10-2837 | - | ACGUUUUUGCUUGCUUUUUAUA | 22 | 21719 |
| CFTR-Intron10-2838 | - | CACGUUUUUGCUUGCUUUUUAUA | 23 | 21720 |
| CFTR-Intron10-2839 | - | UCACGUUUUUGCUUGCUUUUUAUA | 24 | 21721 |
| CFTR-Intron10-2840 | - | CUUGCAGGAGGUGAGGGAUUA | 21 | 21722 |
| CFTR-Intron10-2841 | - | ACUUGCAGGAGGUGAGGGAUUA | 22 | 21723 |
| CFTR-Intron10-2842 | - | AGACUUGCAGGAGGUGAGGGAUUA | 24 | 21724 |
| CFTR-Intron10-2843 | - | CCAAUAAAAGGUUUGUUA | 18 | 21725 |
| CFTR-Intron10-2844 | - | AGCCAAUAAAAGGUUUGUUA | 20 | 21726 |
| CFTR-Intron10-2845 | - | UAAGUUAGCAAUGGUCUAAAC | 21 | 21727 |
| CFTR-Intron10-2846 | - | AUAAGUUAGCAAUGGUCUAAAC | 22 | 21728 |
| CFTR-Intron10-2847 | - | AAUAAGUUAGCAAUGGUCUAAAC | 23 | 21729 |
| CFTR-Intron10-2848 | - | AAAUAAGUUAGCAAUGGUCUAAAC | 24 | 21730 |
| CFTR-Intron10-2849 | - | UAAACUUUGUUUUCAAC | 18 | 21731 |
| CFTR-Intron10-2850 | - | UUAAACUUUGUUUUCAAC | 19 | 21732 |
| CFTR-Intron10-2851 | - | UUUAAACUUUGUUUUCAAC | 20 | 21733 |
| CFTR-Intron10-2852 | - | AUUUAAACUUUGUUUUCAAC | 21 | 21734 |
| CFTR-Intron10-2853 | - | UAUUUAAACUUUGUUUUCAAC | 22 | 21735 |
| CFTR-Intron10-2854 | - | AUAUUUAAACUUUGUUUUCAAC | 23 | 21736 |
| CFTR-Intron10-2855 | - | CAUAUUUAAACUUUGUUUUCAAC | 24 | 21737 |
| CFTR-Intron10-2856 | - | CAUAUAUAUUUUUAAC | 18 | 21738 |
| CFTR-Intron10-2857 | - | UGCAUAUAUAUUUUUAAC | 20 | 21739 |
| CFTR-Intron10-2858 | - | AUGCAUAUAUAUUUUUAAC | 21 | 21740 |
| CFTR-Intron10-2859 | - | UAUGCAUAUAUAUUUUUAAC | 22 | 21741 |
| CFTR-Intron10-2860 | - | AUAUGCAUAUAUAUUUUUAAC | 23 | 21742 |
| CFTR-Intron10-2861 | - | AAUAUGCAUAUAUAUUUUUAAC | 24 | 21743 |

TABLE 41D-continued

4th Tier

| gRNA Name | DNA Strand | Targeting Domain | Target Site Length | Seq ID |
|---|---|---|---|---|
| CFTR-Intron10-2862 | - | UGGAGUCAAAAAUUAUAC | 18 | 21744 |
| CFTR-Intron10-2863 | - | UGUGGAGUCAAAAAUUAUAC | 20 | 21745 |
| CFTR-Intron10-2864 | - | UUGUGGAGUCAAAAAUUAUAC | 21 | 21746 |
| CFTR-Intron10-2865 | - | UUUGUGGAGUCAAAAAUUAUAC | 22 | 21747 |
| CFTR-Intron10-2866 | - | UUUUGUGGAGUCAAAAAUUAUAC | 23 | 21748 |
| CFTR-Intron10-2867 | - | UUUUUGUGGAGUCAAAAAUUAUAC | 24 | 21749 |
| CFTR-Intron10-2868 | - | AGUGCAAUGCCAUAAACC | 18 | 21750 |
| CFTR-Intron10-2869 | - | UAGUGCAAUGCCAUAAACC | 19 | 21751 |
| CFTR-Intron10-2870 | - | UUAGUGCAAUGCCAUAAACC | 20 | 21752 |
| CFTR-Intron10-2871 | - | UUUAGUGCAAUGCCAUAAACC | 21 | 21753 |
| CFTR-Intron10-2872 | - | UGUUUAGUGCAAUGCCAUAAACC | 23 | 21754 |
| CFTR-Intron10-2873 | - | AUGUUUAGUGCAAUGCCAUAAACC | 24 | 21755 |
| CFTR-Intron10-2874 | - | AGAAAAAGUAAGAUAUGCC | 19 | 21756 |
| CFTR-Intron10-2875 | - | AAGAAAAAGUAAGAUAUGCC | 20 | 21757 |
| CFTR-Intron10-2876 | - | UAAGAAAAAGUAAGAUAUGCC | 21 | 21758 |
| CFTR-Intron10-2877 | - | UUAAGAAAAAGUAAGAUAUGCC | 22 | 21759 |
| CFTR-Intron10-2878 | - | AUUAAGAAAAAGUAAGAUAUGCC | 23 | 21760 |
| CFTR-Intron10-2879 | - | AAUUAAGAAAAAGUAAGAUAUGCC | 24 | 21761 |
| CFTR-Intron10-2880 | - | AGGUGAAUUGCUUGAGUCC | 19 | 21762 |
| CFTR-Intron10-1217 | - | CAGGUGAAUUGCUUGAGUCC | 20 | 20102 |
| CFTR-Intron10-2881 | - | AGGCAGGUGAAUUGCUUGAGUCC | 23 | 21763 |
| CFTR-Intron10-2882 | - | CUAAAACCAAACAAGCUUUCC | 21 | 21764 |
| CFTR-Intron10-2883 | - | ACUAAAACCAAACAAGCUUUCC | 22 | 21765 |
| CFTR-Intron10-2884 | - | UACUAAAACCAAACAAGCUUUCC | 23 | 21766 |
| CFTR-Intron10-2885 | - | CUACUAAAACCAAACAAGCUUUCC | 24 | 21767 |
| CFTR-Intron10-2886 | - | AAAUUUUCUUUGUUUUCC | 18 | 21768 |
| CFTR-Intron10-2887 | - | CAAAUUUUCUUUGUUUUCC | 19 | 21769 |
| CFTR-Intron10-2888 | - | ACAAAUUUUCUUUGUUUUCC | 20 | 21770 |
| CFTR-Intron10-2889 | - | AACAAAUUUUCUUUGUUUUCC | 21 | 21771 |
| CFTR-Intron10-2890 | - | AAACAAAUUUUCUUUGUUUUCC | 22 | 21772 |
| CFTR-Intron10-2891 | - | AAAACAAAUUUUCUUUGUUUUCC | 23 | 21773 |
| CFTR-Intron10-2892 | - | CAGCUUUUAAAACAAAUAGC | 21 | 21774 |
| CFTR-Intron10-2893 | - | ACAGCUUUUAAAACAAAUAGC | 22 | 21775 |
| CFTR-Intron10-2894 | - | AACAGCUUUUAAAACAAAUAGC | 23 | 21776 |
| CFTR-Intron10-2895 | - | AAACAGCUUUUAAAACAAAUAGC | 24 | 21777 |
| CFTR-Intron10-2896 | - | CGCGCCACUGCACUCUAGC | 19 | 21778 |
| CFTR-Intron10-2897 | - | UCGCGCCACUGCACUCUAGC | 20 | 21779 |

TABLE 41D-continued

4th Tier

| gRNA Name | DNA Strand | Targeting Domain | Target Site Length | Seq ID |
|---|---|---|---|---|
| CFTR-Intron10-2898 | - | AUCGCGCCACUGCACUCUAGC | 21 | 21780 |
| CFTR-Intron10-2899 | - | AGAUCGCGCCACUGCACUCUAGC | 23 | 21781 |
| CFTR-Intron10-1224 | - | CGGGGUUUCACCGUUUUAGC | 20 | 20109 |
| CFTR-Intron10-2900 | - | ACGGGGUUUCACCGUUUUAGC | 21 | 21782 |
| CFTR-Intron10-2901 | - | AGACGGGGUUUCACCGUUUUAGC | 23 | 21783 |
| CFTR-Intron10-2902 | - | UCGCUCUGUCGCCCAGGC | 18 | 21784 |
| CFTR-Intron10-2903 | - | CUCGCUCUGUCGCCCAGGC | 19 | 21785 |
| CFTR-Intron10-1226 | - | UCUCGCUCUGUCGCCCAGGC | 20 | 20111 |
| CFTR-Intron10-2904 | - | AGUCUCGCUCUGUCGCCCAGGC | 22 | 21786 |
| CFTR-Intron10-2905 | - | CGGGGUUUCACCAUGUUGGC | 20 | 21787 |
| CFTR-Intron10-2906 | - | ACGGGGUUUCACCAUGUUGGC | 21 | 21788 |
| CFTR-Intron10-2907 | - | AGACGGGGUUUCACCAUGUUGGC | 23 | 21789 |
| CFTR-Intron10-2908 | - | AAUACAGGCUUGAACUGC | 18 | 21790 |
| CFTR-Intron10-2909 | - | CAAUACAGGCUUGAACUGC | 19 | 21791 |
| CFTR-Intron10-2910 | - | ACAAUACAGGCUUGAACUGC | 20 | 21792 |
| CFTR-Intron10-2911 | - | AACAAUACAGGCUUGAACUGC | 21 | 21793 |
| CFTR-Intron10-2912 | - | AAACAAUACAGGCUUGAACUGC | 22 | 21794 |
| CFTR-Intron10-2913 | - | UAAACAAUACAGGCUUGAACUGC | 23 | 21795 |
| CFTR-Intron10-2914 | - | UUAAACAAUACAGGCUUGAACUGC | 24 | 21796 |
| CFTR-Intron10-2915 | - | CUCGGCCUCCCAAAGUGC | 18 | 21797 |
| CFTR-Intron10-2916 | - | CCUCGGCCUCCCAAAGUGC | 19 | 21798 |
| CFTR-Intron10-2917 | - | CGCCUCGGCCUCCCAAAGUGC | 21 | 21799 |
| CFTR-Intron10-2918 | - | CCGCCUCGGCCUCCCAAAGUGC | 22 | 21800 |
| CFTR-Intron10-2919 | - | CCCGCCUCGGCCUCCCAAAGUGC | 23 | 21801 |
| CFTR-Intron10-2920 | - | CAGAGGCAGGUGAAUUGC | 18 | 21802 |
| CFTR-Intron10-2921 | - | AGGCAGAGGCAGGUGAAUUGC | 21 | 21803 |
| CFTR-Intron10-2922 | - | UGGAGGCAGAGGCAGGUGAAUUGC | 24 | 21804 |
| CFTR-Intron10-2923 | - | CACUGCAAGCUCCGCCUC | 18 | 21805 |
| CFTR-Intron10-2924 | - | UCACUGCAAGCUCCGCCUC | 19 | 21806 |
| CFTR-Intron10-2925 | - | CUCACUGCAAGCUCCGCCUC | 20 | 21807 |
| CFTR-Intron10-2926 | - | CGGCUCACUGCAAGCUCCGCCUC | 23 | 21808 |
| CFTR-Intron10-2927 | - | UCGGCUCACUGCAAGCUCCGCCUC | 24 | 21809 |
| CFTR-Intron10-2928 | - | AGGUUCUGUAAUUUUUGCUUC | 21 | 21810 |
| CFTR-Intron10-2929 | - | UAGGUUCUGUAAUUUUUGCUUC | 22 | 21811 |
| CFTR-Intron10-2930 | - | AUAGGUUCUGUAAUUUUUGCUUC | 23 | 21812 |
| CFTR-Intron10-2931 | - | UAUAGGUUCUGUAAUUUUUGCUUC | 24 | 21813 |
| CFTR-Intron10-2932 | - | UGUAACAGUACAAGAAAAAG | 21 | 21814 |

TABLE 41D-continued

4th Tier

| gRNA Name | DNA Strand | Targeting Domain | Target Site Length | Seq ID |
|---|---|---|---|---|
| CFTR-Intron10-2933 | − | UUGUAACAGUACAAGAAAAAAG | 22 | 21815 |
| CFTR-Intron10-2934 | − | AGUUGUAACAGUACAAGAAAAAAG | 24 | 21816 |
| CFTR-Intron10-2935 | − | CUUUGCCAUUAACAGAUAAAG | 21 | 21817 |
| CFTR-Intron10-2936 | − | UGCUUUGCCAUUAACAGAUAAAG | 23 | 21818 |
| CFTR-Intron10-2937 | − | UUGCUUUGCCAUUAACAGAUAAAG | 24 | 21819 |
| CFTR-Intron10-2938 | − | UUUUGGAGGCAGAGGCAG | 18 | 21820 |
| CFTR-Intron10-2939 | − | CUUUUGGAGGCAGAGGCAG | 19 | 21821 |
| CFTR-Intron10-2940 | − | ACUUUUGGAGGCAGAGGCAG | 20 | 21822 |
| CFTR-Intron10-2941 | − | CACUUUUGGAGGCAGAGGCAG | 21 | 21823 |
| CFTR-Intron10-2942 | − | AGCACUUUUGGAGGCAGAGGCAG | 23 | 21824 |
| CFTR-Intron10-2943 | − | UAGCACUUUUGGAGGCAGAGGCAG | 24 | 21825 |
| CFTR-Intron10-2944 | − | CUCGGGAGGCUGAGGCAG | 18 | 21826 |
| CFTR-Intron10-2945 | − | ACUCGGGAGGCUGAGGCAG | 19 | 21827 |
| CFTR-Intron10-2946 | − | UACUCGGGAGGCUGAGGCAG | 20 | 21828 |
| CFTR-Intron10-2947 | − | CUACUCGGGAGGCUGAGGCAG | 21 | 21829 |
| CFTR-Intron10-2948 | − | AGCUACUCGGGAGGCUGAGGCAG | 23 | 21830 |
| CFTR-Intron10-2949 | − | CAGCUACUCGGGAGGCUGAGGCAG | 24 | 21831 |
| CFTR-Intron10-2950 | − | AAGGGAGGAAGCAAGGAG | 18 | 21832 |
| CFTR-Intron10-2951 | − | CAAGGGAGGAAGCAAGGAG | 19 | 21833 |
| CFTR-Intron10-2952 | − | ACAAGGGAGGAAGCAAGGAG | 20 | 21834 |
| CFTR-Intron10-2953 | − | AGACAAGGGAGGAAGCAAGGAG | 22 | 21835 |
| CFTR-Intron10-2954 | − | ACAAACAAAGAAAAUAG | 18 | 21836 |
| CFTR-Intron10-2955 | − | CACAAACAAAGAAAAUAG | 19 | 21837 |
| CFTR-Intron10-2956 | − | ACACAAACAAAGAAAAUAG | 20 | 21838 |
| CFTR-Intron10-2957 | − | AACACAAACAAAGAAAAUAG | 21 | 21839 |
| CFTR-Intron10-2958 | − | AAACACAAACAAAGAAAAUAG | 22 | 21840 |
| CFTR-Intron10-2959 | − | AAAACACAAACAAAGAAAAUAG | 23 | 21841 |
| CFTR-Intron10-2960 | − | AAAAACACAAACAAAGAAAAUAG | 24 | 21842 |
| CFTR-Intron10-2961 | − | UCCAAUAGAGAUGUUAG | 18 | 21843 |
| CFTR-Intron10-2962 | − | AUCCAAUAGAGAUGUUAG | 19 | 21844 |
| CFTR-Intron10-2963 | − | CAUCCAAUAGAGAUGUUAG | 20 | 21845 |
| CFTR-Intron10-2964 | − | ACAUCCAAUAGAGAUGUUAG | 21 | 21846 |
| CFTR-Intron10-2965 | − | UGACAUCCAAUAGAGAUGUUAG | 23 | 21847 |
| CFTR-Intron10-2966 | − | UUGACAUCCAAUAGAGAUGUUAG | 24 | 21848 |
| CFTR-Intron10-2967 | − | AGAGUAAGACAGGGAGGG | 18 | 21849 |
| CFTR-Intron10-2968 | − | UAGAGUAAGACAGGGAGGG | 19 | 21850 |
| CFTR-Intron10-2969 | − | AUAGAGUAAGACAGGGAGGG | 20 | 21851 |

TABLE 41D-continued

4th Tier

| gRNA Name | DNA Strand | Targeting Domain | Target Site Length | Seq ID |
|---|---|---|---|---|
| CFTR-Intron10-2970 | - | CAUAGAGUAAGACAGGGAGGG | 21 | 21852 |
| CFTR-Intron10-2971 | - | UGGCAUAGAGUAAGACAGGGAGGG | 24 | 21853 |
| CFTR-Intron10-2972 | - | UAGUAUUCUAUCAUAUGG | 18 | 21854 |
| CFTR-Intron10-2973 | - | AUAGUAUUCUAUCAUAUGG | 19 | 21855 |
| CFTR-Intron10-2974 | - | CAUAGUAUUCUAUCAUAUGG | 20 | 21856 |
| CFTR-Intron10-2975 | - | UGCAUAGUAUUCUAUCAUAUGG | 22 | 21857 |
| CFTR-Intron10-2976 | - | AUGCAUAGUAUUCUAUCAUAUGG | 23 | 21858 |
| CFTR-Intron10-2977 | - | UCUGGACUGAGUAACUGG | 18 | 21859 |
| CFTR-Intron10-2978 | - | UUCUGGACUGAGUAACUGG | 19 | 21860 |
| CFTR-Intron10-2979 | - | UUUCUGGACUGAGUAACUGG | 20 | 21861 |
| CFTR-Intron10-2980 | - | CUUUCUGGACUGAGUAACUGG | 21 | 21862 |
| CFTR-Intron10-2981 | - | AGCUUUCUGGACUGAGUAACUGG | 23 | 21863 |
| CFTR-Intron10-2982 | - | AAGCUUUCUGGACUGAGUAACUGG | 24 | 21864 |
| CFTR-Intron10-2983 | - | UGUAUAUAUGUGUGUCUGG | 19 | 21865 |
| CFTR-Intron10-2984 | - | AUGUAUAUAUGUGUGUCUGG | 20 | 21866 |
| CFTR-Intron10-2985 | - | UAUGUAUAUAUGUGUGUCUGG | 21 | 21867 |
| CFTR-Intron10-2986 | - | UGUAUGUAUAUAUGUGUGUCUGG | 23 | 21868 |
| CFTR-Intron10-2987 | - | AUGUAUGUAUAUAUGUGUGUCUGG | 24 | 21869 |
| CFTR-Intron10-2988 | - | CAGGCUGGAGUGCAGUGG | 18 | 21870 |
| CFTR-Intron10-2989 | - | CCAGGCUGGAGUGCAGUGG | 19 | 21871 |
| CFTR-Intron10-1304 | - | CCCAGGCUGGAGUGCAGUGG | 20 | 20189 |
| CFTR-Intron10-2990 | - | CGCCCAGGCUGGAGUGCAGUGG | 22 | 21872 |
| CFTR-Intron10-2991 | - | UCGCCCAGGCUGGAGUGCAGUGG | 23 | 21873 |
| CFTR-Intron10-2992 | - | CUUGGGAGGCUGAGGUGG | 18 | 21874 |
| CFTR-Intron10-2993 | - | ACUUGGGAGGCUGAGGUGG | 19 | 21875 |
| CFTR-Intron10-2994 | - | UACUUGGGAGGCUGAGGUGG | 20 | 21876 |
| CFTR-Intron10-2995 | - | CUACUUGGGAGGCUGAGGUGG | 21 | 21877 |
| CFTR-Intron10-2996 | - | AGCUACUUGGGAGGCUGAGGUGG | 23 | 21878 |
| CFTR-Intron10-2997 | - | CAGCUACUUGGGAGGCUGAGGUGG | 24 | 21879 |
| CFTR-Intron10-2998 | - | UGGGUGGGGAGCCCCAUAAAUG | 23 | 21880 |
| CFTR-Intron10-2999 | - | UUGGGUGGGGAGCCCCAUAAAUG | 24 | 21881 |
| CFTR-Intron10-3000 | - | AAUUAGCCAGACGUGAUG | 18 | 21882 |
| CFTR-Intron10-3001 | - | AAAUUAGCCAGACGUGAUG | 19 | 21883 |
| CFTR-Intron10-3002 | - | AAAAUUAGCCAGACGUGAUG | 20 | 21884 |
| CFTR-Intron10-3003 | - | AAAAAUUAGCCAGACGUGAUG | 21 | 21885 |
| CFTR-Intron10-3004 | - | AAAAAAUUAGCCAGACGUGAUG | 22 | 21886 |
| CFTR-Intron10-3005 | - | CAAAAAAUUAGCCAGACGUGAUG | 23 | 21887 |

TABLE 41D-continued

4th Tier

| gRNA Name | DNA Strand | Targeting Domain | Target Site Length | Seq ID |
|---|---|---|---|---|
| CFTR-Intron10-3006 | - | ACAAAAAAUUAGCCAGACGUGAUG | 24 | 21888 |
| CFTR-Intron10-3007 | - | UGGGUGAGAUUAGAGGCCACUG | 22 | 21889 |
| CFTR-Intron10-3008 | - | CUGGGUGAGAUUAGAGGCCACUG | 23 | 21890 |
| CFTR-Intron10-3009 | - | UCUGGGUGAGAUUAGAGGCCACUG | 24 | 21891 |
| CFTR-Intron10-3010 | - | CUUCAGCCUCCCAAAGUG | 18 | 21892 |
| CFTR-Intron10-3011 | - | CGCUUCAGCCUCCCAAAGUG | 20 | 21893 |
| CFTR-Intron10-3012 | - | CCGCUUCAGCCUCCCAAAGUG | 21 | 21894 |
| CFTR-Intron10-3013 | - | UCCGCUUCAGCCUCCCAAAGUG | 22 | 21895 |
| CFTR-Intron10-3014 | - | UUCCGCUUCAGCCUCCCAAAGUG | 23 | 21896 |
| CFTR-Intron10-3015 | - | UUUCCGCUUCAGCCUCCCAAAGUG | 24 | 21897 |
| CFTR-Intron10-3016 | - | AAAGACUUGCAGGAGGUG | 18 | 21898 |
| CFTR-Intron10-3017 | - | CAAAGACUUGCAGGAGGUG | 19 | 21899 |
| CFTR-Intron10-1317 | - | ACAAAGACUUGCAGGAGGUG | 20 | 20202 |
| CFTR-Intron10-3018 | - | AACAAAGACUUGCAGGAGGUG | 21 | 21900 |
| CFTR-Intron10-3019 | - | UGAACAAAGACUUGCAGGAGGUG | 23 | 21901 |
| CFTR-Intron10-3020 | - | UUGAACAAAGACUUGCAGGAGGUG | 24 | 21902 |
| CFTR-Intron10-3021 | - | AGGUUUGUUAAAGAAUGACUGUG | 23 | 21903 |
| CFTR-Intron10-3022 | - | AAGGUUUGUUAAAGAAUGACUGUG | 24 | 21904 |
| CFTR-Intron10-3023 | - | CCCAAGGUGAUGGUAUUG | 18 | 21905 |
| CFTR-Intron10-3024 | - | UCCCAAGGUGAUGGUAUUG | 19 | 21906 |
| CFTR-Intron10-3025 | - | UUCCCAAGGUGAUGGUAUUG | 20 | 21907 |
| CFTR-Intron10-3026 | - | AUUCCCAAGGUGAUGGUAUUG | 21 | 21908 |
| CFTR-Intron10-3027 | - | AAUUCCCAAGGUGAUGGUAUUG | 22 | 21909 |
| CFTR-Intron10-3028 | - | UAAUUCCCAAGGUGAUGGUAUUG | 23 | 21910 |
| CFTR-Intron10-3029 | - | CUAAUUCCCAAGGUGAUGGUAUUG | 24 | 21911 |
| CFTR-Intron10-3030 | - | UUAGUAGUUAAGUUUUUG | 18 | 21912 |
| CFTR-Intron10-3031 | - | AUUAGUAGUUAAGUUUUUG | 19 | 21913 |
| CFTR-Intron10-1325 | - | UAUUAGUAGUUAAGUUUUUG | 20 | 20210 |
| CFTR-Intron10-3032 | - | CUAUUAGUAGUUAAGUUUUUG | 21 | 21914 |
| CFTR-Intron10-3033 | - | AGGCUAUUAGUAGUUAAGUUUUUG | 24 | 21915 |
| CFTR-Intron10-3034 | - | UCAGAUUUUUCCCAUGUAAU | 21 | 21916 |
| CFTR-Intron10-3035 | - | UUCAGAUUUUUCCCAUGUAAU | 22 | 21917 |
| CFTR-Intron10-3036 | - | AUUCAGAUUUUUCCCAUGUAAU | 23 | 21918 |
| CFTR-Intron10-3037 | - | AAUUCAGAUUUUUCCCAUGUAAU | 24 | 21919 |
| CFTR-Intron10-3038 | - | UGGGAGGUGAUUAGUCCAU | 19 | 21920 |
| CFTR-Intron10-3039 | - | UUGGGAGGUGAUUAGUCCAU | 20 | 21921 |
| CFTR-Intron10-3040 | - | UUUGGGAGGUGAUUAGUCCAU | 21 | 21922 |

TABLE 41D-continued

4th Tier

| gRNA Name | DNA Strand | Targeting Domain | Target Site Length | Seq ID |
|---|---|---|---|---|
| CFTR-Intron10-3041 | - | CUUUGGGAGGUGAUUAGUCCAU | 22 | 21923 |
| CFTR-Intron10-3042 | - | CCUUUGGGAGGUGAUUAGUCCAU | 23 | 21924 |
| CFTR-Intron10-3043 | - | UGCAUAGUAUUCUAUCAU | 18 | 21925 |
| CFTR-Intron10-3044 | - | AUGCAUAGUAUUCUAUCAU | 19 | 21926 |
| CFTR-Intron10-3045 | - | AGAUGCAUAGUAUUCUAUCAU | 21 | 21927 |
| CFTR-Intron10-3046 | - | UAGAUGCAUAGUAUUCUAUCAU | 22 | 21928 |
| CFTR-Intron10-3047 | - | AUAGAUGCAUAGUAUUCUAUCAU | 23 | 21929 |
| CFTR-Intron10-3048 | - | AAUAGAUGCAUAGUAUUCUAUCAU | 24 | 21930 |
| CFTR-Intron10-3049 | - | UGAGAAAGAGCUUUCUAGUAU | 21 | 21931 |
| CFTR-Intron10-3050 | - | AUGAGAAAGAGCUUUCUAGUAU | 22 | 21932 |
| CFTR-Intron10-3051 | - | AGAUGAGAAAGAGCUUUCUAGUAU | 24 | 21933 |
| CFTR-Intron10-3052 | - | UAAAAAGCUGUGCAUUUUCCU | 21 | 21934 |
| CFTR-Intron10-3053 | - | UUAAAAAGCUGUGCAUUUUCCU | 22 | 21935 |
| CFTR-Intron10-3054 | - | UUUAAAAAGCUGUGCAUUUUCCU | 23 | 21936 |
| CFTR-Intron10-3055 | - | UUUUAAAAAGCUGUGCAUUUUCCU | 24 | 21937 |
| CFTR-Intron10-3056 | - | CAAAUUAUUCUACUGCU | 18 | 21938 |
| CFTR-Intron10-3057 | - | UCAAAUUAUUCUACUGCU | 19 | 21939 |
| CFTR-Intron10-521 | - | UUCAAAUUAUUCUACUGCU | 20 | 19407 |
| CFTR-Intron10-3058 | - | UGUCUGUAGGCUAUAUGUAUCU | 22 | 21940 |
| CFTR-Intron10-3059 | - | UUGUCUGUAGGCUAUAUGUAUCU | 23 | 21941 |
| CFTR-Intron10-3060 | - | AUUGUCUGUAGGCUAUAUGUAUCU | 24 | 21942 |
| CFTR-Intron10-3061 | - | CUCGGCCUCCCAAAGUGU | 18 | 21943 |
| CFTR-Intron10-3062 | - | CCUCGGCCUCCCAAAGUGU | 19 | 21944 |
| CFTR-Intron10-3063 | - | UGCCUCGGCCUCCCAAAGUGU | 21 | 21945 |
| CFTR-Intron10-3064 | - | CUGCCUCGGCCUCCCAAAGUGU | 22 | 21946 |
| CFTR-Intron10-3065 | - | CCUGCCUCGGCCUCCCAAAGUGU | 23 | 21947 |
| CFTR-Intron10-3066 | - | AGGAAGGCAGUGGUCCCUU | 19 | 21948 |
| CFTR-Intron10-1399 | - | AGGAAGCAAGGAGAUGAGUU | 20 | 20283 |
| CFTR-Intron10-3067 | - | AGGGAGGAAGCAAGGAGAUGAGUU | 24 | 21949 |
| CFTR-Intron10-3068 | - | AGAUAAUGGGAGAAACAGGUU | 21 | 21950 |
| CFTR-Intron10-3069 | - | AAGAUAAUGGGAGAAACAGGUU | 22 | 21951 |
| CFTR-Intron10-3070 | - | AAAGAUAAUGGGAGAAACAGGUU | 23 | 21952 |
| CFTR-Intron10-3071 | - | AUAGUUUUAUCAAUAUUU | 18 | 21953 |
| CFTR-Intron10-3072 | - | AAUAGUUUUAUCAAUAUUU | 19 | 21954 |
| CFTR-Intron10-1405 | - | AAAUAGUUUUAUCAAUAUUU | 20 | 20289 |
| CFTR-Intron10-3073 | - | UGCAUGGGUCCACUUAUUU | 19 | 21955 |
| CFTR-Intron10-3074 | - | CUGCAUGGGUCCACUUAUUU | 20 | 21956 |

TABLE 41D-continued

4th Tier

| gRNA Name | DNA Strand | Targeting Domain | Target Site Length | Seq ID |
|---|---|---|---|---|
| CFTR-Intron10-3075 | - | ACUGCAUGGGUCCACUUAUUU | 21 | 21957 |
| CFTR-Intron10-3076 | - | AACUGCAUGGGUCCACUUAUUU | 22 | 21958 |
| CFTR-Intron10-3077 | - | UGAACUGCAUGGGUCCACUUAUUU | 24 | 21959 |
| CFTR-Intron10-3078 | - | UUGUUGUUUUUCUAGUUU | 18 | 21960 |
| CFTR-Intron10-3079 | - | UUUGUUGUUUUUCUAGUUU | 19 | 21961 |
| CFTR-Intron10-3080 | - | UUUUGUUGUUUUUCUAGUUU | 20 | 21962 |
| CFTR-Intron10-3081 | - | UUUUUGUUGUUUUUCUAGUUU | 21 | 21963 |
| CFTR-Intron10-3082 | - | UUUUUUGUUGUUUUUCUAGUUU | 22 | 21964 |
| CFTR-Intron10-3083 | - | CUUUUUUGUUGUUUUUCUAGUUU | 23 | 21965 |
| CFTR-Intron10-3084 | - | AAUACAUUGGAAAAUUUU | 18 | 21966 |
| CFTR-Intron10-3085 | - | UAAUACAUUGGAAAAUUUU | 19 | 21967 |
| CFTR-Intron10-1411 | - | UUAAUACAUUGGAAAAUUUU | 20 | 20295 |
| CFTR-Intron10-3086 | - | AGUUAAUACAUUGGAAAAUUUU | 22 | 21968 |
| CFTR-Intron10-3087 | - | CAGUUAAUACAUUGGAAAAUUUU | 23 | 21969 |
| CFTR-Intron10-3088 | - | UCAGUUAAUACAUUGGAAAAUUUU | 24 | 21970 |
| CFTR-Intron10-3089 | - | UAUGUCCUCCACAAAUAUUUU | 21 | 21971 |
| CFTR-Intron10-3090 | - | AGUAUGUCCUCCACAAAUAUUUU | 23 | 21972 |
| CFTR-Intron10-3091 | - | AAGUAUGUCCUCCACAAAUAUUUU | 24 | 21973 |

Table 41E provides exemplary targeting domains for correcting a mutation (e.g., 3272-26→G) in the CFTR gene selected according to the fifth tier parameters. The targeting domains bind within intron 10, and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 41E

5th Tier

| gRNA Name | DNA Strand | Targeting Domain | Target Site Length | Seq ID |
|---|---|---|---|---|
| CFTR-Intron10-3092 | + | AAAAAAAAAAAAAAAAAA | 18 | 21974 |
| CFTR-Intron10-3093 | + | AAAAAAAAAAAAAAAAAAA | 19 | 21975 |
| CFTR-Intron10-3094 | + | AAAAAAAAAAAAAAAAAAAA | 20 | 21976 |
| CFTR-Intron10-3095 | + | AAAAAAAAAAAAAAAAAAAAA | 21 | 21977 |
| CFTR-Intron10-3096 | + | AAAAAAAAAAAAAAAAAAAAAA | 22 | 21978 |
| CFTR-Intron10-3097 | + | AAAAAAAAAAAAAAAAAAAAAAA | 23 | 21979 |
| CFTR-Intron10-3098 | + | CAAAAAAAAAAAAAAAAAAAAAAA | 24 | 21980 |
| CFTR-Intron10-3099 | + | UAGAAAAACAACAAAAAA | 18 | 21981 |
| CFTR-Intron10-3100 | + | CUAGAAAAACAACAAAAAA | 19 | 21982 |
| CFTR-Intron10-3101 | + | ACUAGAAAAACAACAAAAAA | 20 | 21983 |
| CFTR-Intron10-3102 | + | AACUAGAAAAACAACAAAAAA | 21 | 21984 |

TABLE 41E-continued

5th Tier

| gRNA Name | DNA Strand | Targeting Domain | Target Site Length | Seq ID |
|---|---|---|---|---|
| CFTR-Intron10-3103 | + | AAACUAGAAAAACAACAAAAAA | 22 | 21985 |
| CFTR-Intron10-3104 | + | AAAACUAGAAAAACAACAAAAAA | 23 | 21986 |
| CFTR-Intron10-3105 | + | AAAAACUAGAAAAACAACAAAAAA | 24 | 21987 |
| CFTR-Intron10-3106 | + | CAAACAAAGAAACAAAAA | 18 | 21988 |
| CFTR-Intron10-3107 | + | ACAAACAAAGAAACAAAAA | 19 | 21989 |
| CFTR-Intron10-3108 | + | UACAAACAAAGAAACAAAAA | 20 | 21990 |
| CFTR-Intron10-3109 | + | AUACAAACAAAGAAACAAAAA | 21 | 21991 |
| CFTR-Intron10-3110 | + | AAUACAAACAAAGAAACAAAAA | 22 | 21992 |
| CFTR-Intron10-3111 | + | AAAUACAAACAAAGAAACAAAAA | 23 | 21993 |
| CFTR-Intron10-3112 | + | UAAAUACAAACAAAGAAACAAAAA | 24 | 21994 |
| CFTR-Intron10-3113 | + | CAUAUUGUUACAUAAAA | 18 | 21995 |
| CFTR-Intron10-3114 | + | GCAUAUUGUUACAUAAAA | 19 | 21996 |
| CFTR-Intron10-3115 | + | UGCAUAUUGUUACAUAAAA | 20 | 21997 |
| CFTR-Intron10-3116 | + | CUGCAUAUUGUUACAUAAAA | 21 | 21998 |
| CFTR-Intron10-3117 | + | UCUGCAUAUUGUUACAUAAAA | 22 | 21999 |
| CFTR-Intron10-3118 | + | CUCUGCAUAUUGUUACAUAAAA | 23 | 22000 |
| CFTR-Intron10-3119 | + | ACUCUGCAUAUUGUUACAUAAAA | 24 | 22001 |
| CFTR-Intron10-3120 | + | GUGCAUAAAGGUUGAAAA | 18 | 22002 |
| CFTR-Intron10-3121 | + | AGUGCAUAAAGGUUGAAAA | 19 | 22003 |
| CFTR-Intron10-65 | + | GAGUGCAUAAAGGUUGAAAA | 20 | 18951 |
| CFTR-Intron10-3122 | + | AGAGUGCAUAAAGGUUGAAAA | 21 | 22004 |
| CFTR-Intron10-3123 | + | AAGAGUGCAUAAAGGUUGAAAA | 22 | 22005 |
| CFTR-Intron10-3124 | + | AAAGAGUGCAUAAAGGUUGAAAA | 23 | 22006 |
| CFTR-Intron10-3125 | + | CAAAGAGUGCAUAAAGGUUGAAAA | 24 | 22007 |
| CFTR-Intron10-3126 | + | UUUCCUCAAUAGUUAAAA | 18 | 22008 |
| CFTR-Intron10-3127 | + | AUUUCCUCAAUAGUUAAAA | 19 | 22009 |
| CFTR-Intron10-3128 | + | UAUUUCCUCAAUAGUUAAAA | 20 | 22010 |
| CFTR-Intron10-3129 | + | UUAUUUCCUCAAUAGUUAAAA | 21 | 22011 |
| CFTR-Intron10-3130 | + | UUUAUUUCCUCAAUAGUUAAAA | 22 | 22012 |
| CFTR-Intron10-3131 | + | AUUUAUUUCCUCAAUAGUUAAAA | 23 | 22013 |
| CFTR-Intron10-3132 | + | AAUUUAUUUCCUCAAUAGUUAAAA | 24 | 22014 |
| CFTR-Intron10-3133 | + | UAGUAAAAAAAAUCAAA | 18 | 22015 |
| CFTR-Intron10-3134 | + | UUAGUAAAAAAAAUCAAA | 19 | 22016 |
| CFTR-Intron10-1092 | + | AUUAGUAAAAAAAAUCAAA | 20 | 19977 |
| CFTR-Intron10-3135 | + | AAUUAGUAAAAAAAAUCAAA | 21 | 22017 |
| CFTR-Intron10-3136 | + | AAAUUAGUAAAAAAAAUCAAA | 22 | 22018 |
| CFTR-Intron10-3137 | + | AAAAUUAGUAAAAAAAAUCAAA | 23 | 22019 |

TABLE 41E-continued

5th Tier

| gRNA Name | DNA Strand | Targeting Domain | Target Site Length | Seq ID |
|---|---|---|---|---|
| CFTR-Intron10-3138 | + | CAAAAUUAGUAAAAAAAAUCAAA | 24 | 22020 |
| CFTR-Intron10-3139 | + | GCUAAAAUGACAAUCAAA | 18 | 22021 |
| CFTR-Intron10-3140 | + | AGCUAAAAUGACAAUCAAA | 19 | 22022 |
| CFTR-Intron10-335 | + | CAGCUAAAAUGACAAUCAAA | 20 | 19221 |
| CFTR-Intron10-3141 | + | ACAGCUAAAAUGACAAUCAAA | 21 | 22023 |
| CFTR-Intron10-3142 | + | CACAGCUAAAAUGACAAUCAAA | 22 | 22024 |
| CFTR-Intron10-3143 | + | CCACAGCUAAAAUGACAAUCAAA | 23 | 22025 |
| CFTR-Intron10-3144 | + | ACCACAGCUAAAAUGACAAUCAAA | 24 | 22026 |
| CFTR-Intron10-3145 | + | AGGAUAUCUUAGGUCAAA | 18 | 22027 |
| CFTR-Intron10-3146 | + | UAGGAUAUCUUAGGUCAAA | 19 | 22028 |
| CFTR-Intron10-3147 | + | UUAGGAUAUCUUAGGUCAAA | 20 | 22029 |
| CFTR-Intron10-3148 | + | CUUAGGAUAUCUUAGGUCAAA | 21 | 22030 |
| CFTR-Intron10-3149 | + | CCUUAGGAUAUCUUAGGUCAAA | 22 | 22031 |
| CFTR-Intron10-3150 | + | CCCUUAGGAUAUCUUAGGUCAAA | 23 | 22032 |
| CFTR-Intron10-3151 | + | UCCCUUAGGAUAUCUUAGGUCAAA | 24 | 22033 |
| CFTR-Intron10-3152 | + | AAUGCAGGAGAAUGGAAA | 18 | 22034 |
| CFTR-Intron10-3153 | + | GAAUGCAGGAGAAUGGAAA | 19 | 22035 |
| CFTR-Intron10-3154 | + | GGAAUGCAGGAGAAUGGAAA | 20 | 22036 |
| CFTR-Intron10-3155 | + | GGGAAUGCAGGAGAAUGGAAA | 21 | 22037 |
| CFTR-Intron10-3156 | + | AGGGAAUGCAGGAGAAUGGAAA | 22 | 22038 |
| CFTR-Intron10-3157 | + | GAGGGAAUGCAGGAGAAUGGAAA | 23 | 22039 |
| CFTR-Intron10-3158 | + | UGAGGGAAUGCAGGAGAAUGGAAA | 24 | 22040 |
| CFTR-Intron10-3159 | + | CAAAUACAUUCAAUGAAA | 18 | 22041 |
| CFTR-Intron10-3160 | + | CCAAAUACAUUCAAUGAAA | 19 | 22042 |
| CFTR-Intron10-3161 | + | CCCAAAUACAUUCAAUGAAA | 20 | 22043 |
| CFTR-Intron10-3162 | + | GCCCAAAUACAUUCAAUGAAA | 21 | 22044 |
| CFTR-Intron10-3163 | + | GGCCCAAAUACAUUCAAUGAAA | 22 | 22045 |
| CFTR-Intron10-3164 | + | AGGCCCAAAUACAUUCAAUGAAA | 23 | 22046 |
| CFTR-Intron10-3165 | + | CAGGCCCAAAUACAUUCAAUGAAA | 24 | 22047 |
| CFTR-Intron10-3166 | + | AGUGCAUAAAGGUUGAAA | 18 | 22048 |
| CFTR-Intron10-3167 | + | GAGUGCAUAAAGGUUGAAA | 19 | 22049 |
| CFTR-Intron10-3168 | + | AGAGUGCAUAAAGGUUGAAA | 20 | 22050 |
| CFTR-Intron10-3169 | + | AAGAGUGCAUAAAGGUUGAAA | 21 | 22051 |
| CFTR-Intron10-3170 | + | AAAGAGUGCAUAAAGGUUGAAA | 22 | 22052 |
| CFTR-Intron10-3171 | + | CAAAGAGUGCAUAAAGGUUGAAA | 23 | 22053 |
| CFTR-Intron10-3172 | + | GCAAAGAGUGCAUAAAGGUUGAAA | 24 | 22054 |
| CFTR-Intron10-3173 | + | UGCAUAUUGUUACAUAAA | 18 | 22055 |

TABLE 41E-continued

5th Tier

| gRNA Name | DNA Strand | Targeting Domain | Target Site Length | Seq ID |
|---|---|---|---|---|
| CFTR-Intron10-3174 | + | CUGCAUAUUGUUACAUAAA | 19 | 22056 |
| CFTR-Intron10-3175 | + | UCUGCAUAUUGUUACAUAAA | 20 | 22057 |
| CFTR-Intron10-3176 | + | CUCUGCAUAUUGUUACAUAAA | 21 | 22058 |
| CFTR-Intron10-3177 | + | ACUCUGCAUAUUGUUACAUAAA | 22 | 22059 |
| CFTR-Intron10-3178 | + | AACUCUGCAUAUUGUUACAUAAA | 23 | 22060 |
| CFTR-Intron10-3179 | + | AAACUCUGCAUAUUGUUACAUAAA | 24 | 22061 |
| CFTR-Intron10-3180 | + | UCGUAUGUAGGAAAACAA | 18 | 22062 |
| CFTR-Intron10-3181 | + | UUCGUAUGUAGGAAAACAA | 19 | 22063 |
| CFTR-Intron10-3182 | + | UUUCGUAUGUAGGAAAACAA | 20 | 22064 |
| CFTR-Intron10-3183 | + | GUUUCGUAUGUAGGAAAACAA | 21 | 22065 |
| CFTR-Intron10-3184 | + | UGUUUCGUAUGUAGGAAAACAA | 22 | 22066 |
| CFTR-Intron10-3185 | + | CUGUUUCGUAUGUAGGAAAACAA | 23 | 22067 |
| CFTR-Intron10-3186 | + | GCUGUUUCGUAUGUAGGAAAACAA | 24 | 22068 |
| CFTR-Intron10-3187 | + | AACCAAAUAAACAAACAA | 18 | 22069 |
| CFTR-Intron10-3188 | + | AAACCAAAUAAACAAACAA | 19 | 22070 |
| CFTR-Intron10-1099 | + | AAAACCAAAUAAACAAACAA | 20 | 19984 |
| CFTR-Intron10-3189 | + | AAAAACCAAAUAAACAAACAA | 21 | 22071 |
| CFTR-Intron10-3190 | + | UAAAAACCAAAUAAACAAACAA | 22 | 22072 |
| CFTR-Intron10-3191 | + | GUAAAAACCAAAUAAACAAACAA | 23 | 22073 |
| CFTR-Intron10-3192 | + | AGUAAAAACCAAAUAAACAAACAA | 24 | 22074 |
| CFTR-Intron10-3193 | + | UGUGUGGCUUAUAAACAA | 18 | 22075 |
| CFTR-Intron10-3194 | + | CUGUGUGGCUUAUAAACAA | 19 | 22076 |
| CFTR-Intron10-3195 | + | ACUGUGUGGCUUAUAAACAA | 20 | 22077 |
| CFTR-Intron10-3196 | + | AACUGUGUGGCUUAUAAACAA | 21 | 22078 |
| CFTR-Intron10-3197 | + | GAACUGUGUGGCUUAUAAACAA | 22 | 22079 |
| CFTR-Intron10-3198 | + | UGAACUGUGUGGCUUAUAAACAA | 23 | 22080 |
| CFTR-Intron10-3199 | + | AUGAACUGUGUGGCUUAUAAACAA | 24 | 22081 |
| CFTR-Intron10-3200 | + | CAGCUGUGAUGCAGACAA | 18 | 22082 |
| CFTR-Intron10-3201 | + | UCAGCUGUGAUGCAGACAA | 19 | 22083 |
| CFTR-Intron10-3202 | + | UUCAGCUGUGAUGCAGACAA | 20 | 22084 |
| CFTR-Intron10-3203 | + | CUUCAGCUGUGAUGCAGACAA | 21 | 22085 |
| CFTR-Intron10-3204 | + | GCUUCAGCUGUGAUGCAGACAA | 22 | 22086 |
| CFTR-Intron10-3205 | + | UGCUUCAGCUGUGAUGCAGACAA | 23 | 22087 |
| CFTR-Intron10-3206 | + | CUGCUUCAGCUGUGAUGCAGACAA | 24 | 22088 |
| CFTR-Intron10-3207 | + | UAAUGAGUUACAAUACAA | 18 | 22089 |
| CFTR-Intron10-3208 | + | UUAAUGAGUUACAAUACAA | 19 | 22090 |
| CFTR-Intron10-3209 | + | AUUAAUGAGUUACAAUACAA | 20 | 22091 |

TABLE 41E-continued

5th Tier

| gRNA Name | DNA Strand | Targeting Domain | Target Site Length | Seq ID |
|---|---|---|---|---|
| CFTR-Intron10-3210 | + | AAUUAAUGAGUUACAAUACAA | 21 | 22092 |
| CFTR-Intron10-3211 | + | AAAUUAAUGAGUUACAAUACAA | 22 | 22093 |
| CFTR-Intron10-3212 | + | UAAAUUAAUGAGUUACAAUACAA | 23 | 22094 |
| CFTR-Intron10-3213 | + | AUAAAUUAAUGAGUUACAAUACAA | 24 | 22095 |
| CFTR-Intron10-3214 | + | AGCUUACCGUAAUAGCAA | 18 | 22096 |
| CFTR-Intron10-3215 | + | GAGCUUACCGUAAUAGCAA | 19 | 22097 |
| CFTR-Intron10-3216 | + | UGAGCUUACCGUAAUAGCAA | 20 | 22098 |
| CFTR-Intron10-3217 | + | UUGAGCUUACCGUAAUAGCAA | 21 | 22099 |
| CFTR-Intron10-3218 | + | CUUGAGCUUACCGUAAUAGCAA | 22 | 22100 |
| CFTR-Intron10-3219 | + | GCUUGAGCUUACCGUAAUAGCAA | 23 | 22101 |
| CFTR-Intron10-3220 | + | UGCUUGAGCUUACCGUAAUAGCAA | 24 | 22102 |
| CFTR-Intron10-3221 | + | GGUCAAUUGUAUUAGCAA | 18 | 22103 |
| CFTR-Intron10-3222 | + | GGGUCAAUUGUAUUAGCAA | 19 | 22104 |
| CFTR-Intron10-3223 | + | AGGGUCAAUUGUAUUAGCAA | 20 | 22105 |
| CFTR-Intron10-3224 | + | AAGGGUCAAUUGUAUUAGCAA | 21 | 22106 |
| CFTR-Intron10-3225 | + | UAAGGGUCAAUUGUAUUAGCAA | 22 | 22107 |
| CFTR-Intron10-3226 | + | UUAAGGGUCAAUUGUAUUAGCAA | 23 | 22108 |
| CFTR-Intron10-3227 | + | UUUAAGGGUCAAUUGUAUUAGCAA | 24 | 22109 |
| CFTR-Intron10-3228 | + | UUAGUAAAAAAAAAUCAA | 18 | 22110 |
| CFTR-Intron10-3229 | + | AUUAGUAAAAAAAAAUCAA | 19 | 22111 |
| CFTR-Intron10-3230 | + | AAUUAGUAAAAAAAAAUCAA | 20 | 22112 |
| CFTR-Intron10-3231 | + | AAAUUAGUAAAAAAAAAUCAA | 21 | 22113 |
| CFTR-Intron10-3232 | + | AAAAUUAGUAAAAAAAAAUCAA | 22 | 22114 |
| CFTR-Intron10-3233 | + | CAAAAUUAGUAAAAAAAAAUCAA | 23 | 22115 |
| CFTR-Intron10-3234 | + | ACAAAAUUAGUAAAAAAAAAUCAA | 24 | 22116 |
| CFTR-Intron10-3235 | + | AGCUAAAAUGACAAUCAA | 18 | 22117 |
| CFTR-Intron10-3236 | + | CAGCUAAAAUGACAAUCAA | 19 | 22118 |
| CFTR-Intron10-3237 | + | ACAGCUAAAAUGACAAUCAA | 20 | 22119 |
| CFTR-Intron10-3238 | + | CACAGCUAAAAUGACAAUCAA | 21 | 22120 |
| CFTR-Intron10-3239 | + | CCACAGCUAAAAUGACAAUCAA | 22 | 22121 |
| CFTR-Intron10-3240 | + | ACCACAGCUAAAAUGACAAUCAA | 23 | 22122 |
| CFTR-Intron10-3241 | + | UACCACAGCUAAAAUGACAAUCAA | 24 | 22123 |
| CFTR-Intron10-3242 | + | CUGAAGCGGAAAGGUCAA | 18 | 22124 |
| CFTR-Intron10-3243 | + | GCUGAAGCGGAAAGGUCAA | 19 | 22125 |
| CFTR-Intron10-3244 | + | GGCUGAAGCGGAAAGGUCAA | 20 | 22126 |
| CFTR-Intron10-3245 | + | AGGCUGAAGCGGAAAGGUCAA | 21 | 22127 |
| CFTR-Intron10-3246 | + | GAGGCUGAAGCGGAAAGGUCAA | 22 | 22128 |

TABLE 41E-continued

5th Tier

| gRNA Name | DNA Strand | Targeting Domain | Target Site Length | Seq ID |
|---|---|---|---|---|
| CFTR-Intron10-3247 | + | GGAGGCUGAAGCGGAAAGGUCAA | 23 | 22129 |
| CFTR-Intron10-3248 | + | GGGAGGCUGAAGCGGAAAGGUCAA | 24 | 22130 |
| CFTR-Intron10-3249 | + | CACCUGAAAUAUAUUCAA | 18 | 22131 |
| CFTR-Intron10-3250 | + | UCACCUGAAAUAUAUUCAA | 19 | 22132 |
| CFTR-Intron10-3251 | + | AUCACCUGAAAUAUAUUCAA | 20 | 22133 |
| CFTR-Intron10-3252 | + | UAUCACCUGAAAUAUAUUCAA | 21 | 22134 |
| CFTR-Intron10-3253 | + | AUAUCACCUGAAAUAUAUUCAA | 22 | 22135 |
| CFTR-Intron10-3254 | + | AAUAUCACCUGAAAUAUAUUCAA | 23 | 22136 |
| CFTR-Intron10-3255 | + | UAAUAUCACCUGAAAUAUAUUCAA | 24 | 22137 |
| CFTR-Intron10-3256 | + | AAAAAAAAAAAAAAGAA | 18 | 22138 |
| CFTR-Intron10-3257 | + | AAAAAAAAAAAAAAAGAA | 19 | 22139 |
| CFTR-Intron10-3258 | + | AAAAAAAAAAAAAAAAGAA | 20 | 22140 |
| CFTR-Intron10-3259 | + | AAAAAAAAAAAAAAAAAGAA | 21 | 22141 |
| CFTR-Intron10-3260 | + | AAAAAAAAAAAAAAAAAAGAA | 22 | 22142 |
| CFTR-Intron10-3261 | + | AAAAAAAAAAAAAAAAAAAGAA | 23 | 22143 |
| CFTR-Intron10-3262 | + | AAAAAAAAAAAAAAAAAAAAGAA | 24 | 22144 |
| CFTR-Intron10-3263 | + | GAAAUAUAUUCAAAGAA | 18 | 22145 |
| CFTR-Intron10-3264 | + | UGAAAUAUAUUCAAAGAA | 19 | 22146 |
| CFTR-Intron10-1103 | + | CUGAAAUAUAUUCAAAGAA | 20 | 19988 |
| CFTR-Intron10-3265 | + | CCUGAAAUAUAUUCAAAGAA | 21 | 22147 |
| CFTR-Intron10-3266 | + | ACCUGAAAUAUAUUCAAAGAA | 22 | 22148 |
| CFTR-Intron10-3267 | + | CACCUGAAAUAUAUUCAAAGAA | 23 | 22149 |
| CFTR-Intron10-3268 | + | UCACCUGAAAUAUAUUCAAAGAA | 24 | 22150 |
| CFTR-Intron10-3269 | + | AAAAAUACGAUAUAAGAA | 18 | 22151 |
| CFTR-Intron10-3270 | + | CAAAAAUACGAUAUAAGAA | 19 | 22152 |
| CFTR-Intron10-3271 | + | GCAAAAAUACGAUAUAAGAA | 20 | 22153 |
| CFTR-Intron10-3272 | + | UGCAAAAAUACGAUAUAAGAA | 21 | 22154 |
| CFTR-Intron10-3273 | + | UUGCAAAAAUACGAUAUAAGAA | 22 | 22155 |
| CFTR-Intron10-3274 | + | GUUGCAAAAAUACGAUAUAAGAA | 23 | 22156 |
| CFTR-Intron10-3275 | + | AGUUGCAAAAAUACGAUAUAAGAA | 24 | 22157 |
| CFTR-Intron10-3276 | + | UGAGGGAAUGCAGGAGAA | 18 | 22158 |
| CFTR-Intron10-3277 | + | AUGAGGGAAUGCAGGAGAA | 19 | 22159 |
| CFTR-Intron10-649 | + | GAUGAGGGAAUGCAGGAGAA | 20 | 19535 |
| CFTR-Intron10-3278 | + | GGAUGAGGGAAUGCAGGAGAA | 21 | 22160 |
| CFTR-Intron10-3279 | + | UGGAUGAGGGAAUGCAGGAGAA | 22 | 22161 |
| CFTR-Intron10-3280 | + | UUGGAUGAGGGAAUGCAGGAGAA | 23 | 22162 |
| CFTR-Intron10-3281 | + | GUUGGAUGAGGGAAUGCAGGAGAA | 24 | 22163 |

TABLE 41E-continued

5th Tier

| gRNA Name | DNA Strand | Targeting Domain | Target Site Length | Seq ID |
|---|---|---|---|---|
| CFTR-Intron10-3282 | + | AAUAAACAAACAAAGGAA | 18 | 22164 |
| CFTR-Intron10-3283 | + | AAAUAAACAAACAAAGGAA | 19 | 22165 |
| CFTR-Intron10-3284 | + | CAAAUAAACAAACAAAGGAA | 20 | 22166 |
| CFTR-Intron10-3285 | + | CCAAAUAAACAAACAAAGGAA | 21 | 22167 |
| CFTR-Intron10-3286 | + | ACCAAAUAAACAAACAAAGGAA | 22 | 22168 |
| CFTR-Intron10-3287 | + | AACCAAAUAAACAAACAAAGGAA | 23 | 22169 |
| CFTR-Intron10-3288 | + | AAACCAAAUAAACAAACAAAGGAA | 24 | 22170 |
| CFTR-Intron10-3289 | + | AAAACUGAGUAGAAGGAA | 18 | 22171 |
| CFTR-Intron10-3290 | + | UAAAACUGAGUAGAAGGAA | 19 | 22172 |
| CFTR-Intron10-349 | + | CUAAAACUGAGUAGAAGGAA | 20 | 19235 |
| CFTR-Intron10-3291 | + | ACUAAAACUGAGUAGAAGGAA | 21 | 22173 |
| CFTR-Intron10-3292 | + | GACUAAAACUGAGUAGAAGGAA | 22 | 22174 |
| CFTR-Intron10-3293 | + | UGACUAAAACUGAGUAGAAGGAA | 23 | 22175 |
| CFTR-Intron10-3294 | + | CUGACUAAAACUGAGUAGAAGGAA | 24 | 22176 |
| CFTR-Intron10-3295 | + | UAAACAGAAUCAGGGGAA | 18 | 22177 |
| CFTR-Intron10-3296 | + | UUAAACAGAAUCAGGGGAA | 19 | 22178 |
| CFTR-Intron10-3297 | + | UUUAAACAGAAUCAGGGGAA | 20 | 22179 |
| CFTR-Intron10-3298 | + | AUUUAAACAGAAUCAGGGGAA | 21 | 22180 |
| CFTR-Intron10-3299 | + | UAUUUAAACAGAAUCAGGGGAA | 22 | 22181 |
| CFTR-Intron10-3300 | + | CUAUUUAAACAGAAUCAGGGGAA | 23 | 22182 |
| CFTR-Intron10-3301 | + | GCUAUUUAAACAGAAUCAGGGGAA | 24 | 22183 |
| CFTR-Intron10-3302 | + | GCACUUUGGGAGGCUGAA | 18 | 22184 |
| CFTR-Intron10-3303 | + | AGCACUUUGGGAGGCUGAA | 19 | 22185 |
| CFTR-Intron10-3304 | + | CAGCACUUUGGGAGGCUGAA | 20 | 22186 |
| CFTR-Intron10-3305 | + | CCAGCACUUUGGGAGGCUGAA | 21 | 22187 |
| CFTR-Intron10-3306 | + | CCCAGCACUUUGGGAGGCUGAA | 22 | 22188 |
| CFTR-Intron10-3307 | + | ACCCAGCACUUUGGGAGGCUGAA | 23 | 22189 |
| CFTR-Intron10-3308 | + | AACCCAGCACUUUGGGAGGCUGAA | 24 | 22190 |
| CFTR-Intron10-3309 | + | GUACAUUUAAUAUCUGAA | 18 | 22191 |
| CFTR-Intron10-3310 | + | UGUACAUUUAAUAUCUGAA | 19 | 22192 |
| CFTR-Intron10-3311 | + | AUGUACAUUUAAUAUCUGAA | 20 | 22193 |
| CFTR-Intron10-3312 | + | GAUGUACAUUUAAUAUCUGAA | 21 | 22194 |
| CFTR-Intron10-3313 | + | UGAUGUACAUUUAAUAUCUGAA | 22 | 22195 |
| CFTR-Intron10-3314 | + | AUGAUGUACAUUUAAUAUCUGAA | 23 | 22196 |
| CFTR-Intron10-3315 | + | AAUGAUGUACAUUUAAUAUCUGAA | 24 | 22197 |
| CFTR-Intron10-3316 | + | AAAAAAUUCACAAAUAA | 18 | 22198 |
| CFTR-Intron10-3317 | + | AAAAAAAUUCACAAAUAA | 19 | 22199 |

TABLE 41E-continued

5th Tier

| gRNA Name | DNA Strand | Targeting Domain | Target Site Length | Seq ID |
|---|---|---|---|---|
| CFTR-Intron10-3318 | + | GAAAAAAAAUUCACAAAUAA | 20 | 22200 |
| CFTR-Intron10-3319 | + | UGAAAAAAAAUUCACAAAUAA | 21 | 22201 |
| CFTR-Intron10-3320 | + | CUGAAAAAAAAUUCACAAAUAA | 22 | 22202 |
| CFTR-Intron10-3321 | + | ACUGAAAAAAAAUUCACAAAUAA | 23 | 22203 |
| CFTR-Intron10-3322 | + | AACUGAAAAAAAAUUCACAAAUAA | 24 | 22204 |
| CFTR-Intron10-3323 | + | UGAGGCAAUGAUCAAUAA | 18 | 22205 |
| CFTR-Intron10-3324 | + | GUGAGGCAAUGAUCAAUAA | 19 | 22206 |
| CFTR-Intron10-3325 | + | AGUGAGGCAAUGAUCAAUAA | 20 | 22207 |
| CFTR-Intron10-3326 | + | UAGUGAGGCAAUGAUCAAUAA | 21 | 22208 |
| CFTR-Intron10-3327 | + | AUAGUGAGGCAAUGAUCAAUAA | 22 | 22209 |
| CFTR-Intron10-3328 | + | CAUAGUGAGGCAAUGAUCAAUAA | 23 | 22210 |
| CFTR-Intron10-3329 | + | CCAUAGUGAGGCAAUGAUCAAUAA | 24 | 22211 |
| CFTR-Intron10-3330 | + | AGAACCUAUAAGGAAUAA | 18 | 22212 |
| CFTR-Intron10-3331 | + | CAGAACCUAUAAGGAAUAA | 19 | 22213 |
| CFTR-Intron10-3332 | + | ACAGAACCUAUAAGGAAUAA | 20 | 22214 |
| CFTR-Intron10-3333 | + | UACAGAACCUAUAAGGAAUAA | 21 | 22215 |
| CFTR-Intron10-3334 | + | UUACAGAACCUAUAAGGAAUAA | 22 | 22216 |
| CFTR-Intron10-3335 | + | AUUACAGAACCUAUAAGGAAUAA | 23 | 22217 |
| CFTR-Intron10-3336 | + | AAUUACAGAACCUAUAAGGAAUAA | 24 | 22218 |
| CFTR-Intron10-3337 | + | ACAGUGACUUCAUAAUAA | 18 | 22219 |
| CFTR-Intron10-3338 | + | UACAGUGACUUCAUAAUAA | 19 | 22220 |
| CFTR-Intron10-1111 | + | AUACAGUGACUUCAUAAUAA | 20 | 19996 |
| CFTR-Intron10-3339 | + | AAUACAGUGACUUCAUAAUAA | 21 | 22221 |
| CFTR-Intron10-3340 | + | CAAUACAGUGACUUCAUAAUAA | 22 | 22222 |
| CFTR-Intron10-3341 | + | ACAAUACAGUGACUUCAUAAUAA | 23 | 22223 |
| CFTR-Intron10-3342 | + | GACAAUACAGUGACUUCAUAAUAA | 24 | 22224 |
| CFTR-Intron10-3343 | + | UUACACUACUUAUAAUAA | 18 | 22225 |
| CFTR-Intron10-3344 | + | UUUACACUACUUAUAAUAA | 19 | 22226 |
| CFTR-Intron10-3345 | + | UUUUACACUACUUAUAAUAA | 20 | 22227 |
| CFTR-Intron10-3346 | + | AUUUUACACUACUUAUAAUAA | 21 | 22228 |
| CFTR-Intron10-3347 | + | UAUUUUACACUACUUAUAAUAA | 22 | 22229 |
| CFTR-Intron10-3348 | + | AUAUUUUACACUACUUAUAAUAA | 23 | 22230 |
| CFTR-Intron10-3349 | + | GAUAUUUUACACUACUUAUAAUAA | 24 | 22231 |
| CFTR-Intron10-3350 | + | CAAGUAGAAAAAGAUAA | 18 | 22232 |
| CFTR-Intron10-3351 | + | GCAAGUAGAAAAAGAUAA | 19 | 22233 |
| CFTR-Intron10-3352 | + | AGCAAGUAGAAAAAGAUAA | 20 | 22234 |
| CFTR-Intron10-3353 | + | AAGCAAGUAGAAAAAGAUAA | 21 | 22235 |

TABLE 41E-continued

5th Tier

| gRNA Name | DNA Strand | Targeting Domain | Target Site Length | Seq ID |
|---|---|---|---|---|
| CFTR-Intron10-3354 | + | AAAGCAAGUAGAAAAAGAUAA | 22 | 22236 |
| CFTR-Intron10-3355 | + | CAAAGCAAGUAGAAAAAGAUAA | 23 | 22237 |
| CFTR-Intron10-3356 | + | GCAAAGCAAGUAGAAAAAGAUAA | 24 | 22238 |
| CFTR-Intron10-3357 | + | AUAAUAUACAAGAUAUAA | 18 | 22239 |
| CFTR-Intron10-3358 | + | AAUAAUAUACAAGAUAUAA | 19 | 22240 |
| CFTR-Intron10-3359 | + | UAAUAAUAUACAAGAUAUAA | 20 | 22241 |
| CFTR-Intron10-3360 | + | GUAAUAAUAUACAAGAUAUAA | 21 | 22242 |
| CFTR-Intron10-3361 | + | AGUAAUAAUAUACAAGAUAUAA | 22 | 22243 |
| CFTR-Intron10-3362 | + | UAGUAAUAAUAUACAAGAUAUAA | 23 | 22244 |
| CFTR-Intron10-3363 | + | CUAGUAAUAAUAUACAAGAUAUAA | 24 | 22245 |
| CFTR-Intron10-3364 | + | UAACUUUAUGCUAACUAA | 18 | 22246 |
| CFTR-Intron10-3365 | + | CUAACUUUAUGCUAACUAA | 19 | 22247 |
| CFTR-Intron10-3366 | + | CCUAACUUUAUGCUAACUAA | 20 | 22248 |
| CFTR-Intron10-3367 | + | ACCUAACUUUAUGCUAACUAA | 21 | 22249 |
| CFTR-Intron10-3368 | + | AACCUAACUUUAUGCUAACUAA | 22 | 22250 |
| CFTR-Intron10-3369 | + | AAACCUAACUUUAUGCUAACUAA | 23 | 22251 |
| CFTR-Intron10-3370 | + | CAAACCUAACUUUAUGCUAACUAA | 24 | 22252 |
| CFTR-Intron10-3371 | + | AGUAAAGUAACAAAGUAA | 18 | 22253 |
| CFTR-Intron10-3372 | + | CAGUAAAGUAACAAAGUAA | 19 | 22254 |
| CFTR-Intron10-3373 | + | UCAGUAAAGUAACAAAGUAA | 20 | 22255 |
| CFTR-Intron10-3374 | + | AUCAGUAAAGUAACAAAGUAA | 21 | 22256 |
| CFTR-Intron10-3375 | + | UAUCAGUAAAGUAACAAAGUAA | 22 | 22257 |
| CFTR-Intron10-3376 | + | UUAUCAGUAAAGUAACAAAGUAA | 23 | 22258 |
| CFTR-Intron10-3377 | + | UUUAUCAGUAAAGUAACAAAGUAA | 24 | 22259 |
| CFTR-Intron10-3378 | + | AGCUAAUAAAUAAAGUAA | 18 | 22260 |
| CFTR-Intron10-3379 | + | AAGCUAAUAAAUAAAGUAA | 19 | 22261 |
| CFTR-Intron10-3380 | + | AAAGCUAAUAAAUAAAGUAA | 20 | 22262 |
| CFTR-Intron10-3381 | + | UAAAGCUAAUAAAUAAAGUAA | 21 | 22263 |
| CFTR-Intron10-3382 | + | UUAAAGCUAAUAAAUAAAGUAA | 22 | 22264 |
| CFTR-Intron10-3383 | + | UUUAAAGCUAAUAAAUAAAGUAA | 23 | 22265 |
| CFTR-Intron10-3384 | + | AUUUAAAGCUAAUAAAUAAAGUAA | 24 | 22266 |
| CFTR-Intron10-3385 | + | UUCUAGAAAACAAUGUAA | 18 | 22267 |
| CFTR-Intron10-3386 | + | UUUCUAGAAAACAAUGUAA | 19 | 22268 |
| CFTR-Intron10-1114 | + | UUUUCUAGAAAACAAUGUAA | 20 | 19999 |
| CFTR-Intron10-3387 | + | AUUUUCUAGAAAACAAUGUAA | 21 | 22269 |
| CFTR-Intron10-3388 | + | GAUUUUCUAGAAAACAAUGUAA | 22 | 22270 |
| CFTR-Intron10-3389 | + | AGAUUUUCUAGAAAACAAUGUAA | 23 | 22271 |

TABLE 41E-continued

5th Tier

| gRNA Name | DNA Strand | Targeting Domain | Target Site Length | Seq ID |
|---|---|---|---|---|
| CFTR-Intron10-3390 | + | CAGAUUUCUAGAAAACAAUGUAA | 24 | 22272 |
| CFTR-Intron10-3391 | + | UAUAAGUGUGGAGUGUAA | 18 | 22273 |
| CFTR-Intron10-3392 | + | GUAUAAGUGUGGAGUGUAA | 19 | 22274 |
| CFTR-Intron10-72 | + | GGUAUAAGUGUGGAGUGUAA | 20 | 18958 |
| CFTR-Intron10-3393 | + | GGGUAUAAGUGUGGAGUGUAA | 21 | 22275 |
| CFTR-Intron10-3394 | + | GGGGUAUAAGUGUGGAGUGUAA | 22 | 22276 |
| CFTR-Intron10-3395 | + | UGGGGUAUAAGUGUGGAGUGUAA | 23 | 22277 |
| CFTR-Intron10-3396 | + | AUGGGGUAUAAGUGUGGAGUGUAA | 24 | 22278 |
| CFTR-Intron10-3397 | + | UGAACUCUAAUCUAUUAA | 18 | 22279 |
| CFTR-Intron10-3398 | + | UUGAACUCUAAUCUAUUAA | 19 | 22280 |
| CFTR-Intron10-3399 | + | AUUGAACUCUAAUCUAUUAA | 20 | 22281 |
| CFTR-Intron10-3400 | + | AAUUGAACUCUAAUCUAUUAA | 21 | 22282 |
| CFTR-Intron10-3401 | + | GAAUUGAACUCUAAUCUAUUAA | 22 | 22283 |
| CFTR-Intron10-3402 | + | UGAAUUGAACUCUAAUCUAUUAA | 23 | 22284 |
| CFTR-Intron10-3403 | + | CUGAAUUGAACUCUAAUCUAUUAA | 24 | 22285 |
| CFTR-Intron10-3404 | + | GCUUAACCCAUCUAUUAA | 18 | 22286 |
| CFTR-Intron10-3405 | + | GGCUUAACCCAUCUAUUAA | 19 | 22287 |
| CFTR-Intron10-3406 | + | UGGCUUAACCCAUCUAUUAA | 20 | 22288 |
| CFTR-Intron10-3407 | + | UUGGCUUAACCCAUCUAUUAA | 21 | 22289 |
| CFTR-Intron10-3408 | + | GUUGGCUUAACCCAUCUAUUAA | 22 | 22290 |
| CFTR-Intron10-3409 | + | AGUUGGCUUAACCCAUCUAUUAA | 23 | 22291 |
| CFTR-Intron10-3410 | + | CAGUUGGCUUAACCCAUCUAUUAA | 24 | 22292 |
| CFTR-Intron10-3411 | + | AAUUUUCCAAUGUAUUAA | 18 | 22293 |
| CFTR-Intron10-3412 | + | AAAUUUUCCAAUGUAUUAA | 19 | 22294 |
| CFTR-Intron10-3413 | + | AAAAUUUUCCAAUGUAUUAA | 20 | 22295 |
| CFTR-Intron10-3414 | + | AAAAAUUUUCCAAUGUAUUAA | 21 | 22296 |
| CFTR-Intron10-3415 | + | CAAAAAUUUUCCAAUGUAUUAA | 22 | 22297 |
| CFTR-Intron10-3416 | + | CCAAAAAUUUUCCAAUGUAUUAA | 23 | 22298 |
| CFTR-Intron10-3417 | + | CCCAAAAAUUUUCCAAUGUAUUAA | 24 | 22299 |
| CFTR-Intron10-3418 | + | AGCCUAGAUGAUUAUUAA | 18 | 22300 |
| CFTR-Intron10-3419 | + | CAGCCUAGAUGAUUAUUAA | 19 | 22301 |
| CFTR-Intron10-3420 | + | GCAGCCUAGAUGAUUAUUAA | 20 | 22302 |
| CFTR-Intron10-3421 | + | UGCAGCCUAGAUGAUUAUUAA | 21 | 22303 |
| CFTR-Intron10-3422 | + | UUGCAGCCUAGAUGAUUAUUAA | 22 | 22304 |
| CFTR-Intron10-3423 | + | UUUGCAGCCUAGAUGAUUAUUAA | 23 | 22305 |
| CFTR-Intron10-3424 | + | UUUUGCAGCCUAGAUGAUUAUUAA | 24 | 22306 |
| CFTR-Intron10-3425 | + | UAUUUCCUCAAUAGUUAA | 18 | 22307 |

TABLE 41E-continued

5th Tier

| gRNA Name | DNA Strand | Targeting Domain | Target Site Length | Seq ID |
|---|---|---|---|---|
| CFTR-Intron10-3426 | + | UUAUUUCCUCAAUAGUUAA | 19 | 22308 |
| CFTR-Intron10-3427 | + | UUUAUUUCCUCAAUAGUUAA | 20 | 22309 |
| CFTR-Intron10-3428 | + | AUUUAUUUCCUCAAUAGUUAA | 21 | 22310 |
| CFTR-Intron10-3429 | + | AAUUUAUUUCCUCAAUAGUUAA | 22 | 22311 |
| CFTR-Intron10-3430 | + | AAAUUUAUUUCCUCAAUAGUUAA | 23 | 22312 |
| CFTR-Intron10-3431 | + | UAAAUUUAUUUCCUCAAUAGUUAA | 24 | 22313 |
| CFTR-Intron10-3432 | + | CAACAUUCUUGGAAAACA | 18 | 22314 |
| CFTR-Intron10-3433 | + | ACAACAUUCUUGGAAAACA | 19 | 22315 |
| CFTR-Intron10-3434 | + | AACAACAUUCUUGGAAAACA | 20 | 22316 |
| CFTR-Intron10-3435 | + | GAACAACAUUCUUGGAAAACA | 21 | 22317 |
| CFTR-Intron10-3436 | + | UGAACAACAUUCUUGGAAAACA | 22 | 22318 |
| CFTR-Intron10-3437 | + | UUGAACAACAUUCUUGGAAAACA | 23 | 22319 |
| CFTR-Intron10-3438 | + | UUUGAACAACAUUCUUGGAAAACA | 24 | 22320 |
| CFTR-Intron10-3439 | + | AAUGAAACAAAUAAAACA | 18 | 22321 |
| CFTR-Intron10-3440 | + | AAAUGAAACAAAUAAAACA | 19 | 22322 |
| CFTR-Intron10-3441 | + | GAAAUGAAACAAAUAAAACA | 20 | 22323 |
| CFTR-Intron10-3442 | + | AGAAAUGAAACAAAUAAAACA | 21 | 22324 |
| CFTR-Intron10-3443 | + | AAGAAAUGAAACAAAUAAAACA | 22 | 22325 |
| CFTR-Intron10-3444 | + | AAAGAAAUGAAACAAAUAAAACA | 23 | 22326 |
| CFTR-Intron10-3445 | + | AAAAGAAAUGAAACAAAUAAAACA | 24 | 22327 |
| CFTR-Intron10-3446 | + | AAACCAAAUAAACAAACA | 18 | 22328 |
| CFTR-Intron10-3447 | + | AAAACCAAAUAAACAAACA | 19 | 22329 |
| CFTR-Intron10-3448 | + | AAAAACCAAAUAAACAAACA | 20 | 22330 |
| CFTR-Intron10-3449 | + | UAAAAACCAAAUAAACAAACA | 21 | 22331 |
| CFTR-Intron10-3450 | + | GUAAAAACCAAAUAAACAAACA | 22 | 22332 |
| CFTR-Intron10-3451 | + | AGUAAAAACCAAAUAAACAAACA | 23 | 22333 |
| CFTR-Intron10-3452 | + | AAGUAAAAACCAAAUAAACAAACA | 24 | 22334 |
| CFTR-Intron10-3453 | + | AAACUGUAAAUACAAACA | 18 | 22335 |
| CFTR-Intron10-3454 | + | AAAACUGUAAAUACAAACA | 19 | 22336 |
| CFTR-Intron10-3455 | + | UAAAACUGUAAAUACAAACA | 20 | 22337 |
| CFTR-Intron10-3456 | + | UUAAAACUGUAAAUACAAACA | 21 | 22338 |
| CFTR-Intron10-3457 | + | CUUAAAACUGUAAAUACAAACA | 22 | 22339 |
| CFTR-Intron10-3458 | + | ACUUAAAACUGUAAAUACAAACA | 23 | 22340 |
| CFTR-Intron10-3459 | + | AACUUAAAACUGUAAAUACAAACA | 24 | 22341 |
| CFTR-Intron10-3460 | + | GACAAUCAAAUGGGAACA | 18 | 22342 |
| CFTR-Intron10-3461 | + | UGACAAUCAAAUGGGAACA | 19 | 22343 |
| CFTR-Intron10-363 | + | AUGACAAUCAAAUGGGAACA | 20 | 19249 |

TABLE 41E-continued

5th Tier

| gRNA Name | DNA Strand | Targeting Domain | Target Site Length | Seq ID |
|---|---|---|---|---|
| CFTR-Intron10-3462 | + | AAUGACAAUCAAAUGGGAACA | 21 | 22344 |
| CFTR-Intron10-3463 | + | AAAUGACAAUCAAAUGGGAACA | 22 | 22345 |
| CFTR-Intron10-3464 | + | AAAAUGACAAUCAAAUGGGAACA | 23 | 22346 |
| CFTR-Intron10-3465 | + | UAAAAUGACAAUCAAAUGGGAACA | 24 | 22347 |
| CFTR-Intron10-3466 | + | AACCUAUAAGGAAUAACA | 18 | 22348 |
| CFTR-Intron10-3467 | + | GAACCUAUAAGGAAUAACA | 19 | 22349 |
| CFTR-Intron10-364 | + | AGAACCUAUAAGGAAUAACA | 20 | 19250 |
| CFTR-Intron10-3468 | + | CAGAACCUAUAAGGAAUAACA | 21 | 22350 |
| CFTR-Intron10-3469 | + | ACAGAACCUAUAAGGAAUAACA | 22 | 22351 |
| CFTR-Intron10-3470 | + | UACAGAACCUAUAAGGAAUAACA | 23 | 22352 |
| CFTR-Intron10-3471 | + | UUACAGAACCUAUAAGGAAUAACA | 24 | 22353 |
| CFTR-Intron10-3472 | + | GAGAGAGAACUGCUCACA | 18 | 22354 |
| CFTR-Intron10-3473 | + | GGAGAGAGAACUGCUCACA | 19 | 22355 |
| CFTR-Intron10-1122 | + | UGGAGAGAGAACUGCUCACA | 20 | 20007 |
| CFTR-Intron10-3474 | + | CUGGAGAGAGAACUGCUCACA | 21 | 22356 |
| CFTR-Intron10-3475 | + | ACUGGAGAGAGAACUGCUCACA | 22 | 22357 |
| CFTR-Intron10-3476 | + | UACUGGAGAGAGAACUGCUCACA | 23 | 22358 |
| CFTR-Intron10-3477 | + | UUACUGGAGAGAGAACUGCUCACA | 24 | 22359 |
| CFTR-Intron10-3478 | + | UUUACAAUUCUUAUUACA | 18 | 22360 |
| CFTR-Intron10-3479 | + | UUUUACAAUUCUUAUUACA | 19 | 22361 |
| CFTR-Intron10-1125 | + | AUUUUACAAUUCUUAUUACA | 20 | 20010 |
| CFTR-Intron10-3480 | + | AAUUUUACAAUUCUUAUUACA | 21 | 22362 |
| CFTR-Intron10-3481 | + | AAAUUUUACAAUUCUUAUUACA | 22 | 22363 |
| CFTR-Intron10-3482 | + | UAAAUUUUACAAUUCUUAUUACA | 23 | 22364 |
| CFTR-Intron10-3483 | + | GUAAAUUUUACAAUUCUUAUUACA | 24 | 22365 |
| CFTR-Intron10-3484 | + | CAGGAGUUCAAGGUUACA | 18 | 22366 |
| CFTR-Intron10-3485 | + | CCAGGAGUUCAAGGUUACA | 19 | 22367 |
| CFTR-Intron10-3486 | + | CCCAGGAGUUCAAGGUUACA | 20 | 22368 |
| CFTR-Intron10-3487 | + | GCCCAGGAGUUCAAGGUUACA | 21 | 22369 |
| CFTR-Intron10-3488 | + | AGCCCAGGAGUUCAAGGUUACA | 22 | 22370 |
| CFTR-Intron10-3489 | + | GAGCCCAGGAGUUCAAGGUUACA | 23 | 22371 |
| CFTR-Intron10-3490 | + | UGAGCCCAGGAGUUCAAGGUUACA | 24 | 22372 |
| CFTR-Intron10-3491 | + | UGAGCUAUGAUCACACCA | 18 | 22373 |
| CFTR-Intron10-3492 | + | GUGAGCUAUGAUCACACCA | 19 | 22374 |
| CFTR-Intron10-3493 | + | AGUGAGCUAUGAUCACACCA | 20 | 22375 |
| CFTR-Intron10-3494 | + | CAGUGAGCUAUGAUCACACCA | 21 | 22376 |
| CFTR-Intron10-3495 | + | ACAGUGAGCUAUGAUCACACCA | 22 | 22377 |

TABLE 41E-continued

5th Tier

| gRNA Name | DNA Strand | Targeting Domain | Target Site Length | Seq ID |
|---|---|---|---|---|
| CFTR-Intron10-3496 | + | UACAGUGAGCUAUGAUCACACCA | 23 | 22378 |
| CFTR-Intron10-3497 | + | UUACAGUGAGCUAUGAUCACACCA | 24 | 22379 |
| CFTR-Intron10-3498 | + | GGCCUCUAAUCUCACCCA | 18 | 22380 |
| CFTR-Intron10-3499 | + | UGGCCUCUAAUCUCACCCA | 19 | 22381 |
| CFTR-Intron10-3500 | + | GUGGCCUCUAAUCUCACCCA | 20 | 22382 |
| CFTR-Intron10-3501 | + | AGUGGCCUCUAAUCUCACCCA | 21 | 22383 |
| CFTR-Intron10-3502 | + | CAGUGGCCUCUAAUCUCACCCA | 22 | 22384 |
| CFTR-Intron10-3503 | + | CCAGUGGCCUCUAAUCUCACCCA | 23 | 22385 |
| CFTR-Intron10-3504 | + | UCCAGUGGCCUCUAAUCUCACCCA | 24 | 22386 |
| CFTR-Intron10-3505 | + | CAGCUAAAGUAUUACCCA | 18 | 22387 |
| CFTR-Intron10-3506 | + | ACAGCUAAAGUAUUACCCA | 19 | 22388 |
| CFTR-Intron10-3507 | + | UACAGCUAAAGUAUUACCCA | 20 | 22389 |
| CFTR-Intron10-3508 | + | AUACAGCUAAAGUAUUACCCA | 21 | 22390 |
| CFTR-Intron10-3509 | + | UAUACAGCUAAAGUAUUACCCA | 22 | 22391 |
| CFTR-Intron10-3510 | + | AUAUACAGCUAAAGUAUUACCCA | 23 | 22392 |
| CFTR-Intron10-3511 | + | AAUAUACAGCUAAAGUAUUACCCA | 24 | 22393 |
| CFTR-Intron10-3512 | + | AGUGUUUAAAUAUUCCCA | 18 | 22394 |
| CFTR-Intron10-3513 | + | AAGUGUUUAAAUAUUCCCA | 19 | 22395 |
| CFTR-Intron10-76 | + | GAAGUGUUUAAAUAUUCCCA | 20 | 18962 |
| CFTR-Intron10-3514 | + | AGAAGUGUUUAAAUAUUCCCA | 21 | 22396 |
| CFTR-Intron10-3515 | + | CAGAAGUGUUUAAAUAUUCCCA | 22 | 22397 |
| CFTR-Intron10-3516 | + | UCAGAAGUGUUUAAAUAUUCCCA | 23 | 22398 |
| CFTR-Intron10-3517 | + | CUCAGAAGUGUUUAAAUAUUCCCA | 24 | 22399 |
| CFTR-Intron10-3518 | + | UAGUAUUAAGUAUAGCCA | 18 | 22400 |
| CFTR-Intron10-3519 | + | UUAGUAUUAAGUAUAGCCA | 19 | 22401 |
| CFTR-Intron10-3520 | + | AUUAGUAUUAAGUAUAGCCA | 20 | 22402 |
| CFTR-Intron10-3521 | + | UAUUAGUAUUAAGUAUAGCCA | 21 | 22403 |
| CFTR-Intron10-3522 | + | UUAUUAGUAUUAAGUAUAGCCA | 22 | 22404 |
| CFTR-Intron10-3523 | + | GUUAUUAGUAUUAAGUAUAGCCA | 23 | 22405 |
| CFTR-Intron10-3524 | + | AGUUAUUAGUAUUAAGUAUAGCCA | 24 | 22406 |
| CFTR-Intron10-3525 | + | UGAGUAUACUUUAUGCCA | 18 | 22407 |
| CFTR-Intron10-3526 | + | GUGAGUAUACUUUAUGCCA | 19 | 22408 |
| CFTR-Intron10-3527 | + | UGUGAGUAUACUUUAUGCCA | 20 | 22409 |
| CFTR-Intron10-3528 | + | AUGUGAGUAUACUUUAUGCCA | 21 | 22410 |
| CFTR-Intron10-3529 | + | UAUGUGAGUAUACUUUAUGCCA | 22 | 22411 |
| CFTR-Intron10-3530 | + | CUAUGUGAGUAUACUUUAUGCCA | 23 | 22412 |
| CFTR-Intron10-3531 | + | ACUAUGUGAGUAUACUUUAUGCCA | 24 | 22413 |

TABLE 41E-continued

5th Tier

| gRNA Name | DNA Strand | Targeting Domain | Target Site Length | Seq ID |
|---|---|---|---|---|
| CFTR-Intron10-3532 | + | GAAGGAAAGGAGGUAGCA | 18 | 22414 |
| CFTR-Intron10-3533 | + | AGAAGGAAAGGAGGUAGCA | 19 | 22415 |
| CFTR-Intron10-3534 | + | UAGAAGGAAAGGAGGUAGCA | 20 | 22416 |
| CFTR-Intron10-3535 | + | GUAGAAGGAAAGGAGGUAGCA | 21 | 22417 |
| CFTR-Intron10-3536 | + | AGUAGAAGGAAAGGAGGUAGCA | 22 | 22418 |
| CFTR-Intron10-3537 | + | GAGUAGAAGGAAAGGAGGUAGCA | 23 | 22419 |
| CFTR-Intron10-3538 | + | UGAGUAGAAGGAAAGGAGGUAGCA | 24 | 22420 |
| CFTR-Intron10-3539 | + | UUCAACAUAUGAAUGGCA | 18 | 22421 |
| CFTR-Intron10-3540 | + | UUUCAACAUAUGAAUGGCA | 19 | 22422 |
| CFTR-Intron10-1128 | + | AUUUCAACAUAUGAAUGGCA | 20 | 20013 |
| CFTR-Intron10-3541 | + | GAUUUCAACAUAUGAAUGGCA | 21 | 22423 |
| CFTR-Intron10-3542 | + | GGAUUUCAACAUAUGAAUGGCA | 22 | 22424 |
| CFTR-Intron10-3543 | + | AGGAUUUCAACAUAUGAAUGGCA | 23 | 22425 |
| CFTR-Intron10-3544 | + | UAGGAUUUCAACAUAUGAAUGGCA | 24 | 22426 |
| CFTR-Intron10-3545 | + | CGGGAGGCGGAGCUUGCA | 18 | 22427 |
| CFTR-Intron10-3546 | + | CCGGGAGGCGGAGCUUGCA | 19 | 22428 |
| CFTR-Intron10-3547 | + | CCCGGGAGGCGGAGCUUGCA | 20 | 22429 |
| CFTR-Intron10-3548 | + | ACCCGGGAGGCGGAGCUUGCA | 21 | 22430 |
| CFTR-Intron10-3549 | + | AACCCGGGAGGCGGAGCUUGCA | 22 | 22431 |
| CFTR-Intron10-3550 | + | GAACCCGGGAGGCGGAGCUUGCA | 23 | 22432 |
| CFTR-Intron10-3551 | + | UGAACCCGGGAGGCGGAGCUUGCA | 24 | 22433 |
| CFTR-Intron10-3552 | + | CGGGAGGCAGAGGUUGCA | 18 | 22434 |
| CFTR-Intron10-3553 | + | CCGGGAGGCAGAGGUUGCA | 19 | 22435 |
| CFTR-Intron10-3554 | + | CCCGGGAGGCAGAGGUUGCA | 20 | 22436 |
| CFTR-Intron10-3555 | + | GCCCGGGAGGCAGAGGUUGCA | 21 | 22437 |
| CFTR-Intron10-3556 | + | AGCCCGGGAGGCAGAGGUUGCA | 22 | 22438 |
| CFTR-Intron10-3557 | + | GAGCCCGGGAGGCAGAGGUUGCA | 23 | 22439 |
| CFTR-Intron10-3558 | + | UGAGCCCGGGAGGCAGAGGUUGCA | 24 | 22440 |
| CFTR-Intron10-3559 | + | GCUAUUUAAACAGAAUCA | 18 | 22441 |
| CFTR-Intron10-3560 | + | UGCUAUUUAAACAGAAUCA | 19 | 22442 |
| CFTR-Intron10-77 | + | GUGCUAUUUAAACAGAAUCA | 20 | 18963 |
| CFTR-Intron10-3561 | + | AGUGCUAUUUAAACAGAAUCA | 21 | 22443 |
| CFTR-Intron10-3562 | + | CAGUGCUAUUUAAACAGAAUCA | 22 | 22444 |
| CFTR-Intron10-3563 | + | CCAGUGCUAUUUAAACAGAAUCA | 23 | 22445 |
| CFTR-Intron10-3564 | + | UCCAGUGCUAUUUAAACAGAAUCA | 24 | 22446 |
| CFTR-Intron10-3565 | + | AGUACAAAAGGACUAUCA | 18 | 22447 |
| CFTR-Intron10-3566 | + | UAGUACAAAAGGACUAUCA | 19 | 22448 |

TABLE 41E-continued

5th Tier

| gRNA Name | DNA Strand | Targeting Domain | Target Site Length | Seq ID |
|---|---|---|---|---|
| CFTR-Intron10-3567 | + | AUAGUACAAAAGGACUAUCA | 20 | 22449 |
| CFTR-Intron10-3568 | + | GAUAGUACAAAAGGACUAUCA | 21 | 22450 |
| CFTR-Intron10-3569 | + | UGAUAGUACAAAAGGACUAUCA | 22 | 22451 |
| CFTR-Intron10-3570 | + | AUGAUAGUACAAAAGGACUAUCA | 23 | 22452 |
| CFTR-Intron10-3571 | + | GAUGAUAGUACAAAAGGACUAUCA | 24 | 22453 |
| CFTR-Intron10-3572 | + | UUAGGAUAUCUUAGGUCA | 18 | 22454 |
| CFTR-Intron10-3573 | + | CUUAGGAUAUCUUAGGUCA | 19 | 22455 |
| CFTR-Intron10-3574 | + | CCUUAGGAUAUCUUAGGUCA | 20 | 22456 |
| CFTR-Intron10-3575 | + | CCCUUAGGAUAUCUUAGGUCA | 21 | 22457 |
| CFTR-Intron10-3576 | + | UCCCUUAGGAUAUCUUAGGUCA | 22 | 22458 |
| CFTR-Intron10-3577 | + | UUCCCUUAGGAUAUCUUAGGUCA | 23 | 22459 |
| CFTR-Intron10-3578 | + | UUUCCCUUAGGAUAUCUUAGGUCA | 24 | 22460 |
| CFTR-Intron10-3579 | + | UAUUCUUUUAUGUGGUCA | 18 | 22461 |
| CFTR-Intron10-3580 | + | AUAUUCUUUUAUGUGGUCA | 19 | 22462 |
| CFTR-Intron10-3581 | + | UAUAUUCUUUUAUGUGGUCA | 20 | 22463 |
| CFTR-Intron10-3582 | + | AUAUAUUCUUUUAUGUGGUCA | 21 | 22464 |
| CFTR-Intron10-3583 | + | AAUAUAUUCUUUUAUGUGGUCA | 22 | 22465 |
| CFTR-Intron10-3584 | + | GAAUAUAUUCUUUUAUGUGGUCA | 23 | 22466 |
| CFTR-Intron10-3585 | + | CGAAUAUAUUCUUUUAUGUGGUCA | 24 | 22467 |
| CFTR-Intron10-3586 | + | CUUCACUAAAAUAAUUCA | 18 | 22468 |
| CFTR-Intron10-3587 | + | GCUUCACUAAAAUAAUUCA | 19 | 22469 |
| CFTR-Intron10-1133 | + | UGCUUCACUAAAAUAAUUCA | 20 | 20018 |
| CFTR-Intron10-3588 | + | UUGCUUCACUAAAAUAAUUCA | 21 | 22470 |
| CFTR-Intron10-3589 | + | AUUGCUUCACUAAAAUAAUUCA | 22 | 22471 |
| CFTR-Intron10-3590 | + | UAUUGCUUCACUAAAAUAAUUCA | 23 | 22472 |
| CFTR-Intron10-3591 | + | AUAUUGCUUCACUAAAAUAAUUCA | 24 | 22473 |
| CFTR-Intron10-3592 | + | AAUCUAAAAGCUAAUUCA | 18 | 22474 |
| CFTR-Intron10-3593 | + | AAAUCUAAAAGCUAAUUCA | 19 | 22475 |
| CFTR-Intron10-369 | + | UAAAUCUAAAAGCUAAUUCA | 20 | 19255 |
| CFTR-Intron10-3594 | + | GUAAAUCUAAAAGCUAAUUCA | 21 | 22476 |
| CFTR-Intron10-3595 | + | AGUAAAUCUAAAAGCUAAUUCA | 22 | 22477 |
| CFTR-Intron10-3596 | + | AAGUAAAUCUAAAAGCUAAUUCA | 23 | 22478 |
| CFTR-Intron10-3597 | + | UAAGUAAAUCUAAAAGCUAAUUCA | 24 | 22479 |
| CFTR-Intron10-3598 | + | CAGGCCCAAAUACAUUCA | 18 | 22480 |
| CFTR-Intron10-3599 | + | GCAGGCCCAAAUACAUUCA | 19 | 22481 |
| CFTR-Intron10-3600 | + | UGCAGGCCCAAAUACAUUCA | 20 | 22482 |
| CFTR-Intron10-3601 | + | AUGCAGGCCCAAAUACAUUCA | 21 | 22483 |

TABLE 41E-continued

5th Tier

| gRNA Name | DNA Strand | Targeting Domain | Target Site Length | Seq ID |
|---|---|---|---|---|
| CFTR-Intron10-3602 | + | UAUGCAGGCCCAAAUACAUUCA | 22 | 22484 |
| CFTR-Intron10-3603 | + | AUAUGCAGGCCCAAAUACAUUCA | 23 | 22485 |
| CFTR-Intron10-3604 | + | CAUAUGCAGGCCCAAAUACAUUCA | 24 | 22486 |
| CFTR-Intron10-3605 | + | GAAUUGGUACAAAUUUCA | 18 | 22487 |
| CFTR-Intron10-3606 | + | CGAAUUGGUACAAAUUUCA | 19 | 22488 |
| CFTR-Intron10-370 | + | ACGAAUUGGUACAAAUUUCA | 20 | 19256 |
| CFTR-Intron10-3607 | + | UACGAAUUGGUACAAAUUUCA | 21 | 22489 |
| CFTR-Intron10-3608 | + | GUACGAAUUGGUACAAAUUUCA | 22 | 22490 |
| CFTR-Intron10-3609 | + | AGUACGAAUUGGUACAAAUUUCA | 23 | 22491 |
| CFTR-Intron10-3610 | + | GAGUACGAAUUGGUACAAAUUUCA | 24 | 22492 |
| CFTR-Intron10-3611 | + | UGAAAUAUAUUCAAAGA | 18 | 22493 |
| CFTR-Intron10-3612 | + | CUGAAAUAUAUUCAAAGA | 19 | 22494 |
| CFTR-Intron10-3613 | + | CCUGAAAUAUAUUCAAAGA | 20 | 22495 |
| CFTR-Intron10-3614 | + | ACCUGAAAUAUAUUCAAAGA | 21 | 22496 |
| CFTR-Intron10-3615 | + | CACCUGAAAUAUAUUCAAAGA | 22 | 22497 |
| CFTR-Intron10-3616 | + | UCACCUGAAAUAUAUUCAAAGA | 23 | 22498 |
| CFTR-Intron10-3617 | + | AUCACCUGAAAUAUAUUCAAAGA | 24 | 22499 |
| CFTR-Intron10-3618 | + | GAUGAGAGACAGUAAAGA | 18 | 22500 |
| CFTR-Intron10-3619 | + | AGAUGAGAGACAGUAAAGA | 19 | 22501 |
| CFTR-Intron10-3620 | + | CAGAUGAGAGACAGUAAAGA | 20 | 22502 |
| CFTR-Intron10-3621 | + | ACAGAUGAGAGACAGUAAAGA | 21 | 22503 |
| CFTR-Intron10-3622 | + | GACAGAUGAGAGACAGUAAAGA | 22 | 22504 |
| CFTR-Intron10-3623 | + | GGACAGAUGAGAGACAGUAAAGA | 23 | 22505 |
| CFTR-Intron10-3624 | + | UGGACAGAUGAGAGACAGUAAAGA | 24 | 22506 |
| CFTR-Intron10-3625 | + | AAUAAUAACAUUUUAAGA | 18 | 22507 |
| CFTR-Intron10-3626 | + | AAAUAAUAACAUUUUAAGA | 19 | 22508 |
| CFTR-Intron10-3627 | + | AAAAUAAUAACAUUUUAAGA | 20 | 22509 |
| CFTR-Intron10-3628 | + | AAAAAUAAUAACAUUUUAAGA | 21 | 22510 |
| CFTR-Intron10-3629 | + | GAAAAAUAAUAACAUUUUAAGA | 22 | 22511 |
| CFTR-Intron10-3630 | + | AGAAAAAUAAUAACAUUUUAAGA | 23 | 22512 |
| CFTR-Intron10-3631 | + | AAGAAAAAUAAUAACAUUUUAAGA | 24 | 22513 |
| CFTR-Intron10-3632 | + | UCCAGCCUGGGCGACAGA | 18 | 22514 |
| CFTR-Intron10-3633 | + | CUCCAGCCUGGGCGACAGA | 19 | 22515 |
| CFTR-Intron10-3634 | + | ACUCCAGCCUGGGCGACAGA | 20 | 22516 |
| CFTR-Intron10-3635 | + | CACUCCAGCCUGGGCGACAGA | 21 | 22517 |
| CFTR-Intron10-3636 | + | GCACUCCAGCCUGGGCGACAGA | 22 | 22518 |
| CFTR-Intron10-3637 | + | UGCACUCCAGCCUGGGCGACAGA | 23 | 22519 |

TABLE 41E-continued

5th Tier

| gRNA Name | DNA Strand | Targeting Domain | Target Site Length | Seq ID |
|---|---|---|---|---|
| CFTR-Intron10-3638 | + | CUGCACUCCAGCCUGGGCGACAGA | 24 | 22520 |
| CFTR-Intron10-3639 | + | GUGUUCUCACAUGGCAGA | 18 | 22521 |
| CFTR-Intron10-3640 | + | UGUGUUCUCACAUGGCAGA | 19 | 22522 |
| CFTR-Intron10-3641 | + | CUGUGUUCUCACAUGGCAGA | 20 | 22523 |
| CFTR-Intron10-3642 | + | GCUGUGUUCUCACAUGGCAGA | 21 | 22524 |
| CFTR-Intron10-3643 | + | UGCUGUGUUCUCACAUGGCAGA | 22 | 22525 |
| CFTR-Intron10-3644 | + | CUGCUGUGUUCUCACAUGGCAGA | 23 | 22526 |
| CFTR-Intron10-3645 | + | CCUGCUGUGUUCUCACAUGGCAGA | 24 | 22527 |
| CFTR-Intron10-3646 | + | UGAAUGGCAGGGGAGAGA | 18 | 22528 |
| CFTR-Intron10-3647 | + | AUGAAUGGCAGGGGAGAGA | 19 | 22529 |
| CFTR-Intron10-3648 | + | UAUGAAUGGCAGGGGAGAGA | 20 | 22530 |
| CFTR-Intron10-3649 | + | AUAUGAAUGGCAGGGGAGAGA | 21 | 22531 |
| CFTR-Intron10-3650 | + | CAUAUGAAUGGCAGGGGAGAGA | 22 | 22532 |
| CFTR-Intron10-3651 | + | ACAUAUGAAUGGCAGGGGAGAGA | 23 | 22533 |
| CFTR-Intron10-3652 | + | AACAUAUGAAUGGCAGGGGAGAGA | 24 | 22534 |
| CFTR-Intron10-3653 | + | AUGAGGGAAUGCAGGAGA | 18 | 22535 |
| CFTR-Intron10-3654 | + | GAUGAGGGAAUGCAGGAGA | 19 | 22536 |
| CFTR-Intron10-3655 | + | GGAUGAGGGAAUGCAGGAGA | 20 | 22537 |
| CFTR-Intron10-3656 | + | UGGAUGAGGGAAUGCAGGAGA | 21 | 22538 |
| CFTR-Intron10-3657 | + | UUGGAUGAGGGAAUGCAGGAGA | 22 | 22539 |
| CFTR-Intron10-3658 | + | GUUGGAUGAGGGAAUGCAGGAGA | 23 | 22540 |
| CFTR-Intron10-3659 | + | GGUUGGAUGAGGGAAUGCAGGAGA | 24 | 22541 |
| CFTR-Intron10-3660 | + | GAUCACGAGGUCAGGAGA | 18 | 22542 |
| CFTR-Intron10-3661 | + | GGAUCACGAGGUCAGGAGA | 19 | 22543 |
| CFTR-Intron10-3662 | + | CGGAUCACGAGGUCAGGAGA | 20 | 22544 |
| CFTR-Intron10-3663 | + | GCGGAUCACGAGGUCAGGAGA | 21 | 22545 |
| CFTR-Intron10-3664 | + | GGCGGAUCACGAGGUCAGGAGA | 22 | 22546 |
| CFTR-Intron10-3665 | + | GGGCGGAUCACGAGGUCAGGAGA | 23 | 22547 |
| CFTR-Intron10-3666 | + | CGGGCGGAUCACGAGGUCAGGAGA | 24 | 22548 |
| CFTR-Intron10-3667 | + | UAGGAAAACAACUGGAGA | 18 | 22549 |
| CFTR-Intron10-3668 | + | GUAGGAAAACAACUGGAGA | 19 | 22550 |
| CFTR-Intron10-3669 | + | UGUAGGAAAACAACUGGAGA | 20 | 22551 |
| CFTR-Intron10-3670 | + | AUGUAGGAAAACAACUGGAGA | 21 | 22552 |
| CFTR-Intron10-3671 | + | UAUGUAGGAAAACAACUGGAGA | 22 | 22553 |
| CFTR-Intron10-3672 | + | GUAUGUAGGAAAACAACUGGAGA | 23 | 22554 |
| CFTR-Intron10-3673 | + | CGUAUGUAGGAAAACAACUGGAGA | 24 | 22555 |
| CFTR-Intron10-3674 | + | UAUGCAAUUUACUGGAGA | 18 | 22556 |

TABLE 41E-continued

5th Tier

| gRNA Name | DNA Strand | Targeting Domain | Target Site Length | Seq ID |
|---|---|---|---|---|
| CFTR-Intron10-3675 | + | AUAUGCAAUUUACUGGAGA | 19 | 22557 |
| CFTR-Intron10-3676 | + | AAUAUGCAAUUUACUGGAGA | 20 | 22558 |
| CFTR-Intron10-3677 | + | CAAUAUGCAAUUUACUGGAGA | 21 | 22559 |
| CFTR-Intron10-3678 | + | GCAAUAUGCAAUUUACUGGAGA | 22 | 22560 |
| CFTR-Intron10-3679 | + | UGCAAUAUGCAAUUUACUGGAGA | 23 | 22561 |
| CFTR-Intron10-3680 | + | CUGCAAUAUGCAAUUUACUGGAGA | 24 | 22562 |
| CFTR-Intron10-3681 | + | GAACUAGAGUCACAUAGA | 18 | 22563 |
| CFTR-Intron10-3682 | + | UGAACUAGAGUCACAUAGA | 19 | 22564 |
| CFTR-Intron10-3683 | + | GUGAACUAGAGUCACAUAGA | 20 | 22565 |
| CFTR-Intron10-3684 | + | AGUGAACUAGAGUCACAUAGA | 21 | 22566 |
| CFTR-Intron10-3685 | + | UAGUGAACUAGAGUCACAUAGA | 22 | 22567 |
| CFTR-Intron10-3686 | + | UUAGUGAACUAGAGUCACAUAGA | 23 | 22568 |
| CFTR-Intron10-3687 | + | AUUAGUGAACUAGAGUCACAUAGA | 24 | 22569 |
| CFTR-Intron10-3688 | + | AUUGAUUAUAUAUAGA | 18 | 22570 |
| CFTR-Intron10-3689 | + | UAUUGAUUAUAUAUAGA | 19 | 22571 |
| CFTR-Intron10-3690 | + | AUAUUGAUUAUAUAUAGA | 20 | 22572 |
| CFTR-Intron10-3691 | + | UAUAUUGAUUAUAUAUAGA | 21 | 22573 |
| CFTR-Intron10-3692 | + | GUAUAUUGAUUAUAUAUAGA | 22 | 22574 |
| CFTR-Intron10-3693 | + | UGUAUAUUGAUUAUAUAUAGA | 23 | 22575 |
| CFTR-Intron10-3694 | + | AUGUAUAUUGAUUAUAUAUAGA | 24 | 22576 |
| CFTR-Intron10-3695 | + | AGGAUCACUUUAUAUAGA | 18 | 22577 |
| CFTR-Intron10-3696 | + | UAGGAUCACUUUAUAUAGA | 19 | 22578 |
| CFTR-Intron10-3697 | + | CUAGGAUCACUUUAUAUAGA | 20 | 22579 |
| CFTR-Intron10-3698 | + | UCUAGGAUCACUUUAUAUAGA | 21 | 22580 |
| CFTR-Intron10-3699 | + | UUCUAGGAUCACUUUAUAUAGA | 22 | 22581 |
| CFTR-Intron10-3700 | + | AUUCUAGGAUCACUUUAUAUAGA | 23 | 22582 |
| CFTR-Intron10-3701 | + | GAUUCUAGGAUCACUUUAUAUAGA | 24 | 22583 |
| CFTR-Intron10-3702 | + | UGACUAAAACUGAGUAGA | 18 | 22584 |
| CFTR-Intron10-3703 | + | CUGACUAAAACUGAGUAGA | 19 | 22585 |
| CFTR-Intron10-374 | + | ACUGACUAAAACUGAGUAGA | 20 | 19260 |
| CFTR-Intron10-3704 | + | UACUGACUAAAACUGAGUAGA | 21 | 22586 |
| CFTR-Intron10-3705 | + | CUACUGACUAAAACUGAGUAGA | 22 | 22587 |
| CFTR-Intron10-3706 | + | ACUACUGACUAAAACUGAGUAGA | 23 | 22588 |
| CFTR-Intron10-3707 | + | UACUACUGACUAAAACUGAGUAGA | 24 | 22589 |
| CFTR-Intron10-3708 | + | GCACUCCAGCCUGGGCGA | 18 | 22590 |
| CFTR-Intron10-3709 | + | UGCACUCCAGCCUGGGCGA | 19 | 22591 |
| CFTR-Intron10-3710 | + | CUGCACUCCAGCCUGGGCGA | 20 | 22592 |

TABLE 41E-continued

5th Tier

| gRNA Name | DNA Strand | Targeting Domain | Target Site Length | Seq ID |
|---|---|---|---|---|
| CFTR-Intron10-3711 | + | ACUGCACUCCAGCCUGGGCGA | 21 | 22593 |
| CFTR-Intron10-3712 | + | CACUGCACUCCAGCCUGGGCGA | 22 | 22594 |
| CFTR-Intron10-3713 | + | CCACUGCACUCCAGCCUGGGCGA | 23 | 22595 |
| CFTR-Intron10-3714 | + | GCCACUGCACUCCAGCCUGGGCGA | 24 | 22596 |
| CFTR-Intron10-3715 | + | UGACUUCAUAAUAAAGGA | 18 | 22597 |
| CFTR-Intron10-3716 | + | GUGACUUCAUAAUAAAGGA | 19 | 22598 |
| CFTR-Intron10-3717 | + | AGUGACUUCAUAAUAAAGGA | 20 | 22599 |
| CFTR-Intron10-3718 | + | CAGUGACUUCAUAAUAAAGGA | 21 | 22600 |
| CFTR-Intron10-3719 | + | ACAGUGACUUCAUAAUAAAGGA | 22 | 22601 |
| CFTR-Intron10-3720 | + | UACAGUGACUUCAUAAUAAAGGA | 23 | 22602 |
| CFTR-Intron10-3721 | + | AUACAGUGACUUCAUAAUAAAGGA | 24 | 22603 |
| CFTR-Intron10-3722 | + | AUGCAGACAACAGAAGGA | 18 | 22604 |
| CFTR-Intron10-3723 | + | GAUGCAGACAACAGAAGGA | 19 | 22605 |
| CFTR-Intron10-3724 | + | UGAUGCAGACAACAGAAGGA | 20 | 22606 |
| CFTR-Intron10-3725 | + | GUGAUGCAGACAACAGAAGGA | 21 | 22607 |
| CFTR-Intron10-3726 | + | UGUGAUGCAGACAACAGAAGGA | 22 | 22608 |
| CFTR-Intron10-3727 | + | CUGUGAUGCAGACAACAGAAGGA | 23 | 22609 |
| CFTR-Intron10-3728 | + | GCUGUGAUGCAGACAACAGAAGGA | 24 | 22610 |
| CFTR-Intron10-3729 | + | UAAAACUGAGUAGAAGGA | 18 | 22611 |
| CFTR-Intron10-3730 | + | CUAAAACUGAGUAGAAGGA | 19 | 22612 |
| CFTR-Intron10-3731 | + | ACUAAAACUGAGUAGAAGGA | 20 | 22613 |
| CFTR-Intron10-3732 | + | GACUAAAACUGAGUAGAAGGA | 21 | 22614 |
| CFTR-Intron10-3733 | + | UGACUAAAACUGAGUAGAAGGA | 22 | 22615 |
| CFTR-Intron10-3734 | + | CUGACUAAAACUGAGUAGAAGGA | 23 | 22616 |
| CFTR-Intron10-3735 | + | ACUGACUAAAACUGAGUAGAAGGA | 24 | 22617 |
| CFTR-Intron10-3736 | + | UGUAGGAAAACAACUGGA | 18 | 22618 |
| CFTR-Intron10-3737 | + | AUGUAGGAAAACAACUGGA | 19 | 22619 |
| CFTR-Intron10-3738 | + | UAUGUAGGAAAACAACUGGA | 20 | 22620 |
| CFTR-Intron10-3739 | + | GUAUGUAGGAAAACAACUGGA | 21 | 22621 |
| CFTR-Intron10-3740 | + | CGUAUGUAGGAAAACAACUGGA | 22 | 22622 |
| CFTR-Intron10-3741 | + | UCGUAUGUAGGAAAACAACUGGA | 23 | 22623 |
| CFTR-Intron10-3742 | + | UUCGUAUGUAGGAAAACAACUGGA | 24 | 22624 |
| CFTR-Intron10-3743 | + | AAUAUGCAAUUUACUGGA | 18 | 22625 |
| CFTR-Intron10-3744 | + | CAAUAUGCAAUUUACUGGA | 19 | 22626 |
| CFTR-Intron10-3745 | + | GCAAUAUGCAAUUUACUGGA | 20 | 22627 |
| CFTR-Intron10-3746 | + | UGCAAUAUGCAAUUUACUGGA | 21 | 22628 |
| CFTR-Intron10-3747 | + | CUGCAAUAUGCAAUUUACUGGA | 22 | 22629 |

TABLE 41E-continued

5th Tier

| gRNA Name | DNA Strand | Targeting Domain | Target Site Length | Seq ID |
|---|---|---|---|---|
| CFTR-Intron10-3748 | + | ACUGCAAUAUGCAAUUUACUGGA | 23 | 22630 |
| CFTR-Intron10-3749 | + | UACUGCAAUAUGCAAUUUACUGGA | 24 | 22631 |
| CFTR-Intron10-3750 | + | UUUCAUCUUACUUGAUGA | 18 | 22632 |
| CFTR-Intron10-3751 | + | GUUUCAUCUUACUUGAUGA | 19 | 22633 |
| CFTR-Intron10-3752 | + | AGUUUCAUCUUACUUGAUGA | 20 | 22634 |
| CFTR-Intron10-3753 | + | CAGUUUCAUCUUACUUGAUGA | 21 | 22635 |
| CFTR-Intron10-3754 | + | ACAGUUUCAUCUUACUUGAUGA | 22 | 22636 |
| CFTR-Intron10-3755 | + | AACAGUUUCAUCUUACUUGAUGA | 23 | 22637 |
| CFTR-Intron10-3756 | + | UAACAGUUUCAUCUUACUUGAUGA | 24 | 22638 |
| CFTR-Intron10-3757 | + | UGACACCAAAUUUAUUGA | 18 | 22639 |
| CFTR-Intron10-3758 | + | CUGACACCAAAUUUAUUGA | 19 | 22640 |
| CFTR-Intron10-3759 | + | CCUGACACCAAAUUUAUUGA | 20 | 22641 |
| CFTR-Intron10-3760 | + | GCCUGACACCAAAUUUAUUGA | 21 | 22642 |
| CFTR-Intron10-3761 | + | AGCCUGACACCAAAUUUAUUGA | 22 | 22643 |
| CFTR-Intron10-3762 | + | CAGCCUGACACCAAAUUUAUUGA | 23 | 22644 |
| CFTR-Intron10-3763 | + | CCAGCCUGACACCAAAUUUAUUGA | 24 | 22645 |
| CFTR-Intron10-3764 | + | CUAAUAGCCUAUUGUUGA | 18 | 22646 |
| CFTR-Intron10-3765 | + | ACUAAUAGCCUAUUGUUGA | 19 | 22647 |
| CFTR-Intron10-3766 | + | UACUAAUAGCCUAUUGUUGA | 20 | 22648 |
| CFTR-Intron10-3767 | + | CUACUAAUAGCCUAUUGUUGA | 21 | 22649 |
| CFTR-Intron10-3768 | + | ACUACUAAUAGCCUAUUGUUGA | 22 | 22650 |
| CFTR-Intron10-3769 | + | AACUACUAAUAGCCUAUUGUUGA | 23 | 22651 |
| CFTR-Intron10-3770 | + | UAACUACUAAUAGCCUAUUGUUGA | 24 | 22652 |
| CFTR-Intron10-3771 | + | CCUUGGAAUAUAAAAAUA | 18 | 22653 |
| CFTR-Intron10-3772 | + | UCCUUGGAAUAUAAAAAUA | 19 | 22654 |
| CFTR-Intron10-3773 | + | GUCCUUGGAAUAUAAAAAUA | 20 | 22655 |
| CFTR-Intron10-3774 | + | AGUCCUUGGAAUAUAAAAAUA | 21 | 22656 |
| CFTR-Intron10-3775 | + | CAGUCCUUGGAAUAUAAAAAUA | 22 | 22657 |
| CFTR-Intron10-3776 | + | ACAGUCCUUGGAAUAUAAAAAUA | 23 | 22658 |
| CFTR-Intron10-3777 | + | GACAGUCCUUGGAAUAUAAAAAUA | 24 | 22659 |
| CFTR-Intron10-3778 | + | CUUUGUGUUAACAAAAUA | 18 | 22660 |
| CFTR-Intron10-3779 | + | UCUUUGUGUUAACAAAAUA | 19 | 22661 |
| CFTR-Intron10-3780 | + | UUCUUUGUGUUAACAAAAUA | 20 | 22662 |
| CFTR-Intron10-3781 | + | GUUCUUUGUGUUAACAAAAUA | 21 | 22663 |
| CFTR-Intron10-3782 | + | UGUUCUUUGUGUUAACAAAAUA | 22 | 22664 |
| CFTR-Intron10-3783 | + | UUGUUCUUUGUGUUAACAAAAUA | 23 | 22665 |
| CFTR-Intron10-3784 | + | GUUGUUCUUUGUGUUAACAAAAUA | 24 | 22666 |

TABLE 41E-continued

5th Tier

| gRNA Name | DNA Strand | Targeting Domain | Target Site Length | Seq ID |
|---|---|---|---|---|
| CFTR-Intron10-3785 | + | GGAAGAAAAGUAUCAAUA | 18 | 22667 |
| CFTR-Intron10-3786 | + | AGGAAGAAAAGUAUCAAUA | 19 | 22668 |
| CFTR-Intron10-3787 | + | CAGGAAGAAAAGUAUCAAUA | 20 | 22669 |
| CFTR-Intron10-3788 | + | UCAGGAAGAAAAGUAUCAAUA | 21 | 22670 |
| CFTR-Intron10-3789 | + | AUCAGGAAGAAAAGUAUCAAUA | 22 | 22671 |
| CFTR-Intron10-3790 | + | AAUCAGGAAGAAAAGUAUCAAUA | 23 | 22672 |
| CFTR-Intron10-3791 | + | UAAUCAGGAAGAAAAGUAUCAAUA | 24 | 22673 |
| CFTR-Intron10-3792 | + | UCCUCUGUGCUUUGAAUA | 18 | 22674 |
| CFTR-Intron10-3793 | + | GUCCUCUGUGCUUUGAAUA | 19 | 22675 |
| CFTR-Intron10-382 | + | AGUCCUCUGUGCUUUGAAUA | 20 | 19268 |
| CFTR-Intron10-3794 | + | AAGUCCUCUGUGCUUUGAAUA | 21 | 22676 |
| CFTR-Intron10-3795 | + | CAAGUCCUCUGUGCUUUGAAUA | 22 | 22677 |
| CFTR-Intron10-3796 | + | GCAAGUCCUCUGUGCUUUGAAUA | 23 | 22678 |
| CFTR-Intron10-3797 | + | UGCAAGUCCUCUGUGCUUUGAAUA | 24 | 22679 |
| CFTR-Intron10-3798 | + | UACAGUGACUUCAUAAUA | 18 | 22680 |
| CFTR-Intron10-3799 | + | AUACAGUGACUUCAUAAUA | 19 | 22681 |
| CFTR-Intron10-3800 | + | AAUACAGUGACUUCAUAAUA | 20 | 22682 |
| CFTR-Intron10-3801 | + | CAAUACAGUGACUUCAUAAUA | 21 | 22683 |
| CFTR-Intron10-3802 | + | ACAAUACAGUGACUUCAUAAUA | 22 | 22684 |
| CFTR-Intron10-3803 | + | GACAAUACAGUGACUUCAUAAUA | 23 | 22685 |
| CFTR-Intron10-3804 | + | AGACAAUACAGUGACUUCAUAAUA | 24 | 22686 |
| CFTR-Intron10-3805 | + | CCUAGAUGAUUAUUAAUA | 18 | 22687 |
| CFTR-Intron10-3806 | + | GCCUAGAUGAUUAUUAAUA | 19 | 22688 |
| CFTR-Intron10-384 | + | AGCCUAGAUGAUUAUUAAUA | 20 | 19270 |
| CFTR-Intron10-3807 | + | CAGCCUAGAUGAUUAUUAAUA | 21 | 22689 |
| CFTR-Intron10-3808 | + | GCAGCCUAGAUGAUUAUUAAUA | 22 | 22690 |
| CFTR-Intron10-3809 | + | UGCAGCCUAGAUGAUUAUUAAUA | 23 | 22691 |
| CFTR-Intron10-3810 | + | UUGCAGCCUAGAUGAUUAUUAAUA | 24 | 22692 |
| CFTR-Intron10-3811 | + | UAGUAUAAUUUUUUAAUA | 18 | 22693 |
| CFTR-Intron10-3812 | + | AUAGUAUAAUUUUUUAAUA | 19 | 22694 |
| CFTR-Intron10-3813 | + | UAUAGUAUAAUUUUUUAAUA | 20 | 22695 |
| CFTR-Intron10-3814 | + | CUAUAGUAUAAUUUUUUAAUA | 21 | 22696 |
| CFTR-Intron10-3815 | + | CCUAUAGUAUAAUUUUUUAAUA | 22 | 22697 |
| CFTR-Intron10-3816 | + | UCCUAUAGUAUAAUUUUUUAAUA | 23 | 22698 |
| CFTR-Intron10-3817 | + | CUCCUAUAGUAUAAUUUUUUAAUA | 24 | 22699 |
| CFTR-Intron10-3818 | + | UGAAACAAUAAAACAUA | 18 | 22700 |
| CFTR-Intron10-3819 | + | AUGAAACAAAUAAAACAUA | 19 | 22701 |

TABLE 41E-continued

5th Tier

| gRNA Name | DNA Strand | Targeting Domain | Target Site Length | Seq ID |
|---|---|---|---|---|
| CFTR-Intron10-3820 | + | AAUGAAACAAAUAAAACAUA | 20 | 22702 |
| CFTR-Intron10-3821 | + | AAAUGAAACAAAUAAAACAUA | 21 | 22703 |
| CFTR-Intron10-3822 | + | GAAAUGAAACAAAUAAAACAUA | 22 | 22704 |
| CFTR-Intron10-3823 | + | AGAAAUGAAACAAAUAAAACAUA | 23 | 22705 |
| CFTR-Intron10-3824 | + | AAGAAAUGAAACAAAUAAAACAUA | 24 | 22706 |
| CFTR-Intron10-3825 | + | CUAAAACUCAGUACCAUA | 18 | 22707 |
| CFTR-Intron10-3826 | + | GCUAAAACUCAGUACCAUA | 19 | 22708 |
| CFTR-Intron10-3827 | + | AGCUAAAACUCAGUACCAUA | 20 | 22709 |
| CFTR-Intron10-3828 | + | AAGCUAAAACUCAGUACCAUA | 21 | 22710 |
| CFTR-Intron10-3829 | + | UAAGCUAAAACUCAGUACCAUA | 22 | 22711 |
| CFTR-Intron10-3830 | + | AUAAGCUAAAACUCAGUACCAUA | 23 | 22712 |
| CFTR-Intron10-3831 | + | AAUAAGCUAAAACUCAGUACCAUA | 24 | 22713 |
| CFTR-Intron10-3832 | + | AAAAUAUAUAUGCAUA | 18 | 22714 |
| CFTR-Intron10-3833 | + | AAAAAUAUAUAUGCAUA | 19 | 22715 |
| CFTR-Intron10-3834 | + | UAAAAAUAUAUAUGCAUA | 20 | 22716 |
| CFTR-Intron10-3835 | + | UUAAAAAUAUAUAUGCAUA | 21 | 22717 |
| CFTR-Intron10-3836 | + | GUUAAAAAUAUAUAUGCAUA | 22 | 22718 |
| CFTR-Intron10-3837 | + | GGUUAAAAAUAUAUAUGCAUA | 23 | 22719 |
| CFTR-Intron10-3838 | + | AGGUUAAAAAUAUAUAUGCAUA | 24 | 22720 |
| CFTR-Intron10-3839 | + | ACAUAGAGAAAACUCAUA | 18 | 22721 |
| CFTR-Intron10-3840 | + | AACAUAGAGAAAACUCAUA | 19 | 22722 |
| CFTR-Intron10-1168 | + | AAACAUAGAGAAAACUCAUA | 20 | 20053 |
| CFTR-Intron10-3841 | + | AAAACAUAGAGAAAACUCAUA | 21 | 22723 |
| CFTR-Intron10-3842 | + | UAAAACAUAGAGAAAACUCAUA | 22 | 22724 |
| CFTR-Intron10-3843 | + | AUAAAACAUAGAGAAAACUCAUA | 23 | 22725 |
| CFTR-Intron10-3844 | + | AAUAAAACAUAGAGAAAACUCAUA | 24 | 22726 |
| CFTR-Intron10-3845 | + | GGAAAGUUGUCCAAGAUA | 18 | 22727 |
| CFTR-Intron10-3846 | + | UGGAAAGUUGUCCAAGAUA | 19 | 22728 |
| CFTR-Intron10-3847 | + | AUGGAAAGUUGUCCAAGAUA | 20 | 22729 |
| CFTR-Intron10-3848 | + | UAUGGAAAGUUGUCCAAGAUA | 21 | 22730 |
| CFTR-Intron10-3849 | + | AUAUGGAAAGUUGUCCAAGAUA | 22 | 22731 |
| CFTR-Intron10-3850 | + | AAUAUGGAAAGUUGUCCAAGAUA | 23 | 22732 |
| CFTR-Intron10-3851 | + | GAAUAUGGAAAGUUGUCCAAGAUA | 24 | 22733 |
| CFTR-Intron10-3852 | + | UGUUCUUAGGGUGGGAUA | 18 | 22734 |
| CFTR-Intron10-3853 | + | UUGUUCUUAGGGUGGGAUA | 19 | 22735 |
| CFTR-Intron10-84 | + | GUUGUUCUUAGGGUGGGAUA | 20 | 18970 |
| CFTR-Intron10-3854 | + | AGUUGUUCUUAGGGUGGGAUA | 21 | 22736 |

TABLE 41E-continued

5th Tier

| gRNA Name | DNA Strand | Targeting Domain | Target Site Length | Seq ID |
|---|---|---|---|---|
| CFTR-Intron10-3855 | + | AAGUUGUUCUUAGGGUGGGAUA | 22 | 22737 |
| CFTR-Intron10-3856 | + | UAAGUUGUUCUUAGGGUGGGAUA | 23 | 22738 |
| CFTR-Intron10-3857 | + | UUAAGUUGUUCUUAGGGUGGGAUA | 24 | 22739 |
| CFTR-Intron10-3858 | + | AUAUUGAUUAUAUAUA | 18 | 22740 |
| CFTR-Intron10-3859 | + | UAUAUUGAUUAUAUAUA | 19 | 22741 |
| CFTR-Intron10-3860 | + | GUAUAUUGAUUAUAUAUA | 20 | 22742 |
| CFTR-Intron10-3861 | + | UGUAUAUUGAUUAUAUAUA | 21 | 22743 |
| CFTR-Intron10-3862 | + | AUGUAUAUUGAUUAUAUAUA | 22 | 22744 |
| CFTR-Intron10-3863 | + | AAUGUAUAUUGAUUAUAUAUA | 23 | 22745 |
| CFTR-Intron10-3864 | + | AAAUGUAUAUUGAUUAUAUAUA | 24 | 22746 |
| CFTR-Intron10-3865 | + | GUAUAUUGAUUAUAUAUA | 18 | 22747 |
| CFTR-Intron10-3866 | + | UGUAUAUUGAUUAUAUAUA | 19 | 22748 |
| CFTR-Intron10-3867 | + | AUGUAUAUUGAUUAUAUAUA | 20 | 22749 |
| CFTR-Intron10-3868 | + | AAUGUAUAUUGAUUAUAUAUA | 21 | 22750 |
| CFTR-Intron10-3869 | + | AAAUGUAUAUUGAUUAUAUAUA | 22 | 22751 |
| CFTR-Intron10-3870 | + | AAAAUGUAUAUUGAUUAUAUAUA | 23 | 22752 |
| CFTR-Intron10-3871 | + | AAAAAUGUAUAUUGAUUAUAUAUA | 24 | 22753 |
| CFTR-Intron10-3872 | + | CUAGGAUCACUUUAUAUA | 18 | 22754 |
| CFTR-Intron10-3873 | + | UCUAGGAUCACUUUAUAUA | 19 | 22755 |
| CFTR-Intron10-3874 | + | UUCUAGGAUCACUUUAUAUA | 20 | 22756 |
| CFTR-Intron10-3875 | + | AUUCUAGGAUCACUUUAUAUA | 21 | 22757 |
| CFTR-Intron10-3876 | + | GAUUCUAGGAUCACUUUAUAUA | 22 | 22758 |
| CFTR-Intron10-3877 | + | UGAUUCUAGGAUCACUUUAUAUA | 23 | 22759 |
| CFTR-Intron10-3878 | + | AUGAUUCUAGGAUCACUUUAUAUA | 24 | 22760 |
| CFTR-Intron10-3879 | + | CCUGAAAGCAGUGUUAUA | 18 | 22761 |
| CFTR-Intron10-3880 | + | UCCUGAAAGCAGUGUUAUA | 19 | 22762 |
| CFTR-Intron10-3881 | + | CUCCUGAAAGCAGUGUUAUA | 20 | 22763 |
| CFTR-Intron10-3882 | + | GCUCCUGAAAGCAGUGUUAUA | 21 | 22764 |
| CFTR-Intron10-3883 | + | GGCUCCUGAAAGCAGUGUUAUA | 22 | 22765 |
| CFTR-Intron10-3884 | + | UGGCUCCUGAAAGCAGUGUUAUA | 23 | 22766 |
| CFTR-Intron10-3885 | + | UUGGCUCCUGAAAGCAGUGUUAUA | 24 | 22767 |
| CFTR-Intron10-3886 | + | UUCUAGGAUCACUUUAUA | 18 | 22768 |
| CFTR-Intron10-3887 | + | AUUCUAGGAUCACUUUAUA | 19 | 22769 |
| CFTR-Intron10-3888 | + | GAUUCUAGGAUCACUUUAUA | 20 | 22770 |
| CFTR-Intron10-3889 | + | UGAUUCUAGGAUCACUUUAUA | 21 | 22771 |
| CFTR-Intron10-3890 | + | AUGAUUCUAGGAUCACUUUAUA | 22 | 22772 |
| CFTR-Intron10-3891 | + | UAUGAUUCUAGGAUCACUUUAUA | 23 | 22773 |

TABLE 41E-continued

5th Tier

| gRNA Name | DNA Strand | Targeting Domain | Target Site Length | Seq ID |
|---|---|---|---|---|
| CFTR-Intron10-3892 | + | UUAUGAUUCUAGGAUCACUUUAUA | 24 | 22774 |
| CFTR-Intron10-3893 | + | GACAGAUGAGAGACAGUA | 18 | 22775 |
| CFTR-Intron10-3894 | + | GGACAGAUGAGAGACAGUA | 19 | 22776 |
| CFTR-Intron10-3895 | + | UGGACAGAUGAGAGACAGUA | 20 | 22777 |
| CFTR-Intron10-3896 | + | AUGGACAGAUGAGAGACAGUA | 21 | 22778 |
| CFTR-Intron10-3897 | + | AAUGGACAGAUGAGAGACAGUA | 22 | 22779 |
| CFTR-Intron10-3898 | + | AAAUGGACAGAUGAGAGACAGUA | 23 | 22780 |
| CFTR-Intron10-3899 | + | AAAAUGGACAGAUGAGAGACAGUA | 24 | 22781 |
| CFTR-Intron10-3900 | + | UUUCUAGAAAACAAUGUA | 18 | 22782 |
| CFTR-Intron10-3901 | + | UUUUCUAGAAAACAAUGUA | 19 | 22783 |
| CFTR-Intron10-3902 | + | AUUUUCUAGAAAACAAUGUA | 20 | 22784 |
| CFTR-Intron10-3903 | + | GAUUUUCUAGAAAACAAUGUA | 21 | 22785 |
| CFTR-Intron10-3904 | + | AGAUUUUCUAGAAAACAAUGUA | 22 | 22786 |
| CFTR-Intron10-3905 | + | CAGAUUUUCUAGAAAACAAUGUA | 23 | 22787 |
| CFTR-Intron10-3906 | + | ACAGAUUUUCUAGAAAACAAUGUA | 24 | 22788 |
| CFTR-Intron10-3907 | + | GUAUAAGUGUGGAGUGUA | 18 | 22789 |
| CFTR-Intron10-3908 | + | GGUAUAAGUGUGGAGUGUA | 19 | 22790 |
| CFTR-Intron10-3909 | + | GGGUAUAAGUGUGGAGUGUA | 20 | 22791 |
| CFTR-Intron10-3910 | + | GGGGUAUAAGUGUGGAGUGUA | 21 | 22792 |
| CFTR-Intron10-3911 | + | UGGGGUAUAAGUGUGGAGUGUA | 22 | 22793 |
| CFTR-Intron10-3912 | + | AUGGGGUAUAAGUGUGGAGUGUA | 23 | 22794 |
| CFTR-Intron10-3913 | + | AAUGGGGUAUAAGUGUGGAGUGUA | 24 | 22795 |
| CFTR-Intron10-3914 | + | UUCUUGAAGCAAAAAUUA | 18 | 22796 |
| CFTR-Intron10-3915 | + | AUUCUUGAAGCAAAAAUUA | 19 | 22797 |
| CFTR-Intron10-3916 | + | UAUUCUUGAAGCAAAAAUUA | 20 | 22798 |
| CFTR-Intron10-3917 | + | AUAUUCUUGAAGCAAAAAUUA | 21 | 22799 |
| CFTR-Intron10-3918 | + | AAUAUUCUUGAAGCAAAAAUUA | 22 | 22800 |
| CFTR-Intron10-3919 | + | CAAUAUUCUUGAAGCAAAAAUUA | 23 | 22801 |
| CFTR-Intron10-3920 | + | GCAAUAUUCUUGAAGCAAAAAUUA | 24 | 22802 |
| CFTR-Intron10-3921 | + | CUGAAUAACACGCCAUUA | 18 | 22803 |
| CFTR-Intron10-3922 | + | GCUGAAUAACACGCCAUUA | 19 | 22804 |
| CFTR-Intron10-3923 | + | GGCUGAAUAACACGCCAUUA | 20 | 22805 |
| CFTR-Intron10-3924 | + | UGGCUGAAUAACACGCCAUUA | 21 | 22806 |
| CFTR-Intron10-3925 | + | UUGGCUGAAUAACACGCCAUUA | 22 | 22807 |
| CFTR-Intron10-3926 | + | AUUGGCUGAAUAACACGCCAUUA | 23 | 22808 |
| CFTR-Intron10-3927 | + | UAUUGGCUGAAUAACACGCCAUUA | 24 | 22809 |
| CFTR-Intron10-3928 | + | UUAUCAGAGCUCAUAUUA | 18 | 22810 |

TABLE 41E-continued

5th Tier

| gRNA Name | DNA Strand | Targeting Domain | Target Site Length | Seq ID |
|---|---|---|---|---|
| CFTR-Intron10-3929 | + | UUUAUCAGAGCUCAUAUUA | 19 | 22811 |
| CFTR-Intron10-3930 | + | UUUUAUCAGAGCUCAUAUUA | 20 | 22812 |
| CFTR-Intron10-3931 | + | AUUUUAUCAGAGCUCAUAUUA | 21 | 22813 |
| CFTR-Intron10-3932 | + | GAUUUUAUCAGAGCUCAUAUUA | 22 | 22814 |
| CFTR-Intron10-3933 | + | UGAUUUUAUCAGAGCUCAUAUUA | 23 | 22815 |
| CFTR-Intron10-3934 | + | CUGAUUUUAUCAGAGCUCAUAUUA | 24 | 22816 |
| CFTR-Intron10-3935 | + | CAAAUGCUUGACCACUUA | 18 | 22817 |
| CFTR-Intron10-3936 | + | ACAAAUGCUUGACCACUUA | 19 | 22818 |
| CFTR-Intron10-3937 | + | CACAAAUGCUUGACCACUUA | 20 | 22819 |
| CFTR-Intron10-3938 | + | ACACAAAUGCUUGACCACUUA | 21 | 22820 |
| CFTR-Intron10-3939 | + | UACACAAAUGCUUGACCACUUA | 22 | 22821 |
| CFTR-Intron10-3940 | + | GUACACAAAUGCUUGACCACUUA | 23 | 22822 |
| CFTR-Intron10-3941 | + | AGUACACAAAUGCUUGACCACUUA | 24 | 22823 |
| CFTR-Intron10-3942 | + | AUUAAUAACAAAAUCUUA | 18 | 22824 |
| CFTR-Intron10-3943 | + | UAUUAAUAACAAAAUCUUA | 19 | 22825 |
| CFTR-Intron10-3944 | + | AUAUUAAUAACAAAAUCUUA | 20 | 22826 |
| CFTR-Intron10-3945 | + | AAUAUUAAUAACAAAAUCUUA | 21 | 22827 |
| CFTR-Intron10-3946 | + | UAAUAUUAAUAACAAAAUCUUA | 22 | 22828 |
| CFTR-Intron10-3947 | + | GUAAUAUUAAUAACAAAAUCUUA | 23 | 22829 |
| CFTR-Intron10-3948 | + | AGUAAUAUUAAUAACAAAAUCUUA | 24 | 22830 |
| CFTR-Intron10-3949 | + | ACAUAUUUGGGUAAGUUA | 18 | 22831 |
| CFTR-Intron10-3950 | + | AACAUAUUUGGGUAAGUUA | 19 | 22832 |
| CFTR-Intron10-3951 | + | AAACAUAUUUGGGUAAGUUA | 20 | 22833 |
| CFTR-Intron10-3952 | + | CAAACAUAUUUGGGUAAGUUA | 21 | 22834 |
| CFTR-Intron10-3953 | + | GCAAACAUAUUUGGGUAAGUUA | 22 | 22835 |
| CFTR-Intron10-3954 | + | UGCAAACAUAUUUGGGUAAGUUA | 23 | 22836 |
| CFTR-Intron10-3955 | + | CUGCAAACAUAUUUGGGUAAGUUA | 24 | 22837 |
| CFTR-Intron10-3956 | + | ACUGCAAUAUGCAAUUUA | 18 | 22838 |
| CFTR-Intron10-3957 | + | UACUGCAAUAUGCAAUUUA | 19 | 22839 |
| CFTR-Intron10-3958 | + | UUACUGCAAUAUGCAAUUUA | 20 | 22840 |
| CFTR-Intron10-3959 | + | UUUACUGCAAUAUGCAAUUUA | 21 | 22841 |
| CFTR-Intron10-3960 | + | UUUUACUGCAAUAUGCAAUUUA | 22 | 22842 |
| CFTR-Intron10-3961 | + | UUUUUACUGCAAUAUGCAAUUUA | 23 | 22843 |
| CFTR-Intron10-3962 | + | CUUUUUACUGCAAUAUGCAAUUUA | 24 | 22844 |
| CFTR-Intron10-3963 | + | CCUAUUAUUCAACAUUUA | 18 | 22845 |
| CFTR-Intron10-3964 | + | CCCUAUUAUUCAACAUUUA | 19 | 22846 |
| CFTR-Intron10-398 | + | CCCCUAUUAUUCAACAUUUA | 20 | 19284 |

TABLE 41E-continued

5th Tier

| gRNA Name | DNA Strand | Targeting Domain | Target Site Length | Seq ID |
|---|---|---|---|---|
| CFTR-Intron10-3965 | + | ACCCCUAUUAUUCAACAUUUA | 21 | 22847 |
| CFTR-Intron10-3966 | + | AACCCCUAUUAUUCAACAUUUA | 22 | 22848 |
| CFTR-Intron10-3967 | + | AAACCCCUAUUAUUCAACAUUUA | 23 | 22849 |
| CFTR-Intron10-3968 | + | CAAACCCCUAUUAUUCAACAUUUA | 24 | 22850 |
| CFTR-Intron10-3969 | + | UAAAAAGCAAGCAAAAAC | 18 | 22851 |
| CFTR-Intron10-3970 | + | AUAAAAAGCAAGCAAAAAC | 19 | 22852 |
| CFTR-Intron10-3971 | + | UAUAAAAAGCAAGCAAAAAC | 20 | 22853 |
| CFTR-Intron10-3972 | + | GUAUAAAAAGCAAGCAAAAAC | 21 | 22854 |
| CFTR-Intron10-3973 | + | UGUAUAAAAAGCAAGCAAAAAC | 22 | 22855 |
| CFTR-Intron10-3974 | + | CUGUAUAAAAAGCAAGCAAAAAC | 23 | 22856 |
| CFTR-Intron10-3975 | + | UCUGUAUAAAAAGCAAGCAAAAAC | 24 | 22857 |
| CFTR-Intron10-3976 | + | AACAUCUAACUCAAAAAC | 18 | 22858 |
| CFTR-Intron10-3977 | + | AAACAUCUAACUCAAAAAC | 19 | 22859 |
| CFTR-Intron10-3978 | + | CAAACAUCUAACUCAAAAAC | 20 | 22860 |
| CFTR-Intron10-3979 | + | UCAAACAUCUAACUCAAAAAC | 21 | 22861 |
| CFTR-Intron10-3980 | + | GUCAAACAUCUAACUCAAAAAC | 22 | 22862 |
| CFTR-Intron10-3981 | + | CGUCAAACAUCUAACUCAAAAAC | 23 | 22863 |
| CFTR-Intron10-3982 | + | GCGUCAAACAUCUAACUCAAAAAC | 24 | 22864 |
| CFTR-Intron10-3983 | + | CGUAUGUAGGAAAACAAC | 18 | 22865 |
| CFTR-Intron10-3984 | + | UCGUAUGUAGGAAAACAAC | 19 | 22866 |
| CFTR-Intron10-402 | + | UUCGUAUGUAGGAAAACAAC | 20 | 19288 |
| CFTR-Intron10-3985 | + | UUUCGUAUGUAGGAAAACAAC | 21 | 22867 |
| CFTR-Intron10-3986 | + | GUUUCGUAUGUAGGAAAACAAC | 22 | 22868 |
| CFTR-Intron10-3987 | + | UGUUUCGUAUGUAGGAAAACAAC | 23 | 22869 |
| CFTR-Intron10-3988 | + | CUGUUUCGUAUGUAGGAAAACAAC | 24 | 22870 |
| CFTR-Intron10-3989 | + | GCUUACCGUAAUAGCAAC | 18 | 22871 |
| CFTR-Intron10-3990 | + | AGCUUACCGUAAUAGCAAC | 19 | 22872 |
| CFTR-Intron10-660 | + | GAGCUUACCGUAAUAGCAAC | 20 | 19546 |
| CFTR-Intron10-3991 | + | UGAGCUUACCGUAAUAGCAAC | 21 | 22873 |
| CFTR-Intron10-3992 | + | UUGAGCUUACCGUAAUAGCAAC | 22 | 22874 |
| CFTR-Intron10-3993 | + | CUUGAGCUUACCGUAAUAGCAAC | 23 | 22875 |
| CFTR-Intron10-3994 | + | GCUUGAGCUUACCGUAAUAGCAAC | 24 | 22876 |
| CFTR-Intron10-3995 | + | CAUUGACCCUUUAUCAAC | 18 | 22877 |
| CFTR-Intron10-3996 | + | CCAUUGACCCUUUAUCAAC | 19 | 22878 |
| CFTR-Intron10-3997 | + | ACCAUUGACCCUUUAUCAAC | 20 | 22879 |
| CFTR-Intron10-3998 | + | UACCAUUGACCCUUUAUCAAC | 21 | 22880 |
| CFTR-Intron10-3999 | + | AUACCAUUGACCCUUUAUCAAC | 22 | 22881 |

TABLE 41E-continued

5th Tier

| gRNA Name | DNA Strand | Targeting Domain | Target Site Length | Seq ID |
|---|---|---|---|---|
| CFTR-Intron10-4000 | + | UAUACCAUUGACCCUUUAUCAAC | 23 | 22882 |
| CFTR-Intron10-4001 | + | AUAUACCAUUGACCCUUUAUCAAC | 24 | 22883 |
| CFTR-Intron10-4002 | + | UGACAAUCAAAUGGGAAC | 18 | 22884 |
| CFTR-Intron10-4003 | + | AUGACAAUCAAAUGGGAAC | 19 | 22885 |
| CFTR-Intron10-4004 | + | AAUGACAAUCAAAUGGGAAC | 20 | 22886 |
| CFTR-Intron10-4005 | + | AAAUGACAAUCAAAUGGGAAC | 21 | 22887 |
| CFTR-Intron10-4006 | + | AAAAUGACAAUCAAAUGGGAAC | 22 | 22888 |
| CFTR-Intron10-4007 | + | UAAAAUGACAAUCAAAUGGGAAC | 23 | 22889 |
| CFTR-Intron10-4008 | + | CUAAAAUGACAAUCAAAUGGGAAC | 24 | 22890 |
| CFTR-Intron10-4009 | + | CAGGAGAAUGGCGUGAAC | 18 | 22891 |
| CFTR-Intron10-4010 | + | GCAGGAGAAUGGCGUGAAC | 19 | 22892 |
| CFTR-Intron10-4011 | + | GGCAGGAGAAUGGCGUGAAC | 20 | 22893 |
| CFTR-Intron10-4012 | + | AGGCAGGAGAAUGGCGUGAAC | 21 | 22894 |
| CFTR-Intron10-4013 | + | GAGGCAGGAGAAUGGCGUGAAC | 22 | 22895 |
| CFTR-Intron10-4014 | + | UGAGGCAGGAGAAUGGCGUGAAC | 23 | 22896 |
| CFTR-Intron10-4015 | + | CUGAGGCAGGAGAAUGGCGUGAAC | 24 | 22897 |
| CFTR-Intron10-4016 | + | GAACCUAUAAGGAAUAAC | 18 | 22898 |
| CFTR-Intron10-4017 | + | AGAACCUAUAAGGAAUAAC | 19 | 22899 |
| CFTR-Intron10-403 | + | CAGAACCUAUAAGGAAUAAC | 20 | 19289 |
| CFTR-Intron10-4018 | + | ACAGAACCUAUAAGGAAUAAC | 21 | 22900 |
| CFTR-Intron10-4019 | + | UACAGAACCUAUAAGGAAUAAC | 22 | 22901 |
| CFTR-Intron10-4020 | + | UUACAGAACCUAUAAGGAAUAAC | 23 | 22902 |
| CFTR-Intron10-4021 | + | AUUACAGAACCUAUAAGGAAUAAC | 24 | 22903 |
| CFTR-Intron10-4022 | + | AAAAUAUGCGAGAACCAC | 18 | 22904 |
| CFTR-Intron10-4023 | + | AAAAAUAUGCGAGAACCAC | 19 | 22905 |
| CFTR-Intron10-4024 | + | GAAAAAUAUGCGAGAACCAC | 20 | 22906 |
| CFTR-Intron10-4025 | + | UGAAAAAUAUGCGAGAACCAC | 21 | 22907 |
| CFTR-Intron10-4026 | + | AUGAAAAAUAUGCGAGAACCAC | 22 | 22908 |
| CFTR-Intron10-4027 | + | GAUGAAAAAUAUGCGAGAACCAC | 23 | 22909 |
| CFTR-Intron10-4028 | + | UGAUGAAAAAUAUGCGAGAACCAC | 24 | 22910 |
| CFTR-Intron10-4029 | + | AGUAUUAAGUAUAGCCAC | 18 | 22911 |
| CFTR-Intron10-4030 | + | UAGUAUUAAGUAUAGCCAC | 19 | 22912 |
| CFTR-Intron10-408 | + | UUAGUAUUAAGUAUAGCCAC | 20 | 19294 |
| CFTR-Intron10-4031 | + | AUUAGUAUUAAGUAUAGCCAC | 21 | 22913 |
| CFTR-Intron10-4032 | + | UAUUAGUAUUAAGUAUAGCCAC | 22 | 22914 |
| CFTR-Intron10-4033 | + | UUAUUAGUAUUAAGUAUAGCCAC | 23 | 22915 |
| CFTR-Intron10-4034 | + | GUUAUUAGUAUUAAGUAUAGCCAC | 24 | 22916 |

TABLE 41E-continued

5th Tier

| gRNA Name | DNA Strand | Targeting Domain | Target Site Length | Seq ID |
|---|---|---|---|---|
| CFTR-Intron10-4035 | + | UUUAAUAAAUAAUAUCAC | 18 | 22917 |
| CFTR-Intron10-4036 | + | UUUUAAUAAAUAAUAUCAC | 19 | 22918 |
| CFTR-Intron10-4037 | + | AUUUUAAUAAAUAAUAUCAC | 20 | 22919 |
| CFTR-Intron10-4038 | + | AAUUUUAAUAAAUAAUAUCAC | 21 | 22920 |
| CFTR-Intron10-4039 | + | AAAUUUUAAUAAAUAAUAUCAC | 22 | 22921 |
| CFTR-Intron10-4040 | + | UAAAUUUUAAUAAAUAAUAUCAC | 23 | 22922 |
| CFTR-Intron10-4041 | + | UUAAAUUUUAAUAAAUAAUAUCAC | 24 | 22923 |
| CFTR-Intron10-4042 | + | GGAGAGAGAACUGCUCAC | 18 | 22924 |
| CFTR-Intron10-4043 | + | UGGAGAGAGAACUGCUCAC | 19 | 22925 |
| CFTR-Intron10-4044 | + | CUGGAGAGAGAACUGCUCAC | 20 | 22926 |
| CFTR-Intron10-4045 | + | ACUGGAGAGAGAACUGCUCAC | 21 | 22927 |
| CFTR-Intron10-4046 | + | UACUGGAGAGAGAACUGCUCAC | 22 | 22928 |
| CFTR-Intron10-4047 | + | UUACUGGAGAGAGAACUGCUCAC | 23 | 22929 |
| CFTR-Intron10-4048 | + | UUUACUGGAGAGAGAACUGCUCAC | 24 | 22930 |
| CFTR-Intron10-4049 | + | AAGACAUUUAAUGUAGAC | 18 | 22931 |
| CFTR-Intron10-4050 | + | CAAGACAUUUAAUGUAGAC | 19 | 22932 |
| CFTR-Intron10-4051 | + | GCAAGACAUUUAAUGUAGAC | 20 | 22933 |
| CFTR-Intron10-4052 | + | CGCAAGACAUUUAAUGUAGAC | 21 | 22934 |
| CFTR-Intron10-4053 | + | GCGCAAGACAUUUAAUGUAGAC | 22 | 22935 |
| CFTR-Intron10-4054 | + | AGCGCAAGACAUUUAAUGUAGAC | 23 | 22936 |
| CFTR-Intron10-4055 | + | AAGCGCAAGACAUUUAAUGUAGAC | 24 | 22937 |
| CFTR-Intron10-4056 | + | UUUAGCCCAUUCUAAUAC | 18 | 22938 |
| CFTR-Intron10-4057 | + | CUUUAGCCCAUUCUAAUAC | 19 | 22939 |
| CFTR-Intron10-4058 | + | CCUUUAGCCCAUUCUAAUAC | 20 | 22940 |
| CFTR-Intron10-4059 | + | CCCUUUAGCCCAUUCUAAUAC | 21 | 22941 |
| CFTR-Intron10-4060 | + | GCCCUUUAGCCCAUUCUAAUAC | 22 | 22942 |
| CFTR-Intron10-4061 | + | UGCCCUUUAGCCCAUUCUAAUAC | 23 | 22943 |
| CFTR-Intron10-4062 | + | UUGCCCUUUAGCCCAUUCUAAUAC | 24 | 22944 |
| CFTR-Intron10-4063 | + | UAUUUGUGGAGGACAUAC | 18 | 22945 |
| CFTR-Intron10-4064 | + | AUAUUUGUGGAGGACAUAC | 19 | 22946 |
| CFTR-Intron10-4065 | + | AAUAUUUGUGGAGGACAUAC | 20 | 22947 |
| CFTR-Intron10-4066 | + | AAAUAUUUGUGGAGGACAUAC | 21 | 22948 |
| CFTR-Intron10-4067 | + | AAAAUAUUUGUGGAGGACAUAC | 22 | 22949 |
| CFTR-Intron10-4068 | + | AAAAAUAUUUGUGGAGGACAUAC | 23 | 22950 |
| CFTR-Intron10-4069 | + | AAAAAAUAUUUGUGGAGGACAUAC | 24 | 22951 |
| CFTR-Intron10-4070 | + | GCCUGUAGUCCCAGCUAC | 18 | 22952 |
| CFTR-Intron10-4071 | + | CGCCUGUAGUCCCAGCUAC | 19 | 22953 |

TABLE 41E-continued

5th Tier

| gRNA Name | DNA Strand | Targeting Domain | Target Site Length | Seq ID |
|---|---|---|---|---|
| CFTR-Intron10-4072 | + | GCGCCUGUAGUCCCAGCUAC | 20 | 22954 |
| CFTR-Intron10-4073 | + | GGCGCCUGUAGUCCCAGCUAC | 21 | 22955 |
| CFTR-Intron10-4074 | + | GGGCGCCUGUAGUCCCAGCUAC | 22 | 22956 |
| CFTR-Intron10-4075 | + | CGGGCGCCUGUAGUCCCAGCUAC | 23 | 22957 |
| CFTR-Intron10-4076 | + | GCGGGCGCCUGUAGUCCCAGCUAC | 24 | 22958 |
| CFTR-Intron10-4077 | + | UGCCUGUAGUCCCAGCUAC | 19 | 22959 |
| CFTR-Intron10-4078 | + | GUGCCUGUAGUCCCAGCUAC | 20 | 22960 |
| CFTR-Intron10-4079 | + | CGUGCCUGUAGUCCCAGCUAC | 21 | 22961 |
| CFTR-Intron10-4080 | + | GCGUGCCUGUAGUCCCAGCUAC | 22 | 22962 |
| CFTR-Intron10-4081 | + | UGCGUGCCUGUAGUCCCAGCUAC | 23 | 22963 |
| CFTR-Intron10-4082 | + | GUGCGUGCCUGUAGUCCCAGCUAC | 24 | 22964 |
| CFTR-Intron10-4083 | + | ACUUGCUUCACCUGCUAC | 18 | 22965 |
| CFTR-Intron10-4084 | + | CACUUGCUUCACCUGCUAC | 19 | 22966 |
| CFTR-Intron10-4085 | + | GCACUUGCUUCACCUGCUAC | 20 | 22967 |
| CFTR-Intron10-4086 | + | UGCACUUGCUUCACCUGCUAC | 21 | 22968 |
| CFTR-Intron10-4087 | + | UUGCACUUGCUUCACCUGCUAC | 22 | 22969 |
| CFTR-Intron10-4088 | + | UUUGCACUUGCUUCACCUGCUAC | 23 | 22970 |
| CFTR-Intron10-4089 | + | CUUUGCACUUGCUUCACCUGCUAC | 24 | 22971 |
| CFTR-Intron10-4090 | + | AAAUCUUAUAGAGAUUAC | 18 | 22972 |
| CFTR-Intron10-4091 | + | AAAAUCUUAUAGAGAUUAC | 19 | 22973 |
| CFTR-Intron10-4092 | + | CAAAAUCUUAUAGAGAUUAC | 20 | 22974 |
| CFTR-Intron10-4093 | + | ACAAAAUCUUAUAGAGAUUAC | 21 | 22975 |
| CFTR-Intron10-4094 | + | AACAAAAUCUUAUAGAGAUUAC | 22 | 22976 |
| CFTR-Intron10-4095 | + | UAACAAAAUCUUAUAGAGAUUAC | 23 | 22977 |
| CFTR-Intron10-4096 | + | AUAACAAAAUCUUAUAGAGAUUAC | 24 | 22978 |
| CFTR-Intron10-4097 | + | UUUUACAAUUCUUAUUAC | 18 | 22979 |
| CFTR-Intron10-4098 | + | AUUUUACAAUUCUUAUUAC | 19 | 22980 |
| CFTR-Intron10-4099 | + | AAUUUUACAAUUCUUAUUAC | 20 | 22981 |
| CFTR-Intron10-4100 | + | AAAUUUUACAAUUCUUAUUAC | 21 | 22982 |
| CFTR-Intron10-4101 | + | UAAAUUUUACAAUUCUUAUUAC | 22 | 22983 |
| CFTR-Intron10-4102 | + | GUAAAUUUUACAAUUCUUAUUAC | 23 | 22984 |
| CFTR-Intron10-4103 | + | AGUAAAUUUUACAAUUCUUAUUAC | 24 | 22985 |
| CFTR-Intron10-4104 | + | CUGCAAUAUGCAAUUUAC | 18 | 22986 |
| CFTR-Intron10-4105 | + | ACUGCAAUAUGCAAUUUAC | 19 | 22987 |
| CFTR-Intron10-1190 | + | UACUGCAAUAUGCAAUUUAC | 20 | 20075 |
| CFTR-Intron10-4106 | + | UUACUGCAAUAUGCAAUUUAC | 21 | 22988 |
| CFTR-Intron10-4107 | + | UUUACUGCAAUAUGCAAUUUAC | 22 | 22989 |

TABLE 41E-continued

5th Tier

| gRNA Name | DNA Strand | Targeting Domain | Target Site Length | Seq ID |
|---|---|---|---|---|
| CFTR-Intron10-4108 | + | UUUUACUGCAAUAUGCAAUUUAC | 23 | 22990 |
| CFTR-Intron10-4109 | + | UUUUUACUGCAAUAUGCAAUUUAC | 24 | 22991 |
| CFTR-Intron10-4110 | + | UUUGUACAAAAUUAAACC | 18 | 22992 |
| CFTR-Intron10-4111 | + | CUUUGUACAAAAUUAAACC | 19 | 22993 |
| CFTR-Intron10-4112 | + | CCUUUGUACAAAAUUAAACC | 20 | 22994 |
| CFTR-Intron10-4113 | + | UCCUUUGUACAAAAUUAAACC | 21 | 22995 |
| CFTR-Intron10-4114 | + | UUCCUUUGUACAAAAUUAAACC | 22 | 22996 |
| CFTR-Intron10-4115 | + | AUUCCUUUGUACAAAAUUAAACC | 23 | 22997 |
| CFTR-Intron10-4116 | + | AAUUCCUUUGUACAAAAUUAAACC | 24 | 22998 |
| CFTR-Intron10-4117 | + | AGGAGAAUGGCGUGAACC | 18 | 22999 |
| CFTR-Intron10-4118 | + | CAGGAGAAUGGCGUGAACC | 19 | 23000 |
| CFTR-Intron10-661 | + | GCAGGAGAAUGGCGUGAACC | 20 | 19547 |
| CFTR-Intron10-4119 | + | GGCAGGAGAAUGGCGUGAACC | 21 | 23001 |
| CFTR-Intron10-4120 | + | AGGCAGGAGAAUGGCGUGAACC | 22 | 23002 |
| CFTR-Intron10-4121 | + | GAGGCAGGAGAAUGGCGUGAACC | 23 | 23003 |
| CFTR-Intron10-4122 | + | UGAGGCAGGAGAAUGGCGUGAACC | 24 | 23004 |
| CFTR-Intron10-4123 | + | GGUCUUGAUCUCCUAACC | 18 | 23005 |
| CFTR-Intron10-4124 | + | UGGUCUUGAUCUCCUAACC | 19 | 23006 |
| CFTR-Intron10-4125 | + | AUGGUCUUGAUCUCCUAACC | 20 | 23007 |
| CFTR-Intron10-4126 | + | GAUGGUCUUGAUCUCCUAACC | 21 | 23008 |
| CFTR-Intron10-4127 | + | GGAUGGUCUUGAUCUCCUAACC | 22 | 23009 |
| CFTR-Intron10-4128 | + | AGGAUGGUCUUGAUCUCCUAACC | 23 | 23010 |
| CFTR-Intron10-4129 | + | CAGGAUGGUCUUGAUCUCCUAACC | 24 | 23011 |
| CFTR-Intron10-4130 | + | CCCUGCAAUACCAUCACC | 18 | 23012 |
| CFTR-Intron10-4131 | + | ACCCUGCAAUACCAUCACC | 19 | 23013 |
| CFTR-Intron10-4132 | + | CACCCUGCAAUACCAUCACC | 20 | 23014 |
| CFTR-Intron10-4133 | + | CCACCCUGCAAUACCAUCACC | 21 | 23015 |
| CFTR-Intron10-4134 | + | CCCACCCUGCAAUACCAUCACC | 22 | 23016 |
| CFTR-Intron10-4135 | + | CCCCACCCUGCAAUACCAUCACC | 23 | 23017 |
| CFTR-Intron10-4136 | + | GCCCCACCCUGCAAUACCAUCACC | 24 | 23018 |
| CFTR-Intron10-4137 | + | GUGGCCUCUAAUCUCACC | 18 | 23019 |
| CFTR-Intron10-4138 | + | AGUGGCCUCUAAUCUCACC | 19 | 23020 |
| CFTR-Intron10-4139 | + | CAGUGGCCUCUAAUCUCACC | 20 | 23021 |
| CFTR-Intron10-4140 | + | CCAGUGGCCUCUAAUCUCACC | 21 | 23022 |
| CFTR-Intron10-4141 | + | UCCAGUGGCCUCUAAUCUCACC | 22 | 23023 |
| CFTR-Intron10-4142 | + | CUCCAGUGGCCUCUAAUCUCACC | 23 | 23024 |
| CFTR-Intron10-4143 | + | UCUCCAGUGGCCUCUAAUCUCACC | 24 | 23025 |

TABLE 41E-continued

5th Tier

| gRNA Name | DNA Strand | Targeting Domain | Target Site Length | Seq ID |
|---|---|---|---|---|
| CFTR-Intron10-4144 | + | CUGCUAUAACAAAAUACC | 18 | 23026 |
| CFTR-Intron10-4145 | + | GCUGCUAUAACAAAAUACC | 19 | 23027 |
| CFTR-Intron10-4146 | + | GGCUGCUAUAACAAAAUACC | 20 | 23028 |
| CFTR-Intron10-4147 | + | AGGCUGCUAUAACAAAAUACC | 21 | 23029 |
| CFTR-Intron10-4148 | + | CAGGCUGCUAUAACAAAAUACC | 22 | 23030 |
| CFTR-Intron10-4149 | + | UCAGGCUGCUAUAACAAAAUACC | 23 | 23031 |
| CFTR-Intron10-4150 | + | UUCAGGCUGCUAUAACAAAAUACC | 24 | 23032 |
| CFTR-Intron10-4151 | + | UACAGCUAAAGUAUUACC | 18 | 23033 |
| CFTR-Intron10-4152 | + | AUACAGCUAAAGUAUUACC | 19 | 23034 |
| CFTR-Intron10-4153 | + | UAUACAGCUAAAGUAUUACC | 20 | 23035 |
| CFTR-Intron10-4154 | + | AUAUACAGCUAAAGUAUUACC | 21 | 23036 |
| CFTR-Intron10-4155 | + | AAUAUACAGCUAAAGUAUUACC | 22 | 23037 |
| CFTR-Intron10-4156 | + | UAAUAUACAGCUAAAGUAUUACC | 23 | 23038 |
| CFTR-Intron10-4157 | + | AUAAUAUACAGCUAAAGUAUUACC | 24 | 23039 |
| CFTR-Intron10-4158 | + | GGAGAAUGGCGUGAACCC | 18 | 23040 |
| CFTR-Intron10-4159 | + | AGGAGAAUGGCGUGAACCC | 19 | 23041 |
| CFTR-Intron10-1191 | + | CAGGAGAAUGGCGUGAACCC | 20 | 20076 |
| CFTR-Intron10-4160 | + | GCAGGAGAAUGGCGUGAACCC | 21 | 23042 |
| CFTR-Intron10-4161 | + | GGCAGGAGAAUGGCGUGAACCC | 22 | 23043 |
| CFTR-Intron10-4162 | + | AGGCAGGAGAAUGGCGUGAACCC | 23 | 23044 |
| CFTR-Intron10-4163 | + | GAGGCAGGAGAAUGGCGUGAACCC | 24 | 23045 |
| CFTR-Intron10-4164 | + | GGAGAAUUGCUUGAGCCC | 18 | 23046 |
| CFTR-Intron10-4165 | + | AGGAGAAUUGCUUGAGCCC | 19 | 23047 |
| CFTR-Intron10-1195 | + | CAGGAGAAUUGCUUGAGCCC | 20 | 20080 |
| CFTR-Intron10-4166 | + | GCAGGAGAAUUGCUUGAGCCC | 21 | 23048 |
| CFTR-Intron10-4167 | + | GGCAGGAGAAUUGCUUGAGCCC | 22 | 23049 |
| CFTR-Intron10-4168 | + | AGGCAGGAGAAUUGCUUGAGCCC | 23 | 23050 |
| CFTR-Intron10-4169 | + | GAGGCAGGAGAAUUGCUUGAGCCC | 24 | 23051 |
| CFTR-Intron10-4170 | + | AAGUGUUUAAAUAUUCCC | 18 | 23052 |
| CFTR-Intron10-4171 | + | GAAGUGUUUAAAUAUUCCC | 19 | 23053 |
| CFTR-Intron10-4172 | + | AGAAGUGUUUAAAUAUUCCC | 20 | 23054 |
| CFTR-Intron10-4173 | + | CAGAAGUGUUUAAAUAUUCCC | 21 | 23055 |
| CFTR-Intron10-4174 | + | UCAGAAGUGUUUAAAUAUUCCC | 22 | 23056 |
| CFTR-Intron10-4175 | + | CUCAGAAGUGUUUAAAUAUUCCC | 23 | 23057 |
| CFTR-Intron10-4176 | + | UCUCAGAAGUGUUUAAAUAUUCCC | 24 | 23058 |
| CFTR-Intron10-4177 | + | GGAAAGGUCAAUUGAGCC | 18 | 23059 |
| CFTR-Intron10-4178 | + | CGGAAAGGUCAAUUGAGCC | 19 | 23060 |

TABLE 41E-continued

5th Tier

| gRNA Name | DNA Strand | Targeting Domain | Target Site Length | Seq ID |
|---|---|---|---|---|
| CFTR-Intron10-4179 | + | GCGGAAAGGUCAAUUGAGCC | 20 | 23061 |
| CFTR-Intron10-4180 | + | AGCGGAAAGGUCAAUUGAGCC | 21 | 23062 |
| CFTR-Intron10-4181 | + | AAGCGGAAAGGUCAAUUGAGCC | 22 | 23063 |
| CFTR-Intron10-4182 | + | GAAGCGGAAAGGUCAAUUGAGCC | 23 | 23064 |
| CFTR-Intron10-4183 | + | UGAAGCGGAAAGGUCAAUUGAGCC | 24 | 23065 |
| CFTR-Intron10-4184 | + | AGGAGAAUUGCUUGAGCC | 18 | 23066 |
| CFTR-Intron10-4185 | + | CAGGAGAAUUGCUUGAGCC | 19 | 23067 |
| CFTR-Intron10-665 | + | GCAGGAGAAUUGCUUGAGCC | 20 | 19551 |
| CFTR-Intron10-4186 | + | GGCAGGAGAAUUGCUUGAGCC | 21 | 23068 |
| CFTR-Intron10-4187 | + | AGGCAGGAGAAUUGCUUGAGCC | 22 | 23069 |
| CFTR-Intron10-4188 | + | GAGGCAGGAGAAUUGCUUGAGCC | 23 | 23070 |
| CFTR-Intron10-4189 | + | UGAGGCAGGAGAAUUGCUUGAGCC | 24 | 23071 |
| CFTR-Intron10-4190 | + | GGCACUUGUUGACAGUCC | 18 | 23072 |
| CFTR-Intron10-4191 | + | AGGCACUUGUUGACAGUCC | 19 | 23073 |
| CFTR-Intron10-4192 | + | UAGGCACUUGUUGACAGUCC | 20 | 23074 |
| CFTR-Intron10-4193 | + | CUAGGCACUUGUUGACAGUCC | 21 | 23075 |
| CFTR-Intron10-4194 | + | GCUAGGCACUUGUUGACAGUCC | 22 | 23076 |
| CFTR-Intron10-4195 | + | UGCUAGGCACUUGUUGACAGUCC | 23 | 23077 |
| CFTR-Intron10-4196 | + | GUGCUAGGCACUUGUUGACAGUCC | 24 | 23078 |
| CFTR-Intron10-4197 | + | CUACCAGCCCCCUCUUCC | 18 | 23079 |
| CFTR-Intron10-4198 | + | ACUACCAGCCCCCUCUUCC | 19 | 23080 |
| CFTR-Intron10-4199 | + | CACUACCAGCCCCCUCUUCC | 20 | 23081 |
| CFTR-Intron10-4200 | + | ACACUACCAGCCCCCUCUUCC | 21 | 23082 |
| CFTR-Intron10-4201 | + | CACACUACCAGCCCCCUCUUCC | 22 | 23083 |
| CFTR-Intron10-4202 | + | UCACACUACCAGCCCCCUCUUCC | 23 | 23084 |
| CFTR-Intron10-4203 | + | UUCACACUACCAGCCCCCUCUUCC | 24 | 23085 |
| CFTR-Intron10-4204 | + | CAAGAUAGUGGGAAAAGC | 18 | 23086 |
| CFTR-Intron10-4205 | + | CCAAGAUAGUGGGAAAAGC | 19 | 23087 |
| CFTR-Intron10-4206 | + | UCCAAGAUAGUGGGAAAAGC | 20 | 23088 |
| CFTR-Intron10-4207 | + | GUCCAAGAUAGUGGGAAAAGC | 21 | 23089 |
| CFTR-Intron10-4208 | + | UGUCCAAGAUAGUGGGAAAAGC | 22 | 23090 |
| CFTR-Intron10-4209 | + | UUGUCCAAGAUAGUGGGAAAAGC | 23 | 23091 |
| CFTR-Intron10-4210 | + | GUUGUCCAAGAUAGUGGGAAAAGC | 24 | 23092 |
| CFTR-Intron10-4211 | + | UUACUCAGUCCAGAAAGC | 18 | 23093 |
| CFTR-Intron10-4212 | + | GUUACUCAGUCCAGAAAGC | 19 | 23094 |
| CFTR-Intron10-4213 | + | AGUUACUCAGUCCAGAAAGC | 20 | 23095 |
| CFTR-Intron10-4214 | + | CAGUUACUCAGUCCAGAAAGC | 21 | 23096 |

TABLE 41E-continued

5th Tier

| gRNA Name | DNA Strand | Targeting Domain | Target Site Length | Seq ID |
|---|---|---|---|---|
| CFTR-Intron10-4215 | + | CCAGUUACUCAGUCCAGAAAGC | 22 | 23097 |
| CFTR-Intron10-4216 | + | UCCAGUUACUCAGUCCAGAAAGC | 23 | 23098 |
| CFTR-Intron10-4217 | + | UUCCAGUUACUCAGUCCAGAAAGC | 24 | 23099 |
| CFTR-Intron10-4218 | + | CCGCCACUGCACUCCAGC | 18 | 23100 |
| CFTR-Intron10-4219 | + | CCCGCCACUGCACUCCAGC | 19 | 23101 |
| CFTR-Intron10-4220 | + | UCCCGCCACUGCACUCCAGC | 20 | 23102 |
| CFTR-Intron10-4221 | + | AUCCCGCCACUGCACUCCAGC | 21 | 23103 |
| CFTR-Intron10-4222 | + | GAUCCCGCCACUGCACUCCAGC | 22 | 23104 |
| CFTR-Intron10-4223 | + | AGAUCCCGCCACUGCACUCCAGC | 23 | 23105 |
| CFTR-Intron10-4224 | + | GAGAUCCCGCCACUGCACUCCAGC | 24 | 23106 |
| CFTR-Intron10-4225 | + | CAGGAGAAUUGCUUGAGC | 18 | 23107 |
| CFTR-Intron10-4226 | + | GCAGGAGAAUUGCUUGAGC | 19 | 23108 |
| CFTR-Intron10-4227 | + | GGCAGGAGAAUUGCUUGAGC | 20 | 23109 |
| CFTR-Intron10-4228 | + | AGGCAGGAGAAUUGCUUGAGC | 21 | 23110 |
| CFTR-Intron10-4229 | + | GAGGCAGGAGAAUUGCUUGAGC | 22 | 23111 |
| CFTR-Intron10-4230 | + | UGAGGCAGGAGAAUUGCUUGAGC | 23 | 23112 |
| CFTR-Intron10-4231 | + | GUGAGGCAGGAGAAUUGCUUGAGC | 24 | 23113 |
| CFTR-Intron10-1222 | + | ACCUCAGCCUCCCAAGUAGC | 20 | 20107 |
| CFTR-Intron10-4232 | + | CACCUCAGCCUCCCAAGUAGC | 21 | 23114 |
| CFTR-Intron10-4233 | + | CCACCUCAGCCUCCCAAGUAGC | 22 | 23115 |
| CFTR-Intron10-4234 | + | CCCACCUCAGCCUCCCAAGUAGC | 23 | 23116 |
| CFTR-Intron10-4235 | + | UCCCACCUCAGCCUCCCAAGUAGC | 24 | 23117 |
| CFTR-Intron10-4236 | + | CUCAGCCUCCCGAGUAGC | 18 | 23118 |
| CFTR-Intron10-4237 | + | CCUCAGCCUCCCGAGUAGC | 19 | 23119 |
| CFTR-Intron10-675 | + | GCCUCAGCCUCCCGAGUAGC | 20 | 19561 |
| CFTR-Intron10-4238 | + | UGCCUCAGCCUCCCGAGUAGC | 21 | 23120 |
| CFTR-Intron10-4239 | + | CUGCCUCAGCCUCCCGAGUAGC | 22 | 23121 |
| CFTR-Intron10-4240 | + | CCUGCCUCAGCCUCCCGAGUAGC | 23 | 23122 |
| CFTR-Intron10-4241 | + | UCCUGCCUCAGCCUCCCGAGUAGC | 24 | 23123 |
| CFTR-Intron10-4242 | + | AAACUCAUAAGGGACCGC | 18 | 23124 |
| CFTR-Intron10-4243 | + | AAAACUCAUAAGGGACCGC | 19 | 23125 |
| CFTR-Intron10-4244 | + | GAAAACUCAUAAGGGACCGC | 20 | 23126 |
| CFTR-Intron10-4245 | + | AGAAAACUCAUAAGGGACCGC | 21 | 23127 |
| CFTR-Intron10-4246 | + | GAGAAAACUCAUAAGGGACCGC | 22 | 23128 |
| CFTR-Intron10-4247 | + | AGAGAAAACUCAUAAGGGACCGC | 23 | 23129 |
| CFTR-Intron10-4248 | + | UAGAGAAAACUCAUAAGGGACCGC | 24 | 23130 |
| CFTR-Intron10-4249 | + | UCUCACAGUUCUGGAGGC | 18 | 23131 |

TABLE 41E-continued

5th Tier

| gRNA Name | DNA Strand | Targeting Domain | Target Site Length | Seq ID |
|---|---|---|---|---|
| CFTR-Intron10-4250 | + | UUCUCACAGUUCUGGAGGC | 19 | 23132 |
| CFTR-Intron10-1229 | + | UUUCUCACAGUUCUGGAGGC | 20 | 20114 |
| CFTR-Intron10-4251 | + | AUUUCUCACAGUUCUGGAGGC | 21 | 23133 |
| CFTR-Intron10-4252 | + | UAUUUCUCACAGUUCUGGAGGC | 22 | 23134 |
| CFTR-Intron10-4253 | + | UUAUUUCUCACAGUUCUGGAGGC | 23 | 23135 |
| CFTR-Intron10-4254 | + | UUUAUUUCUCACAGUUCUGGAGGC | 24 | 23136 |
| CFTR-Intron10-4255 | + | UACUUGGGAGGCUGAGGC | 18 | 23137 |
| CFTR-Intron10-4256 | + | CUACUUGGGAGGCUGAGGC | 19 | 23138 |
| CFTR-Intron10-681 | + | GCUACUUGGGAGGCUGAGGC | 20 | 19567 |
| CFTR-Intron10-4257 | + | AGCUACUUGGGAGGCUGAGGC | 21 | 23139 |
| CFTR-Intron10-4258 | + | CAGCUACUUGGGAGGCUGAGGC | 22 | 23140 |
| CFTR-Intron10-4259 | + | CCAGCUACUUGGGAGGCUGAGGC | 23 | 23141 |
| CFTR-Intron10-4260 | + | CCCAGCUACUUGGGAGGCUGAGGC | 24 | 23142 |
| CFTR-Intron10-4261 | + | UACUUGGGAGGGUGAGGC | 18 | 23143 |
| CFTR-Intron10-4262 | + | CUACUUGGGAGGGUGAGGC | 19 | 23144 |
| CFTR-Intron10-682 | + | GCUACUUGGGAGGGUGAGGC | 20 | 19568 |
| CFTR-Intron10-4263 | + | AGCUACUUGGGAGGGUGAGGC | 21 | 23145 |
| CFTR-Intron10-4264 | + | CAGCUACUUGGGAGGGUGAGGC | 22 | 23146 |
| CFTR-Intron10-4265 | + | CCAGCUACUUGGGAGGGUGAGGC | 23 | 23147 |
| CFTR-Intron10-4266 | + | CCCAGCUACUUGGGAGGGUGAGGC | 24 | 23148 |
| CFTR-Intron10-4267 | + | CUGAGGCAGGAGAAUGGC | 18 | 23149 |
| CFTR-Intron10-4268 | + | GCUGAGGCAGGAGAAUGGC | 19 | 23150 |
| CFTR-Intron10-4269 | + | GGCUGAGGCAGGAGAAUGGC | 20 | 23151 |
| CFTR-Intron10-4270 | + | AGGCUGAGGCAGGAGAAUGGC | 21 | 23152 |
| CFTR-Intron10-4271 | + | GAGGCUGAGGCAGGAGAAUGGC | 22 | 23153 |
| CFTR-Intron10-4272 | + | GGAGGCUGAGGCAGGAGAAUGGC | 23 | 23154 |
| CFTR-Intron10-4273 | + | GGGAGGCUGAGGCAGGAGAAUGGC | 24 | 23155 |
| CFTR-Intron10-4274 | + | UUUCAACAUAUGAAUGGC | 18 | 23156 |
| CFTR-Intron10-4275 | + | AUUUCAACAUAUGAAUGGC | 19 | 23157 |
| CFTR-Intron10-683 | + | GAUUUCAACAUAUGAAUGGC | 20 | 19569 |
| CFTR-Intron10-4276 | + | GGAUUUCAACAUAUGAAUGGC | 21 | 23158 |
| CFTR-Intron10-4277 | + | AGGAUUUCAACAUAUGAAUGGC | 22 | 23159 |
| CFTR-Intron10-4278 | + | UAGGAUUUCAACAUAUGAAUGGC | 23 | 23160 |
| CFTR-Intron10-4279 | + | UUAGGAUUUCAACAUAUGAAUGGC | 24 | 23161 |
| CFTR-Intron10-4280 | + | AAUGGCUAUCCACAAUGC | 18 | 23162 |
| CFTR-Intron10-4281 | + | AAAUGGCUAUCCACAAUGC | 19 | 23163 |
| CFTR-Intron10-4282 | + | UAAAUGGCUAUCCACAAUGC | 20 | 23164 |

TABLE 41E-continued

5th Tier

| gRNA Name | DNA Strand | Targeting Domain | Target Site Length | Seq ID |
|---|---|---|---|---|
| CFTR-Intron10-4283 | + | UUAAAUGGCUAUCCACAAUGC | 21 | 23165 |
| CFTR-Intron10-4284 | + | UUUAAAUGGCUAUCCACAAUGC | 22 | 23166 |
| CFTR-Intron10-4285 | + | UUUUAAAUGGCUAUCCACAAUGC | 23 | 23167 |
| CFTR-Intron10-4286 | + | GUUUUAAAUGGCUAUCCACAAUGC | 24 | 23168 |
| CFTR-Intron10-4287 | + | GGUUGGAUGAGGGAAUGC | 18 | 23169 |
| CFTR-Intron10-4288 | + | UGGUUGGAUGAGGGAAUGC | 19 | 23170 |
| CFTR-Intron10-431 | + | UUGGUUGGAUGAGGGAAUGC | 20 | 19317 |
| CFTR-Intron10-4289 | + | CUUGGUUGGAUGAGGGAAUGC | 21 | 23171 |
| CFTR-Intron10-4290 | + | CCUUGGUUGGAUGAGGGAAUGC | 22 | 23172 |
| CFTR-Intron10-4291 | + | ACCUUGGUUGGAUGAGGGAAUGC | 23 | 23173 |
| CFTR-Intron10-4292 | + | UACCUUGGUUGGAUGAGGGAAUGC | 24 | 23174 |
| CFTR-Intron10-4293 | + | ACAUGAUGAAAAAUAUGC | 18 | 23175 |
| CFTR-Intron10-4294 | + | AACAUGAUGAAAAAUAUGC | 19 | 23176 |
| CFTR-Intron10-4295 | + | AAACAUGAUGAAAAAUAUGC | 20 | 23177 |
| CFTR-Intron10-4296 | + | UAAACAUGAUGAAAAAUAUGC | 21 | 23178 |
| CFTR-Intron10-4297 | + | CUAAACAUGAUGAAAAAUAUGC | 22 | 23179 |
| CFTR-Intron10-4298 | + | ACUAAACAUGAUGAAAAAUAUGC | 23 | 23180 |
| CFTR-Intron10-4299 | + | CACUAAACAUGAUGAAAAAUAUGC | 24 | 23181 |
| CFTR-Intron10-4300 | + | CAAUUUUAAUAAAACUGC | 18 | 23182 |
| CFTR-Intron10-4301 | + | UCAAUUUUAAUAAAACUGC | 19 | 23183 |
| CFTR-Intron10-4302 | + | AUCAAUUUUAAUAAAACUGC | 20 | 23184 |
| CFTR-Intron10-4303 | + | CAUCAAUUUUAAUAAAACUGC | 21 | 23185 |
| CFTR-Intron10-4304 | + | UCAUCAAUUUUAAUAAAACUGC | 22 | 23186 |
| CFTR-Intron10-4305 | + | CUCAUCAAUUUUAAUAAAACUGC | 23 | 23187 |
| CFTR-Intron10-4306 | + | GCUCAUCAAUUUUAAUAAAACUGC | 24 | 23188 |
| CFTR-Intron10-4307 | + | GUGAGGCAGGAGAAUUGC | 18 | 23189 |
| CFTR-Intron10-4308 | + | GGUGAGGCAGGAGAAUUGC | 19 | 23190 |
| CFTR-Intron10-4309 | + | GGGUGAGGCAGGAGAAUUGC | 20 | 23191 |
| CFTR-Intron10-4310 | + | AGGGUGAGGCAGGAGAAUUGC | 21 | 23192 |
| CFTR-Intron10-4311 | + | GAGGGUGAGGCAGGAGAAUUGC | 22 | 23193 |
| CFTR-Intron10-4312 | + | GGAGGGUGAGGCAGGAGAAUUGC | 23 | 23194 |
| CFTR-Intron10-4313 | + | GGGAGGGUGAGGCAGGAGAAUUGC | 24 | 23195 |
| CFTR-Intron10-4314 | + | GCCACCAUCAUCACUUGC | 18 | 23196 |
| CFTR-Intron10-4315 | + | AGCCACCAUCAUCACUUGC | 19 | 23197 |
| CFTR-Intron10-4316 | + | AAGCCACCAUCAUCACUUGC | 20 | 23198 |
| CFTR-Intron10-4317 | + | CAAGCCACCAUCAUCACUUGC | 21 | 23199 |
| CFTR-Intron10-4318 | + | UCAAGCCACCAUCAUCACUUGC | 22 | 23200 |

TABLE 41E-continued

5th Tier

| gRNA Name | DNA Strand | Targeting Domain | Target Site Length | Seq ID |
|---|---|---|---|---|
| CFTR-Intron10-4319 | + | AUCAAGCCACCAUCAUCACUUGC | 23 | 23201 |
| CFTR-Intron10-4320 | + | GAUCAAGCCACCAUCAUCACUUGC | 24 | 23202 |
| CFTR-Intron10-4321 | + | ACAAAGUAACAGAAAAUC | 18 | 23203 |
| CFTR-Intron10-4322 | + | AACAAAGUAACAGAAAAUC | 19 | 23204 |
| CFTR-Intron10-4323 | + | UAACAAAGUAACAGAAAAUC | 20 | 23205 |
| CFTR-Intron10-4324 | + | GUAACAAAGUAACAGAAAAUC | 21 | 23206 |
| CFTR-Intron10-4325 | + | AGUAACAAAGUAACAGAAAAUC | 22 | 23207 |
| CFTR-Intron10-4326 | + | AAGUAACAAAGUAACAGAAAAUC | 23 | 23208 |
| CFTR-Intron10-4327 | + | AAAGUAACAAAGUAACAGAAAAUC | 24 | 23209 |
| CFTR-Intron10-4328 | + | UGCUAUUUAAACAGAAUC | 18 | 23210 |
| CFTR-Intron10-4329 | + | GUGCUAUUUAAACAGAAUC | 19 | 23211 |
| CFTR-Intron10-433 | + | AGUGCUAUUUAAACAGAAUC | 20 | 19319 |
| CFTR-Intron10-4330 | + | CAGUGCUAUUUAAACAGAAUC | 21 | 23212 |
| CFTR-Intron10-4331 | + | CCAGUGCUAUUUAAACAGAAUC | 22 | 23213 |
| CFTR-Intron10-4332 | + | UCCAGUGCUAUUUAAACAGAAUC | 23 | 23214 |
| CFTR-Intron10-4333 | + | CUCCAGUGCUAUUUAAACAGAAUC | 24 | 23215 |
| CFTR-Intron10-4334 | + | UUUAGUAGAAACCUAAUC | 18 | 23216 |
| CFTR-Intron10-4335 | + | UUUUAGUAGAAACCUAAUC | 19 | 23217 |
| CFTR-Intron10-91 | + | GUUUUAGUAGAAACCUAAUC | 20 | 18977 |
| CFTR-Intron10-4336 | + | GGUUUUAGUAGAAACCUAAUC | 21 | 23218 |
| CFTR-Intron10-4337 | + | UGGUUUUAGUAGAAACCUAAUC | 22 | 23219 |
| CFTR-Intron10-4338 | + | UUGGUUUUAGUAGAAACCUAAUC | 23 | 23220 |
| CFTR-Intron10-4339 | + | UUUGGUUUUAGUAGAAACCUAAUC | 24 | 23221 |
| CFTR-Intron10-4340 | + | GGCCGAGGCAGGCAGAUC | 18 | 23222 |
| CFTR-Intron10-4341 | + | AGGCCGAGGCAGGCAGAUC | 19 | 23223 |
| CFTR-Intron10-4342 | + | GAGGCCGAGGCAGGCAGAUC | 20 | 23224 |
| CFTR-Intron10-4343 | + | GGAGGCCGAGGCAGGCAGAUC | 21 | 23225 |
| CFTR-Intron10-4344 | + | GGGAGGCCGAGGCAGGCAGAUC | 22 | 23226 |
| CFTR-Intron10-4345 | + | UGGGAGGCCGAGGCAGGCAGAUC | 23 | 23227 |
| CFTR-Intron10-4346 | + | UUGGGAGGCCGAGGCAGGCAGAUC | 24 | 23228 |
| CFTR-Intron10-4347 | + | GGCCGAGGCGGGCGGAUC | 18 | 23229 |
| CFTR-Intron10-4348 | + | AGGCCGAGGCGGGCGGAUC | 19 | 23230 |
| CFTR-Intron10-4349 | + | GAGGCCGAGGCGGGCGGAUC | 20 | 23231 |
| CFTR-Intron10-4350 | + | GGAGGCCGAGGCGGGCGGAUC | 21 | 23232 |
| CFTR-Intron10-4351 | + | GGGAGGCCGAGGCGGGCGGAUC | 22 | 23233 |
| CFTR-Intron10-4352 | + | UGGGAGGCCGAGGCGGGCGGAUC | 23 | 23234 |
| CFTR-Intron10-4353 | + | UUGGGAGGCCGAGGCGGGCGGAUC | 24 | 23235 |

TABLE 41E-continued

5th Tier

| gRNA Name | DNA Strand | Targeting Domain | Target Site Length | Seq ID |
|---|---|---|---|---|
| CFTR-Intron10-4354 | + | UCUAUCAUAGAAUUGAUC | 18 | 23236 |
| CFTR-Intron10-4355 | + | AUCUAUCAUAGAAUUGAUC | 19 | 23237 |
| CFTR-Intron10-4356 | + | CAUCUAUCAUAGAAUUGAUC | 20 | 23238 |
| CFTR-Intron10-4357 | + | ACAUCUAUCAUAGAAUUGAUC | 21 | 23239 |
| CFTR-Intron10-4358 | + | CACAUCUAUCAUAGAAUUGAUC | 22 | 23240 |
| CFTR-Intron10-4359 | + | GCACAUCUAUCAUAGAAUUGAUC | 23 | 23241 |
| CFTR-Intron10-4360 | + | UGCACAUCUAUCAUAGAAUUGAUC | 24 | 23242 |
| CFTR-Intron10-4361 | + | AUACUGGGUUCAUUUAUC | 18 | 23243 |
| CFTR-Intron10-4362 | + | UAUACUGGGUUCAUUUAUC | 19 | 23244 |
| CFTR-Intron10-4363 | + | UUAUACUGGGUUCAUUUAUC | 20 | 23245 |
| CFTR-Intron10-4364 | + | UUUAUACUGGGUUCAUUUAUC | 21 | 23246 |
| CFTR-Intron10-4365 | + | CUUUAUACUGGGUUCAUUUAUC | 22 | 23247 |
| CFTR-Intron10-4366 | + | UCUUUAUACUGGGUUCAUUUAUC | 23 | 23248 |
| CFTR-Intron10-4367 | + | GUCUUUAUACUGGGUUCAUUUAUC | 24 | 23249 |
| CFTR-Intron10-4368 | + | CACGCUGGUCUCAAACUC | 18 | 23250 |
| CFTR-Intron10-4369 | + | CCACGCUGGUCUCAAACUC | 19 | 23251 |
| CFTR-Intron10-4370 | + | CCCACGCUGGUCUCAAACUC | 20 | 23252 |
| CFTR-Intron10-4371 | + | GCCCACGCUGGUCUCAAACUC | 21 | 23253 |
| CFTR-Intron10-4372 | + | UGCCCACGCUGGUCUCAAACUC | 22 | 23254 |
| CFTR-Intron10-4373 | + | UUGCCCACGCUGGUCUCAAACUC | 23 | 23255 |
| CFTR-Intron10-4374 | + | GUUGCCCACGCUGGUCUCAAACUC | 24 | 23256 |
| CFTR-Intron10-4375 | + | GUAUUAGCAAGUGGACUC | 18 | 23257 |
| CFTR-Intron10-4376 | + | UGUAUUAGCAAGUGGACUC | 19 | 23258 |
| CFTR-Intron10-4377 | + | UUGUAUUAGCAAGUGGACUC | 20 | 23259 |
| CFTR-Intron10-4378 | + | AUUGUAUUAGCAAGUGGACUC | 21 | 23260 |
| CFTR-Intron10-4379 | + | AAUUGUAUUAGCAAGUGGACUC | 22 | 23261 |
| CFTR-Intron10-4380 | + | CAAUUGUAUUAGCAAGUGGACUC | 23 | 23262 |
| CFTR-Intron10-4381 | + | UCAAUUGUAUUAGCAAGUGGACUC | 24 | 23263 |
| CFTR-Intron10-4382 | + | ACUAAAGACUUCACCCUC | 18 | 23264 |
| CFTR-Intron10-4383 | + | UACUAAAGACUUCACCCUC | 19 | 23265 |
| CFTR-Intron10-4384 | + | UUACUAAAGACUUCACCCUC | 20 | 23266 |
| CFTR-Intron10-4385 | + | UUUACUAAAGACUUCACCCUC | 21 | 23267 |
| CFTR-Intron10-4386 | + | AUUUACUAAAGACUUCACCCUC | 22 | 23268 |
| CFTR-Intron10-4387 | + | CAUUUACUAAAGACUUCACCCUC | 23 | 23269 |
| CFTR-Intron10-4388 | + | UCAUUUACUAAAGACUUCACCCUC | 24 | 23270 |
| CFTR-Intron10-4389 | + | CCACCCAAUUUUUGGCUC | 18 | 23271 |
| CFTR-Intron10-4390 | + | CCCACCCAAUUUUUGGCUC | 19 | 23272 |

TABLE 41E-continued

5th Tier

| gRNA Name | DNA Strand | Targeting Domain | Target Site Length | Seq ID |
|---|---|---|---|---|
| CFTR-Intron10-4391 | + | CCCCACCCAAUUUUUGGCUC | 20 | 23273 |
| CFTR-Intron10-4392 | + | CCCCCACCCAAUUUUUGGCUC | 21 | 23274 |
| CFTR-Intron10-4393 | + | UCCCCCACCCAAUUUUUGGCUC | 22 | 23275 |
| CFTR-Intron10-4394 | + | CUCCCCCACCCAAUUUUUGGCUC | 23 | 23276 |
| CFTR-Intron10-4395 | + | GCUCCCCCACCCAAUUUUUGGCUC | 24 | 23277 |
| CFTR-Intron10-4396 | + | UAUAGAGAGAAACAUCUC | 18 | 23278 |
| CFTR-Intron10-4397 | + | AUAUAGAGAGAAACAUCUC | 19 | 23279 |
| CFTR-Intron10-1238 | + | UAUAUAGAGAGAAACAUCUC | 20 | 20123 |
| CFTR-Intron10-4398 | + | AUAUAUAGAGAGAAACAUCUC | 21 | 23280 |
| CFTR-Intron10-4399 | + | UAUAUAUAGAGAGAAACAUCUC | 22 | 23281 |
| CFTR-Intron10-4400 | + | AUAUAUAUAGAGAGAAACAUCUC | 23 | 23282 |
| CFTR-Intron10-4401 | + | UAUAUAUAUAGAGAGAAACAUCUC | 24 | 23283 |
| CFTR-Intron10-4402 | + | UUUAAUUGCCAGUAAGUC | 18 | 23284 |
| CFTR-Intron10-4403 | + | AUUUAAUUGCCAGUAAGUC | 19 | 23285 |
| CFTR-Intron10-4404 | + | AAUUUAAUUGCCAGUAAGUC | 20 | 23286 |
| CFTR-Intron10-4405 | + | AAAUUUAAUUGCCAGUAAGUC | 21 | 23287 |
| CFTR-Intron10-4406 | + | GAAAUUUAAUUGCCAGUAAGUC | 22 | 23288 |
| CFTR-Intron10-4407 | + | UGAAAUUUAAUUGCCAGUAAGUC | 23 | 23289 |
| CFTR-Intron10-4408 | + | CUGAAAUUUAAUUGCCAGUAAGUC | 24 | 23290 |
| CFTR-Intron10-4409 | + | CCUUCCAGUUACUCAGUC | 18 | 23291 |
| CFTR-Intron10-4410 | + | UCCUUCCAGUUACUCAGUC | 19 | 23292 |
| CFTR-Intron10-4411 | + | AUCCUUCCAGUUACUCAGUC | 20 | 23293 |
| CFTR-Intron10-4412 | + | UAUCCUUCCAGUUACUCAGUC | 21 | 23294 |
| CFTR-Intron10-4413 | + | UUAUCCUUCCAGUUACUCAGUC | 22 | 23295 |
| CFTR-Intron10-4414 | + | UUUAUCCUUCCAGUUACUCAGUC | 23 | 23296 |
| CFTR-Intron10-4415 | + | AUUUAUCCUUCCAGUUACUCAGUC | 24 | 23297 |
| CFTR-Intron10-4416 | + | AUAAGCCAGCUUUCAGUC | 18 | 23298 |
| CFTR-Intron10-4417 | + | CAUAAGCCAGCUUUCAGUC | 19 | 23299 |
| CFTR-Intron10-4418 | + | CCAUAAGCCAGCUUUCAGUC | 20 | 23300 |
| CFTR-Intron10-4419 | + | GCCAUAAGCCAGCUUUCAGUC | 21 | 23301 |
| CFTR-Intron10-4420 | + | UGCCAUAAGCCAGCUUUCAGUC | 22 | 23302 |
| CFTR-Intron10-4421 | + | AUGCCAUAAGCCAGCUUUCAGUC | 23 | 23303 |
| CFTR-Intron10-4422 | + | GAUGCCAUAAGCCAGCUUUCAGUC | 24 | 23304 |
| CFTR-Intron10-4423 | + | CGGGCGGAUCACGAGGUC | 18 | 23305 |
| CFTR-Intron10-4424 | + | GCGGGCGGAUCACGAGGUC | 19 | 23306 |
| CFTR-Intron10-688 | + | GGCGGGCGGAUCACGAGGUC | 20 | 19574 |
| CFTR-Intron10-4425 | + | AGGCGGGCGGAUCACGAGGUC | 21 | 23307 |

TABLE 41E-continued

5th Tier

| gRNA Name | DNA Strand | Targeting Domain | Target Site Length | Seq ID |
|---|---|---|---|---|
| CFTR-Intron10-4426 | + | GAGGCGGGCGGAUCACGAGGUC | 22 | 23308 |
| CFTR-Intron10-4427 | + | CGAGGCGGGCGGAUCACGAGGUC | 23 | 23309 |
| CFTR-Intron10-4428 | + | CCGAGGCGGGCGGAUCACGAGGUC | 24 | 23310 |
| CFTR-Intron10-4429 | + | CAGGCAGAUCAUGAGGUC | 18 | 23311 |
| CFTR-Intron10-4430 | + | GCAGGCAGAUCAUGAGGUC | 19 | 23312 |
| CFTR-Intron10-4431 | + | GGCAGGCAGAUCAUGAGGUC | 20 | 23313 |
| CFTR-Intron10-4432 | + | AGGCAGGCAGAUCAUGAGGUC | 21 | 23314 |
| CFTR-Intron10-4433 | + | GAGGCAGGCAGAUCAUGAGGUC | 22 | 23315 |
| CFTR-Intron10-4434 | + | CGAGGCAGGCAGAUCAUGAGGUC | 23 | 23316 |
| CFTR-Intron10-4435 | + | CCGAGGCAGGCAGAUCAUGAGGUC | 24 | 23317 |
| CFTR-Intron10-4436 | + | GCUUCACUAAAAUAAUUC | 18 | 23318 |
| CFTR-Intron10-4437 | + | UGCUUCACUAAAAUAAUUC | 19 | 23319 |
| CFTR-Intron10-4438 | + | UUGCUUCACUAAAAUAAUUC | 20 | 23320 |
| CFTR-Intron10-4439 | + | AUUGCUUCACUAAAAUAAUUC | 21 | 23321 |
| CFTR-Intron10-4440 | + | UAUUGCUUCACUAAAAUAAUUC | 22 | 23322 |
| CFTR-Intron10-4441 | + | AUAUUGCUUCACUAAAAUAAUUC | 23 | 23323 |
| CFTR-Intron10-4442 | + | AAUAUUGCUUCACUAAAAUAAUUC | 24 | 23324 |
| CFTR-Intron10-4443 | + | GAUUAUUCGGUAUAAUUC | 18 | 23325 |
| CFTR-Intron10-4444 | + | AGAUUAUUCGGUAUAAUUC | 19 | 23326 |
| CFTR-Intron10-4445 | + | UAGAUUAUUCGGUAUAAUUC | 20 | 23327 |
| CFTR-Intron10-4446 | + | UUAGAUUAUUCGGUAUAAUUC | 21 | 23328 |
| CFTR-Intron10-4447 | + | CUUAGAUUAUUCGGUAUAAUUC | 22 | 23329 |
| CFTR-Intron10-4448 | + | UCUUAGAUUAUUCGGUAUAAUUC | 23 | 23330 |
| CFTR-Intron10-4449 | + | GUCUUAGAUUAUUCGGUAUAAUUC | 24 | 23331 |
| CFTR-Intron10-4450 | + | AAAUCUAAAAGCUAAUUC | 18 | 23332 |
| CFTR-Intron10-4451 | + | UAAAUCUAAAAGCUAAUUC | 19 | 23333 |
| CFTR-Intron10-4452 | + | GUAAAUCUAAAAGCUAAUUC | 20 | 23334 |
| CFTR-Intron10-4453 | + | AGUAAAUCUAAAAGCUAAUUC | 21 | 23335 |
| CFTR-Intron10-4454 | + | AAGUAAAUCUAAAAGCUAAUUC | 22 | 23336 |
| CFTR-Intron10-4455 | + | UAAGUAAAUCUAAAAGCUAAUUC | 23 | 23337 |
| CFTR-Intron10-4456 | + | AUAAGUAAAUCUAAAAGCUAAUUC | 24 | 23338 |
| CFTR-Intron10-4457 | + | AUAAUUUGAACAACAUUC | 18 | 23339 |
| CFTR-Intron10-4458 | + | AAUAAUUUGAACAACAUUC | 19 | 23340 |
| CFTR-Intron10-4459 | + | AAAUAAUUUGAACAACAUUC | 20 | 23341 |
| CFTR-Intron10-4460 | + | GAAAUAAUUUGAACAACAUUC | 21 | 23342 |
| CFTR-Intron10-4461 | + | AGAAAUAAUUUGAACAACAUUC | 22 | 23343 |
| CFTR-Intron10-4462 | + | UAGAAAUAAUUUGAACAACAUUC | 23 | 23344 |

TABLE 41E-continued

5th Tier

| gRNA Name | DNA Strand | Targeting Domain | Target Site Length | Seq ID |
|---|---|---|---|---|
| CFTR-Intron10-4463 | + | GUAGAAAUAAUUUGAACAACAUUC | 24 | 23345 |
| CFTR-Intron10-4464 | + | AUUUAAAAAGCAAUAUUC | 18 | 23346 |
| CFTR-Intron10-4465 | + | AAUUUAAAAAGCAAUAUUC | 19 | 23347 |
| CFTR-Intron10-4466 | + | AAAUUUAAAAAGCAAUAUUC | 20 | 23348 |
| CFTR-Intron10-4467 | + | UAAAUUUAAAAAGCAAUAUUC | 21 | 23349 |
| CFTR-Intron10-4468 | + | UUAAAUUUAAAAAGCAAUAUUC | 22 | 23350 |
| CFTR-Intron10-4469 | + | AUUAAAUUUAAAAAGCAAUAUUC | 23 | 23351 |
| CFTR-Intron10-4470 | + | UAUUAAAUUUAAAAAGCAAUAUUC | 24 | 23352 |
| CFTR-Intron10-4471 | + | ACACAAUGGGUUAUAUUC | 18 | 23353 |
| CFTR-Intron10-4472 | + | UACACAAUGGGUUAUAUUC | 19 | 23354 |
| CFTR-Intron10-4473 | + | CUACACAAUGGGUUAUAUUC | 20 | 23355 |
| CFTR-Intron10-4474 | + | UCUACACAAUGGGUUAUAUUC | 21 | 23356 |
| CFTR-Intron10-4475 | + | AUCUACACAAUGGGUUAUAUUC | 22 | 23357 |
| CFTR-Intron10-4476 | + | UAUCUACACAAUGGGUUAUAUUC | 23 | 23358 |
| CFTR-Intron10-4477 | + | UUAUCUACACAAUGGGUUAUAUUC | 24 | 23359 |
| CFTR-Intron10-4478 | + | AGUAUUUGAAAAGCUUC | 18 | 23360 |
| CFTR-Intron10-4479 | + | AAGUAUUUGAAAAGCUUC | 19 | 23361 |
| CFTR-Intron10-4480 | + | AAAGUAUUUGAAAAGCUUC | 20 | 23362 |
| CFTR-Intron10-4481 | + | GAAAGUAUUUGAAAAGCUUC | 21 | 23363 |
| CFTR-Intron10-4482 | + | AGAAAGUAUUUGAAAAGCUUC | 22 | 23364 |
| CFTR-Intron10-4483 | + | UAGAAAGUAUUUGAAAAGCUUC | 23 | 23365 |
| CFTR-Intron10-4484 | + | CUAGAAAGUAUUUGAAAAGCUUC | 24 | 23366 |
| CFTR-Intron10-4485 | + | AUUUAUUUCUCACAGUUC | 18 | 23367 |
| CFTR-Intron10-4486 | + | AAUUUAUUUCUCACAGUUC | 19 | 23368 |
| CFTR-Intron10-689 | + | GAAUUUAUUUCUCACAGUUC | 20 | 19575 |
| CFTR-Intron10-4487 | + | GGAAUUUAUUUCUCACAGUUC | 21 | 23369 |
| CFTR-Intron10-4488 | + | AGGAAUUUAUUUCUCACAGUUC | 22 | 23370 |
| CFTR-Intron10-4489 | + | CAGGAAUUUAUUUCUCACAGUUC | 23 | 23371 |
| CFTR-Intron10-4490 | + | ACAGGAAUUUAUUUCUCACAGUUC | 24 | 23372 |
| CFTR-Intron10-4491 | + | CGAAUUGGUACAAAUUUC | 18 | 23373 |
| CFTR-Intron10-4492 | + | ACGAAUUGGUACAAAUUUC | 19 | 23374 |
| CFTR-Intron10-443 | + | UACGAAUUGGUACAAAUUUC | 20 | 19329 |
| CFTR-Intron10-4493 | + | GUACGAAUUGGUACAAAUUUC | 21 | 23375 |
| CFTR-Intron10-4494 | + | AGUACGAAUUGGUACAAAUUUC | 22 | 23376 |
| CFTR-Intron10-4495 | + | GAGUACGAAUUGGUACAAAUUUC | 23 | 23377 |
| CFTR-Intron10-4496 | + | UGAGUACGAAUUGGUACAAAUUUC | 24 | 23378 |
| CFTR-Intron10-4497 | + | GAAAAUUUGUUUUCUUUC | 18 | 23379 |

TABLE 41E-continued

5th Tier

| gRNA Name | DNA Strand | Targeting Domain | Target Site Length | Seq ID |
|---|---|---|---|---|
| CFTR-Intron10-4498 | + | AGAAAAUUUGUUUUCUUUC | 19 | 23380 |
| CFTR-Intron10-1248 | + | AAGAAAAUUUGUUUUCUUUC | 20 | 20133 |
| CFTR-Intron10-4499 | + | AAAGAAAAUUUGUUUUCUUUC | 21 | 23381 |
| CFTR-Intron10-4500 | + | CAAAGAAAAUUUGUUUUCUUUC | 22 | 23382 |
| CFTR-Intron10-4501 | + | ACAAAGAAAAUUUGUUUUCUUUC | 23 | 23383 |
| CFTR-Intron10-4502 | + | AACAAAGAAAAUUUGUUUUCUUUC | 24 | 23384 |
| CFTR-Intron10-4503 | + | UCAAAGCUACAGAUUUUC | 18 | 23385 |
| CFTR-Intron10-4504 | + | AUCAAAGCUACAGAUUUUC | 19 | 23386 |
| CFTR-Intron10-4505 | + | AAUCAAAGCUACAGAUUUUC | 20 | 23387 |
| CFTR-Intron10-4506 | + | AAAUCAAAGCUACAGAUUUUC | 21 | 23388 |
| CFTR-Intron10-4507 | + | UAAAUCAAAGCUACAGAUUUUC | 22 | 23389 |
| CFTR-Intron10-4508 | + | AUAAAUCAAAGCUACAGAUUUUC | 23 | 23390 |
| CFTR-Intron10-4509 | + | UAUAAAUCAAAGCUACAGAUUUUC | 24 | 23391 |
| CFTR-Intron10-4510 | + | UUGCUUUAUUAAGAAAAG | 18 | 23392 |
| CFTR-Intron10-4511 | + | AUUGCUUUAUUAAGAAAAG | 19 | 23393 |
| CFTR-Intron10-4512 | + | GAUUGCUUUAUUAAGAAAAG | 20 | 23394 |
| CFTR-Intron10-4513 | + | UGAUUGCUUUAUUAAGAAAAG | 21 | 23395 |
| CFTR-Intron10-4514 | + | CUGAUUGCUUUAUUAAGAAAAG | 22 | 23396 |
| CFTR-Intron10-4515 | + | GCUGAUUGCUUUAUUAAGAAAAG | 23 | 23397 |
| CFTR-Intron10-4516 | + | UGCUGAUUGCUUUAUUAAGAAAAG | 24 | 23398 |
| CFTR-Intron10-4517 | + | GGAUAUCUUAGGUCAAAG | 18 | 23399 |
| CFTR-Intron10-4518 | + | AGGAUAUCUUAGGUCAAAG | 19 | 23400 |
| CFTR-Intron10-447 | + | UAGGAUAUCUUAGGUCAAAG | 20 | 19333 |
| CFTR-Intron10-4519 | + | UUAGGAUAUCUUAGGUCAAAG | 21 | 23401 |
| CFTR-Intron10-4520 | + | CUUAGGAUAUCUUAGGUCAAAG | 22 | 23402 |
| CFTR-Intron10-4521 | + | CCUUAGGAUAUCUUAGGUCAAAG | 23 | 23403 |
| CFTR-Intron10-4522 | + | CCCUUAGGAUAUCUUAGGUCAAAG | 24 | 23404 |
| CFTR-Intron10-4523 | + | UGUUAAUGGCAAAGCAAG | 18 | 23405 |
| CFTR-Intron10-4524 | + | CUGUUAAUGGCAAAGCAAG | 19 | 23406 |
| CFTR-Intron10-4525 | + | UCUGUUAAUGGCAAAGCAAG | 20 | 23407 |
| CFTR-Intron10-4526 | + | AUCUGUUAAUGGCAAAGCAAG | 21 | 23408 |
| CFTR-Intron10-4527 | + | UAUCUGUUAAUGGCAAAGCAAG | 22 | 23409 |
| CFTR-Intron10-4528 | + | UUAUCUGUUAAUGGCAAAGCAAG | 23 | 23410 |
| CFTR-Intron10-4529 | + | UUUAUCUGUUAAUGGCAAAGCAAG | 24 | 23411 |
| CFTR-Intron10-4530 | + | UUGGGUAAGUUAUAGAAG | 18 | 23412 |
| CFTR-Intron10-4531 | + | UUUGGGUAAGUUAUAGAAG | 19 | 23413 |
| CFTR-Intron10-4532 | + | AUUUGGGUAAGUUAUAGAAG | 20 | 23414 |

TABLE 41E-continued

5th Tier

| gRNA Name | DNA Strand | Targeting Domain | Target Site Length | Seq ID |
|---|---|---|---|---|
| CFTR-Intron10-4533 | + | UAUUUGGGUAAGUUAUAGAAG | 21 | 23415 |
| CFTR-Intron10-4534 | + | AUAUUUGGGUAAGUUAUAGAAG | 22 | 23416 |
| CFTR-Intron10-4535 | + | CAUAUUUGGGUAAGUUAUAGAAG | 23 | 23417 |
| CFTR-Intron10-4536 | + | ACAUAUUUGGGUAAGUUAUAGAAG | 24 | 23418 |
| CFTR-Intron10-4537 | + | CACUUUGGGAGGCUGAAG | 18 | 23419 |
| CFTR-Intron10-4538 | + | GCACUUUGGGAGGCUGAAG | 19 | 23420 |
| CFTR-Intron10-1252 | + | AGCACUUUGGGAGGCUGAAG | 20 | 20137 |
| CFTR-Intron10-4539 | + | CAGCACUUUGGGAGGCUGAAG | 21 | 23421 |
| CFTR-Intron10-4540 | + | CCAGCACUUUGGGAGGCUGAAG | 22 | 23422 |
| CFTR-Intron10-4541 | + | CCCAGCACUUUGGGAGGCUGAAG | 23 | 23423 |
| CFTR-Intron10-4542 | + | ACCCAGCACUUUGGGAGGCUGAAG | 24 | 23424 |
| CFTR-Intron10-4543 | + | UACUAUUUCCCUAUAAG | 18 | 23425 |
| CFTR-Intron10-4544 | + | AUACUAUUUCCCUAUAAG | 19 | 23426 |
| CFTR-Intron10-4545 | + | CAUACUAUUUCCCUAUAAG | 20 | 23427 |
| CFTR-Intron10-4546 | + | ACAUACUAUUUCCCUAUAAG | 21 | 23428 |
| CFTR-Intron10-4547 | + | GACAUACUAUUUCCCUAUAAG | 22 | 23429 |
| CFTR-Intron10-4548 | + | UGACAUACUAUUUCCCUAUAAG | 23 | 23430 |
| CFTR-Intron10-4549 | + | UUGACAUACUAUUUCCCUAUAAG | 24 | 23431 |
| CFTR-Intron10-4550 | + | AUUCCUCCUGUGUAUAAG | 18 | 23432 |
| CFTR-Intron10-4551 | + | AAUUCCUCCUGUGUAUAAG | 19 | 23433 |
| CFTR-Intron10-4552 | + | AAAUUCCUCCUGUGUAUAAG | 20 | 23434 |
| CFTR-Intron10-4553 | + | GAAAUUCCUCCUGUGUAUAAG | 21 | 23435 |
| CFTR-Intron10-4554 | + | AGAAAUUCCUCCUGUGUAUAAG | 22 | 23436 |
| CFTR-Intron10-4555 | + | GAGAAAUUCCUCCUGUGUAUAAG | 23 | 23437 |
| CFTR-Intron10-4556 | + | AGAGAAAUUCCUCCUGUGUAUAAG | 24 | 23438 |
| CFTR-Intron10-4557 | + | CUUAACCCAUCUAUUAAG | 18 | 23439 |
| CFTR-Intron10-4558 | + | GCUUAACCCAUCUAUUAAG | 19 | 23440 |
| CFTR-Intron10-97 | + | GGCUUAACCCAUCUAUUAAG | 20 | 18983 |
| CFTR-Intron10-4559 | + | UGGCUUAACCCAUCUAUUAAG | 21 | 23441 |
| CFTR-Intron10-4560 | + | UUGGCUUAACCCAUCUAUUAAG | 22 | 23442 |
| CFTR-Intron10-4561 | + | GUUGGCUUAACCCAUCUAUUAAG | 23 | 23443 |
| CFTR-Intron10-4562 | + | AGUUGGCUUAACCCAUCUAUUAAG | 24 | 23444 |
| CFTR-Intron10-4563 | + | CUGUGAUGCAGACAACAG | 18 | 23445 |
| CFTR-Intron10-4564 | + | GCUGUGAUGCAGACAACAG | 19 | 23446 |
| CFTR-Intron10-4565 | + | AGCUGUGAUGCAGACAACAG | 20 | 23447 |
| CFTR-Intron10-4566 | + | CAGCUGUGAUGCAGACAACAG | 21 | 23448 |
| CFTR-Intron10-4567 | + | UCAGCUGUGAUGCAGACAACAG | 22 | 23449 |

TABLE 41E-continued

5th Tier

| gRNA Name | DNA Strand | Targeting Domain | Target Site Length | Seq ID |
|---|---|---|---|---|
| CFTR-Intron10-4568 | + | UUCAGCUGUGAUGCAGACAACAG | 23 | 23450 |
| CFTR-Intron10-4569 | + | CUUCAGCUGUGAUGCAGACAACAG | 24 | 23451 |
| CFTR-Intron10-4570 | + | AGAAUGGAAAAUGGACAG | 18 | 23452 |
| CFTR-Intron10-4571 | + | GAGAAUGGAAAAUGGACAG | 19 | 23453 |
| CFTR-Intron10-4572 | + | GGAGAAUGGAAAAUGGACAG | 20 | 23454 |
| CFTR-Intron10-4573 | + | AGGAGAAUGGAAAAUGGACAG | 21 | 23455 |
| CFTR-Intron10-4574 | + | CAGGAGAAUGGAAAAUGGACAG | 22 | 23456 |
| CFTR-Intron10-4575 | + | GCAGGAGAAUGGAAAAUGGACAG | 23 | 23457 |
| CFTR-Intron10-4576 | + | UGCAGGAGAAUGGAAAAUGGACAG | 24 | 23458 |
| CFTR-Intron10-4577 | + | AGCUAAAGUAUUACCCAG | 18 | 23459 |
| CFTR-Intron10-4578 | + | CAGCUAAAGUAUUACCCAG | 19 | 23460 |
| CFTR-Intron10-451 | + | ACAGCUAAAGUAUUACCCAG | 20 | 19337 |
| CFTR-Intron10-4579 | + | UACAGCUAAAGUAUUACCCAG | 21 | 23461 |
| CFTR-Intron10-4580 | + | AUACAGCUAAAGUAUUACCCAG | 22 | 23462 |
| CFTR-Intron10-4581 | + | UAUACAGCUAAAGUAUUACCCAG | 23 | 23463 |
| CFTR-Intron10-4582 | + | AUAUACAGCUAAAGUAUUACCCAG | 24 | 23464 |
| CFTR-Intron10-4583 | + | GAUAAAAAUUCCAAGCAG | 18 | 23465 |
| CFTR-Intron10-4584 | + | UGAUAAAAAUUCCAAGCAG | 19 | 23466 |
| CFTR-Intron10-4585 | + | AUGAUAAAAAUUCCAAGCAG | 20 | 23467 |
| CFTR-Intron10-4586 | + | AAUGAUAAAAAUUCCAAGCAG | 21 | 23468 |
| CFTR-Intron10-4587 | + | AAAUGAUAAAAAUUCCAAGCAG | 22 | 23469 |
| CFTR-Intron10-4588 | + | AAAAUGAUAAAAAUUCCAAGCAG | 23 | 23470 |
| CFTR-Intron10-4589 | + | AAAAAUGAUAAAAAUUCCAAGCAG | 24 | 23471 |
| CFTR-Intron10-4590 | + | AAGGAAAGGAGGUAGCAG | 18 | 23472 |
| CFTR-Intron10-4591 | + | GAAGGAAAGGAGGUAGCAG | 19 | 23473 |
| CFTR-Intron10-1260 | + | AGAAGGAAAGGAGGUAGCAG | 20 | 20145 |
| CFTR-Intron10-4592 | + | UAGAAGGAAAGGAGGUAGCAG | 21 | 23474 |
| CFTR-Intron10-4593 | + | GUAGAAGGAAAGGAGGUAGCAG | 22 | 23475 |
| CFTR-Intron10-4594 | + | AGUAGAAGGAAAGGAGGUAGCAG | 23 | 23476 |
| CFTR-Intron10-4595 | + | GAGUAGAAGGAAAGGAGGUAGCAG | 24 | 23477 |
| CFTR-Intron10-4596 | + | UCAACAUAUGAAUGGCAG | 18 | 23478 |
| CFTR-Intron10-4597 | + | UUCAACAUAUGAAUGGCAG | 19 | 23479 |
| CFTR-Intron10-1263 | + | UUUCAACAUAUGAAUGGCAG | 20 | 20148 |
| CFTR-Intron10-4598 | + | AUUUCAACAUAUGAAUGGCAG | 21 | 23480 |
| CFTR-Intron10-4599 | + | GAUUUCAACAUAUGAAUGGCAG | 22 | 23481 |
| CFTR-Intron10-4600 | + | GGAUUUCAACAUAUGAAUGGCAG | 23 | 23482 |
| CFTR-Intron10-4601 | + | AGGAUUUCAACAUAUGAAUGGCAG | 24 | 23483 |

TABLE 41E-continued

5th Tier

| gRNA Name | DNA Strand | Targeting Domain | Target Site Length | Seq ID |
|---|---|---|---|---|
| CFTR-Intron10-4602 | + | CUAUUUAAACAGAAUCAG | 18 | 23484 |
| CFTR-Intron10-4603 | + | GCUAUUUAAACAGAAUCAG | 19 | 23485 |
| CFTR-Intron10-453 | + | UGCUAUUUAAACAGAAUCAG | 20 | 19339 |
| CFTR-Intron10-4604 | + | GUGCUAUUUAAACAGAAUCAG | 21 | 23486 |
| CFTR-Intron10-4605 | + | AGUGCUAUUUAAACAGAAUCAG | 22 | 23487 |
| CFTR-Intron10-4606 | + | CAGUGCUAUUUAAACAGAAUCAG | 23 | 23488 |
| CFTR-Intron10-4607 | + | CCAGUGCUAUUUAAACAGAAUCAG | 24 | 23489 |
| CFTR-Intron10-4608 | + | CAUAAUAAGACAGCUCAG | 18 | 23490 |
| CFTR-Intron10-4609 | + | ACAUAAUAAGACAGCUCAG | 19 | 23491 |
| CFTR-Intron10-4610 | + | AACAUAAUAAGACAGCUCAG | 20 | 23492 |
| CFTR-Intron10-4611 | + | AAACAUAAUAAGACAGCUCAG | 21 | 23493 |
| CFTR-Intron10-4612 | + | AAAACAUAAUAAGACAGCUCAG | 22 | 23494 |
| CFTR-Intron10-4613 | + | CAAAACAUAAUAAGACAGCUCAG | 23 | 23495 |
| CFTR-Intron10-4614 | + | ACAAAACAUAAUAAGACAGCUCAG | 24 | 23496 |
| CFTR-Intron10-4615 | + | AAGAGGAAAAGACUUCAG | 18 | 23497 |
| CFTR-Intron10-4616 | + | UAAGAGGAAAAGACUUCAG | 19 | 23498 |
| CFTR-Intron10-4617 | + | UUAAGAGGAAAAGACUUCAG | 20 | 23499 |
| CFTR-Intron10-4618 | + | AUUAAGAGGAAAAGACUUCAG | 21 | 23500 |
| CFTR-Intron10-4619 | + | UAUUAAGAGGAAAAGACUUCAG | 22 | 23501 |
| CFTR-Intron10-4620 | + | CUAUUAAGAGGAAAAGACUUCAG | 23 | 23502 |
| CFTR-Intron10-4621 | + | UCUAUUAAGAGGAAAAGACUUCAG | 24 | 23503 |
| CFTR-Intron10-4622 | + | UGUUACAUAAAAAGAGAG | 18 | 23504 |
| CFTR-Intron10-4623 | + | UUGUUACAUAAAAAGAGAG | 19 | 23505 |
| CFTR-Intron10-4624 | + | AUUGUUACAUAAAAAGAGAG | 20 | 23506 |
| CFTR-Intron10-4625 | + | UAUUGUUACAUAAAAAGAGAG | 21 | 23507 |
| CFTR-Intron10-4626 | + | AUAUUGUUACAUAAAAAGAGAG | 22 | 23508 |
| CFTR-Intron10-4627 | + | CAUAUUGUUACAUAAAAAGAGAG | 23 | 23509 |
| CFTR-Intron10-4628 | + | GCAUAUUGUUACAUAAAAAGAGAG | 24 | 23510 |
| CFTR-Intron10-4629 | + | UUUGUAUUUUUAGUAGAG | 18 | 23511 |
| CFTR-Intron10-4630 | + | UUUUGUAUUUUUAGUAGAG | 19 | 23512 |
| CFTR-Intron10-4631 | + | UUUUUGUAUUUUUAGUAGAG | 20 | 23513 |
| CFTR-Intron10-4632 | + | UUUUUUGUAUUUUUAGUAGAG | 21 | 23514 |
| CFTR-Intron10-4633 | + | AUUUUUUGUAUUUUUAGUAGAG | 22 | 23515 |
| CFTR-Intron10-4634 | + | AAUUUUUUGUAUUUUUAGUAGAG | 23 | 23516 |
| CFTR-Intron10-4635 | + | UAAUUUUUUGUAUUUUUAGUAGAG | 24 | 23517 |
| CFTR-Intron10-4636 | + | UUUGUGUUUUUUGUAGAG | 18 | 23518 |
| CFTR-Intron10-4637 | + | GUUUGUGUUUUUUGUAGAG | 19 | 23519 |

TABLE 41E-continued

5th Tier

| gRNA Name | DNA Strand | Targeting Domain | Target Site Length | Seq ID |
|---|---|---|---|---|
| CFTR-Intron10-4638 | + | UGUUUGUGUUUUUUGUAGAG | 20 | 23520 |
| CFTR-Intron10-4639 | + | UUGUUUGUGUUUUUUGUAGAG | 21 | 23521 |
| CFTR-Intron10-4640 | + | UUUGUUUGUGUUUUUUGUAGAG | 22 | 23522 |
| CFTR-Intron10-4641 | + | UUUUGUUUGUGUUUUUUGUAGAG | 23 | 23523 |
| CFTR-Intron10-4642 | + | CUUUUGUUUGUGUUUUUUGUAGAG | 24 | 23524 |
| CFTR-Intron10-4643 | + | GCACUUUGGGAGGCCGAG | 18 | 23525 |
| CFTR-Intron10-4644 | + | AGCACUUUGGGAGGCCGAG | 19 | 23526 |
| CFTR-Intron10-4645 | + | CAGCACUUUGGGAGGCCGAG | 20 | 23527 |
| CFTR-Intron10-4646 | + | CCAGCACUUUGGGAGGCCGAG | 21 | 23528 |
| CFTR-Intron10-4647 | + | CCCAGCACUUUGGGAGGCCGAG | 22 | 23529 |
| CFTR-Intron10-4648 | + | UCCCAGCACUUUGGGAGGCCGAG | 23 | 23530 |
| CFTR-Intron10-4649 | + | AUCCCAGCACUUUGGGAGGCCGAG | 24 | 23531 |
| CFTR-Intron10-4650 | + | CUAAUGGCAGAAUUCGAG | 18 | 23532 |
| CFTR-Intron10-4651 | + | ACUAAUGGCAGAAUUCGAG | 19 | 23533 |
| CFTR-Intron10-4652 | + | AACUAAUGGCAGAAUUCGAG | 20 | 23534 |
| CFTR-Intron10-4653 | + | AAACUAAUGGCAGAAUUCGAG | 21 | 23535 |
| CFTR-Intron10-4654 | + | AAAACUAAUGGCAGAAUUCGAG | 22 | 23536 |
| CFTR-Intron10-4655 | + | UAAAACUAAUGGCAGAAUUCGAG | 23 | 23537 |
| CFTR-Intron10-4656 | + | UUAAAACUAAUGGCAGAAUUCGAG | 24 | 23538 |
| CFTR-Intron10-4657 | + | AUGGCGUGAACCCGGGAG | 18 | 23539 |
| CFTR-Intron10-4658 | + | AAUGGCGUGAACCCGGGAG | 19 | 23540 |
| CFTR-Intron10-4659 | + | GAAUGGCGUGAACCCGGGAG | 20 | 23541 |
| CFTR-Intron10-4660 | + | AGAAUGGCGUGAACCCGGGAG | 21 | 23542 |
| CFTR-Intron10-4661 | + | GAGAAUGGCGUGAACCCGGGAG | 22 | 23543 |
| CFTR-Intron10-4662 | + | GGAGAAUGGCGUGAACCCGGGAG | 23 | 23544 |
| CFTR-Intron10-4663 | + | AGGAGAAUGGCGUGAACCCGGGAG | 24 | 23545 |
| CFTR-Intron10-4664 | + | UUAGGGUGGGAUAUGGAG | 18 | 23546 |
| CFTR-Intron10-4665 | + | CUUAGGGUGGGAUAUGGAG | 19 | 23547 |
| CFTR-Intron10-4666 | + | UCUUAGGGUGGGAUAUGGAG | 20 | 23548 |
| CFTR-Intron10-4667 | + | UUCUUAGGGUGGGAUAUGGAG | 21 | 23549 |
| CFTR-Intron10-4668 | + | GUUCUUAGGGUGGGAUAUGGAG | 22 | 23550 |
| CFTR-Intron10-4669 | + | UGUUCUUAGGGUGGGAUAUGGAG | 23 | 23551 |
| CFTR-Intron10-4670 | + | UUGUUCUUAGGGUGGGAUAUGGAG | 24 | 23552 |
| CFTR-Intron10-4671 | + | CUACUGACUAAAACUGAG | 18 | 23553 |
| CFTR-Intron10-4672 | + | ACUACUGACUAAAACUGAG | 19 | 23554 |
| CFTR-Intron10-4673 | + | UACUACUGACUAAAACUGAG | 20 | 23555 |
| CFTR-Intron10-4674 | + | AUACUACUGACUAAAACUGAG | 21 | 23556 |

TABLE 41E-continued

5th Tier

| gRNA Name | DNA Strand | Targeting Domain | Target Site Length | Seq ID |
|---|---|---|---|---|
| CFTR-Intron10-4675 | + | AAUACUACUGACUAAAACUGAG | 22 | 23557 |
| CFTR-Intron10-4676 | + | UAAUACUACUGACUAAAACUGAG | 23 | 23558 |
| CFTR-Intron10-4677 | + | AUAAUACUACUGACUAAAACUGAG | 24 | 23559 |
| CFTR-Intron10-4678 | + | GGCGGAGCUUGCAGUGAG | 18 | 23560 |
| CFTR-Intron10-4679 | + | AGGCGGAGCUUGCAGUGAG | 19 | 23561 |
| CFTR-Intron10-4680 | + | GAGGCGGAGCUUGCAGUGAG | 20 | 23562 |
| CFTR-Intron10-4681 | + | GGAGGCGGAGCUUGCAGUGAG | 21 | 23563 |
| CFTR-Intron10-4682 | + | GGGAGGCGGAGCUUGCAGUGAG | 22 | 23564 |
| CFTR-Intron10-4683 | + | CGGGAGGCGGAGCUUGCAGUGAG | 23 | 23565 |
| CFTR-Intron10-4684 | + | CCGGGAGGCGGAGCUUGCAGUGAG | 24 | 23566 |
| CFTR-Intron10-4685 | + | GGCAGAGGUUGCAGUGAG | 18 | 23567 |
| CFTR-Intron10-4686 | + | AGGCAGAGGUUGCAGUGAG | 19 | 23568 |
| CFTR-Intron10-4687 | + | GAGGCAGAGGUUGCAGUGAG | 20 | 23569 |
| CFTR-Intron10-4688 | + | GGAGGCAGAGGUUGCAGUGAG | 21 | 23570 |
| CFTR-Intron10-4689 | + | GGGAGGCAGAGGUUGCAGUGAG | 22 | 23571 |
| CFTR-Intron10-4690 | + | CGGGAGGCAGAGGUUGCAGUGAG | 23 | 23572 |
| CFTR-Intron10-4691 | + | CCGGGAGGCAGAGGUUGCAGUGAG | 24 | 23573 |
| CFTR-Intron10-4692 | + | GACACCAAAUUUAUUGAG | 18 | 23574 |
| CFTR-Intron10-4693 | + | UGACACCAAAUUUAUUGAG | 19 | 23575 |
| CFTR-Intron10-457 | + | CUGACACCAAAUUUAUUGAG | 20 | 19343 |
| CFTR-Intron10-4694 | + | CCUGACACCAAAUUUAUUGAG | 21 | 23576 |
| CFTR-Intron10-4695 | + | GCCUGACACCAAAUUUAUUGAG | 22 | 23577 |
| CFTR-Intron10-4696 | + | AGCCUGACACCAAAUUUAUUGAG | 23 | 23578 |
| CFTR-Intron10-4697 | + | CAGCCUGACACCAAAUUUAUUGAG | 24 | 23579 |
| CFTR-Intron10-4698 | + | UAAUAGCCUAUUGUUGAG | 18 | 23580 |
| CFTR-Intron10-4699 | + | CUAAUAGCCUAUUGUUGAG | 19 | 23581 |
| CFTR-Intron10-1271 | + | ACUAAUAGCCUAUUGUUGAG | 20 | 20156 |
| CFTR-Intron10-4700 | + | UACUAAUAGCCUAUUGUUGAG | 21 | 23582 |
| CFTR-Intron10-4701 | + | CUACUAAUAGCCUAUUGUUGAG | 22 | 23583 |
| CFTR-Intron10-4702 | + | ACUACUAAUAGCCUAUUGUUGAG | 23 | 23584 |
| CFTR-Intron10-4703 | + | AACUACUAAUAGCCUAUUGUUGAG | 24 | 23585 |
| CFTR-Intron10-4704 | + | CUAGAUGAUUAUUAAUAG | 18 | 23586 |
| CFTR-Intron10-4705 | + | CCUAGAUGAUUAUUAAUAG | 19 | 23587 |
| CFTR-Intron10-100 | + | GCCUAGAUGAUUAUUAAUAG | 20 | 18986 |
| CFTR-Intron10-4706 | + | AGCCUAGAUGAUUAUUAAUAG | 21 | 23588 |
| CFTR-Intron10-4707 | + | CAGCCUAGAUGAUUAUUAAUAG | 22 | 23589 |
| CFTR-Intron10-4708 | + | GCAGCCUAGAUGAUUAUUAAUAG | 23 | 23590 |

TABLE 41E-continued

| | | 5th Tier | | |
|---|---|---|---|---|
| gRNA Name | DNA Strand | Targeting Domain | Target Site Length | Seq ID |
| CFTR-Intron10-4709 | + | UGCAGCCUAGAUGAUUAUUAAUAG | 24 | 23591 |
| CFTR-Intron10-4710 | + | GAAAGUUGUCCAAGAUAG | 18 | 23592 |
| CFTR-Intron10-4711 | + | GGAAAGUUGUCCAAGAUAG | 19 | 23593 |
| CFTR-Intron10-459 | + | UGGAAAGUUGUCCAAGAUAG | 20 | 19345 |
| CFTR-Intron10-4712 | + | AUGGAAAGUUGUCCAAGAUAG | 21 | 23594 |
| CFTR-Intron10-4713 | + | UAUGGAAAGUUGUCCAAGAUAG | 22 | 23595 |
| CFTR-Intron10-4714 | + | AUAUGGAAAGUUGUCCAAGAUAG | 23 | 23596 |
| CFTR-Intron10-4715 | + | AAUAUGGAAAGUUGUCCAAGAUAG | 24 | 23597 |
| CFTR-Intron10-4716 | + | CCUCAGCCUCCCAAGUAG | 18 | 23598 |
| CFTR-Intron10-4717 | + | ACCUCAGCCUCCCAAGUAG | 19 | 23599 |
| CFTR-Intron10-4718 | + | CACCUCAGCCUCCCAAGUAG | 20 | 23600 |
| CFTR-Intron10-4719 | + | CCACCUCAGCCUCCCAAGUAG | 21 | 23601 |
| CFTR-Intron10-4720 | + | CCCACCUCAGCCUCCCAAGUAG | 22 | 23602 |
| CFTR-Intron10-4721 | + | UCCCACCUCAGCCUCCCAAGUAG | 23 | 23603 |
| CFTR-Intron10-4722 | + | CUCCCACCUCAGCCUCCCAAGUAG | 24 | 23604 |
| CFTR-Intron10-4723 | + | GGUAAGUUAUAGAAGUAG | 18 | 23605 |
| CFTR-Intron10-4724 | + | GGGUAAGUUAUAGAAGUAG | 19 | 23606 |
| CFTR-Intron10-4725 | + | UGGGUAAGUUAUAGAAGUAG | 20 | 23607 |
| CFTR-Intron10-4726 | + | UUGGGUAAGUUAUAGAAGUAG | 21 | 23608 |
| CFTR-Intron10-4727 | + | UUUGGGUAAGUUAUAGAAGUAG | 22 | 23609 |
| CFTR-Intron10-4728 | + | AUUUGGGUAAGUUAUAGAAGUAG | 23 | 23610 |
| CFTR-Intron10-4729 | + | UAUUUGGGUAAGUUAUAGAAGUAG | 24 | 23611 |
| CFTR-Intron10-4730 | + | CCUCAGCCUCCCGAGUAG | 18 | 23612 |
| CFTR-Intron10-4731 | + | GCCUCAGCCUCCCGAGUAG | 19 | 23613 |
| CFTR-Intron10-4732 | + | UGCCUCAGCCUCCCGAGUAG | 20 | 23614 |
| CFTR-Intron10-4733 | + | CUGCCUCAGCCUCCCGAGUAG | 21 | 23615 |
| CFTR-Intron10-4734 | + | CCUGCCUCAGCCUCCCGAGUAG | 22 | 23616 |
| CFTR-Intron10-4735 | + | UCCUGCCUCAGCCUCCCGAGUAG | 23 | 23617 |
| CFTR-Intron10-4736 | + | CUCCUGCCUCAGCCUCCCGAGUAG | 24 | 23618 |
| CFTR-Intron10-4737 | + | CUGACUAAAACUGAGUAG | 18 | 23619 |
| CFTR-Intron10-4738 | + | ACUGACUAAAACUGAGUAG | 19 | 23620 |
| CFTR-Intron10-4739 | + | UACUGACUAAAACUGAGUAG | 20 | 23621 |
| CFTR-Intron10-4740 | + | CUACUGACUAAAACUGAGUAG | 21 | 23622 |
| CFTR-Intron10-4741 | + | ACUACUGACUAAAACUGAGUAG | 22 | 23623 |
| CFTR-Intron10-4742 | + | UACUACUGACUAAAACUGAGUAG | 23 | 23624 |
| CFTR-Intron10-4743 | + | AUACUACUGACUAAAACUGAGUAG | 24 | 23625 |
| CFTR-Intron10-4744 | + | UAGAAGGAAAGGAGGUAG | 18 | 23626 |

TABLE 41E-continued

5th Tier

| gRNA Name | DNA Strand | Targeting Domain | Target Site Length | Seq ID |
|---|---|---|---|---|
| CFTR-Intron10-4745 | + | GUAGAAGGAAAGGAGGUAG | 19 | 23627 |
| CFTR-Intron10-4746 | + | AGUAGAAGGAAAGGAGGUAG | 20 | 23628 |
| CFTR-Intron10-4747 | + | GAGUAGAAGGAAAGGAGGUAG | 21 | 23629 |
| CFTR-Intron10-4748 | + | UGAGUAGAAGGAAAGGAGGUAG | 22 | 23630 |
| CFTR-Intron10-4749 | + | CUGAGUAGAAGGAAAGGAGGUAG | 23 | 23631 |
| CFTR-Intron10-4750 | + | ACUGAGUAGAAGGAAAGGAGGUAG | 24 | 23632 |
| CFTR-Intron10-4751 | + | AGGGAGAAAUGUAUGUAG | 18 | 23633 |
| CFTR-Intron10-4752 | + | CAGGGAGAAAUGUAUGUAG | 19 | 23634 |
| CFTR-Intron10-4753 | + | ACAGGGAGAAAUGUAUGUAG | 20 | 23635 |
| CFTR-Intron10-4754 | + | AACAGGGAGAAAUGUAUGUAG | 21 | 23636 |
| CFTR-Intron10-4755 | + | UAACAGGGAGAAAUGUAUGUAG | 22 | 23637 |
| CFTR-Intron10-4756 | + | AUAACAGGGAGAAAUGUAUGUAG | 23 | 23638 |
| CFTR-Intron10-4757 | + | AAUAACAGGGAGAAAUGUAUGUAG | 24 | 23639 |
| CFTR-Intron10-4758 | + | AAAAAUACAAAAAAUUAG | 18 | 23640 |
| CFTR-Intron10-4759 | + | UAAAAAUACAAAAAAUUAG | 19 | 23641 |
| CFTR-Intron10-4760 | + | CUAAAAAUACAAAAAAUUAG | 20 | 23642 |
| CFTR-Intron10-4761 | + | ACUAAAAAUACAAAAAAUUAG | 21 | 23643 |
| CFTR-Intron10-4762 | + | UACUAAAAAUACAAAAAAUUAG | 22 | 23644 |
| CFTR-Intron10-4763 | + | CUACUAAAAAUACAAAAAAUUAG | 23 | 23645 |
| CFTR-Intron10-4764 | + | UCUACUAAAAAUACAAAAAAUUAG | 24 | 23646 |
| CFTR-Intron10-4765 | + | AAGCUUGUUUGGUUUUAG | 18 | 23647 |
| CFTR-Intron10-4766 | + | AAAGCUUGUUUGGUUUUAG | 19 | 23648 |
| CFTR-Intron10-4767 | + | GAAAGCUUGUUUGGUUUUAG | 20 | 23649 |
| CFTR-Intron10-4768 | + | GGAAAGCUUGUUUGGUUUUAG | 21 | 23650 |
| CFTR-Intron10-4769 | + | UGGAAAGCUUGUUUGGUUUUAG | 22 | 23651 |
| CFTR-Intron10-4770 | + | AUGGAAAGCUUGUUUGGUUUUAG | 23 | 23652 |
| CFTR-Intron10-4771 | + | CAUGGAAAGCUUGUUUGGUUUUAG | 24 | 23653 |
| CFTR-Intron10-4772 | + | AAUUUUUUGUAUUUUUAG | 18 | 23654 |
| CFTR-Intron10-4773 | + | UAAUUUUUUGUAUUUUUAG | 19 | 23655 |
| CFTR-Intron10-4774 | + | CUAAUUUUUUGUAUUUUUAG | 20 | 23656 |
| CFTR-Intron10-4775 | + | GCUAAUUUUUUGUAUUUUUAG | 21 | 23657 |
| CFTR-Intron10-4776 | + | GGCUAAUUUUUUGUAUUUUUAG | 22 | 23658 |
| CFTR-Intron10-4777 | + | UGGCUAAUUUUUUGUAUUUUUAG | 23 | 23659 |
| CFTR-Intron10-4778 | + | CUGGCUAAUUUUUUGUAUUUUUAG | 24 | 23660 |
| CFTR-Intron10-4779 | + | ACCAUCCCGGCUAAAACG | 18 | 23661 |
| CFTR-Intron10-4780 | + | GACCAUCCCGGCUAAAACG | 19 | 23662 |
| CFTR-Intron10-4781 | + | AGACCAUCCCGGCUAAAACG | 20 | 23663 |

TABLE 41E-continued

5th Tier

| gRNA Name | DNA Strand | Targeting Domain | Target Site Length | Seq ID |
|---|---|---|---|---|
| CFTR-Intron10-4782 | + | GAGACCAUCCCGGCUAAAACG | 21 | 23664 |
| CFTR-Intron10-4783 | + | CGAGACCAUCCCGGCUAAAACG | 22 | 23665 |
| CFTR-Intron10-4784 | + | UCGAGACCAUCCCGGCUAAAACG | 23 | 23666 |
| CFTR-Intron10-4785 | + | AUCGAGACCAUCCCGGCUAAAACG | 24 | 23667 |
| CFTR-Intron10-4786 | + | AAAAACAACAAAAAGCG | 18 | 23668 |
| CFTR-Intron10-4787 | + | GAAAAACAACAAAAAGCG | 19 | 23669 |
| CFTR-Intron10-4788 | + | AGAAAAACAACAAAAAGCG | 20 | 23670 |
| CFTR-Intron10-4789 | + | UAGAAAAACAACAAAAAGCG | 21 | 23671 |
| CFTR-Intron10-4790 | + | CUAGAAAAACAACAAAAAGCG | 22 | 23672 |
| CFTR-Intron10-4791 | + | ACUAGAAAAACAACAAAAAGCG | 23 | 23673 |
| CFTR-Intron10-4792 | + | AACUAGAAAAACAACAAAAAGCG | 24 | 23674 |
| CFTR-Intron10-4793 | + | GCAAAGAGUGCAUAAAGG | 18 | 23675 |
| CFTR-Intron10-4794 | + | AGCAAAGAGUGCAUAAAGG | 19 | 23676 |
| CFTR-Intron10-4795 | + | AAGCAAAGAGUGCAUAAAGG | 20 | 23677 |
| CFTR-Intron10-4796 | + | AAAGCAAAGAGUGCAUAAAGG | 21 | 23678 |
| CFTR-Intron10-4797 | + | UAAAGCAAAGAGUGCAUAAAGG | 22 | 23679 |
| CFTR-Intron10-4798 | + | CUAAAGCAAAGAGUGCAUAAAGG | 23 | 23680 |
| CFTR-Intron10-4799 | + | CCUAAAGCAAAGAGUGCAUAAAGG | 24 | 23681 |
| CFTR-Intron10-4800 | + | UAUAAGAAAUGAAACAGG | 18 | 23682 |
| CFTR-Intron10-4801 | + | AUAUAAGAAAUGAAACAGG | 19 | 23683 |
| CFTR-Intron10-4802 | + | GAUAUAAGAAAUGAAACAGG | 20 | 23684 |
| CFTR-Intron10-4803 | + | CGAUAUAAGAAAUGAAACAGG | 21 | 23685 |
| CFTR-Intron10-4804 | + | ACGAUAUAAGAAAUGAAACAGG | 22 | 23686 |
| CFTR-Intron10-4805 | + | UACGAUAUAAGAAAUGAAACAGG | 23 | 23687 |
| CFTR-Intron10-4806 | + | AUACGAUAUAAGAAAUGAAACAGG | 24 | 23688 |
| CFTR-Intron10-4807 | + | CCUAUAAGGAAUAACAGG | 18 | 23689 |
| CFTR-Intron10-4808 | + | ACCUAUAAGGAAUAACAGG | 19 | 23690 |
| CFTR-Intron10-4809 | + | AACCUAUAAGGAAUAACAGG | 20 | 23691 |
| CFTR-Intron10-4810 | + | GAACCUAUAAGGAAUAACAGG | 21 | 23692 |
| CFTR-Intron10-4811 | + | AGAACCUAUAAGGAAUAACAGG | 22 | 23693 |
| CFTR-Intron10-4812 | + | CAGAACCUAUAAGGAAUAACAGG | 23 | 23694 |
| CFTR-Intron10-4813 | + | ACAGAACCUAUAAGGAAUAACAGG | 24 | 23695 |
| CFTR-Intron10-4814 | + | AGUAGAAACCUAAUCAGG | 18 | 23696 |
| CFTR-Intron10-4815 | + | UAGUAGAAACCUAAUCAGG | 19 | 23697 |
| CFTR-Intron10-4816 | + | UUAGUAGAAACCUAAUCAGG | 20 | 23698 |
| CFTR-Intron10-4817 | + | UUUAGUAGAAACCUAAUCAGG | 21 | 23699 |
| CFTR-Intron10-4818 | + | UUUUAGUAGAAACCUAAUCAGG | 22 | 23700 |

TABLE 41E-continued

5th Tier

| gRNA Name | DNA Strand | Targeting Domain | Target Site Length | Seq ID |
|---|---|---|---|---|
| CFTR-Intron10-4819 | + | GUUUUAGUAGAAACCUAAUCAGG | 23 | 23701 |
| CFTR-Intron10-4820 | + | GGUUUUAGUAGAAACCUAAUCAGG | 24 | 23702 |
| CFTR-Intron10-4821 | + | GAAAGGAGGUAGCAGAGG | 18 | 23703 |
| CFTR-Intron10-4822 | + | GGAAAGGAGGUAGCAGAGG | 19 | 23704 |
| CFTR-Intron10-4823 | + | AGGAAAGGAGGUAGCAGAGG | 20 | 23705 |
| CFTR-Intron10-4824 | + | AAGGAAAGGAGGUAGCAGAGG | 21 | 23706 |
| CFTR-Intron10-4825 | + | GAAGGAAAGGAGGUAGCAGAGG | 22 | 23707 |
| CFTR-Intron10-4826 | + | AGAAGGAAAGGAGGUAGCAGAGG | 23 | 23708 |
| CFTR-Intron10-4827 | + | UAGAAGGAAAGGAGGUAGCAGAGG | 24 | 23709 |
| CFTR-Intron10-4828 | + | GUUACAUAAAAAGAGAGG | 18 | 23710 |
| CFTR-Intron10-4829 | + | UGUUACAUAAAAAGAGAGG | 19 | 23711 |
| CFTR-Intron10-469 | + | UUGUUACAUAAAAAGAGAGG | 20 | 19355 |
| CFTR-Intron10-4830 | + | AUUGUUACAUAAAAAGAGAGG | 21 | 23712 |
| CFTR-Intron10-4831 | + | UAUUGUUACAUAAAAAGAGAGG | 22 | 23713 |
| CFTR-Intron10-4832 | + | AUAUUGUUACAUAAAAAGAGAGG | 23 | 23714 |
| CFTR-Intron10-4833 | + | CAUAUUGUUACAUAAAAAGAGAGG | 24 | 23715 |
| CFTR-Intron10-4834 | + | UGGCGUGAACCCGGGAGG | 18 | 23716 |
| CFTR-Intron10-4835 | + | AUGGCGUGAACCCGGGAGG | 19 | 23717 |
| CFTR-Intron10-1287 | + | AAUGGCGUGAACCCGGGAGG | 20 | 20172 |
| CFTR-Intron10-4836 | + | GAAUGGCGUGAACCCGGGAGG | 21 | 23718 |
| CFTR-Intron10-4837 | + | AGAAUGGCGUGAACCCGGGAGG | 22 | 23719 |
| CFTR-Intron10-4838 | + | GAGAAUGGCGUGAACCCGGGAGG | 23 | 23720 |
| CFTR-Intron10-4839 | + | GGAGAAUGGCGUGAACCCGGGAGG | 24 | 23721 |
| CFTR-Intron10-4840 | + | UUGCUUGAGCCCGGGAGG | 18 | 23722 |
| CFTR-Intron10-4841 | + | AUUGCUUGAGCCCGGGAGG | 19 | 23723 |
| CFTR-Intron10-4842 | + | AAUUGCUUGAGCCCGGGAGG | 20 | 23724 |
| CFTR-Intron10-4843 | + | GAAUUGCUUGAGCCCGGGAGG | 21 | 23725 |
| CFTR-Intron10-4844 | + | AGAAUUGCUUGAGCCCGGGAGG | 22 | 23726 |
| CFTR-Intron10-4845 | + | GAGAAUUGCUUGAGCCCGGGAGG | 23 | 23727 |
| CFTR-Intron10-4846 | + | GGAGAAUUGCUUGAGCCCGGGAGG | 24 | 23728 |
| CFTR-Intron10-4847 | + | UCCCAGCUACUUGGGAGG | 18 | 23729 |
| CFTR-Intron10-4848 | + | GUCCCAGCUACUUGGGAGG | 19 | 23730 |
| CFTR-Intron10-4849 | + | AGUCCCAGCUACUUGGGAGG | 20 | 23731 |
| CFTR-Intron10-4850 | + | UAGUCCCAGCUACUUGGGAGG | 21 | 23732 |
| CFTR-Intron10-4851 | + | GUAGUCCCAGCUACUUGGGAGG | 22 | 23733 |
| CFTR-Intron10-4852 | + | UGUAGUCCCAGCUACUUGGGAGG | 23 | 23734 |
| CFTR-Intron10-4853 | + | CUGUAGUCCCAGCUACUUGGGAGG | 24 | 23735 |

TABLE 41E-continued

5th Tier

| gRNA Name | DNA Strand | Targeting Domain | Target Site Length | Seq ID |
|---|---|---|---|---|
| CFTR-Intron10-4854 | + | UCCCAACACUUUGGGAGG | 18 | 23736 |
| CFTR-Intron10-4855 | + | AUCCCAACACUUUGGGAGG | 19 | 23737 |
| CFTR-Intron10-4856 | + | AAUCCCAACACUUUGGGAGG | 20 | 23738 |
| CFTR-Intron10-4857 | + | UAAUCCCAACACUUUGGGAGG | 21 | 23739 |
| CFTR-Intron10-4858 | + | GUAAUCCCAACACUUUGGGAGG | 22 | 23740 |
| CFTR-Intron10-4859 | + | UGUAAUCCCAACACUUUGGGAGG | 23 | 23741 |
| CFTR-Intron10-4860 | + | CUGUAAUCCCAACACUUUGGGAGG | 24 | 23742 |
| CFTR-Intron10-4861 | + | ACCCAGCACUUUGGGAGG | 18 | 23743 |
| CFTR-Intron10-4862 | + | AACCCAGCACUUUGGGAGG | 19 | 23744 |
| CFTR-Intron10-4863 | + | AAACCCAGCACUUUGGGAGG | 20 | 23745 |
| CFTR-Intron10-4864 | + | UAAACCCAGCACUUUGGGAGG | 21 | 23746 |
| CFTR-Intron10-4865 | + | AUAAACCCAGCACUUUGGGAGG | 22 | 23747 |
| CFTR-Intron10-4866 | + | UAUAAACCCAGCACUUUGGGAGG | 23 | 23748 |
| CFTR-Intron10-4867 | + | CUAUAAACCCAGCACUUUGGGAGG | 24 | 23749 |
| CFTR-Intron10-4868 | + | UCCCAGCACUUUGGGAGG | 18 | 23750 |
| CFTR-Intron10-4869 | + | AUCCCAGCACUUUGGGAGG | 19 | 23751 |
| CFTR-Intron10-4870 | + | AAUCCCAGCACUUUGGGAGG | 20 | 23752 |
| CFTR-Intron10-4871 | + | UAAUCCCAGCACUUUGGGAGG | 21 | 23753 |
| CFTR-Intron10-4872 | + | GUAAUCCCAGCACUUUGGGAGG | 22 | 23754 |
| CFTR-Intron10-4873 | + | UGUAAUCCCAGCACUUUGGGAGG | 23 | 23755 |
| CFTR-Intron10-4874 | + | CUGUAAUCCCAGCACUUUGGGAGG | 24 | 23756 |
| CFTR-Intron10-4875 | + | UUCUCACAGUUCUGGAGG | 18 | 23757 |
| CFTR-Intron10-4876 | + | UUUCUCACAGUUCUGGAGG | 19 | 23758 |
| CFTR-Intron10-4877 | + | AUUUCUCACAGUUCUGGAGG | 20 | 23759 |
| CFTR-Intron10-4878 | + | UAUUUCUCACAGUUCUGGAGG | 21 | 23760 |
| CFTR-Intron10-4879 | + | UUAUUUCUCACAGUUCUGGAGG | 22 | 23761 |
| CFTR-Intron10-4880 | + | UUUAUUUCUCACAGUUCUGGAGG | 23 | 23762 |
| CFTR-Intron10-4881 | + | AUUUAUUUCUCACAGUUCUGGAGG | 24 | 23763 |
| CFTR-Intron10-4882 | + | CAGCUACUUGGGAGGCUGAGG | 21 | 23764 |
| CFTR-Intron10-4883 | + | CCAGCUACUUGGGAGGCUGAGG | 22 | 23765 |
| CFTR-Intron10-4884 | + | CCCAGCUACUUGGGAGGCUGAGG | 23 | 23766 |
| CFTR-Intron10-4885 | + | UCCCAGCUACUUGGGAGGCUGAGG | 24 | 23767 |
| CFTR-Intron10-4886 | + | CUACUUGGGAGGGUGAGG | 18 | 23768 |
| CFTR-Intron10-4887 | + | GCUACUUGGGAGGGUGAGG | 19 | 23769 |
| CFTR-Intron10-4888 | + | AGCUACUUGGGAGGGUGAGG | 20 | 23770 |
| CFTR-Intron10-4889 | + | CAGCUACUUGGGAGGGUGAGG | 21 | 23771 |
| CFTR-Intron10-4890 | + | CCAGCUACUUGGGAGGGUGAGG | 22 | 23772 |

TABLE 41E-continued

| | | 5th Tier | | |
|---|---|---|---|---|
| gRNA Name | DNA Strand | Targeting Domain | Target Site Length | Seq ID |
| CFTR-Intron10-4891 | + | CCCAGCUACUUGGGAGGGUGAGG | 23 | 23773 |
| CFTR-Intron10-4892 | + | UCCCAGCUACUUGGGAGGGUGAGG | 24 | 23774 |
| CFTR-Intron10-4893 | + | GGUUAAGUUGUUCUUAGG | 18 | 23775 |
| CFTR-Intron10-4894 | + | AGGUUAAGUUGUUCUUAGG | 19 | 23776 |
| CFTR-Intron10-4895 | + | CAGGUUAAGUUGUUCUUAGG | 20 | 23777 |
| CFTR-Intron10-4896 | + | CCAGGUUAAGUUGUUCUUAGG | 21 | 23778 |
| CFTR-Intron10-4897 | + | GCCAGGUUAAGUUGUUCUUAGG | 22 | 23779 |
| CFTR-Intron10-4898 | + | UGCCAGGUUAAGUUGUUCUUAGG | 23 | 23780 |
| CFTR-Intron10-4899 | + | AUGCCAGGUUAAGUUGUUCUUAGG | 24 | 23781 |
| CFTR-Intron10-4900 | + | CUCACAUGGCAGAAAGGG | 18 | 23782 |
| CFTR-Intron10-4901 | + | UCUCACAUGGCAGAAAGGG | 19 | 23783 |
| CFTR-Intron10-4902 | + | UUCUCACAUGGCAGAAAGGG | 20 | 23784 |
| CFTR-Intron10-4903 | + | GUUCUCACAUGGCAGAAAGGG | 21 | 23785 |
| CFTR-Intron10-4904 | + | UGUUCUCACAUGGCAGAAAGGG | 22 | 23786 |
| CFTR-Intron10-4905 | + | GUGUUCUCACAUGGCAGAAAGGG | 23 | 23787 |
| CFTR-Intron10-4906 | + | UGUGUUCUCACAUGGCAGAAAGGG | 24 | 23788 |
| CFTR-Intron10-4907 | + | AACAUAUGAAUGGCAGGG | 18 | 23789 |
| CFTR-Intron10-4908 | + | CAACAUAUGAAUGGCAGGG | 19 | 23790 |
| CFTR-Intron10-4909 | + | UCAACAUAUGAAUGGCAGGG | 20 | 23791 |
| CFTR-Intron10-4910 | + | UUCAACAUAUGAAUGGCAGGG | 21 | 23792 |
| CFTR-Intron10-4911 | + | UUUCAACAUAUGAAUGGCAGGG | 22 | 23793 |
| CFTR-Intron10-4912 | + | AUUUCAACAUAUGAAUGGCAGGG | 23 | 23794 |
| CFTR-Intron10-4913 | + | GAUUUCAACAUAUGAAUGGCAGGG | 24 | 23795 |
| CFTR-Intron10-4914 | + | UUGGUACAAAUUUCAGGG | 18 | 23796 |
| CFTR-Intron10-4915 | + | AUUGGUACAAAUUUCAGGG | 19 | 23797 |
| CFTR-Intron10-4916 | + | AAUUGGUACAAAUUUCAGGG | 20 | 23798 |
| CFTR-Intron10-4917 | + | GAAUUGGUACAAAUUUCAGGG | 21 | 23799 |
| CFTR-Intron10-4918 | + | CGAAUUGGUACAAAUUUCAGGG | 22 | 23800 |
| CFTR-Intron10-4919 | + | ACGAAUUGGUACAAAUUUCAGGG | 23 | 23801 |
| CFTR-Intron10-4920 | + | UACGAAUUGGUACAAAUUUCAGGG | 24 | 23802 |
| CFTR-Intron10-4921 | + | AUUUCAACAUAUGAAUGG | 18 | 23803 |
| CFTR-Intron10-4922 | + | GAUUUCAACAUAUGAAUGG | 19 | 23804 |
| CFTR-Intron10-4923 | + | GGAUUUCAACAUAUGAAUGG | 20 | 23805 |
| CFTR-Intron10-4924 | + | AGGAUUUCAACAUAUGAAUGG | 21 | 23806 |
| CFTR-Intron10-4925 | + | UAGGAUUUCAACAUAUGAAUGG | 22 | 23807 |
| CFTR-Intron10-4926 | + | UUAGGAUUUCAACAUAUGAAUGG | 23 | 23808 |
| CFTR-Intron10-4927 | + | AUUAGGAUUUCAACAUAUGAAUGG | 24 | 23809 |

TABLE 41E-continued

| 5th Tier | | | | |
|---|---|---|---|---|
| gRNA Name | DNA Strand | Targeting Domain | Target Site Length | Seq ID |
| CFTR-Intron10-4928 | + | UGCUGUGUUCUCACAUGG | 18 | 23810 |
| CFTR-Intron10-4929 | + | CUGCUGUGUUCUCACAUGG | 19 | 23811 |
| CFTR-Intron10-4930 | + | CCUGCUGUGUUCUCACAUGG | 20 | 23812 |
| CFTR-Intron10-4931 | + | UCCUGCUGUGUUCUCACAUGG | 21 | 23813 |
| CFTR-Intron10-4932 | + | UUCCUGCUGUGUUCUCACAUGG | 22 | 23814 |
| CFTR-Intron10-4933 | + | CUUCCUGCUGUGUUCUCACAUGG | 23 | 23815 |
| CFTR-Intron10-4934 | + | UCUUCCUGCUGUGUUCUCACAUGG | 24 | 23816 |
| CFTR-Intron10-4935 | + | AUUGGCUACCUUGGUUGG | 18 | 23817 |
| CFTR-Intron10-4936 | + | GAUUGGCUACCUUGGUUGG | 19 | 23818 |
| CFTR-Intron10-4937 | + | GGAUUGGCUACCUUGGUUGG | 20 | 23819 |
| CFTR-Intron10-4938 | + | UGGAUUGGCUACCUUGGUUGG | 21 | 23820 |
| CFTR-Intron10-4939 | + | CUGGAUUGGCUACCUUGGUUGG | 22 | 23821 |
| CFTR-Intron10-4940 | + | CCUGGAUUGGCUACCUUGGUUGG | 23 | 23822 |
| CFTR-Intron10-4941 | + | ACCUGGAUUGGCUACCUUGGUUGG | 24 | 23823 |
| CFTR-Intron10-4942 | + | UGGUUGGAUGAGGGAAUG | 18 | 23824 |
| CFTR-Intron10-4943 | + | UUGGUUGGAUGAGGGAAUG | 19 | 23825 |
| CFTR-Intron10-4944 | + | CUUGGUUGGAUGAGGGAAUG | 20 | 23826 |
| CFTR-Intron10-4945 | + | CCUUGGUUGGAUGAGGGAAUG | 21 | 23827 |
| CFTR-Intron10-4946 | + | ACCUUGGUUGGAUGAGGGAAUG | 22 | 23828 |
| CFTR-Intron10-4947 | + | UACCUUGGUUGGAUGAGGGAAUG | 23 | 23829 |
| CFTR-Intron10-4948 | + | CUACCUUGGUUGGAUGAGGGAAUG | 24 | 23830 |
| CFTR-Intron10-4949 | + | GAAAGCAGUGUUAUAAUG | 18 | 23831 |
| CFTR-Intron10-4950 | + | UGAAAGCAGUGUUAUAAUG | 19 | 23832 |
| CFTR-Intron10-4951 | + | CUGAAAGCAGUGUUAUAAUG | 20 | 23833 |
| CFTR-Intron10-4952 | + | CCUGAAAGCAGUGUUAUAAUG | 21 | 23834 |
| CFTR-Intron10-4953 | + | UCCUGAAAGCAGUGUUAUAAUG | 22 | 23835 |
| CFTR-Intron10-4954 | + | CUCCUGAAAGCAGUGUUAUAAUG | 23 | 23836 |
| CFTR-Intron10-4955 | + | GCUCCUGAAAGCAGUGUUAUAAUG | 24 | 23837 |
| CFTR-Intron10-4956 | + | GGCAUUGCACUAAACAUG | 18 | 23838 |
| CFTR-Intron10-4957 | + | UGGCAUUGCACUAAACAUG | 19 | 23839 |
| CFTR-Intron10-4958 | + | AUGGCAUUGCACUAAACAUG | 20 | 23840 |
| CFTR-Intron10-4959 | + | UAUGGCAUUGCACUAAACAUG | 21 | 23841 |
| CFTR-Intron10-4960 | + | UUAUGGCAUUGCACUAAACAUG | 22 | 23842 |
| CFTR-Intron10-4961 | + | UUUAUGGCAUUGCACUAAACAUG | 23 | 23843 |
| CFTR-Intron10-4962 | + | GUUUAUGGCAUUGCACUAAACAUG | 24 | 23844 |
| CFTR-Intron10-4963 | + | ACCAUCCUGGCCAACAUG | 18 | 23845 |
| CFTR-Intron10-4964 | + | UACCAUCCUGGCCAACAUG | 19 | 23846 |

TABLE 41E-continued

5th Tier

| gRNA Name | DNA Strand | Targeting Domain | Target Site Length | Seq ID |
|---|---|---|---|---|
| CFTR-Intron10-4965 | + | AUACCAUCCUGGCCAACAUG | 20 | 23847 |
| CFTR-Intron10-4966 | + | AAUACCAUCCUGGCCAACAUG | 21 | 23848 |
| CFTR-Intron10-4967 | + | CAAUACCAUCCUGGCCAACAUG | 22 | 23849 |
| CFTR-Intron10-4968 | + | UCAAUACCAUCCUGGCCAACAUG | 23 | 23850 |
| CFTR-Intron10-4969 | + | AUCAAUACCAUCCUGGCCAACAUG | 24 | 23851 |
| CFTR-Intron10-4970 | + | AAAGAUAAGUGAAGAUG | 18 | 23852 |
| CFTR-Intron10-4971 | + | AAAAGAUAAGUGAAGAUG | 19 | 23853 |
| CFTR-Intron10-4972 | + | AAAAAGAUAAGUGAAGAUG | 20 | 23854 |
| CFTR-Intron10-4973 | + | GAAAAAGAUAAGUGAAGAUG | 21 | 23855 |
| CFTR-Intron10-4974 | + | AGAAAAAGAUAAGUGAAGAUG | 22 | 23856 |
| CFTR-Intron10-4975 | + | UAGAAAAAGAUAAGUGAAGAUG | 23 | 23857 |
| CFTR-Intron10-4976 | + | GUAGAAAAAGAUAAGUGAAGAUG | 24 | 23858 |
| CFTR-Intron10-4977 | + | GGCUACCUUGGUUGGAUG | 18 | 23859 |
| CFTR-Intron10-4978 | + | UGGCUACCUUGGUUGGAUG | 19 | 23860 |
| CFTR-Intron10-481 | + | UUGGCUACCUUGGUUGGAUG | 20 | 19367 |
| CFTR-Intron10-4979 | + | AUUGGCUACCUUGGUUGGAUG | 21 | 23861 |
| CFTR-Intron10-4980 | + | GAUUGGCUACCUUGGUUGGAUG | 22 | 23862 |
| CFTR-Intron10-4981 | + | GGAUUGGCUACCUUGGUUGGAUG | 23 | 23863 |
| CFTR-Intron10-4982 | + | UGGAUUGGCUACCUUGGUUGGAUG | 24 | 23864 |
| CFTR-Intron10-4983 | + | UUCUUAGGGUGGGAUAUG | 18 | 23865 |
| CFTR-Intron10-4984 | + | GUUCUUAGGGUGGGAUAUG | 19 | 23866 |
| CFTR-Intron10-4985 | + | UGUUCUUAGGGUGGGAUAUG | 20 | 23867 |
| CFTR-Intron10-4986 | + | UUGUUCUUAGGGUGGGAUAUG | 21 | 23868 |
| CFTR-Intron10-4987 | + | GUUGUUCUUAGGGUGGGAUAUG | 22 | 23869 |
| CFTR-Intron10-4988 | + | AGUUGUUCUUAGGGUGGGAUAUG | 23 | 23870 |
| CFTR-Intron10-4989 | + | AAGUUGUUCUUAGGGUGGGAUAUG | 24 | 23871 |
| CFTR-Intron10-4990 | + | UAAAAGCUGUUUCGUAUG | 18 | 23872 |
| CFTR-Intron10-4991 | + | UUAAAAGCUGUUUCGUAUG | 19 | 23873 |
| CFTR-Intron10-4992 | + | UUUAAAAGCUGUUUCGUAUG | 20 | 23874 |
| CFTR-Intron10-4993 | + | UUUUAAAAGCUGUUUCGUAUG | 21 | 23875 |
| CFTR-Intron10-4994 | + | GUUUUAAAAGCUGUUUCGUAUG | 22 | 23876 |
| CFTR-Intron10-4995 | + | UGUUUUAAAAGCUGUUUCGUAUG | 23 | 23877 |
| CFTR-Intron10-4996 | + | UUGUUUUAAAAGCUGUUUCGUAUG | 24 | 23878 |
| CFTR-Intron10-4997 | + | UAUGUAGGAAAACAACUG | 18 | 23879 |
| CFTR-Intron10-4998 | + | GUAUGUAGGAAAACAACUG | 19 | 23880 |
| CFTR-Intron10-4999 | + | CGUAUGUAGGAAAACAACUG | 20 | 23881 |
| CFTR-Intron10-5000 | + | UCGUAUGUAGGAAAACAACUG | 21 | 23882 |

TABLE 41E-continued

5th Tier

| gRNA Name | DNA Strand | Targeting Domain | Target Site Length | Seq ID |
|---|---|---|---|---|
| CFTR-Intron10-5001 | + | UUCGUAUGUAGGAAAACAACUG | 22 | 23883 |
| CFTR-Intron10-5002 | + | UUUCGUAUGUAGGAAAACAACUG | 23 | 23884 |
| CFTR-Intron10-5003 | + | GUUUCGUAUGUAGGAAAACAACUG | 24 | 23885 |
| CFTR-Intron10-5004 | + | GAAACUCCCCACACACUG | 18 | 23886 |
| CFTR-Intron10-5005 | + | UGAAACUCCCCACACACUG | 19 | 23887 |
| CFTR-Intron10-5006 | + | CUGAAACUCCCCACACACUG | 20 | 23888 |
| CFTR-Intron10-5007 | + | ACUGAAACUCCCCACACACUG | 21 | 23889 |
| CFTR-Intron10-5008 | + | GACUGAAACUCCCCACACACUG | 22 | 23890 |
| CFTR-Intron10-5009 | + | GGACUGAAACUCCCCACACACUG | 23 | 23891 |
| CFTR-Intron10-5010 | + | AGGACUGAAACUCCCCACACACUG | 24 | 23892 |
| CFTR-Intron10-5011 | + | GCAAUAUGCAAUUUACUG | 18 | 23893 |
| CFTR-Intron10-5012 | + | UGCAAUAUGCAAUUUACUG | 19 | 23894 |
| CFTR-Intron10-5013 | + | CUGCAAUAUGCAAUUUACUG | 20 | 23895 |
| CFTR-Intron10-5014 | + | ACUGCAAUAUGCAAUUUACUG | 21 | 23896 |
| CFTR-Intron10-5015 | + | UACUGCAAUAUGCAAUUUACUG | 22 | 23897 |
| CFTR-Intron10-5016 | + | UUACUGCAAUAUGCAAUUUACUG | 23 | 23898 |
| CFTR-Intron10-5017 | + | UUUACUGCAAUAUGCAAUUUACUG | 24 | 23899 |
| CFTR-Intron10-5018 | + | CAUCUGUUAGUAAUGCUG | 18 | 23900 |
| CFTR-Intron10-5019 | + | UCAUCUGUUAGUAAUGCUG | 19 | 23901 |
| CFTR-Intron10-485 | + | AUCAUCUGUUAGUAAUGCUG | 20 | 19371 |
| CFTR-Intron10-5020 | + | UAUCAUCUGUUAGUAAUGCUG | 21 | 23902 |
| CFTR-Intron10-5021 | + | AUAUCAUCUGUUAGUAAUGCUG | 22 | 23903 |
| CFTR-Intron10-5022 | + | AAUAUCAUCUGUUAGUAAUGCUG | 23 | 23904 |
| CFTR-Intron10-5023 | + | UAAUAUCAUCUGUUAGUAAUGCUG | 24 | 23905 |
| CFTR-Intron10-5024 | + | AAUUAGCCGGGCGUAGUG | 18 | 23906 |
| CFTR-Intron10-5025 | + | AAAUUAGCCGGGCGUAGUG | 19 | 23907 |
| CFTR-Intron10-5026 | + | AAAAUUAGCCGGGCGUAGUG | 20 | 23908 |
| CFTR-Intron10-5027 | + | AAAAAUUAGCCGGGCGUAGUG | 21 | 23909 |
| CFTR-Intron10-5028 | + | AAAAAAUUAGCCGGGCGUAGUG | 22 | 23910 |
| CFTR-Intron10-5029 | + | CAAAAAAUUAGCCGGGCGUAGUG | 23 | 23911 |
| CFTR-Intron10-5030 | + | ACAAAAAAUUAGCCGGGCGUAGUG | 24 | 23912 |
| CFTR-Intron10-5031 | + | UCUGUUAGUAAUGCUGUG | 18 | 23913 |
| CFTR-Intron10-5032 | + | AUCUGUUAGUAAUGCUGUG | 19 | 23914 |
| CFTR-Intron10-490 | + | CAUCUGUUAGUAAUGCUGUG | 20 | 19376 |
| CFTR-Intron10-5033 | + | UCAUCUGUUAGUAAUGCUGUG | 21 | 23915 |
| CFTR-Intron10-5034 | + | AUCAUCUGUUAGUAAUGCUGUG | 22 | 23916 |
| CFTR-Intron10-5035 | + | UAUCAUCUGUUAGUAAUGCUGUG | 23 | 23917 |

TABLE 41E-continued

5th Tier

| gRNA Name | DNA Strand | Targeting Domain | Target Site Length | Seq ID |
|---|---|---|---|---|
| CFTR-Intron10-5036 | + | AUAUCAUCUGUUAGUAAUGCUGUG | 24 | 23918 |
| CFTR-Intron10-5037 | + | AUUCAAAAAAUAUUUGUG | 18 | 23919 |
| CFTR-Intron10-5038 | + | UAUUCAAAAAAUAUUUGUG | 19 | 23920 |
| CFTR-Intron10-5039 | + | CUAUUCAAAAAAUAUUUGUG | 20 | 23921 |
| CFTR-Intron10-5040 | + | UCUAUUCAAAAAAUAUUUGUG | 21 | 23922 |
| CFTR-Intron10-5041 | + | AUCUAUUCAAAAAAUAUUUGUG | 22 | 23923 |
| CFTR-Intron10-5042 | + | AAUCUAUUCAAAAAAUAUUUGUG | 23 | 23924 |
| CFTR-Intron10-5043 | + | UAAUCUAUUCAAAAAAUAUUUGUG | 24 | 23925 |
| CFTR-Intron10-5044 | + | CUAUUCAAAAAAUAUUUG | 18 | 23926 |
| CFTR-Intron10-5045 | + | UCUAUUCAAAAAAUAUUUG | 19 | 23927 |
| CFTR-Intron10-1323 | + | AUCUAUUCAAAAAAUAUUUG | 20 | 20208 |
| CFTR-Intron10-5046 | + | AAUCUAUUCAAAAAAUAUUUG | 21 | 23928 |
| CFTR-Intron10-5047 | + | UAAUCUAUUCAAAAAAUAUUUG | 22 | 23929 |
| CFTR-Intron10-5048 | + | CUAAUCUAUUCAAAAAAUAUUUG | 23 | 23930 |
| CFTR-Intron10-5049 | + | GCUAAUCUAUUCAAAAAAUAUUUG | 24 | 23931 |
| CFTR-Intron10-5050 | + | CUUAUAUUUUAUUUUG | 18 | 23932 |
| CFTR-Intron10-5051 | + | ACUUAUAUUUUAUUUUG | 19 | 23933 |
| CFTR-Intron10-5052 | + | CACUUAUAUUUUAUUUUG | 20 | 23934 |
| CFTR-Intron10-5053 | + | CCACUUAUAUUUUAUUUUG | 21 | 23935 |
| CFTR-Intron10-5054 | + | GCCACUUAUAUUUUAUUUUG | 22 | 23936 |
| CFTR-Intron10-5055 | + | GGCCACUUAUAUUUUAUUUUG | 23 | 23937 |
| CFTR-Intron10-5056 | + | AGGCCACUUAUAUUUUAUUUUG | 24 | 23938 |
| CFTR-Intron10-5057 | + | UUUUGUUUGUGUUUUUUG | 18 | 23939 |
| CFTR-Intron10-5058 | + | CUUUUGUUUGUGUUUUUUG | 19 | 23940 |
| CFTR-Intron10-5059 | + | UCUUUUGUUUGUGUUUUUUG | 20 | 23941 |
| CFTR-Intron10-5060 | + | UUCUUUUGUUUGUGUUUUUUG | 21 | 23942 |
| CFTR-Intron10-5061 | + | UUUCUUUUGUUUGUGUUUUUUG | 22 | 23943 |
| CFTR-Intron10-5062 | + | UUUUCUUUUGUUUGUGUUUUUUG | 23 | 23944 |
| CFTR-Intron10-5063 | + | AUUUUCUUUUGUUUGUGUUUUUUG | 24 | 23945 |
| CFTR-Intron10-5064 | + | CUAAAAUGACAAUCAAAU | 18 | 23946 |
| CFTR-Intron10-5065 | + | GCUAAAAUGACAAUCAAAU | 19 | 23947 |
| CFTR-Intron10-498 | + | AGCUAAAAUGACAAUCAAAU | 20 | 19384 |
| CFTR-Intron10-5066 | + | CAGCUAAAAUGACAAUCAAAU | 21 | 23948 |
| CFTR-Intron10-5067 | + | ACAGCUAAAAUGACAAUCAAAU | 22 | 23949 |
| CFTR-Intron10-5068 | + | CACAGCUAAAAUGACAAUCAAAU | 23 | 23950 |
| CFTR-Intron10-5069 | + | CCACAGCUAAAAUGACAAUCAAAU | 24 | 23951 |
| CFTR-Intron10-5070 | + | AACAAUACAAAGAUAAAU | 18 | 23952 |

TABLE 41E-continued

5th Tier

| gRNA Name | DNA Strand | Targeting Domain | Target Site Length | Seq ID |
|---|---|---|---|---|
| CFTR-Intron10-5071 | + | UAACAAUACAAAGAUAAAU | 19 | 23953 |
| CFTR-Intron10-5072 | + | UUAACAAUACAAAGAUAAAU | 20 | 23954 |
| CFTR-Intron10-5073 | + | UUUAACAAUACAAAGAUAAAU | 21 | 23955 |
| CFTR-Intron10-5074 | + | AUUUAACAAUACAAAGAUAAAU | 22 | 23956 |
| CFTR-Intron10-5075 | + | GAUUUAACAAUACAAAGAUAAAU | 23 | 23957 |
| CFTR-Intron10-5076 | + | AGAUUUAACAAUACAAAGAUAAAU | 24 | 23958 |
| CFTR-Intron10-5077 | + | GUUAUAUGUCCUGACAAU | 18 | 23959 |
| CFTR-Intron10-5078 | + | UGUUAUAUGUCCUGACAAU | 19 | 23960 |
| CFTR-Intron10-5079 | + | AUGUUAUAUGUCCUGACAAU | 20 | 23961 |
| CFTR-Intron10-5080 | + | UAUGUUAUAUGUCCUGACAAU | 21 | 23962 |
| CFTR-Intron10-5081 | + | AUAUGUUAUAUGUCCUGACAAU | 22 | 23963 |
| CFTR-Intron10-5082 | + | AAUAUGUUAUAUGUCCUGACAAU | 23 | 23964 |
| CFTR-Intron10-5083 | + | AAAUAUGUUAUAUGUCCUGACAAU | 24 | 23965 |
| CFTR-Intron10-5084 | + | GUGCUAUUUAAACAGAAU | 18 | 23966 |
| CFTR-Intron10-5085 | + | AGUGCUAUUUAAACAGAAU | 19 | 23967 |
| CFTR-Intron10-5086 | + | CAGUGCUAUUUAAACAGAAU | 20 | 23968 |
| CFTR-Intron10-5087 | + | CCAGUGCUAUUUAAACAGAAU | 21 | 23969 |
| CFTR-Intron10-5088 | + | UCCAGUGCUAUUUAAACAGAAU | 22 | 23970 |
| CFTR-Intron10-5089 | + | CUCCAGUGCUAUUUAAACAGAAU | 23 | 23971 |
| CFTR-Intron10-5090 | + | ACUCCAGUGCUAUUUAAACAGAAU | 24 | 23972 |
| CFTR-Intron10-5091 | + | GUCCUCUGUGCUUUGAAU | 18 | 23973 |
| CFTR-Intron10-5092 | + | AGUCCUCUGUGCUUUGAAU | 19 | 23974 |
| CFTR-Intron10-5093 | + | AAGUCCUCUGUGCUUUGAAU | 20 | 23975 |
| CFTR-Intron10-5094 | + | CAAGUCCUCUGUGCUUUGAAU | 21 | 23976 |
| CFTR-Intron10-5095 | + | GCAAGUCCUCUGUGCUUUGAAU | 22 | 23977 |
| CFTR-Intron10-5096 | + | UGCAAGUCCUCUGUGCUUUGAAU | 23 | 23978 |
| CFTR-Intron10-5097 | + | GUGCAAGUCCUCUGUGCUUUGAAU | 24 | 23979 |
| CFTR-Intron10-5098 | + | CCAAGCAGUAGAAAUAAU | 18 | 23980 |
| CFTR-Intron10-5099 | + | UCCAAGCAGUAGAAAUAAU | 19 | 23981 |
| CFTR-Intron10-5100 | + | UUCCAAGCAGUAGAAAUAAU | 20 | 23982 |
| CFTR-Intron10-5101 | + | AUUCCAAGCAGUAGAAAUAAU | 21 | 23983 |
| CFTR-Intron10-5102 | + | AAUUCCAAGCAGUAGAAAUAAU | 22 | 23984 |
| CFTR-Intron10-5103 | + | AAAUUCCAAGCAGUAGAAAUAAU | 23 | 23985 |
| CFTR-Intron10-5104 | + | AAAAUUCCAAGCAGUAGAAAUAAU | 24 | 23986 |
| CFTR-Intron10-5105 | + | UUUUAGUAGAAACCUAAU | 18 | 23987 |
| CFTR-Intron10-5106 | + | GUUUUAGUAGAAACCUAAU | 19 | 23988 |
| CFTR-Intron10-5107 | + | GGUUUUAGUAGAAACCUAAU | 20 | 23989 |

TABLE 41E-continued

5th Tier

| gRNA Name | DNA Strand | Targeting Domain | Target Site Length | Seq ID |
|---|---|---|---|---|
| CFTR-Intron10-5108 | + | UGGUUUUAGUAGAAACCUAAU | 21 | 23990 |
| CFTR-Intron10-5109 | + | UUGGUUUUAGUAGAAACCUAAU | 22 | 23991 |
| CFTR-Intron10-5110 | + | UUUGGUUUUAGUAGAAACCUAAU | 23 | 23992 |
| CFTR-Intron10-5111 | + | GUUUGGUUUUAGUAGAAACCUAAU | 24 | 23993 |
| CFTR-Intron10-5112 | + | GCCUAGAUGAUUAUUAAU | 18 | 23994 |
| CFTR-Intron10-5113 | + | AGCCUAGAUGAUUAUUAAU | 19 | 23995 |
| CFTR-Intron10-503 | + | CAGCCUAGAUGAUUAUUAAU | 20 | 19389 |
| CFTR-Intron10-5114 | + | GCAGCCUAGAUGAUUAUUAAU | 21 | 23996 |
| CFTR-Intron10-5115 | + | UGCAGCCUAGAUGAUUAUUAAU | 22 | 23997 |
| CFTR-Intron10-5116 | + | UUGCAGCCUAGAUGAUUAUUAAU | 23 | 23998 |
| CFTR-Intron10-5117 | + | UUUGCAGCCUAGAUGAUUAUUAAU | 24 | 23999 |
| CFTR-Intron10-5118 | + | UUACAAUUCUUAUUACAU | 18 | 24000 |
| CFTR-Intron10-5119 | + | UUUACAAUUCUUAUUACAU | 19 | 24001 |
| CFTR-Intron10-1333 | + | UUUUACAAUUCUUAUUACAU | 20 | 20218 |
| CFTR-Intron10-5120 | + | AUUUUACAAUUCUUAUUACAU | 21 | 24002 |
| CFTR-Intron10-5121 | + | AAUUUUACAAUUCUUAUUACAU | 22 | 24003 |
| CFTR-Intron10-5122 | + | AAAUUUUACAAUUCUUAUUACAU | 23 | 24004 |
| CFTR-Intron10-5123 | + | UAAAUUUUACAAUUCUUAUUACAU | 24 | 24005 |
| CFTR-Intron10-5124 | + | AGGUAUAGUCAGUCCCAU | 18 | 24006 |
| CFTR-Intron10-5125 | + | CAGGUAUAGUCAGUCCCAU | 19 | 24007 |
| CFTR-Intron10-5126 | + | ACAGGUAUAGUCAGUCCCAU | 20 | 24008 |
| CFTR-Intron10-5127 | + | GACAGGUAUAGUCAGUCCCAU | 21 | 24009 |
| CFTR-Intron10-5128 | + | AGACAGGUAUAGUCAGUCCCAU | 22 | 24010 |
| CFTR-Intron10-5129 | + | CAGACAGGUAUAGUCAGUCCCAU | 23 | 24011 |
| CFTR-Intron10-5130 | + | CCAGACAGGUAUAGUCAGUCCCAU | 24 | 24012 |
| CFTR-Intron10-5131 | + | AACAUAGAGAAAACUCAU | 18 | 24013 |
| CFTR-Intron10-5132 | + | AAACAUAGAGAAAACUCAU | 19 | 24014 |
| CFTR-Intron10-5133 | + | AAAACAUAGAGAAAACUCAU | 20 | 24015 |
| CFTR-Intron10-5134 | + | UAAAACAUAGAGAAAACUCAU | 21 | 24016 |
| CFTR-Intron10-5135 | + | AUAAAACAUAGAGAAAACUCAU | 22 | 24017 |
| CFTR-Intron10-5136 | + | AAUAAAACAUAGAGAAAACUCAU | 23 | 24018 |
| CFTR-Intron10-5137 | + | AAAUAAAACAUAGAGAAAACUCAU | 24 | 24019 |
| CFTR-Intron10-5138 | + | CUAUUUCCCUAUAAGAU | 18 | 24020 |
| CFTR-Intron10-5139 | + | ACUAUUUCCCUAUAAGAU | 19 | 24021 |
| CFTR-Intron10-5140 | + | UACUAUUUCCCUAUAAGAU | 20 | 24022 |
| CFTR-Intron10-5141 | + | AUACUAUUUCCCUAUAAGAU | 21 | 24023 |
| CFTR-Intron10-5142 | + | CAUACUAUUUCCCUAUAAGAU | 22 | 24024 |

TABLE 41E-continued

5th Tier

| gRNA Name | DNA Strand | Targeting Domain | Target Site Length | Seq ID |
|---|---|---|---|---|
| CFTR-Intron10-5143 | + | ACAUACUAUUUCCCUAUAAGAU | 23 | 24025 |
| CFTR-Intron10-5144 | + | GACAUACUAUUUCCCUAUAAGAU | 24 | 24026 |
| CFTR-Intron10-5145 | + | AAUGGAAAAUGGACAGAU | 18 | 24027 |
| CFTR-Intron10-5146 | + | GAAUGGAAAAUGGACAGAU | 19 | 24028 |
| CFTR-Intron10-5147 | + | AGAAUGGAAAAUGGACAGAU | 20 | 24029 |
| CFTR-Intron10-5148 | + | GAGAAUGGAAAAUGGACAGAU | 21 | 24030 |
| CFTR-Intron10-5149 | + | GGAGAAUGGAAAAUGGACAGAU | 22 | 24031 |
| CFTR-Intron10-5150 | + | AGGAGAAUGGAAAAUGGACAGAU | 23 | 24032 |
| CFTR-Intron10-5151 | + | CAGGAGAAUGGAAAAUGGACAGAU | 24 | 24033 |
| CFTR-Intron10-5152 | + | UUGUUCUUAGGGUGGGAU | 18 | 24034 |
| CFTR-Intron10-5153 | + | GUUGUUCUUAGGGUGGGAU | 19 | 24035 |
| CFTR-Intron10-5154 | + | AGUUGUUCUUAGGGUGGGAU | 20 | 24036 |
| CFTR-Intron10-5155 | + | AAGUUGUUCUUAGGGUGGGAU | 21 | 24037 |
| CFTR-Intron10-5156 | + | UAAGUUGUUCUUAGGGUGGGAU | 22 | 24038 |
| CFTR-Intron10-5157 | + | UUAAGUUGUUCUUAGGGUGGGAU | 23 | 24039 |
| CFTR-Intron10-5158 | + | GUUAAGUUGUUCUUAGGGUGGGAU | 24 | 24040 |
| CFTR-Intron10-5159 | + | UGGCUACCUUGGUUGGAU | 18 | 24041 |
| CFTR-Intron10-5160 | + | UUGGCUACCUUGGUUGGAU | 19 | 24042 |
| CFTR-Intron10-5161 | + | AUUGGCUACCUUGGUUGGAU | 20 | 24043 |
| CFTR-Intron10-5162 | + | GAUUGGCUACCUUGGUUGGAU | 21 | 24044 |
| CFTR-Intron10-5163 | + | GGAUUGGCUACCUUGGUUGGAU | 22 | 24045 |
| CFTR-Intron10-5164 | + | UGGAUUGGCUACCUUGGUUGGAU | 23 | 24046 |
| CFTR-Intron10-5165 | + | CUGGAUUGGCUACCUUGGUUGGAU | 24 | 24047 |
| CFTR-Intron10-5166 | + | AAACAUGAUGAAAAAUAU | 18 | 24048 |
| CFTR-Intron10-5167 | + | UAAACAUGAUGAAAAAUAU | 19 | 24049 |
| CFTR-Intron10-5168 | + | CUAAACAUGAUGAAAAAUAU | 20 | 24050 |
| CFTR-Intron10-5169 | + | ACUAAACAUGAUGAAAAAUAU | 21 | 24051 |
| CFTR-Intron10-5170 | + | CACUAAACAUGAUGAAAAAUAU | 22 | 24052 |
| CFTR-Intron10-5171 | + | GCACUAAACAUGAUGAAAAAUAU | 23 | 24053 |
| CFTR-Intron10-5172 | + | UGCACUAAACAUGAUGAAAAAUAU | 24 | 24054 |
| CFTR-Intron10-5173 | + | UUUGUGUUAACAAAAUAU | 18 | 24055 |
| CFTR-Intron10-5174 | + | CUUUGUGUUAACAAAAUAU | 19 | 24056 |
| CFTR-Intron10-506 | + | UCUUUGUGUUAACAAAAUAU | 20 | 19392 |
| CFTR-Intron10-5175 | + | UUCUUUGUGUUAACAAAAUAU | 21 | 24057 |
| CFTR-Intron10-5176 | + | GUUCUUUGUGUUAACAAAAUAU | 22 | 24058 |
| CFTR-Intron10-5177 | + | UGUUCUUUGUGUUAACAAAAUAU | 23 | 24059 |
| CFTR-Intron10-5178 | + | UUGUUCUUUGUGUUAACAAAAUAU | 24 | 24060 |

TABLE 41E-continued

5th Tier

| gRNA Name | DNA Strand | Targeting Domain | Target Site Length | Seq ID |
|---|---|---|---|---|
| CFTR-Intron10-5179 | + | GUUGCAAAAAUACGAUAU | 18 | 24061 |
| CFTR-Intron10-5180 | + | AGUUGCAAAAAUACGAUAU | 19 | 24062 |
| CFTR-Intron10-5181 | + | GAGUUGCAAAAAUACGAUAU | 20 | 24063 |
| CFTR-Intron10-5182 | + | GGAGUUGCAAAAAUACGAUAU | 21 | 24064 |
| CFTR-Intron10-5183 | + | AGGAGUUGCAAAAAUACGAUAU | 22 | 24065 |
| CFTR-Intron10-5184 | + | AAGGAGUUGCAAAAAUACGAUAU | 23 | 24066 |
| CFTR-Intron10-5185 | + | AAAGGAGUUGCAAAAAUACGAUAU | 24 | 24067 |
| CFTR-Intron10-5186 | + | AAAAAUUACAGAACCUAU | 18 | 24068 |
| CFTR-Intron10-5187 | + | CAAAAAUUACAGAACCUAU | 19 | 24069 |
| CFTR-Intron10-5188 | + | GCAAAAAUUACAGAACCUAU | 20 | 24070 |
| CFTR-Intron10-5189 | + | AGCAAAAAUUACAGAACCUAU | 21 | 24071 |
| CFTR-Intron10-5190 | + | AAGCAAAAAUUACAGAACCUAU | 22 | 24072 |
| CFTR-Intron10-5191 | + | GAAGCAAAAAUUACAGAACCUAU | 23 | 24073 |
| CFTR-Intron10-5192 | + | UGAAGCAAAAAUUACAGAACCUAU | 24 | 24074 |
| CFTR-Intron10-5193 | + | AAAUGCUUGACCACUUAU | 18 | 24075 |
| CFTR-Intron10-5194 | + | CAAAUGCUUGACCACUUAU | 19 | 24076 |
| CFTR-Intron10-508 | + | ACAAAUGCUUGACCACUUAU | 20 | 19394 |
| CFTR-Intron10-5195 | + | CACAAAUGCUUGACCACUUAU | 21 | 24077 |
| CFTR-Intron10-5196 | + | ACACAAAUGCUUGACCACUUAU | 22 | 24078 |
| CFTR-Intron10-5197 | + | UACACAAAUGCUUGACCACUUAU | 23 | 24079 |
| CFTR-Intron10-5198 | + | GUACACAAAUGCUUGACCACUUAU | 24 | 24080 |
| CFTR-Intron10-5199 | + | AAAAAGCACUGAUUUUAU | 18 | 24081 |
| CFTR-Intron10-5200 | + | GAAAAAGCACUGAUUUUAU | 19 | 24082 |
| CFTR-Intron10-5201 | + | CGAAAAAGCACUGAUUUUAU | 20 | 24083 |
| CFTR-Intron10-5202 | + | UCGAAAAAGCACUGAUUUUAU | 21 | 24084 |
| CFTR-Intron10-5203 | + | CUCGAAAAAGCACUGAUUUUAU | 22 | 24085 |
| CFTR-Intron10-5204 | + | CCUCGAAAAAGCACUGAUUUUAU | 23 | 24086 |
| CFTR-Intron10-5205 | + | ACCUCGAAAAAGCACUGAUUUUAU | 24 | 24087 |
| CFTR-Intron10-5206 | + | ACAAAGAUUUAUAUAACU | 18 | 24088 |
| CFTR-Intron10-5207 | + | AACAAAGAUUUAUAUAACU | 19 | 24089 |
| CFTR-Intron10-5208 | + | GAACAAAGAUUUAUAUAACU | 20 | 24090 |
| CFTR-Intron10-5209 | + | UGAACAAAGAUUUAUAUAACU | 21 | 24091 |
| CFTR-Intron10-5210 | + | GUGAACAAAGAUUUAUAUAACU | 22 | 24092 |
| CFTR-Intron10-5211 | + | AGUGAACAAAGAUUUAUAUAACU | 23 | 24093 |
| CFTR-Intron10-5212 | + | CAGUGAACAAAGAUUUAUAUAACU | 24 | 24094 |
| CFTR-Intron10-5213 | + | GCCUGUAAUCCCAACACU | 18 | 24095 |
| CFTR-Intron10-5214 | + | UGCCUGUAAUCCCAACACU | 19 | 24096 |

TABLE 41E-continued

5th Tier

| gRNA Name | DNA Strand | Targeting Domain | Target Site Length | Seq ID |
|---|---|---|---|---|
| CFTR-Intron10-5215 | + | AUGCCUGUAAUCCCAACACU | 20 | 24097 |
| CFTR-Intron10-5216 | + | CAUGCCUGUAAUCCCAACACU | 21 | 24098 |
| CFTR-Intron10-5217 | + | UCAUGCCUGUAAUCCCAACACU | 22 | 24099 |
| CFTR-Intron10-5218 | + | CUCAUGCCUGUAAUCCCAACACU | 23 | 24100 |
| CFTR-Intron10-5219 | + | GCUCAUGCCUGUAAUCCCAACACU | 24 | 24101 |
| CFTR-Intron10-5220 | + | GCCUAUAAACCCAGCACU | 18 | 24102 |
| CFTR-Intron10-5221 | + | UGCCUAUAAACCCAGCACU | 19 | 24103 |
| CFTR-Intron10-5222 | + | AUGCCUAUAAACCCAGCACU | 20 | 24104 |
| CFTR-Intron10-5223 | + | CAUGCCUAUAAACCCAGCACU | 21 | 24105 |
| CFTR-Intron10-5224 | + | UCAUGCCUAUAAACCCAGCACU | 22 | 24106 |
| CFTR-Intron10-5225 | + | CUCAUGCCUAUAAACCCAGCACU | 23 | 24107 |
| CFTR-Intron10-5226 | + | GCUCAUGCCUAUAAACCCAGCACU | 24 | 24108 |
| CFTR-Intron10-5227 | + | GCCUGUAAUCCCAGCACU | 18 | 24109 |
| CFTR-Intron10-5228 | + | CGCCUGUAAUCCCAGCACU | 19 | 24110 |
| CFTR-Intron10-5229 | + | ACGCCUGUAAUCCCAGCACU | 20 | 24111 |
| CFTR-Intron10-5230 | + | CACGCCUGUAAUCCCAGCACU | 21 | 24112 |
| CFTR-Intron10-5231 | + | UCACGCCUGUAAUCCCAGCACU | 22 | 24113 |
| CFTR-Intron10-5232 | + | CUCACGCCUGUAAUCCCAGCACU | 23 | 24114 |
| CFTR-Intron10-5233 | + | GCUCACGCCUGUAAUCCCAGCACU | 24 | 24115 |
| CFTR-Intron10-5234 | + | UCCCGAGUAGCUGGGACU | 18 | 24116 |
| CFTR-Intron10-5235 | + | CUCCCGAGUAGCUGGGACU | 19 | 24117 |
| CFTR-Intron10-5236 | + | CCUCCCGAGUAGCUGGGACU | 20 | 24118 |
| CFTR-Intron10-5237 | + | GCCUCCCGAGUAGCUGGGACU | 21 | 24119 |
| CFTR-Intron10-5238 | + | AGCCUCCCGAGUAGCUGGGACU | 22 | 24120 |
| CFTR-Intron10-5239 | + | CAGCCUCCCGAGUAGCUGGGACU | 23 | 24121 |
| CFTR-Intron10-5240 | + | UCAGCCUCCCGAGUAGCUGGGACU | 24 | 24122 |
| CFTR-Intron10-5241 | + | CCUGUAGUCCCAGCUACU | 18 | 17604 |
| CFTR-Intron10-5242 | + | GCCUGUAGUCCCAGCUACU | 19 | 17605 |
| CFTR-Intron10-1344 | + | CGCCUGUAGUCCCAGCUACU | 20 | 20229 |
| CFTR-Intron10-5243 | + | GCGCCUGUAGUCCCAGCUACU | 21 | 24123 |
| CFTR-Intron10-5244 | + | GGCGCCUGUAGUCCCAGCUACU | 22 | 24124 |
| CFTR-Intron10-5245 | + | GGGCGCCUGUAGUCCCAGCUACU | 23 | 24125 |
| CFTR-Intron10-5246 | + | CGGGCGCCUGUAGUCCCAGCUACU | 24 | 24126 |
| CFTR-Intron10-1345 | + | UGCCUGUAGUCCCAGCUACU | 20 | 17606 |
| CFTR-Intron10-5247 | + | CGUGCCUGUAGUCCCAGCUACU | 22 | 24127 |
| CFTR-Intron10-5248 | + | GCGUGCCUGUAGUCCCAGCUACU | 23 | 24128 |
| CFTR-Intron10-5249 | + | UGCGUGCCUGUAGUCCCAGCUACU | 24 | 24129 |

TABLE 41E-continued

| gRNA Name | DNA Strand | Targeting Domain | Target Site Length | Seq ID |
|---|---|---|---|---|
| CFTR-Intron10-5250 | + | CUUGCUUCACCUGCUACU | 18 | 24130 |
| CFTR-Intron10-5251 | + | ACUUGCUUCACCUGCUACU | 19 | 24131 |
| CFTR-Intron10-512 | + | CACUUGCUUCACCUGCUACU | 20 | 19398 |
| CFTR-Intron10-5252 | + | GCACUUGCUUCACCUGCUACU | 21 | 24132 |
| CFTR-Intron10-5253 | + | UGCACUUGCUUCACCUGCUACU | 22 | 24133 |
| CFTR-Intron10-5254 | + | UUGCACUUGCUUCACCUGCUACU | 23 | 24134 |
| CFTR-Intron10-5255 | + | UUUGCACUUGCUUCACCUGCUACU | 24 | 24135 |
| CFTR-Intron10-5256 | + | AAUCUUAUAGAGAUUACU | 18 | 24136 |
| CFTR-Intron10-5257 | + | AAAUCUUAUAGAGAUUACU | 19 | 24137 |
| CFTR-Intron10-513 | + | AAAAUCUUAUAGAGAUUACU | 20 | 19399 |
| CFTR-Intron10-5258 | + | CAAAAUCUUAUAGAGAUUACU | 21 | 24138 |
| CFTR-Intron10-5259 | + | ACAAAAUCUUAUAGAGAUUACU | 22 | 24139 |
| CFTR-Intron10-5260 | + | AACAAAAUCUUAUAGAGAUUACU | 23 | 24140 |
| CFTR-Intron10-5261 | + | UAACAAAAUCUUAUAGAGAUUACU | 24 | 24141 |
| CFTR-Intron10-5262 | + | CCUGCAAUACCAUCACCU | 18 | 24142 |
| CFTR-Intron10-5263 | + | CCCUGCAAUACCAUCACCU | 19 | 24143 |
| CFTR-Intron10-1346 | + | ACCCUGCAAUACCAUCACCU | 20 | 20230 |
| CFTR-Intron10-5264 | + | CACCCUGCAAUACCAUCACCU | 21 | 24144 |
| CFTR-Intron10-5265 | + | CCACCCUGCAAUACCAUCACCU | 22 | 24145 |
| CFTR-Intron10-5266 | + | CCCACCCUGCAAUACCAUCACCU | 23 | 24146 |
| CFTR-Intron10-5267 | + | CCCCACCCUGCAAUACCAUCACCU | 24 | 24147 |
| CFTR-Intron10-5268 | + | AACUCAUAAGGGACCGCU | 18 | 24148 |
| CFTR-Intron10-5269 | + | AAACUCAUAAGGGACCGCU | 19 | 24149 |
| CFTR-Intron10-518 | + | AAAACUCAUAAGGGACCGCU | 20 | 19404 |
| CFTR-Intron10-5270 | + | GAAAACUCAUAAGGGACCGCU | 21 | 24150 |
| CFTR-Intron10-5271 | + | AGAAAACUCAUAAGGGACCGCU | 22 | 24151 |
| CFTR-Intron10-5272 | + | GAGAAAACUCAUAAGGGACCGCU | 23 | 24152 |
| CFTR-Intron10-5273 | + | AGAGAAAACUCAUAAGGGACCGCU | 24 | 24153 |
| CFTR-Intron10-5274 | + | CUCACAGUUCUGGAGGCU | 18 | 24154 |
| CFTR-Intron10-5275 | + | UCUCACAGUUCUGGAGGCU | 19 | 24155 |
| CFTR-Intron10-1357 | + | UUCUCACAGUUCUGGAGGCU | 20 | 20241 |
| CFTR-Intron10-5276 | + | UUUCUCACAGUUCUGGAGGCU | 21 | 24156 |
| CFTR-Intron10-5277 | + | AUUUCUCACAGUUCUGGAGGCU | 22 | 24157 |
| CFTR-Intron10-5278 | + | UAUUUCUCACAGUUCUGGAGGCU | 23 | 24158 |
| CFTR-Intron10-5279 | + | UUAUUUCUCACAGUUCUGGAGGCU | 24 | 24159 |
| CFTR-Intron10-5280 | + | UCAUCUGUUAGUAAUGCU | 18 | 24160 |
| CFTR-Intron10-5281 | + | AUCAUCUGUUAGUAAUGCU | 19 | 24161 |

TABLE 41E-continued

5th Tier

| gRNA Name | DNA Strand | Targeting Domain | Target Site Length | Seq ID |
|---|---|---|---|---|
| CFTR-Intron10-5282 | + | UAUCAUCUGUUAGUAAUGCU | 20 | 24162 |
| CFTR-Intron10-5283 | + | AUAUCAUCUGUUAGUAAUGCU | 21 | 24163 |
| CFTR-Intron10-5284 | + | AAUAUCAUCUGUUAGUAAUGCU | 22 | 24164 |
| CFTR-Intron10-5285 | + | UAAUAUCAUCUGUUAGUAAUGCU | 23 | 24165 |
| CFTR-Intron10-5286 | + | AUAAUAUCAUCUGUUAGUAAUGCU | 24 | 24166 |
| CFTR-Intron10-5287 | + | AGCAGAUUUGGGUCUGCU | 18 | 24167 |
| CFTR-Intron10-5288 | + | CAGCAGAUUUGGGUCUGCU | 19 | 24168 |
| CFTR-Intron10-5289 | + | CCAGCAGAUUUGGGUCUGCU | 20 | 24169 |
| CFTR-Intron10-5290 | + | GCCAGCAGAUUUGGGUCUGCU | 21 | 24170 |
| CFTR-Intron10-5291 | + | UGCCAGCAGAUUUGGGUCUGCU | 22 | 24171 |
| CFTR-Intron10-5292 | + | GUGCCAGCAGAUUUGGGUCUGCU | 23 | 24172 |
| CFTR-Intron10-5293 | + | GGUGCCAGCAGAUUUGGGUCUGCU | 24 | 24173 |
| CFTR-Intron10-5294 | + | AUAUAGAGAGAAACAUCU | 18 | 24174 |
| CFTR-Intron10-5295 | + | UAUAUAGAGAGAAACAUCU | 19 | 24175 |
| CFTR-Intron10-5296 | + | AUAUAUAGAGAGAAACAUCU | 20 | 24176 |
| CFTR-Intron10-5297 | + | UAUAUAUAGAGAGAAACAUCU | 21 | 24177 |
| CFTR-Intron10-5298 | + | AUAUAUAUAGAGAGAAACAUCU | 22 | 24178 |
| CFTR-Intron10-5299 | + | UAUAUAUAUAGAGAGAAACAUCU | 23 | 24179 |
| CFTR-Intron10-5300 | + | UUAUAUAUAUAGAGAGAAACAUCU | 24 | 24180 |
| CFTR-Intron10-5301 | + | AUAGAGAGAAACAUCUCU | 18 | 24181 |
| CFTR-Intron10-5302 | + | UAUAGAGAGAAACAUCUCU | 19 | 24182 |
| CFTR-Intron10-1365 | + | AUAUAGAGAGAAACAUCUCU | 20 | 20249 |
| CFTR-Intron10-5303 | + | UAUAUAGAGAGAAACAUCUCU | 21 | 24183 |
| CFTR-Intron10-5304 | + | AUAUAUAGAGAGAAACAUCUCU | 22 | 24184 |
| CFTR-Intron10-5305 | + | UAUAUAUAGAGAGAAACAUCUCU | 23 | 24185 |
| CFTR-Intron10-5306 | + | AUAUAUAUAGAGAGAAACAUCUCU | 24 | 24186 |
| CFTR-Intron10-5307 | + | AUUAAUUUUAAAAAUUCU | 18 | 24187 |
| CFTR-Intron10-5308 | + | AAUUAAUUUUAAAAAUUCU | 19 | 24188 |
| CFTR-Intron10-5309 | + | GAAUUAAUUUUAAAAAUUCU | 20 | 24189 |
| CFTR-Intron10-5310 | + | AGAAUUAAUUUUAAAAAUUCU | 21 | 24190 |
| CFTR-Intron10-5311 | + | CAGAAUUAAUUUUAAAAAUUCU | 22 | 24191 |
| CFTR-Intron10-5312 | + | GCAGAAUUAAUUUUAAAAAUUCU | 23 | 24192 |
| CFTR-Intron10-5313 | + | CGCAGAAUUAAUUUUAAAAAUUCU | 24 | 24193 |
| CFTR-Intron10-5314 | + | UAAUUUGAACAACAUUCU | 18 | 24194 |
| CFTR-Intron10-5315 | + | AUAAUUUGAACAACAUUCU | 19 | 24195 |
| CFTR-Intron10-527 | + | AAUAAUUUGAACAACAUUCU | 20 | 19413 |
| CFTR-Intron10-5316 | + | AAAUAAUUUGAACAACAUUCU | 21 | 24196 |

TABLE 41E-continued

5th Tier

| gRNA Name | DNA Strand | Targeting Domain | Target Site Length | Seq ID |
|---|---|---|---|---|
| CFTR-Intron10-5317 | + | GAAAUAAUUUGAACAACAUUCU | 22 | 24197 |
| CFTR-Intron10-5318 | + | AGAAAUAAUUUGAACAACAUUCU | 23 | 24198 |
| CFTR-Intron10-5319 | + | UAGAAAUAAUUUGAACAACAUUCU | 24 | 24199 |
| CFTR-Intron10-5320 | + | UUAGUAAACUCCGUUUCU | 18 | 24200 |
| CFTR-Intron10-5321 | + | GUUAGUAAACUCCGUUUCU | 19 | 24201 |
| CFTR-Intron10-5322 | + | AGUUAGUAAACUCCGUUUCU | 20 | 24202 |
| CFTR-Intron10-5323 | + | GAGUUAGUAAACUCCGUUUCU | 21 | 24203 |
| CFTR-Intron10-5324 | + | UGAGUUAGUAAACUCCGUUUCU | 22 | 24204 |
| CFTR-Intron10-5325 | + | UUGAGUUAGUAAACUCCGUUUCU | 23 | 24205 |
| CFTR-Intron10-5326 | + | AUUGAGUUAGUAAACUCCGUUUCU | 24 | 24206 |
| CFTR-Intron10-5327 | + | CCUGACAAUAAGAAAAGU | 18 | 24207 |
| CFTR-Intron10-5328 | + | UCCUGACAAUAAGAAAAGU | 19 | 24208 |
| CFTR-Intron10-5329 | + | GUCCUGACAAUAAGAAAAGU | 20 | 24209 |
| CFTR-Intron10-5330 | + | UGUCCUGACAAUAAGAAAAGU | 21 | 24210 |
| CFTR-Intron10-5331 | + | AUGUCCUGACAAUAAGAAAAGU | 22 | 24211 |
| CFTR-Intron10-5332 | + | UAUGUCCUGACAAUAAGAAAAGU | 23 | 24212 |
| CFTR-Intron10-5333 | + | AUAUGUCCUGACAAUAAGAAAAGU | 24 | 24213 |
| CFTR-Intron10-5334 | + | AGUGCUAGGAUUACAAGU | 18 | 24214 |
| CFTR-Intron10-5335 | + | AAGUGCUAGGAUUACAAGU | 19 | 24215 |
| CFTR-Intron10-5336 | + | AAAGUGCUAGGAUUACAAGU | 20 | 24216 |
| CFTR-Intron10-5337 | + | AAAAGUGCUAGGAUUACAAGU | 21 | 24217 |
| CFTR-Intron10-5338 | + | CAAAAGUGCUAGGAUUACAAGU | 22 | 24218 |
| CFTR-Intron10-5339 | + | CCAAAAGUGCUAGGAUUACAAGU | 23 | 24219 |
| CFTR-Intron10-5340 | + | UCCAAAAGUGCUAGGAUUACAAGU | 24 | 24220 |
| CFTR-Intron10-5341 | + | AGGAAAUGGGGUAUAAGU | 18 | 24221 |
| CFTR-Intron10-5342 | + | AAGGAAAUGGGGUAUAAGU | 19 | 24222 |
| CFTR-Intron10-5343 | + | AAAGGAAAUGGGGUAUAAGU | 20 | 24223 |
| CFTR-Intron10-5344 | + | CAAAGGAAAUGGGGUAUAAGU | 21 | 24224 |
| CFTR-Intron10-5345 | + | ACAAAGGAAAUGGGGUAUAAGU | 22 | 24225 |
| CFTR-Intron10-5346 | + | AACAAAGGAAAUGGGGUAUAAGU | 23 | 24226 |
| CFTR-Intron10-5347 | + | AAACAAAGGAAAUGGGGUAUAAGU | 24 | 24227 |
| CFTR-Intron10-5348 | + | ACAGAAAUAUUCAGCAGU | 18 | 24228 |
| CFTR-Intron10-5349 | + | GACAGAAAUAUUCAGCAGU | 19 | 24229 |
| CFTR-Intron10-5350 | + | AGACAGAAAUAUUCAGCAGU | 20 | 24230 |
| CFTR-Intron10-5351 | + | GAGACAGAAAUAUUCAGCAGU | 21 | 24231 |
| CFTR-Intron10-5352 | + | AGAGACAGAAAUAUUCAGCAGU | 22 | 24232 |
| CFTR-Intron10-5353 | + | GAGAGACAGAAAUAUUCAGCAGU | 23 | 24233 |

TABLE 41E-continued

5th Tier

| gRNA Name | DNA Strand | Targeting Domain | Target Site Length | Seq ID |
|---|---|---|---|---|
| CFTR-Intron10-5354 | + | GGAGAGACAGAAAUAUUCAGCAGU | 24 | 24234 |
| CFTR-Intron10-5355 | + | AAAGUUGUCCAAGAUAGU | 18 | 24235 |
| CFTR-Intron10-5356 | + | GAAAGUUGUCCAAGAUAGU | 19 | 24236 |
| CFTR-Intron10-120 | + | GGAAAGUUGUCCAAGAUAGU | 20 | 19006 |
| CFTR-Intron10-5357 | + | UGGAAAGUUGUCCAAGAUAGU | 21 | 24237 |
| CFTR-Intron10-5358 | + | AUGGAAAGUUGUCCAAGAUAGU | 22 | 24238 |
| CFTR-Intron10-5359 | + | UAUGGAAAGUUGUCCAAGAUAGU | 23 | 24239 |
| CFTR-Intron10-5360 | + | AUAUGGAAAGUUGUCCAAGAUAGU | 24 | 24240 |
| CFTR-Intron10-5361 | + | CUUUAUCAACAUGAAGGU | 18 | 24241 |
| CFTR-Intron10-5362 | + | CCUUUAUCAACAUGAAGGU | 19 | 24242 |
| CFTR-Intron10-5363 | + | CCCUUUAUCAACAUGAAGGU | 20 | 24243 |
| CFTR-Intron10-5364 | + | ACCCUUUAUCAACAUGAAGGU | 21 | 24244 |
| CFTR-Intron10-5365 | + | GACCCUUUAUCAACAUGAAGGU | 22 | 24245 |
| CFTR-Intron10-5366 | + | UGACCCUUUAUCAACAUGAAGGU | 23 | 24246 |
| CFTR-Intron10-5367 | + | UUGACCCUUUAUCAACAUGAAGGU | 24 | 24247 |
| CFTR-Intron10-5368 | + | UGAGGGUCUCUCUAAGGU | 18 | 24248 |
| CFTR-Intron10-5369 | + | GUGAGGGUCUCUCUAAGGU | 19 | 24249 |
| CFTR-Intron10-5370 | + | GGUGAGGGUCUCUCUAAGGU | 20 | 24250 |
| CFTR-Intron10-5371 | + | GGGUGAGGGUCUCUCUAAGGU | 21 | 24251 |
| CFTR-Intron10-5372 | + | GGGGUGAGGGUCUCUCUAAGGU | 22 | 24252 |
| CFTR-Intron10-5373 | + | AGGGGUGAGGGUCUCUCUAAGGU | 23 | 24253 |
| CFTR-Intron10-5374 | + | AAGGGGUGAGGGUCUCUCUAAGGU | 24 | 24254 |
| CFTR-Intron10-5375 | + | UUACAUAAAAGAGAGGU | 18 | 24255 |
| CFTR-Intron10-5376 | + | GUUACAUAAAAGAGAGGU | 19 | 24256 |
| CFTR-Intron10-535 | + | UGUUACAUAAAAGAGAGGU | 20 | 19421 |
| CFTR-Intron10-5377 | + | UUGUUACAUAAAAGAGAGGU | 21 | 24257 |
| CFTR-Intron10-5378 | + | AUUGUUACAUAAAAGAGAGGU | 22 | 24258 |
| CFTR-Intron10-5379 | + | UAUUGUUACAUAAAAGAGAGGU | 23 | 24259 |
| CFTR-Intron10-5380 | + | AUAUUGUUACAUAAAAGAGAGGU | 24 | 24260 |
| CFTR-Intron10-5381 | + | GCGGGCGGAUCACGAGGU | 18 | 24261 |
| CFTR-Intron10-5382 | + | GGCGGGCGGAUCACGAGGU | 19 | 24262 |
| CFTR-Intron10-5383 | + | AGGCGGGCGGAUCACGAGGU | 20 | 24263 |
| CFTR-Intron10-5384 | + | GAGGCGGGCGGAUCACGAGGU | 21 | 24264 |
| CFTR-Intron10-5385 | + | CGAGGCGGGCGGAUCACGAGGU | 22 | 24265 |
| CFTR-Intron10-5386 | + | CCGAGGCGGGCGGAUCACGAGGU | 23 | 24266 |
| CFTR-Intron10-5387 | + | GCCGAGGCGGGCGGAUCACGAGGU | 24 | 24267 |
| CFTR-Intron10-5388 | + | UAUAUUCUUUUAUGUGGU | 18 | 24268 |

TABLE 41E-continued

5th Tier

| gRNA Name | DNA Strand | Targeting Domain | Target Site Length | Seq ID |
|---|---|---|---|---|
| CFTR-Intron10-5389 | + | AUAUAUUCUUUUAUGUGGU | 19 | 24269 |
| CFTR-Intron10-5390 | + | AAUAUAUUCUUUUAUGUGGU | 20 | 24270 |
| CFTR-Intron10-5391 | + | GAAUAUAUUCUUUUAUGUGGU | 21 | 24271 |
| CFTR-Intron10-5392 | + | CGAAUAUAUUCUUUUAUGUGGU | 22 | 24272 |
| CFTR-Intron10-5393 | + | ACGAAUAUAUUCUUUUAUGUGGU | 23 | 24273 |
| CFTR-Intron10-5394 | + | CACGAAUAUAUUCUUUUAUGUGGU | 24 | 24274 |
| CFTR-Intron10-5395 | + | AAAAGCUGUUUCGUAUGU | 18 | 24275 |
| CFTR-Intron10-5396 | + | UAAAAGCUGUUUCGUAUGU | 19 | 24276 |
| CFTR-Intron10-539 | + | UUAAAAGCUGUUUCGUAUGU | 20 | 19425 |
| CFTR-Intron10-5397 | + | UUUAAAAGCUGUUUCGUAUGU | 21 | 24277 |
| CFTR-Intron10-5398 | + | UUUUAAAAGCUGUUUCGUAUGU | 22 | 24278 |
| CFTR-Intron10-5399 | + | GUUUUAAAAGCUGUUUCGUAUGU | 23 | 24279 |
| CFTR-Intron10-5400 | + | UGUUUUAAAAGCUGUUUCGUAUGU | 24 | 24280 |
| CFTR-Intron10-5401 | + | AUCUGUUAGUAAUGCUGU | 18 | 24281 |
| CFTR-Intron10-5402 | + | CAUCUGUUAGUAAUGCUGU | 19 | 24282 |
| CFTR-Intron10-540 | + | UCAUCUGUUAGUAAUGCUGU | 20 | 19426 |
| CFTR-Intron10-5403 | + | AUCAUCUGUUAGUAAUGCUGU | 21 | 24283 |
| CFTR-Intron10-5404 | + | UAUCAUCUGUUAGUAAUGCUGU | 22 | 24284 |
| CFTR-Intron10-5405 | + | AUAUCAUCUGUUAGUAAUGCUGU | 23 | 24285 |
| CFTR-Intron10-5406 | + | AAUAUCAUCUGUUAGUAAUGCUGU | 24 | 24286 |
| CFTR-Intron10-5407 | + | AUAGAGACAAGGUGGUGU | 18 | 24287 |
| CFTR-Intron10-5408 | + | AAUAGAGACAAGGUGGUGU | 19 | 24288 |
| CFTR-Intron10-5409 | + | UAAUAGAGACAAGGUGGUGU | 20 | 24289 |
| CFTR-Intron10-5410 | + | AUAAUAGAGACAAGGUGGUGU | 21 | 24290 |
| CFTR-Intron10-5411 | + | AAUAAUAGAGACAAGGUGGUGU | 22 | 24291 |
| CFTR-Intron10-5412 | + | CAAUAAUAGAGACAAGGUGGUGU | 23 | 24292 |
| CFTR-Intron10-5413 | + | UCAAUAAUAGAGACAAGGUGGUGU | 24 | 24293 |
| CFTR-Intron10-5414 | + | GAAAGAAAAUGUUUUUGU | 18 | 24294 |
| CFTR-Intron10-5415 | + | AGAAAGAAAAUGUUUUUGU | 19 | 24295 |
| CFTR-Intron10-5416 | + | AAGAAAGAAAAUGUUUUUGU | 20 | 24296 |
| CFTR-Intron10-5417 | + | UAAGAAAGAAAAUGUUUUUGU | 21 | 24297 |
| CFTR-Intron10-5418 | + | UUAAGAAAGAAAAUGUUUUUGU | 22 | 24298 |
| CFTR-Intron10-5419 | + | UUUAAGAAAGAAAAUGUUUUUGU | 23 | 24299 |
| CFTR-Intron10-5420 | + | UUUUAAGAAAGAAAAUGUUUUUGU | 24 | 24300 |
| CFTR-Intron10-5421 | + | UGGCUUAACCCAUCUAUU | 18 | 24301 |
| CFTR-Intron10-5422 | + | UUGGCUUAACCCAUCUAUU | 19 | 24302 |
| CFTR-Intron10-5423 | + | GUUGGCUUAACCCAUCUAUU | 20 | 24303 |

TABLE 41E-continued

| | | 5th Tier | | |
|---|---|---|---|---|
| gRNA Name | DNA Strand | Targeting Domain | Target Site Length | Seq ID |
| CFTR-Intron10-5424 | + | AGUUGGCUUAACCCAUCUAUU | 21 | 24304 |
| CFTR-Intron10-5425 | + | CAGUUGGCUUAACCCAUCUAUU | 22 | 24305 |
| CFTR-Intron10-5426 | + | UCAGUUGGCUUAACCCAUCUAUU | 23 | 24306 |
| CFTR-Intron10-5427 | + | UUCAGUUGGCUUAACCCAUCUAUU | 24 | 24307 |
| CFTR-Intron10-5428 | + | AUAAUUCUAGAAAGUAUU | 18 | 24308 |
| CFTR-Intron10-5429 | + | UAUAAUUCUAGAAAGUAUU | 19 | 24309 |
| CFTR-Intron10-5430 | + | GUAUAAUUCUAGAAAGUAUU | 20 | 24310 |
| CFTR-Intron10-5431 | + | GGUAUAAUUCUAGAAAGUAUU | 21 | 24311 |
| CFTR-Intron10-5432 | + | CGGUAUAAUUCUAGAAAGUAUU | 22 | 24312 |
| CFTR-Intron10-5433 | + | UCGGUAUAAUUCUAGAAAGUAUU | 23 | 24313 |
| CFTR-Intron10-5434 | + | UUCGGUAUAAUUCUAGAAAGUAUU | 24 | 24314 |
| CFTR-Intron10-5435 | + | UUUAUUUAUUUAUUUAUU | 18 | 24315 |
| CFTR-Intron10-5436 | + | AUUUAUUUAUUUAUUUAUU | 19 | 24316 |
| CFTR-Intron10-5437 | + | UAUUUAUUUAUUUAUUUAUU | 20 | 24317 |
| CFTR-Intron10-5438 | + | UUAUUUAUUUAUUUAUUUAUU | 21 | 24318 |
| CFTR-Intron10-5439 | + | UUUAUUUAUUUAUUUAUUUAUU | 22 | 24319 |
| CFTR-Intron10-5440 | + | AUUUAUUUAUUUAUUUAUUUAUU | 23 | 24320 |
| CFTR-Intron10-5441 | + | UAUUUAUUUAUUUAUUUAUUUAUU | 24 | 24321 |
| CFTR-Intron10-5442 | + | UUUGCUGAUUGCUUUAUU | 18 | 24322 |
| CFTR-Intron10-5443 | + | AUUUGCUGAUUGCUUUAUU | 19 | 24323 |
| CFTR-Intron10-5444 | + | AAUUUGCUGAUUGCUUUAUU | 20 | 24324 |
| CFTR-Intron10-5445 | + | AAAUUUGCUGAUUGCUUUAUU | 21 | 24325 |
| CFTR-Intron10-5446 | + | GAAAUUUGCUGAUUGCUUUAUU | 22 | 24326 |
| CFTR-Intron10-5447 | + | GGAAAUUUGCUGAUUGCUUUAUU | 23 | 24327 |
| CFTR-Intron10-5448 | + | AGGAAAUUUGCUGAUUGCUUUAUU | 24 | 24328 |
| CFTR-Intron10-5449 | + | CCUGUAAUCCCAACACUU | 18 | 24329 |
| CFTR-Intron10-5450 | + | GCCUGUAAUCCCAACACUU | 19 | 24330 |
| CFTR-Intron10-1391 | + | UGCCUGUAAUCCCAACACUU | 20 | 20275 |
| CFTR-Intron10-5451 | + | AUGCCUGUAAUCCCAACACUU | 21 | 24331 |
| CFTR-Intron10-5452 | + | CAUGCCUGUAAUCCCAACACUU | 22 | 24332 |
| CFTR-Intron10-5453 | + | UCAUGCCUGUAAUCCCAACACUU | 23 | 24333 |
| CFTR-Intron10-5454 | + | CUCAUGCCUGUAAUCCCAACACUU | 24 | 24334 |
| CFTR-Intron10-5455 | + | CCUAUAAACCCAGCACUU | 18 | 24335 |
| CFTR-Intron10-5456 | + | GCCUAUAAACCCAGCACUU | 19 | 24336 |
| CFTR-Intron10-1392 | + | UGCCUAUAAACCCAGCACUU | 20 | 20276 |
| CFTR-Intron10-5457 | + | AUGCCUAUAAACCCAGCACUU | 21 | 24337 |
| CFTR-Intron10-5458 | + | CAUGCCUAUAAACCCAGCACUU | 22 | 24338 |

TABLE 41E-continued

5th Tier

| gRNA Name | DNA Strand | Targeting Domain | Target Site Length | Seq ID |
|---|---|---|---|---|
| CFTR-Intron10-5459 | + | UCAUGCCUAUAAACCCAGCACUU | 23 | 24339 |
| CFTR-Intron10-5460 | + | CUCAUGCCUAUAAACCCAGCACUU | 24 | 24340 |
| CFTR-Intron10-5461 | + | CCUGUAAUCCCAGCACUU | 18 | 24341 |
| CFTR-Intron10-5462 | + | GCCUGUAAUCCCAGCACUU | 19 | 24342 |
| CFTR-Intron10-1393 | + | CGCCUGUAAUCCCAGCACUU | 20 | 20277 |
| CFTR-Intron10-5463 | + | ACGCCUGUAAUCCCAGCACUU | 21 | 24343 |
| CFTR-Intron10-5464 | + | CACGCCUGUAAUCCCAGCACUU | 22 | 24344 |
| CFTR-Intron10-5465 | + | UCACGCCUGUAAUCCCAGCACUU | 23 | 24345 |
| CFTR-Intron10-5466 | + | CUCACGCCUGUAAUCCCAGCACUU | 24 | 24346 |
| CFTR-Intron10-5467 | + | GAACCAUUUUAUAGACUU | 18 | 24347 |
| CFTR-Intron10-5468 | + | GGAACCAUUUUAUAGACUU | 19 | 24348 |
| CFTR-Intron10-5469 | + | AGGAACCAUUUUAUAGACUU | 20 | 24349 |
| CFTR-Intron10-5470 | + | AAGGAACCAUUUUAUAGACUU | 21 | 24350 |
| CFTR-Intron10-5471 | + | CAAGGAACCAUUUUAUAGACUU | 22 | 24351 |
| CFTR-Intron10-5472 | + | ACAAGGAACCAUUUUAUAGACUU | 23 | 24352 |
| CFTR-Intron10-5473 | + | AACAAGGAACCAUUUUAUAGACUU | 24 | 24353 |
| CFTR-Intron10-5474 | + | CUGUAGUCCCAGCUACUU | 18 | 24354 |
| CFTR-Intron10-5475 | + | CCUGUAGUCCCAGCUACUU | 19 | 24355 |
| CFTR-Intron10-720 | + | GCCUGUAGUCCCAGCUACUU | 20 | 19606 |
| CFTR-Intron10-5476 | + | CGCCUGUAGUCCCAGCUACUU | 21 | 24356 |
| CFTR-Intron10-5477 | + | GCGCCUGUAGUCCCAGCUACUU | 22 | 24357 |
| CFTR-Intron10-5478 | + | GGCGCCUGUAGUCCCAGCUACUU | 23 | 24358 |
| CFTR-Intron10-5479 | + | GGGCGCCUGUAGUCCCAGCUACUU | 24 | 24359 |
| CFTR-Intron10-5480 | + | UGCCUGUAGUCCCAGCUACUU | 21 | 24360 |
| CFTR-Intron10-5481 | + | GUGCCUGUAGUCCCAGCUACUU | 22 | 24361 |
| CFTR-Intron10-5482 | + | CGUGCCUGUAGUCCCAGCUACUU | 23 | 24362 |
| CFTR-Intron10-5483 | + | GCGUGCCUGUAGUCCCAGCUACUU | 24 | 24363 |
| CFTR-Intron10-5484 | + | AAUUUAUUUCUCACAGUU | 18 | 24364 |
| CFTR-Intron10-5485 | + | GAAUUUAUUUCUCACAGUU | 19 | 24365 |
| CFTR-Intron10-5486 | + | GGAAUUUAUUUCUCACAGUU | 20 | 24366 |
| CFTR-Intron10-5487 | + | AGGAAUUUAUUUCUCACAGUU | 21 | 24367 |
| CFTR-Intron10-5488 | + | CAGGAAUUUAUUUCUCACAGUU | 22 | 24368 |
| CFTR-Intron10-5489 | + | ACAGGAAUUUAUUUCUCACAGUU | 23 | 24369 |
| CFTR-Intron10-5490 | + | AACAGGAAUUUAUUUCUCACAGUU | 24 | 24370 |
| CFTR-Intron10-5491 | + | CUUGACAUCAGUUGGGUU | 18 | 24371 |
| CFTR-Intron10-5492 | + | GCUUGACAUCAGUUGGGUU | 19 | 24372 |
| CFTR-Intron10-5493 | + | UGCUUGACAUCAGUUGGGUU | 20 | 24373 |

TABLE 41E-continued

5th Tier

| gRNA Name | DNA Strand | Targeting Domain | Target Site Length | Seq ID |
|---|---|---|---|---|
| CFTR-Intron10-5494 | + | CUGCUUGACAUCAGUUGGGUU | 21 | 24374 |
| CFTR-Intron10-5495 | + | UCUGCUUGACAUCAGUUGGGUU | 22 | 24375 |
| CFTR-Intron10-5496 | + | UUCUGCUUGACAUCAGUUGGGUU | 23 | 24376 |
| CFTR-Intron10-5497 | + | CUUCUGCUUGACAUCAGUUGGGUU | 24 | 24377 |
| CFTR-Intron10-5498 | + | AAAAUAUACCCAAAAUUU | 18 | 24378 |
| CFTR-Intron10-5499 | + | UAAAAUAUACCCAAAAUUU | 19 | 24379 |
| CFTR-Intron10-5500 | + | AUAAAAUAUACCCAAAAUUU | 20 | 24380 |
| CFTR-Intron10-5501 | + | UAUAAAAUAUACCCAAAAUUU | 21 | 24381 |
| CFTR-Intron10-5502 | + | AUAUAAAAUAUACCCAAAAUUU | 22 | 24382 |
| CFTR-Intron10-5503 | + | AAUAUAAAAUAUACCCAAAAUUU | 23 | 24383 |
| CFTR-Intron10-5504 | + | AAAUAUAAAAUAUACCCAAAAUUU | 24 | 24384 |
| CFTR-Intron10-5505 | + | ACGAAUUGGUACAAAUUU | 18 | 24385 |
| CFTR-Intron10-5506 | + | UACGAAUUGGUACAAAUUU | 19 | 24386 |
| CFTR-Intron10-5507 | + | GUACGAAUUGGUACAAAUUU | 20 | 24387 |
| CFTR-Intron10-5508 | + | AGUACGAAUUGGUACAAAUUU | 21 | 24388 |
| CFTR-Intron10-5509 | + | GAGUACGAAUUGGUACAAAUUU | 22 | 24389 |
| CFTR-Intron10-5510 | + | UGAGUACGAAUUGGUACAAAUUU | 23 | 24390 |
| CFTR-Intron10-5511 | + | AUGAGUACGAAUUGGUACAAAUUU | 24 | 24391 |
| CFTR-Intron10-5512 | + | CCCUAUUAUUCAACAUUU | 18 | 24392 |
| CFTR-Intron10-5513 | + | CCCCUAUUAUUCAACAUUU | 19 | 24393 |
| CFTR-Intron10-5514 | + | ACCCCUAUUAUUCAACAUUU | 20 | 24394 |
| CFTR-Intron10-5515 | + | AACCCCUAUUAUUCAACAUUU | 21 | 24395 |
| CFTR-Intron10-5516 | + | AAACCCCUAUUAUUCAACAUUU | 22 | 24396 |
| CFTR-Intron10-5517 | + | CAAACCCCUAUUAUUCAACAUUU | 23 | 24397 |
| CFTR-Intron10-5518 | + | UCAAACCCCUAUUAUUCAACAUUU | 24 | 24398 |
| CFTR-Intron10-5519 | + | UCUAUUCAAAAAAUAUUU | 18 | 24399 |
| CFTR-Intron10-5520 | + | AUCUAUUCAAAAAAUAUUU | 19 | 24400 |
| CFTR-Intron10-5521 | + | AAUCUAUUCAAAAAAUAUUU | 20 | 24401 |
| CFTR-Intron10-5522 | + | UAAUCUAUUCAAAAAAUAUUU | 21 | 24402 |
| CFTR-Intron10-5523 | + | CUAAUCUAUUCAAAAAAUAUUU | 22 | 24403 |
| CFTR-Intron10-5524 | + | GCUAAUCUAUUCAAAAAAUAUUU | 23 | 24404 |
| CFTR-Intron10-5525 | + | AGCUAAUCUAUUCAAAAAAUAUUU | 24 | 24405 |
| CFTR-Intron10-5526 | + | CGAGUUAUCUCCGUAUUU | 18 | 24406 |
| CFTR-Intron10-5527 | + | ACGAGUUAUCUCCGUAUUU | 19 | 24407 |
| CFTR-Intron10-5528 | + | CACGAGUUAUCUCCGUAUUU | 20 | 24408 |
| CFTR-Intron10-5529 | + | UCACGAGUUAUCUCCGUAUUU | 21 | 24409 |
| CFTR-Intron10-5530 | + | GUCACGAGUUAUCUCCGUAUUU | 22 | 24410 |

TABLE 41E-continued

5th Tier

| gRNA Name | DNA Strand | Targeting Domain | Target Site Length | Seq ID |
|---|---|---|---|---|
| CFTR-Intron10-5531 | + | AGUCACGAGUUAUCUCCGUAUUU | 23 | 24411 |
| CFTR-Intron10-5532 | + | AAGUCACGAGUUAUCUCCGUAUUU | 24 | 24412 |
| CFTR-Intron10-5533 | + | CUGUAAUCCCAACACUUU | 18 | 24413 |
| CFTR-Intron10-5534 | + | CCUGUAAUCCCAACACUUU | 19 | 24414 |
| CFTR-Intron10-722 | + | GCCUGUAAUCCCAACACUUU | 20 | 19608 |
| CFTR-Intron10-5535 | + | UGCCUGUAAUCCCAACACUUU | 21 | 24415 |
| CFTR-Intron10-5536 | + | AUGCCUGUAAUCCCAACACUUU | 22 | 24416 |
| CFTR-Intron10-5537 | + | CAUGCCUGUAAUCCCAACACUUU | 23 | 24417 |
| CFTR-Intron10-5538 | + | UCAUGCCUGUAAUCCCAACACUUU | 24 | 24418 |
| CFTR-Intron10-5539 | + | CUAUAAACCCAGCACUUU | 18 | 24419 |
| CFTR-Intron10-5540 | + | CCUAUAAACCCAGCACUUU | 19 | 24420 |
| CFTR-Intron10-723 | + | GCCUAUAAACCCAGCACUUU | 20 | 19609 |
| CFTR-Intron10-5541 | + | UGCCUAUAAACCCAGCACUUU | 21 | 24421 |
| CFTR-Intron10-5542 | + | AUGCCUAUAAACCCAGCACUUU | 22 | 24422 |
| CFTR-Intron10-5543 | + | CAUGCCUAUAAACCCAGCACUUU | 23 | 24423 |
| CFTR-Intron10-5544 | + | UCAUGCCUAUAAACCCAGCACUUU | 24 | 24424 |
| CFTR-Intron10-5545 | + | CUGUAAUCCCAGCACUUU | 18 | 24425 |
| CFTR-Intron10-5546 | + | CCUGUAAUCCCAGCACUUU | 19 | 24426 |
| CFTR-Intron10-724 | + | GCCUGUAAUCCCAGCACUUU | 20 | 19610 |
| CFTR-Intron10-5547 | + | CGCCUGUAAUCCCAGCACUUU | 21 | 24427 |
| CFTR-Intron10-5548 | + | ACGCCUGUAAUCCCAGCACUUU | 22 | 24428 |
| CFTR-Intron10-5549 | + | CACGCCUGUAAUCCCAGCACUUU | 23 | 24429 |
| CFTR-Intron10-5550 | + | UCACGCCUGUAAUCCCAGCACUUU | 24 | 24430 |
| CFTR-Intron10-5551 | + | UGAUAAAUAAUUGCCUUU | 18 | 24431 |
| CFTR-Intron10-5552 | + | UUGAUAAAUAAUUGCCUUU | 19 | 24432 |
| CFTR-Intron10-5553 | + | AUUGAUAAAUAAUUGCCUUU | 20 | 24433 |
| CFTR-Intron10-5554 | + | UAUUGAUAAAUAAUUGCCUUU | 21 | 24434 |
| CFTR-Intron10-5555 | + | AUAUUGAUAAAUAAUUGCCUUU | 22 | 24435 |
| CFTR-Intron10-5556 | + | GAUAUUGAUAAAUAAUUGCCUUU | 23 | 24436 |
| CFTR-Intron10-5557 | + | AGAUAUUGAUAAAUAAUUGCCUUU | 24 | 24437 |
| CFTR-Intron10-5558 | + | AAAUAAGCCUUAGUCUUU | 18 | 24438 |
| CFTR-Intron10-5559 | + | GAAAUAAGCCUUAGUCUUU | 19 | 24439 |
| CFTR-Intron10-5560 | + | AGAAAUAAGCCUUAGUCUUU | 20 | 24440 |
| CFTR-Intron10-5561 | + | GAGAAAUAAGCCUUAGUCUUU | 21 | 24441 |
| CFTR-Intron10-5562 | + | AGAGAAAUAAGCCUUAGUCUUU | 22 | 24442 |
| CFTR-Intron10-5563 | + | CAGAGAAAUAAGCCUUAGUCUUU | 23 | 24443 |
| CFTR-Intron10-5564 | + | CCAGAGAAAUAAGCCUUAGUCUUU | 24 | 24444 |

TABLE 41E-continued

5th Tier

| gRNA Name | DNA Strand | Targeting Domain | Target Site Length | Seq ID |
|---|---|---|---|---|
| CFTR-Intron10-5565 | + | AGAAAAUUUGUUUUCUUU | 18 | 24445 |
| CFTR-Intron10-5566 | + | AAGAAAAUUUGUUUUCUUU | 19 | 24446 |
| CFTR-Intron10-5567 | + | AAAGAAAAUUUGUUUUCUUU | 20 | 24447 |
| CFTR-Intron10-5568 | + | CAAAGAAAAUUUGUUUUCUUU | 21 | 24448 |
| CFTR-Intron10-5569 | + | ACAAAGAAAAUUUGUUUUCUUU | 22 | 24449 |
| CFTR-Intron10-5570 | + | AACAAAGAAAAUUUGUUUUCUUU | 23 | 24450 |
| CFTR-Intron10-5571 | + | AAACAAAGAAAAUUUGUUUUCUUU | 24 | 24451 |
| CFTR-Intron10-5572 | + | GAAAAAUAAUAACAUUUU | 18 | 24452 |
| CFTR-Intron10-5573 | + | AGAAAAAUAAUAACAUUUU | 19 | 24453 |
| CFTR-Intron10-5574 | + | AAGAAAAAUAAUAACAUUUU | 20 | 24454 |
| CFTR-Intron10-5575 | + | AAAGAAAAAUAAUAACAUUUU | 21 | 24455 |
| CFTR-Intron10-5576 | + | AAAAGAAAAAUAAUAACAUUUU | 22 | 24456 |
| CFTR-Intron10-5577 | + | UAAAAGAAAAAUAAUAACAUUUU | 23 | 24457 |
| CFTR-Intron10-5578 | + | AUAAAAGAAAAAUAAUAACAUUUU | 24 | 24458 |
| CFTR-Intron10-5579 | + | AUACAUACAUAUGAUUUU | 18 | 24459 |
| CFTR-Intron10-5580 | + | UAUACAUACAUAUGAUUUU | 19 | 24460 |
| CFTR-Intron10-5581 | + | AUAUACAUACAUAUGAUUUU | 20 | 24461 |
| CFTR-Intron10-5582 | + | UAUAUACAUACAUAUGAUUUU | 21 | 24462 |
| CFTR-Intron10-5583 | + | AUAUAUACAUACAUAUGAUUUU | 22 | 24463 |
| CFTR-Intron10-5584 | + | CAUAUAUACAUACAUAUGAUUUU | 23 | 24464 |
| CFTR-Intron10-5585 | + | ACAUAUAUACAUACAUAUGAUUUU | 24 | 24465 |
| CFTR-Intron10-5586 | + | CACCAAUUUUUUUUUUU | 18 | 24466 |
| CFTR-Intron10-5587 | + | ACACCAAUUUUUUUUUUU | 19 | 24467 |
| CFTR-Intron10-5588 | + | AACACCAAUUUUUUUUUUU | 20 | 24468 |
| CFTR-Intron10-5589 | + | AAACACCAAUUUUUUUUUUU | 21 | 24469 |
| CFTR-Intron10-5590 | + | CAAACACCAAUUUUUUUUUUU | 22 | 24470 |
| CFTR-Intron10-5591 | + | GCAAACACCAAUUUUUUUUUUU | 23 | 24471 |
| CFTR-Intron10-5592 | + | UGCAAACACCAAUUUUUUUUUUU | 24 | 24472 |
| CFTR-Intron10-5593 | − | UAAAAAUGUUAAUGAAAA | 18 | 24473 |
| CFTR-Intron10-5594 | − | GUAAAAAUGUUAAUGAAAA | 19 | 24474 |
| CFTR-Intron10-5595 | − | GGUAAAAAUGUUAAUGAAAA | 20 | 24475 |
| CFTR-Intron10-5596 | − | AGGUAAAAAUGUUAAUGAAAA | 21 | 24476 |
| CFTR-Intron10-5597 | − | UAGGUAAAAAUGUUAAUGAAAA | 22 | 24477 |
| CFTR-Intron10-5598 | − | GUAGGUAAAAAUGUUAAUGAAAA | 23 | 24478 |
| CFTR-Intron10-5599 | − | UGUAGGUAAAAAUGUUAAUGAAAA | 24 | 24479 |
| CFTR-Intron10-5600 | − | AUUUAUUAAAAUUUAAAA | 18 | 24480 |
| CFTR-Intron10-5601 | − | UAUUUAUUAAAAUUUAAAA | 19 | 24481 |

TABLE 41E-continued

5th Tier

| gRNA Name | DNA Strand | Targeting Domain | Target Site Length | Seq ID |
|---|---|---|---|---|
| CFTR-Intron10-5602 | - | UUAUUUAUUAAAAUUUAAAA | 20 | 24482 |
| CFTR-Intron10-5603 | - | AUUAUUUAUUAAAAUUUAAAA | 21 | 24483 |
| CFTR-Intron10-5604 | - | UAUUAUUUAUUAAAAUUUAAAA | 22 | 24484 |
| CFTR-Intron10-5605 | - | AUAUUAUUUAUUAAAAUUUAAAA | 23 | 24485 |
| CFTR-Intron10-5606 | - | GAUAUUAUUUAUUAAAAUUUAAAA | 24 | 24486 |
| CFTR-Intron10-5607 | - | CGAAUAAUCUAAGACAAA | 18 | 24487 |
| CFTR-Intron10-5608 | - | CCGAAUAAUCUAAGACAAA | 19 | 24488 |
| CFTR-Intron10-5609 | - | ACCGAAUAAUCUAAGACAAA | 20 | 24489 |
| CFTR-Intron10-5610 | - | UACCGAAUAAUCUAAGACAAA | 21 | 24490 |
| CFTR-Intron10-5611 | - | AUACCGAAUAAUCUAAGACAAA | 22 | 24491 |
| CFTR-Intron10-5612 | - | UAUACCGAAUAAUCUAAGACAAA | 23 | 24492 |
| CFTR-Intron10-5613 | - | UUAUACCGAAUAAUCUAAGACAAA | 24 | 24493 |
| CFTR-Intron10-5614 | - | GCCUAUUUGACAUCCAAA | 18 | 24494 |
| CFTR-Intron10-5615 | - | UGCCUAUUUGACAUCCAAA | 19 | 24495 |
| CFTR-Intron10-5616 | - | AUGCCUAUUUGACAUCCAAA | 20 | 24496 |
| CFTR-Intron10-5617 | - | AAUGCCUAUUUGACAUCCAAA | 21 | 24497 |
| CFTR-Intron10-5618 | - | AAAUGCCUAUUUGACAUCCAAA | 22 | 24498 |
| CFTR-Intron10-5619 | - | GAAAUGCCUAUUUGACAUCCAAA | 23 | 24499 |
| CFTR-Intron10-5620 | - | UGAAAUGCCUAUUUGACAUCCAAA | 24 | 24500 |
| CFTR-Intron10-5621 | - | GACAAACAGAAAAGAAA | 18 | 24501 |
| CFTR-Intron10-5622 | - | AGACAAACAGAAAAGAAA | 19 | 24502 |
| CFTR-Intron10-5623 | - | AAGACAAACAGAAAAGAAA | 20 | 24503 |
| CFTR-Intron10-5624 | - | UAAGACAAACAGAAAAGAAA | 21 | 24504 |
| CFTR-Intron10-5625 | - | CUAAGACAAACAGAAAAGAAA | 22 | 24505 |
| CFTR-Intron10-5626 | - | UCUAAGACAAACAGAAAAGAAA | 23 | 24506 |
| CFTR-Intron10-5627 | - | AUCUAAGACAAACAGAAAAGAAA | 24 | 24507 |
| CFTR-Intron10-5628 | - | AUCUAAGACAAACAGAAA | 18 | 24508 |
| CFTR-Intron10-5629 | - | AAUCUAAGACAAACAGAAA | 19 | 24509 |
| CFTR-Intron10-5630 | - | UAAUCUAAGACAAACAGAAA | 20 | 24510 |
| CFTR-Intron10-5631 | - | AUAAUCUAAGACAAACAGAAA | 21 | 24511 |
| CFTR-Intron10-5632 | - | AAUAAUCUAAGACAAACAGAAA | 22 | 24512 |
| CFTR-Intron10-5633 | - | GAAUAAUCUAAGACAAACAGAAA | 23 | 24513 |
| CFTR-Intron10-5634 | - | CGAAUAAUCUAAGACAAACAGAAA | 24 | 24514 |
| CFTR-Intron10-5635 | - | GGCACCAUUCACAGUAAA | 18 | 24515 |
| CFTR-Intron10-5636 | - | UGGCACCAUUCACAGUAAA | 19 | 24516 |
| CFTR-Intron10-5637 | - | CUGGCACCAUUCACAGUAAA | 20 | 24517 |
| CFTR-Intron10-5638 | - | CCUGGCACCAUUCACAGUAAA | 21 | 24518 |

TABLE 41E-continued

5th Tier

| gRNA Name | DNA Strand | Targeting Domain | Target Site Length | Seq ID |
|---|---|---|---|---|
| CFTR-Intron10-5639 | - | ACCUGGCACCAUUCACAGUAAA | 22 | 24519 |
| CFTR-Intron10-5640 | - | UACCUGGCACCAUUCACAGUAAA | 23 | 24520 |
| CFTR-Intron10-5641 | - | CUACCUGGCACCAUUCACAGUAAA | 24 | 24521 |
| CFTR-Intron10-5642 | - | CCACUGGAGAGUUUUAAA | 18 | 24522 |
| CFTR-Intron10-5643 | - | GCCACUGGAGAGUUUUAAA | 19 | 24523 |
| CFTR-Intron10-5644 | - | GGCCACUGGAGAGUUUUAAA | 20 | 24524 |
| CFTR-Intron10-5645 | - | AGGCCACUGGAGAGUUUUAAA | 21 | 24525 |
| CFTR-Intron10-5646 | - | GAGGCCACUGGAGAGUUUUAAA | 22 | 24526 |
| CFTR-Intron10-5647 | - | AGAGGCCACUGGAGAGUUUUAAA | 23 | 24527 |
| CFTR-Intron10-5648 | - | UAGAGGCCACUGGAGAGUUUUAAA | 24 | 24528 |
| CFTR-Intron10-5649 | - | UACAAAAAACACAAACAA | 18 | 24529 |
| CFTR-Intron10-5650 | - | CUACAAAAAACACAAACAA | 19 | 24530 |
| CFTR-Intron10-5651 | - | UCUACAAAAAACACAAACAA | 20 | 24531 |
| CFTR-Intron10-5652 | - | CUCUACAAAAAACACAAACAA | 21 | 24532 |
| CFTR-Intron10-5653 | - | CCUCUACAAAAAACACAAACAA | 22 | 24533 |
| CFTR-Intron10-5654 | - | ACCUCUACAAAAAACACAAACAA | 23 | 24534 |
| CFTR-Intron10-5655 | - | CACCUCUACAAAAAACACAAACAA | 24 | 24535 |
| CFTR-Intron10-5656 | - | UAAAGACUGUUGUAACAA | 18 | 24536 |
| CFTR-Intron10-5657 | - | AUAAAGACUGUUGUAACAA | 19 | 24537 |
| CFTR-Intron10-5658 | - | UAUAAAGACUGUUGUAACAA | 20 | 24538 |
| CFTR-Intron10-5659 | - | GUAUAAAGACUGUUGUAACAA | 21 | 24539 |
| CFTR-Intron10-5660 | - | AGUAUAAAGACUGUUGUAACAA | 22 | 24540 |
| CFTR-Intron10-5661 | - | CAGUAUAAAGACUGUUGUAACAA | 23 | 24541 |
| CFTR-Intron10-5662 | - | CCAGUAUAAAGACUGUUGUAACAA | 24 | 24542 |
| CFTR-Intron10-5663 | - | UAUUCUGUAGGGAGACAA | 18 | 24543 |
| CFTR-Intron10-5664 | - | CUAUUCUGUAGGGAGACAA | 19 | 24544 |
| CFTR-Intron10-66 | - | GCUAUUCUGUAGGGAGACAA | 20 | 18952 |
| CFTR-Intron10-5665 | - | GGCUAUUCUGUAGGGAGACAA | 21 | 24545 |
| CFTR-Intron10-5666 | - | AGGCUAUUCUGUAGGGAGACAA | 22 | 24546 |
| CFTR-Intron10-5667 | - | UAGGCUAUUCUGUAGGGAGACAA | 23 | 24547 |
| CFTR-Intron10-5668 | - | UUAGGCUAUUCUGUAGGGAGACAA | 24 | 24548 |
| CFTR-Intron10-5669 | - | AUAGAUGGGUUAAGCCAA | 18 | 24549 |
| CFTR-Intron10-5670 | - | AAUAGAUGGGUUAAGCCAA | 19 | 24550 |
| CFTR-Intron10-5671 | - | UAAUAGAUGGGUUAAGCCAA | 20 | 24551 |
| CFTR-Intron10-5672 | - | UUAAUAGAUGGGUUAAGCCAA | 21 | 24552 |
| CFTR-Intron10-5673 | - | CUUAAUAGAUGGGUUAAGCCAA | 22 | 24553 |
| CFTR-Intron10-5674 | - | UCUUAAUAGAUGGGUUAAGCCAA | 23 | 24554 |

TABLE 41E-continued

5th Tier

| gRNA Name | DNA Strand | Targeting Domain | Target Site Length | Seq ID |
|---|---|---|---|---|
| CFTR-Intron10-5675 | - | CUCUUAAUAGAUGGGUUAAGCCAA | 24 | 24555 |
| CFTR-Intron10-5676 | - | AGAAAGAAAAAACAGCAA | 18 | 24556 |
| CFTR-Intron10-5677 | - | UAGAAAGAAAAAACAGCAA | 19 | 24557 |
| CFTR-Intron10-5678 | - | UUAGAAAGAAAAAACAGCAA | 20 | 24558 |
| CFTR-Intron10-5679 | - | AUUAGAAAGAAAAAACAGCAA | 21 | 24559 |
| CFTR-Intron10-5680 | - | GAUUAGAAAGAAAAAACAGCAA | 22 | 24560 |
| CFTR-Intron10-5681 | - | AGAUUAGAAAGAAAAAACAGCAA | 23 | 24561 |
| CFTR-Intron10-5682 | - | UAGAUUAGAAAGAAAAAACAGCAA | 24 | 24562 |
| CFTR-Intron10-5683 | - | ACUGUUGUAACAAAAGAA | 18 | 24563 |
| CFTR-Intron10-5684 | - | GACUGUUGUAACAAAAGAA | 19 | 24564 |
| CFTR-Intron10-5685 | - | AGACUGUUGUAACAAAAGAA | 20 | 24565 |
| CFTR-Intron10-5686 | - | AAGACUGUUGUAACAAAAGAA | 21 | 24566 |
| CFTR-Intron10-5687 | - | AAAGACUGUUGUAACAAAAGAA | 22 | 24567 |
| CFTR-Intron10-5688 | - | UAAAGACUGUUGUAACAAAAGAA | 23 | 24568 |
| CFTR-Intron10-5689 | - | AUAAAGACUGUUGUAACAAAAGAA | 24 | 24569 |
| CFTR-Intron10-5690 | - | GAAGGAAAUGAGGAAGAA | 18 | 24570 |
| CFTR-Intron10-5691 | - | AGAAGGAAAUGAGGAAGAA | 19 | 24571 |
| CFTR-Intron10-1105 | - | AAGAAGGAAAUGAGGAAGAA | 20 | 19990 |
| CFTR-Intron10-5692 | - | AAAGAAGGAAAUGAGGAAGAA | 21 | 24572 |
| CFTR-Intron10-5693 | - | GAAAGAAGGAAAUGAGGAAGAA | 22 | 24573 |
| CFTR-Intron10-5694 | - | AGAAAGAAGGAAAUGAGGAAGAA | 23 | 24574 |
| CFTR-Intron10-5695 | - | AAGAAAGAAGGAAAUGAGGAAGAA | 24 | 24575 |
| CFTR-Intron10-5696 | - | AAAGAGGGUUGAUAAGAA | 18 | 24576 |
| CFTR-Intron10-5697 | - | GAAAGAGGGUUGAUAAGAA | 19 | 24577 |
| CFTR-Intron10-5698 | - | GGAAAGAGGGUUGAUAAGAA | 20 | 24578 |
| CFTR-Intron10-5699 | - | AGGAAAGAGGGUUGAUAAGAA | 21 | 24579 |
| CFTR-Intron10-5700 | - | AAGGAAAGAGGGUUGAUAAGAA | 22 | 24580 |
| CFTR-Intron10-5701 | - | AAAGGAAAGAGGGUUGAUAAGAA | 23 | 24581 |
| CFTR-Intron10-5702 | - | UAAAGGAAAGAGGGUUGAUAAGAA | 24 | 24582 |
| CFTR-Intron10-5703 | - | AUCACCUGAGCCUGAGAA | 18 | 24583 |
| CFTR-Intron10-5704 | - | GAUCACCUGAGCCUGAGAA | 19 | 24584 |
| CFTR-Intron10-5705 | - | GGAUCACCUGAGCCUGAGAA | 20 | 24585 |
| CFTR-Intron10-5706 | - | AGGAUCACCUGAGCCUGAGAA | 21 | 24586 |
| CFTR-Intron10-5707 | - | GAGGAUCACCUGAGCCUGAGAA | 22 | 24587 |
| CFTR-Intron10-5708 | - | GGAGGAUCACCUGAGCCUGAGAA | 23 | 24588 |
| CFTR-Intron10-5709 | - | GGGAGGAUCACCUGAGCCUGAGAA | 24 | 24589 |
| CFTR-Intron10-5710 | - | UUUAAACACUUCUGAGAA | 18 | 24590 |

TABLE 41E-continued

5th Tier

| gRNA Name | DNA Strand | Targeting Domain | Target Site Length | Seq ID |
|---|---|---|---|---|
| CFTR-Intron10-5711 | - | AUUUAAACACUUCUGAGAA | 19 | 24591 |
| CFTR-Intron10-5712 | - | UAUUUAAACACUUCUGAGAA | 20 | 24592 |
| CFTR-Intron10-5713 | - | AUAUUUAAACACUUCUGAGAA | 21 | 24593 |
| CFTR-Intron10-5714 | - | AAUAUUUAAACACUUCUGAGAA | 22 | 24594 |
| CFTR-Intron10-5715 | - | GAAUAUUUAAACACUUCUGAGAA | 23 | 24595 |
| CFTR-Intron10-5716 | - | GGAAUAUUUAAACACUUCUGAGAA | 24 | 24596 |
| CFTR-Intron10-5717 | - | AAGGAAUUUUAUAUAGAA | 18 | 24597 |
| CFTR-Intron10-5718 | - | AAAGGAAUUUUAUAUAGAA | 19 | 24598 |
| CFTR-Intron10-5719 | - | CAAAGGAAUUUUAUAUAGAA | 20 | 24599 |
| CFTR-Intron10-5720 | - | ACAAAGGAAUUUUAUAUAGAA | 21 | 24600 |
| CFTR-Intron10-5721 | - | UACAAAGGAAUUUUAUAUAGAA | 22 | 24601 |
| CFTR-Intron10-5722 | - | GUACAAAGGAAUUUUAUAUAGAA | 23 | 24602 |
| CFTR-Intron10-5723 | - | UGUACAAAGGAAUUUUAUAUAGAA | 24 | 24603 |
| CFTR-Intron10-5724 | - | AAGUCUAGUUUCAAGGAA | 18 | 24604 |
| CFTR-Intron10-5725 | - | CAAGUCUAGUUUCAAGGAA | 19 | 24605 |
| CFTR-Intron10-5726 | - | ACAAGUCUAGUUUCAAGGAA | 20 | 24606 |
| CFTR-Intron10-5727 | - | UACAAGUCUAGUUUCAAGGAA | 21 | 24607 |
| CFTR-Intron10-5728 | - | GUACAAGUCUAGUUUCAAGGAA | 22 | 24608 |
| CFTR-Intron10-5729 | - | UGUACAAGUCUAGUUUCAAGGAA | 23 | 24609 |
| CFTR-Intron10-5730 | - | AUGUACAAGUCUAGUUUCAAGGAA | 24 | 24610 |
| CFTR-Intron10-5731 | - | GAAGGAAGAAAGAAGGAA | 18 | 24611 |
| CFTR-Intron10-5732 | - | GGAAGGAAGAAAGAAGGAA | 19 | 24612 |
| CFTR-Intron10-5733 | - | AGGAAGGAAGAAAGAAGGAA | 20 | 24613 |
| CFTR-Intron10-5734 | - | GAGGAAGGAAGAAAGAAGGAA | 21 | 24614 |
| CFTR-Intron10-5735 | - | AGAGGAAGGAAGAAAGAAGGAA | 22 | 24615 |
| CFTR-Intron10-5736 | - | GAGAGGAAGGAAGAAAGAAGGAA | 23 | 24616 |
| CFTR-Intron10-5737 | - | AGAGAGGAAGGAAGAAAGAAGGAA | 24 | 24617 |
| CFTR-Intron10-5738 | - | UUUUAGUAGUAUUAGGAA | 18 | 24618 |
| CFTR-Intron10-5739 | - | CUUUUAGUAGUAUUAGGAA | 19 | 24619 |
| CFTR-Intron10-350 | - | CCUUUUAGUAGUAUUAGGAA | 20 | 19236 |
| CFTR-Intron10-5740 | - | GCCUUUUAGUAGUAUUAGGAA | 21 | 24620 |
| CFTR-Intron10-5741 | - | UGCCUUUUAGUAGUAUUAGGAA | 22 | 24621 |
| CFTR-Intron10-5742 | - | CUGCCUUUUAGUAGUAUUAGGAA | 23 | 24622 |
| CFTR-Intron10-5743 | - | GCUGCCUUUUAGUAGUAUUAGGAA | 24 | 24623 |
| CFTR-Intron10-5744 | - | UGAAAUUAGAAAGAAUAA | 18 | 24624 |
| CFTR-Intron10-5745 | - | AUGAAAUUAGAAAGAAUAA | 19 | 24625 |
| CFTR-Intron10-5746 | - | AAUGAAAUUAGAAAGAAUAA | 20 | 24626 |

TABLE 41E-continued

5th Tier

| gRNA Name | DNA Strand | Targeting Domain | Target Site Length | Seq ID |
|---|---|---|---|---|
| CFTR-Intron10-5747 | - | GAAUGAAAUUAGAAAGAAUAA | 21 | 24627 |
| CFTR-Intron10-5748 | - | AGAAUGAAAUUAGAAAGAAUAA | 22 | 24628 |
| CFTR-Intron10-5749 | - | CAGAAUGAAAUUAGAAAGAAUAA | 23 | 24629 |
| CFTR-Intron10-5750 | - | CCAGAAUGAAAUUAGAAAGAAUAA | 24 | 24630 |
| CFTR-Intron10-5751 | - | AAAUAUAAGAUUGAAUAA | 18 | 24631 |
| CFTR-Intron10-5752 | - | AAAAUAUAAGAUUGAAUAA | 19 | 24632 |
| CFTR-Intron10-5753 | - | UAAAAUAUAAGAUUGAAUAA | 20 | 24633 |
| CFTR-Intron10-5754 | - | CUAAAAUAUAAGAUUGAAUAA | 21 | 24634 |
| CFTR-Intron10-5755 | - | GCUAAAAUAUAAGAUUGAAUAA | 22 | 24635 |
| CFTR-Intron10-5756 | - | AGCUAAAAUAUAAGAUUGAAUAA | 23 | 24636 |
| CFTR-Intron10-5757 | - | UAGCUAAAAUAUAAGAUUGAAUAA | 24 | 24637 |
| CFTR-Intron10-5758 | - | CCCAUAAAUGUUGAAUAA | 18 | 24638 |
| CFTR-Intron10-5759 | - | CCCCAUAAAUGUUGAAUAA | 19 | 24639 |
| CFTR-Intron10-5760 | - | GCCCCAUAAAUGUUGAAUAA | 20 | 24640 |
| CFTR-Intron10-5761 | - | AGCCCCAUAAAUGUUGAAUAA | 21 | 24641 |
| CFTR-Intron10-5762 | - | GAGCCCCAUAAAUGUUGAAUAA | 22 | 24642 |
| CFTR-Intron10-5763 | - | GGAGCCCCAUAAAUGUUGAAUAA | 23 | 24643 |
| CFTR-Intron10-5764 | - | GGGAGCCCCAUAAAUGUUGAAUAA | 24 | 24644 |
| CFTR-Intron10-5765 | - | AGCUUAUUCUUGUAAUAA | 18 | 24645 |
| CFTR-Intron10-5766 | - | UAGCUUAUUCUUGUAAUAA | 19 | 24646 |
| CFTR-Intron10-5767 | - | UUAGCUUAUUCUUGUAAUAA | 20 | 24647 |
| CFTR-Intron10-5768 | - | UUUAGCUUAUUCUUGUAAUAA | 21 | 24648 |
| CFTR-Intron10-5769 | - | UUUUAGCUUAUUCUUGUAAUAA | 22 | 24649 |
| CFTR-Intron10-5770 | - | GUUUUAGCUUAUUCUUGUAAUAA | 23 | 24650 |
| CFTR-Intron10-5771 | - | AGUUUUAGCUUAUUCUUGUAAUAA | 24 | 24651 |
| CFTR-Intron10-5772 | - | CGUUUACUAGAAAGAUAA | 18 | 24652 |
| CFTR-Intron10-5773 | - | CCGUUUACUAGAAAGAUAA | 19 | 24653 |
| CFTR-Intron10-69 | - | GCCGUUUACUAGAAAGAUAA | 20 | 18955 |
| CFTR-Intron10-5774 | - | UGCCGUUUACUAGAAAGAUAA | 21 | 24654 |
| CFTR-Intron10-5775 | - | GUGCCGUUUACUAGAAAGAUAA | 22 | 24655 |
| CFTR-Intron10-5776 | - | UGUGCCGUUUACUAGAAAGAUAA | 23 | 24656 |
| CFTR-Intron10-5777 | - | AUGUGCCGUUUACUAGAAAGAUAA | 24 | 24657 |
| CFTR-Intron10-5778 | - | CCUGCAAUUUCGAGAUAA | 18 | 24658 |
| CFTR-Intron10-5779 | - | GCCUGCAAUUUCGAGAUAA | 19 | 24659 |
| CFTR-Intron10-5780 | - | UGCCUGCAAUUUCGAGAUAA | 20 | 24660 |
| CFTR-Intron10-5781 | - | UUGCCUGCAAUUUCGAGAUAA | 21 | 24661 |
| CFTR-Intron10-5782 | - | GUUGCCUGCAAUUUCGAGAUAA | 22 | 24662 |

TABLE 41E-continued

5th Tier

| gRNA Name | DNA Strand | Targeting Domain | Target Site Length | Seq ID |
|---|---|---|---|---|
| CFTR-Intron10-5783 | - | AGUUGCCUGCAAUUUCGAGAUAA | 23 | 24663 |
| CFTR-Intron10-5784 | - | CAGUUGCCUGCAAUUUCGAGAUAA | 24 | 24664 |
| CFTR-Intron10-5785 | - | AGAUUAGUGUCUUUAUAA | 18 | 24665 |
| CFTR-Intron10-5786 | - | GAGAUUAGUGUCUUUAUAA | 19 | 24666 |
| CFTR-Intron10-5787 | - | UGAGAUUAGUGUCUUUAUAA | 20 | 24667 |
| CFTR-Intron10-5788 | - | AUGAGAUUAGUGUCUUUAUAA | 21 | 24668 |
| CFTR-Intron10-5789 | - | AAUGAGAUUAGUGUCUUUAUAA | 22 | 24669 |
| CFTR-Intron10-5790 | - | AAAUGAGAUUAGUGUCUUUAUAA | 23 | 24670 |
| CFTR-Intron10-5791 | - | UAAAUGAGAUUAGUGUCUUUAUAA | 24 | 24671 |
| CFTR-Intron10-5792 | - | UGACCUAAGAUAUCCUAA | 18 | 24672 |
| CFTR-Intron10-5793 | - | UUGACCUAAGAUAUCCUAA | 19 | 24673 |
| CFTR-Intron10-358 | - | UUUGACCUAAGAUAUCCUAA | 20 | 19244 |
| CFTR-Intron10-5794 | - | CUUUGACCUAAGAUAUCCUAA | 21 | 24674 |
| CFTR-Intron10-5795 | - | UCUUUGACCUAAGAUAUCCUAA | 22 | 24675 |
| CFTR-Intron10-5796 | - | CUCUUUGACCUAAGAUAUCCUAA | 23 | 24676 |
| CFTR-Intron10-5797 | - | CCUCUUUGACCUAAGAUAUCCUAA | 24 | 24677 |
| CFTR-Intron10-5798 | - | GGCUGGAUAAGAUUCUAA | 18 | 24678 |
| CFTR-Intron10-5799 | - | GGGCUGGAUAAGAUUCUAA | 19 | 24679 |
| CFTR-Intron10-71 | - | GGGGCUGGAUAAGAUUCUAA | 20 | 18957 |
| CFTR-Intron10-5800 | - | UGGGGCUGGAUAAGAUUCUAA | 21 | 24680 |
| CFTR-Intron10-5801 | - | AUGGGGCUGGAUAAGAUUCUAA | 22 | 24681 |
| CFTR-Intron10-5802 | - | GAUGGGGCUGGAUAAGAUUCUAA | 23 | 24682 |
| CFTR-Intron10-5803 | - | AGAUGGGGCUGGAUAAGAUUCUAA | 24 | 24683 |
| CFTR-Intron10-5804 | - | AGUUUUAAACAGAAGUAA | 18 | 24684 |
| CFTR-Intron10-5805 | - | GAGUUUUAAACAGAAGUAA | 19 | 24685 |
| CFTR-Intron10-5806 | - | AGAGUUUUAAACAGAAGUAA | 20 | 24686 |
| CFTR-Intron10-5807 | - | GAGAGUUUUAAACAGAAGUAA | 21 | 24687 |
| CFTR-Intron10-5808 | - | GGAGAGUUUUAAACAGAAGUAA | 22 | 24688 |
| CFTR-Intron10-5809 | - | UGGAGAGUUUUAAACAGAAGUAA | 23 | 24689 |
| CFTR-Intron10-5810 | - | CUGGAGAGUUUUAAACAGAAGUAA | 24 | 24690 |
| CFTR-Intron10-5811 | - | AAAGAAGGAAGGAAGUAA | 18 | 24691 |
| CFTR-Intron10-5812 | - | GAAAGAAGGAAGGAAGUAA | 19 | 24692 |
| CFTR-Intron10-5813 | - | GGAAAGAAGGAAGGAAGUAA | 20 | 24693 |
| CFTR-Intron10-5814 | - | AGGAAAGAAGGAAGGAAGUAA | 21 | 24694 |
| CFTR-Intron10-5815 | - | AAGGAAAGAAGGAAGGAAGUAA | 22 | 24695 |
| CFTR-Intron10-5816 | - | GAAGGAAAGAAGGAAGGAAGUAA | 23 | 24696 |
| CFTR-Intron10-5817 | - | GGAAGGAAAGAAGGAAGGAAGUAA | 24 | 24697 |

TABLE 41E-continued

| 5th Tier | | | | |
|---|---|---|---|---|
| gRNA Name | DNA Strand | Targeting Domain | Target Site Length | Seq ID |
| CFTR-Intron10-5818 | - | GCUUUCUGGACUGAGUAA | 18 | 24698 |
| CFTR-Intron10-5819 | - | AGCUUUCUGGACUGAGUAA | 19 | 24699 |
| CFTR-Intron10-5820 | - | AAGCUUUCUGGACUGAGUAA | 20 | 24700 |
| CFTR-Intron10-5821 | - | CAAGCUUUCUGGACUGAGUAA | 21 | 24701 |
| CFTR-Intron10-5822 | - | CCAAGCUUUCUGGACUGAGUAA | 22 | 24702 |
| CFTR-Intron10-5823 | - | UCCAAGCUUUCUGGACUGAGUAA | 23 | 24703 |
| CFTR-Intron10-5824 | - | UUCCAAGCUUUCUGGACUGAGUAA | 24 | 24704 |
| CFTR-Intron10-5825 | - | GGGUGAAGUCUUUAGUAA | 18 | 24705 |
| CFTR-Intron10-5826 | - | AGGGUGAAGUCUUUAGUAA | 19 | 24706 |
| CFTR-Intron10-5827 | - | GAGGGUGAAGUCUUUAGUAA | 20 | 24707 |
| CFTR-Intron10-5828 | - | UGAGGGUGAAGUCUUUAGUAA | 21 | 24708 |
| CFTR-Intron10-5829 | - | AUGAGGGUGAAGUCUUUAGUAA | 22 | 24709 |
| CFTR-Intron10-5830 | - | CAUGAGGGUGAAGUCUUUAGUAA | 23 | 24710 |
| CFTR-Intron10-5831 | - | CCAUGAGGGUGAAGUCUUUAGUAA | 24 | 24711 |
| CFTR-Intron10-5832 | - | AUAAGUGGCCUUUAAACA | 18 | 24712 |
| CFTR-Intron10-5833 | - | UAUAAGUGGCCUUUAAACA | 19 | 24713 |
| CFTR-Intron10-5834 | - | AUAUAAGUGGCCUUUAAACA | 20 | 24714 |
| CFTR-Intron10-5835 | - | AAUAUAAGUGGCCUUUAAACA | 21 | 24715 |
| CFTR-Intron10-5836 | - | AAAUAUAAGUGGCCUUUAAACA | 22 | 24716 |
| CFTR-Intron10-5837 | - | AAAAUAUAAGUGGCCUUUAAACA | 23 | 24717 |
| CFTR-Intron10-5838 | - | AAAAAUAUAAGUGGCCUUUAAACA | 24 | 24718 |
| CFTR-Intron10-5839 | - | ACCAUCCUGGCUAACACA | 18 | 24719 |
| CFTR-Intron10-5840 | - | GACCAUCCUGGCUAACACA | 19 | 24720 |
| CFTR-Intron10-5841 | - | AGACCAUCCUGGCUAACACA | 20 | 24721 |
| CFTR-Intron10-5842 | - | AAGACCAUCCUGGCUAACACA | 21 | 24722 |
| CFTR-Intron10-5843 | - | CAAGACCAUCCUGGCUAACACA | 22 | 24723 |
| CFTR-Intron10-5844 | - | UCAAGACCAUCCUGGCUAACACA | 23 | 24724 |
| CFTR-Intron10-5845 | - | AUCAAGACCAUCCUGGCUAACACA | 24 | 24725 |
| CFTR-Intron10-5846 | - | CAAUAUUUGUUAACACA | 18 | 24726 |
| CFTR-Intron10-5847 | - | CCAAUAUUUGUUAACACA | 19 | 24727 |
| CFTR-Intron10-5848 | - | UCCAAUAUUUGUUAACACA | 20 | 24728 |
| CFTR-Intron10-5849 | - | UUCCAAUAUUUGUUAACACA | 21 | 24729 |
| CFTR-Intron10-5850 | - | UUUCCAAUAUUUGUUAACACA | 22 | 24730 |
| CFTR-Intron10-5851 | - | GUUUCCAAUAUUUGUUAACACA | 23 | 24731 |
| CFTR-Intron10-5852 | - | UGUUUCCAAUAUUUGUUAACACA | 24 | 24732 |
| CFTR-Intron10-5853 | - | UUCCAUAUUCAAAGCACA | 18 | 24733 |
| CFTR-Intron10-5854 | - | UUUCCAUAUUCAAAGCACA | 19 | 24734 |

TABLE 41E-continued

5th Tier

| gRNA Name | DNA Strand | Targeting Domain | Target Site Length | Seq ID |
|---|---|---|---|---|
| CFTR-Intron10-5855 | - | CUUUCCAUAUUCAAAGCACA | 20 | 24735 |
| CFTR-Intron10-5856 | - | ACUUUCCAUAUUCAAAGCACA | 21 | 24736 |
| CFTR-Intron10-5857 | - | AACUUUCCAUAUUCAAAGCACA | 22 | 24737 |
| CFTR-Intron10-5858 | - | CAACUUUCCAUAUUCAAAGCACA | 23 | 24738 |
| CFTR-Intron10-5859 | - | ACAACUUUCCAUAUUCAAAGCACA | 24 | 24739 |
| CFTR-Intron10-5860 | - | CAUAUGAGAAAAGUCACA | 18 | 24740 |
| CFTR-Intron10-5861 | - | GCAUAUGAGAAAAGUCACA | 19 | 24741 |
| CFTR-Intron10-5862 | - | GGCAUAUGAGAAAAGUCACA | 20 | 24742 |
| CFTR-Intron10-5863 | - | UGGCAUAUGAGAAAAGUCACA | 21 | 24743 |
| CFTR-Intron10-5864 | - | AUGGCAUAUGAGAAAAGUCACA | 22 | 24744 |
| CFTR-Intron10-5865 | - | AAUGGCAUAUGAGAAAAGUCACA | 23 | 24745 |
| CFTR-Intron10-5866 | - | CAAUGGCAUAUGAGAAAAGUCACA | 24 | 24746 |
| CFTR-Intron10-5867 | - | CUGGCAUAGAGUAAGACA | 18 | 24747 |
| CFTR-Intron10-5868 | - | GCUGGCAUAGAGUAAGACA | 19 | 24748 |
| CFTR-Intron10-74 | - | GGCUGGCAUAGAGUAAGACA | 20 | 18960 |
| CFTR-Intron10-5869 | - | AGGCUGGCAUAGAGUAAGACA | 21 | 24749 |
| CFTR-Intron10-5870 | - | GAGGCUGGCAUAGAGUAAGACA | 22 | 24750 |
| CFTR-Intron10-5871 | - | UGAGGCUGGCAUAGAGUAAGACA | 23 | 24751 |
| CFTR-Intron10-5872 | - | CUGAGGCUGGCAUAGAGUAAGACA | 24 | 24752 |
| CFTR-Intron10-5873 | - | CUAUUCUGUAGGGAGACA | 18 | 24753 |
| CFTR-Intron10-5874 | - | GCUAUUCUGUAGGGAGACA | 19 | 24754 |
| CFTR-Intron10-75 | - | GGCUAUUCUGUAGGGAGACA | 20 | 18961 |
| CFTR-Intron10-5875 | - | AGGCUAUUCUGUAGGGAGACA | 21 | 24755 |
| CFTR-Intron10-5876 | - | UAGGCUAUUCUGUAGGGAGACA | 22 | 24756 |
| CFTR-Intron10-5877 | - | UUAGGCUAUUCUGUAGGGAGACA | 23 | 24757 |
| CFTR-Intron10-5878 | - | UUUAGGCUAUUCUGUAGGGAGACA | 24 | 24758 |
| CFTR-Intron10-5879 | - | UUUUUUUCAGUUAAUACA | 18 | 24759 |
| CFTR-Intron10-5880 | - | UUUUUUUUCAGUUAAUACA | 19 | 24760 |
| CFTR-Intron10-5881 | - | AUUUUUUUUCAGUUAAUACA | 20 | 24761 |
| CFTR-Intron10-5882 | - | AAUUUUUUUUCAGUUAAUACA | 21 | 24762 |
| CFTR-Intron10-5883 | - | GAAUUUUUUUUCAGUUAAUACA | 22 | 24763 |
| CFTR-Intron10-5884 | - | UGAAUUUUUUUUCAGUUAAUACA | 23 | 24764 |
| CFTR-Intron10-5885 | - | GUGAAUUUUUUUUCAGUUAAUACA | 24 | 24765 |
| CFTR-Intron10-5886 | - | AUCAUUUCAACUUAUACA | 18 | 24766 |
| CFTR-Intron10-5887 | - | UAUCAUUUCAACUUAUACA | 19 | 24767 |
| CFTR-Intron10-5888 | - | AUAUCAUUUCAACUUAUACA | 20 | 24768 |
| CFTR-Intron10-5889 | - | AAUAUCAUUUCAACUUAUACA | 21 | 24769 |

TABLE 41E-continued

5th Tier

| gRNA Name | DNA Strand | Targeting Domain | Target Site Length | Seq ID |
|---|---|---|---|---|
| CFTR-Intron10-5890 | − | AAAUAUCAUUUCAACUUAUACA | 22 | 24770 |
| CFTR-Intron10-5891 | − | AAAAUAUCAUUUCAACUUAUACA | 23 | 24771 |
| CFTR-Intron10-5892 | − | UAAAAUAUCAUUUCAACUUAUACA | 24 | 24772 |
| CFTR-Intron10-5893 | − | UAGGUUUAAUUUUGUACA | 18 | 24773 |
| CFTR-Intron10-5894 | − | CUAGGUUUAAUUUUGUACA | 19 | 24774 |
| CFTR-Intron10-5895 | − | UCUAGGUUUAAUUUUGUACA | 20 | 24775 |
| CFTR-Intron10-5896 | − | UUCUAGGUUUAAUUUUGUACA | 21 | 24776 |
| CFTR-Intron10-5897 | − | CUUCUAGGUUUAAUUUUGUACA | 22 | 24777 |
| CFTR-Intron10-5898 | − | ACUUCUAGGUUUAAUUUUGUACA | 23 | 24778 |
| CFTR-Intron10-5899 | − | CACUUCUAGGUUUAAUUUUGUACA | 24 | 24779 |
| CFTR-Intron10-5900 | − | GGGUGAGAUUAGAGGCCA | 18 | 24780 |
| CFTR-Intron10-5901 | − | UGGGUGAGAUUAGAGGCCA | 19 | 24781 |
| CFTR-Intron10-5902 | − | CUGGGUGAGAUUAGAGGCCA | 20 | 24782 |
| CFTR-Intron10-5903 | − | UCUGGGUGAGAUUAGAGGCCA | 21 | 24783 |
| CFTR-Intron10-5904 | − | CUCUGGGUGAGAUUAGAGGCCA | 22 | 24784 |
| CFTR-Intron10-5905 | − | UCUCUGGGUGAGAUUAGAGGCCA | 23 | 24785 |
| CFTR-Intron10-5906 | − | UUCUCUGGGUGAGAUUAGAGGCCA | 24 | 24786 |
| CFTR-Intron10-5907 | − | CUUUCCAUAUUCAAAGCA | 18 | 24787 |
| CFTR-Intron10-5908 | − | ACUUUCCAUAUUCAAAGCA | 19 | 24788 |
| CFTR-Intron10-5909 | − | AACUUUCCAUAUUCAAAGCA | 20 | 24789 |
| CFTR-Intron10-5910 | − | CAACUUUCCAUAUUCAAAGCA | 21 | 24790 |
| CFTR-Intron10-5911 | − | ACAACUUUCCAUAUUCAAAGCA | 22 | 24791 |
| CFTR-Intron10-5912 | − | GACAACUUUCCAUAUUCAAAGCA | 23 | 24792 |
| CFTR-Intron10-5913 | − | GGACAACUUUCCAUAUUCAAAGCA | 24 | 24793 |
| CFTR-Intron10-5914 | − | GAGACAAGGGAGGAAGCA | 18 | 24794 |
| CFTR-Intron10-5915 | − | GGAGACAAGGGAGGAAGCA | 19 | 24795 |
| CFTR-Intron10-650 | − | GGGAGACAAGGGAGGAAGCA | 20 | 19536 |
| CFTR-Intron10-5916 | − | AGGGAGACAAGGGAGGAAGCA | 21 | 24796 |
| CFTR-Intron10-5917 | − | UAGGGAGACAAGGGAGGAAGCA | 22 | 24797 |
| CFTR-Intron10-5918 | − | GUAGGGAGACAAGGGAGGAAGCA | 23 | 24798 |
| CFTR-Intron10-5919 | − | UGUAGGGAGACAAGGGAGGAAGCA | 24 | 24799 |
| CFTR-Intron10-5920 | − | GAUUCUGUUUAAAUAGCA | 18 | 24800 |
| CFTR-Intron10-5921 | − | UGAUUCUGUUUAAAUAGCA | 19 | 24801 |
| CFTR-Intron10-5922 | − | CUGAUUCUGUUUAAAUAGCA | 20 | 24802 |
| CFTR-Intron10-5923 | − | CCUGAUUCUGUUUAAAUAGCA | 21 | 24803 |
| CFTR-Intron10-5924 | − | CCCUGAUUCUGUUUAAAUAGCA | 22 | 24804 |
| CFTR-Intron10-5925 | − | CCCCUGAUUCUGUUUAAAUAGCA | 23 | 24805 |

TABLE 41E-continued

5th Tier

| gRNA Name | DNA Strand | Targeting Domain | Target Site Length | Seq ID |
|---|---|---|---|---|
| CFTR-Intron10-5926 | - | UCCCCUGAUUCUGUUUAAAUAGCA | 24 | 24806 |
| CFTR-Intron10-5927 | - | AGUGCCACUAGUGAUGCA | 18 | 24807 |
| CFTR-Intron10-5928 | - | AAGUGCCACUAGUGAUGCA | 19 | 24808 |
| CFTR-Intron10-1129 | - | AAAGUGCCACUAGUGAUGCA | 20 | 20014 |
| CFTR-Intron10-5929 | - | CAAAGUGCCACUAGUGAUGCA | 21 | 24809 |
| CFTR-Intron10-5930 | - | ACAAAGUGCCACUAGUGAUGCA | 22 | 24810 |
| CFTR-Intron10-5931 | - | UACAAAGUGCCACUAGUGAUGCA | 23 | 24811 |
| CFTR-Intron10-5932 | - | AUACAAAGUGCCACUAGUGAUGCA | 24 | 24812 |
| CFTR-Intron10-5933 | - | UGAGAAGUGGAGGCUGCA | 18 | 24813 |
| CFTR-Intron10-5934 | - | CUGAGAAGUGGAGGCUGCA | 19 | 24814 |
| CFTR-Intron10-5935 | - | CCUGAGAAGUGGAGGCUGCA | 20 | 24815 |
| CFTR-Intron10-5936 | - | GCCUGAGAAGUGGAGGCUGCA | 21 | 24816 |
| CFTR-Intron10-5937 | - | AGCCUGAGAAGUGGAGGCUGCA | 22 | 24817 |
| CFTR-Intron10-5938 | - | GAGCCUGAGAAGUGGAGGCUGCA | 23 | 24818 |
| CFTR-Intron10-5939 | - | UGAGCCUGAGAAGUGGAGGCUGCA | 24 | 24819 |
| CFTR-Intron10-5940 | - | CAGGAGGCAGAACUUGCA | 18 | 24820 |
| CFTR-Intron10-5941 | - | CCAGGAGGCAGAACUUGCA | 19 | 24821 |
| CFTR-Intron10-5942 | - | CCCAGGAGGCAGAACUUGCA | 20 | 24822 |
| CFTR-Intron10-5943 | - | ACCCAGGAGGCAGAACUUGCA | 21 | 24823 |
| CFTR-Intron10-5944 | - | AACCCAGGAGGCAGAACUUGCA | 22 | 24824 |
| CFTR-Intron10-5945 | - | GAACCCAGGAGGCAGAACUUGCA | 23 | 24825 |
| CFTR-Intron10-5946 | - | UGAACCCAGGAGGCAGAACUUGCA | 24 | 24826 |
| CFTR-Intron10-5947 | - | GGCAUAUGAGAAAAGUCA | 18 | 24827 |
| CFTR-Intron10-5948 | - | UGGCAUAUGAGAAAAGUCA | 19 | 24828 |
| CFTR-Intron10-5949 | - | AUGGCAUAUGAGAAAAGUCA | 20 | 24829 |
| CFTR-Intron10-5950 | - | AAUGGCAUAUGAGAAAAGUCA | 21 | 24830 |
| CFTR-Intron10-5951 | - | CAAUGGCAUAUGAGAAAAGUCA | 22 | 24831 |
| CFTR-Intron10-5952 | - | ACAAUGGCAUAUGAGAAAAGUCA | 23 | 24832 |
| CFTR-Intron10-5953 | - | AACAAUGGCAUAUGAGAAAAGUCA | 24 | 24833 |
| CFTR-Intron10-5954 | - | AGAACAGUAAGGAGGUCA | 18 | 24834 |
| CFTR-Intron10-5955 | - | AAGAACAGUAAGGAGGUCA | 19 | 24835 |
| CFTR-Intron10-5956 | - | GAAGAACAGUAAGGAGGUCA | 20 | 24836 |
| CFTR-Intron10-5957 | - | UGAAGAACAGUAAGGAGGUCA | 21 | 24837 |
| CFTR-Intron10-5958 | - | UUGAAGAACAGUAAGGAGGUCA | 22 | 24838 |
| CFTR-Intron10-5959 | - | UUUGAAGAACAGUAAGGAGGUCA | 23 | 24839 |
| CFTR-Intron10-5960 | - | GUUUGAAGAACAGUAAGGAGGUCA | 24 | 24840 |
| CFTR-Intron10-5961 | - | GAGGGUAGAAUACUGUCA | 18 | 24841 |

TABLE 41E-continued

5th Tier

| gRNA Name | DNA Strand | Targeting Domain | Target Site Length | Seq ID |
|---|---|---|---|---|
| CFTR-Intron10-5962 | - | GGAGGGUAGAAUACUGUCA | 19 | 24842 |
| CFTR-Intron10-5963 | - | GGGAGGGUAGAAUACUGUCA | 20 | 24843 |
| CFTR-Intron10-5964 | - | AGGGAGGGUAGAAUACUGUCA | 21 | 24844 |
| CFTR-Intron10-5965 | - | CAGGGAGGGUAGAAUACUGUCA | 22 | 24845 |
| CFTR-Intron10-5966 | - | ACAGGGAGGGUAGAAUACUGUCA | 23 | 24846 |
| CFTR-Intron10-5967 | - | GACAGGGAGGGUAGAAUACUGUCA | 24 | 24847 |
| CFTR-Intron10-5968 | - | UGUACAAGUCUAGUUUCA | 18 | 24848 |
| CFTR-Intron10-5969 | - | AUGUACAAGUCUAGUUUCA | 19 | 24849 |
| CFTR-Intron10-79 | - | GAUGUACAAGUCUAGUUUCA | 20 | 18965 |
| CFTR-Intron10-5970 | - | GGAUGUACAAGUCUAGUUUCA | 21 | 24850 |
| CFTR-Intron10-5971 | - | UGGAUGUACAAGUCUAGUUUCA | 22 | 24851 |
| CFTR-Intron10-5972 | - | UUGGAUGUACAAGUCUAGUUUCA | 23 | 24852 |
| CFTR-Intron10-5973 | - | GUUGGAUGUACAAGUCUAGUUUCA | 24 | 24853 |
| CFTR-Intron10-5974 | - | AAGACAAACAGAAAAAGA | 18 | 24854 |
| CFTR-Intron10-5975 | - | UAAGACAAACAGAAAAAGA | 19 | 24855 |
| CFTR-Intron10-5976 | - | CUAAGACAAACAGAAAAAGA | 20 | 24856 |
| CFTR-Intron10-5977 | - | UCUAAGACAAACAGAAAAAGA | 21 | 24857 |
| CFTR-Intron10-5978 | - | AUCUAAGACAAACAGAAAAAGA | 22 | 24858 |
| CFTR-Intron10-5979 | - | AAUCUAAGACAAACAGAAAAAGA | 23 | 24859 |
| CFTR-Intron10-5980 | - | UAAUCUAAGACAAACAGAAAAAGA | 24 | 24860 |
| CFTR-Intron10-5981 | - | CAAACAGAAAAAGAAAGA | 18 | 24861 |
| CFTR-Intron10-5982 | - | ACAAACAGAAAAAGAAAGA | 19 | 24862 |
| CFTR-Intron10-5983 | - | GACAAACAGAAAAAGAAAGA | 20 | 24863 |
| CFTR-Intron10-5984 | - | AGACAAACAGAAAAAGAAAGA | 21 | 24864 |
| CFTR-Intron10-5985 | - | AAGACAAACAGAAAAAGAAAGA | 22 | 24865 |
| CFTR-Intron10-5986 | - | UAAGACAAACAGAAAAAGAAAGA | 23 | 24866 |
| CFTR-Intron10-5987 | - | CUAAGACAAACAGAAAAAGAAAGA | 24 | 24867 |
| CFTR-Intron10-5988 | - | GAGAGGAAGGAAGAAAGA | 18 | 24868 |
| CFTR-Intron10-5989 | - | AGAGAGGAAGGAAGAAAGA | 19 | 24869 |
| CFTR-Intron10-1137 | - | AAGAGAGGAAGGAAGAAAGA | 20 | 20022 |
| CFTR-Intron10-5990 | - | AAAGAGAGGAAGGAAGAAAGA | 21 | 24870 |
| CFTR-Intron10-5991 | - | GAAAGAGAGGAAGGAAGAAAGA | 22 | 24871 |
| CFTR-Intron10-5992 | - | AGAAAGAGAGGAAGGAAGAAAGA | 23 | 24872 |
| CFTR-Intron10-5993 | - | AAGAAAGAGAGGAAGGAAGAAAGA | 24 | 24873 |
| CFTR-Intron10-5994 | - | GAAGGAAGGAAGGAAAGA | 18 | 24874 |
| CFTR-Intron10-5995 | - | GGAAGGAAGGAAGGAAAGA | 19 | 24875 |
| CFTR-Intron10-1138 | - | AGGAAGGAAGGAAGGAAAGA | 20 | 20023 |

TABLE 41E-continued

5th Tier

| gRNA Name | DNA Strand | Targeting Domain | Target Site Length | Seq ID |
|---|---|---|---|---|
| CFTR-Intron10-5996 | - | GAGGAAGGAAGGAAGGAAAGA | 21 | 24876 |
| CFTR-Intron10-5997 | - | GGAGGAAGGAAGGAAGGAAAGA | 22 | 24877 |
| CFTR-Intron10-5998 | - | AGGAGGAAGGAAGGAAGGAAAGA | 23 | 24878 |
| CFTR-Intron10-5999 | - | UAGGAGGAAGGAAGGAAGGAAAGA | 24 | 24879 |
| CFTR-Intron10-6000 | - | GUCUAGUUUCAAGGAAGA | 18 | 24880 |
| CFTR-Intron10-6001 | - | AGUCUAGUUUCAAGGAAGA | 19 | 24881 |
| CFTR-Intron10-372 | - | AAGUCUAGUUUCAAGGAAGA | 20 | 19258 |
| CFTR-Intron10-6002 | - | CAAGUCUAGUUUCAAGGAAGA | 21 | 24882 |
| CFTR-Intron10-6003 | - | ACAAGUCUAGUUUCAAGGAAGA | 22 | 24883 |
| CFTR-Intron10-6004 | - | UACAAGUCUAGUUUCAAGGAAGA | 23 | 24884 |
| CFTR-Intron10-6005 | - | GUACAAGUCUAGUUUCAAGGAAGA | 24 | 24885 |
| CFTR-Intron10-6006 | - | GAAAGAGAGGAAGGAAGA | 18 | 24886 |
| CFTR-Intron10-6007 | - | AGAAAGAGAGGAAGGAAGA | 19 | 24887 |
| CFTR-Intron10-6008 | - | AAGAAAGAGAGGAAGGAAGA | 20 | 24888 |
| CFTR-Intron10-6009 | - | AAAGAAAGAGAGGAAGGAAGA | 21 | 24889 |
| CFTR-Intron10-6010 | - | AAAAGAAAGAGAGGAAGGAAGA | 22 | 24890 |
| CFTR-Intron10-6011 | - | AAAAAGAAAGAGAGGAAGGAAGA | 23 | 24891 |
| CFTR-Intron10-6012 | - | GAAAAAGAAAGAGAGGAAGGAAGA | 24 | 24892 |
| CFTR-Intron10-6013 | - | AGAAGGAAAUGAGGAAGA | 18 | 24893 |
| CFTR-Intron10-6014 | - | AAGAAGGAAAUGAGGAAGA | 19 | 24894 |
| CFTR-Intron10-6015 | - | AAAGAAGGAAAUGAGGAAGA | 20 | 24895 |
| CFTR-Intron10-6016 | - | GAAAGAAGGAAAUGAGGAAGA | 21 | 24896 |
| CFTR-Intron10-6017 | - | AGAAAGAAGGAAAUGAGGAAGA | 22 | 24897 |
| CFTR-Intron10-6018 | - | AAGAAAGAAGGAAAUGAGGAAGA | 23 | 24898 |
| CFTR-Intron10-6019 | - | GAAGAAAGAAGGAAAUGAGGAAGA | 24 | 24899 |
| CFTR-Intron10-6020 | - | GGGCUGGUAGUGUGAAGA | 18 | 24900 |
| CFTR-Intron10-6021 | - | GGGGCUGGUAGUGUGAAGA | 19 | 24901 |
| CFTR-Intron10-80 | - | GGGGGCUGGUAGUGUGAAGA | 20 | 18966 |
| CFTR-Intron10-6022 | - | AGGGGGCUGGUAGUGUGAAGA | 21 | 24902 |
| CFTR-Intron10-6023 | - | GAGGGGGCUGGUAGUGUGAAGA | 22 | 24903 |
| CFTR-Intron10-6024 | - | AGAGGGGGCUGGUAGUGUGAAGA | 23 | 24904 |
| CFTR-Intron10-6025 | - | AAGAGGGGGCUGGUAGUGUGAAGA | 24 | 24905 |
| CFTR-Intron10-6026 | - | AGAAGGAAGGAAGUAAGA | 18 | 24906 |
| CFTR-Intron10-6027 | - | AAGAAGGAAGGAAGUAAGA | 19 | 24907 |
| CFTR-Intron10-1139 | - | AAAGAAGGAAGGAAGUAAGA | 20 | 20024 |
| CFTR-Intron10-6028 | - | GAAAGAAGGAAGGAAGUAAGA | 21 | 24908 |
| CFTR-Intron10-6029 | - | GGAAAGAAGGAAGGAAGUAAGA | 22 | 24909 |

TABLE 41E-continued

5th Tier

| gRNA Name | DNA Strand | Targeting Domain | Target Site Length | Seq ID |
|---|---|---|---|---|
| CFTR-Intron10-6030 | - | AGGAAAGAAGGAAGGAAGUAAGA | 23 | 24910 |
| CFTR-Intron10-6031 | - | AAGGAAAGAAGGAAGGAAGUAAGA | 24 | 24911 |
| CFTR-Intron10-6032 | - | GGCUGGCAUAGAGUAAGA | 18 | 24912 |
| CFTR-Intron10-6033 | - | AGGCUGGCAUAGAGUAAGA | 19 | 24913 |
| CFTR-Intron10-6034 | - | GAGGCUGGCAUAGAGUAAGA | 20 | 24914 |
| CFTR-Intron10-6035 | - | UGAGGCUGGCAUAGAGUAAGA | 21 | 24915 |
| CFTR-Intron10-6036 | - | CUGAGGCUGGCAUAGAGUAAGA | 22 | 24916 |
| CFTR-Intron10-6037 | - | ACUGAGGCUGGCAUAGAGUAAGA | 23 | 24917 |
| CFTR-Intron10-6038 | - | CACUGAGGCUGGCAUAGAGUAAGA | 24 | 24918 |
| CFTR-Intron10-6039 | - | UCUAGCCUGGGUGACAGA | 18 | 24919 |
| CFTR-Intron10-6040 | - | CUCUAGCCUGGGUGACAGA | 19 | 24920 |
| CFTR-Intron10-6041 | - | ACUCUAGCCUGGGUGACAGA | 20 | 24921 |
| CFTR-Intron10-6042 | - | CACUCUAGCCUGGGUGACAGA | 21 | 24922 |
| CFTR-Intron10-6043 | - | GCACUCUAGCCUGGGUGACAGA | 22 | 24923 |
| CFTR-Intron10-6044 | - | UGCACUCUAGCCUGGGUGACAGA | 23 | 24924 |
| CFTR-Intron10-6045 | - | CUGCACUCUAGCCUGGGUGACAGA | 24 | 24925 |
| CFTR-Intron10-6046 | - | AGGUCAAACUUGACCAGA | 18 | 24926 |
| CFTR-Intron10-6047 | - | AAGGUCAAACUUGACCAGA | 19 | 24927 |
| CFTR-Intron10-6048 | - | GAAGGUCAAACUUGACCAGA | 20 | 24928 |
| CFTR-Intron10-6049 | - | AGAAGGUCAAACUUGACCAGA | 21 | 24929 |
| CFTR-Intron10-6050 | - | GAGAAGGUCAAACUUGACCAGA | 22 | 24930 |
| CFTR-Intron10-6051 | - | AGAGAAGGUCAAACUUGACCAGA | 23 | 24931 |
| CFTR-Intron10-6052 | - | UAGAGAAGGUCAAACUUGACCAGA | 24 | 24932 |
| CFTR-Intron10-6053 | - | AAUUUAACAUUUUCCAGA | 18 | 24933 |
| CFTR-Intron10-6054 | - | AAAUUUAACAUUUUCCAGA | 19 | 24934 |
| CFTR-Intron10-6055 | - | AAAAUUUAACAUUUUCCAGA | 20 | 24935 |
| CFTR-Intron10-6056 | - | GAAAAUUUAACAUUUUCCAGA | 21 | 24936 |
| CFTR-Intron10-6057 | - | GGAAAAUUUAACAUUUUCCAGA | 22 | 24937 |
| CFTR-Intron10-6058 | - | GGGAAAAUUUAACAUUUUCCAGA | 23 | 24938 |
| CFTR-Intron10-6059 | - | AGGGAAAAUUUAACAUUUUCCAGA | 24 | 24939 |
| CFTR-Intron10-6060 | - | AAGUGCAAAGCUUUCAGA | 18 | 24940 |
| CFTR-Intron10-6061 | - | CAAGUGCAAAGCUUUCAGA | 19 | 24941 |
| CFTR-Intron10-82 | - | GCAAGUGCAAAGCUUUCAGA | 20 | 18968 |
| CFTR-Intron10-6062 | - | AGCAAGUGCAAAGCUUUCAGA | 21 | 24942 |
| CFTR-Intron10-6063 | - | AAGCAAGUGCAAAGCUUUCAGA | 22 | 24943 |
| CFTR-Intron10-6064 | - | GAAGCAAGUGCAAAGCUUUCAGA | 23 | 24944 |
| CFTR-Intron10-6065 | - | UGAAGCAAGUGCAAAGCUUUCAGA | 24 | 24945 |

TABLE 41E-continued

5th Tier

| gRNA Name | DNA Strand | Targeting Domain | Target Site Length | Seq ID |
|---|---|---|---|---|
| CFTR-Intron10-6066 | - | AGGGUUGAUAAGAAGAGA | 18 | 24946 |
| CFTR-Intron10-6067 | - | GAGGGUUGAUAAGAAGAGA | 19 | 24947 |
| CFTR-Intron10-6068 | - | AGAGGGUUGAUAAGAAGAGA | 20 | 24948 |
| CFTR-Intron10-6069 | - | AAGAGGGUUGAUAAGAAGAGA | 21 | 24949 |
| CFTR-Intron10-6070 | - | AAAGAGGGUUGAUAAGAAGAGA | 22 | 24950 |
| CFTR-Intron10-6071 | - | GAAAGAGGGUUGAUAAGAAGAGA | 23 | 24951 |
| CFTR-Intron10-6072 | - | GGAAAGAGGGUUGAUAAGAAGAGA | 24 | 24952 |
| CFTR-Intron10-6073 | - | AUCAAAUUAGAGAUGAGA | 18 | 24953 |
| CFTR-Intron10-6074 | - | AAUCAAAUUAGAGAUGAGA | 19 | 24954 |
| CFTR-Intron10-6075 | - | GAAUCAAAUUAGAGAUGAGA | 20 | 24955 |
| CFTR-Intron10-6076 | - | AGAAUCAAAUUAGAGAUGAGA | 21 | 24956 |
| CFTR-Intron10-6077 | - | AAGAAUCAAAUUAGAGAUGAGA | 22 | 24957 |
| CFTR-Intron10-6078 | - | AAAGAAUCAAAUUAGAGAUGAGA | 23 | 24958 |
| CFTR-Intron10-6079 | - | GAAAGAAUCAAAUUAGAGAUGAGA | 24 | 24959 |
| CFTR-Intron10-6080 | - | AAAAAAUAGUAGAUUAGA | 18 | 24960 |
| CFTR-Intron10-6081 | - | GAAAAAAUAGUAGAUUAGA | 19 | 24961 |
| CFTR-Intron10-6082 | - | UGAAAAAAUAGUAGAUUAGA | 20 | 24962 |
| CFTR-Intron10-6083 | - | CUGAAAAAAUAGUAGAUUAGA | 21 | 24963 |
| CFTR-Intron10-6084 | - | UCUGAAAAAAUAGUAGAUUAGA | 22 | 24964 |
| CFTR-Intron10-6085 | - | AUCUGAAAAAAUAGUAGAUUAGA | 23 | 24965 |
| CFTR-Intron10-6086 | - | CAUCUGAAAAAAUAGUAGAUUAGA | 24 | 24966 |
| CFTR-Intron10-6087 | - | GAGCUUUCUAGUAUUAGA | 18 | 24967 |
| CFTR-Intron10-6088 | - | AGAGCUUUCUAGUAUUAGA | 19 | 24968 |
| CFTR-Intron10-6089 | - | AAGAGCUUUCUAGUAUUAGA | 20 | 24969 |
| CFTR-Intron10-6090 | - | AAAGAGCUUUCUAGUAUUAGA | 21 | 24970 |
| CFTR-Intron10-6091 | - | GAAAGAGCUUUCUAGUAUUAGA | 22 | 24971 |
| CFTR-Intron10-6092 | - | AGAAAGAGCUUUCUAGUAUUAGA | 23 | 24972 |
| CFTR-Intron10-6093 | - | GAGAAAGAGCUUUCUAGUAUUAGA | 24 | 24973 |
| CFTR-Intron10-6094 | - | GGAUAAGAUUCUAAAGGA | 18 | 24974 |
| CFTR-Intron10-6095 | - | UGGAUAAGAUUCUAAAGGA | 19 | 24975 |
| CFTR-Intron10-6096 | - | CUGGAUAAGAUUCUAAAGGA | 20 | 24976 |
| CFTR-Intron10-6097 | - | GCUGGAUAAGAUUCUAAAGGA | 21 | 24977 |
| CFTR-Intron10-6098 | - | GGCUGGAUAAGAUUCUAAAGGA | 22 | 24978 |
| CFTR-Intron10-6099 | - | GGGCUGGAUAAGAUUCUAAAGGA | 23 | 24979 |
| CFTR-Intron10-6100 | - | GGGGCUGGAUAAGAUUCUAAAGGA | 24 | 24980 |
| CFTR-Intron10-6101 | - | GAAGGAAGGAAAGAAGGA | 18 | 24981 |
| CFTR-Intron10-6102 | - | GGAAGGAAGGAAAGAAGGA | 19 | 24982 |

TABLE 41E-continued

| | | 5th Tier | | |
|---|---|---|---|---|
| gRNA Name | DNA Strand | Targeting Domain | Target Site Length | Seq ID |
| CFTR-Intron10-1145 | − | AGGAAGGAAGGAAAGAAGGA | 20 | 20030 |
| CFTR-Intron10-6103 | − | AAGGAAGGAAGGAAAGAAGGA | 21 | 24983 |
| CFTR-Intron10-6104 | − | GAAGGAAGGAAGGAAAGAAGGA | 22 | 24984 |
| CFTR-Intron10-6105 | − | GGAAGGAAGGAAGGAAAGAAGGA | 23 | 24985 |
| CFTR-Intron10-6106 | − | AGGAAGGAAGGAAGGAAAGAAGGA | 24 | 24986 |
| CFTR-Intron10-6107 | − | GGAGGAAGGAAGGAAGGA | 18 | 24987 |
| CFTR-Intron10-6108 | − | AGGAGGAAGGAAGGAAGGA | 19 | 24988 |
| CFTR-Intron10-6109 | − | UAGGAGGAAGGAAGGAAGGA | 20 | 24989 |
| CFTR-Intron10-6110 | − | GUAGGAGGAAGGAAGGAAGGA | 21 | 24990 |
| CFTR-Intron10-6111 | − | AGUAGGAGGAAGGAAGGAAGGA | 22 | 24991 |
| CFTR-Intron10-6112 | − | AAGUAGGAGGAAGGAAGGAAGGA | 23 | 24992 |
| CFTR-Intron10-6113 | − | GAAGUAGGAGGAAGGAAGGAAGGA | 24 | 24993 |
| CFTR-Intron10-6114 | − | AGUAGGAGGAAGGAAGGA | 18 | 24994 |
| CFTR-Intron10-6115 | − | AAGUAGGAGGAAGGAAGGA | 19 | 24995 |
| CFTR-Intron10-652 | − | GAAGUAGGAGGAAGGAAGGA | 20 | 19538 |
| CFTR-Intron10-6116 | − | GGAAGUAGGAGGAAGGAAGGA | 21 | 24996 |
| CFTR-Intron10-6117 | − | AGGAAGUAGGAGGAAGGAAGGA | 22 | 24997 |
| CFTR-Intron10-6118 | − | AAGGAAGUAGGAGGAAGGAAGGA | 23 | 24998 |
| CFTR-Intron10-6119 | − | AAAGGAAGUAGGAGGAAGGAAGGA | 24 | 24999 |
| CFTR-Intron10-6120 | − | AGGAAGUAGGAGGAAGGA | 18 | 25000 |
| CFTR-Intron10-6121 | − | AAGGAAGUAGGAGGAAGGA | 19 | 25001 |
| CFTR-Intron10-1146 | − | AAAGGAAGUAGGAGGAAGGA | 20 | 20031 |
| CFTR-Intron10-6122 | − | GAAAGGAAGUAGGAGGAAGGA | 21 | 25002 |
| CFTR-Intron10-6123 | − | AGAAAGGAAGUAGGAGGAAGGA | 22 | 25003 |
| CFTR-Intron10-6124 | − | AAGAAAGGAAGUAGGAGGAAGGA | 23 | 25004 |
| CFTR-Intron10-6125 | − | GAAGAAAGGAAGUAGGAGGAAGGA | 24 | 25005 |
| CFTR-Intron10-6126 | − | UUAGAAAGAAUAAGAGGA | 18 | 25006 |
| CFTR-Intron10-6127 | − | AUUAGAAAGAAUAAGAGGA | 19 | 25007 |
| CFTR-Intron10-6128 | − | AAUUAGAAAGAAUAAGAGGA | 20 | 25008 |
| CFTR-Intron10-6129 | − | AAAUUAGAAAGAAUAAGAGGA | 21 | 25009 |
| CFTR-Intron10-6130 | − | GAAAUUAGAAAGAAUAAGAGGA | 22 | 25010 |
| CFTR-Intron10-6131 | − | UGAAAUUAGAAAGAAUAAGAGGA | 23 | 25011 |
| CFTR-Intron10-6132 | − | AUGAAAUUAGAAAGAAUAAGAGGA | 24 | 25012 |
| CFTR-Intron10-6133 | − | AGAAAAAGAAAGAGGA | 18 | 25013 |
| CFTR-Intron10-6134 | − | CAGAAAAAGAAAGAGGA | 19 | 25014 |
| CFTR-Intron10-1149 | − | ACAGAAAAGAAAGAGGA | 20 | 20034 |
| CFTR-Intron10-6135 | − | AACAGAAAAGAAAGAGGA | 21 | 25015 |

TABLE 41E-continued

5th Tier

| gRNA Name | DNA Strand | Targeting Domain | Target Site Length | Seq ID |
|---|---|---|---|---|
| CFTR-Intron10-6136 | - | AAACAGAAAAAGAAAGAGAGGA | 22 | 25016 |
| CFTR-Intron10-6137 | - | CAAACAGAAAAAGAAAGAGAGGA | 23 | 25017 |
| CFTR-Intron10-6138 | - | ACAAACAGAAAAAGAAAGAGAGGA | 24 | 25018 |
| CFTR-Intron10-6139 | - | AGAAAGGAAGUAGGAGGA | 18 | 25019 |
| CFTR-Intron10-6140 | - | AAGAAAGGAAGUAGGAGGA | 19 | 25020 |
| CFTR-Intron10-653 | - | GAAGAAAGGAAGUAGGAGGA | 20 | 19539 |
| CFTR-Intron10-6141 | - | GGAAGAAAGGAAGUAGGAGGA | 21 | 25021 |
| CFTR-Intron10-6142 | - | AGGAAGAAAGGAAGUAGGAGGA | 22 | 25022 |
| CFTR-Intron10-6143 | - | GAGGAAGAAAGGAAGUAGGAGGA | 23 | 25023 |
| CFTR-Intron10-6144 | - | UGAGGAAGAAAGGAAGUAGGAGGA | 24 | 25024 |
| CFTR-Intron10-6145 | - | CUUUUAGUAGUAUUAGGA | 18 | 25025 |
| CFTR-Intron10-6146 | - | CCUUUUAGUAGUAUUAGGA | 19 | 25026 |
| CFTR-Intron10-6147 | - | GCCUUUUAGUAGUAUUAGGA | 20 | 25027 |
| CFTR-Intron10-6148 | - | UGCCUUUUAGUAGUAUUAGGA | 21 | 25028 |
| CFTR-Intron10-6149 | - | CUGCCUUUUAGUAGUAUUAGGA | 22 | 25029 |
| CFTR-Intron10-6150 | - | GCUGCCUUUUAGUAGUAUUAGGA | 23 | 25030 |
| CFTR-Intron10-6151 | - | GGCUGCCUUUUAGUAGUAUUAGGA | 24 | 25031 |
| CFTR-Intron10-6152 | - | GGAGAAACAGGUUUUGGA | 18 | 25032 |
| CFTR-Intron10-6153 | - | GGGAGAAACAGGUUUUGGA | 19 | 25033 |
| CFTR-Intron10-1157 | - | UGGGAGAAACAGGUUUUGGA | 20 | 20042 |
| CFTR-Intron10-6154 | - | AUGGGAGAAACAGGUUUUGGA | 21 | 25034 |
| CFTR-Intron10-6155 | - | AAUGGGAGAAACAGGUUUUGGA | 22 | 25035 |
| CFTR-Intron10-6156 | - | UAAUGGGAGAAACAGGUUUUGGA | 23 | 25036 |
| CFTR-Intron10-6157 | - | AUAAUGGGAGAAACAGGUUUUGGA | 24 | 25037 |
| CFTR-Intron10-6158 | - | AUCACUGGAUGCCCUUGA | 18 | 25038 |
| CFTR-Intron10-6159 | - | CAUCACUGGAUGCCCUUGA | 19 | 25039 |
| CFTR-Intron10-6160 | - | GCAUCACUGGAUGCCCUUGA | 20 | 25040 |
| CFTR-Intron10-6161 | - | UGCAUCACUGGAUGCCCUUGA | 21 | 25041 |
| CFTR-Intron10-6162 | - | UUGCAUCACUGGAUGCCCUUGA | 22 | 25042 |
| CFTR-Intron10-6163 | - | UUUGCAUCACUGGAUGCCCUUGA | 23 | 25043 |
| CFTR-Intron10-6164 | - | UUUUGCAUCACUGGAUGCCCUUGA | 24 | 25044 |
| CFTR-Intron10-6165 | - | AUUCAGGACAUGCUUUGA | 18 | 25045 |
| CFTR-Intron10-6166 | - | GAUUCAGGACAUGCUUUGA | 19 | 25046 |
| CFTR-Intron10-1164 | - | AGAUUCAGGACAUGCUUUGA | 20 | 20049 |
| CFTR-Intron10-6167 | - | CAGAUUCAGGACAUGCUUUGA | 21 | 25047 |
| CFTR-Intron10-6168 | - | UCAGAUUCAGGACAUGCUUUGA | 22 | 25048 |
| CFTR-Intron10-6169 | - | AUCAGAUUCAGGACAUGCUUUGA | 23 | 25049 |

TABLE 41E-continued

5th Tier

| gRNA Name | DNA Strand | Targeting Domain | Target Site Length | Seq ID |
|---|---|---|---|---|
| CFTR-Intron10-6170 | − | GAUCAGAUUCAGGACAUGCUUUGA | 24 | 25050 |
| CFTR-Intron10-6171 | − | CUGUCUAGCCUAGAAAUA | 18 | 25051 |
| CFTR-Intron10-6172 | − | ACUGUCUAGCCUAGAAAUA | 19 | 25052 |
| CFTR-Intron10-6173 | − | AACUGUCUAGCCUAGAAAUA | 20 | 25053 |
| CFTR-Intron10-6174 | − | AAACUGUCUAGCCUAGAAAUA | 21 | 25054 |
| CFTR-Intron10-6175 | − | CAAACUGUCUAGCCUAGAAAUA | 22 | 25055 |
| CFTR-Intron10-6176 | − | ACAAACUGUCUAGCCUAGAAAUA | 23 | 25056 |
| CFTR-Intron10-6177 | − | CACAAACUGUCUAGCCUAGAAAUA | 24 | 25057 |
| CFTR-Intron10-6178 | − | CCGGUGUCUUCUGAAAUA | 18 | 25058 |
| CFTR-Intron10-6179 | − | ACCGGUGUCUUCUGAAAUA | 19 | 25059 |
| CFTR-Intron10-380 | − | AACCGGUGUCUUCUGAAAUA | 20 | 19266 |
| CFTR-Intron10-6180 | − | UAACCGGUGUCUUCUGAAAUA | 21 | 25060 |
| CFTR-Intron10-6181 | − | UUAACCGGUGUCUUCUGAAAUA | 22 | 25061 |
| CFTR-Intron10-6182 | − | AUUAACCGGUGUCUUCUGAAAUA | 23 | 25062 |
| CFTR-Intron10-6183 | − | AAUUAACCGGUGUCUUCUGAAAUA | 24 | 25063 |
| CFTR-Intron10-6184 | − | AGUGAUCCUAGAAUCAUA | 18 | 25064 |
| CFTR-Intron10-6185 | − | AAGUGAUCCUAGAAUCAUA | 19 | 25065 |
| CFTR-Intron10-6186 | − | AAAGUGAUCCUAGAAUCAUA | 20 | 25066 |
| CFTR-Intron10-6187 | − | UAAAGUGAUCCUAGAAUCAUA | 21 | 25067 |
| CFTR-Intron10-6188 | − | AUAAAGUGAUCCUAGAAUCAUA | 22 | 25068 |
| CFTR-Intron10-6189 | − | UAUAAAGUGAUCCUAGAAUCAUA | 23 | 25069 |
| CFTR-Intron10-6190 | − | AUAUAAAGUGAUCCUAGAAUCAUA | 24 | 25070 |
| CFTR-Intron10-6191 | − | CCGUUUACUAGAAAGAUA | 18 | 25071 |
| CFTR-Intron10-6192 | − | GCCGUUUACUAGAAAGAUA | 19 | 25072 |
| CFTR-Intron10-6193 | − | UGCCGUUUACUAGAAAGAUA | 20 | 25073 |
| CFTR-Intron10-6194 | − | GUGCCGUUUACUAGAAAGAUA | 21 | 25074 |
| CFTR-Intron10-6195 | − | UGUGCCGUUUACUAGAAAGAUA | 22 | 25075 |
| CFTR-Intron10-6196 | − | AUGUGCCGUUUACUAGAAAGAUA | 23 | 25076 |
| CFTR-Intron10-6197 | − | AAUGUGCCGUUUACUAGAAAGAUA | 24 | 25077 |
| CFTR-Intron10-6198 | − | CUUGGUAUUUACCAUAUA | 18 | 25078 |
| CFTR-Intron10-6199 | − | GCUUGGUAUUUACCAUAUA | 19 | 25079 |
| CFTR-Intron10-6200 | − | UGCUUGGUAUUUACCAUAUA | 20 | 25080 |
| CFTR-Intron10-6201 | − | UUGCUUGGUAUUUACCAUAUA | 21 | 25081 |
| CFTR-Intron10-6202 | − | GUUGCUUGGUAUUUACCAUAUA | 22 | 25082 |
| CFTR-Intron10-6203 | − | AGUUGCUUGGUAUUUACCAUAUA | 23 | 25083 |
| CFTR-Intron10-6204 | − | GAGUUGCUUGGUAUUUACCAUAUA | 24 | 25084 |
| CFTR-Intron10-6205 | − | UUACACUCUAGCAUUAUA | 18 | 25085 |

TABLE 41E-continued

5th Tier

| gRNA Name | DNA Strand | Targeting Domain | Target Site Length | Seq ID |
|---|---|---|---|---|
| CFTR-Intron10-6206 | - | AUUACACUCUAGCAUUAUA | 19 | 25086 |
| CFTR-Intron10-6207 | - | AAUUACACUCUAGCAUUAUA | 20 | 25087 |
| CFTR-Intron10-6208 | - | UAAUUACACUCUAGCAUUAUA | 21 | 25088 |
| CFTR-Intron10-6209 | - | AUAAUUACACUCUAGCAUUAUA | 22 | 25089 |
| CFTR-Intron10-6210 | - | UAUAAUUACACUCUAGCAUUAUA | 23 | 25090 |
| CFTR-Intron10-6211 | - | UUAUAAUUACACUCUAGCAUUAUA | 24 | 25091 |
| CFTR-Intron10-6212 | - | AAAGUUUCUCAUCUUAUA | 18 | 25092 |
| CFTR-Intron10-6213 | - | AAAAGUUUCUCAUCUUAUA | 19 | 25093 |
| CFTR-Intron10-1171 | - | AAAAAGUUUCUCAUCUUAUA | 20 | 20056 |
| CFTR-Intron10-6214 | - | UAAAAAGUUUCUCAUCUUAUA | 21 | 25094 |
| CFTR-Intron10-6215 | - | UUAAAAAGUUUCUCAUCUUAUA | 22 | 25095 |
| CFTR-Intron10-6216 | - | UUUAAAAAGUUUCUCAUCUUAUA | 23 | 25096 |
| CFTR-Intron10-6217 | - | AUUUAAAAAGUUUCUCAUCUUAUA | 24 | 25097 |
| CFTR-Intron10-6218 | - | GUACAAAGGAAUUUUAUA | 18 | 25098 |
| CFTR-Intron10-6219 | - | UGUACAAAGGAAUUUUAUA | 19 | 25099 |
| CFTR-Intron10-6220 | - | UUGUACAAAGGAAUUUUAUA | 20 | 25100 |
| CFTR-Intron10-6221 | - | UUUGUACAAAGGAAUUUUAUA | 21 | 25101 |
| CFTR-Intron10-6222 | - | UUUUGUACAAAGGAAUUUUAUA | 22 | 25102 |
| CFTR-Intron10-6223 | - | AUUUUGUACAAAGGAAUUUUAUA | 23 | 25103 |
| CFTR-Intron10-6224 | - | AAUUUUGUACAAAGGAAUUUUAUA | 24 | 25104 |
| CFTR-Intron10-6225 | - | CUUGCUCUCUUUUAACUA | 18 | 25105 |
| CFTR-Intron10-6226 | - | ACUUGCUCUCUUUUAACUA | 19 | 25106 |
| CFTR-Intron10-6227 | - | AACUUGCUCUCUUUUAACUA | 20 | 25107 |
| CFTR-Intron10-6228 | - | AAACUUGCUCUCUUUUAACUA | 21 | 25108 |
| CFTR-Intron10-6229 | - | AAAACUUGCUCUCUUUUAACUA | 22 | 25109 |
| CFTR-Intron10-6230 | - | AAAAACUUGCUCUCUUUUAACUA | 23 | 25110 |
| CFTR-Intron10-6231 | - | UAAAAACUUGCUCUCUUUUAACUA | 24 | 25111 |
| CFTR-Intron10-6232 | - | UAUUAAAAAUUAUACUA | 18 | 25112 |
| CFTR-Intron10-6233 | - | CUAUUAAAAAUUAUACUA | 19 | 25113 |
| CFTR-Intron10-6234 | - | ACUAUUAAAAAUUAUACUA | 20 | 25114 |
| CFTR-Intron10-6235 | - | CACUAUUAAAAAUUAUACUA | 21 | 25115 |
| CFTR-Intron10-6236 | - | UCACUAUUAAAAAUUAUACUA | 22 | 25116 |
| CFTR-Intron10-6237 | - | UUCACUAUUAAAAAUUAUACUA | 23 | 25117 |
| CFTR-Intron10-6238 | - | GUUCACUAUUAAAAAUUAUACUA | 24 | 25118 |
| CFTR-Intron10-6239 | - | UUGACCUAAGAUAUCCUA | 18 | 25119 |
| CFTR-Intron10-6240 | - | UUUGACCUAAGAUAUCCUA | 19 | 25120 |
| CFTR-Intron10-387 | - | CUUUGACCUAAGAUAUCCUA | 20 | 19273 |

TABLE 41E-continued

5th Tier

| gRNA Name | DNA Strand | Targeting Domain | Target Site Length | Seq ID |
|---|---|---|---|---|
| CFTR-Intron10-6241 | − | UCUUUGACCUAAGAUAUCCUA | 21 | 25121 |
| CFTR-Intron10-6242 | − | CUCUUUGACCUAAGAUAUCCUA | 22 | 25122 |
| CFTR-Intron10-6243 | − | CCUCUUUGACCUAAGAUAUCCUA | 23 | 25123 |
| CFTR-Intron10-6244 | − | UCCUCUUUGACCUAAGAUAUCCUA | 24 | 25124 |
| CFTR-Intron10-6245 | − | UAGUAUUAGAAUGGGCUA | 18 | 25125 |
| CFTR-Intron10-6246 | − | CUAGUAUUAGAAUGGGCUA | 19 | 25126 |
| CFTR-Intron10-6247 | − | UCUAGUAUUAGAAUGGGCUA | 20 | 25127 |
| CFTR-Intron10-6248 | − | UUCUAGUAUUAGAAUGGGCUA | 21 | 25128 |
| CFTR-Intron10-6249 | − | UUUCUAGUAUUAGAAUGGGCUA | 22 | 25129 |
| CFTR-Intron10-6250 | − | CUUUCUAGUAUUAGAAUGGGCUA | 23 | 25130 |
| CFTR-Intron10-6251 | − | GCUUUCUAGUAUUAGAAUGGGCUA | 24 | 25131 |
| CFTR-Intron10-6252 | − | GGGCUGGAUAAGAUUCUA | 18 | 25132 |
| CFTR-Intron10-6253 | − | GGGGCUGGAUAAGAUUCUA | 19 | 25133 |
| CFTR-Intron10-6254 | − | UGGGGCUGGAUAAGAUUCUA | 20 | 25134 |
| CFTR-Intron10-6255 | − | AUGGGGCUGGAUAAGAUUCUA | 21 | 25135 |
| CFTR-Intron10-6256 | − | GAUGGGGCUGGAUAAGAUUCUA | 22 | 25136 |
| CFTR-Intron10-6257 | − | AGAUGGGGCUGGAUAAGAUUCUA | 23 | 25137 |
| CFTR-Intron10-6258 | − | AAGAUGGGGCUGGAUAAGAUUCUA | 24 | 25138 |
| CFTR-Intron10-6259 | − | CUGGUUUGAAGAACAGUA | 18 | 25139 |
| CFTR-Intron10-6260 | − | UCUGGUUUGAAGAACAGUA | 19 | 25140 |
| CFTR-Intron10-86 | − | GUCUGGUUUGAAGAACAGUA | 20 | 18972 |
| CFTR-Intron10-6261 | − | UGUCUGGUUUGAAGAACAGUA | 21 | 25141 |
| CFTR-Intron10-6262 | − | CUGUCUGGUUUGAAGAACAGUA | 22 | 25142 |
| CFTR-Intron10-6263 | − | CCUGUCUGGUUUGAAGAACAGUA | 23 | 25143 |
| CFTR-Intron10-6264 | − | ACCUGUCUGGUUUGAAGAACAGUA | 24 | 25144 |
| CFTR-Intron10-6265 | − | CUGGCACCAUUCACAGUA | 18 | 25145 |
| CFTR-Intron10-6266 | − | CCUGGCACCAUUCACAGUA | 19 | 25146 |
| CFTR-Intron10-6267 | − | ACCUGGCACCAUUCACAGUA | 20 | 25147 |
| CFTR-Intron10-6268 | − | UACCUGGCACCAUUCACAGUA | 21 | 25148 |
| CFTR-Intron10-6269 | − | CUACCUGGCACCAUUCACAGUA | 22 | 25149 |
| CFTR-Intron10-6270 | − | CCUACCUGGCACCAUUCACAGUA | 23 | 25150 |
| CFTR-Intron10-6271 | − | CCCUACCUGGCACCAUUCACAGUA | 24 | 25151 |
| CFTR-Intron10-6272 | − | UUAAUGAAAGCAAUAGUA | 18 | 25152 |
| CFTR-Intron10-6273 | − | CUUAAUGAAAGCAAUAGUA | 19 | 25153 |
| CFTR-Intron10-6274 | − | ACUUAAUGAAAGCAAUAGUA | 20 | 25154 |
| CFTR-Intron10-6275 | − | GACUUAAUGAAAGCAAUAGUA | 21 | 25155 |
| CFTR-Intron10-6276 | − | UGACUUAAUGAAAGCAAUAGUA | 22 | 25156 |

TABLE 41E-continued

5th Tier

| gRNA Name | DNA Strand | Targeting Domain | Target Site Length | Seq ID |
|---|---|---|---|---|
| CFTR-Intron10-6277 | - | GUGACUUAAUGAAAGCAAUAGUA | 23 | 25157 |
| CFTR-Intron10-6278 | - | CGUGACUUAAUGAAAGCAAUAGUA | 24 | 25158 |
| CFTR-Intron10-6279 | - | GGCUUGAUCCAGGUAGUA | 18 | 25159 |
| CFTR-Intron10-6280 | - | UGGCUUGAUCCAGGUAGUA | 19 | 25160 |
| CFTR-Intron10-6281 | - | GUGGCUUGAUCCAGGUAGUA | 20 | 25161 |
| CFTR-Intron10-6282 | - | GGUGGCUUGAUCCAGGUAGUA | 21 | 25162 |
| CFTR-Intron10-6283 | - | UGGUGGCUUGAUCCAGGUAGUA | 22 | 25163 |
| CFTR-Intron10-6284 | - | AUGGUGGCUUGAUCCAGGUAGUA | 23 | 25164 |
| CFTR-Intron10-6285 | - | GAUGGUGGCUUGAUCCAGGUAGUA | 24 | 25165 |
| CFTR-Intron10-6286 | - | UUUUUAGGCUAUUCUGUA | 18 | 25166 |
| CFTR-Intron10-6287 | - | GUUUUUAGGCUAUUCUGUA | 19 | 25167 |
| CFTR-Intron10-390 | - | UGUUUUUAGGCUAUUCUGUA | 20 | 19276 |
| CFTR-Intron10-6288 | - | AUGUUUUUAGGCUAUUCUGUA | 21 | 25168 |
| CFTR-Intron10-6289 | - | AAUGUUUUUAGGCUAUUCUGUA | 22 | 25169 |
| CFTR-Intron10-6290 | - | UAAUGUUUUUAGGCUAUUCUGUA | 23 | 25170 |
| CFTR-Intron10-6291 | - | CUAAUGUUUUUAGGCUAUUCUGUA | 24 | 25171 |
| CFTR-Intron10-6292 | - | CACUUGACAGGUAUAUUA | 18 | 25172 |
| CFTR-Intron10-6293 | - | GCACUUGACAGGUAUAUUA | 19 | 25173 |
| CFTR-Intron10-6294 | - | AGCACUUGACAGGUAUAUUA | 20 | 25174 |
| CFTR-Intron10-6295 | - | UAGCACUUGACAGGUAUAUUA | 21 | 25175 |
| CFTR-Intron10-6296 | - | CUAGCACUUGACAGGUAUAUUA | 22 | 25176 |
| CFTR-Intron10-6297 | - | CCUAGCACUUGACAGGUAUAUUA | 23 | 25177 |
| CFTR-Intron10-6298 | - | GCCUAGCACUUGACAGGUAUAUUA | 24 | 25178 |
| CFTR-Intron10-6299 | - | GAGAUAACUCGUGACUUA | 18 | 25179 |
| CFTR-Intron10-6300 | - | GGAGAUAACUCGUGACUUA | 19 | 25180 |
| CFTR-Intron10-6301 | - | CGGAGAUAACUCGUGACUUA | 20 | 25181 |
| CFTR-Intron10-6302 | - | ACGGAGAUAACUCGUGACUUA | 21 | 25182 |
| CFTR-Intron10-6303 | - | UACGGAGAUAACUCGUGACUUA | 22 | 25183 |
| CFTR-Intron10-6304 | - | AUACGGAGAUAACUCGUGACUUA | 23 | 25184 |
| CFTR-Intron10-6305 | - | AAUACGGAGAUAACUCGUGACUUA | 24 | 25185 |
| CFTR-Intron10-6306 | - | UUUAUAAAGAAACCUUA | 18 | 25186 |
| CFTR-Intron10-6307 | - | CUUUAUAAAGAAACCUUA | 19 | 25187 |
| CFTR-Intron10-6308 | - | UCUUUAUAAAGAAACCUUA | 20 | 25188 |
| CFTR-Intron10-6309 | - | GUCUUUAUAAAGAAACCUUA | 21 | 25189 |
| CFTR-Intron10-6310 | - | UGUCUUUAUAAAGAAACCUUA | 22 | 25190 |
| CFTR-Intron10-6311 | - | GUGUCUUUAUAAAGAAACCUUA | 23 | 25191 |
| CFTR-Intron10-6312 | - | AGUGUCUUUAUAAAGAAACCUUA | 24 | 25192 |

TABLE 41E-continued

5th Tier

| gRNA Name | DNA Strand | Targeting Domain | Target Site Length | Seq ID |
|---|---|---|---|---|
| CFTR-Intron10-6313 | - | AGAGACCCUCACACCUUA | 18 | 25193 |
| CFTR-Intron10-6314 | - | GAGAGACCCUCACACCUUA | 19 | 25194 |
| CFTR-Intron10-6315 | - | AGAGAGACCCUCACACCUUA | 20 | 25195 |
| CFTR-Intron10-6316 | - | UAGAGAGACCCUCACACCUUA | 21 | 25196 |
| CFTR-Intron10-6317 | - | UUAGAGAGACCCUCACACCUUA | 22 | 25197 |
| CFTR-Intron10-6318 | - | CUUAGAGAGACCCUCACACCUUA | 23 | 25198 |
| CFTR-Intron10-6319 | - | CCUUAGAGAGACCCUCACACCUUA | 24 | 25199 |
| CFTR-Intron10-6320 | - | AAAAAGUUUCUCAUCUUA | 18 | 25200 |
| CFTR-Intron10-6321 | - | UAAAAAGUUUCUCAUCUUA | 19 | 25201 |
| CFTR-Intron10-6322 | - | UUAAAAAGUUUCUCAUCUUA | 20 | 25202 |
| CFTR-Intron10-6323 | - | UUUAAAAAGUUUCUCAUCUUA | 21 | 25203 |
| CFTR-Intron10-6324 | - | AUUUAAAAAGUUUCUCAUCUUA | 22 | 25204 |
| CFTR-Intron10-6325 | - | AAUUUAAAAAGUUUCUCAUCUUA | 23 | 25205 |
| CFTR-Intron10-6326 | - | UAAUUUAAAAAGUUUCUCAUCUUA | 24 | 25206 |
| CFTR-Intron10-6327 | - | GCUAUGAAGGCAGAGUUA | 18 | 25207 |
| CFTR-Intron10-6328 | - | AGCUAUGAAGGCAGAGUUA | 19 | 25208 |
| CFTR-Intron10-6329 | - | CAGCUAUGAAGGCAGAGUUA | 20 | 25209 |
| CFTR-Intron10-6330 | - | GCAGCUAUGAAGGCAGAGUUA | 21 | 25210 |
| CFTR-Intron10-6331 | - | AGCAGCUAUGAAGGCAGAGUUA | 22 | 25211 |
| CFTR-Intron10-6332 | - | AAGCAGCUAUGAAGGCAGAGUUA | 23 | 25212 |
| CFTR-Intron10-6333 | - | AAAGCAGCUAUGAAGGCAGAGUUA | 24 | 25213 |
| CFTR-Intron10-6334 | - | UCUAAGUAUUAGAGGUUA | 18 | 25214 |
| CFTR-Intron10-6335 | - | UUCUAAGUAUUAGAGGUUA | 19 | 25215 |
| CFTR-Intron10-397 | - | AUUCUAAGUAUUAGAGGUUA | 20 | 19283 |
| CFTR-Intron10-6336 | - | CAUUCUAAGUAUUAGAGGUUA | 21 | 25216 |
| CFTR-Intron10-6337 | - | GCAUUCUAAGUAUUAGAGGUUA | 22 | 25217 |
| CFTR-Intron10-6338 | - | GGCAUUCUAAGUAUUAGAGGUUA | 23 | 25218 |
| CFTR-Intron10-6339 | - | GGGCAUUCUAAGUAUUAGAGGUUA | 24 | 25219 |
| CFTR-Intron10-6340 | - | CUGUAGGUAAAAUGUUA | 18 | 25220 |
| CFTR-Intron10-6341 | - | GCUGUAGGUAAAAUGUUA | 19 | 25221 |
| CFTR-Intron10-6342 | - | UGCUGUAGGUAAAAUGUUA | 20 | 25222 |
| CFTR-Intron10-6343 | - | CUGCUGUAGGUAAAAUGUUA | 21 | 25223 |
| CFTR-Intron10-6344 | - | GCUGCUGUAGGUAAAAUGUUA | 22 | 25224 |
| CFTR-Intron10-6345 | - | UGCUGCUGUAGGUAAAAUGUUA | 23 | 25225 |
| CFTR-Intron10-6346 | - | CUGCUGCUGUAGGUAAAAUGUUA | 24 | 25226 |
| CFTR-Intron10-6347 | - | UAAGAAUUGUAAAAUUUA | 18 | 25227 |
| CFTR-Intron10-6348 | - | AUAAGAAUUGUAAAAUUUA | 19 | 25228 |

TABLE 41E-continued

5th Tier

| gRNA Name | DNA Strand | Targeting Domain | Target Site Length | Seq ID |
|---|---|---|---|---|
| CFTR-Intron10-6349 | - | AAUAAGAAUUGUAAAAUUUA | 20 | 25229 |
| CFTR-Intron10-6350 | - | UAAUAAGAAUUGUAAAAUUUA | 21 | 25230 |
| CFTR-Intron10-6351 | - | GUAAUAAGAAUUGUAAAAUUUA | 22 | 25231 |
| CFTR-Intron10-6352 | - | UGUAAUAAGAAUUGUAAAAUUUA | 23 | 25232 |
| CFTR-Intron10-6353 | - | AUGUAAUAAGAAUUGUAAAAUUUA | 24 | 25233 |
| CFTR-Intron10-6354 | - | CUUCCUUGAAUUAUUUA | 18 | 25234 |
| CFTR-Intron10-6355 | - | ACUUCCUUGAAUUAUUUA | 19 | 25235 |
| CFTR-Intron10-6356 | - | AACUUCCUUGAAUUAUUUA | 20 | 25236 |
| CFTR-Intron10-6357 | - | AAACUUCCUUGAAUUAUUUA | 21 | 25237 |
| CFTR-Intron10-6358 | - | GAAACUUCCUUGAAUUAUUUA | 22 | 25238 |
| CFTR-Intron10-6359 | - | UGAAACUUCCUUGAAUUAUUUA | 23 | 25239 |
| CFTR-Intron10-6360 | - | AUGAAACUUCCUUGAAUUAUUUA | 24 | 25240 |
| CFTR-Intron10-6361 | - | UGUUAUAGCAGCCUGAAC | 18 | 25241 |
| CFTR-Intron10-6362 | - | UUGUUAUAGCAGCCUGAAC | 19 | 25242 |
| CFTR-Intron10-6363 | - | UUUGUUAUAGCAGCCUGAAC | 20 | 25243 |
| CFTR-Intron10-6364 | - | UUUUGUUAUAGCAGCCUGAAC | 21 | 25244 |
| CFTR-Intron10-6365 | - | AUUUUGUUAUAGCAGCCUGAAC | 22 | 25245 |
| CFTR-Intron10-6366 | - | UAUUUUGUUAUAGCAGCCUGAAC | 23 | 25246 |
| CFTR-Intron10-6367 | - | GUAUUUUGUUAUAGCAGCCUGAAC | 24 | 25247 |
| CFTR-Intron10-6368 | - | GCUUAUUCUUGUAAUAAC | 18 | 25248 |
| CFTR-Intron10-6369 | - | AGCUUAUUCUUGUAAUAAC | 19 | 25249 |
| CFTR-Intron10-404 | - | UAGCUUAUUCUUGUAAUAAC | 20 | 19290 |
| CFTR-Intron10-6370 | - | UUAGCUUAUUCUUGUAAUAAC | 21 | 25250 |
| CFTR-Intron10-6371 | - | UUUAGCUUAUUCUUGUAAUAAC | 22 | 25251 |
| CFTR-Intron10-6372 | - | UUUUAGCUUAUUCUUGUAAUAAC | 23 | 25252 |
| CFTR-Intron10-6373 | - | GUUUUAGCUUAUUCUUGUAAUAAC | 24 | 25253 |
| CFTR-Intron10-6374 | - | GGCCUGCAUAUGUCUAAC | 18 | 25254 |
| CFTR-Intron10-6375 | - | GGGCCUGCAUAUGUCUAAC | 19 | 25255 |
| CFTR-Intron10-6376 | - | UGGGCCUGCAUAUGUCUAAC | 20 | 25256 |
| CFTR-Intron10-6377 | - | UUGGGCCUGCAUAUGUCUAAC | 21 | 25257 |
| CFTR-Intron10-6378 | - | UUUGGGCCUGCAUAUGUCUAAC | 22 | 25258 |
| CFTR-Intron10-6379 | - | AUUUGGGCCUGCAUAUGUCUAAC | 23 | 25259 |
| CFTR-Intron10-6380 | - | UAUUUGGGCCUGCAUAUGUCUAAC | 24 | 25260 |
| CFTR-Intron10-6381 | - | CUUUCUGGACUGAGUAAC | 18 | 25261 |
| CFTR-Intron10-6382 | - | GCUUUCUGGACUGAGUAAC | 19 | 25262 |
| CFTR-Intron10-1182 | - | AGCUUUCUGGACUGAGUAAC | 20 | 20067 |
| CFTR-Intron10-6383 | - | AAGCUUUCUGGACUGAGUAAC | 21 | 25263 |

TABLE 41E-continued

5th Tier

| gRNA Name | DNA Strand | Targeting Domain | Target Site Length | Seq ID |
|---|---|---|---|---|
| CFTR-Intron10-6384 | - | CAAGCUUUCUGGACUGAGUAAC | 22 | 25264 |
| CFTR-Intron10-6385 | - | CCAAGCUUUCUGGACUGAGUAAC | 23 | 25265 |
| CFTR-Intron10-6386 | - | UCCAAGCUUUCUGGACUGAGUAAC | 24 | 25266 |
| CFTR-Intron10-6387 | - | UCAUUUCAACUUAUACAC | 18 | 25267 |
| CFTR-Intron10-6388 | - | AUCAUUUCAACUUAUACAC | 19 | 25268 |
| CFTR-Intron10-407 | - | UAUCAUUUCAACUUAUACAC | 20 | 19293 |
| CFTR-Intron10-6389 | - | AUAUCAUUUCAACUUAUACAC | 21 | 25269 |
| CFTR-Intron10-6390 | - | AAUAUCAUUUCAACUUAUACAC | 22 | 25270 |
| CFTR-Intron10-6391 | - | AAAUAUCAUUUCAACUUAUACAC | 23 | 25271 |
| CFTR-Intron10-6392 | - | AAAAUAUCAUUUCAACUUAUACAC | 24 | 25272 |
| CFTR-Intron10-6393 | - | GGUGAGAUUAGAGGCCAC | 18 | 25273 |
| CFTR-Intron10-6394 | - | GGGUGAGAUUAGAGGCCAC | 19 | 25274 |
| CFTR-Intron10-409 | - | UGGGUGAGAUUAGAGGCCAC | 20 | 19295 |
| CFTR-Intron10-6395 | - | CUGGGUGAGAUUAGAGGCCAC | 21 | 25275 |
| CFTR-Intron10-6396 | - | UCUGGGUGAGAUUAGAGGCCAC | 22 | 25276 |
| CFTR-Intron10-6397 | - | CUCUGGGUGAGAUUAGAGGCCAC | 23 | 25277 |
| CFTR-Intron10-6398 | - | UCUCUGGGUGAGAUUAGAGGCCAC | 24 | 25278 |
| CFTR-Intron10-6399 | - | CUGAGGUGGGAGGAUCAC | 18 | 25279 |
| CFTR-Intron10-6400 | - | GCUGAGGUGGGAGGAUCAC | 19 | 25280 |
| CFTR-Intron10-6401 | - | GGCUGAGGUGGGAGGAUCAC | 20 | 25281 |
| CFTR-Intron10-6402 | - | AGGCUGAGGUGGGAGGAUCAC | 21 | 25282 |
| CFTR-Intron10-6403 | - | GAGGCUGAGGUGGGAGGAUCAC | 22 | 25283 |
| CFTR-Intron10-6404 | - | GGAGGCUGAGGUGGGAGGAUCAC | 23 | 25284 |
| CFTR-Intron10-6405 | - | GGGAGGCUGAGGUGGGAGGAUCAC | 24 | 25285 |
| CFTR-Intron10-6406 | - | GUUUGUCUUUAAUUUCAC | 18 | 25286 |
| CFTR-Intron10-6407 | - | GGUUUGUCUUUAAUUUCAC | 19 | 25287 |
| CFTR-Intron10-6408 | - | AGGUUUGUCUUUAAUUUCAC | 20 | 25288 |
| CFTR-Intron10-6409 | - | UAGGUUUGUCUUUAAUUUCAC | 21 | 25289 |
| CFTR-Intron10-6410 | - | UUAGGUUUGUCUUUAAUUUCAC | 22 | 25290 |
| CFTR-Intron10-6411 | - | GUUAGGUUUGUCUUUAAUUUCAC | 23 | 25291 |
| CFTR-Intron10-6412 | - | AGUUAGGUUUGUCUUUAAUUUCAC | 24 | 25292 |
| CFTR-Intron10-6413 | - | GGAAAUAAAUUUAAAGAC | 18 | 25293 |
| CFTR-Intron10-6414 | - | AGGAAAUAAAUUUAAAGAC | 19 | 25294 |
| CFTR-Intron10-6415 | - | GAGGAAAUAAAUUUAAAGAC | 20 | 25295 |
| CFTR-Intron10-6416 | - | UGAGGAAAUAAAUUUAAAGAC | 21 | 25296 |
| CFTR-Intron10-6417 | - | UUGAGGAAAUAAAUUUAAAGAC | 22 | 25297 |
| CFTR-Intron10-6418 | - | AUUGAGGAAAUAAAUUUAAAGAC | 23 | 25298 |

TABLE 41E-continued

5th Tier

| gRNA Name | DNA Strand | Targeting Domain | Target Site Length | Seq ID |
|---|---|---|---|---|
| CFTR-Intron10-6419 | - | UAUUGAGGAAAUAAAUUUAAAGAC | 24 | 25299 |
| CFTR-Intron10-6420 | - | GCUGGCAUAGAGUAAGAC | 18 | 25300 |
| CFTR-Intron10-6421 | - | GGCUGGCAUAGAGUAAGAC | 19 | 25301 |
| CFTR-Intron10-412 | - | AGGCUGGCAUAGAGUAAGAC | 20 | 19298 |
| CFTR-Intron10-6422 | - | GAGGCUGGCAUAGAGUAAGAC | 21 | 25302 |
| CFTR-Intron10-6423 | - | UGAGGCUGGCAUAGAGUAAGAC | 22 | 25303 |
| CFTR-Intron10-6424 | - | CUGAGGCUGGCAUAGAGUAAGAC | 23 | 25304 |
| CFTR-Intron10-6425 | - | ACUGAGGCUGGCAUAGAGUAAGAC | 24 | 25305 |
| CFTR-Intron10-6426 | - | GCUAUUCUGUAGGGAGAC | 18 | 25306 |
| CFTR-Intron10-6427 | - | GGCUAUUCUGUAGGGAGAC | 19 | 25307 |
| CFTR-Intron10-6428 | - | AGGCUAUUCUGUAGGGAGAC | 20 | 25308 |
| CFTR-Intron10-6429 | - | UAGGCUAUUCUGUAGGGAGAC | 21 | 25309 |
| CFTR-Intron10-6430 | - | UUAGGCUAUUCUGUAGGGAGAC | 22 | 25310 |
| CFTR-Intron10-6431 | - | UUUAGGCUAUUCUGUAGGGAGAC | 23 | 25311 |
| CFTR-Intron10-6432 | - | UUUUAGGCUAUUCUGUAGGGAGAC | 24 | 25312 |
| CFTR-Intron10-6433 | - | AAGAAUUGAAUAUGAGAC | 18 | 25313 |
| CFTR-Intron10-6434 | - | GAAGAAUUGAAUAUGAGAC | 19 | 25314 |
| CFTR-Intron10-6435 | - | UGAAGAAUUGAAUAUGAGAC | 20 | 25315 |
| CFTR-Intron10-6436 | - | UUGAAGAAUUGAAUAUGAGAC | 21 | 25316 |
| CFTR-Intron10-6437 | - | UUUGAAGAAUUGAAUAUGAGAC | 22 | 25317 |
| CFTR-Intron10-6438 | - | UUUUGAAGAAUUGAAUAUGAGAC | 23 | 25318 |
| CFTR-Intron10-6439 | - | AUUUUGAAGAAUUGAAUAUGAGAC | 24 | 25319 |
| CFTR-Intron10-6440 | - | GCCCGUAGUCCCAGCUAC | 18 | 25320 |
| CFTR-Intron10-6441 | - | UGCCCGUAGUCCCAGCUAC | 19 | 25321 |
| CFTR-Intron10-6442 | - | GUGCCCGUAGUCCCAGCUAC | 20 | 25322 |
| CFTR-Intron10-6443 | - | GGUGCCCGUAGUCCCAGCUAC | 21 | 25323 |
| CFTR-Intron10-6444 | - | GGGUGCCCGUAGUCCCAGCUAC | 22 | 25324 |
| CFTR-Intron10-6445 | - | CGGGUGCCCGUAGUCCCAGCUAC | 23 | 25325 |
| CFTR-Intron10-6446 | - | GCGGGUGCCCGUAGUCCCAGCUAC | 24 | 25326 |
| CFTR-Intron10-6447 | - | UGUGCCUGUAGUCCCAGCUAC | 21 | 25327 |
| CFTR-Intron10-6448 | - | GUGUGCCUGUAGUCCCAGCUAC | 22 | 25328 |
| CFTR-Intron10-6449 | - | UGUGUGCCUGUAGUCCCAGCUAC | 23 | 25329 |
| CFTR-Intron10-6450 | - | GUGUGUGCCUGUAGUCCCAGCUAC | 24 | 25330 |
| CFTR-Intron10-6451 | - | GAAAAGUUGUAACAGUAC | 18 | 25331 |
| CFTR-Intron10-6452 | - | GGAAAAGUUGUAACAGUAC | 19 | 25332 |
| CFTR-Intron10-6453 | - | CGGAAAAGUUGUAACAGUAC | 20 | 25333 |
| CFTR-Intron10-6454 | - | ACGGAAAAGUUGUAACAGUAC | 21 | 25334 |

TABLE 41E-continued

5th Tier

| gRNA Name | DNA Strand | Targeting Domain | Target Site Length | Seq ID |
|---|---|---|---|---|
| CFTR-Intron10-6455 | - | CACGGAAAAGUUGUAACAGUAC | 22 | 25335 |
| CFTR-Intron10-6456 | - | GCACGGAAAAGUUGUAACAGUAC | 23 | 25336 |
| CFTR-Intron10-6457 | - | UGCACGGAAAAGUUGUAACAGUAC | 24 | 25337 |
| CFTR-Intron10-6458 | - | GAUAAAUGUGCCGUUUAC | 18 | 25338 |
| CFTR-Intron10-6459 | - | GGAUAAAUGUGCCGUUUAC | 19 | 25339 |
| CFTR-Intron10-6460 | - | AGGAUAAAUGUGCCGUUUAC | 20 | 25340 |
| CFTR-Intron10-6461 | - | AAGGAUAAAUGUGCCGUUUAC | 21 | 25341 |
| CFTR-Intron10-6462 | - | GAAGGAUAAAUGUGCCGUUUAC | 22 | 25342 |
| CFTR-Intron10-6463 | - | GGAAGGAUAAAUGUGCCGUUUAC | 23 | 25343 |
| CFTR-Intron10-6464 | - | UGGAAGGAUAAAUGUGCCGUUUAC | 24 | 25344 |
| CFTR-Intron10-6465 | - | UCAUAGCUCACUGUAACC | 18 | 25345 |
| CFTR-Intron10-6466 | - | AUCAUAGCUCACUGUAACC | 19 | 25346 |
| CFTR-Intron10-6467 | - | GAUCAUAGCUCACUGUAACC | 20 | 25347 |
| CFTR-Intron10-6468 | - | UGAUCAUAGCUCACUGUAACC | 21 | 25348 |
| CFTR-Intron10-6469 | - | GUGAUCAUAGCUCACUGUAACC | 22 | 25349 |
| CFTR-Intron10-6470 | - | UGUGAUCAUAGCUCACUGUAACC | 23 | 25350 |
| CFTR-Intron10-6471 | - | GUGUGAUCAUAGCUCACUGUAACC | 24 | 25351 |
| CFTR-Intron10-6472 | - | GUCUAGCCUAGAAAUACC | 18 | 25352 |
| CFTR-Intron10-6473 | - | UGUCUAGCCUAGAAAUACC | 19 | 25353 |
| CFTR-Intron10-6474 | - | CUGUCUAGCCUAGAAAUACC | 20 | 25354 |
| CFTR-Intron10-6475 | - | ACUGUCUAGCCUAGAAAUACC | 21 | 25355 |
| CFTR-Intron10-6476 | - | AACUGUCUAGCCUAGAAAUACC | 22 | 25356 |
| CFTR-Intron10-6477 | - | AAACUGUCUAGCCUAGAAAUACC | 23 | 25357 |
| CFTR-Intron10-6478 | - | CAAACUGUCUAGCCUAGAAAUACC | 24 | 25358 |
| CFTR-Intron10-6479 | - | GAGGAAGGCAGUGGUCCC | 18 | 25359 |
| CFTR-Intron10-6480 | - | AGAGGAAGGCAGUGGUCCC | 19 | 25360 |
| CFTR-Intron10-6481 | - | UAGAGGAAGGCAGUGGUCCC | 20 | 25361 |
| CFTR-Intron10-6482 | - | UUAGAGGAAGGCAGUGGUCCC | 21 | 25362 |
| CFTR-Intron10-6483 | - | GUUAGAGGAAGGCAGUGGUCCC | 22 | 25363 |
| CFTR-Intron10-6484 | - | AGUUAGAGGAAGGCAGUGGUCCC | 23 | 25364 |
| CFTR-Intron10-6485 | - | GAGUUAGAGGAAGGCAGUGGUCCC | 24 | 25365 |
| CFTR-Intron10-6486 | - | CUCACAAACUGUCUAGCC | 18 | 25366 |
| CFTR-Intron10-6487 | - | ACUCACAAACUGUCUAGCC | 19 | 25367 |
| CFTR-Intron10-6488 | - | AACUCACAAACUGUCUAGCC | 20 | 25368 |
| CFTR-Intron10-6489 | - | AAACUCACAAACUGUCUAGCC | 21 | 25369 |
| CFTR-Intron10-6490 | - | AAAACUCACAAACUGUCUAGCC | 22 | 25370 |
| CFTR-Intron10-6491 | - | AAAAACUCACAAACUGUCUAGCC | 23 | 25371 |

TABLE 41E-continued

5th Tier

| gRNA Name | DNA Strand | Targeting Domain | Target Site Length | Seq ID |
|---|---|---|---|---|
| CFTR-Intron10-6492 | - | AAAAAACUCACAAACUGUCUAGCC | 24 | 25372 |
| CFTR-Intron10-6493 | - | UGAAUGAAUGUGGUAUCC | 18 | 25373 |
| CFTR-Intron10-6494 | - | GUGAAUGAAUGUGGUAUCC | 19 | 25374 |
| CFTR-Intron10-425 | - | AGUGAAUGAAUGUGGUAUCC | 20 | 19311 |
| CFTR-Intron10-6495 | - | UAGUGAAUGAAUGUGGUAUCC | 21 | 25375 |
| CFTR-Intron10-6496 | - | CUAGUGAAUGAAUGUGGUAUCC | 22 | 25376 |
| CFTR-Intron10-6497 | - | GCUAGUGAAUGAAUGUGGUAUCC | 23 | 25377 |
| CFTR-Intron10-6498 | - | AGCUAGUGAAUGAAUGUGGUAUCC | 24 | 25378 |
| CFTR-Intron10-6499 | - | UUGGGAGGUGAUUAGUCC | 18 | 25379 |
| CFTR-Intron10-6500 | - | UUUGGGAGGUGAUUAGUCC | 19 | 25380 |
| CFTR-Intron10-6501 | - | CUUUGGGAGGUGAUUAGUCC | 20 | 25381 |
| CFTR-Intron10-6502 | - | CCUUUGGGAGGUGAUUAGUCC | 21 | 25382 |
| CFTR-Intron10-6503 | - | GCCUUUGGGAGGUGAUUAGUCC | 22 | 25383 |
| CFTR-Intron10-6504 | - | GGCCUUUGGGAGGUGAUUAGUCC | 23 | 25384 |
| CFTR-Intron10-6505 | - | GGGCCUUUGGGAGGUGAUUAGUCC | 24 | 25385 |
| CFTR-Intron10-6506 | - | UCUUUAUUUUAUAUUCC | 18 | 25386 |
| CFTR-Intron10-6507 | - | UUCUUUAUUUUAUAUUCC | 19 | 25387 |
| CFTR-Intron10-6508 | - | CUUCUUUAUUUUAUAUUCC | 20 | 25388 |
| CFTR-Intron10-6509 | - | UCUUCUUUAUUUUAUAUUCC | 21 | 25389 |
| CFTR-Intron10-6510 | - | GUCUUCUUUAUUUUAUAUUCC | 22 | 25390 |
| CFTR-Intron10-6511 | - | UGUCUUCUUUAUUUUAUAUUCC | 23 | 25391 |
| CFTR-Intron10-6512 | - | AUGUCUUCUUUAUUUUAUAUUCC | 24 | 25392 |
| CFTR-Intron10-6513 | - | GUUGUCAAAUGUCCUUCC | 18 | 25393 |
| CFTR-Intron10-6514 | - | UGUUGUCAAAUGUCCUUCC | 19 | 25394 |
| CFTR-Intron10-6515 | - | AUGUUGUCAAAUGUCCUUCC | 20 | 25395 |
| CFTR-Intron10-6516 | - | GAUGUUGUCAAAUGUCCUUCC | 21 | 25396 |
| CFTR-Intron10-6517 | - | AGAUGUUGUCAAAUGUCCUUCC | 22 | 25397 |
| CFTR-Intron10-6518 | - | UAGAUGUUGUCAAAUGUCCUUCC | 23 | 25398 |
| CFTR-Intron10-6519 | - | GUAGAUGUUGUCAAAUGUCCUUCC | 24 | 25399 |
| CFTR-Intron10-6520 | - | CUUUUUUAGUAUCUUCC | 18 | 25400 |
| CFTR-Intron10-6521 | - | ACUUUUUUAGUAUCUUCC | 19 | 25401 |
| CFTR-Intron10-6522 | - | AACUUUUUUAGUAUCUUCC | 20 | 25402 |
| CFTR-Intron10-6523 | - | UAACUUUUUUAGUAUCUUCC | 21 | 25403 |
| CFTR-Intron10-6524 | - | GUAACUUUUUUAGUAUCUUCC | 22 | 25404 |
| CFTR-Intron10-6525 | - | GGUAACUUUUUUAGUAUCUUCC | 23 | 25405 |
| CFTR-Intron10-6526 | - | AGGUAACUUUUUUAGUAUCUUCC | 24 | 25406 |
| CFTR-Intron10-6527 | - | GGAGACAAGGGAGGAAGC | 18 | 25407 |

TABLE 41E-continued

5th Tier

| gRNA Name | DNA Strand | Targeting Domain | Target Site Length | Seq ID |
|---|---|---|---|---|
| CFTR-Intron10-6528 | - | GGGAGACAAGGGAGGAAGC | 19 | 25408 |
| CFTR-Intron10-6529 | - | AGGGAGACAAGGGAGGAAGC | 20 | 25409 |
| CFTR-Intron10-6530 | - | UAGGGAGACAAGGGAGGAAGC | 21 | 25410 |
| CFTR-Intron10-6531 | - | GUAGGGAGACAAGGGAGGAAGC | 22 | 25411 |
| CFTR-Intron10-6532 | - | UGUAGGGAGACAAGGGAGGAAGC | 23 | 25412 |
| CFTR-Intron10-6533 | - | CUGUAGGGAGACAAGGGAGGAAGC | 24 | 25413 |
| CFTR-Intron10-6534 | - | GCCAUGUGAGAACACAGC | 18 | 25414 |
| CFTR-Intron10-6535 | - | UGCCAUGUGAGAACACAGC | 19 | 25415 |
| CFTR-Intron10-1218 | - | CUGCCAUGUGAGAACACAGC | 20 | 20103 |
| CFTR-Intron10-6536 | - | UCUGCCAUGUGAGAACACAGC | 21 | 25416 |
| CFTR-Intron10-6537 | - | UUCUGCCAUGUGAGAACACAGC | 22 | 25417 |
| CFTR-Intron10-6538 | - | UUUCUGCCAUGUGAGAACACAGC | 23 | 25418 |
| CFTR-Intron10-6539 | - | CUUUCUGCCAUGUGAGAACACAGC | 24 | 25419 |
| CFTR-Intron10-6540 | - | CAGGAGUUUGAGACCAGC | 18 | 25420 |
| CFTR-Intron10-6541 | - | CCAGGAGUUUGAGACCAGC | 19 | 25421 |
| CFTR-Intron10-6542 | - | UCCAGGAGUUUGAGACCAGC | 20 | 25422 |
| CFTR-Intron10-6543 | - | GUCCAGGAGUUUGAGACCAGC | 21 | 25423 |
| CFTR-Intron10-6544 | - | AGUCCAGGAGUUUGAGACCAGC | 22 | 25424 |
| CFTR-Intron10-6545 | - | GAGUCCAGGAGUUUGAGACCAGC | 23 | 25425 |
| CFTR-Intron10-6546 | - | UGAGUCCAGGAGUUUGAGACCAGC | 24 | 25426 |
| CFTR-Intron10-6547 | - | GUAUUUUGUUAUAGCAGC | 18 | 25427 |
| CFTR-Intron10-6548 | - | GGUAUUUUGUUAUAGCAGC | 19 | 25428 |
| CFTR-Intron10-6549 | - | UGGUAUUUUGUUAUAGCAGC | 20 | 25429 |
| CFTR-Intron10-6550 | - | AUGGUAUUUUGUUAUAGCAGC | 21 | 25430 |
| CFTR-Intron10-6551 | - | CAUGGUAUUUUGUUAUAGCAGC | 22 | 25431 |
| CFTR-Intron10-6552 | - | UCAUGGUAUUUUGUUAUAGCAGC | 23 | 25432 |
| CFTR-Intron10-6553 | - | UUCAUGGUAUUUUGUUAUAGCAGC | 24 | 25433 |
| CFTR-Intron10-6554 | - | UGGGAGGAUCACCUGAGC | 18 | 25434 |
| CFTR-Intron10-6555 | - | GUGGGAGGAUCACCUGAGC | 19 | 25435 |
| CFTR-Intron10-6556 | - | GGUGGGAGGAUCACCUGAGC | 20 | 25436 |
| CFTR-Intron10-6557 | - | AGGUGGGAGGAUCACCUGAGC | 21 | 25437 |
| CFTR-Intron10-6558 | - | GAGGUGGGAGGAUCACCUGAGC | 22 | 25438 |
| CFTR-Intron10-6559 | - | UGAGGUGGGAGGAUCACCUGAGC | 23 | 25439 |
| CFTR-Intron10-6560 | - | CUGAGGUGGGAGGAUCACCUGAGC | 24 | 25440 |
| CFTR-Intron10-6561 | - | CUCACCCUCCCAAGUAGC | 18 | 25441 |
| CFTR-Intron10-6562 | - | CCUCACCCUCCCAAGUAGC | 19 | 25442 |
| CFTR-Intron10-672 | - | GCCUCACCCUCCCAAGUAGC | 20 | 19558 |

TABLE 41E-continued

5th Tier

| gRNA Name | DNA Strand | Targeting Domain | Target Site Length | Seq ID |
|---|---|---|---|---|
| CFTR-Intron10-6563 | − | UGCCUCACCCUCCCAAGUAGC | 21 | 25443 |
| CFTR-Intron10-6564 | − | CUGCCUCACCCUCCCAAGUAGC | 22 | 25444 |
| CFTR-Intron10-6565 | − | CCUGCCUCACCCUCCCAAGUAGC | 23 | 25445 |
| CFTR-Intron10-6566 | − | UCCUGCCUCACCCUCCCAAGUAGC | 24 | 25446 |
| CFTR-Intron10-6567 | − | CUCAGCCUCCCAAGUAGC | 18 | 25447 |
| CFTR-Intron10-6568 | − | CCUCAGCCUCCCAAGUAGC | 19 | 25448 |
| CFTR-Intron10-673 | − | GCCUCAGCCUCCCAAGUAGC | 20 | 19559 |
| CFTR-Intron10-6569 | − | UGCCUCAGCCUCCCAAGUAGC | 21 | 25449 |
| CFTR-Intron10-6570 | − | CUGCCUCAGCCUCCCAAGUAGC | 22 | 25450 |
| CFTR-Intron10-6571 | − | CCUGCCUCAGCCUCCCAAGUAGC | 23 | 25451 |
| CFTR-Intron10-6572 | − | UCCUGCCUCAGCCUCCCAAGUAGC | 24 | 25452 |
| CFTR-Intron10-6573 | − | CCCUUAAACAAUACAGGC | 18 | 25453 |
| CFTR-Intron10-6574 | − | ACCCUUAAACAAUACAGGC | 19 | 25454 |
| CFTR-Intron10-6575 | − | GACCCUUAAACAAUACAGGC | 20 | 25455 |
| CFTR-Intron10-6576 | − | UGACCCUUAAACAAUACAGGC | 21 | 25456 |
| CFTR-Intron10-6577 | − | UUGACCCUUAAACAAUACAGGC | 22 | 25457 |
| CFTR-Intron10-6578 | − | AUUGACCCUUAAACAAUACAGGC | 23 | 25458 |
| CFTR-Intron10-6579 | − | AAUUGACCCUUAAACAAUACAGGC | 24 | 25459 |
| CFTR-Intron10-6580 | − | AGUGCUGGGAUUACAGGC | 18 | 25460 |
| CFTR-Intron10-6581 | − | AAGUGCUGGGAUUACAGGC | 19 | 25461 |
| CFTR-Intron10-6582 | − | AAAGUGCUGGGAUUACAGGC | 20 | 25462 |
| CFTR-Intron10-6583 | − | CAAAGUGCUGGGAUUACAGGC | 21 | 25463 |
| CFTR-Intron10-6584 | − | CCAAAGUGCUGGGAUUACAGGC | 22 | 25464 |
| CFTR-Intron10-6585 | − | CCCAAAGUGCUGGGAUUACAGGC | 23 | 25465 |
| CFTR-Intron10-6586 | − | UCCCAAAGUGCUGGGAUUACAGGC | 24 | 25466 |
| CFTR-Intron10-6587 | − | AGUGUUGGGAUUACAGGC | 18 | 25467 |
| CFTR-Intron10-6588 | − | AAGUGUUGGGAUUACAGGC | 19 | 25468 |
| CFTR-Intron10-6589 | − | AAAGUGUUGGGAUUACAGGC | 20 | 25469 |
| CFTR-Intron10-6590 | − | CAAAGUGUUGGGAUUACAGGC | 21 | 25470 |
| CFTR-Intron10-6591 | − | CCAAAGUGUUGGGAUUACAGGC | 22 | 25471 |
| CFTR-Intron10-6592 | − | CCCAAAGUGUUGGGAUUACAGGC | 23 | 25472 |
| CFTR-Intron10-6593 | − | UCCCAAAGUGUUGGGAUUACAGGC | 24 | 25473 |
| CFTR-Intron10-6594 | − | GUCUUACUGUCACCAGGC | 18 | 25474 |
| CFTR-Intron10-6595 | − | AGUCUUACUGUCACCAGGC | 19 | 25475 |
| CFTR-Intron10-677 | − | GAGUCUUACUGUCACCAGGC | 20 | 19563 |
| CFTR-Intron10-6596 | − | AGAGUCUUACUGUCACCAGGC | 21 | 25476 |
| CFTR-Intron10-6597 | − | CAGAGUCUUACUGUCACCAGGC | 22 | 25477 |

TABLE 41E-continued

5th Tier

| gRNA Name | DNA Strand | Targeting Domain | Target Site Length | Seq ID |
|---|---|---|---|---|
| CFTR-Intron10-6598 | - | ACAGAGUCUUACUGUCACCAGGC | 23 | 25478 |
| CFTR-Intron10-6599 | - | GACAGAGUCUUACUGUCACCAGGC | 24 | 25479 |
| CFTR-Intron10-6600 | - | UACUCGGGAGGCUGAGGC | 18 | 25480 |
| CFTR-Intron10-6601 | - | CUACUCGGGAGGCUGAGGC | 19 | 25481 |
| CFTR-Intron10-680 | - | GCUACUCGGGAGGCUGAGGC | 20 | 19566 |
| CFTR-Intron10-6602 | - | AGCUACUCGGGAGGCUGAGGC | 21 | 25482 |
| CFTR-Intron10-6603 | - | CAGCUACUCGGGAGGCUGAGGC | 22 | 25483 |
| CFTR-Intron10-6604 | - | CCAGCUACUCGGGAGGCUGAGGC | 23 | 25484 |
| CFTR-Intron10-6605 | - | CCCAGCUACUCGGGAGGCUGAGGC | 24 | 25485 |
| CFTR-Intron10-6606 | - | AGUGCUGGGUUUAUAGGC | 18 | 25486 |
| CFTR-Intron10-6607 | - | AAGUGCUGGGUUUAUAGGC | 19 | 25487 |
| CFTR-Intron10-6608 | - | AAAGUGCUGGGUUUAUAGGC | 20 | 25488 |
| CFTR-Intron10-6609 | - | CAAAGUGCUGGGUUUAUAGGC | 21 | 25489 |
| CFTR-Intron10-6610 | - | CCAAAGUGCUGGGUUUAUAGGC | 22 | 25490 |
| CFTR-Intron10-6611 | - | CCCAAAGUGCUGGGUUUAUAGGC | 23 | 25491 |
| CFTR-Intron10-6612 | - | UCCCAAAGUGCUGGGUUUAUAGGC | 24 | 25492 |
| CFTR-Intron10-6613 | - | AAGUGCCACUAGUGAUGC | 18 | 25493 |
| CFTR-Intron10-6614 | - | AAAGUGCCACUAGUGAUGC | 19 | 25494 |
| CFTR-Intron10-6615 | - | CAAAGUGCCACUAGUGAUGC | 20 | 25495 |
| CFTR-Intron10-6616 | - | ACAAAGUGCCACUAGUGAUGC | 21 | 25496 |
| CFTR-Intron10-6617 | - | UACAAAGUGCCACUAGUGAUGC | 22 | 25497 |
| CFTR-Intron10-6618 | - | AUACAAAGUGCCACUAGUGAUGC | 23 | 25498 |
| CFTR-Intron10-6619 | - | CAUACAAAGUGCCACUAGUGAUGC | 24 | 25499 |
| CFTR-Intron10-6620 | - | UCAAAUUAUUUCUACUGC | 18 | 25500 |
| CFTR-Intron10-6621 | - | UUCAAAUUAUUUCUACUGC | 19 | 25501 |
| CFTR-Intron10-6622 | - | GUUCAAAUUAUUUCUACUGC | 20 | 25502 |
| CFTR-Intron10-6623 | - | UGUUCAAAUUAUUUCUACUGC | 21 | 25503 |
| CFTR-Intron10-6624 | - | UUGUUCAAAUUAUUUCUACUGC | 22 | 25504 |
| CFTR-Intron10-6625 | - | GUUGUUCAAAUUAUUUCUACUGC | 23 | 25505 |
| CFTR-Intron10-6626 | - | UGUUGUUCAAAUUAUUUCUACUGC | 24 | 25506 |
| CFTR-Intron10-6627 | - | AUUUGAACAAAGACUUGC | 18 | 25507 |
| CFTR-Intron10-6628 | - | CAUUUGAACAAAGACUUGC | 19 | 25508 |
| CFTR-Intron10-1236 | - | ACAUUUGAACAAAGACUUGC | 20 | 20121 |
| CFTR-Intron10-6629 | - | AACAUUUGAACAAAGACUUGC | 21 | 25509 |
| CFTR-Intron10-6630 | - | UAACAUUUGAACAAAGACUUGC | 22 | 25510 |
| CFTR-Intron10-6631 | - | GUAACAUUUGAACAAAGACUUGC | 23 | 25511 |
| CFTR-Intron10-6632 | - | GGUAACAUUUGAACAAAGACUUGC | 24 | 25512 |

TABLE 41E-continued

| | | 5th Tier | | |
|---|---|---|---|---|
| gRNA Name | DNA Strand | Targeting Domain | Target Site Length | Seq ID |
| CFTR-Intron10-6633 | - | GAGUUUACUAACUCAAUC | 18 | 25513 |
| CFTR-Intron10-6634 | - | GGAGUUUACUAACUCAAUC | 19 | 25514 |
| CFTR-Intron10-6635 | - | CGGAGUUUACUAACUCAAUC | 20 | 25515 |
| CFTR-Intron10-6636 | - | ACGGAGUUUACUAACUCAAUC | 21 | 25516 |
| CFTR-Intron10-6637 | - | AACGGAGUUUACUAACUCAAUC | 22 | 25517 |
| CFTR-Intron10-6638 | - | AAACGGAGUUUACUAACUCAAUC | 23 | 25518 |
| CFTR-Intron10-6639 | - | GAAACGGAGUUUACUAACUCAAUC | 24 | 25519 |
| CFTR-Intron10-6640 | - | UCUGCUGGCACCUUGAUC | 18 | 25520 |
| CFTR-Intron10-6641 | - | AUCUGCUGGCACCUUGAUC | 19 | 25521 |
| CFTR-Intron10-6642 | - | AAUCUGCUGGCACCUUGAUC | 20 | 25522 |
| CFTR-Intron10-6643 | - | AAAUCUGCUGGCACCUUGAUC | 21 | 25523 |
| CFTR-Intron10-6644 | - | CAAAUCUGCUGGCACCUUGAUC | 22 | 25524 |
| CFTR-Intron10-6645 | - | CCAAAUCUGCUGGCACCUUGAUC | 23 | 25525 |
| CFTR-Intron10-6646 | - | CCCAAAUCUGCUGGCACCUUGAUC | 24 | 25526 |
| CFTR-Intron10-6647 | - | CUUGCUUUUCCCACUAUC | 18 | 25527 |
| CFTR-Intron10-6648 | - | UCUUGCUUUUCCCACUAUC | 19 | 25528 |
| CFTR-Intron10-6649 | - | UUCUUGCUUUUCCCACUAUC | 20 | 25529 |
| CFTR-Intron10-6650 | - | CUUCUUGCUUUUCCCACUAUC | 21 | 25530 |
| CFTR-Intron10-6651 | - | GCUUCUUGCUUUUCCCACUAUC | 22 | 25531 |
| CFTR-Intron10-6652 | - | UGCUUCUUGCUUUUCCCACUAUC | 23 | 25532 |
| CFTR-Intron10-6653 | - | UUGCUUCUUGCUUUUCCCACUAUC | 24 | 25533 |
| CFTR-Intron10-6654 | - | GUGAAUGAAUGUGGUAUC | 18 | 25534 |
| CFTR-Intron10-6655 | - | AGUGAAUGAAUGUGGUAUC | 19 | 25535 |
| CFTR-Intron10-6656 | - | UAGUGAAUGAAUGUGGUAUC | 20 | 25536 |
| CFTR-Intron10-6657 | - | CUAGUGAAUGAAUGUGGUAUC | 21 | 25537 |
| CFTR-Intron10-6658 | - | GCUAGUGAAUGAAUGUGGUAUC | 22 | 25538 |
| CFTR-Intron10-6659 | - | AGCUAGUGAAUGAAUGUGGUAUC | 23 | 25539 |
| CFTR-Intron10-6660 | - | AAGCUAGUGAAUGAAUGUGGUAUC | 24 | 25540 |
| CFTR-Intron10-6661 | - | CACUGUAACCUUGAACUC | 18 | 25541 |
| CFTR-Intron10-6662 | - | UCACUGUAACCUUGAACUC | 19 | 25542 |
| CFTR-Intron10-6663 | - | CUCACUGUAACCUUGAACUC | 20 | 25543 |
| CFTR-Intron10-6664 | - | GCUCACUGUAACCUUGAACUC | 21 | 25544 |
| CFTR-Intron10-6665 | - | AGCUCACUGUAACCUUGAACUC | 22 | 25545 |
| CFTR-Intron10-6666 | - | UAGCUCACUGUAACCUUGAACUC | 23 | 25546 |
| CFTR-Intron10-6667 | - | AUAGCUCACUGUAACCUUGAACUC | 24 | 25547 |
| CFTR-Intron10-6668 | - | AGAAAUUAAGAAAGACUC | 18 | 25548 |
| CFTR-Intron10-6669 | - | UAGAAAUUAAGAAAGACUC | 19 | 25549 |

TABLE 41E-continued

5th Tier

| gRNA Name | DNA Strand | Targeting Domain | Target Site Length | Seq ID |
|---|---|---|---|---|
| CFTR-Intron10-6670 | - | AUAGAAAUUAAGAAAGACUC | 20 | 25550 |
| CFTR-Intron10-6671 | - | AAUAGAAAUUAAGAAAGACUC | 21 | 25551 |
| CFTR-Intron10-6672 | - | AAAUAGAAAUUAAGAAAGACUC | 22 | 25552 |
| CFTR-Intron10-6673 | - | AAAAUAGAAAUUAAGAAAGACUC | 23 | 25553 |
| CFTR-Intron10-6674 | - | GAAAAUAGAAAUUAAGAAAGACUC | 24 | 25554 |
| CFTR-Intron10-6675 | - | AUUAGGGAAUGCAGACUC | 18 | 25555 |
| CFTR-Intron10-6676 | - | GAUUAGGGAAUGCAGACUC | 19 | 25556 |
| CFTR-Intron10-92 | - | GGAUUAGGGAAUGCAGACUC | 20 | 18978 |
| CFTR-Intron10-6677 | - | GGGAUUAGGGAAUGCAGACUC | 21 | 25557 |
| CFTR-Intron10-6678 | - | AGGGAUUAGGGAAUGCAGACUC | 22 | 25558 |
| CFTR-Intron10-6679 | - | GAGGGAUUAGGGAAUGCAGACUC | 23 | 25559 |
| CFTR-Intron10-6680 | - | UGAGGGAUUAGGGAAUGCAGACUC | 24 | 25560 |
| CFTR-Intron10-6681 | - | UAUUCUUUUGAUAUACUC | 18 | 25561 |
| CFTR-Intron10-6682 | - | UUAUUCUUUUGAUAUACUC | 19 | 25562 |
| CFTR-Intron10-6683 | - | CUUAUUCUUUUGAUAUACUC | 20 | 25563 |
| CFTR-Intron10-6684 | - | CCUUAUUCUUUUGAUAUACUC | 21 | 25564 |
| CFTR-Intron10-6685 | - | GCCUUAUUCUUUUGAUAUACUC | 22 | 25565 |
| CFTR-Intron10-6686 | - | UGCCUUAUUCUUUUGAUAUACUC | 23 | 25566 |
| CFTR-Intron10-6687 | - | AUGCCUUAUUCUUUUGAUAUACUC | 24 | 25567 |
| CFTR-Intron10-6688 | - | CCGUAGUCCCAGCUACUC | 18 | 25568 |
| CFTR-Intron10-6689 | - | CCCGUAGUCCCAGCUACUC | 19 | 25569 |
| CFTR-Intron10-687 | - | GCCCGUAGUCCCAGCUACUC | 20 | 19573 |
| CFTR-Intron10-6690 | - | UGCCCGUAGUCCCAGCUACUC | 21 | 25570 |
| CFTR-Intron10-6691 | - | GUGCCCGUAGUCCCAGCUACUC | 22 | 25571 |
| CFTR-Intron10-6692 | - | GGUGCCCGUAGUCCCAGCUACUC | 23 | 25572 |
| CFTR-Intron10-6693 | - | GGGUGCCCGUAGUCCCAGCUACUC | 24 | 25573 |
| CFTR-Intron10-6694 | - | CUUGGACUUCCCAGCCUC | 18 | 25574 |
| CFTR-Intron10-6695 | - | UCUUGGACUUCCCAGCCUC | 19 | 25575 |
| CFTR-Intron10-6696 | - | AUCUUGGACUUCCCAGCCUC | 20 | 25576 |
| CFTR-Intron10-6697 | - | GAUCUUGGACUUCCCAGCCUC | 21 | 25577 |
| CFTR-Intron10-6698 | - | UGAUCUUGGACUUCCCAGCCUC | 22 | 25578 |
| CFTR-Intron10-6699 | - | UUGAUCUUGGACUUCCCAGCCUC | 23 | 25579 |
| CFTR-Intron10-6700 | - | CUUGAUCUUGGACUUCCCAGCCUC | 24 | 25580 |
| CFTR-Intron10-6701 | - | CACUGCAACCUCUGCCUC | 18 | 25581 |
| CFTR-Intron10-6702 | - | UCACUGCAACCUCUGCCUC | 19 | 25582 |
| CFTR-Intron10-6703 | - | CUCACUGCAACCUCUGCCUC | 20 | 25583 |
| CFTR-Intron10-6704 | - | GCUCACUGCAACCUCUGCCUC | 21 | 25584 |

TABLE 41E-continued

5th Tier

| gRNA Name | DNA Strand | Targeting Domain | Target Site Length | Seq ID |
|---|---|---|---|---|
| CFTR-Intron10-6705 | - | GGCUCACUGCAACCUCUGCCUC | 22 | 25585 |
| CFTR-Intron10-6706 | - | CGGCUCACUGCAACCUCUGCCUC | 23 | 25586 |
| CFTR-Intron10-6707 | - | UCGGCUCACUGCAACCUCUGCCUC | 24 | 25587 |
| CFTR-Intron10-6708 | - | AAAAAGUUUAGUGGUCUC | 18 | 25588 |
| CFTR-Intron10-6709 | - | GAAAAAGUUUAGUGGUCUC | 19 | 25589 |
| CFTR-Intron10-6710 | - | AGAAAAAGUUUAGUGGUCUC | 20 | 25590 |
| CFTR-Intron10-6711 | - | GAGAAAAAGUUUAGUGGUCUC | 21 | 25591 |
| CFTR-Intron10-6712 | - | UGAGAAAAAGUUUAGUGGUCUC | 22 | 25592 |
| CFTR-Intron10-6713 | - | GUGAGAAAAAGUUUAGUGGUCUC | 23 | 25593 |
| CFTR-Intron10-6714 | - | UGUGAGAAAAAGUUUAGUGGUCUC | 24 | 25594 |
| CFTR-Intron10-6715 | - | AGGUGAAUUGCUUGAGUC | 18 | 25595 |
| CFTR-Intron10-6716 | - | CAGGUGAAUUGCUUGAGUC | 19 | 25596 |
| CFTR-Intron10-6717 | - | GCAGGUGAAUUGCUUGAGUC | 20 | 25597 |
| CFTR-Intron10-6718 | - | GGCAGGUGAAUUGCUUGAGUC | 21 | 25598 |
| CFTR-Intron10-6719 | - | AGGCAGGUGAAUUGCUUGAGUC | 22 | 25599 |
| CFTR-Intron10-6720 | - | GAGGCAGGUGAAUUGCUUGAGUC | 23 | 25600 |
| CFTR-Intron10-6721 | - | AGAGGCAGGUGAAUUGCUUGAGUC | 24 | 25601 |
| CFTR-Intron10-6722 | - | UAUGUAUAUAUGUGUGUC | 18 | 25602 |
| CFTR-Intron10-6723 | - | GUAUGUAUAUAUGUGUGUC | 19 | 25603 |
| CFTR-Intron10-1242 | - | UGUAUGUAUAUAUGUGUGUC | 20 | 20127 |
| CFTR-Intron10-6724 | - | AUGUAUGUAUAUAUGUGUGUC | 21 | 25604 |
| CFTR-Intron10-6725 | - | UAUGUAUGUAUAUAUGUGUGUC | 22 | 25605 |
| CFTR-Intron10-6726 | - | AUAUGUAUGUAUAUAUGUGUGUC | 23 | 25606 |
| CFTR-Intron10-6727 | - | CAUAUGUAUGUAUAUAUGUGUGUC | 24 | 25607 |
| CFTR-Intron10-6728 | - | GACCAAAACUUUAUUGUC | 18 | 25608 |
| CFTR-Intron10-6729 | - | GGACCAAAACUUUAUUGUC | 19 | 25609 |
| CFTR-Intron10-440 | - | AGGACCAAAACUUUAUUGUC | 20 | 19326 |
| CFTR-Intron10-6730 | - | AAGGACCAAAACUUUAUUGUC | 21 | 25610 |
| CFTR-Intron10-6731 | - | AAAGGACCAAAACUUUAUUGUC | 22 | 25611 |
| CFTR-Intron10-6732 | - | AAAAGGACCAAAACUUUAUUGUC | 23 | 25612 |
| CFTR-Intron10-6733 | - | CAAAAGGACCAAAACUUUAUUGUC | 24 | 25613 |
| CFTR-Intron10-6734 | - | CAUUAUAACACUGCUUUC | 18 | 25614 |
| CFTR-Intron10-6735 | - | UCAUUAUAACACUGCUUUC | 19 | 25615 |
| CFTR-Intron10-1247 | - | UUCAUUAUAACACUGCUUUC | 20 | 20132 |
| CFTR-Intron10-6736 | - | CUUCAUUAUAACACUGCUUUC | 21 | 25616 |
| CFTR-Intron10-6737 | - | UCUUCAUUAUAACACUGCUUUC | 22 | 25617 |
| CFTR-Intron10-6738 | - | CUCUUCAUUAUAACACUGCUUUC | 23 | 25618 |

TABLE 41E-continued

5th Tier

| gRNA Name | DNA Strand | Targeting Domain | Target Site Length | Seq ID |
|---|---|---|---|---|
| CFTR-Intron10-6739 | – | GCUCUUCAUUAUAACACUGCUUUC | 24 | 25619 |
| CFTR-Intron10-6740 | – | AUGUACAAGUCUAGUUUC | 18 | 25620 |
| CFTR-Intron10-6741 | – | GAUGUACAAGUCUAGUUUC | 19 | 25621 |
| CFTR-Intron10-6742 | – | GGAUGUACAAGUCUAGUUUC | 20 | 25622 |
| CFTR-Intron10-6743 | – | UGGAUGUACAAGUCUAGUUUC | 21 | 25623 |
| CFTR-Intron10-6744 | – | UUGGAUGUACAAGUCUAGUUUC | 22 | 25624 |
| CFTR-Intron10-6745 | – | GUUGGAUGUACAAGUCUAGUUUC | 23 | 25625 |
| CFTR-Intron10-6746 | – | AGUUGGAUGUACAAGUCUAGUUUC | 24 | 25626 |
| CFTR-Intron10-6747 | – | GGAAAAUUUAACAUUUUC | 18 | 25627 |
| CFTR-Intron10-6748 | – | GGGAAAAUUUAACAUUUUC | 19 | 25628 |
| CFTR-Intron10-6749 | – | AGGGAAAAUUUAACAUUUUC | 20 | 25629 |
| CFTR-Intron10-6750 | – | AAGGGAAAAUUUAACAUUUUC | 21 | 25630 |
| CFTR-Intron10-6751 | – | UAAGGGAAAAUUUAACAUUUUC | 22 | 25631 |
| CFTR-Intron10-6752 | – | CUAAGGGAAAAUUUAACAUUUUC | 23 | 25632 |
| CFTR-Intron10-6753 | – | CCUAAGGGAAAAUUUAACAUUUUC | 24 | 25633 |
| CFTR-Intron10-6754 | – | UUCCAUUACAUUGUUUUC | 18 | 25634 |
| CFTR-Intron10-6755 | – | UUUCCAUUACAUUGUUUUC | 19 | 25635 |
| CFTR-Intron10-6756 | – | GUUUCCAUUACAUUGUUUUC | 20 | 25636 |
| CFTR-Intron10-6757 | – | UGUUUCCAUUACAUUGUUUUC | 21 | 25637 |
| CFTR-Intron10-6758 | – | GUGUUUCCAUUACAUUGUUUUC | 22 | 25638 |
| CFTR-Intron10-6759 | – | AGUGUUUCCAUUACAUUGUUUUC | 23 | 25639 |
| CFTR-Intron10-6760 | – | UAGUGUUUCCAUUACAUUGUUUUC | 24 | 25640 |
| CFTR-Intron10-6761 | – | AUUAAAAUAUAUAAAAG | 18 | 25641 |
| CFTR-Intron10-6762 | – | AAUUAAAAUAUAUAAAAG | 19 | 25642 |
| CFTR-Intron10-6763 | – | AAAUUAAAAUAUAUAAAAG | 20 | 25643 |
| CFTR-Intron10-6764 | – | AAAAUUAAAAUAUAUAAAAG | 21 | 25644 |
| CFTR-Intron10-6765 | – | GAAAAUUAAAAUAUAUAAAAG | 22 | 25645 |
| CFTR-Intron10-6766 | – | UGAAAAUUAAAAUAUAUAAAAG | 23 | 25646 |
| CFTR-Intron10-6767 | – | AUGAAAAUUAAAAUAUAUAAAAG | 24 | 25647 |
| CFTR-Intron10-6768 | – | AGAGAGGAAGGAAGAAAG | 18 | 25648 |
| CFTR-Intron10-6769 | – | AAGAGAGGAAGGAAGAAAG | 19 | 25649 |
| CFTR-Intron10-6770 | – | AAAGAGAGGAAGGAAGAAAG | 20 | 25650 |
| CFTR-Intron10-6771 | – | GAAAGAGAGGAAGGAAGAAAG | 21 | 25651 |
| CFTR-Intron10-6772 | – | AGAAAGAGAGGAAGGAAGAAAG | 22 | 25652 |
| CFTR-Intron10-6773 | – | AAGAAAGAGAGGAAGGAAGAAAG | 23 | 25653 |
| CFTR-Intron10-6774 | – | AAAGAAAGAGAGGAAGGAAGAAAG | 24 | 25654 |
| CFTR-Intron10-6775 | – | GGAAGGAAGGAAGGAAAG | 18 | 25655 |

TABLE 41E-continued

5th Tier

| gRNA Name | DNA Strand | Targeting Domain | Target Site Length | Seq ID |
|---|---|---|---|---|
| CFTR-Intron10-6776 | - | AGGAAGGAAGGAAGGAAAG | 19 | 25656 |
| CFTR-Intron10-6777 | - | GAGGAAGGAAGGAAGGAAAG | 20 | 25657 |
| CFTR-Intron10-6778 | - | GGAGGAAGGAAGGAAGGAAAG | 21 | 25658 |
| CFTR-Intron10-6779 | - | AGGAGGAAGGAAGGAAGGAAAG | 22 | 25659 |
| CFTR-Intron10-6780 | - | UAGGAGGAAGGAAGGAAGGAAAG | 23 | 25660 |
| CFTR-Intron10-6781 | - | GUAGGAGGAAGGAAGGAAGGAAAG | 24 | 25661 |
| CFTR-Intron10-6782 | - | AACCCAACUGAUGUCAAG | 18 | 25662 |
| CFTR-Intron10-6783 | - | GAACCCAACUGAUGUCAAG | 19 | 25663 |
| CFTR-Intron10-6784 | - | GGAACCCAACUGAUGUCAAG | 20 | 25664 |
| CFTR-Intron10-6785 | - | CGGAACCCAACUGAUGUCAAG | 21 | 25665 |
| CFTR-Intron10-6786 | - | CCGGAACCCAACUGAUGUCAAG | 22 | 25666 |
| CFTR-Intron10-6787 | - | CCCGGAACCCAACUGAUGUCAAG | 23 | 25667 |
| CFTR-Intron10-6788 | - | UCCCGGAACCCAACUGAUGUCAAG | 24 | 25668 |
| CFTR-Intron10-6789 | - | UCACCUGAGCCUGAGAAG | 18 | 25669 |
| CFTR-Intron10-6790 | - | AUCACCUGAGCCUGAGAAG | 19 | 25670 |
| CFTR-Intron10-692 | - | GAUCACCUGAGCCUGAGAAG | 20 | 19578 |
| CFTR-Intron10-6791 | - | GGAUCACCUGAGCCUGAGAAG | 21 | 25671 |
| CFTR-Intron10-6792 | - | AGGAUCACCUGAGCCUGAGAAG | 22 | 25672 |
| CFTR-Intron10-6793 | - | GAGGAUCACCUGAGCCUGAGAAG | 23 | 25673 |
| CFTR-Intron10-6794 | - | GGAGGAUCACCUGAGCCUGAGAAG | 24 | 25674 |
| CFTR-Intron10-6795 | - | AAUGAGGAAGAAAGGAAG | 18 | 25675 |
| CFTR-Intron10-6796 | - | AAAUGAGGAAGAAAGGAAG | 19 | 25676 |
| CFTR-Intron10-6797 | - | GAAAUGAGGAAGAAAGGAAG | 20 | 25677 |
| CFTR-Intron10-6798 | - | GGAAAUGAGGAAGAAAGGAAG | 21 | 25678 |
| CFTR-Intron10-6799 | - | AGGAAAUGAGGAAGAAAGGAAG | 22 | 25679 |
| CFTR-Intron10-6800 | - | AAGGAAAUGAGGAAGAAAGGAAG | 23 | 25680 |
| CFTR-Intron10-6801 | - | GAAGGAAAUGAGGAAGAAAGGAAG | 24 | 25681 |
| CFTR-Intron10-6802 | - | AGUCUAGUUUCAAGGAAG | 18 | 25682 |
| CFTR-Intron10-6803 | - | AAGUCUAGUUUCAAGGAAG | 19 | 25683 |
| CFTR-Intron10-449 | - | CAAGUCUAGUUUCAAGGAAG | 20 | 19335 |
| CFTR-Intron10-6804 | - | ACAAGUCUAGUUUCAAGGAAG | 21 | 25684 |
| CFTR-Intron10-6805 | - | UACAAGUCUAGUUUCAAGGAAG | 22 | 25685 |
| CFTR-Intron10-6806 | - | GUACAAGUCUAGUUUCAAGGAAG | 23 | 25686 |
| CFTR-Intron10-6807 | - | UGUACAAGUCUAGUUUCAAGGAAG | 24 | 25687 |
| CFTR-Intron10-6808 | - | GGGGCUGGUAGUGUGAAG | 18 | 25688 |
| CFTR-Intron10-6809 | - | GGGGGCUGGUAGUGUGAAG | 19 | 25689 |
| CFTR-Intron10-6810 | - | AGGGGGCUGGUAGUGUGAAG | 20 | 25690 |

TABLE 41E-continued

| | | | Target | |
| gRNA Name | DNA Strand | Targeting Domain | Site Length | Seq ID |
|---|---|---|---|---|
| | | 5th Tier | | |
| CFTR-Intron10-6811 | − | GAGGGGGCUGGUAGUGUGAAG | 21 | 25691 |
| CFTR-Intron10-6812 | − | AGAGGGGGCUGGUAGUGUGAAG | 22 | 25692 |
| CFTR-Intron10-6813 | − | AAGAGGGGGCUGGUAGUGUGAAG | 23 | 25693 |
| CFTR-Intron10-6814 | − | GAAGAGGGGGCUGGUAGUGUGAAG | 24 | 25694 |
| CFTR-Intron10-6815 | − | GAAAUUAGAAAGAAUAAG | 18 | 25695 |
| CFTR-Intron10-6816 | − | UGAAAUUAGAAAGAAUAAG | 19 | 25696 |
| CFTR-Intron10-1254 | − | AUGAAAUUAGAAAGAAUAAG | 20 | 20139 |
| CFTR-Intron10-6817 | − | AAUGAAAUUAGAAAGAAUAAG | 21 | 25697 |
| CFTR-Intron10-6818 | − | GAAUGAAAUUAGAAAGAAUAAG | 22 | 25698 |
| CFTR-Intron10-6819 | − | AGAAUGAAAUUAGAAAGAAUAAG | 23 | 25699 |
| CFTR-Intron10-6820 | − | CAGAAUGAAAUUAGAAAGAAUAAG | 24 | 25700 |
| CFTR-Intron10-6821 | − | AUAGGAUUAAUGGAUAAG | 18 | 25701 |
| CFTR-Intron10-6822 | − | AAUAGGAUUAAUGGAUAAG | 19 | 25702 |
| CFTR-Intron10-6823 | − | CAAUAGGAUUAAUGGAUAAG | 20 | 25703 |
| CFTR-Intron10-6824 | − | CCAAUAGGAUUAAUGGAUAAG | 21 | 25704 |
| CFTR-Intron10-6825 | − | UCCAAUAGGAUUAAUGGAUAAG | 22 | 25705 |
| CFTR-Intron10-6826 | − | AUCCAAUAGGAUUAAUGGAUAAG | 23 | 25706 |
| CFTR-Intron10-6827 | − | GAUCCAAUAGGAUUAAUGGAUAAG | 24 | 25707 |
| CFTR-Intron10-6828 | − | GGAAAGAGGGUUGAUAAG | 18 | 25708 |
| CFTR-Intron10-6829 | − | AGGAAAGAGGGUUGAUAAG | 19 | 25709 |
| CFTR-Intron10-6830 | − | AAGGAAAGAGGGUUGAUAAG | 20 | 25710 |
| CFTR-Intron10-6831 | − | AAAGGAAAGAGGGUUGAUAAG | 21 | 25711 |
| CFTR-Intron10-6832 | − | UAAAGGAAAGAGGGUUGAUAAG | 22 | 25712 |
| CFTR-Intron10-6833 | − | CUAAAGGAAAGAGGGUUGAUAAG | 23 | 25713 |
| CFTR-Intron10-6834 | − | UCUAAAGGAAAGAGGGUUGAUAAG | 24 | 25714 |
| CFTR-Intron10-6835 | − | UAUUUAUCAAUAUCUAAG | 18 | 25715 |
| CFTR-Intron10-6836 | − | UUAUUUAUCAAUAUCUAAG | 19 | 25716 |
| CFTR-Intron10-6837 | − | AUUAUUUAUCAAUAUCUAAG | 20 | 25717 |
| CFTR-Intron10-6838 | − | AAUUAUUUAUCAAUAUCUAAG | 21 | 25718 |
| CFTR-Intron10-6839 | − | CAAUUAUUUAUCAAUAUCUAAG | 22 | 25719 |
| CFTR-Intron10-6840 | − | GCAAUUAUUUAUCAAUAUCUAAG | 23 | 25720 |
| CFTR-Intron10-6841 | − | GGCAAUUAUUUAUCAAUAUCUAAG | 24 | 25721 |
| CFTR-Intron10-6842 | − | GCUCAUUCAUCAAGUAAG | 18 | 25722 |
| CFTR-Intron10-6843 | − | UGCUCAUUCAUCAAGUAAG | 19 | 25723 |
| CFTR-Intron10-6844 | − | AUGCUCAUUCAUCAAGUAAG | 20 | 25724 |
| CFTR-Intron10-6845 | − | AAUGCUCAUUCAUCAAGUAAG | 21 | 25725 |
| CFTR-Intron10-6846 | − | AAAUGCUCAUUCAUCAAGUAAG | 22 | 25726 |

TABLE 41E-continued

5th Tier

| gRNA Name | DNA Strand | Targeting Domain | Target Site Length | Seq ID |
|---|---|---|---|---|
| CFTR-Intron10-6847 | - | CAAAUGCUCAUUCAUCAAGUAAG | 23 | 25727 |
| CFTR-Intron10-6848 | - | UCAAAUGCUCAUUCAUCAAGUAAG | 24 | 25728 |
| CFTR-Intron10-6849 | - | AAGAAGGAAGGAAGUAAG | 18 | 25729 |
| CFTR-Intron10-6850 | - | AAAGAAGGAAGGAAGUAAG | 19 | 25730 |
| CFTR-Intron10-693 | - | GAAAGAAGGAAGGAAGUAAG | 20 | 19579 |
| CFTR-Intron10-6851 | - | GGAAAGAAGGAAGGAAGUAAG | 21 | 25731 |
| CFTR-Intron10-6852 | - | AGGAAAGAAGGAAGGAAGUAAG | 22 | 25732 |
| CFTR-Intron10-6853 | - | AAGGAAAGAAGGAAGGAAGUAAG | 23 | 25733 |
| CFTR-Intron10-6854 | - | GAAGGAAAGAAGGAAGGAAGUAAG | 24 | 25734 |
| CFTR-Intron10-6855 | - | UGCCAUGUGAGAACACAG | 18 | 25735 |
| CFTR-Intron10-6856 | - | CUGCCAUGUGAGAACACAG | 19 | 25736 |
| CFTR-Intron10-6857 | - | UCUGCCAUGUGAGAACACAG | 20 | 25737 |
| CFTR-Intron10-6858 | - | UUCUGCCAUGUGAGAACACAG | 21 | 25738 |
| CFTR-Intron10-6859 | - | UUUCUGCCAUGUGAGAACACAG | 22 | 25739 |
| CFTR-Intron10-6860 | - | CUUUCUGCCAUGUGAGAACACAG | 23 | 25740 |
| CFTR-Intron10-6861 | - | CCUUUCUGCCAUGUGAGAACACAG | 24 | 25741 |
| CFTR-Intron10-6862 | - | AUUUCAACUUAUACACAG | 18 | 25742 |
| CFTR-Intron10-6863 | - | CAUUUCAACUUAUACACAG | 19 | 25743 |
| CFTR-Intron10-6864 | - | UCAUUUCAACUUAUACACAG | 20 | 25744 |
| CFTR-Intron10-6865 | - | AUCAUUUCAACUUAUACACAG | 21 | 25745 |
| CFTR-Intron10-6866 | - | UAUCAUUUCAACUUAUACACAG | 22 | 25746 |
| CFTR-Intron10-6867 | - | AUAUCAUUUCAACUUAUACACAG | 23 | 25747 |
| CFTR-Intron10-6868 | - | AAUAUCAUUUCAACUUAUACACAG | 24 | 25748 |
| CFTR-Intron10-6869 | - | CUGUUGUCUGCAUCACAG | 18 | 25749 |
| CFTR-Intron10-6870 | - | UCUGUUGUCUGCAUCACAG | 19 | 25750 |
| CFTR-Intron10-6871 | - | UUCUGUUGUCUGCAUCACAG | 20 | 25751 |
| CFTR-Intron10-6872 | - | CUUCUGUUGUCUGCAUCACAG | 21 | 25752 |
| CFTR-Intron10-6873 | - | CCUUCUGUUGUCUGCAUCACAG | 22 | 25753 |
| CFTR-Intron10-6874 | - | UCCUUCUGUUGUCUGCAUCACAG | 23 | 25754 |
| CFTR-Intron10-6875 | - | GUCCUUCUGUUGUCUGCAUCACAG | 24 | 25755 |
| CFTR-Intron10-6876 | - | GAGUCUUCCAAGUAGCAG | 18 | 25756 |
| CFTR-Intron10-6877 | - | AGAGUCUUCCAAGUAGCAG | 19 | 25757 |
| CFTR-Intron10-6878 | - | AAGAGUCUUCCAAGUAGCAG | 20 | 25758 |
| CFTR-Intron10-6879 | - | GAAGAGUCUUCCAAGUAGCAG | 21 | 25759 |
| CFTR-Intron10-6880 | - | GGAAGAGUCUUCCAAGUAGCAG | 22 | 25760 |
| CFTR-Intron10-6881 | - | GGGAAGAGUCUUCCAAGUAGCAG | 23 | 25761 |
| CFTR-Intron10-6882 | - | UGGGAAGAGUCUUCCAAGUAGCAG | 24 | 25762 |

TABLE 41E-continued

5th Tier

| gRNA Name | DNA Strand | Targeting Domain | Target Site Length | Seq ID |
|---|---|---|---|---|
| CFTR-Intron10-6883 | - | CCAAAACUUUAUUGUCAG | 18 | 25763 |
| CFTR-Intron10-6884 | - | ACCAAAACUUUAUUGUCAG | 19 | 25764 |
| CFTR-Intron10-6885 | - | GACCAAAACUUUAUUGUCAG | 20 | 25765 |
| CFTR-Intron10-6886 | - | GGACCAAAACUUUAUUGUCAG | 21 | 25766 |
| CFTR-Intron10-6887 | - | AGGACCAAAACUUUAUUGUCAG | 22 | 25767 |
| CFTR-Intron10-6888 | - | AAGGACCAAAACUUUAUUGUCAG | 23 | 25768 |
| CFTR-Intron10-6889 | - | AAAGGACCAAAACUUUAUUGUCAG | 24 | 25769 |
| CFTR-Intron10-6890 | - | CAAGUGCAAAGCUUUCAG | 18 | 25770 |
| CFTR-Intron10-6891 | - | GCAAGUGCAAAGCUUUCAG | 19 | 25771 |
| CFTR-Intron10-6892 | - | AGCAAGUGCAAAGCUUUCAG | 20 | 25772 |
| CFTR-Intron10-6893 | - | AAGCAAGUGCAAAGCUUUCAG | 21 | 25773 |
| CFTR-Intron10-6894 | - | GAAGCAAGUGCAAAGCUUUCAG | 22 | 25774 |
| CFTR-Intron10-6895 | - | UGAAGCAAGUGCAAAGCUUUCAG | 23 | 25775 |
| CFTR-Intron10-6896 | - | GUGAAGCAAGUGCAAAGCUUUCAG | 24 | 25776 |
| CFTR-Intron10-6897 | - | AAACAGAAAAAGAAAGAG | 18 | 25777 |
| CFTR-Intron10-6898 | - | CAAACAGAAAAAGAAAGAG | 19 | 25778 |
| CFTR-Intron10-1269 | - | ACAAACAGAAAAAGAAAGAG | 20 | 20154 |
| CFTR-Intron10-6899 | - | GACAAACAGAAAAAGAAAGAG | 21 | 25779 |
| CFTR-Intron10-6900 | - | AGACAAACAGAAAAAGAAAGAG | 22 | 25780 |
| CFTR-Intron10-6901 | - | AAGACAAACAGAAAAAGAAAGAG | 23 | 25781 |
| CFTR-Intron10-6902 | - | UAAGACAAACAGAAAAAGAAAGAG | 24 | 25782 |
| CFTR-Intron10-6903 | - | AUUUUUGUAUUUUUAGUAGAG | 21 | 25783 |
| CFTR-Intron10-6904 | - | AAUUUUUGUAUUUUUAGUAGAG | 22 | 25784 |
| CFTR-Intron10-6905 | - | UAAUUUUUGUAUUUUUAGUAGAG | 23 | 25785 |
| CFTR-Intron10-6906 | - | CUAAUUUUUGUAUUUUUAGUAGAG | 24 | 25786 |
| CFTR-Intron10-6907 | - | GAAAGAAUCAAAUUAGAG | 18 | 25787 |
| CFTR-Intron10-6908 | - | UGAAAGAAUCAAAUUAGAG | 19 | 25788 |
| CFTR-Intron10-6909 | - | AUGAAAGAAUCAAAUUAGAG | 20 | 25789 |
| CFTR-Intron10-6910 | - | CAUGAAAGAAUCAAAUUAGAG | 21 | 25790 |
| CFTR-Intron10-6911 | - | ACAUGAAAGAAUCAAAUUAGAG | 22 | 25791 |
| CFTR-Intron10-6912 | - | GACAUGAAAGAAUCAAAUUAGAG | 23 | 25792 |
| CFTR-Intron10-6913 | - | AGACAUGAAAGAAUCAAAUUAGAG | 24 | 25793 |
| CFTR-Intron10-6914 | - | AACAAAGACUUGCAGGAG | 18 | 25794 |
| CFTR-Intron10-6915 | - | GAACAAAGACUUGCAGGAG | 19 | 25795 |
| CFTR-Intron10-6916 | - | UGAACAAAGACUUGCAGGAG | 20 | 25796 |
| CFTR-Intron10-6917 | - | UUGAACAAAGACUUGCAGGAG | 21 | 25797 |
| CFTR-Intron10-6918 | - | UUUGAACAAAGACUUGCAGGAG | 22 | 25798 |

TABLE 41E-continued

5th Tier

| gRNA Name | DNA Strand | Targeting Domain | Target Site Length | Seq ID |
|---|---|---|---|---|
| CFTR-Intron10-6919 | - | AUUUGAACAAAGACUUGCAGGAG | 23 | 25799 |
| CFTR-Intron10-6920 | - | CAUUUGAACAAAGACUUGCAGGAG | 24 | 25800 |
| CFTR-Intron10-6921 | - | AUCAAUAUCUAAGAUGAG | 18 | 25801 |
| CFTR-Intron10-6922 | - | UAUCAAUAUCUAAGAUGAG | 19 | 25802 |
| CFTR-Intron10-6923 | - | UUAUCAAUAUCUAAGAUGAG | 20 | 25803 |
| CFTR-Intron10-6924 | - | UUUAUCAAUAUCUAAGAUGAG | 21 | 25804 |
| CFTR-Intron10-6925 | - | AUUUAUCAAUAUCUAAGAUGAG | 22 | 25805 |
| CFTR-Intron10-6926 | - | UAUUUAUCAAUAUCUAAGAUGAG | 23 | 25806 |
| CFTR-Intron10-6927 | - | UUAUUUAUCAAUAUCUAAGAUGAG | 24 | 25807 |
| CFTR-Intron10-6928 | - | GCUACUUGGGAGGCUGAG | 18 | 25808 |
| CFTR-Intron10-6929 | - | AGCUACUUGGGAGGCUGAG | 19 | 25809 |
| CFTR-Intron10-6930 | - | CAGCUACUUGGGAGGCUGAG | 20 | 25810 |
| CFTR-Intron10-6931 | - | CCAGCUACUUGGGAGGCUGAG | 21 | 25811 |
| CFTR-Intron10-6932 | - | CCCAGCUACUUGGGAGGCUGAG | 22 | 25812 |
| CFTR-Intron10-6933 | - | UCCCAGCUACUUGGGAGGCUGAG | 23 | 25813 |
| CFTR-Intron10-6934 | - | GUCCCAGCUACUUGGGAGGCUGAG | 24 | 25814 |
| CFTR-Intron10-6935 | - | GGCAGAACUUGCAGUGAG | 18 | 25815 |
| CFTR-Intron10-6936 | - | AGGCAGAACUUGCAGUGAG | 19 | 25816 |
| CFTR-Intron10-6937 | - | GAGGCAGAACUUGCAGUGAG | 20 | 25817 |
| CFTR-Intron10-6938 | - | GGAGGCAGAACUUGCAGUGAG | 21 | 25818 |
| CFTR-Intron10-6939 | - | AGGAGGCAGAACUUGCAGUGAG | 22 | 25819 |
| CFTR-Intron10-6940 | - | CAGGAGGCAGAACUUGCAGUGAG | 23 | 25820 |
| CFTR-Intron10-6941 | - | CCAGGAGGCAGAACUUGCAGUGAG | 24 | 25821 |
| CFTR-Intron10-6942 | - | UUUUUUUUUUUUUUGAG | 18 | 25822 |
| CFTR-Intron10-6943 | - | UUUUUUUUUUUUUUUGAG | 19 | 25823 |
| CFTR-Intron10-6944 | - | UUUUUUUUUUUUUUUUGAG | 20 | 25824 |
| CFTR-Intron10-6945 | - | UUUUUUUUUUUUUUUUUGAG | 21 | 25825 |
| CFTR-Intron10-6946 | - | UUUUUUUUUUUUUUUUUUGAG | 22 | 25826 |
| CFTR-Intron10-6947 | - | UUUUUUUUUUUUUUUUUUUGAG | 23 | 25827 |
| CFTR-Intron10-6948 | - | UUUUUUUUUUUUUUUUUUUUGAG | 24 | 25828 |
| CFTR-Intron10-6949 | - | GCUUUUAAAACAAAAUAG | 18 | 25829 |
| CFTR-Intron10-6950 | - | AGCUUUUAAAACAAAAUAG | 19 | 25830 |
| CFTR-Intron10-6951 | - | CAGCUUUUAAAACAAAAUAG | 20 | 25831 |
| CFTR-Intron10-6952 | - | ACAGCUUUUAAAACAAAAUAG | 21 | 25832 |
| CFTR-Intron10-6953 | - | AACAGCUUUUAAAACAAAAUAG | 22 | 25833 |
| CFTR-Intron10-6954 | - | AAACAGCUUUUAAAACAAAAUAG | 23 | 25834 |
| CFTR-Intron10-6955 | - | GAAACAGCUUUUAAAACAAAAUAG | 24 | 25835 |

TABLE 41E-continued

5th Tier

| gRNA Name | DNA Strand | Targeting Domain | Target Site Length | Seq ID |
|---|---|---|---|---|
| CFTR-Intron10-6956 | - | ACUUAAUGAAAGCAAUAG | 18 | 25836 |
| CFTR-Intron10-6957 | - | GACUUAAUGAAAGCAAUAG | 19 | 25837 |
| CFTR-Intron10-6958 | - | UGACUUAAUGAAAGCAAUAG | 20 | 25838 |
| CFTR-Intron10-6959 | - | GUGACUUAAUGAAAGCAAUAG | 21 | 25839 |
| CFTR-Intron10-6960 | - | CGUGACUUAAUGAAAGCAAUAG | 22 | 25840 |
| CFTR-Intron10-6961 | - | UCGUGACUUAAUGAAAGCAAUAG | 23 | 25841 |
| CFTR-Intron10-6962 | - | CUCGUGACUUAAUGAAAGCAAUAG | 24 | 25842 |
| CFTR-Intron10-6963 | - | UAAAAAAUUAUACUAUAG | 18 | 25843 |
| CFTR-Intron10-6964 | - | UUAAAAAAUUAUACUAUAG | 19 | 25844 |
| CFTR-Intron10-6965 | - | AUUAAAAAAUUAUACUAUAG | 20 | 25845 |
| CFTR-Intron10-6966 | - | UAUUAAAAAAUUAUACUAUAG | 21 | 25846 |
| CFTR-Intron10-6967 | - | CUAUUAAAAAAUUAUACUAUAG | 22 | 25847 |
| CFTR-Intron10-6968 | - | ACUAUUAAAAAAUUAUACUAUAG | 23 | 25848 |
| CFTR-Intron10-6969 | - | CACUAUUAAAAAAUUAUACUAUAG | 24 | 25849 |
| CFTR-Intron10-6970 | - | GUAGUGGAAGUAGUAUAG | 18 | 25850 |
| CFTR-Intron10-6971 | - | AGUAGUGGAAGUAGUAUAG | 19 | 25851 |
| CFTR-Intron10-6972 | - | UAGUAGUGGAAGUAGUAUAG | 20 | 25852 |
| CFTR-Intron10-6973 | - | GUAGUAGUGGAAGUAGUAUAG | 21 | 25853 |
| CFTR-Intron10-6974 | - | GGUAGUAGUGGAAGUAGUAUAG | 22 | 25854 |
| CFTR-Intron10-6975 | - | AGGUAGUAGUGGAAGUAGUAUAG | 23 | 25855 |
| CFTR-Intron10-6976 | - | CAGGUAGUAGUGGAAGUAGUAUAG | 24 | 25856 |
| CFTR-Intron10-6977 | - | CCUCACCCUCCCAAGUAG | 18 | 25857 |
| CFTR-Intron10-6978 | - | GCCUCACCCUCCCAAGUAG | 19 | 25858 |
| CFTR-Intron10-6979 | - | UGCCUCACCCUCCCAAGUAG | 20 | 25859 |
| CFTR-Intron10-6980 | - | CUGCCUCACCCUCCCAAGUAG | 21 | 25860 |
| CFTR-Intron10-6981 | - | CCUGCCUCACCCUCCCAAGUAG | 22 | 25861 |
| CFTR-Intron10-6982 | - | UCCUGCCUCACCCUCCCAAGUAG | 23 | 25862 |
| CFTR-Intron10-6983 | - | CUCCUGCCUCACCCUCCCAAGUAG | 24 | 25863 |
| CFTR-Intron10-6984 | - | GCCUCAGCCUCCCAAGUAG | 19 | 25864 |
| CFTR-Intron10-6985 | - | UGCCUCAGCCUCCCAAGUAG | 20 | 25865 |
| CFTR-Intron10-6986 | - | CUGCCUCAGCCUCCCAAGUAG | 21 | 25866 |
| CFTR-Intron10-6987 | - | CCUGCCUCAGCCUCCCAAGUAG | 22 | 25867 |
| CFTR-Intron10-6988 | - | UCCUGCCUCAGCCUCCCAAGUAG | 23 | 25868 |
| CFTR-Intron10-6989 | - | CUCCUGCCUCAGCCUCCCAAGUAG | 24 | 25869 |
| CFTR-Intron10-6990 | - | GAGGAAGAAAGGAAGUAG | 18 | 25870 |
| CFTR-Intron10-6991 | - | UGAGGAAGAAAGGAAGUAG | 19 | 25871 |
| CFTR-Intron10-6992 | - | AUGAGGAAGAAAGGAAGUAG | 20 | 25872 |

TABLE 41E-continued

5th Tier

| gRNA Name | DNA Strand | Targeting Domain | Target Site Length | Seq ID |
|---|---|---|---|---|
| CFTR-Intron10-6993 | - | AAUGAGGAAGAAAGGAAGUAG | 21 | 25873 |
| CFTR-Intron10-6994 | - | AAAUGAGGAAGAAAGGAAGUAG | 22 | 25874 |
| CFTR-Intron10-6995 | - | GAAAUGAGGAAGAAAGGAAGUAG | 23 | 25875 |
| CFTR-Intron10-6996 | - | GGAAAUGAGGAAGAAAGGAAGUAG | 24 | 25876 |
| CFTR-Intron10-6997 | - | GCUUGAUCCAGGUAGUAG | 18 | 25877 |
| CFTR-Intron10-6998 | - | GGCUUGAUCCAGGUAGUAG | 19 | 25878 |
| CFTR-Intron10-461 | - | UGGCUUGAUCCAGGUAGUAG | 20 | 19347 |
| CFTR-Intron10-6999 | - | GUGGCUUGAUCCAGGUAGUAG | 21 | 25879 |
| CFTR-Intron10-7000 | - | GGUGGCUUGAUCCAGGUAGUAG | 22 | 25880 |
| CFTR-Intron10-7001 | - | UGGUGGCUUGAUCCAGGUAGUAG | 23 | 25881 |
| CFTR-Intron10-7002 | - | AUGGUGGCUUGAUCCAGGUAGUAG | 24 | 25882 |
| CFTR-Intron10-7003 | - | CUAUGAAGGCAGAGUUAG | 18 | 25883 |
| CFTR-Intron10-7004 | - | GCUAUGAAGGCAGAGUUAG | 19 | 25884 |
| CFTR-Intron10-464 | - | AGCUAUGAAGGCAGAGUUAG | 20 | 19350 |
| CFTR-Intron10-7005 | - | CAGCUAUGAAGGCAGAGUUAG | 21 | 25885 |
| CFTR-Intron10-7006 | - | GCAGCUAUGAAGGCAGAGUUAG | 22 | 25886 |
| CFTR-Intron10-7007 | - | AGCAGCUAUGAAGGCAGAGUUAG | 23 | 25887 |
| CFTR-Intron10-7008 | - | AAGCAGCUAUGAAGGCAGAGUUAG | 24 | 25888 |
| CFTR-Intron10-7009 | - | GGGGUUUCACCGUUUUAG | 18 | 25889 |
| CFTR-Intron10-7010 | - | CGGGGUUUCACCGUUUUAG | 19 | 25890 |
| CFTR-Intron10-7011 | - | ACGGGGUUUCACCGUUUUAG | 20 | 25891 |
| CFTR-Intron10-7012 | - | GACGGGGUUUCACCGUUUUAG | 21 | 25892 |
| CFTR-Intron10-7013 | - | AGACGGGGUUUCACCGUUUUAG | 22 | 25893 |
| CFTR-Intron10-7014 | - | GAGACGGGGUUUCACCGUUUUAG | 23 | 25894 |
| CFTR-Intron10-7015 | - | AGAGACGGGGUUUCACCGUUUUAG | 24 | 25895 |
| CFTR-Intron10-7016 | - | UAAUUUUUGUAUUUUUAG | 18 | 25896 |
| CFTR-Intron10-7017 | - | CUAAUUUUUGUAUUUUUAG | 19 | 25897 |
| CFTR-Intron10-7018 | - | GCUAAUUUUUGUAUUUUUAG | 20 | 25898 |
| CFTR-Intron10-7019 | - | AGCUAAUUUUUGUAUUUUUAG | 21 | 25899 |
| CFTR-Intron10-7020 | - | CAGCUAAUUUUUGUAUUUUUAG | 22 | 25900 |
| CFTR-Intron10-7021 | - | UCAGCUAAUUUUUGUAUUUUUAG | 23 | 25901 |
| CFTR-Intron10-7022 | - | CUCAGCUAAUUUUUGUAUUUUUAG | 24 | 25902 |
| CFTR-Intron10-7023 | - | CGGCUAAUUUUUGUAUUUUUAG | 23 | 25903 |
| CFTR-Intron10-7024 | - | CCGGCUAAUUUUUGUAUUUUUAG | 24 | 25904 |
| CFTR-Intron10-7025 | - | UCAGAGAAGUAAUCGGCG | 18 | 25905 |
| CFTR-Intron10-7026 | - | GUCAGAGAAGUAAUCGGCG | 19 | 25906 |
| CFTR-Intron10-7027 | - | UGUCAGAGAAGUAAUCGGCG | 20 | 25907 |

TABLE 41E-continued

5th Tier

| gRNA Name | DNA Strand | Targeting Domain | Target Site Length | Seq ID |
|---|---|---|---|---|
| CFTR-Intron10-7028 | − | CUGUCAGAGAAGUAAUCGGCG | 21 | 25908 |
| CFTR-Intron10-7029 | − | ACUGUCAGAGAAGUAAUCGGCG | 22 | 25909 |
| CFTR-Intron10-7030 | − | UACUGUCAGAGAAGUAAUCGGCG | 23 | 25910 |
| CFTR-Intron10-7031 | − | AUACUGUCAGAGAAGUAAUCGGCG | 24 | 25911 |
| CFTR-Intron10-7032 | − | UUCUGUAGGGAGACAAGG | 18 | 25912 |
| CFTR-Intron10-7033 | − | AUUCUGUAGGGAGACAAGG | 19 | 25913 |
| CFTR-Intron10-7034 | − | UAUUCUGUAGGGAGACAAGG | 20 | 25914 |
| CFTR-Intron10-7035 | − | CUAUUCUGUAGGGAGACAAGG | 21 | 25915 |
| CFTR-Intron10-7036 | − | GCUAUUCUGUAGGGAGACAAGG | 22 | 25916 |
| CFTR-Intron10-7037 | − | GGCUAUUCUGUAGGGAGACAAGG | 23 | 25917 |
| CFTR-Intron10-7038 | − | AGGCUAUUCUGUAGGGAGACAAGG | 24 | 25918 |
| CFTR-Intron10-7039 | − | ACAAGUCUAGUUUCAAGG | 18 | 25919 |
| CFTR-Intron10-7040 | − | UACAAGUCUAGUUUCAAGG | 19 | 25920 |
| CFTR-Intron10-7041 | − | GUACAAGUCUAGUUUCAAGG | 20 | 25921 |
| CFTR-Intron10-7042 | − | UGUACAAGUCUAGUUUCAAGG | 21 | 25922 |
| CFTR-Intron10-7043 | − | AUGUACAAGUCUAGUUUCAAGG | 22 | 25923 |
| CFTR-Intron10-7044 | − | GAUGUACAAGUCUAGUUUCAAGG | 23 | 25924 |
| CFTR-Intron10-7045 | − | GGAUGUACAAGUCUAGUUUCAAGG | 24 | 25925 |
| CFTR-Intron10-7046 | − | GGAAGGAAGGAAAGAAGG | 18 | 25926 |
| CFTR-Intron10-7047 | − | AGGAAGGAAGGAAAGAAGG | 19 | 25927 |
| CFTR-Intron10-7048 | − | AAGGAAGGAAGGAAAGAAGG | 20 | 25928 |
| CFTR-Intron10-7049 | − | GAAGGAAGGAAGGAAAGAAGG | 21 | 25929 |
| CFTR-Intron10-7050 | − | GGAAGGAAGGAAGGAAAGAAGG | 22 | 25930 |
| CFTR-Intron10-7051 | − | AGGAAGGAAGGAAGGAAAGAAGG | 23 | 25931 |
| CFTR-Intron10-7052 | − | GAGGAAGGAAGGAAGGAAAGAAGG | 24 | 25932 |
| CFTR-Intron10-7053 | − | AAGUAGGAGGAAGGAAGG | 18 | 25933 |
| CFTR-Intron10-7054 | − | GAAGUAGGAGGAAGGAAGG | 19 | 25934 |
| CFTR-Intron10-7055 | − | GGAAGUAGGAGGAAGGAAGG | 20 | 25935 |
| CFTR-Intron10-7056 | − | AGGAAGUAGGAGGAAGGAAGG | 21 | 25936 |
| CFTR-Intron10-7057 | − | AAGGAAGUAGGAGGAAGGAAGG | 22 | 25937 |
| CFTR-Intron10-7058 | − | AAAGGAAGUAGGAGGAAGGAAGG | 23 | 25938 |
| CFTR-Intron10-7059 | − | GAAAGGAAGUAGGAGGAAGGAAGG | 24 | 25939 |
| CFTR-Intron10-7060 | − | AAAAGAAAGAGAGGAAGG | 18 | 25940 |
| CFTR-Intron10-7061 | − | AAAAAGAAAGAGAGGAAGG | 19 | 25941 |
| CFTR-Intron10-7062 | − | GAAAAAGAAAGAGAGGAAGG | 20 | 25942 |
| CFTR-Intron10-7063 | − | AGAAAAAGAAAGAGAGGAAGG | 21 | 25943 |
| CFTR-Intron10-7064 | − | CAGAAAAAGAAAGAGAGGAAGG | 22 | 25944 |

TABLE 41E-continued

| | | 5th Tier | | |
|---|---|---|---|---|
| gRNA Name | DNA Strand | Targeting Domain | Target Site Length | Seq ID |
| CFTR-Intron10-7065 | - | ACAGAAAAAGAAAGAGAGGAAGG | 23 | 25945 |
| CFTR-Intron10-7066 | - | AACAGAAAAAGAAAGAGAGGAAGG | 24 | 25946 |
| CFTR-Intron10-7067 | - | AAGGAAGUAGGAGGAAGG | 18 | 25947 |
| CFTR-Intron10-7068 | - | AAAGGAAGUAGGAGGAAGG | 19 | 25948 |
| CFTR-Intron10-7069 | - | GAAAGGAAGUAGGAGGAAGG | 20 | 25949 |
| CFTR-Intron10-7070 | - | AGAAAGGAAGUAGGAGGAAGG | 21 | 25950 |
| CFTR-Intron10-7071 | - | AAGAAAGGAAGUAGGAGGAAGG | 22 | 25951 |
| CFTR-Intron10-7072 | - | GAAGAAAGGAAGUAGGAGGAAGG | 23 | 25952 |
| CFTR-Intron10-7073 | - | GGAAGAAAGGAAGUAGGAGGAAGG | 24 | 25953 |
| CFTR-Intron10-7074 | - | AGUCUUACUGUCACCAGG | 18 | 25954 |
| CFTR-Intron10-7075 | - | GAGUCUUACUGUCACCAGG | 19 | 25955 |
| CFTR-Intron10-7076 | - | AGAGUCUUACUGUCACCAGG | 20 | 25956 |
| CFTR-Intron10-7077 | - | CAGAGUCUUACUGUCACCAGG | 21 | 25957 |
| CFTR-Intron10-7078 | - | ACAGAGUCUUACUGUCACCAGG | 22 | 25958 |
| CFTR-Intron10-7079 | - | GACAGAGUCUUACUGUCACCAGG | 23 | 25959 |
| CFTR-Intron10-7080 | - | AGACAGAGUCUUACUGUCACCAGG | 24 | 25960 |
| CFTR-Intron10-7081 | - | CUUACUCUGUCACCCAGG | 18 | 25961 |
| CFTR-Intron10-7082 | - | UCUUACUCUGUCACCCAGG | 19 | 25962 |
| CFTR-Intron10-7083 | - | GUCUUACUCUGUCACCCAGG | 20 | 25963 |
| CFTR-Intron10-7084 | - | GGUCUUACUCUGUCACCCAGG | 21 | 25964 |
| CFTR-Intron10-7085 | - | AGGUCUUACUCUGUCACCCAGG | 22 | 25965 |
| CFTR-Intron10-7086 | - | UAGGUCUUACUCUGUCACCCAGG | 23 | 25966 |
| CFTR-Intron10-7087 | - | UUAGGUCUUACUCUGUCACCCAGG | 24 | 25967 |
| CFTR-Intron10-7088 | - | CUCGCUCUGUCGCCCAGG | 18 | 25968 |
| CFTR-Intron10-7089 | - | UCUCGCUCUGUCGCCCAGG | 19 | 25969 |
| CFTR-Intron10-7090 | - | GUCUCGCUCUGUCGCCCAGG | 20 | 25970 |
| CFTR-Intron10-7091 | - | AGUCUCGCUCUGUCGCCCAGG | 21 | 25971 |
| CFTR-Intron10-7092 | - | GAGUCUCGCUCUGUCGCCCAGG | 22 | 25972 |
| CFTR-Intron10-7093 | - | GGAGUCUCGCUCUGUCGCCCAGG | 23 | 25973 |
| CFTR-Intron10-7094 | - | CGGAGUCUCGCUCUGUCGCCCAGG | 24 | 25974 |
| CFTR-Intron10-7095 | - | AGGUGAUGGUAUUGCAGG | 18 | 25975 |
| CFTR-Intron10-7096 | - | AAGGUGAUGGUAUUGCAGG | 19 | 25976 |
| CFTR-Intron10-7097 | - | CAAGGUGAUGGUAUUGCAGG | 20 | 25977 |
| CFTR-Intron10-7098 | - | CCAAGGUGAUGGUAUUGCAGG | 21 | 25978 |
| CFTR-Intron10-7099 | - | CCCAAGGUGAUGGUAUUGCAGG | 22 | 25979 |
| CFTR-Intron10-7100 | - | UCCCAAGGUGAUGGUAUUGCAGG | 23 | 25980 |
| CFTR-Intron10-7101 | - | UUCCCAAGGUGAUGGUAUUGCAGG | 24 | 25981 |

TABLE 41E-continued

5th Tier

| gRNA Name | DNA Strand | Targeting Domain | Target Site Length | Seq ID |
|---|---|---|---|---|
| CFTR-Intron10-7102 | - | CAGAAAAAGAAAGAGAGG | 18 | 25982 |
| CFTR-Intron10-7103 | - | ACAGAAAAAGAAAGAGAGG | 19 | 25983 |
| CFTR-Intron10-7104 | - | AACAGAAAAAGAAAGAGAGG | 20 | 25984 |
| CFTR-Intron10-7105 | - | AAACAGAAAAAGAAAGAGAGG | 21 | 25985 |
| CFTR-Intron10-7106 | - | CAAACAGAAAAAGAAAGAGAGG | 22 | 25986 |
| CFTR-Intron10-7107 | - | ACAAACAGAAAAAGAAAGAGAGG | 23 | 25987 |
| CFTR-Intron10-7108 | - | GACAAACAGAAAAAGAAAGAGAGG | 24 | 25988 |
| CFTR-Intron10-7109 | - | UGGCGUGAACCCAGGAGG | 18 | 25989 |
| CFTR-Intron10-7110 | - | AUGGCGUGAACCCAGGAGG | 19 | 25990 |
| CFTR-Intron10-7111 | - | AAUGGCGUGAACCCAGGAGG | 20 | 25991 |
| CFTR-Intron10-7112 | - | GAAUGGCGUGAACCCAGGAGG | 21 | 25992 |
| CFTR-Intron10-7113 | - | AGAAUGGCGUGAACCCAGGAGG | 22 | 25993 |
| CFTR-Intron10-7114 | - | GAGAAUGGCGUGAACCCAGGAGG | 23 | 25994 |
| CFTR-Intron10-7115 | - | GGAGAAUGGCGUGAACCCAGGAGG | 24 | 25995 |
| CFTR-Intron10-7116 | - | AAGAAAGGAAGUAGGAGG | 18 | 25996 |
| CFTR-Intron10-7117 | - | GAAGAAAGGAAGUAGGAGG | 19 | 25997 |
| CFTR-Intron10-7118 | - | GGAAGAAAGGAAGUAGGAGG | 20 | 25998 |
| CFTR-Intron10-7119 | - | AGGAAGAAAGGAAGUAGGAGG | 21 | 25999 |
| CFTR-Intron10-7120 | - | GAGGAAGAAAGGAAGUAGGAGG | 22 | 26000 |
| CFTR-Intron10-7121 | - | UGAGGAAGAAAGGAAGUAGGAGG | 23 | 26001 |
| CFTR-Intron10-7122 | - | AUGAGGAAGAAAGGAAGUAGGAGG | 24 | 26002 |
| CFTR-Intron10-7123 | - | UCCCAGCUACUCGGGAGG | 18 | 26003 |
| CFTR-Intron10-7124 | - | GUCCCAGCUACUCGGGAGG | 19 | 26004 |
| CFTR-Intron10-7125 | - | AGUCCCAGCUACUCGGGAGG | 20 | 26005 |
| CFTR-Intron10-7126 | - | UAGUCCCAGCUACUCGGGAGG | 21 | 26006 |
| CFTR-Intron10-7127 | - | GUAGUCCCAGCUACUCGGGAGG | 22 | 26007 |
| CFTR-Intron10-7128 | - | CGUAGUCCCAGCUACUCGGGAGG | 23 | 26008 |
| CFTR-Intron10-7129 | - | CCGUAGUCCCAGCUACUCGGGAGG | 24 | 26009 |
| CFTR-Intron10-7130 | - | AGUAAUCGGCGGUGGAGG | 18 | 26010 |
| CFTR-Intron10-7131 | - | AAGUAAUCGGCGGUGGAGG | 19 | 26011 |
| CFTR-Intron10-7132 | - | GAAGUAAUCGGCGGUGGAGG | 20 | 26012 |
| CFTR-Intron10-7133 | - | AGAAGUAAUCGGCGGUGGAGG | 21 | 26013 |
| CFTR-Intron10-7134 | - | GAGAAGUAAUCGGCGGUGGAGG | 22 | 26014 |
| CFTR-Intron10-7135 | - | AGAGAAGUAAUCGGCGGUGGAGG | 23 | 26015 |
| CFTR-Intron10-7136 | - | CAGAGAAGUAAUCGGCGGUGGAGG | 24 | 26016 |
| CFTR-Intron10-7137 | - | UCCUAGCACUUUUGGAGG | 18 | 26017 |
| CFTR-Intron10-7138 | - | AUCCUAGCACUUUUGGAGG | 19 | 26018 |

TABLE 41E-continued

5th Tier

| gRNA Name | DNA Strand | Targeting Domain | Target Site Length | Seq ID |
|---|---|---|---|---|
| CFTR-Intron10-7139 | - | AAUCCUAGCACUUUUGGAGG | 20 | 26019 |
| CFTR-Intron10-7140 | - | UAAUCCUAGCACUUUUGGAGG | 21 | 26020 |
| CFTR-Intron10-7141 | - | GUAAUCCUAGCACUUUUGGAGG | 22 | 26021 |
| CFTR-Intron10-7142 | - | UGUAAUCCUAGCACUUUUGGAGG | 23 | 26022 |
| CFTR-Intron10-7143 | - | UUGUAAUCCUAGCACUUUUGGAGG | 24 | 26023 |
| CFTR-Intron10-7144 | - | AGAAAGAAGGAAAUGAGG | 18 | 26024 |
| CFTR-Intron10-7145 | - | AAGAAAGAAGGAAAUGAGG | 19 | 26025 |
| CFTR-Intron10-7146 | - | GAAGAAAGAAGGAAAUGAGG | 20 | 26026 |
| CFTR-Intron10-7147 | - | GGAAGAAAGAAGGAAAUGAGG | 21 | 26027 |
| CFTR-Intron10-7148 | - | AGGAAGAAAGAAGGAAAUGAGG | 22 | 26028 |
| CFTR-Intron10-7149 | - | AAGGAAGAAAGAAGGAAAUGAGG | 23 | 26029 |
| CFTR-Intron10-7150 | - | GAAGGAAGAAAGAAGGAAAUGAGG | 24 | 26030 |
| CFTR-Intron10-7151 | - | GGUGAUUAGUCCAUGAGG | 18 | 26031 |
| CFTR-Intron10-7152 | - | AGGUGAUUAGUCCAUGAGG | 19 | 26032 |
| CFTR-Intron10-7153 | - | GAGGUGAUUAGUCCAUGAGG | 20 | 26033 |
| CFTR-Intron10-7154 | - | GGAGGUGAUUAGUCCAUGAGG | 21 | 26034 |
| CFTR-Intron10-7155 | - | GGGAGGUGAUUAGUCCAUGAGG | 22 | 26035 |
| CFTR-Intron10-7156 | - | UGGGAGGUGAUUAGUCCAUGAGG | 23 | 26036 |
| CFTR-Intron10-7157 | - | UUGGGAGGUGAUUAGUCCAUGAGG | 24 | 26037 |
| CFTR-Intron10-7158 | - | CUACUCGGGAGGCUGAGG | 18 | 26038 |
| CFTR-Intron10-7159 | - | GCUACUCGGGAGGCUGAGG | 19 | 26039 |
| CFTR-Intron10-7160 | - | AGCUACUCGGGAGGCUGAGG | 20 | 26040 |
| CFTR-Intron10-7161 | - | CAGCUACUCGGGAGGCUGAGG | 21 | 26041 |
| CFTR-Intron10-7162 | - | CCAGCUACUCGGGAGGCUGAGG | 22 | 26042 |
| CFTR-Intron10-7163 | - | CCCAGCUACUCGGGAGGCUGAGG | 23 | 26043 |
| CFTR-Intron10-7164 | - | UCCCAGCUACUCGGGAGGCUGAGG | 24 | 26044 |
| CFTR-Intron10-7165 | - | CUACUUGGGAGGCUGAGG | 18 | 26045 |
| CFTR-Intron10-7166 | - | GCUACUUGGGAGGCUGAGG | 19 | 26046 |
| CFTR-Intron10-1288 | - | AGCUACUUGGGAGGCUGAGG | 20 | 20173 |
| CFTR-Intron10-7167 | - | AAAAAUUAUACUAUAGG | 18 | 26047 |
| CFTR-Intron10-7168 | - | UAAAAAUUAUACUAUAGG | 19 | 26048 |
| CFTR-Intron10-1289 | - | UUAAAAAUUAUACUAUAGG | 20 | 20174 |
| CFTR-Intron10-7169 | - | AUUAAAAAUUAUACUAUAGG | 21 | 26049 |
| CFTR-Intron10-7170 | - | UAUUAAAAAUUAUACUAUAGG | 22 | 26050 |
| CFTR-Intron10-7171 | - | CUAUUAAAAAUUAUACUAUAGG | 23 | 26051 |
| CFTR-Intron10-7172 | - | ACUAUUAAAAAUUAUACUAUAGG | 24 | 26052 |
| CFTR-Intron10-7173 | - | AGGAAGAAAGGAAGUAGG | 18 | 26053 |

TABLE 41E-continued

5th Tier

| gRNA Name | DNA Strand | Targeting Domain | Target Site Length | Seq ID |
|---|---|---|---|---|
| CFTR-Intron10-7174 | - | GAGGAAGAAAGGAAGUAGG | 19 | 26054 |
| CFTR-Intron10-1290 | - | UGAGGAAGAAAGGAAGUAGG | 20 | 20175 |
| CFTR-Intron10-7175 | - | AUGAGGAAGAAAGGAAGUAGG | 21 | 26055 |
| CFTR-Intron10-7176 | - | AAUGAGGAAGAAAGGAAGUAGG | 22 | 26056 |
| CFTR-Intron10-7177 | - | AAAUGAGGAAGAAAGGAAGUAGG | 23 | 26057 |
| CFTR-Intron10-7178 | - | GAAAUGAGGAAGAAAGGAAGUAGG | 24 | 26058 |
| CFTR-Intron10-7179 | - | CAGAGAAGUAAUCGGCGG | 18 | 26059 |
| CFTR-Intron10-7180 | - | UCAGAGAAGUAAUCGGCGG | 19 | 26060 |
| CFTR-Intron10-105 | - | GUCAGAGAAGUAAUCGGCGG | 20 | 18991 |
| CFTR-Intron10-7181 | - | UGUCAGAGAAGUAAUCGGCGG | 21 | 26061 |
| CFTR-Intron10-7182 | - | CUGUCAGAGAAGUAAUCGGCGG | 22 | 26062 |
| CFTR-Intron10-7183 | - | ACUGUCAGAGAAGUAAUCGGCGG | 23 | 26063 |
| CFTR-Intron10-7184 | - | UACUGUCAGAGAAGUAAUCGGCGG | 24 | 26064 |
| CFTR-Intron10-7185 | - | UCUGUAGGGAGACAAGGG | 18 | 26065 |
| CFTR-Intron10-7186 | - | UUCUGUAGGGAGACAAGGG | 19 | 26066 |
| CFTR-Intron10-473 | - | AUUCUGUAGGGAGACAAGGG | 20 | 19359 |
| CFTR-Intron10-7187 | - | UAUUCUGUAGGGAGACAAGGG | 21 | 26067 |
| CFTR-Intron10-7188 | - | CUAUUCUGUAGGGAGACAAGGG | 22 | 26068 |
| CFTR-Intron10-7189 | - | GCUAUUCUGUAGGGAGACAAGGG | 23 | 26069 |
| CFTR-Intron10-7190 | - | GGCUAUUCUGUAGGGAGACAAGGG | 24 | 26070 |
| CFTR-Intron10-7191 | - | GGUGAUGGUAUUGCAGGG | 18 | 26071 |
| CFTR-Intron10-7192 | - | AGGUGAUGGUAUUGCAGGG | 19 | 26072 |
| CFTR-Intron10-1292 | - | AAGGUGAUGGUAUUGCAGGG | 20 | 20177 |
| CFTR-Intron10-7193 | - | CAAGGUGAUGGUAUUGCAGGG | 21 | 26073 |
| CFTR-Intron10-7194 | - | CCAAGGUGAUGGUAUUGCAGGG | 22 | 26074 |
| CFTR-Intron10-7195 | - | CCCAAGGUGAUGGUAUUGCAGGG | 23 | 26075 |
| CFTR-Intron10-7196 | - | UCCCAAGGUGAUGGUAUUGCAGGG | 24 | 26076 |
| CFTR-Intron10-7197 | - | CAGGAGCCAAAAAUUGGG | 18 | 26077 |
| CFTR-Intron10-7198 | - | UCAGGAGCCAAAAAUUGGG | 19 | 26078 |
| CFTR-Intron10-476 | - | UUCAGGAGCCAAAAAUUGGG | 20 | 19362 |
| CFTR-Intron10-7199 | - | UUUCAGGAGCCAAAAAUUGGG | 21 | 26079 |
| CFTR-Intron10-7200 | - | CUUUCAGGAGCCAAAAAUUGGG | 22 | 26080 |
| CFTR-Intron10-7201 | - | GCUUUCAGGAGCCAAAAAUUGGG | 23 | 26081 |
| CFTR-Intron10-7202 | - | UGCUUUCAGGAGCCAAAAAUUGGG | 24 | 26082 |
| CFTR-Intron10-7203 | - | UUACUAGAAAGAUAAUGG | 18 | 26083 |
| CFTR-Intron10-7204 | - | UUUACUAGAAAGAUAAUGG | 19 | 26084 |
| CFTR-Intron10-7205 | - | GUUUACUAGAAAGAUAAUGG | 20 | 26085 |

TABLE 41E-continued

5th Tier

| gRNA Name | DNA Strand | Targeting Domain | Target Site Length | Seq ID |
|---|---|---|---|---|
| CFTR-Intron10-7206 | - | CGUUUACUAGAAAGAUAAUGG | 21 | 26086 |
| CFTR-Intron10-7207 | - | CCGUUUACUAGAAAGAUAAUGG | 22 | 26087 |
| CFTR-Intron10-7208 | - | GCCGUUUACUAGAAAGAUAAUGG | 23 | 26088 |
| CFTR-Intron10-7209 | - | UGCCGUUUACUAGAAAGAUAAUGG | 24 | 26089 |
| CFTR-Intron10-7210 | - | UAAGGCUUAUUUCUCUGG | 18 | 26090 |
| CFTR-Intron10-7211 | - | CUAAGGCUUAUUUCUCUGG | 19 | 26091 |
| CFTR-Intron10-7212 | - | ACUAAGGCUUAUUUCUCUGG | 20 | 26092 |
| CFTR-Intron10-7213 | - | GACUAAGGCUUAUUUCUCUGG | 21 | 26093 |
| CFTR-Intron10-7214 | - | AGACUAAGGCUUAUUUCUCUGG | 22 | 26094 |
| CFTR-Intron10-7215 | - | AAGACUAAGGCUUAUUUCUCUGG | 23 | 26095 |
| CFTR-Intron10-7216 | - | AAAGACUAAGGCUUAUUUCUCUGG | 24 | 26096 |
| CFTR-Intron10-7217 | - | UAGAGGUUAAGGAGGUGG | 18 | 26097 |
| CFTR-Intron10-7218 | - | UUAGAGGUUAAGGAGGUGG | 19 | 26098 |
| CFTR-Intron10-7219 | - | AUUAGAGGUUAAGGAGGUGG | 20 | 26099 |
| CFTR-Intron10-7220 | - | UAUUAGAGGUUAAGGAGGUGG | 21 | 26100 |
| CFTR-Intron10-7221 | - | GUAUUAGAGGUUAAGGAGGUGG | 22 | 26101 |
| CFTR-Intron10-7222 | - | AGUAUUAGAGGUUAAGGAGGUGG | 23 | 26102 |
| CFTR-Intron10-7223 | - | AAGUAUUAGAGGUUAAGGAGGUGG | 24 | 26103 |
| CFTR-Intron10-7224 | - | GAGCCAAAAAUUGGGUGG | 18 | 26104 |
| CFTR-Intron10-7225 | - | GGAGCCAAAAAUUGGGUGG | 19 | 26105 |
| CFTR-Intron10-478 | - | AGGAGCCAAAAAUUGGGUGG | 20 | 19364 |
| CFTR-Intron10-7226 | - | CAGGAGCCAAAAAUUGGGUGG | 21 | 26106 |
| CFTR-Intron10-7227 | - | UCAGGAGCCAAAAAUUGGGUGG | 22 | 26107 |
| CFTR-Intron10-7228 | - | UUCAGGAGCCAAAAAUUGGGUGG | 23 | 26108 |
| CFTR-Intron10-7229 | - | UUUCAGGAGCCAAAAAUUGGGUGG | 24 | 26109 |
| CFTR-Intron10-7230 | - | UCAGGAGCCAAAAAUUGG | 18 | 26110 |
| CFTR-Intron10-7231 | - | UUCAGGAGCCAAAAAUUGG | 19 | 26111 |
| CFTR-Intron10-7232 | - | UUUCAGGAGCCAAAAAUUGG | 20 | 26112 |
| CFTR-Intron10-7233 | - | CUUUCAGGAGCCAAAAAUUGG | 21 | 26113 |
| CFTR-Intron10-7234 | - | GCUUUCAGGAGCCAAAAAUUGG | 22 | 26114 |
| CFTR-Intron10-7235 | - | UGCUUUCAGGAGCCAAAAAUUGG | 23 | 26115 |
| CFTR-Intron10-7236 | - | CUGCUUUCAGGAGCCAAAAAUUGG | 24 | 26116 |
| CFTR-Intron10-7237 | - | GGGAGAAACAGGUUUUGG | 18 | 26117 |
| CFTR-Intron10-7238 | - | UGGGAGAAACAGGUUUUGG | 19 | 26118 |
| CFTR-Intron10-7239 | - | AUGGGAGAAACAGGUUUUGG | 20 | 26119 |
| CFTR-Intron10-7240 | - | AAUGGGAGAAACAGGUUUUGG | 21 | 26120 |
| CFTR-Intron10-7241 | - | UAAUGGGAGAAACAGGUUUUGG | 22 | 26121 |

TABLE 41E-continued

5th Tier

| gRNA Name | DNA Strand | Targeting Domain | Target Site Length | Seq ID |
|---|---|---|---|---|
| CFTR-Intron10-7242 | - | AUAAUGGGAGAAACAGGUUUUGG | 23 | 26122 |
| CFTR-Intron10-7243 | - | GAUAAUGGGAGAAACAGGUUUUGG | 24 | 26123 |
| CFTR-Intron10-7244 | - | GGAAGAAAGAAGGAAAUG | 18 | 26124 |
| CFTR-Intron10-7245 | - | AGGAAGAAAGAAGGAAAUG | 19 | 26125 |
| CFTR-Intron10-1311 | - | AAGGAAGAAAGAAGGAAAUG | 20 | 20196 |
| CFTR-Intron10-7246 | - | GAAGGAAGAAAGAAGGAAAUG | 21 | 26126 |
| CFTR-Intron10-7247 | - | GGAAGGAAGAAAGAAGGAAAUG | 22 | 26127 |
| CFTR-Intron10-7248 | - | AGGAAGGAAGAAAGAAGGAAAUG | 23 | 26128 |
| CFTR-Intron10-7249 | - | GAGGAAGGAAGAAAGAAGGAAAUG | 24 | 26129 |
| CFTR-Intron10-7250 | - | UUAUCAAUAUCUAAGAUG | 18 | 26130 |
| CFTR-Intron10-7251 | - | UUUAUCAAUAUCUAAGAUG | 19 | 26131 |
| CFTR-Intron10-480 | - | AUUUAUCAAUAUCUAAGAUG | 20 | 19366 |
| CFTR-Intron10-7252 | - | UAUUUAUCAAUAUCUAAGAUG | 21 | 26132 |
| CFTR-Intron10-7253 | - | UUAUUUAUCAAUAUCUAAGAUG | 22 | 26133 |
| CFTR-Intron10-7254 | - | AUUAUUUAUCAAUAUCUAAGAUG | 23 | 26134 |
| CFTR-Intron10-7255 | - | AAUUAUUUAUCAAUAUCUAAGAUG | 24 | 26135 |
| CFTR-Intron10-7256 | - | UCCCCUGCCAUUCAUAUG | 18 | 26136 |
| CFTR-Intron10-7257 | - | CUCCCCUGCCAUUCAUAUG | 19 | 26137 |
| CFTR-Intron10-7258 | - | UCUCCCCUGCCAUUCAUAUG | 20 | 26138 |
| CFTR-Intron10-7259 | - | CUCUCCCCUGCCAUUCAUAUG | 21 | 26139 |
| CFTR-Intron10-7260 | - | UCUCUCCCCUGCCAUUCAUAUG | 22 | 26140 |
| CFTR-Intron10-7261 | - | GUCUCUCCCCUGCCAUUCAUAUG | 23 | 26141 |
| CFTR-Intron10-7262 | - | UGUCUCUCCCCUGCCAUUCAUAUG | 24 | 26142 |
| CFTR-Intron10-7263 | - | UGUUUUUAGGCUAUUCUG | 18 | 26143 |
| CFTR-Intron10-7264 | - | AUGUUUUUAGGCUAUUCUG | 19 | 26144 |
| CFTR-Intron10-7265 | - | AAUGUUUUUAGGCUAUUCUG | 20 | 26145 |
| CFTR-Intron10-7266 | - | UAAUGUUUUUAGGCUAUUCUG | 21 | 26146 |
| CFTR-Intron10-7267 | - | CUAAUGUUUUUAGGCUAUUCUG | 22 | 26147 |
| CFTR-Intron10-7268 | - | GCUAAUGUUUUUAGGCUAUUCUG | 23 | 26148 |
| CFTR-Intron10-7269 | - | GGCUAAUGUUUUUAGGCUAUUCUG | 24 | 26149 |
| CFTR-Intron10-7270 | - | CCUCGGCCUCCCAAAGUG | 18 | 26150 |
| CFTR-Intron10-7271 | - | GCCUCGGCCUCCCAAAGUG | 19 | 26151 |
| CFTR-Intron10-7272 | - | CGCCUCGGCCUCCCAAAGUG | 20 | 26152 |
| CFTR-Intron10-7273 | - | CCGCCUCGGCCUCCCAAAGUG | 21 | 26153 |
| CFTR-Intron10-7274 | - | CCCGCCUCGGCCUCCCAAAGUG | 22 | 26154 |
| CFTR-Intron10-7275 | - | GCCCGCCUCGGCCUCCCAAAGUG | 23 | 26155 |
| CFTR-Intron10-7276 | - | CGCCCGCCUCGGCCUCCCAAAGUG | 24 | 26156 |

TABLE 41E-continued

5th Tier

| gRNA Name | DNA Strand | Targeting Domain | Target Site Length | Seq ID |
|---|---|---|---|---|
| CFTR-Intron10-7277 | − | UGCCUCGGCCUCCCAAAGUG | 20 | 26157 |
| CFTR-Intron10-7278 | − | CUGCCUCGGCCUCCCAAAGUG | 21 | 26158 |
| CFTR-Intron10-7279 | − | CCUGCCUCGGCCUCCCAAAGUG | 22 | 26159 |
| CFTR-Intron10-7280 | − | GCCUGCCUCGGCCUCCCAAAGUG | 23 | 26160 |
| CFTR-Intron10-7281 | − | UGCCUGCCUCGGCCUCCCAAAGUG | 24 | 26161 |
| CFTR-Intron10-7282 | − | CCAGGCUGGAGUGCAGUG | 18 | 26162 |
| CFTR-Intron10-7283 | − | CCCAGGCUGGAGUGCAGUG | 19 | 26163 |
| CFTR-Intron10-7284 | − | GCCCAGGCUGGAGUGCAGUG | 20 | 26164 |
| CFTR-Intron10-7285 | − | CGCCCAGGCUGGAGUGCAGUG | 21 | 26165 |
| CFTR-Intron10-7286 | − | UCGCCCAGGCUGGAGUGCAGUG | 22 | 26166 |
| CFTR-Intron10-7287 | − | GUCGCCCAGGCUGGAGUGCAGUG | 23 | 26167 |
| CFTR-Intron10-7288 | − | UGUCGCCCAGGCUGGAGUGCAGUG | 24 | 26168 |
| CFTR-Intron10-7289 | − | UAAGAAGAGAAAGGGGUG | 18 | 26169 |
| CFTR-Intron10-7290 | − | AUAAGAAGAGAAAGGGGUG | 19 | 26170 |
| CFTR-Intron10-7291 | − | GAUAAGAAGAGAAAGGGGUG | 20 | 26171 |
| CFTR-Intron10-7292 | − | UGAUAAGAAGAGAAAGGGGUG | 21 | 26172 |
| CFTR-Intron10-7293 | − | UUGAUAAGAAGAGAAAGGGGUG | 22 | 26173 |
| CFTR-Intron10-7294 | − | GUUGAUAAGAAGAGAAAGGGGUG | 23 | 26174 |
| CFTR-Intron10-7295 | − | GGUUGAUAAGAAGAGAAAGGGGUG | 24 | 26175 |
| CFTR-Intron10-7296 | − | AGGUUAAGGAGGUGGGUG | 18 | 26176 |
| CFTR-Intron10-7297 | − | GAGGUUAAGGAGGUGGGUG | 19 | 26177 |
| CFTR-Intron10-7298 | − | AGAGGUUAAGGAGGUGGGUG | 20 | 26178 |
| CFTR-Intron10-7299 | − | UAGAGGUUAAGGAGGUGGGUG | 21 | 26179 |
| CFTR-Intron10-7300 | − | UUAGAGGUUAAGGAGGUGGGUG | 22 | 26180 |
| CFTR-Intron10-7301 | − | AUUAGAGGUUAAGGAGGUGGGUG | 23 | 26181 |
| CFTR-Intron10-7302 | − | UAUUAGAGGUUAAGGAGGUGGGUG | 24 | 26182 |
| CFTR-Intron10-7303 | − | GGAGCCAAAAAUUGGGUG | 18 | 26183 |
| CFTR-Intron10-7304 | − | AGGAGCCAAAAAUUGGGUG | 19 | 26184 |
| CFTR-Intron10-489 | − | CAGGAGCCAAAAAUUGGGUG | 20 | 19375 |
| CFTR-Intron10-7305 | − | UCAGGAGCCAAAAAUUGGGUG | 21 | 26185 |
| CFTR-Intron10-7306 | − | UUCAGGAGCCAAAAAUUGGGUG | 22 | 26186 |
| CFTR-Intron10-7307 | − | UUUCAGGAGCCAAAAAUUGGGUG | 23 | 26187 |
| CFTR-Intron10-7308 | − | CUUUCAGGAGCCAAAAAUUGGGUG | 24 | 26188 |
| CFTR-Intron10-7309 | − | UGGCAUCUCACCAGUGUG | 18 | 26189 |
| CFTR-Intron10-7310 | − | AUGGCAUCUCACCAGUGUG | 19 | 26190 |
| CFTR-Intron10-491 | − | UAUGGCAUCUCACCAGUGUG | 20 | 19377 |
| CFTR-Intron10-7311 | − | UUAUGGCAUCUCACCAGUGUG | 21 | 26191 |

TABLE 41E-continued

5th Tier

| gRNA Name | DNA Strand | Targeting Domain | Target Site Length | Seq ID |
|---|---|---|---|---|
| CFTR-Intron10-7312 | - | CUUAUGGCAUCUCACCAGUGUG | 22 | 26192 |
| CFTR-Intron10-7313 | - | GCUUAUGGCAUCUCACCAGUGUG | 23 | 26193 |
| CFTR-Intron10-7314 | - | GGCUUAUGGCAUCUCACCAGUGUG | 24 | 26194 |
| CFTR-Intron10-7315 | - | UUAUAAAAAUAAUUGUG | 18 | 26195 |
| CFTR-Intron10-7316 | - | UUUAUAAAAAUAAUUGUG | 19 | 26196 |
| CFTR-Intron10-7317 | - | UUUUAUAAAAAUAAUUGUG | 20 | 26197 |
| CFTR-Intron10-7318 | - | UUUUUAUAAAAAUAAUUGUG | 21 | 26198 |
| CFTR-Intron10-7319 | - | AUUUUUAUAAAAAUAAUUGUG | 22 | 26199 |
| CFTR-Intron10-7320 | - | GAUUUUUAUAAAAAUAAUUGUG | 23 | 26200 |
| CFTR-Intron10-7321 | - | AGAUUUUUAUAAAAAUAAUUGUG | 24 | 26201 |
| CFTR-Intron10-7322 | - | GCAGUUUUAUUAAAAUUG | 18 | 26202 |
| CFTR-Intron10-7323 | - | GGCAGUUUUAUUAAAAUUG | 19 | 26203 |
| CFTR-Intron10-7324 | - | AGGCAGUUUUAUUAAAAUUG | 20 | 26204 |
| CFTR-Intron10-7325 | - | CAGGCAGUUUUAUUAAAAUUG | 21 | 26205 |
| CFTR-Intron10-7326 | - | UCAGGCAGUUUUAUUAAAAUUG | 22 | 26206 |
| CFTR-Intron10-7327 | - | UUCAGGCAGUUUUAUUAAAAUUG | 23 | 26207 |
| CFTR-Intron10-7328 | - | UUUCAGGCAGUUUUAUUAAAAUUG | 24 | 26208 |
| CFTR-Intron10-7329 | - | GCUCUCUUUUAACUAUUG | 18 | 26209 |
| CFTR-Intron10-7330 | - | UGCUCUCUUUUAACUAUUG | 19 | 26210 |
| CFTR-Intron10-495 | - | UUGCUCUCUUUUAACUAUUG | 20 | 19381 |
| CFTR-Intron10-7331 | - | CUUGCUCUCUUUUAACUAUUG | 21 | 26211 |
| CFTR-Intron10-7332 | - | ACUUGCUCUCUUUUAACUAUUG | 22 | 26212 |
| CFTR-Intron10-7333 | - | AACUUGCUCUCUUUUAACUAUUG | 23 | 26213 |
| CFTR-Intron10-7334 | - | AAACUUGCUCUCUUUUAACUAUUG | 24 | 26214 |
| CFTR-Intron10-7335 | - | CAUUUGAACAAAGACUUG | 18 | 26215 |
| CFTR-Intron10-7336 | - | ACAUUUGAACAAAGACUUG | 19 | 26216 |
| CFTR-Intron10-7337 | - | AACAUUUGAACAAAGACUUG | 20 | 26217 |
| CFTR-Intron10-7338 | - | UAACAUUUGAACAAAGACUUG | 21 | 26218 |
| CFTR-Intron10-7339 | - | GUAACAUUUGAACAAAGACUUG | 22 | 26219 |
| CFTR-Intron10-7340 | - | GGUAACAUUUGAACAAAGACUUG | 23 | 26220 |
| CFTR-Intron10-7341 | - | AGGUAACAUUUGAACAAAGACUUG | 24 | 26221 |
| CFTR-Intron10-7342 | - | UUUAGCUGUGGUACUUUG | 18 | 26222 |
| CFTR-Intron10-7343 | - | UUUUAGCUGUGGUACUUUG | 19 | 26223 |
| CFTR-Intron10-7344 | - | AUUUUAGCUGUGGUACUUUG | 20 | 26224 |
| CFTR-Intron10-7345 | - | CAUUUUAGCUGUGGUACUUUG | 21 | 26225 |
| CFTR-Intron10-7346 | - | UCAUUUUAGCUGUGGUACUUUG | 22 | 26226 |
| CFTR-Intron10-7347 | - | GUCAUUUUAGCUGUGGUACUUUG | 23 | 26227 |

TABLE 41E-continued

5th Tier

| gRNA Name | DNA Strand | Targeting Domain | Target Site Length | Seq ID |
|---|---|---|---|---|
| CFTR-Intron10-7348 | − | UGUCAUUUUAGCUGUGGUACUUUG | 24 | 26228 |
| CFTR-Intron10-7349 | − | GAUUCAGGACAUGCUUUG | 18 | 26229 |
| CFTR-Intron10-7350 | − | AGAUUCAGGACAUGCUUUG | 19 | 26230 |
| CFTR-Intron10-7351 | − | CAGAUUCAGGACAUGCUUUG | 20 | 26231 |
| CFTR-Intron10-7352 | − | UCAGAUUCAGGACAUGCUUUG | 21 | 26232 |
| CFTR-Intron10-7353 | − | AUCAGAUUCAGGACAUGCUUUG | 22 | 26233 |
| CFTR-Intron10-7354 | − | GAUCAGAUUCAGGACAUGCUUUG | 23 | 26234 |
| CFTR-Intron10-7355 | − | UGAUCAGAUUCAGGACAUGCUUUG | 24 | 26235 |
| CFTR-Intron10-7356 | − | CUAUACCUGUCUGGUUUG | 18 | 26236 |
| CFTR-Intron10-7357 | − | ACUAUACCUGUCUGGUUUG | 19 | 26237 |
| CFTR-Intron10-7358 | − | GACUAUACCUGUCUGGUUUG | 20 | 26238 |
| CFTR-Intron10-7359 | − | UGACUAUACCUGUCUGGUUUG | 21 | 26239 |
| CFTR-Intron10-7360 | − | CUGACUAUACCUGUCUGGUUUG | 22 | 26240 |
| CFTR-Intron10-7361 | − | ACUGACUAUACCUGUCUGGUUUG | 23 | 26241 |
| CFTR-Intron10-7362 | − | GACUGACUAUACCUGUCUGGUUUG | 24 | 26242 |
| CFTR-Intron10-7363 | − | CUUACCCAAAUAUGUUUG | 18 | 26243 |
| CFTR-Intron10-7364 | − | ACUUACCCAAAUAUGUUUG | 19 | 26244 |
| CFTR-Intron10-7365 | − | AACUUACCCAAAUAUGUUUG | 20 | 26245 |
| CFTR-Intron10-7366 | − | UAACUUACCCAAAUAUGUUUG | 21 | 26246 |
| CFTR-Intron10-7367 | − | AUAACUUACCCAAAUAUGUUUG | 22 | 26247 |
| CFTR-Intron10-7368 | − | UAUAACUUACCCAAAUAUGUUUG | 23 | 26248 |
| CFTR-Intron10-7369 | − | CUAUAACUUACCCAAAUAUGUUUG | 24 | 26249 |
| CFTR-Intron10-7370 | − | UUACCCAAUAAAAAAAU | 18 | 26250 |
| CFTR-Intron10-7371 | − | GUUACCCAAUAAAAAAAU | 19 | 26251 |
| CFTR-Intron10-7372 | − | UGUUACCCAAUAAAAAAAU | 20 | 26252 |
| CFTR-Intron10-7373 | − | UUGUUACCCAAUAAAAAAAU | 21 | 26253 |
| CFTR-Intron10-7374 | − | AUUGUUACCCAAUAAAAAAAU | 22 | 26254 |
| CFTR-Intron10-7375 | − | UAUUGUUACCCAAUAAAAAAAU | 23 | 26255 |
| CFTR-Intron10-7376 | − | UUAUUGUUACCCAAUAAAAAAAU | 24 | 26256 |
| CFTR-Intron10-7377 | − | UUUUGCAAAAUACAAAAU | 18 | 26257 |
| CFTR-Intron10-7378 | − | UUUUUGCAAAAUACAAAAU | 19 | 26258 |
| CFTR-Intron10-7379 | − | CUUUUUGCAAAAUACAAAAU | 20 | 26259 |
| CFTR-Intron10-7380 | − | ACUUUUUGCAAAAUACAAAAU | 21 | 26260 |
| CFTR-Intron10-7381 | − | CACUUUUUGCAAAAUACAAAAU | 22 | 26261 |
| CFTR-Intron10-7382 | − | GCACUUUUUGCAAAAUACAAAAU | 23 | 26262 |
| CFTR-Intron10-7383 | − | UGCACUUUUUGCAAAAUACAAAAU | 24 | 26263 |
| CFTR-Intron10-7384 | − | AACAAAAGAAAAGAAAAU | 18 | 26264 |

TABLE 41E-continued

5th Tier

| gRNA Name | DNA Strand | Targeting Domain | Target Site Length | Seq ID |
|---|---|---|---|---|
| CFTR-Intron10-7385 | - | UAACAAAAGAAAAGAAAAU | 19 | 26265 |
| CFTR-Intron10-7386 | - | GUAACAAAAGAAAAGAAAAU | 20 | 26266 |
| CFTR-Intron10-7387 | - | UGUAACAAAAGAAAAGAAAAU | 21 | 26267 |
| CFTR-Intron10-7388 | - | UUGUAACAAAAGAAAAGAAAAU | 22 | 26268 |
| CFTR-Intron10-7389 | - | GUUGUAACAAAAGAAAAGAAAAU | 23 | 26269 |
| CFTR-Intron10-7390 | - | UGUUGUAACAAAAGAAAAGAAAAU | 24 | 26270 |
| CFTR-Intron10-7391 | - | GACAUGAAAGAAUCAAAU | 18 | 26271 |
| CFTR-Intron10-7392 | - | AGACAUGAAAGAAUCAAAU | 19 | 26272 |
| CFTR-Intron10-7393 | - | AAGACAUGAAAGAAUCAAAU | 20 | 26273 |
| CFTR-Intron10-7394 | - | AAAGACAUGAAAGAAUCAAAU | 21 | 26274 |
| CFTR-Intron10-7395 | - | UAAAGACAUGAAAGAAUCAAAU | 22 | 26275 |
| CFTR-Intron10-7396 | - | UUAAAGACAUGAAAGAAUCAAAU | 23 | 26276 |
| CFTR-Intron10-7397 | - | UUUAAAGACAUGAAAGAAUCAAAU | 24 | 26277 |
| CFTR-Intron10-7398 | - | GUGGUACUUUGUAGAAAU | 18 | 26278 |
| CFTR-Intron10-7399 | - | UGUGGUACUUUGUAGAAAU | 19 | 26279 |
| CFTR-Intron10-7400 | - | CUGUGGUACUUUGUAGAAAU | 20 | 26280 |
| CFTR-Intron10-7401 | - | GCUGUGGUACUUUGUAGAAAU | 21 | 26281 |
| CFTR-Intron10-7402 | - | AGCUGUGGUACUUUGUAGAAAU | 22 | 26282 |
| CFTR-Intron10-7403 | - | UAGCUGUGGUACUUUGUAGAAAU | 23 | 26283 |
| CFTR-Intron10-7404 | - | UUAGCUGUGGUACUUUGUAGAAAU | 24 | 26284 |
| CFTR-Intron10-7405 | - | AGGAAGAAAGAAGGAAAU | 18 | 26285 |
| CFTR-Intron10-7406 | - | AAGGAAGAAAGAAGGAAAU | 19 | 26286 |
| CFTR-Intron10-7407 | - | GAAGGAAGAAAGAAGGAAAU | 20 | 26287 |
| CFTR-Intron10-7408 | - | GGAAGGAAGAAAGAAGGAAAU | 21 | 26288 |
| CFTR-Intron10-7409 | - | AGGAAGGAAGAAAGAAGGAAAU | 22 | 26289 |
| CFTR-Intron10-7410 | - | GAGGAAGGAAGAAAGAAGGAAAU | 23 | 26290 |
| CFTR-Intron10-7411 | - | AGAGGAAGGAAGAAAGAAGGAAAU | 24 | 26291 |
| CFTR-Intron10-7412 | - | ACUUGACCAGAAUGAAAU | 18 | 26292 |
| CFTR-Intron10-7413 | - | AACUUGACCAGAAUGAAAU | 19 | 26293 |
| CFTR-Intron10-7414 | - | AAACUUGACCAGAAUGAAAU | 20 | 26294 |
| CFTR-Intron10-7415 | - | CAAACUUGACCAGAAUGAAAU | 21 | 26295 |
| CFTR-Intron10-7416 | - | UCAAACUUGACCAGAAUGAAAU | 22 | 26296 |
| CFTR-Intron10-7417 | - | GUCAAACUUGACCAGAAUGAAAU | 23 | 26297 |
| CFTR-Intron10-7418 | - | GGUCAAACUUGACCAGAAUGAAAU | 24 | 26298 |
| CFTR-Intron10-7419 | - | ACCGGUGUCUUCUGAAAU | 18 | 26299 |
| CFTR-Intron10-7420 | - | AACCGGUGUCUUCUGAAAU | 19 | 26300 |
| CFTR-Intron10-7421 | - | UAACCGGUGUCUUCUGAAAU | 20 | 26301 |

TABLE 41E-continued

| | | 5th Tier | | |
|---|---|---|---|---|
| gRNA Name | DNA Strand | Targeting Domain | Target Site Length | Seq ID |
| CFTR-Intron10-7422 | − | UUAACCGGUGUCUUCUGAAAU | 21 | 26302 |
| CFTR-Intron10-7423 | − | AUUAACCGGUGUCUUCUGAAAU | 22 | 26303 |
| CFTR-Intron10-7424 | − | AAUUAACCGGUGUCUUCUGAAAU | 23 | 26304 |
| CFTR-Intron10-7425 | − | UAAUUAACCGGUGUCUUCUGAAAU | 24 | 26305 |
| CFTR-Intron10-7426 | − | UUGGGGUUUUUUGACAAU | 18 | 26306 |
| CFTR-Intron10-7427 | − | UUUGGGGUUUUUUGACAAU | 19 | 26307 |
| CFTR-Intron10-7428 | − | UUUUGGGGUUUUUUGACAAU | 20 | 26308 |
| CFTR-Intron10-7429 | − | UUUUUGGGGUUUUUUGACAAU | 21 | 26309 |
| CFTR-Intron10-7430 | − | AUUUUUGGGGUUUUUUGACAAU | 22 | 26310 |
| CFTR-Intron10-7431 | − | AAUUUUUGGGGUUUUUUGACAAU | 23 | 26311 |
| CFTR-Intron10-7432 | − | AAAUUUUUGGGGUUUUUUGACAAU | 24 | 26312 |
| CFTR-Intron10-7433 | − | AAUGAAAUUAGAAAGAAU | 18 | 26313 |
| CFTR-Intron10-7434 | − | GAAUGAAAUUAGAAAGAAU | 19 | 26314 |
| CFTR-Intron10-7435 | − | AGAAUGAAAUUAGAAAGAAU | 20 | 26315 |
| CFTR-Intron10-7436 | − | CAGAAUGAAAUUAGAAAGAAU | 21 | 26316 |
| CFTR-Intron10-7437 | − | CCAGAAUGAAAUUAGAAAGAAU | 22 | 26317 |
| CFTR-Intron10-7438 | − | ACCAGAAUGAAAUUAGAAAGAAU | 23 | 26318 |
| CFTR-Intron10-7439 | − | GACCAGAAUGAAAUUAGAAAGAAU | 24 | 26319 |
| CFTR-Intron10-7440 | − | UAUUUUGAAGAAUUGAAU | 18 | 26320 |
| CFTR-Intron10-7441 | − | AUAUUUUGAAGAAUUGAAU | 19 | 26321 |
| CFTR-Intron10-7442 | − | CAUAUUUUGAAGAAUUGAAU | 20 | 26322 |
| CFTR-Intron10-7443 | − | CCAUAUUUUGAAGAAUUGAAU | 21 | 26323 |
| CFTR-Intron10-7444 | − | ACCAUAUUUUGAAGAAUUGAAU | 22 | 26324 |
| CFTR-Intron10-7445 | − | AACCAUAUUUUGAAGAAUUGAAU | 23 | 26325 |
| CFTR-Intron10-7446 | − | GAACCAUAUUUUGAAGAAUUGAAU | 24 | 26326 |
| CFTR-Intron10-7447 | − | UGGUACUACUGUAAUAAU | 18 | 26327 |
| CFTR-Intron10-7448 | − | AUGGUACUACUGUAAUAAU | 19 | 26328 |
| CFTR-Intron10-7449 | − | UAUGGUACUACUGUAAUAAU | 20 | 26329 |
| CFTR-Intron10-7450 | − | AUAUGGUACUACUGUAAUAAU | 21 | 26330 |
| CFTR-Intron10-7451 | − | CAUAUGGUACUACUGUAAUAAU | 22 | 26331 |
| CFTR-Intron10-7452 | − | ACAUAUGGUACUACUGUAAUAAU | 23 | 26332 |
| CFTR-Intron10-7453 | − | UACAUAUGGUACUACUGUAAUAAU | 24 | 26333 |
| CFTR-Intron10-7454 | − | GUUUACUAGAAAGAUAAU | 18 | 26334 |
| CFTR-Intron10-7455 | − | CGUUUACUAGAAAGAUAAU | 19 | 26335 |
| CFTR-Intron10-501 | − | CCGUUUACUAGAAAGAUAAU | 20 | 19387 |
| CFTR-Intron10-7456 | − | GCCGUUUACUAGAAAGAUAAU | 21 | 26336 |
| CFTR-Intron10-7457 | − | UGCCGUUUACUAGAAAGAUAAU | 22 | 26337 |

TABLE 41E-continued

5th Tier

| gRNA Name | DNA Strand | Targeting Domain | Target Site Length | Seq ID |
|---|---|---|---|---|
| CFTR-Intron10-7458 | - | GUGCCGUUUACUAGAAAGAUAAU | 23 | 26338 |
| CFTR-Intron10-7459 | - | UGUGCCGUUUACUAGAAAGAUAAU | 24 | 26339 |
| CFTR-Intron10-7460 | - | UGACUCUAGUUCACUAAU | 18 | 26340 |
| CFTR-Intron10-7461 | - | GUGACUCUAGUUCACUAAU | 19 | 26341 |
| CFTR-Intron10-7462 | - | UGUGACUCUAGUUCACUAAU | 20 | 26342 |
| CFTR-Intron10-7463 | - | AUGUGACUCUAGUUCACUAAU | 21 | 26343 |
| CFTR-Intron10-7464 | - | UAUGUGACUCUAGUUCACUAAU | 22 | 26344 |
| CFTR-Intron10-7465 | - | CUAUGUGACUCUAGUUCACUAAU | 23 | 26345 |
| CFTR-Intron10-7466 | - | UCUAUGUGACUCUAGUUCACUAAU | 24 | 26346 |
| CFTR-Intron10-7467 | - | AACAUUGAAAGGUAACAU | 18 | 26347 |
| CFTR-Intron10-7468 | - | AAACAUUGAAAGGUAACAU | 19 | 26348 |
| CFTR-Intron10-7469 | - | UAAACAUUGAAAGGUAACAU | 20 | 26349 |
| CFTR-Intron10-7470 | - | UUAAACAUUGAAAGGUAACAU | 21 | 26350 |
| CFTR-Intron10-7471 | - | UUUAAACAUUGAAAGGUAACAU | 22 | 26351 |
| CFTR-Intron10-7472 | - | CUUUAAACAUUGAAAGGUAACAU | 23 | 26352 |
| CFTR-Intron10-7473 | - | CCUUUAAACAUUGAAAGGUAACAU | 24 | 26353 |
| CFTR-Intron10-7474 | - | UUUUUUCAGUUAAUACAU | 18 | 26354 |
| CFTR-Intron10-7475 | - | UUUUUUUCAGUUAAUACAU | 19 | 26355 |
| CFTR-Intron10-1332 | - | UUUUUUUUCAGUUAAUACAU | 20 | 20217 |
| CFTR-Intron10-7476 | - | AUUUUUUUUCAGUUAAUACAU | 21 | 26356 |
| CFTR-Intron10-7477 | - | AAUUUUUUUUCAGUUAAUACAU | 22 | 26357 |
| CFTR-Intron10-7478 | - | GAAUUUUUUUUCAGUUAAUACAU | 23 | 26358 |
| CFTR-Intron10-7479 | - | UGAAUUUUUUUUCAGUUAAUACAU | 24 | 26359 |
| CFTR-Intron10-7480 | - | GCAUAUUUGGAGAUACAU | 18 | 26360 |
| CFTR-Intron10-7481 | - | GGCAUAUUUGGAGAUACAU | 19 | 26361 |
| CFTR-Intron10-7482 | - | UGGCAUAUUUGGAGAUACAU | 20 | 26362 |
| CFTR-Intron10-7483 | - | CUGGCAUAUUUGGAGAUACAU | 21 | 26363 |
| CFTR-Intron10-7484 | - | CCUGGCAUAUUUGGAGAUACAU | 22 | 26364 |
| CFTR-Intron10-7485 | - | ACCUGGCAUAUUUGGAGAUACAU | 23 | 26365 |
| CFTR-Intron10-7486 | - | AACCUGGCAUAUUUGGAGAUACAU | 24 | 26366 |
| CFTR-Intron10-7487 | - | CCAGUUGUUUCCUACAU | 18 | 26367 |
| CFTR-Intron10-7488 | - | UCCAGUUGUUUCCUACAU | 19 | 26368 |
| CFTR-Intron10-7489 | - | CUCCAGUUGUUUCCUACAU | 20 | 26369 |
| CFTR-Intron10-7490 | - | UCUCCAGUUGUUUCCUACAU | 21 | 26370 |
| CFTR-Intron10-7491 | - | CUCUCCAGUUGUUUCCUACAU | 22 | 26371 |
| CFTR-Intron10-7492 | - | UCUCUCCAGUUGUUUCCUACAU | 23 | 26372 |
| CFTR-Intron10-7493 | - | CUCUCUCCAGUUGUUUCCUACAU | 24 | 26373 |

TABLE 41E-continued

5th Tier

| gRNA Name | DNA Strand | Targeting Domain | Target Site Length | Seq ID |
|---|---|---|---|---|
| CFTR-Intron10-7494 | – | CUCACCCCUUUCUGCCAU | 18 | 26374 |
| CFTR-Intron10-7495 | – | CCUCACCCCUUUCUGCCAU | 19 | 26375 |
| CFTR-Intron10-7496 | – | CCCUCACCCCUUUCUGCCAU | 20 | 26376 |
| CFTR-Intron10-7497 | – | ACCCUCACCCCUUUCUGCCAU | 21 | 26377 |
| CFTR-Intron10-7498 | – | GACCCUCACCCCUUUCUGCCAU | 22 | 26378 |
| CFTR-Intron10-7499 | – | AGACCCUCACCCCUUUCUGCCAU | 23 | 26379 |
| CFTR-Intron10-7500 | – | GAGACCCUCACCCCUUUCUGCCAU | 24 | 26380 |
| CFTR-Intron10-7501 | – | UAAGUUGAACAAUGGCAU | 18 | 26381 |
| CFTR-Intron10-7502 | – | AUAAGUUGAACAAUGGCAU | 19 | 26382 |
| CFTR-Intron10-7503 | – | GAUAAGUUGAACAAUGGCAU | 20 | 26383 |
| CFTR-Intron10-7504 | – | GGAUAAGUUGAACAAUGGCAU | 21 | 26384 |
| CFTR-Intron10-7505 | – | UGGAUAAGUUGAACAAUGGCAU | 22 | 26385 |
| CFTR-Intron10-7506 | – | AUGGAUAAGUUGAACAAUGGCAU | 23 | 26386 |
| CFTR-Intron10-7507 | – | AAUGGAUAAGUUGAACAAUGGCAU | 24 | 26387 |
| CFTR-Intron10-7508 | – | AAAAUAUCACCAACUCAU | 18 | 26388 |
| CFTR-Intron10-7509 | – | AAAAAUAUCACCAACUCAU | 19 | 26389 |
| CFTR-Intron10-7510 | – | GAAAAAUAUCACCAACUCAU | 20 | 26390 |
| CFTR-Intron10-7511 | – | UGAAAAAUAUCACCAACUCAU | 21 | 26391 |
| CFTR-Intron10-7512 | – | AUGAAAAAUAUCACCAACUCAU | 22 | 26392 |
| CFTR-Intron10-7513 | – | AAUGAAAAAUAUCACCAACUCAU | 23 | 26393 |
| CFTR-Intron10-7514 | – | UAAUGAAAAAUAUCACCAACUCAU | 24 | 26394 |
| CFTR-Intron10-7515 | – | UUUGUAAAUUUGUUUCAU | 18 | 26395 |
| CFTR-Intron10-7516 | – | UUUUGUAAAUUUGUUUCAU | 19 | 26396 |
| CFTR-Intron10-7517 | – | AUUUUGUAAAUUUGUUUCAU | 20 | 26397 |
| CFTR-Intron10-7518 | – | AAUUUUGUAAAUUUGUUUCAU | 21 | 26398 |
| CFTR-Intron10-7519 | – | UAAUUUUGUAAAUUUGUUUCAU | 22 | 26399 |
| CFTR-Intron10-7520 | – | CUAAUUUUGUAAAUUUGUUUCAU | 23 | 26400 |
| CFTR-Intron10-7521 | – | ACUAAUUUUGUAAAUUUGUUUCAU | 24 | 26401 |
| CFTR-Intron10-7522 | – | UUUAUCAAUAUCUAAGAU | 18 | 26402 |
| CFTR-Intron10-7523 | – | AUUUAUCAAUAUCUAAGAU | 19 | 26403 |
| CFTR-Intron10-7524 | – | UAUUUAUCAAUAUCUAAGAU | 20 | 26404 |
| CFTR-Intron10-7525 | – | UUAUUUAUCAAUAUCUAAGAU | 21 | 26405 |
| CFTR-Intron10-7526 | – | AUUAUUUAUCAAUAUCUAAGAU | 22 | 26406 |
| CFTR-Intron10-7527 | – | AAUUAUUUAUCAAUAUCUAAGAU | 23 | 26407 |
| CFTR-Intron10-7528 | – | CAAUUAUUUAUCAAUAUCUAAGAU | 24 | 26408 |
| CFTR-Intron10-7529 | – | AAGAAUCAAAUUAGAGAU | 18 | 26409 |
| CFTR-Intron10-7530 | – | AAAGAAUCAAAUUAGAGAU | 19 | 26410 |

TABLE 41E-continued

| | | 5th Tier | | |
|---|---|---|---|---|
| gRNA Name | DNA Strand | Targeting Domain | Target Site Length | Seq ID |
| CFTR-Intron10-7531 | – | GAAAGAAUCAAAUUAGAGAU | 20 | 26411 |
| CFTR-Intron10-7532 | – | UGAAAGAAUCAAAUUAGAGAU | 21 | 26412 |
| CFTR-Intron10-7533 | – | AUGAAAGAAUCAAAUUAGAGAU | 22 | 26413 |
| CFTR-Intron10-7534 | – | CAUGAAAGAAUCAAAUUAGAGAU | 23 | 26414 |
| CFTR-Intron10-7535 | – | ACAUGAAAGAAUCAAAUUAGAGAU | 24 | 26415 |
| CFTR-Intron10-7536 | – | UUUGGAAUUUUGGGAGAU | 18 | 26416 |
| CFTR-Intron10-7537 | – | UUUUGGAAUUUUGGGAGAU | 19 | 26417 |
| CFTR-Intron10-7538 | – | AUUUUGGAAUUUUGGGAGAU | 20 | 26418 |
| CFTR-Intron10-7539 | – | UAUUUUGGAAUUUUGGGAGAU | 21 | 26419 |
| CFTR-Intron10-7540 | – | AUAUUUUGGAAUUUUGGGAGAU | 22 | 26420 |
| CFTR-Intron10-7541 | – | AAUAUUUUGGAAUUUUGGGAGAU | 23 | 26421 |
| CFTR-Intron10-7542 | – | CAAUAUUUUGGAAUUUUGGGAGAU | 24 | 26422 |
| CFTR-Intron10-7543 | – | UAUUUCUCUGGGUGAGAU | 18 | 26423 |
| CFTR-Intron10-7544 | – | UUAUUUCUCUGGGUGAGAU | 19 | 26424 |
| CFTR-Intron10-7545 | – | CUUAUUUCUCUGGGUGAGAU | 20 | 26425 |
| CFTR-Intron10-7546 | – | GCUUAUUUCUCUGGGUGAGAU | 21 | 26426 |
| CFTR-Intron10-7547 | – | GGCUUAUUUCUCUGGGUGAGAU | 22 | 26427 |
| CFTR-Intron10-7548 | – | AGGCUUAUUUCUCUGGGUGAGAU | 23 | 26428 |
| CFTR-Intron10-7549 | – | AAGGCUUAUUUCUCUGGGUGAGAU | 24 | 26429 |
| CFTR-Intron10-7550 | – | UCUGAAAAAAUAGUAGAU | 18 | 26430 |
| CFTR-Intron10-7551 | – | AUCUGAAAAAAUAGUAGAU | 19 | 26431 |
| CFTR-Intron10-7552 | – | CAUCUGAAAAAAUAGUAGAU | 20 | 26432 |
| CFTR-Intron10-7553 | – | ACAUCUGAAAAAAUAGUAGAU | 21 | 26433 |
| CFTR-Intron10-7554 | – | UACAUCUGAAAAAAUAGUAGAU | 22 | 26434 |
| CFTR-Intron10-7555 | – | AUACAUCUGAAAAAAUAGUAGAU | 23 | 26435 |
| CFTR-Intron10-7556 | – | GAUACAUCUGAAAAAAUAGUAGAU | 24 | 26436 |
| CFTR-Intron10-7557 | – | UUGCAGGAGGUGAGGGAU | 18 | 26437 |
| CFTR-Intron10-7558 | – | CUUGCAGGAGGUGAGGGAU | 19 | 26438 |
| CFTR-Intron10-7559 | – | ACUUGCAGGAGGUGAGGGAU | 20 | 26439 |
| CFTR-Intron10-7560 | – | GACUUGCAGGAGGUGAGGGAU | 21 | 26440 |
| CFTR-Intron10-7561 | – | AGACUUGCAGGAGGUGAGGGAU | 22 | 26441 |
| CFTR-Intron10-7562 | – | AAGACUUGCAGGAGGUGAGGGAU | 23 | 26442 |
| CFTR-Intron10-7563 | – | AAAGACUUGCAGGAGGUGAGGGAU | 24 | 26443 |
| CFTR-Intron10-7564 | – | AAAGGAAAGAGGGUUGAU | 18 | 26444 |
| CFTR-Intron10-7565 | – | UAAAGGAAAGAGGGUUGAU | 19 | 26445 |
| CFTR-Intron10-7566 | – | CUAAAGGAAAGAGGGUUGAU | 20 | 26446 |
| CFTR-Intron10-7567 | – | UCUAAAGGAAAGAGGGUUGAU | 21 | 26447 |

TABLE 41E-continued

5th Tier

| gRNA Name | DNA Strand | Targeting Domain | Target Site Length | Seq ID |
|---|---|---|---|---|
| CFTR-Intron10-7568 | − | UUCUAAAGGAAAGAGGGUUGAU | 22 | 26448 |
| CFTR-Intron10-7569 | − | AUUCUAAAGGAAAGAGGGUUGAU | 23 | 26449 |
| CFTR-Intron10-7570 | − | GAUUCUAAAGGAAAGAGGGUUGAU | 24 | 26450 |
| CFTR-Intron10-7571 | − | AGUUGAACAAUGGCAUAU | 18 | 26451 |
| CFTR-Intron10-7572 | − | AAGUUGAACAAUGGCAUAU | 19 | 26452 |
| CFTR-Intron10-7573 | − | UAAGUUGAACAAUGGCAUAU | 20 | 26453 |
| CFTR-Intron10-7574 | − | AUAAGUUGAACAAUGGCAUAU | 21 | 26454 |
| CFTR-Intron10-7575 | − | GAUAAGUUGAACAAUGGCAUAU | 22 | 26455 |
| CFTR-Intron10-7576 | − | GGAUAAGUUGAACAAUGGCAUAU | 23 | 26456 |
| CFTR-Intron10-7577 | − | UGGAUAAGUUGAACAAUGGCAUAU | 24 | 26457 |
| CFTR-Intron10-7578 | − | CAACUUAACCUGGCAUAU | 18 | 26458 |
| CFTR-Intron10-7579 | − | ACAACUUAACCUGGCAUAU | 19 | 26459 |
| CFTR-Intron10-7580 | − | AACAACUUAACCUGGCAUAU | 20 | 26460 |
| CFTR-Intron10-7581 | − | GAACAACUUAACCUGGCAUAU | 21 | 26461 |
| CFTR-Intron10-7582 | − | AGAACAACUUAACCUGGCAUAU | 22 | 26462 |
| CFTR-Intron10-7583 | − | AAGAACAACUUAACCUGGCAUAU | 23 | 26463 |
| CFTR-Intron10-7584 | − | UAAGAACAACUUAACCUGGCAUAU | 24 | 26464 |
| CFTR-Intron10-7585 | − | AUUAAAAAUUAUACUAU | 18 | 26465 |
| CFTR-Intron10-7586 | − | UAUUAAAAAUUAUACUAU | 19 | 26466 |
| CFTR-Intron10-1337 | − | CUAUUAAAAAUUAUACUAU | 20 | 20222 |
| CFTR-Intron10-7587 | − | ACUAUUAAAAAUUAUACUAU | 21 | 26467 |
| CFTR-Intron10-7588 | − | CACUAUUAAAAAUUAUACUAU | 22 | 26468 |
| CFTR-Intron10-7589 | − | UCACUAUUAAAAAUUAUACUAU | 23 | 26469 |
| CFTR-Intron10-7590 | − | UUCACUAUUAAAAAUUAUACUAU | 24 | 26470 |
| CFTR-Intron10-7591 | − | UUUAUAAAGCUGUACUAU | 18 | 26471 |
| CFTR-Intron10-7592 | − | GUUUAUAAAGCUGUACUAU | 19 | 26472 |
| CFTR-Intron10-7593 | − | GGUUUAUAAAGCUGUACUAU | 20 | 26473 |
| CFTR-Intron10-7594 | − | AGGUUUAUAAAGCUGUACUAU | 21 | 26474 |
| CFTR-Intron10-7595 | − | UAGGUUUAUAAAGCUGUACUAU | 22 | 26475 |
| CFTR-Intron10-7596 | − | UUAGGUUUAUAAAGCUGUACUAU | 23 | 26476 |
| CFTR-Intron10-7597 | − | UUUAGGUUUAUAAAGCUGUACUAU | 24 | 26477 |
| CFTR-Intron10-7598 | − | UAAGGGCAUUCUAAGUAU | 18 | 26478 |
| CFTR-Intron10-7599 | − | CUAAGGGCAUUCUAAGUAU | 19 | 26479 |
| CFTR-Intron10-7600 | − | CCUAAGGGCAUUCUAAGUAU | 20 | 26480 |
| CFTR-Intron10-7601 | − | GCCUAAGGGCAUUCUAAGUAU | 21 | 26481 |
| CFTR-Intron10-7602 | − | AGCCUAAGGGCAUUCUAAGUAU | 22 | 26482 |
| CFTR-Intron10-7603 | − | UAGCCUAAGGGCAUUCUAAGUAU | 23 | 26483 |

TABLE 41E-continued

5th Tier

| gRNA Name | DNA Strand | Targeting Domain | Target Site Length | Seq ID |
|---|---|---|---|---|
| CFTR-Intron10-7604 | - | UUAGCCUAAGGGCAUUCUAAGUAU | 24 | 26484 |
| CFTR-Intron10-7605 | - | GCUGCCUUUUAGUAGUAU | 18 | 26485 |
| CFTR-Intron10-7606 | - | GGCUGCCUUUUAGUAGUAU | 19 | 26486 |
| CFTR-Intron10-7607 | - | AGGCUGCCUUUUAGUAGUAU | 20 | 26487 |
| CFTR-Intron10-7608 | - | GAGGCUGCCUUUUAGUAGUAU | 21 | 26488 |
| CFTR-Intron10-7609 | - | GGAGGCUGCCUUUUAGUAGUAU | 22 | 26489 |
| CFTR-Intron10-7610 | - | AGGAGGCUGCCUUUUAGUAGUAU | 23 | 26490 |
| CFTR-Intron10-7611 | - | UAGGAGGCUGCCUUUUAGUAGUAU | 24 | 26491 |
| CFTR-Intron10-7612 | - | CUUUUUCAUUGAAUGUAU | 18 | 26492 |
| CFTR-Intron10-7613 | - | UCUUUUUCAUUGAAUGUAU | 19 | 26493 |
| CFTR-Intron10-7614 | - | UUCUUUUUCAUUGAAUGUAU | 20 | 26494 |
| CFTR-Intron10-7615 | - | UUUCUUUUUCAUUGAAUGUAU | 21 | 26495 |
| CFTR-Intron10-7616 | - | UUUUCUUUUUCAUUGAAUGUAU | 22 | 26496 |
| CFTR-Intron10-7617 | - | CUUUUCUUUUUCAUUGAAUGUAU | 23 | 26497 |
| CFTR-Intron10-7618 | - | CCUUUUCUUUUUCAUUGAAUGUAU | 24 | 26498 |
| CFTR-Intron10-7619 | - | CAAUUUGGUAAUUUGUAU | 18 | 26499 |
| CFTR-Intron10-7620 | - | ACAAUUUGGUAAUUUGUAU | 19 | 26500 |
| CFTR-Intron10-7621 | - | UACAAUUUGGUAAUUUGUAU | 20 | 26501 |
| CFTR-Intron10-7622 | - | AUACAAUUUGGUAAUUUGUAU | 21 | 26502 |
| CFTR-Intron10-7623 | - | AAUACAAUUUGGUAAUUUGUAU | 22 | 26503 |
| CFTR-Intron10-7624 | - | CAAUACAAUUUGGUAAUUUGUAU | 23 | 26504 |
| CFTR-Intron10-7625 | - | UCAAUACAAUUUGGUAAUUUGUAU | 24 | 26505 |
| CFTR-Intron10-7626 | - | AUUUUUAACCUGGAUUAU | 18 | 26506 |
| CFTR-Intron10-7627 | - | UAUUUUUAACCUGGAUUAU | 19 | 26507 |
| CFTR-Intron10-7628 | - | AUAUUUUUAACCUGGAUUAU | 20 | 26508 |
| CFTR-Intron10-7629 | - | UAUAUUUUUAACCUGGAUUAU | 21 | 26509 |
| CFTR-Intron10-7630 | - | AUAUAUUUUUAACCUGGAUUAU | 22 | 26510 |
| CFTR-Intron10-7631 | - | UAUAUAUUUUUAACCUGGAUUAU | 23 | 26511 |
| CFTR-Intron10-7632 | - | AUAUAUAUUUUUAACCUGGAUUAU | 24 | 26512 |
| CFTR-Intron10-7633 | - | AAAGUUUCUCAUCUUAU | 18 | 26513 |
| CFTR-Intron10-7634 | - | AAAAGUUUCUCAUCUUAU | 19 | 26514 |
| CFTR-Intron10-1339 | - | UAAAAGUUUCUCAUCUUAU | 20 | 20224 |
| CFTR-Intron10-7635 | - | UUAAAAGUUUCUCAUCUUAU | 21 | 26515 |
| CFTR-Intron10-7636 | - | UUUAAAAGUUUCUCAUCUUAU | 22 | 26516 |
| CFTR-Intron10-7637 | - | AUUUAAAAGUUUCUCAUCUUAU | 23 | 26517 |
| CFTR-Intron10-7638 | - | AAUUUAAAAGUUUCUCAUCUUAU | 24 | 26518 |
| CFTR-Intron10-7639 | - | UUCCCAGCCUCCAGAACU | 18 | 26519 |

TABLE 41E-continued

5th Tier

| gRNA Name | DNA Strand | Targeting Domain | Target Site Length | Seq ID |
|---|---|---|---|---|
| CFTR-Intron10-7640 | - | CUUCCCAGCCUCCAGAACU | 19 | 26520 |
| CFTR-Intron10-7641 | - | ACUUCCCAGCCUCCAGAACU | 20 | 26521 |
| CFTR-Intron10-7642 | - | GACUUCCCAGCCUCCAGAACU | 21 | 26522 |
| CFTR-Intron10-7643 | - | GGACUUCCCAGCCUCCAGAACU | 22 | 26523 |
| CFTR-Intron10-7644 | - | UGGACUUCCCAGCCUCCAGAACU | 23 | 26524 |
| CFTR-Intron10-7645 | - | UUGGACUUCCCAGCCUCCAGAACU | 24 | 26525 |
| CFTR-Intron10-7646 | - | GAUUAGGGAAUGCAGACU | 18 | 26526 |
| CFTR-Intron10-7647 | - | GGAUUAGGGAAUGCAGACU | 19 | 26527 |
| CFTR-Intron10-7648 | - | GGGAUUAGGGAAUGCAGACU | 20 | 26528 |
| CFTR-Intron10-7649 | - | AGGGAUUAGGGAAUGCAGACU | 21 | 26529 |
| CFTR-Intron10-7650 | - | GAGGGAUUAGGGAAUGCAGACU | 22 | 26530 |
| CFTR-Intron10-7651 | - | UGAGGGAUUAGGGAAUGCAGACU | 23 | 26531 |
| CFTR-Intron10-7652 | - | GUGAGGGAUUAGGGAAUGCAGACU | 24 | 26532 |
| CFTR-Intron10-7653 | - | AGAAUUGAAUAUGAGACU | 18 | 26533 |
| CFTR-Intron10-7654 | - | AAGAAUUGAAUAUGAGACU | 19 | 26534 |
| CFTR-Intron10-114 | - | GAAGAAUUGAAUAUGAGACU | 20 | 19000 |
| CFTR-Intron10-7655 | - | UGAAGAAUUGAAUAUGAGACU | 21 | 26535 |
| CFTR-Intron10-7656 | - | UUGAAGAAUUGAAUAUGAGACU | 22 | 26536 |
| CFTR-Intron10-7657 | - | UUUGAAGAAUUGAAUAUGAGACU | 23 | 26537 |
| CFTR-Intron10-7658 | - | UUUUGAAGAAUUGAAUAUGAGACU | 24 | 26538 |
| CFTR-Intron10-7659 | - | UAGAUUAGCUUAUAUACU | 18 | 26539 |
| CFTR-Intron10-7660 | - | AUAGAUUAGCUUAUAUACU | 19 | 26540 |
| CFTR-Intron10-7661 | - | AAUAGAUUAGCUUAUAUACU | 20 | 26541 |
| CFTR-Intron10-7662 | - | GAAUAGAUUAGCUUAUAUACU | 21 | 26542 |
| CFTR-Intron10-7663 | - | UGAAUAGAUUAGCUUAUAUACU | 22 | 26543 |
| CFTR-Intron10-7664 | - | UUGAAUAGAUUAGCUUAUAUACU | 23 | 26544 |
| CFTR-Intron10-7665 | - | UUUGAAUAGAUUAGCUUAUAUACU | 24 | 26545 |
| CFTR-Intron10-7666 | - | CCCGUAGUCCCAGCUACU | 18 | 26546 |
| CFTR-Intron10-7667 | - | GCCCGUAGUCCCAGCUACU | 19 | 26547 |
| CFTR-Intron10-1343 | - | UGCCCGUAGUCCCAGCUACU | 20 | 20228 |
| CFTR-Intron10-7668 | - | GUGCCCGUAGUCCCAGCUACU | 21 | 26548 |
| CFTR-Intron10-7669 | - | GGUGCCCGUAGUCCCAGCUACU | 22 | 26549 |
| CFTR-Intron10-7670 | - | GGGUGCCCGUAGUCCCAGCUACU | 23 | 26550 |
| CFTR-Intron10-7671 | - | CGGGUGCCCGUAGUCCCAGCUACU | 24 | 26551 |
| CFTR-Intron10-7672 | - | GUGCCUGUAGUCCCAGCUACU | 21 | 26552 |
| CFTR-Intron10-7673 | - | UGUGCCUGUAGUCCCAGCUACU | 22 | 26553 |
| CFTR-Intron10-7674 | - | GUGUGCCUGUAGUCCCAGCUACU | 23 | 26554 |

TABLE 41E-continued

5th Tier

| gRNA Name | DNA Strand | Targeting Domain | Target Site Length | Seq ID |
|---|---|---|---|---|
| CFTR-Intron10-7675 | - | UGUGUGCCUGUAGUCCCAGCUACU | 24 | 26555 |
| CFTR-Intron10-7676 | - | UCUUUAUAAAAGAAACCU | 18 | 26556 |
| CFTR-Intron10-7677 | - | GUCUUUAUAAAAGAAACCU | 19 | 26557 |
| CFTR-Intron10-7678 | - | UGUCUUUAUAAAAGAAACCU | 20 | 26558 |
| CFTR-Intron10-7679 | - | GUGUCUUUAUAAAAGAAACCU | 21 | 26559 |
| CFTR-Intron10-7680 | - | AGUGUCUUUAUAAAAGAAACCU | 22 | 26560 |
| CFTR-Intron10-7681 | - | UAGUGUCUUUAUAAAAGAAACCU | 23 | 26561 |
| CFTR-Intron10-7682 | - | UUAGUGUCUUUAUAAAAGAAACCU | 24 | 26562 |
| CFTR-Intron10-7683 | - | AGAGAGACCCUCACACCU | 18 | 26563 |
| CFTR-Intron10-7684 | - | UAGAGAGACCCUCACACCU | 19 | 26564 |
| CFTR-Intron10-7685 | - | UUAGAGAGACCCUCACACCU | 20 | 26565 |
| CFTR-Intron10-7686 | - | CUUAGAGAGACCCUCACACCU | 21 | 26566 |
| CFTR-Intron10-7687 | - | CCUUAGAGAGACCCUCACACCU | 22 | 26567 |
| CFTR-Intron10-7688 | - | ACCUUAGAGAGACCCUCACACCU | 23 | 26568 |
| CFTR-Intron10-7689 | - | AACCUUAGAGAGACCCUCACACCU | 24 | 26569 |
| CFTR-Intron10-7690 | - | UUCUCCAUAUCCCACCCU | 18 | 26570 |
| CFTR-Intron10-7691 | - | CUUCUCCAUAUCCCACCCU | 19 | 26571 |
| CFTR-Intron10-7692 | - | UCUUCUCCAUAUCCCACCCU | 20 | 26572 |
| CFTR-Intron10-7693 | - | CUCUUCUCCAUAUCCCACCCU | 21 | 26573 |
| CFTR-Intron10-7694 | - | CCUCUUCUCCAUAUCCCACCCU | 22 | 26574 |
| CFTR-Intron10-7695 | - | UCCUCUUCUCCAUAUCCCACCCU | 23 | 26575 |
| CFTR-Intron10-7696 | - | AUCCUCUUCUCCAUAUCCCACCCU | 24 | 26576 |
| CFTR-Intron10-7697 | - | AGGAAGGCAGUGGUCCCU | 18 | 26577 |
| CFTR-Intron10-7698 | - | GAGGAAGGCAGUGGUCCCU | 19 | 26578 |
| CFTR-Intron10-515 | - | AGAGGAAGGCAGUGGUCCCU | 20 | 19401 |
| CFTR-Intron10-7699 | - | UAGAGGAAGGCAGUGGUCCCU | 21 | 26579 |
| CFTR-Intron10-7700 | - | UUAGAGGAAGGCAGUGGUCCCU | 22 | 26580 |
| CFTR-Intron10-7701 | - | GUUAGAGGAAGGCAGUGGUCCCU | 23 | 26581 |
| CFTR-Intron10-7702 | - | AGUUAGAGGAAGGCAGUGGUCCCU | 24 | 26582 |
| CFTR-Intron10-7703 | - | GGAGGAUCACCUGAGCCU | 18 | 26583 |
| CFTR-Intron10-7704 | - | GGGAGGAUCACCUGAGCCU | 19 | 26584 |
| CFTR-Intron10-7705 | - | UGGGAGGAUCACCUGAGCCU | 20 | 26585 |
| CFTR-Intron10-7706 | - | GUGGGAGGAUCACCUGAGCCU | 21 | 26586 |
| CFTR-Intron10-7707 | - | GGUGGGAGGAUCACCUGAGCCU | 22 | 26587 |
| CFTR-Intron10-7708 | - | AGGUGGGAGGAUCACCUGAGCCU | 23 | 26588 |
| CFTR-Intron10-7709 | - | GAGGUGGGAGGAUCACCUGAGCCU | 24 | 26589 |
| CFTR-Intron10-7710 | - | GGGUGUAGGGGUUAGCCU | 18 | 26590 |

TABLE 41E-continued

5th Tier

| gRNA Name | DNA Strand | Targeting Domain | Target Site Length | Seq ID |
|---|---|---|---|---|
| CFTR-Intron10-7711 | - | GGGGUGUAGGGGUUAGCCU | 19 | 26591 |
| CFTR-Intron10-7712 | - | AGGGGUGUAGGGGUUAGCCU | 20 | 26592 |
| CFTR-Intron10-7713 | - | AAGGGGUGUAGGGGUUAGCCU | 21 | 26593 |
| CFTR-Intron10-7714 | - | AAAGGGGUGUAGGGGUUAGCCU | 22 | 26594 |
| CFTR-Intron10-7715 | - | GAAAGGGGUGUAGGGGUUAGCCU | 23 | 26595 |
| CFTR-Intron10-7716 | - | AGAAAGGGGUGUAGGGGUUAGCCU | 24 | 26596 |
| CFTR-Intron10-7717 | - | UAUUGCAGGGUGGGGCCU | 18 | 26597 |
| CFTR-Intron10-7718 | - | GUAUUGCAGGGUGGGGCCU | 19 | 26598 |
| CFTR-Intron10-7719 | - | GGUAUUGCAGGGUGGGGCCU | 20 | 26599 |
| CFTR-Intron10-7720 | - | UGGUAUUGCAGGGUGGGGCCU | 21 | 26600 |
| CFTR-Intron10-7721 | - | AUGGUAUUGCAGGGUGGGGCCU | 22 | 26601 |
| CFTR-Intron10-7722 | - | GAUGGUAUUGCAGGGUGGGGCCU | 23 | 26602 |
| CFTR-Intron10-7723 | - | UGAUGGUAUUGCAGGGUGGGGCCU | 24 | 26603 |
| CFTR-Intron10-7724 | - | UUUGACCUAAGAUAUCCU | 18 | 26604 |
| CFTR-Intron10-7725 | - | CUUUGACCUAAGAUAUCCU | 19 | 26605 |
| CFTR-Intron10-7726 | - | UCUUUGACCUAAGAUAUCCU | 20 | 26606 |
| CFTR-Intron10-7727 | - | CUCUUUGACCUAAGAUAUCCU | 21 | 26607 |
| CFTR-Intron10-7728 | - | CCUCUUUGACCUAAGAUAUCCU | 22 | 26608 |
| CFTR-Intron10-7729 | - | UCCUCUUUGACCUAAGAUAUCCU | 23 | 26609 |
| CFTR-Intron10-7730 | - | UUCCUCUUUGACCUAAGAUAUCCU | 24 | 26610 |
| CFTR-Intron10-7731 | - | AGCUUAUGAAAAGCAGCU | 18 | 26611 |
| CFTR-Intron10-7732 | - | UAGCUUAUGAAAAGCAGCU | 19 | 26612 |
| CFTR-Intron10-7733 | - | AUAGCUUAUGAAAAGCAGCU | 20 | 26613 |
| CFTR-Intron10-7734 | - | UAUAGCUUAUGAAAAGCAGCU | 21 | 26614 |
| CFTR-Intron10-7735 | - | UUAUAGCUUAUGAAAAGCAGCU | 22 | 26615 |
| CFTR-Intron10-7736 | - | GUUAUAGCUUAUGAAAAGCAGCU | 23 | 26616 |
| CFTR-Intron10-7737 | - | AGUUAUAGCUUAUGAAAAGCAGCU | 24 | 26617 |
| CFTR-Intron10-7738 | - | AGAUGUGCAAAAAUAGCU | 18 | 26618 |
| CFTR-Intron10-7739 | - | UAGAUGUGCAAAAAUAGCU | 19 | 26619 |
| CFTR-Intron10-7740 | - | AUAGAUGUGCAAAAAUAGCU | 20 | 26620 |
| CFTR-Intron10-7741 | - | GAUAGAUGUGCAAAAAUAGCU | 21 | 26621 |
| CFTR-Intron10-7742 | - | UGAUAGAUGUGCAAAAAUAGCU | 22 | 26622 |
| CFTR-Intron10-7743 | - | AUGAUAGAUGUGCAAAAAUAGCU | 23 | 26623 |
| CFTR-Intron10-7744 | - | UAUGAUAGAUGUGCAAAAAUAGCU | 24 | 26624 |
| CFTR-Intron10-7745 | - | UCAGAUUCAGGACAUGCU | 18 | 26625 |
| CFTR-Intron10-7746 | - | AUCAGAUUCAGGACAUGCU | 19 | 26626 |
| CFTR-Intron10-7747 | - | GAUCAGAUUCAGGACAUGCU | 20 | 26627 |

TABLE 41E-continued

5th Tier

| gRNA Name | DNA Strand | Targeting Domain | Target Site Length | Seq ID |
|---|---|---|---|---|
| CFTR-Intron10-7748 | − | UGAUCAGAUUCAGGACAUGCU | 21 | 26628 |
| CFTR-Intron10-7749 | − | GUGAUCAGAUUCAGGACAUGCU | 22 | 26629 |
| CFTR-Intron10-7750 | − | AGUGAUCAGAUUCAGGACAUGCU | 23 | 26630 |
| CFTR-Intron10-7751 | − | AAGUGAUCAGAUUCAGGACAUGCU | 24 | 26631 |
| CFTR-Intron10-7752 | − | AGUUUACUAACUCAAUCU | 18 | 26632 |
| CFTR-Intron10-7753 | − | GAGUUUACUAACUCAAUCU | 19 | 26633 |
| CFTR-Intron10-118 | − | GGAGUUUACUAACUCAAUCU | 20 | 19004 |
| CFTR-Intron10-7754 | − | CGGAGUUUACUAACUCAAUCU | 21 | 26634 |
| CFTR-Intron10-7755 | − | ACGGAGUUUACUAACUCAAUCU | 22 | 26635 |
| CFTR-Intron10-7756 | − | AACGGAGUUUACUAACUCAAUCU | 23 | 26636 |
| CFTR-Intron10-7757 | − | AAACGGAGUUUACUAACUCAAUCU | 24 | 26637 |
| CFTR-Intron10-7758 | − | UUUAUCAAGUUGUUAUCU | 18 | 26638 |
| CFTR-Intron10-7759 | − | AUUUAUCAAGUUGUUAUCU | 19 | 26639 |
| CFTR-Intron10-7760 | − | AAUUUAUCAAGUUGUUAUCU | 20 | 26640 |
| CFTR-Intron10-7761 | − | AAAUUUAUCAAGUUGUUAUCU | 21 | 26641 |
| CFTR-Intron10-7762 | − | UAAAUUUAUCAAGUUGUUAUCU | 22 | 26642 |
| CFTR-Intron10-7763 | − | AUAAAUUUAUCAAGUUGUUAUCU | 23 | 26643 |
| CFTR-Intron10-7764 | − | GAUAAAUUUAUCAAGUUGUUAUCU | 24 | 26644 |
| CFTR-Intron10-7765 | − | UUAGGGAAUGCAGACUCU | 18 | 26645 |
| CFTR-Intron10-7766 | − | AUUAGGGAAUGCAGACUCU | 19 | 26646 |
| CFTR-Intron10-119 | − | GAUUAGGGAAUGCAGACUCU | 20 | 19005 |
| CFTR-Intron10-7767 | − | GGAUUAGGGAAUGCAGACUCU | 21 | 26647 |
| CFTR-Intron10-7768 | − | GGGAUUAGGGAAUGCAGACUCU | 22 | 26648 |
| CFTR-Intron10-7769 | − | AGGGAUUAGGGAAUGCAGACUCU | 23 | 26649 |
| CFTR-Intron10-7770 | − | GAGGGAUUAGGGAAUGCAGACUCU | 24 | 26650 |
| CFTR-Intron10-7771 | − | CCAAUAAAAUAAAAGUCU | 18 | 26651 |
| CFTR-Intron10-7772 | − | CCCAAUAAAAUAAAAGUCU | 19 | 26652 |
| CFTR-Intron10-7773 | − | ACCCAAUAAAAUAAAAGUCU | 20 | 26653 |
| CFTR-Intron10-7774 | − | AACCCAAUAAAAUAAAAGUCU | 21 | 26654 |
| CFTR-Intron10-7775 | − | AAACCCAAUAAAAUAAAAGUCU | 22 | 26655 |
| CFTR-Intron10-7776 | − | AAAACCCAAUAAAAUAAAAGUCU | 23 | 26656 |
| CFTR-Intron10-7777 | − | GAAAACCCAAUAAAAUAAAAGUCU | 24 | 26657 |
| CFTR-Intron10-7778 | − | GAAUAUUUAAACACUUCU | 18 | 26658 |
| CFTR-Intron10-7779 | − | GGAAUAUUUAAACACUUCU | 19 | 26659 |
| CFTR-Intron10-7780 | − | GGGAAUAUUUAAACACUUCU | 20 | 26660 |
| CFTR-Intron10-7781 | − | UGGGAAUAUUUAAACACUUCU | 21 | 26661 |
| CFTR-Intron10-7782 | − | UUGGGAAUAUUUAAACACUUCU | 22 | 26662 |

TABLE 41E-continued

5th Tier

| gRNA Name | DNA Strand | Targeting Domain | Target Site Length | Seq ID |
|---|---|---|---|---|
| CFTR-Intron10-7783 | - | CUUGGGAAUAUUUAAACACUUCU | 23 | 26663 |
| CFTR-Intron10-7784 | - | CCUUGGGAAUAUUUAAACACUUCU | 24 | 26664 |
| CFTR-Intron10-7785 | - | ACCCAAUAAAAUAAAAGU | 18 | 26665 |
| CFTR-Intron10-7786 | - | AACCCAAUAAAAUAAAAGU | 19 | 26666 |
| CFTR-Intron10-7787 | - | AAACCCAAUAAAAUAAAAGU | 20 | 26667 |
| CFTR-Intron10-7788 | - | AAAACCCAAUAAAAUAAAAGU | 21 | 26668 |
| CFTR-Intron10-7789 | - | GAAAACCCAAUAAAAUAAAAGU | 22 | 26669 |
| CFTR-Intron10-7790 | - | AGAAAACCCAAUAAAAUAAAAGU | 23 | 26670 |
| CFTR-Intron10-7791 | - | AAGAAAACCCAAUAAAAUAAAAGU | 24 | 26671 |
| CFTR-Intron10-7792 | - | AUGAGGAAGAAAGGAAGU | 18 | 26672 |
| CFTR-Intron10-7793 | - | AAUGAGGAAGAAAGGAAGU | 19 | 26673 |
| CFTR-Intron10-1369 | - | AAAUGAGGAAGAAAGGAAGU | 20 | 20253 |
| CFTR-Intron10-7794 | - | GAAAUGAGGAAGAAAGGAAGU | 21 | 26674 |
| CFTR-Intron10-7795 | - | GGAAAUGAGGAAGAAAGGAAGU | 22 | 26675 |
| CFTR-Intron10-7796 | - | AGGAAAUGAGGAAGAAAGGAAGU | 23 | 26676 |
| CFTR-Intron10-7797 | - | AAGGAAAUGAGGAAGAAAGGAAGU | 24 | 26677 |
| CFTR-Intron10-7798 | - | GGAAAGAAGGAAGGAAGU | 18 | 26678 |
| CFTR-Intron10-7799 | - | AGGAAAGAAGGAAGGAAGU | 19 | 26679 |
| CFTR-Intron10-7800 | - | AAGGAAAGAAGGAAGGAAGU | 20 | 26680 |
| CFTR-Intron10-7801 | - | GAAGGAAAGAAGGAAGGAAGU | 21 | 26681 |
| CFTR-Intron10-7802 | - | GGAAGGAAAGAAGGAAGGAAGU | 22 | 26682 |
| CFTR-Intron10-7803 | - | AGGAAGGAAAGAAGGAAGGAAGU | 23 | 26683 |
| CFTR-Intron10-7804 | - | AAGGAAGGAAAGAAGGAAGGAAGU | 24 | 26684 |
| CFTR-Intron10-7805 | - | GGUUUGGGAAUAUUAAGU | 18 | 26685 |
| CFTR-Intron10-7806 | - | UGGUUUGGGAAUAUUAAGU | 19 | 26686 |
| CFTR-Intron10-7807 | - | UUGGUUUGGGAAUAUUAAGU | 20 | 26687 |
| CFTR-Intron10-7808 | - | CUUGGUUUGGGAAUAUUAAGU | 21 | 26688 |
| CFTR-Intron10-7809 | - | GCUUGGUUUGGGAAUAUUAAGU | 22 | 26689 |
| CFTR-Intron10-7810 | - | AGCUUGGUUUGGGAAUAUUAAGU | 23 | 26690 |
| CFTR-Intron10-7811 | - | GAGCUUGGUUUGGGAAUAUUAAGU | 24 | 26691 |
| CFTR-Intron10-7812 | - | UCUGGUUUGAAGAACAGU | 18 | 26692 |
| CFTR-Intron10-7813 | - | GUCUGGUUUGAAGAACAGU | 19 | 26693 |
| CFTR-Intron10-7814 | - | UGUCUGGUUUGAAGAACAGU | 20 | 26694 |
| CFTR-Intron10-7815 | - | CUGUCUGGUUUGAAGAACAGU | 21 | 26695 |
| CFTR-Intron10-7816 | - | CCUGUCUGGUUUGAAGAACAGU | 22 | 26696 |
| CFTR-Intron10-7817 | - | ACCUGUCUGGUUUGAAGAACAGU | 23 | 26697 |
| CFTR-Intron10-7818 | - | UACCUGUCUGGUUUGAAGAACAGU | 24 | 26698 |

TABLE 41E-continued

5th Tier

| gRNA Name | DNA Strand | Targeting Domain | Target Site Length | Seq ID |
|---|---|---|---|---|
| CFTR-Intron10-7819 | - | CAGCUAUGAAGGCAGAGU | 18 | 26699 |
| CFTR-Intron10-7820 | - | GCAGCUAUGAAGGCAGAGU | 19 | 26700 |
| CFTR-Intron10-7821 | - | AGCAGCUAUGAAGGCAGAGU | 20 | 26701 |
| CFTR-Intron10-7822 | - | AAGCAGCUAUGAAGGCAGAGU | 21 | 26702 |
| CFTR-Intron10-7823 | - | AAAGCAGCUAUGAAGGCAGAGU | 22 | 26703 |
| CFTR-Intron10-7824 | - | AAAAGCAGCUAUGAAGGCAGAGU | 23 | 26704 |
| CFTR-Intron10-7825 | - | GAAAAGCAGCUAUGAAGGCAGAGU | 24 | 26705 |
| CFTR-Intron10-7826 | - | UUGCUUGAGUCCAGGAGU | 18 | 26706 |
| CFTR-Intron10-7827 | - | AUUGCUUGAGUCCAGGAGU | 19 | 26707 |
| CFTR-Intron10-7828 | - | AAUUGCUUGAGUCCAGGAGU | 20 | 26708 |
| CFTR-Intron10-7829 | - | GAAUUGCUUGAGUCCAGGAGU | 21 | 26709 |
| CFTR-Intron10-7830 | - | UGAAUUGCUUGAGUCCAGGAGU | 22 | 26710 |
| CFTR-Intron10-7831 | - | GUGAAUUGCUUGAGUCCAGGAGU | 23 | 26711 |
| CFTR-Intron10-7832 | - | GGUGAAUUGCUUGAGUCCAGGAGU | 24 | 26712 |
| CFTR-Intron10-7833 | - | GGAAGCAAGGAGAUGAGU | 18 | 26713 |
| CFTR-Intron10-7834 | - | AGGAAGCAAGGAGAUGAGU | 19 | 26714 |
| CFTR-Intron10-7835 | - | GAGGAAGCAAGGAGAUGAGU | 20 | 26715 |
| CFTR-Intron10-7836 | - | GGAGGAAGCAAGGAGAUGAGU | 21 | 26716 |
| CFTR-Intron10-7837 | - | GGGAGGAAGCAAGGAGAUGAGU | 22 | 26717 |
| CFTR-Intron10-7838 | - | AGGGAGGAAGCAAGGAGAUGAGU | 23 | 26718 |
| CFTR-Intron10-7839 | - | AAGGGAGGAAGCAAGGAGAUGAGU | 24 | 26719 |
| CFTR-Intron10-7840 | - | UAGUGGAAGUAGUAUAGU | 18 | 26720 |
| CFTR-Intron10-7841 | - | GUAGUGGAAGUAGUAUAGU | 19 | 26721 |
| CFTR-Intron10-533 | - | AGUAGUGGAAGUAGUAUAGU | 20 | 19419 |
| CFTR-Intron10-7842 | - | UAGUAGUGGAAGUAGUAUAGU | 21 | 26722 |
| CFTR-Intron10-7843 | - | GUAGUAGUGGAAGUAGUAUAGU | 22 | 26723 |
| CFTR-Intron10-7844 | - | GGUAGUAGUGGAAGUAGUAUAGU | 23 | 26724 |
| CFTR-Intron10-7845 | - | AGGUAGUAGUGGAAGUAGUAUAGU | 24 | 26725 |
| CFTR-Intron10-7846 | - | GAAGAGGGGCUGGUAGU | 18 | 26726 |
| CFTR-Intron10-7847 | - | GGAAGAGGGGCUGGUAGU | 19 | 26727 |
| CFTR-Intron10-7848 | - | AGGAAGAGGGGCUGGUAGU | 20 | 26728 |
| CFTR-Intron10-7849 | - | AAGGAAGAGGGGCUGGUAGU | 21 | 26729 |
| CFTR-Intron10-7850 | - | CAAGGAAGAGGGGCUGGUAGU | 22 | 26730 |
| CFTR-Intron10-7851 | - | UCAAGGAAGAGGGGCUGGUAGU | 23 | 26731 |
| CFTR-Intron10-7852 | - | UUCAAGGAAGAGGGGCUGGUAGU | 24 | 26732 |
| CFTR-Intron10-7853 | - | GAUGCUAAUCAUCUCCGU | 18 | 26733 |
| CFTR-Intron10-7854 | - | UGAUGCUAAUCAUCUCCGU | 19 | 26734 |

TABLE 41E-continued

5th Tier

| gRNA Name | DNA Strand | Targeting Domain | Target Site Length | Seq ID |
|---|---|---|---|---|
| CFTR-Intron10-7855 | - | GUGAUGCUAAUCAUCUCCGU | 20 | 26735 |
| CFTR-Intron10-7856 | - | CGUGAUGCUAAUCAUCUCCGU | 21 | 26736 |
| CFTR-Intron10-7857 | - | ACGUGAUGCUAAUCAUCUCCGU | 22 | 26737 |
| CFTR-Intron10-7858 | - | CACGUGAUGCUAAUCAUCUCCGU | 23 | 26738 |
| CFTR-Intron10-7859 | - | CCACGUGAUGCUAAUCAUCUCCGU | 24 | 26739 |
| CFTR-Intron10-7860 | - | GCAGCUAUGCCAGCAGGU | 18 | 26740 |
| CFTR-Intron10-7861 | - | UGCAGCUAUGCCAGCAGGU | 19 | 26741 |
| CFTR-Intron10-7862 | - | GUGCAGCUAUGCCAGCAGGU | 20 | 26742 |
| CFTR-Intron10-7863 | - | AGUGCAGCUAUGCCAGCAGGU | 21 | 26743 |
| CFTR-Intron10-7864 | - | CAGUGCAGCUAUGCCAGCAGGU | 22 | 26744 |
| CFTR-Intron10-7865 | - | UCAGUGCAGCUAUGCCAGCAGGU | 23 | 26745 |
| CFTR-Intron10-7866 | - | AUCAGUGCAGCUAUGCCAGCAGGU | 24 | 26746 |
| CFTR-Intron10-7867 | - | UCAGUGCUUUUUCGAGGU | 18 | 26747 |
| CFTR-Intron10-7868 | - | AUCAGUGCUUUUUCGAGGU | 19 | 26748 |
| CFTR-Intron10-7869 | - | AAUCAGUGCUUUUUCGAGGU | 20 | 26749 |
| CFTR-Intron10-7870 | - | AAAUCAGUGCUUUUUCGAGGU | 21 | 26750 |
| CFTR-Intron10-7871 | - | AAAAUCAGUGCUUUUUCGAGGU | 22 | 26751 |
| CFTR-Intron10-7872 | - | UAAAAUCAGUGCUUUUUCGAGGU | 23 | 26752 |
| CFTR-Intron10-7873 | - | AUAAAAUCAGUGCUUUUUCGAGGU | 24 | 26753 |
| CFTR-Intron10-7874 | - | CAAAGACUUGCAGGAGGU | 18 | 26754 |
| CFTR-Intron10-7875 | - | ACAAAGACUUGCAGGAGGU | 19 | 26755 |
| CFTR-Intron10-7876 | - | AACAAAGACUUGCAGGAGGU | 20 | 26756 |
| CFTR-Intron10-7877 | - | GAACAAAGACUUGCAGGAGGU | 21 | 26757 |
| CFTR-Intron10-7878 | - | UGAACAAAGACUUGCAGGAGGU | 22 | 26758 |
| CFTR-Intron10-7879 | - | UUGAACAAAGACUUGCAGGAGGU | 23 | 26759 |
| CFTR-Intron10-7880 | - | UUUGAACAAAGACUUGCAGGAGGU | 24 | 26760 |
| CFTR-Intron10-7881 | - | GUAAUCGGCGGUGGAGGU | 18 | 26761 |
| CFTR-Intron10-7882 | - | AGUAAUCGGCGGUGGAGGU | 19 | 26762 |
| CFTR-Intron10-536 | - | AAGUAAUCGGCGGUGGAGGU | 20 | 19422 |
| CFTR-Intron10-7883 | - | GAAGUAAUCGGCGGUGGAGGU | 21 | 26763 |
| CFTR-Intron10-7884 | - | AGAAGUAAUCGGCGGUGGAGGU | 22 | 26764 |
| CFTR-Intron10-7885 | - | GAGAAGUAAUCGGCGGUGGAGGU | 23 | 26765 |
| CFTR-Intron10-7886 | - | AGAGAAGUAAUCGGCGGUGGAGGU | 24 | 26766 |
| CFTR-Intron10-7887 | - | UACUUGGGAGGCUGAGGU | 18 | 26767 |
| CFTR-Intron10-7888 | - | CUACUUGGGAGGCUGAGGU | 19 | 26768 |
| CFTR-Intron10-713 | - | GCUACUUGGGAGGCUGAGGU | 20 | 19599 |
| CFTR-Intron10-7889 | - | AGCUACUUGGGAGGCUGAGGU | 21 | 26769 |

TABLE 41E-continued

5th Tier

| gRNA Name | DNA Strand | Targeting Domain | Target Site Length | Seq ID |
|---|---|---|---|---|
| CFTR-Intron10-7890 | - | CAGCUACUUGGGAGGCUGAGGU | 22 | 26770 |
| CFTR-Intron10-7891 | - | CCAGCUACUUGGGAGGCUGAGGU | 23 | 26771 |
| CFTR-Intron10-7892 | - | CCCAGCUACUUGGGAGGCUGAGGU | 24 | 26772 |
| CFTR-Intron10-7893 | - | AGGAGCCAAAAAUUGGGU | 18 | 26773 |
| CFTR-Intron10-7894 | - | CAGGAGCCAAAAAUUGGGU | 19 | 26774 |
| CFTR-Intron10-537 | - | UCAGGAGCCAAAAAUUGGGU | 20 | 19423 |
| CFTR-Intron10-7895 | - | UUCAGGAGCCAAAAAUUGGGU | 21 | 26775 |
| CFTR-Intron10-7896 | - | UUUCAGGAGCCAAAAAUUGGGU | 22 | 26776 |
| CFTR-Intron10-7897 | - | CUUUCAGGAGCCAAAAAUUGGGU | 23 | 26777 |
| CFTR-Intron10-7898 | - | GCUUUCAGGAGCCAAAAAUUGGGU | 24 | 26778 |
| CFTR-Intron10-7899 | - | UGACUAUACCUGUCUGGU | 18 | 26779 |
| CFTR-Intron10-7900 | - | CUGACUAUACCUGUCUGGU | 19 | 26780 |
| CFTR-Intron10-7901 | - | ACUGACUAUACCUGUCUGGU | 20 | 26781 |
| CFTR-Intron10-7902 | - | GACUGACUAUACCUGUCUGGU | 21 | 26782 |
| CFTR-Intron10-7903 | - | GGACUGACUAUACCUGUCUGGU | 22 | 26783 |
| CFTR-Intron10-7904 | - | GGGACUGACUAUACCUGUCUGGU | 23 | 26784 |
| CFTR-Intron10-7905 | - | UGGGACUGACUAUACCUGUCUGGU | 24 | 26785 |
| CFTR-Intron10-7906 | - | UUUUGGAUGGAGCUUGGU | 18 | 26786 |
| CFTR-Intron10-7907 | - | GUUUUGGAUGGAGCUUGGU | 19 | 26787 |
| CFTR-Intron10-7908 | - | GGUUUUGGAUGGAGCUUGGU | 20 | 26788 |
| CFTR-Intron10-7909 | - | AGGUUUUGGAUGGAGCUUGGU | 21 | 26789 |
| CFTR-Intron10-7910 | - | CAGGUUUUGGAUGGAGCUUGGU | 22 | 26790 |
| CFTR-Intron10-7911 | - | ACAGGUUUUGGAUGGAGCUUGGU | 23 | 26791 |
| CFTR-Intron10-7912 | - | AACAGGUUUUGGAUGGAGCUUGGU | 24 | 26792 |
| CFTR-Intron10-7913 | - | GGUACUUUGUAGAAAUGU | 18 | 26793 |
| CFTR-Intron10-7914 | - | UGGUACUUUGUAGAAAUGU | 19 | 26794 |
| CFTR-Intron10-7915 | - | GUGGUACUUUGUAGAAAUGU | 20 | 26795 |
| CFTR-Intron10-7916 | - | UGUGGUACUUUGUAGAAAUGU | 21 | 26796 |
| CFTR-Intron10-7917 | - | CUGUGGUACUUUGUAGAAAUGU | 22 | 26797 |
| CFTR-Intron10-7918 | - | GCUGUGGUACUUUGUAGAAAUGU | 23 | 26798 |
| CFTR-Intron10-7919 | - | AGCUGUGGUACUUUGUAGAAAUGU | 24 | 26799 |
| CFTR-Intron10-7920 | - | CACCCCUUUCUGCCAUGU | 18 | 26800 |
| CFTR-Intron10-7921 | - | UCACCCCUUUCUGCCAUGU | 19 | 26801 |
| CFTR-Intron10-7922 | - | CUCACCCCUUUCUGCCAUGU | 20 | 26802 |
| CFTR-Intron10-7923 | - | CCUCACCCCUUUCUGCCAUGU | 21 | 26803 |
| CFTR-Intron10-7924 | - | CCCUCACCCCUUUCUGCCAUGU | 22 | 26804 |
| CFTR-Intron10-7925 | - | ACCCUCACCCCUUUCUGCCAUGU | 23 | 26805 |

TABLE 41E-continued

5th Tier

| gRNA Name | DNA Strand | Targeting Domain | Target Site Length | Seq ID |
|---|---|---|---|---|
| CFTR-Intron10-7926 | - | GACCCUCACCCCUUUCUGCCAUGU | 24 | 26806 |
| CFTR-Intron10-7927 | - | CCCAGCCUCCAGAACUGU | 18 | 26807 |
| CFTR-Intron10-7928 | - | UCCCAGCCUCCAGAACUGU | 19 | 26808 |
| CFTR-Intron10-7929 | - | UUCCCAGCCUCCAGAACUGU | 20 | 26809 |
| CFTR-Intron10-7930 | - | CUUCCCAGCCUCCAGAACUGU | 21 | 26810 |
| CFTR-Intron10-7931 | - | ACUUCCCAGCCUCCAGAACUGU | 22 | 26811 |
| CFTR-Intron10-7932 | - | GACUUCCCAGCCUCCAGAACUGU | 23 | 26812 |
| CFTR-Intron10-7933 | - | GGACUUCCCAGCCUCCAGAACUGU | 24 | 26813 |
| CFTR-Intron10-7934 | - | GGGAGGGUAGAAUACUGU | 18 | 26814 |
| CFTR-Intron10-7935 | - | AGGGAGGGUAGAAUACUGU | 19 | 26815 |
| CFTR-Intron10-7936 | - | CAGGGAGGGUAGAAUACUGU | 20 | 26816 |
| CFTR-Intron10-7937 | - | ACAGGGAGGGUAGAAUACUGU | 21 | 26817 |
| CFTR-Intron10-7938 | - | GACAGGGAGGGUAGAAUACUGU | 22 | 26818 |
| CFTR-Intron10-7939 | - | AGACAGGGAGGGUAGAAUACUGU | 23 | 26819 |
| CFTR-Intron10-7940 | - | AAGACAGGGAGGGUAGAAUACUGU | 24 | 26820 |
| CFTR-Intron10-7941 | - | GUUUUUAGGCUAUUCUGU | 18 | 26821 |
| CFTR-Intron10-7942 | - | UGUUUUUAGGCUAUUCUGU | 19 | 26822 |
| CFTR-Intron10-541 | - | AUGUUUUUAGGCUAUUCUGU | 20 | 19427 |
| CFTR-Intron10-7943 | - | AAUGUUUUUAGGCUAUUCUGU | 21 | 26823 |
| CFTR-Intron10-7944 | - | UAAUGUUUUUAGGCUAUUCUGU | 22 | 26824 |
| CFTR-Intron10-7945 | - | CUAAUGUUUUUAGGCUAUUCUGU | 23 | 26825 |
| CFTR-Intron10-7946 | - | GCUAAUGUUUUUAGGCUAUUCUGU | 24 | 26826 |
| CFTR-Intron10-7947 | - | AUGGCAUCUCACCAGUGU | 18 | 26827 |
| CFTR-Intron10-7948 | - | UAUGGCAUCUCACCAGUGU | 19 | 26828 |
| CFTR-Intron10-7949 | - | UUAUGGCAUCUCACCAGUGU | 20 | 26829 |
| CFTR-Intron10-7950 | - | CUUAUGGCAUCUCACCAGUGU | 21 | 26830 |
| CFTR-Intron10-7951 | - | GCUUAUGGCAUCUCACCAGUGU | 22 | 26831 |
| CFTR-Intron10-7952 | - | GGCUUAUGGCAUCUCACCAGUGU | 23 | 26832 |
| CFTR-Intron10-7953 | - | UGGCUUAUGGCAUCUCACCAGUGU | 24 | 26833 |
| CFTR-Intron10-7954 | - | GGCAUCUCACCAGUGUGU | 18 | 26834 |
| CFTR-Intron10-7955 | - | UGGCAUCUCACCAGUGUGU | 19 | 26835 |
| CFTR-Intron10-542 | - | AUGGCAUCUCACCAGUGUGU | 20 | 19428 |
| CFTR-Intron10-7956 | - | UAUGGCAUCUCACCAGUGUGU | 21 | 26836 |
| CFTR-Intron10-7957 | - | UUAUGGCAUCUCACCAGUGUGU | 22 | 26837 |
| CFTR-Intron10-7958 | - | CUUAUGGCAUCUCACCAGUGUGU | 23 | 26838 |
| CFTR-Intron10-7959 | - | GCUUAUGGCAUCUCACCAGUGUGU | 24 | 26839 |
| CFTR-Intron10-7960 | - | GUAUGUAUAUAUGUGUGU | 18 | 26840 |

TABLE 41E-continued

5th Tier

| gRNA Name | DNA Strand | Targeting Domain | Target Site Length | Seq ID |
|---|---|---|---|---|
| CFTR-Intron10-7961 | - | UGUAUGUAUAUAUGUGUGU | 19 | 26841 |
| CFTR-Intron10-7962 | - | AUGUAUGUAUAUAUGUGUGU | 20 | 26842 |
| CFTR-Intron10-7963 | - | UAUGUAUGUAUAUAUGUGUGU | 21 | 26843 |
| CFTR-Intron10-7964 | - | AUAUGUAUGUAUAUAUGUGUGU | 22 | 26844 |
| CFTR-Intron10-7965 | - | CAUAUGUAUGUAUAUAUGUGUGU | 23 | 26845 |
| CFTR-Intron10-7966 | - | UCAUAUGUAUGUAUAUAUGUGUGU | 24 | 26846 |
| CFTR-Intron10-7967 | - | UCUAACUUUUCUUAUUGU | 18 | 26847 |
| CFTR-Intron10-7968 | - | UUCUAACUUUUCUUAUUGU | 19 | 26848 |
| CFTR-Intron10-7969 | - | CUUCUAACUUUUCUUAUUGU | 20 | 26849 |
| CFTR-Intron10-7970 | - | ACUUCUAACUUUUCUUAUUGU | 21 | 26850 |
| CFTR-Intron10-7971 | - | UACUUCUAACUUUUCUUAUUGU | 22 | 26851 |
| CFTR-Intron10-7972 | - | UUACUUCUAACUUUUCUUAUUGU | 23 | 26852 |
| CFTR-Intron10-7973 | - | UUUACUUCUAACUUUUCUUAUUGU | 24 | 26853 |
| CFTR-Intron10-7974 | - | GGACCAAAACUUUAUUGU | 18 | 26854 |
| CFTR-Intron10-7975 | - | AGGACCAAAACUUUAUUGU | 19 | 26855 |
| CFTR-Intron10-7976 | - | AAGGACCAAAACUUUAUUGU | 20 | 26856 |
| CFTR-Intron10-7977 | - | AAAGGACCAAAACUUUAUUGU | 21 | 26857 |
| CFTR-Intron10-7978 | - | AAAAGGACCAAAACUUUAUUGU | 22 | 26858 |
| CFTR-Intron10-7979 | - | CAAAAGGACCAAAACUUUAUUGU | 23 | 26859 |
| CFTR-Intron10-7980 | - | GCAAAAGGACCAAAACUUUAUUGU | 24 | 26860 |
| CFTR-Intron10-7981 | - | UACCCAAUAAAAAAAAUU | 18 | 26861 |
| CFTR-Intron10-7982 | - | UUACCCAAUAAAAAAAAUU | 19 | 26862 |
| CFTR-Intron10-124 | - | GUUACCCAAUAAAAAAAAUU | 20 | 19010 |
| CFTR-Intron10-7983 | - | UGUUACCCAAUAAAAAAAAUU | 21 | 26863 |
| CFTR-Intron10-7984 | - | UUGUUACCCAAUAAAAAAAAUU | 22 | 26864 |
| CFTR-Intron10-7985 | - | AUUGUUACCCAAUAAAAAAAAUU | 23 | 26865 |
| CFTR-Intron10-7986 | - | UAUUGUUACCCAAUAAAAAAAAUU | 24 | 26866 |
| CFTR-Intron10-7987 | - | AGAAAUACCGAGAAAAUU | 18 | 26867 |
| CFTR-Intron10-7988 | - | UAGAAAUACCGAGAAAAUU | 19 | 26868 |
| CFTR-Intron10-7989 | - | CUAGAAAUACCGAGAAAAUU | 20 | 26869 |
| CFTR-Intron10-7990 | - | CCUAGAAAUACCGAGAAAAUU | 21 | 26870 |
| CFTR-Intron10-7991 | - | GCCUAGAAAUACCGAGAAAAUU | 22 | 26871 |
| CFTR-Intron10-7992 | - | AGCCUAGAAAUACCGAGAAAAUU | 23 | 26872 |
| CFTR-Intron10-7993 | - | UAGCCUAGAAAUACCGAGAAAAUU | 24 | 26873 |
| CFTR-Intron10-7994 | - | UUAAUGAAAAUAGAAAUU | 18 | 26874 |
| CFTR-Intron10-7995 | - | GUUAAUGAAAAUAGAAAUU | 19 | 26875 |
| CFTR-Intron10-7996 | - | UGUUAAUGAAAAUAGAAAUU | 20 | 26876 |

TABLE 41E-continued

5th Tier

| gRNA Name | DNA Strand | Targeting Domain | Target Site Length | Seq ID |
|---|---|---|---|---|
| CFTR-Intron10-7997 | - | AUGUUAAUGAAAAUAGAAAUU | 21 | 26877 |
| CFTR-Intron10-7998 | - | AAUGUUAAUGAAAAUAGAAAUU | 22 | 26878 |
| CFTR-Intron10-7999 | - | AAAUGUUAAUGAAAAUAGAAAUU | 23 | 26879 |
| CFTR-Intron10-8000 | - | AAAAUGUUAAUGAAAAUAGAAAUU | 24 | 26880 |
| CFTR-Intron10-8001 | - | CUACAGUUGCCUGCAAUU | 18 | 26881 |
| CFTR-Intron10-8002 | - | GCUACAGUUGCCUGCAAUU | 19 | 26882 |
| CFTR-Intron10-8003 | - | AGCUACAGUUGCCUGCAAUU | 20 | 26883 |
| CFTR-Intron10-8004 | - | CAGCUACAGUUGCCUGCAAUU | 21 | 26884 |
| CFTR-Intron10-8005 | - | GCAGCUACAGUUGCCUGCAAUU | 22 | 26885 |
| CFTR-Intron10-8006 | - | UGCAGCUACAGUUGCCUGCAAUU | 23 | 26886 |
| CFTR-Intron10-8007 | - | CUGCAGCUACAGUUGCCUGCAAUU | 24 | 26887 |
| CFTR-Intron10-8008 | - | UAUCAAUAUUUUGGAAUU | 18 | 26888 |
| CFTR-Intron10-8009 | - | UUAUCAAUAUUUUGGAAUU | 19 | 26889 |
| CFTR-Intron10-8010 | - | UUUAUCAAUAUUUUGGAAUU | 20 | 26890 |
| CFTR-Intron10-8011 | - | UUUUAUCAAUAUUUUGGAAUU | 21 | 26891 |
| CFTR-Intron10-8012 | - | GUUUUAUCAAUAUUUUGGAAUU | 22 | 26892 |
| CFTR-Intron10-8013 | - | AGUUUUAUCAAUAUUUUGGAAUU | 23 | 26893 |
| CFTR-Intron10-8014 | - | UAGUUUUAUCAAUAUUUUGGAAUU | 24 | 26894 |
| CFTR-Intron10-8015 | - | GGUACUACUGUAAUAAUU | 18 | 26895 |
| CFTR-Intron10-8016 | - | UGGUACUACUGUAAUAAUU | 19 | 26896 |
| CFTR-Intron10-1381 | - | AUGGUACUACUGUAAUAAUU | 20 | 20265 |
| CFTR-Intron10-8017 | - | UAUGGUACUACUGUAAUAAUU | 21 | 26897 |
| CFTR-Intron10-8018 | - | AUAUGGUACUACUGUAAUAAUU | 22 | 26898 |
| CFTR-Intron10-8019 | - | CAUAUGGUACUACUGUAAUAAUU | 23 | 26899 |
| CFTR-Intron10-8020 | - | ACAUAUGGUACUACUGUAAUAAUU | 24 | 26900 |
| CFTR-Intron10-8021 | - | AAAUAUCACCAACUCAUU | 18 | 26901 |
| CFTR-Intron10-8022 | - | AAAAUAUCACCAACUCAUU | 19 | 26902 |
| CFTR-Intron10-544 | - | AAAAAUAUCACCAACUCAUU | 20 | 19430 |
| CFTR-Intron10-8023 | - | GAAAAAUAUCACCAACUCAUU | 21 | 26903 |
| CFTR-Intron10-8024 | - | UGAAAAAUAUCACCAACUCAUU | 22 | 26904 |
| CFTR-Intron10-8025 | - | AUGAAAAAUAUCACCAACUCAUU | 23 | 26905 |
| CFTR-Intron10-8026 | - | AAUGAAAAAUAUCACCAACUCAUU | 24 | 26906 |
| CFTR-Intron10-8027 | - | GUAGGAAGUGAUCAGAUU | 18 | 26907 |
| CFTR-Intron10-8028 | - | AGUAGGAAGUGAUCAGAUU | 19 | 26908 |
| CFTR-Intron10-8029 | - | UAGUAGGAAGUGAUCAGAUU | 20 | 26909 |
| CFTR-Intron10-8030 | - | AUAGUAGGAAGUGAUCAGAUU | 21 | 26910 |
| CFTR-Intron10-8031 | - | UAUAGUAGGAAGUGAUCAGAUU | 22 | 26911 |

TABLE 41E-continued

5th Tier

| gRNA Name | DNA Strand | Targeting Domain | Target Site Length | Seq ID |
|---|---|---|---|---|
| CFTR-Intron10-8032 | − | GUAUAGUAGGAAGUGAUCAGAUU | 23 | 26912 |
| CFTR-Intron10-8033 | − | AGUAUAGUAGGAAGUGAUCAGAUU | 24 | 26913 |
| CFTR-Intron10-8034 | − | AGCUGGCUAUCCAGGAUU | 18 | 26914 |
| CFTR-Intron10-8035 | − | CAGCUGGCUAUCCAGGAUU | 19 | 26915 |
| CFTR-Intron10-8036 | − | ACAGCUGGCUAUCCAGGAUU | 20 | 26916 |
| CFTR-Intron10-8037 | − | GACAGCUGGCUAUCCAGGAUU | 21 | 26917 |
| CFTR-Intron10-8038 | − | AGACAGCUGGCUAUCCAGGAUU | 22 | 26918 |
| CFTR-Intron10-8039 | − | AAGACAGCUGGCUAUCCAGGAUU | 23 | 26919 |
| CFTR-Intron10-8040 | − | GAAGACAGCUGGCUAUCCAGGAUU | 24 | 26920 |
| CFTR-Intron10-8041 | − | UGCAGGAGGUGAGGGAUU | 18 | 26921 |
| CFTR-Intron10-8042 | − | UUGCAGGAGGUGAGGGAUU | 19 | 26922 |
| CFTR-Intron10-1384 | − | CUUGCAGGAGGUGAGGGAUU | 20 | 20268 |
| CFTR-Intron10-8043 | − | ACUUGCAGGAGGUGAGGGAUU | 21 | 26923 |
| CFTR-Intron10-8044 | − | GACUUGCAGGAGGUGAGGGAUU | 22 | 26924 |
| CFTR-Intron10-8045 | − | AGACUUGCAGGAGGUGAGGGAUU | 23 | 26925 |
| CFTR-Intron10-8046 | − | AAGACUUGCAGGAGGUGAGGGAUU | 24 | 26926 |
| CFTR-Intron10-8047 | − | AAUAGUUUUAUCAAUAUU | 18 | 26927 |
| CFTR-Intron10-8048 | − | AAAUAGUUUUAUCAAUAUU | 19 | 26928 |
| CFTR-Intron10-8049 | − | CAAAUAGUUUUAUCAAUAUU | 20 | 26929 |
| CFTR-Intron10-8050 | − | GCAAAUAGUUUUAUCAAUAUU | 21 | 26930 |
| CFTR-Intron10-8051 | − | UGCAAAUAGUUUUAUCAAUAUU | 22 | 26931 |
| CFTR-Intron10-8052 | − | CUGCAAAUAGUUUUAUCAAUAUU | 23 | 26932 |
| CFTR-Intron10-8053 | − | UCUGCAAAUAGUUUUAUCAAUAUU | 24 | 26933 |
| CFTR-Intron10-8054 | − | GAUGAGGAGAACCAUAUU | 18 | 26934 |
| CFTR-Intron10-8055 | − | AGAUGAGGAGAACCAUAUU | 19 | 26935 |
| CFTR-Intron10-8056 | − | AAGAUGAGGAGAACCAUAUU | 20 | 26936 |
| CFTR-Intron10-8057 | − | UAAGAUGAGGAGAACCAUAUU | 21 | 26937 |
| CFTR-Intron10-8058 | − | CUAAGAUGAGGAGAACCAUAUU | 22 | 26938 |
| CFTR-Intron10-8059 | − | UCUAAGAUGAGGAGAACCAUAUU | 23 | 26939 |
| CFTR-Intron10-8060 | − | AUCUAAGAUGAGGAGAACCAUAUU | 24 | 26940 |
| CFTR-Intron10-8061 | − | AACUUAACCUGGCAUAUU | 18 | 26941 |
| CFTR-Intron10-8062 | − | CAACUUAACCUGGCAUAUU | 19 | 26942 |
| CFTR-Intron10-546 | − | ACAACUUAACCUGGCAUAUU | 20 | 19432 |
| CFTR-Intron10-8063 | − | AACAACUUAACCUGGCAUAUU | 21 | 26943 |
| CFTR-Intron10-8064 | − | GAACAACUUAACCUGGCAUAUU | 22 | 26944 |
| CFTR-Intron10-8065 | − | AGAACAACUUAACCUGGCAUAUU | 23 | 26945 |
| CFTR-Intron10-8066 | − | AAGAACAACUUAACCUGGCAUAUU | 24 | 26946 |

TABLE 41E-continued

5th Tier

| gRNA Name | DNA Strand | Targeting Domain | Target Site Length | Seq ID |
|---|---|---|---|---|
| CFTR-Intron10-8067 | - | UGCUCUCUUUUAACUAUU | 18 | 26947 |
| CFTR-Intron10-8068 | - | UUGCUCUCUUUUAACUAUU | 19 | 26948 |
| CFTR-Intron10-8069 | - | CUUGCUCUCUUUUAACUAUU | 20 | 26949 |
| CFTR-Intron10-8070 | - | ACUUGCUCUCUUUUAACUAUU | 21 | 26950 |
| CFTR-Intron10-8071 | - | AACUUGCUCUCUUUUAACUAUU | 22 | 26951 |
| CFTR-Intron10-8072 | - | AAACUUGCUCUCUUUUAACUAUU | 23 | 26952 |
| CFTR-Intron10-8073 | - | AAAACUUGCUCUCUUUUAACUAUU | 24 | 26953 |
| CFTR-Intron10-8074 | - | GUUUUUCUUUCCUUUAUU | 18 | 26954 |
| CFTR-Intron10-8075 | - | UGUUUUUCUUUCCUUUAUU | 19 | 26955 |
| CFTR-Intron10-8076 | - | AUGUUUUUCUUUCCUUUAUU | 20 | 26956 |
| CFTR-Intron10-8077 | - | UAUGUUUUUCUUUCCUUUAUU | 21 | 26957 |
| CFTR-Intron10-8078 | - | UUAUGUUUUUCUUUCCUUUAUU | 22 | 26958 |
| CFTR-Intron10-8079 | - | UUUAUGUUUUUCUUUCCUUUAUU | 23 | 26959 |
| CFTR-Intron10-8080 | - | UUUUAUGUUUUUCUUUCCUUUAUU | 24 | 26960 |
| CFTR-Intron10-8081 | - | GGGAAUAUUUAAACACUU | 18 | 26961 |
| CFTR-Intron10-8082 | - | UGGGAAUAUUUAAACACUU | 19 | 26962 |
| CFTR-Intron10-8083 | - | UUGGGAAUAUUUAAACACUU | 20 | 26963 |
| CFTR-Intron10-8084 | - | CUUGGGAAUAUUUAAACACUU | 21 | 26964 |
| CFTR-Intron10-8085 | - | CCUUGGGAAUAUUUAAACACUU | 22 | 26965 |
| CFTR-Intron10-8086 | - | CCCUUGGGAAUAUUUAAACACUU | 23 | 26966 |
| CFTR-Intron10-8087 | - | UCCCUUGGGAAUAUUUAAACACUU | 24 | 26967 |
| CFTR-Intron10-8088 | - | CUUGUAAUCCUAGCACUU | 18 | 26968 |
| CFTR-Intron10-8089 | - | ACUUGUAAUCCUAGCACUU | 19 | 26969 |
| CFTR-Intron10-8090 | - | CACUUGUAAUCCUAGCACUU | 20 | 26970 |
| CFTR-Intron10-8091 | - | ACACUUGUAAUCCUAGCACUU | 21 | 26971 |
| CFTR-Intron10-8092 | - | CACACUUGUAAUCCUAGCACUU | 22 | 26972 |
| CFTR-Intron10-8093 | - | UCACACUUGUAAUCCUAGCACUU | 23 | 26973 |
| CFTR-Intron10-8094 | - | CUCACACUUGUAAUCCUAGCACUU | 24 | 26974 |
| CFTR-Intron10-8095 | - | GAAUUGAAUAUGAGACUU | 18 | 26975 |
| CFTR-Intron10-8096 | - | AGAAUUGAAUAUGAGACUU | 19 | 26976 |
| CFTR-Intron10-1394 | - | AAGAAUUGAAUAUGAGACUU | 20 | 20278 |
| CFTR-Intron10-8097 | - | GAAGAAUUGAAUAUGAGACUU | 21 | 26977 |
| CFTR-Intron10-8098 | - | UGAAGAAUUGAAUAUGAGACUU | 22 | 26978 |
| CFTR-Intron10-8099 | - | UUGAAGAAUUGAAUAUGAGACUU | 23 | 26979 |
| CFTR-Intron10-8100 | - | UUUGAAGAAUUGAAUAUGAGACUU | 24 | 26980 |
| CFTR-Intron10-8101 | - | UGUGCCUGUAGUCCCAGCUACUU | 23 | 26981 |
| CFTR-Intron10-8102 | - | GUGUGCCUGUAGUCCCAGCUACUU | 24 | 26982 |

TABLE 41E-continued

5th Tier

| gRNA Name | DNA Strand | Targeting Domain | Target Site Length | Seq ID |
|---|---|---|---|---|
| CFTR-Intron10-8103 | - | AUUGCAGGGUGGGGCCUU | 18 | 26983 |
| CFTR-Intron10-8104 | - | UAUUGCAGGGUGGGGCCUU | 19 | 26984 |
| CFTR-Intron10-721 | - | GUAUUGCAGGGUGGGGCCUU | 20 | 19607 |
| CFTR-Intron10-8105 | - | GGUAUUGCAGGGUGGGGCCUU | 21 | 26985 |
| CFTR-Intron10-8106 | - | UGGUAUUGCAGGGUGGGGCCUU | 22 | 26986 |
| CFTR-Intron10-8107 | - | AUGGUAUUGCAGGGUGGGGCCUU | 23 | 26987 |
| CFTR-Intron10-8108 | - | GAUGGUAUUGCAGGGUGGGGCCUU | 24 | 26988 |
| CFTR-Intron10-8109 | - | ACAGUGCAGUUAUAGCUU | 18 | 26989 |
| CFTR-Intron10-8110 | - | GACAGUGCAGUUAUAGCUU | 19 | 26990 |
| CFTR-Intron10-8111 | - | UGACAGUGCAGUUAUAGCUU | 20 | 26991 |
| CFTR-Intron10-8112 | - | CUGACAGUGCAGUUAUAGCUU | 21 | 26992 |
| CFTR-Intron10-8113 | - | GCUGACAGUGCAGUUAUAGCUU | 22 | 26993 |
| CFTR-Intron10-8114 | - | GGCUGACAGUGCAGUUAUAGCUU | 23 | 26994 |
| CFTR-Intron10-8115 | - | UGGCUGACAGUGCAGUUAUAGCUU | 24 | 26995 |
| CFTR-Intron10-8116 | - | AUUAAAUGUCUUGCGCUU | 18 | 26996 |
| CFTR-Intron10-8117 | - | CAUUAAAUGUCUUGCGCUU | 19 | 26997 |
| CFTR-Intron10-8118 | - | ACAUUAAAUGUCUUGCGCUU | 20 | 26998 |
| CFTR-Intron10-8119 | - | UACAUUAAAUGUCUUGCGCUU | 21 | 26999 |
| CFTR-Intron10-8120 | - | CUACAUUAAAUGUCUUGCGCUU | 22 | 27000 |
| CFTR-Intron10-8121 | - | UCUACAUUAAAUGUCUUGCGCUU | 23 | 27001 |
| CFTR-Intron10-8122 | - | GUCUACAUUAAAUGUCUUGCGCUU | 24 | 27002 |
| CFTR-Intron10-8123 | - | GGCAAUAGGUAUUUGCUU | 18 | 27003 |
| CFTR-Intron10-8124 | - | GGGCAAUAGGUAUUUGCUU | 19 | 27004 |
| CFTR-Intron10-8125 | - | AGGGCAAUAGGUAUUUGCUU | 20 | 27005 |
| CFTR-Intron10-8126 | - | AAGGGCAAUAGGUAUUUGCUU | 21 | 27006 |
| CFTR-Intron10-8127 | - | AAAGGGCAAUAGGUAUUUGCUU | 22 | 27007 |
| CFTR-Intron10-8128 | - | UAAAGGGCAAUAGGUAUUUGCUU | 23 | 27008 |
| CFTR-Intron10-8129 | - | CUAAAGGGCAAUAGGUAUUUGCUU | 24 | 27009 |
| CFTR-Intron10-8130 | - | AAUUUAACUGAAUAUCUU | 18 | 27010 |
| CFTR-Intron10-8131 | - | AAAUUUAACUGAAUAUCUU | 19 | 27011 |
| CFTR-Intron10-8132 | - | GAAAUUUAACUGAAUAUCUU | 20 | 27012 |
| CFTR-Intron10-8133 | - | AGAAAUUUAACUGAAUAUCUU | 21 | 27013 |
| CFTR-Intron10-8134 | - | UAGAAAUUUAACUGAAUAUCUU | 22 | 27014 |
| CFTR-Intron10-8135 | - | AUAGAAAUUUAACUGAAUAUCUU | 23 | 27015 |
| CFTR-Intron10-8136 | - | UAUAGAAAUUUAACUGAAUAUCUU | 24 | 27016 |
| CFTR-Intron10-8137 | - | AUAAUUAACCGGUGUCUU | 18 | 27017 |
| CFTR-Intron10-8138 | - | UAUAAUUAACCGGUGUCUU | 19 | 27018 |

TABLE 41E-continued

5th Tier

| gRNA Name | DNA Strand | Targeting Domain | Target Site Length | Seq ID |
|---|---|---|---|---|
| CFTR-Intron10-8139 | − | UUAUAAUUAACCGGUGUCUU | 20 | 27019 |
| CFTR-Intron10-8140 | − | GUUAUAAUUAACCGGUGUCUU | 21 | 27020 |
| CFTR-Intron10-8141 | − | UGUUAUAAUUAACCGGUGUCUU | 22 | 27021 |
| CFTR-Intron10-8142 | − | CUGUUAUAAUUAACCGGUGUCUU | 23 | 27022 |
| CFTR-Intron10-8143 | − | ACUGUUAUAAUUAACCGGUGUCUU | 24 | 27023 |
| CFTR-Intron10-8144 | − | UUCUAAGUAUUAGAGGUU | 18 | 27024 |
| CFTR-Intron10-8145 | − | AUUCUAAGUAUUAGAGGUU | 19 | 27025 |
| CFTR-Intron10-8146 | − | CAUUCUAAGUAUUAGAGGUU | 20 | 27026 |
| CFTR-Intron10-8147 | − | GCAUUCUAAGUAUUAGAGGUU | 21 | 27027 |
| CFTR-Intron10-8148 | − | GGCAUUCUAAGUAUUAGAGGUU | 22 | 27028 |
| CFTR-Intron10-8149 | − | GGGCAUUCUAAGUAUUAGAGGUU | 23 | 27029 |
| CFTR-Intron10-8150 | − | AGGGCAUUCUAAGUAUUAGAGGUU | 24 | 27030 |
| CFTR-Intron10-8151 | − | CAGUGCUUUUUCGAGGUU | 18 | 27031 |
| CFTR-Intron10-8152 | − | UCAGUGCUUUUUCGAGGUU | 19 | 27032 |
| CFTR-Intron10-556 | − | AUCAGUGCUUUUUCGAGGUU | 20 | 19442 |
| CFTR-Intron10-8153 | − | AAUCAGUGCUUUUUCGAGGUU | 21 | 27033 |
| CFTR-Intron10-8154 | − | AAAUCAGUGCUUUUUCGAGGUU | 22 | 27034 |
| CFTR-Intron10-8155 | − | AAAAUCAGUGCUUUUUCGAGGUU | 23 | 27035 |
| CFTR-Intron10-8156 | − | UAAAAUCAGUGCUUUUUCGAGGUU | 24 | 27036 |
| CFTR-Intron10-8157 | − | UUUGGAUGGAGCUUGGUU | 18 | 27037 |
| CFTR-Intron10-8158 | − | UUUUGGAUGGAGCUUGGUU | 19 | 27038 |
| CFTR-Intron10-128 | − | GUUUUGGAUGGAGCUUGGUU | 20 | 19014 |
| CFTR-Intron10-8159 | − | GGUUUUGGAUGGAGCUUGGUU | 21 | 27039 |
| CFTR-Intron10-8160 | − | AGGUUUUGGAUGGAGCUUGGUU | 22 | 27040 |
| CFTR-Intron10-8161 | − | CAGGUUUUGGAUGGAGCUUGGUU | 23 | 27041 |
| CFTR-Intron10-8162 | − | ACAGGUUUUGGAUGGAGCUUGGUU | 24 | 27042 |
| CFTR-Intron10-8163 | − | UAAUACAUUGGAAAAUUU | 18 | 27043 |
| CFTR-Intron10-8164 | − | UUAAUACAUUGGAAAAUUU | 19 | 27044 |
| CFTR-Intron10-8165 | − | GUUAAUACAUUGGAAAAUUU | 20 | 27045 |
| CFTR-Intron10-8166 | − | AGUUAAUACAUUGGAAAAUUU | 21 | 27046 |
| CFTR-Intron10-8167 | − | CAGUUAAUACAUUGGAAAAUUU | 22 | 27047 |
| CFTR-Intron10-8168 | − | UCAGUUAAUACAUUGGAAAAUUU | 23 | 27048 |
| CFTR-Intron10-8169 | − | UUCAGUUAAUACAUUGGAAAAUUU | 24 | 27049 |
| CFTR-Intron10-8170 | − | AUCAAUAUUUUGGAAUUU | 18 | 27050 |
| CFTR-Intron10-8171 | − | UAUCAAUAUUUUGGAAUUU | 19 | 27051 |
| CFTR-Intron10-1402 | − | UUAUCAAUAUUUUGGAAUUU | 20 | 20286 |
| CFTR-Intron10-8172 | − | UUUAUCAAUAUUUUGGAAUUU | 21 | 27052 |

TABLE 41E-continued

5th Tier

| gRNA Name | DNA Strand | Targeting Domain | Target Site Length | Seq ID |
|---|---|---|---|---|
| CFTR-Intron10-8173 | - | UUUUAUCAAUAUUUUGGAAUUU | 22 | 27053 |
| CFTR-Intron10-8174 | - | GUUUUAUCAAUAUUUUGGAAUUU | 23 | 27054 |
| CFTR-Intron10-8175 | - | AGUUUUAUCAAUAUUUUGGAAUUU | 24 | 27055 |
| CFTR-Intron10-8176 | - | UUAAUAUUACUAUUAUUU | 18 | 27056 |
| CFTR-Intron10-8177 | - | AUUAAUAUUACUAUUAUUU | 19 | 27057 |
| CFTR-Intron10-8178 | - | UAUUAAUAUUACUAUUAUUU | 20 | 27058 |
| CFTR-Intron10-8179 | - | UUAUUAAUAUUACUAUUAUUU | 21 | 27059 |
| CFTR-Intron10-8180 | - | GUUAUUAAUAUUACUAUUAUUU | 22 | 27060 |
| CFTR-Intron10-8181 | - | UGUUAUUAAUAUUACUAUUAUUU | 23 | 27061 |
| CFTR-Intron10-8182 | - | UUGUUAUUAAUAUUACUAUUAUUU | 24 | 27062 |
| CFTR-Intron10-8183 | - | AAACAAGGAUGUUUAUUU | 18 | 27063 |
| CFTR-Intron10-8184 | - | UAAACAAGGAUGUUUAUUU | 19 | 27064 |
| CFTR-Intron10-8185 | - | CUAAACAAGGAUGUUUAUUU | 20 | 27065 |
| CFTR-Intron10-8186 | - | UCUAAACAAGGAUGUUUAUUU | 21 | 27066 |
| CFTR-Intron10-8187 | - | GUCUAAACAAGGAUGUUUAUUU | 22 | 27067 |
| CFTR-Intron10-8188 | - | GGUCUAAACAAGGAUGUUUAUUU | 23 | 27068 |
| CFTR-Intron10-8189 | - | UGGUCUAAACAAGGAUGUUUAUUU | 24 | 27069 |
| CFTR-Intron10-8190 | - | UUGUAAUCCUAGCACUUU | 18 | 27070 |
| CFTR-Intron10-8191 | - | CUUGUAAUCCUAGCACUUU | 19 | 27071 |
| CFTR-Intron10-1408 | - | ACUUGUAAUCCUAGCACUUU | 20 | 20292 |
| CFTR-Intron10-8192 | - | CACUUGUAAUCCUAGCACUUU | 21 | 27072 |
| CFTR-Intron10-8193 | - | ACACUUGUAAUCCUAGCACUUU | 22 | 27073 |
| CFTR-Intron10-8194 | - | CACACUUGUAAUCCUAGCACUUU | 23 | 27074 |
| CFTR-Intron10-8195 | - | UCACACUUGUAAUCCUAGCACUUU | 24 | 27075 |
| CFTR-Intron10-8196 | - | UUGCAGGGUGGGGCCUUU | 18 | 27076 |
| CFTR-Intron10-8197 | - | AUUGCAGGGUGGGGCCUUU | 19 | 27077 |
| CFTR-Intron10-1409 | - | UAUUGCAGGGUGGGGCCUUU | 20 | 20293 |
| CFTR-Intron10-8198 | - | GUAUUGCAGGGUGGGGCCUUU | 21 | 27078 |
| CFTR-Intron10-8199 | - | GGUAUUGCAGGGUGGGGCCUUU | 22 | 27079 |
| CFTR-Intron10-8200 | - | UGGUAUUGCAGGGUGGGGCCUUU | 23 | 27080 |
| CFTR-Intron10-8201 | - | AUGGUAUUGCAGGGUGGGGCCUUU | 24 | 27081 |
| CFTR-Intron10-8202 | - | AAGAUGAUUCCAAGCUUU | 18 | 27082 |
| CFTR-Intron10-8203 | - | AAAGAUGAUUCCAAGCUUU | 19 | 27083 |
| CFTR-Intron10-8204 | - | CAAAGAUGAUUCCAAGCUUU | 20 | 27084 |
| CFTR-Intron10-8205 | - | UCAAAGAUGAUUCCAAGCUUU | 21 | 27085 |
| CFTR-Intron10-8206 | - | GUCAAAGAUGAUUCCAAGCUUU | 22 | 27086 |
| CFTR-Intron10-8207 | - | AGUCAAAGAUGAUUCCAAGCUUU | 23 | 27087 |

TABLE 41E-continued

| | | 5th Tier | | |
|---|---|---|---|---|
| gRNA Name | DNA Strand | Targeting Domain | Target Site Length | Seq ID |
| CFTR-Intron10-8208 | − | GAGUCAAAGAUGAUUCCAAGCUUU | 24 | 27088 |
| CFTR-Intron10-8209 | − | UCAUUAUAACACUGCUUU | 18 | 27089 |
| CFTR-Intron10-8210 | − | UUCAUUAUAACACUGCUUU | 19 | 27090 |
| CFTR-Intron10-8211 | − | CUUCAUUAUAACACUGCUUU | 20 | 27091 |
| CFTR-Intron10-8212 | − | UCUUCAUUAUAACACUGCUUU | 21 | 27092 |
| CFTR-Intron10-8213 | − | CUCUUCAUUAUAACACUGCUUU | 22 | 27093 |
| CFTR-Intron10-8214 | − | GCUCUUCAUUAUAACACUGCUUU | 23 | 27094 |
| CFTR-Intron10-8215 | − | AGCUCUUCAUUAUAACACUGCUUU | 24 | 27095 |
| CFTR-Intron10-8216 | − | AUUUAACUGAAUAUCUUU | 18 | 27096 |
| CFTR-Intron10-8217 | − | AAUUUAACUGAAUAUCUUU | 19 | 27097 |
| CFTR-Intron10-1410 | − | AAAUUUAACUGAAUAUCUUU | 20 | 20294 |
| CFTR-Intron10-8218 | − | GAAAUUUAACUGAAUAUCUUU | 21 | 27098 |
| CFTR-Intron10-8219 | − | AGAAAUUUAACUGAAUAUCUUU | 22 | 27099 |
| CFTR-Intron10-8220 | − | UAGAAAUUUAACUGAAUAUCUUU | 23 | 27100 |
| CFTR-Intron10-8221 | − | AUAGAAAUUUAACUGAAUAUCUUU | 24 | 27101 |
| CFTR-Intron10-8222 | − | UCAAUAUUUGGAAUUUU | 18 | 27102 |
| CFTR-Intron10-8223 | − | AUCAAUAUUUGGAAUUUU | 19 | 27103 |
| CFTR-Intron10-1412 | − | UAUCAAUAUUUGGAAUUUU | 20 | 20296 |
| CFTR-Intron10-8224 | − | UUAUCAAUAUUUGGAAUUUU | 21 | 27104 |
| CFTR-Intron10-8225 | − | UUUAUCAAUAUUUGGAAUUUU | 22 | 27105 |
| CFTR-Intron10-8226 | − | UUUUAUCAAUAUUUGGAAUUUU | 23 | 27106 |
| CFTR-Intron10-8227 | − | GUUUUAUCAAUAUUUGGAAUUUU | 24 | 27107 |
| CFTR-Intron10-8228 | − | GAUAAAAUCAGUGCUUUU | 18 | 27108 |
| CFTR-Intron10-8229 | − | UGAUAAAAUCAGUGCUUUU | 19 | 27109 |
| CFTR-Intron10-8230 | − | CUGAUAAAAUCAGUGCUUUU | 20 | 27110 |
| CFTR-Intron10-8231 | − | UCUGAUAAAAUCAGUGCUUUU | 21 | 27111 |
| CFTR-Intron10-8232 | − | CUCUGAUAAAAUCAGUGCUUUU | 22 | 27112 |
| CFTR-Intron10-8233 | − | GCUCUGAUAAAAUCAGUGCUUUU | 23 | 27113 |
| CFTR-Intron10-8234 | − | AGCUCUGAUAAAAUCAGUGCUUUU | 24 | 27114 |
| CFTR-Intron10-8235 | − | UUAAAAUUUUAUUCUUUU | 18 | 27115 |
| CFTR-Intron10-8236 | − | UUUAAAAUUUUAUUCUUUU | 19 | 27116 |
| CFTR-Intron10-8237 | − | UUUUAAAAUUUUAUUCUUUU | 20 | 27117 |
| CFTR-Intron10-8238 | − | UUUUUAAAAUUUUAUUCUUUU | 21 | 27118 |
| CFTR-Intron10-8239 | − | AUUUUUAAAAUUUUAUUCUUUU | 22 | 27119 |
| CFTR-Intron10-8240 | − | AAUUUUUAAAAUUUUAUUCUUUU | 23 | 27120 |
| CFTR-Intron10-8241 | − | UAAUUUUUAAAAUUUUAUUCUUUU | 24 | 27121 |
| CFTR-Intron10-8242 | − | AUCAUUUUGACCAUUUUU | 18 | 27122 |

TABLE 41E-continued

5th Tier

| gRNA Name | DNA Strand | Targeting Domain | Target Site Length | Seq ID |
|---|---|---|---|---|
| CFTR-Intron10-8243 | - | UAUCAUUUGACCAUUUUU | 19 | 27123 |
| CFTR-Intron10-8244 | - | UUAUCAUUUGACCAUUUUU | 20 | 27124 |
| CFTR-Intron10-8245 | - | UUUAUCAUUUGACCAUUUUU | 21 | 27125 |
| CFTR-Intron10-8246 | - | AUUUAUCAUUUGACCAUUUUU | 22 | 27126 |
| CFTR-Intron10-8247 | - | AAUUUAUCAUUUGACCAUUUUU | 23 | 27127 |
| CFTR-Intron10-8248 | - | AAAUUUAUCAUUUGACCAUUUUU | 24 | 27128 |
| CFTR-Intron10-8249 | - | AUUAGUAGUUAAGUUUUU | 18 | 27129 |
| CFTR-Intron10-8250 | - | UAUUAGUAGUUAAGUUUUU | 19 | 27130 |
| CFTR-Intron10-8251 | - | CUAUUAGUAGUUAAGUUUUU | 20 | 27131 |
| CFTR-Intron10-8252 | - | GCUAUUAGUAGUUAAGUUUUU | 21 | 27132 |
| CFTR-Intron10-8253 | - | GGCUAUUAGUAGUUAAGUUUUU | 22 | 27133 |
| CFTR-Intron10-8254 | - | AGGCUAUUAGUAGUUAAGUUUUU | 23 | 27134 |
| CFTR-Intron10-8255 | - | UAGGCUAUUAGUAGUUAAGUUUUU | 24 | 27135 |
| CFTR-Intron10-8256 | - | AACACUUUAUAGUUUUUU | 18 | 27136 |
| CFTR-Intron10-8257 | - | GAACACUUUAUAGUUUUUU | 19 | 27137 |
| CFTR-Intron10-8258 | - | GGAACACUUUAUAGUUUUUU | 20 | 27138 |
| CFTR-Intron10-8259 | - | UGGAACACUUUAUAGUUUUUU | 21 | 27139 |
| CFTR-Intron10-8260 | - | AUGGAACACUUUAUAGUUUUUU | 22 | 27140 |
| CFTR-Intron10-8261 | - | AAUGGAACACUUUAUAGUUUUUU | 23 | 27141 |
| CFTR-Intron10-8262 | - | GAAUGGAACACUUUAUAGUUUUUU | 24 | 27142 |
| CFTR-Intron10-8263 | - | UUUUUUUUUUUUUUUUUU | 18 | 27143 |
| CFTR-Intron10-8264 | - | UUUUUUUUUUUUUUUUUUU | 19 | 27144 |
| CFTR-Intron10-8265 | - | UUUUUUUUUUUUUUUUUUUU | 20 | 27145 |
| CFTR-Intron10-8266 | - | UUUUUUUUUUUUUUUUUUUUU | 21 | 27146 |
| CFTR-Intron10-8267 | - | UUUUUUUUUUUUUUUUUUUUUU | 22 | 27147 |
| CFTR-Intron10-8268 | - | UUUUUUUUUUUUUUUUUUUUUUU | 23 | 27148 |
| CFTR-Intron10-8269 | - | CUUUUUUUUUUUUUUUUUUUUUUU | 24 | 27149 |

Table 42A provides exemplary targeting domains for correcting a mutation (e.g., 3272-26→G) in the CFTR gene selected according to the first tier parameters. The targeting domains bind within intron 10, have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 42A

1st Tier

| gRNA Name | DNA Strand | Targeting Domain | Target Site Length | Seq ID |
|---|---|---|---|---|
| CFTR-Intron10-8270 | − | GGUGAAGUCUUUAGUAA | 17 | 27150 |
| CFTR-Intron10-8271 | + | GUUGGUGAUAUUUUUCA | 17 | 27151 |
| CFTR-Intron10-8272 | − | GUCAAGCAUUUGUGUAC | 17 | 27152 |
| CFTR-Intron10-8273 | − | GAUACAUCUGAAAAAU | 17 | 27153 |
| CFTR-Intron10-8274 | + | GGAGUGUAAAGGAAAUU | 17 | 27154 |
| CFTR-Intron10-5827 | − | GAGGGUGAAGUCUUUAGUAA | 20 | 24707 |
| CFTR-Intron10-8275 | + | GGGGAAUAAUAAAAAAUGUA | 20 | 27155 |
| CFTR-Intron10-8276 | + | GGUUUACCCCCUACCUCCAC | 20 | 27156 |
| CFTR-Intron10-8277 | − | GUGGUCAAGCAUUUGUGUAC | 20 | 27157 |
| CFTR-Intron10-8278 | + | GGUAGCAGAGGAAGAAAAG | 20 | 27158 |
| CFTR-Intron10-8279 | − | GCCAUACACUCUAAAUAGAG | 20 | 27159 |
| CFTR-Intron10-8280 | − | GUUUUCUAGAAAAUCUGUAG | 20 | 27160 |
| CFTR-Intron10-8281 | − | GGAGAUACAUCUGAAAAAU | 20 | 27161 |
| CFTR-Intron10-8282 | − | GCAGGAAGACAGCUGGCUAU | 20 | 27162 |

Table 42B provides exemplary targeting domains for correcting a mutation (e.g., 3272-26→G) in the CFTR gene selected according to the second tier parameters. The targeting domains bind within intron 10 and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 42B

2nd Tier

| gRNA Name | DNA Strand | Targeting Domain | Target Site Length | Seq ID |
|---|---|---|---|---|
| CFTR-Intron10-8283 | + | UAGAGAUUACUUGGAAA | 17 | 27163 |
| CFTR-Intron10-8284 | − | AGUCACAGAGGAGUCAA | 17 | 27164 |
| CFTR-Intron10-8285 | + | AAAGGACUAUCAGUGAA | 17 | 27165 |
| CFTR-Intron10-8286 | − | ACUGAAUAUCUUUAGGA | 17 | 27166 |
| CFTR-Intron10-8287 | + | UUACCCCCUACCUCCAC | 17 | 27167 |
| CFTR-Intron10-8288 | − | UCAUUAGGAAAAUGUAC | 17 | 27168 |
| CFTR-Intron10-8289 | − | AAUGGUUCCUUGUUCCC | 17 | 27169 |
| CFTR-Intron10-8290 | − | AAACUUGUCUUCUUUUC | 17 | 27170 |
| CFTR-Intron10-8291 | + | UCCUAACCUCGAAAAAG | 17 | 27171 |
| CFTR-Intron10-8292 | − | AUACACUCUAAAUAGAG | 17 | 27172 |
| CFTR-Intron10-8293 | − | UUCUAGAAAAUCUGUAG | 17 | 27173 |
| CFTR-Intron10-8294 | − | AAGGCUUAUUUCUCUGG | 17 | 27174 |
| CFTR-Intron10-8295 | + | CAAAUUGUAUUGAGUGG | 17 | 27175 |
| CFTR-Intron10-8296 | − | UAUAUAUGACACUAU | 17 | 27176 |
| CFTR-Intron10-8297 | + | CUACUAAAAGGCAGCCU | 17 | 27177 |
| CFTR-Intron10-8298 | + | UGAUCCUUUUGCAGCCU | 17 | 27178 |

TABLE 42B-continued

| | | 2nd Tier | | |
|---|---|---|---|---|
| gRNA Name | DNA Strand | Targeting Domain | Target Site Length | Seq ID |
| CFTR-Intron10-8299 | - | CUUUCCAUGAAUUAGCU | 17 | 27179 |
| CFTR-Intron10-8300 | - | AUUUCCAAGUAAUCUCU | 17 | 27180 |
| CFTR-Intron10-8301 | - | UUCGUGUAGUUUCUAUU | 17 | 27181 |
| CFTR-Intron10-8302 | - | AAAAGUCACAGAGGAGUCAA | 20 | 27182 |
| CFTR-Intron10-8303 | + | ACAAAAGGACUAUCAGUGAA | 20 | 27183 |
| CFTR-Intron10-8304 | + | UGAGUUGGUGAUAUUUUUCA | 20 | 27184 |
| CFTR-Intron10-8305 | - | UUAACUGAAUAUCUUUAGGA | 20 | 27185 |
| CFTR-Intron10-8306 | + | AAUAAAGUAAUAGAAGCAUA | 20 | 27186 |
| CFTR-Intron10-8307 | + | AAAGCUCUUUCUCAUCUCUA | 20 | 27187 |
| CFTR-Intron10-3944 | + | AUAUUAAUAACAAAAUCUUA | 20 | 22826 |
| CFTR-Intron10-8308 | - | UCUAUGAUAUAAUGAAUCAC | 20 | 27188 |
| CFTR-Intron10-8309 | - | UAAAAUGGUUCCUUGUUCCC | 20 | 27189 |
| CFTR-Intron10-8310 | - | UGGAAACUUGUCUUCUUUUC | 20 | 27190 |
| CFTR-Intron10-8311 | - | UAGUGUGAAGAUGGGGCUGG | 20 | 27191 |
| CFTR-Intron10-7212 | - | ACUAAGGCUUAUUUCUCUGG | 20 | 26092 |
| CFTR-Intron10-8312 | + | UACCAAAUUGUAUUGAGUGG | 20 | 27192 |
| CFTR-Intron10-8313 | + | AUACUACUAAAAGGCAGCCU | 20 | 27193 |
| CFTR-Intron10-8314 | - | UAUAUUUCCAAGUAAUCUCU | 20 | 27194 |
| CFTR-Intron10-8315 | + | UGUGGAGUGUAAAGGAAAUU | 20 | 27195 |
| CFTR-Intron10-8316 | - | AUAUUCGUGUAGUUUCUAUU | 20 | 27196 |

Table 42C provides exemplary targeting domains for correcting a mutation (e.g., 3272-26→G) in the CFTR gene selected according to the third tier parameters. The targeting domains bind within intron 10 and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 42C

| | | 3rd Tier | | |
|---|---|---|---|---|
| gRNA Name | DNA Strand | Targeting Domain | Target Site Length | Seq ID |
| CFTR-Intron10-8317 | + | GCUCUUUCUCAUCUCUA | 17 | 27197 |
| CFTR-Intron10-8318 | + | GAAUAAUAAAAAAUGUA | 17 | 27198 |
| CFTR-Intron10-8319 | + | GAUACUAAAAAAAGUUA | 17 | 27199 |
| CFTR-Intron10-8320 | - | GUGCAACUAUCACCUCC | 17 | 27200 |
| CFTR-Intron10-8321 | - | GUGGAGGCUGCAGUGAG | 17 | 27201 |
| CFTR-Intron10-8322 | + | GAGAACUGCUCACACGG | 17 | 27202 |
| CFTR-Intron10-8323 | - | GGAAGACAGCUGGCUAU | 17 | 27203 |
| CFTR-Intron10-8324 | + | GAAGAUACUAAAAAAAGUUA | 20 | 27204 |
| CFTR-Intron10-8325 | - | GUUGUGCAACUAUCACCUCC | 20 | 27205 |

TABLE 42C-continued

| | | 3rd Tier | | |
|---|---|---|---|---|
| gRNA Name | DNA Strand | Targeting Domain | Target Site Length | Seq ID |
| CFTR-Intron10-8326 | − | GAAGUGGAGGCUGCAGUGAG | 20 | 27206 |
| CFTR-Intron10-8327 | + | GCAUCACUAGUGGCACUUUG | 20 | 27207 |
| CFTR-Intron10-8328 | + | GAUAAAUUUUAACUUUUUAU | 20 | 27208 |

Table 42D provides exemplary targeting domains for correcting a mutation (e.g., 3272-26→G) in the CFTR gene selected according to the fourth tier parameters. The targeting domains bind within intron 10. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 42D

| | | 4th Tier | | |
|---|---|---|---|---|
| gRNA Name | DNA Strand | Targeting Domain | Target Site Length | Seq ID |
| CFTR-Intron10-8329 | − | CUUUGGAAUUUGUUAAA | 17 | 27209 |
| CFTR-Intron10-8330 | + | ACCCAAAUGUCAAUCAA | 17 | 27210 |
| CFTR-Intron10-8331 | + | UACCAUCACCUUGGGAA | 17 | 27211 |
| CFTR-Intron10-8332 | − | UGUAUUUAUAUUCAUAA | 17 | 27212 |
| CFTR-Intron10-8333 | − | AUAUAGAAAUGAGGUAA | 17 | 27213 |
| CFTR-Intron10-8334 | − | CAUAUAUAUAUUUUUAA | 17 | 27214 |
| CFTR-Intron10-8335 | − | CUUUGAAGGAAGAUCCA | 17 | 27215 |
| CFTR-Intron10-8336 | + | AAAGUAAUAGAAGCAUA | 17 | 27216 |
| CFTR-Intron10-8337 | − | UGGAGUCAAAAAUUAUA | 17 | 27217 |
| CFTR-Intron10-8338 | + | UUAAUAACAAAAUCUUA | 17 | 27218 |
| CFTR-Intron10-8339 | − | AUGAUAUAAUGAAUCAC | 17 | 27219 |
| CFTR-Intron10-8340 | + | CACACAUAUAUACAUAC | 17 | 27220 |
| CFTR-Intron10-8341 | + | UCCAAGAUCAAGGUGCC | 17 | 27221 |
| CFTR-Intron10-8342 | + | CAAAUAUAAAUCAAAGC | 17 | 27222 |
| CFTR-Intron10-8343 | + | AGCAGAGGAAGAAAAAG | 17 | 27223 |
| CFTR-Intron10-8344 | − | AAUGUUGAAUAAUAGGG | 17 | 27224 |
| CFTR-Intron10-956 | − | AGGGUGGGGCCUUUGGG | 17 | 19841 |
| CFTR-Intron10-8345 | − | UGUGAAGAUGGGGCUGG | 17 | 27225 |
| CFTR-Intron10-8346 | + | CUCUGCCUCCAAAAGUG | 17 | 27226 |
| CFTR-Intron10-8347 | − | CUCGGCCUCCCAAAGUG | 17 | 27227 |
| CFTR-Intron10-8348 | − | UAGUAUAGUAGGAAGUG | 17 | 27228 |
| CFTR-Intron10-8349 | + | UCACUAGUGGCACUUUG | 17 | 27229 |
| CFTR-Intron10-8350 | − | UCCACAAAUAUUUUUUG | 17 | 27230 |
| CFTR-Intron10-8351 | − | AAAGAUCUAGCUAAAAU | 17 | 27231 |
| CFTR-Intron10-8352 | + | AAAUUUUAACUUUUUAU | 17 | 27232 |
| CFTR-Intron10-8353 | − | UUUAUUGAUACUUUUCU | 17 | 27233 |
| CFTR-Intron10-8354 | − | AAAGACUUGCAGGAGGU | 17 | 27234 |

TABLE 42D-continued

4th Tier

| gRNA Name | DNA Strand | Targeting Domain | Target Site Length | Seq ID |
|---|---|---|---|---|
| CFTR-Intron10-8355 | + | UUUCUUUUUCUGUUUGU | 17 | 27235 |
| CFTR-Intron10-8356 | − | UGGGUAUAUUUUAUAUU | 17 | 27236 |
| CFTR-Intron10-8357 | − | CAGUAGUAUUAUCUUUU | 17 | 27237 |
| CFTR-Intron10-8358 | − | UAAAAUUUUAUUCUUUU | 17 | 27238 |
| CFTR-Intron10-8359 | + | UUAUAGAGAUUACUUGGAAA | 20 | 27239 |
| CFTR-Intron10-8360 | − | AUACUUGGAAUUUGUUAAA | 20 | 27240 |
| CFTR-Intron10-8361 | + | ACAACCCAAAUGUCAAUCAA | 20 | 27241 |
| CFTR-Intron10-8362 | + | CAAUACCAUCACCUUGGGAA | 20 | 27242 |
| CFTR-Intron10-8363 | − | UUUUGUAUUUAUAUUCAUAA | 20 | 27243 |
| CFTR-Intron10-8364 | − | UUUAUAUAGAAAUGAGGUAA | 20 | 27244 |
| CFTR-Intron10-8365 | − | AUGCAUAUAUAUAUUUUUAA | 20 | 27245 |
| CFTR-Intron10-8366 | − | AUGCUUUGAAGGAAGAUCCA | 20 | 27246 |
| CFTR-Intron10-8367 | − | UUGUGGAGUCAAAAAUUAUA | 20 | 27247 |
| CFTR-Intron10-8368 | + | AGACACACAUAUAUACAUAC | 20 | 27248 |
| CFTR-Intron10-8369 | − | AACUCAUUAGGAAAAUGUAC | 20 | 27249 |
| CFTR-Intron10-8370 | + | AAGUCCAAGAUCAAGGUGCC | 20 | 27250 |
| CFTR-Intron10-8371 | + | AAACAAAUAUAAAUCAAAGC | 20 | 27251 |
| CFTR-Intron10-8372 | + | AUCUCCUAACCUCGAAAAAG | 20 | 27252 |
| CFTR-Intron10-8373 | + | AGAGAGAACUGCUCACACGG | 20 | 27253 |
| CFTR-Intron10-8374 | − | AUAAAUGUUGAAUAAUAGGG | 20 | 27254 |
| CFTR-Intron10-1300 | − | UGCAGGUGGGGCCUUUGGG | 20 | 20185 |
| CFTR-Intron10-8375 | + | UGCCUCUGCCUCCAAAAGUG | 20 | 27255 |
| CFTR-Intron10-7272 | − | CGCCUCGGCCUCCCAAAGUG | 20 | 26152 |
| CFTR-Intron10-7277 | − | UGCCUCGGCCUCCCAAAGUG | 20 | 26157 |
| CFTR-Intron10-8376 | − | AAGUAGUAUAGUAGGAAGUG | 20 | 27256 |
| CFTR-Intron10-8377 | − | UCCUCCACAAAUAUUUUUUG | 20 | 27257 |
| CFTR-Intron10-8378 | − | ACAAAAGAUCUAGCUAAAAU | 20 | 27258 |
| CFTR-Intron10-8379 | − | ACAUAUAUAUGACACUAU | 20 | 27259 |
| CFTR-Intron10-8380 | + | ACAUGAUCCUUUUGCAGCCU | 20 | 27260 |
| CFTR-Intron10-8381 | − | AAGCUUUCCAUGAAUUAGCU | 20 | 27261 |
| CFTR-Intron10-8382 | − | UCCUUUAUUGAUACUUUUCU | 20 | 27262 |
| CFTR-Intron10-7876 | − | AACAAAGACUUGCAGGAGGU | 20 | 26756 |
| CFTR-Intron10-8383 | + | CUCUUUCUUUUUCUGUUUGU | 20 | 27263 |
| CFTR-Intron10-8384 | − | UUUUGGGUAUAUUUUAUAUU | 20 | 27264 |
| CFTR-Intron10-8385 | − | AGUCAGUAGUAUUAUCUUUU | 20 | 27265 |
| CFTR-Intron10-8237 | − | UUUUAAAAUUUUAUUCUUUU | 20 | 27117 |

Table 43A provides exemplary targeting domains for knocking out the SCNN1A gene selected according to the first tier parameters. The targeting domains bind within the first 500 bp of the coding sequence (e.g., with 500 bp downstream from the start codon), have a high level of orthogonality and start with a 5'G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 43A

1st Tier

| gRNA Name | DNA Strand | Targeting Domain | Target Site Length | Seq ID |
|---|---|---|---|---|
| SCNN1A-327 | + | GAUACCUCCCCUUGGAA | 17 | 4176 |
| SCNN1A-328 | - | GGGCGCAGGGUGGGACA | 17 | 4177 |
| SCNN1A-99 | - | GGCGCCCCAGCAGCCCA | 17 | 536 |
| SCNN1A-329 | - | GCCUCACUCGGGUUCCA | 17 | 4178 |
| SCNN1A-330 | - | GGGAGAAUGUGGGCGCA | 17 | 4179 |
| SCNN1A-141 | + | GCGGUGGAACUCGAUCA | 17 | 551 |
| SCNN1A-80 | - | GCCCAUACCAGGUCUCA | 17 | 529 |
| SCNN1A-106 | - | GCACAACCGCAUGAAGA | 17 | 540 |
| SCNN1A-132 | + | GGAGCACACCAGGCGGA | 17 | 547 |
| SCNN1A-121 | + | GUUGAUGUUGAGGCUGA | 17 | 545 |
| SCNN1A-331 | + | GGACUAACCGACCUGUA | 17 | 4180 |
| SCNN1A-332 | - | GCACCCUCAAUCCCUAC | 17 | 4181 |
| SCNN1A-93 | - | GAACAAGCGUGAGGAGC | 17 | 533 |
| SCNN1A-147 | + | GGCUGCUGGGGCGCCGC | 17 | 554 |
| SCNN1A-117 | + | GUGCAGAUGGUCACUGC | 17 | 544 |
| SCNN1A-333 | - | GAUGGGAGAGGGCACUC | 17 | 4182 |
| SCNN1A-107 | - | GCAUGAAGACGGCCUUC | 17 | 541 |
| SCNN1A-334 | - | GACAUGGGCAUGGCCAG | 17 | 4183 |
| SCNN1A-142 | + | GGCCUCCUCCUCCGCCG | 17 | 552 |
| SCNN1A-150 | + | GGGGCGCCGCAGGUUCG | 17 | 555 |
| SCNN1A-131 | + | GCUGGGAGCACACCAGG | 17 | 546 |
| SCNN1A-103 | - | GCCCACGGCGGAGGAGG | 17 | 539 |
| SCNN1A-102 | - | GCAGCCCACGGCGGAGG | 17 | 538 |
| SCNN1A-139 | + | GCUCUCGGUAGGAGCGG | 17 | 550 |
| SCNN1A-116 | + | GGUGCAGAUGGUCACUG | 17 | 543 |
| SCNN1A-98 | - | GCUGGGCCCCGAACCUG | 17 | 535 |
| SCNN1A-335 | - | GGCGCAGGGUGGGACAU | 17 | 4184 |
| SCNN1A-336 | + | GGUCAAGGCUGAGCUCU | 17 | 4185 |
| SCNN1A-143 | + | GCCUCCUCCUCCGCCGU | 17 | 553 |

TABLE 43A-continued

1st Tier

| gRNA Name | DNA Strand | Targeting Domain | Target Site Length | Seq ID |
|---|---|---|---|---|
| SCNN1A-337 | - | GAAUGUGGGCGCAGGGU | 17 | 4186 |
| SCNN1A-338 | + | GGGACUAACCGACCUGU | 17 | 4187 |
| SCNN1A-339 | + | GAGCCCCGGAGUGGAUU | 17 | 4188 |
| SCNN1A-340 | - | GUGGGACAUGGGCAUGGCCA | 20 | 4189 |
| SCNN1A-341 | - | GCAGCCUCACUCGGGUUCCA | 20 | 4190 |
| SCNN1A-342 | - | GAGCAGUAUCAAGGUAAGCA | 20 | 4191 |
| SCNN1A-15 | - | GGGAACAAGCGUGAGGAGCA | 20 | 507 |
| SCNN1A-62 | + | GGAGCGGUGGAACUCGAUCA | 20 | 525 |
| SCNN1A-343 | - | GUGAUGGGAGAGGGCACUCA | 20 | 4192 |
| SCNN1A-1 | - | GCAGCCCAUACCAGGUCUCA | 20 | 503 |
| SCNN1A-36 | + | GUAGGGAUUGAGGGUGCAGA | 20 | 516 |
| SCNN1A-76 | + | GCCCUGGAGUGGACUGUGGA | 20 | 528 |
| SCNN1A-10 | - | GUCCACUCCAGGGCUCAUGA | 20 | 505 |
| SCNN1A-42 | + | GAGGUUGAUGUUGAGGCUGA | 20 | 519 |
| SCNN1A-344 | + | GUAUGGGCUGCAGAGGUCUA | 20 | 4193 |
| SCNN1A-345 | + | GAGGGACUAACCGACCUGUA | 20 | 4194 |
| SCNN1A-32 | - | GCACCUUUGGCAUGAUGUAC | 20 | 514 |
| SCNN1A-51 | + | GGUUGUGCUGGGAGCACACC | 20 | 522 |
| SCNN1A-346 | + | GUGCCCUCUCCCAUCACCCC | 20 | 4195 |
| SCNN1A-347 | - | GGUGGGACAUGGGCAUGGCC | 20 | 4196 |
| SCNN1A-348 | - | GGCAGCCUCACUCGGGUUCC | 20 | 4197 |
| SCNN1A-176 | - | GCUCAUGAAGGGGAACAAGC | 20 | 811 |
| SCNN1A-68 | + | GUGGGCUGCUGGGGCGCCGC | 20 | 526 |
| SCNN1A-349 | - | GAGUGGGAGAAUGUGGGCGC | 20 | 4198 |
| SCNN1A-350 | - | GGUGAUGGGAGAGGGCACUC | 20 | 4199 |
| SCNN1A-351 | - | GGCCAGGGGCAGCCUCACUC | 20 | 4200 |
| SCNN1A-352 | + | GAUUGGGGAGAGCAAGGGUC | 20 | 4201 |
| SCNN1A-16 | - | GGAACAAGCGUGAGGAGCAG | 20 | 508 |
| SCNN1A-44 | + | GGUUGAUGUUGAGGCUGACG | 20 | 520 |
| SCNN1A-353 | - | GCUCUCCCCAAUCCACUCCG | 20 | 4202 |
| SCNN1A-39 | + | GGGGUGCAGAUGGUCACUGCG | 20 | 518 |
| SCNN1A-71 | + | GCUGGGGCGCCGCAGGUUCG | 20 | 527 |
| SCNN1A-21 | - | GGCGCCCCAGCAGCCCACGG | 20 | 510 |

TABLE 43A-continued

1st Tier

| gRNA Name | DNA Strand | Targeting Domain | Target Site Length | Seq ID |
|---|---|---|---|---|
| SCNN1A-22 | − | GCCCCAGCAGCCCACGGCGG | 20 | 511 |
| SCNN1A-354 | − | GGGAGAAUGUGGGCGCAGGG | 20 | 4203 |
| SCNN1A-2 | − | GCCCAUACCAGGUCUCAUGG | 20 | 497 |
| SCNN1A-37 | + | GAGGGUGCAGAUGGUCACUG | 20 | 517 |
| SCNN1A-19 | − | GGGGCUGGGCCCCGAACCUG | 20 | 509 |
| SCNN1A-355 | − | GUGGGCGCAGGGUGGGACAU | 20 | 4204 |
| SCNN1A-356 | + | GGUAUGGGCUGCAGAGGUCU | 20 | 4205 |
| SCNN1A-58 | + | GAACUCGAAGAGCUCUCGGU | 20 | 524 |
| SCNN1A-357 | − | GGAGAAUGUGGGCGCAGGGU | 20 | 4206 |
| SCNN1A-33 | − | GGCAUGAUGUACUGGCAAUU | 20 | 515 |
| SCNN1A-31 | − | GUGCUGUGGCUCUGCACCUU | 20 | 513 |

Table 43B provides exemplary targeting domains for knocking out the SCNN1A gene selected according to the second tier parameters. The targeting domains bind within the first 500 bp of the coding sequence (e.g., with 500 bp downstream from the start codon) and have a high level of orthogonality. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 43B

2nd Tier

| gRNA Name | DNA Strand | Targeting Domain | Target Site Length | Seq ID |
|---|---|---|---|---|
| SCNN1A-125 | + | CCAGUACAUCAUGCCAA | 17 | 632 |
| SCNN1A-358 | − | CCAGCUGUCCCUUCCAA | 17 | 4207 |
| SCNN1A-359 | − | AGUAUCAAGGUAAGCAA | 17 | 4208 |
| SCNN1A-90 | − | ACUCCAGGGCUCAUGAA | 17 | 611 |
| SCNN1A-360 | − | ACUCCGGGGCUCAUGAA | 17 | 4209 |
| SCNN1A-104 | − | AACAACACCACCAUCCA | 17 | 617 |
| SCNN1A-88 | − | CUCCACAGUCCACUCCA | 17 | 609 |
| SCNN1A-361 | − | CAGUAUCAAGGUAAGCA | 17 | 4210 |
| SCNN1A-94 | − | AACAAGCGUGAGGAGCA | 17 | 613 |
| SCNN1A-362 | − | UAUCAUGAGCAGUAUCA | 17 | 4211 |
| SCNN1A-363 | − | AUGGGAGAGGGCACUCA | 17 | 4212 |
| SCNN1A-126 | + | CCACAGCACUGCCCAGA | 17 | 633 |
| SCNN1A-82 | − | AUACCAGGUCUCAUGGA | 17 | 501 |
| SCNN1A-364 | + | UGAUACCUCCCCUUGGA | 17 | 4213 |
| SCNN1A-89 | − | CACUCCAGGGCUCAUGA | 17 | 610 |
| SCNN1A-365 | − | CACUCCGGGGCUCAUGA | 17 | 4214 |
| SCNN1A-366 | − | UCGGGUUCCAGGGGUGA | 17 | 4215 |
| SCNN1A-367 | + | CGACCUGUAGGGAUUGA | 17 | 4216 |
| SCNN1A-157 | + | CUCCAUGAGACCUGGUA | 17 | 502 |
| SCNN1A-122 | + | UUGAUGUUGAGGCUGAC | 17 | 629 |
| SCNN1A-111 | − | CCUUUGGCAUGAUGUAC | 17 | 622 |
| SCNN1A-130 | + | UGUGCUGGGAGCACACC | 17 | 637 |
| SCNN1A-156 | + | UUCCCCUCCAUGAGACC | 17 | 653 |

TABLE 43B-continued

| | 2nd Tier | | | |
|---|---|---|---|---|
| gRNA Name | DNA Strand | Targeting Domain | Target Site Length | Seq ID |
| SCNN1A-368 | - | CCUCUGCAGCCCAUACC | 17 | 4217 |
| SCNN1A-369 | + | CCGAGUGAGGCUGCCCC | 17 | 4218 |
| SCNN1A-370 | - | UCUCCCCAAUCCACUCC | 17 | 4219 |
| SCNN1A-87 | - | CCUCCACAGUCCACUCC | 17 | 608 |
| SCNN1A-371 | - | AGCCUCACUCGGGUUCC | 17 | 4220 |
| SCNN1A-124 | + | AGUACUCUCCGAAAAGC | 17 | 631 |
| SCNN1A-260 | - | CAUGAAGGGGAACAAGC | 17 | 868 |
| SCNN1A-84 | - | CAUGGAGGGGAACAAGC | 17 | 607 |
| SCNN1A-372 | + | CCCUUGGAAGGGACAGC | 17 | 4221 |
| SCNN1A-373 | - | UGGGAGAAUGUGGGCGC | 17 | 4222 |
| SCNN1A-144 | + | CCUCCGCCGUGGGCUGC | 17 | 643 |
| SCNN1A-128 | + | UCUUCAUGCGGUUGUGC | 17 | 635 |
| SCNN1A-140 | + | AGCGGUGGAACUCGAUC | 17 | 642 |
| SCNN1A-374 | - | CUCUCCCCAAUCCACUC | 17 | 4223 |
| SCNN1A-375 | - | CAGGGGCAGCCUCACUC | 17 | 4224 |
| SCNN1A-376 | + | UGGGGAGAGCAAGGGUC | 17 | 4225 |
| SCNN1A-149 | + | UGGGGCGCCGCAGGUUC | 17 | 647 |
| SCNN1A-377 | - | CAGCUGUCCCUUCCAAG | 17 | 4226 |
| SCNN1A-91 | - | CUCCAGGGCUCAUGAAG | 17 | 612 |
| SCNN1A-378 | - | CUCCGGGGCUCAUGAAG | 17 | 4227 |
| SCNN1A-379 | - | CCUCACUCGGGUUCCAG | 17 | 4228 |
| SCNN1A-95 | - | ACAAGCGUGAGGAGCAG | 17 | 614 |
| SCNN1A-380 | + | CCUGGUAUGGGCUGCAG | 17 | 4229 |
| SCNN1A-138 | + | AGAGCUCUCGGUAGGAG | 17 | 641 |
| SCNN1A-381 | + | CUUCAUGAGCCCCGGAG | 17 | 4230 |
| SCNN1A-152 | + | CUUCAUGAGCCCUGGAG | 17 | 649 |
| SCNN1A-123 | + | UGAUGUUGAGGCUGACG | 17 | 630 |
| SCNN1A-382 | - | CUCCCCAAUCCACUCCG | 17 | 4231 |
| SCNN1A-118 | + | UGCAGAUGGUCACUGCG | 17 | 626 |
| SCNN1A-101 | - | CCAGCAGCCCACGGCGG | 17 | 616 |
| SCNN1A-383 | - | AGAAUGUGGGCGCAGGG | 17 | 4232 |
| SCNN1A-384 | - | CUGUCCCUUCCAAGGGG | 17 | 4233 |
| SCNN1A-81 | - | CAUACCAGGUCUCAUGG | 17 | 605 |
| SCNN1A-127 | + | AGAAGGCCGUCUUCAUG | 17 | 634 |
| SCNN1A-146 | + | UCCGCCGUGGGCUGCUG | 17 | 645 |
| SCNN1A-385 | + | CCCCUGGAACCCGAGUG | 17 | 4234 |
| SCNN1A-386 | + | CCGACCUGUAGGGAUUG | 17 | 4235 |
| SCNN1A-387 | + | AGCCCCGGAGUGGAUUG | 17 | 4236 |

TABLE 43B-continued

| 2nd Tier | | | | |
|---|---|---|---|---|
| gRNA Name | DNA Strand | Targeting Domain | Target Site Length | Seq ID |
| SCNN1A-119 | + | CGAGCUUGUCCGAGUUG | 17 | 627 |
| SCNN1A-120 | + | AGUUGAGGUUGAUGUUG | 17 | 628 |
| SCNN1A-388 | + | UGAGCCCCGGAGUGGAU | 17 | 4237 |
| SCNN1A-389 | - | CGGGUUCCAGGGGUGAU | 17 | 4238 |
| SCNN1A-158 | + | UCCAUGAGACCUGGUAU | 17 | 654 |
| SCNN1A-114 | - | CAACAUCAACCUCAACU | 17 | 625 |
| SCNN1A-97 | - | CGUGAGGAGCAGGGGCU | 17 | 615 |
| SCNN1A-145 | + | CUCCGCCGUGGGCUGCU | 17 | 644 |
| SCNN1A-129 | + | CUUCAUGCGGUUGUGCU | 17 | 636 |
| SCNN1A-136 | + | AGAACUCGAAGAGCUCU | 17 | 639 |
| SCNN1A-390 | + | AUGGGCUGCAGAGGUCU | 17 | 4239 |
| SCNN1A-108 | - | CAUGAAGACGGCCUUCU | 17 | 619 |
| SCNN1A-391 | - | CCUCAAUCCCUACAGGU | 17 | 4240 |
| SCNN1A-137 | + | CUCGAAGAGCUCUCGGU | 17 | 640 |
| SCNN1A-112 | - | AUGAUGUACUGGCAAUU | 17 | 623 |
| SCNN1A-110 | - | CUGUGGCUCUGCACCUU | 17 | 621 |
| SCNN1A-148 | + | CUGGGGCGCCGCAGGUU | 17 | 646 |
| SCNN1A-392 | - | AGCAAGGGAACCUGGUU | 17 | 4241 |
| SCNN1A-113 | - | CAAUUCGGCCUGCUUUU | 17 | 624 |
| SCNN1A-46 | + | UUGCCAGUACAUCAUGCCAA | 20 | 580 |
| SCNN1A-393 | - | AGCAGUAUCAAGGUAAGCAA | 20 | 4242 |
| SCNN1A-394 | + | CAUGAUACCUCCCCUUGGAA | 20 | 4243 |
| SCNN1A-395 | - | UGUGGGCGCAGGGUGGGACA | 20 | 4244 |
| SCNN1A-20 | - | UGCGGCGCCCCAGCAGCCA | 20 | 565 |
| SCNN1A-25 | - | UGCAACAACACCACCAUCCA | 20 | 567 |
| SCNN1A-396 | - | AGUGGGAGAAUGUGGGCGCA | 20 | 4245 |
| SCNN1A-397 | - | AGGUAUCAUGAGCAGUAUCA | 20 | 4246 |
| SCNN1A-398 | + | AUUGGGGAGAGCAAGGGUCA | 20 | 4247 |
| SCNN1A-27 | - | CCAGCACAACCGCAUGAAGA | 20 | 569 |
| SCNN1A-53 | + | CUGGGAGCACACCAGGCGGA | 20 | 585 |
| SCNN1A-3 | - | CCCAUACCAGGUCUCAUGGA | 20 | 556 |
| SCNN1A-399 | + | UCAUGAUACCUCCCCUUGGA | 20 | 4248 |
| SCNN1A-400 | - | AUCCACUCCGGGGCUCAUGA | 20 | 4249 |
| SCNN1A-401 | - | CACUCGGGUUCCAGGGGUGA | 20 | 4250 |
| SCNN1A-402 | + | AACCGACCUGUAGGGAUUGA | 20 | 4251 |
| SCNN1A-78 | + | CCCCUCCAUGAGACCUGGUA | 20 | 500 |
| SCNN1A-43 | + | AGGUUGAUGUUGAGGCUGAC | 20 | 578 |

TABLE 43B-continued

| | 2nd Tier | | | |
|---|---|---|---|---|
| gRNA Name | DNA Strand | Targeting Domain | Target Site Length | Seq ID |
| SCNN1A-403 | − | UCUGCACCCUCAAUCCCUAC | 20 | 4252 |
| SCNN1A-404 | − | UCAAGGUAAGCAAGGGAACC | 20 | 4253 |
| SCNN1A-405 | − | AGACCUCUGCAGCCCAUACC | 20 | 4254 |
| SCNN1A-406 | + | AACCCGAGUGAGGCUGCCCC | 20 | 4255 |
| SCNN1A-407 | − | UAGUCCCUCUGCCCCUUCCC | 20 | 4256 |
| SCNN1A-408 | − | UGCUCUCCCCAAUCCACUCC | 20 | 4257 |
| SCNN1A-8 | − | AGCCCUCCACAGUCCACUCC | 20 | 559 |
| SCNN1A-45 | + | UGAAGUACUCUCCGAAAAGC | 20 | 579 |
| SCNN1A-5 | − | UCUCAUGGAGGGGAACAAGC | 20 | 557 |
| SCNN1A-409 | + | CUCCCCUUGGAAGGGACAGC | 20 | 4258 |
| SCNN1A-17 | − | CAAGCGUGAGGAGCAGGGGC | 20 | 563 |
| SCNN1A-38 | + | AGGGUGCAGAUGGUCACUGC | 20 | 575 |
| SCNN1A-65 | + | CCUCCUCCGCCGUGGGCUGC | 20 | 594 |
| SCNN1A-49 | + | CCGUCUUCAUGCGGUUGUGC | 20 | 582 |
| SCNN1A-61 | + | AGGAGCGGUGGAACUCGAUC | 20 | 591 |
| SCNN1A-410 | − | UUGCUCUCCCCAAUCCACUC | 20 | 4259 |
| SCNN1A-411 | + | UCAGGGUCAAGGCUGAGCUC | 20 | 4260 |
| SCNN1A-28 | − | ACCGCAUGAAGACGGCCUUC | 20 | 570 |
| SCNN1A-70 | + | UGCUGGGGCGCCGCAGGUUC | 20 | 598 |
| SCNN1A-412 | − | AUCCAGCUGUCCCUUCCAAG | 20 | 4261 |
| SCNN1A-413 | − | UGGGACAUGGGCAUGGCCAG | 20 | 4262 |
| SCNN1A-414 | − | CAGCCUCACUCGGGUUCCAG | 20 | 4263 |
| SCNN1A-415 | + | AGACCUGGUAUGGGCUGCAG | 20 | 4264 |
| SCNN1A-59 | + | CGAAGAGCUCUCGGUAGGAG | 20 | 589 |
| SCNN1A-4 | − | CCAUACCAGGUCUCAUGGAG | 20 | 498 |
| SCNN1A-63 | + | CAGGGCCUCCUCCUCCGCCG | 20 | 592 |
| SCNN1A-52 | + | UGUGCUGGGAGCACACCAGG | 20 | 584 |
| SCNN1A-23 | − | CCAGCAGCCCACGGCGGAGG | 20 | 566 |
| SCNN1A-60 | + | AGAGCUCUCGGUAGGAGCGG | 20 | 590 |
| SCNN1A-416 | − | CAGCUGUCCCUUCCAAGGGG | 20 | 4265 |
| SCNN1A-75 | + | AGCCCUGGAGUGGACUGUGG | 20 | 602 |
| SCNN1A-48 | + | CCCAGAAGGCCGUCUUCAUG | 20 | 581 |
| SCNN1A-74 | + | AUGAGCCCUGGAGUGGACUG | 20 | 601 |
| SCNN1A-67 | + | UCCUCCGCCGUGGGCUGCUG | 20 | 596 |
| SCNN1A-417 | + | UCACCCCUGGAACCCGAGUG | 20 | 4266 |
| SCNN1A-13 | − | CAUGAAGGGGAACAAGCGUG | 20 | 562 |
| SCNN1A-418 | + | UAACCGACCUGUAGGGAUUG | 20 | 4267 |
| SCNN1A-419 | + | AUGAGCCCCGGAGUGGAUUG | 20 | 4268 |

TABLE 43B-continued

2nd Tier

| gRNA Name | DNA Strand | Targeting Domain | Target Site Length | Seq ID |
|---|---|---|---|---|
| SCNN1A-40 | + | AGACGAGCUUGUCCGAGUUG | 20 | 576 |
| SCNN1A-41 | + | CCGAGUUGAGGUUGAUGUUG | 20 | 577 |
| SCNN1A-420 | + | UCAUGAGCCCCGGAGUGGAU | 20 | 4269 |
| SCNN1A-421 | − | ACUCGGGUUCCAGGGGUGAU | 20 | 4270 |
| SCNN1A-79 | + | CCCUCCAUGAGACCUGGUAU | 20 | 604 |
| SCNN1A-35 | − | CCUCAACAUCAACCUCAACU | 20 | 574 |
| SCNN1A-18 | − | AAGCGUGAGGAGCAGGGGCU | 20 | 564 |
| SCNN1A-66 | + | CUCCUCCGCCGUGGGCUGCU | 20 | 595 |
| SCNN1A-50 | + | CGUCUUCAUGCGGUUGUGCU | 20 | 583 |
| SCNN1A-57 | + | AGAAGAACUCGAAGAGCUCU | 20 | 588 |
| SCNN1A-422 | + | CAGGGUCAAGGCUGAGCUCU | 20 | 4271 |
| SCNN1A-29 | − | CCGCAUGAAGACGGCCUUCU | 20 | 571 |
| SCNN1A-64 | + | AGGGCCUCCUCCUCCGCCGU | 20 | 593 |
| SCNN1A-423 | − | CACCCUCAAUCCCUACAGGU | 20 | 4272 |
| SCNN1A-424 | + | AGAGGGACUAACCGACCUGU | 20 | 4273 |
| SCNN1A-425 | + | CAUGAGCCCCGGAGUGGAUU | 20 | 4274 |
| SCNN1A-69 | + | CUGCUGGGGCGCCGCAGGUU | 20 | 597 |
| SCNN1A-34 | − | UGGCAAUUCGGCCUGCUUUU | 20 | 573 |

Table 43C provides exemplary targeting domains for knocking out the SCNN1A gene selected according to the third tier parameters. The targeting domains bind within the first 500 bp of the coding sequence (e.g., with 500 bp downstream from the start codon) and start with a 5'G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 43C

3rd Tier

| gRNA Name | DNA Strand | Targeting Domain | Target Site Length | Seq ID |
|---|---|---|---|---|
| SCNN1A-426 | − | GGACAUGGGCAUGGCCA | 17 | 4275 |
| SCNN1A-427 | + | GUGGAUUGGGGAGAGCA | 17 | 4276 |
| SCNN1A-428 | + | GGGGAGAGCAAGGGUCA | 17 | 4277 |
| SCNN1A-115 | + | GGGAUUGAGGGUGCAGA | 17 | 542 |
| SCNN1A-134 | + | GCGGAUGGCGCCGUGGA | 17 | 548 |
| SCNN1A-429 | − | GGGACAUGGGCAUGGCC | 17 | 4278 |
| SCNN1A-86 | − | GAACAAGCUGGAGGAGC | 17 | 531 |

TABLE 43C-continued

3rd Tier

| gRNA Name | DNA Strand | Targeting Domain | Target Site Length | Seq ID |
|---|---|---|---|---|
| SCNN1A-96 | − | GCGUGAGGAGCAGGGGC | 17 | 534 |
| SCNN1A-430 | + | GGGUCAAGGCUGAGCUC | 17 | 4279 |
| SCNN1A-100 | − | GCCCCAGCAGCCCACGG | 17 | 537 |
| SCNN1A-135 | + | GAUGGCGCCGUGGAUGG | 17 | 549 |
| SCNN1A-431 | − | GAAGGGGAACAAGCUGG | 17 | 4280 |
| SCNN1A-85 | − | GGAGGGGAACAAGCUGG | 17 | 530 |
| SCNN1A-92 | − | GAAGGGGAACAAGCUG | 17 | 532 |
| SCNN1A-432 | + | GAGUGGAUUGGGGAGAGCAA | 20 | 4281 |
| SCNN1A-9 | − | GCCCUCCACAGUCCACUCCA | 20 | 499 |
| SCNN1A-433 | + | GGAGUGGAUUGGGGAGAGCA | 20 | 4282 |
| SCNN1A-434 | + | GAGAGCAAGGGUCAGGGUCA | 20 | 4283 |
| SCNN1A-47 | + | GAGCCACAGCACUGCCCAGA | 20 | 521 |
| SCNN1A-435 | − | GUUCCAGGGGUGAUGGGAGA | 20 | 4284 |

TABLE 43C-continued

3rd Tier

| gRNA Name | DNA Strand | Targeting Domain | Target Site Length | Seq ID |
|---|---|---|---|---|
| SCNN1A-7 | − | GGGGAACAAGCUGGAGGAGC | 20 | 504 |
| SCNN1A-14 | − | GGGGAACAAGCGUGAGGAGC | 20 | 506 |
| SCNN1A-436 | − | GGUUCCAGGGGUGAUGGGAG | 20 | 4285 |
| SCNN1A-24 | − | GCAGCCCACGGCGGAGGAGG | 20 | 512 |
| SCNN1A-56 | + | GCGGAUGGCGCCGUGGAUGG | 20 | 523 |
| SCNN1A-437 | − | GUAAGCAAGGGAACCUGGUU | 20 | 4286 |

Table 43D provides exemplary targeting domains for knocking out the SCNN1A gene selected according to the fourth tier parameters. The targeting domains bind within the first 500 bp of the coding sequence (e.g., with 500 bp downstream from the start codon). It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 43D

4th Tier

| gRNA Name | DNA Strand | Targeting Domain | Target Site Length | Seq ID |
|---|---|---|---|---|
| SCNN1A-438 | + | UGGAUUGGGGAGAGCAA | 17 | 4287 |
| SCNN1A-439 | − | UCCAGCUGUCCCUUCCA | 17 | 4288 |
| SCNN1A-440 | − | AGGGUGGGACAUGGGCA | 17 | 4289 |
| SCNN1A-441 | + | AGCAAGGGUCAGGGUCA | 17 | 4290 |
| SCNN1A-442 | + | ACCAGGGAAGGGGCAGA | 17 | 4291 |
| SCNN1A-443 | − | CCAGGGGUGAUGGGAGA | 17 | 4292 |
| SCNN1A-155 | + | CUGGAGUGGACUGUGGA | 17 | 652 |
| SCNN1A-444 | + | UGGGCUGCAGAGGUCUA | 17 | 4293 |
| SCNN1A-445 | − | AGGUAAGCAAGGGAACC | 17 | 4294 |
| SCNN1A-446 | + | CCCUCUCCCAUCACCCC | 17 | 4295 |
| SCNN1A-151 | + | UUCCCCUUCAUGAGCCC | 17 | 648 |
| SCNN1A-447 | − | UCCCUCUGCCCCUUCCC | 17 | 4296 |
| SCNN1A-105 | − | CCACGGCGCCAUCCGCC | 17 | 618 |
| SCNN1A-448 | − | UCCAGGGGUGAUGGGAG | 17 | 4297 |
| SCNN1A-83 | − | UACCAGGUCUCAUGGAG | 17 | 606 |
| SCNN1A-133 | + | CCAGGCGGAUGGCGCCG | 17 | 638 |
| SCNN1A-154 | + | CCUGGAGUGGACUGUGG | 17 | 651 |
| SCNN1A-153 | + | AGCCCUGGAGUGGACUG | 17 | 650 |
| SCNN1A-109 | − | CCUUCUGGGCAGUGCUG | 17 | 620 |

TABLE 43D-continued

4th Tier

| gRNA Name | DNA Strand | Targeting Domain | Target Site Length | Seq ID |
|---|---|---|---|---|
| SCNN1A-449 | − | CCAGGGGCAGCCUCACU | 17 | 4298 |
| SCNN1A-450 | + | CUCAUGAUACCUCCCCU | 17 | 4299 |
| SCNN1A-11 | − | UCCACUCCAGGGCUCAUGAA | 20 | 560 |
| SCNN1A-451 | − | UCCACUCCGGGGCUCAUGAA | 20 | 4300 |
| SCNN1A-452 | − | CGCAGGGUGGGACAUGGGCA | 20 | 4301 |
| SCNN1A-55 | + | CAGGCGGAUGGCGCCGUGGA | 20 | 587 |
| SCNN1A-77 | + | UUGUUCCCCUCCAUGAGACC | 20 | 603 |
| SCNN1A-72 | + | UUGUUCCCCUUCAUGAGCCC | 20 | 599 |
| SCNN1A-26 | − | CAUCCACGGCGCCAUCCGCC | 20 | 568 |
| SCNN1A-12 | − | CCACUCCAGGGCUCAUGAAG | 20 | 561 |
| SCNN1A-453 | − | CCACUCCGGGGCUCAUGAAG | 20 | 4302 |
| SCNN1A-454 | + | CCCCUUCAUGAGCCCCGGAG | 20 | 4303 |
| SCNN1A-73 | + | CCCCUUCAUGAGCCCUGGAG | 20 | 600 |
| SCNN1A-54 | + | ACACCAGGCGGAUGGCGCCG | 20 | 586 |
| SCNN1A-455 | − | CAUGAAGGGGAACAAGCUGG | 20 | 4304 |
| SCNN1A-6 | − | CAUGGAGGGGAACAAGCUGG | 20 | 558 |
| SCNN1A-30 | − | CGGCCUUCUGGGCAGUGCUG | 20 | 572 |
| SCNN1A-456 | − | UGGCCAGGGGCAGCCUCACU | 20 | 4305 |
| SCNN1A-457 | + | CUGCUCAUGAUACCUCCCCU | 20 | 4306 |

Table 43E provides exemplary targeting domains for knocking out the SCNN1A gene selected according to the fifth tier parameters. The targeting domains fall in the coding sequence of the gene, downstream of the first 500 bp of coding sequence (e.g., anywhere from +500 (relative to the start codon) to the stop codon of the gene). It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 43E

5th Tier

| gRNA Name | DNA Strand | Targeting Domain | Target Site Length | Seq ID |
|---|---|---|---|---|
| SCNN1A-458 | − | GCCCCACACCUAAGAAA | 17 | 4307 |
| SCNN1A-459 | − | AUGCCUGGAAUCAACAA | 17 | 4308 |
| SCNN1A-460 | + | ACCCUCAGGCGCUGCAA | 17 | 4309 |
| SCNN1A-461 | + | CCAUUCCUAGGAAAGAA | 17 | 4310 |
| SCNN1A-462 | − | GGCGACUGCACCAAGAA | 17 | 4311 |
| SCNN1A-463 | + | ACGCUGGGGAUGGAGAA | 17 | 4312 |

TABLE 43E-continued

5th Tier

| gRNA Name | DNA Strand | Targeting Domain | Target Site Length | Seq ID |
|---|---|---|---|---|
| SCNN1A-464 | - | CCAUUCUUUCCUAGGAA | 17 | 4313 |
| SCNN1A-465 | + | AACCUGUACCCGGGGAA | 17 | 4314 |
| SCNN1A-466 | - | AGGUAGAGUGUGGGGAA | 17 | 4315 |
| SCNN1A-467 | + | UGAAUACACACCUGGAA | 17 | 4316 |
| SCNN1A-468 | + | AUUUCCGGGUACCUGAA | 17 | 4317 |
| SCNN1A-469 | + | GCUGUGUGUACUUUGAA | 17 | 4318 |
| SCNN1A-470 | + | GCCACCAUCAUCCAUAA | 17 | 4319 |
| SCNN1A-471 | + | UGUACUUUGAAGGGUAA | 17 | 4320 |
| SCNN1A-472 | - | GACUGGGGCCCGGGUAA | 17 | 4321 |
| SCNN1A-473 | - | AUCUCUCUGUACCCACA | 17 | 4322 |
| SCNN1A-474 | + | GGACAAGGACAGAGACA | 17 | 4323 |
| SCNN1A-475 | + | AGGGCCUGGCUGGGACA | 17 | 4324 |
| SCNN1A-476 | - | AGAGGUUUCUCACACCA | 17 | 4325 |
| SCNN1A-477 | + | UCUUGUGGCUGGGACCA | 17 | 4326 |
| SCNN1A-478 | + | AGAUGGGCGGGGGCCCA | 17 | 4327 |
| SCNN1A-479 | + | AGGAGGGGAGGAUGCCA | 17 | 4328 |
| SCNN1A-480 | - | CCUGGGGUGAGACUCCA | 17 | 4329 |
| SCNN1A-481 | + | CAGCGUGUCCUCCUCCA | 17 | 4330 |
| SCNN1A-482 | - | GCUCCCUGCUUGCUCCA | 17 | 4331 |
| SCNN1A-483 | - | GCCCCCGCCCAUCUCCA | 17 | 4332 |
| SCNN1A-484 | + | GCCCCCAAGUCUGUCCA | 17 | 4333 |
| SCNN1A-485 | + | GCGCCAUGGAGCAAGCA | 17 | 4334 |
| SCNN1A-486 | + | AGUCACUGUGGACAGCA | 17 | 4335 |
| SCNN1A-487 | + | AGGCUGGAGAGGGAGCA | 17 | 4336 |
| SCNN1A-488 | - | UCAGCAUGAGGAAGGCA | 17 | 4337 |
| SCNN1A-489 | + | GUUGUUGAUUCCAGGCA | 17 | 4338 |
| SCNN1A-490 | + | CCAGGGUGGCAUAGGCA | 17 | 4339 |
| SCNN1A-491 | - | UCCAGGCCGAGGGGGCA | 17 | 4340 |
| SCNN1A-492 | + | GGGGACACUAACCUGCA | 17 | 4341 |
| SCNN1A-493 | + | GACCCUCAGGCGCUGCA | 17 | 4342 |
| SCNN1A-494 | - | CUCCAGGGGGCUCUGCA | 17 | 4343 |
| SCNN1A-495 | - | GCCCGGGUAAUGGUGCA | 17 | 4344 |
| SCNN1A-496 | + | CUCUGCGCGCAGCAUCA | 17 | 4345 |
| SCNN1A-497 | - | ACCAGACAUACUCAUCA | 17 | 4346 |
| SCNN1A-498 | + | GAAUGGGGUGUCAUCA | 17 | 4347 |
| SCNN1A-499 | - | CCAGGAGAGCAUGAUCA | 17 | 4348 |
| SCNN1A-500 | - | GUCCCGCCCCCGCCUCA | 17 | 4349 |
| SCNN1A-501 | + | CCUCUCCUUCCCUCUCA | 17 | 4350 |
| SCNN1A-502 | + | AGGGGGAGGGGCUGUCA | 17 | 4351 |
| SCNN1A-503 | - | UGAGUCUCCCUCUGUCA | 17 | 4352 |
| SCNN1A-504 | - | AGUCAACAUCUUCUUCA | 17 | 4353 |
| SCNN1A-505 | + | AAGGGGCGAGGGGAAGA | 17 | 4354 |
| SCNN1A-506 | - | ACCUCUCCUCUCACAGA | 17 | 4355 |
| SCNN1A-507 | + | CGACCUACCGUGACAGA | 17 | 4356 |
| SCNN1A-508 | + | CUUAGGUGUGGGCAGA | 17 | 4357 |
| SCNN1A-509 | + | CAGAGACUAGAGUCAGA | 17 | 4358 |
| SCNN1A-510 | + | GGAGGGUGGAGAGGAGA | 17 | 4359 |
| SCNN1A-511 | + | GCAGAGCCCCUGGAGA | 17 | 4360 |
| SCNN1A-512 | + | GCUGUCAAGGCUGGAGA | 17 | 4361 |
| SCNN1A-513 | - | GUUGUCUGUGGUGGAGA | 17 | 4362 |
| SCNN1A-514 | - | CUGGGGGGGCCCUGAGA | 17 | 4363 |
| SCNN1A-515 | - | CUGCUGGUUACUCACGA | 17 | 4364 |
| SCNN1A-516 | + | GAGAGGUACAUUGACGA | 17 | 4365 |
| SCNN1A-517 | + | ACCUGGGAUGUCACCGA | 17 | 4366 |
| SCNN1A-518 | - | GAGGCCCGCAGCGCCGA | 17 | 4367 |
| SCNN1A-519 | - | ACUGGUCUCCAGGCCGA | 17 | 4368 |
| SCNN1A-520 | - | UCCUCAUGCUGCUCCGA | 17 | 4369 |
| SCNN1A-521 | + | UCCCCCGCAGGUCGCGA | 17 | 4370 |
| SCNN1A-522 | + | GGUACCUGAAGGGGCGA | 17 | 4371 |
| SCNN1A-523 | + | CCACGCUACGGGCUCGA | 17 | 4372 |
| SCNN1A-524 | + | GGCAGAAGUGGGAAGGA | 17 | 4373 |
| SCNN1A-525 | + | GCCCAGGUUGGACAGGA | 17 | 4374 |
| SCNN1A-526 | + | ACACCUGGAAGGGAGGA | 17 | 4375 |
| SCNN1A-527 | - | CUCCAUCAGCAUGAGGA | 17 | 4376 |
| SCNN1A-528 | - | AGAGUGUGGGGAAGGGA | 17 | 4377 |
| SCNN1A-529 | + | GUGUCCUCCUCCAGGGA | 17 | 4378 |
| SCNN1A-530 | - | GGGGGCCCUGAGAGGGA | 17 | 4379 |
| SCNN1A-531 | + | CAACCUGUACCCGGGGA | 17 | 4380 |
| SCNN1A-532 | + | UGGCAUAGGCAGGGGA | 17 | 4381 |
| SCNN1A-533 | + | GCUGGUCACGCUGGGGA | 17 | 4382 |
| SCNN1A-534 | - | CAGGUAGAGUGUGGGGA | 17 | 4383 |
| SCNN1A-535 | + | UGGGGCAGAAGUGGGA | 17 | 4384 |
| SCNN1A-536 | - | CCCCCAGGUGGACUGGA | 17 | 4385 |
| SCNN1A-537 | + | GUGAAUACACACCUGGA | 17 | 4386 |

TABLE 43E-continued

5th Tier

| gRNA Name | DNA Strand | Targeting Domain | Target Site Length | Seq ID |
|---|---|---|---|---|
| SCNN1A-538 | - | UGACUGGGAGGCCUGGA | 17 | 4387 |
| SCNN1A-539 | - | GGUAGGUCGUGCCUGGA | 17 | 4388 |
| SCNN1A-540 | - | CCUGCCUUUAUGGAUGA | 17 | 4389 |
| SCNN1A-541 | + | AAUUUCCGGGUACCUGA | 17 | 4390 |
| SCNN1A-542 | - | CCCCUUGCAGCGCCUGA | 17 | 4391 |
| SCNN1A-543 | + | UGCCUUCCUCAUGCUGA | 17 | 4392 |
| SCNN1A-544 | - | AGGGGUGGAUGCGGUGA | 17 | 4393 |
| SCNN1A-545 | + | GGCCACGAGAGUGGUGA | 17 | 4394 |
| SCNN1A-546 | + | UGACCUCUUGUUGUUGA | 17 | 4395 |
| SCNN1A-547 | + | UGCUGUGUGUACUUUGA | 17 | 4396 |
| SCNN1A-548 | - | CUCUCUCUUUCCUGAUA | 17 | 4397 |
| SCNN1A-549 | + | CAUCAGGGACAGACCUA | 17 | 4398 |
| SCNN1A-550 | + | AGCUGGAGGCCACGCUA | 17 | 4399 |
| SCNN1A-551 | + | UCAGGAAAGAGAGAGUA | 17 | 4400 |
| SCNN1A-552 | - | UUCCACCACCCGAUGUA | 17 | 4401 |
| SCNN1A-553 | - | AGACUUGGGGGCGAUUA | 17 | 4402 |
| SCNN1A-554 | - | GGAUGAACCUGCCUUUA | 17 | 4403 |
| SCNN1A-555 | + | GGGUAAAGGUUCUCAAC | 17 | 4404 |
| SCNN1A-556 | + | AGGACAGGUGGAGGAAC | 17 | 4405 |
| SCNN1A-557 | + | CCGAGGAGCCGAACCAC | 17 | 4406 |
| SCNN1A-558 | - | CAUCUCUCUGUACCCAC | 17 | 4407 |
| SCNN1A-559 | + | CGAACCACAGGCUCCAC | 17 | 4408 |
| SCNN1A-560 | - | CCCGGGUAAUGGUGCAC | 17 | 4409 |
| SCNN1A-561 | + | AUUUGUUCUGGUUGCAC | 17 | 4410 |
| SCNN1A-562 | - | UCCCGCCCCCGCCUCAC | 17 | 4411 |
| SCNN1A-563 | + | UCUCUGGCAGCCUCGAC | 17 | 4412 |
| SCNN1A-564 | + | CACGCUACGGGCUCGAC | 17 | 4413 |
| SCNN1A-565 | - | AGGUGGACUGGAAGGAC | 17 | 4414 |
| SCNN1A-566 | + | GGGCCCCCCCAGAGGAC | 17 | 4415 |
| SCNN1A-567 | - | ACAACCCCCAGGUGGAC | 17 | 4416 |
| SCNN1A-568 | + | GGCUGCCCAGGUUGGAC | 17 | 4417 |
| SCNN1A-569 | - | AAGGCAAGGAUGCUGAC | 17 | 4418 |
| SCNN1A-570 | - | CUGCUGUCCACAGUGAC | 17 | 4419 |
| SCNN1A-571 | - | GGUUCCGAAGCCGAUAC | 17 | 4420 |
| SCNN1A-572 | + | GCUGGAGGCCACGCUAC | 17 | 4421 |
| SCNN1A-573 | - | UCCCCUUCCCCGGGUAC | 17 | 4422 |
| SCNN1A-574 | + | AGGAGCUGUAUUUGUAC | 17 | 4423 |
| SCNN1A-575 | - | CACCCUCCUGUCCAACC | 17 | 4424 |
| SCNN1A-576 | - | CCAGGUCUCCUGCAACC | 17 | 4425 |
| SCNN1A-577 | + | CUGAGGAGAAGUCAACC | 17 | 4426 |
| SCNN1A-578 | - | CGCCUGCCGCUUCAACC | 17 | 4427 |
| SCNN1A-579 | + | AGGAGUGAAUACACACC | 17 | 4428 |
| SCNN1A-580 | - | CUUCUCCUCAGACCACC | 17 | 4429 |
| SCNN1A-581 | + | AGUCCUUCCAGUCCACC | 17 | 4430 |
| SCNN1A-582 | + | CCUGGUUGCAGGAGACC | 17 | 4431 |
| SCNN1A-583 | + | CUUCCCCACACUCUACC | 17 | 4432 |
| SCNN1A-584 | - | UCGCCCCUUCAGGUACC | 17 | 4433 |
| SCNN1A-585 | + | GCCCGUGCACCAUUACC | 17 | 4434 |
| SCNN1A-586 | - | GGGUUCAUAGGAAACCC | 17 | 4435 |
| SCNN1A-587 | - | CCCUGCCUAUGCCACCC | 17 | 4436 |
| SCNN1A-588 | - | GGAGGUAGCCUCCACCC | 17 | 4437 |
| SCNN1A-589 | + | CCCGUGCACCAUUACCC | 17 | 4438 |
| SCNN1A-590 | + | CCCUGGAGUCUCACCCC | 17 | 4439 |
| SCNN1A-591 | - | GCGGGACAACAACCCCC | 17 | 4440 |
| SCNN1A-592 | + | GCCCCUGCAGAGCCCCC | 17 | 4441 |
| SCNN1A-593 | - | UUAGUGUCCCCUUCCCC | 17 | 4442 |
| SCNN1A-594 | + | ACUUGGUGAAACAGCCC | 17 | 4443 |
| SCNN1A-595 | + | GAGAUGGGCGGGGGCCC | 17 | 4444 |
| SCNN1A-596 | - | CACAGUGACUGGGGCCC | 17 | 4445 |
| SCNN1A-597 | - | AGAGGUCAGUCCUGCCC | 17 | 4446 |
| SCNN1A-598 | + | GGCUCCACUGGCUGCCC | 17 | 4447 |
| SCNN1A-599 | - | GCCCUCGGUGACAUCCC | 17 | 4448 |
| SCNN1A-600 | - | AGAGACUCUGCCAUCCC | 17 | 4449 |
| SCNN1A-601 | + | GCAGGUGGGGGCUCCC | 17 | 4450 |
| SCNN1A-602 | - | GUUAGUGUCCCCUUCCC | 17 | 4451 |
| SCNN1A-603 | - | CUGUCCUUGUCCCAGCC | 17 | 4452 |
| SCNN1A-604 | + | AUGGAGGUCUCCACGCC | 17 | 4453 |
| SCNN1A-605 | + | CAGGACUGACUCACGCC | 17 | 4454 |
| SCNN1A-606 | - | AUGCUGACUGGGAGGCC | 17 | 4455 |
| SCNN1A-607 | - | GGCUUUAACUUGCGGCC | 17 | 4456 |
| SCNN1A-608 | + | CCCCUGCCCCCUCGGCC | 17 | 4457 |
| SCNN1A-609 | + | GGAGAGGGAGCAGGGCC | 17 | 4458 |
| SCNN1A-610 | - | CCACAGUGACUGGGGCC | 17 | 4459 |
| SCNN1A-611 | - | UGGAUGUCUUCCAUGCC | 17 | 4460 |

TABLE 43E-continued

5th Tier

| gRNA Name | DNA Strand | Targeting Domain | Target Site Length | Seq ID |
|---|---|---|---|---|
| SCNN1A-612 | + | AAGGAGGGGAGGAUGCC | 17 | 4461 |
| SCNN1A-613 | - | CGUGAGUCAGUCCUGCC | 17 | 4462 |
| SCNN1A-614 | - | UCACGGUAGGUCGUGCC | 17 | 4463 |
| SCNN1A-615 | + | CAUCACAGGCUCCAUCC | 17 | 4464 |
| SCNN1A-616 | - | UCCUGGGGUGAGACUCC | 17 | 4465 |
| SCNN1A-617 | + | CCAGCGUGUCCUCCUCC | 17 | 4466 |
| SCNN1A-618 | - | CUGCUACUAUAAGCUCC | 17 | 4467 |
| SCNN1A-619 | - | GGCCCCGCCCAUCUCC | 17 | 4468 |
| SCNN1A-620 | + | CCUUGAUCAUGCUCUCC | 17 | 4469 |
| SCNN1A-621 | - | AGCCGAUACUGGUCUCC | 17 | 4470 |
| SCNN1A-622 | + | CGCCCCCAAGUCUGUCC | 17 | 4471 |
| SCNN1A-623 | + | UCACCGUUGUUGAUUCC | 17 | 4472 |
| SCNN1A-624 | - | CCACCCUCCUCCCUUCC | 17 | 4473 |
| SCNN1A-625 | - | UAUUCACUCCUGCUUCC | 17 | 4474 |
| SCNN1A-626 | - | ACAGAAAGCACAGUUCC | 17 | 4475 |
| SCNN1A-627 | + | GCUCCUCUUUAAUUCC | 17 | 4476 |
| SCNN1A-628 | + | GGCGCCAUGGAGCAAGC | 17 | 4477 |
| SCNN1A-629 | + | GUUGUUGUCCCGCAAGC | 17 | 4478 |
| SCNN1A-630 | + | CAUGCUCUCCUGGAAGC | 17 | 4479 |
| SCNN1A-631 | - | UUCAAGUACACACAGC | 17 | 4480 |
| SCNN1A-632 | + | CAGUCACUGUGGACAGC | 17 | 4481 |
| SCNN1A-633 | + | CUGCGGGCCUCACCAGC | 17 | 4482 |
| SCNN1A-634 | + | GGAACAUGAUGACCAGC | 17 | 4483 |
| SCNN1A-635 | - | GAAGAUCGGCUUCCAGC | 17 | 4484 |
| SCNN1A-636 | + | AGUAACCAGCAGAGAGC | 17 | 4485 |
| SCNN1A-637 | - | GGAAAUUAAAGAGGAGC | 17 | 4486 |
| SCNN1A-638 | - | AGAGGAGCUGGAGGAGC | 17 | 4487 |
| SCNN1A-639 | + | AAGGCUGGAGAGGGAGC | 17 | 4488 |
| SCNN1A-640 | + | GCGACGGCUGCGGGAGC | 17 | 4489 |
| SCNN1A-641 | + | AGCAGAGAGCUGGUAGC | 17 | 4490 |
| SCNN1A-642 | - | CCUGGAGGAGGACACGC | 17 | 4491 |
| SCNN1A-643 | + | CUGGUAGCUGGUCACGC | 17 | 4492 |
| SCNN1A-644 | + | GCGGCAGAGUCCCCGC | 17 | 4493 |
| SCNN1A-645 | + | CCAUCAUCCAUAAAGGC | 17 | 4494 |
| SCNN1A-646 | + | GGAGGGGCUGUCAAGGC | 17 | 4495 |
| SCNN1A-647 | + | AGAGCAAGGAGCCAGGC | 17 | 4496 |
| SCNN1A-648 | + | GACGGGCCCCGUGAGGC | 17 | 4497 |
| SCNN1A-649 | + | CCCAGGGUGGCAUAGGC | 17 | 4498 |
| SCNN1A-650 | + | GACCUGGUUGAAGCGGC | 17 | 4499 |
| SCNN1A-651 | + | GUGGCUGGGACCAGGGC | 17 | 4500 |
| SCNN1A-652 | - | GGUAAUGGUGCACGGGC | 17 | 4501 |
| SCNN1A-653 | - | CUCCAGGCCGAGGGGGC | 17 | 4502 |
| SCNN1A-654 | + | CCCCGUGAGGCGGGGGC | 17 | 4503 |
| SCNN1A-655 | + | GCCCCUGGAGAUGGGC | 17 | 4504 |
| SCNN1A-656 | + | AGGGAGCAGGGCCUGGC | 17 | 4505 |
| SCNN1A-657 | - | UUCACCACUCUCGUGGC | 17 | 4506 |
| SCNN1A-658 | - | AGUGCCGGAAGCCAUGC | 17 | 4507 |
| SCNN1A-659 | - | CAGCCGUCGCGACCUGC | 17 | 4508 |
| SCNN1A-660 | - | GCUCGUCUUUGACCUGC | 17 | 4509 |
| SCNN1A-661 | + | GGGCCCCUCGGCGCUGC | 17 | 4510 |
| SCNN1A-662 | + | CAGGUCGCGACGGCUGC | 17 | 4511 |
| SCNN1A-663 | - | UCUCCAGGGGGCUCUGC | 17 | 4512 |
| SCNN1A-664 | - | AGCUACCAGCUCUCUGC | 17 | 4513 |
| SCNN1A-665 | - | GCUGUUUCACCAAGUGC | 17 | 4514 |
| SCNN1A-666 | - | CGUGGCCUCCAGCUUGC | 17 | 4515 |
| SCNN1A-667 | + | GACUCACGCCUGGUUGC | 17 | 4516 |
| SCNN1A-668 | + | AGCAGUUCCAUACAUC | 17 | 4517 |
| SCNN1A-669 | + | GCUCUGCGCGCAGCAUC | 17 | 4518 |
| SCNN1A-670 | + | UCUGUCGCGAUAGCAUC | 17 | 4519 |
| SCNN1A-671 | - | UACCAGACAUACUCAUC | 17 | 4520 |
| SCNN1A-672 | + | GAGAGUAAUUCCUUAUC | 17 | 4521 |
| SCNN1A-673 | - | AGAACAACUCCAACCUC | 17 | 4522 |
| SCNN1A-674 | + | GCGGGGCGGGACCCUC | 17 | 4523 |
| SCNN1A-675 | - | UUCCUCCACCUGUCCUC | 17 | 4524 |
| SCNN1A-676 | - | AGGGGGCAGGGGUGCUC | 17 | 4525 |
| SCNN1A-677 | + | ACCUCUCCUUCCCUCUC | 17 | 4526 |
| SCNN1A-678 | + | AGGGAUGGCAGAGUCUC | 17 | 4527 |
| SCNN1A-679 | + | GCGAGGGGAAGAGGGUC | 17 | 4528 |
| SCNN1A-680 | + | CCCCUGAUGAGUAUGUC | 17 | 4529 |
| SCNN1A-681 | - | CUUCCCCUCGCCCCUUC | 17 | 4530 |
| SCNN1A-682 | + | CUAACCUGCAUGGCUUC | 17 | 4531 |
| SCNN1A-683 | + | CACAGUACUCCACGUUC | 17 | 4532 |
| SCNN1A-684 | + | AGCAGUCCGAUUUGUUC | 17 | 4533 |
| SCNN1A-685 | + | AGCUCCUCUUUAAUUUC | 17 | 4534 |

TABLE 43E-continued

5th Tier

| gRNA Name | DNA Strand | Targeting Domain | Target Site Length | Seq ID |
|---|---|---|---|---|
| SCNN1A-686 | − | GUACCCGGAAAUUAAAG | 17 | 4535 |
| SCNN1A-687 | − | ACACCGUCAACAACAAG | 17 | 4536 |
| SCNN1A-688 | + | CCCUCAGGCGCUGCAAG | 17 | 4537 |
| SCNN1A-689 | + | UGGGGUGGGGCAGAAG | 17 | 4538 |
| SCNN1A-690 | + | GAAGGGGCGAGGGGAAG | 17 | 4539 |
| SCNN1A-691 | + | ACCUGUACCCGGGGAAG | 17 | 4540 |
| SCNN1A-692 | + | UGUUGAUGUAGUGGAAG | 17 | 4541 |
| SCNN1A-693 | + | UUUCCGGGUACCUGAAG | 17 | 4542 |
| SCNN1A-694 | + | AGGAGACCUGGUUGAAG | 17 | 4543 |
| SCNN1A-695 | + | ACGACCUACCGUGACAG | 17 | 4544 |
| SCNN1A-696 | + | UCUCAGGGCCCCCCCAG | 17 | 4545 |
| SCNN1A-697 | − | CCAACCUGGGCAGCCAG | 17 | 4546 |
| SCNN1A-698 | + | GCAUGGAAGACAUCCAG | 17 | 4547 |
| SCNN1A-699 | − | CCCCCGCCCAUCUCCAG | 17 | 4548 |
| SCNN1A-700 | + | GUCACUGUGGACAGCAG | 17 | 4549 |
| SCNN1A-701 | + | CAGGGUGGCAUAGGCAG | 17 | 4550 |
| SCNN1A-702 | − | CCAGGCCGAGGGGCAG | 17 | 4551 |
| SCNN1A-703 | + | UCUUAGGUGUGGGGCAG | 17 | 4552 |
| SCNN1A-704 | − | UCCAGGGGCUCUGCAG | 17 | 4553 |
| SCNN1A-705 | − | CCAGACAUACUCAUCAG | 17 | 4554 |
| SCNN1A-706 | + | ACAGAGACUAGAGUCAG | 17 | 4555 |
| SCNN1A-707 | + | AGAGACUAGAGUCAGAG | 17 | 4556 |
| SCNN1A-708 | + | GGAGCCGGCCACGAGAG | 17 | 4557 |
| SCNN1A-709 | − | AGGCCCGCAGCGCCGAG | 17 | 4558 |
| SCNN1A-710 | − | CUGGUCUCCAGGCCGAG | 17 | 4559 |
| SCNN1A-711 | + | GUACCUGAAGGGGCGAG | 17 | 4560 |
| SCNN1A-712 | − | CCCUGAGAGGGAAGGAG | 17 | 4561 |
| SCNN1A-713 | + | GCAGAAGUGGGAAGGAG | 17 | 4562 |
| SCNN1A-714 | + | AGGAGGGUGGAGAGGAG | 17 | 4563 |
| SCNN1A-715 | + | ACCAUCUGUGAGAGGAG | 17 | 4564 |
| SCNN1A-716 | − | UGGAUGCGGUGAGGGAG | 17 | 4565 |
| SCNN1A-717 | + | GGCAUAGGCAGGGGGAG | 17 | 4566 |
| SCNN1A-718 | − | ACACCUAAGAAAUGGAG | 17 | 4567 |
| SCNN1A-719 | + | GGCUGUCAAGGCUGGAG | 17 | 4568 |
| SCNN1A-720 | + | AAGGGAGGAGGGUGGAG | 17 | 4569 |
| SCNN1A-721 | − | UCUGGGGGGGCCCUGAG | 17 | 4570 |
| SCNN1A-722 | + | GGGUGACCAUCUGUGAG | 17 | 4571 |
| SCNN1A-723 | + | AUCAGGGACAGACCUAG | 17 | 4572 |
| SCNN1A-724 | + | ACAGGAUGUUGAUGUAG | 17 | 4573 |
| SCNN1A-725 | − | UCCGCGGCCCCAGAACG | 17 | 4574 |
| SCNN1A-726 | − | CCCGCCCCCGCCUCACG | 17 | 4575 |
| SCNN1A-727 | + | CACCACAGACAACACCG | 17 | 4576 |
| SCNN1A-728 | + | UACCUGGGAUGUCACCG | 17 | 4577 |
| SCNN1A-729 | − | UGAGGCCCGCAGCGCCG | 17 | 4578 |
| SCNN1A-730 | − | UACUGGUCUCCAGGCCG | 17 | 4579 |
| SCNN1A-731 | + | UCCACGUUCUGGGGCCG | 17 | 4580 |
| SCNN1A-732 | − | CCUACAUCUUCUAUCCG | 17 | 4581 |
| SCNN1A-733 | − | GGCCCAACCUGAUUCCG | 17 | 4582 |
| SCNN1A-734 | − | CCGUCGAGCCCGUAGCG | 17 | 4583 |
| SCNN1A-735 | + | ACGGGCCCCGUGAGGCG | 17 | 4584 |
| SCNN1A-736 | + | GGGUACCUGAAGGGGCG | 17 | 4585 |
| SCNN1A-737 | + | CCCCCUGGAGAUGGGCG | 17 | 4586 |
| SCNN1A-738 | − | UAACUUGCGGCCUGGCG | 17 | 4587 |
| SCNN1A-739 | − | AGCCGUCGCGACCUGCG | 17 | 4588 |
| SCNN1A-740 | − | CUCCUUCACCACUCUCG | 17 | 4589 |
| SCNN1A-741 | − | ACAUCAACAUCCUGUCG | 17 | 4590 |
| SCNN1A-742 | + | GGGCAGAAGUGGGAAGG | 17 | 4591 |
| SCNN1A-743 | + | CCCCCCCAGAGGACAGG | 17 | 4592 |
| SCNN1A-744 | + | UGCCCAGGUUGGACAGG | 17 | 4593 |
| SCNN1A-745 | − | GGACAACAACCCCCAGG | 17 | 4594 |
| SCNN1A-746 | + | UGGUGAAACAGCCCAGG | 17 | 4595 |
| SCNN1A-747 | − | CCCCGCCCAUCUCCAGG | 17 | 4596 |
| SCNN1A-748 | + | AGGGUGGCAUAGGCAGG | 17 | 4597 |
| SCNN1A-749 | − | GGGCAGGGGUGCUCAGG | 17 | 4598 |
| SCNN1A-750 | − | UGGUCUCCAGGCCGAGG | 17 | 4599 |
| SCNN1A-751 | + | CACACCUGGAAGGGAGG | 17 | 4600 |
| SCNN1A-752 | − | UCUGCCAUCCCUGGAGG | 17 | 4601 |
| SCNN1A-753 | + | CGACGGGCCCCGUGAGG | 17 | 4602 |
| SCNN1A-754 | + | CGGGCCCCGUGAGGCGG | 17 | 4603 |
| SCNN1A-755 | + | CCCCUGGAGAUGGGCGG | 17 | 4604 |
| SCNN1A-756 | − | GCCGUCGCGACCUGCGG | 17 | 4605 |
| SCNN1A-757 | + | AUACACCUGGAAGGG | 17 | 4606 |
| SCNN1A-758 | − | UGGGCGGGGCCCAGGG | 17 | 4607 |
| SCNN1A-759 | + | AGGGGAGGAUGCCAGGG | 17 | 4608 |

TABLE 43E-continued

5th Tier

| gRNA Name | DNA Strand | Targeting Domain | Target Site Length | Seq ID |
|---|---|---|---|---|
| SCNN1A-760 | + | AGGUGUGGGGCAGAGGG | 17 | 4609 |
| SCNN1A-761 | + | CCUGGAAGGGAGGAGGG | 17 | 4610 |
| SCNN1A-762 | + | AGUUUCCAUACAUCGGG | 17 | 4611 |
| SCNN1A-763 | − | GACAUACUCAUCAGGGG | 17 | 4612 |
| SCNN1A-764 | + | GAAGUGGGAAGGAGGGG | 17 | 4613 |
| SCNN1A-765 | + | GUGGCAUAGGCAGGGGG | 17 | 4614 |
| SCNN1A-766 | + | GCCCCGUGAGGCGGGGG | 17 | 4615 |
| SCNN1A-767 | + | AGGACAGAGACAUGGGG | 17 | 4616 |
| SCNN1A-768 | − | CCACCUGUCCUCUGGGG | 17 | 4617 |
| SCNN1A-769 | + | AGCCCCUGGAGAUGGG | 17 | 4618 |
| SCNN1A-770 | − | UGUGGGAAGGGAUGGG | 17 | 4619 |
| SCNN1A-771 | − | CAAGGAUGCUGACUGGG | 17 | 4620 |
| SCNN1A-772 | − | UCCACCUGUCCUCUGGG | 17 | 4621 |
| SCNN1A-773 | + | UUCCUAGGAAAGAAUGG | 17 | 4622 |
| SCNN1A-774 | − | GCCUUUAUGGAUGAUGG | 17 | 4623 |
| SCNN1A-775 | + | CUUCCUCAUGCUGAUGG | 17 | 4624 |
| SCNN1A-776 | + | CCUUCCAGUCCACCUGG | 17 | 4625 |
| SCNN1A-777 | − | GACUCUGCCAUCCCUGG | 17 | 4626 |
| SCNN1A-778 | + | GUUGUCCCGCAAGCUGG | 17 | 4627 |
| SCNN1A-779 | − | AAUUAAAGAGGAGCUGG | 17 | 4628 |
| SCNN1A-780 | − | CUCCACCUGUCCUCUGG | 17 | 4629 |
| SCNN1A-781 | + | CCCCAGAGGACAGGUGG | 17 | 4630 |
| SCNN1A-782 | + | GGAGGAUGCCAGGGUGG | 17 | 4631 |
| SCNN1A-783 | + | UUCCAUACAUCGGGUGG | 17 | 4632 |
| SCNN1A-784 | + | ACAGAGACAUGGGGUGG | 17 | 4633 |
| SCNN1A-785 | − | GGGGAAGGGAUGGGUGG | 17 | 4634 |
| SCNN1A-786 | − | CUCGGUGUUGUCUGUGG | 17 | 4635 |
| SCNN1A-787 | − | ACCCUGGACAGACUUGG | 17 | 4636 |
| SCNN1A-788 | + | AUUCCUAGGAAAGAAUG | 17 | 4637 |
| SCNN1A-789 | + | ACAAGGACAGAGACAUG | 17 | 4638 |
| SCNN1A-790 | + | ACCUUCGGAGCAGCAUG | 17 | 4639 |
| SCNN1A-791 | − | AGACCUCCAUCAGCAUG | 17 | 4640 |
| SCNN1A-792 | − | CUCAUCAGGGGUGGAUG | 17 | 4641 |
| SCNN1A-793 | + | GCGUCUGCUCUGUGAUG | 17 | 4642 |
| SCNN1A-794 | − | UGAUCUCUUGGUGUAUG | 17 | 4643 |
| SCNN1A-795 | + | CCGGGCCCCAGUCACUG | 17 | 4644 |
| SCNN1A-796 | − | GCUGUCCACAGUGACUG | 17 | 4645 |
| SCNN1A-797 | + | UCCUUCCAGUCCACCUG | 17 | 4646 |
| SCNN1A-798 | − | GCAGCCGUCGCGACCUG | 17 | 4647 |
| SCNN1A-799 | + | AUAGUAGCAGUACCCUG | 17 | 4648 |
| SCNN1A-800 | − | GCAGCCAGUGGAGCCUG | 17 | 4649 |
| SCNN1A-801 | − | ACCCCUUGCAGCGCCUG | 17 | 4650 |
| SCNN1A-802 | − | AGAAAGCACAGUUCCUG | 17 | 4651 |
| SCNN1A-803 | + | GGUAGCUGGUCACGCUG | 17 | 4652 |
| SCNN1A-804 | + | CGGGCCCCUCGGCGCUG | 17 | 4653 |
| SCNN1A-805 | + | GCAGGUCGCGACGGCUG | 17 | 4654 |
| SCNN1A-806 | − | CCUCCACCUGUCCUCUG | 17 | 4655 |
| SCNN1A-807 | + | ACAGCCCAGGUGGUCUG | 17 | 4656 |
| SCNN1A-808 | − | CUCCUCGGUGUUGUCUG | 17 | 4657 |
| SCNN1A-809 | + | CAGUACUCCACGUUCUG | 17 | 4658 |
| SCNN1A-810 | − | ACAUCCCAGGUAGAGUG | 17 | 4659 |
| SCNN1A-811 | − | AGCAUGAUCAAGGAGUG | 17 | 4660 |
| SCNN1A-812 | + | GCUCGACGGGCCCCGUG | 17 | 4661 |
| SCNN1A-813 | − | AGUACACACAGCAGGUG | 17 | 4662 |
| SCNN1A-814 | + | ACUCCAUUUCUUAGGUG | 17 | 4663 |
| SCNN1A-815 | − | CAGGGGUGGAUGCGGUG | 17 | 4664 |
| SCNN1A-816 | + | AGGCGCUGCAAGGGGUG | 17 | 4665 |
| SCNN1A-817 | + | GACAGAGACAUGGGGUG | 17 | 4666 |
| SCNN1A-818 | − | UGGGGAAGGGAUGGGUG | 17 | 4667 |
| SCNN1A-819 | − | UCGGCUUCCAGCUGGUG | 17 | 4668 |
| SCNN1A-820 | − | AUCCCAGGUAGAGUGUG | 17 | 4669 |
| SCNN1A-821 | + | UCCAUUUCUUAGGUGUG | 17 | 4670 |
| SCNN1A-822 | − | AUGGUGGCUUUAACUUG | 17 | 4671 |
| SCNN1A-823 | − | AACCCUGGACAGACUUG | 17 | 4672 |
| SCNN1A-824 | − | GCGUGGCCUCCAGCUUG | 17 | 4673 |
| SCNN1A-825 | − | GUGCAACCAGAACAAAU | 17 | 4674 |
| SCNN1A-826 | + | CAUUCCUAGGAAAGAAU | 17 | 4675 |
| SCNN1A-827 | + | AGAGGGAGACUCAGAAU | 17 | 4676 |
| SCNN1A-828 | − | CAUUCUUUCCUAGGAAU | 17 | 4677 |
| SCNN1A-829 | + | GACAAGGACAGAGACAU | 17 | 4678 |
| SCNN1A-830 | + | UAGCAGUUUCCAUACAU | 17 | 4679 |
| SCNN1A-831 | + | GGGGCCCAGGGUGGCAU | 17 | 4680 |
| SCNN1A-832 | − | GGUGUAUGUGGGUUCAU | 17 | 4681 |
| SCNN1A-833 | − | UGGAAGGACUGGAAGAU | 17 | 4682 |

TABLE 43E-continued

5th Tier

| gRNA Name | DNA Strand | Targeting Domain | Target Site Length | Seq ID |
|---|---|---|---|---|
| SCNN1A-834 | + | CAGAGCCCCCUGGAGAU | 17 | 4683 |
| SCNN1A-835 | + | AGAGGUACAUUGACGAU | 17 | 4684 |
| SCNN1A-836 | − | GAGUGUGGGGAAGGGAU | 17 | 4685 |
| SCNN1A-837 | + | GGCCUGGAGACCAGUAU | 17 | 4686 |
| SCNN1A-838 | + | GCAUGGCUUCCGGCACU | 17 | 4687 |
| SCNN1A-839 | − | GAAACCCUGGACAGACU | 17 | 4688 |
| SCNN1A-840 | − | AGGCAAGGAUGCUGACU | 17 | 4689 |
| SCNN1A-841 | − | UGCUGUCCACAGUGACU | 17 | 4690 |
| SCNN1A-842 | − | ACCCUCCUGUCCAACCU | 17 | 4691 |
| SCNN1A-843 | − | UUCUCCUCAGACCACCU | 17 | 4692 |
| SCNN1A-844 | + | GUCCUUCCAGUCCACCU | 17 | 4693 |
| SCNN1A-845 | + | GCAUCAGGGACAGACCU | 17 | 4694 |
| SCNN1A-846 | + | UUCCCCACACUCUACCU | 17 | 4695 |
| SCNN1A-847 | − | CCUGCCUAUGCCACCCU | 17 | 4696 |
| SCNN1A-848 | − | GCUCUCUCUGCACCCCU | 17 | 4697 |
| SCNN1A-849 | + | GAGCACCCCUGCCCCCU | 17 | 4698 |
| SCNN1A-850 | − | UUACUCACGAUGGCCCU | 17 | 4699 |
| SCNN1A-851 | − | CCUGUGGUUCGGCUCCU | 17 | 4700 |
| SCNN1A-852 | + | CUGGAAGACCCAUUCCU | 17 | 4701 |
| SCNN1A-853 | − | CAGAAAGCACAGUUCCU | 17 | 4702 |
| SCNN1A-854 | − | CACCCCAUUCUUUCCU | 17 | 4703 |
| SCNN1A-855 | − | CUGGAGGAGGACACGCU | 17 | 4704 |
| SCNN1A-856 | + | UGGUAGCUGGUCACGCU | 17 | 4705 |
| SCNN1A-857 | + | GGGAGCAGGGCCUGGCU | 17 | 4706 |
| SCNN1A-858 | − | UCCUCCACCUGUCCUCU | 17 | 4707 |
| SCNN1A-859 | + | AACAUCACUGCCAUUCU | 17 | 4708 |
| SCNN1A-860 | + | ACAGUACUCCACGUUCU | 17 | 4709 |
| SCNN1A-861 | + | GGGGUGGGGCAGAAGU | 17 | 4710 |
| SCNN1A-862 | + | UGCAGAGAGCAGAGU | 17 | 4711 |
| SCNN1A-863 | + | AUCAGGAAAGAGAGAGU | 17 | 4712 |
| SCNN1A-864 | + | CCACUGGCUGCCCAGGU | 17 | 4713 |
| SCNN1A-865 | + | CUGCCACGGAAUCAGGU | 17 | 4714 |
| SCNN1A-866 | + | GGAAGACAUCCAGAGGU | 17 | 4715 |
| SCNN1A-867 | − | UCUCCCUCUGUCACGGU | 17 | 4716 |
| SCNN1A-868 | + | GGUGUGGGGCAGAGGGU | 17 | 4717 |
| SCNN1A-869 | + | GGACAGAGACAUGGGGU | 17 | 4718 |
| SCNN1A-870 | − | GUGGGGAAGGGAUGGGU | 17 | 4719 |
| SCNN1A-871 | + | CCGCGGAUAGAAGAUGU | 17 | 4720 |
| SCNN1A-872 | − | GAUCUCUUGGUGUAUGU | 17 | 4721 |
| SCNN1A-873 | + | UAGUAGCAGUACCCUGU | 17 | 4722 |
| SCNN1A-874 | + | AGAAAGGUGCUCAGUGU | 17 | 4723 |
| SCNN1A-875 | − | CAUCCCAGGUAGAGUGU | 17 | 4724 |
| SCNN1A-876 | + | CUCCAUUUCUUAGGUGU | 17 | 4725 |
| SCNN1A-877 | − | AAACCCUGGACAGACUU | 17 | 4726 |
| SCNN1A-878 | + | GAAGAAGAUGUUGACUU | 17 | 4727 |
| SCNN1A-879 | + | AUCGGCUUCGGAACCUU | 17 | 4728 |
| SCNN1A-880 | + | GAGACCAGUAUCGGCUU | 17 | 4729 |
| SCNN1A-881 | + | UGGCCACUCCAUUUCUU | 17 | 4730 |
| SCNN1A-882 | + | UGCCACGGAAUCAGGUU | 17 | 4731 |
| SCNN1A-883 | − | CAGUGGAGCCUGUGGUU | 17 | 4732 |
| SCNN1A-884 | − | UCUGCCCCACACCUAAGAAA | 20 | 4733 |
| SCNN1A-885 | − | UCCAUGCCUGGAAUCAACAA | 20 | 4734 |
| SCNN1A-886 | + | GGGACCCUCAGGCGCUGCAA | 20 | 4735 |
| SCNN1A-887 | + | GACCCAUUCCUAGGAAAGAA | 20 | 4736 |
| SCNN1A-888 | − | UAUGGCGACUGCACCAAGAA | 20 | 4737 |
| SCNN1A-889 | + | GUCACGCUGGGGAUGGAGAA | 20 | 4738 |
| SCNN1A-890 | − | CCCCCAUUCUUUCCUAGGAA | 20 | 4739 |
| SCNN1A-891 | − | CCCAGGUAGAGUGUGGGAA | 20 | 4740 |
| SCNN1A-892 | + | GAGUGAAUACACACCUGGAA | 20 | 4741 |
| SCNN1A-893 | + | UUAAUUUCCGGGUACCGAA | 20 | 4742 |
| SCNN1A-894 | + | CCUGCUGUGUGUACUUUGAA | 20 | 4743 |
| SCNN1A-895 | + | AAAGCCACCAUCAUCCAUAA | 20 | 4744 |
| SCNN1A-896 | + | GUGUGUACUUUGAAGGGUAA | 20 | 4745 |
| SCNN1A-897 | − | AGUGACUGGGGCCCGGGUAA | 20 | 4746 |
| SCNN1A-898 | − | GGCAUCUCUCUGUACCCACA | 20 | 4747 |
| SCNN1A-899 | + | CUGGGACAAGGACAGAGACA | 20 | 4748 |
| SCNN1A-900 | + | AGCAGGGCCUGGCUGGGACA | 20 | 4749 |
| SCNN1A-901 | − | AGGAGAGGUUUCUCACACCA | 20 | 4750 |
| SCNN1A-902 | + | UGGAGAUGGGCGGGGGCCCA | 20 | 4751 |
| SCNN1A-903 | + | GGAAGGAGGGGAGGAUGCCA | 20 | 4752 |
| SCNN1A-904 | − | GUUCCUGGGGUGAGACUCCA | 20 | 4753 |
| SCNN1A-905 | + | GCCCAGCGUGUCCUCCUCCA | 20 | 4754 |
| SCNN1A-906 | + | GAAGCUCCCUGCUUGCUCCA | 20 | 4755 |
| SCNN1A-907 | − | UGGGCCCCGCCCAUCUCCA | 20 | 4756 |

TABLE 43E-continued

5th Tier

| gRNA Name | DNA Strand | Targeting Domain | Target Site Length | Seq ID |
|---|---|---|---|---|
| SCNN1A-908 | + | AUCGCCCCAAGUCUGUCCA | 20 | 4757 |
| SCNN1A-909 | + | AGGGCGCCAUGGAGCAAGCA | 20 | 4758 |
| SCNN1A-910 | + | CCCAGUCACUGUGGACAGCA | 20 | 4759 |
| SCNN1A-911 | + | UCAAGGCUGGAGAGGGAGCA | 20 | 4760 |
| SCNN1A-912 | − | CCAUCAGCAUGAGGAAGGCA | 20 | 4761 |
| SCNN1A-913 | + | ACCGUUGUUGAUUCCAGGCA | 20 | 4762 |
| SCNN1A-914 | + | GGCCCAGGGUGGCAUAGGCA | 20 | 4763 |
| SCNN1A-915 | − | GUCUCCAGGCCGAGGGGCA | 20 | 4764 |
| SCNN1A-916 | + | GAAGGGGACACUAACCUGCA | 20 | 4765 |
| SCNN1A-917 | + | CGGGACCUCAGGCGCUGCA | 20 | 4766 |
| SCNN1A-918 | − | CAUCUCCAGGGGGCUCUGCA | 20 | 4767 |
| SCNN1A-919 | − | GGGGCCCGGGUAAUGGUGCA | 20 | 4768 |
| SCNN1A-920 | + | CUGCUCUGCGCGCAGCAUCA | 20 | 4769 |
| SCNN1A-921 | − | UCUACCAGACAUACUCAUCA | 20 | 4770 |
| SCNN1A-922 | + | AAAGAAUGGGGUGUCAUCA | 20 | 4771 |
| SCNN1A-923 | − | CUUCCAGGAGAGCAUGAUCA | 20 | 4772 |
| SCNN1A-924 | − | AGGGUCCCGCCCCCGCCUCA | 20 | 4773 |
| SCNN1A-925 | + | AAACCUCUCCUUCCCUCUCA | 20 | 4774 |
| SCNN1A-926 | + | GGCAGGGGGAGGGCUGUCA | 20 | 4775 |
| SCNN1A-927 | − | UUCUGAGUCUCCCUCUGUCA | 20 | 4776 |
| SCNN1A-928 | − | CAAAGUCAACAUCUUCUUCA | 20 | 4777 |
| SCNN1A-929 | + | CUGAAGGGGCGAGGGGAAGA | 20 | 4778 |
| SCNN1A-930 | − | UGUACCUCUCCUCUCACAGA | 20 | 4779 |
| SCNN1A-931 | + | GCACGACCUACCGUGACAGA | 20 | 4780 |
| SCNN1A-932 | + | UUUCUUAGGUGUGGGGCAGA | 20 | 4781 |
| SCNN1A-933 | + | ACACAGAGACUAGAGUCAGA | 20 | 4782 |
| SCNN1A-934 | + | GGAGGAGGUGGAGAGGAGA | 20 | 4783 |
| SCNN1A-935 | + | CCUGCAGAGCCCCCUGGAGA | 20 | 4784 |
| SCNN1A-936 | + | GGGGCUGUCAAGGCUGGAGA | 20 | 4785 |
| SCNN1A-937 | − | GGUGUUGUCUGUGGUGGAGA | 20 | 4786 |
| SCNN1A-938 | − | CCUCUGGGGGGCCCUGAGA | 20 | 4787 |
| SCNN1A-939 | − | UCUCUGCUGGUUACUCACGA | 20 | 4788 |
| SCNN1A-940 | + | GAGGAGAGGUACAUUGACGA | 20 | 4789 |
| SCNN1A-941 | + | UCUACCUGGGAUGUCACCGA | 20 | 4790 |
| SCNN1A-942 | − | GGUGAGGCCCGCAGCGCCGA | 20 | 4791 |
| SCNN1A-943 | − | GAUACUGGUCUCCAGGCCGA | 20 | 4792 |
| SCNN1A-944 | − | UGUUCCUCAUGCUGCUCCGA | 20 | 4793 |
| SCNN1A-945 | + | GAGUCCCCGCAGGUCGCGA | 20 | 4794 |
| SCNN1A-946 | + | CCGGGUACCUGAAGGGGCGA | 20 | 4795 |
| SCNN1A-947 | + | AGGCCACGCUACGGGCUCGA | 20 | 4796 |
| SCNN1A-948 | + | GGGGGCAGAAGUGGGAAGGA | 20 | 4797 |
| SCNN1A-949 | + | GCUGCCCAGGUUGGACAGGA | 20 | 4798 |
| SCNN1A-950 | + | UACACACCUGGAAGGGAGGA | 20 | 4799 |
| SCNN1A-951 | − | GACCUCCAUCAGCAUGAGGA | 20 | 4800 |
| SCNN1A-952 | − | GGUAGAGUGUGGGGAAGGGA | 20 | 4801 |
| SCNN1A-953 | + | AGCGUGUCCUCCUCCAGGGA | 20 | 4802 |
| SCNN1A-954 | − | UGGGGGGGCCCUGAGAGGGA | 20 | 4803 |
| SCNN1A-955 | + | GGGUGGCAUAGGCAGGGGA | 20 | 4804 |
| SCNN1A-956 | + | GUAGCUGGUCACGCUGGGGA | 20 | 4805 |
| SCNN1A-957 | − | UCCCAGGUAGAGUGUGGGGA | 20 | 4806 |
| SCNN1A-958 | + | GGGUGGGGGCAGAAGUGGGA | 20 | 4807 |
| SCNN1A-959 | − | CAACCCCCAGGUGGACUGGA | 20 | 4808 |
| SCNN1A-960 | + | GGAGUGAAUACACACCUGGA | 20 | 4809 |
| SCNN1A-961 | − | UGCUGACUGGGAGGCCUGGA | 20 | 4810 |
| SCNN1A-962 | − | CACGGUAGGUCGUGCCUGGA | 20 | 4811 |
| SCNN1A-963 | − | GAACCUGCCUUUAUGGAUGA | 20 | 4812 |
| SCNN1A-964 | + | UUUAAUUCCGGGUACCUGA | 20 | 4813 |
| SCNN1A-965 | − | GCACCCCUUGCAGCGCCUGA | 20 | 4814 |
| SCNN1A-966 | + | CCUUGCCUUCCUCAUGCUGA | 20 | 4815 |
| SCNN1A-967 | − | AUCAGGGGUGGAUGCGGUGA | 20 | 4816 |
| SCNN1A-968 | + | GCCGGCCACGAGAGUGGUGA | 20 | 4817 |
| SCNN1A-969 | + | GACUGACCUCUUGUUGUUGA | 20 | 4818 |
| SCNN1A-970 | + | ACCUGCUGUGUGUACUUUGA | 20 | 4819 |
| SCNN1A-971 | − | CUACUCUCUCUUUCCUGAUA | 20 | 4820 |
| SCNN1A-972 | + | CAGCAUCAGGGACAGACCUA | 20 | 4821 |
| SCNN1A-973 | + | GCAAGCUGGAGGCCACGCUA | 20 | 4822 |
| SCNN1A-974 | + | UUAUCAGGAAAGAGAGAGUA | 20 | 4823 |
| SCNN1A-975 | − | CACUUCCACCACCCGAUGUA | 20 | 4824 |
| SCNN1A-976 | − | GACAGACUUGGGGCGAUUA | 20 | 4825 |
| SCNN1A-977 | − | GCAGGAUGAACCUGCCUUUA | 20 | 4826 |
| SCNN1A-978 | + | GAAGGGUAAAGGUUCUCAAC | 20 | 4827 |
| SCNN1A-979 | + | CAGAGGACAGGUGGAGGAAC | 20 | 4828 |
| SCNN1A-980 | + | ACACCGAGGAGCCGAACCAC | 20 | 4829 |
| SCNN1A-981 | − | AGGCAUCUCUCUGUACCCAC | 20 | 4830 |

TABLE 43E-continued

5th Tier

| gRNA Name | DNA Strand | Targeting Domain | Target Site Length | Seq ID |
|---|---|---|---|---|
| SCNN1A-982 | + | AGCCGAACCACAGGCUCCAC | 20 | 4831 |
| SCNN1A-983 | - | GGGCCCGGGUAAUGGUGCAC | 20 | 4832 |
| SCNN1A-984 | + | CCGAUUUGUUCUGGUUGCAC | 20 | 4833 |
| SCNN1A-985 | - | GGGUCCCGCCCCCGCCUCAC | 20 | 4834 |
| SCNN1A-986 | + | GAGUCUCUGGCAGCCUCGAC | 20 | 4835 |
| SCNN1A-987 | + | GGCCACGCUACGGGCUCGAC | 20 | 4836 |
| SCNN1A-988 | - | CCCAGGUGGACUGGAAGGAC | 20 | 4837 |
| SCNN1A-989 | + | UCAGGGCCCCCCCAGAGGAC | 20 | 4838 |
| SCNN1A-990 | - | ACAACAACCCCCAGGUGGAC | 20 | 4839 |
| SCNN1A-991 | + | ACUGGCUGCCCAGGUUGGAC | 20 | 4840 |
| SCNN1A-992 | - | AGGAAGGCAAGGAUGCUGAC | 20 | 4841 |
| SCNN1A-993 | - | CCCCUGCUGUCCACAGUGAC | 20 | 4842 |
| SCNN1A-994 | - | GAAGGUUCCGAAGCCGAUAC | 20 | 4843 |
| SCNN1A-995 | + | CAAGCUGGAGGCCACGCUAC | 20 | 4844 |
| SCNN1A-996 | - | GUGUCCCCUUCCCGGGUAC | 20 | 4845 |
| SCNN1A-997 | + | UGAAGGAGCUGUAUUUGUAC | 20 | 4846 |
| SCNN1A-998 | - | GGUCACCCUCCUGUCCAACC | 20 | 4847 |
| SCNN1A-999 | - | CAACCAGGUCUCCUGCAACC | 20 | 4848 |
| SCNN1A-1000 | + | GGUCUGAGGAGAAGUCAACC | 20 | 4849 |
| SCNN1A-1001 | - | CUUCGCCUGCCGCUUCAACC | 20 | 4850 |
| SCNN1A-1002 | + | AGCAGGAGUGAAUACACACC | 20 | 4851 |
| SCNN1A-1003 | - | UGACUUCUCCUCAGACCACC | 20 | 4852 |
| SCNN1A-1004 | + | UCCAGUCCUUCCAGUCCACC | 20 | 4853 |
| SCNN1A-1005 | + | ACGCCUGGUUGCAGGAGACC | 20 | 4854 |
| SCNN1A-1006 | + | UCCCUUCCCCACACUCUACC | 20 | 4855 |
| SCNN1A-1007 | - | CCCUCGCCCCUUCAGGUACC | 20 | 4856 |
| SCNN1A-1008 | + | CCUGCCCGUGCACCAUUACC | 20 | 4857 |
| SCNN1A-1009 | - | UGUGGGUUCAUAGGAAACCC | 20 | 4858 |
| SCNN1A-1010 | - | UCCCCCUGCCUAUGCCACCC | 20 | 4859 |
| SCNN1A-1011 | - | UCAGGAGGUAGCCUCCACCC | 20 | 4860 |
| SCNN1A-1012 | + | CUGCCCGUGCACCAUUACCC | 20 | 4861 |
| SCNN1A-1013 | + | GCUCCCUGGAGUCUCACCCC | 20 | 4862 |
| SCNN1A-1014 | - | CUUGCGGGACAACAACCCCC | 20 | 4863 |
| SCNN1A-1015 | + | CUGGCCCCUGCAGAGCCCCC | 20 | 4864 |
| SCNN1A-1016 | - | AGGUUAGUGUCCCCUUCCCC | 20 | 4865 |
| SCNN1A-1017 | - | GGCACUUGGUGAAACAGCCC | 20 | 4866 |
| SCNN1A-1018 | + | CUGGAGAUGGGCGGGGGCCC | 20 | 4867 |
| SCNN1A-1019 | - | GUCCACAGUGACUGGGGCCC | 20 | 4868 |
| SCNN1A-1020 | - | ACAAGAGGUCAGUCCUGCCC | 20 | 4869 |
| SCNN1A-1021 | + | ACAGGCUCCACUGGCUGCCC | 20 | 4870 |
| SCNN1A-1022 | - | AUGGCCCUCGGUGACAUCCC | 20 | 4871 |
| SCNN1A-1023 | - | GCCAGAGACUCUGCCAUCCC | 20 | 4872 |
| SCNN1A-1024 | - | CAGGUUAGUGUCCCCUUCCC | 20 | 4873 |
| SCNN1A-1025 | - | UCUCUGUCCUUGUCCCAGCC | 20 | 4874 |
| SCNN1A-1026 | + | CUGAUGGAGGUCUCCACGCC | 20 | 4875 |
| SCNN1A-1027 | + | AGGCAGGACUGACUCACGCC | 20 | 4876 |
| SCNN1A-1028 | + | AGGAUGCUGACUGGGAGGCC | 20 | 4877 |
| SCNN1A-1029 | - | GGUGGCUUUAACUUGCGGCC | 20 | 4878 |
| SCNN1A-1030 | + | GCACCCCUGCCCCCUCGGCC | 20 | 4879 |
| SCNN1A-1031 | + | GCUGGAGAGGGAGCAGGCC | 20 | 4880 |
| SCNN1A-1032 | - | UGUCCACAGUGACUGGGGCC | 20 | 4881 |
| SCNN1A-1033 | - | CUCUGGAUGCUUCCAUGCC | 20 | 4882 |
| SCNN1A-1034 | + | GGGAAGGAGGGGAGGAUGCC | 20 | 4883 |
| SCNN1A-1035 | - | AGGCGUGAGUCAGUCCUGCC | 20 | 4884 |
| SCNN1A-1036 | - | CUGUCACGGUAGGUCGUGCC | 20 | 4885 |
| SCNN1A-1037 | - | AGUUCUGGGGUGAGACUCC | 20 | 4886 |
| SCNN1A-1038 | + | UGCCCAGCGUGUCCUCCUCC | 20 | 4887 |
| SCNN1A-1039 | - | GUACUGCUACUAUAAGCUCC | 20 | 4888 |
| SCNN1A-1040 | - | CUGGGCCCCGCCCAUCUCC | 20 | 4889 |
| SCNN1A-1041 | + | ACUCCUUGAUCAUGCUCUCC | 20 | 4890 |
| SCNN1A-1042 | - | CGAAGCCGAUACUGGUCUCC | 20 | 4891 |
| SCNN1A-1043 | + | AAUCGCCCCCAAGUCUGUCC | 20 | 4892 |
| SCNN1A-1044 | + | UUCUCACCGUUGUUGAUUCC | 20 | 4893 |
| SCNN1A-1045 | - | UCUCCACCCUCCUCCCUUCC | 20 | 4894 |
| SCNN1A-1046 | - | GUGUAUUCACUCCUGCUUCC | 20 | 4895 |
| SCNN1A-1047 | - | ACUACAGAAAGCACAGUUCC | 20 | 4896 |
| SCNN1A-1048 | + | CCAGCUCCUCUUUAAUUCC | 20 | 4897 |
| SCNN1A-1049 | + | GAGGGCGCCAUGGAGCAAGC | 20 | 4898 |
| SCNN1A-1050 | + | GGGGUUGUUGUCCCGCAAGC | 20 | 4899 |
| SCNN1A-1051 | + | GAUCAUGCUCUCCUGGAAGC | 20 | 4900 |
| SCNN1A-1052 | - | CCCUUCAAAGUACACACAGC | 20 | 4901 |
| SCNN1A-1053 | + | CCCCAGUCACUGUGGACAGC | 20 | 4902 |
| SCNN1A-1054 | + | GCGCUGCGGGCCUCACCAGC | 20 | 4903 |
| SCNN1A-1055 | + | UGAGGAACAUGAUGACCAGC | 20 | 4904 |

TABLE 43E-continued

5th Tier

| gRNA Name | DNA Strand | Targeting Domain | Target Site Length | Seq ID |
|---|---|---|---|---|
| SCNN1A-1056 | - | CUGGAAGAUCGGCUUCCAGC | 20 | 4905 |
| SCNN1A-1057 | + | GUGAGUAACCAGCAGAGAGC | 20 | 4906 |
| SCNN1A-1058 | - | CCCGGAAAUUAAAGAGGAGC | 20 | 4907 |
| SCNN1A-1059 | - | UAAAGAGGAGCUGGAGGAGC | 20 | 4908 |
| SCNN1A-1060 | + | GUCAAGGCUGGAGAGGGAGC | 20 | 4909 |
| SCNN1A-1061 | + | GUCGCGACGGCUGCGGGAGC | 20 | 4910 |
| SCNN1A-1062 | + | ACCAGCAGAGAGCUGGUAGC | 20 | 4911 |
| SCNN1A-1063 | - | AUCCCUGGAGGAGGACACGC | 20 | 4912 |
| SCNN1A-1064 | + | GAGCUGGUAGCUGGUCACGC | 20 | 4913 |
| SCNN1A-1065 | + | GGUGCGGCAGAGUCCCCCGC | 20 | 4914 |
| SCNN1A-1066 | + | CCACCAUCAUCCAUAAAGGC | 20 | 4915 |
| SCNN1A-1067 | + | GGGGGAGGGGCUGUCAAGGC | 20 | 4916 |
| SCNN1A-1068 | + | CUCGACGGGCCCCGUGAGGC | 20 | 4917 |
| SCNN1A-1069 | + | GGGCCCAGGGUGGCAUAGGC | 20 | 4918 |
| SCNN1A-1070 | + | GGAGACCUGGUUGAAGCGGC | 20 | 4919 |
| SCNN1A-1071 | + | CUUGUGGCUGGGACCAGGGC | 20 | 4920 |
| SCNN1A-1072 | - | CCGGGUAAUGGUGCACGGGC | 20 | 4921 |
| SCNN1A-1073 | - | GGUCUCCAGGCCGAGGGGGC | 20 | 4922 |
| SCNN1A-1074 | + | GGGCCCCGUGAGGCGGGGGC | 20 | 4923 |
| SCNN1A-1075 | + | AGAGCCCCCUGGAGAUGGGC | 20 | 4924 |
| SCNN1A-1076 | + | GAGAGGGAGCAGGGCCUGGC | 20 | 4925 |
| SCNN1A-1077 | - | UCCUUCACCACUCUCGUGGC | 20 | 4926 |
| SCNN1A-1078 | - | CCAAGUGCCGGAAGCCAUGC | 20 | 4927 |
| SCNN1A-1079 | - | CCGCAGCCGUCGCGACCUGC | 20 | 4928 |
| SCNN1A-1080 | - | UGAGCUCGUCUUUGACCUGC | 20 | 4929 |
| SCNN1A-1081 | + | GGCGGGCCCCUCGGCGCUGC | 20 | 4930 |
| SCNN1A-1082 | + | CCGCAGGUCGCGACGGCUGC | 20 | 4931 |
| SCNN1A-1083 | - | CCAUCUCCAGGGGGCUCUGC | 20 | 4932 |
| SCNN1A-1084 | - | ACCAGCUACCAGCUCUCUGC | 20 | 4933 |
| SCNN1A-1085 | - | UGGGCUGUUUCACCAAGUGC | 20 | 4934 |
| SCNN1A-1086 | - | UAGCGUGGCCUCCAGCUUGC | 20 | 4935 |
| SCNN1A-1087 | + | ACUGACUCACGCCUGGUUGC | 20 | 4936 |
| SCNN1A-1088 | + | UAUAGCAGUUUCCAUACAUC | 20 | 4937 |
| SCNN1A-1089 | + | UCUGCUCUGCGCGCAGCAUC | 20 | 4938 |
| SCNN1A-1090 | + | UGUUCUGUCGCGAUAGCAUC | 20 | 4939 |
| SCNN1A-1091 | - | UUCUACCAGACAUACUCAUC | 20 | 4940 |
| SCNN1A-1092 | + | AGUGAGAGUAAUUCCUUAUC | 20 | 4941 |
| SCNN1A-1093 | - | ACAAGAACAACUCCAACCUC | 20 | 4942 |
| SCNN1A-1094 | + | GAGGCGGGGGCGGGACCCUC | 20 | 4943 |
| SCNN1A-1095 | - | CAGUUCCUCCACCUGUCCUC | 20 | 4944 |
| SCNN1A-1096 | - | CCGAGGGGGCAGGGGUGCUC | 20 | 4945 |
| SCNN1A-1097 | + | GAAACCUCUCCUUCCCUCUC | 20 | 4946 |
| SCNN1A-1098 | + | UCCAGGGAUGGCAGAGUCUC | 20 | 4947 |
| SCNN1A-1099 | + | GGGGCGAGGGGAAGAGGGUC | 20 | 4948 |
| SCNN1A-1100 | + | CCACCCCUGAUGAGUAUGUC | 20 | 4949 |
| SCNN1A-1101 | - | CCUCUUCCCCUCGCCCCUUC | 20 | 4950 |
| SCNN1A-1102 | + | ACACUAACCUGCAUGGCUUC | 20 | 4951 |
| SCNN1A-1103 | + | AGUCACAGUACUCCACGUUC | 20 | 4952 |
| SCNN1A-1104 | + | AGAAGCAGUCCGAUUUGUUC | 20 | 4953 |
| SCNN1A-1105 | + | UCCAGCUCCUCUUUAAUUUC | 20 | 4954 |
| SCNN1A-1106 | - | CAGGUACCCGGAAAUUAAAG | 20 | 4955 |
| SCNN1A-1107 | - | AUUACACCGUCAACAACAAG | 20 | 4956 |
| SCNN1A-1108 | + | GGACCCUCAGGCGCUGCAAG | 20 | 4957 |
| SCNN1A-1109 | + | ACAUGGGGUGGGGCAGAAG | 20 | 4958 |
| SCNN1A-1110 | + | CCUGAAGGGGCGAGGGGAAG | 20 | 4959 |
| SCNN1A-1111 | + | GGAUGUUGAUGUAGUGGAAG | 20 | 4960 |
| SCNN1A-1112 | + | UAAUUUCCGGGUACCUGAAG | 20 | 4961 |
| SCNN1A-1113 | + | UGCAGGAGACCUGGUUGAAG | 20 | 4962 |
| SCNN1A-1114 | + | GGCACGACCUACCGUGACAG | 20 | 4963 |
| SCNN1A-1115 | + | CCCUCUCAGGGCCCCCCAG | 20 | 4964 |
| SCNN1A-1116 | - | UGUCCAACCUGGGCAGCCAG | 20 | 4965 |
| SCNN1A-1117 | + | CAGGCAUGGAAGACAUCCAG | 20 | 4966 |
| SCNN1A-1118 | - | GGGCCCCCGCCCAUCUCCAG | 20 | 4967 |
| SCNN1A-1119 | + | CCAGUCACUGUGGACAGCAG | 20 | 4968 |
| SCNN1A-1120 | + | GCCCAGGGUGGCAUAGGCAG | 20 | 4969 |
| SCNN1A-1121 | - | UCUCCAGGCCGAGGGGCAG | 20 | 4970 |
| SCNN1A-1122 | + | AUUUCUUAGGUGUGGGGCAG | 20 | 4971 |
| SCNN1A-1123 | - | AUCUCCAGGGGCUCUGCAG | 20 | 4972 |
| SCNN1A-1124 | - | CUACCAGACAUACUCAUCAG | 20 | 4973 |
| SCNN1A-1125 | + | GACACAGAGACUAGAGUCAG | 20 | 4974 |
| SCNN1A-1126 | + | CACAGAGACUAGAGUCAGAG | 20 | 4975 |
| SCNN1A-1127 | + | GCGGGAGCCGGCCACGAGAG | 20 | 4976 |
| SCNN1A-1128 | - | GUGAGGCCCGCAGCGCCGAG | 20 | 4977 |
| SCNN1A-1129 | - | AUACUGGUCUCCAGGCCGAG | 20 | 4978 |

TABLE 43E-continued

5th Tier

| gRNA Name | DNA Strand | Targeting Domain | Target Site Length | Seq ID |
|---|---|---|---|---|
| SCNN1A-1130 | + | CGGGUACCUGAAGGGGCGAG | 20 | 4979 |
| SCNN1A-1131 | - | GGGCCCUGAGAGGGAAGGAG | 20 | 4980 |
| SCNN1A-1132 | + | GGGGCAGAAGUGGGAAGGAG | 20 | 4981 |
| SCNN1A-1133 | + | GGGAGGAGGGUGGAGAGGAG | 20 | 4982 |
| SCNN1A-1134 | + | GUGACCAUCUGUGAGAGGAG | 20 | 4983 |
| SCNN1A-1135 | - | GGGUGGAUGCGGUGAGGGAG | 20 | 4984 |
| SCNN1A-1136 | + | GGUGGCAUAGGCAGGGGGAG | 20 | 4985 |
| SCNN1A-1137 | - | CCCACACCUAAGAAAUGGAG | 20 | 4986 |
| SCNN1A-1138 | + | AGGGGCUGUCAAGGCUGGAG | 20 | 4987 |
| SCNN1A-1139 | + | UGGAAGGGAGGAGGGUGGAG | 20 | 4988 |
| SCNN1A-1140 | - | UCCUCUGGGGGGGCCCUGAG | 20 | 4989 |
| SCNN1A-1141 | + | GGAGGGUGACCAUCUGUGAG | 20 | 4990 |
| SCNN1A-1142 | + | AGCAUCAGGGACAGACCUAG | 20 | 4991 |
| SCNN1A-1143 | + | UCGACAGGAUGUUGAUGUAG | 20 | 4992 |
| SCNN1A-1144 | - | CUAUCCGCGGCCCCAGAACG | 20 | 4993 |
| SCNN1A-1145 | - | GGUCCCGCCCCCGCCUCACG | 20 | 4994 |
| SCNN1A-1146 | + | CUCCACCACAGACAACACCG | 20 | 4995 |
| SCNN1A-1147 | + | CUCUACCUGGGAUGUCACCG | 20 | 4996 |
| SCNN1A-1148 | - | UGGUGAGGCCCGCAGCGCCG | 20 | 4997 |
| SCNN1A-1149 | - | CGAUACUGGUCUCCAGGCCG | 20 | 4998 |
| SCNN1A-1150 | + | UACUCCACGUUCUGGGGCCG | 20 | 4999 |
| SCNN1A-1151 | - | GUGCCUACAUCUUCUAUCCG | 20 | 5000 |
| SCNN1A-1152 | - | UGAGGCCCAACCUGAUUCCG | 20 | 5001 |
| SCNN1A-1153 | - | GGCCCGUCGAGCCCGUAGCG | 20 | 5002 |
| SCNN1A-1154 | + | UCGACGGGCCCCGUGAGGCG | 20 | 5003 |
| SCNN1A-1155 | + | UCCGGGUACCUGAAGGGGCG | 20 | 5004 |
| SCNN1A-1156 | + | GAGCCCCUGGAGAUGGGCG | 20 | 5005 |
| SCNN1A-1157 | - | CUUUAACUUGCGGCCUGGCG | 20 | 5006 |
| SCNN1A-1158 | - | CGCAGCCGUCGCGACCUGCG | 20 | 5007 |
| SCNN1A-1159 | - | CAGCUCCUUCACCACUCUCG | 20 | 5008 |
| SCNN1A-1160 | - | ACUACAUCAACAUCCUGUCG | 20 | 5009 |
| SCNN1A-1161 | + | UGGGGGCAGAAGUGGGAAGG | 20 | 5010 |
| SCNN1A-1162 | + | GGGCCCCCCAGAGGACAGG | 20 | 5011 |
| SCNN1A-1163 | + | GGCUGCCCAGGUUGGACAGG | 20 | 5012 |
| SCNN1A-1164 | + | GCGGGACAACAACCCCCAGG | 20 | 5013 |
| SCNN1A-1165 | + | ACUGGUGAAACAGCCCCAGG | 20 | 5014 |
| SCNN1A-1166 | - | GGCCCCGCCCCAUCUCCAGG | 20 | 5015 |
| SCNN1A-1167 | + | CCCAGGGUGGCAUAGGCAGG | 20 | 5016 |
| SCNN1A-1168 | - | AGGGGCAGGGGUGCUCAGG | 20 | 5017 |
| SCNN1A-1169 | - | UACUGGUCUCCAGGCCGAGG | 20 | 5018 |
| SCNN1A-1170 | + | AUACACACCUGGAAGGGAGG | 20 | 5019 |
| SCNN1A-1171 | - | GACUCUGCCAUCCCUGGAGG | 20 | 5020 |
| SCNN1A-1172 | + | GCUCGACGGGCCCCGUGAGG | 20 | 5021 |
| SCNN1A-1173 | + | CGACGGGCCCCGUGAGGCGG | 20 | 5022 |
| SCNN1A-1174 | + | AGCCCCUGGAGAUGGGCGG | 20 | 5023 |
| SCNN1A-1175 | - | GCAGCCGUCGCGACCUGCGG | 20 | 5024 |
| SCNN1A-1176 | + | UGAAUACACACCUGGAAGGG | 20 | 5025 |
| SCNN1A-1177 | + | AGAUGGGCGGGGCCCAGGG | 20 | 5026 |
| SCNN1A-1178 | + | AGGAGGGAGGAUGCCAGGG | 20 | 5027 |
| SCNN1A-1179 | + | CUUAGGUGUGGGGCAGAGGG | 20 | 5028 |
| SCNN1A-1180 | + | ACACCUGGAAGGGAGGAGGG | 20 | 5029 |
| SCNN1A-1181 | + | AGCAGUUCCAUACAUCGGG | 20 | 5030 |
| SCNN1A-1182 | - | CCAGACAUACUCAUCAGGGG | 20 | 5031 |
| SCNN1A-1183 | + | GCAGAAGUGGGAAGGAGGGG | 20 | 5032 |
| SCNN1A-1184 | + | AGGGUGGCAUAGGCAGGGGG | 20 | 5033 |
| SCNN1A-1185 | + | CGGGCCCCGUGAGGCGGGGG | 20 | 5034 |
| SCNN1A-1186 | + | ACAAGGACAGAGACAUGGGG | 20 | 5035 |
| SCNN1A-1187 | - | CCUCCACCUGUCCUCUGGGG | 20 | 5036 |
| SCNN1A-1188 | + | CAGAGCCCCUGGAGAUGGGG | 20 | 5037 |
| SCNN1A-1189 | - | GAGUGUGGGGAAGGGAUGGG | 20 | 5038 |
| SCNN1A-1190 | - | AGGCAAGGAUGCUGACUGGG | 20 | 5039 |
| SCNN1A-1191 | - | UCCUCCACCUGUCCUCUGGG | 20 | 5040 |
| SCNN1A-1192 | + | CCAUUCCUAGGAAAGAAUGG | 20 | 5041 |
| SCNN1A-1193 | - | CCUGCCUUUAUGGAUGAUGG | 20 | 5042 |
| SCNN1A-1194 | + | UGCCUUCCUCAUGCUGAUGG | 20 | 5043 |
| SCNN1A-1195 | + | AGUCCUUCCAGUCCACCUGG | 20 | 5044 |
| SCNN1A-1196 | - | AGAGACUCUGCCAUCCCUGG | 20 | 5045 |
| SCNN1A-1197 | + | GUUGUUGUCCCGCAAGCUGG | 20 | 5046 |
| SCNN1A-1198 | - | GGAAAUUAAAGAGGAGCUGG | 20 | 5047 |
| SCNN1A-1199 | - | UUCCUCCACCUGUCCUCUGG | 20 | 5048 |
| SCNN1A-1200 | + | CCCCCCCAGAGGACAGGUGG | 20 | 5049 |
| SCNN1A-1201 | + | AGGGGAGGAUGCCAGGGUGG | 20 | 5050 |
| SCNN1A-1202 | + | AGUUCCAUACAUCGGGUGG | 20 | 5051 |
| SCNN1A-1203 | + | AGGACAGAGACAUGGGGUGG | 20 | 5052 |

TABLE 43E-continued

5th Tier

| gRNA Name | DNA Strand | Targeting Domain | Target Site Length | Seq ID |
|---|---|---|---|---|
| SCNN1A-1204 | - | UGUGGGGAAGGGAUGGGUGG | 20 | 5053 |
| SCNN1A-1205 | - | CUCCUCGGUGUUGUCUGUGG | 20 | 5054 |
| SCNN1A-1206 | - | GAAACCCUGGACAGACUUGG | 20 | 5055 |
| SCNN1A-1207 | + | CCCAUUCCUAGGAAAGAAUG | 20 | 5056 |
| SCNN1A-1208 | + | GGGACAAGGACAGAGACAUG | 20 | 5057 |
| SCNN1A-1209 | + | GGAACCUUCGGAGCAGCAUG | 20 | 5058 |
| SCNN1A-1210 | - | UGGAGACCUCCAUCAGCAUG | 20 | 5059 |
| SCNN1A-1211 | - | AUACUCAUCAGGGUGGAUG | 20 | 5060 |
| SCNN1A-1212 | + | AGAGCGUCUGCUCUGUGAUG | 20 | 5061 |
| SCNN1A-1213 | + | UACCCGGGCCCCAGUCACUG | 20 | 5062 |
| SCNN1A-1214 | - | CCUGCUGUCCACAGUGACUG | 20 | 5063 |
| SCNN1A-1215 | + | CAGUCCUUCCAGUCCACCUG | 20 | 5064 |
| SCNN1A-1216 | - | CCCGCAGCCGUCGCGACCUG | 20 | 5065 |
| SCNN1A-1217 | + | CUUAUAGUAGCAGUACCCUG | 20 | 5066 |
| SCNN1A-1218 | - | UGGGCAGCCAGUGGAGCCUG | 20 | 5067 |
| SCNN1A-1219 | - | CGCACCCCUUGCAGCGCCUG | 20 | 5068 |
| SCNN1A-1220 | - | UACAGAAAGCACAGUUCCUG | 20 | 5069 |
| SCNN1A-1221 | + | GCUGGUAGCUGGUCACGCUG | 20 | 5070 |
| SCNN1A-1222 | + | GGGCGGGCCCCUCGGCGCUG | 20 | 5071 |
| SCNN1A-1223 | + | CCCGCAGGUCGCGACGGCUG | 20 | 5072 |
| SCNN1A-1224 | - | GUUCCUCCACCUGUCCUCUG | 20 | 5073 |
| SCNN1A-1225 | + | GAAACAGCCCAGGUGGUCUG | 20 | 5074 |
| SCNN1A-1226 | - | CGGCUCCUCGGUGUUGUCUG | 20 | 5075 |
| SCNN1A-1227 | + | UCACAGUACUCCACGUUCUG | 20 | 5076 |
| SCNN1A-1228 | - | GUGACAUCCCAGGUAGAGUG | 20 | 5077 |
| SCNN1A-1229 | - | GAGAGCAUGAUCAAGGAGUG | 20 | 5078 |
| SCNN1A-1230 | + | CGGGCUCGACGGGCCCCGUG | 20 | 5079 |
| SCNN1A-1231 | - | CAAAGUACACACAGCAGGUG | 20 | 5080 |
| SCNN1A-1232 | + | GCCACUCCAUUUCUUAGGUG | 20 | 5081 |
| SCNN1A-1233 | - | CAUCAGGGGUGGAUGCGGUG | 20 | 5082 |
| SCNN1A-1234 | + | CUCAGGCGCUGCAAGGGGUG | 20 | 5083 |
| SCNN1A-1235 | + | AAGGACAGAGACAUGGGGUG | 20 | 5084 |
| SCNN1A-1236 | - | GUGUGGGGAAGGGAUGGGUG | 20 | 5085 |
| SCNN1A-1237 | - | AGAUCGGCUUCCAGCUGGUG | 20 | 5086 |
| SCNN1A-1238 | - | GACAUCCCAGGUAGAGUGUG | 20 | 5087 |
| SCNN1A-1239 | + | CACUCCAUUUCUUAGGUGUG | 20 | 5088 |
| SCNN1A-1240 | - | AUGAUGGUGGCUUUAACUUG | 20 | 5089 |
| SCNN1A-1241 | - | GGAAACCCUGGACAGACUUG | 20 | 5090 |
| SCNN1A-1242 | - | GUAGCGUGGCCUCCAGCUUG | 20 | 5091 |
| SCNN1A-1243 | - | CCAGUGCAACCAGAACAAAU | 20 | 5092 |
| SCNN1A-1244 | + | ACCCAUUCCUAGGAAAGAAU | 20 | 5093 |
| SCNN1A-1245 | + | GACAGAGGGAGACUCAGAAU | 20 | 5094 |
| SCNN1A-1246 | - | CCCCAUUCUUUCCUAGGAAU | 20 | 5095 |
| SCNN1A-1247 | + | UGGGACAAGGACAGAGACAU | 20 | 5096 |
| SCNN1A-1248 | + | GUAUAGCAGUUUCCAUACAU | 20 | 5097 |
| SCNN1A-1249 | + | GCGGGGGCCCAGGGUGGCAU | 20 | 5098 |
| SCNN1A-1250 | - | CUUGGUGUAUGUGGGUUCAU | 20 | 5099 |
| SCNN1A-1251 | - | GACUGGAAGGACUGGAAGAU | 20 | 5100 |
| SCNN1A-1252 | + | CUGCAGAGCCCCCUGGAGAU | 20 | 5101 |
| SCNN1A-1253 | + | AGGAGAGGUACAUUGACGAU | 20 | 5102 |
| SCNN1A-1254 | - | GUAGAGUGUGGGGAAGGGAU | 20 | 5103 |
| SCNN1A-1255 | + | CUCGGCCUGGAGACCAGUAU | 20 | 5104 |
| SCNN1A-1256 | + | CCUGCAUGGCUUCCGGCACU | 20 | 5105 |
| SCNN1A-1257 | - | UAGGAAACCCUGGACAGACU | 20 | 5106 |
| SCNN1A-1258 | - | GGAAGGCAAGGAUGCUGACU | 20 | 5107 |
| SCNN1A-1259 | - | CCCUGCUGUCCACAGUGACU | 20 | 5108 |
| SCNN1A-1260 | - | GUCACCCUCCUGUCCAACCU | 20 | 5109 |
| SCNN1A-1261 | - | GACUUCUCCUCAGACCACCU | 20 | 5110 |
| SCNN1A-1262 | + | CCAGUCCUUCCAGUCCACCU | 20 | 5111 |
| SCNN1A-1263 | + | GCAGCAUCAGGGACAGACCU | 20 | 5112 |
| SCNN1A-1264 | + | CCCUUCCCCACACUCUACCU | 20 | 5113 |
| SCNN1A-1265 | - | CCCCCUGCCUAUGCCACCCU | 20 | 5114 |
| SCNN1A-1266 | - | UCUGCUCUCUCUGCACCCCU | 20 | 5115 |
| SCNN1A-1267 | + | CCUGAGCACCCCUGCCCCCU | 20 | 5116 |
| SCNN1A-1268 | - | UGGUUACUCACGAUGGCCCU | 20 | 5117 |
| SCNN1A-1269 | - | GAGCCUGUGGUUCGGCUCCU | 20 | 5118 |
| SCNN1A-1270 | + | CAUCUGGAAGACCCAUUCCU | 20 | 5119 |
| SCNN1A-1271 | - | CUACAGAAAGCACAGUUCCU | 20 | 5120 |
| SCNN1A-1272 | - | UGACACCCCAUUCUUUCCU | 20 | 5121 |
| SCNN1A-1273 | - | UCCCUGGAGGAGGACACGCU | 20 | 5122 |
| SCNN1A-1274 | + | AGCUGGUAGCUGGUCACGCU | 20 | 5123 |
| SCNN1A-1275 | + | AGAGGGAGCAGGGCCUGGCU | 20 | 5124 |
| SCNN1A-1276 | - | AGUUCCUCCACCUGUCCUCU | 20 | 5125 |
| SCNN1A-1277 | + | AGGAACAUCACUGCCAUUCU | 20 | 5126 |

TABLE 43E-continued

5th Tier

| gRNA Name | DNA Strand | Targeting Domain | Target Site Length | Seq ID |
|---|---|---|---|---|
| SCNN1A-1278 | + | GUCACAGUACUCCACGUUCU | 20 | 5127 |
| SCNN1A-1279 | + | CAUGGGGUGGGGCAGAAGU | 20 | 5128 |
| SCNN1A-1280 | + | GGGUGCAGAGAGAGCAGAGU | 20 | 5129 |
| SCNN1A-1281 | + | CUUAUCAGGAAAGAGAGAGU | 20 | 5130 |
| SCNN1A-1282 | + | GCUCCACUGGCUGCCCAGGU | 20 | 5131 |
| SCNN1A-1283 | + | UGGCUGCCACGGAAUCAGGU | 20 | 5132 |
| SCNN1A-1284 | + | CAUGGAAGACAUCCAGAGGU | 20 | 5133 |
| SCNN1A-1285 | − | GAGUCUCCCUCUGUCACGGU | 20 | 5134 |
| SCNN1A-1286 | + | UUAGGUGUGGGGCAGAGGGU | 20 | 5135 |
| SCNN1A-1287 | + | CAAGGACAGAGACAUGGGGU | 20 | 5136 |
| SCNN1A-1288 | − | AGUGUGGGGAAGGGAUGGGU | 20 | 5137 |
| SCNN1A-1289 | + | GGGCCGCGGAUAGAAGAUGU | 20 | 5138 |
| SCNN1A-1290 | − | UCUGAUCUCUUGGUGUAUGU | 20 | 5139 |
| SCNN1A-1291 | + | UUAUAGUAGCAGUACCCUGU | 20 | 5140 |
| SCNN1A-1292 | + | UGGAGAAAGGUGCUCAGUGU | 20 | 5141 |
| SCNN1A-1293 | − | UGACAUCCCAGGUAGAGUGU | 20 | 5142 |
| SCNN1A-1294 | + | CCACUCCAUUUCUUAGGUGU | 20 | 5143 |
| SCNN1A-1295 | − | AGGAAACCCUGGACAGACUU | 20 | 5144 |
| SCNN1A-1296 | + | CUUGAAGAAGAUGUUGACUU | 20 | 5145 |
| SCNN1A-1297 | + | AGUAUCGGCUUCGGAACCUU | 20 | 5146 |
| SCNN1A-1298 | + | CUGGAGACCAGUAUCGGCUU | 20 | 5147 |
| SCNN1A-1299 | + | CUUUGGCCACUCCAUUUCUU | 20 | 5148 |
| SCNN1A-1300 | + | GGCUGCCACGGAAUCAGGUU | 20 | 5149 |
| SCNN1A-1301 | − | AGCCAGUGGAGCCUGUGGUU | 20 | 5150 |

Table 44A provides exemplary targeting domains for knocking out the SCNN1A gene selected according to the first tier parameters. The targeting domains bind within the first 500 bp of the coding sequence (e.g., with 500 bp downstream from the start codon), have a high level of orthogonality, start with a 5'G, and PAM is NNGRRT. It is contemplated herein that in an embodiment the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 44A

1st Tier

| gRNA Name | DNA Strand | Targeting Domain | Target Site Length | Seq ID |
|---|---|---|---|---|
| SCNN1A-1302 | + | GGUUGAUGUUGAGGCUGA | 18 | 5151 |
| SCNN1A-42 | + | GAGGUUGAUGUUGAGGCUGA | 20 | 519 |
| SCNN1A-1303 | + | GUUGAGGUUGAUGUUGAGGCUGA | 23 | 5152 |
| SCNN1A-1304 | + | GCCCUCUCCCAUCACCCCUGGAAC | 24 | 5153 |
| SCNN1A-1305 | + | GUCAAGGCUGAGCUCUGGGCC | 21 | 5154 |
| SCNN1A-1306 | + | GGUCAAGGCUGAGCUCUGGGCC | 22 | 5155 |
| SCNN1A-1307 | + | GGGUCAAGGCUGAGCUCUGGGCC | 23 | 5156 |
| SCNN1A-1308 | + | GAGUGGAUUGGGGAGAGC | 18 | 5157 |
| SCNN1A-1309 | + | GGAGUGGAUUGGGGAGAGC | 19 | 5158 |
| SCNN1A-1310 | + | GCCCCGGAGUGGAUUGGGGAGAGC | 24 | 5159 |
| SCNN1A-1311 | + | GCCCUGGAGUGGACUGUGGAGGGC | 24 | 5160 |
| SCNN1A-1312 | + | GUAUGGGCUGCAGAGGUC | 18 | 5161 |
| SCNN1A-1313 | + | GGUAUGGGCUGCAGAGGUC | 19 | 5162 |
| SCNN1A-1314 | + | GACCUGGUAUGGGCUGCAGAGGUC | 24 | 5163 |
| SCNN1A-1315 | + | GAUACCUCCCCUUGGAAGGGACAG | 24 | 5164 |
| SCNN1A-1316 | + | GUGCUGGGAGCACACCAG | 18 | 5165 |

TABLE 44A-continued

1st Tier

| gRNA Name | DNA Strand | Targeting Domain | Target Site Length | Seq ID |
|---|---|---|---|---|
| SCNN1A-1317 | + | GUUGUGCUGGGAGCACACCAG | 21 | 5166 |
| SCNN1A-1318 | + | GGUUGUGCUGGGAGCACACCAG | 22 | 5167 |
| SCNN1A-1319 | + | GCGGUUGUGCUGGGAGCACACCAG | 24 | 5168 |
| SCNN1A-1320 | + | GUACUCUCCGAAAAGCAGG | 19 | 5169 |
| SCNN1A-1321 | + | GAAGUACUCUCCGAAAAGCAGG | 22 | 5170 |
| SCNN1A-1322 | + | GAUUGGGGAGAGCAAGGGU | 19 | 5171 |
| SCNN1A-1323 | + | GGAUUGGGGAGAGCAAGGGU | 20 | 5172 |
| SCNN1A-1324 | + | GUGGAUUGGGGAGAGCAAGGGU | 22 | 5173 |
| SCNN1A-1325 | + | GAGUGGAUUGGGGAGAGCAAGGGU | 24 | 5174 |
| SCNN1A-1326 | + | GAGGGACUAACCGACCUGU | 19 | 5175 |
| SCNN1A-1327 | + | GCAGAGGGACUAACCGACCUGU | 22 | 5176 |
| SCNN1A-1328 | + | GGCAGAGGGACUAACCGACCUGU | 23 | 5177 |
| SCNN1A-1329 | + | GGGCAGAGGGACUAACCGACCUGU | 24 | 5178 |
| SCNN1A-1330 | + | GCGGGGAAGACGAGCUUGU | 19 | 5179 |
| SCNN1A-1331 | + | GACUAACCGACCUGUAGGGAUU | 22 | 5180 |
| SCNN1A-1332 | + | GGACUAACCGACCUGUAGGGAUU | 23 | 5181 |
| SCNN1A-1333 | + | GGGACUAACCGACCUGUAGGGAUU | 24 | 5182 |
| SCNN1A-1334 | − | GCGGAGGAGGAGGCCCUGA | 19 | 5183 |
| SCNN1A-189 | − | GGCGGAGGAGGAGGCCCUGA | 20 | 819 |
| SCNN1A-1335 | − | GGCCAGGGGCAGCCUCAC | 18 | 5184 |
| SCNN1A-1336 | − | GCAGCCUCACUCGGGUUCC | 19 | 5185 |
| SCNN1A-348 | − | GGCAGCCUCACUCGGGUUCC | 20 | 4197 |
| SCNN1A-197 | − | GCAAUUCGGCCUGCUUUUCG | 20 | 826 |
| SCNN1A-1337 | − | GGCAAUUCGGCCUGCUUUUCG | 21 | 5186 |
| SCNN1A-1338 | − | GCUCCUACCGAGAGCUCU | 18 | 5187 |
| SCNN1A-437 | − | GUAAGCAAGGGAACCUGGUU | 20 | 4286 |
| SCNN1A-1339 | − | GGUAAGCAAGGGAACCUGGUU | 21 | 5188 |

Table 44B provides exemplary targeting domains for knocking out the SCNN1A gene selected according to the second tier parameters. The targeting domains bind within the first 500 bp of the coding sequence (e.g., with 500 bp downstream from the start codon), have a high level of orthogonality and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 44B

2nd Tier

| gRNA Name | DNA Strand | Targeting Domain | Target Site Length | Seq ID |
|---|---|---|---|---|
| SCNN1A-1340 | + | AGGUUGAUGUUGAGGCUGA | 19 | 5189 |
| SCNN1A-1341 | + | UGAGGUUGAUGUUGAGGCUGA | 21 | 5190 |

TABLE 44B-continued

| | | 2nd Tier | | |
|---|---|---|---|---|
| gRNA Name | DNA Strand | Targeting Domain | Target Site Length | Seq ID |
| SCNN1A-1342 | + | UUGAGGUUGAUGUUGAGGCUGA | 22 | 5191 |
| SCNN1A-1343 | + | AGUUGAGGUUGAUGUUGAGGCUGA | 24 | 5192 |
| SCNN1A-1344 | + | UCCCAUCACCCCUGGAAC | 18 | 5193 |
| SCNN1A-1345 | + | CUCCCAUCACCCCUGGAAC | 19 | 5194 |
| SCNN1A-1346 | + | UCUCCCAUCACCCCUGGAAC | 20 | 5195 |
| SCNN1A-1347 | + | CUCUCCCAUCACCCCUGGAAC | 21 | 5196 |
| SCNN1A-1348 | + | CCUCUCCCAUCACCCCUGGAAC | 22 | 5197 |
| SCNN1A-1349 | + | CCCUCUCCCAUCACCCCUGGAAC | 23 | 5198 |
| SCNN1A-1350 | + | AAGGCUGAGCUCUGGGCC | 18 | 5199 |
| SCNN1A-1351 | + | CAAGGCUGAGCUCUGGGCC | 19 | 5200 |
| SCNN1A-1352 | + | UCAAGGCUGAGCUCUGGGCC | 20 | 5201 |
| SCNN1A-1353 | + | AGGGUCAAGGCUGAGCUCUGGGCC | 24 | 5202 |
| SCNN1A-1354 | + | CGGAGUGGAUUGGGGAGAGC | 20 | 5203 |
| SCNN1A-1355 | + | CCGGAGUGGAUUGGGGAGAGC | 21 | 5204 |
| SCNN1A-1356 | + | CCCGGAGUGGAUUGGGGAGAGC | 22 | 5205 |
| SCNN1A-1357 | + | CCCCGGAGUGGAUUGGGGAGAGC | 23 | 5206 |
| SCNN1A-1358 | + | CUGGAGUGGACUGUGGAGGGC | 21 | 5207 |
| SCNN1A-1359 | + | CCUGGAGUGGACUGUGGAGGGC | 22 | 5208 |
| SCNN1A-1360 | + | CCCUGGAGUGGACUGUGGAGGGC | 23 | 5209 |
| SCNN1A-1361 | + | UGGUAUGGGCUGCAGAGGUC | 20 | 5210 |
| SCNN1A-1362 | + | CUGGUAUGGGCUGCAGAGGUC | 21 | 5211 |
| SCNN1A-1363 | + | CCUGGUAUGGGCUGCAGAGGUC | 22 | 5212 |
| SCNN1A-1364 | + | ACCUGGUAUGGGCUGCAGAGGUC | 23 | 5213 |
| SCNN1A-1365 | + | UCCCCUUGGAAGGGACAG | 18 | 5214 |
| SCNN1A-1366 | + | CUCCCCUUGGAAGGGACAG | 19 | 5215 |
| SCNN1A-1367 | + | CCUCCCCUUGGAAGGGACAG | 20 | 5216 |
| SCNN1A-1368 | + | ACCUCCCCUUGGAAGGGACAG | 21 | 5217 |
| SCNN1A-1369 | + | UACCUCCCCUUGGAAGGGACAG | 22 | 5218 |
| SCNN1A-1370 | + | AUACCUCCCCUUGGAAGGGACAG | 23 | 5219 |
| SCNN1A-1371 | + | UGUGCUGGGAGCACACCAG | 19 | 5220 |
| SCNN1A-224 | + | UUGUGCUGGGAGCACACCAG | 20 | 847 |
| SCNN1A-1372 | + | CGGUUGUGCUGGGAGCACACCAG | 23 | 5221 |
| SCNN1A-1373 | + | UACUCUCCGAAAAGCAGG | 18 | 5222 |
| SCNN1A-230 | + | AGUACUCUCCGAAAAGCAGG | 20 | 851 |
| SCNN1A-1374 | + | AAGUACUCUCCGAAAAGCAGG | 21 | 5223 |
| SCNN1A-1375 | + | UGAAGUACUCUCCGAAAAGCAGG | 23 | 5224 |
| SCNN1A-1376 | + | CUGAAGUACUCUCCGAAAAGCAGG | 24 | 5225 |

TABLE 44B-continued

| | 2nd Tier | | | |
|---|---|---|---|---|
| gRNA Name | DNA Strand | Targeting Domain | Target Site Length | Seq ID |
| SCNN1A-1377 | + | AUUGGGGAGAGCAAGGGU | 18 | 5226 |
| SCNN1A-1378 | + | UGGAUUGGGGAGAGCAAGGGU | 21 | 5227 |
| SCNN1A-1379 | + | AGUGGAUUGGGGAGAGCAAGGGU | 23 | 5228 |
| SCNN1A-1380 | + | AGGGACUAACCGACCUGU | 18 | 5229 |
| SCNN1A-424 | + | AGAGGGACUAACCGACCUGU | 20 | 4273 |
| SCNN1A-1381 | + | CAGAGGGACUAACCGACCUGU | 21 | 5230 |
| SCNN1A-1382 | + | CGGGGAAGACGAGCUUGU | 18 | 5231 |
| SCNN1A-237 | + | UGCGGGGAAGACGAGCUUGU | 20 | 857 |
| SCNN1A-1383 | + | CUGCGGGGAAGACGAGCUUGU | 21 | 5232 |
| SCNN1A-1384 | + | ACUGCGGGGAAGACGAGCUUGU | 22 | 5233 |
| SCNN1A-1385 | + | CACUGCGGGGAAGACGAGCUUGU | 23 | 5234 |
| SCNN1A-1386 | + | UCACUGCGGGGAAGACGAGCUUGU | 24 | 5235 |
| SCNN1A-1387 | + | AACCGACCUGUAGGGAUU | 18 | 5236 |
| SCNN1A-1388 | + | UAACCGACCUGUAGGGAUU | 19 | 5237 |
| SCNN1A-1389 | + | CUAACCGACCUGUAGGGAUU | 20 | 5238 |
| SCNN1A-1390 | + | ACUAACCGACCUGUAGGGAUU | 21 | 5239 |
| SCNN1A-1391 | − | CGGAGGAGGAGGCCCUGA | 18 | 5240 |
| SCNN1A-1392 | − | UGGCCAGGGGCAGCCUCAC | 19 | 5241 |
| SCNN1A-1393 | − | AUGGCCAGGGGCAGCCUCAC | 20 | 5242 |
| SCNN1A-1394 | − | CAGCCUCACUCGGGUUCC | 18 | 5243 |
| SCNN1A-1395 | − | AAUUCGGCCUGCUUUUCG | 18 | 5244 |
| SCNN1A-1396 | − | CAAUUCGGCCUGCUUUUCG | 19 | 5245 |
| SCNN1A-1397 | − | UGGCAAUUCGGCCUGCUUUUCG | 22 | 5246 |
| SCNN1A-1398 | − | CUGGCAAUUCGGCCUGCUUUUCG | 23 | 5247 |
| SCNN1A-1399 | − | ACUGGCAAUUCGGCCUGCUUUUCG | 24 | 5248 |
| SCNN1A-1400 | − | CGCUCCUACCGAGAGCUCU | 19 | 5249 |
| SCNN1A-192 | − | CCGCUCCUACCGAGAGCUCU | 20 | 822 |
| SCNN1A-1401 | − | ACCGCUCCUACCGAGAGCUCU | 21 | 5250 |
| SCNN1A-1402 | − | CACCGCUCCUACCGAGAGCUCU | 22 | 5251 |
| SCNN1A-1403 | − | CCACCGCUCCUACCGAGAGCUCU | 23 | 5252 |
| SCNN1A-1404 | − | UCCACCGCUCCUACCGAGAGCUCU | 24 | 5253 |
| SCNN1A-1405 | − | AAGCAAGGGAACCUGGUU | 18 | 5254 |
| SCNN1A-1406 | − | UAAGCAAGGGAACCUGGUU | 19 | 5255 |
| SCNN1A-1407 | − | AGGUAAGCAAGGGAACCUGGUU | 22 | 5256 |
| SCNN1A-1408 | − | AAGGUAAGCAAGGGAACCUGGUU | 23 | 5257 |
| SCNN1A-1409 | − | CAAGGUAAGCAAGGGAACCUGGUU | 24 | 5258 |

Table 44C provides exemplary targeting domains for knocking out the SCNN1A gene selected according to the third tier parameters. The targeting domains bind within the first 500 bp of the coding sequence (e.g., with 500 bp downstream from the start codon), have a high level of orthogonality and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 44C

3rd Tier

| gRNA Name | DNA Strand | Targeting Domain | Target Site Length | Seq ID |
|---|---|---|---|---|
| SCNN1A-1410 | + | CCCUUCAUGAGCCCCGGA | 18 | 5259 |
| SCNN1A-1411 | + | CCCCUUCAUGAGCCCCGGA | 19 | 5260 |
| SCNN1A-1412 | + | UCCCCUUCAUGAGCCCCGGA | 20 | 5261 |
| SCNN1A-1413 | + | UUCCCCUUCAUGAGCCCCGGA | 21 | 5262 |
| SCNN1A-1414 | + | GUUCCCCUUCAUGAGCCCCGGA | 22 | 5263 |
| SCNN1A-1415 | + | UGUUCCCCUUCAUGAGCCCCGGA | 23 | 5264 |
| SCNN1A-1416 | + | UUGUUCCCCUUCAUGAGCCCCGGA | 24 | 5265 |
| SCNN1A-1417 | + | GUUCCCCUUCAUGAGCCC | 18 | 5266 |
| SCNN1A-1418 | + | UGUUCCCCUUCAUGAGCCC | 19 | 5267 |
| SCNN1A-72 | + | UUGUUCCCCUUCAUGAGCCC | 20 | 599 |
| SCNN1A-1419 | + | CUUGUUCCCCUUCAUGAGCCC | 21 | 5268 |
| SCNN1A-1420 | + | GCUUGUUCCCCUUCAUGAGCCC | 22 | 5269 |
| SCNN1A-1421 | + | AGCUUGUUCCCCUUCAUGAGCCC | 23 | 5270 |
| SCNN1A-1422 | + | CAGCUUGUUCCCCUUCAUGAGCCC | 24 | 5271 |
| SCNN1A-1423 | + | CGCUUGUUCCCCUUCAUGAGCCC | 23 | 5272 |
| SCNN1A-1424 | + | ACGCUUGUUCCCCUUCAUGAGCCC | 24 | 5273 |
| SCNN1A-1425 | + | CACCAGGCGGAUGGCGCC | 18 | 5274 |
| SCNN1A-1426 | + | ACACCAGGCGGAUGGCGCC | 19 | 5275 |
| SCNN1A-223 | + | CACACCAGGCGGAUGGCGCC | 20 | 846 |
| SCNN1A-1427 | + | GCACACCAGGCGGAUGGCGCC | 21 | 5276 |
| SCNN1A-1428 | + | AGCACACCAGGCGGAUGGCGCC | 22 | 5277 |
| SCNN1A-1429 | + | GAGCACACCAGGCGGAUGGCGCC | 23 | 5278 |
| SCNN1A-1430 | + | GGAGCACACCAGGCGGAUGGCGCC | 24 | 5279 |
| SCNN1A-1431 | + | GAGUGGACUGUGGAGGGC | 18 | 5280 |
| SCNN1A-1432 | + | GGAGUGGACUGUGGAGGGC | 19 | 5281 |
| SCNN1A-201 | + | UGGAGUGGACUGUGGAGGGC | 20 | 830 |
| SCNN1A-1433 | − | CGGCGGAGGAGGAGGCCCUGA | 21 | 5282 |
| SCNN1A-1434 | − | ACGGCGGAGGAGGAGGCCCUGA | 22 | 5283 |
| SCNN1A-1435 | − | CACGGCGGAGGAGGAGGCCCUGA | 23 | 5284 |
| SCNN1A-1436 | − | CCACGGCGGAGGAGGAGGCCCUGA | 24 | 5285 |
| SCNN1A-1437 | − | CAUGGCCAGGGGCAGCCUCAC | 21 | 5286 |
| SCNN1A-1438 | − | GCAUGGCCAGGGGCAGCCUCAC | 22 | 5287 |
| SCNN1A-1439 | − | GGCAUGGCCAGGGGCAGCCUCAC | 23 | 5288 |
| SCNN1A-1440 | − | GGGCAUGGCCAGGGGCAGCCUCAC | 24 | 5289 |
| SCNN1A-1441 | − | GGGCAGCCUCACUCGGGUUCC | 21 | 5290 |

TABLE 44C-continued

3rd Tier

| gRNA Name | DNA Strand | Targeting Domain | Target Site Length | Seq ID |
|---|---|---|---|---|
| SCNN1A-1442 | − | GGGGCAGCCUCACUCGGGUUCC | 22 | 5291 |
| SCNN1A-1443 | − | AGGGGCAGCCUCACUCGGGUUCC | 23 | 5292 |
| SCNN1A-1444 | − | CAGGGGCAGCCUCACUCGGGUUCC | 24 | 5293 |

Table 44D provides exemplary targeting domains for knocking out the SCNN1A gene selected according to the fourth tier parameters. The targeting domains bind within the first 500 bp of the coding sequence (e.g., with 500 bp downstream from the start codon), have a high level of orthogonality and PAM is NNGRRV. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 44D

4th Tier

| gRNA Name | DNA Strand | Targeting Domain | Target Site Length | Seq ID |
|---|---|---|---|---|
| SCNN1A-1445 | + | AUCACCCCUGGAACCCGA | 18 | 5294 |
| SCNN1A-1446 | + | CAUCACCCCUGGAACCCGA | 19 | 5295 |
| SCNN1A-1447 | + | CCAUCACCCCUGGAACCCGA | 20 | 5296 |
| SCNN1A-1448 | + | CCCAUCACCCCUGGAACCCGA | 21 | 5297 |
| SCNN1A-1449 | + | UCCCAUCACCCCUGGAACCCGA | 22 | 5298 |
| SCNN1A-1450 | + | CUCCCAUCACCCCUGGAACCCGA | 23 | 5299 |
| SCNN1A-1451 | + | UCUCCCAUCACCCCUGGAACCCGA | 24 | 5300 |
| SCNN1A-1452 | + | CUAACCGACCUGUAGGGA | 18 | 5301 |
| SCNN1A-1453 | + | ACUAACCGACCUGUAGGGA | 19 | 5302 |
| SCNN1A-1454 | + | GACUAACCGACCUGUAGGGA | 20 | 5303 |
| SCNN1A-1455 | + | GGACUAACCGACCUGUAGGGA | 21 | 5304 |
| SCNN1A-1456 | + | GGGACUAACCGACCUGUAGGGA | 22 | 5305 |
| SCNN1A-1457 | + | AGGGACUAACCGACCUGUAGGGA | 23 | 5306 |
| SCNN1A-1458 | + | GAGGGACUAACCGACCUGUAGGGA | 24 | 5307 |
| SCNN1A-1459 | + | CCCUUCAUGAGCCCUGGA | 18 | 5308 |
| SCNN1A-1460 | + | CCCCUUCAUGAGCCCUGGA | 19 | 5309 |
| SCNN1A-205 | + | UCCCCUUCAUGAGCCCUGGA | 20 | 833 |
| SCNN1A-1461 | + | UUCCCCUUCAUGAGCCCUGGA | 21 | 5310 |
| SCNN1A-1462 | + | GUUCCCCUUCAUGAGCCCUGGA | 22 | 5311 |
| SCNN1A-1463 | + | UGUUCCCCUUCAUGAGCCCUGGA | 23 | 5312 |
| SCNN1A-1464 | + | UUGUUCCCCUUCAUGAGCCCUGGA | 24 | 5313 |
| SCNN1A-1465 | + | CAUGAGCCCCGGAGUGGA | 18 | 5314 |
| SCNN1A-1466 | + | UCAUGAGCCCCGGAGUGGA | 19 | 5315 |
| SCNN1A-1467 | + | UUCAUGAGCCCCGGAGUGGA | 20 | 5316 |
| SCNN1A-1468 | + | CUUCAUGAGCCCCGGAGUGGA | 21 | 5317 |

TABLE 44D-continued

4th Tier

| gRNA Name | DNA Strand | Targeting Domain | Target Site Length | Seq ID |
|---|---|---|---|---|
| SCNN1A-1469 | + | CCUUCAUGAGCCCCGGAGUGGA | 22 | 5318 |
| SCNN1A-1470 | + | CCCUUCAUGAGCCCCGGAGUGGA | 23 | 5319 |
| SCNN1A-1471 | + | CCCCUUCAUGAGCCCCGGAGUGGA | 24 | 5320 |
| SCNN1A-1472 | + | AUGAUACCUCCCCUUGGA | 18 | 5321 |
| SCNN1A-1473 | + | CAUGAUACCUCCCCUUGGA | 19 | 5322 |
| SCNN1A-399 | + | UCAUGAUACCUCCCCUUGGA | 20 | 4248 |
| SCNN1A-1474 | + | CUCAUGAUACCUCCCCUUGGA | 21 | 5323 |
| SCNN1A-1475 | + | GCUCAUGAUACCUCCCCUUGGA | 22 | 5324 |
| SCNN1A-1476 | + | UGCUCAUGAUACCUCCCCUUGGA | 23 | 5325 |
| SCNN1A-1477 | + | CUGCUCAUGAUACCUCCCCUUGGA | 24 | 5326 |
| SCNN1A-1478 | + | GUGUUGUUGCAGAAGAAC | 18 | 5327 |
| SCNN1A-1479 | + | GGUGUUGUUGCAGAAGAAC | 19 | 5328 |
| SCNN1A-220 | + | UGGUGUUGUUGCAGAAGAAC | 20 | 843 |
| SCNN1A-1480 | + | GUGGUGUUGUUGCAGAAGAAC | 21 | 5329 |
| SCNN1A-1481 | + | GGUGGUGUUGUUGCAGAAGAAC | 22 | 5330 |
| SCNN1A-1482 | + | UGGUGGUGUUGUUGCAGAAGAAC | 23 | 5331 |
| SCNN1A-1483 | + | AUGGUGGUGUUGUUGCAGAAGAAC | 24 | 5332 |
| SCNN1A-1484 | + | UGCCCUCUCCCAUCACCC | 18 | 5333 |
| SCNN1A-1485 | + | GUGCCCUCUCCCAUCACCC | 19 | 5334 |
| SCNN1A-1486 | + | AGUGCCCUCUCCCAUCACCC | 20 | 5335 |
| SCNN1A-1487 | + | GAGUGCCCUCUCCCAUCACCC | 21 | 5336 |
| SCNN1A-1488 | + | UGAGUGCCCUCUCCCAUCACCC | 22 | 5337 |
| SCNN1A-1489 | + | CUGAGUGCCCUCUCCCAUCACCC | 23 | 5338 |
| SCNN1A-1490 | + | CCUGAGUGCCCUCUCCCAUCACCC | 24 | 5339 |
| SCNN1A-1491 | + | GCCCUCUCCCAUCACCCC | 18 | 5340 |
| SCNN1A-1492 | + | UGCCCUCUCCCAUCACCCC | 19 | 5341 |
| SCNN1A-346 | + | GUGCCCUCUCCCAUCACCCC | 20 | 4195 |
| SCNN1A-1493 | + | AGUGCCCUCUCCCAUCACCCC | 21 | 5342 |
| SCNN1A-1494 | + | GAGUGCCCUCUCCCAUCACCCC | 22 | 5343 |
| SCNN1A-1495 | + | UGAGUGCCCUCUCCCAUCACCCC | 23 | 5344 |
| SCNN1A-1496 | + | CUGAGUGCCCUCUCCCAUCACCCC | 24 | 5345 |
| SCNN1A-1497 | + | UGCUCAUGAUACCUCCCC | 18 | 5346 |
| SCNN1A-1498 | + | CUGCUCAUGAUACCUCCCC | 19 | 5347 |
| SCNN1A-1499 | + | ACUGCUCAUGAUACCUCCCC | 20 | 5348 |
| SCNN1A-1500 | + | UACUGCUCAUGAUACCUCCCC | 21 | 5349 |
| SCNN1A-1501 | + | AUACUGCUCAUGAUACCUCCCC | 22 | 5350 |
| SCNN1A-1502 | + | GAUACUGCUCAUGAUACCUCCCC | 23 | 5351 |
| SCNN1A-1503 | + | UGAUACUGCUCAUGAUACCUCCCC | 24 | 5352 |

TABLE 44D-continued

4th Tier

| gRNA Name | DNA Strand | Targeting Domain | Target Site Length | Seq ID |
|---|---|---|---|---|
| SCNN1A-1504 | + | UGUUCCCCUUCAUGAGCC | 18 | 5353 |
| SCNN1A-1505 | + | UUGUUCCCCUUCAUGAGCC | 19 | 5354 |
| SCNN1A-207 | + | CUUGUUCCCCUUCAUGAGCC | 20 | 834 |
| SCNN1A-1506 | + | GCUUGUUCCCCUUCAUGAGCC | 21 | 5355 |
| SCNN1A-1507 | + | AGCUUGUUCCCCUUCAUGAGCC | 22 | 5356 |
| SCNN1A-1508 | + | CAGCUUGUUCCCCUUCAUGAGCC | 23 | 5357 |
| SCNN1A-1509 | + | CCAGCUUGUUCCCCUUCAUGAGCC | 24 | 5358 |
| SCNN1A-1510 | + | CGCUUGUUCCCCUUCAUGAGCC | 22 | 5359 |
| SCNN1A-1511 | + | ACGCUUGUUCCCCUUCAUGAGCC | 23 | 5360 |
| SCNN1A-1512 | + | CACGCUUGUUCCCCUUCAUGAGCC | 24 | 5361 |
| SCNN1A-1513 | + | AGGGCCUCCUCCUCCGCC | 18 | 5362 |
| SCNN1A-1514 | + | CAGGGCCUCCUCCUCCGCC | 19 | 5363 |
| SCNN1A-213 | + | UCAGGGCCUCCUCCUCCGCC | 20 | 838 |
| SCNN1A-1515 | + | AUCAGGGCCUCCUCCUCCGCC | 21 | 5364 |
| SCNN1A-1516 | + | GAUCAGGGCCUCCUCCUCCGCC | 22 | 5365 |
| SCNN1A-1517 | + | CGAUCAGGGCCUCCUCCUCCGCC | 23 | 5366 |
| SCNN1A-1518 | + | UCGAUCAGGGCCUCCUCCUCCGCC | 24 | 5367 |
| SCNN1A-1519 | + | CAGAGCCACAGCACUGCC | 18 | 5368 |
| SCNN1A-1520 | + | GCAGAGCCACAGCACUGCC | 19 | 5369 |
| SCNN1A-228 | + | UGCAGAGCCACAGCACUGCC | 20 | 849 |
| SCNN1A-1521 | + | GUGCAGAGCCACAGCACUGCC | 21 | 5370 |
| SCNN1A-1522 | + | GGUGCAGAGCCACAGCACUGCC | 22 | 5371 |
| SCNN1A-1523 | + | AGGUGCAGAGCCACAGCACUGCC | 23 | 5372 |
| SCNN1A-1524 | + | AAGGUGCAGAGCCACAGCACUGCC | 24 | 5373 |
| SCNN1A-1525 | + | UCCAGCUUGUUCCCCUCC | 18 | 5374 |
| SCNN1A-1526 | + | CUCCAGCUUGUUCCCCUCC | 19 | 5375 |
| SCNN1A-200 | + | CCUCCAGCUUGUUCCCCUCC | 20 | 829 |
| SCNN1A-1527 | + | UCCUCCAGCUUGUUCCCCUCC | 21 | 5376 |
| SCNN1A-1528 | + | CUCCUCCAGCUUGUUCCCCUCC | 22 | 5377 |
| SCNN1A-1529 | + | GCUCCUCCAGCUUGUUCCCCUCC | 23 | 5378 |
| SCNN1A-1530 | + | UGCUCCUCCAGCUUGUUCCCCUCC | 24 | 5379 |
| SCNN1A-1531 | + | GGUGCAGAUGGUCACUGC | 18 | 5380 |
| SCNN1A-1532 | + | GGGUGCAGAUGGUCACUGC | 19 | 5381 |
| SCNN1A-38 | + | AGGGUGCAGAUGGUCACUGC | 20 | 575 |
| SCNN1A-1533 | + | GAGGGUGCAGAUGGUCACUGC | 21 | 5382 |
| SCNN1A-1534 | + | UGAGGGUGCAGAUGGUCACUGC | 22 | 5383 |
| SCNN1A-1535 | + | UUGAGGGUGCAGAUGGUCACUGC | 23 | 5384 |

TABLE 44D-continued

4th Tier

| gRNA Name | DNA Strand | Targeting Domain | Target Site Length | Seq ID |
|---|---|---|---|---|
| SCNN1A-1536 | + | AUUGAGGGUGCAGAUGGUCACUGC | 24 | 5385 |
| SCNN1A-1537 | + | UCCUCCGCCGUGGGCUGC | 18 | 5386 |
| SCNN1A-1538 | + | CUCCUCCGCCGUGGGCUGC | 19 | 5387 |
| SCNN1A-65 | + | CCUCCUCCGCCGUGGGCUGC | 20 | 594 |
| SCNN1A-1539 | + | UCCUCCUCCGCCGUGGGCUGC | 21 | 5388 |
| SCNN1A-1540 | + | CUCCUCCUCCGCCGUGGGCUGC | 22 | 5389 |
| SCNN1A-1541 | + | CCUCCUCCUCCGCCGUGGGCUGC | 23 | 5390 |
| SCNN1A-1542 | + | GCCUCCUCCUCCGCCGUGGGCUGC | 24 | 5391 |
| SCNN1A-1543 | + | GUCUUCAUGCGGUUGUGC | 18 | 5392 |
| SCNN1A-1544 | + | CGUCUUCAUGCGGUUGUGC | 19 | 5393 |
| SCNN1A-49 | + | CCGUCUUCAUGCGGUUGUGC | 20 | 582 |
| SCNN1A-1545 | + | GCCGUCUUCAUGCGGUUGUGC | 21 | 5394 |
| SCNN1A-1546 | + | GGCCGUCUUCAUGCGGUUGUGC | 22 | 5395 |
| SCNN1A-1547 | + | AGGCCGUCUUCAUGCGGUUGUGC | 23 | 5396 |
| SCNN1A-1548 | + | AAGGCCGUCUUCAUGCGGUUGUGC | 24 | 5397 |
| SCNN1A-1549 | + | UCCAGCUUGUUCCCCUUC | 18 | 5398 |
| SCNN1A-1550 | + | CUCCAGCUUGUUCCCCUUC | 19 | 5399 |
| SCNN1A-1551 | + | CCUCCAGCUUGUUCCCCUUC | 20 | 5400 |
| SCNN1A-1552 | + | UCCUCCAGCUUGUUCCCCUUC | 21 | 5401 |
| SCNN1A-1553 | + | CUCCUCCAGCUUGUUCCCCUUC | 22 | 5402 |
| SCNN1A-1554 | + | GCUCCUCCAGCUUGUUCCCCUUC | 23 | 5403 |
| SCNN1A-1555 | + | UGCUCCUCCAGCUUGUUCCCCUUC | 24 | 5404 |
| SCNN1A-1556 | + | UCACGCUUGUUCCCCUUC | 18 | 5405 |
| SCNN1A-1557 | + | CUCACGCUUGUUCCCCUUC | 19 | 5406 |
| SCNN1A-208 | + | CCUCACGCUUGUUCCCCUUC | 20 | 835 |
| SCNN1A-1558 | + | UCCUCACGCUUGUUCCCCUUC | 21 | 5407 |
| SCNN1A-1559 | + | CUCCUCACGCUUGUUCCCCUUC | 22 | 5408 |
| SCNN1A-1560 | + | GCUCCUCACGCUUGUUCCCCUUC | 23 | 5409 |
| SCNN1A-1561 | + | UGCUCCUCACGCUUGUUCCCCUUC | 24 | 5410 |
| SCNN1A-1562 | + | AUGGUCACUGCGGGGAAG | 18 | 5411 |
| SCNN1A-1563 | + | GAUGGUCACUGCGGGGAAG | 19 | 5412 |
| SCNN1A-238 | + | AGAUGGUCACUGCGGGGAAG | 20 | 858 |
| SCNN1A-1564 | + | CAGAUGGUCACUGCGGGGAAG | 21 | 5413 |
| SCNN1A-1565 | + | GCAGAUGGUCACUGCGGGGAAG | 22 | 5414 |
| SCNN1A-1566 | + | UGCAGAUGGUCACUGCGGGGAAG | 23 | 5415 |
| SCNN1A-1567 | + | GUGCAGAUGGUCACUGCGGGGAAG | 24 | 5416 |
| SCNN1A-1568 | + | AUGGUGGUGUUGUUGCAG | 18 | 5417 |
| SCNN1A-1569 | + | GAUGGUGGUGUUGUUGCAG | 19 | 5418 |

TABLE 44D-continued

4th Tier

| gRNA Name | DNA Strand | Targeting Domain | Target Site Length | Seq ID |
|---|---|---|---|---|
| SCNN1A-221 | + | GGAUGGUGGUGUUGUUGCAG | 20 | 844 |
| SCNN1A-1570 | + | UGGAUGGUGGUGUUGUUGCAG | 21 | 5419 |
| SCNN1A-1571 | + | GUGGAUGGUGGUGUUGUUGCAG | 22 | 5420 |
| SCNN1A-1572 | + | CGUGGAUGGUGGUGUUGUUGCAG | 23 | 5421 |
| SCNN1A-1573 | + | CCGUGGAUGGUGGUGUUGUUGCAG | 24 | 5422 |
| SCNN1A-1574 | + | AAGACGAGCUUGUCCGAG | 18 | 5423 |
| SCNN1A-1575 | + | GAAGACGAGCUUGUCCGAG | 19 | 5424 |
| SCNN1A-236 | + | GGAAGACGAGCUUGUCCGAG | 20 | 856 |
| SCNN1A-1576 | + | GGGAAGACGAGCUUGUCCGAG | 21 | 5425 |
| SCNN1A-1577 | + | GGGGAAGACGAGCUUGUCCGAG | 22 | 5426 |
| SCNN1A-1578 | + | CGGGGAAGACGAGCUUGUCCGAG | 23 | 5427 |
| SCNN1A-1579 | + | GCGGGGAAGACGAGCUUGUCCGAG | 24 | 5428 |
| SCNN1A-1580 | + | UUGAGGCUGACGGGGUAG | 18 | 5429 |
| SCNN1A-1581 | + | GUUGAGGCUGACGGGGUAG | 19 | 5430 |
| SCNN1A-232 | + | UGUUGAGGCUGACGGGGUAG | 20 | 853 |
| SCNN1A-1582 | + | AUGUUGAGGCUGACGGGGUAG | 21 | 5431 |
| SCNN1A-1583 | + | GAUGUUGAGGCUGACGGGGUAG | 22 | 5432 |
| SCNN1A-1584 | + | UGAUGUUGAGGCUGACGGGGUAG | 23 | 5433 |
| SCNN1A-1585 | + | UUGAUGUUGAGGCUGACGGGGUAG | 24 | 5434 |
| SCNN1A-1586 | + | GAGCUCUCGGUAGGAGCG | 18 | 5435 |
| SCNN1A-1587 | + | AGAGCUCUCGGUAGGAGCG | 19 | 5436 |
| SCNN1A-216 | + | AAGAGCUCUCGGUAGGAGCG | 20 | 840 |
| SCNN1A-1588 | + | GAAGAGCUCUCGGUAGGAGCG | 21 | 5437 |
| SCNN1A-1589 | + | CGAAGAGCUCUCGGUAGGAGCG | 22 | 5438 |
| SCNN1A-1590 | + | UCGAAGAGCUCUCGGUAGGAGCG | 23 | 5439 |
| SCNN1A-1591 | + | CUCGAAGAGCUCUCGGUAGGAGCG | 24 | 5440 |
| SCNN1A-1592 | + | GUGCAGAUGGUCACUGCG | 18 | 5441 |
| SCNN1A-1593 | + | GGUGCAGAUGGUCACUGCG | 19 | 5442 |
| SCNN1A-39 | + | GGGUGCAGAUGGUCACUGCG | 20 | 518 |
| SCNN1A-1594 | + | AGGGUGCAGAUGGUCACUGCG | 21 | 5443 |
| SCNN1A-1595 | + | GAGGGUGCAGAUGGUCACUGCG | 22 | 5444 |
| SCNN1A-1596 | + | UGAGGGUGCAGAUGGUCACUGCG | 23 | 5445 |
| SCNN1A-1597 | + | UUGAGGGUGCAGAUGGUCACUGCG | 24 | 5446 |
| SCNN1A-1598 | + | UUGUUGCAGAAGAACUCG | 18 | 5447 |
| SCNN1A-1599 | + | GUUGUUGCAGAAGAACUCG | 19 | 5448 |
| SCNN1A-219 | + | UGUUGUUGCAGAAGAACUCG | 20 | 842 |
| SCNN1A-1600 | + | GUGUUGUUGCAGAAGAACUCG | 21 | 5449 |

TABLE 44D-continued

4th Tier

| gRNA Name | DNA Strand | Targeting Domain | Target Site Length | Seq ID |
|---|---|---|---|---|
| SCNN1A-1601 | + | GGUGUUGUUGCAGAAGAACUCG | 22 | 5450 |
| SCNN1A-1602 | + | UGGUGUUGUUGCAGAAGAACUCG | 23 | 5451 |
| SCNN1A-1603 | + | GUGGUGUUGUUGCAGAAGAACUCG | 24 | 5452 |
| SCNN1A-1604 | + | CAAGGGUCAGGGUCAAGG | 18 | 5453 |
| SCNN1A-1605 | + | GCAAGGGUCAGGGUCAAGG | 19 | 5454 |
| SCNN1A-1606 | + | AGCAAGGGUCAGGGUCAAGG | 20 | 5455 |
| SCNN1A-1607 | + | GAGCAAGGGUCAGGGUCAAGG | 21 | 5456 |
| SCNN1A-1608 | + | AGAGCAAGGGUCAGGGUCAAGG | 22 | 5457 |
| SCNN1A-1609 | + | GAGAGCAAGGGUCAGGGUCAAGG | 23 | 5458 |
| SCNN1A-1610 | + | GGAGAGCAAGGGUCAGGGUCAAGG | 24 | 5459 |
| SCNN1A-1611 | + | AGCUCUCGGUAGGAGCGG | 18 | 5460 |
| SCNN1A-1612 | + | GAGCUCUCGGUAGGAGCGG | 19 | 5461 |
| SCNN1A-60 | + | AGAGCUCUCGGUAGGAGCGG | 20 | 590 |
| SCNN1A-1613 | + | AAGAGCUCUCGGUAGGAGCGG | 21 | 5462 |
| SCNN1A-1614 | + | GAAGAGCUCUCGGUAGGAGCGG | 22 | 5463 |
| SCNN1A-1615 | + | CGAAGAGCUCUCGGUAGGAGCGG | 23 | 5464 |
| SCNN1A-1616 | + | UCGAAGAGCUCUCGGUAGGAGCGG | 24 | 5465 |
| SCNN1A-1617 | + | AACUCGAAGAGCUCUCGG | 18 | 5466 |
| SCNN1A-1618 | + | GAACUCGAAGAGCUCUCGG | 19 | 5467 |
| SCNN1A-218 | + | AGAACUCGAAGAGCUCUCGG | 20 | 841 |
| SCNN1A-1619 | + | AAGAACUCGAAGAGCUCUCGG | 21 | 5468 |
| SCNN1A-1620 | + | GAAGAACUCGAAGAGCUCUCGG | 22 | 5469 |
| SCNN1A-1621 | + | AGAAGAACUCGAAGAGCUCUCGG | 23 | 5470 |
| SCNN1A-1622 | + | CAGAAGAACUCGAAGAGCUCUCGG | 24 | 5471 |
| SCNN1A-1623 | + | GCCCCGGAGUGGAUUGGG | 18 | 5472 |
| SCNN1A-1624 | + | AGCCCCGGAGUGGAUUGGG | 19 | 5473 |
| SCNN1A-1625 | + | GAGCCCCGGAGUGGAUUGGG | 20 | 5474 |
| SCNN1A-1626 | + | UGAGCCCCGGAGUGGAUUGGG | 21 | 5475 |
| SCNN1A-1627 | + | AUGAGCCCCGGAGUGGAUUGGG | 22 | 5476 |
| SCNN1A-1628 | + | CAUGAGCCCCGGAGUGGAUUGGG | 23 | 5477 |
| SCNN1A-1629 | + | UCAUGAGCCCCGGAGUGGAUUGGG | 24 | 5478 |
| SCNN1A-1630 | + | CAUGAUACCUCCCCUUGG | 18 | 5479 |
| SCNN1A-1631 | + | UCAUGAUACCUCCCCUUGG | 19 | 5480 |
| SCNN1A-1632 | + | CUCAUGAUACCUCCCCUUGG | 20 | 5481 |
| SCNN1A-1633 | + | GCUCAUGAUACCUCCCCUUGG | 21 | 5482 |
| SCNN1A-1634 | + | UGCUCAUGAUACCUCCCCUUGG | 22 | 5483 |
| SCNN1A-1635 | + | CUGCUCAUGAUACCUCCCCUUGG | 23 | 5484 |
| SCNN1A-1636 | + | ACUGCUCAUGAUACCUCCCCUUGG | 24 | 5485 |

TABLE 44D-continued

4th Tier

| gRNA Name | DNA Strand | Targeting Domain | Target Site Length | Seq ID |
|---|---|---|---|---|
| SCNN1A-1637 | + | UCCGAGUUGAGGUUGAUG | 18 | 5486 |
| SCNN1A-1638 | + | GUCCGAGUUGAGGUUGAUG | 19 | 5487 |
| SCNN1A-235 | + | UGUCCGAGUUGAGGUUGAUG | 20 | 855 |
| SCNN1A-1639 | + | UUGUCCGAGUUGAGGUUGAUG | 21 | 5488 |
| SCNN1A-1640 | + | CUUGUCCGAGUUGAGGUUGAUG | 22 | 5489 |
| SCNN1A-1641 | + | GCUUGUCCGAGUUGAGGUUGAUG | 23 | 5490 |
| SCNN1A-1642 | + | AGCUUGUCCGAGUUGAGGUUGAUG | 24 | 5491 |
| SCNN1A-1643 | + | GGGUGCAGAUGGUCACUG | 18 | 5492 |
| SCNN1A-1644 | + | AGGGUGCAGAUGGUCACUG | 19 | 5493 |
| SCNN1A-37 | + | GAGGGUGCAGAUGGUCACUG | 20 | 517 |
| SCNN1A-1645 | + | UGAGGGUGCAGAUGGUCACUG | 21 | 5494 |
| SCNN1A-1646 | + | UUGAGGGUGCAGAUGGUCACUG | 22 | 5495 |
| SCNN1A-1647 | + | AUUGAGGGUGCAGAUGGUCACUG | 23 | 5496 |
| SCNN1A-1648 | + | GAUUGAGGGUGCAGAUGGUCACUG | 24 | 5497 |
| SCNN1A-1649 | + | GAGCCCUGGAGUGGACUG | 18 | 5498 |
| SCNN1A-1650 | + | UGAGCCCUGGAGUGGACUG | 19 | 5499 |
| SCNN1A-74 | + | AUGAGCCCUGGAGUGGACUG | 20 | 601 |
| SCNN1A-1651 | + | CAUGAGCCCUGGAGUGGACUG | 21 | 5500 |
| SCNN1A-1652 | + | UCAUGAGCCCUGGAGUGGACUG | 22 | 5501 |
| SCNN1A-1653 | + | UUCAUGAGCCCUGGAGUGGACUG | 23 | 5502 |
| SCNN1A-1654 | + | CUUCAUGAGCCCUGGAGUGGACUG | 24 | 5503 |
| SCNN1A-1655 | + | GAGGGACUAACCGACCUG | 18 | 5504 |
| SCNN1A-1656 | + | AGAGGGACUAACCGACCUG | 19 | 5505 |
| SCNN1A-1657 | + | CAGAGGGACUAACCGACCUG | 20 | 5506 |
| SCNN1A-1658 | + | GCAGAGGGACUAACCGACCUG | 21 | 5507 |
| SCNN1A-1659 | + | GGCAGAGGGACUAACCGACCUG | 22 | 5508 |
| SCNN1A-1660 | + | GGGCAGAGGGACUAACCGACCUG | 23 | 5509 |
| SCNN1A-1661 | + | GGGGCAGAGGGACUAACCGACCUG | 24 | 5510 |
| SCNN1A-1662 | + | AGGUUGAUGUUGAGGCUG | 18 | 5511 |
| SCNN1A-1663 | + | GAGGUUGAUGUUGAGGCUG | 19 | 5512 |
| SCNN1A-234 | + | UGAGGUUGAUGUUGAGGCUG | 20 | 854 |
| SCNN1A-1664 | + | UUGAGGUUGAUGUUGAGGCUG | 21 | 5513 |
| SCNN1A-1665 | + | GUUGAGGUUGAUGUUGAGGCUG | 22 | 5514 |
| SCNN1A-1666 | + | AGUUGAGGUUGAUGUUGAGGCUG | 23 | 5515 |
| SCNN1A-1667 | + | GAGUUGAGGUUGAUGUUGAGGCUG | 24 | 5516 |
| SCNN1A-1668 | + | GAGACCUGGUAUGGGCUG | 18 | 5517 |
| SCNN1A-1669 | + | UGAGACCUGGUAUGGGCUG | 19 | 5518 |

TABLE 44D-continued

4th Tier

| gRNA Name | DNA Strand | Targeting Domain | Target Site Length | Seq ID |
|---|---|---|---|---|
| SCNN1A-1670 | + | AUGAGACCUGGUAUGGGCUG | 20 | 5519 |
| SCNN1A-1671 | + | CAUGAGACCUGGUAUGGGCUG | 21 | 5520 |
| SCNN1A-1672 | + | CCAUGAGACCUGGUAUGGGCUG | 22 | 5521 |
| SCNN1A-1673 | + | UCCAUGAGACCUGGUAUGGGCUG | 23 | 5522 |
| SCNN1A-1674 | + | CUCCAUGAGACCUGGUAUGGGCUG | 24 | 5523 |
| SCNN1A-1675 | + | CUCCUCCGCCGUGGGCUG | 18 | 5524 |
| SCNN1A-1676 | + | CCUCCUCCGCCGUGGGCUG | 19 | 5525 |
| SCNN1A-212 | + | UCCUCCUCCGCCGUGGGCUG | 20 | 837 |
| SCNN1A-1677 | + | CUCCUCCUCCGCCGUGGGCUG | 21 | 5526 |
| SCNN1A-1678 | + | CCUCCUCCUCCGCCGUGGGCUG | 22 | 5527 |
| SCNN1A-1679 | + | GCCUCCUCCUCCGCCGUGGGCUG | 23 | 5528 |
| SCNN1A-1680 | + | GGCCUCCUCCUCCGCCGUGGGCUG | 24 | 5529 |
| SCNN1A-1681 | + | UACAUCAUGCCAAAGGUG | 18 | 5530 |
| SCNN1A-1682 | + | GUACAUCAUGCCAAAGGUG | 19 | 5531 |
| SCNN1A-229 | + | AGUACAUCAUGCCAAAGGUG | 20 | 850 |
| SCNN1A-1683 | + | CAGUACAUCAUGCCAAAGGUG | 21 | 5532 |
| SCNN1A-1684 | + | CCAGUACAUCAUGCCAAAGGUG | 22 | 5533 |
| SCNN1A-1685 | + | GCCAGUACAUCAUGCCAAAGGUG | 23 | 5534 |
| SCNN1A-1686 | + | UGCCAGUACAUCAUGCCAAAGGUG | 24 | 5535 |
| SCNN1A-1687 | + | GCCCUGGAGUGGACUGUG | 18 | 5536 |
| SCNN1A-1688 | + | AGCCCUGGAGUGGACUGUG | 19 | 5537 |
| SCNN1A-202 | + | GAGCCCUGGAGUGGACUGUG | 20 | 831 |
| SCNN1A-1689 | + | UGAGCCCUGGAGUGGACUGUG | 21 | 5538 |
| SCNN1A-1690 | + | AUGAGCCCUGGAGUGGACUGUG | 22 | 5539 |
| SCNN1A-1691 | + | CAUGAGCCCUGGAGUGGACUGUG | 23 | 5540 |
| SCNN1A-1692 | + | UCAUGAGCCCUGGAGUGGACUGUG | 24 | 5541 |
| SCNN1A-1693 | + | CGUCUUCAUGCGGUUGUG | 18 | 5542 |
| SCNN1A-1694 | + | CCGUCUUCAUGCGGUUGUG | 19 | 5543 |
| SCNN1A-227 | + | GCCGUCUUCAUGCGGUUGUG | 20 | 848 |
| SCNN1A-1695 | + | GGCCGUCUUCAUGCGGUUGUG | 21 | 5544 |
| SCNN1A-1696 | + | AGGCCGUCUUCAUGCGGUUGUG | 22 | 5545 |
| SCNN1A-1697 | + | AAGGCCGUCUUCAUGCGGUUGUG | 23 | 5546 |
| SCNN1A-1698 | + | GAAGGCCGUCUUCAUGCGGUUGUG | 24 | 5547 |
| SCNN1A-1699 | + | GAGCCCCGGAGUGGAUUG | 18 | 5548 |
| SCNN1A-1700 | + | UGAGCCCCGGAGUGGAUUG | 19 | 5549 |
| SCNN1A-419 | + | AUGAGCCCCGGAGUGGAUUG | 20 | 4268 |
| SCNN1A-1701 | + | CAUGAGCCCCGGAGUGGAUUG | 21 | 5550 |
| SCNN1A-1702 | + | UCAUGAGCCCCGGAGUGGAUUG | 22 | 5551 |

TABLE 44D-continued

4th Tier

| gRNA Name | DNA Strand | Targeting Domain | Target Site Length | Seq ID |
|---|---|---|---|---|
| SCNN1A-1703 | + | UUCAUGAGCCCCGGAGUGGAUUG | 23 | 5552 |
| SCNN1A-1704 | + | CUUCAUGAGCCCCGGAGUGGAUUG | 24 | 5553 |
| SCNN1A-1705 | + | UGGAUGGUGGUGUUGUUG | 18 | 5554 |
| SCNN1A-1706 | + | GUGGAUGGUGGUGUUGUUG | 19 | 5555 |
| SCNN1A-222 | + | CGUGGAUGGUGGUGUUGUUG | 20 | 845 |
| SCNN1A-1707 | + | CCGUGGAUGGUGGUGUUGUUG | 21 | 5556 |
| SCNN1A-1708 | + | GCCGUGGAUGGUGGUGUUGUUG | 22 | 5557 |
| SCNN1A-1709 | + | CGCCGUGGAUGGUGGUGUUGUUG | 23 | 5558 |
| SCNN1A-1710 | + | GCGCCGUGGAUGGUGGUGUUGUUG | 24 | 5559 |
| SCNN1A-1711 | + | GGAGCGGUGGAACUCGAU | 18 | 5560 |
| SCNN1A-1712 | + | AGGAGCGGUGGAACUCGAU | 19 | 5561 |
| SCNN1A-214 | + | UAGGAGCGGUGGAACUCGAU | 20 | 839 |
| SCNN1A-1713 | + | GUAGGAGCGGUGGAACUCGAU | 21 | 5562 |
| SCNN1A-1714 | + | GGUAGGAGCGGUGGAACUCGAU | 22 | 5563 |
| SCNN1A-1715 | + | CGGUAGGAGCGGUGGAACUCGAU | 23 | 5564 |
| SCNN1A-1716 | + | UCGGUAGGAGCGGUGGAACUCGAU | 24 | 5565 |
| SCNN1A-1717 | + | AUGAGCCCCGGAGUGGAU | 18 | 5566 |
| SCNN1A-1718 | + | CAUGAGCCCCGGAGUGGAU | 19 | 5567 |
| SCNN1A-420 | + | UCAUGAGCCCCGGAGUGGAU | 20 | 4269 |
| SCNN1A-1719 | + | UUCAUGAGCCCCGGAGUGGAU | 21 | 5568 |
| SCNN1A-1720 | + | CUUCAUGAGCCCCGGAGUGGAU | 22 | 5569 |
| SCNN1A-1721 | + | CCUUCAUGAGCCCCGGAGUGGAU | 23 | 5570 |
| SCNN1A-1722 | + | CCCUUCAUGAGCCCCGGAGUGGAU | 24 | 5571 |
| SCNN1A-1723 | + | AGGGUGCAGAUGGUCACU | 18 | 5572 |
| SCNN1A-1724 | + | GAGGGUGCAGAUGGUCACU | 19 | 5573 |
| SCNN1A-242 | + | UGAGGGUGCAGAUGGUCACU | 20 | 859 |
| SCNN1A-1725 | + | UUGAGGGUGCAGAUGGUCACU | 21 | 5574 |
| SCNN1A-1726 | + | AUUGAGGGUGCAGAUGGUCACU | 22 | 5575 |
| SCNN1A-1727 | + | GAUUGAGGGUGCAGAUGGUCACU | 23 | 5576 |
| SCNN1A-1728 | + | GGAUUGAGGGUGCAGAUGGUCACU | 24 | 5577 |
| SCNN1A-1729 | + | UGAGCCCUGGAGUGGACU | 18 | 5578 |
| SCNN1A-1730 | + | AUGAGCCCUGGAGUGGACU | 19 | 5579 |
| SCNN1A-204 | + | CAUGAGCCCUGGAGUGGACU | 20 | 832 |
| SCNN1A-1731 | + | UCAUGAGCCCUGGAGUGGACU | 21 | 5580 |
| SCNN1A-1732 | + | UUCAUGAGCCCUGGAGUGGACU | 22 | 5581 |
| SCNN1A-1733 | + | CUUCAUGAGCCCUGGAGUGGACU | 23 | 5582 |
| SCNN1A-1734 | + | CCUUCAUGAGCCCUGGAGUGGACU | 24 | 5583 |

TABLE 44D-continued

4th Tier

| gRNA Name | DNA Strand | Targeting Domain | Target Site Length | Seq ID |
|---|---|---|---|---|
| SCNN1A-1735 | + | GCUCAUGAUACCUCCCCU | 18 | 5584 |
| SCNN1A-1736 | + | UGCUCAUGAUACCUCCCCU | 19 | 5585 |
| SCNN1A-457 | + | CUGCUCAUGAUACCUCCCCU | 20 | 4306 |
| SCNN1A-1737 | + | ACUGCUCAUGAUACCUCCCCU | 21 | 5586 |
| SCNN1A-1738 | + | UACUGCUCAUGAUACCUCCCCU | 22 | 5587 |
| SCNN1A-1739 | + | AUACUGCUCAUGAUACCUCCCCU | 23 | 5588 |
| SCNN1A-1740 | + | GAUACUGCUCAUGAUACCUCCCCU | 24 | 5589 |
| SCNN1A-1741 | + | CAGGGUCAAGGCUGAGCU | 18 | 5590 |
| SCNN1A-1742 | + | UCAGGGUCAAGGCUGAGCU | 19 | 5591 |
| SCNN1A-1743 | + | GUCAGGGUCAAGGCUGAGCU | 20 | 5592 |
| SCNN1A-1744 | + | GGUCAGGGUCAAGGCUGAGCU | 21 | 5593 |
| SCNN1A-1745 | + | GGGUCAGGGUCAAGGCUGAGCU | 22 | 5594 |
| SCNN1A-1746 | + | AGGGUCAGGGUCAAGGCUGAGCU | 23 | 5595 |
| SCNN1A-1747 | + | AAGGGUCAGGGUCAAGGCUGAGCU | 24 | 5596 |
| SCNN1A-1748 | + | UCUUCAUGCGGUUGUGCU | 18 | 5597 |
| SCNN1A-1749 | + | GUCUUCAUGCGGUUGUGCU | 19 | 5598 |
| SCNN1A-50 | + | CGUCUUCAUGCGGUUGUGCU | 20 | 583 |
| SCNN1A-1750 | + | CCGUCUUCAUGCGGUUGUGCU | 21 | 5599 |
| SCNN1A-1751 | + | GCCGUCUUCAUGCGGUUGUGCU | 22 | 5600 |
| SCNN1A-1752 | + | GGCCGUCUUCAUGCGGUUGUGCU | 23 | 5601 |
| SCNN1A-1753 | + | AGGCCGUCUUCAUGCGGUUGUGCU | 24 | 5602 |
| SCNN1A-1754 | + | GGGUAGCUGAAGUACUCU | 18 | 5603 |
| SCNN1A-1755 | + | GGGGUAGCUGAAGUACUCU | 19 | 5604 |
| SCNN1A-231 | + | CGGGGUAGCUGAAGUACUCU | 20 | 852 |
| SCNN1A-1756 | + | ACGGGGUAGCUGAAGUACUCU | 21 | 5605 |
| SCNN1A-1757 | + | GACGGGGUAGCUGAAGUACUCU | 22 | 5606 |
| SCNN1A-1758 | + | UGACGGGGUAGCUGAAGUACUCU | 23 | 5607 |
| SCNN1A-1759 | + | CUGACGGGGUAGCUGAAGUACUCU | 24 | 5608 |
| SCNN1A-1760 | + | UGCUGGGGCGCCGCAGGU | 18 | 5609 |
| SCNN1A-1761 | + | CUGCUGGGGCGCCGCAGGU | 19 | 5610 |
| SCNN1A-210 | + | GCUGCUGGGGCGCCGCAGGU | 20 | 836 |
| SCNN1A-1762 | + | GGCUGCUGGGGCGCCGCAGGU | 21 | 5611 |
| SCNN1A-1763 | + | GGGCUGCUGGGGCGCCGCAGGU | 22 | 5612 |
| SCNN1A-1764 | + | UGGGCUGCUGGGGCGCCGCAGGU | 23 | 5613 |
| SCNN1A-1765 | + | GUGGGCUGCUGGGGCGCCGCAGGU | 24 | 5614 |
| SCNN1A-1766 | + | ACUCGAAGAGCUCUCGGU | 18 | 5615 |
| SCNN1A-1767 | + | AACUCGAAGAGCUCUCGGU | 19 | 5616 |
| SCNN1A-58 | + | GAACUCGAAGAGCUCUCGGU | 20 | 524 |

TABLE 44D-continued

4th Tier

| gRNA Name | DNA Strand | Targeting Domain | Target Site Length | Seq ID |
|---|---|---|---|---|
| SCNN1A-1768 | + | AGAACUCGAAGAGCUCUCGGU | 21 | 5617 |
| SCNN1A-1769 | + | AAGAACUCGAAGAGCUCUCGGU | 22 | 5618 |
| SCNN1A-1770 | + | GAAGAACUCGAAGAGCUCUCGGU | 23 | 5619 |
| SCNN1A-1771 | + | AGAAGAACUCGAAGAGCUCUCGGU | 24 | 5620 |
| SCNN1A-1772 | + | CCCUCCAUGAGACCUGGU | 18 | 5621 |
| SCNN1A-1773 | + | CCCCUCCAUGAGACCUGGU | 19 | 5622 |
| SCNN1A-199 | + | UCCCCUCCAUGAGACCUGGU | 20 | 828 |
| SCNN1A-1774 | + | UUCCCCUCCAUGAGACCUGGU | 21 | 5623 |
| SCNN1A-1775 | + | GUUCCCCUCCAUGAGACCUGGU | 22 | 5624 |
| SCNN1A-1776 | + | UGUUCCCCUCCAUGAGACCUGGU | 23 | 5625 |
| SCNN1A-1777 | + | UUGUUCCCCUCCAUGAGACCUGGU | 24 | 5626 |
| SCNN1A-1778 | + | UGAGCCCCGGAGUGGAUU | 18 | 5627 |
| SCNN1A-1779 | + | AUGAGCCCCGGAGUGGAUU | 19 | 5628 |
| SCNN1A-425 | + | CAUGAGCCCCGGAGUGGAUU | 20 | 4274 |
| SCNN1A-1780 | + | UCAUGAGCCCCGGAGUGGAUU | 21 | 5629 |
| SCNN1A-1781 | + | UUCAUGAGCCCCGGAGUGGAUU | 22 | 5630 |
| SCNN1A-1782 | + | CUUCAUGAGCCCCGGAGUGGAUU | 23 | 5631 |
| SCNN1A-1783 | + | CCUUCAUGAGCCCCGGAGUGGAUU | 24 | 5632 |
| SCNN1A-1784 | + | GCUGGGGCGCCGCAGGUU | 18 | 5633 |
| SCNN1A-1785 | + | UGCUGGGGCGCCGCAGGUU | 19 | 5634 |
| SCNN1A-69 | + | CUGCUGGGGCGCCGCAGGUU | 20 | 597 |
| SCNN1A-1786 | + | GCUGCUGGGGCGCCGCAGGUU | 21 | 5635 |
| SCNN1A-1787 | + | GGCUGCUGGGGCGCCGCAGGUU | 22 | 5636 |
| SCNN1A-1788 | + | GGGCUGCUGGGGCGCCGCAGGUU | 23 | 5637 |
| SCNN1A-1789 | + | UGGGCUGCUGGGGCGCCGCAGGUU | 24 | 5638 |
| SCNN1A-1790 | - | CAGUAUCAAGGUAAGCAA | 18 | 5639 |
| SCNN1A-1791 | - | GCAGUAUCAAGGUAAGCAA | 19 | 5640 |
| SCNN1A-393 | - | AGCAGUAUCAAGGUAAGCAA | 20 | 4242 |
| SCNN1A-1792 | - | GAGCAGUAUCAAGGUAAGCAA | 21 | 5641 |
| SCNN1A-1793 | - | UGAGCAGUAUCAAGGUAAGCAA | 22 | 5642 |
| SCNN1A-1794 | - | AUGAGCAGUAUCAAGGUAAGCAA | 23 | 5643 |
| SCNN1A-1795 | - | CAUGAGCAGUAUCAAGGUAAGCAA | 24 | 5644 |
| SCNN1A-1796 | - | CACUCCAGGGCUCAUGAA | 18 | 5645 |
| SCNN1A-1797 | - | CCACUCCAGGGCUCAUGAA | 19 | 5646 |
| SCNN1A-11 | - | UCCACUCCAGGGCUCAUGAA | 20 | 560 |
| SCNN1A-1798 | - | GUCCACUCCAGGGCUCAUGAA | 21 | 5647 |
| SCNN1A-1799 | - | AGUCCACUCCAGGGCUCAUGAA | 22 | 5648 |

TABLE 44D-continued

4th Tier

| gRNA Name | DNA Strand | Targeting Domain | Target Site Length | Seq ID |
|---|---|---|---|---|
| SCNN1A-1800 | - | CAGUCCACUCCAGGGCUCAUGAA | 23 | 5649 |
| SCNN1A-1801 | - | ACAGUCCACUCCAGGGCUCAUGAA | 24 | 5650 |
| SCNN1A-1802 | - | CACUCCGGGGCUCAUGAA | 18 | 5651 |
| SCNN1A-1803 | - | CCACUCCGGGGCUCAUGAA | 19 | 5652 |
| SCNN1A-451 | - | UCCACUCCGGGGCUCAUGAA | 20 | 4300 |
| SCNN1A-1804 | - | AUCCACUCCGGGGCUCAUGAA | 21 | 5653 |
| SCNN1A-1805 | - | AAUCCACUCCGGGGCUCAUGAA | 22 | 5654 |
| SCNN1A-1806 | - | CAAUCCACUCCGGGGCUCAUGAA | 23 | 5655 |
| SCNN1A-1807 | - | CCAAUCCACUCCGGGGCUCAUGAA | 24 | 5656 |
| SCNN1A-1808 | - | GCAGUAUCAAGGUAAGCA | 18 | 5657 |
| SCNN1A-1809 | - | AGCAGUAUCAAGGUAAGCA | 19 | 5658 |
| SCNN1A-342 | - | GAGCAGUAUCAAGGUAAGCA | 20 | 4191 |
| SCNN1A-1810 | - | UGAGCAGUAUCAAGGUAAGCA | 21 | 5659 |
| SCNN1A-1811 | - | AUGAGCAGUAUCAAGGUAAGCA | 22 | 5660 |
| SCNN1A-1812 | - | CAUGAGCAGUAUCAAGGUAAGCA | 23 | 5661 |
| SCNN1A-1813 | - | UCAUGAGCAGUAUCAAGGUAAGCA | 24 | 5662 |
| SCNN1A-1814 | - | AGCCCAUACCAGGUCUCA | 18 | 5663 |
| SCNN1A-1815 | - | CAGCCCAUACCAGGUCUCA | 19 | 5664 |
| SCNN1A-1 | - | GCAGCCCAUACCAGGUCUCA | 20 | 503 |
| SCNN1A-1816 | - | UGCAGCCCAUACCAGGUCUCA | 21 | 5665 |
| SCNN1A-1817 | - | CUGCAGCCCAUACCAGGUCUCA | 22 | 5666 |
| SCNN1A-1818 | - | UCUGCAGCCCAUACCAGGUCUCA | 23 | 5667 |
| SCNN1A-1819 | - | CUCUGCAGCCCAUACCAGGUCUCA | 24 | 5668 |
| SCNN1A-1820 | - | GUUCCAGGGGUGAUGGGA | 18 | 5669 |
| SCNN1A-1821 | - | GGUUCCAGGGGUGAUGGGA | 19 | 5670 |
| SCNN1A-1822 | - | GGGUUCCAGGGGUGAUGGGA | 20 | 5671 |
| SCNN1A-1823 | - | CGGGUUCCAGGGGUGAUGGGA | 21 | 5672 |
| SCNN1A-1824 | - | UCGGGUUCCAGGGGUGAUGGGA | 22 | 5673 |
| SCNN1A-1825 | - | CUCGGGUUCCAGGGGUGAUGGGA | 23 | 5674 |
| SCNN1A-1826 | - | ACUCGGGUUCCAGGGGUGAUGGGA | 24 | 5675 |
| SCNN1A-1827 | - | CAUACCAGGUCUCAUGGA | 18 | 5676 |
| SCNN1A-1828 | - | CCAUACCAGGUCUCAUGGA | 19 | 5677 |
| SCNN1A-3 | - | CCCAUACCAGGUCUCAUGGA | 20 | 556 |
| SCNN1A-1829 | - | GCCCAUACCAGGUCUCAUGGA | 21 | 5678 |
| SCNN1A-1830 | - | AGCCCAUACCAGGUCUCAUGGA | 22 | 5679 |
| SCNN1A-1831 | - | CAGCCCAUACCAGGUCUCAUGGA | 23 | 5680 |
| SCNN1A-1832 | - | GCAGCCCAUACCAGGUCUCAUGGA | 24 | 5681 |
| SCNN1A-1833 | - | CCACUCCAGGGCUCAUGA | 18 | 5682 |

TABLE 44D-continued

4th Tier

| gRNA Name | DNA Strand | Targeting Domain | Target Site Length | Seq ID |
|---|---|---|---|---|
| SCNN1A-1834 | - | UCCACUCCAGGGCUCAUGA | 19 | 5683 |
| SCNN1A-10 | - | GUCCACUCCAGGGCUCAUGA | 20 | 505 |
| SCNN1A-1835 | - | AGUCCACUCCAGGGCUCAUGA | 21 | 5684 |
| SCNN1A-1836 | - | CAGUCCACUCCAGGGCUCAUGA | 22 | 5685 |
| SCNN1A-1837 | - | ACAGUCCACUCCAGGGCUCAUGA | 23 | 5686 |
| SCNN1A-1838 | - | CACAGUCCACUCCAGGGCUCAUGA | 24 | 5687 |
| SCNN1A-1839 | - | CCACUCCGGGGCUCAUGA | 18 | 5688 |
| SCNN1A-1840 | - | UCCACUCCGGGGCUCAUGA | 19 | 5689 |
| SCNN1A-400 | - | AUCCACUCCGGGGCUCAUGA | 20 | 4249 |
| SCNN1A-1841 | - | AAUCCACUCCGGGGCUCAUGA | 21 | 5690 |
| SCNN1A-1842 | - | CAAUCCACUCCGGGGCUCAUGA | 22 | 5691 |
| SCNN1A-1843 | - | CCAAUCCACUCCGGGGCUCAUGA | 23 | 5692 |
| SCNN1A-1844 | - | CCCAAUCCACUCCGGGGCUCAUGA | 24 | 5693 |
| SCNN1A-1845 | - | CUCGGGUUCCAGGGGUGA | 18 | 5694 |
| SCNN1A-1846 | - | ACUCGGGUUCCAGGGGUGA | 19 | 5695 |
| SCNN1A-401 | - | CACUCGGGUUCCAGGGGUGA | 20 | 4250 |
| SCNN1A-1847 | - | UCACUCGGGUUCCAGGGGUGA | 21 | 5696 |
| SCNN1A-1848 | - | CUCACUCGGGUUCCAGGGGUGA | 22 | 5697 |
| SCNN1A-1849 | - | CCUCACUCGGGUUCCAGGGGUGA | 23 | 5698 |
| SCNN1A-1850 | - | GCCUCACUCGGGUUCCAGGGGUGA | 24 | 5699 |
| SCNN1A-1851 | - | CGAGUUCCACCGCUCCUA | 18 | 5700 |
| SCNN1A-1852 | - | UCGAGUUCCACCGCUCCUA | 19 | 5701 |
| SCNN1A-190 | - | AUCGAGUUCCACCGCUCCUA | 20 | 820 |
| SCNN1A-1853 | - | GAUCGAGUUCCACCGCUCCUA | 21 | 5702 |
| SCNN1A-1854 | - | UGAUCGAGUUCCACCGCUCCUA | 22 | 5703 |
| SCNN1A-1855 | - | CUGAUCGAGUUCCACCGCUCCUA | 23 | 5704 |
| SCNN1A-1856 | - | CCUGAUCGAGUUCCACCGCUCCUA | 24 | 5705 |
| SCNN1A-1857 | - | CUCAACAUCAACCUCAAC | 18 | 5706 |
| SCNN1A-1858 | - | CCUCAACAUCAACCUCAAC | 19 | 5707 |
| SCNN1A-198 | - | GCCUCAACAUCAACCUCAAC | 20 | 827 |
| SCNN1A-1859 | - | AGCCUCAACAUCAACCUCAAC | 21 | 5708 |
| SCNN1A-1860 | - | CAGCCUCAACAUCAACCUCAAC | 22 | 5709 |
| SCNN1A-1861 | - | UCAGCCUCAACAUCAACCUCAAC | 23 | 5710 |
| SCNN1A-1862 | - | GUCAGCCUCAACAUCAACCUCAAC | 24 | 5711 |
| SCNN1A-1863 | - | GUGGGCGCAGGGUGGGAC | 18 | 5712 |
| SCNN1A-1864 | - | UGUGGGCGCAGGGUGGGAC | 19 | 5713 |
| SCNN1A-1865 | - | AUGUGGGCGCAGGGUGGGAC | 20 | 5714 |

TABLE 44D-continued

4th Tier

| gRNA Name | DNA Strand | Targeting Domain | Target Site Length | Seq ID |
|---|---|---|---|---|
| SCNN1A-1866 | − | AAUGUGGGCGCAGGGUGGGAC | 21 | 5715 |
| SCNN1A-1867 | − | GAAUGUGGGCGCAGGGUGGGAC | 22 | 5716 |
| SCNN1A-1868 | − | AGAAUGUGGGCGCAGGGUGGGAC | 23 | 5717 |
| SCNN1A-1869 | − | GAGAAUGUGGGCGCAGGGUGGGAC | 24 | 5718 |
| SCNN1A-1870 | − | AGUUCCACCGCUCCUACC | 18 | 5719 |
| SCNN1A-1871 | − | GAGUUCCACCGCUCCUACC | 19 | 5720 |
| SCNN1A-191 | − | CGAGUUCCACCGCUCCUACC | 20 | 821 |
| SCNN1A-1872 | − | UCGAGUUCCACCGCUCCUACC | 21 | 5721 |
| SCNN1A-1873 | − | AUCGAGUUCCACCGCUCCUACC | 22 | 5722 |
| SCNN1A-1874 | − | GAUCGAGUUCCACCGCUCCUACC | 23 | 5723 |
| SCNN1A-1875 | − | UGAUCGAGUUCCACCGCUCCUACC | 24 | 5724 |
| SCNN1A-1876 | − | GAGAGGGCACUCAGGGCC | 18 | 5725 |
| SCNN1A-1877 | − | GGAGAGGGCACUCAGGGCC | 19 | 5726 |
| SCNN1A-1878 | − | GGGAGAGGGCACUCAGGGCC | 20 | 5727 |
| SCNN1A-1879 | − | UGGGAGAGGGCACUCAGGGCC | 21 | 5728 |
| SCNN1A-1880 | − | AUGGGAGAGGGCACUCAGGGCC | 22 | 5729 |
| SCNN1A-1881 | − | GAUGGGAGAGGGCACUCAGGGCC | 23 | 5730 |
| SCNN1A-1882 | − | UGAUGGGAGAGGGCACUCAGGGCC | 24 | 5731 |
| SCNN1A-1883 | − | AGGAGCAGGGGCUGGGCC | 18 | 5732 |
| SCNN1A-1884 | − | GAGGAGCAGGGGCUGGGCC | 19 | 5733 |
| SCNN1A-182 | − | UGAGGAGCAGGGGCUGGGCC | 20 | 815 |
| SCNN1A-1885 | − | GUGAGGAGCAGGGGCUGGGCC | 21 | 5734 |
| SCNN1A-1886 | − | CGUGAGGAGCAGGGGCUGGGCC | 22 | 5735 |
| SCNN1A-1887 | − | GCGUGAGGAGCAGGGGCUGGGCC | 23 | 5736 |
| SCNN1A-1888 | − | AGCGUGAGGAGCAGGGGCUGGGCC | 24 | 5737 |
| SCNN1A-1889 | − | UGGGACAUGGGCAUGGCC | 18 | 5738 |
| SCNN1A-1890 | − | GUGGGACAUGGGCAUGGCC | 19 | 5739 |
| SCNN1A-347 | − | GGUGGGACAUGGGCAUGGCC | 20 | 4196 |
| SCNN1A-1891 | − | GGGUGGGACAUGGGCAUGGCC | 21 | 5740 |
| SCNN1A-1892 | − | AGGGUGGGACAUGGGCAUGGCC | 22 | 5741 |
| SCNN1A-1893 | − | CAGGGUGGGACAUGGGCAUGGCC | 23 | 5742 |
| SCNN1A-1894 | − | GCAGGGUGGGACAUGGGCAUGGCC | 24 | 5743 |
| SCNN1A-1895 | − | UCAUGAAGGGGAACAAGC | 18 | 5744 |
| SCNN1A-1896 | − | CUCAUGAAGGGGAACAAGC | 19 | 5745 |
| SCNN1A-176 | − | GCUCAUGAAGGGGAACAAGC | 20 | 811 |
| SCNN1A-1897 | − | GGCUCAUGAAGGGGAACAAGC | 21 | 5746 |
| SCNN1A-1898 | − | GGGCUCAUGAAGGGGAACAAGC | 22 | 5747 |
| SCNN1A-1899 | − | AGGGCUCAUGAAGGGGAACAAGC | 23 | 5748 |

TABLE 44D-continued

4th Tier

| gRNA Name | DNA Strand | Targeting Domain | Target Site Length | Seq ID |
|---|---|---|---|---|
| SCNN1A-1900 | − | CAGGGCUCAUGAAGGGGAACAAGC | 24 | 5749 |
| SCNN1A-1901 | − | GGGGCUCAUGAAGGGGAACAAGC | 23 | 5750 |
| SCNN1A-1902 | − | CGGGGCUCAUGAAGGGGAACAAGC | 24 | 5751 |
| SCNN1A-1903 | − | UCAUGGAGGGGAACAAGC | 18 | 5752 |
| SCNN1A-1904 | − | CUCAUGGAGGGGAACAAGC | 19 | 5753 |
| SCNN1A-5 | − | UCUCAUGGAGGGGAACAAGC | 20 | 557 |
| SCNN1A-1905 | − | GUCUCAUGGAGGGGAACAAGC | 21 | 5754 |
| SCNN1A-1906 | − | GGUCUCAUGGAGGGGAACAAGC | 22 | 5755 |
| SCNN1A-1907 | − | AGGUCUCAUGGAGGGGAACAAGC | 23 | 5756 |
| SCNN1A-1908 | − | CAGGUCUCAUGGAGGGGAACAAGC | 24 | 5757 |
| SCNN1A-1909 | − | AGCAGUAUCAAGGUAAGC | 18 | 5758 |
| SCNN1A-1910 | − | GAGCAGUAUCAAGGUAAGC | 19 | 5759 |
| SCNN1A-1911 | − | UGAGCAGUAUCAAGGUAAGC | 20 | 5760 |
| SCNN1A-1912 | − | AUGAGCAGUAUCAAGGUAAGC | 21 | 5761 |
| SCNN1A-1913 | − | CAUGAGCAGUAUCAAGGUAAGC | 22 | 5762 |
| SCNN1A-1914 | − | UCAUGAGCAGUAUCAAGGUAAGC | 23 | 5763 |
| SCNN1A-1915 | − | AUCAUGAGCAGUAUCAAGGUAAGC | 24 | 5764 |
| SCNN1A-1916 | − | GGAACAAGCGUGAGGAGC | 18 | 5765 |
| SCNN1A-1917 | − | GGGAACAAGCGUGAGGAGC | 19 | 5766 |
| SCNN1A-14 | − | GGGGAACAAGCGUGAGGAGC | 20 | 506 |
| SCNN1A-1918 | − | AGGGGAACAAGCGUGAGGAGC | 21 | 5767 |
| SCNN1A-1919 | − | AAGGGGAACAAGCGUGAGGAGC | 22 | 5768 |
| SCNN1A-1920 | − | GAAGGGGAACAAGCGUGAGGAGC | 23 | 5769 |
| SCNN1A-1921 | − | UGAAGGGGAACAAGCGUGAGGAGC | 24 | 5770 |
| SCNN1A-1922 | − | UGCUCCCAGCACAACCGC | 18 | 5771 |
| SCNN1A-1923 | − | GUGCUCCCAGCACAACCGC | 19 | 5772 |
| SCNN1A-193 | − | UGUGCUCCCAGCACAACCGC | 20 | 823 |
| SCNN1A-1924 | − | GUGUGCUCCCAGCACAACCGC | 21 | 5773 |
| SCNN1A-1925 | − | GGUGUGCUCCCAGCACAACCGC | 22 | 5774 |
| SCNN1A-1926 | − | UGGUGUGCUCCCAGCACAACCGC | 23 | 5775 |
| SCNN1A-1927 | − | CUGGUGUGCUCCCAGCACAACCGC | 24 | 5776 |
| SCNN1A-1928 | − | GUGGGACAUGGGCAUGGC | 18 | 5777 |
| SCNN1A-1929 | − | GGUGGGACAUGGGCAUGGC | 19 | 5778 |
| SCNN1A-1930 | − | GGGUGGGACAUGGGCAUGGC | 20 | 5779 |
| SCNN1A-1931 | − | AGGGUGGGACAUGGGCAUGGC | 21 | 5780 |
| SCNN1A-1932 | − | CAGGGUGGGACAUGGGCAUGGC | 22 | 5781 |
| SCNN1A-1933 | − | GCAGGGUGGGACAUGGGCAUGGC | 23 | 5782 |

TABLE 44D-continued

4th Tier

| gRNA Name | DNA Strand | Targeting Domain | Target Site Length | Seq ID |
|---|---|---|---|---|
| SCNN1A-1934 | - | CGCAGGGUGGGACAUGGGCAUGGC | 24 | 5783 |
| SCNN1A-1935 | - | CUUCCAAGGGGAGGUAUC | 18 | 5784 |
| SCNN1A-1936 | - | CCUUCCAAGGGGAGGUAUC | 19 | 5785 |
| SCNN1A-1937 | - | CCCUUCCAAGGGGAGGUAUC | 20 | 5786 |
| SCNN1A-1938 | - | UCCCUUCCAAGGGGAGGUAUC | 21 | 5787 |
| SCNN1A-1939 | - | GUCCCUUCCAAGGGGAGGUAUC | 22 | 5788 |
| SCNN1A-1940 | - | UGUCCCUUCCAAGGGGAGGUAUC | 23 | 5789 |
| SCNN1A-1941 | - | CUGUCCCUUCCAAGGGGAGGUAUC | 24 | 5790 |
| SCNN1A-1942 | - | GCUCUCCCCAAUCCACUC | 18 | 5791 |
| SCNN1A-1943 | - | UGCUCUCCCCAAUCCACUC | 19 | 5792 |
| SCNN1A-410 | - | UUGCUCUCCCCAAUCCACUC | 20 | 4259 |
| SCNN1A-1944 | - | CUUGCUCUCCCCAAUCCACUC | 21 | 5793 |
| SCNN1A-1945 | - | CCUUGCUCUCCCCAAUCCACUC | 22 | 5794 |
| SCNN1A-1946 | - | CCCUUGCUCUCCCCAAUCCACUC | 23 | 5795 |
| SCNN1A-1947 | - | ACCCUUGCUCUCCCCAAUCCACUC | 24 | 5796 |
| SCNN1A-1948 | - | GCCCUCCACAGUCCACUC | 18 | 5797 |
| SCNN1A-1949 | - | AGCCCUCCACAGUCCACUC | 19 | 5798 |
| SCNN1A-170 | - | UAGCCCUCCACAGUCCACUC | 20 | 808 |
| SCNN1A-1950 | - | CUAGCCCUCCACAGUCCACUC | 21 | 5799 |
| SCNN1A-1951 | - | UCUAGCCCUCCACAGUCCACUC | 22 | 5800 |
| SCNN1A-1952 | - | CUCUAGCCCUCCACAGUCCACUC | 23 | 5801 |
| SCNN1A-1953 | - | ACUCUAGCCCUCCACAGUCCACUC | 24 | 5802 |
| SCNN1A-1954 | - | CAGUCCACUCCAGGGCUC | 18 | 5803 |
| SCNN1A-1955 | - | ACAGUCCACUCCAGGGCUC | 19 | 5804 |
| SCNN1A-171 | - | CACAGUCCACUCCAGGGCUC | 20 | 809 |
| SCNN1A-1956 | - | CCACAGUCCACUCCAGGGCUC | 21 | 5805 |
| SCNN1A-1957 | - | UCCACAGUCCACUCCAGGGCUC | 22 | 5806 |
| SCNN1A-1958 | - | CUCCACAGUCCACUCCAGGGCUC | 23 | 5807 |
| SCNN1A-1959 | - | CCUCCACAGUCCACUCCAGGGCUC | 24 | 5808 |
| SCNN1A-1960 | - | CAAUCCACUCCGGGGCUC | 18 | 5809 |
| SCNN1A-1961 | - | CCAAUCCACUCCGGGGCUC | 19 | 5810 |
| SCNN1A-1962 | - | CCCAAUCCACUCCGGGGCUC | 20 | 5811 |
| SCNN1A-1963 | - | CCCCAAUCCACUCCGGGGCUC | 21 | 5812 |
| SCNN1A-1964 | - | UCCCCAAUCCACUCCGGGGCUC | 22 | 5813 |
| SCNN1A-1965 | - | CUCCCCAAUCCACUCCGGGGCUC | 23 | 5814 |
| SCNN1A-1966 | - | UCUCCCCAAUCCACUCCGGGGCUC | 24 | 5815 |
| SCNN1A-1967 | - | CAGCCCAUACCAGGUCUC | 18 | 5816 |
| SCNN1A-1968 | - | GCAGCCCAUACCAGGUCUC | 19 | 5817 |

TABLE 44D-continued

4th Tier

| gRNA Name | DNA Strand | Targeting Domain | Target Site Length | Seq ID |
|---|---|---|---|---|
| SCNN1A-159 | - | UGCAGCCCAUACCAGGUCUC | 20 | 803 |
| SCNN1A-1969 | - | CUGCAGCCCAUACCAGGUCUC | 21 | 5818 |
| SCNN1A-1970 | - | UCUGCAGCCCAUACCAGGUCUC | 22 | 5819 |
| SCNN1A-1971 | - | CUCUGCAGCCCAUACCAGGUCUC | 23 | 5820 |
| SCNN1A-1972 | - | CCUCUGCAGCCCAUACCAGGUCUC | 24 | 5821 |
| SCNN1A-1973 | - | GCAGCCUCACUCGGGUUC | 18 | 5822 |
| SCNN1A-1974 | - | GGCAGCCUCACUCGGGUUC | 19 | 5823 |
| SCNN1A-1975 | - | GGGCAGCCUCACUCGGGUUC | 20 | 5824 |
| SCNN1A-1976 | - | GGGGCAGCCUCACUCGGGUUC | 21 | 5825 |
| SCNN1A-1977 | - | AGGGGCAGCCUCACUCGGGUUC | 22 | 5826 |
| SCNN1A-1978 | - | CAGGGGCAGCCUCACUCGGGUUC | 23 | 5827 |
| SCNN1A-1979 | - | CCAGGGGCAGCCUCACUCGGGUUC | 24 | 5828 |
| SCNN1A-1980 | - | CUCAUGAAGGGGAACAAG | 18 | 5829 |
| SCNN1A-1981 | - | GCUCAUGAAGGGGAACAAG | 19 | 5830 |
| SCNN1A-1982 | - | GGCUCAUGAAGGGGAACAAG | 20 | 5831 |
| SCNN1A-1983 | - | GGGCUCAUGAAGGGGAACAAG | 21 | 5832 |
| SCNN1A-1984 | - | GGGGCUCAUGAAGGGGAACAAG | 22 | 5833 |
| SCNN1A-1985 | - | CGGGGCUCAUGAAGGGGAACAAG | 23 | 5834 |
| SCNN1A-1986 | - | CCGGGGCUCAUGAAGGGGAACAAG | 24 | 5835 |
| SCNN1A-1987 | - | CUCAUGGAGGGGAACAAG | 18 | 5836 |
| SCNN1A-1988 | - | UCUCAUGGAGGGGAACAAG | 19 | 5837 |
| SCNN1A-165 | - | GUCUCAUGGAGGGGAACAAG | 20 | 805 |
| SCNN1A-1989 | - | GGUCUCAUGGAGGGGAACAAG | 21 | 5838 |
| SCNN1A-1990 | - | AGGUCUCAUGGAGGGGAACAAG | 22 | 5839 |
| SCNN1A-1991 | - | CAGGUCUCAUGGAGGGGAACAAG | 23 | 5840 |
| SCNN1A-1992 | - | CCAGGUCUCAUGGAGGGGAACAAG | 24 | 5841 |
| SCNN1A-1993 | - | CCAGCUGUCCCUUCCAAG | 18 | 5842 |
| SCNN1A-1994 | - | UCCAGCUGUCCCUUCCAAG | 19 | 5843 |
| SCNN1A-412 | - | AUCCAGCUGUCCCUUCCAAG | 20 | 4261 |
| SCNN1A-1995 | - | ACUCCAGGGCUCAUGAAG | 18 | 5844 |
| SCNN1A-1996 | - | CACUCCAGGGCUCAUGAAG | 19 | 5845 |
| SCNN1A-12 | - | CCACUCCAGGGCUCAUGAAG | 20 | 561 |
| SCNN1A-1997 | - | UCCACUCCAGGGCUCAUGAAG | 21 | 5846 |
| SCNN1A-1998 | - | GUCCACUCCAGGGCUCAUGAAG | 22 | 5847 |
| SCNN1A-1999 | - | AGUCCACUCCAGGGCUCAUGAAG | 23 | 5848 |
| SCNN1A-2000 | - | CAGUCCACUCCAGGGCUCAUGAAG | 24 | 5849 |
| SCNN1A-2001 | - | ACUCCGGGGCUCAUGAAG | 18 | 5850 |

TABLE 44D-continued

4th Tier

| gRNA Name | DNA Strand | Targeting Domain | Target Site Length | Seq ID |
|---|---|---|---|---|
| SCNN1A-2002 | − | CACUCCGGGGCUCAUGAAG | 19 | 5851 |
| SCNN1A-453 | − | CCACUCCGGGGCUCAUGAAG | 20 | 4302 |
| SCNN1A-2003 | − | UCCACUCCGGGGCUCAUGAAG | 21 | 5852 |
| SCNN1A-2004 | − | AUCCACUCCGGGGCUCAUGAAG | 22 | 5853 |
| SCNN1A-2005 | − | AAUCCACUCCGGGGCUCAUGAAG | 23 | 5854 |
| SCNN1A-2006 | − | CAAUCCACUCCGGGGCUCAUGAAG | 24 | 5855 |
| SCNN1A-2007 | − | GGGAACAAGCUGGAGGAG | 18 | 5856 |
| SCNN1A-2008 | − | GGGGAACAAGCUGGAGGAG | 19 | 5857 |
| SCNN1A-169 | − | AGGGGAACAAGCUGGAGGAG | 20 | 807 |
| SCNN1A-2009 | − | AAGGGGAACAAGCUGGAGGAG | 21 | 5858 |
| SCNN1A-2010 | − | GAAGGGGAACAAGCUGGAGGAG | 22 | 5859 |
| SCNN1A-2011 | − | UGAAGGGGAACAAGCUGGAGGAG | 23 | 5860 |
| SCNN1A-2012 | − | AUGAAGGGGAACAAGCUGGAGGAG | 24 | 5861 |
| SCNN1A-2013 | − | GAGGGGAACAAGCUGGAGGAG | 21 | 5862 |
| SCNN1A-2014 | − | GGAGGGGAACAAGCUGGAGGAG | 22 | 5863 |
| SCNN1A-2015 | − | UGGAGGGGAACAAGCUGGAGGAG | 23 | 5864 |
| SCNN1A-2016 | − | AUGGAGGGGAACAAGCUGGAGGAG | 24 | 5865 |
| SCNN1A-2017 | − | GGGAACAAGCGUGAGGAG | 18 | 5866 |
| SCNN1A-2018 | − | GGGGAACAAGCGUGAGGAG | 19 | 5867 |
| SCNN1A-179 | − | AGGGGAACAAGCGUGAGGAG | 20 | 813 |
| SCNN1A-2019 | − | AAGGGGAACAAGCGUGAGGAG | 21 | 5868 |
| SCNN1A-2020 | − | GAAGGGGAACAAGCGUGAGGAG | 22 | 5869 |
| SCNN1A-2021 | − | UGAAGGGGAACAAGCGUGAGGAG | 23 | 5870 |
| SCNN1A-2022 | − | AUGAAGGGGAACAAGCGUGAGGAG | 24 | 5871 |
| SCNN1A-2023 | − | CAGCAGCCCACGGCGGAG | 18 | 5872 |
| SCNN1A-2024 | − | CCAGCAGCCCACGGCGGAG | 19 | 5873 |
| SCNN1A-187 | − | CCCAGCAGCCCACGGCGGAG | 20 | 818 |
| SCNN1A-2025 | − | CCCCAGCAGCCCACGGCGGAG | 21 | 5874 |
| SCNN1A-2026 | − | GCCCCAGCAGCCCACGGCGGAG | 22 | 5875 |
| SCNN1A-2027 | − | CGCCCCAGCAGCCCACGGCGGAG | 23 | 5876 |
| SCNN1A-2028 | − | GCGCCCCAGCAGCCCACGGCGGAG | 24 | 5877 |
| SCNN1A-2029 | − | AUACCAGGUCUCAUGGAG | 18 | 5878 |
| SCNN1A-2030 | − | CAUACCAGGUCUCAUGGAG | 19 | 5879 |
| SCNN1A-4 | − | CCAUACCAGGUCUCAUGGAG | 20 | 498 |
| SCNN1A-2031 | − | CCCAUACCAGGUCUCAUGGAG | 21 | 5880 |
| SCNN1A-2032 | − | GCCCAUACCAGGUCUCAUGGAG | 22 | 5881 |
| SCNN1A-2033 | − | AGCCCAUACCAGGUCUCAUGGAG | 23 | 5882 |
| SCNN1A-2034 | − | CAGCCCAUACCAGGUCUCAUGGAG | 24 | 5883 |

TABLE 44D-continued

4th Tier

| gRNA Name | DNA Strand | Targeting Domain | Target Site Length | Seq ID |
|---|---|---|---|---|
| SCNN1A-2035 | - | GCGCCCCAGCAGCCCACG | 18 | 5884 |
| SCNN1A-2036 | - | GGCGCCCCAGCAGCCCACG | 19 | 5885 |
| SCNN1A-183 | - | CGGCGCCCCAGCAGCCCACG | 20 | 816 |
| SCNN1A-2037 | - | GCGGCGCCCCAGCAGCCCACG | 21 | 5886 |
| SCNN1A-2038 | - | UGCGGCGCCCCAGCAGCCCACG | 22 | 5887 |
| SCNN1A-2039 | - | CUGCGGCGCCCCAGCAGCCCACG | 23 | 5888 |
| SCNN1A-2040 | - | CCUGCGGCGCCCCAGCAGCCCACG | 24 | 5889 |
| SCNN1A-2041 | - | CCCCAGCAGCCCACGGCG | 18 | 5890 |
| SCNN1A-2042 | - | GCCCCAGCAGCCCACGGCG | 19 | 5891 |
| SCNN1A-185 | - | CGCCCCAGCAGCCCACGGCG | 20 | 817 |
| SCNN1A-2043 | - | GCGCCCCAGCAGCCCACGGCG | 21 | 5892 |
| SCNN1A-2044 | - | GGCGCCCCAGCAGCCCACGGCG | 22 | 5893 |
| SCNN1A-2045 | - | CGGCGCCCCAGCAGCCCACGGCG | 23 | 5894 |
| SCNN1A-2046 | - | GCGGCGCCCCAGCAGCCCACGGCG | 24 | 5895 |
| SCNN1A-2047 | - | GGAGAAUGUGGGCGCAGG | 18 | 5896 |
| SCNN1A-2048 | - | GGGAGAAUGUGGGCGCAGG | 19 | 5897 |
| SCNN1A-2049 | - | UGGGAGAAUGUGGGCGCAGG | 20 | 5898 |
| SCNN1A-2050 | - | AGCAGCCCACGGCGGAGG | 18 | 5899 |
| SCNN1A-2051 | - | CAGCAGCCCACGGCGGAGG | 19 | 5900 |
| SCNN1A-23 | - | CCAGCAGCCCACGGCGGAGG | 20 | 566 |
| SCNN1A-2052 | - | CCCAGCAGCCCACGGCGGAGG | 21 | 5901 |
| SCNN1A-2053 | - | CCCCAGCAGCCCACGGCGGAGG | 22 | 5902 |
| SCNN1A-2054 | - | GCCCCAGCAGCCCACGGCGGAGG | 23 | 5903 |
| SCNN1A-2055 | - | CGCCCCAGCAGCCCACGGCGGAGG | 24 | 5904 |
| SCNN1A-2056 | - | CGCCCCAGCAGCCCACGG | 18 | 5905 |
| SCNN1A-2057 | - | GCGCCCCAGCAGCCCACGG | 19 | 5906 |
| SCNN1A-21 | - | GGCGCCCCAGCAGCCCACGG | 20 | 510 |
| SCNN1A-2058 | - | CGGCGCCCCAGCAGCCCACGG | 21 | 5907 |
| SCNN1A-2059 | - | GCGGCGCCCCAGCAGCCCACGG | 22 | 5908 |
| SCNN1A-2060 | - | UGCGGCGCCCCAGCAGCCCACGG | 23 | 5909 |
| SCNN1A-2061 | - | CUGCGGCGCCCCAGCAGCCCACGG | 24 | 5910 |
| SCNN1A-2062 | - | CCCAGCAGCCCACGGCGG | 18 | 5911 |
| SCNN1A-2063 | - | CCCCAGCAGCCCACGGCGG | 19 | 5912 |
| SCNN1A-22 | - | GCCCCAGCAGCCCACGGCGG | 20 | 511 |
| SCNN1A-2064 | - | CGCCCCAGCAGCCCACGGCGG | 21 | 5913 |
| SCNN1A-2065 | - | GCGCCCCAGCAGCCCACGGCGG | 22 | 5914 |
| SCNN1A-2066 | - | GGCGCCCCAGCAGCCCACGGCGG | 23 | 5915 |

TABLE 44D-continued

4th Tier

| gRNA Name | DNA Strand | Targeting Domain | Target Site Length | Seq ID |
|---|---|---|---|---|
| SCNN1A-2067 | - | CGGCGCCCCAGCAGCCCACGGCGG | 24 | 5916 |
| SCNN1A-2068 | - | GAGAAUGUGGGCGCAGGG | 18 | 5917 |
| SCNN1A-2069 | - | GGAGAAUGUGGGCGCAGGG | 19 | 5918 |
| SCNN1A-354 | - | GGGAGAAUGUGGGCGCAGGG | 20 | 4203 |
| SCNN1A-2070 | - | UGGGAGAAUGUGGGCGCAGGG | 21 | 5919 |
| SCNN1A-2071 | - | GUGGGAGAAUGUGGGCGCAGGG | 22 | 5920 |
| SCNN1A-2072 | - | AGUGGGAGAAUGUGGGCGCAGGG | 23 | 5921 |
| SCNN1A-2073 | - | GAGUGGGAGAAUGUGGGCGCAGGG | 24 | 5922 |
| SCNN1A-2074 | - | AAGCGUGAGGAGCAGGGG | 18 | 5923 |
| SCNN1A-2075 | - | CAAGCGUGAGGAGCAGGGG | 19 | 5924 |
| SCNN1A-181 | - | ACAAGCGUGAGGAGCAGGGG | 20 | 814 |
| SCNN1A-2076 | - | AACAAGCGUGAGGAGCAGGGG | 21 | 5925 |
| SCNN1A-2077 | - | GAACAAGCGUGAGGAGCAGGGG | 22 | 5926 |
| SCNN1A-2078 | - | GGAACAAGCGUGAGGAGCAGGGG | 23 | 5927 |
| SCNN1A-2079 | - | GGGAACAAGCGUGAGGAGCAGGGG | 24 | 5928 |
| SCNN1A-2080 | - | CCAUACCAGGUCUCAUGG | 18 | 5929 |
| SCNN1A-2081 | - | CCCAUACCAGGUCUCAUGG | 19 | 5930 |
| SCNN1A-2 | - | GCCCAUACCAGGUCUCAUGG | 20 | 497 |
| SCNN1A-2082 | - | AGCCCAUACCAGGUCUCAUGG | 21 | 5931 |
| SCNN1A-2083 | - | CAGCCCAUACCAGGUCUCAUGG | 22 | 5932 |
| SCNN1A-2084 | - | GCAGCCCAUACCAGGUCUCAUGG | 23 | 5933 |
| SCNN1A-2085 | - | UGCAGCCCAUACCAGGUCUCAUGG | 24 | 5934 |
| SCNN1A-2086 | - | GGGUUCCAGGGGUGAUGG | 18 | 5935 |
| SCNN1A-2087 | - | CGGGUUCCAGGGGUGAUGG | 19 | 5936 |
| SCNN1A-2088 | - | UCGGGUUCCAGGGGUGAUGG | 20 | 5937 |
| SCNN1A-2089 | - | CUCGGGUUCCAGGGGUGAUGG | 21 | 5938 |
| SCNN1A-2090 | - | ACUCGGGUUCCAGGGGUGAUGG | 22 | 5939 |
| SCNN1A-2091 | - | CACUCGGGUUCCAGGGGUGAUGG | 23 | 5940 |
| SCNN1A-2092 | - | UCACUCGGGUUCCAGGGGUGAUGG | 24 | 5941 |
| SCNN1A-2093 | - | UGAAGGGGAACAAGCUGG | 18 | 5942 |
| SCNN1A-2094 | - | AUGAAGGGGAACAAGCUGG | 19 | 5943 |
| SCNN1A-455 | - | CAUGAAGGGGAACAAGCUGG | 20 | 4304 |
| SCNN1A-2095 | - | UCAUGAAGGGGAACAAGCUGG | 21 | 5944 |
| SCNN1A-2096 | - | CUCAUGAAGGGGAACAAGCUGG | 22 | 5945 |
| SCNN1A-2097 | - | GCUCAUGAAGGGGAACAAGCUGG | 23 | 5946 |
| SCNN1A-2098 | - | GGCUCAUGAAGGGGAACAAGCUGG | 24 | 5947 |
| SCNN1A-2099 | - | UGGAGGGGAACAAGCUGG | 18 | 5948 |
| SCNN1A-2100 | - | AUGGAGGGGAACAAGCUGG | 19 | 5949 |

TABLE 44D-continued

4th Tier

| gRNA Name | DNA Strand | Targeting Domain | Target Site Length | Seq ID |
|---|---|---|---|---|
| SCNN1A-6 | - | CAUGGAGGGGAACAAGCUGG | 20 | 558 |
| SCNN1A-2101 | - | UCAUGGAGGGGAACAAGCUGG | 21 | 5950 |
| SCNN1A-2102 | - | CUCAUGGAGGGGAACAAGCUGG | 22 | 5951 |
| SCNN1A-2103 | - | UCUCAUGGAGGGGAACAAGCUGG | 23 | 5952 |
| SCNN1A-2104 | - | GUCUCAUGGAGGGGAACAAGCUGG | 24 | 5953 |
| SCNN1A-2105 | - | UCCACUCCAGGGCUCAUG | 18 | 5954 |
| SCNN1A-2106 | - | GUCCACUCCAGGGCUCAUG | 19 | 5955 |
| SCNN1A-172 | - | AGUCCACUCCAGGGCUCAUG | 20 | 810 |
| SCNN1A-2107 | - | CAGUCCACUCCAGGGCUCAUG | 21 | 5956 |
| SCNN1A-2108 | - | ACAGUCCACUCCAGGGCUCAUG | 22 | 5957 |
| SCNN1A-2109 | - | CACAGUCCACUCCAGGGCUCAUG | 23 | 5958 |
| SCNN1A-2110 | - | CCACAGUCCACUCCAGGGCUCAUG | 24 | 5959 |
| SCNN1A-2111 | - | UCCACUCCGGGGCUCAUG | 18 | 5960 |
| SCNN1A-2112 | - | AUCCACUCCGGGGCUCAUG | 19 | 5961 |
| SCNN1A-2113 | - | AAUCCACUCCGGGGCUCAUG | 20 | 5962 |
| SCNN1A-2114 | - | CAAUCCACUCCGGGGCUCAUG | 21 | 5963 |
| SCNN1A-2115 | - | CCAAUCCACUCCGGGGCUCAUG | 22 | 5964 |
| SCNN1A-2116 | - | CCCAAUCCACUCCGGGGCUCAUG | 23 | 5965 |
| SCNN1A-2117 | - | CCCCAAUCCACUCCGGGGCUCAUG | 24 | 5966 |
| SCNN1A-2118 | - | CCCAUACCAGGUCUCAUG | 18 | 5967 |
| SCNN1A-2119 | - | GCCCAUACCAGGUCUCAUG | 19 | 5968 |
| SCNN1A-161 | - | AGCCCAUACCAGGUCUCAUG | 20 | 804 |
| SCNN1A-2120 | - | CAGCCCAUACCAGGUCUCAUG | 21 | 5969 |
| SCNN1A-2121 | - | GCAGCCCAUACCAGGUCUCAUG | 22 | 5970 |
| SCNN1A-2122 | - | UGCAGCCCAUACCAGGUCUCAUG | 23 | 5971 |
| SCNN1A-2123 | - | CUGCAGCCCAUACCAGGUCUCAUG | 24 | 5972 |
| SCNN1A-2124 | - | AUGAAGGGGAACAAGCUG | 18 | 5973 |
| SCNN1A-2125 | - | CAUGAAGGGGAACAAGCUG | 19 | 5974 |
| SCNN1A-2126 | - | UCAUGAAGGGGAACAAGCUG | 20 | 5975 |
| SCNN1A-2127 | - | CUCAUGAAGGGGAACAAGCUG | 21 | 5976 |
| SCNN1A-2128 | - | GCUCAUGAAGGGGAACAAGCUG | 22 | 5977 |
| SCNN1A-2129 | - | GGCUCAUGAAGGGGAACAAGCUG | 23 | 5978 |
| SCNN1A-2130 | - | GGGCUCAUGAAGGGGAACAAGCUG | 24 | 5979 |
| SCNN1A-2131 | - | AUGGAGGGGAACAAGCUG | 18 | 5980 |
| SCNN1A-2132 | - | CAUGGAGGGGAACAAGCUG | 19 | 5981 |
| SCNN1A-167 | - | UCAUGGAGGGGAACAAGCUG | 20 | 806 |
| SCNN1A-2133 | - | CUCAUGGAGGGGAACAAGCUG | 21 | 5982 |

TABLE 44D-continued

4th Tier

| gRNA Name | DNA Strand | Targeting Domain | Target Site Length | Seq ID |
|---|---|---|---|---|
| SCNN1A-2134 | − | UCUCAUGGAGGGGAACAAGCUG | 22 | 5983 |
| SCNN1A-2135 | − | GUCUCAUGGAGGGGAACAAGCUG | 23 | 5984 |
| SCNN1A-2136 | − | GGUCUCAUGGAGGGGAACAAGCUG | 24 | 5985 |
| SCNN1A-2137 | − | UGAAGGGGAACAAGCGUG | 18 | 5986 |
| SCNN1A-2138 | − | AUGAAGGGGAACAAGCGUG | 19 | 5987 |
| SCNN1A-13 | − | CAUGAAGGGGAACAAGCGUG | 20 | 562 |
| SCNN1A-2139 | − | UCAUGAAGGGGAACAAGCGUG | 21 | 5988 |
| SCNN1A-2140 | − | CUCAUGAAGGGGAACAAGCGUG | 22 | 5989 |
| SCNN1A-2141 | − | GCUCAUGAAGGGGAACAAGCGUG | 23 | 5990 |
| SCNN1A-2142 | − | GGCUCAUGAAGGGGAACAAGCGUG | 24 | 5991 |
| SCNN1A-2143 | − | ACUCGGGUUCCAGGGGUG | 18 | 5992 |
| SCNN1A-2144 | − | CACUCGGGUUCCAGGGGUG | 19 | 5993 |
| SCNN1A-2145 | − | UCACUCGGGUUCCAGGGGUG | 20 | 5994 |
| SCNN1A-2146 | − | CUCACUCGGGUUCCAGGGGUG | 21 | 5995 |
| SCNN1A-2147 | − | CCUCACUCGGGUUCCAGGGGUG | 22 | 5996 |
| SCNN1A-2148 | − | GCCUCACUCGGGUUCCAGGGGUG | 23 | 5997 |
| SCNN1A-2149 | − | AGCCUCACUCGGGUUCCAGGGGUG | 24 | 5998 |
| SCNN1A-2150 | − | UCGGGUUCCAGGGGUGAU | 18 | 5999 |
| SCNN1A-2151 | − | CUCGGGUUCCAGGGGUGAU | 19 | 6000 |
| SCNN1A-421 | − | ACUCGGGUUCCAGGGGUGAU | 20 | 4270 |
| SCNN1A-2152 | − | CACUCGGGUUCCAGGGGUGAU | 21 | 6001 |
| SCNN1A-2153 | − | UCACUCGGGUUCCAGGGGUGAU | 22 | 6002 |
| SCNN1A-2154 | − | CUCACUCGGGUUCCAGGGGUGAU | 23 | 6003 |
| SCNN1A-2155 | − | CCUCACUCGGGUUCCAGGGGUGAU | 24 | 6004 |
| SCNN1A-2156 | − | UGCUCUCCCCAAUCCACU | 18 | 6005 |
| SCNN1A-2157 | − | UUGCUCUCCCCAAUCCACU | 19 | 6006 |
| SCNN1A-2158 | − | CUUGCUCUCCCCAAUCCACU | 20 | 6007 |
| SCNN1A-2159 | − | CCUUGCUCUCCCCAAUCCACU | 21 | 6008 |
| SCNN1A-2160 | − | CCCUUGCUCUCCCCAAUCCACU | 22 | 6009 |
| SCNN1A-2161 | − | ACCCUUGCUCUCCCCAAUCCACU | 23 | 6010 |
| SCNN1A-2162 | − | GACCCUUGCUCUCCCCAAUCCACU | 24 | 6011 |
| SCNN1A-2163 | − | GUGAUGGGAGAGGGCACU | 18 | 6012 |
| SCNN1A-2164 | − | GGUGAUGGGAGAGGGCACU | 19 | 6013 |
| SCNN1A-2165 | − | GGGUGAUGGGAGAGGGCACU | 20 | 6014 |
| SCNN1A-2166 | − | GGGGUGAUGGGAGAGGGCACU | 21 | 6015 |
| SCNN1A-2167 | − | AGGGGUGAUGGGAGAGGGCACU | 22 | 6016 |
| SCNN1A-2168 | − | CAGGGGUGAUGGGAGAGGGCACU | 23 | 6017 |
| SCNN1A-2169 | − | CCAGGGGUGAUGGGAGAGGGCACU | 24 | 6018 |

TABLE 44D-continued

4th Tier

| gRNA Name | DNA Strand | Targeting Domain | Target Site Length | Seq ID |
|---|---|---|---|---|
| SCNN1A-2170 | − | AUGAAGGGGAACAAGCGU | 18 | 6019 |
| SCNN1A-2171 | − | CAUGAAGGGGAACAAGCGU | 19 | 6020 |
| SCNN1A-177 | − | UCAUGAAGGGGAACAAGCGU | 20 | 812 |
| SCNN1A-2172 | − | CUCAUGAAGGGGAACAAGCGU | 21 | 6021 |
| SCNN1A-2173 | − | GCUCAUGAAGGGGAACAAGCGU | 22 | 6022 |
| SCNN1A-2174 | − | GGCUCAUGAAGGGGAACAAGCGU | 23 | 6023 |
| SCNN1A-2175 | − | GGGCUCAUGAAGGGGAACAAGCGU | 24 | 6024 |
| SCNN1A-2176 | − | UAAGCAAGGGAACCUGGU | 18 | 6025 |
| SCNN1A-2177 | − | GUAAGCAAGGGAACCUGGU | 19 | 6026 |
| SCNN1A-2178 | − | GGUAAGCAAGGGAACCUGGU | 20 | 6027 |
| SCNN1A-2179 | − | AGGUAAGCAAGGGAACCUGGU | 21 | 6028 |
| SCNN1A-2180 | − | AAGGUAAGCAAGGGAACCUGGU | 22 | 6029 |
| SCNN1A-2181 | − | CAAGGUAAGCAAGGGAACCUGGU | 23 | 6030 |
| SCNN1A-2182 | − | UCAAGGUAAGCAAGGGAACCUGGU | 24 | 6031 |
| SCNN1A-2183 | − | CCGCAUGAAGACGGCCUU | 18 | 6032 |
| SCNN1A-2184 | − | ACCGCAUGAAGACGGCCUU | 19 | 6033 |
| SCNN1A-194 | − | AACCGCAUGAAGACGGCCUU | 20 | 824 |
| SCNN1A-2185 | − | CAACCGCAUGAAGACGGCCUU | 21 | 6034 |
| SCNN1A-2186 | − | ACAACCGCAUGAAGACGGCCUU | 22 | 6035 |
| SCNN1A-2187 | − | CACAACCGCAUGAAGACGGCCUU | 23 | 6036 |
| SCNN1A-2188 | − | GCACAACCGCAUGAAGACGGCCUU | 24 | 6037 |
| SCNN1A-2189 | − | GGCAAUUCGGCCUGCUUU | 18 | 6038 |
| SCNN1A-2190 | − | UGGCAAUUCGGCCUGCUUU | 19 | 6039 |
| SCNN1A-195 | − | CUGGCAAUUCGGCCUGCUUU | 20 | 825 |
| SCNN1A-2191 | − | ACUGGCAAUUCGGCCUGCUUU | 21 | 6040 |
| SCNN1A-2192 | − | UACUGGCAAUUCGGCCUGCUUU | 22 | 6041 |
| SCNN1A-2193 | − | GUACUGGCAAUUCGGCCUGCUUU | 23 | 6042 |
| SCNN1A-2194 | − | UGUACUGGCAAUUCGGCCUGCUUU | 24 | 6043 |
| SCNN1A-2195 | − | GCAAUUCGGCCUGCUUUU | 18 | 6044 |
| SCNN1A-2196 | − | GGCAAUUCGGCCUGCUUUU | 19 | 6045 |
| SCNN1A-34 | − | UGGCAAUUCGGCCUGCUUUU | 20 | 573 |
| SCNN1A-2197 | − | CUGGCAAUUCGGCCUGCUUUU | 21 | 6046 |
| SCNN1A-2198 | − | ACUGGCAAUUCGGCCUGCUUUU | 22 | 6047 |
| SCNN1A-2199 | − | UACUGGCAAUUCGGCCUGCUUUU | 23 | 6048 |
| SCNN1A-2200 | − | GUACUGGCAAUUCGGCCUGCUUUU | 24 | 6049 |

Table 44E provides exemplary targeting domains for knocking out the SCNN1A gene selected according to the fifth tier parameters. The targeting domains fall in the coding sequence of the gene, downstream of the first 500 bp of coding sequence (e.g., anywhere from +500 (relative to the start codon) to the stop codon of the gene), starts with a 5'G and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 44E

5th Tier

| gRNA Name | DNA Strand | Targeting Domain | Target Site Length | Seq ID |
|---|---|---|---|---|
| SCNN1A-2201 | + | GUACCUGAAGGGGCGAGGGGAA | 22 | 6050 |
| SCNN1A-2202 | + | GGUACCUGAAGGGGCGAGGGGAA | 23 | 6051 |
| SCNN1A-2203 | + | GGGUACCUGAAGGGGCGAGGGGAA | 24 | 6052 |
| SCNN1A-2204 | + | GGGACAAGGACAGAGACA | 18 | 6053 |
| SCNN1A-2205 | + | GCUGGGACAAGGACAGAGACA | 21 | 6054 |
| SCNN1A-2206 | + | GGCUGGGACAAGGACAGAGACA | 22 | 6055 |
| SCNN1A-2207 | + | GUAUAGCAGUUUCCAUACA | 19 | 6056 |
| SCNN1A-2208 | + | GAAAGUAUAGCAGUUUCCAUACA | 23 | 6057 |
| SCNN1A-2209 | + | GGACCCUCAGGCGCUGCA | 18 | 6058 |
| SCNN1A-2210 | + | GGGACCCUCAGGCGCUGCA | 19 | 6059 |
| SCNN1A-2211 | + | GCGGGACCCUCAGGCGCUGCA | 21 | 6060 |
| SCNN1A-2212 | + | GGCGGGACCCUCAGGCGCUGCA | 22 | 6061 |
| SCNN1A-2213 | + | GGGCGGGACCCUCAGGCGCUGCA | 23 | 6062 |
| SCNN1A-2214 | + | GGGGCGGGACCCUCAGGCGCUGCA | 24 | 6063 |
| SCNN1A-2215 | + | GUAAUUCCUUAUCAGGAAAGA | 21 | 6064 |
| SCNN1A-2216 | + | GAGUAAUUCCUUAUCAGGAAAGA | 23 | 6065 |
| SCNN1A-2217 | + | GAGUCUCUGGCAGCCUCGA | 19 | 6066 |
| SCNN1A-2218 | + | GCAGAGUCUCUGGCAGCCUCGA | 22 | 6067 |
| SCNN1A-2219 | + | GGCAGAGUCUCUGGCAGCCUCGA | 23 | 6068 |
| SCNN1A-2220 | + | GCUCUCCUGGAAGCAGGA | 18 | 6069 |
| SCNN1A-2221 | + | GAUCAUGCUCUCCUGGAAGCAGGA | 24 | 6070 |
| SCNN1A-2222 | + | GAAGACCCAUUCCUAGGA | 18 | 6071 |
| SCNN1A-2223 | + | GGAAGACCCAUUCCUAGGA | 19 | 6072 |
| SCNN1A-2224 | + | GCUGCGGGAGCCGGCCAC | 18 | 6073 |
| SCNN1A-2225 | + | GGCUGCGGGAGCCGGCCAC | 19 | 6074 |
| SCNN1A-2226 | + | GACGGCUGCGGGAGCCGGCCAC | 22 | 6075 |
| SCNN1A-2227 | + | GCGACGGCUGCGGGAGCCGGCCAC | 24 | 6076 |
| SCNN1A-2228 | + | GUUGCACUGGACACAGAGAC | 20 | 6077 |
| SCNN1A-2229 | + | GGUUGCACUGGACACAGAGAC | 21 | 6078 |
| SCNN1A-2230 | + | GCCCCCUGGAGAUGGGCGGGGCC | 24 | 6079 |
| SCNN1A-2231 | + | GUACUCCACGUUCUGGGGCC | 20 | 6080 |
| SCNN1A-2232 | + | GCCCAGCGUGUCCUCCUCC | 19 | 6081 |
| SCNN1A-2233 | + | GUUGCCCAGCGUGUCCUCCUCC | 22 | 6082 |
| SCNN1A-1051 | + | GAUCAUGCUCUCCUGGAAGC | 20 | 4900 |
| SCNN1A-2234 | + | GGAAGGAGGGGAGGAUGC | 18 | 6083 |

TABLE 44E-continued

5th Tier

| gRNA Name | DNA Strand | Targeting Domain | Target Site Length | Seq ID |
|---|---|---|---|---|
| SCNN1A-2235 | + | GGGAAGGAGGGGAGGAUGC | 19 | 6084 |
| SCNN1A-2236 | + | GUGGGAAGGAGGGGAGGAUGC | 21 | 6085 |
| SCNN1A-2237 | + | GAAGUGGGAAGGAGGGGAGGAUGC | 24 | 6086 |
| SCNN1A-2238 | + | GAUGUCACCGAGGGCCAUC | 19 | 6087 |
| SCNN1A-2239 | + | GGAUGUCACCGAGGGCCAUC | 20 | 6088 |
| SCNN1A-2240 | + | GGGAUGUCACCGAGGGCCAUC | 21 | 6089 |
| SCNN1A-2241 | + | GCCAUAAUCGCCCCCAAGUCUGUC | 24 | 6090 |
| SCNN1A-2242 | + | GCUGCCCAGGUUGGACAG | 18 | 6091 |
| SCNN1A-2243 | + | GGCUGCCCAGGUUGGACAG | 19 | 6092 |
| SCNN1A-2244 | + | GCCCCAGUCACUGUGGACAGCAG | 23 | 6093 |
| SCNN1A-2245 | + | GGCCCCAGUCACUGUGGACAGCAG | 24 | 6094 |
| SCNN1A-2246 | + | GACCUAGGGGUGCAGAGAGAG | 21 | 6095 |
| SCNN1A-2247 | + | GAAUACACACCUGGAAGGGAG | 21 | 6096 |
| SCNN1A-2248 | + | GUGAAUACACACCUGGAAGGGAG | 23 | 6097 |
| SCNN1A-2249 | + | GCGCUGCAAGGGGUGCGG | 18 | 6098 |
| SCNN1A-2250 | + | GGCGCUGCAAGGGGUGCGG | 19 | 6099 |
| SCNN1A-2251 | + | GCAGAAGUGGGAAGGAGGG | 19 | 6100 |
| SCNN1A-2252 | + | GGCAGAAGUGGGAAGGAGGG | 20 | 6101 |
| SCNN1A-2253 | + | GGGCAGAAGUGGGAAGGAGGG | 21 | 6102 |
| SCNN1A-2254 | + | GGGGCAGAAGUGGGAAGGAGGG | 22 | 6103 |
| SCNN1A-2255 | + | GGGGGCAGAAGUGGGAAGGAGGG | 23 | 6104 |
| SCNN1A-2256 | + | GUCCUCCUCCAGGGAUGG | 18 | 6105 |
| SCNN1A-2257 | + | GUGUCCUCCUCCAGGGAUGG | 20 | 6106 |
| SCNN1A-2258 | + | GCGUGUCCUCCUCCAGGGAUGG | 22 | 6107 |
| SCNN1A-2259 | + | GCCUCACCUGCUGUGUGUACUUUG | 24 | 6108 |
| SCNN1A-2260 | + | GACCCAUUCCUAGGAAAGAAU | 21 | 6109 |
| SCNN1A-2261 | + | GAAGACCCAUUCCUAGGAAAGAAU | 24 | 6110 |
| SCNN1A-2262 | + | GACCUACCGUGACAGAGGGAGACU | 24 | 6111 |
| SCNN1A-1263 | + | GCAGCAUCAGGGACAGACCU | 20 | 5112 |
| SCNN1A-2263 | + | GCGCAGCAUCAGGGACAGACCU | 22 | 6112 |
| SCNN1A-2264 | + | GCGCGCAGCAUCAGGGACAGACCU | 24 | 6113 |
| SCNN1A-2265 | + | GCUUAUAGUAGCAGUACCCU | 20 | 6114 |
| SCNN1A-2266 | + | GAGCUUAUAGUAGCAGUACCCU | 22 | 6115 |
| SCNN1A-2267 | + | GGAGCUUAUAGUAGCAGUACCCU | 23 | 6116 |
| SCNN1A-2268 | + | GCUGGUAGCUGGUCACGCU | 19 | 6117 |
| SCNN1A-2269 | + | GAGCUGGUAGCUGGUCACGCU | 21 | 6118 |
| SCNN1A-2270 | + | GAGAGCUGGUAGCUGGUCACGCU | 23 | 6119 |

TABLE 44E-continued

5th Tier

| gRNA Name | DNA Strand | Targeting Domain | Target Site Length | Seq ID |
|---|---|---|---|---|
| SCNN1A-2271 | + | GCAUGGAAGACAUCCAGAGGU | 21 | 6120 |
| SCNN1A-2272 | + | GGCAUGGAAGACAUCCAGAGGU | 22 | 6121 |
| SCNN1A-2273 | + | GCUCCUCCAGCUCCUCUUUAAUUU | 24 | 6122 |
| SCNN1A-2274 | - | GGCAUCUCUCUGUACCCA | 18 | 6123 |
| SCNN1A-2275 | - | GAACAGGCAUCUCUCUGUACCCA | 23 | 6124 |
| SCNN1A-2276 | - | GCUUCCAGGAGAGCAUGAUCA | 21 | 6125 |
| SCNN1A-2277 | - | GACACCCCAUUCUUUCCUAGGA | 23 | 6126 |
| SCNN1A-2278 | - | GACAUCCCAGGUAGAGUGUGGGA | 24 | 6127 |
| SCNN1A-2279 | - | GACCCUACUCUCUCUUUCCUGAUA | 24 | 6128 |
| SCNN1A-2280 | - | GAUUAUGGCGACUGCACC | 18 | 6129 |
| SCNN1A-2281 | - | GCGAUUAUGGCGACUGCACC | 20 | 6130 |
| SCNN1A-2282 | - | GGCGAUUAUGGCGACUGCACC | 21 | 6131 |
| SCNN1A-2283 | - | GGGCGAUUAUGGCGACUGCACC | 22 | 6132 |
| SCNN1A-2284 | - | GGGGCGAUUAUGGCGACUGCACC | 23 | 6133 |
| SCNN1A-2285 | - | GGGGGCGAUUAUGGCGACUGCACC | 24 | 6134 |
| SCNN1A-2286 | - | GCAGGUUAGUGUCCCCUUCC | 20 | 6135 |
| SCNN1A-2287 | - | GACUACAGAAAGCACAGUUCC | 21 | 6136 |
| SCNN1A-2288 | - | GUGACUACAGAAAGCACAGUUCC | 23 | 6137 |
| SCNN1A-2289 | - | GACCUCCAUCAGCAUGAGGAAGGC | 24 | 6138 |
| SCNN1A-2290 | - | GGUCUCCUGCAACCAGGC | 18 | 6139 |
| SCNN1A-2291 | - | GUCUCCAGGCCGAGGGGC | 19 | 6140 |
| SCNN1A-1073 | - | GGUCUCCAGGCCGAGGGGC | 20 | 4922 |
| SCNN1A-2292 | - | GUCCACAGUGACUGGGGC | 18 | 6141 |
| SCNN1A-2293 | - | GCUGUCCACAGUGACUGGGGC | 21 | 6142 |
| SCNN1A-2294 | - | GCUUCUACCAGACAUACUCAUC | 22 | 6143 |
| SCNN1A-2295 | - | GUCCCUGAUGCUGCGCGCAGAG | 22 | 6144 |
| SCNN1A-2296 | - | GCCCUCGGUGACAUCCCAGG | 20 | 6145 |
| SCNN1A-2297 | - | GGCCCUCGGUGACAUCCCAGG | 21 | 6146 |
| SCNN1A-2298 | - | GAUGGCCCUCGGUGACAUCCCAGG | 24 | 6147 |
| SCNN1A-2299 | - | GUAGAGUGUGGGGAAGGG | 18 | 6148 |
| SCNN1A-2300 | - | GGUAGAGUGUGGGGAAGGG | 19 | 6149 |
| SCNN1A-2301 | - | GCCCGGGUAAUGGUGCACGGG | 21 | 6150 |
| SCNN1A-2302 | - | GGCCCGGGUAAUGGUGCACGGG | 22 | 6151 |
| SCNN1A-2303 | - | GGGCCCGGGUAAUGGUGCACGGG | 23 | 6152 |
| SCNN1A-2304 | - | GGGGCCCGGGUAAUGGUGCACGGG | 24 | 6153 |
| SCNN1A-2305 | - | GUGGGGAAGGGAUGGGUG | 18 | 6154 |
| SCNN1A-1236 | - | GUGUGGGGAAGGGAUGGGUG | 20 | 5085 |
| SCNN1A-2306 | - | GAGUGUGGGGAAGGGAUGGGUG | 22 | 6155 |

TABLE 44E-continued

5th Tier

| gRNA Name | DNA Strand | Targeting Domain | Target Site Length | Seq ID |
|---|---|---|---|---|
| SCNN1A-2307 | − | GACAAGAACAACUCCAACCU | 20 | 6156 |
| SCNN1A-2308 | − | GCACCCCUUGCAGCGCCU | 18 | 6157 |
| SCNN1A-2309 | − | GCCGCACCCCUUGCAGCGCCU | 21 | 6158 |
| SCNN1A-2310 | − | GACACCCCAUUCUUUCCU | 19 | 6159 |
| SCNN1A-2311 | − | GAUGACACCCCAUUCUUUCCU | 22 | 6160 |
| SCNN1A-2312 | − | GCUGAACUACAAAACCAAUU | 20 | 6161 |
| SCNN1A-2313 | − | GAGCUGAACUACAAAACCAAUU | 22 | 6162 |
| SCNN1A-2314 | − | GGAGCUGAACUACAAAACCAAUU | 23 | 6163 |
| SCNN1A-2315 | − | GCAGGAUGAACCUGCCUUU | 19 | 6164 |
| SCNN1A-2316 | − | GGCAGGAUGAACCUGCCUUU | 20 | 6165 |
| SCNN1A-2317 | − | GGGCAGGAUGAACCUGCCUUU | 21 | 6166 |

Table 44F provides exemplary targeting domains for knocking out the SCNN1A gene selected according to the six tier parameters. The targeting domains fall in the coding sequence of the gene, downstream of the first 500 bp of coding sequence (e.g., anywhere from +500 (relative to the start codon) to the stop codon of the gene) and PAM is NNGRRT. It is contemplated herein that in an embodiment the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 44F

6th Tier

| gRNA Name | DNA Strand | Targeting Domain | Target Site Length | Seq ID |
|---|---|---|---|---|
| SCNN1A-2318 | + | CUGAAGGGGCGAGGGGAA | 18 | 6167 |
| SCNN1A-2319 | + | CCUGAAGGGGCGAGGGGAA | 19 | 6168 |
| SCNN1A-2320 | + | ACCUGAAGGGGCGAGGGGAA | 20 | 6169 |
| SCNN1A-2321 | + | UACCUGAAGGGGCGAGGGGAA | 21 | 6170 |
| SCNN1A-2322 | + | UGGGACAAGGACAGAGACA | 19 | 6171 |
| SCNN1A-899 | + | CUGGGACAAGGACAGAGACA | 20 | 4748 |
| SCNN1A-2323 | + | UGGCUGGGACAAGGACAGAGACA | 23 | 6172 |
| SCNN1A-2324 | + | CUGGCUGGGACAAGGACAGAGACA | 24 | 6173 |
| SCNN1A-2325 | + | UAUAGCAGUUUCCAUACA | 18 | 6174 |
| SCNN1A-2326 | + | AGUAUAGCAGUUUCCAUACA | 20 | 6175 |
| SCNN1A-2327 | + | AAGUAUAGCAGUUUCCAUACA | 21 | 6176 |
| SCNN1A-2328 | + | AAAGUAUAGCAGUUUCCAUACA | 22 | 6177 |
| SCNN1A-2329 | + | UGAAAGUAUAGCAGUUUCCAUACA | 24 | 6178 |
| SCNN1A-2330 | + | UUUCUUAGGUGUGGGCA | 18 | 6179 |
| SCNN1A-2331 | + | AUUUCUUAGGUGUGGGCA | 19 | 6180 |
| SCNN1A-2332 | + | CAUUUCUUAGGUGUGGGCA | 20 | 6181 |
| SCNN1A-2333 | + | CCAUUUCUUAGGUGUGGGCA | 21 | 6182 |

TABLE 44F-continued

6th Tier

| gRNA Name | DNA Strand | Targeting Domain | Target Site Length | Seq ID |
|---|---|---|---|---|
| SCNN1A-2334 | + | UCCAUUUCUUAGGUGUGGGGCA | 22 | 6183 |
| SCNN1A-2335 | + | CUCCAUUUCUUAGGUGUGGGGCA | 23 | 6184 |
| SCNN1A-2336 | + | ACUCCAUUUCUUAGGUGUGGGGCA | 24 | 6185 |
| SCNN1A-917 | + | CGGGACCCUCAGGCGCUGCA | 20 | 4766 |
| SCNN1A-2337 | + | AUUCCUUAUCAGGAAAGA | 18 | 6186 |
| SCNN1A-2338 | + | AAUUCCUUAUCAGGAAAGA | 19 | 6187 |
| SCNN1A-2339 | + | UAAUUCCUUAUCAGGAAAGA | 20 | 6188 |
| SCNN1A-2340 | + | AGUAAUUCCUUAUCAGGAAAGA | 22 | 6189 |
| SCNN1A-2341 | + | AGAGUAAUUCCUUAUCAGGAAAGA | 24 | 6190 |
| SCNN1A-2342 | + | AGUCUCUGGCAGCCUCGA | 18 | 6191 |
| SCNN1A-2343 | + | AGAGUCUCUGGCAGCCUCGA | 20 | 6192 |
| SCNN1A-2344 | + | CAGAGUCUCUGGCAGCCUCGA | 21 | 6193 |
| SCNN1A-2345 | + | UGGCAGAGUCUCUGGCAGCCUCGA | 24 | 6194 |
| SCNN1A-2346 | + | UGCUCUCCUGGAAGCAGGA | 19 | 6195 |
| SCNN1A-2347 | + | AUGCUCUCCUGGAAGCAGGA | 20 | 6196 |
| SCNN1A-2348 | + | CAUGCUCUCCUGGAAGCAGGA | 21 | 6197 |
| SCNN1A-2349 | + | UCAUGCUCUCCUGGAAGCAGGA | 22 | 6198 |
| SCNN1A-2350 | + | AUCAUGCUCUCCUGGAAGCAGGA | 23 | 6199 |
| SCNN1A-2351 | + | UGGAAGACCCAUUCCUAGGA | 20 | 6200 |
| SCNN1A-2352 | + | CUGGAAGACCCAUUCCUAGGA | 21 | 6201 |
| SCNN1A-2353 | + | UCUGGAAGACCCAUUCCUAGGA | 22 | 6202 |
| SCNN1A-2354 | + | AUCUGGAAGACCCAUUCCUAGGA | 23 | 6203 |
| SCNN1A-2355 | + | CAUCUGGAAGACCCAUUCCUAGGA | 24 | 6204 |
| SCNN1A-2356 | + | CGGCUGCGGGAGCCGGCCAC | 20 | 6205 |
| SCNN1A-2357 | + | ACGGCUGCGGGAGCCGGCCAC | 21 | 6206 |
| SCNN1A-2358 | + | CGACGGCUGCGGGAGCCGGCCAC | 23 | 6207 |
| SCNN1A-2359 | + | UGCACUGGACACAGAGAC | 18 | 6208 |
| SCNN1A-2360 | + | UUGCACUGGACACAGAGAC | 19 | 6209 |
| SCNN1A-2361 | + | UGGUUGCACUGGACACAGAGAC | 22 | 6210 |
| SCNN1A-2362 | + | CUGGUUGCACUGGACACAGAGAC | 23 | 6211 |
| SCNN1A-2363 | + | UCUGGUUGCACUGGACACAGAGAC | 24 | 6212 |
| SCNN1A-2364 | + | CCUUCCCCACACUCUACC | 18 | 6213 |
| SCNN1A-2365 | + | CCCUUCCCCACACUCUACC | 19 | 6214 |
| SCNN1A-1006 | + | UCCCUUCCCCACACUCUACC | 20 | 4855 |
| SCNN1A-2366 | + | AUCCCUUCCCCACACUCUACC | 21 | 6215 |
| SCNN1A-2367 | + | CAUCCCUUCCCCACACUCUACC | 22 | 6216 |
| SCNN1A-2368 | + | CCAUCCCUUCCCCACACUCUACC | 23 | 6217 |
| SCNN1A-2369 | + | CCCAUCCCUUCCCCACACUCUACC | 24 | 6218 |

TABLE 44F-continued

6th Tier

| gRNA Name | DNA Strand | Targeting Domain | Target Site Length | Seq ID |
|---|---|---|---|---|
| SCNN1A-2370 | + | UGGAGAUGGGCGGGGGCC | 18 | 6219 |
| SCNN1A-2371 | + | CUGGAGAUGGGCGGGGGCC | 19 | 6220 |
| SCNN1A-2372 | + | CCUGGAGAUGGGCGGGGGCC | 20 | 6221 |
| SCNN1A-2373 | + | CCCUGGAGAUGGGCGGGGGCC | 21 | 6222 |
| SCNN1A-2374 | + | CCCCUGGAGAUGGGCGGGGGCC | 22 | 6223 |
| SCNN1A-2375 | + | CCCCCUGGAGAUGGGCGGGGGCC | 23 | 6224 |
| SCNN1A-2376 | + | ACUCCACGUUCUGGGGCC | 18 | 6225 |
| SCNN1A-2377 | + | UACUCCACGUUCUGGGGCC | 19 | 6226 |
| SCNN1A-2378 | + | AGUACUCCACGUUCUGGGGCC | 21 | 6227 |
| SCNN1A-2379 | + | CAGUACUCCACGUUCUGGGGCC | 22 | 6228 |
| SCNN1A-2380 | + | ACAGUACUCCACGUUCUGGGGCC | 23 | 6229 |
| SCNN1A-2381 | + | CACAGUACUCCACGUUCUGGGGCC | 24 | 6230 |
| SCNN1A-2382 | + | CCCAGCGUGUCCUCCUCC | 18 | 6231 |
| SCNN1A-1038 | + | UGCCCAGCGUGUCCUCCUCC | 20 | 4887 |
| SCNN1A-2383 | + | UUGCCCAGCGUGUCCUCCUCC | 21 | 6232 |
| SCNN1A-2384 | + | AGUUGCCCAGCGUGUCCUCCUCC | 23 | 6233 |
| SCNN1A-2385 | + | AAGUUGCCCAGCGUGUCCUCCUCC | 24 | 6234 |
| SCNN1A-2386 | + | UCAUGCUCUCCUGGAAGC | 18 | 6235 |
| SCNN1A-2387 | + | AUCAUGCUCUCCUGGAAGC | 19 | 6236 |
| SCNN1A-2388 | + | UGAUCAUGCUCUCCUGGAAGC | 21 | 6237 |
| SCNN1A-2389 | + | UUGAUCAUGCUCUCCUGGAAGC | 22 | 6238 |
| SCNN1A-2390 | + | CUUGAUCAUGCUCUCCUGGAAGC | 23 | 6239 |
| SCNN1A-2391 | + | CCUUGAUCAUGCUCUCCUGGAAGC | 24 | 6240 |
| SCNN1A-2392 | + | UGGGAAGGAGGGGAGGAUGC | 20 | 6241 |
| SCNN1A-2393 | + | AGUGGGAAGGAGGGGAGGAUGC | 22 | 6242 |
| SCNN1A-2394 | + | AAGUGGGAAGGAGGGGAGGAUGC | 23 | 6243 |
| SCNN1A-2395 | + | AUGUCACCGAGGGCCAUC | 18 | 6244 |
| SCNN1A-2396 | + | UGGGAUGUCACCGAGGGCCAUC | 22 | 6245 |
| SCNN1A-2397 | + | CUGGGAUGUCACCGAGGGCCAUC | 23 | 6246 |
| SCNN1A-2398 | + | CCUGGGAUGUCACCGAGGGCCAUC | 24 | 6247 |
| SCNN1A-2399 | + | AUCGCCCCAAGUCUGUC | 18 | 6248 |
| SCNN1A-2400 | + | AAUCGCCCCAAGUCUGUC | 19 | 6249 |
| SCNN1A-2401 | + | UAAUCGCCCCAAGUCUGUC | 20 | 6250 |
| SCNN1A-2402 | + | AUAAUCGCCCCAAGUCUGUC | 21 | 6251 |
| SCNN1A-2403 | + | CAUAAUCGCCCCAAGUCUGUC | 22 | 6252 |
| SCNN1A-2404 | + | CCAUAAUCGCCCCAAGUCUGUC | 23 | 6253 |
| SCNN1A-2405 | + | UGGCUGCCCAGGUUGGACAG | 20 | 6254 |

TABLE 44F-continued

6th Tier

| gRNA Name | DNA Strand | Targeting Domain | Target Site Length | Seq ID |
|---|---|---|---|---|
| SCNN1A-2406 | + | CUGGCUGCCCAGGUUGGACAG | 21 | 6255 |
| SCNN1A-2407 | + | ACUGGCUGCCCAGGUUGGACAG | 22 | 6256 |
| SCNN1A-2408 | + | CACUGGCUGCCCAGGUUGGACAG | 23 | 6257 |
| SCNN1A-2409 | + | CCACUGGCUGCCCAGGUUGGACAG | 24 | 6258 |
| SCNN1A-2410 | + | AGUCACUGUGGACAGCAG | 18 | 6259 |
| SCNN1A-2411 | + | CAGUCACUGUGGACAGCAG | 19 | 6260 |
| SCNN1A-1119 | + | CCAGUCACUGUGGACAGCAG | 20 | 4968 |
| SCNN1A-2412 | + | CCCAGUCACUGUGGACAGCAG | 21 | 6261 |
| SCNN1A-2413 | + | CCCCAGUCACUGUGGACAGCAG | 22 | 6262 |
| SCNN1A-2414 | + | UUAUCAGGAAAGAGAGAG | 18 | 6263 |
| SCNN1A-2415 | + | CUUAUCAGGAAAGAGAGAG | 19 | 6264 |
| SCNN1A-2416 | + | CCUUAUCAGGAAAGAGAGAG | 20 | 6265 |
| SCNN1A-2417 | + | UCCUUAUCAGGAAAGAGAGAG | 21 | 6266 |
| SCNN1A-2418 | + | UUCCUUAUCAGGAAAGAGAGAG | 22 | 6267 |
| SCNN1A-2419 | + | AUUCCUUAUCAGGAAAGAGAGAG | 23 | 6268 |
| SCNN1A-2420 | + | AAUUCCUUAUCAGGAAAGAGAGAG | 24 | 6269 |
| SCNN1A-2421 | + | CUAGGGGUGCAGAGAGAG | 18 | 6270 |
| SCNN1A-2422 | + | CCUAGGGGUGCAGAGAGAG | 19 | 6271 |
| SCNN1A-2423 | + | ACCUAGGGGUGCAGAGAGAG | 20 | 6272 |
| SCNN1A-2424 | + | AGACCUAGGGGUGCAGAGAGAG | 22 | 6273 |
| SCNN1A-2425 | + | CAGACCUAGGGGUGCAGAGAGAG | 23 | 6274 |
| SCNN1A-2426 | + | ACAGACCUAGGGGUGCAGAGAGAG | 24 | 6275 |
| SCNN1A-2427 | + | UACACACCUGGAAGGGAG | 18 | 6276 |
| SCNN1A-2428 | + | AUACACACCUGGAAGGGAG | 19 | 6277 |
| SCNN1A-2429 | + | AAUACACACCUGGAAGGGAG | 20 | 6278 |
| SCNN1A-2430 | + | UGAAUACACACCUGGAAGGGAG | 22 | 6279 |
| SCNN1A-2431 | + | AGUGAAUACACACCUGGAAGGGAG | 24 | 6280 |
| SCNN1A-2432 | + | AGGCGCUGCAAGGGGUGCGG | 20 | 6281 |
| SCNN1A-2433 | + | CAGGCGCUGCAAGGGGUGCGG | 21 | 6282 |
| SCNN1A-2434 | + | UCAGGCGCUGCAAGGGGUGCGG | 22 | 6283 |
| SCNN1A-2435 | + | CUCAGGCGCUGCAAGGGGUGCGG | 23 | 6284 |
| SCNN1A-2436 | + | CCUCAGGCGCUGCAAGGGGUGCGG | 24 | 6285 |
| SCNN1A-2437 | + | CAGAAGUGGGAAGGAGGG | 18 | 6286 |
| SCNN1A-2438 | + | UGGGGGCAGAAGUGGGAAGGAGGG | 24 | 6287 |
| SCNN1A-2439 | + | UGUCCUCCUCCAGGGAUGG | 19 | 6288 |
| SCNN1A-2440 | + | CGUGUCCUCCUCCAGGGAUGG | 21 | 6289 |
| SCNN1A-2441 | + | AGCGUGUCCUCCUCCAGGGAUGG | 23 | 6290 |
| SCNN1A-2442 | + | CAGCGUGUCCUCCUCCAGGGAUGG | 24 | 6291 |

TABLE 44F-continued

6th Tier

| gRNA Name | DNA Strand | Targeting Domain | Target Site Length | Seq ID |
|---|---|---|---|---|
| SCNN1A-2443 | + | UCACCGCAUCCACCCCUG | 18 | 6292 |
| SCNN1A-2444 | + | CUCACCGCAUCCACCCCUG | 19 | 6293 |
| SCNN1A-2445 | + | CCUCACCGCAUCCACCCCUG | 20 | 6294 |
| SCNN1A-2446 | + | CCCUCACCGCAUCCACCCCUG | 21 | 6295 |
| SCNN1A-2447 | + | UCCCUCACCGCAUCCACCCCUG | 22 | 6296 |
| SCNN1A-2448 | + | CUCCCUCACCGCAUCCACCCCUG | 23 | 6297 |
| SCNN1A-2449 | + | ACUCCCUCACCGCAUCCACCCCUG | 24 | 6298 |
| SCNN1A-2450 | + | CCUGCUGUGUGUACUUUG | 18 | 6299 |
| SCNN1A-2451 | + | ACCUGCUGUGUGUACUUUG | 19 | 6300 |
| SCNN1A-2452 | + | CACCUGCUGUGUGUACUUUG | 20 | 6301 |
| SCNN1A-2453 | + | UCACCUGCUGUGUGUACUUUG | 21 | 6302 |
| SCNN1A-2454 | + | CUCACCUGCUGUGUGUACUUUG | 22 | 6303 |
| SCNN1A-2455 | + | CCUCACCUGCUGUGUGUACUUUG | 23 | 6304 |
| SCNN1A-2456 | + | CCAUUCCUAGGAAAGAAU | 18 | 6305 |
| SCNN1A-2457 | + | CCCAUUCCUAGGAAAGAAU | 19 | 6306 |
| SCNN1A-1244 | + | ACCCAUUCCUAGGAAAGAAU | 20 | 5093 |
| SCNN1A-2458 | + | AGACCCAUUCCUAGGAAAGAAU | 22 | 6307 |
| SCNN1A-2459 | + | AAGACCCAUUCCUAGGAAAGAAU | 23 | 6308 |
| SCNN1A-2460 | + | CCGUGACAGAGGGAGACU | 18 | 6309 |
| SCNN1A-2461 | + | ACCGUGACAGAGGGAGACU | 19 | 6310 |
| SCNN1A-2462 | + | UACCGUGACAGAGGGAGACU | 20 | 6311 |
| SCNN1A-2463 | + | CUACCGUGACAGAGGGAGACU | 21 | 6312 |
| SCNN1A-2464 | + | CCUACCGUGACAGAGGGAGACU | 22 | 6313 |
| SCNN1A-2465 | + | ACCUACCGUGACAGAGGGAGACU | 23 | 6314 |
| SCNN1A-2466 | + | AGUCCUUCCAGUCCACCU | 18 | 6315 |
| SCNN1A-2467 | + | CAGUCCUUCCAGUCCACCU | 19 | 6316 |
| SCNN1A-1262 | + | CCAGUCCUUCCAGUCCACCU | 20 | 5111 |
| SCNN1A-2468 | + | UCCAGUCCUUCCAGUCCACCU | 21 | 6317 |
| SCNN1A-2469 | + | UUCCAGUCCUUCCAGUCCACCU | 22 | 6318 |
| SCNN1A-2470 | + | CUUCCAGUCCUUCCAGUCCACCU | 23 | 6319 |
| SCNN1A-2471 | + | UCUUCCAGUCCUUCCAGUCCACCU | 24 | 6320 |
| SCNN1A-2472 | + | AGCAUCAGGGACAGACCU | 18 | 6321 |
| SCNN1A-2473 | + | CAGCAUCAGGGACAGACCU | 19 | 6322 |
| SCNN1A-2474 | + | CGCAGCAUCAGGGACAGACCU | 21 | 6323 |
| SCNN1A-2475 | + | CGCGCAGCAUCAGGGACAGACCU | 23 | 6324 |
| SCNN1A-2476 | + | UUAUAGUAGCAGUACCCU | 18 | 6325 |
| SCNN1A-2477 | + | CUUAUAGUAGCAGUACCCU | 19 | 6326 |

TABLE 44F-continued

6th Tier

| gRNA Name | DNA Strand | Targeting Domain | Target Site Length | Seq ID |
|---|---|---|---|---|
| SCNN1A-2478 | + | AGCUUAUAGUAGCAGUACCCU | 21 | 6327 |
| SCNN1A-2479 | + | UGGAGCUUAUAGUAGCAGUACCCU | 24 | 6328 |
| SCNN1A-2480 | + | CUGGUAGCUGGUCACGCU | 18 | 6329 |
| SCNN1A-1274 | + | AGCUGGUAGCUGGUCACGCU | 20 | 5123 |
| SCNN1A-2481 | + | AGAGCUGGUAGCUGGUCACGCU | 22 | 6330 |
| SCNN1A-2482 | + | AGAGAGCUGGUAGCUGGUCACGCU | 24 | 6331 |
| SCNN1A-2483 | + | ACAUCGGGUGGUGGAAGU | 18 | 6332 |
| SCNN1A-2484 | + | UACAUCGGGUGGUGGAAGU | 19 | 6333 |
| SCNN1A-2485 | + | AUACAUCGGGUGGUGGAAGU | 20 | 6334 |
| SCNN1A-2486 | + | CAUACAUCGGGUGGUGGAAGU | 21 | 6335 |
| SCNN1A-2487 | + | CCAUACAUCGGGUGGUGGAAGU | 22 | 6336 |
| SCNN1A-2488 | + | UCCAUACAUCGGGUGGUGGAAGU | 23 | 6337 |
| SCNN1A-2489 | + | UUCCAUACAUCGGGUGGUGGAAGU | 24 | 6338 |
| SCNN1A-2490 | + | UGGAAGACAUCCAGAGGU | 18 | 6339 |
| SCNN1A-2491 | + | AUGGAAGACAUCCAGAGGU | 19 | 6340 |
| SCNN1A-1284 | + | CAUGGAAGACAUCCAGAGGU | 20 | 5133 |
| SCNN1A-2492 | + | AGGCAUGGAAGACAUCCAGAGGU | 23 | 6341 |
| SCNN1A-2493 | + | CAGGCAUGGAAGACAUCCAGAGGU | 24 | 6342 |
| SCNN1A-2494 | + | CCAGCUCCUCUUUAAUUU | 18 | 6343 |
| SCNN1A-2495 | + | UCCAGCUCCUCUUUAAUUU | 19 | 6344 |
| SCNN1A-2496 | + | CUCCAGCUCCUCUUUAAUUU | 20 | 6345 |
| SCNN1A-2497 | + | CCUCCAGCUCCUCUUUAAUUU | 21 | 6346 |
| SCNN1A-2498 | + | UCCUCCAGCUCCUCUUUAAUUU | 22 | 6347 |
| SCNN1A-2499 | + | CUCCUCCAGCUCCUCUUUAAUUU | 23 | 6348 |
| SCNN1A-2500 | − | UGCCCCACACCUAAGAAA | 18 | 6349 |
| SCNN1A-2501 | − | CUGCCCCACACCUAAGAAA | 19 | 6350 |
| SCNN1A-884 | − | UCUGCCCCACACCUAAGAAA | 20 | 4733 |
| SCNN1A-2502 | − | CUCUGCCCCACACCUAAGAAA | 21 | 6351 |
| SCNN1A-2503 | − | CCUCUGCCCCACACCUAAGAAA | 22 | 6352 |
| SCNN1A-2504 | − | CCCUCUGCCCCACACCUAAGAAA | 23 | 6353 |
| SCNN1A-2505 | − | ACCCUCUGCCCCACACCUAAGAAA | 24 | 6354 |
| SCNN1A-2506 | − | AGGCAUCUCUCUGUACCCA | 19 | 6355 |
| SCNN1A-2507 | − | CAGGCAUCUCUCUGUACCCA | 20 | 6356 |
| SCNN1A-2508 | − | ACAGGCAUCUCUCUGUACCCA | 21 | 6357 |
| SCNN1A-2509 | − | AACAGGCAUCUCUCUGUACCCA | 22 | 6358 |
| SCNN1A-2510 | − | AGAACAGGCAUCUCUCUGUACCCA | 24 | 6359 |
| SCNN1A-2511 | − | UCCAGGAGAGCAUGAUCA | 18 | 6360 |
| SCNN1A-2512 | − | UUCCAGGAGAGCAUGAUCA | 19 | 6361 |

TABLE 44F-continued

6th Tier

| gRNA Name | DNA Strand | Targeting Domain | Target Site Length | Seq ID |
|---|---|---|---|---|
| SCNN1A-923 | - | CUUCCAGGAGAGCAUGAUCA | 20 | 4772 |
| SCNN1A-2513 | - | UGCUUCCAGGAGAGCAUGAUCA | 22 | 6362 |
| SCNN1A-2514 | - | CUGCUUCCAGGAGAGCAUGAUCA | 23 | 6363 |
| SCNN1A-2515 | - | CCUGCUUCCAGGAGAGCAUGAUCA | 24 | 6364 |
| SCNN1A-2516 | - | CCCCAUUCUUUCCUAGGA | 18 | 6365 |
| SCNN1A-2517 | - | CCCCCAUUCUUUCCUAGGA | 19 | 6366 |
| SCNN1A-2518 | - | ACCCCCAUUCUUUCCUAGGA | 20 | 6367 |
| SCNN1A-2519 | - | CACCCCCAUUCUUUCCUAGGA | 21 | 6368 |
| SCNN1A-2520 | - | ACACCCCCAUUCUUUCCUAGGA | 22 | 6369 |
| SCNN1A-2521 | - | UGACACCCCCAUUCUUUCCUAGGA | 24 | 6370 |
| SCNN1A-2522 | - | CCAGGUAGAGUGUGGGGA | 18 | 6371 |
| SCNN1A-2523 | - | CCCAGGUAGAGUGUGGGGA | 19 | 6372 |
| SCNN1A-957 | - | UCCCAGGUAGAGUGUGGGGA | 20 | 4806 |
| SCNN1A-2524 | - | AUCCCAGGUAGAGUGUGGGGA | 21 | 6373 |
| SCNN1A-2525 | - | CAUCCCAGGUAGAGUGUGGGGA | 22 | 6374 |
| SCNN1A-2526 | - | ACAUCCCAGGUAGAGUGUGGGGA | 23 | 6375 |
| SCNN1A-2527 | - | CAGGGGUGGAUGCGGUGA | 18 | 6376 |
| SCNN1A-2528 | - | UCAGGGGUGGAUGCGGUGA | 19 | 6377 |
| SCNN1A-967 | - | AUCAGGGGUGGAUGCGGUGA | 20 | 4816 |
| SCNN1A-2529 | - | CAUCAGGGGUGGAUGCGGUGA | 21 | 6378 |
| SCNN1A-2530 | - | UCAUCAGGGGUGGAUGCGGUGA | 22 | 6379 |
| SCNN1A-2531 | - | CUCAUCAGGGGUGGAUGCGGUGA | 23 | 6380 |
| SCNN1A-2532 | - | ACUCAUCAGGGGUGGAUGCGGUGA | 24 | 6381 |
| SCNN1A-2533 | - | ACUCUCUCUUUCCUGAUA | 18 | 6382 |
| SCNN1A-2534 | - | UACUCUCUCUUUCCUGAUA | 19 | 6383 |
| SCNN1A-971 | - | CUACUCUCUCUUUCCUGAUA | 20 | 4820 |
| SCNN1A-2535 | - | CCUACUCUCUCUUUCCUGAUA | 21 | 6384 |
| SCNN1A-2536 | - | CCCUACUCUCUCUUUCCUGAUA | 22 | 6385 |
| SCNN1A-2537 | - | ACCCUACUCUCUCUUUCCUGAUA | 23 | 6386 |
| SCNN1A-2538 | - | CGAUUAUGGCGACUGCACC | 19 | 6387 |
| SCNN1A-2539 | - | CUGGAUGUCUUCCAUGCC | 18 | 6388 |
| SCNN1A-2540 | - | UCUGGAUGUCUUCCAUGCC | 19 | 6389 |
| SCNN1A-1033 | - | CUCUGGAUGUCUUCCAUGCC | 20 | 4882 |
| SCNN1A-2541 | - | CCUCUGGAUGUCUUCCAUGCC | 21 | 6390 |
| SCNN1A-2542 | - | ACCUCUGGAUGUCUUCCAUGCC | 22 | 6391 |
| SCNN1A-2543 | - | AACCUCUGGAUGUCUUCCAUGCC | 23 | 6392 |
| SCNN1A-2544 | - | CAACCUCUGGAUGUCUUCCAUGCC | 24 | 6393 |

TABLE 44F-continued

6th Tier

| gRNA Name | DNA Strand | Targeting Domain | Target Site Length | Seq ID |
|---|---|---|---|---|
| SCNN1A-2545 | - | AGGUUAGUGUCCCCUUCC | 18 | 6394 |
| SCNN1A-2546 | - | CAGGUUAGUGUCCCCUUCC | 19 | 6395 |
| SCNN1A-2547 | - | UGCAGGUUAGUGUCCCCUUCC | 21 | 6396 |
| SCNN1A-2548 | - | AUGCAGGUUAGUGUCCCCUUCC | 22 | 6397 |
| SCNN1A-2549 | - | CAUGCAGGUUAGUGUCCCCUUCC | 23 | 6398 |
| SCNN1A-2550 | - | CCAUGCAGGUUAGUGUCCCCUUCC | 24 | 6399 |
| SCNN1A-2551 | - | UACAGAAAGCACAGUUCC | 18 | 6400 |
| SCNN1A-2552 | - | CUACAGAAAGCACAGUUCC | 19 | 6401 |
| SCNN1A-1047 | - | ACUACAGAAAGCACAGUUCC | 20 | 4896 |
| SCNN1A-2553 | - | UGACUACAGAAAGCACAGUUCC | 22 | 6402 |
| SCNN1A-2554 | - | UGUGACUACAGAAAGCACAGUUCC | 24 | 6403 |
| SCNN1A-2555 | - | CAUCAGCAUGAGGAAGGC | 18 | 6404 |
| SCNN1A-2556 | - | CCAUCAGCAUGAGGAAGGC | 19 | 6405 |
| SCNN1A-2557 | - | UCCAUCAGCAUGAGGAAGGC | 20 | 6406 |
| SCNN1A-2558 | - | CUCCAUCAGCAUGAGGAAGGC | 21 | 6407 |
| SCNN1A-2559 | - | CCUCCAUCAGCAUGAGGAAGGC | 22 | 6408 |
| SCNN1A-2560 | - | ACCUCCAUCAGCAUGAGGAAGGC | 23 | 6409 |
| SCNN1A-2561 | - | AGGUCUCCUGCAACCAGGC | 19 | 6410 |
| SCNN1A-2562 | - | CAGGUCUCCUGCAACCAGGC | 20 | 6411 |
| SCNN1A-2563 | - | CCAGGUCUCCUGCAACCAGGC | 21 | 6412 |
| SCNN1A-2564 | - | ACCAGGUCUCCUGCAACCAGGC | 22 | 6413 |
| SCNN1A-2565 | - | AACCAGGUCUCCUGCAACCAGGC | 23 | 6414 |
| SCNN1A-2566 | - | CAACCAGGUCUCCUGCAACCAGGC | 24 | 6415 |
| SCNN1A-2567 | - | UCUCCAGGCCGAGGGGGC | 18 | 6416 |
| SCNN1A-2568 | - | UGGUCUCCAGGCCGAGGGGGC | 21 | 6417 |
| SCNN1A-2569 | - | CUGGUCUCCAGGCCGAGGGGGC | 22 | 6418 |
| SCNN1A-2570 | - | ACUGGUCUCCAGGCCGAGGGGGC | 23 | 6419 |
| SCNN1A-2571 | - | UACUGGUCUCCAGGCCGAGGGGGC | 24 | 6420 |
| SCNN1A-2572 | - | UGUCCACAGUGACUGGGGC | 19 | 6421 |
| SCNN1A-2573 | - | CUGUCCACAGUGACUGGGGC | 20 | 6422 |
| SCNN1A-2574 | - | UGCUGUCCACAGUGACUGGGGC | 22 | 6423 |
| SCNN1A-2575 | - | CUGCUGUCCACAGUGACUGGGGC | 23 | 6424 |
| SCNN1A-2576 | - | CCUGCUGUCCACAGUGACUGGGGC | 24 | 6425 |
| SCNN1A-2577 | - | UGUCACGGUAGGUCGUGC | 18 | 6426 |
| SCNN1A-2578 | - | CUGUCACGGUAGGUCGUGC | 19 | 6427 |
| SCNN1A-2579 | - | UCUGUCACGGUAGGUCGUGC | 20 | 6428 |
| SCNN1A-2580 | - | CUCUGUCACGGUAGGUCGUGC | 21 | 6429 |
| SCNN1A-2581 | - | CCUCUGUCACGGUAGGUCGUGC | 22 | 6430 |

TABLE 44F-continued

6th Tier

| gRNA Name | DNA Strand | Targeting Domain | Target Site Length | Seq ID |
|---|---|---|---|---|
| SCNN1A-2582 | - | CCCUCUGUCACGGUAGGUCGUGC | 23 | 6431 |
| SCNN1A-2583 | - | UCCCUCUGUCACGGUAGGUCGUGC | 24 | 6432 |
| SCNN1A-2584 | - | CUACCAGACAUACUCAUC | 18 | 6433 |
| SCNN1A-2585 | - | UCUACCAGACAUACUCAUC | 19 | 6434 |
| SCNN1A-1091 | - | UUCUACCAGACAUACUCAUC | 20 | 4940 |
| SCNN1A-2586 | - | CUUCUACCAGACAUACUCAUC | 21 | 6435 |
| SCNN1A-2587 | - | UGCUUCUACCAGACAUACUCAUC | 23 | 6436 |
| SCNN1A-2588 | - | CUGCUUCUACCAGACAUACUCAUC | 24 | 6437 |
| SCNN1A-2589 | - | CUGAUGCUGCGCGCAGAG | 18 | 6438 |
| SCNN1A-2590 | - | CCUGAUGCUGCGCGCAGAG | 19 | 6439 |
| SCNN1A-2591 | - | CCCUGAUGCUGCGCGCAGAG | 20 | 6440 |
| SCNN1A-2592 | - | UCCCUGAUGCUGCGCGCAGAG | 21 | 6441 |
| SCNN1A-2593 | - | UGUCCCUGAUGCUGCGCGCAGAG | 23 | 6442 |
| SCNN1A-2594 | - | CUGUCCCUGAUGCUGCGCGCAGAG | 24 | 6443 |
| SCNN1A-2595 | - | AUCCGCGGCCCCAGAACG | 18 | 6444 |
| SCNN1A-2596 | - | UAUCCGCGGCCCCAGAACG | 19 | 6445 |
| SCNN1A-1144 | - | CUAUCCGCGGCCCCAGAACG | 20 | 4993 |
| SCNN1A-2597 | - | UCUAUCCGCGGCCCCAGAACG | 21 | 6446 |
| SCNN1A-2598 | - | UUCUAUCCGCGGCCCCAGAACG | 22 | 6447 |
| SCNN1A-2599 | - | CUUCUAUCCGCGGCCCCAGAACG | 23 | 6448 |
| SCNN1A-2600 | - | UCUUCUAUCCGCGGCCCCAGAACG | 24 | 6449 |
| SCNN1A-2601 | - | CCUCGGUGACAUCCCAGG | 18 | 6450 |
| SCNN1A-2602 | - | CCCUCGGUGACAUCCCAGG | 19 | 6451 |
| SCNN1A-2603 | - | UGGCCCUCGGUGACAUCCCAGG | 22 | 6452 |
| SCNN1A-2604 | - | AUGGCCCUCGGUGACAUCCCAGG | 23 | 6453 |
| SCNN1A-2605 | - | AGGUAGAGUGUGGGGAAGGG | 20 | 6454 |
| SCNN1A-2606 | - | CAGGUAGAGUGUGGGGAAGGG | 21 | 6455 |
| SCNN1A-2607 | - | CCAGGUAGAGUGUGGGGAAGGG | 22 | 6456 |
| SCNN1A-2608 | - | CCCAGGUAGAGUGUGGGGAAGGG | 23 | 6457 |
| SCNN1A-2609 | - | UCCCAGGUAGAGUGUGGGGAAGGG | 24 | 6458 |
| SCNN1A-2610 | - | CAGACAUACUCAUCAGGG | 18 | 6459 |
| SCNN1A-2611 | - | CCAGACAUACUCAUCAGGG | 19 | 6460 |
| SCNN1A-2612 | - | ACCAGACAUACUCAUCAGGG | 20 | 6461 |
| SCNN1A-2613 | - | UACCAGACAUACUCAUCAGGG | 21 | 6462 |
| SCNN1A-2614 | - | CUACCAGACAUACUCAUCAGGG | 22 | 6463 |
| SCNN1A-2615 | - | UCUACCAGACAUACUCAUCAGGG | 23 | 6464 |
| SCNN1A-2616 | - | UUCUACCAGACAUACUCAUCAGGG | 24 | 6465 |

TABLE 44F-continued

6th Tier

| gRNA Name | DNA Strand | Targeting Domain | Target Site Length | Seq ID |
|---|---|---|---|---|
| SCNN1A-2617 | − | CGGGUAAUGGUGCACGGG | 18 | 6466 |
| SCNN1A-2618 | − | CCGGGUAAUGGUGCACGGG | 19 | 6467 |
| SCNN1A-2619 | − | CCCGGGUAAUGGUGCACGGG | 20 | 6468 |
| SCNN1A-2620 | − | UGUGGGGAAGGGAUGGGUG | 19 | 6469 |
| SCNN1A-2621 | − | AGUGUGGGGAAGGGAUGGGUG | 21 | 6470 |
| SCNN1A-2622 | − | AGAGUGUGGGGAAGGGAUGGGUG | 23 | 6471 |
| SCNN1A-2623 | − | UAGAGUGUGGGGAAGGGAUGGGUG | 24 | 6472 |
| SCNN1A-2624 | − | CAAGAACAACUCCAACCU | 18 | 6473 |
| SCNN1A-2625 | − | ACAAGAACAACUCCAACCU | 19 | 6474 |
| SCNN1A-2626 | − | UGACAAGAACAACUCCAACCU | 21 | 6475 |
| SCNN1A-2627 | − | AUGACAAGAACAACUCCAACCU | 22 | 6476 |
| SCNN1A-2628 | − | AAUGACAAGAACAACUCCAACCU | 23 | 6477 |
| SCNN1A-2629 | − | CAAUGACAAGAACAACUCCAACCU | 24 | 6478 |
| SCNN1A-2630 | − | CGCACCCCUUGCAGCGCCU | 19 | 6479 |
| SCNN1A-2631 | − | CCGCACCCCUUGCAGCGCCU | 20 | 6480 |
| SCNN1A-2632 | − | UGCCGCACCCCUUGCAGCGCCU | 22 | 6481 |
| SCNN1A-2633 | − | CUGCCGCACCCCUUGCAGCGCCU | 23 | 6482 |
| SCNN1A-2634 | − | UCUGCCGCACCCCUUGCAGCGCCU | 24 | 6483 |
| SCNN1A-2635 | − | ACACCCCCAUUCUUUCCU | 18 | 6484 |
| SCNN1A-1272 | − | UGACACCCCCAUUCUUUCCU | 20 | 5121 |
| SCNN1A-2636 | − | AUGACACCCCCAUUCUUUCCU | 21 | 6485 |
| SCNN1A-2637 | − | UGAUGACACCCCCAUUCUUUCCU | 23 | 6486 |
| SCNN1A-2638 | − | UUGAUGACACCCCCAUUCUUUCCU | 24 | 6487 |
| SCNN1A-2639 | − | UGAACUACAAAACCAAUU | 18 | 6488 |
| SCNN1A-2640 | − | CUGAACUACAAAACCAAUU | 19 | 6489 |
| SCNN1A-2641 | − | AGCUGAACUACAAAACCAAUU | 21 | 6490 |
| SCNN1A-2642 | − | AGGAGCUGAACUACAAAACCAAUU | 24 | 6491 |
| SCNN1A-2643 | − | CAGGAUGAACCUGCCUUU | 18 | 6492 |
| SCNN1A-2644 | − | CGGGCAGGAUGAACCUGCCUUU | 22 | 6493 |
| SCNN1A-2645 | − | ACGGGCAGGAUGAACCUGCCUUU | 23 | 6494 |
| SCNN1A-2646 | − | CACGGGCAGGAUGAACCUGCCUUU | 24 | 6495 |

Table 44G provides exemplary targeting domains for knocking out the SCNN1A gene selected according to the seven tier parameters. The targeting domains fall in the coding sequence of the gene, downstream of the first 500 bp of coding sequence (e.g., anywhere from +500 (relative to the start codon) to the stop codon of the gene) and PAM is NNGRRV. It is contemplated herein that in an embodiment the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 44G

7th Tier

| gRNA Name | DNA Strand | Targeting Domain | Target Site Length | Seq ID |
|---|---|---|---|---|
| SCNN1A-2647 | + | UAAUUCCUUAUCAGGAAA | 18 | 6496 |
| SCNN1A-2648 | + | GUAAUUCCUUAUCAGGAAA | 19 | 6497 |
| SCNN1A-2649 | + | AGUAAUUCCUUAUCAGGAAA | 20 | 6498 |
| SCNN1A-2650 | + | GAGUAAUUCCUUAUCAGGAAA | 21 | 6499 |
| SCNN1A-2651 | + | AGAGUAAUUCCUUAUCAGGAAA | 22 | 6500 |
| SCNN1A-2652 | + | GAGAGUAAUUCCUUAUCAGGAAA | 23 | 6501 |
| SCNN1A-2653 | + | UGAGAGUAAUUCCUUAUCAGGAAA | 24 | 6502 |
| SCNN1A-2654 | + | AAGGGUAAAGGUUCUCAA | 18 | 6503 |
| SCNN1A-2655 | + | GAAGGGUAAAGGUUCUCAA | 19 | 6504 |
| SCNN1A-2656 | + | UGAAGGGUAAAGGUUCUCAA | 20 | 6505 |
| SCNN1A-2657 | + | UUGAAGGGUAAAGGUUCUCAA | 21 | 6506 |
| SCNN1A-2658 | + | UUUGAAGGGUAAAGGUUCUCAA | 22 | 6507 |
| SCNN1A-2659 | + | CUUUGAAGGGUAAAGGUUCUCAA | 23 | 6508 |
| SCNN1A-2660 | + | ACUUUGAAGGGUAAAGGUUCUCAA | 24 | 6509 |
| SCNN1A-2661 | + | CCCAUUCCUAGGAAAGAA | 18 | 6510 |
| SCNN1A-2662 | + | ACCCAUUCCUAGGAAAGAA | 19 | 6511 |
| SCNN1A-887 | + | GACCCAUUCCUAGGAAAGAA | 20 | 4736 |
| SCNN1A-2663 | + | AGACCCAUUCCUAGGAAAGAA | 21 | 6512 |
| SCNN1A-2664 | + | AAGACCCAUUCCUAGGAAAGAA | 22 | 6513 |
| SCNN1A-2665 | + | GAAGACCCAUUCCUAGGAAAGAA | 23 | 6514 |
| SCNN1A-2666 | + | GGAAGACCCAUUCCUAGGAAAGAA | 24 | 6515 |
| SCNN1A-2667 | + | CAUGGGGUGGGGCAGAA | 18 | 6516 |
| SCNN1A-2668 | + | ACAUGGGGUGGGGCAGAA | 19 | 6517 |
| SCNN1A-2669 | + | GACAUGGGGUGGGGCAGAA | 20 | 6518 |
| SCNN1A-2670 | + | AGACAUGGGGUGGGGCAGAA | 21 | 6519 |
| SCNN1A-2671 | + | GAGACAUGGGGUGGGGCAGAA | 22 | 6520 |
| SCNN1A-2672 | + | AGAGACAUGGGGUGGGGCAGAA | 23 | 6521 |
| SCNN1A-2673 | + | CAGAGACAUGGGGUGGGGCAGAA | 24 | 6522 |
| SCNN1A-2674 | + | GUGAAUACACACCUGGAA | 18 | 6523 |
| SCNN1A-2675 | + | AGUGAAUACACACCUGGAA | 19 | 6524 |
| SCNN1A-892 | + | GAGUGAAUACACACCUGGAA | 20 | 4741 |
| SCNN1A-2676 | + | GGAGUGAAUACACACCUGGAA | 21 | 6525 |
| SCNN1A-2677 | + | AGGAGUGAAUACACACCUGGAA | 22 | 6526 |
| SCNN1A-2678 | + | CAGGAGUGAAUACACACCUGGAA | 23 | 6527 |
| SCNN1A-2679 | + | GCAGGAGUGAAUACACACCUGGAA | 24 | 6528 |
| SCNN1A-2680 | + | AUACAUCGGGUGGUGGAA | 18 | 6529 |
| SCNN1A-2681 | + | CAUACAUCGGGUGGUGGAA | 19 | 6530 |
| SCNN1A-2682 | + | CCAUACAUCGGGUGGUGGAA | 20 | 6531 |

TABLE 44G-continued

7th Tier

| gRNA Name | DNA Strand | Targeting Domain | Target Site Length | Seq ID |
|---|---|---|---|---|
| SCNN1A-2683 | + | UCCAUACAUCGGGUGGUGGAA | 21 | 6532 |
| SCNN1A-2684 | + | UUCCAUACAUCGGGUGGUGGAA | 22 | 6533 |
| SCNN1A-2685 | + | UUUCCAUACAUCGGGUGGUGGAA | 23 | 6534 |
| SCNN1A-2686 | + | GUUUCCAUACAUCGGGUGGUGGAA | 24 | 6535 |
| SCNN1A-2687 | + | UCUCCACCACAGACAACA | 18 | 6536 |
| SCNN1A-2688 | + | AUCUCCACCACAGACAACA | 19 | 6537 |
| SCNN1A-2689 | + | CAUCUCCACCACAGACAACA | 20 | 6538 |
| SCNN1A-2690 | + | CCAUCUCCACCACAGACAACA | 21 | 6539 |
| SCNN1A-2691 | + | GCCAUCUCCACCACAGACAACA | 22 | 6540 |
| SCNN1A-2692 | + | AGCCAUCUCCACCACAGACAACA | 23 | 6541 |
| SCNN1A-2693 | + | CAGCCAUCUCCACCACAGACAACA | 24 | 6542 |
| SCNN1A-2694 | + | UUCUGGUUGCACUGGACA | 18 | 6543 |
| SCNN1A-2695 | + | GUUCUGGUUGCACUGGACA | 19 | 6544 |
| SCNN1A-2696 | + | UGUUCUGGUUGCACUGGACA | 20 | 6545 |
| SCNN1A-2697 | + | UUGUUCUGGUUGCACUGGACA | 21 | 6546 |
| SCNN1A-2698 | + | UUUGUUCUGGUUGCACUGGACA | 22 | 6547 |
| SCNN1A-2699 | + | AUUUGUUCUGGUUGCACUGGACA | 23 | 6548 |
| SCNN1A-2700 | + | GAUUUGUUCUGGUUGCACUGGACA | 24 | 6549 |
| SCNN1A-2701 | + | GCACGACCUACCGUGACA | 18 | 6550 |
| SCNN1A-2702 | + | GGCACGACCUACCGUGACA | 19 | 6551 |
| SCNN1A-2703 | + | AGGCACGACCUACCGUGACA | 20 | 6552 |
| SCNN1A-2704 | + | CAGGCACGACCUACCGUGACA | 21 | 6553 |
| SCNN1A-2705 | + | CCAGGCACGACCUACCGUGACA | 22 | 6554 |
| SCNN1A-2706 | + | UCCAGGCACGACCUACCGUGACA | 23 | 6555 |
| SCNN1A-2707 | + | AUCCAGGCACGACCUACCGUGACA | 24 | 6556 |
| SCNN1A-2708 | + | CAGUACCCUGUGGGUACA | 18 | 6557 |
| SCNN1A-2709 | + | GCAGUACCCUGUGGGUACA | 19 | 6558 |
| SCNN1A-2710 | + | AGCAGUACCCUGUGGGUACA | 20 | 6559 |
| SCNN1A-2711 | + | UAGCAGUACCCUGUGGGUACA | 21 | 6560 |
| SCNN1A-2712 | + | GUAGCAGUACCCUGUGGGUACA | 22 | 6561 |
| SCNN1A-2713 | + | AGUAGCAGUACCCUGUGGGUACA | 23 | 6562 |
| SCNN1A-2714 | + | UAGUAGCAGUACCCUGUGGGUACA | 24 | 6563 |
| SCNN1A-2715 | + | CCUCUCAGGGCCCCCCA | 18 | 6564 |
| SCNN1A-2716 | + | CCCUCUCAGGGCCCCCCA | 19 | 6565 |
| SCNN1A-2717 | + | UCCCUCUCAGGGCCCCCCA | 20 | 6566 |
| SCNN1A-2718 | + | UUCCCUCUCAGGGCCCCCCA | 21 | 6567 |
| SCNN1A-2719 | + | CUUCCCUCUCAGGGCCCCCCA | 22 | 6568 |

TABLE 44G-continued

7th Tier

| gRNA Name | DNA Strand | Targeting Domain | Target Site Length | Seq ID |
|---|---|---|---|---|
| SCNN1A-2720 | + | CCUUCCCUCUCAGGGCCCCCCA | 23 | 6569 |
| SCNN1A-2721 | + | UCCUUCCCUCUCAGGGCCCCCCA | 24 | 6570 |
| SCNN1A-2722 | + | GGCGCCAUGGAGCAAGCA | 18 | 6571 |
| SCNN1A-2723 | + | GGGCGCCAUGGAGCAAGCA | 19 | 6572 |
| SCNN1A-909 | + | AGGGCGCCAUGGAGCAAGCA | 20 | 4758 |
| SCNN1A-2724 | + | GAGGGCGCCAUGGAGCAAGCA | 21 | 6573 |
| SCNN1A-2725 | + | AGAGGGCGCCAUGGAGCAAGCA | 22 | 6574 |
| SCNN1A-2726 | + | CAGAGGGCGCCAUGGAGCAAGCA | 23 | 6575 |
| SCNN1A-2727 | + | GCAGAGGGCGCCAUGGAGCAAGCA | 24 | 6576 |
| SCNN1A-2728 | + | CAGUCACUGUGGACAGCA | 18 | 6577 |
| SCNN1A-2729 | + | CCAGUCACUGUGGACAGCA | 19 | 6578 |
| SCNN1A-910 | + | CCCAGUCACUGUGGACAGCA | 20 | 4759 |
| SCNN1A-2730 | + | CCCCAGUCACUGUGGACAGCA | 21 | 6579 |
| SCNN1A-2731 | + | GCCCCAGUCACUGUGGACAGCA | 22 | 6580 |
| SCNN1A-2732 | + | GGCCCCAGUCACUGUGGACAGCA | 23 | 6581 |
| SCNN1A-2733 | + | GGGCCCCAGUCACUGUGGACAGCA | 24 | 6582 |
| SCNN1A-2734 | + | CAUCGUGAGUAACCAGCA | 18 | 6583 |
| SCNN1A-2735 | + | CCAUCGUGAGUAACCAGCA | 19 | 6584 |
| SCNN1A-2736 | + | GCCAUCGUGAGUAACCAGCA | 20 | 6585 |
| SCNN1A-2737 | + | GGCCAUCGUGAGUAACCAGCA | 21 | 6586 |
| SCNN1A-2738 | + | GGGCCAUCGUGAGUAACCAGCA | 22 | 6587 |
| SCNN1A-2739 | + | AGGGCCAUCGUGAGUAACCAGCA | 23 | 6588 |
| SCNN1A-2740 | + | GAGGGCCAUCGUGAGUAACCAGCA | 24 | 6589 |
| SCNN1A-2741 | + | CGUUGUUGAUUCCAGGCA | 18 | 6590 |
| SCNN1A-2742 | + | CCGUUGUUGAUUCCAGGCA | 19 | 6591 |
| SCNN1A-913 | + | ACCGUUGUUGAUUCCAGGCA | 20 | 4762 |
| SCNN1A-2743 | + | CACCGUUGUUGAUUCCAGGCA | 21 | 6592 |
| SCNN1A-2744 | + | UCACCGUUGUUGAUUCCAGGCA | 22 | 6593 |
| SCNN1A-2745 | + | CUCACCGUUGUUGAUUCCAGGCA | 23 | 6594 |
| SCNN1A-2746 | + | UCUCACCGUUGUUGAUUCCAGGCA | 24 | 6595 |
| SCNN1A-2747 | + | CCCAGGGUGGCAUAGGCA | 18 | 6596 |
| SCNN1A-2748 | + | GCCCAGGGUGGCAUAGGCA | 19 | 6597 |
| SCNN1A-914 | + | GGCCCAGGGUGGCAUAGGCA | 20 | 4763 |
| SCNN1A-2749 | + | GGGCCCAGGGUGGCAUAGGCA | 21 | 6598 |
| SCNN1A-2750 | + | GGGGCCCAGGGUGGCAUAGGCA | 22 | 6599 |
| SCNN1A-2751 | + | GGGGGCCCAGGGUGGCAUAGGCA | 23 | 6600 |
| SCNN1A-2752 | + | CGGGGGCCCAGGGUGGCAUAGGCA | 24 | 6601 |
| SCNN1A-2753 | + | GACAGACCUAGGGGUGCA | 18 | 6602 |

TABLE 44G-continued

7th Tier

| gRNA Name | DNA Strand | Targeting Domain | Target Site Length | Seq ID |
|---|---|---|---|---|
| SCNN1A-2754 | + | GGACAGACCUAGGGGUGCA | 19 | 6603 |
| SCNN1A-2755 | + | GGGACAGACCUAGGGGUGCA | 20 | 6604 |
| SCNN1A-2756 | + | AGGGACAGACCUAGGGGUGCA | 21 | 6605 |
| SCNN1A-2757 | + | CAGGGACAGACCUAGGGGUGCA | 22 | 6606 |
| SCNN1A-2758 | + | UCAGGGACAGACCUAGGGGUGCA | 23 | 6607 |
| SCNN1A-2759 | + | AUCAGGGACAGACCUAGGGGUGCA | 24 | 6608 |
| SCNN1A-2760 | + | CGAUUUGUUCUGGUUGCA | 18 | 6609 |
| SCNN1A-2761 | + | CCGAUUUGUUCUGGUUGCA | 19 | 6610 |
| SCNN1A-2762 | + | UCCGAUUUGUUCUGGUUGCA | 20 | 6611 |
| SCNN1A-2763 | + | GUCCGAUUUGUUCUGGUUGCA | 21 | 6612 |
| SCNN1A-2764 | + | AGUCCGAUUUGUUCUGGUUGCA | 22 | 6613 |
| SCNN1A-2765 | + | CAGUCCGAUUUGUUCUGGUUGCA | 23 | 6614 |
| SCNN1A-2766 | + | GCAGUCCGAUUUGUUCUGGUUGCA | 24 | 6615 |
| SCNN1A-2767 | + | ACACAGAGACUAGAGUCA | 18 | 6616 |
| SCNN1A-2768 | + | GACACAGAGACUAGAGUCA | 19 | 6617 |
| SCNN1A-2769 | + | GGACACAGAGACUAGAGUCA | 20 | 6618 |
| SCNN1A-2770 | + | UGGACACAGAGACUAGAGUCA | 21 | 6619 |
| SCNN1A-2771 | + | CUGGACACAGAGACUAGAGUCA | 22 | 6620 |
| SCNN1A-2772 | + | ACUGGACACAGAGACUAGAGUCA | 23 | 6621 |
| SCNN1A-2773 | + | CACUGGACACAGAGACUAGAGUCA | 24 | 6622 |
| SCNN1A-2774 | + | CUGUAUUUGUACAGGUCA | 18 | 6623 |
| SCNN1A-2775 | + | GCUGUAUUUGUACAGGUCA | 19 | 6624 |
| SCNN1A-2776 | + | AGCUGUAUUUGUACAGGUCA | 20 | 6625 |
| SCNN1A-2777 | + | GAGCUGUAUUUGUACAGGUCA | 21 | 6626 |
| SCNN1A-2778 | + | GGAGCUGUAUUUGUACAGGUCA | 22 | 6627 |
| SCNN1A-2779 | + | AGGAGCUGUAUUUGUACAGGUCA | 23 | 6628 |
| SCNN1A-2780 | + | AAGGAGCUGUAUUUGUACAGGUCA | 24 | 6629 |
| SCNN1A-2781 | + | ACUCUACCUGGGAUGUCA | 18 | 6630 |
| SCNN1A-2782 | + | CACUCUACCUGGGAUGUCA | 19 | 6631 |
| SCNN1A-2783 | + | ACACUCUACCUGGGAUGUCA | 20 | 6632 |
| SCNN1A-2784 | + | CACACUCUACCUGGGAUGUCA | 21 | 6633 |
| SCNN1A-2785 | + | CCACACUCUACCUGGGAUGUCA | 22 | 6634 |
| SCNN1A-2786 | + | CCCACACUCUACCUGGGAUGUCA | 23 | 6635 |
| SCNN1A-2787 | + | CCCCACACUCUACCUGGGAUGUCA | 24 | 6636 |
| SCNN1A-2788 | + | UUGGAGUUGUUCUUGUCA | 18 | 6637 |
| SCNN1A-2789 | + | GUUGGAGUUGUUCUUGUCA | 19 | 6638 |
| SCNN1A-2790 | + | GGUUGGAGUUGUUCUUGUCA | 20 | 6639 |

TABLE 44G-continued

| 7th Tier | | | | |
|---|---|---|---|---|
| gRNA Name | DNA Strand | Targeting Domain | Target Site Length | Seq ID |
| SCNN1A-2791 | + | AGGUUGGAGUUGUUCUUGUCA | 21 | 6640 |
| SCNN1A-2792 | + | GAGGUUGGAGUUGUUCUUGUCA | 22 | 6641 |
| SCNN1A-2793 | + | AGAGGUUGGAGUUGUUCUUGUCA | 23 | 6642 |
| SCNN1A-2794 | + | CAGAGGUUGGAGUUGUUCUUGUCA | 24 | 6643 |
| SCNN1A-2795 | + | ACCCAUUCCUAGGAAAGA | 18 | 6644 |
| SCNN1A-2796 | + | GACCCAUUCCUAGGAAAGA | 19 | 6645 |
| SCNN1A-2797 | + | AGACCCAUUCCUAGGAAAGA | 20 | 6646 |
| SCNN1A-2798 | + | AAGACCCAUUCCUAGGAAAGA | 21 | 6647 |
| SCNN1A-2799 | + | GAAGACCCAUUCCUAGGAAAGA | 22 | 6648 |
| SCNN1A-2800 | + | GGAAGACCCAUUCCUAGGAAAGA | 23 | 6649 |
| SCNN1A-2801 | + | UGGAAGACCCAUUCCUAGGAAAGA | 24 | 6650 |
| SCNN1A-2802 | + | ACGACCUACCGUGACAGA | 18 | 6651 |
| SCNN1A-2803 | + | CACGACCUACCGUGACAGA | 19 | 6652 |
| SCNN1A-931 | + | GCACGACCUACCGUGACAGA | 20 | 4780 |
| SCNN1A-2804 | + | GGCACGACCUACCGUGACAGA | 21 | 6653 |
| SCNN1A-2805 | + | AGGCACGACCUACCGUGACAGA | 22 | 6654 |
| SCNN1A-2806 | + | CAGGCACGACCUACCGUGACAGA | 23 | 6655 |
| SCNN1A-2807 | + | CCAGGCACGACCUACCGUGACAGA | 24 | 6656 |
| SCNN1A-2808 | + | CAGACCUAGGGGUGCAGA | 18 | 6657 |
| SCNN1A-2809 | + | ACAGACCUAGGGGUGCAGA | 19 | 6658 |
| SCNN1A-2810 | + | GACAGACCUAGGGGUGCAGA | 20 | 6659 |
| SCNN1A-2811 | + | GGACAGACCUAGGGGUGCAGA | 21 | 6660 |
| SCNN1A-2812 | + | GGGACAGACCUAGGGGUGCAGA | 22 | 6661 |
| SCNN1A-2813 | + | AGGGACAGACCUAGGGGUGCAGA | 23 | 6662 |
| SCNN1A-2814 | + | CAGGGACAGACCUAGGGGUGCAGA | 24 | 6663 |
| SCNN1A-2815 | + | ACAGAGACUAGAGUCAGA | 18 | 6664 |
| SCNN1A-2816 | + | CACAGAGACUAGAGUCAGA | 19 | 6665 |
| SCNN1A-933 | + | ACACAGAGACUAGAGUCAGA | 20 | 4782 |
| SCNN1A-2817 | + | GACACAGAGACUAGAGUCAGA | 21 | 6666 |
| SCNN1A-2818 | + | GGACACAGAGACUAGAGUCAGA | 22 | 6667 |
| SCNN1A-2819 | + | UGGACACAGAGACUAGAGUCAGA | 23 | 6668 |
| SCNN1A-2820 | + | CUGGACACAGAGACUAGAGUCAGA | 24 | 6669 |
| SCNN1A-2821 | + | GGCUGUCAAGGCUGGAGA | 18 | 6670 |
| SCNN1A-2822 | + | GGGCUGUCAAGGCUGGAGA | 19 | 6671 |
| SCNN1A-936 | + | GGGGCUGUCAAGGCUGGAGA | 20 | 4785 |
| SCNN1A-2823 | + | AGGGGCUGUCAAGGCUGGAGA | 21 | 6672 |
| SCNN1A-2824 | + | GAGGGGCUGUCAAGGCUGGAGA | 22 | 6673 |
| SCNN1A-2825 | + | GGAGGGGCUGUCAAGGCUGGAGA | 23 | 6674 |

TABLE 44G-continued

7th Tier

| gRNA Name | DNA Strand | Targeting Domain | Target Site Length | Seq ID |
|---|---|---|---|---|
| SCNN1A-2826 | + | GGGAGGGGCUGUCAAGGCUGGAGA | 24 | 6675 |
| SCNN1A-2827 | + | GGGUACCUGAAGGGGCGA | 18 | 6676 |
| SCNN1A-2828 | + | CGGGUACCUGAAGGGGCGA | 19 | 6677 |
| SCNN1A-946 | + | CCGGGUACCUGAAGGGGCGA | 20 | 4795 |
| SCNN1A-2829 | + | UCCGGGUACCUGAAGGGGCGA | 21 | 6678 |
| SCNN1A-2830 | + | UUCCGGGUACCUGAAGGGGCGA | 22 | 6679 |
| SCNN1A-2831 | + | UUUCCGGGUACCUGAAGGGGCGA | 23 | 6680 |
| SCNN1A-2832 | + | AUUUCCGGGUACCUGAAGGGGCGA | 24 | 6681 |
| SCNN1A-2833 | + | GCCUGGCUGGGACAAGGA | 18 | 6682 |
| SCNN1A-2834 | + | GGCCUGGCUGGGACAAGGA | 19 | 6683 |
| SCNN1A-2835 | + | GGGCCUGGCUGGGACAAGGA | 20 | 6684 |
| SCNN1A-2836 | + | AGGGCCUGGCUGGGACAAGGA | 21 | 6685 |
| SCNN1A-2837 | + | CAGGGCCUGGCUGGGACAAGGA | 22 | 6686 |
| SCNN1A-2838 | + | GCAGGGCCUGGCUGGGACAAGGA | 23 | 6687 |
| SCNN1A-2839 | + | AGCAGGGCCUGGCUGGGACAAGGA | 24 | 6688 |
| SCNN1A-2840 | + | GGGCAGAAGUGGGAAGGA | 18 | 6689 |
| SCNN1A-2841 | + | GGGGCAGAAGUGGGAAGGA | 19 | 6690 |
| SCNN1A-948 | + | GGGGGCAGAAGUGGGAAGGA | 20 | 4797 |
| SCNN1A-2842 | + | UGGGGGCAGAAGUGGGAAGGA | 21 | 6691 |
| SCNN1A-2843 | + | GUGGGGGCAGAAGUGGGAAGGA | 22 | 6692 |
| SCNN1A-2844 | + | GGUGGGGGCAGAAGUGGGAAGGA | 23 | 6693 |
| SCNN1A-2845 | + | GGGUGGGGGCAGAAGUGGGAAGGA | 24 | 6694 |
| SCNN1A-2846 | + | AGUAAUUCCUUAUCAGGA | 18 | 6695 |
| SCNN1A-2847 | + | GAGUAAUUCCUUAUCAGGA | 19 | 6696 |
| SCNN1A-2848 | + | AGAGUAAUUCCUUAUCAGGA | 20 | 6697 |
| SCNN1A-2849 | + | GAGAGUAAUUCCUUAUCAGGA | 21 | 6698 |
| SCNN1A-2850 | + | UGAGAGUAAUUCCUUAUCAGGA | 22 | 6699 |
| SCNN1A-2851 | + | GUGAGAGUAAUUCCUUAUCAGGA | 23 | 6700 |
| SCNN1A-2852 | + | AGUGAGAGUAAUUCCUUAUCAGGA | 24 | 6701 |
| SCNN1A-2853 | + | GGAGGAGGUGGAGAGGA | 18 | 6702 |
| SCNN1A-2854 | + | GGGAGGAGGUGGAGAGGA | 19 | 6703 |
| SCNN1A-2855 | + | AGGGAGGAGGGUGGAGAGGA | 20 | 6704 |
| SCNN1A-2856 | + | AAGGGAGGAGGGUGGAGAGGA | 21 | 6705 |
| SCNN1A-2857 | + | GAAGGGAGGAGGGUGGAGAGGA | 22 | 6706 |
| SCNN1A-2858 | + | GGAAGGGAGGAGGGUGGAGAGGA | 23 | 6707 |
| SCNN1A-2859 | + | UGGAAGGGAGGAGGGUGGAGAGGA | 24 | 6708 |
| SCNN1A-2860 | + | ACGUUCUGGGGCCGCGGA | 18 | 6709 |

TABLE 44G-continued

7th Tier

| gRNA Name | DNA Strand | Targeting Domain | Target Site Length | Seq ID |
|---|---|---|---|---|
| SCNN1A-2861 | + | CACGUUCUGGGGCCGCGGA | 19 | 6710 |
| SCNN1A-2862 | + | CCACGUUCUGGGGCCGCGGA | 20 | 6711 |
| SCNN1A-2863 | + | UCCACGUUCUGGGGCCGCGGA | 21 | 6712 |
| SCNN1A-2864 | + | CUCCACGUUCUGGGGCCGCGGA | 22 | 6713 |
| SCNN1A-2865 | + | ACUCCACGUUCUGGGGCCGCGGA | 23 | 6714 |
| SCNN1A-2866 | + | UACUCCACGUUCUGGGGCCGCGGA | 24 | 6715 |
| SCNN1A-2867 | + | ACUGUGGACAGCAGGGGA | 18 | 6716 |
| SCNN1A-2868 | + | CACUGUGGACAGCAGGGGA | 19 | 6717 |
| SCNN1A-2869 | + | UCACUGUGGACAGCAGGGGA | 20 | 6718 |
| SCNN1A-2870 | + | GUCACUGUGGACAGCAGGGGA | 21 | 6719 |
| SCNN1A-2871 | + | AGUCACUGUGGACAGCAGGGGA | 22 | 6720 |
| SCNN1A-2872 | + | CAGUCACUGUGGACAGCAGGGGA | 23 | 6721 |
| SCNN1A-2873 | + | CCAGUCACUGUGGACAGCAGGGGA | 24 | 6722 |
| SCNN1A-2874 | + | AGCUGGUCACGCUGGGGA | 18 | 6723 |
| SCNN1A-2875 | + | UAGCUGGUCACGCUGGGGA | 19 | 6724 |
| SCNN1A-956 | + | GUAGCUGGUCACGCUGGGGA | 20 | 4805 |
| SCNN1A-2876 | + | GGUAGCUGGUCACGCUGGGGA | 21 | 6725 |
| SCNN1A-2877 | + | UGGUAGCUGGUCACGCUGGGGA | 22 | 6726 |
| SCNN1A-2878 | + | CUGGUAGCUGGUCACGCUGGGGA | 23 | 6727 |
| SCNN1A-2879 | + | GCUGGUAGCUGGUCACGCUGGGGA | 24 | 6728 |
| SCNN1A-2880 | + | GUGGGGGCAGAAGUGGGA | 18 | 6729 |
| SCNN1A-2881 | + | GGUGGGGGCAGAAGUGGGA | 19 | 6730 |
| SCNN1A-958 | + | GGGUGGGGGCAGAAGUGGGA | 20 | 4807 |
| SCNN1A-2882 | + | GGGGUGGGGGCAGAAGUGGGA | 21 | 6731 |
| SCNN1A-2883 | + | UGGGGUGGGGGCAGAAGUGGGA | 22 | 6732 |
| SCNN1A-2884 | + | AUGGGGUGGGGGCAGAAGUGGGA | 23 | 6733 |
| SCNN1A-2885 | + | CAUGGGGUGGGGGCAGAAGUGGGA | 24 | 6734 |
| SCNN1A-2886 | + | AGUGAAUACACACCUGGA | 18 | 6735 |
| SCNN1A-2887 | + | GAGUGAAUACACACCUGGA | 19 | 6736 |
| SCNN1A-960 | + | GGAGUGAAUACACACCUGGA | 20 | 4809 |
| SCNN1A-2888 | + | AGGAGUGAAUACACACCUGGA | 21 | 6737 |
| SCNN1A-2889 | + | CAGGAGUGAAUACACACCUGGA | 22 | 6738 |
| SCNN1A-2890 | + | GCAGGAGUGAAUACACACCUGGA | 23 | 6739 |
| SCNN1A-2891 | + | AGCAGGAGUGAAUACACACCUGGA | 24 | 6740 |
| SCNN1A-2892 | + | GGGGCUGUCAAGGCUGGA | 18 | 6741 |
| SCNN1A-2893 | + | AGGGGCUGUCAAGGCUGGA | 19 | 6742 |
| SCNN1A-2894 | + | GAGGGGCUGUCAAGGCUGGA | 20 | 6743 |
| SCNN1A-2895 | + | GGAGGGGCUGUCAAGGCUGGA | 21 | 6744 |

TABLE 44G-continued

7th Tier

| gRNA Name | DNA Strand | Targeting Domain | Target Site Length | Seq ID |
|---|---|---|---|---|
| SCNN1A-2896 | + | GGGAGGGGCUGUCAAGGCUGGA | 22 | 6745 |
| SCNN1A-2897 | + | GGGGAGGGGCUGUCAAGGCUGGA | 23 | 6746 |
| SCNN1A-2898 | + | GGGGGAGGGGCUGUCAAGGCUGGA | 24 | 6747 |
| SCNN1A-2899 | + | GGAAGGGAGGAGGGUGGA | 18 | 6748 |
| SCNN1A-2900 | + | UGGAAGGGAGGAGGGUGGA | 19 | 6749 |
| SCNN1A-2901 | + | CUGGAAGGGAGGAGGGUGGA | 20 | 6750 |
| SCNN1A-2902 | + | CCUGGAAGGGAGGAGGGUGGA | 21 | 6751 |
| SCNN1A-2903 | + | ACCUGGAAGGGAGGAGGGUGGA | 22 | 6752 |
| SCNN1A-2904 | + | CACCUGGAAGGGAGGAGGGUGGA | 23 | 6753 |
| SCNN1A-2905 | + | ACACCUGGAAGGGAGGAGGGUGGA | 24 | 6754 |
| SCNN1A-2906 | + | CUGGCUGCCCAGGUUGGA | 18 | 6755 |
| SCNN1A-2907 | + | ACUGGCUGCCCAGGUUGGA | 19 | 6756 |
| SCNN1A-2908 | + | CACUGGCUGCCCAGGUUGGA | 20 | 6757 |
| SCNN1A-2909 | + | CCACUGGCUGCCCAGGUUGGA | 21 | 6758 |
| SCNN1A-2910 | + | UCCACUGGCUGCCCAGGUUGGA | 22 | 6759 |
| SCNN1A-2911 | + | CUCCACUGGCUGCCCAGGUUGGA | 23 | 6760 |
| SCNN1A-2912 | + | GCUCCACUGGCUGCCCAGGUUGGA | 24 | 6761 |
| SCNN1A-2913 | + | UAAUUUCCGGGUACCUGA | 18 | 6762 |
| SCNN1A-2914 | + | UUAAUUUCCGGGUACCUGA | 19 | 6763 |
| SCNN1A-964 | + | UUUAAUUUCCGGGUACCUGA | 20 | 4813 |
| SCNN1A-2915 | + | CUUUAAUUUCCGGGUACCUGA | 21 | 6764 |
| SCNN1A-2916 | + | UCUUUAAUUUCCGGGUACCUGA | 22 | 6765 |
| SCNN1A-2917 | + | CUCUUUAAUUUCCGGGUACCUGA | 23 | 6766 |
| SCNN1A-2918 | + | CCUCUUUAAUUUCCGGGUACCUGA | 24 | 6767 |
| SCNN1A-2919 | + | UUGCCUUCCUCAUGCUGA | 18 | 6768 |
| SCNN1A-2920 | + | CUUGCCUUCCUCAUGCUGA | 19 | 6769 |
| SCNN1A-966 | + | CCUUGCCUUCCUCAUGCUGA | 20 | 4815 |
| SCNN1A-2921 | + | UCCUUGCCUUCCUCAUGCUGA | 21 | 6770 |
| SCNN1A-2922 | + | AUCCUUGCCUUCCUCAUGCUGA | 22 | 6771 |
| SCNN1A-2923 | + | CAUCCUUGCCUUCCUCAUGCUGA | 23 | 6772 |
| SCNN1A-2924 | + | GCAUCCUUGCCUUCCUCAUGCUGA | 24 | 6773 |
| SCNN1A-2925 | + | AGGCACGACCUACCGUGA | 18 | 6774 |
| SCNN1A-2926 | + | CAGGCACGACCUACCGUGA | 19 | 6775 |
| SCNN1A-2927 | + | CCAGGCACGACCUACCGUGA | 20 | 6776 |
| SCNN1A-2928 | + | UCCAGGCACGACCUACCGUGA | 21 | 6777 |
| SCNN1A-2929 | + | AUCCAGGCACGACCUACCGUGA | 22 | 6778 |
| SCNN1A-2930 | + | CAUCCAGGCACGACCUACCGUGA | 23 | 6779 |

TABLE 44G-continued

7th Tier

| gRNA Name | DNA Strand | Targeting Domain | Target Site Length | Seq ID |
|---|---|---|---|---|
| SCNN1A-2931 | + | CCAUCCAGGCACGACCUACCGUGA | 24 | 6780 |
| SCNN1A-2932 | + | CGGCCACGAGAGUGGUGA | 18 | 6781 |
| SCNN1A-2933 | + | CCGGCCACGAGAGUGGUGA | 19 | 6782 |
| SCNN1A-968 | + | GCCGGCCACGAGAGUGGUGA | 20 | 4817 |
| SCNN1A-2934 | + | AGCCGGCCACGAGAGUGGUGA | 21 | 6783 |
| SCNN1A-2935 | + | GAGCCGGCCACGAGAGUGGUGA | 22 | 6784 |
| SCNN1A-2936 | + | GGAGCCGGCCACGAGAGUGGUGA | 23 | 6785 |
| SCNN1A-2937 | + | GGGAGCCGGCCACGAGAGUGGUGA | 24 | 6786 |
| SCNN1A-2938 | + | GAGGGUGACCAUCUGUGA | 18 | 6787 |
| SCNN1A-2939 | + | GGAGGGUGACCAUCUGUGA | 19 | 6788 |
| SCNN1A-2940 | + | AGGAGGGUGACCAUCUGUGA | 20 | 6789 |
| SCNN1A-2941 | + | CAGGAGGGUGACCAUCUGUGA | 21 | 6790 |
| SCNN1A-2942 | + | ACAGGAGGGUGACCAUCUGUGA | 22 | 6791 |
| SCNN1A-2943 | + | GACAGGAGGGUGACCAUCUGUGA | 23 | 6792 |
| SCNN1A-2944 | + | GGACAGGAGGGUGACCAUCUGUGA | 24 | 6793 |
| SCNN1A-2945 | + | AGCAGUACCCUGUGGGUA | 18 | 6794 |
| SCNN1A-2946 | + | UAGCAGUACCCUGUGGGUA | 19 | 6795 |
| SCNN1A-2947 | + | GUAGCAGUACCCUGUGGGUA | 20 | 6796 |
| SCNN1A-2948 | + | AGUAGCAGUACCCUGUGGGUA | 21 | 6797 |
| SCNN1A-2949 | + | UAGUAGCAGUACCCUGUGGGUA | 22 | 6798 |
| SCNN1A-2950 | + | AUAGUAGCAGUACCCUGUGGGUA | 23 | 6799 |
| SCNN1A-2951 | + | UAUAGUAGCAGUACCCUGUGGGUA | 24 | 6800 |
| SCNN1A-2952 | + | CGACAGGAUGUUGAUGUA | 18 | 6801 |
| SCNN1A-2953 | + | UCGACAGGAUGUUGAUGUA | 19 | 6802 |
| SCNN1A-2954 | + | CUCGACAGGAUGUUGAUGUA | 20 | 6803 |
| SCNN1A-2955 | + | CCUCGACAGGAUGUUGAUGUA | 21 | 6804 |
| SCNN1A-2956 | + | GCCUCGACAGGAUGUUGAUGUA | 22 | 6805 |
| SCNN1A-2957 | + | AGCCUCGACAGGAUGUUGAUGUA | 23 | 6806 |
| SCNN1A-2958 | + | CAGCCUCGACAGGAUGUUGAUGUA | 24 | 6807 |
| SCNN1A-2959 | + | AGGGUAAAGGUUCUCAAC | 18 | 6808 |
| SCNN1A-2960 | + | AAGGGUAAAGGUUCUCAAC | 19 | 6809 |
| SCNN1A-978 | + | GAAGGGUAAAGGUUCUCAAC | 20 | 4827 |
| SCNN1A-2961 | + | UGAAGGGUAAAGGUUCUCAAC | 21 | 6810 |
| SCNN1A-2962 | + | UUGAAGGGUAAAGGUUCUCAAC | 22 | 6811 |
| SCNN1A-2963 | + | UUUGAAGGGUAAAGGUUCUCAAC | 23 | 6812 |
| SCNN1A-2964 | + | CUUUGAAGGGUAAAGGUUCUCAAC | 24 | 6813 |
| SCNN1A-2965 | + | GUCUGAGGAGAAGUCAAC | 18 | 6814 |
| SCNN1A-2966 | + | GGUCUGAGGAGAAGUCAAC | 19 | 6815 |

TABLE 44G-continued

7th Tier

| gRNA Name | DNA Strand | Targeting Domain | Target Site Length | Seq ID |
|---|---|---|---|---|
| SCNN1A-2967 | + | UGGUCUGAGGAGAAGUCAAC | 20 | 6816 |
| SCNN1A-2968 | + | GUGGUCUGAGGAGAAGUCAAC | 21 | 6817 |
| SCNN1A-2969 | + | GGUGGUCUGAGGAGAAGUCAAC | 22 | 6818 |
| SCNN1A-2970 | + | AGGUGGUCUGAGGAGAAGUCAAC | 23 | 6819 |
| SCNN1A-2971 | + | CAGGUGGUCUGAGGAGAAGUCAAC | 24 | 6820 |
| SCNN1A-2972 | + | GCAGGAGUGAAUACACAC | 18 | 6821 |
| SCNN1A-2973 | + | AGCAGGAGUGAAUACACAC | 19 | 6822 |
| SCNN1A-2974 | + | AAGCAGGAGUGAAUACACAC | 20 | 6823 |
| SCNN1A-2975 | + | GAAGCAGGAGUGAAUACACAC | 21 | 6824 |
| SCNN1A-2976 | + | GGAAGCAGGAGUGAAUACACAC | 22 | 6825 |
| SCNN1A-2977 | + | UGGAAGCAGGAGUGAAUACACAC | 23 | 6826 |
| SCNN1A-2978 | + | CUGGAAGCAGGAGUGAAUACACAC | 24 | 6827 |
| SCNN1A-2979 | + | CCAGUCCUUCCAGUCCAC | 18 | 6828 |
| SCNN1A-2980 | + | UCCAGUCCUUCCAGUCCAC | 19 | 6829 |
| SCNN1A-2981 | + | UUCCAGUCCUUCCAGUCCAC | 20 | 6830 |
| SCNN1A-2982 | + | CUUCCAGUCCUUCCAGUCCAC | 21 | 6831 |
| SCNN1A-2983 | + | UCUUCCAGUCCUUCCAGUCCAC | 22 | 6832 |
| SCNN1A-2984 | + | AUCUUCCAGUCCUUCCAGUCCAC | 23 | 6833 |
| SCNN1A-2985 | + | GAUCUUCCAGUCCUUCCAGUCCAC | 24 | 6834 |
| SCNN1A-2986 | + | UGGGACAAGGACAGAGAC | 18 | 6835 |
| SCNN1A-2987 | + | CUGGGACAAGGACAGAGAC | 19 | 6836 |
| SCNN1A-2988 | + | GCUGGGACAAGGACAGAGAC | 20 | 6837 |
| SCNN1A-2989 | + | GGCUGGGACAAGGACAGAGAC | 21 | 6838 |
| SCNN1A-2990 | + | UGGCUGGGACAAGGACAGAGAC | 22 | 6839 |
| SCNN1A-2991 | + | CUGGCUGGGACAAGGACAGAGAC | 23 | 6840 |
| SCNN1A-2992 | + | CCUGGCUGGGACAAGGACAGAGAC | 24 | 6841 |
| SCNN1A-2993 | + | GCAGGGCCUGGCUGGGAC | 18 | 6842 |
| SCNN1A-2994 | + | AGCAGGGCCUGGCUGGGAC | 19 | 6843 |
| SCNN1A-2995 | + | GAGCAGGGCCUGGCUGGGAC | 20 | 6844 |
| SCNN1A-2996 | + | GGAGCAGGGCCUGGCUGGGAC | 21 | 6845 |
| SCNN1A-2997 | + | GGGAGCAGGGCCUGGCUGGGAC | 22 | 6846 |
| SCNN1A-2998 | + | AGGGAGCAGGGCCUGGCUGGGAC | 23 | 6847 |
| SCNN1A-2999 | + | GAGGGAGCAGGGCCUGGCUGGGAC | 24 | 6848 |
| SCNN1A-3000 | + | UGGCUGCCCAGGUUGGAC | 18 | 6849 |
| SCNN1A-3001 | + | CUGGCUGCCCAGGUUGGAC | 19 | 6850 |
| SCNN1A-991 | + | ACUGGCUGCCCAGGUUGGAC | 20 | 4840 |
| SCNN1A-3002 | + | CACUGGCUGCCCAGGUUGGAC | 21 | 6851 |

TABLE 44G-continued

7th Tier

| gRNA Name | DNA Strand | Targeting Domain | Target Site Length | Seq ID |
|---|---|---|---|---|
| SCNN1A-3003 | + | CCACUGGCUGCCCAGGUUGGAC | 22 | 6852 |
| SCNN1A-3004 | + | UCCACUGGCUGCCCAGGUUGGAC | 23 | 6853 |
| SCNN1A-3005 | + | CUCCACUGGCUGCCCAGGUUGGAC | 24 | 6854 |
| SCNN1A-3006 | + | CCCUUCCCCACACUCUAC | 18 | 6855 |
| SCNN1A-3007 | + | UCCCUUCCCCACACUCUAC | 19 | 6856 |
| SCNN1A-3008 | + | AUCCCUUCCCCACACUCUAC | 20 | 6857 |
| SCNN1A-3009 | + | CAUCCCUUCCCCACACUCUAC | 21 | 6858 |
| SCNN1A-3010 | + | CCAUCCCUUCCCCACACUCUAC | 22 | 6859 |
| SCNN1A-3011 | + | CCCAUCCCUUCCCCACACUCUAC | 23 | 6860 |
| SCNN1A-3012 | + | ACCCAUCCCUUCCCCACACUCUAC | 24 | 6861 |
| SCNN1A-3013 | + | UCUUUAAUUUCCGGGUAC | 18 | 6862 |
| SCNN1A-3014 | + | CUCUUUAAUUUCCGGGUAC | 19 | 6863 |
| SCNN1A-3015 | + | CCUCUUUAAUUUCCGGGUAC | 20 | 6864 |
| SCNN1A-3016 | + | UCCUCUUUAAUUUCCGGGUAC | 21 | 6865 |
| SCNN1A-3017 | + | CUCCUCUUUAAUUUCCGGGUAC | 22 | 6866 |
| SCNN1A-3018 | + | GCUCCUCUUUAAUUUCCGGGUAC | 23 | 6867 |
| SCNN1A-3019 | + | AGCUCCUCUUUAAUUUCCGGGUAC | 24 | 6868 |
| SCNN1A-3020 | + | CUGCCCGUGCACCAUUAC | 18 | 6869 |
| SCNN1A-3021 | + | CCUGCCCGUGCACCAUUAC | 19 | 6870 |
| SCNN1A-3022 | + | UCCUGCCCGUGCACCAUUAC | 20 | 6871 |
| SCNN1A-3023 | + | AUCCUGCCCGUGCACCAUUAC | 21 | 6872 |
| SCNN1A-3024 | + | CAUCCUGCCCGUGCACCAUUAC | 22 | 6873 |
| SCNN1A-3025 | + | UCAUCCUGCCCGUGCACCAUUAC | 23 | 6874 |
| SCNN1A-3026 | + | UUCAUCCUGCCCGUGCACCAUUAC | 24 | 6875 |
| SCNN1A-3027 | + | UCUGAGGAGAAGUCAACC | 18 | 6876 |
| SCNN1A-3028 | + | GUCUGAGGAGAAGUCAACC | 19 | 6877 |
| SCNN1A-1000 | + | GGUCUGAGGAGAAGUCAACC | 20 | 4849 |
| SCNN1A-3029 | + | UGGUCUGAGGAGAAGUCAACC | 21 | 6878 |
| SCNN1A-3030 | + | GUGGUCUGAGGAGAAGUCAACC | 22 | 6879 |
| SCNN1A-3031 | + | GGUGGUCUGAGGAGAAGUCAACC | 23 | 6880 |
| SCNN1A-3032 | + | AGGUGGUCUGAGGAGAAGUCAACC | 24 | 6881 |
| SCNN1A-3033 | + | UCCACCACAGACAACACC | 18 | 6882 |
| SCNN1A-3034 | + | CUCCACCACAGACAACACC | 19 | 6883 |
| SCNN1A-3035 | + | UCUCCACCACAGACAACACC | 20 | 6884 |
| SCNN1A-3036 | + | AUCUCCACCACAGACAACACC | 21 | 6885 |
| SCNN1A-3037 | + | CAUCUCCACCACAGACAACACC | 22 | 6886 |
| SCNN1A-3038 | + | CCAUCUCCACCACAGACAACACC | 23 | 6887 |
| SCNN1A-3039 | + | GCCAUCUCCACCACAGACAACACC | 24 | 6888 |

TABLE 44G-continued

7th Tier

| gRNA Name | DNA Strand | Targeting Domain | Target Site Length | Seq ID |
|---|---|---|---|---|
| SCNN1A-3040 | + | CAGGAGUGAAUACACACC | 18 | 6889 |
| SCNN1A-3041 | + | GCAGGAGUGAAUACACACC | 19 | 6890 |
| SCNN1A-1002 | + | AGCAGGAGUGAAUACACACC | 20 | 4851 |
| SCNN1A-3042 | + | AAGCAGGAGUGAAUACACACC | 21 | 6891 |
| SCNN1A-3043 | + | GAAGCAGGAGUGAAUACACACC | 22 | 6892 |
| SCNN1A-3044 | + | GGAAGCAGGAGUGAAUACACACC | 23 | 6893 |
| SCNN1A-3045 | + | UGGAAGCAGGAGUGAAUACACACC | 24 | 6894 |
| SCNN1A-3046 | + | UAUGAACCCACAUACACC | 18 | 6895 |
| SCNN1A-3047 | + | CUAUGAACCCACAUACACC | 19 | 6896 |
| SCNN1A-3048 | + | CCUAUGAACCCACAUACACC | 20 | 6897 |
| SCNN1A-3049 | + | UCCUAUGAACCCACAUACACC | 21 | 6898 |
| SCNN1A-3050 | + | UUCCUAUGAACCCACAUACACC | 22 | 6899 |
| SCNN1A-3051 | + | UUUCCUAUGAACCCACAUACACC | 23 | 6900 |
| SCNN1A-3052 | + | GUUUCCUAUGAACCCACAUACACC | 24 | 6901 |
| SCNN1A-3053 | + | CAGUCCUUCCAGUCCACC | 18 | 6902 |
| SCNN1A-3054 | + | CCAGUCCUUCCAGUCCACC | 19 | 6903 |
| SCNN1A-1004 | + | UCCAGUCCUUCCAGUCCACC | 20 | 4853 |
| SCNN1A-3055 | + | UUCCAGUCCUUCCAGUCCACC | 21 | 6904 |
| SCNN1A-3056 | + | CUUCCAGUCCUUCCAGUCCACC | 22 | 6905 |
| SCNN1A-3057 | + | UCUUCCAGUCCUUCCAGUCCACC | 23 | 6906 |
| SCNN1A-3058 | + | AUCUUCCAGUCCUUCCAGUCCACC | 24 | 6907 |
| SCNN1A-3059 | + | UCUACCUGGGAUGUCACC | 18 | 6908 |
| SCNN1A-3060 | + | CUCUACCUGGGAUGUCACC | 19 | 6909 |
| SCNN1A-3061 | + | ACUCUACCUGGGAUGUCACC | 20 | 6910 |
| SCNN1A-3062 | + | CACUCUACCUGGGAUGUCACC | 21 | 6911 |
| SCNN1A-3063 | + | ACACUCUACCUGGGAUGUCACC | 22 | 6912 |
| SCNN1A-3064 | + | CACACUCUACCUGGGAUGUCACC | 23 | 6913 |
| SCNN1A-3065 | + | CCACACUCUACCUGGGAUGUCACC | 24 | 6914 |
| SCNN1A-3066 | + | CAGCAUCAGGGACAGACC | 18 | 6915 |
| SCNN1A-3067 | + | GCAGCAUCAGGGACAGACC | 19 | 6916 |
| SCNN1A-3068 | + | CGCAGCAUCAGGGACAGACC | 20 | 6917 |
| SCNN1A-3069 | + | GCGCAGCAUCAGGGACAGACC | 21 | 6918 |
| SCNN1A-3070 | + | CGCGCAGCAUCAGGGACAGACC | 22 | 6919 |
| SCNN1A-3071 | + | GCGCGCAGCAUCAGGGACAGACC | 23 | 6920 |
| SCNN1A-3072 | + | UGCGCGCAGCAUCAGGGACAGACC | 24 | 6921 |
| SCNN1A-3073 | + | CUCCCUGGAGUCUCACCC | 18 | 6922 |
| SCNN1A-3074 | + | GCUCCCUGGAGUCUCACCC | 19 | 6923 |

TABLE 44G-continued

7th Tier

| gRNA Name | DNA Strand | Targeting Domain | Target Site Length | Seq ID |
|---|---|---|---|---|
| SCNN1A-3075 | + | GGCUCCCUGGAGUCUCACCC | 20 | 6924 |
| SCNN1A-3076 | + | GGGCUCCCUGGAGUCUCACCC | 21 | 6925 |
| SCNN1A-3077 | + | GGGGCUCCCUGGAGUCUCACCC | 22 | 6926 |
| SCNN1A-3078 | + | GGGGGCUCCCUGGAGUCUCACCC | 23 | 6927 |
| SCNN1A-3079 | + | UGGGGGCUCCCUGGAGUCUCACCC | 24 | 6928 |
| SCNN1A-3080 | + | UCCCUGGAGUCUCACCCC | 18 | 6929 |
| SCNN1A-3081 | + | CUCCCUGGAGUCUCACCCC | 19 | 6930 |
| SCNN1A-1013 | + | GCUCCCUGGAGUCUCACCCC | 20 | 4862 |
| SCNN1A-3082 | + | GGCUCCCUGGAGUCUCACCCC | 21 | 6931 |
| SCNN1A-3083 | + | GGGCUCCCUGGAGUCUCACCCC | 22 | 6932 |
| SCNN1A-3084 | + | GGGGCUCCCUGGAGUCUCACCCC | 23 | 6933 |
| SCNN1A-3085 | + | GGGGGCUCCCUGGAGUCUCACCCC | 24 | 6934 |
| SCNN1A-3086 | + | UCCCUCUCAGGGCCCCC | 18 | 6935 |
| SCNN1A-3087 | + | UUCCCUCUCAGGGCCCCC | 19 | 6936 |
| SCNN1A-3088 | + | CUUCCCUCUCAGGGCCCCC | 20 | 6937 |
| SCNN1A-3089 | + | CCUUCCCUCUCAGGGCCCCC | 21 | 6938 |
| SCNN1A-3090 | + | UCCUUCCCUCUCAGGGCCCCC | 22 | 6939 |
| SCNN1A-3091 | + | CUCCUUCCCUCUCAGGGCCCCC | 23 | 6940 |
| SCNN1A-3092 | + | UCUCCUUCCCUCUCAGGGCCCCC | 24 | 6941 |
| SCNN1A-3093 | + | GGCCCCUGCAGAGCCCCC | 18 | 6942 |
| SCNN1A-3094 | + | UGGCCCCUGCAGAGCCCCC | 19 | 6943 |
| SCNN1A-1015 | + | CUGGCCCCUGCAGAGCCCCC | 20 | 4864 |
| SCNN1A-3095 | + | ACUGGCCCCUGCAGAGCCCCC | 21 | 6944 |
| SCNN1A-3096 | + | AACUGGCCCCUGCAGAGCCCCC | 22 | 6945 |
| SCNN1A-3097 | + | GAACUGGCCCCUGCAGAGCCCCC | 23 | 6946 |
| SCNN1A-3098 | + | GGAACUGGCCCCUGCAGAGCCCCC | 24 | 6947 |
| SCNN1A-3099 | + | UGGCCCCUGCAGAGCCCC | 18 | 6948 |
| SCNN1A-3100 | + | CUGGCCCCUGCAGAGCCCC | 19 | 6949 |
| SCNN1A-3101 | + | ACUGGCCCCUGCAGAGCCCC | 20 | 6950 |
| SCNN1A-3102 | + | AACUGGCCCCUGCAGAGCCCC | 21 | 6951 |
| SCNN1A-3103 | + | GAACUGGCCCCUGCAGAGCCCC | 22 | 6952 |
| SCNN1A-3104 | + | GGAACUGGCCCCUGCAGAGCCCC | 23 | 6953 |
| SCNN1A-3105 | + | AGGAACUGGCCCCUGCAGAGCCCC | 24 | 6954 |
| SCNN1A-3106 | + | ACGGGCUCGACGGGCCCC | 18 | 6955 |
| SCNN1A-3107 | + | UACGGGCUCGACGGGCCCC | 19 | 6956 |
| SCNN1A-3108 | + | CUACGGGCUCGACGGGCCCC | 20 | 6957 |
| SCNN1A-3109 | + | GCUACGGGCUCGACGGGCCCC | 21 | 6958 |
| SCNN1A-3110 | + | CGCUACGGGCUCGACGGGCCCC | 22 | 6959 |

TABLE 44G-continued

7th Tier

| gRNA Name | DNA Strand | Targeting Domain | Target Site Length | Seq ID |
|---|---|---|---|---|
| SCNN1A-3111 | + | ACGCUACGGGCUCGACGGGCCCC | 23 | 6960 |
| SCNN1A-3112 | + | CACGCUACGGGCUCGACGGGCCCC | 24 | 6961 |
| SCNN1A-3113 | + | CGGCUGCGGGAGCCGGCC | 18 | 6962 |
| SCNN1A-3114 | + | ACGGCUGCGGGAGCCGGCC | 19 | 6963 |
| SCNN1A-3115 | + | GACGGCUGCGGGAGCCGGCC | 20 | 6964 |
| SCNN1A-3116 | + | CGACGGCUGCGGGAGCCGGCC | 21 | 6965 |
| SCNN1A-3117 | + | GCGACGGCUGCGGGAGCCGGCC | 22 | 6966 |
| SCNN1A-3118 | + | CGCGACGGCUGCGGGAGCCGGCC | 23 | 6967 |
| SCNN1A-3119 | + | UCGCGACGGCUGCGGGAGCCGGCC | 24 | 6968 |
| SCNN1A-3120 | + | ACCCCUGCCCCCUCGGCC | 18 | 6969 |
| SCNN1A-3121 | + | CACCCCUGCCCCCUCGGCC | 19 | 6970 |
| SCNN1A-1030 | + | GCACCCCUGCCCCCUCGGCC | 20 | 4879 |
| SCNN1A-3122 | + | AGCACCCCUGCCCCCUCGGCC | 21 | 6971 |
| SCNN1A-3123 | + | GAGCACCCCUGCCCCCUCGGCC | 22 | 6972 |
| SCNN1A-3124 | + | UGAGCACCCCUGCCCCCUCGGCC | 23 | 6973 |
| SCNN1A-3125 | + | CUGAGCACCCCUGCCCCCUCGGCC | 24 | 6974 |
| SCNN1A-3126 | + | GUUUUGUAGUUCAGCUCC | 18 | 6975 |
| SCNN1A-3127 | + | GGUUUUGUAGUUCAGCUCC | 19 | 6976 |
| SCNN1A-3128 | + | UGGUUUUGUAGUUCAGCUCC | 20 | 6977 |
| SCNN1A-3129 | + | UUGGUUUUGUAGUUCAGCUCC | 21 | 6978 |
| SCNN1A-3130 | + | AUUGGUUUUGUAGUUCAGCUCC | 22 | 6979 |
| SCNN1A-3131 | + | AAUUGGUUUUGUAGUUCAGCUCC | 23 | 6980 |
| SCNN1A-3132 | + | GAAUUGGUUUUGUAGUUCAGCUCC | 24 | 6981 |
| SCNN1A-3133 | + | UCCUUGAUCAUGCUCUCC | 18 | 6982 |
| SCNN1A-3134 | + | CUCCUUGAUCAUGCUCUCC | 19 | 6983 |
| SCNN1A-1041 | + | ACUCCUUGAUCAUGCUCUCC | 20 | 4890 |
| SCNN1A-3135 | + | CACUCCUUGAUCAUGCUCUCC | 21 | 6984 |
| SCNN1A-3136 | + | ACACUCCUUGAUCAUGCUCUCC | 22 | 6985 |
| SCNN1A-3137 | + | CACACUCCUUGAUCAUGCUCUCC | 23 | 6986 |
| SCNN1A-3138 | + | CCACACUCCUUGAUCAUGCUCUCC | 24 | 6987 |
| SCNN1A-3139 | + | AUCUGGAAGACCCAUUCC | 18 | 6988 |
| SCNN1A-3140 | + | CAUCUGGAAGACCCAUUCC | 19 | 6989 |
| SCNN1A-3141 | + | GCAUCUGGAAGACCCAUUCC | 20 | 6990 |
| SCNN1A-3142 | + | AGCAUCUGGAAGACCCAUUCC | 21 | 6991 |
| SCNN1A-3143 | + | UAGCAUCUGGAAGACCCAUUCC | 22 | 6992 |
| SCNN1A-3144 | + | AUAGCAUCUGGAAGACCCAUUCC | 23 | 6993 |
| SCNN1A-3145 | + | GAUAGCAUCUGGAAGACCCAUUCC | 24 | 6994 |

TABLE 44G-continued

7th Tier

| gRNA Name | DNA Strand | Targeting Domain | Target Site Length | Seq ID |
|---|---|---|---|---|
| SCNN1A-3146 | + | GGGCGCCAUGGAGCAAGC | 18 | 6995 |
| SCNN1A-3147 | + | AGGGCGCCAUGGAGCAAGC | 19 | 6996 |
| SCNN1A-1049 | + | GAGGGCGCCAUGGAGCAAGC | 20 | 4898 |
| SCNN1A-3148 | + | AGAGGGCGCCAUGGAGCAAGC | 21 | 6997 |
| SCNN1A-3149 | + | CAGAGGGCGCCAUGGAGCAAGC | 22 | 6998 |
| SCNN1A-3150 | + | GCAGAGGGCGCCAUGGAGCAAGC | 23 | 6999 |
| SCNN1A-3151 | + | AGCAGAGGGCGCCAUGGAGCAAGC | 24 | 7000 |
| SCNN1A-3152 | + | GGUUGUUGUCCCGCAAGC | 18 | 7001 |
| SCNN1A-3153 | + | GGGUUGUUGUCCCGCAAGC | 19 | 7002 |
| SCNN1A-1050 | + | GGGGUUGUUGUCCCGCAAGC | 20 | 4899 |
| SCNN1A-3154 | + | GGGGGUUGUUGUCCCGCAAGC | 21 | 7003 |
| SCNN1A-3155 | + | UGGGGGUUGUUGUCCCGCAAGC | 22 | 7004 |
| SCNN1A-3156 | + | CUGGGGGUUGUUGUCCCGCAAGC | 23 | 7005 |
| SCNN1A-3157 | + | CCUGGGGGUUGUUGUCCCGCAAGC | 24 | 7006 |
| SCNN1A-3158 | + | CCAGUCACUGUGGACAGC | 18 | 7007 |
| SCNN1A-3159 | + | CCCAGUCACUGUGGACAGC | 19 | 7008 |
| SCNN1A-1053 | + | CCCCAGUCACUGUGGACAGC | 20 | 4902 |
| SCNN1A-3160 | + | GCCCCAGUCACUGUGGACAGC | 21 | 7009 |
| SCNN1A-3161 | + | GGCCCCAGUCACUGUGGACAGC | 22 | 7010 |
| SCNN1A-3162 | + | GGGCCCCAGUCACUGUGGACAGC | 23 | 7011 |
| SCNN1A-3163 | + | CGGGCCCCAGUCACUGUGGACAGC | 24 | 7012 |
| SCNN1A-3164 | + | GCUGCGGGCCUCACCAGC | 18 | 7013 |
| SCNN1A-3165 | + | CGCUGCGGGCCUCACCAGC | 19 | 7014 |
| SCNN1A-1054 | + | GCGCUGCGGGCCUCACCAGC | 20 | 4903 |
| SCNN1A-3166 | + | GGCGCUGCGGGCCUCACCAGC | 21 | 7015 |
| SCNN1A-3167 | + | CGGCGCUGCGGGCCUCACCAGC | 22 | 7016 |
| SCNN1A-3168 | + | UCGGCGCUGCGGGCCUCACCAGC | 23 | 7017 |
| SCNN1A-3169 | + | CUCGGCGCUGCGGGCCUCACCAGC | 24 | 7018 |
| SCNN1A-3170 | + | CGGAACCUUCGGAGCAGC | 18 | 7019 |
| SCNN1A-3171 | + | UCGGAACCUUCGGAGCAGC | 19 | 7020 |
| SCNN1A-3172 | + | UUCGGAACCUUCGGAGCAGC | 20 | 7021 |
| SCNN1A-3173 | + | CUUCGGAACCUUCGGAGCAGC | 21 | 7022 |
| SCNN1A-3174 | + | GCUUCGGAACCUUCGGAGCAGC | 22 | 7023 |
| SCNN1A-3175 | + | GGCUUCGGAACCUUCGGAGCAGC | 23 | 7024 |
| SCNN1A-3176 | + | CGGCUUCGGAACCUUCGGAGCAGC | 24 | 7025 |
| SCNN1A-3177 | + | GCUGGUAGCUGGUCACGC | 18 | 7026 |
| SCNN1A-3178 | + | AGCUGGUAGCUGGUCACGC | 19 | 7027 |
| SCNN1A-1064 | + | GAGCUGGUAGCUGGUCACGC | 20 | 4913 |

TABLE 44G-continued

7th Tier

| gRNA Name | DNA Strand | Targeting Domain | Target Site Length | Seq ID |
|---|---|---|---|---|
| SCNN1A-3179 | + | AGAGCUGGUAGCUGGUCACGC | 21 | 7028 |
| SCNN1A-3180 | + | GAGAGCUGGUAGCUGGUCACGC | 22 | 7029 |
| SCNN1A-3181 | + | AGAGAGCUGGUAGCUGGUCACGC | 23 | 7030 |
| SCNN1A-3182 | + | CAGAGAGCUGGUAGCUGGUCACGC | 24 | 7031 |
| SCNN1A-3183 | + | GGGAGGGGCUGUCAAGGC | 18 | 7032 |
| SCNN1A-3184 | + | GGGGAGGGGCUGUCAAGGC | 19 | 7033 |
| SCNN1A-1067 | + | GGGGGAGGGGCUGUCAAGGC | 20 | 4916 |
| SCNN1A-3185 | + | AGGGGGAGGGGCUGUCAAGGC | 21 | 7034 |
| SCNN1A-3186 | + | CAGGGGGAGGGGCUGUCAAGGC | 22 | 7035 |
| SCNN1A-3187 | + | GCAGGGGGAGGGGCUGUCAAGGC | 23 | 7036 |
| SCNN1A-3188 | + | GGCAGGGGGAGGGGCUGUCAAGGC | 24 | 7037 |
| SCNN1A-3189 | + | CCGUUGUUGAUUCCAGGC | 18 | 7038 |
| SCNN1A-3190 | + | ACCGUUGUUGAUUCCAGGC | 19 | 7039 |
| SCNN1A-3191 | + | CACCGUUGUUGAUUCCAGGC | 20 | 7040 |
| SCNN1A-3192 | + | UCACCGUUGUUGAUUCCAGGC | 21 | 7041 |
| SCNN1A-3193 | + | CUCACCGUUGUUGAUUCCAGGC | 22 | 7042 |
| SCNN1A-3194 | + | UCUCACCGUUGUUGAUUCCAGGC | 23 | 7043 |
| SCNN1A-3195 | + | UUCUCACCGUUGUUGAUUCCAGGC | 24 | 7044 |
| SCNN1A-3196 | + | CGACGGGCCCCGUGAGGC | 18 | 7045 |
| SCNN1A-3197 | + | UCGACGGGCCCCGUGAGGC | 19 | 7046 |
| SCNN1A-1068 | + | CUCGACGGGCCCCGUGAGGC | 20 | 4917 |
| SCNN1A-3198 | + | GCUCGACGGGCCCCGUGAGGC | 21 | 7047 |
| SCNN1A-3199 | + | GGCUCGACGGGCCCCGUGAGGC | 22 | 7048 |
| SCNN1A-3200 | + | GGGCUCGACGGGCCCCGUGAGGC | 23 | 7049 |
| SCNN1A-3201 | + | CGGGCUCGACGGGCCCCGUGAGGC | 24 | 7050 |
| SCNN1A-3202 | + | GCCCAGGGUGGCAUAGGC | 18 | 7051 |
| SCNN1A-3203 | + | GGCCCAGGGUGGCAUAGGC | 19 | 7052 |
| SCNN1A-1069 | + | GGGCCCAGGGUGGCAUAGGC | 20 | 4918 |
| SCNN1A-3204 | + | GGGGCCCAGGGUGGCAUAGGC | 21 | 7053 |
| SCNN1A-3205 | + | GGGGGCCCAGGGUGGCAUAGGC | 22 | 7054 |
| SCNN1A-3206 | + | CGGGGGCCCAGGGUGGCAUAGGC | 23 | 7055 |
| SCNN1A-3207 | + | GCGGGGGCCCAGGGUGGCAUAGGC | 24 | 7056 |
| SCNN1A-3208 | + | CACCCCUGCCCCCUCGGC | 18 | 7057 |
| SCNN1A-3209 | + | GCACCCCUGCCCCCUCGGC | 19 | 7058 |
| SCNN1A-3210 | + | AGCACCCCUGCCCCCUCGGC | 20 | 7059 |
| SCNN1A-3211 | + | GAGCACCCCUGCCCCCUCGGC | 21 | 7060 |
| SCNN1A-3212 | + | UGAGCACCCCUGCCCCCUCGGC | 22 | 7061 |

TABLE 44G-continued

7th Tier

| gRNA Name | DNA Strand | Targeting Domain | Target Site Length | Seq ID |
|---|---|---|---|---|
| SCNN1A-3213 | + | CUGAGCACCCCUGCCCCUCGGC | 23 | 7062 |
| SCNN1A-3214 | + | CCUGAGCACCCCUGCCCCUCGGC | 24 | 7063 |
| SCNN1A-3215 | + | CCGGGUACCUGAAGGGGC | 18 | 7064 |
| SCNN1A-3216 | + | UCCGGGUACCUGAAGGGGC | 19 | 7065 |
| SCNN1A-3217 | + | UUCCGGGUACCUGAAGGGGC | 20 | 7066 |
| SCNN1A-3218 | + | UUUCCGGGUACCUGAAGGGGC | 21 | 7067 |
| SCNN1A-3219 | + | AUUUCCGGGUACCUGAAGGGGC | 22 | 7068 |
| SCNN1A-3220 | + | AAUUUCCGGGUACCUGAAGGGGC | 23 | 7069 |
| SCNN1A-3221 | + | UAAUUUCCGGGUACCUGAAGGGGC | 24 | 7070 |
| SCNN1A-3222 | + | AGCCCCUGGAGAUGGGC | 18 | 7071 |
| SCNN1A-3223 | + | GAGCCCCUGGAGAUGGGC | 19 | 7072 |
| SCNN1A-1075 | + | AGAGCCCCUGGAGAUGGGC | 20 | 4924 |
| SCNN1A-3224 | + | CAGAGCCCCUGGAGAUGGGC | 21 | 7073 |
| SCNN1A-3225 | + | GCAGAGCCCCUGGAGAUGGGC | 22 | 7074 |
| SCNN1A-3226 | + | UGCAGAGCCCCUGGAGAUGGGC | 23 | 7075 |
| SCNN1A-3227 | + | CUGCAGAGCCCCUGGAGAUGGGC | 24 | 7076 |
| SCNN1A-3228 | + | GAGGGAGCAGGGCCUGGC | 18 | 7077 |
| SCNN1A-3229 | + | AGAGGGAGCAGGGCCUGGC | 19 | 7078 |
| SCNN1A-1076 | + | GAGAGGGAGCAGGGCCUGGC | 20 | 4925 |
| SCNN1A-3230 | + | GGAGAGGGAGCAGGGCCUGGC | 21 | 7079 |
| SCNN1A-3231 | + | UGGAGAGGGAGCAGGGCCUGGC | 22 | 7080 |
| SCNN1A-3232 | + | CUGGAGAGGGAGCAGGGCCUGGC | 23 | 7081 |
| SCNN1A-3233 | + | GCUGGAGAGGGAGCAGGGCCUGGC | 24 | 7082 |
| SCNN1A-3234 | + | GGGACCCUCAGGCGCUGC | 18 | 7083 |
| SCNN1A-3235 | + | CGGGACCCUCAGGCGCUGC | 19 | 7084 |
| SCNN1A-3236 | + | GCGGGACCCUCAGGCGCUGC | 20 | 7085 |
| SCNN1A-3237 | + | GGCGGGACCCUCAGGCGCUGC | 21 | 7086 |
| SCNN1A-3238 | + | GGGCGGGACCCUCAGGCGCUGC | 22 | 7087 |
| SCNN1A-3239 | + | GGGGCGGGACCCUCAGGCGCUGC | 23 | 7088 |
| SCNN1A-3240 | + | GGGGGCGGGACCCUCAGGCGCUGC | 24 | 7089 |
| SCNN1A-3241 | + | GCAGGUCGCGACGGCUGC | 18 | 7090 |
| SCNN1A-3242 | + | CGCAGGUCGCGACGGCUGC | 19 | 7091 |
| SCNN1A-1082 | + | CCGCAGGUCGCGACGGCUGC | 20 | 4931 |
| SCNN1A-3243 | + | CCCGCAGGUCGCGACGGCUGC | 21 | 7092 |
| SCNN1A-3244 | + | CCCCGCAGGUCGCGACGGCUGC | 22 | 7093 |
| SCNN1A-3245 | + | CCCCCGCAGGUCGCGACGGCUGC | 23 | 7094 |
| SCNN1A-3246 | + | UCCCCCGCAGGUCGCGACGGCUGC | 24 | 7095 |
| SCNN1A-3247 | + | UGACUCACGCCUGGUUGC | 18 | 7096 |

TABLE 44G-continued

7th Tier

| gRNA Name | DNA Strand | Targeting Domain | Target Site Length | Seq ID |
|---|---|---|---|---|
| SCNN1A-3248 | + | CUGACUCACGCCUGGUUGC | 19 | 7097 |
| SCNN1A-1087 | + | ACUGACUCACGCCUGGUUGC | 20 | 4936 |
| SCNN1A-3249 | + | GACUGACUCACGCCUGGUUGC | 21 | 7098 |
| SCNN1A-3250 | + | GGACUGACUCACGCCUGGUUGC | 22 | 7099 |
| SCNN1A-3251 | + | AGGACUGACUCACGCCUGGUUGC | 23 | 7100 |
| SCNN1A-3252 | + | CAGGACUGACUCACGCCUGGUUGC | 24 | 7101 |
| SCNN1A-3253 | + | CCAGGCAUGGAAGACAUC | 18 | 7102 |
| SCNN1A-3254 | + | UCCAGGCAUGGAAGACAUC | 19 | 7103 |
| SCNN1A-3255 | + | UUCCAGGCAUGGAAGACAUC | 20 | 7104 |
| SCNN1A-3256 | + | AUUCCAGGCAUGGAAGACAUC | 21 | 7105 |
| SCNN1A-3257 | + | GAUUCCAGGCAUGGAAGACAUC | 22 | 7106 |
| SCNN1A-3258 | + | UGAUUCCAGGCAUGGAAGACAUC | 23 | 7107 |
| SCNN1A-3259 | + | UUGAUUCCAGGCAUGGAAGACAUC | 24 | 7108 |
| SCNN1A-3260 | + | UGCUCUGCGCGCAGCAUC | 18 | 7109 |
| SCNN1A-3261 | + | CUGCUCUGCGCGCAGCAUC | 19 | 7110 |
| SCNN1A-1089 | + | UCUGCUCUGCGCGCAGCAUC | 20 | 4938 |
| SCNN1A-3262 | + | UUCUGCUCUGCGCGCAGCAUC | 21 | 7111 |
| SCNN1A-3263 | + | AUUCUGCUCUGCGCGCAGCAUC | 22 | 7112 |
| SCNN1A-3264 | + | CAUUCUGCUCUGCGCGCAGCAUC | 23 | 7113 |
| SCNN1A-3265 | + | UCAUUCUGCUCUGCGCGCAGCAUC | 24 | 7114 |
| SCNN1A-3266 | + | UUCUGUCGCGAUAGCAUC | 18 | 7115 |
| SCNN1A-3267 | + | GUUCUGUCGCGAUAGCAUC | 19 | 7116 |
| SCNN1A-1090 | + | UGUUCUGUCGCGAUAGCAUC | 20 | 4939 |
| SCNN1A-3268 | + | UUGUUCUGUCGCGAUAGCAUC | 21 | 7117 |
| SCNN1A-3269 | + | AUUGUUCUGUCGCGAUAGCAUC | 22 | 7118 |
| SCNN1A-3270 | + | AAUUGUUCUGUCGCGAUAGCAUC | 23 | 7119 |
| SCNN1A-3271 | + | UAAUUGUUCUGUCGCGAUAGCAUC | 24 | 7120 |
| SCNN1A-3272 | + | UGAGAGUAAUUCCUUAUC | 18 | 7121 |
| SCNN1A-3273 | + | GUGAGAGUAAUUCCUUAUC | 19 | 7122 |
| SCNN1A-1092 | + | AGUGAGAGUAAUUCCUUAUC | 20 | 4941 |
| SCNN1A-3274 | + | AAGUGAGAGUAAUUCCUUAUC | 21 | 7123 |
| SCNN1A-3275 | + | GAAGUGAGAGUAAUUCCUUAUC | 22 | 7124 |
| SCNN1A-3276 | + | GGAAGUGAGAGUAAUUCCUUAUC | 23 | 7125 |
| SCNN1A-3277 | + | UGGAAGUGAGAGUAAUUCCUUAUC | 24 | 7126 |
| SCNN1A-3278 | + | CAGGGUGGAGGCUACCUC | 18 | 7127 |
| SCNN1A-3279 | + | CCAGGGUGGAGGCUACCUC | 19 | 7128 |
| SCNN1A-3280 | + | GCCAGGGUGGAGGCUACCUC | 20 | 7129 |

TABLE 44G-continued

7th Tier

| gRNA Name | DNA Strand | Targeting Domain | Target Site Length | Seq ID |
|---|---|---|---|---|
| SCNN1A-3281 | + | UGCCAGGGUGGAGGCUACCUC | 21 | 7130 |
| SCNN1A-3282 | + | AUGCCAGGGUGGAGGCUACCUC | 22 | 7131 |
| SCNN1A-3283 | + | GAUGCCAGGGUGGAGGCUACCUC | 23 | 7132 |
| SCNN1A-3284 | + | GGAUGCCAGGGUGGAGGCUACCUC | 24 | 7133 |
| SCNN1A-3285 | + | GCCCAGCGUGUCCUCCUC | 18 | 7134 |
| SCNN1A-3286 | + | UGCCCAGCGUGUCCUCCUC | 19 | 7135 |
| SCNN1A-3287 | + | UUGCCCAGCGUGUCCUCCUC | 20 | 7136 |
| SCNN1A-3288 | + | GUUGCCCAGCGUGUCCUCCUC | 21 | 7137 |
| SCNN1A-3289 | + | AGUUGCCCAGCGUGUCCUCCUC | 22 | 7138 |
| SCNN1A-3290 | + | AAGUUGCCCAGCGUGUCCUCCUC | 23 | 7139 |
| SCNN1A-3291 | + | GAAGUUGCCCAGCGUGUCCUCCUC | 24 | 7140 |
| SCNN1A-3292 | + | CUCCUUGAUCAUGCUCUC | 18 | 7141 |
| SCNN1A-3293 | + | ACUCCUUGAUCAUGCUCUC | 19 | 7142 |
| SCNN1A-3294 | + | CACUCCUUGAUCAUGCUCUC | 20 | 7143 |
| SCNN1A-3295 | + | ACACUCCUUGAUCAUGCUCUC | 21 | 7144 |
| SCNN1A-3296 | + | CACACUCCUUGAUCAUGCUCUC | 22 | 7145 |
| SCNN1A-3297 | + | CCACACUCCUUGAUCAUGCUCUC | 23 | 7146 |
| SCNN1A-3298 | + | GCCACACUCCUUGAUCAUGCUCUC | 24 | 7147 |
| SCNN1A-3299 | + | UCACAGUACUCCACGUUC | 18 | 7148 |
| SCNN1A-3300 | + | GUCACAGUACUCCACGUUC | 19 | 7149 |
| SCNN1A-1103 | + | AGUCACAGUACUCCACGUUC | 20 | 4952 |
| SCNN1A-3301 | + | UAGUCACAGUACUCCACGUUC | 21 | 7150 |
| SCNN1A-3302 | + | GUAGUCACAGUACUCCACGUUC | 22 | 7151 |
| SCNN1A-3303 | + | UGUAGUCACAGUACUCCACGUUC | 23 | 7152 |
| SCNN1A-3304 | + | CUGUAGUCACAGUACUCCACGUUC | 24 | 7153 |
| SCNN1A-3305 | + | AUGACCAGCAGGUCAAAG | 18 | 7154 |
| SCNN1A-3306 | + | GAUGACCAGCAGGUCAAAG | 19 | 7155 |
| SCNN1A-3307 | + | UGAUGACCAGCAGGUCAAAG | 20 | 7156 |
| SCNN1A-3308 | + | AUGAUGACCAGCAGGUCAAAG | 21 | 7157 |
| SCNN1A-3309 | + | CAUGAUGACCAGCAGGUCAAAG | 22 | 7158 |
| SCNN1A-3310 | + | ACAUGAUGACCAGCAGGUCAAAG | 23 | 7159 |
| SCNN1A-3311 | + | AACAUGAUGACCAGCAGGUCAAAG | 24 | 7160 |
| SCNN1A-3312 | + | AGGGCGCCAUGGAGCAAG | 18 | 7161 |
| SCNN1A-3313 | + | GAGGGCGCCAUGGAGCAAG | 19 | 7162 |
| SCNN1A-3314 | + | AGAGGGCGCCAUGGAGCAAG | 20 | 7163 |
| SCNN1A-3315 | + | CAGAGGGCGCCAUGGAGCAAG | 21 | 7164 |
| SCNN1A-3316 | + | GCAGAGGGCGCCAUGGAGCAAG | 22 | 7165 |
| SCNN1A-3317 | + | AGCAGAGGGCGCCAUGGAGCAAG | 23 | 7166 |

TABLE 44G-continued

7th Tier

| gRNA Name | DNA Strand | Targeting Domain | Target Site Length | Seq ID |
|---|---|---|---|---|
| SCNN1A-3318 | + | AAGCAGAGGGCGCCAUGGAGCAAG | 24 | 7167 |
| SCNN1A-3319 | + | GGGUUGUUGUCCCGCAAG | 18 | 7168 |
| SCNN1A-3320 | + | GGGGUUGUUGUCCCGCAAG | 19 | 7169 |
| SCNN1A-3321 | + | GGGGGUUGUUGUCCCGCAAG | 20 | 7170 |
| SCNN1A-3322 | + | UGGGGGUUGUUGUCCCGCAAG | 21 | 7171 |
| SCNN1A-3323 | + | CUGGGGGUUGUUGUCCCGCAAG | 22 | 7172 |
| SCNN1A-3324 | + | CCUGGGGGUUGUUGUCCCGCAAG | 23 | 7173 |
| SCNN1A-3325 | + | ACCUGGGGGUUGUUGUCCCGCAAG | 24 | 7174 |
| SCNN1A-3326 | + | AUGGGGUGGGGGCAGAAG | 18 | 7175 |
| SCNN1A-3327 | + | CAUGGGGUGGGGGCAGAAG | 19 | 7176 |
| SCNN1A-1109 | + | ACAUGGGGUGGGGGCAGAAG | 20 | 4958 |
| SCNN1A-3328 | + | GACAUGGGGUGGGGGCAGAAG | 21 | 7177 |
| SCNN1A-3329 | + | AGACAUGGGGUGGGGGCAGAAG | 22 | 7178 |
| SCNN1A-3330 | + | GAGACAUGGGGUGGGGGCAGAAG | 23 | 7179 |
| SCNN1A-3331 | + | AGAGACAUGGGGUGGGGGCAGAAG | 24 | 7180 |
| SCNN1A-3332 | + | UUGAAGCGGCAGGCGAAG | 18 | 7181 |
| SCNN1A-3333 | + | GUUGAAGCGGCAGGCGAAG | 19 | 7182 |
| SCNN1A-3334 | + | GGUUGAAGCGGCAGGCGAAG | 20 | 7183 |
| SCNN1A-3335 | + | UGGUUGAAGCGGCAGGCGAAG | 21 | 7184 |
| SCNN1A-3336 | + | CUGGUUGAAGCGGCAGGCGAAG | 22 | 7185 |
| SCNN1A-3337 | + | CCUGGUUGAAGCGGCAGGCGAAG | 23 | 7186 |
| SCNN1A-3338 | + | ACCUGGUUGAAGCGGCAGGCGAAG | 24 | 7187 |
| SCNN1A-3339 | + | GGGGGCAGAAGUGGGAAG | 18 | 7188 |
| SCNN1A-3340 | + | UGGGGGCAGAAGUGGGAAG | 19 | 7189 |
| SCNN1A-3341 | + | GUGGGGGCAGAAGUGGGAAG | 20 | 7190 |
| SCNN1A-3342 | + | GGUGGGGGCAGAAGUGGGAAG | 21 | 7191 |
| SCNN1A-3343 | + | GGGUGGGGGCAGAAGUGGGAAG | 22 | 7192 |
| SCNN1A-3344 | + | GGGGUGGGGGCAGAAGUGGGAAG | 23 | 7193 |
| SCNN1A-3345 | + | UGGGGUGGGGGCAGAAGUGGGAAG | 24 | 7194 |
| SCNN1A-3346 | + | AUCAUGCUCUCCUGGAAG | 18 | 7195 |
| SCNN1A-3347 | + | GAUCAUGCUCUCCUGGAAG | 19 | 7196 |
| SCNN1A-3348 | + | UGAUCAUGCUCUCCUGGAAG | 20 | 7197 |
| SCNN1A-3349 | + | UUGAUCAUGCUCUCCUGGAAG | 21 | 7198 |
| SCNN1A-3350 | + | CUUGAUCAUGCUCUCCUGGAAG | 22 | 7199 |
| SCNN1A-3351 | + | CCUUGAUCAUGCUCUCCUGGAAG | 23 | 7200 |
| SCNN1A-3352 | + | UCCUUGAUCAUGCUCUCCUGGAAG | 24 | 7201 |
| SCNN1A-3353 | + | GGCCCCCCCAGAGGACAG | 18 | 7202 |

TABLE 44G-continued

7th Tier

| gRNA Name | DNA Strand | Targeting Domain | Target Site Length | Seq ID |
|---|---|---|---|---|
| SCNN1A-3354 | + | GGGCCCCCCAGAGGACAG | 19 | 7203 |
| SCNN1A-3355 | + | AGGGCCCCCCAGAGGACAG | 20 | 7204 |
| SCNN1A-3356 | + | CAGGGCCCCCCAGAGGACAG | 21 | 7205 |
| SCNN1A-3357 | + | UCAGGGCCCCCCAGAGGACAG | 22 | 7206 |
| SCNN1A-3358 | + | CUCAGGGCCCCCCAGAGGACAG | 23 | 7207 |
| SCNN1A-3359 | + | UCUCAGGGCCCCCCAGAGGACAG | 24 | 7208 |
| SCNN1A-3360 | + | CCCAGUCACUGUGGACAG | 18 | 7209 |
| SCNN1A-3361 | + | CCCCAGUCACUGUGGACAG | 19 | 7210 |
| SCNN1A-3362 | + | GCCCCAGUCACUGUGGACAG | 20 | 7211 |
| SCNN1A-3363 | + | GGCCCCAGUCACUGUGGACAG | 21 | 7212 |
| SCNN1A-3364 | + | GGGCCCCAGUCACUGUGGACAG | 22 | 7213 |
| SCNN1A-3365 | + | CGGGCCCCAGUCACUGUGGACAG | 23 | 7214 |
| SCNN1A-3366 | + | CCGGGCCCCAGUCACUGUGGACAG | 24 | 7215 |
| SCNN1A-3367 | + | CACGACCUACCGUGACAG | 18 | 7216 |
| SCNN1A-3368 | + | GCACGACCUACCGUGACAG | 19 | 7217 |
| SCNN1A-1114 | + | GGCACGACCUACCGUGACAG | 20 | 4963 |
| SCNN1A-3369 | + | AGGCACGACCUACCGUGACAG | 21 | 7218 |
| SCNN1A-3370 | + | CAGGCACGACCUACCGUGACAG | 22 | 7219 |
| SCNN1A-3371 | + | CCAGGCACGACCUACCGUGACAG | 23 | 7220 |
| SCNN1A-3372 | + | UCCAGGCACGACCUACCGUGACAG | 24 | 7221 |
| SCNN1A-3373 | + | GCCAUCGUGAGUAACCAG | 18 | 7222 |
| SCNN1A-3374 | + | GGCCAUCGUGAGUAACCAG | 19 | 7223 |
| SCNN1A-3375 | + | GGGCCAUCGUGAGUAACCAG | 20 | 7224 |
| SCNN1A-3376 | + | AGGGCCAUCGUGAGUAACCAG | 21 | 7225 |
| SCNN1A-3377 | + | GAGGGCCAUCGUGAGUAACCAG | 22 | 7226 |
| SCNN1A-3378 | + | CGAGGGCCAUCGUGAGUAACCAG | 23 | 7227 |
| SCNN1A-3379 | + | CCGAGGGCCAUCGUGAGUAACCAG | 24 | 7228 |
| SCNN1A-3380 | + | CGCUGCGGGCCUCACCAG | 18 | 7229 |
| SCNN1A-3381 | + | GCGCUGCGGGCCUCACCAG | 19 | 7230 |
| SCNN1A-3382 | + | GGCGCUGCGGGCCUCACCAG | 20 | 7231 |
| SCNN1A-3383 | + | CGGCGCUGCGGGCCUCACCAG | 21 | 7232 |
| SCNN1A-3384 | + | UCGGCGCUGCGGGCCUCACCAG | 22 | 7233 |
| SCNN1A-3385 | + | CUCGGCGCUGCGGGCCUCACCAG | 23 | 7234 |
| SCNN1A-3386 | + | CCUCGGCGCUGCGGGCCUCACCAG | 24 | 7235 |
| SCNN1A-3387 | + | CCAGGGUGGCAUAGGCAG | 18 | 7236 |
| SCNN1A-3388 | + | CCCAGGGUGGCAUAGGCAG | 19 | 7237 |
| SCNN1A-1120 | + | GCCCAGGGUGGCAUAGGCAG | 20 | 4969 |
| SCNN1A-3389 | + | GGCCCAGGGUGGCAUAGGCAG | 21 | 7238 |

TABLE 44G-continued

7th Tier

| gRNA Name | DNA Strand | Targeting Domain | Target Site Length | Seq ID |
|---|---|---|---|---|
| SCNN1A-3390 | + | GGGCCCAGGGUGGCAUAGGCAG | 22 | 7239 |
| SCNN1A-3391 | + | GGGGCCCAGGGUGGCAUAGGCAG | 23 | 7240 |
| SCNN1A-3392 | + | GGGGGCCCAGGGUGGCAUAGGCAG | 24 | 7241 |
| SCNN1A-3393 | + | ACCUGGUUGAAGCGGCAG | 18 | 7242 |
| SCNN1A-3394 | + | GACCUGGUUGAAGCGGCAG | 19 | 7243 |
| SCNN1A-3395 | + | AGACCUGGUUGAAGCGGCAG | 20 | 7244 |
| SCNN1A-3396 | + | GAGACCUGGUUGAAGCGGCAG | 21 | 7245 |
| SCNN1A-3397 | + | GGAGACCUGGUUGAAGCGGCAG | 22 | 7246 |
| SCNN1A-3398 | + | AGGAGACCUGGUUGAAGCGGCAG | 23 | 7247 |
| SCNN1A-3399 | + | CAGGAGACCUGGUUGAAGCGGCAG | 24 | 7248 |
| SCNN1A-3400 | + | CACAGAGACUAGAGUCAG | 18 | 7249 |
| SCNN1A-3401 | + | ACACAGAGACUAGAGUCAG | 19 | 7250 |
| SCNN1A-1125 | + | GACACAGAGACUAGAGUCAG | 20 | 4974 |
| SCNN1A-3402 | + | GGACACAGAGACUAGAGUCAG | 21 | 7251 |
| SCNN1A-3403 | + | UGGACACAGAGACUAGAGUCAG | 22 | 7252 |
| SCNN1A-3404 | + | CUGGACACAGAGACUAGAGUCAG | 23 | 7253 |
| SCNN1A-3405 | + | ACUGGACACAGAGACUAGAGUCAG | 24 | 7254 |
| SCNN1A-3406 | + | AGGGAGGAGGGUGGAGAG | 18 | 7255 |
| SCNN1A-3407 | + | AAGGGAGGAGGGUGGAGAG | 19 | 7256 |
| SCNN1A-3408 | + | GAAGGGAGGAGGGUGGAGAG | 20 | 7257 |
| SCNN1A-3409 | + | GGAAGGGAGGAGGGUGGAGAG | 21 | 7258 |
| SCNN1A-3410 | + | UGGAAGGGAGGAGGGUGGAGAG | 22 | 7259 |
| SCNN1A-3411 | + | CUGGAAGGGAGGAGGGUGGAGAG | 23 | 7260 |
| SCNN1A-3412 | + | CCUGGAAGGGAGGAGGGUGGAGAG | 24 | 7261 |
| SCNN1A-3413 | + | GGUGACCAUCUGUGAGAG | 18 | 7262 |
| SCNN1A-3414 | + | GGGUGACCAUCUGUGAGAG | 19 | 7263 |
| SCNN1A-3415 | + | AGGGUGACCAUCUGUGAGAG | 20 | 7264 |
| SCNN1A-3416 | + | GAGGGUGACCAUCUGUGAGAG | 21 | 7265 |
| SCNN1A-3417 | + | GGAGGGUGACCAUCUGUGAGAG | 22 | 7266 |
| SCNN1A-3418 | + | AGGAGGGUGACCAUCUGUGAGAG | 23 | 7267 |
| SCNN1A-3419 | + | CAGGAGGGUGACCAUCUGUGAGAG | 24 | 7268 |
| SCNN1A-3420 | + | GGUACCUGAAGGGGCGAG | 18 | 7269 |
| SCNN1A-3421 | + | GGGUACCUGAAGGGGCGAG | 19 | 7270 |
| SCNN1A-1130 | + | CGGGUACCUGAAGGGGCGAG | 20 | 4979 |
| SCNN1A-3422 | + | CCGGGUACCUGAAGGGGCGAG | 21 | 7271 |
| SCNN1A-3423 | + | UCCGGGUACCUGAAGGGGCGAG | 22 | 7272 |
| SCNN1A-3424 | + | UUCCGGGUACCUGAAGGGGCGAG | 23 | 7273 |

TABLE 44G-continued

7th Tier

| gRNA Name | DNA Strand | Targeting Domain | Target Site Length | Seq ID |
|---|---|---|---|---|
| SCNN1A-3425 | + | UUUCCGGGUACCUGAAGGGGCGAG | 24 | 7274 |
| SCNN1A-3426 | + | GGCAGAAGUGGGAAGGAG | 18 | 7275 |
| SCNN1A-3427 | + | GGGCAGAAGUGGGAAGGAG | 19 | 7276 |
| SCNN1A-1132 | + | GGGGCAGAAGUGGGAAGGAG | 20 | 4981 |
| SCNN1A-3428 | + | GGGGGCAGAAGUGGGAAGGAG | 21 | 7277 |
| SCNN1A-3429 | + | UGGGGGCAGAAGUGGGAAGGAG | 22 | 7278 |
| SCNN1A-3430 | + | GUGGGGGCAGAAGUGGGAAGGAG | 23 | 7279 |
| SCNN1A-3431 | + | GGUGGGGGCAGAAGUGGGAAGGAG | 24 | 7280 |
| SCNN1A-3432 | + | ACAGACAACACCGAGGAG | 18 | 7281 |
| SCNN1A-3433 | + | CACAGACAACACCGAGGAG | 19 | 7282 |
| SCNN1A-3434 | + | CCACAGACAACACCGAGGAG | 20 | 7283 |
| SCNN1A-3435 | + | ACCACAGACAACACCGAGGAG | 21 | 7284 |
| SCNN1A-3436 | + | CACCACAGACAACACCGAGGAG | 22 | 7285 |
| SCNN1A-3437 | + | CCACCACAGACAACACCGAGGAG | 23 | 7286 |
| SCNN1A-3438 | + | UCCACCACAGACAACACCGAGGAG | 24 | 7287 |
| SCNN1A-3439 | + | UCAAGGCUGGAGAGGGAG | 18 | 7288 |
| SCNN1A-3440 | + | GUCAAGGCUGGAGAGGGAG | 19 | 7289 |
| SCNN1A-3441 | + | UGUCAAGGCUGGAGAGGGAG | 20 | 7290 |
| SCNN1A-3442 | + | CUGUCAAGGCUGGAGAGGGAG | 21 | 7291 |
| SCNN1A-3443 | + | GCUGUCAAGGCUGGAGAGGGAG | 22 | 7292 |
| SCNN1A-3444 | + | GGCUGUCAAGGCUGGAGAGGGAG | 23 | 7293 |
| SCNN1A-3445 | + | GGGCUGUCAAGGCUGGAGAGGGAG | 24 | 7294 |
| SCNN1A-3446 | + | CUGCAGAGCCCCCUGGAG | 18 | 7295 |
| SCNN1A-3447 | + | CCUGCAGAGCCCCCUGGAG | 19 | 7296 |
| SCNN1A-3448 | + | CCCUGCAGAGCCCCCUGGAG | 20 | 7297 |
| SCNN1A-3449 | + | CCCCUGCAGAGCCCCCUGGAG | 21 | 7298 |
| SCNN1A-3450 | + | GCCCCUGCAGAGCCCCCUGGAG | 22 | 7299 |
| SCNN1A-3451 | + | GGCCCCUGCAGAGCCCCCUGGAG | 23 | 7300 |
| SCNN1A-3452 | + | UGGCCCCUGCAGAGCCCCCUGGAG | 24 | 7301 |
| SCNN1A-3453 | + | GGGCUGUCAAGGCUGGAG | 18 | 7302 |
| SCNN1A-3454 | + | GGGGCUGUCAAGGCUGGAG | 19 | 7303 |
| SCNN1A-1138 | + | AGGGGCUGUCAAGGCUGGAG | 20 | 4987 |
| SCNN1A-3455 | + | GAGGGGCUGUCAAGGCUGGAG | 21 | 7304 |
| SCNN1A-3456 | + | GGAGGGGCUGUCAAGGCUGGAG | 22 | 7305 |
| SCNN1A-3457 | + | GGGAGGGGCUGUCAAGGCUGGAG | 23 | 7306 |
| SCNN1A-3458 | + | GGGGAGGGGCUGUCAAGGCUGGAG | 24 | 7307 |
| SCNN1A-3459 | + | GAAGGGAGGAGGGUGGAG | 18 | 7308 |
| SCNN1A-3460 | + | GGAAGGGAGGAGGGUGGAG | 19 | 7309 |

TABLE 44G-continued

7th Tier

| gRNA Name | DNA Strand | Targeting Domain | Target Site Length | Seq ID |
|---|---|---|---|---|
| SCNN1A-1139 | + | UGGAAGGGAGGAGGGUGGAG | 20 | 4988 |
| SCNN1A-3461 | + | CUGGAAGGGAGGAGGGUGGAG | 21 | 7310 |
| SCNN1A-3462 | + | CCUGGAAGGGAGGAGGGUGGAG | 22 | 7311 |
| SCNN1A-3463 | + | ACCUGGAAGGGAGGAGGGUGGAG | 23 | 7312 |
| SCNN1A-3464 | + | CACCUGGAAGGGAGGAGGGUGGAG | 24 | 7313 |
| SCNN1A-3465 | + | CAGCCCAGGUGGUCUGAG | 18 | 7314 |
| SCNN1A-3466 | + | ACAGCCCAGGUGGUCUGAG | 19 | 7315 |
| SCNN1A-3467 | + | AACAGCCCAGGUGGUCUGAG | 20 | 7316 |
| SCNN1A-3468 | + | AAACAGCCCAGGUGGUCUGAG | 21 | 7317 |
| SCNN1A-3469 | + | GAAACAGCCCAGGUGGUCUGAG | 22 | 7318 |
| SCNN1A-3470 | + | UGAAACAGCCCAGGUGGUCUGAG | 23 | 7319 |
| SCNN1A-3471 | + | GUGAAACAGCCCAGGUGGUCUGAG | 24 | 7320 |
| SCNN1A-3472 | + | CUCGACGGGCCCCGUGAG | 18 | 7321 |
| SCNN1A-3473 | + | GCUCGACGGGCCCCGUGAG | 19 | 7322 |
| SCNN1A-3474 | + | GGCUCGACGGGCCCCGUGAG | 20 | 7323 |
| SCNN1A-3475 | + | GGGCUCGACGGGCCCCGUGAG | 21 | 7324 |
| SCNN1A-3476 | + | CGGGCUCGACGGGCCCCGUGAG | 22 | 7325 |
| SCNN1A-3477 | + | ACGGGCUCGACGGGCCCCGUGAG | 23 | 7326 |
| SCNN1A-3478 | + | UACGGGCUCGACGGGCCCCGUGAG | 24 | 7327 |
| SCNN1A-3479 | + | AGGGUGACCAUCUGUGAG | 18 | 7328 |
| SCNN1A-3480 | + | GAGGGUGACCAUCUGUGAG | 19 | 7329 |
| SCNN1A-1141 | + | GGAGGGUGACCAUCUGUGAG | 20 | 4990 |
| SCNN1A-3481 | + | AGGAGGGUGACCAUCUGUGAG | 21 | 7330 |
| SCNN1A-3482 | + | CAGGAGGGUGACCAUCUGUGAG | 22 | 7331 |
| SCNN1A-3483 | + | ACAGGAGGGUGACCAUCUGUGAG | 23 | 7332 |
| SCNN1A-3484 | + | GACAGGAGGGUGACCAUCUGUGAG | 24 | 7333 |
| SCNN1A-3485 | + | GACAGGAUGUUGAUGUAG | 18 | 7334 |
| SCNN1A-3486 | + | CGACAGGAUGUUGAUGUAG | 19 | 7335 |
| SCNN1A-1143 | + | UCGACAGGAUGUUGAUGUAG | 20 | 4992 |
| SCNN1A-3487 | + | CUCGACAGGAUGUUGAUGUAG | 21 | 7336 |
| SCNN1A-3488 | + | CCUCGACAGGAUGUUGAUGUAG | 22 | 7337 |
| SCNN1A-3489 | + | GCCUCGACAGGAUGUUGAUGUAG | 23 | 7338 |
| SCNN1A-3490 | + | AGCCUCGACAGGAUGUUGAUGUAG | 24 | 7339 |
| SCNN1A-3491 | + | AGCUGGUAGCUGGUCACG | 18 | 7340 |
| SCNN1A-3492 | + | GAGCUGGUAGCUGGUCACG | 19 | 7341 |
| SCNN1A-3493 | + | AGAGCUGGUAGCUGGUCACG | 20 | 7342 |
| SCNN1A-3494 | + | GAGAGCUGGUAGCUGGUCACG | 21 | 7343 |

TABLE 44G-continued

7th Tier

| gRNA Name | DNA Strand | Targeting Domain | Target Site Length | Seq ID |
|---|---|---|---|---|
| SCNN1A-3495 | + | AGAGAGCUGGUAGCUGGUCACG | 22 | 7344 |
| SCNN1A-3496 | + | CAGAGAGCUGGUAGCUGGUCACG | 23 | 7345 |
| SCNN1A-3497 | + | GCAGAGAGCUGGUAGCUGGUCACG | 24 | 7346 |
| SCNN1A-3498 | + | AGGAGAGGUACAUUGACG | 18 | 7347 |
| SCNN1A-3499 | + | GAGGAGAGGUACAUUGACG | 19 | 7348 |
| SCNN1A-3500 | + | AGAGGAGAGGUACAUUGACG | 20 | 7349 |
| SCNN1A-3501 | + | GAGAGGAGAGGUACAUUGACG | 21 | 7350 |
| SCNN1A-3502 | + | UGAGAGGAGAGGUACAUUGACG | 22 | 7351 |
| SCNN1A-3503 | + | GUGAGAGGAGAGGUACAUUGACG | 23 | 7352 |
| SCNN1A-3504 | + | UGUGAGAGGAGAGGUACAUUGACG | 24 | 7353 |
| SCNN1A-3505 | + | CCACCACAGACAACACCG | 18 | 7354 |
| SCNN1A-3506 | + | UCCACCACAGACAACACCG | 19 | 7355 |
| SCNN1A-1146 | + | CUCCACCACAGACAACACCG | 20 | 4995 |
| SCNN1A-3507 | + | UCUCCACCACAGACAACACCG | 21 | 7356 |
| SCNN1A-3508 | + | AUCUCCACCACAGACAACACCG | 22 | 7357 |
| SCNN1A-3509 | + | CAUCUCCACCACAGACAACACCG | 23 | 7358 |
| SCNN1A-3510 | + | CCAUCUCCACCACAGACAACACCG | 24 | 7359 |
| SCNN1A-3511 | + | CGGGUACCUGAAGGGGCG | 18 | 7360 |
| SCNN1A-3512 | + | CCGGGUACCUGAAGGGGCG | 19 | 7361 |
| SCNN1A-1155 | + | UCCGGGUACCUGAAGGGGCG | 20 | 5004 |
| SCNN1A-3513 | + | UUCCGGGUACCUGAAGGGGCG | 21 | 7362 |
| SCNN1A-3514 | + | UUUCCGGGUACCUGAAGGGGCG | 22 | 7363 |
| SCNN1A-3515 | + | AUUUCCGGGUACCUGAAGGGGCG | 23 | 7364 |
| SCNN1A-3516 | + | AAUUUCCGGGUACCUGAAGGGGCG | 24 | 7365 |
| SCNN1A-3517 | + | GGCCACGCUACGGGCUCG | 18 | 7366 |
| SCNN1A-3518 | + | AGGCCACGCUACGGGCUCG | 19 | 7367 |
| SCNN1A-3519 | + | GAGGCCACGCUACGGGCUCG | 20 | 7368 |
| SCNN1A-3520 | + | GGAGGCCACGCUACGGGCUCG | 21 | 7369 |
| SCNN1A-3521 | + | UGGAGGCCACGCUACGGGCUCG | 22 | 7370 |
| SCNN1A-3522 | + | CUGGAGGCCACGCUACGGGCUCG | 23 | 7371 |
| SCNN1A-3523 | + | GCUGGAGGCCACGCUACGGGCUCG | 24 | 7372 |
| SCNN1A-3524 | + | GGGGAGGGCUGUCAAGG | 18 | 7373 |
| SCNN1A-3525 | + | GGGGGAGGGCUGUCAAGG | 19 | 7374 |
| SCNN1A-3526 | + | AGGGGGAGGGCUGUCAAGG | 20 | 7375 |
| SCNN1A-3527 | + | CAGGGGGAGGGCUGUCAAGG | 21 | 7376 |
| SCNN1A-3528 | + | GCAGGGGGAGGGCUGUCAAGG | 22 | 7377 |
| SCNN1A-3529 | + | GGCAGGGGGAGGGCUGUCAAGG | 23 | 7378 |
| SCNN1A-3530 | + | AGGCAGGGGGAGGGCUGUCAAGG | 24 | 7379 |

TABLE 44G-continued

7th Tier

| gRNA Name | DNA Strand | Targeting Domain | Target Site Length | Seq ID |
|---|---|---|---|---|
| SCNN1A-3531 | + | GGGGCAGAAGUGGGAAGG | 18 | 7380 |
| SCNN1A-3532 | + | GGGGGCAGAAGUGGGAAGG | 19 | 7381 |
| SCNN1A-1161 | + | UGGGGGCAGAAGUGGGAAGG | 20 | 5010 |
| SCNN1A-3533 | + | GUGGGGGCAGAAGUGGGAAGG | 21 | 7382 |
| SCNN1A-3534 | + | GGUGGGGGCAGAAGUGGGAAGG | 22 | 7383 |
| SCNN1A-3535 | + | GGGUGGGGGCAGAAGUGGGAAGG | 23 | 7384 |
| SCNN1A-3536 | + | GGGGUGGGGGCAGAAGUGGGAAGG | 24 | 7385 |
| SCNN1A-3537 | + | GAAUACACACCUGGAAGG | 18 | 7386 |
| SCNN1A-3538 | + | UGAAUACACACCUGGAAGG | 19 | 7387 |
| SCNN1A-3539 | + | GUGAAUACACACCUGGAAGG | 20 | 7388 |
| SCNN1A-3540 | + | AGUGAAUACACACCUGGAAGG | 21 | 7389 |
| SCNN1A-3541 | + | GAGUGAAUACACACCUGGAAGG | 22 | 7390 |
| SCNN1A-3542 | + | GGAGUGAAUACACACCUGGAAGG | 23 | 7391 |
| SCNN1A-3543 | + | AGGAGUGAAUACACACCUGGAAGG | 24 | 7392 |
| SCNN1A-3544 | + | GCCCCCCCAGAGGACAGG | 18 | 7393 |
| SCNN1A-3545 | + | GGCCCCCCCAGAGGACAGG | 19 | 7394 |
| SCNN1A-1162 | + | GGGCCCCCCCAGAGGACAGG | 20 | 5011 |
| SCNN1A-3546 | + | AGGGCCCCCCCAGAGGACAGG | 21 | 7395 |
| SCNN1A-3547 | + | CAGGGCCCCCCCAGAGGACAGG | 22 | 7396 |
| SCNN1A-3548 | + | UCAGGGCCCCCCCAGAGGACAGG | 23 | 7397 |
| SCNN1A-3549 | + | CUCAGGGCCCCCCCAGAGGACAGG | 24 | 7398 |
| SCNN1A-3550 | + | CUCCACUGGCUGCCCAGG | 18 | 7399 |
| SCNN1A-3551 | + | GCUCCACUGGCUGCCCAGG | 19 | 7400 |
| SCNN1A-3552 | + | GGCUCCACUGGCUGCCCAGG | 20 | 7401 |
| SCNN1A-3553 | + | AGGCUCCACUGGCUGCCCAGG | 21 | 7402 |
| SCNN1A-3554 | + | CAGGCUCCACUGGCUGCCCAGG | 22 | 7403 |
| SCNN1A-3555 | + | ACAGGCUCCACUGGCUGCCCAGG | 23 | 7404 |
| SCNN1A-3556 | + | CACAGGCUCCACUGGCUGCCCAGG | 24 | 7405 |
| SCNN1A-3557 | + | GGAGGGGAGGAUGCCAGG | 18 | 7406 |
| SCNN1A-3558 | + | AGGAGGGGAGGAUGCCAGG | 19 | 7407 |
| SCNN1A-3559 | + | AAGGAGGGGAGGAUGCCAGG | 20 | 7408 |
| SCNN1A-3560 | + | GAAGGAGGGGAGGAUGCCAGG | 21 | 7409 |
| SCNN1A-3561 | + | GGAAGGAGGGGAGGAUGCCAGG | 22 | 7410 |
| SCNN1A-3562 | + | GGGAAGGAGGGGAGGAUGCCAGG | 23 | 7411 |
| SCNN1A-3563 | + | UGGGAAGGAGGGGAGGAUGCCAGG | 24 | 7412 |
| SCNN1A-3564 | + | CAGGGUGGCAUAGGCAGG | 18 | 7413 |
| SCNN1A-3565 | + | CCAGGGUGGCAUAGGCAGG | 19 | 7414 |

TABLE 44G-continued

7th Tier

| gRNA Name | DNA Strand | Targeting Domain | Target Site Length | Seq ID |
|---|---|---|---|---|
| SCNN1A-1167 | + | CCCAGGGUGGCAUAGGCAGG | 20 | 5016 |
| SCNN1A-3566 | + | GCCCAGGGUGGCAUAGGCAGG | 21 | 7415 |
| SCNN1A-3567 | + | GGCCCAGGGUGGCAUAGGCAGG | 22 | 7416 |
| SCNN1A-3568 | + | GGGCCCAGGGUGGCAUAGGCAGG | 23 | 7417 |
| SCNN1A-3569 | + | GGGGCCCAGGGUGGCAUAGGCAGG | 24 | 7418 |
| SCNN1A-3570 | + | AUGGAAGACAUCCAGAGG | 18 | 7419 |
| SCNN1A-3571 | + | CAUGGAAGACAUCCAGAGG | 19 | 7420 |
| SCNN1A-3572 | + | GCAUGGAAGACAUCCAGAGG | 20 | 7421 |
| SCNN1A-3573 | + | GGCAUGGAAGACAUCCAGAGG | 21 | 7422 |
| SCNN1A-3574 | + | AGGCAUGGAAGACAUCCAGAGG | 22 | 7423 |
| SCNN1A-3575 | + | CAGGCAUGGAAGACAUCCAGAGG | 23 | 7424 |
| SCNN1A-3576 | + | CCAGGCAUGGAAGACAUCCAGAGG | 24 | 7425 |
| SCNN1A-3577 | + | UUAGGUGUGGGCAGAGG | 18 | 7426 |
| SCNN1A-3578 | + | CUUAGGUGUGGGGCAGAGG | 19 | 7427 |
| SCNN1A-3579 | + | UCUUAGGUGUGGGGCAGAGG | 20 | 7428 |
| SCNN1A-3580 | + | UUCUUAGGUGUGGGGCAGAGG | 21 | 7429 |
| SCNN1A-3581 | + | UUUCUUAGGUGUGGGGCAGAGG | 22 | 7430 |
| SCNN1A-3582 | + | AUUUCUUAGGUGUGGGGCAGAGG | 23 | 7431 |
| SCNN1A-3583 | + | CAUUUCUUAGGUGUGGGGCAGAGG | 24 | 7432 |
| SCNN1A-3584 | + | CACCUGGAAGGGAGGAGG | 18 | 7433 |
| SCNN1A-3585 | + | ACACCUGGAAGGGAGGAGG | 19 | 7434 |
| SCNN1A-3586 | + | CACACCUGGAAGGGAGGAGG | 20 | 7435 |
| SCNN1A-3587 | + | ACACACCUGGAAGGGAGGAGG | 21 | 7436 |
| SCNN1A-3588 | + | UACACACCUGGAAGGGAGGAGG | 22 | 7437 |
| SCNN1A-3589 | + | AUACACACCUGGAAGGGAGGAGG | 23 | 7438 |
| SCNN1A-3590 | + | AAUACACACCUGGAAGGGAGGAGG | 24 | 7439 |
| SCNN1A-3591 | + | UCGACGGGCCCCGUGAGG | 18 | 7440 |
| SCNN1A-3592 | + | CUCGACGGGCCCCGUGAGG | 19 | 7441 |
| SCNN1A-1172 | + | GCUCGACGGGCCCCGUGAGG | 20 | 5021 |
| SCNN1A-3593 | + | GGCUCGACGGGCCCCGUGAGG | 21 | 7442 |
| SCNN1A-3594 | + | GGGCUCGACGGGCCCCGUGAGG | 22 | 7443 |
| SCNN1A-3595 | + | CGGGCUCGACGGGCCCCGUGAGG | 23 | 7444 |
| SCNN1A-3596 | + | ACGGGCUCGACGGGCCCCGUGAGG | 24 | 7445 |
| SCNN1A-3597 | + | GGCCCAGGGUGGCAUAGG | 18 | 7446 |
| SCNN1A-3598 | + | GGGCCCAGGGUGGCAUAGG | 19 | 7447 |
| SCNN1A-3599 | + | GGGGCCCAGGGUGGCAUAGG | 20 | 7448 |
| SCNN1A-3600 | + | GGGGGCCCAGGGUGGCAUAGG | 21 | 7449 |
| SCNN1A-3601 | + | CGGGGGCCCAGGGUGGCAUAGG | 22 | 7450 |

TABLE 44G-continued

7th Tier

| gRNA Name | DNA Strand | Targeting Domain | Target Site Length | Seq ID |
|---|---|---|---|---|
| SCNN1A-3602 | + | GCGGGGGCCCAGGGUGGCAUAGG | 23 | 7451 |
| SCNN1A-3603 | + | GGCGGGGGCCCAGGGUGGCAUAGG | 24 | 7452 |
| SCNN1A-3604 | + | AAUACACACCUGGAAGGG | 18 | 7453 |
| SCNN1A-3605 | + | GAAUACACACCUGGAAGGG | 19 | 7454 |
| SCNN1A-1176 | + | UGAAUACACACCUGGAAGGG | 20 | 5025 |
| SCNN1A-3606 | + | GUGAAUACACACCUGGAAGGG | 21 | 7455 |
| SCNN1A-3607 | + | AGUGAAUACACACCUGGAAGGG | 22 | 7456 |
| SCNN1A-3608 | + | GAGUGAAUACACACCUGGAAGGG | 23 | 7457 |
| SCNN1A-3609 | + | GGAGUGAAUACACACCUGGAAGGG | 24 | 7458 |
| SCNN1A-3610 | + | UUCCGGGUACCUGAAGGG | 18 | 7459 |
| SCNN1A-3611 | + | UUUCCGGGUACCUGAAGGG | 19 | 7460 |
| SCNN1A-3612 | + | AUUUCCGGGUACCUGAAGGG | 20 | 7461 |
| SCNN1A-3613 | + | AAUUUCCGGGUACCUGAAGGG | 21 | 7462 |
| SCNN1A-3614 | + | UAAUUUCCGGGUACCUGAAGGG | 22 | 7463 |
| SCNN1A-3615 | + | UUAAUUUCCGGGUACCUGAAGGG | 23 | 7464 |
| SCNN1A-3616 | + | UUUAAUUUCCGGGUACCUGAAGGG | 24 | 7465 |
| SCNN1A-3617 | + | UUGUGGCUGGGACCAGGG | 18 | 7466 |
| SCNN1A-3618 | + | CUUGUGGCUGGGACCAGGG | 19 | 7467 |
| SCNN1A-3619 | + | UCUUGUGGCUGGGACCAGGG | 20 | 7468 |
| SCNN1A-3620 | + | GAGGGGAGGAUGCCAGGG | 18 | 7469 |
| SCNN1A-3621 | + | GGAGGGGAGGAUGCCAGGG | 19 | 7470 |
| SCNN1A-1178 | + | AGGAGGGGAGGAUGCCAGGG | 20 | 5027 |
| SCNN1A-3622 | + | AAGGAGGGGAGGAUGCCAGGG | 21 | 7471 |
| SCNN1A-3623 | + | GAAGGAGGGGAGGAUGCCAGGG | 22 | 7472 |
| SCNN1A-3624 | + | GGAAGGAGGGGAGGAUGCCAGGG | 23 | 7473 |
| SCNN1A-3625 | + | GGGAAGGAGGGGAGGAUGCCAGGG | 24 | 7474 |
| SCNN1A-3626 | + | UAGGUGUGGGCAGAGGG | 18 | 7475 |
| SCNN1A-3627 | + | UUAGGUGUGGGCAGAGGG | 19 | 7476 |
| SCNN1A-1179 | + | CUUAGGUGUGGGCAGAGGG | 20 | 5028 |
| SCNN1A-3628 | + | UCUUAGGUGUGGGCAGAGGG | 21 | 7477 |
| SCNN1A-3629 | + | UUCUUAGGUGUGGGCAGAGGG | 22 | 7478 |
| SCNN1A-3630 | + | UUUCUUAGGUGUGGGCAGAGGG | 23 | 7479 |
| SCNN1A-3631 | + | AUUUCUUAGGUGUGGGCAGAGGG | 24 | 7480 |
| SCNN1A-3632 | + | ACCUGGAAGGGAGGAGGG | 18 | 7481 |
| SCNN1A-3633 | + | CACCUGGAAGGGAGGAGGG | 19 | 7482 |
| SCNN1A-1180 | + | ACACCUGGAAGGGAGGAGGG | 20 | 5029 |
| SCNN1A-3634 | + | CACACCUGGAAGGGAGGAGGG | 21 | 7483 |

TABLE 44G-continued

7th Tier

| gRNA Name | DNA Strand | Targeting Domain | Target Site Length | Seq ID |
|---|---|---|---|---|
| SCNN1A-3635 | + | ACACACCUGGAAGGGAGGAGGG | 22 | 7484 |
| SCNN1A-3636 | + | UACACACCUGGAAGGGAGGAGGG | 23 | 7485 |
| SCNN1A-3637 | + | AUACACACCUGGAAGGGAGGAGGG | 24 | 7486 |
| SCNN1A-3638 | + | GGGUGGCAUAGGCAGGGG | 18 | 7487 |
| SCNN1A-3639 | + | AGGGUGGCAUAGGCAGGGG | 19 | 7488 |
| SCNN1A-3640 | + | CAGGGUGGCAUAGGCAGGGG | 20 | 7489 |
| SCNN1A-3641 | + | CCAGGGUGGCAUAGGCAGGGG | 21 | 7490 |
| SCNN1A-3642 | + | CCCAGGGUGGCAUAGGCAGGGG | 22 | 7491 |
| SCNN1A-3643 | + | GCCCAGGGUGGCAUAGGCAGGGG | 23 | 7492 |
| SCNN1A-3644 | + | GGCCCAGGGUGGCAUAGGCAGGGG | 24 | 7493 |
| SCNN1A-3645 | + | ACCUGAAGGGGCGAGGGG | 18 | 7494 |
| SCNN1A-3646 | + | UACCUGAAGGGGCGAGGGG | 19 | 7495 |
| SCNN1A-3647 | + | GUACCUGAAGGGGCGAGGGG | 20 | 7496 |
| SCNN1A-3648 | + | GGUACCUGAAGGGGCGAGGGG | 21 | 7497 |
| SCNN1A-3649 | + | GGGUACCUGAAGGGGCGAGGGG | 22 | 7498 |
| SCNN1A-3650 | + | CGGGUACCUGAAGGGGCGAGGGG | 23 | 7499 |
| SCNN1A-3651 | + | CCGGGUACCUGAAGGGGCGAGGGG | 24 | 7500 |
| SCNN1A-3652 | + | GGGCCCCGUGAGGCGGGG | 18 | 7501 |
| SCNN1A-3653 | + | CGGGCCCCGUGAGGCGGGG | 19 | 7502 |
| SCNN1A-3654 | + | ACGGGCCCCGUGAGGCGGGG | 20 | 7503 |
| SCNN1A-3655 | + | GACGGGCCCCGUGAGGCGGGG | 21 | 7504 |
| SCNN1A-3656 | + | CGACGGGCCCCGUGAGGCGGGG | 22 | 7505 |
| SCNN1A-3657 | + | UCGACGGGCCCCGUGAGGCGGGG | 23 | 7506 |
| SCNN1A-3658 | + | CUCGACGGGCCCCGUGAGGCGGGG | 24 | 7507 |
| SCNN1A-3659 | + | GGUGGCAUAGGCAGGGGG | 18 | 7508 |
| SCNN1A-3660 | + | GGGUGGCAUAGGCAGGGGG | 19 | 7509 |
| SCNN1A-1184 | + | AGGGUGGCAUAGGCAGGGGG | 20 | 5033 |
| SCNN1A-3661 | + | CAGGGUGGCAUAGGCAGGGGG | 21 | 7510 |
| SCNN1A-3662 | + | CCAGGGUGGCAUAGGCAGGGGG | 22 | 7511 |
| SCNN1A-3663 | + | CCCAGGGUGGCAUAGGCAGGGGG | 23 | 7512 |
| SCNN1A-3664 | + | GCCCAGGGUGGCAUAGGCAGGGGG | 24 | 7513 |
| SCNN1A-3665 | + | GGCCCCGUGAGGCGGGGG | 18 | 7514 |
| SCNN1A-3666 | + | GGGCCCCGUGAGGCGGGGG | 19 | 7515 |
| SCNN1A-1185 | + | CGGGCCCCGUGAGGCGGGGG | 20 | 5034 |
| SCNN1A-3667 | + | ACGGGCCCCGUGAGGCGGGGG | 21 | 7516 |
| SCNN1A-3668 | + | GACGGGCCCCGUGAGGCGGGGG | 22 | 7517 |
| SCNN1A-3669 | + | CGACGGGCCCCGUGAGGCGGGGG | 23 | 7518 |
| SCNN1A-3670 | + | UCGACGGGCCCCGUGAGGCGGGGG | 24 | 7519 |

TABLE 44G-continued

7th Tier

| gRNA Name | DNA Strand | Targeting Domain | Target Site Length | Seq ID |
|---|---|---|---|---|
| SCNN1A-3671 | + | AGAGACAUGGGGUGGGGG | 18 | 7520 |
| SCNN1A-3672 | + | CAGAGACAUGGGGUGGGGG | 19 | 7521 |
| SCNN1A-3673 | + | ACAGAGACAUGGGGUGGGGG | 20 | 7522 |
| SCNN1A-3674 | + | GACAGAGACAUGGGGUGGGGG | 21 | 7523 |
| SCNN1A-3675 | + | GGACAGAGACAUGGGGUGGGGG | 22 | 7524 |
| SCNN1A-3676 | + | AGGACAGAGACAUGGGGUGGGGG | 23 | 7525 |
| SCNN1A-3677 | + | AAGGACAGAGACAUGGGGUGGGGG | 24 | 7526 |
| SCNN1A-3678 | + | AAGGACAGAGACAUGGGG | 18 | 7527 |
| SCNN1A-3679 | + | CAAGGACAGAGACAUGGGG | 19 | 7528 |
| SCNN1A-1186 | + | ACAAGGACAGAGACAUGGGG | 20 | 5035 |
| SCNN1A-3680 | + | GACAAGGACAGAGACAUGGGG | 21 | 7529 |
| SCNN1A-3681 | + | GGACAAGGACAGAGACAUGGGG | 22 | 7530 |
| SCNN1A-3682 | + | GGGACAAGGACAGAGACAUGGGG | 23 | 7531 |
| SCNN1A-3683 | + | UGGGACAAGGACAGAGACAUGGGG | 24 | 7532 |
| SCNN1A-3684 | + | UAGCUGGUCACGCUGGGG | 18 | 7533 |
| SCNN1A-3685 | + | GUAGCUGGUCACGCUGGGG | 19 | 7534 |
| SCNN1A-3686 | + | GGUAGCUGGUCACGCUGGGG | 20 | 7535 |
| SCNN1A-3687 | + | UGGUAGCUGGUCACGCUGGGG | 21 | 7536 |
| SCNN1A-3688 | + | CUGGUAGCUGGUCACGCUGGGG | 22 | 7537 |
| SCNN1A-3689 | + | GCUGGUAGCUGGUCACGCUGGGG | 23 | 7538 |
| SCNN1A-3690 | + | AGCUGGUAGCUGGUCACGCUGGGG | 24 | 7539 |
| SCNN1A-3691 | + | CAUUUCUUAGGUGUGGGG | 18 | 7540 |
| SCNN1A-3692 | + | CCAUUUCUUAGGUGUGGGG | 19 | 7541 |
| SCNN1A-3693 | + | UCCAUUUCUUAGGUGUGGGG | 20 | 7542 |
| SCNN1A-3694 | + | CUCCAUUUCUUAGGUGUGGGG | 21 | 7543 |
| SCNN1A-3695 | + | ACUCCAUUUCUUAGGUGUGGGG | 22 | 7544 |
| SCNN1A-3696 | + | CACUCCAUUUCUUAGGUGUGGGG | 23 | 7545 |
| SCNN1A-3697 | + | CCACUCCAUUUCUUAGGUGUGGGG | 24 | 7546 |
| SCNN1A-3698 | + | CAAGGACAGAGACAUGGG | 18 | 7547 |
| SCNN1A-3699 | + | ACAAGGACAGAGACAUGGG | 19 | 7548 |
| SCNN1A-3700 | + | GACAAGGACAGAGACAUGGG | 20 | 7549 |
| SCNN1A-3701 | + | GGACAAGGACAGAGACAUGGG | 21 | 7550 |
| SCNN1A-3702 | + | GGGACAAGGACAGAGACAUGGG | 22 | 7551 |
| SCNN1A-3703 | + | UGGGACAAGGACAGAGACAUGGG | 23 | 7552 |
| SCNN1A-3704 | + | CUGGGACAAGGACAGAGACAUGGG | 24 | 7553 |
| SCNN1A-3705 | + | GAGCCCCUGGAGAUGGG | 18 | 7554 |
| SCNN1A-3706 | + | AGAGCCCCUGGAGAUGGG | 19 | 7555 |

TABLE 44G-continued

| | | 7th Tier | | |
|---|---|---|---|---|
| gRNA Name | DNA Strand | Targeting Domain | Target Site Length | Seq ID |
| SCNN1A-1188 | + | CAGAGCCCCCUGGAGAUGGG | 20 | 5037 |
| SCNN1A-3707 | + | GCAGAGCCCCCUGGAGAUGGG | 21 | 7556 |
| SCNN1A-3708 | + | UGCAGAGCCCCCUGGAGAUGGG | 22 | 7557 |
| SCNN1A-3709 | + | CUGCAGAGCCCCCUGGAGAUGGG | 23 | 7558 |
| SCNN1A-3710 | + | CCUGCAGAGCCCCCUGGAGAUGGG | 24 | 7559 |
| SCNN1A-3711 | + | GGUGGGGGCAGAAGUGGG | 18 | 7560 |
| SCNN1A-3712 | + | GGGUGGGGGCAGAAGUGGG | 19 | 7561 |
| SCNN1A-3713 | + | GGGGUGGGGGCAGAAGUGGG | 20 | 7562 |
| SCNN1A-3714 | + | UGGGGUGGGGGCAGAAGUGGG | 21 | 7563 |
| SCNN1A-3715 | + | AUGGGGUGGGGGCAGAAGUGGG | 22 | 7564 |
| SCNN1A-3716 | + | CAUGGGGUGGGGGCAGAAGUGGG | 23 | 7565 |
| SCNN1A-3717 | + | ACAUGGGGUGGGGGCAGAAGUGGG | 24 | 7566 |
| SCNN1A-3718 | + | UGUGGGGCAGAGGGUGGG | 18 | 7567 |
| SCNN1A-3719 | + | GUGUGGGGCAGAGGGUGGG | 19 | 7568 |
| SCNN1A-3720 | + | GGUGUGGGGCAGAGGGUGGG | 20 | 7569 |
| SCNN1A-3721 | + | AGGUGUGGGGCAGAGGGUGGG | 21 | 7570 |
| SCNN1A-3722 | + | UAGGUGUGGGGCAGAGGGUGGG | 22 | 7571 |
| SCNN1A-3723 | + | UUAGGUGUGGGGCAGAGGGUGGG | 23 | 7572 |
| SCNN1A-3724 | + | CUUAGGUGUGGGGCAGAGGGUGGG | 24 | 7573 |
| SCNN1A-3725 | + | AGAGCCCCCUGGAGAUGG | 18 | 7574 |
| SCNN1A-3726 | + | CAGAGCCCCCUGGAGAUGG | 19 | 7575 |
| SCNN1A-3727 | + | GCAGAGCCCCCUGGAGAUGG | 20 | 7576 |
| SCNN1A-3728 | + | UGCAGAGCCCCCUGGAGAUGG | 21 | 7577 |
| SCNN1A-3729 | + | CUGCAGAGCCCCCUGGAGAUGG | 22 | 7578 |
| SCNN1A-3730 | + | CCUGCAGAGCCCCCUGGAGAUGG | 23 | 7579 |
| SCNN1A-3731 | + | CCCUGCAGAGCCCCCUGGAGAUGG | 24 | 7580 |
| SCNN1A-3732 | + | GAGUGAAUACACACCUGG | 18 | 7581 |
| SCNN1A-3733 | + | GGAGUGAAUACACACCUGG | 19 | 7582 |
| SCNN1A-3734 | + | AGGAGUGAAUACACACCUGG | 20 | 7583 |
| SCNN1A-3735 | + | CAGGAGUGAAUACACACCUGG | 21 | 7584 |
| SCNN1A-3736 | + | GCAGGAGUGAAUACACACCUGG | 22 | 7585 |
| SCNN1A-3737 | + | AGCAGGAGUGAAUACACACCUGG | 23 | 7586 |
| SCNN1A-3738 | + | AAGCAGGAGUGAAUACACACCUGG | 24 | 7587 |
| SCNN1A-3739 | + | UGGUUGCAGGAGACCUGG | 18 | 7588 |
| SCNN1A-3740 | + | CUGGUUGCAGGAGACCUGG | 19 | 7589 |
| SCNN1A-3741 | + | CCUGGUUGCAGGAGACCUGG | 20 | 7590 |
| SCNN1A-3742 | + | GCCUGGUUGCAGGAGACCUGG | 21 | 7591 |
| SCNN1A-3743 | + | CGCCUGGUUGCAGGAGACCUGG | 22 | 7592 |

TABLE 44G-continued

7th Tier

| gRNA Name | DNA Strand | Targeting Domain | Target Site Length | Seq ID |
|---|---|---|---|---|
| SCNN1A-3744 | + | ACGCCUGGUUGCAGGAGACCUGG | 23 | 7593 |
| SCNN1A-3745 | + | CACGCCUGGUUGCAGGAGACCUGG | 24 | 7594 |
| SCNN1A-3746 | + | AGAGGGAGCAGGGCCUGG | 18 | 7595 |
| SCNN1A-3747 | + | GAGAGGGAGCAGGGCCUGG | 19 | 7596 |
| SCNN1A-3748 | + | GGAGAGGGAGCAGGGCCUGG | 20 | 7597 |
| SCNN1A-3749 | + | UGGAGAGGGAGCAGGGCCUGG | 21 | 7598 |
| SCNN1A-3750 | + | CUGGAGAGGGAGCAGGGCCUGG | 22 | 7599 |
| SCNN1A-3751 | + | GCUGGAGAGGGAGCAGGGCCUGG | 23 | 7600 |
| SCNN1A-3752 | + | GGCUGGAGAGGGAGCAGGGCCUGG | 24 | 7601 |
| SCNN1A-3753 | + | CCUGAUGAGUAUGUCUGG | 18 | 7602 |
| SCNN1A-3754 | + | CCCUGAUGAGUAUGUCUGG | 19 | 7603 |
| SCNN1A-3755 | + | CCCCUGAUGAGUAUGUCUGG | 20 | 7604 |
| SCNN1A-3756 | + | ACCCCUGAUGAGUAUGUCUGG | 21 | 7605 |
| SCNN1A-3757 | + | CACCCCUGAUGAGUAUGUCUGG | 22 | 7606 |
| SCNN1A-3758 | + | CCACCCCUGAUGAGUAUGUCUGG | 23 | 7607 |
| SCNN1A-3759 | + | UCCACCCCUGAUGAGUAUGUCUGG | 24 | 7608 |
| SCNN1A-3760 | + | CCCCCAGAGGACAGGUGG | 18 | 7609 |
| SCNN1A-3761 | + | CCCCCCAGAGGACAGGUGG | 19 | 7610 |
| SCNN1A-1200 | + | CCCCCCCAGAGGACAGGUGG | 20 | 5049 |
| SCNN1A-3762 | + | GCCCCCCCAGAGGACAGGUGG | 21 | 7611 |
| SCNN1A-3763 | + | GGCCCCCCCAGAGGACAGGUGG | 22 | 7612 |
| SCNN1A-3764 | + | GGGCCCCCCCAGAGGACAGGUGG | 23 | 7613 |
| SCNN1A-3765 | + | AGGGCCCCCCCAGAGGACAGGUGG | 24 | 7614 |
| SCNN1A-3766 | + | UUUCCAUACAUCGGGUGG | 18 | 7615 |
| SCNN1A-3767 | + | GUUUCCAUACAUCGGGUGG | 19 | 7616 |
| SCNN1A-1202 | + | AGUUUCCAUACAUCGGGUGG | 20 | 5051 |
| SCNN1A-3768 | + | CAGUUUCCAUACAUCGGGUGG | 21 | 7617 |
| SCNN1A-3769 | + | GCAGUUUCCAUACAUCGGGUGG | 22 | 7618 |
| SCNN1A-3770 | + | AGCAGUUUCCAUACAUCGGGUGG | 23 | 7619 |
| SCNN1A-3771 | + | UAGCAGUUUCCAUACAUCGGGUGG | 24 | 7620 |
| SCNN1A-3772 | + | AACCUUCGGAGCAGCAUG | 18 | 7621 |
| SCNN1A-3773 | + | GAACCUUCGGAGCAGCAUG | 19 | 7622 |
| SCNN1A-1209 | + | GGAACCUUCGGAGCAGCAUG | 20 | 5058 |
| SCNN1A-3774 | + | CGGAACCUUCGGAGCAGCAUG | 21 | 7623 |
| SCNN1A-3775 | + | UCGGAACCUUCGGAGCAGCAUG | 22 | 7624 |
| SCNN1A-3776 | + | UUCGGAACCUUCGGAGCAGCAUG | 23 | 7625 |
| SCNN1A-3777 | + | CUUCGGAACCUUCGGAGCAGCAUG | 24 | 7626 |

TABLE 44G-continued

7th Tier

| gRNA Name | DNA Strand | Targeting Domain | Target Site Length | Seq ID |
|---|---|---|---|---|
| SCNN1A-3778 | + | CUGGUCACGCUGGGGAUG | 18 | 7627 |
| SCNN1A-3779 | + | GCUGGUCACGCUGGGGAUG | 19 | 7628 |
| SCNN1A-3780 | + | AGCUGGUCACGCUGGGGAUG | 20 | 7629 |
| SCNN1A-3781 | + | UAGCUGGUCACGCUGGGGAUG | 21 | 7630 |
| SCNN1A-3782 | + | GUAGCUGGUCACGCUGGGGAUG | 22 | 7631 |
| SCNN1A-3783 | + | GGUAGCUGGUCACGCUGGGGAUG | 23 | 7632 |
| SCNN1A-3784 | + | UGGUAGCUGGUCACGCUGGGGAUG | 24 | 7633 |
| SCNN1A-3785 | + | UUAAUUUCCGGGUACCUG | 18 | 7634 |
| SCNN1A-3786 | + | UUUAAUUUCCGGGUACCUG | 19 | 7635 |
| SCNN1A-3787 | + | CUUUAAUUUCCGGGUACCUG | 20 | 7636 |
| SCNN1A-3788 | + | UCUUUAAUUUCCGGGUACCUG | 21 | 7637 |
| SCNN1A-3789 | + | CUCUUUAAUUUCCGGGUACCUG | 22 | 7638 |
| SCNN1A-3790 | + | CCUCUUUAAUUUCCGGGUACCUG | 23 | 7639 |
| SCNN1A-3791 | + | UCCUCUUUAAUUUCCGGGUACCUG | 24 | 7640 |
| SCNN1A-3792 | + | UGGAGGAACUGGCCCCUG | 18 | 7641 |
| SCNN1A-3793 | + | GUGGAGGAACUGGCCCCUG | 19 | 7642 |
| SCNN1A-3794 | + | GGUGGAGGAACUGGCCCCUG | 20 | 7643 |
| SCNN1A-3795 | + | AGGUGGAGGAACUGGCCCCUG | 21 | 7644 |
| SCNN1A-3796 | + | CAGGUGGAGGAACUGGCCCCUG | 22 | 7645 |
| SCNN1A-3797 | + | ACAGGUGGAGGAACUGGCCCCUG | 23 | 7646 |
| SCNN1A-3798 | + | GACAGGUGGAGGAACUGGCCCCUG | 24 | 7647 |
| SCNN1A-3799 | + | GAGGGGCUGUCAAGGCUG | 18 | 7648 |
| SCNN1A-3800 | + | GGAGGGGCUGUCAAGGCUG | 19 | 7649 |
| SCNN1A-3801 | + | GGGAGGGGCUGUCAAGGCUG | 20 | 7650 |
| SCNN1A-3802 | + | GGGGAGGGGCUGUCAAGGCUG | 21 | 7651 |
| SCNN1A-3803 | + | GGGGGAGGGGCUGUCAAGGCUG | 22 | 7652 |
| SCNN1A-3804 | + | AGGGGGAGGGGCUGUCAAGGCUG | 23 | 7653 |
| SCNN1A-3805 | + | CAGGGGGAGGGGCUGUCAAGGCUG | 24 | 7654 |
| SCNN1A-3806 | + | CGCAGGUCGCGACGGCUG | 18 | 7655 |
| SCNN1A-3807 | + | CCGCAGGUCGCGACGGCUG | 19 | 7656 |
| SCNN1A-1223 | + | CCCGCAGGUCGCGACGGCUG | 20 | 5072 |
| SCNN1A-3808 | + | CCCCGCAGGUCGCGACGGCUG | 21 | 7657 |
| SCNN1A-3809 | + | CCCCCGCAGGUCGCGACGGCUG | 22 | 7658 |
| SCNN1A-3810 | + | UCCCCCGCAGGUCGCGACGGCUG | 23 | 7659 |
| SCNN1A-3811 | + | GUCCCCCGCAGGUCGCGACGGCUG | 24 | 7660 |
| SCNN1A-3812 | + | CUUGCCUUCCUCAUGCUG | 18 | 7661 |
| SCNN1A-3813 | + | CCUUGCCUUCCUCAUGCUG | 19 | 7662 |
| SCNN1A-3814 | + | UCCUUGCCUUCCUCAUGCUG | 20 | 7663 |

TABLE 44G-continued

7th Tier

| gRNA Name | DNA Strand | Targeting Domain | Target Site Length | Seq ID |
|---|---|---|---|---|
| SCNN1A-3815 | + | AUCCUUGCCUUCCUCAUGCUG | 21 | 7664 |
| SCNN1A-3816 | + | CAUCCUUGCCUUCCUCAUGCUG | 22 | 7665 |
| SCNN1A-3817 | + | GCAUCCUUGCCUUCCUCAUGCUG | 23 | 7666 |
| SCNN1A-3818 | + | AGCAUCCUUGCCUUCCUCAUGCUG | 24 | 7667 |
| SCNN1A-3819 | + | AACAGCCCAGGUGGUCUG | 18 | 7668 |
| SCNN1A-3820 | + | AAACAGCCCAGGUGGUCUG | 19 | 7669 |
| SCNN1A-1225 | + | GAAACAGCCCAGGUGGUCUG | 20 | 5074 |
| SCNN1A-3821 | + | UGAAACAGCCCAGGUGGUCUG | 21 | 7670 |
| SCNN1A-3822 | + | GUGAAACAGCCCAGGUGGUCUG | 22 | 7671 |
| SCNN1A-3823 | + | GGUGAAACAGCCCAGGUGGUCUG | 23 | 7672 |
| SCNN1A-3824 | + | UGGUGAAACAGCCCAGGUGGUCUG | 24 | 7673 |
| SCNN1A-3825 | + | GAGCCGGCCACGAGAGUG | 18 | 7674 |
| SCNN1A-3826 | + | GGAGCCGGCCACGAGAGUG | 19 | 7675 |
| SCNN1A-3827 | + | GGGAGCCGGCCACGAGAGUG | 20 | 7676 |
| SCNN1A-3828 | + | CGGGAGCCGGCCACGAGAGUG | 21 | 7677 |
| SCNN1A-3829 | + | GCGGGAGCCGGCCACGAGAGUG | 22 | 7678 |
| SCNN1A-3830 | + | UGCGGGAGCCGGCCACGAGAGUG | 23 | 7679 |
| SCNN1A-3831 | + | CUGCGGGAGCCGGCCACGAGAGUG | 24 | 7680 |
| SCNN1A-3832 | + | CCCCCCAGAGGACAGGUG | 18 | 7681 |
| SCNN1A-3833 | + | CCCCCCCAGAGGACAGGUG | 19 | 7682 |
| SCNN1A-3834 | + | GCCCCCCCAGAGGACAGGUG | 20 | 7683 |
| SCNN1A-3835 | + | GGCCCCCCCAGAGGACAGGUG | 21 | 7684 |
| SCNN1A-3836 | + | GGGCCCCCCCAGAGGACAGGUG | 22 | 7685 |
| SCNN1A-3837 | + | AGGGCCCCCCCAGAGGACAGGUG | 23 | 7686 |
| SCNN1A-3838 | + | CAGGGCCCCCCCAGAGGACAGGUG | 24 | 7687 |
| SCNN1A-3839 | + | CACUCCAUUUCUUAGGUG | 18 | 7688 |
| SCNN1A-3840 | + | CCACUCCAUUUCUUAGGUG | 19 | 7689 |
| SCNN1A-1232 | + | GCCACUCCAUUUCUUAGGUG | 20 | 5081 |
| SCNN1A-3841 | + | GGCCACUCCAUUUCUUAGGUG | 21 | 7690 |
| SCNN1A-3842 | + | UGGCCACUCCAUUUCUUAGGUG | 22 | 7691 |
| SCNN1A-3843 | + | UUGGCCACUCCAUUUCUUAGGUG | 23 | 7692 |
| SCNN1A-3844 | + | UUUGGCCACUCCAUUUCUUAGGUG | 24 | 7693 |
| SCNN1A-3845 | + | CUGGAAGGGAGGAGGGUG | 18 | 7694 |
| SCNN1A-3846 | + | CCUGGAAGGGAGGAGGGUG | 19 | 7695 |
| SCNN1A-3847 | + | ACCUGGAAGGGAGGAGGGUG | 20 | 7696 |
| SCNN1A-3848 | + | CACCUGGAAGGGAGGAGGGUG | 21 | 7697 |
| SCNN1A-3849 | + | ACACCUGGAAGGGAGGAGGGUG | 22 | 7698 |

TABLE 44G-continued

7th Tier

| gRNA Name | DNA Strand | Targeting Domain | Target Site Length | Seq ID |
|---|---|---|---|---|
| SCNN1A-3850 | + | CACACCUGGAAGGGAGGAGGGUG | 23 | 7699 |
| SCNN1A-3851 | + | ACACACCUGGAAGGGAGGAGGGUG | 24 | 7700 |
| SCNN1A-3852 | + | GUUUCCAUACAUCGGGUG | 18 | 7701 |
| SCNN1A-3853 | + | AGUUUCCAUACAUCGGGUG | 19 | 7702 |
| SCNN1A-3854 | + | CAGUUUCCAUACAUCGGGUG | 20 | 7703 |
| SCNN1A-3855 | + | GCAGUUUCCAUACAUCGGGUG | 21 | 7704 |
| SCNN1A-3856 | + | AGCAGUUUCCAUACAUCGGGUG | 22 | 7705 |
| SCNN1A-3857 | + | UAGCAGUUUCCAUACAUCGGGUG | 23 | 7706 |
| SCNN1A-3858 | + | AUAGCAGUUUCCAUACAUCGGGUG | 24 | 7707 |
| SCNN1A-3859 | + | GGGACAGACCUAGGGGUG | 18 | 7708 |
| SCNN1A-3860 | + | AGGGACAGACCUAGGGGUG | 19 | 7709 |
| SCNN1A-3861 | + | CAGGGACAGACCUAGGGGUG | 20 | 7710 |
| SCNN1A-3862 | + | UCAGGGACAGACCUAGGGGUG | 21 | 7711 |
| SCNN1A-3863 | + | AUCAGGGACAGACCUAGGGGUG | 22 | 7712 |
| SCNN1A-3864 | + | CAUCAGGGACAGACCUAGGGGUG | 23 | 7713 |
| SCNN1A-3865 | + | GCAUCAGGGACAGACCUAGGGGUG | 24 | 7714 |
| SCNN1A-3866 | + | CCGGCCACGAGAGUGGUG | 18 | 7715 |
| SCNN1A-3867 | + | GCCGGCCACGAGAGUGGUG | 19 | 7716 |
| SCNN1A-3868 | + | AGCCGGCCACGAGAGUGGUG | 20 | 7717 |
| SCNN1A-3869 | + | GAGCCGGCCACGAGAGUGGUG | 21 | 7718 |
| SCNN1A-3870 | + | GGAGCCGGCCACGAGAGUGGUG | 22 | 7719 |
| SCNN1A-3871 | + | GGGAGCCGGCCACGAGAGUGGUG | 23 | 7720 |
| SCNN1A-3872 | + | CGGGAGCCGGCCACGAGAGUGGUG | 24 | 7721 |
| SCNN1A-3873 | + | CAUGGCUUCCGGCACUUG | 18 | 7722 |
| SCNN1A-3874 | + | GCAUGGCUUCCGGCACUUG | 19 | 7723 |
| SCNN1A-3875 | + | UGCAUGGCUUCCGGCACUUG | 20 | 7724 |
| SCNN1A-3876 | + | CUGCAUGGCUUCCGGCACUUG | 21 | 7725 |
| SCNN1A-3877 | + | CCUGCAUGGCUUCCGGCACUUG | 22 | 7726 |
| SCNN1A-3878 | + | ACCUGCAUGGCUUCCGGCACUUG | 23 | 7727 |
| SCNN1A-3879 | + | AACCUGCAUGGCUUCCGGCACUUG | 24 | 7728 |
| SCNN1A-3880 | + | UUGUAGUUCAGCUCCUUG | 18 | 7729 |
| SCNN1A-3881 | + | UUUGUAGUUCAGCUCCUUG | 19 | 7730 |
| SCNN1A-3882 | + | UUUUGUAGUUCAGCUCCUUG | 20 | 7731 |
| SCNN1A-3883 | + | GUUUUGUAGUUCAGCUCCUUG | 21 | 7732 |
| SCNN1A-3884 | + | GGUUUUGUAGUUCAGCUCCUUG | 22 | 7733 |
| SCNN1A-3885 | + | UGGUUUUGUAGUUCAGCUCCUUG | 23 | 7734 |
| SCNN1A-3886 | + | UUGGUUUUGUAGUUCAGCUCCUUG | 24 | 7735 |
| SCNN1A-3887 | + | CUGACUCACGCCUGGUUG | 18 | 7736 |

TABLE 44G-continued

7th Tier

| gRNA Name | DNA Strand | Targeting Domain | Target Site Length | Seq ID |
|---|---|---|---|---|
| SCNN1A-3888 | + | ACUGACUCACGCCUGGUUG | 19 | 7737 |
| SCNN1A-3889 | + | GACUGACUCACGCCUGGUUG | 20 | 7738 |
| SCNN1A-3890 | + | GGACUGACUCACGCCUGGUUG | 21 | 7739 |
| SCNN1A-3891 | + | AGGACUGACUCACGCCUGGUUG | 22 | 7740 |
| SCNN1A-3892 | + | CAGGACUGACUCACGCCUGGUUG | 23 | 7741 |
| SCNN1A-3893 | + | GCAGGACUGACUCACGCCUGGUUG | 24 | 7742 |
| SCNN1A-3894 | + | GAACCUUCGGAGCAGCAU | 18 | 7743 |
| SCNN1A-3895 | + | GGAACCUUCGGAGCAGCAU | 19 | 7744 |
| SCNN1A-3896 | + | CGGAACCUUCGGAGCAGCAU | 20 | 7745 |
| SCNN1A-3897 | + | UCGGAACCUUCGGAGCAGCAU | 21 | 7746 |
| SCNN1A-3898 | + | UUCGGAACCUUCGGAGCAGCAU | 22 | 7747 |
| SCNN1A-3899 | + | CUUCGGAACCUUCGGAGCAGCAU | 23 | 7748 |
| SCNN1A-3900 | + | GCUUCGGAACCUUCGGAGCAGCAU | 24 | 7749 |
| SCNN1A-3901 | + | CUGCUCUGCGCGCAGCAU | 18 | 7750 |
| SCNN1A-3902 | + | UCUGCUCUGCGCGCAGCAU | 19 | 7751 |
| SCNN1A-3903 | + | UUCUGCUCUGCGCGCAGCAU | 20 | 7752 |
| SCNN1A-3904 | + | AUUCUGCUCUGCGCGCAGCAU | 21 | 7753 |
| SCNN1A-3905 | + | CAUUCUGCUCUGCGCGCAGCAU | 22 | 7754 |
| SCNN1A-3906 | + | UCAUUCUGCUCUGCGCGCAGCAU | 23 | 7755 |
| SCNN1A-3907 | + | GUCAUUCUGCUCUGCGCGCAGCAU | 24 | 7756 |
| SCNN1A-3908 | + | GUUCUGUCGCGAUAGCAU | 18 | 7757 |
| SCNN1A-3909 | + | UGUUCUGUCGCGAUAGCAU | 19 | 7758 |
| SCNN1A-3910 | + | UUGUUCUGUCGCGAUAGCAU | 20 | 7759 |
| SCNN1A-3911 | + | AUUGUUCUGUCGCGAUAGCAU | 21 | 7760 |
| SCNN1A-3912 | + | AAUUGUUCUGUCGCGAUAGCAU | 22 | 7761 |
| SCNN1A-3913 | + | UAAUUGUUCUGUCGCGAUAGCAU | 23 | 7762 |
| SCNN1A-3914 | + | GUAAUUGUUCUGUCGCGAUAGCAU | 24 | 7763 |
| SCNN1A-3915 | + | GUGAGAGUAAUUCCUUAU | 18 | 7764 |
| SCNN1A-3916 | + | AGUGAGAGUAAUUCCUUAU | 19 | 7765 |
| SCNN1A-3917 | + | AAGUGAGAGUAAUUCCUUAU | 20 | 7766 |
| SCNN1A-3918 | + | GAAGUGAGAGUAAUUCCUUAU | 21 | 7767 |
| SCNN1A-3919 | + | GGAAGUGAGAGUAAUUCCUUAU | 22 | 7768 |
| SCNN1A-3920 | + | UGGAAGUGAGAGUAAUUCCUUAU | 23 | 7769 |
| SCNN1A-3921 | + | GUGGAAGUGAGAGUAAUUCCUUAU | 24 | 7770 |
| SCNN1A-3922 | + | ACCCGGGCCCCAGUCACU | 18 | 7771 |
| SCNN1A-3923 | + | UACCCGGGCCCCAGUCACU | 19 | 7772 |
| SCNN1A-3924 | + | UUACCCGGGCCCCAGUCACU | 20 | 7773 |

TABLE 44G-continued

7th Tier

| gRNA Name | DNA Strand | Targeting Domain | Target Site Length | Seq ID |
|---|---|---|---|---|
| SCNN1A-3925 | + | AUUACCCGGGCCCCAGUCACU | 21 | 7774 |
| SCNN1A-3926 | + | CAUUACCCGGGCCCCAGUCACU | 22 | 7775 |
| SCNN1A-3927 | + | CCAUUACCCGGGCCCCAGUCACU | 23 | 7776 |
| SCNN1A-3928 | + | ACCAUUACCCGGGCCCCAGUCACU | 24 | 7777 |
| SCNN1A-3929 | + | UCACCUGCUGUGUGUACU | 18 | 7778 |
| SCNN1A-3930 | + | CUCACCUGCUGUGUGUACU | 19 | 7779 |
| SCNN1A-3931 | + | CCUCACCUGCUGUGUGUACU | 20 | 7780 |
| SCNN1A-3932 | + | GCCUCACCUGCUGUGUGUACU | 21 | 7781 |
| SCNN1A-3933 | + | GGCCUCACCUGCUGUGUGUACU | 22 | 7782 |
| SCNN1A-3934 | + | GGGCCUCACCUGCUGUGUGUACU | 23 | 7783 |
| SCNN1A-3935 | + | UGGGCCUCACCUGCUGUGUGUACU | 24 | 7784 |
| SCNN1A-3936 | + | GUAUCGGCUUCGGAACCU | 18 | 7785 |
| SCNN1A-3937 | + | AGUAUCGGCUUCGGAACCU | 19 | 7786 |
| SCNN1A-3938 | + | CAGUAUCGGCUUCGGAACCU | 20 | 7787 |
| SCNN1A-3939 | + | CCAGUAUCGGCUUCGGAACCU | 21 | 7788 |
| SCNN1A-3940 | + | ACCAGUAUCGGCUUCGGAACCU | 22 | 7789 |
| SCNN1A-3941 | + | GACCAGUAUCGGCUUCGGAACCU | 23 | 7790 |
| SCNN1A-3942 | + | AGACCAGUAUCGGCUUCGGAACCU | 24 | 7791 |
| SCNN1A-3943 | + | UCUGGAAGACCCAUUCCU | 18 | 7792 |
| SCNN1A-3944 | + | AUCUGGAAGACCCAUUCCU | 19 | 7793 |
| SCNN1A-1270 | + | CAUCUGGAAGACCCAUUCCU | 20 | 5119 |
| SCNN1A-3945 | + | GCAUCUGGAAGACCCAUUCCU | 21 | 7794 |
| SCNN1A-3946 | + | AGCAUCUGGAAGACCCAUUCCU | 22 | 7795 |
| SCNN1A-3947 | + | UAGCAUCUGGAAGACCCAUUCCU | 23 | 7796 |
| SCNN1A-3948 | + | AUAGCAUCUGGAAGACCCAUUCCU | 24 | 7797 |
| SCNN1A-3949 | + | GUCUGUCCAGGGUUUCCU | 18 | 7798 |
| SCNN1A-3950 | + | AGUCUGUCCAGGGUUUCCU | 19 | 7799 |
| SCNN1A-3951 | + | AAGUCUGUCCAGGGUUUCCU | 20 | 7800 |
| SCNN1A-3952 | + | CAAGUCUGUCCAGGGUUUCCU | 21 | 7801 |
| SCNN1A-3953 | + | CCAAGUCUGUCCAGGGUUUCCU | 22 | 7802 |
| SCNN1A-3954 | + | CCCAAGUCUGUCCAGGGUUUCCU | 23 | 7803 |
| SCNN1A-3955 | + | CCCCAAGUCUGUCCAGGGUUUCCU | 24 | 7804 |
| SCNN1A-3956 | + | CAAGCUGGAGGCCACGCU | 18 | 7805 |
| SCNN1A-3957 | + | GCAAGCUGGAGGCCACGCU | 19 | 7806 |
| SCNN1A-3958 | + | CGCAAGCUGGAGGCCACGCU | 20 | 7807 |
| SCNN1A-3959 | + | CCGCAAGCUGGAGGCCACGCU | 21 | 7808 |
| SCNN1A-3960 | + | CCCGCAAGCUGGAGGCCACGCU | 22 | 7809 |
| SCNN1A-3961 | + | UCCCGCAAGCUGGAGGCCACGCU | 23 | 7810 |

TABLE 44G-continued

7th Tier

| gRNA Name | DNA Strand | Targeting Domain | Target Site Length | Seq ID |
|---|---|---|---|---|
| SCNN1A-3962 | + | GUCCCGCAAGCUGGAGGCCACGCU | 24 | 7811 |
| SCNN1A-3963 | + | CCGCAGGUCGCGACGGCU | 18 | 7812 |
| SCNN1A-3964 | + | CCCGCAGGUCGCGACGGCU | 19 | 7813 |
| SCNN1A-3965 | + | CCCCGCAGGUCGCGACGGCU | 20 | 7814 |
| SCNN1A-3966 | + | CCCCCGCAGGUCGCGACGGCU | 21 | 7815 |
| SCNN1A-3967 | + | UCCCCCGCAGGUCGCGACGGCU | 22 | 7816 |
| SCNN1A-3968 | + | GUCCCCCGCAGGUCGCGACGGCU | 23 | 7817 |
| SCNN1A-3969 | + | AGUCCCCCGCAGGUCGCGACGGCU | 24 | 7818 |
| SCNN1A-3970 | + | UGGAGACCAGUAUCGGCU | 18 | 7819 |
| SCNN1A-3971 | + | CUGGAGACCAGUAUCGGCU | 19 | 7820 |
| SCNN1A-3972 | + | CCUGGAGACCAGUAUCGGCU | 20 | 7821 |
| SCNN1A-3973 | + | GCCUGGAGACCAGUAUCGGCU | 21 | 7822 |
| SCNN1A-3974 | + | GGCCUGGAGACCAGUAUCGGCU | 22 | 7823 |
| SCNN1A-3975 | + | CGGCCUGGAGACCAGUAUCGGCU | 23 | 7824 |
| SCNN1A-3976 | + | UCGGCCUGGAGACCAGUAUCGGCU | 24 | 7825 |
| SCNN1A-3977 | + | ACAGGAGGGUGACCAUCU | 18 | 7826 |
| SCNN1A-3978 | + | GACAGGAGGGUGACCAUCU | 19 | 7827 |
| SCNN1A-3979 | + | GGACAGGAGGGUGACCAUCU | 20 | 7828 |
| SCNN1A-3980 | + | UGGACAGGAGGGUGACCAUCU | 21 | 7829 |
| SCNN1A-3981 | + | UUGGACAGGAGGGUGACCAUCU | 22 | 7830 |
| SCNN1A-3982 | + | GUUGGACAGGAGGGUGACCAUCU | 23 | 7831 |
| SCNN1A-3983 | + | GGUUGGACAGGAGGGUGACCAUCU | 24 | 7832 |
| SCNN1A-3984 | + | AAACCUCUCCUUCCCUCU | 18 | 7833 |
| SCNN1A-3985 | + | GAAACCUCUCCUUCCCUCU | 19 | 7834 |
| SCNN1A-3986 | + | AGAAACCUCUCCUUCCCUCU | 20 | 7835 |
| SCNN1A-3987 | + | GAGAAACCUCUCCUUCCCUCU | 21 | 7836 |
| SCNN1A-3988 | + | UGAGAAACCUCUCCUUCCCUCU | 22 | 7837 |
| SCNN1A-3989 | + | GUGAGAAACCUCUCCUUCCCUCU | 23 | 7838 |
| SCNN1A-3990 | + | UGUGAGAAACCUCUCCUUCCCUCU | 24 | 7839 |
| SCNN1A-3991 | + | AAACAGCCCAGGUGGUCU | 18 | 7840 |
| SCNN1A-3992 | + | GAAACAGCCCAGGUGGUCU | 19 | 7841 |
| SCNN1A-3993 | + | UGAAACAGCCCAGGUGGUCU | 20 | 7842 |
| SCNN1A-3994 | + | GUGAAACAGCCCAGGUGGUCU | 21 | 7843 |
| SCNN1A-3995 | + | GGUGAAACAGCCCAGGUGGUCU | 22 | 7844 |
| SCNN1A-3996 | + | UGGUGAAACAGCCCAGGUGGUCU | 23 | 7845 |
| SCNN1A-3997 | + | UUGGUGAAACAGCCCAGGUGGUCU | 24 | 7846 |
| SCNN1A-3998 | + | UGGGGUGGGGCAGAAGU | 18 | 7847 |

TABLE 44G-continued

7th Tier

| gRNA Name | DNA Strand | Targeting Domain | Target Site Length | Seq ID |
|---|---|---|---|---|
| SCNN1A-3999 | + | AUGGGGUGGGGGCAGAAGU | 19 | 7848 |
| SCNN1A-1279 | + | CAUGGGGUGGGGGCAGAAGU | 20 | 5128 |
| SCNN1A-4000 | + | ACAUGGGGUGGGGGCAGAAGU | 21 | 7849 |
| SCNN1A-4001 | + | GACAUGGGGUGGGGGCAGAAGU | 22 | 7850 |
| SCNN1A-4002 | + | AGACAUGGGGUGGGGGCAGAAGU | 23 | 7851 |
| SCNN1A-4003 | + | GAGACAUGGGGUGGGGGCAGAAGU | 24 | 7852 |
| SCNN1A-4004 | + | GGACACAGAGACUAGAGU | 18 | 7853 |
| SCNN1A-4005 | + | UGGACACAGAGACUAGAGU | 19 | 7854 |
| SCNN1A-4006 | + | CUGGACACAGAGACUAGAGU | 20 | 7855 |
| SCNN1A-4007 | + | ACUGGACACAGAGACUAGAGU | 21 | 7856 |
| SCNN1A-4008 | + | CACUGGACACAGAGACUAGAGU | 22 | 7857 |
| SCNN1A-4009 | + | GCACUGGACACAGAGACUAGAGU | 23 | 7858 |
| SCNN1A-4010 | + | UGCACUGGACACAGAGACUAGAGU | 24 | 7859 |
| SCNN1A-4011 | + | CCACUCCAUUUCUUAGGU | 18 | 7860 |
| SCNN1A-4012 | + | GCCACUCCAUUUCUUAGGU | 19 | 7861 |
| SCNN1A-4013 | + | GGCCACUCCAUUUCUUAGGU | 20 | 7862 |
| SCNN1A-4014 | + | UGGCCACUCCAUUUCUUAGGU | 21 | 7863 |
| SCNN1A-4015 | + | UUGGCCACUCCAUUUCUUAGGU | 22 | 7864 |
| SCNN1A-4016 | + | UUUGGCCACUCCAUUUCUUAGGU | 23 | 7865 |
| SCNN1A-4017 | + | CUUUGGCCACUCCAUUUCUUAGGU | 24 | 7866 |
| SCNN1A-4018 | + | AGGUGUGGGGCAGAGGGU | 18 | 7867 |
| SCNN1A-4019 | + | UAGGUGUGGGGCAGAGGGU | 19 | 7868 |
| SCNN1A-1286 | + | UUAGGUGUGGGGCAGAGGGU | 20 | 5135 |
| SCNN1A-4020 | + | CUUAGGUGUGGGGCAGAGGGU | 21 | 7869 |
| SCNN1A-4021 | + | UCUUAGGUGUGGGGCAGAGGGU | 22 | 7870 |
| SCNN1A-4022 | + | UUCUUAGGUGUGGGGCAGAGGGU | 23 | 7871 |
| SCNN1A-4023 | + | UUUCUUAGGUGUGGGGCAGAGGGU | 24 | 7872 |
| SCNN1A-4024 | + | GGAAAGAGAGAGUAGGGU | 18 | 7873 |
| SCNN1A-4025 | + | AGGAAAGAGAGAGUAGGGU | 19 | 7874 |
| SCNN1A-4026 | + | CAGGAAAGAGAGAGUAGGGU | 20 | 7875 |
| SCNN1A-4027 | + | UCAGGAAAGAGAGAGUAGGGU | 21 | 7876 |
| SCNN1A-4028 | + | AUCAGGAAAGAGAGAGUAGGGU | 22 | 7877 |
| SCNN1A-4029 | + | UAUCAGGAAAGAGAGAGUAGGGU | 23 | 7878 |
| SCNN1A-4030 | + | UUAUCAGGAAAGAGAGAGUAGGGU | 24 | 7879 |
| SCNN1A-4031 | + | AGGACAGAGACAUGGGGU | 18 | 7880 |
| SCNN1A-4032 | + | AAGGACAGAGACAUGGGGU | 19 | 7881 |
| SCNN1A-1287 | + | CAAGGACAGAGACAUGGGGU | 20 | 5136 |
| SCNN1A-4033 | + | ACAAGGACAGAGACAUGGGGU | 21 | 7882 |

TABLE 44G-continued

7th Tier

| gRNA Name | DNA Strand | Targeting Domain | Target Site Length | Seq ID |
|---|---|---|---|---|
| SCNN1A-4034 | + | GACAAGGACAGAGACAUGGGGU | 22 | 7883 |
| SCNN1A-4035 | + | GGACAAGGACAGAGACAUGGGGU | 23 | 7884 |
| SCNN1A-4036 | + | GGGACAAGGACAGAGACAUGGGGU | 24 | 7885 |
| SCNN1A-4037 | + | UGAAACAGCCCAGGUGGU | 18 | 7886 |
| SCNN1A-4038 | + | GUGAAACAGCCCAGGUGGU | 19 | 7887 |
| SCNN1A-4039 | + | GGUGAAACAGCCCAGGUGGU | 20 | 7888 |
| SCNN1A-4040 | + | UGGUGAAACAGCCCAGGUGGU | 21 | 7889 |
| SCNN1A-4041 | + | UUGGUGAAACAGCCCAGGUGGU | 22 | 7890 |
| SCNN1A-4042 | + | CUUGGUGAAACAGCCCAGGUGGU | 23 | 7891 |
| SCNN1A-4043 | + | ACUUGGUGAAACAGCCCAGGUGGU | 24 | 7892 |
| SCNN1A-4044 | + | AGGAGGGUGACCAUCUGU | 18 | 7893 |
| SCNN1A-4045 | + | CAGGAGGGUGACCAUCUGU | 19 | 7894 |
| SCNN1A-4046 | + | ACAGGAGGGUGACCAUCUGU | 20 | 7895 |
| SCNN1A-4047 | + | GACAGGAGGGUGACCAUCUGU | 21 | 7896 |
| SCNN1A-4048 | + | GGACAGGAGGGUGACCAUCUGU | 22 | 7897 |
| SCNN1A-4049 | + | UGGACAGGAGGGUGACCAUCUGU | 23 | 7898 |
| SCNN1A-4050 | + | UUGGACAGGAGGGUGACCAUCUGU | 24 | 7899 |
| SCNN1A-4051 | + | UAUCGGCUUCGGAACCUU | 18 | 7900 |
| SCNN1A-4052 | + | GUAUCGGCUUCGGAACCUU | 19 | 7901 |
| SCNN1A-1297 | + | AGUAUCGGCUUCGGAACCUU | 20 | 5146 |
| SCNN1A-4053 | + | CAGUAUCGGCUUCGGAACCUU | 21 | 7902 |
| SCNN1A-4054 | + | CCAGUAUCGGCUUCGGAACCUU | 22 | 7903 |
| SCNN1A-4055 | + | ACCAGUAUCGGCUUCGGAACCUU | 23 | 7904 |
| SCNN1A-4056 | + | GACCAGUAUCGGCUUCGGAACCUU | 24 | 7905 |
| SCNN1A-4057 | + | GGAGACCAGUAUCGGCUU | 18 | 7906 |
| SCNN1A-4058 | + | UGGAGACCAGUAUCGGCUU | 19 | 7907 |
| SCNN1A-1298 | + | CUGGAGACCAGUAUCGGCUU | 20 | 5147 |
| SCNN1A-4059 | + | CCUGGAGACCAGUAUCGGCUU | 21 | 7908 |
| SCNN1A-4060 | + | GCCUGGAGACCAGUAUCGGCUU | 22 | 7909 |
| SCNN1A-4061 | + | GGCCUGGAGACCAGUAUCGGCUU | 23 | 7910 |
| SCNN1A-4062 | + | CGGCCUGGAGACCAGUAUCGGCUU | 24 | 7911 |
| SCNN1A-4063 | + | GUCACAGUACUCCACGUU | 18 | 7912 |
| SCNN1A-4064 | + | AGUCACAGUACUCCACGUU | 19 | 7913 |
| SCNN1A-4065 | + | UAGUCACAGUACUCCACGUU | 20 | 7914 |
| SCNN1A-4066 | + | GUAGUCACAGUACUCCACGUU | 21 | 7915 |
| SCNN1A-4067 | + | UGUAGUCACAGUACUCCACGUU | 22 | 7916 |
| SCNN1A-4068 | + | CUGUAGUCACAGUACUCCACGUU | 23 | 7917 |

TABLE 44G-continued

7th Tier

| gRNA Name | DNA Strand | Targeting Domain | Target Site Length | Seq ID |
|---|---|---|---|---|
| SCNN1A-4069 | + | UCUGUAGUCACAGUACUCCACGUU | 24 | 7918 |
| SCNN1A-4070 | - | CAGUGCAACCAGAACAAA | 18 | 7919 |
| SCNN1A-4071 | - | CCAGUGCAACCAGAACAAA | 19 | 7920 |
| SCNN1A-4072 | - | UCCAGUGCAACCAGAACAAA | 20 | 7921 |
| SCNN1A-4073 | - | GUCCAGUGCAACCAGAACAAA | 21 | 7922 |
| SCNN1A-4074 | - | UGUCCAGUGCAACCAGAACAAA | 22 | 7923 |
| SCNN1A-4075 | - | GUGUCCAGUGCAACCAGAACAAA | 23 | 7924 |
| SCNN1A-4076 | - | UGUGUCCAGUGCAACCAGAACAAA | 24 | 7925 |
| SCNN1A-4077 | - | AGGUACCCGGAAAUUAAA | 18 | 7926 |
| SCNN1A-4078 | - | CAGGUACCCGGAAAUUAAA | 19 | 7927 |
| SCNN1A-4079 | - | UCAGGUACCCGGAAAUUAAA | 20 | 7928 |
| SCNN1A-4080 | - | UUCAGGUACCCGGAAAUUAAA | 21 | 7929 |
| SCNN1A-4081 | - | CUUCAGGUACCCGGAAAUUAAA | 22 | 7930 |
| SCNN1A-4082 | - | CCUUCAGGUACCCGGAAAUUAAA | 23 | 7931 |
| SCNN1A-4083 | - | CCCUUCAGGUACCCGGAAAUUAAA | 24 | 7932 |
| SCNN1A-4084 | - | CUGCCCCACACCUAAGAA | 18 | 7933 |
| SCNN1A-4085 | - | UCUGCCCCACACCUAAGAA | 19 | 7934 |
| SCNN1A-4086 | - | CUCUGCCCCACACCUAAGAA | 20 | 7935 |
| SCNN1A-4087 | - | CCUCUGCCCCACACCUAAGAA | 21 | 7936 |
| SCNN1A-4088 | - | CCCUCUGCCCCACACCUAAGAA | 22 | 7937 |
| SCNN1A-4089 | - | ACCCUCUGCCCCACACCUAAGAA | 23 | 7938 |
| SCNN1A-4090 | - | CACCCUCUGCCCCACACCUAAGAA | 24 | 7939 |
| SCNN1A-4091 | - | GUCCAACCUGGGCAGCCA | 18 | 7940 |
| SCNN1A-4092 | - | UGUCCAACCUGGGCAGCCA | 19 | 7941 |
| SCNN1A-4093 | - | CUGUCCAACCUGGGCAGCCA | 20 | 7942 |
| SCNN1A-4094 | - | CCUGUCCAACCUGGGCAGCCA | 21 | 7943 |
| SCNN1A-4095 | - | UCCUGUCCAACCUGGGCAGCCA | 22 | 7944 |
| SCNN1A-4096 | - | CUCCUGUCCAACCUGGGCAGCCA | 23 | 7945 |
| SCNN1A-4097 | - | CCUCCUGUCCAACCUGGGCAGCCA | 24 | 7946 |
| SCNN1A-4098 | - | UCCUGGGGUGAGACUCCA | 18 | 7947 |
| SCNN1A-4099 | - | UUCCUGGGGUGAGACUCCA | 19 | 7948 |
| SCNN1A-904 | - | GUUCCUGGGGUGAGACUCCA | 20 | 4753 |
| SCNN1A-4100 | - | AGUUCCUGGGGUGAGACUCCA | 21 | 7949 |
| SCNN1A-4101 | - | CAGUUCCUGGGGUGAGACUCCA | 22 | 7950 |
| SCNN1A-4102 | - | ACAGUUCCUGGGGUGAGACUCCA | 23 | 7951 |
| SCNN1A-4103 | - | CACAGUUCCUGGGGUGAGACUCCA | 24 | 7952 |
| SCNN1A-4104 | - | GGCCCCCGCCCAUCUCCA | 18 | 7953 |
| SCNN1A-4105 | - | GGGCCCCCGCCCAUCUCCA | 19 | 7954 |

TABLE 44G-continued

7th Tier

| gRNA Name | DNA Strand | Targeting Domain | Target Site Length | Seq ID |
|---|---|---|---|---|
| SCNN1A-907 | - | UGGGCCCCCGCCCAUCUCCA | 20 | 4756 |
| SCNN1A-4106 | - | CUGGGCCCCCGCCCAUCUCCA | 21 | 7955 |
| SCNN1A-4107 | - | CCUGGGCCCCCGCCCAUCUCCA | 22 | 7956 |
| SCNN1A-4108 | - | CCCUGGGCCCCCGCCCAUCUCCA | 23 | 7957 |
| SCNN1A-4109 | - | ACCCUGGGCCCCCGCCCAUCUCCA | 24 | 7958 |
| SCNN1A-4110 | - | AGGAGCUGGACCGCAUCA | 18 | 7959 |
| SCNN1A-4111 | - | GAGGAGCUGGACCGCAUCA | 19 | 7960 |
| SCNN1A-4112 | - | GGAGGAGCUGGACCGCAUCA | 20 | 7961 |
| SCNN1A-4113 | - | UGGAGGAGCUGGACCGCAUCA | 21 | 7962 |
| SCNN1A-4114 | - | CUGGAGGAGCUGGACCGCAUCA | 22 | 7963 |
| SCNN1A-4115 | - | GCUGGAGGAGCUGGACCGCAUCA | 23 | 7964 |
| SCNN1A-4116 | - | AGCUGGAGGAGCUGGACCGCAUCA | 24 | 7965 |
| SCNN1A-4117 | - | GGUCCCGCCCCCGCCUCA | 18 | 7966 |
| SCNN1A-4118 | - | GGGUCCCGCCCCCGCCUCA | 19 | 7967 |
| SCNN1A-924 | - | AGGGUCCCGCCCCCGCCUCA | 20 | 4773 |
| SCNN1A-4119 | - | GAGGGUCCCGCCCCCGCCUCA | 21 | 7968 |
| SCNN1A-4120 | - | UGAGGGUCCCGCCCCCGCCUCA | 22 | 7969 |
| SCNN1A-4121 | - | CUGAGGGUCCCGCCCCCGCCUCA | 23 | 7970 |
| SCNN1A-4122 | - | CCUGAGGGUCCCGCCCCCGCCUCA | 24 | 7971 |
| SCNN1A-4123 | - | AAGUCAACAUCUUCUUCA | 18 | 7972 |
| SCNN1A-4124 | - | AAAGUCAACAUCUUCUUCA | 19 | 7973 |
| SCNN1A-928 | - | CAAAGUCAACAUCUUCUUCA | 20 | 4777 |
| SCNN1A-4125 | - | CCAAAGUCAACAUCUUCUUCA | 21 | 7974 |
| SCNN1A-4126 | - | GCCAAAGUCAACAUCUUCUUCA | 22 | 7975 |
| SCNN1A-4127 | - | GGCCAAAGUCAACAUCUUCUUCA | 23 | 7976 |
| SCNN1A-4128 | - | UGGCCAAAGUCAACAUCUUCUUCA | 24 | 7977 |
| SCNN1A-4129 | - | UUGGUGUAUGUGGGUUCA | 18 | 7978 |
| SCNN1A-4130 | - | CUUGGUGUAUGUGGGUUCA | 19 | 7979 |
| SCNN1A-4131 | - | UCUUGGUGUAUGUGGGUUCA | 20 | 7980 |
| SCNN1A-4132 | - | CUCUUGGUGUAUGUGGGUUCA | 21 | 7981 |
| SCNN1A-4133 | - | UCUCUUGGUGUAUGUGGGUUCA | 22 | 7982 |
| SCNN1A-4134 | - | AUCUCUUGGUGUAUGUGGGUUCA | 23 | 7983 |
| SCNN1A-4135 | - | GAUCUCUUGGUGUAUGUGGGUUCA | 24 | 7984 |
| SCNN1A-4136 | - | UCUGGGGGGCCCUGAGA | 18 | 7985 |
| SCNN1A-4137 | - | CUCUGGGGGGCCCUGAGA | 19 | 7986 |
| SCNN1A-938 | - | CCUCUGGGGGGCCCUGAGA | 20 | 4787 |
| SCNN1A-4138 | - | UCCUCUGGGGGGCCCUGAGA | 21 | 7987 |

TABLE 44G-continued

7th Tier

| gRNA Name | DNA Strand | Targeting Domain | Target Site Length | Seq ID |
|---|---|---|---|---|
| SCNN1A-4139 | − | GUCCUCUGGGGGGCCCUGAGA | 22 | 7988 |
| SCNN1A-4140 | − | UGUCCUCUGGGGGGCCCUGAGA | 23 | 7989 |
| SCNN1A-4141 | − | CUGUCCUCUGGGGGGCCCUGAGA | 24 | 7990 |
| SCNN1A-4142 | − | UACUGGUCUCCAGGCCGA | 18 | 7991 |
| SCNN1A-4143 | − | AUACUGGUCUCCAGGCCGA | 19 | 7992 |
| SCNN1A-943 | − | GAUACUGGUCUCCAGGCCGA | 20 | 4792 |
| SCNN1A-4144 | − | CGAUACUGGUCUCCAGGCCGA | 21 | 7993 |
| SCNN1A-4145 | − | CCGAUACUGGUCUCCAGGCCGA | 22 | 7994 |
| SCNN1A-4146 | − | GCCGAUACUGGUCUCCAGGCCGA | 23 | 7995 |
| SCNN1A-4147 | − | AGCCGAUACUGGUCUCCAGGCCGA | 24 | 7996 |
| SCNN1A-4148 | − | UUCCAGAUGCUAUCGCGA | 18 | 7997 |
| SCNN1A-4149 | − | CUUCCAGAUGCUAUCGCGA | 19 | 7998 |
| SCNN1A-4150 | − | UCUUCCAGAUGCUAUCGCGA | 20 | 7999 |
| SCNN1A-4151 | − | GUCUUCCAGAUGCUAUCGCGA | 21 | 8000 |
| SCNN1A-4152 | − | GGUCUUCCAGAUGCUAUCGCGA | 22 | 8001 |
| SCNN1A-4153 | − | GGGUCUUCCAGAUGCUAUCGCGA | 23 | 8002 |
| SCNN1A-4154 | − | UGGGUCUUCCAGAUGCUAUCGCGA | 24 | 8003 |
| SCNN1A-4155 | − | CCAGGUGGACUGGAAGGA | 18 | 8004 |
| SCNN1A-4156 | − | CCCAGGUGGACUGGAAGGA | 19 | 8005 |
| SCNN1A-4157 | − | CCCCAGGUGGACUGGAAGGA | 20 | 8006 |
| SCNN1A-4158 | − | CCCCCAGGUGGACUGGAAGGA | 21 | 8007 |
| SCNN1A-4159 | − | ACCCCCAGGUGGACUGGAAGGA | 22 | 8008 |
| SCNN1A-4160 | − | AACCCCCAGGUGGACUGGAAGGA | 23 | 8009 |
| SCNN1A-4161 | − | CAACCCCCAGGUGGACUGGAAGGA | 24 | 8010 |
| SCNN1A-4162 | − | GGGGGGCCCUGAGAGGGA | 18 | 8011 |
| SCNN1A-4163 | − | GGGGGGGCCCUGAGAGGGA | 19 | 8012 |
| SCNN1A-954 | − | UGGGGGGGCCCUGAGAGGGA | 20 | 4803 |
| SCNN1A-4164 | − | CUGGGGGGGCCCUGAGAGGGA | 21 | 8013 |
| SCNN1A-4165 | − | UCUGGGGGGGCCCUGAGAGGGA | 22 | 8014 |
| SCNN1A-4166 | − | CUCUGGGGGGGCCCUGAGAGGGA | 23 | 8015 |
| SCNN1A-4167 | − | CCUCUGGGGGGGCCCUGAGAGGGA | 24 | 8016 |
| SCNN1A-4168 | − | CGGUAGGUCGUGCCUGGA | 18 | 8017 |
| SCNN1A-4169 | − | ACGGUAGGUCGUGCCUGGA | 19 | 8018 |
| SCNN1A-962 | − | CACGGUAGGUCGUGCCUGGA | 20 | 4811 |
| SCNN1A-4170 | − | UCACGGUAGGUCGUGCCUGGA | 21 | 8019 |
| SCNN1A-4171 | − | GUCACGGUAGGUCGUGCCUGGA | 22 | 8020 |
| SCNN1A-4172 | − | UGUCACGGUAGGUCGUGCCUGGA | 23 | 8021 |
| SCNN1A-4173 | − | CUGUCACGGUAGGUCGUGCCUGGA | 24 | 8022 |

TABLE 44G-continued

7th Tier

| gRNA Name | DNA Strand | Targeting Domain | Target Site Length | Seq ID |
|---|---|---|---|---|
| SCNN1A-4174 | - | CAACAACCCCCAGGUGGA | 18 | 8023 |
| SCNN1A-4175 | - | ACAACAACCCCCAGGUGGA | 19 | 8024 |
| SCNN1A-4176 | - | GACAACAACCCCCAGGUGGA | 20 | 8025 |
| SCNN1A-4177 | - | GGACAACAACCCCCAGGUGGA | 21 | 8026 |
| SCNN1A-4178 | - | GGGACAACAACCCCCAGGUGGA | 22 | 8027 |
| SCNN1A-4179 | - | CGGGACAACAACCCCCAGGUGGA | 23 | 8028 |
| SCNN1A-4180 | - | GCGGGACAACAACCCCCAGGUGGA | 24 | 8029 |
| SCNN1A-4181 | - | CCUCUGGGGGGCCCUGA | 18 | 8030 |
| SCNN1A-4182 | - | UCCUCUGGGGGGCCCUGA | 19 | 8031 |
| SCNN1A-4183 | - | GUCCUCUGGGGGGCCCUGA | 20 | 8032 |
| SCNN1A-4184 | - | UGUCCUCUGGGGGGCCCUGA | 21 | 8033 |
| SCNN1A-4185 | - | CUGUCCUCUGGGGGGCCCUGA | 22 | 8034 |
| SCNN1A-4186 | - | CCUGUCCUCUGGGGGGCCCUGA | 23 | 8035 |
| SCNN1A-4187 | - | ACCUGUCCUCUGGGGGGCCCUGA | 24 | 8036 |
| SCNN1A-4188 | - | GGAAGGCAAGGAUGCUGA | 18 | 8037 |
| SCNN1A-4189 | - | AGGAAGGCAAGGAUGCUGA | 19 | 8038 |
| SCNN1A-4190 | - | GAGGAAGGCAAGGAUGCUGA | 20 | 8039 |
| SCNN1A-4191 | - | UGAGGAAGGCAAGGAUGCUGA | 21 | 8040 |
| SCNN1A-4192 | - | AUGAGGAAGGCAAGGAUGCUGA | 22 | 8041 |
| SCNN1A-4193 | - | CAUGAGGAAGGCAAGGAUGCUGA | 23 | 8042 |
| SCNN1A-4194 | - | GCAUGAGGAAGGCAAGGAUGCUGA | 24 | 8043 |
| SCNN1A-4195 | - | CCCUGCUGUCCACAGUGA | 18 | 8044 |
| SCNN1A-4196 | - | CCCCUGCUGUCCACAGUGA | 19 | 8045 |
| SCNN1A-4197 | - | UCCCCUGCUGUCCACAGUGA | 20 | 8046 |
| SCNN1A-4198 | - | UUCCCCUGCUGUCCACAGUGA | 21 | 8047 |
| SCNN1A-4199 | - | AUUCCCCUGCUGUCCACAGUGA | 22 | 8048 |
| SCNN1A-4200 | - | CAUUCCCCUGCUGUCCACAGUGA | 23 | 8049 |
| SCNN1A-4201 | - | UCAUUCCCCUGCUGUCCACAGUGA | 24 | 8050 |
| SCNN1A-4202 | - | CGUGGAGUACUGUGACUA | 18 | 8051 |
| SCNN1A-4203 | - | ACGUGGAGUACUGUGACUA | 19 | 8052 |
| SCNN1A-4204 | - | AACGUGGAGUACUGUGACUA | 20 | 8053 |
| SCNN1A-4205 | - | GAACGUGGAGUACUGUGACUA | 21 | 8054 |
| SCNN1A-4206 | - | AGAACGUGGAGUACUGUGACUA | 22 | 8055 |
| SCNN1A-4207 | - | CAGAACGUGGAGUACUGUGACUA | 23 | 8056 |
| SCNN1A-4208 | - | CCAGAACGUGGAGUACUGUGACUA | 24 | 8057 |
| SCNN1A-4209 | - | CUUCCACCACCCGAUGUA | 18 | 8058 |
| SCNN1A-4210 | - | ACUUCCACCACCCGAUGUA | 19 | 8059 |

TABLE 44G-continued

7th Tier

| gRNA Name | DNA Strand | Targeting Domain | Target Site Length | Seq ID |
|---|---|---|---|---|
| SCNN1A-975 | - | CACUUCCACCACCCGAUGUA | 20 | 4824 |
| SCNN1A-4211 | - | UCACUUCCACCACCCGAUGUA | 21 | 8060 |
| SCNN1A-4212 | - | CUCACUUCCACCACCCGAUGUA | 22 | 8061 |
| SCNN1A-4213 | - | UCUCACUUCCACCACCCGAUGUA | 23 | 8062 |
| SCNN1A-4214 | - | CUCUCACUUCCACCACCCGAUGUA | 24 | 8063 |
| SCNN1A-4215 | - | UCAGGUACCCGGAAAUUA | 18 | 8064 |
| SCNN1A-4216 | - | UUCAGGUACCCGGAAAUUA | 19 | 8065 |
| SCNN1A-4217 | - | CUUCAGGUACCCGGAAAUUA | 20 | 8066 |
| SCNN1A-4218 | - | CCUUCAGGUACCCGGAAAUUA | 21 | 8067 |
| SCNN1A-4219 | - | CCCUUCAGGUACCCGGAAAUUA | 22 | 8068 |
| SCNN1A-4220 | - | CCCCUUCAGGUACCCGGAAAUUA | 23 | 8069 |
| SCNN1A-4221 | - | GCCCCUUCAGGUACCCGGAAAUUA | 24 | 8070 |
| SCNN1A-4222 | - | AAUUACACCGUCAACAAC | 18 | 8071 |
| SCNN1A-4223 | - | CAAUUACACCGUCAACAAC | 19 | 8072 |
| SCNN1A-4224 | - | ACAAUUACACCGUCAACAAC | 20 | 8073 |
| SCNN1A-4225 | - | AACAAUUACACCGUCAACAAC | 21 | 8074 |
| SCNN1A-4226 | - | GAACAAUUACACCGUCAACAAC | 22 | 8075 |
| SCNN1A-4227 | - | AGAACAAUUACACCGUCAACAAC | 23 | 8076 |
| SCNN1A-4228 | - | CAGAACAAUUACACCGUCAACAAC | 24 | 8077 |
| SCNN1A-4229 | - | GUCACCCUCCUGUCCAAC | 18 | 8078 |
| SCNN1A-4230 | - | GGUCACCCUCCUGUCCAAC | 19 | 8079 |
| SCNN1A-4231 | - | UGGUCACCCUCCUGUCCAAC | 20 | 8080 |
| SCNN1A-4232 | - | AUGGUCACCCUCCUGUCCAAC | 21 | 8081 |
| SCNN1A-4233 | - | GAUGGUCACCCUCCUGUCCAAC | 22 | 8082 |
| SCNN1A-4234 | - | AGAUGGUCACCCUCCUGUCCAAC | 23 | 8083 |
| SCNN1A-4235 | - | CAGAUGGUCACCCUCCUGUCCAAC | 24 | 8084 |
| SCNN1A-4236 | - | CUCUGUGUCCAGUGCAAC | 18 | 8085 |
| SCNN1A-4237 | - | UCUCUGUGUCCAGUGCAAC | 19 | 8086 |
| SCNN1A-4238 | - | GUCUCUGUGUCCAGUGCAAC | 20 | 8087 |
| SCNN1A-4239 | - | AGUCUCUGUGUCCAGUGCAAC | 21 | 8088 |
| SCNN1A-4240 | - | UAGUCUCUGUGUCCAGUGCAAC | 22 | 8089 |
| SCNN1A-4241 | - | CUAGUCUCUGUGUCCAGUGCAAC | 23 | 8090 |
| SCNN1A-4242 | - | UCUAGUCUCUGUGUCCAGUGCAAC | 24 | 8091 |
| SCNN1A-4243 | - | UAUCCGCGGCCCCAGAAC | 18 | 8092 |
| SCNN1A-4244 | - | CUAUCCGCGGCCCCAGAAC | 19 | 8093 |
| SCNN1A-4245 | - | UCUAUCCGCGGCCCCAGAAC | 20 | 8094 |
| SCNN1A-4246 | - | UUCUAUCCGCGGCCCCAGAAC | 21 | 8095 |
| SCNN1A-4247 | - | CUUCUAUCCGCGGCCCCAGAAC | 22 | 8096 |

TABLE 44G-continued

7th Tier

| gRNA Name | DNA Strand | Targeting Domain | Target Site Length | Seq ID |
|---|---|---|---|---|
| SCNN1A-4248 | - | UCUUCUAUCCGCGGCCCCAGAAC | 23 | 8097 |
| SCNN1A-4249 | - | AUCUUCUAUCCGCGGCCCCAGAAC | 24 | 8098 |
| SCNN1A-4250 | - | GACUUCUCCUCAGACCAC | 18 | 8099 |
| SCNN1A-4251 | - | UGACUUCUCCUCAGACCAC | 19 | 8100 |
| SCNN1A-4252 | - | UUGACUUCUCCUCAGACCAC | 20 | 8101 |
| SCNN1A-4253 | - | GUUGACUUCUCCUCAGACCAC | 21 | 8102 |
| SCNN1A-4254 | - | GGUUGACUUCUCCUCAGACCAC | 22 | 8103 |
| SCNN1A-4255 | - | AGGUUGACUUCUCCUCAGACCAC | 23 | 8104 |
| SCNN1A-4256 | - | CAGGUUGACUUCUCCUCAGACCAC | 24 | 8105 |
| SCNN1A-4257 | - | AGGAAACCCUGGACAGAC | 18 | 8106 |
| SCNN1A-4258 | - | UAGGAAACCCUGGACAGAC | 19 | 8107 |
| SCNN1A-4259 | - | AUAGGAAACCCUGGACAGAC | 20 | 8108 |
| SCNN1A-4260 | - | CAUAGGAAACCCUGGACAGAC | 21 | 8109 |
| SCNN1A-4261 | - | UCAUAGGAAACCCUGGACAGAC | 22 | 8110 |
| SCNN1A-4262 | - | UUCAUAGGAAACCCUGGACAGAC | 23 | 8111 |
| SCNN1A-4263 | - | GUUCAUAGGAAACCCUGGACAGAC | 24 | 8112 |
| SCNN1A-4264 | - | CAGGUGGACUGGAAGGAC | 18 | 8113 |
| SCNN1A-4265 | - | CCAGGUGGACUGGAAGGAC | 19 | 8114 |
| SCNN1A-988 | - | CCCAGGUGGACUGGAAGGAC | 20 | 4837 |
| SCNN1A-4266 | - | CCCCAGGUGGACUGGAAGGAC | 21 | 8115 |
| SCNN1A-4267 | - | CCCCCAGGUGGACUGGAAGGAC | 22 | 8116 |
| SCNN1A-4268 | - | ACCCCCAGGUGGACUGGAAGGAC | 23 | 8117 |
| SCNN1A-4269 | - | AACCCCCAGGUGGACUGGAAGGAC | 24 | 8118 |
| SCNN1A-4270 | - | AACAACCCCCAGGUGGAC | 18 | 8119 |
| SCNN1A-4271 | - | CAACAACCCCCAGGUGGAC | 19 | 8120 |
| SCNN1A-990 | - | ACAACAACCCCCAGGUGGAC | 20 | 4839 |
| SCNN1A-4272 | - | GACAACAACCCCCAGGUGGAC | 21 | 8121 |
| SCNN1A-4273 | - | GGACAACAACCCCCAGGUGGAC | 22 | 8122 |
| SCNN1A-4274 | - | GGGACAACAACCCCCAGGUGGAC | 23 | 8123 |
| SCNN1A-4275 | - | CGGGACAACAACCCCCAGGUGGAC | 24 | 8124 |
| SCNN1A-4276 | - | UGCUAUACUUUCAAUGAC | 18 | 8125 |
| SCNN1A-4277 | - | CUGCUAUACUUUCAAUGAC | 19 | 8126 |
| SCNN1A-4278 | - | ACUGCUAUACUUUCAAUGAC | 20 | 8127 |
| SCNN1A-4279 | - | AACUGCUAUACUUUCAAUGAC | 21 | 8128 |
| SCNN1A-4280 | - | AAACUGCUAUACUUUCAAUGAC | 22 | 8129 |
| SCNN1A-4281 | - | GAAACUGCUAUACUUUCAAUGAC | 23 | 8130 |
| SCNN1A-4282 | - | GGAAACUGCUAUACUUUCAAUGAC | 24 | 8131 |

TABLE 44G-continued

7th Tier

| gRNA Name | DNA Strand | Targeting Domain | Target Site Length | Seq ID |
|---|---|---|---|---|
| SCNN1A-4283 | - | GAAGGCAAGGAUGCUGAC | 18 | 8132 |
| SCNN1A-4284 | - | GGAAGGCAAGGAUGCUGAC | 19 | 8133 |
| SCNN1A-992 | - | AGGAAGGCAAGGAUGCUGAC | 20 | 4841 |
| SCNN1A-4285 | - | GAGGAAGGCAAGGAUGCUGAC | 21 | 8134 |
| SCNN1A-4286 | - | UGAGGAAGGCAAGGAUGCUGAC | 22 | 8135 |
| SCNN1A-4287 | - | AUGAGGAAGGCAAGGAUGCUGAC | 23 | 8136 |
| SCNN1A-4288 | - | CAUGAGGAAGGCAAGGAUGCUGAC | 24 | 8137 |
| SCNN1A-4289 | - | CCUGCUGUCCACAGUGAC | 18 | 8138 |
| SCNN1A-4290 | - | CCCUGCUGUCCACAGUGAC | 19 | 8139 |
| SCNN1A-993 | - | CCCCUGCUGUCCACAGUGAC | 20 | 4842 |
| SCNN1A-4291 | - | UCCCCUGCUGUCCACAGUGAC | 21 | 8140 |
| SCNN1A-4292 | - | UUCCCCUGCUGUCCACAGUGAC | 22 | 8141 |
| SCNN1A-4293 | - | AUUCCCCUGCUGUCCACAGUGAC | 23 | 8142 |
| SCNN1A-4294 | - | CAUUCCCCUGCUGUCCACAGUGAC | 24 | 8143 |
| SCNN1A-4295 | - | CCUCGCCCCUUCAGGUAC | 18 | 8144 |
| SCNN1A-4296 | - | CCCUCGCCCCUUCAGGUAC | 19 | 8145 |
| SCNN1A-4297 | - | CCCCUCGCCCCUUCAGGUAC | 20 | 8146 |
| SCNN1A-4298 | - | UCCCCUCGCCCCUUCAGGUAC | 21 | 8147 |
| SCNN1A-4299 | - | UUCCCCUCGCCCCUUCAGGUAC | 22 | 8148 |
| SCNN1A-4300 | - | CUUCCCCUCGCCCCUUCAGGUAC | 23 | 8149 |
| SCNN1A-4301 | - | UCUUCCCCUCGCCCCUUCAGGUAC | 24 | 8150 |
| SCNN1A-4302 | - | GUGGGUUCAUAGGAAACC | 18 | 8151 |
| SCNN1A-4303 | - | UGUGGGUUCAUAGGAAACC | 19 | 8152 |
| SCNN1A-4304 | - | AUGUGGGUUCAUAGGAAACC | 20 | 8153 |
| SCNN1A-4305 | - | UAUGUGGGUUCAUAGGAAACC | 21 | 8154 |
| SCNN1A-4306 | - | GUAUGUGGGUUCAUAGGAAACC | 22 | 8155 |
| SCNN1A-4307 | - | UGUAUGUGGGUUCAUAGGAAACC | 23 | 8156 |
| SCNN1A-4308 | - | GUGUAUGUGGGUUCAUAGGAAACC | 24 | 8157 |
| SCNN1A-4309 | - | CCCCCUGCCUAUGCCACC | 18 | 8158 |
| SCNN1A-4310 | - | UCCCCCUGCCUAUGCCACC | 19 | 8159 |
| SCNN1A-4311 | - | CUCCCCCUGCCUAUGCCACC | 20 | 8160 |
| SCNN1A-4312 | - | CCUCCCCCUGCCUAUGCCACC | 21 | 8161 |
| SCNN1A-4313 | - | CCCUCCCCCUGCCUAUGCCACC | 22 | 8162 |
| SCNN1A-4314 | - | CCCCUCCCCCUGCCUAUGCCACC | 23 | 8163 |
| SCNN1A-4315 | - | GCCCCUCCCCCUGCCUAUGCCACC | 24 | 8164 |
| SCNN1A-4316 | - | CUCGCCCCUUCAGGUACC | 18 | 8165 |
| SCNN1A-4317 | - | CCUCGCCCCUUCAGGUACC | 19 | 8166 |
| SCNN1A-1007 | - | CCCUCGCCCCUUCAGGUACC | 20 | 4856 |

TABLE 44G-continued

7th Tier

| gRNA Name | DNA Strand | Targeting Domain | Target Site Length | Seq ID |
|---|---|---|---|---|
| SCNN1A-4318 | − | CCCCUCGCCCCUUCAGGUACC | 21 | 8167 |
| SCNN1A-4319 | − | UCCCCUCGCCCCUUCAGGUACC | 22 | 8168 |
| SCNN1A-4320 | − | UUCCCCUCGCCCCUUCAGGUACC | 23 | 8169 |
| SCNN1A-4321 | − | CUUCCCCUCGCCCCUUCAGGUACC | 24 | 8170 |
| SCNN1A-4322 | − | AUCUUCUAUCCGCGGCCC | 18 | 8171 |
| SCNN1A-4323 | − | CAUCUUCUAUCCGCGGCCC | 19 | 8172 |
| SCNN1A-4324 | − | ACAUCUUCUAUCCGCGGCCC | 20 | 8173 |
| SCNN1A-4325 | − | UACAUCUUCUAUCCGCGGCCC | 21 | 8174 |
| SCNN1A-4326 | − | CUACAUCUUCUAUCCGCGGCCC | 22 | 8175 |
| SCNN1A-4327 | − | CCUACAUCUUCUAUCCGCGGCCC | 23 | 8176 |
| SCNN1A-4328 | − | GCCUACAUCUUCUAUCCGCGGCCC | 24 | 8177 |
| SCNN1A-4329 | − | CAGAGACUCUGCCAUCCC | 18 | 8178 |
| SCNN1A-4330 | − | CCAGAGACUCUGCCAUCCC | 19 | 8179 |
| SCNN1A-1023 | − | GCCAGAGACUCUGCCAUCCC | 20 | 4872 |
| SCNN1A-4331 | − | UGCCAGAGACUCUGCCAUCCC | 21 | 8180 |
| SCNN1A-4332 | − | CUGCCAGAGACUCUGCCAUCCC | 22 | 8181 |
| SCNN1A-4333 | − | GCUGCCAGAGACUCUGCCAUCCC | 23 | 8182 |
| SCNN1A-4334 | − | GGCUGCCAGAGACUCUGCCAUCCC | 24 | 8183 |
| SCNN1A-4335 | − | GGUGAGGCCCGCAGCGCC | 18 | 8184 |
| SCNN1A-4336 | − | UGGUGAGGCCCGCAGCGCC | 19 | 8185 |
| SCNN1A-4337 | − | CUGGUGAGGCCCGCAGCGCC | 20 | 8186 |
| SCNN1A-4338 | − | GCUGGUGAGGCCCGCAGCGCC | 21 | 8187 |
| SCNN1A-4339 | − | AGCUGGUGAGGCCCGCAGCGCC | 22 | 8188 |
| SCNN1A-4340 | − | CAGCUGGUGAGGCCCGCAGCGCC | 23 | 8189 |
| SCNN1A-4341 | − | CCAGCUGGUGAGGCCCGCAGCGCC | 24 | 8190 |
| SCNN1A-4342 | − | GAUACUGGUCUCCAGGCC | 18 | 8191 |
| SCNN1A-4343 | − | CGAUACUGGUCUCCAGGCC | 19 | 8192 |
| SCNN1A-4344 | − | CCGAUACUGGUCUCCAGGCC | 20 | 8193 |
| SCNN1A-4345 | − | GCCGAUACUGGUCUCCAGGCC | 21 | 8194 |
| SCNN1A-4346 | − | AGCCGAUACUGGUCUCCAGGCC | 22 | 8195 |
| SCNN1A-4347 | − | AAGCCGAUACUGGUCUCCAGGCC | 23 | 8196 |
| SCNN1A-4348 | − | GAAGCCGAUACUGGUCUCCAGGCC | 24 | 8197 |
| SCNN1A-4349 | − | GAUGCUGACUGGGAGGCC | 18 | 8198 |
| SCNN1A-4350 | − | GGAUGCUGACUGGGAGGCC | 19 | 8199 |
| SCNN1A-1028 | − | AGGAUGCUGACUGGGAGGCC | 20 | 4877 |
| SCNN1A-4351 | − | AAGGAUGCUGACUGGGAGGCC | 21 | 8200 |
| SCNN1A-4352 | − | CAAGGAUGCUGACUGGGAGGCC | 22 | 8201 |

TABLE 44G-continued

| 7th Tier | | | | |
|---|---|---|---|---|
| gRNA Name | DNA Strand | Targeting Domain | Target Site Length | Seq ID |
| SCNN1A-4353 | - | GCAAGGAUGCUGACUGGGAGGCC | 23 | 8202 |
| SCNN1A-4354 | - | GGCAAGGAUGCUGACUGGGAGGCC | 24 | 8203 |
| SCNN1A-4355 | - | CUGUCCUCUGGGGGGCC | 18 | 8204 |
| SCNN1A-4356 | - | CCUGUCCUCUGGGGGGCC | 19 | 8205 |
| SCNN1A-4357 | - | ACCUGUCCUCUGGGGGGCC | 20 | 8206 |
| SCNN1A-4358 | - | CACCUGUCCUCUGGGGGGCC | 21 | 8207 |
| SCNN1A-4359 | - | CCACCUGUCCUCUGGGGGGCC | 22 | 8208 |
| SCNN1A-4360 | - | UCCACCUGUCCUCUGGGGGGCC | 23 | 8209 |
| SCNN1A-4361 | - | CUCCACCUGUCCUCUGGGGGGCC | 24 | 8210 |
| SCNN1A-4362 | - | CCAGAGACUCUGCCAUCC | 18 | 8211 |
| SCNN1A-4363 | - | GCCAGAGACUCUGCCAUCC | 19 | 8212 |
| SCNN1A-4364 | - | UGCCAGAGACUCUGCCAUCC | 20 | 8213 |
| SCNN1A-4365 | - | CUGCCAGAGACUCUGCCAUCC | 21 | 8214 |
| SCNN1A-4366 | - | GCUGCCAGAGACUCUGCCAUCC | 22 | 8215 |
| SCNN1A-4367 | - | GGCUGCCAGAGACUCUGCCAUCC | 23 | 8216 |
| SCNN1A-4368 | - | AGGCUGCCAGAGACUCUGCCAUCC | 24 | 8217 |
| SCNN1A-4369 | - | UUCCUGGGGUGAGACUCC | 18 | 8218 |
| SCNN1A-4370 | - | GUUCCUGGGGUGAGACUCC | 19 | 8219 |
| SCNN1A-1037 | - | AGUUCCUGGGGUGAGACUCC | 20 | 4886 |
| SCNN1A-4371 | - | CAGUUCCUGGGGUGAGACUCC | 21 | 8220 |
| SCNN1A-4372 | - | ACAGUUCCUGGGGUGAGACUCC | 22 | 8221 |
| SCNN1A-4373 | - | CACAGUUCCUGGGGUGAGACUCC | 23 | 8222 |
| SCNN1A-4374 | - | GCACAGUUCCUGGGGUGAGACUCC | 24 | 8223 |
| SCNN1A-4375 | - | GGGCCCCCGCCCAUCUCC | 18 | 8224 |
| SCNN1A-4376 | - | UGGGCCCCCGCCCAUCUCC | 19 | 8225 |
| SCNN1A-1040 | - | CUGGGCCCCCGCCCAUCUCC | 20 | 4889 |
| SCNN1A-4377 | - | CCUGGGCCCCCGCCCAUCUCC | 21 | 8226 |
| SCNN1A-4378 | - | CCCUGGGCCCCCGCCCAUCUCC | 22 | 8227 |
| SCNN1A-4379 | - | ACCCUGGGCCCCCGCCCAUCUCC | 23 | 8228 |
| SCNN1A-4380 | - | CACCCUGGGCCCCCGCCCAUCUCC | 24 | 8229 |
| SCNN1A-4381 | - | GUAUUCACUCCUGCUUCC | 18 | 8230 |
| SCNN1A-4382 | - | UGUAUUCACUCCUGCUUCC | 19 | 8231 |
| SCNN1A-1046 | - | GUGUAUUCACUCCUGCUUCC | 20 | 4895 |
| SCNN1A-4383 | - | UGUGUAUUCACUCCUGCUUCC | 21 | 8232 |
| SCNN1A-4384 | - | GUGUGUAUUCACUCCUGCUUCC | 22 | 8233 |
| SCNN1A-4385 | - | GGUGUGUAUUCACUCCUGCUUCC | 23 | 8234 |
| SCNN1A-4386 | - | AGGUGUGUAUUCACUCCUGCUUCC | 24 | 8235 |
| SCNN1A-4387 | - | GACACCCCAUUCUUUCC | 18 | 8236 |

TABLE 44G-continued

7th Tier

| gRNA Name | DNA Strand | Targeting Domain | Target Site Length | Seq ID |
|---|---|---|---|---|
| SCNN1A-4388 | − | UGACACCCCCAUUCUUUCC | 19 | 8237 |
| SCNN1A-4389 | − | AUGACACCCCCAUUCUUUCC | 20 | 8238 |
| SCNN1A-4390 | − | GAUGACACCCCCAUUCUUUCC | 21 | 8239 |
| SCNN1A-4391 | − | UGAUGACACCCCCAUUCUUUCC | 22 | 8240 |
| SCNN1A-4392 | − | UUGAUGACACCCCCAUUCUUUCC | 23 | 8241 |
| SCNN1A-4393 | − | CUUGAUGACACCCCCAUUCUUUCC | 24 | 8242 |
| SCNN1A-4394 | − | GUGGAGACCUCCAUCAGC | 18 | 8243 |
| SCNN1A-4395 | − | CGUGGAGACCUCCAUCAGC | 19 | 8244 |
| SCNN1A-4396 | − | GCGUGGAGACCUCCAUCAGC | 20 | 8245 |
| SCNN1A-4397 | − | GGCGUGGAGACCUCCAUCAGC | 21 | 8246 |
| SCNN1A-4398 | − | UGGCGUGGAGACCUCCAUCAGC | 22 | 8247 |
| SCNN1A-4399 | − | CUGGCGUGGAGACCUCCAUCAGC | 23 | 8248 |
| SCNN1A-4400 | − | CCUGGCGUGGAGACCUCCAUCAGC | 24 | 8249 |
| SCNN1A-4401 | − | CGGAAAUUAAAGAGGAGC | 18 | 8250 |
| SCNN1A-4402 | − | CCGGAAAUUAAAGAGGAGC | 19 | 8251 |
| SCNN1A-1058 | − | CCCGGAAAUUAAAGAGGAGC | 20 | 4907 |
| SCNN1A-4403 | − | ACCCGGAAAUUAAAGAGGAGC | 21 | 8252 |
| SCNN1A-4404 | − | UACCCGGAAAUUAAAGAGGAGC | 22 | 8253 |
| SCNN1A-4405 | − | GUACCCGGAAAUUAAAGAGGAGC | 23 | 8254 |
| SCNN1A-4406 | − | GGUACCCGGAAAUUAAAGAGGAGC | 24 | 8255 |
| SCNN1A-4407 | − | CCGCACCCCUUGCAGCGC | 18 | 8256 |
| SCNN1A-4408 | − | GCCGCACCCCUUGCAGCGC | 19 | 8257 |
| SCNN1A-4409 | − | UGCCGCACCCCUUGCAGCGC | 20 | 8258 |
| SCNN1A-4410 | − | CUGCCGCACCCCUUGCAGCGC | 21 | 8259 |
| SCNN1A-4411 | − | UCUGCCGCACCCCUUGCAGCGC | 22 | 8260 |
| SCNN1A-4412 | − | CUCUGCCGCACCCCUUGCAGCGC | 23 | 8261 |
| SCNN1A-4413 | − | ACUCUGCCGCACCCCUUGCAGCGC | 24 | 8262 |
| SCNN1A-4414 | − | GGAUGCUGACUGGGAGGC | 18 | 8263 |
| SCNN1A-4415 | − | AGGAUGCUGACUGGGAGGC | 19 | 8264 |
| SCNN1A-4416 | − | AAGGAUGCUGACUGGGAGGC | 20 | 8265 |
| SCNN1A-4417 | − | CAAGGAUGCUGACUGGGAGGC | 21 | 8266 |
| SCNN1A-4418 | − | GCAAGGAUGCUGACUGGGAGGC | 22 | 8267 |
| SCNN1A-4419 | − | GGCAAGGAUGCUGACUGGGAGGC | 23 | 8268 |
| SCNN1A-4420 | − | AGGCAAGGAUGCUGACUGGGAGGC | 24 | 8269 |
| SCNN1A-4421 | − | UUUAACUUGCGGCCUGGC | 18 | 8270 |
| SCNN1A-4422 | − | CUUUAACUUGCGGCCUGGC | 19 | 8271 |
| SCNN1A-4423 | − | GCUUUAACUUGCGGCCUGGC | 20 | 8272 |

TABLE 44G-continued

| 7th Tier | | | | |
|---|---|---|---|---|
| gRNA Name | DNA Strand | Targeting Domain | Target Site Length | Seq ID |
| SCNN1A-4424 | − | GGCUUUAACUUGCGGCCUGGC | 21 | 8273 |
| SCNN1A-4425 | − | UGGCUUUAACUUGCGGCCUGGC | 22 | 8274 |
| SCNN1A-4426 | − | GUGGCUUUAACUUGCGGCCUGGC | 23 | 8275 |
| SCNN1A-4427 | − | GGUGGCUUUAACUUGCGGCCUGGC | 24 | 8276 |
| SCNN1A-4428 | − | UCUGGAUGUCUUCCAUGC | 18 | 8277 |
| SCNN1A-4429 | − | CUCUGGAUGUCUUCCAUGC | 19 | 8278 |
| SCNN1A-4430 | − | CCUCUGGAUGUCUUCCAUGC | 20 | 8279 |
| SCNN1A-4431 | − | ACCUCUGGAUGUCUUCCAUGC | 21 | 8280 |
| SCNN1A-4432 | − | AACCUCUGGAUGUCUUCCAUGC | 22 | 8281 |
| SCNN1A-4433 | − | CAACCUCUGGAUGUCUUCCAUGC | 23 | 8282 |
| SCNN1A-4434 | − | CCAACCUCUGGAUGUCUUCCAUGC | 24 | 8283 |
| SCNN1A-4435 | − | GCAGCCGUCGCGACCUGC | 18 | 8284 |
| SCNN1A-4436 | − | CGCAGCCGUCGCGACCUGC | 19 | 8285 |
| SCNN1A-1079 | − | CCGCAGCCGUCGCGACCUGC | 20 | 4928 |
| SCNN1A-4437 | − | CCCGCAGCCGUCGCGACCUGC | 21 | 8286 |
| SCNN1A-4438 | − | UCCCGCAGCCGUCGCGACCUGC | 22 | 8287 |
| SCNN1A-4439 | − | CUCCCGCAGCCGUCGCGACCUGC | 23 | 8288 |
| SCNN1A-4440 | − | GCUCCCGCAGCCGUCGCGACCUGC | 24 | 8289 |
| SCNN1A-4441 | − | ACAUCCUGUCGAGGCUGC | 18 | 8290 |
| SCNN1A-4442 | − | AACAUCCUGUCGAGGCUGC | 19 | 8291 |
| SCNN1A-4443 | − | CAACAUCCUGUCGAGGCUGC | 20 | 8292 |
| SCNN1A-4444 | − | UCAACAUCCUGUCGAGGCUGC | 21 | 8293 |
| SCNN1A-4445 | − | AUCAACAUCCUGUCGAGGCUGC | 22 | 8294 |
| SCNN1A-4446 | − | CAUCAACAUCCUGUCGAGGCUGC | 23 | 8295 |
| SCNN1A-4447 | − | ACAUCAACAUCCUGUCGAGGCUGC | 24 | 8296 |
| SCNN1A-4448 | − | AUCUCCAGGGGCUCUGC | 18 | 8297 |
| SCNN1A-4449 | − | CAUCUCCAGGGGCUCUGC | 19 | 8298 |
| SCNN1A-1083 | − | CCAUCUCCAGGGGCUCUGC | 20 | 4932 |
| SCNN1A-4450 | − | CCCAUCUCCAGGGGCUCUGC | 21 | 8299 |
| SCNN1A-4451 | − | GCCCAUCUCCAGGGGCUCUGC | 22 | 8300 |
| SCNN1A-4452 | − | CGCCCAUCUCCAGGGGCUCUGC | 23 | 8301 |
| SCNN1A-4453 | − | CCGCCCAUCUCCAGGGGCUCUGC | 24 | 8302 |
| SCNN1A-4454 | − | GGCUGUUUCACCAAGUGC | 18 | 8303 |
| SCNN1A-4455 | − | GGGCUGUUUCACCAAGUGC | 19 | 8304 |
| SCNN1A-1085 | − | UGGGCUGUUUCACCAAGUGC | 20 | 4934 |
| SCNN1A-4456 | − | CUGGGCUGUUUCACCAAGUGC | 21 | 8305 |
| SCNN1A-4457 | − | CCUGGGCUGUUUCACCAAGUGC | 22 | 8306 |
| SCNN1A-4458 | − | ACCUGGGCUGUUUCACCAAGUGC | 23 | 8307 |

TABLE 44G-continued

7th Tier

| gRNA Name | DNA Strand | Targeting Domain | Target Site Length | Seq ID |
|---|---|---|---|---|
| SCNN1A-4459 | - | CACCUGGGCUGUUUCACCAAGUGC | 24 | 8308 |
| SCNN1A-4460 | - | GGGCCCGGGUAAUGGUGC | 18 | 8309 |
| SCNN1A-4461 | - | GGGGCCCGGGUAAUGGUGC | 19 | 8310 |
| SCNN1A-4462 | - | UGGGGCCCGGGUAAUGGUGC | 20 | 8311 |
| SCNN1A-4463 | - | CUGGGGCCCGGGUAAUGGUGC | 21 | 8312 |
| SCNN1A-4464 | - | ACUGGGGCCCGGGUAAUGGUGC | 22 | 8313 |
| SCNN1A-4465 | - | GACUGGGGCCCGGGUAAUGGUGC | 23 | 8314 |
| SCNN1A-4466 | - | UGACUGGGGCCCGGGUAAUGGUGC | 24 | 8315 |
| SCNN1A-4467 | - | UUCCAGGAGAGCAUGAUC | 18 | 8316 |
| SCNN1A-4468 | - | CUUCCAGGAGAGCAUGAUC | 19 | 8317 |
| SCNN1A-4469 | - | GCUUCCAGGAGAGCAUGAUC | 20 | 8318 |
| SCNN1A-4470 | - | UGCUUCCAGGAGAGCAUGAUC | 21 | 8319 |
| SCNN1A-4471 | - | CUGCUUCCAGGAGAGCAUGAUC | 22 | 8320 |
| SCNN1A-4472 | - | CCUGCUUCCAGGAGAGCAUGAUC | 23 | 8321 |
| SCNN1A-4473 | - | UCCUGCUUCCAGGAGAGCAUGAUC | 24 | 8322 |
| SCNN1A-4474 | - | GUUCCUGGGGUGAGACUC | 18 | 8323 |
| SCNN1A-4475 | - | AGUUCCUGGGGUGAGACUC | 19 | 8324 |
| SCNN1A-4476 | - | CAGUUCCUGGGGUGAGACUC | 20 | 8325 |
| SCNN1A-4477 | - | ACAGUUCCUGGGGUGAGACUC | 21 | 8326 |
| SCNN1A-4478 | - | CACAGUUCCUGGGGUGAGACUC | 22 | 8327 |
| SCNN1A-4479 | - | GCACAGUUCCUGGGGUGAGACUC | 23 | 8328 |
| SCNN1A-4480 | - | AGCACAGUUCCUGGGGUGAGACUC | 24 | 8329 |
| SCNN1A-4481 | - | GGGUCCCGCCCCCGCCUC | 18 | 8330 |
| SCNN1A-4482 | - | AGGGUCCCGCCCCCGCCUC | 19 | 8331 |
| SCNN1A-4483 | - | GAGGGUCCCGCCCCCGCCUC | 20 | 8332 |
| SCNN1A-4484 | - | UGAGGGUCCCGCCCCCGCCUC | 21 | 8333 |
| SCNN1A-4485 | - | CUGAGGGUCCCGCCCCCGCCUC | 22 | 8334 |
| SCNN1A-4486 | - | CCUGAGGGUCCCGCCCCCGCCUC | 23 | 8335 |
| SCNN1A-4487 | - | GCCUGAGGGUCCCGCCCCCGCCUC | 24 | 8336 |
| SCNN1A-4488 | - | GUUCCUCCACCUGUCCUC | 18 | 8337 |
| SCNN1A-4489 | - | AGUUCCUCCACCUGUCCUC | 19 | 8338 |
| SCNN1A-1095 | - | CAGUUCCUCCACCUGUCCUC | 20 | 4944 |
| SCNN1A-4490 | - | CCAGUUCCUCCACCUGUCCUC | 21 | 8339 |
| SCNN1A-4491 | - | GCCAGUUCCUCCACCUGUCCUC | 22 | 8340 |
| SCNN1A-4492 | - | GGCCAGUUCCUCCACCUGUCCUC | 23 | 8341 |
| SCNN1A-4493 | - | GGGCCAGUUCCUCCACCUGUCCUC | 24 | 8342 |
| SCNN1A-4494 | - | GAGGGGCAGGGGUGCUC | 18 | 8343 |

TABLE 44G-continued

7th Tier

| gRNA Name | DNA Strand | Targeting Domain | Target Site Length | Seq ID |
|---|---|---|---|---|
| SCNN1A-4495 | − | CGAGGGGGCAGGGGUGCUC | 19 | 8344 |
| SCNN1A-1096 | − | CCGAGGGGGCAGGGGUGCUC | 20 | 4945 |
| SCNN1A-4496 | − | GCCGAGGGGGCAGGGGUGCUC | 21 | 8345 |
| SCNN1A-4497 | − | GGCCGAGGGGGCAGGGGUGCUC | 22 | 8346 |
| SCNN1A-4498 | − | AGGCCGAGGGGGCAGGGGUGCUC | 23 | 8347 |
| SCNN1A-4499 | − | CAGGCCGAGGGGGCAGGGGUGCUC | 24 | 8348 |
| SCNN1A-4500 | − | UGGGCCCCCGCCCAUCUC | 18 | 8349 |
| SCNN1A-4501 | − | CUGGGCCCCCGCCCAUCUC | 19 | 8350 |
| SCNN1A-4502 | − | CCUGGGCCCCCGCCCAUCUC | 20 | 8351 |
| SCNN1A-4503 | − | CCCUGGGCCCCCGCCCAUCUC | 21 | 8352 |
| SCNN1A-4504 | − | ACCCUGGGCCCCCGCCCAUCUC | 22 | 8353 |
| SCNN1A-4505 | − | CACCCUGGGCCCCCGCCCAUCUC | 23 | 8354 |
| SCNN1A-4506 | − | CCACCCUGGGCCCCCGCCCAUCUC | 24 | 8355 |
| SCNN1A-4507 | − | UGUAUUCACUCCUGCUUC | 18 | 8356 |
| SCNN1A-4508 | − | GUGUAUUCACUCCUGCUUC | 19 | 8357 |
| SCNN1A-4509 | − | UGUGUAUUCACUCCUGCUUC | 20 | 8358 |
| SCNN1A-4510 | − | GUGUGUAUUCACUCCUGCUUC | 21 | 8359 |
| SCNN1A-4511 | − | GGUGUGUAUUCACUCCUGCUUC | 22 | 8360 |
| SCNN1A-4512 | − | AGGUGUGUAUUCACUCCUGCUUC | 23 | 8361 |
| SCNN1A-4513 | − | CAGGUGUGUAUUCACUCCUGCUUC | 24 | 8362 |
| SCNN1A-4514 | − | AAAGUCAACAUCUUCUUC | 18 | 8363 |
| SCNN1A-4515 | − | CAAAGUCAACAUCUUCUUC | 19 | 8364 |
| SCNN1A-4516 | − | CCAAAGUCAACAUCUUCUUC | 20 | 8365 |
| SCNN1A-4517 | − | GCCAAAGUCAACAUCUUCUUC | 21 | 8366 |
| SCNN1A-4518 | − | GGCCAAAGUCAACAUCUUCUUC | 22 | 8367 |
| SCNN1A-4519 | − | UGGCCAAAGUCAACAUCUUCUUC | 23 | 8368 |
| SCNN1A-4520 | − | GUGGCCAAAGUCAACAUCUUCUUC | 24 | 8369 |
| SCNN1A-4521 | − | CUACAGAAAGCACAGUUC | 18 | 8370 |
| SCNN1A-4522 | − | ACUACAGAAAGCACAGUUC | 19 | 8371 |
| SCNN1A-4523 | − | GACUACAGAAAGCACAGUUC | 20 | 8372 |
| SCNN1A-4524 | − | UGACUACAGAAAGCACAGUUC | 21 | 8373 |
| SCNN1A-4525 | − | GUGACUACAGAAAGCACAGUUC | 22 | 8374 |
| SCNN1A-4526 | − | UGUGACUACAGAAAGCACAGUUC | 23 | 8375 |
| SCNN1A-4527 | − | CUGUGACUACAGAAAGCACAGUUC | 24 | 8376 |
| SCNN1A-4528 | − | GGUACCCGGAAAUUAAAG | 18 | 8377 |
| SCNN1A-4529 | − | AGGUACCCGGAAAUUAAAG | 19 | 8378 |
| SCNN1A-1106 | − | CAGGUACCCGGAAAUUAAAG | 20 | 4955 |
| SCNN1A-4530 | − | UCAGGUACCCGGAAAUUAAAG | 21 | 8379 |

TABLE 44G-continued

7th Tier

| gRNA Name | DNA Strand | Targeting Domain | Target Site Length | Seq ID |
|---|---|---|---|---|
| SCNN1A-4531 | - | UUCAGGUACCCGGAAAUUAAAG | 22 | 8380 |
| SCNN1A-4532 | - | CUUCAGGUACCCGGAAAUUAAAG | 23 | 8381 |
| SCNN1A-4533 | - | CCUUCAGGUACCCGGAAAUUAAAG | 24 | 8382 |
| SCNN1A-4534 | - | GGGGCCCUGAGAGGGAAG | 18 | 8383 |
| SCNN1A-4535 | - | GGGGGCCCUGAGAGGGAAG | 19 | 8384 |
| SCNN1A-4536 | - | GGGGGGCCCUGAGAGGGAAG | 20 | 8385 |
| SCNN1A-4537 | - | GGGGGGGCCCUGAGAGGGAAG | 21 | 8386 |
| SCNN1A-4538 | - | UGGGGGGGCCCUGAGAGGGAAG | 22 | 8387 |
| SCNN1A-4539 | - | CUGGGGGGGCCCUGAGAGGGAAG | 23 | 8388 |
| SCNN1A-4540 | - | UCUGGGGGGGCCCUGAGAGGGAAG | 24 | 8389 |
| SCNN1A-4541 | - | CGGGACAACAACCCCCAG | 18 | 8390 |
| SCNN1A-4542 | - | GCGGGACAACAACCCCCAG | 19 | 8391 |
| SCNN1A-4543 | - | UGCGGGACAACAACCCCCAG | 20 | 8392 |
| SCNN1A-4544 | - | UUGCGGGACAACAACCCCCAG | 21 | 8393 |
| SCNN1A-4545 | - | CUUGCGGGACAACAACCCCCAG | 22 | 8394 |
| SCNN1A-4546 | - | GCUUGCGGGACAACAACCCCCAG | 23 | 8395 |
| SCNN1A-4547 | - | AGCUUGCGGGACAACAACCCCCAG | 24 | 8396 |
| SCNN1A-4548 | - | UCCAACCUGGGCAGCCAG | 18 | 8397 |
| SCNN1A-4549 | - | GUCCAACCUGGGCAGCCAG | 19 | 8398 |
| SCNN1A-1116 | - | UGUCCAACCUGGGCAGCCAG | 20 | 4965 |
| SCNN1A-4550 | - | CUGUCCAACCUGGGCAGCCAG | 21 | 8399 |
| SCNN1A-4551 | - | CCUGUCCAACCUGGGCAGCCAG | 22 | 8400 |
| SCNN1A-4552 | - | UCCUGUCCAACCUGGGCAGCCAG | 23 | 8401 |
| SCNN1A-4553 | - | CUCCUGUCCAACCUGGGCAGCCAG | 24 | 8402 |
| SCNN1A-4554 | - | AUUCACUCCUGCUUCCAG | 18 | 8403 |
| SCNN1A-4555 | - | UAUUCACUCCUGCUUCCAG | 19 | 8404 |
| SCNN1A-4556 | - | GUAUUCACUCCUGCUUCCAG | 20 | 8405 |
| SCNN1A-4557 | - | UGUAUUCACUCCUGCUUCCAG | 21 | 8406 |
| SCNN1A-4558 | - | GUGUAUUCACUCCUGCUUCCAG | 22 | 8407 |
| SCNN1A-4559 | - | UGUGUAUUCACUCCUGCUUCCAG | 23 | 8408 |
| SCNN1A-4560 | - | GUGUGUAUUCACUCCUGCUUCCAG | 24 | 8409 |
| SCNN1A-4561 | - | UCAAAGUACACACAGCAG | 18 | 8410 |
| SCNN1A-4562 | - | UUCAAAGUACACACAGCAG | 19 | 8411 |
| SCNN1A-4563 | - | CUUCAAAGUACACACAGCAG | 20 | 8412 |
| SCNN1A-4564 | - | CCUUCAAAGUACACACAGCAG | 21 | 8413 |
| SCNN1A-4565 | - | CCCUUCAAAGUACACACAGCAG | 22 | 8414 |
| SCNN1A-4566 | - | ACCCUUCAAAGUACACACAGCAG | 23 | 8415 |

TABLE 44G-continued

7th Tier

| gRNA Name | DNA Strand | Targeting Domain | Target Site Length | Seq ID |
|---|---|---|---|---|
| SCNN1A-4567 | − | UACCCUUCAAAGUACACACAGCAG | 24 | 8416 |
| SCNN1A-4568 | − | AACAUCUUCUUCAAGGAG | 18 | 8417 |
| SCNN1A-4569 | − | CAACAUCUUCUUCAAGGAG | 19 | 8418 |
| SCNN1A-4570 | − | UCAACAUCUUCUUCAAGGAG | 20 | 8419 |
| SCNN1A-4571 | − | GUCAACAUCUUCUUCAAGGAG | 21 | 8420 |
| SCNN1A-4572 | − | AGUCAACAUCUUCUUCAAGGAG | 22 | 8421 |
| SCNN1A-4573 | − | AAGUCAACAUCUUCUUCAAGGAG | 23 | 8422 |
| SCNN1A-4574 | − | AAAGUCAACAUCUUCUUCAAGGAG | 24 | 8423 |
| SCNN1A-4575 | − | CCGGAAAUUAAAGAGGAG | 18 | 8424 |
| SCNN1A-4576 | − | CCCGGAAAUUAAAGAGGAG | 19 | 8425 |
| SCNN1A-4577 | − | ACCCGGAAAUUAAAGAGGAG | 20 | 8426 |
| SCNN1A-4578 | − | UACCCGGAAAUUAAAGAGGAG | 21 | 8427 |
| SCNN1A-4579 | − | GUACCCGGAAAUUAAAGAGGAG | 22 | 8428 |
| SCNN1A-4580 | − | GGUACCCGGAAAUUAAAGAGGAG | 23 | 8429 |
| SCNN1A-4581 | − | AGGUACCCGGAAAUUAAAGAGGAG | 24 | 8430 |
| SCNN1A-4582 | − | AAAGAGGAGCUGGAGGAG | 18 | 8431 |
| SCNN1A-4583 | − | UAAAGAGGAGCUGGAGGAG | 19 | 8432 |
| SCNN1A-4584 | − | UUAAAGAGGAGCUGGAGGAG | 20 | 8433 |
| SCNN1A-4585 | − | AUUAAAGAGGAGCUGGAGGAG | 21 | 8434 |
| SCNN1A-4586 | − | AAUUAAAGAGGAGCUGGAGGAG | 22 | 8435 |
| SCNN1A-4587 | − | AAAUUAAAGAGGAGCUGGAGGAG | 23 | 8436 |
| SCNN1A-4588 | − | GAAAUUAAAGAGGAGCUGGAGGAG | 24 | 8437 |
| SCNN1A-4589 | − | ACUCUGCCAUCCCUGGAG | 18 | 8438 |
| SCNN1A-4590 | − | GACUCUGCCAUCCCUGGAG | 19 | 8439 |
| SCNN1A-4591 | − | AGACUCUGCCAUCCCUGGAG | 20 | 8440 |
| SCNN1A-4592 | − | GAGACUCUGCCAUCCCUGGAG | 21 | 8441 |
| SCNN1A-4593 | − | AGAGACUCUGCCAUCCCUGGAG | 22 | 8442 |
| SCNN1A-4594 | − | CAGAGACUCUGCCAUCCCUGGAG | 23 | 8443 |
| SCNN1A-4595 | − | CCAGAGACUCUGCCAUCCCUGGAG | 24 | 8444 |
| SCNN1A-4596 | − | CUCUGGGGGGCCCUGAG | 18 | 8445 |
| SCNN1A-4597 | − | CCUCUGGGGGGCCCUGAG | 19 | 8446 |
| SCNN1A-1140 | − | UCCUCUGGGGGGCCCUGAG | 20 | 4989 |
| SCNN1A-4598 | − | GUCCUCUGGGGGGCCCUGAG | 21 | 8447 |
| SCNN1A-4599 | − | UGUCCUCUGGGGGGCCCUGAG | 22 | 8448 |
| SCNN1A-4600 | − | CUGUCCUCUGGGGGGCCCUGAG | 23 | 8449 |
| SCNN1A-4601 | − | CCUGUCCUCUGGGGGGCCCUGAG | 24 | 8450 |
| SCNN1A-4602 | − | UGCCUGGAAUCAACAACG | 18 | 8451 |
| SCNN1A-4603 | − | AUGCCUGGAAUCAACAACG | 19 | 8452 |

TABLE 44G-continued

7th Tier

| gRNA Name | DNA Strand | Targeting Domain | Target Site Length | Seq ID |
|---|---|---|---|---|
| SCNN1A-4604 | − | CAUGCCUGGAAUCAACAACG | 20 | 8453 |
| SCNN1A-4605 | − | CCAUGCCUGGAAUCAACAACG | 21 | 8454 |
| SCNN1A-4606 | − | UCCAUGCCUGGAAUCAACAACG | 22 | 8455 |
| SCNN1A-4607 | − | UUCCAUGCCUGGAAUCAACAACG | 23 | 8456 |
| SCNN1A-4608 | − | CUUCCAUGCCUGGAAUCAACAACG | 24 | 8457 |
| SCNN1A-4609 | − | UCCCUGGAGGAGGACACG | 18 | 8458 |
| SCNN1A-4610 | − | AUCCCUGGAGGAGGACACG | 19 | 8459 |
| SCNN1A-4611 | − | CAUCCCUGGAGGAGGACACG | 20 | 8460 |
| SCNN1A-4612 | − | CCAUCCCUGGAGGAGGACACG | 21 | 8461 |
| SCNN1A-4613 | − | GCCAUCCCUGGAGGAGGACACG | 22 | 8462 |
| SCNN1A-4614 | − | UGCCAUCCCUGGAGGAGGACACG | 23 | 8463 |
| SCNN1A-4615 | − | CUGCCAUCCCUGGAGGAGGACACG | 24 | 8464 |
| SCNN1A-4616 | − | CCCGCCUCACGGGGCCCG | 18 | 8465 |
| SCNN1A-4617 | − | CCCCGCCUCACGGGGCCCG | 19 | 8466 |
| SCNN1A-4618 | − | CCCCCGCCUCACGGGGCCCG | 20 | 8467 |
| SCNN1A-4619 | − | GCCCCCGCCUCACGGGGCCCG | 21 | 8468 |
| SCNN1A-4620 | − | CGCCCCCGCCUCACGGGGCCCG | 22 | 8469 |
| SCNN1A-4621 | − | CCGCCCCCGCCUCACGGGGCCCG | 23 | 8470 |
| SCNN1A-4622 | − | CCCGCCCCCGCCUCACGGGGCCCG | 24 | 8471 |
| SCNN1A-4623 | − | GUGAGGCCCGCAGCGCCG | 18 | 8472 |
| SCNN1A-4624 | − | GGUGAGGCCCGCAGCGCCG | 19 | 8473 |
| SCNN1A-1148 | − | UGGUGAGGCCCGCAGCGCCG | 20 | 4997 |
| SCNN1A-4625 | − | CUGGUGAGGCCCGCAGCGCCG | 21 | 8474 |
| SCNN1A-4626 | − | GCUGGUGAGGCCCGCAGCGCCG | 22 | 8475 |
| SCNN1A-4627 | − | AGCUGGUGAGGCCCGCAGCGCCG | 23 | 8476 |
| SCNN1A-4628 | − | CAGCUGGUGAGGCCCGCAGCGCCG | 24 | 8477 |
| SCNN1A-4629 | − | AUACUGGUCUCCAGGCCG | 18 | 8478 |
| SCNN1A-4630 | − | GAUACUGGUCUCCAGGCCG | 19 | 8479 |
| SCNN1A-1149 | − | CGAUACUGGUCUCCAGGCCG | 20 | 4998 |
| SCNN1A-4631 | − | CCGAUACUGGUCUCCAGGCCG | 21 | 8480 |
| SCNN1A-4632 | − | GCCGAUACUGGUCUCCAGGCCG | 22 | 8481 |
| SCNN1A-4633 | − | AGCCGAUACUGGUCUCCAGGCCG | 23 | 8482 |
| SCNN1A-4634 | − | AAGCCGAUACUGGUCUCCAGGCCG | 24 | 8483 |
| SCNN1A-4635 | − | CUGGUGAGGCCCGCAGCG | 18 | 8484 |
| SCNN1A-4636 | − | GCUGGUGAGGCCCGCAGCG | 19 | 8485 |
| SCNN1A-4637 | − | AGCUGGUGAGGCCCGCAGCG | 20 | 8486 |
| SCNN1A-4638 | − | CAGCUGGUGAGGCCCGCAGCG | 21 | 8487 |

TABLE 44G-continued

7th Tier

| gRNA Name | DNA Strand | Targeting Domain | Target Site Length | Seq ID |
|---|---|---|---|---|
| SCNN1A-4639 | − | CCAGCUGGUGAGGCCCGCAGCG | 22 | 8488 |
| SCNN1A-4640 | − | UCCAGCUGGUGAGGCCCGCAGCG | 23 | 8489 |
| SCNN1A-4641 | − | UUCCAGCUGGUGAGGCCCGCAGCG | 24 | 8490 |
| SCNN1A-4642 | − | UGUCCCUGAUGCUGCGCG | 18 | 8491 |
| SCNN1A-4643 | − | CUGUCCCUGAUGCUGCGCG | 19 | 8492 |
| SCNN1A-4644 | − | UCUGUCCCUGAUGCUGCGCG | 20 | 8493 |
| SCNN1A-4645 | − | GUCUGUCCCUGAUGCUGCGCG | 21 | 8494 |
| SCNN1A-4646 | − | GGUCUGUCCCUGAUGCUGCGCG | 22 | 8495 |
| SCNN1A-4647 | − | AGGUCUGUCCCUGAUGCUGCGCG | 23 | 8496 |
| SCNN1A-4648 | − | UAGGUCUGUCCCUGAUGCUGCGCG | 24 | 8497 |
| SCNN1A-4649 | − | UUAACUUGCGGCCUGGCG | 18 | 8498 |
| SCNN1A-4650 | − | UUUAACUUGCGGCCUGGCG | 19 | 8499 |
| SCNN1A-1157 | − | CUUUAACUUGCGGCCUGGCG | 20 | 5006 |
| SCNN1A-4651 | − | GCUUUAACUUGCGGCCUGGCG | 21 | 8500 |
| SCNN1A-4652 | − | GGCUUUAACUUGCGGCCUGGCG | 22 | 8501 |
| SCNN1A-4653 | − | UGGCUUUAACUUGCGGCCUGGCG | 23 | 8502 |
| SCNN1A-4654 | − | GUGGCUUUAACUUGCGGCCUGGCG | 24 | 8503 |
| SCNN1A-4655 | − | UCAUCAGGGGUGGAUGCG | 18 | 8504 |
| SCNN1A-4656 | − | CUCAUCAGGGGUGGAUGCG | 19 | 8505 |
| SCNN1A-4657 | − | ACUCAUCAGGGGUGGAUGCG | 20 | 8506 |
| SCNN1A-4658 | − | UACUCAUCAGGGGUGGAUGCG | 21 | 8507 |
| SCNN1A-4659 | − | AUACUCAUCAGGGGUGGAUGCG | 22 | 8508 |
| SCNN1A-4660 | − | CAUACUCAUCAGGGGUGGAUGCG | 23 | 8509 |
| SCNN1A-4661 | − | ACAUACUCAUCAGGGGUGGAUGCG | 24 | 8510 |
| SCNN1A-4662 | − | CAGCCGUCGCGACCUGCG | 18 | 8511 |
| SCNN1A-4663 | − | GCAGCCGUCGCGACCUGCG | 19 | 8512 |
| SCNN1A-1158 | − | CGCAGCCGUCGCGACCUGCG | 20 | 5007 |
| SCNN1A-4664 | − | CCGCAGCCGUCGCGACCUGCG | 21 | 8513 |
| SCNN1A-4665 | − | CCCGCAGCCGUCGCGACCUGCG | 22 | 8514 |
| SCNN1A-4666 | − | UCCCGCAGCCGUCGCGACCUGCG | 23 | 8515 |
| SCNN1A-4667 | − | CUCCCGCAGCCGUCGCGACCUGCG | 24 | 8516 |
| SCNN1A-4668 | − | CCGAUACUGGUCUCCAGG | 18 | 8517 |
| SCNN1A-4669 | − | GCCGAUACUGGUCUCCAGG | 19 | 8518 |
| SCNN1A-4670 | − | AGCCGAUACUGGUCUCCAGG | 20 | 8519 |
| SCNN1A-4671 | − | AAGCCGAUACUGGUCUCCAGG | 21 | 8520 |
| SCNN1A-4672 | − | GAAGCCGAUACUGGUCUCCAGG | 22 | 8521 |
| SCNN1A-4673 | − | CGAAGCCGAUACUGGUCUCCAGG | 23 | 8522 |
| SCNN1A-4674 | − | CCGAAGCCGAUACUGGUCUCCAGG | 24 | 8523 |

TABLE 44G-continued

7th Tier

| gRNA Name | DNA Strand | Targeting Domain | Target Site Length | Seq ID |
|---|---|---|---|---|
| SCNN1A-4675 | - | UAAUGGUGCACGGGCAGG | 18 | 8524 |
| SCNN1A-4676 | - | GUAAUGGUGCACGGGCAGG | 19 | 8525 |
| SCNN1A-4677 | - | GGUAAUGGUGCACGGGCAGG | 20 | 8526 |
| SCNN1A-4678 | - | GGGUAAUGGUGCACGGGCAGG | 21 | 8527 |
| SCNN1A-4679 | - | CGGGUAAUGGUGCACGGGCAGG | 22 | 8528 |
| SCNN1A-4680 | - | CCGGGUAAUGGUGCACGGGCAGG | 23 | 8529 |
| SCNN1A-4681 | - | CCCGGGUAAUGGUGCACGGGCAGG | 24 | 8530 |
| SCNN1A-4682 | - | GGGGGGGCCCUGAGAGGG | 18 | 8531 |
| SCNN1A-4683 | - | UGGGGGGGCCCUGAGAGGG | 19 | 8532 |
| SCNN1A-4684 | - | CUGGGGGGGCCCUGAGAGGG | 20 | 8533 |
| SCNN1A-4685 | - | UCUGGGGGGGCCCUGAGAGGG | 21 | 8534 |
| SCNN1A-4686 | - | CUCUGGGGGGGCCCUGAGAGGG | 22 | 8535 |
| SCNN1A-4687 | - | CCUCUGGGGGGGCCCUGAGAGGG | 23 | 8536 |
| SCNN1A-4688 | - | UCCUCUGGGGGGGCCCUGAGAGGG | 24 | 8537 |
| SCNN1A-4689 | - | GUCUCCAGGCCGAGGGGG | 18 | 8538 |
| SCNN1A-4690 | - | GGUCUCCAGGCCGAGGGGG | 19 | 8539 |
| SCNN1A-4691 | - | UGGUCUCCAGGCCGAGGGGG | 20 | 8540 |
| SCNN1A-4692 | - | CUGGUCUCCAGGCCGAGGGGG | 21 | 8541 |
| SCNN1A-4693 | - | ACUGGUCUCCAGGCCGAGGGGG | 22 | 8542 |
| SCNN1A-4694 | - | UACUGGUCUCCAGGCCGAGGGGG | 23 | 8543 |
| SCNN1A-4695 | - | AUACUGGUCUCCAGGCCGAGGGGG | 24 | 8544 |
| SCNN1A-4696 | - | CCCAGGUAGAGUGUGGGG | 18 | 8545 |
| SCNN1A-4697 | - | UCCCAGGUAGAGUGUGGGG | 19 | 8546 |
| SCNN1A-4698 | - | AUCCCAGGUAGAGUGUGGGG | 20 | 8547 |
| SCNN1A-4699 | - | CAUCCCAGGUAGAGUGUGGGG | 21 | 8548 |
| SCNN1A-4700 | - | ACAUCCCAGGUAGAGUGUGGGG | 22 | 8549 |
| SCNN1A-4701 | - | GACAUCCCAGGUAGAGUGUGGGG | 23 | 8550 |
| SCNN1A-4702 | - | UGACAUCCCAGGUAGAGUGUGGGG | 24 | 8551 |
| SCNN1A-4703 | - | GUGUGGGGAAGGGAUGGG | 18 | 8552 |
| SCNN1A-4704 | - | AGUGUGGGGAAGGGAUGGG | 19 | 8553 |
| SCNN1A-1189 | - | GAGUGUGGGGAAGGGAUGGG | 20 | 5038 |
| SCNN1A-4705 | - | AGAGUGUGGGGAAGGGAUGGG | 21 | 8554 |
| SCNN1A-4706 | - | UAGAGUGUGGGGAAGGGAUGGG | 22 | 8555 |
| SCNN1A-4707 | - | GUAGAGUGUGGGGAAGGGAUGGG | 23 | 8556 |
| SCNN1A-4708 | - | GGUAGAGUGUGGGGAAGGGAUGGG | 24 | 8557 |
| SCNN1A-4709 | - | GAAAGCACAGUUCCUGGG | 18 | 8558 |
| SCNN1A-4710 | - | AGAAAGCACAGUUCCUGGG | 19 | 8559 |

TABLE 44G-continued

7th Tier

| gRNA Name | DNA Strand | Targeting Domain | Target Site Length | Seq ID |
|---|---|---|---|---|
| SCNN1A-4711 | - | CAGAAAGCACAGUUCCUGGG | 20 | 8560 |
| SCNN1A-4712 | - | ACAGAAAGCACAGUUCCUGGG | 21 | 8561 |
| SCNN1A-4713 | - | UACAGAAAGCACAGUUCCUGGG | 22 | 8562 |
| SCNN1A-4714 | - | CUACAGAAAGCACAGUUCCUGGG | 23 | 8563 |
| SCNN1A-4715 | - | ACUACAGAAAGCACAGUUCCUGGG | 24 | 8564 |
| SCNN1A-4716 | - | UGUCUGUGGUGGAGAUGG | 18 | 8565 |
| SCNN1A-4717 | - | UUGUCUGUGGUGGAGAUGG | 19 | 8566 |
| SCNN1A-4718 | - | GUUGUCUGUGGUGGAGAUGG | 20 | 8567 |
| SCNN1A-4719 | - | UGUUGUCUGUGGUGGAGAUGG | 21 | 8568 |
| SCNN1A-4720 | - | GUGUUGUCUGUGGUGGAGAUGG | 22 | 8569 |
| SCNN1A-4721 | - | GGUGUUGUCUGUGGUGGAGAUGG | 23 | 8570 |
| SCNN1A-4722 | - | CGGUGUUGUCUGUGGUGGAGAUGG | 24 | 8571 |
| SCNN1A-4723 | - | AGUGUGGGGAAGGGAUGG | 18 | 8572 |
| SCNN1A-4724 | - | GAGUGUGGGGAAGGGAUGG | 19 | 8573 |
| SCNN1A-4725 | - | AGAGUGUGGGGAAGGGAUGG | 20 | 8574 |
| SCNN1A-4726 | - | UAGAGUGUGGGGAAGGGAUGG | 21 | 8575 |
| SCNN1A-4727 | - | GUAGAGUGUGGGGAAGGGAUGG | 22 | 8576 |
| SCNN1A-4728 | - | GGUAGAGUGUGGGGAAGGGAUGG | 23 | 8577 |
| SCNN1A-4729 | - | AGGUAGAGUGUGGGGAAGGGAUGG | 24 | 8578 |
| SCNN1A-4730 | - | AACCCCCAGGUGGACUGG | 18 | 8579 |
| SCNN1A-4731 | - | CAACCCCCAGGUGGACUGG | 19 | 8580 |
| SCNN1A-4732 | - | ACAACCCCCAGGUGGACUGG | 20 | 8581 |
| SCNN1A-4733 | - | AACAACCCCCAGGUGGACUGG | 21 | 8582 |
| SCNN1A-4734 | - | CAACAACCCCCAGGUGGACUGG | 22 | 8583 |
| SCNN1A-4735 | - | ACAACAACCCCCAGGUGGACUGG | 23 | 8584 |
| SCNN1A-4736 | - | GACAACAACCCCCAGGUGGACUGG | 24 | 8585 |
| SCNN1A-4737 | - | AGACUCUGCCAUCCCUGG | 18 | 8586 |
| SCNN1A-4738 | - | GAGACUCUGCCAUCCCUGG | 19 | 8587 |
| SCNN1A-1196 | - | AGAGACUCUGCCAUCCCUGG | 20 | 5045 |
| SCNN1A-4739 | - | CAGAGACUCUGCCAUCCCUGG | 21 | 8588 |
| SCNN1A-4740 | - | CCAGAGACUCUGCCAUCCCUGG | 22 | 8589 |
| SCNN1A-4741 | - | GCCAGAGACUCUGCCAUCCCUGG | 23 | 8590 |
| SCNN1A-4742 | - | UGCCAGAGACUCUGCCAUCCCUGG | 24 | 8591 |
| SCNN1A-4743 | - | ACGGUAGGUCGUGCCUGG | 18 | 8592 |
| SCNN1A-4744 | - | CACGGUAGGUCGUGCCUGG | 19 | 8593 |
| SCNN1A-4745 | - | UCACGGUAGGUCGUGCCUGG | 20 | 8594 |
| SCNN1A-4746 | - | GUCACGGUAGGUCGUGCCUGG | 21 | 8595 |
| SCNN1A-4747 | - | UGUCACGGUAGGUCGUGCCUGG | 22 | 8596 |

TABLE 44G-continued

7th Tier

| gRNA Name | DNA Strand | Targeting Domain | Target Site Length | Seq ID |
|---|---|---|---|---|
| SCNN1A-4748 | - | CUGUCACGGUAGGUCGUGCCUGG | 23 | 8597 |
| SCNN1A-4749 | - | UCUGUCACGGUAGGUCGUGCCUGG | 24 | 8598 |
| SCNN1A-4750 | - | AAAUUAAAGAGGAGCUGG | 18 | 8599 |
| SCNN1A-4751 | - | GAAAUUAAAGAGGAGCUGG | 19 | 8600 |
| SCNN1A-1198 | - | GGAAAUUAAAGAGGAGCUGG | 20 | 5047 |
| SCNN1A-4752 | - | CGGAAAUUAAAGAGGAGCUGG | 21 | 8601 |
| SCNN1A-4753 | - | CCGGAAAUUAAAGAGGAGCUGG | 22 | 8602 |
| SCNN1A-4754 | - | CCCGGAAAUUAAAGAGGAGCUGG | 23 | 8603 |
| SCNN1A-4755 | - | ACCCGGAAAUUAAAGAGGAGCUGG | 24 | 8604 |
| SCNN1A-4756 | - | CCUCCACCUGUCCUCUGG | 18 | 8605 |
| SCNN1A-4757 | - | UCCUCCACCUGUCCUCUGG | 19 | 8606 |
| SCNN1A-1199 | - | UUCCUCCACCUGUCCUCUGG | 20 | 5048 |
| SCNN1A-4758 | - | GUUCCUCCACCUGUCCUCUGG | 21 | 8607 |
| SCNN1A-4759 | - | AGUUCCUCCACCUGUCCUCUGG | 22 | 8608 |
| SCNN1A-4760 | - | CAGUUCCUCCACCUGUCCUCUGG | 23 | 8609 |
| SCNN1A-4761 | - | CCAGUUCCUCCACCUGUCCUCUGG | 24 | 8610 |
| SCNN1A-4762 | - | CCUCGGUGUUGUCUGUGG | 18 | 8611 |
| SCNN1A-4763 | - | UCCUCGGUGUUGUCUGUGG | 19 | 8612 |
| SCNN1A-1205 | - | CUCCUCGGUGUUGUCUGUGG | 20 | 5054 |
| SCNN1A-4764 | - | GCUCCUCGGUGUUGUCUGUGG | 21 | 8613 |
| SCNN1A-4765 | - | GGCUCCUCGGUGUUGUCUGUGG | 22 | 8614 |
| SCNN1A-4766 | - | CGGCUCCUCGGUGUUGUCUGUGG | 23 | 8615 |
| SCNN1A-4767 | - | UCGGCUCCUCGGUGUUGUCUGUGG | 24 | 8616 |
| SCNN1A-4768 | - | GAGACCUCCAUCAGCAUG | 18 | 8617 |
| SCNN1A-4769 | - | GGAGACCUCCAUCAGCAUG | 19 | 8618 |
| SCNN1A-1210 | - | UGGAGACCUCCAUCAGCAUG | 20 | 5059 |
| SCNN1A-4770 | - | GUGGAGACCUCCAUCAGCAUG | 21 | 8619 |
| SCNN1A-4771 | - | CGUGGAGACCUCCAUCAGCAUG | 22 | 8620 |
| SCNN1A-4772 | - | GCGUGGAGACCUCCAUCAGCAUG | 23 | 8621 |
| SCNN1A-4773 | - | GGCGUGGAGACCUCCAUCAGCAUG | 24 | 8622 |
| SCNN1A-4774 | - | CGCAGCCGUCGCGACCUG | 18 | 8623 |
| SCNN1A-4775 | - | CCGCAGCCGUCGCGACCUG | 19 | 8624 |
| SCNN1A-1216 | - | CCCGCAGCCGUCGCGACCUG | 20 | 5065 |
| SCNN1A-4776 | - | UCCCGCAGCCGUCGCGACCUG | 21 | 8625 |
| SCNN1A-4777 | - | CUCCCGCAGCCGUCGCGACCUG | 22 | 8626 |
| SCNN1A-4778 | - | GCUCCCGCAGCCGUCGCGACCUG | 23 | 8627 |
| SCNN1A-4779 | - | GGCUCCCGCAGCCGUCGCGACCUG | 24 | 8628 |

TABLE 44G-continued

7th Tier

| gRNA Name | DNA Strand | Targeting Domain | Target Site Length | Seq ID |
|---|---|---|---|---|
| SCNN1A-4780 | - | GAGACUCUGCCAUCCCUG | 18 | 8629 |
| SCNN1A-4781 | - | AGAGACUCUGCCAUCCCUG | 19 | 8630 |
| SCNN1A-4782 | - | CAGAGACUCUGCCAUCCCUG | 20 | 8631 |
| SCNN1A-4783 | - | CCAGAGACUCUGCCAUCCCUG | 21 | 8632 |
| SCNN1A-4784 | - | GCCAGAGACUCUGCCAUCCCUG | 22 | 8633 |
| SCNN1A-4785 | - | UGCCAGAGACUCUGCCAUCCCUG | 23 | 8634 |
| SCNN1A-4786 | - | CUGCCAGAGACUCUGCCAUCCCUG | 24 | 8635 |
| SCNN1A-4787 | - | CACUACAUCAACAUCCUG | 18 | 8636 |
| SCNN1A-4788 | - | CCACUACAUCAACAUCCUG | 19 | 8637 |
| SCNN1A-4789 | - | UCCACUACAUCAACAUCCUG | 20 | 8638 |
| SCNN1A-4790 | - | UUCCACUACAUCAACAUCCUG | 21 | 8639 |
| SCNN1A-4791 | - | CUUCCACUACAUCAACAUCCUG | 22 | 8640 |
| SCNN1A-4792 | - | GCUUCCACUACAUCAACAUCCUG | 23 | 8641 |
| SCNN1A-4793 | - | CGCUUCCACUACAUCAACAUCCUG | 24 | 8642 |
| SCNN1A-4794 | - | AUGGCAGUGAUGUUCCUG | 18 | 8643 |
| SCNN1A-4795 | - | AAUGGCAGUGAUGUUCCUG | 19 | 8644 |
| SCNN1A-4796 | - | GAAUGGCAGUGAUGUUCCUG | 20 | 8645 |
| SCNN1A-4797 | - | AGAAUGGCAGUGAUGUUCCUG | 21 | 8646 |
| SCNN1A-4798 | - | AAGAAUGGCAGUGAUGUUCCUG | 22 | 8647 |
| SCNN1A-4799 | - | CAAGAAUGGCAGUGAUGUUCCUG | 23 | 8648 |
| SCNN1A-4800 | - | CCAAGAAUGGCAGUGAUGUUCCUG | 24 | 8649 |
| SCNN1A-4801 | - | AAGAUCGGCUUCCAGCUG | 18 | 8650 |
| SCNN1A-4802 | - | GAAGAUCGGCUUCCAGCUG | 19 | 8651 |
| SCNN1A-4803 | - | GGAAGAUCGGCUUCCAGCUG | 20 | 8652 |
| SCNN1A-4804 | - | UGGAAGAUCGGCUUCCAGCUG | 21 | 8653 |
| SCNN1A-4805 | - | CUGGAAGAUCGGCUUCCAGCUG | 22 | 8654 |
| SCNN1A-4806 | - | ACUGGAAGAUCGGCUUCCAGCUG | 23 | 8655 |
| SCNN1A-4807 | - | GACUGGAAGAUCGGCUUCCAGCUG | 24 | 8656 |
| SCNN1A-4808 | - | GAAAUUAAAGAGGAGCUG | 18 | 8657 |
| SCNN1A-4809 | - | GGAAAUUAAAGAGGAGCUG | 19 | 8658 |
| SCNN1A-4810 | - | CGGAAAUUAAAGAGGAGCUG | 20 | 8659 |
| SCNN1A-4811 | - | CCGGAAAUUAAAGAGGAGCUG | 21 | 8660 |
| SCNN1A-4812 | - | CCCGGAAAUUAAAGAGGAGCUG | 22 | 8661 |
| SCNN1A-4813 | - | ACCCGGAAAUUAAAGAGGAGCUG | 23 | 8662 |
| SCNN1A-4814 | - | UACCCGGAAAUUAAAGAGGAGCUG | 24 | 8663 |
| SCNN1A-4815 | - | UCCUCCACCUGUCCUCUG | 18 | 8664 |
| SCNN1A-4816 | - | UUCCUCCACCUGUCCUCUG | 19 | 8665 |
| SCNN1A-1224 | - | GUUCCUCCACCUGUCCUCUG | 20 | 5073 |

TABLE 44G-continued

7th Tier

| gRNA Name | DNA Strand | Targeting Domain | Target Site Length | Seq ID |
|---|---|---|---|---|
| SCNN1A-4817 | - | AGUUCCUCCACCUGUCCUCUG | 21 | 8666 |
| SCNN1A-4818 | - | CAGUUCCUCCACCUGUCCUCUG | 22 | 8667 |
| SCNN1A-4819 | - | CCAGUUCCUCCACCUGUCCUCUG | 23 | 8668 |
| SCNN1A-4820 | - | GCCAGUUCCUCCACCUGUCCUCUG | 24 | 8669 |
| SCNN1A-4821 | - | CAUCUCCAGGGGGCUCUG | 18 | 8670 |
| SCNN1A-4822 | - | CCAUCUCCAGGGGGCUCUG | 19 | 8671 |
| SCNN1A-4823 | - | CCCAUCUCCAGGGGGCUCUG | 20 | 8672 |
| SCNN1A-4824 | - | GCCCAUCUCCAGGGGGCUCUG | 21 | 8673 |
| SCNN1A-4825 | - | CGCCCAUCUCCAGGGGGCUCUG | 22 | 8674 |
| SCNN1A-4826 | - | CCGCCCAUCUCCAGGGGGCUCUG | 23 | 8675 |
| SCNN1A-4827 | - | CCCGCCCAUCUCCAGGGGGCUCUG | 24 | 8676 |
| SCNN1A-4828 | - | GGGCUGUUUCACCAAGUG | 18 | 8677 |
| SCNN1A-4829 | - | UGGGCUGUUUCACCAAGUG | 19 | 8678 |
| SCNN1A-4830 | - | CUGGGCUGUUUCACCAAGUG | 20 | 8679 |
| SCNN1A-4831 | - | CCUGGGCUGUUUCACCAAGUG | 21 | 8680 |
| SCNN1A-4832 | - | ACCUGGGCUGUUUCACCAAGUG | 22 | 8681 |
| SCNN1A-4833 | - | CACCUGGGCUGUUUCACCAAGUG | 23 | 8682 |
| SCNN1A-4834 | - | CCACCUGGGCUGUUUCACCAAGUG | 24 | 8683 |
| SCNN1A-4835 | - | GACAUCCCAGGUAGAGUG | 18 | 8684 |
| SCNN1A-4836 | - | UGACAUCCCAGGUAGAGUG | 19 | 8685 |
| SCNN1A-1228 | - | GUGACAUCCCAGGUAGAGUG | 20 | 5077 |
| SCNN1A-4837 | - | GGUGACAUCCCAGGUAGAGUG | 21 | 8686 |
| SCNN1A-4838 | - | CGGUGACAUCCCAGGUAGAGUG | 22 | 8687 |
| SCNN1A-4839 | - | UCGGUGACAUCCCAGGUAGAGUG | 23 | 8688 |
| SCNN1A-4840 | - | CUCGGUGACAUCCCAGGUAGAGUG | 24 | 8689 |
| SCNN1A-4841 | - | UCAGGGGUGGAUGCGGUG | 18 | 8690 |
| SCNN1A-4842 | - | AUCAGGGGUGGAUGCGGUG | 19 | 8691 |
| SCNN1A-1233 | - | CAUCAGGGGUGGAUGCGGUG | 20 | 5082 |
| SCNN1A-4843 | - | UCAUCAGGGGUGGAUGCGGUG | 21 | 8692 |
| SCNN1A-4844 | - | CUCAUCAGGGGUGGAUGCGGUG | 22 | 8693 |
| SCNN1A-4845 | - | ACUCAUCAGGGGUGGAUGCGGUG | 23 | 8694 |
| SCNN1A-4846 | - | UACUCAUCAGGGGUGGAUGCGGUG | 24 | 8695 |
| SCNN1A-4847 | - | UCCUCGGUGUUGUCUGUG | 18 | 8696 |
| SCNN1A-4848 | - | CUCCUCGGUGUUGUCUGUG | 19 | 8697 |
| SCNN1A-4849 | - | GCUCCUCGGUGUUGUCUGUG | 20 | 8698 |
| SCNN1A-4850 | - | GGCUCCUCGGUGUUGUCUGUG | 21 | 8699 |
| SCNN1A-4851 | - | CGGCUCCUCGGUGUUGUCUGUG | 22 | 8700 |

TABLE 44G-continued

7th Tier

| gRNA Name | DNA Strand | Targeting Domain | Target Site Length | Seq ID |
|---|---|---|---|---|
| SCNN1A-4852 | - | UCGGCUCCUCGGUGUUGUCUGUG | 23 | 8701 |
| SCNN1A-4853 | - | UUCGGCUCCUCGGUGUUGUCUGUG | 24 | 8702 |
| SCNN1A-4854 | - | CAUCCCAGGUAGAGUGUG | 18 | 8703 |
| SCNN1A-4855 | - | ACAUCCCAGGUAGAGUGUG | 19 | 8704 |
| SCNN1A-1238 | - | GACAUCCCAGGUAGAGUGUG | 20 | 5087 |
| SCNN1A-4856 | - | UGACAUCCCAGGUAGAGUGUG | 21 | 8705 |
| SCNN1A-4857 | - | GUGACAUCCCAGGUAGAGUGUG | 22 | 8706 |
| SCNN1A-4858 | - | GGUGACAUCCCAGGUAGAGUGUG | 23 | 8707 |
| SCNN1A-4859 | - | CGGUGACAUCCCAGGUAGAGUGUG | 24 | 8708 |
| SCNN1A-4860 | - | AGCGUGGCCUCCAGCUUG | 18 | 8709 |
| SCNN1A-4861 | - | UAGCGUGGCCUCCAGCUUG | 19 | 8710 |
| SCNN1A-1242 | - | GUAGCGUGGCCUCCAGCUUG | 20 | 5091 |
| SCNN1A-4862 | - | CGUAGCGUGGCCUCCAGCUUG | 21 | 8711 |
| SCNN1A-4863 | - | CCGUAGCGUGGCCUCCAGCUUG | 22 | 8712 |
| SCNN1A-4864 | - | CCCGUAGCGUGGCCUCCAGCUUG | 23 | 8713 |
| SCNN1A-4865 | - | GCCCGUAGCGUGGCCUCCAGCUUG | 24 | 8714 |
| SCNN1A-4866 | - | GGAGACCUCCAUCAGCAU | 18 | 8715 |
| SCNN1A-4867 | - | UGGAGACCUCCAUCAGCAU | 19 | 8716 |
| SCNN1A-4868 | - | GUGGAGACCUCCAUCAGCAU | 20 | 8717 |
| SCNN1A-4869 | - | CGUGGAGACCUCCAUCAGCAU | 21 | 8718 |
| SCNN1A-4870 | - | GCGUGGAGACCUCCAUCAGCAU | 22 | 8719 |
| SCNN1A-4871 | - | GGCGUGGAGACCUCCAUCAGCAU | 23 | 8720 |
| SCNN1A-4872 | - | UGGCGUGGAGACCUCCAUCAGCAU | 24 | 8721 |
| SCNN1A-4873 | - | UCUACCAGACAUACUCAU | 18 | 8722 |
| SCNN1A-4874 | - | UUCUACCAGACAUACUCAU | 19 | 8723 |
| SCNN1A-4875 | - | CUUCUACCAGACAUACUCAU | 20 | 8724 |
| SCNN1A-4876 | - | GCUUCUACCAGACAUACUCAU | 21 | 8725 |
| SCNN1A-4877 | - | UGCUUCUACCAGACAUACUCAU | 22 | 8726 |
| SCNN1A-4878 | - | CUGCUUCUACCAGACAUACUCAU | 23 | 8727 |
| SCNN1A-4879 | - | ACUGCUUCUACCAGACAUACUCAU | 24 | 8728 |
| SCNN1A-4880 | - | UGGUGUAUGUGGGUUCAU | 18 | 8729 |
| SCNN1A-4881 | - | UUGGUGUAUGUGGGUUCAU | 19 | 8730 |
| SCNN1A-1250 | - | CUUGGUGUAUGUGGGUUCAU | 20 | 5099 |
| SCNN1A-4882 | - | UCUUGGUGUAUGUGGGUUCAU | 21 | 8731 |
| SCNN1A-4883 | - | CUCUUGGUGUAUGUGGGUUCAU | 22 | 8732 |
| SCNN1A-4884 | - | UCUCUUGGUGUAUGUGGGUUCAU | 23 | 8733 |
| SCNN1A-4885 | - | AUCUCUUGGUGUAUGUGGGUUCAU | 24 | 8734 |
| SCNN1A-4886 | - | UACUCUCUCUUUCCUGAU | 18 | 8735 |

TABLE 44G-continued

7th Tier

| gRNA Name | DNA Strand | Targeting Domain | Target Site Length | Seq ID |
|---|---|---|---|---|
| SCNN1A-4887 | − | CUACUCUCUCUUUCCUGAU | 19 | 8736 |
| SCNN1A-4888 | − | CCUACUCUCUCUUUCCUGAU | 20 | 8737 |
| SCNN1A-4889 | − | CCCUACUCUCUCUUUCCUGAU | 21 | 8738 |
| SCNN1A-4890 | − | ACCCUACUCUCUCUUUCCUGAU | 22 | 8739 |
| SCNN1A-4891 | − | GACCCUACUCUCUCUUUCCUGAU | 23 | 8740 |
| SCNN1A-4892 | − | UGACCCUACUCUCUCUUUCCUGAU | 24 | 8741 |
| SCNN1A-4893 | − | GGAAACCCUGGACAGACU | 18 | 8742 |
| SCNN1A-4894 | − | AGGAAACCCUGGACAGACU | 19 | 8743 |
| SCNN1A-1257 | − | UAGGAAACCCUGGACAGACU | 20 | 5106 |
| SCNN1A-4895 | − | AUAGGAAACCCUGGACAGACU | 21 | 8744 |
| SCNN1A-4896 | − | CAUAGGAAACCCUGGACAGACU | 22 | 8745 |
| SCNN1A-4897 | − | UCAUAGGAAACCCUGGACAGACU | 23 | 8746 |
| SCNN1A-4898 | − | UUCAUAGGAAACCCUGGACAGACU | 24 | 8747 |
| SCNN1A-4899 | − | AAGGCAAGGAUGCUGACU | 18 | 8748 |
| SCNN1A-4900 | − | GAAGGCAAGGAUGCUGACU | 19 | 8749 |
| SCNN1A-1258 | − | GGAAGGCAAGGAUGCUGACU | 20 | 5107 |
| SCNN1A-4901 | − | AGGAAGGCAAGGAUGCUGACU | 21 | 8750 |
| SCNN1A-4902 | − | GAGGAAGGCAAGGAUGCUGACU | 22 | 8751 |
| SCNN1A-4903 | − | UGAGGAAGGCAAGGAUGCUGACU | 23 | 8752 |
| SCNN1A-4904 | − | AUGAGGAAGGCAAGGAUGCUGACU | 24 | 8753 |
| SCNN1A-4905 | − | ACCCUCUGCCCCACACCU | 18 | 8754 |
| SCNN1A-4906 | − | CACCCUCUGCCCCACACCU | 19 | 8755 |
| SCNN1A-4907 | − | CCACCCUCUGCCCCACACCU | 20 | 8756 |
| SCNN1A-4908 | − | CCCACCCUCUGCCCCACACCU | 21 | 8757 |
| SCNN1A-4909 | − | UCCCACCCUCUGCCCCACACCU | 22 | 8758 |
| SCNN1A-4910 | − | UUCCCACCCUCUGCCCCACACCU | 23 | 8759 |
| SCNN1A-4911 | − | CUUCCCACCCUCUGCCCCACACCU | 24 | 8760 |
| SCNN1A-4912 | − | CCGCAGCCGUCGCGACCU | 18 | 8761 |
| SCNN1A-4913 | − | CCCGCAGCCGUCGCGACCU | 19 | 8762 |
| SCNN1A-4914 | − | UCCCGCAGCCGUCGCGACCU | 20 | 8763 |
| SCNN1A-4915 | − | CUCCCGCAGCCGUCGCGACCU | 21 | 8764 |
| SCNN1A-4916 | − | GCUCCCGCAGCCGUCGCGACCU | 22 | 8765 |
| SCNN1A-4917 | − | GGCUCCCGCAGCCGUCGCGACCU | 23 | 8766 |
| SCNN1A-4918 | − | CGGCUCCCGCAGCCGUCGCGACCU | 24 | 8767 |
| SCNN1A-4919 | − | GUCCUCUGGGGGGCCCU | 18 | 8768 |
| SCNN1A-4920 | − | UGUCCUCUGGGGGGCCCU | 19 | 8769 |
| SCNN1A-4921 | − | CUGUCCUCUGGGGGGCCCU | 20 | 8770 |

TABLE 44G-continued

7th Tier

| gRNA Name | DNA Strand | Targeting Domain | Target Site Length | Seq ID |
|---|---|---|---|---|
| SCNN1A-4922 | - | CCUGUCCUCUGGGGGGCCCU | 21 | 8771 |
| SCNN1A-4923 | - | ACCUGUCCUCUGGGGGGCCCU | 22 | 8772 |
| SCNN1A-4924 | - | CACCUGUCCUCUGGGGGGCCCU | 23 | 8773 |
| SCNN1A-4925 | - | CCACCUGUCCUCUGGGGGGCCCU | 24 | 8774 |
| SCNN1A-4926 | - | AGUUCCUCCACCUGUCCU | 18 | 8775 |
| SCNN1A-4927 | - | CAGUUCCUCCACCUGUCCU | 19 | 8776 |
| SCNN1A-4928 | - | CCAGUUCCUCCACCUGUCCU | 20 | 8777 |
| SCNN1A-4929 | - | GCCAGUUCCUCCACCUGUCCU | 21 | 8778 |
| SCNN1A-4930 | - | GGCCAGUUCCUCCACCUGUCCU | 22 | 8779 |
| SCNN1A-4931 | - | GGGCCAGUUCCUCCACCUGUCCU | 23 | 8780 |
| SCNN1A-4932 | - | GGGGCCAGUUCCUCCACCUGUCCU | 24 | 8781 |
| SCNN1A-4933 | - | CAUGUUCCUCAUGCUGCU | 18 | 8782 |
| SCNN1A-4934 | - | UCAUGUUCCUCAUGCUGCU | 19 | 8783 |
| SCNN1A-4935 | - | AUCAUGUUCCUCAUGCUGCU | 20 | 8784 |
| SCNN1A-4936 | - | CAUCAUGUUCCUCAUGCUGCU | 21 | 8785 |
| SCNN1A-4937 | - | UCAUCAUGUUCCUCAUGCUGCU | 22 | 8786 |
| SCNN1A-4938 | - | GUCAUCAUGUUCCUCAUGCUGCU | 23 | 8787 |
| SCNN1A-4939 | - | GGUCAUCAUGUUCCUCAUGCUGCU | 24 | 8788 |
| SCNN1A-4940 | - | CGAGGGGGCAGGGUGCU | 18 | 8789 |
| SCNN1A-4941 | - | CCGAGGGGGCAGGGUGCU | 19 | 8790 |
| SCNN1A-4942 | - | GCCGAGGGGGCAGGGUGCU | 20 | 8791 |
| SCNN1A-4943 | - | GGCCGAGGGGGCAGGGUGCU | 21 | 8792 |
| SCNN1A-4944 | - | AGGCCGAGGGGGCAGGGUGCU | 22 | 8793 |
| SCNN1A-4945 | - | CAGGCCGAGGGGGCAGGGUGCU | 23 | 8794 |
| SCNN1A-4946 | - | CCAGGCCGAGGGGGCAGGGUGCU | 24 | 8795 |
| SCNN1A-4947 | - | UUCCUCCACCUGUCCUCU | 18 | 8796 |
| SCNN1A-4948 | - | GUUCCUCCACCUGUCCUCU | 19 | 8797 |
| SCNN1A-1276 | - | AGUUCCUCCACCUGUCCUCU | 20 | 5125 |
| SCNN1A-4949 | - | CAGUUCCUCCACCUGUCCUCU | 21 | 8798 |
| SCNN1A-4950 | - | CCAGUUCCUCCACCUGUCCUCU | 22 | 8799 |
| SCNN1A-4951 | - | GCCAGUUCCUCCACCUGUCCUCU | 23 | 8800 |
| SCNN1A-4952 | - | GGCCAGUUCCUCCACCUGUCCUCU | 24 | 8801 |
| SCNN1A-4953 | - | UGACAUCCCAGGUAGAGU | 18 | 8802 |
| SCNN1A-4954 | - | GUGACAUCCCAGGUAGAGU | 19 | 8803 |
| SCNN1A-4955 | - | GGUGACAUCCCAGGUAGAGU | 20 | 8804 |
| SCNN1A-4956 | - | CGGUGACAUCCCAGGUAGAGU | 21 | 8805 |
| SCNN1A-4957 | - | UCGGUGACAUCCCAGGUAGAGU | 22 | 8806 |
| SCNN1A-4958 | - | CUCGGUGACAUCCCAGGUAGAGU | 23 | 8807 |

TABLE 44G-continued

7th Tier

| gRNA Name | DNA Strand | Targeting Domain | Target Site Length | Seq ID |
|---|---|---|---|---|
| SCNN1A-4959 | - | CCUCGGUGACAUCCCAGGUAGAGU | 24 | 8808 |
| SCNN1A-4960 | - | CCUGGAAUCAACAACGGU | 18 | 8809 |
| SCNN1A-4961 | - | GCCUGGAAUCAACAACGGU | 19 | 8810 |
| SCNN1A-4962 | - | UGCCUGGAAUCAACAACGGU | 20 | 8811 |
| SCNN1A-4963 | - | AUGCCUGGAAUCAACAACGGU | 21 | 8812 |
| SCNN1A-4964 | - | CAUGCCUGGAAUCAACAACGGU | 22 | 8813 |
| SCNN1A-4965 | - | CCAUGCCUGGAAUCAACAACGGU | 23 | 8814 |
| SCNN1A-4966 | - | UCCAUGCCUGGAAUCAACAACGGU | 24 | 8815 |
| SCNN1A-4967 | - | AUCAGGGGUGGAUGCGGU | 18 | 8816 |
| SCNN1A-4968 | - | CAUCAGGGGUGGAUGCGGU | 19 | 8817 |
| SCNN1A-4969 | - | UCAUCAGGGGUGGAUGCGGU | 20 | 8818 |
| SCNN1A-4970 | - | CUCAUCAGGGGUGGAUGCGGU | 21 | 8819 |
| SCNN1A-4971 | - | ACUCAUCAGGGGUGGAUGCGGU | 22 | 8820 |
| SCNN1A-4972 | - | UACUCAUCAGGGGUGGAUGCGGU | 23 | 8821 |
| SCNN1A-4973 | - | AUACUCAUCAGGGGUGGAUGCGGU | 24 | 8822 |
| SCNN1A-4974 | - | UGUGGGGAAGGGAUGGGU | 18 | 8823 |
| SCNN1A-4975 | - | GUGUGGGGAAGGGAUGGGU | 19 | 8824 |
| SCNN1A-1288 | - | AGUGUGGGGAAGGGAUGGGU | 20 | 5137 |
| SCNN1A-4976 | - | GAGUGUGGGGAAGGGAUGGGU | 21 | 8825 |
| SCNN1A-4977 | - | AGAGUGUGGGGAAGGGAUGGGU | 22 | 8826 |
| SCNN1A-4978 | - | UAGAGUGUGGGGAAGGGAUGGGU | 23 | 8827 |
| SCNN1A-4979 | - | GUAGAGUGUGGGGAAGGGAUGGGU | 24 | 8828 |
| SCNN1A-4980 | - | ACUUCCACCACCCGAUGU | 18 | 8829 |
| SCNN1A-4981 | - | CACUUCCACCACCCGAUGU | 19 | 8830 |
| SCNN1A-4982 | - | UCACUUCCACCACCCGAUGU | 20 | 8831 |
| SCNN1A-4983 | - | CUCACUUCCACCACCCGAUGU | 21 | 8832 |
| SCNN1A-4984 | - | UCUCACUUCCACCACCCGAUGU | 22 | 8833 |
| SCNN1A-4985 | - | CUCUCACUUCCACCACCCGAUGU | 23 | 8834 |
| SCNN1A-4986 | - | ACUCUCACUUCCACCACCCGAUGU | 24 | 8835 |
| SCNN1A-4987 | - | ACAUCCCAGGUAGAGUGU | 18 | 8836 |
| SCNN1A-4988 | - | GACAUCCCAGGUAGAGUGU | 19 | 8837 |
| SCNN1A-1293 | - | UGACAUCCCAGGUAGAGUGU | 20 | 5142 |
| SCNN1A-4989 | - | GUGACAUCCCAGGUAGAGUGU | 21 | 8838 |
| SCNN1A-4990 | - | GGUGACAUCCCAGGUAGAGUGU | 22 | 8839 |
| SCNN1A-4991 | - | CGGUGACAUCCCAGGUAGAGUGU | 23 | 8840 |
| SCNN1A-4992 | - | UCGGUGACAUCCCAGGUAGAGUGU | 24 | 8841 |
| SCNN1A-4993 | - | GAAACCCUGGACAGACUU | 18 | 8842 |

TABLE 44G-continued

7th Tier

| gRNA Name | DNA Strand | Targeting Domain | Target Site Length | Seq ID |
|---|---|---|---|---|
| SCNN1A-4994 | - | GGAAACCCUGGACAGACUU | 19 | 8843 |
| SCNN1A-1295 | - | AGGAAACCCUGGACAGACUU | 20 | 5144 |
| SCNN1A-4995 | - | UAGGAAACCCUGGACAGACUU | 21 | 8844 |
| SCNN1A-4996 | - | AUAGGAAACCCUGGACAGACUU | 22 | 8845 |
| SCNN1A-4997 | - | CAUAGGAAACCCUGGACAGACUU | 23 | 8846 |
| SCNN1A-4998 | - | UCAUAGGAAACCCUGGACAGACUU | 24 | 8847 |
| SCNN1A-4999 | - | UAGCGUGGCCUCCAGCUU | 18 | 8848 |
| SCNN1A-5000 | - | GUAGCGUGGCCUCCAGCUU | 19 | 8849 |
| SCNN1A-5001 | - | CGUAGCGUGGCCUCCAGCUU | 20 | 8850 |
| SCNN1A-5002 | - | CCGUAGCGUGGCCUCCAGCUU | 21 | 8851 |
| SCNN1A-5003 | - | CCCGUAGCGUGGCCUCCAGCUU | 22 | 8852 |
| SCNN1A-5004 | - | GCCCGUAGCGUGGCCUCCAGCUU | 23 | 8853 |
| SCNN1A-5005 | - | AGCCCGUAGCGUGGCCUCCAGCUU | 24 | 8854 |
| SCNN1A-5006 | - | CAUGCUGCUCCGAAGGUU | 18 | 8855 |
| SCNN1A-5007 | - | UCAUGCUGCUCCGAAGGUU | 19 | 8856 |
| SCNN1A-5008 | - | CUCAUGCUGCUCCGAAGGUU | 20 | 8857 |
| SCNN1A-5009 | - | CCUCAUGCUGCUCCGAAGGUU | 21 | 8858 |
| SCNN1A-5010 | - | UCCUCAUGCUGCUCCGAAGGUU | 22 | 8859 |
| SCNN1A-5011 | - | UUCCUCAUGCUGCUCCGAAGGUU | 23 | 8860 |
| SCNN1A-5012 | - | GUUCCUCAUGCUGCUCCGAAGGUU | 24 | 8861 |
| SCNN1A-5013 | - | GGCAGUGAUGUUCCUGUU | 18 | 8862 |
| SCNN1A-5014 | - | UGGCAGUGAUGUUCCUGUU | 19 | 8863 |
| SCNN1A-5015 | - | AUGGCAGUGAUGUUCCUGUU | 20 | 8864 |
| SCNN1A-5016 | - | AAUGGCAGUGAUGUUCCUGUU | 21 | 8865 |
| SCNN1A-5017 | - | GAAUGGCAGUGAUGUUCCUGUU | 22 | 8866 |
| SCNN1A-5018 | - | AGAAUGGCAGUGAUGUUCCUGUU | 23 | 8867 |
| SCNN1A-5019 | - | AAGAAUGGCAGUGAUGUUCCUGUU | 24 | 8868 |

Table 45A provides exemplary targeting domains for knocking out the SCNN1A gene selected according to the first tier parameters. The targeting domains bind within the first 500 bp of the coding sequence (e.g., with 500 bp downstream from the start codon), have a high level of orthogonality and start with a 5'G. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 45A

1st Tier

| gRNA Name | DNA Strand | Targeting Domain | Target Site Length | Seq ID |
|---|---|---|---|---|
| SCNN1A-5020 | + | GGCUAGAGUCCUGCUCC | 17 | 8869 |
| SCNN1A-5021 | + | GUCUAGGGUCCUGCUCC | 17 | 8870 |
| SCNN1A-5022 | + | GAUUCCAAACCAGGUUC | 17 | 8871 |
| SCNN1A-5023 | - | GAUGUACUGGCAAUUCG | 17 | 8872 |

Table 45B provides exemplary targeting domains for knocking out the SCNN1A gene selected according to the second tier parameters. The targeting domains bind within the first 500 bp of the coding sequence (e.g., with 500 bp downstream from the start codon) and have a high level of orthogonality. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 45B

2nd Tier

| gRNA Name | DNA Strand | Targeting Domain | Target Site Length | Seq ID |
|---|---|---|---|---|
| SCNN1A-322 | + | UGGUCACUGCGGGGAAG | 17 | 915 |
| SCNN1A-5024 | + | CCCUUCAUGAGCCCCGG | 17 | 8873 |
| SCNN1A-5025 | + | AGGGACUAACCGACCUG | 17 | 8874 |
| SCNN1A-238 | + | AGAUGGUCACUGCGGGGAAG | 20 | 858 |
| SCNN1A-5026 | − | CAUGAUGUACUGGCAAUUCG | 20 | 8875 |
| SCNN1A-5027 | + | UUCCCCUUCAUGAGCCCCGG | 20 | 8876 |
| SCNN1A-1657 | + | CAGAGGGACUAACCGACCUG | 20 | 5506 |

Table 45C provides exemplary targeting domains for knocking out the SCNN1A gene selected according to the third tier parameters. The targeting domains bind within the first 500 bp of the coding sequence (e.g., with 500 bp downstream from the start codon) and start with a 5'G. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 45C

3rd Tier

| gRNA Name | DNA Strand | Targeting Domain | Target Site Length | Seq ID |
|---|---|---|---|---|
| SCNN1A-5028 | + | GGCCCAGCCCCUGCUCC | 17 | 8877 |
| SCNN1A-5029 | + | GAGGGCUAGAGUCCUGCUCC | 20 | 8878 |
| SCNN1A-5030 | + | GAGGUCUAGGGUCCUGCUCC | 20 | 8879 |

Table 45D provides exemplary targeting domains for knocking out the SCNN1A gene selected according to the fourth tier parameters. The targeting domains bind within the first 500 bp of the coding sequence (e.g., with 500 bp downstream from the start codon). It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 45D

4th Tier

| gRNA Name | DNA Strand | Targeting Domain | Target Site Length | Seq ID |
|---|---|---|---|---|
| SCNN1A-5031 | + | CGGGGCCCAGCCCCUGCUCC | 20 | 8880 |
| SCNN1A-5032 | + | CAGGAUUCCAAACCAGGUUC | 20 | 8881 |

Table 45E provides exemplary targeting domains for knocking out the SCNN1A gene selected according to the fifth tier parameters. The targeting domains fall in the coding sequence of the gene, downstream of the first 500 bp of coding sequence (e.g., anywhere from +500 (relative to the start codon) to the stop codon of the gene). It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 45E

5th Tier

| gRNA Name | DNA Strand | Targeting Domain | Target Site Length | Seq ID |
|---|---|---|---|---|
| SCNN1A-5033 | + | GAGUCUCACCCCAGGAA | 17 | 8882 |
| SCNN1A-5034 | − | ACAGCAGGUGAGGCCCA | 17 | 8883 |
| SCNN1A-485 | + | GCGCCAUGGAGCAAGCA | 17 | 4334 |
| SCNN1A-5035 | + | UAUGUCUGGUAGAAGCA | 17 | 8884 |
| SCNN1A-5036 | − | UCCAGGUGUGUAUUCAC | 17 | 8885 |
| SCNN1A-577 | + | CUGAGGAGAAGUCAACC | 17 | 4426 |
| SCNN1A-5037 | − | GCUUGCUCCAUGGCGCC | 17 | 8886 |
| SCNN1A-5038 | − | GCAACUUCAUCUUCGCC | 17 | 8887 |
| SCNN1A-5039 | − | GAGCCCGUAGCGUGGCC | 17 | 8888 |
| SCNN1A-5040 | − | ACUGGAAGGACUGGAAG | 17 | 8889 |
| SCNN1A-5041 | − | GCAACCAGAACAAAUCG | 17 | 8890 |
| SCNN1A-5042 | − | AUGCGGUGAGGGAGUGG | 17 | 8891 |
| SCNN1A-787 | − | ACCCUGGACAGACUUGG | 17 | 4636 |
| SCNN1A-5043 | + | AAGGGGACACUAACCUG | 17 | 8892 |
| SCNN1A-5044 | − | CUGCCUUUAUGGAUGAU | 17 | 8893 |
| SCNN1A-5045 | − | AACAACGGUGAGAAGCU | 17 | 8894 |
| SCNN1A-5046 | + | UCGGCCUGGAGACCAGU | 17 | 8895 |
| SCNN1A-5047 | + | AGGGAGCUUCUCACCGU | 17 | 8896 |
| SCNN1A-5048 | + | CUGGAGUCUCACCCCAGGAA | 20 | 8897 |
| SCNN1A-5049 | − | CACACAGCAGGUGAGGCCCA | 20 | 8898 |
| SCNN1A-909 | + | AGGGCGCCAUGGAGCAAGCA | 20 | 4758 |
| SCNN1A-5050 | + | GAGUAUGUCUGGUAGAAGCA | 20 | 8899 |
| SCNN1A-5051 | − | CCUUCCAGGUGUGUAUUCAC | 20 | 8900 |

TABLE 45E-continued

5th Tier

| gRNA Name | DNA Strand | Targeting Domain | Target Site Length | Seq ID |
|---|---|---|---|---|
| SCNN1A-1000 | + | GGUCUGAGGAGAAGUCAACC | 20 | 4849 |
| SCNN1A-5052 | − | CCUGCUUGCUCCAUGGCGCC | 20 | 8901 |
| SCNN1A-5053 | − | UGGGCAACUUCAUCUUCGCC | 20 | 8902 |
| SCNN1A-5054 | − | GUCGAGCCCGUAGCGUGGCC | 20 | 8903 |
| SCNN1A-5055 | − | UGGACUGGAAGGACUGGAAG | 20 | 8904 |
| SCNN1A-5056 | − | AGUGCAACCAGAACAAAUCG | 20 | 8905 |
| SCNN1A-5057 | − | UGGAUGCGGUGAGGGAGUGG | 20 | 8906 |
| SCNN1A-1206 | − | GAAACCCUGGACAGACUUGG | 20 | 5055 |
| SCNN1A-5058 | + | GGGAAGGGGACACUAACCUG | 20 | 8907 |
| SCNN1A-5059 | − | AACCUGCCUUUAUGGAUGAU | 20 | 8908 |
| SCNN1A-5060 | − | AUCAACAACGGUGAGAAGCU | 20 | 8909 |
| SCNN1A-5061 | + | CCCUCGGCCUGGAGACCAGU | 20 | 8910 |
| SCNN1A-5062 | + | AGCAGGGAGCUUCUCACCGU | 20 | 8911 |

Table 46A provides exemplary targeting domains for knocking down the SCNN1A gene selected according to the first tier parameters. The targeting domains bind within 500 bp (e.g., upstream or downstream) of a transcription start site (TSS), have a high level of orthogonality and start with a 5'G. It is contemplated herein that in an embodiment the targeting domain hybridizes to the target domain through complementary base pairing. Any of the targeting domains in the table can be used with a S. pyogenes eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 46A

1st Tier

| gRNA Name | DNA Strand | Targeting Domain | Target Site Length | Seq ID |
|---|---|---|---|---|
| SCNN1A-5063 | + | GAGAAUCAGACCCAAAA | 17 | 8912 |
| SCNN1A-5064 | − | GAGCUGGCAAAUAGAAA | 17 | 8913 |
| SCNN1A-5065 | + | GAAGGAGCCAGCACCAA | 17 | 8914 |
| SCNN1A-5066 | + | GGGCAACACAAGGAGAA | 17 | 8915 |
| SCNN1A-5067 | + | GCUGGGCUUCCCUAGAA | 17 | 8916 |
| SCNN1A-5068 | − | GCCAGAUUCAACUGGAA | 17 | 8917 |
| SCNN1A-327 | + | GAUACCUCCCCUUGGAA | 17 | 4176 |
| SCNN1A-5069 | + | GCUAGGAGGGCAACACA | 17 | 8918 |
| SCNN1A-328 | − | GGGCGCAGGGUGGGACA | 17 | 4177 |
| SCNN1A-5070 | + | GAAACUGACCCUUCCCA | 17 | 8919 |
| SCNN1A-5071 | − | GAGAGCAGACGAAUCCA | 17 | 8920 |
| SCNN1A-329 | − | GCCUCACUCGGGUUCCA | 17 | 4178 |
| SCNN1A-5072 | + | GUGCCAAGUGGUGAGCA | 17 | 8921 |
| SCNN1A-330 | − | GGGAGAAUGUGGGCGCA | 17 | 4179 |
| SCNN1A-5073 | + | GGUCCUUACAUUGGGCA | 17 | 8922 |
| SCNN1A-5074 | − | GAAAGGUGGCCCUAUCA | 17 | 8923 |
| SCNN1A-5075 | + | GCAGUACUCCAGGCUCA | 17 | 8924 |
| SCNN1A-80 | − | GCCCAUACCAGGUCUCA | 17 | 529 |
| SCNN1A-5076 | − | GACACAGCUCGAGGUCA | 17 | 8925 |
| SCNN1A-5077 | + | GAGUACUGGACCUGAGA | 17 | 8926 |
| SCNN1A-5078 | − | GAGGGCCUAGAGUGAGA | 17 | 8927 |
| SCNN1A-5079 | + | GGAAGGAGGGCUCCCGA | 17 | 8928 |
| SCNN1A-5080 | + | GGGAGUUUUCCGAAGGA | 17 | 8929 |
| SCNN1A-5081 | + | GUUUUCCGAAGGAAGGA | 17 | 8930 |
| SCNN1A-5082 | + | GAACCGGGAGGACAGGA | 17 | 8931 |
| SCNN1A-5083 | + | GGAGUCUGUCUCCAGGA | 17 | 8932 |
| SCNN1A-5084 | + | GGAUGUGAAAGCCGGGA | 17 | 8933 |
| SCNN1A-5085 | − | GUCUGCUGGCUUGUGGA | 17 | 8934 |
| SCNN1A-5086 | − | GUCUGGACAAGGUUGGA | 17 | 8935 |
| SCNN1A-5087 | − | GCUCUGUGUGGGAGUGA | 17 | 8936 |
| SCNN1A-5088 | + | GAGGAGAAAUUCGUUGA | 17 | 8937 |
| SCNN1A-5089 | − | GAGGAGAGGCCGUUCUA | 17 | 8938 |
| SCNN1A-5090 | − | GGAGACUGGAGUUUCUA | 17 | 8939 |
| SCNN1A-5091 | − | GGACCAUGCCCAAUGUA | 17 | 8940 |
| SCNN1A-5092 | − | GGAAUCCUGGUUGACAC | 17 | 8941 |
| SCNN1A-5093 | + | GGCUGCCGCUUCCUCAC | 17 | 8942 |
| SCNN1A-5094 | + | GGGCUUUAGACGCAGAC | 17 | 8943 |
| SCNN1A-5095 | + | GAAAGCCGGUGUCAACC | 17 | 8944 |
| SCNN1A-5096 | + | GAGCAUUGAUACACACC | 17 | 8945 |
| SCNN1A-5097 | + | GAUUCUGUCUCUGCCCC | 17 | 8946 |
| SCNN1A-5098 | − | GGGCGGGCUCCCCAGCC | 17 | 8947 |
| SCNN1A-5099 | − | GCUGAGCCUCUAGCUCC | 17 | 8948 |
| SCNN1A-5100 | − | GGGCGAUUACACAUUCC | 17 | 8949 |
| SCNN1A-5101 | + | GUCCCAAGUGUGCUUCC | 17 | 8950 |
| SCNN1A-5102 | − | GGUGGCGAGGAAUCAGC | 17 | 8951 |
| SCNN1A-5103 | + | GCCAAAAGUGCCGGAGC | 17 | 8952 |

TABLE 46A-continued

1st Tier

| gRNA Name | DNA Strand | Targeting Domain | Target Site Length | Seq ID |
|---|---|---|---|---|
| SCNN1A-5104 | + | GAGGAUGUGGCCAGCGC | 17 | 8953 |
| SCNN1A-5105 | + | GAAGCUGGGGGCUAGGC | 17 | 8954 |
| SCNN1A-5106 | + | GAAGGCGGACUCUGGGC | 17 | 8955 |
| SCNN1A-5107 | + | GGAGCCCGCCCGCUGGC | 17 | 8956 |
| SCNN1A-5108 | + | GCCUAGGGGCUCACUGC | 17 | 8957 |
| SCNN1A-5109 | + | GGAGCCAGCAGACCUGC | 17 | 8958 |
| SCNN1A-5110 | − | GCUGGGCCUUUGUCUGC | 17 | 8959 |
| SCNN1A-5111 | + | GUUGGGGCCAAAAGUGC | 17 | 8960 |
| SCNN1A-5112 | + | GCAGGCACUGAAGGUGC | 17 | 8961 |
| SCNN1A-5113 | + | GUCUGCUCUCUGGGUGC | 17 | 8962 |
| SCNN1A-5114 | − | GCUGAGCACCUUAUUGC | 17 | 8963 |
| SCNN1A-5115 | − | GGGGCAGAGACAGAAUC | 17 | 8964 |
| SCNN1A-5116 | + | GUGGGAGCAGCGCACUC | 17 | 8965 |
| SCNN1A-333 | − | GAUGGGAGAGGGCACUC | 17 | 4182 |
| SCNN1A-5117 | − | GGCCCUCGCGCUGCCUC | 17 | 8966 |
| SCNN1A-5118 | + | GGCAGUACUCCAGGCUC | 17 | 8967 |
| SCNN1A-5119 | − | GGUGUGUAUCAAUGCUC | 17 | 8968 |
| SCNN1A-5120 | − | GAGUUUCUAGGGGUCUC | 17 | 8969 |
| SCNN1A-5121 | − | GGACACAGCUCGAGGUC | 17 | 8970 |
| SCNN1A-5122 | − | GCUAGUGGUUGGAUUUC | 17 | 8971 |
| SCNN1A-5123 | + | GCUAGAGGCUCAGCAAG | 17 | 8972 |
| SCNN1A-5124 | + | GGAAUGUGGGCAACCAG | 17 | 8973 |
| SCNN1A-334 | − | GACAUGGGCAUGGCCAG | 17 | 4183 |
| SCNN1A-5125 | + | GGGCUAGGGGAGCCUAG | 17 | 8974 |
| SCNN1A-5126 | + | GUGCUUCCAGGAGCUAG | 17 | 8975 |
| SCNN1A-5127 | − | GAGACUGGAGUUUCUAG | 17 | 8976 |
| SCNN1A-5128 | + | GGGCACUGAGUGAGUAG | 17 | 8977 |
| SCNN1A-5129 | − | GUCCACAGUGUCCUGCG | 17 | 8978 |
| SCNN1A-5130 | − | GGACAAAACUCGAAAGG | 17 | 8979 |
| SCNN1A-5131 | + | GACGCAGACAGGCAAGG | 17 | 8980 |
| SCNN1A-5132 | + | GGAACCGGGAGGACAGG | 17 | 8981 |
| SCNN1A-5133 | + | GGAGCAGCGCACUCAGG | 17 | 8982 |
| SCNN1A-5134 | − | GUAGAUAGCCCCAGAGG | 17 | 8983 |
| SCNN1A-5135 | − | GGGCCUAGAGUGAGAGG | 17 | 8984 |
| SCNN1A-5136 | + | GCAUUGAUACACACCGG | 17 | 8985 |
| SCNN1A-5137 | + | GCACUGAAGGUGCAGGG | 17 | 8986 |
| SCNN1A-5138 | + | GACCCAAAAAGGGCUGG | 17 | 8987 |
| SCNN1A-5139 | − | GGUCUGGACAAGGUUGG | 17 | 8988 |
| SCNN1A-5140 | − | GGGGUCUCUGGGAUAUG | 17 | 8989 |
| SCNN1A-5141 | + | GGCCACGCAGGACACUG | 17 | 8990 |
| SCNN1A-5142 | + | GUGCAGCGGCCUGGCUG | 17 | 8991 |
| SCNN1A-5143 | + | GGGUCCAACCUGGUCUG | 17 | 8992 |
| SCNN1A-5144 | + | GAUAAAUCAGUUUUCUG | 17 | 8993 |
| SCNN1A-5145 | + | GUGAGUAGAGGCAGGUG | 17 | 8994 |
| SCNN1A-5146 | − | GCUGCACCUGUCAGGUG | 17 | 8995 |
| SCNN1A-5147 | − | GGUCUCUGGGAUAUGUG | 17 | 8996 |
| SCNN1A-335 | − | GGCGCAGGGUGGGACAU | 17 | 4184 |
| SCNN1A-5148 | + | GAGCCAGGUCCUUACAU | 17 | 8997 |
| SCNN1A-5149 | + | GCGAAGGACAGAGAGAU | 17 | 8998 |
| SCNN1A-5150 | + | GGGCUAGGCGGGGCCCU | 17 | 8999 |
| SCNN1A-5151 | − | GAAAACUGAUUUAUCCU | 17 | 9000 |
| SCNN1A-5152 | + | GUGCUGGGUUAUCUCCU | 17 | 9001 |
| SCNN1A-5153 | − | GUAUCAAUGCUCAGGCU | 17 | 9002 |
| SCNN1A-5154 | + | GGUGCAGCGGCCUGGCU | 17 | 9003 |
| SCNN1A-336 | + | GGUCAAGGCUGAGCUCU | 17 | 4185 |
| SCNN1A-5155 | + | GGAUUCGUCUGCUCUCU | 17 | 9004 |
| SCNN1A-5156 | − | GAGAUGACACCUUCUCU | 17 | 9005 |
| SCNN1A-5157 | − | GGGAGACUGGAGUUUCU | 17 | 9006 |
| SCNN1A-5158 | − | GGGAUAUGUGGGGCAGU | 17 | 9007 |
| SCNN1A-5159 | + | GAGCAGCGCACUCAGGU | 17 | 9008 |
| SCNN1A-337 | − | GAAUGUGGGCGCAGGGU | 17 | 4186 |
| SCNN1A-5160 | − | GGGUCUCUGGGAUAUGU | 17 | 9009 |
| SCNN1A-5161 | + | GUUCUUUUUUACACUGU | 17 | 9010 |
| SCNN1A-5162 | − | GGGUGAGGCUGACCUGU | 17 | 9011 |
| SCNN1A-5163 | − | GUUGCCCUCCUAGCUGU | 17 | 9012 |
| SCNN1A-5164 | − | GGGUCAGUUUCUUCAUU | 17 | 9013 |
| SCNN1A-339 | + | GAGCCCCGGAGUGGAUU | 17 | 4188 |
| SCNN1A-5165 | − | GGGAGCCCUCCUUCCUU | 17 | 9014 |
| SCNN1A-5166 | + | GCAGACCUGCGGGAGUU | 17 | 9015 |
| SCNN1A-5167 | + | GCAAGUGGGCAGCCCUCCAA | 20 | 9016 |
| SCNN1A-5168 | + | GUCUCCAGGAAGGAGAGCAA | 20 | 9017 |
| SCNN1A-5169 | + | GCAAAUAGUUUUCAUAUCAA | 20 | 9018 |
| SCNN1A-5170 | + | GGAGGGCAACACAAGGAGAA | 20 | 9019 |
| SCNN1A-5171 | + | GGAGCUGGGCUUCCCUAGAA | 20 | 9020 |

TABLE 46A-continued

1st Tier

| gRNA Name | DNA Strand | Targeting Domain | Target Site Length | Seq ID |
|---|---|---|---|---|
| SCNN1A-5172 | − | GUGCUAGGACAAAACUCGAA | 20 | 9021 |
| SCNN1A-5173 | − | GCUGCCAGAUUCAACUGGAA | 20 | 9022 |
| SCNN1A-5174 | + | GGAUGUGGCCAGCGCUGGAA | 20 | 9023 |
| SCNN1A-5175 | − | GCCCCUCCCGGGUCUGGACA | 20 | 9024 |
| SCNN1A-5176 | + | GAAGAAACUGACCCUUCCCA | 20 | 9025 |
| SCNN1A-5177 | + | GAGAUAAGACAUAAGAGCCA | 20 | 9026 |
| SCNN1A-5178 | + | GCCCGCCCGCUGGCCGGCCA | 20 | 9027 |
| SCNN1A-340 | − | GUGGGACAUGGGCAUGGCCA | 20 | 4189 |
| SCNN1A-341 | − | GCAGCCUCACUCGGGUUCCA | 20 | 4190 |
| SCNN1A-342 | − | GAGCAGUAUCAAGGUAAGCA | 20 | 4191 |
| SCNN1A-5179 | + | GGAGUGCCAAGUGGUGAGCA | 20 | 9028 |
| SCNN1A-5180 | − | GCUGGCAAAUAGAAAAGGCA | 20 | 9029 |
| SCNN1A-5181 | + | GCUUUAGACGCAGACAGGCA | 20 | 9030 |
| SCNN1A-5182 | − | GCCUAGAGUGAGAGGGGGCA | 20 | 9031 |
| SCNN1A-5183 | + | GAGAAGGCGGACUCUGGGCA | 20 | 9032 |
| SCNN1A-5184 | − | GUGCUGAGCACCUUAUUGCA | 20 | 9033 |
| SCNN1A-5185 | + | GGCAAAUAGUUUUCAUAUCA | 20 | 9034 |
| SCNN1A-343 | − | GUGAUGGGAGAGGGCACUCA | 20 | 4192 |
| SCNN1A-5186 | + | GGAAGGCUGCCGCUUCCUCA | 20 | 9035 |
| SCNN1A-1 | − | GCAGCCCAUACCAGGUCUCA | 20 | 503 |
| SCNN1A-5187 | + | GCCAGCGCUGGAAAGGAAGA | 20 | 9036 |
| SCNN1A-5188 | − | GCUGAGGGCCUAGAGUGAGA | 20 | 9037 |
| SCNN1A-5189 | + | GGCAACCAGAGGCAGCGCGA | 20 | 9038 |
| SCNN1A-5190 | + | GCCGGGAGUUUUCCGAAGGA | 20 | 9039 |
| SCNN1A-5191 | + | GGAGUUUCCGAAGGAAGGA | 20 | 9040 |
| SCNN1A-5192 | + | GCCCGCUGGCCGGCCAGGGA | 20 | 9041 |
| SCNN1A-5193 | + | GGCCCUGCACGCGGCAGGGA | 20 | 9042 |
| SCNN1A-76 | + | GCCCUGGAGUGGACUGUGGA | 20 | 528 |
| SCNN1A-5194 | − | GACCUGUGGGUGCCCUUGGA | 20 | 9043 |
| SCNN1A-5195 | + | GAGGAGGAGAAAUUCGUUGA | 20 | 9044 |
| SCNN1A-5196 | + | GCAUGGUCCUCCCUGCAAUA | 20 | 9045 |
| SCNN1A-5197 | + | GCCUGCAAUACAAUAAGAUA | 20 | 9046 |
| SCNN1A-5198 | + | GACAUAAGAGCCAAGGGCUA | 20 | 9047 |
| SCNN1A-344 | + | GUAUGGGCUGCAGAGGUCUA | 20 | 4193 |
| SCNN1A-5199 | + | GCAGAGGAGAGGCCGUUCUA | 20 | 9048 |
| SCNN1A-5200 | − | GGAGGACCAUGCCCAAUGUA | 20 | 9049 |
| SCNN1A-5201 | + | GAAAUCCAACCACUAGCUUA | 20 | 9050 |

TABLE 46A-continued

1st Tier

| gRNA Name | DNA Strand | Targeting Domain | Target Site Length | Seq ID |
|---|---|---|---|---|
| SCNN1A-5202 | − | GUUUGGCUGCCAGAUUCAAC | 20 | 9051 |
| SCNN1A-5203 | + | GCUCCCGAGGGCAGGUGAAC | 20 | 9052 |
| SCNN1A-5204 | + | GCCUGAGCAUUGAUACACAC | 20 | 9053 |
| SCNN1A-5205 | + | GAAGGCUGCCGCUUCCUCAC | 20 | 9054 |
| SCNN1A-5206 | + | GAGUGCAGGAAUGUGGUCAC | 20 | 9055 |
| SCNN1A-5207 | − | GGACCUGGCUCAAGGGAGAC | 20 | 9056 |
| SCNN1A-5208 | + | GGCAUGGCACACGCCUAGAC | 20 | 9057 |
| SCNN1A-5209 | + | GGGUGGGGAACCGGGAGGAC | 20 | 9058 |
| SCNN1A-5210 | + | GGUUGCGGCUGGACUGGGAC | 20 | 9059 |
| SCNN1A-5211 | + | GGCAGGUGAACUGGGAGUAC | 20 | 9060 |
| SCNN1A-5212 | + | GUCAACCAGGAUUCCAAACC | 20 | 9061 |
| SCNN1A-5213 | − | GUCCCAGUCCAGCCGCAACC | 20 | 9062 |
| SCNN1A-5214 | + | GAGGGCCUGGGUGGGAACC | 20 | 9063 |
| SCNN1A-5215 | + | GAUCGGGCUCAGGUGCACC | 20 | 9064 |
| SCNN1A-5216 | − | GCCUAGCCCCAGCUUCACC | 20 | 9065 |
| SCNN1A-5217 | + | GGACACUGUGGACACAGACC | 20 | 9066 |
| SCNN1A-5218 | − | GUCCUCCCGGUUCCCCACCC | 20 | 9067 |
| SCNN1A-346 | + | GUGCCCUCUCCCAUCACCCC | 20 | 4195 |
| SCNN1A-5219 | + | GCACACGCCUAGACAGGCCC | 20 | 9068 |
| SCNN1A-5220 | − | GCUUCACCUGGGCCCCUCCC | 20 | 9069 |
| SCNN1A-5221 | + | GCUGAGGAGGAGUCAGAGCC | 20 | 9070 |
| SCNN1A-347 | − | GGUGGGACAUGGGCAUGGCC | 20 | 4196 |
| SCNN1A-5222 | − | GCGAUUACACAUUCCUGGCC | 20 | 9071 |
| SCNN1A-5223 | + | GUGAGAAGAAUUGCAAUGCC | 20 | 9072 |
| SCNN1A-5224 | − | GGGAACCUGGUUUGGAAUCC | 20 | 9073 |
| SCNN1A-5225 | + | GGGAUGCGUCUGCCUCCUCC | 20 | 9074 |
| SCNN1A-5226 | + | GGAGUCCCAAGUGUGCUUCC | 20 | 9075 |
| SCNN1A-348 | − | GGCAGCCUCACUCGGGUUCC | 20 | 4197 |
| SCNN1A-5227 | + | GUGCACCUGGAUGUGAAAGC | 20 | 9076 |
| SCNN1A-176 | − | GCUCAUGAAGGGGAACAGC | 20 | 811 |
| SCNN1A-5228 | − | GCAACCUGGGAGUGGGAAGC | 20 | 9077 |
| SCNN1A-5229 | − | GGGGGUGGCGAGGAAUCAGC | 20 | 9078 |
| SCNN1A-5230 | − | GCUGCUCCCACUUAGUGAGC | 20 | 9079 |
| SCNN1A-349 | − | GAGUGGGAGAAUGUGGGCGC | 20 | 4198 |
| SCNN1A-5231 | − | GUGUGUAUCAAUGCUCAGGC | 20 | 9080 |
| SCNN1A-5232 | + | GAAUCAGACCCAAAAAGGGC | 20 | 9081 |
| SCNN1A-5233 | + | GAAGGAGGGCUCCCGAGGGC | 20 | 9082 |

TABLE 46A-continued

1st Tier

| gRNA Name | DNA Strand | Targeting Domain | Target Site Length | Seq ID |
|---|---|---|---|---|
| SCNN1A-5234 | + | GACAGGUGCAGCGGCCUGGC | 20 | 9083 |
| SCNN1A-5235 | + | GGAGCCUAGGGGCUCACUGC | 20 | 9084 |
| SCNN1A-5236 | + | GGAGUUGGGGCCAAAAGUGC | 20 | 9085 |
| SCNN1A-5237 | - | GGUGCUGAGCACCUUAUUGC | 20 | 9086 |
| SCNN1A-5238 | + | GGUUCCUUUCCAGUUGAAUC | 20 | 9087 |
| SCNN1A-350 | - | GGUGAUGGGAGAGGGCACUC | 20 | 4199 |
| SCNN1A-351 | - | GGCCAGGGGCAGCCUCACUC | 20 | 4200 |
| SCNN1A-5239 | + | GGGCUCACUGCAGGAGACUC | 20 | 9088 |
| SCNN1A-5240 | + | GGACCUGAGAAGGCGGACUC | 20 | 9089 |
| SCNN1A-5241 | - | GUUCUAGGGAAGCCCAGCUC | 20 | 9090 |
| SCNN1A-5242 | - | GCCCUCCUAGCUGUGGGCUC | 20 | 9091 |
| SCNN1A-352 | + | GAUUGGGGAGAGCAAGGGUC | 20 | 4201 |
| SCNN1A-5243 | - | GCCAGGCCGCUGCACCUGUC | 20 | 9092 |
| SCNN1A-5244 | - | GCGAGGAAUCAGCAGGAAAG | 20 | 9093 |
| SCNN1A-5245 | + | GGAGCUAGAGGCUCAGCAAG | 20 | 9094 |
| SCNN1A-5246 | - | GUGAGAGGGGCAAGGCAAG | 20 | 9095 |
| SCNN1A-5247 | + | GGCCAGCGCUGGAAAGGAAG | 20 | 9096 |
| SCNN1A-5248 | + | GCAGGAAUGUGGGCAACCAG | 20 | 9097 |
| SCNN1A-5249 | - | GCAAGAGACUGCCGCAAGAG | 20 | 9098 |
| SCNN1A-5250 | - | GAAACAGAAGGCAGAUAGAG | 20 | 9099 |
| SCNN1A-5251 | - | GUCCAGCCGCAACCUGGGAG | 20 | 9100 |
| SCNN1A-5252 | - | GGGUCUGGACAAGGUUGGAG | 20 | 9101 |
| SCNN1A-5253 | - | GCCAUGCUGCCUUAAGCUAG | 20 | 9102 |
| SCNN1A-5254 | + | GAGGGGCACUGAGUGAGUAG | 20 | 9103 |
| SCNN1A-353 | - | GCUCUCCCCAAUCCACUCCG | 20 | 4202 |
| SCNN1A-5255 | + | GGGCAACCAGAGGCAGCGCG | 20 | 9104 |
| SCNN1A-5256 | + | GUGAAGCUGGGGGCUAGGCG | 20 | 9105 |
| SCNN1A-5257 | + | GACAGACUCAUGGGGGAUCG | 20 | 9106 |
| SCNN1A-5258 | + | GAGUACUGGACCUGAGAAGG | 20 | 9107 |
| SCNN1A-5259 | + | GGGAGUUUUCCGAAGGAAGG | 20 | 9108 |
| SCNN1A-5260 | + | GUGGGAGCAGCGCACUCAGG | 20 | 9109 |
| SCNN1A-5261 | - | GUAGAUAGCCCCAGAGGAGG | 20 | 9110 |
| SCNN1A-5262 | - | GGUCUGGACAAGGUUGGAGG | 20 | 9111 |
| SCNN1A-354 | - | GGGAGAAUGUGGGCGCAGGG | 20 | 4203 |
| SCNN1A-5263 | - | GGCAAAUAGAAAAGGCAGGG | 20 | 9112 |
| SCNN1A-5264 | + | GGCCUGGGUGGGGAACCGGG | 20 | 9113 |
| SCNN1A-5265 | + | GCAUUGAUACACACCGGGGG | 20 | 9114 |
| SCNN1A-2 | - | GCCCAUACCAGGUCUCAUGG | 20 | 497 |
| SCNN1A-5266 | - | GCUGGCUCCAGGAAAGGUGG | 20 | 9115 |
| SCNN1A-5267 | + | GUCACAGAGUUGCAGGAAUG | 20 | 9116 |
| SCNN1A-5268 | + | GAGGGCCACGCAGGACACUG | 20 | 9117 |
| SCNN1A-5269 | - | GCACUCUGGGCUGCCUCCUG | 20 | 9118 |
| SCNN1A-5270 | - | GCCGCUGCACCUGUCAGGUG | 20 | 9119 |
| SCNN1A-5271 | - | GGCCUUUGUCUGCUGGCUUG | 20 | 9120 |
| SCNN1A-355 | - | GUGGGCGCAGGGUGGGACAU | 20 | 4204 |
| SCNN1A-5272 | + | GAGACAGACUCAUGGGGGAU | 20 | 9121 |
| SCNN1A-5273 | - | GUCUCCUGCAGUGAGCCCCU | 20 | 9122 |
| SCNN1A-5274 | - | GGCUGACCUGUGGGUGCCCU | 20 | 9123 |
| SCNN1A-5275 | + | GCCAAGGGCUAGGGGAGCCU | 20 | 9124 |
| SCNN1A-5276 | + | GCCUUGCCCCCUCUCACUCU | 20 | 9125 |
| SCNN1A-5277 | + | GACCUGAGAAGGCGGACUCU | 20 | 9126 |
| SCNN1A-356 | + | GGUAUGGGCUGCAGAGGUCU | 20 | 4205 |
| SCNN1A-5278 | + | GCCAGCAGACCUGCGGGAGU | 20 | 9127 |
| SCNN1A-5279 | - | GAGGAAGCCACAGACCAGGU | 20 | 9128 |
| SCNN1A-357 | - | GGAGAAUGUGGGCGCAGGGU | 20 | 4206 |
| SCNN1A-5280 | + | GCGCUGGAAAGGAAGAGGGU | 20 | 9129 |
| SCNN1A-5281 | - | GUGCAGGGCCUGGGUUGUGU | 20 | 9130 |
| SCNN1A-5282 | - | GAAGGGUCAGUUUCUUCAUU | 20 | 9131 |
| SCNN1A-5283 | - | GAGUCUCCUCCAGCCCUUUU | 20 | 9132 |

Table 46B provides exemplary targeting domains for knocking down the SCNN1A gene selected according to the second tier parameters. The targeting domains bind within 500 bp (e.g., upstream or downstream) of a transcription start site (TSS) and have a high level of orthogonality. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 46B

2nd Tier

| gRNA Name | DNA Strand | Targeting Domain | Target Site Length | Seq ID |
|---|---|---|---|---|
| SCNN1A-5284 | + | AAGGAGCCAGCACCAAA | 17 | 9133 |
| SCNN1A-5285 | + | AAACUUAAUGCAGCAAA | 17 | 9134 |

TABLE 46B-continued

2nd Tier

| gRNA Name | DNA Strand | Targeting Domain | Target Site Length | Seq ID |
|---|---|---|---|---|
| SCNN1A-5286 | - | CUGUCUCAGGAAGUAAA | 17 | 9135 |
| SCNN1A-5287 | + | UAAGACAUAAGAGCCAA | 17 | 9136 |
| SCNN1A-5288 | + | AGUGGGCAGCCCUCCAA | 17 | 9137 |
| SCNN1A-358 | - | CCAGCUGUCCCUUCCAA | 17 | 4207 |
| SCNN1A-359 | - | AGUAUCAAGGUAAGCAA | 17 | 4208 |
| SCNN1A-5289 | + | UGGCUGUUUGAUCUCAA | 17 | 9138 |
| SCNN1A-5290 | - | CUAGGACAAAACUCGAA | 17 | 9139 |
| SCNN1A-5291 | - | UCUGCUGGCUCCAGGAA | 17 | 9140 |
| SCNN1A-5292 | - | UGAUUUAUCCUUGGGAA | 17 | 9141 |
| SCNN1A-5293 | + | UGUGGCCAGCGCUGGAA | 17 | 9142 |
| SCNN1A-360 | - | ACUCCGGGCUCAUGAA | 17 | 4209 |
| SCNN1A-5294 | + | AUUAGCAUCUCAAUUAA | 17 | 9143 |
| SCNN1A-5295 | - | CCUCCCGGGUCUGGACA | 17 | 9144 |
| SCNN1A-5296 | - | UUGAGAUCAAACAGCCA | 17 | 9145 |
| SCNN1A-5297 | + | AUAAGACAUAAGAGCCA | 17 | 9146 |
| SCNN1A-5298 | - | ACCUUUCACAGAGCCA | 17 | 9147 |
| SCNN1A-5299 | + | CGCCCGCUGGCCGGCCA | 17 | 9148 |
| SCNN1A-88 | - | CUCCACAGUCCACUCCA | 17 | 609 |
| SCNN1A-5300 | + | AAGUGGGCAGCCCUCCA | 17 | 9149 |
| SCNN1A-5301 | + | CUGAAUCUUGACAAGCA | 17 | 9150 |
| SCNN1A-361 | - | CAGUAUCAAGGUAAGCA | 17 | 4210 |
| SCNN1A-5302 | - | ACUCUGUGACCACAGCA | 17 | 9151 |
| SCNN1A-5303 | + | ACUAGCUUAAGGCAGCA | 17 | 9152 |
| SCNN1A-5304 | + | UCAAUUAAAGGUGAGCA | 17 | 9153 |
| SCNN1A-5305 | - | UGAGAGGGGCAAGGCA | 17 | 9154 |
| SCNN1A-5306 | + | UUAGACGCAGACAGGCA | 17 | 9155 |
| SCNN1A-5307 | + | AGGCCCUGCACGCGGCA | 17 | 9156 |
| SCNN1A-5308 | - | CUUCCCUGCCGCGUGCA | 17 | 9157 |
| SCNN1A-5309 | + | CAGGCACUGAAGGUGCA | 17 | 9158 |
| SCNN1A-5310 | - | CUGAGCACCUUAUUGCA | 17 | 9159 |
| SCNN1A-362 | - | UAUCAUGAGCAGUAUCA | 17 | 4211 |
| SCNN1A-363 | - | AUGGGAGAGGGCACUCA | 17 | 4212 |
| SCNN1A-5311 | + | UUCCUGAGACAGACUCA | 17 | 9160 |
| SCNN1A-5312 | + | AGGCUGCCGCUUCCUCA | 17 | 9161 |
| SCNN1A-5313 | - | UGUAAGGACCUGGCUCA | 17 | 9162 |
| SCNN1A-5314 | + | AGCGCUGGAAAGGAAGA | 17 | 9163 |
| SCNN1A-5315 | + | AGGGCAACACAAGGAGA | 17 | 9164 |
| SCNN1A-5316 | + | UGGUGGGGGCAAAUAGA | 17 | 9165 |
| SCNN1A-5317 | + | AGCCGGGAGUUUCCGA | 17 | 9166 |
| SCNN1A-5318 | + | AACCAGAGGCAGCGCGA | 17 | 9167 |
| SCNN1A-5319 | + | UGAGCCCACAGCUAGGA | 17 | 9168 |
| SCNN1A-5320 | + | CGCUGGCCGGCCAGGGA | 17 | 9169 |
| SCNN1A-5321 | + | CCUGCACGCGGCAGGGA | 17 | 9170 |
| SCNN1A-5322 | + | CUUGUCCAGACCCGGGA | 17 | 9171 |
| SCNN1A-5323 | + | UGAGCAGGGCGGGGGA | 17 | 9172 |
| SCNN1A-5324 | - | UGACACCUUCUCUGGGA | 17 | 9173 |
| SCNN1A-82 | - | AUACCAGGUCUCAUGGA | 17 | 501 |
| SCNN1A-364 | + | UGAUACCUCCCCUUGGA | 17 | 4213 |
| SCNN1A-5325 | - | CUGUGGGUGCCCUUGGA | 17 | 9174 |
| SCNN1A-365 | - | CACUCCGGGGCUCAUGA | 17 | 4214 |
| SCNN1A-5326 | - | CUGCACCGUCAGGUGA | 17 | 9175 |
| SCNN1A-366 | - | UCGGGUUCCAGGGGUGA | 17 | 4215 |
| SCNN1A-5327 | + | UGGUCCUCCCUGCAAUA | 17 | 9176 |
| SCNN1A-5328 | + | CGAAGGACAGAGAGAUA | 17 | 9177 |
| SCNN1A-5329 | + | AGGGCUAGGGGAGCCUA | 17 | 9178 |
| SCNN1A-5330 | - | AAGAACAGAAUGUCCUA | 17 | 9179 |
| SCNN1A-5331 | + | AUAAGAGCCAAGGGCUA | 17 | 9180 |
| SCNN1A-157 | + | CUCCAUGAGACCUGGUA | 17 | 502 |
| SCNN1A-5332 | + | AUCCAACCACUAGCUUA | 17 | 9181 |
| SCNN1A-5333 | - | UGGCUGCCAGAUUCAAC | 17 | 9182 |
| SCNN1A-5334 | + | CCCGAGGGCAGGUGAAC | 17 | 9183 |
| SCNN1A-5335 | + | UGAGCAUUGAUACACAC | 17 | 9184 |
| SCNN1A-5336 | + | CCUCCAAGGGCACCCAC | 17 | 9185 |
| SCNN1A-5337 | + | UUCCUCACGGGCCCCAC | 17 | 9186 |
| SCNN1A-5338 | - | AGAGCAGACGAAUCCAC | 17 | 9187 |
| SCNN1A-5339 | + | UGCAGGAAUGUGGUCAC | 17 | 9188 |
| SCNN1A-5340 | - | CCUGGCUCAAGGGAGAC | 17 | 9189 |
| SCNN1A-5341 | + | AUGGCACACGCCUAGAC | 17 | 9190 |
| SCNN1A-5342 | + | CCAGGGAUGGAAGCGAC | 17 | 9191 |
| SCNN1A-5343 | + | UGGGGAACCGGGAGGAC | 17 | 9192 |
| SCNN1A-5344 | + | UGCGGCUGGACUGGGAC | 17 | 9193 |
| SCNN1A-5345 | + | CCAGGUUGCGGCUGGAC | 17 | 9194 |
| SCNN1A-5346 | + | CCUCCCCCUCACCUGAC | 17 | 9195 |

TABLE 46B-continued

2nd Tier

| gRNA Name | DNA Strand | Targeting Domain | Target Site Length | Seq ID |
|---|---|---|---|---|
| SCNN1A-5347 | + | AGGUGAACUGGGAGUAC | 17 | 9196 |
| SCNN1A-5348 | + | AGGCUCAGGGUCCAACC | 17 | 9197 |
| SCNN1A-5349 | - | CCAGUCCAGCCGCAACC | 17 | 9198 |
| SCNN1A-5350 | + | CCAACCUUGUCCAGACC | 17 | 9199 |
| SCNN1A-156 | + | UUCCCCUCCAUGAGACC | 17 | 653 |
| SCNN1A-5351 | - | UGCCCAAUGUAAGGACC | 17 | 9200 |
| SCNN1A-368 | - | CCUCUGCAGCCCAUACC | 17 | 4217 |
| SCNN1A-5352 | - | CUCCCGGUUCCCCACCC | 17 | 9201 |
| SCNN1A-5353 | + | UAAGGUGCUCAGCACCC | 17 | 9202 |
| SCNN1A-5354 | + | CAACCUUGUCCAGACCC | 17 | 9203 |
| SCNN1A-369 | + | CCGAGUGAGGCUGCCCC | 17 | 4218 |
| SCNN1A-5355 | - | AGGCCUAUCUCCUCCCC | 17 | 9204 |
| SCNN1A-5356 | + | ACACAGACCCGGAGCCC | 17 | 9205 |
| SCNN1A-5357 | + | AGACCCGGGAGGGGCCC | 17 | 9206 |
| SCNN1A-5358 | - | CCUGUCGCUUCCAUCCC | 17 | 9207 |
| SCNN1A-5359 | - | AGGUUGGACCCUGAGCC | 17 | 9208 |
| SCNN1A-5360 | + | CCAGUCUCCCUUGAGCC | 17 | 9209 |
| SCNN1A-5361 | + | CCGCCCGCUGGCCGGCC | 17 | 9210 |
| SCNN1A-5362 | + | UGACAGGUGCAGCGGCC | 17 | 9211 |
| SCNN1A-5363 | - | CUGCCGCGUGCAGGGCC | 17 | 9212 |
| SCNN1A-5364 | + | AGAAGAAUUGCAAUGCC | 17 | 9213 |
| SCNN1A-5365 | + | UUACACUGUUGGCUGCC | 17 | 9214 |
| SCNN1A-5366 | - | UCCCGGCUUUCACAUCC | 17 | 9215 |
| SCNN1A-5367 | - | AGCUGAGACACAGAUCC | 17 | 9216 |
| SCNN1A-5368 | - | UUCCUUCGGAAAACUCC | 17 | 9217 |
| SCNN1A-370 | - | UCUCCCCAAUCCACUCC | 17 | 4219 |
| SCNN1A-87 | - | CCUCCACAGUCCACUCC | 17 | 608 |
| SCNN1A-5369 | + | AGAAAAGGCAGUACUCC | 17 | 9218 |
| SCNN1A-5370 | - | UUCACCUGGGCCCCUCC | 17 | 9219 |
| SCNN1A-5371 | + | AUGCGUCUGCCUCCUCC | 17 | 9220 |
| SCNN1A-5372 | + | UUUGGUCUUCUUCCUCC | 17 | 9221 |
| SCNN1A-5373 | + | AAAGGGAGUCUGUCUCC | 17 | 9222 |
| SCNN1A-371 | - | AGCCUCACUCGGGUUCC | 17 | 4220 |
| SCNN1A-5374 | + | CUUCUUAAAGUGAAAGC | 17 | 9223 |
| SCNN1A-5375 | + | CACCUGGAUGUGAAAGC | 17 | 9224 |
| SCNN1A-260 | - | CAUGAAGGGGAACAAGC | 17 | 868 |
| SCNN1A-84 | - | CAUGGAGGGGAACAAGC | 17 | 607 |
| SCNN1A-5376 | + | AGGGGCCCAGGUGAAGC | 17 | 9225 |
| SCNN1A-5377 | - | AACUCUGUGACCACAGC | 17 | 9226 |
| SCNN1A-372 | + | CCCUUGGAAGGGACAGC | 17 | 4221 |
| SCNN1A-5378 | - | AUCCCUGGCCGGCCAGC | 17 | 9227 |
| SCNN1A-5379 | + | CUCAAUUAAAGGUGAGC | 17 | 9228 |
| SCNN1A-5380 | + | CAAGCAAGGAGUUUAGC | 17 | 9229 |
| SCNN1A-5381 | + | CAGCGCGAGGGCCACGC | 17 | 9230 |
| SCNN1A-5382 | + | CUGGGGAGCCCGCCCGC | 17 | 9231 |
| SCNN1A-5383 | - | UUGGCCCAACUCCCCGC | 17 | 9232 |
| SCNN1A-5384 | - | CUCUUCCUUUCCAGCGC | 17 | 9233 |
| SCNN1A-373 | - | UGGGAGAAUGUGGGCGC | 17 | 4222 |
| SCNN1A-5385 | - | UGGCAAAUAGAAAAGGC | 17 | 9234 |
| SCNN1A-5386 | - | UGUAUCAAUGCUCAGGC | 17 | 9235 |
| SCNN1A-5387 | + | ACUGAGUGAGUAGAGGC | 17 | 9236 |
| SCNN1A-5388 | + | CAGGCCCUGCACGCGGC | 17 | 9237 |
| SCNN1A-5389 | + | CACUCCCAGGUUGCGGC | 17 | 9238 |
| SCNN1A-5390 | + | UCAGACCCAAAAAGGGC | 17 | 9239 |
| SCNN1A-5391 | + | UUAAAGGUGAGCAGGGC | 17 | 9240 |
| SCNN1A-5392 | - | CUGGCCGGCCAGCGGGC | 17 | 9241 |
| SCNN1A-5393 | - | UCGCUUCCAUCCCUGGC | 17 | 9242 |
| SCNN1A-5394 | + | AGGUGCAGCGGCCUGGC | 17 | 9243 |
| SCNN1A-5395 | + | AGAGAAGAGGUCUCUGC | 17 | 9244 |
| SCNN1A-5396 | - | AACUCCCGCAGGUCUGC | 17 | 9245 |
| SCNN1A-5397 | - | CCUUCCCUGCCGCGUGC | 17 | 9246 |
| SCNN1A-5398 | - | CAGACUCCCUUUGGUGC | 17 | 9247 |
| SCNN1A-5399 | - | UUAUCUUAUUGUAUUGC | 17 | 9248 |
| SCNN1A-5400 | + | UGUGGUCACAGAGUUGC | 17 | 9249 |
| SCNN1A-5401 | + | UCCUUCCAGUUGAAUC | 17 | 9250 |
| SCNN1A-5402 | + | CAGACUCAUGGGGAUC | 17 | 9251 |
| SCNN1A-5403 | - | CGAAAGGUGGCCCUAUC | 17 | 9252 |
| SCNN1A-374 | - | CUCUCCCCAAUCCACUC | 17 | 4223 |
| SCNN1A-375 | - | CAGGGGCAGCCUCACUC | 17 | 4224 |
| SCNN1A-5404 | + | CUCACUGCAGGAGACUC | 17 | 9253 |
| SCNN1A-5405 | + | CCUGAGAAGGCGGACUC | 17 | 9254 |
| SCNN1A-5406 | + | AGGUCAGCCUCACCCUC | 17 | 9255 |
| SCNN1A-5407 | - | CCAGUUCACCUGCCCUC | 17 | 9256 |
| SCNN1A-5408 | - | CUAGGGAAGCCCAGCUC | 17 | 9257 |

TABLE 46B-continued

2nd Tier

| gRNA Name | DNA Strand | Targeting Domain | Target Site Length | Seq ID |
|---|---|---|---|---|
| SCNN1A-5409 | + | AUGGGGAUCGGGGCUC | 17 | 9258 |
| SCNN1A-5410 | - | CUCCUAGCUGUGGGCUC | 17 | 9259 |
| SCNN1A-5411 | + | UGGAUUCGUCUGCUCUC | 17 | 9260 |
| SCNN1A-5412 | - | CCCCAUGAGUCUGUCUC | 17 | 9261 |
| SCNN1A-5413 | - | AGAGAUGACACCUUCUC | 17 | 9262 |
| SCNN1A-5414 | - | CCAGAGUCCGCCUUCUC | 17 | 9263 |
| SCNN1A-376 | + | UGGGGAGAGCAAGGGUC | 17 | 4225 |
| SCNN1A-5415 | + | AAUUGCAAUGCCUGGUC | 17 | 9264 |
| SCNN1A-5416 | - | AGGCCGCUGCACCUGUC | 17 | 9265 |
| SCNN1A-5417 | + | AGGAGUGGAGUGCCAAG | 17 | 9266 |
| SCNN1A-377 | - | CAGCUGUCCCUUCCAAG | 17 | 4226 |
| SCNN1A-5418 | + | CAGCGCUGGAAAGGAAG | 17 | 9267 |
| SCNN1A-5419 | + | ACCCGGAGCCCAGGAAG | 17 | 9268 |
| SCNN1A-5420 | - | UGGGGCCCGUGAGGAAG | 17 | 9269 |
| SCNN1A-378 | - | CUCCGGGGCUCAUGAAG | 17 | 4227 |
| SCNN1A-5421 | + | CCUCCCCGCUCACUAAG | 17 | 9270 |
| SCNN1A-5422 | - | UAAGUAGAUAGCCCCAG | 17 | 9271 |
| SCNN1A-5423 | - | CAUCCCUGGCCGGCCAG | 17 | 9272 |
| SCNN1A-5424 | - | CUCGAGGUCAGGGCCAG | 17 | 9273 |
| SCNN1A-379 | - | CCUCACUCGGGUUCCAG | 17 | 4228 |
| SCNN1A-5425 | - | CCCUAUCAGGGAAGCAG | 17 | 9274 |
| SCNN1A-5426 | - | CUCUGUGACCACAGCAG | 17 | 9275 |
| SCNN1A-5427 | - | UGGGAUAUGUGGGGCAG | 17 | 9276 |
| SCNN1A-5428 | + | AGGCGGACUCUGGGCAG | 17 | 9277 |
| SCNN1A-380 | + | CCUGGUAUGGGCUGCAG | 17 | 4229 |
| SCNN1A-5429 | + | UCACCUGACAGGUGCAG | 17 | 9278 |
| SCNN1A-5430 | - | AGAGACUGCCGCAAGAG | 17 | 9279 |
| SCNN1A-5431 | - | AGGGCCUAGAGUGAGAG | 17 | 9280 |
| SCNN1A-381 | + | CUUCAUGAGCCCCGGAG | 17 | 4230 |
| SCNN1A-5432 | + | UUGUCCAGACCCGGGAG | 17 | 9281 |
| SCNN1A-5433 | - | CAAGGCAAGGGGGGGAG | 17 | 9282 |
| SCNN1A-5434 | - | CAGCCGCAACCUGGGAG | 17 | 9283 |
| SCNN1A-5435 | - | UCUGGACAAGGUUGGAG | 17 | 9284 |
| SCNN1A-5436 | - | UGAGGGCCUAGAGUGAG | 17 | 9285 |
| SCNN1A-5437 | - | UGCUCCCACUUAGUGAG | 17 | 9286 |
| SCNN1A-5438 | - | AUGCUGCCUUAAGCUAG | 17 | 9287 |
| SCNN1A-5439 | + | UAAGAGCCAAGGGCUAG | 17 | 9288 |
| SCNN1A-5440 | + | AACCCAGGCCCUGCACG | 17 | 9289 |
| SCNN1A-5441 | + | AGCAUUGAUACACACCG | 17 | 9290 |
| SCNN1A-5442 | + | CUCCCACACAGAGCCCG | 17 | 9291 |
| SCNN1A-5443 | + | AGGAAGGAGGGCUCCCG | 17 | 9292 |
| SCNN1A-382 | - | CUCCCCAAUCCACUCCG | 17 | 4231 |
| SCNN1A-5444 | - | CUCCCACUUAGUGAGCG | 17 | 9293 |
| SCNN1A-5445 | + | CAACCAGAGGCAGCGCG | 17 | 9294 |
| SCNN1A-5446 | + | UAAAGGUGAGCAGGGCG | 17 | 9295 |
| SCNN1A-5447 | + | AGACUCAUGGGGGAUCG | 17 | 9296 |
| SCNN1A-5448 | - | AAUCAGGACACAGCUCG | 17 | 9297 |
| SCNN1A-5449 | + | AGUUUUCCGAAGGAAGG | 17 | 9298 |
| SCNN1A-5450 | + | CUCACGGGCCCCACAGG | 17 | 9299 |
| SCNN1A-5451 | + | AAAGGUGAGCAGGGCGG | 17 | 9300 |
| SCNN1A-5452 | + | AUUAAAGGUGAGCAGGG | 17 | 9301 |
| SCNN1A-383 | - | AGAAUGUGGGCGCAGGG | 17 | 4232 |
| SCNN1A-5453 | - | AGCACCUUAUUGCAGGG | 17 | 9302 |
| SCNN1A-5454 | + | CUGGGUGGGAACCGGG | 17 | 9303 |
| SCNN1A-5455 | + | CCUUGUCCAGACCCGGG | 17 | 9304 |
| SCNN1A-5456 | - | CCUGGCCGGCCAGCGGG | 17 | 9305 |
| SCNN1A-5457 | + | AAGGUGAGCAGGGCGGG | 17 | 9306 |
| SCNN1A-384 | - | CUGUCCCUUCCAAGGGG | 17 | 4233 |
| SCNN1A-5458 | - | CCACUUAGUGAGCGGGG | 17 | 9307 |
| SCNN1A-5459 | + | UUGAUACACACCGGGGG | 17 | 9308 |
| SCNN1A-5460 | + | CCUAGACAGGCCCUGGG | 17 | 9309 |
| SCNN1A-5461 | + | CUGAGACAGACUCAUGG | 17 | 9310 |
| SCNN1A-81 | - | CAUACCAGGUCUCAUGG | 17 | 605 |
| SCNN1A-5462 | - | UGAGACACAGAUCCUGG | 17 | 9311 |
| SCNN1A-5463 | - | UGUCUGCUGGCUUGUGG | 17 | 9312 |
| SCNN1A-5464 | - | CCUGUGGGUGCCCUUGG | 17 | 9313 |
| SCNN1A-5465 | + | ACAGAGUUGCAGGAAUG | 17 | 9314 |
| SCNN1A-5466 | + | CCUGAGACAGACUCAUG | 17 | 9315 |
| SCNN1A-5467 | - | UGUUGCCUCCUAGCUG | 17 | 9316 |
| SCNN1A-5468 | + | UGUAAUCGCCCCUGCUG | 17 | 9317 |
| SCNN1A-385 | + | CCCCUGGAACCCGAGUG | 17 | 4234 |
| SCNN1A-5469 | - | CUCCUGUGGGGCCCGUG | 17 | 9318 |
| SCNN1A-5470 | - | AAUCCACGGGCUCUGUG | 17 | 9319 |
| SCNN1A-387 | + | AGCCCCGGAGUGGAUUG | 17 | 4236 |

TABLE 46B-continued

2nd Tier

| gRNA Name | DNA Strand | Targeting Domain | Target Site Length | Seq ID |
|---|---|---|---|---|
| SCNN1A-5471 | + | UGUGGCUUCCUCUCUUG | 17 | 9320 |
| SCNN1A-5472 | + | CAGACCUGCGGGAGUUG | 17 | 9321 |
| SCNN1A-5473 | + | UCCUGAGACAGACUCAU | 17 | 9322 |
| SCNN1A-5474 | + | ACACCGGGGAGGAGAU | 17 | 9323 |
| SCNN1A-5475 | + | ACAGACUCAUGGGGGAU | 17 | 9324 |
| SCNN1A-388 | + | UGAGCCCCGGAGUGGAU | 17 | 4237 |
| SCNN1A-5476 | + | UCCUCUGCUUCCCUGAU | 17 | 9325 |
| SCNN1A-389 | − | CGGGUUCCAGGGGUGAU | 17 | 4238 |
| SCNN1A-5477 | + | AGGAGAAAUUCGUUGAU | 17 | 9326 |
| SCNN1A-158 | + | UCCAUGAGACCUGGUAU | 17 | 654 |
| SCNN1A-5478 | + | CCGAGGGCAGGUGAACU | 17 | 9327 |
| SCNN1A-5479 | − | UCUCCUUGCUCACCACU | 17 | 9328 |
| SCNN1A-5480 | + | CAGGUUGCGGCUGGACU | 17 | 9329 |
| SCNN1A-5481 | − | CAGUCCAGCCGCAACCU | 17 | 9330 |
| SCNN1A-5482 | − | AGCCCCAGCUUCACCU | 17 | 9331 |
| SCNN1A-5483 | − | UAGGCUCCCCUAGCCCU | 17 | 9332 |
| SCNN1A-5484 | + | ACGCCUAGACAGGCCU | 17 | 9333 |
| SCNN1A-5485 | − | UGACCUGUGGGUGCCCU | 17 | 9334 |
| SCNN1A-5486 | + | AAGGGCUAGGGGAGCCU | 17 | 9335 |
| SCNN1A-5487 | − | UGCCGCGUGCAGGGCCU | 17 | 9336 |
| SCNN1A-5488 | + | AUCCUGAGCCCACAGCU | 17 | 9337 |
| SCNN1A-5489 | + | CCAAAAGUGCCGGAGCU | 17 | 9338 |
| SCNN1A-5490 | + | CAUAAGAGCCAAGGGCU | 17 | 9339 |
| SCNN1A-5491 | − | CCACAUUCCUGCACUCU | 17 | 9340 |
| SCNN1A-5492 | + | UUGCCCCUCUCACUCU | 17 | 9341 |
| SCNN1A-5493 | + | CUGAGAAGGCGGACUCU | 17 | 9342 |
| SCNN1A-5494 | − | AGUUUCUAGGGGUCUCU | 17 | 9343 |
| SCNN1A-390 | + | AUGGGCUGCAGAGGUCU | 17 | 4239 |
| SCNN1A-5495 | + | AGGGCUCCAGGAGGUCU | 17 | 9344 |
| SCNN1A-5496 | − | AGAGGAGAGGCCGUUCU | 17 | 9345 |
| SCNN1A-5497 | + | CUAGAGGCUCAGCAAGU | 17 | 9346 |
| SCNN1A-5498 | + | CUCCCCGCUCACUAAGU | 17 | 9347 |
| SCNN1A-5499 | + | AGCAGACCUGCGGGAGU | 17 | 9348 |
| SCNN1A-5500 | − | AGCCGCAACCUGGGAGU | 17 | 9349 |
| SCNN1A-5501 | − | CCGGGUCUGGACAAGGU | 17 | 9350 |
| SCNN1A-5502 | + | AGUGAGUAGAGGCAGGU | 17 | 9351 |
| SCNN1A-5503 | − | UGCCUUAAGCUAGUGGU | 17 | 9352 |
| SCNN1A-5504 | + | CAGAGUUGCAGGAAUGU | 17 | 9353 |
| SCNN1A-5505 | − | UCUGGGCUGCCUCCUGU | 17 | 9354 |
| SCNN1A-5506 | − | AUCCACGGGCUCUGUGU | 17 | 9355 |
| SCNN1A-5507 | + | AGCCAGGUCCUUACAUU | 17 | 9356 |
| SCNN1A-5508 | − | CUCCUGGAAGCACACUU | 17 | 9357 |
| SCNN1A-5509 | − | UGGAGACAGACUCCCUU | 17 | 9358 |
| SCNN1A-5510 | − | UUUUGCUGCAUUAAGUU | 17 | 9359 |
| SCNN1A-392 | − | AGCAAGGGAACCUGGUU | 17 | 4241 |
| SCNN1A-5511 | − | CCCAGCUCCGGCACUUU | 17 | 9360 |
| SCNN1A-5512 | − | UCUCCUCCAGCCCUUUU | 17 | 9361 |
| SCNN1A-5513 | − | CUCCUCCAGCCCUUUUU | 17 | 9362 |
| SCNN1A-5514 | + | UCAGAGAAUCAGACCCAAAA | 20 | 9363 |
| SCNN1A-5515 | + | UAGAAGGAGCCAGCACCAAA | 20 | 9364 |
| SCNN1A-5516 | − | CAUGAGCUGGCAAAUAGAAA | 20 | 9365 |
| SCNN1A-5517 | + | AUCUCCUUGGCUCUGUGAAA | 20 | 9366 |
| SCNN1A-5518 | + | AUAGAAGGAGCCAGCACCAA | 20 | 9367 |
| SCNN1A-5519 | − | UCCUGGAGGAAGAAGACCAA | 20 | 9368 |
| SCNN1A-5520 | + | AGAUAAGACAUAAGAGCCAA | 20 | 9369 |
| SCNN1A-5521 | − | AAUCCAGCUGUCCCUUCCAA | 20 | 9370 |
| SCNN1A-393 | − | AGCAGUAUCAAGGUAAGCAA | 20 | 4242 |
| SCNN1A-5522 | − | AAUGUAAGGACCUGGCUCAA | 20 | 9371 |
| SCNN1A-5523 | + | CCCUGGCUGUUUGAUCUCAA | 20 | 9372 |
| SCNN1A-5524 | − | AGGUCUGCUGGCUCCAGGAA | 20 | 9373 |
| SCNN1A-5525 | − | AACUGAUUUAUCCUUGGGAA | 20 | 9374 |
| SCNN1A-394 | + | CAUGAUACCUCCCCUUGGAA | 20 | 4243 |
| SCNN1A-5526 | + | CUCAUUAGCAUCUCAAUUAA | 20 | 9375 |
| SCNN1A-5527 | + | ACAGCUAGGAGGGCAACACA | 20 | 9376 |
| SCNN1A-395 | − | UGUGGGCGCAGGGUGGGACA | 20 | 4244 |
| SCNN1A-5528 | − | CCUUUGAGAUCAAACAGCCA | 20 | 9377 |
| SCNN1A-5529 | − | CCAGAGAGCAGACGAAUCCA | 20 | 9378 |
| SCNN1A-5530 | + | AGCAAGUGGGCAGCCCUCCA | 20 | 9379 |
| SCNN1A-5531 | − | AAAUCCAGCUGUCCCUUCCA | 20 | 9380 |
| SCNN1A-5532 | + | CUGCUGAAUCUUGACAAGCA | 20 | 9381 |
| SCNN1A-5533 | + | UGUCUCCAGGAAGGAGAGCA | 20 | 9382 |
| SCNN1A-5534 | + | AUCUCAAUUAAAGGUGAGCA | 20 | 9383 |
| SCNN1A-396 | − | AGUGGGAGAAUGUGGGCGCA | 20 | 4245 |
| SCNN1A-5535 | + | CCGGAGCCCAGGAAGAGGCA | 20 | 9384 |

TABLE 46B-continued

2nd Tier

| gRNA Name | DNA Strand | Targeting Domain | Target Site Length | Seq ID |
|---|---|---|---|---|
| SCNN1A-5536 | + | CCCAGGCCCUGCACGCGGCA | 20 | 9385 |
| SCNN1A-5537 | + | CCAGGUCCUUACAUUGGGCA | 20 | 9386 |
| SCNN1A-5538 | − | AGCCUUCCCUGCCGCGUGCA | 20 | 9387 |
| SCNN1A-5539 | + | AAGCAGGCACUGAAGGUGCA | 20 | 9388 |
| SCNN1A-5540 | − | CUCGAAAGGUGGCCCUAUCA | 20 | 9389 |
| SCNN1A-397 | − | AGGUAUCAUGAGCAGUAUCA | 20 | 4246 |
| SCNN1A-5541 | + | AAGGCAGUACUCCAGGCUCA | 20 | 9390 |
| SCNN1A-5542 | − | CAAUGUAAGGACCUGGCUCA | 20 | 9391 |
| SCNN1A-398 | + | AUUGGGAGAGCAAGGGUCA | 20 | 4247 |
| SCNN1A-5543 | + | UGGGAGUACUGGACCUGAGA | 20 | 9392 |
| SCNN1A-5544 | + | CAGAGCCGGGAGUUUUCCGA | 20 | 9393 |
| SCNN1A-5545 | + | ACAAUAGAGAGGGACAGCGA | 20 | 9394 |
| SCNN1A-5546 | + | AAGGGAGUCUGUCUCCAGGA | 20 | 9395 |
| SCNN1A-5547 | + | UCCUGAGCCCACAGCUAGGA | 20 | 9396 |
| SCNN1A-5548 | + | AACCUUGUCCAGACCCGGGA | 20 | 9397 |
| SCNN1A-5549 | + | CCUGGAUGUGAAAGCCGGGA | 20 | 9398 |
| SCNN1A-5550 | − | AGAUGACACCUUCUCUGGGA | 20 | 9399 |
| SCNN1A-5551 | − | AAACUGAUUUAUCCUUGGGA | 20 | 9400 |
| SCNN1A-3 | − | CCCAUACCAGGUCUCAUGGA | 20 | 556 |
| SCNN1A-5552 | − | UUUGUCUGCUGGCUUGUGGA | 20 | 9401 |
| SCNN1A-399 | + | UCAUGAUACCUCCCCUUGGA | 20 | 4248 |
| SCNN1A-5553 | − | CGGGUCUGGACAAGGUUGGA | 20 | 9402 |
| SCNN1A-400 | − | AUCCACUCCGGGGCUCAUGA | 20 | 4249 |
| SCNN1A-5554 | − | CUCUUCUCUGCAGGGCCUGA | 20 | 9403 |
| SCNN1A-5555 | − | CGGGCUCUGUGUGGGAGUGA | 20 | 9404 |
| SCNN1A-5556 | − | CCGCUGCACCUGUCAGGUGA | 20 | 9405 |
| SCNN1A-401 | − | CACUCGGGUUCCAGGGGUGA | 20 | 4250 |
| SCNN1A-5557 | + | UCUCCUCUGCUUCCCUGAUA | 20 | 9406 |
| SCNN1A-5558 | − | AAGGGAGACUGGAGUUUCUA | 20 | 9407 |
| SCNN1A-78 | + | CCCCUCCAUGAGACCUGGUA | 20 | 500 |
| SCNN1A-5559 | − | UUUGGAAUCCUGGUUGACAC | 20 | 9408 |
| SCNN1A-5560 | + | AGCCCUCCAAGGGCACCCAC | 20 | 9409 |
| SCNN1A-5561 | + | CGCUUCCUCACGGGCCCCAC | 20 | 9410 |
| SCNN1A-5562 | − | CAGAGAGCAGACGAAUCCAC | 20 | 9411 |
| SCNN1A-5563 | + | CAGGGGCUUUAGACGCAGAC | 20 | 9412 |
| SCNN1A-5564 | + | CGGCCAGGGAUGGAAGCGAC | 20 | 9413 |
| SCNN1A-5565 | + | CUCCCAGGUUGCGGCUGGAC | 20 | 9414 |
| SCNN1A-5566 | + | UCCAGGCUCAGGGUCCAACC | 20 | 9415 |
| SCNN1A-5567 | + | AGUGAAAGCCGGUGUCAACC | 20 | 9416 |
| SCNN1A-404 | − | UCAAGGUAAGCAAGGGAACC | 20 | 4253 |
| SCNN1A-5568 | + | CCUGAGCAUUGAUACACACC | 20 | 9417 |
| SCNN1A-5569 | + | CCUCCAACCUUGUCCAGACC | 20 | 9418 |
| SCNN1A-5570 | − | CCAUGCCCAAUGUAAGGACC | 20 | 9419 |
| SCNN1A-5571 | − | AGCAGGAAAGAGGAGGGACC | 20 | 9420 |
| SCNN1A-405 | − | AGACCUCUGCAGCCCAUACC | 20 | 4254 |
| SCNN1A-5572 | + | CUCCAACCUUGUCCAGACCC | 20 | 9421 |
| SCNN1A-406 | + | AACCCGAGUGAGGCUGCCCC | 20 | 4255 |
| SCNN1A-5573 | + | CCUGAUUCUGUCUCUGCCCC | 20 | 9422 |
| SCNN1A-5574 | − | UGCAGGCCUAUCUCCUCCCC | 20 | 9423 |
| SCNN1A-5575 | + | UGGACACAGACCCGGAGCCC | 20 | 9424 |
| SCNN1A-5576 | − | AUUCCUGUCGCUUCCAUCCC | 20 | 9425 |
| SCNN1A-5577 | − | AACGAAUUUCUCCUCCUCCC | 20 | 9426 |
| SCNN1A-5578 | − | ACCUUUGAGAUCAAACAGCC | 20 | 9427 |
| SCNN1A-5579 | − | AGCGGGCGGGCUCCCCAGCC | 20 | 9428 |
| SCNN1A-5580 | + | ACAAGGAGAAGGGGCCAGCC | 20 | 9429 |
| SCNN1A-5581 | − | ACCAGGUUGGACCCUGAGCC | 20 | 9430 |
| SCNN1A-5582 | + | ACUCCAGUCUCCCUUGAGCC | 20 | 9431 |
| SCNN1A-5583 | + | ACACUGUUGGCUGCCAGGCC | 20 | 9432 |
| SCNN1A-5584 | + | ACCUGACAGGUGCAGCGGCC | 20 | 9433 |
| SCNN1A-5585 | − | UCCCUGCCGCGUGCAGGGCC | 20 | 9434 |
| SCNN1A-5586 | + | UUUUUACACUGUUGGCUGCC | 20 | 9435 |
| SCNN1A-5587 | − | CCUUCCCGGCUUUCACAUCC | 20 | 9436 |
| SCNN1A-5588 | − | AGGAGCUGAGACACAGAUCC | 20 | 9437 |
| SCNN1A-5589 | − | UCCUUCCUUCGGAAAACUCC | 20 | 9438 |
| SCNN1A-408 | − | UGCUCUCCCCAAUCCACUCC | 20 | 4257 |
| SCNN1A-8 | − | AGCCCUCCACAGUCCACUCC | 20 | 559 |
| SCNN1A-5590 | + | AAGAGAAAGGCAGUACUCC | 20 | 9439 |
| SCNN1A-5591 | − | UGGAGGCAGCCCAGACCUCC | 20 | 9440 |
| SCNN1A-5592 | − | AGCUUCACCUGGGCCCCUCC | 20 | 9441 |
| SCNN1A-5593 | − | UUUCUGCCCUCCUGUCCUCC | 20 | 9442 |
| SCNN1A-5594 | − | CUUGCUGAGCCUCUAGCUCC | 20 | 9443 |
| SCNN1A-5595 | − | CCCGCAGGUCUGCUGGCUCC | 20 | 9444 |
| SCNN1A-5596 | + | ACCAAAGGGAGUCUGUCCCC | 20 | 9445 |
| SCNN1A-5597 | − | CAGGGGCGAUUACACAUUCC | 20 | 9446 |

TABLE 46B-continued

2nd Tier

| gRNA Name | DNA Strand | Targeting Domain | Target Site Length | Seq ID |
|---|---|---|---|---|
| SCNN1A-5598 | − | UCCCCCUUGCUCUCCUUCC | 20 | 9447 |
| SCNN1A-5 | − | UCUCAUGGAGGGGAACAAGC | 20 | 557 |
| SCNN1A-5599 | − | UGCAACUCUGUGACCACAGC | 20 | 9448 |
| SCNN1A-409 | + | CUCCCCUUGGAAGGGACAGC | 20 | 4258 |
| SCNN1A-5600 | − | UCCAUCCCUGGCCGGCCAGC | 20 | 9449 |
| SCNN1A-5601 | + | CAUCUCAAUUAAAGGUGAGC | 20 | 9450 |
| SCNN1A-5602 | + | UGACAAGCAAGGAGUUUAGC | 20 | 9451 |
| SCNN1A-5603 | + | AGGCAGCGCGAGGGCCACGC | 20 | 9452 |
| SCNN1A-5604 | + | UGGCUGGGGAGCCCGCCCGC | 20 | 9453 |
| SCNN1A-5605 | − | CUUUUGGCCCCAACUCCCGC | 20 | 9454 |
| SCNN1A-5606 | − | ACCCUCUUCCUUUCCAGCGC | 20 | 9455 |
| SCNN1A-5607 | − | UCGAGGUCAGGGCCAGAGGC | 20 | 9456 |
| SCNN1A-5608 | + | ACGCAGACAGGCAAGGAGGC | 20 | 9457 |
| SCNN1A-5609 | + | ACCCAGGCCCUGCACGCGGC | 20 | 9458 |
| SCNN1A-5610 | + | UCCCACUCCCAGGUUGCGGC | 20 | 9459 |
| SCNN1A-5611 | + | CAAUUAAAGGUGAGCAGGGC | 20 | 9460 |
| SCNN1A-5612 | − | UCCCUGGCCGGCCAGCGGGC | 20 | 9461 |
| SCNN1A-5613 | + | UGAGAAGGCGGACUCUGGGC | 20 | 9462 |
| SCNN1A-5614 | − | CUGUCGCUUCCAUCCCUGGC | 20 | 9463 |
| SCNN1A-5615 | + | CCUGGAGCCAGCAGACCUGC | 20 | 9464 |
| SCNN1A-5616 | + | AAGAGAGAAGAGGUCUCUGC | 20 | 9465 |
| SCNN1A-5617 | − | CCCAACUCCCGCAGGUCUGC | 20 | 9466 |
| SCNN1A-5618 | − | CAGGCUGGGCCUUUGUCUGC | 20 | 9467 |
| SCNN1A-5619 | − | CAGCCUUCCCUGCCGCGUGC | 20 | 9468 |
| SCNN1A-5620 | + | AAAGCAGGCACUGAAGGUGC | 20 | 9469 |
| SCNN1A-5621 | + | UUCGUCUGCUCUCUGGGUGC | 20 | 9470 |
| SCNN1A-5622 | − | ACCUUAUCUUAUUGUAUUGC | 20 | 9471 |
| SCNN1A-5623 | + | UGCUGUGGUCACAGAGUUGC | 20 | 9472 |
| SCNN1A-5624 | − | CCUGGGGCAGAGACAGAAUC | 20 | 9473 |
| SCNN1A-5625 | + | AGACAGACUCAUGGGGGAUC | 20 | 9474 |
| SCNN1A-5626 | − | ACUCGAAAGGUGGCCCUAUC | 20 | 9475 |
| SCNN1A-410 | − | UUGCUCUCCCCAAUCCACUC | 20 | 4259 |
| SCNN1A-5627 | + | UAAGUGGGAGCAGCGCACUC | 20 | 9476 |
| SCNN1A-5628 | + | AAAAGGGCUGGAGGAGACUC | 20 | 9477 |
| SCNN1A-5629 | + | CACAGGUCAGCCUCACCCUC | 20 | 9478 |
| SCNN1A-5630 | − | CGUGGCCCUCGCGCUGCCUC | 20 | 9479 |
| SCNN1A-411 | + | UCAGGGUCAAGGCUGAGCUC | 20 | 4260 |
| SCNN1A-5631 | + | AAAGGCAGUACUCCAGGCUC | 20 | 9480 |
| SCNN1A-5632 | + | CUCAUGGGGAUCGGGGCUC | 20 | 9481 |
| SCNN1A-5633 | − | CCCGGUGUGUAUCAAUGCUC | 20 | 9482 |
| SCNN1A-5634 | + | CCGUGGAUUCGUCUGCUCUC | 20 | 9483 |
| SCNN1A-5635 | − | CUGGAGUUUCUAGGGGUCUC | 20 | 9484 |
| SCNN1A-5636 | − | AUCCCCCAUGAGUCUGUCUC | 20 | 9485 |
| SCNN1A-5637 | − | AGCAGAGAUGACACCUUCUC | 20 | 9486 |
| SCNN1A-5638 | − | UGCCCAGAGUCCGCCUUCUC | 20 | 9487 |
| SCNN1A-5639 | − | UCAGGACACAGCUCGAGGUC | 20 | 9488 |
| SCNN1A-5640 | + | AAGAAUUGCAAUGCCUGGUC | 20 | 9489 |
| SCNN1A-5641 | − | UAAGCUAGUGGUUGGAUUUC | 20 | 9490 |
| SCNN1A-5642 | + | AUAAGGAGUGGAGUGCCAAG | 20 | 9491 |
| SCNN1A-412 | − | AUCCAGCUGUCCCUUCCAAG | 20 | 4261 |
| SCNN1A-5643 | + | CAGACCCGGAGCCCAGGAAG | 20 | 9492 |
| SCNN1A-5644 | − | CUGUGGGGCCCGUGAGGAAG | 20 | 9493 |
| SCNN1A-5645 | + | UCUCCUCCCCGCUCACUAAG | 20 | 9494 |
| SCNN1A-5646 | − | CGCUAAGUAGAUAGCCCCAG | 20 | 9495 |
| SCNN1A-5647 | − | UUCCAUCCCUGGCCGGCCAG | 20 | 9496 |
| SCNN1A-5648 | − | CAGCUCGAGGUCAGGGCCAG | 20 | 9497 |
| SCNN1A-413 | − | UGGGACAUGGGCAUGGCCAG | 20 | 4262 |
| SCNN1A-414 | − | CAGCCUCACUCGGGUUCCAG | 20 | 4263 |
| SCNN1A-5649 | − | UGGCCCUAUCAGGGAAGCAG | 20 | 9498 |
| SCNN1A-5650 | − | CAACUCUGUGACCACAGCAG | 20 | 9499 |
| SCNN1A-5651 | − | CUCUGGGAUAUGUGGGGCAG | 20 | 9500 |
| SCNN1A-5652 | + | AGAAGGCGGACUCUGGGCAG | 20 | 9501 |
| SCNN1A-415 | + | AGACCUGGUAUGGGCUGCAG | 20 | 4264 |
| SCNN1A-5653 | − | CUGAGGGCCUAGAGUGAGAG | 20 | 9502 |
| SCNN1A-5654 | + | UGCAGCAAAAGGAUAAGGAG | 20 | 9503 |
| SCNN1A-5655 | + | ACCUUGUCCAGACCCGGGAG | 20 | 9504 |
| SCNN1A-4 | − | CCAUACCAGGUCUCAUGGAG | 20 | 498 |
| SCNN1A-5656 | + | AAGGGGCCAGCCAGGCUGAG | 20 | 9505 |
| SCNN1A-5657 | − | AGCUGAGGGCUAGAGUGAG | 20 | 9506 |
| SCNN1A-5658 | − | CGCUGCUCCCACUUAGUGAG | 20 | 9507 |
| SCNN1A-5659 | − | CGCUGCACCUGUCAGGUGAG | 20 | 9508 |
| SCNN1A-5660 | + | CAAGGGCUAGGGGAGCCUAG | 20 | 9509 |
| SCNN1A-5661 | + | AGUGUGCUUCCAGGAGCUAG | 20 | 9510 |
| SCNN1A-5662 | + | ACAUAAGAGCCAAGGGCUAG | 20 | 9511 |

TABLE 46B-continued

2nd Tier

| gRNA Name | DNA Strand | Targeting Domain | Target Site Length | Seq ID |
|---|---|---|---|---|
| SCNN1A-5663 | - | AGGGAGACUGGAGUUUCUAG | 20 | 9512 |
| SCNN1A-5664 | + | CACAACCCAGGCCCUGCACG | 20 | 9513 |
| SCNN1A-5665 | + | CUGAGCAUUGAUACACACCG | 20 | 9514 |
| SCNN1A-5666 | + | UCACUCCCACACAGAGCCCG | 20 | 9515 |
| SCNN1A-5667 | + | CGAAGGAAGGAGGGCUCCCG | 20 | 9516 |
| SCNN1A-5668 | - | CUGCUCCCACUUAGUGAGCG | 20 | 9517 |
| SCNN1A-5669 | + | AAUUAAAGGUGAGCAGGGCG | 20 | 9518 |
| SCNN1A-5670 | - | CAAGGUUGGAGGGGUGGCG | 20 | 9519 |
| SCNN1A-5671 | - | UGUGUCCACAGUGUCCUGCG | 20 | 9520 |
| SCNN1A-5672 | - | CAGAAUCAGGACACAGCUCG | 20 | 9521 |
| SCNN1A-5673 | - | CUAGGACAAAACUCGAAAGG | 20 | 9522 |
| SCNN1A-5674 | + | UUAGACGCAGACAGGCAAGG | 20 | 9523 |
| SCNN1A-5675 | + | UUCCUCACGGGCCCCACAGG | 20 | 9524 |
| SCNN1A-5676 | + | UGGGGAACCGGGAGGACAGG | 20 | 9525 |
| SCNN1A-5677 | + | ACUGAGUGAGUAGAGGCAGG | 20 | 9526 |
| SCNN1A-5678 | - | UAAGUAGAUAGCCCCAGAGG | 20 | 9527 |
| SCNN1A-5679 | - | UGAGGGCCUAGAGUGAGAGG | 20 | 9528 |
| SCNN1A-5680 | + | AUCCUGAGCCCACAGCUAGG | 20 | 9529 |
| SCNN1A-5681 | + | AGGUGAAGCUGGGGGCUAGG | 20 | 9530 |
| SCNN1A-5682 | + | UGAGCAUUGAUACACACCGG | 20 | 9531 |
| SCNN1A-5683 | + | AUUAAAGGUGAGCAGGGCGG | 20 | 9532 |
| SCNN1A-5684 | + | CAGGCACUGAAGGUGCAGGG | 20 | 9533 |
| SCNN1A-5685 | - | CUGAGCACCUUAUUGCAGGG | 20 | 9534 |
| SCNN1A-5686 | + | CAACCUUGUCCAGACCCGGG | 20 | 9535 |
| SCNN1A-5687 | - | AUCCCUGGCCGGCCAGCGGG | 20 | 9536 |
| SCNN1A-5688 | + | UUAAAGGUGAGCAGGGCGGG | 20 | 9537 |
| SCNN1A-416 | - | CAGCUGUCCCUUCCAAGGGG | 20 | 4265 |
| SCNN1A-5689 | - | CUCCCACUUAGUGAGCGGGG | 20 | 9538 |
| SCNN1A-5690 | - | CUGGACAAGGUUGGAGGGGG | 20 | 9539 |
| SCNN1A-5691 | + | ACGCCUAGACAGGCCCUGGG | 20 | 9540 |
| SCNN1A-5692 | + | UUCCUGAGACAGACUCAUGG | 20 | 9541 |
| SCNN1A-5693 | - | AGCUGAGACACAGAUCCUGG | 20 | 9542 |
| SCNN1A-5694 | + | UCAGACCCAAAAAGGGCUGG | 20 | 9543 |
| SCNN1A-75 | + | AGCCCUGGAGUGGACUGUGG | 20 | 602 |
| SCNN1A-5695 | - | CUUUGUCUGCUGGCUUGUGG | 20 | 9544 |
| SCNN1A-5696 | - | UGACCUGUGGGUGCCCUUGG | 20 | 9545 |
| SCNN1A-5697 | - | CCGGGUCUGGACAAGGUUGG | 20 | 9546 |
| SCNN1A-5698 | + | CUUCCUGAGACAGACUCAUG | 20 | 9547 |
| SCNN1A-5699 | + | CUGAAGGUGCAGGGAGGAUG | 20 | 9548 |
| SCNN1A-5700 | - | CUAGGGGUCUCUGGGAUAUG | 20 | 9549 |
| SCNN1A-5701 | + | UCCUGGAGCCAGCAGACCUG | 20 | 9550 |
| SCNN1A-5702 | - | CUGAGGGUGAGGCUGACCUG | 20 | 9551 |
| SCNN1A-5703 | - | UCUCUUCUCUGCAGGGCCUG | 20 | 9552 |
| SCNN1A-5704 | - | UUGUGUUGCCCUCCUAGCUG | 20 | 9553 |
| SCNN1A-5705 | + | CAGGUGCAGCGGCCUGGCUG | 20 | 9554 |
| SCNN1A-5706 | + | AUGUGUAAUCGCCCCUGCUG | 20 | 9555 |
| SCNN1A-5707 | + | AGAAUUCUCCUCCUCCUCUG | 20 | 9556 |
| SCNN1A-5708 | + | UCAGGGUCCAACCUGGUCUG | 20 | 9557 |
| SCNN1A-5709 | + | AAGGAUAAAUCAGUUUUCUG | 20 | 9558 |
| SCNN1A-5710 | - | CUGGGAUAUGUGGGGCAGUG | 20 | 9559 |
| SCNN1A-417 | + | UCACCCCUGGAACCCGAGUG | 20 | 4266 |
| SCNN1A-5711 | - | ACGGGCUCUGUGUGGGAGUG | 20 | 9560 |
| SCNN1A-5712 | - | UGCCUCCUGUGGGGCCCGUG | 20 | 9561 |
| SCNN1A-5713 | + | UGAGUGAGUAGAGGCAGGUG | 20 | 9562 |
| SCNN1A-5714 | - | CUCUGCAGGGCCUGAGGGUG | 20 | 9563 |
| SCNN1A-5715 | - | AGGGGUCUCUGGGAUAUGUG | 20 | 9564 |
| SCNN1A-5716 | - | ACUCUGGGCUGCCUCCUGUG | 20 | 9565 |
| SCNN1A-5717 | - | ACGAAUCCACGGGCUCUGUG | 20 | 9566 |
| SCNN1A-5718 | - | CGUGCAGGGCCUGGGUUGUG | 20 | 9567 |
| SCNN1A-419 | + | AUGAGCCCCGGAGUGGAUUG | 20 | 4268 |
| SCNN1A-5719 | + | CAGCAGACCUGCGGGAGUUG | 20 | 9568 |
| SCNN1A-5720 | + | CUGAGGUUAGAAAACAAAAU | 20 | 9569 |
| SCNN1A-5721 | + | CUUGAGCCAGGUCCUUACAU | 20 | 9570 |
| SCNN1A-5722 | + | ACAGCGAAGGACAGAGAGAU | 20 | 9571 |
| SCNN1A-5723 | + | UACACACCGGGGGAGGAGAU | 20 | 9572 |
| SCNN1A-420 | + | UCAUGAGCCCCGGAGUGGAU | 20 | 4269 |
| SCNN1A-5724 | + | CUCUCCUCUGCUUCCCUGAU | 20 | 9573 |
| SCNN1A-421 | - | ACUCGGGUUCCAGGGGUGAU | 20 | 4270 |
| SCNN1A-5725 | + | AGGAGGAGAAAUUCGUUGAU | 20 | 9574 |
| SCNN1A-79 | + | CCCUCCAUGAGACCUGGUAU | 20 | 604 |
| SCNN1A-5726 | + | CUCCCGAGGGCAGGUGAACU | 20 | 9575 |
| SCNN1A-5727 | - | CUAGCUCCUGGAAGCACACU | 20 | 9576 |
| SCNN1A-5728 | - | CUCUCCUUGCUCACCACU | 20 | 9577 |
| SCNN1A-5729 | + | AAAAAGGGCUGGAGGAGACU | 20 | 9578 |

TABLE 46B-continued

2nd Tier

| gRNA Name | DNA Strand | Targeting Domain | Target Site Length | Seq ID |
|---|---|---|---|---|
| SCNN1A-5730 | + | UCCCAGGUUGCGGCUGGACU | 20 | 9579 |
| SCNN1A-5731 | − | UCCCAGUCCAGCCGCAACCU | 20 | 9580 |
| SCNN1A-5732 | − | CCUAGCCCCCAGCUUCACCU | 20 | 9581 |
| SCNN1A-5733 | − | CCCUAGGCUCCCCUAGCCCU | 20 | 9582 |
| SCNN1A-5734 | + | CACACGCCUAGACAGGCCCU | 20 | 9583 |
| SCNN1A-5735 | + | UGGGGGCUAGGCGGGGCCCU | 20 | 9584 |
| SCNN1A-5736 | − | ACUCCCAGUUCACCUGCCCU | 20 | 9585 |
| SCNN1A-5737 | − | CCCUGCCGCGUGCAGGGCCU | 20 | 9586 |
| SCNN1A-5738 | + | UGGGUGCUGGGUUAUCUCCU | 20 | 9587 |
| SCNN1A-5739 | − | UCCUGGAGCCCUGCAGUCCU | 20 | 9588 |
| SCNN1A-5740 | + | AGGAUCCUGAGCCCACAGCU | 20 | 9589 |
| SCNN1A-5741 | − | UGUGUAUCAAUGCUCAGGCU | 20 | 9590 |
| SCNN1A-5742 | + | CGCAGACAGGCAAGGAGGCU | 20 | 9591 |
| SCNN1A-5743 | + | AGACAUAAGAGCCAAGGGCU | 20 | 9592 |
| SCNN1A-5744 | + | ACAGGUGCAGCGGCCUGGCU | 20 | 9593 |
| SCNN1A-5745 | + | UCGUCUGCUCUCUGGGUGCU | 20 | 9594 |
| SCNN1A-5746 | − | UGACCACAUUCCUGCACUCU | 20 | 9595 |
| SCNN1A-422 | + | CAGGGUCAAGGCUGAGCUCU | 20 | 4271 |
| SCNN1A-5747 | + | CGUGGAUUCGUCUGCUCUCU | 20 | 9596 |
| SCNN1A-5748 | + | UGGAGUUUCUAGGGGUCUCU | 20 | 9597 |
| SCNN1A-5749 | + | UGCAGGGCUCCAGGAGGUCU | 20 | 9598 |
| SCNN1A-5750 | − | AGCAGAGGAGAGGCCGUUCU | 20 | 9599 |
| SCNN1A-5751 | − | CAAGGGAGACUGGAGUUUCU | 20 | 9600 |
| SCNN1A-5752 | + | CUCCUCCCCGCUCACUAAGU | 20 | 9601 |
| SCNN1A-5753 | − | UCUGGGAUAUGUGGGGCAGU | 20 | 9602 |
| SCNN1A-5754 | − | UCCAGCCGCAACCUGGGAGU | 20 | 9603 |
| SCNN1A-5755 | − | CUCCCGGGUCUGGACAAGGU | 20 | 9604 |
| SCNN1A-5756 | + | CUGAGUGAGUAGAGGCAGGU | 20 | 9605 |
| SCNN1A-5757 | + | UGGGAGCAGCGCACUCAGGU | 20 | 9606 |
| SCNN1A-5758 | − | UGCUGCCUUAAGCUAGUGGU | 20 | 9607 |
| SCNN1A-5759 | − | AGGGAGGAGUGGGAGAAUGU | 20 | 9608 |
| SCNN1A-5760 | + | UCACAGAGUUGCAGGAAUGU | 20 | 9609 |
| SCNN1A-5761 | − | UAGGGGUCUCUGGGAUAUGU | 20 | 9610 |
| SCNN1A-5762 | + | UCUGUUCUUUUUUACACUGU | 20 | 9611 |
| SCNN1A-5763 | − | UGAGGGUGAGGCUGACCUGU | 20 | 9612 |
| SCNN1A-5764 | + | CACUCUGGGCUGCCUCCUGU | 20 | 9613 |
| SCNN1A-5765 | − | UGUGUUGCCCUCCUAGCUGU | 20 | 9614 |

TABLE 46B-continued

2nd Tier

| gRNA Name | DNA Strand | Targeting Domain | Target Site Length | Seq ID |
|---|---|---|---|---|
| SCNN1A-5766 | − | CGAAUCCACGGGCUCUGUGU | 20 | 9615 |
| SCNN1A-5767 | + | UUGAGCCAGGUCCUUACAUU | 20 | 9616 |
| SCNN1A-425 | + | CAUGAGCCCCGGAGUGGAUU | 20 | 4274 |
| SCNN1A-5768 | − | UAGCUCCUGGAAGCACACUU | 20 | 9617 |
| SCNN1A-5769 | − | UCCUGGAGACAGACUCCCUU | 20 | 9618 |
| SCNN1A-5770 | − | CUCGGGAGCCCUCCUUCCUU | 20 | 9619 |
| SCNN1A-5771 | − | UCCUUUUGCUGCAUUAAGUU | 20 | 9620 |
| SCNN1A-5772 | + | CCAGCAGACCUGCGGGAGUU | 20 | 9621 |
| SCNN1A-5773 | − | UUAAGUUUGGAAAGAGAUUU | 20 | 9622 |
| SCNN1A-5774 | − | AAGCCCAGCUCCGGCACUUU | 20 | 9623 |
| SCNN1A-5775 | − | AGUCUCCUCCAGCCCUUUUU | 20 | 9624 |

Table 46C provides exemplary targeting domains for knocking down the SCNN1A gene selected according to the third tier parameters. The targeting domains bind within 500 bp (e.g., upstream or downstream) of a transcription start site (TSS) and start with a 5'G. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene

TABLE 46C

3rd Tier

| gRNA Name | DNA Strand | Targeting Domain | Target Site Length | Seq ID |
|---|---|---|---|---|
| SCNN1A-5776 | − | GGGGGCAGAGACAGAAA | 17 | 9625 |
| SCNN1A-5777 | − | GAGAGGGGGCAAGGCAA | 17 | 9626 |
| SCNN1A-5778 | − | GUAAGGACCUGGCUCAA | 17 | 9627 |
| SCNN1A-5779 | − | GAAGAAGACCAAAGGAA | 17 | 9628 |
| SCNN1A-426 | − | GGACAUGGGCAUGGCCA | 17 | 4275 |
| SCNN1A-427 | + | GUGGAUUGGGGAGAGCA | 17 | 4276 |
| SCNN1A-5780 | − | GGCAAAUAGAAAAGGCA | 17 | 9629 |
| SCNN1A-5781 | + | GAGCCCAGGAAGAGGCA | 17 | 9630 |
| SCNN1A-428 | + | GGGGAGAGCAAGGGUCA | 17 | 4277 |
| SCNN1A-5782 | + | GGAAGCCUUCCCAGAGA | 17 | 9631 |
| SCNN1A-5783 | + | GAGGGAGACAAUAGAGA | 17 | 9632 |
| SCNN1A-5784 | + | GGCCAGCCAGGCUGAGA | 17 | 9633 |

TABLE 46C-continued

3rd Tier

| gRNA Name | DNA Strand | Targeting Domain | Target Site Length | Seq ID |
|---|---|---|---|---|
| SCNN1A-5785 | - | GGAAGAAGACCAAAGGA | 17 | 9634 |
| SCNN1A-5786 | + | GAGGCUGGGGACAGGA | 17 | 9635 |
| SCNN1A-5787 | + | GAGAUAGGGAUGGAGGA | 17 | 9636 |
| SCNN1A-5788 | - | GAAAGGUGGAGGAGGGA | 17 | 9637 |
| SCNN1A-5789 | + | GGACAGAGAGAUAGGGA | 17 | 9638 |
| SCNN1A-5790 | + | GGGAAAGCAGGCACUGA | 17 | 9639 |
| SCNN1A-5791 | + | GACAGGAUGGCAGGUGA | 17 | 9640 |
| SCNN1A-5792 | + | GGGCCUGGGUGGGGAAC | 17 | 9641 |
| SCNN1A-5793 | + | GGCCUGGGUGGGGAACC | 17 | 9642 |
| SCNN1A-5794 | - | GAAUUUCUCCUCCUCCC | 17 | 9643 |
| SCNN1A-5795 | + | GAGGAGGAGUCAGAGCC | 17 | 9644 |
| SCNN1A-5796 | + | GCCAGGCUGAGAGGGCC | 17 | 9645 |
| SCNN1A-429 | - | GGGACAUGGGCAUGGCC | 17 | 4278 |
| SCNN1A-5797 | - | GCCUCUUCCUGGGCUCC | 17 | 9646 |
| SCNN1A-5798 | - | GCAGGUCUGCUGGCUCC | 17 | 9647 |
| SCNN1A-5799 | + | GAAGAGGCAGGGAAAGC | 17 | 9648 |
| SCNN1A-5800 | - | GCCAGAAAGAGGAGAGC | 17 | 9649 |
| SCNN1A-86 | - | GAACAAGCUGGAGGAGC | 17 | 531 |
| SCNN1A-5801 | - | GGAUUUCAGGCAUGAGC | 17 | 9650 |
| SCNN1A-5802 | - | GCUCCCACUUAGUGAGC | 17 | 9651 |
| SCNN1A-5803 | + | GGAGCCCAGGAAGAGGC | 17 | 9652 |
| SCNN1A-5804 | - | GGGAGAGGAAGAGAGGC | 17 | 9653 |
| SCNN1A-5805 | - | GAGAGGGAGUGAGAGGC | 17 | 9654 |
| SCNN1A-5806 | - | GAUUAGAGAGAGGAGGC | 17 | 9655 |
| SCNN1A-5807 | - | GGCUUGUGGAGGGAGGC | 17 | 9656 |
| SCNN1A-5808 | + | GGAGGGCUCCCGAGGGC | 17 | 9657 |
| SCNN1A-5809 | - | GGCCCUCUCAGCCUGGC | 17 | 9658 |
| SCNN1A-5810 | + | GAGGCAGCCCAGAGUGC | 17 | 9659 |
| SCNN1A-5811 | + | GAAUUCUCCUCCUCCUC | 17 | 9660 |
| SCNN1A-430 | + | GGGUCAAGGCUGAGCUC | 17 | 4279 |
| SCNN1A-5812 | - | GGAGGCAGGCCAGAAAG | 17 | 9661 |
| SCNN1A-5813 | + | GACAGGAGGGCAGAAAG | 17 | 9662 |
| SCNN1A-5814 | + | GGCAACACAAGGAGAAG | 17 | 9663 |
| SCNN1A-5815 | - | GGGGGGGAGAGGAAGAG | 17 | 9664 |
| SCNN1A-5816 | + | GGUGAGCAAGGAGAGAG | 17 | 9665 |
| SCNN1A-5817 | + | GAGGCAGGAUUAGAGAG | 17 | 9666 |
| SCNN1A-5818 | - | GAGGAGGGAGGGAGGAG | 17 | 9667 |
| SCNN1A-5819 | + | GAGCAGGGCGGGGGGAG | 17 | 9668 |
| SCNN1A-5820 | + | GGGCCAGCCAGGCUGAG | 17 | 9669 |
| SCNN1A-5821 | - | GAUAGAGAGGGAGUGAG | 17 | 9670 |
| SCNN1A-5822 | - | GGUUGGAGGGGUGGCG | 17 | 9671 |
| SCNN1A-5823 | - | GCUGGCUCCAGGAAAGG | 17 | 9672 |
| SCNN1A-5824 | - | GAGGGGGCAAGGCAAGG | 17 | 9673 |
| SCNN1A-5825 | + | GACUGCAGGGCUCCAGG | 17 | 9674 |
| SCNN1A-5826 | + | GAGUGAGUAGAGGCAGG | 17 | 9675 |
| SCNN1A-5827 | + | GAGCAAGGAGAGAGAGG | 17 | 9676 |
| SCNN1A-5828 | - | GCAGGAUUAGAGAGAGG | 17 | 9677 |
| SCNN1A-5829 | - | GAGGAGGGACCAGGAGG | 17 | 9678 |
| SCNN1A-5830 | - | GAUAGCCCCAGAGGAGG | 17 | 9679 |
| SCNN1A-5831 | + | GGGGGGAGGGCUGAGG | 17 | 9680 |
| SCNN1A-5832 | - | GCACCUGUCAGGUGAGG | 17 | 9681 |
| SCNN1A-5833 | - | GGCAGAGACAGAAAGGG | 17 | 9682 |
| SCNN1A-5834 | + | GCUGGAAAGGAAGAGGG | 17 | 9683 |
| SCNN1A-5835 | - | GGAAAGGUGGAGGAGGG | 17 | 9684 |
| SCNN1A-5836 | - | GGGGGCAAGGCAAGGGG | 17 | 9685 |
| SCNN1A-5837 | - | GACAAGGUUGGAGGGGG | 17 | 9686 |
| SCNN1A-5838 | + | GUGAGCAGGGCGGGGGG | 17 | 9687 |
| SCNN1A-5839 | + | GGCUGAGAGGGCCUGGG | 17 | 9688 |
| SCNN1A-5840 | + | GAGUAGAGGCAGGUGGG | 17 | 9689 |
| SCNN1A-5841 | - | GGCCUGGGUUGUGUGGG | 17 | 9690 |
| SCNN1A-431 | - | GAAGGGGAACAAGCUGG | 17 | 4280 |
| SCNN1A-85 | - | GGAGGGGAACAAGCUGG | 17 | 530 |
| SCNN1A-5842 | + | GGCCCAGGUGAAGCUGG | 17 | 9691 |
| SCNN1A-5843 | - | GGCUCCAGGAAAGGUGG | 17 | 9692 |
| SCNN1A-5844 | + | GUGGGGGGCAGUGGUGG | 17 | 9693 |
| SCNN1A-5845 | - | GGAGGAGUGGGAGAAUG | 17 | 9694 |
| SCNN1A-5846 | - | GGAGCCCUGCAGUCCUG | 17 | 9695 |
| SCNN1A-5847 | + | GGGCCAGGUGAAGCUG | 17 | 9696 |
| SCNN1A-5848 | - | GCCAGAGGCUGGAGCUG | 17 | 9697 |
| SCNN1A-5849 | + | GACAGGCAAGGAGGCUG | 17 | 9698 |
| SCNN1A-5850 | + | GGCGGGGGAGGGGCUG | 17 | 9699 |
| SCNN1A-5851 | - | GGAUAUGUGGGGCAGUG | 17 | 9700 |
| SCNN1A-5852 | - | GGCUCUGUGUGGGAGUG | 17 | 9701 |
| SCNN1A-5853 | + | GGACAGGAUGGCAGGUG | 17 | 9702 |

TABLE 46C-continued

3rd Tier

| gRNA Name | DNA Strand | Targeting Domain | Target Site Length | Seq ID |
|---|---|---|---|---|
| SCNN1A-5854 | + | GGUGGGGGGCAGUGGUG | 17 | 9703 |
| SCNN1A-5855 | - | GCAGGGCCUGGGUUGUG | 17 | 9704 |
| SCNN1A-5856 | - | GCUCCUGGAAGCACACU | 17 | 9705 |
| SCNN1A-5857 | + | GGGGCCCAGGUGAAGCU | 17 | 9706 |
| SCNN1A-5858 | - | GAAGCCACAGACCAGGU | 17 | 9707 |
| SCNN1A-5859 | + | GCUGAGGGCCUGGGU | 17 | 9708 |
| SCNN1A-5860 | - | GAGGAGUGGGAGAAUGU | 17 | 9709 |
| SCNN1A-5861 | - | GAGGGGGAGGAGAGGUU | 17 | 9710 |
| SCNN1A-5862 | + | GCCUUCUGUUUCUCUUU | 17 | 9711 |
| SCNN1A-5863 | - | GAAGGGGGCAGAGACAGAAA | 20 | 9712 |
| SCNN1A-432 | + | GAGUGGAUUGGGGAGAGCAA | 20 | 4281 |
| SCNN1A-5864 | - | GGAAGGGGCAGAGACAGAA | 20 | 9713 |
| SCNN1A-5865 | - | GAGGAAGAAGACCAAAGGAA | 20 | 9714 |
| SCNN1A-5866 | - | GAGACCUUUCACAGAGCCA | 20 | 9715 |
| SCNN1A-9 | - | GCCCUCCACAGUCCACUCCA | 20 | 499 |
| SCNN1A-5867 | - | GCAACUCUGUGACCACAGCA | 20 | 9716 |
| SCNN1A-433 | + | GGAGUGGAUUGGGGAGAGCA | 20 | 4282 |
| SCNN1A-5868 | - | GAGUGAGAGGGGCAAGGCA | 20 | 9717 |
| SCNN1A-5869 | + | GGAAAGGAAGAGGGUGGGCA | 20 | 9718 |
| SCNN1A-5870 | + | GUCUCUGCCCCAGGACUGCA | 20 | 9719 |
| SCNN1A-434 | + | GAGAGCAAGGGUCAGGGUCA | 20 | 4283 |
| SCNN1A-5871 | - | GAGACCCAAAGAGAAACAGA | 20 | 9720 |
| SCNN1A-435 | - | GUUCCAGGGGUGAUGGGAGA | 20 | 4284 |
| SCNN1A-5872 | + | GAAGGAAGGAGGGCUCCCGA | 20 | 9721 |
| SCNN1A-5873 | - | GGAGGAAGAAGACCAAAGGA | 20 | 9722 |
| SCNN1A-5874 | + | GGGGAACCGGGAGGACAGGA | 20 | 9723 |
| SCNN1A-5875 | - | GGAAUCAGCAGGAAAGAGGA | 20 | 9724 |
| SCNN1A-5876 | + | GUGAGCAAGGAGAGAGAGGA | 20 | 9725 |
| SCNN1A-5877 | - | GCUCCAGGAAAGGUGGAGGA | 20 | 9726 |
| SCNN1A-5878 | + | GAAGGACAGAGAGAUAGGGA | 20 | 9727 |
| SCNN1A-5879 | + | GCAGGGAAAGCAGGCACUGA | 20 | 9728 |
| SCNN1A-5880 | - | GGGCCAGAGGCUGGAGCUGA | 20 | 9729 |
| SCNN1A-5881 | + | GGGGACAGGAUGGCAGGUGA | 20 | 9730 |
| SCNN1A-5882 | + | GAGAGCCACCCACACAACCC | 20 | 9731 |
| SCNN1A-5883 | + | GCCUCCAGCUUCCCACUCCC | 20 | 9732 |
| SCNN1A-5884 | - | GGGAGUGAGGGAGGCCUUCC | 20 | 9733 |
| SCNN1A-5885 | + | GGGAGGGGCCCAGGUGAAGC | 20 | 9734 |
| SCNN1A-5886 | + | GGCUGAGGAGGAGUCAGAGC | 20 | 9735 |
| SCNN1A-7 | - | GGGGAACAAGCUGGAGGAGC | 20 | 504 |
| SCNN1A-5887 | + | GGGGCCAAAAGUGCCGGAGC | 20 | 9736 |
| SCNN1A-5888 | - | GUUGGAUUUCAGGCAUGAGC | 20 | 9737 |
| SCNN1A-5889 | - | GGGGGGAGAGGAAGAGAGGC | 20 | 9738 |
| SCNN1A-5890 | + | GGCACUGAGUGAGUAGAGGC | 20 | 9739 |
| SCNN1A-5891 | - | GCUGGCUUGUGGAGGGAGGC | 20 | 9740 |
| SCNN1A-5892 | + | GGUGAAGCUGGGGGCUAGGC | 20 | 9741 |
| SCNN1A-5893 | - | GUGACCACAUUCCUGCACUC | 20 | 9742 |
| SCNN1A-5894 | + | GAGGACAGGAGGGCAGAAAG | 20 | 9743 |
| SCNN1A-5895 | + | GAGGGCAACACAAGGAGAAG | 20 | 9744 |
| SCNN1A-5896 | + | GAAAGAGGGAGACAAUAGAG | 20 | 9745 |
| SCNN1A-5897 | - | GUGGAGGAGGGAGGGAGGAG | 20 | 9746 |
| SCNN1A-5898 | + | GAGAGAUAGGGAUGGAGGAG | 20 | 9747 |
| SCNN1A-5899 | + | GGUGAGCAGGGCGGGGGGAG | 20 | 9748 |
| SCNN1A-5900 | - | GGGCAAGGCAAGGGGGGGAG | 20 | 9749 |
| SCNN1A-436 | - | GGUUCCAGGGGUGAUGGGAG | 20 | 4285 |
| SCNN1A-5901 | - | GCAGAUAGAGAGGGAGUGAG | 20 | 9750 |
| SCNN1A-5902 | + | GGGACAGGAUGGCAGGUGAG | 20 | 9751 |
| SCNN1A-5903 | - | GGAAGAAGACCAAAGGAAGG | 20 | 9752 |
| SCNN1A-5904 | + | GGUGAGCAAGGAGAGAGAGG | 20 | 9753 |
| SCNN1A-5905 | - | GAGGCAGGAUUAGAGAGAGG | 20 | 9754 |
| SCNN1A-5906 | - | GGCUCCAGGAAAGGUGGAGG | 20 | 9755 |
| SCNN1A-5907 | + | GGCGGGGGAGGGGCUGAGG | 20 | 9756 |
| SCNN1A-5908 | - | GCUGCACCUGUCAGGUGAGG | 20 | 9757 |
| SCNN1A-5909 | - | GGGGGCAGAGACAGAAAGGG | 20 | 9758 |
| SCNN1A-5910 | - | GAGAGGGGCAAGGCAAGGG | 20 | 9759 |
| SCNN1A-5911 | - | GAAAGGUGGAGGAGGGAGGG | 20 | 9760 |
| SCNN1A-5912 | - | GUCUGCUGGCUUGUGGAGGG | 20 | 9761 |
| SCNN1A-5913 | - | GCUCUGUGGGGAGUGAGGG | 20 | 9762 |
| SCNN1A-5914 | - | GCACCUGUCAGGUGAGGGG | 20 | 9763 |
| SCNN1A-5915 | + | GGACAGAGAGAUAGGGAUGG | 20 | 9764 |
| SCNN1A-5916 | + | GAGUGAGUAGAGGCAGGUGG | 20 | 9765 |
| SCNN1A-5917 | - | GAGGGAGGAGUGGGAGAAUG | 20 | 9766 |
| SCNN1A-5918 | + | GAGGGCCCAGGUGAAGCUG | 20 | 9767 |
| SCNN1A-5919 | - | GCAGACAGGCAAGGAGGCUG | 20 | 9768 |
| SCNN1A-5920 | + | GGGGGACAGGAUGGCAGGUG | 20 | 9769 |

TABLE 46C-continued

3rd Tier

| gRNA Name | DNA Strand | Targeting Domain | Target Site Length | Seq ID |
|---|---|---|---|---|
| SCNN1A-5921 | + | GCAGGUGGGGGCAGUGGUG | 20 | 9770 |
| SCNN1A-5922 | + | GUCUGUGGCUUCCUCUCUUG | 20 | 9771 |
| SCNN1A-5923 | + | GGAGGGGCCCAGGUGAAGCU | 20 | 9772 |
| SCNN1A-5924 | + | GGGCCAAAAGUGCCGGAGCU | 20 | 9773 |
| SCNN1A-5925 | − | GAGACAGAAAGGGAGGUGCU | 20 | 9774 |
| SCNN1A-5926 | − | GCAGAGAUGACACCUUCUCU | 20 | 9775 |
| SCNN1A-5927 | + | GAGCUAGAGGCUCAGCAAGU | 20 | 9776 |
| SCNN1A-5928 | + | GGCAGGUGGGGGCAGUGGU | 20 | 9777 |
| SCNN1A-5929 | − | GGUGAGGGGGAGGAGAGGUU | 20 | 9778 |
| SCNN1A-437 | − | GUAAGCAAGGGAACCUGGUU | 20 | 4286 |

Table 46D provides exemplary targeting domains for knocking down the SCNN1A gene selected according to the fourth tier parameters. The targeting domains bind within 500 bp (e.g., upstream or downstream) of a transcription start site (TSS). It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene

TABLE 46D

4th Tier

| gRNA Name | DNA Strand | Targeting Domain | Target Site Length | Seq ID |
|---|---|---|---|---|
| SCNN1A-5930 | + | AGAAUCAGACCCAAAAA | 17 | 9779 |
| SCNN1A-5931 | + | AAAGAUUGUCUUUAAAA | 17 | 9780 |
| SCNN1A-5932 | + | CAGGCAAAGAAGAGAAA | 17 | 9781 |
| SCNN1A-5933 | + | UCCUUGGCUCUGUGAAA | 17 | 9782 |
| SCNN1A-5934 | + | CACAAGCCAGCAGACAA | 17 | 9783 |
| SCNN1A-5935 | − | UGGAGGAAGAAGACCAA | 17 | 9784 |
| SCNN1A-5936 | + | UCCAGGAAGGAGAGCAA | 17 | 9785 |
| SCNN1A-438 | + | UGGAUUGGGGAGAGCAA | 17 | 4287 |
| SCNN1A-5937 | + | AAUAGUUUUCAUAUCAA | 17 | 9786 |
| SCNN1A-5938 | − | AGGGGGCAGAGACAGAA | 17 | 9787 |
| SCNN1A-5939 | − | AAUUUCUCCUCCUCCCA | 17 | 9788 |
| SCNN1A-439 | − | UCCAGCUGUCCCUUCCA | 17 | 4288 |
| SCNN1A-5940 | + | CUCCAGGAAGGAGAGCA | 17 | 9789 |
| SCNN1A-5941 | − | UAGAGUGAGAGGGGGCA | 17 | 9790 |
| SCNN1A-440 | − | AGGGUGGGACAUGGGCA | 17 | 4289 |
| SCNN1A-5942 | + | AAGGCGGACUCUGGGCA | 17 | 9791 |
| SCNN1A-5943 | + | AAGGAAGAGGGUGGGCA | 17 | 9792 |
| SCNN1A-5944 | + | UCUGCCCCAGGACUGCA | 17 | 9793 |
| SCNN1A-5945 | − | CUUCUCUCUUCUCUGCA | 17 | 9794 |
| SCNN1A-5946 | + | AAAUAGUUUUCAUAUCA | 17 | 9795 |
| SCNN1A-441 | + | AGCAAGGGUCAGGGUCA | 17 | 4290 |
| SCNN1A-5947 | + | ACAGGAGGGCAGAAAGA | 17 | 9796 |

TABLE 46D-continued

4th Tier

| gRNA Name | DNA Strand | Targeting Domain | Target Site Length | Seq ID |
|---|---|---|---|---|
| SCNN1A-5948 | − | ACCCAAAGAGAAACAGA | 17 | 9797 |
| SCNN1A-5949 | − | CAGAAGGCAGAUAGAGA | 17 | 9798 |
| SCNN1A-443 | − | CCAGGGGUGAUGGGAGA | 17 | 4292 |
| SCNN1A-5950 | + | AGAUCUGAACAAGUAGA | 17 | 9799 |
| SCNN1A-5951 | + | AUAGAGAGGGACAGCGA | 17 | 9800 |
| SCNN1A-5952 | − | AUCAGCAGGAAAGAGGA | 17 | 9801 |
| SCNN1A-5953 | + | AGCAAGGAGAGAGAGGA | 17 | 9802 |
| SCNN1A-5954 | − | CCAGGAAAGGUGGAGGA | 17 | 9803 |
| SCNN1A-5955 | − | CUGAUUUAUCCUUGGGA | 17 | 9804 |
| SCNN1A-155 | + | CUGGAGUGGACUGUGGA | 17 | 652 |
| SCNN1A-5956 | − | UUCUCUGCAGGGCCUGA | 17 | 9805 |
| SCNN1A-5957 | − | CCAGAGGCUGGAGCUGA | 17 | 9806 |
| SCNN1A-5958 | + | UGCAAUACAAUAAGAUA | 17 | 9807 |
| SCNN1A-5959 | + | AAUGCAGCAAAAGGAUA | 17 | 9808 |
| SCNN1A-5960 | + | CCUCUGCUUCCCUGAUA | 17 | 9809 |
| SCNN1A-444 | + | UGGGCUGCAGAGGUCUA | 17 | 4293 |
| SCNN1A-5961 | + | CAAGGAGGCUGGGGGAC | 17 | 9810 |
| SCNN1A-5962 | + | AACCAGGAUUCCAAACC | 17 | 9811 |
| SCNN1A-445 | − | AGGUAAGCAAGGGAACC | 17 | 4294 |
| SCNN1A-5963 | + | CGGGGCUCAGGUGCACC | 17 | 9812 |
| SCNN1A-5964 | − | UAGCCCCCAGCUUCACC | 17 | 9813 |
| SCNN1A-5965 | + | CACUGUGGACACAGACC | 17 | 9814 |
| SCNN1A-5966 | − | AGAGGAAGCCACAGACC | 17 | 9815 |
| SCNN1A-5967 | − | AGGAAAGAGGAGGGACC | 17 | 9816 |
| SCNN1A-5968 | + | AGCCACCCACACAACCC | 17 | 9817 |
| SCNN1A-446 | + | CCCUCUCCCAUCACCCC | 17 | 4295 |
| SCNN1A-151 | + | UUCCCCUUCAUGAGCCC | 17 | 648 |
| SCNN1A-5969 | + | CACGCCUAGACAGGCCC | 17 | 9818 |
| SCNN1A-5970 | + | UCCAGCUUCCCACUCCC | 17 | 9819 |
| SCNN1A-5971 | − | UCACCUGGGCCCCUCCC | 17 | 9820 |
| SCNN1A-5972 | + | ACCUGGAUGUGAAAGCC | 17 | 9821 |
| SCNN1A-5973 | − | UUUGAGAUCAAACAGCC | 17 | 9822 |
| SCNN1A-5974 | + | AGGAGAAGGGGCCAGCC | 17 | 9823 |
| SCNN1A-5975 | − | CCCAGGCCCUCUCAGCC | 17 | 9824 |
| SCNN1A-5976 | + | CUGUUGGCUGCCAGGCC | 17 | 9825 |
| SCNN1A-5977 | − | AUUACACAUUCCUGGCC | 17 | 9826 |
| SCNN1A-5978 | − | AACCUGGUUUGGAAUCC | 17 | 9827 |

TABLE 46D-continued

4th Tier

| gRNA Name | DNA Strand | Targeting Domain | Target Site Length | Seq ID |
|---|---|---|---|---|
| SCNN1A-5979 | − | AGGCAGCCCAGACCUCC | 17 | 9828 |
| SCNN1A-5980 | − | CUGCCCUCCUGUCCUCC | 17 | 9829 |
| SCNN1A-5981 | + | CAGGACUGCAGGGCUCC | 17 | 9830 |
| SCNN1A-5982 | − | CUGGAGCCCUGCAGUCC | 17 | 9831 |
| SCNN1A-5983 | − | AGUGAGGGAGGCCUUCC | 17 | 9832 |
| SCNN1A-5984 | − | CCCCUUGCUCUCCUUCC | 17 | 9833 |
| SCNN1A-5985 | − | CUUUCCCUGCCUCUUCC | 17 | 9834 |
| SCNN1A-5986 | + | CCCUCCUCCACCUUUCC | 17 | 9835 |
| SCNN1A-5987 | − | ACCUGGGAGUGGGAAGC | 17 | 9836 |
| SCNN1A-5988 | + | UGAGGAGGAGUCAGAGC | 17 | 9837 |
| SCNN1A-5989 | − | AGGUCAGGGCCAGAGGC | 17 | 9838 |
| SCNN1A-5990 | + | CAGACAGGCAAGGAGGC | 17 | 9839 |
| SCNN1A-5991 | + | CUGGGGGACAGGAUGGC | 17 | 9840 |
| SCNN1A-5992 | + | CUCUGCCCCAGGACUGC | 17 | 9841 |
| SCNN1A-5993 | − | UCUUCUCUCUUCUCUGC | 17 | 9842 |
| SCNN1A-5994 | − | ACCACAUUCCUGCACUC | 17 | 9843 |
| SCNN1A-5995 | + | AGGGCUGGAGGAGACUC | 17 | 9844 |
| SCNN1A-5996 | + | CCCUCAGCUCCAGCCUC | 17 | 9845 |
| SCNN1A-5997 | − | UGCCUCUUCCUGGGCUC | 17 | 9846 |
| SCNN1A-5998 | + | CAGGGCUCCAGGAGGUC | 17 | 9847 |
| SCNN1A-5999 | − | UGGGCCCCUCCCGGGUC | 17 | 9848 |
| SCNN1A-6000 | + | UCCUGCUCUCCUCUUUC | 17 | 9849 |
| SCNN1A-6001 | − | AGGAAUCAGCAGGAAAG | 17 | 9850 |
| SCNN1A-6002 | + | CCAGGAAGGAGAGCAAG | 17 | 9851 |
| SCNN1A-6003 | − | AGAGGGGCAAGGCAAG | 17 | 9852 |
| SCNN1A-6004 | + | UGCAGAGAAGAGAGAAG | 17 | 9853 |
| SCNN1A-6005 | − | AAGAAGACCAAAGGAAG | 17 | 9854 |
| SCNN1A-6006 | + | AGGCAGGUGGGGGCAG | 17 | 9855 |
| SCNN1A-6007 | + | AGAGGGAGACAAUAGAG | 17 | 9856 |
| SCNN1A-6008 | − | ACAGAAGGCAGAUAGAG | 17 | 9857 |
| SCNN1A-6009 | + | AGCAAAAGGAUAAGGAG | 17 | 9858 |
| SCNN1A-6010 | − | UCAGGGAAGCAGAGGAG | 17 | 9859 |
| SCNN1A-6011 | − | CAGGUGAGGGGAGGAG | 17 | 9860 |
| SCNN1A-6012 | + | AGAUAGGGAUGGAGGAG | 17 | 9861 |
| SCNN1A-448 | − | UCCAGGGUGAUGGGAG | 17 | 4297 |
| SCNN1A-83 | − | UACCAGGUCUCAUGGAG | 17 | 606 |
| SCNN1A-6013 | + | ACAGGAUGGCAGGUGAG | 17 | 9862 |
| SCNN1A-6014 | − | UGCACCUGUCAGGUGAG | 17 | 9863 |

TABLE 46D-continued

4th Tier

| gRNA Name | DNA Strand | Targeting Domain | Target Site Length | Seq ID |
|---|---|---|---|---|
| SCNN1A-6015 | + | AAGCUGGGGCUAGGCG | 17 | 9864 |
| SCNN1A-6016 | + | CAGGAAGGAGAGCAAGG | 17 | 9865 |
| SCNN1A-6017 | + | UACUGGACCUGAGAAGG | 17 | 9866 |
| SCNN1A-6018 | − | AGAAGACCAAAGGAAGG | 17 | 9867 |
| SCNN1A-6019 | − | AAAGAGGAGGGACCAGG | 17 | 9868 |
| SCNN1A-6020 | − | AAUCAGCAGGAAAGAGG | 17 | 9869 |
| SCNN1A-6021 | + | AGACAGGCCCUGGGAGG | 17 | 9870 |
| SCNN1A-6022 | + | AGAGAUAGGGAUGGAGG | 17 | 9871 |
| SCNN1A-6023 | − | UCCAGGAAAGGUGGAGG | 17 | 9872 |
| SCNN1A-6024 | − | CUGGACAAGGUUGGAGG | 17 | 9873 |
| SCNN1A-6025 | + | CUGAGCCCACAGCUAGG | 17 | 9874 |
| SCNN1A-6026 | + | UGAAGCUGGGGCUAGG | 17 | 9875 |
| SCNN1A-6027 | + | AGGAAGGAGAGCAAGGG | 17 | 9876 |
| SCNN1A-6028 | − | AGGGGGCAAGGCAAGGG | 17 | 9877 |
| SCNN1A-6029 | − | AAAUAGAAAAGGCAGGG | 17 | 9878 |
| SCNN1A-6030 | − | AGGUGGAGGAGGGAGGG | 17 | 9879 |
| SCNN1A-6031 | − | UGCUGGCUUGUGGAGGG | 17 | 9880 |
| SCNN1A-6032 | − | CUGUGUGGGAGUGAGGG | 17 | 9881 |
| SCNN1A-6033 | − | CCUGUCAGGUGAGGGGG | 17 | 9882 |
| SCNN1A-6034 | + | CAGAGAGAUAGGGAUGG | 17 | 9883 |
| SCNN1A-6035 | − | UGGGAGUGGGAAGCUGG | 17 | 9884 |
| SCNN1A-6036 | + | ACAGGCAAGGAGGCUGG | 17 | 9885 |
| SCNN1A-6037 | + | CAGGUGGGGGGCAGUGG | 17 | 9886 |
| SCNN1A-6038 | + | UGAGUAGAGGCAGGUGG | 17 | 9887 |
| SCNN1A-154 | + | CCUGGAGUGGACUGUGG | 17 | 651 |
| SCNN1A-6039 | + | CCCAGAGUGCAGGAAUG | 17 | 9888 |
| SCNN1A-6040 | + | AAGGUGCAGGGAGGAUG | 17 | 9889 |
| SCNN1A-153 | + | AGCCCUGGAGUGGACUG | 17 | 650 |
| SCNN1A-6041 | + | UGGAGCCAGCAGACCUG | 17 | 9890 |
| SCNN1A-6042 | − | AGGGUGAGGCUGACCUG | 17 | 9891 |
| SCNN1A-6043 | − | CUUCUCUGCAGGGCCUG | 17 | 9892 |
| SCNN1A-6044 | − | CUCUGGGCUGCCUCCUG | 17 | 9893 |
| SCNN1A-6045 | + | AUUCUCCUCCUCCUCUG | 17 | 9894 |
| SCNN1A-6046 | − | UGCAGGGCCUGAGGGUG | 17 | 9895 |
| SCNN1A-6047 | + | CUGAGAGGGCCUGGGUG | 17 | 9896 |
| SCNN1A-6048 | − | CUGGGCUGCCUCCUGUG | 17 | 9897 |
| SCNN1A-6049 | − | CUUUGUCUGCUGGCUUG | 17 | 9898 |

TABLE 46D-continued

| 4th Tier | | | | |
|---|---|---|---|---|
| gRNA Name | DNA Strand | Targeting Domain | Target Site Length | Seq ID |
| SCNN1A-6050 | + | UUCCCACUCCCAGGUUG | 17 | 9899 |
| SCNN1A-6051 | + | AGGUUAGAAAACAAAAU | 17 | 9900 |
| SCNN1A-449 | − | CCAGGGGCAGCCUCACU | 17 | 4298 |
| SCNN1A-6052 | + | AAGGGCUGGAGGAGACU | 17 | 9901 |
| SCNN1A-6053 | − | UCCUGCAGUGAGCCCCU | 17 | 9902 |
| SCNN1A-450 | + | CUCAUGAUACCUCCCCU | 17 | 4299 |
| SCNN1A-6054 | − | CCCAGUUCACCUGCCCU | 17 | 9903 |
| SCNN1A-6055 | + | CCAGGCUGAGAGGGCCU | 17 | 9904 |
| SCNN1A-6056 | − | UGGAGCCCUGCAGUCCU | 17 | 9905 |
| SCNN1A-6057 | − | AAAGAACAGAAUGUCCU | 17 | 9906 |
| SCNN1A-6058 | − | UUUCCUGCCUCUUCCU | 17 | 9907 |
| SCNN1A-6059 | + | AGACAGGCAAGGAGGCU | 17 | 9908 |
| SCNN1A-6060 | + | AGGUGAAGCUGGGGGCU | 17 | 9909 |
| SCNN1A-6061 | − | ACAGAAAGGGAGGUGCU | 17 | 9910 |
| SCNN1A-6062 | + | UCUGCUCUCUGGGUGCU | 17 | 9911 |
| SCNN1A-6063 | + | AAUUCUCCUCCUCCCUCU | 17 | 9912 |
| SCNN1A-6064 | − | CCUCCCAGGGCCUGUCU | 17 | 9913 |
| SCNN1A-6065 | − | AGGAGGGAGGGAGGAGU | 17 | 9914 |
| SCNN1A-6066 | + | CUGGAAAGGAAGAGGGU | 17 | 9915 |
| SCNN1A-6067 | + | AGGUGGGGGGCAGUGGU | 17 | 9916 |
| SCNN1A-6068 | − | CAGGGCCUGGGUUGUGU | 17 | 9917 |
| SCNN1A-6069 | − | AAAACUGAUUUAUCCUU | 17 | 9918 |
| SCNN1A-6070 | + | UCUCUGCCCCCUUCCUU | 17 | 9919 |
| SCNN1A-6071 | + | UGCCUUCUGUUUCUCUU | 17 | 9920 |
| SCNN1A-6072 | − | AGUUUGGAAAGAGAUUU | 17 | 9921 |
| SCNN1A-6073 | + | CAGAGAAUCAGACCCAAAAA | 20 | 9922 |
| SCNN1A-6074 | + | UUAAAAGAUUGUCUUUAAAA | 20 | 9923 |
| SCNN1A-6075 | + | UCCAAACUUAAUGCAGCAAA | 20 | 9924 |
| SCNN1A-6076 | + | UAGCAGGCAAAGAAGAGAAA | 20 | 9925 |
| SCNN1A-6077 | − | AGUCUGUCUCAGGAAGUAAA | 20 | 9926 |
| SCNN1A-6078 | + | CUCCACAAGCCAGCAGACAA | 20 | 9927 |
| SCNN1A-6079 | − | AGUGAGAGGGGGCAAGGCAA | 20 | 9928 |
| SCNN1A-451 | − | UCCACUCCGGGGCUCAUGAA | 20 | 4300 |
| SCNN1A-6080 | − | ACGAAUUUCUCCUCCUCCCA | 20 | 9929 |
| SCNN1A-6081 | + | ACCACUAGCUUAAGGCAGCA | 20 | 9930 |
| SCNN1A-452 | − | CGCAGGGUGGGACAUGGGCA | 20 | 4301 |
| SCNN1A-6082 | − | CCUCUUCUCUCUUCUCUGCA | 20 | 9931 |
| SCNN1A-6083 | + | UACUUCCUGAGACAGACUCA | 20 | 9932 |

TABLE 46D-continued

4th Tier

| gRNA Name | DNA Strand | Targeting Domain | Target Site Length | Seq ID |
|---|---|---|---|---|
| SCNN1A-6084 | − | CAGGACACAGCUCGAGGUCA | 20 | 9933 |
| SCNN1A-6085 | + | AGGACAGGAGGGCAGAAAGA | 20 | 9934 |
| SCNN1A-6086 | + | UCAGGAAGCCUUCCCAGAGA | 20 | 9935 |
| SCNN1A-6087 | + | AAAGAGGGAGACAAUAGAGA | 20 | 9936 |
| SCNN1A-6088 | − | AAACAGAAGGCAGAUAGAGA | 20 | 9937 |
| SCNN1A-6089 | + | AGGAGGGCAACACAAGGAGA | 20 | 9938 |
| SCNN1A-6090 | + | AGGGGCCAGCCAGGCUGAGA | 20 | 9939 |
| SCNN1A-6091 | + | CAGUGGUGGGGCAAAUAGA | 20 | 9940 |
| SCNN1A-6092 | + | CAAAGAUCUGAACAAGUAGA | 20 | 9941 |
| SCNN1A-6093 | + | AAGGAGGCUGGGGGACAGGA | 20 | 9942 |
| SCNN1A-6094 | + | AGAGAGAUAGGGAUGGAGGA | 20 | 9943 |
| SCNN1A-6095 | − | CAGGAAAGGUGGAGGAGGGA | 20 | 9944 |
| SCNN1A-6096 | + | AGGUGAGCAGGGCGGGGGA | 20 | 9945 |
| SCNN1A-6097 | + | CAGCGAAGGACAGAGAGAUA | 20 | 9946 |
| SCNN1A-6098 | + | CUUAAUGCAGCAAAAGGAUA | 20 | 9947 |
| SCNN1A-6099 | + | CCAAGGGCUAGGGGAGCCUA | 20 | 9948 |
| SCNN1A-6100 | − | AAAAAGAACAGAAUGUCCUA | 20 | 9949 |
| SCNN1A-6101 | + | AGAGGGCCUGGGUGGGGAAC | 20 | 9950 |
| SCNN1A-6102 | + | AGGCAAGGAGGCUGGGGGAC | 20 | 9951 |
| SCNN1A-6103 | + | UCUCCUCCCCCUCACCUGAC | 20 | 9952 |
| SCNN1A-6104 | − | AAGAGAGGAAGCCACAGACC | 20 | 9953 |
| SCNN1A-77 | + | UUGUUCCCCUCCAUGAGACC | 20 | 603 |
| SCNN1A-6105 | + | CAAUAAGGUGCUCAGCACCC | 20 | 9954 |
| SCNN1A-72 | + | UUGUUCCCCUUCAUGAGCCC | 20 | 599 |
| SCNN1A-6106 | + | UCCAGACCCGGGAGGGGCCC | 20 | 9955 |
| SCNN1A-6107 | + | UGCACCUGGAUGUGAAAGCC | 20 | 9956 |
| SCNN1A-6108 | − | CCACCCAGGCCCUCUCAGCC | 20 | 9957 |
| SCNN1A-6109 | + | AGCCCGCCCGCUGGCCGGCC | 20 | 9958 |
| SCNN1A-6110 | + | CCAGCCAGGCUGAGAGGGCC | 20 | 9959 |
| SCNN1A-6111 | + | UCCUUUGGUCUUCUUCCUCC | 20 | 9960 |
| SCNN1A-6112 | + | CCCCAGGACUGCAGGGCUCC | 20 | 9961 |
| SCNN1A-6113 | − | CCUGCCUCUUCCUGGGCUCC | 20 | 9962 |
| SCNN1A-6114 | − | CUCCUGGAGCCCUGCAGUCC | 20 | 9963 |
| SCNN1A-6115 | − | CUGCUUUCCCUGCCUCUUCC | 20 | 9964 |
| SCNN1A-6116 | + | CCUCCCUCCUCCACCUUUCC | 20 | 9965 |
| SCNN1A-6117 | + | CAGGAAGAGGCAGGGAAAGC | 20 | 9966 |
| SCNN1A-6118 | + | CGACUUCUUAAAGUGAAAGC | 20 | 9967 |

TABLE 46D-continued

4th Tier

| gRNA Name | DNA Strand | Targeting Domain | Target Site Length | Seq ID |
|---|---|---|---|---|
| SCNN1A-6119 | - | CAGGCCAGAAAGAGGAGAGC | 20 | 9968 |
| SCNN1A-6120 | + | AGGGAGGAUGUGGCCAGCGC | 20 | 9969 |
| SCNN1A-6121 | - | AGCUGGCAAAUAGAAAAGGC | 20 | 9970 |
| SCNN1A-6122 | + | CCCGGAGCCCAGGAAGAGGC | 20 | 9971 |
| SCNN1A-6123 | - | AUAGAGAGGGAGUGAGAGGC | 20 | 9972 |
| SCNN1A-6124 | - | CAGGAUUAGAGAGAGGAGGC | 20 | 9973 |
| SCNN1A-6125 | + | AGGCUGGGGGACAGGAUGGC | 20 | 9974 |
| SCNN1A-6126 | - | CCAGGCCCUCUCAGCCUGGC | 20 | 9975 |
| SCNN1A-6127 | + | UGGGGAGCCCGCCCGCUGGC | 20 | 9976 |
| SCNN1A-6128 | + | UGUCUCUGCCCCAGGACUGC | 20 | 9977 |
| SCNN1A-6129 | - | ACCUCUUCUCUCUUCUCUGC | 20 | 9978 |
| SCNN1A-6130 | + | CAGGAGGCAGCCCAGAGUGC | 20 | 9979 |
| SCNN1A-6131 | - | AGACAGACUCCCUUUGGUGC | 20 | 9980 |
| SCNN1A-6132 | - | CUCCCAGUUCACCUGCCCUC | 20 | 9981 |
| SCNN1A-6133 | + | AGGCCCUCAGCUCCAGCCUC | 20 | 9982 |
| SCNN1A-6134 | + | UCAGAAUUCUCCUCCUCCUC | 20 | 9983 |
| SCNN1A-6135 | - | CCCUGCCUCUUCCUGGGCUC | 20 | 9984 |
| SCNN1A-6136 | + | CUGCAGGGCUCCAGGAGGUC | 20 | 9985 |
| SCNN1A-6137 | - | ACCUGGGCCCCUCCCGGGUC | 20 | 9986 |
| SCNN1A-6138 | + | CUCUCCUGCUCUCCUCUUUC | 20 | 9987 |
| SCNN1A-6139 | - | AGAGGAGGCAGGCCAGAAAG | 20 | 9988 |
| SCNN1A-6140 | + | UCUCCAGGAAGGAGAGCAAG | 20 | 9989 |
| SCNN1A-6141 | + | CCCUGCAGAGAAGAGAGAAG | 20 | 9990 |
| SCNN1A-6142 | - | AGGAAGAAGACCAAAGGAAG | 20 | 9991 |
| SCNN1A-453 | - | CCACUCCGGGGCUCAUGAAG | 20 | 4302 |
| SCNN1A-6143 | + | UAGAGGCAGGUGGGGGGCAG | 20 | 9992 |
| SCNN1A-6144 | + | CCCUCACCUGACAGGUGCAG | 20 | 9993 |
| SCNN1A-6145 | - | CAAGGGGGGAGAGGAAGAG | 20 | 9994 |
| SCNN1A-6146 | + | AGUGGUGAGCAAGGAGAGAG | 20 | 9995 |
| SCNN1A-6147 | - | AGAGAGGCAGGAUUAGAGAG | 20 | 9996 |
| SCNN1A-6148 | - | CUAUCAGGGAAGCAGAGGAG | 20 | 9997 |
| SCNN1A-6149 | - | UGUCAGGUGAGGGGGAGGAG | 20 | 9998 |
| SCNN1A-454 | + | CCCCUUCAUGAGCCCCGGAG | 20 | 4303 |
| SCNN1A-6150 | - | UCUGCUGGCUCCAGGAAAGG | 20 | 9999 |
| SCNN1A-6151 | + | CUCCAGGAAGGAGAGCAAGG | 20 | 10000 |
| SCNN1A-6152 | - | UGAGAGGGGGCAAGGCAAGG | 20 | 10001 |
| SCNN1A-6153 | - | AGGAAAGAGGAGGGACCAGG | 20 | 10002 |
| SCNN1A-6154 | + | CAGGACUGCAGGGCUCCAGG | 20 | 10003 |

TABLE 46D-continued

4th Tier

| gRNA Name | DNA Strand | Targeting Domain | Target Site Length | Seq ID |
|---|---|---|---|---|
| SCNN1A-6155 | - | AGGAAUCAGCAGGAAAGAGG | 20 | 10004 |
| SCNN1A-6156 | - | AAAGAGGAGGGACCAGGAGG | 20 | 10005 |
| SCNN1A-6157 | + | CCUAGACAGGCCCUGGGAGG | 20 | 10006 |
| SCNN1A-6158 | + | CAGAGAGAUAGGGAUGGAGG | 20 | 10007 |
| SCNN1A-6159 | + | UCCAGGAAGGAGAGCAAGGG | 20 | 10008 |
| SCNN1A-6160 | + | UCAAUUAAAGGUGAGCAGGG | 20 | 10009 |
| SCNN1A-6161 | + | AGCGCUGGAAAGGAAGAGGG | 20 | 10010 |
| SCNN1A-6162 | - | CCAGGAAAGGUGGAGGAGGG | 20 | 10011 |
| SCNN1A-6163 | - | AGAGGGGCAAGGCAAGGGG | 20 | 10012 |
| SCNN1A-6164 | + | AAGGUGAGCAGGGCGGGGGG | 20 | 10013 |
| SCNN1A-6165 | + | CCAGGCUGAGAGGGCCUGGG | 20 | 10014 |
| SCNN1A-6166 | + | AGUGAGUAGAGGCAGGUGGG | 20 | 10015 |
| SCNN1A-6167 | - | CAGGGCCUGGGUUGUGUGGG | 20 | 10016 |
| SCNN1A-455 | - | CAUGAAGGGGAACAAGCUGG | 20 | 4304 |
| SCNN1A-6 | - | CAUGGAGGGGAACAAGCUGG | 20 | 558 |
| SCNN1A-6168 | - | ACCUGGGAGUGGGAAGCUGG | 20 | 10017 |
| SCNN1A-6169 | + | AGGGGCCCAGGUGAAGCUGG | 20 | 10018 |
| SCNN1A-6170 | + | CAGACAGGCAAGGAGGCUGG | 20 | 10019 |
| SCNN1A-6171 | + | AGGCAGGUGGGGGCAGUGG | 20 | 10020 |
| SCNN1A-6172 | + | CAGGUGGGGGCAGUGGUGG | 20 | 10021 |
| SCNN1A-6173 | + | CAGCCCAGAGUGCAGGAAUG | 20 | 10022 |
| SCNN1A-6174 | - | CCUGGAGCCCUGCAGUCCUG | 20 | 10023 |
| SCNN1A-6175 | - | AGGGCCAGAGGCUGGAGCUG | 20 | 10024 |
| SCNN1A-6176 | + | CAGGGCGGGGGAGGGGCUG | 20 | 10025 |
| SCNN1A-6177 | + | AGGCUGAGAGGGCCUGGGUG | 20 | 10026 |
| SCNN1A-6178 | + | AGCUUCCCACUCCCAGGUUG | 20 | 10027 |
| SCNN1A-6179 | + | ACUUCCUGAGACAGACUCAU | 20 | 10028 |
| SCNN1A-456 | - | UGGCCAGGGGCAGCCUCACU | 20 | 4305 |
| SCNN1A-457 | + | CUGCUCAUGAUACCUCCCCU | 20 | 4306 |
| SCNN1A-6180 | + | CAGCCAGGCUGAGAGGGCCU | 20 | 10029 |
| SCNN1A-6181 | - | UCAGAAAACUGAUUUAUCCU | 20 | 10030 |
| SCNN1A-6182 | - | AAAAAAGAACAGAAUGUCCU | 20 | 10031 |
| SCNN1A-6183 | - | UGCUUUCCCUGCCUCUUCCU | 20 | 10032 |
| SCNN1A-6184 | + | CCCAGGUGAAGCUGGGGGCU | 20 | 10033 |
| SCNN1A-6185 | + | CAGAAUUCUCCUCCUCCUCU | 20 | 10034 |
| SCNN1A-6186 | - | CCUCCUCCCAGGGCCUGUCU | 20 | 10035 |
| SCNN1A-6187 | - | UGGAGGAGGGAGGGAGGAGU | 20 | 10036 |

TABLE 46D-continued

4th Tier

| gRNA Name | DNA Strand | Targeting Domain | Target Site Length | Seq ID |
|---|---|---|---|---|
| SCNN1A-6188 | + | CAGGCUGAGAGGGCCUGGGU | 20 | 10037 |
| SCNN1A-6189 | − | CAGAAAACUGAUUUAUCCUU | 20 | 10038 |
| SCNN1A-6190 | + | CUGUCUCUGCCCCCUUCCUU | 20 | 10039 |
| SCNN1A-6191 | + | AUCUGCCUUCUGUUUCUCUU | 20 | 10040 |
| SCNN1A-6192 | + | UCUGCCUUCUGUUUCUCUUU | 20 | 10041 |

Table 46E provides exemplary targeting domains for knocking down the SCNN1A gene selected according to the fifth tier parameters. The targeting domains bind within the additional 500 bp (e.g., upstream or downstream) of a transcription start site (TSS), e.g., extending to 1 kb upstream and downstream of a TSS. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 46E

5th Tier

| gRNA Name | DNA Strand | Targeting Domain | Target Site Length | Seq ID |
|---|---|---|---|---|
| SCNN1A-6193 | − | GAAAAUAAAAGCAAAAA | 17 | 10042 |
| SCNN1A-6194 | − | AAAGAUCAUCUUUAAAA | 17 | 10043 |
| SCNN1A-6195 | + | UCCUUUCCCUCCCCAAA | 17 | 10044 |
| SCNN1A-6196 | + | GUCUGGGCUGAGCCAAA | 17 | 10045 |
| SCNN1A-6197 | + | UUCCUUUCCCUCCCCAA | 17 | 10046 |
| SCNN1A-6198 | + | GGUCUGGGCUGAGCCAA | 17 | 10047 |
| SCNN1A-125 | + | CCAGUACAUCAUGCCAA | 17 | 632 |
| SCNN1A-6199 | − | UUGGGGAGGGAAAGGAA | 17 | 10048 |
| SCNN1A-6200 | + | GCGCAGGCACCAGGGAA | 17 | 10049 |
| SCNN1A-6201 | − | CCCCUUUGGGGAGGGAA | 17 | 10050 |
| SCNN1A-6202 | − | GGUGCCUGCGCCUGGAA | 17 | 10051 |
| SCNN1A-90 | − | ACUCCAGGGCUCAUGAA | 17 | 611 |
| SCNN1A-6203 | − | UACAUGUAAGUUUAUAA | 17 | 10052 |
| SCNN1A-6204 | − | GAAAGGAAGGGGACUAA | 17 | 10053 |
| SCNN1A-6205 | + | GAGCUCUACCUGGGACA | 17 | 10054 |
| SCNN1A-6206 | + | UCCAGGCGCAGGCACCA | 17 | 10055 |
| SCNN1A-99 | − | GGCGCCCCAGCAGCCCA | 17 | 536 |
| SCNN1A-104 | − | AACAACACCACCAUCCA | 17 | 617 |
| SCNN1A-88 | − | CUCCACAGUCCACUCCA | 17 | 609 |
| SCNN1A-6207 | − | CCUGGAAGGGUGGUCCA | 17 | 10056 |
| SCNN1A-94 | − | AACAAGCGUGAGGAGCA | 17 | 613 |
| SCNN1A-6208 | − | GAAACAUACCUAUAGCA | 17 | 10057 |
| SCNN1A-6209 | − | CCCGGCAGGACGUGGCA | 17 | 10058 |

TABLE 46E-continued

5th Tier

| gRNA Name | DNA Strand | Targeting Domain | Target Site Length | Seq ID |
|---|---|---|---|---|
| SCNN1A-141 | + | GCGGUGGAACUCGAUCA | 17 | 551 |
| SCNN1A-106 | − | GCACAACCGCAUGAAGA | 17 | 540 |
| SCNN1A-126 | + | CCACAGCACUGCCCAGA | 17 | 633 |
| SCNN1A-442 | + | ACCAGGGAAGGGGCAGA | 17 | 4291 |
| SCNN1A-115 | + | GGGAUUGAGGGUGCAGA | 17 | 542 |
| SCNN1A-6210 | − | UUUGGGGAGGGAAAGGA | 17 | 10059 |
| SCNN1A-132 | + | GGAGCACACCAGGCGGA | 17 | 547 |
| SCNN1A-6211 | + | GGCGCAGGCACCAGGGA | 17 | 10060 |
| SCNN1A-6212 | − | UGGCUCCCCUUUGGGGA | 17 | 10061 |
| SCNN1A-6213 | − | UGGUGCCUGCGCCUGGA | 17 | 10062 |
| SCNN1A-134 | + | GCGGAUGGCGCCGUGGA | 17 | 548 |
| SCNN1A-155 | + | CUGGAGUGGACUGUGGA | 17 | 652 |
| SCNN1A-89 | − | CACUCCAGGGCUCAUGA | 17 | 610 |
| SCNN1A-6214 | − | CAGAGCCUCAGACCUGA | 17 | 10063 |
| SCNN1A-121 | + | GUUGAUGUUGAGGCUGA | 17 | 545 |
| SCNN1A-367 | + | CGACCUGUAGGGAUUGA | 17 | 4216 |
| SCNN1A-6215 | − | GGAAAGGAAGGGGACUA | 17 | 10064 |
| SCNN1A-6216 | + | CCACGUCCUGCCGGGUA | 17 | 10065 |
| SCNN1A-331 | + | GGACUAACCGACCUGUA | 17 | 4180 |
| SCNN1A-6217 | − | GACAGAUAUACAAAUUA | 17 | 10066 |
| SCNN1A-6218 | + | CUGGAGCGGGCUAGAAC | 17 | 10067 |
| SCNN1A-6219 | − | GGUGCUGAGGUGCUCAC | 17 | 10068 |
| SCNN1A-6220 | + | UUAUUUAUCUUAGAGAC | 17 | 10069 |
| SCNN1A-6221 | + | UGAGCUCUACCUGGGAC | 17 | 10070 |
| SCNN1A-122 | + | UUGAUGUUGAGGCUGAC | 17 | 629 |
| SCNN1A-332 | − | GCACCCUCAAUCCCUAC | 17 | 4181 |
| SCNN1A-111 | − | CCUUUGGCAUGAUGUAC | 17 | 622 |
| SCNN1A-130 | + | UGUGCUGGGAGCACACC | 17 | 637 |
| SCNN1A-6222 | + | UUCCAGGCGCAGGCACC | 17 | 10071 |
| SCNN1A-6223 | − | UUGGCUCAGCCCAGACC | 17 | 10072 |
| SCNN1A-6224 | + | AAUAGAAAUCUGAGACC | 17 | 10073 |
| SCNN1A-6225 | + | CUGCAGCAUUCUAGACC | 17 | 10074 |
| SCNN1A-6226 | − | AUUGCCACUCCCAUACC | 17 | 10075 |
| SCNN1A-6227 | + | CAGCAGUGAGCUCUACC | 17 | 10076 |
| SCNN1A-6228 | + | UGAGCACCUCAGCACCC | 17 | 10077 |
| SCNN1A-151 | + | UUCCCCUUCAUGAGCCC | 17 | 648 |
| SCNN1A-6229 | − | ACUGACACCCCUGUCCC | 17 | 10078 |

TABLE 46E-continued

| 5th Tier | | | | |
|---|---|---|---|---|
| gRNA Name | DNA Strand | Targeting Domain | Target Site Length | Seq ID |
| SCNN1A-447 | − | UCCCUCUGCCCCUUCCC | 17 | 4296 |
| SCNN1A-105 | − | CCACGGCGCCAUCCGCC | 17 | 618 |
| SCNN1A-6230 | − | UCCCUGGUGCCUGCGCC | 17 | 10079 |
| SCNN1A-5364 | + | AGAAGAAUUGCAAUGCC | 17 | 9213 |
| SCNN1A-6231 | + | CCCUGCCACGUCCUGCC | 17 | 10080 |
| SCNN1A-87 | − | CCUCCACAGUCCACUCC | 17 | 608 |
| SCNN1A-6232 | − | CUGUUCUAGCCCGCUCC | 17 | 10081 |
| SCNN1A-6233 | − | ACUUCUGACCAAAGUCC | 17 | 10082 |
| SCNN1A-6234 | − | GCCUGGAAGGGUGGUCC | 17 | 10083 |
| SCNN1A-6235 | + | CCCUGGACCACCCUUCC | 17 | 10084 |
| SCNN1A-124 | + | AGUACUCUCCGAAAAGC | 17 | 631 |
| SCNN1A-93 | − | GAACAAGCGUGAGGAGC | 17 | 533 |
| SCNN1A-6236 | + | CAUUCUAGACCUGGAGC | 17 | 10085 |
| SCNN1A-147 | + | GGCUGCUGGGGCGCCGC | 17 | 554 |
| SCNN1A-6237 | + | ACCACCCUUCCAGGCGC | 17 | 10086 |
| SCNN1A-6238 | + | UGCACUAUCCUCUAGGC | 17 | 10087 |
| SCNN1A-6239 | − | CCACUCCCAUACCCGGC | 17 | 10088 |
| SCNN1A-96 | − | GCGUGAGGAGCAGGGGC | 17 | 534 |
| SCNN1A-6240 | − | UGAGGUGCUCACUGGGC | 17 | 10089 |
| SCNN1A-6241 | − | ACCCGGCAGGACGUGGC | 17 | 10090 |
| SCNN1A-6242 | − | CAGGUAGAGCUCACUGC | 17 | 10091 |
| SCNN1A-117 | + | GUGCAGAUGGUCACUGC | 17 | 544 |
| SCNN1A-6243 | + | ACCCUGCCACGUCCUGC | 17 | 10092 |
| SCNN1A-144 | + | CCUCCGCCGUGGGCUGC | 17 | 643 |
| SCNN1A-128 | + | UCUUCAUGCGGUUGUGC | 17 | 635 |
| SCNN1A-140 | + | AGCGGUGGAACUCGAUC | 17 | 642 |
| SCNN1A-6244 | + | UGUCAGUUCCCACCCUC | 17 | 10093 |
| SCNN1A-5415 | + | AAUUGCAAUGCCUGGUC | 17 | 9264 |
| SCNN1A-107 | − | GCAUGAAGACGGCCUUC | 17 | 541 |
| SCNN1A-149 | + | UGGGGCGCCGCAGGUUC | 17 | 647 |
| SCNN1A-6245 | + | CCUUUCCCUCCCCAAAG | 17 | 10094 |
| SCNN1A-6246 | − | UGGGGAGGGAAAGGAAG | 17 | 10095 |
| SCNN1A-6247 | + | CGCAGGCACCAGGGAAG | 17 | 10096 |
| SCNN1A-91 | − | CUCCAGGGCUCAUGAAG | 17 | 612 |
| SCNN1A-6248 | + | AGCUCUACCUGGGACAG | 17 | 10097 |
| SCNN1A-95 | − | ACAAGCGUGAGGAGCAG | 17 | 614 |
| SCNN1A-6249 | + | CACCAGGGAAGGGGCAG | 17 | 10098 |
| SCNN1A-138 | + | AGAGCUCUCGGUAGGAG | 17 | 641 |

TABLE 46E-continued

5th Tier

| gRNA Name | DNA Strand | Targeting Domain | Target Site Length | Seq ID |
|---|---|---|---|---|
| SCNN1A-6250 | + | CCUGCCGGGUAUGGGAG | 17 | 10099 |
| SCNN1A-6251 | + | GCAUUCUAGACCUGGAG | 17 | 10100 |
| SCNN1A-152 | + | CUUCAUGAGCCCUGGAG | 17 | 649 |
| SCNN1A-6252 | − | GCUGUACUCCAGCCUAG | 17 | 10101 |
| SCNN1A-6253 | − | CCAUACCCGGCAGGACG | 17 | 10102 |
| SCNN1A-123 | + | UGAUGUUGAGGCUGACG | 17 | 630 |
| SCNN1A-142 | + | GGCCUCCUCCUCCGCCG | 17 | 552 |
| SCNN1A-133 | + | CCAGGCGGAUGGCGCCG | 17 | 638 |
| SCNN1A-118 | + | UGCAGAUGGUCACUGCG | 17 | 626 |
| SCNN1A-150 | + | GGGGCGCCGCAGGUUCG | 17 | 555 |
| SCNN1A-131 | + | GCUGGGAGCACACCAGG | 17 | 546 |
| SCNN1A-103 | − | GCCCACGGCGGAGGAGG | 17 | 539 |
| SCNN1A-102 | − | GCAGCCCACGGCGGAGG | 17 | 538 |
| SCNN1A-100 | − | GCCCCAGCAGCCCACGG | 17 | 537 |
| SCNN1A-139 | + | GCUCUCGGUAGGAGCGG | 17 | 550 |
| SCNN1A-101 | − | CCAGCAGCCCACGGCGG | 17 | 616 |
| SCNN1A-6254 | + | UGGGCUGAGCCAAAGGG | 17 | 10103 |
| SCNN1A-6255 | − | GCCUGCGCCUGGAAGGG | 17 | 10104 |
| SCNN1A-6256 | − | AGCCUCAGACCUGAGGG | 17 | 10105 |
| SCNN1A-6257 | − | GUGGCUCCCCUUUGGGG | 17 | 10106 |
| SCNN1A-135 | + | GAUGGCGCCGUGGAUGG | 17 | 549 |
| SCNN1A-6258 | − | AGAUAUACAAAUUAUGG | 17 | 10107 |
| SCNN1A-154 | + | CCUGGAGUGGACUGUGG | 17 | 651 |
| SCNN1A-127 | + | AGAAGGCCGUCUUCAUG | 17 | 634 |
| SCNN1A-116 | + | GGUGCAGAUGGUCACUG | 17 | 543 |
| SCNN1A-153 | + | AGCCCUGGAGUGGACUG | 17 | 650 |
| SCNN1A-98 | − | GCUGGGCCCCGAACCUG | 17 | 535 |
| SCNN1A-6259 | − | GCAGAGCCUCAGACCUG | 17 | 10108 |
| SCNN1A-146 | + | UCCGCCGUGGGCUGCUG | 17 | 645 |
| SCNN1A-109 | − | CCUUCUGGGCAGUGCUG | 17 | 620 |
| SCNN1A-6260 | − | GGUGGUCCAGGGUGCUG | 17 | 10109 |
| SCNN1A-6261 | + | UCCCACCCUCAGGUCUG | 17 | 10110 |
| SCNN1A-92 | − | GAAGGGGAACAAGCGUG | 17 | 532 |
| SCNN1A-6262 | + | ACAGGCUUGGUGUUGUG | 17 | 10111 |
| SCNN1A-386 | + | CCGACCUGUAGGGAUUG | 17 | 4235 |
| SCNN1A-119 | + | CGAGCUUGUCCAGUUG | 17 | 627 |
| SCNN1A-120 | + | AGUUGAGGUUGAUGUUG | 17 | 628 |

TABLE 46E-continued

5th Tier

| gRNA Name | DNA Strand | Targeting Domain | Target Site Length | Seq ID |
|---|---|---|---|---|
| SCNN1A-6263 | - | AUGGUGGCUCCCCUUUG | 17 | 10112 |
| SCNN1A-6264 | + | GACAGAGACCAUGCUAU | 17 | 10113 |
| SCNN1A-6265 | + | CACGUCCUGCCGGGUAU | 17 | 10114 |
| SCNN1A-114 | - | CAACAUCAACCUCAACU | 17 | 625 |
| SCNN1A-6266 | - | UAGAAUGCUGCAGCACU | 17 | 10115 |
| SCNN1A-6267 | - | GUGCUGAGGUGCUCACU | 17 | 10116 |
| SCNN1A-6268 | + | AGCAGUGAGCUCUACCU | 17 | 10117 |
| SCNN1A-6269 | + | GCGGGCUAGAACAGGCU | 17 | 10118 |
| SCNN1A-97 | - | CGUGAGGAGCAGGGGCU | 17 | 615 |
| SCNN1A-145 | + | CUCCGCCGUGGGCUGCU | 17 | 644 |
| SCNN1A-129 | + | CUUCAUGCGGUUGUGCU | 17 | 636 |
| SCNN1A-6270 | + | AUCAUGCACUAUCCUCU | 17 | 10119 |
| SCNN1A-136 | + | AGAACUCGAAGAGCUCU | 17 | 639 |
| SCNN1A-6271 | + | AUUGCAAUGCCUGGUCU | 17 | 10120 |
| SCNN1A-108 | - | CAUGAAGACGGCCUUCU | 17 | 619 |
| SCNN1A-143 | + | GCCUCCUCCUCCGCCGU | 17 | 553 |
| SCNN1A-391 | - | CCUCAAUCCCUACAGGU | 17 | 4240 |
| SCNN1A-137 | + | CUCGAAGAGCUCUCGGU | 17 | 640 |
| SCNN1A-6272 | - | GCCUCAGACCUGAGGGU | 17 | 10121 |
| SCNN1A-338 | + | GGGACUAACCGACCUGU | 17 | 4187 |
| SCNN1A-112 | - | AUGAUGUACUGGCAAUU | 17 | 623 |
| SCNN1A-6273 | + | AUCUGAGACCUGGACUU | 17 | 10122 |
| SCNN1A-110 | - | CUGUGGCUCUGCACCUU | 17 | 621 |
| SCNN1A-6274 | - | GCAGGGUCACCACCCUU | 17 | 10123 |
| SCNN1A-6275 | - | UUAUGGUGGCUCCCCUU | 17 | 10124 |
| SCNN1A-148 | + | CUGGGGCGCCGCAGGUU | 17 | 646 |
| SCNN1A-6276 | - | UAUGGUGGCUCCCCUUU | 17 | 10125 |
| SCNN1A-113 | - | CAAUUCGGCCUGCUUUU | 17 | 624 |
| SCNN1A-6277 | - | UAAGAAAUAAAAGCAAAAA | 20 | 10126 |
| SCNN1A-6278 | - | UUAAAAGAUCAUCUUUAAAA | 20 | 10127 |
| SCNN1A-6279 | + | CCUUCCUUUCCCUCCCCAAA | 20 | 10128 |
| SCNN1A-6280 | + | CUGGUCUGGGCUGAGCCAAA | 20 | 10129 |
| SCNN1A-6281 | + | CCCUUCCUUUCCCUCCCCAA | 20 | 10130 |
| SCNN1A-6282 | + | CCUGGUCUGGGCUGAGCCAA | 20 | 10131 |
| SCNN1A-46 | + | UUGCCAGUACAUCAUGCCAA | 20 | 580 |
| SCNN1A-6283 | - | CCUUUGGGAGGGAAAGGAA | 20 | 10132 |
| SCNN1A-6284 | + | CAGGCGCAGGCACCAGGGAA | 20 | 10133 |
| SCNN1A-6285 | - | GCUCCCCUUUGGGGAGGGAA | 20 | 10134 |

TABLE 46E-continued

| | | 5th Tier | | |
|---|---|---|---|---|
| gRNA Name | DNA Strand | Targeting Domain | Target Site Length | Seq ID |
| SCNN1A-6286 | − | CCUGGUGCCUGCGCCUGGAA | 20 | 10135 |
| SCNN1A-11 | − | UCCACUCCAGGGCUCAUGAA | 20 | 560 |
| SCNN1A-6287 | − | AAAUACAUGUAAGUUUAUAA | 20 | 10136 |
| SCNN1A-6288 | − | AGGGAAAGGAAGGGGACUAA | 20 | 10137 |
| SCNN1A-6289 | + | AGUGAGCUCUACCUGGGACA | 20 | 10138 |
| SCNN1A-6290 | + | CCUUCCAGGCGCAGGCACCA | 20 | 10139 |
| SCNN1A-20 | − | UGCGGCGCCCCAGCAGCCCA | 20 | 565 |
| SCNN1A-25 | − | UGCAACAACACCACCAUCCA | 20 | 567 |
| SCNN1A-9 | − | GCCCUCCACAGUCCACUCCA | 20 | 499 |
| SCNN1A-6291 | − | GCGCCUGGAAGGGUGGUCCA | 20 | 10140 |
| SCNN1A-15 | − | GGGAACAAGCGUGAGGAGCA | 20 | 507 |
| SCNN1A-6292 | − | GUAGAAACAUACCUAUAGCA | 20 | 10141 |
| SCNN1A-6293 | − | AUACCCGGCAGGACGUGGCA | 20 | 10142 |
| SCNN1A-62 | + | GGAGCGGUGGAACUCGAUCA | 20 | 525 |
| SCNN1A-27 | − | CCAGCACAACCGCAUGAAGA | 20 | 569 |
| SCNN1A-47 | + | GAGCCACAGCACUGCCCAGA | 20 | 521 |
| SCNN1A-6294 | + | GGCACCAGGGAAGGGGCAGA | 20 | 10143 |
| SCNN1A-36 | + | GUAGGGAUUGAGGGUGCAGA | 20 | 516 |
| SCNN1A-6295 | − | CCCUUGGGGAGGGAAAGGA | 20 | 10144 |
| SCNN1A-53 | + | CUGGGAGCACACCAGGCGGA | 20 | 585 |
| SCNN1A-6296 | + | CCAGGCGCAGGCACCAGGGA | 20 | 10145 |
| SCNN1A-6297 | − | UGGUGGCUCCCCUUUGGGGA | 20 | 10146 |
| SCNN1A-6298 | − | CCCUGGUGCCUGCGCCUGGA | 20 | 10147 |
| SCNN1A-55 | + | CAGGCGGAUGGCGCCGUGGA | 20 | 587 |
| SCNN1A-76 | + | GCCCUGGAGUGGACUGUGGA | 20 | 528 |
| SCNN1A-10 | − | GUCCACUCCAGGGCUCAUGA | 20 | 505 |
| SCNN1A-6299 | − | AGGCAGAGCCUCAGACCUGA | 20 | 10148 |
| SCNN1A-42 | + | GAGGUUGAUGUUGAGGCUGA | 20 | 519 |
| SCNN1A-402 | + | AACCGACCUGUAGGGAUUGA | 20 | 4251 |
| SCNN1A-6300 | − | GAGGGAAAGGAAGGGGACUA | 20 | 10149 |
| SCNN1A-6301 | + | CUGCCACGUCCUGCCGGGUA | 20 | 10150 |
| SCNN1A-345 | + | GAGGGACUAACCGACCUGUA | 20 | 4194 |
| SCNN1A-6302 | − | AUAGACAGAUAUACAAAUUA | 20 | 10151 |
| SCNN1A-6303 | + | GACCUGGAGCGGGCUAGAAC | 20 | 10152 |
| SCNN1A-6304 | − | CAGGGUGCUGAGGUGCUCAC | 20 | 10153 |
| SCNN1A-6305 | + | UUCUUAUUUAUCUUAGAGAC | 20 | 10154 |
| SCNN1A-6306 | + | CAGUGAGCUCUACCUGGGAC | 20 | 10155 |

TABLE 46E-continued

5th Tier

| gRNA Name | DNA Strand | Targeting Domain | Target Site Length | Seq ID |
|---|---|---|---|---|
| SCNN1A-43 | + | AGGUUGAUGUUGAGGCUGAC | 20 | 578 |
| SCNN1A-403 | − | UCUGCACCCUCAAUCCCUAC | 20 | 4252 |
| SCNN1A-32 | − | GCACCUUUGGCAUGAUGUAC | 20 | 514 |
| SCNN1A-51 | + | GGUUGUGCUGGGAGCACACC | 20 | 522 |
| SCNN1A-6307 | + | CCCUUCCAGGCGCAGGCACC | 20 | 10156 |
| SCNN1A-6308 | − | CCUUUGGCUCAGCCCAGACC | 20 | 10157 |
| SCNN1A-6309 | + | GAAAAUAGAAAUCUGAGACC | 20 | 10158 |
| SCNN1A-6310 | + | GUGCUGCAGCAUUCUAGACC | 20 | 10159 |
| SCNN1A-6311 | − | CGCAUUGCCACUCCCAUACC | 20 | 10160 |
| SCNN1A-6312 | + | UGCCAGCAGUGAGCUCUACC | 20 | 10161 |
| SCNN1A-6313 | + | CAGUGAGCACCUCAGCACCC | 20 | 10162 |
| SCNN1A-72 | + | UUGUUCCCCUUCAUGAGCCC | 20 | 599 |
| SCNN1A-6314 | − | GGAACUGACACCCCUGUCCC | 20 | 10163 |
| SCNN1A-407 | − | UAGUCCCUCUGCCCCUUCCC | 20 | 4256 |
| SCNN1A-26 | − | CAUCCACGGCGCCAUCCGCC | 20 | 568 |
| SCNN1A-6315 | − | CCUUCCCUGGUGCCUGCGCC | 20 | 10164 |
| SCNN1A-5223 | + | GUGAGAAGAAUUGCAAUGCC | 20 | 9072 |
| SCNN1A-6316 | + | UGACCCUGCCACGUCCUGCC | 20 | 10165 |
| SCNN1A-8 | − | AGCCCUCCACAGUCCACUCC | 20 | 559 |
| SCNN1A-6317 | − | AGCCUGUUCUAGCCCGCUCC | 20 | 10166 |
| SCNN1A-6318 | − | UGGACUUCUGACCAAAGUCC | 20 | 10167 |
| SCNN1A-6319 | − | UGCGCCUGGAAGGGUGGUCC | 20 | 10168 |
| SCNN1A-6320 | + | GCACCCUGGACCACCCUUCC | 20 | 10169 |
| SCNN1A-45 | + | UGAAGUACUCUCCGAAAAGC | 20 | 579 |
| SCNN1A-14 | − | GGGGAACAAGCGUGAGGAGC | 20 | 506 |
| SCNN1A-6321 | + | CAGCAUUCUAGACCUGGAGC | 20 | 10170 |
| SCNN1A-68 | + | GUGGGCUGCUGGGGCGCCGC | 20 | 526 |
| SCNN1A-6322 | + | UGGACCACCCUUCCAGGCGC | 20 | 10171 |
| SCNN1A-6323 | + | UCAUGCACUAUCCUCUAGGC | 20 | 10172 |
| SCNN1A-6324 | − | UUGCCACUCCCAUACCCGGC | 20 | 10173 |
| SCNN1A-17 | − | CAAGCGUGAGGAGCAGGGGC | 20 | 563 |
| SCNN1A-6325 | − | UGCUGAGGUGCUCACUGGGC | 20 | 10174 |
| SCNN1A-6326 | − | CAUACCCGGCAGGACGUGGC | 20 | 10175 |
| SCNN1A-6327 | − | UCCCAGGUAGAGCUCACUGC | 20 | 10176 |
| SCNN1A-38 | + | AGGGUGCAGAUGGUCACUGC | 20 | 575 |
| SCNN1A-6328 | + | GUGACCCUGCCACGUCCUGC | 20 | 10177 |
| SCNN1A-65 | + | CCUCCUCCGCCGUGGGCUGC | 20 | 594 |
| SCNN1A-49 | + | CCGUCUUCAUGCGGUUGUGC | 20 | 582 |

TABLE 46E-continued

| | | 5th Tier | | |
|---|---|---|---|---|
| gRNA Name | DNA Strand | Targeting Domain | Target Site Length | Seq ID |
| SCNN1A-61 | + | AGGAGCGGUGGAACUCGAUC | 20 | 591 |
| SCNN1A-6329 | + | GGGUGUCAGUUCCCACCCUC | 20 | 10178 |
| SCNN1A-5640 | + | AAGAAUUGCAAUGCCUGGUC | 20 | 9489 |
| SCNN1A-28 | − | ACCGCAUGAAGACGGCCUUC | 20 | 570 |
| SCNN1A-70 | + | UGCUGGGGCGCCGCAGGUUC | 20 | 598 |
| SCNN1A-6330 | + | CUUCCUUUCCCUCCCCAAAG | 20 | 10179 |
| SCNN1A-6331 | − | CUUUGGGGAGGGAAAGGAAG | 20 | 10180 |
| SCNN1A-6332 | + | AGGCGCAGGCACCAGGGAAG | 20 | 10181 |
| SCNN1A-12 | − | CCACUCCAGGGCUCAUGAAG | 20 | 561 |
| SCNN1A-6333 | + | GUGAGCUCUACCUGGGACAG | 20 | 10182 |
| SCNN1A-16 | − | GGAACAAGCGUGAGGAGCAG | 20 | 508 |
| SCNN1A-6334 | + | AGGCACCAGGGAAGGGGCAG | 20 | 10183 |
| SCNN1A-59 | + | CGAAGAGCUCUCGGUAGGAG | 20 | 589 |
| SCNN1A-6335 | + | CGUCCUGCCGGGUAUGGGAG | 20 | 10184 |
| SCNN1A-6336 | + | GCAGCAUUCUAGACCUGGAG | 20 | 10185 |
| SCNN1A-73 | + | CCCCUUCAUGAGCCCUGGAG | 20 | 600 |
| SCNN1A-6337 | − | GCUGCUGUACUCCAGCCUAG | 20 | 10186 |
| SCNN1A-6338 | − | CUCCCAUACCCGGCAGGACG | 20 | 10187 |
| SCNN1A-44 | + | GGUUGAUGUUGAGGCUGACG | 20 | 520 |
| SCNN1A-63 | + | CAGGGCCUCCUCCUCCGCCG | 20 | 592 |
| SCNN1A-54 | + | ACACCAGGCGGAUGGCGCCG | 20 | 586 |
| SCNN1A-39 | + | GGGUGCAGAUGGUCACUGCG | 20 | 518 |
| SCNN1A-71 | + | GCUGGGGCGCCGCAGGUUCG | 20 | 527 |
| SCNN1A-52 | + | UGUGCUGGGAGCACACCAGG | 20 | 584 |
| SCNN1A-24 | − | GCAGCCCACGGCGGAGGAGG | 20 | 512 |
| SCNN1A-23 | − | CCAGCAGCCCACGGCGGAGG | 20 | 566 |
| SCNN1A-21 | − | GGCGCCCCAGCAGCCCACGG | 20 | 510 |
| SCNN1A-60 | + | AGAGCUCUCGGUAGGAGCGG | 20 | 590 |
| SCNN1A-22 | − | GCCCCAGCAGCCCACGGCGG | 20 | 511 |
| SCNN1A-6339 | + | GUCUGGGCUGAGCCAAAGGG | 20 | 10188 |
| SCNN1A-6340 | − | GGUGCCUGCGCCUGGAAGGG | 20 | 10189 |
| SCNN1A-6341 | − | CAGAGCCUCAGACCUGAGGG | 20 | 10190 |
| SCNN1A-6342 | − | AUGGUGGCUCCCCUUUGGGG | 20 | 10191 |
| SCNN1A-56 | + | GCGGAUGGCGCCGUGGAUGG | 20 | 523 |
| SCNN1A-6343 | − | GACAGAUAUACAAAUUAUGG | 20 | 10192 |
| SCNN1A-75 | + | AGCCCUGGAGUGGACUGUGG | 20 | 602 |
| SCNN1A-48 | + | CCCAGAAGGCCGUCUUCAUG | 20 | 581 |

TABLE 46E-continued

5th Tier

| gRNA Name | DNA Strand | Targeting Domain | Target Site Length | Seq ID |
|---|---|---|---|---|
| SCNN1A-37 | + | GAGGGUGCAGAUGGUCACUG | 20 | 517 |
| SCNN1A-74 | + | AUGAGCCCUGGAGUGGACUG | 20 | 601 |
| SCNN1A-19 | - | GGGGCUGGGCCCCGAACCUG | 20 | 509 |
| SCNN1A-6344 | - | CAGGCAGAGCCUCAGACCUG | 20 | 10193 |
| SCNN1A-67 | + | UCCUCCGCCGUGGGCUGCUG | 20 | 596 |
| SCNN1A-30 | - | CGGCCUUCUGGGCAGUGCUG | 20 | 572 |
| SCNN1A-6345 | - | AAGGGUGGUCCAGGGUGCUG | 20 | 10194 |
| SCNN1A-6346 | + | AGUUCCCACCCUCAGGUCUG | 20 | 10195 |
| SCNN1A-13 | - | CAUGAAGGGGAACAAGCGUG | 20 | 562 |
| SCNN1A-6347 | + | AGAACAGGCUUGGUGUUGUG | 20 | 10196 |
| SCNN1A-418 | + | UAACCGACCUGUAGGGAUUG | 20 | 4267 |
| SCNN1A-40 | + | AGACGAGCUUGUCCGAGUUG | 20 | 576 |
| SCNN1A-41 | + | CCGAGUUGAGGUUGAUGUUG | 20 | 577 |
| SCNN1A-6348 | - | AUUAUGGUGGCUCCCCUUUG | 20 | 10197 |
| SCNN1A-6349 | + | UAUGACAGAGACCAUGCUAU | 20 | 10198 |
| SCNN1A-6350 | + | UGCCACGUCCUGCCGGGUAU | 20 | 10199 |
| SCNN1A-35 | - | CCUCAACAUCAACCUCAACU | 20 | 574 |
| SCNN1A-6351 | - | GUCUAGAAUGCUGCAGCACU | 20 | 10200 |
| SCNN1A-6352 | - | AGGGUGCUGAGGUGCUCACU | 20 | 10201 |
| SCNN1A-6353 | + | GCCAGCAGUGAGCUCUACCU | 20 | 10202 |
| SCNN1A-6354 | + | GGAGCGGGCUAGAACAGGCU | 20 | 10203 |
| SCNN1A-18 | - | AAGCGUGAGGAGCAGGGGCU | 20 | 564 |
| SCNN1A-66 | + | CUCCUCCGCCGUGGGCUGCU | 20 | 595 |
| SCNN1A-50 | + | CGUCUUCAUGCGGUUGUGCU | 20 | 583 |
| SCNN1A-6355 | + | AGGAUCAUGCACUAUCCUCU | 20 | 10204 |
| SCNN1A-57 | + | AGAAGAACUCGAAGAGCUCU | 20 | 588 |
| SCNN1A-6356 | + | AGAAUUGCAAUGCCUGGUCU | 20 | 10205 |
| SCNN1A-29 | - | CCGCAUGAAGACGGCCUUCU | 20 | 571 |
| SCNN1A-64 | + | AGGGCCUCCUCCUCCGCCGU | 20 | 593 |
| SCNN1A-423 | - | CACCCUCAAUCCCUACAGGU | 20 | 4272 |
| SCNN1A-58 | + | GAACUCGAAGAGCUCUCGGU | 20 | 524 |
| SCNN1A-6357 | - | AGAGCCUCAGACCUGAGGGU | 20 | 10206 |
| SCNN1A-424 | + | AGAGGGACUAACCGACCUGU | 20 | 4273 |
| SCNN1A-33 | - | GGCAUGAUGUACUGGCAAUU | 20 | 515 |
| SCNN1A-6358 | + | GAAAUCUGAGACCUGGACUU | 20 | 10207 |
| SCNN1A-31 | - | GUGCUGUGGCUCUGCACCUU | 20 | 513 |
| SCNN1A-6359 | - | GUGGCAGGGUCACCACCCUU | 20 | 10208 |
| SCNN1A-6360 | - | AAAUUAUGGUGGCUCCCCUU | 20 | 10209 |

TABLE 46E-continued

5th Tier

| gRNA Name | DNA Strand | Targeting Domain | Target Site Length | Seq ID |
|---|---|---|---|---|
| SCNN1A-69 | + | CUGCUGGGGCGCCGCAGGUU | 20 | 597 |
| SCNN1A-6361 | - | AAUUAUGGUGGCUCCCCUUU | 20 | 10210 |
| SCNN1A-34 | - | UGGCAAUUCGGCCUGCUUUU | 20 | 573 |

Table 47A provides exemplary targeting domains for knocking down the SCNN1A gene selected according to the first tier parameters. The targeting domains bind within 500 bp (e.g., upstream or downstream) of a transcription start site (TSS), have a high level of orthogonality, start with a 5'G, and PAM is NNGRRT. It is contemplated herein that in an embodiment the targeting domain hybridizes to the target domain through complementary base pairing. Any of the targeting domains in the table can be used with a *S. Aureus* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 47A

1st Tier

| gRNA Name | DNA Strand | Targeting Domain | Target Site Length | Seq ID |
|---|---|---|---|---|
| SCNN1A-6362 | + | GAAGGAGCCAGCACCAAA | 18 | 10211 |
| SCNN1A-6363 | + | GCCAGCGCUGGAAAGGAA | 18 | 10212 |
| SCNN1A-6364 | + | GGCCAGCGCUGGAAAGGAA | 19 | 10213 |
| SCNN1A-6365 | + | GUGGCCAGCGCUGGAAAGGAA | 21 | 10214 |
| SCNN1A-6366 | + | GAUGUGGCCAGCGCUGGAAAGGAA | 24 | 10215 |
| SCNN1A-6367 | + | GCUGAAUCUUGACAAGCA | 18 | 10216 |
| SCNN1A-6368 | + | GUAAUCGCCCCUGCUGGUCA | 22 | 10217 |
| SCNN1A-6369 | + | GUGUAAUCGCCCCUGCUGGUCA | 24 | 10218 |
| SCNN1A-6370 | + | GUGAAAGCCGGUGUCAAC | 18 | 10219 |
| SCNN1A-1304 | + | GCCCUCUCCCAUCACCCCUGGAAC | 24 | 5153 |
| SCNN1A-6371 | + | GAUCGGGGCUCAGGUGCAC | 19 | 10220 |
| SCNN1A-6372 | + | GGAUCGGGGCUCAGGUGCAC | 20 | 10221 |
| SCNN1A-6373 | + | GGGAUCGGGGCUCAGGUGCAC | 21 | 10222 |
| SCNN1A-6374 | + | GGGGAUCGGGGCUCAGGUGCAC | 22 | 10223 |
| SCNN1A-6375 | + | GGGGGAUCGGGGCUCAGGUGCAC | 23 | 10224 |
| SCNN1A-6376 | + | GCCAGGGAUGGAAGCGAC | 18 | 10225 |
| SCNN1A-6377 | + | GGCCAGGGAUGGAAGCGAC | 19 | 10226 |
| SCNN1A-6378 | + | GCCGGCCAGGGAUGGAAGCGAC | 22 | 10227 |
| SCNN1A-6379 | + | GGCCGGCCAGGGAUGGAAGCGAC | 23 | 10228 |
| SCNN1A-6380 | + | GAAGAAACUGACCCUUCCC | 19 | 10229 |
| SCNN1A-6381 | + | GCCCCACAGGAGGCAGCC | 18 | 10230 |
| SCNN1A-6382 | + | GGCCCCACAGGAGGCAGCC | 19 | 10231 |
| SCNN1A-6383 | + | GGGCCCCACAGGAGGCAGCC | 20 | 10232 |
| SCNN1A-5221 | + | GCUGAGGAGGAGUCAGAGCC | 20 | 9070 |

TABLE 47A-continued

1st Tier

| gRNA Name | DNA Strand | Targeting Domain | Target Site Length | Seq ID |
|---|---|---|---|---|
| SCNN1A-6384 | + | GCCCGCCCGCUGGCCGGCC | 19 | 10233 |
| SCNN1A-6385 | + | GAGCCCGCCCGCUGGCCGGCC | 21 | 10234 |
| SCNN1A-6386 | + | GGAGCCCGCCCGCUGGCCGGCC | 22 | 10235 |
| SCNN1A-6387 | + | GGGAGCCCGCCCGCUGGCCGGCC | 23 | 10236 |
| SCNN1A-6388 | + | GGGGAGCCCGCCCGCUGGCCGGCC | 24 | 10237 |
| SCNN1A-1305 | + | GUCAAGGCUGAGCUCUGGGCC | 21 | 5154 |
| SCNN1A-1306 | + | GGUCAAGGCUGAGCUCUGGGCC | 22 | 5155 |
| SCNN1A-1307 | + | GGGUCAAGGCUGAGCUCUGGGCC | 23 | 5156 |
| SCNN1A-1308 | + | GAGUGGAUUGGGGAGAGC | 18 | 5157 |
| SCNN1A-1309 | + | GGAGUGGAUUGGGGAGAGC | 19 | 5158 |
| SCNN1A-1310 | + | GCCCCGGAGUGGAUUGGGGAGAGC | 24 | 5159 |
| SCNN1A-1311 | + | GCCCUGGAGUGGACUGUGGAGGGC | 24 | 5160 |
| SCNN1A-6389 | + | GGAGGCAGCCCAGAGUGC | 18 | 10238 |
| SCNN1A-6390 | + | GCUGUGGUCACAGAGUUGC | 19 | 10239 |
| SCNN1A-1312 | + | GUAUGGGCUGCAGAGGUC | 18 | 5161 |
| SCNN1A-1313 | + | GGUAUGGGCUGCAGAGGUC | 19 | 5162 |
| SCNN1A-1314 | + | GACCUGGUAUGGGCUGCAGAGGUC | 24 | 5163 |
| SCNN1A-1315 | + | GAUACCUCCCCUUGGAAGGGACAG | 24 | 5164 |
| SCNN1A-6391 | + | GGACUGGUUCCUUUCCAG | 18 | 10240 |
| SCNN1A-6392 | + | GGGACUGGUUCCUUUCCAG | 19 | 10241 |
| SCNN1A-6393 | + | GACUGGGACUGGUUCCUUUCCAG | 23 | 10242 |
| SCNN1A-6394 | + | GGACUGGGACUGGUUCCUUUCCAG | 24 | 10243 |
| SCNN1A-6395 | + | GCAGCAAAAGGAUAAGGAG | 19 | 10244 |
| SCNN1A-6396 | + | GGCAAAGAUCUGAACAAGUAG | 21 | 10245 |
| SCNN1A-6397 | + | GGGCAAAGAUCUGAACAAGUAG | 22 | 10246 |
| SCNN1A-6398 | + | GGGGCAAAGAUCUGAACAAGUAG | 23 | 10247 |
| SCNN1A-6399 | + | GCAGGCACUGAAGGUGCAGG | 20 | 10248 |
| SCNN1A-6400 | + | GGGAGCAGCGCACUCAGG | 18 | 10249 |
| SCNN1A-5260 | + | GUGGGAGCAGCGCACUCAGG | 20 | 9109 |
| SCNN1A-6401 | + | GAUUCGUCUGCUCUCUGGGUG | 21 | 10250 |
| SCNN1A-6402 | + | GGAUUCGUCUGCUCUCUGGGUG | 22 | 10251 |
| SCNN1A-6403 | + | GUGGAUUCGUCUGCUCUCUGGGUG | 24 | 10252 |
| SCNN1A-6404 | + | GCCCGUGGAUUCGUCUGCUCU | 21 | 10253 |
| SCNN1A-6405 | + | GAGCCCGUGGAUUCGUCUGCUCU | 23 | 10254 |
| SCNN1A-1322 | + | GAUUGGGGAGAGCAAGGGU | 19 | 5171 |
| SCNN1A-1323 | + | GGAUUGGGGAGAGCAAGGGU | 20 | 5172 |
| SCNN1A-1324 | + | GUGGAUUGGGGAGAGCAAGGGU | 22 | 5173 |
| SCNN1A-1325 | + | GAGUGGAUUGGGGAGAGCAAGGGU | 24 | 5174 |

TABLE 47A-continued

1st Tier

| gRNA Name | DNA Strand | Targeting Domain | Target Site Length | Seq ID |
|---|---|---|---|---|
| SCNN1A-6406 | + | GCAGAGCUAUAAACAGAAUU | 20 | 10255 |
| SCNN1A-6407 | + | GAGCAGAGCUAUAAACAGAAUU | 22 | 10256 |
| SCNN1A-6408 | + | GGAGCAGAGCUAUAAACAGAAUU | 23 | 10257 |
| SCNN1A-6409 | + | GCUUCCCUGAUAGGGCCACCUU | 22 | 10258 |
| SCNN1A-6410 | - | GCCAACAGUGUAAAAAGAA | 20 | 10259 |
| SCNN1A-6411 | - | GCAGCCAACAGUGUAAAAAGAA | 23 | 10260 |
| SCNN1A-6412 | - | GGCAGCCAACAGUGUAAAAAGAA | 24 | 10261 |
| SCNN1A-6413 | - | GAGAAAAUAUAGCCCAUCA | 19 | 10262 |
| SCNN1A-6414 | - | GGAGAAAAUAUAGCCCAUCA | 20 | 10263 |
| SCNN1A-6415 | - | GCAGUCCUGGGGCAGAGA | 18 | 10264 |
| SCNN1A-6416 | - | GGUCUGGACAAGGUUGGA | 18 | 10265 |
| SCNN1A-6417 | - | GGGUCUGGACAAGGUUGGA | 19 | 10266 |
| SCNN1A-6418 | - | GAGGCAGACGCAUCCCAC | 18 | 10267 |
| SCNN1A-6419 | - | GGAGGCAGACGCAUCCCAC | 19 | 10268 |
| SCNN1A-6420 | - | GAGGAGGCAGACGCAUCCCAC | 21 | 10269 |
| SCNN1A-6421 | - | GGAGGAGGCAGACGCAUCCCAC | 22 | 10270 |
| SCNN1A-1335 | - | GGCCAGGGGCAGCCUCAC | 18 | 5184 |
| SCNN1A-6422 | - | GACCUGGCUCAAGGGAGAC | 19 | 10271 |
| SCNN1A-5207 | - | GGACCUGGCUCAAGGGAGAC | 20 | 9056 |
| SCNN1A-6423 | - | GCACCUGAGCCCCGAUCCCC | 21 | 10272 |
| SCNN1A-6424 | - | GUGCACCUGAGCCCCGAUCCCC | 23 | 10273 |
| SCNN1A-6425 | - | GGUGCACCUGAGCCCCGAUCCCC | 24 | 10274 |
| SCNN1A-6426 | - | GACCAGGUUGGACCCUGAGCC | 21 | 10275 |
| SCNN1A-6427 | - | GCGUCUAAAGCCCCUGCC | 18 | 10276 |
| SCNN1A-6428 | - | GUCUGCGUCUAAAGCCCCUGCC | 22 | 10277 |
| SCNN1A-1336 | - | GCAGCCUCACUCGGGUUCC | 19 | 5185 |
| SCNN1A-348 | - | GGCAGCCUCACUCGGGUUCC | 20 | 4197 |
| SCNN1A-6429 | - | GAACCUUUGAGAUCAAACAGC | 21 | 10278 |
| SCNN1A-6430 | - | GCCUUCCCUGCCGCGUGCAGGGC | 23 | 10279 |
| SCNN1A-6431 | - | GCUUCACCUGGGCCCCUC | 18 | 10280 |
| SCNN1A-6432 | - | GUUGUGUGGGUGGCUCUC | 18 | 10281 |
| SCNN1A-6433 | - | GGUUGUGUGGGUGGCUCUC | 19 | 10282 |
| SCNN1A-6434 | - | GGGUUGUGUGGGUGGCUCUC | 20 | 10283 |
| SCNN1A-6435 | - | GGAGUUUCUAGGGUCUC | 18 | 10284 |
| SCNN1A-6436 | - | GACUGGAGUUUCUAGGGGUCUC | 22 | 10285 |
| SCNN1A-6437 | - | GAGACUGGAGUUUCUAGGGGUCUC | 24 | 10286 |
| SCNN1A-6438 | - | GAUAACCCAGCACCCAGAGAGCAG | 24 | 10287 |

TABLE 47A-continued

1st Tier

| gRNA Name | DNA Strand | Targeting Domain | Target Site Length | Seq ID |
|---|---|---|---|---|
| SCNN1A-6439 | - | GAUAGCCCCAGAGGAGGAG | 19 | 10288 |
| SCNN1A-6440 | - | GUAGAUAGCCCCAGAGGAGGAG | 22 | 10289 |
| SCNN1A-6441 | - | GAGUGGGAGAAUGUGGGCG | 19 | 10290 |
| SCNN1A-6442 | - | GGAGUGGGAGAAUGUGGGCG | 20 | 10291 |
| SCNN1A-6443 | - | GACAAGGUUGGAGGGGUGGCG | 22 | 10292 |
| SCNN1A-6444 | - | GGACAAGGUUGGAGGGGUGGCG | 23 | 10293 |
| SCNN1A-6445 | - | GCUGCCUUAAGCUAGUGG | 18 | 10294 |
| SCNN1A-6446 | - | GCCAUGCUGCCUUAAGCUAGUGG | 23 | 10295 |
| SCNN1A-6447 | - | GUCCCAGUCCAGCCGCAACCU | 21 | 10296 |
| SCNN1A-6448 | - | GCCUGAGGGUGAGGCUGACCU | 21 | 10297 |
| SCNN1A-6449 | - | GGCCUGAGGGUGAGGCUGACCU | 22 | 10298 |
| SCNN1A-6450 | - | GGGCCUGAGGGUGAGGCUGACCU | 23 | 10299 |
| SCNN1A-6451 | - | GCCCUCCUAGCUGUGGGCU | 19 | 10300 |
| SCNN1A-6452 | - | GCUCAAGGGAGACUGGAGUUUCU | 23 | 10301 |
| SCNN1A-6453 | - | GGCUCAAGGGAGACUGGAGUUUCU | 24 | 10302 |
| SCNN1A-6454 | - | GAAUCCACGGGCUCUGUGU | 19 | 10303 |
| SCNN1A-6455 | - | GACGAAUCCACGGGCUCUGUGU | 22 | 10304 |
| SCNN1A-6456 | - | GUGCAGGGCCUGGGUUGU | 18 | 10305 |
| SCNN1A-6457 | - | GCGUGCAGGGCCUGGGUUGU | 20 | 10306 |
| SCNN1A-6458 | - | GCCGCGUGCAGGGCCUGGGUUGU | 23 | 10307 |
| SCNN1A-437 | - | GUAAGCAAGGGAACCUGGUU | 20 | 4286 |
| SCNN1A-1339 | - | GGUAAGCAAGGGAACCUGGUU | 21 | 5188 |
| SCNN1A-6459 | - | GAGUCUCCUCCAGCCCUUU | 19 | 10308 |

Table 47B provides exemplary targeting domains for knocking down the SCNN1A gene selected according to the second tier parameters. The targeting domains bind within 500 bp (e.g., upstream or downstream) of a transcription start site (TSS), have a high level of orthogonality and PAM is NNGRRT. It is contemplated herein that in an embodiment the targeting domain hybridizes to the target domain through complementary base pairing. Any of the targeting domains in the table can be used with a *S. Aureus* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 47B

2nd Tier

| gRNA Name | DNA Strand | Targeting Domain | Target Site Length | Seq ID |
|---|---|---|---|---|
| SCNN1A-6460 | + | AGAAGGAGCCAGCACCAAA | 19 | 10309 |
| SCNN1A-5515 | + | UAGAAGGAGCCAGCACCAAA | 20 | 9364 |
| SCNN1A-6461 | + | UAGGAGCAGAGCUAUAAA | 18 | 10310 |
| SCNN1A-6462 | + | AUAGGAGCAGAGCUAUAAA | 19 | 10311 |
| SCNN1A-6463 | + | AAUAGGAGCAGAGCUAUAAA | 20 | 10312 |

TABLE 47B-continued

2nd Tier

| gRNA Name | DNA Strand | Targeting Domain | Target Site Length | Seq ID |
|---|---|---|---|---|
| SCNN1A-6464 | + | AAAUAGGAGCAGAGCUAUAAA | 21 | 10313 |
| SCNN1A-6465 | + | AAAAUAGGAGCAGAGCUAUAAA | 22 | 10314 |
| SCNN1A-6466 | + | CAAAAUAGGAGCAGAGCUAUAAA | 23 | 10315 |
| SCNN1A-6467 | + | ACAAAAUAGGAGCAGAGCUAUAAA | 24 | 10316 |
| SCNN1A-6468 | + | UUUCCAAACUUAAUGCAGCAA | 21 | 10317 |
| SCNN1A-6469 | + | CUUUCCAAACUUAAUGCAGCAA | 22 | 10318 |
| SCNN1A-6470 | + | UCUUUCCAAACUUAAUGCAGCAA | 23 | 10319 |
| SCNN1A-6471 | + | CUCUUUCCAAACUUAAUGCAGCAA | 24 | 10320 |
| SCNN1A-6472 | + | UGGCCAGCGCUGGAAAGGAA | 20 | 10321 |
| SCNN1A-6473 | + | UGUGGCCAGCGCUGGAAAGGAA | 22 | 10322 |
| SCNN1A-6474 | + | AUGUGGCCAGCGCUGGAAAGGAA | 23 | 10323 |
| SCNN1A-6475 | + | UGCUGAAUCUUGACAAGCA | 19 | 10324 |
| SCNN1A-5532 | + | CUGCUGAAUCUUGACAAGCA | 20 | 9381 |
| SCNN1A-6476 | + | UCUGCUGAAUCUUGACAAGCA | 21 | 10325 |
| SCNN1A-6477 | + | CUCUGCUGAAUCUUGACAAGCA | 22 | 10326 |
| SCNN1A-6478 | + | UCUCUGCUGAAUCUUGACAAGCA | 23 | 10327 |
| SCNN1A-6479 | + | AUCUCUGCUGAAUCUUGACAAGCA | 24 | 10328 |
| SCNN1A-6480 | + | AGGGAUGGAGGAGGGGCA | 18 | 10329 |
| SCNN1A-6481 | + | UAGGGAUGGAGGAGGGGCA | 19 | 10330 |
| SCNN1A-6482 | + | AUAGGGAUGGAGGAGGGGCA | 20 | 10331 |
| SCNN1A-6483 | + | UCGCCCCUGCUGUGGUCA | 18 | 10332 |
| SCNN1A-6484 | + | AUCGCCCCUGCUGUGGUCA | 19 | 10333 |
| SCNN1A-6485 | + | AAUCGCCCCUGCUGUGGUCA | 20 | 10334 |
| SCNN1A-6486 | + | UAAUCGCCCCUGCUGUGGUCA | 21 | 10335 |
| SCNN1A-6487 | + | UGUAAUCGCCCCUGCUGUGGUCA | 23 | 10336 |
| SCNN1A-6488 | + | UAAUGCAGCAAAAGGAUA | 18 | 10337 |
| SCNN1A-6489 | + | UUAAUGCAGCAAAAGGAUA | 19 | 10338 |
| SCNN1A-6098 | + | CUUAAUGCAGCAAAAGGAUA | 20 | 9947 |
| SCNN1A-6490 | + | AGUGAAAGCCGGUGUCAAC | 19 | 10339 |
| SCNN1A-6491 | + | AAGUGAAAGCCGGUGUCAAC | 20 | 10340 |
| SCNN1A-6492 | + | AAAGUGAAAGCCGGUGUCAAC | 21 | 10341 |
| SCNN1A-6493 | + | UAAAGUGAAAGCCGGUGUCAAC | 22 | 10342 |
| SCNN1A-6494 | + | UUAAAGUGAAAGCCGGUGUCAAC | 23 | 10343 |
| SCNN1A-6495 | + | CUUAAAGUGAAAGCCGGUGUCAAC | 24 | 10344 |
| SCNN1A-1344 | + | UCCCAUCACCCCUGGAAC | 18 | 5193 |
| SCNN1A-1345 | + | CUCCCAUCACCCCUGGAAC | 19 | 5194 |
| SCNN1A-1346 | + | UCUCCCAUCACCCCUGGAAC | 20 | 5195 |

TABLE 47B-continued

2nd Tier

| gRNA Name | DNA Strand | Targeting Domain | Target Site Length | Seq ID |
|---|---|---|---|---|
| SCNN1A-1347 | + | CUCUCCCAUCACCCCUGGAAC | 21 | 5196 |
| SCNN1A-1348 | + | CCUCUCCCAUCACCCCUGGAAC | 22 | 5197 |
| SCNN1A-1349 | + | CCCUCUCCCAUCACCCCUGGAAC | 23 | 5198 |
| SCNN1A-6496 | + | AUCGGGGCUCAGGUGCAC | 18 | 10345 |
| SCNN1A-6497 | + | UGGGGGAUCGGGGCUCAGGUGCAC | 24 | 10346 |
| SCNN1A-5564 | + | CGGCCAGGGAUGGAAGCGAC | 20 | 9413 |
| SCNN1A-6498 | + | CCGGCCAGGGAUGGAAGCGAC | 21 | 10347 |
| SCNN1A-6499 | + | UGGCCGGCCAGGGAUGGAAGCGAC | 24 | 10348 |
| SCNN1A-6500 | + | CACUCCCACACAGAGCCC | 18 | 10349 |
| SCNN1A-6501 | + | UCACUCCCACACAGAGCCC | 19 | 10350 |
| SCNN1A-6502 | + | CUCACUCCCACACAGAGCCC | 20 | 10351 |
| SCNN1A-6503 | + | AAGAAACUGACCCUUCCC | 18 | 10352 |
| SCNN1A-6504 | + | UGAAGAAACUGACCCUUCCC | 20 | 10353 |
| SCNN1A-6505 | + | AUGAAGAAACUGACCCUUCCC | 21 | 10354 |
| SCNN1A-6506 | + | AAUGAAGAAACUGACCCUUCCC | 22 | 10355 |
| SCNN1A-6507 | + | UAAUGAAGAAACUGACCCUUCCC | 23 | 10356 |
| SCNN1A-6508 | + | CUAAUGAAGAAACUGACCCUUCCC | 24 | 10357 |
| SCNN1A-6509 | + | CGGGCCCCACAGGAGGCAGCC | 21 | 10358 |
| SCNN1A-6510 | + | ACGGGCCCCACAGGAGGCAGCC | 22 | 10359 |
| SCNN1A-6511 | + | CACGGGCCCCACAGGAGGCAGCC | 23 | 10360 |
| SCNN1A-6512 | + | UCACGGGCCCCACAGGAGGCAGCC | 24 | 10361 |
| SCNN1A-6513 | + | UGAGGAGGAGUCAGAGCC | 18 | 10362 |
| SCNN1A-6514 | + | CUGAGGAGGAGUCAGAGCC | 19 | 10363 |
| SCNN1A-6515 | + | ACUGUUGGCUGCCAGGCC | 18 | 10364 |
| SCNN1A-6516 | + | CACUGUUGGCUGCCAGGCC | 19 | 10365 |
| SCNN1A-5583 | + | ACACUGUUGGCUGCCAGGCC | 20 | 9432 |
| SCNN1A-6517 | + | UACACUGUUGGCUGCCAGGCC | 21 | 10366 |
| SCNN1A-6518 | + | UUACACUGUUGGCUGCCAGGCC | 22 | 10367 |
| SCNN1A-6519 | + | UUUACACUGUUGGCUGCCAGGCC | 23 | 10368 |
| SCNN1A-6520 | + | UUUUACACUGUUGGCUGCCAGGCC | 24 | 10369 |
| SCNN1A-6521 | + | CCCGCCCGCUGGCCGGCC | 18 | 10370 |
| SCNN1A-6109 | + | AGCCCGCCCGCUGGCCGGCC | 20 | 9958 |
| SCNN1A-1350 | + | AAGGCUGAGCUCUGGGCC | 18 | 5199 |
| SCNN1A-1351 | + | CAAGGCUGAGCUCUGGGCC | 19 | 5200 |
| SCNN1A-1352 | + | UCAAGGCUGAGCUCUGGGCC | 20 | 5201 |
| SCNN1A-1353 | + | AGGGUCAAGGCUGAGCUCUGGGCC | 24 | 5202 |
| SCNN1A-1354 | + | CGGAGUGGAUUGGGGAGAGC | 20 | 5203 |
| SCNN1A-1355 | + | CCGGAGUGGAUUGGGGAGAGC | 21 | 5204 |

TABLE 47B-continued

2nd Tier

| gRNA Name | DNA Strand | Targeting Domain | Target Site Length | Seq ID |
|---|---|---|---|---|
| SCNN1A-1356 | + | CCCGGAGUGGAUUGGGGAGAGC | 22 | 5205 |
| SCNN1A-1357 | + | CCCCGGAGUGGAUUGGGGAGAGC | 23 | 5206 |
| SCNN1A-1358 | + | CUGGAGUGGACUGUGGAGGGC | 21 | 5207 |
| SCNN1A-1359 | + | CCUGGAGUGGACUGUGGAGGGC | 22 | 5208 |
| SCNN1A-1360 | + | CCCUGGAGUGGACUGUGGAGGGC | 23 | 5209 |
| SCNN1A-6522 | + | UGGAGCCAGCAGACCUGC | 18 | 10371 |
| SCNN1A-6523 | + | CUGGAGCCAGCAGACCUGC | 19 | 10372 |
| SCNN1A-5615 | + | CCUGGAGCCAGCAGACCUGC | 20 | 9464 |
| SCNN1A-6524 | + | AGGAGGCAGCCCAGAGUGC | 19 | 10373 |
| SCNN1A-6130 | + | CAGGAGGCAGCCCAGAGUGC | 20 | 9979 |
| SCNN1A-6525 | + | ACAGGAGGCAGCCCAGAGUGC | 21 | 10374 |
| SCNN1A-6526 | + | CACAGGAGGCAGCCCAGAGUGC | 22 | 10375 |
| SCNN1A-6527 | + | CCACAGGAGGCAGCCCAGAGUGC | 23 | 10376 |
| SCNN1A-6528 | + | CCCACAGGAGGCAGCCCAGAGUGC | 24 | 10377 |
| SCNN1A-6529 | + | CUGUGGUCACAGAGUUGC | 18 | 10378 |
| SCNN1A-5623 | + | UGCUGUGGUCACAGAGUUGC | 20 | 9472 |
| SCNN1A-6530 | + | CUGCUGUGGUCACAGAGUUGC | 21 | 10379 |
| SCNN1A-6531 | + | CCUGCUGUGGUCACAGAGUUGC | 22 | 10380 |
| SCNN1A-6532 | + | CCCUGCUGUGGUCACAGAGUUGC | 23 | 10381 |
| SCNN1A-6533 | + | CCCCUGCUGUGGUCACAGAGUUGC | 24 | 10382 |
| SCNN1A-6534 | + | CCUUUGGUCUUCUUCCUC | 18 | 10383 |
| SCNN1A-6535 | + | UCCUUUGGUCUUCUUCCUC | 19 | 10384 |
| SCNN1A-6536 | + | UUCCUUUGGUCUUCUUCCUC | 20 | 10385 |
| SCNN1A-1361 | + | UGGUAUGGGCUGCAGAGGUC | 20 | 5210 |
| SCNN1A-1362 | + | CUGGUAUGGGCUGCAGAGGUC | 21 | 5211 |
| SCNN1A-1363 | + | CCUGGUAUGGGCUGCAGAGGUC | 22 | 5212 |
| SCNN1A-1364 | + | ACCUGGUAUGGGCUGCAGAGGUC | 23 | 5213 |
| SCNN1A-1365 | + | UCCCCUUGGAAGGGACAG | 18 | 5214 |
| SCNN1A-1366 | + | CUCCCCUUGGAAGGGACAG | 19 | 5215 |
| SCNN1A-1367 | + | CCUCCCCUUGGAAGGGACAG | 20 | 5216 |
| SCNN1A-1368 | + | ACCUCCCCUUGGAAGGGACAG | 21 | 5217 |
| SCNN1A-1369 | + | UACCUCCCCUUGGAAGGGACAG | 22 | 5218 |
| SCNN1A-1370 | + | AUACCUCCCCUUGGAAGGGACAG | 23 | 5219 |
| SCNN1A-6537 | + | UGGGACUGGUUCCUUUCCAG | 20 | 10386 |
| SCNN1A-6538 | + | CUGGGACUGGUUCCUUUCCAG | 21 | 10387 |
| SCNN1A-6539 | + | ACUGGGACUGGUUCCUUUCCAG | 22 | 10388 |
| SCNN1A-6540 | + | CAGCAAAAGGAUAAGGAG | 18 | 10389 |

TABLE 47B-continued

2nd Tier

| gRNA Name | DNA Strand | Targeting Domain | Target Site Length | Seq ID |
|---|---|---|---|---|
| SCNN1A-5654 | + | UGCAGCAAAAGGAUAAGGAG | 20 | 9503 |
| SCNN1A-6541 | + | AUGCAGCAAAAGGAUAAGGAG | 21 | 10390 |
| SCNN1A-6542 | + | AAUGCAGCAAAAGGAUAAGGAG | 22 | 10391 |
| SCNN1A-6543 | + | UAAUGCAGCAAAAGGAUAAGGAG | 23 | 10392 |
| SCNN1A-6544 | + | UUAAUGCAGCAAAAGGAUAAGGAG | 24 | 10393 |
| SCNN1A-6545 | + | UAUCAAGGGCUCUGUGAG | 18 | 10394 |
| SCNN1A-6546 | + | AUAUCAAGGGCUCUGUGAG | 19 | 10395 |
| SCNN1A-6547 | + | CAUAUCAAGGGCUCUGUGAG | 20 | 10396 |
| SCNN1A-6548 | + | UCAUAUCAAGGGCUCUGUGAG | 21 | 10397 |
| SCNN1A-6549 | + | UUCAUAUCAAGGGCUCUGUGAG | 22 | 10398 |
| SCNN1A-6550 | + | UUUCAUAUCAAGGGCUCUGUGAG | 23 | 10399 |
| SCNN1A-6551 | + | UUUUCAUAUCAAGGGCUCUGUGAG | 24 | 10400 |
| SCNN1A-6552 | + | AGGGGCAAAGAUCUGAACAAGUAG | 24 | 10401 |
| SCNN1A-6553 | + | AGGCACUGAAGGUGCAGG | 18 | 10402 |
| SCNN1A-6554 | + | CAGGCACUGAAGGUGCAGG | 19 | 10403 |
| SCNN1A-6555 | + | UGGGAGCAGCGCACUCAGG | 19 | 10404 |
| SCNN1A-6556 | + | AGUGGGAGCAGCGCACUCAGG | 21 | 10405 |
| SCNN1A-6557 | + | AAGUGGGAGCAGCGCACUCAGG | 22 | 10406 |
| SCNN1A-6558 | + | UAAGUGGGAGCAGCGCACUCAGG | 23 | 10407 |
| SCNN1A-6559 | + | CUAAGUGGGAGCAGCGCACUCAGG | 24 | 10408 |
| SCNN1A-6560 | + | CAGGAAGGAGAGCAAGGG | 18 | 10409 |
| SCNN1A-6561 | + | CCAGGAAGGAGAGCAAGGG | 19 | 10410 |
| SCNN1A-6159 | + | UCCAGGAAGGAGAGCAAGGG | 20 | 10008 |
| SCNN1A-6562 | + | UCCUGAGACAGACUCAUG | 18 | 10411 |
| SCNN1A-6563 | + | UUCCUGAGACAGACUCAUG | 19 | 10412 |
| SCNN1A-5698 | + | CUUCCUGAGACAGACUCAUG | 20 | 9547 |
| SCNN1A-6564 | + | ACUUCCUGAGACAGACUCAUG | 21 | 10413 |
| SCNN1A-6565 | + | UACUUCCUGAGACAGACUCAUG | 22 | 10414 |
| SCNN1A-6566 | + | UUACUUCCUGAGACAGACUCAUG | 23 | 10415 |
| SCNN1A-6567 | + | UUUACUUCCUGAGACAGACUCAUG | 24 | 10416 |
| SCNN1A-6568 | + | UCGUCUGCUCUCUGGGUG | 18 | 10417 |
| SCNN1A-6569 | + | UUCGUCUGCUCUCUGGGUG | 19 | 10418 |
| SCNN1A-6570 | + | AUUCGUCUGCUCUCUGGGUG | 20 | 10419 |
| SCNN1A-6571 | + | UGGAUUCGUCUGCUCUCUGGGUG | 23 | 10420 |
| SCNN1A-6572 | + | AGCGAAGGACAGAGAGAU | 18 | 10421 |
| SCNN1A-6573 | + | CAGCGAAGGACAGAGAGAU | 19 | 10422 |
| SCNN1A-5722 | + | ACAGCGAAGGACAGAGAGAU | 20 | 9571 |
| SCNN1A-6574 | + | CCCGAGGGCAGGUGAACU | 18 | 10423 |

TABLE 47B-continued

| | | 2nd Tier | | |
|---|---|---|---|---|
| gRNA Name | DNA Strand | Targeting Domain | Target Site Length | Seq ID |
| SCNN1A-6575 | + | UCCCGAGGGCAGGUGAACU | 19 | 10424 |
| SCNN1A-5726 | + | CUCCCGAGGGCAGGUGAACU | 20 | 9575 |
| SCNN1A-6576 | + | AAGGCAGUACUCCAGGCU | 18 | 10425 |
| SCNN1A-6577 | + | AAAGGCAGUACUCCAGGCU | 19 | 10426 |
| SCNN1A-6578 | + | AAAAGGCAGUACUCCAGGCU | 20 | 10427 |
| SCNN1A-6579 | + | CGUGGAUUCGUCUGCUCU | 18 | 10428 |
| SCNN1A-6580 | + | CCGUGGAUUCGUCUGCUCU | 19 | 10429 |
| SCNN1A-6581 | + | CCCGUGGAUUCGUCUGCUCU | 20 | 10430 |
| SCNN1A-6582 | + | AGCCCGUGGAUUCGUCUGCUCU | 22 | 10431 |
| SCNN1A-6583 | + | AGAGCCCGUGGAUUCGUCUGCUCU | 24 | 10432 |
| SCNN1A-6584 | + | UCUGCCUUCUGUUUCUCU | 18 | 10433 |
| SCNN1A-6585 | + | AUCUGCCUUCUGUUUCUCU | 19 | 10434 |
| SCNN1A-6586 | + | UAUCUGCCUUCUGUUUCUCU | 20 | 10435 |
| SCNN1A-6587 | + | CUAUCUGCCUUCUGUUUCUCU | 21 | 10436 |
| SCNN1A-6588 | + | UCUAUCUGCCUUCUGUUUCUCU | 22 | 10437 |
| SCNN1A-6589 | + | CUCUAUCUGCCUUCUGUUUCUCU | 23 | 10438 |
| SCNN1A-6590 | + | UCUCUAUCUGCCUUCUGUUUCUCU | 24 | 10439 |
| SCNN1A-1377 | + | AUUGGGGAGAGCAAGGGU | 18 | 5226 |
| SCNN1A-1378 | + | UGGAUUGGGGAGAGCAAGGGU | 21 | 5227 |
| SCNN1A-1379 | + | AGUGGAUUGGGGAGAGCAAGGGU | 23 | 5228 |
| SCNN1A-6591 | + | AGAGCUAUAAACAGAAUU | 18 | 10440 |
| SCNN1A-6592 | + | CAGAGCUAUAAACAGAAUU | 19 | 10441 |
| SCNN1A-6593 | + | AGCAGAGCUAUAAACAGAAUU | 21 | 10442 |
| SCNN1A-6594 | + | AGGAGCAGAGCUAUAAACAGAAUU | 24 | 10443 |
| SCNN1A-6595 | + | CUUCCCUGAUAGGGCCACCUU | 21 | 10444 |
| SCNN1A-6596 | + | UGCUUCCCUGAUAGGGCCACCUU | 23 | 10445 |
| SCNN1A-6597 | + | CUGCUUCCCUGAUAGGGCCACCUU | 24 | 10446 |
| SCNN1A-6598 | − | CAACAGUGUAAAAAGAA | 18 | 10447 |
| SCNN1A-6599 | − | CCAACAGUGUAAAAAGAA | 19 | 10448 |
| SCNN1A-6600 | − | AGCCAACAGUGUAAAAAGAA | 21 | 10449 |
| SCNN1A-6601 | − | CAGCCAACAGUGUAAAAAGAA | 22 | 10450 |
| SCNN1A-6602 | − | AGAAAAUAUAGCCCAUCA | 18 | 10451 |
| SCNN1A-6603 | − | UGCAGUCCUGGGGCAGAGA | 19 | 10452 |
| SCNN1A-6604 | − | CUGCAGUCCUGGGGCAGAGA | 20 | 10453 |
| SCNN1A-5553 | − | CGGGUCUGGACAAGGUUGGA | 20 | 9402 |
| SCNN1A-6605 | − | CCGGGUCUGGACAAGGUUGGA | 21 | 10454 |
| SCNN1A-6606 | − | CCCGGGUCUGGACAAGGUUGGA | 22 | 10455 |

TABLE 47B-continued

2nd Tier

| gRNA Name | DNA Strand | Targeting Domain | Target Site Length | Seq ID |
|---|---|---|---|---|
| SCNN1A-6607 | - | UCCCGGGUCUGGACAAGGUUGGA | 23 | 10456 |
| SCNN1A-6608 | - | CUCCCGGGUCUGGACAAGGUUGGA | 24 | 10457 |
| SCNN1A-6609 | - | AGGAGGCAGACGCAUCCCAC | 20 | 10458 |
| SCNN1A-6610 | - | AGGAGGAGGCAGACGCAUCCCAC | 23 | 10459 |
| SCNN1A-6611 | - | CAGGAGGAGGCAGACGCAUCCCAC | 24 | 10460 |
| SCNN1A-1392 | - | UGGCCAGGGGCAGCCUCAC | 19 | 5241 |
| SCNN1A-1393 | - | AUGGCCAGGGGCAGCCUCAC | 20 | 5242 |
| SCNN1A-6612 | - | ACCUGGCUCAAGGGAGAC | 18 | 10461 |
| SCNN1A-6613 | - | CCUGAGCCCCGAUCCCCC | 18 | 10462 |
| SCNN1A-6614 | - | ACCUGAGCCCCGAUCCCCC | 19 | 10463 |
| SCNN1A-6615 | - | CACCUGAGCCCCGAUCCCCC | 20 | 10464 |
| SCNN1A-6616 | - | UGCACCUGAGCCCCGAUCCCCC | 22 | 10465 |
| SCNN1A-6617 | - | CAGGUUGGACCCUGAGCC | 18 | 10466 |
| SCNN1A-6618 | - | CCAGGUUGGACCCUGAGCC | 19 | 10467 |
| SCNN1A-5581 | - | ACCAGGUUGGACCCUGAGCC | 20 | 9430 |
| SCNN1A-6619 | - | AGACCAGGUUGGACCCUGAGCC | 22 | 10468 |
| SCNN1A-6620 | - | CAGACCAGGUUGGACCCUGAGCC | 23 | 10469 |
| SCNN1A-6621 | - | ACAGACCAGGUUGGACCCUGAGCC | 24 | 10470 |
| SCNN1A-6622 | - | UGCGUCUAAAGCCCCUGCC | 19 | 10471 |
| SCNN1A-6623 | - | CUGCGUCUAAAGCCCCUGCC | 20 | 10472 |
| SCNN1A-6624 | - | UCUGCGUCUAAAGCCCCUGCC | 21 | 10473 |
| SCNN1A-6625 | - | UGUCUGCGUCUAAAGCCCCUGCC | 23 | 10474 |
| SCNN1A-6626 | - | CUGUCUGCGUCUAAAGCCCCUGCC | 24 | 10475 |
| SCNN1A-1394 | - | CAGCCUCACUCGGGUUCC | 18 | 5243 |
| SCNN1A-6627 | - | CCUUUGAGAUCAAACAGC | 18 | 10476 |
| SCNN1A-6628 | - | ACCUUUGAGAUCAAACAGC | 19 | 10477 |
| SCNN1A-6629 | - | AACCUUUGAGAUCAAACAGC | 20 | 10478 |
| SCNN1A-6630 | - | AGAACCUUUGAGAUCAAACAGC | 22 | 10479 |
| SCNN1A-6631 | - | CAGAACCUUUGAGAUCAAACAGC | 23 | 10480 |
| SCNN1A-6632 | - | UCAGAACCUUUGAGAUCAAACAGC | 24 | 10481 |
| SCNN1A-6633 | - | CCCUGCCGCGUGCAGGGC | 18 | 10482 |
| SCNN1A-6634 | - | UCCCUGCCGCGUGCAGGGC | 19 | 10483 |
| SCNN1A-6635 | - | UUCCCUGCCGCGUGCAGGGC | 20 | 10484 |
| SCNN1A-6636 | - | CUUCCCUGCCGCGUGCAGGGC | 21 | 10485 |
| SCNN1A-6637 | - | CCUUCCCUGCCGCGUGCAGGGC | 22 | 10486 |
| SCNN1A-6638 | - | AGCCUUCCCUGCCGCGUGCAGGGC | 24 | 10487 |
| SCNN1A-6639 | - | AGCUUCACCUGGGCCCUC | 19 | 10488 |
| SCNN1A-6640 | - | CAGCUUCACCUGGGCCCUC | 20 | 10489 |

TABLE 47B-continued

2nd Tier

| gRNA Name | DNA Strand | Targeting Domain | Target Site Length | Seq ID |
|---|---|---|---|---|
| SCNN1A-6641 | - | CCAGCUUCACCUGGGCCCCUC | 21 | 10490 |
| SCNN1A-6642 | - | CCCAGCUUCACCUGGGCCCCUC | 22 | 10491 |
| SCNN1A-6643 | - | CCCCAGCUUCACCUGGGCCCCUC | 23 | 10492 |
| SCNN1A-6644 | - | CCCCCAGCUUCACCUGGGCCCCUC | 24 | 10493 |
| SCNN1A-6645 | - | UGGAGUUUCUAGGGGUCUC | 19 | 10494 |
| SCNN1A-5635 | - | CUGGAGUUUCUAGGGGUCUC | 20 | 9484 |
| SCNN1A-6646 | - | ACUGGAGUUUCUAGGGGUCUC | 21 | 10495 |
| SCNN1A-6647 | - | AGACUGGAGUUUCUAGGGGUCUC | 23 | 10496 |
| SCNN1A-6648 | - | CCAGCACCCAGAGAGCAG | 18 | 10497 |
| SCNN1A-6649 | - | CCCAGCACCCAGAGAGCAG | 19 | 10498 |
| SCNN1A-6650 | - | ACCCAGCACCCAGAGAGCAG | 20 | 10499 |
| SCNN1A-6651 | - | AACCCAGCACCCAGAGAGCAG | 21 | 10500 |
| SCNN1A-6652 | - | UAACCCAGCACCCAGAGAGCAG | 22 | 10501 |
| SCNN1A-6653 | - | AUAACCCAGCACCCAGAGAGCAG | 23 | 10502 |
| SCNN1A-6654 | - | AUAGCCCCAGAGGAGGAG | 18 | 10503 |
| SCNN1A-6655 | - | AGAUAGCCCCAGAGGAGGAG | 20 | 10504 |
| SCNN1A-6656 | - | UAGAUAGCCCCAGAGGAGGAG | 21 | 10505 |
| SCNN1A-6657 | - | AGUAGAUAGCCCCAGAGGAGGAG | 23 | 10506 |
| SCNN1A-6658 | - | AAGUAGAUAGCCCCAGAGGAGGAG | 24 | 10507 |
| SCNN1A-6659 | - | AGUGGGAGAAUGUGGGCG | 18 | 10508 |
| SCNN1A-6660 | - | AGGUUGGAGGGGUGGCG | 18 | 10509 |
| SCNN1A-6661 | - | AAGGUUGGAGGGGUGGCG | 19 | 10510 |
| SCNN1A-5670 | - | CAAGGUUGGAGGGGUGGCG | 20 | 9519 |
| SCNN1A-6662 | - | ACAAGGUUGGAGGGGUGGCG | 21 | 10511 |
| SCNN1A-6663 | - | UGGACAAGGUUGGAGGGGUGGCG | 24 | 10512 |
| SCNN1A-6664 | - | AACUGAUUUAUCCUUGGG | 18 | 10513 |
| SCNN1A-6665 | - | AAACUGAUUUAUCCUUGGG | 19 | 10514 |
| SCNN1A-6666 | - | AAAACUGAUUUAUCCUUGGG | 20 | 10515 |
| SCNN1A-6667 | - | UGCUGCCUUAAGCUAGUGG | 19 | 10516 |
| SCNN1A-6668 | - | AUGCUGCCUUAAGCUAGUGG | 20 | 10517 |
| SCNN1A-6669 | - | CAUGCUGCCUUAAGCUAGUGG | 21 | 10518 |
| SCNN1A-6670 | - | CCAUGCUGCCUUAAGCUAGUGG | 22 | 10519 |
| SCNN1A-6671 | - | UGCCAUGCUGCCUUAAGCUAGUGG | 24 | 10520 |
| SCNN1A-6672 | - | CCAGUCCAGCCGCAACCU | 18 | 10521 |
| SCNN1A-6673 | - | CCCAGUCCAGCCGCAACCU | 19 | 10522 |
| SCNN1A-5731 | - | UCCCAGUCCAGCCGCAACCU | 20 | 9580 |
| SCNN1A-6674 | - | AGUCCCAGUCCAGCCGCAACCU | 22 | 10523 |

TABLE 47B-continued

| | | 2nd Tier | | |
|---|---|---|---|---|
| gRNA Name | DNA Strand | Targeting Domain | Target Site Length | Seq ID |
| SCNN1A-6675 | − | CAGUCCCAGUCCAGCCGCAACCU | 23 | 10524 |
| SCNN1A-6676 | − | CCAGUCCCAGUCCAGCCGCAACCU | 24 | 10525 |
| SCNN1A-6677 | − | UGAGGGUGAGGCUGACCU | 18 | 10526 |
| SCNN1A-6678 | − | CUGAGGGUGAGGCUGACCU | 19 | 10527 |
| SCNN1A-6679 | − | CCUGAGGGUGAGGCUGACCU | 20 | 10528 |
| SCNN1A-6680 | − | AGGGCCUGAGGGUGAGGCUGACCU | 24 | 10529 |
| SCNN1A-6681 | − | CUCUUCUCUGCAGGGCCU | 18 | 10530 |
| SCNN1A-6682 | − | UCUCUUCUCUGCAGGGCCU | 19 | 10531 |
| SCNN1A-6683 | − | CUCUCUUCUCUGCAGGGCCU | 20 | 10532 |
| SCNN1A-6684 | − | UCUCUCUUCUCUGCAGGGCCU | 21 | 10533 |
| SCNN1A-6685 | − | UUCUCUCUUCUCUGCAGGGCCU | 22 | 10534 |
| SCNN1A-6686 | − | CUUCUCUCUUCUCUGCAGGGCCU | 23 | 10535 |
| SCNN1A-6687 | − | UCUUCUCUCUUCUCUGCAGGGCCU | 24 | 10536 |
| SCNN1A-6688 | − | CCUGCCUCUUCCUGGGCU | 18 | 10537 |
| SCNN1A-6689 | − | CCCUGCCUCUUCCUGGGCU | 19 | 10538 |
| SCNN1A-6690 | − | UCCCUGCCUCUUCCUGGGCU | 20 | 10539 |
| SCNN1A-6691 | − | CCCUCCUAGCUGUGGGCU | 18 | 10540 |
| SCNN1A-6692 | − | UGCCCUCCUAGCUGUGGGCU | 20 | 10541 |
| SCNN1A-6693 | − | AGGGAGACUGGAGUUUCU | 18 | 10542 |
| SCNN1A-6694 | − | AAGGGAGACUGGAGUUUCU | 19 | 10543 |
| SCNN1A-5751 | − | CAAGGGAGACUGGAGUUUCU | 20 | 9600 |
| SCNN1A-6695 | − | UCAAGGGAGACUGGAGUUUCU | 21 | 10544 |
| SCNN1A-6696 | − | CUCAAGGGAGACUGGAGUUUCU | 22 | 10545 |
| SCNN1A-6697 | − | AAUCCACGGGCUCUGUGU | 18 | 10546 |
| SCNN1A-5766 | − | CGAAUCCACGGGCUCUGUGU | 20 | 9615 |
| SCNN1A-6698 | − | ACGAAUCCACGGGCUCUGUGU | 21 | 10547 |
| SCNN1A-6699 | − | AGACGAAUCCACGGGCUCUGUGU | 23 | 10548 |
| SCNN1A-6700 | − | CAGACGAAUCCACGGGCUCUGUGU | 24 | 10549 |
| SCNN1A-6701 | − | CGUGCAGGGCCUGGGUUGU | 19 | 10550 |
| SCNN1A-6702 | − | CGCGUGCAGGGCCUGGGUUGU | 21 | 10551 |
| SCNN1A-6703 | − | CCGCGUGCAGGGCCUGGGUUGU | 22 | 10552 |
| SCNN1A-6704 | − | UGCCGCGUGCAGGGCCUGGGUUGU | 24 | 10553 |
| SCNN1A-1405 | − | AAGCAAGGGAACCUGGUU | 18 | 5254 |
| SCNN1A-1406 | − | UAAGCAAGGGAACCUGGUU | 19 | 5255 |
| SCNN1A-1407 | − | AGGUAAGCAAGGGAACCUGGUU | 22 | 5256 |
| SCNN1A-1408 | − | AAGGUAAGCAAGGGAACCUGGUU | 23 | 5257 |
| SCNN1A-1409 | − | CAAGGUAAGCAAGGGAACCUGGUU | 24 | 5258 |
| SCNN1A-6705 | − | AGUCUCCUCCAGCCCUUU | 18 | 10554 |

TABLE 47B-continued

2nd Tier

| gRNA Name | DNA Strand | Targeting Domain | Target Site Length | Seq ID |
|---|---|---|---|---|
| SCNN1A-6706 | - | CGAGUCUCCUCCAGCCCUUU | 20 | 10555 |
| SCNN1A-6707 | - | CCGAGUCUCCUCCAGCCCUUU | 21 | 10556 |
| SCNN1A-6708 | - | CCCGAGUCUCCUCCAGCCCUUU | 22 | 10557 |
| SCNN1A-6709 | - | UCCCGAGUCUCCUCCAGCCCUUU | 23 | 10558 |
| SCNN1A-6710 | - | CUCCCGAGUCUCCUCCAGCCCUUU | 24 | 10559 |

Table 47C provides exemplary targeting domains for knocking down the SCNN1A gene selected according to the third tier parameters. The targeting domains bind within 500 bp (e.g., upstream or downstream) of a transcription start site (TSS), and PAM is NNGRRT. It is contemplated herein that in an embodiment the targeting domain hybridizes to the target domain through complementary base pairing. Any of the targeting domains in the table can be used with a S. Aureus eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 47C

3rd Tier

| gRNA Name | DNA Strand | Targeting Domain | Target Site Length | Seq ID |
|---|---|---|---|---|
| SCNN1A-6711 | + | AUAGAAGGAGCCAGCACCAAA | 21 | 10560 |
| SCNN1A-6712 | + | AAUAGAAGGAGCCAGCACCAAA | 22 | 10561 |
| SCNN1A-6713 | + | AAAUAGAAGGAGCCAGCACCAAA | 23 | 10562 |
| SCNN1A-6714 | + | CAAAUAGAAGGAGCCAGCACCAAA | 24 | 10563 |
| SCNN1A-6715 | + | CCAAACUUAAUGCAGCAA | 18 | 10564 |
| SCNN1A-6716 | + | UCCAAACUUAAUGCAGCAA | 19 | 10565 |
| SCNN1A-6717 | + | UUCCAAACUUAAUGCAGCAA | 20 | 10566 |
| SCNN1A-6718 | + | GAUAGGGAUGGAGGAGGGGCA | 21 | 10567 |
| SCNN1A-6719 | + | AGAUAGGGAUGGAGGAGGGGCA | 22 | 10568 |
| SCNN1A-6720 | + | GAGAUAGGGAUGGAGGAGGGGCA | 23 | 10569 |
| SCNN1A-6721 | + | AGAGAUAGGGAUGGAGGAGGGGCA | 24 | 10570 |
| SCNN1A-6722 | + | GGAGAGAGAGGAGGGUCA | 18 | 10571 |
| SCNN1A-6723 | + | AGGAGAGAGAGGAGGGUCA | 19 | 10572 |
| SCNN1A-6724 | + | AAGGAGAGAGAGGAGGGUCA | 20 | 10573 |
| SCNN1A-6725 | + | CAAGGAGAGAGAGGAGGGUCA | 21 | 10574 |
| SCNN1A-6726 | + | GCAAGGAGAGAGAGGAGGGUCA | 22 | 10575 |
| SCNN1A-6727 | + | AGCAAGGAGAGAGAGGAGGGUCA | 23 | 10576 |
| SCNN1A-6728 | + | GAGCAAGGAGAGAGAGGAGGGUCA | 24 | 10577 |
| SCNN1A-1410 | + | CCCUUCAUGAGCCCCGGA | 18 | 5259 |
| SCNN1A-1411 | + | CCCCUUCAUGAGCCCCGGA | 19 | 5260 |
| SCNN1A-1412 | + | UCCCCUUCAUGAGCCCCGGA | 20 | 5261 |
| SCNN1A-1413 | + | UUCCCCUUCAUGAGCCCCGGA | 21 | 5262 |
| SCNN1A-1414 | + | GUUCCCCUUCAUGAGCCCCGGA | 22 | 5263 |

TABLE 47C-continued

3rd Tier

| gRNA Name | DNA Strand | Targeting Domain | Target Site Length | Seq ID |
|---|---|---|---|---|
| SCNN1A-1415 | + | UGUUCCCCUUCAUGAGCCCCGGA | 23 | 5264 |
| SCNN1A-1416 | + | UUGUUCCCCUUCAUGAGCCCCGGA | 24 | 5265 |
| SCNN1A-6729 | + | GGCAAGGAGGCUGGGGGA | 18 | 10578 |
| SCNN1A-6730 | + | AGGCAAGGAGGCUGGGGGA | 19 | 10579 |
| SCNN1A-6731 | + | CAGGCAAGGAGGCUGGGGGA | 20 | 10580 |
| SCNN1A-6732 | + | ACAGGCAAGGAGGCUGGGGGA | 21 | 10581 |
| SCNN1A-6733 | + | GACAGGCAAGGAGGCUGGGGGA | 22 | 10582 |
| SCNN1A-6734 | + | AGACAGGCAAGGAGGCUGGGGGA | 23 | 10583 |
| SCNN1A-6735 | + | CAGACAGGCAAGGAGGCUGGGGGA | 24 | 10584 |
| SCNN1A-6736 | + | AUGGAGGAGGGGCACUGA | 18 | 10585 |
| SCNN1A-6737 | + | GAUGGAGGAGGGGCACUGA | 19 | 10586 |
| SCNN1A-6738 | + | GGAUGGAGGAGGGGCACUGA | 20 | 10587 |
| SCNN1A-6739 | + | GGGAUGGAGGAGGGGCACUGA | 21 | 10588 |
| SCNN1A-6740 | + | AGGGAUGGAGGAGGGGCACUGA | 22 | 10589 |
| SCNN1A-6741 | + | UAGGGAUGGAGGAGGGGCACUGA | 23 | 10590 |
| SCNN1A-6742 | + | AUAGGGAUGGAGGAGGGGCACUGA | 24 | 10591 |
| SCNN1A-6743 | + | ACUUAAUGCAGCAAAAGGAUA | 21 | 10592 |
| SCNN1A-6744 | + | AACUUAAUGCAGCAAAAGGAUA | 22 | 10593 |
| SCNN1A-6745 | + | AAACUUAAUGCAGCAAAAGGAUA | 23 | 10594 |
| SCNN1A-6746 | + | CAAACUUAAUGCAGCAAAAGGAUA | 24 | 10595 |
| SCNN1A-6747 | + | CCUCACUCCCACACAGAGCCC | 21 | 10596 |
| SCNN1A-6748 | + | CCCUCACUCCCACACAGAGCCC | 22 | 10597 |
| SCNN1A-6749 | + | UCCCUCACUCCCACACAGAGCCC | 23 | 10598 |
| SCNN1A-6750 | + | CUCCCUCACUCCCACACAGAGCCC | 24 | 10599 |
| SCNN1A-1417 | + | GUUCCCCUUCAUGAGCCC | 18 | 5266 |
| SCNN1A-1418 | + | UGUUCCCCUUCAUGAGCCC | 19 | 5267 |
| SCNN1A-72 | + | UUGUUCCCCUUCAUGAGCCC | 20 | 599 |
| SCNN1A-1419 | + | CUUGUUCCCCUUCAUGAGCCC | 21 | 5268 |
| SCNN1A-1420 | + | GCUUGUUCCCCUUCAUGAGCCC | 22 | 5269 |
| SCNN1A-1421 | + | AGCUUGUUCCCCUUCAUGAGCCC | 23 | 5270 |
| SCNN1A-1422 | + | CAGCUUGUUCCCCUUCAUGAGCCC | 24 | 5271 |
| SCNN1A-6751 | + | GGCUGAGGAGGAGUCAGAGCC | 21 | 10600 |
| SCNN1A-6752 | + | GGGCUGAGGAGGAGUCAGAGCC | 22 | 10601 |
| SCNN1A-6753 | + | GGGGCUGAGGAGGAGUCAGAGCC | 23 | 10602 |
| SCNN1A-6754 | + | AGGGGCUGAGGAGGAGUCAGAGCC | 24 | 10603 |
| SCNN1A-6755 | + | CAGCCAGGCUGAGAGGGC | 18 | 10604 |
| SCNN1A-6756 | + | CCAGCCAGGCUGAGAGGGC | 19 | 10605 |

TABLE 47C-continued

3rd Tier

| gRNA Name | DNA Strand | Targeting Domain | Target Site Length | Seq ID |
|---|---|---|---|---|
| SCNN1A-6757 | + | GCCAGCCAGGCUGAGAGGGC | 20 | 10606 |
| SCNN1A-6758 | + | GGCCAGCCAGGCUGAGAGGGC | 21 | 10607 |
| SCNN1A-6759 | + | GGGCCAGCCAGGCUGAGAGGGC | 22 | 10608 |
| SCNN1A-6760 | + | GGGGCCAGCCAGGCUGAGAGGGC | 23 | 10609 |
| SCNN1A-6761 | + | AGGGGCCAGCCAGGCUGAGAGGGC | 24 | 10610 |
| SCNN1A-1431 | + | GAGUGGACUGUGGAGGGC | 18 | 5280 |
| SCNN1A-1432 | + | GGAGUGGACUGUGGAGGGC | 19 | 5281 |
| SCNN1A-201 | + | UGGAGUGGACUGUGGAGGGC | 20 | 830 |
| SCNN1A-6762 | + | UCCUGGAGCCAGCAGACCUGC | 21 | 10611 |
| SCNN1A-6763 | + | UUCCUGGAGCCAGCAGACCUGC | 22 | 10612 |
| SCNN1A-6764 | + | UUUCCUGGAGCCAGCAGACCUGC | 23 | 10613 |
| SCNN1A-6765 | + | CUUUCCUGGAGCCAGCAGACCUGC | 24 | 10614 |
| SCNN1A-6766 | + | CUUCCUUUGGUCUUCUUCCUC | 21 | 10615 |
| SCNN1A-6767 | + | CCUUCCUUUGGUCUUCUUCCUC | 22 | 10616 |
| SCNN1A-6768 | + | CCCUUCCUUUGGUCUUCUUCCUC | 23 | 10617 |
| SCNN1A-6769 | + | CCCCUUCCUUUGGUCUUCUUCCUC | 24 | 10618 |
| SCNN1A-6770 | + | GUGAGCAAGGAGAGAGAG | 18 | 10619 |
| SCNN1A-6771 | + | GGUGAGCAAGGAGAGAGAG | 19 | 10620 |
| SCNN1A-6772 | + | UGGUGAGCAAGGAGAGAGAG | 20 | 10621 |
| SCNN1A-6773 | + | GUGGUGAGCAAGGAGAGAGAG | 21 | 10622 |
| SCNN1A-6774 | + | AGUGGUGAGCAAGGAGAGAGAG | 22 | 10623 |
| SCNN1A-6775 | + | AAGUGGUGAGCAAGGAGAGAGAG | 23 | 10624 |
| SCNN1A-6776 | + | CAAGUGGUGAGCAAGGAGAGAGAG | 24 | 10625 |
| SCNN1A-6777 | + | AAAGAUCUGAACAAGUAG | 18 | 10626 |
| SCNN1A-6778 | + | CAAAGAUCUGAACAAGUAG | 19 | 10627 |
| SCNN1A-6779 | + | GCAAAGAUCUGAACAAGUAG | 20 | 10628 |
| SCNN1A-6780 | + | AGCAGGCACUGAAGGUGCAGG | 21 | 10629 |
| SCNN1A-6781 | + | AAGCAGGCACUGAAGGUGCAGG | 22 | 10630 |
| SCNN1A-6782 | + | AAAGCAGGCACUGAAGGUGCAGG | 23 | 10631 |
| SCNN1A-6783 | + | GAAAGCAGGCACUGAAGGUGCAGG | 24 | 10632 |
| SCNN1A-6784 | + | CGGGGGAGGGGCUGAGG | 18 | 10633 |
| SCNN1A-6785 | + | GCGGGGGAGGGGCUGAGG | 19 | 10634 |
| SCNN1A-5907 | + | GGCGGGGGAGGGGCUGAGG | 20 | 9756 |
| SCNN1A-6786 | + | GGGCGGGGGAGGGGCUGAGG | 21 | 10635 |
| SCNN1A-6787 | + | AGGGCGGGGGAGGGGCUGAGG | 22 | 10636 |
| SCNN1A-6788 | + | CAGGGCGGGGGAGGGGCUGAGG | 23 | 10637 |
| SCNN1A-6789 | + | GCAGGGCGGGGGAGGGGCUGAGG | 24 | 10638 |
| SCNN1A-6790 | + | CUCCAGGAAGGAGAGCAAGGG | 21 | 10639 |

TABLE 47C-continued

3rd Tier

| gRNA Name | DNA Strand | Targeting Domain | Target Site Length | Seq ID |
|---|---|---|---|---|
| SCNN1A-6791 | + | UCUCCAGGAAGGAGAGCAAGGG | 22 | 10640 |
| SCNN1A-6792 | + | GUCUCCAGGAAGGAGAGCAAGGG | 23 | 10641 |
| SCNN1A-6793 | + | UGUCUCCAGGAAGGAGAGCAAGGG | 24 | 10642 |
| SCNN1A-6794 | + | GAGAAGGUGUCAUCUCUG | 18 | 10643 |
| SCNN1A-6795 | + | AGAGAAGGUGUCAUCUCUG | 19 | 10644 |
| SCNN1A-6796 | + | CAGAGAAGGUGUCAUCUCUG | 20 | 10645 |
| SCNN1A-6797 | + | CCAGAGAAGGUGUCAUCUCUG | 21 | 10646 |
| SCNN1A-6798 | + | CCCAGAGAAGGUGUCAUCUCUG | 22 | 10647 |
| SCNN1A-6799 | + | UCCCAGAGAAGGUGUCAUCUCUG | 23 | 10648 |
| SCNN1A-6800 | + | UUCCCAGAGAAGGUGUCAUCUCUG | 24 | 10649 |
| SCNN1A-6801 | + | GACAGCGAAGGACAGAGAGAU | 21 | 10650 |
| SCNN1A-6802 | + | GGACAGCGAAGGACAGAGAGAU | 22 | 10651 |
| SCNN1A-6803 | + | GGGACAGCGAAGGACAGAGAGAU | 23 | 10652 |
| SCNN1A-6804 | + | AGGGACAGCGAAGGACAGAGAGAU | 24 | 10653 |
| SCNN1A-6805 | + | GCUCCCGAGGGCAGGUGAACU | 21 | 10654 |
| SCNN1A-6806 | + | GGCUCCCGAGGGCAGGUGAACU | 22 | 10655 |
| SCNN1A-6807 | + | GGGCUCCCGAGGGCAGGUGAACU | 23 | 10656 |
| SCNN1A-6808 | + | AGGGCUCCCGAGGGCAGGUGAACU | 24 | 10657 |
| SCNN1A-6809 | + | GAAAAGGCAGUACUCCAGGCU | 21 | 10658 |
| SCNN1A-6810 | + | AGAAAAGGCAGUACUCCAGGCU | 22 | 10659 |
| SCNN1A-6811 | + | GAGAAAAGGCAGUACUCCAGGCU | 23 | 10660 |
| SCNN1A-6812 | + | AGAGAAAAGGCAGUACUCCAGGCU | 24 | 10661 |
| SCNN1A-6813 | + | CCCUGAUAGGGCCACCUU | 18 | 10662 |
| SCNN1A-6814 | + | UCCCUGAUAGGGCCACCUU | 19 | 10663 |
| SCNN1A-6815 | + | UUCCCUGAUAGGGCCACCUU | 20 | 10664 |
| SCNN1A-6816 | − | UGGAGAAAAUAUAGCCCAUCA | 21 | 10665 |
| SCNN1A-6817 | − | UUGGAGAAAAUAUAGCCCAUCA | 22 | 10666 |
| SCNN1A-6818 | − | UUUGGAGAAAAUAUAGCCCAUCA | 23 | 10667 |
| SCNN1A-6819 | − | UUUUGGAGAAAAUAUAGCCCAUCA | 24 | 10668 |
| SCNN1A-6820 | − | CCUGCAGUCCUGGGGCAGAGA | 21 | 10669 |
| SCNN1A-6821 | − | CCCUGCAGUCCUGGGGCAGAGA | 22 | 10670 |
| SCNN1A-6822 | − | GCCCUGCAGUCCUGGGGCAGAGA | 23 | 10671 |
| SCNN1A-6823 | − | AGCCCUGCAGUCCUGGGGCAGAGA | 24 | 10672 |
| SCNN1A-6824 | − | ACAGAAGGCAGAUAGAGA | 18 | 10673 |
| SCNN1A-6825 | − | AACAGAAGGCAGAUAGAGA | 19 | 10674 |
| SCNN1A-6088 | − | AAACAGAAGGCAGAUAGAGA | 20 | 9937 |
| SCNN1A-6826 | − | GAAACAGAAGGCAGAUAGAGA | 21 | 10675 |

TABLE 47C-continued

3rd Tier

| gRNA Name | DNA Strand | Targeting Domain | Target Site Length | Seq ID |
|---|---|---|---|---|
| SCNN1A-6827 | - | AGAAACAGAAGGCAGAUAGAGA | 22 | 10676 |
| SCNN1A-6828 | - | GAGAAACAGAAGGCAGAUAGAGA | 23 | 10677 |
| SCNN1A-6829 | - | AGAGAAACAGAAGGCAGAUAGAGA | 24 | 10678 |
| SCNN1A-1437 | - | CAUGGCCAGGGGCAGCCUCAC | 21 | 5286 |
| SCNN1A-1438 | - | GCAUGGCCAGGGGCAGCCUCAC | 22 | 5287 |
| SCNN1A-1439 | - | GGCAUGGCCAGGGGCAGCCUCAC | 23 | 5288 |
| SCNN1A-1440 | - | GGGCAUGGCCAGGGGCAGCCUCAC | 24 | 5289 |
| SCNN1A-6830 | - | AGGACCUGGCUCAAGGGAGAC | 21 | 10679 |
| SCNN1A-6831 | - | AAGGACCUGGCUCAAGGGAGAC | 22 | 10680 |
| SCNN1A-6832 | - | UAAGGACCUGGCUCAAGGGAGAC | 23 | 10681 |
| SCNN1A-6833 | - | GUAAGGACCUGGCUCAAGGGAGAC | 24 | 10682 |
| SCNN1A-6834 | - | AGGCUGGAGCUGAGGGCC | 18 | 10683 |
| SCNN1A-6835 | - | GAGGCUGGAGCUGAGGGCC | 19 | 10684 |
| SCNN1A-6836 | - | AGAGGCUGGAGCUGAGGGCC | 20 | 10685 |
| SCNN1A-6837 | - | CAGAGGCUGGAGCUGAGGGCC | 21 | 10686 |
| SCNN1A-6838 | - | CCAGAGGCUGGAGCUGAGGGCC | 22 | 10687 |
| SCNN1A-6839 | - | GCCAGAGGCUGGAGCUGAGGGCC | 23 | 10688 |
| SCNN1A-6840 | - | GGCCAGAGGCUGGAGCUGAGGGCC | 24 | 10689 |
| SCNN1A-1441 | - | GGGCAGCCUCACUCGGGUUCC | 21 | 5290 |
| SCNN1A-1442 | - | GGGGCAGCCUCACUCGGGUUCC | 22 | 5291 |
| SCNN1A-1443 | - | AGGGGCAGCCUCACUCGGGUUCC | 23 | 5292 |
| SCNN1A-1444 | - | CAGGGGCAGCCUCACUCGGGUUCC | 24 | 5293 |
| SCNN1A-6841 | - | UGGGUUGUGUGGGUGGCUCUC | 21 | 10690 |
| SCNN1A-6842 | - | CUGGGUUGUGUGGGUGGCUCUC | 22 | 10691 |
| SCNN1A-6843 | - | CCUGGGUUGUGUGGGUGGCUCUC | 23 | 10692 |
| SCNN1A-6844 | - | GCCUGGGUUGUGUGGGUGGCUCUC | 24 | 10693 |
| SCNN1A-6845 | - | CUUCUCUGGGAAGGCUUC | 18 | 10694 |
| SCNN1A-6846 | - | CCUUCUCUGGGAAGGCUUC | 19 | 10695 |
| SCNN1A-6847 | - | ACCUUCUCUGGGAAGGCUUC | 20 | 10696 |
| SCNN1A-6848 | - | CACCUUCUCUGGGAAGGCUUC | 21 | 10697 |
| SCNN1A-6849 | - | ACACCUUCUCUGGGAAGGCUUC | 22 | 10698 |
| SCNN1A-6850 | - | GACACCUUCUCUGGGAAGGCUUC | 23 | 10699 |
| SCNN1A-6851 | - | UGACACCUUCUCUGGGAAGGCUUC | 24 | 10700 |
| SCNN1A-6852 | - | AGGAGUGGGAGAAUGUGGGCG | 21 | 10701 |
| SCNN1A-6853 | - | GAGGAGUGGGAGAAUGUGGGCG | 22 | 10702 |
| SCNN1A-6854 | - | GGAGGAGUGGGAGAAUGUGGGCG | 23 | 10703 |
| SCNN1A-6855 | - | GGGAGGAGUGGGAGAAUGUGGGCG | 24 | 10704 |
| SCNN1A-6856 | - | GGGGGAGAGGAAGAGAGG | 18 | 10705 |

TABLE 47C-continued

3rd Tier

| gRNA Name | DNA Strand | Targeting Domain | Target Site Length | Seq ID |
|---|---|---|---|---|
| SCNN1A-6857 | - | GGGGGGAGAGGAAGAGAGG | 19 | 10706 |
| SCNN1A-6858 | - | GGGGGGGAGAGGAAGAGAGG | 20 | 10707 |
| SCNN1A-6859 | - | AGGGGGGGAGAGGAAGAGAGG | 21 | 10708 |
| SCNN1A-6860 | - | AAGGGGGGGAGAGGAAGAGAGG | 22 | 10709 |
| SCNN1A-6861 | - | CAAGGGGGGGAGAGGAAGAGAGG | 23 | 10710 |
| SCNN1A-6862 | - | GCAAGGGGGGGAGAGGAAGAGAGG | 24 | 10711 |
| SCNN1A-6863 | - | AAGGUGGAGGAGGGAGGG | 18 | 10712 |
| SCNN1A-6864 | - | AAAGGUGGAGGAGGGAGGG | 19 | 10713 |
| SCNN1A-5911 | - | GAAAGGUGGAGGAGGGAGGG | 20 | 9760 |
| SCNN1A-6865 | - | GGAAAGGUGGAGGAGGGAGGG | 21 | 10714 |
| SCNN1A-6866 | - | AGGAAAGGUGGAGGAGGGAGGG | 22 | 10715 |
| SCNN1A-6867 | - | CAGGAAAGGUGGAGGAGGGAGGG | 23 | 10716 |
| SCNN1A-6868 | - | CCAGGAAAGGUGGAGGAGGGAGGG | 24 | 10717 |
| SCNN1A-6869 | - | GAAAACUGAUUUAUCCUUGGG | 21 | 10718 |
| SCNN1A-6870 | - | AGAAAACUGAUUUAUCCUUGGG | 22 | 10719 |
| SCNN1A-6871 | - | CAGAAAACUGAUUUAUCCUUGGG | 23 | 10720 |
| SCNN1A-6872 | - | UCAGAAAACUGAUUUAUCCUUGGG | 24 | 10721 |
| SCNN1A-6873 | - | GGAGGGAGGGAGGAGUGG | 18 | 10722 |
| SCNN1A-6874 | - | AGGAGGGAGGGAGGAGUGG | 19 | 10723 |
| SCNN1A-6875 | - | GAGGAGGGAGGGAGGAGUGG | 20 | 10724 |
| SCNN1A-6876 | - | GGAGGAGGGAGGGAGGAGUGG | 21 | 10725 |
| SCNN1A-6877 | - | UGGAGGAGGGAGGGAGGAGUGG | 22 | 10726 |
| SCNN1A-6878 | - | GUGGAGGAGGGAGGGAGGAGUGG | 23 | 10727 |
| SCNN1A-6879 | - | GGUGGAGGAGGGAGGGAGGAGUGG | 24 | 10728 |
| SCNN1A-6880 | - | UUCCCUGCCUCUUCCUGGGCU | 21 | 10729 |
| SCNN1A-6881 | - | UUUCCCUGCCUCUUCCUGGGCU | 22 | 10730 |
| SCNN1A-6882 | - | CUUUCCCUGCCUCUUCCUGGGCU | 23 | 10731 |
| SCNN1A-6883 | - | GCUUUCCCUGCCUCUUCCUGGGCU | 24 | 10732 |
| SCNN1A-6884 | - | UUGCCCUCCUAGCUGUGGGCU | 21 | 10733 |
| SCNN1A-6885 | - | GUUGCCCUCCUAGCUGUGGGCU | 22 | 10734 |
| SCNN1A-6886 | - | UGUUGCCCUCCUAGCUGUGGGCU | 23 | 10735 |
| SCNN1A-6887 | - | GUGUUGCCCUCCUAGCUGUGGGCU | 24 | 10736 |
| SCNN1A-6888 | - | CAGAGGAGGAGGAGAAUU | 18 | 10737 |
| SCNN1A-6889 | - | CCAGAGGAGGAGGAGAAUU | 19 | 10738 |
| SCNN1A-6890 | - | CCCAGAGGAGGAGGAGAAUU | 20 | 10739 |
| SCNN1A-6891 | - | CCCCAGAGGAGGAGGAGAAUU | 21 | 10740 |
| SCNN1A-6892 | - | GCCCCAGAGGAGGAGGAGAAUU | 22 | 10741 |

TABLE 47C-continued

| | | 3rd Tier | | |
|---|---|---|---|---|
| gRNA Name | DNA Strand | Targeting Domain | Target Site Length | Seq ID |
| SCNN1A-6893 | - | AGCCCCAGAGGAGGAGGAGAAUU | 23 | 10742 |
| SCNN1A-6894 | - | UAGCCCCAGAGGAGGAGGAGAAUU | 24 | 10743 |

Table 47D provides exemplary targeting domains for knocking down the SCNN1A gene selected according to the fourth tier parameters. The targeting domains bind within 500 bp (e.g., upstream or downstream) of a transcription start site (TSS), and PAM is NNGRRV. It is contemplated herein that in an embodiment the targeting domain hybridizes to the target domain through complementary base pairing. Any of the targeting domains in the table can be used with a *S. Aureus* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 47D

| | | 4th Tier | | |
|---|---|---|---|---|
| gRNA Name | DNA Strand | Targeting Domain | Target Site Length | Seq ID |
| SCNN1A-6895 | + | UGAGGUUAGAAAACAAAA | 18 | 10744 |
| SCNN1A-6896 | + | CUGAGGUUAGAAAACAAAA | 19 | 10745 |
| SCNN1A-6897 | + | UCUGAGGUUAGAAAACAAAA | 20 | 10746 |
| SCNN1A-6898 | + | UUCUGAGGUUAGAAAACAAAA | 21 | 10747 |
| SCNN1A-6899 | + | UUUCUGAGGUUAGAAAACAAAA | 22 | 10748 |
| SCNN1A-6900 | + | UUUUCUGAGGUUAGAAAACAAAA | 23 | 10749 |
| SCNN1A-6901 | + | GUUUUCUGAGGUUAGAAAACAAAA | 24 | 10750 |
| SCNN1A-6902 | + | CAGAGAAUCAGACCCAAA | 18 | 10751 |
| SCNN1A-6903 | + | UCAGAGAAUCAGACCCAAA | 19 | 10752 |
| SCNN1A-6904 | + | GUCAGAGAAUCAGACCCAAA | 20 | 10753 |
| SCNN1A-6905 | + | GGUCAGAGAAUCAGACCCAAA | 21 | 10754 |
| SCNN1A-6906 | + | GGGUCAGAGAAUCAGACCCAAA | 22 | 10755 |
| SCNN1A-6907 | + | AGGGUCAGAGAAUCAGACCCAAA | 23 | 10756 |
| SCNN1A-6908 | + | GAGGGUCAGAGAAUCAGACCCAAA | 24 | 10757 |
| SCNN1A-6909 | + | GGCAGUGGUGGGGCAAA | 18 | 10758 |
| SCNN1A-6910 | + | GGGCAGUGGUGGGGCAAA | 19 | 10759 |
| SCNN1A-6911 | + | GGGGCAGUGGUGGGGCAAA | 20 | 10760 |
| SCNN1A-6912 | + | GGGGGCAGUGGUGGGGCAAA | 21 | 10761 |
| SCNN1A-6913 | + | GGGGGGCAGUGGUGGGGCAAA | 22 | 10762 |
| SCNN1A-6914 | + | UGGGGGGCAGUGGUGGGGCAAA | 23 | 10763 |
| SCNN1A-6915 | + | GUGGGGGGCAGUGGUGGGGCAAA | 24 | 10764 |
| SCNN1A-6916 | + | AGGACAGGAGGGCAGAAA | 18 | 10765 |
| SCNN1A-6917 | + | GAGGACAGGAGGGCAGAAA | 19 | 10766 |
| SCNN1A-6918 | + | GGAGGACAGGAGGGCAGAAA | 20 | 10767 |
| SCNN1A-6919 | + | GGGAGGACAGGAGGGCAGAAA | 21 | 10768 |
| SCNN1A-6920 | + | CGGGAGGACAGGAGGGCAGAAA | 22 | 10769 |

TABLE 47D-continued

4th Tier

| gRNA Name | DNA Strand | Targeting Domain | Target Site Length | Seq ID |
|---|---|---|---|---|
| SCNN1A-6921 | + | CCGGGAGGACAGGAGGGCAGAAA | 23 | 10770 |
| SCNN1A-6922 | + | ACCGGGAGGACAGGAGGGCAGAAA | 24 | 10771 |
| SCNN1A-6923 | + | CUCUUGCGACUUCUUAAA | 18 | 10772 |
| SCNN1A-6924 | + | UCUCUUGCGACUUCUUAAA | 19 | 10773 |
| SCNN1A-6925 | + | GUCUCUUGCGACUUCUUAAA | 20 | 10774 |
| SCNN1A-6926 | + | AGUCUCUUGCGACUUCUUAAA | 21 | 10775 |
| SCNN1A-6927 | + | CAGUCUCUUGCGACUUCUUAAA | 22 | 10776 |
| SCNN1A-6928 | + | GCAGUCUCUUGCGACUUCUUAAA | 23 | 10777 |
| SCNN1A-6929 | + | GGCAGUCUCUUGCGACUUCUUAAA | 24 | 10778 |
| SCNN1A-6930 | + | UAAAAGAUUGUCUUUAAA | 18 | 10779 |
| SCNN1A-6931 | + | UUAAAAGAUUGUCUUUAAA | 19 | 10780 |
| SCNN1A-6932 | + | UUUAAAAGAUUGUCUUUAAA | 20 | 10781 |
| SCNN1A-6933 | + | CUUUAAAAGAUUGUCUUUAAA | 21 | 10782 |
| SCNN1A-6934 | + | ACUUUAAAAGAUUGUCUUUAAA | 22 | 10783 |
| SCNN1A-6935 | + | CACUUUAAAAGAUUGUCUUUAAA | 23 | 10784 |
| SCNN1A-6936 | + | ACACUUUAAAAGAUUGUCUUUAAA | 24 | 10785 |
| SCNN1A-6937 | + | GCAGAAAGAGGGAGACAA | 18 | 10786 |
| SCNN1A-6938 | + | GGCAGAAAGAGGGAGACAA | 19 | 10787 |
| SCNN1A-6939 | + | GGGCAGAAAGAGGGAGACAA | 20 | 10788 |
| SCNN1A-6940 | + | AGGGCAGAAAGAGGGAGACAA | 21 | 10789 |
| SCNN1A-6941 | + | GAGGGCAGAAAGAGGGAGACAA | 22 | 10790 |
| SCNN1A-6942 | + | GGAGGGCAGAAAGAGGGAGACAA | 23 | 10791 |
| SCNN1A-6943 | + | AGGAGGGCAGAAAGAGGGAGACAA | 24 | 10792 |
| SCNN1A-6944 | + | AGAAGGAGCCAGCACCAA | 18 | 10793 |
| SCNN1A-6945 | + | UAGAAGGAGCCAGCACCAA | 19 | 10794 |
| SCNN1A-5518 | + | AUAGAAGGAGCCAGCACCAA | 20 | 9367 |
| SCNN1A-6946 | + | AAUAGAAGGAGCCAGCACCAA | 21 | 10795 |
| SCNN1A-6947 | + | AAAUAGAAGGAGCCAGCACCAA | 22 | 10796 |
| SCNN1A-6948 | + | CAAAUAGAAGGAGCCAGCACCAA | 23 | 10797 |
| SCNN1A-6949 | + | GCAAAUAGAAGGAGCCAGCACCAA | 24 | 10798 |
| SCNN1A-6950 | + | GAGCUAGAGGCUCAGCAA | 18 | 10799 |
| SCNN1A-6951 | + | GGAGCUAGAGGCUCAGCAA | 19 | 10800 |
| SCNN1A-6952 | + | AGGAGCUAGAGGCUCAGCAA | 20 | 10801 |
| SCNN1A-6953 | + | CAGGAGCUAGAGGCUCAGCAA | 21 | 10802 |
| SCNN1A-6954 | + | CCAGGAGCUAGAGGCUCAGCAA | 22 | 10803 |
| SCNN1A-6955 | + | UCCAGGAGCUAGAGGCUCAGCAA | 23 | 10804 |
| SCNN1A-6956 | + | UUCCAGGAGCUAGAGGCUCAGCAA | 24 | 10805 |

TABLE 47D-continued

4th Tier

| gRNA Name | DNA Strand | Targeting Domain | Target Site Length | Seq ID |
|---|---|---|---|---|
| SCNN1A-6957 | + | CUCCAGGAAGGAGAGCAA | 18 | 10806 |
| SCNN1A-6958 | + | UCUCCAGGAAGGAGAGCAA | 19 | 10807 |
| SCNN1A-5168 | + | GUCUCCAGGAAGGAGAGCAA | 20 | 9017 |
| SCNN1A-6959 | + | UGUCUCCAGGAAGGAGAGCAA | 21 | 10808 |
| SCNN1A-6960 | + | CUGUCUCCAGGAAGGAGAGCAA | 22 | 10809 |
| SCNN1A-6961 | + | UCUGUCUCCAGGAAGGAGAGCAA | 23 | 10810 |
| SCNN1A-6962 | + | GUCUGUCUCCAGGAAGGAGAGCAA | 24 | 10811 |
| SCNN1A-6963 | + | AGUUUAGCAGGCAAAGAA | 18 | 10812 |
| SCNN1A-6964 | + | GAGUUUAGCAGGCAAAGAA | 19 | 10813 |
| SCNN1A-6965 | + | GGAGUUUAGCAGGCAAAGAA | 20 | 10814 |
| SCNN1A-6966 | + | AGGAGUUUAGCAGGCAAAGAA | 21 | 10815 |
| SCNN1A-6967 | + | AAGGAGUUUAGCAGGCAAAGAA | 22 | 10816 |
| SCNN1A-6968 | + | CAAGGAGUUUAGCAGGCAAAGAA | 23 | 10817 |
| SCNN1A-6969 | + | GCAAGGAGUUUAGCAGGCAAAGAA | 24 | 10818 |
| SCNN1A-6970 | + | CUCAGGCCCUGCAGAGAA | 18 | 10819 |
| SCNN1A-6971 | + | CCUCAGGCCCUGCAGAGAA | 19 | 10820 |
| SCNN1A-6972 | + | CCCUCAGGCCCUGCAGAGAA | 20 | 10821 |
| SCNN1A-6973 | + | ACCCUCAGGCCCUGCAGAGAA | 21 | 10822 |
| SCNN1A-6974 | + | CACCCUCAGGCCCUGCAGAGAA | 22 | 10823 |
| SCNN1A-6975 | + | UCACCCUCAGGCCCUGCAGAGAA | 23 | 10824 |
| SCNN1A-6976 | + | CUCACCCUCAGGCCCUGCAGAGAA | 24 | 10825 |
| SCNN1A-6977 | + | GAGGGCCUGGGUGGGAA | 18 | 10826 |
| SCNN1A-6978 | + | AGAGGGCCUGGGUGGGAA | 19 | 10827 |
| SCNN1A-6979 | + | GAGAGGGCCUGGGUGGGAA | 20 | 10828 |
| SCNN1A-6980 | + | UGAGAGGGCCUGGGUGGGAA | 21 | 10829 |
| SCNN1A-6981 | + | CUGAGAGGGCCUGGGUGGGAA | 22 | 10830 |
| SCNN1A-6982 | + | GCUGAGAGGGCCUGGGUGGGAA | 23 | 10831 |
| SCNN1A-6983 | + | GGCUGAGAGGGCCUGGGUGGGAA | 24 | 10832 |
| SCNN1A-6984 | + | AUGUGGCCAGCGCUGGAA | 18 | 10833 |
| SCNN1A-6985 | + | GAUGUGGCCAGCGCUGGAA | 19 | 10834 |
| SCNN1A-5174 | + | GGAUGUGGCCAGCGCUGGAA | 20 | 9023 |
| SCNN1A-6986 | + | AGGAUGUGGCCAGCGCUGGAA | 21 | 10835 |
| SCNN1A-6987 | + | GAGGAUGUGGCCAGCGCUGGAA | 22 | 10836 |
| SCNN1A-6988 | + | GGAGGAUGUGGCCAGCGCUGGAA | 23 | 10837 |
| SCNN1A-6989 | + | GGGAGGAUGUGGCCAGCGCUGGAA | 24 | 10838 |
| SCNN1A-6990 | + | CUCCCGAGGGCAGGUGAA | 18 | 10839 |
| SCNN1A-6991 | + | GCUCCCGAGGGCAGGUGAA | 19 | 10840 |
| SCNN1A-6992 | + | GGCUCCCGAGGGCAGGUGAA | 20 | 10841 |

TABLE 47D-continued

4th Tier

| gRNA Name | DNA Strand | Targeting Domain | Target Site Length | Seq ID |
|---|---|---|---|---|
| SCNN1A-6993 | + | GGGCUCCCGAGGGCAGGUGAA | 21 | 10842 |
| SCNN1A-6994 | + | AGGGCUCCCGAGGGCAGGUGAA | 22 | 10843 |
| SCNN1A-6995 | + | GAGGGCUCCCGAGGGCAGGUGAA | 23 | 10844 |
| SCNN1A-6996 | + | GGAGGGCUCCCGAGGGCAGGUGAA | 24 | 10845 |
| SCNN1A-6997 | + | CUCCUCCCCGCUCACUAA | 18 | 10846 |
| SCNN1A-6998 | + | UCUCCUCCCCGCUCACUAA | 19 | 10847 |
| SCNN1A-6999 | + | GUCUCCUCCCCGCUCACUAA | 20 | 10848 |
| SCNN1A-7000 | + | GGUCUCCUCCCCGCUCACUAA | 21 | 10849 |
| SCNN1A-7001 | + | AGGUCUCCUCCCCGCUCACUAA | 22 | 10850 |
| SCNN1A-7002 | + | CAGGUCUCCUCCCCGCUCACUAA | 23 | 10851 |
| SCNN1A-7003 | + | GCAGGUCUCCUCCCCGCUCACUAA | 24 | 10852 |
| SCNN1A-7004 | + | AGCUAGGAGGGCAACACA | 18 | 10853 |
| SCNN1A-7005 | + | CAGCUAGGAGGGCAACACA | 19 | 10854 |
| SCNN1A-5527 | + | ACAGCUAGGAGGGCAACACA | 20 | 9376 |
| SCNN1A-7006 | + | CACAGCUAGGAGGGCAACACA | 21 | 10855 |
| SCNN1A-7007 | + | CCACAGCUAGGAGGGCAACACA | 22 | 10856 |
| SCNN1A-7008 | + | CCCACAGCUAGGAGGGCAACACA | 23 | 10857 |
| SCNN1A-7009 | + | GCCCACAGCUAGGAGGGCAACACA | 24 | 10858 |
| SCNN1A-7010 | + | CCUGAGCAUUGAUACACA | 18 | 10859 |
| SCNN1A-7011 | + | GCCUGAGCAUUGAUACACA | 19 | 10860 |
| SCNN1A-7012 | + | AGCCUGAGCAUUGAUACACA | 20 | 10861 |
| SCNN1A-7013 | + | CAGCCUGAGCAUUGAUACACA | 21 | 10862 |
| SCNN1A-7014 | + | CCAGCCUGAGCAUUGAUACACA | 22 | 10863 |
| SCNN1A-7015 | + | CCCAGCCUGAGCAUUGAUACACA | 23 | 10864 |
| SCNN1A-7016 | + | GCCCAGCCUGAGCAUUGAUACACA | 24 | 10865 |
| SCNN1A-7017 | + | GCCUCCCUCACUCCCACA | 18 | 10866 |
| SCNN1A-7018 | + | GGCCUCCCUCACUCCCACA | 19 | 10867 |
| SCNN1A-7019 | + | AGGCCUCCCUCACUCCCACA | 20 | 10868 |
| SCNN1A-7020 | + | AAGGCCUCCCUCACUCCCACA | 21 | 10869 |
| SCNN1A-7021 | + | GAAGGCCUCCCUCACUCCCACA | 22 | 10870 |
| SCNN1A-7022 | + | GGAAGGCCUCCCUCACUCCCACA | 23 | 10871 |
| SCNN1A-7023 | + | GGGAAGGCCUCCCUCACUCCCACA | 24 | 10872 |
| SCNN1A-7024 | + | GAGGGACAGCGAAGGACA | 18 | 10873 |
| SCNN1A-7025 | + | AGAGGGACAGCGAAGGACA | 19 | 10874 |
| SCNN1A-7026 | + | GAGAGGGACAGCGAAGGACA | 20 | 10875 |
| SCNN1A-7027 | + | AGAGAGGGACAGCGAAGGACA | 21 | 10876 |
| SCNN1A-7028 | + | UAGAGAGGGACAGCGAAGGACA | 22 | 10877 |

TABLE 47D-continued

4th Tier

| gRNA Name | DNA Strand | Targeting Domain | Target Site Length | Seq ID |
|---|---|---|---|---|
| SCNN1A-7029 | + | AUAGAGAGGGACAGCGAAGGACA | 23 | 10878 |
| SCNN1A-7030 | + | AAUAGAGAGGGACAGCGAAGGACA | 24 | 10879 |
| SCNN1A-7031 | + | AGACAAUAGAGAGGGACA | 18 | 10880 |
| SCNN1A-7032 | + | GAGACAAUAGAGAGGGACA | 19 | 10881 |
| SCNN1A-7033 | + | GGAGACAAUAGAGAGGGACA | 20 | 10882 |
| SCNN1A-7034 | + | GGGAGACAAUAGAGAGGGACA | 21 | 10883 |
| SCNN1A-7035 | + | AGGGAGACAAUAGAGAGGGACA | 22 | 10884 |
| SCNN1A-7036 | + | GAGGGAGACAAUAGAGAGGGACA | 23 | 10885 |
| SCNN1A-7037 | + | AGAGGGAGACAAUAGAGAGGGACA | 24 | 10886 |
| SCNN1A-7038 | + | UUGAGCCAGGUCCUUACA | 18 | 10887 |
| SCNN1A-7039 | + | CUUGAGCCAGGUCCUUACA | 19 | 10888 |
| SCNN1A-7040 | + | CCUUGAGCCAGGUCCUUACA | 20 | 10889 |
| SCNN1A-7041 | + | CCCUUGAGCCAGGUCCUUACA | 21 | 10890 |
| SCNN1A-7042 | + | UCCCUUGAGCCAGGUCCUUACA | 22 | 10891 |
| SCNN1A-7043 | + | CUCCCUUGAGCCAGGUCCUUACA | 23 | 10892 |
| SCNN1A-7044 | + | UCUCCCUUGAGCCAGGUCCUUACA | 24 | 10893 |
| SCNN1A-7045 | + | UAGAAGGAGCCAGCACCA | 18 | 10894 |
| SCNN1A-7046 | + | AUAGAAGGAGCCAGCACCA | 19 | 10895 |
| SCNN1A-7047 | + | AAUAGAAGGAGCCAGCACCA | 20 | 10896 |
| SCNN1A-7048 | + | AAAUAGAAGGAGCCAGCACCA | 21 | 10897 |
| SCNN1A-7049 | + | CAAAUAGAAGGAGCCAGCACCA | 22 | 10898 |
| SCNN1A-7050 | + | GCAAAUAGAAGGAGCCAGCACCA | 23 | 10899 |
| SCNN1A-7051 | + | GGCAAAUAGAAGGAGCCAGCACCA | 24 | 10900 |
| SCNN1A-7052 | + | GCUUCCUCACGGGCCCCA | 18 | 10901 |
| SCNN1A-7053 | + | CGCUUCCUCACGGGCCCCA | 19 | 10902 |
| SCNN1A-7054 | + | CCGCUUCCUCACGGGCCCCA | 20 | 10903 |
| SCNN1A-7055 | + | GCCGCUUCCUCACGGGCCCCA | 21 | 10904 |
| SCNN1A-7056 | + | UGCCGCUUCCUCACGGGCCCCA | 22 | 10905 |
| SCNN1A-7057 | + | CUGCCGCUUCCUCACGGGCCCCA | 23 | 10906 |
| SCNN1A-7058 | + | GCUGCCGCUUCCUCACGGGCCCCA | 24 | 10907 |
| SCNN1A-7059 | + | ACUCAGGAAGCCUUCCCA | 18 | 10908 |
| SCNN1A-7060 | + | GACUCAGGAAGCCUUCCCA | 19 | 10909 |
| SCNN1A-7061 | + | AGACUCAGGAAGCCUUCCCA | 20 | 10910 |
| SCNN1A-7062 | + | GAGACUCAGGAAGCCUUCCCA | 21 | 10911 |
| SCNN1A-7063 | + | GGAGACUCAGGAAGCCUUCCCA | 22 | 10912 |
| SCNN1A-7064 | + | AGGAGACUCAGGAAGCCUUCCCA | 23 | 10913 |
| SCNN1A-7065 | + | CAGGAGACUCAGGAAGCCUUCCCA | 24 | 10914 |
| SCNN1A-7066 | + | UCUCCAGGAAGGAGAGCA | 18 | 10915 |

TABLE 47D-continued

| | | 4th Tier | | |
|---|---|---|---|---|
| gRNA Name | DNA Strand | Targeting Domain | Target Site Length | Seq ID |
| SCNN1A-7067 | + | GUCUCCAGGAAGGAGAGCA | 19 | 10916 |
| SCNN1A-5533 | + | UGUCUCCAGGAAGGAGAGCA | 20 | 9382 |
| SCNN1A-7068 | + | CUGUCUCCAGGAAGGAGAGCA | 21 | 10917 |
| SCNN1A-7069 | + | UCUGUCUCCAGGAAGGAGAGCA | 22 | 10918 |
| SCNN1A-7070 | + | GUCUGUCUCCAGGAAGGAGAGCA | 23 | 10919 |
| SCNN1A-7071 | + | AGUCUGUCUCCAGGAAGGAGAGCA | 24 | 10920 |
| SCNN1A-7072 | + | AGUGCCAAGUGGUGAGCA | 18 | 10921 |
| SCNN1A-7073 | + | GAGUGCCAAGUGGUGAGCA | 19 | 10922 |
| SCNN1A-5179 | + | GGAGUGCCAAGUGGUGAGCA | 20 | 9028 |
| SCNN1A-7074 | + | UGGAGUGCCAAGUGGUGAGCA | 21 | 10923 |
| SCNN1A-7075 | + | GUGGAGUGCCAAGUGGUGAGCA | 22 | 10924 |
| SCNN1A-7076 | + | AGUGGAGUGCCAAGUGGUGAGCA | 23 | 10925 |
| SCNN1A-7077 | + | GAGUGGAGUGCCAAGUGGUGAGCA | 24 | 10926 |
| SCNN1A-7078 | + | UUUAGACGCAGACAGGCA | 18 | 10927 |
| SCNN1A-7079 | + | CUUUAGACGCAGACAGGCA | 19 | 10928 |
| SCNN1A-5181 | + | GCUUUAGACGCAGACAGGCA | 20 | 9030 |
| SCNN1A-7080 | + | GGCUUUAGACGCAGACAGGCA | 21 | 10929 |
| SCNN1A-7081 | + | GGGCUUUAGACGCAGACAGGCA | 22 | 10930 |
| SCNN1A-7082 | + | GGGGCUUUAGACGCAGACAGGCA | 23 | 10931 |
| SCNN1A-7083 | + | AGGGGCUUUAGACGCAGACAGGCA | 24 | 10932 |
| SCNN1A-7084 | + | AGGCAGGGAAAGCAGGCA | 18 | 10933 |
| SCNN1A-7085 | + | GAGGCAGGGAAAGCAGGCA | 19 | 10934 |
| SCNN1A-7086 | + | AGAGGCAGGGAAAGCAGGCA | 20 | 10935 |
| SCNN1A-7087 | + | AAGAGGCAGGGAAAGCAGGCA | 21 | 10936 |
| SCNN1A-7088 | + | GAAGAGGCAGGGAAAGCAGGCA | 22 | 10937 |
| SCNN1A-7089 | + | GGAAGAGGCAGGGAAAGCAGGCA | 23 | 10938 |
| SCNN1A-7090 | + | AGGAAGAGGCAGGGAAAGCAGGCA | 24 | 10939 |
| SCNN1A-7091 | + | CAAGGAGUUUAGCAGGCA | 18 | 10940 |
| SCNN1A-7092 | + | GCAAGGAGUUUAGCAGGCA | 19 | 10941 |
| SCNN1A-7093 | + | AGCAAGGAGUUUAGCAGGCA | 20 | 10942 |
| SCNN1A-7094 | + | AAGCAAGGAGUUUAGCAGGCA | 21 | 10943 |
| SCNN1A-7095 | + | CAAGCAAGGAGUUUAGCAGGCA | 22 | 10944 |
| SCNN1A-7096 | + | ACAAGCAAGGAGUUUAGCAGGCA | 23 | 10945 |
| SCNN1A-7097 | + | GACAAGCAAGGAGUUUAGCAGGCA | 24 | 10946 |
| SCNN1A-7098 | + | GGAGCCCAGGAAGAGGCA | 18 | 10947 |
| SCNN1A-7099 | + | CGGAGCCCAGGAAGAGGCA | 19 | 10948 |
| SCNN1A-5535 | + | CCGGAGCCCAGGAAGAGGCA | 20 | 9384 |

TABLE 47D-continued

4th Tier

| gRNA Name | DNA Strand | Targeting Domain | Target Site Length | Seq ID |
|---|---|---|---|---|
| SCNN1A-7100 | + | CCCGGAGCCCAGGAAGAGGCA | 21 | 10949 |
| SCNN1A-7101 | + | ACCCGGAGCCCAGGAAGAGGCA | 22 | 10950 |
| SCNN1A-7102 | + | GACCCGGAGCCCAGGAAGAGGCA | 23 | 10951 |
| SCNN1A-7103 | + | AGACCCGGAGCCCAGGAAGAGGCA | 24 | 10952 |
| SCNN1A-7104 | + | CAGGCCCUGCACGCGGCA | 18 | 10953 |
| SCNN1A-7105 | + | CCAGGCCCUGCACGCGGCA | 19 | 10954 |
| SCNN1A-5536 | + | CCCAGGCCCUGCACGCGGCA | 20 | 9385 |
| SCNN1A-7106 | + | ACCCAGGCCCUGCACGCGGCA | 21 | 10955 |
| SCNN1A-7107 | + | AACCCAGGCCCUGCACGCGGCA | 22 | 10956 |
| SCNN1A-7108 | + | CAACCCAGGCCCUGCACGCGGCA | 23 | 10957 |
| SCNN1A-7109 | + | ACAACCCAGGCCCUGCACGCGGCA | 24 | 10958 |
| SCNN1A-7110 | + | UCACCCUCAGGCCCUGCA | 18 | 10959 |
| SCNN1A-7111 | + | CUCACCCUCAGGCCCUGCA | 19 | 10960 |
| SCNN1A-7112 | + | CCUCACCCUCAGGCCCUGCA | 20 | 10961 |
| SCNN1A-7113 | + | GCCUCACCCUCAGGCCCUGCA | 21 | 10962 |
| SCNN1A-7114 | + | AGCCUCACCCUCAGGCCCUGCA | 22 | 10963 |
| SCNN1A-7115 | + | CAGCCUCACCCUCAGGCCCUGCA | 23 | 10964 |
| SCNN1A-7116 | + | UCAGCCUCACCCUCAGGCCCUGCA | 24 | 10965 |
| SCNN1A-7117 | + | GCAGGCACUGAAGGUGCA | 18 | 10966 |
| SCNN1A-7118 | + | AGCAGGCACUGAAGGUGCA | 19 | 10967 |
| SCNN1A-5539 | + | AAGCAGGCACUGAAGGUGCA | 20 | 9388 |
| SCNN1A-7119 | + | AAAGCAGGCACUGAAGGUGCA | 21 | 10968 |
| SCNN1A-7120 | + | GAAAGCAGGCACUGAAGGUGCA | 22 | 10969 |
| SCNN1A-7121 | + | GGAAAGCAGGCACUGAAGGUGCA | 23 | 10970 |
| SCNN1A-7122 | + | GGGAAAGCAGGCACUGAAGGUGCA | 24 | 10971 |
| SCNN1A-7123 | + | CUUCCUGAGACAGACUCA | 18 | 10972 |
| SCNN1A-7124 | + | ACUUCCUGAGACAGACUCA | 19 | 10973 |
| SCNN1A-6083 | + | UACUUCCUGAGACAGACUCA | 20 | 9932 |
| SCNN1A-7125 | + | UUACUUCCUGAGACAGACUCA | 21 | 10974 |
| SCNN1A-7126 | + | UUUACUUCCUGAGACAGACUCA | 22 | 10975 |
| SCNN1A-7127 | + | AUUUACUUCCUGAGACAGACUCA | 23 | 10976 |
| SCNN1A-7128 | + | CAUUUACUUCCUGAGACAGACUCA | 24 | 10977 |
| SCNN1A-7129 | + | GACAGGAGGGCAGAAAGA | 18 | 10978 |
| SCNN1A-7130 | + | GGACAGGAGGGCAGAAAGA | 19 | 10979 |
| SCNN1A-6085 | + | AGGACAGGAGGGCAGAAAGA | 20 | 9934 |
| SCNN1A-7131 | + | GAGGACAGGAGGGCAGAAAGA | 21 | 10980 |
| SCNN1A-7132 | + | GGAGGACAGGAGGGCAGAAAGA | 22 | 10981 |
| SCNN1A-7133 | + | GGGAGGACAGGAGGGCAGAAAGA | 23 | 10982 |

TABLE 47D-continued

| | 4th Tier | | | |
|---|---|---|---|---|
| gRNA Name | DNA Strand | Targeting Domain | Target Site Length | Seq ID |
| SCNN1A-7134 | + | CGGGAGGACAGGAGGGCAGAAAGA | 24 | 10983 |
| SCNN1A-7135 | + | CAGGCCCUGCAGAGAAGA | 18 | 10984 |
| SCNN1A-7136 | + | UCAGGCCCUGCAGAGAAGA | 19 | 10985 |
| SCNN1A-7137 | + | CUCAGGCCCUGCAGAGAAGA | 20 | 10986 |
| SCNN1A-7138 | + | CCUCAGGCCCUGCAGAGAAGA | 21 | 10987 |
| SCNN1A-7139 | + | CCCUCAGGCCCUGCAGAGAAGA | 22 | 10988 |
| SCNN1A-7140 | + | ACCCUCAGGCCCUGCAGAGAAGA | 23 | 10989 |
| SCNN1A-7141 | + | CACCCUCAGGCCCUGCAGAGAAGA | 24 | 10990 |
| SCNN1A-7142 | + | GGAGGACAGGAGGGCAGA | 18 | 10991 |
| SCNN1A-7143 | + | GGGAGGACAGGAGGGCAGA | 19 | 10992 |
| SCNN1A-7144 | + | CGGGAGGACAGGAGGGCAGA | 20 | 10993 |
| SCNN1A-7145 | + | CCGGGAGGACAGGAGGGCAGA | 21 | 10994 |
| SCNN1A-7146 | + | ACCGGGAGGACAGGAGGGCAGA | 22 | 10995 |
| SCNN1A-7147 | + | AACCGGGAGGACAGGAGGGCAGA | 23 | 10996 |
| SCNN1A-7148 | + | GAACCGGGAGGACAGGAGGGCAGA | 24 | 10997 |
| SCNN1A-7149 | + | CAGCGAAGGACAGAGAGA | 18 | 10998 |
| SCNN1A-7150 | + | ACAGCGAAGGACAGAGAGA | 19 | 10999 |
| SCNN1A-7151 | + | GACAGCGAAGGACAGAGAGA | 20 | 11000 |
| SCNN1A-7152 | + | GGACAGCGAAGGACAGAGAGA | 21 | 11001 |
| SCNN1A-7153 | + | GGGACAGCGAAGGACAGAGAGA | 22 | 11002 |
| SCNN1A-7154 | + | AGGGACAGCGAAGGACAGAGAGA | 23 | 11003 |
| SCNN1A-7155 | + | GAGGGACAGCGAAGGACAGAGAGA | 24 | 11004 |
| SCNN1A-7156 | + | GUGGUGAGCAAGGAGAGA | 18 | 11005 |
| SCNN1A-7157 | + | AGUGGUGAGCAAGGAGAGA | 19 | 11006 |
| SCNN1A-7158 | + | AAGUGGUGAGCAAGGAGAGA | 20 | 11007 |
| SCNN1A-7159 | + | CAAGUGGUGAGCAAGGAGAGA | 21 | 11008 |
| SCNN1A-7160 | + | CCAAGUGGUGAGCAAGGAGAGA | 22 | 11009 |
| SCNN1A-7161 | + | GCCAAGUGGUGAGCAAGGAGAGA | 23 | 11010 |
| SCNN1A-7162 | + | UGCCAAGUGGUGAGCAAGGAGAGA | 24 | 11011 |
| SCNN1A-7163 | + | GAGGGCAACACAAGGAGA | 18 | 11012 |
| SCNN1A-7164 | + | GGAGGGCAACACAAGGAGA | 19 | 11013 |
| SCNN1A-6089 | + | AGGAGGGCAACACAAGGAGA | 20 | 9938 |
| SCNN1A-7165 | + | UAGGAGGGCAACACAAGGAGA | 21 | 11014 |
| SCNN1A-7166 | + | CUAGGAGGGCAACACAAGGAGA | 22 | 11015 |
| SCNN1A-7167 | + | GCUAGGAGGGCAACACAAGGAGA | 23 | 11016 |
| SCNN1A-7168 | + | AGCUAGGAGGGCAACACAAGGAGA | 24 | 11017 |
| SCNN1A-7169 | + | AAGUGGUGAGCAAGGAGA | 18 | 11018 |

TABLE 47D-continued

4th Tier

| gRNA Name | DNA Strand | Targeting Domain | Target Site Length | Seq ID |
|---|---|---|---|---|
| SCNN1A-7170 | + | CAAGUGGUGAGCAAGGAGA | 19 | 11019 |
| SCNN1A-7171 | + | CCAAGUGGUGAGCAAGGAGA | 20 | 11020 |
| SCNN1A-7172 | + | GCCAAGUGGUGAGCAAGGAGA | 21 | 11021 |
| SCNN1A-7173 | + | UGCCAAGUGGUGAGCAAGGAGA | 22 | 11022 |
| SCNN1A-7174 | + | GUGCCAAGUGGUGAGCAAGGAGA | 23 | 11023 |
| SCNN1A-7175 | + | AGUGCCAAGUGGUGAGCAAGGAGA | 24 | 11024 |
| SCNN1A-7176 | + | GUGGUGGGGGCAAAUAGA | 18 | 11025 |
| SCNN1A-7177 | + | AGUGGUGGGGGCAAAUAGA | 19 | 11026 |
| SCNN1A-6091 | + | CAGUGGUGGGGGCAAAUAGA | 20 | 9940 |
| SCNN1A-7178 | + | GCAGUGGUGGGGGCAAAUAGA | 21 | 11027 |
| SCNN1A-7179 | + | GGCAGUGGUGGGGGCAAAUAGA | 22 | 11028 |
| SCNN1A-7180 | + | GGGCAGUGGUGGGGGCAAAUAGA | 23 | 11029 |
| SCNN1A-7181 | + | GGGGCAGUGGUGGGGGCAAAUAGA | 24 | 11030 |
| SCNN1A-7182 | + | AAAGAGGGAGACAAUAGA | 18 | 11031 |
| SCNN1A-7183 | + | GAAAGAGGGAGACAAUAGA | 19 | 11032 |
| SCNN1A-7184 | + | AGAAAGAGGGAGACAAUAGA | 20 | 11033 |
| SCNN1A-7185 | + | CAGAAAGAGGGAGACAAUAGA | 21 | 11034 |
| SCNN1A-7186 | + | GCAGAAAGAGGGAGACAAUAGA | 22 | 11035 |
| SCNN1A-7187 | + | GGCAGAAAGAGGGAGACAAUAGA | 23 | 11036 |
| SCNN1A-7188 | + | GGGCAGAAAGAGGGAGACAAUAGA | 24 | 11037 |
| SCNN1A-1445 | + | AUCACCCCUGGAACCCGA | 18 | 5294 |
| SCNN1A-1446 | + | CAUCACCCCUGGAACCCGA | 19 | 5295 |
| SCNN1A-1447 | + | CCAUCACCCCUGGAACCCGA | 20 | 5296 |
| SCNN1A-1448 | + | CCCAUCACCCCUGGAACCCGA | 21 | 5297 |
| SCNN1A-1449 | + | UCCCAUCACCCCUGGAACCCGA | 22 | 5298 |
| SCNN1A-1450 | + | CUCCCAUCACCCCUGGAACCCGA | 23 | 5299 |
| SCNN1A-1451 | + | UCUCCCAUCACCCCUGGAACCCGA | 24 | 5300 |
| SCNN1A-7189 | + | GAGCCGGGAGUUUUCCGA | 18 | 11038 |
| SCNN1A-7190 | + | AGAGCCGGGAGUUUUCCGA | 19 | 11039 |
| SCNN1A-5544 | + | CAGAGCCGGGAGUUUUCCGA | 20 | 9393 |
| SCNN1A-7191 | + | UCAGAGCCGGGAGUUUUCCGA | 21 | 11040 |
| SCNN1A-7192 | + | GUCAGAGCCGGGAGUUUUCCGA | 22 | 11041 |
| SCNN1A-7193 | + | AGUCAGAGCCGGGAGUUUUCCGA | 23 | 11042 |
| SCNN1A-7194 | + | GAGUCAGAGCCGGGAGUUUUCCGA | 24 | 11043 |
| SCNN1A-7195 | + | GGCCAGGGAUGGAAGCGA | 18 | 11044 |
| SCNN1A-7196 | + | CGGCCAGGGAUGGAAGCGA | 19 | 11045 |
| SCNN1A-7197 | + | CCGGCCAGGGAUGGAAGCGA | 20 | 11046 |
| SCNN1A-7198 | + | GCCGGCCAGGGAUGGAAGCGA | 21 | 11047 |

TABLE 47D-continued

4th Tier

| gRNA Name | DNA Strand | Targeting Domain | Target Site Length | Seq ID |
|---|---|---|---|---|
| SCNN1A-7199 | + | GGCCGGCCAGGGAUGGAAGCGA | 22 | 11048 |
| SCNN1A-7200 | + | UGGCCGGCCAGGGAUGGAAGCGA | 23 | 11049 |
| SCNN1A-7201 | + | CUGGCCGGCCAGGGAUGGAAGCGA | 24 | 11050 |
| SCNN1A-7202 | + | CCAAGUGGUGAGCAAGGA | 18 | 11051 |
| SCNN1A-7203 | + | GCCAAGUGGUGAGCAAGGA | 19 | 11052 |
| SCNN1A-7204 | + | UGCCAAGUGGUGAGCAAGGA | 20 | 11053 |
| SCNN1A-7205 | + | GUGCCAAGUGGUGAGCAAGGA | 21 | 11054 |
| SCNN1A-7206 | + | AGUGCCAAGUGGUGAGCAAGGA | 22 | 11055 |
| SCNN1A-7207 | + | GAGUGCCAAGUGGUGAGCAAGGA | 23 | 11056 |
| SCNN1A-7208 | + | GGAGUGCCAAGUGGUGAGCAAGGA | 24 | 11057 |
| SCNN1A-7209 | + | CGGGAGUUUUCCGAAGGA | 18 | 11058 |
| SCNN1A-7210 | + | CCGGGAGUUUUCCGAAGGA | 19 | 11059 |
| SCNN1A-5190 | + | GCCGGGAGUUUUCCGAAGGA | 20 | 9039 |
| SCNN1A-7211 | + | AGCCGGGAGUUUUCCGAAGGA | 21 | 11060 |
| SCNN1A-7212 | + | GAGCCGGGAGUUUUCCGAAGGA | 22 | 11061 |
| SCNN1A-7213 | + | AGAGCCGGGAGUUUUCCGAAGGA | 23 | 11062 |
| SCNN1A-7214 | + | CAGAGCCGGGAGUUUUCCGAAGGA | 24 | 11063 |
| SCNN1A-7215 | + | GAGAGGGACAGCGAAGGA | 18 | 11064 |
| SCNN1A-7216 | + | AGAGAGGGACAGCGAAGGA | 19 | 11065 |
| SCNN1A-7217 | + | UAGAGAGGGACAGCGAAGGA | 20 | 11066 |
| SCNN1A-7218 | + | AUAGAGAGGGACAGCGAAGGA | 21 | 11067 |
| SCNN1A-7219 | + | AAUAGAGAGGGACAGCGAAGGA | 22 | 11068 |
| SCNN1A-7220 | + | CAAUAGAGAGGGACAGCGAAGGA | 23 | 11069 |
| SCNN1A-7221 | + | ACAAUAGAGAGGGACAGCGAAGGA | 24 | 11070 |
| SCNN1A-7222 | + | GCAGCAAAAGGAUAAGGA | 18 | 11071 |
| SCNN1A-7223 | + | UGCAGCAAAAGGAUAAGGA | 19 | 11072 |
| SCNN1A-7224 | + | AUGCAGCAAAAGGAUAAGGA | 20 | 11073 |
| SCNN1A-7225 | + | AAUGCAGCAAAAGGAUAAGGA | 21 | 11074 |
| SCNN1A-7226 | + | UAAUGCAGCAAAAGGAUAAGGA | 22 | 11075 |
| SCNN1A-7227 | + | UUAAUGCAGCAAAAGGAUAAGGA | 23 | 11076 |
| SCNN1A-7228 | + | CUUAAUGCAGCAAAAGGAUAAGGA | 24 | 11077 |
| SCNN1A-7229 | + | GGGAGUCUGUCUCCAGGA | 18 | 11078 |
| SCNN1A-7230 | + | AGGGAGUCUGUCUCCAGGA | 19 | 11079 |
| SCNN1A-5546 | + | AAGGGAGUCUGUCUCCAGGA | 20 | 9395 |
| SCNN1A-7231 | + | AAAGGGAGUCUGUCUCCAGGA | 21 | 11080 |
| SCNN1A-7232 | + | CAAAGGGAGUCUGUCUCCAGGA | 22 | 11081 |
| SCNN1A-7233 | + | CCAAAGGGAGUCUGUCUCCAGGA | 23 | 11082 |

TABLE 47D-continued

4th Tier

| gRNA Name | DNA Strand | Targeting Domain | Target Site Length | Seq ID |
|---|---|---|---|---|
| SCNN1A-7234 | + | ACCAAAGGGAGUCUGUCUCCAGGA | 24 | 11083 |
| SCNN1A-7235 | + | GGUGGGGAACCGGGAGGA | 18 | 11084 |
| SCNN1A-7236 | + | GGGUGGGGAACCGGGAGGA | 19 | 11085 |
| SCNN1A-7237 | + | UGGGUGGGGAACCGGGAGGA | 20 | 11086 |
| SCNN1A-7238 | + | CUGGGUGGGGAACCGGGAGGA | 21 | 11087 |
| SCNN1A-7239 | + | CCUGGGUGGGGAACCGGGAGGA | 22 | 11088 |
| SCNN1A-7240 | + | GCCUGGGUGGGGAACCGGGAGGA | 23 | 11089 |
| SCNN1A-7241 | + | GGCCUGGGUGGGGAACCGGGAGGA | 24 | 11090 |
| SCNN1A-7242 | + | CCGCUGGCCGGCCAGGGA | 18 | 11091 |
| SCNN1A-7243 | + | CCCGCUGGCCGGCCAGGGA | 19 | 11092 |
| SCNN1A-5192 | + | GCCCGCUGGCCGGCCAGGGA | 20 | 9041 |
| SCNN1A-7244 | + | CGCCCGCUGGCCGGCCAGGGA | 21 | 11093 |
| SCNN1A-7245 | + | CCGCCCGCUGGCCGGCCAGGGA | 22 | 11094 |
| SCNN1A-7246 | + | CCCGCCCGCUGGCCGGCCAGGGA | 23 | 11095 |
| SCNN1A-7247 | + | GCCCGCCCGCUGGCCGGCCAGGGA | 24 | 11096 |
| SCNN1A-7248 | + | AGGACAGAGAGAUAGGGA | 18 | 11097 |
| SCNN1A-7249 | + | AAGGACAGAGAGAUAGGGA | 19 | 11098 |
| SCNN1A-5878 | + | GAAGGACAGAGAGAUAGGGA | 20 | 9727 |
| SCNN1A-7250 | + | CGAAGGACAGAGAGAUAGGGA | 21 | 11099 |
| SCNN1A-7251 | + | GCGAAGGACAGAGAGAUAGGGA | 22 | 11100 |
| SCNN1A-7252 | + | AGCGAAGGACAGAGAGAUAGGGA | 23 | 11101 |
| SCNN1A-7253 | + | CAGCGAAGGACAGAGAGAUAGGGA | 24 | 11102 |
| SCNN1A-7254 | + | AGACAGACUCAUGGGGA | 18 | 11103 |
| SCNN1A-7255 | + | GAGACAGACUCAUGGGGA | 19 | 11104 |
| SCNN1A-7256 | + | UGAGACAGACUCAUGGGGA | 20 | 11105 |
| SCNN1A-7257 | + | CUGAGACAGACUCAUGGGGA | 21 | 11106 |
| SCNN1A-7258 | + | CCUGAGACAGACUCAUGGGGA | 22 | 11107 |
| SCNN1A-7259 | + | UCCUGAGACAGACUCAUGGGGA | 23 | 11108 |
| SCNN1A-7260 | + | UUCCUGAGACAGACUCAUGGGGA | 24 | 11109 |
| SCNN1A-7261 | + | GAUGUGGCCAGCGCUGGA | 18 | 11110 |
| SCNN1A-7262 | + | GGAUGUGGCCAGCGCUGGA | 19 | 11111 |
| SCNN1A-7263 | + | AGGAUGUGGCCAGCGCUGGA | 20 | 11112 |
| SCNN1A-7264 | + | GAGGAUGUGGCCAGCGCUGGA | 21 | 11113 |
| SCNN1A-7265 | + | GGAGGAUGUGGCCAGCGCUGGA | 22 | 11114 |
| SCNN1A-7266 | + | GGGAGGAUGUGGCCAGCGCUGGA | 23 | 11115 |
| SCNN1A-7267 | + | AGGGAGGAUGUGGCCAGCGCUGGA | 24 | 11116 |
| SCNN1A-7268 | + | UCCCAGGUUGCGGCUGGA | 18 | 11117 |
| SCNN1A-7269 | + | CUCCCAGGUUGCGGCUGGA | 19 | 11118 |

TABLE 47D-continued

4th Tier

| gRNA Name | DNA Strand | Targeting Domain | Target Site Length | Seq ID |
|---|---|---|---|---|
| SCNN1A-7270 | + | ACUCCCAGGUUGCGGCUGGA | 20 | 11119 |
| SCNN1A-7271 | + | CACUCCCAGGUUGCGGCUGGA | 21 | 11120 |
| SCNN1A-7272 | + | CCACUCCCAGGUUGCGGCUGGA | 22 | 11121 |
| SCNN1A-7273 | + | CCCACUCCCAGGUUGCGGCUGGA | 23 | 11122 |
| SCNN1A-7274 | + | UCCCACUCCCAGGUUGCGGCUGGA | 24 | 11123 |
| SCNN1A-1465 | + | CAUGAGCCCCGGAGUGGA | 18 | 5314 |
| SCNN1A-1466 | + | UCAUGAGCCCCGGAGUGGA | 19 | 5315 |
| SCNN1A-1467 | + | UUCAUGAGCCCCGGAGUGGA | 20 | 5316 |
| SCNN1A-1468 | + | CUUCAUGAGCCCCGGAGUGGA | 21 | 5317 |
| SCNN1A-1469 | + | CCUUCAUGAGCCCCGGAGUGGA | 22 | 5318 |
| SCNN1A-1470 | + | CCCUUCAUGAGCCCCGGAGUGGA | 23 | 5319 |
| SCNN1A-1471 | + | CCCCUUCAUGAGCCCCGGAGUGGA | 24 | 5320 |
| SCNN1A-1472 | + | AUGAUACCUCCCCUUGGA | 18 | 5321 |
| SCNN1A-1473 | + | CAUGAUACCUCCCCUUGGA | 19 | 5322 |
| SCNN1A-399 | + | UCAUGAUACCUCCCCUUGGA | 20 | 4248 |
| SCNN1A-1474 | + | CUCAUGAUACCUCCCCUUGGA | 21 | 5323 |
| SCNN1A-1475 | + | GCUCAUGAUACCUCCCCUUGGA | 22 | 5324 |
| SCNN1A-1476 | + | UGCUCAUGAUACCUCCCCUUGGA | 23 | 5325 |
| SCNN1A-1477 | + | CUGCUCAUGAUACCUCCCCUUGGA | 24 | 5326 |
| SCNN1A-7275 | + | UCUCCUCUGCUUCCCUGA | 18 | 11124 |
| SCNN1A-7276 | + | CUCUCCUCUGCUUCCCUGA | 19 | 11125 |
| SCNN1A-7277 | + | CCUCUCCUCUGCUUCCCUGA | 20 | 11126 |
| SCNN1A-7278 | + | GCCUCUCCUCUGCUUCCCUGA | 21 | 11127 |
| SCNN1A-7279 | + | GGCCUCUCCUCUGCUUCCCUGA | 22 | 11128 |
| SCNN1A-7280 | + | CGGCCUCUCCUCUGCUUCCCUGA | 23 | 11129 |
| SCNN1A-7281 | + | ACGGCCUCUCCUCUGCUUCCCUGA | 24 | 11130 |
| SCNN1A-7282 | + | AGGGGCCAGCCAGGCUGA | 18 | 11131 |
| SCNN1A-7283 | + | AAGGGGCCAGCCAGGCUGA | 19 | 11132 |
| SCNN1A-7284 | + | GAAGGGGCCAGCCAGGCUGA | 20 | 11133 |
| SCNN1A-7285 | + | AGAAGGGGCCAGCCAGGCUGA | 21 | 11134 |
| SCNN1A-7286 | + | GAGAAGGGGCCAGCCAGGCUGA | 22 | 11135 |
| SCNN1A-7287 | + | GGAGAAGGGGCCAGCCAGGCUGA | 23 | 11136 |
| SCNN1A-7288 | + | AGGAGAAGGGGCCAGCCAGGCUGA | 24 | 11137 |
| SCNN1A-7289 | + | AGAAAGAGGGAGACAAUA | 18 | 11138 |
| SCNN1A-7290 | + | CAGAAAGAGGGAGACAAUA | 19 | 11139 |
| SCNN1A-7291 | + | GCAGAAAGAGGGAGACAAUA | 20 | 11140 |
| SCNN1A-7292 | + | GGCAGAAAGAGGGAGACAAUA | 21 | 11141 |

TABLE 47D-continued

4th Tier

| gRNA Name | DNA Strand | Targeting Domain | Target Site Length | Seq ID |
|---|---|---|---|---|
| SCNN1A-7293 | + | GGGCAGAAAGAGGGAGACAAUA | 22 | 11142 |
| SCNN1A-7294 | + | AGGGCAGAAAGAGGGAGACAAUA | 23 | 11143 |
| SCNN1A-7295 | + | GAGGGCAGAAAGAGGGAGACAAUA | 24 | 11144 |
| SCNN1A-7296 | + | UUUUUCUUCAUUGUCCUA | 18 | 11145 |
| SCNN1A-7297 | + | AUUUUUCUUCAUUGUCCUA | 19 | 11146 |
| SCNN1A-7298 | + | GAUUUUUCUUCAUUGUCCUA | 20 | 11147 |
| SCNN1A-7299 | + | GGAUUUUUCUUCAUUGUCCUA | 21 | 11148 |
| SCNN1A-7300 | + | UGGAUUUUUCUUCAUUGUCCUA | 22 | 11149 |
| SCNN1A-7301 | + | CUGGAUUUUUCUUCAUUGUCCUA | 23 | 11150 |
| SCNN1A-7302 | + | GCUGGAUUUUUCUUCAUUGUCCUA | 24 | 11151 |
| SCNN1A-7303 | + | CAUAAGAGCCAAGGGCUA | 18 | 11152 |
| SCNN1A-7304 | + | ACAUAAGAGCCAAGGGCUA | 19 | 11153 |
| SCNN1A-5198 | + | GACAUAAGAGCCAAGGGCUA | 20 | 9047 |
| SCNN1A-7305 | + | AGACAUAAGAGCCAAGGGCUA | 21 | 11154 |
| SCNN1A-7306 | + | AAGACAUAAGAGCCAAGGGCUA | 22 | 11155 |
| SCNN1A-7307 | + | UAAGACAUAAGAGCCAAGGGCUA | 23 | 11156 |
| SCNN1A-7308 | + | AUAAGACAUAAGAGCCAAGGGCUA | 24 | 11157 |
| SCNN1A-7309 | + | GCAGGUGAACUGGGAGUA | 18 | 11158 |
| SCNN1A-7310 | + | GGCAGGUGAACUGGGAGUA | 19 | 11159 |
| SCNN1A-7311 | + | GGGCAGGUGAACUGGGAGUA | 20 | 11160 |
| SCNN1A-7312 | + | AGGGCAGGUGAACUGGGAGUA | 21 | 11161 |
| SCNN1A-7313 | + | GAGGGCAGGUGAACUGGGAGUA | 22 | 11162 |
| SCNN1A-7314 | + | CGAGGGCAGGUGAACUGGGAGUA | 23 | 11163 |
| SCNN1A-7315 | + | CCGAGGGCAGGUGAACUGGGAGUA | 24 | 11164 |
| SCNN1A-7316 | + | UGCAGGAAUGUGGGCAAC | 18 | 11165 |
| SCNN1A-7317 | + | UUGCAGGAAUGUGGGCAAC | 19 | 11166 |
| SCNN1A-7318 | + | GUUGCAGGAAUGUGGGCAAC | 20 | 11167 |
| SCNN1A-7319 | + | AGUUGCAGGAAUGUGGGCAAC | 21 | 11168 |
| SCNN1A-7320 | + | GAGUUGCAGGAAUGUGGGCAAC | 22 | 11169 |
| SCNN1A-7321 | + | AGAGUUGCAGGAAUGUGGGCAAC | 23 | 11170 |
| SCNN1A-7322 | + | CAGAGUUGCAGGAAUGUGGGCAAC | 24 | 11171 |
| SCNN1A-7323 | + | AGGGCCUGGGUGGGAAC | 18 | 11172 |
| SCNN1A-7324 | + | GAGGGCCUGGGUGGGAAC | 19 | 11173 |
| SCNN1A-6101 | + | AGAGGGCCUGGGUGGGAAC | 20 | 9950 |
| SCNN1A-7325 | + | GAGAGGGCCUGGGUGGGAAC | 21 | 11174 |
| SCNN1A-7326 | + | UGAGAGGGCCUGGGUGGGAAC | 22 | 11175 |
| SCNN1A-7327 | + | CUGAGAGGGCCUGGGUGGGAAC | 23 | 11176 |
| SCNN1A-7328 | + | GCUGAGAGGGCCUGGGUGGGAAC | 24 | 11177 |

TABLE 47D-continued

4th Tier

| gRNA Name | DNA Strand | Targeting Domain | Target Site Length | Seq ID |
|---|---|---|---|---|
| SCNN1A-7329 | + | UCCCGAGGGCAGGUGAAC | 18 | 11178 |
| SCNN1A-7330 | + | CUCCCGAGGGCAGGUGAAC | 19 | 11179 |
| SCNN1A-5203 | + | GCUCCCGAGGGCAGGUGAAC | 20 | 9052 |
| SCNN1A-7331 | + | GGCUCCCGAGGGCAGGUGAAC | 21 | 11180 |
| SCNN1A-7332 | + | GGGCUCCCGAGGGCAGGUGAAC | 22 | 11181 |
| SCNN1A-7333 | + | AGGGCUCCCGAGGGCAGGUGAAC | 23 | 11182 |
| SCNN1A-7334 | + | GAGGGCUCCCGAGGGCAGGUGAAC | 24 | 11183 |
| SCNN1A-7335 | + | CAGCUAGGAGGGCAACAC | 18 | 11184 |
| SCNN1A-7336 | + | ACAGCUAGGAGGGCAACAC | 19 | 11185 |
| SCNN1A-7337 | + | CACAGCUAGGAGGGCAACAC | 20 | 11186 |
| SCNN1A-7338 | + | CCACAGCUAGGAGGGCAACAC | 21 | 11187 |
| SCNN1A-7339 | + | CCCACAGCUAGGAGGGCAACAC | 22 | 11188 |
| SCNN1A-7340 | + | GCCCACAGCUAGGAGGGCAACAC | 23 | 11189 |
| SCNN1A-7341 | + | AGCCCACAGCUAGGAGGGCAACAC | 24 | 11190 |
| SCNN1A-7342 | + | CUGAGCAUUGAUACACAC | 18 | 11191 |
| SCNN1A-7343 | + | CCUGAGCAUUGAUACACAC | 19 | 11192 |
| SCNN1A-5204 | + | GCCUGAGCAUUGAUACACAC | 20 | 9053 |
| SCNN1A-7344 | + | AGCCUGAGCAUUGAUACACAC | 21 | 11193 |
| SCNN1A-7345 | + | CAGCCUGAGCAUUGAUACACAC | 22 | 11194 |
| SCNN1A-7346 | + | CCAGCCUGAGCAUUGAUACACAC | 23 | 11195 |
| SCNN1A-7347 | + | CCCAGCCUGAGCAUUGAUACACAC | 24 | 11196 |
| SCNN1A-7348 | + | CUUCCUCACGGGCCCCAC | 18 | 11197 |
| SCNN1A-7349 | + | GCUUCCUCACGGGCCCCAC | 19 | 11198 |
| SCNN1A-5561 | + | CGCUUCCUCACGGGCCCCAC | 20 | 9410 |
| SCNN1A-7350 | + | CCGCUUCCUCACGGGCCCCAC | 21 | 11199 |
| SCNN1A-7351 | + | GCCGCUUCCUCACGGGCCCCAC | 22 | 11200 |
| SCNN1A-7352 | + | UGCCGCUUCCUCACGGGCCCCAC | 23 | 11201 |
| SCNN1A-7353 | + | CUGCCGCUUCCUCACGGGCCCCAC | 24 | 11202 |
| SCNN1A-7354 | + | GACACUGUGGACACAGAC | 18 | 11203 |
| SCNN1A-7355 | + | GGACACUGUGGACACAGAC | 19 | 11204 |
| SCNN1A-7356 | + | AGGACACUGUGGACACAGAC | 20 | 11205 |
| SCNN1A-7357 | + | CAGGACACUGUGGACACAGAC | 21 | 11206 |
| SCNN1A-7358 | + | GCAGGACACUGUGGACACAGAC | 22 | 11207 |
| SCNN1A-7359 | + | CGCAGGACACUGUGGACACAGAC | 23 | 11208 |
| SCNN1A-7360 | + | ACGCAGGACACUGUGGACACAGAC | 24 | 11209 |
| SCNN1A-7361 | + | CUCCAACCUUGUCCAGAC | 18 | 11210 |
| SCNN1A-7362 | + | CCUCCAACCUUGUCCAGAC | 19 | 11211 |

TABLE 47D-continued

4th Tier

| gRNA Name | DNA Strand | Targeting Domain | Target Site Length | Seq ID |
|---|---|---|---|---|
| SCNN1A-7363 | + | CCCUCCAACCUUGUCCAGAC | 20 | 11212 |
| SCNN1A-7364 | + | CCCCUCCAACCUUGUCCAGAC | 21 | 11213 |
| SCNN1A-7365 | + | CCCCCUCCAACCUUGUCCAGAC | 22 | 11214 |
| SCNN1A-7366 | + | ACCCCCUCCAACCUUGUCCAGAC | 23 | 11215 |
| SCNN1A-7367 | + | CACCCCCUCCAACCUUGUCCAGAC | 24 | 11216 |
| SCNN1A-7368 | + | AAAGGGCUGGAGGAGAC | 18 | 11217 |
| SCNN1A-7369 | + | AAAAGGGCUGGAGGAGAC | 19 | 11218 |
| SCNN1A-7370 | + | CAAAAGGGCUGGAGGAGAC | 20 | 11219 |
| SCNN1A-7371 | + | CCAAAAGGGCUGGAGGAGAC | 21 | 11220 |
| SCNN1A-7372 | + | CCCAAAAGGGCUGGAGGAGAC | 22 | 11221 |
| SCNN1A-7373 | + | ACCCAAAAGGGCUGGAGGAGAC | 23 | 11222 |
| SCNN1A-7374 | + | GACCCAAAAGGGCUGGAGGAGAC | 24 | 11223 |
| SCNN1A-7375 | + | GUGGGGAACCGGGAGGAC | 18 | 11224 |
| SCNN1A-7376 | + | GGUGGGGAACCGGGAGGAC | 19 | 11225 |
| SCNN1A-5209 | + | GGGUGGGGAACCGGGAGGAC | 20 | 9058 |
| SCNN1A-7377 | + | UGGGUGGGGAACCGGGAGGAC | 21 | 11226 |
| SCNN1A-7378 | + | CUGGGUGGGGAACCGGGAGGAC | 22 | 11227 |
| SCNN1A-7379 | + | CCUGGGUGGGGAACCGGGAGGAC | 23 | 11228 |
| SCNN1A-7380 | + | GCCUGGGUGGGGAACCGGGAGGAC | 24 | 11229 |
| SCNN1A-7381 | + | GAACUGGGAGUACUGGAC | 18 | 11230 |
| SCNN1A-7382 | + | UGAACUGGGAGUACUGGAC | 19 | 11231 |
| SCNN1A-7383 | + | GUGAACUGGGAGUACUGGAC | 20 | 11232 |
| SCNN1A-7384 | + | GGUGAACUGGGAGUACUGGAC | 21 | 11233 |
| SCNN1A-7385 | + | AGGUGAACUGGGAGUACUGGAC | 22 | 11234 |
| SCNN1A-7386 | + | CAGGUGAACUGGGAGUACUGGAC | 23 | 11235 |
| SCNN1A-7387 | + | GCAGGUGAACUGGGAGUACUGGAC | 24 | 11236 |
| SCNN1A-7388 | + | CCCAGGUUGCGGCUGGAC | 18 | 11237 |
| SCNN1A-7389 | + | UCCCAGGUUGCGGCUGGAC | 19 | 11238 |
| SCNN1A-5565 | + | CUCCCAGGUUGCGGCUGGAC | 20 | 9414 |
| SCNN1A-7390 | + | ACUCCCAGGUUGCGGCUGGAC | 21 | 11239 |
| SCNN1A-7391 | + | CACUCCCAGGUUGCGGCUGGAC | 22 | 11240 |
| SCNN1A-7392 | + | CCACUCCCAGGUUGCGGCUGGAC | 23 | 11241 |
| SCNN1A-7393 | + | CCCACUCCCAGGUUGCGGCUGGAC | 24 | 11242 |
| SCNN1A-7394 | + | GGGCCUGGGUGGGGAACC | 18 | 11243 |
| SCNN1A-7395 | + | AGGGCCUGGGUGGGGAACC | 19 | 11244 |
| SCNN1A-5214 | + | GAGGGCCUGGGUGGGGAACC | 20 | 9063 |
| SCNN1A-7396 | + | AGAGGGCCUGGGUGGGGAACC | 21 | 11245 |
| SCNN1A-7397 | + | GAGAGGGCCUGGGUGGGGAACC | 22 | 11246 |

TABLE 47D-continued

| | | 4th Tier | | |
|---|---|---|---|---|
| gRNA Name | DNA Strand | Targeting Domain | Target Site Length | Seq ID |
| SCNN1A-7398 | + | UGAGAGGGCCUGGGUGGGGAACC | 23 | 11247 |
| SCNN1A-7399 | + | CUGAGAGGGCCUGGGUGGGGAACC | 24 | 11248 |
| SCNN1A-7400 | + | UGAGCAUUGAUACACACC | 18 | 11249 |
| SCNN1A-7401 | + | CUGAGCAUUGAUACACACC | 19 | 11250 |
| SCNN1A-5568 | + | CCUGAGCAUUGAUACACACC | 20 | 9417 |
| SCNN1A-7402 | + | GCCUGAGCAUUGAUACACACC | 21 | 11251 |
| SCNN1A-7403 | + | AGCCUGAGCAUUGAUACACACC | 22 | 11252 |
| SCNN1A-7404 | + | CAGCCUGAGCAUUGAUACACACC | 23 | 11253 |
| SCNN1A-7405 | + | CCAGCCUGAGCAUUGAUACACACC | 24 | 11254 |
| SCNN1A-7406 | + | ACACUGUGGACACAGACC | 18 | 11255 |
| SCNN1A-7407 | + | GACACUGUGGACACAGACC | 19 | 11256 |
| SCNN1A-5217 | + | GGACACUGUGGACACAGACC | 20 | 9066 |
| SCNN1A-7408 | + | AGGACACUGUGGACACAGACC | 21 | 11257 |
| SCNN1A-7409 | + | CAGGACACUGUGGACACAGACC | 22 | 11258 |
| SCNN1A-7410 | + | GCAGGACACUGUGGACACAGACC | 23 | 11259 |
| SCNN1A-7411 | + | CGCAGGACACUGUGGACACAGACC | 24 | 11260 |
| SCNN1A-7412 | + | UCCAACCUUGUCCAGACC | 18 | 11261 |
| SCNN1A-7413 | + | CUCCAACCUUGUCCAGACC | 19 | 11262 |
| SCNN1A-5569 | + | CCUCCAACCUUGUCCAGACC | 20 | 9418 |
| SCNN1A-7414 | + | CCCUCCAACCUUGUCCAGACC | 21 | 11263 |
| SCNN1A-7415 | + | CCCCUCCAACCUUGUCCAGACC | 22 | 11264 |
| SCNN1A-7416 | + | CCCCCUCCAACCUUGUCCAGACC | 23 | 11265 |
| SCNN1A-7417 | + | ACCCCCUCCAACCUUGUCCAGACC | 24 | 11266 |
| SCNN1A-7418 | + | CAGCCUCUGGCCCUGACC | 18 | 11267 |
| SCNN1A-7419 | + | CCAGCCUCUGGCCCUGACC | 19 | 11268 |
| SCNN1A-7420 | + | UCCAGCCUCUGGCCCUGACC | 20 | 11269 |
| SCNN1A-7421 | + | CUCCAGCCUCUGGCCCUGACC | 21 | 11270 |
| SCNN1A-7422 | + | GCUCCAGCCUCUGGCCCUGACC | 22 | 11271 |
| SCNN1A-7423 | + | AGCUCCAGCCUCUGGCCCUGACC | 23 | 11272 |
| SCNN1A-7424 | + | CAGCUCCAGCCUCUGGCCCUGACC | 24 | 11273 |
| SCNN1A-1484 | + | UGCCCUCUCCCAUCACCC | 18 | 5333 |
| SCNN1A-1485 | + | GUGCCCUCUCCCAUCACCC | 19 | 5334 |
| SCNN1A-1486 | + | AGUGCCCUCUCCCAUCACCC | 20 | 5335 |
| SCNN1A-1487 | + | GAGUGCCCUCUCCCAUCACCC | 21 | 5336 |
| SCNN1A-1488 | + | UGAGUGCCCUCUCCCAUCACCC | 22 | 5337 |
| SCNN1A-1489 | + | CUGAGUGCCCUCUCCCAUCACCC | 23 | 5338 |
| SCNN1A-1490 | + | CCUGAGUGCCCUCUCCCAUCACCC | 24 | 5339 |

TABLE 47D-continued

4th Tier

| gRNA Name | DNA Strand | Targeting Domain | Target Site Length | Seq ID |
|---|---|---|---|---|
| SCNN1A-7425 | + | CCAACCUUGUCCAGACCC | 18 | 11274 |
| SCNN1A-7426 | + | UCCAACCUUGUCCAGACCC | 19 | 11275 |
| SCNN1A-5572 | + | CUCCAACCUUGUCCAGACCC | 20 | 9421 |
| SCNN1A-7427 | + | CCUCCAACCUUGUCCAGACCC | 21 | 11276 |
| SCNN1A-7428 | + | CCCUCCAACCUUGUCCAGACCC | 22 | 11277 |
| SCNN1A-7429 | + | CCCCUCCAACCUUGUCCAGACCC | 23 | 11278 |
| SCNN1A-7430 | + | CCCCCUCCAACCUUGUCCAGACCC | 24 | 11279 |
| SCNN1A-1491 | + | GCCCUCUCCCAUCACCCC | 18 | 5340 |
| SCNN1A-1492 | + | UGCCCUCUCCCAUCACCCC | 19 | 5341 |
| SCNN1A-346 | + | GUGCCCUCUCCCAUCACCCC | 20 | 4195 |
| SCNN1A-1493 | + | AGUGCCCUCUCCCAUCACCCC | 21 | 5342 |
| SCNN1A-1494 | + | GAGUGCCCUCUCCCAUCACCCC | 22 | 5343 |
| SCNN1A-1495 | + | UGAGUGCCCUCUCCCAUCACCCC | 23 | 5344 |
| SCNN1A-1496 | + | CUGAGUGCCCUCUCCCAUCACCCC | 24 | 5345 |
| SCNN1A-7431 | + | ACAUAUCCCAGAGACCCC | 18 | 11280 |
| SCNN1A-7432 | + | CACAUAUCCCAGAGACCCC | 19 | 11281 |
| SCNN1A-7433 | + | CCACAUAUCCCAGAGACCCC | 20 | 11282 |
| SCNN1A-7434 | + | CCCACAUAUCCCAGAGACCCC | 21 | 11283 |
| SCNN1A-7435 | + | CCCCACAUAUCCCAGAGACCCC | 22 | 11284 |
| SCNN1A-7436 | + | GCCCCACAUAUCCCAGAGACCCC | 23 | 11285 |
| SCNN1A-7437 | + | UGCCCCACAUAUCCCAGAGACCCC | 24 | 11286 |
| SCNN1A-1497 | + | UGCUCAUGAUACCUCCCC | 18 | 5346 |
| SCNN1A-1498 | + | CUGCUCAUGAUACCUCCCC | 19 | 5347 |
| SCNN1A-1499 | + | ACUGCUCAUGAUACCUCCCC | 20 | 5348 |
| SCNN1A-1500 | + | UACUGCUCAUGAUACCUCCCC | 21 | 5349 |
| SCNN1A-1501 | + | AUACUGCUCAUGAUACCUCCCC | 22 | 5350 |
| SCNN1A-1502 | + | GAUACUGCUCAUGAUACCUCCCC | 23 | 5351 |
| SCNN1A-1503 | + | UGAUACUGCUCAUGAUACCUCCCC | 24 | 5352 |
| SCNN1A-7438 | + | GACACAGACCCGGAGCCC | 18 | 11287 |
| SCNN1A-7439 | + | GGACACAGACCCGGAGCCC | 19 | 11288 |
| SCNN1A-5575 | + | UGGACACAGACCCGGAGCCC | 20 | 9424 |
| SCNN1A-7440 | + | GUGGACACAGACCCGGAGCCC | 21 | 11289 |
| SCNN1A-7441 | + | UGUGGACACAGACCCGGAGCCC | 22 | 11290 |
| SCNN1A-7442 | + | CUGUGGACACAGACCCGGAGCCC | 23 | 11291 |
| SCNN1A-7443 | + | ACUGUGGACACAGACCCGGAGCCC | 24 | 11292 |
| SCNN1A-7444 | + | ACACGCCUAGACAGGCCC | 18 | 11293 |
| SCNN1A-7445 | + | CACACGCCUAGACAGGCCC | 19 | 11294 |
| SCNN1A-5219 | + | GCACACGCCUAGACAGGCCC | 20 | 9068 |

TABLE 47D-continued

4th Tier

| gRNA Name | DNA Strand | Targeting Domain | Target Site Length | Seq ID |
|---|---|---|---|---|
| SCNN1A-7446 | + | GGCACACGCCUAGACAGGCCC | 21 | 11295 |
| SCNN1A-7447 | + | UGGCACACGCCUAGACAGGCCC | 22 | 11296 |
| SCNN1A-7448 | + | AUGGCACACGCCUAGACAGGCCC | 23 | 11297 |
| SCNN1A-7449 | + | CAUGGCACACGCCUAGACAGGCCC | 24 | 11298 |
| SCNN1A-7450 | + | GGGGGCUAGGCGGGGCCC | 18 | 11299 |
| SCNN1A-7451 | + | UGGGGGCUAGGCGGGGCCC | 19 | 11300 |
| SCNN1A-7452 | + | CUGGGGGCUAGGCGGGGCCC | 20 | 11301 |
| SCNN1A-7453 | + | GCUGGGGGCUAGGCGGGGCCC | 21 | 11302 |
| SCNN1A-7454 | + | AGCUGGGGGCUAGGCGGGGCCC | 22 | 11303 |
| SCNN1A-7455 | + | AAGCUGGGGGCUAGGCGGGGCCC | 23 | 11304 |
| SCNN1A-7456 | + | GAAGCUGGGGGCUAGGCGGGGCCC | 24 | 11305 |
| SCNN1A-7457 | + | CUGAUUCUGUCUCUGCCC | 18 | 11306 |
| SCNN1A-7458 | + | CCUGAUUCUGUCUCUGCCC | 19 | 11307 |
| SCNN1A-7459 | + | UCCUGAUUCUGUCUCUGCCC | 20 | 11308 |
| SCNN1A-7460 | + | GUCCUGAUUCUGUCUCUGCCC | 21 | 11309 |
| SCNN1A-7461 | + | UGUCCUGAUUCUGUCUCUGCCC | 22 | 11310 |
| SCNN1A-7462 | + | GUGUCCUGAUUCUGUCUCUGCCC | 23 | 11311 |
| SCNN1A-7463 | + | UGUGUCCUGAUUCUGUCUCUGCCC | 24 | 11312 |
| SCNN1A-7464 | + | GAAGGAAGGAGGGCUCCC | 18 | 11313 |
| SCNN1A-7465 | + | CGAAGGAAGGAGGGCUCCC | 19 | 11314 |
| SCNN1A-7466 | + | CCGAAGGAAGGAGGGCUCCC | 20 | 11315 |
| SCNN1A-7467 | + | UCCGAAGGAAGGAGGGCUCCC | 21 | 11316 |
| SCNN1A-7468 | + | UUCCGAAGGAAGGAGGGCUCCC | 22 | 11317 |
| SCNN1A-7469 | + | UUUCCGAAGGAAGGAGGGCUCCC | 23 | 11318 |
| SCNN1A-7470 | + | UUUUCCGAAGGAAGGAGGGCUCCC | 24 | 11319 |
| SCNN1A-7471 | + | UAGAAACUCCAGUCUCCC | 18 | 11320 |
| SCNN1A-7472 | + | CUAGAAACUCCAGUCUCCC | 19 | 11321 |
| SCNN1A-7473 | + | CCUAGAAACUCCAGUCUCCC | 20 | 11322 |
| SCNN1A-7474 | + | CCCUAGAAACUCCAGUCUCCC | 21 | 11323 |
| SCNN1A-7475 | + | CCCCUAGAAACUCCAGUCUCCC | 22 | 11324 |
| SCNN1A-7476 | + | ACCCCUAGAAACUCCAGUCUCCC | 23 | 11325 |
| SCNN1A-7477 | + | GACCCCUAGAAACUCCAGUCUCCC | 24 | 11326 |
| SCNN1A-7478 | + | GCCGGAGCUGGGCUUCCC | 18 | 11327 |
| SCNN1A-7479 | + | UGCCGGAGCUGGGCUUCCC | 19 | 11328 |
| SCNN1A-7480 | + | GUGCCGGAGCUGGGCUUCCC | 20 | 11329 |
| SCNN1A-7481 | + | AGUGCCGGAGCUGGGCUUCCC | 21 | 11330 |
| SCNN1A-7482 | + | AAGUGCCGGAGCUGGGCUUCCC | 22 | 11331 |

TABLE 47D-continued

4th Tier

| gRNA Name | DNA Strand | Targeting Domain | Target Site Length | Seq ID |
|---|---|---|---|---|
| SCNN1A-7483 | + | AAAGUGCCGGAGCUGGGCUUCCC | 23 | 11332 |
| SCNN1A-7484 | + | AAAAGUGCCGGAGCUGGGCUUCCC | 24 | 11333 |
| SCNN1A-7485 | + | CACCUGGAUGUGAAAGCC | 18 | 11334 |
| SCNN1A-7486 | + | GCACCUGGAUGUGAAAGCC | 19 | 11335 |
| SCNN1A-6107 | + | UGCACCUGGAUGUGAAAGCC | 20 | 9956 |
| SCNN1A-7487 | + | GUGCACCUGGAUGUGAAAGCC | 21 | 11336 |
| SCNN1A-7488 | + | GGUGCACCUGGAUGUGAAAGCC | 22 | 11337 |
| SCNN1A-7489 | + | AGGUGCACCUGGAUGUGAAAGCC | 23 | 11338 |
| SCNN1A-7490 | + | CAGGUGCACCUGGAUGUGAAAGCC | 24 | 11339 |
| SCNN1A-7491 | + | AGAUAAGACAUAAGAGCC | 18 | 11340 |
| SCNN1A-7492 | + | GAGAUAAGACAUAAGAGCC | 19 | 11341 |
| SCNN1A-7493 | + | AGAGAUAAGACAUAAGAGCC | 20 | 11342 |
| SCNN1A-7494 | + | CAGAGAUAAGACAUAAGAGCC | 21 | 11343 |
| SCNN1A-7495 | + | UCAGAGAUAAGACAUAAGAGCC | 22 | 11344 |
| SCNN1A-7496 | + | CUCAGAGAUAAGACAUAAGAGCC | 23 | 11345 |
| SCNN1A-7497 | + | UCUCAGAGAUAAGACAUAAGAGCC | 24 | 11346 |
| SCNN1A-7498 | + | GGACACAGACCCGGAGCC | 18 | 11347 |
| SCNN1A-7499 | + | UGGACACAGACCCGGAGCC | 19 | 11348 |
| SCNN1A-7500 | + | GUGGACACAGACCCGGAGCC | 20 | 11349 |
| SCNN1A-7501 | + | UGUGGACACAGACCCGGAGCC | 21 | 11350 |
| SCNN1A-7502 | + | CUGUGGACACAGACCCGGAGCC | 22 | 11351 |
| SCNN1A-7503 | + | ACUGUGGACACAGACCCGGAGCC | 23 | 11352 |
| SCNN1A-7504 | + | CACUGUGGACACAGACCCGGAGCC | 24 | 11353 |
| SCNN1A-7505 | + | CCAAGGGCUAGGGGAGCC | 18 | 11354 |
| SCNN1A-7506 | + | GCCAAGGGCUAGGGGAGCC | 19 | 11355 |
| SCNN1A-7507 | + | AGCCAAGGGCUAGGGGAGCC | 20 | 11356 |
| SCNN1A-7508 | + | GAGCCAAGGGCUAGGGGAGCC | 21 | 11357 |
| SCNN1A-7509 | + | AGAGCCAAGGGCUAGGGGAGCC | 22 | 11358 |
| SCNN1A-7510 | + | AAGAGCCAAGGGCUAGGGGAGCC | 23 | 11359 |
| SCNN1A-7511 | + | UAAGAGCCAAGGGCUAGGGGAGCC | 24 | 11360 |
| SCNN1A-1504 | + | UGUUCCCCUUCAUGAGCC | 18 | 5353 |
| SCNN1A-1505 | + | UUGUUCCCCUUCAUGAGCC | 19 | 5354 |
| SCNN1A-207 | + | CUUGUUCCCCUUCAUGAGCC | 20 | 834 |
| SCNN1A-1506 | + | GCUUGUUCCCCUUCAUGAGCC | 21 | 5355 |
| SCNN1A-1507 | + | AGCUUGUUCCCCUUCAUGAGCC | 22 | 5356 |
| SCNN1A-1508 | + | CAGCUUGUUCCCCUUCAUGAGCC | 23 | 5357 |
| SCNN1A-1509 | + | CCAGCUUGUUCCCCUUCAUGAGCC | 24 | 5358 |
| SCNN1A-7512 | + | CACACGCCUAGACAGGCC | 18 | 11361 |

TABLE 47D-continued

| | | 4th Tier | | |
|---|---|---|---|---|
| gRNA Name | DNA Strand | Targeting Domain | Target Site Length | Seq ID |
| SCNN1A-7513 | + | GCACACGCCUAGACAGGCC | 19 | 11362 |
| SCNN1A-7514 | + | GGCACACGCCUAGACAGGCC | 20 | 11363 |
| SCNN1A-7515 | + | UGGCACACGCCUAGACAGGCC | 21 | 11364 |
| SCNN1A-7516 | + | AUGGCACACGCCUAGACAGGCC | 22 | 11365 |
| SCNN1A-7517 | + | CAUGGCACACGCCUAGACAGGCC | 23 | 11366 |
| SCNN1A-7518 | + | GCAUGGCACACGCCUAGACAGGCC | 24 | 11367 |
| SCNN1A-7519 | + | CCACUGCCCCACAUAUCC | 18 | 11368 |
| SCNN1A-7520 | + | CCCACUGCCCCACAUAUCC | 19 | 11369 |
| SCNN1A-7521 | + | CCCCACUGCCCCACAUAUCC | 20 | 11370 |
| SCNN1A-7522 | + | UCCCCACUGCCCCACAUAUCC | 21 | 11371 |
| SCNN1A-7523 | + | GUCCCCACUGCCCCACAUAUCC | 22 | 11372 |
| SCNN1A-7524 | + | UGUCCCCACUGCCCCACAUAUCC | 23 | 11373 |
| SCNN1A-7525 | + | CUGUCCCCACUGCCCCACAUAUCC | 24 | 11374 |
| SCNN1A-1525 | + | UCCAGCUUGUUCCCCUCC | 18 | 5374 |
| SCNN1A-1526 | + | CUCCAGCUUGUUCCCCUCC | 19 | 5375 |
| SCNN1A-200 | + | CCUCCAGCUUGUUCCCCUCC | 20 | 829 |
| SCNN1A-1527 | + | UCCUCCAGCUUGUUCCCCUCC | 21 | 5376 |
| SCNN1A-1528 | + | CUCCUCCAGCUUGUUCCCCUCC | 22 | 5377 |
| SCNN1A-1529 | + | GCUCCUCCAGCUUGUUCCCCUCC | 23 | 5378 |
| SCNN1A-1530 | + | UGCUCCUCCAGCUUGUUCCCCUCC | 24 | 5379 |
| SCNN1A-7526 | + | GCAAGUGGGCAGCCCUCC | 18 | 11375 |
| SCNN1A-7527 | + | AGCAAGUGGGCAGCCCUCC | 19 | 11376 |
| SCNN1A-7528 | + | CAGCAAGUGGGCAGCCCUCC | 20 | 11377 |
| SCNN1A-7529 | + | UCAGCAAGUGGGCAGCCCUCC | 21 | 11378 |
| SCNN1A-7530 | + | CUCAGCAAGUGGGCAGCCCUCC | 22 | 11379 |
| SCNN1A-7531 | + | GCUCAGCAAGUGGGCAGCCCUCC | 23 | 11380 |
| SCNN1A-7532 | + | GGCUCAGCAAGUGGGCAGCCCUCC | 24 | 11381 |
| SCNN1A-7533 | + | CCAGGACUGCAGGGCUCC | 18 | 11382 |
| SCNN1A-7534 | + | CCCAGGACUGCAGGGCUCC | 19 | 11383 |
| SCNN1A-6112 | + | CCCCAGGACUGCAGGGCUCC | 20 | 9961 |
| SCNN1A-7535 | + | GCCCCAGGACUGCAGGGCUCC | 21 | 11384 |
| SCNN1A-7536 | + | UGCCCCAGGACUGCAGGGCUCC | 22 | 11385 |
| SCNN1A-7537 | + | CUGCCCCAGGACUGCAGGGCUCC | 23 | 11386 |
| SCNN1A-7538 | + | UCUGCCCCAGGACUGCAGGGCUCC | 24 | 11387 |
| SCNN1A-7539 | + | CAAAGGGAGUCUGUCUCC | 18 | 11388 |
| SCNN1A-7540 | + | CCAAAGGGAGUCUGUCUCC | 19 | 11389 |
| SCNN1A-5596 | + | ACCAAAGGGAGUCUGUCUCC | 20 | 9445 |

TABLE 47D-continued

| 4th Tier | | | | |
|---|---|---|---|---|
| gRNA Name | DNA Strand | Targeting Domain | Target Site Length | Seq ID |
| SCNN1A-7541 | + | CACCAAAGGGAGUCUGUCUCC | 21 | 11390 |
| SCNN1A-7542 | + | GCACCAAAGGGAGUCUGUCUCC | 22 | 11391 |
| SCNN1A-7543 | + | AGCACCAAAGGGAGUCUGUCUCC | 23 | 11392 |
| SCNN1A-7544 | + | CAGCACCAAAGGGAGUCUGUCUCC | 24 | 11393 |
| SCNN1A-7545 | + | AGACUCAGGAAGCCUUCC | 18 | 11394 |
| SCNN1A-7546 | + | GAGACUCAGGAAGCCUUCC | 19 | 11395 |
| SCNN1A-7547 | + | GGAGACUCAGGAAGCCUUCC | 20 | 11396 |
| SCNN1A-7548 | + | AGGAGACUCAGGAAGCCUUCC | 21 | 11397 |
| SCNN1A-7549 | + | CAGGAGACUCAGGAAGCCUUCC | 22 | 11398 |
| SCNN1A-7550 | + | GCAGGAGACUCAGGAAGCCUUCC | 23 | 11399 |
| SCNN1A-7551 | + | UGCAGGAGACUCAGGAAGCCUUCC | 24 | 11400 |
| SCNN1A-7552 | + | AGUCCCAAGUGUGCUUCC | 18 | 11401 |
| SCNN1A-7553 | + | GAGUCCCAAGUGUGCUUCC | 19 | 11402 |
| SCNN1A-5226 | + | GGAGUCCCAAGUGUGCUUCC | 20 | 9075 |
| SCNN1A-7554 | + | GGGAGUCCCAAGUGUGCUUCC | 21 | 11403 |
| SCNN1A-7555 | + | GGGGAGUCCCAAGUGUGCUUCC | 22 | 11404 |
| SCNN1A-7556 | + | GGGGGAGUCCCAAGUGUGCUUCC | 23 | 11405 |
| SCNN1A-7557 | + | GGGGGGAGUCCCAAGUGUGCUUCC | 24 | 11406 |
| SCNN1A-7558 | + | UCCCUCCUCCACCUUUCC | 18 | 11407 |
| SCNN1A-7559 | + | CUCCCUCCUCCACCUUUCC | 19 | 11408 |
| SCNN1A-6116 | + | CCUCCCUCCUCCACCUUUCC | 20 | 9965 |
| SCNN1A-7560 | + | CCCUCCCUCCUCCACCUUUCC | 21 | 11409 |
| SCNN1A-7561 | + | UCCCUCCCUCCUCCACCUUUCC | 22 | 11410 |
| SCNN1A-7562 | + | CUCCCUCCCUCCUCCACCUUUCC | 23 | 11411 |
| SCNN1A-7563 | + | CCUCCCUCCCUCCUCCACCUUUCC | 24 | 11412 |
| SCNN1A-7564 | + | GCACCUGGAUGUGAAAGC | 18 | 11413 |
| SCNN1A-7565 | + | UGCACCUGGAUGUGAAAGC | 19 | 11414 |
| SCNN1A-5227 | + | GUGCACCUGGAUGUGAAAGC | 20 | 9076 |
| SCNN1A-7566 | + | GGUGCACCUGGAUGUGAAAGC | 21 | 11415 |
| SCNN1A-7567 | + | AGGUGCACCUGGAUGUGAAAGC | 22 | 11416 |
| SCNN1A-7568 | + | CAGGUGCACCUGGAUGUGAAAGC | 23 | 11417 |
| SCNN1A-7569 | + | UCAGGUGCACCUGGAUGUGAAAGC | 24 | 11418 |
| SCNN1A-7570 | + | UGCUGAAUCUUGACAAGC | 18 | 11419 |
| SCNN1A-7571 | + | CUGCUGAAUCUUGACAAGC | 19 | 11420 |
| SCNN1A-7572 | + | UCUGCUGAAUCUUGACAAGC | 20 | 11421 |
| SCNN1A-7573 | + | CUCUGCUGAAUCUUGACAAGC | 21 | 11422 |
| SCNN1A-7574 | + | UCUCUGCUGAAUCUUGACAAGC | 22 | 11423 |
| SCNN1A-7575 | + | AUCUCUGCUGAAUCUUGACAAGC | 23 | 11424 |

TABLE 47D-continued

4th Tier

| gRNA Name | DNA Strand | Targeting Domain | Target Site Length | Seq ID |
|---|---|---|---|---|
| SCNN1A-7576 | + | CAUCUCUGCUGAAUCUUGACAAGC | 24 | 11425 |
| SCNN1A-7577 | + | GAGGGGCCCAGGUGAAGC | 18 | 11426 |
| SCNN1A-7578 | + | GGAGGGGCCCAGGUGAAGC | 19 | 11427 |
| SCNN1A-5885 | + | GGGAGGGGCCCAGGUGAAGC | 20 | 9734 |
| SCNN1A-7579 | + | CGGGAGGGGCCCAGGUGAAGC | 21 | 11428 |
| SCNN1A-7580 | + | CCGGGAGGGGCCCAGGUGAAGC | 22 | 11429 |
| SCNN1A-7581 | + | CCCGGGAGGGGCCCAGGUGAAGC | 23 | 11430 |
| SCNN1A-7582 | + | ACCCGGGAGGGGCCCAGGUGAAGC | 24 | 11431 |
| SCNN1A-7583 | + | GGAUCCUGAGCCCACAGC | 18 | 11432 |
| SCNN1A-7584 | + | AGGAUCCUGAGCCCACAGC | 19 | 11433 |
| SCNN1A-7585 | + | AAGGAUCCUGAGCCCACAGC | 20 | 11434 |
| SCNN1A-7586 | + | GAAGGAUCCUGAGCCCACAGC | 21 | 11435 |
| SCNN1A-7587 | + | AGAAGGAUCCUGAGCCCACAGC | 22 | 11436 |
| SCNN1A-7588 | + | UAGAAGGAUCCUGAGCCCACAGC | 23 | 11437 |
| SCNN1A-7589 | + | GUAGAAGGAUCCUGAGCCCACAGC | 24 | 11438 |
| SCNN1A-7590 | + | AGCAGACAAAGGCCCAGC | 18 | 11439 |
| SCNN1A-7591 | + | CAGCAGACAAAGGCCCAGC | 19 | 11440 |
| SCNN1A-7592 | + | CCAGCAGACAAAGGCCCAGC | 20 | 11441 |
| SCNN1A-7593 | + | GCCAGCAGACAAAGGCCCAGC | 21 | 11442 |
| SCNN1A-7594 | + | AGCCAGCAGACAAAGGCCCAGC | 22 | 11443 |
| SCNN1A-7595 | + | AAGCCAGCAGACAAAGGCCCAGC | 23 | 11444 |
| SCNN1A-7596 | + | CAAGCCAGCAGACAAAGGCCCAGC | 24 | 11445 |
| SCNN1A-7597 | + | UGGGCAACCAGAGGCAGC | 18 | 11446 |
| SCNN1A-7598 | + | GUGGGCAACCAGAGGCAGC | 19 | 11447 |
| SCNN1A-7599 | + | UGUGGGCAACCAGAGGCAGC | 20 | 11448 |
| SCNN1A-7600 | + | AUGUGGGCAACCAGAGGCAGC | 21 | 11449 |
| SCNN1A-7601 | + | AAUGUGGGCAACCAGAGGCAGC | 22 | 11450 |
| SCNN1A-7602 | + | GAAUGUGGGCAACCAGAGGCAGC | 23 | 11451 |
| SCNN1A-7603 | + | GGAAUGUGGGCAACCAGAGGCAGC | 24 | 11452 |
| SCNN1A-7604 | + | CUGAGGAGGAGUCAGAGC | 18 | 11453 |
| SCNN1A-7605 | + | GCUGAGGAGGAGUCAGAGC | 19 | 11454 |
| SCNN1A-5886 | + | GGCUGAGGAGGAGUCAGAGC | 20 | 9735 |
| SCNN1A-7606 | + | GGGCUGAGGAGGAGUCAGAGC | 21 | 11455 |
| SCNN1A-7607 | + | GGGGCUGAGGAGGAGUCAGAGC | 22 | 11456 |
| SCNN1A-7608 | + | AGGGGCUGAGGAGGAGUCAGAGC | 23 | 11457 |
| SCNN1A-7609 | + | GAGGGGCUGAGGAGGAGUCAGAGC | 24 | 11458 |
| SCNN1A-7610 | + | GUCUCCAGGAAGGAGAGC | 18 | 11459 |

TABLE 47D-continued

4th Tier

| gRNA Name | DNA Strand | Targeting Domain | Target Site Length | Seq ID |
|---|---|---|---|---|
| SCNN1A-7611 | + | UGUCUCCAGGAAGGAGAGC | 19 | 11460 |
| SCNN1A-7612 | + | CUGUCUCCAGGAAGGAGAGC | 20 | 11461 |
| SCNN1A-7613 | + | UCUGUCUCCAGGAAGGAGAGC | 21 | 11462 |
| SCNN1A-7614 | + | GUCUGUCUCCAGGAAGGAGAGC | 22 | 11463 |
| SCNN1A-7615 | + | AGUCUGUCUCCAGGAAGGAGAGC | 23 | 11464 |
| SCNN1A-7616 | + | GAGUCUGUCUCCAGGAAGGAGAGC | 24 | 11465 |
| SCNN1A-7617 | + | AAGUGUGCUUCCAGGAGC | 18 | 11466 |
| SCNN1A-7618 | + | CAAGUGUGCUUCCAGGAGC | 19 | 11467 |
| SCNN1A-7619 | + | CCAAGUGUGCUUCCAGGAGC | 20 | 11468 |
| SCNN1A-7620 | + | CCCAAGUGUGCUUCCAGGAGC | 21 | 11469 |
| SCNN1A-7621 | + | UCCCAAGUGUGCUUCCAGGAGC | 22 | 11470 |
| SCNN1A-7622 | + | GUCCCAAGUGUGCUUCCAGGAGC | 23 | 11471 |
| SCNN1A-7623 | + | AGUCCCAAGUGUGCUUCCAGGAGC | 24 | 11472 |
| SCNN1A-7624 | + | GAGUGCCAAGUGGUGAGC | 18 | 11473 |
| SCNN1A-7625 | + | GGAGUGCCAAGUGGUGAGC | 19 | 11474 |
| SCNN1A-7626 | + | UGGAGUGCCAAGUGGUGAGC | 20 | 11475 |
| SCNN1A-7627 | + | GUGGAGUGCCAAGUGGUGAGC | 21 | 11476 |
| SCNN1A-7628 | + | AGUGGAGUGCCAAGUGGUGAGC | 22 | 11477 |
| SCNN1A-7629 | + | GAGUGGAGUGCCAAGUGGUGAGC | 23 | 11478 |
| SCNN1A-7630 | + | GGAGUGGAGUGCCAAGUGGUGAGC | 24 | 11479 |
| SCNN1A-7631 | + | GGAGGAUGUGGCCAGCGC | 18 | 11480 |
| SCNN1A-7632 | + | GGGAGGAUGUGGCCAGCGC | 19 | 11481 |
| SCNN1A-6120 | + | AGGGAGGAUGUGGCCAGCGC | 20 | 9969 |
| SCNN1A-7633 | + | CAGGGAGGAUGUGGCCAGCGC | 21 | 11482 |
| SCNN1A-7634 | + | GCAGGGAGGAUGUGGCCAGCGC | 22 | 11483 |
| SCNN1A-7635 | + | UGCAGGGAGGAUGUGGCCAGCGC | 23 | 11484 |
| SCNN1A-7636 | + | GUGCAGGGAGGAUGUGGCCAGCGC | 24 | 11485 |
| SCNN1A-7637 | + | GGCAACCAGAGGCAGCGC | 18 | 11486 |
| SCNN1A-7638 | + | GGGCAACCAGAGGCAGCGC | 19 | 11487 |
| SCNN1A-7639 | + | UGGGCAACCAGAGGCAGCGC | 20 | 11488 |
| SCNN1A-7640 | + | GUGGGCAACCAGAGGCAGCGC | 21 | 11489 |
| SCNN1A-7641 | + | UGUGGGCAACCAGAGGCAGCGC | 22 | 11490 |
| SCNN1A-7642 | + | AUGUGGGCAACCAGAGGCAGCGC | 23 | 11491 |
| SCNN1A-7643 | + | AAUGUGGGCAACCAGAGGCAGCGC | 24 | 11492 |
| SCNN1A-7644 | + | CUUUAGACGCAGACAGGC | 18 | 11493 |
| SCNN1A-7645 | + | GCUUUAGACGCAGACAGGC | 19 | 11494 |
| SCNN1A-7646 | + | GGCUUUAGACGCAGACAGGC | 20 | 11495 |
| SCNN1A-7647 | + | GGGCUUUAGACGCAGACAGGC | 21 | 11496 |

TABLE 47D-continued

4th Tier

| gRNA Name | DNA Strand | Targeting Domain | Target Site Length | Seq ID |
|---|---|---|---|---|
| SCNN1A-7648 | + | GGGGCUUUAGACGCAGACAGGC | 22 | 11497 |
| SCNN1A-7649 | + | AGGGGCUUUAGACGCAGACAGGC | 23 | 11498 |
| SCNN1A-7650 | + | CAGGGGCUUUAGACGCAGACAGGC | 24 | 11499 |
| SCNN1A-7651 | + | CACUGUUGGCUGCCAGGC | 18 | 11500 |
| SCNN1A-7652 | + | ACACUGUUGGCUGCCAGGC | 19 | 11501 |
| SCNN1A-7653 | + | UACACUGUUGGCUGCCAGGC | 20 | 11502 |
| SCNN1A-7654 | + | UUACACUGUUGGCUGCCAGGC | 21 | 11503 |
| SCNN1A-7655 | + | UUUACACUGUUGGCUGCCAGGC | 22 | 11504 |
| SCNN1A-7656 | + | UUUUACACUGUUGGCUGCCAGGC | 23 | 11505 |
| SCNN1A-7657 | + | UUUUUACACUGUUGGCUGCCAGGC | 24 | 11506 |
| SCNN1A-7658 | + | CGGAGCCCAGGAAGAGGC | 18 | 11507 |
| SCNN1A-7659 | + | CCGGAGCCCAGGAAGAGGC | 19 | 11508 |
| SCNN1A-6122 | + | CCCGGAGCCCAGGAAGAGGC | 20 | 9971 |
| SCNN1A-7660 | + | ACCCGGAGCCCAGGAAGAGGC | 21 | 11509 |
| SCNN1A-7661 | + | GACCCGGAGCCCAGGAAGAGGC | 22 | 11510 |
| SCNN1A-7662 | + | AGACCCGGAGCCCAGGAAGAGGC | 23 | 11511 |
| SCNN1A-7663 | + | CAGACCCGGAGCCCAGGAAGAGGC | 24 | 11512 |
| SCNN1A-7664 | + | GCAGACAGGCAAGGAGGC | 18 | 11513 |
| SCNN1A-7665 | + | CGCAGACAGGCAAGGAGGC | 19 | 11514 |
| SCNN1A-5608 | + | ACGCAGACAGGCAAGGAGGC | 20 | 9457 |
| SCNN1A-7666 | + | GACGCAGACAGGCAAGGAGGC | 21 | 11515 |
| SCNN1A-7667 | + | AGACGCAGACAGGCAAGGAGGC | 22 | 11516 |
| SCNN1A-7668 | + | UAGACGCAGACAGGCAAGGAGGC | 23 | 11517 |
| SCNN1A-7669 | + | UUAGACGCAGACAGGCAAGGAGGC | 24 | 11518 |
| SCNN1A-7670 | + | GCCCGCCCGCUGGCCGGC | 18 | 11519 |
| SCNN1A-7671 | + | AGCCCGCCCGCUGGCCGGC | 19 | 11520 |
| SCNN1A-7672 | + | GAGCCCGCCCGCUGGCCGGC | 20 | 11521 |
| SCNN1A-7673 | + | GGAGCCCGCCCGCUGGCCGGC | 21 | 11522 |
| SCNN1A-7674 | + | GGGAGCCCGCCCGCUGGCCGGC | 22 | 11523 |
| SCNN1A-7675 | + | GGGGAGCCCGCCCGCUGGCCGGC | 23 | 11524 |
| SCNN1A-7676 | + | UGGGGAGCCCGCCCGCUGGCCGGC | 24 | 11525 |
| SCNN1A-7677 | + | CCAGGCCCUGCACGCGGC | 18 | 11526 |
| SCNN1A-7678 | + | CCCAGGCCCUGCACGCGGC | 19 | 11527 |
| SCNN1A-5609 | + | ACCCAGGCCCUGCACGCGGC | 20 | 9458 |
| SCNN1A-7679 | + | AACCCAGGCCCUGCACGCGGC | 21 | 11528 |
| SCNN1A-7680 | + | CAACCCAGGCCCUGCACGCGGC | 22 | 11529 |
| SCNN1A-7681 | + | ACAACCCAGGCCCUGCACGCGGC | 23 | 11530 |

TABLE 47D-continued

4th Tier

| gRNA Name | DNA Strand | Targeting Domain | Target Site Length | Seq ID |
|---|---|---|---|---|
| SCNN1A-7682 | + | CACAACCCAGGCCCUGCACGCGGC | 24 | 11531 |
| SCNN1A-7683 | + | AUCAGACCCAAAAAGGGC | 18 | 11532 |
| SCNN1A-7684 | + | AAUCAGACCCAAAAAGGGC | 19 | 11533 |
| SCNN1A-5232 | + | GAAUCAGACCCAAAAAGGGC | 20 | 9081 |
| SCNN1A-7685 | + | AGAAUCAGACCCAAAAAGGGC | 21 | 11534 |
| SCNN1A-7686 | + | GAGAAUCAGACCCAAAAAGGGC | 22 | 11535 |
| SCNN1A-7687 | + | AGAGAAUCAGACCCAAAAAGGGC | 23 | 11536 |
| SCNN1A-7688 | + | CAGAGAAUCAGACCCAAAAAGGGC | 24 | 11537 |
| SCNN1A-7689 | + | GACAUAAGAGCCAAGGGC | 18 | 11538 |
| SCNN1A-7690 | + | AGACAUAAGAGCCAAGGGC | 19 | 11539 |
| SCNN1A-7691 | + | AAGACAUAAGAGCCAAGGGC | 20 | 11540 |
| SCNN1A-7692 | + | UAAGACAUAAGAGCCAAGGGC | 21 | 11541 |
| SCNN1A-7693 | + | AUAAGACAUAAGAGCCAAGGGC | 22 | 11542 |
| SCNN1A-7694 | + | GAUAAGACAUAAGAGCCAAGGGC | 23 | 11543 |
| SCNN1A-7695 | + | AGAUAAGACAUAAGAGCCAAGGGC | 24 | 11544 |
| SCNN1A-7696 | + | AUUAAAGGUGAGCAGGGC | 18 | 11545 |
| SCNN1A-7697 | + | AAUUAAAGGUGAGCAGGGC | 19 | 11546 |
| SCNN1A-5611 | + | CAAUUAAAGGUGAGCAGGGC | 20 | 9460 |
| SCNN1A-7698 | + | UCAAUUAAAGGUGAGCAGGGC | 21 | 11547 |
| SCNN1A-7699 | + | CUCAAUUAAAGGUGAGCAGGGC | 22 | 11548 |
| SCNN1A-7700 | + | UCUCAAUUAAAGGUGAGCAGGGC | 23 | 11549 |
| SCNN1A-7701 | + | AUCUCAAUUAAAGGUGAGCAGGGC | 24 | 11550 |
| SCNN1A-7702 | + | AGAAGGCGGACUCUGGGC | 18 | 11551 |
| SCNN1A-7703 | + | GAGAAGGCGGACUCUGGGC | 19 | 11552 |
| SCNN1A-5613 | + | UGAGAAGGCGGACUCUGGGC | 20 | 9462 |
| SCNN1A-7704 | + | CUGAGAAGGCGGACUCUGGGC | 21 | 11553 |
| SCNN1A-7705 | + | CCUGAGAAGGCGGACUCUGGGC | 22 | 11554 |
| SCNN1A-7706 | + | ACCUGAGAAGGCGGACUCUGGGC | 23 | 11555 |
| SCNN1A-7707 | + | GACCUGAGAAGGCGGACUCUGGGC | 24 | 11556 |
| SCNN1A-7708 | + | CAGGUGCAGCGGCCUGGC | 18 | 11557 |
| SCNN1A-7709 | + | ACAGGUGCAGCGGCCUGGC | 19 | 11558 |
| SCNN1A-5234 | + | GACAGGUGCAGCGGCCUGGC | 20 | 9083 |
| SCNN1A-7710 | + | UGACAGGUGCAGCGGCCUGGC | 21 | 11559 |
| SCNN1A-7711 | + | CUGACAGGUGCAGCGGCCUGGC | 22 | 11560 |
| SCNN1A-7712 | + | CCUGACAGGUGCAGCGGCCUGGC | 23 | 11561 |
| SCNN1A-7713 | + | ACCUGACAGGUGCAGCGGCCUGGC | 24 | 11562 |
| SCNN1A-7714 | + | CUAUUUGCCAGCUCAUGC | 18 | 11563 |
| SCNN1A-7715 | + | UCUAUUUGCCAGCUCAUGC | 19 | 11564 |

TABLE 47D-continued

| | | 4th Tier | | |
|---|---|---|---|---|
| gRNA Name | DNA Strand | Targeting Domain | Target Site Length | Seq ID |
| SCNN1A-7716 | + | UUCUAUUUGCCAGCUCAUGC | 20 | 11565 |
| SCNN1A-7717 | + | UUUCUAUUUGCCAGCUCAUGC | 21 | 11566 |
| SCNN1A-7718 | + | UUUUCUAUUUGCCAGCUCAUGC | 22 | 11567 |
| SCNN1A-7719 | + | CUUUUCUAUUUGCCAGCUCAUGC | 23 | 11568 |
| SCNN1A-7720 | + | CCUUUUCUAUUUGCCAGCUCAUGC | 24 | 11569 |
| SCNN1A-7721 | + | AGCCUAGGGGCUCACUGC | 18 | 11570 |
| SCNN1A-7722 | + | GAGCCUAGGGGCUCACUGC | 19 | 11571 |
| SCNN1A-5235 | + | GGAGCCUAGGGGCUCACUGC | 20 | 9084 |
| SCNN1A-7723 | + | GGGAGCCUAGGGGCUCACUGC | 21 | 11572 |
| SCNN1A-7724 | + | GGGGAGCCUAGGGGCUCACUGC | 22 | 11573 |
| SCNN1A-7725 | + | AGGGGAGCCUAGGGGCUCACUGC | 23 | 11574 |
| SCNN1A-7726 | + | UAGGGGAGCCUAGGGGCUCACUGC | 24 | 11575 |
| SCNN1A-7727 | + | AGUUGGGGCCAAAAGUGC | 18 | 11576 |
| SCNN1A-7728 | + | GAGUUGGGGCCAAAAGUGC | 19 | 11577 |
| SCNN1A-5236 | + | GGAGUUGGGGCCAAAAGUGC | 20 | 9085 |
| SCNN1A-7729 | + | GGGAGUUGGGGCCAAAAGUGC | 21 | 11578 |
| SCNN1A-7730 | + | CGGGAGUUGGGGCCAAAAGUGC | 22 | 11579 |
| SCNN1A-7731 | + | GCGGGAGUUGGGGCCAAAAGUGC | 23 | 11580 |
| SCNN1A-7732 | + | UGCGGGAGUUGGGGCCAAAAGUGC | 24 | 11581 |
| SCNN1A-7733 | + | AGCAGGCACUGAAGGUGC | 18 | 11582 |
| SCNN1A-7734 | + | AAGCAGGCACUGAAGGUGC | 19 | 11583 |
| SCNN1A-5620 | + | AAAGCAGGCACUGAAGGUGC | 20 | 9469 |
| SCNN1A-7735 | + | GAAAGCAGGCACUGAAGGUGC | 21 | 11584 |
| SCNN1A-7736 | + | GGAAAGCAGGCACUGAAGGUGC | 22 | 11585 |
| SCNN1A-7737 | + | GGGAAAGCAGGCACUGAAGGUGC | 23 | 11586 |
| SCNN1A-7738 | + | AGGGAAAGCAGGCACUGAAGGUGC | 24 | 11587 |
| SCNN1A-7739 | + | UGAACAAGUAGAAGGAUC | 18 | 11588 |
| SCNN1A-7740 | + | CUGAACAAGUAGAAGGAUC | 19 | 11589 |
| SCNN1A-7741 | + | UCUGAACAAGUAGAAGGAUC | 20 | 11590 |
| SCNN1A-7742 | + | AUCUGAACAAGUAGAAGGAUC | 21 | 11591 |
| SCNN1A-7743 | + | GAUCUGAACAAGUAGAAGGAUC | 22 | 11592 |
| SCNN1A-7744 | + | AGAUCUGAACAAGUAGAAGGAUC | 23 | 11593 |
| SCNN1A-7745 | + | AAGAUCUGAACAAGUAGAAGGAUC | 24 | 11594 |
| SCNN1A-7746 | + | GCAAUAGUUUUCAUAUC | 18 | 11595 |
| SCNN1A-7747 | + | GGCAAUAGUUUUCAUAUC | 19 | 11596 |
| SCNN1A-7748 | + | UGGCAAUAGUUUUCAUAUC | 20 | 11597 |
| SCNN1A-7749 | + | AUGGCAAUAGUUUUCAUAUC | 21 | 11598 |

TABLE 47D-continued

4th Tier

| gRNA Name | DNA Strand | Targeting Domain | Target Site Length | Seq ID |
|---|---|---|---|---|
| SCNN1A-7750 | + | CAUGGCAAAUAGUUUUCAUAUC | 22 | 11599 |
| SCNN1A-7751 | + | GCAUGGCAAAUAGUUUUCAUAUC | 23 | 11600 |
| SCNN1A-7752 | + | AGCAUGGCAAAUAGUUUUCAUAUC | 24 | 11601 |
| SCNN1A-7753 | + | ACUUCCUGAGACAGACUC | 18 | 11602 |
| SCNN1A-7754 | + | UACUUCCUGAGACAGACUC | 19 | 11603 |
| SCNN1A-7755 | + | UUACUUCCUGAGACAGACUC | 20 | 11604 |
| SCNN1A-7756 | + | UUUACUUCCUGAGACAGACUC | 21 | 11605 |
| SCNN1A-7757 | + | AUUUACUUCCUGAGACAGACUC | 22 | 11606 |
| SCNN1A-7758 | + | CAUUUACUUCCUGAGACAGACUC | 23 | 11607 |
| SCNN1A-7759 | + | CCAUUUACUUCCUGAGACAGACUC | 24 | 11608 |
| SCNN1A-7760 | + | GCUCACUGCAGGAGACUC | 18 | 11609 |
| SCNN1A-7761 | + | GGCUCACUGCAGGAGACUC | 19 | 11610 |
| SCNN1A-5239 | + | GGGCUCACUGCAGGAGACUC | 20 | 9088 |
| SCNN1A-7762 | + | GGGGCUCACUGCAGGAGACUC | 21 | 11611 |
| SCNN1A-7763 | + | AGGGGCUCACUGCAGGAGACUC | 22 | 11612 |
| SCNN1A-7764 | + | UAGGGGCUCACUGCAGGAGACUC | 23 | 11613 |
| SCNN1A-7765 | + | CUAGGGGCUCACUGCAGGAGACUC | 24 | 11614 |
| SCNN1A-7766 | + | AAGGGCUGGAGGAGACUC | 18 | 11615 |
| SCNN1A-7767 | + | AAAGGGCUGGAGGAGACUC | 19 | 11616 |
| SCNN1A-5628 | + | AAAAGGGCUGGAGGAGACUC | 20 | 9477 |
| SCNN1A-7768 | + | AAAAAGGGCUGGAGGAGACUC | 21 | 11617 |
| SCNN1A-7769 | + | CAAAAAGGGCUGGAGGAGACUC | 22 | 11618 |
| SCNN1A-7770 | + | CCAAAAAGGGCUGGAGGAGACUC | 23 | 11619 |
| SCNN1A-7771 | + | CCCAAAAAGGGCUGGAGGAGACUC | 24 | 11620 |
| SCNN1A-7772 | + | AGAAUUCUCCUCCUCCUC | 18 | 11621 |
| SCNN1A-7773 | + | CAGAAUUCUCCUCCUCCUC | 19 | 11622 |
| SCNN1A-6134 | + | UCAGAAUUCUCCUCCUCCUC | 20 | 9983 |
| SCNN1A-7774 | + | UUCAGAAUUCUCCUCCUCCUC | 21 | 11623 |
| SCNN1A-7775 | + | AUUCAGAAUUCUCCUCCUCCUC | 22 | 11624 |
| SCNN1A-7776 | + | AAUUCAGAAUUCUCCUCCUCCUC | 23 | 11625 |
| SCNN1A-7777 | + | GAAUUCAGAAUUCUCCUCCUCCUC | 24 | 11626 |
| SCNN1A-7778 | + | GAAGGCUGCCGCUUCCUC | 18 | 11627 |
| SCNN1A-7779 | + | GGAAGGCUGCCGCUUCCUC | 19 | 11628 |
| SCNN1A-7780 | + | GGGAAGGCUGCCGCUUCCUC | 20 | 11629 |
| SCNN1A-7781 | + | AGGGAAGGCUGCCGCUUCCUC | 21 | 11630 |
| SCNN1A-7782 | + | CAGGGAAGGCUGCCGCUUCCUC | 22 | 11631 |
| SCNN1A-7783 | + | GCAGGGAAGGCUGCCGCUUCCUC | 23 | 11632 |
| SCNN1A-7784 | + | GGCAGGGAAGGCUGCCGCUUCCUC | 24 | 11633 |

TABLE 47D-continued

4th Tier

| gRNA Name | DNA Strand | Targeting Domain | Target Site Length | Seq ID |
|---|---|---|---|---|
| SCNN1A-7785 | + | CCCAGGACUGCAGGGCUC | 18 | 11634 |
| SCNN1A-7786 | + | CCCCAGGACUGCAGGGCUC | 19 | 11635 |
| SCNN1A-7787 | + | GCCCCAGGACUGCAGGGCUC | 20 | 11636 |
| SCNN1A-7788 | + | UGCCCCAGGACUGCAGGGCUC | 21 | 11637 |
| SCNN1A-7789 | + | CUGCCCCAGGACUGCAGGGCUC | 22 | 11638 |
| SCNN1A-7790 | + | UCUGCCCCAGGACUGCAGGGCUC | 23 | 11639 |
| SCNN1A-7791 | + | CUCUGCCCCAGGACUGCAGGGCUC | 24 | 11640 |
| SCNN1A-7792 | + | CCGAAGGAAGGAGGGCUC | 18 | 11641 |
| SCNN1A-7793 | + | UCCGAAGGAAGGAGGGCUC | 19 | 11642 |
| SCNN1A-7794 | + | UUCCGAAGGAAGGAGGGCUC | 20 | 11643 |
| SCNN1A-7795 | + | UUUCCGAAGGAAGGAGGGCUC | 21 | 11644 |
| SCNN1A-7796 | + | UUUUCCGAAGGAAGGAGGGCUC | 22 | 11645 |
| SCNN1A-7797 | + | GUUUUCCGAAGGAAGGAGGGCUC | 23 | 11646 |
| SCNN1A-7798 | + | AGUUUUCCGAAGGAAGGAGGGCUC | 24 | 11647 |
| SCNN1A-7799 | + | CCAAAGGGAGUCUGUCUC | 18 | 11648 |
| SCNN1A-7800 | + | ACCAAAGGGAGUCUGUCUC | 19 | 11649 |
| SCNN1A-7801 | + | CACCAAAGGGAGUCUGUCUC | 20 | 11650 |
| SCNN1A-7802 | + | GCACCAAAGGGAGUCUGUCUC | 21 | 11651 |
| SCNN1A-7803 | + | AGCACCAAAGGGAGUCUGUCUC | 22 | 11652 |
| SCNN1A-7804 | + | CAGCACCAAAGGGAGUCUGUCUC | 23 | 11653 |
| SCNN1A-7805 | + | CCAGCACCAAAGGGAGUCUGUCUC | 24 | 11654 |
| SCNN1A-7806 | + | GCUUUUGCCAUUUACUUC | 18 | 11655 |
| SCNN1A-7807 | + | CGCUUUUGCCAUUUACUUC | 19 | 11656 |
| SCNN1A-7808 | + | GCGCUUUUGCCAUUUACUUC | 20 | 11657 |
| SCNN1A-7809 | + | AGCGCUUUUGCCAUUUACUUC | 21 | 11658 |
| SCNN1A-7810 | + | UAGCGCUUUUGCCAUUUACUUC | 22 | 11659 |
| SCNN1A-7811 | + | UUAGCGCUUUUGCCAUUUACUUC | 23 | 11660 |
| SCNN1A-7812 | + | CUUAGCGCUUUUGCCAUUUACUUC | 24 | 11661 |
| SCNN1A-1549 | + | UCCAGCUUGUUCCCCUUC | 18 | 5398 |
| SCNN1A-1550 | + | CUCCAGCUUGUUCCCCUUC | 19 | 5399 |
| SCNN1A-1551 | + | CCUCCAGCUUGUUCCCCUUC | 20 | 5400 |
| SCNN1A-1552 | + | UCCUCCAGCUUGUUCCCCUUC | 21 | 5401 |
| SCNN1A-1553 | + | CUCCUCCAGCUUGUUCCCCUUC | 22 | 5402 |
| SCNN1A-1554 | + | GCUCCUCCAGCUUGUUCCCCUUC | 23 | 5403 |
| SCNN1A-1555 | + | UGCUCCUCCAGCUUGUUCCCCUUC | 24 | 5404 |
| SCNN1A-7813 | + | GAGUCCCAAGUGUGCUUC | 18 | 11662 |
| SCNN1A-7814 | + | GGAGUCCCAAGUGUGCUUC | 19 | 11663 |

TABLE 47D-continued

4th Tier

| gRNA Name | DNA Strand | Targeting Domain | Target Site Length | Seq ID |
|---|---|---|---|---|
| SCNN1A-7815 | + | GGGAGUCCCAAGUGUGCUUC | 20 | 11664 |
| SCNN1A-7816 | + | GGGGAGUCCCAAGUGUGCUUC | 21 | 11665 |
| SCNN1A-7817 | + | GGGGGAGUCCCAAGUGUGCUUC | 22 | 11666 |
| SCNN1A-7818 | + | GGGGGGAGUCCCAAGUGUGCUUC | 23 | 11667 |
| SCNN1A-7819 | + | AGGGGGGAGUCCCAAGUGUGCUUC | 24 | 11668 |
| SCNN1A-7820 | + | CUCCCUCCUCCACCUUUC | 18 | 11669 |
| SCNN1A-7821 | + | CCUCCCUCCUCCACCUUUC | 19 | 11670 |
| SCNN1A-7822 | + | CCCUCCCUCCUCCACCUUUC | 20 | 11671 |
| SCNN1A-7823 | + | UCCCUCCCUCCUCCACCUUUC | 21 | 11672 |
| SCNN1A-7824 | + | CUCCCUCCCUCCUCCACCUUUC | 22 | 11673 |
| SCNN1A-7825 | + | CCUCCCUCCCUCCUCCACCUUUC | 23 | 11674 |
| SCNN1A-7826 | + | UCCUCCCUCCCUCCUCCACCUUUC | 24 | 11675 |
| SCNN1A-7827 | + | GGAGUUUAGCAGGCAAAG | 18 | 11676 |
| SCNN1A-7828 | + | AGGAGUUUAGCAGGCAAAG | 19 | 11677 |
| SCNN1A-7829 | + | AAGGAGUUUAGCAGGCAAAG | 20 | 11678 |
| SCNN1A-7830 | + | CAAGGAGUUUAGCAGGCAAAG | 21 | 11679 |
| SCNN1A-7831 | + | GCAAGGAGUUUAGCAGGCAAAG | 22 | 11680 |
| SCNN1A-7832 | + | AGCAAGGAGUUUAGCAGGCAAAG | 23 | 11681 |
| SCNN1A-7833 | + | AAGCAAGGAGUUUAGCAGGCAAAG | 24 | 11682 |
| SCNN1A-7834 | + | GGACAGGAGGGCAGAAAG | 18 | 11683 |
| SCNN1A-7835 | + | AGGACAGGAGGGCAGAAAG | 19 | 11684 |
| SCNN1A-5894 | + | GAGGACAGGAGGGCAGAAAG | 20 | 9743 |
| SCNN1A-7836 | + | GGAGGACAGGAGGGCAGAAAG | 21 | 11685 |
| SCNN1A-7837 | + | GGGAGGACAGGAGGGCAGAAAG | 22 | 11686 |
| SCNN1A-7838 | + | CGGGAGGACAGGAGGGCAGAAAG | 23 | 11687 |
| SCNN1A-7839 | + | CCGGGAGGACAGGAGGGCAGAAAG | 24 | 11688 |
| SCNN1A-7840 | + | UGCACCUGGAUGUGAAAG | 18 | 11689 |
| SCNN1A-7841 | + | GUGCACCUGGAUGUGAAAG | 19 | 11690 |
| SCNN1A-7842 | + | GGUGCACCUGGAUGUGAAAG | 20 | 11691 |
| SCNN1A-7843 | + | AGGUGCACCUGGAUGUGAAAG | 21 | 11692 |
| SCNN1A-7844 | + | CAGGUGCACCUGGAUGUGAAAG | 22 | 11693 |
| SCNN1A-7845 | + | UCAGGUGCACCUGGAUGUGAAAG | 23 | 11694 |
| SCNN1A-7846 | + | CUCAGGUGCACCUGGAUGUGAAAG | 24 | 11695 |
| SCNN1A-7847 | + | UUAGCAUCUCAAUUAAAG | 18 | 11696 |
| SCNN1A-7848 | + | AUUAGCAUCUCAAUUAAAG | 19 | 11697 |
| SCNN1A-7849 | + | CAUUAGCAUCUCAAUUAAAG | 20 | 11698 |
| SCNN1A-7850 | + | UCAUUAGCAUCUCAAUUAAAG | 21 | 11699 |
| SCNN1A-7851 | + | CUCAUUAGCAUCUCAAUUAAAG | 22 | 11700 |

TABLE 47D-continued

4th Tier

| gRNA Name | DNA Strand | Targeting Domain | Target Site Length | Seq ID |
|---|---|---|---|---|
| SCNN1A-7852 | + | UCUCAUUAGCAUCUCAAUUAAAG | 23 | 11701 |
| SCNN1A-7853 | + | AUCUCAUUAGCAUCUCAAUUAAAG | 24 | 11702 |
| SCNN1A-7854 | + | GGCAAAGAUCUGAACAAG | 18 | 11703 |
| SCNN1A-7855 | + | GGGCAAAGAUCUGAACAAG | 19 | 11704 |
| SCNN1A-7856 | + | GGGGCAAAGAUCUGAACAAG | 20 | 11705 |
| SCNN1A-7857 | + | AGGGGCAAAGAUCUGAACAAG | 21 | 11706 |
| SCNN1A-7858 | + | GAGGGGCAAAGAUCUGAACAAG | 22 | 11707 |
| SCNN1A-7859 | + | UGAGGGGCAAAGAUCUGAACAAG | 23 | 11708 |
| SCNN1A-7860 | + | GUGAGGGGCAAAGAUCUGAACAAG | 24 | 11709 |
| SCNN1A-7861 | + | CUAGGAGGGCAACACAAG | 18 | 11710 |
| SCNN1A-7862 | + | GCUAGGAGGGCAACACAAG | 19 | 11711 |
| SCNN1A-7863 | + | AGCUAGGAGGGCAACACAAG | 20 | 11712 |
| SCNN1A-7864 | + | CAGCUAGGAGGGCAACACAAG | 21 | 11713 |
| SCNN1A-7865 | + | ACAGCUAGGAGGGCAACACAAG | 22 | 11714 |
| SCNN1A-7866 | + | CACAGCUAGGAGGGCAACACAAG | 23 | 11715 |
| SCNN1A-7867 | + | CCACAGCUAGGAGGGCAACACAAG | 24 | 11716 |
| SCNN1A-7868 | + | UCCAGGAAGGAGAGCAAG | 18 | 11717 |
| SCNN1A-7869 | + | CUCCAGGAAGGAGAGCAAG | 19 | 11718 |
| SCNN1A-6140 | + | UCUCCAGGAAGGAGAGCAAG | 20 | 9989 |
| SCNN1A-7870 | + | GUCUCCAGGAAGGAGAGCAAG | 21 | 11719 |
| SCNN1A-7871 | + | UGUCUCCAGGAAGGAGAGCAAG | 22 | 11720 |
| SCNN1A-7872 | + | CUGUCUCCAGGAAGGAGAGCAAG | 23 | 11721 |
| SCNN1A-7873 | + | UCUGUCUCCAGGAAGGAGAGCAAG | 24 | 11722 |
| SCNN1A-7874 | + | UGCCAAGUGGUGAGCAAG | 18 | 11723 |
| SCNN1A-7875 | + | GUGCCAAGUGGUGAGCAAG | 19 | 11724 |
| SCNN1A-7876 | + | AGUGCCAAGUGGUGAGCAAG | 20 | 11725 |
| SCNN1A-7877 | + | GAGUGCCAAGUGGUGAGCAAG | 21 | 11726 |
| SCNN1A-7878 | + | GGAGUGCCAAGUGGUGAGCAAG | 22 | 11727 |
| SCNN1A-7879 | + | UGGAGUGCCAAGUGGUGAGCAAG | 23 | 11728 |
| SCNN1A-7880 | + | GUGGAGUGCCAAGUGGUGAGCAAG | 24 | 11729 |
| SCNN1A-7881 | + | AGUACUGGACCUGAGAAG | 18 | 11730 |
| SCNN1A-7882 | + | GAGUACUGGACCUGAGAAG | 19 | 11731 |
| SCNN1A-7883 | + | GGAGUACUGGACCUGAGAAG | 20 | 11732 |
| SCNN1A-7884 | + | GGGAGUACUGGACCUGAGAAG | 21 | 11733 |
| SCNN1A-7885 | + | UGGGAGUACUGGACCUGAGAAG | 22 | 11734 |
| SCNN1A-7886 | + | CUGGGAGUACUGGACCUGAGAAG | 23 | 11735 |
| SCNN1A-7887 | + | ACUGGGAGUACUGGACCUGAGAAG | 24 | 11736 |

TABLE 47D-continued

4th Tier

| gRNA Name | DNA Strand | Targeting Domain | Target Site Length | Seq ID |
|---|---|---|---|---|
| SCNN1A-7888 | + | GGAGUUUUCCGAAGGAAG | 18 | 11737 |
| SCNN1A-7889 | + | GGGAGUUUUCCGAAGGAAG | 19 | 11738 |
| SCNN1A-7890 | + | CGGGAGUUUUCCGAAGGAAG | 20 | 11739 |
| SCNN1A-7891 | + | CCGGGAGUUUUCCGAAGGAAG | 21 | 11740 |
| SCNN1A-7892 | + | GCCGGGAGUUUUCCGAAGGAAG | 22 | 11741 |
| SCNN1A-7893 | + | AGCCGGGAGUUUUCCGAAGGAAG | 23 | 11742 |
| SCNN1A-7894 | + | GAGCCGGGAGUUUUCCGAAGGAAG | 24 | 11743 |
| SCNN1A-7895 | + | GAGUCUGUCUCCAGGAAG | 18 | 11744 |
| SCNN1A-7896 | + | GGAGUCUGUCUCCAGGAAG | 19 | 11745 |
| SCNN1A-7897 | + | GGGAGUCUGUCUCCAGGAAG | 20 | 11746 |
| SCNN1A-7898 | + | AGGGAGUCUGUCUCCAGGAAG | 21 | 11747 |
| SCNN1A-7899 | + | AAGGGAGUCUGUCUCCAGGAAG | 22 | 11748 |
| SCNN1A-7900 | + | AAAGGGAGUCUGUCUCCAGGAAG | 23 | 11749 |
| SCNN1A-7901 | + | CAAAGGGAGUCUGUCUCCAGGAAG | 24 | 11750 |
| SCNN1A-7902 | + | GGAGGGGCCCAGGUGAAG | 18 | 11751 |
| SCNN1A-7903 | + | GGGAGGGGCCCAGGUGAAG | 19 | 11752 |
| SCNN1A-7904 | + | CGGGAGGGGCCCAGGUGAAG | 20 | 11753 |
| SCNN1A-7905 | + | CCGGGAGGGGCCCAGGUGAAG | 21 | 11754 |
| SCNN1A-7906 | + | CCCGGGAGGGGCCCAGGUGAAG | 22 | 11755 |
| SCNN1A-7907 | + | ACCCGGGAGGGGCCCAGGUGAAG | 23 | 11756 |
| SCNN1A-7908 | + | GACCCGGGAGGGGCCCAGGUGAAG | 24 | 11757 |
| SCNN1A-7909 | + | UCCUCCCCGCUCACUAAG | 18 | 11758 |
| SCNN1A-7910 | + | CUCCUCCCCGCUCACUAAG | 19 | 11759 |
| SCNN1A-5645 | + | UCUCCUCCCCGCUCACUAAG | 20 | 9494 |
| SCNN1A-7911 | + | GUCUCCUCCCCGCUCACUAAG | 21 | 11760 |
| SCNN1A-7912 | + | GGUCUCCUCCCCGCUCACUAAG | 22 | 11761 |
| SCNN1A-7913 | + | AGGUCUCCUCCCCGCUCACUAAG | 23 | 11762 |
| SCNN1A-7914 | + | CAGGUCUCCUCCCCGCUCACUAAG | 24 | 11763 |
| SCNN1A-7915 | + | GGGGAACCGGGAGGACAG | 18 | 11764 |
| SCNN1A-7916 | + | UGGGGAACCGGGAGGACAG | 19 | 11765 |
| SCNN1A-7917 | + | GUGGGGAACCGGGAGGACAG | 20 | 11766 |
| SCNN1A-7918 | + | GGUGGGGAACCGGGAGGACAG | 21 | 11767 |
| SCNN1A-7919 | + | GGGUGGGGAACCGGGAGGACAG | 22 | 11768 |
| SCNN1A-7920 | + | UGGGUGGGGAACCGGGAGGACAG | 23 | 11769 |
| SCNN1A-7921 | + | CUGGGUGGGGAACCGGGAGGACAG | 24 | 11770 |
| SCNN1A-7922 | + | GACCCGGGAGGGGCCCAG | 18 | 11771 |
| SCNN1A-7923 | + | AGACCCGGGAGGGGCCCAG | 19 | 11772 |
| SCNN1A-7924 | + | CAGACCCGGGAGGGGCCCAG | 20 | 11773 |

TABLE 47D-continued

4th Tier

| gRNA Name | DNA Strand | Targeting Domain | Target Site Length | Seq ID |
|---|---|---|---|---|
| SCNN1A-7925 | + | CCAGACCCGGGAGGGGCCCAG | 21 | 11774 |
| SCNN1A-7926 | + | UCCAGACCCGGGAGGGGCCCAG | 22 | 11775 |
| SCNN1A-7927 | + | GUCCAGACCCGGGAGGGGCCCAG | 23 | 11776 |
| SCNN1A-7928 | + | UGUCCAGACCCGGGAGGGGCCCAG | 24 | 11777 |
| SCNN1A-7929 | + | CUGAGUGAGUAGAGGCAG | 18 | 11778 |
| SCNN1A-7930 | + | ACUGAGUGAGUAGAGGCAG | 19 | 11779 |
| SCNN1A-7931 | + | CACUGAGUGAGUAGAGGCAG | 20 | 11780 |
| SCNN1A-7932 | + | GCACUGAGUGAGUAGAGGCAG | 21 | 11781 |
| SCNN1A-7933 | + | GGCACUGAGUGAGUAGAGGCAG | 22 | 11782 |
| SCNN1A-7934 | + | GGGCACUGAGUGAGUAGAGGCAG | 23 | 11783 |
| SCNN1A-7935 | + | GGGGCACUGAGUGAGUAGAGGCAG | 24 | 11784 |
| SCNN1A-7936 | + | GAGGGCUCCCGAGGGCAG | 18 | 11785 |
| SCNN1A-7937 | + | GGAGGGCUCCCGAGGGCAG | 19 | 11786 |
| SCNN1A-7938 | + | AGGAGGGCUCCCGAGGGCAG | 20 | 11787 |
| SCNN1A-7939 | + | AAGGAGGGCUCCCGAGGGCAG | 21 | 11788 |
| SCNN1A-7940 | + | GAAGGAGGGCUCCCGAGGGCAG | 22 | 11789 |
| SCNN1A-7941 | + | GGAAGGAGGGCUCCCGAGGGCAG | 23 | 11790 |
| SCNN1A-7942 | + | AGGAAGGAGGGCUCCCGAGGGCAG | 24 | 11791 |
| SCNN1A-7943 | + | UGGGGGACAGGAUGGCAG | 18 | 11792 |
| SCNN1A-7944 | + | CUGGGGGACAGGAUGGCAG | 19 | 11793 |
| SCNN1A-7945 | + | GCUGGGGGACAGGAUGGCAG | 20 | 11794 |
| SCNN1A-7946 | + | GGCUGGGGGACAGGAUGGCAG | 21 | 11795 |
| SCNN1A-7947 | + | AGGCUGGGGGACAGGAUGGCAG | 22 | 11796 |
| SCNN1A-7948 | + | GAGGCUGGGGGACAGGAUGGCAG | 23 | 11797 |
| SCNN1A-7949 | + | GGAGGCUGGGGGACAGGAUGGCAG | 24 | 11798 |
| SCNN1A-7950 | + | UGGGAGCAGCGCACUCAG | 18 | 11799 |
| SCNN1A-7951 | + | GUGGGAGCAGCGCACUCAG | 19 | 11800 |
| SCNN1A-7952 | + | AGUGGGAGCAGCGCACUCAG | 20 | 11801 |
| SCNN1A-7953 | + | AAGUGGGAGCAGCGCACUCAG | 21 | 11802 |
| SCNN1A-7954 | + | UAAGUGGGAGCAGCGCACUCAG | 22 | 11803 |
| SCNN1A-7955 | + | CUAAGUGGGAGCAGCGCACUCAG | 23 | 11804 |
| SCNN1A-7956 | + | ACUAAGUGGGAGCAGCGCACUCAG | 24 | 11805 |
| SCNN1A-7957 | + | CCCUCAGGCCCUGCAGAG | 18 | 11806 |
| SCNN1A-7958 | + | ACCCUCAGGCCCUGCAGAG | 19 | 11807 |
| SCNN1A-7959 | + | CACCCUCAGGCCCUGCAGAG | 20 | 11808 |
| SCNN1A-7960 | + | UCACCCUCAGGCCCUGCAGAG | 21 | 11809 |
| SCNN1A-7961 | + | CUCACCCUCAGGCCCUGCAGAG | 22 | 11810 |

TABLE 47D-continued

4th Tier

| gRNA Name | DNA Strand | Targeting Domain | Target Site Length | Seq ID |
|---|---|---|---|---|
| SCNN1A-7962 | + | CCUCACCCUCAGGCCCUGCAGAG | 23 | 11811 |
| SCNN1A-7963 | + | GCCUCACCCUCAGGCCCUGCAGAG | 24 | 11812 |
| SCNN1A-7964 | + | GCUGAGGAGGAGUCAGAG | 18 | 11813 |
| SCNN1A-7965 | + | GGCUGAGGAGGAGUCAGAG | 19 | 11814 |
| SCNN1A-7966 | + | GGGCUGAGGAGGAGUCAGAG | 20 | 11815 |
| SCNN1A-7967 | + | GGGGCUGAGGAGGAGUCAGAG | 21 | 11816 |
| SCNN1A-7968 | + | AGGGGCUGAGGAGGAGUCAGAG | 22 | 11817 |
| SCNN1A-7969 | + | GAGGGGCUGAGGAGGAGUCAGAG | 23 | 11818 |
| SCNN1A-7970 | + | GGAGGGGCUGAGGAGGAGUCAGAG | 24 | 11819 |
| SCNN1A-7971 | + | GCCCUGCAGAGAAGAGAG | 18 | 11820 |
| SCNN1A-7972 | + | GGCCCUGCAGAGAAGAGAG | 19 | 11821 |
| SCNN1A-7973 | + | AGGCCCUGCAGAGAAGAGAG | 20 | 11822 |
| SCNN1A-7974 | + | CAGGCCCUGCAGAGAAGAGAG | 21 | 11823 |
| SCNN1A-7975 | + | UCAGGCCCUGCAGAGAAGAGAG | 22 | 11824 |
| SCNN1A-7976 | + | CUCAGGCCCUGCAGAGAAGAGAG | 23 | 11825 |
| SCNN1A-7977 | + | CCUCAGGCCCUGCAGAGAAGAGAG | 24 | 11826 |
| SCNN1A-7978 | + | UGGUGAGCAAGGAGAGAG | 18 | 11827 |
| SCNN1A-7979 | + | GUGGUGAGCAAGGAGAGAG | 19 | 11828 |
| SCNN1A-6146 | + | AGUGGUGAGCAAGGAGAGAG | 20 | 9995 |
| SCNN1A-7980 | + | AAGUGGUGAGCAAGGAGAGAG | 21 | 11829 |
| SCNN1A-7981 | + | CAAGUGGUGAGCAAGGAGAGAG | 22 | 11830 |
| SCNN1A-7982 | + | CCAAGUGGUGAGCAAGGAGAGAG | 23 | 11831 |
| SCNN1A-7983 | + | GCCAAGUGGUGAGCAAGGAGAGAG | 24 | 11832 |
| SCNN1A-7984 | + | AAGAGGGAGACAAUAGAG | 18 | 11833 |
| SCNN1A-7985 | + | AAAGAGGGAGACAAUAGAG | 19 | 11834 |
| SCNN1A-5896 | + | GAAAGAGGGAGACAAUAGAG | 20 | 9745 |
| SCNN1A-7986 | + | AGAAAGAGGGAGACAAUAGAG | 21 | 11835 |
| SCNN1A-7987 | + | CAGAAAGAGGGAGACAAUAGAG | 22 | 11836 |
| SCNN1A-7988 | + | GCAGAAAGAGGGAGACAAUAGAG | 23 | 11837 |
| SCNN1A-7989 | + | GGCAGAAAGAGGGAGACAAUAGAG | 24 | 11838 |
| SCNN1A-7990 | + | GGAGGGCAACACAAGGAG | 18 | 11839 |
| SCNN1A-7991 | + | AGGAGGGCAACACAAGGAG | 19 | 11840 |
| SCNN1A-7992 | + | UAGGAGGGCAACACAAGGAG | 20 | 11841 |
| SCNN1A-7993 | + | CUAGGAGGGCAACACAAGGAG | 21 | 11842 |
| SCNN1A-7994 | + | GCUAGGAGGGCAACACAAGGAG | 22 | 11843 |
| SCNN1A-7995 | + | AGCUAGGAGGGCAACACAAGGAG | 23 | 11844 |
| SCNN1A-7996 | + | CAGCUAGGAGGGCAACACAAGGAG | 24 | 11845 |
| SCNN1A-7997 | + | GACAGGCCCUGGGAGGAG | 18 | 11846 |

TABLE 47D-continued

4th Tier

| gRNA Name | DNA Strand | Targeting Domain | Target Site Length | Seq ID |
|---|---|---|---|---|
| SCNN1A-7998 | + | AGACAGGCCCUGGGAGGAG | 19 | 11847 |
| SCNN1A-7999 | + | UAGACAGGCCCUGGGAGGAG | 20 | 11848 |
| SCNN1A-8000 | + | CUAGACAGGCCCUGGGAGGAG | 21 | 11849 |
| SCNN1A-8001 | + | CCUAGACAGGCCCUGGGAGGAG | 22 | 11850 |
| SCNN1A-8002 | + | GCCUAGACAGGCCCUGGGAGGAG | 23 | 11851 |
| SCNN1A-8003 | + | CGCCUAGACAGGCCCUGGGAGGAG | 24 | 11852 |
| SCNN1A-8004 | + | UAGAAAACAAAUAGGAG | 18 | 11853 |
| SCNN1A-8005 | + | UUAGAAAACAAAUAGGAG | 19 | 11854 |
| SCNN1A-8006 | + | GUUAGAAAACAAAUAGGAG | 20 | 11855 |
| SCNN1A-8007 | + | GGUUAGAAAACAAAUAGGAG | 21 | 11856 |
| SCNN1A-8008 | + | AGGUUAGAAAACAAAUAGGAG | 22 | 11857 |
| SCNN1A-8009 | + | GAGGUUAGAAAACAAAUAGGAG | 23 | 11858 |
| SCNN1A-8010 | + | UGAGGUUAGAAAACAAAUAGGAG | 24 | 11859 |
| SCNN1A-8011 | + | GGGCCAAAAGUGCCGGAG | 18 | 11860 |
| SCNN1A-8012 | + | GGGGCCAAAAGUGCCGGAG | 19 | 11861 |
| SCNN1A-8013 | + | UGGGGCCAAAAGUGCCGGAG | 20 | 11862 |
| SCNN1A-8014 | + | UUGGGGCCAAAAGUGCCGGAG | 21 | 11863 |
| SCNN1A-8015 | + | GUUGGGGCCAAAAGUGCCGGAG | 22 | 11864 |
| SCNN1A-8016 | + | AGUUGGGGCCAAAAGUGCCGGAG | 23 | 11865 |
| SCNN1A-8017 | + | GAGUUGGGGCCAAAAGUGCCGGAG | 24 | 11866 |
| SCNN1A-8018 | + | CCAGCAGACCUGCGGGAG | 18 | 11867 |
| SCNN1A-8019 | + | GCCAGCAGACCUGCGGGAG | 19 | 11868 |
| SCNN1A-8020 | + | AGCCAGCAGACCUGCGGGAG | 20 | 11869 |
| SCNN1A-8021 | + | GAGCCAGCAGACCUGCGGGAG | 21 | 11870 |
| SCNN1A-8022 | + | GGAGCCAGCAGACCUGCGGGAG | 22 | 11871 |
| SCNN1A-8023 | + | UGGAGCCAGCAGACCUGCGGGAG | 23 | 11872 |
| SCNN1A-8024 | + | CUGGAGCCAGCAGACCUGCGGGAG | 24 | 11873 |
| SCNN1A-8025 | + | CUAGACAGGCCCUGGGAG | 18 | 11874 |
| SCNN1A-8026 | + | CCUAGACAGGCCCUGGGAG | 19 | 11875 |
| SCNN1A-8027 | + | GCCUAGACAGGCCCUGGGAG | 20 | 11876 |
| SCNN1A-8028 | + | CGCCUAGACAGGCCCUGGGAG | 21 | 11877 |
| SCNN1A-8029 | + | ACGCCUAGACAGGCCCUGGGAG | 22 | 11878 |
| SCNN1A-8030 | + | CACGCCUAGACAGGCCCUGGGAG | 23 | 11879 |
| SCNN1A-8031 | + | ACACGCCUAGACAGGCCCUGGGAG | 24 | 11880 |
| SCNN1A-8032 | + | AGAGAGAUAGGGAUGGAG | 18 | 11881 |
| SCNN1A-8033 | + | CAGAGAGAUAGGGAUGGAG | 19 | 11882 |
| SCNN1A-8034 | + | ACAGAGAGAUAGGGAUGGAG | 20 | 11883 |

TABLE 47D-continued

4th Tier

| gRNA Name | DNA Strand | Targeting Domain | Target Site Length | Seq ID |
|---|---|---|---|---|
| SCNN1A-8035 | + | GACAGAGAGAUAGGGAUGGAG | 21 | 11884 |
| SCNN1A-8036 | + | GGACAGAGAGAUAGGGAUGGAG | 22 | 11885 |
| SCNN1A-8037 | + | AGGACAGAGAGAUAGGGAUGGAG | 23 | 11886 |
| SCNN1A-8038 | + | AAGGACAGAGAGAUAGGGAUGGAG | 24 | 11887 |
| SCNN1A-8039 | + | GCGGGGGAGGGGCUGAG | 18 | 11888 |
| SCNN1A-8040 | + | GGCGGGGGAGGGGCUGAG | 19 | 11889 |
| SCNN1A-8041 | + | GGGCGGGGGAGGGGCUGAG | 20 | 11890 |
| SCNN1A-8042 | + | AGGGCGGGGGAGGGGCUGAG | 21 | 11891 |
| SCNN1A-8043 | + | CAGGGCGGGGGAGGGGCUGAG | 22 | 11892 |
| SCNN1A-8044 | + | GCAGGGCGGGGGAGGGGCUGAG | 23 | 11893 |
| SCNN1A-8045 | + | AGCAGGGCGGGGGAGGGGCUGAG | 24 | 11894 |
| SCNN1A-8046 | + | GGAGGGGCACUGAGUGAG | 18 | 11895 |
| SCNN1A-8047 | + | AGGAGGGGCACUGAGUGAG | 19 | 11896 |
| SCNN1A-8048 | + | GAGGAGGGGCACUGAGUGAG | 20 | 11897 |
| SCNN1A-8049 | + | GGAGGAGGGGCACUGAGUGAG | 21 | 11898 |
| SCNN1A-8050 | + | UGGAGGAGGGGCACUGAGUGAG | 22 | 11899 |
| SCNN1A-8051 | + | AUGGAGGAGGGGCACUGAGUGAG | 23 | 11900 |
| SCNN1A-8052 | + | GAUGGAGGAGGGGCACUGAGUGAG | 24 | 11901 |
| SCNN1A-8053 | + | AUCUCAAUUAAAGGUGAG | 18 | 11902 |
| SCNN1A-8054 | + | CAUCUCAAUUAAAGGUGAG | 19 | 11903 |
| SCNN1A-8055 | + | GCAUCUCAAUUAAAGGUGAG | 20 | 11904 |
| SCNN1A-8056 | + | AGCAUCUCAAUUAAAGGUGAG | 21 | 11905 |
| SCNN1A-8057 | + | UAGCAUCUCAAUUAAAGGUGAG | 22 | 11906 |
| SCNN1A-8058 | + | UUAGCAUCUCAAUUAAAGGUGAG | 23 | 11907 |
| SCNN1A-8059 | + | AUUAGCAUCUCAAUUAAAGGUGAG | 24 | 11908 |
| SCNN1A-8060 | + | AGUGGUGGGGCAAAUAG | 18 | 11909 |
| SCNN1A-8061 | + | CAGUGGUGGGGCAAAUAG | 19 | 11910 |
| SCNN1A-8062 | + | GCAGUGGUGGGGCAAAUAG | 20 | 11911 |
| SCNN1A-8063 | + | GGCAGUGGUGGGGCAAAUAG | 21 | 11912 |
| SCNN1A-8064 | + | GGGCAGUGGUGGGGCAAAUAG | 22 | 11913 |
| SCNN1A-8065 | + | GGGGCAGUGGUGGGGCAAAUAG | 23 | 11914 |
| SCNN1A-8066 | + | GGGGGCAGUGGUGGGGCAAAUAG | 24 | 11915 |
| SCNN1A-8067 | + | UCCUGAGCCCACAGCUAG | 18 | 11916 |
| SCNN1A-8068 | + | AUCCUGAGCCCACAGCUAG | 19 | 11917 |
| SCNN1A-8069 | + | GAUCCUGAGCCCACAGCUAG | 20 | 11918 |
| SCNN1A-8070 | + | GGAUCCUGAGCCCACAGCUAG | 21 | 11919 |
| SCNN1A-8071 | + | AGGAUCCUGAGCCCACAGCUAG | 22 | 11920 |
| SCNN1A-8072 | + | AAGGAUCCUGAGCCCACAGCUAG | 23 | 11921 |

TABLE 47D-continued

4th Tier

| gRNA Name | DNA Strand | Targeting Domain | Target Site Length | Seq ID |
|---|---|---|---|---|
| SCNN1A-8073 | + | GAAGGAUCCUGAGCCCACAGCUAG | 24 | 11922 |
| SCNN1A-8074 | + | AUAAGAGCCAAGGGCUAG | 18 | 11923 |
| SCNN1A-8075 | + | CAUAAGAGCCAAGGGCUAG | 19 | 11924 |
| SCNN1A-5662 | + | ACAUAAGAGCCAAGGGCUAG | 20 | 9511 |
| SCNN1A-8076 | + | GACAUAAGAGCCAAGGGCUAG | 21 | 11925 |
| SCNN1A-8077 | + | AGACAUAAGAGCCAAGGGCUAG | 22 | 11926 |
| SCNN1A-8078 | + | AAGACAUAAGAGCCAAGGGCUAG | 23 | 11927 |
| SCNN1A-8079 | + | UAAGACAUAAGAGCCAAGGGCUAG | 24 | 11928 |
| SCNN1A-8080 | + | GGUGAAGCUGGGGGCUAG | 18 | 11929 |
| SCNN1A-8081 | + | AGGUGAAGCUGGGGGCUAG | 19 | 11930 |
| SCNN1A-8082 | + | CAGGUGAAGCUGGGGGCUAG | 20 | 11931 |
| SCNN1A-8083 | + | CCAGGUGAAGCUGGGGGCUAG | 21 | 11932 |
| SCNN1A-8084 | + | CCCAGGUGAAGCUGGGGGCUAG | 22 | 11933 |
| SCNN1A-8085 | + | GCCCAGGUGAAGCUGGGGGCUAG | 23 | 11934 |
| SCNN1A-8086 | + | GGCCCAGGUGAAGCUGGGGGCUAG | 24 | 11935 |
| SCNN1A-8087 | + | GGCAGCGCGAGGGCCACG | 18 | 11936 |
| SCNN1A-8088 | + | AGGCAGCGCGAGGGCCACG | 19 | 11937 |
| SCNN1A-8089 | + | GAGGCAGCGCGAGGGCCACG | 20 | 11938 |
| SCNN1A-8090 | + | AGAGGCAGCGCGAGGGCCACG | 21 | 11939 |
| SCNN1A-8091 | + | CAGAGGCAGCGCGAGGGCCACG | 22 | 11940 |
| SCNN1A-8092 | + | CCAGAGGCAGCGCGAGGGCCACG | 23 | 11941 |
| SCNN1A-8093 | + | ACCAGAGGCAGCGCGAGGGCCACG | 24 | 11942 |
| SCNN1A-8094 | + | GAGCAUUGAUACACACCG | 18 | 11943 |
| SCNN1A-8095 | + | UGAGCAUUGAUACACACCG | 19 | 11944 |
| SCNN1A-5665 | + | CUGAGCAUUGAUACACACCG | 20 | 9514 |
| SCNN1A-8096 | + | CCUGAGCAUUGAUACACACCG | 21 | 11945 |
| SCNN1A-8097 | + | GCCUGAGCAUUGAUACACACCG | 22 | 11946 |
| SCNN1A-8098 | + | AGCCUGAGCAUUGAUACACACCG | 23 | 11947 |
| SCNN1A-8099 | + | CAGCCUGAGCAUUGAUACACACCG | 24 | 11948 |
| SCNN1A-8100 | + | AGAGCCGGGAGUUUUCCG | 18 | 11949 |
| SCNN1A-8101 | + | CAGAGCCGGGAGUUUUCCG | 19 | 11950 |
| SCNN1A-8102 | + | UCAGAGCCGGGAGUUUUCCG | 20 | 11951 |
| SCNN1A-8103 | + | GUCAGAGCCGGGAGUUUUCCG | 21 | 11952 |
| SCNN1A-8104 | + | AGUCAGAGCCGGGAGUUUUCCG | 22 | 11953 |
| SCNN1A-8105 | + | GAGUCAGAGCCGGGAGUUUUCCG | 23 | 11954 |
| SCNN1A-8106 | + | GGAGUCAGAGCCGGGAGUUUUCCG | 24 | 11955 |
| SCNN1A-8107 | + | CAAUAGAGAGGGACAGCG | 18 | 11956 |

TABLE 47D-continued

4th Tier

| gRNA Name | DNA Strand | Targeting Domain | Target Site Length | Seq ID |
|---|---|---|---|---|
| SCNN1A-8108 | + | ACAAUAGAGAGGGACAGCG | 19 | 11957 |
| SCNN1A-8109 | + | GACAAUAGAGAGGGACAGCG | 20 | 11958 |
| SCNN1A-8110 | + | AGACAAUAGAGAGGGACAGCG | 21 | 11959 |
| SCNN1A-8111 | + | GAGACAAUAGAGAGGGACAGCG | 22 | 11960 |
| SCNN1A-8112 | + | GGAGACAAUAGAGAGGGACAGCG | 23 | 11961 |
| SCNN1A-8113 | + | GGGAGACAAUAGAGAGGGACAGCG | 24 | 11962 |
| SCNN1A-8114 | + | GGGAGGAUGUGGCCAGCG | 18 | 11963 |
| SCNN1A-8115 | + | AGGGAGGAUGUGGCCAGCG | 19 | 11964 |
| SCNN1A-8116 | + | CAGGGAGGAUGUGGCCAGCG | 20 | 11965 |
| SCNN1A-8117 | + | GCAGGGAGGAUGUGGCCAGCG | 21 | 11966 |
| SCNN1A-8118 | + | UGCAGGGAGGAUGUGGCCAGCG | 22 | 11967 |
| SCNN1A-8119 | + | GUGCAGGGAGGAUGUGGCCAGCG | 23 | 11968 |
| SCNN1A-8120 | + | GGUGCAGGGAGGAUGUGGCCAGCG | 24 | 11969 |
| SCNN1A-8121 | + | UUAAAGGUGAGCAGGGCG | 18 | 11970 |
| SCNN1A-8122 | + | AUUAAAGGUGAGCAGGGCG | 19 | 11971 |
| SCNN1A-5669 | + | AAUUAAAGGUGAGCAGGGCG | 20 | 9518 |
| SCNN1A-8123 | + | CAAUUAAAGGUGAGCAGGGCG | 21 | 11972 |
| SCNN1A-8124 | + | UCAAUUAAAGGUGAGCAGGGCG | 22 | 11973 |
| SCNN1A-8125 | + | CUCAAUUAAAGGUGAGCAGGGCG | 23 | 11974 |
| SCNN1A-8126 | + | UCUCAAUUAAAGGUGAGCAGGGCG | 24 | 11975 |
| SCNN1A-8127 | + | UGGCCAGCGCUGGAAAGG | 18 | 11976 |
| SCNN1A-8128 | + | GUGGCCAGCGCUGGAAAGG | 19 | 11977 |
| SCNN1A-8129 | + | UGUGGCCAGCGCUGGAAAGG | 20 | 11978 |
| SCNN1A-8130 | + | AUGUGGCCAGCGCUGGAAAGG | 21 | 11979 |
| SCNN1A-8131 | + | GAUGUGGCCAGCGCUGGAAAGG | 22 | 11980 |
| SCNN1A-8132 | + | GGAUGUGGCCAGCGCUGGAAAGG | 23 | 11981 |
| SCNN1A-8133 | + | AGGAUGUGGCCAGCGCUGGAAAGG | 24 | 11982 |
| SCNN1A-8134 | + | CCAGGAAGGAGAGCAAGG | 18 | 11983 |
| SCNN1A-8135 | + | UCCAGGAAGGAGAGCAAGG | 19 | 11984 |
| SCNN1A-6151 | + | CUCCAGGAAGGAGAGCAAGG | 20 | 10000 |
| SCNN1A-8136 | + | UCUCCAGGAAGGAGAGCAAGG | 21 | 11985 |
| SCNN1A-8137 | + | GUCUCCAGGAAGGAGAGCAAGG | 22 | 11986 |
| SCNN1A-8138 | + | UGUCUCCAGGAAGGAGAGCAAGG | 23 | 11987 |
| SCNN1A-8139 | + | CUGUCUCCAGGAAGGAGAGCAAGG | 24 | 11988 |
| SCNN1A-1604 | + | CAAGGGUCAGGGUCAAGG | 18 | 5453 |
| SCNN1A-1605 | + | GCAAGGGUCAGGGUCAAGG | 19 | 5454 |
| SCNN1A-1606 | + | AGCAAGGGUCAGGGUCAAGG | 20 | 5455 |
| SCNN1A-1607 | + | GAGCAAGGGUCAGGGUCAAGG | 21 | 5456 |

TABLE 47D-continued

4th Tier

| gRNA Name | DNA Strand | Targeting Domain | Target Site Length | Seq ID |
|---|---|---|---|---|
| SCNN1A-1608 | + | AGAGCAAGGGUCAGGGUCAAGG | 22 | 5457 |
| SCNN1A-1609 | + | GAGAGCAAGGGUCAGGGUCAAGG | 23 | 5458 |
| SCNN1A-1610 | + | GGAGAGCAAGGGUCAGGGUCAAGG | 24 | 5459 |
| SCNN1A-8140 | + | CCGGGAGUUUUCCGAAGG | 18 | 11989 |
| SCNN1A-8141 | + | GCCGGGAGUUUUCCGAAGG | 19 | 11990 |
| SCNN1A-8142 | + | AGCCGGGAGUUUUCCGAAGG | 20 | 11991 |
| SCNN1A-8143 | + | GAGCCGGGAGUUUUCCGAAGG | 21 | 11992 |
| SCNN1A-8144 | + | AGAGCCGGGAGUUUUCCGAAGG | 22 | 11993 |
| SCNN1A-8145 | + | CAGAGCCGGGAGUUUUCCGAAGG | 23 | 11994 |
| SCNN1A-8146 | + | UCAGAGCCGGGAGUUUUCCGAAGG | 24 | 11995 |
| SCNN1A-8147 | + | ACAGACCCGGAGCCCAGG | 18 | 11996 |
| SCNN1A-8148 | + | CACAGACCCGGAGCCCAGG | 19 | 11997 |
| SCNN1A-8149 | + | ACACAGACCCGGAGCCCAGG | 20 | 11998 |
| SCNN1A-8150 | + | GACACAGACCCGGAGCCCAGG | 21 | 11999 |
| SCNN1A-8151 | + | GGACACAGACCCGGAGCCCAGG | 22 | 12000 |
| SCNN1A-8152 | + | UGGACACAGACCCGGAGCCCAGG | 23 | 12001 |
| SCNN1A-8153 | + | GUGGACACAGACCCGGAGCCCAGG | 24 | 12002 |
| SCNN1A-8154 | + | GAGAAGGGGCCAGCCAGG | 18 | 12003 |
| SCNN1A-8155 | + | GGAGAAGGGGCCAGCCAGG | 19 | 12004 |
| SCNN1A-8156 | + | AGGAGAAGGGGCCAGCCAGG | 20 | 12005 |
| SCNN1A-8157 | + | AAGGAGAAGGGGCCAGCCAGG | 21 | 12006 |
| SCNN1A-8158 | + | CAAGGAGAAGGGGCCAGCCAGG | 22 | 12007 |
| SCNN1A-8159 | + | ACAAGGAGAAGGGGCCAGCCAGG | 23 | 12008 |
| SCNN1A-8160 | + | CACAAGGAGAAGGGGCCAGCCAGG | 24 | 12009 |
| SCNN1A-8161 | + | AGGGAGUCUGUCUCCAGG | 18 | 12010 |
| SCNN1A-8162 | + | AAGGGAGUCUGUCUCCAGG | 19 | 12011 |
| SCNN1A-8163 | + | AAAGGGAGUCUGUCUCCAGG | 20 | 12012 |
| SCNN1A-8164 | + | CAAAGGGAGUCUGUCUCCAGG | 21 | 12013 |
| SCNN1A-8165 | + | CCAAAGGGAGUCUGUCUCCAGG | 22 | 12014 |
| SCNN1A-8166 | + | ACCAAAGGGAGUCUGUCUCCAGG | 23 | 12015 |
| SCNN1A-8167 | + | CACCAAAGGGAGUCUGUCUCCAGG | 24 | 12016 |
| SCNN1A-8168 | + | CAAUUAAAGGUGAGCAGG | 18 | 12017 |
| SCNN1A-8169 | + | UCAAUUAAAGGUGAGCAGG | 19 | 12018 |
| SCNN1A-8170 | + | CUCAAUUAAAGGUGAGCAGG | 20 | 12019 |
| SCNN1A-8171 | + | UCUCAAUUAAAGGUGAGCAGG | 21 | 12020 |
| SCNN1A-8172 | + | AUCUCAAUUAAAGGUGAGCAGG | 22 | 12021 |
| SCNN1A-8173 | + | CAUCUCAAUUAAAGGUGAGCAGG | 23 | 12022 |

TABLE 47D-continued

4th Tier

| gRNA Name | DNA Strand | Targeting Domain | Target Site Length | Seq ID |
|---|---|---|---|---|
| SCNN1A-8174 | + | GCAUCUCAAUUAAAGGUGAGCAGG | 24 | 12023 |
| SCNN1A-8175 | + | UGAGUGAGUAGAGGCAGG | 18 | 12024 |
| SCNN1A-8176 | + | CUGAGUGAGUAGAGGCAGG | 19 | 12025 |
| SCNN1A-5677 | + | ACUGAGUGAGUAGAGGCAGG | 20 | 9526 |
| SCNN1A-8177 | + | CACUGAGUGAGUAGAGGCAGG | 21 | 12026 |
| SCNN1A-8178 | + | GCACUGAGUGAGUAGAGGCAGG | 22 | 12027 |
| SCNN1A-8179 | + | GGCACUGAGUGAGUAGAGGCAGG | 23 | 12028 |
| SCNN1A-8180 | + | GGGCACUGAGUGAGUAGAGGCAGG | 24 | 12029 |
| SCNN1A-8181 | + | GCGCUGGAAAGGAAGAGG | 18 | 12030 |
| SCNN1A-8182 | + | AGCGCUGGAAAGGAAGAGG | 19 | 12031 |
| SCNN1A-8183 | + | CAGCGCUGGAAAGGAAGAGG | 20 | 12032 |
| SCNN1A-8184 | + | CCAGCGCUGGAAAGGAAGAGG | 21 | 12033 |
| SCNN1A-8185 | + | GCCAGCGCUGGAAAGGAAGAGG | 22 | 12034 |
| SCNN1A-8186 | + | GGCCAGCGCUGGAAAGGAAGAGG | 23 | 12035 |
| SCNN1A-8187 | + | UGGCCAGCGCUGGAAAGGAAGAGG | 24 | 12036 |
| SCNN1A-8188 | + | CCGGAGCCCAGGAAGAGG | 18 | 12037 |
| SCNN1A-8189 | + | CCCGGAGCCCAGGAAGAGG | 19 | 12038 |
| SCNN1A-8190 | + | ACCCGGAGCCCAGGAAGAGG | 20 | 12039 |
| SCNN1A-8191 | + | GACCCGGAGCCCAGGAAGAGG | 21 | 12040 |
| SCNN1A-8192 | + | AGACCCGGAGCCCAGGAAGAGG | 22 | 12041 |
| SCNN1A-8193 | + | CAGACCCGGAGCCCAGGAAGAGG | 23 | 12042 |
| SCNN1A-8194 | + | ACAGACCCGGAGCCCAGGAAGAGG | 24 | 12043 |
| SCNN1A-8195 | + | CGCAGACAGGCAAGGAGG | 18 | 12044 |
| SCNN1A-8196 | + | ACGCAGACAGGCAAGGAGG | 19 | 12045 |
| SCNN1A-8197 | + | GACGCAGACAGGCAAGGAGG | 20 | 12046 |
| SCNN1A-8198 | + | AGACGCAGACAGGCAAGGAGG | 21 | 12047 |
| SCNN1A-8199 | + | UAGACGCAGACAGGCAAGGAGG | 22 | 12048 |
| SCNN1A-8200 | + | UUAGACGCAGACAGGCAAGGAGG | 23 | 12049 |
| SCNN1A-8201 | + | UUUAGACGCAGACAGGCAAGGAGG | 24 | 12050 |
| SCNN1A-8202 | + | UAGACAGGCCCUGGGAGG | 18 | 12051 |
| SCNN1A-8203 | + | CUAGACAGGCCCUGGGAGG | 19 | 12052 |
| SCNN1A-6157 | + | CCUAGACAGGCCCUGGGAGG | 20 | 10006 |
| SCNN1A-8204 | + | GCCUAGACAGGCCCUGGGAGG | 21 | 12053 |
| SCNN1A-8205 | + | CGCCUAGACAGGCCCUGGGAGG | 22 | 12054 |
| SCNN1A-8206 | + | ACGCCUAGACAGGCCCUGGGAGG | 23 | 12055 |
| SCNN1A-8207 | + | CACGCCUAGACAGGCCCUGGGAGG | 24 | 12056 |
| SCNN1A-8208 | + | GAGAGAUAGGGAUGGAGG | 18 | 12057 |
| SCNN1A-8209 | + | AGAGAGAUAGGGAUGGAGG | 19 | 12058 |

TABLE 47D-continued

4th Tier

| gRNA Name | DNA Strand | Targeting Domain | Target Site Length | Seq ID |
|---|---|---|---|---|
| SCNN1A-6158 | + | CAGAGAGAUAGGGAUGGAGG | 20 | 10007 |
| SCNN1A-8210 | + | ACAGAGAGAUAGGGAUGGAGG | 21 | 12059 |
| SCNN1A-8211 | + | GACAGAGAGAUAGGGAUGGAGG | 22 | 12060 |
| SCNN1A-8212 | + | GGACAGAGAGAUAGGGAUGGAGG | 23 | 12061 |
| SCNN1A-8213 | + | AGGACAGAGAGAUAGGGAUGGAGG | 24 | 12062 |
| SCNN1A-8214 | + | GUGAAGCUGGGGGCUAGG | 18 | 12063 |
| SCNN1A-8215 | + | GGUGAAGCUGGGGGCUAGG | 19 | 12064 |
| SCNN1A-5681 | + | AGGUGAAGCUGGGGGCUAGG | 20 | 9530 |
| SCNN1A-8216 | + | CAGGUGAAGCUGGGGGCUAGG | 21 | 12065 |
| SCNN1A-8217 | + | CCAGGUGAAGCUGGGGGCUAGG | 22 | 12066 |
| SCNN1A-8218 | + | CCCAGGUGAAGCUGGGGGCUAGG | 23 | 12067 |
| SCNN1A-8219 | + | GCCCAGGUGAAGCUGGGGGCUAGG | 24 | 12068 |
| SCNN1A-8220 | + | GCCUGGGUGGGAACCGG | 18 | 12069 |
| SCNN1A-8221 | + | GGCCUGGGUGGGAACCGG | 19 | 12070 |
| SCNN1A-8222 | + | GGGCCUGGGUGGGAACCGG | 20 | 12071 |
| SCNN1A-8223 | + | AGGGCCUGGGUGGGAACCGG | 21 | 12072 |
| SCNN1A-8224 | + | GAGGGCCUGGGUGGGAACCGG | 22 | 12073 |
| SCNN1A-8225 | + | AGAGGGCCUGGGUGGGAACCGG | 23 | 12074 |
| SCNN1A-8226 | + | GAGAGGGCCUGGGUGGGAACCGG | 24 | 12075 |
| SCNN1A-8227 | + | AGCAUUGAUACACACCGG | 18 | 12076 |
| SCNN1A-8228 | + | GAGCAUUGAUACACACCGG | 19 | 12077 |
| SCNN1A-5682 | + | UGAGCAUUGAUACACACCGG | 20 | 9531 |
| SCNN1A-8229 | + | CUGAGCAUUGAUACACACCGG | 21 | 12078 |
| SCNN1A-8230 | + | CCUGAGCAUUGAUACACACCGG | 22 | 12079 |
| SCNN1A-8231 | + | GCCUGAGCAUUGAUACACACCGG | 23 | 12080 |
| SCNN1A-8232 | + | AGCCUGAGCAUUGAUACACACCGG | 24 | 12081 |
| SCNN1A-8233 | + | AACCUUGUCCAGACCCGG | 18 | 12082 |
| SCNN1A-8234 | + | CAACCUUGUCCAGACCCGG | 19 | 12083 |
| SCNN1A-8235 | + | CCAACCUUGUCCAGACCCGG | 20 | 12084 |
| SCNN1A-8236 | + | UCCAACCUUGUCCAGACCCGG | 21 | 12085 |
| SCNN1A-8237 | + | CUCCAACCUUGUCCAGACCCGG | 22 | 12086 |
| SCNN1A-8238 | + | CCUCCAACCUUGUCCAGACCCGG | 23 | 12087 |
| SCNN1A-8239 | + | CCCUCCAACCUUGUCCAGACCCGG | 24 | 12088 |
| SCNN1A-8240 | + | CCCAGGCCCUGCACGCGG | 18 | 12089 |
| SCNN1A-8241 | + | ACCCAGGCCCUGCACGCGG | 19 | 12090 |
| SCNN1A-8242 | + | AACCCAGGCCCUGCACGCGG | 20 | 12091 |
| SCNN1A-8243 | + | CAACCCAGGCCCUGCACGCGG | 21 | 12092 |

TABLE 47D-continued

4th Tier

| gRNA Name | DNA Strand | Targeting Domain | Target Site Length | Seq ID |
|---|---|---|---|---|
| SCNN1A-8244 | + | ACAACCCAGGCCCUGCACGCGG | 22 | 12093 |
| SCNN1A-8245 | + | CACAACCCAGGCCCUGCACGCGG | 23 | 12094 |
| SCNN1A-8246 | + | ACACAACCCAGGCCCUGCACGCGG | 24 | 12095 |
| SCNN1A-8247 | + | UAAAGGUGAGCAGGGCGG | 18 | 12096 |
| SCNN1A-8248 | + | UUAAAGGUGAGCAGGGCGG | 19 | 12097 |
| SCNN1A-5683 | + | AUUAAAGGUGAGCAGGGCGG | 20 | 9532 |
| SCNN1A-8249 | + | AAUUAAAGGUGAGCAGGGCGG | 21 | 12098 |
| SCNN1A-8250 | + | CAAUUAAAGGUGAGCAGGGCGG | 22 | 12099 |
| SCNN1A-8251 | + | UCAAUUAAAGGUGAGCAGGGCGG | 23 | 12100 |
| SCNN1A-8252 | + | CUCAAUUAAAGGUGAGCAGGGCGG | 24 | 12101 |
| SCNN1A-8253 | + | CCCACUCCCAGGUUGCGG | 18 | 12102 |
| SCNN1A-8254 | + | UCCCACUCCCAGGUUGCGG | 19 | 12103 |
| SCNN1A-8255 | + | UUCCCACUCCCAGGUUGCGG | 20 | 12104 |
| SCNN1A-8256 | + | CUUCCCACUCCCAGGUUGCGG | 21 | 12105 |
| SCNN1A-8257 | + | GCUUCCCACUCCCAGGUUGCGG | 22 | 12106 |
| SCNN1A-8258 | + | AGCUUCCCACUCCCAGGUUGCGG | 23 | 12107 |
| SCNN1A-8259 | + | CAGCUUCCCACUCCCAGGUUGCGG | 24 | 12108 |
| SCNN1A-8260 | + | GGGCUGGAGGAGACUCGG | 18 | 12109 |
| SCNN1A-8261 | + | AGGGCUGGAGGAGACUCGG | 19 | 12110 |
| SCNN1A-8262 | + | AAGGGCUGGAGGAGACUCGG | 20 | 12111 |
| SCNN1A-8263 | + | AAAGGGCUGGAGGAGACUCGG | 21 | 12112 |
| SCNN1A-8264 | + | AAAAGGGCUGGAGGAGACUCGG | 22 | 12113 |
| SCNN1A-8265 | + | AAAAAGGGCUGGAGGAGACUCGG | 23 | 12114 |
| SCNN1A-8266 | + | CAAAAAGGGCUGGAGGAGACUCGG | 24 | 12115 |
| SCNN1A-8267 | + | AAUCAGACCCAAAAAGGG | 18 | 12116 |
| SCNN1A-8268 | + | GAAUCAGACCCAAAAAGGG | 19 | 12117 |
| SCNN1A-8269 | + | AGAAUCAGACCCAAAAAGGG | 20 | 12118 |
| SCNN1A-8270 | + | GAGAAUCAGACCCAAAAAGGG | 21 | 12119 |
| SCNN1A-8271 | + | AGAGAAUCAGACCCAAAAAGGG | 22 | 12120 |
| SCNN1A-8272 | + | CAGAGAAUCAGACCCAAAAAGGG | 23 | 12121 |
| SCNN1A-8273 | + | UCAGAGAAUCAGACCCAAAAAGGG | 24 | 12122 |
| SCNN1A-8274 | + | CCCGCUGGCCGGCCAGGG | 18 | 12123 |
| SCNN1A-8275 | + | GCCCGCUGGCCGGCCAGGG | 19 | 12124 |
| SCNN1A-8276 | + | CGCCCGCUGGCCGGCCAGGG | 20 | 12125 |
| SCNN1A-8277 | + | CCGCCCGCUGGCCGGCCAGGG | 21 | 12126 |
| SCNN1A-8278 | + | CCCGCCCGCUGGCCGGCCAGGG | 22 | 12127 |
| SCNN1A-8279 | + | GCCCGCCCGCUGGCCGGCCAGGG | 23 | 12128 |
| SCNN1A-8280 | + | AGCCCGCCCGCUGGCCGGCCAGGG | 24 | 12129 |

TABLE 47D-continued

4th Tier

| gRNA Name | DNA Strand | Targeting Domain | Target Site Length | Seq ID |
|---|---|---|---|---|
| SCNN1A-8281 | + | AAUUAAAGGUGAGCAGGG | 18 | 12130 |
| SCNN1A-8282 | + | CAAUUAAAGGUGAGCAGGG | 19 | 12131 |
| SCNN1A-6160 | + | UCAAUUAAAGGUGAGCAGGG | 20 | 10009 |
| SCNN1A-8283 | + | CUCAAUUAAAGGUGAGCAGGG | 21 | 12132 |
| SCNN1A-8284 | + | UCUCAAUUAAAGGUGAGCAGGG | 22 | 12133 |
| SCNN1A-8285 | + | AUCUCAAUUAAAGGUGAGCAGGG | 23 | 12134 |
| SCNN1A-8286 | + | CAUCUCAAUUAAAGGUGAGCAGGG | 24 | 12135 |
| SCNN1A-8287 | + | ACCGGGAGGACAGGAGGG | 18 | 12136 |
| SCNN1A-8288 | + | AACCGGGAGGACAGGAGGG | 19 | 12137 |
| SCNN1A-8289 | + | GAACCGGGAGGACAGGAGGG | 20 | 12138 |
| SCNN1A-8290 | + | GGAACCGGGAGGACAGGAGGG | 21 | 12139 |
| SCNN1A-8291 | + | GGGAACCGGGAGGACAGGAGGG | 22 | 12140 |
| SCNN1A-8292 | + | GGGGAACCGGGAGGACAGGAGGG | 23 | 12141 |
| SCNN1A-8293 | + | UGGGGAACCGGGAGGACAGGAGGG | 24 | 12142 |
| SCNN1A-8294 | + | AAGGACAGAGAGAUAGGG | 18 | 12143 |
| SCNN1A-8295 | + | GAAGGACAGAGAGAUAGGG | 19 | 12144 |
| SCNN1A-8296 | + | CGAAGGACAGAGAGAUAGGG | 20 | 12145 |
| SCNN1A-8297 | + | GCGAAGGACAGAGAGAUAGGG | 21 | 12146 |
| SCNN1A-8298 | + | AGCGAAGGACAGAGAGAUAGGG | 22 | 12147 |
| SCNN1A-8299 | + | CAGCGAAGGACAGAGAGAUAGGG | 23 | 12148 |
| SCNN1A-8300 | + | ACAGCGAAGGACAGAGAGAUAGGG | 24 | 12149 |
| SCNN1A-8301 | + | ACCUUGUCCAGACCCGGG | 18 | 12150 |
| SCNN1A-8302 | + | AACCUUGUCCAGACCCGGG | 19 | 12151 |
| SCNN1A-5686 | + | CAACCUUGUCCAGACCCGGG | 20 | 9535 |
| SCNN1A-8303 | + | CCAACCUUGUCCAGACCCGGG | 21 | 12152 |
| SCNN1A-8304 | + | UCCAACCUUGUCCAGACCCGGG | 22 | 12153 |
| SCNN1A-8305 | + | CUCCAACCUUGUCCAGACCCGGG | 23 | 12154 |
| SCNN1A-8306 | + | CCUCCAACCUUGUCCAGACCCGGG | 24 | 12155 |
| SCNN1A-8307 | + | AAAGGUGAGCAGGGCGGG | 18 | 12156 |
| SCNN1A-8308 | + | UAAAGGUGAGCAGGGCGGG | 19 | 12157 |
| SCNN1A-5688 | + | UUAAAGGUGAGCAGGGCGGG | 20 | 9537 |
| SCNN1A-8309 | + | AUUAAAGGUGAGCAGGGCGGG | 21 | 12158 |
| SCNN1A-8310 | + | AAUUAAAGGUGAGCAGGGCGGG | 22 | 12159 |
| SCNN1A-8311 | + | CAAUUAAAGGUGAGCAGGGCGGG | 23 | 12160 |
| SCNN1A-8312 | + | UCAAUUAAAGGUGAGCAGGGCGGG | 24 | 12161 |
| SCNN1A-8313 | + | GCAGGGCGGGGGAGGGG | 18 | 12162 |
| SCNN1A-8314 | + | AGCAGGGCGGGGGAGGGG | 19 | 12163 |

TABLE 47D-continued

4th Tier

| gRNA Name | DNA Strand | Targeting Domain | Target Site Length | Seq ID |
|---|---|---|---|---|
| SCNN1A-8315 | + | GAGCAGGGCGGGGGAGGGG | 20 | 12164 |
| SCNN1A-8316 | + | UGAGCAGGGCGGGGGAGGGG | 21 | 12165 |
| SCNN1A-8317 | + | GUGAGCAGGGCGGGGGAGGGG | 22 | 12166 |
| SCNN1A-8318 | + | GGUGAGCAGGGCGGGGGAGGGG | 23 | 12167 |
| SCNN1A-8319 | + | AGGUGAGCAGGGCGGGGGAGGGG | 24 | 12168 |
| SCNN1A-8320 | + | CAUUGAUACACACCGGGG | 18 | 12169 |
| SCNN1A-8321 | + | GCAUUGAUACACACCGGGG | 19 | 12170 |
| SCNN1A-8322 | + | AGCAUUGAUACACACCGGGG | 20 | 12171 |
| SCNN1A-8323 | + | GAGCAUUGAUACACACCGGGG | 21 | 12172 |
| SCNN1A-8324 | + | UGAGCAUUGAUACACACCGGGG | 22 | 12173 |
| SCNN1A-8325 | + | CUGAGCAUUGAUACACACCGGGG | 23 | 12174 |
| SCNN1A-8326 | + | CCUGAGCAUUGAUACACACCGGGG | 24 | 12175 |
| SCNN1A-8327 | + | AUUGAUACACACCGGGGG | 18 | 12176 |
| SCNN1A-8328 | + | CAUUGAUACACACCGGGGG | 19 | 12177 |
| SCNN1A-5265 | + | GCAUUGAUACACACCGGGGG | 20 | 9114 |
| SCNN1A-8329 | + | AGCAUUGAUACACACCGGGGG | 21 | 12178 |
| SCNN1A-8330 | + | GAGCAUUGAUACACACCGGGGG | 22 | 12179 |
| SCNN1A-8331 | + | UGAGCAUUGAUACACACCGGGGG | 23 | 12180 |
| SCNN1A-8332 | + | CUGAGCAUUGAUACACACCGGGGG | 24 | 12181 |
| SCNN1A-8333 | + | AGGUGAGCAGGGCGGGGG | 18 | 12182 |
| SCNN1A-8334 | + | AAGGUGAGCAGGGCGGGGG | 19 | 12183 |
| SCNN1A-8335 | + | AAAGGUGAGCAGGGCGGGGG | 20 | 12184 |
| SCNN1A-8336 | + | UAAAGGUGAGCAGGGCGGGGG | 21 | 12185 |
| SCNN1A-8337 | + | UUAAAGGUGAGCAGGGCGGGGG | 22 | 12186 |
| SCNN1A-8338 | + | AUUAAAGGUGAGCAGGGCGGGGG | 23 | 12187 |
| SCNN1A-8339 | + | AAUUAAAGGUGAGCAGGGCGGGGG | 24 | 12188 |
| SCNN1A-8340 | + | GGUGAGCAGGGCGGGGGG | 18 | 12189 |
| SCNN1A-8341 | + | AGGUGAGCAGGGCGGGGGG | 19 | 12190 |
| SCNN1A-6164 | + | AAGGUGAGCAGGGCGGGGGG | 20 | 10013 |
| SCNN1A-8342 | + | AAAGGUGAGCAGGGCGGGGGG | 21 | 12191 |
| SCNN1A-8343 | + | UAAAGGUGAGCAGGGCGGGGGG | 22 | 12192 |
| SCNN1A-8344 | + | UUAAAGGUGAGCAGGGCGGGGGG | 23 | 12193 |
| SCNN1A-8345 | + | AUUAAAGGUGAGCAGGGCGGGGGG | 24 | 12194 |
| SCNN1A-8346 | + | GCCUAGACAGGCCCUGGG | 18 | 12195 |
| SCNN1A-8347 | + | CGCCUAGACAGGCCCUGGG | 19 | 12196 |
| SCNN1A-5691 | + | ACGCCUAGACAGGCCCUGGG | 20 | 9540 |
| SCNN1A-8348 | + | CACGCCUAGACAGGCCCUGGG | 21 | 12197 |
| SCNN1A-8349 | + | ACACGCCUAGACAGGCCCUGGG | 22 | 12198 |

TABLE 47D-continued

| | 4th Tier | | | |
|---|---|---|---|---|
| gRNA Name | DNA Strand | Targeting Domain | Target Site Length | Seq ID |
| SCNN1A-8350 | + | CACACGCCUAGACAGGCCCUGGG | 23 | 12199 |
| SCNN1A-8351 | + | GCACACGCCUAGACAGGCCCUGGG | 24 | 12200 |
| SCNN1A-8352 | + | AGGCUGAGAGGGCCUGGG | 18 | 12201 |
| SCNN1A-8353 | + | CAGGCUGAGAGGGCCUGGG | 19 | 12202 |
| SCNN1A-6165 | + | CCAGGCUGAGAGGGCCUGGG | 20 | 10014 |
| SCNN1A-8354 | + | GCCAGGCUGAGAGGGCCUGGG | 21 | 12203 |
| SCNN1A-8355 | + | AGCCAGGCUGAGAGGGCCUGGG | 22 | 12204 |
| SCNN1A-8356 | + | CAGCCAGGCUGAGAGGGCCUGGG | 23 | 12205 |
| SCNN1A-8357 | + | CCAGCCAGGCUGAGAGGGCCUGGG | 24 | 12206 |
| SCNN1A-8358 | + | GAGAAGGCGGACUCUGGG | 18 | 12207 |
| SCNN1A-8359 | + | UGAGAAGGCGGACUCUGGG | 19 | 12208 |
| SCNN1A-8360 | + | CUGAGAAGGCGGACUCUGGG | 20 | 12209 |
| SCNN1A-8361 | + | CCUGAGAAGGCGGACUCUGGG | 21 | 12210 |
| SCNN1A-8362 | + | ACCUGAGAAGGCGGACUCUGGG | 22 | 12211 |
| SCNN1A-8363 | + | GACCUGAGAAGGCGGACUCUGGG | 23 | 12212 |
| SCNN1A-8364 | + | GGACCUGAGAAGGCGGACUCUGGG | 24 | 12213 |
| SCNN1A-1623 | + | GCCCCGGAGUGGAUUGGG | 18 | 5472 |
| SCNN1A-1624 | + | AGCCCCGGAGUGGAUUGGG | 19 | 5473 |
| SCNN1A-1625 | + | GAGCCCCGGAGUGGAUUGGG | 20 | 5474 |
| SCNN1A-1626 | + | UGAGCCCCGGAGUGGAUUGGG | 21 | 5475 |
| SCNN1A-1627 | + | AUGAGCCCCGGAGUGGAUUGGG | 22 | 5476 |
| SCNN1A-1628 | + | CAUGAGCCCCGGAGUGGAUUGGG | 23 | 5477 |
| SCNN1A-1629 | + | UCAUGAGCCCCGGAGUGGAUUGGG | 24 | 5478 |
| SCNN1A-8365 | + | ACAGAGAGAUAGGGAUGG | 18 | 12214 |
| SCNN1A-8366 | + | GACAGAGAGAUAGGGAUGG | 19 | 12215 |
| SCNN1A-5915 | + | GGACAGAGAGAUAGGGAUGG | 20 | 9764 |
| SCNN1A-8367 | + | AGGACAGAGAGAUAGGGAUGG | 21 | 12216 |
| SCNN1A-8368 | + | AAGGACAGAGAGAUAGGGAUGG | 22 | 12217 |
| SCNN1A-8369 | + | GAAGGACAGAGAGAUAGGGAUGG | 23 | 12218 |
| SCNN1A-8370 | + | CGAAGGACAGAGAGAUAGGGAUGG | 24 | 12219 |
| SCNN1A-8371 | + | CGCCUAGACAGGCCCUGG | 18 | 12220 |
| SCNN1A-8372 | + | ACGCCUAGACAGGCCCUGG | 19 | 12221 |
| SCNN1A-8373 | + | CACGCCUAGACAGGCCCUGG | 20 | 12222 |
| SCNN1A-8374 | + | ACACGCCUAGACAGGCCCUGG | 21 | 12223 |
| SCNN1A-8375 | + | CACACGCCUAGACAGGCCCUGG | 22 | 12224 |
| SCNN1A-8376 | + | GCACACGCCUAGACAGGCCCUGG | 23 | 12225 |
| SCNN1A-8377 | + | GGCACACGCCUAGACAGGCCCUGG | 24 | 12226 |

TABLE 47D-continued

4th Tier

| gRNA Name | DNA Strand | Targeting Domain | Target Site Length | Seq ID |
|---|---|---|---|---|
| SCNN1A-8378 | + | ACAGGUGCAGCGGCCUGG | 18 | 12227 |
| SCNN1A-8379 | + | GACAGGUGCAGCGGCCUGG | 19 | 12228 |
| SCNN1A-8380 | + | UGACAGGUGCAGCGGCCUGG | 20 | 12229 |
| SCNN1A-8381 | + | CUGACAGGUGCAGCGGCCUGG | 21 | 12230 |
| SCNN1A-8382 | + | CCUGACAGGUGCAGCGGCCUGG | 22 | 12231 |
| SCNN1A-8383 | + | ACCUGACAGGUGCAGCGGCCUGG | 23 | 12232 |
| SCNN1A-8384 | + | CACCUGACAGGUGCAGCGGCCUGG | 24 | 12233 |
| SCNN1A-8385 | + | CAGGCUGAGAGGGCCUGG | 18 | 12234 |
| SCNN1A-8386 | + | CCAGGCUGAGAGGGCCUGG | 19 | 12235 |
| SCNN1A-8387 | + | GCCAGGCUGAGAGGGCCUGG | 20 | 12236 |
| SCNN1A-8388 | + | AGCCAGGCUGAGAGGGCCUGG | 21 | 12237 |
| SCNN1A-8389 | + | CAGCCAGGCUGAGAGGGCCUGG | 22 | 12238 |
| SCNN1A-8390 | + | CCAGCCAGGCUGAGAGGGCCUGG | 23 | 12239 |
| SCNN1A-8391 | + | GCCAGCCAGGCUGAGAGGGCCUGG | 24 | 12240 |
| SCNN1A-8392 | + | AGACCCAAAAAGGGCUGG | 18 | 12241 |
| SCNN1A-8393 | + | CAGACCCAAAAAGGGCUGG | 19 | 12242 |
| SCNN1A-5694 | + | UCAGACCCAAAAAGGGCUGG | 20 | 9543 |
| SCNN1A-8394 | + | AUCAGACCCAAAAAGGGCUGG | 21 | 12243 |
| SCNN1A-8395 | + | AAUCAGACCCAAAAAGGGCUGG | 22 | 12244 |
| SCNN1A-8396 | + | GAAUCAGACCCAAAAAGGGCUGG | 23 | 12245 |
| SCNN1A-8397 | + | AGAAUCAGACCCAAAAAGGGCUGG | 24 | 12246 |
| SCNN1A-8398 | + | GCAGGUGGGGGCAGUGG | 18 | 12247 |
| SCNN1A-8399 | + | GGCAGGUGGGGGCAGUGG | 19 | 12248 |
| SCNN1A-6171 | + | AGGCAGGUGGGGGCAGUGG | 20 | 10020 |
| SCNN1A-8400 | + | GAGGCAGGUGGGGGCAGUGG | 21 | 12249 |
| SCNN1A-8401 | + | AGAGGCAGGUGGGGGCAGUGG | 22 | 12250 |
| SCNN1A-8402 | + | UAGAGGCAGGUGGGGGCAGUGG | 23 | 12251 |
| SCNN1A-8403 | + | GUAGAGGCAGGUGGGGGCAGUGG | 24 | 12252 |
| SCNN1A-1630 | + | CAUGAUACCUCCCCUUGG | 18 | 5479 |
| SCNN1A-1631 | + | UCAUGAUACCUCCCCUUGG | 19 | 5480 |
| SCNN1A-1632 | + | CUCAUGAUACCUCCCCUUGG | 20 | 5481 |
| SCNN1A-1633 | + | GCUCAUGAUACCUCCCCUUGG | 21 | 5482 |
| SCNN1A-1634 | + | UGCUCAUGAUACCUCCCCUUGG | 22 | 5483 |
| SCNN1A-1635 | + | CUGCUCAUGAUACCUCCCCUUGG | 23 | 5484 |
| SCNN1A-1636 | + | ACUGCUCAUGAUACCUCCCCUUGG | 24 | 5485 |
| SCNN1A-8404 | + | UUCUUCAUUGUCCUAAUG | 18 | 12253 |
| SCNN1A-8405 | + | UUUCUUCAUUGUCCUAAUG | 19 | 12254 |
| SCNN1A-8406 | + | UUUUCUUCAUUGUCCUAAUG | 20 | 12255 |

TABLE 47D-continued

4th Tier

| gRNA Name | DNA Strand | Targeting Domain | Target Site Length | Seq ID |
|---|---|---|---|---|
| SCNN1A-8407 | + | UUUUUCUUCAUUGUCCUAAUG | 21 | 12256 |
| SCNN1A-8408 | + | AUUUUUCUUCAUUGUCCUAAUG | 22 | 12257 |
| SCNN1A-8409 | + | GAUUUUUCUUCAUUGUCCUAAUG | 23 | 12258 |
| SCNN1A-8410 | + | GGAUUUUUCUUCAUUGUCCUAAUG | 24 | 12259 |
| SCNN1A-8411 | + | GACAGAGAGAUAGGGAUG | 18 | 12260 |
| SCNN1A-8412 | + | GGACAGAGAGAUAGGGAUG | 19 | 12261 |
| SCNN1A-8413 | + | AGGACAGAGAGAUAGGGAUG | 20 | 12262 |
| SCNN1A-8414 | + | AAGGACAGAGAGAUAGGGAUG | 21 | 12263 |
| SCNN1A-8415 | + | GAAGGACAGAGAGAUAGGGAUG | 22 | 12264 |
| SCNN1A-8416 | + | CGAAGGACAGAGAGAUAGGGAUG | 23 | 12265 |
| SCNN1A-8417 | + | GCGAAGGACAGAGAGAUAGGGAUG | 24 | 12266 |
| SCNN1A-8418 | + | GAGCCUAGGGGCUCACUG | 18 | 12267 |
| SCNN1A-8419 | + | GGAGCCUAGGGGCUCACUG | 19 | 12268 |
| SCNN1A-8420 | + | GGGAGCCUAGGGGCUCACUG | 20 | 12269 |
| SCNN1A-8421 | + | GGGGAGCCUAGGGGCUCACUG | 21 | 12270 |
| SCNN1A-8422 | + | AGGGGAGCCUAGGGGCUCACUG | 22 | 12271 |
| SCNN1A-8423 | + | UAGGGGAGCCUAGGGGCUCACUG | 23 | 12272 |
| SCNN1A-8424 | + | CUAGGGGAGCCUAGGGGCUCACUG | 24 | 12273 |
| SCNN1A-8425 | + | GUCUCUGCCCCAGGACUG | 18 | 12274 |
| SCNN1A-8426 | + | UGUCUCUGCCCCAGGACUG | 19 | 12275 |
| SCNN1A-8427 | + | CUGUCUCUGCCCCAGGACUG | 20 | 12276 |
| SCNN1A-8428 | + | UCUGUCUCUGCCCCAGGACUG | 21 | 12277 |
| SCNN1A-8429 | + | UUCUGUCUCUGCCCCAGGACUG | 22 | 12278 |
| SCNN1A-8430 | + | AUUCUGUCUCUGCCCCAGGACUG | 23 | 12279 |
| SCNN1A-8431 | + | GAUUCUGUCUCUGCCCCAGGACUG | 24 | 12280 |
| SCNN1A-8432 | + | CUGGAGCCAGCAGACCUG | 18 | 12281 |
| SCNN1A-8433 | + | CCUGGAGCCAGCAGACCUG | 19 | 12282 |
| SCNN1A-5701 | + | UCCUGGAGCCAGCAGACCUG | 20 | 9550 |
| SCNN1A-8434 | + | UUCCUGGAGCCAGCAGACCUG | 21 | 12283 |
| SCNN1A-8435 | + | UUUCCUGGAGCCAGCAGACCUG | 22 | 12284 |
| SCNN1A-8436 | + | CUUUCCUGGAGCCAGCAGACCUG | 23 | 12285 |
| SCNN1A-8437 | + | CCUUUCCUGGAGCCAGCAGACCUG | 24 | 12286 |
| SCNN1A-8438 | + | CCUCACCCUCAGGCCCUG | 18 | 12287 |
| SCNN1A-8439 | + | GCCUCACCCUCAGGCCCUG | 19 | 12288 |
| SCNN1A-8440 | + | AGCCUCACCCUCAGGCCCUG | 20 | 12289 |
| SCNN1A-8441 | + | CAGCCUCACCCUCAGGCCCUG | 21 | 12290 |
| SCNN1A-8442 | + | UCAGCCUCACCCUCAGGCCCUG | 22 | 12291 |

TABLE 47D-continued

4th Tier

| gRNA Name | DNA Strand | Targeting Domain | Target Site Length | Seq ID |
|---|---|---|---|---|
| SCNN1A-8443 | + | GUCAGCCUCACCCUCAGGCCCUG | 23 | 12292 |
| SCNN1A-8444 | + | GGUCAGCCUCACCCUCAGGCCCUG | 24 | 12293 |
| SCNN1A-8445 | + | AGACAGGCAAGGAGGCUG | 18 | 12294 |
| SCNN1A-8446 | + | CAGACAGGCAAGGAGGCUG | 19 | 12295 |
| SCNN1A-5919 | + | GCAGACAGGCAAGGAGGCUG | 20 | 9768 |
| SCNN1A-8447 | + | CGCAGACAGGCAAGGAGGCUG | 21 | 12296 |
| SCNN1A-8448 | + | ACGCAGACAGGCAAGGAGGCUG | 22 | 12297 |
| SCNN1A-8449 | + | GACGCAGACAGGCAAGGAGGCUG | 23 | 12298 |
| SCNN1A-8450 | + | AGACGCAGACAGGCAAGGAGGCUG | 24 | 12299 |
| SCNN1A-8451 | + | CAGACCCAAAAAGGGCUG | 18 | 12300 |
| SCNN1A-8452 | + | UCAGACCCAAAAAGGGCUG | 19 | 12301 |
| SCNN1A-8453 | + | AUCAGACCCAAAAAGGGCUG | 20 | 12302 |
| SCNN1A-8454 | + | AAUCAGACCCAAAAAGGGCUG | 21 | 12303 |
| SCNN1A-8455 | + | GAAUCAGACCCAAAAAGGGCUG | 22 | 12304 |
| SCNN1A-8456 | + | AGAAUCAGACCCAAAAAGGGCUG | 23 | 12305 |
| SCNN1A-8457 | + | GAGAAUCAGACCCAAAAAGGGCUG | 24 | 12306 |
| SCNN1A-8458 | + | GGGCGGGGGAGGGGCUG | 18 | 12307 |
| SCNN1A-8459 | + | AGGGCGGGGGAGGGGCUG | 19 | 12308 |
| SCNN1A-6176 | + | CAGGGCGGGGGAGGGGCUG | 20 | 10025 |
| SCNN1A-8460 | + | GCAGGGCGGGGGAGGGGCUG | 21 | 12309 |
| SCNN1A-8461 | + | AGCAGGGCGGGGGAGGGGCUG | 22 | 12310 |
| SCNN1A-8462 | + | GAGCAGGGCGGGGGAGGGGCUG | 23 | 12311 |
| SCNN1A-8463 | + | UGAGCAGGGCGGGGGAGGGGCUG | 24 | 12312 |
| SCNN1A-1668 | + | GAGACCUGGUAUGGGCUG | 18 | 5517 |
| SCNN1A-1669 | + | UGAGACCUGGUAUGGGCUG | 19 | 5518 |
| SCNN1A-1670 | + | AUGAGACCUGGUAUGGGCUG | 20 | 5519 |
| SCNN1A-1671 | + | CAUGAGACCUGGUAUGGGCUG | 21 | 5520 |
| SCNN1A-1672 | + | CCAUGAGACCUGGUAUGGGCUG | 22 | 5521 |
| SCNN1A-1673 | + | UCCAUGAGACCUGGUAUGGGCUG | 23 | 5522 |
| SCNN1A-1674 | + | CUCCAUGAGACCUGGUAUGGGCUG | 24 | 5523 |
| SCNN1A-8464 | + | GGUGCAGCGGCCUGGCUG | 18 | 12313 |
| SCNN1A-8465 | + | AGGUGCAGCGGCCUGGCUG | 19 | 12314 |
| SCNN1A-5705 | + | CAGGUGCAGCGGCCUGGCUG | 20 | 9554 |
| SCNN1A-8466 | + | ACAGGUGCAGCGGCCUGGCUG | 21 | 12315 |
| SCNN1A-8467 | + | GACAGGUGCAGCGGCCUGGCUG | 22 | 12316 |
| SCNN1A-8468 | + | UGACAGGUGCAGCGGCCUGGCUG | 23 | 12317 |
| SCNN1A-8469 | + | CUGACAGGUGCAGCGGCCUGGCUG | 24 | 12318 |
| SCNN1A-8470 | + | GAGUUGGGGCCAAAAGUG | 18 | 12319 |

TABLE 47D-continued

4th Tier

| gRNA Name | DNA Strand | Targeting Domain | Target Site Length | Seq ID |
|---|---|---|---|---|
| SCNN1A-8471 | + | GGAGUUGGGGCCAAAAGUG | 19 | 12320 |
| SCNN1A-8472 | + | GGGAGUUGGGGCCAAAAGUG | 20 | 12321 |
| SCNN1A-8473 | + | CGGGAGUUGGGGCCAAAAGUG | 21 | 12322 |
| SCNN1A-8474 | + | GCGGGAGUUGGGGCCAAAAGUG | 22 | 12323 |
| SCNN1A-8475 | + | UGCGGGAGUUGGGGCCAAAAGUG | 23 | 12324 |
| SCNN1A-8476 | + | CUGCGGGAGUUGGGGCCAAAAGUG | 24 | 12325 |
| SCNN1A-8477 | + | GGAGUGGAGUGCCAAGUG | 18 | 12326 |
| SCNN1A-8478 | + | AGGAGUGGAGUGCCAAGUG | 19 | 12327 |
| SCNN1A-8479 | + | AAGGAGUGGAGUGCCAAGUG | 20 | 12328 |
| SCNN1A-8480 | + | UAAGGAGUGGAGUGCCAAGUG | 21 | 12329 |
| SCNN1A-8481 | + | AUAAGGAGUGGAGUGCCAAGUG | 22 | 12330 |
| SCNN1A-8482 | + | GAUAAGGAGUGGAGUGCCAAGUG | 23 | 12331 |
| SCNN1A-8483 | + | GGAUAAGGAGUGGAGUGCCAAGUG | 24 | 12332 |
| SCNN1A-8484 | + | GGCAGGUGGGGGCAGUG | 18 | 12333 |
| SCNN1A-8485 | + | AGGCAGGUGGGGGCAGUG | 19 | 12334 |
| SCNN1A-8486 | + | GAGGCAGGUGGGGGCAGUG | 20 | 12335 |
| SCNN1A-8487 | + | AGAGGCAGGUGGGGGCAGUG | 21 | 12336 |
| SCNN1A-8488 | + | UAGAGGCAGGUGGGGGCAGUG | 22 | 12337 |
| SCNN1A-8489 | + | GUAGAGGCAGGUGGGGGCAGUG | 23 | 12338 |
| SCNN1A-8490 | + | AGUAGAGGCAGGUGGGGGCAGUG | 24 | 12339 |
| SCNN1A-8491 | + | AGGAGGCAGCCCAGAGUG | 18 | 12340 |
| SCNN1A-8492 | + | CAGGAGGCAGCCCAGAGUG | 19 | 12341 |
| SCNN1A-8493 | + | ACAGGAGGCAGCCCAGAGUG | 20 | 12342 |
| SCNN1A-8494 | + | CACAGGAGGCAGCCCAGAGUG | 21 | 12343 |
| SCNN1A-8495 | + | CCACAGGAGGCAGCCCAGAGUG | 22 | 12344 |
| SCNN1A-8496 | + | CCCACAGGAGGCAGCCCAGAGUG | 23 | 12345 |
| SCNN1A-8497 | + | CCCCACAGGAGGCAGCCCAGAGUG | 24 | 12346 |
| SCNN1A-8498 | + | AAGCAGGCACUGAAGGUG | 18 | 12347 |
| SCNN1A-8499 | + | AAAGCAGGCACUGAAGGUG | 19 | 12348 |
| SCNN1A-8500 | + | GAAAGCAGGCACUGAAGGUG | 20 | 12349 |
| SCNN1A-8501 | + | GGAAAGCAGGCACUGAAGGUG | 21 | 12350 |
| SCNN1A-8502 | + | GGGAAAGCAGGCACUGAAGGUG | 22 | 12351 |
| SCNN1A-8503 | + | AGGGAAAGCAGGCACUGAAGGUG | 23 | 12352 |
| SCNN1A-8504 | + | CAGGGAAAGCAGGCACUGAAGGUG | 24 | 12353 |
| SCNN1A-8505 | + | AGUGAGUAGAGGCAGGUG | 18 | 12354 |
| SCNN1A-8506 | + | GAGUGAGUAGAGGCAGGUG | 19 | 12355 |
| SCNN1A-5713 | + | UGAGUGAGUAGAGGCAGGUG | 20 | 9562 |

TABLE 47D-continued

4th Tier

| gRNA Name | DNA Strand | Targeting Domain | Target Site Length | Seq ID |
|---|---|---|---|---|
| SCNN1A-8507 | + | CUGAGUGAGUAGAGGCAGGUG | 21 | 12356 |
| SCNN1A-8508 | + | ACUGAGUGAGUAGAGGCAGGUG | 22 | 12357 |
| SCNN1A-8509 | + | CACUGAGUGAGUAGAGGCAGGUG | 23 | 12358 |
| SCNN1A-8510 | + | GCACUGAGUGAGUAGAGGCAGGUG | 24 | 12359 |
| SCNN1A-8511 | + | GGGACAGGAUGGCAGGUG | 18 | 12360 |
| SCNN1A-8512 | + | GGGGACAGGAUGGCAGGUG | 19 | 12361 |
| SCNN1A-5920 | + | GGGGGACAGGAUGGCAGGUG | 20 | 9769 |
| SCNN1A-8513 | + | UGGGGGACAGGAUGGCAGGUG | 21 | 12362 |
| SCNN1A-8514 | + | CUGGGGGACAGGAUGGCAGGUG | 22 | 12363 |
| SCNN1A-8515 | + | GCUGGGGGACAGGAUGGCAGGUG | 23 | 12364 |
| SCNN1A-8516 | + | GGCUGGGGGACAGGAUGGCAGGUG | 24 | 12365 |
| SCNN1A-8517 | + | GCUGAGAGGGCCUGGGUG | 18 | 12366 |
| SCNN1A-8518 | + | GGCUGAGAGGGCCUGGGUG | 19 | 12367 |
| SCNN1A-6177 | + | AGGCUGAGAGGGCCUGGGUG | 20 | 10026 |
| SCNN1A-8519 | + | CAGGCUGAGAGGGCCUGGGUG | 21 | 12368 |
| SCNN1A-8520 | + | CCAGGCUGAGAGGGCCUGGGUG | 22 | 12369 |
| SCNN1A-8521 | + | GCCAGGCUGAGAGGGCCUGGGUG | 23 | 12370 |
| SCNN1A-8522 | + | AGCCAGGCUGAGAGGGCCUGGGUG | 24 | 12371 |
| SCNN1A-1699 | + | GAGCCCCGGAGUGGAUUG | 18 | 5548 |
| SCNN1A-1700 | + | UGAGCCCCGGAGUGGAUUG | 19 | 5549 |
| SCNN1A-419 | + | AUGAGCCCCGGAGUGGAUUG | 20 | 4268 |
| SCNN1A-1701 | + | CAUGAGCCCCGGAGUGGAUUG | 21 | 5550 |
| SCNN1A-1702 | + | UCAUGAGCCCCGGAGUGGAUUG | 22 | 5551 |
| SCNN1A-1703 | + | UUCAUGAGCCCCGGAGUGGAUUG | 23 | 5552 |
| SCNN1A-1704 | + | CUUCAUGAGCCCCGGAGUGGAUUG | 24 | 5553 |
| SCNN1A-8523 | + | GCUGUGGUCACAGAGUUG | 18 | 12372 |
| SCNN1A-8524 | + | UGCUGUGGUCACAGAGUUG | 19 | 12373 |
| SCNN1A-8525 | + | CUGCUGUGGUCACAGAGUUG | 20 | 12374 |
| SCNN1A-8526 | + | CCUGCUGUGGUCACAGAGUUG | 21 | 12375 |
| SCNN1A-8527 | + | CCCUGCUGUGGUCACAGAGUUG | 22 | 12376 |
| SCNN1A-8528 | + | CCCCUGCUGUGGUCACAGAGUUG | 23 | 12377 |
| SCNN1A-8529 | + | GCCCCUGCUGUGGUCACAGAGUUG | 24 | 12378 |
| SCNN1A-8530 | + | AGGAGGAGAAAUUCGUUG | 18 | 12379 |
| SCNN1A-8531 | + | GAGGAGGAGAAAUUCGUUG | 19 | 12380 |
| SCNN1A-8532 | + | GGAGGAGGAGAAAUUCGUUG | 20 | 12381 |
| SCNN1A-8533 | + | GGGAGGAGGAGAAAUUCGUUG | 21 | 12382 |
| SCNN1A-8534 | + | UGGGAGGAGGAGAAAUUCGUUG | 22 | 12383 |
| SCNN1A-8535 | + | CUGGGAGGAGGAGAAAUUCGUUG | 23 | 12384 |

TABLE 47D-continued

4th Tier

| gRNA Name | DNA Strand | Targeting Domain | Target Site Length | Seq ID |
|---|---|---|---|---|
| SCNN1A-8536 | + | CCUGGGAGGAGGAGAAAUUCGUUG | 24 | 12385 |
| SCNN1A-8537 | + | GAGGUUAGAAAACAAAAU | 18 | 12386 |
| SCNN1A-8538 | + | UGAGGUUAGAAAACAAAAU | 19 | 12387 |
| SCNN1A-5720 | + | CUGAGGUUAGAAAACAAAAU | 20 | 9569 |
| SCNN1A-8539 | + | UCUGAGGUUAGAAAACAAAAU | 21 | 12388 |
| SCNN1A-8540 | + | UUCUGAGGUUAGAAAACAAAAU | 22 | 12389 |
| SCNN1A-8541 | + | UUUCUGAGGUUAGAAAACAAAAU | 23 | 12390 |
| SCNN1A-8542 | + | UUUUCUGAGGUUAGAAAACAAAAU | 24 | 12391 |
| SCNN1A-8543 | + | UCACAGAGUUGCAGGAAU | 18 | 12392 |
| SCNN1A-8544 | + | GUCACAGAGUUGCAGGAAU | 19 | 12393 |
| SCNN1A-8545 | + | GGUCACAGAGUUGCAGGAAU | 20 | 12394 |
| SCNN1A-8546 | + | UGGUCACAGAGUUGCAGGAAU | 21 | 12395 |
| SCNN1A-8547 | + | GUGGUCACAGAGUUGCAGGAAU | 22 | 12396 |
| SCNN1A-8548 | + | UGUGGUCACAGAGUUGCAGGAAU | 23 | 12397 |
| SCNN1A-8549 | + | CUGUGGUCACAGAGUUGCAGGAAU | 24 | 12398 |
| SCNN1A-8550 | + | UUCUCAGAGAUAAGACAU | 18 | 12399 |
| SCNN1A-8551 | + | UUUCUCAGAGAUAAGACAU | 19 | 12400 |
| SCNN1A-8552 | + | AUUUCUCAGAGAUAAGACAU | 20 | 12401 |
| SCNN1A-8553 | + | GAUUUCUCAGAGAUAAGACAU | 21 | 12402 |
| SCNN1A-8554 | + | AGAUUUCUCAGAGAUAAGACAU | 22 | 12403 |
| SCNN1A-8555 | + | CAGAUUUCUCAGAGAUAAGACAU | 23 | 12404 |
| SCNN1A-8556 | + | UCAGAUUUCUCAGAGAUAAGACAU | 24 | 12405 |
| SCNN1A-8557 | + | UUCCUGAGACAGACUCAU | 18 | 12406 |
| SCNN1A-8558 | + | CUUCCUGAGACAGACUCAU | 19 | 12407 |
| SCNN1A-6179 | + | ACUUCCUGAGACAGACUCAU | 20 | 10028 |
| SCNN1A-8559 | + | UACUUCCUGAGACAGACUCAU | 21 | 12408 |
| SCNN1A-8560 | + | UUACUUCCUGAGACAGACUCAU | 22 | 12409 |
| SCNN1A-8561 | + | UUUACUUCCUGAGACAGACUCAU | 23 | 12410 |
| SCNN1A-8562 | + | AUUUACUUCCUGAGACAGACUCAU | 24 | 12411 |
| SCNN1A-8563 | + | CAGGUGAGGGGCAAAGAU | 18 | 12412 |
| SCNN1A-8564 | + | GCAGGUGAGGGGCAAAGAU | 19 | 12413 |
| SCNN1A-8565 | + | GGCAGGUGAGGGGCAAAGAU | 20 | 12414 |
| SCNN1A-8566 | + | UGGCAGGUGAGGGGCAAAGAU | 21 | 12415 |
| SCNN1A-8567 | + | AUGGCAGGUGAGGGGCAAAGAU | 22 | 12416 |
| SCNN1A-8568 | + | GAUGGCAGGUGAGGGGCAAAGAU | 23 | 12417 |
| SCNN1A-8569 | + | GGAUGGCAGGUGAGGGGCAAAGAU | 24 | 12418 |
| SCNN1A-8570 | + | UUAAUGCAGCAAAAGGAU | 18 | 12419 |

TABLE 47D-continued

4th Tier

| gRNA Name | DNA Strand | Targeting Domain | Target Site Length | Seq ID |
|---|---|---|---|---|
| SCNN1A-8571 | + | CUUAAUGCAGCAAAAGGAU | 19 | 12420 |
| SCNN1A-8572 | + | ACUUAAUGCAGCAAAAGGAU | 20 | 12421 |
| SCNN1A-8573 | + | AACUUAAUGCAGCAAAAGGAU | 21 | 12422 |
| SCNN1A-8574 | + | AAACUUAAUGCAGCAAAAGGAU | 22 | 12423 |
| SCNN1A-8575 | + | CAAACUUAAUGCAGCAAAAGGAU | 23 | 12424 |
| SCNN1A-8576 | + | CCAAACUUAAUGCAGCAAAAGGAU | 24 | 12425 |
| SCNN1A-8577 | + | GACAGACUCAUGGGGAU | 18 | 12426 |
| SCNN1A-8578 | + | AGACAGACUCAUGGGGAU | 19 | 12427 |
| SCNN1A-5272 | + | GAGACAGACUCAUGGGGAU | 20 | 9121 |
| SCNN1A-8579 | + | UGAGACAGACUCAUGGGGAU | 21 | 12428 |
| SCNN1A-8580 | + | CUGAGACAGACUCAUGGGGAU | 22 | 12429 |
| SCNN1A-8581 | + | CCUGAGACAGACUCAUGGGGAU | 23 | 12430 |
| SCNN1A-8582 | + | UCCUGAGACAGACUCAUGGGGAU | 24 | 12431 |
| SCNN1A-8583 | + | GCUCAGGUGCACCUGGAU | 18 | 12432 |
| SCNN1A-8584 | + | GGCUCAGGUGCACCUGGAU | 19 | 12433 |
| SCNN1A-8585 | + | GGGCUCAGGUGCACCUGGAU | 20 | 12434 |
| SCNN1A-8586 | + | GGGGCUCAGGUGCACCUGGAU | 21 | 12435 |
| SCNN1A-8587 | + | CGGGGCUCAGGUGCACCUGGAU | 22 | 12436 |
| SCNN1A-8588 | + | UCGGGGCUCAGGUGCACCUGGAU | 23 | 12437 |
| SCNN1A-8589 | + | AUCGGGGCUCAGGUGCACCUGGAU | 24 | 12438 |
| SCNN1A-1717 | + | AUGAGCCCCGGAGUGGAU | 18 | 5566 |
| SCNN1A-1718 | + | CAUGAGCCCCGGAGUGGAU | 19 | 5567 |
| SCNN1A-420 | + | UCAUGAGCCCCGGAGUGGAU | 20 | 4269 |
| SCNN1A-1719 | + | UUCAUGAGCCCCGGAGUGGAU | 21 | 5568 |
| SCNN1A-1720 | + | CUUCAUGAGCCCCGGAGUGGAU | 22 | 5569 |
| SCNN1A-1721 | + | CCUUCAUGAGCCCCGGAGUGGAU | 23 | 5570 |
| SCNN1A-1722 | + | CCCUUCAUGAGCCCCGGAGUGGAU | 24 | 5571 |
| SCNN1A-8590 | + | AGGGCCACGCAGGACACU | 18 | 12439 |
| SCNN1A-8591 | + | GAGGGCCACGCAGGACACU | 19 | 12440 |
| SCNN1A-8592 | + | CGAGGGCCACGCAGGACACU | 20 | 12441 |
| SCNN1A-8593 | + | GCGAGGGCCACGCAGGACACU | 21 | 12442 |
| SCNN1A-8594 | + | CGCGAGGGCCACGCAGGACACU | 22 | 12443 |
| SCNN1A-8595 | + | GCGCGAGGGCCACGCAGGACACU | 23 | 12444 |
| SCNN1A-8596 | + | AGCGCGAGGGCCACGCAGGACACU | 24 | 12445 |
| SCNN1A-8597 | + | GGCUCACUGCAGGAGACU | 18 | 12446 |
| SCNN1A-8598 | + | GGGCUCACUGCAGGAGACU | 19 | 12447 |
| SCNN1A-8599 | + | GGGGCUCACUGCAGGAGACU | 20 | 12448 |
| SCNN1A-8600 | + | AGGGGCUCACUGCAGGAGACU | 21 | 12449 |

TABLE 47D-continued

4th Tier

| gRNA Name | DNA Strand | Targeting Domain | Target Site Length | Seq ID |
|---|---|---|---|---|
| SCNN1A-8601 | + | UAGGGGCUCACUGCAGGAGACU | 22 | 12450 |
| SCNN1A-8602 | + | CUAGGGGCUCACUGCAGGAGACU | 23 | 12451 |
| SCNN1A-8603 | + | CCUAGGGGCUCACUGCAGGAGACU | 24 | 12452 |
| SCNN1A-8604 | + | AAAGGGCUGGAGGAGACU | 18 | 12453 |
| SCNN1A-8605 | + | AAAAGGGCUGGAGGAGACU | 19 | 12454 |
| SCNN1A-5729 | + | AAAAAGGGCUGGAGGAGACU | 20 | 9578 |
| SCNN1A-8606 | + | CAAAAAGGGCUGGAGGAGACU | 21 | 12455 |
| SCNN1A-8607 | + | CCAAAAAGGGCUGGAGGAGACU | 22 | 12456 |
| SCNN1A-8608 | + | CCCAAAAAGGGCUGGAGGAGACU | 23 | 12457 |
| SCNN1A-8609 | + | ACCCAAAAAGGGCUGGAGGAGACU | 24 | 12458 |
| SCNN1A-8610 | + | GACCUGAGAAGGCGGACU | 18 | 12459 |
| SCNN1A-8611 | + | GGACCUGAGAAGGCGGACU | 19 | 12460 |
| SCNN1A-8612 | + | UGGACCUGAGAAGGCGGACU | 20 | 12461 |
| SCNN1A-8613 | + | CUGGACCUGAGAAGGCGGACU | 21 | 12462 |
| SCNN1A-8614 | + | ACUGGACCUGAGAAGGCGGACU | 22 | 12463 |
| SCNN1A-8615 | + | UACUGGACCUGAGAAGGCGGACU | 23 | 12464 |
| SCNN1A-8616 | + | GUACUGGACCUGAGAAGGCGGACU | 24 | 12465 |
| SCNN1A-8617 | + | CCUGGAGCCAGCAGACCU | 18 | 12466 |
| SCNN1A-8618 | + | UCCUGGAGCCAGCAGACCU | 19 | 12467 |
| SCNN1A-8619 | + | UUCCUGGAGCCAGCAGACCU | 20 | 12468 |
| SCNN1A-8620 | + | UUUCCUGGAGCCAGCAGACCU | 21 | 12469 |
| SCNN1A-8621 | + | CUUUCCUGGAGCCAGCAGACCU | 22 | 12470 |
| SCNN1A-8622 | + | CCUUUCCUGGAGCCAGCAGACCU | 23 | 12471 |
| SCNN1A-8623 | + | ACCUUUCCUGGAGCCAGCAGACCU | 24 | 12472 |
| SCNN1A-8624 | + | ACUGGGAGUACUGGACCU | 18 | 12473 |
| SCNN1A-8625 | + | AACUGGGAGUACUGGACCU | 19 | 12474 |
| SCNN1A-8626 | + | GAACUGGGAGUACUGGACCU | 20 | 12475 |
| SCNN1A-8627 | + | UGAACUGGGAGUACUGGACCU | 21 | 12476 |
| SCNN1A-8628 | + | GUGAACUGGGAGUACUGGACCU | 22 | 12477 |
| SCNN1A-8629 | + | GGUGAACUGGGAGUACUGGACCU | 23 | 12478 |
| SCNN1A-8630 | + | AGGUGAACUGGGAGUACUGGACCU | 24 | 12479 |
| SCNN1A-1735 | + | GCUCAUGAUACCUCCCCU | 18 | 5584 |
| SCNN1A-1736 | + | UGCUCAUGAUACCUCCCCU | 19 | 5585 |
| SCNN1A-457 | + | CUGCUCAUGAUACCUCCCCU | 20 | 4306 |
| SCNN1A-1737 | + | ACUGCUCAUGAUACCUCCCCU | 21 | 5586 |
| SCNN1A-1738 | + | UACUGCUCAUGAUACCUCCCCU | 22 | 5587 |
| SCNN1A-1739 | + | AUACUGCUCAUGAUACCUCCCCU | 23 | 5588 |

TABLE 47D-continued

4th Tier

| gRNA Name | DNA Strand | Targeting Domain | Target Site Length | Seq ID |
|---|---|---|---|---|
| SCNN1A-1740 | + | GAUACUGCUCAUGAUACCUCCCCU | 24 | 5589 |
| SCNN1A-8631 | + | CACGCCUAGACAGGCCCU | 18 | 12480 |
| SCNN1A-8632 | + | ACACGCCUAGACAGGCCCU | 19 | 12481 |
| SCNN1A-5734 | + | CACACGCCUAGACAGGCCCU | 20 | 9583 |
| SCNN1A-8633 | + | GCACACGCCUAGACAGGCCCU | 21 | 12482 |
| SCNN1A-8634 | + | GGCACACGCCUAGACAGGCCCU | 22 | 12483 |
| SCNN1A-8635 | + | UGGCACACGCCUAGACAGGCCCU | 23 | 12484 |
| SCNN1A-8636 | + | AUGGCACACGCCUAGACAGGCCCU | 24 | 12485 |
| SCNN1A-8637 | + | CAAGGGCUAGGGGAGCCU | 18 | 12486 |
| SCNN1A-8638 | + | CCAAGGGCUAGGGGAGCCU | 19 | 12487 |
| SCNN1A-5275 | + | GCCAAGGGCUAGGGGAGCCU | 20 | 9124 |
| SCNN1A-8639 | + | AGCCAAGGGCUAGGGGAGCCU | 21 | 12488 |
| SCNN1A-8640 | + | GAGCCAAGGGCUAGGGGAGCCU | 22 | 12489 |
| SCNN1A-8641 | + | AGAGCCAAGGGCUAGGGGAGCCU | 23 | 12490 |
| SCNN1A-8642 | + | AAGAGCCAAGGGCUAGGGGAGCCU | 24 | 12491 |
| SCNN1A-8643 | + | CAGAAUUCUCCUCCUCCU | 18 | 12492 |
| SCNN1A-8644 | + | UCAGAAUUCUCCUCCUCCU | 19 | 12493 |
| SCNN1A-8645 | + | UUCAGAAUUCUCCUCCUCCU | 20 | 12494 |
| SCNN1A-8646 | + | AUUCAGAAUUCUCCUCCUCCU | 21 | 12495 |
| SCNN1A-8647 | + | AAUUCAGAAUUCUCCUCCUCCU | 22 | 12496 |
| SCNN1A-8648 | + | GAAUUCAGAAUUCUCCUCCUCCU | 23 | 12497 |
| SCNN1A-8649 | + | AGAAUUCAGAAUUCUCCUCCUCCU | 24 | 12498 |
| SCNN1A-8650 | + | AGGGGCCCAGGUGAAGCU | 18 | 12499 |
| SCNN1A-8651 | + | GAGGGGCCCAGGUGAAGCU | 19 | 12500 |
| SCNN1A-5923 | + | GGAGGGGCCCAGGUGAAGCU | 20 | 9772 |
| SCNN1A-8652 | + | GGGAGGGGCCCAGGUGAAGCU | 21 | 12501 |
| SCNN1A-8653 | + | CGGGAGGGGCCCAGGUGAAGCU | 22 | 12502 |
| SCNN1A-8654 | + | CCGGGAGGGGCCCAGGUGAAGCU | 23 | 12503 |
| SCNN1A-8655 | + | CCCGGGAGGGGCCCAGGUGAAGCU | 24 | 12504 |
| SCNN1A-8656 | + | GAUCCUGAGCCCACAGCU | 18 | 12505 |
| SCNN1A-8657 | + | GGAUCCUGAGCCCACAGCU | 19 | 12506 |
| SCNN1A-5740 | + | AGGAUCCUGAGCCCACAGCU | 20 | 9589 |
| SCNN1A-8658 | + | AAGGAUCCUGAGCCCACAGCU | 21 | 12507 |
| SCNN1A-8659 | + | GAAGGAUCCUGAGCCCACAGCU | 22 | 12508 |
| SCNN1A-8660 | + | AGAAGGAUCCUGAGCCCACAGCU | 23 | 12509 |
| SCNN1A-8661 | + | UAGAAGGAUCCUGAGCCCACAGCU | 24 | 12510 |
| SCNN1A-1741 | + | CAGGGUCAAGGCUGAGCU | 18 | 5590 |
| SCNN1A-1742 | + | UCAGGGUCAAGGCUGAGCU | 19 | 5591 |

TABLE 47D-continued

4th Tier

| gRNA Name | DNA Strand | Targeting Domain | Target Site Length | Seq ID |
|---|---|---|---|---|
| SCNN1A-1743 | + | GUCAGGGUCAAGGCUGAGCU | 20 | 5592 |
| SCNN1A-1744 | + | GGUCAGGGUCAAGGCUGAGCU | 21 | 5593 |
| SCNN1A-1745 | + | GGGUCAGGGUCAAGGCUGAGCU | 22 | 5594 |
| SCNN1A-1746 | + | AGGGUCAGGGUCAAGGCUGAGCU | 23 | 5595 |
| SCNN1A-1747 | + | AAGGGUCAGGGUCAAGGCUGAGCU | 24 | 5596 |
| SCNN1A-8662 | + | GAAGGGGCCAGCCAGGCU | 18 | 12511 |
| SCNN1A-8663 | + | AGAAGGGGCCAGCCAGGCU | 19 | 12512 |
| SCNN1A-8664 | + | GAGAAGGGGCCAGCCAGGCU | 20 | 12513 |
| SCNN1A-8665 | + | GGAGAAGGGGCCAGCCAGGCU | 21 | 12514 |
| SCNN1A-8666 | + | AGGAGAAGGGGCCAGCCAGGCU | 22 | 12515 |
| SCNN1A-8667 | + | AAGGAGAAGGGGCCAGCCAGGCU | 23 | 12516 |
| SCNN1A-8668 | + | CAAGGAGAAGGGGCCAGCCAGGCU | 24 | 12517 |
| SCNN1A-8669 | + | CAGACAGGCAAGGAGGCU | 18 | 12518 |
| SCNN1A-8670 | + | GCAGACAGGCAAGGAGGCU | 19 | 12519 |
| SCNN1A-5742 | + | CGCAGACAGGCAAGGAGGCU | 20 | 9591 |
| SCNN1A-8671 | + | ACGCAGACAGGCAAGGAGGCU | 21 | 12520 |
| SCNN1A-8672 | + | GACGCAGACAGGCAAGGAGGCU | 22 | 12521 |
| SCNN1A-8673 | + | AGACGCAGACAGGCAAGGAGGCU | 23 | 12522 |
| SCNN1A-8674 | + | UAGACGCAGACAGGCAAGGAGGCU | 24 | 12523 |
| SCNN1A-8675 | + | ACAUAAGAGCCAAGGGCU | 18 | 12524 |
| SCNN1A-8676 | + | GACAUAAGAGCCAAGGGCU | 19 | 12525 |
| SCNN1A-5743 | + | AGACAUAAGAGCCAAGGGCU | 20 | 9592 |
| SCNN1A-8677 | + | AAGACAUAAGAGCCAAGGGCU | 21 | 12526 |
| SCNN1A-8678 | + | UAAGACAUAAGAGCCAAGGGCU | 22 | 12527 |
| SCNN1A-8679 | + | AUAAGACAUAAGAGCCAAGGGCU | 23 | 12528 |
| SCNN1A-8680 | + | GAUAAGACAUAAGAGCCAAGGGCU | 24 | 12529 |
| SCNN1A-8681 | + | AGGGCGGGGGAGGGGCU | 18 | 12530 |
| SCNN1A-8682 | + | CAGGGCGGGGGAGGGGCU | 19 | 12531 |
| SCNN1A-8683 | + | GCAGGGCGGGGGAGGGGCU | 20 | 12532 |
| SCNN1A-8684 | + | AGCAGGGCGGGGGAGGGGCU | 21 | 12533 |
| SCNN1A-8685 | + | GAGCAGGGCGGGGGAGGGGCU | 22 | 12534 |
| SCNN1A-8686 | + | UGAGCAGGGCGGGGGAGGGGCU | 23 | 12535 |
| SCNN1A-8687 | + | GUGAGCAGGGCGGGGGAGGGGCU | 24 | 12536 |
| SCNN1A-8688 | + | AGGUGCAGCGGCCUGGCU | 18 | 12537 |
| SCNN1A-8689 | + | CAGGUGCAGCGGCCUGGCU | 19 | 12538 |
| SCNN1A-5744 | + | ACAGGUGCAGCGGCCUGGCU | 20 | 9593 |
| SCNN1A-8690 | + | GACAGGUGCAGCGGCCUGGCU | 21 | 12539 |

TABLE 47D-continued

4th Tier

| gRNA Name | DNA Strand | Targeting Domain | Target Site Length | Seq ID |
|---|---|---|---|---|
| SCNN1A-8691 | + | UGACAGGUGCAGCGGCCUGGCU | 22 | 12540 |
| SCNN1A-8692 | + | CUGACAGGUGCAGCGGCCUGGCU | 23 | 12541 |
| SCNN1A-8693 | + | CCUGACAGGUGCAGCGGCCUGGCU | 24 | 12542 |
| SCNN1A-8694 | + | UUUCAUAUCAAGGGCUCU | 18 | 12543 |
| SCNN1A-8695 | + | UUUUCAUAUCAAGGGCUCU | 19 | 12544 |
| SCNN1A-8696 | + | GUUUUCAUAUCAAGGGCUCU | 20 | 12545 |
| SCNN1A-8697 | + | AGUUUUCAUAUCAAGGGCUCU | 21 | 12546 |
| SCNN1A-8698 | + | UAGUUUUCAUAUCAAGGGCUCU | 22 | 12547 |
| SCNN1A-8699 | + | AUAGUUUUCAUAUCAAGGGCUCU | 23 | 12548 |
| SCNN1A-8700 | + | AAUAGUUUUCAUAUCAAGGGCUCU | 24 | 12549 |
| SCNN1A-8701 | + | GGUUAUCUCCUUGGCUCU | 18 | 12550 |
| SCNN1A-8702 | + | GGGUUAUCUCCUUGGCUCU | 19 | 12551 |
| SCNN1A-8703 | + | UGGGUUAUCUCCUUGGCUCU | 20 | 12552 |
| SCNN1A-8704 | + | CUGGGUUAUCUCCUUGGCUCU | 21 | 12553 |
| SCNN1A-8705 | + | GCUGGGUUAUCUCCUUGGCUCU | 22 | 12554 |
| SCNN1A-8706 | + | UGCUGGGUUAUCUCCUUGGCUCU | 23 | 12555 |
| SCNN1A-8707 | + | GUGCUGGGUUAUCUCCUUGGCUCU | 24 | 12556 |
| SCNN1A-8708 | + | UGCAGAUCUCAGAUUUCU | 18 | 12557 |
| SCNN1A-8709 | + | GUGCAGAUCUCAGAUUUCU | 19 | 12558 |
| SCNN1A-8710 | + | AGUGCAGAUCUCAGAUUUCU | 20 | 12559 |
| SCNN1A-8711 | + | AAGUGCAGAUCUCAGAUUUCU | 21 | 12560 |
| SCNN1A-8712 | + | AAAGUGCAGAUCUCAGAUUUCU | 22 | 12561 |
| SCNN1A-8713 | + | AAAAGUGCAGAUCUCAGAUUUCU | 23 | 12562 |
| SCNN1A-8714 | + | CAAAAGUGCAGAUCUCAGAUUUCU | 24 | 12563 |
| SCNN1A-8715 | + | CCUCCCCGCUCACUAAGU | 18 | 12564 |
| SCNN1A-8716 | + | UCCUCCCCGCUCACUAAGU | 19 | 12565 |
| SCNN1A-5752 | + | CUCCUCCCCGCUCACUAAGU | 20 | 9601 |
| SCNN1A-8717 | + | UCUCCUCCCCGCUCACUAAGU | 21 | 12566 |
| SCNN1A-8718 | + | GUCUCCUCCCCGCUCACUAAGU | 22 | 12567 |
| SCNN1A-8719 | + | GGUCUCCUCCCCGCUCACUAAGU | 23 | 12568 |
| SCNN1A-8720 | + | AGGUCUCCUCCCCGCUCACUAAGU | 24 | 12569 |
| SCNN1A-8721 | + | GAGGGGCUGAGGAGGAGU | 18 | 12570 |
| SCNN1A-8722 | + | GGAGGGGCUGAGGAGGAGU | 19 | 12571 |
| SCNN1A-8723 | + | GGGAGGGGCUGAGGAGGAGU | 20 | 12572 |
| SCNN1A-8724 | + | GGGGAGGGGCUGAGGAGGAGU | 21 | 12573 |
| SCNN1A-8725 | + | GGGGGAGGGGCUGAGGAGGAGU | 22 | 12574 |
| SCNN1A-8726 | + | GGGGGGAGGGGCUGAGGAGGAGU | 23 | 12575 |
| SCNN1A-8727 | + | CGGGGGGAGGGGCUGAGGAGGAGU | 24 | 12576 |

TABLE 47D-continued

4th Tier

| gRNA Name | DNA Strand | Targeting Domain | Target Site Length | Seq ID |
|---|---|---|---|---|
| SCNN1A-8728 | + | CAGCAGACCUGCGGGAGU | 18 | 12577 |
| SCNN1A-8729 | + | CCAGCAGACCUGCGGGAGU | 19 | 12578 |
| SCNN1A-5278 | + | GCCAGCAGACCUGCGGGAGU | 20 | 9127 |
| SCNN1A-8730 | + | AGCCAGCAGACCUGCGGGAGU | 21 | 12579 |
| SCNN1A-8731 | + | GAGCCAGCAGACCUGCGGGAGU | 22 | 12580 |
| SCNN1A-8732 | + | GGAGCCAGCAGACCUGCGGGAGU | 23 | 12581 |
| SCNN1A-8733 | + | UGGAGCCAGCAGACCUGCGGGAGU | 24 | 12582 |
| SCNN1A-8734 | + | GAGUGAGUAGAGGCAGGU | 18 | 12583 |
| SCNN1A-8735 | + | UGAGUGAGUAGAGGCAGGU | 19 | 12584 |
| SCNN1A-5756 | + | CUGAGUGAGUAGAGGCAGGU | 20 | 9605 |
| SCNN1A-8736 | + | ACUGAGUGAGUAGAGGCAGGU | 21 | 12585 |
| SCNN1A-8737 | + | CACUGAGUGAGUAGAGGCAGGU | 22 | 12586 |
| SCNN1A-8738 | + | GCACUGAGUGAGUAGAGGCAGGU | 23 | 12587 |
| SCNN1A-8739 | + | GGCACUGAGUGAGUAGAGGCAGGU | 24 | 12588 |
| SCNN1A-8740 | + | GGGGACAGGAUGGCAGGU | 18 | 12589 |
| SCNN1A-8741 | + | GGGGGACAGGAUGGCAGGU | 19 | 12590 |
| SCNN1A-8742 | + | UGGGGGACAGGAUGGCAGGU | 20 | 12591 |
| SCNN1A-8743 | + | CUGGGGGACAGGAUGGCAGGU | 21 | 12592 |
| SCNN1A-8744 | + | GCUGGGGGACAGGAUGGCAGGU | 22 | 12593 |
| SCNN1A-8745 | + | GGCUGGGGGACAGGAUGGCAGGU | 23 | 12594 |
| SCNN1A-8746 | + | AGGCUGGGGGACAGGAUGGCAGGU | 24 | 12595 |
| SCNN1A-8747 | + | UGCAGGGCUCCAGGAGGU | 18 | 12596 |
| SCNN1A-8748 | + | CUGCAGGGCUCCAGGAGGU | 19 | 12597 |
| SCNN1A-8749 | + | ACUGCAGGGCUCCAGGAGGU | 20 | 12598 |
| SCNN1A-8750 | + | GACUGCAGGGCUCCAGGAGGU | 21 | 12599 |
| SCNN1A-8751 | + | GGACUGCAGGGCUCCAGGAGGU | 22 | 12600 |
| SCNN1A-8752 | + | AGGACUGCAGGGCUCCAGGAGGU | 23 | 12601 |
| SCNN1A-8753 | + | CAGGACUGCAGGGCUCCAGGAGGU | 24 | 12602 |
| SCNN1A-8754 | + | AAAUCAGUUUCUGAGGU | 18 | 12603 |
| SCNN1A-8755 | + | UAAAUCAGUUUCUGAGGU | 19 | 12604 |
| SCNN1A-8756 | + | AUAAAUCAGUUUCUGAGGU | 20 | 12605 |
| SCNN1A-8757 | + | GAUAAAUCAGUUUCUGAGGU | 21 | 12606 |
| SCNN1A-8758 | + | GGAUAAAUCAGUUUCUGAGGU | 22 | 12607 |
| SCNN1A-8759 | + | AGGAUAAAUCAGUUUCUGAGGU | 23 | 12608 |
| SCNN1A-8760 | + | AAGGAUAAAUCAGUUUCUGAGGU | 24 | 12609 |
| SCNN1A-8761 | + | AAGGAGAGAGGAGGGU | 18 | 12610 |
| SCNN1A-8762 | + | CAAGGAGAGAGAGGAGGGU | 19 | 12611 |

TABLE 47D-continued

4th Tier

| gRNA Name | DNA Strand | Targeting Domain | Target Site Length | Seq ID |
|---|---|---|---|---|
| SCNN1A-8763 | + | GCAAGGAGAGAGAGGAGGGU | 20 | 12612 |
| SCNN1A-8764 | + | AGCAAGGAGAGAGAGGAGGGU | 21 | 12613 |
| SCNN1A-8765 | + | GAGCAAGGAGAGAGAGGAGGGU | 22 | 12614 |
| SCNN1A-8766 | + | UGAGCAAGGAGAGAGAGGAGGGU | 23 | 12615 |
| SCNN1A-8767 | + | GUGAGCAAGGAGAGAGAGGAGGGU | 24 | 12616 |
| SCNN1A-8768 | + | GGCUGAGAGGGCCUGGGU | 18 | 12617 |
| SCNN1A-8769 | + | AGGCUGAGAGGGCCUGGGU | 19 | 12618 |
| SCNN1A-6188 | + | CAGGCUGAGAGGGCCUGGGU | 20 | 10037 |
| SCNN1A-8770 | + | CCAGGCUGAGAGGGCCUGGGU | 21 | 12619 |
| SCNN1A-8771 | + | GCCAGGCUGAGAGGGCCUGGGU | 22 | 12620 |
| SCNN1A-8772 | + | AGCCAGGCUGAGAGGGCCUGGGU | 23 | 12621 |
| SCNN1A-8773 | + | CAGCCAGGCUGAGAGGGCCUGGGU | 24 | 12622 |
| SCNN1A-1772 | + | CCCUCCAUGAGACCUGGU | 18 | 5621 |
| SCNN1A-1773 | + | CCCCUCCAUGAGACCUGGU | 19 | 5622 |
| SCNN1A-199 | + | UCCCCUCCAUGAGACCUGGU | 20 | 828 |
| SCNN1A-1774 | + | UUCCCCUCCAUGAGACCUGGU | 21 | 5623 |
| SCNN1A-1775 | + | GUUCCCCUCCAUGAGACCUGGU | 22 | 5624 |
| SCNN1A-1776 | + | UGUUCCCCUCCAUGAGACCUGGU | 23 | 5625 |
| SCNN1A-1777 | + | UUGUUCCCCUCCAUGAGACCUGGU | 24 | 5626 |
| SCNN1A-8774 | + | CAGGUGGGGGCAGUGGU | 18 | 12623 |
| SCNN1A-8775 | + | GCAGGUGGGGGCAGUGGU | 19 | 12624 |
| SCNN1A-5928 | + | GGCAGGUGGGGGCAGUGGU | 20 | 9777 |
| SCNN1A-8776 | + | AGGCAGGUGGGGGCAGUGGU | 21 | 12625 |
| SCNN1A-8777 | + | GAGGCAGGUGGGGGCAGUGGU | 22 | 12626 |
| SCNN1A-8778 | + | AGAGGCAGGUGGGGGCAGUGGU | 23 | 12627 |
| SCNN1A-8779 | + | UAGAGGCAGGUGGGGGCAGUGGU | 24 | 12628 |
| SCNN1A-8780 | + | UCAUAUCAAGGGCUCUGU | 18 | 12629 |
| SCNN1A-8781 | + | UUCAUAUCAAGGGCUCUGU | 19 | 12630 |
| SCNN1A-8782 | + | UUUCAUAUCAAGGGCUCUGU | 20 | 12631 |
| SCNN1A-8783 | + | UUUUCAUAUCAAGGGCUCUGU | 21 | 12632 |
| SCNN1A-8784 | + | GUUUUCAUAUCAAGGGCUCUGU | 22 | 12633 |
| SCNN1A-8785 | + | AGUUUUCAUAUCAAGGGCUCUGU | 23 | 12634 |
| SCNN1A-8786 | + | UAGUUUUCAUAUCAAGGGCUCUGU | 24 | 12635 |
| SCNN1A-1778 | + | UGAGCCCCGGAGUGGAUU | 18 | 5627 |
| SCNN1A-1779 | + | AUGAGCCCCGGAGUGGAUU | 19 | 5628 |
| SCNN1A-425 | + | CAUGAGCCCCGGAGUGGAUU | 20 | 4274 |
| SCNN1A-1780 | + | UCAUGAGCCCCGGAGUGGAUU | 21 | 5629 |
| SCNN1A-1781 | + | UUCAUGAGCCCCGGAGUGGAUU | 22 | 5630 |

TABLE 47D-continued

| | 4th Tier | | | |
|---|---|---|---|---|
| gRNA Name | DNA Strand | Targeting Domain | Target Site Length | Seq ID |
| SCNN1A-1782 | + | CUUCAUGAGCCCCGGAGUGGAUU | 23 | 5631 |
| SCNN1A-1783 | + | CCUUCAUGAGCCCCGGAGUGGAUU | 24 | 5632 |
| SCNN1A-8787 | + | UGUUUGAUCUCAAAGGUU | 18 | 12636 |
| SCNN1A-8788 | + | CUGUUUGAUCUCAAAGGUU | 19 | 12637 |
| SCNN1A-8789 | + | GCUGUUUGAUCUCAAAGGUU | 20 | 12638 |
| SCNN1A-8790 | + | GGCUGUUUGAUCUCAAAGGUU | 21 | 12639 |
| SCNN1A-8791 | + | UGGCUGUUUGAUCUCAAAGGUU | 22 | 12640 |
| SCNN1A-8792 | + | CUGGCUGUUUGAUCUCAAAGGUU | 23 | 12641 |
| SCNN1A-8793 | + | CCUGGCUGUUUGAUCUCAAAGGUU | 24 | 12642 |
| SCNN1A-8794 | + | CAAGGAUAAAUCAGUUUU | 18 | 12643 |
| SCNN1A-8795 | + | CCAAGGAUAAAUCAGUUUU | 19 | 12644 |
| SCNN1A-8796 | + | CCCAAGGAUAAAUCAGUUUU | 20 | 12645 |
| SCNN1A-8797 | + | UCCCAAGGAUAAAUCAGUUUU | 21 | 12646 |
| SCNN1A-8798 | + | UUCCCAAGGAUAAAUCAGUUUU | 22 | 12647 |
| SCNN1A-8799 | + | CUUCCCAAGGAUAAAUCAGUUUU | 23 | 12648 |
| SCNN1A-8800 | + | CCUUCCCAAGGAUAAAUCAGUUUU | 24 | 12649 |
| SCNN1A-8801 | + | GUCAGAGCCGGGAGUUUU | 18 | 12650 |
| SCNN1A-8802 | + | AGUCAGAGCCGGGAGUUUU | 19 | 12651 |
| SCNN1A-8803 | + | GAGUCAGAGCCGGGAGUUUU | 20 | 12652 |
| SCNN1A-8804 | + | GGAGUCAGAGCCGGGAGUUUU | 21 | 12653 |
| SCNN1A-8805 | + | AGGAGUCAGAGCCGGGAGUUUU | 22 | 12654 |
| SCNN1A-8806 | + | GAGGAGUCAGAGCCGGGAGUUUU | 23 | 12655 |
| SCNN1A-8807 | + | GGAGGAGUCAGAGCCGGGAGUUUU | 24 | 12656 |
| SCNN1A-8808 | − | GCAGCCAACAGUGUAAAA | 18 | 12657 |
| SCNN1A-8809 | − | GGCAGCCAACAGUGUAAAA | 19 | 12658 |
| SCNN1A-8810 | − | UGGCAGCCAACAGUGUAAAA | 20 | 12659 |
| SCNN1A-8811 | − | CUGGCAGCCAACAGUGUAAAA | 21 | 12660 |
| SCNN1A-8812 | − | CCUGGCAGCCAACAGUGUAAAA | 22 | 12661 |
| SCNN1A-8813 | − | GCCUGGCAGCCAACAGUGUAAAA | 23 | 12662 |
| SCNN1A-8814 | − | GGCCUGGCAGCCAACAGUGUAAAA | 24 | 12663 |
| SCNN1A-8815 | − | UCUUUUAAAGUGUACAAA | 18 | 12664 |
| SCNN1A-8816 | − | AUCUUUUAAAGUGUACAAA | 19 | 12665 |
| SCNN1A-8817 | − | AAUCUUUUAAAGUGUACAAA | 20 | 12666 |
| SCNN1A-8818 | − | CAAUCUUUUAAAGUGUACAAA | 21 | 12667 |
| SCNN1A-8819 | − | ACAAUCUUUUAAAGUGUACAAA | 22 | 12668 |
| SCNN1A-8820 | − | GACAAUCUUUUAAAGUGUACAAA | 23 | 12669 |
| SCNN1A-8821 | − | AGACAAUCUUUUAAAGUGUACAAA | 24 | 12670 |

TABLE 47D-continued

4th Tier

| gRNA Name | DNA Strand | Targeting Domain | Target Site Length | Seq ID |
|---|---|---|---|---|
| SCNN1A-8822 | - | GAGCAGGAGAGACCCAAA | 18 | 12671 |
| SCNN1A-8823 | - | AGAGCAGGAGAGACCCAAA | 19 | 12672 |
| SCNN1A-8824 | - | GAGAGCAGGAGAGACCCAAA | 20 | 12673 |
| SCNN1A-8825 | - | GGAGAGCAGGAGAGACCCAAA | 21 | 12674 |
| SCNN1A-8826 | - | AGGAGAGCAGGAGAGACCCAAA | 22 | 12675 |
| SCNN1A-8827 | - | GAGGAGAGCAGGAGAGACCCAAA | 23 | 12676 |
| SCNN1A-8828 | - | AGAGGAGAGCAGGAGAGACCCAAA | 24 | 12677 |
| SCNN1A-8829 | - | CAGGCAUGAGCUGGCAAA | 18 | 12678 |
| SCNN1A-8830 | - | UCAGGCAUGAGCUGGCAAA | 19 | 12679 |
| SCNN1A-8831 | - | UUCAGGCAUGAGCUGGCAAA | 20 | 12680 |
| SCNN1A-8832 | - | UUUCAGGCAUGAGCUGGCAAA | 21 | 12681 |
| SCNN1A-8833 | - | AUUUCAGGCAUGAGCUGGCAAA | 22 | 12682 |
| SCNN1A-8834 | - | GAUUUCAGGCAUGAGCUGGCAAA | 23 | 12683 |
| SCNN1A-8835 | - | GGAUUUCAGGCAUGAGCUGGCAAA | 24 | 12684 |
| SCNN1A-8836 | - | AGGGGGCAGAGACAGAAA | 18 | 12685 |
| SCNN1A-8837 | - | AAGGGGGCAGAGACAGAAA | 19 | 12686 |
| SCNN1A-5863 | - | GAAGGGGGCAGAGACAGAAA | 20 | 9712 |
| SCNN1A-8838 | - | GGAAGGGGGCAGAGACAGAAA | 21 | 12687 |
| SCNN1A-8839 | - | AGGAAGGGGGCAGAGACAGAAA | 22 | 12688 |
| SCNN1A-8840 | - | AAGGAAGGGGGCAGAGACAGAAA | 23 | 12689 |
| SCNN1A-8841 | - | AAAGGAAGGGGGCAGAGACAGAAA | 24 | 12690 |
| SCNN1A-8842 | - | GAGGAGGCAGGCCAGAAA | 18 | 12691 |
| SCNN1A-8843 | - | AGAGGAGGCAGGCCAGAAA | 19 | 12692 |
| SCNN1A-8844 | - | GAGAGGAGGCAGGCCAGAAA | 20 | 12693 |
| SCNN1A-8845 | - | AGAGAGGAGGCAGGCCAGAAA | 21 | 12694 |
| SCNN1A-8846 | - | GAGAGAGGAGGCAGGCCAGAAA | 22 | 12695 |
| SCNN1A-8847 | - | AGAGAGAGGAGGCAGGCCAGAAA | 23 | 12696 |
| SCNN1A-8848 | - | UAGAGAGAGGAGGCAGGCCAGAAA | 24 | 12697 |
| SCNN1A-8849 | - | GAGAGACCCAAAGAGAAA | 18 | 12698 |
| SCNN1A-8850 | - | GGAGAGACCCAAAGAGAAA | 19 | 12699 |
| SCNN1A-8851 | - | AGGAGAGACCCAAAGAGAAA | 20 | 12700 |
| SCNN1A-8852 | - | CAGGAGAGACCCAAAGAGAAA | 21 | 12701 |
| SCNN1A-8853 | - | GCAGGAGAGACCCAAAGAGAAA | 22 | 12702 |
| SCNN1A-8854 | - | AGCAGGAGAGACCCAAAGAGAAA | 23 | 12703 |
| SCNN1A-8855 | - | GAGCAGGAGAGACCCAAAGAGAAA | 24 | 12704 |
| SCNN1A-8856 | - | CGAGGAAUCAGCAGGAAA | 18 | 12705 |
| SCNN1A-8857 | - | GCGAGGAAUCAGCAGGAAA | 19 | 12706 |
| SCNN1A-8858 | - | GGCGAGGAAUCAGCAGGAAA | 20 | 12707 |

TABLE 47D-continued

4th Tier

| gRNA Name | DNA Strand | Targeting Domain | Target Site Length | Seq ID |
|---|---|---|---|---|
| SCNN1A-8859 | - | UGGCGAGGAAUCAGCAGGAAA | 21 | 12708 |
| SCNN1A-8860 | - | GUGGCGAGGAAUCAGCAGGAAA | 22 | 12709 |
| SCNN1A-8861 | - | GGUGGCGAGGAAUCAGCAGGAAA | 23 | 12710 |
| SCNN1A-8862 | - | GGGUGGCGAGGAAUCAGCAGGAAA | 24 | 12711 |
| SCNN1A-8863 | - | CUGGAGGAAGAAGACCAA | 18 | 12712 |
| SCNN1A-8864 | - | CCUGGAGGAAGAAGACCAA | 19 | 12713 |
| SCNN1A-5519 | - | UCCUGGAGGAAGAAGACCAA | 20 | 9368 |
| SCNN1A-8865 | - | AUCCUGGAGGAAGAAGACCAA | 21 | 12714 |
| SCNN1A-8866 | - | GAUCCUGGAGGAAGAAGACCAA | 22 | 12715 |
| SCNN1A-8867 | - | AGAUCCUGGAGGAAGAAGACCAA | 23 | 12716 |
| SCNN1A-8868 | - | CAGAUCCUGGAGGAAGAAGACCAA | 24 | 12717 |
| SCNN1A-8869 | - | UCCAGCUGUCCCUUCCAA | 18 | 12718 |
| SCNN1A-8870 | - | AUCCAGCUGUCCCUUCCAA | 19 | 12719 |
| SCNN1A-5521 | - | AAUCCAGCUGUCCCUUCCAA | 20 | 9370 |
| SCNN1A-8871 | - | AAAUCCAGCUGUCCCUUCCAA | 21 | 12720 |
| SCNN1A-8872 | - | AAAAUCCAGCUGUCCCUUCCAA | 22 | 12721 |
| SCNN1A-8873 | - | AAAAAUCCAGCUGUCCCUUCCAA | 23 | 12722 |
| SCNN1A-8874 | - | GAAAAAUCCAGCUGUCCCUUCCAA | 24 | 12723 |
| SCNN1A-1790 | - | CAGUAUCAAGGUAAGCAA | 18 | 5639 |
| SCNN1A-1791 | - | GCAGUAUCAAGGUAAGCAA | 19 | 5640 |
| SCNN1A-393 | - | AGCAGUAUCAAGGUAAGCAA | 20 | 4242 |
| SCNN1A-1792 | - | GAGCAGUAUCAAGGUAAGCAA | 21 | 5641 |
| SCNN1A-1793 | - | UGAGCAGUAUCAAGGUAAGCAA | 22 | 5642 |
| SCNN1A-1794 | - | AUGAGCAGUAUCAAGGUAAGCAA | 23 | 5643 |
| SCNN1A-1795 | - | CAUGAGCAGUAUCAAGGUAAGCAA | 24 | 5644 |
| SCNN1A-8875 | - | CGCAAGAGACUGCCGCAA | 18 | 12724 |
| SCNN1A-8876 | - | UCGCAAGAGACUGCCGCAA | 19 | 12725 |
| SCNN1A-8877 | - | GUCGCAAGAGACUGCCGCAA | 20 | 12726 |
| SCNN1A-8878 | - | AGUCGCAAGAGACUGCCGCAA | 21 | 12727 |
| SCNN1A-8879 | - | AAGUCGCAAGAGACUGCCGCAA | 22 | 12728 |
| SCNN1A-8880 | - | GAAGUCGCAAGAGACUGCCGCAA | 23 | 12729 |
| SCNN1A-8881 | - | AGAAGUCGCAAGAGACUGCCGCAA | 24 | 12730 |
| SCNN1A-8882 | - | UGAGAGGGGCAAGGCAA | 18 | 12731 |
| SCNN1A-8883 | - | GUGAGAGGGGCAAGGCAA | 19 | 12732 |
| SCNN1A-6079 | - | AGUGAGAGGGGCAAGGCAA | 20 | 9928 |
| SCNN1A-8884 | - | GAGUGAGAGGGGCAAGGCAA | 21 | 12733 |
| SCNN1A-8885 | - | AGAGUGAGAGGGGCAAGGCAA | 22 | 12734 |

TABLE 47D-continued

4th Tier

| gRNA Name | DNA Strand | Targeting Domain | Target Site Length | Seq ID |
|---|---|---|---|---|
| SCNN1A-8886 | - | UAGAGUGAGAGGGGGCAAGGCAA | 23 | 12735 |
| SCNN1A-8887 | - | CUAGAGUGAGAGGGGGCAAGGCAA | 24 | 12736 |
| SCNN1A-8888 | - | UGUAAGGACCUGGCUCAA | 18 | 12737 |
| SCNN1A-8889 | - | AUGUAAGGACCUGGCUCAA | 19 | 12738 |
| SCNN1A-5522 | - | AAUGUAAGGACCUGGCUCAA | 20 | 9371 |
| SCNN1A-8890 | - | CAAUGUAAGGACCUGGCUCAA | 21 | 12739 |
| SCNN1A-8891 | - | CCAAUGUAAGGACCUGGCUCAA | 22 | 12740 |
| SCNN1A-8892 | - | CCCAAUGUAAGGACCUGGCUCAA | 23 | 12741 |
| SCNN1A-8893 | - | GCCCAAUGUAAGGACCUGGCUCAA | 24 | 12742 |
| SCNN1A-8894 | - | UUUGGCUGCCAGAUUCAA | 18 | 12743 |
| SCNN1A-8895 | - | GUUUGGCUGCCAGAUUCAA | 19 | 12744 |
| SCNN1A-8896 | - | GGUUUGGCUGCCAGAUUCAA | 20 | 12745 |
| SCNN1A-8897 | - | AGGUUUGGCUGCCAGAUUCAA | 21 | 12746 |
| SCNN1A-8898 | - | GAGGUUUGGCUGCCAGAUUCAA | 22 | 12747 |
| SCNN1A-8899 | - | AGAGGUUUGGCUGCCAGAUUCAA | 23 | 12748 |
| SCNN1A-8900 | - | GAGAGGUUUGGCUGCCAGAUUCAA | 24 | 12749 |
| SCNN1A-8901 | - | AAGGGGGCAGAGACAGAA | 18 | 12750 |
| SCNN1A-8902 | - | GAAGGGGGCAGAGACAGAA | 19 | 12751 |
| SCNN1A-5864 | - | GGAAGGGGGCAGAGACAGAA | 20 | 9713 |
| SCNN1A-8903 | - | AGGAAGGGGGCAGAGACAGAA | 21 | 12752 |
| SCNN1A-8904 | - | AAGGAAGGGGGCAGAGACAGAA | 22 | 12753 |
| SCNN1A-8905 | - | AAAGGAAGGGGGCAGAGACAGAA | 23 | 12754 |
| SCNN1A-8906 | - | CAAAGGAAGGGGGCAGAGACAGAA | 24 | 12755 |
| SCNN1A-8907 | - | GGAAGAAGACCAAAGGAA | 18 | 12756 |
| SCNN1A-8908 | - | AGGAAGAAGACCAAAGGAA | 19 | 12757 |
| SCNN1A-5865 | - | GAGGAAGAAGACCAAAGGAA | 20 | 9714 |
| SCNN1A-8909 | - | GGAGGAAGAAGACCAAAGGAA | 21 | 12758 |
| SCNN1A-8910 | - | UGGAGGAAGAAGACCAAAGGAA | 22 | 12759 |
| SCNN1A-8911 | - | CUGGAGGAAGAAGACCAAAGGAA | 23 | 12760 |
| SCNN1A-8912 | - | CCUGGAGGAAGAAGACCAAAGGAA | 24 | 12761 |
| SCNN1A-8913 | - | GCAAGGGGGGAGAGGAA | 18 | 12762 |
| SCNN1A-8914 | - | GGCAAGGGGGGAGAGGAA | 19 | 12763 |
| SCNN1A-8915 | - | AGGCAAGGGGGGAGAGGAA | 20 | 12764 |
| SCNN1A-8916 | - | AAGGCAAGGGGGGAGAGGAA | 21 | 12765 |
| SCNN1A-8917 | - | CAAGGCAAGGGGGGAGAGGAA | 22 | 12766 |
| SCNN1A-8918 | - | GCAAGGCAAGGGGGGAGAGGAA | 23 | 12767 |
| SCNN1A-8919 | - | GGCAAGGCAAGGGGGGAGAGGAA | 24 | 12768 |
| SCNN1A-8920 | - | UGCCAGAUUCAACUGGAA | 18 | 12769 |

TABLE 47D-continued

4th Tier

| gRNA Name | DNA Strand | Targeting Domain | Target Site Length | Seq ID |
|---|---|---|---|---|
| SCNN1A-8921 | - | CUGCCAGAUUCAACUGGAA | 19 | 12770 |
| SCNN1A-5173 | - | GCUGCCAGAUUCAACUGGAA | 20 | 9022 |
| SCNN1A-8922 | - | GGCUGCCAGAUUCAACUGGAA | 21 | 12771 |
| SCNN1A-8923 | - | UGGCUGCCAGAUUCAACUGGAA | 22 | 12772 |
| SCNN1A-8924 | - | UUGGCUGCCAGAUUCAACUGGAA | 23 | 12773 |
| SCNN1A-8925 | - | UUUGGCUGCCAGAUUCAACUGGAA | 24 | 12774 |
| SCNN1A-1802 | - | CACUCCGGGGCUCAUGAA | 18 | 5651 |
| SCNN1A-1803 | - | CCACUCCGGGGCUCAUGAA | 19 | 5652 |
| SCNN1A-451 | - | UCCACUCCGGGGCUCAUGAA | 20 | 4300 |
| SCNN1A-1804 | - | AUCCACUCCGGGGCUCAUGAA | 21 | 5653 |
| SCNN1A-1805 | - | AAUCCACUCCGGGGCUCAUGAA | 22 | 5654 |
| SCNN1A-1806 | - | CAAUCCACUCCGGGGCUCAUGAA | 23 | 5655 |
| SCNN1A-1807 | - | CCAAUCCACUCCGGGGCUCAUGAA | 24 | 5656 |
| SCNN1A-8926 | - | CGCCCUGCUCACCUUUAA | 18 | 12775 |
| SCNN1A-8927 | - | CCGCCCUGCUCACCUUUAA | 19 | 12776 |
| SCNN1A-8928 | - | CCCGCCCUGCUCACCUUUAA | 20 | 12777 |
| SCNN1A-8929 | - | CCCCGCCCUGCUCACCUUUAA | 21 | 12778 |
| SCNN1A-8930 | - | CCCCCGCCCUGCUCACCUUUAA | 22 | 12779 |
| SCNN1A-8931 | - | CCCCCCGCCCUGCUCACCUUUAA | 23 | 12780 |
| SCNN1A-8932 | - | UCCCCCCGCCCUGCUCACCUUUAA | 24 | 12781 |
| SCNN1A-8933 | - | AGUUUCUUCAUUAGGACA | 18 | 12782 |
| SCNN1A-8934 | - | CAGUUUCUUCAUUAGGACA | 19 | 12783 |
| SCNN1A-8935 | - | UCAGUUUCUUCAUUAGGACA | 20 | 12784 |
| SCNN1A-8936 | - | GUCAGUUUCUUCAUUAGGACA | 21 | 12785 |
| SCNN1A-8937 | - | GGUCAGUUUCUUCAUUAGGACA | 22 | 12786 |
| SCNN1A-8938 | - | GGGUCAGUUUCUUCAUUAGGACA | 23 | 12787 |
| SCNN1A-8939 | - | AGGGUCAGUUUCUUCAUUAGGACA | 24 | 12788 |
| SCNN1A-8940 | - | CCUGGAGGAAGAAGACCA | 18 | 12789 |
| SCNN1A-8941 | - | UCCUGGAGGAAGAAGACCA | 19 | 12790 |
| SCNN1A-8942 | - | AUCCUGGAGGAAGAAGACCA | 20 | 12791 |
| SCNN1A-8943 | - | GAUCCUGGAGGAAGAAGACCA | 21 | 12792 |
| SCNN1A-8944 | - | AGAUCCUGGAGGAAGAAGACCA | 22 | 12793 |
| SCNN1A-8945 | - | CAGAUCCUGGAGGAAGAAGACCA | 23 | 12794 |
| SCNN1A-8946 | - | ACAGAUCCUGGAGGAAGAAGACCA | 24 | 12795 |
| SCNN1A-8947 | - | GAGAUAACCCAGCACCCA | 18 | 12796 |
| SCNN1A-8948 | - | GGAGAUAACCCAGCACCCA | 19 | 12797 |
| SCNN1A-8949 | - | AGGAGAUAACCCAGCACCCA | 20 | 12798 |

TABLE 47D-continued

4th Tier

| gRNA Name | DNA Strand | Targeting Domain | Target Site Length | Seq ID |
|---|---|---|---|---|
| SCNN1A-8950 | - | AAGGAGAUAACCCAGCACCCA | 21 | 12799 |
| SCNN1A-8951 | - | CAAGGAGAUAACCCAGCACCCA | 22 | 12800 |
| SCNN1A-8952 | - | CCAAGGAGAUAACCCAGCACCCA | 23 | 12801 |
| SCNN1A-8953 | - | GCCAAGGAGAUAACCCAGCACCCA | 24 | 12802 |
| SCNN1A-8954 | - | GAGAGCAGGAGAGACCCA | 18 | 12803 |
| SCNN1A-8955 | - | GGAGAGCAGGAGAGACCCA | 19 | 12804 |
| SCNN1A-8956 | - | AGGAGAGCAGGAGAGACCCA | 20 | 12805 |
| SCNN1A-8957 | - | GAGGAGAGCAGGAGAGACCCA | 21 | 12806 |
| SCNN1A-8958 | - | AGAGGAGAGCAGGAGAGACCCA | 22 | 12807 |
| SCNN1A-8959 | - | AAGAGGAGAGCAGGAGAGACCCA | 23 | 12808 |
| SCNN1A-8960 | - | AAAGAGGAGAGCAGGAGAGACCCA | 24 | 12809 |
| SCNN1A-8961 | - | GCUAAGUAGAUAGCCCCA | 18 | 12810 |
| SCNN1A-8962 | - | CGCUAAGUAGAUAGCCCCA | 19 | 12811 |
| SCNN1A-8963 | - | GCGCUAAGUAGAUAGCCCCA | 20 | 12812 |
| SCNN1A-8964 | - | AGCGCUAAGUAGAUAGCCCCA | 21 | 12813 |
| SCNN1A-8965 | - | AAGCGCUAAGUAGAUAGCCCCA | 22 | 12814 |
| SCNN1A-8966 | - | AAAGCGCUAAGUAGAUAGCCCCA | 23 | 12815 |
| SCNN1A-8967 | - | AAAAGCGCUAAGUAGAUAGCCCCA | 24 | 12816 |
| SCNN1A-8968 | - | GACCUUUUCACAGAGCCA | 18 | 12817 |
| SCNN1A-8969 | - | AGACCUUUUCACAGAGCCA | 19 | 12818 |
| SCNN1A-5866 | - | GAGACCUUUUCACAGAGCCA | 20 | 9715 |
| SCNN1A-8970 | - | AGAGACCUUUUCACAGAGCCA | 21 | 12819 |
| SCNN1A-8971 | - | CAGAGACCUUUUCACAGAGCCA | 22 | 12820 |
| SCNN1A-8972 | - | GCAGAGACCUUUUCACAGAGCCA | 23 | 12821 |
| SCNN1A-8973 | - | UGCAGAGACCUUUUCACAGAGCCA | 24 | 12822 |
| SCNN1A-8974 | - | UCCAUCCCUGGCCGGCCA | 18 | 12823 |
| SCNN1A-8975 | - | UUCCAUCCCUGGCCGGCCA | 19 | 12824 |
| SCNN1A-8976 | - | CUUCCAUCCCUGGCCGGCCA | 20 | 12825 |
| SCNN1A-8977 | - | GCUUCCAUCCCUGGCCGGCCA | 21 | 12826 |
| SCNN1A-8978 | - | CGCUUCCAUCCCUGGCCGGCCA | 22 | 12827 |
| SCNN1A-8979 | - | UCGCUUCCAUCCCUGGCCGGCCA | 23 | 12828 |
| SCNN1A-8980 | - | GUCGCUUCCAUCCCUGGCCGGCCA | 24 | 12829 |
| SCNN1A-8981 | - | AUCCAGCUGUCCCUUCCA | 18 | 12830 |
| SCNN1A-8982 | - | AAUCCAGCUGUCCCUUCCA | 19 | 12831 |
| SCNN1A-5531 | - | AAAUCCAGCUGUCCCUUCCA | 20 | 9380 |
| SCNN1A-8983 | - | AAAAUCCAGCUGUCCCUUCCA | 21 | 12832 |
| SCNN1A-8984 | - | AAAAAUCCAGCUGUCCCUUCCA | 22 | 12833 |
| SCNN1A-8985 | - | GAAAAAUCCAGCUGUCCCUUCCA | 23 | 12834 |

TABLE 47D-continued

4th Tier

| gRNA Name | DNA Strand | Targeting Domain | Target Site Length | Seq ID |
|---|---|---|---|---|
| SCNN1A-8986 | - | AGAAAAAUCCAGCUGUCCCUUCCA | 24 | 12835 |
| SCNN1A-8987 | - | GGCCCUAUCAGGGAAGCA | 18 | 12836 |
| SCNN1A-8988 | - | UGGCCCUAUCAGGGAAGCA | 19 | 12837 |
| SCNN1A-8989 | - | GUGGCCCUAUCAGGGAAGCA | 20 | 12838 |
| SCNN1A-8990 | - | GGUGGCCCUAUCAGGGAAGCA | 21 | 12839 |
| SCNN1A-8991 | - | AGGUGGCCCUAUCAGGGAAGCA | 22 | 12840 |
| SCNN1A-8992 | - | AAGGUGGCCCUAUCAGGGAAGCA | 23 | 12841 |
| SCNN1A-8993 | - | AAAGGUGGCCCUAUCAGGGAAGCA | 24 | 12842 |
| SCNN1A-1808 | - | GCAGUAUCAAGGUAAGCA | 18 | 5657 |
| SCNN1A-1809 | - | AGCAGUAUCAAGGUAAGCA | 19 | 5658 |
| SCNN1A-342 | - | GAGCAGUAUCAAGGUAAGCA | 20 | 4191 |
| SCNN1A-1810 | - | UGAGCAGUAUCAAGGUAAGCA | 21 | 5659 |
| SCNN1A-1811 | - | AUGAGCAGUAUCAAGGUAAGCA | 22 | 5660 |
| SCNN1A-1812 | - | CAUGAGCAGUAUCAAGGUAAGCA | 23 | 5661 |
| SCNN1A-1813 | - | UCAUGAGCAGUAUCAAGGUAAGCA | 24 | 5662 |
| SCNN1A-8994 | - | UGGCAAAUAGAAAAGGCA | 18 | 12843 |
| SCNN1A-8995 | - | CUGGCAAAUAGAAAAGGCA | 19 | 12844 |
| SCNN1A-5180 | - | GCUGGCAAAUAGAAAAGGCA | 20 | 9029 |
| SCNN1A-8996 | - | AGCUGGCAAAUAGAAAAGGCA | 21 | 12845 |
| SCNN1A-8997 | - | GAGCUGGCAAAUAGAAAAGGCA | 22 | 12846 |
| SCNN1A-8998 | - | UGAGCUGGCAAAUAGAAAAGGCA | 23 | 12847 |
| SCNN1A-8999 | - | AUGAGCUGGCAAAUAGAAAAGGCA | 24 | 12848 |
| SCNN1A-9000 | - | GUGAGAGGGGGCAAGGCA | 18 | 12849 |
| SCNN1A-9001 | - | AGUGAGAGGGGGCAAGGCA | 19 | 12850 |
| SCNN1A-5868 | - | GAGUGAGAGGGGGCAAGGCA | 20 | 9717 |
| SCNN1A-9002 | - | AGAGUGAGAGGGGGCAAGGCA | 21 | 12851 |
| SCNN1A-9003 | - | UAGAGUGAGAGGGGGCAAGGCA | 22 | 12852 |
| SCNN1A-9004 | - | CUAGAGUGAGAGGGGGCAAGGCA | 23 | 12853 |
| SCNN1A-9005 | - | CCUAGAGUGAGAGGGGGCAAGGCA | 24 | 12854 |
| SCNN1A-9006 | - | UCUGGGAUAUGUGGGGCA | 18 | 12855 |
| SCNN1A-9007 | - | CUCUGGGAUAUGUGGGGCA | 19 | 12856 |
| SCNN1A-9008 | - | UCUCUGGGAUAUGUGGGGCA | 20 | 12857 |
| SCNN1A-9009 | - | GUCUCUGGGAUAUGUGGGGCA | 21 | 12858 |
| SCNN1A-9010 | - | GGUCUCUGGGAUAUGUGGGGCA | 22 | 12859 |
| SCNN1A-9011 | - | GGGUCUCUGGGAUAUGUGGGGCA | 23 | 12860 |
| SCNN1A-9012 | - | GGGGUCUCUGGGAUAUGUGGGGCA | 24 | 12861 |
| SCNN1A-9013 | - | CUUCCUGAGUCUCCUGCA | 18 | 12862 |

TABLE 47D-continued

4th Tier

| gRNA Name | DNA Strand | Targeting Domain | Target Site Length | Seq ID |
|---|---|---|---|---|
| SCNN1A-9014 | - | GCUUCCUGAGUCUCCUGCA | 19 | 12863 |
| SCNN1A-9015 | - | GGCUUCCUGAGUCUCCUGCA | 20 | 12864 |
| SCNN1A-9016 | - | AGGCUUCCUGAGUCUCCUGCA | 21 | 12865 |
| SCNN1A-9017 | - | AAGGCUUCCUGAGUCUCCUGCA | 22 | 12866 |
| SCNN1A-9018 | - | GAAGGCUUCCUGAGUCUCCUGCA | 23 | 12867 |
| SCNN1A-9019 | - | GGAAGGCUUCCUGAGUCUCCUGCA | 24 | 12868 |
| SCNN1A-9020 | - | GCUGAGCACCUUAUUGCA | 18 | 12869 |
| SCNN1A-9021 | - | UGCUGAGCACCUUAUUGCA | 19 | 12870 |
| SCNN1A-5184 | - | GUGCUGAGCACCUUAUUGCA | 20 | 9033 |
| SCNN1A-9022 | - | GGUGCUGAGCACCUUAUUGCA | 21 | 12871 |
| SCNN1A-9023 | - | GGGUGCUGAGCACCUUAUUGCA | 22 | 12872 |
| SCNN1A-9024 | - | AGGGUGCUGAGCACCUUAUUGCA | 23 | 12873 |
| SCNN1A-9025 | - | CAGGGUGCUGAGCACCUUAUUGCA | 24 | 12874 |
| SCNN1A-9026 | - | CGAAAGGUGGCCCUAUCA | 18 | 12875 |
| SCNN1A-9027 | - | UCGAAAGGUGGCCCUAUCA | 19 | 12876 |
| SCNN1A-5540 | - | CUCGAAAGGUGGCCCUAUCA | 20 | 9389 |
| SCNN1A-9028 | - | ACUCGAAAGGUGGCCCUAUCA | 21 | 12877 |
| SCNN1A-9029 | - | AACUCGAAAGGUGGCCCUAUCA | 22 | 12878 |
| SCNN1A-9030 | - | AAACUCGAAAGGUGGCCCUAUCA | 23 | 12879 |
| SCNN1A-9031 | - | AAAACUCGAAAGGUGGCCCUAUCA | 24 | 12880 |
| SCNN1A-9032 | - | AUGUAAGGACCUGGCUCA | 18 | 12881 |
| SCNN1A-9033 | - | AAUGUAAGGACCUGGCUCA | 19 | 12882 |
| SCNN1A-5542 | - | CAAUGUAAGGACCUGGCUCA | 20 | 9391 |
| SCNN1A-9034 | - | CCAAUGUAAGGACCUGGCUCA | 21 | 12883 |
| SCNN1A-9035 | - | CCCAAUGUAAGGACCUGGCUCA | 22 | 12884 |
| SCNN1A-9036 | - | GCCCAAUGUAAGGACCUGGCUCA | 23 | 12885 |
| SCNN1A-9037 | - | UGCCCAAUGUAAGGACCUGGCUCA | 24 | 12886 |
| SCNN1A-1814 | - | AGCCCAUACCAGGUCUCA | 18 | 5663 |
| SCNN1A-1815 | - | CAGCCCAUACCAGGUCUCA | 19 | 5664 |
| SCNN1A-1 | - | GCAGCCCAUACCAGGUCUCA | 20 | 503 |
| SCNN1A-1816 | - | UGCAGCCCAUACCAGGUCUCA | 21 | 5665 |
| SCNN1A-1817 | - | CUGCAGCCCAUACCAGGUCUCA | 22 | 5666 |
| SCNN1A-1818 | - | UCUGCAGCCCAUACCAGGUCUCA | 23 | 5667 |
| SCNN1A-1819 | - | CUCUGCAGCCCAUACCAGGUCUCA | 24 | 5668 |
| SCNN1A-9038 | - | GCAUUGCAAUUCUUCUCA | 18 | 12887 |
| SCNN1A-9039 | - | GGCAUUGCAAUUCUUCUCA | 19 | 12888 |
| SCNN1A-9040 | - | AGGCAUUGCAAUUCUUCUCA | 20 | 12889 |
| SCNN1A-9041 | - | CAGGCAUUGCAAUUCUUCUCA | 21 | 12890 |

TABLE 47D-continued

| | | 4th Tier | | |
|---|---|---|---|---|
| gRNA Name | DNA Strand | Targeting Domain | Target Site Length | Seq ID |
| SCNN1A-9042 | - | CCAGGCAUUGCAAUUCUUCUCA | 22 | 12891 |
| SCNN1A-9043 | - | ACCAGGCAUUGCAAUUCUUCUCA | 23 | 12892 |
| SCNN1A-9044 | - | GACCAGGCAUUGCAAUUCUUCUCA | 24 | 12893 |
| SCNN1A-9045 | - | AGUGCAGAGACCUUUUCA | 18 | 12894 |
| SCNN1A-9046 | - | CAGUGCAGAGACCUUUUCA | 19 | 12895 |
| SCNN1A-9047 | - | ACAGUGCAGAGACCUUUUCA | 20 | 12896 |
| SCNN1A-9048 | - | GACAGUGCAGAGACCUUUUCA | 21 | 12897 |
| SCNN1A-9049 | - | GGACAGUGCAGAGACCUUUUCA | 22 | 12898 |
| SCNN1A-9050 | - | GGGACAGUGCAGAGACCUUUUCA | 23 | 12899 |
| SCNN1A-9051 | - | GGGGACAGUGCAGAGACCUUUUCA | 24 | 12900 |
| SCNN1A-9052 | - | CAAGAGACUGCCGCAAGA | 18 | 12901 |
| SCNN1A-9053 | - | GCAAGAGACUGCCGCAAGA | 19 | 12902 |
| SCNN1A-9054 | - | CGCAAGAGACUGCCGCAAGA | 20 | 12903 |
| SCNN1A-9055 | - | UCGCAAGAGACUGCCGCAAGA | 21 | 12904 |
| SCNN1A-9056 | - | GUCGCAAGAGACUGCCGCAAGA | 22 | 12905 |
| SCNN1A-9057 | - | AGUCGCAAGAGACUGCCGCAAGA | 23 | 12906 |
| SCNN1A-9058 | - | AAGUCGCAAGAGACUGCCGCAAGA | 24 | 12907 |
| SCNN1A-9059 | - | GAAGGGGGCAGAGACAGA | 18 | 12908 |
| SCNN1A-9060 | - | GGAAGGGGGCAGAGACAGA | 19 | 12909 |
| SCNN1A-9061 | - | AGGAAGGGGGCAGAGACAGA | 20 | 12910 |
| SCNN1A-9062 | - | AAGGAAGGGGGCAGAGACAGA | 21 | 12911 |
| SCNN1A-9063 | - | AAAGGAAGGGGGCAGAGACAGA | 22 | 12912 |
| SCNN1A-9064 | - | CAAAGGAAGGGGGCAGAGACAGA | 23 | 12913 |
| SCNN1A-9065 | - | CCAAAGGAAGGGGGCAGAGACAGA | 24 | 12914 |
| SCNN1A-9066 | - | GAGAGGAGGCAGGCCAGA | 18 | 12915 |
| SCNN1A-9067 | - | AGAGAGGAGGCAGGCCAGA | 19 | 12916 |
| SCNN1A-9068 | - | GAGAGAGGAGGCAGGCCAGA | 20 | 12917 |
| SCNN1A-9069 | - | AGAGAGAGGAGGCAGGCCAGA | 21 | 12918 |
| SCNN1A-9070 | - | UAGAGAGAGGAGGCAGGCCAGA | 22 | 12919 |
| SCNN1A-9071 | - | UUAGAGAGAGGAGGCAGGCCAGA | 23 | 12920 |
| SCNN1A-9072 | - | AUUAGAGAGAGGAGGCAGGCCAGA | 24 | 12921 |
| SCNN1A-9073 | - | AGAGAAACAGAAGGCAGA | 18 | 12922 |
| SCNN1A-9074 | - | AAGAGAAACAGAAGGCAGA | 19 | 12923 |
| SCNN1A-9075 | - | AAAGAGAAACAGAAGGCAGA | 20 | 12924 |
| SCNN1A-9076 | - | CAAAGAGAAACAGAAGGCAGA | 21 | 12925 |
| SCNN1A-9077 | - | CCAAAGAGAAACAGAAGGCAGA | 22 | 12926 |
| SCNN1A-9078 | - | CCCAAAGAGAAACAGAAGGCAGA | 23 | 12927 |

TABLE 47D-continued

4th Tier

| gRNA Name | DNA Strand | Targeting Domain | Target Site Length | Seq ID |
|---|---|---|---|---|
| SCNN1A-9079 | - | ACCCAAAGAGAAACAGAAGGCAGA | 24 | 12928 |
| SCNN1A-9080 | - | AAAGGAAGGGGCAGAGA | 18 | 12929 |
| SCNN1A-9081 | - | CAAAGGAAGGGGCAGAGA | 19 | 12930 |
| SCNN1A-9082 | - | CCAAAGGAAGGGGCAGAGA | 20 | 12931 |
| SCNN1A-9083 | - | ACCAAAGGAAGGGGCAGAGA | 21 | 12932 |
| SCNN1A-9084 | - | GACCAAAGGAAGGGGCAGAGA | 22 | 12933 |
| SCNN1A-9085 | - | AGACCAAAGGAAGGGGCAGAGA | 23 | 12934 |
| SCNN1A-9086 | - | AAGACCAAAGGAAGGGGCAGAGA | 24 | 12935 |
| SCNN1A-9087 | - | GAGAGGCAGGAUUAGAGA | 18 | 12936 |
| SCNN1A-9088 | - | AGAGAGGCAGGAUUAGAGA | 19 | 12937 |
| SCNN1A-9089 | - | AAGAGAGGCAGGAUUAGAGA | 20 | 12938 |
| SCNN1A-9090 | - | GAAGAGAGGCAGGAUUAGAGA | 21 | 12939 |
| SCNN1A-9091 | - | GGAAGAGAGGCAGGAUUAGAGA | 22 | 12940 |
| SCNN1A-9092 | - | AGGAAGAGAGGCAGGAUUAGAGA | 23 | 12941 |
| SCNN1A-9093 | - | GAGGAAGAGAGGCAGGAUUAGAGA | 24 | 12942 |
| SCNN1A-9094 | - | GACCUGGCUCAAGGGAGA | 18 | 12943 |
| SCNN1A-9095 | - | GGACCUGGCUCAAGGGAGA | 19 | 12944 |
| SCNN1A-9096 | - | AGGACCUGGCUCAAGGGAGA | 20 | 12945 |
| SCNN1A-9097 | - | AAGGACCUGGCUCAAGGGAGA | 21 | 12946 |
| SCNN1A-9098 | - | UAAGGACCUGGCUCAAGGGAGA | 22 | 12947 |
| SCNN1A-9099 | - | GUAAGGACCUGGCUCAAGGGAGA | 23 | 12948 |
| SCNN1A-9100 | - | UGUAAGGACCUGGCUCAAGGGAGA | 24 | 12949 |
| SCNN1A-9101 | - | UGAGGGCCUAGAGUGAGA | 18 | 12950 |
| SCNN1A-9102 | - | CUGAGGGCCUAGAGUGAGA | 19 | 12951 |
| SCNN1A-5188 | - | GCUGAGGGCCUAGAGUGAGA | 20 | 9037 |
| SCNN1A-9103 | - | AGCUGAGGGCCUAGAGUGAGA | 21 | 12952 |
| SCNN1A-9104 | - | GAGCUGAGGGCCUAGAGUGAGA | 22 | 12953 |
| SCNN1A-9105 | - | GGAGCUGAGGGCCUAGAGUGAGA | 23 | 12954 |
| SCNN1A-9106 | - | UGGAGCUGAGGGCCUAGAGUGAGA | 24 | 12955 |
| SCNN1A-9107 | - | AAACAGAAGGCAGAUAGA | 18 | 12956 |
| SCNN1A-9108 | - | GAAACAGAAGGCAGAUAGA | 19 | 12957 |
| SCNN1A-9109 | - | AGAAACAGAAGGCAGAUAGA | 20 | 12958 |
| SCNN1A-9110 | - | GAGAAACAGAAGGCAGAUAGA | 21 | 12959 |
| SCNN1A-9111 | - | AGAGAAACAGAAGGCAGAUAGA | 22 | 12960 |
| SCNN1A-9112 | - | AAGAGAAACAGAAGGCAGAUAGA | 23 | 12961 |
| SCNN1A-9113 | - | AAAGAGAAACAGAAGGCAGAUAGA | 24 | 12962 |
| SCNN1A-9114 | - | UGGAGCUGAGGGCCUAGA | 18 | 12963 |
| SCNN1A-9115 | - | CUGGAGCUGAGGGCCUAGA | 19 | 12964 |

TABLE 47D-continued

4th Tier

| gRNA Name | DNA Strand | Targeting Domain | Target Site Length | Seq ID |
|---|---|---|---|---|
| SCNN1A-9116 | - | GCUGGAGCUGAGGGCCUAGA | 20 | 12965 |
| SCNN1A-9117 | - | GGCUGGAGCUGAGGGCCUAGA | 21 | 12966 |
| SCNN1A-9118 | - | AGGCUGGAGCUGAGGGCCUAGA | 22 | 12967 |
| SCNN1A-9119 | - | GAGGCUGGAGCUGAGGGCCUAGA | 23 | 12968 |
| SCNN1A-9120 | - | AGAGGCUGGAGCUGAGGGCCUAGA | 24 | 12969 |
| SCNN1A-9121 | - | AAGAGAGGCAGGAUUAGA | 18 | 12970 |
| SCNN1A-9122 | - | GAAGAGAGGCAGGAUUAGA | 19 | 12971 |
| SCNN1A-9123 | - | GGAAGAGAGGCAGGAUUAGA | 20 | 12972 |
| SCNN1A-9124 | - | AGGAAGAGAGGCAGGAUUAGA | 21 | 12973 |
| SCNN1A-9125 | - | GAGGAAGAGAGGCAGGAUUAGA | 22 | 12974 |
| SCNN1A-9126 | - | AGAGGAAGAGAGGCAGGAUUAGA | 23 | 12975 |
| SCNN1A-9127 | - | GAGAGGAAGAGAGGCAGGAUUAGA | 24 | 12976 |
| SCNN1A-9128 | - | AGGAAGAAGACCAAAGGA | 18 | 12977 |
| SCNN1A-9129 | - | GAGGAAGAAGACCAAAGGA | 19 | 12978 |
| SCNN1A-5873 | - | GGAGGAAGAAGACCAAAGGA | 20 | 9722 |
| SCNN1A-9130 | - | UGGAGGAAGAAGACCAAAGGA | 21 | 12979 |
| SCNN1A-9131 | - | CUGGAGGAAGAAGACCAAAGGA | 22 | 12980 |
| SCNN1A-9132 | - | CCUGGAGGAAGAAGACCAAAGGA | 23 | 12981 |
| SCNN1A-9133 | - | UCCUGGAGGAAGAAGACCAAAGGA | 24 | 12982 |
| SCNN1A-9134 | - | GGCGAGGAAUCAGCAGGA | 18 | 12983 |
| SCNN1A-9135 | - | UGGCGAGGAAUCAGCAGGA | 19 | 12984 |
| SCNN1A-9136 | - | GUGGCGAGGAAUCAGCAGGA | 20 | 12985 |
| SCNN1A-9137 | - | GGUGGCGAGGAAUCAGCAGGA | 21 | 12986 |
| SCNN1A-9138 | - | GGGUGGCGAGGAAUCAGCAGGA | 22 | 12987 |
| SCNN1A-9139 | - | GGGGUGGCGAGGAAUCAGCAGGA | 23 | 12988 |
| SCNN1A-9140 | - | GGGGGUGGCGAGGAAUCAGCAGGA | 24 | 12989 |
| SCNN1A-9141 | - | UGGAGGAGGGAGGGAGGA | 18 | 12990 |
| SCNN1A-9142 | - | GUGGAGGAGGGAGGGAGGA | 19 | 12991 |
| SCNN1A-9143 | - | GGUGGAGGAGGGAGGGAGGA | 20 | 12992 |
| SCNN1A-9144 | - | AGGUGGAGGAGGGAGGGAGGA | 21 | 12993 |
| SCNN1A-9145 | - | AAGGUGGAGGAGGGAGGGAGGA | 22 | 12994 |
| SCNN1A-9146 | - | AAAGGUGGAGGAGGGAGGGAGGA | 23 | 12995 |
| SCNN1A-9147 | - | GAAAGGUGGAGGAGGGAGGGAGGA | 24 | 12996 |
| SCNN1A-9148 | - | UCCAGGAAAGGUGGAGGA | 18 | 12997 |
| SCNN1A-9149 | - | CUCCAGGAAAGGUGGAGGA | 19 | 12998 |
| SCNN1A-5877 | - | GCUCCAGGAAAGGUGGAGGA | 20 | 9726 |
| SCNN1A-9150 | - | GGCUCCAGGAAAGGUGGAGGA | 21 | 12999 |

TABLE 47D-continued

4th Tier

| gRNA Name | DNA Strand | Targeting Domain | Target Site Length | Seq ID |
|---|---|---|---|---|
| SCNN1A-9151 | - | UGGCUCCAGGAAAGGUGGAGGA | 22 | 13000 |
| SCNN1A-9152 | - | CUGGCUCCAGGAAAGGUGGAGGA | 23 | 13001 |
| SCNN1A-9153 | - | GCUGGCUCCAGGAAAGGUGGAGGA | 24 | 13002 |
| SCNN1A-9154 | - | AAGGCAGAUAGAGAGGGA | 18 | 13003 |
| SCNN1A-9155 | - | GAAGGCAGAUAGAGAGGGA | 19 | 13004 |
| SCNN1A-9156 | - | AGAAGGCAGAUAGAGAGGGA | 20 | 13005 |
| SCNN1A-9157 | - | CAGAAGGCAGAUAGAGAGGGA | 21 | 13006 |
| SCNN1A-9158 | - | ACAGAAGGCAGAUAGAGAGGGA | 22 | 13007 |
| SCNN1A-9159 | - | AACAGAAGGCAGAUAGAGAGGGA | 23 | 13008 |
| SCNN1A-9160 | - | AAACAGAAGGCAGAUAGAGAGGGA | 24 | 13009 |
| SCNN1A-9161 | - | GGAAAGGUGGAGGAGGGA | 18 | 13010 |
| SCNN1A-9162 | - | AGGAAAGGUGGAGGAGGGA | 19 | 13011 |
| SCNN1A-6095 | - | CAGGAAAGGUGGAGGAGGGA | 20 | 9944 |
| SCNN1A-9163 | - | CCAGGAAAGGUGGAGGAGGGA | 21 | 13012 |
| SCNN1A-9164 | - | UCCAGGAAAGGUGGAGGAGGGA | 22 | 13013 |
| SCNN1A-9165 | - | CUCCAGGAAAGGUGGAGGAGGGA | 23 | 13014 |
| SCNN1A-9166 | - | GCUCCAGGAAAGGUGGAGGAGGGA | 24 | 13015 |
| SCNN1A-9167 | - | GGCAAGGCAAGGGGGGA | 18 | 13016 |
| SCNN1A-9168 | - | GGGCAAGGCAAGGGGGGA | 19 | 13017 |
| SCNN1A-9169 | - | GGGGCAAGGCAAGGGGGGA | 20 | 13018 |
| SCNN1A-9170 | - | GGGGGCAAGGCAAGGGGGGA | 21 | 13019 |
| SCNN1A-9171 | - | AGGGGGCAAGGCAAGGGGGGA | 22 | 13020 |
| SCNN1A-9172 | - | GAGGGGGCAAGGCAAGGGGGGA | 23 | 13021 |
| SCNN1A-9173 | - | AGAGGGGGCAAGGCAAGGGGGGA | 24 | 13022 |
| SCNN1A-1820 | - | GUUCCAGGGGUGAUGGGA | 18 | 5669 |
| SCNN1A-1821 | - | GGUUCCAGGGGUGAUGGGA | 19 | 5670 |
| SCNN1A-1822 | - | GGGUUCCAGGGGUGAUGGGA | 20 | 5671 |
| SCNN1A-1823 | - | CGGGUUCCAGGGGUGAUGGGA | 21 | 5672 |
| SCNN1A-1824 | - | UCGGGUUCCAGGGGUGAUGGGA | 22 | 5673 |
| SCNN1A-1825 | - | CUCGGGUUCCAGGGGUGAUGGGA | 23 | 5674 |
| SCNN1A-1826 | - | ACUCGGGUUCCAGGGGUGAUGGGA | 24 | 5675 |
| SCNN1A-9174 | - | UCCAGCCGCAACCUGGGA | 18 | 13023 |
| SCNN1A-9175 | - | GUCCAGCCGCAACCUGGGA | 19 | 13024 |
| SCNN1A-9176 | - | AGUCCAGCCGCAACCUGGGA | 20 | 13025 |
| SCNN1A-9177 | - | CAGUCCAGCCGCAACCUGGGA | 21 | 13026 |
| SCNN1A-9178 | - | CCAGUCCAGCCGCAACCUGGGA | 22 | 13027 |
| SCNN1A-9179 | - | CCCAGUCCAGCCGCAACCUGGGA | 23 | 13028 |
| SCNN1A-9180 | - | UCCCAGUCCAGCCGCAACCUGGGA | 24 | 13029 |

TABLE 47D-continued

| | | 4th Tier | | |
|---|---|---|---|---|
| gRNA Name | DNA Strand | Targeting Domain | Target Site Length | Seq ID |
| SCNN1A-9181 | - | CACGGGCUCUGUGUGGGA | 18 | 13030 |
| SCNN1A-9182 | - | CCACGGGCUCUGUGUGGGA | 19 | 13031 |
| SCNN1A-9183 | - | UCCACGGGCUCUGUGUGGGA | 20 | 13032 |
| SCNN1A-9184 | - | AUCCACGGGCUCUGUGUGGGA | 21 | 13033 |
| SCNN1A-9185 | - | AAUCCACGGGCUCUGUGUGGGA | 22 | 13034 |
| SCNN1A-9186 | - | GAAUCCACGGGCUCUGUGUGGGA | 23 | 13035 |
| SCNN1A-9187 | - | CGAAUCCACGGGCUCUGUGUGGGA | 24 | 13036 |
| SCNN1A-1827 | - | CAUACCAGGUCUCAUGGA | 18 | 5676 |
| SCNN1A-1828 | - | CCAUACCAGGUCUCAUGGA | 19 | 5677 |
| SCNN1A-3 | - | CCCAUACCAGGUCUCAUGGA | 20 | 556 |
| SCNN1A-1829 | - | GCCCAUACCAGGUCUCAUGGA | 21 | 5678 |
| SCNN1A-1830 | - | AGCCCAUACCAGGUCUCAUGGA | 22 | 5679 |
| SCNN1A-1831 | - | CAGCCCAUACCAGGUCUCAUGGA | 23 | 5680 |
| SCNN1A-1832 | - | GCAGCCCAUACCAGGUCUCAUGGA | 24 | 5681 |
| SCNN1A-9188 | - | CUGCCAGAUUCAACUGGA | 18 | 13037 |
| SCNN1A-9189 | - | GCUGCCAGAUUCAACUGGA | 19 | 13038 |
| SCNN1A-9190 | - | GGCUGCCAGAUUCAACUGGA | 20 | 13039 |
| SCNN1A-9191 | - | UGGCUGCCAGAUUCAACUGGA | 21 | 13040 |
| SCNN1A-9192 | - | UUGGCUGCCAGAUUCAACUGGA | 22 | 13041 |
| SCNN1A-9193 | - | UUUGGCUGCCAGAUUCAACUGGA | 23 | 13042 |
| SCNN1A-9194 | - | GUUUGGCUGCCAGAUUCAACUGGA | 24 | 13043 |
| SCNN1A-9195 | - | UGUCUGCUGGCUUGUGGA | 18 | 13044 |
| SCNN1A-9196 | - | UUGUCUGCUGGCUUGUGGA | 19 | 13045 |
| SCNN1A-5552 | - | UUUGUCUGCUGGCUUGUGGA | 20 | 9401 |
| SCNN1A-9197 | - | CUUUGUCUGCUGGCUUGUGGA | 21 | 13046 |
| SCNN1A-9198 | - | CCUUUGUCUGCUGGCUUGUGGA | 22 | 13047 |
| SCNN1A-9199 | - | GCCUUUGUCUGCUGGCUUGUGGA | 23 | 13048 |
| SCNN1A-9200 | - | GGCCUUUGUCUGCUGGCUUGUGGA | 24 | 13049 |
| SCNN1A-9201 | - | UGCUGCAUUAAGUUUGGA | 18 | 13050 |
| SCNN1A-9202 | - | UUGCUGCAUUAAGUUUGGA | 19 | 13051 |
| SCNN1A-9203 | - | UUUGCUGCAUUAAGUUUGGA | 20 | 13052 |
| SCNN1A-9204 | - | UUUUGCUGCAUUAAGUUUGGA | 21 | 13053 |
| SCNN1A-9205 | - | CUUUUGCUGCAUUAAGUUUGGA | 22 | 13054 |
| SCNN1A-9206 | - | CCUUUUGCUGCAUUAAGUUUGGA | 23 | 13055 |
| SCNN1A-9207 | - | UCCUUUUGCUGCAUUAAGUUUGGA | 24 | 13056 |
| SCNN1A-1839 | - | CCACUCCGGGGCUCAUGA | 18 | 5688 |
| SCNN1A-1840 | - | UCCACUCCGGGGCUCAUGA | 19 | 5689 |

TABLE 47D-continued

4th Tier

| gRNA Name | DNA Strand | Targeting Domain | Target Site Length | Seq ID |
|---|---|---|---|---|
| SCNN1A-400 | - | AUCCACUCCGGGGCUCAUGA | 20 | 4249 |
| SCNN1A-1841 | - | AAUCCACUCCGGGGCUCAUGA | 21 | 5690 |
| SCNN1A-1842 | - | CAAUCCACUCCGGGGCUCAUGA | 22 | 5691 |
| SCNN1A-1843 | - | CCAAUCCACUCCGGGGCUCAUGA | 23 | 5692 |
| SCNN1A-1844 | - | CCCAAUCCACUCCGGGGCUCAUGA | 24 | 5693 |
| SCNN1A-9208 | - | GCUGAGGGCCUAGAGUGA | 18 | 13057 |
| SCNN1A-9209 | - | AGCUGAGGGCCUAGAGUGA | 19 | 13058 |
| SCNN1A-9210 | - | GAGCUGAGGGCCUAGAGUGA | 20 | 13059 |
| SCNN1A-9211 | - | GGAGCUGAGGGCCUAGAGUGA | 21 | 13060 |
| SCNN1A-9212 | - | UGGAGCUGAGGGCCUAGAGUGA | 22 | 13061 |
| SCNN1A-9213 | - | CUGGAGCUGAGGGCCUAGAGUGA | 23 | 13062 |
| SCNN1A-9214 | - | GCUGGAGCUGAGGGCCUAGAGUGA | 24 | 13063 |
| SCNN1A-9215 | - | GGCUCUGUGUGGGAGUGA | 18 | 13064 |
| SCNN1A-9216 | - | GGGCUCUGUGUGGGAGUGA | 19 | 13065 |
| SCNN1A-5555 | - | CGGGCUCUGUGUGGGAGUGA | 20 | 9404 |
| SCNN1A-9217 | - | ACGGGCUCUGUGUGGGAGUGA | 21 | 13066 |
| SCNN1A-9218 | - | CACGGGCUCUGUGUGGGAGUGA | 22 | 13067 |
| SCNN1A-9219 | - | CCACGGGCUCUGUGUGGGAGUGA | 23 | 13068 |
| SCNN1A-9220 | - | UCCACGGGCUCUGUGUGGGAGUGA | 24 | 13069 |
| SCNN1A-9221 | - | GCUGCUCCCACUUAGUGA | 18 | 13070 |
| SCNN1A-9222 | - | CGCUGCUCCCACUUAGUGA | 19 | 13071 |
| SCNN1A-9223 | - | GCGCUGCUCCCACUUAGUGA | 20 | 13072 |
| SCNN1A-9224 | - | UGCGCUGCUCCCACUUAGUGA | 21 | 13073 |
| SCNN1A-9225 | - | GUGCGCUGCUCCCACUUAGUGA | 22 | 13074 |
| SCNN1A-9226 | - | AGUGCGCUGCUCCCACUUAGUGA | 23 | 13075 |
| SCNN1A-9227 | - | GAGUGCGCUGCUCCCACUUAGUGA | 24 | 13076 |
| SCNN1A-9228 | - | GCUGCACCUGUCAGGUGA | 18 | 13077 |
| SCNN1A-9229 | - | CGCUGCACCUGUCAGGUGA | 19 | 13078 |
| SCNN1A-5556 | - | CCGCUGCACCUGUCAGGUGA | 20 | 9405 |
| SCNN1A-9230 | - | GCCGCUGCACCUGUCAGGUGA | 21 | 13079 |
| SCNN1A-9231 | - | GGCCGCUGCACCUGUCAGGUGA | 22 | 13080 |
| SCNN1A-9232 | - | AGGCCGCUGCACCUGUCAGGUGA | 23 | 13081 |
| SCNN1A-9233 | - | CAGGCCGCUGCACCUGUCAGGUGA | 24 | 13082 |
| SCNN1A-1845 | - | CUCGGGUUCCAGGGGUGA | 18 | 5694 |
| SCNN1A-1846 | - | ACUCGGGUUCCAGGGGUGA | 19 | 5695 |
| SCNN1A-401 | - | CACUCGGGUUCCAGGGGUGA | 20 | 4250 |
| SCNN1A-1847 | - | UCACUCGGGUUCCAGGGGUGA | 21 | 5696 |
| SCNN1A-1848 | - | CUCACUCGGGUUCCAGGGGUGA | 22 | 5697 |

TABLE 47D-continued

4th Tier

| gRNA Name | DNA Strand | Targeting Domain | Target Site Length | Seq ID |
|---|---|---|---|---|
| SCNN1A-1849 | − | CCUCACUCGGGUUCCAGGGGUGA | 23 | 5698 |
| SCNN1A-1850 | − | GCCUCACUCGGGUUCCAGGGGUGA | 24 | 5699 |
| SCNN1A-9234 | − | AGAAACAGAAGGCAGAUA | 18 | 13083 |
| SCNN1A-9235 | − | GAGAAACAGAAGGCAGAUA | 19 | 13084 |
| SCNN1A-9236 | − | AGAGAAACAGAAGGCAGAUA | 20 | 13085 |
| SCNN1A-9237 | − | AAGAGAAACAGAAGGCAGAUA | 21 | 13086 |
| SCNN1A-9238 | − | AAAGAGAAACAGAAGGCAGAUA | 22 | 13087 |
| SCNN1A-9239 | − | CAAAGAGAAACAGAAGGCAGAUA | 23 | 13088 |
| SCNN1A-9240 | − | CCAAAGAGAAACAGAAGGCAGAUA | 24 | 13089 |
| SCNN1A-9241 | − | CCUUUAAUUGAGAUGCUA | 18 | 13090 |
| SCNN1A-9242 | − | ACCUUUAAUUGAGAUGCUA | 19 | 13091 |
| SCNN1A-9243 | − | CACCUUUAAUUGAGAUGCUA | 20 | 13092 |
| SCNN1A-9244 | − | UCACCUUUAAUUGAGAUGCUA | 21 | 13093 |
| SCNN1A-9245 | − | CUCACCUUUAAUUGAGAUGCUA | 22 | 13094 |
| SCNN1A-9246 | − | GCUCACCUUUAAUUGAGAUGCUA | 23 | 13095 |
| SCNN1A-9247 | − | UGCUCACCUUUAAUUGAGAUGCUA | 24 | 13096 |
| SCNN1A-9248 | − | AGAGGAGAGGCCGUUCUA | 18 | 13097 |
| SCNN1A-9249 | − | CAGAGGAGAGGCCGUUCUA | 19 | 13098 |
| SCNN1A-5199 | − | GCAGAGGAGAGGCCGUUCUA | 20 | 9048 |
| SCNN1A-9250 | − | AGCAGAGGAGAGGCCGUUCUA | 21 | 13099 |
| SCNN1A-9251 | − | AAGCAGAGGAGAGGCCGUUCUA | 22 | 13100 |
| SCNN1A-9252 | − | GAAGCAGAGGAGAGGCCGUUCUA | 23 | 13101 |
| SCNN1A-9253 | − | GGAAGCAGAGGAGAGGCCGUUCUA | 24 | 13102 |
| SCNN1A-9254 | − | GGAAGAGAGGCAGGAUUA | 18 | 13103 |
| SCNN1A-9255 | − | AGGAAGAGAGGCAGGAUUA | 19 | 13104 |
| SCNN1A-9256 | − | GAGGAAGAGAGGCAGGAUUA | 20 | 13105 |
| SCNN1A-9257 | − | AGAGGAAGAGAGGCAGGAUUA | 21 | 13106 |
| SCNN1A-9258 | − | GAGAGGAAGAGAGGCAGGAUUA | 22 | 13107 |
| SCNN1A-9259 | − | GGAGAGGAAGAGAGGCAGGAUUA | 23 | 13108 |
| SCNN1A-9260 | − | GGGAGAGGAAGAGAGGCAGGAUUA | 24 | 13109 |
| SCNN1A-9261 | − | GUGCGCUGCUCCCACUUA | 18 | 13110 |
| SCNN1A-9262 | − | AGUGCGCUGCUCCCACUUA | 19 | 13111 |
| SCNN1A-9263 | − | GAGUGCGCUGCUCCCACUUA | 20 | 13112 |
| SCNN1A-9264 | − | UGAGUGCGCUGCUCCCACUUA | 21 | 13113 |
| SCNN1A-9265 | − | CUGAGUGCGCUGCUCCCACUUA | 22 | 13114 |
| SCNN1A-9266 | − | CCUGAGUGCGCUGCUCCCACUUA | 23 | 13115 |
| SCNN1A-9267 | − | ACCUGAGUGCGCUGCUCCCACUUA | 24 | 13116 |

TABLE 47D-continued

4th Tier

| gRNA Name | DNA Strand | Targeting Domain | Target Site Length | Seq ID |
|---|---|---|---|---|
| SCNN1A-9268 | - | GAGGUGCUAGGACAAAAC | 18 | 13117 |
| SCNN1A-9269 | - | GGAGGUGCUAGGACAAAAC | 19 | 13118 |
| SCNN1A-9270 | - | GGGAGGUGCUAGGACAAAAC | 20 | 13119 |
| SCNN1A-9271 | - | AGGGAGGUGCUAGGACAAAAC | 21 | 13120 |
| SCNN1A-9272 | - | AAGGGAGGUGCUAGGACAAAAC | 22 | 13121 |
| SCNN1A-9273 | - | AAAGGGAGGUGCUAGGACAAAAC | 23 | 13122 |
| SCNN1A-9274 | - | GAAAGGGAGGUGCUAGGACAAAAC | 24 | 13123 |
| SCNN1A-9275 | - | UCCCAGUCCAGCCGCAAC | 18 | 13124 |
| SCNN1A-9276 | - | GUCCCAGUCCAGCCGCAAC | 19 | 13125 |
| SCNN1A-9277 | - | AGUCCCAGUCCAGCCGCAAC | 20 | 13126 |
| SCNN1A-9278 | - | CAGUCCCAGUCCAGCCGCAAC | 21 | 13127 |
| SCNN1A-9279 | - | CCAGUCCCAGUCCAGCCGCAAC | 22 | 13128 |
| SCNN1A-9280 | - | ACCAGUCCCAGUCCAGCCGCAAC | 23 | 13129 |
| SCNN1A-9281 | - | AACCAGUCCCAGUCCAGCCGCAAC | 24 | 13130 |
| SCNN1A-9282 | - | UUGGCUGCCAGAUUCAAC | 18 | 13131 |
| SCNN1A-9283 | - | UUUGGCUGCCAGAUUCAAC | 19 | 13132 |
| SCNN1A-5202 | - | GUUUGGCUGCCAGAUUCAAC | 20 | 9051 |
| SCNN1A-9284 | - | GGUUUGGCUGCCAGAUUCAAC | 21 | 13133 |
| SCNN1A-9285 | - | AGGUUUGGCUGCCAGAUUCAAC | 22 | 13134 |
| SCNN1A-9286 | - | GAGGUUUGGCUGCCAGAUUCAAC | 23 | 13135 |
| SCNN1A-9287 | - | AGAGGUUUGGCUGCCAGAUUCAAC | 24 | 13136 |
| SCNN1A-9288 | - | UAGCUCCUGGAAGCACAC | 18 | 13137 |
| SCNN1A-9289 | - | CUAGCUCCUGGAAGCACAC | 19 | 13138 |
| SCNN1A-9290 | - | UCUAGCUCCUGGAAGCACAC | 20 | 13139 |
| SCNN1A-9291 | - | CUCUAGCUCCUGGAAGCACAC | 21 | 13140 |
| SCNN1A-9292 | - | CCUCUAGCUCCUGGAAGCACAC | 22 | 13141 |
| SCNN1A-9293 | - | GCCUCUAGCUCCUGGAAGCACAC | 23 | 13142 |
| SCNN1A-9294 | - | AGCCUCUAGCUCCUGGAAGCACAC | 24 | 13143 |
| SCNN1A-9295 | - | UUUCACAUCCAGGUGCAC | 18 | 13144 |
| SCNN1A-9296 | - | CUUUCACAUCCAGGUGCAC | 19 | 13145 |
| SCNN1A-9297 | - | GCUUUCACAUCCAGGUGCAC | 20 | 13146 |
| SCNN1A-9298 | - | GGCUUUCACAUCCAGGUGCAC | 21 | 13147 |
| SCNN1A-9299 | - | CGGCUUUCACAUCCAGGUGCAC | 22 | 13148 |
| SCNN1A-9300 | - | CCGGCUUUCACAUCCAGGUGCAC | 23 | 13149 |
| SCNN1A-9301 | - | CCCGGCUUUCACAUCCAGGUGCAC | 24 | 13150 |
| SCNN1A-9302 | - | CCUAGCCCCCAGCUUCAC | 18 | 13151 |
| SCNN1A-9303 | - | GCCUAGCCCCCAGCUUCAC | 19 | 13152 |
| SCNN1A-9304 | - | CGCCUAGCCCCCAGCUUCAC | 20 | 13153 |

TABLE 47D-continued

4th Tier

| gRNA Name | DNA Strand | Targeting Domain | Target Site Length | Seq ID |
|---|---|---|---|---|
| SCNN1A-9305 | - | CCGCCUAGCCCCCAGCUUCAC | 21 | 13154 |
| SCNN1A-9306 | - | CCCGCCUAGCCCCCAGCUUCAC | 22 | 13155 |
| SCNN1A-9307 | - | CCCCGCCUAGCCCCCAGCUUCAC | 23 | 13156 |
| SCNN1A-9308 | - | GCCCCGCCUAGCCCCCAGCUUCAC | 24 | 13157 |
| SCNN1A-9309 | - | GCAGGAAAGAGGAGGGAC | 18 | 13158 |
| SCNN1A-9310 | - | AGCAGGAAAGAGGAGGGAC | 19 | 13159 |
| SCNN1A-9311 | - | CAGCAGGAAAGAGGAGGGAC | 20 | 13160 |
| SCNN1A-9312 | - | UCAGCAGGAAAGAGGAGGGAC | 21 | 13161 |
| SCNN1A-9313 | - | AUCAGCAGGAAAGAGGAGGGAC | 22 | 13162 |
| SCNN1A-9314 | - | AAUCAGCAGGAAAGAGGAGGGAC | 23 | 13163 |
| SCNN1A-9315 | - | GAAUCAGCAGGAAAGAGGAGGGAC | 24 | 13164 |
| SCNN1A-1863 | - | GUGGGCGCAGGGUGGGAC | 18 | 5712 |
| SCNN1A-1864 | - | UGUGGGCGCAGGGUGGGAC | 19 | 5713 |
| SCNN1A-1865 | - | AUGUGGGCGCAGGGUGGGAC | 20 | 5714 |
| SCNN1A-1866 | - | AAUGUGGGCGCAGGGUGGGAC | 21 | 5715 |
| SCNN1A-1867 | - | GAAUGUGGGCGCAGGGUGGGAC | 22 | 5716 |
| SCNN1A-1868 | - | AGAAUGUGGGCGCAGGGUGGGAC | 23 | 5717 |
| SCNN1A-1869 | - | GAGAAUGUGGGCGCAGGGUGGGAC | 24 | 5718 |
| SCNN1A-9316 | - | CCCAGUCCAGCCGCAACC | 18 | 13165 |
| SCNN1A-9317 | - | UCCCAGUCCAGCCGCAACC | 19 | 13166 |
| SCNN1A-5213 | - | GUCCCAGUCCAGCCGCAACC | 20 | 9062 |
| SCNN1A-9318 | - | AGUCCCAGUCCAGCCGCAACC | 21 | 13167 |
| SCNN1A-9319 | - | CAGUCCCAGUCCAGCCGCAACC | 22 | 13168 |
| SCNN1A-9320 | - | CCAGUCCCAGUCCAGCCGCAACC | 23 | 13169 |
| SCNN1A-9321 | - | ACCAGUCCCAGUCCAGCCGCAACC | 24 | 13170 |
| SCNN1A-9322 | - | AGGAGAUAACCCAGCACC | 18 | 13171 |
| SCNN1A-9323 | - | AAGGAGAUAACCCAGCACC | 19 | 13172 |
| SCNN1A-9324 | - | CAAGGAGAUAACCCAGCACC | 20 | 13173 |
| SCNN1A-9325 | - | CCAAGGAGAUAACCCAGCACC | 21 | 13174 |
| SCNN1A-9326 | - | GCCAAGGAGAUAACCCAGCACC | 22 | 13175 |
| SCNN1A-9327 | - | AGCCAAGGAGAUAACCCAGCACC | 23 | 13176 |
| SCNN1A-9328 | - | GAGCCAAGGAGAUAACCCAGCACC | 24 | 13177 |
| SCNN1A-9329 | - | CAGGAAAGAGGAGGGACC | 18 | 13178 |
| SCNN1A-9330 | - | GCAGGAAAGAGGAGGGACC | 19 | 13179 |
| SCNN1A-5571 | - | AGCAGGAAAGAGGAGGGACC | 20 | 9420 |
| SCNN1A-9331 | - | CAGCAGGAAAGAGGAGGGACC | 21 | 13180 |
| SCNN1A-9332 | - | UCAGCAGGAAAGAGGAGGGACC | 22 | 13181 |

TABLE 47D-continued

4th Tier

| gRNA Name | DNA Strand | Targeting Domain | Target Site Length | Seq ID |
|---|---|---|---|---|
| SCNN1A-9333 | - | AUCAGCAGGAAAGAGGAGGGACC | 23 | 13182 |
| SCNN1A-9334 | - | AAUCAGCAGGAAAGAGGAGGGACC | 24 | 13183 |
| SCNN1A-9335 | - | CACAGACCAGGUUGGACC | 18 | 13184 |
| SCNN1A-9336 | - | CCACAGACCAGGUUGGACC | 19 | 13185 |
| SCNN1A-9337 | - | GCCACAGACCAGGUUGGACC | 20 | 13186 |
| SCNN1A-9338 | - | AGCCACAGACCAGGUUGGACC | 21 | 13187 |
| SCNN1A-9339 | - | AAGCCACAGACCAGGUUGGACC | 22 | 13188 |
| SCNN1A-9340 | - | GAAGCCACAGACCAGGUUGGACC | 23 | 13189 |
| SCNN1A-9341 | - | GGAAGCCACAGACCAGGUUGGACC | 24 | 13190 |
| SCNN1A-9342 | - | GCGCUAAGUAGAUAGCCC | 18 | 13191 |
| SCNN1A-9343 | - | AGCGCUAAGUAGAUAGCCC | 19 | 13192 |
| SCNN1A-9344 | - | AAGCGCUAAGUAGAUAGCCC | 20 | 13193 |
| SCNN1A-9345 | - | AAAGCGCUAAGUAGAUAGCCC | 21 | 13194 |
| SCNN1A-9346 | - | AAAAGCGCUAAGUAGAUAGCCC | 22 | 13195 |
| SCNN1A-9347 | - | CAAAAGCGCUAAGUAGAUAGCCC | 23 | 13196 |
| SCNN1A-9348 | - | GCAAAAGCGCUAAGUAGAUAGCCC | 24 | 13197 |
| SCNN1A-9349 | - | CUGCCUCCUGUGGGGCCC | 18 | 13198 |
| SCNN1A-9350 | - | GCUGCCUCCUGUGGGGCCC | 19 | 13199 |
| SCNN1A-9351 | - | GGCUGCCUCCUGUGGGGCCC | 20 | 13200 |
| SCNN1A-9352 | - | GGGCUGCCUCCUGUGGGGCCC | 21 | 13201 |
| SCNN1A-9353 | - | UGGGCUGCCUCCUGUGGGGCCC | 22 | 13202 |
| SCNN1A-9354 | - | CUGGGCUGCCUCCUGUGGGGCCC | 23 | 13203 |
| SCNN1A-9355 | - | UCUGGGCUGCCUCCUGUGGGGCCC | 24 | 13204 |
| SCNN1A-9356 | - | CUCCCAGUUCACCUGCCC | 18 | 13205 |
| SCNN1A-9357 | - | ACUCCCAGUUCACCUGCCC | 19 | 13206 |
| SCNN1A-9358 | - | UACUCCCAGUUCACCUGCCC | 20 | 13207 |
| SCNN1A-9359 | - | GUACUCCCAGUUCACCUGCCC | 21 | 13208 |
| SCNN1A-9360 | - | AGUACUCCCAGUUCACCUGCCC | 22 | 13209 |
| SCNN1A-9361 | - | CAGUACUCCCAGUUCACCUGCCC | 23 | 13210 |
| SCNN1A-9362 | - | CCAGUACUCCCAGUUCACCUGCCC | 24 | 13211 |
| SCNN1A-9363 | - | GCUGACCUGUGGGUGCCC | 18 | 13212 |
| SCNN1A-9364 | - | GGCUGACCUGUGGGUGCCC | 19 | 13213 |
| SCNN1A-9365 | - | AGGCUGACCUGUGGGUGCCC | 20 | 13214 |
| SCNN1A-9366 | - | GAGGCUGACCUGUGGGUGCCC | 21 | 13215 |
| SCNN1A-9367 | - | UGAGGCUGACCUGUGGGUGCCC | 22 | 13216 |
| SCNN1A-9368 | - | GUGAGGCUGACCUGUGGGUGCCC | 23 | 13217 |
| SCNN1A-9369 | - | GGUGAGGCUGACCUGUGGGUGCCC | 24 | 13218 |
| SCNN1A-9370 | - | AGACCUUUUCACAGAGCC | 18 | 13219 |

TABLE 47D-continued

4th Tier

| gRNA Name | DNA Strand | Targeting Domain | Target Site Length | Seq ID |
|---|---|---|---|---|
| SCNN1A-9371 | - | GAGACCUUUUCACAGAGCC | 19 | 13220 |
| SCNN1A-9372 | - | AGAGACCUUUUCACAGAGCC | 20 | 13221 |
| SCNN1A-9373 | - | CAGAGACCUUUUCACAGAGCC | 21 | 13222 |
| SCNN1A-9374 | - | GCAGAGACCUUUUCACAGAGCC | 22 | 13223 |
| SCNN1A-9375 | - | UGCAGAGACCUUUUCACAGAGCC | 23 | 13224 |
| SCNN1A-9376 | - | GUGCAGAGACCUUUUCACAGAGCC | 24 | 13225 |
| SCNN1A-1876 | - | GAGAGGGCACUCAGGGCC | 18 | 5725 |
| SCNN1A-1877 | - | GGAGAGGGCACUCAGGGCC | 19 | 5726 |
| SCNN1A-1878 | - | GGGAGAGGGCACUCAGGGCC | 20 | 5727 |
| SCNN1A-1879 | - | UGGGAGAGGGCACUCAGGGCC | 21 | 5728 |
| SCNN1A-1880 | - | AUGGGAGAGGGCACUCAGGGCC | 22 | 5729 |
| SCNN1A-1881 | - | GAUGGGAGAGGGCACUCAGGGCC | 23 | 5730 |
| SCNN1A-1882 | - | UGAUGGGAGAGGGCACUCAGGGCC | 24 | 5731 |
| SCNN1A-1889 | - | UGGGACAUGGGCAUGGCC | 18 | 5738 |
| SCNN1A-1890 | - | GUGGGACAUGGGCAUGGCC | 19 | 5739 |
| SCNN1A-347 | - | GGUGGGACAUGGGCAUGGCC | 20 | 4196 |
| SCNN1A-1891 | - | GGGUGGGACAUGGGCAUGGCC | 21 | 5740 |
| SCNN1A-1892 | - | AGGGUGGGACAUGGGCAUGGCC | 22 | 5741 |
| SCNN1A-1893 | - | CAGGGUGGGACAUGGGCAUGGCC | 23 | 5742 |
| SCNN1A-1894 | - | GCAGGGUGGGACAUGGGCAUGGCC | 24 | 5743 |
| SCNN1A-9377 | - | CAGAGAGCAGACGAAUCC | 18 | 13226 |
| SCNN1A-9378 | - | CCAGAGAGCAGACGAAUCC | 19 | 13227 |
| SCNN1A-9379 | - | CCCAGAGAGCAGACGAAUCC | 20 | 13228 |
| SCNN1A-9380 | - | ACCCAGAGAGCAGACGAAUCC | 21 | 13229 |
| SCNN1A-9381 | - | CACCCAGAGAGCAGACGAAUCC | 22 | 13230 |
| SCNN1A-9382 | - | GCACCCAGAGAGCAGACGAAUCC | 23 | 13231 |
| SCNN1A-9383 | - | AGCACCCAGAGAGCAGACGAAUCC | 24 | 13232 |
| SCNN1A-9384 | - | GAGCUGAGACACAGAUCC | 18 | 13233 |
| SCNN1A-9385 | - | GGAGCUGAGACACAGAUCC | 19 | 13234 |
| SCNN1A-5588 | - | AGGAGCUGAGACACAGAUCC | 20 | 9437 |
| SCNN1A-9386 | - | CAGGAGCUGAGACACAGAUCC | 21 | 13235 |
| SCNN1A-9387 | - | GCAGGAGCUGAGACACAGAUCC | 22 | 13236 |
| SCNN1A-9388 | - | GGCAGGAGCUGAGACACAGAUCC | 23 | 13237 |
| SCNN1A-9389 | - | AGGCAGGAGCUGAGACACAGAUCC | 24 | 13238 |
| SCNN1A-9390 | - | CAGAAAACUGAUUUAUCC | 18 | 13239 |
| SCNN1A-9391 | - | UCAGAAAACUGAUUUAUCC | 19 | 13240 |
| SCNN1A-9392 | - | CUCAGAAAACUGAUUUAUCC | 20 | 13241 |

TABLE 47D-continued

4th Tier

| gRNA Name | DNA Strand | Targeting Domain | Target Site Length | Seq ID |
|---|---|---|---|---|
| SCNN1A-9393 | - | CCUCAGAAAACUGAUUUAUCC | 21 | 13242 |
| SCNN1A-9394 | - | ACCUCAGAAAACUGAUUUAUCC | 22 | 13243 |
| SCNN1A-9395 | - | AACCUCAGAAAACUGAUUUAUCC | 23 | 13244 |
| SCNN1A-9396 | - | UAACCUCAGAAAACUGAUUUAUCC | 24 | 13245 |
| SCNN1A-9397 | - | GAGGCAGCCCAGACCUCC | 18 | 13246 |
| SCNN1A-9398 | - | GGAGGCAGCCCAGACCUCC | 19 | 13247 |
| SCNN1A-5591 | - | UGGAGGCAGCCCAGACCUCC | 20 | 9440 |
| SCNN1A-9399 | - | CUGGAGGCAGCCCAGACCUCC | 21 | 13248 |
| SCNN1A-9400 | - | GCUGGAGGCAGCCCAGACCUCC | 22 | 13249 |
| SCNN1A-9401 | - | AGCUGGAGGCAGCCCAGACCUCC | 23 | 13250 |
| SCNN1A-9402 | - | AAGCUGGAGGCAGCCCAGACCUCC | 24 | 13251 |
| SCNN1A-9403 | - | ACGAAUUUCUCCUCCUCC | 18 | 13252 |
| SCNN1A-9404 | - | AACGAAUUUCUCCUCCUCC | 19 | 13253 |
| SCNN1A-9405 | - | CAACGAAUUUCUCCUCCUCC | 20 | 13254 |
| SCNN1A-9406 | - | UCAACGAAUUUCUCCUCCUCC | 21 | 13255 |
| SCNN1A-9407 | - | AUCAACGAAUUUCUCCUCCUCC | 22 | 13256 |
| SCNN1A-9408 | - | CAUCAACGAAUUUCUCCUCCUCC | 23 | 13257 |
| SCNN1A-9409 | - | CCAUCAACGAAUUUCUCCUCCUCC | 24 | 13258 |
| SCNN1A-9410 | - | UGCUGAGCCUCUAGCUCC | 18 | 13259 |
| SCNN1A-9411 | - | UUGCUGAGCCUCUAGCUCC | 19 | 13260 |
| SCNN1A-5594 | - | CUUGCUGAGCCUCUAGCUCC | 20 | 9443 |
| SCNN1A-9412 | - | ACUUGCUGAGCCUCUAGCUCC | 21 | 13261 |
| SCNN1A-9413 | - | CACUUGCUGAGCCUCUAGCUCC | 22 | 13262 |
| SCNN1A-9414 | - | CCACUUGCUGAGCCUCUAGCUCC | 23 | 13263 |
| SCNN1A-9415 | - | CCCACUUGCUGAGCCUCUAGCUCC | 24 | 13264 |
| SCNN1A-9416 | - | CGCAGGUCUGCUGGCUCC | 18 | 13265 |
| SCNN1A-9417 | - | CCGCAGGUCUGCUGGCUCC | 19 | 13266 |
| SCNN1A-5595 | - | CCCGCAGGUCUGCUGGCUCC | 20 | 9444 |
| SCNN1A-9418 | - | UCCCGCAGGUCUGCUGGCUCC | 21 | 13267 |
| SCNN1A-9419 | - | CUCCCGCAGGUCUGCUGGCUCC | 22 | 13268 |
| SCNN1A-9420 | - | ACUCCCGCAGGUCUGCUGGCUCC | 23 | 13269 |
| SCNN1A-9421 | - | AACUCCCGCAGGUCUGCUGGCUCC | 24 | 13270 |
| SCNN1A-9422 | - | CCUGGAGCCCUGCAGUCC | 18 | 13271 |
| SCNN1A-9423 | - | UCCUGGAGCCCUGCAGUCC | 19 | 13272 |
| SCNN1A-6114 | - | CUCCUGGAGCCCUGCAGUCC | 20 | 9963 |
| SCNN1A-9424 | - | CCUCCUGGAGCCCUGCAGUCC | 21 | 13273 |
| SCNN1A-9425 | - | ACCUCCUGGAGCCCUGCAGUCC | 22 | 13274 |
| SCNN1A-9426 | - | GACCUCCUGGAGCCCUGCAGUCC | 23 | 13275 |

TABLE 47D-continued

4th Tier

| gRNA Name | DNA Strand | Targeting Domain | Target Site Length | Seq ID |
|---|---|---|---|---|
| SCNN1A-9427 | − | AGACCUCCUGGAGCCCUGCAGUCC | 24 | 13276 |
| SCNN1A-9428 | − | AAAAAGAACAGAAUGUCC | 18 | 13277 |
| SCNN1A-9429 | − | AAAAAAGAACAGAAUGUCC | 19 | 13278 |
| SCNN1A-9430 | − | UAAAAAAGAACAGAAUGUCC | 20 | 13279 |
| SCNN1A-9431 | − | GUAAAAAAGAACAGAAUGUCC | 21 | 13280 |
| SCNN1A-9432 | − | UGUAAAAAAGAACAGAAUGUCC | 22 | 13281 |
| SCNN1A-9433 | − | GUGUAAAAAAGAACAGAAUGUCC | 23 | 13282 |
| SCNN1A-9434 | − | AGUGUAAAAAAGAACAGAAUGUCC | 24 | 13283 |
| SCNN1A-9435 | − | AAUCCAGCUGUCCCUUCC | 18 | 13284 |
| SCNN1A-9436 | − | AAAUCCAGCUGUCCCUUCC | 19 | 13285 |
| SCNN1A-9437 | − | AAAAUCCAGCUGUCCCUUCC | 20 | 13286 |
| SCNN1A-9438 | − | AAAAAUCCAGCUGUCCCUUCC | 21 | 13287 |
| SCNN1A-9439 | − | GAAAAAUCCAGCUGUCCCUUCC | 22 | 13288 |
| SCNN1A-9440 | − | AGAAAAAUCCAGCUGUCCCUUCC | 23 | 13289 |
| SCNN1A-9441 | − | AAGAAAAAUCCAGCUGUCCCUUCC | 24 | 13290 |
| SCNN1A-9442 | − | CCCCCUUGCUCUCCUUCC | 18 | 13291 |
| SCNN1A-9443 | − | CCCCCCUUGCUCUCCUUCC | 19 | 13292 |
| SCNN1A-5598 | − | UCCCCCCUUGCUCUCCUUCC | 20 | 9447 |
| SCNN1A-9444 | − | CUCCCCCCUUGCUCUCCUUCC | 21 | 13293 |
| SCNN1A-9445 | − | ACUCCCCCCUUGCUCUCCUUCC | 22 | 13294 |
| SCNN1A-9446 | − | GACUCCCCCCUUGCUCUCCUUCC | 23 | 13295 |
| SCNN1A-9447 | − | GGACUCCCCCCUUGCUCUCCUUCC | 24 | 13296 |
| SCNN1A-1895 | − | UCAUGAAGGGGAACAAGC | 18 | 5744 |
| SCNN1A-1896 | − | CUCAUGAAGGGGAACAAGC | 19 | 5745 |
| SCNN1A-176 | − | GCUCAUGAAGGGGAACAAGC | 20 | 811 |
| SCNN1A-1897 | − | GGCUCAUGAAGGGGAACAAGC | 21 | 5746 |
| SCNN1A-1898 | − | GGGCUCAUGAAGGGGAACAAGC | 22 | 5747 |
| SCNN1A-1901 | − | GGGGCUCAUGAAGGGGAACAAGC | 23 | 5750 |
| SCNN1A-1902 | − | CGGGGCUCAUGAAGGGGAACAAGC | 24 | 5751 |
| SCNN1A-1903 | − | UCAUGGAGGGGAACAAGC | 18 | 5752 |
| SCNN1A-1904 | − | CUCAUGGAGGGGAACAAGC | 19 | 5753 |
| SCNN1A-5 | − | UCUCAUGGAGGGGAACAAGC | 20 | 557 |
| SCNN1A-1905 | − | GUCUCAUGGAGGGGAACAAGC | 21 | 5754 |
| SCNN1A-1906 | − | GGUCUCAUGGAGGGGAACAAGC | 22 | 5755 |
| SCNN1A-1907 | − | AGGUCUCAUGGAGGGGAACAAGC | 23 | 5756 |
| SCNN1A-1908 | − | CAGGUCUCAUGGAGGGGAACAAGC | 24 | 5757 |
| SCNN1A-9448 | − | AACCUGGGAGUGGGAAGC | 18 | 13297 |

TABLE 47D-continued

4th Tier

| gRNA Name | DNA Strand | Targeting Domain | Target Site Length | Seq ID |
|---|---|---|---|---|
| SCNN1A-9449 | - | CAACCUGGGAGUGGGAAGC | 19 | 13298 |
| SCNN1A-5228 | - | GCAACCUGGGAGUGGGAAGC | 20 | 9077 |
| SCNN1A-9450 | - | CGCAACCUGGGAGUGGGAAGC | 21 | 13299 |
| SCNN1A-9451 | - | CCGCAACCUGGGAGUGGGAAGC | 22 | 13300 |
| SCNN1A-9452 | - | GCCGCAACCUGGGAGUGGGAAGC | 23 | 13301 |
| SCNN1A-9453 | - | AGCCGCAACCUGGGAGUGGGAAGC | 24 | 13302 |
| SCNN1A-1909 | - | AGCAGUAUCAAGGUAAGC | 18 | 5758 |
| SCNN1A-1910 | - | GAGCAGUAUCAAGGUAAGC | 19 | 5759 |
| SCNN1A-1911 | - | UGAGCAGUAUCAAGGUAAGC | 20 | 5760 |
| SCNN1A-1912 | - | AUGAGCAGUAUCAAGGUAAGC | 21 | 5761 |
| SCNN1A-1913 | - | CAUGAGCAGUAUCAAGGUAAGC | 22 | 5762 |
| SCNN1A-1914 | - | UCAUGAGCAGUAUCAAGGUAAGC | 23 | 5763 |
| SCNN1A-1915 | - | AUCAUGAGCAGUAUCAAGGUAAGC | 24 | 5764 |
| SCNN1A-9454 | - | ACAGAAUCAGGACACAGC | 18 | 13303 |
| SCNN1A-9455 | - | GACAGAAUCAGGACACAGC | 19 | 13304 |
| SCNN1A-9456 | - | AGACAGAAUCAGGACACAGC | 20 | 13305 |
| SCNN1A-9457 | - | GAGACAGAAUCAGGACACAGC | 21 | 13306 |
| SCNN1A-9458 | - | AGAGACAGAAUCAGGACACAGC | 22 | 13307 |
| SCNN1A-9459 | - | CAGAGACAGAAUCAGGACACAGC | 23 | 13308 |
| SCNN1A-9460 | - | GCAGAGACAGAAUCAGGACACAGC | 24 | 13309 |
| SCNN1A-9461 | - | CAACUCUGUGACCACAGC | 18 | 13310 |
| SCNN1A-9462 | - | GCAACUCUGUGACCACAGC | 19 | 13311 |
| SCNN1A-5599 | - | UGCAACUCUGUGACCACAGC | 20 | 9448 |
| SCNN1A-9463 | - | CUGCAACUCUGUGACCACAGC | 21 | 13312 |
| SCNN1A-9464 | - | CCUGCAACUCUGUGACCACAGC | 22 | 13313 |
| SCNN1A-9465 | - | UCCUGCAACUCUGUGACCACAGC | 23 | 13314 |
| SCNN1A-9466 | - | UUCCUGCAACUCUGUGACCACAGC | 24 | 13315 |
| SCNN1A-9467 | - | GGGUGGCGAGGAAUCAGC | 18 | 13316 |
| SCNN1A-9468 | - | GGGGUGGCGAGGAAUCAGC | 19 | 13317 |
| SCNN1A-5229 | - | GGGGGUGGCGAGGAAUCAGC | 20 | 9078 |
| SCNN1A-9469 | - | AGGGGGUGGCGAGGAAUCAGC | 21 | 13318 |
| SCNN1A-9470 | - | GAGGGGGUGGCGAGGAAUCAGC | 22 | 13319 |
| SCNN1A-9471 | - | GGAGGGGGUGGCGAGGAAUCAGC | 23 | 13320 |
| SCNN1A-9472 | - | UGGAGGGGGUGGCGAGGAAUCAGC | 24 | 13321 |
| SCNN1A-9473 | - | GGCCAGAAAGAGGAGAGC | 18 | 13322 |
| SCNN1A-9474 | - | AGGCCAGAAAGAGGAGAGC | 19 | 13323 |
| SCNN1A-6119 | - | CAGGCCAGAAAGAGGAGAGC | 20 | 9968 |
| SCNN1A-9475 | - | GCAGGCCAGAAAGAGGAGAGC | 21 | 13324 |

TABLE 47D-continued

4th Tier

| gRNA Name | DNA Strand | Targeting Domain | Target Site Length | Seq ID |
|---|---|---|---|---|
| SCNN1A-9476 | − | GGCAGGCCAGAAAGAGGAGAGC | 22 | 13325 |
| SCNN1A-9477 | − | AGGCAGGCCAGAAAGAGGAGAGC | 23 | 13326 |
| SCNN1A-9478 | − | GAGGCAGGCCAGAAAGAGGAGAGC | 24 | 13327 |
| SCNN1A-9479 | − | CCAGGUUGGACCCUGAGC | 18 | 13328 |
| SCNN1A-9480 | − | ACCAGGUUGGACCCUGAGC | 19 | 13329 |
| SCNN1A-9481 | − | GACCAGGUUGGACCCUGAGC | 20 | 13330 |
| SCNN1A-9482 | − | AGACCAGGUUGGACCCUGAGC | 21 | 13331 |
| SCNN1A-9483 | − | CAGACCAGGUUGGACCCUGAGC | 22 | 13332 |
| SCNN1A-9484 | − | ACAGACCAGGUUGGACCCUGAGC | 23 | 13333 |
| SCNN1A-9485 | − | CACAGACCAGGUUGGACCCUGAGC | 24 | 13334 |
| SCNN1A-9486 | − | UGCUCCCACUUAGUGAGC | 18 | 13335 |
| SCNN1A-9487 | − | CUGCUCCCACUUAGUGAGC | 19 | 13336 |
| SCNN1A-5230 | − | GCUGCUCCCACUUAGUGAGC | 20 | 9079 |
| SCNN1A-9488 | − | CGCUGCUCCCACUUAGUGAGC | 21 | 13337 |
| SCNN1A-9489 | − | GCGCUGCUCCCACUUAGUGAGC | 22 | 13338 |
| SCNN1A-9490 | − | UGCGCUGCUCCCACUUAGUGAGC | 23 | 13339 |
| SCNN1A-9491 | − | GUGCGCUGCUCCCACUUAGUGAGC | 24 | 13340 |
| SCNN1A-9492 | − | GUCGCAAGAGACUGCCGC | 18 | 13341 |
| SCNN1A-9493 | − | AGUCGCAAGAGACUGCCGC | 19 | 13342 |
| SCNN1A-9494 | − | AAGUCGCAAGAGACUGCCGC | 20 | 13343 |
| SCNN1A-9495 | − | GAAGUCGCAAGAGACUGCCGC | 21 | 13344 |
| SCNN1A-9496 | − | AGAAGUCGCAAGAGACUGCCGC | 22 | 13345 |
| SCNN1A-9497 | − | AAGAAGUCGCAAGAGACUGCCGC | 23 | 13346 |
| SCNN1A-9498 | − | UAAGAAGUCGCAAGAGACUGCCGC | 24 | 13347 |
| SCNN1A-9499 | − | UUCACUUUAAGAAGUCGC | 18 | 13348 |
| SCNN1A-9500 | − | UUUCACUUUAAGAAGUCGC | 19 | 13349 |
| SCNN1A-9501 | − | CUUUCACUUUAAGAAGUCGC | 20 | 13350 |
| SCNN1A-9502 | − | GCUUUCACUUUAAGAAGUCGC | 21 | 13351 |
| SCNN1A-9503 | − | GGCUUUCACUUUAAGAAGUCGC | 22 | 13352 |
| SCNN1A-9504 | − | CGGCUUUCACUUUAAGAAGUCGC | 23 | 13353 |
| SCNN1A-9505 | − | CCGGCUUUCACUUUAAGAAGUCGC | 24 | 13354 |
| SCNN1A-9506 | − | CUGGCAAAUAGAAAAGGC | 18 | 13355 |
| SCNN1A-9507 | − | GCUGGCAAAUAGAAAAGGC | 19 | 13356 |
| SCNN1A-6121 | − | AGCUGGCAAAUAGAAAAGGC | 20 | 9970 |
| SCNN1A-9508 | − | GAGCUGGCAAAUAGAAAAGGC | 21 | 13357 |
| SCNN1A-9509 | − | UGAGCUGGCAAAUAGAAAAGGC | 22 | 13358 |
| SCNN1A-9510 | − | AUGAGCUGGCAAAUAGAAAAGGC | 23 | 13359 |

TABLE 47D-continued

4th Tier

| gRNA Name | DNA Strand | Targeting Domain | Target Site Length | Seq ID |
|---|---|---|---|---|
| SCNN1A-9511 | - | CAUGAGCUGGCAAAUAGAAAAGGC | 24 | 13360 |
| SCNN1A-9512 | - | AGUGAGAGGGGCAAGGC | 18 | 13361 |
| SCNN1A-9513 | - | GAGUGAGAGGGGCAAGGC | 19 | 13362 |
| SCNN1A-9514 | - | AGAGUGAGAGGGGCAAGGC | 20 | 13363 |
| SCNN1A-9515 | - | UAGAGUGAGAGGGGCAAGGC | 21 | 13364 |
| SCNN1A-9516 | - | CUAGAGUGAGAGGGGCAAGGC | 22 | 13365 |
| SCNN1A-9517 | - | CCUAGAGUGAGAGGGGCAAGGC | 23 | 13366 |
| SCNN1A-9518 | - | GCCUAGAGUGAGAGGGGCAAGGC | 24 | 13367 |
| SCNN1A-9519 | - | UAGAGAGAGGAGGCAGGC | 18 | 13368 |
| SCNN1A-9520 | - | UUAGAGAGAGGAGGCAGGC | 19 | 13369 |
| SCNN1A-9521 | - | AUUAGAGAGAGGAGGCAGGC | 20 | 13370 |
| SCNN1A-9522 | - | GAUUAGAGAGAGGAGGCAGGC | 21 | 13371 |
| SCNN1A-9523 | - | GGAUUAGAGAGAGGAGGCAGGC | 22 | 13372 |
| SCNN1A-9524 | - | AGGAUUAGAGAGAGGAGGCAGGC | 23 | 13373 |
| SCNN1A-9525 | - | CAGGAUUAGAGAGAGGAGGCAGGC | 24 | 13374 |
| SCNN1A-9526 | - | AGUGGUUGGAUUUCAGGC | 18 | 13375 |
| SCNN1A-9527 | - | UAGUGGUUGGAUUUCAGGC | 19 | 13376 |
| SCNN1A-9528 | - | CUAGUGGUUGGAUUUCAGGC | 20 | 13377 |
| SCNN1A-9529 | - | GCUAGUGGUUGGAUUUCAGGC | 21 | 13378 |
| SCNN1A-9530 | - | AGCUAGUGGUUGGAUUUCAGGC | 22 | 13379 |
| SCNN1A-9531 | - | AAGCUAGUGGUUGGAUUUCAGGC | 23 | 13380 |
| SCNN1A-9532 | - | UAAGCUAGUGGUUGGAUUUCAGGC | 24 | 13381 |
| SCNN1A-9533 | - | GAGGUCAGGGCCAGAGGC | 18 | 13382 |
| SCNN1A-9534 | - | CGAGGUCAGGGCCAGAGGC | 19 | 13383 |
| SCNN1A-5607 | - | UCGAGGUCAGGGCCAGAGGC | 20 | 9456 |
| SCNN1A-9535 | - | CUCGAGGUCAGGGCCAGAGGC | 21 | 13384 |
| SCNN1A-9536 | - | GCUCGAGGUCAGGGCCAGAGGC | 22 | 13385 |
| SCNN1A-9537 | - | AGCUCGAGGUCAGGGCCAGAGGC | 23 | 13386 |
| SCNN1A-9538 | - | CAGCUCGAGGUCAGGGCCAGAGGC | 24 | 13387 |
| SCNN1A-9539 | - | AGAGAGGGAGUGAGAGGC | 18 | 13388 |
| SCNN1A-9540 | - | UAGAGAGGGAGUGAGAGGC | 19 | 13389 |
| SCNN1A-6123 | - | AUAGAGAGGGAGUGAGAGGC | 20 | 9972 |
| SCNN1A-9541 | - | GAUAGAGAGGGAGUGAGAGGC | 21 | 13390 |
| SCNN1A-9542 | - | AGAUAGAGAGGGAGUGAGAGGC | 22 | 13391 |
| SCNN1A-9543 | - | CAGAUAGAGAGGGAGUGAGAGGC | 23 | 13392 |
| SCNN1A-9544 | - | GCAGAUAGAGAGGGAGUGAGAGGC | 24 | 13393 |
| SCNN1A-9545 | - | CUCUCUUCUCUGCAGGGC | 18 | 13394 |
| SCNN1A-9546 | - | UCUCUCUUCUCUGCAGGGC | 19 | 13395 |

TABLE 47D-continued

4th Tier

| gRNA Name | DNA Strand | Targeting Domain | Target Site Length | Seq ID |
|---|---|---|---|---|
| SCNN1A-9547 | - | UUCUCUCUUCUCUGCAGGGC | 20 | 13396 |
| SCNN1A-9548 | - | CUUCUCUCUUCUCUGCAGGGC | 21 | 13397 |
| SCNN1A-9549 | - | UCUUCUCUCUUCUCUGCAGGGC | 22 | 13398 |
| SCNN1A-9550 | - | CUCUUCUCUCUUCUCUGCAGGGC | 23 | 13399 |
| SCNN1A-9551 | - | CCUCUUCUCUCUUCUCUGCAGGGC | 24 | 13400 |
| SCNN1A-9552 | - | ACAGCUCGAGGUCAGGGC | 18 | 13401 |
| SCNN1A-9553 | - | CACAGCUCGAGGUCAGGGC | 19 | 13402 |
| SCNN1A-9554 | - | ACACAGCUCGAGGUCAGGGC | 20 | 13403 |
| SCNN1A-9555 | - | GACACAGCUCGAGGUCAGGGC | 21 | 13404 |
| SCNN1A-9556 | - | GGACACAGCUCGAGGUCAGGGC | 22 | 13405 |
| SCNN1A-9557 | - | AGGACACAGCUCGAGGUCAGGGC | 23 | 13406 |
| SCNN1A-9558 | - | CAGGACACAGCUCGAGGUCAGGGC | 24 | 13407 |
| SCNN1A-1928 | - | GUGGGACAUGGGCAUGGC | 18 | 5777 |
| SCNN1A-1929 | - | GGUGGGACAUGGGCAUGGC | 19 | 5778 |
| SCNN1A-1930 | - | GGGUGGGACAUGGGCAUGGC | 20 | 5779 |
| SCNN1A-1931 | - | AGGGUGGGACAUGGGCAUGGC | 21 | 5780 |
| SCNN1A-1932 | - | CAGGGUGGGACAUGGGCAUGGC | 22 | 5781 |
| SCNN1A-1933 | - | GCAGGGUGGGACAUGGGCAUGGC | 23 | 5782 |
| SCNN1A-1934 | - | CGCAGGGUGGGACAUGGGCAUGGC | 24 | 5783 |
| SCNN1A-9559 | - | AAGGUUGGAGGGGUGGC | 18 | 13408 |
| SCNN1A-9560 | - | CAAGGUUGGAGGGGUGGC | 19 | 13409 |
| SCNN1A-9561 | - | ACAAGGUUGGAGGGGUGGC | 20 | 13410 |
| SCNN1A-9562 | - | GACAAGGUUGGAGGGGUGGC | 21 | 13411 |
| SCNN1A-9563 | - | GGACAAGGUUGGAGGGGUGGC | 22 | 13412 |
| SCNN1A-9564 | - | UGGACAAGGUUGGAGGGGUGGC | 23 | 13413 |
| SCNN1A-9565 | - | CUGGACAAGGUUGGAGGGGUGGC | 24 | 13414 |
| SCNN1A-9566 | - | AGACAGAAAGGGAGGUGC | 18 | 13415 |
| SCNN1A-9567 | - | GAGACAGAAAGGGAGGUGC | 19 | 13416 |
| SCNN1A-9568 | - | AGAGACAGAAAGGGAGGUGC | 20 | 13417 |
| SCNN1A-9569 | - | CAGAGACAGAAAGGGAGGUGC | 21 | 13418 |
| SCNN1A-9570 | - | GCAGAGACAGAAAGGGAGGUGC | 22 | 13419 |
| SCNN1A-9571 | - | GGCAGAGACAGAAAGGGAGGUGC | 23 | 13420 |
| SCNN1A-9572 | - | GGGCAGAGACAGAAAGGGAGGUGC | 24 | 13421 |
| SCNN1A-9573 | - | UGCUGAGCACCUUAUUGC | 18 | 13422 |
| SCNN1A-9574 | - | GUGCUGAGCACCUUAUUGC | 19 | 13423 |
| SCNN1A-5237 | - | GGUGCUGAGCACCUUAUUGC | 20 | 9086 |
| SCNN1A-9575 | - | GGGUGCUGAGCACCUUAUUGC | 21 | 13424 |

TABLE 47D-continued

4th Tier

| gRNA Name | DNA Strand | Targeting Domain | Target Site Length | Seq ID |
|---|---|---|---|---|
| SCNN1A-9576 | - | AGGGUGCUGAGCACCUUAUUGC | 22 | 13425 |
| SCNN1A-9577 | - | CAGGGUGCUGAGCACCUUAUUGC | 23 | 13426 |
| SCNN1A-9578 | - | CCAGGGUGCUGAGCACCUUAUUGC | 24 | 13427 |
| SCNN1A-9579 | - | GGAGCUGAGACACAGAUC | 18 | 13428 |
| SCNN1A-9580 | - | AGGAGCUGAGACACAGAUC | 19 | 13429 |
| SCNN1A-9581 | - | CAGGAGCUGAGACACAGAUC | 20 | 13430 |
| SCNN1A-9582 | - | GCAGGAGCUGAGACACAGAUC | 21 | 13431 |
| SCNN1A-9583 | - | GGCAGGAGCUGAGACACAGAUC | 22 | 13432 |
| SCNN1A-9584 | - | AGGCAGGAGCUGAGACACAGAUC | 23 | 13433 |
| SCNN1A-9585 | - | GAGGCAGGAGCUGAGACACAGAUC | 24 | 13434 |
| SCNN1A-9586 | - | UCGAAAGGUGGCCCUAUC | 18 | 13435 |
| SCNN1A-9587 | - | CUCGAAAGGUGGCCCUAUC | 19 | 13436 |
| SCNN1A-5626 | - | ACUCGAAAGGUGGCCCUAUC | 20 | 9475 |
| SCNN1A-9588 | - | AACUCGAAAGGUGGCCCUAUC | 21 | 13437 |
| SCNN1A-9589 | - | AAACUCGAAAGGUGGCCCUAUC | 22 | 13438 |
| SCNN1A-9590 | - | AAAACUCGAAAGGUGGCCCUAUC | 23 | 13439 |
| SCNN1A-9591 | - | CAAAACUCGAAAGGUGGCCCUAUC | 24 | 13440 |
| SCNN1A-1935 | - | CUUCCAAGGGGAGGUAUC | 18 | 5784 |
| SCNN1A-1936 | - | CCUUCCAAGGGGAGGUAUC | 19 | 5785 |
| SCNN1A-1937 | - | CCCUUCCAAGGGGAGGUAUC | 20 | 5786 |
| SCNN1A-1938 | - | UCCCUUCCAAGGGGAGGUAUC | 21 | 5787 |
| SCNN1A-1939 | - | GUCCCUUCCAAGGGGAGGUAUC | 22 | 5788 |
| SCNN1A-1940 | - | UGUCCCUUCCAAGGGGAGGUAUC | 23 | 5789 |
| SCNN1A-1941 | - | CUGUCCCUUCCAAGGGGAGGUAUC | 24 | 5790 |
| SCNN1A-1942 | - | GCUCUCCCCAAUCCACUC | 18 | 5791 |
| SCNN1A-1943 | - | UGCUCUCCCCAAUCCACUC | 19 | 5792 |
| SCNN1A-410 | - | UUGCUCUCCCCAAUCCACUC | 20 | 4259 |
| SCNN1A-1944 | - | CUUGCUCUCCCCAAUCCACUC | 21 | 5793 |
| SCNN1A-1945 | - | CCUUGCUCUCCCCAAUCCACUC | 22 | 5794 |
| SCNN1A-1946 | - | CCCUUGCUCUCCCCAAUCCACUC | 23 | 5795 |
| SCNN1A-1947 | - | ACCCUUGCUCUCCCCAAUCCACUC | 24 | 5796 |
| SCNN1A-1948 | - | GCCCUCCACAGUCCACUC | 18 | 5797 |
| SCNN1A-1949 | - | AGCCCUCCACAGUCCACUC | 19 | 5798 |
| SCNN1A-170 | - | UAGCCCUCCACAGUCCACUC | 20 | 808 |
| SCNN1A-1950 | - | CUAGCCCUCCACAGUCCACUC | 21 | 5799 |
| SCNN1A-1951 | - | UCUAGCCCUCCACAGUCCACUC | 22 | 5800 |
| SCNN1A-1952 | - | CUCUAGCCCUCCACAGUCCACUC | 23 | 5801 |
| SCNN1A-1953 | - | ACUCUAGCCCUCCACAGUCCACUC | 24 | 5802 |

TABLE 47D-continued

| | | 4th Tier | | |
|---|---|---|---|---|
| gRNA Name | DNA Strand | Targeting Domain | Target Site Length | Seq ID |
| SCNN1A-9592 | - | GGAGGCAGCCCAGACCUC | 18 | 13441 |
| SCNN1A-9593 | - | UGGAGGCAGCCCAGACCUC | 19 | 13442 |
| SCNN1A-9594 | - | CUGGAGGCAGCCCAGACCUC | 20 | 13443 |
| SCNN1A-9595 | - | GCUGGAGGCAGCCCAGACCUC | 21 | 13444 |
| SCNN1A-9596 | - | AGCUGGAGGCAGCCCAGACCUC | 22 | 13445 |
| SCNN1A-9597 | - | AAGCUGGAGGCAGCCCAGACCUC | 23 | 13446 |
| SCNN1A-9598 | - | GAAGCUGGAGGCAGCCCAGACCUC | 24 | 13447 |
| SCNN1A-9599 | - | CCCAGUUCACCUGCCCUC | 18 | 13448 |
| SCNN1A-9600 | - | UCCCAGUUCACCUGCCCUC | 19 | 13449 |
| SCNN1A-6132 | - | CUCCCAGUUCACCUGCCCUC | 20 | 9981 |
| SCNN1A-9601 | - | ACUCCCAGUUCACCUGCCCUC | 21 | 13450 |
| SCNN1A-9602 | - | UACUCCCAGUUCACCUGCCCUC | 22 | 13451 |
| SCNN1A-9603 | - | GUACUCCCAGUUCACCUGCCCUC | 23 | 13452 |
| SCNN1A-9604 | - | AGUACUCCCAGUUCACCUGCCCUC | 24 | 13453 |
| SCNN1A-9605 | - | UUGCUGAGCCUCUAGCUC | 18 | 13454 |
| SCNN1A-9606 | - | CUUGCUGAGCCUCUAGCUC | 19 | 13455 |
| SCNN1A-9607 | - | ACUUGCUGAGCCUCUAGCUC | 20 | 13456 |
| SCNN1A-9608 | - | CACUUGCUGAGCCUCUAGCUC | 21 | 13457 |
| SCNN1A-9609 | - | CCACUUGCUGAGCCUCUAGCUC | 22 | 13458 |
| SCNN1A-9610 | - | CCCACUUGCUGAGCCUCUAGCUC | 23 | 13459 |
| SCNN1A-9611 | - | GCCCACUUGCUGAGCCUCUAGCUC | 24 | 13460 |
| SCNN1A-1960 | - | CAAUCCACUCCGGGGCUC | 18 | 5809 |
| SCNN1A-1961 | - | CCAAUCCACUCCGGGGCUC | 19 | 5810 |
| SCNN1A-1962 | - | CCCAAUCCACUCCGGGGCUC | 20 | 5811 |
| SCNN1A-1963 | - | CCCCAAUCCACUCCGGGGCUC | 21 | 5812 |
| SCNN1A-1964 | - | UCCCCAAUCCACUCCGGGGCUC | 22 | 5813 |
| SCNN1A-1965 | - | CUCCCCAAUCCACUCCGGGGCUC | 23 | 5814 |
| SCNN1A-1966 | - | UCUCCCCAAUCCACUCCGGGGCUC | 24 | 5815 |
| SCNN1A-9612 | - | AAUGUAAGGACCUGGCUC | 18 | 13461 |
| SCNN1A-9613 | - | CAAUGUAAGGACCUGGCUC | 19 | 13462 |
| SCNN1A-9614 | - | CCAAUGUAAGGACCUGGCUC | 20 | 13463 |
| SCNN1A-9615 | - | CCCAAUGUAAGGACCUGGCUC | 21 | 13464 |
| SCNN1A-9616 | - | GCCCAAUGUAAGGACCUGGCUC | 22 | 13465 |
| SCNN1A-9617 | - | UGCCCAAUGUAAGGACCUGGCUC | 23 | 13466 |
| SCNN1A-9618 | - | AUGCCCAAUGUAAGGACCUGGCUC | 24 | 13467 |
| SCNN1A-9619 | - | CCGCAGGUCUGCUGGCUC | 18 | 13468 |
| SCNN1A-9620 | - | CCCGCAGGUCUGCUGGCUC | 19 | 13469 |

TABLE 47D-continued

4th Tier

| gRNA Name | DNA Strand | Targeting Domain | Target Site Length | Seq ID |
|---|---|---|---|---|
| SCNN1A-9621 | - | UCCCGCAGGUCUGCUGGCUC | 20 | 13470 |
| SCNN1A-9622 | - | CUCCCGCAGGUCUGCUGGCUC | 21 | 13471 |
| SCNN1A-9623 | - | ACUCCCGCAGGUCUGCUGGCUC | 22 | 13472 |
| SCNN1A-9624 | - | AACUCCCGCAGGUCUGCUGGCUC | 23 | 13473 |
| SCNN1A-9625 | - | CAACUCCCGCAGGUCUGCUGGCUC | 24 | 13474 |
| SCNN1A-1967 | - | CAGCCCAUACCAGGUCUC | 18 | 5816 |
| SCNN1A-1968 | - | GCAGCCCAUACCAGGUCUC | 19 | 5817 |
| SCNN1A-159 | - | UGCAGCCCAUACCAGGUCUC | 20 | 803 |
| SCNN1A-1969 | - | CUGCAGCCCAUACCAGGUCUC | 21 | 5818 |
| SCNN1A-1970 | - | UCUGCAGCCCAUACCAGGUCUC | 22 | 5819 |
| SCNN1A-1971 | - | CUCUGCAGCCCAUACCAGGUCUC | 23 | 5820 |
| SCNN1A-1972 | - | CCUCUGCAGCCCAUACCAGGUCUC | 24 | 5821 |
| SCNN1A-9626 | - | CCCCCAUGAGUCUGUCUC | 18 | 13475 |
| SCNN1A-9627 | - | UCCCCCAUGAGUCUGUCUC | 19 | 13476 |
| SCNN1A-5636 | - | AUCCCCCAUGAGUCUGUCUC | 20 | 9485 |
| SCNN1A-9628 | - | GAUCCCCCAUGAGUCUGUCUC | 21 | 13477 |
| SCNN1A-9629 | - | CGAUCCCCCAUGAGUCUGUCUC | 22 | 13478 |
| SCNN1A-9630 | - | CCGAUCCCCCAUGAGUCUGUCUC | 23 | 13479 |
| SCNN1A-9631 | - | CCCGAUCCCCCAUGAGUCUGUCUC | 24 | 13480 |
| SCNN1A-9632 | - | CAGAGAUGACACCUUCUC | 18 | 13481 |
| SCNN1A-9633 | - | GCAGAGAUGACACCUUCUC | 19 | 13482 |
| SCNN1A-5637 | - | AGCAGAGAUGACACCUUCUC | 20 | 9486 |
| SCNN1A-9634 | - | CAGCAGAGAUGACACCUUCUC | 21 | 13483 |
| SCNN1A-9635 | - | UCAGCAGAGAUGACACCUUCUC | 22 | 13484 |
| SCNN1A-9636 | - | UUCAGCAGAGAUGACACCUUCUC | 23 | 13485 |
| SCNN1A-9637 | - | AUUCAGCAGAGAUGACACCUUCUC | 24 | 13486 |
| SCNN1A-9638 | - | UCCUGGAGCCCUGCAGUC | 18 | 13487 |
| SCNN1A-9639 | - | CUCCUGGAGCCCUGCAGUC | 19 | 13488 |
| SCNN1A-9640 | - | CCUCCUGGAGCCCUGCAGUC | 20 | 13489 |
| SCNN1A-9641 | - | ACCUCCUGGAGCCCUGCAGUC | 21 | 13490 |
| SCNN1A-9642 | - | GACCUCCUGGAGCCCUGCAGUC | 22 | 13491 |
| SCNN1A-9643 | - | AGACCUCCUGGAGCCCUGCAGUC | 23 | 13492 |
| SCNN1A-9644 | - | CAGACCUCCUGGAGCCCUGCAGUC | 24 | 13493 |
| SCNN1A-9645 | - | CCCCCUUGCUCUCCUUC | 18 | 13494 |
| SCNN1A-9646 | - | UCCCCCUUGCUCUCCUUC | 19 | 13495 |
| SCNN1A-9647 | - | CUCCCCCUUGCUCUCCUUC | 20 | 13496 |
| SCNN1A-9648 | - | ACUCCCCCUUGCUCUCCUUC | 21 | 13497 |
| SCNN1A-9649 | - | GACUCCCCCUUGCUCUCCUUC | 22 | 13498 |

TABLE 47D-continued

| | | 4th Tier | | |
|---|---|---|---|---|
| gRNA Name | DNA Strand | Targeting Domain | Target Site Length | Seq ID |
| SCNN1A-9650 | - | GGACUCCCCCCUUGCUCUCCUUC | 23 | 13499 |
| SCNN1A-9651 | - | GGGACUCCCCCCUUGCUCUCCUUC | 24 | 13500 |
| SCNN1A-9652 | - | UGCUUUCCCUGCCUCUUC | 18 | 13501 |
| SCNN1A-9653 | - | CUGCUUUCCCUGCCUCUUC | 19 | 13502 |
| SCNN1A-9654 | - | CCUGCUUUCCCUGCCUCUUC | 20 | 13503 |
| SCNN1A-9655 | - | GCCUGCUUUCCCUGCCUCUUC | 21 | 13504 |
| SCNN1A-9656 | - | UGCCUGCUUUCCCUGCCUCUUC | 22 | 13505 |
| SCNN1A-9657 | - | GUGCCUGCUUUCCCUGCCUCUUC | 23 | 13506 |
| SCNN1A-9658 | - | AGUGCCUGCUUUCCCUGCCUCUUC | 24 | 13507 |
| SCNN1A-9659 | - | GCAGAGGAGAGGCCGUUC | 18 | 13508 |
| SCNN1A-9660 | - | AGCAGAGGAGAGGCCGUUC | 19 | 13509 |
| SCNN1A-9661 | - | AAGCAGAGGAGAGGCCGUUC | 20 | 13510 |
| SCNN1A-9662 | - | GAAGCAGAGGAGAGGCCGUUC | 21 | 13511 |
| SCNN1A-9663 | - | GGAAGCAGAGGAGAGGCCGUUC | 22 | 13512 |
| SCNN1A-9664 | - | GGGAAGCAGAGGAGAGGCCGUUC | 23 | 13513 |
| SCNN1A-9665 | - | AGGGAAGCAGAGGAGAGGCCGUUC | 24 | 13514 |
| SCNN1A-1973 | - | GCAGCCUCACUCGGGUUC | 18 | 5822 |
| SCNN1A-1974 | - | GGCAGCCUCACUCGGGUUC | 19 | 5823 |
| SCNN1A-1975 | - | GGGCAGCCUCACUCGGGUUC | 20 | 5824 |
| SCNN1A-1976 | - | GGGGCAGCCUCACUCGGGUUC | 21 | 5825 |
| SCNN1A-1977 | - | AGGGGCAGCCUCACUCGGGUUC | 22 | 5826 |
| SCNN1A-1978 | - | CAGGGGCAGCCUCACUCGGGUUC | 23 | 5827 |
| SCNN1A-1979 | - | CCAGGGGCAGCCUCACUCGGGUUC | 24 | 5828 |
| SCNN1A-9666 | - | AAGGGAGACUGGAGUUUC | 18 | 13515 |
| SCNN1A-9667 | - | CAAGGGAGACUGGAGUUUC | 19 | 13516 |
| SCNN1A-9668 | - | UCAAGGGAGACUGGAGUUUC | 20 | 13517 |
| SCNN1A-9669 | - | CUCAAGGGAGACUGGAGUUUC | 21 | 13518 |
| SCNN1A-9670 | - | GCUCAAGGGAGACUGGAGUUUC | 22 | 13519 |
| SCNN1A-9671 | - | GGCUCAAGGGAGACUGGAGUUUC | 23 | 13520 |
| SCNN1A-9672 | - | UGGCUCAAGGGAGACUGGAGUUUC | 24 | 13521 |
| SCNN1A-9673 | - | AGGAGGCAGGCCAGAAAG | 18 | 13522 |
| SCNN1A-9674 | - | GAGGAGGCAGGCCAGAAAG | 19 | 13523 |
| SCNN1A-6139 | - | AGAGGAGGCAGGCCAGAAAG | 20 | 9988 |
| SCNN1A-9675 | - | GAGAGGAGGCAGGCCAGAAAG | 21 | 13524 |
| SCNN1A-9676 | - | AGAGAGGAGGCAGGCCAGAAAG | 22 | 13525 |
| SCNN1A-9677 | - | GAGAGAGGAGGCAGGCCAGAAAG | 23 | 13526 |
| SCNN1A-9678 | - | AGAGAGAGGAGGCAGGCCAGAAAG | 24 | 13527 |

TABLE 47D-continued

4th Tier

| gRNA Name | DNA Strand | Targeting Domain | Target Site Length | Seq ID |
|---|---|---|---|---|
| SCNN1A-9679 | - | CUGCUGGCUCCAGGAAAG | 18 | 13528 |
| SCNN1A-9680 | - | UCUGCUGGCUCCAGGAAAG | 19 | 13529 |
| SCNN1A-9681 | - | GUCUGCUGGCUCCAGGAAAG | 20 | 13530 |
| SCNN1A-9682 | - | GGUCUGCUGGCUCCAGGAAAG | 21 | 13531 |
| SCNN1A-9683 | - | AGGUCUGCUGGCUCCAGGAAAG | 22 | 13532 |
| SCNN1A-9684 | - | CAGGUCUGCUGGCUCCAGGAAAG | 23 | 13533 |
| SCNN1A-9685 | - | GCAGGUCUGCUGGCUCCAGGAAAG | 24 | 13534 |
| SCNN1A-9686 | - | GAGGAAUCAGCAGGAAAG | 18 | 13535 |
| SCNN1A-9687 | - | CGAGGAAUCAGCAGGAAAG | 19 | 13536 |
| SCNN1A-5244 | - | GCGAGGAAUCAGCAGGAAAG | 20 | 9093 |
| SCNN1A-9688 | - | GGCGAGGAAUCAGCAGGAAAG | 21 | 13537 |
| SCNN1A-9689 | - | UGGCGAGGAAUCAGCAGGAAAG | 22 | 13538 |
| SCNN1A-9690 | - | GUGGCGAGGAAUCAGCAGGAAAG | 23 | 13539 |
| SCNN1A-9691 | - | GGUGGCGAGGAAUCAGCAGGAAAG | 24 | 13540 |
| SCNN1A-1980 | - | CUCAUGAAGGGGAACAAG | 18 | 5829 |
| SCNN1A-1981 | - | GCUCAUGAAGGGGAACAAG | 19 | 5830 |
| SCNN1A-1982 | - | GGCUCAUGAAGGGGAACAAG | 20 | 5831 |
| SCNN1A-1983 | - | GGGCUCAUGAAGGGGAACAAG | 21 | 5832 |
| SCNN1A-1984 | - | GGGGCUCAUGAAGGGGAACAAG | 22 | 5833 |
| SCNN1A-1985 | - | CGGGGCUCAUGAAGGGGAACAAG | 23 | 5834 |
| SCNN1A-1986 | - | CCGGGGCUCAUGAAGGGGAACAAG | 24 | 5835 |
| SCNN1A-1987 | - | CUCAUGGAGGGGAACAAG | 18 | 5836 |
| SCNN1A-1988 | - | UCUCAUGGAGGGGAACAAG | 19 | 5837 |
| SCNN1A-165 | - | GUCUCAUGGAGGGGAACAAG | 20 | 805 |
| SCNN1A-1989 | - | GGUCUCAUGGAGGGGAACAAG | 21 | 5838 |
| SCNN1A-1990 | - | AGGUCUCAUGGAGGGGAACAAG | 22 | 5839 |
| SCNN1A-1991 | - | CAGGUCUCAUGGAGGGGAACAAG | 23 | 5840 |
| SCNN1A-1992 | - | CCAGGUCUCAUGGAGGGGAACAAG | 24 | 5841 |
| SCNN1A-1993 | - | CCAGCUGUCCCUUCCAAG | 18 | 5842 |
| SCNN1A-1994 | - | UCCAGCUGUCCCUUCCAAG | 19 | 5843 |
| SCNN1A-412 | - | AUCCAGCUGUCCCUUCCAAG | 20 | 4261 |
| SCNN1A-9692 | - | AAUCCAGCUGUCCCUUCCAAG | 21 | 13541 |
| SCNN1A-9693 | - | AAAUCCAGCUGUCCCUUCCAAG | 22 | 13542 |
| SCNN1A-9694 | - | AAAAUCCAGCUGUCCCUUCCAAG | 23 | 13543 |
| SCNN1A-9695 | - | AAAAAUCCAGCUGUCCCUUCCAAG | 24 | 13544 |
| SCNN1A-9696 | - | GAGAGGGGCAAGGCAAG | 18 | 13545 |
| SCNN1A-9697 | - | UGAGAGGGGCAAGGCAAG | 19 | 13546 |
| SCNN1A-5246 | - | GUGAGAGGGGCAAGGCAAG | 20 | 9095 |

TABLE 47D-continued

4th Tier

| gRNA Name | DNA Strand | Targeting Domain | Target Site Length | Seq ID |
|---|---|---|---|---|
| SCNN1A-9698 | - | AGUGAGAGGGGGCAAGGCAAG | 21 | 13547 |
| SCNN1A-9699 | - | GAGUGAGAGGGGGCAAGGCAAG | 22 | 13548 |
| SCNN1A-9700 | - | AGAGUGAGAGGGGGCAAGGCAAG | 23 | 13549 |
| SCNN1A-9701 | - | UAGAGUGAGAGGGGGCAAGGCAAG | 24 | 13550 |
| SCNN1A-9702 | - | GUGGCCCUAUCAGGGAAG | 18 | 13551 |
| SCNN1A-9703 | - | GGUGGCCCUAUCAGGGAAG | 19 | 13552 |
| SCNN1A-9704 | - | AGGUGGCCCUAUCAGGGAAG | 20 | 13553 |
| SCNN1A-9705 | - | AAGGUGGCCCUAUCAGGGAAG | 21 | 13554 |
| SCNN1A-9706 | - | AAAGGUGGCCCUAUCAGGGAAG | 22 | 13555 |
| SCNN1A-9707 | - | GAAAGGUGGCCCUAUCAGGGAAG | 23 | 13556 |
| SCNN1A-9708 | - | CGAAAGGUGGCCCUAUCAGGGAAG | 24 | 13557 |
| SCNN1A-9709 | - | CAACCUGGGAGUGGGAAG | 18 | 13558 |
| SCNN1A-9710 | - | GCAACCUGGGAGUGGGAAG | 19 | 13559 |
| SCNN1A-9711 | - | CGCAACCUGGGAGUGGGAAG | 20 | 13560 |
| SCNN1A-9712 | - | CCGCAACCUGGGAGUGGGAAG | 21 | 13561 |
| SCNN1A-9713 | - | GCCGCAACCUGGGAGUGGGAAG | 22 | 13562 |
| SCNN1A-9714 | - | AGCCGCAACCUGGGAGUGGGAAG | 23 | 13563 |
| SCNN1A-9715 | - | CAGCCGCAACCUGGGAGUGGGAAG | 24 | 13564 |
| SCNN1A-2001 | - | ACUCCGGGGCUCAUGAAG | 18 | 5850 |
| SCNN1A-2002 | - | CACUCCGGGGCUCAUGAAG | 19 | 5851 |
| SCNN1A-453 | - | CCACUCCGGGGCUCAUGAAG | 20 | 4302 |
| SCNN1A-2003 | - | UCCACUCCGGGGCUCAUGAAG | 21 | 5852 |
| SCNN1A-2004 | - | AUCCACUCCGGGGCUCAUGAAG | 22 | 5853 |
| SCNN1A-2005 | - | AAUCCACUCCGGGGCUCAUGAAG | 23 | 5854 |
| SCNN1A-2006 | - | CAAUCCACUCCGGGGCUCAUGAAG | 24 | 5855 |
| SCNN1A-9716 | - | GCAACUCUGUGACCACAG | 18 | 13565 |
| SCNN1A-9717 | - | UGCAACUCUGUGACCACAG | 19 | 13566 |
| SCNN1A-9718 | - | CUGCAACUCUGUGACCACAG | 20 | 13567 |
| SCNN1A-9719 | - | CCUGCAACUCUGUGACCACAG | 21 | 13568 |
| SCNN1A-9720 | - | UCCUGCAACUCUGUGACCACAG | 22 | 13569 |
| SCNN1A-9721 | - | UUCCUGCAACUCUGUGACCACAG | 23 | 13570 |
| SCNN1A-9722 | - | AUUCCUGCAACUCUGUGACCACAG | 24 | 13571 |
| SCNN1A-9723 | - | GGAAAGAGGAGGGACCAG | 18 | 13572 |
| SCNN1A-9724 | - | AGGAAAGAGGAGGGACCAG | 19 | 13573 |
| SCNN1A-9725 | - | CAGGAAAGAGGAGGGACCAG | 20 | 13574 |
| SCNN1A-9726 | - | GCAGGAAAGAGGAGGGACCAG | 21 | 13575 |
| SCNN1A-9727 | - | AGCAGGAAAGAGGAGGGACCAG | 22 | 13576 |

TABLE 47D-continued

4th Tier

| gRNA Name | DNA Strand | Targeting Domain | Target Site Length | Seq ID |
|---|---|---|---|---|
| SCNN1A-9728 | - | CAGCAGGAAAGAGGAGGGACCAG | 23 | 13577 |
| SCNN1A-9729 | - | UCAGCAGGAAAGAGGAGGGACCAG | 24 | 13578 |
| SCNN1A-9730 | - | CUAAGUAGAUAGCCCCAG | 18 | 13579 |
| SCNN1A-9731 | - | GCUAAGUAGAUAGCCCCAG | 19 | 13580 |
| SCNN1A-5646 | - | CGCUAAGUAGAUAGCCCCAG | 20 | 9495 |
| SCNN1A-9732 | - | GCGCUAAGUAGAUAGCCCCAG | 21 | 13581 |
| SCNN1A-9733 | - | AGCGCUAAGUAGAUAGCCCCAG | 22 | 13582 |
| SCNN1A-9734 | - | AAGCGCUAAGUAGAUAGCCCCAG | 23 | 13583 |
| SCNN1A-9735 | - | AAAGCGCUAAGUAGAUAGCCCCAG | 24 | 13584 |
| SCNN1A-9736 | - | GCCCUAUCAGGGAAGCAG | 18 | 13585 |
| SCNN1A-9737 | - | GGCCCUAUCAGGGAAGCAG | 19 | 13586 |
| SCNN1A-5649 | - | UGGCCCUAUCAGGGAAGCAG | 20 | 9498 |
| SCNN1A-9738 | - | GUGGCCCUAUCAGGGAAGCAG | 21 | 13587 |
| SCNN1A-9739 | - | GGUGGCCCUAUCAGGGAAGCAG | 22 | 13588 |
| SCNN1A-9740 | - | AGGUGGCCCUAUCAGGGAAGCAG | 23 | 13589 |
| SCNN1A-9741 | - | AAGGUGGCCCUAUCAGGGAAGCAG | 24 | 13590 |
| SCNN1A-9742 | - | CCAGAAAGAGGAGAGCAG | 18 | 13591 |
| SCNN1A-9743 | - | GCCAGAAAGAGGAGAGCAG | 19 | 13592 |
| SCNN1A-9744 | - | GGCCAGAAAGAGGAGAGCAG | 20 | 13593 |
| SCNN1A-9745 | - | AGGCCAGAAAGAGGAGAGCAG | 21 | 13594 |
| SCNN1A-9746 | - | CAGGCCAGAAAGAGGAGAGCAG | 22 | 13595 |
| SCNN1A-9747 | - | GCAGGCCAGAAAGAGGAGAGCAG | 23 | 13596 |
| SCNN1A-9748 | - | GGCAGGCCAGAAAGAGGAGAGCAG | 24 | 13597 |
| SCNN1A-9749 | - | CUGGGAUAUGUGGGGCAG | 18 | 13598 |
| SCNN1A-9750 | - | UCUGGGAUAUGUGGGGCAG | 19 | 13599 |
| SCNN1A-5651 | - | CUCUGGGAUAUGUGGGGCAG | 20 | 9500 |
| SCNN1A-9751 | - | UCUCUGGGAUAUGUGGGGCAG | 21 | 13600 |
| SCNN1A-9752 | - | GUCUCUGGGAUAUGUGGGGCAG | 22 | 13601 |
| SCNN1A-9753 | - | GGUCUCUGGGAUAUGUGGGGCAG | 23 | 13602 |
| SCNN1A-9754 | - | GGGUCUCUGGGAUAUGUGGGGCAG | 24 | 13603 |
| SCNN1A-9755 | - | GGGGUGGCGAGGAAUCAG | 18 | 13604 |
| SCNN1A-9756 | - | GGGGGUGGCGAGGAAUCAG | 19 | 13605 |
| SCNN1A-9757 | - | AGGGGGUGGCGAGGAAUCAG | 20 | 13606 |
| SCNN1A-9758 | - | GAGGGGGUGGCGAGGAAUCAG | 21 | 13607 |
| SCNN1A-9759 | - | GGAGGGGGUGGCGAGGAAUCAG | 22 | 13608 |
| SCNN1A-9760 | - | UGGAGGGGGUGGCGAGGAAUCAG | 23 | 13609 |
| SCNN1A-9761 | - | UUGGAGGGGGUGGCGAGGAAUCAG | 24 | 13610 |
| SCNN1A-9762 | - | GGCCGCUGCACCUGUCAG | 18 | 13611 |

TABLE 47D-continued

4th Tier

| gRNA Name | DNA Strand | Targeting Domain | Target Site Length | Seq ID |
|---|---|---|---|---|
| SCNN1A-9763 | - | AGGCCGCUGCACCUGUCAG | 19 | 13612 |
| SCNN1A-9764 | - | CAGGCCGCUGCACCUGUCAG | 20 | 13613 |
| SCNN1A-9765 | - | CCAGGCCGCUGCACCUGUCAG | 21 | 13614 |
| SCNN1A-9766 | - | GCCAGGCCGCUGCACCUGUCAG | 22 | 13615 |
| SCNN1A-9767 | - | AGCCAGGCCGCUGCACCUGUCAG | 23 | 13616 |
| SCNN1A-9768 | - | CAGCCAGGCCGCUGCACCUGUCAG | 24 | 13617 |
| SCNN1A-9769 | - | UUGCUUGUCAAGAUUCAG | 18 | 13618 |
| SCNN1A-9770 | - | CUUGCUUGUCAAGAUUCAG | 19 | 13619 |
| SCNN1A-9771 | - | CCUUGCUUGUCAAGAUUCAG | 20 | 13620 |
| SCNN1A-9772 | - | UCCUUGCUUGUCAAGAUUCAG | 21 | 13621 |
| SCNN1A-9773 | - | CUCCUUGCUUGUCAAGAUUCAG | 22 | 13622 |
| SCNN1A-9774 | - | ACUCCUUGCUUGUCAAGAUUCAG | 23 | 13623 |
| SCNN1A-9775 | - | AACUCCUUGCUUGUCAAGAUUCAG | 24 | 13624 |
| SCNN1A-9776 | - | GAGGCAGGCCAGAAAGAG | 18 | 13625 |
| SCNN1A-9777 | - | GGAGGCAGGCCAGAAAGAG | 19 | 13626 |
| SCNN1A-9778 | - | AGGAGGCAGGCCAGAAAGAG | 20 | 13627 |
| SCNN1A-9779 | - | GAGGAGGCAGGCCAGAAAGAG | 21 | 13628 |
| SCNN1A-9780 | - | AGAGGAGGCAGGCCAGAAAGAG | 22 | 13629 |
| SCNN1A-9781 | - | GAGAGGAGGCAGGCCAGAAAGAG | 23 | 13630 |
| SCNN1A-9782 | - | AGAGAGGAGGCAGGCCAGAAAGAG | 24 | 13631 |
| SCNN1A-9783 | - | GGAAUCAGCAGGAAAGAG | 18 | 13632 |
| SCNN1A-9784 | - | AGGAAUCAGCAGGAAAGAG | 19 | 13633 |
| SCNN1A-9785 | - | GAGGAAUCAGCAGGAAAGAG | 20 | 13634 |
| SCNN1A-9786 | - | CGAGGAAUCAGCAGGAAAGAG | 21 | 13635 |
| SCNN1A-9787 | - | GCGAGGAAUCAGCAGGAAAGAG | 22 | 13636 |
| SCNN1A-9788 | - | GGCGAGGAAUCAGCAGGAAAGAG | 23 | 13637 |
| SCNN1A-9789 | - | UGGCGAGGAAUCAGCAGGAAAGAG | 24 | 13638 |
| SCNN1A-9790 | - | AAGAGACUGCCGCAAGAG | 18 | 13639 |
| SCNN1A-9791 | - | CAAGAGACUGCCGCAAGAG | 19 | 13640 |
| SCNN1A-5249 | - | GCAAGAGACUGCCGCAAGAG | 20 | 9098 |
| SCNN1A-9792 | - | CGCAAGAGACUGCCGCAAGAG | 21 | 13641 |
| SCNN1A-9793 | - | UCGCAAGAGACUGCCGCAAGAG | 22 | 13642 |
| SCNN1A-9794 | - | GUCGCAAGAGACUGCCGCAAGAG | 23 | 13643 |
| SCNN1A-9795 | - | AGUCGCAAGAGACUGCCGCAAGAG | 24 | 13644 |
| SCNN1A-9796 | - | AAGUAGAUAGCCCCAGAG | 18 | 13645 |
| SCNN1A-9797 | - | UAAGUAGAUAGCCCCAGAG | 19 | 13646 |
| SCNN1A-9798 | - | CUAAGUAGAUAGCCCCAGAG | 20 | 13647 |

TABLE 47D-continued

4th Tier

| gRNA Name | DNA Strand | Targeting Domain | Target Site Length | Seq ID |
|---|---|---|---|---|
| SCNN1A-9799 | - | GCUAAGUAGAUAGCCCCAGAG | 21 | 13648 |
| SCNN1A-9800 | - | CGCUAAGUAGAUAGCCCCAGAG | 22 | 13649 |
| SCNN1A-9801 | - | GCGCUAAGUAGAUAGCCCCAGAG | 23 | 13650 |
| SCNN1A-9802 | - | AGCGCUAAGUAGAUAGCCCCAGAG | 24 | 13651 |
| SCNN1A-9803 | - | CCUAUCAGGGAAGCAGAG | 18 | 13652 |
| SCNN1A-9804 | - | CCCUAUCAGGGAAGCAGAG | 19 | 13653 |
| SCNN1A-9805 | - | GCCCUAUCAGGGAAGCAGAG | 20 | 13654 |
| SCNN1A-9806 | - | GGCCCUAUCAGGGAAGCAGAG | 21 | 13655 |
| SCNN1A-9807 | - | UGGCCCUAUCAGGGAAGCAGAG | 22 | 13656 |
| SCNN1A-9808 | - | GUGGCCCUAUCAGGGAAGCAGAG | 23 | 13657 |
| SCNN1A-9809 | - | GGUGGCCCUAUCAGGGAAGCAGAG | 24 | 13658 |
| SCNN1A-9810 | - | AGAGGCAGGAUUAGAGAG | 18 | 13659 |
| SCNN1A-9811 | - | GAGAGGCAGGAUUAGAGAG | 19 | 13660 |
| SCNN1A-6147 | - | AGAGAGGCAGGAUUAGAGAG | 20 | 9996 |
| SCNN1A-9812 | - | AAGAGAGGCAGGAUUAGAGAG | 21 | 13661 |
| SCNN1A-9813 | - | GAAGAGAGGCAGGAUUAGAGAG | 22 | 13662 |
| SCNN1A-9814 | - | GGAAGAGAGGCAGGAUUAGAGAG | 23 | 13663 |
| SCNN1A-9815 | - | AGGAAGAGAGGCAGGAUUAGAGAG | 24 | 13664 |
| SCNN1A-9816 | - | AGGCCAGAAAGAGGAGAG | 18 | 13665 |
| SCNN1A-9817 | - | CAGGCCAGAAAGAGGAGAG | 19 | 13666 |
| SCNN1A-9818 | - | GCAGGCCAGAAAGAGGAGAG | 20 | 13667 |
| SCNN1A-9819 | - | GGCAGGCCAGAAAGAGGAGAG | 21 | 13668 |
| SCNN1A-9820 | - | AGGCAGGCCAGAAAGAGGAGAG | 22 | 13669 |
| SCNN1A-9821 | - | GAGGCAGGCCAGAAAGAGGAGAG | 23 | 13670 |
| SCNN1A-9822 | - | GGAGGCAGGCCAGAAAGAGGAGAG | 24 | 13671 |
| SCNN1A-9823 | - | AACAGAAGGCAGAUAGAG | 18 | 13672 |
| SCNN1A-9824 | - | AAACAGAAGGCAGAUAGAG | 19 | 13673 |
| SCNN1A-5250 | - | GAAACAGAAGGCAGAUAGAG | 20 | 9099 |
| SCNN1A-9825 | - | AGAAACAGAAGGCAGAUAGAG | 21 | 13674 |
| SCNN1A-9826 | - | GAGAAACAGAAGGCAGAUAGAG | 22 | 13675 |
| SCNN1A-9827 | - | AGAGAAACAGAAGGCAGAUAGAG | 23 | 13676 |
| SCNN1A-9828 | - | AAGAGAAACAGAAGGCAGAUAGAG | 24 | 13677 |
| SCNN1A-9829 | - | GGGAGUGAGAGGCAGGAG | 18 | 13678 |
| SCNN1A-9830 | - | AGGGAGUGAGAGGCAGGAG | 19 | 13679 |
| SCNN1A-9831 | - | GAGGGAGUGAGAGGCAGGAG | 20 | 13680 |
| SCNN1A-9832 | - | AGAGGGAGUGAGAGGCAGGAG | 21 | 13681 |
| SCNN1A-9833 | - | GAGAGGGAGUGAGAGGCAGGAG | 22 | 13682 |
| SCNN1A-9834 | - | AGAGAGGGAGUGAGAGGCAGGAG | 23 | 13683 |

TABLE 47D-continued

4th Tier

| gRNA Name | DNA Strand | Targeting Domain | Target Site Length | Seq ID |
|---|---|---|---|---|
| SCNN1A-9835 | - | UAGAGAGGGAGUGAGAGGCAGGAG | 24 | 13684 |
| SCNN1A-9836 | - | UAGAUAGCCCCAGAGGAG | 18 | 13685 |
| SCNN1A-9837 | - | GUAGAUAGCCCCAGAGGAG | 19 | 13686 |
| SCNN1A-9838 | - | AGUAGAUAGCCCCAGAGGAG | 20 | 13687 |
| SCNN1A-9839 | - | AAGUAGAUAGCCCCAGAGGAG | 21 | 13688 |
| SCNN1A-9840 | - | UAAGUAGAUAGCCCCAGAGGAG | 22 | 13689 |
| SCNN1A-9841 | - | CUAAGUAGAUAGCCCCAGAGGAG | 23 | 13690 |
| SCNN1A-9842 | - | GCUAAGUAGAUAGCCCCAGAGGAG | 24 | 13691 |
| SCNN1A-9843 | - | GGAGGAGGGAGGGAGGAG | 18 | 13692 |
| SCNN1A-9844 | - | UGGAGGAGGGAGGGAGGAG | 19 | 13693 |
| SCNN1A-5897 | - | GUGGAGGAGGGAGGGAGGAG | 20 | 9746 |
| SCNN1A-9845 | - | GGUGGAGGAGGGAGGGAGGAG | 21 | 13694 |
| SCNN1A-9846 | - | AGGUGGAGGAGGGAGGGAGGAG | 22 | 13695 |
| SCNN1A-9847 | - | AAGGUGGAGGAGGGAGGGAGGAG | 23 | 13696 |
| SCNN1A-9848 | - | AAAGGUGGAGGAGGGAGGGAGGAG | 24 | 13697 |
| SCNN1A-2007 | - | GGGAACAAGCUGGAGGAG | 18 | 5856 |
| SCNN1A-2008 | - | GGGGAACAAGCUGGAGGAG | 19 | 5857 |
| SCNN1A-169 | - | AGGGGAACAAGCUGGAGGAG | 20 | 807 |
| SCNN1A-2009 | - | AAGGGGAACAAGCUGGAGGAG | 21 | 5858 |
| SCNN1A-2010 | - | GAAGGGGAACAAGCUGGAGGAG | 22 | 5859 |
| SCNN1A-2011 | - | UGAAGGGGAACAAGCUGGAGGAG | 23 | 5860 |
| SCNN1A-2012 | - | AUGAAGGGGAACAAGCUGGAGGAG | 24 | 5861 |
| SCNN1A-2013 | - | GAGGGGAACAAGCUGGAGGAG | 21 | 5862 |
| SCNN1A-2014 | - | GGAGGGGAACAAGCUGGAGGAG | 22 | 5863 |
| SCNN1A-2015 | - | UGGAGGGGAACAAGCUGGAGGAG | 23 | 5864 |
| SCNN1A-2016 | - | AUGGAGGGGAACAAGCUGGAGGAG | 24 | 5865 |
| SCNN1A-9849 | - | CUGUCAGGUGAGGGGAG | 18 | 13698 |
| SCNN1A-9850 | - | CCUGUCAGGUGAGGGGAG | 19 | 13699 |
| SCNN1A-9851 | - | ACCUGUCAGGUGAGGGGAG | 20 | 13700 |
| SCNN1A-9852 | - | CACCUGUCAGGUGAGGGGAG | 21 | 13701 |
| SCNN1A-9853 | - | GCACCUGUCAGGUGAGGGGAG | 22 | 13702 |
| SCNN1A-9854 | - | UGCACCUGUCAGGUGAGGGGAG | 23 | 13703 |
| SCNN1A-9855 | - | CUGCACCUGUCAGGUGAGGGGAG | 24 | 13704 |
| SCNN1A-9856 | - | GCAAGGCAAGGGGGGAG | 18 | 13705 |
| SCNN1A-9857 | - | GGCAAGGCAAGGGGGGAG | 19 | 13706 |
| SCNN1A-5900 | - | GGGCAAGGCAAGGGGGGAG | 20 | 9749 |
| SCNN1A-9858 | - | GGGGCAAGGCAAGGGGGGAG | 21 | 13707 |

TABLE 47D-continued

4th Tier

| gRNA Name | DNA Strand | Targeting Domain | Target Site Length | Seq ID |
|---|---|---|---|---|
| SCNN1A-9859 | - | GGGGGCAAGGCAAGGGGGGAG | 22 | 13708 |
| SCNN1A-9860 | - | AGGGGGCAAGGCAAGGGGGGAG | 23 | 13709 |
| SCNN1A-9861 | - | GAGGGGGCAAGGCAAGGGGGGAG | 24 | 13710 |
| SCNN1A-9862 | - | CCAGCCGCAACCUGGGAG | 18 | 13711 |
| SCNN1A-9863 | - | UCCAGCCGCAACCUGGGAG | 19 | 13712 |
| SCNN1A-5251 | - | GUCCAGCCGCAACCUGGGAG | 20 | 9100 |
| SCNN1A-9864 | - | AGUCCAGCCGCAACCUGGGAG | 21 | 13713 |
| SCNN1A-9865 | - | CAGUCCAGCCGCAACCUGGGAG | 22 | 13714 |
| SCNN1A-9866 | - | CCAGUCCAGCCGCAACCUGGGAG | 23 | 13715 |
| SCNN1A-9867 | - | CCCAGUCCAGCCGCAACCUGGGAG | 24 | 13716 |
| SCNN1A-2029 | - | AUACCAGGUCUCAUGGAG | 18 | 5878 |
| SCNN1A-2030 | - | CAUACCAGGUCUCAUGGAG | 19 | 5879 |
| SCNN1A-4 | - | CCAUACCAGGUCUCAUGGAG | 20 | 498 |
| SCNN1A-2031 | - | CCCAUACCAGGUCUCAUGGAG | 21 | 5880 |
| SCNN1A-2032 | - | GCCCAUACCAGGUCUCAUGGAG | 22 | 5881 |
| SCNN1A-2033 | - | AGCCCAUACCAGGUCUCAUGGAG | 23 | 5882 |
| SCNN1A-2034 | - | CAGCCCAUACCAGGUCUCAUGGAG | 24 | 5883 |
| SCNN1A-9868 | - | CAGGGCCAGAGGCUGGAG | 18 | 13717 |
| SCNN1A-9869 | - | UCAGGGCCAGAGGCUGGAG | 19 | 13718 |
| SCNN1A-9870 | - | GUCAGGGCCAGAGGCUGGAG | 20 | 13719 |
| SCNN1A-9871 | - | GGUCAGGGCCAGAGGCUGGAG | 21 | 13720 |
| SCNN1A-9872 | - | AGGUCAGGGCCAGAGGCUGGAG | 22 | 13721 |
| SCNN1A-9873 | - | GAGGUCAGGGCCAGAGGCUGGAG | 23 | 13722 |
| SCNN1A-9874 | - | CGAGGUCAGGGCCAGAGGCUGGAG | 24 | 13723 |
| SCNN1A-9875 | - | GCUCCAGGAAAGGUGGAG | 18 | 13724 |
| SCNN1A-9876 | - | GGCUCCAGGAAAGGUGGAG | 19 | 13725 |
| SCNN1A-9877 | - | UGGCUCCAGGAAAGGUGGAG | 20 | 13726 |
| SCNN1A-9878 | - | CUGGCUCCAGGAAAGGUGGAG | 21 | 13727 |
| SCNN1A-9879 | - | GCUGGCUCCAGGAAAGGUGGAG | 22 | 13728 |
| SCNN1A-9880 | - | UGCUGGCUCCAGGAAAGGUGGAG | 23 | 13729 |
| SCNN1A-9881 | - | CUGCUGGCUCCAGGAAAGGUGGAG | 24 | 13730 |
| SCNN1A-9882 | - | CUGAGGGCCUAGAGUGAG | 18 | 13731 |
| SCNN1A-9883 | - | GCUGAGGGCCUAGAGUGAG | 19 | 13732 |
| SCNN1A-5657 | - | AGCUGAGGGCCUAGAGUGAG | 20 | 9506 |
| SCNN1A-9884 | - | GAGCUGAGGGCCUAGAGUGAG | 21 | 13733 |
| SCNN1A-9885 | - | GGAGCUGAGGGCCUAGAGUGAG | 22 | 13734 |
| SCNN1A-9886 | - | UGGAGCUGAGGGCCUAGAGUGAG | 23 | 13735 |
| SCNN1A-9887 | - | CUGGAGCUGAGGGCCUAGAGUGAG | 24 | 13736 |

TABLE 47D-continued

4th Tier

| gRNA Name | DNA Strand | Targeting Domain | Target Site Length | Seq ID |
|---|---|---|---|---|
| SCNN1A-9888 | - | CUGCUCCCACUUAGUGAG | 18 | 13737 |
| SCNN1A-9889 | - | GCUGCUCCCACUUAGUGAG | 19 | 13738 |
| SCNN1A-5658 | - | CGCUGCUCCCACUUAGUGAG | 20 | 9507 |
| SCNN1A-9890 | - | GCGCUGCUCCCACUUAGUGAG | 21 | 13739 |
| SCNN1A-9891 | - | UGCGCUGCUCCCACUUAGUGAG | 22 | 13740 |
| SCNN1A-9892 | - | GUGCGCUGCUCCCACUUAGUGAG | 23 | 13741 |
| SCNN1A-9893 | - | AGUGCGCUGCUCCCACUUAGUGAG | 24 | 13742 |
| SCNN1A-9894 | - | CUGCACCUGUCAGGUGAG | 18 | 13743 |
| SCNN1A-9895 | - | GCUGCACCUGUCAGGUGAG | 19 | 13744 |
| SCNN1A-5659 | - | CGCUGCACCUGUCAGGUGAG | 20 | 9508 |
| SCNN1A-9896 | - | CCGCUGCACCUGUCAGGUGAG | 21 | 13745 |
| SCNN1A-9897 | - | GCCGCUGCACCUGUCAGGUGAG | 22 | 13746 |
| SCNN1A-9898 | - | GGCCGCUGCACCUGUCAGGUGAG | 23 | 13747 |
| SCNN1A-9899 | - | AGGCCGCUGCACCUGUCAGGUGAG | 24 | 13748 |
| SCNN1A-9900 | - | GCUCCCACUUAGUGAGCG | 18 | 13749 |
| SCNN1A-9901 | - | UGCUCCCACUUAGUGAGCG | 19 | 13750 |
| SCNN1A-5668 | - | CUGCUCCCACUUAGUGAGCG | 20 | 9517 |
| SCNN1A-9902 | - | GCUGCUCCCACUUAGUGAGCG | 21 | 13751 |
| SCNN1A-9903 | - | CGCUGCUCCCACUUAGUGAGCG | 22 | 13752 |
| SCNN1A-9904 | - | GCGCUGCUCCCACUUAGUGAGCG | 23 | 13753 |
| SCNN1A-9905 | - | UGCGCUGCUCCCACUUAGUGAGCG | 24 | 13754 |
| SCNN1A-9906 | - | GCUGGCAAAUAGAAAAGG | 18 | 13755 |
| SCNN1A-9907 | - | AGCUGGCAAAUAGAAAAGG | 19 | 13756 |
| SCNN1A-9908 | - | GAGCUGGCAAAUAGAAAAGG | 20 | 13757 |
| SCNN1A-9909 | - | UGAGCUGGCAAAUAGAAAAGG | 21 | 13758 |
| SCNN1A-9910 | - | AUGAGCUGGCAAAUAGAAAAGG | 22 | 13759 |
| SCNN1A-9911 | - | CAUGAGCUGGCAAAUAGAAAAGG | 23 | 13760 |
| SCNN1A-9912 | - | GCAUGAGCUGGCAAAUAGAAAAGG | 24 | 13761 |
| SCNN1A-9913 | - | GAGGAAGAAGACCAAAGG | 18 | 13762 |
| SCNN1A-9914 | - | GGAGGAAGAAGACCAAAGG | 19 | 13763 |
| SCNN1A-9915 | - | UGGAGGAAGAAGACCAAAGG | 20 | 13764 |
| SCNN1A-9916 | - | CUGGAGGAAGAAGACCAAAGG | 21 | 13765 |
| SCNN1A-9917 | - | CCUGGAGGAAGAAGACCAAAGG | 22 | 13766 |
| SCNN1A-9918 | - | UCCUGGAGGAAGAAGACCAAAGG | 23 | 13767 |
| SCNN1A-9919 | - | AUCCUGGAGGAAGAAGACCAAAGG | 24 | 13768 |
| SCNN1A-9920 | - | UGCUGGCUCCAGGAAAGG | 18 | 13769 |
| SCNN1A-9921 | - | CUGCUGGCUCCAGGAAAGG | 19 | 13770 |

TABLE 47D-continued

| 4th Tier | | | | |
|---|---|---|---|---|
| gRNA Name | DNA Strand | Targeting Domain | Target Site Length | Seq ID |
| SCNN1A-6150 | − | UCUGCUGGCUCCAGGAAAGG | 20 | 9999 |
| SCNN1A-9922 | − | GUCUGCUGGCUCCAGGAAAGG | 21 | 13771 |
| SCNN1A-9923 | − | GGUCUGCUGGCUCCAGGAAAGG | 22 | 13772 |
| SCNN1A-9924 | − | AGGUCUGCUGGCUCCAGGAAAGG | 23 | 13773 |
| SCNN1A-9925 | − | CAGGUCUGCUGGCUCCAGGAAAGG | 24 | 13774 |
| SCNN1A-9926 | − | UCCCGGGUCUGGACAAGG | 18 | 13775 |
| SCNN1A-9927 | − | CUCCCGGGUCUGGACAAGG | 19 | 13776 |
| SCNN1A-9928 | − | CCUCCCGGGUCUGGACAAGG | 20 | 13777 |
| SCNN1A-9929 | − | CCCUCCCGGGUCUGGACAAGG | 21 | 13778 |
| SCNN1A-9930 | − | CCCCUCCCGGGUCUGGACAAGG | 22 | 13779 |
| SCNN1A-9931 | − | GCCCCUCCCGGGUCUGGACAAGG | 23 | 13780 |
| SCNN1A-9932 | − | GGCCCCUCCCGGGUCUGGACAAGG | 24 | 13781 |
| SCNN1A-9933 | − | AGAGGGGGCAAGGCAAGG | 18 | 13782 |
| SCNN1A-9934 | − | GAGAGGGGGCAAGGCAAGG | 19 | 13783 |
| SCNN1A-6152 | − | UGAGAGGGGGCAAGGCAAGG | 20 | 10001 |
| SCNN1A-9935 | − | GUGAGAGGGGGCAAGGCAAGG | 21 | 13784 |
| SCNN1A-9936 | − | AGUGAGAGGGGGCAAGGCAAGG | 22 | 13785 |
| SCNN1A-9937 | − | GAGUGAGAGGGGGCAAGGCAAGG | 23 | 13786 |
| SCNN1A-9938 | − | AGAGUGAGAGGGGGCAAGGCAAGG | 24 | 13787 |
| SCNN1A-9939 | − | AGGAAGCCACAGACCAGG | 18 | 13788 |
| SCNN1A-9940 | − | GAGGAAGCCACAGACCAGG | 19 | 13789 |
| SCNN1A-9941 | − | AGAGGAAGCCACAGACCAGG | 20 | 13790 |
| SCNN1A-9942 | − | GAGAGGAAGCCACAGACCAGG | 21 | 13791 |
| SCNN1A-9943 | − | AGAGAGGAAGCCACAGACCAGG | 22 | 13792 |
| SCNN1A-9944 | − | AAGAGAGGAAGCCACAGACCAGG | 23 | 13793 |
| SCNN1A-9945 | − | CAAGAGAGGAAGCCACAGACCAGG | 24 | 13794 |
| SCNN1A-9946 | − | GAAAGAGGAGGGACCAGG | 18 | 13795 |
| SCNN1A-9947 | − | GGAAAGAGGAGGGACCAGG | 19 | 13796 |
| SCNN1A-6153 | − | AGGAAAGAGGAGGGACCAGG | 20 | 10002 |
| SCNN1A-9948 | − | CAGGAAAGAGGAGGGACCAGG | 21 | 13797 |
| SCNN1A-9949 | − | GCAGGAAAGAGGAGGGACCAGG | 22 | 13798 |
| SCNN1A-9950 | − | AGCAGGAAAGAGGAGGGACCAGG | 23 | 13799 |
| SCNN1A-9951 | − | CAGCAGGAAAGAGGAGGGACCAGG | 24 | 13800 |
| SCNN1A-2047 | − | GGAGAAUGUGGGCGCAGG | 18 | 5896 |
| SCNN1A-2048 | − | GGGAGAAUGUGGGCGCAGG | 19 | 5897 |
| SCNN1A-2049 | − | UGGGAGAAUGUGGGCGCAGG | 20 | 5898 |
| SCNN1A-9952 | − | GUGGGAGAAUGUGGGCGCAGG | 21 | 13801 |
| SCNN1A-9953 | − | AGUGGGAGAAUGUGGGCGCAGG | 22 | 13802 |

TABLE 47D-continued

4th Tier

| gRNA Name | DNA Strand | Targeting Domain | Target Site Length | Seq ID |
|---|---|---|---|---|
| SCNN1A-9954 | - | GAGUGGGAGAAUGUGGGCGCAGG | 23 | 13803 |
| SCNN1A-9955 | - | GGAGUGGGAGAAUGUGGGCGCAGG | 24 | 13804 |
| SCNN1A-9956 | - | UGAGCACCUUAUUGCAGG | 18 | 13805 |
| SCNN1A-9957 | - | CUGAGCACCUUAUUGCAGG | 19 | 13806 |
| SCNN1A-9958 | - | GCUGAGCACCUUAUUGCAGG | 20 | 13807 |
| SCNN1A-9959 | - | UGCUGAGCACCUUAUUGCAGG | 21 | 13808 |
| SCNN1A-9960 | - | GUGCUGAGCACCUUAUUGCAGG | 22 | 13809 |
| SCNN1A-9961 | - | GGUGCUGAGCACCUUAUUGCAGG | 23 | 13810 |
| SCNN1A-9962 | - | GGGUGCUGAGCACCUUAUUGCAGG | 24 | 13811 |
| SCNN1A-9963 | - | UGUGUAUCAAUGCUCAGG | 18 | 13812 |
| SCNN1A-9964 | - | GUGUGUAUCAAUGCUCAGG | 19 | 13813 |
| SCNN1A-9965 | - | GGUGUGUAUCAAUGCUCAGG | 20 | 13814 |
| SCNN1A-9966 | - | CGGUGUGUAUCAAUGCUCAGG | 21 | 13815 |
| SCNN1A-9967 | - | CCGGUGUGUAUCAAUGCUCAGG | 22 | 13816 |
| SCNN1A-9968 | - | CCCGGUGUGUAUCAAUGCUCAGG | 23 | 13817 |
| SCNN1A-9969 | - | CCCCGGUGUGUAUCAAUGCUCAGG | 24 | 13818 |
| SCNN1A-9970 | - | GAAUCAGCAGGAAAGAGG | 18 | 13819 |
| SCNN1A-9971 | - | GGAAUCAGCAGGAAAGAGG | 19 | 13820 |
| SCNN1A-6155 | - | AGGAAUCAGCAGGAAAGAGG | 20 | 10004 |
| SCNN1A-9972 | - | GAGGAAUCAGCAGGAAAGAGG | 21 | 13821 |
| SCNN1A-9973 | - | CGAGGAAUCAGCAGGAAAGAGG | 22 | 13822 |
| SCNN1A-9974 | - | GCGAGGAAUCAGCAGGAAAGAGG | 23 | 13823 |
| SCNN1A-9975 | - | GGCGAGGAAUCAGCAGGAAAGAGG | 24 | 13824 |
| SCNN1A-9976 | - | AGUAGAUAGCCCCAGAGG | 18 | 13825 |
| SCNN1A-9977 | - | AAGUAGAUAGCCCCAGAGG | 19 | 13826 |
| SCNN1A-5678 | - | UAAGUAGAUAGCCCCAGAGG | 20 | 9527 |
| SCNN1A-9978 | - | CUAAGUAGAUAGCCCCAGAGG | 21 | 13827 |
| SCNN1A-9979 | - | GCUAAGUAGAUAGCCCCAGAGG | 22 | 13828 |
| SCNN1A-9980 | - | CGCUAAGUAGAUAGCCCCAGAGG | 23 | 13829 |
| SCNN1A-9981 | - | GCGCUAAGUAGAUAGCCCCAGAGG | 24 | 13830 |
| SCNN1A-9982 | - | CGAGGUCAGGGCCAGAGG | 18 | 13831 |
| SCNN1A-9983 | - | UCGAGGUCAGGGCCAGAGG | 19 | 13832 |
| SCNN1A-9984 | - | CUCGAGGUCAGGGCCAGAGG | 20 | 13833 |
| SCNN1A-9985 | - | GCUCGAGGUCAGGGCCAGAGG | 21 | 13834 |
| SCNN1A-9986 | - | AGCUCGAGGUCAGGGCCAGAGG | 22 | 13835 |
| SCNN1A-9987 | - | CAGCUCGAGGUCAGGGCCAGAGG | 23 | 13836 |
| SCNN1A-9988 | - | ACAGCUCGAGGUCAGGGCCAGAGG | 24 | 13837 |

TABLE 47D-continued

4th Tier

| gRNA Name | DNA Strand | Targeting Domain | Target Site Length | Seq ID |
|---|---|---|---|---|
| SCNN1A-9989 | - | AGGCAAGGGGGGAGAGG | 18 | 13838 |
| SCNN1A-9990 | - | AAGGCAAGGGGGGAGAGG | 19 | 13839 |
| SCNN1A-9991 | - | CAAGGCAAGGGGGGAGAGG | 20 | 13840 |
| SCNN1A-9992 | - | GCAAGGCAAGGGGGGAGAGG | 21 | 13841 |
| SCNN1A-9993 | - | GGCAAGGCAAGGGGGGAGAGG | 22 | 13842 |
| SCNN1A-9994 | - | GGGCAAGGCAAGGGGGGAGAGG | 23 | 13843 |
| SCNN1A-9995 | - | GGGGCAAGGCAAGGGGGGAGAGG | 24 | 13844 |
| SCNN1A-9996 | - | UAGAGAGGGAGUGAGAGG | 18 | 13845 |
| SCNN1A-9997 | - | AUAGAGAGGGAGUGAGAGG | 19 | 13846 |
| SCNN1A-9998 | - | GAUAGAGAGGGAGUGAGAGG | 20 | 13847 |
| SCNN1A-9999 | - | AGAUAGAGAGGGAGUGAGAGG | 21 | 13848 |
| SCNN1A-10000 | - | CAGAUAGAGAGGGAGUGAGAGG | 22 | 13849 |
| SCNN1A-10001 | - | GCAGAUAGAGAGGGAGUGAGAGG | 23 | 13850 |
| SCNN1A-10002 | - | GGCAGAUAGAGAGGGAGUGAGAGG | 24 | 13851 |
| SCNN1A-10003 | - | AGAUAGCCCCAGAGGAGG | 18 | 13852 |
| SCNN1A-10004 | - | UAGAUAGCCCCAGAGGAGG | 19 | 13853 |
| SCNN1A-5261 | - | GUAGAUAGCCCCAGAGGAGG | 20 | 9110 |
| SCNN1A-10005 | - | AGUAGAUAGCCCCAGAGGAGG | 21 | 13854 |
| SCNN1A-10006 | - | AAGUAGAUAGCCCCAGAGGAGG | 22 | 13855 |
| SCNN1A-10007 | - | UAAGUAGAUAGCCCCAGAGGAGG | 23 | 13856 |
| SCNN1A-10008 | - | CUAAGUAGAUAGCCCCAGAGGAGG | 24 | 13857 |
| SCNN1A-10009 | - | CAGGAAAGGUGGAGGAGG | 18 | 13858 |
| SCNN1A-10010 | - | CCAGGAAAGGUGGAGGAGG | 19 | 13859 |
| SCNN1A-10011 | - | UCCAGGAAAGGUGGAGGAGG | 20 | 13860 |
| SCNN1A-10012 | - | CUCCAGGAAAGGUGGAGGAGG | 21 | 13861 |
| SCNN1A-10013 | - | GCUCCAGGAAAGGUGGAGGAGG | 22 | 13862 |
| SCNN1A-10014 | - | GGCUCCAGGAAAGGUGGAGGAGG | 23 | 13863 |
| SCNN1A-10015 | - | UGGCUCCAGGAAAGGUGGAGGAGG | 24 | 13864 |
| SCNN1A-10016 | - | AAAGGUGGAGGAGGGAGG | 18 | 13865 |
| SCNN1A-10017 | - | GAAAGGUGGAGGAGGGAGG | 19 | 13866 |
| SCNN1A-10018 | - | GGAAAGGUGGAGGAGGGAGG | 20 | 13867 |
| SCNN1A-10019 | - | AGGAAAGGUGGAGGAGGGAGG | 21 | 13868 |
| SCNN1A-10020 | - | CAGGAAAGGUGGAGGAGGGAGG | 22 | 13869 |
| SCNN1A-10021 | - | CCAGGAAAGGUGGAGGAGGGAGG | 23 | 13870 |
| SCNN1A-10022 | - | UCCAGGAAAGGUGGAGGAGGGAGG | 24 | 13871 |
| SCNN1A-10023 | - | CUGGCUUGUGGAGGGAGG | 18 | 13872 |
| SCNN1A-10024 | - | GCUGGCUUGUGGAGGGAGG | 19 | 13873 |
| SCNN1A-10025 | - | UGCUGGCUUGUGGAGGGAGG | 20 | 13874 |

TABLE 47D-continued

4th Tier

| gRNA Name | DNA Strand | Targeting Domain | Target Site Length | Seq ID |
|---|---|---|---|---|
| SCNN1A-10026 | - | CUGCUGGCUUGUGGAGGGAGG | 21 | 13875 |
| SCNN1A-10027 | - | UCUGCUGGCUUGUGGAGGGAGG | 22 | 13876 |
| SCNN1A-10028 | - | GUCUGCUGGCUUGUGGAGGGAGG | 23 | 13877 |
| SCNN1A-10029 | - | UGUCUGCUGGCUUGUGGAGGGAGG | 24 | 13878 |
| SCNN1A-10030 | - | AGACACAGAUCCUGGAGG | 18 | 13879 |
| SCNN1A-10031 | - | GAGACACAGAUCCUGGAGG | 19 | 13880 |
| SCNN1A-10032 | - | UGAGACACAGAUCCUGGAGG | 20 | 13881 |
| SCNN1A-10033 | - | CUGAGACACAGAUCCUGGAGG | 21 | 13882 |
| SCNN1A-10034 | - | GCUGAGACACAGAUCCUGGAGG | 22 | 13883 |
| SCNN1A-10035 | - | AGCUGAGACACAGAUCCUGGAGG | 23 | 13884 |
| SCNN1A-10036 | - | GAGCUGAGACACAGAUCCUGGAGG | 24 | 13885 |
| SCNN1A-10037 | - | CUCCAGGAAAGGUGGAGG | 18 | 13886 |
| SCNN1A-10038 | - | GCUCCAGGAAAGGUGGAGG | 19 | 13887 |
| SCNN1A-5906 | - | GGCUCCAGGAAAGGUGGAGG | 20 | 9755 |
| SCNN1A-10039 | - | UGGCUCCAGGAAAGGUGGAGG | 21 | 13888 |
| SCNN1A-10040 | - | CUGGCUCCAGGAAAGGUGGAGG | 22 | 13889 |
| SCNN1A-10041 | - | GCUGGCUCCAGGAAAGGUGGAGG | 23 | 13890 |
| SCNN1A-10042 | - | UGCUGGCUCCAGGAAAGGUGGAGG | 24 | 13891 |
| SCNN1A-10043 | - | UCUCUGCAGGGCCUGAGG | 18 | 13892 |
| SCNN1A-10044 | - | UUCUCUGCAGGGCCUGAGG | 19 | 13893 |
| SCNN1A-10045 | - | CUUCUCUGCAGGGCCUGAGG | 20 | 13894 |
| SCNN1A-10046 | - | UCUUCUCUGCAGGGCCUGAGG | 21 | 13895 |
| SCNN1A-10047 | - | CUCUUCUCUGCAGGGCCUGAGG | 22 | 13896 |
| SCNN1A-10048 | - | UCUCUUCUCUGCAGGGCCUGAGG | 23 | 13897 |
| SCNN1A-10049 | - | CUCUCUUCUCUGCAGGGCCUGAGG | 24 | 13898 |
| SCNN1A-10050 | - | UGCACCUGUCAGGUGAGG | 18 | 13899 |
| SCNN1A-10051 | - | CUGCACCUGUCAGGUGAGG | 19 | 13900 |
| SCNN1A-5908 | - | GCUGCACCUGUCAGGUGAGG | 20 | 9757 |
| SCNN1A-10052 | - | CGCUGCACCUGUCAGGUGAGG | 21 | 13901 |
| SCNN1A-10053 | - | CCGCUGCACCUGUCAGGUGAGG | 22 | 13902 |
| SCNN1A-10054 | - | GCCGCUGCACCUGUCAGGUGAGG | 23 | 13903 |
| SCNN1A-10055 | - | GGCCGCUGCACCUGUCAGGUGAGG | 24 | 13904 |
| SCNN1A-10056 | - | UCCCUGGCCGGCCAGCGG | 18 | 13905 |
| SCNN1A-10057 | - | AUCCCUGGCCGGCCAGCGG | 19 | 13906 |
| SCNN1A-10058 | - | CAUCCCUGGCCGGCCAGCGG | 20 | 13907 |
| SCNN1A-10059 | - | CCAUCCCUGGCCGGCCAGCGG | 21 | 13908 |
| SCNN1A-10060 | - | UCCAUCCCUGGCCGGCCAGCGG | 22 | 13909 |

TABLE 47D-continued

4th Tier

| gRNA Name | DNA Strand | Targeting Domain | Target Site Length | Seq ID |
|---|---|---|---|---|
| SCNN1A-10061 | - | UUCCAUCCCUGGCCGGCCAGCGG | 23 | 13910 |
| SCNN1A-10062 | - | CUUCCAUCCCUGGCCGGCCAGCGG | 24 | 13911 |
| SCNN1A-10063 | - | GAGGGGGCAAGGCAAGGG | 18 | 13912 |
| SCNN1A-10064 | - | AGAGGGGGCAAGGCAAGGG | 19 | 13913 |
| SCNN1A-5910 | - | GAGAGGGGGCAAGGCAAGGG | 20 | 9759 |
| SCNN1A-10065 | - | UGAGAGGGGGCAAGGCAAGGG | 21 | 13914 |
| SCNN1A-10066 | - | GUGAGAGGGGGCAAGGCAAGGG | 22 | 13915 |
| SCNN1A-10067 | - | AGUGAGAGGGGGCAAGGCAAGGG | 23 | 13916 |
| SCNN1A-10068 | - | GAGUGAGAGGGGGCAAGGCAAGGG | 24 | 13917 |
| SCNN1A-2068 | - | GAGAAUGUGGGCGCAGGG | 18 | 5917 |
| SCNN1A-2069 | - | GGAGAAUGUGGGCGCAGGG | 19 | 5918 |
| SCNN1A-354 | - | GGGAGAAUGUGGGCGCAGGG | 20 | 4203 |
| SCNN1A-2070 | - | UGGGAGAAUGUGGGCGCAGGG | 21 | 5919 |
| SCNN1A-2071 | - | GUGGGAGAAUGUGGGCGCAGGG | 22 | 5920 |
| SCNN1A-2072 | - | AGUGGGAGAAUGUGGGCGCAGGG | 23 | 5921 |
| SCNN1A-2073 | - | GAGUGGGAGAAUGUGGGCGCAGGG | 24 | 5922 |
| SCNN1A-10069 | - | AGGAAAGGUGGAGGAGGG | 18 | 13918 |
| SCNN1A-10070 | - | CAGGAAAGGUGGAGGAGGG | 19 | 13919 |
| SCNN1A-6162 | - | CCAGGAAAGGUGGAGGAGGG | 20 | 10011 |
| SCNN1A-10071 | - | UCCAGGAAAGGUGGAGGAGGG | 21 | 13920 |
| SCNN1A-10072 | - | CUCCAGGAAAGGUGGAGGAGGG | 22 | 13921 |
| SCNN1A-10073 | - | GCUCCAGGAAAGGUGGAGGAGGG | 23 | 13922 |
| SCNN1A-10074 | - | GGCUCCAGGAAAGGUGGAGGAGGG | 24 | 13923 |
| SCNN1A-10075 | - | UCCCACUUAGUGAGCGGG | 18 | 13924 |
| SCNN1A-10076 | - | CUCCCACUUAGUGAGCGGG | 19 | 13925 |
| SCNN1A-10077 | - | GCUCCCACUUAGUGAGCGGG | 20 | 13926 |
| SCNN1A-10078 | - | UGCUCCCACUUAGUGAGCGGG | 21 | 13927 |
| SCNN1A-10079 | - | CUGCUCCCACUUAGUGAGCGGG | 22 | 13928 |
| SCNN1A-10080 | - | GCUGCUCCCACUUAGUGAGCGGG | 23 | 13929 |
| SCNN1A-10081 | - | CGCUGCUCCCACUUAGUGAGCGGG | 24 | 13930 |
| SCNN1A-10082 | - | AGGGGGCAAGGCAAGGGG | 18 | 13931 |
| SCNN1A-10083 | - | GAGGGGGCAAGGCAAGGGG | 19 | 13932 |
| SCNN1A-6163 | - | AGAGGGGGCAAGGCAAGGGG | 20 | 10012 |
| SCNN1A-10084 | - | GAGAGGGGGCAAGGCAAGGGG | 21 | 13933 |
| SCNN1A-10085 | - | UGAGAGGGGGCAAGGCAAGGGG | 22 | 13934 |
| SCNN1A-10086 | - | GUGAGAGGGGGCAAGGCAAGGGG | 23 | 13935 |
| SCNN1A-10087 | - | AGUGAGAGGGGGCAAGGCAAGGGG | 24 | 13936 |
| SCNN1A-10088 | - | CACCUGUCAGGUGAGGGG | 18 | 13937 |

TABLE 47D-continued

4th Tier

| gRNA Name | DNA Strand | Targeting Domain | Target Site Length | Seq ID |
|---|---|---|---|---|
| SCNN1A-10089 | - | GCACCUGUCAGGUGAGGGG | 19 | 13938 |
| SCNN1A-10090 | - | UGCACCUGUCAGGUGAGGGG | 20 | 13939 |
| SCNN1A-10091 | - | CUGCACCUGUCAGGUGAGGGG | 21 | 13940 |
| SCNN1A-10092 | - | GCUGCACCUGUCAGGUGAGGGG | 22 | 13941 |
| SCNN1A-10093 | - | CGCUGCACCUGUCAGGUGAGGGG | 23 | 13942 |
| SCNN1A-10094 | - | CCGCUGCACCUGUCAGGUGAGGGG | 24 | 13943 |
| SCNN1A-10095 | - | CCCACUUAGUGAGCGGGG | 18 | 13944 |
| SCNN1A-10096 | - | UCCCACUUAGUGAGCGGGG | 19 | 13945 |
| SCNN1A-5689 | - | CUCCCACUUAGUGAGCGGGG | 20 | 9538 |
| SCNN1A-10097 | - | GCUCCCACUUAGUGAGCGGGG | 21 | 13946 |
| SCNN1A-10098 | - | UGCUCCCACUUAGUGAGCGGGG | 22 | 13947 |
| SCNN1A-10099 | - | CUGCUCCCACUUAGUGAGCGGGG | 23 | 13948 |
| SCNN1A-10100 | - | GCUGCUCCCACUUAGUGAGCGGGG | 24 | 13949 |
| SCNN1A-10101 | - | AAGACCAAAGGAAGGGGG | 18 | 13950 |
| SCNN1A-10102 | - | GAAGACCAAAGGAAGGGGG | 19 | 13951 |
| SCNN1A-10103 | - | AGAAGACCAAAGGAAGGGGG | 20 | 13952 |
| SCNN1A-10104 | - | AAGAAGACCAAAGGAAGGGGG | 21 | 13953 |
| SCNN1A-10105 | - | GAAGAAGACCAAAGGAAGGGGG | 22 | 13954 |
| SCNN1A-10106 | - | GGAAGAAGACCAAAGGAAGGGGG | 23 | 13955 |
| SCNN1A-10107 | - | AGGAAGAAGACCAAAGGAAGGGGG | 24 | 13956 |
| SCNN1A-10108 | - | ACCUGUCAGGUGAGGGGG | 18 | 13957 |
| SCNN1A-10109 | - | CACCUGUCAGGUGAGGGGG | 19 | 13958 |
| SCNN1A-5914 | - | GCACCUGUCAGGUGAGGGGG | 20 | 9763 |
| SCNN1A-10110 | - | UGCACCUGUCAGGUGAGGGGG | 21 | 13959 |
| SCNN1A-10111 | - | CUGCACCUGUCAGGUGAGGGGG | 22 | 13960 |
| SCNN1A-10112 | - | GCUGCACCUGUCAGGUGAGGGGG | 23 | 13961 |
| SCNN1A-10113 | - | CGCUGCACCUGUCAGGUGAGGGGG | 24 | 13962 |
| SCNN1A-10114 | - | GGGGCAAGGCAAGGGGG | 18 | 13963 |
| SCNN1A-10115 | - | GGGGGCAAGGCAAGGGGG | 19 | 13964 |
| SCNN1A-10116 | - | AGGGGGCAAGGCAAGGGGG | 20 | 13965 |
| SCNN1A-10117 | - | GAGGGGGCAAGGCAAGGGGG | 21 | 13966 |
| SCNN1A-10118 | - | AGAGGGGGCAAGGCAAGGGGG | 22 | 13967 |
| SCNN1A-10119 | - | GAGAGGGGGCAAGGCAAGGGGG | 23 | 13968 |
| SCNN1A-10120 | - | UGAGAGGGGGCAAGGCAAGGGGG | 24 | 13969 |
| SCNN1A-10121 | - | AGCCCUGCAGUCCUGGGG | 18 | 13970 |
| SCNN1A-10122 | - | GAGCCCUGCAGUCCUGGGG | 19 | 13971 |
| SCNN1A-10123 | - | GGAGCCCUGCAGUCCUGGGG | 20 | 13972 |

TABLE 47D-continued

4th Tier

| gRNA Name | DNA Strand | Targeting Domain | Target Site Length | Seq ID |
|---|---|---|---|---|
| SCNN1A-10124 | - | UGGAGCCCUGCAGUCCUGGGG | 21 | 13973 |
| SCNN1A-10125 | - | CUGGAGCCCUGCAGUCCUGGGG | 22 | 13974 |
| SCNN1A-10126 | - | CCUGGAGCCCUGCAGUCCUGGGG | 23 | 13975 |
| SCNN1A-10127 | - | UCCUGGAGCCCUGCAGUCCUGGGG | 24 | 13976 |
| SCNN1A-2080 | - | CCAUACCAGGUCUCAUGG | 18 | 5929 |
| SCNN1A-2081 | - | CCCAUACCAGGUCUCAUGG | 19 | 5930 |
| SCNN1A-2 | - | GCCCAUACCAGGUCUCAUGG | 20 | 497 |
| SCNN1A-2082 | - | AGCCCAUACCAGGUCUCAUGG | 21 | 5931 |
| SCNN1A-2083 | - | CAGCCCAUACCAGGUCUCAUGG | 22 | 5932 |
| SCNN1A-2084 | - | GCAGCCCAUACCAGGUCUCAUGG | 23 | 5933 |
| SCNN1A-2085 | - | UGCAGCCCAUACCAGGUCUCAUGG | 24 | 5934 |
| SCNN1A-2086 | - | GGGUUCCAGGGGUGAUGG | 18 | 5935 |
| SCNN1A-2087 | - | CGGGUUCCAGGGGUGAUGG | 19 | 5936 |
| SCNN1A-2088 | - | UCGGGUUCCAGGGGUGAUGG | 20 | 5937 |
| SCNN1A-2089 | - | CUCGGGUUCCAGGGGUGAUGG | 21 | 5938 |
| SCNN1A-2090 | - | ACUCGGGUUCCAGGGGUGAUGG | 22 | 5939 |
| SCNN1A-2091 | - | CACUCGGGUUCCAGGGGUGAUGG | 23 | 5940 |
| SCNN1A-2092 | - | UCACUCGGGUUCCAGGGGUGAUGG | 24 | 5941 |
| SCNN1A-10128 | - | CUGAGACACAGAUCCUGG | 18 | 13977 |
| SCNN1A-10129 | - | GCUGAGACACAGAUCCUGG | 19 | 13978 |
| SCNN1A-5693 | - | AGCUGAGACACAGAUCCUGG | 20 | 9542 |
| SCNN1A-10130 | - | GAGCUGAGACACAGAUCCUGG | 21 | 13979 |
| SCNN1A-10131 | - | GGAGCUGAGACACAGAUCCUGG | 22 | 13980 |
| SCNN1A-10132 | - | AGGAGCUGAGACACAGAUCCUGG | 23 | 13981 |
| SCNN1A-10133 | - | CAGGAGCUGAGACACAGAUCCUGG | 24 | 13982 |
| SCNN1A-2093 | - | UGAAGGGGAACAAGCUGG | 18 | 5942 |
| SCNN1A-2094 | - | AUGAAGGGGAACAAGCUGG | 19 | 5943 |
| SCNN1A-455 | - | CAUGAAGGGGAACAAGCUGG | 20 | 4304 |
| SCNN1A-2095 | - | UCAUGAAGGGGAACAAGCUGG | 21 | 5944 |
| SCNN1A-2096 | - | CUCAUGAAGGGGAACAAGCUGG | 22 | 5945 |
| SCNN1A-2097 | - | GCUCAUGAAGGGGAACAAGCUGG | 23 | 5946 |
| SCNN1A-2098 | - | GGCUCAUGAAGGGGAACAAGCUGG | 24 | 5947 |
| SCNN1A-2099 | - | UGGAGGGGAACAAGCUGG | 18 | 5948 |
| SCNN1A-2100 | - | AUGGAGGGGAACAAGCUGG | 19 | 5949 |
| SCNN1A-6 | - | CAUGGAGGGGAACAAGCUGG | 20 | 558 |
| SCNN1A-2101 | - | UCAUGGAGGGGAACAAGCUGG | 21 | 5950 |
| SCNN1A-2102 | - | CUCAUGGAGGGGAACAAGCUGG | 22 | 5951 |
| SCNN1A-2103 | - | UCUCAUGGAGGGGAACAAGCUGG | 23 | 5952 |

TABLE 47D-continued

4th Tier

| gRNA Name | DNA Strand | Targeting Domain | Target Site Length | Seq ID |
|---|---|---|---|---|
| SCNN1A-2104 | - | GUCUCAUGGAGGGGAACAAGCUGG | 24 | 5953 |
| SCNN1A-10134 | - | UGGCUCCAGGAAAGGUGG | 18 | 13983 |
| SCNN1A-10135 | - | CUGGCUCCAGGAAAGGUGG | 19 | 13984 |
| SCNN1A-5266 | - | GCUGGCUCCAGGAAAGGUGG | 20 | 9115 |
| SCNN1A-10136 | - | UGCUGGCUCCAGGAAAGGUGG | 21 | 13985 |
| SCNN1A-10137 | - | CUGCUGGCUCCAGGAAAGGUGG | 22 | 13986 |
| SCNN1A-10138 | - | UCUGCUGGCUCCAGGAAAGGUGG | 23 | 13987 |
| SCNN1A-10139 | - | GUCUGCUGGCUCCAGGAAAGGUGG | 24 | 13988 |
| SCNN1A-10140 | - | UUGUCUGCUGGCUUGUGG | 18 | 13989 |
| SCNN1A-10141 | - | UUUGUCUGCUGGCUUGUGG | 19 | 13990 |
| SCNN1A-5695 | - | CUUUGUCUGCUGGCUUGUGG | 20 | 9544 |
| SCNN1A-10142 | - | CCUUUGUCUGCUGGCUUGUGG | 21 | 13991 |
| SCNN1A-10143 | - | GCCUUUGUCUGCUGGCUUGUGG | 22 | 13992 |
| SCNN1A-10144 | - | GGCCUUUGUCUGCUGGCUUGUGG | 23 | 13993 |
| SCNN1A-10145 | - | GGGCCUUUGUCUGCUGGCUUGUGG | 24 | 13994 |
| SCNN1A-10146 | - | GGGUCUGGACAAGGUUGG | 18 | 13995 |
| SCNN1A-10147 | - | CGGGUCUGGACAAGGUUGG | 19 | 13996 |
| SCNN1A-5697 | - | CCGGGUCUGGACAAGGUUGG | 20 | 9546 |
| SCNN1A-10148 | - | CCCGGGUCUGGACAAGGUUGG | 21 | 13997 |
| SCNN1A-10149 | - | UCCCGGGUCUGGACAAGGUUGG | 22 | 13998 |
| SCNN1A-10150 | - | CUCCCGGGUCUGGACAAGGUUGG | 23 | 13999 |
| SCNN1A-10151 | - | CCUCCCGGGUCUGGACAAGGUUGG | 24 | 14000 |
| SCNN1A-10152 | - | UUCUUCAUUAGGACAAUG | 18 | 14001 |
| SCNN1A-10153 | - | UUUCUUCAUUAGGACAAUG | 19 | 14002 |
| SCNN1A-10154 | - | GUUUCUUCAUUAGGACAAUG | 20 | 14003 |
| SCNN1A-10155 | - | AGUUUCUUCAUUAGGACAAUG | 21 | 14004 |
| SCNN1A-10156 | - | CAGUUUCUUCAUUAGGACAAUG | 22 | 14005 |
| SCNN1A-10157 | - | UCAGUUUCUUCAUUAGGACAAUG | 23 | 14006 |
| SCNN1A-10158 | - | GUCAGUUUCUUCAUUAGGACAAUG | 24 | 14007 |
| SCNN1A-2111 | - | UCCACUCCGGGGCUCAUG | 18 | 5960 |
| SCNN1A-2112 | - | AUCCACUCCGGGGCUCAUG | 19 | 5961 |
| SCNN1A-2113 | - | AAUCCACUCCGGGGCUCAUG | 20 | 5962 |
| SCNN1A-2114 | - | CAAUCCACUCCGGGGCUCAUG | 21 | 5963 |
| SCNN1A-2115 | - | CCAAUCCACUCCGGGGCUCAUG | 22 | 5964 |
| SCNN1A-2116 | - | CCCAAUCCACUCCGGGGCUCAUG | 23 | 5965 |
| SCNN1A-2117 | - | CCCCAAUCCACUCCGGGGCUCAUG | 24 | 5966 |
| SCNN1A-2118 | - | CCCAUACCAGGUCUCAUG | 18 | 5967 |

TABLE 47D-continued

4th Tier

| gRNA Name | DNA Strand | Targeting Domain | Target Site Length | Seq ID |
|---|---|---|---|---|
| SCNN1A-2119 | - | GCCCAUACCAGGUCUCAUG | 19 | 5968 |
| SCNN1A-161 | - | AGCCCAUACCAGGUCUCAUG | 20 | 804 |
| SCNN1A-2120 | - | CAGCCCAUACCAGGUCUCAUG | 21 | 5969 |
| SCNN1A-2121 | - | GCAGCCCAUACCAGGUCUCAUG | 22 | 5970 |
| SCNN1A-2122 | - | UGCAGCCCAUACCAGGUCUCAUG | 23 | 5971 |
| SCNN1A-2123 | - | CUGCAGCCCAUACCAGGUCUCAUG | 24 | 5972 |
| SCNN1A-10159 | - | AGGGGUCUCUGGGAUAUG | 18 | 14008 |
| SCNN1A-10160 | - | UAGGGGUCUCUGGGAUAUG | 19 | 14009 |
| SCNN1A-5700 | - | CUAGGGGUCUCUGGGAUAUG | 20 | 9549 |
| SCNN1A-10161 | - | UCUAGGGGUCUCUGGGAUAUG | 21 | 14010 |
| SCNN1A-10162 | - | UUCUAGGGGUCUCUGGGAUAUG | 22 | 14011 |
| SCNN1A-10163 | - | UUUCUAGGGGUCUCUGGGAUAUG | 23 | 14012 |
| SCNN1A-10164 | - | GUUUCUAGGGGUCUCUGGGAUAUG | 24 | 14013 |
| SCNN1A-10165 | - | GAGCGGGGAGGAGACCUG | 18 | 14014 |
| SCNN1A-10166 | - | UGAGCGGGGAGGAGACCUG | 19 | 14015 |
| SCNN1A-10167 | - | GUGAGCGGGGAGGAGACCUG | 20 | 14016 |
| SCNN1A-10168 | - | AGUGAGCGGGGAGGAGACCUG | 21 | 14017 |
| SCNN1A-10169 | - | UAGUGAGCGGGGAGGAGACCUG | 22 | 14018 |
| SCNN1A-10170 | - | UUAGUGAGCGGGGAGGAGACCUG | 23 | 14019 |
| SCNN1A-10171 | - | CUUAGUGAGCGGGGAGGAGACCUG | 24 | 14020 |
| SCNN1A-10172 | - | GCUGAGACACAGAUCCUG | 18 | 14021 |
| SCNN1A-10173 | - | AGCUGAGACACAGAUCCUG | 19 | 14022 |
| SCNN1A-10174 | - | GAGCUGAGACACAGAUCCUG | 20 | 14023 |
| SCNN1A-10175 | - | GGAGCUGAGACACAGAUCCUG | 21 | 14024 |
| SCNN1A-10176 | - | AGGAGCUGAGACACAGAUCCUG | 22 | 14025 |
| SCNN1A-10177 | - | CAGGAGCUGAGACACAGAUCCUG | 23 | 14026 |
| SCNN1A-10178 | - | GCAGGAGCUGAGACACAGAUCCUG | 24 | 14027 |
| SCNN1A-10179 | - | ACUCUGGGCUGCCUCCUG | 18 | 14028 |
| SCNN1A-10180 | - | CACUCUGGGCUGCCUCCUG | 19 | 14029 |
| SCNN1A-5269 | - | GCACUCUGGGCUGCCUCCUG | 20 | 9118 |
| SCNN1A-10181 | - | UGCACUCUGGGCUGCCUCCUG | 21 | 14030 |
| SCNN1A-10182 | - | CUGCACUCUGGGCUGCCUCCUG | 22 | 14031 |
| SCNN1A-10183 | - | CCUGCACUCUGGGCUGCCUCCUG | 23 | 14032 |
| SCNN1A-10184 | - | UCCUGCACUCUGGGCUGCCUCCUG | 24 | 14033 |
| SCNN1A-2124 | - | AUGAAGGGGAACAAGCUG | 18 | 5973 |
| SCNN1A-2125 | - | CAUGAAGGGGAACAAGCUG | 19 | 5974 |
| SCNN1A-2126 | - | UCAUGAAGGGGAACAAGCUG | 20 | 5975 |
| SCNN1A-2127 | - | CUCAUGAAGGGGAACAAGCUG | 21 | 5976 |

TABLE 47D-continued

4th Tier

| gRNA Name | DNA Strand | Targeting Domain | Target Site Length | Seq ID |
|---|---|---|---|---|
| SCNN1A-2128 | - | GCUCAUGAAGGGGAACAAGCUG | 22 | 5977 |
| SCNN1A-2129 | - | GGCUCAUGAAGGGGAACAAGCUG | 23 | 5978 |
| SCNN1A-2130 | - | GGGCUCAUGAAGGGGAACAAGCUG | 24 | 5979 |
| SCNN1A-2131 | - | AUGGAGGGGAACAAGCUG | 18 | 5980 |
| SCNN1A-2132 | - | CAUGGAGGGGAACAAGCUG | 19 | 5981 |
| SCNN1A-167 | - | UCAUGGAGGGGAACAAGCUG | 20 | 806 |
| SCNN1A-2133 | - | CUCAUGGAGGGGAACAAGCUG | 21 | 5982 |
| SCNN1A-2134 | - | UCUCAUGGAGGGGAACAAGCUG | 22 | 5983 |
| SCNN1A-2135 | - | GUCUCAUGGAGGGGAACAAGCUG | 23 | 5984 |
| SCNN1A-2136 | - | GGUCUCAUGGAGGGGAACAAGCUG | 24 | 5985 |
| SCNN1A-10185 | - | CCUCUUCUCUCUUCUCUG | 18 | 14034 |
| SCNN1A-10186 | - | ACCUCUUCUCUCUUCUCUG | 19 | 14035 |
| SCNN1A-10187 | - | GACCUCUUCUCUCUUCUCUG | 20 | 14036 |
| SCNN1A-10188 | - | AGACCUCUUCUCUCUUCUCUG | 21 | 14037 |
| SCNN1A-10189 | - | GAGACCUCUUCUCUCUUCUCUG | 22 | 14038 |
| SCNN1A-10190 | - | AGAGACCUCUUCUCUCUUCUCUG | 23 | 14039 |
| SCNN1A-10191 | - | CAGAGACCUCUUCUCUCUUCUCUG | 24 | 14040 |
| SCNN1A-10192 | - | GGGGCAGUGGGGACAGUG | 18 | 14041 |
| SCNN1A-10193 | - | UGGGGCAGUGGGGACAGUG | 19 | 14042 |
| SCNN1A-10194 | - | GUGGGGCAGUGGGGACAGUG | 20 | 14043 |
| SCNN1A-10195 | - | UGUGGGGCAGUGGGGACAGUG | 21 | 14044 |
| SCNN1A-10196 | - | AUGUGGGGCAGUGGGGACAGUG | 22 | 14045 |
| SCNN1A-10197 | - | UAUGUGGGGCAGUGGGGACAGUG | 23 | 14046 |
| SCNN1A-10198 | - | AUAUGUGGGGCAGUGGGGACAGUG | 24 | 14047 |
| SCNN1A-10199 | - | GGGCUCUGUGUGGGAGUG | 18 | 14048 |
| SCNN1A-10200 | - | CGGGCUCUGUGUGGGAGUG | 19 | 14049 |
| SCNN1A-5711 | - | ACGGGCUCUGUGUGGGAGUG | 20 | 9560 |
| SCNN1A-10201 | - | CACGGGCUCUGUGUGGGAGUG | 21 | 14050 |
| SCNN1A-10202 | - | CCACGGGCUCUGUGUGGGAGUG | 22 | 14051 |
| SCNN1A-10203 | - | UCCACGGGCUCUGUGUGGGAGUG | 23 | 14052 |
| SCNN1A-10204 | - | AUCCACGGGCUCUGUGUGGGAGUG | 24 | 14053 |
| SCNN1A-10205 | - | CCUCCUGUGGGGCCCGUG | 18 | 14054 |
| SCNN1A-10206 | - | GCCUCCUGUGGGGCCCGUG | 19 | 14055 |
| SCNN1A-5712 | - | UGCCUCCUGUGGGGCCCGUG | 20 | 9561 |
| SCNN1A-10207 | - | CUGCCUCCUGUGGGGCCCGUG | 21 | 14056 |
| SCNN1A-10208 | - | GCUGCCUCCUGUGGGGCCCGUG | 22 | 14057 |
| SCNN1A-10209 | - | GGCUGCCUCCUGUGGGGCCCGUG | 23 | 14058 |

TABLE 47D-continued

4th Tier

| gRNA Name | DNA Strand | Targeting Domain | Target Site Length | Seq ID |
|---|---|---|---|---|
| SCNN1A-10210 | - | GGGCUGCCUCCUGUGGGGCCCGUG | 24 | 14059 |
| SCNN1A-10211 | - | AGCCUUCCCUGCCGCGUG | 18 | 14060 |
| SCNN1A-10212 | - | CAGCCUUCCCUGCCGCGUG | 19 | 14061 |
| SCNN1A-10213 | - | GCAGCCUUCCCUGCCGCGUG | 20 | 14062 |
| SCNN1A-10214 | - | GGCAGCCUUCCCUGCCGCGUG | 21 | 14063 |
| SCNN1A-10215 | - | CGGCAGCCUUCCCUGCCGCGUG | 22 | 14064 |
| SCNN1A-10216 | - | GCGGCAGCCUUCCCUGCCGCGUG | 23 | 14065 |
| SCNN1A-10217 | - | AGCGGCAGCCUUCCCUGCCGCGUG | 24 | 14066 |
| SCNN1A-10218 | - | CUGGCUCCAGGAAAGGUG | 18 | 14067 |
| SCNN1A-10219 | - | GCUGGCUCCAGGAAAGGUG | 19 | 14068 |
| SCNN1A-10220 | - | UGCUGGCUCCAGGAAAGGUG | 20 | 14069 |
| SCNN1A-10221 | - | CUGCUGGCUCCAGGAAAGGUG | 21 | 14070 |
| SCNN1A-10222 | - | UCUGCUGGCUCCAGGAAAGGUG | 22 | 14071 |
| SCNN1A-10223 | - | GUCUGCUGGCUCCAGGAAAGGUG | 23 | 14072 |
| SCNN1A-10224 | - | GGUCUGCUGGCUCCAGGAAAGGUG | 24 | 14073 |
| SCNN1A-10225 | - | CGCUGCACCUGUCAGGUG | 18 | 14074 |
| SCNN1A-10226 | - | CCGCUGCACCUGUCAGGUG | 19 | 14075 |
| SCNN1A-5270 | - | GCCGCUGCACCUGUCAGGUG | 20 | 9119 |
| SCNN1A-10227 | - | GGCCGCUGCACCUGUCAGGUG | 21 | 14076 |
| SCNN1A-10228 | - | AGGCCGCUGCACCUGUCAGGUG | 22 | 14077 |
| SCNN1A-10229 | - | CAGGCCGCUGCACCUGUCAGGUG | 23 | 14078 |
| SCNN1A-10230 | - | CCAGGCCGCUGCACCUGUCAGGUG | 24 | 14079 |
| SCNN1A-10231 | - | GAUCAAACAGCCAGGGUG | 18 | 14080 |
| SCNN1A-10232 | - | AGAUCAAACAGCCAGGGUG | 19 | 14081 |
| SCNN1A-10233 | - | GAGAUCAAACAGCCAGGGUG | 20 | 14082 |
| SCNN1A-10234 | - | UGAGAUCAAACAGCCAGGGUG | 21 | 14083 |
| SCNN1A-10235 | - | UUGAGAUCAAACAGCCAGGGUG | 22 | 14084 |
| SCNN1A-10236 | - | UUUGAGAUCAAACAGCCAGGGUG | 23 | 14085 |
| SCNN1A-10237 | - | CUUUGAGAUCAAACAGCCAGGGUG | 24 | 14086 |
| SCNN1A-2143 | - | ACUCGGGUUCCAGGGGUG | 18 | 5992 |
| SCNN1A-2144 | - | CACUCGGGUUCCAGGGGUG | 19 | 5993 |
| SCNN1A-2145 | - | UCACUCGGGUUCCAGGGGUG | 20 | 5994 |
| SCNN1A-2146 | - | CUCACUCGGGUUCCAGGGGUG | 21 | 5995 |
| SCNN1A-2147 | - | CCUCACUCGGGUUCCAGGGGUG | 22 | 5996 |
| SCNN1A-2148 | - | GCCUCACUCGGGUUCCAGGGGUG | 23 | 5997 |
| SCNN1A-2149 | - | AGCCUCACUCGGGUUCCAGGGGUG | 24 | 5998 |
| SCNN1A-10238 | - | ACAAGGUUGGAGGGGUG | 18 | 14087 |
| SCNN1A-10239 | - | GACAAGGUUGGAGGGGUG | 19 | 14088 |

TABLE 47D-continued

4th Tier

| gRNA Name | DNA Strand | Targeting Domain | Target Site Length | Seq ID |
|---|---|---|---|---|
| SCNN1A-10240 | − | GGACAAGGUUGGAGGGGGUG | 20 | 14089 |
| SCNN1A-10241 | − | UGGACAAGGUUGGAGGGGGUG | 21 | 14090 |
| SCNN1A-10242 | − | CUGGACAAGGUUGGAGGGGGUG | 22 | 14091 |
| SCNN1A-10243 | − | UCUGGACAAGGUUGGAGGGGGUG | 23 | 14092 |
| SCNN1A-10244 | − | GUCUGGACAAGGUUGGAGGGGGUG | 24 | 14093 |
| SCNN1A-10245 | − | GAAUCCACGGGCUCUGUG | 18 | 14094 |
| SCNN1A-10246 | − | CGAAUCCACGGGCUCUGUG | 19 | 14095 |
| SCNN1A-5717 | − | ACGAAUCCACGGGCUCUGUG | 20 | 9566 |
| SCNN1A-10247 | − | GACGAAUCCACGGGCUCUGUG | 21 | 14096 |
| SCNN1A-10248 | − | AGACGAAUCCACGGGCUCUGUG | 22 | 14097 |
| SCNN1A-10249 | − | CAGACGAAUCCACGGGCUCUGUG | 23 | 14098 |
| SCNN1A-10250 | − | GCAGACGAAUCCACGGGCUCUGUG | 24 | 14099 |
| SCNN1A-10251 | − | UUUGUCUGCUGGCUUGUG | 18 | 14100 |
| SCNN1A-10252 | − | CUUUGUCUGCUGGCUUGUG | 19 | 14101 |
| SCNN1A-10253 | − | CCUUUGUCUGCUGGCUUGUG | 20 | 14102 |
| SCNN1A-10254 | − | GCCUUUGUCUGCUGGCUUGUG | 21 | 14103 |
| SCNN1A-10255 | − | GGCCUUUGUCUGCUGGCUUGUG | 22 | 14104 |
| SCNN1A-10256 | − | GGGCCUUUGUCUGCUGGCUUGUG | 23 | 14105 |
| SCNN1A-10257 | − | UGGGCCUUUGUCUGCUGGCUUGUG | 24 | 14106 |
| SCNN1A-10258 | − | GUGCUGAGCACCUUAUUG | 18 | 14107 |
| SCNN1A-10259 | − | GGUGCUGAGCACCUUAUUG | 19 | 14108 |
| SCNN1A-10260 | − | GGGUGCUGAGCACCUUAUUG | 20 | 14109 |
| SCNN1A-10261 | − | AGGGUGCUGAGCACCUUAUUG | 21 | 14110 |
| SCNN1A-10262 | − | CAGGGUGCUGAGCACCUUAUUG | 22 | 14111 |
| SCNN1A-10263 | − | CCAGGGUGCUGAGCACCUUAUUG | 23 | 14112 |
| SCNN1A-10264 | − | GCCAGGGUGCUGAGCACCUUAUUG | 24 | 14113 |
| SCNN1A-10265 | − | UGGAGGGCUGCCCACUUG | 18 | 14114 |
| SCNN1A-10266 | − | UUGGAGGGCUGCCCACUUG | 19 | 14115 |
| SCNN1A-10267 | − | CUUGGAGGGCUGCCCACUUG | 20 | 14116 |
| SCNN1A-10268 | − | CCUUGGAGGGCUGCCCACUUG | 21 | 14117 |
| SCNN1A-10269 | − | CCCUUGGAGGGCUGCCCACUUG | 22 | 14118 |
| SCNN1A-10270 | − | GCCCUUGGAGGGCUGCCCACUUG | 23 | 14119 |
| SCNN1A-10271 | − | UGCCCUUGGAGGGCUGCCCACUUG | 24 | 14120 |
| SCNN1A-10272 | − | GACCUGUGGGUGCCCUUG | 18 | 14121 |
| SCNN1A-10273 | − | UGACCUGUGGGUGCCCUUG | 19 | 14122 |
| SCNN1A-10274 | − | CUGACCUGUGGGUGCCCUUG | 20 | 14123 |
| SCNN1A-10275 | − | GCUGACCUGUGGGUGCCCUUG | 21 | 14124 |

TABLE 47D-continued

4th Tier

| gRNA Name | DNA Strand | Targeting Domain | Target Site Length | Seq ID |
|---|---|---|---|---|
| SCNN1A-10276 | − | GGCUGACCUGUGGGUGCCCUUG | 22 | 14125 |
| SCNN1A-10277 | − | AGGCUGACCUGUGGGUGCCCUUG | 23 | 14126 |
| SCNN1A-10278 | − | GAGGCUGACCUGUGGGUGCCCUUG | 24 | 14127 |
| SCNN1A-10279 | − | CCUUUGUCUGCUGGCUUG | 18 | 14128 |
| SCNN1A-10280 | − | GCCUUUGUCUGCUGGCUUG | 19 | 14129 |
| SCNN1A-5271 | − | GGCCUUUGUCUGCUGGCUUG | 20 | 9120 |
| SCNN1A-10281 | − | GGGCCUUUGUCUGCUGGCUUG | 21 | 14130 |
| SCNN1A-10282 | − | UGGGCCUUUGUCUGCUGGCUUG | 22 | 14131 |
| SCNN1A-10283 | − | CUGGGCCUUUGUCUGCUGGCUUG | 23 | 14132 |
| SCNN1A-10284 | − | GCUGGGCCUUUGUCUGCUGGCUUG | 24 | 14133 |
| SCNN1A-10285 | − | CGGGUCUGGACAAGGUUG | 18 | 14134 |
| SCNN1A-10286 | − | CCGGGUCUGGACAAGGUUG | 19 | 14135 |
| SCNN1A-10287 | − | CCCGGGUCUGGACAAGGUUG | 20 | 14136 |
| SCNN1A-10288 | − | UCCCGGGUCUGGACAAGGUUG | 21 | 14137 |
| SCNN1A-10289 | − | CUCCCGGGUCUGGACAAGGUUG | 22 | 14138 |
| SCNN1A-10290 | − | CCUCCCGGGUCUGGACAAGGUUG | 23 | 14139 |
| SCNN1A-10291 | − | CCCUCCCGGGUCUGGACAAGGUUG | 24 | 14140 |
| SCNN1A-10292 | − | GUUUGGAAAGAGAUUUUG | 18 | 14141 |
| SCNN1A-10293 | − | AGUUUGGAAAGAGAUUUUG | 19 | 14142 |
| SCNN1A-10294 | − | AAGUUUGGAAAGAGAUUUUG | 20 | 14143 |
| SCNN1A-10295 | − | UAAGUUUGGAAAGAGAUUUUG | 21 | 14144 |
| SCNN1A-10296 | − | UUAAGUUUGGAAAGAGAUUUUG | 22 | 14145 |
| SCNN1A-10297 | − | AUUAAGUUUGGAAAGAGAUUUUG | 23 | 14146 |
| SCNN1A-10298 | − | CAUUAAGUUUGGAAAGAGAUUUUG | 24 | 14147 |
| SCNN1A-10299 | − | GUCUUAUCUCUGAGAAAU | 18 | 14148 |
| SCNN1A-10300 | − | UGUCUUAUCUCUGAGAAAU | 19 | 14149 |
| SCNN1A-10301 | − | AUGUCUUAUCUCUGAGAAAU | 20 | 14150 |
| SCNN1A-10302 | − | UAUGUCUUAUCUCUGAGAAAU | 21 | 14151 |
| SCNN1A-10303 | − | UUAUGUCUUAUCUCUGAGAAAU | 22 | 14152 |
| SCNN1A-10304 | − | CUUAUGUCUUAUCUCUGAGAAAU | 23 | 14153 |
| SCNN1A-10305 | − | UCUUAUGUCUUAUCUCUGAGAAAU | 24 | 14154 |
| SCNN1A-10306 | − | CUGGGGCAGAGACAGAAU | 18 | 14155 |
| SCNN1A-10307 | − | CCUGGGGCAGAGACAGAAU | 19 | 14156 |
| SCNN1A-10308 | − | UCCUGGGGCAGAGACAGAAU | 20 | 14157 |
| SCNN1A-10309 | − | GUCCUGGGGCAGAGACAGAAU | 21 | 14158 |
| SCNN1A-10310 | − | AGUCCUGGGGCAGAGACAGAAU | 22 | 14159 |
| SCNN1A-10311 | − | CAGUCCUGGGGCAGAGACAGAAU | 23 | 14160 |
| SCNN1A-10312 | − | GCAGUCCUGGGGCAGAGACAGAAU | 24 | 14161 |

TABLE 47D-continued

4th Tier

| gRNA Name | DNA Strand | Targeting Domain | Target Site Length | Seq ID |
|---|---|---|---|---|
| SCNN1A-10313 | - | AGGGAGGAGUGGGAGAAU | 18 | 14162 |
| SCNN1A-10314 | - | GAGGGAGGAGUGGGAGAAU | 19 | 14163 |
| SCNN1A-10315 | - | GGAGGGAGGAGUGGGAGAAU | 20 | 14164 |
| SCNN1A-10316 | - | GGGAGGGAGGAGUGGGAGAAU | 21 | 14165 |
| SCNN1A-10317 | - | AGGGAGGGAGGAGUGGGAGAAU | 22 | 14166 |
| SCNN1A-10318 | - | GAGGGAGGGAGGAGUGGGAGAAU | 23 | 14167 |
| SCNN1A-10319 | - | GGAGGGAGGGAGGAGUGGGAGAAU | 24 | 14168 |
| SCNN1A-10320 | - | AAGGGUCAGUUUCUUCAU | 18 | 14169 |
| SCNN1A-10321 | - | GAAGGGUCAGUUUCUUCAU | 19 | 14170 |
| SCNN1A-10322 | - | GGAAGGGUCAGUUUCUUCAU | 20 | 14171 |
| SCNN1A-10323 | - | GGGAAGGGUCAGUUUCUUCAU | 21 | 14172 |
| SCNN1A-10324 | - | UGGGAAGGGUCAGUUUCUUCAU | 22 | 14173 |
| SCNN1A-10325 | - | UUGGGAAGGGUCAGUUUCUUCAU | 23 | 14174 |
| SCNN1A-10326 | - | CUUGGGAAGGGUCAGUUUCUUCAU | 24 | 14175 |
| SCNN1A-10327 | - | GAGGAAGAGAGGCAGGAU | 18 | 14176 |
| SCNN1A-10328 | - | AGAGGAAGAGAGGCAGGAU | 19 | 14177 |
| SCNN1A-10329 | - | GAGAGGAAGAGAGGCAGGAU | 20 | 14178 |
| SCNN1A-10330 | - | GGAGAGGAAGAGAGGCAGGAU | 21 | 14179 |
| SCNN1A-10331 | - | GGGAGAGGAAGAGAGGCAGGAU | 22 | 14180 |
| SCNN1A-10332 | - | GGGGAGAGGAAGAGAGGCAGGAU | 23 | 14181 |
| SCNN1A-10333 | - | GGGGGAGAGGAAGAGAGGCAGGAU | 24 | 14182 |
| SCNN1A-2150 | - | UCGGGUUCCAGGGGUGAU | 18 | 5999 |
| SCNN1A-2151 | - | CUCGGGUUCCAGGGGUGAU | 19 | 6000 |
| SCNN1A-421 | - | ACUCGGGUUCCAGGGGUGAU | 20 | 4270 |
| SCNN1A-2152 | - | CACUCGGGUUCCAGGGGUGAU | 21 | 6001 |
| SCNN1A-2153 | - | UCACUCGGGUUCCAGGGGUGAU | 22 | 6002 |
| SCNN1A-2154 | - | CUCACUCGGGUUCCAGGGGUGAU | 23 | 6003 |
| SCNN1A-2155 | - | CCUCACUCGGGUUCCAGGGGUGAU | 24 | 6004 |
| SCNN1A-10334 | - | UCUCACAGAGCCCUUGAU | 18 | 14183 |
| SCNN1A-10335 | - | UUCUCACAGAGCCCUUGAU | 19 | 14184 |
| SCNN1A-10336 | - | CUUCUCACAGAGCCCUUGAU | 20 | 14185 |
| SCNN1A-10337 | - | UCUUCUCACAGAGCCCUUGAU | 21 | 14186 |
| SCNN1A-10338 | - | UUCUUCUCACAGAGCCCUUGAU | 22 | 14187 |
| SCNN1A-10339 | - | AUUCUUCUCACAGAGCCCUUGAU | 23 | 14188 |
| SCNN1A-10340 | - | AAUUCUUCUCACAGAGCCCUUGAU | 24 | 14189 |
| SCNN1A-10341 | - | UAGGGGUCUCUGGGAUAU | 18 | 14190 |
| SCNN1A-10342 | - | CUAGGGGUCUCUGGGAUAU | 19 | 14191 |

TABLE 47D-continued

4th Tier

| gRNA Name | DNA Strand | Targeting Domain | Target Site Length | Seq ID |
|---|---|---|---|---|
| SCNN1A-10343 | - | UCUAGGGGUCUCUGGGAUAU | 20 | 14192 |
| SCNN1A-10344 | - | UUCUAGGGGUCUCUGGGAUAU | 21 | 14193 |
| SCNN1A-10345 | - | UUUCUAGGGGUCUCUGGGAUAU | 22 | 14194 |
| SCNN1A-10346 | - | GUUUCUAGGGGUCUCUGGGAUAU | 23 | 14195 |
| SCNN1A-10347 | - | AGUUUCUAGGGGUCUCUGGGAUAU | 24 | 14196 |
| SCNN1A-10348 | - | CUCGAAAGGUGGCCCUAU | 18 | 14197 |
| SCNN1A-10349 | - | ACUCGAAAGGUGGCCCUAU | 19 | 14198 |
| SCNN1A-10350 | - | AACUCGAAAGGUGGCCCUAU | 20 | 14199 |
| SCNN1A-10351 | - | AAACUCGAAAGGUGGCCCUAU | 21 | 14200 |
| SCNN1A-10352 | - | AAAACUCGAAAGGUGGCCCUAU | 22 | 14201 |
| SCNN1A-10353 | - | CAAAACUCGAAAGGUGGCCCUAU | 23 | 14202 |
| SCNN1A-10354 | - | ACAAAACUCGAAAGGUGGCCCUAU | 24 | 14203 |
| SCNN1A-10355 | - | AGCUCCUGGAAGCACACU | 18 | 14204 |
| SCNN1A-10356 | - | UAGCUCCUGGAAGCACACU | 19 | 14205 |
| SCNN1A-5727 | - | CUAGCUCCUGGAAGCACACU | 20 | 9576 |
| SCNN1A-10357 | - | UCUAGCUCCUGGAAGCACACU | 21 | 14206 |
| SCNN1A-10358 | - | CUCUAGCUCCUGGAAGCACACU | 22 | 14207 |
| SCNN1A-10359 | - | CCUCUAGCUCCUGGAAGCACACU | 23 | 14208 |
| SCNN1A-10360 | - | GCCUCUAGCUCCUGGAAGCACACU | 24 | 14209 |
| SCNN1A-2156 | - | UGCUCUCCCCAAUCCACU | 18 | 6005 |
| SCNN1A-2157 | - | UUGCUCUCCCCAAUCCACU | 19 | 6006 |
| SCNN1A-2158 | - | CUUGCUCUCCCCAAUCCACU | 20 | 6007 |
| SCNN1A-2159 | - | CCUUGCUCUCCCCAAUCCACU | 21 | 6008 |
| SCNN1A-2160 | - | CCCUUGCUCUCCCCAAUCCACU | 22 | 6009 |
| SCNN1A-2161 | - | ACCCUUGCUCUCCCCAAUCCACU | 23 | 6010 |
| SCNN1A-2162 | - | GACCCUUGCUCUCCCCAAUCCACU | 24 | 6011 |
| SCNN1A-2163 | - | GUGAUGGGAGAGGGCACU | 18 | 6012 |
| SCNN1A-2164 | - | GGUGAUGGGAGAGGGCACU | 19 | 6013 |
| SCNN1A-2165 | - | GGGUGAUGGGAGAGGGCACU | 20 | 6014 |
| SCNN1A-2166 | - | GGGGUGAUGGGAGAGGGCACU | 21 | 6015 |
| SCNN1A-2167 | - | AGGGGUGAUGGGAGAGGGCACU | 22 | 6016 |
| SCNN1A-2168 | - | CAGGGGUGAUGGGAGAGGGCACU | 23 | 6017 |
| SCNN1A-2169 | - | CCAGGGGUGAUGGGAGAGGGCACU | 24 | 6018 |
| SCNN1A-10361 | - | UGACCACAUUCCUGCACU | 18 | 14210 |
| SCNN1A-10362 | - | GUGACCACAUUCCUGCACU | 19 | 14211 |
| SCNN1A-10363 | - | AGUGACCACAUUCCUGCACU | 20 | 14212 |
| SCNN1A-10364 | - | CAGUGACCACAUUCCUGCACU | 21 | 14213 |
| SCNN1A-10365 | - | CCAGUGACCACAUUCCUGCACU | 22 | 14214 |

TABLE 47D-continued

4th Tier

| gRNA Name | DNA Strand | Targeting Domain | Target Site Length | Seq ID |
|---|---|---|---|---|
| SCNN1A-10366 | - | GCCAGUGACCACAUUCCUGCACU | 23 | 14215 |
| SCNN1A-10367 | - | AGCCAGUGACCACAUUCCUGCACU | 24 | 14216 |
| SCNN1A-10368 | - | AGGUGCUUUUCAGAACCU | 18 | 14217 |
| SCNN1A-10369 | - | GAGGUGCUUUUCAGAACCU | 19 | 14218 |
| SCNN1A-10370 | - | GGAGGUGCUUUUCAGAACCU | 20 | 14219 |
| SCNN1A-10371 | - | GGGAGGUGCUUUUCAGAACCU | 21 | 14220 |
| SCNN1A-10372 | - | AGGGAGGUGCUUUUCAGAACCU | 22 | 14221 |
| SCNN1A-10373 | - | CAGGGAGGUGCUUUUCAGAACCU | 23 | 14222 |
| SCNN1A-10374 | - | GCAGGGAGGUGCUUUUCAGAACCU | 24 | 14223 |
| SCNN1A-10375 | - | UAUUUUGUUUUCUAACCU | 18 | 14224 |
| SCNN1A-10376 | - | CUAUUUUGUUUUCUAACCU | 19 | 14225 |
| SCNN1A-10377 | - | CCUAUUUUGUUUUCUAACCU | 20 | 14226 |
| SCNN1A-10378 | - | UCCUAUUUUGUUUUCUAACCU | 21 | 14227 |
| SCNN1A-10379 | - | CUCCUAUUUUGUUUUCUAACCU | 22 | 14228 |
| SCNN1A-10380 | - | GCUCCUAUUUUGUUUUCUAACCU | 23 | 14229 |
| SCNN1A-10381 | - | UGCUCCUAUUUUGUUUUCUAACCU | 24 | 14230 |
| SCNN1A-10382 | - | UCCCAGUUCACCUGCCCU | 18 | 14231 |
| SCNN1A-10383 | - | CUCCCAGUUCACCUGCCCU | 19 | 14232 |
| SCNN1A-5736 | - | ACUCCCAGUUCACCUGCCCU | 20 | 9585 |
| SCNN1A-10384 | - | UACUCCCAGUUCACCUGCCCU | 21 | 14233 |
| SCNN1A-10385 | - | GUACUCCCAGUUCACCUGCCCU | 22 | 14234 |
| SCNN1A-10386 | - | AGUACUCCCAGUUCACCUGCCCU | 23 | 14235 |
| SCNN1A-10387 | - | CAGUACUCCCAGUUCACCUGCCCU | 24 | 14236 |
| SCNN1A-10388 | - | CUGACCUGGGGUGCCCU | 18 | 14237 |
| SCNN1A-10389 | - | GCUGACCUGUGGGUGCCCU | 19 | 14238 |
| SCNN1A-5274 | - | GGCUGACCUGUGGGUGCCCU | 20 | 9123 |
| SCNN1A-10390 | - | AGGCUGACCUGUGGGUGCCCU | 21 | 14239 |
| SCNN1A-10391 | - | GAGGCUGACCUGUGGGUGCCCU | 22 | 14240 |
| SCNN1A-10392 | - | UGAGGCUGACCUGUGGGUGCCCU | 23 | 14241 |
| SCNN1A-10393 | - | GUGAGGCUGACCUGUGGGUGCCCU | 24 | 14242 |
| SCNN1A-10394 | - | AGAAAACUGAUUUAUCCU | 18 | 14243 |
| SCNN1A-10395 | - | CAGAAAACUGAUUUAUCCU | 19 | 14244 |
| SCNN1A-6181 | - | UCAGAAAACUGAUUUAUCCU | 20 | 10030 |
| SCNN1A-10396 | - | CUCAGAAAACUGAUUUAUCCU | 21 | 14245 |
| SCNN1A-10397 | - | CCUCAGAAAACUGAUUUAUCCU | 22 | 14246 |
| SCNN1A-10398 | - | ACCUCAGAAAACUGAUUUAUCCU | 23 | 14247 |
| SCNN1A-10399 | - | AACCUCAGAAAACUGAUUUAUCCU | 24 | 14248 |

TABLE 47D-continued

4th Tier

| gRNA Name | DNA Strand | Targeting Domain | Target Site Length | Seq ID |
|---|---|---|---|---|
| SCNN1A-10400 | - | CACUCUGGGCUGCCUCCU | 18 | 14249 |
| SCNN1A-10401 | - | GCACUCUGGGCUGCCUCCU | 19 | 14250 |
| SCNN1A-10402 | - | UGCACUCUGGGCUGCCUCCU | 20 | 14251 |
| SCNN1A-10403 | - | CUGCACUCUGGGCUGCCUCCU | 21 | 14252 |
| SCNN1A-10404 | - | CCUGCACUCUGGGCUGCCUCCU | 22 | 14253 |
| SCNN1A-10405 | - | UCCUGCACUCUGGGCUGCCUCCU | 23 | 14254 |
| SCNN1A-10406 | - | UUCCUGCACUCUGGGCUGCCUCCU | 24 | 14255 |
| SCNN1A-10407 | - | UCGGGAGCCCUCCUUCCU | 18 | 14256 |
| SCNN1A-10408 | - | CUCGGGAGCCCUCCUUCCU | 19 | 14257 |
| SCNN1A-10409 | - | CCUCGGGAGCCCUCCUUCCU | 20 | 14258 |
| SCNN1A-10410 | - | CCCUCGGGAGCCCUCCUUCCU | 21 | 14259 |
| SCNN1A-10411 | - | GCCCUCGGGAGCCCUCCUUCCU | 22 | 14260 |
| SCNN1A-10412 | - | UGCCCUCGGGAGCCCUCCUUCCU | 23 | 14261 |
| SCNN1A-10413 | - | CUGCCCUCGGGAGCCCUCCUUCCU | 24 | 14262 |
| SCNN1A-10414 | - | GGGCCAGAGGCUGGAGCU | 18 | 14263 |
| SCNN1A-10415 | - | AGGGCCAGAGGCUGGAGCU | 19 | 14264 |
| SCNN1A-10416 | - | CAGGGCCAGAGGCUGGAGCU | 20 | 14265 |
| SCNN1A-10417 | - | UCAGGGCCAGAGGCUGGAGCU | 21 | 14266 |
| SCNN1A-10418 | - | GUCAGGGCCAGAGGCUGGAGCU | 22 | 14267 |
| SCNN1A-10419 | - | GGUCAGGGCCAGAGGCUGGAGCU | 23 | 14268 |
| SCNN1A-10420 | - | AGGUCAGGGCCAGAGGCUGGAGCU | 24 | 14269 |
| SCNN1A-10421 | - | UGUGUUGCCCUCCUAGCU | 18 | 14270 |
| SCNN1A-10422 | - | UUGUGUUGCCCUCCUAGCU | 19 | 14271 |
| SCNN1A-10423 | - | CUUGUGUUGCCCUCCUAGCU | 20 | 14272 |
| SCNN1A-10424 | - | CCUUGUGUUGCCCUCCUAGCU | 21 | 14273 |
| SCNN1A-10425 | - | UCCUUGUGUUGCCCUCCUAGCU | 22 | 14274 |
| SCNN1A-10426 | - | CUCCUUGUGUUGCCCUCCUAGCU | 23 | 14275 |
| SCNN1A-10427 | - | UCUCCUUGUGUUGCCCUCCUAGCU | 24 | 14276 |
| SCNN1A-10428 | - | GGCUCUUAUGUCUUAUCU | 18 | 14277 |
| SCNN1A-10429 | - | UGGCUCUUAUGUCUUAUCU | 19 | 14278 |
| SCNN1A-10430 | - | UUGGCUCUUAUGUCUUAUCU | 20 | 14279 |
| SCNN1A-10431 | - | CUUGGCUCUUAUGUCUUAUCU | 21 | 14280 |
| SCNN1A-10432 | - | CCUUGGCUCUUAUGUCUUAUCU | 22 | 14281 |
| SCNN1A-10433 | - | CCCUUGGCUCUUAUGUCUUAUCU | 23 | 14282 |
| SCNN1A-10434 | - | GCCCUUGGCUCUUAUGUCUUAUCU | 24 | 14283 |
| SCNN1A-10435 | - | CUCUUAUGUCUUAUCUCU | 18 | 14284 |
| SCNN1A-10436 | - | GCUCUUAUGUCUUAUCUCU | 19 | 14285 |
| SCNN1A-10437 | - | GGCUCUUAUGUCUUAUCUCU | 20 | 14286 |

TABLE 47D-continued

4th Tier

| gRNA Name | DNA Strand | Targeting Domain | Target Site Length | Seq ID |
|---|---|---|---|---|
| SCNN1A-10438 | - | UGGCUCUUAUGUCUUAUCUCU | 21 | 14287 |
| SCNN1A-10439 | - | UUGGCUCUUAUGUCUUAUCUCU | 22 | 14288 |
| SCNN1A-10440 | - | CUUGGCUCUUAUGUCUUAUCUCU | 23 | 14289 |
| SCNN1A-10441 | - | CCUUGGCUCUUAUGUCUUAUCUCU | 24 | 14290 |
| SCNN1A-10442 | - | AGAGAUGACACCUUCUCU | 18 | 14291 |
| SCNN1A-10443 | - | CAGAGAUGACACCUUCUCU | 19 | 14292 |
| SCNN1A-5926 | - | GCAGAGAUGACACCUUCUCU | 20 | 9775 |
| SCNN1A-10444 | - | AGCAGAGAUGACACCUUCUCU | 21 | 14293 |
| SCNN1A-10445 | - | CAGCAGAGAUGACACCUUCUCU | 22 | 14294 |
| SCNN1A-10446 | - | UCAGCAGAGAUGACACCUUCUCU | 23 | 14295 |
| SCNN1A-10447 | - | UUCAGCAGAGAUGACACCUUCUCU | 24 | 14296 |
| SCNN1A-10448 | - | UGGAGUUUCUAGGGGUCU | 18 | 14297 |
| SCNN1A-10449 | - | CUGGAGUUUCUAGGGGUCU | 19 | 14298 |
| SCNN1A-10450 | - | ACUGGAGUUUCUAGGGGUCU | 20 | 14299 |
| SCNN1A-10451 | - | GACUGGAGUUUCUAGGGGUCU | 21 | 14300 |
| SCNN1A-10452 | - | AGACUGGAGUUUCUAGGGGUCU | 22 | 14301 |
| SCNN1A-10453 | - | GAGACUGGAGUUUCUAGGGGUCU | 23 | 14302 |
| SCNN1A-10454 | - | GGAGACUGGAGUUUCUAGGGGUCU | 24 | 14303 |
| SCNN1A-10455 | - | UCCCCCAUGAGUCUGUCU | 18 | 14304 |
| SCNN1A-10456 | - | AUCCCCCAUGAGUCUGUCU | 19 | 14305 |
| SCNN1A-10457 | - | GAUCCCCCAUGAGUCUGUCU | 20 | 14306 |
| SCNN1A-10458 | - | CGAUCCCCCAUGAGUCUGUCU | 21 | 14307 |
| SCNN1A-10459 | - | CCGAUCCCCCAUGAGUCUGUCU | 22 | 14308 |
| SCNN1A-10460 | - | CCCGAUCCCCCAUGAGUCUGUCU | 23 | 14309 |
| SCNN1A-10461 | - | CCCCGAUCCCCCAUGAGUCUGUCU | 24 | 14310 |
| SCNN1A-10462 | - | GCAGAGAUGACACCUUCU | 18 | 14311 |
| SCNN1A-10463 | - | AGCAGAGAUGACACCUUCU | 19 | 14312 |
| SCNN1A-10464 | - | CAGCAGAGAUGACACCUUCU | 20 | 14313 |
| SCNN1A-10465 | - | UCAGCAGAGAUGACACCUUCU | 21 | 14314 |
| SCNN1A-10466 | - | UUCAGCAGAGAUGACACCUUCU | 22 | 14315 |
| SCNN1A-10467 | - | AUUCAGCAGAGAUGACACCUUCU | 23 | 14316 |
| SCNN1A-10468 | - | GAUUCAGCAGAGAUGACACCUUCU | 24 | 14317 |
| SCNN1A-10469 | - | CAGAGGAGAGGCCGUUCU | 18 | 14318 |
| SCNN1A-10470 | - | GCAGAGGAGAGGCCGUUCU | 19 | 14319 |
| SCNN1A-5750 | - | AGCAGAGGAGAGGCCGUUCU | 20 | 9599 |
| SCNN1A-10471 | - | AAGCAGAGGAGAGGCCGUUCU | 21 | 14320 |
| SCNN1A-10472 | - | GAAGCAGAGGAGAGGCCGUUCU | 22 | 14321 |

TABLE 47D-continued

| | | 4th Tier | | |
|---|---|---|---|---|
| gRNA Name | DNA Strand | Targeting Domain | Target Site Length | Seq ID |
| SCNN1A-10473 | - | GGAAGCAGAGGAGAGGCCGUUCU | 23 | 14322 |
| SCNN1A-10474 | - | GGGAAGCAGAGGAGAGGCCGUUCU | 24 | 14323 |
| SCNN1A-10475 | - | CCUUUUGCUGCAUUAAGU | 18 | 14324 |
| SCNN1A-10476 | - | UCCUUUUGCUGCAUUAAGU | 19 | 14325 |
| SCNN1A-10477 | - | AUCCUUUUGCUGCAUUAAGU | 20 | 14326 |
| SCNN1A-10478 | - | UAUCCUUUUGCUGCAUUAAGU | 21 | 14327 |
| SCNN1A-10479 | - | UUAUCCUUUUGCUGCAUUAAGU | 22 | 14328 |
| SCNN1A-10480 | - | CUUAUCCUUUUGCUGCAUUAAGU | 23 | 14329 |
| SCNN1A-10481 | - | CCUUAUCCUUUUGCUGCAUUAAGU | 24 | 14330 |
| SCNN1A-10482 | - | UGGGAUAUGUGGGGCAGU | 18 | 14331 |
| SCNN1A-10483 | - | CUGGGAUAUGUGGGGCAGU | 19 | 14332 |
| SCNN1A-5753 | - | UCUGGGAUAUGUGGGGCAGU | 20 | 9602 |
| SCNN1A-10484 | - | CUCUGGGAUAUGUGGGGCAGU | 21 | 14333 |
| SCNN1A-10485 | - | UCUCUGGGAUAUGUGGGGCAGU | 22 | 14334 |
| SCNN1A-10486 | - | GUCUCUGGGAUAUGUGGGGCAGU | 23 | 14335 |
| SCNN1A-10487 | - | GGUCUCUGGGAUAUGUGGGGCAGU | 24 | 14336 |
| SCNN1A-10488 | - | GAGCUGAGGGCCUAGAGU | 18 | 14337 |
| SCNN1A-10489 | - | GGAGCUGAGGGCCUAGAGU | 19 | 14338 |
| SCNN1A-10490 | - | UGGAGCUGAGGGCCUAGAGU | 20 | 14339 |
| SCNN1A-10491 | - | CUGGAGCUGAGGGCCUAGAGU | 21 | 14340 |
| SCNN1A-10492 | - | GCUGGAGCUGAGGGCCUAGAGU | 22 | 14341 |
| SCNN1A-10493 | - | GGCUGGAGCUGAGGGCCUAGAGU | 23 | 14342 |
| SCNN1A-10494 | - | AGGCUGGAGCUGAGGGCCUAGAGU | 24 | 14343 |
| SCNN1A-10495 | - | GAGGAGGGAGGGAGGAGU | 18 | 14344 |
| SCNN1A-10496 | - | GGAGGAGGGAGGGAGGAGU | 19 | 14345 |
| SCNN1A-6187 | - | UGGAGGAGGGAGGGAGGAGU | 20 | 10036 |
| SCNN1A-10497 | - | GUGGAGGAGGGAGGGAGGAGU | 21 | 14346 |
| SCNN1A-10498 | - | GGUGGAGGAGGGAGGGAGGAGU | 22 | 14347 |
| SCNN1A-10499 | - | AGGUGGAGGAGGGAGGGAGGAGU | 23 | 14348 |
| SCNN1A-10500 | - | AAGGUGGAGGAGGGAGGGAGGAGU | 24 | 14349 |
| SCNN1A-10501 | - | GGCAGAUAGAGAGGGAGU | 18 | 14350 |
| SCNN1A-10502 | - | AGGCAGAUAGAGAGGGAGU | 19 | 14351 |
| SCNN1A-10503 | - | AAGGCAGAUAGAGAGGGAGU | 20 | 14352 |
| SCNN1A-10504 | - | GAAGGCAGAUAGAGAGGGAGU | 21 | 14353 |
| SCNN1A-10505 | - | AGAAGGCAGAUAGAGAGGGAGU | 22 | 14354 |
| SCNN1A-10506 | - | CAGAAGGCAGAUAGAGAGGGAGU | 23 | 14355 |
| SCNN1A-10507 | - | ACAGAAGGCAGAUAGAGAGGGAGU | 24 | 14356 |
| SCNN1A-10508 | - | CAGCCGCAACCUGGGAGU | 18 | 14357 |

TABLE 47D-continued

| 4th Tier | | | | |
|---|---|---|---|---|
| gRNA Name | DNA Strand | Targeting Domain | Target Site Length | Seq ID |
| SCNN1A-10509 | - | CCAGCCGCAACCUGGGAGU | 19 | 14358 |
| SCNN1A-5754 | - | UCCAGCCGCAACCUGGGAGU | 20 | 9603 |
| SCNN1A-10510 | - | GUCCAGCCGCAACCUGGGAGU | 21 | 14359 |
| SCNN1A-10511 | - | AGUCCAGCCGCAACCUGGGAGU | 22 | 14360 |
| SCNN1A-10512 | - | CAGUCCAGCCGCAACCUGGGAGU | 23 | 14361 |
| SCNN1A-10513 | - | CCAGUCCAGCCGCAACCUGGGAGU | 24 | 14362 |
| SCNN1A-10514 | - | CGGGCUCUGUGUGGGAGU | 18 | 14363 |
| SCNN1A-10515 | - | ACGGGCUCUGUGUGGGAGU | 19 | 14364 |
| SCNN1A-10516 | - | CACGGGCUCUGUGUGGGAGU | 20 | 14365 |
| SCNN1A-10517 | - | CCACGGGCUCUGUGUGGGAGU | 21 | 14366 |
| SCNN1A-10518 | - | UCCACGGGCUCUGUGUGGGAGU | 22 | 14367 |
| SCNN1A-10519 | - | AUCCACGGGCUCUGUGUGGGAGU | 23 | 14368 |
| SCNN1A-10520 | - | AAUCCACGGGCUCUGUGUGGGAGU | 24 | 14369 |
| SCNN1A-10521 | - | GCCUCCUGUGGGGCCCGU | 18 | 14370 |
| SCNN1A-10522 | - | UGCCUCCUGUGGGGCCCGU | 19 | 14371 |
| SCNN1A-10523 | - | CUGCCUCCUGUGGGGCCCGU | 20 | 14372 |
| SCNN1A-10524 | - | GCUGCCUCCUGUGGGGCCCGU | 21 | 14373 |
| SCNN1A-10525 | - | GGCUGCCUCCUGUGGGGCCCGU | 22 | 14374 |
| SCNN1A-10526 | - | GGGCUGCCUCCUGUGGGGCCCGU | 23 | 14375 |
| SCNN1A-10527 | - | UGGGCUGCCUCCUGUGGGGCCCGU | 24 | 14376 |
| SCNN1A-10528 | - | CCCGGGUCUGGACAAGGU | 18 | 14377 |
| SCNN1A-10529 | - | UCCCGGGUCUGGACAAGGU | 19 | 14378 |
| SCNN1A-5755 | - | CUCCCGGGUCUGGACAAGGU | 20 | 9604 |
| SCNN1A-10530 | - | CCUCCCGGGUCUGGACAAGGU | 21 | 14379 |
| SCNN1A-10531 | - | CCCUCCCGGGUCUGGACAAGGU | 22 | 14380 |
| SCNN1A-10532 | - | CCCCUCCCGGGUCUGGACAAGGU | 23 | 14381 |
| SCNN1A-10533 | - | GCCCCUCCCGGGUCUGGACAAGGU | 24 | 14382 |
| SCNN1A-10534 | - | CCGCUGCACCUGUCAGGU | 18 | 14383 |
| SCNN1A-10535 | - | GCCGCUGCACCUGUCAGGU | 19 | 14384 |
| SCNN1A-10536 | - | GGCCGCUGCACCUGUCAGGU | 20 | 14385 |
| SCNN1A-10537 | - | AGGCCGCUGCACCUGUCAGGU | 21 | 14386 |
| SCNN1A-10538 | - | CAGGCCGCUGCACCUGUCAGGU | 22 | 14387 |
| SCNN1A-10539 | - | CCAGGCCGCUGCACCUGUCAGGU | 23 | 14388 |
| SCNN1A-10540 | - | GCCAGGCCGCUGCACCUGUCAGGU | 24 | 14389 |
| SCNN1A-10541 | - | CAGGACACAGCUCGAGGU | 18 | 14390 |
| SCNN1A-10542 | - | UCAGGACACAGCUCGAGGU | 19 | 14391 |
| SCNN1A-10543 | - | AUCAGGACACAGCUCGAGGU | 20 | 14392 |

TABLE 47D-continued

4th Tier

| gRNA Name | DNA Strand | Targeting Domain | Target Site Length | Seq ID |
|---|---|---|---|---|
| SCNN1A-10544 | - | AAUCAGGACACAGCUCGAGGU | 21 | 14393 |
| SCNN1A-10545 | - | GAAUCAGGACACAGCUCGAGGU | 22 | 14394 |
| SCNN1A-10546 | - | AGAAUCAGGACACAGCUCGAGGU | 23 | 14395 |
| SCNN1A-10547 | - | CAGAAUCAGGACACAGCUCGAGGU | 24 | 14396 |
| SCNN1A-10548 | - | CCUGGGCCCCUCCCGGGU | 18 | 14397 |
| SCNN1A-10549 | - | ACCUGGGCCCCUCCCGGGU | 19 | 14398 |
| SCNN1A-10550 | - | CACCUGGGCCCCUCCCGGGU | 20 | 14399 |
| SCNN1A-10551 | - | UCACCUGGGCCCCUCCCGGGU | 21 | 14400 |
| SCNN1A-10552 | - | UUCACCUGGGCCCCUCCCGGGU | 22 | 14401 |
| SCNN1A-10553 | - | CUUCACCUGGGCCCCUCCCGGGU | 23 | 14402 |
| SCNN1A-10554 | - | GCUUCACCUGGGCCCCUCCCGGGU | 24 | 14403 |
| SCNN1A-2176 | - | UAAGCAAGGGAACCUGGU | 18 | 6025 |
| SCNN1A-2177 | - | GUAAGCAAGGGAACCUGGU | 19 | 6026 |
| SCNN1A-2178 | - | GGUAAGCAAGGGAACCUGGU | 20 | 6027 |
| SCNN1A-2179 | - | AGGUAAGCAAGGGAACCUGGU | 21 | 6028 |
| SCNN1A-2180 | - | AAGGUAAGCAAGGGAACCUGGU | 22 | 6029 |
| SCNN1A-2181 | - | CAAGGUAAGCAAGGGAACCUGGU | 23 | 6030 |
| SCNN1A-2182 | - | UCAAGGUAAGCAAGGGAACCUGGU | 24 | 6031 |
| SCNN1A-10555 | - | GAGGACCAUGCCCAAUGU | 18 | 14404 |
| SCNN1A-10556 | - | GGAGGACCAUGCCCAAUGU | 19 | 14405 |
| SCNN1A-10557 | - | GGGAGGACCAUGCCCAAUGU | 20 | 14406 |
| SCNN1A-10558 | - | AGGGAGGACCAUGCCCAAUGU | 21 | 14407 |
| SCNN1A-10559 | - | CAGGGAGGACCAUGCCCAAUGU | 22 | 14408 |
| SCNN1A-10560 | - | GCAGGGAGGACCAUGCCCAAUGU | 23 | 14409 |
| SCNN1A-10561 | - | UGCAGGGAGGACCAUGCCCAAUGU | 24 | 14410 |
| SCNN1A-10562 | - | CGAAUCCACGGGCUCUGU | 18 | 14411 |
| SCNN1A-10563 | - | ACGAAUCCACGGGCUCUGU | 19 | 14412 |
| SCNN1A-10564 | - | GACGAAUCCACGGGCUCUGU | 20 | 14413 |
| SCNN1A-10565 | - | AGACGAAUCCACGGGCUCUGU | 21 | 14414 |
| SCNN1A-10566 | - | CAGACGAAUCCACGGGCUCUGU | 22 | 14415 |
| SCNN1A-10567 | - | GCAGACGAAUCCACGGGCUCUGU | 23 | 14416 |
| SCNN1A-10568 | - | AGCAGACGAAUCCACGGGCUCUGU | 24 | 14417 |
| SCNN1A-10569 | - | UGAGAUCUGCACUUUUGU | 18 | 14418 |
| SCNN1A-10570 | - | CUGAGAUCUGCACUUUUGU | 19 | 14419 |
| SCNN1A-10571 | - | UCUGAGAUCUGCACUUUUGU | 20 | 14420 |
| SCNN1A-10572 | - | AUCUGAGAUCUGCACUUUUGU | 21 | 14421 |
| SCNN1A-10573 | - | AAUCUGAGAUCUGCACUUUUGU | 22 | 14422 |
| SCNN1A-10574 | - | AAAUCUGAGAUCUGCACUUUUGU | 23 | 14423 |

TABLE 47D-continued

4th Tier

| gRNA Name | DNA Strand | Targeting Domain | Target Site Length | Seq ID |
|---|---|---|---|---|
| SCNN1A-10575 | - | GAAAUCUGAGAUCUGCACUUUUGU | 24 | 14424 |
| SCNN1A-10576 | - | UAAGUUUGGAAAGAGAUU | 18 | 14425 |
| SCNN1A-10577 | - | UUAAGUUUGGAAAGAGAUU | 19 | 14426 |
| SCNN1A-10578 | - | AUUAAGUUUGGAAAGAGAUU | 20 | 14427 |
| SCNN1A-10579 | - | CAUUAAGUUUGGAAAGAGAUU | 21 | 14428 |
| SCNN1A-10580 | - | GCAUUAAGUUUGGAAAGAGAUU | 22 | 14429 |
| SCNN1A-10581 | - | UGCAUUAAGUUUGGAAAGAGAUU | 23 | 14430 |
| SCNN1A-10582 | - | CUGCAUUAAGUUUGGAAAGAGAUU | 24 | 14431 |
| SCNN1A-10583 | - | GAAAACUGAUUUAUCCUU | 18 | 14432 |
| SCNN1A-10584 | - | AGAAAACUGAUUUAUCCUU | 19 | 14433 |
| SCNN1A-6189 | - | CAGAAAACUGAUUUAUCCUU | 20 | 10038 |
| SCNN1A-10585 | - | UCAGAAAACUGAUUUAUCCUU | 21 | 14434 |
| SCNN1A-10586 | - | CUCAGAAAACUGAUUUAUCCUU | 22 | 14435 |
| SCNN1A-10587 | - | CCUCAGAAAACUGAUUUAUCCUU | 23 | 14436 |
| SCNN1A-10588 | - | ACCUCAGAAAACUGAUUUAUCCUU | 24 | 14437 |
| SCNN1A-10589 | - | CGGGAGCCCUCCUUCCUU | 18 | 14438 |
| SCNN1A-10590 | - | UCGGGAGCCCUCCUUCCUU | 19 | 14439 |
| SCNN1A-5770 | - | CUCGGGAGCCCUCCUUCCUU | 20 | 9619 |
| SCNN1A-10591 | - | CCUCGGGAGCCCUCCUUCCUU | 21 | 14440 |
| SCNN1A-10592 | - | CCCUCGGGAGCCCUCCUUCCUU | 22 | 14441 |
| SCNN1A-10593 | - | GCCCUCGGGAGCCCUCCUUCCUU | 23 | 14442 |
| SCNN1A-10594 | - | UGCCCUCGGGAGCCCUCCUUCCUU | 24 | 14443 |
| SCNN1A-10595 | - | GCCUUUGUCUGCUGGCUU | 18 | 14444 |
| SCNN1A-10596 | - | GGCCUUUGUCUGCUGGCUU | 19 | 14445 |
| SCNN1A-10597 | - | GGGCCUUUGUCUGCUGGCUU | 20 | 14446 |
| SCNN1A-10598 | - | UGGGCCUUUGUCUGCUGGCUU | 21 | 14447 |
| SCNN1A-10599 | - | CUGGGCCUUUGUCUGCUGGCUU | 22 | 14448 |
| SCNN1A-10600 | - | GCUGGGCCUUUGUCUGCUGGCUU | 23 | 14449 |
| SCNN1A-10601 | - | GGCUGGGCCUUUGUCUGCUGGCUU | 24 | 14450 |
| SCNN1A-10602 | - | CUUUUGCUGCAUUAAGUU | 18 | 14451 |
| SCNN1A-10603 | - | CCUUUUGCUGCAUUAAGUU | 19 | 14452 |
| SCNN1A-5771 | - | UCCUUUUGCUGCAUUAAGUU | 20 | 9620 |
| SCNN1A-10604 | - | AUCCUUUUGCUGCAUUAAGUU | 21 | 14453 |
| SCNN1A-10605 | - | UAUCCUUUUGCUGCAUUAAGUU | 22 | 14454 |
| SCNN1A-10606 | - | UUAUCCUUUUGCUGCAUUAAGUU | 23 | 14455 |
| SCNN1A-10607 | - | CUUAUCCUUUUGCUGCAUUAAGUU | 24 | 14456 |
| SCNN1A-10608 | - | AAGUUUGGAAAGAGAUUU | 18 | 14457 |

TABLE 47D-continued

4th Tier

| gRNA Name | DNA Strand | Targeting Domain | Target Site Length | Seq ID |
|---|---|---|---|---|
| SCNN1A-10609 | - | UAAGUUUGGAAAGAGAUUU | 19 | 14458 |
| SCNN1A-5773 | - | UUAAGUUUGGAAAGAGAUUU | 20 | 9622 |
| SCNN1A-10610 | - | AUUAAGUUUGGAAAGAGAUUU | 21 | 14459 |
| SCNN1A-10611 | - | CAUUAAGUUUGGAAAGAGAUUU | 22 | 14460 |
| SCNN1A-10612 | - | GCAUUAAGUUUGGAAAGAGAUUU | 23 | 14461 |
| SCNN1A-10613 | - | UGCAUUAAGUUUGGAAAGAGAUUU | 24 | 14462 |
| SCNN1A-10614 | - | GACACCGGCUUUCACUUU | 18 | 14463 |
| SCNN1A-10615 | - | UGACACCGGCUUUCACUUU | 19 | 14464 |
| SCNN1A-10616 | - | UUGACACCGGCUUUCACUUU | 20 | 14465 |
| SCNN1A-10617 | - | GUUGACACCGGCUUUCACUUU | 21 | 14466 |
| SCNN1A-10618 | - | GGUUGACACCGGCUUUCACUUU | 22 | 14467 |
| SCNN1A-10619 | - | UGGUUGACACCGGCUUUCACUUU | 23 | 14468 |
| SCNN1A-10620 | - | CUGGUUGACACCGGCUUUCACUUU | 24 | 14469 |
| SCNN1A-10621 | - | AGGCAGGGAGGUGCUUUU | 18 | 14470 |
| SCNN1A-10622 | - | AAGGCAGGGAGGUGCUUUU | 19 | 14471 |
| SCNN1A-10623 | - | AAAGGCAGGGAGGUGCUUUU | 20 | 14472 |
| SCNN1A-10624 | - | AAAAGGCAGGGAGGUGCUUUU | 21 | 14473 |
| SCNN1A-10625 | - | GAAAAGGCAGGGAGGUGCUUUU | 22 | 14474 |
| SCNN1A-10626 | - | AGAAAAGGCAGGGAGGUGCUUUU | 23 | 14475 |
| SCNN1A-10627 | - | UAGAAAAGGCAGGGAGGUGCUUUU | 24 | 14476 |

Table 47E provides exemplary targeting domains for knocking down the SCNN1A gene selected according to the fifth tier parameters. The targeting domains bind within the additional 500 bp (e.g., upstream or downstream) of a transcription start site (TSS), e.g., extending to 1 kb upstream and downstream of a TSS, starts with a 5′G and PAM is NNGRRT. It is contemplated herein that in an embodiment the targeting domain hybridizes to the target domain through co Any of the targeting domains in the table can be used with a S. Aureus eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A genemplementary base pairing. Any of the targeting domains in the Table can be used with a S. aureus Cas9 molecule that generates a double stranded break (Cas9 nuclease) or a single-stranded break (Cas9 nickase).

TABLE 47E

5th Tier

| gRNA Name | DNA Strand | Targeting Domain | Target Site Length | Seq ID |
|---|---|---|---|---|
| SCNN1A-10628 | + | GCCUGGUCUGGGCUGAGCCA | 20 | 14477 |
| SCNN1A-1302 | + | GGUUGAUGUUGAGGCUGA | 18 | 5151 |
| SCNN1A-42 | + | GAGGUUGAUGUUGAGGCUGA | 20 | 519 |
| SCNN1A-1303 | + | GUUGAGGUUGAUGUUGAGGCUGA | 23 | 5152 |
| SCNN1A-10629 | + | GUGAGCUCUACCUGGGAC | 18 | 14478 |
| SCNN1A-10630 | + | GCAGUGAGCUCUACCUGGGAC | 21 | 14479 |
| SCNN1A-1417 | + | GUUCCCCUUCAUGAGCCC | 18 | 5266 |

TABLE 47E-continued

5th Tier

| gRNA Name | DNA Strand | Targeting Domain | Target Site Length | Seq ID |
|---|---|---|---|---|
| SCNN1A-1420 | + | GCUUGUUCCCCUUCAUGAGCCC | 22 | 5269 |
| SCNN1A-1427 | + | GCACACCAGGCGGAUGGCGCC | 21 | 5276 |
| SCNN1A-1429 | + | GAGCACACCAGGCGGAUGGCGCC | 23 | 5278 |
| SCNN1A-1430 | + | GGAGCACACCAGGCGGAUGGCGCC | 24 | 5279 |
| SCNN1A-10631 | + | GAUCAUGCACUAUCCUCUAGGC | 22 | 14480 |
| SCNN1A-10632 | + | GGAUCAUGCACUAUCCUCUAGGC | 23 | 14481 |
| SCNN1A-1316 | + | GUGCUGGGAGCACACCAG | 18 | 5165 |
| SCNN1A-1317 | + | GUUGUGCUGGGAGCACACCAG | 21 | 5166 |
| SCNN1A-1318 | + | GGUUGUGCUGGGAGCACACCAG | 22 | 5167 |
| SCNN1A-1319 | + | GCGGUUGUGCUGGGAGCACACCAG | 24 | 5168 |
| SCNN1A-1320 | + | GUACUCUCCGAAAAGCAGG | 19 | 5169 |
| SCNN1A-1321 | + | GAAGUACUCUCCGAAAAGCAGG | 22 | 5170 |
| SCNN1A-10633 | + | GUGACCCUGCCACGUCCUG | 19 | 14482 |
| SCNN1A-10634 | + | GGUGACCCUGCCACGUCCUG | 20 | 14483 |
| SCNN1A-10635 | + | GUGGUGACCCUGCCACGUCCUG | 22 | 14484 |
| SCNN1A-10636 | + | GGUGGUGACCCUGCCACGUCCUG | 23 | 14485 |
| SCNN1A-10637 | + | GGGUGGUGACCCUGCCACGUCCUG | 24 | 14486 |
| SCNN1A-10638 | + | GCCACGUCCUGCCGGGUAU | 19 | 14487 |
| SCNN1A-1326 | + | GAGGGACUAACCGACCUGU | 19 | 5175 |
| SCNN1A-1327 | + | GCAGAGGGACUAACCGACCUGU | 22 | 5176 |
| SCNN1A-1328 | + | GGCAGAGGGACUAACCGACCUGU | 23 | 5177 |
| SCNN1A-1329 | + | GGGCAGAGGGACUAACCGACCUGU | 24 | 5178 |
| SCNN1A-1330 | + | GCGGGGAAGACGAGCUUGU | 19 | 5179 |
| SCNN1A-1331 | + | GACUAACCGACCUGUAGGGAUU | 22 | 5180 |
| SCNN1A-1332 | + | GGACUAACCGACCUGUAGGGAUU | 23 | 5181 |
| SCNN1A-1333 | + | GGGACUAACCGACCUGUAGGGAUU | 24 | 5182 |
| SCNN1A-1334 | − | GCGGAGGAGGAGGCCCUGA | 19 | 5183 |
| SCNN1A-189 | − | GGCGGAGGAGGAGGCCCUGA | 20 | 819 |
| SCNN1A-10639 | − | GCUGCUGUACUCCAGCCUA | 19 | 14488 |
| SCNN1A-10640 | − | GUUCUAGCCCGCUCCAGGUC | 20 | 14489 |
| SCNN1A-10641 | − | GCCUGUUCUAGCCCGCUCCAGGUC | 24 | 14490 |
| SCNN1A-10642 | − | GCGCCUGGAAGGGUGGUC | 18 | 14491 |
| SCNN1A-10643 | − | GCCUGCGCCUGGAAGGGUGGUC | 22 | 14492 |
| SCNN1A-10644 | − | GUGCCUGCGCCUGGAAGGGUGGUC | 24 | 14493 |
| SCNN1A-197 | − | GCAAUUCGGCCUGCUUUUCG | 20 | 826 |
| SCNN1A-1337 | − | GGCAAUUCGGCCUGCUUUUCG | 21 | 5186 |
| SCNN1A-10645 | − | GCAGGCAGAGCCUCAGACCU | 20 | 14494 |

TABLE 47E-continued

5th Tier

| gRNA Name | DNA Strand | Targeting Domain | Target Site Length | Seq ID |
|---|---|---|---|---|
| SCNN1A-10646 | – | GGCAGGCAGAGCCUCAGACCU | 21 | 14495 |
| SCNN1A-10647 | – | GGGCAGGCAGAGCCUCAGACCU | 22 | 14496 |
| SCNN1A-1338 | – | GCUCCUACCGAGAGCUCU | 18 | 5187 |

Table 47F provides exemplary targeting domains for knocking down the SCNN1A gene selected according to the six tier parameters. The targeting domains bind within the additional 500 bp (e.g., upstream or downstream) of a transcription start site (TSS), e.g., extending to 1 kb upstream and downstream of a TSS and PAM is NNGRRT. It is contemplated herein that in an embodiment the targeting domain hybridizes to the target domain through complementary base pairing. Any of the targeting domains in the table can be used with a *S. Aureus* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 47F

6th Tier

| gRNA Name | DNA Strand | Targeting Domain | Target Site Length | Seq ID |
|---|---|---|---|---|
| SCNN1A-10648 | + | CUGGUCUGGGCUGAGCCA | 18 | 14497 |
| SCNN1A-10649 | + | CCUGGUCUGGGCUGAGCCA | 19 | 14498 |
| SCNN1A-10650 | + | UGCCUGGUCUGGGCUGAGCCA | 21 | 14499 |
| SCNN1A-10651 | + | AUGCCUGGUCUGGGCUGAGCCA | 22 | 14500 |
| SCNN1A-10652 | + | AAUGCCUGGUCUGGGCUGAGCCA | 23 | 14501 |
| SCNN1A-10653 | + | CAAUGCCUGGUCUGGGCUGAGCCA | 24 | 14502 |
| SCNN1A-10654 | + | UCUUAUUUAUCUUAGAGA | 18 | 14503 |
| SCNN1A-10655 | + | UUCUUAUUUAUCUUAGAGA | 19 | 14504 |
| SCNN1A-10656 | + | UUUCUUAUUUAUCUUAGAGA | 20 | 14505 |
| SCNN1A-10657 | + | UUUUCUUAUUUAUCUUAGAGA | 21 | 14506 |
| SCNN1A-10658 | + | AUUUUCUUAUUUAUCUUAGAGA | 22 | 14507 |
| SCNN1A-10659 | + | UAUUUUCUUAUUUAUCUUAGAGA | 23 | 14508 |
| SCNN1A-10660 | + | UUAUUUUCUUAUUUAUCUUAGAGA | 24 | 14509 |
| SCNN1A-1340 | + | AGGUUGAUGUUGAGGCUGA | 19 | 5189 |
| SCNN1A-1341 | + | UGAGGUUGAUGUUGAGGCUGA | 21 | 5190 |
| SCNN1A-1342 | + | UUGAGGUUGAUGUUGAGGCUGA | 22 | 5191 |
| SCNN1A-1343 | + | AGUUGAGGUUGAUGUUGAGGCUGA | 24 | 5192 |
| SCNN1A-10661 | + | AGUGAGCUCUACCUGGGAC | 19 | 14510 |
| SCNN1A-6306 | + | CAGUGAGCUCUACCUGGGAC | 20 | 10155 |
| SCNN1A-10662 | + | AGCAGUGAGCUCUACCUGGGAC | 22 | 14511 |
| SCNN1A-10663 | + | CAGCAGUGAGCUCUACCUGGGAC | 23 | 14512 |
| SCNN1A-10664 | + | CCAGCAGUGAGCUCUACCUGGGAC | 24 | 14513 |
| SCNN1A-1418 | + | UGUUCCCUUCAUGAGCCC | 19 | 5267 |
| SCNN1A-72 | + | UUGUUCCCUUCAUGAGCCC | 20 | 599 |

TABLE 47F-continued

6th Tier

| gRNA Name | DNA Strand | Targeting Domain | Target Site Length | Seq ID |
|---|---|---|---|---|
| SCNN1A-1419 | + | CUUGUUCCCUUCAUGAGCCC | 21 | 5268 |
| SCNN1A-1423 | + | CGCUUGUUCCCUUCAUGAGCCC | 23 | 5272 |
| SCNN1A-1424 | + | ACGCUUGUUCCCUUCAUGAGCCC | 24 | 5273 |
| SCNN1A-1425 | + | CACCAGGCGGAUGGCGCC | 18 | 5274 |
| SCNN1A-1426 | + | ACACCAGGCGGAUGGCGCC | 19 | 5275 |
| SCNN1A-223 | + | CACACCAGGCGGAUGGCGCC | 20 | 846 |
| SCNN1A-1428 | + | AGCACACCAGGCGGAUGGCGCC | 22 | 5277 |
| SCNN1A-10665 | + | AUGCACUAUCCUCUAGGC | 18 | 14514 |
| SCNN1A-10666 | + | CAUGCACUAUCCUCUAGGC | 19 | 14515 |
| SCNN1A-6323 | + | UCAUGCACUAUCCUCUAGGC | 20 | 10172 |
| SCNN1A-10667 | + | AUCAUGCACUAUCCUCUAGGC | 21 | 14516 |
| SCNN1A-10668 | + | AGGAUCAUGCACUAUCCUCUAGGC | 24 | 14517 |
| SCNN1A-1371 | + | UGUGCUGGGAGCACACCAG | 19 | 5220 |
| SCNN1A-224 | + | UUGUGCUGGGAGCACACCAG | 20 | 847 |
| SCNN1A-1372 | + | CGGUUGUGCUGGGAGCACACCAG | 23 | 5221 |
| SCNN1A-1373 | + | UACUCUCCGAAAAGCAGG | 18 | 5222 |
| SCNN1A-230 | + | AGUACUCUCCGAAAAGCAGG | 20 | 851 |
| SCNN1A-1374 | + | AAGUACUCUCCGAAAAGCAGG | 21 | 5223 |
| SCNN1A-1375 | + | UGAAGUACUCUCCGAAAAGCAGG | 23 | 5224 |
| SCNN1A-1376 | + | CUGAAGUACUCUCCGAAAAGCAGG | 24 | 5225 |
| SCNN1A-10669 | + | UGACCCUGCCACGUCCUG | 18 | 14518 |
| SCNN1A-10670 | + | UGGUGACCCUGCCACGUCCUG | 21 | 14519 |
| SCNN1A-10671 | + | CCACGUCCUGCCGGGUAU | 18 | 14520 |
| SCNN1A-6350 | + | UGCCACGUCCUGCCGGGUAU | 20 | 10199 |
| SCNN1A-10672 | + | CUGCCACGUCCUGCCGGGUAU | 21 | 14521 |
| SCNN1A-10673 | + | CCUGCCACGUCCUGCCGGGUAU | 22 | 14522 |
| SCNN1A-10674 | + | CCCUGCCACGUCCUGCCGGGUAU | 23 | 14523 |
| SCNN1A-10675 | + | ACCCUGCCACGUCCUGCCGGGUAU | 24 | 14524 |
| SCNN1A-1380 | + | AGGGACUAACCGACCUGU | 18 | 5229 |
| SCNN1A-424 | + | AGAGGGACUAACCGACCUGU | 20 | 4273 |
| SCNN1A-1381 | + | CAGAGGGACUAACCGACCUGU | 21 | 5230 |
| SCNN1A-1382 | + | CGGGGAAGACGAGCUUGU | 18 | 5231 |
| SCNN1A-237 | + | UGCGGGGAAGACGAGCUUGU | 20 | 857 |
| SCNN1A-1383 | + | CUGCGGGGAAGACGAGCUUGU | 21 | 5232 |
| SCNN1A-1384 | + | ACUGCGGGGAAGACGAGCUUGU | 22 | 5233 |
| SCNN1A-1385 | + | CACUGCGGGGAAGACGAGCUUGU | 23 | 5234 |
| SCNN1A-1386 | + | UCACUGCGGGGAAGACGAGCUUGU | 24 | 5235 |

TABLE 47F-continued

6th Tier

| gRNA Name | DNA Strand | Targeting Domain | Target Site Length | Seq ID |
|---|---|---|---|---|
| SCNN1A-1387 | + | AACCGACCUGUAGGGAUU | 18 | 5236 |
| SCNN1A-1388 | + | UAACCGACCUGUAGGGAUU | 19 | 5237 |
| SCNN1A-1389 | + | CUAACCGACCUGUAGGGAUU | 20 | 5238 |
| SCNN1A-1390 | + | ACUAACCGACCUGUAGGGAUU | 21 | 5239 |
| SCNN1A-1391 | - | CGGAGGAGGAGGCCCUGA | 18 | 5240 |
| SCNN1A-1433 | - | CGGCGGAGGAGGAGGCCCUGA | 21 | 5282 |
| SCNN1A-1434 | - | ACGGCGGAGGAGGAGGCCCUGA | 22 | 5283 |
| SCNN1A-1435 | - | CACGGCGGAGGAGGAGGCCCUGA | 23 | 5284 |
| SCNN1A-1436 | - | CCACGGCGGAGGAGGAGGCCCUGA | 24 | 5285 |
| SCNN1A-10676 | - | CUGCUGUACUCCAGCCUA | 18 | 14525 |
| SCNN1A-10677 | - | UGCUGCUGUACUCCAGCCUA | 20 | 14526 |
| SCNN1A-10678 | - | AUGCUGCUGUACUCCAGCCUA | 21 | 14527 |
| SCNN1A-10679 | - | CAUGCUGCUGUACUCCAGCCUA | 22 | 14528 |
| SCNN1A-10680 | - | UCAUGCUGCUGUACUCCAGCCUA | 23 | 14529 |
| SCNN1A-10681 | - | AUCAUGCUGCUGUACUCCAGCCUA | 24 | 14530 |
| SCNN1A-10682 | - | UCUAGCCCGCUCCAGGUC | 18 | 14531 |
| SCNN1A-10683 | - | UUCUAGCCCGCUCCAGGUC | 19 | 14532 |
| SCNN1A-10684 | - | UGUUCUAGCCCGCUCCAGGUC | 21 | 14533 |
| SCNN1A-10685 | - | CUGUUCUAGCCCGCUCCAGGUC | 22 | 14534 |
| SCNN1A-10686 | - | CCUGUUCUAGCCCGCUCCAGGUC | 23 | 14535 |
| SCNN1A-10687 | - | UGCGCCUGGAAGGGUGGUC | 19 | 14536 |
| SCNN1A-10688 | - | CUGCGCCUGGAAGGGUGGUC | 20 | 14537 |
| SCNN1A-10689 | - | CCUGCGCCUGGAAGGGUGGUC | 21 | 14538 |
| SCNN1A-10690 | - | UGCCUGCGCCUGGAAGGGUGGUC | 23 | 14539 |
| SCNN1A-1395 | - | AAUUCGGCCUGCUUUUCG | 18 | 5244 |
| SCNN1A-1396 | - | CAAUUCGGCCUGCUUUUCG | 19 | 5245 |
| SCNN1A-1397 | - | UGGCAAUUCGGCCUGCUUUUCG | 22 | 5246 |
| SCNN1A-1398 | - | CUGGCAAUUCGGCCUGCUUUUCG | 23 | 5247 |
| SCNN1A-1399 | - | ACUGGCAAUUCGGCCUGCUUUUCG | 24 | 5248 |
| SCNN1A-10691 | - | CCUGGUGCCUGCGCCUGG | 18 | 14540 |
| SCNN1A-10692 | - | CCCUGGUGCCUGCGCCUGG | 19 | 14541 |
| SCNN1A-10693 | - | UCCCUGGUGCCUGCGCCUGG | 20 | 14542 |
| SCNN1A-10694 | - | UUCCCUGGUGCCUGCGCCUGG | 21 | 14543 |
| SCNN1A-10695 | - | CUUCCCUGGUGCCUGCGCCUGG | 22 | 14544 |
| SCNN1A-10696 | - | CCUUCCCUGGUGCCUGCGCCUGG | 23 | 14545 |
| SCNN1A-10697 | - | CCCUUCCCUGGUGCCUGCGCCUGG | 24 | 14546 |
| SCNN1A-10698 | - | AUACCCGGCAGGACGUGG | 18 | 14547 |

TABLE 47F-continued

6th Tier

| gRNA Name | DNA Strand | Targeting Domain | Target Site Length | Seq ID |
|---|---|---|---|---|
| SCNN1A-10699 | − | CAUACCCGGCAGGACGUGG | 19 | 14548 |
| SCNN1A-10700 | − | CCAUACCCGGCAGGACGUGG | 20 | 14549 |
| SCNN1A-10701 | − | CCCAUACCCGGCAGGACGUGG | 21 | 14550 |
| SCNN1A-10702 | − | UCCCAUACCCGGCAGGACGUGG | 22 | 14551 |
| SCNN1A-10703 | − | CUCCCAUACCCGGCAGGACGUGG | 23 | 14552 |
| SCNN1A-10704 | − | ACUCCCAUACCCGGCAGGACGUGG | 24 | 14553 |
| SCNN1A-10705 | − | AGGCAGAGCCUCAGACCU | 18 | 14554 |
| SCNN1A-10706 | − | CAGGCAGAGCCUCAGACCU | 19 | 14555 |
| SCNN1A-10707 | − | UGGGCAGGCAGAGCCUCAGACCU | 23 | 14556 |
| SCNN1A-10708 | − | CUGGGCAGGCAGAGCCUCAGACCU | 24 | 14557 |
| SCNN1A-1400 | − | CGCUCCUACCGAGAGCUCU | 19 | 5249 |
| SCNN1A-192 | − | CCGCUCCUACCGAGAGCUCU | 20 | 822 |
| SCNN1A-1401 | − | ACCGCUCCUACCGAGAGCUCU | 21 | 5250 |
| SCNN1A-1402 | − | CACCGCUCCUACCGAGAGCUCU | 22 | 5251 |
| SCNN1A-1403 | − | CCACCGCUCCUACCGAGAGCUCU | 23 | 5252 |
| SCNN1A-1404 | − | UCCACCGCUCCUACCGAGAGCUCU | 24 | 5253 |

Table 47G provides exemplary targeting domains for knocking down the SCNN1A gene selected according to the seven tier parameters. The targeting domains bind within the additional 500 bp (e.g., upstream or downstream) of a transcription start site (TSS), e.g., extending to 1 kb upstream and downstream of a TSS and PAM is NNGRRV. It is contemplated herein that in an embodiment the targeting domain hybridizes to the target domain through complementary base pairing. Any of the targeting domains in the table can be used with a S. Aureus eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 47G

7th Tier

| gRNA Name | DNA Strand | Targeting Domain | Target Site Length | Seq ID |
|---|---|---|---|---|
| SCNN1A-10709 | + | UUGGUGUUGUGAGGAAAA | 18 | 14558 |
| SCNN1A-10710 | + | CUUGGUGUUGUGAGGAAAA | 19 | 14559 |
| SCNN1A-10711 | + | GCUUGGUGUUGUGAGGAAAA | 20 | 14560 |
| SCNN1A-10712 | + | GGCUUGGUGUUGUGAGGAAAA | 21 | 14561 |
| SCNN1A-10713 | + | AGGCUUGGUGUUGUGAGGAAAA | 22 | 14562 |
| SCNN1A-10714 | + | CAGGCUUGGUGUUGUGAGGAAAA | 23 | 14563 |
| SCNN1A-10715 | + | ACAGGCUUGGUGUUGUGAGGAAAA | 24 | 14564 |
| SCNN1A-10716 | + | UUCCUUUCCCUCCCCAAA | 18 | 14565 |
| SCNN1A-10717 | + | CUUCCUUUCCCUCCCCAAA | 19 | 14566 |
| SCNN1A-6279 | + | CCUUCCUUUCCCUCCCCAAA | 20 | 10128 |
| SCNN1A-10718 | + | CCCUUCCUUUCCCUCCCCAAA | 21 | 14567 |

TABLE 47G-continued

7th Tier

| gRNA Name | DNA Strand | Targeting Domain | Target Site Length | Seq ID |
|---|---|---|---|---|
| SCNN1A-10719 | + | CCCCUUCCUUUCCCUCCCCAAA | 22 | 14568 |
| SCNN1A-10720 | + | UCCCCUUCCUUUCCCUCCCCAAA | 23 | 14569 |
| SCNN1A-10721 | + | GUCCCCUUCCUUUCCCUCCCCAAA | 24 | 14570 |
| SCNN1A-10722 | + | CUUCCUUUCCCUCCCCAA | 18 | 14571 |
| SCNN1A-10723 | + | CCUUCCUUUCCCUCCCCAA | 19 | 14572 |
| SCNN1A-6281 | + | CCCUUCCUUUCCCUCCCCAA | 20 | 10130 |
| SCNN1A-10724 | + | CCCCUUCCUUUCCCUCCCCAA | 21 | 14573 |
| SCNN1A-10725 | + | UCCCCUUCCUUUCCCUCCCCAA | 22 | 14574 |
| SCNN1A-10726 | + | GUCCCCUUCCUUUCCCUCCCCAA | 23 | 14575 |
| SCNN1A-10727 | + | AGUCCCCUUCCUUUCCCUCCCCAA | 24 | 14576 |
| SCNN1A-10728 | + | UUCCAGGCGCAGGCACCA | 18 | 14577 |
| SCNN1A-10729 | + | CUUCCAGGCGCAGGCACCA | 19 | 14578 |
| SCNN1A-6290 | + | CCUUCCAGGCGCAGGCACCA | 20 | 10139 |
| SCNN1A-10730 | + | CCCUUCCAGGCGCAGGCACCA | 21 | 14579 |
| SCNN1A-10731 | + | ACCCUUCCAGGCGCAGGCACCA | 22 | 14580 |
| SCNN1A-10732 | + | CACCCUUCCAGGCGCAGGCACCA | 23 | 14581 |
| SCNN1A-10733 | + | CCACCCUUCCAGGCGCAGGCACCA | 24 | 14582 |
| SCNN1A-10734 | + | CCUUCCUUUCCCUCCCCA | 18 | 14583 |
| SCNN1A-10735 | + | CCCUUCCUUUCCCUCCCCA | 19 | 14584 |
| SCNN1A-10736 | + | CCCCUUCCUUUCCCUCCCCA | 20 | 14585 |
| SCNN1A-10737 | + | UCCCCUUCCUUUCCCUCCCCA | 21 | 14586 |
| SCNN1A-10738 | + | GUCCCCUUCCUUUCCCUCCCCA | 22 | 14587 |
| SCNN1A-10739 | + | AGUCCCCUUCCUUUCCCUCCCCA | 23 | 14588 |
| SCNN1A-10740 | + | UAGUCCCCUUCCUUUCCCUCCCCA | 24 | 14589 |
| SCNN1A-10741 | + | UGAGGCUCUGCCUGCCCA | 18 | 14590 |
| SCNN1A-10742 | + | CUGAGGCUCUGCCUGCCCA | 19 | 14591 |
| SCNN1A-10743 | + | UCUGAGGCUCUGCCUGCCCA | 20 | 14592 |
| SCNN1A-10744 | + | GUCUGAGGCUCUGCCUGCCCA | 21 | 14593 |
| SCNN1A-10745 | + | GGUCUGAGGCUCUGCCUGCCCA | 22 | 14594 |
| SCNN1A-10746 | + | AGGUCUGAGGCUCUGCCUGCCCA | 23 | 14595 |
| SCNN1A-10747 | + | CAGGUCUGAGGCUCUGCCUGCCCA | 24 | 14596 |
| SCNN1A-10748 | + | GGCACCAGGGAAGGGGCA | 18 | 14597 |
| SCNN1A-10749 | + | AGGCACCAGGGAAGGGGCA | 19 | 14598 |
| SCNN1A-10750 | + | CAGGCACCAGGGAAGGGGCA | 20 | 14599 |
| SCNN1A-10751 | + | GCAGGCACCAGGGAAGGGGCA | 21 | 14600 |
| SCNN1A-10752 | + | CGCAGGCACCAGGGAAGGGGCA | 22 | 14601 |
| SCNN1A-10753 | + | GCGCAGGCACCAGGGAAGGGGCA | 23 | 14602 |
| SCNN1A-10754 | + | GGCGCAGGCACCAGGGAAGGGGCA | 24 | 14603 |

TABLE 47G-continued

7th Tier

| gRNA Name | DNA Strand | Targeting Domain | Target Site Length | Seq ID |
|---|---|---|---|---|
| SCNN1A-10755 | + | AGGCGCAGGCACCAGGGA | 18 | 14604 |
| SCNN1A-10756 | + | CAGGCGCAGGCACCAGGGA | 19 | 14605 |
| SCNN1A-6296 | + | CCAGGCGCAGGCACCAGGGA | 20 | 10145 |
| SCNN1A-10757 | + | UCCAGGCGCAGGCACCAGGGA | 21 | 14606 |
| SCNN1A-10758 | + | UUCCAGGCGCAGGCACCAGGGA | 22 | 14607 |
| SCNN1A-10759 | + | CUUCCAGGCGCAGGCACCAGGGA | 23 | 14608 |
| SCNN1A-10760 | + | CCUUCCAGGCGCAGGCACCAGGGA | 24 | 14609 |
| SCNN1A-1452 | + | CUAACCGACCUGUAGGGA | 18 | 5301 |
| SCNN1A-1453 | + | ACUAACCGACCUGUAGGGA | 19 | 5302 |
| SCNN1A-1454 | + | GACUAACCGACCUGUAGGGA | 20 | 5303 |
| SCNN1A-1455 | + | GGACUAACCGACCUGUAGGGA | 21 | 5304 |
| SCNN1A-1456 | + | GGGACUAACCGACCUGUAGGGA | 22 | 5305 |
| SCNN1A-1457 | + | AGGGACUAACCGACCUGUAGGGA | 23 | 5306 |
| SCNN1A-1458 | + | GAGGGACUAACCGACCUGUAGGGA | 24 | 5307 |
| SCNN1A-10761 | + | AGUGAGCUCUACCUGGGA | 18 | 14610 |
| SCNN1A-10762 | + | CAGUGAGCUCUACCUGGGA | 19 | 14611 |
| SCNN1A-10763 | + | GCAGUGAGCUCUACCUGGGA | 20 | 14612 |
| SCNN1A-10764 | + | AGCAGUGAGCUCUACCUGGGA | 21 | 14613 |
| SCNN1A-10765 | + | CAGCAGUGAGCUCUACCUGGGA | 22 | 14614 |
| SCNN1A-10766 | + | CCAGCAGUGAGCUCUACCUGGGA | 23 | 14615 |
| SCNN1A-10767 | + | GCCAGCAGUGAGCUCUACCUGGGA | 24 | 14616 |
| SCNN1A-10768 | + | CAGCAUUCUAGACCUGGA | 18 | 14617 |
| SCNN1A-10769 | + | GCAGCAUUCUAGACCUGGA | 19 | 14618 |
| SCNN1A-10770 | + | UGCAGCAUUCUAGACCUGGA | 20 | 14619 |
| SCNN1A-10771 | + | CUGCAGCAUUCUAGACCUGGA | 21 | 14620 |
| SCNN1A-10772 | + | GCUGCAGCAUUCUAGACCUGGA | 22 | 14621 |
| SCNN1A-10773 | + | UGCUGCAGCAUUCUAGACCUGGA | 23 | 14622 |
| SCNN1A-10774 | + | GUGCUGCAGCAUUCUAGACCUGGA | 24 | 14623 |
| SCNN1A-1459 | + | CCCUUCAUGAGCCCUGGA | 18 | 5308 |
| SCNN1A-1460 | + | CCCCUUCAUGAGCCCUGGA | 19 | 5309 |
| SCNN1A-205 | + | UCCCCUUCAUGAGCCCUGGA | 20 | 833 |
| SCNN1A-1461 | + | UUCCCCUUCAUGAGCCCUGGA | 21 | 5310 |
| SCNN1A-1462 | + | GUUCCCCUUCAUGAGCCCUGGA | 22 | 5311 |
| SCNN1A-1463 | + | UGUUCCCCUUCAUGAGCCCUGGA | 23 | 5312 |
| SCNN1A-1464 | + | UUGUUCCCCUUCAUGAGCCCUGGA | 24 | 5313 |
| SCNN1A-10775 | + | UAUAGUUCUUUUUAUGA | 18 | 14624 |
| SCNN1A-10776 | + | AUAUAGUUCUUUUUAUGA | 19 | 14625 |

TABLE 47G-continued

7th Tier

| gRNA Name | DNA Strand | Targeting Domain | Target Site Length | Seq ID |
|---|---|---|---|---|
| SCNN1A-10777 | + | UAUAUAGUUCUUUUUAUGA | 20 | 14626 |
| SCNN1A-10778 | + | AUAUAUAGUUCUUUUUAUGA | 21 | 14627 |
| SCNN1A-10779 | + | AAUAUAUAGUUCUUUUUAUGA | 22 | 14628 |
| SCNN1A-10780 | + | AAAUAUAUAGUUCUUUUUAUGA | 23 | 14629 |
| SCNN1A-10781 | + | AAAAUAUAUAGUUCUUUUUAUGA | 24 | 14630 |
| SCNN1A-10782 | + | UACAAUUUUCAGCAAUA | 18 | 14631 |
| SCNN1A-10783 | + | GUACAAUUUUCAGCAAUA | 19 | 14632 |
| SCNN1A-10784 | + | AGUACAAUUUUCAGCAAUA | 20 | 14633 |
| SCNN1A-10785 | + | CAGUACAAUUUUCAGCAAUA | 21 | 14634 |
| SCNN1A-10786 | + | ACAGUACAAUUUUCAGCAAUA | 22 | 14635 |
| SCNN1A-10787 | + | CACAGUACAAUUUUCAGCAAUA | 23 | 14636 |
| SCNN1A-10788 | + | UCACAGUACAAUUUUCAGCAAUA | 24 | 14637 |
| SCNN1A-10789 | + | CAGCAAUACAGAAGUAUA | 18 | 14638 |
| SCNN1A-10790 | + | UCAGCAAUACAGAAGUAUA | 19 | 14639 |
| SCNN1A-10791 | + | UUCAGCAAUACAGAAGUAUA | 20 | 14640 |
| SCNN1A-10792 | + | UUUCAGCAAUACAGAAGUAUA | 21 | 14641 |
| SCNN1A-10793 | + | UUUUCAGCAAUACAGAAGUAUA | 22 | 14642 |
| SCNN1A-10794 | + | UUUUUCAGCAAUACAGAAGUAUA | 23 | 14643 |
| SCNN1A-10795 | + | AUUUUUCAGCAAUACAGAAGUAUA | 24 | 14644 |
| SCNN1A-10796 | + | GCCACGUCCUGCCGGGUA | 18 | 14645 |
| SCNN1A-10797 | + | UGCCACGUCCUGCCGGGUA | 19 | 14646 |
| SCNN1A-6301 | + | CUGCCACGUCCUGCCGGGUA | 20 | 10150 |
| SCNN1A-10798 | + | CCUGCCACGUCCUGCCGGGUA | 21 | 14647 |
| SCNN1A-10799 | + | CCCUGCCACGUCCUGCCGGGUA | 22 | 14648 |
| SCNN1A-10800 | + | ACCCUGCCACGUCCUGCCGGGUA | 23 | 14649 |
| SCNN1A-10801 | + | GACCCUGCCACGUCCUGCCGGGUA | 24 | 14650 |
| SCNN1A-1478 | + | GUGUUGUUGCAGAAGAAC | 18 | 5327 |
| SCNN1A-1479 | + | GGUGUUGUUGCAGAAGAAC | 19 | 5328 |
| SCNN1A-220 | + | UGGUGUUGUUGCAGAAGAAC | 20 | 843 |
| SCNN1A-1480 | + | GUGGUGUUGUUGCAGAAGAAC | 21 | 5329 |
| SCNN1A-1481 | + | GGUGGUGUUGUUGCAGAAGAAC | 22 | 5330 |
| SCNN1A-1482 | + | UGGUGGUGUUGUUGCAGAAGAAC | 23 | 5331 |
| SCNN1A-1483 | + | AUGGUGGUGUUGUUGCAGAAGAAC | 24 | 5332 |
| SCNN1A-10802 | + | CCUUCCAGGCGCAGGCAC | 18 | 14651 |
| SCNN1A-10803 | + | CCCUUCCAGGCGCAGGCAC | 19 | 14652 |
| SCNN1A-10804 | + | ACCCUUCCAGGCGCAGGCAC | 20 | 14653 |
| SCNN1A-10805 | + | CACCCUUCCAGGCGCAGGCAC | 21 | 14654 |
| SCNN1A-10806 | + | CCACCCUUCCAGGCGCAGGCAC | 22 | 14655 |

TABLE 47G-continued

7th Tier

| gRNA Name | DNA Strand | Targeting Domain | Target Site Length | Seq ID |
|---|---|---|---|---|
| SCNN1A-10807 | + | ACCACCCUUCCAGGCGCAGGCAC | 23 | 14656 |
| SCNN1A-10808 | + | GACCACCCUUCCAGGCGCAGGCAC | 24 | 14657 |
| SCNN1A-10809 | + | AAAAUAGAAAUCUGAGAC | 18 | 14658 |
| SCNN1A-10810 | + | GAAAAUAGAAAUCUGAGAC | 19 | 14659 |
| SCNN1A-10811 | + | GGAAAAUAGAAAUCUGAGAC | 20 | 14660 |
| SCNN1A-10812 | + | AGGAAAAUAGAAAUCUGAGAC | 21 | 14661 |
| SCNN1A-10813 | + | GAGGAAAAUAGAAAUCUGAGAC | 22 | 14662 |
| SCNN1A-10814 | + | UGAGGAAAAUAGAAAUCUGAGAC | 23 | 14663 |
| SCNN1A-10815 | + | GUGAGGAAAAUAGAAAUCUGAGAC | 24 | 14664 |
| SCNN1A-10816 | + | UGCUGCAGCAUUCUAGAC | 18 | 14665 |
| SCNN1A-10817 | + | GUGCUGCAGCAUUCUAGAC | 19 | 14666 |
| SCNN1A-10818 | + | AGUGCUGCAGCAUUCUAGAC | 20 | 14667 |
| SCNN1A-10819 | + | UAGUGCUGCAGCAUUCUAGAC | 21 | 14668 |
| SCNN1A-10820 | + | CUAGUGCUGCAGCAUUCUAGAC | 22 | 14669 |
| SCNN1A-10821 | + | CCUAGUGCUGCAGCAUUCUAGAC | 23 | 14670 |
| SCNN1A-10822 | + | GCCUAGUGCUGCAGCAUUCUAGAC | 24 | 14671 |
| SCNN1A-10823 | + | AGUGAGCACCUCAGCACC | 18 | 14672 |
| SCNN1A-10824 | + | CAGUGAGCACCUCAGCACC | 19 | 14673 |
| SCNN1A-10825 | + | CCAGUGAGCACCUCAGCACC | 20 | 14674 |
| SCNN1A-10826 | + | CCCAGUGAGCACCUCAGCACC | 21 | 14675 |
| SCNN1A-10827 | + | GCCCAGUGAGCACCUCAGCACC | 22 | 14676 |
| SCNN1A-10828 | + | UGCCCAGUGAGCACCUCAGCACC | 23 | 14677 |
| SCNN1A-10829 | + | CUGCCCAGUGAGCACCUCAGCACC | 24 | 14678 |
| SCNN1A-10830 | + | CUUCCAGGCGCAGGCACC | 18 | 14679 |
| SCNN1A-10831 | + | CCUUCCAGGCGCAGGCACC | 19 | 14680 |
| SCNN1A-6307 | + | CCCUUCCAGGCGCAGGCACC | 20 | 10156 |
| SCNN1A-10832 | + | ACCCUUCCAGGCGCAGGCACC | 21 | 14681 |
| SCNN1A-10833 | + | CACCCUUCCAGGCGCAGGCACC | 22 | 14682 |
| SCNN1A-10834 | + | CCACCCUUCCAGGCGCAGGCACC | 23 | 14683 |
| SCNN1A-10835 | + | ACCACCCUUCCAGGCGCAGGCACC | 24 | 14684 |
| SCNN1A-10836 | + | GCUGCAGCAUUCUAGACC | 18 | 14685 |
| SCNN1A-10837 | + | UGCUGCAGCAUUCUAGACC | 19 | 14686 |
| SCNN1A-6310 | + | GUGCUGCAGCAUUCUAGACC | 20 | 10159 |
| SCNN1A-10838 | + | AGUGCUGCAGCAUUCUAGACC | 21 | 14687 |
| SCNN1A-10839 | + | UAGUGCUGCAGCAUUCUAGACC | 22 | 14688 |
| SCNN1A-10840 | + | CUAGUGCUGCAGCAUUCUAGACC | 23 | 14689 |
| SCNN1A-10841 | + | CCUAGUGCUGCAGCAUUCUAGACC | 24 | 14690 |

TABLE 47G-continued

7th Tier

| gRNA Name | DNA Strand | Targeting Domain | Target Site Length | Seq ID |
|---|---|---|---|---|
| SCNN1A-10842 | + | CCAGCAGUGAGCUCUACC | 18 | 14691 |
| SCNN1A-10843 | + | GCCAGCAGUGAGCUCUACC | 19 | 14692 |
| SCNN1A-6312 | + | UGCCAGCAGUGAGCUCUACC | 20 | 10161 |
| SCNN1A-1504 | + | UGUUCCCCUUCAUGAGCC | 18 | 5353 |
| SCNN1A-1505 | + | UUGUUCCCCUUCAUGAGCC | 19 | 5354 |
| SCNN1A-207 | + | CUUGUUCCCCUUCAUGAGCC | 20 | 834 |
| SCNN1A-1506 | + | GCUUGUUCCCCUUCAUGAGCC | 21 | 5355 |
| SCNN1A-1510 | + | CGCUUGUUCCCCUUCAUGAGCC | 22 | 5359 |
| SCNN1A-1511 | + | ACGCUUGUUCCCCUUCAUGAGCC | 23 | 5360 |
| SCNN1A-1512 | + | CACGCUUGUUCCCCUUCAUGAGCC | 24 | 5361 |
| SCNN1A-1513 | + | AGGGCCUCCUCCUCCGCC | 18 | 5362 |
| SCNN1A-1514 | + | CAGGGCCUCCUCCUCCGCC | 19 | 5363 |
| SCNN1A-213 | + | UCAGGGCCUCCUCCUCCGCC | 20 | 838 |
| SCNN1A-1515 | + | AUCAGGGCCUCCUCCUCCGCC | 21 | 5364 |
| SCNN1A-1516 | + | GAUCAGGGCCUCCUCCUCCGCC | 22 | 5365 |
| SCNN1A-1517 | + | CGAUCAGGGCCUCCUCCUCCGCC | 23 | 5366 |
| SCNN1A-1518 | + | UCGAUCAGGGCCUCCUCCUCCGCC | 24 | 5367 |
| SCNN1A-1519 | + | CAGAGCCACAGCACUGCC | 18 | 5368 |
| SCNN1A-1520 | + | GCAGAGCCACAGCACUGCC | 19 | 5369 |
| SCNN1A-228 | + | UGCAGAGCCACAGCACUGCC | 20 | 849 |
| SCNN1A-1521 | + | GUGCAGAGCCACAGCACUGCC | 21 | 5370 |
| SCNN1A-1522 | + | GGUGCAGAGCCACAGCACUGCC | 22 | 5371 |
| SCNN1A-1523 | + | AGGUGCAGAGCCACAGCACUGCC | 23 | 5372 |
| SCNN1A-1524 | + | AAGGUGCAGAGCCACAGCACUGCC | 24 | 5373 |
| SCNN1A-1431 | + | GAGUGGACUGUGGAGGGC | 18 | 5280 |
| SCNN1A-1432 | + | GGAGUGGACUGUGGAGGGC | 19 | 5281 |
| SCNN1A-201 | + | UGGAGUGGACUGUGGAGGGC | 20 | 830 |
| SCNN1A-1358 | + | CUGGAGUGGACUGUGGAGGGC | 21 | 5207 |
| SCNN1A-1359 | + | CCUGGAGUGGACUGUGGAGGGC | 22 | 5208 |
| SCNN1A-1360 | + | CCCUGGAGUGGACUGUGGAGGGC | 23 | 5209 |
| SCNN1A-1311 | + | GCCCUGGAGUGGACUGUGGAGGGC | 24 | 5160 |
| SCNN1A-10844 | + | UCUAGACCUGGAGCGGGC | 18 | 14693 |
| SCNN1A-10845 | + | UUCUAGACCUGGAGCGGGC | 19 | 14694 |
| SCNN1A-10846 | + | AUUCUAGACCUGGAGCGGGC | 20 | 14695 |
| SCNN1A-10847 | + | CAUUCUAGACCUGGAGCGGGC | 21 | 14696 |
| SCNN1A-10848 | + | GCAUUCUAGACCUGGAGCGGGC | 22 | 14697 |
| SCNN1A-10849 | + | AGCAUUCUAGACCUGGAGCGGGC | 23 | 14698 |
| SCNN1A-10850 | + | CAGCAUUCUAGACCUGGAGCGGGC | 24 | 14699 |

TABLE 47G-continued

7th Tier

| gRNA Name | DNA Strand | Targeting Domain | Target Site Length | Seq ID |
|---|---|---|---|---|
| SCNN1A-1531 | + | GGUGCAGAUGGUCACUGC | 18 | 5380 |
| SCNN1A-1532 | + | GGGUGCAGAUGGUCACUGC | 19 | 5381 |
| SCNN1A-38 | + | AGGGUGCAGAUGGUCACUGC | 20 | 575 |
| SCNN1A-1533 | + | GAGGGUGCAGAUGGUCACUGC | 21 | 5382 |
| SCNN1A-1534 | + | UGAGGGUGCAGAUGGUCACUGC | 22 | 5383 |
| SCNN1A-1535 | + | UUGAGGGUGCAGAUGGUCACUGC | 23 | 5384 |
| SCNN1A-1536 | + | AUUGAGGGUGCAGAUGGUCACUGC | 24 | 5385 |
| SCNN1A-1537 | + | UCCUCCGCCGUGGGCUGC | 18 | 5386 |
| SCNN1A-1538 | + | CUCCUCCGCCGUGGGCUGC | 19 | 5387 |
| SCNN1A-65 | + | CCUCCUCCGCCGUGGGCUGC | 20 | 594 |
| SCNN1A-1539 | + | UCCUCCUCCGCCGUGGGCUGC | 21 | 5388 |
| SCNN1A-1540 | + | CUCCUCCUCCGCCGUGGGCUGC | 22 | 5389 |
| SCNN1A-1541 | + | CCUCCUCCUCCGCCGUGGGCUGC | 23 | 5390 |
| SCNN1A-1542 | + | GCCUCCUCCUCCGCCGUGGGCUGC | 24 | 5391 |
| SCNN1A-1543 | + | GUCUUCAUGCGGUUGUGC | 18 | 5392 |
| SCNN1A-1544 | + | CGUCUUCAUGCGGUUGUGC | 19 | 5393 |
| SCNN1A-49 | + | CCGUCUUCAUGCGGUUGUGC | 20 | 582 |
| SCNN1A-1545 | + | GCCGUCUUCAUGCGGUUGUGC | 21 | 5394 |
| SCNN1A-1546 | + | GGCCGUCUUCAUGCGGUUGUGC | 22 | 5395 |
| SCNN1A-1547 | + | AGGCCGUCUUCAUGCGGUUGUGC | 23 | 5396 |
| SCNN1A-1548 | + | AAGGCCGUCUUCAUGCGGUUGUGC | 24 | 5397 |
| SCNN1A-1556 | + | UCACGCUUGUUCCCCUUC | 18 | 5405 |
| SCNN1A-1557 | + | CUCACGCUUGUUCCCCUUC | 19 | 5406 |
| SCNN1A-208 | + | CCUCACGCUUGUUCCCCUUC | 20 | 835 |
| SCNN1A-1558 | + | UCCUCACGCUUGUUCCCCUUC | 21 | 5407 |
| SCNN1A-1559 | + | CUCCUCACGCUUGUUCCCCUUC | 22 | 5408 |
| SCNN1A-1560 | + | GCUCCUCACGCUUGUUCCCCUUC | 23 | 5409 |
| SCNN1A-1561 | + | UGCUCCUCACGCUUGUUCCCCUUC | 24 | 5410 |
| SCNN1A-10851 | + | UCCUUUCCCUCCCCAAAG | 18 | 14700 |
| SCNN1A-10852 | + | UUCCUUUCCCUCCCCAAAG | 19 | 14701 |
| SCNN1A-6330 | + | CUUCCUUUCCCUCCCCAAAG | 20 | 10179 |
| SCNN1A-10853 | + | CCUUCCUUUCCCUCCCCAAAG | 21 | 14702 |
| SCNN1A-10854 | + | CCCUUCCUUUCCCUCCCCAAAG | 22 | 14703 |
| SCNN1A-10855 | + | CCCCUUCCUUUCCCUCCCCAAAG | 23 | 14704 |
| SCNN1A-10856 | + | UCCCCUUCCUUUCCCUCCCCAAAG | 24 | 14705 |
| SCNN1A-1562 | + | AUGGUCACUGCGGGGAAG | 18 | 5411 |
| SCNN1A-1563 | + | GAUGGUCACUGCGGGGAAG | 19 | 5412 |

TABLE 47G-continued

7th Tier

| gRNA Name | DNA Strand | Targeting Domain | Target Site Length | Seq ID |
|---|---|---|---|---|
| SCNN1A-238 | + | AGAUGGUCACUGCGGGGAAG | 20 | 858 |
| SCNN1A-1564 | + | CAGAUGGUCACUGCGGGGAAG | 21 | 5413 |
| SCNN1A-1565 | + | GCAGAUGGUCACUGCGGGGAAG | 22 | 5414 |
| SCNN1A-1566 | + | UGCAGAUGGUCACUGCGGGGAAG | 23 | 5415 |
| SCNN1A-1567 | + | GUGCAGAUGGUCACUGCGGGGAAG | 24 | 5416 |
| SCNN1A-10857 | + | GCACCAGGGAAGGGGCAG | 18 | 14706 |
| SCNN1A-10858 | + | GGCACCAGGGAAGGGGCAG | 19 | 14707 |
| SCNN1A-6334 | + | AGGCACCAGGGAAGGGGCAG | 20 | 10183 |
| SCNN1A-10859 | + | CAGGCACCAGGGAAGGGGCAG | 21 | 14708 |
| SCNN1A-10860 | + | GCAGGCACCAGGGAAGGGGCAG | 22 | 14709 |
| SCNN1A-10861 | + | CGCAGGCACCAGGGAAGGGGCAG | 23 | 14710 |
| SCNN1A-10862 | + | GCGCAGGCACCAGGGAAGGGGCAG | 24 | 14711 |
| SCNN1A-1568 | + | AUGGUGGUGUUGUUGCAG | 18 | 5417 |
| SCNN1A-1569 | + | GAUGGUGGUGUUGUUGCAG | 19 | 5418 |
| SCNN1A-221 | + | GGAUGGUGGUGUUGUUGCAG | 20 | 844 |
| SCNN1A-1570 | + | UGGAUGGUGGUGUUGUUGCAG | 21 | 5419 |
| SCNN1A-1571 | + | GUGGAUGGUGGUGUUGUUGCAG | 22 | 5420 |
| SCNN1A-1572 | + | CGUGGAUGGUGGUGUUGUUGCAG | 23 | 5421 |
| SCNN1A-1573 | + | CCGUGGAUGGUGGUGUUGUUGCAG | 24 | 5422 |
| SCNN1A-1574 | + | AAGACGAGCUUGUCCGAG | 18 | 5423 |
| SCNN1A-1575 | + | GAAGACGAGCUUGUCCGAG | 19 | 5424 |
| SCNN1A-236 | + | GGAAGACGAGCUUGUCCGAG | 20 | 856 |
| SCNN1A-1576 | + | GGGAAGACGAGCUUGUCCGAG | 21 | 5425 |
| SCNN1A-1577 | + | GGGGAAGACGAGCUUGUCCGAG | 22 | 5426 |
| SCNN1A-1578 | + | CGGGGAAGACGAGCUUGUCCGAG | 23 | 5427 |
| SCNN1A-1579 | + | GCGGGGAAGACGAGCUUGUCCGAG | 24 | 5428 |
| SCNN1A-1580 | + | UUGAGGCUGACGGGGUAG | 18 | 5429 |
| SCNN1A-1581 | + | GUUGAGGCUGACGGGGUAG | 19 | 5430 |
| SCNN1A-232 | + | UGUUGAGGCUGACGGGGUAG | 20 | 853 |
| SCNN1A-1582 | + | AUGUUGAGGCUGACGGGGUAG | 21 | 5431 |
| SCNN1A-1583 | + | GAUGUUGAGGCUGACGGGGUAG | 22 | 5432 |
| SCNN1A-1584 | + | UGAUGUUGAGGCUGACGGGGUAG | 23 | 5433 |
| SCNN1A-1585 | + | UUGAUGUUGAGGCUGACGGGGUAG | 24 | 5434 |
| SCNN1A-1586 | + | GAGCUCUCGGUAGGAGCG | 18 | 5435 |
| SCNN1A-1587 | + | AGAGCUCUCGGUAGGAGCG | 19 | 5436 |
| SCNN1A-216 | + | AAGAGCUCUCGGUAGGAGCG | 20 | 840 |
| SCNN1A-1588 | + | GAAGAGCUCUCGGUAGGAGCG | 21 | 5437 |
| SCNN1A-1589 | + | CGAAGAGCUCUCGGUAGGAGCG | 22 | 5438 |

TABLE 47G-continued

7th Tier

| gRNA Name | DNA Strand | Targeting Domain | Target Site Length | Seq ID |
|---|---|---|---|---|
| SCNN1A-1590 | + | UCGAAGAGCUCUCGGUAGGAGCG | 23 | 5439 |
| SCNN1A-1591 | + | CUCGAAGAGCUCUCGGUAGGAGCG | 24 | 5440 |
| SCNN1A-1592 | + | GUGCAGAUGGUCACUGCG | 18 | 5441 |
| SCNN1A-1593 | + | GGUGCAGAUGGUCACUGCG | 19 | 5442 |
| SCNN1A-39 | + | GGGUGCAGAUGGUCACUGCG | 20 | 518 |
| SCNN1A-1594 | + | AGGGUGCAGAUGGUCACUGCG | 21 | 5443 |
| SCNN1A-1595 | + | GAGGGUGCAGAUGGUCACUGCG | 22 | 5444 |
| SCNN1A-1596 | + | UGAGGGUGCAGAUGGUCACUGCG | 23 | 5445 |
| SCNN1A-1597 | + | UUGAGGGUGCAGAUGGUCACUGCG | 24 | 5446 |
| SCNN1A-1598 | + | UUGUUGCAGAAGAACUCG | 18 | 5447 |
| SCNN1A-1599 | + | GUUGUUGCAGAAGAACUCG | 19 | 5448 |
| SCNN1A-219 | + | UGUUGUUGCAGAAGAACUCG | 20 | 842 |
| SCNN1A-1600 | + | GUGUUGUUGCAGAAGAACUCG | 21 | 5449 |
| SCNN1A-1601 | + | GGUGUUGUUGCAGAAGAACUCG | 22 | 5450 |
| SCNN1A-1602 | + | UGGUGUUGUUGCAGAAGAACUCG | 23 | 5451 |
| SCNN1A-1603 | + | GUGGUGUUGUUGCAGAAGAACUCG | 24 | 5452 |
| SCNN1A-10863 | + | CAUGCACUAUCCUCUAGG | 18 | 14712 |
| SCNN1A-10864 | + | UCAUGCACUAUCCUCUAGG | 19 | 14713 |
| SCNN1A-10865 | + | AUCAUGCACUAUCCUCUAGG | 20 | 14714 |
| SCNN1A-10866 | + | GAUCAUGCACUAUCCUCUAGG | 21 | 14715 |
| SCNN1A-10867 | + | GGAUCAUGCACUAUCCUCUAGG | 22 | 14716 |
| SCNN1A-10868 | + | AGGAUCAUGCACUAUCCUCUAGG | 23 | 14717 |
| SCNN1A-10869 | + | CAGGAUCAUGCACUAUCCUCUAGG | 24 | 14718 |
| SCNN1A-1611 | + | AGCUCUCGGUAGGAGCGG | 18 | 5460 |
| SCNN1A-1612 | + | GAGCUCUCGGUAGGAGCGG | 19 | 5461 |
| SCNN1A-60 | + | AGAGCUCUCGGUAGGAGCGG | 20 | 590 |
| SCNN1A-1613 | + | AAGAGCUCUCGGUAGGAGCGG | 21 | 5462 |
| SCNN1A-1614 | + | GAAGAGCUCUCGGUAGGAGCGG | 22 | 5463 |
| SCNN1A-1615 | + | CGAAGAGCUCUCGGUAGGAGCGG | 23 | 5464 |
| SCNN1A-1616 | + | UCGAAGAGCUCUCGGUAGGAGCGG | 24 | 5465 |
| SCNN1A-1617 | + | AACUCGAAGAGCUCUCGG | 18 | 5466 |
| SCNN1A-1618 | + | GAACUCGAAGAGCUCUCGG | 19 | 5467 |
| SCNN1A-218 | + | AGAACUCGAAGAGCUCUCGG | 20 | 841 |
| SCNN1A-1619 | + | AAGAACUCGAAGAGCUCUCGG | 21 | 5468 |
| SCNN1A-1620 | + | GAAGAACUCGAAGAGCUCUCGG | 22 | 5469 |
| SCNN1A-1621 | + | AGAAGAACUCGAAGAGCUCUCGG | 23 | 5470 |
| SCNN1A-1622 | + | CAGAAGAACUCGAAGAGCUCUCGG | 24 | 5471 |

TABLE 47G-continued

7th Tier

| gRNA Name | DNA Strand | Targeting Domain | Target Site Length | Seq ID |
|---|---|---|---|---|
| SCNN1A-10870 | + | CAGGCGCAGGCACCAGGG | 18 | 14719 |
| SCNN1A-10871 | + | CCAGGCGCAGGCACCAGGG | 19 | 14720 |
| SCNN1A-10872 | + | UCCAGGCGCAGGCACCAGGG | 20 | 14721 |
| SCNN1A-10873 | + | UUCCAGGCGCAGGCACCAGGG | 21 | 14722 |
| SCNN1A-10874 | + | CUUCCAGGCGCAGGCACCAGGG | 22 | 14723 |
| SCNN1A-10875 | + | CCUUCCAGGCGCAGGCACCAGGG | 23 | 14724 |
| SCNN1A-10876 | + | CCCUUCCAGGCGCAGGCACCAGGG | 24 | 14725 |
| SCNN1A-10877 | + | CAGGCACCAGGGAAGGGG | 18 | 14726 |
| SCNN1A-10878 | + | GCAGGCACCAGGGAAGGGG | 19 | 14727 |
| SCNN1A-10879 | + | CGCAGGCACCAGGGAAGGGG | 20 | 14728 |
| SCNN1A-10880 | + | GCGCAGGCACCAGGGAAGGGG | 21 | 14729 |
| SCNN1A-10881 | + | GGCGCAGGCACCAGGGAAGGGG | 22 | 14730 |
| SCNN1A-10882 | + | AGGCGCAGGCACCAGGGAAGGGG | 23 | 14731 |
| SCNN1A-10883 | + | CAGGCGCAGGCACCAGGGAAGGGG | 24 | 14732 |
| SCNN1A-10884 | + | UGCAAUGCCUGGUCUGGG | 18 | 14733 |
| SCNN1A-10885 | + | UUGCAAUGCCUGGUCUGGG | 19 | 14734 |
| SCNN1A-10886 | + | AUUGCAAUGCCUGGUCUGGG | 20 | 14735 |
| SCNN1A-10887 | + | AAUUGCAAUGCCUGGUCUGGG | 21 | 14736 |
| SCNN1A-10888 | + | GAAUUGCAAUGCCUGGUCUGGG | 22 | 14737 |
| SCNN1A-10889 | + | AGAAUUGCAAUGCCUGGUCUGGG | 23 | 14738 |
| SCNN1A-10890 | + | AAGAAUUGCAAUGCCUGGUCUGGG | 24 | 14739 |
| SCNN1A-1637 | + | UCCGAGUUGAGGUUGAUG | 18 | 5486 |
| SCNN1A-1638 | + | GUCCGAGUUGAGGUUGAUG | 19 | 5487 |
| SCNN1A-235 | + | UGUCCGAGUUGAGGUUGAUG | 20 | 855 |
| SCNN1A-1639 | + | UUGUCCGAGUUGAGGUUGAUG | 21 | 5488 |
| SCNN1A-1640 | + | CUUGUCCGAGUUGAGGUUGAUG | 22 | 5489 |
| SCNN1A-1641 | + | GCUUGUCCGAGUUGAGGUUGAUG | 23 | 5490 |
| SCNN1A-1642 | + | AGCUUGUCCGAGUUGAGGUUGAUG | 24 | 5491 |
| SCNN1A-1643 | + | GGGUGCAGAUGGUCACUG | 18 | 5492 |
| SCNN1A-1644 | + | AGGGUGCAGAUGGUCACUG | 19 | 5493 |
| SCNN1A-37 | + | GAGGGUGCAGAUGGUCACUG | 20 | 517 |
| SCNN1A-1645 | + | UGAGGGUGCAGAUGGUCACUG | 21 | 5494 |
| SCNN1A-1646 | + | UUGAGGGUGCAGAUGGUCACUG | 22 | 5495 |
| SCNN1A-1647 | + | AUUGAGGGUGCAGAUGGUCACUG | 23 | 5496 |
| SCNN1A-1648 | + | GAUUGAGGGUGCAGAUGGUCACUG | 24 | 5497 |
| SCNN1A-1649 | + | GAGCCCUGGAGUGGACUG | 18 | 5498 |
| SCNN1A-1650 | + | UGAGCCCUGGAGUGGACUG | 19 | 5499 |
| SCNN1A-74 | + | AUGAGCCCUGGAGUGGACUG | 20 | 601 |

TABLE 47G-continued

7th Tier

| gRNA Name | DNA Strand | Targeting Domain | Target Site Length | Seq ID |
|---|---|---|---|---|
| SCNN1A-1651 | + | CAUGAGCCCUGGAGUGGACUG | 21 | 5500 |
| SCNN1A-1652 | + | UCAUGAGCCCUGGAGUGGACUG | 22 | 5501 |
| SCNN1A-1653 | + | UUCAUGAGCCCUGGAGUGGACUG | 23 | 5502 |
| SCNN1A-1654 | + | CUUCAUGAGCCCUGGAGUGGACUG | 24 | 5503 |
| SCNN1A-1655 | + | GAGGGACUAACCGACCUG | 18 | 5504 |
| SCNN1A-1656 | + | AGAGGGACUAACCGACCUG | 19 | 5505 |
| SCNN1A-1657 | + | CAGAGGGACUAACCGACCUG | 20 | 5506 |
| SCNN1A-1658 | + | GCAGAGGGACUAACCGACCUG | 21 | 5507 |
| SCNN1A-1659 | + | GGCAGAGGGACUAACCGACCUG | 22 | 5508 |
| SCNN1A-1660 | + | GGGCAGAGGGACUAACCGACCUG | 23 | 5509 |
| SCNN1A-1661 | + | GGGGCAGAGGGACUAACCGACCUG | 24 | 5510 |
| SCNN1A-1662 | + | AGGUUGAUGUUGAGGCUG | 18 | 5511 |
| SCNN1A-1663 | + | GAGGUUGAUGUUGAGGCUG | 19 | 5512 |
| SCNN1A-234 | + | UGAGGUUGAUGUUGAGGCUG | 20 | 854 |
| SCNN1A-1664 | + | UUGAGGUUGAUGUUGAGGCUG | 21 | 5513 |
| SCNN1A-1665 | + | GUUGAGGUUGAUGUUGAGGCUG | 22 | 5514 |
| SCNN1A-1666 | + | AGUUGAGGUUGAUGUUGAGGCUG | 23 | 5515 |
| SCNN1A-1667 | + | GAGUUGAGGUUGAUGUUGAGGCUG | 24 | 5516 |
| SCNN1A-1675 | + | CUCCUCCGCCGUGGGCUG | 18 | 5524 |
| SCNN1A-1676 | + | CCUCCUCCGCCGUGGGCUG | 19 | 5525 |
| SCNN1A-212 | + | UCCUCCUCCGCCGUGGGCUG | 20 | 837 |
| SCNN1A-1677 | + | CUCCUCCUCCGCCGUGGGCUG | 21 | 5526 |
| SCNN1A-1678 | + | CCUCCUCCUCCGCCGUGGGCUG | 22 | 5527 |
| SCNN1A-1679 | + | GCCUCCUCCUCCGCCGUGGGCUG | 23 | 5528 |
| SCNN1A-1680 | + | GGCCUCCUCCUCCGCCGUGGGCUG | 24 | 5529 |
| SCNN1A-1681 | + | UACAUCAUGCCAAAGGUG | 18 | 5530 |
| SCNN1A-1682 | + | GUACAUCAUGCCAAAGGUG | 19 | 5531 |
| SCNN1A-229 | + | AGUACAUCAUGCCAAAGGUG | 20 | 850 |
| SCNN1A-1683 | + | CAGUACAUCAUGCCAAAGGUG | 21 | 5532 |
| SCNN1A-1684 | + | CCAGUACAUCAUGCCAAAGGUG | 22 | 5533 |
| SCNN1A-1685 | + | GCCAGUACAUCAUGCCAAAGGUG | 23 | 5534 |
| SCNN1A-1686 | + | UGCCAGUACAUCAUGCCAAAGGUG | 24 | 5535 |
| SCNN1A-1687 | + | GCCCUGGAGUGGACUGUG | 18 | 5536 |
| SCNN1A-1688 | + | AGCCCUGGAGUGGACUGUG | 19 | 5537 |
| SCNN1A-202 | + | GAGCCCUGGAGUGGACUGUG | 20 | 831 |
| SCNN1A-1689 | + | UGAGCCCUGGAGUGGACUGUG | 21 | 5538 |
| SCNN1A-1690 | + | AUGAGCCCUGGAGUGGACUGUG | 22 | 5539 |

TABLE 47G-continued

7th Tier

| gRNA Name | DNA Strand | Targeting Domain | Target Site Length | Seq ID |
|---|---|---|---|---|
| SCNN1A-1691 | + | CAUGAGCCCUGGAGUGGACUGUG | 23 | 5540 |
| SCNN1A-1692 | + | UCAUGAGCCCUGGAGUGGACUGUG | 24 | 5541 |
| SCNN1A-1693 | + | CGUCUUCAUGCGGUUGUG | 18 | 5542 |
| SCNN1A-1694 | + | CCGUCUUCAUGCGGUUGUG | 19 | 5543 |
| SCNN1A-227 | + | GCCGUCUUCAUGCGGUUGUG | 20 | 848 |
| SCNN1A-1695 | + | GGCCGUCUUCAUGCGGUUGUG | 21 | 5544 |
| SCNN1A-1696 | + | AGGCCGUCUUCAUGCGGUUGUG | 22 | 5545 |
| SCNN1A-1697 | + | AAGGCCGUCUUCAUGCGGUUGUG | 23 | 5546 |
| SCNN1A-1698 | + | GAAGGCCGUCUUCAUGCGGUUGUG | 24 | 5547 |
| SCNN1A-10891 | + | AACAGGCUUGGUGUUGUG | 18 | 14740 |
| SCNN1A-10892 | + | GAACAGGCUUGGUGUUGUG | 19 | 14741 |
| SCNN1A-6347 | + | AGAACAGGCUUGGUGUUGUG | 20 | 10196 |
| SCNN1A-10893 | + | UAGAACAGGCUUGGUGUUGUG | 21 | 14742 |
| SCNN1A-10894 | + | CUAGAACAGGCUUGGUGUUGUG | 22 | 14743 |
| SCNN1A-10895 | + | GCUAGAACAGGCUUGGUGUUGUG | 23 | 14744 |
| SCNN1A-10896 | + | GGCUAGAACAGGCUUGGUGUUGUG | 24 | 14745 |
| SCNN1A-1705 | + | UGGAUGGUGGUGUUGUUG | 18 | 5554 |
| SCNN1A-1706 | + | GUGGAUGGUGGUGUUGUUG | 19 | 5555 |
| SCNN1A-222 | + | CGUGGAUGGUGGUGUUGUUG | 20 | 845 |
| SCNN1A-1707 | + | CCGUGGAUGGUGGUGUUGUUG | 21 | 5556 |
| SCNN1A-1708 | + | GCCGUGGAUGGUGGUGUUGUUG | 22 | 5557 |
| SCNN1A-1709 | + | CGCCGUGGAUGGUGGUGUUGUUG | 23 | 5558 |
| SCNN1A-1710 | + | GCGCCGUGGAUGGUGGUGUUGUUG | 24 | 5559 |
| SCNN1A-10897 | + | UGUGAGGAAAAUAGAAAU | 18 | 14746 |
| SCNN1A-10898 | + | UUGUGAGGAAAAUAGAAAU | 19 | 14747 |
| SCNN1A-10899 | + | GUUGUGAGGAAAAUAGAAAU | 20 | 14748 |
| SCNN1A-10900 | + | UGUUGUGAGGAAAAUAGAAAU | 21 | 14749 |
| SCNN1A-10901 | + | GUGUUGUGAGGAAAAUAGAAAU | 22 | 14750 |
| SCNN1A-10902 | + | GGUGUUGUGAGGAAAAUAGAAAU | 23 | 14751 |
| SCNN1A-10903 | + | UGGUGUUGUGAGGAAAAUAGAAAU | 24 | 14752 |
| SCNN1A-10904 | + | GGGUAUGGGAGUGGCAAU | 18 | 14753 |
| SCNN1A-10905 | + | CGGGUAUGGGAGUGGCAAU | 19 | 14754 |
| SCNN1A-10906 | + | CCGGGUAUGGGAGUGGCAAU | 20 | 14755 |
| SCNN1A-10907 | + | GCCGGGUAUGGGAGUGGCAAU | 21 | 14756 |
| SCNN1A-10908 | + | UGCCGGGUAUGGGAGUGGCAAU | 22 | 14757 |
| SCNN1A-10909 | + | CUGCCGGGUAUGGGAGUGGCAAU | 23 | 14758 |
| SCNN1A-10910 | + | CCUGCCGGGUAUGGGAGUGGCAAU | 24 | 14759 |
| SCNN1A-1711 | + | GGAGCGGUGGAACUCGAU | 18 | 5560 |

TABLE 47G-continued

7th Tier

| gRNA Name | DNA Strand | Targeting Domain | Target Site Length | Seq ID |
|---|---|---|---|---|
| SCNN1A-1712 | + | AGGAGCGGUGGAACUCGAU | 19 | 5561 |
| SCNN1A-214 | + | UAGGAGCGGUGGAACUCGAU | 20 | 839 |
| SCNN1A-1713 | + | GUAGGAGCGGUGGAACUCGAU | 21 | 5562 |
| SCNN1A-1714 | + | GGUAGGAGCGGUGGAACUCGAU | 22 | 5563 |
| SCNN1A-1715 | + | CGGUAGGAGCGGUGGAACUCGAU | 23 | 5564 |
| SCNN1A-1716 | + | UCGGUAGGAGCGGUGGAACUCGAU | 24 | 5565 |
| SCNN1A-1723 | + | AGGGUGCAGAUGGUCACU | 18 | 5572 |
| SCNN1A-1724 | + | GAGGGUGCAGAUGGUCACU | 19 | 5573 |
| SCNN1A-242 | + | UGAGGGUGCAGAUGGUCACU | 20 | 859 |
| SCNN1A-1725 | + | UUGAGGGUGCAGAUGGUCACU | 21 | 5574 |
| SCNN1A-1726 | + | AUUGAGGGUGCAGAUGGUCACU | 22 | 5575 |
| SCNN1A-1727 | + | GAUUGAGGGUGCAGAUGGUCACU | 23 | 5576 |
| SCNN1A-1728 | + | GGAUUGAGGGUGCAGAUGGUCACU | 24 | 5577 |
| SCNN1A-1729 | + | UGAGCCCUGGAGUGGACU | 18 | 5578 |
| SCNN1A-1730 | + | AUGAGCCCUGGAGUGGACU | 19 | 5579 |
| SCNN1A-204 | + | CAUGAGCCCUGGAGUGGACU | 20 | 832 |
| SCNN1A-1731 | + | UCAUGAGCCCUGGAGUGGACU | 21 | 5580 |
| SCNN1A-1732 | + | UUCAUGAGCCCUGGAGUGGACU | 22 | 5581 |
| SCNN1A-1733 | + | CUUCAUGAGCCCUGGAGUGGACU | 23 | 5582 |
| SCNN1A-1734 | + | CCUUCAUGAGCCCUGGAGUGGACU | 24 | 5583 |
| SCNN1A-1748 | + | UCUUCAUGCGGUUGUGCU | 18 | 5597 |
| SCNN1A-1749 | + | GUCUUCAUGCGGUUGUGCU | 19 | 5598 |
| SCNN1A-50 | + | CGUCUUCAUGCGGUUGUGCU | 20 | 583 |
| SCNN1A-1750 | + | CCGUCUUCAUGCGGUUGUGCU | 21 | 5599 |
| SCNN1A-1751 | + | GCCGUCUUCAUGCGGUUGUGCU | 22 | 5600 |
| SCNN1A-1752 | + | GGCCGUCUUCAUGCGGUUGUGCU | 23 | 5601 |
| SCNN1A-1753 | + | AGGCCGUCUUCAUGCGGUUGUGCU | 24 | 5602 |
| SCNN1A-10911 | + | UUAUUUUCUUAUUUAUCU | 18 | 14760 |
| SCNN1A-10912 | + | UUUAUUUUCUUAUUUAUCU | 19 | 14761 |
| SCNN1A-10913 | + | UUUUAUUUUCUUAUUUAUCU | 20 | 14762 |
| SCNN1A-10914 | + | CUUUUAUUUUCUUAUUUAUCU | 21 | 14763 |
| SCNN1A-10915 | + | GCUUUUAUUUUCUUAUUUAUCU | 22 | 14764 |
| SCNN1A-10916 | + | UGCUUUUAUUUUCUUAUUUAUCU | 23 | 14765 |
| SCNN1A-10917 | + | UUGCUUUUAUUUUCUUAUUUAUCU | 24 | 14766 |
| SCNN1A-1754 | + | GGGUAGCUGAAGUACUCU | 18 | 5603 |
| SCNN1A-1755 | + | GGGGUAGCUGAAGUACUCU | 19 | 5604 |
| SCNN1A-231 | + | CGGGGUAGCUGAAGUACUCU | 20 | 852 |

TABLE 47G-continued

7th Tier

| gRNA Name | DNA Strand | Targeting Domain | Target Site Length | Seq ID |
|---|---|---|---|---|
| SCNN1A-1756 | + | ACGGGGUAGCUGAAGUACUCU | 21 | 5605 |
| SCNN1A-1757 | + | GACGGGGUAGCUGAAGUACUCU | 22 | 5606 |
| SCNN1A-1758 | + | UGACGGGGUAGCUGAAGUACUCU | 23 | 5607 |
| SCNN1A-1759 | + | CUGACGGGGUAGCUGAAGUACUCU | 24 | 5608 |
| SCNN1A-1760 | + | UGCUGGGGCGCCGCAGGU | 18 | 5609 |
| SCNN1A-1761 | + | CUGCUGGGGCGCCGCAGGU | 19 | 5610 |
| SCNN1A-210 | + | GCUGCUGGGGCGCCGCAGGU | 20 | 836 |
| SCNN1A-1762 | + | GGCUGCUGGGGCGCCGCAGGU | 21 | 5611 |
| SCNN1A-1763 | + | GGGCUGCUGGGGCGCCGCAGGU | 22 | 5612 |
| SCNN1A-1764 | + | UGGGCUGCUGGGGCGCCGCAGGU | 23 | 5613 |
| SCNN1A-1765 | + | GUGGGCUGCUGGGGCGCCGCAGGU | 24 | 5614 |
| SCNN1A-10918 | + | CAGUUCCCACCCUCAGGU | 18 | 14767 |
| SCNN1A-10919 | + | UCAGUUCCCACCCUCAGGU | 19 | 14768 |
| SCNN1A-10920 | + | GUCAGUUCCCACCCUCAGGU | 20 | 14769 |
| SCNN1A-10921 | + | UGUCAGUUCCCACCCUCAGGU | 21 | 14770 |
| SCNN1A-10922 | + | GUGUCAGUUCCCACCCUCAGGU | 22 | 14771 |
| SCNN1A-10923 | + | GGUGUCAGUUCCCACCCUCAGGU | 23 | 14772 |
| SCNN1A-10924 | + | GGGUGUCAGUUCCCACCCUCAGGU | 24 | 14773 |
| SCNN1A-1766 | + | ACUCGAAGAGCUCUCGGU | 18 | 5615 |
| SCNN1A-1767 | + | AACUCGAAGAGCUCUCGGU | 19 | 5616 |
| SCNN1A-58 | + | GAACUCGAAGAGCUCUCGGU | 20 | 524 |
| SCNN1A-1768 | + | AGAACUCGAAGAGCUCUCGGU | 21 | 5617 |
| SCNN1A-1769 | + | AAGAACUCGAAGAGCUCUCGGU | 22 | 5618 |
| SCNN1A-1770 | + | GAAGAACUCGAAGAGCUCUCGGU | 23 | 5619 |
| SCNN1A-1771 | + | AGAAGAACUCGAAGAGCUCUCGGU | 24 | 5620 |
| SCNN1A-10925 | + | UGCCACGUCCUGCCGGGU | 18 | 14774 |
| SCNN1A-10926 | + | CUGCCACGUCCUGCCGGGU | 19 | 14775 |
| SCNN1A-10927 | + | CCUGCCACGUCCUGCCGGGU | 20 | 14776 |
| SCNN1A-10928 | + | CCCUGCCACGUCCUGCCGGGU | 21 | 14777 |
| SCNN1A-10929 | + | ACCCUGCCACGUCCUGCCGGGU | 22 | 14778 |
| SCNN1A-10930 | + | GACCCUGCCACGUCCUGCCGGGU | 23 | 14779 |
| SCNN1A-10931 | + | UGACCCUGCCACGUCCUGCCGGGU | 24 | 14780 |
| SCNN1A-10932 | + | AGAAUUGCAAUGCCUGGU | 18 | 14781 |
| SCNN1A-10933 | + | AAGAAUUGCAAUGCCUGGU | 19 | 14782 |
| SCNN1A-10934 | + | GAAGAAUUGCAAUGCCUGGU | 20 | 14783 |
| SCNN1A-10935 | + | AGAAGAAUUGCAAUGCCUGGU | 21 | 14784 |
| SCNN1A-10936 | + | GAGAAGAAUUGCAAUGCCUGGU | 22 | 14785 |
| SCNN1A-10937 | + | UGAGAAGAAUUGCAAUGCCUGGU | 23 | 14786 |

TABLE 47G-continued

7th Tier

| gRNA Name | DNA Strand | Targeting Domain | Target Site Length | Seq ID |
|---|---|---|---|---|
| SCNN1A-10938 | + | GUGAGAAGAAUUGCAAUGCCUGGU | 24 | 14787 |
| SCNN1A-10939 | + | UGAGACCUGGACUUUGGU | 18 | 14788 |
| SCNN1A-10940 | + | CUGAGACCUGGACUUUGGU | 19 | 14789 |
| SCNN1A-10941 | + | UCUGAGACCUGGACUUUGGU | 20 | 14790 |
| SCNN1A-10942 | + | AUCUGAGACCUGGACUUUGGU | 21 | 14791 |
| SCNN1A-10943 | + | AAUCUGAGACCUGGACUUUGGU | 22 | 14792 |
| SCNN1A-10944 | + | AAAUCUGAGACCUGGACUUUGGU | 23 | 14793 |
| SCNN1A-10945 | + | GAAAUCUGAGACCUGGACUUUGGU | 24 | 14794 |
| SCNN1A-10946 | + | GAACAGGCUUGGUGUUGU | 18 | 14795 |
| SCNN1A-10947 | + | AGAACAGGCUUGGUGUUGU | 19 | 14796 |
| SCNN1A-10948 | + | UAGAACAGGCUUGGUGUUGU | 20 | 14797 |
| SCNN1A-10949 | + | CUAGAACAGGCUUGGUGUUGU | 21 | 14798 |
| SCNN1A-10950 | + | GCUAGAACAGGCUUGGUGUUGU | 22 | 14799 |
| SCNN1A-10951 | + | GGCUAGAACAGGCUUGGUGUUGU | 23 | 14800 |
| SCNN1A-10952 | + | GGGCUAGAACAGGCUUGGUGUUGU | 24 | 14801 |
| SCNN1A-1784 | + | GCUGGGGCGCCGCAGGUU | 18 | 5633 |
| SCNN1A-1785 | + | UGCUGGGGCGCCGCAGGUU | 19 | 5634 |
| SCNN1A-69 | + | CUGCUGGGGCGCCGCAGGUU | 20 | 597 |
| SCNN1A-1786 | + | GCUGCUGGGGCGCCGCAGGUU | 21 | 5635 |
| SCNN1A-1787 | + | GGCUGCUGGGGCGCCGCAGGUU | 22 | 5636 |
| SCNN1A-1788 | + | GGGCUGCUGGGGCGCCGCAGGUU | 23 | 5637 |
| SCNN1A-1789 | + | UGGGCUGCUGGGGCGCCGCAGGUU | 24 | 5638 |
| SCNN1A-10953 | + | UAGAACAGGCUUGGUGUU | 18 | 14802 |
| SCNN1A-10954 | + | CUAGAACAGGCUUGGUGUU | 19 | 14803 |
| SCNN1A-10955 | + | GCUAGAACAGGCUUGGUGUU | 20 | 14804 |
| SCNN1A-10956 | + | GGCUAGAACAGGCUUGGUGUU | 21 | 14805 |
| SCNN1A-10957 | + | GGGCUAGAACAGGCUUGGUGUU | 22 | 14806 |
| SCNN1A-10958 | + | CGGGCUAGAACAGGCUUGGUGUU | 23 | 14807 |
| SCNN1A-10959 | + | GCGGGCUAGAACAGGCUUGGUGUU | 24 | 14808 |
| SCNN1A-10960 | − | AGAAAAUAAAAGCAAAAA | 18 | 14809 |
| SCNN1A-10961 | − | AAGAAAAUAAAAGCAAAAA | 19 | 14810 |
| SCNN1A-6277 | − | UAAGAAAAUAAAAGCAAAAA | 20 | 10126 |
| SCNN1A-10962 | − | AUAAGAAAAUAAAAGCAAAAA | 21 | 14811 |
| SCNN1A-10963 | − | AAUAAGAAAAUAAAAGCAAAAA | 22 | 14812 |
| SCNN1A-10964 | − | AAAUAAGAAAAUAAAAGCAAAAA | 23 | 14813 |
| SCNN1A-10965 | − | UAAAUAAGAAAAUAAAAGCAAAAA | 24 | 14814 |
| SCNN1A-10966 | − | AAGAAAAUAAAAGCAAAA | 18 | 14815 |

TABLE 47G-continued

7th Tier

| gRNA Name | DNA Strand | Targeting Domain | Target Site Length | Seq ID |
|---|---|---|---|---|
| SCNN1A-10967 | – | UAAGAAAAUAAAAGCAAAA | 19 | 14816 |
| SCNN1A-10968 | – | AUAAGAAAAUAAAAGCAAAA | 20 | 14817 |
| SCNN1A-10969 | – | AAUAAGAAAAUAAAAGCAAAA | 21 | 14818 |
| SCNN1A-10970 | – | AAAUAAGAAAAUAAAAGCAAAA | 22 | 14819 |
| SCNN1A-10971 | – | UAAAUAAGAAAAUAAAAGCAAAA | 23 | 14820 |
| SCNN1A-10972 | – | AUAAAUAAGAAAAUAAAAGCAAAA | 24 | 14821 |
| SCNN1A-10973 | – | AUGGUCUCUGUCAUAAAA | 18 | 14822 |
| SCNN1A-10974 | – | CAUGGUCUCUGUCAUAAAA | 19 | 14823 |
| SCNN1A-10975 | – | GCAUGGUCUCUGUCAUAAAA | 20 | 14824 |
| SCNN1A-10976 | – | AGCAUGGUCUCUGUCAUAAAA | 21 | 14825 |
| SCNN1A-10977 | – | UAGCAUGGUCUCUGUCAUAAAA | 22 | 14826 |
| SCNN1A-10978 | – | AUAGCAUGGUCUCUGUCAUAAAA | 23 | 14827 |
| SCNN1A-10979 | – | UAUAGCAUGGUCUCUGUCAUAAAA | 24 | 14828 |
| SCNN1A-10980 | – | UAAAAGAUCAUCUUUAAA | 18 | 14829 |
| SCNN1A-10981 | – | UUAAAAGAUCAUCUUUAAA | 19 | 14830 |
| SCNN1A-10982 | – | UUUAAAAGAUCAUCUUUAAA | 20 | 14831 |
| SCNN1A-10983 | – | CUUUAAAAGAUCAUCUUUAAA | 21 | 14832 |
| SCNN1A-10984 | – | ACUUUAAAAGAUCAUCUUUAAA | 22 | 14833 |
| SCNN1A-10985 | – | CACUUUAAAAGAUCAUCUUUAAA | 23 | 14834 |
| SCNN1A-10986 | – | ACACUUUAAAAGAUCAUCUUUAAA | 24 | 14835 |
| SCNN1A-10987 | – | UUUGGGGAGGGAAAGGAA | 18 | 14836 |
| SCNN1A-10988 | – | CUUUGGGGAGGGAAAGGAA | 19 | 14837 |
| SCNN1A-6283 | – | CCUUUGGGGAGGGAAAGGAA | 20 | 10132 |
| SCNN1A-10989 | – | CCCUUUGGGGAGGGAAAGGAA | 21 | 14838 |
| SCNN1A-10990 | – | CCCCUUUGGGGAGGGAAAGGAA | 22 | 14839 |
| SCNN1A-10991 | – | UCCCCUUUGGGGAGGGAAAGGAA | 23 | 14840 |
| SCNN1A-10992 | – | CUCCCCUUUGGGGAGGGAAAGGAA | 24 | 14841 |
| SCNN1A-10993 | – | UCCCCUUUGGGGAGGGAA | 18 | 14842 |
| SCNN1A-10994 | – | CUCCCCUUUGGGGAGGGAA | 19 | 14843 |
| SCNN1A-6285 | – | GCUCCCCUUUGGGGAGGGAA | 20 | 10134 |
| SCNN1A-10995 | – | GGCUCCCCUUUGGGGAGGGAA | 21 | 14844 |
| SCNN1A-10996 | – | UGGCUCCCCUUUGGGGAGGGAA | 22 | 14845 |
| SCNN1A-10997 | – | GUGGCUCCCCUUUGGGGAGGGAA | 23 | 14846 |
| SCNN1A-10998 | – | GGUGGCUCCCCUUUGGGGAGGGAA | 24 | 14847 |
| SCNN1A-1796 | – | CACUCCAGGGCUCAUGAA | 18 | 5645 |
| SCNN1A-1797 | – | CCACUCCAGGGCUCAUGAA | 19 | 5646 |
| SCNN1A-11 | – | UCCACUCCAGGGCUCAUGAA | 20 | 560 |
| SCNN1A-1798 | – | GUCCACUCCAGGGCUCAUGAA | 21 | 5647 |

TABLE 47G-continued

7th Tier

| gRNA Name | DNA Strand | Targeting Domain | Target Site Length | Seq ID |
|---|---|---|---|---|
| SCNN1A-1799 | - | AGUCCACUCCAGGGCUCAUGAA | 22 | 5648 |
| SCNN1A-1800 | - | CAGUCCACUCCAGGGCUCAUGAA | 23 | 5649 |
| SCNN1A-1801 | - | ACAGUCCACUCCAGGGCUCAUGAA | 24 | 5650 |
| SCNN1A-10999 | - | GGAAAGGAAGGGGACUAA | 18 | 14848 |
| SCNN1A-11000 | - | GGGAAAGGAAGGGGACUAA | 19 | 14849 |
| SCNN1A-6288 | - | AGGGAAAGGAAGGGGACUAA | 20 | 10137 |
| SCNN1A-11001 | - | GAGGGAAAGGAAGGGGACUAA | 21 | 14850 |
| SCNN1A-11002 | - | GGAGGGAAAGGAAGGGGACUAA | 22 | 14851 |
| SCNN1A-11003 | - | GGGAGGGAAAGGAAGGGGACUAA | 23 | 14852 |
| SCNN1A-11004 | - | GGGGAGGGAAAGGAAGGGGACUAA | 24 | 14853 |
| SCNN1A-11005 | - | AGGGUGCUGAGGUGCUCA | 18 | 14854 |
| SCNN1A-11006 | - | CAGGGUGCUGAGGUGCUCA | 19 | 14855 |
| SCNN1A-11007 | - | CCAGGGUGCUGAGGUGCUCA | 20 | 14856 |
| SCNN1A-11008 | - | UCCAGGGUGCUGAGGUGCUCA | 21 | 14857 |
| SCNN1A-11009 | - | GUCCAGGGUGCUGAGGUGCUCA | 22 | 14858 |
| SCNN1A-11010 | - | GGUCCAGGGUGCUGAGGUGCUCA | 23 | 14859 |
| SCNN1A-11011 | - | UGGUCCAGGGUGCUGAGGUGCUCA | 24 | 14860 |
| SCNN1A-11012 | - | CUUUGGGGAGGGAAAGGA | 18 | 14861 |
| SCNN1A-11013 | - | CCUUUGGGGAGGGAAAGGA | 19 | 14862 |
| SCNN1A-6295 | - | CCCUUUGGGGAGGGAAAGGA | 20 | 10144 |
| SCNN1A-11014 | - | CCCCUUUGGGGAGGGAAAGGA | 21 | 14863 |
| SCNN1A-11015 | - | UCCCCUUUGGGGAGGGAAAGGA | 22 | 14864 |
| SCNN1A-11016 | - | CUCCCCUUUGGGGAGGGAAAGGA | 23 | 14865 |
| SCNN1A-11017 | - | GCUCCCCUUUGGGGAGGGAAAGGA | 24 | 14866 |
| SCNN1A-11018 | - | CUCCCCUUUGGGGAGGGA | 18 | 14867 |
| SCNN1A-11019 | - | GCUCCCCUUUGGGGAGGGA | 19 | 14868 |
| SCNN1A-11020 | - | GGCUCCCCUUUGGGGAGGGA | 20 | 14869 |
| SCNN1A-11021 | - | UGGCUCCCCUUUGGGGAGGGA | 21 | 14870 |
| SCNN1A-11022 | - | GUGGCUCCCCUUUGGGGAGGGA | 22 | 14871 |
| SCNN1A-11023 | - | GGUGGCUCCCCUUUGGGGAGGGA | 23 | 14872 |
| SCNN1A-11024 | - | UGGUGGCUCCCCUUUGGGGAGGGA | 24 | 14873 |
| SCNN1A-11025 | - | GUGGCUCCCCUUUGGGGA | 18 | 14874 |
| SCNN1A-11026 | - | GGUGGCUCCCCUUUGGGGA | 19 | 14875 |
| SCNN1A-6297 | - | UGGUGGCUCCCCUUUGGGGA | 20 | 10146 |
| SCNN1A-11027 | - | AUGGUGGCUCCCCUUUGGGGA | 21 | 14876 |
| SCNN1A-11028 | - | UAUGGUGGCUCCCCUUUGGGGA | 22 | 14877 |
| SCNN1A-11029 | - | UUAUGGUGGCUCCCCUUUGGGGA | 23 | 14878 |

TABLE 47G-continued

7th Tier

| gRNA Name | DNA Strand | Targeting Domain | Target Site Length | Seq ID |
|---|---|---|---|---|
| SCNN1A-11030 | − | AUUAUGGUGGCUCCCCUUUGGGGA | 24 | 14879 |
| SCNN1A-1833 | − | CCACUCCAGGGCUCAUGA | 18 | 5682 |
| SCNN1A-1834 | − | UCCACUCCAGGGCUCAUGA | 19 | 5683 |
| SCNN1A-10 | − | GUCCACUCCAGGGCUCAUGA | 20 | 505 |
| SCNN1A-1835 | − | AGUCCACUCCAGGGCUCAUGA | 21 | 5684 |
| SCNN1A-1836 | − | CAGUCCACUCCAGGGCUCAUGA | 22 | 5685 |
| SCNN1A-1837 | − | ACAGUCCACUCCAGGGCUCAUGA | 23 | 5686 |
| SCNN1A-1838 | − | CACAGUCCACUCCAGGGCUCAUGA | 24 | 5687 |
| SCNN1A-11031 | − | GGGAAAGGAAGGGGACUA | 18 | 14880 |
| SCNN1A-11032 | − | AGGGAAAGGAAGGGGACUA | 19 | 14881 |
| SCNN1A-6300 | − | GAGGGAAAGGAAGGGGACUA | 20 | 10149 |
| SCNN1A-11033 | − | GGAGGGAAAGGAAGGGGACUA | 21 | 14882 |
| SCNN1A-11034 | − | GGGAGGGAAAGGAAGGGGACUA | 22 | 14883 |
| SCNN1A-11035 | − | GGGGAGGGAAAGGAAGGGGACUA | 23 | 14884 |
| SCNN1A-11036 | − | UGGGGAGGGAAAGGAAGGGGACUA | 24 | 14885 |
| SCNN1A-1851 | − | CGAGUUCCACCGCUCCUA | 18 | 5700 |
| SCNN1A-1852 | − | UCGAGUUCCACCGCUCCUA | 19 | 5701 |
| SCNN1A-190 | − | AUCGAGUUCCACCGCUCCUA | 20 | 820 |
| SCNN1A-1853 | − | GAUCGAGUUCCACCGCUCCUA | 21 | 5702 |
| SCNN1A-1854 | − | UGAUCGAGUUCCACCGCUCCUA | 22 | 5703 |
| SCNN1A-1855 | − | CUGAUCGAGUUCCACCGCUCCUA | 23 | 5704 |
| SCNN1A-1856 | − | CCUGAUCGAGUUCCACCGCUCCUA | 24 | 5705 |
| SCNN1A-1857 | − | CUCAACAUCAACCUCAAC | 18 | 5706 |
| SCNN1A-1858 | − | CCUCAACAUCAACCUCAAC | 19 | 5707 |
| SCNN1A-198 | − | GCCUCAACAUCAACCUCAAC | 20 | 827 |
| SCNN1A-1859 | − | AGCCUCAACAUCAACCUCAAC | 21 | 5708 |
| SCNN1A-1860 | − | CAGCCUCAACAUCAACCUCAAC | 22 | 5709 |
| SCNN1A-1861 | − | UCAGCCUCAACAUCAACCUCAAC | 23 | 5710 |
| SCNN1A-1862 | − | GUCAGCCUCAACAUCAACCUCAAC | 24 | 5711 |
| SCNN1A-11037 | − | GCAGGCAGAGCCUCAGAC | 18 | 14886 |
| SCNN1A-11038 | − | GGCAGGCAGAGCCUCAGAC | 19 | 14887 |
| SCNN1A-11039 | − | GGGCAGGCAGAGCCUCAGAC | 20 | 14888 |
| SCNN1A-11040 | − | UGGGCAGGCAGAGCCUCAGAC | 21 | 14889 |
| SCNN1A-11041 | − | CUGGGCAGGCAGAGCCUCAGAC | 22 | 14890 |
| SCNN1A-11042 | − | ACUGGGCAGGCAGAGCCUCAGAC | 23 | 14891 |
| SCNN1A-11043 | − | CACUGGGCAGGCAGAGCCUCAGAC | 24 | 14892 |
| SCNN1A-1870 | − | AGUUCCACCGCUCCUACC | 18 | 5719 |
| SCNN1A-1871 | − | GAGUUCCACCGCUCCUACC | 19 | 5720 |

TABLE 47G-continued

7th Tier

| gRNA Name | DNA Strand | Targeting Domain | Target Site Length | Seq ID |
|---|---|---|---|---|
| SCNN1A-191 | - | CGAGUUCCACCGCUCCUACC | 20 | 821 |
| SCNN1A-1872 | - | UCGAGUUCCACCGCUCCUACC | 21 | 5721 |
| SCNN1A-1873 | - | AUCGAGUUCCACCGCUCCUACC | 22 | 5722 |
| SCNN1A-1874 | - | GAUCGAGUUCCACCGCUCCUACC | 23 | 5723 |
| SCNN1A-1875 | - | UGAUCGAGUUCCACCGCUCCUACC | 24 | 5724 |
| SCNN1A-11044 | - | UGCUGCUGUACUCCAGCC | 18 | 14893 |
| SCNN1A-11045 | - | AUGCUGCUGUACUCCAGCC | 19 | 14894 |
| SCNN1A-11046 | - | CAUGCUGCUGUACUCCAGCC | 20 | 14895 |
| SCNN1A-11047 | - | UCAUGCUGCUGUACUCCAGCC | 21 | 14896 |
| SCNN1A-11048 | - | AUCAUGCUGCUGUACUCCAGCC | 22 | 14897 |
| SCNN1A-11049 | - | GAUCAUGCUGCUGUACUCCAGCC | 23 | 14898 |
| SCNN1A-11050 | - | UGAUCAUGCUGCUGUACUCCAGCC | 24 | 14899 |
| SCNN1A-11051 | - | UUCCCUGGUGCCUGCGCC | 18 | 14900 |
| SCNN1A-11052 | - | CUUCCCUGGUGCCUGCGCC | 19 | 14901 |
| SCNN1A-6315 | - | CCUUCCCUGGUGCCUGCGCC | 20 | 10164 |
| SCNN1A-11053 | - | CCCUUCCCUGGUGCCUGCGCC | 21 | 14902 |
| SCNN1A-11054 | - | CCCCUUCCCUGGUGCCUGCGCC | 22 | 14903 |
| SCNN1A-11055 | - | GCCCCUUCCCUGGUGCCUGCGCC | 23 | 14904 |
| SCNN1A-11056 | - | UGCCCCUUCCCUGGUGCCUGCGCC | 24 | 14905 |
| SCNN1A-1883 | - | AGGAGCAGGGGCUGGGCC | 18 | 5732 |
| SCNN1A-1884 | - | GAGGAGCAGGGGCUGGGCC | 19 | 5733 |
| SCNN1A-182 | - | UGAGGAGCAGGGGCUGGGCC | 20 | 815 |
| SCNN1A-1885 | - | GUGAGGAGCAGGGGCUGGGCC | 21 | 5734 |
| SCNN1A-1886 | - | CGUGAGGAGCAGGGGCUGGGCC | 22 | 5735 |
| SCNN1A-1887 | - | GCGUGAGGAGCAGGGGCUGGGCC | 23 | 5736 |
| SCNN1A-1888 | - | AGCGUGAGGAGCAGGGGCUGGGCC | 24 | 5737 |
| SCNN1A-1895 | - | UCAUGAAGGGGAACAAGC | 18 | 5744 |
| SCNN1A-1896 | - | CUCAUGAAGGGGAACAAGC | 19 | 5745 |
| SCNN1A-176 | - | GCUCAUGAAGGGGAACAAGC | 20 | 811 |
| SCNN1A-1897 | - | GGCUCAUGAAGGGGAACAAGC | 21 | 5746 |
| SCNN1A-1898 | - | GGGCUCAUGAAGGGGAACAAGC | 22 | 5747 |
| SCNN1A-1899 | - | AGGGCUCAUGAAGGGGAACAAGC | 23 | 5748 |
| SCNN1A-1900 | - | CAGGGCUCAUGAAGGGGAACAAGC | 24 | 5749 |
| SCNN1A-1916 | - | GGAACAAGCGUGAGGAGC | 18 | 5765 |
| SCNN1A-1917 | - | GGGAACAAGCGUGAGGAGC | 19 | 5766 |
| SCNN1A-14 | - | GGGGAACAAGCGUGAGGAGC | 20 | 506 |
| SCNN1A-1918 | - | AGGGGAACAAGCGUGAGGAGC | 21 | 5767 |

TABLE 47G-continued

7th Tier

| gRNA Name | DNA Strand | Targeting Domain | Target Site Length | Seq ID |
|---|---|---|---|---|
| SCNN1A-1919 | - | AAGGGGAACAAGCGUGAGGAGC | 22 | 5768 |
| SCNN1A-1920 | - | GAAGGGGAACAAGCGUGAGGAGC | 23 | 5769 |
| SCNN1A-1921 | - | UGAAGGGGAACAAGCGUGAGGAGC | 24 | 5770 |
| SCNN1A-1922 | - | UGCUCCCAGCACAACCGC | 18 | 5771 |
| SCNN1A-1923 | - | GUGCUCCCAGCACAACCGC | 19 | 5772 |
| SCNN1A-193 | - | UGUGCUCCCAGCACAACCGC | 20 | 823 |
| SCNN1A-1924 | - | GUGUGCUCCCAGCACAACCGC | 21 | 5773 |
| SCNN1A-1925 | - | GGUGUGCUCCCAGCACAACCGC | 22 | 5774 |
| SCNN1A-1926 | - | UGGUGUGCUCCCAGCACAACCGC | 23 | 5775 |
| SCNN1A-1927 | - | CUGGUGUGCUCCCAGCACAACCGC | 24 | 5776 |
| SCNN1A-11057 | - | CUUCCCUGGUGCCUGCGC | 18 | 14906 |
| SCNN1A-11058 | - | CCUUCCCUGGUGCCUGCGC | 19 | 14907 |
| SCNN1A-11059 | - | CCCUUCCCUGGUGCCUGCGC | 20 | 14908 |
| SCNN1A-11060 | - | CCCCUUCCCUGGUGCCUGCGC | 21 | 14909 |
| SCNN1A-11061 | - | GCCCCUUCCCUGGUGCCUGCGC | 22 | 14910 |
| SCNN1A-11062 | - | UGCCCCUUCCCUGGUGCCUGCGC | 23 | 14911 |
| SCNN1A-11063 | - | CUGCCCCUUCCCUGGUGCCUGCGC | 24 | 14912 |
| SCNN1A-1948 | - | GCCCUCCACAGUCCACUC | 18 | 5797 |
| SCNN1A-1949 | - | AGCCCUCCACAGUCCACUC | 19 | 5798 |
| SCNN1A-170 | - | UAGCCCUCCACAGUCCACUC | 20 | 808 |
| SCNN1A-1954 | - | CAGUCCACUCCAGGGCUC | 18 | 5803 |
| SCNN1A-1955 | - | ACAGUCCACUCCAGGGCUC | 19 | 5804 |
| SCNN1A-171 | - | CACAGUCCACUCCAGGGCUC | 20 | 809 |
| SCNN1A-1956 | - | CCACAGUCCACUCCAGGGCUC | 21 | 5805 |
| SCNN1A-1957 | - | UCCACAGUCCACUCCAGGGCUC | 22 | 5806 |
| SCNN1A-1958 | - | CUCCACAGUCCACUCCAGGGCUC | 23 | 5807 |
| SCNN1A-1959 | - | CCUCCACAGUCCACUCCAGGGCUC | 24 | 5808 |
| SCNN1A-1995 | - | ACUCCAGGGCUCAUGAAG | 18 | 5844 |
| SCNN1A-1996 | - | CACUCCAGGGCUCAUGAAG | 19 | 5845 |
| SCNN1A-12 | - | CCACUCCAGGGCUCAUGAAG | 20 | 561 |
| SCNN1A-1997 | - | UCCACUCCAGGGCUCAUGAAG | 21 | 5846 |
| SCNN1A-1998 | - | GUCCACUCCAGGGCUCAUGAAG | 22 | 5847 |
| SCNN1A-1999 | - | AGUCCACUCCAGGGCUCAUGAAG | 23 | 5848 |
| SCNN1A-2000 | - | CAGUCCACUCCAGGGCUCAUGAAG | 24 | 5849 |
| SCNN1A-2017 | - | GGGAACAAGCGUGAGGAG | 18 | 5866 |
| SCNN1A-2018 | - | GGGGAACAAGCGUGAGGAG | 19 | 5867 |
| SCNN1A-179 | - | AGGGGAACAAGCGUGAGGAG | 20 | 813 |
| SCNN1A-2019 | - | AAGGGGAACAAGCGUGAGGAG | 21 | 5868 |

TABLE 47G-continued

7th Tier

| gRNA Name | DNA Strand | Targeting Domain | Target Site Length | Seq ID |
|---|---|---|---|---|
| SCNN1A-2020 | - | GAAGGGGAACAAGCGUGAGGAG | 22 | 5869 |
| SCNN1A-2021 | - | UGAAGGGGAACAAGCGUGAGGAG | 23 | 5870 |
| SCNN1A-2022 | - | AUGAAGGGGAACAAGCGUGAGGAG | 24 | 5871 |
| SCNN1A-2023 | - | CAGCAGCCCACGGCGGAG | 18 | 5872 |
| SCNN1A-2024 | - | CCAGCAGCCCACGGCGGAG | 19 | 5873 |
| SCNN1A-187 | - | CCCAGCAGCCCACGGCGGAG | 20 | 818 |
| SCNN1A-2025 | - | CCCCAGCAGCCCACGGCGGAG | 21 | 5874 |
| SCNN1A-2026 | - | GCCCCAGCAGCCCACGGCGGAG | 22 | 5875 |
| SCNN1A-2027 | - | CGCCCCAGCAGCCCACGGCGGAG | 23 | 5876 |
| SCNN1A-2028 | - | GCGCCCCAGCAGCCCACGGCGGAG | 24 | 5877 |
| SCNN1A-2035 | - | GCCCCCAGCAGCCCACG | 18 | 5884 |
| SCNN1A-2036 | - | GGCGCCCCAGCAGCCCACG | 19 | 5885 |
| SCNN1A-183 | - | CGGCGCCCCAGCAGCCCACG | 20 | 816 |
| SCNN1A-2037 | - | GCGGCGCCCCAGCAGCCCACG | 21 | 5886 |
| SCNN1A-2038 | - | UGCGGCGCCCCAGCAGCCCACG | 22 | 5887 |
| SCNN1A-2039 | - | CUGCGGCGCCCCAGCAGCCCACG | 23 | 5888 |
| SCNN1A-2040 | - | CCUGCGGCGCCCCAGCAGCCCACG | 24 | 5889 |
| SCNN1A-2041 | - | CCCCAGCAGCCCACGGCG | 18 | 5890 |
| SCNN1A-2042 | - | GCCCCAGCAGCCCACGGCG | 19 | 5891 |
| SCNN1A-185 | - | CGCCCCAGCAGCCCACGGCG | 20 | 817 |
| SCNN1A-2043 | - | GCGCCCCAGCAGCCCACGGCG | 21 | 5892 |
| SCNN1A-2044 | - | GGCGCCCCAGCAGCCCACGGCG | 22 | 5893 |
| SCNN1A-2045 | - | CGGCGCCCCAGCAGCCCACGGCG | 23 | 5894 |
| SCNN1A-2046 | - | GCGGCGCCCCAGCAGCCCACGGCG | 24 | 5895 |
| SCNN1A-11064 | - | CCUUUGGGGAGGGAAAGG | 18 | 14913 |
| SCNN1A-11065 | - | CCCUUUGGGGAGGGAAAGG | 19 | 14914 |
| SCNN1A-11066 | - | CCCCUUUGGGGAGGGAAAGG | 20 | 14915 |
| SCNN1A-11067 | - | UCCCCUUUGGGGAGGGAAAGG | 21 | 14916 |
| SCNN1A-11068 | - | CUCCCCUUUGGGGAGGGAAAGG | 22 | 14917 |
| SCNN1A-11069 | - | GCUCCCCUUUGGGGAGGGAAAGG | 23 | 14918 |
| SCNN1A-11070 | - | GGCUCCCCUUUGGGGAGGGAAAGG | 24 | 14919 |
| SCNN1A-11071 | - | UGACACCCCUGUCCCAGG | 18 | 14920 |
| SCNN1A-11072 | - | CUGACACCCCUGUCCCAGG | 19 | 14921 |
| SCNN1A-11073 | - | ACUGACACCCCUGUCCCAGG | 20 | 14922 |
| SCNN1A-11074 | - | AACUGACACCCCUGUCCCAGG | 21 | 14923 |
| SCNN1A-11075 | - | GAACUGACACCCCUGUCCCAGG | 22 | 14924 |
| SCNN1A-11076 | - | GGAACUGACACCCCUGUCCCAGG | 23 | 14925 |

TABLE 47G-continued

7th Tier

| gRNA Name | DNA Strand | Targeting Domain | Target Site Length | Seq ID |
|---|---|---|---|---|
| SCNN1A-11077 | - | GGGAACUGACACCCCUGUCCCAGG | 24 | 14926 |
| SCNN1A-11078 | - | AGGUGCUCACUGGGCAGG | 18 | 14927 |
| SCNN1A-11079 | - | GAGGUGCUCACUGGGCAGG | 19 | 14928 |
| SCNN1A-11080 | - | UGAGGUGCUCACUGGGCAGG | 20 | 14929 |
| SCNN1A-11081 | - | CUGAGGUGCUCACUGGGCAGG | 21 | 14930 |
| SCNN1A-11082 | - | GCUGAGGUGCUCACUGGGCAGG | 22 | 14931 |
| SCNN1A-11083 | - | UGCUGAGGUGCUCACUGGGCAGG | 23 | 14932 |
| SCNN1A-11084 | - | GUGCUGAGGUGCUCACUGGGCAGG | 24 | 14933 |
| SCNN1A-2050 | - | AGCAGCCCACGGCGGAGG | 18 | 5899 |
| SCNN1A-2051 | - | CAGCAGCCCACGGCGGAGG | 19 | 5900 |
| SCNN1A-23 | - | CCAGCAGCCCACGGCGGAGG | 20 | 566 |
| SCNN1A-2052 | - | CCCAGCAGCCCACGGCGGAGG | 21 | 5901 |
| SCNN1A-2053 | - | CCCCAGCAGCCCACGGCGGAGG | 22 | 5902 |
| SCNN1A-2054 | - | GCCCCAGCAGCCCACGGCGGAGG | 23 | 5903 |
| SCNN1A-2055 | - | CGCCCCAGCAGCCCACGGCGGAGG | 24 | 5904 |
| SCNN1A-11085 | - | AGAGCCUCAGACCUGAGG | 18 | 14934 |
| SCNN1A-11086 | - | CAGAGCCUCAGACCUGAGG | 19 | 14935 |
| SCNN1A-11087 | - | GCAGAGCCUCAGACCUGAGG | 20 | 14936 |
| SCNN1A-11088 | - | GGCAGAGCCUCAGACCUGAGG | 21 | 14937 |
| SCNN1A-11089 | - | AGGCAGAGCCUCAGACCUGAGG | 22 | 14938 |
| SCNN1A-11090 | - | CAGGCAGAGCCUCAGACCUGAGG | 23 | 14939 |
| SCNN1A-11091 | - | GCAGGCAGAGCCUCAGACCUGAGG | 24 | 14940 |
| SCNN1A-2056 | - | CGCCCCAGCAGCCCACGG | 18 | 5905 |
| SCNN1A-2057 | - | GCGCCCCAGCAGCCCACGG | 19 | 5906 |
| SCNN1A-21 | - | GGCGCCCCAGCAGCCCACGG | 20 | 510 |
| SCNN1A-2058 | - | CGGCGCCCCAGCAGCCCACGG | 21 | 5907 |
| SCNN1A-2059 | - | GCGGCGCCCCAGCAGCCCACGG | 22 | 5908 |
| SCNN1A-2060 | - | UGCGGCGCCCCAGCAGCCCACGG | 23 | 5909 |
| SCNN1A-2061 | - | CUGCGGCGCCCCAGCAGCCCACGG | 24 | 5910 |
| SCNN1A-11092 | - | UGCCACUCCCAUACCCGG | 18 | 14941 |
| SCNN1A-11093 | - | UUGCCACUCCCAUACCCGG | 19 | 14942 |
| SCNN1A-11094 | - | AUUGCCACUCCCAUACCCGG | 20 | 14943 |
| SCNN1A-11095 | - | CAUUGCCACUCCCAUACCCGG | 21 | 14944 |
| SCNN1A-11096 | - | GCAUUGCCACUCCCAUACCCGG | 22 | 14945 |
| SCNN1A-11097 | - | CGCAUUGCCACUCCCAUACCCGG | 23 | 14946 |
| SCNN1A-11098 | - | UCGCAUUGCCACUCCCAUACCCGG | 24 | 14947 |
| SCNN1A-2062 | - | CCCAGCAGCCCACGGCGG | 18 | 5911 |
| SCNN1A-2063 | - | CCCCAGCAGCCCACGGCGG | 19 | 5912 |

TABLE 47G-continued

7th Tier

| gRNA Name | DNA Strand | Targeting Domain | Target Site Length | Seq ID |
|---|---|---|---|---|
| SCNN1A-22 | − | GCCCCAGCAGCCCACGGCGG | 20 | 511 |
| SCNN1A-2064 | − | CGCCCCAGCAGCCCACGGCGG | 21 | 5913 |
| SCNN1A-2065 | − | GCGCCCCAGCAGCCCACGGCGG | 22 | 5914 |
| SCNN1A-2066 | − | GGCGCCCCAGCAGCCCACGGCGG | 23 | 5915 |
| SCNN1A-2067 | − | CGGCGCCCCAGCAGCCCACGGCGG | 24 | 5916 |
| SCNN1A-11099 | − | GAGCCUCAGACCUGAGGG | 18 | 14948 |
| SCNN1A-11100 | − | AGAGCCUCAGACCUGAGGG | 19 | 14949 |
| SCNN1A-6341 | − | CAGAGCCUCAGACCUGAGGG | 20 | 10190 |
| SCNN1A-11101 | − | GCAGAGCCUCAGACCUGAGGG | 21 | 14950 |
| SCNN1A-11102 | − | GGCAGAGCCUCAGACCUGAGGG | 22 | 14951 |
| SCNN1A-11103 | − | AGGCAGAGCCUCAGACCUGAGGG | 23 | 14952 |
| SCNN1A-11104 | − | CAGGCAGAGCCUCAGACCUGAGGG | 24 | 14953 |
| SCNN1A-2074 | − | AAGCGUGAGGAGCAGGGG | 18 | 5923 |
| SCNN1A-2075 | − | CAAGCGUGAGGAGCAGGGG | 19 | 5924 |
| SCNN1A-181 | − | ACAAGCGUGAGGAGCAGGGG | 20 | 814 |
| SCNN1A-2076 | − | AACAAGCGUGAGGAGCAGGGG | 21 | 5925 |
| SCNN1A-2077 | − | GAACAAGCGUGAGGAGCAGGGG | 22 | 5926 |
| SCNN1A-2078 | − | GGAACAAGCGUGAGGAGCAGGGG | 23 | 5927 |
| SCNN1A-2079 | − | GGGAACAAGCGUGAGGAGCAGGGG | 24 | 5928 |
| SCNN1A-11105 | − | GGUGGCUCCCCUUUGGGG | 18 | 14954 |
| SCNN1A-11106 | − | UGGUGGCUCCCCUUUGGGG | 19 | 14955 |
| SCNN1A-6342 | − | AUGGUGGCUCCCCUUUGGGG | 20 | 10191 |
| SCNN1A-11107 | − | UAUGGUGGCUCCCCUUUGGGG | 21 | 14956 |
| SCNN1A-11108 | − | UUAUGGUGGCUCCCCUUUGGGG | 22 | 14957 |
| SCNN1A-11109 | − | AUUAUGGUGGCUCCCCUUUGGGG | 23 | 14958 |
| SCNN1A-11110 | − | AAUUAUGGUGGCUCCCCUUUGGGG | 24 | 14959 |
| SCNN1A-11111 | − | UGGUGGCUCCCCUUUGGG | 18 | 14960 |
| SCNN1A-11112 | − | AUGGUGGCUCCCCUUUGGG | 19 | 14961 |
| SCNN1A-11113 | − | UAUGGUGGCUCCCCUUUGGG | 20 | 14962 |
| SCNN1A-11114 | − | UUAUGGUGGCUCCCCUUUGGG | 21 | 14963 |
| SCNN1A-11115 | − | AUUAUGGUGGCUCCCCUUUGGG | 22 | 14964 |
| SCNN1A-11116 | − | AAUUAUGGUGGCUCCCCUUUGGG | 23 | 14965 |
| SCNN1A-11117 | − | AAAUUAUGGUGGCUCCCCUUUGGG | 24 | 14966 |
| SCNN1A-2105 | − | UCCACUCCAGGGCUCAUG | 18 | 5954 |
| SCNN1A-2106 | − | GUCCACUCCAGGGCUCAUG | 19 | 5955 |
| SCNN1A-172 | − | AGUCCACUCCAGGGCUCAUG | 20 | 810 |
| SCNN1A-2107 | − | CAGUCCACUCCAGGGCUCAUG | 21 | 5956 |

TABLE 47G-continued

7th Tier

| gRNA Name | DNA Strand | Targeting Domain | Target Site Length | Seq ID |
|---|---|---|---|---|
| SCNN1A-2108 | - | ACAGUCCACUCCAGGGCUCAUG | 22 | 5957 |
| SCNN1A-2109 | - | CACAGUCCACUCCAGGGCUCAUG | 23 | 5958 |
| SCNN1A-2110 | - | CCACAGUCCACUCCAGGGCUCAUG | 24 | 5959 |
| SCNN1A-2137 | - | UGAAGGGGAACAAGCGUG | 18 | 5986 |
| SCNN1A-2138 | - | AUGAAGGGGAACAAGCGUG | 19 | 5987 |
| SCNN1A-13 | - | CAUGAAGGGGAACAAGCGUG | 20 | 562 |
| SCNN1A-2139 | - | UCAUGAAGGGGAACAAGCGUG | 21 | 5988 |
| SCNN1A-2140 | - | CUCAUGAAGGGGAACAAGCGUG | 22 | 5989 |
| SCNN1A-2141 | - | GCUCAUGAAGGGGAACAAGCGUG | 23 | 5990 |
| SCNN1A-2142 | - | GGCUCAUGAAGGGGAACAAGCGUG | 24 | 5991 |
| SCNN1A-11118 | - | GAAGGGUGGUCCAGGGUG | 18 | 14967 |
| SCNN1A-11119 | - | GGAAGGGUGGUCCAGGGUG | 19 | 14968 |
| SCNN1A-11120 | - | UGGAAGGGUGGUCCAGGGUG | 20 | 14969 |
| SCNN1A-11121 | - | CUGGAAGGGUGGUCCAGGGUG | 21 | 14970 |
| SCNN1A-11122 | - | CCUGGAAGGGUGGUCCAGGGUG | 22 | 14971 |
| SCNN1A-11123 | - | GCCUGGAAGGGUGGUCCAGGGUG | 23 | 14972 |
| SCNN1A-11124 | - | CGCCUGGAAGGGUGGUCCAGGGUG | 24 | 14973 |
| SCNN1A-11125 | - | CUAUAUACUUCUGUAUUG | 18 | 14974 |
| SCNN1A-11126 | - | UCUAUAUACUUCUGUAUUG | 19 | 14975 |
| SCNN1A-11127 | - | CUCUAUAUACUUCUGUAUUG | 20 | 14976 |
| SCNN1A-11128 | - | GCUCUAUAUACUUCUGUAUUG | 21 | 14977 |
| SCNN1A-11129 | - | AGCUCUAUAUACUUCUGUAUUG | 22 | 14978 |
| SCNN1A-11130 | - | AAGCUCUAUAUACUUCUGUAUUG | 23 | 14979 |
| SCNN1A-11131 | - | GAAGCUCUAUAUACUUCUGUAUUG | 24 | 14980 |
| SCNN1A-11132 | - | AAGCAAAAAUGGAAGUUG | 18 | 14981 |
| SCNN1A-11133 | - | AAAGCAAAAAUGGAAGUUG | 19 | 14982 |
| SCNN1A-11134 | - | AAAAGCAAAAAUGGAAGUUG | 20 | 14983 |
| SCNN1A-11135 | - | UAAAAGCAAAAAUGGAAGUUG | 21 | 14984 |
| SCNN1A-11136 | - | AUAAAAGCAAAAAUGGAAGUUG | 22 | 14985 |
| SCNN1A-11137 | - | AAUAAAAGCAAAAAUGGAAGUUG | 23 | 14986 |
| SCNN1A-11138 | - | AAAUAAAAGCAAAAAUGGAAGUUG | 24 | 14987 |
| SCNN1A-11139 | - | UAUGGUGGCUCCCCUUUG | 18 | 14988 |
| SCNN1A-11140 | - | UUAUGGUGGCUCCCCUUUG | 19 | 14989 |
| SCNN1A-6348 | - | AUUAUGGUGGCUCCCCUUUG | 20 | 10197 |
| SCNN1A-11141 | - | AAUUAUGGUGGCUCCCCUUUG | 21 | 14990 |
| SCNN1A-11142 | - | AAAUUAUGGUGGCUCCCCUUUG | 22 | 14991 |
| SCNN1A-11143 | - | CAAAUUAUGGUGGCUCCCCUUUG | 23 | 14992 |
| SCNN1A-11144 | - | ACAAAUUAUGGUGGCUCCCCUUUG | 24 | 14993 |

TABLE 47G-continued

7th Tier

| gRNA Name | DNA Strand | Targeting Domain | Target Site Length | Seq ID |
|---|---|---|---|---|
| SCNN1A-11145 | - | CCUGUCUCUAAGAUAAAU | 18 | 14994 |
| SCNN1A-11146 | - | UCCUGUCUCUAAGAUAAAU | 19 | 14995 |
| SCNN1A-11147 | - | AUCCUGUCUCUAAGAUAAAU | 20 | 14996 |
| SCNN1A-11148 | - | GAUCCUGUCUCUAAGAUAAAU | 21 | 14997 |
| SCNN1A-11149 | - | UGAUCCUGUCUCUAAGAUAAAU | 22 | 14998 |
| SCNN1A-11150 | - | AUGAUCCUGUCUCUAAGAUAAAU | 23 | 14999 |
| SCNN1A-11151 | - | CAUGAUCCUGUCUCUAAGAUAAAU | 24 | 15000 |
| SCNN1A-11152 | - | AGGGAAAGGAAGGGGACU | 18 | 15001 |
| SCNN1A-11153 | - | GAGGGAAAGGAAGGGGACU | 19 | 15002 |
| SCNN1A-11154 | - | GGAGGGAAAGGAAGGGGACU | 20 | 15003 |
| SCNN1A-11155 | - | GGGAGGGAAAGGAAGGGGACU | 21 | 15004 |
| SCNN1A-11156 | - | GGGGAGGGAAAGGAAGGGGACU | 22 | 15005 |
| SCNN1A-11157 | - | UGGGGAGGGAAAGGAAGGGGACU | 23 | 15006 |
| SCNN1A-11158 | - | UUGGGGAGGGAAAGGAAGGGGACU | 24 | 15007 |
| SCNN1A-11159 | - | AAUUAUGGUGGCUCCCCU | 18 | 15008 |
| SCNN1A-11160 | - | AAAUUAUGGUGGCUCCCCU | 19 | 15009 |
| SCNN1A-11161 | - | CAAAUUAUGGUGGCUCCCCU | 20 | 15010 |
| SCNN1A-11162 | - | ACAAAUUAUGGUGGCUCCCCU | 21 | 15011 |
| SCNN1A-11163 | - | UACAAAUUAUGGUGGCUCCCCU | 22 | 15012 |
| SCNN1A-11164 | - | AUACAAAUUAUGGUGGCUCCCCU | 23 | 15013 |
| SCNN1A-11165 | - | UAUACAAAUUAUGGUGGCUCCCCU | 24 | 15014 |
| SCNN1A-2170 | - | AUGAAGGGGAACAAGCGU | 18 | 6019 |
| SCNN1A-2171 | - | CAUGAAGGGGAACAAGCGU | 19 | 6020 |
| SCNN1A-177 | - | UCAUGAAGGGGAACAAGCGU | 20 | 812 |
| SCNN1A-2172 | - | CUCAUGAAGGGGAACAAGCGU | 21 | 6021 |
| SCNN1A-2173 | - | GCUCAUGAAGGGGAACAAGCGU | 22 | 6022 |
| SCNN1A-2174 | - | GGCUCAUGAAGGGGAACAAGCGU | 23 | 6023 |
| SCNN1A-2175 | - | GGGCUCAUGAAGGGGAACAAGCGU | 24 | 6024 |
| SCNN1A-11166 | - | AGCCUCAGACCUGAGGGU | 18 | 15015 |
| SCNN1A-11167 | - | GAGCCUCAGACCUGAGGGU | 19 | 15016 |
| SCNN1A-6357 | - | AGAGCCUCAGACCUGAGGGU | 20 | 10206 |
| SCNN1A-11168 | - | CAGAGCCUCAGACCUGAGGGU | 21 | 15017 |
| SCNN1A-11169 | - | GCAGAGCCUCAGACCUGAGGGU | 22 | 15018 |
| SCNN1A-11170 | - | GGCAGAGCCUCAGACCUGAGGGU | 23 | 15019 |
| SCNN1A-11171 | - | AGGCAGAGCCUCAGACCUGAGGGU | 24 | 15020 |
| SCNN1A-11172 | - | AUUAUGGUGGCUCCCCUU | 18 | 15021 |
| SCNN1A-11173 | - | AAUUAUGGUGGCUCCCCUU | 19 | 15022 |

TABLE 47G-continued

7th Tier

| gRNA Name | DNA Strand | Targeting Domain | Target Site Length | Seq ID |
|---|---|---|---|---|
| SCNN1A-6360 | - | AAAUUAUGGUGGCUCCCCUU | 20 | 10209 |
| SCNN1A-11174 | - | CAAAUUAUGGUGGCUCCCCUU | 21 | 15023 |
| SCNN1A-11175 | - | ACAAAUUAUGGUGGCUCCCCUU | 22 | 15024 |
| SCNN1A-11176 | - | UACAAAUUAUGGUGGCUCCCCUU | 23 | 15025 |
| SCNN1A-11177 | - | AUACAAAUUAUGGUGGCUCCCCUU | 24 | 15026 |
| SCNN1A-2183 | - | CCGCAUGAAGACGGCCUU | 18 | 6032 |
| SCNN1A-2184 | - | ACCGCAUGAAGACGGCCUU | 19 | 6033 |
| SCNN1A-194 | - | AACCGCAUGAAGACGGCCUU | 20 | 824 |
| SCNN1A-2185 | - | CAACCGCAUGAAGACGGCCUU | 21 | 6034 |
| SCNN1A-2186 | - | ACAACCGCAUGAAGACGGCCUU | 22 | 6035 |
| SCNN1A-2187 | - | CACAACCGCAUGAAGACGGCCUU | 23 | 6036 |
| SCNN1A-2188 | - | GCACAACCGCAUGAAGACGGCCUU | 24 | 6037 |
| SCNN1A-11178 | - | UUAUGGUGGCUCCCCUUU | 18 | 15027 |
| SCNN1A-11179 | - | AUUAUGGUGGCUCCCCUUU | 19 | 15028 |
| SCNN1A-6361 | - | AAUUAUGGUGGCUCCCCUUU | 20 | 10210 |
| SCNN1A-11180 | - | AAAUUAUGGUGGCUCCCCUUU | 21 | 15029 |
| SCNN1A-11181 | - | CAAAUUAUGGUGGCUCCCCUUU | 22 | 15030 |
| SCNN1A-11182 | - | ACAAAUUAUGGUGGCUCCCCUUU | 23 | 15031 |
| SCNN1A-11183 | - | UACAAAUUAUGGUGGCUCCCCUUU | 24 | 15032 |
| SCNN1A-2189 | - | GGCAAUUCGGCCUGCUUU | 18 | 6038 |
| SCNN1A-2190 | - | UGGCAAUUCGGCCUGCUUU | 19 | 6039 |
| SCNN1A-195 | - | CUGGCAAUUCGGCCUGCUUU | 20 | 825 |
| SCNN1A-2191 | - | ACUGGCAAUUCGGCCUGCUUU | 21 | 6040 |
| SCNN1A-2192 | - | UACUGGCAAUUCGGCCUGCUUU | 22 | 6041 |
| SCNN1A-2193 | - | GUACUGGCAAUUCGGCCUGCUUU | 23 | 6042 |
| SCNN1A-2194 | - | UGUACUGGCAAUUCGGCCUGCUUU | 24 | 6043 |
| SCNN1A-2195 | - | GCAAUUCGGCCUGCUUUU | 18 | 6044 |
| SCNN1A-2196 | - | GGCAAUUCGGCCUGCUUUU | 19 | 6045 |
| SCNN1A-34 | - | UGGCAAUUCGGCCUGCUUUU | 20 | 573 |
| SCNN1A-2197 | - | CUGGCAAUUCGGCCUGCUUUU | 21 | 6046 |
| SCNN1A-2198 | - | ACUGGCAAUUCGGCCUGCUUUU | 22 | 6047 |

TABLE 47G-continued

7th Tier

| gRNA Name | DNA Strand | Targeting Domain | Target Site Length | Seq ID |
|---|---|---|---|---|
| SCNN1A-2199 | − | UACUGGCAAUUCGGCCUGCUUUU | 23 | 6048 |
| SCNN1A-2200 | − | GUACUGGCAAUUCGGCCUGCUUUU | 24 | 6049 |

Table 48A provides exemplary targeting domains for knocking down the SCNN1A gene selected according to the first tier parameters. The targeting domains bind within 500 bp (e.g., upstream or downstream) of a transcription start site (TSS), have a high level of orthogonality and start with a 5'G. It is contemplated herein that in an embodiment the targeting domain hybridizes to the target domain through complementary base pairing. Any of the targeting domains in the table can be used with a *N. meningitis* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

Table 48B provides exemplary targeting domains for knocking down the SCNN1A gene selected according to the second tier parameters. The targeting domains bind within 500 bp (e.g., upstream or downstream) of a transcription start site (TSS) and have a high level of orthogonality. It is contemplated herein that in an embodiment the targeting domain hybridizes to the target domain through complementary base pairing. Any of the targeting domains in the table can be used with a *N. miningtidis* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 48A

1st Tier

| gRNA Name | DNA Strand | Targeting Domain | Target Site Length | Seq ID |
|---|---|---|---|---|
| SCNN1A-11184 | + | GUGAAAGCCGGUGUCAA | 17 | 15033 |
| SCNN1A-11185 | − | GUUUUCUAACCUCAGAA | 17 | 15034 |
| SCNN1A-11186 | − | GCUGCAUUAAGUUUGGA | 17 | 15035 |
| SCNN1A-5020 | + | GGCUAGAGUCCUGCUCC | 17 | 8869 |
| SCNN1A-5021 | + | GUCUAGGGUCCUGCUCC | 17 | 8870 |
| SCNN1A-11187 | − | GAUGCUAAUGAGAUUCC | 17 | 15036 |
| SCNN1A-5106 | + | GAAGGCGGACUCUGGGC | 17 | 8955 |
| SCNN1A-5022 | + | GAUUCCAAACCAGGUUC | 17 | 8871 |
| SCNN1A-11188 | + | GGCCAAAAGUGCCGGAG | 17 | 15037 |
| SCNN1A-11189 | − | GAUGACACCUUCUCUGG | 17 | 15038 |
| SCNN1A-11190 | − | GCUGCCUUAAGCUAGUG | 17 | 15039 |
| SCNN1A-11191 | − | GCUAAACUCCUUGCUUG | 17 | 15040 |
| SCNN1A-11192 | − | GGAGUGAGGGAGGCCUU | 17 | 15041 |
| SCNN1A-11193 | + | GAGCAAGGGGGAGUCCCAA | 20 | 15042 |
| SCNN1A-11194 | − | GGUUUGGAAUCCUGGUUGAC | 20 | 15043 |
| SCNN1A-11195 | + | GCUCAGGGUCCAACCUGGUC | 20 | 15044 |
| SCNN1A-11196 | + | GGCCCUGACCUCGAGCUGUG | 20 | 15045 |
| SCNN1A-11197 | − | GGGGGAGGAGAGGUUUGGCU | 20 | 15046 |
| SCNN1A-11198 | − | GUGGGAGUGAGGGAGGCCUU | 20 | 15047 |
| SCNN1A-11199 | + | GGUUUCUAUUUGUACACUUU | 20 | 15048 |

TABLE 48B

2nd Tier

| gRNA Name | DNA Strand | Targeting Domain | Target Site Length | Seq ID |
|---|---|---|---|---|
| SCNN1A-11200 | + | CAAGGGGGAGUCCCAA | 17 | 15049 |
| SCNN1A-11201 | + | UCCCCUUGGAAGGGACA | 17 | 15050 |
| SCNN1A-11202 | − | CUUUAAUUGAGAUGCUA | 17 | 15051 |
| SCNN1A-11203 | − | UUGGAAUCCUGGUUGAC | 17 | 15052 |
| SCNN1A-11204 | + | AUGCCUGAAAUCCAACC | 17 | 15053 |
| SCNN1A-11205 | + | CACUCCCACACAGAGCC | 17 | 15054 |
| SCNN1A-11206 | − | UAGGGCCCCGCCUAGCC | 17 | 15055 |
| SCNN1A-11207 | + | AGGAGGUCUGGGCUGCC | 17 | 15056 |
| SCNN1A-11208 | + | UGGUCCCUCCUCUUUCC | 17 | 15057 |
| SCNN1A-11209 | + | CACGCGGCAGGGAAGGC | 17 | 15058 |
| SCNN1A-11210 | + | CCCUAGAACGGCCUCUC | 17 | 15059 |
| SCNN1A-11211 | + | CAGGGUCCAACCUGGUC | 17 | 15060 |
| SCNN1A-11212 | + | AGUGCAGGAAUGUGGUC | 17 | 15061 |
| SCNN1A-5426 | − | CUCUGUGACCACAGCAG | 17 | 9275 |
| SCNN1A-5024 | + | CCCUUCAUGAGCCCCGG | 17 | 8873 |
| SCNN1A-6029 | − | AAAUAGAAAGGCAGGG | 17 | 9878 |
| SCNN1A-11213 | − | CCUCCAGCCCUUUUUGG | 17 | 15062 |
| SCNN1A-11214 | + | CCUGACCUCGAGCUGUG | 17 | 15063 |
| SCNN1A-11215 | + | CUAACAAAAGUGCAGAU | 17 | 15064 |
| SCNN1A-11216 | − | UCUUUGCCUGCUAAACU | 17 | 15065 |
| SCNN1A-11217 | + | CUCUGGGGCUAUCUACU | 17 | 15066 |
| SCNN1A-11218 | + | UUCUAUUUGUACACUUU | 17 | 15067 |
| SCNN1A-11219 | + | AAAGUGAAAGCCGGUGUCAA | 20 | 15068 |
| SCNN1A-11220 | − | UUUGUUUUCUAACCUCAGAA | 20 | 15069 |
| SCNN1A-11221 | + | ACCUCCCCUUGGAAGGGACA | 20 | 15070 |
| SCNN1A-9203 | − | UUUGCUGCAUUAAGUUUGGA | 20 | 13052 |
| SCNN1A-9243 | − | CACCUUUAAUUGAGAUGCUA | 20 | 13092 |
| SCNN1A-11222 | + | CUCAUGCCUGAAAUCCAACC | 20 | 15071 |
| SCNN1A-11223 | + | CCUCACUCCCACACAGAGCC | 20 | 15072 |
| SCNN1A-11224 | − | UCCUAGGGCCCCGCCUAGCC | 20 | 15073 |
| SCNN1A-11225 | + | UCCAGGAGGUCUGGGCUGCC | 20 | 15074 |
| SCNN1A-11226 | − | UGAGAUGCUAAUGAGAUUCC | 20 | 15075 |
| SCNN1A-11227 | + | UCCUGGUCCCUCCUCUUUCC | 20 | 15076 |
| SCNN1A-11228 | − | CUGCACGCGGCAGGGAAGGC | 20 | 15077 |
| SCNN1A-11229 | + | CUUCCCUAGAACGGCCUCUC | 20 | 15078 |
| SCNN1A-11230 | + | CAGAGUGCAGGAAUGUGGUC | 20 | 15079 |
| SCNN1A-5650 | − | CAACUCUGUGACCACAGCAG | 20 | 9499 |
| SCNN1A-8013 | + | UGGGGCCAAAAGUGCCGGAG | 20 | 11862 |

TABLE 48B-continued

2nd Tier

| gRNA Name | DNA Strand | Targeting Domain | Target Site Length | Seq ID |
|---|---|---|---|---|
| SCNN1A-5027 | + | UUCCCCUUCAUGAGCCCCGG | 20 | 8876 |
| SCNN1A-11231 | - | UCUCCUCCAGCCCUUUUUGG | 20 | 15080 |
| SCNN1A-11232 | - | CAUGCUGCCUUAAGCUAGUG | 20 | 15081 |
| SCNN1A-11233 | - | CCUGCUAAACUCCUUGCUUG | 20 | 15082 |
| SCNN1A-11234 | + | CUUCUAACAAAAGUGCAGAU | 20 | 15083 |
| SCNN1A-11235 | - | UCUUCUUUGCCUGCUAAACU | 20 | 15084 |
| SCNN1A-11236 | + | CUCCUCUGGGGCUAUCUACU | 20 | 15085 |
| SCNN1A-11237 | - | CUCAGGCUGGGCCUUUGUCU | 20 | 15086 |
| SCNN1A-11238 | - | AUCCUCCCUGCACCUUCAGU | 20 | 15087 |

Table 48C provides exemplary targeting domains for knocking down the SCNN1A gene selected according to the third tier parameters. The targeting domains bind within 500 bp (e.g., upstream or downstream) of a transcription start site (TSS) and start with a 5'G. It is contemplated herein that in an embodiment the targeting domain hybridizes to the target domain through complementary base pairing. Any of the targeting domains in the table can be used with a N. miningtidis eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 48C

3rd Tier

| gRNA Name | DNA Strand | Targeting Domain | Target Site Length | Seq ID |
|---|---|---|---|---|
| SCNN1A-11239 | - | GGGGGAGAGGAAGAGAG | 17 | 15088 |
| SCNN1A-11240 | - | GGAGGAGAGGUUUGGCU | 17 | 15089 |
| SCNN1A-5029 | + | GAGGGCUAGAGUCCUGCUCC | 20 | 8878 |
| SCNN1A-5030 | + | GAGGUCUAGGGUCCUGCUCC | 20 | 8879 |
| SCNN1A-5263 | - | GGCAAAUAGAAAAGGCAGGG | 20 | 9112 |

Table 48D provides exemplary targeting domains for knocking out the SCNN1A gene selected according to the fourth tier parameters. The targeting domains bind within 500 bp (e.g., upstream or downstream) of a transcription start site (TSS). It is contemplated herein that in an embodiment the targeting domain hybridizes to the target domain through complementary base pairing. Any of the targeting domains in the table can be used with a N. miningtidis eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

TABLE 48D

4th Tier

| gRNA Name | DNA Strand | Targeting Domain | Target Site Length | Seq ID |
|---|---|---|---|---|
| SCNN1A-11241 | − | AGGCUGGGCCUUUGUCU | 17 | 15090 |
| SCNN1A-11242 | − | CUCCCUGCACCUUCAGU | 17 | 15091 |
| SCNN1A-5613 | + | UGAGAAGGCGGACUCUGGGC | 20 | 9462 |
| SCNN1A-5032 | + | CAGGAUUCCAAACCAGGUUC | 20 | 8881 |
| SCNN1A-11243 | − | AGGGGGGGAGAGGAAGAGAG | 20 | 15092 |
| SCNN1A-11244 | − | AGAGAUGACACCUUCUCUGG | 20 | 15093 |

Table 48E provides exemplary targeting domains for knocking down the SCNN1A gene selected according to the fifth tier parameters. The targeting domains bind within the additional 500 bp (e.g., upstream or downstream) of a transcription start site (TSS), e.g., extending to 1 kb upstream and downstream of a TSS. It is contemplated herein that in an embodiment the targeting domain hybridizes to the target domain through complementary base pairing. Any of the targeting domains in the table can be used with a *N. miningtidis* eiCas9 molecule or eiCas9 fusion protein (e.g., an eiCas9 fused to a transcription repressor domain) to alter the SCNN1A gene (e.g., reduce or eliminate SCNN1A gene expression, SCNN1A protein function, or the level of SCNN1A protein). One or more gRNA may be used to target an eiCas9 to the promoter region of the SCNN1A gene.

III. Cas9 Molecules

Cas9 molecules of a variety of species can be used in the methods and compositions described herein. While the *S. pyogenes*, *S. aureus* and *S. thermophilus* Cas9 molecules are the subject of much of the disclosure herein, Cas9 molecules of, derived from, or based on the Cas9 proteins of other species listed herein can be used as well. In other words, while the much of the description herein uses *S. pyogenes* and *S. thermophilus* Cas9 molecules, Cas9 molecules from the other species can replace them, e.g., *Staphylococcus aureus* and *Neisseria meningitidis* Cas9 molecules. Additional Cas9 species include: *Acidovorax avenae, Actinobacillus pleuropneumoniae, Actinobacillus succinogenes, Actinobacillus suis, Actinomyces* sp., *cycliphilus denitrificans, Aminomonas paucivorans, Bacillus cereus, Bacillus smithii, Bacillus thuringiensis, Bacteroides* sp., *Blastopirellula*

TABLE 48E

5th Tier

| gRNA Name | DNA Strand | Targeting Domain | Target Site Length | Seq ID |
|---|---|---|---|---|
| SCNN1A-11245 | + | ACCUGGAGCGGGCUAGA | 17 | 15094 |
| SCNN1A-11246 | + | AGCAAUACAGAAGUAUA | 17 | 15095 |
| SCNN1A-5028 | + | GGCCCAGCCCCUGCUCC | 17 | 8877 |
| SCNN1A-322 | + | UGGUCACUGCGGGGAAG | 17 | 915 |
| SCNN1A-5023 | − | GAUGUACUGGCAAUUCG | 17 | 8872 |
| SCNN1A-5025 | + | AGGGACUAACCGACCUG | 17 | 8874 |
| SCNN1A-11247 | + | GUUUCUACAACUUCCAU | 17 | 15096 |
| SCNN1A-11248 | − | CUGACCAAAGUCCAGGU | 17 | 15097 |
| SCNN1A-11249 | + | UAGACCUGGAGCGGGCUAGA | 20 | 15098 |
| SCNN1A-10791 | + | UUCAGCAAUACAGAAGUAUA | 20 | 14640 |
| SCNN1A-5031 | + | CGGGGCCCAGCCCCUGCUCC | 20 | 8880 |
| SCNN1A-238 | + | AGAUGGUCACUGCGGGGAAG | 20 | 858 |
| SCNN1A-5026 | − | CAUGAUGUACUGGCAAUUCG | 20 | 8875 |
| SCNN1A-1657 | + | CAGAGGGACUAACCGACCUG | 20 | 5506 |
| SCNN1A-11250 | + | UAUGUUUCUACAACUUCCAU | 20 | 15099 |
| SCNN1A-11251 | − | CUUCUGACCAAAGUCCAGGU | 20 | 15100 | marina, *Bradyrhizobium* sp., *Brevibacillus laterosporus*, *Campylobacter coli*, *Campylobacter jejuni*, *Campylobacter lari*, *Candidatus Puniceispirillum*, *Clostridium cellulolyticum*, *Clostridium perfringens*, *Corynebacterium accolens*, *Corynebacterium diphtheria*, *Corynebacterium matruchotii*, *Dinoroseobacter shibae*, *Eubacterium dolichum*, *gamma proteobacterium*, *Gluconacetobacter diazotrophicus*, *Haemophilus parainfluenzae*, *Haemophilus sputorum*, *Helicobacter canadensis*, *Helicobacter cinaedi*, *Helicobacter mustelae*, *Ilyobacter polytropus*, *Kingella kingae*, *Lactobacillus crispatus*, *Listeria ivanovii*, *Listeria monocytogenes*, *Listeriaceae bacterium*, *Methylocystis* sp., *Methylosinus trichosporium*, *Mobiluncus mulieris*, *Neisseria bacilliformis*, *Neisseria cinerea*, *Neisseria flavescens*, *Neisseria lactamica*, *Neisseria meningitidis*, *Neisseria* sp., *Neisseria wadsworthii*, *Nitrosomonas* sp., *Parvibaculum lavamentivorans*, *Pasteurella multocida*, *Phascolarctobacterium succinatutens*, *Ralstonia syzygii*, *Rhodopseudomonas palustris*, *Rhodovulum* sp., *Simonsiella muelleri*, *Sphingomonas* sp., *Sporolactobacillus vineae*, *Staphylococcus lugdunensis*, *Streptococcus* sp., *Subdoligranulum* sp., *Tistrella mobilis*, *Treponema* sp., or *Verminephrobacter eiseniae*.

A Cas9 molecule or Cas9 polypeptide, as that term is used herein, refers to a molecule or polypeptide that can interact with a guide RNA (gRNA) molecule and, in concert with the gRNA molecule, home or localizes to a site which comprises a target domain and PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table 50.

Cas9 Domains

Crystal structures have been determined for two different naturally occurring bacterial Cas9 molecules (Jinek et al., Science, 343(6176):1247997, 2014) and for *S. pyogenes* Cas9 with a guide RNA (e.g., a synthetic fusion of crRNA and tracrRNA) (Nishimasu et al., Cell, 156:935-949, 2014; and Anders et al., Nature, 2014, doi: 10.1038/nature13579).

A naturally occurring Cas9 molecule comprises two lobes: a recognition (REC) lobe and a nuclease (NUC) lobe; each of which further comprises domains described herein. FIGS. 9A-9B provide a schematic of the organization of important Cas9 domains in the primary structure. The domain nomenclature and the numbering of the amino acid residues encompassed by each domain used throughout this disclosure is as described in Nishimasu et al. The numbering of the amino acid residues is with reference to Cas9 from *S. pyogenes*.

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain (also referred to herein as RuvC-like domain), the HNH domain (also referred to herein as HNH-like domain), and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

A RuvC-Like Domain and an HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

(SEQ ID NO: 8)
D-X1-G-X2-X3-X4-X5-G-X6-X7-X8-X9, wherein,

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X4 is selected from S, Y, N and F (e.g., S);
X5 is selected from V, I, L, C, T and F (e.g., selected from V, I and L);
X6 is selected from W, F, V, Y, S and L (e.g., W);
X7 is selected from A, S, C, V and G (e.g., selected from A and S);
X8 is selected from V, I, L, A, M and H (e.g., selected from V, I, M and L); and
X9 is selected from any amino acid or is absent (e.g., selected from T, V, I, L, A, F, S, A, Y, M and R, or, e.g., selected from T, V, I, L and A).

In an embodiment, the N-terminal RuvC-like domain differs from a sequence of SEQ ID NO:8, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

(SEQ ID NO: 9)
D-X1-G-X2-X3-S-X5-G-X6-X7-X8-X9,, wherein
X1 is selected from I, V, M, L and T (e.g., selected from I, V, and L);
X2 is selected from T, I, V, S, N, Y, E and L (e.g., selected from T, V, and I);
X3 is selected from N, S, G, A, D, T, R, M and F (e.g., A or N);
X5 is selected from V, I, L, C, T and F (e.g., selected from V, I and L);
X6 is selected from W, F, V, Y, S and L (e.g., W);
X7 is selected from A, S, C, V and G (e.g., selected from A and S);
X8 is selected from V, I, L, A, M and H (e.g., selected from V, I, M and L); and
X9 is selected from any amino acid or is absent (e.g., selected from T, V, I, L, A, F, S, A, Y, M and R or selected from e.g., T, V, I, L and A).

In an embodiment, the N-terminal RuvC-like domain differs from a sequence of SEQ ID NO:9 by as many as 1 but no more than 2, 3, 4, or 5 residues.

In an embodiment, the N-terminal RuvC-like domain comprises an amino acid sequence of formula III:

(SEQ ID NO: 10)
D-I-G-X2-X3-S-V-G-W-A-X8-X9, wherein
X2 is selected from T, I, V, S, N, Y, E and L (e.g., selected from T, V, and I);
X3 is selected from N, S, G, A, D, T, R, M and F (e.g., A or N);
X8 is selected from V, I, L, A, M and H (e.g., selected from V, I, M and L); and
X9 is selected from any amino acid or is absent (e.g., selected from T, V, I, L, A, F, S, A, Y, M and R or selected from e.g., T, V, I, L and A).

In an embodiment, the N-terminal RuvC-like domain differs from a sequence of SEQ ID NO:10 by as many as 1 but no more than 2, 3, 4, or 5 residues.

In an embodiment, the N-terminal RuvC-like domain comprises an amino acid sequence of formula III:

(SEQ ID NO: 11)
D-I-G-T-N-S-V-G-W-A-V-X, wherein
X is a non-polar alkyl amino acid or a hydroxyl amino acid, e.g., X is selected from V, I, L and T (e.g., the eaCas9 molecule can comprise an N-terminal RuvC-like domain shown in FIGS. 2A-2G (is depicted as Y)).

In an embodiment, the N-terminal RuvC-like domain differs from a sequence of SEQ ID NO:11 by as many as 1 but no more than, 2, 3, 4, or 5 residues.

In an embodiment, the N-terminal RuvC-like domain differs from a sequence of an N-terminal RuvC like domain disclosed herein, e.g., in FIGS. 3A-3B or FIGS. 7A-7B, as many as 1 but no more than 2, 3, 4, or 5 residues. In an embodiment, 1, 2, 3 or all of the highly conserved residues identified in FIGS. 3A-3B or FIGS. 7A-7B are present.

In an embodiment, the N-terminal RuvC-like domain differs from a sequence of an N-terminal RuvC-like domain disclosed herein, e.g., in FIGS. 4A-4B or FIGS. 7A-7B, as many as 1 but no more than 2, 3, 4, or 5 residues. In an embodiment, 1, 2, or all of the highly conserved residues identified in FIGS. 4A-4B or FIGS. 7A-7B are present.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:
I-X1-X2-E-X3-A-R-E (SEQ ID NO:12), wherein
X1 is V or H,
X2 is I, L or V (e.g., I or V); and
X3 is M or T.

In an embodiment, the additional RuvC-like domain comprises the amino acid sequence:
I-V-X2-E-M-A-R-E (SEQ ID NO:13), wherein
X2 is I, L or V (e.g., I or V) (e.g., the eaCas9 molecule or eaCas9 polypeptide can comprise an additional RuvC-like domain shown in FIG. 2A-2G or FIGS. 7A-7B (depicted as B)).

An additional RuvC-like domain can comprise an amino acid sequence:
H-H-A-X1-D-A-X2-X3 (SEQ ID NO: 14), wherein
X1 is H or L;
X2 is R or V; and
X3 is E or V.

In an embodiment, the additional RuvC-like domain comprises the amino acid sequence:

(SEQ ID NO: 15)
H-H-A-H-D-A-Y-L.

In an embodiment, the additional RuvC-like domain differs from a sequence of SEQ ID NO: 12, 13, 14 or 15 by as many as 1 but no more than 2, 3, 4, or 5 residues.

In some embodiments, the sequence flanking the N-terminal RuvC-like domain is a sequences of formula V:

(SEQ ID NO: 16)
K-X1'-Y-X2'-X3'-X4'-Z-T-D-X9'-Y,.

wherein
X1' is selected from K and P,
X2' is selected from V, L, I, and F (e.g., V, I and L);
X3' is selected from G, A and S (e.g., G),
X4' is selected from L, I, V and F (e.g., L);
X9' is selected from D, E, N and Q; and Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

X1-X2-X3-H-X4-X5-P-X6-X7-X8-X9-X10-X11-X12-X13-X14-X15-N-X16-X17-X18-X19-X20-X21-X22-X23-N(SEQ ID NO: 17), wherein X1 is selected from D, E, Q and N (e.g., D and E);
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X7 is selected from S, A, D, T and K (e.g., S and A);
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X11 is selected from D, S, N, R, L and T (e.g., D);
X12 is selected from D, N and S;
X13 is selected from S, A, T, G and R (e.g., S);
X14 is selected from I, L, F, S, R, Y, Q, W, D, K and H (e.g., I, L and F);
X15 is selected from D, S, I, N, E, A, H, F, L, Q, M, G, Y and V;
X16 is selected from K, L, R, M, T and F (e.g., L, R and K);
X17 is selected from V, L, I, A and T;
X18 is selected from L, I, V and A (e.g., L and I);
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, a HNH-like domain differs from a sequence of SEQ ID NO: 17 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

(SEQ ID NO: 18)
X1-X2-X3-H-X4-X5-P-X6-S-X8-X9-X10-D-D-S-X14-X15-N-K-V-L-X19-X20-X21-X22-X23-N, wherein
X1 is selected from D and E;
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 18 by 1, 2, 3, 4, or 5 residues.

In an embodiment, an eaCas9 molecule or eaCas9 polypeptide comprises an HNH-like domain comprising an amino acid sequence of formula VII:

(SEQ ID NO: 19)
X1-V-X3-H-I-V-P-X6-S-X8-X9-X10-D-D-S-X14-X15-N-K-V-L-T-X20-X21-X22-X23-N, wherein
X1 is selected from D and E;
X3 is selected from D and E;
X6 is selected from Q, H, R, K, Y, I, L and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 19 by 1, 2, 3, 4, or 5 residues.

In an embodiment, an eaCas9 molecule or eaCas9 polypeptide comprises an HNH-like domain having an amino acid sequence of formula VIII:

(SEQ ID NO: 20)
D-X2-D-H-I-X5-P-Q-X7-F-X9-X10-D-X12-S-I-D-N-X16-V-L-X19-X20-S-X22-X23-N, wherein
X2 is selected from I and V;
X5 is selected from I and V;
X7 is selected from A and S;

X9 is selected from I and L;
X10 is selected from K and T;
X12 is selected from D and N;
X16 is selected from R, K and L; X19 is selected from T and V;
X20 is selected from S and R;
X22 is selected from K, D and A; and
X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO: 20 by as many as 1 but no more than 2, 3, 4, or 5 residues.

In an embodiment, an eaCas9 molecule or eaCas9 polypeptide comprises the amino acid sequence of formula IX:

(SEQ ID NO: 21)
L-Y-Y-L-Q-N-G-X1'-D-M-Y-X2'-X3'-X4'-X5'-L-D-I-X6'-

X7'-L-S-X8'-Y-Z-N-R-X9'-K-X10'-D-X11'-V-P, wherein
X1' is selected from K and R;
X2' is selected from V and T;
X3' is selected from G and D;
X4' is selected from E, Q and D;
X5' is selected from E and D;
X6' is selected from D, N and H;
X7' is selected from Y, R and N;
X8' is selected from Q, D and N; X9' is selected from G and E;
X10' is selected from S and G;
X11' is selected from D and N; and
Z is an HNH-like domain, e.g., as described above.

In an embodiment, the eaCas9 molecule or eaCas9 polypeptide comprises an amino acid sequence that differs from a sequence of SEQ ID NO:21 by as many as 1 but no more than 2, 3, 4, or 5 residues.

In an embodiment, the HNH-like domain differs from a sequence of an HNH-like domain disclosed herein, e.g., in FIGS. 5A-5C or FIGS. 7A-7B, as many as 1 but no more than 2, 3, 4, or 5 residues. In an embodiment, 1 or both of the highly conserved residues identified in FIGS. 5A-5C or FIGS. 7A-7B are present.

In an embodiment, the HNH-like domain differs from a sequence of an HNH-like domain disclosed herein, e.g., in FIGS. 6A-6B or FIGS. 7A-7B, as many as 1 but no more than 2, 3, 4, or 5 residues. In an embodiment, 1, 2, all 3 of the highly conserved residues identified in FIGS. 6A-6B or FIGS. 7A-7B are present.

Cas9 Activities

Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide. In an embodiment, an eaCas9 molecule or eaCas9 polypeptide, comprises one or more of the following activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double stranded break, which in an embodiment is the presence of two nickase activities;

an endonuclease activity;

an exonuclease activity; and a helicase activity, i.e., the ability to unwind the helical structure of a double stranded nucleic acid.

In an embodiment, an enzymatically active Cas9 or an eaCas9 molecule or an eaCas9 polypeptide cleaves both DNA strands and results in a double stranded break. In an embodiment, an eaCas9 molecule or eaCas9 polypeptide cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH-like domain. In an embodiment, an eaCas9 molecule or eaCas9 polypeptide comprises cleavage activity associated with an N-terminal RuvC-like domain. In an embodiment, an eaCas9 molecule or eaCas9 polypeptide comprises cleavage activity associated with an HNH-like domain and cleavage activity associated with an N-terminal RuvC-like domain. In an embodiment, an eaCas9 molecule or eaCas9 polypeptide comprises an active, or cleavage competent, HNH-like domain and an inactive, or cleavage incompetent, N-terminal RuvC-like domain. In an embodiment, an eaCas9 molecule or eaCas9 polypeptide comprises an inactive, or cleavage incompetent, HNH-like domain and an active, or cleavage competent, N-terminal RuvC-like domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain and PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of *S. pyogenes* recognizes the sequence motif NGG and directs cleavage of a target nucleic acid sequence 1 to 10, e.g., 3 to 5, base pairs upstream from that sequence. See, e.g., Mali et al., SCIENCE 2013; 339(6121): 823-826. In an embodiment, an eaCas9 molecule of *S. thermophilus* recognizes the sequence motif NGGNG and NNAGAAW (W=A or T) and directs cleavage of a core target nucleic acid sequence 1 to 10, e.g., 3 to 5, base pairs upstream from these sequences. See, e.g., Horvath et al., SCIENCE 2010; 327(5962):167-170, and Deveau et al., J BACTERIOL 2008; 190(4): 1390-1400. In an embodiment, an eaCas9 molecule of *S. mutans* recognizes the sequence motif NGG and/or NAAR (R=A or G) and directs cleavage of a core target nucleic acid sequence 1 to 10, e.g., 3 to 5 base pairs, upstream from this sequence. See, e.g., Deveau et al., J BACTERIOL 2008; 190(4): 1390-1400. In an embodiment, an eaCas9 molecule of *S. aureus* recognizes the sequence motif NNGRR (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRN (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRT (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRV (R=A or G, V=A, G or C) and directs cleavage of a target nucleic acid sequence 1 to 10, e.g., 3 to 5, base pairs upstream from that sequence. In an embodiment, an eaCas9 molecule of *Neisseria meningitidis* recognizes the sequence motif NNNNGATT or NNNGCTT and directs cleavage of a target nucleic acid sequence 1 to 10, e.g., 3 to 5, base pairs upstream from that sequence. See, e.g., Hou et al., PNAS Early Edition 2013, 1-6. The ability of a Cas9 molecule to recognize a PAM sequence can be determined, e.g., using a transformation assay described in Jinek et al., SCIENCE 2012 337:816. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski et al., RNA BIOLOGY 2013 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Additional exemplary Cas9 molecules are a Cas9 molecule of *Neisseria meningitides* (Hou et al., PNAS Early Edition 2013, 1-6 and a *S. aureus* cas9 molecule.

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 85%, 90%, 95%, 96%, 97%, 98% or 99% homology with;

differs at no more than, 2, 5, 10, 15, 20, 30, or 40% of the amino acid residues when compared with;

differs by at least 1, 2, 5, 10 or 20 amino acids, but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al., RNA BIOLOGY 2013 10:5, 727-737; Hou et al., PNAS Early Edition 2013, 1-6; SEQ ID NO:1-4. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

In an embodiment, a Cas9 molecule or Cas9 polypeptide comprises any of the amino acid sequence of the consensus sequence of FIGS. 2A-2G, wherein "*" indicates any amino acid found in the corresponding position in the amino acid sequence of a Cas9 molecule or Cas9 polypeptide of *S. pyogenes, S. thermophilus, S. mutans* and *L. innocua*, and "-" indicates any amino acid. In an embodiment, a Cas9 molecule differs from the sequence of the consensus sequence of FIGS. 2A-2G by at least 1, but no more than 2, 3, 4, 5, 6, 7, 8, 9, or 10 amino acid residues. In an embodiment, a Cas9 molecule or Cas9 polypeptide comprises the amino acid sequence of SEQ ID NO:7 of FIGS. 7A-7B, wherein "*" indicates any amino acid found in the corresponding position in the amino acid sequence of a Cas9 molecule or Cas9 polypeptide of *S. pyogenes*, or *N. meningitides*, "-" indicates any amino acid, and "-" indicates any amino acid or absent. In an embodiment, a Cas9 molecule or Cas9 polypeptide differs from the sequence of SEQ ID NO:6 or 7 disclosed in FIGS. 7A-7B by at least 1, but no more than 2, 3, 4, 5, 6, 7, 8, 9, or 10 amino acid residues.

A comparison of the sequence of a number of Cas9 molecules indicate that certain regions are conserved. These are identified below as:

region 1 (residues 1 to 180, or in the case of region 1' residues 120 to 180)

region 2 (residues 360 to 480);

region 3 (residues 660 to 720);

region 4 (residues 817 to 900); and region 5 (residues 900 to 960);

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-5, independently, have 50%, 60%, 70%, 80%, 85%, 90%, 95%, 96%, 97%, 98% or 99% homology with the corresponding residues of a Cas9 molecule or Cas9 polypeptide described herein, e.g., a sequence from FIGS. 2A-2G or from FIGS. 7A-7B.

In an embodiment, a Cas9 molecule or Cas9 polypeptide, e.g., an eaCas9 molecule or eaCas9 polypeptide, comprises an amino acid sequence referred to as region 1:

having 50%, 60%, 70%, 80%, 85%, 90%, 95%, 96%, 97%, 98% or 99% homology with amino acids 1-180 (the numbering is according to the motif sequence in FIGS. 2A-2G; 52% of residues in the four Cas9 sequences in FIGS. 2A-2G are conserved) of the amino acid sequence of Cas9 of S. pyogenes;

differs by at least 1, 2, 5, 10 or 20 amino acids but by no more than 90, 80, 70, 60, 50, 40 or 30 amino acids from amino acids 1-180 of the amino acid sequence of Cas9 of S. pyogenes, S. thermophilus, S. mutans or Listeria innocua; or is identical to 1-180 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 1':

having 55%, 60%, 65%, 70%, 75%, 80%, 85%, 90%, 95%, 96%, 97%, 98% or 99% homology with amino acids 120-180 (55% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 120-180 of the amino acid sequence of Cas9 of S. pyogenes, S. thermophilus, S. mutans or L. innocua; or is identical to 120-180 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 2:

having 50%, 55%, 60%, 65%, 70%, 75%, 80%, 85%, 90%, 95%, 96%, 97%, 98% or 99% homology with amino acids 360-480 (52% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 360-480 of the amino acid sequence of Cas9 of S. pyogenes, S. thermophilus, S. mutans or L. innocua; or is identical to 360-480 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 3:

having 55%, 60%, 65%, 70%, 75%, 80%, 85%, 90%, 95%, 96%, 97%, 98%, or 99% homology with amino acids 660-720 (56% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 660-720 of the amino acid sequence of Cas9 of S. pyogenes, S. thermophilus, S. mutans or L. innocua; or is identical to 660-720 of the amino acid sequence of Cas9 of S. pyogenes, S. thermophilus, S. mutans or L. innocua.

In an embodiment, a Cas9 molecule, e.g., an eaCas9 molecule, comprises an amino acid sequence referred to as region 4:

having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 817-900 of the amino acid sequence of Cas9 of S. pyogenes, S. thermophilus, S. mutans or L. innocua; or is identical to 817-900 of the amino acid sequence of Cas9 of S. pyogenes, S. thermophilus, S. mutans or L. innocua.

In an embodiment, a Cas9 molecule or Cas9 polypeptide, e.g., an eaCas9 molecule or eaCas9 polypeptide, comprises an amino acid sequence referred to as region 5:

having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 2A-2G are conserved) of the amino acid sequence of Cas9 of S. pyogenes, S. thermophilus, S. mutans or L. innocua;

differs by at least 1, 2, or 5 amino acids but by no more than 35, 30, 25, 20 or 10 amino acids from amino acids 900-960 of the amino acid sequence of Cas9 of S. pyogenes, S. thermophilus, S. mutans or L. innocua; or is identical to 900-960 of the amino acid sequence of Cas9 of S. pyogenes, S. thermophilus, S. mutans or L. innocua.

Engineered or Altered Cas9 Molecules and Cas9 Polypeptides

Cas9 molecules and Cas9 polypeptides described herein, e.g., naturally occurring Cas9 molecules can possess any of a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In typical embodiments, a Cas9 molecule or Cas9 polypeptide have the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. E.g., an engineered Cas9 molecule can be altered to recognize a PAM sequence other than that recognized by the endogenous wild-type PI domain. In an embodiment, a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring Cas9 molecules or Cas9 polypeptides to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40 or 50 mutations, but less than 200, 100, or 80 mutations relative to a reference, e.g., a parental, Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

Modified Cleavage eaCas9 Molecules and eaCas9 Polypeptides

In an embodiment, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In an embodiment, an eaCas9 molecule or eaCas9 polypeptide comprises an active, or cleavage competent, HNH-like domain (e.g., an HNH-like domain described herein, e.g., SEQ ID NO: 17, SEQ ID NO: 18, SEQ ID NO: 19, SEQ ID NO: 20 or SEQ ID NO: 21) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 2A-2G or an aspartic acid at position 10 of SEQ ID NO: 7, e.g., can be substituted with an alanine. In an embodiment, the eaCas9 molecule or eaCas9 polypeptide differs from wild type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., a RuvC-like domain described herein, e.g., SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, or SEQ ID NO: 16). Exemplary inactive, or cleavage incompetent HNH-like domains can have a mutation at one or more of: a histidine in an HNH-like domain, e.g., a histidine shown at position 856 of the consensus sequence disclosed in FIGS. 2A-2G, e.g., can be substituted with an alanine; and one or more asparagines in an HNH-like domain, e.g., an asparagine shown at position 870 of the consensus sequence disclosed in FIGS. 2A-2G and/or at position 879 of the consensus sequence disclosed in FIGS. 2A-2G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in one or more RuvC-like domain, e.g., an N-terminal RuvC-like domain; an HNH-like domain; a region outside the RuvC-like domains and the HNH-like domain. In some embodiments, a mutation(s) is present in a RuvC-like domain, e.g., an N-terminal RuvC-like domain. In some embodiments, a mutation(s) is present in an HNH-like domain. In some embodiments, mutations are present in both a RuvC-like domain, e.g., an N-terminal RuvC-like domain and an HNH-like domain.

Exemplary mutations that may be made in the RuvC domain or HNH domain with reference to the *S. pyogenes* sequence include: D10A, E762A, H840A, N854A, N863A and/or D986A.

In an embodiment, a Cas9 molecule or Cas9 polypeptide is an eiCas9 molecule or eiCas9 polypeptide comprising one or more differences in a RuvC domain and/or in an HNH domain as compared to a reference Cas9 molecule, and the eiCas9 molecule or eiCas9 polypeptide does not cleave a nucleic acid, or cleaves with significantly less efficiency than does wildtype, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative or by the method described in Section IV. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. aureus, S. pyogenes,* or *C. jejuni* as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S. aureus, S. pyogenes,* or *C. jejuni*); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of *S. aureus, S. pyogenes,* or *C. jejuni*); or the ability to cleave a nucleic acid molecule, e.g., a double stranded or single stranded nucleic acid molecule, can be eliminated.

In an embodiment, the altered Cas9 molecule or Cas9 polypeptide is an eaCas9 molecule or eaCas9 polypeptide comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule or Cas9 polypeptide is an eiCas9 molecule or eiCas9 polypeptide which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of *S. pyogenes, S. thermophilus, S. aureus, C. jejuni* or *N. meningitidis*. In an embodiment, the reference Cas9 molecule is the naturally occurring Cas9 molecule having the closest sequence identity or homology. In an embodiment, the eiCas9 molecule or eiCas9 polypeptide lacks substantial cleavage activity associated with a RuvC domain and cleavage activity associated with an HNH domain.

In an embodiment, the altered Cas9 molecule or Cas9 polypeptide is an eaCas9 molecule or eaCas9 polypeptide comprising the fixed amino acid residues of *S. pyogenes* shown in the consensus sequence disclosed in FIGS. 2A-2G, and has one or more amino acids that differ from the amino acid sequence of *S. pyogenes* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIG. 2A-2G or SEQ ID NO:7.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. pyogenes* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *S. pyogenes* Cas9 molecule.

In an embodiment, the altered Cas9 molecule or Cas9 polypeptide is an eaCas9 molecule or eaCas9 polypeptide comprising the fixed amino acid residues of *S. thermophilus* shown in the consensus sequence disclosed in FIGS. 2A-2G, and has one or more amino acids that differ from the amino acid sequence of *S. thermophilus* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. thermophilus* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *S. thermophilus* Cas9 molecule.

In an embodiment, the altered Cas9 molecule or Cas9 polypeptide is an eaCas9 molecule or eaCas9 polypeptide comprising the fixed amino acid residues of *S. mutans* shown in the consensus sequence disclosed in FIGS. 2A-2G, and has one or more amino acids that differ from the amino acid sequence of *S. mutans* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. mutans* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *S. mutans* Cas9 molecule.

In an embodiment, the altered Cas9 molecule or Cas9 polypeptide is an eaCas9 molecule or eaCas9 polypeptide comprising the fixed amino acid residues of *L. innocula* shown in the consensus sequence disclosed in FIGS. 2A-2G, and has one or more amino acids that differ from the amino acid sequence of *L. innocula* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *L. innocula* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *L. innocula* Cas9 molecule.

In an embodiment, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of *S. pyogenes* comprising an N-terminal RuvC-like domain can be fused to a fragment of a Cas9 molecule of a species other than *S. pyogenes* (e.g., *S. thermophilus*) comprising an HNH-like domain.

Cas9 Molecules or Cas9 Polypeptides with Altered PAM Recognition or No PAM Recognition Naturally occurring Cas9 molecules can recognize specific PAM sequences, for example, the PAM recognition sequences described above for *S. pyogenes*, *S. thermophiles*, *S. mutans*, *S. aureus* and *N. meningitidis*.

In an embodiment, a Cas9 molecule or Cas9 polypeptide has the same PAM specificities as a naturally occurring Cas9 molecule. In another embodiment, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule or Cas9 polypeptide can be altered, e.g., to alter PAM recognition, e.g., to alter the PAM sequence that the Cas9 molecule recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to high level of identity (e.g., 98%, 99% or 100% match between gRNA and a PAM sequence), e.g., to decrease off target sites and increase specificity. In an embodiment, the length of the PAM recognition sequence is at least 4, 5, 6, 7, 8, 9, 10 or 15 amino acids in length. In an embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. NATURE 2011, 472(7344): 499-503. Candidate Cas9 molecules can be evaluated, e.g., by methods described in Section IV.

Alterations of the PI domain, which mediates PAM recognition, are discussed below.

Synthetic Cas9 Molecules and Cas9 Polypeptides with Altered PI Domains

Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or Syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule or Syn-Cas9 polypeptide comprises:

a) a Cas9 core domain, e.g., a Cas9 core domain from Table 50 or 51, e.g., a *S. aureus*, *S. pyogenes*, or *C. jejuni* Cas9 core domain; and b) an altered PI domain from a species X Cas9 sequence selected from Tables 53 and 54.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table 50 and said altered PI domain comprises a PI domain from a species Y Cas9 from Table 50.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 90, 95, or 100% homology with the amino acid sequence of a naturally occurring PI domain of said species Y from Table 50.

In an embodiment, the altered PI domain differs by no more than 50, 40, 30, 25, 20, 15, 10, 5, 4, 3, 2, or 1 amino acid residue from the amino acid sequence of a naturally occurring PI domain of said second species from Table 50.

In an embodiment, the Cas9 core domain comprises a *S. aureus* core domain and altered PI domain comprises: an *A. denitrificans* PI domain; a *C. jejuni* PI domain; a *H. mustelae* PI domain; or an altered PI domain of species X PI domain, wherein species X is selected from Table 54.

In an embodiment, the Cas9 core domain comprises a *S. pyogenes* core domain and the altered PI domain comprises: an *A. denitrificans* PI domain; a *C. jejuni* PI domain; a *H. mustelae* PI domain; or an altered PI domain of species X PI domain, wherein species X is selected from Table 54.

In an embodiment, the Cas9 core domain comprises a *C. jejuni* core domain and the altered PI domain comprises: an *A. denitrificans* PI domain; a *H. mustelae* PI domain; or an altered PI domain of species X PI domain, wherein species X is selected from Table 54.

In an embodiment, the Cas9 molecule or Cas9 polypeptide further comprises a linker disposed between said Cas9 core domain and said altered PI domain.

In an embodiment, the linker comprises: a linker described elsewhere herein disposed between the Cas9 core domain and the heterologous PI domain. Suitable linkers are further described in Section V.

Exemplary altered PI domains for use in Syn-Cas9 molecules are described in Tables 53 and 54. The sequences for the 83 Cas9 orthologs referenced in Tables 53 and 54 are provided in Table 50. Table 52 provides the Cas9 orthologs with known PAM sequences and the corresponding RKR motif.

In an embodiment, a Syn-Cas9 molecule or Syn-Cas9 polypeptide may also be size-optimized, e.g., the Syn-Cas9 molecule or Syn-Cas9 polypeptide comprises one or more deletions, and optionally one or more linkers disposed between the amino acid residues flanking the deletions. In an embodiment, a Syn-Cas9 molecule or Syn-Cas9 polypeptide comprises a REC deletion.

Size-Optimized Cas9 Molecules and Cas9 Polypeptides

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a *S. aureus, S. pyogenes*, or *C. jejuni*, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule or Cas9 polypeptide can comprise one or more deletions that do not substantially affect or decrease the activity of the resultant Cas9 molecules or Cas9 polypeptides described herein. Activities that are retained in the Cas9 molecules or Cas9 polypeptides comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules or Cas9 polypeptides described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 50, can be modeled onto the crystal structure of *S. pyogenes* Cas9 (Nishimasu et al., Cell, 156:935-949, 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

REC-Optimized Cas9 Molecules and Cas9 Polypeptides

A REC-optimized Cas9 molecule, or a REC-optimized Cas9 polypeptide, as that term is used herein, refers to a Cas9 molecule or Cas9 polypeptide that comprises a deletion in one or both of the REC2 domain and the $RE1_{CT}$ domain (collectively a REC deletion), wherein the deletion comprises at least 10% of the amino acid residues in the cognate domain. A REC-optimized Cas9 molecule or Cas9 polypeptide can be an eaCas9 molecule or eaCas9 polypeptide, or an eiCas9 molecule or eiCas9 polypeptide. An exemplary REC-optimized Cas9 molecule or REC-optimized Cas9 polypeptide comprises:

a) a deletion selected from:

i) a REC2 deletion;

ii) a $REC1_{CT}$ deletion; or iii) a $REC1_{SUB}$ deletion.

Optionally, a linker is disposed between the amino acid residues that flank the deletion. In an embodiment, a Cas9 molecule or Cas9 polypeptide includes only one deletion, or only two deletions. A Cas9 molecule or Cas9 polypeptide can comprise a REC2 deletion and a $REC1_{CT}$ deletion. A Cas9 molecule or Cas9 polypeptide can comprise a REC2 deletion and a $REC1_{SUB}$ deletion.

Generally, the deletion will contain at least 10% of the amino acids in the cognate domain, e.g., a REC2 deletion will include at least 10% of the amino acids in the REC2 domain.

A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule or REC-optimized Cas9 polypeptide can include a linker disposed between the amino acid residues that flank the deletion. Any linkers known in the art that maintain the conformation or native fold of the Cas9 molecule (thereby retaining Cas9 activity) can be used between the amino acid resides that flank a REC deletion in a REC-optimized Cas9 molecule or REC-optimized Cas9 polypeptide. Linkers for use in generating recombinant proteins, e.g., multi-domain proteins, are known in the art (Chen et al., *Adv Drug Delivery Rev,* 65:1357-69, 2013).

In an embodiment, a REC-optimized Cas9 molecule or REC-optimized Cas9 polypeptide comprises an amino acid sequence that, other than any REC deletion and associated linker, has at least 50, 55, 60, 65, 70, 75, 80, 85, 90, 95, 99, or 100% homology with the amino acid sequence of a naturally occurring Cas 9, e.g., a Cas9 molecule described in Table 50, e.g., a *S. aureus* Cas9 molecule, a *S. pyogenes* Cas9 molecule, or a *C. jejuni* Cas9 molecule.

In an embodiment, a a REC-optimized Cas9 molecule or REC-optimized Cas9 polypeptide comprises an amino acid sequence that, other than any REC deletion and associated linker, differs by no more than 1, 2, 3, 4, 5, 6, 7, 8, 9, 10, 15, 20, or 25, amino acid residues from the amino acid sequence of a naturally occurring Cas 9, e.g., a Cas9 molecule described in Table 50, e.g., a *S. aureus* Cas9 molecule, a *S. pyogenes* Cas9 molecule, or a *C. jejuni* Cas9 molecule.

In an embodiment, a REC-optimized Cas9 molecule or REC-optimized Cas9 polypeptide comprises an amino acid sequence that, other than any REC deletion and associate linker, differs by no more than 1, 2, 3, 4, 5, 6, 7, 8, 9, 10, 15, 20, or 25% of the, amino acid residues from the amino acid sequence of a naturally occurring Cas 9, e.g., a Cas9 molecule described in Table 50, e.g., a *S. aureus* Cas9 molecule, a *S. pyogenes* Cas9 molecule, or a *C. jejuni* Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM1250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table 50.

The amino acid sequences of exemplary Cas9 molecules from different bacterial species are shown below.

TABLE 50

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| *Staphylococcus Aureus* tr\|J7RUA5\|J7RUA5_STAAU | SEQ ID NO: 304 | 126 | 166 | 41 | 296 | 352 | 57 | 296 | 352 | 57 |
| *Streptococcus Pyogenes* sp\|Q99ZW2\|CAS9_STRP1 | SEQ ID NO: 305 | 176 | 314 | 139 | 511 | 592 | 82 | 511 | 592 | 82 |

TABLE 50-continued

Amino Acid Sequence of Cas9 Orthologs

| Species/Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| *Campylobacter jejuni* NCTC 11168 gi\|218563121\|ref\|YP_002344900.1 | SEQ ID NO: 306 | 137 | 181 | 45 | 316 | 360 | 45 | 316 | 360 | 45 |
| *Bacteroides fragilis* NCTC 9343 gi\|60683389\|ref\|YP_213533.1\| | SEQ ID NO: 307 | 148 | 339 | 192 | 524 | 617 | 84 | 524 | 617 | 84 |
| *Bifidobacterium bifidum* S17 gi\|310286728\|ref\|YP_003937986. | SEQ ID NO: 308 | 173 | 335 | 163 | 516 | 607 | 87 | 516 | 607 | 87 |
| *Veillonella atypica* ACS-134-V-Col7a gi\|303229466\|ref\|ZP_07316256.1 | SEQ ID NO: 309 | 185 | 339 | 155 | 574 | 663 | 79 | 574 | 663 | 79 |
| *Lactobacillus rhamnosus* GG gi\|258509199\|ref\|YP_003171950.1 | SEQ ID NO: 310 | 169 | 320 | 152 | 559 | 645 | 78 | 559 | 645 | 78 |
| *Filifactor alocis* ATCC 35896 gi\|374307738\|ref\|YP_005054169.1 | SEQ ID NO: 311 | 166 | 314 | 149 | 508 | 592 | 76 | 508 | 592 | 76 |
| *Oenococcus kitaharae* DSM 17330 gi\|366983953\|gb\|EHN59352.1\| | SEQ ID NO: 312 | 169 | 317 | 149 | 555 | 639 | 80 | 555 | 639 | 80 |
| *Fructobacillus fructosus* KCTC 3544 gi\|339625081\|ref\|ZP_08660870.1 | SEQ ID NO: 313 | 168 | 314 | 147 | 488 | 571 | 76 | 488 | 571 | 76 |
| *Catenibacterium mitsuokai* DSM 15897 gi\|224543312\|ref\|ZP_03683851.1 | SEQ ID NO: 314 | 173 | 318 | 146 | 511 | 594 | 78 | 511 | 594 | 78 |
| *Finegoldia magna* ATCC 29328 gi\|169823755\|ref\|YP_001691366.1 | SEQ ID NO: 315 | 168 | 313 | 146 | 452 | 534 | 77 | 452 | 534 | 77 |
| *Coriobacteriumglomerans*PW2 gi\|328956315\|ref\|YP_004373648.1 | SEQ ID NO: 316 | 175 | 318 | 144 | 511 | 592 | 82 | 511 | 592 | 82 |
| *Eubacterium yurii* ATCC 43715 gi\|306821691\|ref\|ZP_07455288.1 | SEQ ID NO: 317 | 169 | 310 | 142 | 552 | 633 | 76 | 552 | 633 | 76 |
| *Peptoniphilus duerdenii* ATCC BAA-1640 gi\|304438954\|ref\|ZP_07398877.1 | SEQ ID NO: 318 | 171 | 311 | 141 | 535 | 615 | 76 | 535 | 615 | 76 |
| *Acidaminococcus* sp. D21 gi\|227824983\|ref\|ZP_03989815.1 | SEQ ID NO: 319 | 167 | 306 | 140 | 511 | 591 | 75 | 511 | 591 | 75 |
| *Lactobacillus farciminis* KCTC 3681 gi\|336394882\|ref\|ZP_08576281.1 | SEQ ID NO: 320 | 171 | 310 | 140 | 542 | 621 | 85 | 542 | 621 | 85 |
| *Streptococcus sanguinis* SK49 gi\|422884106\|ref\|ZP_16930555.1 | SEQ ID NO: 321 | 185 | 324 | 140 | 411 | 490 | 85 | 411 | 490 | 85 |
| *Coprococcus catus* GD-7 gi\|291520705\|emb\|CBK78998.1\| | SEQ ID NO: 322 | 172 | 310 | 139 | 556 | 634 | 76 | 556 | 634 | 76 |
| *Streptococcus mutans* UA159 gi\|24379809\|ref\|NP_721764.1\| | SEQ ID NO: 323 | 176 | 314 | 139 | 392 | 470 | 84 | 392 | 470 | 84 |
| *Streptococcus pyogenes* M1 GAS gi\|13622193\|gb\|AAK33936.1\| | SEQ ID NO: 324 | 176 | 314 | 139 | 523 | 600 | 82 | 523 | 600 | 82 |
| *Streptococcus thermophilus* LMD-9 gi\|116628213\|ref\|YP_820832.1\| | SEQ ID NO: 325 | 176 | 314 | 139 | 481 | 558 | 81 | 481 | 558 | 81 |
| *Fusobacteriumnucleatum* ATCC49256 gi\|34762592\|ref\|ZP_00143587.1\| | SEQ ID NO: 326 | 171 | 308 | 138 | 537 | 614 | 76 | 537 | 614 | 76 |
| *Planococcus antarcticus* DSM 14505 gi\|389815359\|ref\|ZP_10206685.1 | SEQ ID NO: 327 | 162 | 299 | 138 | 538 | 614 | 94 | 538 | 614 | 94 |
| *Treponema denticola* ATCC 35405 gi\|42525843\|ref\|NP_970941.1\| | SEQ ID NO: 328 | 169 | 305 | 137 | 524 | 600 | 81 | 524 | 600 | 81 |
| *Solobacterium moorei* F0204 gi\|320528778\|ref\|ZP_08029929.1 | SEQ ID NO: 329 | 179 | 314 | 136 | 544 | 619 | 77 | 544 | 619 | 77 |
| *Staphylococcus pseudintermedius* ED99 gi\|323463801\|gb\|ADX75954.1\| | SEQ ID NO: 330 | 164 | 299 | 136 | 531 | 606 | 92 | 531 | 606 | 92 |
| *Flavobacterium branchiophilum* FL-15 gi\|347536497\|ref\|YP_004843922.1 | SEQ ID NO: 331 | 162 | 286 | 125 | 538 | 613 | 63 | 538 | 613 | 63 |
| *Ignavibacterium album* JCM 16511 gi\|385811609\|ref\|YP_005848005.1 | SEQ ID NO: 332 | 223 | 329 | 107 | 357 | 432 | 90 | 357 | 432 | 90 |

TABLE 50-continued

Amino Acid Sequence of Cas9 Orthologs

| Species/Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| Bergeyella zoohelcum ATCC 43767 gi\|423317190\|ref\|ZP_17295095.1\| | SEQ ID NO: 333 | 165 | 261 | 97 | 529 | 604 | 56 | 529 | 604 | 56 |
| Nitrobacter hamburgensis X14 gi\|92109262\|ref\|YP_571550.1\| | SEQ ID NO: 334 | 169 | 253 | 85 | 536 | 611 | 48 | 536 | 611 | 48 |
| Odoribacter laneus YIT 12061 gi\|374384763\|ref\|ZP_09642280.1 | SEQ ID NO: 335 | 164 | 242 | 79 | 535 | 610 | 63 | 535 | 610 | 63 |
| Legionella pneumophila str. Paris gi\|54296138\|ref\|YP_122507.1\| | SEQ ID NO: 336 | 164 | 239 | 76 | 402 | 476 | 67 | 402 | 476 | 67 |
| Bacteroides sp. 20 3 gi\|301311869\|ref\|ZP_07217791.1\| | SEQ ID NO: 337 | 198 | 269 | 72 | 530 | 604 | 83 | 530 | 604 | 83 |
| Akkermansia muciniphila ATCC BAA-835 gi\|187736489\|ref\|YP_001878601. | SEQ ID NO: 338 | 136 | 202 | 67 | 348 | 418 | 62 | 348 | 418 | 62 |
| Prevotella sp. C561 gi\|345885718\|ref\|ZP_08837074.1 | SEQ ID NO: 339 | 184 | 250 | 67 | 357 | 425 | 78 | 357 | 425 | 78 |
| Wolinella succinogenes DSM 1740 gi\|34557932\|ref\|NP_907747.1\| | SEQ ID NO: 340 | 157 | 218 | 36 | 401 | 468 | 60 | 401 | 468 | 60 |
| Alicyclobacillus hesperidum URH17-3-68 gi\|403744858\|ref\|ZP_10953934.1 | SEQ ID NO: 341 | 142 | 196 | 55 | 416 | 482 | 61 | 416 | 482 | 61 |
| Caenispirillum salinarum AK4 gi\|427429481\|ref\|ZP_18919511.1 | SEQ ID NO: 342 | 161 | 214 | 54 | 330 | 393 | 68 | 330 | 393 | 68 |
| Eubacterium rectale ATCC 33656 gi\|238924075\|ref\|YP_002937591.1 | SEQ ID NO: 343 | 133 | 185 | 53 | 322 | 384 | 60 | 322 | 384 | 60 |
| Mycoplasma synoviae 53 gi\|71894592\|ref\|YP_278700.1\| | SEQ ID NO: 344 | 187 | 239 | 53 | 319 | 381 | 80 | 319 | 381 | 80 |
| Porphyromonas sp. oral taxon 279 str. F0450 gi\|402847315\|ref\|ZP_10895610.1 | SEQ ID NO: 345 | 150 | 202 | 53 | 309 | 371 | 60 | 309 | 371 | 60 |
| Streptococcus thermophilus LMD-9 gi\|116627542\|ref\|YP_820161.1\| | SEQ ID NO: 346 | 127 | 178 | 139 | 424 | 486 | 81 | 424 | 486 | 81 |
| Roseburia inulinivorans DSM 16841 gi\|225377804\|ref\|ZP_03755025.1 | SEQ ID NO: 347 | 154 | 204 | 51 | 318 | 380 | 69 | 318 | 380 | 69 |
| Methylosinus trichosporium OB3b gi\|296446027\|ref\|ZP_06887976.1 | SEQ ID NO: 348 | 144 | 193 | 50 | 426 | 488 | 64 | 426 | 488 | 64 |
| Ruminococcus albus 8 gi\|325677756\|ref\|ZP_08157403.1 | SEQ ID NO: 349 | 139 | 187 | 49 | 351 | 412 | 55 | 351 | 412 | 55 |
| Bifidobacterium longum DJO10A gi\|189440764\|ref\|YP_001955845. | SEQ ID NO: 350 | 183 | 230 | 48 | 370 | 431 | 44 | 370 | 431 | 44 |
| Enterococcus faecalis TX0012 gi\|315149830\|gb\|EFT93846.1\| | SEQ ID NO: 351 | 123 | 170 | 48 | 327 | 387 | 60 | 327 | 387 | 60 |
| Mycoplasma mobile 163K gi\|47458868\|ref\|YP_015730.1\| | SEQ ID NO: 352 | 179 | 226 | 48 | 314 | 374 | 79 | 314 | 374 | 79 |
| Actinomyces coleocanis DSM 15436 gi\|227494853\|ref\|ZP_03925169.1 | SEQ ID NO: 353 | 147 | 193 | 47 | 358 | 418 | 40 | 358 | 418 | 40 |
| Dinoroseobacter shibae DFL 12 gi\|159042956\|ref\|YP_001531750.1 | SEQ ID NO: 354 | 138 | 184 | 47 | 338 | 398 | 48 | 338 | 398 | 48 |
| Actinomyces sp. oral taxon 180 str. F0310 gi\|315605738\|ref\|ZP_07880770.1 | SEQ ID NO: 355 | 183 | 228 | 46 | 349 | 409 | 40 | 349 | 409 | 40 |
| Alcanivorax sp. W11-5 gi\|407803669\|ref\|ZP_11150502.1 | SEQ ID NO: 356 | 139 | 183 | 45 | 344 | 404 | 61 | 344 | 404 | 61 |
| Aminomonas paucivorans DSM 12260 gi\|312879015\|ref\|ZP_07738815.1 | SEQ ID NO: 357 | 134 | 178 | 45 | 341 | 401 | 63 | 341 | 401 | 63 |
| Mycoplasma canis PG 14 gi\|384393286\|gb\|EIE39736.1\| | SEQ ID NO: 358 | 139 | 183 | 45 | 319 | 379 | 76 | 319 | 379 | 76 |
| Lactobacillus coryniformis KCTC 3535 gi\|336393381\|ref\|ZP_08574780.1 | SEQ ID NO: 359 | 141 | 184 | 44 | 328 | 387 | 61 | 328 | 387 | 61 |
| Elusimicrobium minutum Pei191 gi\|187250660\|ref\|YP_001875142.1 | SEQ ID NO: 360 | 177 | 219 | 43 | 322 | 381 | 47 | 322 | 381 | 47 |

TABLE 50-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| *Neisseria meningitidis* Z2491 gi\|218767588\|ref\|YP_002342100.1 | SEQ ID NO: 361 | 147 | 189 | 43 | 360 | 419 | 61 | 360 | 419 | 61 |
| *Pasteurella multocida* str. Pm70 gi\|15602992\|ref\|NP_246064.1\| | SEQ ID NO: 362 | 139 | 181 | 43 | 319 | 378 | 61 | 319 | 378 | 61 |
| *Rhodovulum* sp. PH10 gi\|402849997\|ref\|ZP_10898214.1 | SEQ ID NO: 363 | 141 | 183 | 43 | 319 | 378 | 48 | 319 | 378 | 48 |
| *Eubacterium dolichum* DSM 3991 gi\|160915782\|ref\|ZP_02077990.1 | SEQ ID NO: 364 | 131 | 172 | 42 | 303 | 361 | 59 | 303 | 361 | 59 |
| *Nitratifractor salsuginis* DSM 16511 gi\|319957206\|ref\|YP_004168469.1 | SEQ ID NO: 365 | 143 | 184 | 42 | 347 | 404 | 61 | 347 | 404 | 61 |
| *Rhodospirillum rubrum* ATCC 11170 gi\|83591793\|ref\|YP_425545.1\| | SEQ ID NO: 366 | 139 | 180 | 42 | 314 | 371 | 55 | 314 | 371 | 55 |
| *Clostridium cellulolyticum* H10 gi\|220930482\|ref\|YP_002507391.1 | SEQ ID NO: 367 | 137 | 176 | 40 | 320 | 376 | 61 | 320 | 376 | 61 |
| *Helicobacter mustelae* 12198 gi\|291276265\|ref\|YP_003516037.1 | SEQ ID NO: 368 | 148 | 187 | 40 | 298 | 354 | 48 | 298 | 354 | 48 |
| *Ilyobacter polytropus* DSM 2926 gi\|310780384\|ref\|YP_003968716.1 | SEQ ID NO: 369 | 134 | 173 | 40 | 462 | 517 | 63 | 462 | 517 | 63 |
| *Sphaerochaeta globus* str. Buddy gi\|325972003\|ref\|YP_004248194.1 | SEQ ID NO: 370 | 163 | 202 | 40 | 335 | 389 | 45 | 335 | 389 | 45 |
| *Staphylococcus lugdunensis* M23590 gi\|315659848\|ref\|ZP_07912707.1 | SEQ ID NO: 371 | 128 | 167 | 40 | 337 | 391 | 57 | 337 | 391 | 57 |
| *Treponema* sp. JC4 gi\|384109266\|ref\|ZP_10010146.1 | SEQ ID NO: 372 | 144 | 183 | 40 | 328 | 382 | 63 | 328 | 382 | 63 |
| uncultured delta proteobacterium HF0070 07E19 gi\|297182908\|gb\|ADI19058.1\| | SEQ ID NO: 373 | 154 | 193 | 40 | 313 | 365 | 55 | 313 | 365 | 55 |
| *Alicycliphilus denitrificans* K601 gi\|330822845\|ref\|YP_004386148.1 | SEQ ID NO: 374 | 140 | 178 | 39 | 317 | 366 | 48 | 317 | 366 | 48 |
| *Azospirillum* sp. B510 gi\|288957741\|ref\|YP_003448082.1 | SEQ ID NO: 375 | 205 | 243 | 39 | 342 | 389 | 46 | 342 | 389 | 46 |
| *Bradyrhizobium* sp. BTAi1 gi\|148255343\|ref\|YP_001239928.1 | SEQ ID NO: 376 | 143 | 181 | 39 | 323 | 370 | 48 | 323 | 370 | 48 |
| *Parvibaculum lavamentivorans* DS-1 gi\|154250555\|ref\|YP_001411379.1 | SEQ ID NO: 377 | 138 | 176 | 39 | 327 | 374 | 58 | 327 | 374 | 58 |
| *Prevotella timonensis* CRIS 5C-B1 gi\|282880052\|ref\|ZP_06288774.1 | SEQ ID NO: 378 | 170 | 208 | 39 | 328 | 375 | 61 | 328 | 375 | 61 |
| *Bacillus smithii* 7 3 47FAA gi\|365156657\|ref\|ZP_09352959.1 | SEQ ID NO: 379 | 134 | 171 | 38 | 401 | 448 | 63 | 401 | 448 | 63 |
| *Cand. Puniceispirillum marinum* IMCC1322 gi\|294086111\|ref\|YP_003552871.1 | SEQ ID NO: 380 | 135 | 172 | 38 | 344 | 391 | 53 | 344 | 391 | 53 |
| *Barnesiella intestinihominis* YIT 11860 gi\|404487228\|ref\|ZP_11022414.1 | SEQ ID NO: 381 | 140 | 176 | 37 | 371 | 417 | 60 | 371 | 417 | 60 |
| *Ralstonia syzygii* R24 gi\|344171927\|emb\|CCA84553.1\| | SEQ ID NO: 382 | 140 | 176 | 37 | 395 | 440 | 50 | 395 | 440 | 50 |
| *Wolinella succinogenes* DSM 1740 gi\|34557790\|ref\|NP_907605.1\| | SEQ ID NO: 383 | 145 | 180 | 36 | 348 | 392 | 60 | 348 | 392 | 60 |
| *Mycoplasma gallisepticum* str. F gi\|284931710\|gb\|ADC31648.1\| | SEQ ID NO: 384 | 144 | 177 | 34 | 373 | 416 | 71 | 373 | 416 | 71 |
| *Acidothermus cellulolyticus* 11B gi\|117929158\|ref\|YP_873709.1\| | SEQ ID NO: 385 | 150 | 182 | 33 | 341 | 380 | 58 | 341 | 380 | 58 |
| *Mycoplasma ovipneumoniae* SC01 gi\|363542550\|ref\|ZP_09312133.1 | SEQ ID NO: 386 | 156 | 184 | 29 | 381 | 420 | 62 | 381 | 420 | 62 |

TABLE 51

Amino Acid Sequence of Cas9 Core Domains

| Strain Name | Cas9 Start (AA pos) | Cas9 Stop (AA pos) |
|---|---|---|
| Start and Stop numbers refer to the sequence in Table 50 | | |
| Staphylococcus Aureus | 1 | 772 |
| Streptococcus Pyogenes | 1 | 1099 |
| Campulobacter Jejuni | 1 | 741 |

TABLE 52

Identified PAM sequences and corresponding RKR motifs.

| Strain Name | PAM sequence (NA) | RKR motif (AA) |
|---|---|---|
| Streptococcus pyogenes | NGG | RKR |
| Streptococcus mutans | NGG | RKR |
| Streptococcus thermophilus A | NGGNG | RYR |
| Treponema denticola | NAAAAN | VAK |
| Streptococcus thermophilus B | NNAAAAW | IYK |
| Campylobacter jejuni | NNNNACA | NLK |
| Pasteurella multocida | GNNNCNNA | KDG |
| Neisseria meningitidis | NNNNGATT or | IGK |
| Staphylococcus aureus | NNGRRV (R = A or G; V = A, G or C) NNGRRT (R = A or G) | NDK |

PI domains are provided in Tables 53 and 54.

TABLE 53

Altered PI Domains

| Strain Name | PI Start (AA pos) | PI Stop (AA pos) | Length of PI (AA) | RKR motif (AA) |
|---|---|---|---|---|
| Start and Stop numbers refer to the sequences in Table 50 | | | | |
| Alicycliphilus denitrificans K601 | 837 | 1029 | 193 | --Y |
| Campylobacter jejuni NCTC 11168 | 741 | 984 | 244 | -NG |
| Helicobacter mustelae 12198 | 771 | 1024 | 254 | -NQ |

TABLE 54

Other Altered PI Domains

| Strain Name | PI Start (AA pos) | PI Stop (AA pos) | Length of PI (AA) | RKR motif (AA) |
|---|---|---|---|---|
| Start and Stop numbers refer to the sequences in Table 50 | | | | |
| Akkermansia muciniphila ATCC BAA-835 | 871 | 1101 | 231 | ALK |
| Ralstonia syzygii R24 | 821 | 1062 | 242 | APY |
| Cand. Puniceispirillum marinum IMCC1322 | 815 | 1035 | 221 | AYK |
| Fructobacillus fructosus KCTC 3544 | 1074 | 1323 | 250 | DGN |
| Eubacterium yurii ATCC 43715 | 1107 | 1391 | 285 | DGY |
| Eubacterium dolichum DSM 3991 | 779 | 1096 | 318 | DKK |
| Dinoroseobacter shibae DFL 12 | 851 | 1079 | 229 | DPI |
| Clostridium cellulolyticum H10 | 767 | 1021 | 255 | EGK |
| Pasteurella multocida str. Pm70 | 815 | 1056 | 242 | ENN |
| Mycoplasma canis PG 14 | 907 | 1233 | 327 | EPK |
| Porphyromonas sp. oral taxon 279 str. F0450 | 935 | 1197 | 263 | EPT |
| Filifactor alocis ATCC 35896 | 1094 | 1365 | 272 | EVD |
| Aminomonas paucivorans DSM 12260 | 801 | 1052 | 252 | EVY |
| Wolinella succinogenes DSM 1740 | 1034 | 1409 | 376 | EYK |
| Oenococcus kitaharae DSM 17330 | 1119 | 1389 | 271 | GAL |
| Coriobacteriumglomerans PW2 | 1126 | 1384 | 259 | GDR |
| Peptoniphilus duerdenii ATCC BAA-1640 | 1091 | 1364 | 274 | GDS |
| Bifidobacterium bifidum S17 | 1138 | 1420 | 283 | GGL |
| Alicyclobacillus hesperidum URH17-3-68 | 876 | 1146 | 271 | GGR |
| Roseburia inulinivorans DSM 16841 | 895 | 1152 | 258 | GGT |
| Actinomyces coleocanis DSM 15436 | 843 | 1105 | 263 | GKK |
| Odoribacter laneus YIT 12061 | 1103 | 1498 | 396 | GKV |
| Coprococcus catus GD-7 | 1063 | 1338 | 276 | GNQ |
| Enterococcus faecalis TX0012 | 829 | 1150 | 322 | GRK |
| Bacillus smithii 7 3 47FAA | 809 | 1088 | 280 | GSK |
| Legionella pneumophila str. Paris | 1021 | 1372 | 352 | GTM |
| Bacteroides fragilis NCTC 9343 | 1140 | 1436 | 297 | IPV |
| Mycoplasma ovipneumoniae SC01 | 923 | 1265 | 343 | IRI |
| Actinomyces sp. oral taxon 180 str. F0310 | 895 | 1181 | 287 | KEK |

TABLE 54-continued

Other Altered PI Domains

| Strain Name | PI Start (AA pos) | PI Stop (AA pos) | Length of PI (AA) | RKR motif (AA) |
|---|---|---|---|---|
| *Treponema* sp. JC4 | 832 | 1062 | 231 | KIS |
| *Fusobacterium nucleatum* ATCC49256 | 1073 | 1374 | 302 | KKV |
| *Lactobacillus farciminis* KCTC 3681 | 1101 | 1356 | 256 | KKV |
| *Nitratifractor salsuginis* DSM 16511 | 840 | 1132 | 293 | KMR |
| *Lactobacillus coryniformis* KCTC 3535 | 850 | 1119 | 270 | KNK |
| *Mycoplasma mobile* 163K | 916 | 1236 | 321 | KNY |
| *Flavobacterium branchiophilum* FL-15 | 1182 | 1473 | 292 | KQK |
| *Prevotella timonensis* CRIS 5C-B1 | 957 | 1218 | 262 | KQQ |
| *Methylosinus trichosporium* OB3b | 830 | 1082 | 253 | KRP |
| *Prevotella* sp. C561 | 1099 | 1424 | 326 | KRY |
| *Mycoplasma gallisepticum* str. F | 911 | 1269 | 359 | KTA |
| *Lactobacillus rhamnosus* GG | 1077 | 1363 | 287 | KYG |
| *Wolinella succinogenes* DSM 1740 | 811 | 1059 | 249 | LPN |
| *Streptococcus thermophilus* LMD-9 | 1099 | 1388 | 290 | MLA |
| *Treponema denticola* ATCC 35405 | 1092 | 1395 | 304 | NDS |
| *Bergeyella zoohelcum* ATCC 43767 | 1098 | 1415 | 318 | NEK |
| *Veillonella atypica* ACS-134-V-Col7a | 1107 | 1398 | 292 | NGF |
| *Neisseria meningitidis* Z2491 | 835 | 1082 | 248 | NHN |
| *Ignavibacterium album* JCM 16511 | 1296 | 1688 | 393 | NKK |
| *Ruminococcus albus* 8 | 853 | 1156 | 304 | NNF |
| *Streptococcus thermophilus* LMD-9 | 811 | 1121 | 311 | NNK |
| *Barnesiella intestinihominis* YIT 11860 | 871 | 1153 | 283 | NPV |
| *Azospirillum* sp. B510 | 911 | 1168 | 258 | PFH |
| *Rhodospirillum rubrum* ATCC 11170 | 863 | 1173 | 311 | PRG |
| *Planococcus antarcticus* DSM 14505 | 1087 | 1333 | 247 | PYY |
| *Staphylococcus pseudintermedius* ED99 | 1073 | 1334 | 262 | QIV |
| *Alcanivorax* sp. W11-5 | 843 | 1113 | 271 | RIE |
| *Bradyrhizobium* sp. BTAi1 | 811 | 1064 | 254 | RIY |
| *Streptococcus pyogenes* M1 GAS | 1099 | 1368 | 270 | RKR |
| *Streptococcus mutans* UA159 | 1078 | 1345 | 268 | RKR |
| *Streptococcus Pyogenes* | 1099 | 1368 | 270 | RKR |
| *Bacteroides* sp. 20 3 | 1147 | 1517 | 371 | RNI |
| *S. aureus* | 772 | 1053 | 282 | RNK |
| *Solobacterium moorei* F0204 | 1062 | 1327 | 266 | RSG |
| *Finegoldia magna* ATCC 29328 | 1081 | 1348 | 268 | RTE |
| uncultured *delta proteobacterium* HF0070 07E19 | 770 | 1011 | 242 | SGG |
| *Acidaminococcus* sp. D21 | 1064 | 1358 | 295 | SIG |
| *Eubacterium rectale* ATCC 33656 | 824 | 1114 | 291 | SKK |
| *Caenispirillum salinarum* AK4 | 1048 | 1442 | 395 | SLV |
| *Acidothermus cellulolyticus* 11B | 830 | 1138 | 309 | SPS |
| *Catenibacterium mitsuokai* DSM 15897 | 1068 | 1329 | 262 | SPT |
| *Parvibaculum lavamentivorans* DS-1 | 827 | 1037 | 211 | TGN |
| *Staphylococcus lugdunensis* M23590 | 772 | 1054 | 283 | TKK |
| *Streptococcus sanguinis* SK49 | 1123 | 1421 | 299 | TRM |
| *Elusimicrobium minutum* Pei191 | 910 | 1195 | 286 | TTG |
| *Nitrobacter hamburgensis* X14 | 914 | 1166 | 253 | VAY |
| *Mycoplasma synoviae* 53 | 991 | 1314 | 324 | VGF |
| *Sphaerochaeta globus* str. Buddy | 877 | 1179 | 303 | VKG |
| *Ilyobacter polytropus* DSM 2926 | 837 | 1092 | 256 | VNG |
| *Rhodovulum* sp. PH10 | 821 | 1059 | 239 | VPY |
| *Bifidobacterium longum* DJO10A | 904 | 1187 | 284 | VRK |

Amino acid sequences described in Table 50:

```
                                                          SEQ ID NO: 304
MKRNYILGLDIGITSVGYGIIDYETRDVIDAGVRLFKEANVENNEGRRSKRGARRLKRRRHRI

QRVKKLLFDYNLLTDHSELSGINPYEARVKGLSQKLSEEEFSAALLHLAKRRGVHNVNEVEEDT

GNELSTKEQISRNSKALEEKYVAELQLERLKKDGEVRGSINRFKTSDYVKEAKQLLKVQKAYHQ

LDQSFIDTYIDLLETRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVNEEDIKGYRVTSTGK

PEFTNLKVYHDIKDITARKEIIENAELLDQIAKILTIYQSSEDIQEELTNLNSELTQEEIEQIS

NLKGYTGTHNLSLKAINLILDELWHTNDNQIAIFNRLKLVPKKVDLSQQKEIPTTLVDDFILSP

VVKRSFIQSIKVINAIIKKYGLPNDIIIELAREKNSKDAQKMINEMQKRNRQTNERIEEIIRTT
```

-continued

GKENAKYLIEKIKLHDMQEGKCLYSLEAIPLEDLLNNPFNYEVDHIIPRSVSFDNSFNNKVLVK

QEENSKKGNRTPFQYLSSSDSKISYETFKKHILNLAKGKGRISKTKKEYLLEERDINRFSVQKD

FINRNLVDTRYATRGLMNLLRSYFRVNNLDVKVKSINGGFTSFLRRKWKFKKERNKGYKHHAED

ALIIANADFIFKEWKKLDKAKKVMENQMFEEKQAESMPEIETEQEYKEIFITPHQIKHIKDFKD

YKYSHRVDKKPNRELINDTLYSTRKDDKGNTLIVNNLNGLYDKDNDKLKKLINKSPEKLLMYHH

DPQTYQKLKLIMEQYGDEKNPLYKYYEETGNYLTKYSKKDNGPVIKKIKYYGNKLNAHLDITDD

YPNSRNKVVKLSLKPYRFDVYLDNGVYKFVTVKNLDVIKKENYYEVNSKCYEEAKKLKKISNQA

EFIASFYNNDLIKINGELYRVIGVNNDLLNRIEVNMIDITYREYLENMNDKRPPRIIKTIASKT

QSIKKYSTDILGNLYEVKSKKHPQIIKKG

SEQ ID NO: 305
MDKKYSIGLDIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD

SEQ ID NO: 306
MARILAFDIGISSIGWAFSENDELKDCGVRIFTKVENPKTGESLALPRRLARSARKRLARRKAR

LNHLKHLIANEFKLNYEDYQSFDESLAKAYKGSLISPYELRFRALNELLSKQDFARVILHIAKR

RGYDDIKNSDDKEKGAILKAIKQNEEKLANYQSVGEYLYKEYFQKFKENSKEFTNVRNKKESYE

RCIAQSFLKDELKLIFKKQREFGFSFSKKFEEEVLSVAFYKRALKDFSHLVGNCSFFTDEKRAP

KNSPLAFMFVALTRIINLLNNLKNTEGILYTKDDLNALLNEVLKNGTLTYKQTKKLLGLSDDYE

FKGEKGTYFIEFKKYKEFIKALGEHNLSQDDLNEIAKDITLIKDEIKLKKALAKYDLNQNQIDS

LSKLEFKDHLNISFKALKLVTPLMLEGKKYDEACNELNLKVAINEDKKDFLPAFNETYYKDEVT

NPVVLRAIKEYRKVLNALLKKYGKVHKINIELAREVGKNHSQRAKIEKEQNENYKAKKDAELEC

```
EKLGLKINSKNILKLRLFKEQKEFCAYSGEKIKISDLQDEKMLEIDHIYPYSRSFDDSYMNKVL

VFTKQNQEKLNQTPFEAFGNDSAKWQKIEVLAKNLPTKKQKRILDKNYKDKEQKNFKDRNLNDT

RYIARLVLNYTKDYLDFLPLSDDENTKLNDTQKGSKVHVEAKSGMLTSALRHTWGFSAKDRNNH

LHHAIDAVIIAYANNSIVKAFSDFKKEQESNSAELYAKKISELDYKNRKFFEPFSGFRQKVLD

KIDEIFVSKPERKKPSGALHEETFRKEEEFYQSYGGKEGVLKALELGKIRKVNGKIVKNGDMFR

VDIFKHKKTNKFYAVPIYTMDFALKVLPNKAVARSKKGEIKDWILMDENYEFCFSLYKDSLILI

QTKDMQEPEFVYYNAFTSSTVSLIVSKHDNKFETLSKNQKILFKNANEKEVIAKSIGIQNLKVF

EKYIVSALGEVTKAEFRQREDFKK
```

SEQ ID NO: 307
```
MKRILGLDLGTNSIGWALVNEAENKDERSSIVKLGVRVNPLTVDELTNFEKGKSITTNADRTLK

RGMRRNLQRYKLRRETLTEVLKEHKLITEDTILSENGNRTTFETYRLRAKAVTEEISLEEFARV

LLMINKKRGYKSSRKAKGVEEGTLIDGMDIARELYNNNLTPGELCLQLLDAGKKFLPDFYRSDL

QNELDRIWEKQKEYYPEILTDVLKEELRGKKRDAVWAICAKYFVWKENYTEWNKEKGKTEQQER

EHKLEGIYSKRKRDEAKRENLQWRVNGLKEKLSLEQLVIVFQEMNTQINNSSGYLGAISDRSKE

LYFNKQTVGQYQMEMLDKNPNASLRNMVFYRQDYLDEFNMLWEKQAVYHKELTEELKKEIRDII

IFYQRRLKSQKGLIGFCEFESRQIEVDIDGKKKIKTVGNRVISRSSPLFQEFKIWQILNNIEVT

VVGKKRKRRKLKENYSALFEELNDAEQLELNGSRRLCQEEKELLAQELFIRDKMTKSEVLKLLF

DNPQELDLNFKTIDGNKTGYALFQAYSKMIEMSGHEPVDFKKPVEKVVEYIKAVFDLLNWNTDI

LGFNSNEELDNQPYYKLWHLLYSFEGDNTPTGNGRLIQKMTELYGFEKEYATILANVSFQDDYG

SLSAKAIHKILPHLKEGNRYDVACVYAGYRHSESSLTREEIANKVLKDRLMLLPKNSLHNPVVE

KILNQMVNVINVIIDIYGKPDEIRVELARELKKNAKEREELTKSIAQTTKAHEEYKTLLQTEFG

LTNVSRTDILRYKLYKELESCGYKTLYSNTYISREKLFSKEFDIEHIIPQARLFDDSFSNKTLE

ARSVNIEKGNKTAYDFVKEKFGESGADNSLEHYLNNIEDLFKSGKISKTKYNKLKMAEQDIPDG

FIERDLRNTQYIAKKALSMLNEISHRVVATSGSVTDKLREDWQLIDVMKELNWEKYKALGLVEY

FEDRDGRQIGRIKDWTKRNDHRHHAMDALTVAFTKDVFIQYFNNKNASLDPNANEHAIKNKYFQ

NGRAIAPMPLREFRAEAKKHLENTLISIKAKNKVITGNINKTRKKGGVNKNMQQTPRGQLHLET

IYGSGKQYLTKEEKVNASFDMRKIGTVSKSAYRDALLKRLYENDNDPKKAFAGKNSLDKQPIWL

DKEQMRKVPEKVKIVTLEAIYTIRKEISPDLKVDKVIDVGVRKILIDRLNEYGNDAKKAFSNLD

KNPIWLNKEKGISIKRVTISGISNAQSLHVKKDKDGKPILDENGRNIPVDFVNTGNNHHVAVYY

RPVIDKRGQLVVDEAGNPKYELEEVVVSFFEAVTRANLGLPIIDKDYKTTEGWQFLFSMKQNEY

FVFPNEKTGFNPKEIDLLDVENYGLISPNLFRVQKFSLKNYVFRHHLETTIKDTSSILRGITWI

DFRSSKGLDTIVKVRVNHIGQIVSVGEY
```

SEQ ID NO: 308
```
MSRKNYVDDYAISLDIGNASVGWSAFTPNYRLVRAKGHELIGVRLFDPADTAESRRMARTTRRR

YSRRRWRLRLLDALFDQALSEIDPSFLARRKYSWVHPDDENNADCWYGSVLFDSNEQDKRFYEK

YPTIYHLRKALMEDDSQHDIREIYLAIHHMVKYRGNFLVEGTLESSNAFKEDELLKLLGRITRY

EMSEGEQNSDIEQDDENKLVAPANGQLADALCATRGSRSMRVDNALEALSAVNDLSREQRAIVK

AIFAGLEGNKLDLAKIFVSKEFSSENKKILGIYFNKSDYEEKCVQIVDSGLLDDEEREFLDRMQ

GQYNAIALKQLLGRSTSVSDSKCASYDAHRANWNLIKLQLRTKENEKDINENYGILVGWKIDSG

QRKSVRGESAYENMRKKANVFFKKMIETSDLSETDKNRLIHDIEEDKLFPIQRDSDNGVIPHQL

HQNELKQIIKKQGKYYPFLLDAFEKDGKQINKIEGLLTFRVPYFVGPLVVPEDLQKSDNSENHW

MVRKKKGEITPWNFDEMVDKDASGRKFIERLVGTDSYLLGEPTLPKNSLLYQEYEVLNELNNVR
```

-continued

LSVRTGNHWNDKRRMRLGREEKTLLCQRLFMKGQTVTKRTAENLLRKEYGRTYELSGLSDESKF

TSSLSTYGKMCRIFGEKYVNEHRDLMEKIVELQTVFEDKETLLHQLRQLEGISEADCALLVNTH

YTGWGRLSRKLLTTKAGECKISDDFAPRKHSIIEIMRAEDRNLMEIITDKQLGFSDWIEQENLG

AENGSSLMEVVDDLRVSPKVKRGIIQSIRLIDDISKAVGKRPSRIFLELADDIQPSGRTISRKS

RLQDLYRNANLGKEFKGIADELNACSDKDLQDDRLFLYYTQLGKDMYTGEELDLDRLSSAYDID

HIIPQAVTQNDSIDNRVLVARAENARKTDSFTYMPQIADRMRNFWQILLDNGLISRVKFERLTR

QNEFSEREKERFVQRSLVETRQIMKNVATLMRQRYGNSAAVIGLNAELTKEMHRYLGFSHKNRD

INDYHHAQDALCVGIAGQFAANRGFFADGEVSDGAQNSYNQYLRDYLRGYREKLSAEDRKQGRA

FGFIVGSMRSQDEQKRVNPRTGEVVWSEEDKDYLRKVMNYRKMLVTQKVGDDFGALYDETRYAA

TDPKGIKGIPFDGAKQDTSLYGGFSSAKPAYAVLIESKGKTRLVNVTMQEYSLLGDRPSDDELR

KVLAKKKSEYAKANILLRHVPKMQLIRYGGGLMVIKSAGELNNAQQLWLPYEEYCYFDDLSQGK

GSLEKDDLKKLLDSILGSVQCLYPWHRFTEEELADLHVAFDKLPEDEKKNVITGIVSALHADAK

TANLSIVGMTGSWRRMNNKSGYTFSDEDEFIFQSPSGLFEKRVTVGELKRKAKKEVNSKYRTNE

KRLPTLSGASQP

SEQ ID NO: 309
METQTSNQLITSHLKDYPKQDYFVGLDIGTNSVGWAVTNTSYELLKFHSHKMWGSRLFEEGESA

VTRRGFRSMRRRLERRKLRLKLLEELFADAMAQVDSTFFIRLHESKYHYEDKTTGHSSKHILFI

DEDYTDQDYFTEYPTIYHLRKDLMENGTDDIRKLFLAVHHILKYRGNFLYEGATFNSNAFTFED

VLKQALVNITFNCFDTNSAISSISNILMESGKTKSDKAKAIERLVDTYTVFDEVNTPDKPQKEQ

VKEDKKTLKAFANLVLGLSANLIDLFGSVEDIDDDLKKLQIVGDTYDEKRDELAKVWGDEIHII

DDCKSVYDAIILMSIKEPGLTISQSKVKAFDKHKEDLVILKSLLKLDRNVYNEMFKSDKKGLHN

YVHYIKQGRTEETSCSREDFYKYTKKIVEGLADSKDKEYILNEIELQTLLPLQRIKDNGVIPYQ

LHLEELKVILDKCGPKFPFLHTVSDGFSVTEKLIKMLEFRIPYYVGPLNTHHNIDNGGFSWAVR

KQAGRVTPWNFEEKIDREKSAAAFIKNLTNKCTYLFGEDVLPKSSLLYSEFMLLNELNNVRIDG

KALAQGVKQHLIDSIFKQDHKKMTKNRIELFLKDNNYITKKHKPEITGLDGEIKNDLTSYRDMV

RILGNNFDVSMAEDIITDITIFGESKKMLRQTLRNKFGSQLNDETIKKLSKLRYRDWGRLSKKL

LKGIDGCDKAGNGAPKTIIELMRNDSYNLMEILGDKFSFMECIEEENAKLAQGQVVNPHDIIDE

LALSPAVKRAVWQALRIVDEVAHIKKALPSRIFVEVARTNKSEKKKKDSRQKRLSDLYSAIKKD

DVLQSGLQDKEFGALKSGLANYDDAALRSKKLYLYYTQMGRCAYTGNIIDLNQLNTDNYDIDHI

YPRSLTKDDSFDNLVLCERTANAKKSDIYPIDNRIQTKQKPFWAFLKHQGLISERKYERLTRIA

PLTADDLSGFIARQLVETNQSVKATTTLLRRLYPDIDVVFVKAENVSDFRHNNNFIKVRSLNHH

HHAKDAYLNIVVGNVYHEKFTRNFRLFFKKNGANRTYNLAKMFNYDVICTNAQDGKAWDVKTSM

NTVKKMMASNDVRVTRRLLEQSGALADATIYKASVAAKAKDGAYIGMKTKYSVFADVTKYGGMT

KIKNAYSIIVQYTGKKGEEIKEIVPLPIYLINRNATDIELIDYVKSVIPKAKDISIKYRKLCIN

QLVKVNGFYYYLGGKTNDKIYIDNAIELVVPHDIATYIKLLDKYDLLRKENKTLKASSITTSIY

NINTSTVVSLNKVGIDVFDYFMSKLRTPLYMKMKGNKVDELSSTGRSKFIKMTLEEQSIYLLEV

LNLLTNSKTTFDVKPLGITGSRSTIGVKIHNLDEFKIINESITGLYSNEVTIV

SEQ ID NO: 310
MTKLNQPYGIGLDIGSNSIGFAVVDANSHLLRLKGETAIGARLFREGQSAADRRGSRTTRRRLS

RTRWRLSFLRDFFAPHITKIDPDFFLRQKYSEISPKDKDRFYEKRLFNDRTDAEFYEDYPSMY

HLRLHLMTHTHKADPREIFLAIHHILKSRGHFLTPGAAKDFNTDKVDLEDIFPALTEAYAQVYP

-continued

DLELTFDLAKADDFKAKLLLDEQATPSDTQKALVNLLLSSDGEKEIVKKRKQVLTEFAKAITGLK

TKFNLALGTEVDEADASNWQFSMGQLDDKWSNIETSMTDQGTEIFEQIQELYRARLLNGIVPAG

MSLSQAKVADYGQHKEDLELFKTYLKKLNDHELAKTIRGLYDRYINGDDAKPFLREDFVKALTK

EVTAHPNEVSEQLLNRMGQANFMLKQRTKANGAIPIQLQQRELDQIIANQSKYYDWLAAPNPVE

AHRWKMPYQLDELLNFHIPYYVGPLITPKQQAESGENVFAWMVRKDPSGNITPYNFDEKVDREA

SANTFIQRMKTTDTYLIGEDVLPKQSLLYQKYEVLNELNNVRINNECLGTDQKQRLIREVFERH

SSVTIKQVADNLVAHGDFARRPEIRGLADEKRFLSSLSTYHQLKEILHEAIDDPTKLLDIENII

TWSTVFEDHTIFETKLAEIEWLDPKKINELSGIRYRGWGQFSRKLLDGLKLGNGHTVIQELMLS

NHNLMQILADETLKETMTELNQDKLKTDDIEDVINDAYTSPSNKKALRQVLRVVEDIKHAANGQ

DPSWLFIETADGTGTAGKRTQSRQKQIQTVYANAAQELIDSAVRGELEDKIADKASFTDRLVLY

FMQGGRDIYTGAPLNIDQLSHYDIDHILPQSLIKDDSLDNRVLVNATINREKNNVFASTLFAGK

MKATWRKWHEAGLISGRKLRNLMLRPDEIDKFAKGFVARQLVETRQIIKLTEQIAAAQYPNTKI

IAVKAGLSHQLREELDFPKNRDVNHYHHAFDAFLAARIGTYLLKRYPKLAPFFTYGEFAKVDVK

KFREFNFIGALTHAKKNIIAKDTGEIVWDKERDIRELDRIYNFKRMLITHEVYFETADLFKQTI

YAAKDSKERGGSKQLIPKKQGYPTQVYGGYTQESGSYNALVRVAEADTTAYQVIKISAQNASKI

ASANLKSREKGKQLLNEIVVKQLAKRRKNWKPSANSFKIVIPRFGMTLFQNAKYGLFMVNSDT

YYRNYQELWLSRENQKLLKKLFSIKYEKTQMNHDALQVYKAIIDQVEKFFKLYDINQFRAKLSD

AIERFEKLPINTDGNKIGKTETLRQILIGLQANGTRSNVKNLGIKTDLGLLQVGSGIKLDKDTQ

IVYQSPSGLFKRRIPLADL

SEQ ID NO: 311
MTKEYYLGLDVGTNSVGWAVTDSQYNLCKFKKKDMWGIRLFESANTAKDRRLQRGNRRRLERKK

QRIDLLQEIFSPEICKIDPTFFIRLNESRLHLEDKSNDFKYPLFIEKDYSDIEYYKEFPTIFHL

RKHLIESEEKQDIRLIYLALHNIIKTRGHFLIDGDLQSAKQLRPILDTFLLSLQEEQNLSVSLS

ENQKDEYEEILKNRSIAKSEKVKKLKNLFEISDELEKEEKKAQSAVIENFCKFIVGNKGDVCKF

LRVSKEELEIDSFSFSEGKYEDDIVKNLEEKVPEKVYLFEQMKAMYDWNILVDILETEEYISFA

KVKQYEKHKTNLRLLRDIILKYCTKDEYNRMFNDEKEAGSYTAYVGKLKKNNKKYWIEKKRNPE

EFYKSLGKLLDKIEPLKEDLEVLTMMIEECKNHTLLPIQKNKDNGVIPHQVHEVELKKILENAK

KYYSFLTETDKDGYSVVQKIESIFRFRIPYYVGPLSTRHQEKGSNVWMVRKPGREDRIYPWNME

EIIDFEKSNENFITRMTNKCTYLIGEDVLPKHSLLYSKYMVLNELNNVKVRGKKLPTSLKQVF

EDLFENKSKVTGKNLLEYLQIQDKDIQIDDLSGFDKDFKTSLKSYLDFKKQIFGEEIEKESIQN

MIEDIIKWITIYGNDKEMLKRVIRANYSNQLTEEQMKKITGFQYSGWGNFSKMFLKGISGSDVS

TGETFDIITAMWETDNNLMQILSKKFTFMDNVEDFNSGKVGKIDKITYDSTVKEMFLSPENKRA

VWQTIQVAEEIKKVMGCEPKKIFIEMARGGEKVKKRTKSRKAQLLELYAACEEDCRELIKEIED

RDERDFNSMKLFLYYTQFGKCMYSGDDIDINELIRGNSKWDRDHIYPQSKIKDDSIDNLVLVNK

TYNAKKSNELLSEDIQKKMHSFWLSLLNKKLITKSKYDRLTRKGDFTDEELSGFIARQLVETRQ

STKAIADIFKQIYSSEVVYVKSSLVSDFRKKPLNYLKSRRVNDYHHAKDAYLNIVVGNVYNKKF

TSNPIQWMKKNRDTNYSLNKVFEHDVVINGEVIWEKCTYHEDTNTYDGGTLDRIRKIVERDNIL

YTEYAYCEKGELFNATIQNKNGNSTVSLKKGLDVKKYGGYFSANTSYFSLIEFEDKKGDRARHI

IGVPIYIANMLEHSPSAFLEYCEQKGYQNVRILVEKIKKNSLLIINGYPLRIRGENEVDTSFKR

-continued

AIQLKLDQKNYELVRNIEKFLEKYVEKKGNYPIDENRDHITHEKMNQLYEVLLSKMKKFNKKGM
ADPSDRIEKSKPKFIKLEDLIDKINVINKMLNLLRCDNDTKADLSLIELPKNAGSFVVKKNTIG
KSKIILVNQSVTGLYENRREL

SEQ ID NO: 312
MARDYSVGLDIGTSSVGWAAIDNKYHLIRAKSKNLIGVRLFDSAVTAEKRRGYRTTRRRLSRRH
WRLRLLNDIFAGPLTDFGDENFLARLKYSWVHPQDQSNQAHFAAGLLFDSKEQDKDFYRKYPTI
YHLRLALMNDDQKHDLREVYLAIHHLVKYRGHFLIEGDVKADSAFDVHTFADAIQRYAESNNSD
ENLLGKIDEKKLSAALTDKHGSKSQRAETAETAFDILDLQSKKQIQAILKSVVGNQANLMAIFG
LDSSAISKDEQKNYKFSFDDADIDEKIADSEALLSDTEFEFLCDLKAAFDGLTLKMLLGDDKTV
SAAMVRRFNEHQKDWEYIKSHIRNAKNAGNGLYEKSKKFDGINAAYLALQSDNEDDRKKAKKIF
QDEISSADIPDDVKADFLKKIDDDQFLPIQRTKNNGTIPHQLHRNELEQIIEKQGIYYPFLKDT
YQENSHELNKITALINFRVPYYVGPLVEEEQKIADDGKNIPDPTNHWMVRKSNDTITPWNLSQV
VDLDKSGRRFIERLTGTDTYLIGEPTLPKNSLLYQKFDVLQELNNIRVSGRRLDIRAKQDAFEH
LFKVQKTVSATNLKDFLVQAGYISEDTQIEGLADVNGKNFNNALTTYNYLVSVLGREFVENPSN
EELLEEITELQTVFEDKKVLRRQLDQLDGLSDHNREKLSRKHYTGWGRISKKLLTTKIVQNADK
IDNQTFDVPRMNQSIIDTLYNTKMNLMEIINNAEDDFGVRAWIDKQNTTDGDEQDVYSLIDELA
GPKEIKRGIVQSFRILDDITKAVGYAPKRVYLEFARKTQESHLTNSRKNQLSTLLKNAGLSELV
TQVSQYDAAALQNDRLYLFLQQGKDMYSGEKLNLDNLSNYDIDHIIPQAYTKDNSLDNRVLVS
NITNRRKSDSSNYLPALIDKMRPFWSVLSKQGLLSKHKFANLTRTRDFDDMEKERFIARSLVET
RQIIKNVASLIDSHFGGETKAVAIRSSLTADMRRYVDIPKNRDINDYHHAFDALLFSTVGQYTE
NSGLMKKGQLSDSAGNQYNRYIKEWIHAARLNAQSQRVNPFGFVVGSMRNAAPGKLNPETGEIT
PEENADWSIADLDYLHKVMNFRKITVTRRLKDQKGQLYDESRYPSVLHDAKSKASINFDKHKPV
DLYGGFSSAKPAYAALIKFKNKFRLVNVLRQWTYSDKNSEDYILEQIRGKYPKAEMVLSHIPYG
QLVKKDGALVTISSATELHNFEQLWLPLADYKLINTLLKTKEDNLVDILHNRLDLPEMTIESAF
YKAFDSILSFAFNRYALHQNALVKLQAHRDDFNALNYEDKQQTLERILDALHASPASSDLKKIN
LSSGFGRLFSPSHFTLADTDEFIFQSVTGLFSTQKTVAQLYQETK

SEQ ID NO: 313
MVYDVGLDIGTGSVGWVALDENGKLARAKGKNLVGVRLFDTAQTAADRRGFRTTRRRLSRRKWR
LRLLDELFSAEINEIDSSFFQRLKYSYVHPKDEENKAHYYGGYLFPTEEETKKFHRSYPTIYHL
RQELMAQPNKRFDIREIYLAIHHLVKYRGHFLSSQEKITIGSTYNPEDLANAIEVYADEKGLSW
ELNNPEQLTEIISGEAGYGLNKSMKADEALKLFEFDNNQDKVAIKTLLAGLTGNQIDFAKLFGK
DISDKDEAKLWKLKLDDEALEEKSQTILSQLTDEEIELFHAVVQAYDGFVLIGLLNGADSVSAA
MVQLYDQHREDRKLLKSLAQKAGLKHKRFSEIYEQLALATDEATIKNGISTARELVEESNLSKE
VKEDTLRRLDENEFLPKQRTKANSVIPHQLHLAELQKILQNQGQYYPFLLDTFEKEDGQDNKIE
ELLRFRIPYYVGPLVTKKDVEHAGGDADNHWVERNEGFEKSRVTPWNFDKVFNRDKAARDFIER
LTGNDTYLIGEKTLPQNSLRYQLFTVLNELNNVRVNGKKFDSKTKADLINDLFKARKTVSLSAL
KDYLKAQGKGDVTITGLADESKFNSSLSSYNDLKKTFDAEYLENEDNQETLEKIIEIQTVFEDS
KIASRELSKLPLDDDQVKKLSQTHYTGWGRLSEKLLDSKIIDERGQKVSILDKLKSTSQNFMSI
INNDKYGVQAWITEQNTGSSKLTFDEKVNELTTSPANKRGIKQSFAVLNDIKKAMKEEPRRVYL
EFAREDQTSVRSVPRYNQLKEKYQSKSLSEEAKVLKKTLDGNKNKMSDDRYFLYFQQQGKDMYT
GRPINFERLSQDYDIDHIIPQAFTKDDSLDNRVLVSRPENARKSDSFAYTDEVQKQDGSLWTSL

-continued

LKSGFINRKKYERLTKAGKYLDGQKTGFIARQLVETRQIIKNVASLIEGEYENSKAVAIRSEIT

ADMRLLVGIKKHREINSFHHAFDALLITAAGQYMQNRYPDRDSTNVYNEFDRYTNDYLKNLRQL

SSRDEVRRLKSFGFVVGTMRKGNEDWSEENTSYLRKVMMFKNILTTKKTEKDRGPLNKETIFSP

KSGKKLIPLNSKRSDTALYGGYSNVYSAYMTLVRANGKNLLIKIPISIANQIEVGNLKINDYIV

NNPAIKKFEKILISKLPLGQLVNEDGNLIYLASNEYRHNAKQLWLSTTDADKIASISENSSDEE

LLEAYDILTSENVKNRFPFFKKDIDKLSQVRDEFLDSDKRIAVIQTILRGLQIDAAYQAPVKII

SKKVSDWHKLQQSGGIKLSDNSEMIYQSATGIFETRVKISDLL

SEQ ID NO: 314
IVDYCIGLDLGTGSVGWAVVDMNHRLMKRNGKHLWGSRLFSNAETAANRRASRSIRRRYNKRRE

RIRLLRAILQDMVLEKDPTFFIRLEHTSFLDEEDKAKYLGTDYKDNYNLFIDEDFNDYTYYHKY

PTIYHLRKALCESTEKADPRLIYLALHHIVKYRGNFLYEGQKFNMDASNIEDKLSDIFTQFTSF

NNIPYEDDEKKNLEILEILKKPLSKKAKVDEVMTLIAPEKDYKSAFKELVTGIAGNKMNVTKMI

LCEPIKQGDSEIKLKFSDSNYDDQFSEVEKDLGEYVEFVDALHNVYSWVELQTIMGATHTDNAS

ISEAMVSRYNKHHDDLKLLKDCIKNNVPNKYFDMFRNDSEKSKGYYNYINRPSKAPVDEFYKYV

KKCIEKVDTPEAKQILNDIELENFLLKQNSRTNGSVPYQMQLDEMIKIIDNQAEYYPILKEKRE

QLLSILTFRIPYYFGPLNETSEHAWIKRLEGKENQRILPWNYQDIVDVDATAEGFIKRMRSYCT

YFPDEEVLPKNSLIVSKYEVYNELNKIRVDDKLLEVDVKNDIYNELFMKNKTVTEKKLKNWLVN

NQCCSKDAEIKGFQKENQFSTSLTPWIDFTNIFGKIDQSNFDLIENIIYDLTVFEDKKIMKRRL

KKKYALPDDKVKQILKLKYKDWSRLSKKLLDGIVADNRFGSSVTVLDVLEMSRLNLMEIINDKD

LGYAQMIEEATSCPEDGKFTYEEVERLAGSPALKRGIWQSLQIVEEITKVMKCRPKYIYIEFER

SEEAKERTESKIKKLENVYKDLDEQTKKEYKSVLEELKGFDNTKKISSDSLFLYFTQLGKCMYS

GKKLDIDSLDKYQIDHIVPQSLVKDDSFDNRVLVVPSENQRKLDDLVVPFDIRDKMYRFWKLLF

DHELISPKKFYSLIKTEYTERDEERFINRQLVETRQITKNVTQIIEDHYSTTKVAAIRANLSHE

FRVKNHIYKNRDINDYHHAHDAYIVALIGGFMRDRYPNMHDSKAVYSEYMKMFRKNKNDQKRWK

DGFVINSMNYPYEVDGKLIWNPDLINEIKKCFYYKDCYCTTKLDQKSGQLFNLTVLSNDAHADK

GVTKAVVPVNKNRSDVHKYGGFSGLQYTIVAIEGQKKKGKKTELVKKISGVPLHLKAASINEKI

NYIEEKEGLSDVRIIKDNIPVNQMIEMDGGEYLLTSPTEYVNARQLVLNEKQCALIADIYNAIY

KQDYDNLDDILMIQLYIELTNKMKVLYPAYRGIAEKFESMNENYVVISKEEKANIIKQMLIVMH

RGPQNGNIVYDDFKISDRIGRLKTKNHNLNNIVFISQSPTGIYTKKYKL

SEQ ID NO: 315
MKSEKKYYIGLDVGTNSVGWAVTDEFYNILRAKGKDLWGVRLFEKADTAANTRIFRSGRRRNDR

KGMRLQILREIFEDEIKKVDKDFYDRLDESKFWAEDKKVSGKYSLFNDKNFSDKQYFEKFPTIF

HLRKYLMEEHGKVDIRYYFLAINQMMKRRGHFLIDGQISHVTDDKPLKEQLILLINDLLKIELE

EELMDSIFEILADVNEKRTDKKNNLKELIKGQDFNKQEGNILNSIFESIVTGKAKIKNIISDED

ILEKIKEDNKEDFVLTGDSYEENLQYFEEVLQENITLFNTLKSTYDFLILQSILKGKSTLSDAQ

VERYDEHKKDLEILKKVIKKYDEDGKLFKQVFKEDNGNGYVSYIGYYLNKNKKITAKKKISNIE

FTKYVKGILEKQCDCEDEDVKYLLGKIEQENFLLKQISSINSVIPHQIHLFELDKILENLAKNY

PSFNNKKEEFTKIEKIRKTFTFRIPYYVGPLNDYHKNNGGNAWIFRNKGEKIRPWNFEKIVDLH

KSEEEFIKRMLNQCTYLPEETVLPKSSILYSEYMVLNELNNLRINGKPLDTDVKLKLIEELFKK

KTKVTLKSIRDYMVRNNFADKEDFDNSEKNLEIASNMKSYIDFNNILEDKFDVEMVEDLIEKIT

IHTGNKKLLKKYIEETYPDLSSSQIQKIINLKYKDWGRLSRKLLDGIKGTKKETEKTDTVINFL

RNSSDNLMQIIGSQNYSFNEYIDKLRKKYIPQEISYEVVENLYVSPSVKKMIWQVIRVTEEITK

-continued

VMGYDPDKIFIEMAKSEEEKKTTISRKNKLLDLYKAIKKDERDSQYEKLLTGLNKLDDSDLRSR

KLYLYYTQMGRDMYTGEKIDLDKLFDSTHYDKDHIIPQSMKKDDSIINNLVLVNKNANQTTKGN

IYPVPSSIRNNPKIYNYWKYLMEKEFISKEKYNRLIRNTPLTNEELGGFINRQLVETRQSTKAI

KELFEKFYQKSKIIPVKASLASDLRKDMNTLKSREVNDLHHAHDAFLNIVAGDVWNREFTSNPI

NYVKENREGDKVKYSLSKDFTRPRKSKGKVIWTPEKGRKLIVDTLNKPSVLISNESHVKKGELF

NATIAGKKDYKKGKIYLPLKKDDRLQDVSKYGGYKAINGAFFFLVEHTKSKKRIRSIELFPLHL

LSKFYEDKNTVLDYAINVLQLQDPKIIIDKINYRTEIIIDNFSYLISTKSNDGSITVKPNEQMY

WRVDEISNLKKIENKYKKDAILTEEDRKIMESYIDKIYQQFKAGKYKNRRTTDTIIEKYEIIDL

DTLDNKQLYQLLVAFISLSYKTSNNAVDFTVIGLGTECGKPRITNLPDNTYLVYKSITGIYEKR

IRIK

SEQ ID NO: 316
MKLRGIEDDYSIGLDMGTSSVGWAVTDERGTLAHFKRKPTWGSRLFREAQTAAVARMPRGQRRR

YVRRRWRLDLLQKLFEQQMEQADPDFFIRLRQSRLLRDDRAEEHADYRWPLFNDCKFTERDYYQ

RFPTIYHVRSWLMETDEQADIRLIYLALHNIVKHRGNFLREGQSLSAKSARPDEALNHLRETLR

VWSSERGFECSIADNGSILAMLTHPDLSPSDRRKKIAPLFDVKSDDAAADKKLGIALAGAVIGL

KTEFKNIFGDFPCEDSSIYLSNDEAVDAVRSACPDDCAELFDRLCEVYSAYVLQGLLSYAPGQT

ISANMVEKYRRYGEDLALLKKLVKIYAPDQYRMFFSGATYPGTGIYDAAQARGYTKYNLGPKKS

EYKPSESMQYDDFRKAVEKLFAKTDARADERYRMMMDRFDKQQFLRRLKTSDNGSIYHQLHLEE

LKAIVENQGRFYPFLKRDADKLVSLVSFRIPYYVGPLSTRNARTDQHGENRFAWSERKPGMQDE

PIFPWNWESIIDRSKSAEKFILRMTGMCTYLQQEPVLPKSSLLYEEFCVLNELNGAHWSIDGDD

EHRFDAADREGIIEELFRRKRTVSYGDVAGWMERERNQIGAHVCGGQGEKGFESKLGSYIFFCK

DVFKVERLEQSDYPMIERIILWNTLFEDRKILSQRLKEEYGSRLSAEQIKTICKKRFTGWGRLS

EKFLTGITVQVDEDSVSIMDVLREGCPVSGKRGRAMVMMEILRDEELGFQKKVDDFNRAFFAEN

AQALGVNELPGSPAVRRSLNQSIRIVDEIASIAGKAPANIFIEVTRDEDPKKKGRRTKRRYNDL

KDALEAFKKEDPELWRELCETAPNDMDERLSLYFMQRGKCLYSGRAIDIHQLSNAGIYEVDHII

PRTYVKDDSLENKALVYREENQRKTDMLLIDPEIRRRMSGYWRMLHEAKLIGDKKFRNLLRSRI

DDKALKGFIARQLVETGQMVKLVRSLLEARYPETNIISVKASISHDLRTAAELVKCREANDFHH

AHDAFLACRVGLFIQKRHPCVYENPIGLSQVVRNYVRQQADIFKRCRTIPGSSGFIVNSFMTSG

FDKETGEIFKDDWDAEAEVEGIRRSLNFRQCFISRMPFEDHGVFWDATIYSPRAKKTAALPLKQ

GLNPSRYGSFSREQFAYFFIYKARNPRKEQTLFEFAQVPVRLSAQIRQDENALERYARELAKDQ

GLEFIRIERSKILKNQLIEIDGDRLCITGKEEVRNACELAFAQDEMRVIRMLVSEKPVSRECVI

SLFNRILLHGDQASRRLSKQLKLALLSEAFSEASDNVQRNVVLGLIAIFNGSTNMVNLSDIGGS

KFAGNVRIKYKKELASPKVNVHLIDQSVTGMFERRTKIGL

SEQ ID NO: 317
MENKQYYIGLDVGTNSVGWAVTDTSYNLLRAKGKDMWGARLFEKANTAAERRTKRTSRRRSERE

KARKAMLKELFADEINRVDPSFFIRLEESKFFLDDRSENNRQRYTLFNDATFTDKDYYEKYKTI

FHLRSALINSDEKFDVRLVFLAILNLFSHRGHFLNASLKGDGDIQGMDVFYNDLVESCEYFEIE

LPRITNIDNFEKILSQKGKSRTKILEELSEELSISKKDKSKYNLIKLISGLEASVVELYNIEDI

QDENKKIKIGFRESDYEESSLKVKEIIGDEYFDLVERAKSVHDMGLLSNIIGNSKYLCEARVEA

YENHHKDLLKIKELLKKYDKKAYNDMFRKMTDKNYSAYVGSVNSNIAKERRSVDKRKIEDLYKY

IEDTALKNIPDDNKDKIEILEKIKLGEFLKKQLTASNGVIPNQLQSRELRAILKKAENYLPFLK

```
EKGEKNLTVSEMIIQLFEFQIPYYVGPLDKNPKKDNKANSWAKIKQGGRILPWNFEDKVDVKGS

RKEFIEKMVRKCTYISDEHTLPKQSLLYEKFMVLNEINNIKIDGEKISVEAKQKIYNDLFVKGK

KVSQKDIKKELISLNIMDKDSVLSGTDTVCNAYLSSIGKFTGVFKEEINKQSIVDMIEDIIFLK

TVYGDEKRFVKEEIVEKYGDEIDKDKIKRILGFKFSNWGNLSKSFLELEGADVGTGEVRSIIQS

LWETNFNLMELLSSRFTYMDELEKRVKKLEKPLSEWTIEDLDDMYLSSPVKRMIWQSMKIVDEI

QTVIGYAPKRIFVEMTRSEGEKVRTKSRKDRLKELYNGIKEDSKQWVKELDSKDESYFRSKKMY

LYYLQKGRCMYSGEVIELDKLMDDNLYDIDHIYPRSFVKDDSLDNLVLVKKEINNRKQNDPITP

QIQASCQGFWKILHDQGFMSNEKYSRLTRKTQEFSDEEKLSFINRQIVETGQATKCMAQILQKS

MGEDVDVVFSKARLVSEFRHKFELFKSRLINDFHHANDAYLNIVVGNSYFVKFTRNPANFIKDA

RKNPDNPVYKYHMDRFFERDVKSKSEVAWIGQSEGNSGTIVIVKKTMAKNSPLITKKVEEGHGS

ITKETIVGVKEIKFGRNKVEKADTKPKKPNLQAYRPIKTSDERLCNILRYGGRTSISISGYCLV

EYVKKRKTIRSLEAIPVYLGRKDSLSEEKLLNYFRYNLNDGGKDSVSDIRLCLPFISTNSLVKI

DGYLYYLGGKNDDRIQLYNAYQLKMKKEEVEYIRKIEKAVSMSKFDEIDREKNPVLTEEKNIEL

YNKIQDKFENTVFSKRMSLVKYNKKDLSFGDFLKNKKSKFEEIDLEKQCKVLYNIIFNLSNLKE

VDLSDIGGSKSTGKCRCKKNITNYKEFKLIQQSITGLYSCEKDLMTI

SEQ ID NO: 318
MKNLKEYYIGLDIGTASVGWAVTDESYNIPKFNGKKMWGVRLFDDAKTAEERRTQRGSRRRLNR

RKERINLLQDLFATEISKVDPNFFLRLDNSDLYREDKDEKLKSKYTLFNDKDFKDRDYHKKYPT

IHHLIMDLIEDEGKKDIRLLYLACHYLLKNRGHFIFEGQKFDTKNSFDKSINDLKIHLRDEYNI

DLEFNNEDLIEIITDTTLNKTNKKKELKNIVGDTKFLKAISAIMIGSSQKLVDLFEDGEFEETT

VKSVDFSTTAFDDKYSEYEEALGDTISLLNILKSIYDSSILENLLKDADKSKDGNKYISKAFVK

KFNKHGKDLKTLKRIIKKYLPSEYANIFRNKSINDNYVAYTKSNITSNKRTKASKFTKQEDFYK

FIKKHLDTIKETKLNSSENEDLKLIDEMLTDIEFKTFIPKLKSSDNGVIPYQLKLMELKKILDN

QSKYYDFLNESDEYGTVKDKVESIMEFRIPYYVGPLNPDSKYAWIKRENTKITPWNFKDIVDLD

SSREEFIDRLIGRCTYLKEEKVLPKASLIYNEFMVLNELNNLKLNEFLITEEMKKAIFEELFKT

KKKVTLKAVSNLLKKEFNLTGDILLSGTDGDFKQGLNSYIDFKNIIGDKVDRDDYRIKIEEIIK

LIVLYEDDKTYLKKKIKSAYKNDFTDDEIKKIAALNYKDWGRLSKRFLTGIEGVDKTTGEKGSI

IYFMREYNLNLMELMSGHYTFTEEVEKLNPVENRELCYEMVDELYLSPSVKRMLWQSLRVVDEI

KRIIGKDPKKIFIEMARAKEAKNSRKESRKNKLLEFYKFGKKAFINEIGEERYNYLLNEINSEE

ESKFRWDNLYLYYTQLGRCMYSLEPIDLADLKSNNIYDQDHIYPKSKIYDDSLENRVLVKKNLN

HEKGNQYPIPEKVLNKNAYGFWKILFDKGLIGQKKYTRLTRRTPFEERELAEFIERQIVETRQA

TKETANLLKNICQDSEIVYSKAENASRFRQEFDIIKCRTVNDLHHMHDAYLNIVVGNVYNTKFT

KNPLNFIKDKDNVRSYNLENMFKYDVVRGSYTAWIADDSEGNVKAATIKKVKRELEGKNYRFTR

MSYIGTGGLYDQNLMRKGKGQIPQKENTNKSNIEKYGGYNKASSAYFALIESDGKAGRERTLET

IPIMVYNQEKYGNTEAVDKYLKDNLELQDPKILKDKIKINSLIKLDGFLYNIKGKTGDSLSIAG

SVQLIVNKEEQKLIKKMDKFLVKKKDNKDIKVTSFDNIKEEELIKLYKTLSDKLNNGIYSNKRN

NQAKNISEALDKFKEISIEEKIDVLNQIILLFQSYNNGCNLKSIGLSAKTGVVFIPKKLNYKEC

KLINQSITGLFENEVDLLNL

SEQ ID NO: 319
MGKMYYLGLDIGTNSVGYAVTDPSYHLLKFKGEPMWGAHVFAAGNQSAERRSFRTSRRRLDRRQ

QRVKLVQEIFAPVISPIDPRFFIRLHESALWRDDVAETDKHIFFNDPTYTDKEYYSDYPTIHHL

IVDLMESSEKHDPRLVYLAVAWLVAHRGHFLNEVDKDNIGDVLSFDAFYPEFLAFLSDNGVSPW
```

-continued

VCESKALQATLLSRNSVNDKYKALKSLIFGSQKPEDNFDANISEDGLIQLLAGKKVKVNKLFPQ

ESNDASFTLNDKEDAIEEILGTLTPDECEWIAHIRRLFDWAIMKHALKDGRTISESKVKLYEQH

HHDLTQLKYFVKTYLAKEYDDIFRNVDSETTKNYVAYSYHVKEVKGTLPKNKATQEEFCKYVLG

KVKNIECSEADKVDFDEMIQRLTDNSFMPKQVSGENRVIPYQLYYYELKTILNKAASYLPFLTQ

CGKDAISNQDKLLSIMTFRIPYFVGPLRKDNSEHAWLERKAGKIYPWNFNDKVDLDKSEEAFIR

RMTNTCTYYPGEDVLPLDSLIYEKFMILNEINNIRIDGYPISVDVKQQVFGLFEKKRRVTVKDI

QNLLLSLGALDKHGKLTGIDTTIHSNYNTYHHFKSLMERGVLTRDDVERIVERMTYSDDTKRVR

LWLNNNYGTLTADDVKHISRLRKHDFGRLSKMFLTGLKGVHKETGERASILDFMWNTNDNLMQL

LSECYTFSDEITKLQEAYYAKAQLSLNDFLDSMYISNAVKRPIYRTLAVVNDIRKACGTAPKRI

FIEMARDGESKKKRSVTRREQIKNLYRSIRKDFQQEVDFLEKILENKSDGQLQSDALYLYFAQL

GRDMYTGDPIKLEHIKDQSFYNIDHIYPQSMVKDDSLDNKVLVQSEINGEKSSRYPLDAAIRNK

MKPLWDAYYNHGLISLKKYQRLTRSTPFTDDEKWDFINRQLVETRQSTKALAILLKRKFPDTEI

VYSKAGLSSDFRHEFGLVKSRNINDLHHAKDAFLAIVTGNVYHERFNRRWFMVNQPYSVKTKTL

FTHSIKNGNFVAWNGEEDLGRIVKMLKQNKNTIHFTRFSFDRKEGLFDIQPLKASTGLVPRKAG

LDVVKYGGYDKSTAAYYLLVRFTLEDKKTQHKLMMIPVEGLYKARIDHDKEFLTDYAQTTISEI

LQKDKQKVINIMFPMGTRHIKLNSMISIDGFYLSIGGKSSKGKSVLCHAMVPLIVPHKIECYIK

AMESFARKFKENNKLRIVEKFDKITVEDNLNLYELFLQKLQHNPYNKFFSTQFDVLTNGRSTFT

KLSPEEQVQTLLNILSIFKTCRSSGCDLKSINGSAQAARIMISADLTGLSKKYSDIRLVEQSAS

GLFVSKSQNLLEYL

SEQ ID NO: 320
MTKKEQPYNIGLDIGTSSVGWAVTNDNYDLLNIKKKNLWGVRLFEEAQTAKETRLNRSTRRRYR

RRKNRINWLNEIFSEELAKTDPSFLIRLQNSWVSKKDPDRKRDKYNLFIDGPYTDKEYYREFPT

IFHLRKELILNKDKADIRLIYLALHNILKYRGNFTYEHQKFNISNLNNNLSKELIELNQQLIKY

DISFPDDCDWNHISDILIGRGNATQKSSNILKDFTLDKETKKLLKEVINLILGNVAHLNTIFKT

SLTKDEEKLNFSGKDIESKLDDLDSILDDDQFTVLDAANRIYSTITLNEILNGESYFSMAKVNQ

YENHAIDLCKLRDMWHTTKNEEAVEQSRQAYDDYINKPKYGTKELYTSLKKFLKVALPTNLAKE

AEEKISKGTYLVKPRNSENGVVPYQLNKIEMEKIIDNQSQYYPFLKENKEKLLSILSFRIPYYV

GPLQSAEKNPFAWMERKSNGHARPWNFDEIVDREKSSNKFIRRMTVTDSYLVGEPVLPKNSLIY

QRYEVLNELNNIRITENLKTNPIGSRLTVETKQRIYNELFKKYKKVTVKKLTKWLIAQGYYKNP

ILIGLSQKDEFNSTLTTYLDMKKIFGSSFMEDNKNYDQIEELIEWLTIFEDKQILNEKLHSSKY

SYTPDQIKKISNMRYKGWGRLSKKILMDITTETNTPQLLQLSNYSILDLMWATNNNFISIMSND

KYDFKNYIENHNLNKNEDQNISDLVNDIHVSPALKRGITQSIKIVQEIVKFMGHAPKHIFIEVT

RETKKSEITTSREKRIKRLQSKLLNKANDFKPQLREYLVPNKKIQEELKKHKNDLSSERIMLYF

LQNGKSLYSEESLNINKLSDYQVDHILPRTYIPDDSLENKALVLAKENQRKADDLLLNSNVIDR

NLERWTYMLNNNMIGLKKFKNLTRRVITDKDKLGFIHRQLVQTSQMVKGVANILDNMYKNQGTT

CIQARANLSTAFRKALSGQDDTYHFKHPELVKNRNVNDFHHAQDAYLASFLGTYRLRRFPTNEM

LLMNGEYNKFYGQVKELYSKKKKLPDSRKNGFIISPLVNGTTQYDRNTGEIIWNVGFRDKILKI

FNYHQCNVTRKTEIKTGQFYDQTIYSPKNPKYKKLIAQKKDMDPNIYGGFSGDNKSSITIVKID

NNKIKPVAIPIRLINDLKDKKTLQNWLEENVKHKKSIQIIKNNVPIGQIIYSKKVGLLSLNSDR

-continued

EVANRQQLILPPEHSALLRLLQIPDEDLDQILAFYDKNILVEILQELITKMKKFYPFYKGEREF

LIANIENFNQATTSEKVNSLEELITLLHANSTSAHLIFNNIEKKAFGRKTHGLTLNNTDFIYQS

VTGLYETRIHIE

SEQ ID NO: 321

MTKFNKNYSIGLDIGVSSVGYAVVTEDYRVPAFKFKVLGNTEKEKIKKNLIGSTTFVSAQPAKG

TRVFRVNRRRIDRRNHRITYLRDIFQKEIEKVDKNFYRRLDESFRVLGDKSEDLQIKQPFFGDK

ELETAYHKKYPTIYHLRKHLADADKNSPVADIREVYMAISHILKYRGHFLTLDKINPNNINMQN

SWIDFIESCQEVFDLEISDESKNIADIFKSSENRQEKVKKILPYFQQELLKKDKSIFKQLLQLL

FGLKTKFKDCFELEEEPDLNFSKENYDENLENFLGSLEEDFSDVFAKLKVLRDTILLSGMLTYT

GATHARFSATMVERYEEHRKDLQRFKFFIKQNLSEQDYLDIFGRKTQNGFDVDKETKGYVGYIT

NKMVLTNPQKQKTIQQNFYDYISGKITGIEGAEYFLNKISDGTFLRKLRTSDNGAIPNQIHAYE

LEKIIERQGKDYPFLLENKDKLLSILTFKIPYYVGPLAKGSNSRFAWIKRATSSDILDDNDEDT

RNGKIRPWNYQKLINMDETRDAFITNLIGNDIILLNEKVLPKRSLIYEEVMLQNELTRVKYKDK

YGKAHFFDSELRQNIINGLFKNNSKRVNAKSLIKYLSDNHKDLNAIEIVSGVEKGKSFNSTLKT

YNDLKTIFSEELLDSEIYQKELEEIIKVITVFDDKKSIKNYLTKFFGHLEILDEEKINQLSKLR

YSGWGRYSAKLLLDIRDEDTGFNLLQFLRNDEENRNLTKLISDNTLSFEPKIKDIQSKSTIEDD

IFDEIKKLAGSPAIKRGILNSIKIVDELVQIIGYPPHNIVIEMARENMTTEEGQKKAKTRKTKL

ESALKNIENSLLENGKVPHSDEQLQSEKLYLYYLQNGKDMYTLDKTGSPAPLYLDQLDQYEVDH

IIPYSFLPIDSIDNKVLTHRENNQQKLNNIPDKETVANMKPFWEKLYNAKLISQTKYQRLTTSE

RTPDGVLTESMKAGFIERQLVETRQIIKHVARILDNRFSDTKIITLKSQLITNFRNTFHIAKIR

ELNDYHHAHDAYLAVVVGQTLLKVYPKLAPELIYGHHAHFNRHEENKATLRKHLYSNIMRFFNN

PDSKVSKDIWDCNRDLPIIKDVIYNSQINFVKRTMIKKGAFYNQNPVGKFNKQLAANNRYPLKT

KALCLDTSIYGGYGPMNSALSIIIIAERFNEKKGKIETVKEFHDIFIIDYEKFNNNPFQFLNDT

SENGFLKKNNINRVLGFYRIPKYSLMQKIDGTRMLFESKSNLHKATQFKLTKTQNELFFHMKRL

LTKSNLMDLKSKSAIKESQNFILKHKEEFDNISNQLSAFSQKMLGNTTSLKNLIKGYNERKIKE

IDIRDETIKYFYDNFIKMFSFVKSGAPKDINDFFDNKCTVARMRPKPDKKLLNATLIHQSITGL

YETRIDLSKLGED

SEQ ID NO: 322

MKQEYFLGLDMGTGSLGWAVTDSTYQVMRKHGKALWGTRLFESASTAEERRMFRTARRRLDRRN

WRIQVLQEIFSEEISKVDPGFFLRMKESKYYPEDKRDAEGNCPELPYALFVDDNYTDKNYHKDY

PTIYHLRKMLMETTEIPDIRLVYLVLHHMMKHRGHFLLSGDISQIKEFKSTFEQLIQNIQDEEL

EWHISLDDAAIQFVEHVLKDRNLTRSTKKSRLIKQLNAKSACEKAILNLLSGGTVKLSDIFNNK

ELDESERPKVSFADSGYDDYIGIVEAELAEQYYIIASAKAVYDWSVLVEILGNSVSISEAKIKV

YQKHQADLKTLKKIVRQYMTKEDYKRVFVDTEEKLNNYSAYIGMTKKNGKKVDLSKQCTQADF

YDFLKKNVIKVIDHKEITQEIESEIEKENFLPKQVTKDNGVIPYQVHDYELKKILDNLGTRMPF

IKENAEKIQQLFEFRIPYYVGPLNRVDDGKDGKFTWSVRKSDARIYPWNFTEVIDVEASAEKFI

RRMTNKCTYLVGEDVLPKDSLVYSKFMVLNELNNLRLNGEKISVELKQRIYEELFCKYRKVTRK

KLERYLVIEGIAKKGVEITGIDGDFKASLTAYHDFKERLTDVQLSQRAKEAIVLNVVLFGDDKK

LLKQRLSKMYPNLTTGQLKGICSLSYQGWGRLSKTFLEEITVPAPGTGEVWNIMTALWQTNDNL

MQLLSRNYGFTNEVEEFNTLKKETDLSYKTVDELYVSPAVKRQIWQTLKVVKEIQKVMGNAPKR

VFVEMAREKQEGKRSDSRKKQLVELYRACKNEERDWITELNAQSDQQLRSDKLFLYYIQKGRCM

-continued

YSGETIQLDELWDNTKYDIDHIYPQSKTMDDSLNNRVLVKKNYNAIKSDTYPLSLDIQKKMMSF

WKMLQQQGFITKEKYVRLVRSDELSADELAGFIERQIVETRQSTKAVATILKEALPDTEIVYVK

AGNVSNFRQTYELLKVREMNDLHHAKDAYLNIVVGNAYFVKFTKNAAWFIRNNPGRSYNLKRMF

EFDIERSGEIAWKAGNKGSIVTVKKVMQKNNILVTRKAYEVKGGLFDQQIMKKGKGQVPIKGND

ERLADIEKYGGYNKAAGTYFMLVKSLDKKGKEIRTIEFVPLYLKNQIEINHESAIQYLAQERGL

NSPEILLSKIKIDTLFKVDGFKMWLSGRTGNQLIFKGANQLILSHQEAAILKGVVKYVNRKNEN

KDAKLSERDGMTEEKLLQLYDTFLDKLSNTVYSIRLSAQIKTLTEKRAKFIGLSNEDQCIVLNE

ILHMFQCQSGSANLKLIGGPGSAGILVMNNNITACKQISVINQSPTGIYEKEIDLIKL

SEQ ID NO: 323

MKKPYSIGLDIGTNSVGWAVVTDDYKVPAKKMKVLGNTDKSHIEKNLLGALLFDSGNTAEDRRL

KRTARRRYTRRRNRILYLQEIFSEEMGKVDDSFFHRLEDSFLVTEDKRGERHPIFGNLEEEVKY

HENFPTIYHLRQYLADNPEKVDLRLVYLALAHIIKFRGHFLIEGKFDTRNNDVQRLFQEFLAVY

DNTFENSSLQEQNVQVEEILTDKISKSAKKDRVLKLFPNEKSNGRFAEFLKLIVGNQADFKKHF

ELEEKAPLQFSKDTYEEELEVLLAQIGDNYAELFLSAKKLYDSILLSGILTVTDVGTKAPLSAS

MIQRYNEHQMDLAQLKQFIRQKLSDKYNEVFSDVSKDGYAGYIDGKTNQEAFYKYLKGLLNKIE

GSGYFLDKIEREDFLRKQRTFDNGSIPHQIHLQEMRAIIRRQAEFYPFLADNQDRIEKLLTFRI

PYYVGPLARGKSDFAWLSRKSADKITPWNFDEIVDKESSAEAFINRMTNYDLYLPNQKVLPKHS

LLYEKFTVYNELTKVKYKTEQGKTAFFDANMKQEIFDGVFKVYRKVTKDKLMDFLEKEFDEFRI

VDLTGLDKENKVFNASYGTYHDLCKILDKDFLDNSKNEKILEDIVLTLTLFEDREMIRKRLENY

SDLLTKEQVKKLERRHYTGWGRLSAELIHGIRNKESRKTILDYLIDDGNSNRNFMQLINDDALS

FKEEIAKAQVIGETDNLNQVVSDIAGSPAIKKGILQSLKIVDELVKIMGHQPENIVVEMARENQ

FTNQGRRNSQQRLKGLTDSIKEFGSQILKEHPVENSQLQNDRLFLYYLQNGRDMYTGEELDIDY

LSQYDIDHIIPQAFIKDNSIDNRVLTSSKENRGKSDDVPSKDVVRKMKSYWSKLLSAKLITQRK

FDNLTKAERGGLTDDDKAGFIKRQLVETRQITKHVARILDERFNTETDENNKKIRQVKIVTLKS

NLVSNFRKEFELYKVREINDYHHAHDAYLNAVIGKALLGVYPQLEPEFVYGDYPHFHGHKENKA

TAKKFFYSNIMNFFKKDDVRTDKNGEIIWKKDEHISNIKKVLSYPQVNIVKKVEEQTGGFSKES

ILPKGNSDKLIPRKTKKFYWDTKKYGGFDSPIVAYSILVIADIEKGKSKKLKTVKALVGVTIME

KMTFERDPVAFLERKGYRNVQEENIIKLPKYSLFKLENGRKRLLASARELQKGNEIVLPNHLGT

LLYHAKNIHKVDEPKHLDYVDKHKDEFKELLDVVSNFSKKYTLAEGNLEKIKELYAQNNGEDLK

ELASSFINLLTFTAIGAPATFKFFDKNIDRKRYTSTTEILNATLIHQSITGLYETRIDLNKLGG

D

SEQ ID NO: 324

MDKKYSIGLDIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

-continued

HLFDDKVMKQLKRRRYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRHKPENIVIEMARENQ
TTQKGQKNSRERMKRIEEGIKELGSQILKEHPVENTQLQNEKLYLYYLQNGRDMYVDQELDINR
LSDYDVDHIVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVYDVRKMIAK
SEQEIGKATAKYFFYSNIMNFFKTEITLANGEIRKRPLIETNGETGEIVWDKGRDFATVRKVLS
MPQVNIVKKTEVQTGGFSKESILPKRNSDKLIARKKDWDPKKYGGFDSPTVAYSVLVVAKVEKG
KSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRV
ILADANLDKVLSAYNKHRDKPIREQAENIIHLFTLTNLGAPAAFKYFDTTIDRKRYTSTKEVLD
ATLIHQSITGLYETRIDLSQLGGD

SEQ ID NO: 325
MTKPYSIGLDIGTNSVGWAVTTDNYKVPSKKMKVLGNTSKKYIKKNLLGVLLFDSGITAEGRRL
KRTARRRYTRRRNRILYLQEIFSTEMATLDDAFFQRLDDSFLVPDDKRDSKYPIFGNLVEEKAY
HDEFPTIYHLRKYLADSTKKADLRLVYLALAHMIKYRGHFLIEGEFNSKNNDIQKNFQDFLDTY
NAIFESDLSLENSKQLEEIVKDKISKLEKKDRILKLFPGEKNSGIFSEFLKLIVGNQADFRKCF
NLDEKASLHFSKESYDEDLETLLGYIGDDYSDVFLKAKKLYDAILLSGFLTVTDNETEAPLSSA
MIKRYNEHKEDLALLKEYIRNISLKTYNEVFKDDTKNGYAGYIDGKTNQEDFYVYLKKLLAEFE
GADYFLEKIDREDFLRKQRTFDNGSIPYQIHLQEMRAILDKQAKFYPFLAKNKERIEKILTFRI
PYYVGPLARGNSDFAWSIRKRNEKITPWNFEDVIDKESSAEAFINRMTSFDLYLPEEKVLPKHS
LLYETFNVYNELTKVRFIAESMRDYQFLDSKQKKDIVRLYFKDKRKVTDKDIIEYLHAIYGYDG
IELKGIEKQFNSSLSTYHDLLNIINDKEFLDDSSNEAIIEEIIHTLTIFEDREMIKQRLSKFEN
IFDKSVLKKLSRRHYTGWGKLSAKLINGIRDEKSGNTILDYLIDDGISNRNFMQLIHDDALSFK
KKIQKAQIIGDEDKGNIKEVVKSLPGSPAIKKGILQSIKIVDELVKVMGGRKPESIVVEMAREN
QYTNQGKSNSQQRLKRLEKSLKELGSKILKENIPAKLSKIDNNALQNDRLYLYYLQNGKDMYTG
DDLDIDRLSNYDIDHIIPQAFLKDNSIDNKVLVSSASNRGKSDDVPSLEVVKKRKTFWYQLLKS
KLISQRKFDNLTKAERGGLSPEDKAGFIQRQLVETRQITKHVARLLDEKFNNKKDENNRAVRTV
KIITLKSTLVSQFRKDFELYKVREINDFHHAHDAYLNAVVASALLKKYPKLEPEFVYGDYPKYN
SFRERKSATEKVYFYSNIMNIFKKSISLADGRVIERPLIEVNEETGESVWNKESDLATVRRVLS
YPQVNVVKKVEEQNHGLDRGKPKGLFNANLSSKPKPNSNENLVGAKEYLDPKKYGGYAGISNSF
TVLVKGTIEKGAKKKITNVLEFQGISILDRINYRKDKLNFLLEKGYKDIELIIELPKYSLFELS
DGSRRMLASILSTNNKRGEIHKGNQIFLSQKFVKLLYHAKRISNTINENHRKYVENHKKEFEEL
FYYILEFNENYVGAKKNGKLLNSAFQSWQNHSIDELCSSFIGPTGSERKGLFELTSRGSAADFE
FLGVKIPRYRDYTPSSLLKDATLIHQSVTGLYETRIDLAKLGEG

SEQ ID NO: 326
MKKQKFSDYYLGFDIGTNSVGWCVTDLDYNVLRFNKKDMWGSRLFDEAKTAAERRVQRNSRRRL
KRRKWRLNLLEEIFSDEIMKIDSNFFRRLKESSLWLEDKNSKEKFTLFNDDNYKDYDFYKQYPT
IFHLRDELIKNPEKKDIRLIYLALHSIFKSRGHFLFEGQNLKEIKNFETLYNNLISFLEDNGIN
KSIDKDNIEKLEKIICDSGKGLKDKEKEFKGIFNSDKQLVAIFKLSVGSSVSLNDLFDTDEYKK
EEVEKEKISFREQIYEDDKPIYYSILGEKIELLDIAKSFYDFMVLNNILSDSNYISEAKVKLYE

-continued

EHKKDLKNLKYIIRKYNKENYDKLFKDKNENNYPAYIGLNKEKDKKEVVEKSRLKIDDLIKVTK

GYLPKPERIEEKDKTIFNEILNKIELKTILPKQRISDNGTLPYQIHEVELEKILENQSKYYDFL

NYEENGVSTKDKLLKTFKFRIPYYVGPLNSYHKDKGGNSWIVRKEEGKILPWNFEQKVDIEKSA

EEFIKRMTNKCTYLNGEDVIPKDSFLYSEYIILNELNKVQVNDEFLNEENKRKIIDELFKENKK

VSEKKFKEYLLVNQIANRTVELKGIKDSFNSNYVSYIKFKDIFGEKLNLDIYKEISEKSILWKC

LYGDDKKIFEKKIKNEYGDILNKDEIKKINSFKFNTWGRLSEKLLTGIEFINLETGECYSSVME

ALRRTNYNLMELLSSKFTLQESIDNENKEMNEVSYRDLIEESYVSPSLKRAILQTLKIYEEIKK

ITGRVPKKVFIEMARGGDESMKNKKIPARQEQLKKLYDSCGNDIANFSIDIKEMKNSLSSYDNN

SLRQKKLYLYYLQFGKCMYTGREIDLDRLLQNNDTYDIDHIYPRSKVIKDDSFDNLVLVLKNEN

AEKSNEYPVKKEIQEKMKSFWRFLKEKNFISDEKYKRLTGKDDFELRGFMARQLVNVRQTTKEV

GKILQQIEPEIKIVYSKAEIASSFREMFDFIKVRELNDTHHAKDAYLNIVAGNVYNTKFTEKPY

RYLQEIKENYDVKKIYNYDIKNAWDKENSLEIVKKNMEKNTVNITRFIKEEKGELFNLNPIKKG

ETSNEIISIKPKLYDGKDNKLNEKYGYYTSLKAAYFIYVEHEKKNKKVKTFERITRIDSTLIKN

EKNLIKYLVSQKKLLNPKIIKKIYKEQTLIIDSYPYTFTGVDSNKKVELKNKKQLYLEKKYEQI

LKNALKFVEDNQGETEENYKFIYLKKRNNNEKNETIDAVKERYNIEFNEMYDKFLEKLSSKDYK

NYINNKLYTNFLNSKEKFKKLKLWEKSLILREFLKIFNKNTYGKYEIKDSQTKEKLFSFPEDTG

RIRLGQSSLGNNKELLEESVTGLFVKKIKL

SEQ ID NO: 327
MKNYTIGLDIGVASVGWVCIDENYKILNYNNRHAFGVHEFESAESAAGRRLKRGMRRRYNRRKK

RLQLLQSLFDSYITDSGFFSKTDSQHFWKNNNEFENRSLTEVLSSLRISSRKYPTIYHLRSDLI

ESNKKMDLRLVYLALHNLVKYRGHFLQEGNWSEAASAEGMDDQLLELVTRYAELENLSPLDLSE

SQWKAAETLLLNRNLTKTDQSKELTAMFGKEYEPFCKLVAGLGVSLHQLFPSSEQALAYKETKT

KVQLSNENVEEVMELLLEEESALLEAVQPFYQQVVLYELLKGETYVAKAKVSAFKQYQKDMASL

KNLLDKTFGEKVYRSYFISDKNSQREYQKSHKVEVLCKLDQFNKEAKFAETFYKDLKKLLEDKS

KTSIGTTEKDEMLRIIKAIDSNQFLQKQKGIQNAAIPHQNSLYEAEKILRNQQAHYPFITTEWI

EKVKQILAFRIPYYIGPLVKDTTQSPFSWVERKGDAPITPWNFDEQIDKAASAEAFISRMRKTC

TYLKGQEVLPKSSLTYERFEVLNELNGIQLRTTGAESDFRHRLSYEMKCWIIDNVFKQYKTVST

KRLLQELKKSPYADELYDEHTGEIKEVFGTQKENAFATSLSGYISMKSILGAVVDDNPAMTEEL

IYWIAVFEDREILHLKIQEKYPSITDVQRQKLALVKLPGWGRFSRLLIDGLPLDEQGQSVLDHM

EQYSSVFMEVLKNKGFGLEKKIQKMNQHQVDGTKKIRYEDIEELAGSPALKRGIWRSVKIVEEL

VSIFGEPANIVLEVAREDGEKKRTKSRKDQWEELTKTTLKNDPDLKSFIGEIKSQGDQRFNEQR

FWLYVTQQGKCLYTGKALDIQNLSMYEVDHILPQNFVKDDSLDNLALVMPEANQRKNQVGQNKM

PLEIIEANQQYAMRTLWERLHELKLISSGKLGRLKKPSFDEVDKDKFIARQLVETRQIIKHVRD

LLDERFSKSDIHLVKAGIVSKFRRFSEIPKIRDYNNKHHAMDALFAAALIQSILGKYGKNFLAF

DLSKKDRQKQWRSVKGSNKEFFLFKNFGNLRLQSPVTGEEVSGVEYMKHVYFELPWQTTKMTQT

GDGMFYKESIFSPKVKQAKYVSPKTEKFVHDEVKNHSICLVEFTFMKKEKEVQETKFIDLKVIE

HHQFLKEPESQLAKFLAEKETNSPIIHARIIRTIPKYQKIWIEHFPYYFISTRELHNARQFEIS

YELMEKVKQLSERSSVEELKIVFGLLIDQMNDNYPIYTKSSIQDRVQKFVDTQLYDFKSFEIGF

EELKKAVAANAQRSDTFGSRISKKPKPEEVAIGYESITGLKYRKPRSVVGTKR

SEQ ID NO: 328
MKKEIKDYFLGLDVGTGSVGWAVTDTDYKLLKANRKDLWGMRCFETAETAEVRRLHRGARRRIE

RRKKRIKLLQELFSQEIAKTDEGFFQRMKESPFYAEDKTILQENTLFNDKDFADKTYHKAYPTI

-continued

NHLIKAWIENKVKPDPRLLYLACHNIIKKRGHFLFEGDFDSENQFDTSIQALFEYLREDMEVDI
DADSQKVKEILKDSSLKNSEKQSRLNKILGLKPSDKQKKAITNLISGNKINFADLYDNPDLKDA
EKNSISFSKDDFDALSDDLASILGDSFELLLKAKAVYNCSVLSKVIGDEQYLSFAKVKIYEKHK
TDLTKLKNVIKKHFPKDYKKVFGYNKNEKNNNNYSGYVGVCKTKSKKLIINNSVNQEDFYKFLK
TILSAKSEIKEVNDILTEIETGTFLPKQISKSNAEIPYQLRKMELEKILSNAEKHFSFLKQKDE
KGLSHSEKIIMLLTFKIPYYIGPINDNHKKFFPDRCWVVKKEKSPSGKTTPWNFFDHIDKEKTA
EAFITSRTNFCTYLVGESVLPKSSLLYSEYTVLNEINNLQIIIDGKNICDIKLKQKIYEDLFKK
YKKITQKQISTFIKHEGICNKTDEVIILGIDKECTSSLKSYIELKNIFGKQVDEISTKNMLEEI
IRWATIYDEGEGKTILKTKIKAEYGKYCSDEQIKKILNLKFSGWGRLSRKFLETVTSEMPGFSE
PVNIITAMRETQNNLMELLSSEFTFTENIKKINSGFEDAEKQFSYDGLVKPLFLSPSVKKMLWQ
TLKLVKEISHITQAPPKKIFIEMAKGAELEPARTKTRLKILQDLYNNCKNDADAFSSEIKDLSG
KIENEDNLRLRSDKLYLYYTQLGKCMYCGKPIEIGHVFDTSNYDIDHIYPQSKIKDDSISNRVL
VCSSCNKNKEDKYPLKSEIQSKQRGFWNFLQRNNFISLEKLNRLTRATPISDDETAKFIARQLV
ETRQATKVAAKVLEKMFPETKIVYSKAETVSMFRNKFDIVKCREINDFHHAHDAYLNIVVGNVY
NTKFTNNPWNFIKEKRDNPKIADTYNYYKVFDYDVKRNNITAWEKGKTIITVKDMLKRNTPIYT
RQAACKKGELFNQTIMKKGLGQHPLKKEGPFSNISKYGGYNKVSAAYYTLIEYEEKGNKIRSLE
TIPLYLVKDIQKDQDVLKSYLTDLLGKKEFKILVPKIKINSLLKINGFPCHITGKTNDSFLLRP
AVQFCCSNNEVLYFKKIIRFSEIRSQREKIGKTISPYEDLSFRSYIKENLWKKTKNDEIGEKEF
YDLLQKKNLEIYDMLLTKHKDTIYKKRPNSATIDILVKGKEKFKSLIIENQFEVILEILKLFSA
TRNVSDLQHIGGSKYSGVAKIGNKISSLDNCILIYQSITGIFEKRIDLLKV

SEQ ID NO: 329
MEGQMKNNGNNLQQGNYYLGLDVGTSSVGWAVTDTDYNVLKFRGKSMWGARLFDEASTAEERRT
HRGNRRRLARRKYRLLLLEQLFEKEIRKIDDNFFVRLHESNLWADDKSKPSKFLLFNDTNFTDK
DYLKKYPTIYHLRSDLIHNSTEHDIRLVFLALHHLIKYRGHFIYDNSANGDVKTLDEAVSDFEE
YLNENDIEFNIENKKEFINVLSDKHLTKKEKKISLKKLYGDITDSENINISVLIEMLSGSSISL
SNLFKDIEFDGKQNLSLDSDIEETLNDVVDILGDNIDLLIHAKEVYDIAVLTSSLGKHKYLCDA
KVELFEKNKKDLMILKKYIKKNHPEDYKKIFSSPTEKKNYAAYSQTNSKNVCSQEEFCLFIKPY
IRDMVKSENEDEVRIAKEVEDKSFLTKLKGTNNSVVPYQIHERELNQILKNIVAYLPFMNDEQE
DISVVDKIKLIFKFKIPYYVGPLNTKSTRSWVYRSDEKIYPWNFSNVIDLDKTAHEFMNRLIGR
CTYTNDPVLPMDSLLYSKYNVLNEINPIKVNGKAIPVEVKQAIYTDLFENSKKKVTRKSIYIYL
LKNGYIEKEDIVSGIDIEIKSKLKSHHDFTQIVQENKCTPEEIERIIKGILVYSDDKSMLRRWL
KNNIKGLSENDVKYLAKLNYKEWGRLSKTLLTDIYTINPEDGEACSILDIMWNTNATLMEILSN
EKYQFKQNIENYKAENYDEKQNLHEELDDMYISPAARRSIWQALRIVDEIVDIKKSAPKKIFIE
MAREKKSAMKKKRTESRKDTLLELYKSCKSQADGFYDEELFEKLSNESNSRLRRDQLYLYYTQM
GRSMYTGKRIDFDKLINDKNTYDIDHIYPRSKIKDDSITNRVLVEKDINGEKTDIYPISEDIRQ
KMQPFWKILKEKGLINEEKYKRLTRNYELTDEELSSFVARQLVETQQSTKALATLLKKEYPSAK
IVYSKAGNVSEFRNRKDKELPKFREINDLHHAKDAYLNIVVGNVYDTKFTEKFFNNIRNENYSL
KRVFDFSVPGAWDAKGSTFNTIKKYMAKNNPIIAFAPYEVKGELFDQQIVPKGKGQFPIKQGKD
IEKYGGYNKLSSAFLFAVEYKGKKARERSLETVYIKDVELYLQDPIKYCESVLGLKEPQIIKPK
ILMGSLFSINNKKLVVTGRSGKQYVCHHIYQLSINDEDSQYLKNIAKYLQEEPDGNIERQNILN

-continued

ITSVNNIKLFDVLCTKFNSNTYEIILNSLKNDVNEGREKFSELDILEQCNILLQLLKAFKCNRE
SSNLEKLNNKKQAGVIVIPHLFTKCSVFKVIHQSITGLFEKEMDLLK

SEQ ID NO: 330
MGRKPYILSLDIGTGSVGYACMDKGFNVLKYHDKDALGVYLFDGALTAQERRQFRTSRRRKNRR
IKRLGLLQELLAPLVQNPNFYQFQRQFAWKNDNMDFKNKSLSEVLSFLGYESKKYPTIYHLQEA
LLLKDEKFDPELIYMALYHLVKYRGHFLFDHLKIENLTNNDNMHDFVELIETYENLNNIKLNLD
YEKTKVIYEILKDNEMTKNDRAKRVKNMEKKLEQFSIMLLGLKFNEGKLFNHADNAEELKGANQ
SHTFADNYEENLTPFLTVEQSEFIERANKIYLSLTLQDILKGKKSMAMSKVAAYDKFRNELKQV
KDIVYKADSTRTQFKKIFVSSKKSLKQYDATPNDQTFSSLCLFDQYLIRPKKQYSLLIKELKKI
IPQDSELYFEAENDTLLKVLNTTDNASIPMQINLYEAETILRNQQKYHAEITDEMIEKVLSLIQ
FRIPYYVGPLVNDHTASKFGWMERKSNESIKPWNFDEVVDRSKSATQFIRRMTNKCSYLINEDV
LPKNSLLYQEMEVLNELNATQIRLQTDPKNRKYRMMPQIKLFAVEHIFKKYKTVSHSKFLEIML
NSNHRENFMNHGEKLSIFGTQDDKKFASKLSSYQDMTKIFGDIEGKRAQIEEIIQWITIFEDKK
ILVQKLKECYPELTSKQINQLKKLNYSGWGRLSEKLLTHAYQGHSIIELLRHSDENFMEILTND
VYGFQNFIKEENQVQSNKIQHQDIANLTTSPALKKGIWSTIKLVRELTSIFGEPEKIIMEFATE
DQQKGKKQKSRKQLWDDNIKKNKLKSVDEYKYIIDVANKLNNEQLQQEKLWLYLSQNGKCMYSG
QSIDLDALLSPNATKHYEVDHIFPRSFIKDDSIDNKVLVIKKMNQTKGDQVPLQFIQQPYERIA
YWKSLNKAGLISDSKLHKLMKPEFTAMDKEGFIQRQLVETRQISVHVRDFLKEEYPNTKVIPMK
AKMVSEFRKKFDIPKIRQMNDAHHAIDAYLNGVVYHGAQLAYPNVDLFDFNFKWEKVREKWKAL
GEFNTKQKSRELFFFKKLEKMEVSQGERLISKIKLDMNHFKINYSRKLANIPQQFYNQTAVSPK
TAELKYESNKSNEVVYKGLTPYQTYVVAIKSVNKKGKEKMEYQMIDHYVFDFYKFQNGNEKELA
LYLAQRENKDEVLDAQIVYSLNKGDLLYINNHPCYFVSRKEVINAKQFELTVEQQLSLYNVMNN
KETNVEKLLIEYDFIAEKVINEYHHYLNSKLKEKRVRTFFSESNQTHEDFIKALDELFKVVTAS
ATRSDKIGSRKNSMTHRAFLGKGKDVKIAYTSISGLKTTKPKSLFKLAESRNEL

SEQ ID NO: 331
MAKILGLDLGTNSIGWAVVERENIDFSLIDKGVRIFSEGVKSEKGIESSRAAERTGYRSARKIK
YRRKLRKYETLKVLSLNRMCPLSIEEVEEWKKSGFKDYPLNPEFLKWLSTDEESNVNPYFFRDR
ASKHKVSLFELGRAFYHIAQRRGFLSNRLDQSAEGILEEHCPKIEAIVEDLISIDEISTNITDY
FFETGILDSNEKNGYAKDLDEGDKKLVSLYKSLLAILKKNESDFENCKSEIIERLNKKDVLGKV
KGKIKDISQAMLDGNYKTLGQYFYSLYSKEKIRNQYTSREEHYLSEFITICKVQGIDQINEEEK
INEKKFDGLAKDLYKAIFFQRPLKSQKGLIGKCSFEKSKSRCAISHPDFEEYRMWTYLNTIKIG
TQSDKKLRFLTQDEKLKLVPKFYRKNDFNFDVLAKELIEKGSSFGFYKSSKKNDFFYWFNYKPT
DTVAACQVAASLKNAIGEDWKTKSFKYQTINSNKEQVSRTVDYKDLWHLLTVATSDVYLYEFAI
DKLGLDEKNAKAFSKTKLKKDFASLSLSAINKILPYLKEGLLYSHAVFVANIENIVDENIWKDE
KQRDYIKTQISEIIENYTLEKSRFEIINGLLKEYKSENEDGKRVYYSKEAEQSFENDLKKKLVL
FYKSNEIENKEQQETIFNELLPIFIQQLKDYEFIKIQRLDQKVLIFLKGKNETGQIFCTEEKGT
AEEKEKKIKNRLKKLYHPSDIEKFKKKIIKDEFGNEKIVLGSPLTPSIKNPMAMRALHQLRKVL
NALILEGQIDEKTIIHIEMARELNDANKRKGIQDYQNDNKKFREDAIKEIKKLYFEDCKKEVEP
TEDDILRYQLWMEQNRSEIYEEGKNISICDIIGSNPAYDIEHTIPRSRSQDNSQMNKTLCSQRF
NREVKKQSMPIELNNHLEILPRIAHWKEEADNLTREIEIISRSIKAAATKEIKDKKIRRRHYLT
LKRDYLQGKYDRFIWEEPKVGFKNSQIPDTGIITKYAQAYLKSYFKKVESVKGGMVAEFRKIWG

-continued

IQESFIDENGMKHYKVKDRSKHTHHTIDAITIACMTKEKYDVLAHAWTLEDQQNKKEARSIIEA

SKPWKTFKEDLLKIEEEILVSHYTPDNVKKQAKKIVRVRGKKQFVAEVERDVNGKAVPKKAASG

KTIYKLDGEGKKLPRLQQGDTIRGSLHQDSIYGAIKNPLNTDEIKYVIRKDLESIKGSDVESIV

DEVVKEKIKEAIANKVLLLSSNAQQKNKLVGTVWMNEEKRIAINKVRIYANSVKNPLHIKEHSL

LSKSKHVHKQKVYGQNDENYAMAIYELDGKRDFELINIFNLAKLIKQGQGFYPLHKKKEIKGKI

VFVPIEKRNKRDVVLKRGQQVVFYDKEVENPKDISEIVDFKGRIYIIEGLSIQRIVRPSGKVDE

YGVIMLRYFKEARKADDIKQDNFKPDGVFKLGENKPTRKMNHQFTAFVEGIDFKVLPSGKFEKI

SEQ ID NO: 332
MEFKKVLGLDIGTNSIGCALLSLPKSIQDYGKGGRLEWLTSRVIPLDADYMKAFIDGKNGLPQV

ITPAGKRRQKRGSRRLKHRYKLRRSRLIRVFKTLNWLPEDFPLDNPKRIKETISTEGKFSFRIS

DYVPISDESYREFYREFGYPENEIEQVIEEINFRRKTKGKNKNPMIKLLPEDWVVYYLRKKALI

KPTTKEELIRIIYLFNQRRGFKSSRKDLTETAILDYDEFAKRLAEKEKYSAENYETKFVSITKV

KEVVELKTDGRKGKKRFKVILEDSRIEPYEIERKEKPDWEGKEYTFLVTQKLEKGKFKQNKPDL

PKEEDWALCTTALDNRMGSKHPGEFFFDELLKAFKEKRGYKIRQYPVNRWRYKKELEFIWTKQC

QLNPELNNLNINKEILRKLATVLYPSQSKFFGPKIKEFENSDVLHIISEDIIYYQRDLKSQKSL

ISECRYEKRKGIDGEIYGLKCIPKSSPLYQEFRIWQDIHNIKVIRKESEVNGKKKINIDETQLY

INENIKEKLFELFNSKDSLSEKDILELISLNIINSGIKISKKEEETTHRINLFANRKELKGNET

KSRYRKVFKKLGFDGEYILNHPSKLNRLWHSDYSNDYADKEKTEKSILSSLGWKNRNGKWEKSK

NYDVFNLPLEVAKAIANLPPLKKEYGSYSALAIRKMLVVMRDGKYWQHPDQIAKDQENTSLMLF

DKNLIQLTNNQRKVLNKYLLTLAEVQKRSTLIKQKLNEIEHNPYKLELVSDQDLEKQVLKSFLE

KKNESDYLKGLKTYQAGYLIYGKHSEKDVPIVNSPDELGEYIRKKLPNNSLRNPIVEQVIRETI

FIVRDVWKSFGIIDEIHIELGRELKNNSEERKKTSESQEKNFQEKERARKLLKELLNSSNFEHY

DENGNKIFSSFTVNPNPDSPLDIEKFRIWKNQSGLTDEELNKKLKDEKIPTEIEVKKYILWLTQ

KCRSPYTGKIIPLSKLFDSNVYEIEHIIPRSKMKNDSTNNLVICELGVNKAKGDRLAANFISES

NGKCKFGEVEYTLLKYGDYLQYCKDTFKYQKAKYKNLLATEPPEDFIERQINDTRYIGRKLAEL

LTPVVKDSKNIIFTIGSITSELKITWGLNGVWKDILRPRFKRLESIINKKLIFQDEDDPNKYHF

DLSINPQLDKEGLKRLDHRHHALDATIIAATTREHVRYLNSLNAADNDEEKREYFLSLCNHKIR

DFKLPWENFTSEVKSKLLSCVVSYKESKPILSDPFNKYLKWEYKNGKWQKVFAIQIKNDRWKAV

RRSMFKEPIGTVWIKKIKEVSLKEAIKIQAIWEEVKNDPVRKKKEKYIYDDYAQKVIAKIVQEL

GLSSSMRKQDDEKLNKFINEAKVSAGVNKNLNTTNKTIYNLEGRFYEKIKVAEYVLYKAKRMPL

NKKEYIEKLSLQKMFNDLPNFILEKSILDNYPEILKELESDNKYIIEPHKKNNPVNRLLLEHIL

EYHNNPKEAFSTEGLEKLNKKAINKIGKPIKYITRLDGDINEEEIFRGAVFETDKGSNVYFVMY

ENNQTKDREFLKPNPSISVLKAIEHKNKIDFFAPNRLGFSRIILSPGDLVYVPTNDQYVLIKDN

SSNETIINWDDNEFISNRIYQVKKFTGNSCYFLKNDIASLILSYSASNGVGEFGSQNISEYSVD

DPPIRIKDVCIKIRVDRLGNVRPL

SEQ ID NO: 333
MKHILGLDLGTNSIGWALIERNIEEKYGKIIGMGSRIVPMGAELSKFEQGQAQTKNADRRTNRG

ARRLNKRYKQRRNKLIYILQKLDMLPSQIKLKEDFSDPNKIDKITILPISKKQEQLTAFDLVSL

RVKALTEKVGLEDLGKIIYKYNQLRGYAGGSLEPEKEDIFDEEQSKDKKNKSFIAFSKIVFLGE

PQEEIFKNKKLNRRAIIVETEEGNFEGSTFLENIKVGDSLELLINISASKSGDTITIKLPNKTN

WRKKMENIENQLKEKSKEMGREFYISEFLLELLKENRWAKIRNNTILRARYESEFEAIWNEQVK

HYPFLENLDKKTLIEIVSFIFPPGEKESQKKYRELGLEKGLKYIIKNQVVFYQRELKDQSHLISD

-continued

CRYEPNEKAIAKSHPVFQEYKVWEQINKLIVNTKIEAGTNRKGEKKYKYIDRPIPTALKEWIFE
ELQNKKEITFSAIFKKLKAEFDLREGIDFLNGMSPKDKLKGNETKLQLQKSLGELWDVLGLDSI
NRQIELWNILYNEKGNEYDLTSDRTSKVLEFINKYGNNIVDDNAEETAIRISKIKFARAYSSLS
LKAVERILPLVRAGKYFNNDFSQQLQSKILKLLNENVEDPFAKAAQTYLDNNQSVLSEGGVGNS
IATILVYDKHTAKEYSHDELYKSYKEINLLKQGDLRNPLVEQIINEALVLIRDIWKNYGIKPNE
IRVELARDLKNSAKERATIHKRNKDNQTINNKIKETLVKNKKELSLANIEKVKLWEAQRHLSPY
TGQPIPLSDLFDKEKYDVDHIIPISRYFDDSFTNKVISEKSVNQEKANRTAMEYFEVGSLKYSI
FTKEQFIAHVNEYFSGVKRKNLLATSIPEDPVQRQIKDTQYIAIRVKEELNKIVGNENVKTTTG
SITDYLRNHWGLTDKFKLLLKERYEALLESEKFLEAEYDNYKKDFDSRKKEYEEKEVLFEEQEL
TREEFIKEYKENYIRYKKNKLIIKGWSKRIDHRHHAIDALIVACTEPAHIKRLNDLNKVLQDWL
VEHKSEFMPNFEGSNSELLEEILSLPENERTEIFTQIEKFRAIEMPWKGFPEQVEQKLKEIIIS
HKPKDKLLLQYNKAGDRQIKLRGQLHEGTLYGISQGKEAYRIPLTKFGGSKFATEKNIQKIVSP
FLSGFIANHLKEYNNKKEEAFSAEGIMDLNNKLAQYRNEKGELKPHTPISTVKIYYKDPSKNKK
KKDEEDLSLQKLDREKAFNEKLYVKTGDNYLFAVLEGEIKTKKTSQIKRLYDIISFFDATNFLK
EEFRNAPDKKTFDKDLLFRQYFEERNKAKLLFTLKQGDFVYLPNENEEVILDKESPLYNQYWGD
LKERGKNIYVVQKFSKKQIYFIKHTIADIIKKDVEFGSQNCYETVEGRSIKENCFKLEIDRLGN
IVKVIKR

SEQ ID NO: 334
MHVEIDFPHFSRGDSHLAMNKNEILRGSSVLYRLGLDLGSNSLGWFVTHLEKRGDRHEPVALGP
GGVRIFPDGRDPQSGTSNAVDRRMARGARKRRDRFVERRKELIAALIKYNLLPDDARERRALEV
LDPYALRKTALTDTLPAHHVGRALFHLNQRRGFQSNRKTDSKQSEDGAIKQAASRLATDKGNET
LGVFFADMHLRKSYEDRQTAIRAELVRLGKDHLTGNARKKIWAKVRKRLFGDEVLPRADAPHGV
RARATITGTKASYDYYPTRDMLRDEFNAIWAGQSAHHATITDEARTEIEHIIFYQRPLKPAIVG
KCTLDPATRPFKEDPEGYRAPWSHPLAQRFRILSEARNLEIRDTGKGSRRLTKEQSDLVVAALL
ANREVKFDKLRTLLKLPAEARFNLESDRRAALDGDQTAARLSDKKGFNKAWRGFPPERQIAIVA
RLEETEDENELIAWLEKECALDGAAAARVANTTLPDGHCRLGLRAIKKIVPIMQDGLDEDGVAG
AGYHIAAKRAGYDHAKLPTGEQLGRLPYYGQWLQDAVVGSGDARDQKEKQYGQFPNPTVHIGLG
QLRRVVNDLIDKYGPPTEISIEFTRALKLSEQQKAERQREQRRNQDKNKARAEELAKFGRPANP
RNLLKMRLWEELAHDPLDRKCVYTGEQISIERLLSDEVDIDHILPVAMTLDDSPANKIICMRYA
NRHKRKQTPSEAFGSSPTLQGHRYNWDDIAARATGLPRNKRWRFDANAREEFDKRGGFLARQLN
ETGWLARLAKQYLGAVTDPNQIWVVPGRLTSMLRGKWGLNGLLPSDNYAGVQDKAEEFLASTDD
MEFSGVKNRADHRHHAIDGLVTALTDRSLLWKMANAYDEEHEKFVIEPPWPTMRDDLKAALEKM
VVSHKPDHGIEGKLHEDSAYGFVKPLDATGLKEEEAGNLVYRKAIESLNENEVDRIRDIQLRTI
VRDHVNVEKTKGVALADALRQLQAPSDDYPQFKHGLRHVRILKKEKGDYLVPIANRASGVAYKA
YSAGENFCVEVFETAGGKWDGEAVRRFDANKKNAGPKIAHAPQWRDANEGAKLVMRIHKGDLIR
LDHEGRARIMVVHRLDAAAGRFKLADHNETGNLDKRHATNNDIDPFRWLMASYNTLKKLAAVPV
RVDELGRVWRVMPN

SEQ ID NO: 335
METTLGIDLGTNSIGLALVDQEEHQILYSGVRIFPEGINKDTIGLGEKEESRNATRRAKRQMRR
QYFRKKLRKAKLLELLIAYDMCPLKPEDVRRWKNWDKQQKSTVRQFPDTPAFREWLKQNPYELR
KQAVTEDVTRPELGRILYQMIQRRGFLSSRKGKEEGKIFTGKDRMVGIDETRKNLQKQTLGAYL

-continued

YDIAPKNGEKYRFRTERVRARYTLRDMYIREFEIIWQRQAGHLGLAHEQATRKKNIFLEGSATN

VRNSKLITHLQAKYGRGHVLIEDTRITVTFQLPLKEVLGGKIEIEEEQLKFKSNESVLFWQRPL

RSQKSLLSKCVFEGRNFYDPVHQKWIIAGPTPAPLSHPEFEEFRAYQFINNIIYGKNEHLTAIQ

REAVFELMCTESKDFNFEKIPKHLKLFEKFNFDDTTKVPACTTISQLRKLFPHPVWEEKREEIW

HCFYFYDDNTLLFEKLQKDYALQTNDLEKIKKIRLSESYGNVSLKAIRRINPYLKKGYAYSTAV

LLGGIRNSFGKRFEYFKEYEPEIEKAVCRILKEKNAEGEVIRKIKDYLVHNRFGFAKNDRAFQK

LYHHSQAITTQAQKERLPETGNLRNPIVQQGLNELRRTVNKLLATCREKYGPSFKFDHIHVEMG

RELRSSKTEREKQSRQIRENEKKNEAAKVKLAEYGLKAYRDNIQKYLLYKEIEEKGGTVCCPYT

GKTLNISHTLGSDNSVQIEHIIPYSISLDDSLANKTLCDATFNREKGELTPYDFYQKDPSPEKW

GASSWEEIEDRAFRLLPYAKAQRFIRRKPQESNEFISRQLNDTRYISKKAVEYLSAICSDVKAF

PGQLTAELRHLWGLNNILQSAPDITFPLPVSATENHREYYVITNEQNEVIRLFPKQGETPRTEK

GELLLTGEVERKVFRCKGMQEFQTDVSDGKYWRRIKLSSSVTWSPLFAPKPISADGQIVLKGRI

EKGVFVCNQLKQKLKTGLPDGSYWISLPVISQTFKEGESVNNSKLTSQQVQLFGRVREGIFRCH

NYQCPASGADGNFWCTLDTDTAQPAFTPIKNAPPGVGGGQIILTGDVDDKGIFHADDDLHYELP

ASLPKGKYYGIFTVESCDPTLIPIELSAPKTSKGENLIEGNIWVDEHTGEVRFDPKKNREDQRH

HAIDAIVIALSSQSLFQRLSTYNARRENKKRGLDSTEHFPSPWPGFAQDVRQSVVPLLVSYKQN

PKTLCKISKTLYKDGKKIHSCGNAVRGQLHKETVYGQRTAPGATEKSYHIRKDIRELKTSKHIG

KVVDITIRQMLLKHLQENYHIDITQEFNIPSNAFFKEGVYRIFLPNKHGEPVPIKKIRMKEELG

NAERLKDNINQYVNPRNNHHVMIYQDADGNLKEEIVSFWSVIERQNQGQPIYQLPREGRNIVSI

LQINDTFLIGLKEEEPEVYRNDLSTLSKHLYRVQKLSGMYYTFRHHLASTLNNEREEFRIQSLE

AWKRANPVKVQIDEIGRITFLNGPLC

SEQ ID NO: 336
MESSQILSPIGIDLGGKFTGVCLSHLEAFAELPNHANTKYSVILIDHNNFQLSQAQRRATRHRV

RNKKRNQFVKRVALQLFQHILSRDLNAKEETALCHYLNNRGYTYVDTDLDEYIKDETTINLLKE

LLPSESEHNFIDWFLQKMQSSEFRKILVSKVEEKKDDKELKNAVKNIKNFITGFEKNSVEGHRH

RKVYFENIKSDITKDNQLDSIKKKIPSVCLSNLLGHLSNLQWKNLHRYLAKNPKQFDEQTFGNE

FLRMLKNFRHLKGSQESLAVRNLIQQLEQSQDYISILEKTPPEITIPPYEARTNTGMEKDQSLL

LNPEKLNNLYPNWRNLIPGIIDAHPFLEKDLEHTKLRDRKRIISPSKQDEKRDSYILQRYLDLN

KKIDKFKIKKQLSFLGQGKQLPANLIETQKEMETHFNSSLVSVLIQIASAYNKEREDAAQGIWF

DNAFSLCELSNINPPRKQKILPLLVGAILSEDFINNKDKWAKFKIFWNTHKIGRTSLKSKCKEI

EEARKNSGNAFKIDYEEALNHPEHSNNKALIKIIQTIPDIIQAIQSHLGHNDSQALIYHNPFSL

SQLYTILETKRDGFHKNCVAVTCENYWRSQKTEIDPEISYASRLPADSVRPFDGVLARMMQRLA

YEIAMAKWEQIKHIPDNSSLLIPIYLEQNRFEFEESFKKIKGSSSDKTLEQAIEKQNIQWEEKF

QRIINASMNICPYKGASIGGQGEIDHIYPRSLSKKHFGVIFNSEVNLIYCSSQGNREKKEEHYL

LEHLSPLYLKHQFGTDNVSDIKNFISQNVANIKKYISFHLLTPEQQKAARHALFLDYDDEAFKT

ITKFLMSQQKARVNGTQKFLGKQIMEFLSTLADSKQLQLEFSIKQITAEEVHDHRELLSKQEPK

LVKSRQQSFPSHAIDATLTMSIGLKEFPQFSQELDNSWFINHLMPDEVHLNPVRSKEKYNKPNI

SSTPLFKDSLYAERFIPVWVKGETFAIGFSEKDLFEIKPSNKEKLFTLLKTYSTKNPGESLQEL

QAKSKAKWLYFPINKTLALEFLHHYFHKEIVTPDDTTVCHFINSLRYYTKKESITVKILKEPMP

VLSVKFESSKKNVLGSFKHTIALPATKDWERLFNHPNFLALKANPAPNPKEFNEFIRKYFLSDN

NPNSDIPNNGHNIKPQKHKAVRKVFSLPVIPGNAGTMMRIRRKDNKGQPLYQLQTIDDTPSMGI

-continued
QINEDRLVKQEVLMDAYKTRNLSTIDGINNSEGQAYATFDNWLTLPVSTFKPEIIKLEMKPHSK
TRRYIRITQSLADFIKTIDEALMIKPSDSIDDPLNMPNEIVCKNKLFGNELKPRDGKMKIVSTG
KIVTYEFESDSTPQWIQTLYVTQLKKQP SEQ ID NO: 337
MKKIVGLDLGTNSIGWALINAYINKEHLYGIEACGSRIIPMDAAILGNFDKGNSISQTADRTSY
RGIRRLRERHLLRRERLHRILDLLGFLPKHYSDSLNRYGKFLNDIECKLPWVKDETGSYKFIFQ
ESFKEMLANFTEHHPILIANNKKVPYDWTIYYLRKKALTQKISKEELAWILLNFNQKRGYYQLR
GEEEETPNKLVEYYSLKVEKVEDSGERKGKDTWYNVHLENGMIYRRTSNIPLDWEGKTKEFIVT
TDLEADGSPKKDKEGNIKRSFRAPKDDDWTLIKKKTEADIDKIKMTVGAYIYDTLLQKPDQKIR
GKLVRTIERKYYKNELYQILKTQSEFHEELRDKQLYIACLNELYPNNEPRRNSISTRDFCHLFI
EDIIFYQRPLKSKKSLIDNCPYEENRYIDKESGEIKHASIKCIAKSHPLYQEFRLWQFIVNLRI
YRKETDVDVTQELLPTEADYVTLFEWLNEKKEIDQKAFFKYPPFGFKKTTSNYRWNYVEDKPYP
CNETHAQIIARLGKAHIPKAFLSKEKEETLWHILYSIEDKQEIEKALHSFANKNNLSEEFIEQF
KNFPPPKKEYGSYSAKAIKKLLPLMRMGKYWSIENIDNGTRIRINKIIDGEYDENIRERVRQKA
INLTDITHFRALPLWLACYLVYDRHSEVKDIVKWKTPKDIDLYLKSFKQHSLRNPIVEQVITET
LRTVRDIWQQVGHIDEIHIELGREMKNPADKRARMSQQMIKNENTNLRIKALLTEFLNPEFGIE
NVRPYSPSQQDLLRIYEEGVLNSILELPEDIGIILGKFNQTDTLKRPTRSEILRYKLWEQKYR
SPYTGEMIPLSKLFTPAYEIEHIIPQSRYFDDSLSNKVICESEINKLKDRSLGYEFIKNHHGEK
VELAFDKPVEVLSVEAYEKLVHESYSHNRSKMKKLLMEDIPDQFIERQLNDSRYISKVVKSLLS
NIVREENEQEAISKNVIPCTGGITDRLKKDWGINDVWNKIVLPRFIRLNELTESTRFTSINTNN
TMIPSMPLELQKGFNKKRIDHRHHAMDAIIIACANRNIVNYLNNVSASKNTKITRRDLQTLLCH
KDKTDNNGNYKWVIDKPWETFTQDTLTALQKITVSFKQNLRVINKTTNHYQHYENGKKIVSNQS
KGDSWAIRKSMHKETVHGEVNLRMIKTVSFNEALKKPQAIVEMDLKKKILAMLELGYDTKRIKN
YFEENKDTWQDINPSKIKVYYFTKETKDRYFAVRKPIDTSFDKKKIKESITDTGIQQIMLRHLE
TKDNDPTLAFSPDGIDEMNRNILILNKGKKHQPIYKVRVYEKAEKFTVGQKGNKRTKFVEAAKG
TNLFFAIYETEEIDKDTKKVIRKRSYSTIPLNVVIERQKQGLSSAPEDENGNLPKYILSPNDLV
YVPTQEEINKGEVVMPIDRDRIYKMVDSSGITANFIPASTANLIFALPKATAEIYCNGENCIQN
EYGIGSPQSKNQKAITGEMVKEICFPIKVDRLGNIIQVGSCILTN SEQ ID NO: 338
MSRSLTFSFDIGYASIGWAVIASASHDDADPSVCGCGTVLFPKDDCQAFKRREYRRLRRNIRSR
RVRIERIGRLLVQAQIITPEMKETSGHPAPFYLASEALKGHRTLAPIELWHVLRWYAHNRGYDN
NASWSNSLSEDGGNGEDTERVKHAQDLMDKHGTATMAETICRELKLEEGKADAPMEVSTPAYKN
LNTAFPRLIVEKEVRRILELSAPLIPGLTAEIIELIAQHHPLTTEQRGVLLQHGIKLARRYRGS
LLFGQLIPRFDNRIISRCPVTWAQVYEAELKKGNSEQSARERAEKLSKVPTANCPEFYEYRMAR
ILCNIRADGEPLSAEIRRELMNQARQEGKLTKASLEKAISSRLGKETETNVSNYFTLHPDSEEA
LYLNPAVEVLQRSGIGQILSPSVYRIAANRLRRGKSVTPNYLLNLLKSRGESGEALEKKIEKES
KKKEADYADTPLKPKYATGRAPYARTVLKKVVEEILDGEDPTRPARGEAHPDGELKAHDGCLYC
LLDTDSSVNQHQKERRLDTMTNNHLVRHRMLILDRLLKDLIQDFADGQKDRISRVCVEVGKELT
TFSAMDSKKIQRELTLRQKSHTDAVNRLKRKLPGKALSANLIRKCRIAMDMNWTCPFTGATYGD
HELENLELEHIVPHSFRQSNALSSLVLTWPGVNRMKGQRTGYDFVEQEQENPVPDKPNLHICSL
NNYRELVEKLDDKKGHEDDRRRKKKRKALLMVRGLSHKHQSQNHEAMKEIGMTEGMMTQSSHLM
KLACKSIKTSLPDAHIDMIPGAVTAEVRKAWDVFGVFKELCPEAADPDSGKILKENLRSLTHLH -continued

HALDACVLGLIPYIIPAHHNGLLRRVLAMRRIPEKLIPQVRPVANQRHYVLNDDGRMMLRDLSA

SLKENIREQLMEQRVIQHVPADMGGALLKETMQRVLSVDGSGEDAMVSLSKKKDGKKEKNQVKA

SKLVGVFPEGPSKLKALKAAIEIDGNYGVALDPKPVVIRHIKVFKRIMALKEQNGGKPVRILKK

GMLIHLTSSKDPKHAGVWRIESIQDSKGGVKLDLQRAHCAVPKNKTHECNWREVDLISLLKKYQ

MKRYPTSYTGTPR

SEQ ID NO: 339

MTQKVLGLDLGTNSIGSAVRNLDLSDDLQWQLEFFSSDIFRSSVNKESNGREYSLAAQRSAHRR

SRGLNEVRRRRLWATLNLLIKHGFCPMSSESLMRWCTYDKRKGLFREYPIDDKDFNAWILLDFN

GDGRPDYSSPYQLRRELVTRQFDFEQPIERYKLGRALYHIAQHRGFKSSKGETLSQQETNSKPS

STDEIPDVAGAMKASEEKLSKGLSTYMKEHNLLTVGAAFAQLEDEGVRVRNNNDYRAIRSQFQH

EIETIFKFQQGLSVESELYERLISEKKNVGTIFYKRPLRSQRGNVGKCTLERSKPRCAIGHPLF

EKFRAWTLINNIKVRMSVDTLDEQLPMKLRLDLYNECFLAFVRTEFKFEDIRKYLEKRLGIHFS

YNDKTINYKDSTSVAGCPITARFRKMLGEEWESFRVEGQKERQAHSKNNISFHRVSYSIEDIWH

FCYDAEEPEAVLAFAQETLRLERKKAEELVRIWSAMPQGYAMLSQKAIRNINKILMLGLKYSDA

VILAKVPELVDVSDEELLSIAKDYYLVEAQVNYDKRINSIVNGLIAKYKSVSEEYRFADHNYEY

LLDESDEKDIIRQIENSLGARRWSLMDANEQTDILQKVRDRYQDFFRSHERKFVESPKLGESFE

NYLTKKFPMVEREQWKKLYHPSQITIYRPVSVGKDRSVLRLGNPDIGAIKNPTVLRVLNTLRRR

VNQLLDDGVISPDETRVVVETARELNDANRKWALDTYNRIRHDENEKIKKILEEFYPKRDGIST

DDIDKARYVIDQREVDYFTGSKTYNKDIKKYKFWLEQGGQCMYTGRTINLSNLFDPNAFDIEHT

IPESLSFDSSDMNLTLCDAHYNRFIKKNHIPTDMPNYDKAITIDGKEYPAITSQLQRWVERVER

LNRNVEYWKGQARRAQNKDRKDQCMREMHLWKMELEYWKKKLERFTVTEVTDGFKNSQLVDTRV

ITRHAVLYLKSIFPHVDVQRGDVTAKFRKILGIQSVDEKKDRSLHSHHAIDATTLTIIPVSAKR

DRMLELFAKIEEINKMLSFSGSEDRTGLIQELEGLKNKLQMEVKVCRIGHNVSEIGTFINDNII

VNHHIKNQALTPVRRRLRKKGYIVGGVDNPRWQTGDALRGEIHKASYYGAITQFAKDDEGKVLM

KEGRPQVNPTIKFVIRRELKYKKSAADSGFASWDDLGKAIVDKELFALMKGQFPAETSFKDACE

QGIYMIKKGKNGMPDIKLHHIRHVRCEAPQSGLKIKEQTYKSEKEYKRYFYAAVGDLYAMCCYT

NGKIREFRIYSLYDVSCHRKSDIEDIPEFITDKKGNRLMLDYKLRTGDMILLYKDNPAELYDLD

NVNLSRRLYKINRFESQSNLVLMTHHLSTSKERGRSLGKTVDYQNLPESIRSSVKSLNFLIMGE

NRDFVIKNGKIIFNHR

SEQ ID NO: 340

MLVSPISVDLGGKNTGFFSFTDSLDNSQSGTVIYDESFVLSQVGRRSKRHSKRNNLRNKLVKRL

FLLILQEHHGLSIDVLPDEIRGLFNKRGYTYAGFELDEKKKDALESDTLKEFLSEKLQSIDRDS

DVEDFLNQIASNAESFKDYKKGFEAVFASATHSPNKKLELKDELKSEYGENAKELLAGLRVTKE

ILDEFDKQENQGNLPRAKYFEELGEYIATNEKVKSFFDSNSLKLTDMTKLIGNISNYQLKELRR

YFNDKEMEKGDIWIPNKLHKITERFVRSWHPKNDADRQRRAELMKDLKSKEIMELLTTTEPVMT

IPPYDDMNNRGAVKCQTLRLNEEYLDKHLPNWRDIAKRLNHGKFNDDLADSTVKGYSEDSTLLH

RLLDTSKEIDIYELRGKKPNELLVKTLGQSDANRLYGFAQNYYELIRQKVRAGIWVPVKNKDDS

LNLEDNSNMLKRCNHNPPHKKNQIHNLVAGILGVKLDEAKFAEFEKELWSAKVGNKKLSAYCKN

IEELRKTHGNTFKIDIEELRKKDPAELSKEEKAKLRLTDDVILNEWSQKIANFFDIDDKHRQRF

NNLFSMAQLHTVIDTPRSGFSSTCKRCTAENRFRSETAFYNDETGEFHKKATATCQRLPADTQR

PFSGKIERYIDKLGYELAKIKAKELEGMEAKEIKVPIILEQNAFEYEESLRKSKTGSNDRVINS

-continued

KKDRDGKKLAKAKENAEDRLKDKDKRIKAFSSGICPYCGDTIGDDGEIDHILPRSHTLKIYGTV

FNPEGNLIYVHQKCNQAKADSIYKLSDIKAGVSAQWIEEQVANIKGYKTFSVLSAEQQKAFRYA

LFLQNDNEAYKKVVDWLRTDQSARVNGTQKYLAKKIQEKLTKMLPNKHLSFEFILADATEVSEL

RRQYARQNPLLAKAEKQAPSSHAIDAVMAFVARYQKVFKDGTPPNADEVAKLAMLDSWNPASNE

PLTKGLSTNQKIEKMIKSGDYGQKNMREVFGKSIFGENAIGERYKPIVVQEGGYYIGYPATVKK

GYELKNCKVVTSKNDIAKLEKIIKNQDLISLKENQYIKIFSINKQTISELSNRYFNMNYKNLVE

RDKEIVGLLEFIVENCRYYTKKVDVKFAPKYIHETKYPFYDDWRRFDEAWRYLQENQNKTSSKD

RFVIDKSSLNEYYQPDKNEYKLDVDTQPIWDDFCRWYFLDRYKTANDKKSIRIKARKTFSLLAE

SGVQGKVFRAKRKIPTGYAYQALPMDNNVIAGDYANILLEANSKTLSLVPKSGISIEKQLDKKL

DVIKKTDVRGLAIDNNSFFNADFDTHGIRLIVENTSVKVGNFPISAIDKSAKRMIFRALFEKEK

GKRKKKTTISFKESGPVQDYLKVFLKKIVKIQLRTDGSISNIVVRKNAADFTLSFRSEHIQKLL

K

SEQ ID NO: 341

MAYRLGLDIGITSVGWAVVALEKDESGLKPVRIQDLGVRIFDKAEDSKTGASLALPRREARSAR

RRTRRRRHRLWRVKRLLEQHGILSMEQIEALYAQRTSSPDVYALRVAGLDRCLIAEEIARVLIH

IAHRRGFQSNRKSEIKDSDAGKLLKAVQENENLMQSKGYRTVAEMLVSEATKTDAEGKLVHGKK

HGYVSNVRNKAGEYRHTVSRQAIVDEVRKIFAAQRALGNDVMSEELEDSYLKILCSQRNFDDGP

GGDSPYGHGSVSPDGVRQSIYERMVGSCTFETGEKRAPRSSYSFERFQLLTKVVNLRIYRQQED

GGRYPCELTQTERARVIDCAYEQTKITYGKLRKLLDMKDTESFAGLTYGLNRSRNKTEDTVFVE

MKFYHEVRKALQRAGVFIQDLSIETLDQIGWILSVWKSDDNRRKKLSTLGLSDNVIEELLPLNG

SKFGHLSLKAIRKILPFLEDGYSYDVACELAGYQFQGKTEYVKQRLLPPLGEGEVTNPVVRRAL

SQAIKVVNAVIRKHGSPESIHIELARELSKNLDERRKIEKAQKENQKNNEQIKDEIREILGSAH

VTGRDIVKYKLFKQQQEFCMYSGEKLDVTRLFEPGYAEVDHIIPYGISFDDSYDNKVLVKTEQN

RQKGNRTPLEYLRDKPEQKAKFIALVESIPLSQKKKNHLLMDKRAIDLEQEGFRERNLSDTRYI

TRALMNHIQAWLLFDETASTRSKRVVCVNGAVTAYMRARWGLTKDRDAGDKHHAADAVVVACIG

DSLIQRVTKYDKFKRNALADRNRYVQQVSKSEGITQYVDKETGEVFTWESFDERKFLPNEPLEP

WPFFRDELLARLSDDPSKNIRAIGLLTYSETEQIDPIFVSRMPTRKVTGAAHKETIRSPRIVKV

DDNKGTEIQVVVSKVALTELKLTKDGEIKDYFRPEDDPRLYNTLRERLVQFGGDAKAAFKEPVY

KISKDGSVRTPVRKVKIQEKLTLGVPVHGGRGIAENGGMVRIDVFAKGGKYYFVPIYVADVLKR

ELPNRLATAHKPYSEWRVVDDSYQFKFSLYPNDAVMIKPSREVDITYKDRKEPVGCRIMYFVSA

NIASASISLRTHDNSGELEGLGIQGLEVFEKYVVGPLGDTHPVYKERRMPFRVERKMN

SEQ ID NO: 342

MPVLSPLSPNAAQGRRRWSLALDIGEGSIGWAVAEVDAEGRVLQLTGTGVTLFPSAWSNENGTY

VAHGAADRAVRGQQQRHDSRRRRLAGLARLCAPVLERSPEDLKDLTRTPPKADPRAIFFLRADA

ARRPLDGPELFRVLHHMAAHRGIRLAELQEVDPPPESDADDAAPAATEDEDGTRRAAADERAFR

RLMAEHMHRHGTQPTCGEIMAGRLRETPAGAQPVTRARDGLRVGGGVAVPTRALIEQEFDAIRA

IQAPRHPDLPWDSLRRLVLDQAPIAVPPATPCLFLEELRRRGETFQGRTITREAIDRGLTVDPL

IQALRIRETVGNLRLHERITEPDGRQRYVPRAMPELGLSHGELTAPERDTLVRALMHDPDGLAA

KDGRIPYTRLRKLIGYDNSPVCFAQERDTSGGGITVNPTDPLMARWIDGWVDLPLKARSLYVRD

VVARGADSAALARLLAEGAHGVPPVAAAAVPAATAAILESDIMQPGRYSVCPWAAEAILDAWAN

APTEGFYDVTRGLFGFAPGEIVLEDLRRARGALLAHLPRTMAAARTPNRAAQQRGPLPAYESVI

PSQLITSLRRAHKGRAADWSAADPEERNPFLRTWTGNAATDHILNQVRKTANEVITKYGNRRGW

-continued

DPLPSRITVELAREAKHGVIRRNEIAKENRENEGRRKKESAALDTFCQDNTVSWQAGGLPKERA
ALRLRLAQRQEFFCPYCAERPKLRATDLFSPAETEIDHVIERRMGGDGPDNLVLAHKDCNNAKG
KKTPHEHAGDLLDSPALAALWQGWRKENADRLKGKGHKARTPREDKDFMDRVGWRFEEDARAKA
EENQERRGRRMLHDTARATRLARLYLAAAVMPEDPAEIGAPPVETPPSPEDPTGYTAIYRTISR
VQPVNGSVTHMLRQRLLQRDKNRDYQTHHAEDACLLLLAGPAVVQAFNTEAAQHGADAPDDRPV
DLMPTSDAYHQQRRARALGRVPLATVDAALADIVMPESDRQDPETGRVHWRLTRAGRGLKRRID
DLTRNCVILSRPRRPSETGTPGALHNATHYGRREITVDGRTDTVVTQRMNARDLVALLDNAKIV
PAARLDAAAPGDTILKEICTEIADRHDRVVDPEGTHARRWISARLAALVPAHAEAVARDIAELA
DLDALADADRTPEQEARRSALRQSPYLGRAISAKKADGRARAREQEILTRALLDPHWGPRGLRH
LIMREARAPSLVRIRANKTDAFGRPVPDAAVWVKTDGNAVSQLWRLTSVVTDDGRRIPLPKPIE
KRIEISNLEYARLNGLDEGAGVTGNNAPPRPLRQDIDRLTPLWRDHGTAPGGYLGTAVGELEDK
ARSALRGKAMRQTLTDAGITAEAGWRLDSEGAVCDLEVAKGDTVKKDGKTYKVGVITQGIFGMP
VDAAGSAPRTPEDCEKFEEQYGIKPWKAKGIPLA

SEQ ID NO: 343
MNYTEKEKLFMKYILALDIGIASVGWAILDKESETVIEAGSNIFPEASAADNQLRRDMRGAKRN
NRRLKTRINDFIKLWENNNLSIPQFKSTEIVGLKVRAITEEITLDELYLILYSYLKHRGISYLE
DALDDTVSGSSAYANGLKLNAKELETHYPCEIQQERLNTIGKYRGQSQIINENGEVLDLSNVFT
IGAYRKEIQRVFEIQKKYHPELTDEFCDGYMLIFNRKRKYYEGPGNEKSRTDYGRFTTKLDANG
NYITEDNIFEKLIGKCSVYPDELRAAAASYTAQEYNVLNDLNNLTINGRKLEENEKHEIVERIK
SSNTINMRKIISDCMGENIDDFAGARIDKSGKEIFHKFEVYNKMRKALLEIGIDISNYSREELD
EIGYIMTINTDKEAMMEAFQKSWIDLSDDVKQCLINMRKTNGALFNKWQSFSLKIMNELIPEMY
AQPKEQMTLLTEMGVTKGTQEEFAGLKYIPVDVVSEDIFNPVVRRSVRISFKILNAVLKKYKAL
DTIVIEMPRDRNSEEQKKRINDSQKLNEKEMEYIEKKLAVTYGIKLSPSDFSSQKQLSLKLKLW
NEQDGICLYSGKTIDPNDIINNPQLFEIDHIIPRSISFDDARSNKVLVYRSENQKKGNQTPYYY
LTHSHSEWSFEQYKATVMNLSKKKEYAISRKKIQNLLYSEDITKMDVLKGFINRNINDTSYASR
LVLNTIQNFFMANEADTKVKVIKGSYTHQMRCNLKLDKNRDESYSHHAVDAMLIGYSELGYEAY
HKLQGEFIDFETGEILRKDMWDENMSDEVYADYLYGKKWANIRNEVVKAEKNVKYWHYVMRKSN
RGLCNQTIRGTREYDGKQYKINKLDIRTKEGIKVFAKLAFSKKDSDRERLLVYLNDRRTFDDLC
KIYEDYSDAANPFVQYEKETGDIIRKYSKKHNGPRIDKLKYKDGEVGACIDISHKYGFEKGSKK
VILESLVPYRMDVYYKEENHSYYLVGVKQSDIKFEKGRNVIDEEAYARILVNEKMIQPGQSRAD
LENLGFKFKLSFYKNDIIEYEKDGKIYTERLVSRTMPKQRNYIETKPIDKAKFEKQNLVGLGKT
KFIKKYRYDILGNKYSCSEEKFTSFC

SEQ ID NO: 344
MLRLYCANNLVLNNVQNLWKYLLLLIFDKKIIFLFKIKVILIRRYMENNNKEKIVIGFDLGVAS
VGWSIVNAETKEVIDLGVRLFSEPEKADYRRAKRTTRRLLRRKKFKREKFHKLILKNAEIFGLQ
SRNEILNVYKDQSSKYRNILKLKINALKEEIKPSELVWILRDYLQNRGYFYKNEKLTDEFVSNS
FPSKKLHEHYEKYGFFRGSVKLDNKLDNKKDKAKEKDEEEESDAKKESEELIFSNKQWINEIVK
VFENQSYLTESFKEEYLKLFNYVRPFNKGPGSKNSRTAYGVFSTDIDPETNKFKDYSNIWDKTI
GKCSLFEEEIRAPKNLPSALIFNLQNEICTIKNEFTEFKNWWLNAEQKSEILKFVFTELFNWKD
KKYSDKKFNKNLQDKIKKYLLNFALENFNLNEEILKNRDLENDTVLGLKGVKYYEKSNATADAA
LEFSSLKPLYVFIKFLKEKKLDLNYLLGLENTEILYFLDSIYLAISYSSDLKERNEWFKKLLKE

-continued

LYPKIKNNNLEIIENVEDIFEITDQEKFESFSKTHSLSREAFNHIIPLLLSNNEGKNYESLKHS

NEELKKRTEKAELKAQQNQKYLKDNFLKEALVPLSVKTSVLQAIKIFNQIIKNFGKKYEISQVV

IEMARELTKPNLEKLLNNATNSNIKILKEKLDQTEKFDDFTKKKFIDKIENSVVFRNKLFLWFE

QDRKDPYTQLDIKINEIEDETEIDHVIPYSKSADDSWFNKLLVKKSTNQLKKNKTVWEYYQNES

DPEAKWNKFVAWAKRIYLVQKSDKESKDNSEKNSIFKNKKPNLKFKNITKKLFDPYKDLGFLAR

NLNDTRYATKVFRDQLNNYSKHHSKDDENKLFKVVCMNGSITSFLRKSMWRKNEEQVYRFNFWK

KDRDQFFHHAVDASIIAIFSLLTKTLYNKLRVYESYDVQRREDGVYLINKETGEVKKADKDYWK

DQHNFLKIRENAIEIKNVLNNVDFQNQVRYSRKANTKLNTQLFNETLYGVKEFENNFYKLEKVN

LFSRKDLRKFILEDLNEESEKNKKNENGSRKRILTEKYIVDEILQILENEEFKDSKSDINALNK

YMDSLPSKFSEFFSQDFINKCKKENSLILTFDAIKHNDPKKVIKIKNLKFFREDATLKNKQAVH

KDSKNQIKSFYESYKCVGFIWLKNKNDLEESIFVPINSRVIHFGDKDKDIFDFDSYNKEKLLNE

INLKRPENKKFNSINEIEFVKFVKPGALLLNFENQQIYYISTLESSSLRAKIKLLNKMDKGKAV

SMKKITNPDEYKIIEHVNPLGINLNWTKKLENNN

SEQ ID NO: 345

MLMSKHVLGLDLGVGSIGWCLIALDAQGDPAEILGMGSRVVPLNNATKAIEAFNAGAAFTASQE

RTARRTMRRGFARYQLRRYRLRRELEKVGMLPDAALIQLPLLELWELRERAATAGRRLTLPELG

RVLCHINQKRGYRHVKSDAAAIVGDEGEKKKDSNSAYLAGIRANDEKLQAEHKTVGQYFAEQLR

QNQSESPTGGISYRIKDQIFSRQCYIDEYDQIMAVQRVHYPDILTDEFIRMLRDEVIFMQRPLK

SCKHLVSLCEFEKQERVMRVQQDDGKGGWQLVERRVKFGPKVAPKSSPLFQLCCIYEAVNNIRL

TRPNGSPCDITPEERAKIVAHLQSSASLSFAALKKLLKEKALIADQLTSKSGLKGNSTRVALAS

ALQPYPQYHHLLDMELETRMMTVQLTDEETGEVTEREVAVVTDSYVRKPLYRLWHILYSIEERE

AMRRALITQLGMKEEDLDGGLLDQLYRLDFVKPGYGNKSAKFICKLLPQLQQGLGYSEACAAVG

YRHSNSPTSEEITERTLLEKIPLLQRNELRQPLVEKILNQMINLVNALKAEYGIDEVRVELARE

LKMSREERERMARNNKDREERNKGVAAKIRECGLYPTKPRIQKYMLWKEAGRQCLYCGRSIEEE

QCLREGGMEVEHIIPKSVLYDDSYGNKTCACRRCNKEKGNRTALEYIRAKGREAEYMKRINDLL

KEKKISYSKHQRLRWLKEDIPSDFLERQLRLTQYISRQAMAILQQGIRRVSASEGGVTARLRSL

WGYGKILHTLNLDRYDSMGETERVSREGEATEELHITNWSKRMDHRHHAIDALVVACTRQSYIQ

RLNRLSSEFGREDKKKEDQEAQEQQATETGRLSNLERWLTQRPHFSVRTVSDKVAEILISYRPG

QRVVTRGRNIYRKKMADGREVSCVQRGVLVPRGELMEASFYGKILSQGRVRIVKRYPLHDLKGE

VVDPHLRELITTYNQELKSREKGAPIPPLCLDKDKKQEVRSVRCYAKTLSLDKAIPMCFDEKGE

PTAFVKSASNHHLALYRTPKGKLVESIVTFWDAVDRARYGIPLVITHPREVMEQVLQRGDIPEQ

VLSLLPPSDWVFVDSLQQDEMVVIGLSDEELQRALEAQNYRKISEHLYRVQKMSSSYYVFRYHL

ETSVADDKNTSGRIPKFHRVQSLKAYEERNIRKVRVDLLGRISLL

SEQ ID NO: 346

MSDLVLGLDIGIGSVGVGILNKVTGEIIHKNSRIFPAAQAENNLVRRTNRQGRRLARRKKHRRV

RLNRLFEESGLITDFTKISINLNPYQLRVKGLTDELSNEELFIALKNMVKHRGISYLDDASDDG

NSSVGDYAQIVKENSKQLETKTPGQIQLERYQTYGQLRGDFTVEKDGKKHRLINVFPTSAYRSE

ALRILQTQQEFNPQITDEFINRYLEILTGKRKYYHGPGNEKSRTDYGRYRTSGETLDNIFGILI

GKCTFYPDEFRAAKASYTAQEFNLLNDLNNLTVPTETKKLSKEQKNQIINYVKNEKAMGPAKLF

KYIAKLLSCDVADIKGYRIDKSGKAEIHTFEAYRKMKTLETLDIEQMDRETLDKLAYVLTLNTE

REGIQEALEHEFADGSFSQKQVDELVQFRKANSSIFGKGWHNFSVKLMMELIPELYETSEEQMT

ILTRLGKQKTTSSSNKTKYIDEKLLTEEIYNPVVAKSVRQAIKIVNAAIKEYGDFDNIVIEMAR

-continued

ETNEDDEKKAIQKIQKANKDEKDAAMLKAANQYNGKAELPHSVFHGHKQLATKIRLWHQQGERC
LYTGKTISIHDLINNSNQFEVDHILPLSITFDDSLANKVLVYATANQEKGQRTPYQALDSMDDA
WSFRELKAFVRESKTLSNKKKEYLLTEEDISKFDVRKKFIERNLVDTRYASRVVLNALQEHFRA
HKIDTKVSVVRGQFTSQLRRHWGIEKTRDTYHHHAVDALIIAASSQLNLWKKQKNTLVSYSEDQ
LLDIETGELISDDEYKESVFKAPYQHFVDTLKSKEFEDSILFSYQVDSKFNRKISDATIYATRQ
AKVGKDKADETYVLGKIKDIYTQDGYDAFMKIYKKDKSKFLMYRHDPQTFEKVIEPILENYPNK
QINEKGKEVPCNPFLKYKEEHGYIRKYSKKGNGPEIKSLKYYDSKLGNHIDITPKDSNNKVVLQ
SVSPWRADVYFNKTTGKYEILGLKYADLQFEKGTGTYKISQEKYNDIKKKEGVDSDSEFKFTLY
KNDLLLVKDTETKEQQLFRFLSRTMPKQKHYVELKPYDKQKFEGGEALIKVLGNVANSGQCKKG
LGKSNISIYKVRTDVLGNQHIIKNEGDKPKLDF

SEQ ID NO: 347
MNAEHGKEGLLIMEENFQYRIGLDIGITSVGWAVLQNNSQDEPVRITDLGVRIFDVAENPKNGD
ALAAPRRDARTTRRRLRRRRHRLERIKFLLQENGLIEMDSFMERYYKGNLPDVYQLRYEGLDRK
LKDEELAQVLIHIAKHRGFRSTRKAETKEKEGGAVLKATTENQKIMQEKGYRTVGEMLYLDEAF
HTECLWNEKGYVLTPRNRPDDYKHTILRSMLVEEVHAIFAAQRAHGNQKATEGLEEAYVEIMTS
QRSFDMGPGLQPDGKPSPYAMEGFGDRVGKCTFEKDEYRAPKATYTAELFVALQKINHTKLIDE
FGTGRFFSEEERKTIIGLLLSSKELKYGTIRKKLNIDPSLKFNSLNYSAKKEGETEEERVLDTE
KAKFASMFWTYEYSKCLKDRTEEMPVGEKADLFDRIGEILTAYKNDDSRSSRLKELGLSGEEID
GLLDLSPAKYQRVSLKAMRKMQPYLEDGLIYDKACEAAGYDFRALNDGNKKHLLKGEEINAIVN
DITNPVVKRSVSQTIKVINAIIQKYGSPQAVNIELAREMSKNFQDRTNLEKEMKKRQQENERAK
QQIIELGKQNPTGQDILKYRLWNDQGGYCLYSGKKIPLEELFDGGYDIDHILPYSITFDDSYRN
KVLVTAQENRQKGNRTPYEYFGADEKRWEDYEASVRLLVRDYKKQQKLLKKNFTEEERKEFKER
NLNDTKYITRVVYNMIRQNLELEPFNHPEKKKQVWAVNGAVTSYLRKRWGLMQKDRSTDRHHAM
DAVVIACCTDGMIHKISRYMQGRELAYSRNFKFPDEETGEILNRDNFTREQWDEKFGVKVPLPW
NSFRDELDIRLLNEDPKNFLLTHADVQRELDYPGWMYGEEESPIEEGRYINYIRPLFVSRMPNH
KVTGSAHDATIRSARDYETRGVVITKVPLTDLKLNKDNEIEGYYDKDSDRLLYQALVRQLLLHG
NDGKKAFAEDFHKPKADGTEGPVVRKVKIEKKQTSGVMVRGGTGIAANGEMVRIDVFRENGKYY
FVPVYTADVVRKVLPNRAATHTKPYSEWRVMDDANFVFSLYSRDLIHVKSKKDIKTNLVNGGLL
LQKEIFAYYTGADIATASIAGFANDSNFKFRGLGIQSLEIFEKCQVDILGNISVVRHENRQEFH

SEQ ID NO: 348
MRVLGLDAGIASLGWALIEIEESNRGELSQGTIIGAGTWMFDAPEEKTQAGAKLKSEQRRTFRG
QRRVVRRRRQRMNEVRRILHSHGLLPSSDRDALKQPGLDPWRIRAEALDRLLGPVELAVALGHI
ARHRGFKSNSKGAKTNDPADDTSKMKRAVNETREKLARFGSAAKMLVEDESFVLRQTPTKNGAS
EIVRRFRNREGDYSRSLLRDDLAAEMRALFTAQARFQSAIATADLQTAFTKAAFFQRPLQDSEK
LVGPCPFEVDEKRAPKRGYSFELFRFLSRLNHVTLRDGKQERTLTRDELALAAADFGAAAKVSF
TALRKKLKLPETTVFVGVKADEESKLDVVARSGKAAEGTARLRSVIVDALGELAWGALLCSPEK
LDKIAEVISFRSDIGRISEGLAQAGCNAPLVDALTAAASDGRFDPFTGAGHISSKAARNILSGL
RQGMTYDKACCAADYDHTASRERGAFDVGGHGREALKRILQEERISRELVGSPTARKALIESIK
QVKAIVERYGVPDRIHVELARDVGKSIEEREEITRGIEKRNRQKDKLRGLFEKEVGRPPQDGAR
GKEELLRFELWSEQMGRCLYTDDYISPSQLVATDDAVQVDHILPWSRFADDSYANKTLCMAKAN
QDKKGRTPYEWFKAEKTDTEWDAFIVRVEALADMKGFKKRNYKLRNAEEAAAKFRNRNLNDTRW

```
                                                          -continued
ACRLLAEALKQLYPKGEKDKDGKERRRVFSRPGALTDRLRRAWGLQWMKKSTKGDRIPDDRHHA

LDAIVIAATTESLLQRATREVQEIEDKGLHYDLVKNVTPPWPGFREQAVEAVEKVFVARAERRR

ARGKAHDATIRHIAVREGEQRVYERRKVAELKLADLDRVKDAERNARLIEKLRNWIEAGSPKDD

PPLSPKGDPIFKVRLVTKSKVNIALDTGNPKRPGTVDRGEMARVDVFRKASKKGKYEYYLVPIY

PHDIATMKTPPIRAVQAYKPEDEWPEMDSSYEFCWSLVPMTYLQVISSKGEIFEGYYRGMNRSV

GAIQLSAHSNSSDVVQGIGARTLTEFKKFNVDRFGRKHEVERELRTWRGETWRGKAYI

SEQ ID NO: 349
MGNYYLGLDVGIGSIGWAVINIEKKRIEDFNVRIFKSGEIQEKNRNSRASQQCRRSRGLRRLYR

RKSHRKLRLKNYLSIIGLTTSEKIDYYYETADNNVIQLRNKGLSEKLTPEEIAACLIHICNNRG

YKDFYEVNVEDIEDPDERNEYKEEHDSIVLISNLMNEGGYCTPAEMICNCREFDEPNSVYRKFH

NSAASKNHYLITRHMLVKEVDLILENQSKYYGILDDKTIAKIKDIIFAQRDFEIGPGKNERFRR

FTGYLDSIGKCQFFKDQERGSRFTVIADIYAFVNVLSQYTYTNNRGESVFDTSFANDLINSALK

NGSMDKRELKAIAKSYHIDISDKNSDTSLTKCFKYIKVVKPLFEKYGYDWDKLIENYTDTDNNV

LNRIGIVLSQAQTPKRRREKLKALNIGLDDGLINELTKLKLSGTANVSYKYMQGSIEAFCEGDL

YGKYQAKFNKEIPDIDENAKPQKLPPFKNEDDCEFFKNPVVFRSINETRKLINAIIDKYGYPAA

VNIETADELNKTFEDRAIDTKRNNDNQKENDRIVKEIIECIKCDEVHARHLIEKYKLWEAQEGK

CLYSGETITKEDMLRDKDKLFEVDHIVPYSLILDNTINNKALVYAEENQKKGQRTPLMYMNEAQ

AADYRVRVNTMFKSKKCSKKKYQYLMLPDLNDQELLGGWRSRNLNDTRYICKYLVNYLRKNLRF

DRSYESSDEDDLKIRDHYRVFPVKSRFTSMFRRWWLNEKTWGRYDKAELKKLTYLDHAADAIII

ANCRPEYVVLAGEKLKLNKMYHQAGKRITPEYEQSKKACIDNLYKLFRMDRRTAEKLLSGHGRL

TPIIPNLSEEVDKRLWDKNIYEQFWKDDKDKKSCEELYRENVASLYKGDPKFASSLSMPVISLK

PDHKYRGTITGEEAIRVKEIDGKLIKLKRKSISEITAESINSIYTDDKILIDSLKTIFEQADYK

DVGDYLKKTNQHFFTTSSGKRVNKVTVIEKVPSRWLRKEIDDNNFSLLNDSSYYCIELYKDSKG

DNNLQGIAMSDIVHDRKTKKLYLKPDFNYPDDYYTHVMYIFPGDYLRIKSTSKKSGEQLKFEGY

FISVKNVNENSFRFISDNKPCAKDKRVSITKKDIVIKLAVDLMGKVQGENNGKGISCGEPLSLL

KEKN

SEQ ID NO: 350
MLSRQLLGASHLARPVSYSYNVQDNDVHCSYGERCFMRGKRYRIGIDVGLNSVGLAAVEVSDEN

SPVRLLNAQSVIHDGGVDPQKNKEAITRKNMSGVARRTRRMRRRKRERLHKLDMLLGKFGYPVI

EPESLDKPFEEWHVRAELATRYIEDDELRRESISIALRHMARHRGWRNPYRQVDSLISDNPYSK

QYGELKEKAKAYNDDATAAEEESTPAQLVVAMLDAGYAEAPRLRWRTGSKKPDAEGYLPVRLMQ

EDNANELKQIFRVQRVPADEWKPLFRSVFYAVSPKGSAEQRVGQDPLAPEQARALKASLAFQEY

RIANVITNLRIKDASAELRKLTVDEKQSIYDQLVSPSSEDITWSDLCDFLGFKRSQLKGVGSLT

EDGEERISSRPPRLTSVQRIYESDNKIRKPLVAWWKSASDNEHEAMIRLLSNTVDIDKVREDVA

YASAIEFIDGLDDDALTKLDSVDLPSGRAAYSVETLQKLTRQMLTTDDDLHEARKTLFNVTDSW

RPPADPIGEPLGNPSVDRVLKNVNRYLMNCQQRWGNPVSVNIEHVRSSFSSVAFARKDKREYEK

NNEKRSIFRSSLSEQLRADEQMEKVRESDLRRLEAIQRQNGQCLYCGRTITFRTCEMDHIVPRK

GVGSTNTRTNFAAVCAECNRMKSNTPFAIWARSEDAQTRGVSLAEAKKRVTMFTFNPKSYAPRE

VKAFKQAVIARLQQTEDDAAIDNRSIESVAWMADELHRRIDWYFNAKQYVNSASIDDAEAETMK

TTVSVFQGRVTASARRAAGIEGKIHFIGQQSKTRLDRRHHAVDASVIAMMNTAAAQTLMERESL

RESQRLIGLMPGERSWKEYPYEGTSRYESFHLWLDNMDVLLELLNDALDNDRIAVMQSQRYVLG

NSIAHDATIHPLEKVPLGSAMSADLIRRASTPALWCALTRLPDYDEKEGLPEDSHREIRVHDTR
```

-continued

YSADDEMGFFASQAAQIAVQEGSADIGSAIHHARVYRCWKTNAKGVRKYFYGMIRVFQTDLLRA

CHDDLFTVPLPPQSISMRYGEPRVVQALQSGNAQYLGSLVVGDEIEMDFSSLDVDGQIGEYLQF

FSQFSGGNLAWKHWVVDGFFNQTQLRIRPRYLAAEGLAKAFSDDVVPDGVQKIVTKQGWLPPVN

TASKTAVRIVRRNAFGEPRLSSAHHMPCSWQWRHE

SEQ ID NO: 351
MYSIGLDLGISSVGWSVIDERTGNVIDLGVRLFSAKNSEKNLERRTNRGGRRLIRRKTNRLKDA

KKILAAVGFYEDKSLKNSCPYQLRVKGLTEPLSRGEIYKVTLHILKKRGISYLDEVDTEAAKES

QDYKEQVRKNAQLLTKYTPGQIQLQRLKENNRVKTGINAQGNYQLNVFKVSAYANELATILKTQ

QAFYPNELTDDWIALFVQPGIAEEAGLIYRKRPYYHGPGNEANNSPYGRWSDFQKTGEPATNIF

DKLIGKDFQGELRASGLSLSAQQYNLLNDLTNLKIDGEVPLSSEQKEYILTELMTKEFTRFGVN

DVVKLLGVKKERLSGWRLDKKGKPEIHTLKGYRNWRKIFAEAGIDLATLPTETIDCLAKVLTLN

TEREGIENTLAFELPELSESVKLLVLDRYKELSQSISTQSWHRFSLKTLHLLIPELMNATSEQN

TLLEQFQLKSDVRKRYSEYKKLPTKDVLAEIYNPTVNKTVSQAFKVIDALLVKYGKEQIRYITI

EMPRDDNEEDEKKRIKELHAKNSQRKNDSQSYFMQKSGWSQEKFQTTIQKNRRFLAKLLYYYEQ

DGICAYTGLPISPELLVSDSTEIDHIIPISISLDDSINNKVLVLSKANQVKGQQTPYDAWMDGS

FKKINGKFSNWDDYQKWVESRHFSHKKENNLLETRNIFDSEQVEKFLARNLNDTRYASRLVLNT

LQSFFTNQETKVRVVNGSFTHTLRKKWGADLDKTRETHHHHAVDATLCAVTSFVKVSRYHYAVK

EETGEKVMREIDFETGEIVNEMSYWEFKKSKKYERKTYQVKWPNFREQLKPVNLHPRIKFSHQV

DRKANRKLSDATIYSVREKTEVKTLKSGKQKITTDEYTIGKIKDIYTLDGWEAFKKKQDKLLMK

DLDEKTYERLLSIAETTPDFQEVEEKNGKVKRVKRSPFAVYCEENDIPAIQKYAKKNNGPLIRS

LKYYDGKLNKHINITKDSQGRPVEKTKNGRKVTLQSLKPYRYDIYQDLETKAYYTVQLYYSDLR

FVEGKYGITEKEYMKKVAEQTKGQVVRFCFSLQKNDGLEIEWKDSQRYDVRFYNFQSANSINFK

GLEQEMMPAENQFKQKPYNNGAINLNIAKYGKEGKKLRKFNTDILGKKHYLFYEKEPKNIIK

SEQ ID NO: 352
MYFYKNKENKLNKKVVLGLDLGIASVGWCLTDISQKEDNKFPIILHGVRLFETVDDSDDKLLNE

TRRKKRGQRRRNRRLFTRKRDFIKYLIDNNIIELEFDKNPKILVRNFIEKYINPFSKNLELKYK

SVTNLPIGFHNLRKAAINEKYKLDKSELIVLLYFYLSLRGAFFDNPEDTKSKEMNKNEIEIFDK

NESIKNAEFPIDKIIEFYKISGKIRSTINLKFGHQDYLKEIKQVFEKQNIDFMNYEKFAMEEKS

FFSRIRNYSEGPGNEKSFSKYGLYANENGNPELIINEKGQKIYTKIFKTLWESKIGKCSYDKKL

YRAPKNSFSAKVFDITNKLTDWKHKNEYISERLKRKILLSRFLNKDSKSAVEKILKEENIKFEN

LSEIAYNKDDNKINLPIINAYHSLTTIFKKHLINFENYLISNENDLSKLMSFYKQQSEKLFVPN

EKGSYEINQNNNVLHIFDAISNILNKFSTIQDRIRILEGYFEFSNLKKDVKSSEIYSEIAKLRE

FSGTSSLSFGAYYKFIPNLISEGSKNYSTISYEEKALQNQKNNFSHSNLFEKTWVEDLIASPTV

KRSLRQTMNLLKEIFKYSEKNNLEIEKIVVEVTRSSNNKHERKKIEGINKYRKEKYEELKKVYD

LPNENTTLLKKLWLLRQQQGYDAYSLRKIEANDVINKPWNYDIDHIVPRSISFDDSFSNLVIVN

KLDNAKKSNDLSAKQFIEKIYGIEKLKEAKENWGNWYLRNANGKAFNDKGKFIKLYTIDNLDEF

DNSDFINRNLSDTSYITNALVNHLTFSNSKYKYSVVSVNGKQTSNLRNQIAFVGIKNNKETERE

WKRPEGFKSINSNDFLIREEGKNDVKDDVLIKDRSFNGHHAEDAYFITIISQYFRSFKRIERLN

VNYRKETRELDDLEKNNIKFKEKASFDNFLLINALDELNEKLNQMRFSRMVITKKNTQLFNETL

YSGKYDKGKNTIKKVEKLNLLDNRTDKIKKIEEFFDEDKLKENELTKLHIFNHDKNLYETLKII

WNEVKIEIKNKNLNEKNYFKYFVNKKLQEGKISFNEWVPILDNDFKIIRKIRYIKFSSEEKETD

-continued

EIIFSQSNFLKIDQRQNFSFHNTLYWVQIWVYKNQKDQYCFISIDARNSKFEKDEIKINYEKLK

TQKEKLQIINEEPILKINKGDLFENEEKELFYIVGRDEKPQKLEIKYILGKKIKDQKQIQKPVK

KYFPNWKKVNLTYMGEIFKK

SEQ ID NO: 353

MDKNYRIGIDVGLNSIGFCAVEVDQHDTPLGFLNLSVYRHDAGIDPNGKKTNTTRLAMSGVAR

RTRRLFRKRKRRLAALDRFIEAQGWTLPDHADYKDPYTPWLVRAELAQTPIRDENDLHEKLAIA

VRHIARHRGWRSPWVPVRSLHVEQPPSDQYLALKERVEAKTLLQMPEGATPAEMVVALDLSVDV

NLRPKNREKTDTRPENKKPGFLGGKLMQSDNANELRKIAKIQGLDDALLRELIELVFAADSPKG

ASGELVGYDVLPGQHGKRRAEKAHPAFQRYRIASIVSNLRIRHLGSGADERLDVETQKRVFEYL

LNAKPTADITWSDVAEEIGVERNLLMGTATQTADGERASAKPPVDVTNVAFATCKIKPLKEWWL

NADYEARCVMVSALSHAEKLTEGTAAEVEVAEFLQNLSDEDNEKLDSFSLPIGRAAYSVDSLER

LTKRMIENGEDLFEARVNEFGVSEDWRPPAEPIGARVGNPAVDRVLKAVNRYLMAAEAEWGAPL

SVNIEHVREGFISKRQAVEIDRENQKRYQRNQAVRSQIADHINATSGVRGSDVTRYLAIQRQNG

ECLYCGTAITFVNSEMDHIVPRAGLGSTNTRDNLVATCERCNKSKSNKPFAVWAAECGIPGVSV

AEALKRVDFWIADGFASSKEHRELQKGVKDRLKRKVSDPEIDNRSMESVAWMARELAHRVQYYF

DEKHTGTKVRVFRGSLTSAARKASGFESRVNFIGGNGKTRLDRRHHAMDAATVAMLRNSVAKTL

VLRGNIRASERAIGAAETWKSFRGENVADRQIFESWSENMRVLVEKFNLALYNDEVSIFSSLRL

QLGNGKAHDDTITKLQMHKVGDAWSLTEIDRASTPALWCALTRQPDFTWKDGLPANEDRTIIVN

GTHYGPLDKVGIFGKAAASLLVRGGSVDIGSAIHHARIYRIAGKKPTYGMVRVFAPDLLRYRNE

DLFNVELPPQSVSMRYAEPKVREAIREGKAEYLGWLVVGDELLLDLSSETSGQIAELQQDFPGT

THWTVAGFFSPSRLRLRPVYLAQEGLGEDVSEGSKSIIAGQGWRPAVNKVFGSAMPEVIRRDGL

GRKRRFSYSGLPVSWQG

SEQ ID NO: 354

MRLGLDIGTSSIGWWLYETDGAGSDARITGVVDGGVRIFSDGRDPKSGASLAVDRRAARAMRRR

RDRYLRRRATLMKVLAETGLMPADPAEAKALEALDPFALRAAGLDEPLPLPHLGRALFHLNQRR

GFKSNRKTDRGDNESGKIKDATARLDMEMMANGARTYGEFLHKRRQKATDPRHVPSVRTRLSIA

NRGGPDGKEEAGYDFYPDRRHLEEEFHKLWAAQGAHHPELTETLRDLLFEKIFFQRPLKEPEVG

LCLFSGHHGVPPKDPRLPKAHPLTQRRVLYETVNQLRVTADGREARPLTREERDQVIHALDNKK

PTKSLSSMVLKLPALAKVLKLRDGERFTLETGVRDAIACDPLRASPAHPDRFGPRWSILDADAQ

WEVISRIRRVQSDAEHAALVDWLTEAHGLDRAHAEATAHAPLPDGYGRLGLTATTRILYQLTAD

VVTYADAVKACGWHHSDGRTGECFDRLPYYGEVLERHVIPGSYHPDDDDITRFGRITNPTVHIG

LNQLRRLVNRIIETHGKPHQIVVELARDLKKSEEQKRADIKRIRDTTEAAKKRSEKLEELEIED

NGRNRMLLRLWEDLNPDDAMRRFCPYTGTRISAAMIFDGSCDVDHILPYSRTLDDSFPNRTLCL

REANRQKRNQTPWQAWGDTPHWHAIAANLKNLPENKRWRFAPDAMTRFEGENGFLDRALKDTQY

LARISRSYLDTLFTKGGHVWVVPGRFTEMLRRHWGLNSLLSDAGRGAVKAKNRTDHRHHAIDAA

VIAATDPGLLNRISRAAGQGEAAGQSAELIARDTPPPWEGFRDDLRVRLDRIIVSHRADHGRID

HAARKQGRDSTAGQLHQETAYSIVDDIHVASRTDLLSLKPAQLLDEPGRSGQVRDPQLRKALRV

ATGGKTGKDFENALRYFASKPGPYQAIRRVRIIKPLQAQARVPVPAQDPIKAYQGGSNHLFEIW

RLPDGEIEAQVITSFEAHTLEGEKRPHPAAKRLLRVHKGDMVALERDGRRVVGHVQKMDIANGL

FIVPHNEANADTRNNDKSDPFKWIQIGARPAIASGIRRVSVDEIGRLRDGGTRPI

SEQ ID NO: 355

MLHCIAVIRVPPSEEPGFFETHADSCALCHHGCMTYAANDKAIRYRVGIDVGLRSIGFCAVEVD
DEDHPIRILNSVVHVHDAGTGGPGETESLRKRSGVAARARRRGRAEKQRLKKLDVLLEELGWGV
SSNELLDSHAPWHIRKRLVSEYIEDETERRQCLSVAMAHIARHRGWRNSFSKVDTLLLEQAPSD
RMQGLKERVEDRTGLQFSEEVTQGELVATLLEHDGDVTIRGFVRKGGKATKVHGVLEGKYMQSD
LVAELRQICRTQRVSETTFEKLVLSIFHSKEPAPSAARQRERVGLDELQLALDPAAKQPRAERA
HPAFQKFKVVATLANMRIREQSAGERSLTSEELNRVARYLLNHTESESPTWDDVARKLEVPRHR
LRGSSRASLETGGGLTYPPVDDTTVRVMSAEVDWLADWWDCANDESRGHMIDAISNGCGSEPDD
VEDEEVNELISSATAEDMLKLELLAKKLPSGRVAYSLKTLREVTAAILETGDDLSQAITRLYGV
DPGWVPTPAPIEAPVGNPSVDRVLKQVARWLKFASKRWGVPQTVNIEHTREGLKSASLLEEERE
RWERFEARREIRQKEMYKRLGISGPFRRSDQVRYEILDLQDCACLYCGNEINFQTFEVDHIIPR
VDASSDSRRTNLAAVCHSCNSAKGGLAFGQWVKRGDCPSGVSLENAIKRVRSWSKDRLGLTEKA
MGKRKSEVISRLKTEMPYEEFDGRSMESVAWMAIELKKRIEGYFNSDRPEGCAAVQVNAYSGRL
TACARRAAHVDKRVRLIRLKGDDGHHKNRFDRRNHAMDALVIALMTPAIARTIAVREDRREAQQ
LTRAFESWKNFLGSEERMQDRWESWIGDVEYACDRLNELIDADKIPVTENLRLRNSGKLHADQP
ESLKKARRGSKRPRPQRYVLGDALPADVINRVTDPGLWTALVRAPGFDSQLGLPADLNRGLKLR
GKRISADFPIDYFPTDSPALAVQGGYVGLEFHHARLYRIIGPKEKVKYALLRVCAIDLCGIDCD
DLFEVELKPSSISMRTADAKLKEAMGNGSAKQIGWLVLGDEIQIDPTKFPKQSIGKFLKECGPV
SSWRVSALDTPSKITLKPRLLSNEPLLKTSRVGGHESDLVVAECVEKIMKKTGWVVEINALCQS
GLIRVIRRNALGEVRTSPKSGLPISLNLR

SEQ ID NO: 356

MRYRVGLDLGTASVGAAVFSMDEQGNPMELIWHYERLFSEPLVPDMGQLKPKKAARRLARQQRR
QIDRRASRLRRIAIVSRRLGIAPGRNDSGVHGNDVPTLRAMAVNERIELGQLRAVLLRMGKKRG
YGGTFKAVRKVGEAGEVASGASRLEEEMVALASVQNKDSVTVGEYLAARVEHGLPSKLKVAANN
EYYAPEYALFRQYLGLPAIKGRPDCLPNMYALRHQIEHEFERIWATQSQFHDVMKDHGVKEEIR
NAIFFQRPLKSPADKVGRCSLQTNLPRAPRAQIAAQNFRIEKQMADLRWGMGRRAEMLNDHQKA
VIRELLNQQKELSFRKIYKELERAGCPGPEGKGLNMDRAALGGRDDLSGNTTLAAWRKLGLEDR
WQELDEVTQIQVINFLADLGSPEQLDTDDWSCRFMGKNGRPRNFSDEFVAFMNELRMTDGFDRL
SKMGFEGGRSSYSIKALKALTEWMIAPHWRETPETHRVDEEAAIRECYPESLATPAQGGRQSKL
EPPPLTGNEVVDVALRQVRHTINMMIDDLGSVPAQIVVEMAREMKGGVTRRNDIEKQNKRFASE
RKKAAQSIEENGKTPTPARILRYQLWIEQGHQCPYCESNISLEQALSGAYTNFEHILPRTLTQI
GRKRSELVLAHRECNDEKGNRTPYQAFGHDDRRWRIVEQRANALPKKSSRKTRLLLLKDFEGEA
LTDESIDEFADRQLHESSWLAKVTTQWLSSLGSDVYVSRGSLTAELRRRWGLDTVIPQVRFESG
MPVVDEEGAEITPEEFEKFRLQWEGHRVTREMRTDRRPDKRIDHRHHLVDAIVTALTSRSLYQQ
YAKAWKVADEKQRHGRVDVKVELPMPILTIRDIALEAVRSVRISHKPDRYPDGRFFEATAYGIA
QRLDERSGEKVDWLVSRKSLTDLAPEKKSIDVDKVRANISRIVGEAIRLHISNIFEKRVSKGMT
PQQALREPIEFQGNILRKVRCFYSKADDCVRIEHSSRRGHHYKMLLNDGFAYMEVPCKEGILYG
VPNLVRPSEAVGIKRAPESGDFIRFYKGDTVKNIKTGRVYTIKQILGDGGGKLILTPVTETKPA
DLLSAKWGRLKVGGRNIHLLRLCAE

SEQ ID NO: 357

MIGEHVRGGCLFDDHWTPNWGAFRLPNTVRTFTKAENPKDGSSLAEPRRQARGLRRRLRRKTQR
LEDLRRLLAKEGVLSLSDLETLFRETPAKDPYQLRAEGLDRPLSFPEWVRVLYHITKHRGFQSN

```
RRNPVEDGQERSRQEEEGKLLSGVGENERLLREGGYRTAGEMLARDPKFQDHRRNRAGDYSHTL

SRSLLLEEARRLFQSQRTLGNPHASSNLEEAFLHLVAFQNPFASGEDIRNKAGHCSLEPDQIRA

PRRSASAETFMLLQKTGNLRLIHRRTGEERPLTDKEREQIHLLAWKQEKVTHKTLRRHLEIPEE

WLFTGLPYHRSGDKAEEKLFVHLAGIHEIRKALDKGPDPAVWDTLRSRRDLLDSIADTLTFYKN

EDEILPRLESLGLSPENARALAPLSFSGTAHLSLSALGKLLPHLEEGKSYTQARADAGYAAPPP

DRHPKLPPLEEADWRNPVVFRALTQTRKVVNALVRRYGPPWCIHLETARELSQPAKVRRRIETE

QQANEKKKQQAEREFLDIVGTAPGPGDLLKMRLWREQGGFCPYCEEYLNPTRLAEPGYAEMDHI

LPYSRSLDNGWHNRVLVHGKDNRDKGNRTPFEAFGGDTARWDRLVAWVQASHLSAPKKRNLLRE

DFGEEAERELKDRNLTDTRFITKTAATLLRDRLTFHPEAPKDPVMTLNGRLTAFLRKQWGLHKN

RKNGDLHHALDAAVLAVASRSFVYRLSSHNAAWGELPRGREAENGFSLPYPAFRSEVLARLCPT

REEILLRLDQGGVGYDEAFRNGLRPVFVSRAPSRRLRGKAHMETLRSPKWKDHPEGPRTASRIP

LKDLNLEKLERMVGKDRDRKLYEALRERLAAFGGNGKKAFVAPFRKPCRSGEGPLVRSLRIFDS

GYSGVELRDGGEVYAVADHESMVRVDVYAKKNRFYLVPVYVADVARGIVKNRAIVAHKSEEEWD

LVDGSFDFRFSLFPGDLVEIEKKDGAYLGYYKSCHRGDGRLLLDRHDRMPRESDCGTFYVSTRK

DVLSMSKYQVDPLGEIRLVGSEKPPFVL

SEQ ID NO: 358
MEKKRKVTLGFDLGIASVGWAIVDSETNQVYKLGSRLFDAPDTNLERRTQRGTRRLLRRRKYRN

QKFYNLVKRTEVFGLSSREAIENRFRELSIKYPNIIELKTKALSQEVCPDEIAWILHDYLKNRG

YFYDEKETKEDFDQQTVESMPSYKLNEFYKKYGYFKGALSQPTESEMKDNKDLKEAFFFDFSNK

EWLKEINYFFNVQKNILSETFIEEFKKIFSFTRDISKGPGSDNMPSPYGIFGEFGDNGQGGRYE

HIWDKNIGKCSIFTNEQRAPKYLPSALIFNFLNELANIRLYSTDKKNIQPLWKLSSVDKLNILL

NLFNLPISEKKKKLTSTNINDIVKKESIKSIMISVEDIDMIKDEWAGKEPNVYGVGLSGLNIEE

SAKENKFKFQDLKILNVLINLLDNVGIKFEFKDRNDIIKNLELLDNLYLFLIYQKESNNKDSSI

DLFIAKNESLNIENLKLKLKEFLLGAGNEFENHNSKTHSLSKKAIDEILPKLLDNNEGWNLEAI

KNYDEEIKSQIEDNSSLMAKQDKKYLNDNFLKDAILPPNVKVTFQQAILIFNKIIQKFSKDFEI

DKVVIELAREMTQDQENDALKGIAKAQKSKKSLVEERLEANNIDKSVFNDKYEKLIYKIFLWIS

QDFKDPYTGAQISVNEIVNNKVEIDHIIPYSLCFDDSSANKVLVHKQSNQEKSNSLPYEYIKQG

HSGWNWDEFTKYVKRVFVNNVDSILSKKERLKKSENLLTASYDGYDKLGFLARNLNDTRYATIL

FRDQLNNYAEHHLIDNKKMFKVIAMNGAVTSFIRKNMSYDNKLRLKDRSDFSHHAYDAAIIALF

SNKTKTLYNLIDPSLNGIISKRSEGYWVIEDRYTGEIKELKKEDWTSIKNNVQARKIAKEIEEY

LIDLDDEVFFSRKTKRKTNRQLYNETIYGIATKTDEDGITNYYKKEKFSILDDKDIYLRLLRER

EKFVINQSNPEVIDQIIEIIESYGKENNIPSRDEAINIKYTKNKINYNLYLKQYMRSLTKSLDQ

FSEEFINQMIANKTFVLYNPTKNTTRKIKFLRLVNDVKINDIRKNQVINKFNGKNNEPKAFYEN

INSLGAIVFKNSANNFKTLSINTQIAIFGDKNWDIEDFKTYNMEKIEKYKEIYGIDKTYNFHSF

IFPGTILLDKQNKEFYYISSIQTVRDIIEIKFLNKIEFKDENKNQDTSKTPKRLMFGIKSIMNN

YEQVDISPFGINKKIFE

SEQ ID NO: 359
MGYRIGLDVGITSTGYAVLKTDKNGLPYKILTLDSVIYPRAENPQTGASLAEPRRIKRGLRRRT

RRTKFRKQRTQQLFIHSGLLSKPEIEQILATPQAKYSVYELRVAGLDRRLTNSELFRVLYFFIG

HRGFKSNRKAELNPENEADKKQMGQLLNSIEEIRKAIAEKGYRTVGELYLKDPKYNDHKRNKGY

IDGYLSTPNRQMLVDEIKQILDKQRELGNEKLTDEFYATYLLGDENRAGIFQAQRDFDEGPGAG
```

-continued

PYAGDQIKKMVGKDIFEPTEDRAAKATYTFQYFNLLQKMTSLNYQNTTGDTWHTLNGLDRQAII

DAVFAKAEKPTKTYKPTDFGELRKLLKLPDDARFNLVNYGSLQTQKEIETVEKKTRFVDFKAYH

DLVKVLPEEMWQSRQLLDHIGTALTLYSSDKRRRYFAEELNLPAELIEKLLPLNFSKFGHLSI

KSMQNIIPYLEMGQVYSEATTNTGYDFRKKQISKDTIREEITNPVVRRAVTKTIKIVEQIIRRY

GKPDGINIELARELGRNFKERGDIQKRQDKNRQTNDKIAAELTELGIPVNGQNIIRYKLHKEQN

GVDPYTGDQIPFERAFSEGYEVDHIIPYSISWDDSYTNKVLTSAKCNREKGNRIPMVYLANNEQ

RLNALTNIADNIIRNSRKRQKLLKQKLSDEELKDWKQRNINDTRFITRVLYNYFRQAIEFNPEL

EKKQRVLPLNGEVTSKIRSRWGFLKVREDGDLHHAIDATVIAAITPKFIQQVTKYSQHQEVKNN

QALWHDAEIKDAEYAAEAQRMDADLFNKIFNGFPLPWPEFLDELLARISDNPVEMMKSRSWNTY

TPIEIAKLKPVFVVRLANHKISGPAHLDTIRSAKLFDEKGIVLSRVSITKLKINKKGQVATGDG

IYDPENSNNGDKVVYSAIRQALEAHNGSGELAFPDGYLEYVDHGTKKLVRKVRVAKKVSLPVRL

KNKAAADNGSMVRIDVFNTGKKFVFVPIYIKDTVEQVLPNKAIARGKSLWYQITESDQFCFSLY

PGDMVHIESKTGIKPKYSNKENNTSVVPIKNFYGYFDGADIATASILVRAHDSSYTARSIGIAG

LLKFEKYQVDYFGRYHKVHEKKRQLFVKRDE

SEQ ID NO: 360
MQKNINTKQNHIYIKQAQKIKEKLGDKPYRIGLDLGVGSIGFAIVSMEENDGNVLLPKEIIMVG

SRIFKASAGAADRKLSRGQRNNHRHTRERMRYLWKVLAEQKLALPVPADLDRKENSSEGETSAK

RFLGDVLQKDIYELRVKSLDERLSLQELGYVLYHIAGHRGSSAIRTFENDSEEAQKENTENKKI

AGNIKRLMAKKNYRTYGEYLYKEFFENKEKHKREKISNAANNHKFSPTRDLVIKEAEAILKKQA

GKDGFHKELTEEYIEKLTKAIGYESEKLIPESGFCPYLKDEKRLPASHKLNEERRLWETLNNAR

YSDPIVDIVTGEITGYYEKQFTKEQKQKLFDYLLTGSELTPAQTKKLLGLKNTNFEDIILQGRD

KKAQKIKGYKLIKLESMPFWARLSEAQQDSFLYDWNSCPDEKLLTEKLSNEYHLTEEEIDNAFN

EIVLSSSYAPLGKSAMLIILEKIKNDLSYTEAVEEALKEGKLTKEKQAIKDRLPYYGAVLQEST

QKIIAKGFSPQFKDKGYKTPHTNKYELEYGRIANPVVHQTLNELRKLVNEIIDILGKKPCEIGL

ETARELKKSAEDRSKLSREQNDNESNRNRIYEIYIRPQQQVIITRRENPRNYILKFELLEEQKS

QCPFCGGQISPNDIINNQADIEHLFPIAESEDNGRNNLVISHSACNADKAKRSPWAAFASAAKD

SKYDYNRILSNVKENIPHKAWRFNQGAFEKFIENKPMAARFKTDNSYISKVAHKYLACLFEKPN

IICVKGSLTAQLRMAWGLQGLMIPFAKQLITEKESESFNKDVNSNKKIRLDNRHHALDAIVIAY

ASRGYGNLLNKMAGKDYKINYSERNWLSKILLPPNNIVWENIDADLESFESSVKTALKNAFISV

KHDHSDNGELVKGTMYKIFYSERGYTLTTYKKLSALKLTDPQKKKTPKDFLETALLKFKGRESE

MKNEKIKSAIENNKRLFDVIQDNLEKAKKLLEEENEKSKAEGKKEKNINDASIYQKAISLSGDK

YVQLSKKEPGKFFAISKPTPTTTGYGYDTGDSLCVDLYYDNKGKLCGEIIRKIDAQQKNPLKYK

EQGFTLFERIYGGDILEVDFDIHSDKNSFRNNTGSAPENRVFIKVGTFTEITNNNIQIWFGNII

KSTGGQDDSFTINSMQQYNPRKLILSSCGFIKYRSPILKNKEG

SEQ ID NO: 361
MAAFKPNPINYILGLDIGIASVGWAMVEIDEDENPICLIDLGVRVFERAEVPKTGDSLAMARRL

ARSVRRLTRRRAHRLLRARRLLKREGVLQAADFDENGLIKSLPNTPWQLRAAALDRKLTPLEWS

AVLLHLIKHRGYLSQRKNEGETADKELGALLKGVADNAHALQTGDFRTPAELALNKFEKESGHI

RNQRGDYSHTFSRKDLQAELILLFEKQKEFGNPHVSGGLKEGIETLLMTQRPALSGDAVQKMLG

HCTFEPAEPKAAKNTYTAERFIWLTKLNNLRILEQGSERPLTDTERATLMDEPYRKSKLTYAQA

RKLLGLEDTAFFKGLRYGKDNAEASTLMEMKAYHAISRALEKEGLKDKKSPLNLSPELQDEIGT

AFSLFKTDEDITGRLKDRIQPEILEALLKHISFDKFVQISLKALRRIVPLMEQGKRYDEACAEI

-continued

YGDHYGKKNTEEKIYLPPIPADEIRNPVVLRALSQARKVINGVVRRYGSPARIHIETAREVGKS

FKDRKEIEKRQEENRKDREKAAAKFREYFPNFVGEPKSKDILKLRLYEQQHGKCLYSGKEINLG

RLNEKGYVEIDHALPFSRTWDDSFNNKVLVLGSENQNKGNQTPYEYFNGKDNSREWQEFKARVE

TSRFPRSKKQRILLQKFDEDGFKERNLNDTRYVNRFLCQFVADRMRLTGKGKKRVFASNGQITN

LLRGFWGLRKVRAENDRHHALDAVVVACSTVAMQQKITRFVRYKEMNAFDGKTIDKETGEVLHQ

KTHFPQPWEFFAQEVMIRVFGKPDGKPEFEEADTPEKLRTLLAEKLSSRPEAVHEYVTPLFVSR

APNRKMSGQGHMETVKSAKRLDEGVSVLRVPLTQLKLKDLEKMVNEREPKLYEALKARLEAHK

DDPAKAFAEPFYKYDKAGNRTQQVKAVRVEQVQKTGVWVRNHNGIADNATMVRVDVFEKGDKYY

LVPIYSWQVAKGILPDRAVVQGKDEEDWQLIDDSFNFKFSLHPNDLVEVITKKARMFGYFASCH

RGTGNINIRIHDLDHKIGKNGILEGIGVKTALSFQKYQIDELGKEIRPCRLKKRPPVR

SEQ ID NO: 362
MQTTNLSYILGLDLGIASVGWAVVEINENEDPIGLIDVGVRIFERAEVPKTGESLALSRRLARS

TRRLIRRRAHRLLLAKRFLKREGILSTIDLEKGLPNQAWELRVAGLERRLSAIEWGAVLLHLIK

HRGYLSKRKNESQTNNKELGALLSGVAQNHQLLQSDDYRTPAELALKKFAKEEGHIRNQRGAYT

HTFNRLDLLAELNLLFAQQHQFGNPHCKEHIQQYMTELLMWQKPALSGEAILKMLGKCTHEKNE

FKAAKHTYSAERFVWLTKLNNLRILEDGAERALNEEERQLLINHPYEKSKLTYAQVRKLLGLSE

QAIFKHLRYSKENAESATFMELKAWHAIRKALENQGLKDTWQDLAKKPDLLDEIGTAFSLYKTD

EDIQQYLTNKVPNSVINALLVSLNFDKFIELSLKSLRKILPLMEQGKRYDQACREIYGHHYGEA

NQKTSQLLPAIPAQEIRNPVVLRTLSQARKVINAIIRQYGSPARVHIETGRELGKSFKERREIQ

KQQEDNRTKRESAVQKFKELFSDFSSEPKSKDILKFRLYEQQHGKCLYSGKEINIHRLNEKGYV

EIDHALPFSRTWDDSFNNKVLVLASENQNKGNQTPYEWLQGKINSERWKNFVALVLGSQCSAAK

KQRLLTQVIDDNKFIDRNLNDTRYIARFLSNYIQENLLLVGKNKKNVFTPNGQITALLRSRWGL

IKARENNNRRHHALDAIVVACATPSMQQKITRFIRFKEVHPYKIENRYEMVDQESGEIISPHFPE

PWAYFRQEVNIRVFDNHPDTVLKEMLPDRPQANHQFVQPLFVSRAPTRKMSGQGHMETIKSAKR

LAEGISVLRIPLTQLKPNLLENMVNKEREPALYAGLKARLAEFNQDPAKAFATPFYKQGGQQVK

AIRVEQVQKSGVLVRENNGVADNASIVRTDVFIKNNKFFLVPIYTWQVAKGILPNKAIVAHKNE

DEWEEMDEGAKFKFSLFPNDLVELKTKKEYFFGYYIGLDRATGNISLKEHDGEISKGKDGVYRV

GVKLALSFEKYQVDELGKNRQICRPQQRQPVR

SEQ ID NO: 363
MGIRFAFDLGTNSIGWAVVWRTGPGVFGEDTAASLDGSGVLIFKDGRNPKDGQSLATMRRVPRQS

RKRRDRFVLRRRDLLAALRKAGLFPVDVEEGRRLAATDPYHLRAKALDESLTPHEMGRVIFHLN

QRRGFRSNRKADRQDREKGKIAEGSKRLAETLAATNCRTLGEFLWSRHRGTPRTRSPTRIRMEG

EGAKALYAFYPTREMVRAEFERLWTAQSRFAPDLLTPERHEEIAGILFRQRDLAPPKIGCCTFE

PSERRLPRALPSVEARGIYERLAHLRITTGPVSDRGLTRPERDVLASALLAGKSLTFKAVRKTL

KILPHALVNFEEAGEKGLDGALTAKLLSKPDHYGAAWHGLSFAEKDTFVGKLLDEADEERLIRR

LVTENRLSEDAARRCASIPLADGYGRLGRTANTEILAALVEETDETGTVVTYAEAVRRAGERTG

RNWHHSDERDGVILDRLPYYGEILQRHVVPGSGEPEEKNEAARWGRLANPTVHIGLNQLRKVVN

RLIAAHGRPDQIVVELARELKLNREQKERLDRENRKNREENERRTAILAEHGQRDTAENKIRLR

LFEEQARANAGIALCPYTGRAIGIAELFTSEVEIDHILPVSLTLDDSLANRVLCRREANREKRR

QTPFQAFGATPAWNDIVARAAKLPPNKRWRFDPAALERFEREGGFLGRQLNETKYLSRLAKIYL

GKICDPDRVYVTPGTLTGLLRARWGLNSILSDSNFKNRSDHRHHAVDAVVIGVLTRGMIQRIAH

-continued

DAARAEDQDLDRVFRDVPVPFEDFRDHVRERVSTITVAVKPEHGKGGALHEDTSYGLVPDTDPN

AALGNLVVRKPIRSLTAGEVDRVRDRALRARLGALAAPFRDESGRVRDAKGLAQALEAFGAENG

IRRVRILKPDASVVTIADRRTGVPYRAVAPGENHHVDIVQMRDGSWRGFAASVFEVNRPGWRPE

WEVKKLGGKLVMRLHKGDMVELSDKDGQRRVKVVQQIEISANRVRLSPHNDGGKLQDRHADADD

PFRWDLATIPLLKDRGCVAVRVDPIGVVTLRRSNV

SEQ ID NO: 364
MMEVFMGRLVLGLDIGITSVGFGIIDLDESEIVDYGVRLFKEGTAAENETRRTKRGGRRLKRRR

VTRREDMLHLLKQAGIISTSFHPLNNPYDVRVKGLNERLNGEELATALLHLCKHRGSSVETIED

DEAKAKEAGETKKVLSMNDQLLKSGKYVCEIQKERLRTNGHIRGHENNFKTRAYVDEAFQILSH

QDLSNELKSAIITIISRKRMYYDGPGGPLSPTPYGRYTYFGQKEPIDLIEKMRGKCSLFPNEPR

APKLAYSAELFNLLNDLNNLSIEGEKLTSEQKAMILKIVHEKGKITPKQLAKEVGVSLEQIRGF

RIDTKGSPLLSELTGYKMIREVLEKSNDEHLEDHVFYDEIAEILTKTKDIEGRKKQISELSSDL

NEESVHQLAGLTKFTAYHSLSFKALRLINEEMLKTELNQMQSITLFGLKQNNELSVKGMKNIQA

DDTAILSPVAKRAQRETFKVVNRLREIYGEFDSIVVEMAREKNSEEQRKAIRERQKFFEMRNKQ

VADIIGDDRKINAKLREKLVLYQEQDGKTAYSLEPIDLKLLIDDPNAYEVDHIIPISISLDDSI

TNKVLVTHRENQEKGNLTPISAFVKGRFTKGSLAQYKAYCLKLKEKNIKTNKGYRKKVEQYLLN

ENDIYKYDIQKEFINRNLVDTSYASRVVLNTLTTYFKQNEIPTKVFTVKGSLTNAFRRKINLKK

DRDEDYGHHAIDALIIASMPKMRLLSTIFSRYKIEDIYDESTGEVFSSGDDSMYYDDRYFAFIA

SLKAIKVRKFSHKIDTKPNRSVADETIYSTRVIDGKEKVVKKYKDIYDPKFTALAEDILNNAYQ

EKYLMALHDPQTFDQIVKVVNYYFEEMSKSEKYFTKDKKGRIKISGMNPLSLYRDEHGMLKKYS

KKGDGPAITQMKYFDGVLGNHIDISAHYQVRDKKVVLQQISPYRTDFYYSKENGYKFVTIRYKD

VRWSEKKKKYVIDQQDYAMKKAEKKIDDTYEFQFSMHRDELIGITKAEGEALIYPDETWHNFNF

FFHAGETPEILKFTATNNDKSNKIEVKPIHCYCKMRLMPTISKKIVRIDKYATDVVGNLYKVKK

NTLKFEFD

SEQ ID NO: 365
MKKILGVDLGITSFGYAILQETGKDLYRCLDNSVVMRNNPYDEKSGESSQSIRSTQKSMRRLIE

KRKKRIRCVAQTMERYGILDYSETMKINDPKNNPIKNRWQLRAVDAWKRPLSPQELFAIFAHMA

KHRGYKSIATEDLIYELELELGLNDPEKESEKKADERRQVYNALRHLEELRKKYGGETIAQTIH

RAVEAGDLRSYRNHDDYEKMIRREDIEEEIEKVLLRQAELGALGLPEEQVSELIDELKACITDQ

EMPTIDESLFGKCTFYKDELAAPAYSYLYDLYRLYKKLADLNIDGYEVTQEDREKVIEWVEKKI

AQGKNLKKITHKDLRKILGLAPEQKIFGVEDERIVKGKKEPRTFVPFFFLADIAKFKELFASIQ

KHPDALQIFRELAEILQRSKTPQEALDRLRALMAGKGIDTDDRELLELFKNKRSGTRELSHRYI

LEALPLFLEGYDEKEVQRILGFDDREDYSRYPKSLRHLHLREGNLFEKEENPINNHAVKSLASW

ALGLIADLSWRYGPFDEIILETTRDALPEKIRKEIDKAMREREKALDKIIGKYKKEFPSIDKRL

ARKIQLWERQKGLDLYSGKVINLSQLLDGSADIEHIVPQSLGGLSTDYNTIVTLKSVNAAKGNR

LPGDWLAGNPDYRERIGMLSEKGLIDWKKRKNLLAQSLDEIYTENTHSKGIRATSYLEALVAQV

LKRYYPFPDPELRKNGIGVRMIPGKVTSKTRSLLGIKSKSRETNFHHAEDALILSTLTRGWQNR

LHRMLRDNYGKSEAELKELWKKYMPHIEGLTLADYIDEAFRRFMSKGEESLFYRDMFDTIRSIS

YWVDKKPLSASSHKETVYSSRHEVPTLRKNILEAFDSLNVIKDRHKLTTEEFMKRYDKEIRQKL

WLHRIGNTNDESYRAVEERATQIAQILTRYQLMDAQNDKEIDEKFQQALKELITSPIEVTGKLL

RKMRFVYDKLNAMQIDRGLVETDKNMLGIHISKGPNEKLIFRRMDVNNAHELQKERSGILCYLN

-continued

EMLFIFNKKGLIHYGCLRSYLEKGQGSKYIALFNPRFPANPKAQPSKFTSDSKIKQVGIGSATG

IIKAHLDLDGHVRSYEVFGTLPEGSIEWFKEESGYGRVEDDPHH

SEQ ID NO: 366
MRPIEPWILGLDIGTDSLGWAVFSCEEKGPPTAKELLGGGVRLFDSGRDAKDHTSRQAERGAFR

RARRQTRTWPWRRDRLIALFQAAGLTPPAAETRQIALALRREAVSRPLAPDALWAALLHLAHHR

GFRSNRIDKRERAAAKALAKAKPAKATAKATAPAKEADDEAGFWEGAEAALRQRMAASGAPTVG

ALLADDLDRGQPVRMRYNQSDRDGVVAPTRALIAEELAEIVARQSSAYPGLDWPAVTRLVLDQR

PLRSKGAGPCAFLPGEDRALRALPTVQDFIIRQTLANLRLPSTSADEPRPLTDEEHAKALALLS

TARFVEWPALRRALGLKRGVKFTAETERNGAKQAARGTAGNLTEAILAPLIPGWSGWDLDRKDR

VFSDLWAARQDRSALLALIGDPRGPTRVTEDETAEAVADAIQIVLPTGRASLSAKAARAIAQAM

APGIGYDEAVTLALGLHHSHRPRQERLARLPYYAAALPDVGLDGDPVGPPPAEDDGAAAEAYYG

RIGNISVHIALNETRKIVNALLHRHGPILRLVMVETTRELKAGADERKRMIAEQAERERENAEI

DVELRKSDRWMANARERRQRVRLARRQNNLCPYTSTPIGHADLLGDAYDIDHVIPLARGGRDSL

DNMVLCQSDANKTKGDKTPWEAFHDKPGWIAQRDDFLARLDPQTAKALAWRFADDAGERVARKS

AEDEDQGFLPRQLTDTGYIARVALRYLSLVTNEPNAVVATNGRLTGLLRLAWDITPGPAPRDLL

PTPRDALRDDTAARRFLDGLTPPPLAKAVEGAVQARLAALGRSRVADAGLADALGLTLASLGGG

GKNRADHRHHFIDAAMIAVTTRGLINQINQASGAGRILDLRKWPRTNFEPPYPTFRAEVMKQWD

HIHPSIRPAHRDGGSLHAATVFGVRNRPDARVLVQRKPVEKLFLDANAKPLPADKIAEIIDGFA

SPRMAKRFKALLARYQAAHPEVPPALAALAVARDPAFGPRGMTANTVIAGRSDGDGEDAGLITP

FRANPKAAVRTMGNAVYEVWEIQVKGRPRWTHRVLTRFDRTQPAPPPPPENARLVMRLRRGDLV

YWPLESGDRLFLVKKMAVDGRLALWPARLATGKATALYAQLSCPNINLNGDQGYCVQSAEGIRK

EKIRTTSCTALGRLRLSKKAT

SEQ ID NO: 367
MKYTLGLDVGIASVGWAVIDKDNNKIIDLGVRCFDKAEESKTGESLATARRIARGMRRRISRRS

QRLRLVKKLFVQYEIIKDSSEFNRIFDTSRDGWKDPWELRYNALSRILKPYELVQVLTHITKRR

GFKSNRKEDLSTTKEGVVITSIKNNSEMLRTKNYRTIGEMIFMETPENSNKRNKVDEYIHTIAR

EDLLNEIKYIFSIQRKLGSPFVTEKLEHDFLNIWEFQRPFASGDSILSKVGKCTLLKEELRAPT

SCYTSEYFGLLQSINNLVLVEDNNTLTLNNDQRAKIIEYAHFKNEIKYSEIRKLLDIEPEILFK

AHNLTHKNPSGNNESKKFYEMKSYHKLKSTLPTDIWGKLHSNKESLDNLFYCLTVYKNDNEIKD

YLQANNLDYLIEYIAKLPTFNKFKHLSLVAMKRIIPFMEKGYKYSDACNMAELDFTGSSKLEKC

NKLTVEPIIENVTNPVVIRALTQARKVINAIIQKYGLPYMVNIELAREAGMTRQDRDNLKKEHE

NNRKAREKISDLIRQNGRVASGLDILKWRLWEDQGGRCAYSGKPIPVCDLLNDSLTQIDHIYPY

SRSMDDSYMNKVLVLTDENQNKRSYTPYEVWGSTEKWEDFEARIYSMHLPQSKEKRLLNRNFIT

KDLDSFISRNLNDTRYISRFLKNYIESYLQFSNDSPKSCVVCVNGQCTAQLRSRWGLNKNREES

DLHHALDAAVIACADRKIIKEITNYYNERENHNYKVKYPLPWHSFRQDLMETLAGVFISRAPRR

KITGPAHDETIRSPKHFNKGLTSVKIPLTTVTLEKLETMVKNTKGGISDKAVYNVLKNRLIEHN

NKPLKAFAEKIYKPLKNGTNGAIIRSIRVETPSYTGVFRNEGKGISDNSLMVRVDVFKKKDKYY

LVPIYVAHMIKKELPSKAIVPLKPESQWELIDSTHEFLFSLYQNDYLVIKTKKGITEGYYRSCH

RGTGSLSLMPHFANNKNVKIDIGVRTAISIEKYNVDILGNKSIVKGEPRRGMEKYNSFKSN

SEQ ID NO: 368
MIRTLGIDIGIASIGWAVIEGEYTDKGLENKEIVASGVRVFTKAENPKNKESLALPRTLARSAR

RRNARKKGRIQQVKHYLSKALGLDLECFVQGEKLATLFQTSKDFLSPWELRERALYRVLDKEEL

-continued

ARVILHIAKRRGYDDITYGVEDNDSGKIKKAIAENSKRIKEEQCKTIGEMMYKLYFQKSLNVRN

KKESYNRCVGRSELREELKTIFQIQQELKSPWVNEELIYKLLGNPDAQSKQEREGLIFYQRPLK

GFGDKIGKCSHIKKGENSPYRACKHAPSAEEFVALTKSINFLKNLTNRHGLCFSQEDMCVYLGK

ILQEAQKNEKGLTYSKLKLLLDLPSDFEFLGLDYSGKNPEKAVFLSLPSTFKLNKITQDRKTQD

KIANILGANKDWEAILKELESLQLSKEQIQTIKDAKLNFSKHINLSLEALYHLLPLMREGKRYD

EGVEILQERGIFSKPQPKNRQLLPPLSELAKEESYFDIPNPVLRRALSEFRKVVNALLEKYGGF

HYFHIELTRDVCKAKSARMQLEKINKKNKSENDAASQLLEVLGLPNTYNNRLKCKLWKQQEEYC

LYSGEKITIDHLKDQRALQIDHAFPLSRSLDDSQSNKVLCLTSSNQEKSNKTPYEWLGSDEKKW

DMYVGRVYSSNFSPSKKRKLTQKNFKERNEEDFLARNLVDTGYIGRVTKEYIKHSLSFLPLPDG

KKEHIRIISGSMTSTMRSFWGVQEKNRDHHLHHAQDAIIACIEPSMIQKYTTYLKDKETHRLK

SHQKAQILREGDHKLSLRWPMSNFKDKIQESIQNIIPSHHVSHKVTGELHQETVRTKEFYYQAF

GGEEGVKKALKFGKIREINQGIVDNGAMVRVDIFKSKDKGKFYAVPIYTYDFAIGKLPNKAIVQ

GKKNGIIKDWLEMDENYEFCFSLFKNDCIKIQTKEMQEAVLAIYKSTNSAKATIELEHLSKYAL

KNEDEEKMFTDTDKEKNKTMTRESCGIQGLKVFQKVKLSVLGEVLEHKPRNRQNIALKTTPKHV

SEQ ID NO: 369
MKYSIGLDIGIASVGWSVINKDKERIEDMGVRIFQKAENPKDGSSLASSRREKRGSRRRNRRKK

HRLDRIKNILCESGLVKKNEIEKIYKNAYLKSPWELRAKSLEAKISNKEIAQILLHIAKRRGFK

SFRKTDRNADDTGKLLSGIQENKKIMEEKGYLTIGDMVAKDPKFNTHVRNKAGSYLFSFSRKLL

EDEVRKIQAKQKELGNTHFTDDVLEKYIEVFNSQRNFDEGPSKPSPYYSEIGQIAKMIGNCTFE

SSEKRTAKNTWSGERFVFLQKLNNFRIVGLSGKRPLTEEERDIVEKEVYLKKEVRYEKLRKILY

LKEEERFGDLNYSKDEKQDKKTEKTKFISLIGNYTIKKLNLSEKLKSEIEEDKSKLDKIIEILT

FNKSDKTIESNLKKLELSREDIEILLSEEFSGTLNLSLKAIKKILPYLEKGLSYNEACEKADYD

YKNNGIKFKRGELLPVVDKDLIANPVVLRAISQTRKVVNAIIRKYGTPHTIHVEVARDLAKSYD

DRQTIIKENKKRELENEKTKKFISEEFGIKNVKGKLLLKYRLYQEQEGRCAYSRKELSLSEVIL

DESMTDIDHIIPYSRSMDDSYSNKVLVLSGENRKKSNLLPKEYFDRQGRDWDTFVLNVKAMKIH

PRKKSNLLKEKFTREDNKDWKSRALNDTRYISRFVANYLENALEYRDDSPKKRVFMIPGQLTAQ

LRARWRLNKVRENGDLHHALDAAVVAVTDQKAINNISNISRYKELKNCKDVIPSIEYHADEETG

EVYFEEVKDTRFPMPWSGFDLELQKRLESENPREEFYNLLSDKRYLGWFNYEEGFIEKLRPVFV

SRMPNRGVKGQAHQETIRSSKKISNQIAVSKKPLNSIKLKDLEKMQGRDTDRKLYEALKNRLEE

YDDKPEKAFAEPFYKPTNSGKRGPLVRGIKVEEKQNVGVYVNGGQASNGSMVRIDVFRKNGKFY

TVPIYVHQTLLKELPNRAINGKPYKDWDLIDGSFEFLYSFYPNDLIEIEFGKSKSIKNDNKLTK

TEIPEVNLSEVLGYYRGMDTSTGAATIDTQDGKIQMRIGIKTVKNIKKYQVDVLGNVYKVKREK

RQTF

SEQ ID NO: 370
MSKKVSRRYEEQAQEICQRLGSRPYSIGLDLGVGSIGVAVAAYDPIKKQPSDLVFVSSRIFIPS

TGAAERRQKRGQRNSLRHRANRLKFLWKLLAERNLMLSYSEQDVPDPARLRFEDAVVRANPYEL

RLKGLNEQLTLSELGYALYHIANHRGSSSVRTFLDEEKSSDDKKLEEQQAMTEQLAKEKGISTF

IEVLTAFNTNGLIGYRNSESVKSKGVPVPTRDIISNEIDVLLQTQKQFYQEILSDEYCDRIVSA

ILFENEKIVPEAGCCPYFPDEKKLPRCHFLNEERRLWEAINNARIKMPMQEGAAKRYQSASFSD

EQRHILFHIARSGTDITPKLVQKEFPALKTSIIVLQGKEKAIQKIAGFRFRRLEEKSFWKRLSE

EQKDDFFSAWTNTPDDKRLSKYLMKHLLLTENEVVDALKTVSLIGDYGPIGKTATQLLMKHLED

```
                                                      -continued
GLTYTEALERGMETGEFQELSVWEQQSLLPYYGQILTGSTQALMGKYWHSAFKEKRDSEGFFKP

NTNSDEEKYGRIANPVVHQTLNELRKLMNELITILGAKPQEITVELARELKVGAEKREDIIKQQ

TKQEKEAVLAYSKYCEPNNLDKRYIERFRLLEDQAFVCPYCLEHISVADIAAGRADVDHIFPRD

DTADNSYGNKVVAHRQCNDIKGKRTPYAAFSNTSAWGPIMHYLDETPGMWRKRRKFETNEEEYA

KYLQSKGFVSRFESDNSYIAKAAKEYLRCLFNPNNVTAVGSLKGMETSILRKAWNLQGIDDLLG

SRHWSKDADTSPTMRKNRDDNRHHGLDAIVALYCSRSLVQMINTMSEQGKRAVEIEAMIPIPGY

ASEPNLSFEAQRELFRKKILEFMDLHAFVSMKTDNDANGALLKDTVYSILGADTQGEDLVFVVK

KKIKDIGVKIGDYEEVASAIRGRITDKQPKWYPMEMKDKIEQLQSKNEAALQKYKESLVQAAAV

LEESNRKLIESGKKPIQLSEKTISKKALELVGGYYYLISNNKRTKTFVVKEPSNEVKGFAFDTG

SNLCLDFYHDAQGKLCGEIIRKIQAMNPSYKPAYMKQGYSLYVRLYQGDVCELRASDLTEAESN

LAKTTHVRLPNAKPGRTFVIIITFTEMGSGYQIYFSNLAKSKKGQDTSFTLTTIKNYDVRKVQL

SSAGLVRYVSPLLVDKIEKDEVALCGE

SEQ ID NO: 371
MNQKFILGLDIGITSVGYGLIDYETKNIIDAGVRLFPEANVENNEGRRSKRGSRRLKRRRIHRL

ERVKKLLEDYNLLDQSQIPQSTNPYAIRVKGLSEALSKDELVIALLHIAKRRGIHKIDVIDSND

DVGNELSTKEQLNKNSKLLKDKFVCQIQLERMNEGQVRGEKNRFKTADIIKEIIQLLNVQKNFH

QLDENFINKYIELVEMRREYFEGPGKGSPYGWEGDPKAWYETLMGHCTYFPDELRSVKYAYSAD

LFNALNDLNNLVIQRDGLSKLEYHEKYHIIENVFKQKKKPTLKQIANEINVNPEDIKGYRITKS

GKPQFTEFKLYHDLKSVLFDQSILENEDVLDQIAEILTIYQDKDSIKSKLTELDILLNEEDKEN

IAQLTGYTGTHRLSLKCIRLVLEEQWYSSRNQMEIFTHLNIKPKKINLTAANKIPKAMIDEFIL

SPVVKRTFGQAINLINKIIEKYGVPEDIIIELARENNSKDKQKFINEMQKKNENTRKRINEIIG

KYGNQNAKRLVEKIRLHDEQEGKCLYSLESIPLEDLLNNPNHYEVDHIIPRSVSFDNSYHNKVL

VKQSENSKKSNLTPYQYFNSGKSKLSYNQFKQHILNLSKSQDRISKKKKEYLLEERDINKFEVQ

KEFINRNLVDTRYATRELTNYLKAYFSANNMNVKVKTINGSFTDYLRKVWKFKKERNHGYKHHA

EDALIIANADFLFKENKKLKAVNSVLEKPEIESKQLDIQVDSEDNYSEMFIIPKQVQDIKDFRN

FKYSHRVDKKPNRQLINDTLYSTRKKDNSTYIVQTIKDIYAKDNTTLKKQFDKSPEKFLMYQHD

PRTFEKLEVIMKQYANEKNPLAKYHEETGEYLTKYSKKNNGPIVKSLKYIGNKLGSHLDVTHQF

KSSTKKLVKLSIKPYRFDVYLTDKGYKFITISYLDVLKKDNYYYIPEQKYDKLKLGKAIDKNAK

FIASFYKNDLIKLDGEIYKIIGVNSDTRNMIELDLPDIRYKEYCELNNIKGEPRIKKTIGKKVN

SIEKLTTDVLGNVFTNTQYTKPQLLFKRGN

SEQ ID NO: 372
MIMKLEKWRLGLDLGTNSIGWSVFSLDKDNSVQDLIDMGVRIFSDGRDPKTKEPLAVARRTARS

QRKLIYRRKLRRKQVFKFLQEQGLFPKTKEECMTLKSLNPYELRIKALDEKLEPYELGRALFNL

AVRRGFKSNRKDGSREEVSEKKSPDEIKTQADMQTHLEKAIKENGCRTITEFLYKNQGENGGIR

FAPGRMTYYPTRKMYEEEFNLIRSKQEKYYPQVDWDDIYKAIFYQRPLKPQQRGYCIYENDKER

TFKAMPCSQKLRILQDIGNLAYYEGGSKKRVELNDNQDKVLYELLNSKDKVTFDQMRKALCLAD

SNSFNLEENRDFLIGNPTAVKMRSKNRFGKLWDEIPLEEQDLIIETIITADEDDAVYEVIKKYD

LTQEQRDFIVKNTILQSGTSMLCKEVSEKLVKRLEEIADLKYHEAVESLGYKFADQTVEKYDLL

PYYGKVLPGSTMEIDLSAPETNPEKHYGKISNPTVHVALNQTRVVVNALIKEYGKPSQIAIELS

RDLKNNVEKKAEIARKQNQRAKENIAINDTISALYHTAFPGKSFYPNRNDRMKYRLWSELGLGN

KCIYCGKGISGAELFTKEIEIEHILPFSRTLLDAESNLTVAHSSCNAFKAERSPFEAFGTNPSG

YSWQEIIQRANQLKNTSKKNKFSPNAMDSFEKDSSFIARQLSDNQYIAKAALRYLKCLVENPSD
```

-continued

VWTTNGSMTKLLRDKWEMDSILCRKFTEKEVALLGLKPEQIGNYKKNRFDHRHHAIDAVVIGLT
DRSMVQKLATKNSHKGNRIEIPEFPILRSDLIEKVKNIVVSFKPDHGAEGKLSKETLLGKIKLH
GKETFVCRENIVSLSEKNLDDIVDEIKSKVKDYVAKHKGQKIEAVLSDFSKENGIKKVRCVNRV
QTPIEITSGKISRYLSPEDYFAAVIWEIPGEKKTFKAQYIRRNEVEKNSKGLNVVKPAVLENGK
PHPAAKQVCLLHKDDYLEFSDKGKMYFCRIAGYAATNNKLDIRPVYAVSYCADWINSTNETMLT
GYWKPTPTQNWVSVNVLFDKQKARLVTVSPIGRVFRK

SEQ ID NO: 373
MSSKAIDSLEQLDLFKPQEYTLGLDLGIKSIGWAILSGERIANAGVYLFETAEELNSTGNKLIS
KAAERGRKRRIRRMLDRKARRGRHIRYLLEREGLPTDELEEVVVHQSNRTLWDVRAEAVERKLT
KQELAAVLFHLVRHRGYFPNTKKLPPDDESDSADEEQGKINRATSRLREELKASDCKTIGQFLA
QNRDRQRNREGDYSNLMARKLVFEEALQILAFQRKQGHELSKDFEKTYLDVLMGQRSGRSPKLG
NCSLIPSELRAPSSAPSTEWFKFLQNLGNLQISNAYREEWSIDAPRRAQIIDACSQRSTSSYWQ
IRRDFQIPDEYRFNLVNYERRDPDVDLQEYLQQQERKTLANFRNWKQLEKIIGTGHPIQTLDEA
ARLITLIKDDEKLSDQLADLLPEASDKAITQLCELDFTTAAKISLEAMYRILPHMNQGMGFFDA
CQQESLPEIGVPPAGDRVPPFDEMYNPVVNRVLSQSRKLINAVIDEYGMPAKIRVELARDLGKG
RELRERIKLDQLDKSKQNDQRAEDFRAEFQQAPRGDQSLRYRLWKEQNCTCPYSGRMIPVNSVL
SEDTQIDHILPISQSFDNSLSNKVLCFTEENAQKSNRTPFEYLDAADFQRLEAISGNWPEAKRN
KLLHKSFGKVAEEWKSRALNDTRYLTSALADHLRHHLPDSKIQTVNGRITGYLRKQWGLEKDRD
KHTHHAVDAIVVACTTPAIVQQVTLYHQDIRRYKKLGEKRPTPWPETFRQDVLDVEEEIFITRQ
PKKVSGGIQTKDTLRKHRSKPDRQRVALTKVKLADLERLVEKDASNRNLYEHLKQCLEESGDQP
TKAFKAPFYMPSGPEAKQRPILSKVTLLREKPEPPKQLTELSGGRRYDSMAQGRLDIYRYKPGG
KRKDEYRVVLQRMIDLMRGEENVHVFQKGVPYDQGPEIEQNYTFLFSLYFDDLVEFQRSADSEV
IRGYYRTFNIANGQLKISTYLEGRQDFDFFGANRLAHFAKVQVNLLGKVIK

SEQ ID NO: 374
MRSLRYRLALDLGSTSLGWALFRLDACNRPTAVIKAGVRIFSDGRNPKDGSSLAVTRRAARAMR
RRRDRLLKRKTRMQAKLVEHGFFPADAGKRKALEQLNPYALRAKGLQEALLPGEFARALFHINQ
RRGFKSNRKTDKKDNDSGVLKKAIGQLRQQMAEQGSRTVGEYLWTRLQQGQGVRARYREKPYTT
EEGKKRIDKSYDLYIDRAMIEQEFDALWAAQAAFNPTLFHEAARADLKDTLLHQRPLRPVKPGR
CTLLPEEERAPLALPSTQRFRIHQEVNHLRLLDENLREVALTLAQRDAVVTALETKAKLSFEQI
RKLLKLSGSVQFNLEDAKRTELKGNATSAALARKELFGAAWSGFDEALQDEIVWQLVTEEGEGA
LIAWLQTHTGVDEARAQAIVDVSLPEGYGNLSRKALARIVPALRAAVITYDKAVQAAGFDHHSQ
LGFEYDASEVEDLVHPETGEIRSVFKQLPYYGKALQRHVAFGSGKPEDPDEKRYGKIANPTVHI
GLNQVRMVVNALIRRYGRPTEVVIELARDLKQSREQKVEAQRRQADNQRRNARIRRSIAEVLGI
GEERVRGSDIQKWICWEELSFDAADRRCPYSGVQISAAMLLSDEVEVEHILPFSKTLDDSLNNR
TVAMRQANRIKRNRTPWDARAEFEAQGWSYEDILQRAERMPLRKRYRFAPDGYERWLGDDKDFL
ARALNDTRYLSRVAAEYLRLVCPGTRVIPGQLTALLRGKFGLNDVLGLDGEKNRNDHRHHAVDA
CVIGVTDQGLMQRFATASAQARGDGLTRLVDGMPMPWPTYRDHVERAVRHIWVSHRPDHGFEGA
MMEETSYGIRKDGSIKQRRKADGSAGREISNLIRIHEATQPLRHGVSADGQPLAYKGYVGGSNY
CIEITVNDKGKWEGEVISTFRAYGVVRAGGMGRLRNPHEGQNGRKLIMRLVIGDSVRLEVDGAE
RTMRIVKISGSNGQIFMAPIHEANVDARNTDKQDAFTYTSKYAGSLQKAKTRRVTISPIGEVRD
PGFKG

-continued

SEQ ID NO: 375
MARPAFRAPRREHVNGWTPDPHRISKPFFILVSWHLLSRVVIDSSSGCFPGTSRDHTDKFAEWE
CAVQPYRLSFDLGTNSIGWGLLNLDRQGKPREIRALGSRIFSDGRDPQDKASLAVARRLARQMR
RRRDRYLTRRTRLMGALVRFGLMPADPAARKRLEVAVDPYLARERATRERLEPFEIGRALFHLN
QRRGYKPVRTATKPDEEAGKVKEAVERLEAAIAAAGAPTLGAWFAWRKTRGETLRARLAGKGKE
AAYPFYPARRMLEAEFDTLWAEQARHHPDLLTAEAREILRHRIFHQRPLKPPPVGRCTLYPDDG
RAPRALPSAQRLRLFQELASLRVIHLDLSERPLTPAERDRIVAFVQGRPPKAGRKPGKVQKSVP
FEKLRGLLELPPGTGFSLESDKRPELLGDETGARIAPAFGPGWTALPLEEQDALVELLLTEAEP
ERAIAALTARWALDEATAAKLAGATLPDFHGRYGRRAVAELLPVLERETRGDPDGRVRPIRLDE
AVKLLRGGKDHSDFSREGALLDALPYYGAVLERHVAFGTGNPADPEEKRVGRVANPTVHIALNQ
LRHLVNAILARHGRPEEIVIELARDLKRSAEDRRREDKRQADNQKRNEERKRLILSLGERPTPR
NLLKLRLWEEQGPVENRRCPYSGETISMRMLLSEQVDIDHILPFSVSLDDSAANKVVCLREANR
IKRNRSPWEAFGHDSERWAGILARAEALPKNKRWRFAPDALEKLEGEGGLRARHLNDTRHLSRL
AVEYLRCVCPKVRVSPGRLTALLRRRWGIDAILAEADGPPPEVPAETLDPSPAEKNRADHRHHA
LDAVVIGCIDRSMVQRVQLAAASAEREAAAREDNIRRVLEGFKEEPWDGFRAELERRARTIVVS
HRPEHGIGGALHKETAYGPVDPPEEGFNLVVRKPIDGLSKDEINSVRDPRLRRALIDRLAIRRR
DANDPATALAKAAEDLAAQPASRGIRRVRVLKKESNPIRVEHGGNPSGPRSGGPFHKLLLAGEV
HHVDVALRADGRRWVGHWVTLFEAHGGRGADGAAAPPRLGDGERFLMRLHKGDCLKLEHKGRVR
VMQVVKLEPSSNSVVVVEPHQVKTDRSKHVKISCDQLRARGARRVTVDPLGRVRVHAPGARVGI
GGDAGRTAMEPAEDIS

SEQ ID NO: 376
MKRTSLRAYRLGVDLGANSLGWFVVWLDDHGQPEGLGPGGVRIFPDGRNPQSKQSNAAGRRLAR
SARRRRDRYLQRRGKLMGLLVKHGLMPADEPARKRLECLDPYGLRAKALDEVLPLHHVGRALFH
LNQRRGLFANRAIEQGDKDASAIKAAAGRLQTSMQACGARTLGEFLNRRHQLRATVRARSPVGG
DVQARYEFYPTRAMVDAEFEAIWAAQAPHHPTMTAEAHDTIREAIFSQRAMKRPSIGKCSLDPA
TSQDDVDGFRCAWSHPLAQRFRIWQDVRNLAVVETGPTSSRLGKEDQDKVARALLQTDQLSFDE
IRGLLGLPSDARFNLESDRRDHLKGDATGAILSARRHFGPAWHDRSLDRQIDIVALLESALDEA
AIIASLGTTHSLDEAAAQRALSALLPDGYCRLGLRAIKRVLPLMEAGRTYAEAASAAGYDHALL
PGGKLSPTGYLPYYGQWLQNDVVGSDDERDTNERRWGRLPNPTVHIGIGQLRRVVNELIRWHGP
PAEITVELTRDLKLSPRRLAELEREQAENQRKNDKRTSLLRKLGLPASTHNLLKLRLWDEQGDV
ASECPYTGEAIGLERLVSDDVDIDHLIPFSISWDDSAANKVVCMRYANREKGNRTPFEAFGHRQ
GRPYDWADIAERAARLPRGKRWRFGPGARAQFEELGDFQARLLNETSWLARVAKQYLAAVTHPH
RIHVLPGRLTALLRATWELNDLLPGSDDRAAKSRKDHRHHAIDALVAALTDQALLRRMANAHDD
TRRKIEVLLPWPTFRIDLETRLKAMLVSHKPDHGLQARLHEDTAYGTVEHPETEDGANLVYRKT
FVDISEKEIDRIRDRRLRDLVRAHVAGERQQGKTLKAAVLSFAQRRDIAGHPNGIRHVRLTKSI
KPDYLVPIRDKAGRIYKSYNAGENAFVDILQAESGRWIARATTVFQANQANESHDAPAAQPIMR
VFKGDMLRIDHAGAEKFVKIVRLSPSNNLLYLVEHHQAGVFQTRHDDPEDSFRWLFASFDKLRE
WNAELVRIDTLGQPWRRKRGLETGSEDATRIGWTRPKKWP

SEQ ID NO: 377
MERIFGFDIGTTSIGFSVIDYSSTQSAGNIQRLGVRIFPEARDPDGTPLNQQRRQKRMMRRQLR
RRRIRRKALNETLHEAGFLPAYGSADWPVVMADEPYELRRRGLEEGLSAYEFGRAIYHLAQHRH
FKGRELEESDTPDPDVDDEKEAANERAATLKALKNEQTTLGAWLARRPPSDRKRGIHAHRNVVA

-continued

EEFERLWEVQSKFHPALKSEEMRARISDTIFAQRPVFWRKNTLGECRFMPGEPLCPKGSWLSQQ

RRMLEKLNNLAIAGGNARPLDAEERDAILSKLQQQASMSWPGVRSALKALYKQRGEPGAEKSLK

FNLELGGESKLLGNALEAKLADMFGPDWPAHPRKQEIRHAVHERLWAADYGETPDKKRVIILSE

KDRKAHREAAANSFVADFGITGEQAAQLQALKLPTGWEPYSIPALNLFLAELEKGERFGALVNG

PDWEGWRRTNFPHRNQPTGEILDKLPSPASKEERERISQLRNPTVVRTQNELRKVVNNLIGLYG

KPDRIRIEVGRDVGKSKREREEIQSGIRRNEKQRKKATEDLIKNGIANPSRDDVEKWILWKEGQ

ERCPYTGDQIGFNALFREGRYEVEHIWPRSRSFDNSPRNKTLCRKDVNIEKGNRMPFEAFGHDE

DRWSAIQIRLQGMVSAKGGTGMSPGKVKRFLAKTMPEDFAARQLNDTRYAAKQILAQLKRLWPD

MGPEAPVKVEAVTGQVTAQLRKLWTLNNILADDGEKTRADHRHHAIDALTVACTHPGMTNKLSR

YWQLRDDPRAEKPALTPPWDTIRADAEKAVSEIVVSHRVRKKVSGPLHKETTYGDTGTDIKTKS

GTYRQFVTRKKIESLSKGELDEIRDPRIKEIVAAHVAGRGGDPKKAFPPYPCVSPGGPEIRKVR

LTSKQQLNLMAQTGNGYADLGSNHHIAIYRLPDGKADFEIVSLFDASRRLAQRNPIVQRTRADG

ASFVMSLAAGEAIMIPEGSKKGIWIVQGVWASGQVVLERDTDADHSTTTRPMPNPILKDDAKKV

SIDPIGRVRPSND

SEQ ID NO: 378

MNKRILGLDTGTNSLGWAVVDWDEHAQSYELIKYGDVIFQEGVKIEKGIESSKAAERSGYKAIR

KQYFRRRLRKIQVLKVLVKYHLCPYLSDDDLRQWHLQKQYPKSDELMLWQRTSDEEGKNPYYDR

HRCLHEKLDLTVEADRYTLGRALYHLTQRRGFLSNRLDTSADNKEDGVVKSGISQLSTEMEEAG

CEYLGDYFYKLYDAQGNKVRIRQRYTDRNKHYQHEFDAICEKQELSSELIEDLQRAIFFQLPLK

SQRHGVGRCTFERGKPRCADSHPDYEEFRMLCFVNNIQVKGPHDLELRPLTYEEREKIEPLFFR

KSKPNFDFEDIAKALAGKKNYAWIHDKEERAYKFNYRMTQGVPGCPTIAQLKSIFGDDWKTGIA

ETYTLIQKKNGSKSLQEMVDDVWNVLYSFSSVEKLKEFAHHKLQLDEESAEKFAKIKLSHSFAA

LSLKAIRKFLPFLRKGMYYTHASFFANIPTIVGKEIWNKEQNRKYIMENVGELVFNYQPKHREV

QGTIEMLIKDFLANNFELPAGATDKLYHPSMIETYPNAQRNEFGILQLGSPRTNAIRNPMAMRS

LHILRRVVNQLLKESIIDENTEVHVEYARELNDANKRRAIADRQKEQDKQHKKYGDEIRKLYKE

ETGKDIEPTQTDVLKFQLWEEQNHHCLYTGEQIGITDFIGSNPKFDIEHTIPQSVGGDSTQMNL

TLCDNRFNREVKKAKLPTELANHEEILTRIEPWKNKYEQLVKERDKQRTFAGMDKAVKDIRIQK

RHKLQMEIDYWRGKYERFTMTEVPEGFSRRQGTGIGLISRYAGLYLKSLFHQADSRNKSNVYVV

KGVATAEFRKMWGLQSEYEKKCRDNHSHHCMDAITIACIGKREYDLMAEYYRMEETFKQGRGSK

PKFSKPWATFTEDVLNIYKNLLVVHDTPNNMPKHTKKYVQTSIGKVLAQGDTARGSLHLDTYYG

AIERDGEIRYVVRRPLSSFTKPEELENIVDETVKRTIKEAIADKNFKQAIAEPIYMNEEKGILI

KKVRCFAKSVKQPINIRQHRDLSKKEYKQQYHVMNENNYLLAIYEGLVKNKVVREFEIVSYIEA

AKYYKRSQDRNIFSSIVPTHSTKYGLPLKTKLLMGQLVLMFEENPDEIQVDNTKDLVKRLYKVV

GIEKDGRIKFKYHQEARKEGLPIFSTPYKNNDDYAPIFRQSINNINILVDGIDFTIDILGKVTL

KE

SEQ ID NO: 379

MNYKMGLDIGIASVGWAVINLDLKRIEDLGVRIFDKAEHPQNGESLALPRRIARSARRRLRRRK

HRLERIRRLLVSENVLTKEEMNLLFKQKKQIDVWQLRVDALERKLNNDELARVLLHLAKRRGFK

SNRKSERNSKESSEFLKNIEENQSILAQYRSVGEMIVKDSKFAYHKRNKLDSYSNMIARDDLER

EIKLIFEKQREFNNPVCTERLEEKYLNIWSSQRPFASKEDIEKKVGFCTFEPKEKRAPKATYTF

QSFIVWEHINKLRLVSPDETRALTEIERNLLYKQAFSKNKMTYYDIRKLLNLSDDIHFKGLLYD

PKSSLKQIENIRFLELDSYHKIRKCIENVYGKDGIRMFNETDIDTFGYALTIFKDDEDIVAYLQ

-continued

NEYITKNGKRVSNLANKVYDKSLIDELLNLSFSKFAHLSMKAIRNILPYMEQGEIYSKACELAG

YNFTGPKKKEKALLLPVIPNIANPVVMRALTQSRKVVNAIIKKYGSPVSIHIELARDLSHSFDE

RKKIQKDQTENRKKNETAIKQLIEYELTKNPTGLDIVKFKLWSEQQGRCMYSLKPIELERLLEP

GYVEVDHILPYSRSLDDSYANKVLVLTKENREKGNHTPVEYLGLGSERWKKFEKFVLANKQFSK

KKKQNLLRLRYEETEEKEFKERNLNDTRYISKFFANFIKEHLKFADGDGGQKVYTINGKITAHL

RSRWDFNKNREESDLHHAVDAVIVACATQGMIKKITEFYKAREQNKESAKKKEPIFPQPWPHFA

DELKARLSKFPQESIEAFALGNYDRKKLESLRPVFVSRMPKRSVTGAAHQETLRRCVGIDEQSG

KIQTAVKTKLSDIKLDKDGHFPMYQKESDPRTYEAIRQRLLEHNNDPKKAFQEPLYKPKKNGEP

GPVIRTVKIIDTKNKVVHLDGSKTVAYNSNIVRTDVFEKDGKYYCVPVYTMDIMKGTLPNKAIE

ANKPYSEWKEMTEEYTFQFSLFPNDLVRIVLPREKTIKTSTNEEIIIKDIFAYYKTIDSATGGL

ELISHDRNFSLRGVGSKTLKRFEKYQVDVLGNIHKVKGEKRVGLAAPTNQKKGKTVDSLQSVSD

SEQ ID NO: 380
MRRLGLDLGTNSIGWCLLDLGDDGEPVSIFRTGARIFSDGRDPKSLGSLKATRREARLTRRRRD

RFIQRQKNLINALVKYGLMPADEIQRQALAYKDPYPIRKKALDEAIDPYEMGRAIFHINQRRGF

KSNRKSADNEAGVVKQSIADLEMKLGEAGARTIGEFLADRQATNDTVRARRLSGTNALYEFYPD

RYMLEQEFDTLWAKQAAFNPSLYIEAARERLKEIVFFQRKLKPQEVGRCIFLSDEDRISKALPS

FQRFRIYQELSNLAWIDHDGVAHRITASLALRDHLFDELEHKKKLTFKAMRAILRKQGVVDYPV

GFNLESDNRDHLIGNLTSCIMRDAKKMIGSAWDRLDEEEQDSFILMLQDDQKGDDEVRSILTQQ

YGLSDDVAEDCLDVRLPDGHGSLSKKAIDRILPVLRDQGLIYYDAVKEAGLGEANLYDPYAALS

DKLDYYGKALAGHVMGASGKFEDSDEKRYGTISNPTVHIALNQVRAVVNELIRLHGKPDEVVIE

IGRDLPMGADGKRELERFQKEGRAKNERARDELKKLGHIDSRESRQKFQLWEQLAKEPVDRCCP

FTGKMMSISDLFSDKVEIEHLLPFSLTLDDSMANKTVCFRQANRDKGNRAPFDAFGNSPAGYDW

QEILGRSQNLPYAKRWRFLPDAMKRFEADGGFLERQLNDTRYISRYTTEYISTIIPKNKIWVVT

GRLTSLLRGFWGLNSILRGHNTDDGTPAKKSRDDHRHHAIDAIVVGMTSRGLLQKVSKAARRSE

DLDLTRLFEGRIDPWDGFRDEVKKHIDAIIVSHRPRKKSQGALHNDTAYGIVEHAENGASTVVH

RVPITSLGKQSDIEKVRDPLIKSALLNETAGLSGKSFENAVQKWCADNSIKSLRIVETVSIIPI

TDKEGVAYKGYKGDGNAYMDIYQDPTSSKWKGEIVSRFDANQKGFIPSWQSQFPTARLIMRLRI

NDLLKLQDGEIEEIYRVQRLSGSKILMAPHTEANVDARDRDKNDTFKLTSKSPGKLQSASARKV

HISPTGLIREG

SEQ ID NO: 381
MKNILGLDLGLSSIGWSVIRENSEEQELVAMGSRVVSLTAAELSSFTQGNGVSINSQRTQKRTQ

RKGYDRYQLRRTLLRNKLDTLGMLPDDSLSYLPKLQLWGLRAKAVTQRIELNELGRVLLHLNQK

RGYKSIKSDFSGDKKITDYVKTVKTRYDELKEMRLTIGELFFRRLTENAFFRCKEQVYPRQAYV

EEFDCIMNCQRKFYPDILTDETIRCIRDEIIYYQRPLKSCKYLVSRCEFEKRFYLNAAGKKTEA

GPKVSPRTSPLFQVCRLWESINNIVVKDRRNEIVFISAEQRAALFDFLNTHEKLKGSDLLKLLG

LSKTYGYRLGEQFKTGIQGNKTRVEIERALGNYPDKKRLLQFNLQEESSSMVNTETGEIIPMIS

LSFEQEPLYRLWHVLYSIDDREQLQSVLRQKFGIDDDEVLERLSAIDLVKAGFGNKSSKAIRRI

LPFLQLGMNYAEACEAAGYNHSNNYTKAENEARALLDRLPAIKKNELRQPVVEKILNQMVNVVN

ALMEKYGRFDEIRVELARELKQSKEERSNTYKSINKNQRENEQIAKRIVEYGVPTRSRIQKYKM

WEEESKHCCIYCGQPVDVGDFLRGFDVEVEHIIPKSLYFDDSFANKVCSCRSCNKEKNNRTAYDY

MKSKGEKALSDYVERVNTMYTNNQISKTKWQNLLTPVDKISIDFIDRQLRESQYIARKAKEILT

```
-continued
SICYNVTATSGSVTSFLRHVWGWDTVLHDLNFDRYKKVGLTEVIEVNHRGSVIRREQIKDWSKR

FDHRHHAIDALTIACTKQAYIQRLNNLRAEEGPDFNKMSLERYIQSQPHFSVAQVREAVDRILV

SFRAGKRAVTPGKRYIRKNRKRISVQSVLIPRGALSEESVYGVIHVWEKDEQGHVIQKQRAVMK

YPITSINREMLDKEKVVDKRIHRILSGRLAQYNDNPKEAFAKPVYIDKECRIPIRTVRCFAKPA

INTLVPLKKDDKGNPVAWVNPGNNHHVAIYRDEDGKYKERTVTFWEAVDRCRVGIPAIVTQPDT

IWDNILQRNDISENVLESLPDVKWQFVLSLQQNEMFILGMNEEDYRYAMDQQDYALLNKYLYRV

QKLSKSDYSFRYHTETSVEDKYDGKPNLKLSMQMGKLKRVSIKSLLGLNPHKVHISVLGEIKEI

S
```
```
                                                            SEQ ID NO: 382
MAEKQHRWGLDIGTNSIGWAVIALIEGRPAGLVATGSRIFSDGRNPKDGSSLAVERRGPRQMRR

RRDRYLRRRDRFMQALINVGLMPGDAAARKALVTENPYVLRQRGLDQALTLPEFGRALFHLNQR

RGFQSNRKTDRATAKESGKVKNAIAAFRAGMGNARTVGEALARRLEDGRPVRARMVGQGKDEHY

ELYIAREWIAQEFDALWASQQRFHAEVLADAARDRLRAILLFQRKLLPVPVGKCFLEPNQPRVA

AALPSAQRFRLMQELNHLRVMTLADKRERPLSFQERNDLLAQLVARPKCGFDMLRKIVFGANKE

AYRFTIESERRKELKGCDTAAKLAKVNALGTRWQALSLDEQDRLVCLLLDGENDAVLADALREH

YGLTDAQIDTLLGLSFEDGHMRLGRSALLRVLDALESGRDEQGLPLSYDKAVVAAGYPAHTADL

ENGERDALPYYGELLWRYTQDAPTAKNDAERKFGKIANPTVHIGLNQLRKLVNALIQRYGKPAQ

IVVELARNLKAGLEEKERIKKQQTANLERNERIRQKLQDAGVPDNRENRLRMRLFEELGQGNGL

GTPCIYSGRQISLQRLFSNDVQVDHILPFSKTLDDSFANKVLAQHDANRYKGNRGPFEAFGANR

DGYAWDDIRARAAVLPRNKRNRFAETAMQDWLHNETDFLARQLTDTAYLSRVARQYLTAICSKD

DVYVSPGRLTAMLRAKWGLNRVLDGVMEEQGRPAVKNRDDHRHHAIDAVVIGATDRAMLQQVAT

LAARAREQDAERLIGDMPTPWPNFLEDVRAAVARCVVSHKPDHGPEGGLHNDTAYGIVAGPFED

GRYRVRHRVSLFDLKPGDLSNVRCDAPLQAELEPIFEQDDARAREVALTALAERYRQRKVWLEE

LMSVLPIRPRGEDGKTLPDSAPYKAYKGDSNYCYELFINERGRWDGELISTFRANQAAYRRFRN

DPARFRRYTAGGRPLLMRLCINDYIAVGTAAERTIFRVVKMSENKITLAEHFEGGTLKQRDADK

DDPFKYLTKSPGALRDLGARRIFVDLIGRVLDPGIKGD
```
```
                                                            SEQ ID NO: 383
MIERILGVDLGISSLGWAIVEYDKDDEAANRIIDCGVRLFTAAETPKKKESPNKARREARGIRR

VLNRRRVRMNMIKKLFLRAGLIQDVDLDGEGGMFYSKANRADVWELRHDGLYRLLKGDELARVL

IHIAKHRGYKFIGDDEADEESGKVKKAGVVLRQNFEAAGCRTVGEWLWRERGANGKKRNKHGDY

EISIHRDLLVEEVEAIFVAQQEMRSTIATDALKAAYREIAFFVRPMQRIEKMVGHCTYFPEERR

APKSAPTAEKFIAISKFFSTVIIDNEGWEQKIIERKTLEELLDFAVSREKVEFRHLRKFLDLSD

NEIFKGLHYKGKPKTAKKREATLFDPNEPTELEFDKVEAEKKAWISLRGAAKLREALGNEFYGR

FVALGKHADEATKILTYYKDEGQKRRELTKLPLEAEMVERLVKIGFSDFLKLSLKAIRDILPAM

ESGARYDEAVLMLGVPHKEKSAILPPLNKTDIDILNPTVIRAFAQFRKVANALVRKYGAFDRVH

FELAREINTKGEIEDIKESQRKNEKERKEAADWIAETSFQVPLTRKNILKKRLYIQQDGRCAYT

GDVIELERLFDEGYCEIDHILPRSRSADDSFANKVLCLARANQQKTDRTPYEWFGHDAARWNAF

ETRTSAPSNRVRTGKGKIDRLLKKNFDENSEMAFKDRNLNDTRYMARAIKTYCEQYWVFKNSHT

KAPVQVRSGKLTSVLRYQWGLESKDRESHTHHAVDAIIIAFSTQGMVQKLSEYYRFKETHREKE

RPKLAVPLANFRDAVEEATRIENTETVKEGVEVKRLLISRPPRARVTGQAHEQTAKPYPRIKQV

KNKKKWRLAPIDEEKFESFKADRVASANQKNFYETSTIPRVDVYHKKGKFHLVPIYLHEMVLNE

LPNLSLGTNPEAMDENFFKFSIFKDDLISIQTQGTPKKPAKIIMGYFKNMHGANMVLSSINNSP
```

-continued

CEGFTCTPVSMDKKHKDKCKLCPEENRIAGRCLQGFLDYWSQEGLRPPRKEFECDQGVKFALDV

KKYQIDPLGYYYEVKQEKRLGTIPQMRSAKKLVKK

SEQ ID NO: 384
MNNSIKSKPEVTIGLDLGVGSVGWAIVDNETNIIHHLGSRLFSQAKTAEDRRSFRGVRRLIRRR

KYKLKRFVNLIWKYNSYFGFKNKEDILNNYQEQQKLHNTVLNLKSEALNAKIDPKALSWILHDY

LKNRGHFYEDNRDFNVYPTKELAKYFDKYGYYKGIIDSKEDNDNKLEEELTKYKFSNKHWLEEV

KKVLSNQTGLPEKFKEEYESLFSYVRNYSEGPGSINSVSPYGIYHLDEKEGKVVQKYNNIWDKT

IGKCNIFPDEYRAPKNSPIAMIFNEINELSTIRSYSIYLTGWFINQEFKKAYLNKLLDLLIKTN

GEKPIDARQFKKLREETIAESIGKETLKDVENEEKLEKEDHKWKLKGLKLNTNGKIQYNDLSSL

AKFVHKLKQHLKLDFLLEDQYATLDKINFLQSLFVYLGKHLRYSNRVDSANLKEFSDSNKLFER

ILQKQKDGLFKLFEQTDKDDEKILAQTHSLSTKAMLLAITRMTNLDNDEDNQKNNDKGWNFEAI

KNFDQKFIDITKKNNNLSLKQNKRYLDDRFINDAILSPGVKRILREATKVFNAILKQFSEEYDV

TKVVIELARELSEEKELENTKNYKKLIKKNGDKISEGLKALGISEDEIKDILKSPTKSYKFLLW

LQQDHIDPYSLKEIAFDDIFTKTEKFEIDHIIPYSISFDDSSSNKLLVLAESNQAKSNQTPYEF

ISSGNAGIKWEDYEAYCRKFKDGDSSLLDSTQRSKKFAKMMKTDTSSKYDIGFLARNLNDTRYA

TIVFRDALEDYANNHLVEDKPMFKVVCINGSVTSFLRKNFDDSSYAKKDRDKNIHHAVDASIIS

IFSNETKTLFNQLTQFADYKLFKNTDGSWKKIDPKTGVVTEVTDENWKQIRVRNQVSEIAKVIE

KYIQDSNIERKARYSRKIENKTNISLFNDTVYSAKKVGYEDQIKRKNLKTLDIHESAKENKNSK

VKRQFVYRKLVNVSLLNNDKLADLFAEKEDILMYRANPWVINLAEQIFNEYTENKKIKSQNVFE

KYMLDLTKEFPEKFSEFLVKSMLRNKTAIIYDDKKNIVHRIKRLKMLSSELKENKLSNVIIRSK

NQSGTKLSYQDTINSLALMIMRSIDPTAKKQYIRVPLNTLNLHLGDHDFDLHNMDAYLKKPKFV

KYLKANEIGDEYKPWRVLTSGTLLIHKKDKKLMYISSFQNLNDVIEIKNLIETEYKENDDSDSK

KKKKANRFLMTLSTILNDYILLDAKDNFDILGLSKNRIDEILNSKLGLDKIVK

SEQ ID NO: 385
MGGSEVGTVPVTWRLGVDVGERSIGLAAVSYEEDKPKEILAAVSWIHDGGVGDERSGASRLALR

GMARRARRLRRFRRARLRDLDMLLSELGWTPLPDKNVSPVDAWLARKRLAEEYVVDETERRRLL

GYAVSHMARHRGWRNPWTTIKDLKNLPQPSDSWERTRESLEARYSVSLEPGTVGQWAGYLLQRA

PGIRLNPTQQSAGRRAELSNATAFETRLRQEDVLWELRCIADVQGLPEDVVSNVIDAVFCQKRP

SVPAERIGRDPLDPSQLRASRACLEFQEYRIVAAVANLRIRDGSGSRPLSLEERNAVIEALLAQ

TERSLTWSDIALEILKLPNESDLTSVPEEDGPSSLAYSQFAPFDETSARIAEFIAKNRRKIPTF

AQWWQEQDRTSRSDLVAALADNSIAGEEEQELLVHLPDAELEALEGLALPSGRVAYSRLTLSGL

TRVMRDDGVDVHNARKTCFGVDDNWRPPLPALHEATGHPVVDRNLAILRKFLSSATMRWGPPQS

IVVELARGASESRERQAEEEAARRAHRKANDRIRAELRASGLSDPSPADLVRARLLELYDCHCM

YCGAPISWENSELDHIVPRTDGGSNRHENLAITCGACNKEKGRRPFASWAETSNRVQLRDVIDR

VQKLKYSGNMYWTRDEFSRYKKSVVARLKRRTSDPEVIQSIESTGYAAVALRDRLLSYGEKNGV

AQVAVFRGGVTAEARRWLDISIERLFSRVAIFAQSTSTKRLDRRHHAVDAVVLTTLTPGVAKTL

ADARSRRVSAEFWRRPSDVNRHSTEEPQSPAYRQWKESCSGLGDLLISTAARDSIAVAAPLRLR

PTGALHEETLRAFSEHTVGAAWKGAELRRIVEPEVYAAFLALTDPGGRFLKVSPSEDVLPADEN

RHIVLSDRVLGPRDRVKLFPDDRGSIRVRGGAAYIASFHHARVFRWGSSHSPSFALLRVSLADL

AVAGLLRDGVDVFTAELPPWTPAWRYASIALVKAVESGDAKQVGWLVPGDELDFGPEGVTTAAG

-continued

DLSMFLKYFPERHWVVTGFEDDKRINLKPAFLSAEQAEVLRTERSDRPDTLTEAGEILAQFFPR

CWRATVAKVLCHPGLTVIRRTALGQPRWRRGHLPYSWRPWSADPWSGGTP

SEQ ID NO: 386
MHNKKNITIGFDLGIASIGWAIIDSTTSKILDWGTRTFEERKTANERRAFRSTRRNIRRKAYRN

QRFINLILKYKDLFELKNISDIQRANKKDTENYEKIISFFTEIYKKCAAKHSNILEVKVKALDS

KIEKLDLIWILHDYLENRGFFYDLEEENVADKYEGIEHPSILLYDFFKKNGFFKSNSSIPKDLG

GYSFSNLQWVNEIKKLFEVQEINPEFSEKFLNLFTSVRDYAKGPGSEHSASEYGIFQKDEKGKV

FKKYDNIWDKTIGKCSFFVEENRSPVNYPSYEIFNLLNQLINLSTDLKTTNKKIWQLSSNDRNE

LLDELLKVKEKAKIISISLKKNEIKKIILKDFGFEKSDIDDQDTIEGRKIIKEEPTTKLEVTKH

LLATIYSHSSDSNWININNILEFLPYLDAICIILDREKSRGQDEVLKKLTEKNIFEVLKIDREK

QLDFVKSIFSNTKFNFKKIGNFSLKAIREFLPKMFEQNKNSEYLKWKDEEIRRKWEEQKSKLGK

TDKKTKYLNPRIFQDEIISPGTKNTFEQAVLVLNQIIKKYSKENIIDAIIIESPREKNDKKTIE

EIKKRNKKGKGKTLEKLFQILNLENKGYKLSDLETKPAKLLDRLRFYHQQDGIDLYTLDKINID

QLINGSQKYEIEHIIPYSMSYDNSQANKILTEKAENLKKGKLIASEYIKRNGDEFYNKYYEKAK

ELFINKYKKNKKLDSYVDLDEDSAKNRFRFLTLQDYDEFQVEFLARNLNDTRYSTKLFYHALVE

HFENNEFFTYIDENSSKHKVKISTIKGHVTKYFRAKPVQKNNGPNENLNNNKPEKIEKNRENNE

HHAVDAAIVAIIGNKNPQIANLLTLADNKTDKKFLLHDENYKENIETGELVKIPKFEVDKLAKV

EDLKKIIQEKYEEAKKHTAIKFSRKTRTILNGGLSDETLYGFKYDEKEDKYFKIIKKKLVTSKN

EELKKYFENPFGKKADGKSEYTVLMAQSHLSEFNKLKEIFEKYNGFSNKTGNAFVEYMNDLALK

EPTLKAEIESAKSVEKLLYYNFKPSDQFTYHDNINNKSFKRFYKNIRIIEYKSIPIKFKILSKH

DGGKSFKDTLFSLYSLVYKVYENGKESYKSIPVTSQMRNFGIDEFDFLDENLYNKEKLDIYKSD

FAKPIPVNCKPVFVLKKGSILKKKSLDIDDFKETKETEEGNYYFISTISKRFNRDTAYGLKPLK

LSVVKPVAEPSTNPIFKEYIPIHLDELGNEYPVKIKEHTDDEKLMCTIK

Nucleic Acids Encoding Cas9 Molecules

Nucleic acids encoding the Cas9 molecules or Cas9 polypeptides, e.g., an eaCas9 molecule or eaCas9 polypeptide are provided herein.

Exemplary nucleic acids encoding Cas9 molecules are described in Cong et al., SCIENCE 2013, 399(6121):819-823; Wang et al., CELL 2013, 153(4):910-918; Mali et al., SCIENCE 2013, 399(6121):823-826; Jinek et al., SCIENCE 2012, 337 (6096):816-821. Another exemplary nucleic acid encoding a Cas9 molecule or Cas9 polypeptide is shown in FIG. 8.

In an embodiment, a nucleic acid encoding a Cas9 molecule or Cas9 polypeptide can be a synthetic nucleic acid sequence. For example, the synthetic nucleic acid molecule can be chemically modified, e.g., as described in Section VIII. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

Provided below is an exemplary codon optimized nucleic acid sequence encoding a Cas9 molecule of S. pyogenes.

(SEQ ID NO: 22)
ATGGATAAAA AGTACAGCAT CGGGCTGGAC ATCGGTACAA

ACTCAGTGGG GTGGGCCGTG ATTACGGACG AGTACAAGGT

ACCCTCCAAA AAATTTAAAG TGCTGGGTAA CACGGACAGA

CACTCTATAA AGAAAAATCT TATTGGAGCC TTGCTGTTCG

ACTCAGGCGA GACAGCCGAA GCCACAAGGT TGAAGCGGAC

CGCCAGGAGG CGGTATACCA GGAGAAAGAA CCGCATATGC

TACCTGCAAG AAATCTTCAG TAACGAGATG GCAAAGGTTG

ACGATAGCTT TTTCCATCGC CTGGAAGAAT CCTTTCTTGT

TGAGGAAGAC AAGAAGCACG AACGGCACCC CATCTTTGGC

AATATTGTCG ACGAAGTGGC ATATCACGAA AAGTACCCGA

CTATCTACCA CCTCAGGAAG AAGCTGGTGG ACTCTACCGA

TAAGGCGGAC CTCAGACTTA TTTATTTGGC ACTCGCCCAC

ATGATTAAAT TTAGAGGACA TTTCTTGATC GAGGGCGACC

TGAACCCGGA CAACAGTGAC GTCGATAAGC TGTTCATCCA

-continued

```
ACTTGTGCAG ACCTACAATC AACTGTTCGA AGAAAACCCT
ATAAATGCTT CAGGAGTCGA CGCTAAAGCA ATCCTGTCCG
CGCGCCTCTC AAAATCTAGA AGACTTGAGA ATCTGATTGC
TCAGTTGCCC GGGGAAAAGA AAAATGGATT GTTTGGCAAC
CTGATCGCCC TCAGTCTCGG ACTGACCCCA AATTTCAAAA
GTAACTTCGA CCTGGCCGAA GACGCTAAGC TCCAGCTGTC
CAAGGACACA TACGATGACG ACCTCGACAA TCTGCTGGCC
CAGATTGGGG ATCAGTACGC CGATCTCTTT TTGGCAGCAA
AGAACCTGTC CGACGCCATC CTGTTGAGCG ATATCTTGAG
AGTGAACACC GAAATTACTA AGCACCCCT TAGCGCATCT
ATGATCAAGC GGTACGACGA GCATCATCAG GATCTGACCC
TGCTGAAGGC TCTTGTGAGG CAACAGCTCC CCGAAAAATA
CAAGGAAATC TTCTTTGACC AGAGCAAAAA CGGCTACGCT
GGCTATATAG ATGGTGGGGC CAGTCAGGAG GAATTCTATA
AATTCATCAA GCCCATTCTC GAGAAAATGG ACGGCACAGA
GGAGTTGCTG GTCAAACTTA ACAGGGAGGA CCTGCTGCGG
AAGCAGCGGA CCTTTGACAA CGGGTCTATC CCCCACCAGA
TTCATCTGGG CGAACTGCAC GCAATCCTGA GGAGGCAGGA
GGATTTTTAT CCTTTTCTTA AAGATAACCG CGAGAAAATA
GAAAAGATTC TTACATTCAG GATCCCGTAC TACGTGGGAC
CTCTCGCCCG GGGCAATTCA CGGTTTGCCT GGATGACAAG
GAAGTCAGAG GAGACTATTA CACCTTGGAA CTTCGAAGAA
GTGGTGGACA AGGGTGCATC TGCCCAGTCT TTCATCGAGC
GGATGACAAA TTTTGACAAG AACCTCCCTA ATGAGAAGGT
GCTGCCCAAA CATTCTCTGC TCTACGAGTA CTTTACCGTC
TACAATGAAC TGACTAAAGT CAAGTACGTC ACCGAGGGAA
TGAGGAAGCC GGCATTCCTT AGTGGAGAAC AGAAGAAGGC
GATTGTAGAC CTGTTGTTCA AGACCAACAG GAAGGTGACT
GTGAAGCAAC TTAAAGAAGA CTACTTTAAG AAGATCGAAT
GTTTTGACAG TGTGGAAATT TCAGGGGTTG AAGACCGCTT
CAATGCGTCA TTGGGGACTT ACCATGATCT TCTCAAGATC
ATAAAGGACA AAGACTTCCT GGACAACGAA GAAAATGAGG
ATATTCTCGA AGACATCGTC CTCACCCTGA CCCTGTTCGA
AGACAGGGAA ATGATAGAAG AGCGCTTGAA AACCTATGCC
CACCTCTTCG ACGATAAAGT TATGAAGCAG CTGAAGCGCA
GGAGATACAC AGGATGGGA AGATTGTCAA GGAAGCTGAT
CAATGGAATT AGGGATAAAC AGAGTGGCAA GACCATACTG
GATTTCCTCA AATCTGATGG CTTCGCCAAT AGGAACTTCA
TGCAACTGAT TCACGATGAC TCTCTTACCT TCAAGGAGGA
CATTCAAAAG GCTCAGGTGA GCGGGCAGGG AGACTCCCTT
CATGAACACA TCGCGAATTT GGCAGGTTCC CCCGCTATTA
```

-continued

```
AAAAGGGCAT CCTTCAAACT GTCAAGGTGG TGGATGAATT
GGTCAAGGTA ATGGGCAGAC ATAAGCCAGA AAATATTGTG
ATCGAGATGG CCCGCGAAAA CCAGACCACA CAGAAGGGCC
AGAAAAATAG TAGAGAGCGG ATGAAGAGGA TCGAGGAGGG
CATCAAAGAG CTGGGATCTC AGATTCTCAA GAACACCCC
GTAGAAAACA CACAGCTGCA GAACGAAAAA TTGTACTTGT
ACTATCTGCA GAACGGCAGA GACATGTACG TCGACCAAGA
ACTTGATATT AATAGACTGT CCGACTATGA CGTAGACCAT
ATCGTGCCCC AGTCCTTCCT GAAGGACGAC TCCATTGATA
ACAAAGTCTT GACAAGAAGC GACAAGAACA GGGGTAAAAG
TGATAATGTG CCTAGCGAGG AGGTGGTGAA AAAAATGAAG
AACTACTGGC GACAGCTGCT TAATGCAAAG CTCATTACAC
AACGGAAGTT CGATAATCTG ACGAAAGCAG AGAGAGGTGG
CTTGTCTGAG TTGGACAAGG CAGGGTTTAT TAAGCGGCAG
CTGGTGGAAA CTAGGCAGAT CACAAAGCAC GTGGCGCAGA
TTTTGGACAG CCGGATGAAC ACAAAATACG ACGAAAATGA
TAAACTGATA CGAGAGGTCA AGTTATCAC GCTGAAAAGC
AAGCTGGTGT CCGATTTTCG GAAAGACTTC CAGTTCTACA
AAGTTCGCGA GATTAATAAC TACCATCATG CTCACGATGC
GTACCTGAAC GCTGTTGTCG GACCGCCTT GATAAAGAAG
TACCCAAAGC TGGAATCCGA GTTCGTATAC GGGGATTACA
AAGTGTACGA TGTGAGGAAA ATGATAGCCA AGTCCGAGCA
GGAGATTGGA AAGGCCACAG CTAAGTACTT CTTTTATTCT
AACATCATGA ATTTTTTTAA GACGGAAATT ACCCTGGCCA
ACGGAGAGAT CAGAAAGCGG CCCCTTATAG AGACAAATGG
TGAAACAGGT GAAATCGTCT GGGATAAGGG CAGGGATTTC
GCTACTGTGA GGAAGGTGCT GAGTATGCCA CAGGTAAATA
TCGTGAAAAA AACCGAAGTA CAGACCGGAG GATTTTCCAA
GGAAAGCATT TTGCCTAAAA GAAACTCAGA CAAGCTCATC
GCCCGCAAGA AGATTGGGA CCCTAAGAAA TACGGGGGAT
TTGACTCACC CACCGTAGCC TATTCTGTGC TGGTGGTAGC
TAAGGTGGAA AAAGGAAAGT CTAAGAAGCT GAAGTCCGTG
AAGGAACTCT TGGGAATCAC TATCATGGAA AGATCATCCT
TTGAAAAGAA CCCTATCGAT TTCCTGGAGG CTAAGGGTTA
CAAGGAGGTC AAGAAAGACC TCATCATTAA ACTGCCAAAA
TACTCTCTCT TCGAGCTGGA AAATGGCAGG AAGAGAATGT
TGGCCAGCGC CGGAGAGCTG CAAAAGGGAA ACGAGCTTGC
TCTGCCCTCC AAATATGTTA ATTTTCTCTA TCTCGCTTCC
CACTATGAAA AGCTGAAAGG GTCTCCCGAA GATAACGAGC
AGAAGCAGCT GTTCGTCGAA CAGCACAAGC ACTATCTGGA
```

-continued
```
TGAAATAATC GAACAAATAA GCGAGTTCAG CAAAAGGGTT

ATCCTGGCGG ATGCTAATTT GGACAAAGTA CTGTCTGCTT

ATAACAAGCA CCGGGATAAG CCTATTAGGG AACAAGCCGA

GAATATAATT CACCTCTTTA CACTCACGAA TCTCGGAGCC

CCCGCCGCCT TCAAATACTT TGATACGACT ATCGACCGGA

AACGGTATAC CAGTACCAAA GAGGTCCTCG ATGCCACCCT

CATCCACCAG TCAATTACTG GCCTGTACGA AACACGGATC

GACCTCTCTC AACTGGGCGG CGACTAG
```

Provided below is the corresponding amino acid sequence of a *S. pyogenes* Cas9 molecule.

(SEQ ID NO: 23)
```
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD*
```

Provided below is an exemplary codon optimized nucleic acid sequence encoding a Cas9 molecule of *N. meningitidis*.

(SEQ ID NO: 24)
```
ATGGCCGCCTTCAAGCCCAACCCCATCAACTACATCCTGGGCCTGGACAT

CGGCATCGCCAGCGTGGGCTGGGCCATGGTGGAGATCGACGAGGACGAGA

ACCCCATCTGCCTGATCGACCTGGGTGTGCGCGTGTTCGAGCGCGCTGAG

GTGCCCAAGACTGGTGACAGTCTGGCTATGGCTCGCCGGCTTGCTCGCTC

TGTTCGGCGCCTTACTCGCCGGCGCGCTCACCGCCTTCTGCGCGCTCGCC

GCCTGCTGAAGCGCGAGGGTGTGCTGCAGGCTGCCGACTTCGACGAGAAC

GGCCTGATCAAGAGCCTGCCCAACACTCCTTGGCAGCTGCGCGCTGCCGC

TCTGGACCGCAAGCTGACTCCTCTGGAGTGGAGCGCCGTGCTGCTGCACC

TGATCAAGCACCGCGGCTACCTGAGCCAGCGCAAGAACGAGGGCGAGACC

GCCGACAAGGAGCTGGGTGCTCTGCTGAAGGGCGTGGCCGACAACGCCCA

CGCCCTGCAGACTGGTGACTTCCGCACTCCTGCTGAGCTGGCCCTGAACA

AGTTCGAGAAGGAGAGCGGCCACATCCGCAACCAGCGCGGCGACTACAGC

CACACCTTCAGCCGCAAGGACCTGCAGGCCGAGCTGATCCTGCTGTTCGA

GAAGCAGAAGGAGTTCGGCAACCCCCACGTGAGCGGCGGCCTGAAGGAGG

GCATCGAGACCCTGCTGATGACCCAGCGCCCCGCCCTGAGCGGCGACGCC

GTGCAGAAGATGCTGGGCCACTGCACCTTCGAGCCAGCCGAGCCCAAGGC

CGCCAAGAACACCTACACCGCCGAGCGCTTCATCTGGCTGACCAAGCTGA

ACAACCTGCGCATCCTGGAGCAGGGCAGCGAGCGCCCCCTGACCGACACC

GAGCGCGCCACCCTGATGGACGAGCCCTACCGCAAGAGCAAGCTGACCTA

CGCCCAGGCCCGCAAGCTGCTGGGTCTGGAGGACACCGCCTTCTTCAAGG

GCCTGCGCTACGGCAAGGACAACGCCGAGGCCAGCACCCTGATGGAGATG

AAGGCCTACCACGCCATCAGCCGCGCCCTGGAGAAGGAGGGCCTGAAGGA

CAAGAAGAGTCCTCTGAACCTGAGCCCCGAGCTGCAGGACGAGATCGGCA

CCGCCTTCAGCCTGTTCAAGACCGACGAGGACATCACCGGCCGCCTGAAG

GACCGCATCCAGCCCGAGATCCTGGAGGCCCTGCTGAAGCACATCAGCTT

CGACAAGTTCGTGCAGATCAGCCTGAAGGCCCTGCGCCGCATCGTGCCCC

TGATGGAGCAGGGCAAGCGCTACGACGAGGCCTGCGCCGAGATCTACGGC

GACCACTACGGCAAGAAGAACACCGAGGAGAAGATCTACCTGCCTCCTAT

CCCCGCCGACGAGATCCGCAACCCCGTGGTGCTGCGCGCCCTGAGCCAGG

CCCGCAAGGTGATCAACGGCGTGGTGCGCCGCTACGGCAGCCCCGCCCGC

ATCCACATCGAGACCGCCCGCGAGGTGGGCAAGAGCTTCAAGGACCGCAA

GGAGATCGAGAAGCGCCAGGAGGAGAACCGCAAGGACCGCGAGAAGGCCG

CCGCCAAGTTCCGCGAGTACTTCCCCAACTTCGTGGGCGAGCCCAAGAGC

AAGGACATCCTGAAGCTGCGCCTGTACGAGCAGCAGCACGGCAAGTGCCT

GTACAGCGGCAAGGAGATCAACCTGGGCCGCCTGAACGAGAAGGGCTACG

TGGAGATCGACCACGCCCTGCCCTTCAGCCGCACCTGGGACGACAGCTTC

AACAACAAGGTGCTGGTGCTGGGCAGCGAGAACCAGAACAAGGGCAACCA

GACCCCCTACGAGTACTTCAACGGCAAGGACAACAGCCGCGAGTGGCAGG

AGTTCAAGGCCCGCGTGGAGACCAGCCGCTTCCCCCGCAGCAAGAAGCAG

CGCATCCTGCTGCAGAAGTTCGACGAGGACGGCTTCAAGGAGCGCAACCT
```

-continued
```
GAACGACACCCGCTACGTGAACCGCTTCCTGTGCCAGTTCGTGGCCGACC
GCATGCGCCTGACCGGCAAGGGCAAGAAGCGCGTGTTCGCCAGCAACGGC
CAGATCACCAACCTGCTGCGCGGCTTCTGGGGCCTGCGCAAGGTGCGCGC
CGAGAACGACCGCCACCACGCCCTGGACGCCGTGGTGGTGGCCTGCAGCA
CCGTGGCCATGCAGCAGAAGATCACCCGCTTCGTGCGCTACAAGGAGATG
AACGCCTTCGACGGTAAAACCATCGACAAGGAGACCGGCGAGGTGCTGCA
CCAGAAGACCCACTTCCCCCAGCCCTGGGAGTTCTTCGCCCAGGAGGTGA
TGATCCGCGTGTTCGGCAAGCCCGACGGCAAGCCCGAGTTCGAGGAGGCC
GACACCCCCGAGAAGCTGCGCACCCTGCTGGCCGAGAAGCTGAGCAGCCG
CCCTGAGGCCGTGCACGAGTACGTGACTCCTCTGTTCGTGAGCCGCGCCC
CCAACCGCAAGATGAGCGGTCAGGGTCACATGGAGACCGTGAAGAGCGCC
AAGCGCCTGGACGAGGGCGTGAGCGTGCTGCGCGTGCCCCTGACCCAGCT
GAAGCTGAAGGACCTGGAGAAGATGGTGAACCGCGAGCGCGAGCCCAAGC
TGTACGAGGCCCTGAAGGCCCGCCTGGAGGCCCACAAGGACGACCCCGCC
AAGGCCTTCGCCGAGCCCTTCTACAAGTACGACAAGGCCGGCAACCGCAC
CCAGCAGGTGAAGGCCGTGCGCGTGGAGCAGGTGCAGAAGACCGGCGTGT
GGGTGCGCAACCACAACGGCATCGCCGACAACGCCACCATGGTGCGCGTG
GACGTGTTCGAGAAGGGCGACAAGTACTACCTGGTGCCCATCTACAGCTG
GCAGGTGGCCAAGGGCATCCTGCCCGACCGCGCCGTGGTGCAGGGCAAGG
ACGAGGAGGACTGGCAGCTGATCGACGACAGCTTCAACTTCAAGTTCAGC
CTGCACCCCAACGACCTGGTGGAGGTGATCACCAAGAAGGCCCGCATGTT
CGGCTACTTCGCCAGCTGCCACCGCGGCACCGGCAACATCAACATCCGCA
TCCACGACCTGGACCACAAGATCGGCAAGAACGGCATCCTGGAGGGCATC
GGCGTGAAGACCGCCCTGAGCTTCCAGAAGTACCAGATCGACGAGCTGGG
CAAGGAGATCCGCCCCTGCCGCCTGAAGAAGCGCCCTCCTGTGCGCTAA
```

Provided below is the corresponding amino acid sequence of a *N. meningitidis* Cas9 molecule.

(SEQ ID NO: 25)
```
MAAFKPNPINYILGLDIGIASVGWAMVEIDEDENPICLIDLGVRVFERAE
VPKTGDSLAMARRLARSVRRLTRRRAHRLLRARRLLKREGVLQAADFDEN
GLIKSLPNTPWQLRAAALDRKLTPLEWSAVLLHLIKHRGYLSQRKNEGET
ADKELGALLKGVADNAHALQTGDFRTPAELALNKFEKESGHIRNQRGDYS
HTFSRKDLQAELILLFEKQKEFGNPHVSGGLKEGIETLLMTQRPALSGDA
VQKMLGHCTFEPAEPKAAKNTYTAERFIWLTKLNNLRILEQGSERPLTDT
ERATLMDEPYRKSKLTYAQARKLLGLEDTAFFKGLRYGKDNAEASTLMEM
KAYHAISRALEKEGLKDKKSPLNLSPELQDEIGTAFSLFKTDEDITGRLK
DRIQPEILEALLKHISFDKFVQISLKALRRIVPLMEQGKRYDEACAEIYG
DHYGKKNTEEKIYLPPIPADEIRNPVVLRALSQARKVINGVVRRYGSPAR
IHIETAREVGKSFKDRKEIEKRQEENRKDREKAAAKFREYFPNFVGEPKS
KDILKLRLYEQQHGKCLYSGKEINLGRLNEKGYVEIDHALPFSRTWDDSF
NNKVLVLGSENQNKGNQTPYEYFNGKDNSREWQEFKARVETSRFPRSKKQ
RILLQKFDEDGFKERNLNDTRYVNRFLCQFVADRMRLTGKGKKRVFASNG
QITNLLRGFWGLRKVRAENDRHHALDAVVVACSTVAMQQKITRFVRYKEM
NAFDGKTIDKETGEVLHQKTHFPQPWEFFAQEVMIRVFGKPDGKPEFEEA
DTPEKLRTLLAEKLSSRPEAVHEYVTPLFVSRAPNRKMSGQGHMETVKSA
KRLDEGVSVLRVPLTQLKLKDLEKMVNREREPKLYEALKARLEAHKDDPA
KAFAEPFYKYDKAGNRTQQVKAVRVEQVQKTGVWVRNHNGIADNATMVRV
DVFEKGDKYYLVPIYSWQVAKGILPDRAVVQGKDEEDWQLIDDSFNFKFS
LHPNDLVEVITKKARMFGYFASCHRGTGNINIRIHDLDHKIGKNGILEGI
GVKTALSFQKYQIDELGKEIRPCRLKKRPPVR*
```

Provided below is an amino acid sequence of a *S. aureus* Cas9 molecule.

(SEQ ID NO: 26)
```
MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFFEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG*
```

Provided below is an exemplary codon optimized nucleic acid sequence encoding a Cas9 molecule of *S. aureus* Cas9.

(SEQ ID NO: 39)
```
ATGAAAAGGAACTACATTCTGGGGCTGGACATCGGGATTACAAGCGTGGG
GTATGGGATTATTGACTATGAAACAAGGGACGTGATCGACGCAGGCGTCA
GACTGTTCAAGGAGGCCAACGTGGAAAACAATGAGGGACGGAGAAGCAAG
```

```
AGGGGAGCCAGGCGCCTGAAACGACGGAGAAGGCACAGAATCCAGAGGGT
GAAGAAACTGCTGTTCGATTACAACCTGCTGACCGACCATTCTGAGCTGA
GTGGAATTAATCCTTATGAAGCCAGGGTGAAAGGCCTGAGTCAGAAGCTG
TCAGAGGAAGAGTTTTCCGCAGCTCTGCTGCACCTGGCTAAGCGCCGAGG
AGTGCATAACGTCAATGAGGTGGAAGAGGACACCGGCAACGAGCTGTCTA
CAAAGGAACAGATCTCACGCAATAGCAAAGCTCTGGAAGAGAAGTATGTC
GCAGAGCTGCAGCTGGAACGGCTGAAGAAAGATGGCGAGGTGAGAGGGTC
AATTAATAGGTTCAAGACAAGCGACTACGTCAAAGAAGCCAAGCAGCTGC
TGAAAGTGCAGAAGGCTTACCACCAGCTGGATCAGAGCTTCATCGATACT
TATATCGACCTGCTGGAGACTCGGAGAACCTACTATGAGGGACCAGGAGA
AGGGAGCCCCTTCGGATGGAAAGACATCAAGGAATGGTACGAGATGCTGA
TGGGACATTGCACCTATTTTCCAGAAGAGCTGAGAAGCGTCAAGTACGCT
TATAACGCAGATCTGTACAACGCCCTGAATGACCTGAACAACCTGGTCAT
CACCCAGGGATGAAAACGAGAAACTGGAATACTATGAGAAGTTCCAGATCA
TCGAAAACGTGTTTAAGCAGAAGAAAAAGCCTACACTGAAACAGATTGCT
AAGGAGATCCTGGTCAACGAAGAGGACATCAAGGGCTACCGGGTGACAAG
CACTGGAAAACCAGAGTTCACCAATCTGAAAGTGTATCACGATATTAAGG
ACATCACAGCACGGAAAGAAATCATTGAGAACGCCGAACTGCTGGATCAG
ATTGCTAAGATCCTGACTATCTACCAGAGCTCCGAGGACATCCAGGAAGA
GCTGACTAACCTGAACAGCGAGCTGACCCAGGAAGAGATCGAACAGATTA
GTAATCTGAAGGGGTACACCGGAACACACAACCTGTCCCTGAAAGCTATC
AATCTGATTCTGGATGAGCTGTGGCATACAAACGACAATCAGATTGCAAT
CTTTAACCGGCTGAAGCTGGTCCCAAAAAAGGTGGACCTGAGTCAGCAGA
AAGAGATCCCAACCACACTGGTGGACGATTTCATTCTGTCACCCGTGGTC
AAGCGGAGCTTCATCCAGAGCATCAAAGTGATCAACGCCATCATCAAGAA
GTACGGCCTGCCCAATGATATCATTATCGAGCTGGCTAGGGAGAAGAACA
GCAAGGACGCACAGAAGATGATCAATGAGATGCAGAAACGAAACCGGCAG
ACCAATGAACGCATTGAAGAGATTATCCGAACTACCGGGAAAGAGAACGC
AAAGTACCTGATTGAAAAAATCAAGCTGCACGATATGCAGGAGGGAAAGT
GTCTGTATTCTCTGGAGGCCATCCCCCTGGAGGACCTGCTGAACAATCCA
TTCAACTACGAGGTCGATCATATTATCCCCAGAAGCGTGTCCTTCGACAA
TTCCTTTAACAACAAGGTGCTGGTCAAGCAGGAAGAGAACTCTAAAAAGG
GCAATAGGACTCCTTTCCAGTACCTGTCTAGTTCAGATTCCAAGATCTCT
TACGAAACCTTTAAAAAGCACATTCTGAATCTGGCCAAAGGAAAGGGCCG
CATCAGCAAGACCAAAAAGGAGTACCTGCTGGAAGAGCGGGACATCAACA
GATTCTCCGTCCAGAAGGATTTTATTAACCGGAATCTGGTGGACACAAGA
TACGCTACTCGCGGCCTGATGAATCTGCTGCGATCCTATTTCCGGGTGAA
CAATCTGGATGTGAAAGTCAAGTCCATCAACGGCGGGTTCACATCTTTTC
TGAGGCGCAAATGGAAGTTTAAAAAGGAGCGCAACAAAGGGTACAAGCAC
CATGCCGAAGATGCTCTGATTATCGCAAATGCCGACTTCATCTTTAAGGA
GTGGAAAAAGCTGGACAAAGCCAAGAAAGTGATGGAGAACCAGATGTTCG

AAGAGAAGCAGGCCGAATCTATGCCCGAAATCGAGACAGAACAGGAGTAC
AAGGAGATTTTCATCACTCCTCACCAGATCAAGCATATCAAGGATTTCAA
GGACTACAAGTACTCTCACCGGGTGGATAAAAAGCCCAACAGAGAGCTGA
TCAATGACACCCTGTATAGTACAAGAAAAGACGATAAGGGGAATACCCTG
ATTGTGAACAATCTGAACGGACTGTACGACAAAGATAATGACAAGCTGAA
AAAGCTGATCAACAAAAGTCCCGAGAAGCTGCTGATGTACCACCATGATC
CTCAGACATATCAGAAACTGAAGCTGATTATGGAGCAGTACGGCGACGAG
AAGAACCCACTGTATAAGTACTATGAAGAGACTGGGAACTACCTGACCAA
GTATAGCAAAAAGGATAATGGCCCCGTGATCAAGAAGATCAAGTACTATG
GGAACAAGCTGAATGCCCATCTGGACATCACAGACGATTACCCTAACAGT
CGCAACAAGGTGGTCAAGCTGTCACTGAAGCCATACAGATTCGATGTCTA
TCTGGACAACGGCGTGTATAAATTTGTGACTGTCAAGAATCTGGATGTCA
TCAAAAAGGAGAACTACTATGAAGTGAATAGCAAGTGCTACGAAGAGGCT
AAAAAGCTGAAAAAGATTAGCAACCAGGCAGAGTTCATCGCCTCCTTTTA
CAACAACGACCTGATTAAGATCAATGGCGAACTGTATAGGGTCATCGGGG
TGAACAATGATCTGCTGAACCGCATTGAAGTGAATATGATTGACATCACT
TACCGAGAGTATCTGGAAAACATGAATGATAAGCGCCCCCCTCGAATTAT
CAAAACAATTGCCTCTAAGACTCAGAGTATCAAAAAGTACTCAACCGACA
TTCTGGGAAACCTGTATGAGGTGAAGAGCAAAAAGCACCCTCAGATTATC
AAAAAGGGC
```

If any of the above Cas9 sequences are fused with a peptide or polypeptide at the C-terminus, it is understood that the stop codon will be removed.

Other Cas Molecules and Cas9 Polypeptides

Various types of Cas molecules or Cas9 polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al., PLoS COMPUTATIONAL BIOLOGY 2005, 1(6): e60 and Makarova et al., NATURE REVIEW MICROBIOLOGY 2011, 9:467-477, the contents of both references are incorporated herein by reference in their entirety. Exemplary Cas molecules (and Cas systems) are also shown in Table 55.

TABLE 55

Cas Systems

| Gene name[‡] | System type or subtype | Name from Haft et al.[§] | Structure of encoded protein (PDB accessions)[¶] | Families (and superfamily) of encoded protein[#][**] | Representatives |
|---|---|---|---|---|---|
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |
| cas8a2 | Subtype I-A[‡‡] | csa4 and csx9 | NA | PH0918 | AF0070, AF1873, MJ0385, PF0637, PH0918 and SSO1401 |
| cas8b | Subtype I-B[‡‡] | csh1 and TM1802 | NA | BH0338-like | MTH1090 and TM1802 |
| cas8c | Subtype I-C[‡‡] | csd1 and csp2 | NA | BH0338-like | BH0338 |
| cas9 | Type II[‡‡] | csn1 and csx12 | NA | COG3513 | FTN_0757 and SPy1046 |
| cas10 | Type III[‡‡] | cmr2, csm1 and csx11 | NA | COG1353 | MTH326, Rv2823c[§§] and TM1794[§§] |
| cas10d | Subtype I-D[‡‡] | csc3 | NA | COG1353 | slr7011 |
| csy1 | Subtype I-F[‡‡] | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E[‡‡] | cse1 | NA | YgcL-like | ygcL |
| cse2 | Subtype I-E | cse2 | 2ZCA | YgcK-like | ygcK |
| csc1 | Subtype I-D | cse1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ380, PF0643 and SSO1398 |
| csn2 | Subtype II-A | csn2 | NA | SPy1049-like | SPy1049 |
| csm2 | Subtype III-A[‡‡] | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |

TABLE 55-continued

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cmr4 | Subtype III-B | cmr4 | NA | COG1336 (RAMP) | PF1126 |
| cmr5 | Subtype III-B‡‡ | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U§§ | NA | NA | (RAMP) | Balac_1305 and GSU0054 |
| csb3 | Subtype I-U | NA | NA | (RAMP) | Balac_1303§§ |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE_2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

IV. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule are described, e.g., in Jinek et al., SCIENCE 2012, 337(6096):816-821.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μl. Reactions are initiated by the addition of 1 μl target DNA (10 nM) and incubated for 1 h at 37° C. Reactions are quenched by the addition of 20 μl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA are described, e.g., in Jinek et al., SCIENCE 2012; 337(6096):816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 µl. Cas9 protein molecule is programmed with equimolar amounts of pre-annealed gRNA molecule and titrated from 100 µM to 1 µM. Radiolabeled DNA is added to a final concentration of 20 pM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10×SYPRO Orange® (Life Technologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer+10×SYPRO Orange® (Life Technologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

V. Genome Editing Approaches

Mutations in the CFTR gene may be corrected using one of the approaches or pathways described herein, e.g., using HDR and/or NHEJ. In an embodiment, a mutation in the CFTR gene is corrected by homology directed repair (HDR) using a template nucleic acid (see Section V.1).

Also described herein are methods for targeted knockout of one or both alleles of the SCNN1A gene using NHEJ (see Section V.2).

V.1 HDR Repair, HDR Mediated Knockin and Template Nucleic Acids

As described herein, nuclease-induced homology directed repair (HDR) can be used to alter a target sequence and correct (e.g., repair or edit) a mutation in the genome. While not wishing to be bound by theory, it is believed that alteration of the target sequence occurs by homology-directed repair (HDR) with a donor template or template nucleic acid. For example, the donor template or the template nucleic acid provides for alteration of the target sequence. It is contemplated that a plasmid donor can be used as a template for homologous recombination. It is further contemplated that a single stranded donor template can be used as a template for alteration of the target sequence by alternate methods of homology directed repair (e.g., single strand annealing) between the target sequence and the donor template. Donor template-effected alteration of a target sequence depends on cleavage by a Cas9 molecule. Cleavage by Cas9 can comprise a double strand break or one, two or more single strand breaks.

Mutations that can be corrected by HDR using a template nucleic acid include point mutations. In an embodiment, a point mutation can be corrected by either a single double-strand break or two single strand breaks. In an embodiment, a point mutation can be corrected by (1) a single double-strand break, (2) two single strand breaks, (3) two double stranded breaks with a break occurring on each side of the target sequence, or (4) four single stranded breaks with a pair of single stranded breaks occurring on each side of the target sequence.

Mutations in the CFTR gene that can be corrected (e.g., altered) by HDR with a template nucleic acid include deletion mutation at F508 (F508del) or point mutation at G551, e.g., G551D.

Double Strand Break Mediated Correction or Knockin

In an embodiment, double strand cleavage is effected by a Cas9 molecule having cleavage activity associated with an HNH-like domain and cleavage activity associated with an RuvC-like domain, e.g., an N-terminal RuvC-like domain, e.g., a wild type Cas9. Such embodiments require only a single gRNA.

Single Strand Break Mediated Correction or Knockin

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). In other embodiments, a Cas9 molecule having an N863, e.g., an N863A mutation can be used as a nickase. N863A inactivates HNH therefore the Cas9 nickase has (only) RuvC activity and cuts on the non-complementary strand (the strand that has the PAM and whose sequence is identical to the gRNA).

In an embodiment, in which a nickase and two gRNAs are used to position two single strand nicks, one nick is on the + strand and one nick is on the − strand of the target nucleic acid. The PAMs are outwardly facing. The gRNAs can be selected such that the gRNAs are separated by, from about 0-50, 0-100, or 0-200 nucleotides. In an embodiment, there is no overlap between the target sequence that is complementary to the targeting domains of the two gRNAs.

In an embodiment, the gRNAs do not overlap and are separated by as much as 50, 100, or 200 nucleotides. In an embodiment, the use of two gRNAs can increase specificity, e.g., by decreasing off-target binding (Ran et al., Cell 2013; 154(6):1380-1389).

In an embodiment, a single nick can be used to induce HDR. It is contemplated herein that a single nick can be used to increase the ratio of HR to NHEJ at a given cleavage site.

Placement of Double Strand or Single Strand Breaks Relative to the Target Position The double strand break or single strand break in one of the strands should be sufficiently close to the target position such that correction occurs. In an embodiment, the distance is not more than 50, 100, 200, 300, 350 or 400 nucleotides. While not wishing to be bound by theory, it is believed that the break should be sufficiently close to the target sequence such that the break is within the region that is subject to exonuclease-mediated removal during end resection. If the distance between the target sequence and a break is too great, the mutation may not be included in the end resection and, therefore, may not be corrected, as donor sequence may only be used to correct sequence within the end resection region.

In an embodiment, in which a gRNA (unimolecular (or chimeric) or modular gRNA) and Cas9 nuclease induce a double strand break for the purpose of inducing HDR-mediated correction, the cleavage site is between 0 to 200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In an embodiment, the cleavage site is between 0 to 100 bp (e.g., 0 to 75, 0 to 50, 0 to 25, 25 to 100, 25 to 75, 25 to 50, 50 to 100, 50 to 75 or 75 to 100 bp) away from the target position.

In an embodiment, in which two gRNAs (independently, unimolecular (or chimeric) or modular gRNA) complexing with Cas9 nickases induce two single strand breaks for the purpose of inducing HDR-mediated correction, the closer nick is between 0 to 200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25 to 55 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp) and no more than 100 bp away from each other (e.g., no more than 90, 80, 70, 60, 50, 40, 30, 20, 10 or 5 bp away from each other). In an embodiment, the cleavage site is between 0 to 100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of the target position. In an embodiment, the gRNAs are configured to place a single strand break on the same side (either 5' or 3') of the target position.

Regardless of whether a break is a double strand or a single strand break, the gRNA should be configured to avoid unwanted target chromosome elements, such as repeated elements, e.g., an Alu repeat, in the target domain. In addition, a break, whether a double strand or a single strand break, should be sufficiently distant from any sequence that should not be altered. For example, cleavage sites positioned within introns should be sufficiently distant from any intron/exon border, or naturally occurring splice signal, to avoid alteration of the exonic sequence or unwanted splicing events.

Length of the Homology Arms

The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., Alu repeats, LINE repeats.

Exemplary homology arm lengths include a least 50, 100, 250, 500, 750 or 1000 nucleotides.

Target position, as used herein, refers to a site on a target nucleic acid (e.g., the chromosome) that is modified by a Cas9 molecule-dependent process. For example, the target position can be a modified Cas9 molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or downstream of a target sequence (e.g., the sequence to which the gRNA binds).

A template nucleic acid, as that term is used herein, refers to a nucleic acid sequence which can be used in conjunction with a Cas9 molecule and a gRNA molecule to alter the structure of a target position. In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is encoded on the same vector backbone, e.g.

AAV genome, plasmid DNA, as the Cas9 and gRNA. In an embodiment, the template nucleic acid is excised from a vector backbone in vivo, e.g., it is flanked by gRNA recognition sequences.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In another embodiment, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in the CFTR gene can be used to alter the structure of a target sequence. The template sequence can be used to alter an unwanted structure, e.g., an unwanted or mutant nucleotide.

A template nucleic acid comprises the following components:

[5' homology arm]-[replacement sequence]-[3' homology arm].

The homology arms provide for recombination into the chromosome, thus replacing the undesired element, e.g., a mutation or signature, with the replacement sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, or 2000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, or 2000 nucleotides 3' from the 3' end of the replacement sequence.

Exemplary Template Nucleic Acids

Exemplary template nucleic acids (also referred to herein as donor constructs) to correct a mutation, e.g., F508del target position in the CFTR gene, are provided.

Suitable sequence for the 5' homology arm can be selected from (e.g., includes a portion of) or include the following sequence:

(5'H arm)
SEQ ID NO: 27266
AAAATACAAAAAATTAGCCAGACGTGATGGCGGGTGCCCGTAGTCCCAGC

TACTCGGGAGGCTGAGGCAGGAGAATGGCGTGAACCCAGGAGGCAGAACT

TGCAGTGAGCCGAGATCGCGCCACTGCACTCTAGCCTGGGTGACAGAGTG

AGACTCTGTCTCTAAATAAATAAATAAATAAATAAATAAATAAATAAAAT

CAGTGCTTTTTCTTCCTCTGCTACCTCCTTTCCTTCTACTCAGTTTTAGT

CAGTAGTATTATCTTTTTTCAGATTTATCTTTGTATTGTTAAATCTGCTT

ATGCTTCTATTACTTTATTTATTAGCTTTAAATGATACCTTTTGACTTTC

AGCTTTTCTTAATAAAGCAATCAGCAAATTTCCTTTACACTCCACACTTA

TACCCCATTTCCTTTGTTTGTTTATTTGGTTTTTACTTCTAACTTTTCTT

ATTGTCAGGACATATAACATATTTAAACTTTGTTTTTCAACTCGAATTCT

GCCATTAGTTTTAATTTTTGTTCACAGTTATATAAATCTTTGTTCACTGA

TAGTCCTTTTGTACTATCATCTCTTAAATGACTTTATACTCCAAGAAAGG

CTCATGGGAACAATATTACCTGAATATGTCTCTATTACTTAATCTGTACC

TAATAATATGAAGGTAATCTACTTTGTAGGATTTCTGTGAAGATTAAATA

AATTAATATAGTTAAAGCACATAGAACAGCACTCGACACAGAGTGAGCAC

TTGGCAACTGTTAGCTGTTACTAACCTTTCCCATTCTTCCTCCAAACCTA

TTCCAACTATCTGAATCATGTGCCCCTTCTCTGTGAACCTCTATCATAAT

ACTTGTCACACTGTATTGTAATTGTCTCTTTTACTTTCCCTTGTATCTTT

TGTGCATAGCAGAGTACCTGAAACAGGAAGTATTTTAAATATTTTGAATC

AAATGAGTTAATAGAATCTTTACAAATAAGAATATACACTTCTGCTTAGG

ATGATAATTGGAGGCAAGTGAATCCTGAGCGTGATTTGATAATGACCTAA

TAATGATGGGTTTTATTTCCAGACTTCACTTCTAATGGTGATTATGGGAG

AACTGGAGCCTTCAGAGGGTAAAATTAAGCACAGTGGAAGAATTTCATTC

TGTTCTCAGTTTTCCTGGATTATGCCTGGCACCATTAAAGAAAATATCAT

Suitable sequence for the 3' homology arm can be selected from (e.g., includes a portion of) or include the following sequence:

(3'H arm)
SEQ ID NO: 27267
TGGTGTTTCCTATGATGAATATAGATACAGAAGCGTCATCAAAGCATGCC

AACTAGAAGAGGTAAGAAACTATGTGAAAACTTTTTGATTATGCATATGA

ACCCTTCACACTACCCAAATTATATATTTGGCTCCATATTCAATCGGTTA

GTCTACATATATTTATGTTTCCTCTATGGGTAAGCTACTGTGAATGGATC

AATTAATAAAACACATGACCTATGCTTTAAGAAGCTTGCAAACACATGAA

ATAAATGCAATTTATTTTTTAAATAATGGGTTCATTTGATCACAATAAAT

GCATTTTATGAAATGGTGAGAATTTTGTTCACTCATTAGTGAGACAAACG

TCCTCAATGGTTATTTATATGGCATGCATATAAGTGATATGTGGTATCTT

TTTAAAAGATACCACAAAATATGCATCTTTAAAAATATACTCCAAAAATT

-continued
```
ATTAAGATTATTTTAATAATTTTAATAATACTATAGCCTAATGGAATGAG
CATTGATCTGCCAGCAGAGAATTAGAGGGGTAAAATTGTGAAGATATTGT
ATCCCTGGCTTTGAACAAATACCATATAACTTCTAGTGACTGCAATTCTT
TGATGCAGAGGCAAAATGAAGATGATGTCATTACTCATTTCACAACAATA
TTGGAGAATGAGCTAATTATCTGAAAATTACATGAAGTATTCCAAGAGAA
ACCAGTATATGGATCTTGTGCTGTTCACTATGTAAATTGTGTGATGGTGG
GTTCAGTAGTTATTGCTGTAAATGTTAGGGCAGGGAATATGTTACTATGA
AGTTTATTGACAGTATACTCCAAATAGTGTTTGTGATTCAAAAGCAATAT
CTTTGATAGTTGGCATTTGCAATTCCTTTATATAATCTTTTATGAAAAAA
ATTGCAGAGAAAGTAAAATGTAGCTTAAAATACAGTATCCAAAAAAATGG
AAAAGGGCAAACCGTGGATTAGATAGAAATGGCAATTCTTATAAAAAGGG
TTGCATGCTTACATGAATGGCTTTCCATGTATATACTCAGTCATTCAACA
GTTTTTTTTTTAGAGCCCCATTCTTATTTTTTATACACTTTGAGAGCATA
ATGAAAAGAAAAGCTACCTGCAAAAGTTTTGGACTTACCTCAAAGAGGAT
ATACTTCATTCCTCAAAAGGCCTTCTTCCAGGAATAGTATTTCATAACCT
```

In an embodiment, the replacement sequence comprises or consists of CTT residues.

In an embodiment, to correct a mutation, e.g., F508del target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted bases to correct the F508del mutation is shown as lower case sequence, and the 3' homology arm is shown as no emphasis capitalized sequence.

(Template Construct 1; SEQ ID NO: 27268)
```
AAAATACAAAAAATTAGCCAGACGTGATGGCGGGTGCCCGTAGTCCCAGC
TACTCGGGAGGCTGAGGCAGGAGAATGGCGTGAACCCAGGAGGCAGAACT
TGCAGTGAGCCGAGATCGCGCCACTGCACTCTAGCCTGGGTGACAGAGTG
AGACTCTGTCTCTAAATAAATAAATAAATAAATAAATAAATAAATAAAT
CAGTGCTTTTTCTTCCTCTGCTACCTCCTTTCCTTCTACTCAGTTTTAGT
CAGTAGTATTATCTTTTTTCAGATTTATCTTTGTATTGTTAAATCTGCTT
ATGCTTCTATTACTTTATTTATTAGCTTTAAATGATACCTTTTGACTTTC
AGCTTTTCTTAATAAAGCAATCAGCAAATTTCCTTTACACTCCACACTTA
TACCCCATTTCCTTTGTTTGTTTATTTGGTTTTTACTTCTAACTTTTCTT
ATTGTCAGGACATATAACATATTTAAACTTTGTTTTTCAACTCGAATTCT
GCCATTAGTTTTAATTTTTGTTCACAGTTATATAAATCTTTGTTCACTGA
TAGTCCTTTTGTACTATCATCTCTTAAATGACTTTATACTCCAAGAAAGG
CTCATGGGAACAATATTACCTGAATATGTCTCTATTACTTAATCTGTACC
TAATAATATGAAGGTAATCTACTTTGTAGGATTTCTGTGAAGATTAAATA
AATTAATATAGTTAAAGCACATAGAACAGCACTCGACACAGAGTGAGCAC
TTGGCAACTGTTAGCTGTTACTAACCTTTCCCATTCTTCCTCCAAACCTA
TTCCAACTATCTGAATCATGTGCCCCTTCTCTGTGAACCTCTATCATAAT
```

-continued
```
ACTTGTCACACTGTATTGTAATTGTCTCTTTTACTTTCCCTTGTATCTTT
TGTGCATAGCAGAGTACCTGAAACAGGAAGTATTTTAAATATTTTGAATC
AAATGAGTTAATAGAATCTTTACAAATAAGAATATACACTTCTGCTTAGG
ATGATAATTGGAGGCAAGTGAATCCTGAGCGTGATTTGATAATGACCTAA
TAATGATGGGTTTTATTTCCAGACTTCACTTCTAATGGTGATTATGGGAG
AACTGGAGCCTTCAGAGGGTAAAATTAAGCACAGTGGAAGAATTTCATTC
TGTTCTCAGTTTTCCTGGATTATGCCTGGCACCATTAAAGAAAATATCAT
cttTGGTGTTTCCTATGATGAATATAGATACAGAAGCGTCATCAAAGCAT
GCCAACTAGAAGAGGTAAGAAACTATGTGAAAACTTTTTGATTATGCATA
TGAACCCTTCACACTACCCAAATTATATATTTGGCTCCATATTCAATCGG
TTAGTCTACATATATTTATGTTTCCTCTATGGGTAAGCTACTGTGAATGG
ATCAATTAATAAAACACATGACCTATGCTTTAAGAAGCTTGCAAACACAT
GAAATAAATGCAATTTATTTTTTAAATAATGGGTTCATTTGATCACAATA
AATGCATTTTATGAAATGGTGAGAATTTTGTTCACTCATTAGTGAGACAA
ACGTCCTCAATGGTTATTTATATGGCATGCATATAAGTGATATGTGGTAT
CTTTTTAAAAGATACCACAAAATATGCATCTTTAAAAATATACTCCAAAA
ATTATTAAGATTATTTTAATAATTTTAATAATACTATAGCCTAATGGAAT
GAGCATTGATCTGCCAGCAGAGAATTAGAGGGGTAAAATTGTGAAGATAT
TGTATCCCTGGCTTTGAACAAATACCATATAACTTCTAGTGACTGCAATT
CTTTGATGCAGAGGCAAAATGAAGATGATGTCATTACTCATTTCACAACA
ATATTGGAGAATGAGCTAATTATCTGAAAATTACATGAAGTATTCCAAGA
GAAACCAGTATATGGATCTTGTGCTGTTCACTATGTAAATTGTGTGATGG
TGGGTTCAGTAGTTATTGCTGTAAATGTTAGGGCAGGGAATATGTTACTA
TGAAGTTTATTGACAGTATACTCCAAATAGTGTTTGTGATTCAAAAGCAA
TATCTTTGATAGTTGGCATTTGCAATTCCTTTATATAATCTTTTATGAAA
AAAATTGCAGAGAAAGTAAAATGTAGCTTAAAATACAGTATCCAAAAAAA
TGGAAAAGGGCAAACCGTGGATTAGATAGAAATGGCAATTCTTATAAAAA
GGGTTGCATGCTTACATGAATGGCTTTCCATGTATATACTCAGTCATTCA
ACAGTTTTTTTTTAGAGCCCCATTCTTATTTTTTATACACTTTGAGAGC
ATAATGAAAAGAAAAGCTACCTGCAAAAGTTTTGGACTTACCTCAAAGAG
GATATACTTCATTCCTCAAAAGGCCTTCTTCCAGGAATAGTATTTCATAA
CCT
```

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct F508del mutation in the CFTR gene, the 5' homology arm may be shortened less than 500 nucleotides, e.g., approximately 450 nucleotides, e.g., 428 nucleotides, to avoid inclusion of a LINE repeat element in the 5' homology arm. The 5' homology arm is shown as bold sequence, the inserted bases to correct the F508del mutation is shown as lower case sequence, and the 3' homology arm is shown as no emphasis capitalized sequence.

(Template Construct 2; SEQ ID NO: 27269)
AACCTTTCCCATTCTTCCTCCAAACCTATTCCAACTATCTGAATCATGTG

CCCCTTCTCTGTGAACCTCTATCATAATACTTGTCACACTGTATTGTAAT

TGTCTCTTTTACTTTCCCTTGTATCTTTTGTGCATAGCAGAGTACCTGAA

ACAGGAAGTATTTTAAATATTTTGAATCAAATGAGTTAATAGAATCTTTA

CAAATAAGAATATACACTTCTGCTTAGGATGATAATTGGAGGCAAGTGAA

TCCTGAGCGTGATTTGATAATGACCTAATAATGATGGGTTTTATTTCCAG

ACTTCACTTCTAATGGTGATTATGGGAGAACTGGAGCCTTCAGAGGGTAA

AATTAAGCACAGTGGAAGAATTTCATTCTGTTCTCAGTTTTCCTGGATTA

TGCCTGGCACCATTAAAGAAAATATCATcttTGGTGTTTCCTATGATGAA

TATAGATACAGAAGCGTCATCAAAGCATGCCAACTAGAAGAGGTAAGAAA

CTATGTGAAAACTTTTTGATTATGCATATGAACCCTTCACACTACCCAAA

TTATATATTTGGCTCCATATTCAATCGGTTAGTCTACATATATTTATGTT

TCCTCTATGGGTAAGCTACTGTGAATGGATCAATTAATAAAACACATGAC

CTATGCTTTAAGAAGCTTGCAAACACATGAAATAAATGCAATTTATTTTT

TAAATAATGGGTTCATTTGATCACAATAAATGCATTTTATGAAATGGTGA

GAATTTTGTTCACTCATTAGTGAGACAAACGTCCTCAATGGTTATTTATA

TGGCATGCATATAAGTGATATGTGGTATCTTTTTAAAAGATACCACAAAA

TATGCATCTTTAAAAATATACTCCAAAAATTATTAAGATTATTTTAATAA

TTTTAATAATACTATAGCCTAATGGAATGAGCATTGATCTGCCAGCAGAG

AATTAGAGGGGTAAAATTGTGAAGATATTGTATCCCTGGCTTTGAACAAA

TACCATATAACTTCTAGTGACTGCAATTCTTTGATGCAGAGGCAAAATGA

AGATGATGTCATTACTCATTTCACAACAATATTGGAGAATGAGCTAATTA

TCTGAAAATTACATGAAGTATTCCAAGAGAAACCAGTATATGGATCTTGT

GCTGTTCACTATGTAAATTGTGTGATGGTGGGTTCAGTAGTTATTGCTGT

AAATGTTAGGGCAGGGAATATGTTACTATGAAGTTTATTGACAGTATACT

CCAAATAGTGTTTGTGATTCAAAAGCAATATCTTTGATAGTTGGCATTTG

CAATTCCTTTATATAATCTTTTATGAAAAAAATTGCAGAGAAAGTAAAAT

GTAGCTTAAAATACAGTATCCAAAAAATGGAAAAGGGCAAACCGTGGAT

TAGATAGAAATGGCAATTCTTATAAAAAGGGTTGCATGCTTACATGAATG

GCTTTCCATGTATATACTCAGTCATTCAACAGTTTTTTTTTAGAGCCCC

ATTCTTATTTTTTATACACTTTGAGAGCATAATGAAAAGAAAAGCTACCT

GCAAAAGTTTTGGACTTACCTCAAAGAGGATATACTTCATTCCTCAAAAG

GCCTTCTTCCAGGAATAGTATTTCATAACCT

In an embodiment, to correct F508del mutation in the CFTR gene, the 5' homology arm may be shortened to approximately 500 nucleotides. The 5' homology arm is shown as bold sequence, the inserted bases to correct the F508del mutation is shown as lower case sequence, and the 3' homology arm is shown as no emphasis capitalized sequence.

(Template Construct 3; SEQ ID NO: 27270)
AATTAATATAGTTAAAGCACATAGAACAGCACTCGACACAGAGTGAGCAC

TTGGCAACTGTTAGCTGTTACTAACCTTTCCCATTCTTCCTCCAAACCTA

TTCCAACTATCTGAATCATGTGCCCCTTCTCTGTGAACCTCTATCATAAT

ACTTGTCACACTGTATTGTAATTGTCTCTTTTACTTTCCCTTGTATCTTT

TGTGCATAGCAGAGTACCTGAAACAGGAAGTATTTTAAATATTTTGAATC

AAATGAGTTAATAGAATCTTTACAAATAAGAATATACACTTCTGCTTAGG

ATGATAATTGGAGGCAAGTGAATCCTGAGCGTGATTTGATAATGACCTAA

TAATGATGGGTTTTATTTCCAGACTTCACTTCTAATGGTGATTATGGGAG

AACTGGAGCCTTCAGAGGGTAAAATTAAGCACAGTGGAAGAATTTCATTC

TGTTCTCAGTTTTCCTGGATTATGCCTGGC*ACCATTAAAG*A*AAATA*T*CAT* ctt*TGG*TGTTTCCTATGATGAATATAGATACAGAAGCGTCATCAAAGCAT

GCCAACTAGAAGAGGTAAGAAACTATGTGAAAACTTTTTGATTATGCATA

TGAACCCTTCACACTACCCAAATTATATATTTGGCTCCATATTCAATCGG

TTAGTCTACATATATTTATGTTTCCTCTATGGGTAAGCTACTGTGAATGG

ATCAATTAATAAAACACATGACCTATGCTTTAAGAAGCTTGCAAACACAT

GAAATAAATGCAATTTATTTTTTAAATAATGGGTTCATTTGATCACAATA

AATGCATTTTATGAAATGGTGAGAATTTTGTTCACTCATTAGTGAGACAA

ACGTCCTCAATGGTTATTTATATGGCATGCATATAAGTGATATGTGGTAT

CTTTTTAAAAGATACCACAAAATATGCATCTTTAAAAATATACTCCAAAA

ATTATTAAGATTATTTTAATAATTTTAATAATACTATAGCCTAATGGAAT

GAG

It is contemplated herein that, in an embodiment, template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., F508del target site in the CFTR gene. For example, the ssODN may include 5' and 3' homology arms as shown below. The 5' homology arm is shown as bold sequence, the inserted bases to correct the F508del mutation is shown as lower case sequence, and the 3' homology arm is shown as no emphasis capitalized sequence.

(Template Construct 4; SEQ ID NO: 27271)
TAAGCACAGTGGAAGAATTTCATTCTGTTCTCAGTTTTCCTGGATTATGC

CTGGCACCATTAAAGAAAATATCATcttTGGTGTTTCCTATGATGAATAT

AGATACAGAAGCGTCATCAAAGCATGCCAACTAGAAGAGGTAAGAAACTA

TGT

Exemplary template nucleic acids (also referred to herein as donor constructs) to correction a mutation, e.g., G542X target site in the CFTR gene, are provided.

Suitable sequence for the 5' homology arm can be selected from (e.g., includes a portion of) or include the following sequence:

(5'H arm)

SEQ ID NO: 27272

TGTCCATATGGTAGATAAATGGAACAAATGAATAACAGAAGTAACCATTT

TGATACTTTAGATATAGATAATATTGGATTATTTCTGGATTGTGAAAGAA

GAAGGAAGAAGCATATGGAAGAGAAGTTTTAGTAGAGGGGAGGAAGGAGG

AGGTGGAAACGAATGTACAAGGATGGGAGGAGAAAAGGGAGAGAGACTTT

TTTTTTTTTAAGGCGAGAGTTTACTACCTATCTAACTCTTCGCATTCTTG

AAGTCTCAGACCAAATCCCATCGGTTTGAAAGCCTCTAGGGTATTCTATC

TATTGTATACTTCTGTTATGTACAAAATTAATTTGCCAATTAATTGTGAA

CTGTTTTATAAACTATCTTAAAATGGTTAGTTAAATCTTTGGGATAGTAT

TTAGCTTTCTCCAGGATTATGACTTACCTTCTAAATTAGACATACAATGC

CTAGGAGTCAAGGACTATTTTGCATAAATTCCAGTCTTCTTTTACAATGC

CTAGAATGATTGTTACCACAGAAATATTCATTACCTGGGAGAAAGGATGA

CAGGAGGGGCAGAATGAATGGAGAGAGGTCGTGAGAATGAGGTGCTGAGG

ATGGACGAGGAAGAAAGCTGTTTTAGTTGGGAGGATAGGTGACAGAAGCA

TGGAAAGGAATTGCCTTGGACCCATGGAAGCCCAGTGAAGATACTTAGAT

CCTGCAGGGGTGTGAATAATGTTCTTTTAGTTTCTCTTCTTAGGAGGTTT

GTTCATTTTGGGAGATTTCTTTTGAAAAGAGTGAACTTAAATTGGAGAAA

AGTACATTTTAGTATGTTGATAACATTTGAATTTGTAAAATGGACCTATG

GATGATCTACACATATTTATATACCCATAAATATACACATATTTTAATTT

TTGGTATTTTATAATTATTATTTAATGATCATTCATGACATTTTAAAAAT

TACAGAAAAATTTACATCTAAAATTTCAGCAATGTTGTTTTTGACCAACT

AAATAAATTGCATTTGAAATAATGGAGATGCAATGTTCAAAATTTCAACT

GTGGTTAAAGCAATAGTGTGATATATGATTACATTAGAAGGAAGATGTGC

CTTTCAAATTCAGATTGAGCATACTAAAAGTGACTCTCTAATTTTCTATT

TTTGGTAATAGGACATCTCCAAGTTTGCAGAGAAAGACAATATAGTTCTT

Suitable sequence for the 3' homology arm can be selected from (e.g., includes a portion of) or include the following sequence:

(3'H arm)

SEQ ID NO: 27273

GAGAAGGTGGAATCACACTGAGTGGAGGTCAACGAGCAAGAATTTCTTTA

GCAAGGTGAATAACTAATTATTGGTCTAGCAAGCATTTGCTGTAAATGTC

ATTCATGTAAAAAAATTACAGACATTTCTCTATTGCTTTATATTCTGTTT

CTGGAATTGAAAAAATCCTGGGGTTTTATGGCTAGTGGGTTAAGAATCAC

ATTTAAGAACTATAAATAATGGTATAGTATCCAGATTTGGTAGAGATTAT

GGTTACTCAGAATCTGTGCCCGTATCTTGGTGTCAGTGTATTTGTTTGCC

TCATAGTATAGTTTACTACAAATGGAAAACTCTAGGATTCTGCATAATAC

TGGACAGAGAAGATGTAAATATCTGTTAGTTCCATCATAGACCCTGCCAC

TCCAATGTACACACCAGCTTTAGGCTTCTTGGTATAGATAAACATACATT

TTCAAAATTTTTCATCATAATTTTCATAACAAAATAGGAAGGCAAATGAT

GTCACTTGGCTTAAAATCTATAATATTTAAAATAAACAGGACAAATGCAT

TAACATTGTTGGGGAGGAGGTCCCTTAGTAGAAACACTCTTGGTCCAAG

CATTTTAAAGCTGTCAAAGAGATGTAAATATAGATAATGTATGTCAAGGA

GAGAGCTTTGTGGTTAAACTGTAACTTTCAGTTTAAACAATTATTGGTGA

CTCTGATGTCAAATGTTTCTCAAGCTTTATCTGAACAAAATTCTTCTCAC

TTTGTTGCCAAAGTCGTTAACAAGAAATCACATTGACTCATTGATGTTTT

GGCTCCTTTCCCTTACTTTCTGTTGCTTTCCAAAAGCTGAGACAGGAAAC

TAACCCTAACTGAGCACCTGCAATTGCCTGGTAGTATTCTAGTCATGTGT

GTACTTTTGTGTGTATGTAATCCCCTTACAGCTCTGCAAAGTAAGAATTG

TTCTCCCTGCTTTACAGAAGAGATCATAAGATAATTGAGGCTGTTAGATG

TTAACTTGCCAAAAGCCATACAGGAAAATGGTAGAGTCACAGTTTGAACC

AGGTCCTTTTGATTCTTTACATTAAACCATGCTTTGATCTTGGAAATACA

CTGTAAGGCAATAAATCAATAGATACGGATAATTCACAGGCTTCTAAATA

AATGGAAGTTGATTGTTTTTATCTGTGAGCCAAAGTAAGACTTATTCTAA

In an embodiment, the replacement sequence comprises or consists of a Guanine (G) residue.

In an embodiment, to correct a mutation, e.g., G542X target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the G542X mutation is shown as lower case sequence, and the 3' homology arm is shown as no emphasis capitalized sequence.

(Template Construct 5; SEQ ID NO: 27274)

TGTCCATATGGTAGATAAATGGAACAAATGAATAACAGAAGTAACCATTT

TGATACTTTAGATATAGATAATATTGGATTATTTCTGGATTGTGAAAGAA

GAAGGAAGAAGCATATGGAAGAGAAGTTTTAGTAGAGGGGAGGAAGGAGG

AGGTGGAAACGAATGTACAAGGATGGGAGGAGAAAAGGGAGAGAGACTTT

TTTTTTTTTAAGGCGAGAGTTTACTACCTATCTAACTCTTCGCATTCTTG

AAGTCTCAGACCAAATCCCATCGGTTTGAAAGCCTCTAGGGTATTCTATC

TATTGTATACTTCTGTTATGTACAAAATTAATTTGCCAATTAATTGTGAA

CTGTTTTATAAACTATCTTAAAATGGTTAGTTAAATCTTTGGGATAGTAT

TTAGCTTTCTCCAGGATTATGACTTACCTTCTAAATTAGACATACAATGC

CTAGGAGTCAAGGACTATTTTGCATAAATTCCAGTCTTCTTTTACAATGC

CTAGAATGATTGTTACCACAGAAATATTCATTACCTGGGAGAAAGGATGA

CAGGAGGGGCAGAATGAATGGAGAGAGGTCGTGAGAATGAGGTGCTGAGG

ATGGACGAGGAAGAAAGCTGTTTTAGTTGGGAGGATAGGTGACAGAAGCA

TGGAAAGGAATTGCCTTGGACCCATGGAAGCCCAGTGAAGATACTTAGAT

CCTGCAGGGGTGTGAATAATGTTCTTTTAGTTTCTCTTCTTAGGAGGTTT

GTTCATTTTGGGAGATTTCTTTTGAAAAGAGTGAACTTAAATTGGAGAAA

AGTACATTTTAGTATGTTGATAACATTTGAATTTGTAAAATGGACCTATG

GATGATCTACACATATTTATATACCCATAAATATACACATATTTTAATTT

TTGGTATTTTATAATTATTATTTAATGATCATTCATGACATTTTAAAAAT

TACAGAAAAATTTACATCTAAAATTTCAGCAATGTTGTTTTTGACCAACT

```
AAATAAATTGCATTTGAAATAATGGAGATGCAATGTTCAAAATTTCAACT

GTGGTTAAAGCAATAGTGTGATATATGATTACATTAGAAGGAAGATGTGC

CTTTCAAATTCAGATTGAGCATACTAAAAGTGACTCTCTAATTTTCTATT

TTTGGTAATAGGACATCTCCAAGTTTGCAGAGAAAGACAATATAGTTCTT gGAGAAGGTGGAATCACACTGAGTGGAGGTCAACGAGCAAGAATTTCTTT

AGCAAGGTGAATAACTAATTATTGGTCTAGCAAGCATTTGCTGTAAATGT

CATTCATGTAAAAAAATTACAGACATTTCTCTATTGCTTTATATTCTGTT

TCTGGAATTGAAAAAATCCTGGGGTTTTATGGCTAGTGGGTTAAGAATCA

CATTTAAGAACTATAAATAATGGTATAGTATCCAGATTTGGTAGAGATTA

TGGTTACTCAGAATCTGTGCCCGTATCTTGGTGTCAGTGTATTTGTTTGC

CTCATAGTATAGTTTACTACAAATGGAAAACTCTAGGATTCTGCATAATA

CTGGACAGAGAAGATGTAAATATCTGTTAGTTCCATCATAGACCCTGCCA

CTCCAATGTACACACCAGCTTTAGGCTTCTTGGTATAGATAAACATACAT

TTTCAAAATTTTTCATCATAATTTTCATAACAAAATAGGAAGGCAAATGA

TGTCACTTGGCTTAAAATCTATAATATTTAAAATAAACAGGACAAATGCA

TTAACATTGTTGGGGGAGGAGGTCCCTTAGTAGAAACACTCTTGGTCCAA

GCATTTTAAAGCTGTCAAAGAGATGTAAATATAGATAATGTATGTCAAGG

AGAGAGCTTTGTGGTTAAACTGTAACTTTCAGTTTAAACAATTATTGGTG

ACTCTGATGTCAAATGTTTCTCAAGCTTTATCTGAACAAAATTCTTCTCA

CTTTGTTGCCAAAGTCGTTAACAAGAAATCACATTGACTCATTGATGTTT

TGGCTCCTTTCCCTTACTTTCTGTTGCTTTCCAAAAGCTGAGACAGGAAA

CTAACCCTAACTGAGCACCTGCAATTGCCTGGTAGTATTCTAGTCATGTG

TGTACTTTTGTGTGTATGTAATCCCCTTACAGCTCTGCAAAGTAAGAATT

GTTCTCCCTGCTTTACAGAAGAGATCATAAGATAATTGAGGCTGTTAGAT

GTTAACTTGCCAAAAGCCATACAGGAAAATGGTAGAGTCACAGTTTGAAC

CAGGTCCTTTTGATTCTTTACATTAAACCATGCTTTGATCTTGGAAATAC

ACTGTAAGGCAATAAATCAATAGATACGGATAATTCACAGGCTTCTAAAT

AAATGGAAGTTGATTGTTTTTATCTGTGAGCCAAAGTAAGACTTATTCTA

A
```

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct G542X mutation in the CFTR gene, the 5' homology arm may be shortened less than 1000 nucleotides, e.g., e.g., 500 nucleotides, to avoid inclusion of a LINE repeat element in the 5' homology arm. The 5' homology arm is shown as bold sequence, the inserted base to correct the G542X mutation is shown as lower case sequence, and the 3' homology arm is shown as no emphasis capitalized sequence.

```
                            (Template Construct 6; SEQ ID NO: 27275)
CCTGCAGGGGTGTGAATAATGTTCTTTTAGTTTCTCTTCTTAGGAGGTTT

GTTCATTTTGGGAGATTTCTTTTGAAAAGAGTGAACTTAAATTGGAGAAA

AGTACATTTTAGTATGTTGATAACATTTGAATTTGTAAAATGGACCTATG

GATGATCTACACATATTTATATACCCATAAATATACACATATTTTAATTT

TTGGTATTTTATAATTATTATTTAATGATCATTCATGACATTTTAAAAAT

TACAGAAAAATTTACATCTAAAATTTCAGCAATGTTGTTTTTGACCAACT

AAATAAATTGCATTTGAAATAATGGAGATGCAATGTTCAAAATTTCAACT

GTGGTTAAAGCAATAGTGTGATATATGATTACATTAGAAGGAAGATGTGC

CTTTCAAATTCAGATTGAGCATACTAAAAGTGACTCTCTAATTTTCTATT

TTTGGTAATAGGACATCTCCAAGTTTGCAGAGAAAGACAATATAGTTCTT gGAGAAGGTGGAATCACACTGAGTGGAGGTCAACGAGCAAGAATTTCTTT

AGCAAGGTGAATAACTAATTATTGGTCTAGCAAGCATTTGCTGTAAATGT

CATTCATGTAAAAAAATTACAGACATTTCTCTATTGCTTTATATTCTGTT

TCTGGAATTGAAAAAATCCTGGGGTTTTATGGCTAGTGGGTTAAGAATCA

CATTTAAGAACTATAAATAATGGTATAGTATCCAGATTTGGTAGAGATTA

TGGTTACTCAGAATCTGTGCCCGTATCTTGGTGTCAGTGTATTTGTTTGC

CTCATAGTATAGTTTACTACAAATGGAAAACTCTAGGATTCTGCATAATA

CTGGACAGAGAAGATGTAAATATCTGTTAGTTCCATCATAGACCCTGCCA

CTCCAATGTACACACCAGCTTTAGGCTTCTTGGTATAGATAAACATACAT

TTTCAAAATTTTTCATCATAATTTTCATAACAAAATAGGAAGGCAAATGA

T
```

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., G542X target site in the CFTR gene. For example, the ssODN may include 5' and 3' homology arms as shown below. The 5' homology arm is shown as bold sequence, the inserted bases to correct the G542X mutation is shown as lower case sequence, and the 3' homology arm is shown as no emphasis capitalized sequence.

```
                            (Template Construct 7; SEQ ID NO: 27276)
AAAAGTGACTCTCTAATTTTCTATTTTTGGTAATAGGACATCTCCAAGTT TGCAGAGAAAGACAATATAGTTCTTgGAGAAGGTGGAATCACACTGAGTG

GAGGTCAACGAGCAAGAATTTCTTTAGCAAGGTGAATAACTAATTATTGG

T
```

It is contemplated herein that, in an embodiment, a Cas9 molecule could potentially cleave donor constructs either prior to or following homology directed repair (e.g., homologous recombination), resulting in a possible non-homologous-end-joining event and further DNA sequence mutation at the chromosomal locus of interest. Therefore, to avoid cleavage of the donor sequence before and/or after Cas9-mediated homology directed repair, alternate versions of the donor sequence may be used where silent mutations are introduced. These silent mutations may disrupt Cas9 binding and cleavage, but not disrupt the amino acid sequence of the repaired gene. For example, mutations may include those made to a donor sequence to repair the CFTR gene, the mutant form which can cause CF or CF-like disease. In an embodiment, a silent mutation that disrupts Cas9 binding and cleavage, but does not disrupt the amino acid sequence of the repaired gene, is a sense mutation.

In an embodiment, to correct a mutation, e.g., G542X target site in the CFTR gene, and concomitantly introduce a silent mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the G542X mutation is shown as lower case sequence, the silent sense mutation is shown as lower case underlined and italicized sequence, and the 3' homology arm is shown as no emphasis capitalized sequence.

(Template Construct 8; SEQ ID NO: 27277)
TGTCCATATGGTAGATAAATGGAACAAATGAATAACAGAAGTAACCATTT

TGATACTTTAGATATAGATAATATTGGATTATTTCTGGATTGTGAAAGAA

GAAGGAAGAAGCATATGGAAGAGAAGTTTTAGTAGAGGGGAGGAAGGAGG

AGGTGGAAACGAATGTACAAGGATGGGAGGAGAAAAGGGAGAGAGACTTT

TTTTTTTTTAAGGCGAGAGTTTACTACCTATCTAACTCTTCGCATTCTTG

AAGTCTCAGACCAAATCCCATCGGTTTGAAAGCCTCTAGGGTATTCTATC

TATTGTATACTTCTGTTATGTACAAAATTAATTTGCCAATTAATTGTGAA

CTGTTTTATAAACTATCTTAAAATGGTTAGTTAAATCTTTGGGATAGTAT

TTAGCTTTCTCCAGGATTATGACTTACCTTCTAAATTAGACATACAATGC

CTAGGAGTCAAGGACTATTTTGCATAAATTCCAGTCTTCTTTTACAATGC

CTAGAATGATTGTTACCACAGAAATATTCATTACCTGGGAGAAAGGATGA

CAGGAGGGGCAGAATGAATGGAGAGAGGTCGTGAGAATGAGGTGCTGAGG

ATGGACGAGGAAGAAAGCTGTTTTAGTTGGGAGGATAGGTGACAGAAGCA

TGGAAAGGAATTGCCTTGGACCCATGGAAGCCCAGTGAAGATACTTAGAT

CCTGCAGGGGTGTGAATAATGTTCTTTTAGTTTCTCTTCTTAGGAGGTTT

GTTCATTTTGGGAGATTTCTTTTGAAAAGAGTGAACTTAAATTGGAGAAA

AGTACATTTTAGTATGTTGATAACATTTGAATTTGTAAAATGGACCTATG

GATGATCTACACATATTTATATACCCATAAATATACACATATTTTAATTT

TTGGTATTTTATAATTATTATTTAATGATCATTCATGACATTTTAAAAAT

TACAGAAAAATTTACATCTAAAATTTCAGCAATGTTGTTTTTGACCAACT

AAATAAATTGCATTTGAAATAATGGAGATGCAATGTTCAAAATTTCAACT

GTGGTTAAAGCAATAGTGTGATATATGATTACATTAGAAGGAAGATGTGC

CTTTCAAATTCAGATTGAGCATACTAAAAGTGACTCTCTAATTTTCTATT

TTTGGTAATAGGACATCTCCAAGTTTGCAGAGAAAGACAATATAGTTCT<u>a</u>

<u>gGt</u>GAAGGTGGAATCACACTGAGTGGAGGTCAACGAGCAAGAATTTCTTT

AGCAAGGTGAATAACTAATTATTGGTCTAGCAAGCATTTGCTGTAAATGT

CATTCATGTAAAAAAATTACAGACATTTCTCTATTGCTTTATATTCTGTT

TCTGGAATTGAAAAAATCCTGGGGTTTTATGGCTAGTGGGTTAAGAATCA

CATTTAAGAACTATAAATAATGGTATAGTATCCAGATTTGGTAGAGATTA

TGGTTACTCAGAATCTGTGCCCGTATCTTGGTGTCAGTGTATTTGTTTGC

CTCATAGTATAGTTTACTACAAATGGAAAACTCTAGGATTCTGCATAATA

CTGGACAGAGAAGATGTAAATATCTGTTAGTTCCATCATAGACCCTGCCA

CTCCAATGTACACACCAGCTTTAGGCTTCTTGGTATAGATAAACATACAT

TTTCAAAATTTTTCATCATAATTTTCATAACAAAATAGGAAGGCAAATGA

TGTCACTTGGCTTAAAATCTATAATATTTAAAATAAACAGGACAAATGCA

TTAACATTGTTGGGGAGGAGGTCCCTTAGTAGAAACACTCTTGGTCCAA

GCATTTTAAAGCTGTCAAAGAGATGTAAATATAGATAATGTATGTCAAGG

AGAGAGCTTTGTGGTTAAACTGTAACTTTCAGTTTAAACAATTATTGGTG

ACTCTGATGTCAAATGTTTCTCAAGCTTTATCTGAACAAAATTCTTCTCA

CTTTGTTGCCAAAGTCGTTAACAAGAAATCACATTGACTCATTGATGTTT

TGGCTCCTTTCCCTTACTTTCTGTTGCTTTCCAAAAGCTGAGACAGGAAA

CTAACCCTAACTGAGCACCTGCAATTGCCTGGTAGTATTCTAGTCATGTG

TGTACTTTTGTGTGTATGTAATCCCCTTACAGCTCTGCAAAGTAAGAATT

GTTCTCCCTGCTTTACAGAAGAGATCATAAGATAATTGAGGCTGTTAGAT

GTTAACTTGCCAAAAGCCATACAGGAAAATGGTAGAGTCACAGTTTGAAC

CAGGTCCTTTTGATTCTTTACATTAAACCATGCTTTGATCTTGGAAATAC

ACTGTAAGGCAATAAATCAATAGATACGGATAATTCACAGGCTTCTAAAT

AAATGGAAGTTGATTGTTTTTATCTGTGAGCCAAAGTAAGACTTATTCTA

A

In an embodiment, to correct a mutation, e.g., G542X target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the G542X mutation is shown as lower case sequence, the silent sense mutation is shown as lower case underlined and italicized sequence, and the 3' homology arm is shown as no emphasis capitalized sequence.

(Template Construct 9; SEQ ID NO: 27278)
CCTGCAGGGGTGTGAATAATGTTCTTTTAGTTTCTCTTCTTAGGAGGTTT

GTTCATTTTGGGAGATTTCTTTTGAAAAGAGTGAACTTAAATTGGAGAAA

AGTACATTTTAGTATGTTGATAACATTTGAATTTGTAAAATGGACCTATG

GATGATCTACACATATTTATATACCCATAAATATACACATATTTTAATTT

TTGGTATTTTATAATTATTATTTAATGATCATTCATGACATTTTAAAAAT

TACAGAAAAATTTACATCTAAAATTTCAGCAATGTTGTTTTTGACCAACT

AAATAAATTGCATTTGAAATAATGGAGATGCAATGTTCAAAATTTCAACT

GTGGTTAAAGCAATAGTGTGATATATGATTACATTAGAAGGAAGATGTGC

CTTTCAAATTCAGATTGAGCATACTAAAAGTGACTCTCTAATTTTCTATT

-continued

TTTGGTAATAGGACATCTCCAAGTTTGCAGAGAAAGACAATATAGTTCTa
gG*t*GAAGGTGGAATCACACTGAGTGGAGGTCAACGAGCAAGAATTTCTTT
AGCAAGGTGAATAACTAATTATTGGTCTAGCAAGCATTTGCTGTAAATGT
CATTCATGTAAAAAAATTACAGACATTTCTCTATTGCTTTATATTCTGTT
TCTGGAATTGAAAAAATCCTGGGGTTTTATGGCTAGTGGGTTAAGAATCA
CATTTAAGAACTATAAATAATGGTATAGTATCCAGATTTGGTAGAGATTA
TGGTTACTCAGAATCTGTGCCCGTATCTTGGTGTCAGTGTATTTGTTTGC
CTCATAGTATAGTTTACTACAAATGGAAAACTCTAGGATTCTGCATAATA
CTGGACAGAGAAGATGTAAATATCTGTTAGTTCCATCATAGACCCTGCCA
CTCCAATGTACACACCAGCTTTAGGCTTCTTGGTATAGATAAACATACAT
TTTCAAAATTTTTCATCATAATTTTCATAACAAAATAGGAAGGCAAATGA
T

In an embodiment, an ssODN may be to correct a mutation, e.g., G542X target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the G542X mutation is shown as lower case sequence, the silent sense mutation is shown as lower case underlined and italicized sequence, and the 3' homology arm is shown as no emphasis capitalized sequence.

(Template Construct 10; SEQ ID NO: 27279)
AAAAGTGACTCTCTAATTTTCTATTTTTGGTAATAGGACATCTCCAAGTT
TGCAGAGAAAGACAATATAGTTCTa*g*G*t*GAAGGTGGAATCACACTGAGTG
GAGGTCAACGAGCAAGAATTTCTTTAGCAAGGTGAATAACTAATTATTGG
T The underlined A has been changed from a T to A at that position and the underlined T has been changed from an A to T at that position so that wild-type CFTR is still transcribed, but the PAM sequence AGG has been modified to reduce or eliminate Cas9 cleavage at that locus.

Exemplary template nucleic acids (also referred to herein as donor constructs) to correction a mutation, e.g., G551D target site in the CFTR gene, are provided.

Suitable sequence for the 5' homology arm can be selected from (e.g., includes a portion of) or include the following sequence:

(5'H arm)
SEQ ID NO: 27280
TGAATAACAGAAGTAACCATTTTGATACTTTAGATATAGATAATATTGGA
TTATTTCTGGATTGTGAAAGAAGAAGGAAGAAGCATATGGAAGAGAAGTT
TTAGTAGAGGGGAGGAAGGAGGAGGTGGAAACGAATGTACAAGGATGGGA
GGAGAAAAGGGAGAGAGACTTTTTTTTTTTAAGGCGAGAGTTTACTACC
TATCTAACTCTTCGCATTCTTGAAGTCTCAGACCAAATCCCATCGGTTTG
AAAGCCTCTAGGGTATTCTATCTATTGTATACTTCTGTTATGTACAAAAT
TAATTTGCCAATTAATTGTGAACTGTTTTATAAACTATCTTAAAATGGTT AGTTAAATCTTTGGGATAGTATTTAGCTTTCTCCAGGATTATGACTTACC
TTCTAAATTAGACATACAATGCCTAGGAGTCAAGGACTATTTTGCATAAA
TTCCAGTCTTCTTTTACAATGCCTAGAATGATTGTTACCACAGAAATATT
CATTACCTGGGAGAAAGGATGACAGGAGGGGCAGAATGAATGGAGAGAGG
TCGTGAGAATGAGGTGCTGAGGATGGACGAGGAAGAAAGCTGTTTTAGTT
GGGAGGATAGGTGACAGAAGCATGGAAAGGAATTGCCTTGGACCCATGGA
AGCCCAGTGAAGATACTTAGATCCTGCAGGGGTGTGAATAATGTTCTTTT
AGTTTCTCTTCTTAGGAGGTTTGTTCATTTTGGGAGATTTCTTTTGAAAA
GAGTGAACTTAAATTGGAGAAAAGTACATTTTAGTATGTTGATAACATTT
GAATTTGTAAAATGGACCTATGGATGATCTACACATATTTATATACCCAT
AAATATACACATATTTTAATTTTTGGTATTTTATAATTATTATTTAATGA
TCATTCATGACATTTTAAAAATTACAGAAAAATTTACATCTAAAATTTCA
GCAATGTTGTTTTTGACCAACTAAATAAATTGCATTTGAAATAATGGAGA
TGCAATGTTCAAAATTTCAACTGTGGTTAAAGCAATAGTGTGATATATGA
TTACATTAGAAGGAAGATGTGCCTTTCAAATTCAGATTGAGCATACTAAA
AGTGACTCTCTAATTTTCTATTTTTGGTAATAGGACATCTCCAAGTTTGC
AGAGAAAGACAATATAGTTCTTGGAGAAGGTGGAATCACACTGAGTGGAG Suitable sequence for the 3' homology arm can be selected from (e.g., includes a portion of) or include the following sequence:

(3'H arm)
SEQ ID NO: 27281
TCAACGAGCAAGAATTTCTTTAGCAAGGTGAATAACTAATTATTGGTCTA
GCAAGCATTTGCTGTAAATGTCATTCATGTAAAAAAATTACAGACATTTC
TCTATTGCTTTATATTCTGTTTCTGGAATTGAAAAAATCCTGGGGTTTTA
TGGCTAGTGGGTTAAGAATCACATTTAAGAACTATAAATAATGGTATAGT
ATCCAGATTTGGTAGAGATTATGGTTACTCAGAATCTGTGCCCGTATCTT
GGTGTCAGTGTATTTGTTTGCCTCATAGTATAGTTTACTACAAATGGAAA
ACTCTAGGATTCTGCATAATACTGGACAGAGAAGATGTAAATATCTGTTA
GTTCCATCATAGACCCTGCCACTCCAATGTACACACCAGCTTTAGGCTTC
TTGGTATAGATAAACATACATTTTCAAAATTTTTCATCATAATTTTCATA
ACAAAATAGGAAGGCAAATGATGTCACTTGGCTTAAAATCTATAATATTT
AAAATAAACAGGACAAATGCATTAACATTGTTGGGGGAGGAGGTCCCTTA
GTAGAAACACTCTTGGTCCAAGCATTTTAAAGCTGTCAAAGAGATGTAAA
TATAGATAATGTATGTCAAGGAGAGAGCTTTGTGGTTAAACTGTAACTTT
CAGTTTAAACAATTATTGGTGACTCTGATGTCAAATGTTTCTCAAGCTTT
ATCTGAACAAAATTCTTCTCACTTTGTTGCCAAAGTCGTTAACAAGAAAT
CACATTGACTCATTGATGTTTTGGCTCCTTTCCCTTACTTTCTGTTGCTT
TCCAAAAGCTGAGACAGGAAACTAACCCTAACTGAGCACCTGCAATTGCC
TGGTAGTATTCTAGTCATGTGTGTACTTTTGTGTGTATGTAATCCCCTTA
CAGCTCTGCAAAGTAAGAATTGTTCTCCCTGCTTTACAGAAGAGATCATA
AGATAATTGAGGCTGTTAGATGTTAACTTGCCAAAAGCCATACAGGAAAA -continued

```
TGGTAGAGTCACAGTTTGAACCAGGTCCTTTTGATTCTTTACATTAAACC

ATGCTTTGATCTTGGAAATACACTGTAAGGCAATAAATCAATAGATACGG

ATAATTCACAGGCTTCTAAATAAATGGAAGTTGATTGTTTTTATCTGTGA

GCCAAAGTAAGACTTATTCTAAGAATTCCACAAATTTAGATAAGATAGAG
```

In an embodiment, the replacement sequence comprises or consists of a Guanine (G) residue.

In an embodiment, to correct a mutation, e.g., G551D target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, codon 551 is shown as underlined sequence, the inserted base to correct the G551D mutation is shown as non-bold and boxed sequence, and the 3' homology arm is shown as no emphasis sequence.

(Template Construct 11; SEQ ID NO: 27282)
```
TGAATAACAGAAGTAACCATTTTGATACTTTAGATATAGATAATATTGGATTATTTCTGGATTG

TGAAAGAAGAAGGAAGAAGCATATGGAAGAGAAGTTTTAGTAGAGGGGAGGAAGGAGGAGGTGG

AAACGAATGTACAAGGATGGGAGGAGAAAAGGGAGAGAGACTTTTTTTTTTTTAAGGCGAGAGT

TTACTACCTATCTAACTCTTCGCATTCTTGAAGTCTCAGACCAAATCCCATCGGTTTGAAAGCC

TCTAGGGTATTCTATCTATTGTATACTTCTGTTATGTACAAAATTAATTTGCCAATTAATTGTG

AACTGTTTTATAAACTATCTTAAAATGGTTAGTTAAATCTTTGGGATAGTATTTAGCTTTCTCC

AGGATTATGACTTACCTTCTAAATTAGACATACAATGCCTAGGAGTCAAGGACTATTTTGCATA

AATTCCAGTCTTCTTTTACAATGCCTAGAATGATTGTTACCACAGAAATATTCATTACCTGGGA

GAAAGGATGACAGGAGGGGCAGAATGAATGGAGAGAGGTCGTGAGAATGAGGTGCTGAGGATGG

ACGAGGAAGAAAGCTGTTTTAGTTGGGAGGATAGGTGACAGAAGCATGGAAAGGAATTGCCTTG

GACCCATGGAAGCCCAGTGAAGATACTTAGATCCTGCAGGGGTGTGAATAATGTTCTTTTAGTT

TCTCTTCTTAGGAGGTTTGTTCATTTTGGGAGATTTCTTTTGAAAAGAGTGAACTTAAATTGGA

GAAAAGTACATTTTAGTATGTTGATAACATTTGAATTTGTAAAATGGACCTATGGATGATCTAC

ACATATTTATATACCCATAAATATACACATATTTTAATTTTTGGTATTTTATAATTATTATTTA

ATGATCATTCATGACATTTTAAAAATTACAGAAAAATTTACATCTAAAATTTCAGCAATGTTGT

TTTTGACCAACTAAATAAATTGCATTTGAAATAATGGAGATGCAATGTTCAAAATTTCAACTGT

GGTTAAAGCAATAGTGTGATATATGATTACATTAGAAGGAAGATGTGCCTTTCAAATTCAGATT

GAGCATACTAAAAGTGACTCTCTAATTTTCTATTTTTGGTAATAGGACATCTCCAAGTTTGCAG

AGAAAGACAATATAGTTCTTGGAGAAGGTGGAATCACACTGAGTGGAGGTCAACGAGCAAGAAT
```
(where `GGT` contains the underlined `G` for codon 551 and boxed inserted `G`)
```
TTCTTTAGCAAGGTGAATAACTAATTATTGGTCTAGCAAGCATTTGCTGTAAATGTCATTCATG

TAAAAAAATTACAGACATTTCTCTATTGCTTTATATTCTGTTTCTGGAATTGAAAAAATCCTGG

GGTTTTATGGCTAGTGGGTTAAGAATCACATTTAAGAACTATAAATAATGGTATAGTATCCAGA

TTTGGTAGAGATTATGGTTACTCAGAATCTGTGCCCGTATCTTGGTGTCAGTGTATTTGTTTGC

CTCATAGTATAGTTTACTACAAATGGAAAACTCTAGGATTCTGCATAATACTGGACAGAGAAGA

TGTAAATATCTGTTAGTTCCATCATAGACCCTGCCACTCCAATGTACACACCAGCTTTAGGCTT

CTTGGTATAGATAAACATACATTTTCAAAATTTTTCATCATAATTTTCATAACAAAATAGGAAG

GCAAATGATGTCACTTGGCTTAAAATCTATAATATTTAAAATAAACAGGACAAATGCATTAACA

TTGTTGGGGGAGGAGGTCCCTTAGTAGAAACACTCTTGGTCCAAGCATTTTAAAGCTGTCAAAG

AGATGTAAATATAGATAATGTATGTCAAGGAGAGAGCTTTGTGGTTAAACTGTAACTTTCAGTT

TAAACAATTATTGGTGACTCTGATGTCAAATGTTTCTCAAGCTTTATCTGAACAAAATTCTTCT

CACTTTGTTGCCAAAGTCGTTAACAAGAAATCACATTGACTCATTGATGTTTTGGCTCCTTTCC

CTTACTTTCTGTTGCTTTCCAAAAGCTGAGACAGGAAACTAACCCTAACTGAGCACCTGCAATT

GCCTGGTAGTATTCTAGTCATGTGTGTACTTTTGTGTGTATGTAATCCCCTTACAGCTCTGCAA
```

```
AGTAAGAATTGTTCTCCCTGCTTTACAGAAGAGATCATAAGATAATTGAGGCTGTTAGATGTTA

ACTTGCCAAAAGCCATACAGGAAAATGGTAGAGTCACAGTTTGAACCAGGTCCTTTTGATTCTT

TACATTAAACCATGCTTTGATCTTGGAAATACACTGTAAGGCAATAAATCAATAGATACGGATA

ATTCACAGGCTTCTAAATAAATGGAAGTTGATTGTTTTTATCTGTGAGCCAAAGTAAGACTTAT

TCTAAGAATTCCACAAATTTAGATAAGATAGAG
```

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct G551D mutation in the CFTR gene, the 5' homology arm may be shortened less than 1000 nucleotides, e.g., approximately 750 nucleotides, e.g., 724 nucleotides, to avoid inclusion of a LINE repeat element in the 5' homology arm. The 5' homology arm is shown as bold sequence, codon 551 is shown as underlined sequence, the inserted base to correct the G551D mutation is shown as non-bold and boxed sequence, and the 3' homology arm is shown as no emphasis sequence.

(Template Construct 12; SEQ ID NO: 27283)
```
AATGATTGTTACCACAGAAATATTCATTACCTGGGAGAAAGGATGACAGGAGGGGCAGAATGAA

TGGAGAGAGGTCGTGAGAATGAGGTGCTGAGGATGGACGAGGAAGAAAGCTGTTTTAGTTGGGA

GGATAGGTGACAGAAGCATGGAAAGGAATTGCCTTGGACCCATGGAAGCCCAGTGAAGATACTT

AGATCCTGCAGGGGTGTGAATAATGTTCTTTTAGTTTCTCTTCTTAGGAGGTTTGTTCATTTTG

GGAGATTTCTTTTGAAAAGAGTGAACTTAAATTGGAGAAAAGTACATTTTAGTATGTTGATAAC

ATTTGAATTTGTAAAATGGACCTATGGATGATCTACACATATTTATATACCCATAAATATACAC

ATATTTAATTTTTGGTATTTTATAATTATTATTTAATGATCATTCATGACATTTTAAAAATTA

CAGAAAAATTTACATCTAAAATTTCAGCAATGTTGTTTTTGACCAACTAAATAAATTGCATTTG

AAATAATGGAGATGCAATGTTCAAAATTTCAACTGTGGTTAAAGCAATAGTGTGATATATGATT

ACATTAGAAGGAAGATGTGCCTTTCAAATTCAGATTGAGCATACTAAAAGTGACTCTCTAATTT

TCTATTTTTGGTAATAGGACATCTCCAAGTTTGCAGAGAAAGACAATATAGTTCTTGGAGAAGG

TGGAATCACACTGAGTGGAG͟G͟TCAACGAGCAAGAATTTCTTTAGCAAGGTGAATAACTAATTAT
```
TGGTCTAGCAAGCATTTGCTGTAAATGTCATTCATGTAAAAAAATTACAGACATTTCTCTATTG

CTTTATATTCTGTTTCTGGAATTGAAAAAATCCTGGGGTTTTATGGCTAGTGGGTTAAGAATCA

CATTTAAGAACTATAAATAATGGTATAGTATCCAGATTTGGTAGAGATTATGGTTACTCAGAAT

CTGTGCCCGTATCTTGGTGTCAGTGTATTTGTTTGCCTCATAGTATAGTTTACTACAAATGGAA

AACTCTAGGATTCTGCATAATACTGGACAGAGAAGATGTAAATATCTGTTAGTTCCATCATAGA

CCCTGCCACTCCAATGTACACACCAGCTTTAGGCTTCTTGGTATAGATAAACATACATTTTCAA

AATTTTTCATCATAATTTTCATAACAAAATAGGAAGGCAAATGATGTCACTTGGCTTAAAATCT

ATAATATTTAAAATAAACAGGACAAATGCATTAACATTGTTGGGGGAGGAGGTCCCTTAGTAGA

AACACTCTTGGTCCAAGCATTTTAAAGCTGTCAAAGAGATGTAAATATAGATAATGTATGTCAA

GGAGAGAGCTTTGTGGTTAAACTGTAACTTTCAGTTTAAACAATTATTGGTGACTCTGATGTCA

AATGTTTCTCAAGCTTTATCTGAACAAAATTCTTCTCACTTTGTTGCCAAAGTCGTTAACAAGA
```

-continued

```
AATCACATTGACTCATTGATGTTTTGGCTCCTTTCCCTTACTTTCTGTTGCTTTCCAAAAGCTG

AGACAGGA
```

In an embodiment, to correct G551D mutation in the CFTR gene, the 5' homology arm may be shortened less than 750 nucleotides, e.g., e.g., 500 nucleotides, to avoid inclusion of a LINE repeat element in the 5' homology arm. The 5' homology arm is shown as bold sequence, the inserted base to correct the G551D mutation is shown as lower case sequence, and the 3' homology arm is shown as no emphasis capitalized sequence.

(Template Construct 13; SEQ ID NO: 27284)
```
AGTTTCTCTTCTTAGGAGGTTTGTTCATTTTGGGAGATTTCTTTTGAAAA

GAGTGAACTTAAATTGGAGAAAAGTACATTTTAGTATGTTGATAACATTT

GAATTTGTAAAATGGACCTATGGATGATCTACACATATTTATATACCCAT

AAATATACACATATTTTAATTTTTGGTATTTTATAATTATTATTTAATGA

TCATTCATGACATTTTAAAAATTACAGAAAAATTTACATCTAAAATTTCA

GCAATGTTGTTTTTGACCAACTAAATAAATTGCATTTGAAATAATGGAGA

TGCAATGTTCAAAATTTCAACTGTGGTTAAAGCAATAGTGTGATATATGA

TTACATTAGAAGGAAGATGTGCCTTTCAAATTCAGATTGAGCATACTAAA

AGTGACTCTCTAATTTTCTATTTTTGGTAATAGGACATCTCCAAGTTTGC

AGAGAAAGACAATATAGTTCTTGGAGAAGGTGGAATCACACTGAGTGGAG gTCAACGAGCAAGAATTTCTTTAGCAAGGTGAATAACTAATTATTGGTCT

AGCAAGCATTTGCTGTAAATGTCATTCATGTAAAAAAATTACAGACATTT

CTCTATTGCTTTATATTCTGTTTCTGGAATTGAAAAAATCCTGGGGTTTT

ATGGCTAGTGGGTTAAGAATCACATTTAAGAACTATAAATAATGGTATAG

TATCCAGATTTGGTAGAGATTATGGTTACTCAGAATCTGTGCCCGTATCT

TGGTGTCAGTGTATTTGTTTGCCTCATAGTATAGTTTACTACAAATGGAA

AACTCTAGGATTCTGCATAATACTGGACAGAGAAGATGTAAATATCTGTT

AGTTCCATCATAGACCCTGCCACTCCAATGTACACACCAGCTTTAGGCTT

CTTGGTATAGATAAACATACATTTTCAAAATTTTTCATCATAATTTTCAT

AACAAAATAGGAAGGCAAATGATGTCACTTGGCTTAAAATCTATAATATT

T
```

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., G551D target site in the CFTR gene. For example, the ssODN may include 5' and 3' homology arms as shown below. The 5' homology arm is shown as bold sequence, the inserted bases to correct the G542X mutation is shown as lower case sequence, and the 3' homology arm is shown as no emphasis capitalized sequence.

(Template Construct 14; SEQ ID NO: 27285)
```
GGTAATAGGACATCTCCAAGTTTGCAGAGAAAGACAATATAGTTCTTGGA GAAGGTGGAATCACACTGAGTGGAGgTCAACGAGCAAGAATTTCTTTAGC

AAGGTGAATAACTAATTATTGGTCTAGCAAGCATTTGCTGTAAATGTCAT

T
```

In an embodiment, to correct a mutation, e.g., G551D target site in the CFTR gene, and concomitantly introduce a silent mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the G551D mutation is shown as lower case sequence, the silent sense mutation is shown as lower case underlined and italicized sequence, and the 3' homology arm is shown as no emphasis capitalized sequence.

(Template Construct 15; SEQ ID NO: 27286)
```
TGAATAACAGAAGTAACCATTTTGATACTTTAGATATAGATAATATTGGA

TTATTTCTGGATTGTGAAAGAAGAAGGAAGAAGCATATGGAAGAGAAGTT

TTAGTAGAGGGGAGGAAGGAGGAGGTGGAAACGAATGTACAAGGATGGGA

GGAGAAAAGGGAGAGAGACTTTTTTTTTTTAAGGCGAGAGTTTACTACC

TATCTAACTCTTCGCATTCTTGAAGTCTCAGACCAAATCCCATCGGTTTG

AAAGCCTCTAGGGTATTCTATCTATTGTATACTTCTGTTATGTACAAAAT

TAATTTGCCAATTAATTGTGAACTGTTTTATAAACTATCTTAAAATGGTT

AGTTAAATCTTTGGGATAGTATTTAGCTTTCTCCAGGATTATGACTTACC

TTCTAAATTAGACATACAATGCCTAGGAGTCAAGGACTATTTTGCATAAA

TTCCAGTCTTCTTTTACAATGCCTAGAATGATTGTTACCACAGAAATATT

CATTACCTGGGAGAAAGGATGACAGGAGGGGCAGAATGAATGGAGAGAGG

TCGTGAGAATGAGGTGCTGAGGATGGACGAGGAAGAAAGCTGTTTTAGTT

GGGAGGATAGGTGACAGAAGCATGGAAAGGAATTGCCTTGGACCCATGGA

AGCCCAGTGAAGATACTTAGATCCTGCAGGGGTGTGAATAATGTTCTTTT

AGTTTCTCTTCTTAGGAGGTTTGTTCATTTTGGGAGATTTCTTTTGAAAA

GAGTGAACTTAAATTGGAGAAAAGTACATTTTAGTATGTTGATAACATTT

GAATTTGTAAAATGGACCTATGGATGATCTACACATATTTATATACCCAT

AAATATACACATATTTTAATTTTTGGTATTTTATAATTATTATTTAATGA

TCATTCATGACATTTTAAAAATTACAGAAAAATTTACATCTAAAATTTCA

GCAATGTTGTTTTTGACCAACTAAATAAATTGCATTTGAAATAATGGAGA

TGCAATGTTCAAAATTTCAACTGTGGTTAAAGCAATAGTGTGATATATGA

TTACATTAGAAGGAAGATGTGCCTTTCAAATTCAGATTGAGCATACTAAA
```

AGTGACTCTCTAATTTTCTATTTTTGGTAATAGGACATCTCCAAGTTTGC

AGAGAAAGACAATATAGTTCTTGGAGAAGGTGGAATCACACTG<u>t</u><i>c</i>TGGAG gTCAACGAGCAAGAATTTCTTTAGCAAGGTGAATAACTAATTATTGGTCT

AGCAAGCATTTGCTGTAAATGTCATTCATGTAAAAAAATTACAGACATTT

CTCTATTGCTTTATATTCTGTTTCTGGAATTGAAAAAATCCTGGGGTTTT

ATGGCTAGTGGGTTAAGAATCACATTTAAGAACTATAAATAATGGTATAG

TATCCAGATTTGGTAGAGATTATGGTTACTCAGAATCTGTGCCCGTATCT

TGGTGTCAGTGTATTTGTTTGCCTCATAGTATAGTTTACTACAAATGGAA

AACTCTAGGATTCTGCATAATACTGGACAGAGAAGATGTAAATATCTGTT

AGTTCCATCATAGACCCTGCCACTCCAATGTACACACCAGCTTTAGGCTT

CTTGGTATAGATAAACATACATTTTCAAAATTTTTCATCATAATTTTCAT

AACAAAATAGGAAGGCAAATGATGTCACTTGGCTTAAAATCTATAATATT

TAAAATAAACAGGACAAATGCATTAACATTGTTGGGGGAGGAGGTCCCTT

AGTAGAAACACTCTTGGTCCAAGCATTTTAAAGCTGTCAAAGAGATGTAA

ATATAGATAATGTATGTCAAGGAGAGAGCTTTGTGGTTAAACTGTAACTT

TCAGTTTAAACAATTATTGGTGACTCTGATGTCAAATGTTTCTCAAGCTT

TATCTGAACAAAATTCTTCTCACTTTGTTGCCAAAGTCGTTAACAAGAAA

TCACATTGACTCATTGATGTTTTGGCTCCTTTCCCTTACTTTCTGTTGCT

TTCCAAAAGCTGAGACAGGAAACTAACCCTAACTGAGCACCTGCAATTGC

CTGGTAGTATTCTAGTCATGTGTGTACTTTTGTGTGTATGTAATCCCCTT

ACAGCTCTGCAAAGTAAGAATTGTTCTCCCTGCTTTACAGAAGAGATCAT

AAGATAATTGAGGCTGTTAGATGTTAACTTGCCAAAAGCCATACAGGAAA

ATGGTAGAGTCACAGTTTGAACCAGGTCCTTTTGATTCTTTACATTAAAC

CATGCTTTGATCTTGGAAATACACTGTAAGGCAATAAATCAATAGATACG

GATAATTCACAGGCTTCTAAATAAATGGAAGTTGATTGTTTTTATCTGTG

AGCCAAAGTAAGACTTATTCTAAGAATTCCACAAATTTAGATAAGATAGA

G

In an embodiment, to correct a mutation, e.g., G551D target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the G551D mutation is shown as lower case sequence, the silent sense mutation is shown as lower case underlined and italicized sequence, and the 3' homology arm is shown as no emphasis capitalized sequence.

(Template Construct 16; SEQ ID NO: 27287)
AGTTTCTCTTCTTAGGAGGTTTGTTCATTTTGGGAGATTTCTTTTGAAAA

GAGTGAACTTAAATTGGAGAAAAGTACATTTTAGTATGTTGATAACATTT

GAATTTGTAAAATGGACCTATGGATGATCTACACATATTTATATACCCAT

AAATATACACATATTTTAATTTTTGGTATTTTATAATTATTATTTAATGA

TCATTCATGACATTTTAAAAATTACAGAAAAATTTACATCTAAAATTTCA

GCAATGTTGTTTTTGACCAACTAAATAAATTGCATTTGAAATAATGGAGA

TGCAATGTTCAAAATTTCAACTGTGGTTAAAGCAATAGTGTGATATATGA

TTACATTAGAAGGAAGATGTGCCTTTCAAATTCAGATTGAGCATACTAAA

AGTGACTCTCTAATTTTCTATTTTTGGTAATAGGACATCTCCAAGTTTGC

AGAGAAAGACAATATAGTTCTTGGAGAAGGTGGAATCACACTG<u>t</u><i>c</i>TGGAG gTCAACGAGCAAGAATTTCTTTAGCAAGGTGAATAACTAATTATTGGTCT

AGCAAGCATTTGCTGTAAATGTCATTCATGTAAAAAAATTACAGACATTT

CTCTATTGCTTTATATTCTGTTTCTGGAATTGAAAAAATCCTGGGGTTTT

ATGGCTAGTGGGTTAAGAATCACATTTAAGAACTATAAATAATGGTATAG

TATCCAGATTTGGTAGAGATTATGGTTACTCAGAATCTGTGCCCGTATCT

TGGTGTCAGTGTATTTGTTTGCCTCATAGTATAGTTTACTACAAATGGAA

AACTCTAGGATTCTGCATAATACTGGACAGAGAAGATGTAAATATCTGTT

AGTTCCATCATAGACCCTGCCACTCCAATGTACACACCAGCTTTAGGCTT

CTTGGTATAGATAAACATACATTTTCAAAATTTTTCATCATAATTTTCAT

AACAAAATAGGAAGGCAAATGATGTCACTTGGCTTAAAATCTATAATATT

T

In an embodiment, an ssODN may be to correct a mutation, e.g., G551D target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the G551D mutation is shown as lower case sequence, the silent sense mutation is shown as lower case underlined and italicized sequence, and the 3' homology arm is shown as no emphasis capitalized sequence.

(Template Construct 18; SEQ ID NO: 27288)
GGTAATAGGACATCTCCAAGTTTGCAGAGAAAGACAATATAGTTCTTGGA GAAGGTGGAATCACACTG<u>t</u><i>c</i>TGGAGgTCAACGAGCAAGAATTTCTTTAGC

AAGGTGAATAACTAATTATTGGTCTAGCAAGCATTTGCTGTAAATGTCAT

T

The underlined T has been changed from a A to T at that position and the underlined C has been changed from an G to C at that position so that wild-type CFTR is still transcribed, but the PAM sequence TGG has been modified to reduce or eliminate Cas9 cleavage at that locus.

Exemplary template nucleic acids (also referred to herein as donor constructs) to correction a mutation, e.g., N1303K target site in the CFTR gene, are provided.

Suitable sequence for the 5' homology arm can be selected from (e.g., includes a portion of) or include the following sequence:

(5'H arm)
SEQ ID NO: 27289
GTTTCTGAGACATTTGACAACAACTTTTTCTTTAAGTCATCAGTTATGCC

CCGGGGTATGAAATTTCTAACATGATCCTCAGTAAACTTGGCTGCCTTGC

TGAGGATACTCTCCATCTGCCTGAGAGACACAGACACCATTAATTGGGAA

TTGACTTGACTTGTGTGGTTCCTTGTGGACCAGATGGCCACTAAATATTC

TCATTTCAAGGCAATTGGTAAAAACTACACTTCAAGAAATTTCATTCTTA

ATTCCCCTTAGTGGATGTTATTAACCAAAGGCAAAAGAAAAAAAGGGTAA

AAAAAATATTCTAAATGTTAATATCAAAAATATTATTTTCAATTCACCCC

AGGCACAGAGAACTAAGTATTATTATTGCTATTGCACCGGCATTCCCCAA

TGAGACAGTGATTTTCTTTTAAGACATTTTTAAATAATATAGGCAGAATT

AAGTAGACGGTGATCTGGTAAGTAGATGTTTCAGGGTAACAGCTGTGCAA

TGCTCCATGCAGGGAATTAGATTGTCATTTTATTCCTTACCAGGAACATA

CATTCAGTTAAACAATTATTTGACTTCTGCTCTTCCACTGATTTCTAAGT

TGAGGCTCTCTCTTGTGCCTGTCTGATCAGATAAGTAGAGTTGTGCCTTG

GTTTATAGATGAGATAAATGTGTATTTGAATAAGCATAAGTTAAAGAAAT

TTTAAAATCCCTTAGGAAGCTAGGCTTATCAGAGAAATCCAAGGAAATAC

ATTAACAAACTAGGAATTTGTTCTAACAGGTTAATTATAACTCATAAACT

TATTGGGTTTTTTTACCTTTTAATTTTATATTACATTTGCTTATAATAAG

GAATATTGCTAGGAATAAAATTTTTAATATTCTACAATTAACAATTATC

TCAATTTCTTTATTCTAAAGACATTGGGATTAGAAAAATGTTCACAAGGG

ACTCCAAATATTGCTGTAGTATTTGTTTCTTAAAAGAATGATACAAAGCA

GACATGATAAAATATTAAAATTTGAGAGAACTTGATGGTAAGTACATGGG

TGTTTCTTATTTTAAAATAATTTTTCTACTTGAAATATTTTACAATACAA

TAAGGGAAAAATAAAAAGTTATTTAAGTTATTCATACTTTCTTCTTCTTT

TCTTTTTTGCTATAGAAAGTATTTATTTTTTCTGGAACATTTAGAAAAAA

Suitable sequence for the 3' homology arm can be selected from (e.g., includes a portion of) or include the following sequence:

(3'H arm)
SEQ ID NO: 27290
TTGGATCCCTATGAACAGTGGAGTGATCAAGAAATATGGAAAGTTGCAGA

TGAGGTAAGGCTGCTAACTGAAATGATTTTGAAAGGGGTAACTCATACCA

ACACAAATGGCTGATATAGCTGACATCATTCTACACACTTTGTGTGCATG

TATGTGTGTGCACAACTTTAAAATGGAGTACCCTAACATACCTGGAGCAA

CAGGTACTTTTGACTGGACCTACCCCTAACTGAAATGATTTTGAAAGAGG

TAACTCATACCAACACAAATGGTTGATATGGCTAAGATCATTCTACACAC

TTTGTGTGCATGTATTTCTGTGCACAACTTCAAAATGGAGTACCCTAAAA

TACCTGGCGCGACAAGTACTTTTGACTGAGCCTACTTCTCTCCTCACTGG

TATGGCTCCAACCATCAGGCCCTATCTTGGTCCATTTAGGCTGCTAAAAT

AAAATACCAAAGACTGAGCTGCTTATAAGCAATCTTTGGAGGCTGAGAAG

TCAAAGATCAAGGTGCCAGCAGGTTTGCTGTCTCGTGAGAGCATACTTCC

TGGTTCATTGATGGTGCTTTCTTGCTGTGTCCTCACATAATGGAAAGGGC

AAGACCTCTCTGGTGTCTCTTTTACAATGGCACTAATCCCATCATGAGGG

CTTTGTTCTCATGACCTAATCACCTCCCACATGTCCTACATTCTAATACT

ATCACCTTGGGGGTTAGGATTTTAACATATGAATTTGAGGAGGTGGCGGG

GGGGACACAAATATTTAGACCATAGCATTTCACTCCTGACCTCCAAAGTT

CATGTCTTCTTCACATGCAAAATACATTCATTCCATCCCAATAGCCCCCA

AAGTCTTAACTTGTTCCAGCATCAACTTACAAGGCTAAAGTCCAAGGTTT

CATCTAAATATCAGCTAAATCAGCACAAACAGCTAAATCAGGTAGAGTGG

GACTTAAGGTGTGATTCCTCTTTAGGCAGATTGCTCTCCAACTATGAAAT

TGTGAAATCAAACCTATTATGTACTTTCAAAATAAAATGGTGAAACAGGC

ACAGGCTAGACAGTCCCATTTCAAAAAAGAGAAATAGAAAAGAAAAAAGG

AGTGACAGGTCTCTATAAGTCTAAAACTTTAAGGCTTGAGAATAATTTGC

TTTGCTTTGCCTCCAGGCTCACTGGGGTGGTGTCTTACCTCTGGACACAC

In an embodiment, the replacement sequence comprises or consists of a Cytosine (C) residue.

In an embodiment, to correct a mutation, e.g., N1303K target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the G542X mutation is shown as lower case sequence, and the 3' homology arm is shown as no emphasis capitalized sequence.

(Template Construct 19; SEQ ID NO: 27291)
GTTTCTGAGACATTTGACAACAACTTTTTCTTTAAGTCATCAGTTATGCC

CCGGGGTATGAAATTTCTAACATGATCCTCAGTAAACTTGGCTGCCTTGC

TGAGGATACTCTCCATCTGCCTGAGAGACACAGACACCATTAATTGGGAA

TTGACTTGACTTGTGTGGTTCCTTGTGGACCAGATGGCCACTAAATATTC

TCATTTCAAGGCAATTGGTAAAAACTACACTTCAAGAAATTTCATTCTTA

ATTCCCCTTAGTGGATGTTATTAACCAAAGGCAAAAGAAAAAAGGGTAA

AAAAAATATTCTAAATGTTAATATCAAAAATATTATTTTCAATTCACCCC

AGGCACAGAGAACTAAGTATTATTATTGCTATTGCACCGGCATTCCCCAA

TGAGACAGTGATTTTCTTTTAAGACATTTTTAAATAATATAGGCAGAATT

AAGTAGACGGTGATCTGGTAAGTAGATGTTTCAGGGTAACAGCTGTGCAA

TGCTCCATGCAGGGAATTAGATTGTCATTTTATTCCTTACCAGGAACATA

CATTCAGTTAAACAATTATTTGACTTCTGCTCTTCCACTGATTTCTAAGT

TGAGGCTCTCTCTTGTGCCTGTCTGATCAGATAAGTAGAGTTGTGCCTTG

GTTTATAGATGAGATAAATGTGTATTTGAATAAGCATAAGTTAAAGAAAT

TTTAAAATCCCTTAGGAAGCTAGGCTTATCAGAGAAATCCAAGGAAATAC

ATTAACAAACTAGGAATTTGTTCTAACAGGTTAATTATAACTCATAAACT

TATTGGGTTTTTTTACCTTTTAATTTTATATTACATTTGCTTATAATAAG

GAATATTGCTAGGAATAAAATTTTTAATATTCTACAATTAACAATTATC

TCAATTTCTTTATTCTAAAGACATTGGGATTAGAAAAATGTTCACAAGGG

ACTCCAAATATTGCTGTAGTATTTGTTTCTTAAAAGAATGATACAAAGCA

GACATGATAAAATATTAAAATTTGAGAGAACTTGATGGTAAGTACATGGG

TGTTTCTTATTTTAAAATAATTTTTCTACTTGAAATATTTTACAATACAA

TAAGGGAAAAATAAAAAGTTATTTAAGTTATTCATACTTTCTTCTTCTTT

TCTTTTTTGCTATAGAAAGTATTTATTTTTTCTGGAACATTTAGAAAAAA

-continued
cTTGGATCCCTATGAACAGTGGAGTGATCAAGAAATATGGAAAGTTGCAG

ATGAGGTAAGGCTGCTAACTGAAATGATTTTGAAAGGGGTAACTCATACC

AACACAAATGGCTGATATAGCTGACATCATTCTACACACTTTGTGTGCAT

GTATGTGTGTGCACAACTTTAAAATGGAGTACCCTAACATACCTGGAGCA

ACAGGTACTTTTGACTGGACCTACCCCTAACTGAAATGATTTTGAAAGAG

GTAACTCATACCAACACAAATGGTTGATATGGCTAAGATCATTCTACACA

CTTTGTGTGCATGTATTTCTGTGCACAACTTCAAAATGGAGTACCCTAAA

ATACCTGGCGCGACAAGTACTTTTGACTGAGCCTACTTCTCTCCTCACTG

GTATGGCTCCAACCATCAGGCCCTATCTTGGTCCATTTAGGCTGCTAAAA

TAAAATACCAAAGACTGAGCTGCTTATAAGCAATCTTTGGAGGCTGAGAA

GTCAAAGATCAAGGTGCCAGCAGGTTTGCTGTCTCGTGAGAGCATACTTC

CTGGTTCATTGATGGTGCTTTCTTGCTGTGTCCTCACATAATGGAAAGGG

CAAGACCTCTCTGGTGTCTCTTTTACAATGGCACTAATCCCATCATGAGG

GCTTTGTTCTCATGACCTAATCACCTCCCACATGTCCTACATTCTAATAC

TATCACCTTGGGGGTTAGGATTTTAACATATGAATTTGAGGAGGTGGCGG

GGGGGACACAAATATTTAGACCATAGCATTTCACTCCTGACCTCCAAAGT

TCATGTCTTCTTCACATGCAAAATACATTCATTCCATCCCAATAGCCCCC

AAAGTCTTAACTTGTTCCAGCATCAACTTACAAGGCTAAAGTCCAAGGTT

TCATCTAAATATCAGCTAAATCAGCACAAACAGCTAAATCAGGTAGAGTG

GGACTTAAGGTGTGATTCCTCTTTAGGCAGATTGCTCTCCAACTATGAAA

TTGTGAAATCAAACCTATTATGTACTTTCAAAATAAAATGGTGAAACAGG

CACAGGCTAGACAGTCCCATTTCAAAAAAGAGAAATAGAAAAGAAAAAAG

GAGTGACAGGTCTCTATAAGTCTAAAACTTTAAGGCTTGAGAATAATTTG

CTTTGCTTTGCCTCCAGGCTCACTGGGGTGGTGTCTTACCTCTGGACACA

C

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct N1303K mutation in the CFTR gene, the 5' homology arm may be shortened less than 1000 nucleotides, e.g., e.g., 500 nucleotides, to avoid inclusion of a LINE repeat element in the 5' homology arm. The 5' homology arm is shown as bold sequence, the inserted base to correct the N1303K mutation is shown as lower case sequence, and the 3' homology arm is shown as no emphasis capitalized sequence.

(Template Construct 20; SEQ ID NO: 27292)
TTTAAAATCCCTTAGGAAGCTAGGCTTATCAGAGAAATCCAAGGAAATAC

ATTAACAAACTAGGAATTTGTTCTAACAGGTTAATTATAACTCATAAACT

-continued
TATTGGGTTTTTTTACCTTTTAATTTTATATTACATTTGCTTATAATAAG

GAATATTGCTAGGAATAAAATTTTTTAATATTCTACAATTAACAATTATC

TCAATTTCTTTATTCTAAAGACATTGGGATTAGAAAAATGTTCACAAGGG

ACTCCAAATATTGCTGTAGTATTTGTTTCTTAAAAGAATGATACAAAGCA

GACATGATAAAATATTAAAATTTGAGAGAACTTGATGGTAAGTACATGGG

TGTTTCTTATTTTAAAATAATTTTTCTACTTGAAATATTTTACAATACAA

TAAGGGAAAAATAAAAAGTTATTTAAGTTATTCATACTTTCTTCTTCTTT

TCTTTTTTGCTATAGAAAGTATTTATTTTTTCTGGAACATTTAGAAAAAA cTTGGATCCCTATGAACAGTGGAGTGATCAAGAAATATGGAAAGTTGCAG

ATGAGGTAAGGCTGCTAACTGAAATGATTTTGAAAGGGGTAACTCATACC

AACACAAATGGCTGATATAGCTGACATCATTCTACACACTTTGTGTGCAT

GTATGTGTGTGCACAACTTTAAAATGGAGTACCCTAACATACCTGGAGCA

ACAGGTACTTTTGACTGGACCTACCCCTAACTGAAATGATTTTGAAAGAG

GTAACTCATACCAACACAAATGGTTGATATGGCTAAGATCATTCTACACA

CTTTGTGTGCATGTATTTCTGTGCACAACTTCAAAATGGAGTACCCTAAA

ATACCTGGCGCGACAAGTACTTTTGACTGAGCCTACTTCTCTCCTCACTG

GTATGGCTCCAACCATCAGGCCCTATCTTGGTCCATTTAGGCTGCTAAAA

TAAAATACCAAAGACTGAGCTGCTTATAAGCAATCTTTGGAGGCTGAGAA

G

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., N1303K target site in the CFTR gene. For example, the ssODN may include 5' and 3' homology arms as shown below. The 5' homology arm is shown as bold sequence, the inserted bases to correct the N1303K mutation is shown as lower case sequence, and the 3' homology arm is shown as no emphasis capitalized sequence.

(Template Construct 21; SEQ ID NO: 27293)
AGTTATTCATACTTTCTTCTTCTTTTCTTTTTTGCTATAGAAAGTATTTA

TTTTTTCTGGAACATTTAGAAAAAcTTGGATCCCTATGAACAGTGGAGT

GATCAAGAAATATGGAAAGTTGCAGATGAGGTAAGGCTGCTAACTGAAAT

G

In an embodiment, to correct a mutation, e.g., N1303K target site in the CFTR gene, and concomitantly introduce a silent sense mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the N1303K mutation is shown as lower case sequence, the silent sense mutation is shown as lower case underlined and italicized sequence, and the 3' homology arm is shown as no emphasis capitalized sequence.

(Template Construct 22; SEQ ID NO: 27294)
GTTTCTGAGACATTTGACAACAACTTTTTCTTTAAGTCATCAGTTATGCC

CCGGGGTATGAAATTTCTAACATGATCCTCAGTAAACTTGGCTGCCTTGC

TGAGGATACTCTCCATCTGCCTGAGAGACACAGACACCATTAATTGGGAA

TTGACTTGACTTGTGTGGTTCCTTGTGGACCAGATGGCCACTAAATATTC

TCATTTCAAGGCAATTGGTAAAAACTACACTTCAAGAAATTTCATTCTTA

ATTCCCCTTAGTGGATGTTATTAACCAAAGGCAAAAGAAAAAAAGGGTAA

AAAAAATATTCTAAATGTTAATATCAAAAATATTATTTTCAATTCACCCC

AGGCACAGAGAACTAAGTATTATTATTGCTATTGCACCGGCATTCCCCAA

TGAGACAGTGATTTTCTTTTAAGACATTTTTAAATAATATAGGCAGAATT

AAGTAGACGGTGATCTGGTAAGTAGATGTTTCAGGGTAACAGCTGTGCAA

TGCTCCATGCAGGGAATTAGATTGTCATTTTATTCCTTACCAGGAACATA

CATTCAGTTAAACAATTATTTGACTTCTGCTCTTCCACTGATTTCTAAGT

TGAGGCTCTCTCTTGTGCCTGTCTGATCAGATAAGTAGAGTTGTGCCTTG

GTTTATAGATGAGATAAATGTGTATTTGAATAAGCATAAGTTAAAGAAAT

TTTAAAATCCCTTAGGAAGCTAGGCTTATCAGAGAAATCCAAGGAAATAC

ATTAACAAACTAGGAATTTGTTCTAACAGGTTAATTATAACTCATAAACT

TATTGGTTTTTTTACCTTTTAATTTTATATTACATTTGCTTATAATAAG

GAATATTGCTAGGAATAAAATTTTTTAATATTCTACAATTAACAATTATC

TCAATTTCTTTATTCTAAAGACATTGGGATTAGAAAAATGTTCACAAGGG

ACTCCAAATATTGCTGTAGTATTTGTTTCTTAAAAGAATGATACAAAGCA

GACATGATAAAATATTAAAATTTGAGAGAACTTGATGGTAAGTACATGGG

TGTTTCTTATTTTAAAATAATTTTTCTACTTGAAATATTTTACAATACAA

TAAGGGAAAAATAAAAAGTTATTTAAGTTATTCATACTTTCTTCTTCTTT

TCTTTTTTGCTATAGAAAGTATTTATTTTTTCTGGAACATTTAGAAAAAA c<u>*c*</u>T<u>*c*</u>GATCCCTATGAACAGTGGAGTGATCAAGAAATATGGAAAGTTGCAG

ATGAGGTAAGGCTGCTAACTGAAATGATTTTGAAAGGGGTAACTCATACC

AACACAAATGGCTGATATAGCTGACATCATTCTACACACTTTGTGTGCAT

GTATGTGTGTGCACAACTTTAAAATGGAGTACCCTAACATACCTGGAGCA

ACAGGTACTTTTGACTGGACCTACCCCTAACTGAAATGATTTTGAAAGAG

GTAACTCATACCAACACAAATGGTTGATATGGCTAAGATCATTCTACACA

CTTTGTGTGCATGTATTTCTGTGCACAACTTCAAAATGGAGTACCCTAAA

ATACCTGGCGCGACAAGTACTTTTGACTGAGCCTACTTCTCTCCTCACTG

GTATGGCTCCAACCATCAGGCCCTATCTTGGTCCATTTAGGCTGCTAAAA

TAAAATACCAAAGACTGAGCTGCTTATAAGCAATCTTTGGAGGCTGAGAA

GTCAAAGATCAAGGTGCCAGCAGGTTTGCTGTCTCGTGAGAGCATACTTC

CTGGTTCATTGATGGTGCTTTCTTGCTGTGTCCTCACATAATGGAAAGGG

CAAGACCTCTCTGGTGTCTCTTTTACAATGGCACTAATCCCATCATGAGG

GCTTTGTTCTCATGACCTAATCACCTCCCACATGTCCTACATTCTAATAC

TATCACCTTGGGGGTTAGGATTTTAACATATGAATTTGAGGAGGTGGCGG

GGGGGACACAAATATTTAGACCATAGCATTTCACTCCTGACCTCCAAAGT

TCATGTCTTCTTCACATGCAAAATACATTCATTCCATCCCAATAGCCCCC

AAAGTCTTAACTTGTTCCAGCATCAACTTACAAGGCTAAAGTCCAAGGTT

TCATCTAAATATCAGCTAAATCAGCACAAACAGCTAAATCAGGTAGAGTG

GGACTTAAGGTGTGATTCCTCTTTAGGCAGATTGCTCTCCAACTATGAAA

TTGTGAAATCAAACCTATTATGTACTTTCAAAATAAAATGGTGAAACAGG

CACAGGCTAGACAGTCCCATTTCAAAAAAGAGAAATAGAAAAGAAAAAAG

GAGTGACAGGTCTCTATAAGTCTAAAACTTTAAGGCTTGAGAATAATTTG

CTTTGCTTTGCCTCCAGGCTCACTGGGGTGGTGTCTTACCTCTGGACACA

C

In an embodiment, to correct a mutation, e.g., N1303K target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the N1303K mutation is shown as lower case sequence, the silent sense mutation is shown as lower case underlined and italicized sequence, and the 3' homology arm is shown as no emphasis capitalized sequence.

(Template Construct 23; SEQ ID NO: 27295)
TTTAAAATCCCTTAGGAAGCTAGGCTTATCAGAGAAATCCAAGGAAATAC

ATTAACAAACTAGGAATTTGTTCTAACAGGTTAATTATAACTCATAAACT

TATTGGTTTTTTTACCTTTTAATTTTATATTACATTTGCTTATAATAAG

GAATATTGCTAGGAATAAAATTTTTTAATATTCTACAATTAACAATTATC

TCAATTTCTTTATTCTAAAGACATTGGGATTAGAAAAATGTTCACAAGGG

ACTCCAAATATTGCTGTAGTATTTGTTTCTTAAAAGAATGATACAAAGCA

GACATGATAAAATATTAAAATTTGAGAGAACTTGATGGTAAGTACATGGG

TGTTTCTTATTTTAAAATAATTTTTCTACTTGAAATATTTTACAATACAA

TAAGGGAAAAATAAAAAGTTATTTAAGTTATTCATACTTTCTTCTTCTTT

TCTTTTTTGCTATAGAAAGTATTTATTTTTTCTGGAACATTTAGAAAAAA c<u>*c*</u>T<u>*c*</u>GATCCCTATGAACAGTGGAGTGATCAAGAAATATGGAAAGTTGCAG

ATGAGGTAAGGCTGCTAACTGAAATGATTTTGAAAGGGGTAACTCATACC

AACACAAATGGCTGATATAGCTGACATCATTCTACACACTTTGTGTGCAT

GTATGTGTGTGCACAACTTTAAAATGGAGTACCCTAACATACCTGGAGCA

ACAGGTACTTTTGACTGGACCTACCCCTAACTGAAATGATTTTGAAAGAG

GTAACTCATACCAACACAAATGGTTGATATGGCTAAGATCATTCTACACA

CTTTGTGTGCATGTATTTCTGTGCACAACTTCAAAATGGAGTACCCTAAA

ATACCTGGCGCGACAAGTACTTTTGACTGAGCCTACTTCTCTCCTCACTG

GTATGGCTCCAACCATCAGGCCCTATCTTGGTCCATTTAGGCTGCTAAAA

TAAAATACCAAAGACTGAGCTGCTTATAAGCAATCTTTGGAGGCTGAGAA

G

In an embodiment, an ssODN may be to correct a mutation, e.g., N1303K target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the N1303K mutation is shown as lower case sequence, the silent sense mutation is shown as lower case underlined and italicized sequence, and the 3' homology arm is shown as no emphasis capitalized sequence.

(Template Construct 24; SEQ ID NO: 27296)
AGTTATTCATACTTTCTTCTTCTTTTCTTTTTTGCTATAGAAAGTATTTA

TTTTTTCTGGAACATTTAGAAAAAAc*c*T*c*GATCCCTATGAACAGTGGAGT

GATCAAGAAATATGGAAAGTTGCAGATGAGGTAAGGCTGCTAACTGAAAT

G

The underlined C has been changed from a G to C so that wild-type CFTR is still transcribed, but the PAM sequence TGG has been modified to reduce or eliminate Cas9 cleavage at that locus.

Exemplary template nucleic acids (also referred to herein as donor constructs) to correction a mutation, e.g., R117H target site in the CFTR gene, are provided.

Suitable sequence for the 5' homology arm can be selected from (e.g., includes a portion of) or include the following sequence:

(5'H arm)
SEQ ID NO: 27297
AACCCCTCAAATTAAGGGATGAGGCAGAATAATGCTTGGCAATACCAGGG

GTAGGCTGCAGTCTTTCTTGGAAATATATATTTTAAATGGAACCAATTAT

CATAGCATCATTTCCTCTCAGGGTTACCCTCTGATCCCTATTTTACTAAA

TCGTTATAAAACAAATGAGGAATTATGTGTCCTTCCCTTTTGAAGCCAA

TGTAACAAGATGGGTAAGAATTAGACCTCCTGAGTTCAAAATCCCTGGAT

TCAGATCTATTCCTGTATATTCAGGAGAAGTGGTAATAAATTCGATGGAC

AATTTGGTTTAGTAGTCGATTGAGGACCCTGATGAGGTATATTTGGGAAA

ACATAACTTCCGCTCTCTCATTGACTCACGGGCCTTTGAGGAGTCCAG

GAGTCATTGGAATCTGGCCTGAGGTTGAGGCTGCTGGCAAAACTCCTTCC

CCAAAGTCCATTCCTATTGCTGACTGAGAAGGGACTAGCATTGGAAGTGG

CTGATTTTAAATACCGCTAGTGCTGGTGTGCTCCTCCCTCCCATTCCCAG

CTCTGCTTTGTGTAGTTGCCTTGAGAAGCTAAGTTCATTCTGAAAATAAT

GCCATTGCACAAAACACTTTTGAAAGTTCTAGTTTGAAATTACATCAGGT

CACTTGGTCTGTGTGGCCTCAGTTTCTTCATCTGCCATGTGAAAATAATA

ATGCCTACTCTGTAGCAAAGAAAGTCTCTATAGTAAACAAAAAAAAAGCC

TACTCTGATACTGAAAGTTGTTATGAAAAATAAAAAAGGGAAATGCTTTA

GAAACTGTTAAGTGCTATGTAGATGTTACTAATTAACAAACCATTTCAGA

AACTATACTTTTTATTTTATGGCCACTATTCACTGTTTAACTTAAAATAC

CTCATATGTAAACTTGTCTCCCACTGTTGCTATAACAAATCCCAAGTCTT

ATTTCAAAGTACCAAGATATTGAAAATAGTGCTAAGAGTTTCACATATGG

TATGACCCTCTATATAAACTCATTTTAAGTCTCCTCTAAAGATGAAAAGT

CTTGTGTTGAAATTCTCAGGGTATTTTATGAGAAATAAATGAAATTTAAT

-continued
TTCTCTGTTTTTCCCCTTTTGTAGGAAGTCACCAAAGCAGTACAGCCTCT

CTTACTGGGAAGAATCATAGCTTCCTATGACCCGGATAACAAGG<u>AGG</u>AAC

Suitable sequence for the 3' homology arm can be selected from (e.g., includes a portion of) or include the following sequence:

(3'H arm)
SEQ ID NO: 27298
CTCTATCGCGATTTATCTAGGCATAGGCTTATGCCTTCTCTTTATTGTGA

GGACACTGCTCCTACACCCAGCCATTTTTGGCCTTCATCACATTGGAATG

CAGATGAGAATAGCTATGTTTAGTTTGATTTATAAGAAGGTAATACTTCC

TTGCACAGGCCCCATGGCACATATATTCTGTATCGTACATGTTTTAATGT

CATAAATTAGGTAGTGAGCTGGTACAAGTAAGGGATAAATGCTGAAATTA

ATTTAATATGCCTATTAAATAAATGGCAGGAATAATTAATGCTCTTAATT

ATCCTTGATAATTTAATTGACTTAAACTGATAATTATTGAGTATCTTCTG

TAAACTGCCTCTGTTGTAGTTTTTTTTTTCTCCTAATCATGTTATCATTT

TTTTGGAATCCATGGTTTCCTGTTAAGATGACTCACACAGCCTACATAAA

AGTAATTGACAAAATATCATCTTATAGTAAAATGCCACATATCTTTATGT

TCAGCAAGAAGAGTATAATATATGATTGTTAATGATAACCCAAACAACAA

AAGATTTCACCTTAACTGGTTGTCATAAGTAGTAGTATCCACCGCCTTAT

TTTGAGTTGGATTTTTATCATCCTATGAGCCCTACAAATTTAAAGTTTTT

GGAACAGCACGTGCATTGAACCCATAAGAACCTACTCTGCTTTTCTGCAT

GTATTGTCCAGACAAGAGACCAAATTGCCGAGGCATCATTTAGGTGAATT

CTAATTAACATTTAGCTACCTTACAACCACAATTCAAGGTTGTTTCAAAG

GCATGTGCTTGCATCATCCTGATTCACTACCATGTGTTACTAACTTGGAT

CTGCAAAGTCATTATAAAAAGCTGTTTTGATGGACTTATTTGGATATTGC

TTTACCCTTCTTCTCTCTTTTCTTTTATCAATGTAAAAACATTATATGTT

AAATACTTGGCTTTTAAGAGCATAGATCTGAAATCTGCCTCTAGCAAATA

ACCCATAACACTTCTAAGATATACCTGCAAGGTCAATTGTGTTGTAAAAC

CTTGATAACCATACTTTATTGTTCAAAAAAGCCTTTTATGAAGGCAGAAG

TTAAAAAAAAAAAACAAAAAAAACAGAGTCCACAGTTATCACCTCAGCTA

CAATCTCATCAGTTCACAAGTACCAGCAAAACATGTGATAAGTCAACAAA

In an embodiment, the replacement sequence comprises or consists of a Guanine (G) residue.

In an embodiment, to correct a mutation, e.g., R117H target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the R117H mutation is shown as lower case sequence, and the 3' homology arm is shown as no emphasis capitalized sequence.

(Template Construct 25; SEQ ID NO: 27299)
AACCCCTCAAATTAAGGGATGAGGCAGAATAATGCTTGGCAATACCAGGG

GTAGGCTGCAGTCTTTCTTGGAAATATATATTTTAAATGGAACCAATTAT

-continued

CATAGCATCATTTCCTCTCAGGGTTACCCTCTGATCCCTATTTTACTAAA

TCGTTATAAAACAAAATGAGGAATTATGTGTCCTTCCCTTTTGAAGCCAA

TGTAACAAGATGGGTAAGAATTAGACCTCCTGAGTTCAAAATCCCTGGAT

TCAGATCTATTCCTGTATATTCAGGAGAAGTGGTAATAAATTCGATGGAC

AATTTGGTTTAGTAGTCGATTGAGGACCCTGATGAGGTATATTTGGGAAA

ACATAACTTCCGCTCTCTCTCATTGACTCACGGGCCTTTGAGGAGTCCAG

GAGTCATTGGAATCTGGCCTGAGGTTGAGGCTGCTGGCAAAACTCCTTCC

CCAAAGTCCATTCCTATTGCTGACTGAGAAGGGACTAGCATTGGAAGTGG

CTGATTTTAAATACCGCTAGTGCTGGTGTGCTCCTCCCTCCCATTCCCAG

CTCTGCTTTGTGTAGTTGCCTTGAGAAGCTAAGTTCATTCTGAAAATAAT

GCCATTGCACAAAACACTTTTGAAAGTTCTAGTTTGAAATTACATCAGGT

CACTTGGTCTGTGTGGCCTCAGTTTCTTCATCTGCCATGTGAAAATAATA

ATGCCTACTCTGTAGCAAAGAAAGTCTCTATAGTAAACAAAAAAAAGCC

TACTCTGATACTGAAAGTTGTTATGAAAAATAAAAAAGGGAAATGCTTTA

GAAACTGTTAAGTGCTATGTAGATGTTACTAATTAACAAACCATTTCAGA

AACTATACTTTTTATTTTATGGCCACTATTCACTGTTTAACTTAAAATAC

CTCATATGTAAACTTGTCTCCCACTGTTGCTATAACAAATCCCAAGTCTT

ATTTCAAAGTACCAAGATATTGAAAATAGTGCTAAGAGTTTCACATATGG

TATGACCCTCTATATAAACTCATTTTAAGTCTCCTCTAAAGATGAAAAGT

CTTGTGTTGAAATTCTCAGGGTATTTTATGAGAAATAAATGAAATTTAAT

TTCTCTGTTTTTCCCCTTTTGTAGGAAGTCACCAAAGCAGTACAGCCTCT

CTTACTGGGAAGAATCATAGCTTCCTATGACCCGGATAACAAGG<u>AGG</u>AAC gCTCTATCGCGATTTATCTAGGCATAGGCTTATGCCTTCTCTTTATTGTG

AGGACACTGCTCCTACACCCAGCCATTTTTGGCCTTCATCACATTGGAAT

GCAGATGAGAATAGCTATGTTTAGTTTGATTTATAAGAAGGTAATACTTC

CTTGCACAGGCCCCATGGCACATATATTCTGTATCGTACATGTTTTAATG

TCATAAATTAGGTAGTGAGCTGGTACAAGTAAGGGATAAATGCTGAAATT

AATTTAATATGCCTATTAAATAAATGGCAGGAATAATTAATGCTCTTAAT

TATCCTTGATAATTTAATTGACTTAAACTGATAATTATTGAGTATCTTCT

GTAAACTGCCTCTGTTGTAGTTTTTTTTTCTCCTAATCATGTTATCATT

TTTTTGGAATCCATGGTTTCCTGTTAAGATGACTCACACAGCCTACATAA

AAGTAATTGACAAAATATCATCTTATAGTAAAATGCCACATATCTTTATG

TTCAGCAAGAAGAGTATAATATATGATTGTTAATGATAACCCAAACAACA

AAAGATTTCACCTTAACTGGTTGTCATAAGTAGTAGTATCCACCGCCTTA

TTTTGAGTTGGATTTTTATCATCCTATGAGCCCTACAAATTTAAAGTTTT

TGGAACAGCACGTGCATTGAACCCATAAGAACCTACTCTGCTTTTCTGCA

TGTATTGTCCAGACAAGAGACCAAATTGCCGAGGCATCATTTAGGTGAAT

TCTAATTAACATTTAGCTACCTTACAACCACAATTCAAGGTTGTTTCAAA

GGCATGTGCTTGCATCATCCTGATTCACTACCATGTGTTACTAACTTGGA

TCTGCAAAGTCATTATAAAAGCTGTTTTGATGGACTTATTTGGATATTG

CTTTACCCTTCTTCTCTCTTTTCTTTTATCAATGTAAAAACATTATATGT

-continued

TAAATACTTGGCTTTTAAGAGCATAGATCTGAAATCTGCCTCTAGCAAAT

AACCCATAACACTTCTAAGATATACCTGCAAGGTCAATTGTGTTGTAAAA

CCTTGATAACCATACTTTATTGTTCAAAAAAGCCTTTTATGAAGGCAGAA

GTTAAAAAAAAAAACAAAAAAAACAGAGTCCACAGTTATCACCTCAGCT

ACAATCTCATCAGTTCACAAGTACCAGCAAAACATGTGATAAGTCAACAA

A

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct R117H mutation in the CFTR gene, the 5' homology arm may be shortened less than 1000 nucleotides, e.g., e.g., 500 nucleotides, to avoid inclusion of a LINE repeat element in the 5' homology arm. The 5' homology arm is shown as bold sequence, the inserted base to correct the R117H mutation is shown as lower case sequence, and the 3' homology arm is shown as no emphasis capitalized sequence.

(Template Construct 26; SEQ ID NO: 27300)
ATGCCTACTCTGTAGCAAAGAAAGTCTCTATAGTAAACAAAAAAAAGCC

TACTCTGATACTGAAAGTTGTTATGAAAAATAAAAAAGGGAAATGCTTTA

GAAACTGTTAAGTGCTATGTAGATGTTACTAATTAACAAACCATTTCAGA

AACTATACTTTTTATTTTATGGCCACTATTCACTGTTTAACTTAAAATAC

CTCATATGTAAACTTGTCTCCCACTGTTGCTATAACAAATCCCAAGTCTT

ATTTCAAAGTACCAAGATATTGAAAATAGTGCTAAGAGTTTCACATATGG

TATGACCCTCTATATAAACTCATTTTAAGTCTCCTCTAAAGATGAAAAGT

CTTGTGTTGAAATTCTCAGGGTATTTTATGAGAAATAAATGAAATTTAAT

TTCTCTGTTTTTCCCCTTTTGTAGGAAGTCACCAAAGCAGTACAGCCTCT

CTTACTGGGAAGAATCATAGCTTCCTATGACCCGGATAACAAGG<u>AGG</u>AAC gCTCTATCGCGATTTATCTAGGCATAGGCTTATGCCTTCTCTTTATTGTG

AGGACACTGCTCCTACACCCAGCCATTTTTGGCCTTCATCACATTGGAAT

GCAGATGAGAATAGCTATGTTTAGTTTGATTTATAAGAAGGTAATACTTC

CTTGCACAGGCCCCATGGCACATATATTCTGTATCGTACATGTTTTAATG

TCATAAATTAGGTAGTGAGCTGGTACAAGTAAGGGATAAATGCTGAAATT

AATTTAATATGCCTATTAAATAAATGGCAGGAATAATTAATGCTCTTAAT

TATCCTTGATAATTTAATTGACTTAAACTGATAATTATTGAGTATCTTCT

GTAAACTGCCTCTGTTGTAGTTTTTTTTTCTCCTAATCATGTTATCATT

TTTTTGGAATCCATGGTTTCCTGTTAAGATGACTCACACAGCCTACATAA

AAGTAATTGACAAAATATCATCTTATAGTAAAATGCCACATATCTTTATG

T

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., R117H target site in the CFTR gene. For example, the ssODN may include 5' and 3' homology arms as shown below. The 5' homology arm is shown as bold sequence, the inserted bases to correct the R117H mutation is shown as lower case sequence, and the 3' homology arm is shown as no emphasis capitalized sequence.

(Template Construct 27; SEQ ID NO: 27301)
AAGTCACCAAAGCAGTACAGCCTCTCTTACTGGGAAGAATCATAGCTTCC TATGACCCGGATAACAAGGAGGAACgCTCTATCGCGATTTATCTAGGCAT

AGGCTTATGCCTTCTCTTTATTGTGAGGACACTGCTCCTACACCCAGCCA

T

In an embodiment, to correct a mutation, e.g., R117H target site in the CFTR gene, and concomitantly introduce a silent sense mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the R117H mutation is shown as lower case sequence, the silent sense mutation is shown as lower case underlined and italicized sequence, and the 3' homology arm is shown as no emphasis capitalized sequence.

(Template Construct 28; SEQ ID NO: 27302)
AACCCCTCAAATTAAGGGATGAGGCAGAATAATGCTTGGCAATACCAGGG

GTAGGCTGCAGTCTTTCTTGGAAATATATATTTTAAATGGAACCAATTAT

CATAGCATCATTTCCTCTCAGGGTTACCCTCTGATCCCTATTTTACTAAA

TCGTTATAAAACAAAATGAGGAATTATGTGTCCTTCCCTTTTGAAGCCAA

TGTAACAAGATGGGTAAGAATTAGACCTCCTGAGTTCAAAATCCCTGGAT

TCAGATCTATTCCTGTATATTCAGGAGAAGTGGTAATAAATTCGATGGAC

AATTTGGTTTAGTAGTCGATTGAGGACCCTGATGAGGTATATTTGGGAAA

ACATAACTTCCGCTCTCTCATTGACTCACGGGCCTTTGAGGAGTCCAG

GAGTCATTGGAATCTGGCCTGAGGTTGAGGCTGCTGGCAAAACTCCTTCC

CCAAAGTCCATTCCTATTGCTGACTGAGAAGGGACTAGCATTGGAAGTGG

CTGATTTTAAATACCGCTAGTGCTGGTGTGCTCCTCCCTCCCATTCCCAG

CTCTGCTTTGTGTAGTTGCCTTGAGAAGCTAAGTTCATTCTGAAAATAAT

GCCATTGCACAAAACACTTTTGAAAGTTCTAGTTTGAAATTACATCAGGT

CACTTGGTCTGTGTGGCCTCAGTTTCTTCATCTGCCATGTGAAAATAATA

ATGCCTACTCTGTAGCAAAGAAAGTCTCTATAGTAAACAAAAAAAAAGCC

TACTCTGATACTGAAAGTTGTTATGAAAAATAAAAAAGGGAAATGCTTTA

GAAACTGTTAAGTGCTATGTAGATGTTACTAATTAACAAACCATTTCAGA

-continued
AACTATACTTTTTATTTTATGGCCACTATTCACTGTTTAACTTAAAATAC

CTCATATGTAAACTTGTCTCCCACTGTTGCTATAACAAATCCCAAGTCTT

ATTTCAAAGTACCAAGATATTGAAAATAGTGCTAAGAGTTTCACATATGG

TATGACCCTCTATATAAACTCATTTTAAGTCTCCTCTAAAGATGAAAAGT

CTTGTGTTGAAATTCTCAGGGTATTTTATGAGAAATAAATGAAATTTAAT

TTCTCTGTTTTTCCCCTTTTGTAGGAAGTCACCAAAGCAGTACAGCCTCT

CTTACTGGGAAGAATCATAGCTTCCTATGACCCGGATAAtAAaGAaGAAC gCTCTATCGCGATTTATCTAGGCATAGGCTTATGCCTTCTCTTTATTGTG

AGGACACTGCTCCTACACCCAGCCATTTTTGGCCTTCATCACATTGGAAT

GCAGATGAGAATAGCTATGTTTAGTTTGATTTATAAGAAGGTAATACTTC

CTTGCACAGGCCCCATGGCACATATATTCTGTATCGTACATGTTTTAATG

TCATAAATTAGGTAGTGAGCTGGTACAAGTAAGGGATAAATGCTGAAATT

AATTTAATATGCCTATTAAATAAATGGCAGGAATAATTAATGCTCTTAAT

TATCCTTGATAATTTAATTGACTTAAACTGATAATTATTGAGTATCTTCT

GTAAACTGCCTCTGTTGTAGTTTTTTTTTTCTCCTAATCATGTTATCATT

TTTTTGGAATCCATGGTTTCCTGTTAAGATGACTCACACAGCCTACATAA

AAGTAATTGACAAAATATCATCTTATAGTAAAATGCCACATATCTTTATG

TTCAGCAAGAAGAGTATAATATATGATTGTTAATGATAACCCAAACAACA

AAAGATTTCACCTTAACTGGTTGTCATAAGTAGTAGTATCCACCGCCTTA

TTTTGAGTTGGATTTTTATCATCCTATGAGCCCTACAAATTTAAAGTTTT

TGGAACAGCACGTGCATTGAACCCATAAGAACCTACTCTGCTTTTCTGCA

TGTATTGTCCAGACAAGAGACCAAATTGCCGAGGCATCATTTAGGTGAAT

TCTAATTAACATTTAGCTACCTTACAACCACAATTCAAGGTTGTTTCAAA

GGCATGTGCTTGCATCATCCTGATTCACTACCATGTGTTACTAACTTGGA

TCTGCAAAGTCATTATAAAAGCTGTTTTGATGGACTTATTTGGATATTG

CTTTACCCTTCTTCTCTCTTTTCTTTTATCAATGTAAAAACATTATATGT

TAAATACTTGGCTTTTAAGAGCATAGATCTGAAATCTGCCTCTAGCAAAT

AACCCATAACACTTCTAAGATATACCTGCAAGGTCAATTGTGTTGTAAAA

CCTTGATAACCATACTTTATTGTTCAAAAAAGCCTTTTATGAAGGCAGAA

GTTAAAAAAAAAAACAAAAAAAACAGAGTCCACAGTTATCACCTCAGCT

ACAATCTCATCAGTTCACAAGTACCAGCAAAACATGTGATAAGTCAACAA

A

In an embodiment, to correct a mutation, e.g., R117H target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the R117H mutation is shown as lower case sequence, the silent sense mutation is shown as lower case underlined and italicized sequence, and the 3' homology arm is shown as no emphasis capitalized sequence.

(Template Construct 29; SEQ ID NO: 27303)
ATGCCTACTCTGTAGCAAAGAAAGTCTCTATAGTAAACAAAAAAAAAGCC

TACTCTGATACTGAAAGTTGTTATGAAAAATAAAAAAGGGAAATGCTTTA

GAAACTGTTAAGTGCTATGTAGATGTTACTAATTAACAAACCATTTCAGA

AACTATACTTTTTATTTTATGGCCACTATTCACTGTTTAACTTAAAATAC

CTCATATGTAAACTTGTCTCCCACTGTTGCTATAACAAATCCCAAGTCTT

ATTTCAAAGTACCAAGATATTGAAAATAGTGCTAAGAGTTTCACATATGG

TATGACCCTCTATATAAACTCATTTTAAGTCTCCTCTAAAGATGAAAAGT

CTTGTGTTGAAATTCTCAGGGTATTTTATGAGAAATAAATGAAATTTAAT

TTCTCTGTTTTTCCCCTTTTGTAGGAAGTCACCAAAGCAGTACAGCCTCT

CTTACTGGGAAGAATCATAGCTTCCTATGACCCGGATAA<u>t</u>AA<u>a</u>GA<u>a</u>GAAC gCTCTATCGCGATTTATCTAGGCATAGGCTTATGCCTTCTCTTTATTGTG

AGGACACTGCTCCTACACCCAGCCATTTTTGGCCTTCATCACATTGGAAT

GCAGATGAGAATAGCTATGTTTAGTTTGATTTATAAGAAGGTAATACTTC

CTTGCACAGGCCCCATGGCACATATATTCTGTATCGTACATGTTTTAATG

TCATAAATTAGGTAGTGAGCTGGTACAAGTAAGGGATAAATGCTGAAATT

AATTTAATATGCCTATTAAATAAATGGCAGGAATAATTAATGCTCTTAAT

TATCCTTGATAATTTAATTGACTTAAACTGATAATTATTGAGTATCTTCT

GTAAACTGCCTCTGTTGTAGTTTTTTTTTTCTCCTAATCATGTTATCATT

TTTTTGGAATCCATGGTTTCCTGTTAAGATGACTCACACAGCCTACATAA

AAGTAATTGACAAAATATCATCTTATAGTAAAATGCCACATATCTTTATG

T

In an embodiment, an ssODN may be to correct a mutation, e.g., R117H target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the R117H mutation is shown as lower case sequence, the silent sense mutation is shown as lower case underlined and italicized sequence, and the 3' homology arm is shown as no emphasis capitalized sequence.

(Template Construct 30; SEQ ID NO: 27304)
AAGTCACCAAAGCAGTACAGCCTCTCTTACTGGGAAGAATCATAGCTTCC TATGACCCGGATAA<u>t</u>AA<u>a</u>GA<u>a</u>GAACgCTCTATCGCGATTTATCTAGGCAT

AGGCTTATGCCTTCTCTTTATTGTGAGGACACTGCTCCTACACCCAGCCA

T

The underlined T has been changed from an A to T at that position and each underlined A has been changed from a T to A at that position so that wild-type CFTR is still transcribed, but the PAM sequence TGG has been modified to reduce or eliminate Cas9 cleavage at that locus.

Exemplary template nucleic acids (also referred to herein as donor constructs) to correction a mutation, e.g., W1282X target site in the CFTR gene, are provided.

Suitable sequence for the 5' homology arm can be selected from (e.g., includes a portion of) or include the following sequence:

(5'H arm)
SEQ ID NO: 27305
TTTTTATTATATATTTTTGAAGTATTGATATGTAGTGAATTAGAAATTTA

AAAAGAAAACAAAACTGTCCTTCACTACAGATTGAAAAGCATTATACTAA

AAGACCATTTGCTCAGTTATAGTATATAAAGGCCAAATGACTTAAAAACA

AATTATGTAAGGAGAAGGAAACAACCATTTATTCAGTGCCACTAACTGTC

AGCCAGTTTTTTCAGTGGTCAGTTAATGACTGCAGTAGTGTTCTACCTTG

CTCAAAGCACCCTCCTCAAGTTCTGGCATCTAAGCTGACATCAGAACACA

GAGTTGGGGCTCTCTGTGGGTCACCTCTAGCACTTGATCTCCTCATGCAG

TGCATGGTGCTCTCACGTCTATGCTATGTTCTTATGGTCTTTAGGTAACA

AGAATAATTTTCTTTCTTTTCCTTACTATACATTTTGCTTTCTGAAATTC

CCTTCTCGCCAATCCAGGTGAATGTCAGAATGTGATTTGACAACTGTCCA

AAGTACTCATTCACTGAGGAGTGGTAAGGCCTTCGCCCAACCTGCCTTCT

CTGGGAATATACTGCTGCCTGAACATATCATTGTTTATTGCCAGGCTTGA

ACTTCACCAAATTAATTTATTAGGGTCAACATCTAAATATTAGAACTATT

TCAGATTAATTTTTAAGTCGTATCCACTTTGGGTACTAGATCAAATTGCA

GGTCTCTGCTTCTGGCTTGAGCCTATGTTTAGAGATGATGTGCATGAAGA

CACTCTTTGCTTTTCCTTTATGCAAAATGGGCATTTTCAATCTTTTTGTC

ATTAGTAAAGGTCAGTGATAAAGGAAGTCTGCATCAGGGGTCCAATTCCT

TATGGCCAGTTTCTCTATTCTGTTCCAAGGTTGTTTGTCTCCATATATCA

ACATTGGTCAGGATTGAAAGTGTGCAACAAGGTTTGAATGAATAAGTGAA

AATCTTCCACTGGTGACAGGATAAAATATTCCAATGGTTTTTATTGAAGT

ACAATACTGAATTATGTTTATGGCATGGTACCTATATGTCACAGAAGTGA

TCCCATCACTTTTTACCTTATAGGTGGGCCTCTTGGGAAGAACTGGATCAG

GGAAGAGTACTTTGTTATCAGCTTTTTTGAGACTACTGAACACTGAAGGA

GAAATCCAGATCGATGGTGTGTCTTGGGATTCAATAACTTTGCAACAGTG

Suitable sequence for the 3' homology arm can be selected from (e.g., includes a portion of) or include the following sequence:

(3'H arm)
SEQ ID NO: 27306
AGGAAAGCCTTTGGAGTGATACCACAGGTGAGCAAAAGGACTTAGCCAGA

AAAAAGGCAACTAAATTATATTTTTTACTGCTATTTGATACTTGTACTCA

AGAAATTCATATTACTCTGCAAAATATATTTGTTATGCATTGCTGTCTTT

TTTCTCCAGTGCAGTTTTCTCATAGGCAGAAAAGATGTCTCTAAAAGTTT

GGAATTCTCAAATTCTGGTTATTGAAATGTTCATAGCTTTGATAGTGTTT

TTCAGAAGACCAAATTTACAGTGGGAGCCTTGGGCTTTTGTTTTTTAACA

GCTCTTTTTTGTTCCTGCTTCAGTGGCCTGACCTCCAAGTTAGCAATCGC

CAGGTTGAGAAATGCTTTGCGAGACATAACAGATGCTCCTGAAATAACAA

ACACTTGGAATCATGAGGTAGTGGAATTGAAAATAGAAAGTGTAGTGATT

GTTTTTTGTTATTTGGATGGGATGAACAATGTCAGATTAGTCTGTAACTA

TTTTTTTTTAATGTCACTCTGATTTGGTCACAAAGGATCTCTAGTCTCAT

TGCCTTAGTATCATTCTACGAATTAGAATGTGTTACTGTGTAAGAGCACT

TCTTGTATATGAGAGAAATAGCAACAGTTCCAGTTTAAAGTGATATAAAT

GGAAACCAAGAAATGTCTTTACTGGGACCAAATCTGGACAGCATTTACTG

TATTTTTGCTGGTATTTTCTCTAGTCTTTCCGGGTATATTCACATTTAAT

GATCACTTTTCTCCCTTTGTGCTAATGGACACTGAATCCATTCCACTACC

ATAGTTCTTGCTAATACTACTCTACTTTTTACACAAAATTAAAATGCCAG

GAGCACCTCCAGGTAGACTGACTATAAATCTAGACTGAAAAAAAAGCTTG

TATTTCTTAACAGATTACCTTGTGGAACATTTGCTCCTTTCAACTAATGA

GGCACTAAATATTGTAACTGCTCAACTGGTGCTTTTAATTTATTTGTCTA

GACTTTGTCATGTTGCCAGAAGCTTTATCCTGGTTGGAGTTTTGAAAACA

GTATTGTTTCTTCAGAAAGAAAAAAGGGATTGTCAGATGATCTAAAAATA

AAGAAACACTGGAAATACAAGTATCCCAAGGTGATAGCATTAGGCAAGAT

AAAAATGTTGAAAAGCGAAAAAGAACTGGTTGATAGAGAAGTGTTGTTAT

In an embodiment, the replacement sequence comprises or consists of a Guanine (G) residue.

In an embodiment, to correct a mutation, e.g., W1282X target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the W1282X mutation is shown as lower case sequence, and the 3' homology arm is shown as no emphasis capitalized sequence.

(Template Construct 31; SEQ ID NO: 27307)
TTTTTATTATATATTTTTGAAGTATTGATATGTAGTGAATTAGAAATTTA

AAAAGAAAACAAAACTGTCCTTCACTACAGATTGAAAAGCATTATACTAA

AAGACCATTTGCTCAGTTATAGTATATAAAGGCCAAATGACTTAAAAACA

AATTATGTAAGGAGAAGGAAACAACCATTTATTCAGTGCCACTAACTGTC

AGCCAGTTTTTTCAGTGGTCAGTTAATGACTGCAGTAGTGTTCTACCTTG

CTCAAAGCACCCTCCTCAAGTTCTGGCATCTAAGCTGACATCAGAACACA

GAGTTGGGGCTCTCTGTGGGTCACCTCTAGCACTTGATCTCCTCATGCAG

TGCATGGTGCTCTCACGTCTATGCTATGTTCTTATGGTCTTTAGGTAACA

AGAATAATTTTCTTTCTTTTCCTTACTATACATTTTGCTTTCTGAAATTC

CCTTCTCGCCAATCCAGGTGAATGTCAGAATGTGATTTGACAACTGTCCA

AAGTACTCATTCACTGAGGAGTGGTAAGGCCTTCGCCCAACCTGCCTTCT

CTGGGAATATACTGCTGCCTGAACATATCATTGTTTATTGCCAGGCTTGA

ACTTCACCAAATTAATTTATTAGGGTCAACATCTAAATATTAGAACTATT

TCAGATTAATTTTTAAGTCGTATCCACTTTGGGTACTAGATCAAATTGCA

GGTCTCTGCTTCTGGCTTGAGCCTATGTTTAGAGATGATGTGCATGAAGA

CACTCTTTGCTTTTCCTTTATGCAAAATGGGCATTTTCAATCTTTTTGTC

ATTAGTAAAGGTCAGTGATAAAGGAAGTCTGCATCAGGGGTCCAATTCCT

TATGGCCAGTTTCTCTATTCTGTTCCAAGGTTGTTTGTCTCCATATATCA

ACATTGGTCAGGATTGAAAGTGTGCAACAAGGTTTGAATGAATAAGTGAA

AATCTTCCACTGGTGACAGGATAAAATATTCCAATGGTTTTTATTGAAGT

ACAATACTGAATTATGTTTATGGCATGGTACCTATATGTCACAGAAGTGA

TCCCATCACTTTTACCTTATAGGTGGGCCTCTTGGGAAGAACTGGATCAG

GGAAGAGTACTTTGTTATCAGCTTTTTTGAGACTACTGAACACTGAAGGA

GAAATCCAGATCGATGGTGTGTCTTGGGATTCAATAACTTTGCAACAGTG gAGGAAAGCCTTTGGAGTGATACCACAGGTGAGCAAAAGGACTTAGCCAG

AAAAAAGGCAACTAAATTATATTTTTTACTGCTATTTGATACTTGTACTC

AAGAAATTCATATTACTCTGCAAAATATATTTGTTATGCATTGCTGTCTT

TTTTCTCCAGTGCAGTTTTCTCATAGGCAGAAAAGATGTCTCTAAAAGTT

TGGAATTCTCAAATTCTGGTTATTGAAATGTTCATAGCTTTGATAGTGTT

TTTCAGAAGACCAAATTTACAGTGGGAGCCTTGGGCTTTTGTTTTTTAAC

AGCTCTTTTTGTTCCTGCTTCAGTGGCCTGACCTCCAAGTTAGCAATCG

CCAGGTTGAGAAATGCTTTGCGAGACATAACAGATGCTCCTGAAATAACA

AACACTTGGAATCATGAGGTAGTGGAATTGAAAATAGAAAGTGTAGTGAT

TGTTTTTTGTTATTTGGATGGGATGAACAATGTCAGATTAGTCTGTAACT

ATTTTTTTTTAATGTCACTCTGATTTGGTCACAAAGGATCTCTAGTCTCA

TTGCCTTAGTATCATTCTACGAATTAGAATGTGTTACTGTGTAAGAGCAC

TTCTTGTATATGAGAGAAATAGCAACAGTTCCAGTTTAAAGTGATATAAA

TGGAAACCAAGAAATGTCTTTACTGGGACCAAATCTGGACAGCATTTACT

GTATTTTTGCTGGTATTTTCTCTAGTCTTTCCGGGTATATTCACATTTAA

TGATCACTTTTCTCCCTTTGTGCTAATGGACACTGAATCCATTCCACTAC

CATAGTTCTTGCTAATACTACTCTACTTTTTACACAAAATTAAAATGCCA

GGAGCACCTCCAGGTAGACTGACTATAAATCTAGACTGAAAAAAAAGCTT

GTATTTCTTAACAGATTACCTTGTGGAACATTTGCTCCTTTCAACTAATG

AGGCACTAAATATTGTAACTGCTCAACTGGTGCTTTTAATTTATTTGTCT

AGACTTTGTCATGTTGCCAGAAGCTTTATCCTGGTTGGAGTTTTGAAAAC

AGTATTGTTTCTTCAGAAAGAAAAAAGGGATTGTCAGATGATCTAAAAAT

AAAGAAACACTGGAAATACAAGTATCCCAAGGTGATAGCATTAGGCAAGA

TAAAAATGTTGAAAAGCGAAAAAGAACTGGTTGATAGAGAAGTGTTGTTA

T

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct W1282X mutation in the CFTR gene, the 5' homology arm may be shortened less than 1000 nucleotides, e.g., e.g., 500 nucleotides, to avoid inclusion of a LINE repeat element in the 5' homology arm. The 5' homology arm is shown as bold sequence, the inserted base to correct the W1282X mutation is shown as lower case sequence, and the 3' homology arm is shown as no emphasis capitalized sequence.

(Template Construct 32; SEQ ID NO: 27308)
GGTCTCTGCTTCTGGCTTGAGCCTATGTTTAGAGATGATGTGCATGAAGA

CACTCTTTGCTTTTCCTTTATGCAAAATGGGCATTTTCAATCTTTTTGTC

ATTAGTAAAGGTCAGTGATAAAGGAAGTCTGCATCAGGGGTCCAATTCCT

TATGGCCAGTTTCTCTATTCTGTTCCAAGGTTGTTTGTCTCCATATATCA

ACATTGGTCAGGATTGAAAGTGTGCAACAAGGTTTGAATGAATAAGTGAA

AATCTTCCACTGGTGACAGGATAAAATATTCCAATGGTTTTTATTGAAGT

ACAATACTGAATTATGTTTATGGCATGGTACCTATATGTCACAGAAGTGA

TCCCATCACTTTTACCTTATAGGTGGGCCTCTTGGGAAGAACTGGATCAG

GGAAGAGTACTTTGTTATCAGCTTTTTTGAGACTACTGAACACTGAAGGA

GAAATCCAGATCGATGGTGTGTCTTGGGATTCAATAACTTTGCAACAGTG

<u>g</u>AGGAAAGCCTTTGGAGTGATACCACAGGTGAGCAAAAGGACTTAGCCAG

AAAAAAGGCAACTAAATTATATTTTTTACTGCTATTTGATACTTGTACTC

AAGAAATTCATATTACTCTGCAAAATATATTTGTTATGCATTGCTGTCTT

TTTTCTCCAGTGCAGTTTTCTCATAGGCAGAAAAGATGTCTCTAAAAGTT

TGGAATTCTCAAATTCTGGTTATTGAAATGTTCATAGCTTTGATAGTGTT

TTTCAGAAGACCAAATTTACAGTGGGAGCCTTGGGCTTTTGTTTTTTAAC

AGCTCTTTTTTGTTCCTGCTTCAGTGGCCTGACCTCCAAGTTAGCAATCG

CCAGGTTGAGAAATGCTTTGCGAGACATAACAGATGCTCCTGAAATAACA

AACACTTGGAATCATGAGGTAGTGGAATTGAAAATAGAAAGTGTAGTGAT

TGTTTTTTGTTATTTGGATGGGATGAACAATGTCAGATTAGTCTGTAACT

A

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., W1282X target site in the CFTR gene. For example, the ssODN may include 5' and 3' homology arms as shown below. The 5' homology arm is shown as bold sequence, the inserted bases to correct the W1282X mutation is shown as lower case sequence, and the 3' homology arm is shown as no emphasis capitalized sequence.

(Template Construct 33; SEQ ID NO: 27309)
TTTGAGACTACTGAACACTGAAGGAGAAATCCAGATCGATGGTGTGTCTT

GGGATTCAATAACTTTGCAACAGTG<u>g</u>AGGAAAGCCTTTGGAGTGATACCA

CAGGTGAGCAAAAGGACTTAGCCAGAAAAAAGGCAACTAAATTATATTTT

In an embodiment, to correct a mutation, e.g., W1282X target site in the CFTR gene, and concomitantly introduce a silent sense mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the W1282X mutation is shown as lower case sequence, the silent sense mutation is shown as lower case underlined and italicized sequence, and the 3' homology arm is shown as no emphasis capitalized sequence.

(Template Construct 34; SEQ ID NO: 27310)
TTTTTATTATATATTTTTGAAGTATTGATATGTAGTGAATTAGAAATTTA

AAAAGAAAACAAAACTGTCCTTCACTACAGATTGAAAAGCATTATACTAA

AAGACCATTTGCTCAGTTATAGTATATAAAGGCCAAATGACTTAAAAACA

AATTATGTAAGGAGAAGGAAACAACCATTTATTCAGTGCCACTAACTGTC

AGCCAGTTTTTTCAGTGGTCAGTTAATGACTGCAGTAGTGTTCTACCTTG

CTCAAAGCACCCTCCTCAAGTTCTGGCATCTAAGCTGACATCAGAACACA

GAGTTGGGGCTCTCTGTGGGTCACCTCTAGCACTTGATCTCCTCATGCAG

TGCATGGTGCTCTCACGTCTATGCTATGTTCTTATGGTCTTTAGGTAACA

AGAATAATTTTCTTTCTTTTCCTTACTATACATTTTGCTTTCTGAAATTC

CCTTCTCGCCAATCCAGGTGAATGTCAGAATGTGATTTGACAACTGTCCA

AAGTACTCATTCACTGAGGAGTGGTAAGGCCTTCGCCCAACCTGCCTTCT

CTGGGAATATACTGCTGCCTGAACATATCATTGTTTATTGCCAGGCTTGA

ACTTCACCAAATTAATTTATTAGGGTCAACATCTAAATATTAGAACTATT

TCAGATTAATTTTTAAGTCGTATCCACTTTGGGTACTAGATCAAATTGCA

GGTCTCTGCTTCTGGCTTGAGCCTATGTTTAGAGATGATGTGCATGAAGA

CACTCTTTGCTTTTCCTTTATGCAAAATGGGCATTTTCAATCTTTTTGTC

ATTAGTAAAGGTCAGTGATAAAGGAAGTCTGCATCAGGGGTCCAATTCCT

TATGGCCAGTTTCTCTATTCTGTTCCAAGGTTGTTTGTCTCCATATATCA

ACATTGGTCAGGATTGAAAGTGTGCAACAAGGTTTGAATGAATAAGTGAA

AATCTTCCACTGGTGACAGGATAAAATATTCCAATGGTTTTTATTGAAGT

ACAATACTGAATTATGTTTATGGCATGGTACCTATATGTCACAGAAGTGA

TCCCATCACTTTTACCTTATAGGTGGGCCTCTTGGGAAGAACTGGATCAG

GGAAGAGTACTTTGTTATCAGCTTTTTTGAGACTACTGAACACTGAAGGA

GAAATCCAGATCGATGGTGTGTCTTGGGATTCAATAACTTTGCAACAGTG gAG<u>a</u>AAAGCCTTTGGAGTGATACCACAGGTGAGCAAAAGGACTTAGCCAG

AAAAAAGGCAACTAAATTATATTTTTTACTGCTATTTGATACTTGTACTC

AAGAAATTCATATTACTCTGCAAAATATATTTGTTATGCATTGCTGTCTT

TTTTCTCCAGTGCAGTTTTCTCATAGGCAGAAAAGATGTCTCTAAAAGTT

TGGAATTCTCAAATTCTGGTTATTGAAATGTTCATAGCTTTGATAGTGTT

TTTCAGAAGACCAAATTTACAGTGGGAGCCTTGGGCTTTTGTTTTTTAAC

AGCTCTTTTTTGTTCCTGCTTCAGTGGCCTGACCTCCAAGTTAGCAATCG

CCAGGTTGAGAAATGCTTTGCGAGACATAACAGATGCTCCTGAAATAACA

AACACTTGGAATCATGAGGTAGTGGAATTGAAAATAGAAAGTGTAGTGAT

TGTTTTTTGTTATTTGGATGGGATGAACAATGTCAGATTAGTCTGTAACT

ATTTTTTTTAATGTCACTCTGATTTGGTCACAAAGGATCTCTAGTCTCA

TTGCCTTAGTATCATTCTACGAATTAGAATGTGTTACTGTGTAAGAGCAC

TTCTTGTATATGAGAGAAATAGCAACAGTTCCAGTTTAAAGTGATATAAA

TGGAAACCAAGAAATGTCTTTACTGGGACCAAATCTGGACAGCATTTACT

-continued

```
GTATTTTTGCTGGTATTTTCTCTAGTCTTTCCGGGTATATTCACATTTAA

TGATCACTTTTCTCCCTTTGTGCTAATGGACACTGAATCCATTCCACTAC

CATAGTTCTTGCTAATACTACTCTACTTTTTACACAAAATTAAAATGCCA

GGAGCACCTCCAGGTAGACTGACTATAAATCTAGACTGAAAAAAAGCTT

GTATTTCTTAACAGATTACCTTGTGGAACATTTGCTCCTTTCAACTAATG

AGGCACTAAATATTGTAACTGCTCAACTGGTGCTTTTAATTTATTTGTCT

AGACTTTGTCATGTTGCCAGAAGCTTTATCCTGGTTGGAGTTTTGAAAAC

AGTATTGTTTCTTCAGAAAGAAAAAAGGGATTGTCAGATGATCTAAAAAT

AAAGAAACACTGGAAATACAAGTATCCCAAGGTGATAGCATTAGGCAAGA

TAAAAATGTTGAAAAGCGAAAAAGAACTGGTTGATAGAGAAGTGTTGTTA

T
```

In an embodiment, to correct a mutation, e.g., W1282X target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the W1282X mutation is shown as lower case sequence, the silent sense mutation is shown as lower case underlined and italicized sequence, and the 3' homology arm is shown as no emphasis capitalized sequence.

```
GGTCTCTGCTTCTGGCTTGAGCCTATGTTTAGAGATGATGTGCATGAAGA

CACTCTTTGCTTTTCCTTTATGCAAAATGGGCATTTTCAATCTTTTTGTC

ATTAGTAAAGGTCAGTGATAAAGGAAGTCTGCATCAGGGGTCCAATTCCT

TATGGCCAGTTTCTCTATTCTGTTCCAAGGTTGTTTGTCTCCATATATCA

ACATTGGTCAGGATTGAAAGTGTGCAACAAGGTTTGAATGAATAAGTGAA

AATCTTCCACTGGTGACAGGATAAAATATTCCAATGGTTTTTATTGAAGT

ACAATACTGAATTATGTTTATGGCATGGTACCTATATGTCACAGAAGTGA

TCCCATCACTTTTACCTTATAGGTGGGCCTCTTGGGAAGAACTGGATCAG

GGAAGAGTACTTTGTTATCAGCTTTTTTGAGACTACTGAACACTGAAGGA

GAAATCCAGATCGATGGTGTGTCTTGGGATTCAATAACTTTGCAACAGTG gAGaAAAGCCTTTGGAGTGATACCACAGGTGAGCAAAAGGACTTAGCCAG

AAAAAAGGCAACTAAATTATATTTTTTACTGCTATTTGATACTTGTACTC

AAGAAATTCATATTACTCTGCAAAATATATTTGTTATGCATTGCTGTCTT

TTTTCTCCAGTGCAGTTTTCTCATAGGCAGAAAAGATGTCTCTAAAAGTT

TGGAATTCTCAAATTCTGGTTATTGAAATGTTCATAGCTTTGATAGTGTT

TTTCAGAAGACCAAATTTACAGTGGGAGCCTTGGGCTTTTGTTTTTTAAC

AGCTCTTTTTTGTTCCTGCTTCAGTGGCCTGACCTCCAAGTTAGCAATCG

CCAGGTTGAGAAATGCTTTGCGAGACATAACAGATGCTCCTGAAATAACA

AACACTTGGAATCATGAGGTAGTGGAATTGAAAATAGAAAGTGTAGTGAT

TGTTTTTTGTTATTTGGATGGGATGAACAATGTCAGATTAGTCTGTAACT

A
```

In an embodiment, an ssODN may be to correct a mutation, e.g., W1282X target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the W1282X mutation is shown as lower case sequence, the silent sense mutation is shown as lower case underlined and italicized sequence, and the 3' homology arm is shown as no emphasis capitalized sequence.

(Template Construct 35; SEQ ID NO: 27311)
```
TTTGAGACTACTGAACACTGAAGGAGAAATCCAGATCGATGGTGTGTCTT GGGATTCAATAACTTTGCAACAGTGgAGaAAAGCCTTTGGAGTGATACCA

CAGGTGAGCAAAAGGACTTAGCCAGAAAAAAGGCAACTAAATTATATTTT
```

The underlined A has been changed from a T to A at that position so that wild-type CFTR is still transcribed, but the PAM sequence AGG has been modified to reduce or eliminate Cas9 cleavage at that locus.

Exemplary template nucleic acids (also referred to herein as donor constructs) to correction a mutation, e.g., R553X target site in the CFTR gene, are provided.

Suitable sequence for the 5' homology arm can be selected from (e.g., includes a portion of) or include the following sequence:

(5'H arm)
SEQ ID NO: 27312
```
AACAGAAGTAACCATTTTGATACTTTAGATATAGATAATATTGGATTATT

TCTGGATTGTGAAAGAAGAAGGAAGAAGCATATGGAAGAGAAGTTTTAGT

AGAGGGGAGGAAGGAGGAGGTGGAAACGAATGTACAAGGATGGGAGGAGA

AAAGGGAGAGAGACTTTTTTTTTTTAAGGCGAGAGTTTACTACCTATCT

AACTCTTCGCATTCTTGAAGTCTCAGACCAAATCCCATCGGTTTGAAAGC

CTCTAGGGTATTCTATCTATTGTATACTTCTGTTATGTACAAAATTAATT

TGCCAATTAATTGTGAACTGTTTTATAAACTATCTTAAAATGGTTAGTTA

AATCTTTGGGATAGTATTTAGCTTTCTCCAGGATTATGACTTACCTTCTA

AATTAGACATACAATGCCTAGGAGTCAAGGACTATTTTGCATAAATTCCA

GTCTTCTTTTACAATGCCTAGAATGATTGTTACCACAGAAATATTCATTA

CCTGGGAGAAAGGATGACAGGAGGGGCAGAATGAATGGAGAGAGGTCGTG

AGAATGAGGTGCTGAGGATGGACGAGGAAGAAAGCTGTTTTAGTTGGGAG

GATAGGTGACAGAAGCATGGAAAGGAATTGCCTTGGACCCATGGAAGCCC

AGTGAAGATACTTAGATCCTGCAGGGGTGTGAATAATGTTCTTTTAGTTT

CTCTTCTTAGGAGGTTTGTTCATTTTGGGAGATTTCTTTTGAAAAGAGTG

AACTTAAATTGGAGAAAAGTACATTTTAGTATGTTGATAACATTTGAATT

TGTAAAATGGACCTATGGATGATCTACACATATTTATATACCCATAAATA

TACACATATTTTAATTTTTGGTATTTTATAATTATTATTTAATGATCATT

CATGACATTTTAAAAATTACAGAAAAATTTACATCTAAAATTTCAGCAAT

GTTGTTTTTGACCAACTAAATAAATTGCATTTGAAATAATGGAGATGCAA

TGTTCAAAATTTCAACTGTGGTTAAAGCAATAGTGTGATATATGATTACA

TTAGAAGGAAGATGTGCCTTTCAAATTCAGATTGAGCATACTAAAAGTGA
```

CTCTCTAATTTTCTATTTTTGGTAATAGGACATCTCCAAGTTTGCAGAGA

AAGACAATATAGTTCTTGGAGAAGGTGGAATCACACTGAGTGG<u>AGG</u>TCAA

Suitable sequence for the 3' homology arm can be selected from (e.g., includes a portion of) or include the following sequence:

(3'H arm)
SEQ ID NO: 27313
GAGCAAGAATTTCTTTAGCAAGGTGAATAACTAATTATTGGTCTAGCAAG

CATTTGCTGTAAATGTCATTCATGTAAAAAAATTACAGACATTTCTCTAT

TGCTTTATATTCTGTTTCTGGAATTGAAAAAATCCTGGGGTTTTATGGCT

AGTGGGTTAAGAATCACATTTAAGAACTATAAATAATGGTATAGTATCCA

GATTTGGTAGAGATTATGGTTACTCAGAATCTGTGCCCGTATCTTGGTGT

CAGTGTATTTGTTTGCCTCATAGTATAGTTTACTACAAATGGAAAACTCT

AGGATTCTGCATAATACTGGACAGAGAAGATGTAAATATCTGTTAGTTCC

ATCATAGACCCTGCCACTCCAATGTACACACCAGCTTTAGGCTTCTTGGT

ATAGATAAACATACATTTTCAAAATTTTTCATCATAATTTTCATAACAAA

ATAGGAAGGCAAATGATGTCACTTGGCTTAAAATCTATAATATTTAAAAT

AAACAGGACAAATGCATTAACATTGTTGGGGGAGGAGGTCCCTTAGTAGA

AACACTCTTGGTCCAAGCATTTTAAAGCTGTCAAAGAGATGTAAATATAG

ATAATGTATGTCAAGGAGAGAGCTTTGTGGTTAAACTGTAACTTTCAGTT

TAAACAATTATTGGTGACTCTGATGTCAAATGTTTCTCAAGCTTTATCTG

AACAAAATTCTTCTCACTTTGTTGCCAAAGTCGTTAACAAGAAATCACAT

TGACTCATTGATGTTTTGGCTCCTTTCCCTTACTTTCTGTTGCTTTCCAA

AAGCTGAGACAGGAAACTAACCCTAACTGAGCACCTGCAATTGCCTGGTA

GTATTCTAGTCATGTGTGTACTTTTGTGTGTATGTAATCCCCTTACAGCT

CTGCAAAGTAAGAATTGTTCTCCCTGCTTTACAGAAGAGATCATAAGATA

ATTGAGGCTGTTAGATGTTAACTTGCCAAAAGCCATACAGGAAAATGGTA

GAGTCACAGTTTGAACCAGGTCCTTTTGATTCTTTACATTAAACCATGCT

TTGATCTTGGAAATACACTGTAAGGCAATAAATCAATAGATACGGATAAT

TCACAGGCTTCTAAATAAATGGAAGTTGATTGTTTTTATCTGTGAGCCAA

AGTAAGACTTATTCTAAGAATTCCACAAATTTAGATAAGATAGAGTATAT

In an embodiment, the replacement sequence comprises or consists of a Cytosine (C) residue.

In an embodiment, to correct a mutation, e.g., R553X target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the R553X mutation is shown as lower case sequence, and the 3' homology arm is shown as no emphasis capitalized sequence.

(Template Construct 36; SEQ ID NO: 27314)
AACAGAAGTAACCATTTTGATACTTTAGATATAGATAATATTGGATTATT

TCTGGATTGTGAAAGAAGAAGGAAGAAGCATATGGAAGAGAAGTTTTAGT

AGAGGGGAGGAAGGAGGAGGTGGAAACGAATGTACAAGGATGGGAGGAGA

AAAGGGAGAGAGACTTTTTTTTTTTAAGGCGAGAGTTTACTACCTATCT

AACTCTTCGCATTCTTGAAGTCTCAGACCAAATCCCATCGGTTTGAAAGC

CTCTAGGGTATTCTATCTATTGTATACTTCTGTTATGTACAAAATTAATT

TGCCAATTAATTGTGAACTGTTTTATAAACTATCTTAAAATGGTTAGTTA

AATCTTTGGGATAGTATTTAGCTTTCTCCAGGATTATGACTTACCTTCTA

AATTAGACATACAATGCCTAGGAGTCAAGGACTATTTTGCATAAATTCCA

GTCTTCTTTTACAATGCCTAGAATGATTGTTACCACAGAAATATTCATTA

CCTGGGAGAAAGGATGACAGGAGGGGCAGAATGAATGGAGAGAGGTCGTG

AGAATGAGGTGCTGAGGATGGACGAGGAAGAAAGCTGTTTTAGTTGGGAG

GATAGGTGACAGAAGCATGGAAAGGAATTGCCTTGGACCCATGGAAGCCC

AGTGAAGATACTTAGATCCTGCAGGGGTGTGAATAATGTTCTTTTAGTTT

CTCTTCTTAGGAGGTTTGTTCATTTTGGGAGATTTCTTTTGAAAAGAGTG

AACTTAAATTGGAGAAAAGTACATTTTAGTATGTTGATAACATTTGAATT

TGTAAAATGGACCTATGGATGATCTACACATATTTATATACCCATAAATA

TACACATATTTTAATTTTTGGTATTTTATAATTATTATTTAATGATCATT

CATGACATTTTAAAAATTACAGAAAAATTTACATCTAAAATTTCAGCAAT

GTTGTTTTTGACCAACTAAATAAATTGCATTTGAAATAATGGAGATGCAA

TGTTCAAAATTTCAACTGTGGTTAAAGCAATAGTGTGATATATGATTACA

TTAGAAGGAAGATGTGCCTTTCAAATTCAGATTGAGCATACTAAAAGTGA

CTCTCTAATTTTCTATTTTTGGTAATAGGACATCTCCAAGTTTGCAGAGA

AAGACAATATAGTTCTTGGAGAAGGTGGAATCACACTGAGTGG<u>AGG</u>TCAA cGAGCAAGAATTTCTTTAGCAAGGTGAATAACTAATTATTGGTCTAGCAA

GCATTTGCTGTAAATGTCATTCATGTAAAAAAATTACAGACATTTCTCTA

TTGCTTTATATTCTGTTTCTGGAATTGAAAAAATCCTGGGGTTTTATGGC

TAGTGGGTTAAGAATCACATTTAAGAACTATAAATAATGGTATAGTATCC

AGATTTGGTAGAGATTATGGTTACTCAGAATCTGTGCCCGTATCTTGGTG

TCAGTGTATTTGTTTGCCTCATAGTATAGTTTACTACAAATGGAAAACTC

TAGGATTCTGCATAATACTGGACAGAGAAGATGTAAATATCTGTTAGTTC

CATCATAGACCCTGCCACTCCAATGTACACACCAGCTTTAGGCTTCTTGG

TATAGATAAACATACATTTTCAAAATTTTTCATCATAATTTTCATAACAA

AATAGGAAGGCAAATGATGTCACTTGGCTTAAAATCTATAATATTTAAAA

TAAACAGGACAAATGCATTAACATTGTTGGGGGAGGAGGTCCCTTAGTAG

AAACACTCTTGGTCCAAGCATTTTAAAGCTGTCAAAGAGATGTAAATATA

GATAATGTATGTCAAGGAGAGAGCTTTGTGGTTAAACTGTAACTTTCAGT

TTAAACAATTATTGGTGACTCTGATGTCAAATGTTTCTCAAGCTTTATCT

GAACAAAATTCTTCTCACTTTGTTGCCAAAGTCGTTAACAAGAAATCACA

TTGACTCATTGATGTTTTGGCTCCTTTCCCTTACTTTCTGTTGCTTTCCA

AAAGCTGAGACAGGAAACTAACCCTAACTGAGCACCTGCAATTGCCTGGT

AGTATTCTAGTCATGTGTGTACTTTTGTGTGTATGTAATCCCCTTACAGC

-continued
TCTGCAAAGTAAGAATTGTTCTCCCTGCTTTACAGAAGAGATCATAAGAT

AATTGAGGCTGTTAGATGTTAACTTGCCAAAAGCCATACAGGAAAATGGT

AGAGTCACAGTTTGAACCAGGTCCTTTTGATTCTTTACATTAAACCATGC

TTTGATCTTGGAAATACACTGTAAGGCAATAAATCAATAGATACGGATAA

TTCACAGGCTTCTAAATAAATGGAAGTTGATTGTTTTTATCTGTGAGCCA

AAGTAAGACTTATTCTAAGAATTCCACAAATTTAGATAAGATAGAGTATA

T

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct R553X mutation in the CFTR gene, the 5' homology arm may be shortened less than 1000 nucleotides, e.g., e.g., 500 nucleotides, to avoid inclusion of a LINE repeat element in the 5' homology arm. The 5' homology arm is shown as bold sequence, the inserted base to correct the R553X mutation is shown as lower case sequence, and the 3' homology arm is shown as no emphasis capitalized sequence.

(Template Construct 37; SEQ ID NO: 27315)
CTCTTCTTAGGAGGTTTGTTCATTTTGGGAGATTTCTTTTGAAAAGAGTG

AACTTAAATTGGAGAAAAGTACATTTTAGTATGTTGATAACATTTGAATT

TGTAAAATGGACCTATGGATGATCTACACATATTTATATACCCATAAATA

TACACATATTTTAATTTTTGGTATTTTATAATTATTATTTAATGATCATT

CATGACATTTTAAAAATTACAGAAAAATTTACATCTAAAATTTCAGCAAT

GTTGTTTTTGACCAACTAAATAAATTGCATTTGAAATAATGGAGATGCAA

TGTTCAAAATTTCAACTGTGGTTAAAGCAATAGTGTGATATATGATTACA

TTAGAAGGAAGATGTGCCTTTCAAATTCAGATTGAGCATACTAAAAGTGA

CTCTCTAATTTTCTATTTTTGGTAATAGGACATCTCCAAGTTTGCAGAGA

AAGACAATATAGTTCTTGGAGAAGGTGGAATCACACTGAGTGG<u>A</u>GG<u>T</u>CAA cGAGCAAGAATTTCTTTAGCAAGGTGAATAACTAATTATTGGTCTAGCAA

GCATTTGCTGTAAATGTCATTCATGTAAAAAAATTACAGACATTTCTCTA

TTGCTTTATATTCTGTTTCTGGAATTGAAAAAATCCTGGGGTTTTATGGC

TAGTGGGTTAAGAATCACATTTAAGAACTATAAATAATGGTATAGTATCC

AGATTTGGTAGAGATTATGGTTACTCAGAATCTGTGCCCGTATCTTGGTG

TCAGTGTATTTGTTTGCCTCATAGTATAGTTTACTACAAATGGAAAACTC

TAGGATTCTGCATAATACTGGACAGAGAAGATGTAAATATCTGTTAGTTC

CATCATAGACCCTGCCACTCCAATGTACACACCAGCTTTAGGCTTCTTGG

TATAGATAAACATACATTTTCAAAATTTTTCATCATAATTTTCATAACAA

-continued
AATAGGAAGGCAAATGATGTCACTTGGCTTAAAATCTATAATATTTAAAA

T

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., R553X target site in the CFTR gene. For example, the ssODN may include 5' and 3' homology arms as shown below. The 5' homology arm is shown as bold sequence, the inserted bases to correct the R553X mutation is shown as lower case sequence, and the 3' homology arm is shown as no emphasis capitalized sequence.

(Template Construct 38; SEQ ID NO: 27316)
TAGGACATCTCCAAGTTTGCAGAGAAAGACAATATAGTTCTTGGAGAAGG TGGAATCACACTGAGTGG<u>A</u>GG<u>T</u>CAAcGAGCAAGAATTTCTTTAGCAAGGT

GAATAACTAATTATTGGTCTAGCAAGCATTTGCTGTAAATGTCATTCATG

T

In an embodiment, to correct a mutation, e.g., R553X target site in the CFTR gene, and concomitantly introduce a silent sense mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the R553X mutation is shown as lower case sequence, the silent sense mutation is shown as lower case underlined and italicized sequence, and the 3' homology arm is shown as no emphasis capitalized sequence.

(Template Construct 39; SEQ ID NO: 27317)
AACAGAAGTAACCATTTTGATACTTTAGATATAGATAATATTGGATTATT

TCTGGATTGTGAAAGAAGAAGGAAGAAGCATATGGAAGAGAAGTTTTAGT

AGAGGGGAGGAAGGAGGAGGTGGAAACGAATGTACAAGGATGGGAGGAGA

AAAGGGAGAGAGACTTTTTTTTTTTAAGGCGAGAGTTTACTACCTATCT

AACTCTTCGCATTCTTGAAGTCTCAGACCAAATCCCATCGGTTTGAAAGC

CTCTAGGGTATTCTATCTATTGTATACTTCTGTTATGTACAAAATTAATT

TGCCAATTAATTGTGAACTGTTTTATAAACTATCTTAAAATGGTTAGTTA

AATCTTTGGGATAGTATTTAGCTTTCTCCAGGATTATGACTTACCTTCTA

AATTAGACATACAATGCCTAGGAGTCAAGGACTATTTTGCATAAATTCCA

GTCTTCTTTTACAATGCCTAGAATGATTGTTACCACAGAAATATTCATTA

CCTGGGAGAAAGGATGACAGGAGGGGCAGAATGAATGGAGAGAGGTCGTG

AGAATGAGGTGCTGAGGATGGACGAGGAAGAAAGCTGTTTTAGTTGGGAG

GATAGGTGACAGAAGCATGGAAAGGAATTGCCTTGGACCCATGGAAGCCC

AGTGAAGATACTTAGATCCTGCAGGGGTGTGAATAATGTTCTTTTAGTTT

-continued

CTCTTCTTAGGAGGTTTGTTCATTTTGGGAGATTTCTTTTGAAAAGAGTG

AACTTAAATTGGAGAAAAGTACATTTTAGTATGTTGATAACATTTGAATT

TGTAAAATGGACCTATGGATGATCTACACATATTTATATACCCATAAATA

TACACATATTTTAATTTTTGGTATTTTATAATTATTATTTAATGATCATT

CATGACATTTTAAAAATTACAGAAAAATTTACATCTAAAATTTCAGCAAT

GTTGTTTTTGACCAACTAAATAAATTGCATTTGAAATAATGGAGATGCAA

TGTTCAAAATTTCAACTGTGGTTAAAGCAATAGTGTGATATATGATTACA

TTAGAAGGAAGATGTGCCTTTCAAATTCAGATTGAGCATACTAAAAGTGA

CTCTCTAATTTTCTATTTTTGGTAATAGGACATCTCCAAGTTTGCAGAGA

AAGACAATATAGTTCTTGGAGAAGGTGGAATCACACTG*tca*GGAGGTCAA cGAGCAAGAATTTCTTTAGCAAGGTGAATAACTAATTATTGGTCTAGCAA

GCATTTGCTGTAAATGTCATTCATGTAAAAAAATTACAGACATTTCTCTA

TTGCTTTATATTCTGTTTCTGGAATTGAAAAAATCCTGGGGTTTTATGGC

TAGTGGGTTAAGAATCACATTTAAGAACTATAAATAATGGTATAGTATCC

AGATTTGGTAGAGATTATGGTTACTCAGAATCTGTGCCCGTATCTTGGTG

TCAGTGTATTTGTTTGCCTCATAGTATAGTTTACTACAAATGGAAAACTC

TAGGATTCTGCATAATACTGGACAGAGAAGATGTAAATATCTGTTAGTTC

CATCATAGACCCTGCCACTCCAATGTACACACCAGCTTTAGGCTTCTTGG

TATAGATAAACATACATTTTCAAAATTTTTCATCATAATTTTCATAACAA

AATAGGAAGGCAAATGATGTCACTTGGCTTAAAATCTATAATATTTAAAA

TAAACAGGACAAATGCATTAACATTGTTGGGGGAGGAGGTCCCTTAGTAG

AAACACTCTTGGTCCAAGCATTTTAAAGCTGTCAAAGAGATGTAAATATA

GATAATGTATGTCAAGGAGAGAGCTTTGTGGTTAAACTGTAACTTTCAGT

TTAAACAATTATTGGTGACTCTGATGTCAAATGTTTCTCAAGCTTTATCT

GAACAAAATTCTTCTCACTTTGTTGCCAAAGTCGTTAACAAGAAATCACA

TTGACTCATTGATGTTTTGGCTCCTTTCCCTTACTTTCTGTTGCTTTCCA

AAAGCTGAGACAGGAAACTAACCCTAACTGAGCACCTGCAATTGCCTGGT

AGTATTCTAGTCATGTGTGTACTTTTGTGTGTATGTAATCCCCTTACAGC

TCTGCAAAGTAAGAATTGTTCTCCCTGCTTTACGAAGAGATCATAAGAT

AATTGAGGCTGTTAGATGTTAACTTGCCAAAAGCCATACAGGAAAATGGT

AGAGTCACAGTTTGAACCAGGTCCTTTTGATTCTTTACATTAAACCATGC

TTTGATCTTGGAAATACACTGTAAGGCAATAAATCAATAGATACGGATAA

TTCACAGGCTTCTAAATAAATGGAAGTTGATTGTTTTTATCTGTGAGCCA

AAGTAAGACTTATTCTAAGAATTCCACAAATTTAGATAAGATAGAGTATA

T

In an embodiment, to correct a mutation, e.g., R553X target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the R553X mutation is shown as lower case sequence, the silent sense mutation is shown as lower case underlined and italicized sequence, and the 3' homology arm is shown as no emphasis capitalized sequence.

(Template Construct 40; SEQ ID NO: 27318)
CTCTTCTTAGGAGGTTTGTTCATTTTGGGAGATTTCTTTTGAAAAGAGTG

AACTTAAATTGGAGAAAAGTACATTTTAGTATGTTGATAACATTTGAATT

TGTAAAATGGACCTATGGATGATCTACACATATTTATATACCCATAAATA

TACACATATTTTAATTTTTGGTATTTTATAATTATTATTTAATGATCATT

CATGACATTTTAAAAATTACAGAAAAATTTACATCTAAAATTTCAGCAAT

GTTGTTTTTGACCAACTAAATAAATTGCATTTGAAATAATGGAGATGCAA

TGTTCAAAATTTCAACTGTGGTTAAAGCAATAGTGTGATATATGATTACA

TTAGAAGGAAGATGTGCCTTTCAAATTCAGATTGAGCATACTAAAAGTGA

CTCTCTAATTTTCTATTTTTGGTAATAGGACATCTCCAAGTTTGCAGAGA

AAGACAATATAGTTCTTGGAGAAGGTGGAATCACACTG*tca*GGAGGTCAA cGAGCAAGAATTTCTTTAGCAAGGTGAATAACTAATTATTGGTCTAGCAA

GCATTTGCTGTAAATGTCATTCATGTAAAAAAATTACAGACATTTCTCTA

TTGCTTTATATTCTGTTTCTGGAATTGAAAAAATCCTGGGGTTTTATGGC

TAGTGGGTTAAGAATCACATTTAAGAACTATAAATAATGGTATAGTATCC

AGATTTGGTAGAGATTATGGTTACTCAGAATCTGTGCCCGTATCTTGGTG

TCAGTGTATTTGTTTGCCTCATAGTATAGTTTACTACAAATGGAAAACTC

TAGGATTCTGCATAATACTGGACAGAGAAGATGTAAATATCTGTTAGTTC

CATCATAGACCCTGCCACTCCAATGTACACACCAGCTTTAGGCTTCTTGG

TATAGATAAACATACATTTTCAAAATTTTTCATCATAATTTTCATAACAA

AATAGGAAGGCAAATGATGTCACTTGGCTTAAAATCTATAATATTTAAAA

T

In an embodiment, an ssODN may be to correct a mutation, e.g., R553X target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the R553X mutation is shown as lower case sequence, the silent sense mutation is shown as lower case underlined and italicized sequence, and the 3' homology arm is shown as no emphasis capitalized sequence.

(Template Construct 41; SEQ ID NO: 27319)
TAGGACATCTCCAAGTTTGCAGAGAAAGACAATATAGTTCTTGGAGAAGG

TGGAATCACACTG_*tca*_GGAGGTCAAcGAGCAAGAATTTCTTTAGCAAGGT

GAATAACTAATTATTGGTCTAGCAAGCATTTGCTGTAAATGTCATTCATG

T

The underlined T has been changed from an A to T at that position, the underlined C has been changed from a G to C at that position, and the underlined A has been changed from a T to A at that position, so that wild-type CFTR is still transcribed, but the PAM sequence AGG has been modified to reduce or eliminate Cas9 cleavage at that locus.

Exemplary template nucleic acids (also referred to herein as donor constructs) to correction a mutation, e.g., an intronic 2789+5 bp (G→A) target site in the CFTR gene, are provided.

Suitable sequence for the 5' homology arm can be selected from (e.g., includes a portion of) or include the following sequence:

(5'H arm)
SEQ ID NO: 27320
TTTTTCTGTTTCATTCTGTGGTAAAGGTATCATTTGGCTAATTGTATAAT

TTCAGTGTCATTTCTAATATTCCAATTGTGATAGTATCAACACAAGATTA

AATTTCTCTACATGGTTTATGAGAATGGAATGCCAAATTGAAATAGAACA

GAGCACAGATGATCTAAATATAAAAAGAACTACAAAAATCACAGTTGTTT

AAAAAGGTTTTTTGTTTGTTTATATATGGTGCAGAACATTTGTTCCTTAG

CCAAATGTTTCCACCTTGAGAAAGCTATAGAGATTCTATGTAGTCCTAGT

ACCAATAATATGTTTTAACCTGAATGTACCTTATCTTTATTCATAAACTG

TGACTTTTTACACTGCTGAAACTTTTTTTTTAAGACAATCTCACTCTGT

CGTCCAGTCTGGAGTGCAGCAGTGGTGTGATCTTGGCTCACTGCAACCTC

TACCTTCTGTGTTCAAGCAATTCTGGTGCCTCGGCCACCTGAGTAGTTGG

GATCACAGGTGTACACCACCAGGCCTGGCTAATAGTTTTTGATATTTCTA

GTAGAGATGAGTTTTGCCACATTGGCCAGGCTGGCCTGAAACTCCTGGCC

TCAAGTGATCTGCCTGCCTTGGCCTCCCAAAGTGTTGGTATTACAAGTGT

GAGCCACTGTGCCTGGCCTGAAACTCATAATTCATTTCCATTAATATTAA

TCTCACCTTTTCCAATAATTAATTGATTTCACAAGTATTAGTCCCCTATA

ATCATTGAATGGCTAATAAAATTATTTATAGCAAACAGATTAATTATCTG

CCAGCAGTCTGAGATTAGTTTCTTTAAAAAATGTTTATTATTTAAAACAT

TCAGCTGTGATCTTGGCTTTCTTGTGAGGTTCAATAGTTTCTATTGAGTA

AAGGAGAGAAATGGCAGAGAATTTACTTCAGTGAAATTTGAATTCCATTA

ACTTAATGTGGTCTCATCACAAATAATAGTACTTAGAACACCTAGTACAG

CTGCTGGACCCAGGAACACAAAGCAAAGGAAGATGAAATTGTGTGTACCT

TGATATTGGTACACACATCAAATGGTGTGATGTGAATTTAGATGTGGGCA

TGGGAGGAATAGGTGAAGATGTTAGAAAAAAAATCAACTGTGTCTTGTTC

CATTCCAGGTGGCTGCTTCTTTGGTTGTGCTGTGGCTCCTTGGAAAGTGA

Suitable sequence for the 3' homology arm can be selected from (e.g., includes a portion of) or include the following sequence:

(3'H arm)
SEQ ID NO: 27321
TATT<u>CCA</u>TGTCCTATTGTGTAGATTGTGTTTATTTCTGTTGATTAAATA

TTGTAATCCACTATGTTTGTATGTATTGTAATCCACTTTGTTTCATTTCT

CCCAAGCATTATGGTAGTGGAAAGATAAGGTTTTTTGTTTAAATGATGAC

CATTAGTTGGGTGAGGTGACACATTCCTGTAGTCCTAGCTCCTCCACAGG

CTGACGCAGGAGGATCACTTGAGCCCAGGAGTTCAGGGCTGTAGTGTTGT

ATCATTGTGAGTAGCCACCGCACTCCAGCCTGGACAATATAGTGAGATCC

TATATCTAAAATAAAATAAAATAAAATGAATAAAATTGTGAGCATGTGCAG

CTCCTGCAGTTTCTAAAGAATATAGTTCTGTTCAGTTTCTGTGAAACACA

ATAAAAATATTTGAAATAACATTACATATTTAGGGTTTTCTTCAAATTTT

-continued
TTAATTTAATAAAGAACAACTCAATCTCTATCAATAGTGAGAAAACATAT

CTATTTTCTTGCAATAATAGTATGATTTTGAGGTTAAGGGTGCATGCTCT

TCTAATGCAAAATATTGTATTTATTTAGACTCAAGTTTAGTTCCATTTAC

ATGTATTGGAAATTCAGTAAGTAACTTTGGCTGCCAAATAACGATTTCCT

ATTTGCTTTACAGCACTCCTCTTCAAGACAAAGGGAATAGTACTCATAGT

AGAAATAACAGCTATGCAGTGATTATCACCAGCACCAGTTCGTATTATGT

GTTTTACATTTACGTGGGAGTAGCCGACACTTTGCTTGCTATGGGATTCT

TCAGAGGTCTACCACTGGTGCATACTCTAATCACAGTGTCGAAAATTTTA

CACCACAAAATGTTACATTCTGTTCTTCAAGCACCTATGTCAACCCTCAA

CACGTTGAAAGCAGGTACTTTACTAGGTCTAAGAAATGAAACTGCTGATC

CACCATCAATAGGGCCTGTGGTTTTGTTGGTTTTCTAATGGCAGTGCTGG

CTTTTGCACAGAGGCATGTGCCCTTTGTTGAACCTCCATTTGACTGGCAT

GCACATGTCTCAGATATTATAGGTTATCATATATTGTTGCTCCTAATATT

TCTGTGTTAGATAATTAGAGTAGCTTGGTTTGTAAGAATGTGATGTTGGT

GGGACTGTAGCAGAACAAGAAGGCCCTTATGGGTCAGTCATACCTCTCTT

In an embodiment, the replacement sequence comprises or consists of a Guanine (G) residue.

In an embodiment, to correct a mutation, e.g., an intronic 2789+5 bp (G→A) target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the intronic 2789+5 bp (G→A) mutation is shown as lower case sequence, and the 3' homology arm is shown as no emphasis capitalized sequence.

(Template Construct 42; SEQ ID NO: 27322)
TTTTTCTGTTTCATTCTGTGGTAAAGGTATCATTTGGCTAATTGTATAAT

TTCAGTGTCATTTCTAATATTCCAATTGTGATAGTATCAACACAAGATTA

AATTTCTCTACATGGTTTATGAGAATGGAATGCCAAATTGAAATAGAACA

GAGCACAGATGATCTAAATATAAAAAGAACTACAAAAATCACAGTTGTTT

AAAAAGGTTTTTTGTTTGTTTATATATGGTGCAGAACATTTGTTCCTTAG

CCAAATGTTTCCACCTTGAGAAAGCTATAGAGATTCTATGTAGTCCTAGT

ACCAATAATATGTTTTAACCTGAATGTACCTTATCTTTATTCATAAACTG

TGACTTTTTACACTGCTGAAACTTTTTTTTTAAGACAATCTCACTCTGT

CGTCCAGTCTGGAGTGCAGCAGTGGTGTGATCTTGGCTCACTGCAACCTC

TACCTTCTGTGTTCAAGCAATTCTGGTGCCTCGGCCACCTGAGTAGTTGG

GATCACAGGTGTACACCACCAGGCCTGGCTAATAGTTTTTGATATTTCTA

GTAGAGATGAGTTTTGCCACATTGGCCAGGCTGGCCTGAAACTCCTGGCC

TCAAGTGATCTGCCTGCCTTGGCCTCCCAAAGTGTTGGTATTACAAGTGT

GAGCCACTGTGCCTGGCCTGAAACTCATAATTCATTTCCATTAATATTAA

TCTCACCTTTTCCAATAATTAATTGATTTCACAAGTATTAGTCCCCTATA

ATCATTGAATGGCTAATAAAATTATTTATAGCAAACAGATTAATTATCTG

CCAGCAGTCTGAGATTAGTTTCTTTAAAAAATGTTTATTATTTAAAACAT

-continued

TCAGCTGTGATCTTGGCTTTCTTGTGAGGTTCAATAGTTTCTATTGAGTA

AAGGAGAGAAATGGCAGAGAATTTACTTCAGTGAAATTTGAATTCCATTA

ACTTAATGTGGTCTCATCACAAATAATAGTACTTAGAACACCTAGTACAG

CTGCTGGACCCAGGAACACAAAGCAAAGGAAGATGAAATTGTGTGTACCT

TGATATTGGTACACACATCAAATGGTGTGATGTGAATTTAGATGTGGGCA

TGGGAGGAATAGGTGAAGATGTTAGAAAAAAAATCAACTGTGTCTTGTTC

CATTCCAGGTGGCTGCTTCTTTGGTTGTGCTGTGGCTCCTTGGAAAGTGA gTATT<u>CCA</u>TGTCCTATTGTGTAGATTGTGTTTTATTTCTGTTGATTAAAT

ATTGTAATCCACTATGTTTGTATGTATTGTAATCCACTTTGTTTCATTTC

TCCCAAGCATTATGGTAGTGGAAAGATAAGGTTTTTTGTTTAAATGATGA

CCATTAGTTGGGTGAGGTGACACATTCCTGTAGTCCTAGCTCCTCCACAG

GCTGACGCAGGAGGATCACTTGAGCCCAGGAGTTCAGGGCTGTAGTGTTG

TATCATTGTGAGTAGCCACCGCACTCCAGCCTGGACAATATAGTGAGATC

CTATATCTAAAATAAAATAAAATAAAATGAATAAATTGTGAGCATGTGCA

GCTCCTGCAGTTTCTAAAGAATATAGTTCTGTTCAGTTTCTGTGAAACAC

AATAAAAATATTTGAAATAACATTACATATTTAGGGTTTTCTTCAAATTT

TTTAATTTAATAAAGAACAACTCAATCTCTATCAATAGTGAGAAAACATA

TCTATTTTCTTGCAATAATAGTATGATTTTGAGGTTAAGGGTGCATGCTC

TTCTAATGCAAAATATTGTATTTATTTAGACTCAAGTTTAGTTCCATTTA

CATGTATTGGAAATTCAGTAAGTAACTTTGGCTGCCAAATAACGATTTCC

TATTTGCTTTACAGCACTCCTCTTCAAGACAAAGGGAATAGTACTCATAG

TAGAAATAACAGCTATGCAGTGATTATCACCAGCACCAGTTCGTATTATG

TGTTTTACATTTACGTGGGAGTAGCCGACACTTTGCTTGCTATGGGATTC

TTCAGAGGTCTACCACTGGTGCATACTCTAATCACAGTGTCGAAAATTTT

ACACCACAAATGTTACATTCTGTTCTTCAAGCACCTATGTCAACCCTCA

ACACGTTGAAAGCAGGTACTTTACTAGGTCTAAGAAATGAAACTGCTGAT

CCACCATCAATAGGGCCTGTGGTTTTGTTGGTTTTCTAATGGCAGTGCTG

GCTTTTGCACAGAGGCATGTGCCCTTTGTTGAACCTCCATTTGACTGGCA

TGCACATGTCTCAGATATTATAGGTTATCATATATTGTTGCTCCTAATAT

TTCTGTGTTAGATAATTAGAGTAGCTTGGTTTGTAAGAATGTGATGTTGG

TGGGACTGTAGCAGAACAAGAAGGCCCTTATGGGTCAGTCATACCTCTCT

T

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct an intronic 2789+5 bp (G→A) mutation in the CFTR gene, the 5' homology arm may be shortened less than 1000 nucleotides, e.g., e.g., 500 nucleotides, to avoid inclusion of a LINE repeat element in the 5' homology arm. The 5' homology arm is shown as bold sequence, the inserted base to correct the intronic 2789+5 bp (G→A) mutation is shown as lower case sequence, and the 3' homology arm is shown as no emphasis capitalized sequence.

(Template Construct 43; SEQ ID NO: 27323)
TCTCACCTTTTCCAATAATTAATTGATTTCACAAGTATTAGTCCCCTATA

ATCATTGAATGGCTAATAAAATTATTTATAGCAAACAGATTAATTATCTG

CCAGCAGTCTGAGATTAGTTTCTTTAAAAAATGTTTATTATTTAAAACAT

TCAGCTGTGATCTTGGCTTTCTTGTGAGGTTCAATAGTTTCTATTGAGTA

AAGGAGAGAAATGGCAGAGAATTTACTTCAGTGAAATTTGAATTCCATTA

ACTTAATGTGGTCTCATCACAAATAATAGTACTTAGAACACCTAGTACAG

CTGCTGGACCCAGGAACACAAAGCAAAGGAAGATGAAATTGTGTGTACCT

TGATATTGGTACACACATCAAATGGTGTGATGTGAATTTAGATGTGGGCA

TGGGAGGAATAGGTGAAGATGTTAGAAAAAAAATCAACTGTGTCTTGTTC

CATTCCAGGTGGCTGCTTCTTTGGTTGTGCTGTGGCTCCTTGGAAAGTGA gTATT<u>CCA</u>TGTCCTATTGTGTAGATTGTGTTTTATTTCTGTTGATTAAAT

ATTGTAATCCACTATGTTTGTATGTATTGTAATCCACTTTGTTTCATTTC

TCCCAAGCATTATGGTAGTGGAAAGATAAGGTTTTTTGTTTAAATGATGA

CCATTAGTTGGGTGAGGTGACACATTCCTGTAGTCCTAGCTCCTCCACAG

GCTGACGCAGGAGGATCACTTGAGCCCAGGAGTTCAGGGCTGTAGTGTTG

TATCATTGTGAGTAGCCACCGCACTCCAGCCTGGACAATATAGTGAGATC

CTATATCTAAAATAAAATAAAATAAAATGAATAAATTGTGAGCATGTGCA

GCTCCTGCAGTTTCTAAAGAATATAGTTCTGTTCAGTTTCTGTGAAACAC

AATAAAAATATTTGAAATAACATTACATATTTAGGGTTTTCTTCAAATTT

TTTAATTTAATAAAGAACAACTCAATCTCTATCAATAGTGAGAAAACATA

T

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., an intronic 2789+5 bp (G→A) target site in the CFTR gene. For example, the ssODN may include 5' and 3' homology arms as shown below. The 5' homology arm is shown as bold sequence, the inserted bases to correct the intronic 2789+5 bp (G→A) mutation is shown as lower case sequence, and the 3' homology arm is shown as no emphasis capitalized sequence.

(Template Construct 44; SEQ ID NO: 27324)
AAAAAAAATCAACTGTGTCTTGTTCCATTCCAGGTGGCTGCTTCTTTGGT

TGTGCTGTGGCTCCTTGGAAAGTGAgTATT<u>CCA</u>TGTCCTATTGTGTAGAT

In an embodiment, to correct a mutation, e.g., an intronic 2789+5 bp (G→A) target site in the CFTR gene, and concomitantly introduce a silent sense mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the intronic 2789+5 bp (G→A) mutation is shown as lower case sequence, the silent sense mutation is shown as lower case underlined and italicized sequence, and the 3' homology arm is shown as no emphasis capitalized sequence.

(Template Construct 45; SEQ ID NO: 27325)
TTTTTCTGTTTCATTCTGTGGTAAAGGTATCATTTGGCTAATTGTATAAT
TTCAGTGTCATTTCTAATATTCCAATTGTGATAGTATCAACACAAGATTA
AATTTCTCTACATGGTTTATGAGAATGGAATGCCAAATTGAAATAGAACA
GAGCACAGATGATCTAAATATAAAAAGAACTACAAAAATCACAGTTGTTT
AAAAAGGTTTTTTGTTTGTTTATATATGGTGCAGAACATTTGTTCCTTAG
CCAAATGTTTCCACCTTGAGAAAGCTATAGAGATTCTATGTAGTCCTAGT
ACCAATAATATGTTTTAACCTGAATGTACCTTATCTTTATTCATAAACTG
TGACTTTTTACACTGCTGAAACTTTTTTTTTAAGACAATCTCACTCTGT
CGTCCAGTCTGGAGTGCAGCAGTGGTGTGATCTTGGCTCACTGCAACCTC
TACCTTCTGTGTTCAAGCAATTCTGGTGCCTCGGCCACCTGAGTAGTTGG
GATCACAGGTGTACACCACCAGGCCTGGCTAATAGTTTTTGATATTTCTA
GTAGAGATGAGTTTTGCCACATTGGCCAGGCTGGCCTGAAACTCCTGGCC
TCAAGTGATCTGCCTGCCTTGGCCTCCCAAAGTGTTGGTATTACAAGTGT
GAGCCACTGTGCCTGGCCTGAAACTCATAATTCATTTCCATTAATATTAA
TCTCACCTTTTCCAATAATTAATTGATTTCACAAGTATTAGTCCCCTATA
ATCATTGAATGGCTAATAAAATTATTTATAGCAAACAGATTAATTATCTG
CCAGCAGTCTGAGATTAGTTTCTTTAAAAAATGTTTATTATTTAAAACAT
TCAGCTGTGATCTTGGCTTTCTTGTGAGGTTCAATAGTTTCTATTGAGTA
AAGGAGAGAAATGGCAGAGAATTTACTTCAGTGAAATTTGAATTCCATTA
ACTTAATGTGGTCTCATCACAAATAATAGTACTTAGAACACCTAGTACAG
CTGCTGGACCCAGGAACACAAAGCAAAGGAAGATGAAATTGTGTGTACCT
TGATATTGGTACACACATCAAATGGTGTGATGTGAATTTAGATGTGGGCA
TGGGAGGAATAGGTGAAGATGTTAGAAAAAAAATCAACTGTGTCTTGTTC
CATTCCAGGTGGCTGCTTCTTTGGTTGTGCTGTGGCTCCTTGGAAAGTGA
gTATT*gg*ATGTCCTATTGTGTAGATTGTGTTTTATTTCTGTTGATTAAAT
ATTGTAATCCACTATGTTTGTATGTATTGTAATCCACTTTGTTTCATTTC
TCCCAAGCATTATGGTAGTGGAAAGATAAGGTTTTTGTTTAAATGATGA
CCATTAGTTGGGTGAGGTGACACATTCCTGTAGTCCTAGCTCCTCCACAG
GCTGACGCAGGAGGATCACTTGAGCCCAGGAGTTCAGGGCTGTAGTGTTG
TATCATTGTGAGTAGCCACCGCACTCCAGCCTGGACAATATAGTGAGATC
CTATATCTAAAATAAAATAAAATAAAATGAATAAATTGTGAGCATGTGCA
GCTCCTGCAGTTTCTAAAGAATATAGTTCTGTTCAGTTTCTGTGAAACAC
AATAAAAATATTTGAAATAACATTACATATTTAGGGTTTTCTTCAAATTT
TTTAATTTAATAAAGAACAACTCAATCTCTATCAATAGTGAGAAAACATA
TCTATTTTCTTGCAATAATAGTATGATTTTGAGGTTAAGGGTGCATGCTC
TTCTAATGCAAAATATTTGTATTTATTTAGACTCAAGTTTAGTTCCATTTA
CATGTATTGGAAATTCAGTAAGTAACTTTGGCTGCCAAATAACGATTTCC
TATTTGCTTTACAGCACTCCTCTTCAAGACAAAGGGAATAGTACTCATAG
TAGAAATAACAGCTATGCAGTGATTATCACCAGCACCAGTTCGTATTATG
TGTTTTACATTTACGTGGGAGTAGCCGACACTTTGCTTGCTATGGGATTC
TTCAGAGGTCTACCACTGGTGCATACTCTAATCACAGTGTCGAAAATTTT
ACACCACAAAATGTTACATTCTGTTCTTCAAGCACCTATGTCAACCCTCA
ACACGTTGAAAGCAGGTACTTTACTAGGTCTAAGAAATGAAACTGCTGAT
CCACCATCAATAGGGCCTGTGGTTTTGTTGGTTTTCTAATGGCAGTGCTG
GCTTTTGCACAGAGGCATGTGCCCTTTGTTGAACCTCCATTTGACTGGCA
TGCACATGTCTCAGATATTATAGGTTATCATATATTGTTGCTCCTAATAT
TTCTGTGTTAGATAATTAGAGTAGCTTGGTTTGTAAGAATGTGATGTTGG
TGGGACTGTAGCAGAACAAGAAGGCCCTTATGGGTCAGTCATACCTCTCT
T In an embodiment, to correct a mutation, e.g., an intronic 2789+5 bp (G→A) target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the intronic 2789+5 bp (G→A) mutation is shown as lower case sequence, the silent sense mutation is shown as lower case underlined and italicized sequence, and the 3' homology arm is shown as no emphasis capitalized sequence.

(Template Construct 46; SEQ ID NO: 27326)
TCTCACCTTTTCCAATAATTAATTGATTTCACAAGTATTAGTCCCCTATA
ATCATTGAATGGCTAATAAAATTATTTATAGCAAACAGATTAATTATCTG
CCAGCAGTCTGAGATTAGTTTCTTTAAAAAATGTTTATTATTTAAAACAT
TCAGCTGTGATCTTGGCTTTCTTGTGAGGTTCAATAGTTTCTATTGAGTA
AAGGAGAGAAATGGCAGAGAATTTACTTCAGTGAAATTTGAATTCCATTA
ACTTAATGTGGTCTCATCACAAATAATAGTACTTAGAACACCTAGTACAG
CTGCTGGACCCAGGAACACAAAGCAAAGGAAGATGAAATTGTGTGTACCT
TGATATTGGTACACACATCAAATGGTGTGATGTGAATTTAGATGTGGGCA
TGGGAGGAATAGGTGAAGATGTTAGAAAAAAAATCAACTGTGTCTTGTTC
CATTCCAGGTGGCTGCTTCTTTGGTTGTGCTGTGGCTCCTTGGAAAGTGA
gTATT*gg*ATGTCCTATTGTGTAGATTGTGTTTTATTTCTGTTGATTAAAT -continued

ATTGTAATCCACTATGTTTGTATGTATTGTAATCCACTTTGTTTCATTTC

TCCCAAGCATTATGGTAGTGGAAAGATAAGGTTTTTTGTTTAAATGATGA

CCATTAGTTGGGTGAGGTGACACATTCCTGTAGTCCTAGCTCCTCCACAG

GCTGACGCAGGAGGATCACTTGAGCCCAGGAGTTCAGGGCTGTAGTGTTG

TATCATTGTGAGTAGCCACCGCACTCCAGCCTGGACAATATAGTGAGATC

CTATATCTAAAATAAAATAAAATAAAATGAATAAATTGTGAGCATGTGCA

GCTCCTGCAGTTTCTAAAGAATATAGTTCTGTTCAGTTTCTGTGAAACAC

AATAAAAATATTTGAAATAACATTACATATTTAGGGTTTTCTTCAAATTT

TTTAATTTAATAAAGAACAACTCAATCTCTATCAATAGTGAGAAAACATA

T

In an embodiment, an ssODN may be to correct a mutation, e.g., an intronic 2789+5 bp (G→A) target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the intronic 2789+5 bp (G→A) mutation is shown as lower case sequence, the silent sense mutation is shown as lower case underlined and italicized sequence, and the 3' homology arm is shown as no emphasis capitalized sequence.

(Template Construct 47; SEQ ID NO: 27327)
AAAAAAAATCAACTGTGTCTTGTTCCATTCCAGGTGGCTGCTTCTTTGGT

TGTGCTGTGGCTCCTTGGAAAGTGAgTATT*gg*ATGTCCTATTGTGTAGAT

TGTGTTTTATTTCTGTTGATTAAATATTGTAATCCACTATGTTTGTATGT

A

The underlined G has been changed from a C to G at that position, so that wild-type CFTR is still transcribed, but the PAM sequence CCA has been modified to reduce or eliminate Cas9 cleavage at that locus.

Exemplary template nucleic acids (also referred to herein as donor constructs) to correction a mutation, e.g., an intronic 3272-26 bp (A→G) target site in the CFTR gene, are provided.

Suitable sequence for the 5' homology arm can be selected from (e.g., includes a portion of) or include the following sequence:

(5'H arm)
SEQ ID NO: 27328
GTGCACTGTACCCTAAAACTTAAAGTATAATAAAAAAAATAAAAAAAAG

TTTGAGGTGTTTAAAGTATGCAAAAAAAAAAAAAGAAATAAATCACTGAC

ACACTTTGTCCACTTTGCAATGTGAAAATGTTTACTCACCAACATGTTTT

CTTTGATCTTACAGTTGTTATTAATTGTGATTGGAGCTATAGCAGTTGTC

GCAGTTTTACAACCCTACATCTTTGTTGCAACAGTGCCAGTGATAGTGGC

TTTTATTATGTTGAGAGCATATTTCCTCCAAACCTCACAGCAACTCAAAC

AACTGGAATCTGAAGGTATGACAGTGAATGTGCGATACTCATCTTGTAAA

AAAGCTATAAGAGCTATTTGAGATTCTTTATTGTTAATCTACTTAAAAAA

AATTCTGCTTTTAAACTTTTACATCATATAACAATAATTTTTTTCTACAT

GCATGTGTATATAAAAGGAAACTATATTACAAAGTACACATGGATTTTTT

TTCTTAATTAATGACCATGTGACTTCATTTTGGTTTTAAAATAGGTATAT

AGAATCTTACCACAGTTGGTGTACAGGACATTCATTTATAATAAACTTAT

ATCAGTCAAATTAAACAAGGATAGTGCTGCTATTACTAAAGGTTTCTCTG

GGTTCCCAAATGATACTTGACCAAATTTGTCCCTTTGGCTTGTTGTCTTC

AGACACCCTTTCTTCATGTGTTGGAGCTGCCATTTCGTGTGCCCCCAAAC

TCTACTTGAGCTGTTAGGGAATCACATTTTGCAGTGACAGCCTTAGTGTG

GGTGCATTTTCAGGCAATACTTTTTCAGTATATTTCTGCTTTGTAGATTA

TTAGCTAAATCAAGTCACATAAACTTCCTTAATTTAGATACTTGAAAAAA

TTGTCTTAAAAGAAAATTTTTTTAGTAAGAATTAATTTAGAATTAGCCAG

AAAACTCCCAGTGGTAGCCAAGAAAGAGGAATAAATATTGGTGGTAATTT

TTTAAGTTCCCATCTCTGGTAGCCAAGTAAAAAAAGAGGGTAACTCATTA

ATAAAATAACAAATCATATCTATTCAAAGAATGGCACCAGTGTGAAAAAA

AGCTTTTTAACCAATGACATTTGTGATATGATTATTCTAATTTAGTCTTT

TTCAGGTACAAGATATTATGAAATTACATTTTGTGTTTATGTTATTTGCA

Suitable sequence for the 3' homology arm can be selected from (e.g., includes a portion of) or include the following sequence:

(3'H arm)
SEQ ID NO: 27329
TGTTTTCTA<u>TGG</u>AAATATTTCACAGGCAGGAGTCCAATTTTCACTCATCT

TGTTACAAGCTTAAAAGGACTATGGACACTTCGTGCCTTCGGACGGCAGC

CTTACTTTGAAACTCTGTTCCACAAAGCTCTGAATTTACATACTGCCAAC

TGGTTCTTGTACCTGTCAACACTGCGCTGGTTCCAAATGAGAATAGAAAT

GATTTTTGTCATCTTCTTCATTGCTGTTACCTTCATTTCCATTTTAACAA

CAGGTACTATGAACTCATTAACTTTAGCTAAGCATTTAAGTAAAAAATTT

TCAATGAATAAAATGCTGCATTCTATAGGTTATCAATTTTTGATATCTTT

AGAGTTTAGTAATTAACAAATTTGTTGGTTTATTATTGAACAAGTGATTT

CTTTGAATTTCCATTGTTTTATTGTTAAACAAATAATTTCCTTGAAATCG

GATATATATATATATGTATATATATATATATATATATATATATACA

TATATATATAGTATTATCCCTGTTTTCACAGTTTTAAAAACCGATGCA

CACAGATTGTCAGATAGCAATTCTGTGATTGAAGGGGAAATATGTCACCT

CTTCATACTCATATTGGTGAAGGGTCCTAGCTTCAAAATTAATAGATTCC

TAAAGAGGGGAAATGAAACATCCGCATTTACACACACACACACACACACA

CACACAGAGTTCCTCTTGTCGGTAAGTTTTGTTTTTTTAAATCTCTACT

AGATAAAATTTGTTATCTAATTGTGAGTTTTACACAAAGAAAAACTGTCA

CAGAAAAGAAAGACAGTGTCACATTTTTCAAAAGAAAAAGAAGAAAAGAA

AGTGCCATGTTTTCAAATACAAATGTTCTGGATTGATTTTAGGATCTTT

AGTGAAAAACAAAGTATTTCATAATAAGTAAAATAAAAATCTATGTAGGT

AAATTTGTTTCTCTAATTTAAGAATTTGAATTTCTGAGTATTTATGATAA

GTGTTGAAATAACTTCTTATATGTGACAGTGAATACTGGCAGAGCAAATG

-continued
CCAAATCAATGCCAAATCTGTAGGATCATTTGATTGTAGGAACAGAATTC

TACTCAAACCGAAAGCAGGCATTTGCTGGAGTTACAGAAAGGCCTCATGG

AACACCGAGAAGGTGGTGCCATTCGACTCTTAAAGAAGCTGCAACAGGCA

In an embodiment, the replacement sequence comprises or consists of an Adenine (A) residue.

In an embodiment, to correct a mutation, e.g., an intronic 3272-26 bp (A→G) target site in the CFTR gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the intronic 3272-26 bp (A→G) mutation is shown as lower case sequence, and the 3' homology arm is shown as no emphasis capitalized sequence.

(Template Construct 48; SEQ ID NO: 27330)
GTGCACATGTACCCTAAAACTTAAAGTATAATAAAAAAAATAAAAAAAAG

TTTGAGGTGTTTAAAGTATGCAAAAAAAAAAAAAGAAATAAATCACTGAC

ACACTTTGTCCACTTTGCAATGTGAAAATGTTTACTCACCAACATGTTTT

CTTTGATCTTACAGTTGTTATTAATTGTGATTGGAGCTATAGCAGTTGTC

GCAGTTTTACAACCCTACATCTTTGTTGCAACAGTGCCAGTGATAGTGGC

TTTTATTATGTTGAGAGCATATTTCCTCCAAACCTCACAGCAACTCAAAC

AACTGGAATCTGAAGGTATGACAGTGAATGTGCGATACTCATCTTGTAAA

AAAGCTATAAGAGCTATTTGAGATTCTTTATTGTTAATCTACTTAAAAAA

AATTCTGCTTTTAAACTTTTACATCATATAACAATAATTTTTTCTACAT

GCATGTGTATATAAAAGGAAACTATATTACAAAGTACACATGGATTTTTT

TTCTTAATTAATGACCATGTGACTTCATTTTGGTTTTAAAATAGGTATAT

AGAATCTTACCACAGTTGGTGTACAGGACATTCATTTATAATAAACTTAT

ATCAGTCAAATTAAACAAGGATAGTGCTGCTATTACTAAAGGTTTCTCTG

GGTTCCCAAATGATACTTGACCAAATTTGTCCCTTTGGCTTGTTGTCTTC

AGACACCCTTTCTTCATGTGTTGGAGCTGCCATTTCGTGTGCCCCCAAAC

TCTACTTGAGCTGTTAGGGAATCACATTTTGCAGTGACAGCCTTAGTGTG

GGTGCATTTTCAGGCAATACTTTTTCAGTATATTTCTGCTTTGTAGATTA

TTAGCTAAATCAAGTCACATAAACTTCCTTAATTTAGATACTTGAAAAAA

TTGTCTTAAAAGAAAATTTTTTAGTAAGAATTAATTTAGAATTAGCCAG

AAAACTCCCAGTGGTAGCCAAGAAAGAGGAATAAATATTGGTGGTAATTT

TTTAAGTTCCCATCTCTGGTAGCCAAGTAAAAAAAGAGGGTAACTCATTA

ATAAAATAACAAATCATATCTATTCAAAGAATGGCACCAGTGTGAAAAAA

AGCTTTTTAACCAATGACATTTGTGATATGATTATTCTAATTTAGTCTTT

TTCAGGTACAAGATATTATGAAATTACATTTTGTGTTTATGTTATTTGCA aTGTTTTCTA<u>TGG</u>AAATATTTCACAGGCAGGAGTCCAATTTTCACTCATC

TTGTTACAAGCTTAAAAGGACTATGGCACTTCGTGCCTTCGGACGGCAG

CCTTACTTTGAAACTCTGTTCCACAAAGCTCTGAATTTACATACTGCCAA

CTGGTTCTTGTACCTGTCAACACTGCGCTGGTTCCAAATGAGAATAGAAA

TGATTTTGTCATCTTCTTCATTGCTGTTACCTTCATTTCCATTTTAACA

-continued
ACAGGTACTATGAACTCATTAACTTTAGCTAAGCATTTAAGTAAAAAATT

TTCAATGAATAAAATGCTGCATTCTATAGGTTATCAATTTTTGATATCTT

TAGAGTTTAGTAATTAACAAATTTGTTGGTTTATTATTGAACAAGTGATT

TCTTTGAATTTCCATTGTTTTATTGTTAAACAAATAATTTCCTTGAAATC

GGATATATATATATATATGTATATATATATATATATATATATATATATAC

ATATATATATATAGTATTATCCCTGTTTTCACAGTTTTAAAAACCGATGC

ACACAGATTGTCAGATAGCAATTCTGTGATTGAAGGGGAAATATGTCACC

TCTTCATACTCATATTGGTGAAGGGTCCTAGCTTCAAAATTAATAGATTC

CTAAAGAGGGGAAATGAAACATCCGCATTTACACACACACACACACACAC

ACACACAGAGTTCCTCTTGTCGGTAAGTTTTGTTTTTTTTAAATCTCTAC

TAGATAAAATTTGTTATCTAATTGTGAGTTTTACACAAAGAAAAACTGTC

ACAGAAAAGAAAGACAGTGTCACATTTTTCAAAAGAAAAAGAAGAAAAGA

AAGTGCCATGTTTTTCAAATACAAATGTTCTGGATTGATTTTAGGATCTT

TAGTGAAAAACAAAGTATTTCATAATAAGTAAAATAAAAATCTATGTAGG

TAAATTTGTTTCTCTAATTTAAGAATTTGAATTTCTGAGTATTTATGATA

AGTGTTGAAATAACTTCTTATATGTGACAGTGAATACTGGCAGAGCAAAT

GCCAAATCAATGCCAAATCTGTAGGATCATTTGATTGTAGGAACAGAATT

CTACTCAAACCGAAAGCAGGCATTTGCTGGAGTTACAGAAAGGCCTCATG

GAACACCGAGAAGGTGGTGCCATTCGACTCTTAAAGAAGCTGCAACAGGC

A

As described below in Table 49, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct an intronic 3272-26 bp (A→G) mutation in the CFTR gene, the 5' homology arm may be shortened less than 1000 nucleotides, e.g., e.g., 500 nucleotides, to avoid inclusion of a LINE repeat element in the 5' homology arm. The 5' homology arm is shown as bold sequence, the inserted base to correct the intronic 3272-26 bp (A→G) mutation is shown as lower case sequence, and the 3' homology arm is shown as no emphasis capitalized sequence.

(Template Construct 49; SEQ ID NO: 27331)
AGACACCCTTTCTTCATGTGTTGGAGCTGCCATTTCGTGTGCCCCCAAAC

TCTACTTGAGCTGTTAGGGAATCACATTTTGCAGTGACAGCCTTAGTGTG

GGTGCATTTTCAGGCAATACTTTTTCAGTATATTTCTGCTTTGTAGATTA

TTAGCTAAATCAAGTCACATAAACTTCCTTAATTTAGATACTTGAAAAAA

TTGTCTTAAAAGAAAATTTTTTAGTAAGAATTAATTTAGAATTAGCCAG

AAAACTCCCAGTGGTAGCCAAGAAAGAGGAATAAATATTGGTGGTAATTT

TTTAAGTTCCCATCTCTGGTAGCCAAGTAAAAAAAGAGGGTAACTCATTA

ATAAAATAACAAATCATATCTATTCAAAGAATGGCACCAGTGTGAAAAAA

AGCTTTTTAACCAATGACATTTGTGATATGATTATTCTAATTTAGTCTTT

TTCAGGTACAAGATATTATGAAATTACATTTTGTGTTTATGTTATTTGCA aTGTTTTCTAT<u>GG</u>AAATATTTCACAGGCAGGAGTCCAATTTTCACTCATC

TTGTTACAAGCTTAAAAGGACTATGGACACTTCGTGCCTTCGGACGGCAG

CCTTACTTTGAAACTCTGTTCCACAAAGCTCTGAATTTACATACTGCCAA

CTGGTTCTTGTACCTGTCAACACTGCGCTGGTTCCAAATGAGAATAGAAA

TGATTTTTGTCATCTTCTTCATTGCTGTTACCTTCATTTCCATTTTAACA

ACAGGTACTATGAACTCATTAACTTTAGCTAAGCATTTAAGTAAAAAATT

TTCAATGAATAAAATGCTGCATTCTATAGGTTATCAATTTTTGATATCTT

TAGAGTTTAGTAATTAACAAATTTGTTGGTTTATTATTGAACAAGTGATT

TCTTTGAATTTCCATTGTTTTATTGTTAAACAAATAATTTCCTTGAAATC

GGATATATATATATATATGTATATATATATATATATATATATATATATAC

A

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., an intronic 3272-26 bp (A→G) target site in the CFTR gene. For example, the ssODN may include 5' and 3' homology arms as shown below. The 5' homology arm is shown as bold sequence, the inserted bases to correct the intronic 3272-26 bp (A→G) mutation is shown as lower case sequence, and the 3' homology arm is shown as no emphasis capitalized sequence.

(Template Construct 50; SEQ ID NO: 27332)
ATATGATTATTCTAATTTAGTCTTTTTCAGGTACAAGATATTATGAAATT

ACATTTTGTGTTTATGTTATTTGCAaTGTTTTCTAT<u>GG</u>AAATATTTCACA

GGCAGGAGTCCAATTTTCACTCATCTTGTTACAAGCTTAAAAGGACTATG

G

In an embodiment, to correct a mutation, e.g., an intronic 3272-26 bp (A→G) target site in the CFTR gene, and concomitantly introduce a silent sense mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted base to correct the intronic 3272-26 bp (A→G) mutation is shown as lower case sequence, the silent sense mutation is shown as lower case underlined and italicized sequence, and the 3' homology arm is shown as no emphasis capitalized sequence.

(Template Construct 51; SEQ ID NO: 27333)
GTGCACATGTACCCTAAAACTTAAAGTATAATAAAAAAAATAAAAAAAAG

TTTGAGGTGTTTAAAGTATGCAAAAAAAAAAAAAGAAATAAATCACTGAC

ACACTTTGTCCACTTTGCAATGTGAAAATGTTTACTCACCAACATGTTTT

CTTTGATCTTACAGTTGTTATTAATTGTGATTGGAGCTATAGCAGTTGTC

GCAGTTTTACAACCCTACATCTTTGTTGCAACAGTGCCAGTGATAGTGGC

TTTTATTATGTTGAGAGCATATTTCCTCCAAACCTCACAGCAACTCAAAC

AACTGGAATCTGAAGGTATGACAGTGAATGTGCGATACTCATCTTGTAAA

AAAGCTATAAGAGCTATTTGAGATTCTTTATTGTTAATCTACTTAAAAAA

AATTCTGCTTTTAAACTTTTACATCATATAACAATAATTTTTTTCTACAT

GCATGTGTATATAAAAGGAAACTATATTACAAAGTACACATGGATTTTTT

TTCTTAATTAATGACCATGTGACTTCATTTTGGTTTTAAAATAGGTATAT

AGAATCTTACCACAGTTGGTGTACAGGACATTCATTTATAATAAACTTAT

ATCAGTCAAATTAAACAAGGATAGTGCTGCTATTACTAAAGGTTTCTCTG

GGTTCCCAAATGATACTTGACCAAATTTGTCCCTTTGGCTTGTTGTCTTC

AGACACCCTTTCTTCATGTGTTGGAGCTGCCATTTCGTGTGCCCCCAAAC

TCTACTTGAGCTGTTAGGGAATCACATTTTGCAGTGACAGCCTTAGTGTG

GGTGCATTTTCAGGCAATACTTTTTCAGTATATTTCTGCTTTGTAGATTA

TTAGCTAAATCAAGTCACATAAACTTCCTTAATTTAGATACTTGAAAAAA

TTGTCTTAAAAGAAAATTTTTTTAGTAAGAATTAATTTAGAATTAGCCAG

AAAACTCCCAGTGGTAGCCAAGAAAGAGGAATAAATATTGGTGGTAATTT

TTTAAGTTCCCATCTCTGGTAGCCAAGTAAAAAAAGAGGGTAACTCATTA

ATAAAATAACAAATCATATCTATTCAAAGAATGGCACCAGTGTGAAAAAA

AGCTTTTTAACCAATGACATTTGTGATATGATTATTCTAATTTAGTCTTT

TTCAGGTACAAGATATTATGAAATTACATTTTGTGTTTATGTTATTTGCA aTGTTTTCTAT<u>cc</u>AAATATTTCACAGGCAGGAGTCCAATTTTCACTCATC

TTGTTACAAGCTTAAAAGGACTATGGACACTTCGTGCCTTCGGACGGCAG

CCTTACTTTGAAACTCTGTTCCACAAAGCTCTGAATTTACATACTGCCAA

CTGGTTCTTGTACCTGTCAACACTGCGCTGGTTCCAAATGAGAATAGAAA

TGATTTTTGTCATCTTCTTCATTGCTGTTACCTTCATTTCCATTTTAACA

ACAGGTACTATGAACTCATTAACTTTAGCTAAGCATTTAAGTAAAAAATT

TTCAATGAATAAAATGCTGCATTCTATAGGTTATCAATTTTTGATATCTT

TAGAGTTTAGTAATTAACAAATTTGTTGGTTTATTATTGAACAAGTGATT

TCTTTGAATTTCCATTGTTTTATTGTTAAACAAATAATTTCCTTGAAATC

GGATATATATATATATGTATATATATATATATATATATATATATATATAC

ATATATATATATAGTATTATCCCTGTTTTCACAGTTTTAAAAACCGATGC

ACACAGATTGTCAGATAGCAATTCTGTGATTGAAGGGGAAATATGTCACC

TCTTCATACTCATATTGGTGAAGGGTCCTAGCTTCAAAATTAATAGATTC

CTAAAGAGGGGAAATGAAACATCCGCATTTACACACACACACACACACAC

ACACACAGAGTTCCTCTTGTCGGTAAGTTTTGTTTTTTTTAAATCTCTAC

TAGATAAAATTTGTTATCTAATTGTGAGTTTTACACAAAGAAAAACTGTC

-continued

ACAGAAAAGAAAGACAGTGTCACATTTTTCAAAAGAAAAAGAAGAAAAGA

AAGTGCCATGTTTTTCAAATACAAATGTTCTGGATTGATTTTAGGATCTT

TAGTGAAAAACAAAGTATTTCATAATAAGTAAAATAAAAATCTATGTAGG

TAAATTTGTTTCTCTAATTTAAGAATTTGAATTTCTGAGTATTTATGATA

AGTGTTGAAATAACTTCTTATATGTGACAGTGAATACTGGCAGAGCAAAT

GCCAAATCAATGCCAAATCTGTAGGATCATTTGATTGTAGGAACAGAATT

CTACTCAAACCGAAAGCAGGCATTTGCTGGAGTTACAGAAAGGCCTCATG

GAACACCGAGAAGGTGGTGCCATTCGACTCTTAAAGAAGCTGCAACAGGC

A

In an embodiment, to correct a mutation, e.g., an intronic 3272-26 bp (A→G) target site in the CFTR gene, and concomitantly introduce a silent mutation to disrupt subsequent Cas9 binding and cleavage, the 5' homology arm may be shortened less than 750 nucleotides, e.g., 500 nucleotides, to avoid inclusion of a LINE repeat element in the 5' homology arm. The 5' homology arm is shown as bold sequence, the inserted base to correct the intronic 3272-26 bp (A→G) mutation is shown as lower case sequence, the silent sense mutation is shown as lower case underlined and italicized sequence, and the 3' homology arm is shown as no emphasis capitalized sequence.

(Template Construct 52; SEQ ID NO: 27334)
AGACACCCTTTCTTCATGTGTTGGAGCTGCCATTTCGTGTGCCCCCAAAC

TCTACTTGAGCTGTTAGGGAATCACATTTTGCAGTGACAGCCTTAGTGTG

GGTGCATTTTCAGGCAATACTTTTTCAGTATATTTCTGCTTTGTAGATTA

TTAGCTAAATCAAGTCACATAAACTTCCTTAATTTAGATACTTGAAAAAA

TTGTCTTAAAAGAAAATTTTTTTAGTAAGAATTAATTTAGAATTAGCCAG

AAAACTCCCAGTGGTAGCCAAGAAAGAGGAATAAATATTGGTGGTAATTT

TTTAAGTTCCCATCTCTGGTAGCCAAGTAAAAAAAGAGGGTAACTCATTA

ATAAAATAACAAATCATATCTATTCAAAGAATGGCACCAGTGTGAAAAAA

AGCTTTTTAACCAATGACATTTGTGATATGATTATTCTAATTTAGTCTTT

TTCAGGTACAAGATATTATGAAATTACATTTTGTGTTTATGTTATTTGCA aTGTTTTCTAT*cc*AAATATTTCACAGGCAGGAGTCCAATTTTCACTCATC

TTGTTACAAGCTTAAAAGGACTATGGACACTTCGTGCCTTCGGACGGCAG

CCTTACTTTGAAACTCTGTTCCACAAAGCTCTGAATTTACATACTGCCAA

CTGGTTCTTGTACCTGTCAACACTGCGCTGGTTCCAAATGAGAATAGAAA

TGATTTTGTCATCTTCTTCATTGCTGTTACCTTCATTTCCATTTTAACA

ACAGGTACTATGAACTCATTAACTTTAGCTAAGCATTTAAGTAAAAAATT

TTCAATGAATAAAATGCTGCATTCTATAGGTTATCAATTTTTGATATCTT

TAGAGTTTAGTAATTAACAAATTTGTTGGTTTATTATTGAACAAGTGATT

TCTTTGAATTTCCATTGTTTTATTGTTAAACAAATAATTTCCTTGAAATC

GGATATATATATATATATGTATATATATATATATATATATATATATATAC

A

In an embodiment, an ssODN may be to correct a mutation, e.g., an intronic 3272-26 bp (A→G) target site in the CFTR gene, and concomitantly introduce a silent mutation to disrupt subsequent Cas9 binding and cleavage. For example, the ssODN may include 5' and 3' homology arms as shown below. The 5' homology arm is shown as bold sequence, the inserted base to correct the intronic 3272-26 bp (A→G) mutation is shown as lower case sequence, the silent sense mutation is shown as lower case underlined and italicized sequence, and the 3' homology arm is shown as no emphasis capitalized sequence.

(Template Construct 53; SEQ ID NO: 27335)
ATATGATTATTCTAATTTAGTCTTTTTCAGGTACAAGATATTATGAAATT ACATTTTGTGTTTATGTTATTTGCAaTGTTTTCTAT*cc*AAATATTTCACA

GGCAGGAGTCCAATTTTCACTCATCTTGTTACAAGCTTAAAAGGACTATG

G

The underlined C has been changed from a G to C at that position, so that wild-type CFTR is still transcribed, but the PAM sequence TGG has been modified to reduce or eliminate Cas9 cleavage at that locus.

Table 49 below provides exemplary template nucleic acids. In an embodiment, the template nucleic acid includes the 5' homology arm and the 3' homology arm of a row from Table 49. In other embodiments, a 5' homology arm from the first column can be combined with a 3' homology arm from Table 49. In each embodiment, a combination of the 5' and 3' homology arms include a replacement sequence, e.g., Cytosine-Thymine-Thymine (CTT) residues or a Guanine (G) residue.

TABLE 49

| 5' homology arm (the number of nucleotides from SEQ ID NO: 5'H, beginning at the 3' end of SEQ ID NO: 5'H) | Replacement Sequence = CTT or G | 3' homology arm (the number of nucleotides from SEQ ID NO: 3'H, beginning at the 5' end of SEQ ID NO: 3'H) |
|---|---|---|
| 10 or more | | 10 or more |
| 20 or more | | 20 or more |
| 50 or more | | 50 or more |
| 100 or more | | 100 or more |
| 150 or more | | 150 or more |
| 200 or more | | 200 or more |
| 250 or more | | 250 or more |
| 300 or more | | 300 or more |
| 350 or more | | 350 or more |
| 400 or more | | 400 or more |
| 450 or more | | 450 or more |
| 500 or more | | 500 or more |
| 550 or more | | 550 or more |
| 600 or more | | 600 or more |
| 650 or more | | 650 or more |
| 700 or more | | 700 or more |
| 750 or more | | 750 or more |
| 800 or more | | 800 or more |
| 850 or more | | 850 or more |
| 900 or more | | 900 or more |
| 1000 or more | | 1000 or more |
| 1100 or more | | 1100 or more |
| 1200 or more | | 1200 or more |
| 1300 or more | | 1300 or more |
| 1400 or more | | 1400 or more |
| 1500 or more | | 1500 or more |
| 1600 or more | | 1600 or more |
| 1700 or more | | 1700 or more |
| 1800 or more | | 1800 or more |
| 1900 or more | | 1900 or more |
| 1200 or more | | 1200 or more |
| At least 50 but not long enough to include a repeated element. | | At least 50 but not long enough to include a repeated element. |

TABLE 49-continued

| 5' homology arm (the number of nucleotides from SEQ ID NO: 5'H, beginning at the 3' end of SEQ ID NO: 5'H) | Replacement Sequence = CTT or G | 3' homology arm (the number of nucleotides from SEQ ID NO: 3'H, beginning at the 5' end of SEQ ID NO: 3'H) |
|---|---|---|
| At least 100 but not long enough to include a repeated element. | | At least 100 but not long enough to include a repeated element. |
| At least 150 but not long enough to include a repeated element. | | At least 150 but not long enough to include a repeated element. |
| 5 to 100 nucleotides | | 5 to 100 nucleotides |
| 10 to 150 nucleotides | | 10 to 150 nucleotides |
| 20 to 150 nucleotides | | 20 to 150 nucleotides |
| Template Construct No. 1 | | |
| Template Construct No. 2 | | |
| Template Construct No. 3 | | |
| Template Construct No. 4 | | |

In an embodiment, a single or dual nickase eaCas9 is used to cleave the target DNA near the site of the mutation, or signature, to be modified, e.g., replaced. While not wishing to be bound by theory, in an embodiment, it is believed that the Cas9 mediated break induces HDR with the template nucleic acid to replace the target DNA sequence with the template sequence.

Targeted Knockin by cDNA Insertion

In an embodiment, homology-directed repair of the CFTR gene is used to target an intronic region between exons X and Y, wherein exons X and Y are any exons between exon 1 and exon 27, given that exon X and exon Y are adjacent and exon X has a lower number than exon Y, and deliver a Cas9 molecule, CRISPER-gRNAs, and homology-directed repair templates that include homology arms, splice acceptor, contiguous coding sequence of exons (X+1) through exon 27 of CFTR gene and polyadenylation signal.

In an embodiment, one single strand break, two single strand breaks, one double strand break or two double strand breaks are introduced (e.g., positioned by one, two, three, or four gRNA molecule/s) at or in close proximity to a CF target knockin position in the CFTR gene. The CF target knockin position is the intronic region between CFTR exons X and Y. Altering the CF target knockin position refers to homology-directed repair of genomic sequence including the delivery of cDNA template of contiguous exons (X+1) through exon 27 of CFTR gene. Targeted knockin of CFTR cDNA leads to the cessation of production of mutant or truncated CFTR protein and results in the production of wild-type CFTR protein. Targeted knockin of CFTR cDNA prevents the development or progression of lung, gastrointestinal and/or reproductive disease in a subject due to the cessation of production of mutant CFTR protein and restoration of wild-type CFTR protein production. This approach cures and/or prevents the progression of lung, gastrointestinal and/or reproductive disease in any subject with CF or CF-like disease deficiency who has a mutation in exon (X+1) through exon 27 of the CFTR gene, or in any subject who has a mutation in an intronic or exonic region of the CFTR gene that is after intron X.

In an embodiment, homology-directed repair of the CFTR gene in any subject with CF mutations in exons 3 through 27 and introns 2 through 26 by targeting intronic region between exons 2 and 3 and with delivery of a homology-directed repair template including homology arms, splice acceptor, coding sequence of contiguous exons 3-27 of CFTR gene and polyadenylation signal. The CF target position is the intronic region between exons 2 and 3. Altering the CF target position refers to homology-directed repair of genomic sequence including the delivery of cDNA template of exons 3-27 of CFTR gene. This approach cures and/or prevents the progression of lung, gastrointestinal and/or reproductive disease in any subject with CF or CF-like disease deficiency who has a mutation in exons 3-27 of the CFTR gene, or in any subject who has a mutation in an intronic or exonic region of the CFTR gene that is on or after the second intron, including but not limited to the following mutations: e.g., F508del, G551D, G542X, N1303K, R117H, W1282X, R553X, c.3717+12191C>T, 2657+5G>A, or c.3140-26A>G.

In an embodiment, a cDNA insert construct comprises a 5' homology arm, a splice acceptor, a cDNA insert (e.g., CFTR exons 3 to 27, e.g., CFTR exons 11 to 27), a 3' homology arm, and a polyadenylation signal. Splice acceptors and polyadenylation signals are well known to one of skill in the art.

It is contemplated herein that, in an embodiment, a Cas9 molecule could potentially cleave cDNA insert constructs either prior to or following homology directed repair (e.g., homologous recombination), resulting in a possible non-homologous-end-joining event and further DNA sequence mutation at the chromosomal locus of interest. Therefore, to avoid cleavage of the cDNA insert sequence before and/or after Cas9-mediated homology directed repair, alternate versions of the homology arms may be used where silent mutations are introduced into a PAM. These silent mutations may disrupt Cas9 binding and cleavage, but not disrupt the amino acid sequence of the cDNA insert.

Exemplary template cDNA (also referred to herein as cDNA inserts) to introduce wild-type sequence, e.g., exons 3 to 27 of the CFTR gene, are provided. In an embodiment, the CRISPR-Cas9 binding site is CTCAAGTGATCTGCC-CACCTTGG (SEQ ID NO: 27336) (PAM is underlined TGG).

In an embodiment, to insert CFTR cDNA (e.g., CFTR exons 3 to 27) into intron 2, and concomitantly introduce a silent mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the CRISPR-Cas9 binding site is shown as italicized sequence, the PAM site is underlined, the silent sense mutation in the PAM is shown as lower case underlined sequence, and the 3' homology arm is shown as no emphasis capitalized sequence.

(SEQ ID NO: 27337)
CAATCAAAAGGTTAGGATCCTTTTGATTGCCAGTGACAGAAACCCAATTT

ACTAGCTTAAGTAAATAAAAGGAACGAATTTATTGGCTCATGAAGCCTGA

ACTATGTGAAGACCTAGGTGGAGAACTGGCCTTAGGAACTCAATGGGACC

AAGGACTCAAATGCCACCTGGTGGCATTTGCCTTATGCTGGTTTTATTTT

CTCAGACCGGACCAGCTTTCTACATAAAGTGGGTCCCTGGTTAGAACTCT

TTGCTCCTATCTTTAAGGACCACGAAAGAAGGAGCCCTTTGTCCTTGGCT

AAATGTGAAAAATCCCAGAGACTCTTGAGTCATAGTGCTTACCCCTTGGG

CCACTCATAGTCTAGAATGAACTAGGCTGAGTCTCGTGCCAACAGCACAG

GCCTGATGCCAGATAAAAGGGTGAGTGAAGGGGGATAAAAAATAAGACAT

AGCTACTAAATTATTGCACCAAAGTAAAAACATTGAGTTGACTTGCAATT

-continued

TGTTTCTTTTAATTAAATTCATTTCCTTTTTTTGGCATTTTGAAGGCAAA

GTAAGATATTAAACTTTATTTTTATTGATTTTATTCAAAGAATTAAGCTA

GTGGGAGTAGCAGATTCACACTTCTAAGATCAAGGGCCAGCTTCTATTAT

TGAACACTTGGTGTGTGCAAATGCCATGAGGTAGGGATACTTTGTTTTGT

TTTTTATTTTTTATTGGGTTCGATCTCTTTTGTTTATGATGTATCCCCAA

GTGCCTAGAATAGGGCCTGGCATATGGTATATACTCAATAAATATTTGTT

GAATGAATCCATGATGGAATGTGAAATGGCTAGCATTACATAGAAACCTG

TAGCATTGCTGGAGAGATAAAATATATAAACATAATCCATTGCAGGTATA

TTGACAAGTTCAAAATAATATAATGGGTATTGAATATCTAAATGTTTGTT

GTTGTTGTTGCTGTTGTTTTTGAGACAGAGTCTTGCTCTGTTGCCCAGGC

TGGAGTGTAATGGTGCAATTTTGGCTCACTGCAAACTTCGTCTCCTGGGT

TCAAGTGATTCTCCTGCCTCAGCCTCTCGAGTAGCTGGGTTTACAGGCAC

TCGCCACAATGCCTGGCTAATTTTTGTATTTTAGTAGATGTGGAGTTTCG

CCATGTTGGCCAGGCTGGTCTTGAACTCCT*GACCTCAAGTGATCTGCCCA*

*CCT*T*aa*CCTCCCAAAATGCTGGGATTATAGGTGTGAGCCACTATGCCCAG

CTTTGAATATCTAAGTTTTAATTGGATGCTGAGGGAATGATTAATCAGAG

TAGGGCTGGGTTAATTGAAAAATGTGATACATTTGTATTTATGGCCAGAT

AGAGAACATGAATCTGAATTTGCAGAATTATCTGGCTTAACATTTTTTTC

TTTCCAGTTTTCACTGTATCCCCCATGTTGATTCAATTTAAAAAATATAC

CTATTTTACTTCAATTCAACAATGCTATGCCAGTACAAACCCATACGTTC

TATTATTTTTGTTTTGTTTTGTTTTTGTATCTCCACCCTGTTACTTCTTT

TCTTATAAAATTGGTATTTGAAATTTATTGAAATATTTTGGAAGAGTGAC

ATACCATTTTTGGTACTTTGTACCTCTGCACCCTTGGGAAGTGACCCTGG

CTTCACATTTCATAACTGCCTTGTGACCATGGCCCTCAAGTGGTTGCCAG

ATGGTTGAAGAACATTAACCTATCTGGCTCAATTTTGTGACCATGGATTG

AATCCTCTACATAACTGCAGTGTGCAAACCACACATCCGTTCCAAGATTG

TAGTCAGGATATGAACTTTTTAAGAATAAAACTTCTTCCCTTCTGATCTG

GGCCTGGTATGTGGTCCTACTAGAACCACATCACCTACTCTTGGTGCTAA

CAATTTGTGGCACCAAGTTGTTCAAGTTTCACCCATTAAAGAAATTCCCC

GACCTTGCCTTCTCCTCAGGTAACTACCCCATTCTATTTTTTCTTTCATA

GCTAACATTCTCTGCTCTCCTGGTCTCTCTACTTCACTTTCATTTACATC

TCAGCTCCTGAAGTATGGTTTCCACCATGTTCCTAAAACTACATTGCCCA

GGGTCACTAGAGACCTCTTATGAAATATAACAACACCTTTCTACATTACT

TCCGTGTGGACCACTTTTTCACATTGAACCCATTTTGTTGGTTTATGTAC

ACACCCCTTCCTTGGCTTTCCCATCTGATCCATTTCTCCTTTGATGGAGA

AGGTGAGTCTGCTCCATATTTAGCTTCTTACTCTGAGTAACCAAATGTTA

TGGATGGGAGGTTAGCTCTGTGTGTGAGAGAAAGGTGGAGAAGCATGTGG

GGAGGGAAATAGATGGGAAAAGGTAATTAGGCTTTATAGAAGGGCTCTCA

The underlined A has been changed from a G to A at that position so that wild-type CFTR is still transcribed, but the PAM sequence TGG has been modified to TAA to reduce or eliminate Cas9 cleavage at that locus.

In an embodiment, suitable sequence for the cDNA insert of CFTR exons 3 to 27, can be selected from (e.g., includes a portion of) or include the following sequence:

(SEQ ID NO: 27338)
AGAATGGGATAGAGAGCTGGCTTCAAAGAAAAATCCTAAACTCATTAATG

CCCTTCGGCGATGTTTTTTCTGGAGATTTATGTTCTATGGAATCTTTTTA

TATTTAGGGGAAGTCACCAAAGCAGTACAGCCTCTCTTACTGGGAAGAAT

CATAGCTTCCTATGACCCGGATAACAAGGAGGAACGCTCTATCGCGATTT

ATCTAGGCATAGGCTTATGCCTTCTCTTTATTGTGAGGACACTGCTCCTA

CACCCAGCCATTTTTGGCCTTCATCACATTGGAATGCAGATGAGAATAGC

TATGTTTAGTTTGATTTATAAGAAGACTTTAAAGCTGTCAAGCCGTGTTC

TAGATAAAATAAGTATTGGACAACTTGTTAGTCTCCTTTCCAACAACCTG

AACAAATTTGATGAAGGACTTGCATTGGCACATTTCGTGTGGATCGCTCC

TTTGCAAGTGGCACTCCTCATGGGCTAATCTGGGAGTTGTTACAGGCGT

CTGCCTTCTGTGGACTTGGTTTCCTGATAGTCCTTGCCCTTTTTCAGGCT

GGGCTAGGGAGAATGATGATGAAGTACAGAGATCAGAGAGCTGGGAAGAT

CAGTGAAAGACTTGTGATTACCTCAGAAATGATTGAAAATATCCAATCTG

TTAAGGCATACTGCTGGGAAGAAGCAATGGAAAAAATGATTGAAAACTTA

AGACAAACAGAACTGAAACTGACTCGGAAGGCAGCCTATGTGAGATACTT

CAATAGCTCAGCCTTCTTCTTCTCAGGGTTCTTTGTGGTGTTTTTATCTG

TGCTTCCCTATGCACTAATCAAAGGAATCATCCTCCGGAAAATATTCACC

ACCATCTCATTCTGCATTGTTCTGCGCATGGCGGTCACTCGGCAATTTCC

CTGGGCTGTACAAACATGGTATGACTCTCTTGGAGCAATAAACAAAATAC

AGGATTCTTACAAAAGCAAGAATATAAGACATTGGAATATAACTTAACG

ACTACAGAAGTAGTGATGGAGAATGTAACAGCCTTCTGGGAGGAGGGATT

TGGGGAATTATTTGAGAAAGCAAAACAAAACAATAACAATAGAAAAACTT

CTAATGGTGATGACAGCCTCTTCTTCAGTAATTTCTCACTTCTTGGTACT

CCTGTCCTGAAAGATATTAATTTCAAGATAGAAAGAGGACAGTTGTTGGC

GGTTGCTGGATCCACTGGAGCAGGCAAGACTTCACTTCTAATGGTGATTA

TGGGAGAACTGGAGCCTTCAGAGGGTAAAATTAAGCACAGTGGAAGAATT

TCATTCTGTTCTCAGTTTTCCTGGATTATGCCTGGCACCATTAAAGAAAA

TATCATCTTTGGTGTTTCCTATGATGAATATAGATACAGAAGCGTCATCA

AAGCATGCCAACTAGAAGAGGACATCTCCAAGTTTGCAGAGAAAGACAAT

ATAGTTCTTGGAGAAGGTGGAATCACACTGAGTGGAGGTCAACGAGCAAG

AATTTCTTTAGCAAGAGCAGTATACAAAGATGCTGATTTGTATTTATTAG

ACTCTCCTTTTGGATACCTAGATGTTTTAACAGAAAAAGAAATATTTGAA

AGCTGTGTCTGTAAACTGATGGCTAACAAAACTAGGATTTTGGTCACTTC

TAAAATGGAACATTTAAAGAAAGCTGACAAAATATTAATTTTGCATGAAG

GTAGCAGCTATTTTTATGGGACATTTTCAGAACTCCAAAATCTACAGCCA

GACTTTAGCTCAAAACTCATGGGATGTGATTCTTTCGACCAATTTAGTGC

AGAAAGAAGAAATTCAATCCTAACTGAGACCTTACACCGTTTCTCATTAG

AAGGAGATGCTCCTGTCTCCTGGACAGAAACAAAAAAACAATCTTTTAAA

CAGACTGGAGAGTTTGGGGAAAAAAGGAAGAATTCTATTCTCAATCCAAT

CAACTCTATACGAAAATTTTCCATTGTGCAAAAGACTCCCTTACAAATGA

ATGGCATCGAAGAGGATTCTGATGAGCCTTTAGAGAGAAGGCTGTCCTTA

GTACCAGATTCTGAGCAGGGAGAGGCGATACTGCCTCGCATCAGCGTGAT

CAGCACTGGCCCCACGCTTCAGGCACGAAGGAGGCAGTCTGTCCTGAACC

TGATGACACACTCAGTTAACCAAGGTCAGAACATTCACCGAAAGACAACA

GCATCCACACGAAAAGTGTCACTGGCCCCTCAGGCAAACTTGACTGAACT

GGATATATATTCAAGAAGGTTATCTCAAGAAACTGGCTTGGAAATAAGTG

AAGAAATTAACGAAGAAGACTTAAAGGAGTGCTTTTTTGATGATATGGAG

AGCATACCAGCAGTGACTACATGGAACACATACCTTCGATATATTACTGT

CCACAAGAGCTTAATTTTTGTGCTAATTTGGTGCTTAGTAATTTTTCTGG

CAGAGGTGGCTGCTTCTTTGGTTGTGCTGTGGCTCCTTGGAAACACTCCT

CTTCAAGACAAAGGGAATAGTACTCATAGTAGAAATAACAGCTATGCAGT

GATTATCACCAGCACCAGTTCGTATTATGTGTTTTACATTTACGTGGGAG

TAGCCGACACTTTGCTTGCTATGGGATTCTTCAGAGGTCTACCACTGGTG

CATACTCTAATCACAGTGTCGAAAATTTTACACCACAAAATGTTACATTC

TGTTCTTCAAGCACCTATGTCAACCCTCAACACGTTGAAAGCAGGTGGGA

TTCTTAATAGATTCTCCAAAGATATAGCAATTTTGGATGACCTTCTGCCT

CTTACCATATTTGACTTCATCCAGTTGTTATTAATTGTGATTGGAGCTAT

AGCAGTTGTCGCAGTTTTACAACCCTACATCTTTGTTGCAACAGTGCCAG

TGATAGTGGCTTTTATTATGTTGAGAGCATATTTCCTCCAAACCTCACAG

CAACTCAAACAACTGGAATCTGAAGGCAGGAGTCCAATTTTCACTCATCT

TGTTACAAGCTTAAAAGGACTATGGACACTTCGTGCCTTCGGACGGCAGC

CTTACTTTGAAACTCTGTTCCACAAAGCTCTGAATTTACATACTGCCAAC

TGGTTCTTGTACCTGTCAACACTGCGCTGGTTCCAAATGAGAATAGAAAT

GATTTTTGTCATCTTCTTCATTGCTGTTACCTTCATTTCCATTTTAACAA

CAGGAGAAGGAGAAGGAAGAGTTGGTATTATCCTGACTTTAGCCATGAAT

ATCATGAGTACATTGCAGTGGGCTGTAAACTCCAGCATAGATGTGGATAG

CTTGATGCGATCTGTGAGCCGAGTCTTTAAGTTCATTGACATGCCAACAG

AAGGTAAACCTACCAAGTCAACCAAACCATACAAGAATGGCCAACTCTCG

AAAGTTATGATTATTGAGAATTCACACGTGAAGAAAGATGACATCTGGCC

CTCAGGGGGCCAAATGACTGTCAAAGATCTCACAGCAAAATACACAGAAG

GTGGAAATGCCATATTAGAGAACATTTCCTTCTCAATAAGTCCTGGCCAG

AGGGTGGGCCTCTTGGGAAGAACTGGATCAGGGAAGAGTACTTTGTTATC

AGCTTTTTTGAGACTACTGAACACTGAAGGAGAAATCCAGATCGATGGTG

TGTCTTGGGATTCAATAACTTTGCAACAGTGGAGGAAAGCCTTTGGAGTG

ATACCACAGAAAGTATTTATTTTTTCTGGAACATTTAGAAAAAACTTGGA

TCCCTATGAACAGTGGAGTGATCAAGAAATATGGAAAGTTGCAGATGAGG

TTGGGCTCAGATCTGTGATAGAACAGTTTCCTGGGAAGCTTGACTTTGTC

CTTGTGGATGGGGCTGTGTCCTAAGCCATGGCCACAAGCAGTTGATGTG

CTTGGCTAGATCTGTTCTCAGTAAGGCGAAGATCTTGCTGCTTGATGAAC

CCAGTGCTCATTTGGATCCAGTAACATACCAAATAATTAGAAGAACTCTA

AAACAAGCATTTGCTGATTGCACAGTAATTCTCTGTGAACACAGGATAGA

AGCAATGCTGGAATGCCAACAATTTTTGGTCATAGAAGAGAACAAAGTGC

GGCAGTACGATTCCATCCAGAAACTGCTGAACGAGAGGAGCCTCTTCCGG

CAAGCCATCAGCCCCTCCGACAGGGTGAAGCTCTTTCCCCACCGGAACTC

AAGCAAGTGCAAGTCTAAGCCCCAGATTGCTGCTCTGAAAGAGGAGACAG

AAGAAGAGGTGCAAGATACAAGGCTTTAG

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to insert CFTR cDNA (e.g., CFTR exons 3 to 27) into intron 2, and concomitantly introduce a silent mutation to disrupt subsequent Cas9 binding and cleavage, the homology arms, e.g., the 5' and 3' homology arms, may be shorted to approximately 500 bp. The 5' homology arm is shown as bold sequence, the CRISPR-Cas9 binding site is shown as italicized sequence, the PAM site is underlined, the silent sense mutation in the PAM is shown as lower case underlined sequence, and the 3' homology arm is shown as no emphasis capitalized sequence.

(SEQ ID NO: 27339)

TTTTTATTTTTTATTGGGTTCGATCTCTTTTGTTTATGATGTATCCCCAA

GTGCCTAGAATAGGGCCTGGCATATGGTATATACTCAATAAATATTTGTT

GAATGAATCCATGATGGAATGTGAAATGGCTAGCATTACATAGAAACCTG

TAGCATTGCTGGAGAGATAAAATATATAAACATAATCCATTGCAGGTATA

TTGACAAGTTCAAAATAATATAATGGGTATTGAATATCTAAATGTTTGTT

GTTGTTGTTGCTGTTGTTTTTGAGACAGAGTCTTGCTCTGTTGCCCAGGC

TGGAGTGTAATGGTGCAATTTTGGCTCACTGCAAACTTCGTCTCCTGGGT

TCAAGTGATTCTCCTGCCTCAGCCTCTCGAGTAGCTGGGTTTACAGGCAC

TCGCCACAATGCCTGGCTAATTTTTGTATTTTAGTAGATGTGGAGTTTCG

CCATGTTGGCCAGGCTGGTCTTGAACTCCTGACCTCAAGTGATCTGCCCA

CCTTaaCCTCCCAAAATGCTGGGATTATAGGTGTGAGCCACTATGCCCAG

CTTTGAATATCTAAGTTTTAATTGGATGCTGAGGGAATGATTAATCAGAG

TAGGGCTGGGTTAATTGAAAAATGTGATACATTTGTATTTATGGCCAGAT

AGAGAACATGAATCTGAATTTGCAGAATTATCTGGCTTAACATTTTTTC

TTTCCAGTTTTCACTGTATCCCCATGTTGATTCAATTTAAAAAATATAC

CTATTTTACTTCAATTCAACAATGCTATGCCAGTACAAACCCATACGTTC

TATTATTTTGTTTTGTTTTGTTTTTGTATCTCCACCCTGTTACTTCTTT

TCTTATAAAATTGGTATTTGAAATTTATTGAAATATTTTGGAAGAGTGAC

ATACCATTTTTGGTACTTTGTACCTCTGCACCCTTGGGAAGTGACCCTGG

CTTCACATTTCATAACTGCCTTGTGACCATGGCCCTCAAGTGGTTGCCAG

The underlined A has been changed from a G to A at that position so that wild-type CFTR is still transcribed, but the PAM sequence TGG has been modified to TAA to reduce or eliminate Cas9 cleavage at that locus.

Exemplary template cDNA (also referred to herein as cDNA inserts) to introduce wild-type sequence, e.g., exons 11 to 27 of the CFTR gene, are provided. In an embodiment, the CRISPR-Cas9 binding site is AGTGAAT-GAATGTGGTATCCCGG (SEQ ID NO: 27340)(PAM is underlined CGG).

In an embodiment, to insert CFTR cDNA (e.g., CFTR exons 11 to 27) into intron 10, and concomitantly introduce a silent mutation to disrupt subsequent Cas9 binding and cleavage, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the CRISPR-Cas9 binding site is shown as italicized sequence, the PAM site is underlined, the silent sense mutation in the PAM is shown as lower case underlined sequence, and the 3' homology arm is shown as no emphasis capitalized sequence.

(SEQ ID NO: 27341)
CTAAATAGAGTGCTGATTTCCCCACAGCATTACTAACAGATGATATTATC

TAATTTAAAAAGTTTCTCATCTTATAGGGAAAATAGTATGTCAATGTATT

CTTAACTTGCATTTCTTTTATTATAAGTAGTGTAAAATATCATTTCAACT

TATACACAGGAGGAATTTCTCTCTATATAAAGTGATCCTAGAATCATAAT

GAAAAATATCACCAACTCATTAGGAAAATGTACAAAGGATTGAATAGATA

TCTCATCAAAAATAAAAATATAAGTGGCCTTTAAACATTGAAAGGTAACA

TTTGAACAAAGACTTGCAGGAGGTGAGGGATTAGGGAATGCAGACTCTGG

GAAGAGTCTTCCAAGTAGCAGGTGAAGCAAGTGCAAAGCTTTCAGATGGG

ACTGACTATACCTGTCTGGTTTGAAGAACAGTAAGGAGGTCACTGAGGCT

GGCATAGAGTAAGACAGGGAGGGTAGAATACTGTCAGAGAAGTAATCGGC

GGTGGAGGTAGGGGGTAAACCATAAAGTGCTCGTAAAGACTAAGGCTTAT

TTCTCTGGGTGAGATTAGAGGCCACTGGAGAGTTTTAAACAGAAGTAACA

GGGCCACTTTGGCTAATGTTTTTAGGCTATTCTGTAGGGAGACAAGGGAG

GAAGCAAGGAGATGAGTTAGGAGTCTATTGTGCCAGTTCAGGCAAGTGAT

GATGGTGGCTTGATCCAGGTAGTAGTGGAAGTAGTATAGTAGGAAGTGAT

CAGATTCAGGACATGCTTTGAAGGAAGATCCAATAGGATTAATGGATAAG

TTGAACAATGGCATATGAGAAAAGTCACAGAGGAGTCAAAGATGATTCCA

AGCTTTCTGGACTGAGTAACTGGAAGGATAAATGTGCCGTTTACTAGAAA

GATAATGGGAGAAACAGGTTTTGGATGGAGCTTGGTTTGGGAATATTAAG

TTTGAAATGCCTATTTGACATCCAAATAGAGATGTTAGTTGGATGTACAA

GTCTAGTTTCAAGGAAGAGGGGGCTGGTAGTGTGAAGATGGGGCTGGATA

AGATTCTAAAGGAAAGAGGGTTGATAAGAAGAGAAAGGGGTGTAGGGGTT

AGCCTAAGGGCATTCTAAGTATTAGAGGTTAAGGAGGTGGGTGAAGAAAA

CCCAATAAAATAAAAGTCTGAGAAGACAAAGCTAGTGAATGAATGTGGTA

TCCCttAACCCAACTGATGTCAAGCAGAAGGGTGTTATCAACTAGGTCAA

ATGCTCATTCATCAAGTAAGATGAAACTGTTATAATTAACCGGTGTCTTC

TGAAATACGGAGATAACTCGTGACTTAATGAAAGCAATAGTAGAGAAGGT

CAAACTTGACCAGAATGAAATTAGAAAGAATAAGAGGAAAGAAAAGACCA

AATACAGACAACCATTGATGCCTTATTCTTTTGATATACTCCTGGAGTCC

ACTTGCTAATACAATTGACCCTTAAACAATACAGGCTTGAACTGCATGGG

TCCACTTATTTGTGAATTTTTTTTCAGTTAATACATTGGAAAATTTTTGG

GGTTTTTTGACAATTTGAAAAAACTCACAAACTGTCTAGCCTAGAAATAC

CGAGAAAATTAAGAAAAAGTAAGATATGCCATGAATGCATAAAATATATG

TAGACACTAGCCTATTTTATCATTTGCTACTATAAAATATACACAATCTA

TTATAAAAAGTTAAAATTTATCAAAACTTAACACACACTAACACCTACCC

TACCTGGCACCATTCACAGTAAAGAGAAATGTAAATAAACATAAAAATGT

AGTATTAAACCATAATGGCATAAAACTAATTGTAGTACATATGGTACTAC

TGTAATAATTTGGAAGCCACTTCCTGTTGCTATTACGGTAAGCTCAAGCA

TTGTGGATAGCCATTTAAAACACCACGTGATGCTAATCATCTCCGTGTGA

GCAGTTCTCTCTCCAGTAAATTGCATATTGCAGTAAAAAGTGATCTCTAG

TGGTTCTCGCATATTTTTCATCATGTTTAGTGCAATGCCATAAACCTTGA

ATAACATCAAGCAATCCATACAAAGTGCCACTAGTGATGCACGGAAAAGT

TGTAACAGTACAAGAAAAAAGTTGAGTTGCTTGGTATTTACCATATATTG

AGGTCTGCAGCTACAGTTGCCTGCAATTTCGAGATAAATGAACCCAGTAT

AAAGACTGTTGTAACAAAAGAAAAGAAAATGTGAAACCATCAGTGCAGCT

ATGCCAGCAGGTGTGAAGTCTTGCACTTTTTGCAAAATACAAAATATGAA

ATATGTGTTAATTGACTGTTTATGTTATCTGTAAGGTTTCCACTCAACAA

TAGGCTATTAGTAGTTAAGTTTTTGTGGAGTCAAAAATTATACGTGGATT

The underlined T has been changed from a G to T at that position so that wild-type CFTR is still transcribed, but the PAM sequence CGG has been modified to CTT to reduce or eliminate Cas9 cleavage at that locus.

In an embodiment, suitable sequence for the cDNA insert of CFTR exons 11 to 27, can be selected from (e.g., includes a portion of) or include the following sequence:

(SEQ ID NO: 27342)
ACTTCACTTCTAATGGTGATTATGGGAGAACTGGAGCCTTCAGAGGGTAA

AATTAAGCACAGTGGAAGAATTTCATTCTGTTCTCAGTTTTCCTGGATTA

TGCCTGGCACCATTAAAGAAAATATCATCTTTGGTGTTTCCTATGATGAA

TATAGATACAGAAGCGTCATCAAAGCATGCCAACTAGAAGAGGACATCTC

CAAGTTTGCAGAGAAAGACAATATAGTTCTTGGAGAAGGTGGAATCACAC

TGAGTGGAGGTCAACGAGCAAGAATTTCTTTAGCAAGAGCAGTATACAAA

GATGCTGATTTGTATTTATTAGACTCTCCTTTTGGATACCTAGATGTTTT

AACAGAAAAGAAATATTTGAAAGCTGTGTCTGTAAACTGATGGCTAACA

AAACTAGGATTTTGGTCACTTCTAAAATGGAACATTTAAAGAAAGCTGAC

```
AAAATATTAATTTTGCATGAAGGTAGCAGCTATTTTTATGGGACATTTTC
AGAACTCCAAAATCTACAGCCAGACTTTAGCTCAAAACTCATGGGATGTG
ATTCTTTCGACCAATTTAGTGCAGAAAGAAGAAATTCAATCCTAACTGAG
ACCTTACACCGTTTCTCATTAGAAGGAGATGCTCCTGTCTCCTGGACAGA
AACAAAAAAACAATCTTTTAAACAGACTGGAGAGTTTGGGGAAAAAAGGA
AGAATTCTATTCTCAATCCAATCAACTCTATACGAAAATTTTCCATTGTG
CAAAAGACTCCCTTACAAATGAATGGCATCGAAGAGGATTCTGATGAGCC
TTTAGAGAGAAGGCTGTCCTTAGTACCAGATTCTGAGCAGGGAGAGGCGA
TACTGCCTCGCATCAGCGTGATCAGCACTGGCCCCACGCTTCAGGCACGA
AGGAGGCAGTCTGTCCTGAACCTGATGACACACTCAGTTAACCAAGGTCA
GAACATTCACCGAAAGACAACAGCATCCACACGAAAAGTGTCACTGGCCC
CTCAGGCAAACTTGACTGAACTGGATATATATTCAAGAAGGTTATCTCAA
GAAACTGGCTTGGAAATAAGTGAAGAAATTAACGAAGAAGACTTAAAGGA
GTGCTTTTTTGATGATATGGAGAGCATACCAGCAGTGACTACATGGAACA
CATACCTTCGATATATTACTGTCCACAAGAGCTTAATTTTTGTGCTAATT
TGGTGCTTAGTAATTTTTCTGGCAGAGGTGGCTGCTTCTTTGGTTGTGCT
GTGGCTCCTTGGAAACACTCCTCTTCAAGACAAAGGGAATAGTACTCATA
GTAGAAATAACAGCTATGCAGTGATTATCACCAGCACCAGTTCGTATTAT
GTGTTTTACATTTACGTGGGAGTAGCCGACACTTTGCTTGCTATGGGATT
CTTCAGAGGTCTACCACTGGTGCATACTCTAATCACAGTGTCGAAAATTT
TACACCACAAAATGTTACATTCTGTTCTTCAAGCACCTATGTCAACCCTC
AACACGTTGAAAGCAGGTGGGATTCTTAATAGATTCTCCAAAGATATAGC
AATTTTGGATGACCTTCTGCCTCTTACCATATTTGACTTCATCCAGTTGT
TATTAATTGTGATTGGAGCTATAGCAGTTGTCGCAGTTTTACAACCCTAC
ATCTTTGTTGCAACAGTGCCAGTGATAGTGGCTTTTATTATGTTGAGAGC
ATATTTCCTCCAAACCTCACAGCAACTCAAACAACTGGAATCTGAAGGCA
GGAGTCCAATTTTCACTCATCTTGTTACAAGCTTAAAAGGACTATGGACA
CTTCGTGCCTTCGGACGGCAGCCTTACTTTGAAACTCTGTTCCACAAAGC
TCTGAATTTACATACTGCCAACTGGTTCTTGTACCTGTCAACACTGCGCT
GGTTCCAAATGAGAATAGAAATGATTTTTGTCATCTTCTTCATTGCTGTT
ACCTTCATTTCCATTTTAACAACAGGAGAAGGAGAAGGAAGAGTTGGTAT
TATCCTGACTTTAGCCATGAATATCATGAGTACATTGCAGTGGGCTGTAA
ACTCCAGCATAGATGTGGATAGCTTGATGCGATCTGTGAGCCGAGTCTTT
AAGTTCATTGACATGCCAACAGAAGGTAAACCTACCAAGTCAACCAAACC
ATACAAGAATGGCCAACTCTCGAAAGTTATGATTATTGAGAATTCACACG
TGAAGAAAGATGACATCTGGCCCTCAGGGGGCCAAATGACTGTCAAAGAT
CTCACAGCAAAATACACAGAAGGTGGAAATGCCATATTAGAGAACATTTC
CTTCTCAATAAGTCCTGGCCAGAGGGTGGGCCTCTTGGGAAGAACTGGAT
CAGGGAAGAGTACTTTGTTATCAGCTTTTTTGAGACTACTGAACACTGAA
GGAGAAATCCAGATCGATGGTGTGTCTTGGGATTCAATAACTTTGCAACA
GTGGAGGAAAGCCTTTGGAGTGATACCACAGAAAGTATTTATTTTTTCTG
```

```
GAACATTTAGAAAAAACTTGGATCCCTATGAACAGTGGAGTGATCAAGAA
ATATGGAAAGTTGCAGATGAGGTTGGGCTCAGATCTGTGATAGAACAGTT
TCCTGGGAAGCTTGACTTTGTCCTTGTGGATGGGGGCTGTGTCCTAAGCC
ATGGCCACAAGCAGTTGATGTGCTTGGCTAGATCTGTTCTCAGTAAGGCG
AAGATCTTGCTGCTTGATGAACCCAGTGCTCATTTGGATCCAGTAACATA
CCAAATAATTAGAAGAACTCTAAAACAAGCATTTGCTGATTGCACAGTAA
TTCTCTGTGAACACAGGATAGAAGCAATGCTGGAATGCCAACAATTTTTG
GTCATAGAAGAGAACAAAGTGCGGCAGTACGATTCCATCCAGAAACTGCT
GAACGAGAGGAGCCTCTTCCGGCAAGCCATCAGCCCCTCCGACAGGGTGA
AGCTCTTTCCCCACCGGAACTCAAGCAAGTGCAAGTCTAAGCCCCAGATT
GCTGCTCTGAAAGAGGAGACAGAAGAAGAGGTGCAAGATACAAGGCTTTA
G
```

In an embodiment, to insert CFTR cDNA (e.g., CFTR exons 11 to 27) into intron 10, and concomitantly introduce a silent mutation to disrupt subsequent Cas9 binding and cleavage, the homology arms, e.g., the 5' and 3' homology arms, may be shorted to approximately 500 bp. The 5' homology arm is shown as bold sequence, the CRISPR-Cas9 binding site is shown as italicized sequence, the PAM site is underlined, the silent sense mutation in the PAM is shown as lower case underlined sequence, and the 3' homology arm is shown as no emphasis capitalized sequence.

(SEQ ID NO: 27343)
GATGGTGGCTTGATCCAGGTAGTAGTGGAAGTAGTATAGTAGGAAGTGAT
CAGATTCAGGACATGCTTTGAAGGAAGATCCAATAGGATTAATGGATAAG
TTGAACAATGGCATATGAGAAAAGTCACAGAGGAGTCAAAGATGATTCCA
AGCTTTCTGGACTGAGTAACTGGAAGGATAAATGTGCCGTTTACTAGAAA
GATAATGGGAGAAACAGGTTTTGGATGGAGCTTGGTTTGGGAATATTAAG
TTTGAAATGCCTATTTGACATCCAAATAGAGATGTTAGTTGGATGTACAA
GTCTAGTTTCAAGGAAGAGGGGGCTGGTAGTGTGAAGATGGGGCTGGATA
AGATTCTAAAGGAAAGAGGGTTGATAAGAAGAGAAAGGGGTGTAGGGGTT
AGCCTAAGGGCATTCTAAGTATTAGAGGTTAAGGAGGTGGGTGAAGAAAA
CCCAATAAAATAAAAGTCTGAGAAGACAAAGCT_AGTGAATGAATGTGGTA_
_TCCC_<ins>ttt</ins>_AACCCAACTGATGTCAAGCAGAAGGGTGTTATCAACTAGGTCAA_
ATGCTCATTCATCAAGTAAGATGAAACTGTTATAATTAACCGGTGTCTTC
TGAAATACGGAGATAACTCGTGACTTAATGAAAGCAATAGTAGAGAAGGT
CAAACTTGACCAGAATGAAATTAGAAAGAATAAGAGGAAAGAAAAGACCA
AATACAGACAACCATTGATGCCTTATTCTTTTGATATACTCCTGGAGTCC
ACTTGCTAATACAATTGACCCTTAAACAATACAGGCTTGAACTGCATGGG
TCCACTTATTTGTGAATTTTTTTCAGTTAATACATTGGAAAATTTTTGG
GGTTTTTTGACAATTTGAAAAAACTCACAAACTGTCTAGCCTAGAAATAC
CGAGAAATTAAGAAAAAGTAAGATATGCCATGAATGCATAAAATATATG
TAGACACTAGCCTATTTTATCATTTGCTACTATAAAATATACACAATCTA The underlined T has been changed from a G to T at that position so that wild-type CFTR is still transcribed, but the PAM sequence CGG has been modified to CTT to reduce or eliminate Cas9 cleavage at that locus.

V.2 NHEJ Approaches for Gene Targeting

As described herein, nuclease-induced non-homologous end-joining (NHEJ) can be used to target gene-specific knockouts. Nuclease-induced NHEJ can also be used to remove (e.g., delete) sequence insertions in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Placement of Double Strand or Single Strand Breaks Relative to the Target Position In an embodiment, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-30 bp away from the target position (e.g., less than 30, 25, 20, 15, 10, 9, 8, 7, 6, 5, 4, 3, 2 or 1 bp from the target position).

In an embodiment, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In an embodiment, the gRNAs are configured to position cuts at the same position, or within a few nucleotides of one another, on different strands, essentially mimicking a double strand break. In an embodiment, the closer nick is between 0-30 bp away from the target position (e.g., less than 30, 25, 20, 15, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

V.3 Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

V. 4 Other DNA Repair Pathways

SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, Nature Reviews Genetics 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways hace a common feature in that they typically recognize a lesion on one strand of the DNA, then exo/endonucleases remove the lesion and leave a 1-30 nucleotide gap that is sub-sequentially filled in by DNA polymerase and finally sealed with ligase. A more complete picture is given in Li, Cell Research (2008) 18:85-98, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutL α which possesses an ATPase activity and is important for multiple steps of MMR. It possesses a PCNA/replication factor C (RFC)-dependent endonuclease activity which plays an important role in 3' nick-directed MMR involving EXO1. (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Pol that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al., Nature Reviews Molecular Cell Biology 15, 465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA pol □ and Rev1.

Error-free postreplication repair (PRR) is another pathway for repairing a single stranded break left after a defective replication event.

V.5 Targeted Knockdown

Unlike CRISPR/Cas-mediated gene knockout, which permanently eliminates expression by mutating the gene at the DNA level, CRISPR/Cas knockdown allows for temporary reduction of gene expression through the use of artificial transcription factors. Mutating key residues in both DNA cleavage domains of the Cas9 protein (e.g. the D10A and H840A mutations) results in the generation of a catalytically inactive Cas9 (eiCas9 which is also known as dead Cas9 or dCas9) molecule. A catalytically inactive Cas9 complexes with a gRNA and localizes to the DNA sequence specified by that gRNA's targeting domain, however, it does not cleave the target DNA. Fusion of the dCas9 to an effector domain, e.g., a transcription repression domain, enables recruitment of the effector to any DNA site specified by the gRNA. Although an enzymatically inactive (eiCas9) Cas9 molecule itself can block transcription when recruited to early regions in the coding sequence, more robust repression can be achieved by fusing a transcriptional repression domain (for example KRAB, SID or ERD) to the Cas9 and recruiting it to the target knockdown position, e.g., within 1000 bp of sequence 3' of the start codon or within 500 bp of a promoter region 5' of the start codon of a gene. It is likely that targeting DNAseI hypersensitive sites (DHSs) of the promoter may yield more efficient gene repression or activation because these regions are more likely to be accessible to the Cas9 protein and are also more likely to harbor sites for endogenous transcription factors. Especially for gene repression, it is contemplated herein that blocking the binding site of an endogenous transcription factor would aid in downregulating gene expression. In an embodiment, one or more eiCas9 molecules may be used to block binding of one or more endogenous transcription factors. In another embodiment, an eiCas9 molecule can be fused to a chromatin modifying protein. Altering chromatin status can result in decreased expression of the target gene. One or more eiCas9 molecules fused to one or more chromatin modifying proteins may be used to alter chromatin status.

In an embodiment, a gRNA molecule can be targeted to a known transcription response elements (e.g., promoters, enhancers, etc.), a known upstream activating sequences (UAS), and/or sequences of unknown or known function that are suspected of being able to control expression of the target DNA.

CRISPR/Cas-mediated gene knockdown can be used to reduce expression of an unwanted allele or transcript. Contemplated herein are scenarios wherein permanent destruction of the gene is not ideal. In these scenarios, site-specific repression may be used to temporarily reduce or eliminate expression. It is also contemplated herein that the off-target effects of a Cas-repressor may be less severe than those of a Cas-nuclease as a nuclease can cleave any DNA sequence and cause mutations whereas a Cas-repressor may only have an effect if it targets the promoter region of an actively transcribed gene. However, while nuclease-mediated knockout is permanent, repression may only persist as long as the Cas-repressor is present in the cells. Once the repressor is no longer present, it is likely that endogenous transcription factors and gene regulatory elements would restore expression to its natural state.

V.6 Examples of gRNAs in Genome Editing Methods gRNA molecules as described herein can be used with Cas9 molecules that generate a double strand break or a single strand break to alter the sequence of a target nucleic acid, e.g., a target position or target genetic signature. gRNA molecules useful in these methods are described below.

In an embodiment, the gRNA, e.g., a chimeric gRNA, is configured such that it comprises one or more of the following properties;

a) it can position, e.g., when targeting a Cas9 molecule that makes double strand breaks, a double strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c)
- (i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;
- (ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
- (iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5, 6, 7, 8, 9 or 10 nucleotides therefrom;
- iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain; or, or a sequence that differs by no more than 1, 2, 3, 4, 5, 6, 7, 8, 9 or 10 nucleotides therefrom; or
- (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(iii), and c(i).

In an embodiment, the gRNA is configured such that in comprises properties: a(i), b(iii), and c(ii).

In an embodiment, the gRNA, e.g., a chimeric gRNA, is configured such that it comprises one or more of the following properties;

a) it can position, e.g., when targeting a Cas9 molecule that makes single strand breaks, a single strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c)
- (i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5, 6, 7, 8, 9 or 10 nucleotides therefrom;
- (ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5, 6, 7, 8, 9 or 10 nucleotides therefrom;
- (iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
- iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain; or, a sequence that differs by no more than 1, 2, 3, 4, 5, 6, 7, 8, 9 or 10 nucleotides therefrom; or
- (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(iii), and c(i).

In an embodiment, the gRNA is configured such that in comprises properties: a(i), b(iii), and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment, the gRNAs are used with a Cas9 nickase molecule having RuvC activity, e.g., a Cas9 molecule having the HNH activity inactivated, e.g., a Cas9 molecule having a mutation at N863, e.g., an N863A mutation.

In an embodiment, a pair of gRNAs, e.g., a pair of chimeric gRNAs, comprising a first and a second gRNA, is configured such that they comprises one or more of the following properties;

a) one or both of the gRNAs can position, e.g., when targeting a Cas9 molecule that makes single strand breaks, a single strand break within (i) 50, 100, 150 or 200 nucleotides of a target position, or (ii) sufficiently close that the target position is within the region of end resection;

b) one or both have a targeting domain of at least 17 nucleotides, e.g., a targeting domain of (i) 17 or (ii) 18 nucleotides;

c) for one or both:
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring S. pyogenes, S. thermophilus, S. aureus, or N. meningitidis tail and proximal domain, or a sequence that differs by no more than 1, 2, 3, 4, 5, 6, 7, 8, 9 or 10 nucleotides therefrom;
(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring S. pyogenes, S. thermophilus, S. aureus, or N. meningitidis gRNA, or a sequence that differs by no more than 1, 2, 3, 4, 5, 6, 7, 8, 9 or 10 nucleotides therefrom;
(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring S. pyogenes, S. thermophilus, S. aureus, or N. meningitidis gRNA, or a sequence that differs by no more than 1, 2, 3, 4, 5; 6, 7, 8, 9 or 10 nucleotides therefrom;
iv) the tail domain is at least 10, 15, 20, 25, 30, 35 or 40 nucleotides in length, e.g., it comprises at least 10, 15, 20, 25, 30, 35 or 40 nucleotides from a naturally occurring S. pyogenes, S. thermophilus, S. aureus, or N. meningitidis tail domain; or, or a sequence that differs by no more than 1, 2, 3, 4, 5, 6, 7, 8, 9 or 10 nucleotides therefrom; or
(v) the tail domain comprises 15, 20, 25, 30, 35, 40 nucleotides or all of the corresponding portions of a naturally occurring tail domain, e.g., a naturally occurring S. pyogenes, S. thermophilus, S. aureus, or N. meningitidis tail domain;

d) the gRNAs are configured such that, when hybridized to target nucleic acid, they are separated by 0-50, 0-100, 0-200, at least 10, at least 20, at least 30 or at least 50 nucleotides;

e) the breaks made by the first gRNA and second gRNA are on different strands; and f) the PAMs are facing outwards.

In an embodiment, one or both of the gRNAs is configured such that it comprises properties: a and b(i).

In an embodiment, one or both of the gRNAs is configured such that it comprises properties: a and b(ii).

In an embodiment, one or both of the gRNAs is configured such that it comprises properties: a and b(iii).

In an embodiment, one or both of the gRNAs configured such that it comprises properties: a and c.

In an embodiment, one or both of the gRNAs is configured such that in comprises properties: a, b, and c.

In an embodiment, one or both of the gRNAs is configured such that in comprises properties: a(i), b(i), and c(i).

In an embodiment, one or both of the gRNAs is configured such that in comprises properties: a(i), b(i), and c(ii).

In an embodiment, one or both of the gRNAs is configured such that in comprises properties: a(i), b(i), c, and d.

In an embodiment, one or both of the gRNAs is configured such that in comprises properties: a(i), b(i), c, and e.

In an embodiment, one or both of the gRNAs is configured such that in comprises properties: a(i), b(i), c, d, and e.

In an embodiment, one or both of the gRNAs is configured such that in comprises properties: a(i), b(iii), and c(i).

In an embodiment, one or both of the gRNAs is configured such that in comprises properties: a(i), b(iii), and c(ii).

In an embodiment, one or both of the gRNAs is configured such that in comprises properties: a(i), b(iii), c, and d.

In an embodiment, one or both of the gRNAs is configured such that in comprises properties: a(i), b(iii), c, and e.

In an embodiment, one or both of the gRNAs is configured such that in comprises properties: a(i), b(iii), c, d, and e.

In an embodiment, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNAs are used with a Cas9 nickase molecule having RuvC activity, e.g., a Cas9 molecule having the HNH activity inactivated, e.g., a Cas9 molecule having a mutation at H840, e.g., a H840A.

In an embodiment, the gRNAs are used with a Cas9 nickase molecule having RuvC activity, e.g., a Cas9 molecule having the HNH activity inactivated, e.g., a Cas9 molecule having a mutation at N863, e.g., a N863A mutation.

VI. Target Cells

Cas9 molecules, gRNA molecules (e.g., a Cas9 molecule/gRNA molecule complex), and donor nucleic acids can be used to manipulate a cell, e.g., to edit a target nucleic acid, in a wide variety of cells.

In an embodiment, a cell is manipulated by editing (e.g., correcting or introducing a mutation in) the CFTR and/or SCNN1A target genes, e.g., as described herein. In an embodiment, the expression of the CFTR and/or SCNN1A target genes is modulated, e.g., in vivo. In another embodiment, the expression of the CFTR and/or SCNN1A target genes is modulated, e.g., ex vivo.

The Cas9 and gRNA molecules described herein can be delivered to a target cell. Methods and compositions discussed herein, provide for treating or delaying the onset or progression of diseases of the lung and airways, including the nose, trachea, bronchus, bronchioles, alveoli, submucosal ducts and submucosal glands. In an embodiment, the target cell is an airway cell, e.g., a nasal epithelial cell, e.g., a tracheal epithelial cell. In an embodiment, the target cell is a lung epithelial cell, e.g., a bronchial epithelial cell, e.g., a proximal bronchial epithelial cell, e.g., a bronchiolar epithelial cell, e.g., an alveolar epithelial cell, e.g., a clara cell, e.g., a ciliated cell, e.g., a goblet cell, e.g., a basal cell, e.g., an acinus cell. Methods and compositions discussed herein, provide for treating or delaying the onset or progression of diseases of the gastrointestinal tract, including pancreas, bile ducts, gallbladder, small intestine, large intestine and salivary glands. In an embodiment, the target cell is a gastrointestinal epithelial cell. In an embodiment, the target cell is a biliary epithelial cell. In an embodiment, the target cell is a pancreatic ductal epithelial cell. In an embodiment, the target cell is a gastrointestinal cell, e.g., an enteroendocrine cell, e.g., a Brunner's gland cell. In an embodiment, the target cell is a hepatobiliary epithelial cell. In an embodiment, the target cell is a gallbladder epithelial cell. In an embodiment, the target cell is a large intestine epithelial cell. In an embodiment, the target cell is a small intestine epithelial cell. In an embodiment, the target cell is a jejunum epithelial cell. In an embodiment, the target cell is an epithelial cell of the iluem. In an embodiment, the target cell is a duodenum epithelial cell. Methods and compositions discussed herein, provide for treating or delaying the onset or progression of diseases of the reproductive tract, including the epididymis. In an embodiment, the target cell is a reproductive epithelial cell, e.g. an epididymal epithelial cell. In an embodiment, the target cell is a pulmonary stem cell. In an embodiment, the target cell is a gastrointestinal stem cell.

In an embodiment, the target cell is manipulated ex vivo by editing (e.g., correcting or introducing a mutation in) the CFTR and/or SCNN1A target genes and/or modulating the expression of the CFTR and/or SCNN1A target genes, and administered to the subject. A suitable cell for such manipulation can include a stem cell such as, by way of example, an embryonic stem cell, an induced pluripotent stem cell, a pulmonary stem cell, a gastrointestinal stem cell and a mesenchymal stem cell. In an embodiment, the cell is an induced pluripotent stem cell (iPS) cell or a cell derived from an iPS cell, e.g., an iPS cell generated from the subject, modified to correct or introduce the mutation and differentiated into a clinically relevant cell such as a pulmonary stem cell, a gastrointestinal stem cell, a pulmonary epithelial cell, a bronchial epithelial cell, a proximal bronchial epithelial cell, a bronchiolar epithelial cell, an alveolar epithelial cell, a clara cell, a ciliated cell, a goblet cell, a basal cell, an acinus cell, a gastrointestinal epithelial cell, a biliary epithelial cell, a pancreatic ductal epithelial cell, a hepatobiliary epithelial cell, an enteroendocrine cell, a Brunner's gland cell, a reproductive epithelial cell, or an epididymal epithelial cell.

VII. Delivery, Formulations and Routes of Administration

The components, e.g., a Cas9 molecule and gRNA molecule (e.g., a Cas9 molecule/gRNA molecule complex), and a donor template nucleic acid can be delivered or formulated in a variety of forms, see, e.g., Tables 56-57. In an embodiment, one Cas9 molecule and two or more (e.g., 2, 3, 4, or more) different gRNA molecules are delivered, e.g., by an AAV vector. In an embodiment, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 or gRNA component is encoded as DNA for delivery, the DNA will typically but not necessarily include a control region, e.g., comprising a promoter, to effect expression. Useful promoters for Cas9 molecule sequences include CMV, EFS, EF-1a, MSCV, PGK, CAG control promoters. In an embodiment, the promoter is a constitutive promoter. In another embodiment, the promoter is a tissue specific promoter. Useful promoters for gRNAs include H1, 7SK, tRNA and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment, the sequence encoding a Cas9 molecule comprises at least two nuclear localization signals. In an embodiment a promoter for a Cas9 molecule or a gRNA molecule can be, independently, inducible, tissue specific, or cell specific.

Table 56 provides examples of how the components can be formulated, delivered, or administered.

TABLE 56

| Cas9 Molecule(s) | gRNA Molecule(s) | Donor Template Nucleic Acid | Comments |
| --- | --- | --- | --- |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided as a separate DNA molecule. |
| DNA | DNA | | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the gRNA. |

TABLE 56-continued

| Cas9 Molecule(s) | gRNA Molecule(s) | Donor Template Nucleic Acid | Comments |
|---|---|---|---|
| DNA | | DNA | In this embodiment, a Cas9 molecule, typically an eaCas9 molecule, and a gRNA are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the Cas9. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided as a separate DNA molecule. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided on the same DNA molecule that encodes the Cas9. |
| mRNA | RNA | DNA | In this embodiment, a Cas9 molecule, typically an eaCas9 molecule, is translated from in vitro transcribed mRNA, and a gRNA is provided as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed mRNA, and a gRNA is transcribed from DNA. In this embodiment, the donor template is provided as a separate DNA molecule. |
| mRNA | DNA | | In this embodiment, a Cas9 molecule, typically an eaCas9 molecule, is translated from in vitro transcribed mRNA, and a gRNA is transcribed from DNA. In this embodiment, the donor template is provided on the same DNA molecule that encodes the gRNA. |
| Protein | DNA | DNA | In this embodiment, a Cas9 molecule, typically an eaCas9 molecule, is provided as a protein, and a gRNA is transcribed from DNA. In this embodiment, the donor template is provided as a separate DNA molecule. |
| Protein | DNA | | In this embodiment, a Cas9 molecule, typically an eaCas9 molecule, is provided as a protein, and a gRNA is transcribed from DNA. In this embodiment, the donor template is provided on the same DNA molecule that encodes the gRNA. |
| Protein | RNA | DNA | In this embodiment, an eaCas9 molecule is provided as a protein, and a gRNA is provided as transcribed or synthesized RNA. In this embodiment, the donor template is provided as a DNA molecule. |

Table 57 summarizes various delivery methods for the components of a Cas system, e.g., the Cas9 molecule component and the gRNA molecule component, as described herein.

TABLE 57

| Delivery Vector/Mode | | Delivery into Non-Dividing Cells | Duration of Expression | Genome Integration | Type of Molecule Delivered |
|---|---|---|---|---|---|
| Physical (eg, electroporation, particle gun, Calcium Phosphate transfection, cell compression or squeezing) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cas9 Molecule and/or One or More gRNA Molecule

Nucleic acids encoding Cas9 molecules (e.g., eaCas9 molecules), gRNA molecules, a donor template nucleic acid, or a combination thereof, can be administered to subjects or delivered into cells by art-known methods or as described herein. For example, Cas9-encoding and/or gRNA-encoding DNA, as well as donor nucleic acids can be delivered, e.g., by vectors (e.g., viral or non-viral vectors), non-vector based methods (e.g., using naked DNA or DNA complexes), or a combination thereof.

DNA encoding Cas9 molecules (e.g., eaCas9 molecules) and/or gRNA molecules, as well as template nucleic acids, can be conjugated to molecules (e.g., N-acetylgalactosamine), thereby promoting uptake by the target cells (e.g., the target cells described herein).

In some embodiments, the Cas9- and/or gRNA-encoding DNA is delivered by a vector (e.g., viral vector/virus or plasmid). In some embodiments the donor nucleic acid is delivered by a vector (e.g., a viral vector/virus or plasmid).

A vector can comprise a sequence that encodes a Cas9 molecule and/or a gRNA molecule. A vector can comprise a donor nucleic acid. A vector can also comprise a sequence encoding a signal peptide (e.g., for nuclear localization, nucleolar localization, mitochondrial localization), fused, e.g., to a Cas9 molecule sequence. For example, ae vector can comprise a nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

Exemplary viral vectors/viruses include, e.g., retroviruses, lentiviruses, adenovirus, adeno-associated virus (AAV), vaccinia viruses, poxviruses, and herpes simplex viruses.

In some embodiments, the Cas9- and/or gRNA-encoding sequence is delivered by a recombinant retrovirus. In some embodiments, the donor nucleic acid is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one or more coding regions for the genes necessary for additional rounds of virion replication and packaging replaced with other genes, or deleted.

In some embodiments, the Cas9- and/or gRNA-encoding sequence is delivered by a recombinant lentivirus. In some embodiments, the donor nucleic acid is delivered by a recombinant lentivirus. For example, the lentivirus is replication-defective, e.g., does not comprise one or more genes required for viral replication.

In some embodiments, the Cas9- and/or gRNA-encoding sequence is delivered by a recombinant adenovirus. In some embodiments, the donor nucleic acid is delivered by a recombinant adenovirus. In some embodiments, the adenovirus is engineered to have reduced immunity in human.

In some embodiments, the Cas9- and/or gRNA-encoding DNA is delivered by a recombinant AAV. In some embodiments, the AAV does not incorporate its genome into that of a host cell, e.g., a target cell as describe herein. In some embodiments, the AAV can incorporate at least part of its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh 10, and pseudotyped AAV, such as AAV2/8, AAV2/5 and AAV2/6 can also be used in the disclosed methods. In an embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8.

In an embodiment, the Cas9- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In an embodiment, the Cas9- and/or gRNA-encoding DNA is delivered by a chimeric AAV capsid. In an embodiment, the donor nucleic acid is delivered by a chimeric AAV capsid. Exemplary chimeric AAV capsids include, but are not limited to, AAV9i1, AAV2i8, AAV-DJ, AAV2G9, AAV2i8G9, or AAV8G9.

In an embodiment, the AAV is a self-complementary adeno-associated virus (scAAV), e.g., a scAAV that packages both strands which anneal together to form double stranded DNA.

In some embodiments, the Cas9- and/or gRNA-encoding DNA is delivered by a hybrid virus, e.g., a hybrid of one or more of the viruses described herein. In an embodiment, the hybrid virus is hybrid of an AAV (e.g., of any AAV serotype), with a Bocavirus, B19 virus, porcine AAV, goose AAV, feline AAV, canine AAV, or MVM.

A Packaging cell is used to form a virus particle that is capable of infecting a target cell. Such a cell includes a 293 cell, which can package adenovirus, and a ψ2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, e.g. Cas9. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In embodiment, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the helper plasmid with ITRs. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibodies, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutin (HA) can be incorporated to increase viral uptake into cells. In an embodiment, the viral vector has the ability of nuclear localization. For example, a virus that requires the breakdown of the nuclear envelope (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (e.g., as described in Lee, et al [2012] Nano Lett 12: 6322-27), gene gun, sonoporation, magnetofection, lipid-mediated transfection, dendrimers, inorganic nanoparticles, calcium phosphates, or a combination thereof.

In an embodiment, delivery via electroporation comprises mixing the cells with the Cas9- and/or gRNA-encoding DNA in a cartridge, chamber or cuvette and applying one or more electrical impulses of defined duration and amplitude. In an embodiment, delivery via electroporation is performed using a system in which cells are mixed with the Cas9- and/or gRNA-encoding DNA in a vessel connected to a device (e.g., a pump) which feeds the mixture into a cartridge, chamber or cuvette wherein one or more electrical impulses of defined duration and amplitude are applied, after which the cells are delivered to a second vessel.

In some embodiments, the Cas9- and/or gRNA-encoding DNA is delivered by a combination of a vector and a non-vector based method. In some embodiments, the donor nucleic acid is delivered by a combination of a vector and a non-vector based method. For example, a virosome comprises a liposome combined with an inactivated virus (e.g., HIV or influenza virus), which can result in more efficient gene transfer, e.g., in a respiratory epithelial cell than either a viral or a liposomal method alone.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle. Exemplary organic nanoparticles include, e.g., SNALP liposomes (e.g., SNALP liposomes that contain cationic lipids together with neutral helper lipids and polyethylene glycol (PEG)-conjugated lipids) and protamine-nucleic acid complexes, e.g., protamine-nucleic acid complexes coated with lipid coating.

Exemplary lipids for gene transfer are shown below in Table 58.

TABLE 58

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |

TABLE 58-continued

Lipids Used for Gene Transfer

| Lipid | Abbreviation | Feature |
|---|---|---|
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 59.

TABLE 59

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovesicle (30-100 nm) of endocytic origin (e.g., can be produced from various cell types and can therefore be taken up by cells without the need of for targeting ligands).

In an embodiment, the delivery vehicle is a powder comprising, e.g., calcium carbonate, sucrose, mannitol, dextrose, or lactose.

In an embodiment, components are delivered as an aerosol.

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA Encoding a Cas9 Molecule

RNA encoding Cas9 molecules (e.g., eaCas9 molecules or eiCas9 molecules) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, transient cell compression or squeezing (e.g., as described in Lee, et al [2012] *Nano Lett* 12: 6322-27), lipid-mediated transfection, lipid-mediated transfection, peptide-mediated delivery, or a combination thereof. Cas9-encoding and/or gRNA-encoding RNA can be conjugated to molecules promoting uptake by the target cells (e.g., target cells described herein).

In an embodiment, delivery via electroporation comprises mixing the cells with the RNA encoding Cas9 molecules (e.g., eaCas9 molecules, eiCas9 molecules or eiCas9 fusion proteins) and/or gRNA molecules, with or without donor nucleic acid molecules in a cartridge, chamber or cuvette and applying one or more electrical impulses of defined duration and amplitude. In an embodiment, delivery via electroporation is performed using a system in which cells are mixed with the RNA encoding Cas9 molecules (e.g., eaCas9 molecules, eiCas9 molecules or eiCas9 fusion proteins) and/or gRNA molecules, with or without donor nucleic acid molecules in a vessel connected to a device (e.g., a pump) which feeds the mixture into a cartridge, chamber or cuvette wherein one or more electrical impulses of defined duration and amplitude are applied, after which the cells are delivered to a second vessel.

Delivery Cas9 Molecule Protein

Cas9 molecules (e.g., eaCas9 molecules or eiCas9 molecules) can be delivered into cells by art-known methods or as described herein. For example, Cas9 protein molecules can be delivered, e.g., by microinjection, electroporation, lipid-mediated transfection, peptide-mediated delivery, or a combination thereof. Delivery can be accompanied by DNA encoding a gRNA or by a gRNA. Cas9 protein can be conjugated to molecules promoting uptake by the target cells (e.g., target cells described herein).

In an embodiment, delivery via electroporation comprises mixing the cells with the Cas9 molecules (e.g., eaCas9 molecules, eiCas9 molecules or eiCas9 fusion proteins) and/or gRNA molecules, with or without donor nucleic acid, in a cartridge, chamber or cuvette and applying one or more electrical impulses of defined duration and amplitude. In an embodiment, delivery via electroporation is performed using a system in which cells are mixed with the Cas9 molecules (e.g., eaCas9 molecules, eiCas9 molecules or eiCas9 fusion proteins) and/or gRNA molecules, with or without donor nucleic acid in a vessel connected to a device (e.g., a pump) which feeds the mixture into a cartridge, chamber or cuvette wherein one or more electrical impulses of defined duration and amplitude are applied, after which the cells are delivered to a second vessel.

Route of Administration

Systemic modes of administration include oral and parenteral routes. Parenteral routes include, by way of example, intravenous, intra-arterial, intraosseous, intramuscular, intradermal, subcutaneous and intraperitoneal routes. Components administered systemically may be modified or formulated to target the components to specific cells, e.g., airway epithelial cells, pulmonary epithelial cells, gastrointestinal epithelial cells, biliary epithelial cells, pancreatic ductal epithelial cells, reproductive epithelial cells or pulmonary stem cells.

Local modes of administration include, by way of example, inhalation, intra-nasal instillation, and intraparenchymal injection, e.g., intraparenchymal injection into the lung, bronchial tree, liver, pancreas, pancreatic duct, bile duct, gastrointestinal tract or reproductive tract. In an embodiment, significantly smaller amounts of the components (compared with systemic approaches) may exert an effect when administered locally (for example, by inhalation) compared to when administered systemically (for example, intravenously). Local modes of administration can reduce or eliminate the incidence of potentially toxic side effects that may occur when therapeutically effective amounts of a component are administered systemically.

In an embodiment, components described herein are delivered by inhalation.

In an embodiment, nanoparticle or viral, e.g., AAV vector, delivery is via inhalation.

In an embodiment, subjects are treated with mucus loosening agents and/or chest physical therapy prior to administration of components by inhalation.

Administration may be provided as a periodic bolus or as continuous infusion from an internal reservoir or from an external reservoir (for example, from an intravenous bag). Components may be administered locally, for example, by continuous release from a sustained release drug delivery device.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly(caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly(ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly(vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for injection. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, or template nucleic acid. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno-associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmcokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. E.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment, the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

Ex Vivo Delivery

In some embodiments, components described in Table 56 are introduced into cells which are then introduced into the subject e.g., cells are removed from a subject, manipulated ex vivo and then introduced into the subject. Methods of introducing the components can include, e.g., any of the delivery methods described herein, e.g., any of the delivery methods described in Table 57.

VIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications
The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), O(CH$_2$CH$_2$O)$_n$CH$_2$CH$_2$OR wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a C$_{1-6}$ alkylene or C$_{1-6}$ heteroalkylene bridge, to the 4' carbon of the same ribose sugar, where exemplary bridges can include methylene, propylene, ether, or amino bridges; O-amino (wherein amino can be, e.g., NH$_2$; alkylamino, dialkylamino, heterocyclyl, arylamino, diarylamino, heteroarylamino, or diheteroarylamino, ethylenediamine, or polyamino) and aminoalkoxy, O(CH$_2$)$_n$-amino, (wherein amino can be, e.g., NH$_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), (OCH$_2$CH$_2$OCH$_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., NH$_2$; alkylamino, dialkylamino, heterocyclyl, arylamino, diarylamino, heteroarylamino, diheteroarylamino, or amino acid); NH(CH$_2$CH$_2$NH)$_n$CH$_2$CH$_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s2U), 5-propynyl-uridine, 1-propynyl-pseudouridine, 5-taurinomethyl-uridine (τcm$^5$U), 1-taurinomethyl-pseudouridine, 5-taurinomethyl-2-thio-uridine (τm$^5$s2U), 1-taurinomethyl-4-thio-pseudouridine, 5-methyl-uridine (m$^5$U, i.e., having the nucleobase deoxythymine), 1-methyl-pseudouridine (m$^1$ψ), 5-methyl-2-thio-uridine (m$^5$s2U), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp$^3$U), 1-methyl-3-(3-amino-3-carboxypropyl) pseudouridine (acp$^3$ψ), 5-(isopentenylaminomethyl)uridine (inm$^5$U), 5-(isopentenylaminomethyl)-2-thio-uridine (inm$^5$s2U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s2Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl-2'-O-methyl-uridine (cmnm$^5$Um), 3,2'-O-dimethyl-uridine (m$^3$Um), 5-(isopentenylaminomethyl)-2'-O-methyl-uridine (inm$^5$Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine ($m^3C$), N4-acetyl-cytidine (ac), 5-formyl-cytidine ($f^5C$), N4-methyl-cytidine ($m^4C$), 5-methyl-cytidine ($m^5C$), 5-halo-cytidine (e.g., 5-iodo-cytidine), 5-hydroxymethyl-cytidine ($hm^5C$), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine ($k^2C$), α-thio-cytidine, 2'-O-methyl-cytidine (Cm), 5,2'-O-dimethyl-cytidine ($m^5Cm$), N4-acetyl-2'-O-methyl-cytidine ($ac^4Cm$), N4,2'-O-dimethyl-cytidine ($m^4Cm$), 5-formyl-2'-O-methyl-cytidine ($f^5Cm$), N4,N4,2'-O-trimethyl-cytidine ($m^4_2Cm$), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenosine, 7-deaza-8-aza-adenosine, 7-deaza-2-amino-purine, 7-deaza-8-aza-2-amino-purine, 7-deaza-2,6-diaminopurine, 7-deaza-8-aza-2,6-diaminopurine, 1-methyl-adenosine ($m^1A$), 2-methyl-adenosine ($m^2A$), N6-methyl-adenosine ($m^6A$), 2-methylthio-N6-methyl-adenosine (ms2 $m^6A$), N6-isopentenyl-adenosine ($i^6A$), 2-methylthio-N6-isopentenyl-adenosine ($ms^2i^6A$), N6-(cis-hydroxyisopentenyl)adenosine ($io^6A$), 2-methyl-thio-N6-(cis-hydroxyisopentenyl)adenosine ($ms2io^6A$), N6-glycinylcarbamoyl-adenosine ($g^6A$), N6-threonylcarbamoyl-adenosine ($t^6A$), N6-methyl-N6-threonylcarbamoyl-adenosine 2-methylthio-N6-threonylcarbamoyl-adenosine ($ms^2g^6A$), N6,N6-dimethyl-adenosine ($m^6_2A$), N6-hydroxynorvalylcarbamoyl-adenosine ($hn^6A$), 2-methylthio-N6-hydroxynorvalylcarbamoyl-adenosine ($ms2hn^6A$), N6-acetyl-adenosine ($ac^6A$), 7-methyl-adenosine, 2-methylthio-adenosine, 2-methoxy-adenosine, α-thio-adenosine, 2'-O-methyl-adenosine (Am), $N^6$,2'-O-dimethyl-adenosine ($m^6Am$), $N^6$-Methyl-2-deoxyadenosine, N6,N6,2'-O-trimethyl-adenosine ($m^6_2Am$), 1,2'-O-dimethyl-adenosine ($m^1Am$), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine ($m^1I$), wyosine (imG), methyl-wyosine (mimG), 4-demethyl-wyosine (imG-14), isowyosine (imG2), wybutosine (yW), peroxywybutosine ($o_2yW$), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine ($preQ_0$), 7-aminomethyl-7-deaza-guanosine ($preQ_1$), archaeosine ($G^+$), 7-deaza-8-aza-guanosine, 6-thio-guanosine, 6-thio-7-deaza-guanosine, 6-thio-7-deaza-8-aza-guanosine, 7-methyl-guanosine ($m^7G$), 6-thio-7-methyl-guanosine, 7-methyl-inosine, 6-methoxy-guanosine, 1-methyl-guanosine (m'G), N2-methyl-guanosine ($m^2G$), N2,N2-dimethyl-guanosine ($m^2_2G$), N2,7-dimethyl-guanosine ($m^2,7G$), N2,N2,7-dimethyl-guanosine ($m^2,2,7G$), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine ($m^2Gm$), N2,N2-dimethyl-2'-O-methyl-guanosine ($m^2_2Gm$), 1-methyl-2'-O-methyl-guanosine (m'Gm), N2,7-dimethyl-2'-O-methyl-guanosine ($m^2,7Gm$), 2'-O-methyl-inosine (Im), 1,2'-O-dimethyl-inosine (m'Im), $O^6$-phenyl-2'-deoxyinosine, 2'-O-ribosylguanosine (phosphate) (Gr(p)), 1-thio-guanosine, $O^6$-methyl-guanosine, $O^6$-Methyl-2'-deoxyguanosine, 2'-F-ara-guanosine, and 2'-F-guanosine.

Exemplary Modified gRNAs

In some embodiments, the modified nucleic acids can be modified gRNAs. It is to be understood that any of the gRNAs described herein can be modified in accordance with this section, including any gRNA that comprises a targeting domain from Tables 1A-1E, 2A-2E, 3A-3D, 4A-4D, 5A-5E, 6A-6C, 7A-7D, 8A-8E, 9A-9B, 10A-10C, 11A-11E, 12A-12C, 13A-13D, 14A-14E, 15A-15C, or 16A-16D, 17A-17E, 18A-18C, 19A-19D, 20A-20E, 21A-21B, 22A-22D, 23A-23E, 24A-24D, 25A-25D, 26A-26E, 27A-27D, 28A-28D, 29A-29E, 30A-30B, 31A-31D, 32A-32D, 33A-33B, 34A-34D, 35A-35D, 36A-36D, 37A-37D, 38A-38E, 39A-39D, 40A-40D, 41A-41E, 42A-42D, 43A-43E, 44A-44G, 45A-45E, 46A-46E, 47A-47G, or 48A-48E.

Through experimentation (results not shown) we have found that the guide RNA (gRNA) component of the CRISPR/Cas system is more efficient at editing genes in T cells when it has been modified at or near its 5' end (e.g., when the 5' end of a gRNA is modified by the inclusion of a eukaryotic mRNA cap structure or cap analog). While not wishing to be bound by theory it is believed that these and other modified gRNAs described herein elicit a reduced innate immune response from certain circulatory cell types (e.g., T cells) and that this might be responsible for the observed improvements. The present invention encompasses the realization that minimizing the innate immune response of circulating cells (e.g., T cells) to gRNAs could be advantageous when using gRNAs to edit circulating cells (whether ex vivo or in vivo) and could also be advantageous when using gRNAs to edit non-circulating cells, e.g., when a gRNA is administered systemically or locally for in vivo gene editing purposes. The present invention also encompasses the realization that the improvements observed with a 5' capped gRNA can be extended to gRNAs that have been modified in other ways to achieve the same type of structural or functional result (e.g., by the inclusion of modified nucleosides or nucleotides, or when an in vitro transcribed gRNA is modified by treatment with a phosphatase such as calf intestinal alkaline phosphatase to remove the 5' triphosphate group). While not wishing to be bound by theory, in some embodiments, the modified gRNAs described herein may contain one or more modifications (e.g., modified nucleosides or nucleotides) which introduce stability toward nucleases (e.g., by the inclusion of modified nucleosides or nucleotides and/or a 3' polyA tract).

Thus, in one aspect, methods and compositions discussed herein provide methods and compositions for gene editing by using gRNAs which have been modified at or near their 5' end (e.g., within 1-10, 1-5, or 1-2 nucleotides of their 5' end). In an embodiment, the 5' end of a gRNA is modified by the inclusion of a eukaryotic mRNA cap structure or cap analog (e.g., a G(5)ppp(5)G cap analog, a m7G(5)ppp(5)G cap analog, or a 3'-O-Me-m7G(5)ppp(5)G anti reverse cap analog (ARCA)). The cap or cap analog can be included during either chemical synthesis or in vitro transcription of the gRNA. In an embodiment, an in vitro transcribed gRNA is modified by treatment with a phosphatase (e.g., calf intestinal alkaline phosphatase) to remove the 5' triphosphate group.

In another aspect, methods and compositions discussed herein provide methods and compositions for gene editing by using gRNAs which include one or more modified nucleosides or nucleotides that are described herein. In some embodiments, the inclusion of the one or more modified nucleosides or nucleotides causes the gRNA to elicit a reduced innate immune response in certain circulating cell types (e.g., T cells, macrophages, dendritic cells, and/or B cells) as compared to an otherwise unmodified gRNA.

While some of the exemplary modifications discussed in this section may be included at any position within the gRNA sequence, in some embodiments, a gRNA comprises a modification at or near its 5' end (e.g., within 1-10, 1-5, or 1-2 nucleotides of its 5' end). In some embodiments, a gRNA comprises a modification at or near its 3' end (e.g., within 1-10, 1-5, or 1-2 nucleotides of its 3' end). In some embodiments, a gRNA comprises both a modification at or near its 5' end and a modification at or near its 3' end.

In an embodiment, the 3' end of a gRNA is modified by the addition of one or more (e.g., 25-200) adenine (A) residues. The polyA tract can be contained in the nucleic acid (e.g., plasmid, PCR product, viral genome) encoding the gRNA, or can be added to the gRNA during chemical synthesis, or following in vitro transcription using a polyadenosine polymerase (e.g., E. coli Poly(A)Polymerase).

In an embodiment, in vitro transcribed gRNA contains both a 5' cap structure or cap analog and a 3' polyA tract. In an embodiment, an in vitro transcribed gRNA is modified by treatment with a phosphatase (e.g., calf intestinal alkaline phosphatase) to remove the 5' triphosphate group and comprises a 3' polyA tract.

In some embodiments, gRNAs can be modified at a 3' terminal U ribose. For example, the two terminal hydroxyl groups of the U ribose can be oxidized to aldehyde groups and a concomitant opening of the ribose ring to afford a modified nucleoside as shown below:

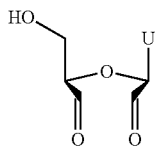

wherein "U" can be an unmodified or modified uridine.

In another embodiment, the 3' terminal U can be modified with a 2'3' cyclic phosphate as shown below:

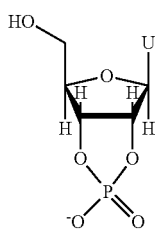

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines, cytidines and guanosines can be replaced with modified adenosines, cytidines and guanosines, e.g., with modifications at the 8-position, e.g., 8-bromo guanosine, or with any of the modified adenosines, cytidines or guanosines described herein.

In some embodiments, sugar-modified ribonucleotides can be incorporated into the gRNA, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclylamino, arylamino, diarylamino, heteroarylamino, diheteroarylamino, or amino acid); or cyano (—CN). In some embodiments, the phosphate backbone can be modified as described herein, e.g., with a phosphothioate group. In some embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In some embodiments, a gRNA can include "locked" nucleic acids (LNA) in which the 2' OH-group can be connected, e.g., by a C1-6 alkylene or C1-6 heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclylamino, arylamino, diarylamino, heteroarylamino, or diheteroarylamino, ethylenediamine, or polyamino) and aminoalkoxy or $O(CH_2)_n$-amino (wherein amino can be, e.g., $NH_2$; alkylamino, dialkylamino, heterocyclylamino, arylamino, diarylamino, heteroarylamino, or diheteroarylamino, ethylenediamine, or polyamino).

In some embodiments, a gRNA can include a modified nucleotide which is multicyclic (e.g., tricyclo; and "unlocked" forms, such as glycol nucleic acid (GNA) (e.g., R-GNA or 5-GNA, where ribose is replaced by glycol units attached to phosphodiester bonds), or threose nucleic acid (TNA, where ribose is replaced with α-L-threofuranosyl-(3'→2')).

Generally, gRNA molecules include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In an embodiment, a gRNA comprises a 4'-S, 4'-Se or a 4'-C-aminomethyl-2'-O-Me modification.

In some embodiments, deaza nucleotides, e.g., 7-deaza-adenosine, can be incorporated into the gRNA. In some embodiments, O- and N-alkylated nucleotides, e.g., N6-methyl adenosine, can be incorporated into the gRNA. In some embodiments, one or more or all of the nucleotides in a gRNA molecule are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory it is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

EXAMPLES

The following Examples are merely illustrative and are not intended to limit the scope or content of the invention in any way.

Example 1

Evaluation of Candidate Guide RNAs (gRNAs)

The suitability of candidate gRNAs can be evaluated as described in this example. Although described for a chimeric gRNA, the approach can also be used to evaluate modular gRNAs.

Cloning gRNAs into Vectors

For each gRNA, a pair of overlapping oligonucleotides is designed and obtained. Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters maybe used to drive in vivo transcription (e.g. H1 promoter) or for in vitro transcription (e.g., a T7 promoter).

Cloning gRNAs in Linear dsDNA Molecule (STITCHR)

For each gRNA, a single oligonucleotide is designed and obtained. The U6 promoter and the gRNA scaffold (e.g. including everything except the targeting domain, e.g., including sequences derived from the crRNA and tracrRNA, e.g., including a first complementarity domain; a linking domain; a second complementarity domain; a proximal domain; and a tail domain) are separately PCR amplified and purified as dsDNA molecules. The gRNA-specific oligonucleotide is used in a PCR reaction to stitch together the U6 and the gRNA scaffold, linked by the targeting domain specified in the oligonucleotide. Resulting dsDNA molecule (STITCHR product) is purified for transfection. Alternate promoters may be used to drive in vivo transcription (e.g., H1 promoter) or for in vitro transcription (e.g., T7 promoter). Any gRNA scaffold may be used to create gRNAs compatible with Cas9s from any bacterial species.

Initial gRNA Screen

Each gRNA to be tested is transfected, along with a plasmid expressing Cas9 and a small amount of a GFP-expressing plasmid into human cells. In preliminary experiments, these cells can be immortalized human cell lines such as 293T, K562 or U2OS. Alternatively, primary human cells may be used. In this case, cells may be relevant to the eventual therapeutic cell target (for example, an erythroid cell). The use of primary cells similar to the potential therapeutic target cell population may provide important information on gene targeting rates in the context of endogenous chromatin and gene expression.

Transfection may be performed using lipid transfection (such as Lipofectamine or Fugene) or by electroporation (such as Lonza Nucleofection). Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc.) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) which recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1-\text{fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, miniprepped and sequenced with a single primer. Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2

Assessment of Gene Targeting by NHEJ

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency to generate the desired mutations (either knockout of a target gene or removal of a target sequence motif) may be determined by sequencing. For Sanger sequencing, PCR amplicons may be 500-700 bp long. For next generation sequencing, PCR amplicons may be 300-500 bp long. If the goal is to knockout gene function, sequencing may be used to assess what percent of alleles have undergone NHEJ-induced indels that result in a frameshift or large deletion or insertion that would be expected to destroy gene function. If the goal is to remove a specific sequence motif, sequencing may be used to assess what percent of alleles have undergone NHEJ-induced deletions that span this sequence.

Example 3

Assessment of Gene Targeting by HDR

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency can be determined by several methods.

Determination of gene targeting frequency involves measuring the percentage of alleles that have undergone homologous directed repair (HDR) with the donor template and which therefore have incorporated desired correction. If the desired HDR event creates or destroys a restriction enzyme site, the frequency of gene targeting may be determined by a RFLP assay. If no restriction site is created or destroyed, sequencing may be used to determine gene targeting frequency. If a RFLP assay is used, sequencing may still be used to verify the desired HDR event and ensure that no other mutations are present. At least one of the primers is placed in the endogenous gene sequence outside of the region included in the homology arms, which prevents amplification of donor template still present in the cells. Therefore, the length of the homology arms present in the donor template may affect the length of the PCR amplicon. PCR amplicons can either span the entire donor region (both primers placed outside the homology arms) or they can span only part of the donor region and a single junction between donor and endogenous DNA (one internal and one external primer). If the amplicons span less than entire donor region, two different PCRs should be used to amplify and sequence both the 5' and the 3' junction.

If the PCR amplicon is short (less than 600 bp) it is possible to use next generation sequencing. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low gene targeting rates.

If the PCR amplicon is too long for next generation sequencing, Sanger sequencing can be performed. For Sanger sequencing, purified PCR amplicons will be cloned into a plasmid backbone (for example, TOPO cloned using the LifeTech Zero Blunt® TOPO® cloning kit), transformed, miniprepped and sequenced.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (27343 sequences)

SEQ ID NO: 1 - protein, 1344 aa, Streptococcus mutans
KKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1387 aa, Streptococcus thermophilus
TKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 4 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 5 - RNA, 96 nt, Artificial Sequence
  Synthetic oligonucleotide
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugc

SEQ ID NO: 6 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 7 - protein, 1368 aa, Streptococcus pyogenes [sequence omitted]

SEQ ID NO: 8 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (6)..(6): Xaa is Ser or Tyr or Asn or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXXXGXXXX

SEQ ID NO: 9 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXSXGXXXX

SEQ ID NO: 10 - protein, 12 aa, Artificial Sequence
  Synthetic peptide
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (11)..(11): Xaa is Val or Ile or Leu or Ala or Met or His
  VARIANT (12)..(12): Any amino acid or absent
DIGXXSVGWAXX

SEQ ID NO: 11 - protein, 12 aa, Artificial Sequence
  Synthetic peptide
  MOD_RES (12)..(12): Any non-polar alkyl amino acid or a hydroxyl amino acid
DIGTNSVGWAVX

SEQ ID NO: 12 - protein, 8 aa, Artificial Sequence
  Synthetic peptide
  VARIANT (2)..(2): Xaa is Val or His
  VARIANT (3)..(3): Xaa is Ile or Leu or Val
  VARIANT (5)..(5): Xaa is Met or Thr
IXXEXARE

SEQ ID NO: 13 - protein, 8 aa, Artificial Sequence
  Synthetic peptide
  VARIANT (3)..(3): Xaa is Ile or Leu or Val
IVXEMARE

SEQ ID NO: 14 - protein, 8 aa, Artificial Sequence
  Synthetic peptide
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 15 - protein, 8 aa, Artificial Sequence
  Synthetic peptide
HHAHDAYL

SEQ ID NO: 16 - protein, 30 aa, Artificial Sequence
  Synthetic polypeptide
  VARIANT (2)..(2): Xaa is Lys or Pro
  VARIANT (4)..(4): Xaa is Val or Leu or Ile or Phe
  VARIANT (5)..(5): Xaa is Gly or Ala or Ser
  VARIANT (6)..(6): Xaa is Leu or Ile or Val or Phe
  MOD_RES (7)..(26): Any amino acid and this region may encompass 5-20 residues wherein some positions may be absent
  VARIANT (29)..(29): Xaa is Asp or Glu or Asn or Gln
KXYXXXXXXXXXXXXXXXXXXXXXXXTDXY

SEQ ID NO: 17 - protein, 27 aa, Artificial Sequence
  Synthetic peptide
  VARIANT (1)..(1): Xaa is Asp or Glu or Gln or Asn
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (9)..(9): Xaa is Ser or Ala or Asp or Thr or Lys
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (13)..(13): Xaa is Asp or Ser or Asn or Arg or Leu or Thr
  VARIANT (14)..(14): Xaa is Asp or Asn or Ser
  VARIANT (15)..(15): Xaa is Ser or Ala or Thr or Gly or Arg
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (19)..(19): Xaa is Lys or Leu or Arg or Met or Thr or Phe
  VARIANT (20)..(20): Xaa is Val or Leu or Ile or Ala or Thr
  VARIANT (21)..(21): Xaa is Leu or Ile or Val or Ala
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XXXHXXPXXXXXXXXXXNXXXXXXXXN

SEQ ID NO: 18 - protein, 27 aa, Artificial Sequence
  Synthetic peptide
  VARIANT (1)..(1): Xaa is Asp or Glu
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys Met or Asp or Phe
XXXHXXPXSXXXDDSXXNKVLXXXXXN

SEQ ID NO: 19 - protein, 27 aa, Artificial Sequence
  Synthetic peptide
  VARIANT (1)..(1): Xaa is Asp or Glu
  VARIANT (3)..(3): Xaa is Asp or Glu
  VARIANT (8)..(8): Xaa is Gln or His or Arg or Lys or Tyr or Ile or Leu or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XVXHIVPXSXXXDDSXXNKVLTXXXXN

SEQ ID NO: 20 - protein, 27 aa, Artificial Sequence
  Synthetic peptide
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg or Lys or Leu
  VARIANT (22)..(22): Xaa is Thr or Val
  VARIANT (23)..(23): Xaa is Ser or Arg
  VARIANT (25)..(25): Xaa is Lys or Asp or Ala
  VARIANT (26)..(26): Xaa is Glu or Lys or Gly or Asn
DXDHIXPQXFXXDXSIDNXVLXXSXXN

SEQ ID NO: 21 - protein, 73 aa, Artificial Sequence
  Synthetic polypeptide
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu or Gln or Asp
  VARIANT (15)..(15): Xaa is Glu or Asp
  VARIANT (19)..(19): Xaa is Asp or Asn or His
  VARIANT (20)..(20): Xaa is Tyr or Arg or Asn
  VARIANT (23)..(23): Xaa is Gln or Asp or Asn
  MOD_RES (25)..(64): Any amino acid and this region may encompass 15-40 residues wherein some positions may be absent
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 22 - DNA, 4107 bp, Artificial Sequence
  Synthetic polynucleotide
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 23 - protein, 1368 aa, Streptococcus pyogenes [sequence omitted]

SEQ ID NO: 24 - DNA, 3249 bp, Artificial Sequence
  Synthetic polynucleotide
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 25 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 26 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - RNA, 104 nt, Artificial Sequence
  Synthetic polynucleotide
  misc_feature (1)..(20): a, c, u, g, unknown or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 28 - RNA, 106 nt, Artificial Sequence
  Synthetic polynucleotide
  misc_feature (1)..(20): a, c, u, g, unknown or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 29 - RNA, 116 nt, Artificial Sequence
  Synthetic polynucleotide
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 96 nt, Artificial Sequence
  Synthetic oligonucleotide
  misc_feature (1)..(20): a, c, u, g, unknown or other
nnnnnnnnnnnnnnnnnnnnguauuagagcuagaaauagcaaguuaauauaaggcuaguccguuaucaacuugaaaaaguggcaccgagucggugc

SEQ ID NO: 31 - RNA, 96 nt, Artificial Sequence
  Synthetic oligonucleotide
  misc_feature (1)..(20): a, c, u, g, unknown or other
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 116 nt, Artificial Sequence
  Synthetic polynucleotide
  misc_feature (1)..(20): a, c, u, g, unknown or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 33 - RNA, 47 nt, Artificial Sequence
  Synthetic oligonucleotide
aaggcuaguccguuaucaacuugaaaaaguggcaccgagucggugcu

SEQ ID NO: 34 - RNA, 49 nt, Artificial Sequence
  Synthetic oligonucleotide
aaggcuaguccguuaucaacuugaaaaaguggcaccgagucgguggugc

SEQ ID NO: 35 - RNA, 51 nt, Artificial Sequence
  Synthetic oligonucleotide
aaggcuaguccguuaucaacuugaaaaaguggcaccgagucggugcggauc

SEQ ID NO: 36 - RNA, 31 nt, Artificial Sequence
  Synthetic oligonucleotide
aaggcuaguccguuaucaacuugaaaaagug

SEQ ID NO: 37 - RNA, 18 nt, Artificial Sequence
  Synthetic oligonucleotide
aaggcuaguccguuauca

SEQ ID NO: 38 - RNA, 12 nt, Artificial Sequence
  Synthetic oligonucleotide
aaggcuaguccg

SEQ ID NO: 39 - DNA, 3159 bp, Artificial Sequence
  Synthetic polynucleotide
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 40 - RNA, 102 nt, Artificial Sequence
  Synthetic oligonucleotide
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 41 - skipped

SEQ ID NO: 42 - RNA, 42 nt, Streptococcus pyogenes
  misc_feature (1)..(20): a, c, u, g, unknown or other
nnnnnnnnnnnnnnnnnnnnguuuuagagcuaugcuguuuug

SEQ ID NO: 43 - RNA, 85 nt, Streptococcus pyogenes
ggaaccauucaaaacagcauagcaaguuaaaauaaggcuaguccguuaucaacuugaaaaaguggcaccgagucggugcuuuuuu

SEQ ID NO: 44 - RNA, 62 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccg

SEQ ID NO: 45 - RNA, 102 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 46 - RNA, 75 nt, Streptococcus pyogenes
  misc_feature (1)..(20): a, c, u, g, unknown or other
nnnnnnnnnnnnnnnnnnnnguuuuagagcuaugcugaaaagcauagcaaguuaaaauaaggcuaguccguuauc

SEQ ID NO: 47 - RNA, 87 nt, Streptococcus pyogenes
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuauc

SEQ ID NO: 48 - RNA, 42 nt, Streptococcus thermophilus
  misc_feature (1)..(20): a, c, u, g, unknown or other
nnnnnnnnnnnnnnnnnnnnguuuuagagcuguguuguuucg

SEQ ID NO: 49 - RNA, 78 nt, Streptococcus thermophilus
gggcgaaacaacacagcgaguuaaaauaaggcuuaguccguacucaacuugaaaagguggcaccgauucgguguuuuu

SEQ ID NO: 50 - RNA, 42 nt, Streptococcus pyogenes; identical to SEQ ID NO: 42
  misc_feature (1)..(20): a, c, u, g, unknown or other

SEQ ID NO: 51 - RNA, 42 nt, Streptococcus thermophilus; identical to SEQ ID NO: 48
  misc_feature (1)..(20): a, c, u, g, unknown or other

SEQ ID NO: 52 - RNA, 85 nt, Streptococcus pyogenes
gaaccauucaaaacagcauagcaaguuaaaauaaggcuaguccguuaucaacuugaaaaaguggcaccgagucggugcuuuuuuu

SEQ ID NO: 53 - RNA, 78 nt, Streptococcus thermophilus; identical to SEQ ID NO: 49

SEQ ID NO: 54 - protein, 12 aa, Artificial Sequence
  Synthetic peptide
DIGTNSVGWAVT

SEQ ID NO: 55 - protein, 12 aa, Artificial Sequence
  Synthetic peptide
DIGTNSVGWAVT

SEQ ID NO: 56 - protein, 12 aa, Artificial Sequence
  Synthetic peptide
DVGTNSVGWAVT

SEQ ID NO: 57 - protein, 12 aa, Artificial Sequence
  Synthetic peptide
DVGTNSVGWAVT

SEQ ID NO: 58 - protein, 12 aa, Artificial Sequence
  Synthetic peptide
DMGTNSVGWAVT

SEQ ID NO: 59 - protein, 12 aa, Artificial Sequence
  Synthetic peptide
DVGTSSVGWAVT

SEQ ID NO: 60 - protein, 12 aa, Artificial Sequence
  Synthetic peptide
DIGTASVGWAVT

SEQ ID NO: 61 - protein, 12 aa, Artificial Sequence
  Synthetic peptide
DVGTGSVGWAVT

SEQ ID NO: 62 - protein, 12 aa, Artificial Sequence
  Synthetic peptide
DIGTNSVGWAVV

SEQ ID NO: 63 - protein, 12 aa, Artificial Sequence
  Synthetic peptide
DIGTNSVGWAVI

SEQ ID NO: 64 - protein, 12 aa, Artificial Sequence
  Synthetic peptide
DIGTNSVGWAVL

SEQ ID NO: 65 - protein, 12 aa, Artificial Sequence
  Synthetic peptide
DLGTNSIGWAVV

SEQ ID NO: 66 - protein, 11 aa, Artificial Sequence
  Synthetic peptide
DLGTNSIGWAI

SEQ ID NO: 67 - protein, 12 aa, Artificial Sequence
  Synthetic peptide
DLGTNSIGWALV

SEQ ID NO: 68 - protein, 12 aa, Artificial Sequence
  Synthetic peptide
DIGTNSVGWCVT

SEQ ID NO: 69 - protein, 12 aa, Artificial Sequence
  Synthetic peptide
DIGTNSVGYAVT

SEQ ID NO: 70 - protein, 12 aa, Artificial Sequence
  Synthetic peptide
DMGTGSLGWAVT

SEQ ID NO: 71 - protein, 12 aa, Artificial Sequence
  Synthetic peptide
DIGTSSVGWAAI

SEQ ID NO: 72 - protein, 12 aa, Artificial Sequence
  Synthetic peptide
DLGTGSVGWAVV

SEQ ID NO: 73 - protein, 12 aa, Artificial Sequence
  Synthetic peptide
DLGVGSVGWAIV

SEQ ID NO: 74 - protein, 12 aa, Artificial Sequence
  Synthetic peptide
DLGIASIGWAII

SEQ ID NO: 75 - protein, 12 aa, Artificial Sequence
  Synthetic peptide
DLGIASVGWAIV

SEQ ID NO: 76 - protein, 12 aa, Artificial Sequence
  Synthetic peptide
DLGVASVGWSIV

SEQ ID NO: 77 - protein, 12 aa, Artificial Sequence
  Synthetic peptide
DIGIASVGWAIL

SEQ ID NO: 78 - protein, 12 aa, Artificial Sequence
  Synthetic peptide
DLGISSVGWSVI

SEQ ID NO: 79 - protein, 12 aa, Artificial Sequence
  Synthetic peptide
DIGIASVGWSVI

SEQ ID NO: 80 - protein, 12 aa, Artificial Sequence
  Synthetic peptide
DVGIGSIGWAVI

SEQ ID NO: 81 - protein, 12 aa, Artificial Sequence
  Synthetic peptide
DLGVGSIGFAIV

SEQ ID NO: 82 - protein, 12 aa, Artificial Sequence
  Synthetic peptide
DIGYASIGWAVI

SEQ ID NO: 83 - protein, 12 aa, Artificial Sequence
  Synthetic peptide
DTGTNSLGWAIV

SEQ ID NO: 84 - protein, 12 aa, Artificial Sequence
  Synthetic peptide
DLGTNSIGWCLL

SEQ ID NO: 85 - protein, 12 aa, Artificial Sequence
  Synthetic peptide
DIGTDSLGWAVF

SEQ ID NO: 86 - protein, 12 aa, Artificial Sequence
  Synthetic peptide
DIGSNSIGFAVV

SEQ ID NO: 87 - protein, 12 aa, Artificial Sequence
  Synthetic peptide
DLGVGSIGVAVA

SEQ ID NO: 88 - protein, 12 aa, Artificial Sequence
  Synthetic peptide
DLGIASCGWGVV

SEQ ID NO: 89 - protein, 12 aa, Artificial Sequence
  Synthetic peptide
DLGIASVGWCLT

SEQ ID NO: 90 - protein, 12 aa, Artificial Sequence
  Synthetic peptide
DIGIGSVGVGIL

SEQ ID NO: 91 - protein, 12 aa, Artificial Sequence
  Synthetic peptide
DIGITSVGYGLI

SEQ ID NO: 92 - protein, 12 aa, Artificial Sequence
  Synthetic peptide
DIGITSVGFGII

SEQ ID NO: 93 - protein, 12 aa, Artificial Sequence
  Synthetic peptide
DVGITSTGYAVL

SEQ ID NO: 94 - protein, 12 aa, Artificial Sequence
  Synthetic peptide
DLGITSFGYAIL

SEQ ID NO: 95 - protein, 12 aa, Artificial Sequence
  Synthetic peptide
DIGNASVGWSAF

SEQ ID NO: 96 - protein, 12 aa, Artificial Sequence
  Synthetic peptide
DVGTNSCGWVAM

SEQ ID NO: 97 - protein, 12 aa, Artificial Sequence
  Synthetic peptide
DVGERSIGLAAV

SEQ ID NO: 98 - protein, 12 aa, Artificial Sequence
  Synthetic peptide
DVGLNSVGLAAV

SEQ ID NO: 99 - protein, 12 aa, Artificial Sequence
  Synthetic peptide
DVGLMSVGLAAI

SEQ ID NO: 100 - protein, 12 aa, Artificial Sequence
  Synthetic peptide
DVGTFSVGLAAI

SEQ ID NO: 101 - protein, 12 aa, Artificial Sequence
  Synthetic peptide
DIGTGSVGYACM

SEQ ID NO: 102 - protein, 12 aa, Artificial Sequence
  Synthetic peptide
DLGTTSIGFAHI

SEQ ID NO: 103 - protein, 12 aa, Artificial Sequence
  Synthetic peptide
DLGTNSIGSSVR

SEQ ID NO: 104 - protein, 12 aa, Artificial Sequence
  Synthetic peptide
DIGTNSVGWAVT

SEQ ID NO: 105 - protein, 12 aa, Artificial Sequence
  Synthetic peptide
DIGTNSVGWAVT

SEQ ID NO: 106 - protein, 12 aa, Artificial Sequence
  Synthetic peptide
DVGTNSVGWAVT

SEQ ID NO: 107 - protein, 12 aa, Artificial Sequence
  Synthetic peptide
DVGTNSVGWAVT

SEQ ID NO: 108 - protein, 12 aa, Artificial Sequence
  Synthetic peptide
DMGTNSVGWAVT

SEQ ID NO: 109 - protein, 12 aa, Artificial Sequence
  Synthetic peptide
DVGTSSVGWAVT

SEQ ID NO: 110 - protein, 12 aa, Artificial Sequence
  Synthetic peptide
DIGTASVGWAVT

SEQ ID NO: 111 - protein, 12 aa, Artificial Sequence
  Synthetic peptide
DVGTGSVGWAVT

SEQ ID NO: 112 - protein, 12 aa, Artificial Sequence
  Synthetic peptide
DIGTNSVGWAVV

SEQ ID NO: 113 - protein, 12 aa, Artificial Sequence
  Synthetic peptide
DIGTNSVGWAVI

SEQ ID NO: 114 - protein, 12 aa, Artificial Sequence
  Synthetic peptide
DIGTNSIGWAVI

SEQ ID NO: 115 - protein, 12 aa, Artificial Sequence
  Synthetic peptide
DIGTNSVGWAVL

SEQ ID NO: 116 - protein, 12 aa, Artificial Sequence
  Synthetic peptide
DLGTNSIGWAVV

SEQ ID NO: 117 - protein, 11 aa, Artificial Sequence
  Synthetic peptide
DLGTNSIGWAI

SEQ ID NO: 118 - protein, 12 aa, Artificial Sequence
  Synthetic peptide
DLGTNSIGWALV

SEQ ID NO: 119 - protein, 12 aa, Artificial Sequence
  Synthetic peptide
DIGTNSVGWCVT

SEQ ID NO: 120 - protein, 12 aa, Artificial Sequence
  Synthetic peptide
DIGTNSVGYAVT

SEQ ID NO: 121 - protein, 12 aa, Artificial Sequence
  Synthetic peptide
DMGTGSLGWAVT

SEQ ID NO: 122 - protein, 12 aa, Artificial Sequence
  Synthetic peptide
DIGTSSVGWAAI

SEQ ID NO: 123 - protein, 12 aa, Artificial Sequence
  Synthetic peptide
DLGTGSVGWAVV

SEQ ID NO: 124 - protein, 12 aa, Artificial Sequence
  Synthetic peptide
DLGVGSVGWAIV

SEQ ID NO: 125 - protein, 12 aa, Artificial Sequence
  Synthetic peptide
DLGIASIGWAII

SEQ ID NO: 126 - protein, 12 aa, Artificial Sequence
  Synthetic peptide
DLGIASVGWAIV

SEQ ID NO: 127 - protein, 12 aa, Artificial Sequence
  Synthetic peptide
DLGIASVGWAVV

SEQ ID NO: 128 - protein, 12 aa, Artificial Sequence
  Synthetic peptide
DLGVASVGWSIV

SEQ ID NO: 129 - protein, 12 aa, Artificial Sequence
  Synthetic peptide
DIGIASVGWAIL

SEQ ID NO: 130 - protein, 12 aa, Artificial Sequence
  Synthetic peptide
DIGIASVGWAVL

SEQ ID NO: 131 - protein, 12 aa, Artificial Sequence
  Synthetic peptide
DIGIASIGWAVI

SEQ ID NO: 132 - protein, 12 aa, Artificial Sequence
  Synthetic peptide
DIGIASVGWAII

SEQ ID NO: 133 - protein, 12 aa, Artificial Sequence
  Synthetic peptide
DVGIASVGWAVI

SEQ ID NO: 134 - protein, 11 aa, Artificial Sequence
  Synthetic peptide
DIGIASVGWAL

SEQ ID NO: 135 - protein, 12 aa, Artificial Sequence
  Synthetic peptide
DIGIASVGWAMV

SEQ ID NO: 136 - protein, 12 aa, Artificial Sequence
  Synthetic peptide
DIGIASVGWSVI

SEQ ID NO: 137 - protein, 12 aa, Artificial Sequence
  Synthetic peptide
DLGISSVGWSVI

SEQ ID NO: 138 - protein, 12 aa, Artificial Sequence
  Synthetic peptide
DIGITSVGWAVI

SEQ ID NO: 139 - protein, 12 aa, Artificial Sequence
  Synthetic peptide
DVGIGSIGWAVI

SEQ ID NO: 140 - protein, 12 aa, Artificial Sequence
  Synthetic peptide
DLGISSLGWAIV

SEQ ID NO: 141 - protein, 12 aa, Artificial Sequence
  Synthetic peptide
DLGVGSIGFAIV

SEQ ID NO: 142 - protein, 12 aa, Artificial Sequence
  Synthetic peptide
DIGYASIGWAVI

SEQ ID NO: 143 - protein, 12 aa, Artificial Sequence
  Synthetic peptide
DLGTNSIGWCLL

SEQ ID NO: 144 - protein, 12 aa, Artificial Sequence
  Synthetic peptide
DLGTNSIGWGLL

SEQ ID NO: 145 - protein, 12 aa, Artificial Sequence
  Synthetic peptide
DTGTNSLGWAIV

SEQ ID NO: 146 - protein, 12 aa, Artificial Sequence
  Synthetic peptide
DIGTDSLGWAVF

SEQ ID NO: 147 - protein, 12 aa, Artificial Sequence
  Synthetic peptide
DLGSTSLGWAIF

SEQ ID NO: 148 - protein, 12 aa, Artificial Sequence
  Synthetic peptide
DIGISSIGWAFS

SEQ ID NO: 149 - protein, 12 aa, Artificial Sequence
  Synthetic peptide
DLGIASVGWCLT

SEQ ID NO: 150 - protein, 12 aa, Artificial Sequence
  Synthetic peptide
DLGIASCGWGVV

SEQ ID NO: 151 - protein, 12 aa, Artificial Sequence
  Synthetic peptide
DIGSNSIGFAVV

SEQ ID NO: 152 - protein, 12 aa, Artificial Sequence
  Synthetic peptide
DIGTTSIGFSVI

SEQ ID NO: 153 - protein, 12 aa, Artificial Sequence
  Synthetic peptide
DIGITSVGYGLI

SEQ ID NO: 154 - protein, 12 aa, Artificial Sequence
  Synthetic peptide
DIGITSVGFGII

SEQ ID NO: 155 - protein, 12 aa, Artificial Sequence
  Synthetic peptide
DLGTTSIGFAHI

SEQ ID NO: 156 - protein, 12 aa, Artificial Sequence
  Synthetic peptide
DIGIGSVGVGIL

SEQ ID NO: 157 - protein, 12 aa, Artificial Sequence
  Synthetic peptide
DLGVGSIGVAVA

SEQ ID NO: 158 - protein, 12 aa, Artificial Sequence
  Synthetic peptide
DVGITSTGYAVL

SEQ ID NO: 159 - protein, 12 aa, Artificial Sequence
  Synthetic peptide
DLGITSFGYAIL

SEQ ID NO: 160 - protein, 12 aa, Artificial Sequence
  Synthetic peptide
DIGTSSIGWWLY

SEQ ID NO: 161 - protein, 12 aa, Artificial Sequence
  Synthetic peptide
DLGSNSLGWFVT

SEQ ID NO: 162 - protein, 12 aa, Artificial Sequence
  Synthetic peptide
DLGANSLGWFVV

SEQ ID NO: 163 - protein, 12 aa, Artificial Sequence
  Synthetic peptide
DIGNASVGWSAF

SEQ ID NO: 164 - protein, 12 aa, Artificial Sequence
  Synthetic peptide
DVGTNSCGWVAM

SEQ ID NO: 165 - protein, 12 aa, Artificial Sequence
  Synthetic peptide
DVGERSIGLAAV

SEQ ID NO: 166 - protein, 12 aa, Artificial Sequence
  Synthetic peptide
DVGLNSVGLAAV

SEQ ID NO: 167 - protein, 12 aa, Artificial Sequence
  Synthetic peptide
DVGLMSVGLAAI

SEQ ID NO: 168 - protein, 12 aa, Artificial Sequence
  Synthetic peptide
DVGTFSVGLAAI

SEQ ID NO: 169 - protein, 12 aa, Artificial Sequence
  Synthetic peptide
DIGTGSVGYACM

SEQ ID NO: 170 - protein, 12 aa, Artificial Sequence
  Synthetic peptide
DLGTNSIGSSVR

SEQ ID NO: 171 - protein, 15 aa, Artificial Sequence
  Synthetic peptide
DIGLRIGITSCGWSI

SEQ ID NO: 172 - protein, 12 aa, Artificial Sequence
  Synthetic peptide
DMGAKYTGVFYA

SEQ ID NO: 173 - protein, 12 aa, Artificial Sequence
  Synthetic peptide
DLGGKNTGFFSF

SEQ ID NO: 174 - protein, 12 aa, Artificial Sequence
  Synthetic peptide
DLGVKNTGVFSA

SEQ ID NO: 175 - protein, 12 aa, Artificial Sequence
  Synthetic peptide
DLGAKFTGVALY

SEQ ID NO: 176 - protein, 12 aa, Artificial Sequence
  Synthetic peptide
DLGGKFTGVCLS

SEQ ID NO: 177 - protein, 12 aa, Artificial Sequence
  Synthetic peptide
DLGGTYTGTFIT

SEQ ID NO: 178 - protein, 28 aa, Artificial Sequence
  Synthetic peptide
YDIDHIYPRSLTKDDSFDNLVLCERTAN

SEQ ID NO: 179 - protein, 28 aa, Artificial Sequence
  Synthetic peptide
DIDHIYPRSKVIKDDSFDNLVLVLKNEN

SEQ ID NO: 180 - protein, 27 aa, Artificial Sequence
  Synthetic peptide
DRDHIYPQSKIKDDSIDNLVLVNKTYN

SEQ ID NO: 181 - protein, 27 aa, Artificial Sequence
  Synthetic peptide
DIDHIYPRSKIKDDSITNRVLVEKDIN

SEQ ID NO: 182 - protein, 27 aa, Artificial Sequence
  Synthetic peptide
DIDHIYPQSKIKDDSISNRVLVCSSCN

SEQ ID NO: 183 - protein, 27 aa, Artificial Sequence
  Synthetic peptide
DIDHIYPQSKTMDDSLNNRVLVKKNYN

SEQ ID NO: 184 - protein, 27 aa, Artificial Sequence
  Synthetic peptide
DQDHIYPKSKIYDDSLENRVLVKKNLN

SEQ ID NO: 185 - protein, 27 aa, Artificial Sequence
  Synthetic peptide
QIDHIVPQSLVKDDSFDNRVLVVPSEN

SEQ ID NO: 186 - protein, 27 aa, Artificial Sequence
  Synthetic peptide
DIDHIIPQAFIKDNSIDNRVLTSSKEN

SEQ ID NO: 187 - protein, 27 aa, Artificial Sequence
  Synthetic peptide
DIDHIIPQAFLKDNSIDNKVLVSSASN

SEQ ID NO: 188 - protein, 27 aa, Artificial Sequence
  Synthetic peptide
DIDHIIPQAYTKDNSLDNRVLVSNITN

SEQ ID NO: 189 - protein, 27 aa, Artificial Sequence
  Synthetic peptide
DIDHIVPQSFITDNSIDNLVLTSSAGN

SEQ ID NO: 190 - protein, 27 aa, Artificial Sequence
  Synthetic peptide
DVDHIVPQSFLKDDSIDNKVLTRSDKN

SEQ ID NO: 191 - protein, 27 aa, Artificial Sequence
  Synthetic peptide
NIDHIYPQSMVKDDSLDNKVLVQSEIN

SEQ ID NO: 192 - protein, 27 aa, Artificial Sequence
  Synthetic peptide
DIDHILPQSLIKDDSLDNRVLVNATIN

SEQ ID NO: 193 - protein, 27 aa, Artificial Sequence
  Synthetic peptide
DIDHILPQSFIKDDSLENRVLVKKAVN

SEQ ID NO: 194 - protein, 27 aa, Artificial Sequence
  Synthetic peptide
EVDHIFPRSFIKDDSIDNKVLVIKKMN

SEQ ID NO: 195 - protein, 27 aa, Artificial Sequence
  Synthetic peptide
EVDHIIPRSYIKDDSFENKVLVYREEN

SEQ ID NO: 196 - protein, 27 aa, Artificial Sequence
  Synthetic peptide
DIDHIIPQAVTQNDSIDNRVLVARAEN

SEQ ID NO: 197 - protein, 27 aa, Artificial Sequence
  Synthetic peptide
EIDHIIPYSISFDDSSSNKLLVLAESN

SEQ ID NO: 198 - protein, 27 aa, Artificial Sequence
  Synthetic peptide
EIDHIIPYSLCFDDSSANKVLVHKQSN

SEQ ID NO: 199 - protein, 27 aa, Artificial Sequence
  Synthetic peptide
DIDHIIPYSRSMDDSYSNKVLVLSGEN

SEQ ID NO: 200 - protein, 27 aa, Artificial Sequence
  Synthetic peptide
DIDHIIPYSKSMDDSFNNKVLCLAEEN

SEQ ID NO: 201 - protein, 27 aa, Artificial Sequence
  Synthetic peptide
EIDHIYPYSRSFDDSYMNKVLVFTKQN

SEQ ID NO: 202 - protein, 27 aa, Artificial Sequence
  Synthetic peptide
QIDHIYPYSRSMDDSYMNKVLVLTDEN

SEQ ID NO: 203 - protein, 27 aa, Artificial Sequence
  Synthetic peptide
EIDHIIPFSRSFDDSLSNKILVLGSEN

SEQ ID NO: 204 - protein, 27 aa, Artificial Sequence
  Synthetic peptide
EIDHALPFSRTWDDSFNNKVLVLGSEN

SEQ ID NO: 205 - protein, 27 aa, Artificial Sequence
  Synthetic peptide
EIDHALPFSRTWDDSFNNKVLVLASEN

SEQ ID NO: 206 - protein, 27 aa, Artificial Sequence
  Synthetic peptide
EIDHIIPISISLDDSINNKVLVLSKAN

SEQ ID NO: 207 - protein, 27 aa, Artificial Sequence
  Synthetic peptide
EVDHIIPISISLDDSITNKVLVTHREN

SEQ ID NO: 208 - protein, 27 aa, Artificial Sequence
  Synthetic peptide
QVDHALPYSRSYDDSKNNKVLVLTHEN

SEQ ID NO: 209 - protein, 27 aa, Artificial Sequence
  Synthetic peptide
EVDHILPLSITFDDSLANKVLVYATAN

SEQ ID NO: 210 - protein, 27 aa, Artificial Sequence
  Synthetic peptide
EIDHIIPRSISFDDARSNKVLVYRSEN

SEQ ID NO: 211 - protein, 27 aa, Artificial Sequence
  Synthetic peptide
EVDHIIPRSVSFDNSYHNKVLVKQSEN

SEQ ID NO: 212 - protein, 27 aa, Artificial Sequence
  Synthetic peptide
DIDHILPYSITFDDSFRNKVLVTSQEN

SEQ ID NO: 213 - protein, 27 aa, Artificial Sequence
  Synthetic peptide
EIDHILPRSRSADDSFANKVLCLARAN

SEQ ID NO: 214 - protein, 27 aa, Artificial Sequence
  Synthetic peptide
EIEHLLPFSLTLDDSMANKTVCFRQAN

SEQ ID NO: 215 - protein, 27 aa, Artificial Sequence
  Synthetic peptide
DIDHILPFSVSLDDSAANKVVCLREAN

SEQ ID NO: 216 - protein, 27 aa, Artificial Sequence
  Synthetic peptide
DIDHLIPFSISWDDSAANKVVCMRYAN

SEQ ID NO: 217 - protein, 27 aa, Artificial Sequence
  Synthetic peptide
DIDHILPVAMTLDDSPANKIICMRYAN

SEQ ID NO: 218 - protein, 27 aa, Artificial Sequence
  Synthetic peptide
DVDHILPYSRTLDDSFPNRTLCLREAN

SEQ ID NO: 219 - protein, 27 aa, Artificial Sequence
  Synthetic peptide
EIEHILPFSRTLDDSLNNRTVAMRRAN

SEQ ID NO: 220 - protein, 27 aa, Artificial Sequence
  Synthetic peptide
EVDHIIPYSISWDDSYTNKVLTSAKCN

SEQ ID NO: 221 - protein, 27 aa, Artificial Sequence
  Synthetic peptide
QVDHILPWSRFGDDSYLNKTLCTARSN

SEQ ID NO: 222 - protein, 27 aa, Artificial Sequence
  Synthetic peptide
QVDHILPFSKTLDDSFANKVLAQHDAN

SEQ ID NO: 223 - protein, 27 aa, Artificial Sequence
  Synthetic peptide
QIDHAFPLSRSLDDSQSNKVLCLTSSN

SEQ ID NO: 224 - protein, 27 aa, Artificial Sequence
  Synthetic peptide
DIDHIVPRSISFDDSFSNLVIVNKLDN

SEQ ID NO: 225 - protein, 27 aa, Artificial Sequence
  Synthetic peptide
EIEHIIPYSMSYDNSQANKILTEKAEN

SEQ ID NO: 226 - protein, 27 aa, Artificial Sequence
  Synthetic peptide
EIDHVIPYSKSADDSWFNKLLVKKSTN

SEQ ID NO: 227 - protein, 27 aa, Artificial Sequence
  Synthetic peptide
EMDHILPYSRSLDNGWHNRVLVHGKDN

SEQ ID NO: 228 - protein, 27 aa, Artificial Sequence
  Synthetic peptide
EVDHIVPYSLILDNTINNKALVYAEEN

SEQ ID NO: 229 - protein, 27 aa, Artificial Sequence
  Synthetic peptide
EIEHVIPQSLYFDDSFSNKVICEAEVN

SEQ ID NO: 230 - protein, 27 aa, Artificial Sequence
  Synthetic peptide
DIEHIIPQARLFDDSFSNKTLEARSVN

SEQ ID NO: 231 - protein, 27 aa, Artificial Sequence
  Synthetic peptide
EIEHIVPKARVFDDSFSNKTLTFHRIN

SEQ ID NO: 232 - protein, 28 aa, Artificial Sequence
  Synthetic peptide
DKDHIIPQSMKKDDSIINNLVLVNKNAN

SEQ ID NO: 233 - protein, 27 aa, Artificial Sequence
  Synthetic peptide
EVEHIWPRSRSFDNSPRNKTLCRKDVN

SEQ ID NO: 234 - protein, 27 aa, Artificial Sequence
  Synthetic peptide
IVNHIIPYNRSFDDTYHNRVLTLTETK

SEQ ID NO: 235 - protein, 27 aa, Artificial Sequence
  Synthetic peptide
DMEHTIPKSISFDNSDQNLTLCESYYN

SEQ ID NO: 236 - protein, 27 aa, Artificial Sequence
  Synthetic peptide
DIEHTIPRSAGGDSTKMNLTLCSSRFN

SEQ ID NO: 237 - protein, 27 aa, Artificial Sequence
  Synthetic peptide
DIEHTIPRSISQDNSQMNKTLCSLKFN

SEQ ID NO: 238 - protein, 27 aa, Artificial Sequence
  Synthetic peptide
DIDHVIPLARGGRDSLDNMVLCQSDAN

SEQ ID NO: 239 - protein, 27 aa, Artificial Sequence
  Synthetic peptide
DIEHLFPIAESEDNGRNNLVISHSACN

SEQ ID NO: 240 - protein, 27 aa, Artificial Sequence
  Synthetic peptide
DVDHIFPRDDTADNSYGNKVVAHRQCN

SEQ ID NO: 241 - protein, 27 aa, Artificial Sequence
  Synthetic peptide
DIEHIVPQSLGGLSTDYNTIVTLKSVN

SEQ ID NO: 242 - protein, 27 aa, Artificial Sequence
  Synthetic peptide
ELDHIVPRTDGGSNRHENLAITCGACN

SEQ ID NO: 243 - protein, 28 aa, Artificial Sequence
  Synthetic peptide
EMDHIVPRKGVGSTNTRTNFAAVCAECN

SEQ ID NO: 244 - protein, 28 aa, Artificial Sequence
  Synthetic peptide
EMDHIVPRKGVGSTNTRVNLAAACAACN

SEQ ID NO: 245 - protein, 28 aa, Artificial Sequence
  Synthetic peptide
EMDHIVPRAGQGSTNTRENLVAVCHRCN

SEQ ID NO: 246 - protein, 33 aa, Artificial Sequence
  Synthetic polypeptide
EIDHILPRSLIKDARGIVFNAEPNLIYASSRGN

SEQ ID NO: 247 - protein, 33 aa, Artificial Sequence
  Synthetic polypeptide
EIDHIIPRSLTGRTKKTVFNSEANLIYCSSKGN

SEQ ID NO: 248 - protein, 33 aa, Artificial Sequence
  Synthetic polypeptide
EIDHIIPRSLTLKKSESIYNSEVNLIFVSAQGN

SEQ ID NO: 249 - protein, 33 aa, Artificial Sequence
  Synthetic polypeptide
EIDHIYPRSLSKKHFGVIFNSEVNLIYCSSQGN

SEQ ID NO: 250 - protein, 33 aa, Artificial Sequence
  Synthetic polypeptide
EIDHILPRSHTLKIYGTVFNPEGNLIYVHQKCN

SEQ ID NO: 251 - protein, 30 aa, Artificial Sequence
  Synthetic polypeptide
ELDHIIPRSHKKYGTLNDEANLICVTRGDN

SEQ ID NO: 252 - protein, 27 aa, Artificial Sequence
  Synthetic peptide
ELEHIVPHSFRQSNALSSLVLTWPGVN

SEQ ID NO: 253 - protein, 28 aa, Artificial Sequence
  Synthetic peptide
YDIDHIYPRSLTKDDSFDNLVLCERTAN

SEQ ID NO: 254 - protein, 28 aa, Artificial Sequence
  Synthetic peptide
DIDHIYPRSKVIKDDSFDNLVLVLKNEN

SEQ ID NO: 255 - protein, 27 aa, Artificial Sequence
  Synthetic peptide
DRDHIYPQSKIKDDSIDNLVLVNKTYN

SEQ ID NO: 256 - protein, 27 aa, Artificial Sequence
  Synthetic peptide
DIDHIYPRSKIKDDSITNRVLVEKDIN

SEQ ID NO: 257 - protein, 27 aa, Artificial Sequence
  Synthetic peptide
DIDHIYPQSKIKDDSISNRVLVCSSCN

SEQ ID NO: 258 - protein, 27 aa, Artificial Sequence
  Synthetic peptide
DIDHIYPQSKTMDDSLNNRVLVKKNYN

SEQ ID NO: 259 - protein, 27 aa, Artificial Sequence
  Synthetic peptide
DQDHIYPKSKIYDDSLENRVLVKKNLN

SEQ ID NO: 260 - protein, 27 aa, Artificial Sequence
  Synthetic peptide
QIDHIVPQSLVKDDSFDNRVLVVPSEN

SEQ ID NO: 261 - protein, 27 aa, Artificial Sequence
  Synthetic peptide
DIDHIIPQAFIKDNSIDNRVLTSSKEN

SEQ ID NO: 262 - protein, 27 aa, Artificial Sequence
  Synthetic peptide
DIDHIIPQAFLKDNSIDNKVLVSSASN

SEQ ID NO: 263 - protein, 27 aa, Artificial Sequence
  Synthetic peptide
DIDHIIPQAYTKDNSLDNRVLVSNITN

SEQ ID NO: 264 - protein, 27 aa, Artificial Sequence
  Synthetic peptide
DIDHIVPQSFITDNSIDNLVLTSSAGN

SEQ ID NO: 265 - protein, 27 aa, Artificial Sequence
  Synthetic peptide
DVDHIVPQSFLKDDSIDNKVLTRSDKN

SEQ ID NO: 266 - protein, 27 aa, Artificial Sequence
  Synthetic peptide
NIDHIYPQSMVKDDSLDNKVLVQSEIN

SEQ ID NO: 267 - protein, 27 aa, Artificial Sequence
  Synthetic peptide
DIDHILPQSLIKDDSLDNRVLVNATIN

SEQ ID NO: 268 - protein, 27 aa, Artificial Sequence
  Synthetic peptide
DIDHILPQSFIKDDSLENRVLVKKAVN

SEQ ID NO: 269 - protein, 27 aa, Artificial Sequence
  Synthetic peptide
EVDHIFPRSFIKDDSIDNKVLVIKKMN

SEQ ID NO: 270 - protein, 27 aa, Artificial Sequence
  Synthetic peptide
EVDHIIPRSYIKDDSFENKVLVYREEN

SEQ ID NO: 271 - protein, 27 aa, Artificial Sequence
  Synthetic peptide
DIDHIIPQAVTQNDSIDNRVLVARAEN

SEQ ID NO: 272 - protein, 27 aa, Artificial Sequence
  Synthetic peptide
DIDHIVPRSISFDDSFSNLVIVNKLDN

SEQ ID NO: 273 - protein, 27 aa, Artificial Sequence
  Synthetic peptide
EIDHIIPYSISFDDSSSNKLLVLAESN

SEQ ID NO: 274 - protein, 27 aa, Artificial Sequence
  Synthetic peptide
EIDHIIPYSLCFDDSSANKVLVHKQSN

SEQ ID NO: 275 - protein, 27 aa, Artificial Sequence
  Synthetic peptide
EIDHIIPISISLDDSINNKVLVLSKAN

SEQ ID NO: 276 - protein, 27 aa, Artificial Sequence
  Synthetic peptide
EVDHIIPISISLDDSITNKVLVTHREN

SEQ ID NO: 277 - protein, 27 aa, Artificial Sequence
  Synthetic peptide
EVDHILPLSITFDDSLANKVLVYATAN

SEQ ID NO: 278 - protein, 27 aa, Artificial Sequence
  Synthetic peptide
EIDHIIPRSISFDDARSNKVLVYRSEN

SEQ ID NO: 279 - protein, 27 aa, Artificial Sequence
  Synthetic peptide
EVDHIIPRSVSFDNSYHNKVLVKQSEN

SEQ ID NO: 280 - protein, 27 aa, Artificial Sequence
  Synthetic peptide
EVDHIIPYSISWDDSYTNKVLTSAKCN

SEQ ID NO: 281 - protein, 27 aa, Artificial Sequence
  Synthetic peptide
DIDHIIPYSRSMDDSYSNKVLVLSGEN

SEQ ID NO: 282 - protein, 27 aa, Artificial Sequence
  Synthetic peptide
EIEHIIPYSMSYDNSQANKILTEKAEN

SEQ ID NO: 283 - protein, 27 aa, Artificial Sequence
  Synthetic peptide
EVDHIVPYSLILDNTINNKALVYAEEN

SEQ ID NO: 284 - protein, 27 aa, Artificial Sequence
  Synthetic peptide
EIDHVIPYSKSADDSWFNKLLVKKSTN

SEQ ID NO: 285 - protein, 27 aa, Artificial Sequence
  Synthetic peptide
EMDHILPYSRSLDNGWHNRVLVHGKDN

SEQ ID NO: 286 - protein, 27 aa, Artificial Sequence
  Synthetic peptide
EIEHVIPQSLYFDDSFSNKVICEAEVN

SEQ ID NO: 287 - protein, 27 aa, Artificial Sequence
  Synthetic peptide
DIEHIIPQARLFDDSFSNKTLEARSVN

SEQ ID NO: 288 - protein, 27 aa, Artificial Sequence
  Synthetic peptide
EIEHIVPKARVFDDSFSNKTLTFHRIN

SEQ ID NO: 289 - protein, 28 aa, Artificial Sequence
  Synthetic peptide
DKDHIIPQSMKKDDSIINNLVLVNKNAN

SEQ ID NO: 290 - protein, 27 aa, Artificial Sequence
  Synthetic peptide
QVDHILPWSRFGDDSYLNKTLCTARSN

SEQ ID NO: 291 - protein, 27 aa, Artificial Sequence
  Synthetic peptide
DIDHVIPLARGGRDSLDNMVLCQSDAN

SEQ ID NO: 292 - protein, 27 aa, Artificial Sequence
  Synthetic peptide
DMEHTIPKSISFDNSDQNLTLCESYYN

SEQ ID NO: 293 - protein, 27 aa, Artificial Sequence
  Synthetic peptide
DIEHTIPRSAGGDSTKMNLTLCSSRFN

SEQ ID NO: 294 - protein, 27 aa, Artificial Sequence
  Synthetic peptide
DIEHTIPRSISQDNSQMNKTLCSLKFN

SEQ ID NO: 295 - protein, 27 aa, Artificial Sequence
  Synthetic peptide
DIEHLFPIAESEDNGRNNLVISHSACN

SEQ ID NO: 296 - protein, 27 aa, Artificial Sequence
  Synthetic peptide
DVDHIFPRDDTADNSYGNKVVAHRQCN

SEQ ID NO: 297 - protein, 27 aa, Artificial Sequence
  Synthetic peptide
DIEHIVPQSLGGLSTDYNTIVTLKSVN

SEQ ID NO: 298 - protein, 27 aa, Artificial Sequence
  Synthetic peptide
ELDHIVPRTDGGSNRHENLAITCGACN

SEQ ID NO: 299 - protein, 28 aa, Artificial Sequence
  Synthetic peptide
EMDHIVPRKGVGSTNTRTNFAAVCAECN

SEQ ID NO: 300 - protein, 28 aa, Artificial Sequence
  Synthetic peptide
EMDHIVPRKGVGSTNTRVNLAAACAACN

SEQ ID NO: 301 - protein, 28 aa, Artificial Sequence
  Synthetic peptide
EMDHIVPRAGQGSTNTRENLVAVCHRCN

SEQ ID NO: 302 - protein, 27 aa, Artificial Sequence
  Synthetic peptide
ELEHIVPHSFRQSNALSSLVLTWPGVN

SEQ ID NO: 303 - DNA, 3333 bp, Artificial Sequence
  Synthetic polynucleotide
atggtgcctaagaagaagagaaaggtggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttacccatacgatgttccagattacgctgcagctccagcagcgaagaaaaagaagctggattaa

SEQ ID NO: 304 - protein, 1053 aa, Staphylococcus aureus; identical to SEQ ID NO: 26

SEQ ID NO: 305 - protein, 1368 aa, Streptococcus pyogenes [sequence omitted]

SEQ ID NO: 306 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 307 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 308 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 309 - protein, 1397 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 310 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 311 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 312 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 313 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 314 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 315 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 316 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 317 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 318 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 319 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 320 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 321 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 322 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 323 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 324 - protein, 1368 aa, Streptococcus pyogenes [sequence omitted]

SEQ ID NO: 325 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 326 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 327 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 329 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 330 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 331 - protein, 1472 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 332 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 333 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 334 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 335 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 336 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 337 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 338 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 339 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 340 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 341 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 342 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 343 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 344 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 345 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 346 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 347 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 348 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 349 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 350 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 351 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 352 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 353 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 354 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 355 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 356 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 357 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 358 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 359 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 360 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 361 - protein, 1082 aa, Neisseria meningitidis; identical to SEQ ID NO: 25

SEQ ID NO: 362 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 363 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 364 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 365 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 366 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 367 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 368 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 369 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 370 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 371 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 372 - protein, 1061 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 373 - protein, 1011 aa, Unknown
  Uncultured delta polypeptide
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 374 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 375 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 376 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 379 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 380 - protein, 1035 aa, Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 381 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 382 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 383 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 384 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 385 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 386 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 387 - RNA, 20 nt, Artificial Sequence
  Synthetic
gaggguaaaauuaagcacag

SEQ ID NO: 388 - RNA, 20 nt, Artificial Sequence
  Synthetic
aguuucuuaccucuucuagu

SEQ ID NO: 389 - RNA, 20 nt, Artificial Sequence
  Synthetic
aauggugccaggcauaaucc

SEQ ID NO: 390 - RNA, 17 nt, Artificial Sequence
  Synthetic
gguaaaauuaagcacag

SEQ ID NO: 391 - RNA, 17 nt, Artificial Sequence
  Synthetic
agcaugccaacuagaag

SEQ ID NO: 392 - RNA, 17 nt, Artificial Sequence
  Synthetic
guaucuauauucaucau

SEQ ID NO: 393 - RNA, 17 nt, Artificial Sequence
  Synthetic
gaugauauuuucuuuaa

SEQ ID NO: 394 - RNA, 17 nt, Artificial Sequence
  Synthetic
ggugccaggcauaaucc

SEQ ID NO: 395 - RNA, 20 nt, Artificial Sequence
  Synthetic
gauaaugaccuaauaaugau

SEQ ID NO: 396 - RNA, 20 nt, Artificial Sequence
  Synthetic
gggagaacuggagccuucag

SEQ ID NO: 397 - RNA, 20 nt, Artificial Sequence
  Synthetic
ggagaacuggagccuucaga

SEQ ID NO: 398 - RNA, 20 nt, Artificial Sequence
  Synthetic
guagacuaaccgauugaaua

SEQ ID NO: 399 - RNA, 20 nt, Artificial Sequence
  Synthetic
gucauuaucaaaucacgcuc

SEQ ID NO: 400 - RNA, 17 nt, Artificial Sequence
  Synthetic
ggugauuaugggagaac

SEQ ID NO: 401 - RNA, 17 nt, Artificial Sequence
  Synthetic
gaacuggagccuucaga

SEQ ID NO: 402 - RNA, 17 nt, Artificial Sequence
  Synthetic
ggguaagcuacugugaa

SEQ ID NO: 403 - RNA, 17 nt, Artificial Sequence
  Synthetic
gacuaaccgauugaaua

SEQ ID NO: 404 - RNA, 17 nt, Artificial Sequence
  Synthetic
gagccaaauauauaauu

SEQ ID NO: 405 - RNA, 20 nt, Artificial Sequence
  Synthetic
cauucuguucucaguuuucc

SEQ ID NO: 406 - RNA, 20 nt, Artificial Sequence
  Synthetic
caguuuuccuggauuaugcc

SEQ ID NO: 407 - RNA, 20 nt, Artificial Sequence
  Synthetic
auuaaagaaaauaucaucuu

SEQ ID NO: 408 - RNA, 20 nt, Artificial Sequence
  Synthetic
caaagcaugccaacuagaag

SEQ ID NO: 409 - RNA, 20 nt, Artificial Sequence
  Synthetic
ucuguaucuauauucaucau

SEQ ID NO: 410 - RNA, 20 nt, Artificial Sequence
  Synthetic
aaagaugauauuuucuuuaa

SEQ ID NO: 411 - RNA, 20 nt, Artificial Sequence
  Synthetic
auauuuucuuuaauggugcc

SEQ ID NO: 412 - RNA, 20 nt, Artificial Sequence
  Synthetic
ugcuuaauuuuacccucuga

SEQ ID NO: 413 - RNA, 17 nt, Artificial Sequence
  Synthetic
ucuguucucaguuuucc

SEQ ID NO: 414 - RNA, 17 nt, Artificial Sequence
  Synthetic
uuuuccuggauuaugcc

SEQ ID NO: 415 - RNA, 17 nt, Artificial Sequence
  Synthetic
aaagaaaauaucaucuu

SEQ ID NO: 416 - RNA, 17 nt, Artificial Sequence
  Synthetic
uucuuaccucuucuagu

SEQ ID NO: 417 - RNA, 17 nt, Artificial Sequence
  Synthetic
uuuucuuuaauggugcc

SEQ ID NO: 418 - RNA, 17 nt, Artificial Sequence
  Synthetic
uuaauuuuacccucuga

SEQ ID NO: 419 - RNA, 20 nt, Artificial Sequence
  Synthetic
ugauaaugaccuaauaauga

SEQ ID NO: 420 - RNA, 20 nt, Artificial Sequence
  Synthetic
uuuccagacuucacuucuaa

SEQ ID NO: 421 - RNA, 20 nt, Artificial Sequence
  Synthetic
uucacuucuaauggugauua

SEQ ID NO: 422 - RNA, 20 nt, Artificial Sequence
  Synthetic
ucacuucuaauggugauuau

SEQ ID NO: 423 - RNA, 20 nt, Artificial Sequence
  Synthetic
aauggugauuaugggagaac

SEQ ID NO: 424 - RNA, 20 nt, Artificial Sequence
  Synthetic
cacuacccaaauuauauauu

SEQ ID NO: 425 - RNA, 20 nt, Artificial Sequence
  Synthetic
uauuuggcuccauauucaau

SEQ ID NO: 426 - RNA, 20 nt, Artificial Sequence
  Synthetic
auauauuuauguuuccucua

SEQ ID NO: 427 - RNA, 20 nt, Artificial Sequence
  Synthetic
uauauuuauguuuccucuau

SEQ ID NO: 428 - RNA, 20 nt, Artificial Sequence
  Synthetic
uauggguaagcuacugugaa

SEQ ID NO: 429 - RNA, 20 nt, Artificial Sequence
  Synthetic
ucacaguagcuuacccauag

SEQ ID NO: 430 - RNA, 20 nt, Artificial Sequence
  Synthetic
auggagccaaauauauaauu

SEQ ID NO: 431 - RNA, 20 nt, Artificial Sequence
  Synthetic
uggagccaaauauauaauuu

SEQ ID NO: 432 - RNA, 20 nt, Artificial Sequence
  Synthetic
auauaauuuggguaguguga

SEQ ID NO: 433 - RNA, 20 nt, Artificial Sequence
  Synthetic
uauaauuuggguagugugaa

SEQ ID NO: 434 - RNA, 20 nt, Artificial Sequence
  Synthetic
ucaccauuagaagugaaguc

SEQ ID NO: 435 - RNA, 20 nt, Artificial Sequence
  Synthetic
aaauaaaacccaucauuauu

SEQ ID NO: 436 - RNA, 17 nt, Artificial Sequence
  Synthetic
uaaugaccuaauaauga

SEQ ID NO: 437 - RNA, 17 nt, Artificial Sequence
  Synthetic
aaugaccuaauaaugau

SEQ ID NO: 438 - RNA, 17 nt, Artificial Sequence
  Synthetic
ccagacuucacuucuaa

SEQ ID NO: 439 - RNA, 17 nt, Artificial Sequence
  Synthetic
acuucuaauggugauua

SEQ ID NO: 440 - RNA, 17 nt, Artificial Sequence
  Synthetic
cuucuaauggugauuau

SEQ ID NO: 441 - RNA, 17 nt, Artificial Sequence
  Synthetic
agaacuggagccuucag

SEQ ID NO: 442 - RNA, 17 nt, Artificial Sequence
  Synthetic
uacccaaauuauauauu

SEQ ID NO: 443 - RNA, 17 nt, Artificial Sequence
  Synthetic
uuggcuccauauucaau

SEQ ID NO: 444 - RNA, 17 nt, Artificial Sequence
  Synthetic
uauuuauguuuccucua

SEQ ID NO: 445 - RNA, 17 nt, Artificial Sequence
  Synthetic
auuuauguuuccucuau

SEQ ID NO: 446 - RNA, 17 nt, Artificial Sequence
  Synthetic
caguagcuuacccauag

SEQ ID NO: 447 - RNA, 17 nt, Artificial Sequence
  Synthetic
agccaaauauauaauuu

SEQ ID NO: 448 - RNA, 17 nt, Artificial Sequence
  Synthetic
uaauuuggguaguguga

SEQ ID NO: 449 - RNA, 17 nt, Artificial Sequence
  Synthetic
aauuuggguagugugaa

SEQ ID NO: 450 - RNA, 17 nt, Artificial Sequence
  Synthetic
ccauuagaagugaaguc

SEQ ID NO: 451 - RNA, 17 nt, Artificial Sequence
  Synthetic
uaaaacccaucauuauu

SEQ ID NO: 452 - RNA, 17 nt, Artificial Sequence
  Synthetic
auuaucaaaucacgcuc

SEQ ID NO: 453 - RNA, 20 nt, Artificial Sequence
  Synthetic
gagaaagacaauauaguucu

SEQ ID NO: 454 - RNA, 20 nt, Artificial Sequence
  Synthetic
gguggaaucacacugagugg

SEQ ID NO: 455 - RNA, 20 nt, Artificial Sequence
  Synthetic
cccacuagccauaaaacccc

SEQ ID NO: 456 - RNA, 17 nt, Artificial Sequence
  Synthetic
gguggaaucacacugag

SEQ ID NO: 457 - RNA, 17 nt, Artificial Sequence
  Synthetic
ggaaucacacugagugg

SEQ ID NO: 458 - RNA, 17 nt, Artificial Sequence
  Synthetic
gggguuuuauggcuagu

SEQ ID NO: 459 - RNA, 17 nt, Artificial Sequence
  Synthetic
acuagccauaaaacccc

SEQ ID NO: 460 - RNA, 20 nt, Artificial Sequence
  Synthetic
gacaauauaguucuuggaga

SEQ ID NO: 461 - RNA, 20 nt, Artificial Sequence
  Synthetic
gaagguggaaucacacugag

SEQ ID NO: 462 - RNA, 20 nt, Artificial Sequence
  Synthetic
gagcaagaauuucuuuagca

SEQ ID NO: 463 - RNA, 20 nt, Artificial Sequence
  Synthetic
gaaaaaauccugggguuuua

SEQ ID NO: 464 - RNA, 17 nt, Artificial Sequence
  Synthetic
guucaaaauuucaacug

SEQ ID NO: 465 - RNA, 17 nt, Artificial Sequence
  Synthetic
ggugaauaacuaauuau

SEQ ID NO: 466 - RNA, 17 nt, Artificial Sequence
  Synthetic
gcuuuauauucuguuuc

SEQ ID NO: 467 - RNA, 17 nt, Artificial Sequence
  Synthetic
ggaauugaaaaaauccu

SEQ ID NO: 468 - RNA, 17 nt, Artificial Sequence
  Synthetic
gaauugaaaaaauccug

SEQ ID NO: 469 - RNA, 17 nt, Artificial Sequence
  Synthetic
gucuuucucugcaaacu

SEQ ID NO: 470 - RNA, 20 nt, Artificial Sequence
  Synthetic
aauguucaaaauuucaacug

SEQ ID NO: 471 - RNA, 20 nt, Artificial Sequence
  Synthetic
ugauauaugauuacauuaga

SEQ ID NO: 472 - RNA, 20 nt, Artificial Sequence
  Synthetic
acucucuaauuuucuauuuu

SEQ ID NO: 473 - RNA, 20 nt, Artificial Sequence
  Synthetic
aauuuucuauuuuugguaau

SEQ ID NO: 474 - RNA, 20 nt, Artificial Sequence
  Synthetic
aauauaguucuuggagaagg

SEQ ID NO: 475 - RNA, 20 nt, Artificial Sequence
  Synthetic
caaggugaauaacuaauuau

SEQ ID NO: 476 - RNA, 20 nt, Artificial Sequence
  Synthetic
auugcuuuauauucuguuuc

SEQ ID NO: 477 - RNA, 20 nt, Artificial Sequence
  Synthetic
uucuggaauugaaaaaaucc

SEQ ID NO: 478 - RNA, 20 nt, Artificial Sequence
  Synthetic
ucuggaauugaaaaaauccu

SEQ ID NO: 479 - RNA, 20 nt, Artificial Sequence
  Synthetic
cuggaauugaaaaaauccug

SEQ ID NO: 480 - RNA, 20 nt, Artificial Sequence
  Synthetic
uccugggguuuuauggcuag

SEQ ID NO: 481 - RNA, 20 nt, Artificial Sequence
  Synthetic
ccugggguuuuauggcuagu

SEQ ID NO: 482 - RNA, 20 nt, Artificial Sequence
  Synthetic
cauuuaagaacuauaaauaa

SEQ ID NO: 483 - RNA, 20 nt, Artificial Sequence
  Synthetic
auugucuuucucugcaaacu

SEQ ID NO: 484 - RNA, 20 nt, Artificial Sequence
  Synthetic
augcucaaucugaauuugaa

SEQ ID NO: 485 - RNA, 17 nt, Artificial Sequence
  Synthetic
uauaugauuacauuaga

SEQ ID NO: 486 - RNA, 17 nt, Artificial Sequence
  Synthetic
cucuaauuuucuauuuu

SEQ ID NO: 487 - RNA, 17 nt, Artificial Sequence
  Synthetic
uuucuauuuuugguaau

SEQ ID NO: 488 - RNA, 17 nt, Artificial Sequence
  Synthetic
aaagacaauauaguucu

SEQ ID NO: 489 - RNA, 17 nt, Artificial Sequence
  Synthetic
aauauaguucuuggaga

SEQ ID NO: 490 - RNA, 17 nt, Artificial Sequence
  Synthetic
auaguucuuggagaagg

SEQ ID NO: 491 - RNA, 17 nt, Artificial Sequence
  Synthetic
caagaauuucuuuagca

SEQ ID NO: 492 - RNA, 17 nt, Artificial Sequence
  Synthetic
uggaauugaaaaaaucc

SEQ ID NO: 493 - RNA, 17 nt, Artificial Sequence
  Synthetic
aaaauccugggguuuua

SEQ ID NO: 494 - RNA, 17 nt, Artificial Sequence
  Synthetic
ugggguuuuauggcuag

SEQ ID NO: 495 - RNA, 17 nt, Artificial Sequence
  Synthetic
uuaagaacuauaaauaa

SEQ ID NO: 496 - RNA, 17 nt, Artificial Sequence
  Synthetic
cucaaucugaauuugaa

SEQ ID NO: 497 - RNA, 20 nt, Artificial Sequence
  Synthetic
gcccauaccaggucucaugg

SEQ ID NO: 498 - RNA, 20 nt, Artificial Sequence
  Synthetic
ccauaccaggucucauggag

SEQ ID NO: 499 - RNA, 20 nt, Artificial Sequence
  Synthetic
gcccuccacaguccacucca

SEQ ID NO: 500 - RNA, 20 nt, Artificial Sequence
  Synthetic
ccccuccaugagaccuggua

SEQ ID NO: 501 - RNA, 17 nt, Artificial Sequence
  Synthetic
auaccaggucucaugga

SEQ ID NO: 502 - RNA, 17 nt, Artificial Sequence
  Synthetic
cuccaugagaccuggua

SEQ ID NO: 503 - RNA, 20 nt, Artificial Sequence
  Synthetic
gcagcccauaccaggucuca

SEQ ID NO: 504 - RNA, 20 nt, Artificial Sequence
  Synthetic
ggggaacaagcuggaggagc

SEQ ID NO: 505 - RNA, 20 nt, Artificial Sequence
  Synthetic
guccacuccagggcucauga

SEQ ID NO: 506 - RNA, 20 nt, Artificial Sequence
  Synthetic
ggggaacaagcgugaggagc

SEQ ID NO: 507 - RNA, 20 nt, Artificial Sequence
  Synthetic
gggaacaagcgugaggagca

SEQ ID NO: 508 - RNA, 20 nt, Artificial Sequence
  Synthetic
ggaacaagcgugaggagcag

SEQ ID NO: 509 - RNA, 20 nt, Artificial Sequence
  Synthetic
ggggcugggccccgaaccug

SEQ ID NO: 510 - RNA, 20 nt, Artificial Sequence
  Synthetic
ggcgccccagcagcccacgg

SEQ ID NO: 511 - RNA, 20 nt, Artificial Sequence
  Synthetic
gccccagcagcccacggcgg

SEQ ID NO: 512 - RNA, 20 nt, Artificial Sequence
  Synthetic
gcagcccacggcggaggagg

SEQ ID NO: 513 - RNA, 20 nt, Artificial Sequence
  Synthetic
gugcuguggcucugcaccuu

SEQ ID NO: 514 - RNA, 20 nt, Artificial Sequence
  Synthetic
gcaccuuuggcaugauguac

SEQ ID NO: 515 - RNA, 20 nt, Artificial Sequence
  Synthetic
ggcaugauguacuggcaauu

SEQ ID NO: 516 - RNA, 20 nt, Artificial Sequence
  Synthetic
guagggauugagggugcaga

SEQ ID NO: 517 - RNA, 20 nt, Artificial Sequence
  Synthetic
gagggugcagauggucacug

SEQ ID NO: 518 - RNA, 20 nt, Artificial Sequence
  Synthetic
gggugcagauggucacugcg

SEQ ID NO: 519 - RNA, 20 nt, Artificial Sequence
  Synthetic
gagguugauguugaggcuga

SEQ ID NO: 520 - RNA, 20 nt, Artificial Sequence
  Synthetic
gguugauguugaggcugacg

SEQ ID NO: 521 - RNA, 20 nt, Artificial Sequence
  Synthetic
gagccacagcacugcccaga

SEQ ID NO: 522 - RNA, 20 nt, Artificial Sequence
  Synthetic
gguugugcugggagcacacc

SEQ ID NO: 523 - RNA, 20 nt, Artificial Sequence
  Synthetic
gcggauggcgccguggaugg

SEQ ID NO: 524 - RNA, 20 nt, Artificial Sequence
  Synthetic
gaacucgaagagcucucggu

SEQ ID NO: 525 - RNA, 20 nt, Artificial Sequence
  Synthetic
ggagcgguggaacucgauca

SEQ ID NO: 526 - RNA, 20 nt, Artificial Sequence
  Synthetic
gugggcugcuggggcgccgc

SEQ ID NO: 527 - RNA, 20 nt, Artificial Sequence
  Synthetic
gcuggggcgccgcagguucg

SEQ ID NO: 528 - RNA, 20 nt, Artificial Sequence
  Synthetic
gcccuggaguggacugugga

SEQ ID NO: 529 - RNA, 17 nt, Artificial Sequence
  Synthetic
gcccauaccaggucuca

SEQ ID NO: 530 - RNA, 17 nt, Artificial Sequence
  Synthetic
ggaggggaacaagcugg

SEQ ID NO: 531 - RNA, 17 nt, Artificial Sequence
  Synthetic
gaacaagcuggaggagc

SEQ ID NO: 532 - RNA, 17 nt, Artificial Sequence
  Synthetic
gaaggggaacaagcgug

SEQ ID NO: 533 - RNA, 17 nt, Artificial Sequence
  Synthetic
gaacaagcgugaggagc

SEQ ID NO: 534 - RNA, 17 nt, Artificial Sequence
  Synthetic
gcgugaggagcaggggc

SEQ ID NO: 535 - RNA, 17 nt, Artificial Sequence
  Synthetic
gcugggccccgaaccug

SEQ ID NO: 536 - RNA, 17 nt, Artificial Sequence
  Synthetic
ggcgccccagcagccca

SEQ ID NO: 537 - RNA, 17 nt, Artificial Sequence
  Synthetic
gccccagcagcccacgg

SEQ ID NO: 538 - RNA, 17 nt, Artificial Sequence
  Synthetic
gcagcccacggcggagg

SEQ ID NO: 539 - RNA, 17 nt, Artificial Sequence
  Synthetic
gcccacggcggaggagg

SEQ ID NO: 540 - RNA, 17 nt, Artificial Sequence
  Synthetic
gcacaaccgcaugaaga

SEQ ID NO: 541 - RNA, 17 nt, Artificial Sequence
  Synthetic
gcaugaagacggccuuc

SEQ ID NO: 542 - RNA, 17 nt, Artificial Sequence
  Synthetic
gggauugagggugcaga

SEQ ID NO: 543 - RNA, 17 nt, Artificial Sequence
  Synthetic
ggugcagauggucacug

SEQ ID NO: 544 - RNA, 17 nt, Artificial Sequence
  Synthetic
gugcagauggucacugc

SEQ ID NO: 545 - RNA, 17 nt, Artificial Sequence
  Synthetic
guugauguugaggcuga

SEQ ID NO: 546 - RNA, 17 nt, Artificial Sequence
  Synthetic
gcugggagcacaccagg

SEQ ID NO: 547 - RNA, 17 nt, Artificial Sequence
  Synthetic
ggagcacaccaggcgga

SEQ ID NO: 548 - RNA, 17 nt, Artificial Sequence
  Synthetic
gcggauggcgccgugga

SEQ ID NO: 549 - RNA, 17 nt, Artificial Sequence
  Synthetic
gauggcgccguggaugg

SEQ ID NO: 550 - RNA, 17 nt, Artificial Sequence
  Synthetic
gcucucgguaggagcgg

SEQ ID NO: 551 - RNA, 17 nt, Artificial Sequence
  Synthetic
gcgguggaacucgauca

SEQ ID NO: 552 - RNA, 17 nt, Artificial Sequence
  Synthetic
ggccuccuccuccgccg

SEQ ID NO: 553 - RNA, 17 nt, Artificial Sequence
  Synthetic
gccuccuccuccgccgu

SEQ ID NO: 554 - RNA, 17 nt, Artificial Sequence
  Synthetic
ggcugcuggggcgccgc

SEQ ID NO: 555 - RNA, 17 nt, Artificial Sequence
  Synthetic
ggggcgccgcagguucg

SEQ ID NO: 556 - RNA, 20 nt, Artificial Sequence
  Synthetic
cccauaccaggucucaugga

SEQ ID NO: 557 - RNA, 20 nt, Artificial Sequence
  Synthetic
ucucauggaggggaacaagc

SEQ ID NO: 558 - RNA, 20 nt, Artificial Sequence
  Synthetic
cauggaggggaacaagcugg

SEQ ID NO: 559 - RNA, 20 nt, Artificial Sequence
  Synthetic
agcccuccacaguccacucc

SEQ ID NO: 560 - RNA, 20 nt, Artificial Sequence
  Synthetic
uccacuccagggcucaugaa

SEQ ID NO: 561 - RNA, 20 nt, Artificial Sequence
  Synthetic
ccacuccagggcucaugaag

SEQ ID NO: 562 - RNA, 20 nt, Artificial Sequence
  Synthetic
caugaaggggaacaagcgug

SEQ ID NO: 563 - RNA, 20 nt, Artificial Sequence
  Synthetic
caagcgugaggagcaggggc

SEQ ID NO: 564 - RNA, 20 nt, Artificial Sequence
  Synthetic
aagcgugaggagcaggggcu

SEQ ID NO: 565 - RNA, 20 nt, Artificial Sequence
  Synthetic
ugcggcgccccagcagccca

SEQ ID NO: 566 - RNA, 20 nt, Artificial Sequence
  Synthetic
ccagcagcccacggcggagg

SEQ ID NO: 567 - RNA, 20 nt, Artificial Sequence
  Synthetic
ugcaacaacaccaccaucca

SEQ ID NO: 568 - RNA, 20 nt, Artificial Sequence
  Synthetic
cauccacggcgccauccgcc

SEQ ID NO: 569 - RNA, 20 nt, Artificial Sequence
  Synthetic
ccagcacaaccgcaugaaga

SEQ ID NO: 570 - RNA, 20 nt, Artificial Sequence
  Synthetic
accgcaugaagacggccuuc

SEQ ID NO: 571 - RNA, 20 nt, Artificial Sequence
  Synthetic
ccgcaugaagacggccuucu

SEQ ID NO: 572 - RNA, 20 nt, Artificial Sequence
  Synthetic
cggccuucugggcagugcug

SEQ ID NO: 573 - RNA, 20 nt, Artificial Sequence
  Synthetic
uggcaauucggccugcuuuu

SEQ ID NO: 574 - RNA, 20 nt, Artificial Sequence
  Synthetic
ccucaacaucaaccucaacu

SEQ ID NO: 575 - RNA, 20 nt, Artificial Sequence
  Synthetic
agggugcagauggucacugc

SEQ ID NO: 576 - RNA, 20 nt, Artificial Sequence
  Synthetic
agacgagcuuguccgaguug

SEQ ID NO: 577 - RNA, 20 nt, Artificial Sequence
  Synthetic
ccgaguugagguugauguug

SEQ ID NO: 578 - RNA, 20 nt, Artificial Sequence
  Synthetic
agguugauguugaggcugac

SEQ ID NO: 579 - RNA, 20 nt, Artificial Sequence
  Synthetic
ugaaguacucuccgaaaagc

SEQ ID NO: 580 - RNA, 20 nt, Artificial Sequence
  Synthetic
uugccaguacaucaugccaa

SEQ ID NO: 581 - RNA, 20 nt, Artificial Sequence
  Synthetic
cccagaaggccgucuucaug

SEQ ID NO: 582 - RNA, 20 nt, Artificial Sequence
  Synthetic
ccgucuucaugcgguugugc

SEQ ID NO: 583 - RNA, 20 nt, Artificial Sequence
  Synthetic
cgucuucaugcgguugugcu

SEQ ID NO: 584 - RNA, 20 nt, Artificial Sequence
  Synthetic
ugugcugggagcacaccagg

SEQ ID NO: 585 - RNA, 20 nt, Artificial Sequence
  Synthetic
cugggagcacaccaggcgga

SEQ ID NO: 586 - RNA, 20 nt, Artificial Sequence
  Synthetic
acaccaggcggauggcgccg

SEQ ID NO: 587 - RNA, 20 nt, Artificial Sequence
  Synthetic
caggcggauggcgccgugga

SEQ ID NO: 588 - RNA, 20 nt, Artificial Sequence
  Synthetic
agaagaacucgaagagcucu

SEQ ID NO: 589 - RNA, 20 nt, Artificial Sequence
  Synthetic
cgaagagcucucgguaggag

SEQ ID NO: 590 - RNA, 20 nt, Artificial Sequence
  Synthetic
agagcucucgguaggagcgg

SEQ ID NO: 591 - RNA, 20 nt, Artificial Sequence
  Synthetic
aggagcgguggaacucgauc

SEQ ID NO: 592 - RNA, 20 nt, Artificial Sequence
  Synthetic
cagggccuccuccuccgccg

SEQ ID NO: 593 - RNA, 20 nt, Artificial Sequence
  Synthetic
agggccuccuccuccgccgu

SEQ ID NO: 594 - RNA, 20 nt, Artificial Sequence
  Synthetic
ccuccuccgccgugggcugc

SEQ ID NO: 595 - RNA, 20 nt, Artificial Sequence
  Synthetic
cuccuccgccgugggcugcu

SEQ ID NO: 596 - RNA, 20 nt, Artificial Sequence
  Synthetic
uccuccgccgugggcugcug

SEQ ID NO: 597 - RNA, 20 nt, Artificial Sequence
  Synthetic
cugcuggggcgccgcagguu

SEQ ID NO: 598 - RNA, 20 nt, Artificial Sequence
  Synthetic
ugcuggggcgccgcagguuc

SEQ ID NO: 599 - RNA, 20 nt, Artificial Sequence
  Synthetic
uuguuccccuucaugagccc

SEQ ID NO: 600 - RNA, 20 nt, Artificial Sequence
  Synthetic
ccccuucaugagcccuggag

SEQ ID NO: 601 - RNA, 20 nt, Artificial Sequence
  Synthetic
augagcccuggaguggacug

SEQ ID NO: 602 - RNA, 20 nt, Artificial Sequence
  Synthetic
agcccuggaguggacugugg

SEQ ID NO: 603 - RNA, 20 nt, Artificial Sequence
  Synthetic
uuguuccccuccaugagacc

SEQ ID NO: 604 - RNA, 20 nt, Artificial Sequence
  Synthetic
cccuccaugagaccugguau

SEQ ID NO: 605 - RNA, 17 nt, Artificial Sequence
  Synthetic
cauaccaggucucaugg

SEQ ID NO: 606 - RNA, 17 nt, Artificial Sequence
  Synthetic
uaccaggucucauggag

SEQ ID NO: 607 - RNA, 17 nt, Artificial Sequence
  Synthetic
cauggaggggaacaagc

SEQ ID NO: 608 - RNA, 17 nt, Artificial Sequence
  Synthetic
ccuccacaguccacucc

SEQ ID NO: 609 - RNA, 17 nt, Artificial Sequence
  Synthetic
cuccacaguccacucca

SEQ ID NO: 610 - RNA, 17 nt, Artificial Sequence
  Synthetic
cacuccagggcucauga

SEQ ID NO: 611 - RNA, 17 nt, Artificial Sequence
  Synthetic
acuccagggcucaugaa

SEQ ID NO: 612 - RNA, 17 nt, Artificial Sequence
  Synthetic
cuccagggcucaugaag

SEQ ID NO: 613 - RNA, 17 nt, Artificial Sequence
  Synthetic
aacaagcgugaggagca

SEQ ID NO: 614 - RNA, 17 nt, Artificial Sequence
  Synthetic
acaagcgugaggagcag

SEQ ID NO: 615 - RNA, 17 nt, Artificial Sequence
  Synthetic
cgugaggagcaggggcu

SEQ ID NO: 616 - RNA, 17 nt, Artificial Sequence
  Synthetic
ccagcagcccacggcgg

SEQ ID NO: 617 - RNA, 17 nt, Artificial Sequence
  Synthetic
aacaacaccaccaucca

SEQ ID NO: 618 - RNA, 17 nt, Artificial Sequence
  Synthetic
ccacggcgccauccgcc

SEQ ID NO: 619 - RNA, 17 nt, Artificial Sequence
  Synthetic
caugaagacggccuucu

SEQ ID NO: 620 - RNA, 17 nt, Artificial Sequence
  Synthetic
ccuucugggcagugcug

SEQ ID NO: 621 - RNA, 17 nt, Artificial Sequence
  Synthetic
cuguggcucugcaccuu

SEQ ID NO: 622 - RNA, 17 nt, Artificial Sequence
  Synthetic
ccuuuggcaugauguac

SEQ ID NO: 623 - RNA, 17 nt, Artificial Sequence
  Synthetic
augauguacuggcaauu

SEQ ID NO: 624 - RNA, 17 nt, Artificial Sequence
  Synthetic
caauucggccugcuuuu

SEQ ID NO: 625 - RNA, 17 nt, Artificial Sequence
  Synthetic
caacaucaaccucaacu

SEQ ID NO: 626 - RNA, 17 nt, Artificial Sequence
  Synthetic
ugcagauggucacugcg

SEQ ID NO: 627 - RNA, 17 nt, Artificial Sequence
  Synthetic
cgagcuuguccgaguug

SEQ ID NO: 628 - RNA, 17 nt, Artificial Sequence
  Synthetic
aguugagguugauguug

SEQ ID NO: 629 - RNA, 17 nt, Artificial Sequence
  Synthetic
uugauguugaggcugac

SEQ ID NO: 630 - RNA, 17 nt, Artificial Sequence
  Synthetic
ugauguugaggcugacg

SEQ ID NO: 631 - RNA, 17 nt, Artificial Sequence
  Synthetic
aguacucuccgaaaagc

SEQ ID NO: 632 - RNA, 17 nt, Artificial Sequence
  Synthetic
ccaguacaucaugccaa

SEQ ID NO: 633 - RNA, 17 nt, Artificial Sequence
  Synthetic
ccacagcacugcccaga

SEQ ID NO: 634 - RNA, 17 nt, Artificial Sequence
  Synthetic
agaaggccgucuucaug

SEQ ID NO: 635 - RNA, 17 nt, Artificial Sequence
  Synthetic
ucuucaugcgguugugc

SEQ ID NO: 636 - RNA, 17 nt, Artificial Sequence
  Synthetic
cuucaugcgguugugcu

SEQ ID NO: 637 - RNA, 17 nt, Artificial Sequence
  Synthetic
ugugcugggagcacacc

SEQ ID NO: 638 - RNA, 17 nt, Artificial Sequence
  Synthetic
ccaggcggauggcgccg

SEQ ID NO: 639 - RNA, 17 nt, Artificial Sequence
  Synthetic
agaacucgaagagcucu

SEQ ID NO: 640 - RNA, 17 nt, Artificial Sequence
  Synthetic
cucgaagagcucucggu

SEQ ID NO: 641 - RNA, 17 nt, Artificial Sequence
  Synthetic
agagcucucgguaggag

SEQ ID NO: 642 - RNA, 17 nt, Artificial Sequence
  Synthetic
agcgguggaacucgauc

SEQ ID NO: 643 - RNA, 17 nt, Artificial Sequence
  Synthetic
ccuccgccgugggcugc

SEQ ID NO: 644 - RNA, 17 nt, Artificial Sequence
  Synthetic
cuccgccgugggcugcu

SEQ ID NO: 645 - RNA, 17 nt, Artificial Sequence
  Synthetic
uccgccgugggcugcug

SEQ ID NO: 646 - RNA, 17 nt, Artificial Sequence
  Synthetic
cuggggcgccgcagguu

SEQ ID NO: 647 - RNA, 17 nt, Artificial Sequence
  Synthetic
uggggcgccgcagguuc

SEQ ID NO: 648 - RNA, 17 nt, Artificial Sequence
  Synthetic
uuccccuucaugagccc

SEQ ID NO: 649 - RNA, 17 nt, Artificial Sequence
  Synthetic
cuucaugagcccuggag

SEQ ID NO: 650 - RNA, 17 nt, Artificial Sequence
  Synthetic
agcccuggaguggacug

SEQ ID NO: 651 - RNA, 17 nt, Artificial Sequence
  Synthetic
ccuggaguggacugugg

SEQ ID NO: 652 - RNA, 17 nt, Artificial Sequence
  Synthetic
cuggaguggacugugga

SEQ ID NO: 653 - RNA, 17 nt, Artificial Sequence
  Synthetic
uuccccuccaugagacc

SEQ ID NO: 654 - RNA, 17 nt, Artificial Sequence
  Synthetic
uccaugagaccugguau

SEQ ID NO: 655 - RNA, 20 nt, Artificial Sequence
  Synthetic
uaauuggaggcaagugaauc

SEQ ID NO: 656 - RNA, 20 nt, Artificial Sequence
  Synthetic
uugauaaugaccuaauaaug

SEQ ID NO: 657 - RNA, 20 nt, Artificial Sequence
  Synthetic
cuucacuucuaauggugauu

SEQ ID NO: 658 - RNA, 20 nt, Artificial Sequence
  Synthetic
acuucuaauggugauuaugg

SEQ ID NO: 659 - RNA, 20 nt, Artificial Sequence
  Synthetic
uaauggugauuaugggagaa

SEQ ID NO: 660 - RNA, 20 nt, Artificial Sequence
  Synthetic
uaugggagaacuggagccuu

SEQ ID NO: 661 - RNA, 20 nt, Artificial Sequence
  Synthetic
ugggagaacuggagccuuca

SEQ ID NO: 662 - RNA, 20 nt, Artificial Sequence
  Synthetic
agaggguaaaauuaagcaca

SEQ ID NO: 663 - RNA, 20 nt, Artificial Sequence
  Synthetic
gguaaaauuaagcacagugg

SEQ ID NO: 664 - RNA, 20 nt, Artificial Sequence
  Synthetic
ucauucuguucucaguuuuc

SEQ ID NO: 665 - RNA, 20 nt, Artificial Sequence
  Synthetic
gauuaugccuggcaccauua

SEQ ID NO: 666 - RNA, 20 nt, Artificial Sequence
  Synthetic
caucuuugguguuuccuaug

SEQ ID NO: 667 - RNA, 20 nt, Artificial Sequence
  Synthetic
uccuaugaugaauauagaua

SEQ ID NO: 668 - RNA, 20 nt, Artificial Sequence
  Synthetic
cgucaucaaagcaugccaac

SEQ ID NO: 669 - RNA, 20 nt, Artificial Sequence
  Synthetic
caucaaagcaugccaacuag

SEQ ID NO: 670 - RNA, 20 nt, Artificial Sequence
  Synthetic
gcaugccaacuagaagaggu

SEQ ID NO: 671 - RNA, 20 nt, Artificial Sequence
  Synthetic
uagaagagguaagaaacuau

SEQ ID NO: 672 - RNA, 20 nt, Artificial Sequence
  Synthetic
aaaacuuuuugauuaugcau

SEQ ID NO: 673 - RNA, 20 nt, Artificial Sequence
  Synthetic
cauauauuuauguuuccucu

SEQ ID NO: 674 - RNA, 20 nt, Artificial Sequence
  Synthetic
uccucuauggguaagcuacu

SEQ ID NO: 675 - RNA, 20 nt, Artificial Sequence
  Synthetic
cuauggguaagcuacuguga

SEQ ID NO: 676 - RNA, 20 nt, Artificial Sequence
  Synthetic
ggucauuaucaaaucacgcu

SEQ ID NO: 677 - RNA, 20 nt, Artificial Sequence
  Synthetic
aucaccauuagaagugaagu

SEQ ID NO: 678 - RNA, 20 nt, Artificial Sequence
  Synthetic
ucccauaaucaccauuagaa

SEQ ID NO: 679 - RNA, 20 nt, Artificial Sequence
  Synthetic
aguucucccauaaucaccau

SEQ ID NO: 680 - RNA, 20 nt, Artificial Sequence
  Synthetic
acugugcuuaauuuuacccu

SEQ ID NO: 681 - RNA, 20 nt, Artificial Sequence
  Synthetic
ccaggaaaacugagaacaga

SEQ ID NO: 682 - RNA, 20 nt, Artificial Sequence
  Synthetic
uaauccaggaaaacugagaa

SEQ ID NO: 683 - RNA, 20 nt, Artificial Sequence
  Synthetic
aggcauaauccaggaaaacu

SEQ ID NO: 684 - RNA, 20 nt, Artificial Sequence
  Synthetic
ccaggcauaauccaggaaaa

SEQ ID NO: 685 - RNA, 20 nt, Artificial Sequence
  Synthetic
uaauggugccaggcauaauc

SEQ ID NO: 686 - RNA, 20 nt, Artificial Sequence
  Synthetic
uucuguaucuauauucauca

SEQ ID NO: 687 - RNA, 20 nt, Artificial Sequence
  Synthetic
uauauaauuuggguagugug

SEQ ID NO: 688 - RNA, 20 nt, Artificial Sequence
  Synthetic
aaauauauaauuuggguagu

SEQ ID NO: 689 - RNA, 20 nt, Artificial Sequence
  Synthetic
uauggagccaaauauauaau

SEQ ID NO: 690 - RNA, 20 nt, Artificial Sequence
  Synthetic
uguagacuaaccgauugaau

SEQ ID NO: 691 - RNA, 20 nt, Artificial Sequence
  Synthetic
aauauauguagacuaaccga

SEQ ID NO: 692 - RNA, 20 nt, Artificial Sequence
  Synthetic
uucacaguagcuuacccaua

SEQ ID NO: 693 - RNA, 20 nt, Artificial Sequence
  Synthetic
cauucacaguagcuuaccca

SEQ ID NO: 694 - RNA, 17 nt, Artificial Sequence
  Synthetic
uuggaggcaagugaauc

SEQ ID NO: 695 - RNA, 17 nt, Artificial Sequence
  Synthetic
auaaugaccuaauaaug

SEQ ID NO: 696 - RNA, 17 nt, Artificial Sequence
  Synthetic
cacuucuaauggugauu

SEQ ID NO: 697 - RNA, 17 nt, Artificial Sequence
  Synthetic
ucuaauggugauuaugg

SEQ ID NO: 698 - RNA, 17 nt, Artificial Sequence
  Synthetic
uggugauuaugggagaa

SEQ ID NO: 699 - RNA, 17 nt, Artificial Sequence
  Synthetic
gggagaacuggagccuu

SEQ ID NO: 700 - RNA, 17 nt, Artificial Sequence
  Synthetic
gagaacuggagccuuca

SEQ ID NO: 701 - RNA, 17 nt, Artificial Sequence
  Synthetic
ggguaaaauuaagcaca

SEQ ID NO: 702 - RNA, 17 nt, Artificial Sequence
  Synthetic
aaaauuaagcacagugg

SEQ ID NO: 703 - RNA, 17 nt, Artificial Sequence
  Synthetic
uucuguucucaguuuuc

SEQ ID NO: 704 - RNA, 17 nt, Artificial Sequence
  Synthetic
uaugccuggcaccauua

SEQ ID NO: 705 - RNA, 17 nt, Artificial Sequence
  Synthetic
cuuugguguuuccuaug

SEQ ID NO: 706 - RNA, 17 nt, Artificial Sequence
  Synthetic
uaugaugaauauagaua

SEQ ID NO: 707 - RNA, 17 nt, Artificial Sequence
  Synthetic
caucaaagcaugccaac

SEQ ID NO: 708 - RNA, 17 nt, Artificial Sequence
  Synthetic
caaagcaugccaacuag

SEQ ID NO: 709 - RNA, 17 nt, Artificial Sequence
  Synthetic
ugccaacuagaagaggu

SEQ ID NO: 710 - RNA, 17 nt, Artificial Sequence
  Synthetic
aagagguaagaaacuau

SEQ ID NO: 711 - RNA, 17 nt, Artificial Sequence
  Synthetic
acuuuuugauuaugcau

SEQ ID NO: 712 - RNA, 17 nt, Artificial Sequence
  Synthetic
auauuuauguuuccucu

SEQ ID NO: 713 - RNA, 17 nt, Artificial Sequence
  Synthetic
ucuauggguaagcuacu

SEQ ID NO: 714 - RNA, 17 nt, Artificial Sequence
  Synthetic
uggguaagcuacuguga

SEQ ID NO: 715 - RNA, 17 nt, Artificial Sequence
  Synthetic
cauuaucaaaucacgcu

SEQ ID NO: 716 - RNA, 17 nt, Artificial Sequence
  Synthetic
accauuagaagugaagu

SEQ ID NO: 717 - RNA, 17 nt, Artificial Sequence
  Synthetic
cauaaucaccauuagaa

SEQ ID NO: 718 - RNA, 17 nt, Artificial Sequence
  Synthetic
ucucccauaaucaccau

SEQ ID NO: 719 - RNA, 17 nt, Artificial Sequence
  Synthetic
gugcuuaauuuuacccu

SEQ ID NO: 720 - RNA, 17 nt, Artificial Sequence
  Synthetic
ggaaaacugagaacaga

SEQ ID NO: 721 - RNA, 17 nt, Artificial Sequence
  Synthetic
uccaggaaaacugagaa

SEQ ID NO: 722 - RNA, 17 nt, Artificial Sequence
  Synthetic
cauaauccaggaaaacu

SEQ ID NO: 723 - RNA, 17 nt, Artificial Sequence
  Synthetic
ggcauaauccaggaaaa

SEQ ID NO: 724 - RNA, 17 nt, Artificial Sequence
  Synthetic
uggugccaggcauaauc

SEQ ID NO: 725 - RNA, 17 nt, Artificial Sequence
  Synthetic
uguaucuauauucauca

SEQ ID NO: 726 - RNA, 17 nt, Artificial Sequence
  Synthetic
auaauuuggguagugug

SEQ ID NO: 727 - RNA, 17 nt, Artificial Sequence
  Synthetic
uauauaauuuggguagu

SEQ ID NO: 728 - RNA, 17 nt, Artificial Sequence
  Synthetic
ggagccaaauauauaau

SEQ ID NO: 729 - RNA, 17 nt, Artificial Sequence
  Synthetic
agacuaaccgauugaau

SEQ ID NO: 730 - RNA, 17 nt, Artificial Sequence
  Synthetic
auauguagacuaaccga

SEQ ID NO: 731 - RNA, 17 nt, Artificial Sequence
  Synthetic
acaguagcuuacccaua

SEQ ID NO: 732 - RNA, 17 nt, Artificial Sequence
  Synthetic
ucacaguagcuuaccca

SEQ ID NO: 733 - RNA, 20 nt, Artificial Sequence
  Synthetic
agugugauauaugauuacau

SEQ ID NO: 734 - RNA, 20 nt, Artificial Sequence
  Synthetic
gugauauaugauuacauuag

SEQ ID NO: 735 - RNA, 20 nt, Artificial Sequence
  Synthetic
augugccuuucaaauucaga

SEQ ID NO: 736 - RNA, 20 nt, Artificial Sequence
  Synthetic
uaauuuucuauuuuugguaa

SEQ ID NO: 737 - RNA, 20 nt, Artificial Sequence
  Synthetic
auaggacaucuccaaguuug

SEQ ID NO: 738 - RNA, 20 nt, Artificial Sequence
  Synthetic
aggacaucuccaaguuugca

SEQ ID NO: 739 - RNA, 20 nt, Artificial Sequence
  Synthetic
agagaaagacaauauaguuc

SEQ ID NO: 740 - RNA, 20 nt, Artificial Sequence
  Synthetic
gaaagacaauauaguucuug

SEQ ID NO: 741 - RNA, 20 nt, Artificial Sequence
  Synthetic
caauauaguucuuggagaag

SEQ ID NO: 742 - RNA, 20 nt, Artificial Sequence
  Synthetic
uuggagaagguggaaucaca

SEQ ID NO: 743 - RNA, 20 nt, Artificial Sequence
  Synthetic
agaagguggaaucacacuga

SEQ ID NO: 744 - RNA, 20 nt, Artificial Sequence
  Synthetic
aucacacugaguggagguca

SEQ ID NO: 745 - RNA, 20 nt, Artificial Sequence
  Synthetic
cugaguggaggucaacgagc

SEQ ID NO: 746 - RNA, 20 nt, Artificial Sequence
  Synthetic
gcaagaauuucuuuagcaag

SEQ ID NO: 747 - RNA, 20 nt, Artificial Sequence
  Synthetic
uauugcuuuauauucuguuu

SEQ ID NO: 748 - RNA, 20 nt, Artificial Sequence
  Synthetic
uuuauauucuguuucuggaa

SEQ ID NO: 749 - RNA, 20 nt, Artificial Sequence
  Synthetic
uuucuggaauugaaaaaauc

SEQ ID NO: 750 - RNA, 20 nt, Artificial Sequence
  Synthetic
auccugggguuuuauggcua

SEQ ID NO: 751 - RNA, 20 nt, Artificial Sequence
  Synthetic
gguuuuauggcuaguggguu

SEQ ID NO: 752 - RNA, 20 nt, Artificial Sequence
  Synthetic
guggguuaagaaucacauuu

SEQ ID NO: 753 - RNA, 20 nt, Artificial Sequence
  Synthetic
cuuuaaccacaguugaaauu

SEQ ID NO: 754 - RNA, 20 nt, Artificial Sequence
  Synthetic
cacuauugcuuuaaccacag

SEQ ID NO: 755 - RNA, 20 nt, Artificial Sequence
  Synthetic
uuaguaugcucaaucugaau

SEQ ID NO: 756 - RNA, 20 nt, Artificial Sequence
  Synthetic
ucacuuuuaguaugcucaau

SEQ ID NO: 757 - RNA, 20 nt, Artificial Sequence
  Synthetic
uuaccaaaaauagaaaauua

SEQ ID NO: 758 - RNA, 20 nt, Artificial Sequence
  Synthetic
uauuaccaaaaauagaaaau

SEQ ID NO: 759 - RNA, 20 nt, Artificial Sequence
  Synthetic
agauguccuauuaccaaaaa

SEQ ID NO: 760 - RNA, 20 nt, Artificial Sequence
  Synthetic
uauugucuuucucugcaaac

SEQ ID NO: 761 - RNA, 20 nt, Artificial Sequence
  Synthetic
agugugauuccaccuucucc

SEQ ID NO: 762 - RNA, 20 nt, Artificial Sequence
  Synthetic
auuaguuauucaccuugcua

SEQ ID NO: 763 - RNA, 20 nt, Artificial Sequence
  Synthetic
aaugucuguaauuuuuuuac

SEQ ID NO: 764 - RNA, 20 nt, Artificial Sequence
  Synthetic
aaacagaauauaaagcaaua

SEQ ID NO: 765 - RNA, 20 nt, Artificial Sequence
  Synthetic
agaaacagaauauaaagcaa

SEQ ID NO: 766 - RNA, 20 nt, Artificial Sequence
  Synthetic
gauuuuuucaauuccagaaa

SEQ ID NO: 767 - RNA, 20 nt, Artificial Sequence
  Synthetic
ccccaggauuuuuucaauuc

SEQ ID NO: 768 - RNA, 17 nt, Artificial Sequence
  Synthetic
gugauauaugauuacau

SEQ ID NO: 769 - RNA, 17 nt, Artificial Sequence
  Synthetic
auauaugauuacauuag

SEQ ID NO: 770 - RNA, 17 nt, Artificial Sequence
  Synthetic
ugccuuucaaauucaga

SEQ ID NO: 771 - RNA, 17 nt, Artificial Sequence
  Synthetic
uuuucuauuuuugguaa

SEQ ID NO: 772 - RNA, 17 nt, Artificial Sequence
  Synthetic
ggacaucuccaaguuug

SEQ ID NO: 773 - RNA, 17 nt, Artificial Sequence
  Synthetic
acaucuccaaguuugca

SEQ ID NO: 774 - RNA, 17 nt, Artificial Sequence
  Synthetic
gaaagacaauauaguuc

SEQ ID NO: 775 - RNA, 17 nt, Artificial Sequence
  Synthetic
agacaauauaguucuug

SEQ ID NO: 776 - RNA, 17 nt, Artificial Sequence
  Synthetic
uauaguucuuggagaag

SEQ ID NO: 777 - RNA, 17 nt, Artificial Sequence
  Synthetic
gagaagguggaaucaca

SEQ ID NO: 778 - RNA, 17 nt, Artificial Sequence
  Synthetic
agguggaaucacacuga

SEQ ID NO: 779 - RNA, 17 nt, Artificial Sequence
  Synthetic
acacugaguggagguca

SEQ ID NO: 780 - RNA, 17 nt, Artificial Sequence
  Synthetic
aguggaggucaacgagc

SEQ ID NO: 781 - RNA, 17 nt, Artificial Sequence
  Synthetic
agaauuucuuuagcaag

SEQ ID NO: 782 - RNA, 17 nt, Artificial Sequence
  Synthetic
ugcuuuauauucuguuu

SEQ ID NO: 783 - RNA, 17 nt, Artificial Sequence
  Synthetic
auauucuguuucuggaa

SEQ ID NO: 784 - RNA, 17 nt, Artificial Sequence
  Synthetic
cuggaauugaaaaaauc

SEQ ID NO: 785 - RNA, 17 nt, Artificial Sequence
  Synthetic
cugggguuuuauggcua

SEQ ID NO: 786 - RNA, 17 nt, Artificial Sequence
  Synthetic
uuuauggcuaguggguu

SEQ ID NO: 787 - RNA, 17 nt, Artificial Sequence
  Synthetic
gguuaagaaucacauuu

SEQ ID NO: 788 - RNA, 17 nt, Artificial Sequence
  Synthetic
uaaccacaguugaaauu

SEQ ID NO: 789 - RNA, 17 nt, Artificial Sequence
  Synthetic
uauugcuuuaaccacag

SEQ ID NO: 790 - RNA, 17 nt, Artificial Sequence
  Synthetic
guaugcucaaucugaau

SEQ ID NO: 791 - RNA, 17 nt, Artificial Sequence
  Synthetic
cuuuuaguaugcucaau

SEQ ID NO: 792 - RNA, 17 nt, Artificial Sequence
  Synthetic
ccaaaaauagaaaauua

SEQ ID NO: 793 - RNA, 17 nt, Artificial Sequence
  Synthetic
uaccaaaaauagaaaau

SEQ ID NO: 794 - RNA, 17 nt, Artificial Sequence
  Synthetic
uguccuauuaccaaaaa

SEQ ID NO: 795 - RNA, 17 nt, Artificial Sequence
  Synthetic
ugucuuucucugcaaac

SEQ ID NO: 796 - RNA, 17 nt, Artificial Sequence
  Synthetic
gugauuccaccuucucc

SEQ ID NO: 797 - RNA, 17 nt, Artificial Sequence
  Synthetic
aguuauucaccuugcua

SEQ ID NO: 798 - RNA, 17 nt, Artificial Sequence
  Synthetic
gucuguaauuuuuuuac

SEQ ID NO: 799 - RNA, 17 nt, Artificial Sequence
  Synthetic
cagaauauaaagcaaua

SEQ ID NO: 800 - RNA, 17 nt, Artificial Sequence
  Synthetic
aacagaauauaaagcaa

SEQ ID NO: 801 - RNA, 17 nt, Artificial Sequence
  Synthetic
uuuuucaauuccagaaa

SEQ ID NO: 802 - RNA, 17 nt, Artificial Sequence
  Synthetic
caggauuuuuucaauuc

SEQ ID NO: 803 - RNA, 20 nt, Artificial Sequence
  Synthetic
ugcagcccauaccaggucuc

SEQ ID NO: 804 - RNA, 20 nt, Artificial Sequence
  Synthetic
agcccauaccaggucucaug

SEQ ID NO: 805 - RNA, 20 nt, Artificial Sequence
  Synthetic
gucucauggaggggaacaag

SEQ ID NO: 806 - RNA, 20 nt, Artificial Sequence
  Synthetic
ucauggaggggaacaagcug

SEQ ID NO: 807 - RNA, 20 nt, Artificial Sequence
  Synthetic
aggggaacaagcuggaggag

SEQ ID NO: 808 - RNA, 20 nt, Artificial Sequence
  Synthetic
uagcccuccacaguccacuc

SEQ ID NO: 809 - RNA, 20 nt, Artificial Sequence
  Synthetic
cacaguccacuccagggcuc

SEQ ID NO: 810 - RNA, 20 nt, Artificial Sequence
  Synthetic
aguccacuccagggcucaug

SEQ ID NO: 811 - RNA, 20 nt, Artificial Sequence
  Synthetic
gcucaugaaggggaacaagc

SEQ ID NO: 812 - RNA, 20 nt, Artificial Sequence
  Synthetic
ucaugaaggggaacaagcgu

SEQ ID NO: 813 - RNA, 20 nt, Artificial Sequence
  Synthetic
aggggaacaagcgugaggag

SEQ ID NO: 814 - RNA, 20 nt, Artificial Sequence
  Synthetic
acaagcgugaggagcagggg

SEQ ID NO: 815 - RNA, 20 nt, Artificial Sequence
  Synthetic
ugaggagcaggggcugggcc

SEQ ID NO: 816 - RNA, 20 nt, Artificial Sequence
  Synthetic
cggcgccccagcagcccacg

SEQ ID NO: 817 - RNA, 20 nt, Artificial Sequence
  Synthetic
cgccccagcagcccacggcg

SEQ ID NO: 818 - RNA, 20 nt, Artificial Sequence
  Synthetic
cccagcagcccacggcggag

SEQ ID NO: 819 - RNA, 20 nt, Artificial Sequence
  Synthetic
ggcggaggaggaggcccuga

SEQ ID NO: 820 - RNA, 20 nt, Artificial Sequence
  Synthetic
aucgaguuccaccgcuccua

SEQ ID NO: 821 - RNA, 20 nt, Artificial Sequence
  Synthetic
cgaguuccaccgcuccuacc

SEQ ID NO: 822 - RNA, 20 nt, Artificial Sequence
  Synthetic
ccgcuccuaccgagagcucu

SEQ ID NO: 823 - RNA, 20 nt, Artificial Sequence
  Synthetic
ugugcucccagcacaaccgc

SEQ ID NO: 824 - RNA, 20 nt, Artificial Sequence
  Synthetic
aaccgcaugaagacggccuu

SEQ ID NO: 825 - RNA, 20 nt, Artificial Sequence
  Synthetic
cuggcaauucggccugcuuu

SEQ ID NO: 826 - RNA, 20 nt, Artificial Sequence
  Synthetic
gcaauucggccugcuuuucg

SEQ ID NO: 827 - RNA, 20 nt, Artificial Sequence
  Synthetic
gccucaacaucaaccucaac

SEQ ID NO: 828 - RNA, 20 nt, Artificial Sequence
  Synthetic
uccccuccaugagaccuggu

SEQ ID NO: 829 - RNA, 20 nt, Artificial Sequence
  Synthetic
ccuccagcuuguuccccucc

SEQ ID NO: 830 - RNA, 20 nt, Artificial Sequence
  Synthetic
uggaguggacuguggagggc

SEQ ID NO: 831 - RNA, 20 nt, Artificial Sequence
  Synthetic
gagcccuggaguggacugug

SEQ ID NO: 832 - RNA, 20 nt, Artificial Sequence
  Synthetic
caugagcccuggaguggacu

SEQ ID NO: 833 - RNA, 20 nt, Artificial Sequence
  Synthetic
uccccuucaugagcccugga

SEQ ID NO: 834 - RNA, 20 nt, Artificial Sequence
  Synthetic
cuuguuccccuucaugagcc

SEQ ID NO: 835 - RNA, 20 nt, Artificial Sequence
  Synthetic
ccucacgcuuguuccccuuc

SEQ ID NO: 836 - RNA, 20 nt, Artificial Sequence
  Synthetic
gcugcuggggcgccgcaggu

SEQ ID NO: 837 - RNA, 20 nt, Artificial Sequence
  Synthetic
uccuccuccgccgugggcug

SEQ ID NO: 838 - RNA, 20 nt, Artificial Sequence
  Synthetic
ucagggccuccuccuccgcc

SEQ ID NO: 839 - RNA, 20 nt, Artificial Sequence
  Synthetic
uaggagcgguggaacucgau

SEQ ID NO: 840 - RNA, 20 nt, Artificial Sequence
  Synthetic
aagagcucucgguaggagcg

SEQ ID NO: 841 - RNA, 20 nt, Artificial Sequence
  Synthetic
agaacucgaagagcucucgg

SEQ ID NO: 842 - RNA, 20 nt, Artificial Sequence
  Synthetic
uguuguugcagaagaacucg

SEQ ID NO: 843 - RNA, 20 nt, Artificial Sequence
  Synthetic
ugguguuguugcagaagaac

SEQ ID NO: 844 - RNA, 20 nt, Artificial Sequence
  Synthetic
ggauggugguguuguugcag

SEQ ID NO: 845 - RNA, 20 nt, Artificial Sequence
  Synthetic
cguggauggugguguuguug

SEQ ID NO: 846 - RNA, 20 nt, Artificial Sequence
  Synthetic
cacaccaggcggauggcgcc

SEQ ID NO: 847 - RNA, 20 nt, Artificial Sequence
  Synthetic
uugugcugggagcacaccag

SEQ ID NO: 848 - RNA, 20 nt, Artificial Sequence
  Synthetic
gccgucuucaugcgguugug

SEQ ID NO: 849 - RNA, 20 nt, Artificial Sequence
  Synthetic
ugcagagccacagcacugcc

SEQ ID NO: 850 - RNA, 20 nt, Artificial Sequence
  Synthetic
aguacaucaugccaaaggug

SEQ ID NO: 851 - RNA, 20 nt, Artificial Sequence
  Synthetic
aguacucuccgaaaagcagg

SEQ ID NO: 852 - RNA, 20 nt, Artificial Sequence
  Synthetic
cgggguagcugaaguacucu

SEQ ID NO: 853 - RNA, 20 nt, Artificial Sequence
  Synthetic
uguugaggcugacgggguag

SEQ ID NO: 854 - RNA, 20 nt, Artificial Sequence
  Synthetic
ugagguugauguugaggcug

SEQ ID NO: 855 - RNA, 20 nt, Artificial Sequence
  Synthetic
uguccgaguugagguugaug

SEQ ID NO: 856 - RNA, 20 nt, Artificial Sequence
  Synthetic
ggaagacgagcuuguccgag

SEQ ID NO: 857 - RNA, 20 nt, Artificial Sequence
  Synthetic
ugcggggaagacgagcuugu

SEQ ID NO: 858 - RNA, 20 nt, Artificial Sequence
  Synthetic
agauggucacugcggggaag

SEQ ID NO: 859 - RNA, 20 nt, Artificial Sequence
  Synthetic
ugagggugcagauggucacu

SEQ ID NO: 860 - RNA, 17 nt, Artificial Sequence
  Synthetic
agcccauaccaggucuc

SEQ ID NO: 861 - RNA, 17 nt, Artificial Sequence
  Synthetic
ccauaccaggucucaug

SEQ ID NO: 862 - RNA, 17 nt, Artificial Sequence
  Synthetic
ucauggaggggaacaag

SEQ ID NO: 863 - RNA, 17 nt, Artificial Sequence
  Synthetic
uggaggggaacaagcug

SEQ ID NO: 864 - RNA, 17 nt, Artificial Sequence
  Synthetic
ggaacaagcuggaggag

SEQ ID NO: 865 - RNA, 17 nt, Artificial Sequence
  Synthetic
cccuccacaguccacuc

SEQ ID NO: 866 - RNA, 17 nt, Artificial Sequence
  Synthetic
aguccacuccagggcuc

SEQ ID NO: 867 - RNA, 17 nt, Artificial Sequence
  Synthetic
ccacuccagggcucaug

SEQ ID NO: 868 - RNA, 17 nt, Artificial Sequence
  Synthetic
caugaaggggaacaagc

SEQ ID NO: 869 - RNA, 17 nt, Artificial Sequence
  Synthetic
ugaaggggaacaagcgu

SEQ ID NO: 870 - RNA, 17 nt, Artificial Sequence
  Synthetic
ggaacaagcgugaggag

SEQ ID NO: 871 - RNA, 17 nt, Artificial Sequence
  Synthetic
agcgugaggagcagggg

SEQ ID NO: 872 - RNA, 17 nt, Artificial Sequence
  Synthetic
ggagcaggggcugggcc

SEQ ID NO: 873 - RNA, 17 nt, Artificial Sequence
  Synthetic
cgccccagcagcccacg

SEQ ID NO: 874 - RNA, 17 nt, Artificial Sequence
  Synthetic
cccagcagcccacggcg

SEQ ID NO: 875 - RNA, 17 nt, Artificial Sequence
  Synthetic
agcagcccacggcggag

SEQ ID NO: 876 - RNA, 17 nt, Artificial Sequence
  Synthetic
ggaggaggaggcccuga

SEQ ID NO: 877 - RNA, 17 nt, Artificial Sequence
  Synthetic
gaguuccaccgcuccua

SEQ ID NO: 878 - RNA, 17 nt, Artificial Sequence
  Synthetic
guuccaccgcuccuacc

SEQ ID NO: 879 - RNA, 17 nt, Artificial Sequence
  Synthetic
cuccuaccgagagcucu

SEQ ID NO: 880 - RNA, 17 nt, Artificial Sequence
  Synthetic
gcucccagcacaaccgc

SEQ ID NO: 881 - RNA, 17 nt, Artificial Sequence
  Synthetic
cgcaugaagacggccuu

SEQ ID NO: 882 - RNA, 17 nt, Artificial Sequence
  Synthetic
gcaauucggccugcuuu

SEQ ID NO: 883 - RNA, 17 nt, Artificial Sequence
  Synthetic
auucggccugcuuuucg

SEQ ID NO: 884 - RNA, 17 nt, Artificial Sequence
  Synthetic
ucaacaucaaccucaac

SEQ ID NO: 885 - RNA, 17 nt, Artificial Sequence
  Synthetic
ccuccaugagaccuggu

SEQ ID NO: 886 - RNA, 17 nt, Artificial Sequence
  Synthetic
ccagcuuguuccccucc

SEQ ID NO: 887 - RNA, 17 nt, Artificial Sequence
  Synthetic
aguggacuguggagggc

SEQ ID NO: 888 - RNA, 17 nt, Artificial Sequence
  Synthetic
cccuggaguggacugug

SEQ ID NO: 889 - RNA, 17 nt, Artificial Sequence
  Synthetic
gagcccuggaguggacu

SEQ ID NO: 890 - RNA, 17 nt, Artificial Sequence
  Synthetic
ccuucaugagcccugga

SEQ ID NO: 891 - RNA, 17 nt, Artificial Sequence
  Synthetic
guuccccuucaugagcc

SEQ ID NO: 892 - RNA, 17 nt, Artificial Sequence
  Synthetic
cacgcuuguuccccuuc

SEQ ID NO: 893 - RNA, 17 nt, Artificial Sequence
  Synthetic
gcuggggcgccgcaggu

SEQ ID NO: 894 - RNA, 17 nt, Artificial Sequence
  Synthetic
uccuccgccgugggcug

SEQ ID NO: 895 - RNA, 17 nt, Artificial Sequence
  Synthetic
gggccuccuccuccgcc

SEQ ID NO: 896 - RNA, 17 nt, Artificial Sequence
  Synthetic
gagcgguggaacucgau

SEQ ID NO: 897 - RNA, 17 nt, Artificial Sequence
  Synthetic
agcucucgguaggagcg

SEQ ID NO: 898 - RNA, 17 nt, Artificial Sequence
  Synthetic
acucgaagagcucucgg

SEQ ID NO: 899 - RNA, 17 nt, Artificial Sequence
  Synthetic
uguugcagaagaacucg

SEQ ID NO: 900 - RNA, 17 nt, Artificial Sequence
  Synthetic
uguuguugcagaagaac

SEQ ID NO: 901 - RNA, 17 nt, Artificial Sequence
  Synthetic
uggugguguuguugcag

SEQ ID NO: 902 - RNA, 17 nt, Artificial Sequence
  Synthetic
ggauggugguguuguug

SEQ ID NO: 903 - RNA, 17 nt, Artificial Sequence
  Synthetic
accaggcggauggcgcc

SEQ ID NO: 904 - RNA, 17 nt, Artificial Sequence
  Synthetic
ugcugggagcacaccag

SEQ ID NO: 905 - RNA, 17 nt, Artificial Sequence
  Synthetic
gucuucaugcgguugug

SEQ ID NO: 906 - RNA, 17 nt, Artificial Sequence
  Synthetic
agagccacagcacugcc

SEQ ID NO: 907 - RNA, 17 nt, Artificial Sequence
  Synthetic
acaucaugccaaaggug

SEQ ID NO: 908 - RNA, 17 nt, Artificial Sequence
  Synthetic
acucuccgaaaagcagg

SEQ ID NO: 909 - RNA, 17 nt, Artificial Sequence
  Synthetic
gguagcugaaguacucu

SEQ ID NO: 910 - RNA, 17 nt, Artificial Sequence
  Synthetic
ugaggcugacgggguag

SEQ ID NO: 911 - RNA, 17 nt, Artificial Sequence
  Synthetic
gguugauguugaggcug

SEQ ID NO: 912 - RNA, 17 nt, Artificial Sequence
  Synthetic
ccgaguugagguugaug

SEQ ID NO: 913 - RNA, 17 nt, Artificial Sequence
  Synthetic
agacgagcuuguccgag

SEQ ID NO: 914 - RNA, 17 nt, Artificial Sequence
  Synthetic
ggggaagacgagcuugu

SEQ ID NO: 915 - RNA, 17 nt, Artificial Sequence
  Synthetic
uggucacugcggggaag

SEQ ID NO: 916 - RNA, 17 nt, Artificial Sequence
  Synthetic
gggugcagauggucacu

SEQ ID NO: 917 - RNA, 20 nt, Artificial Sequence
  Synthetic
uggaggcaagugaauccuga

SEQ ID NO: 918 - RNA, 20 nt, Artificial Sequence
  Synthetic
uucauucuguucucaguuuu

SEQ ID NO: 919 - RNA, 20 nt, Artificial Sequence
  Synthetic
uaagaaacuaugugaaaacu

SEQ ID NO: 920 - RNA, 20 nt, Artificial Sequence
  Synthetic
aggucauuaucaaaucacgc

SEQ ID NO: 921 - RNA, 20 nt, Artificial Sequence
  Synthetic
aacauaaauauauguagacu

SEQ ID NO: 922 - RNA, 17 nt, Artificial Sequence
  Synthetic
aggcaagugaauccuga

SEQ ID NO: 923 - RNA, 17 nt, Artificial Sequence
  Synthetic
auucuguucucaguuuu

SEQ ID NO: 924 - RNA, 17 nt, Artificial Sequence
  Synthetic
gaaacuaugugaaaacu

SEQ ID NO: 925 - RNA, 17 nt, Artificial Sequence
  Synthetic
ucauuaucaaaucacgc

SEQ ID NO: 926 - RNA, 17 nt, Artificial Sequence
  Synthetic
auaaauauauguagacu

SEQ ID NO: 927 - RNA, 20 nt, Artificial Sequence
  Synthetic
gguuaaagcaauagugugau

SEQ ID NO: 928 - RNA, 20 nt, Artificial Sequence
  Synthetic
aggaagaugugccuuucaaa

SEQ ID NO: 929 - RNA, 20 nt, Artificial Sequence
  Synthetic
ugcucguugaccuccacuca

SEQ ID NO: 930 - RNA, 20 nt, Artificial Sequence
  Synthetic
aacccacuagccauaaaacc

SEQ ID NO: 931 - RNA, 20 nt, Artificial Sequence
  Synthetic
ccauuauuuauaguucuuaa

SEQ ID NO: 932 - RNA, 17 nt, Artificial Sequence
  Synthetic
uaaagcaauagugugau

SEQ ID NO: 933 - RNA, 17 nt, Artificial Sequence
  Synthetic
aagaugugccuuucaaa

SEQ ID NO: 934 - RNA, 17 nt, Artificial Sequence
  Synthetic
ucguugaccuccacuca

SEQ ID NO: 935 - RNA, 17 nt, Artificial Sequence
  Synthetic
ccacuagccauaaaacc

SEQ ID NO: 936 - RNA, 17 nt, Artificial Sequence
  Synthetic
uuauuuauaguucuuaa

SEQ ID NO: 937 - RNA, 17 nt, Artificial Sequence
  Synthetic
gaagcagccaccuggaa

SEQ ID NO: 938 - RNA, 17 nt, Artificial Sequence
  Synthetic
ggaauauucacuuucca

SEQ ID NO: 939 - RNA, 17 nt, Artificial Sequence
  Synthetic
gaauuuagaugugggca

SEQ ID NO: 940 - RNA, 17 nt, Artificial Sequence
  Synthetic
gugucuuguuccauucc

SEQ ID NO: 941 - RNA, 17 nt, Artificial Sequence
  Synthetic
gugggcaugggaggaau

SEQ ID NO: 942 - RNA, 17 nt, Artificial Sequence
  Synthetic
guugugcuguggcuccu

SEQ ID NO: 943 - RNA, 17 nt, Artificial Sequence
  Synthetic
gaugugaauuuagaugu

SEQ ID NO: 944 - RNA, 20 nt, Artificial Sequence
  Synthetic
gacccaggaacacaaagcaa

SEQ ID NO: 945 - RNA, 20 nt, Artificial Sequence
  Synthetic
gugucaccucacccaacuaa

SEQ ID NO: 946 - RNA, 20 nt, Artificial Sequence
  Synthetic
gugucuuguuccauuccagg

SEQ ID NO: 947 - RNA, 20 nt, Artificial Sequence
  Synthetic
gaugugggcaugggaggaau

SEQ ID NO: 948 - RNA, 20 nt, Artificial Sequence
  Synthetic
gugaauuuagaugugggcau

SEQ ID NO: 949 - RNA, 17 nt, Artificial Sequence
  Synthetic
uugguacacacaucaaa

SEQ ID NO: 950 - RNA, 17 nt, Artificial Sequence
  Synthetic
ucaccucacccaacuaa

SEQ ID NO: 951 - RNA, 17 nt, Artificial Sequence
  Synthetic
aucuacacaauaggaca

SEQ ID NO: 952 - RNA, 17 nt, Artificial Sequence
  Synthetic
uguguguaccaauauca

SEQ ID NO: 953 - RNA, 17 nt, Artificial Sequence
  Synthetic
augguaguggaaagaua

SEQ ID NO: 954 - RNA, 17 nt, Artificial Sequence
  Synthetic
auuucucccaagcauua

SEQ ID NO: 955 - RNA, 17 nt, Artificial Sequence
  Synthetic
ccaaagaagcagccacc

SEQ ID NO: 956 - RNA, 17 nt, Artificial Sequence
  Synthetic
ccuuugcuuuguguucc

SEQ ID NO: 957 - RNA, 17 nt, Artificial Sequence
  Synthetic
cccaagcauuaugguag

SEQ ID NO: 958 - RNA, 17 nt, Artificial Sequence
  Synthetic
uuagaugugggcauggg

SEQ ID NO: 959 - RNA, 17 nt, Artificial Sequence
  Synthetic
cuucuuugguugugcug

SEQ ID NO: 960 - RNA, 17 nt, Artificial Sequence
  Synthetic
ugaccauuaguugggug

SEQ ID NO: 961 - RNA, 17 nt, Artificial Sequence
  Synthetic
aauuuagaugugggcau

SEQ ID NO: 962 - RNA, 17 nt, Artificial Sequence
  Synthetic
uguguguaccuugauau

SEQ ID NO: 963 - RNA, 17 nt, Artificial Sequence
  Synthetic
uccacuaccauaaugcu

SEQ ID NO: 964 - RNA, 17 nt, Artificial Sequence
  Synthetic
aaaugaugaccauuagu

SEQ ID NO: 965 - RNA, 17 nt, Artificial Sequence
  Synthetic
ccacuaccauaaugcuu

SEQ ID NO: 966 - RNA, 17 nt, Artificial Sequence
  Synthetic
ccagguggcugcuucuu

SEQ ID NO: 967 - RNA, 20 nt, Artificial Sequence
  Synthetic
auauugguacacacaucaaa

SEQ ID NO: 968 - RNA, 20 nt, Artificial Sequence
  Synthetic
aaagaagcagccaccuggaa

SEQ ID NO: 969 - RNA, 20 nt, Artificial Sequence
  Synthetic
acaaucuacacaauaggaca

SEQ ID NO: 970 - RNA, 20 nt, Artificial Sequence
  Synthetic
ugugaauuuagaugugggca

SEQ ID NO: 971 - RNA, 20 nt, Artificial Sequence
  Synthetic
ugauguguguaccaauauca

SEQ ID NO: 972 - RNA, 20 nt, Artificial Sequence
  Synthetic
auuaugguaguggaaagaua

SEQ ID NO: 973 - RNA, 20 nt, Artificial Sequence
  Synthetic
uucauuucucccaagcauua

SEQ ID NO: 974 - RNA, 20 nt, Artificial Sequence
  Synthetic
caaccaaagaagcagccacc

SEQ ID NO: 975 - RNA, 20 nt, Artificial Sequence
  Synthetic
acugugucuuguuccauucc

SEQ ID NO: 976 - RNA, 20 nt, Artificial Sequence
  Synthetic
cuuccuuugcuuuguguucc

SEQ ID NO: 977 - RNA, 20 nt, Artificial Sequence
  Synthetic
uacaauacauacaaacauag

SEQ ID NO: 978 - RNA, 20 nt, Artificial Sequence
  Synthetic
ucucccaagcauuaugguag

SEQ ID NO: 979 - RNA, 20 nt, Artificial Sequence
  Synthetic
aauuuagaugugggcauggg

SEQ ID NO: 980 - RNA, 20 nt, Artificial Sequence
  Synthetic
cugcuucuuugguugugcug

SEQ ID NO: 981 - RNA, 20 nt, Artificial Sequence
  Synthetic
ugaugaccauuaguugggug

SEQ ID NO: 982 - RNA, 20 nt, Artificial Sequence
  Synthetic
aauuguguguaccuugauau

SEQ ID NO: 983 - RNA, 20 nt, Artificial Sequence
  Synthetic
uugguugugcuguggcuccu

SEQ ID NO: 984 - RNA, 20 nt, Artificial Sequence
  Synthetic
cuuuccacuaccauaaugcu

SEQ ID NO: 985 - RNA, 20 nt, Artificial Sequence
  Synthetic
uuuaaaugaugaccauuagu

SEQ ID NO: 986 - RNA, 20 nt, Artificial Sequence
  Synthetic
ugugaugugaauuuagaugu

SEQ ID NO: 987 - RNA, 20 nt, Artificial Sequence
  Synthetic
uuuccacuaccauaaugcuu

SEQ ID NO: 988 - RNA, 20 nt, Artificial Sequence
  Synthetic
auuccagguggcugcuucuu

SEQ ID NO: 989 - RNA, 20 nt, Artificial Sequence
  Synthetic
uuaaaugaugaccauuaguu

SEQ ID NO: 990 - RNA, 17 nt, Artificial Sequence
  Synthetic
ggaggagcuaggacuac

SEQ ID NO: 991 - RNA, 17 nt, Artificial Sequence
  Synthetic
ggagaaaugaaacaaag

SEQ ID NO: 992 - RNA, 20 nt, Artificial Sequence
  Synthetic
gugugaugugaauuuagaug

SEQ ID NO: 993 - RNA, 17 nt, Artificial Sequence
  Synthetic
ccaggaacacaaagcaa

SEQ ID NO: 994 - RNA, 17 nt, Artificial Sequence
  Synthetic
aguccuagcuccuccac

SEQ ID NO: 995 - RNA, 17 nt, Artificial Sequence
  Synthetic
aauacauacaaacauag

SEQ ID NO: 996 - RNA, 17 nt, Artificial Sequence
  Synthetic
ucuuguuccauuccagg

SEQ ID NO: 997 - RNA, 17 nt, Artificial Sequence
  Synthetic
ugaugugaauuuagaug

SEQ ID NO: 998 - RNA, 17 nt, Artificial Sequence
  Synthetic
aacacaaucuacacaau

SEQ ID NO: 999 - RNA, 17 nt, Artificial Sequence
  Synthetic
cuuugcuuuguguuccu

SEQ ID NO: 1000 - RNA, 17 nt, Artificial Sequence
  Synthetic
aaugaugaccauuaguu

SEQ ID NO: 1001 - RNA, 20 nt, Artificial Sequence
  Synthetic
cauggaauauucacuuucca

SEQ ID NO: 1002 - RNA, 20 nt, Artificial Sequence
  Synthetic
uguaguccuagcuccuccac

SEQ ID NO: 1003 - RNA, 20 nt, Artificial Sequence
  Synthetic
uguggaggagcuaggacuac

SEQ ID NO: 1004 - RNA, 20 nt, Artificial Sequence
  Synthetic
uugggagaaaugaaacaaag

SEQ ID NO: 1005 - RNA, 20 nt, Artificial Sequence
  Synthetic
uaaaacacaaucuacacaau

SEQ ID NO: 1006 - RNA, 20 nt, Artificial Sequence
  Synthetic
uuccuuugcuuuguguuccu

SEQ ID NO: 1007 - RNA, 22 nt, Artificial Sequence
  Synthetic
gauuacaauacauacaaacaua

SEQ ID NO: 1008 - RNA, 23 nt, Artificial Sequence
  Synthetic
ggauuacaauacauacaaacaua

SEQ ID NO: 1009 - RNA, 18 nt, Artificial Sequence
  Synthetic
gcuguggcuccuuggaaa

SEQ ID NO: 1010 - RNA, 20 nt, Artificial Sequence
  Synthetic
gugcuguggcuccuuggaaa

SEQ ID NO: 1011 - RNA, 23 nt, Artificial Sequence
  Synthetic
guugugcuguggcuccuuggaaa

SEQ ID NO: 1012 - RNA, 24 nt, Artificial Sequence
  Synthetic
gguugugcuguggcuccuuggaaa

SEQ ID NO: 1013 - RNA, 20 nt, Artificial Sequence
  Synthetic
guuuaaaugaugaccauuag

SEQ ID NO: 1014 - RNA, 23 nt, Artificial Sequence
  Synthetic
guacacacaucaaauggugugau

SEQ ID NO: 1015 - RNA, 24 nt, Artificial Sequence
  Synthetic
gguacacacaucaaauggugugau

SEQ ID NO: 1016 - RNA, 18 nt, Artificial Sequence
  Synthetic
ugggagaaaugaaacaaa

SEQ ID NO: 1017 - RNA, 19 nt, Artificial Sequence
  Synthetic
uugggagaaaugaaacaaa

SEQ ID NO: 1018 - RNA, 20 nt, Artificial Sequence
  Synthetic
cuugggagaaaugaaacaaa

SEQ ID NO: 1019 - RNA, 18 nt, Artificial Sequence
  Synthetic
acaauacauacaaacaua

SEQ ID NO: 1020 - RNA, 19 nt, Artificial Sequence
  Synthetic
uacaauacauacaaacaua

SEQ ID NO: 1021 - RNA, 20 nt, Artificial Sequence
  Synthetic
uuacaauacauacaaacaua

SEQ ID NO: 1022 - RNA, 21 nt, Artificial Sequence
  Synthetic
auuacaauacauacaaacaua

SEQ ID NO: 1023 - RNA, 24 nt, Artificial Sequence
  Synthetic
uggauuacaauacauacaaacaua

SEQ ID NO: 1024 - RNA, 18 nt, Artificial Sequence
  Synthetic
accaaagaagcagccacc

SEQ ID NO: 1025 - RNA, 19 nt, Artificial Sequence
  Synthetic
aaccaaagaagcagccacc

SEQ ID NO: 1026 - RNA, 18 nt, Artificial Sequence
  Synthetic
uuccuuugcuuuguguuc

SEQ ID NO: 1027 - RNA, 19 nt, Artificial Sequence
  Synthetic
cuuccuuugcuuuguguuc

SEQ ID NO: 1028 - RNA, 20 nt, Artificial Sequence
  Synthetic
ucuuccuuugcuuuguguuc

SEQ ID NO: 1029 - RNA, 19 nt, Artificial Sequence
  Synthetic
ugcuguggcuccuuggaaa

SEQ ID NO: 1030 - RNA, 21 nt, Artificial Sequence
  Synthetic
ugugcuguggcuccuuggaaa

SEQ ID NO: 1031 - RNA, 22 nt, Artificial Sequence
  Synthetic
uugugcuguggcuccuuggaaa

SEQ ID NO: 1032 - RNA, 18 nt, Artificial Sequence
  Synthetic
uuaaaugaugaccauuag

SEQ ID NO: 1033 - RNA, 19 nt, Artificial Sequence
  Synthetic
uuuaaaugaugaccauuag

SEQ ID NO: 1034 - RNA, 21 nt, Artificial Sequence
  Synthetic
uguuuaaaugaugaccauuag

SEQ ID NO: 1035 - RNA, 22 nt, Artificial Sequence
  Synthetic
uuguuuaaaugaugaccauuag

SEQ ID NO: 1036 - RNA, 23 nt, Artificial Sequence
  Synthetic
uuuguuuaaaugaugaccauuag

SEQ ID NO: 1037 - RNA, 24 nt, Artificial Sequence
  Synthetic
uuuuguuuaaaugaugaccauuag

SEQ ID NO: 1038 - RNA, 18 nt, Artificial Sequence
  Synthetic
uuuagaugugggcauggg

SEQ ID NO: 1039 - RNA, 19 nt, Artificial Sequence
  Synthetic
auuuagaugugggcauggg

SEQ ID NO: 1040 - RNA, 18 nt, Artificial Sequence
  Synthetic
cacaucaaauggugugau

SEQ ID NO: 1041 - RNA, 19 nt, Artificial Sequence
  Synthetic
acacaucaaauggugugau

SEQ ID NO: 1042 - RNA, 20 nt, Artificial Sequence
  Synthetic
cacacaucaaauggugugau

SEQ ID NO: 1043 - RNA, 21 nt, Artificial Sequence
  Synthetic
acacacaucaaauggugugau

SEQ ID NO: 1044 - RNA, 22 nt, Artificial Sequence
  Synthetic
uacacacaucaaauggugugau

SEQ ID NO: 1045 - RNA, 21 nt, Artificial Sequence
  Synthetic
gcuugggagaaaugaaacaaa

SEQ ID NO: 1046 - RNA, 19 nt, Artificial Sequence
  Synthetic
guggaggagcuaggacuac

SEQ ID NO: 1047 - RNA, 23 nt, Artificial Sequence
  Synthetic
gcacaaccaaagaagcagccacc

SEQ ID NO: 1048 - RNA, 21 nt, Artificial Sequence
  Synthetic
gaauuuagaugugggcauggg

SEQ ID NO: 1049 - RNA, 23 nt, Artificial Sequence
  Synthetic
gugaauuuagaugugggcauggg

SEQ ID NO: 1050 - RNA, 22 nt, Artificial Sequence
  Synthetic
ugcuugggagaaaugaaacaaa

SEQ ID NO: 1051 - RNA, 23 nt, Artificial Sequence
  Synthetic
augcuugggagaaaugaaacaaa

SEQ ID NO: 1052 - RNA, 24 nt, Artificial Sequence
  Synthetic
aaugcuugggagaaaugaaacaaa

SEQ ID NO: 1053 - RNA, 18 nt, Artificial Sequence
  Synthetic
aaucuacacaauaggaca

SEQ ID NO: 1054 - RNA, 19 nt, Artificial Sequence
  Synthetic
caaucuacacaauaggaca

SEQ ID NO: 1055 - RNA, 21 nt, Artificial Sequence
  Synthetic
cacaaucuacacaauaggaca

SEQ ID NO: 1056 - RNA, 22 nt, Artificial Sequence
  Synthetic
acacaaucuacacaauaggaca

SEQ ID NO: 1057 - RNA, 23 nt, Artificial Sequence
  Synthetic
aacacaaucuacacaauaggaca

SEQ ID NO: 1058 - RNA, 24 nt, Artificial Sequence
  Synthetic
aaacacaaucuacacaauaggaca

SEQ ID NO: 1059 - RNA, 18 nt, Artificial Sequence
  Synthetic
uggaggagcuaggacuac

SEQ ID NO: 1060 - RNA, 21 nt, Artificial Sequence
  Synthetic
acaaccaaagaagcagccacc

SEQ ID NO: 1061 - RNA, 22 nt, Artificial Sequence
  Synthetic
cacaaccaaagaagcagccacc

SEQ ID NO: 1062 - RNA, 24 nt, Artificial Sequence
  Synthetic
agcacaaccaaagaagcagccacc

SEQ ID NO: 1063 - RNA, 21 nt, Artificial Sequence
  Synthetic
aucuuccuuugcuuuguguuc

SEQ ID NO: 1064 - RNA, 22 nt, Artificial Sequence
  Synthetic
caucuuccuuugcuuuguguuc

SEQ ID NO: 1065 - RNA, 23 nt, Artificial Sequence
  Synthetic
ucaucuuccuuugcuuuguguuc

SEQ ID NO: 1066 - RNA, 24 nt, Artificial Sequence
  Synthetic
uucaucuuccuuugcuuuguguuc

SEQ ID NO: 1067 - RNA, 22 nt, Artificial Sequence
  Synthetic
ugaauuuagaugugggcauggg

SEQ ID NO: 1068 - RNA, 24 nt, Artificial Sequence
  Synthetic
ugugaauuuagaugugggcauggg

SEQ ID NO: 1069 - RNA, 18 nt, Artificial Sequence
  Synthetic
aaaacacaaucuacacaa

SEQ ID NO: 1070 - RNA, 19 nt, Artificial Sequence
  Synthetic
uaaaacacaaucuacacaa

SEQ ID NO: 1071 - RNA, 20 nt, Artificial Sequence
  Synthetic
auaaaacacaaucuacacaa

SEQ ID NO: 1072 - RNA, 21 nt, Artificial Sequence
  Synthetic
aauaaaacacaaucuacacaa

SEQ ID NO: 1073 - RNA, 22 nt, Artificial Sequence
  Synthetic
aaauaaaacacaaucuacacaa

SEQ ID NO: 1074 - RNA, 23 nt, Artificial Sequence
  Synthetic
gaaauaaaacacaaucuacacaa

SEQ ID NO: 1075 - RNA, 24 nt, Artificial Sequence
  Synthetic
agaaauaaaacacaaucuacacaa

SEQ ID NO: 1076 - RNA, 18 nt, Artificial Sequence
  Synthetic
auuacaauauuuaaucaa

SEQ ID NO: 1077 - RNA, 19 nt, Artificial Sequence
  Synthetic
gauuacaauauuuaaucaa

SEQ ID NO: 1078 - RNA, 20 nt, Artificial Sequence
  Synthetic
ggauuacaauauuuaaucaa

SEQ ID NO: 1079 - RNA, 21 nt, Artificial Sequence
  Synthetic
uggauuacaauauuuaaucaa

SEQ ID NO: 1080 - RNA, 22 nt, Artificial Sequence
  Synthetic
guggauuacaauauuuaaucaa

SEQ ID NO: 1081 - RNA, 23 nt, Artificial Sequence
  Synthetic
aguggauuacaauauuuaaucaa

SEQ ID NO: 1082 - RNA, 24 nt, Artificial Sequence
  Synthetic
uaguggauuacaauauuuaaucaa

SEQ ID NO: 1083 - RNA, 18 nt, Artificial Sequence
  Synthetic
ccauaaugcuugggagaa

SEQ ID NO: 1084 - RNA, 19 nt, Artificial Sequence
  Synthetic
accauaaugcuugggagaa

SEQ ID NO: 1085 - RNA, 20 nt, Artificial Sequence
  Synthetic
uaccauaaugcuugggagaa

SEQ ID NO: 1086 - RNA, 21 nt, Artificial Sequence
  Synthetic
cuaccauaaugcuugggagaa

SEQ ID NO: 1087 - RNA, 22 nt, Artificial Sequence
  Synthetic
acuaccauaaugcuugggagaa

SEQ ID NO: 1088 - RNA, 23 nt, Artificial Sequence
  Synthetic
cacuaccauaaugcuugggagaa

SEQ ID NO: 1089 - RNA, 24 nt, Artificial Sequence
  Synthetic
ccacuaccauaaugcuugggagaa

SEQ ID NO: 1090 - RNA, 18 nt, Artificial Sequence
  Synthetic
agaagcagccaccuggaa

SEQ ID NO: 1091 - RNA, 19 nt, Artificial Sequence
  Synthetic
aagaagcagccaccuggaa

SEQ ID NO: 1092 - RNA, 21 nt, Artificial Sequence
  Synthetic
caaagaagcagccaccuggaa

SEQ ID NO: 1093 - RNA, 22 nt, Artificial Sequence
  Synthetic
ccaaagaagcagccaccuggaa

SEQ ID NO: 1094 - RNA, 23 nt, Artificial Sequence
  Synthetic
accaaagaagcagccaccuggaa

SEQ ID NO: 1095 - RNA, 24 nt, Artificial Sequence
  Synthetic
aaccaaagaagcagccaccuggaa

SEQ ID NO: 1096 - RNA, 18 nt, Artificial Sequence
  Synthetic
ggagccacagcacaacca

SEQ ID NO: 1097 - RNA, 19 nt, Artificial Sequence
  Synthetic
aggagccacagcacaacca

SEQ ID NO: 1098 - RNA, 20 nt, Artificial Sequence
  Synthetic
aaggagccacagcacaacca

SEQ ID NO: 1099 - RNA, 21 nt, Artificial Sequence
  Synthetic
caaggagccacagcacaacca

SEQ ID NO: 1100 - RNA, 22 nt, Artificial Sequence
  Synthetic
ccaaggagccacagcacaacca

SEQ ID NO: 1101 - RNA, 23 nt, Artificial Sequence
  Synthetic
uccaaggagccacagcacaacca

SEQ ID NO: 1102 - RNA, 24 nt, Artificial Sequence
  Synthetic
uuccaaggagccacagcacaacca

SEQ ID NO: 1103 - RNA, 18 nt, Artificial Sequence
  Synthetic
uggaauauucacuuucca

SEQ ID NO: 1104 - RNA, 19 nt, Artificial Sequence
  Synthetic
auggaauauucacuuucca

SEQ ID NO: 1105 - RNA, 21 nt, Artificial Sequence
  Synthetic
acauggaauauucacuuucca

SEQ ID NO: 1106 - RNA, 22 nt, Artificial Sequence
  Synthetic
gacauggaauauucacuuucca

SEQ ID NO: 1107 - RNA, 23 nt, Artificial Sequence
  Synthetic
ggacauggaauauucacuuucca

SEQ ID NO: 1108 - RNA, 24 nt, Artificial Sequence
  Synthetic
aggacauggaauauucacuuucca

SEQ ID NO: 1109 - RNA, 18 nt, Artificial Sequence
  Synthetic
aagaagcagccaccugga

SEQ ID NO: 1110 - RNA, 19 nt, Artificial Sequence
  Synthetic
aaagaagcagccaccugga

SEQ ID NO: 1111 - RNA, 20 nt, Artificial Sequence
  Synthetic
caaagaagcagccaccugga

SEQ ID NO: 1112 - RNA, 21 nt, Artificial Sequence
  Synthetic
ccaaagaagcagccaccugga

SEQ ID NO: 1113 - RNA, 22 nt, Artificial Sequence
  Synthetic
accaaagaagcagccaccugga

SEQ ID NO: 1114 - RNA, 23 nt, Artificial Sequence
  Synthetic
aaccaaagaagcagccaccugga

SEQ ID NO: 1115 - RNA, 24 nt, Artificial Sequence
  Synthetic
caaccaaagaagcagccaccugga

SEQ ID NO: 1116 - RNA, 18 nt, Artificial Sequence
  Synthetic
guggaggagcuaggacua

SEQ ID NO: 1117 - RNA, 19 nt, Artificial Sequence
  Synthetic
uguggaggagcuaggacua

SEQ ID NO: 1118 - RNA, 20 nt, Artificial Sequence
  Synthetic
cuguggaggagcuaggacua

SEQ ID NO: 1119 - RNA, 18 nt, Artificial Sequence
  Synthetic
aaccaaagaagcagccac

SEQ ID NO: 1120 - RNA, 19 nt, Artificial Sequence
  Synthetic
caaccaaagaagcagccac

SEQ ID NO: 1121 - RNA, 20 nt, Artificial Sequence
  Synthetic
acaaccaaagaagcagccac

SEQ ID NO: 1122 - RNA, 21 nt, Artificial Sequence
  Synthetic
cacaaccaaagaagcagccac

SEQ ID NO: 1123 - RNA, 22 nt, Artificial Sequence
  Synthetic
gcacaaccaaagaagcagccac

SEQ ID NO: 1124 - RNA, 23 nt, Artificial Sequence
  Synthetic
agcacaaccaaagaagcagccac

SEQ ID NO: 1125 - RNA, 24 nt, Artificial Sequence
  Synthetic
cagcacaaccaaagaagcagccac

SEQ ID NO: 1126 - RNA, 18 nt, Artificial Sequence
  Synthetic
caaucuacacaauaggac

SEQ ID NO: 1127 - RNA, 19 nt, Artificial Sequence
  Synthetic
acaaucuacacaauaggac

SEQ ID NO: 1128 - RNA, 20 nt, Artificial Sequence
  Synthetic
cacaaucuacacaauaggac

SEQ ID NO: 1129 - RNA, 21 nt, Artificial Sequence
  Synthetic
acacaaucuacacaauaggac

SEQ ID NO: 1130 - RNA, 22 nt, Artificial Sequence
  Synthetic
aacacaaucuacacaauaggac

SEQ ID NO: 1131 - RNA, 23 nt, Artificial Sequence
  Synthetic
aaacacaaucuacacaauaggac

SEQ ID NO: 1132 - RNA, 24 nt, Artificial Sequence
  Synthetic
aaaacacaaucuacacaauaggac

SEQ ID NO: 1133 - RNA, 18 nt, Artificial Sequence
  Synthetic
auggaauauucacuuucc

SEQ ID NO: 1134 - RNA, 19 nt, Artificial Sequence
  Synthetic
cauggaauauucacuuucc

SEQ ID NO: 1135 - RNA, 20 nt, Artificial Sequence
  Synthetic
acauggaauauucacuuucc

SEQ ID NO: 1136 - RNA, 21 nt, Artificial Sequence
  Synthetic
gacauggaauauucacuuucc

SEQ ID NO: 1137 - RNA, 22 nt, Artificial Sequence
  Synthetic
ggacauggaauauucacuuucc

SEQ ID NO: 1138 - RNA, 23 nt, Artificial Sequence
  Synthetic
aggacauggaauauucacuuucc

SEQ ID NO: 1139 - RNA, 24 nt, Artificial Sequence
  Synthetic
uaggacauggaauauucacuuucc

SEQ ID NO: 1140 - RNA, 18 nt, Artificial Sequence
  Synthetic
uuuccacuaccauaaugc

SEQ ID NO: 1141 - RNA, 19 nt, Artificial Sequence
  Synthetic
cuuuccacuaccauaaugc

SEQ ID NO: 1142 - RNA, 20 nt, Artificial Sequence
  Synthetic
ucuuuccacuaccauaaugc

SEQ ID NO: 1143 - RNA, 21 nt, Artificial Sequence
  Synthetic
aucuuuccacuaccauaaugc

SEQ ID NO: 1144 - RNA, 22 nt, Artificial Sequence
  Synthetic
uaucuuuccacuaccauaaugc

SEQ ID NO: 1145 - RNA, 23 nt, Artificial Sequence
  Synthetic
uuaucuuuccacuaccauaaugc

SEQ ID NO: 1146 - RNA, 24 nt, Artificial Sequence
  Synthetic
cuuaucuuuccacuaccauaaugc

SEQ ID NO: 1147 - RNA, 18 nt, Artificial Sequence
  Synthetic
cacuaccauaaugcuugg

SEQ ID NO: 1148 - RNA, 19 nt, Artificial Sequence
  Synthetic
ccacuaccauaaugcuugg

SEQ ID NO: 1149 - RNA, 20 nt, Artificial Sequence
  Synthetic
uccacuaccauaaugcuugg

SEQ ID NO: 1150 - RNA, 21 nt, Artificial Sequence
  Synthetic
uuccacuaccauaaugcuugg

SEQ ID NO: 1151 - RNA, 22 nt, Artificial Sequence
  Synthetic
uuuccacuaccauaaugcuugg

SEQ ID NO: 1152 - RNA, 23 nt, Artificial Sequence
  Synthetic
cuuuccacuaccauaaugcuugg

SEQ ID NO: 1153 - RNA, 24 nt, Artificial Sequence
  Synthetic
ucuuuccacuaccauaaugcuugg

SEQ ID NO: 1154 - RNA, 18 nt, Artificial Sequence
  Synthetic
uuccacuaccauaaugcu

SEQ ID NO: 1155 - RNA, 19 nt, Artificial Sequence
  Synthetic
uuuccacuaccauaaugcu

SEQ ID NO: 1156 - RNA, 21 nt, Artificial Sequence
  Synthetic
ucuuuccacuaccauaaugcu

SEQ ID NO: 1157 - RNA, 22 nt, Artificial Sequence
  Synthetic
aucuuuccacuaccauaaugcu

SEQ ID NO: 1158 - RNA, 23 nt, Artificial Sequence
  Synthetic
uaucuuuccacuaccauaaugcu

SEQ ID NO: 1159 - RNA, 24 nt, Artificial Sequence
  Synthetic
uuaucuuuccacuaccauaaugcu

SEQ ID NO: 1160 - RNA, 18 nt, Artificial Sequence
  Synthetic
uccacuaccauaaugcuu

SEQ ID NO: 1161 - RNA, 19 nt, Artificial Sequence
  Synthetic
uuccacuaccauaaugcuu

SEQ ID NO: 1162 - RNA, 21 nt, Artificial Sequence
  Synthetic
cuuuccacuaccauaaugcuu

SEQ ID NO: 1163 - RNA, 22 nt, Artificial Sequence
  Synthetic
ucuuuccacuaccauaaugcuu

SEQ ID NO: 1164 - RNA, 23 nt, Artificial Sequence
  Synthetic
aucuuuccacuaccauaaugcuu

SEQ ID NO: 1165 - RNA, 24 nt, Artificial Sequence
  Synthetic
uaucuuuccacuaccauaaugcuu

SEQ ID NO: 1166 - RNA, 18 nt, Artificial Sequence
  Synthetic
cccaggaacacaaagcaa

SEQ ID NO: 1167 - RNA, 19 nt, Artificial Sequence
  Synthetic
acccaggaacacaaagcaa

SEQ ID NO: 1168 - RNA, 21 nt, Artificial Sequence
  Synthetic
ggacccaggaacacaaagcaa

SEQ ID NO: 1169 - RNA, 22 nt, Artificial Sequence
  Synthetic
uggacccaggaacacaaagcaa

SEQ ID NO: 1170 - RNA, 23 nt, Artificial Sequence
  Synthetic
cuggacccaggaacacaaagcaa

SEQ ID NO: 1171 - RNA, 24 nt, Artificial Sequence
  Synthetic
gcuggacccaggaacacaaagcaa

SEQ ID NO: 1172 - RNA, 18 nt, Artificial Sequence
  Synthetic
acccaggaacacaaagca

SEQ ID NO: 1173 - RNA, 19 nt, Artificial Sequence
  Synthetic
gacccaggaacacaaagca

SEQ ID NO: 1174 - RNA, 20 nt, Artificial Sequence
  Synthetic
ggacccaggaacacaaagca

SEQ ID NO: 1175 - RNA, 21 nt, Artificial Sequence
  Synthetic
uggacccaggaacacaaagca

SEQ ID NO: 1176 - RNA, 22 nt, Artificial Sequence
  Synthetic
cuggacccaggaacacaaagca

SEQ ID NO: 1177 - RNA, 23 nt, Artificial Sequence
  Synthetic
gcuggacccaggaacacaaagca

SEQ ID NO: 1178 - RNA, 24 nt, Artificial Sequence
  Synthetic
ugcuggacccaggaacacaaagca

SEQ ID NO: 1179 - RNA, 18 nt, Artificial Sequence
  Synthetic
ugaauuuagaugugggca

SEQ ID NO: 1180 - RNA, 19 nt, Artificial Sequence
  Synthetic
gugaauuuagaugugggca

SEQ ID NO: 1181 - RNA, 21 nt, Artificial Sequence
  Synthetic
augugaauuuagaugugggca

SEQ ID NO: 1182 - RNA, 22 nt, Artificial Sequence
  Synthetic
gaugugaauuuagaugugggca

SEQ ID NO: 1183 - RNA, 23 nt, Artificial Sequence
  Synthetic
ugaugugaauuuagaugugggca

SEQ ID NO: 1184 - RNA, 24 nt, Artificial Sequence
  Synthetic
gugaugugaauuuagaugugggca

SEQ ID NO: 1185 - RNA, 18 nt, Artificial Sequence
  Synthetic
cucccaagcauuauggua

SEQ ID NO: 1186 - RNA, 19 nt, Artificial Sequence
  Synthetic
ucucccaagcauuauggua

SEQ ID NO: 1187 - RNA, 20 nt, Artificial Sequence
  Synthetic
uucucccaagcauuauggua

SEQ ID NO: 1188 - RNA, 21 nt, Artificial Sequence
  Synthetic
uuucucccaagcauuauggua

SEQ ID NO: 1189 - RNA, 22 nt, Artificial Sequence
  Synthetic
auuucucccaagcauuauggua

SEQ ID NO: 1190 - RNA, 23 nt, Artificial Sequence
  Synthetic
cauuucucccaagcauuauggua

SEQ ID NO: 1191 - RNA, 24 nt, Artificial Sequence
  Synthetic
ucauuucucccaagcauuauggua

SEQ ID NO: 1192 - RNA, 18 nt, Artificial Sequence
  Synthetic
ugguugugcuguggcucc

SEQ ID NO: 1193 - RNA, 19 nt, Artificial Sequence
  Synthetic
uugguugugcuguggcucc

SEQ ID NO: 1194 - RNA, 20 nt, Artificial Sequence
  Synthetic
uuugguugugcuguggcucc

SEQ ID NO: 1195 - RNA, 21 nt, Artificial Sequence
  Synthetic
cuuugguugugcuguggcucc

SEQ ID NO: 1196 - RNA, 22 nt, Artificial Sequence
  Synthetic
ucuuugguugugcuguggcucc

SEQ ID NO: 1197 - RNA, 23 nt, Artificial Sequence
  Synthetic
uucuuugguugugcuguggcucc

SEQ ID NO: 1198 - RNA, 24 nt, Artificial Sequence
  Synthetic
cuucuuugguugugcuguggcucc

SEQ ID NO: 1199 - RNA, 18 nt, Artificial Sequence
  Synthetic
gugaauuuagaugugggc

SEQ ID NO: 1200 - RNA, 19 nt, Artificial Sequence
  Synthetic
ugugaauuuagaugugggc

SEQ ID NO: 1201 - RNA, 20 nt, Artificial Sequence
  Synthetic
augugaauuuagaugugggc

SEQ ID NO: 1202 - RNA, 21 nt, Artificial Sequence
  Synthetic
gaugugaauuuagaugugggc

SEQ ID NO: 1203 - RNA, 22 nt, Artificial Sequence
  Synthetic
ugaugugaauuuagaugugggc

SEQ ID NO: 1204 - RNA, 23 nt, Artificial Sequence
  Synthetic
gugaugugaauuuagaugugggc

SEQ ID NO: 1205 - RNA, 24 nt, Artificial Sequence
  Synthetic
ugugaugugaauuuagaugugggc

SEQ ID NO: 1206 - RNA, 18 nt, Artificial Sequence
  Synthetic
aacacaaagcaaaggaag

SEQ ID NO: 1207 - RNA, 19 nt, Artificial Sequence
  Synthetic
gaacacaaagcaaaggaag

SEQ ID NO: 1208 - RNA, 20 nt, Artificial Sequence
  Synthetic
ggaacacaaagcaaaggaag

SEQ ID NO: 1209 - RNA, 21 nt, Artificial Sequence
  Synthetic
aggaacacaaagcaaaggaag

SEQ ID NO: 1210 - RNA, 22 nt, Artificial Sequence
  Synthetic
caggaacacaaagcaaaggaag

SEQ ID NO: 1211 - RNA, 23 nt, Artificial Sequence
  Synthetic
ccaggaacacaaagcaaaggaag

SEQ ID NO: 1212 - RNA, 24 nt, Artificial Sequence
  Synthetic
cccaggaacacaaagcaaaggaag

SEQ ID NO: 1213 - RNA, 18 nt, Artificial Sequence
  Synthetic
ugggcaugggaggaauag

SEQ ID NO: 1214 - RNA, 19 nt, Artificial Sequence
  Synthetic
gugggcaugggaggaauag

SEQ ID NO: 1215 - RNA, 20 nt, Artificial Sequence
  Synthetic
ugugggcaugggaggaauag

SEQ ID NO: 1216 - RNA, 21 nt, Artificial Sequence
  Synthetic
augugggcaugggaggaauag

SEQ ID NO: 1217 - RNA, 22 nt, Artificial Sequence
  Synthetic
gaugugggcaugggaggaauag

SEQ ID NO: 1218 - RNA, 23 nt, Artificial Sequence
  Synthetic
agaugugggcaugggaggaauag

SEQ ID NO: 1219 - RNA, 24 nt, Artificial Sequence
  Synthetic
uagaugugggcaugggaggaauag

SEQ ID NO: 1220 - RNA, 18 nt, Artificial Sequence
  Synthetic
ucccaagcauuaugguag

SEQ ID NO: 1221 - RNA, 19 nt, Artificial Sequence
  Synthetic
cucccaagcauuaugguag

SEQ ID NO: 1222 - RNA, 21 nt, Artificial Sequence
  Synthetic
uucucccaagcauuaugguag

SEQ ID NO: 1223 - RNA, 22 nt, Artificial Sequence
  Synthetic
uuucucccaagcauuaugguag

SEQ ID NO: 1224 - RNA, 23 nt, Artificial Sequence
  Synthetic
auuucucccaagcauuaugguag

SEQ ID NO: 1225 - RNA, 24 nt, Artificial Sequence
  Synthetic
cauuucucccaagcauuaugguag

SEQ ID NO: 1226 - RNA, 18 nt, Artificial Sequence
  Synthetic
auuuagaugugggcaugg

SEQ ID NO: 1227 - RNA, 19 nt, Artificial Sequence
  Synthetic
aauuuagaugugggcaugg

SEQ ID NO: 1228 - RNA, 20 nt, Artificial Sequence
  Synthetic
gaauuuagaugugggcaugg

SEQ ID NO: 1229 - RNA, 21 nt, Artificial Sequence
  Synthetic
ugaauuuagaugugggcaugg

SEQ ID NO: 1230 - RNA, 22 nt, Artificial Sequence
  Synthetic
gugaauuuagaugugggcaugg

SEQ ID NO: 1231 - RNA, 23 nt, Artificial Sequence
  Synthetic
ugugaauuuagaugugggcaugg

SEQ ID NO: 1232 - RNA, 24 nt, Artificial Sequence
  Synthetic
augugaauuuagaugugggcaugg

SEQ ID NO: 1233 - RNA, 18 nt, Artificial Sequence
  Synthetic
augaugaccauuaguugg

SEQ ID NO: 1234 - RNA, 19 nt, Artificial Sequence
  Synthetic
aaugaugaccauuaguugg

SEQ ID NO: 1235 - RNA, 20 nt, Artificial Sequence
  Synthetic
aaaugaugaccauuaguugg

SEQ ID NO: 1236 - RNA, 21 nt, Artificial Sequence
  Synthetic
uaaaugaugaccauuaguugg

SEQ ID NO: 1237 - RNA, 22 nt, Artificial Sequence
  Synthetic
uuaaaugaugaccauuaguugg

SEQ ID NO: 1238 - RNA, 23 nt, Artificial Sequence
  Synthetic
uuuaaaugaugaccauuaguugg

SEQ ID NO: 1239 - RNA, 24 nt, Artificial Sequence
  Synthetic
guuuaaaugaugaccauuaguugg

SEQ ID NO: 1240 - RNA, 18 nt, Artificial Sequence
  Synthetic
gaauuuagaugugggcau

SEQ ID NO: 1241 - RNA, 19 nt, Artificial Sequence
  Synthetic
ugaauuuagaugugggcau

SEQ ID NO: 1242 - RNA, 21 nt, Artificial Sequence
  Synthetic
ugugaauuuagaugugggcau

SEQ ID NO: 1243 - RNA, 22 nt, Artificial Sequence
  Synthetic
augugaauuuagaugugggcau

SEQ ID NO: 1244 - RNA, 23 nt, Artificial Sequence
  Synthetic
gaugugaauuuagaugugggcau

SEQ ID NO: 1245 - RNA, 24 nt, Artificial Sequence
  Synthetic
ugaugugaauuuagaugugggcau

SEQ ID NO: 1246 - RNA, 18 nt, Artificial Sequence
  Synthetic
ugugaugugaauuuagau

SEQ ID NO: 1247 - RNA, 19 nt, Artificial Sequence
  Synthetic
gugugaugugaauuuagau

SEQ ID NO: 1248 - RNA, 20 nt, Artificial Sequence
  Synthetic
ggugugaugugaauuuagau

SEQ ID NO: 1249 - RNA, 21 nt, Artificial Sequence
  Synthetic
uggugugaugugaauuuagau

SEQ ID NO: 1250 - RNA, 22 nt, Artificial Sequence
  Synthetic
auggugugaugugaauuuagau

SEQ ID NO: 1251 - RNA, 23 nt, Artificial Sequence
  Synthetic
aauggugugaugugaauuuagau

SEQ ID NO: 1252 - RNA, 24 nt, Artificial Sequence
  Synthetic
aaauggugugaugugaauuuagau

SEQ ID NO: 1253 - RNA, 18 nt, Artificial Sequence
  Synthetic
gguugugcuguggcuccu

SEQ ID NO: 1254 - RNA, 19 nt, Artificial Sequence
  Synthetic
ugguugugcuguggcuccu

SEQ ID NO: 1255 - RNA, 21 nt, Artificial Sequence
  Synthetic
uuugguugugcuguggcuccu

SEQ ID NO: 1256 - RNA, 22 nt, Artificial Sequence
  Synthetic
cuuugguugugcuguggcuccu

SEQ ID NO: 1257 - RNA, 23 nt, Artificial Sequence
  Synthetic
ucuuugguugugcuguggcuccu

SEQ ID NO: 1258 - RNA, 24 nt, Artificial Sequence
  Synthetic
uucuuugguugugcuguggcuccu

SEQ ID NO: 1259 - RNA, 18 nt, Artificial Sequence
  Synthetic
aggaauaggugaagaugu

SEQ ID NO: 1260 - RNA, 19 nt, Artificial Sequence
  Synthetic
gaggaauaggugaagaugu

SEQ ID NO: 1261 - RNA, 20 nt, Artificial Sequence
  Synthetic
ggaggaauaggugaagaugu

SEQ ID NO: 1262 - RNA, 21 nt, Artificial Sequence
  Synthetic
gggaggaauaggugaagaugu

SEQ ID NO: 1263 - RNA, 22 nt, Artificial Sequence
  Synthetic
ugggaggaauaggugaagaugu

SEQ ID NO: 1264 - RNA, 23 nt, Artificial Sequence
  Synthetic
augggaggaauaggugaagaugu

SEQ ID NO: 1265 - RNA, 24 nt, Artificial Sequence
  Synthetic
caugggaggaauaggugaagaugu

SEQ ID NO: 1266 - RNA, 17 nt, Artificial Sequence
  Synthetic
ggaauggaacaagacac

SEQ ID NO: 1267 - RNA, 20 nt, Artificial Sequence
  Synthetic
gcuugggagaaaugaaacaa

SEQ ID NO: 1268 - RNA, 20 nt, Artificial Sequence
  Synthetic
guacacacaauuucaucuuc

SEQ ID NO: 1269 - RNA, 17 nt, Artificial Sequence
  Synthetic
ugggagaaaugaaacaa

SEQ ID NO: 1270 - RNA, 17 nt, Artificial Sequence
  Synthetic
uuaucuuuccacuacca

SEQ ID NO: 1271 - RNA, 17 nt, Artificial Sequence
  Synthetic
cacacaauuucaucuuc

SEQ ID NO: 1272 - RNA, 17 nt, Artificial Sequence
  Synthetic
agauuguguuuuauuuc

SEQ ID NO: 1273 - RNA, 17 nt, Artificial Sequence
  Synthetic
uauuccauguccuauug

SEQ ID NO: 1274 - RNA, 17 nt, Artificial Sequence
  Synthetic
cuuguuccauuccaggu

SEQ ID NO: 1275 - RNA, 20 nt, Artificial Sequence
  Synthetic
accuuaucuuuccacuacca

SEQ ID NO: 1276 - RNA, 20 nt, Artificial Sequence
  Synthetic
ccuggaauggaacaagacac

SEQ ID NO: 1277 - RNA, 20 nt, Artificial Sequence
  Synthetic
uguagauuguguuuuauuuc

SEQ ID NO: 1278 - RNA, 20 nt, Artificial Sequence
  Synthetic
auuacaauacauacaaacau

SEQ ID NO: 1279 - RNA, 20 nt, Artificial Sequence
  Synthetic
gaauauuccauguccuauug

SEQ ID NO: 1280 - RNA, 17 nt, Artificial Sequence
  Synthetic
acaauacauacaaacau

SEQ ID NO: 1281 - RNA, 20 nt, Artificial Sequence
  Synthetic
ugucuuguuccauuccaggu

SEQ ID NO: 1282 - RNA, 17 nt, Artificial Sequence
  Synthetic
guaaggcugccguccga

SEQ ID NO: 1283 - RNA, 17 nt, Artificial Sequence
  Synthetic
ggaaauauuucacaggc

SEQ ID NO: 1284 - RNA, 17 nt, Artificial Sequence
  Synthetic
guaaauucagagcuuug

SEQ ID NO: 1285 - RNA, 20 nt, Artificial Sequence
  Synthetic
ggacacuucgugccuucgga

SEQ ID NO: 1286 - RNA, 20 nt, Artificial Sequence
  Synthetic
ggaaccagcgcaguguugac

SEQ ID NO: 1287 - RNA, 20 nt, Artificial Sequence
  Synthetic
guaacaagaugagugaaaau

SEQ ID NO: 1288 - RNA, 17 nt, Artificial Sequence
  Synthetic
cuuguuacaagcuuaaa

SEQ ID NO: 1289 - RNA, 17 nt, Artificial Sequence
  Synthetic
cauaucuauucaaagaa

SEQ ID NO: 1290 - RNA, 17 nt, Artificial Sequence
  Synthetic
uacuuggcuaccagaga

SEQ ID NO: 1291 - RNA, 17 nt, Artificial Sequence
  Synthetic
cacuucgugccuucgga

SEQ ID NO: 1292 - RNA, 17 nt, Artificial Sequence
  Synthetic
caagcuuaaaaggacua

SEQ ID NO: 1293 - RNA, 17 nt, Artificial Sequence
  Synthetic
auuuacauacugccaac

SEQ ID NO: 1294 - RNA, 17 nt, Artificial Sequence
  Synthetic
aaagcuuuuuuucacac

SEQ ID NO: 1295 - RNA, 17 nt, Artificial Sequence
  Synthetic
cuauggaaauauuucac

SEQ ID NO: 1296 - RNA, 17 nt, Artificial Sequence
  Synthetic
accagcgcaguguugac

SEQ ID NO: 1297 - RNA, 17 nt, Artificial Sequence
  Synthetic
accugucaacacugcgc

SEQ ID NO: 1298 - RNA, 17 nt, Artificial Sequence
  Synthetic
cuaauuuagucuuuuuc

SEQ ID NO: 1299 - RNA, 17 nt, Artificial Sequence
  Synthetic
cauaucacaaaugucau

SEQ ID NO: 1300 - RNA, 17 nt, Artificial Sequence
  Synthetic
acuuggcuaccagagau

SEQ ID NO: 1301 - RNA, 17 nt, Artificial Sequence
  Synthetic
uacccucuuuuuuuacu

SEQ ID NO: 1302 - RNA, 17 nt, Artificial Sequence
  Synthetic
cagguacaagaaccagu

SEQ ID NO: 1303 - RNA, 17 nt, Artificial Sequence
  Synthetic
uggacacuucgugccuu

SEQ ID NO: 1304 - RNA, 20 nt, Artificial Sequence
  Synthetic
caucuuguuacaagcuuaaa

SEQ ID NO: 1305 - RNA, 20 nt, Artificial Sequence
  Synthetic
aaucauaucuauucaaagaa

SEQ ID NO: 1306 - RNA, 20 nt, Artificial Sequence
  Synthetic
uuuuacuuggcuaccagaga

SEQ ID NO: 1307 - RNA, 20 nt, Artificial Sequence
  Synthetic
aaaguaaggcugccguccga

SEQ ID NO: 1308 - RNA, 20 nt, Artificial Sequence
  Synthetic
uuacaagcuuaaaaggacua

SEQ ID NO: 1309 - RNA, 20 nt, Artificial Sequence
  Synthetic
uggaacagaguuucaaagua

SEQ ID NO: 1310 - RNA, 20 nt, Artificial Sequence
  Synthetic
ugaauuuacauacugccaac

SEQ ID NO: 1311 - RNA, 20 nt, Artificial Sequence
  Synthetic
uaaaaagcuuuuuuucacac

SEQ ID NO: 1312 - RNA, 20 nt, Artificial Sequence
  Synthetic
uuucuauggaaauauuucac

SEQ ID NO: 1313 - RNA, 20 nt, Artificial Sequence
  Synthetic
uguaccugucaacacugcgc

SEQ ID NO: 1314 - RNA, 20 nt, Artificial Sequence
  Synthetic
uauggaaauauuucacaggc

SEQ ID NO: 1315 - RNA, 20 nt, Artificial Sequence
  Synthetic
ugguagccaaguaaaaaaag

SEQ ID NO: 1316 - RNA, 20 nt, Artificial Sequence
  Synthetic
uauguaaauucagagcuuug

SEQ ID NO: 1317 - RNA, 20 nt, Artificial Sequence
  Synthetic
aaucauaucacaaaugucau

SEQ ID NO: 1318 - RNA, 20 nt, Artificial Sequence
  Synthetic
uuuacuuggcuaccagagau

SEQ ID NO: 1319 - RNA, 20 nt, Artificial Sequence
  Synthetic
aguuacccucuuuuuuuacu

SEQ ID NO: 1320 - RNA, 20 nt, Artificial Sequence
  Synthetic
ugacagguacaagaaccagu

SEQ ID NO: 1321 - RNA, 20 nt, Artificial Sequence
  Synthetic
cuauggacacuucgugccuu

SEQ ID NO: 1322 - RNA, 20 nt, Artificial Sequence
  Synthetic
gguagccaaguaaaaaaaga

SEQ ID NO: 1323 - RNA, 20 nt, Artificial Sequence
  Synthetic
guuauuugcaguguuuucua

SEQ ID NO: 1324 - RNA, 17 nt, Artificial Sequence
  Synthetic
agccaaguaaaaaaaga

SEQ ID NO: 1325 - RNA, 17 nt, Artificial Sequence
  Synthetic
auuugcaguguuuucua

SEQ ID NO: 1326 - RNA, 17 nt, Artificial Sequence
  Synthetic
aacagaguuucaaagua

SEQ ID NO: 1327 - RNA, 17 nt, Artificial Sequence
  Synthetic
uagccaaguaaaaaaag

SEQ ID NO: 1328 - RNA, 17 nt, Artificial Sequence
  Synthetic
acaagaugagugaaaau

SEQ ID NO: 1329 - RNA, 20 nt, Artificial Sequence
  Synthetic
auucuaauuuagucuuuuuc

SEQ ID NO: 1330 - RNA, 22 nt, Artificial Sequence
  Synthetic
guccuuuuaagcuuguaacaag

SEQ ID NO: 1331 - RNA, 20 nt, Artificial Sequence
  Synthetic
guaccugaaaaagacuaaau

SEQ ID NO: 1332 - RNA, 24 nt, Artificial Sequence
  Synthetic
gucaacacugcgcugguuccaaau

SEQ ID NO: 1333 - RNA, 18 nt, Artificial Sequence
  Synthetic
uuuuaagcuuguaacaag

SEQ ID NO: 1334 - RNA, 19 nt, Artificial Sequence
  Synthetic
cuuuuaagcuuguaacaag

SEQ ID NO: 1335 - RNA, 20 nt, Artificial Sequence
  Synthetic
ccuuuuaagcuuguaacaag

SEQ ID NO: 1336 - RNA, 21 nt, Artificial Sequence
  Synthetic
uccuuuuaagcuuguaacaag

SEQ ID NO: 1337 - RNA, 23 nt, Artificial Sequence
  Synthetic
aguccuuuuaagcuuguaacaag

SEQ ID NO: 1338 - RNA, 24 nt, Artificial Sequence
  Synthetic
uaguccuuuuaagcuuguaacaag

SEQ ID NO: 1339 - RNA, 18 nt, Artificial Sequence
  Synthetic
accugaaaaagacuaaau

SEQ ID NO: 1340 - RNA, 19 nt, Artificial Sequence
  Synthetic
uaccugaaaaagacuaaau

SEQ ID NO: 1341 - RNA, 21 nt, Artificial Sequence
  Synthetic
uguaccugaaaaagacuaaau

SEQ ID NO: 1342 - RNA, 22 nt, Artificial Sequence
  Synthetic
uuguaccugaaaaagacuaaau

SEQ ID NO: 1343 - RNA, 23 nt, Artificial Sequence
  Synthetic
cuuguaccugaaaaagacuaaau

SEQ ID NO: 1344 - RNA, 24 nt, Artificial Sequence
  Synthetic
ucuuguaccugaaaaagacuaaau

SEQ ID NO: 1345 - RNA, 18 nt, Artificial Sequence
  Synthetic
ucacacuggugccauucu

SEQ ID NO: 1346 - RNA, 19 nt, Artificial Sequence
  Synthetic
uucacacuggugccauucu

SEQ ID NO: 1347 - RNA, 20 nt, Artificial Sequence
  Synthetic
uuucacacuggugccauucu

SEQ ID NO: 1348 - RNA, 21 nt, Artificial Sequence
  Synthetic
uuuucacacuggugccauucu

SEQ ID NO: 1349 - RNA, 22 nt, Artificial Sequence
  Synthetic
uuuuucacacuggugccauucu

SEQ ID NO: 1350 - RNA, 23 nt, Artificial Sequence
  Synthetic
uuuuuucacacuggugccauucu

SEQ ID NO: 1351 - RNA, 24 nt, Artificial Sequence
  Synthetic
uuuuuuucacacuggugccauucu

SEQ ID NO: 1352 - RNA, 18 nt, Artificial Sequence
  Synthetic
acaaaucauaucuauuca

SEQ ID NO: 1353 - RNA, 19 nt, Artificial Sequence
  Synthetic
aacaaaucauaucuauuca

SEQ ID NO: 1354 - RNA, 20 nt, Artificial Sequence
  Synthetic
uaacaaaucauaucuauuca

SEQ ID NO: 1355 - RNA, 21 nt, Artificial Sequence
  Synthetic
auaacaaaucauaucuauuca

SEQ ID NO: 1356 - RNA, 22 nt, Artificial Sequence
  Synthetic
aauaacaaaucauaucuauuca

SEQ ID NO: 1357 - RNA, 23 nt, Artificial Sequence
  Synthetic
aaauaacaaaucauaucuauuca

SEQ ID NO: 1358 - RNA, 24 nt, Artificial Sequence
  Synthetic
aaaauaacaaaucauaucuauuca

SEQ ID NO: 1359 - RNA, 18 nt, Artificial Sequence
  Synthetic
uggaaauauuucacaggc

SEQ ID NO: 1360 - RNA, 19 nt, Artificial Sequence
  Synthetic
auggaaauauuucacaggc

SEQ ID NO: 1361 - RNA, 18 nt, Artificial Sequence
  Synthetic
acugcgcugguuccaaau

SEQ ID NO: 1362 - RNA, 19 nt, Artificial Sequence
  Synthetic
cacugcgcugguuccaaau

SEQ ID NO: 1363 - RNA, 20 nt, Artificial Sequence
  Synthetic
acacugcgcugguuccaaau

SEQ ID NO: 1364 - RNA, 21 nt, Artificial Sequence
  Synthetic
aacacugcgcugguuccaaau

SEQ ID NO: 1365 - RNA, 22 nt, Artificial Sequence
  Synthetic
caacacugcgcugguuccaaau

SEQ ID NO: 1366 - RNA, 23 nt, Artificial Sequence
  Synthetic
ucaacacugcgcugguuccaaau

SEQ ID NO: 1367 - RNA, 18 nt, Artificial Sequence
  Synthetic
acucuguuccacaaagcu

SEQ ID NO: 1368 - RNA, 19 nt, Artificial Sequence
  Synthetic
aacucuguuccacaaagcu

SEQ ID NO: 1369 - RNA, 20 nt, Artificial Sequence
  Synthetic
aaacucuguuccacaaagcu

SEQ ID NO: 1370 - RNA, 22 nt, Artificial Sequence
  Synthetic
guaaauucagagcuuuguggaa

SEQ ID NO: 1371 - RNA, 22 nt, Artificial Sequence
  Synthetic
gauaugauuuguuauuuuauua

SEQ ID NO: 1372 - RNA, 18 nt, Artificial Sequence
  Synthetic
gguagccaaguaaaaaaa

SEQ ID NO: 1373 - RNA, 21 nt, Artificial Sequence
  Synthetic
gaaacucuguuccacaaagcu

SEQ ID NO: 1374 - RNA, 18 nt, Artificial Sequence
  Synthetic
auucagagcuuuguggaa

SEQ ID NO: 1375 - RNA, 19 nt, Artificial Sequence
  Synthetic
aauucagagcuuuguggaa

SEQ ID NO: 1376 - RNA, 20 nt, Artificial Sequence
  Synthetic
aaauucagagcuuuguggaa

SEQ ID NO: 1377 - RNA, 21 nt, Artificial Sequence
  Synthetic
uaaauucagagcuuuguggaa

SEQ ID NO: 1378 - RNA, 23 nt, Artificial Sequence
  Synthetic
uguaaauucagagcuuuguggaa

SEQ ID NO: 1379 - RNA, 24 nt, Artificial Sequence
  Synthetic
auguaaauucagagcuuuguggaa

SEQ ID NO: 1380 - RNA, 18 nt, Artificial Sequence
  Synthetic
ugauuuguuauuuuauua

SEQ ID NO: 1381 - RNA, 19 nt, Artificial Sequence
  Synthetic
augauuuguuauuuuauua

SEQ ID NO: 1382 - RNA, 20 nt, Artificial Sequence
  Synthetic
uaugauuuguuauuuuauua

SEQ ID NO: 1383 - RNA, 21 nt, Artificial Sequence
  Synthetic
auaugauuuguuauuuuauua

SEQ ID NO: 1384 - RNA, 23 nt, Artificial Sequence
  Synthetic
agauaugauuuguuauuuuauua

SEQ ID NO: 1385 - RNA, 24 nt, Artificial Sequence
  Synthetic
uagauaugauuuguuauuuuauua

SEQ ID NO: 1386 - RNA, 19 nt, Artificial Sequence
  Synthetic
ugguagccaaguaaaaaaa

SEQ ID NO: 1387 - RNA, 20 nt, Artificial Sequence
  Synthetic
cugguagccaaguaaaaaaa

SEQ ID NO: 1388 - RNA, 21 nt, Artificial Sequence
  Synthetic
ucugguagccaaguaaaaaaa

SEQ ID NO: 1389 - RNA, 22 nt, Artificial Sequence
  Synthetic
cucugguagccaaguaaaaaaa

SEQ ID NO: 1390 - RNA, 23 nt, Artificial Sequence
  Synthetic
ucucugguagccaaguaaaaaaa

SEQ ID NO: 1391 - RNA, 24 nt, Artificial Sequence
  Synthetic
aucucugguagccaaguaaaaaaa

SEQ ID NO: 1392 - RNA, 21 nt, Artificial Sequence
  Synthetic
cuauggaaauauuucacaggc

SEQ ID NO: 1393 - RNA, 22 nt, Artificial Sequence
  Synthetic
ucuauggaaauauuucacaggc

SEQ ID NO: 1394 - RNA, 23 nt, Artificial Sequence
  Synthetic
uucuauggaaauauuucacaggc

SEQ ID NO: 1395 - RNA, 24 nt, Artificial Sequence
  Synthetic
uuucuauggaaauauuucacaggc

SEQ ID NO: 1396 - RNA, 22 nt, Artificial Sequence
  Synthetic
ugaaacucuguuccacaaagcu

SEQ ID NO: 1397 - RNA, 23 nt, Artificial Sequence
  Synthetic
uugaaacucuguuccacaaagcu

SEQ ID NO: 1398 - RNA, 24 nt, Artificial Sequence
  Synthetic
uuugaaacucuguuccacaaagcu

SEQ ID NO: 1399 - RNA, 18 nt, Artificial Sequence
  Synthetic
uaacaagaugagugaaaa

SEQ ID NO: 1400 - RNA, 19 nt, Artificial Sequence
  Synthetic
guaacaagaugagugaaaa

SEQ ID NO: 1401 - RNA, 20 nt, Artificial Sequence
  Synthetic
uguaacaagaugagugaaaa

SEQ ID NO: 1402 - RNA, 21 nt, Artificial Sequence
  Synthetic
uuguaacaagaugagugaaaa

SEQ ID NO: 1403 - RNA, 22 nt, Artificial Sequence
  Synthetic
cuuguaacaagaugagugaaaa

SEQ ID NO: 1404 - RNA, 23 nt, Artificial Sequence
  Synthetic
gcuuguaacaagaugagugaaaa

SEQ ID NO: 1405 - RNA, 24 nt, Artificial Sequence
  Synthetic
agcuuguaacaagaugagugaaaa

SEQ ID NO: 1406 - RNA, 18 nt, Artificial Sequence
  Synthetic
gccugugaaauauuucca

SEQ ID NO: 1407 - RNA, 19 nt, Artificial Sequence
  Synthetic
ugccugugaaauauuucca

SEQ ID NO: 1408 - RNA, 20 nt, Artificial Sequence
  Synthetic
cugccugugaaauauuucca

SEQ ID NO: 1409 - RNA, 21 nt, Artificial Sequence
  Synthetic
ccugccugugaaauauuucca

SEQ ID NO: 1410 - RNA, 22 nt, Artificial Sequence
  Synthetic
uccugccugugaaauauuucca

SEQ ID NO: 1411 - RNA, 23 nt, Artificial Sequence
  Synthetic
cuccugccugugaaauauuucca

SEQ ID NO: 1412 - RNA, 24 nt, Artificial Sequence
  Synthetic
acuccugccugugaaauauuucca

SEQ ID NO: 1413 - RNA, 18 nt, Artificial Sequence
  Synthetic
uuacuuggcuaccagaga

SEQ ID NO: 1414 - RNA, 19 nt, Artificial Sequence
  Synthetic
uuuacuuggcuaccagaga

SEQ ID NO: 1415 - RNA, 21 nt, Artificial Sequence
  Synthetic
uuuuuacuuggcuaccagaga

SEQ ID NO: 1416 - RNA, 22 nt, Artificial Sequence
  Synthetic
uuuuuuacuuggcuaccagaga

SEQ ID NO: 1417 - RNA, 23 nt, Artificial Sequence
  Synthetic
uuuuuuuacuuggcuaccagaga

SEQ ID NO: 1418 - RNA, 24 nt, Artificial Sequence
  Synthetic
cuuuuuuuacuuggcuaccagaga

SEQ ID NO: 1419 - RNA, 18 nt, Artificial Sequence
  Synthetic
aagcuuguaacaagauga

SEQ ID NO: 1420 - RNA, 19 nt, Artificial Sequence
  Synthetic
uaagcuuguaacaagauga

SEQ ID NO: 1421 - RNA, 20 nt, Artificial Sequence
  Synthetic
uuaagcuuguaacaagauga

SEQ ID NO: 1422 - RNA, 21 nt, Artificial Sequence
  Synthetic
uuuaagcuuguaacaagauga

SEQ ID NO: 1423 - RNA, 22 nt, Artificial Sequence
  Synthetic
uuuuaagcuuguaacaagauga

SEQ ID NO: 1424 - RNA, 23 nt, Artificial Sequence
  Synthetic
cuuuuaagcuuguaacaagauga

SEQ ID NO: 1425 - RNA, 24 nt, Artificial Sequence
  Synthetic
ccuuuuaagcuuguaacaagauga

SEQ ID NO: 1426 - RNA, 18 nt, Artificial Sequence
  Synthetic
cuuuuuuuacuuggcuac

SEQ ID NO: 1427 - RNA, 19 nt, Artificial Sequence
  Synthetic
ucuuuuuuuacuuggcuac

SEQ ID NO: 1428 - RNA, 20 nt, Artificial Sequence
  Synthetic
cucuuuuuuuacuuggcuac

SEQ ID NO: 1429 - RNA, 21 nt, Artificial Sequence
  Synthetic
ccucuuuuuuuacuuggcuac

SEQ ID NO: 1430 - RNA, 22 nt, Artificial Sequence
  Synthetic
cccucuuuuuuuacuuggcuac

SEQ ID NO: 1431 - RNA, 23 nt, Artificial Sequence
  Synthetic
acccucuuuuuuuacuuggcuac

SEQ ID NO: 1432 - RNA, 24 nt, Artificial Sequence
  Synthetic
uacccucuuuuuuuacuuggcuac

SEQ ID NO: 1433 - RNA, 18 nt, Artificial Sequence
  Synthetic
cgcaguguugacagguac

SEQ ID NO: 1434 - RNA, 19 nt, Artificial Sequence
  Synthetic
gcgcaguguugacagguac

SEQ ID NO: 1435 - RNA, 20 nt, Artificial Sequence
  Synthetic
agcgcaguguugacagguac

SEQ ID NO: 1436 - RNA, 21 nt, Artificial Sequence
  Synthetic
cagcgcaguguugacagguac

SEQ ID NO: 1437 - RNA, 22 nt, Artificial Sequence
  Synthetic
ccagcgcaguguugacagguac

SEQ ID NO: 1438 - RNA, 23 nt, Artificial Sequence
  Synthetic
accagcgcaguguugacagguac

SEQ ID NO: 1439 - RNA, 24 nt, Artificial Sequence
  Synthetic
aaccagcgcaguguugacagguac

SEQ ID NO: 1440 - RNA, 18 nt, Artificial Sequence
  Synthetic
uuucauaauaucuuguac

SEQ ID NO: 1441 - RNA, 19 nt, Artificial Sequence
  Synthetic
auuucauaauaucuuguac

SEQ ID NO: 1442 - RNA, 20 nt, Artificial Sequence
  Synthetic
aauuucauaauaucuuguac

SEQ ID NO: 1443 - RNA, 21 nt, Artificial Sequence
  Synthetic
uaauuucauaauaucuuguac

SEQ ID NO: 1444 - RNA, 22 nt, Artificial Sequence
  Synthetic
guaauuucauaauaucuuguac

SEQ ID NO: 1445 - RNA, 23 nt, Artificial Sequence
  Synthetic
uguaauuucauaauaucuuguac

SEQ ID NO: 1446 - RNA, 24 nt, Artificial Sequence
  Synthetic
auguaauuucauaauaucuuguac

SEQ ID NO: 1447 - RNA, 18 nt, Artificial Sequence
  Synthetic
aggcugccguccgaaggc

SEQ ID NO: 1448 - RNA, 19 nt, Artificial Sequence
  Synthetic
aaggcugccguccgaaggc

SEQ ID NO: 1449 - RNA, 20 nt, Artificial Sequence
  Synthetic
uaaggcugccguccgaaggc

SEQ ID NO: 1450 - RNA, 21 nt, Artificial Sequence
  Synthetic
guaaggcugccguccgaaggc

SEQ ID NO: 1451 - RNA, 22 nt, Artificial Sequence
  Synthetic
aguaaggcugccguccgaaggc

SEQ ID NO: 1452 - RNA, 23 nt, Artificial Sequence
  Synthetic
aaguaaggcugccguccgaaggc

SEQ ID NO: 1453 - RNA, 24 nt, Artificial Sequence
  Synthetic
aaaguaaggcugccguccgaaggc

SEQ ID NO: 1454 - RNA, 18 nt, Artificial Sequence
  Synthetic
uuuacuuggcuaccagag

SEQ ID NO: 1455 - RNA, 19 nt, Artificial Sequence
  Synthetic
uuuuacuuggcuaccagag

SEQ ID NO: 1456 - RNA, 20 nt, Artificial Sequence
  Synthetic
uuuuuacuuggcuaccagag

SEQ ID NO: 1457 - RNA, 21 nt, Artificial Sequence
  Synthetic
uuuuuuacuuggcuaccagag

SEQ ID NO: 1458 - RNA, 22 nt, Artificial Sequence
  Synthetic
uuuuuuuacuuggcuaccagag

SEQ ID NO: 1459 - RNA, 23 nt, Artificial Sequence
  Synthetic
cuuuuuuuacuuggcuaccagag

SEQ ID NO: 1460 - RNA, 24 nt, Artificial Sequence
  Synthetic
ucuuuuuuuacuuggcuaccagag

SEQ ID NO: 1461 - RNA, 18 nt, Artificial Sequence
  Synthetic
uguaaauucagagcuuug

SEQ ID NO: 1462 - RNA, 19 nt, Artificial Sequence
  Synthetic
auguaaauucagagcuuug

SEQ ID NO: 1463 - RNA, 21 nt, Artificial Sequence
  Synthetic
guauguaaauucagagcuuug

SEQ ID NO: 1464 - RNA, 22 nt, Artificial Sequence
  Synthetic
aguauguaaauucagagcuuug

SEQ ID NO: 1465 - RNA, 23 nt, Artificial Sequence
  Synthetic
caguauguaaauucagagcuuug

SEQ ID NO: 1466 - RNA, 24 nt, Artificial Sequence
  Synthetic
gcaguauguaaauucagagcuuug

SEQ ID NO: 1467 - RNA, 18 nt, Artificial Sequence
  Synthetic
uacuuggcuaccagagau

SEQ ID NO: 1468 - RNA, 19 nt, Artificial Sequence
  Synthetic
uuacuuggcuaccagagau

SEQ ID NO: 1469 - RNA, 21 nt, Artificial Sequence
  Synthetic
uuuuacuuggcuaccagagau

SEQ ID NO: 1470 - RNA, 22 nt, Artificial Sequence
  Synthetic
uuuuuacuuggcuaccagagau

SEQ ID NO: 1471 - RNA, 23 nt, Artificial Sequence
  Synthetic
uuuuuuacuuggcuaccagagau

SEQ ID NO: 1472 - RNA, 24 nt, Artificial Sequence
  Synthetic
uuuuuuuacuuggcuaccagagau

SEQ ID NO: 1473 - RNA, 18 nt, Artificial Sequence
  Synthetic
aaaauuggacuccugccu

SEQ ID NO: 1474 - RNA, 19 nt, Artificial Sequence
  Synthetic
gaaaauuggacuccugccu

SEQ ID NO: 1475 - RNA, 20 nt, Artificial Sequence
  Synthetic
ugaaaauuggacuccugccu

SEQ ID NO: 1476 - RNA, 21 nt, Artificial Sequence
  Synthetic
gugaaaauuggacuccugccu

SEQ ID NO: 1477 - RNA, 22 nt, Artificial Sequence
  Synthetic
agugaaaauuggacuccugccu

SEQ ID NO: 1478 - RNA, 23 nt, Artificial Sequence
  Synthetic
gagugaaaauuggacuccugccu

SEQ ID NO: 1479 - RNA, 24 nt, Artificial Sequence
  Synthetic
ugagugaaaauuggacuccugccu

SEQ ID NO: 1480 - RNA, 18 nt, Artificial Sequence
  Synthetic
ucaaaguaaggcugccgu

SEQ ID NO: 1481 - RNA, 19 nt, Artificial Sequence
  Synthetic
uucaaaguaaggcugccgu

SEQ ID NO: 1482 - RNA, 20 nt, Artificial Sequence
  Synthetic
uuucaaaguaaggcugccgu

SEQ ID NO: 1483 - RNA, 21 nt, Artificial Sequence
  Synthetic
guuucaaaguaaggcugccgu

SEQ ID NO: 1484 - RNA, 22 nt, Artificial Sequence
  Synthetic
aguuucaaaguaaggcugccgu

SEQ ID NO: 1485 - RNA, 23 nt, Artificial Sequence
  Synthetic
gaguuucaaaguaaggcugccgu

SEQ ID NO: 1486 - RNA, 24 nt, Artificial Sequence
  Synthetic
agaguuucaaaguaaggcugccgu

SEQ ID NO: 1487 - RNA, 18 nt, Artificial Sequence
  Synthetic
guuggcaguauguaaauu

SEQ ID NO: 1488 - RNA, 19 nt, Artificial Sequence
  Synthetic
aguuggcaguauguaaauu

SEQ ID NO: 1489 - RNA, 20 nt, Artificial Sequence
  Synthetic
caguuggcaguauguaaauu

SEQ ID NO: 1490 - RNA, 21 nt, Artificial Sequence
  Synthetic
ccaguuggcaguauguaaauu

SEQ ID NO: 1491 - RNA, 22 nt, Artificial Sequence
  Synthetic
accaguuggcaguauguaaauu

SEQ ID NO: 1492 - RNA, 23 nt, Artificial Sequence
  Synthetic
aaccaguuggcaguauguaaauu

SEQ ID NO: 1493 - RNA, 24 nt, Artificial Sequence
  Synthetic
gaaccaguuggcaguauguaaauu

SEQ ID NO: 1494 - RNA, 18 nt, Artificial Sequence
  Synthetic
auguaaauucagagcuuu

SEQ ID NO: 1495 - RNA, 19 nt, Artificial Sequence
  Synthetic
uauguaaauucagagcuuu

SEQ ID NO: 1496 - RNA, 20 nt, Artificial Sequence
  Synthetic
guauguaaauucagagcuuu

SEQ ID NO: 1497 - RNA, 21 nt, Artificial Sequence
  Synthetic
aguauguaaauucagagcuuu

SEQ ID NO: 1498 - RNA, 22 nt, Artificial Sequence
  Synthetic
caguauguaaauucagagcuuu

SEQ ID NO: 1499 - RNA, 23 nt, Artificial Sequence
  Synthetic
gcaguauguaaauucagagcuuu

SEQ ID NO: 1500 - RNA, 24 nt, Artificial Sequence
  Synthetic
ggcaguauguaaauucagagcuuu

SEQ ID NO: 1501 - RNA, 18 nt, Artificial Sequence
  Synthetic
cugguagccaaguaaaaa

SEQ ID NO: 1502 - RNA, 19 nt, Artificial Sequence
  Synthetic
ucugguagccaaguaaaaa

SEQ ID NO: 1503 - RNA, 20 nt, Artificial Sequence
  Synthetic
cucugguagccaaguaaaaa

SEQ ID NO: 1504 - RNA, 21 nt, Artificial Sequence
  Synthetic
ucucugguagccaaguaaaaa

SEQ ID NO: 1505 - RNA, 22 nt, Artificial Sequence
  Synthetic
aucucugguagccaaguaaaaa

SEQ ID NO: 1506 - RNA, 23 nt, Artificial Sequence
  Synthetic
caucucugguagccaaguaaaaa

SEQ ID NO: 1507 - RNA, 24 nt, Artificial Sequence
  Synthetic
ccaucucugguagccaaguaaaaa

SEQ ID NO: 1508 - RNA, 18 nt, Artificial Sequence
  Synthetic
acacugcgcugguuccaa

SEQ ID NO: 1509 - RNA, 19 nt, Artificial Sequence
  Synthetic
aacacugcgcugguuccaa

SEQ ID NO: 1510 - RNA, 20 nt, Artificial Sequence
  Synthetic
caacacugcgcugguuccaa

SEQ ID NO: 1511 - RNA, 21 nt, Artificial Sequence
  Synthetic
ucaacacugcgcugguuccaa

SEQ ID NO: 1512 - RNA, 22 nt, Artificial Sequence
  Synthetic
gucaacacugcgcugguuccaa

SEQ ID NO: 1513 - RNA, 23 nt, Artificial Sequence
  Synthetic
ugucaacacugcgcugguuccaa

SEQ ID NO: 1514 - RNA, 24 nt, Artificial Sequence
  Synthetic
cugucaacacugcgcugguuccaa

SEQ ID NO: 1515 - RNA, 18 nt, Artificial Sequence
  Synthetic
gcugguuccaaaugagaa

SEQ ID NO: 1516 - RNA, 19 nt, Artificial Sequence
  Synthetic
cgcugguuccaaaugagaa

SEQ ID NO: 1517 - RNA, 20 nt, Artificial Sequence
  Synthetic
gcgcugguuccaaaugagaa

SEQ ID NO: 1518 - RNA, 21 nt, Artificial Sequence
  Synthetic
ugcgcugguuccaaaugagaa

SEQ ID NO: 1519 - RNA, 22 nt, Artificial Sequence
  Synthetic
cugcgcugguuccaaaugagaa

SEQ ID NO: 1520 - RNA, 23 nt, Artificial Sequence
  Synthetic
acugcgcugguuccaaaugagaa

SEQ ID NO: 1521 - RNA, 24 nt, Artificial Sequence
  Synthetic
cacugcgcugguuccaaaugagaa

SEQ ID NO: 1522 - RNA, 18 nt, Artificial Sequence
  Synthetic
aucuuguuacaagcuuaa

SEQ ID NO: 1523 - RNA, 19 nt, Artificial Sequence
  Synthetic
caucuuguuacaagcuuaa

SEQ ID NO: 1524 - RNA, 20 nt, Artificial Sequence
  Synthetic
ucaucuuguuacaagcuuaa

SEQ ID NO: 1525 - RNA, 21 nt, Artificial Sequence
  Synthetic
cucaucuuguuacaagcuuaa

SEQ ID NO: 1526 - RNA, 22 nt, Artificial Sequence
  Synthetic
acucaucuuguuacaagcuuaa

SEQ ID NO: 1527 - RNA, 23 nt, Artificial Sequence
  Synthetic
cacucaucuuguuacaagcuuaa

SEQ ID NO: 1528 - RNA, 24 nt, Artificial Sequence
  Synthetic
ucacucaucuuguuacaagcuuaa

SEQ ID NO: 1529 - RNA, 18 nt, Artificial Sequence
  Synthetic
uauuugcaguguuuucua

SEQ ID NO: 1530 - RNA, 19 nt, Artificial Sequence
  Synthetic
uuauuugcaguguuuucua

SEQ ID NO: 1531 - RNA, 21 nt, Artificial Sequence
  Synthetic
uguuauuugcaguguuuucua

SEQ ID NO: 1532 - RNA, 22 nt, Artificial Sequence
  Synthetic
auguuauuugcaguguuuucua

SEQ ID NO: 1533 - RNA, 23 nt, Artificial Sequence
  Synthetic
uauguuauuugcaguguuuucua

SEQ ID NO: 1534 - RNA, 24 nt, Artificial Sequence
  Synthetic
uuauguuauuugcaguguuuucua

SEQ ID NO: 1535 - RNA, 18 nt, Artificial Sequence
  Synthetic
auggaaauauuucacagg

SEQ ID NO: 1536 - RNA, 19 nt, Artificial Sequence
  Synthetic
uauggaaauauuucacagg

SEQ ID NO: 1537 - RNA, 20 nt, Artificial Sequence
  Synthetic
cuauggaaauauuucacagg

SEQ ID NO: 1538 - RNA, 21 nt, Artificial Sequence
  Synthetic
ucuauggaaauauuucacagg

SEQ ID NO: 1539 - RNA, 22 nt, Artificial Sequence
  Synthetic
uucuauggaaauauuucacagg

SEQ ID NO: 1540 - RNA, 23 nt, Artificial Sequence
  Synthetic
uuucuauggaaauauuucacagg

SEQ ID NO: 1541 - RNA, 24 nt, Artificial Sequence
  Synthetic
uuuucuauggaaauauuucacagg

SEQ ID NO: 1542 - RNA, 18 nt, Artificial Sequence
  Synthetic
uacaagcuuaaaaggacu

SEQ ID NO: 1543 - RNA, 19 nt, Artificial Sequence
  Synthetic
uuacaagcuuaaaaggacu

SEQ ID NO: 1544 - RNA, 20 nt, Artificial Sequence
  Synthetic
guuacaagcuuaaaaggacu

SEQ ID NO: 1545 - RNA, 21 nt, Artificial Sequence
  Synthetic
uguuacaagcuuaaaaggacu

SEQ ID NO: 1546 - RNA, 22 nt, Artificial Sequence
  Synthetic
uuguuacaagcuuaaaaggacu

SEQ ID NO: 1547 - RNA, 23 nt, Artificial Sequence
  Synthetic
cuuguuacaagcuuaaaaggacu

SEQ ID NO: 1548 - RNA, 24 nt, Artificial Sequence
  Synthetic
ucuuguuacaagcuuaaaaggacu

SEQ ID NO: 1549 - RNA, 18 nt, Artificial Sequence
  Synthetic
ucggacggcagccuuacu

SEQ ID NO: 1550 - RNA, 19 nt, Artificial Sequence
  Synthetic
uucggacggcagccuuacu

SEQ ID NO: 1551 - RNA, 20 nt, Artificial Sequence
  Synthetic
cuucggacggcagccuuacu

SEQ ID NO: 1552 - RNA, 21 nt, Artificial Sequence
  Synthetic
ccuucggacggcagccuuacu

SEQ ID NO: 1553 - RNA, 22 nt, Artificial Sequence
  Synthetic
gccuucggacggcagccuuacu

SEQ ID NO: 1554 - RNA, 23 nt, Artificial Sequence
  Synthetic
ugccuucggacggcagccuuacu

SEQ ID NO: 1555 - RNA, 24 nt, Artificial Sequence
  Synthetic
gugccuucggacggcagccuuacu

SEQ ID NO: 1556 - RNA, 18 nt, Artificial Sequence
  Synthetic
uauggacacuucgugccu

SEQ ID NO: 1557 - RNA, 19 nt, Artificial Sequence
  Synthetic
cuauggacacuucgugccu

SEQ ID NO: 1558 - RNA, 20 nt, Artificial Sequence
  Synthetic
acuauggacacuucgugccu

SEQ ID NO: 1559 - RNA, 21 nt, Artificial Sequence
  Synthetic
gacuauggacacuucgugccu

SEQ ID NO: 1560 - RNA, 22 nt, Artificial Sequence
  Synthetic
ggacuauggacacuucgugccu

SEQ ID NO: 1561 - RNA, 23 nt, Artificial Sequence
  Synthetic
aggacuauggacacuucgugccu

SEQ ID NO: 1562 - RNA, 24 nt, Artificial Sequence
  Synthetic
aaggacuauggacacuucgugccu

SEQ ID NO: 1563 - RNA, 18 nt, Artificial Sequence
  Synthetic
uuauuugcaguguuuucu

SEQ ID NO: 1564 - RNA, 19 nt, Artificial Sequence
  Synthetic
guuauuugcaguguuuucu

SEQ ID NO: 1565 - RNA, 20 nt, Artificial Sequence
  Synthetic
uguuauuugcaguguuuucu

SEQ ID NO: 1566 - RNA, 21 nt, Artificial Sequence
  Synthetic
auguuauuugcaguguuuucu

SEQ ID NO: 1567 - RNA, 22 nt, Artificial Sequence
  Synthetic
uauguuauuugcaguguuuucu

SEQ ID NO: 1568 - RNA, 23 nt, Artificial Sequence
  Synthetic
uuauguuauuugcaguguuuucu

SEQ ID NO: 1569 - RNA, 24 nt, Artificial Sequence
  Synthetic
uuuauguuauuugcaguguuuucu

SEQ ID NO: 1570 - RNA, 18 nt, Artificial Sequence
  Synthetic
ucaaagaauggcaccagu

SEQ ID NO: 1571 - RNA, 19 nt, Artificial Sequence
  Synthetic
uucaaagaauggcaccagu

SEQ ID NO: 1572 - RNA, 20 nt, Artificial Sequence
  Synthetic
auucaaagaauggcaccagu

SEQ ID NO: 1573 - RNA, 21 nt, Artificial Sequence
  Synthetic
uauucaaagaauggcaccagu

SEQ ID NO: 1574 - RNA, 22 nt, Artificial Sequence
  Synthetic
cuauucaaagaauggcaccagu

SEQ ID NO: 1575 - RNA, 23 nt, Artificial Sequence
  Synthetic
ucuauucaaagaauggcaccagu

SEQ ID NO: 1576 - RNA, 24 nt, Artificial Sequence
  Synthetic
aucuauucaaagaauggcaccagu

SEQ ID NO: 1577 - RNA, 18 nt, Artificial Sequence
  Synthetic
uuucagguacaagauauu

SEQ ID NO: 1578 - RNA, 19 nt, Artificial Sequence
  Synthetic
uuuucagguacaagauauu

SEQ ID NO: 1579 - RNA, 20 nt, Artificial Sequence
  Synthetic
uuuuucagguacaagauauu

SEQ ID NO: 1580 - RNA, 21 nt, Artificial Sequence
  Synthetic
cuuuuucagguacaagauauu

SEQ ID NO: 1581 - RNA, 22 nt, Artificial Sequence
  Synthetic
ucuuuuucagguacaagauauu

SEQ ID NO: 1582 - RNA, 23 nt, Artificial Sequence
  Synthetic
gucuuuuucagguacaagauauu

SEQ ID NO: 1583 - RNA, 24 nt, Artificial Sequence
  Synthetic
agucuuuuucagguacaagauauu

SEQ ID NO: 1584 - RNA, 17 nt, Artificial Sequence
  Synthetic
auggcaccagugugaaa

SEQ ID NO: 1585 - RNA, 17 nt, Artificial Sequence
  Synthetic
ugccauucuuugaauag

SEQ ID NO: 1586 - RNA, 17 nt, Artificial Sequence
  Synthetic
uuggcaguauguaaauu

SEQ ID NO: 1587 - RNA, 17 nt, Artificial Sequence
  Synthetic
aaguguccauaguccuu

SEQ ID NO: 1588 - RNA, 20 nt, Artificial Sequence
  Synthetic
agaauggcaccagugugaaa

SEQ ID NO: 1589 - RNA, 20 nt, Artificial Sequence
  Synthetic
uggugccauucuuugaauag

SEQ ID NO: 1590 - RNA, 20 nt, Artificial Sequence
  Synthetic
acgaaguguccauaguccuu

SEQ ID NO: 1591 - RNA, 17 nt, Artificial Sequence
  Synthetic
acaaaugucauugguua

SEQ ID NO: 1592 - RNA, 17 nt, Artificial Sequence
  Synthetic
aaccaaugacauuugug

SEQ ID NO: 1593 - RNA, 17 nt, Artificial Sequence
  Synthetic
uuuucacucaucuuguu

SEQ ID NO: 1594 - RNA, 20 nt, Artificial Sequence
  Synthetic
aucacaaaugucauugguua

SEQ ID NO: 1595 - RNA, 20 nt, Artificial Sequence
  Synthetic
uuuaaccaaugacauuugug

SEQ ID NO: 1596 - RNA, 20 nt, Artificial Sequence
  Synthetic
caauuuucacucaucuuguu

SEQ ID NO: 1597 - RNA, 20 nt, Artificial Sequence
  Synthetic
accaaugauauuuucuuuaa

SEQ ID NO: 1598 - RNA, 20 nt, Artificial Sequence
  Synthetic
accauuaaagaaaauaucau

SEQ ID NO: 1599 - RNA, 17 nt, Artificial Sequence
  Synthetic
aaugauauuuucuuuaa

SEQ ID NO: 1600 - RNA, 17 nt, Artificial Sequence
  Synthetic
auuaaagaaaauaucau

SEQ ID NO: 1601 - RNA, 23 nt, Artificial Sequence
  Synthetic
gaauauggagccaaauauauaau

SEQ ID NO: 1602 - RNA, 19 nt, Artificial Sequence
  Synthetic
gucauuaucaaaucacgcu

SEQ ID NO: 1603 - RNA, 18 nt, Artificial Sequence
  Synthetic
ggagaacuggagccuuca

SEQ ID NO: 1604 - RNA, 19 nt, Artificial Sequence
  Synthetic
gggagaacuggagccuuca

SEQ ID NO: 1605 - RNA, 19 nt, Artificial Sequence
  Synthetic
guaaaauuaagcacagugg

SEQ ID NO: 1606 - RNA, 21 nt, Artificial Sequence
  Synthetic
ggguaaaauuaagcacagugg

SEQ ID NO: 1607 - RNA, 23 nt, Artificial Sequence
  Synthetic
gaggguaaaauuaagcacagugg

SEQ ID NO: 1608 - RNA, 18 nt, Artificial Sequence
  Synthetic
gauaaugaccuaauaaug

SEQ ID NO: 1609 - RNA, 23 nt, Artificial Sequence
  Synthetic
gauuugauaaugaccuaauaaug

SEQ ID NO: 1610 - RNA, 23 nt, Artificial Sequence
  Synthetic
guuuccucuauggguaagcuacu

SEQ ID NO: 1611 - RNA, 18 nt, Artificial Sequence
  Synthetic
auccaggaaaacugagaa

SEQ ID NO: 1612 - RNA, 19 nt, Artificial Sequence
  Synthetic
aauccaggaaaacugagaa

SEQ ID NO: 1613 - RNA, 18 nt, Artificial Sequence
  Synthetic
uauauguagacuaaccga

SEQ ID NO: 1614 - RNA, 19 nt, Artificial Sequence
  Synthetic
auauauguagacuaaccga

SEQ ID NO: 1615 - RNA, 21 nt, Artificial Sequence
  Synthetic
aaauauauguagacuaaccga

SEQ ID NO: 1616 - RNA, 22 nt, Artificial Sequence
  Synthetic
uaaauauauguagacuaaccga

SEQ ID NO: 1617 - RNA, 23 nt, Artificial Sequence
  Synthetic
auaaauauauguagacuaaccga

SEQ ID NO: 1618 - RNA, 24 nt, Artificial Sequence
  Synthetic
cauaaauauauguagacuaaccga

SEQ ID NO: 1619 - RNA, 18 nt, Artificial Sequence
  Synthetic
uauaauuuggguagugug

SEQ ID NO: 1620 - RNA, 19 nt, Artificial Sequence
  Synthetic
auauaauuuggguagugug

SEQ ID NO: 1621 - RNA, 21 nt, Artificial Sequence
  Synthetic
auauauaauuuggguagugug

SEQ ID NO: 1622 - RNA, 22 nt, Artificial Sequence
  Synthetic
aauauauaauuuggguagugug

SEQ ID NO: 1623 - RNA, 23 nt, Artificial Sequence
  Synthetic
aaauauauaauuuggguagugug

SEQ ID NO: 1624 - RNA, 24 nt, Artificial Sequence
  Synthetic
caaauauauaauuuggguagugug

SEQ ID NO: 1625 - RNA, 18 nt, Artificial Sequence
  Synthetic
uggagccaaauauauaau

SEQ ID NO: 1626 - RNA, 19 nt, Artificial Sequence
  Synthetic
auggagccaaauauauaau

SEQ ID NO: 1627 - RNA, 21 nt, Artificial Sequence
  Synthetic
auauggagccaaauauauaau

SEQ ID NO: 1628 - RNA, 22 nt, Artificial Sequence
  Synthetic
aauauggagccaaauauauaau

SEQ ID NO: 1629 - RNA, 24 nt, Artificial Sequence
  Synthetic
ugaauauggagccaaauauauaau

SEQ ID NO: 1630 - RNA, 18 nt, Artificial Sequence
  Synthetic
ucauuaucaaaucacgcu

SEQ ID NO: 1631 - RNA, 21 nt, Artificial Sequence
  Synthetic
aggucauuaucaaaucacgcu

SEQ ID NO: 1632 - RNA, 22 nt, Artificial Sequence
  Synthetic
uaggucauuaucaaaucacgcu

SEQ ID NO: 1633 - RNA, 23 nt, Artificial Sequence
  Synthetic
uuaggucauuaucaaaucacgcu

SEQ ID NO: 1634 - RNA, 24 nt, Artificial Sequence
  Synthetic
auuaggucauuaucaaaucacgcu

SEQ ID NO: 1635 - RNA, 18 nt, Artificial Sequence
  Synthetic
auggguaagcuacuguga

SEQ ID NO: 1636 - RNA, 19 nt, Artificial Sequence
  Synthetic
uauggguaagcuacuguga

SEQ ID NO: 1637 - RNA, 21 nt, Artificial Sequence
  Synthetic
ucuauggguaagcuacuguga

SEQ ID NO: 1638 - RNA, 22 nt, Artificial Sequence
  Synthetic
cucuauggguaagcuacuguga

SEQ ID NO: 1639 - RNA, 23 nt, Artificial Sequence
  Synthetic
ccucuauggguaagcuacuguga

SEQ ID NO: 1640 - RNA, 24 nt, Artificial Sequence
  Synthetic
uccucuauggguaagcuacuguga

SEQ ID NO: 1641 - RNA, 18 nt, Artificial Sequence
  Synthetic
auucuguucucaguuuuc

SEQ ID NO: 1642 - RNA, 19 nt, Artificial Sequence
  Synthetic
cauucuguucucaguuuuc

SEQ ID NO: 1643 - RNA, 21 nt, Artificial Sequence
  Synthetic
uucauucuguucucaguuuuc

SEQ ID NO: 1644 - RNA, 22 nt, Artificial Sequence
  Synthetic
uuucauucuguucucaguuuuc

SEQ ID NO: 1645 - RNA, 23 nt, Artificial Sequence
  Synthetic
auuucauucuguucucaguuuuc

SEQ ID NO: 1646 - RNA, 24 nt, Artificial Sequence
  Synthetic
aauuucauucuguucucaguuuuc

SEQ ID NO: 1647 - RNA, 18 nt, Artificial Sequence
  Synthetic
uaaaauuaagcacagugg

SEQ ID NO: 1648 - RNA, 22 nt, Artificial Sequence
  Synthetic
aggguaaaauuaagcacagugg

SEQ ID NO: 1649 - RNA, 24 nt, Artificial Sequence
  Synthetic
agaggguaaaauuaagcacagugg

SEQ ID NO: 1650 - RNA, 19 nt, Artificial Sequence
  Synthetic
ugauaaugaccuaauaaug

SEQ ID NO: 1651 - RNA, 21 nt, Artificial Sequence
  Synthetic
uuugauaaugaccuaauaaug

SEQ ID NO: 1652 - RNA, 22 nt, Artificial Sequence
  Synthetic
auuugauaaugaccuaauaaug

SEQ ID NO: 1653 - RNA, 24 nt, Artificial Sequence
  Synthetic
ugauuugauaaugaccuaauaaug

SEQ ID NO: 1654 - RNA, 18 nt, Artificial Sequence
  Synthetic
ucauugguguuuccuaug

SEQ ID NO: 1655 - RNA, 19 nt, Artificial Sequence
  Synthetic
aucauugguguuuccuaug

SEQ ID NO: 1656 - RNA, 20 nt, Artificial Sequence
  Synthetic
uaucauugguguuuccuaug

SEQ ID NO: 1657 - RNA, 21 nt, Artificial Sequence
  Synthetic
auaucauugguguuuccuaug

SEQ ID NO: 1658 - RNA, 22 nt, Artificial Sequence
  Synthetic
aauaucauugguguuuccuaug

SEQ ID NO: 1659 - RNA, 23 nt, Artificial Sequence
  Synthetic
aaauaucauugguguuuccuaug

SEQ ID NO: 1660 - RNA, 24 nt, Artificial Sequence
  Synthetic
aaaauaucauugguguuuccuaug

SEQ ID NO: 1661 - RNA, 18 nt, Artificial Sequence
  Synthetic
cucuauggguaagcuacu

SEQ ID NO: 1662 - RNA, 19 nt, Artificial Sequence
  Synthetic
ccucuauggguaagcuacu

SEQ ID NO: 1663 - RNA, 21 nt, Artificial Sequence
  Synthetic
uuccucuauggguaagcuacu

SEQ ID NO: 1664 - RNA, 22 nt, Artificial Sequence
  Synthetic
uuuccucuauggguaagcuacu

SEQ ID NO: 1665 - RNA, 24 nt, Artificial Sequence
  Synthetic
uguuuccucuauggguaagcuacu

SEQ ID NO: 1666 - RNA, 18 nt, Artificial Sequence
  Synthetic
uauauuuauguuuccucu

SEQ ID NO: 1667 - RNA, 19 nt, Artificial Sequence
  Synthetic
auauauuuauguuuccucu

SEQ ID NO: 1668 - RNA, 21 nt, Artificial Sequence
  Synthetic
acauauauuuauguuuccucu

SEQ ID NO: 1669 - RNA, 22 nt, Artificial Sequence
  Synthetic
uacauauauuuauguuuccucu

SEQ ID NO: 1670 - RNA, 23 nt, Artificial Sequence
  Synthetic
cuacauauauuuauguuuccucu

SEQ ID NO: 1671 - RNA, 24 nt, Artificial Sequence
  Synthetic
ucuacauauauuuauguuuccucu

SEQ ID NO: 1672 - RNA, 23 nt, Artificial Sequence
  Synthetic
gcauaauccaggaaaacugagaa

SEQ ID NO: 1673 - RNA, 24 nt, Artificial Sequence
  Synthetic
ggcauaauccaggaaaacugagaa

SEQ ID NO: 1674 - RNA, 21 nt, Artificial Sequence
  Synthetic
auaauccaggaaaacugagaa

SEQ ID NO: 1675 - RNA, 22 nt, Artificial Sequence
  Synthetic
cauaauccaggaaaacugagaa

SEQ ID NO: 1676 - RNA, 21 nt, Artificial Sequence
  Synthetic
augggagaacuggagccuuca

SEQ ID NO: 1677 - RNA, 22 nt, Artificial Sequence
  Synthetic
uaugggagaacuggagccuuca

SEQ ID NO: 1678 - RNA, 23 nt, Artificial Sequence
  Synthetic
uuaugggagaacuggagccuuca

SEQ ID NO: 1679 - RNA, 24 nt, Artificial Sequence
  Synthetic
auuaugggagaacuggagccuuca

SEQ ID NO: 1680 - RNA, 18 nt, Artificial Sequence
  Synthetic
aggcauaauccaggaaaa

SEQ ID NO: 1681 - RNA, 19 nt, Artificial Sequence
  Synthetic
caggcauaauccaggaaaa

SEQ ID NO: 1682 - RNA, 21 nt, Artificial Sequence
  Synthetic
gccaggcauaauccaggaaaa

SEQ ID NO: 1683 - RNA, 22 nt, Artificial Sequence
  Synthetic
ugccaggcauaauccaggaaaa

SEQ ID NO: 1684 - RNA, 23 nt, Artificial Sequence
  Synthetic
gugccaggcauaauccaggaaaa

SEQ ID NO: 1685 - RNA, 24 nt, Artificial Sequence
  Synthetic
ggugccaggcauaauccaggaaaa

SEQ ID NO: 1686 - RNA, 18 nt, Artificial Sequence
  Synthetic
ccauaaucaccauuagaa

SEQ ID NO: 1687 - RNA, 19 nt, Artificial Sequence
  Synthetic
cccauaaucaccauuagaa

SEQ ID NO: 1688 - RNA, 21 nt, Artificial Sequence
  Synthetic
cucccauaaucaccauuagaa

SEQ ID NO: 1689 - RNA, 22 nt, Artificial Sequence
  Synthetic
ucucccauaaucaccauuagaa

SEQ ID NO: 1690 - RNA, 23 nt, Artificial Sequence
  Synthetic
uucucccauaaucaccauuagaa

SEQ ID NO: 1691 - RNA, 24 nt, Artificial Sequence
  Synthetic
guucucccauaaucaccauuagaa

SEQ ID NO: 1692 - RNA, 18 nt, Artificial Sequence
  Synthetic
uucacaguagcuuaccca

SEQ ID NO: 1693 - RNA, 19 nt, Artificial Sequence
  Synthetic
auucacaguagcuuaccca

SEQ ID NO: 1694 - RNA, 21 nt, Artificial Sequence
  Synthetic
ccauucacaguagcuuaccca

SEQ ID NO: 1695 - RNA, 22 nt, Artificial Sequence
  Synthetic
uccauucacaguagcuuaccca

SEQ ID NO: 1696 - RNA, 23 nt, Artificial Sequence
  Synthetic
auccauucacaguagcuuaccca

SEQ ID NO: 1697 - RNA, 24 nt, Artificial Sequence
  Synthetic
gauccauucacaguagcuuaccca

SEQ ID NO: 1698 - RNA, 18 nt, Artificial Sequence
  Synthetic
cuguaucuauauucauca

SEQ ID NO: 1699 - RNA, 19 nt, Artificial Sequence
  Synthetic
ucuguaucuauauucauca

SEQ ID NO: 1700 - RNA, 21 nt, Artificial Sequence
  Synthetic
cuucuguaucuauauucauca

SEQ ID NO: 1701 - RNA, 22 nt, Artificial Sequence
  Synthetic
gcuucuguaucuauauucauca

SEQ ID NO: 1702 - RNA, 23 nt, Artificial Sequence
  Synthetic
cgcuucuguaucuauauucauca

SEQ ID NO: 1703 - RNA, 24 nt, Artificial Sequence
  Synthetic
acgcuucuguaucuauauucauca

SEQ ID NO: 1704 - RNA, 18 nt, Artificial Sequence
  Synthetic
aggaaaacugagaacaga

SEQ ID NO: 1705 - RNA, 19 nt, Artificial Sequence
  Synthetic
caggaaaacugagaacaga

SEQ ID NO: 1706 - RNA, 21 nt, Artificial Sequence
  Synthetic
uccaggaaaacugagaacaga

SEQ ID NO: 1707 - RNA, 22 nt, Artificial Sequence
  Synthetic
auccaggaaaacugagaacaga

SEQ ID NO: 1708 - RNA, 23 nt, Artificial Sequence
  Synthetic
aauccaggaaaacugagaacaga

SEQ ID NO: 1709 - RNA, 24 nt, Artificial Sequence
  Synthetic
uaauccaggaaaacugagaacaga

SEQ ID NO: 1710 - RNA, 18 nt, Artificial Sequence
  Synthetic
agacuaaccgauugaaua

SEQ ID NO: 1711 - RNA, 19 nt, Artificial Sequence
  Synthetic
uagacuaaccgauugaaua

SEQ ID NO: 1712 - RNA, 21 nt, Artificial Sequence
  Synthetic
uguagacuaaccgauugaaua

SEQ ID NO: 1713 - RNA, 22 nt, Artificial Sequence
  Synthetic
auguagacuaaccgauugaaua

SEQ ID NO: 1714 - RNA, 23 nt, Artificial Sequence
  Synthetic
uauguagacuaaccgauugaaua

SEQ ID NO: 1715 - RNA, 24 nt, Artificial Sequence
  Synthetic
auauguagacuaaccgauugaaua

SEQ ID NO: 1716 - RNA, 18 nt, Artificial Sequence
  Synthetic
cacaguagcuuacccaua

SEQ ID NO: 1717 - RNA, 19 nt, Artificial Sequence
  Synthetic
ucacaguagcuuacccaua

SEQ ID NO: 1718 - RNA, 21 nt, Artificial Sequence
  Synthetic
auucacaguagcuuacccaua

SEQ ID NO: 1719 - RNA, 22 nt, Artificial Sequence
  Synthetic
cauucacaguagcuuacccaua

SEQ ID NO: 1720 - RNA, 23 nt, Artificial Sequence
  Synthetic
ccauucacaguagcuuacccaua

SEQ ID NO: 1721 - RNA, 24 nt, Artificial Sequence
  Synthetic
uccauucacaguagcuuacccaua

SEQ ID NO: 1722 - RNA, 18 nt, Artificial Sequence
  Synthetic
uggugccaggcauaaucc

SEQ ID NO: 1723 - RNA, 19 nt, Artificial Sequence
  Synthetic
auggugccaggcauaaucc

SEQ ID NO: 1724 - RNA, 21 nt, Artificial Sequence
  Synthetic
uaauggugccaggcauaaucc

SEQ ID NO: 1725 - RNA, 22 nt, Artificial Sequence
  Synthetic
uuaauggugccaggcauaaucc

SEQ ID NO: 1726 - RNA, 23 nt, Artificial Sequence
  Synthetic
uuuaauggugccaggcauaaucc

SEQ ID NO: 1727 - RNA, 24 nt, Artificial Sequence
  Synthetic
cuuuaauggugccaggcauaaucc

SEQ ID NO: 1728 - RNA, 18 nt, Artificial Sequence
  Synthetic
auggugccaggcauaauc

SEQ ID NO: 1729 - RNA, 19 nt, Artificial Sequence
  Synthetic
aauggugccaggcauaauc

SEQ ID NO: 1730 - RNA, 21 nt, Artificial Sequence
  Synthetic
uuaauggugccaggcauaauc

SEQ ID NO: 1731 - RNA, 22 nt, Artificial Sequence
  Synthetic
uuuaauggugccaggcauaauc

SEQ ID NO: 1732 - RNA, 23 nt, Artificial Sequence
  Synthetic
cuuuaauggugccaggcauaauc

SEQ ID NO: 1733 - RNA, 24 nt, Artificial Sequence
  Synthetic
ucuuuaauggugccaggcauaauc

SEQ ID NO: 1734 - RNA, 18 nt, Artificial Sequence
  Synthetic
accauuagaagugaaguc

SEQ ID NO: 1735 - RNA, 19 nt, Artificial Sequence
  Synthetic
caccauuagaagugaaguc

SEQ ID NO: 1736 - RNA, 21 nt, Artificial Sequence
  Synthetic
aucaccauuagaagugaaguc

SEQ ID NO: 1737 - RNA, 22 nt, Artificial Sequence
  Synthetic
aaucaccauuagaagugaaguc

SEQ ID NO: 1738 - RNA, 23 nt, Artificial Sequence
  Synthetic
uaaucaccauuagaagugaaguc

SEQ ID NO: 1739 - RNA, 24 nt, Artificial Sequence
  Synthetic
auaaucaccauuagaagugaaguc

SEQ ID NO: 1740 - RNA, 18 nt, Artificial Sequence
  Synthetic
acaguagcuuacccauag

SEQ ID NO: 1741 - RNA, 19 nt, Artificial Sequence
  Synthetic
cacaguagcuuacccauag

SEQ ID NO: 1742 - RNA, 21 nt, Artificial Sequence
  Synthetic
uucacaguagcuuacccauag

SEQ ID NO: 1743 - RNA, 22 nt, Artificial Sequence
  Synthetic
auucacaguagcuuacccauag

SEQ ID NO: 1744 - RNA, 23 nt, Artificial Sequence
  Synthetic
cauucacaguagcuuacccauag

SEQ ID NO: 1745 - RNA, 24 nt, Artificial Sequence
  Synthetic
ccauucacaguagcuuacccauag

SEQ ID NO: 1746 - RNA, 18 nt, Artificial Sequence
  Synthetic
uagacuaaccgauugaau

SEQ ID NO: 1747 - RNA, 19 nt, Artificial Sequence
  Synthetic
guagacuaaccgauugaau

SEQ ID NO: 1748 - RNA, 21 nt, Artificial Sequence
  Synthetic
auguagacuaaccgauugaau

SEQ ID NO: 1749 - RNA, 22 nt, Artificial Sequence
  Synthetic
uauguagacuaaccgauugaau

SEQ ID NO: 1750 - RNA, 23 nt, Artificial Sequence
  Synthetic
auauguagacuaaccgauugaau

SEQ ID NO: 1751 - RNA, 24 nt, Artificial Sequence
  Synthetic
uauauguagacuaaccgauugaau

SEQ ID NO: 1752 - RNA, 18 nt, Artificial Sequence
  Synthetic
uucucccauaaucaccau

SEQ ID NO: 1753 - RNA, 19 nt, Artificial Sequence
  Synthetic
guucucccauaaucaccau

SEQ ID NO: 1754 - RNA, 21 nt, Artificial Sequence
  Synthetic
caguucucccauaaucaccau

SEQ ID NO: 1755 - RNA, 22 nt, Artificial Sequence
  Synthetic
ccaguucucccauaaucaccau

SEQ ID NO: 1756 - RNA, 23 nt, Artificial Sequence
  Synthetic
uccaguucucccauaaucaccau

SEQ ID NO: 1757 - RNA, 24 nt, Artificial Sequence
  Synthetic
cuccaguucucccauaaucaccau

SEQ ID NO: 1758 - RNA, 18 nt, Artificial Sequence
  Synthetic
uguaucuauauucaucau

SEQ ID NO: 1759 - RNA, 19 nt, Artificial Sequence
  Synthetic
cuguaucuauauucaucau

SEQ ID NO: 1760 - RNA, 21 nt, Artificial Sequence
  Synthetic
uucuguaucuauauucaucau

SEQ ID NO: 1761 - RNA, 22 nt, Artificial Sequence
  Synthetic
cuucuguaucuauauucaucau

SEQ ID NO: 1762 - RNA, 23 nt, Artificial Sequence
  Synthetic
gcuucuguaucuauauucaucau

SEQ ID NO: 1763 - RNA, 24 nt, Artificial Sequence
  Synthetic
cgcuucuguaucuauauucaucau

SEQ ID NO: 1764 - RNA, 18 nt, Artificial Sequence
  Synthetic
gcauaauccaggaaaacu

SEQ ID NO: 1765 - RNA, 19 nt, Artificial Sequence
  Synthetic
ggcauaauccaggaaaacu

SEQ ID NO: 1766 - RNA, 21 nt, Artificial Sequence
  Synthetic
caggcauaauccaggaaaacu

SEQ ID NO: 1767 - RNA, 22 nt, Artificial Sequence
  Synthetic
ccaggcauaauccaggaaaacu

SEQ ID NO: 1768 - RNA, 23 nt, Artificial Sequence
  Synthetic
gccaggcauaauccaggaaaacu

SEQ ID NO: 1769 - RNA, 24 nt, Artificial Sequence
  Synthetic
ugccaggcauaauccaggaaaacu

SEQ ID NO: 1770 - RNA, 18 nt, Artificial Sequence
  Synthetic
ugugcuuaauuuuacccu

SEQ ID NO: 1771 - RNA, 19 nt, Artificial Sequence
  Synthetic
cugugcuuaauuuuacccu

SEQ ID NO: 1772 - RNA, 21 nt, Artificial Sequence
  Synthetic
cacugugcuuaauuuuacccu

SEQ ID NO: 1773 - RNA, 22 nt, Artificial Sequence
  Synthetic
ccacugugcuuaauuuuacccu

SEQ ID NO: 1774 - RNA, 23 nt, Artificial Sequence
  Synthetic
uccacugugcuuaauuuuacccu

SEQ ID NO: 1775 - RNA, 24 nt, Artificial Sequence
  Synthetic
uuccacugugcuuaauuuuacccu

SEQ ID NO: 1776 - RNA, 18 nt, Artificial Sequence
  Synthetic
caccauuagaagugaagu

SEQ ID NO: 1777 - RNA, 19 nt, Artificial Sequence
  Synthetic
ucaccauuagaagugaagu

SEQ ID NO: 1778 - RNA, 21 nt, Artificial Sequence
  Synthetic
aaucaccauuagaagugaagu

SEQ ID NO: 1779 - RNA, 22 nt, Artificial Sequence
  Synthetic
uaaucaccauuagaagugaagu

SEQ ID NO: 1780 - RNA, 23 nt, Artificial Sequence
  Synthetic
auaaucaccauuagaagugaagu

SEQ ID NO: 1781 - RNA, 24 nt, Artificial Sequence
  Synthetic
cauaaucaccauuagaagugaagu

SEQ ID NO: 1782 - RNA, 18 nt, Artificial Sequence
  Synthetic
auauauaauuuggguagu

SEQ ID NO: 1783 - RNA, 19 nt, Artificial Sequence
  Synthetic
aauauauaauuuggguagu

SEQ ID NO: 1784 - RNA, 21 nt, Artificial Sequence
  Synthetic
caaauauauaauuuggguagu

SEQ ID NO: 1785 - RNA, 22 nt, Artificial Sequence
  Synthetic
ccaaauauauaauuuggguagu

SEQ ID NO: 1786 - RNA, 23 nt, Artificial Sequence
  Synthetic
gccaaauauauaauuuggguagu

SEQ ID NO: 1787 - RNA, 24 nt, Artificial Sequence
  Synthetic
agccaaauauauaauuuggguagu

SEQ ID NO: 1788 - RNA, 18 nt, Artificial Sequence
  Synthetic
auggugauuaugggagaa

SEQ ID NO: 1789 - RNA, 19 nt, Artificial Sequence
  Synthetic
aauggugauuaugggagaa

SEQ ID NO: 1790 - RNA, 21 nt, Artificial Sequence
  Synthetic
cuaauggugauuaugggagaa

SEQ ID NO: 1791 - RNA, 22 nt, Artificial Sequence
  Synthetic
ucuaauggugauuaugggagaa

SEQ ID NO: 1792 - RNA, 23 nt, Artificial Sequence
  Synthetic
uucuaauggugauuaugggagaa

SEQ ID NO: 1793 - RNA, 24 nt, Artificial Sequence
  Synthetic
cuucuaauggugauuaugggagaa

SEQ ID NO: 1794 - RNA, 18 nt, Artificial Sequence
  Synthetic
aggguaaaauuaagcaca

SEQ ID NO: 1795 - RNA, 19 nt, Artificial Sequence
  Synthetic
gaggguaaaauuaagcaca

SEQ ID NO: 1796 - RNA, 21 nt, Artificial Sequence
  Synthetic
cagaggguaaaauuaagcaca

SEQ ID NO: 1797 - RNA, 22 nt, Artificial Sequence
  Synthetic
ucagaggguaaaauuaagcaca

SEQ ID NO: 1798 - RNA, 23 nt, Artificial Sequence
  Synthetic
uucagaggguaaaauuaagcaca

SEQ ID NO: 1799 - RNA, 24 nt, Artificial Sequence
  Synthetic
cuucagaggguaaaauuaagcaca

SEQ ID NO: 1800 - RNA, 18 nt, Artificial Sequence
  Synthetic
cuaugaugaauauagaua

SEQ ID NO: 1801 - RNA, 19 nt, Artificial Sequence
  Synthetic
ccuaugaugaauauagaua

SEQ ID NO: 1802 - RNA, 21 nt, Artificial Sequence
  Synthetic
uuccuaugaugaauauagaua

SEQ ID NO: 1803 - RNA, 22 nt, Artificial Sequence
  Synthetic
uuuccuaugaugaauauagaua

SEQ ID NO: 1804 - RNA, 23 nt, Artificial Sequence
  Synthetic
guuuccuaugaugaauauagaua

SEQ ID NO: 1805 - RNA, 24 nt, Artificial Sequence
  Synthetic
uguuuccuaugaugaauauagaua

SEQ ID NO: 1806 - RNA, 18 nt, Artificial Sequence
  Synthetic
uuaugccuggcaccauua

SEQ ID NO: 1807 - RNA, 19 nt, Artificial Sequence
  Synthetic
auuaugccuggcaccauua

SEQ ID NO: 1808 - RNA, 21 nt, Artificial Sequence
  Synthetic
ggauuaugccuggcaccauua

SEQ ID NO: 1809 - RNA, 22 nt, Artificial Sequence
  Synthetic
uggauuaugccuggcaccauua

SEQ ID NO: 1810 - RNA, 23 nt, Artificial Sequence
  Synthetic
cuggauuaugccuggcaccauua

SEQ ID NO: 1811 - RNA, 24 nt, Artificial Sequence
  Synthetic
ccuggauuaugccuggcaccauua

SEQ ID NO: 1812 - RNA, 18 nt, Artificial Sequence
  Synthetic
cacuucuaauggugauua

SEQ ID NO: 1813 - RNA, 19 nt, Artificial Sequence
  Synthetic
ucacuucuaauggugauua

SEQ ID NO: 1814 - RNA, 21 nt, Artificial Sequence
  Synthetic
cuucacuucuaauggugauua

SEQ ID NO: 1815 - RNA, 22 nt, Artificial Sequence
  Synthetic
acuucacuucuaauggugauua

SEQ ID NO: 1816 - RNA, 23 nt, Artificial Sequence
  Synthetic
gacuucacuucuaauggugauua

SEQ ID NO: 1817 - RNA, 24 nt, Artificial Sequence
  Synthetic
agacuucacuucuaauggugauua

SEQ ID NO: 1818 - RNA, 18 nt, Artificial Sequence
  Synthetic
ucaucaaagcaugccaac

SEQ ID NO: 1819 - RNA, 19 nt, Artificial Sequence
  Synthetic
gucaucaaagcaugccaac

SEQ ID NO: 1820 - RNA, 21 nt, Artificial Sequence
  Synthetic
gcgucaucaaagcaugccaac

SEQ ID NO: 1821 - RNA, 22 nt, Artificial Sequence
  Synthetic
agcgucaucaaagcaugccaac

SEQ ID NO: 1822 - RNA, 23 nt, Artificial Sequence
  Synthetic
aagcgucaucaaagcaugccaac

SEQ ID NO: 1823 - RNA, 24 nt, Artificial Sequence
  Synthetic
gaagcgucaucaaagcaugccaac

SEQ ID NO: 1824 - RNA, 18 nt, Artificial Sequence
  Synthetic
uggugauuaugggagaac

SEQ ID NO: 1825 - RNA, 19 nt, Artificial Sequence
  Synthetic
auggugauuaugggagaac

SEQ ID NO: 1826 - RNA, 21 nt, Artificial Sequence
  Synthetic
uaauggugauuaugggagaac

SEQ ID NO: 1827 - RNA, 22 nt, Artificial Sequence
  Synthetic
cuaauggugauuaugggagaac

SEQ ID NO: 1828 - RNA, 23 nt, Artificial Sequence
  Synthetic
ucuaauggugauuaugggagaac

SEQ ID NO: 1829 - RNA, 24 nt, Artificial Sequence
  Synthetic
uucuaauggugauuaugggagaac

SEQ ID NO: 1830 - RNA, 18 nt, Artificial Sequence
  Synthetic
auuggaggcaagugaauc

SEQ ID NO: 1831 - RNA, 19 nt, Artificial Sequence
  Synthetic
aauuggaggcaagugaauc

SEQ ID NO: 1832 - RNA, 18 nt, Artificial Sequence
  Synthetic
ggguaaaauuaagcacag

SEQ ID NO: 1833 - RNA, 19 nt, Artificial Sequence
  Synthetic
aggguaaaauuaagcacag

SEQ ID NO: 1834 - RNA, 21 nt, Artificial Sequence
  Synthetic
agaggguaaaauuaagcacag

SEQ ID NO: 1835 - RNA, 22 nt, Artificial Sequence
  Synthetic
cagaggguaaaauuaagcacag

SEQ ID NO: 1836 - RNA, 23 nt, Artificial Sequence
  Synthetic
ucagaggguaaaauuaagcacag

SEQ ID NO: 1837 - RNA, 24 nt, Artificial Sequence
  Synthetic
uucagaggguaaaauuaagcacag

SEQ ID NO: 1838 - RNA, 18 nt, Artificial Sequence
  Synthetic
ucaaagcaugccaacuag

SEQ ID NO: 1839 - RNA, 19 nt, Artificial Sequence
  Synthetic
aucaaagcaugccaacuag

SEQ ID NO: 1840 - RNA, 21 nt, Artificial Sequence
  Synthetic
ucaucaaagcaugccaacuag

SEQ ID NO: 1841 - RNA, 22 nt, Artificial Sequence
  Synthetic
gucaucaaagcaugccaacuag

SEQ ID NO: 1842 - RNA, 23 nt, Artificial Sequence
  Synthetic
cgucaucaaagcaugccaacuag

SEQ ID NO: 1843 - RNA, 24 nt, Artificial Sequence
  Synthetic
gcgucaucaaagcaugccaacuag

SEQ ID NO: 1844 - RNA, 18 nt, Artificial Sequence
  Synthetic
uucuaauggugauuaugg

SEQ ID NO: 1845 - RNA, 19 nt, Artificial Sequence
  Synthetic
cuucuaauggugauuaugg

SEQ ID NO: 1846 - RNA, 21 nt, Artificial Sequence
  Synthetic
cacuucuaauggugauuaugg

SEQ ID NO: 1847 - RNA, 22 nt, Artificial Sequence
  Synthetic
ucacuucuaauggugauuaugg

SEQ ID NO: 1848 - RNA, 23 nt, Artificial Sequence
  Synthetic
uucacuucuaauggugauuaugg

SEQ ID NO: 1849 - RNA, 24 nt, Artificial Sequence
  Synthetic
cuucacuucuaauggugauuaugg

SEQ ID NO: 1850 - RNA, 18 nt, Artificial Sequence
  Synthetic
aacuuuuugauuaugcau

SEQ ID NO: 1851 - RNA, 19 nt, Artificial Sequence
  Synthetic
aaacuuuuugauuaugcau

SEQ ID NO: 1852 - RNA, 21 nt, Artificial Sequence
  Synthetic
gaaaacuuuuugauuaugcau

SEQ ID NO: 1853 - RNA, 22 nt, Artificial Sequence
  Synthetic
ugaaaacuuuuugauuaugcau

SEQ ID NO: 1854 - RNA, 23 nt, Artificial Sequence
  Synthetic
gugaaaacuuuuugauuaugcau

SEQ ID NO: 1855 - RNA, 24 nt, Artificial Sequence
  Synthetic
ugugaaaacuuuuugauuaugcau

SEQ ID NO: 1856 - RNA, 18 nt, Artificial Sequence
  Synthetic
gaagagguaagaaacuau

SEQ ID NO: 1857 - RNA, 19 nt, Artificial Sequence
  Synthetic
agaagagguaagaaacuau

SEQ ID NO: 1858 - RNA, 21 nt, Artificial Sequence
  Synthetic
cuagaagagguaagaaacuau

SEQ ID NO: 1859 - RNA, 22 nt, Artificial Sequence
  Synthetic
acuagaagagguaagaaacuau

SEQ ID NO: 1860 - RNA, 23 nt, Artificial Sequence
  Synthetic
aacuagaagagguaagaaacuau

SEQ ID NO: 1861 - RNA, 24 nt, Artificial Sequence
  Synthetic
caacuagaagagguaagaaacuau

SEQ ID NO: 1862 - RNA, 18 nt, Artificial Sequence
  Synthetic
acuucuaauggugauuau

SEQ ID NO: 1863 - RNA, 19 nt, Artificial Sequence
  Synthetic
cacuucuaauggugauuau

SEQ ID NO: 1864 - RNA, 21 nt, Artificial Sequence
  Synthetic
uucacuucuaauggugauuau

SEQ ID NO: 1865 - RNA, 22 nt, Artificial Sequence
  Synthetic
cuucacuucuaauggugauuau

SEQ ID NO: 1866 - RNA, 23 nt, Artificial Sequence
  Synthetic
acuucacuucuaauggugauuau

SEQ ID NO: 1867 - RNA, 24 nt, Artificial Sequence
  Synthetic
gacuucacuucuaauggugauuau

SEQ ID NO: 1868 - RNA, 18 nt, Artificial Sequence
  Synthetic
augccaacuagaagaggu

SEQ ID NO: 1869 - RNA, 19 nt, Artificial Sequence
  Synthetic
caugccaacuagaagaggu

SEQ ID NO: 1870 - RNA, 21 nt, Artificial Sequence
  Synthetic
agcaugccaacuagaagaggu

SEQ ID NO: 1871 - RNA, 22 nt, Artificial Sequence
  Synthetic
aagcaugccaacuagaagaggu

SEQ ID NO: 1872 - RNA, 23 nt, Artificial Sequence
  Synthetic
aaagcaugccaacuagaagaggu

SEQ ID NO: 1873 - RNA, 24 nt, Artificial Sequence
  Synthetic
caaagcaugccaacuagaagaggu

SEQ ID NO: 1874 - RNA, 18 nt, Artificial Sequence
  Synthetic
ucacuucuaauggugauu

SEQ ID NO: 1875 - RNA, 19 nt, Artificial Sequence
  Synthetic
uucacuucuaauggugauu

SEQ ID NO: 1876 - RNA, 21 nt, Artificial Sequence
  Synthetic
acuucacuucuaauggugauu

SEQ ID NO: 1877 - RNA, 22 nt, Artificial Sequence
  Synthetic
gacuucacuucuaauggugauu

SEQ ID NO: 1878 - RNA, 23 nt, Artificial Sequence
  Synthetic
agacuucacuucuaauggugauu

SEQ ID NO: 1879 - RNA, 24 nt, Artificial Sequence
  Synthetic
cagacuucacuucuaauggugauu

SEQ ID NO: 1880 - RNA, 18 nt, Artificial Sequence
  Synthetic
ugggagaacuggagccuu

SEQ ID NO: 1881 - RNA, 19 nt, Artificial Sequence
  Synthetic
augggagaacuggagccuu

SEQ ID NO: 1882 - RNA, 21 nt, Artificial Sequence
  Synthetic
uuaugggagaacuggagccuu

SEQ ID NO: 1883 - RNA, 22 nt, Artificial Sequence
  Synthetic
auuaugggagaacuggagccuu

SEQ ID NO: 1884 - RNA, 23 nt, Artificial Sequence
  Synthetic
gauuaugggagaacuggagccuu

SEQ ID NO: 1885 - RNA, 24 nt, Artificial Sequence
  Synthetic
ugauuaugggagaacuggagccuu

SEQ ID NO: 1886 - RNA, 17 nt, Artificial Sequence
  Synthetic
agaaugaaauucuucca

SEQ ID NO: 1887 - RNA, 17 nt, Artificial Sequence
  Synthetic
cuuaccucuucuaguug

SEQ ID NO: 1888 - RNA, 20 nt, Artificial Sequence
  Synthetic
uucuaguuggcaugcuuuga

SEQ ID NO: 1889 - RNA, 17 nt, Artificial Sequence
  Synthetic
uaguuggcaugcuuuga

SEQ ID NO: 1890 - RNA, 20 nt, Artificial Sequence
  Synthetic
aacagaaugaaauucuucca

SEQ ID NO: 1891 - RNA, 20 nt, Artificial Sequence
  Synthetic
uuucuuaccucuucuaguug

SEQ ID NO: 1892 - RNA, 17 nt, Artificial Sequence
  Synthetic
auaguucuuugagaagg

SEQ ID NO: 1893 - RNA, 20 nt, Artificial Sequence
  Synthetic
gacaauauaguucuuugaga

SEQ ID NO: 1894 - RNA, 17 nt, Artificial Sequence
  Synthetic
aauugcauuugaaauaa

SEQ ID NO: 1895 - RNA, 17 nt, Artificial Sequence
  Synthetic
aauauaguucuuugaga

SEQ ID NO: 1896 - RNA, 20 nt, Artificial Sequence
  Synthetic
auaaauugcauuugaaauaa

SEQ ID NO: 1897 - RNA, 20 nt, Artificial Sequence
  Synthetic
aauauaguucuuugagaagg

SEQ ID NO: 1898 - RNA, 21 nt, Artificial Sequence
  Synthetic
ggauuuuuucaauuccagaaa

SEQ ID NO: 1899 - RNA, 21 nt, Artificial Sequence
  Synthetic
gucacuuuuaguaugcucaau

SEQ ID NO: 1900 - RNA, 23 nt, Artificial Sequence
  Synthetic
gagucacuuuuaguaugcucaau

SEQ ID NO: 1901 - RNA, 18 nt, Artificial Sequence
  Synthetic
gaguggaggucaacgagc

SEQ ID NO: 1902 - RNA, 22 nt, Artificial Sequence
  Synthetic
gagcaagaauuucuuuagcaag

SEQ ID NO: 1903 - RNA, 19 nt, Artificial Sequence
  Synthetic
guuuuauggcuaguggguu

SEQ ID NO: 1904 - RNA, 21 nt, Artificial Sequence
  Synthetic
ggguuuuauggcuaguggguu

SEQ ID NO: 1905 - RNA, 22 nt, Artificial Sequence
  Synthetic
gggguuuuauggcuaguggguu

SEQ ID NO: 1906 - RNA, 18 nt, Artificial Sequence
  Synthetic
uuuuuucaauuccagaaa

SEQ ID NO: 1907 - RNA, 19 nt, Artificial Sequence
  Synthetic
auuuuuucaauuccagaaa

SEQ ID NO: 1908 - RNA, 22 nt, Artificial Sequence
  Synthetic
aggauuuuuucaauuccagaaa

SEQ ID NO: 1909 - RNA, 23 nt, Artificial Sequence
  Synthetic
caggauuuuuucaauuccagaaa

SEQ ID NO: 1910 - RNA, 24 nt, Artificial Sequence
  Synthetic
ccaggauuuuuucaauuccagaaa

SEQ ID NO: 1911 - RNA, 18 nt, Artificial Sequence
  Synthetic
ugucuguaauuuuuuuac

SEQ ID NO: 1912 - RNA, 19 nt, Artificial Sequence
  Synthetic
augucuguaauuuuuuuac

SEQ ID NO: 1913 - RNA, 18 nt, Artificial Sequence
  Synthetic
ccacuagccauaaaaccc

SEQ ID NO: 1914 - RNA, 19 nt, Artificial Sequence
  Synthetic
cccacuagccauaaaaccc

SEQ ID NO: 1915 - RNA, 20 nt, Artificial Sequence
  Synthetic
acccacuagccauaaaaccc

SEQ ID NO: 1916 - RNA, 21 nt, Artificial Sequence
  Synthetic
aacccacuagccauaaaaccc

SEQ ID NO: 1917 - RNA, 22 nt, Artificial Sequence
  Synthetic
uaacccacuagccauaaaaccc

SEQ ID NO: 1918 - RNA, 23 nt, Artificial Sequence
  Synthetic
uuaacccacuagccauaaaaccc

SEQ ID NO: 1919 - RNA, 24 nt, Artificial Sequence
  Synthetic
cuuaacccacuagccauaaaaccc

SEQ ID NO: 1920 - RNA, 18 nt, Artificial Sequence
  Synthetic
acuuuuaguaugcucaau

SEQ ID NO: 1921 - RNA, 19 nt, Artificial Sequence
  Synthetic
cacuuuuaguaugcucaau

SEQ ID NO: 1922 - RNA, 22 nt, Artificial Sequence
  Synthetic
agucacuuuuaguaugcucaau

SEQ ID NO: 1923 - RNA, 24 nt, Artificial Sequence
  Synthetic
agagucacuuuuaguaugcucaau

SEQ ID NO: 1924 - RNA, 18 nt, Artificial Sequence
  Synthetic
ccugggguuuuauggcua

SEQ ID NO: 1925 - RNA, 19 nt, Artificial Sequence
  Synthetic
uccugggguuuuauggcua

SEQ ID NO: 1926 - RNA, 21 nt, Artificial Sequence
  Synthetic
aauccugggguuuuauggcua

SEQ ID NO: 1927 - RNA, 22 nt, Artificial Sequence
  Synthetic
aaauccugggguuuuauggcua

SEQ ID NO: 1928 - RNA, 23 nt, Artificial Sequence
  Synthetic
aaaauccugggguuuuauggcua

SEQ ID NO: 1929 - RNA, 24 nt, Artificial Sequence
  Synthetic
aaaaauccugggguuuuauggcua

SEQ ID NO: 1930 - RNA, 19 nt, Artificial Sequence
  Synthetic
ugaguggaggucaacgagc

SEQ ID NO: 1931 - RNA, 18 nt, Artificial Sequence
  Synthetic
ugcuuuauauucuguuuc

SEQ ID NO: 1932 - RNA, 19 nt, Artificial Sequence
  Synthetic
uugcuuuauauucuguuuc

SEQ ID NO: 1933 - RNA, 21 nt, Artificial Sequence
  Synthetic
uauugcuuuauauucuguuuc

SEQ ID NO: 1934 - RNA, 22 nt, Artificial Sequence
  Synthetic
cuauugcuuuauauucuguuuc

SEQ ID NO: 1935 - RNA, 23 nt, Artificial Sequence
  Synthetic
ucuauugcuuuauauucuguuuc

SEQ ID NO: 1936 - RNA, 24 nt, Artificial Sequence
  Synthetic
cucuauugcuuuauauucuguuuc

SEQ ID NO: 1937 - RNA, 18 nt, Artificial Sequence
  Synthetic
aagaauuucuuuagcaag

SEQ ID NO: 1938 - RNA, 19 nt, Artificial Sequence
  Synthetic
caagaauuucuuuagcaag

SEQ ID NO: 1939 - RNA, 21 nt, Artificial Sequence
  Synthetic
agcaagaauuucuuuagcaag

SEQ ID NO: 1940 - RNA, 23 nt, Artificial Sequence
  Synthetic
cgagcaagaauuucuuuagcaag

SEQ ID NO: 1941 - RNA, 24 nt, Artificial Sequence
  Synthetic
acgagcaagaauuucuuuagcaag

SEQ ID NO: 1942 - RNA, 18 nt, Artificial Sequence
  Synthetic
uuuuauggcuaguggguu

SEQ ID NO: 1943 - RNA, 23 nt, Artificial Sequence
  Synthetic
ugggguuuuauggcuaguggguu

SEQ ID NO: 1944 - RNA, 24 nt, Artificial Sequence
  Synthetic
cugggguuuuauggcuaguggguu

SEQ ID NO: 1945 - RNA, 22 nt, Artificial Sequence
  Synthetic
gaaaugucuguaauuuuuuuac

SEQ ID NO: 1946 - RNA, 24 nt, Artificial Sequence
  Synthetic
gagaaaugucuguaauuuuuuuac

SEQ ID NO: 1947 - RNA, 24 nt, Artificial Sequence
  Synthetic
guucuuugagaagguggaaucaca

SEQ ID NO: 1948 - RNA, 22 nt, Artificial Sequence
  Synthetic
guuucuggaauugaaaaaaucc

SEQ ID NO: 1949 - RNA, 23 nt, Artificial Sequence
  Synthetic
gacaauauaguucuuugagaagg

SEQ ID NO: 1950 - RNA, 18 nt, Artificial Sequence
  Synthetic
accaaaaauagaaaauua

SEQ ID NO: 1951 - RNA, 19 nt, Artificial Sequence
  Synthetic
uaccaaaaauagaaaauua

SEQ ID NO: 1952 - RNA, 21 nt, Artificial Sequence
  Synthetic
auuaccaaaaauagaaaauua

SEQ ID NO: 1953 - RNA, 22 nt, Artificial Sequence
  Synthetic
uauuaccaaaaauagaaaauua

SEQ ID NO: 1954 - RNA, 23 nt, Artificial Sequence
  Synthetic
cuauuaccaaaaauagaaaauua

SEQ ID NO: 1955 - RNA, 24 nt, Artificial Sequence
  Synthetic
ccuauuaccaaaaauagaaaauua

SEQ ID NO: 1956 - RNA, 21 nt, Artificial Sequence
  Synthetic
aaaugucuguaauuuuuuuac

SEQ ID NO: 1957 - RNA, 23 nt, Artificial Sequence
  Synthetic
agaaaugucuguaauuuuuuuac

SEQ ID NO: 1958 - RNA, 18 nt, Artificial Sequence
  Synthetic
ugagaagguggaaucaca

SEQ ID NO: 1959 - RNA, 19 nt, Artificial Sequence
  Synthetic
uugagaagguggaaucaca

SEQ ID NO: 1960 - RNA, 20 nt, Artificial Sequence
  Synthetic
uuugagaagguggaaucaca

SEQ ID NO: 1961 - RNA, 21 nt, Artificial Sequence
  Synthetic
cuuugagaagguggaaucaca

SEQ ID NO: 1962 - RNA, 22 nt, Artificial Sequence
  Synthetic
ucuuugagaagguggaaucaca

SEQ ID NO: 1963 - RNA, 23 nt, Artificial Sequence
  Synthetic
uucuuugagaagguggaaucaca

SEQ ID NO: 1964 - RNA, 18 nt, Artificial Sequence
  Synthetic
cuggaauugaaaaaaucc

SEQ ID NO: 1965 - RNA, 19 nt, Artificial Sequence
  Synthetic
ucuggaauugaaaaaaucc

SEQ ID NO: 1966 - RNA, 21 nt, Artificial Sequence
  Synthetic
uuucuggaauugaaaaaaucc

SEQ ID NO: 1967 - RNA, 23 nt, Artificial Sequence
  Synthetic
uguuucuggaauugaaaaaaucc

SEQ ID NO: 1968 - RNA, 24 nt, Artificial Sequence
  Synthetic
cuguuucuggaauugaaaaaaucc

SEQ ID NO: 1969 - RNA, 21 nt, Artificial Sequence
  Synthetic
acugaguggaggucaacgagc

SEQ ID NO: 1970 - RNA, 22 nt, Artificial Sequence
  Synthetic
cacugaguggaggucaacgagc

SEQ ID NO: 1971 - RNA, 23 nt, Artificial Sequence
  Synthetic
acacugaguggaggucaacgagc

SEQ ID NO: 1972 - RNA, 24 nt, Artificial Sequence
  Synthetic
cacacugaguggaggucaacgagc

SEQ ID NO: 1973 - RNA, 18 nt, Artificial Sequence
  Synthetic
uauaguucuuugagaagg

SEQ ID NO: 1974 - RNA, 19 nt, Artificial Sequence
  Synthetic
auauaguucuuugagaagg

SEQ ID NO: 1975 - RNA, 21 nt, Artificial Sequence
  Synthetic
caauauaguucuuugagaagg

SEQ ID NO: 1976 - RNA, 22 nt, Artificial Sequence
  Synthetic
acaauauaguucuuugagaagg

SEQ ID NO: 1977 - RNA, 24 nt, Artificial Sequence
  Synthetic
agacaauauaguucuuugagaagg

SEQ ID NO: 1978 - RNA, 18 nt, Artificial Sequence
  Synthetic
auguccuauuaccaaaaa

SEQ ID NO: 1979 - RNA, 19 nt, Artificial Sequence
  Synthetic
gauguccuauuaccaaaaa

SEQ ID NO: 1980 - RNA, 21 nt, Artificial Sequence
  Synthetic
gagauguccuauuaccaaaaa

SEQ ID NO: 1981 - RNA, 22 nt, Artificial Sequence
  Synthetic
ggagauguccuauuaccaaaaa

SEQ ID NO: 1982 - RNA, 23 nt, Artificial Sequence
  Synthetic
uggagauguccuauuaccaaaaa

SEQ ID NO: 1983 - RNA, 24 nt, Artificial Sequence
  Synthetic
uuggagauguccuauuaccaaaaa

SEQ ID NO: 1984 - RNA, 18 nt, Artificial Sequence
  Synthetic
aaacagaauauaaagcaa

SEQ ID NO: 1985 - RNA, 19 nt, Artificial Sequence
  Synthetic
gaaacagaauauaaagcaa

SEQ ID NO: 1986 - RNA, 21 nt, Artificial Sequence
  Synthetic
cagaaacagaauauaaagcaa

SEQ ID NO: 1987 - RNA, 22 nt, Artificial Sequence
  Synthetic
ccagaaacagaauauaaagcaa

SEQ ID NO: 1988 - RNA, 23 nt, Artificial Sequence
  Synthetic
uccagaaacagaauauaaagcaa

SEQ ID NO: 1989 - RNA, 24 nt, Artificial Sequence
  Synthetic
uuccagaaacagaauauaaagcaa

SEQ ID NO: 1990 - RNA, 18 nt, Artificial Sequence
  Synthetic
ugugauuccaccuucuca

SEQ ID NO: 1991 - RNA, 19 nt, Artificial Sequence
  Synthetic
gugugauuccaccuucuca

SEQ ID NO: 1992 - RNA, 20 nt, Artificial Sequence
  Synthetic
agugugauuccaccuucuca

SEQ ID NO: 1993 - RNA, 21 nt, Artificial Sequence
  Synthetic
cagugugauuccaccuucuca

SEQ ID NO: 1994 - RNA, 22 nt, Artificial Sequence
  Synthetic
ucagugugauuccaccuucuca

SEQ ID NO: 1995 - RNA, 23 nt, Artificial Sequence
  Synthetic
cucagugugauuccaccuucuca

SEQ ID NO: 1996 - RNA, 24 nt, Artificial Sequence
  Synthetic
acucagugugauuccaccuucuca

SEQ ID NO: 1997 - RNA, 18 nt, Artificial Sequence
  Synthetic
acagaauauaaagcaaua

SEQ ID NO: 1998 - RNA, 19 nt, Artificial Sequence
  Synthetic
aacagaauauaaagcaaua

SEQ ID NO: 1999 - RNA, 21 nt, Artificial Sequence
  Synthetic
gaaacagaauauaaagcaaua

SEQ ID NO: 2000 - RNA, 22 nt, Artificial Sequence
  Synthetic
agaaacagaauauaaagcaaua

SEQ ID NO: 2001 - RNA, 23 nt, Artificial Sequence
  Synthetic
cagaaacagaauauaaagcaaua

SEQ ID NO: 2002 - RNA, 24 nt, Artificial Sequence
  Synthetic
ccagaaacagaauauaaagcaaua

SEQ ID NO: 2003 - RNA, 18 nt, Artificial Sequence
  Synthetic
uaguuauucaccuugcua

SEQ ID NO: 2004 - RNA, 19 nt, Artificial Sequence
  Synthetic
uuaguuauucaccuugcua

SEQ ID NO: 2005 - RNA, 21 nt, Artificial Sequence
  Synthetic
aauuaguuauucaccuugcua

SEQ ID NO: 2006 - RNA, 22 nt, Artificial Sequence
  Synthetic
uaauuaguuauucaccuugcua

SEQ ID NO: 2007 - RNA, 23 nt, Artificial Sequence
  Synthetic
auaauuaguuauucaccuugcua

SEQ ID NO: 2008 - RNA, 24 nt, Artificial Sequence
  Synthetic
aauaauuaguuauucaccuugcua

SEQ ID NO: 2009 - RNA, 18 nt, Artificial Sequence
  Synthetic
uugucuuucucugcaaac

SEQ ID NO: 2010 - RNA, 19 nt, Artificial Sequence
  Synthetic
auugucuuucucugcaaac

SEQ ID NO: 2011 - RNA, 21 nt, Artificial Sequence
  Synthetic
auauugucuuucucugcaaac

SEQ ID NO: 2012 - RNA, 22 nt, Artificial Sequence
  Synthetic
uauauugucuuucucugcaaac

SEQ ID NO: 2013 - RNA, 23 nt, Artificial Sequence
  Synthetic
cuauauugucuuucucugcaaac

SEQ ID NO: 2014 - RNA, 24 nt, Artificial Sequence
  Synthetic
acuauauugucuuucucugcaaac

SEQ ID NO: 2015 - RNA, 18 nt, Artificial Sequence
  Synthetic
ccaggauuuuuucaauuc

SEQ ID NO: 2016 - RNA, 19 nt, Artificial Sequence
  Synthetic
cccaggauuuuuucaauuc

SEQ ID NO: 2017 - RNA, 21 nt, Artificial Sequence
  Synthetic
accccaggauuuuuucaauuc

SEQ ID NO: 2018 - RNA, 22 nt, Artificial Sequence
  Synthetic
aaccccaggauuuuuucaauuc

SEQ ID NO: 2019 - RNA, 23 nt, Artificial Sequence
  Synthetic
aaaccccaggauuuuuucaauuc

SEQ ID NO: 2020 - RNA, 24 nt, Artificial Sequence
  Synthetic
aaaaccccaggauuuuuucaauuc

SEQ ID NO: 2021 - RNA, 18 nt, Artificial Sequence
  Synthetic
cuauugcuuuaaccacag

SEQ ID NO: 2022 - RNA, 19 nt, Artificial Sequence
  Synthetic
acuauugcuuuaaccacag

SEQ ID NO: 2023 - RNA, 21 nt, Artificial Sequence
  Synthetic
acacuauugcuuuaaccacag

SEQ ID NO: 2024 - RNA, 22 nt, Artificial Sequence
  Synthetic
cacacuauugcuuuaaccacag

SEQ ID NO: 2025 - RNA, 23 nt, Artificial Sequence
  Synthetic
ucacacuauugcuuuaaccacag

SEQ ID NO: 2026 - RNA, 24 nt, Artificial Sequence
  Synthetic
aucacacuauugcuuuaaccacag

SEQ ID NO: 2027 - RNA, 18 nt, Artificial Sequence
  Synthetic
uuaccaaaaauagaaaau

SEQ ID NO: 2028 - RNA, 19 nt, Artificial Sequence
  Synthetic
auuaccaaaaauagaaaau

SEQ ID NO: 2029 - RNA, 21 nt, Artificial Sequence
  Synthetic
cuauuaccaaaaauagaaaau

SEQ ID NO: 2030 - RNA, 22 nt, Artificial Sequence
  Synthetic
ccuauuaccaaaaauagaaaau

SEQ ID NO: 2031 - RNA, 23 nt, Artificial Sequence
  Synthetic
uccuauuaccaaaaauagaaaau

SEQ ID NO: 2032 - RNA, 24 nt, Artificial Sequence
  Synthetic
guccuauuaccaaaaauagaaaau

SEQ ID NO: 2033 - RNA, 18 nt, Artificial Sequence
  Synthetic
aguaugcucaaucugaau

SEQ ID NO: 2034 - RNA, 19 nt, Artificial Sequence
  Synthetic
uaguaugcucaaucugaau

SEQ ID NO: 2035 - RNA, 21 nt, Artificial Sequence
  Synthetic
uuuaguaugcucaaucugaau

SEQ ID NO: 2036 - RNA, 22 nt, Artificial Sequence
  Synthetic
uuuuaguaugcucaaucugaau

SEQ ID NO: 2037 - RNA, 23 nt, Artificial Sequence
  Synthetic
cuuuuaguaugcucaaucugaau

SEQ ID NO: 2038 - RNA, 24 nt, Artificial Sequence
  Synthetic
acuuuuaguaugcucaaucugaau

SEQ ID NO: 2039 - RNA, 18 nt, Artificial Sequence
  Synthetic
ugucuuucucugcaaacu

SEQ ID NO: 2040 - RNA, 19 nt, Artificial Sequence
  Synthetic
uugucuuucucugcaaacu

SEQ ID NO: 2041 - RNA, 21 nt, Artificial Sequence
  Synthetic
uauugucuuucucugcaaacu

SEQ ID NO: 2042 - RNA, 22 nt, Artificial Sequence
  Synthetic
auauugucuuucucugcaaacu

SEQ ID NO: 2043 - RNA, 23 nt, Artificial Sequence
  Synthetic
uauauugucuuucucugcaaacu

SEQ ID NO: 2044 - RNA, 24 nt, Artificial Sequence
  Synthetic
cuauauugucuuucucugcaaacu

SEQ ID NO: 2045 - RNA, 18 nt, Artificial Sequence
  Synthetic
uuaaccacaguugaaauu

SEQ ID NO: 2046 - RNA, 19 nt, Artificial Sequence
  Synthetic
uuuaaccacaguugaaauu

SEQ ID NO: 2047 - RNA, 21 nt, Artificial Sequence
  Synthetic
gcuuuaaccacaguugaaauu

SEQ ID NO: 2048 - RNA, 22 nt, Artificial Sequence
  Synthetic
ugcuuuaaccacaguugaaauu

SEQ ID NO: 2049 - RNA, 23 nt, Artificial Sequence
  Synthetic
uugcuuuaaccacaguugaaauu

SEQ ID NO: 2050 - RNA, 24 nt, Artificial Sequence
  Synthetic
auugcuuuaaccacaguugaaauu

SEQ ID NO: 2051 - RNA, 18 nt, Artificial Sequence
  Synthetic
uauauucuguuucuggaa

SEQ ID NO: 2052 - RNA, 19 nt, Artificial Sequence
  Synthetic
uuauauucuguuucuggaa

SEQ ID NO: 2053 - RNA, 21 nt, Artificial Sequence
  Synthetic
cuuuauauucuguuucuggaa

SEQ ID NO: 2054 - RNA, 22 nt, Artificial Sequence
  Synthetic
gcuuuauauucuguuucuggaa

SEQ ID NO: 2055 - RNA, 23 nt, Artificial Sequence
  Synthetic
ugcuuuauauucuguuucuggaa

SEQ ID NO: 2056 - RNA, 24 nt, Artificial Sequence
  Synthetic
uugcuuuauauucuguuucuggaa

SEQ ID NO: 2057 - RNA, 18 nt, Artificial Sequence
  Synthetic
aaauugcauuugaaauaa

SEQ ID NO: 2058 - RNA, 19 nt, Artificial Sequence
  Synthetic
uaaauugcauuugaaauaa

SEQ ID NO: 2059 - RNA, 18 nt, Artificial Sequence
  Synthetic
auuuucuauuuuugguaa

SEQ ID NO: 2060 - RNA, 19 nt, Artificial Sequence
  Synthetic
aauuuucuauuuuugguaa

SEQ ID NO: 2061 - RNA, 21 nt, Artificial Sequence
  Synthetic
cuaauuuucuauuuuugguaa

SEQ ID NO: 2062 - RNA, 22 nt, Artificial Sequence
  Synthetic
ucuaauuuucuauuuuugguaa

SEQ ID NO: 2063 - RNA, 23 nt, Artificial Sequence
  Synthetic
cucuaauuuucuauuuuugguaa

SEQ ID NO: 2064 - RNA, 24 nt, Artificial Sequence
  Synthetic
ucucuaauuuucuauuuuugguaa

SEQ ID NO: 2065 - RNA, 18 nt, Artificial Sequence
  Synthetic
gacaucuccaaguuugca

SEQ ID NO: 2066 - RNA, 19 nt, Artificial Sequence
  Synthetic
ggacaucuccaaguuugca

SEQ ID NO: 2067 - RNA, 21 nt, Artificial Sequence
  Synthetic
uaggacaucuccaaguuugca

SEQ ID NO: 2068 - RNA, 22 nt, Artificial Sequence
  Synthetic
auaggacaucuccaaguuugca

SEQ ID NO: 2069 - RNA, 23 nt, Artificial Sequence
  Synthetic
aauaggacaucuccaaguuugca

SEQ ID NO: 2070 - RNA, 24 nt, Artificial Sequence
  Synthetic
uaauaggacaucuccaaguuugca

SEQ ID NO: 2071 - RNA, 18 nt, Artificial Sequence
  Synthetic
cacacugaguggagguca

SEQ ID NO: 2072 - RNA, 19 nt, Artificial Sequence
  Synthetic
ucacacugaguggagguca

SEQ ID NO: 2073 - RNA, 21 nt, Artificial Sequence
  Synthetic
aaucacacugaguggagguca

SEQ ID NO: 2074 - RNA, 22 nt, Artificial Sequence
  Synthetic
gaaucacacugaguggagguca

SEQ ID NO: 2075 - RNA, 23 nt, Artificial Sequence
  Synthetic
ggaaucacacugaguggagguca

SEQ ID NO: 2076 - RNA, 24 nt, Artificial Sequence
  Synthetic
uggaaucacacugaguggagguca

SEQ ID NO: 2077 - RNA, 18 nt, Artificial Sequence
  Synthetic
gugccuuucaaauucaga

SEQ ID NO: 2078 - RNA, 19 nt, Artificial Sequence
  Synthetic
ugugccuuucaaauucaga

SEQ ID NO: 2079 - RNA, 21 nt, Artificial Sequence
  Synthetic
gaugugccuuucaaauucaga

SEQ ID NO: 2080 - RNA, 22 nt, Artificial Sequence
  Synthetic
agaugugccuuucaaauucaga

SEQ ID NO: 2081 - RNA, 23 nt, Artificial Sequence
  Synthetic
aagaugugccuuucaaauucaga

SEQ ID NO: 2082 - RNA, 24 nt, Artificial Sequence
  Synthetic
gaagaugugccuuucaaauucaga

SEQ ID NO: 2083 - RNA, 18 nt, Artificial Sequence
  Synthetic
auauaugauuacauuaga

SEQ ID NO: 2084 - RNA, 19 nt, Artificial Sequence
  Synthetic
gauauaugauuacauuaga

SEQ ID NO: 2085 - RNA, 21 nt, Artificial Sequence
  Synthetic
gugauauaugauuacauuaga

SEQ ID NO: 2086 - RNA, 22 nt, Artificial Sequence
  Synthetic
ugugauauaugauuacauuaga

SEQ ID NO: 2087 - RNA, 23 nt, Artificial Sequence
  Synthetic
gugugauauaugauuacauuaga

SEQ ID NO: 2088 - RNA, 24 nt, Artificial Sequence
  Synthetic
agugugauauaugauuacauuaga

SEQ ID NO: 2089 - RNA, 18 nt, Artificial Sequence
  Synthetic
aagguggaaucacacuga

SEQ ID NO: 2090 - RNA, 19 nt, Artificial Sequence
  Synthetic
gaagguggaaucacacuga

SEQ ID NO: 2091 - RNA, 21 nt, Artificial Sequence
  Synthetic
gagaagguggaaucacacuga

SEQ ID NO: 2092 - RNA, 22 nt, Artificial Sequence
  Synthetic
ugagaagguggaaucacacuga

SEQ ID NO: 2093 - RNA, 23 nt, Artificial Sequence
  Synthetic
uugagaagguggaaucacacuga

SEQ ID NO: 2094 - RNA, 24 nt, Artificial Sequence
  Synthetic
uuugagaagguggaaucacacuga

SEQ ID NO: 2095 - RNA, 18 nt, Artificial Sequence
  Synthetic
uaaauugcauuugaaaua

SEQ ID NO: 2096 - RNA, 19 nt, Artificial Sequence
  Synthetic
auaaauugcauuugaaaua

SEQ ID NO: 2097 - RNA, 20 nt, Artificial Sequence
  Synthetic
aauaaauugcauuugaaaua

SEQ ID NO: 2098 - RNA, 18 nt, Artificial Sequence
  Synthetic
ucuggaauugaaaaaauc

SEQ ID NO: 2099 - RNA, 19 nt, Artificial Sequence
  Synthetic
uucuggaauugaaaaaauc

SEQ ID NO: 2100 - RNA, 21 nt, Artificial Sequence
  Synthetic
guuucuggaauugaaaaaauc

SEQ ID NO: 2101 - RNA, 22 nt, Artificial Sequence
  Synthetic
uguuucuggaauugaaaaaauc

SEQ ID NO: 2102 - RNA, 23 nt, Artificial Sequence
  Synthetic
cuguuucuggaauugaaaaaauc

SEQ ID NO: 2103 - RNA, 24 nt, Artificial Sequence
  Synthetic
ucuguuucuggaauugaaaaaauc

SEQ ID NO: 2104 - RNA, 18 nt, Artificial Sequence
  Synthetic
auauaguucuuugagaag

SEQ ID NO: 2105 - RNA, 19 nt, Artificial Sequence
  Synthetic
aauauaguucuuugagaag

SEQ ID NO: 2106 - RNA, 20 nt, Artificial Sequence
  Synthetic
caauauaguucuuugagaag

SEQ ID NO: 2107 - RNA, 21 nt, Artificial Sequence
  Synthetic
acaauauaguucuuugagaag

SEQ ID NO: 2108 - RNA, 22 nt, Artificial Sequence
  Synthetic
gacaauauaguucuuugagaag

SEQ ID NO: 2109 - RNA, 23 nt, Artificial Sequence
  Synthetic
agacaauauaguucuuugagaag

SEQ ID NO: 2110 - RNA, 24 nt, Artificial Sequence
  Synthetic
aagacaauauaguucuuugagaag

SEQ ID NO: 2111 - RNA, 18 nt, Artificial Sequence
  Synthetic
agguggaaucacacugag

SEQ ID NO: 2112 - RNA, 19 nt, Artificial Sequence
  Synthetic
aagguggaaucacacugag

SEQ ID NO: 2113 - RNA, 21 nt, Artificial Sequence
  Synthetic
agaagguggaaucacacugag

SEQ ID NO: 2114 - RNA, 22 nt, Artificial Sequence
  Synthetic
gagaagguggaaucacacugag

SEQ ID NO: 2115 - RNA, 23 nt, Artificial Sequence
  Synthetic
ugagaagguggaaucacacugag

SEQ ID NO: 2116 - RNA, 24 nt, Artificial Sequence
  Synthetic
uugagaagguggaaucacacugag

SEQ ID NO: 2117 - RNA, 18 nt, Artificial Sequence
  Synthetic
gauauaugauuacauuag

SEQ ID NO: 2118 - RNA, 19 nt, Artificial Sequence
  Synthetic
ugauauaugauuacauuag

SEQ ID NO: 2119 - RNA, 21 nt, Artificial Sequence
  Synthetic
ugugauauaugauuacauuag

SEQ ID NO: 2120 - RNA, 22 nt, Artificial Sequence
  Synthetic
gugugauauaugauuacauuag

SEQ ID NO: 2121 - RNA, 23 nt, Artificial Sequence
  Synthetic
agugugauauaugauuacauuag

SEQ ID NO: 2122 - RNA, 24 nt, Artificial Sequence
  Synthetic
uagugugauauaugauuacauuag

SEQ ID NO: 2123 - RNA, 18 nt, Artificial Sequence
  Synthetic
aggacaucuccaaguuug

SEQ ID NO: 2124 - RNA, 19 nt, Artificial Sequence
  Synthetic
uaggacaucuccaaguuug

SEQ ID NO: 2125 - RNA, 21 nt, Artificial Sequence
  Synthetic
aauaggacaucuccaaguuug

SEQ ID NO: 2126 - RNA, 22 nt, Artificial Sequence
  Synthetic
uaauaggacaucuccaaguuug

SEQ ID NO: 2127 - RNA, 23 nt, Artificial Sequence
  Synthetic
guaauaggacaucuccaaguuug

SEQ ID NO: 2128 - RNA, 24 nt, Artificial Sequence
  Synthetic
gguaauaggacaucuccaaguuug

SEQ ID NO: 2129 - RNA, 18 nt, Artificial Sequence
  Synthetic
ugugauauaugauuacau

SEQ ID NO: 2130 - RNA, 19 nt, Artificial Sequence
  Synthetic
gugugauauaugauuacau

SEQ ID NO: 2131 - RNA, 21 nt, Artificial Sequence
  Synthetic
uagugugauauaugauuacau

SEQ ID NO: 2132 - RNA, 22 nt, Artificial Sequence
  Synthetic
auagugugauauaugauuacau

SEQ ID NO: 2133 - RNA, 23 nt, Artificial Sequence
  Synthetic
aauagugugauauaugauuacau

SEQ ID NO: 2134 - RNA, 24 nt, Artificial Sequence
  Synthetic
caauagugugauauaugauuacau

SEQ ID NO: 2135 - RNA, 18 nt, Artificial Sequence
  Synthetic
gaaagacaauauaguucu

SEQ ID NO: 2136 - RNA, 19 nt, Artificial Sequence
  Synthetic
agaaagacaauauaguucu

SEQ ID NO: 2137 - RNA, 21 nt, Artificial Sequence
  Synthetic
agagaaagacaauauaguucu

SEQ ID NO: 2138 - RNA, 22 nt, Artificial Sequence
  Synthetic
cagagaaagacaauauaguucu

SEQ ID NO: 2139 - RNA, 23 nt, Artificial Sequence
  Synthetic
gcagagaaagacaauauaguucu

SEQ ID NO: 2140 - RNA, 24 nt, Artificial Sequence
  Synthetic
ugcagagaaagacaauauaguucu

SEQ ID NO: 2141 - RNA, 18 nt, Artificial Sequence
  Synthetic
aagacaauauaguucuuu

SEQ ID NO: 2142 - RNA, 19 nt, Artificial Sequence
  Synthetic
aaagacaauauaguucuuu

SEQ ID NO: 2143 - RNA, 20 nt, Artificial Sequence
  Synthetic
gaaagacaauauaguucuuu

SEQ ID NO: 2144 - RNA, 21 nt, Artificial Sequence
  Synthetic
agaaagacaauauaguucuuu

SEQ ID NO: 2145 - RNA, 22 nt, Artificial Sequence
  Synthetic
gagaaagacaauauaguucuuu

SEQ ID NO: 2146 - RNA, 23 nt, Artificial Sequence
  Synthetic
agagaaagacaauauaguucuuu

SEQ ID NO: 2147 - RNA, 24 nt, Artificial Sequence
  Synthetic
cagagaaagacaauauaguucuuu

SEQ ID NO: 2148 - RNA, 18 nt, Artificial Sequence
  Synthetic
uugcuuuauauucuguuu

SEQ ID NO: 2149 - RNA, 19 nt, Artificial Sequence
  Synthetic
auugcuuuauauucuguuu

SEQ ID NO: 2150 - RNA, 21 nt, Artificial Sequence
  Synthetic
cuauugcuuuauauucuguuu

SEQ ID NO: 2151 - RNA, 22 nt, Artificial Sequence
  Synthetic
ucuauugcuuuauauucuguuu

SEQ ID NO: 2152 - RNA, 23 nt, Artificial Sequence
  Synthetic
cucuauugcuuuauauucuguuu

SEQ ID NO: 2153 - RNA, 24 nt, Artificial Sequence
  Synthetic
ucucuauugcuuuauauucuguuu

SEQ ID NO: 2154 - RNA, 17 nt, Artificial Sequence
  Synthetic
guaaucauauaucacac

SEQ ID NO: 2155 - RNA, 17 nt, Artificial Sequence
  Synthetic
ugaaugacauuuacagc

SEQ ID NO: 2156 - RNA, 20 nt, Artificial Sequence
  Synthetic
aauguaaucauauaucacac

SEQ ID NO: 2157 - RNA, 20 nt, Artificial Sequence
  Synthetic
acaugaaugacauuuacagc

SEQ ID NO: 2158 - RNA, 17 nt, Artificial Sequence
  Synthetic
aauuacagacauuucuc

SEQ ID NO: 2159 - RNA, 20 nt, Artificial Sequence
  Synthetic
aaaaauuacagacauuucuc

SEQ ID NO: 2160 - RNA, 18 nt, Artificial Sequence
  Synthetic
ggagaagguggaaucaca

SEQ ID NO: 2161 - RNA, 24 nt, Artificial Sequence
  Synthetic
guucuuggagaagguggaaucaca

SEQ ID NO: 2162 - RNA, 23 nt, Artificial Sequence
  Synthetic
gacaauauaguucuuggagaagg

SEQ ID NO: 2163 - RNA, 19 nt, Artificial Sequence
  Synthetic
uggagaagguggaaucaca

SEQ ID NO: 2164 - RNA, 21 nt, Artificial Sequence
  Synthetic
cuuggagaagguggaaucaca

SEQ ID NO: 2165 - RNA, 22 nt, Artificial Sequence
  Synthetic
ucuuggagaagguggaaucaca

SEQ ID NO: 2166 - RNA, 23 nt, Artificial Sequence
  Synthetic
uucuuggagaagguggaaucaca

SEQ ID NO: 2167 - RNA, 18 nt, Artificial Sequence
  Synthetic
uauaguucuuggagaagg

SEQ ID NO: 2168 - RNA, 19 nt, Artificial Sequence
  Synthetic
auauaguucuuggagaagg

SEQ ID NO: 2169 - RNA, 21 nt, Artificial Sequence
  Synthetic
caauauaguucuuggagaagg

SEQ ID NO: 2170 - RNA, 22 nt, Artificial Sequence
  Synthetic
acaauauaguucuuggagaagg

SEQ ID NO: 2171 - RNA, 24 nt, Artificial Sequence
  Synthetic
agacaauauaguucuuggagaagg

SEQ ID NO: 2172 - RNA, 18 nt, Artificial Sequence
  Synthetic
gaguggagaucaacgagc

SEQ ID NO: 2173 - RNA, 19 nt, Artificial Sequence
  Synthetic
ugaguggagaucaacgagc

SEQ ID NO: 2174 - RNA, 20 nt, Artificial Sequence
  Synthetic
cugaguggagaucaacgagc

SEQ ID NO: 2175 - RNA, 21 nt, Artificial Sequence
  Synthetic
acugaguggagaucaacgagc

SEQ ID NO: 2176 - RNA, 22 nt, Artificial Sequence
  Synthetic
cacugaguggagaucaacgagc

SEQ ID NO: 2177 - RNA, 23 nt, Artificial Sequence
  Synthetic
acacugaguggagaucaacgagc

SEQ ID NO: 2178 - RNA, 24 nt, Artificial Sequence
  Synthetic
cacacugaguggagaucaacgagc

SEQ ID NO: 2179 - RNA, 18 nt, Artificial Sequence
  Synthetic
ugugauuccaccuucucc

SEQ ID NO: 2180 - RNA, 19 nt, Artificial Sequence
  Synthetic
gugugauuccaccuucucc

SEQ ID NO: 2181 - RNA, 21 nt, Artificial Sequence
  Synthetic
cagugugauuccaccuucucc

SEQ ID NO: 2182 - RNA, 22 nt, Artificial Sequence
  Synthetic
ucagugugauuccaccuucucc

SEQ ID NO: 2183 - RNA, 23 nt, Artificial Sequence
  Synthetic
cucagugugauuccaccuucucc

SEQ ID NO: 2184 - RNA, 24 nt, Artificial Sequence
  Synthetic
acucagugugauuccaccuucucc

SEQ ID NO: 2185 - RNA, 18 nt, Artificial Sequence
  Synthetic
cacacugaguggagauca

SEQ ID NO: 2186 - RNA, 19 nt, Artificial Sequence
  Synthetic
ucacacugaguggagauca

SEQ ID NO: 2187 - RNA, 20 nt, Artificial Sequence
  Synthetic
aucacacugaguggagauca

SEQ ID NO: 2188 - RNA, 21 nt, Artificial Sequence
  Synthetic
aaucacacugaguggagauca

SEQ ID NO: 2189 - RNA, 22 nt, Artificial Sequence
  Synthetic
gaaucacacugaguggagauca

SEQ ID NO: 2190 - RNA, 23 nt, Artificial Sequence
  Synthetic
ggaaucacacugaguggagauca

SEQ ID NO: 2191 - RNA, 24 nt, Artificial Sequence
  Synthetic
uggaaucacacugaguggagauca

SEQ ID NO: 2192 - RNA, 22 nt, Artificial Sequence
  Synthetic
ggagaagguggaaucacacuga

SEQ ID NO: 2193 - RNA, 23 nt, Artificial Sequence
  Synthetic
uggagaagguggaaucacacuga

SEQ ID NO: 2194 - RNA, 24 nt, Artificial Sequence
  Synthetic
uuggagaagguggaaucacacuga

SEQ ID NO: 2195 - RNA, 18 nt, Artificial Sequence
  Synthetic
agaaagacaauauaguuc

SEQ ID NO: 2196 - RNA, 19 nt, Artificial Sequence
  Synthetic
gagaaagacaauauaguuc

SEQ ID NO: 2197 - RNA, 21 nt, Artificial Sequence
  Synthetic
cagagaaagacaauauaguuc

SEQ ID NO: 2198 - RNA, 22 nt, Artificial Sequence
  Synthetic
gcagagaaagacaauauaguuc

SEQ ID NO: 2199 - RNA, 23 nt, Artificial Sequence
  Synthetic
ugcagagaaagacaauauaguuc

SEQ ID NO: 2200 - RNA, 24 nt, Artificial Sequence
  Synthetic
uugcagagaaagacaauauaguuc

SEQ ID NO: 2201 - RNA, 18 nt, Artificial Sequence
  Synthetic
auauaguucuuggagaag

SEQ ID NO: 2202 - RNA, 19 nt, Artificial Sequence
  Synthetic
aauauaguucuuggagaag

SEQ ID NO: 2203 - RNA, 21 nt, Artificial Sequence
  Synthetic
acaauauaguucuuggagaag

SEQ ID NO: 2204 - RNA, 22 nt, Artificial Sequence
  Synthetic
gacaauauaguucuuggagaag

SEQ ID NO: 2205 - RNA, 23 nt, Artificial Sequence
  Synthetic
agacaauauaguucuuggagaag

SEQ ID NO: 2206 - RNA, 24 nt, Artificial Sequence
  Synthetic
aagacaauauaguucuuggagaag

SEQ ID NO: 2207 - RNA, 23 nt, Artificial Sequence
  Synthetic
ggagaagguggaaucacacugag

SEQ ID NO: 2208 - RNA, 24 nt, Artificial Sequence
  Synthetic
uggagaagguggaaucacacugag

SEQ ID NO: 2209 - RNA, 18 nt, Artificial Sequence
  Synthetic
aagacaauauaguucuug

SEQ ID NO: 2210 - RNA, 19 nt, Artificial Sequence
  Synthetic
aaagacaauauaguucuug

SEQ ID NO: 2211 - RNA, 21 nt, Artificial Sequence
  Synthetic
agaaagacaauauaguucuug

SEQ ID NO: 2212 - RNA, 22 nt, Artificial Sequence
  Synthetic
gagaaagacaauauaguucuug

SEQ ID NO: 2213 - RNA, 23 nt, Artificial Sequence
  Synthetic
agagaaagacaauauaguucuug

SEQ ID NO: 2214 - RNA, 24 nt, Artificial Sequence
  Synthetic
cagagaaagacaauauaguucuug

SEQ ID NO: 2215 - RNA, 18 nt, Artificial Sequence
  Synthetic
ggguuaagaaucacauuu

SEQ ID NO: 2216 - RNA, 19 nt, Artificial Sequence
  Synthetic
uggguuaagaaucacauuu

SEQ ID NO: 2217 - RNA, 21 nt, Artificial Sequence
  Synthetic
aguggguuaagaaucacauuu

SEQ ID NO: 2218 - RNA, 22 nt, Artificial Sequence
  Synthetic
uaguggguuaagaaucacauuu

SEQ ID NO: 2219 - RNA, 23 nt, Artificial Sequence
  Synthetic
cuaguggguuaagaaucacauuu

SEQ ID NO: 2220 - RNA, 24 nt, Artificial Sequence
  Synthetic
gcuaguggguuaagaaucacauuu

SEQ ID NO: 2221 - RNA, 17 nt, Artificial Sequence
  Synthetic
ucguugaucuccacuca

SEQ ID NO: 2222 - RNA, 20 nt, Artificial Sequence
  Synthetic
ugcucguugaucuccacuca

SEQ ID NO: 2223 - RNA, 17 nt, Artificial Sequence
  Synthetic
ggagugaucaagaaaua

SEQ ID NO: 2224 - RNA, 17 nt, Artificial Sequence
  Synthetic
gaguacccuaacauacc

SEQ ID NO: 2225 - RNA, 20 nt, Artificial Sequence
  Synthetic
gugugugcacaacuuuaaaa

SEQ ID NO: 2226 - RNA, 20 nt, Artificial Sequence
  Synthetic
ggaaaguugcagaugaggua

SEQ ID NO: 2227 - RNA, 20 nt, Artificial Sequence
  Synthetic
gaacuugaugguaaguacau

SEQ ID NO: 2228 - RNA, 20 nt, Artificial Sequence
  Synthetic
gcuauaucagccauuugugu

SEQ ID NO: 2229 - RNA, 17 nt, Artificial Sequence
  Synthetic
ugugcacaacuuuaaaa

SEQ ID NO: 2230 - RNA, 17 nt, Artificial Sequence
  Synthetic
acuugaugguaaguaca

SEQ ID NO: 2231 - RNA, 17 nt, Artificial Sequence
  Synthetic
aauuugagagaacuuga

SEQ ID NO: 2232 - RNA, 17 nt, Artificial Sequence
  Synthetic
ucacuccacuguucaua

SEQ ID NO: 2233 - RNA, 17 nt, Artificial Sequence
  Synthetic
aaguugcagaugaggua

SEQ ID NO: 2234 - RNA, 17 nt, Artificial Sequence
  Synthetic
uggaucccuaugaacag

SEQ ID NO: 2235 - RNA, 17 nt, Artificial Sequence
  Synthetic
auggaaaguugcagaug

SEQ ID NO: 2236 - RNA, 17 nt, Artificial Sequence
  Synthetic
cuugaugguaaguacau

SEQ ID NO: 2237 - RNA, 17 nt, Artificial Sequence
  Synthetic
aucacuccacuguucau

SEQ ID NO: 2238 - RNA, 17 nt, Artificial Sequence
  Synthetic
auaucagccauuugugu

SEQ ID NO: 2239 - RNA, 20 nt, Artificial Sequence
  Synthetic
agaacuugaugguaaguaca

SEQ ID NO: 2240 - RNA, 20 nt, Artificial Sequence
  Synthetic
aguggagugaucaagaaaua

SEQ ID NO: 2241 - RNA, 20 nt, Artificial Sequence
  Synthetic
ugaucacuccacuguucaua

SEQ ID NO: 2242 - RNA, 20 nt, Artificial Sequence
  Synthetic
aauauggaaaguugcagaug

SEQ ID NO: 2243 - RNA, 20 nt, Artificial Sequence
  Synthetic
uugaucacuccacuguucau

SEQ ID NO: 2244 - RNA, 20 nt, Artificial Sequence
  Synthetic
guaacucauaccaacacaaa

SEQ ID NO: 2245 - RNA, 17 nt, Artificial Sequence
  Synthetic
acucauaccaacacaaa

SEQ ID NO: 2246 - RNA, 17 nt, Artificial Sequence
  Synthetic
cugaaaugauuuugaaa

SEQ ID NO: 2247 - RNA, 17 nt, Artificial Sequence
  Synthetic
acugaaaugauuuugaa

SEQ ID NO: 2248 - RNA, 17 nt, Artificial Sequence
  Synthetic
auuuuacaauacaauaa

SEQ ID NO: 2249 - RNA, 17 nt, Artificial Sequence
  Synthetic
uauuuuacaauacaaua

SEQ ID NO: 2250 - RNA, 17 nt, Artificial Sequence
  Synthetic
uugcuccagguauguua

SEQ ID NO: 2251 - RNA, 17 nt, Artificial Sequence
  Synthetic
aaaguauuuauuuuuuc

SEQ ID NO: 2252 - RNA, 17 nt, Artificial Sequence
  Synthetic
ugaaaugauuuugaaag

SEQ ID NO: 2253 - RNA, 17 nt, Artificial Sequence
  Synthetic
aacauuuagaaaaaagu

SEQ ID NO: 2254 - RNA, 20 nt, Artificial Sequence
  Synthetic
uaacugaaaugauuuugaaa

SEQ ID NO: 2255 - RNA, 20 nt, Artificial Sequence
  Synthetic
cuaacugaaaugauuuugaa

SEQ ID NO: 2256 - RNA, 20 nt, Artificial Sequence
  Synthetic
aauauuuuacaauacaauaa

SEQ ID NO: 2257 - RNA, 20 nt, Artificial Sequence
  Synthetic
uaaaauuugagagaacuuga

SEQ ID NO: 2258 - RNA, 20 nt, Artificial Sequence
  Synthetic
aaauauuuuacaauacaaua

SEQ ID NO: 2259 - RNA, 20 nt, Artificial Sequence
  Synthetic
auggaguacccuaacauacc

SEQ ID NO: 2260 - RNA, 20 nt, Artificial Sequence
  Synthetic
uagaaaguauuuauuuuuuc

SEQ ID NO: 2261 - RNA, 20 nt, Artificial Sequence
  Synthetic
aacugaaaugauuuugaaag

SEQ ID NO: 2262 - RNA, 20 nt, Artificial Sequence
  Synthetic
aguuggaucccuaugaacag

SEQ ID NO: 2263 - RNA, 20 nt, Artificial Sequence
  Synthetic
uggaacauuuagaaaaaagu

SEQ ID NO: 2264 - RNA, 18 nt, Artificial Sequence
  Synthetic
gaucacuccacuguucau

SEQ ID NO: 2265 - RNA, 18 nt, Artificial Sequence
  Synthetic
gugugcacaacuuuaaaa

SEQ ID NO: 2266 - RNA, 21 nt, Artificial Sequence
  Synthetic
gcuaacugaaaugauuuugaa

SEQ ID NO: 2267 - RNA, 24 nt, Artificial Sequence
  Synthetic
gcugcuaacugaaaugauuuugaa

SEQ ID NO: 2268 - RNA, 18 nt, Artificial Sequence
  Synthetic
gaacuugaugguaaguac

SEQ ID NO: 2269 - RNA, 20 nt, Artificial Sequence
  Synthetic
gagaacuugaugguaaguac

SEQ ID NO: 2270 - RNA, 22 nt, Artificial Sequence
  Synthetic
gagagaacuugaugguaaguac

SEQ ID NO: 2271 - RNA, 19 nt, Artificial Sequence
  Synthetic
ugaucacuccacuguucau

SEQ ID NO: 2272 - RNA, 21 nt, Artificial Sequence
  Synthetic
cuugaucacuccacuguucau

SEQ ID NO: 2273 - RNA, 22 nt, Artificial Sequence
  Synthetic
ucuugaucacuccacuguucau

SEQ ID NO: 2274 - RNA, 23 nt, Artificial Sequence
  Synthetic
uucuugaucacuccacuguucau

SEQ ID NO: 2275 - RNA, 24 nt, Artificial Sequence
  Synthetic
uuucuugaucacuccacuguucau

SEQ ID NO: 2276 - RNA, 19 nt, Artificial Sequence
  Synthetic
ugugugcacaacuuuaaaa

SEQ ID NO: 2277 - RNA, 22 nt, Artificial Sequence
  Synthetic
ugcuaacugaaaugauuuugaa

SEQ ID NO: 2278 - RNA, 23 nt, Artificial Sequence
  Synthetic
cugcuaacugaaaugauuuugaa

SEQ ID NO: 2279 - RNA, 19 nt, Artificial Sequence
  Synthetic
agaacuugaugguaaguac

SEQ ID NO: 2280 - RNA, 21 nt, Artificial Sequence
  Synthetic
agagaacuugaugguaaguac

SEQ ID NO: 2281 - RNA, 23 nt, Artificial Sequence
  Synthetic
ugagagaacuugaugguaaguac

SEQ ID NO: 2282 - RNA, 24 nt, Artificial Sequence
  Synthetic
uugagagaacuugaugguaaguac

SEQ ID NO: 2283 - RNA, 24 nt, Artificial Sequence
  Synthetic
gcuauaucagccauuuguguuggu

SEQ ID NO: 2284 - RNA, 24 nt, Artificial Sequence
  Synthetic
guaugugugugcacaacuuuaaaa

SEQ ID NO: 2285 - RNA, 18 nt, Artificial Sequence
  Synthetic
ggaacauuuagaaaaaag

SEQ ID NO: 2286 - RNA, 19 nt, Artificial Sequence
  Synthetic
guuggaucccuaugaacag

SEQ ID NO: 2287 - RNA, 18 nt, Artificial Sequence
  Synthetic
acaugcacacaaagugug

SEQ ID NO: 2288 - RNA, 19 nt, Artificial Sequence
  Synthetic
uacaugcacacaaagugug

SEQ ID NO: 2289 - RNA, 20 nt, Artificial Sequence
  Synthetic
auacaugcacacaaagugug

SEQ ID NO: 2290 - RNA, 21 nt, Artificial Sequence
  Synthetic
cauacaugcacacaaagugug

SEQ ID NO: 2291 - RNA, 22 nt, Artificial Sequence
  Synthetic
acauacaugcacacaaagugug

SEQ ID NO: 2292 - RNA, 23 nt, Artificial Sequence
  Synthetic
cacauacaugcacacaaagugug

SEQ ID NO: 2293 - RNA, 24 nt, Artificial Sequence
  Synthetic
acacauacaugcacacaaagugug

SEQ ID NO: 2294 - RNA, 18 nt, Artificial Sequence
  Synthetic
agaaaagaagaagaaagu

SEQ ID NO: 2295 - RNA, 19 nt, Artificial Sequence
  Synthetic
aagaaaagaagaagaaagu

SEQ ID NO: 2296 - RNA, 20 nt, Artificial Sequence
  Synthetic
aaagaaaagaagaagaaagu

SEQ ID NO: 2297 - RNA, 21 nt, Artificial Sequence
  Synthetic
aaaagaaaagaagaagaaagu

SEQ ID NO: 2298 - RNA, 22 nt, Artificial Sequence
  Synthetic
aaaaagaaaagaagaagaaagu

SEQ ID NO: 2299 - RNA, 23 nt, Artificial Sequence
  Synthetic
aaaaaagaaaagaagaagaaagu

SEQ ID NO: 2300 - RNA, 24 nt, Artificial Sequence
  Synthetic
caaaaaagaaaagaagaagaaagu

SEQ ID NO: 2301 - RNA, 18 nt, Artificial Sequence
  Synthetic
ucagccauuuguguuggu

SEQ ID NO: 2302 - RNA, 19 nt, Artificial Sequence
  Synthetic
aucagccauuuguguuggu

SEQ ID NO: 2303 - RNA, 20 nt, Artificial Sequence
  Synthetic
uaucagccauuuguguuggu

SEQ ID NO: 2304 - RNA, 21 nt, Artificial Sequence
  Synthetic
auaucagccauuuguguuggu

SEQ ID NO: 2305 - RNA, 22 nt, Artificial Sequence
  Synthetic
uauaucagccauuuguguuggu

SEQ ID NO: 2306 - RNA, 23 nt, Artificial Sequence
  Synthetic
cuauaucagccauuuguguuggu

SEQ ID NO: 2307 - RNA, 21 nt, Artificial Sequence
  Synthetic
ugugugugcacaacuuuaaaa

SEQ ID NO: 2308 - RNA, 22 nt, Artificial Sequence
  Synthetic
augugugugcacaacuuuaaaa

SEQ ID NO: 2309 - RNA, 23 nt, Artificial Sequence
  Synthetic
uaugugugugcacaacuuuaaaa

SEQ ID NO: 2310 - RNA, 18 nt, Artificial Sequence
  Synthetic
aacugaaaugauuuugaa

SEQ ID NO: 2311 - RNA, 19 nt, Artificial Sequence
  Synthetic
uaacugaaaugauuuugaa

SEQ ID NO: 2312 - RNA, 19 nt, Artificial Sequence
  Synthetic
uggaacauuuagaaaaaag

SEQ ID NO: 2313 - RNA, 20 nt, Artificial Sequence
  Synthetic
cuggaacauuuagaaaaaag

SEQ ID NO: 2314 - RNA, 21 nt, Artificial Sequence
  Synthetic
ucuggaacauuuagaaaaaag

SEQ ID NO: 2315 - RNA, 22 nt, Artificial Sequence
  Synthetic
uucuggaacauuuagaaaaaag

SEQ ID NO: 2316 - RNA, 23 nt, Artificial Sequence
  Synthetic
uuucuggaacauuuagaaaaaag

SEQ ID NO: 2317 - RNA, 24 nt, Artificial Sequence
  Synthetic
uuuucuggaacauuuagaaaaaag

SEQ ID NO: 2318 - RNA, 18 nt, Artificial Sequence
  Synthetic
uuggaucccuaugaacag

SEQ ID NO: 2319 - RNA, 21 nt, Artificial Sequence
  Synthetic
aaguuggaucccuaugaacag

SEQ ID NO: 2320 - RNA, 22 nt, Artificial Sequence
  Synthetic
aaaguuggaucccuaugaacag

SEQ ID NO: 2321 - RNA, 23 nt, Artificial Sequence
  Synthetic
aaaaguuggaucccuaugaacag

SEQ ID NO: 2322 - RNA, 24 nt, Artificial Sequence
  Synthetic
aaaaaguuggaucccuaugaacag

SEQ ID NO: 2323 - RNA, 18 nt, Artificial Sequence
  Synthetic
auacuuucuauagcaaaa

SEQ ID NO: 2324 - RNA, 19 nt, Artificial Sequence
  Synthetic
aauacuuucuauagcaaaa

SEQ ID NO: 2325 - RNA, 20 nt, Artificial Sequence
  Synthetic
aaauacuuucuauagcaaaa

SEQ ID NO: 2326 - RNA, 21 nt, Artificial Sequence
  Synthetic
uaaauacuuucuauagcaaaa

SEQ ID NO: 2327 - RNA, 22 nt, Artificial Sequence
  Synthetic
auaaauacuuucuauagcaaaa

SEQ ID NO: 2328 - RNA, 23 nt, Artificial Sequence
  Synthetic
aauaaauacuuucuauagcaaaa

SEQ ID NO: 2329 - RNA, 24 nt, Artificial Sequence
  Synthetic
aaauaaauacuuucuauagcaaaa

SEQ ID NO: 2330 - RNA, 18 nt, Artificial Sequence
  Synthetic
uucuauagcaaaaaagaa

SEQ ID NO: 2331 - RNA, 19 nt, Artificial Sequence
  Synthetic
uuucuauagcaaaaaagaa

SEQ ID NO: 2332 - RNA, 20 nt, Artificial Sequence
  Synthetic
cuuucuauagcaaaaaagaa

SEQ ID NO: 2333 - RNA, 21 nt, Artificial Sequence
  Synthetic
acuuucuauagcaaaaaagaa

SEQ ID NO: 2334 - RNA, 22 nt, Artificial Sequence
  Synthetic
uacuuucuauagcaaaaaagaa

SEQ ID NO: 2335 - RNA, 23 nt, Artificial Sequence
  Synthetic
auacuuucuauagcaaaaaagaa

SEQ ID NO: 2336 - RNA, 24 nt, Artificial Sequence
  Synthetic
aauacuuucuauagcaaaaaagaa

SEQ ID NO: 2337 - RNA, 18 nt, Artificial Sequence
  Synthetic
ugaucacuccacuguuca

SEQ ID NO: 2338 - RNA, 19 nt, Artificial Sequence
  Synthetic
uugaucacuccacuguuca

SEQ ID NO: 2339 - RNA, 20 nt, Artificial Sequence
  Synthetic
cuugaucacuccacuguuca

SEQ ID NO: 2340 - RNA, 21 nt, Artificial Sequence
  Synthetic
ucuugaucacuccacuguuca

SEQ ID NO: 2341 - RNA, 22 nt, Artificial Sequence
  Synthetic
uucuugaucacuccacuguuca

SEQ ID NO: 2342 - RNA, 23 nt, Artificial Sequence
  Synthetic
uuucuugaucacuccacuguuca

SEQ ID NO: 2343 - RNA, 24 nt, Artificial Sequence
  Synthetic
auuucuugaucacuccacuguuca

SEQ ID NO: 2344 - RNA, 18 nt, Artificial Sequence
  Synthetic
acuuuuuucuaaauguuc

SEQ ID NO: 2345 - RNA, 19 nt, Artificial Sequence
  Synthetic
aacuuuuuucuaaauguuc

SEQ ID NO: 2346 - RNA, 20 nt, Artificial Sequence
  Synthetic
caacuuuuuucuaaauguuc

SEQ ID NO: 2347 - RNA, 21 nt, Artificial Sequence
  Synthetic
ccaacuuuuuucuaaauguuc

SEQ ID NO: 2348 - RNA, 22 nt, Artificial Sequence
  Synthetic
uccaacuuuuuucuaaauguuc

SEQ ID NO: 2349 - RNA, 23 nt, Artificial Sequence
  Synthetic
auccaacuuuuuucuaaauguuc

SEQ ID NO: 2350 - RNA, 24 nt, Artificial Sequence
  Synthetic
gauccaacuuuuuucuaaauguuc

SEQ ID NO: 2351 - RNA, 18 nt, Artificial Sequence
  Synthetic
uauagcaaaaaagaaaag

SEQ ID NO: 2352 - RNA, 19 nt, Artificial Sequence
  Synthetic
cuauagcaaaaaagaaaag

SEQ ID NO: 2353 - RNA, 20 nt, Artificial Sequence
  Synthetic
ucuauagcaaaaaagaaaag

SEQ ID NO: 2354 - RNA, 21 nt, Artificial Sequence
  Synthetic
uucuauagcaaaaaagaaaag

SEQ ID NO: 2355 - RNA, 22 nt, Artificial Sequence
  Synthetic
uuucuauagcaaaaaagaaaag

SEQ ID NO: 2356 - RNA, 23 nt, Artificial Sequence
  Synthetic
cuuucuauagcaaaaaagaaaag

SEQ ID NO: 2357 - RNA, 24 nt, Artificial Sequence
  Synthetic
acuuucuauagcaaaaaagaaaag

SEQ ID NO: 2358 - RNA, 18 nt, Artificial Sequence
  Synthetic
auuguaaaauauuucaag

SEQ ID NO: 2359 - RNA, 19 nt, Artificial Sequence
  Synthetic
uauuguaaaauauuucaag

SEQ ID NO: 2360 - RNA, 20 nt, Artificial Sequence
  Synthetic
guauuguaaaauauuucaag

SEQ ID NO: 2361 - RNA, 21 nt, Artificial Sequence
  Synthetic
uguauuguaaaauauuucaag

SEQ ID NO: 2362 - RNA, 22 nt, Artificial Sequence
  Synthetic
uuguauuguaaaauauuucaag

SEQ ID NO: 2363 - RNA, 23 nt, Artificial Sequence
  Synthetic
auuguauuguaaaauauuucaag

SEQ ID NO: 2364 - RNA, 24 nt, Artificial Sequence
  Synthetic
uauuguauuguaaaauauuucaag

SEQ ID NO: 2365 - RNA, 18 nt, Artificial Sequence
  Synthetic
agcaaaaaagaaaagaag

SEQ ID NO: 2366 - RNA, 19 nt, Artificial Sequence
  Synthetic
uagcaaaaaagaaaagaag

SEQ ID NO: 2367 - RNA, 20 nt, Artificial Sequence
  Synthetic
auagcaaaaaagaaaagaag

SEQ ID NO: 2368 - RNA, 21 nt, Artificial Sequence
  Synthetic
uauagcaaaaaagaaaagaag

SEQ ID NO: 2369 - RNA, 22 nt, Artificial Sequence
  Synthetic
cuauagcaaaaaagaaaagaag

SEQ ID NO: 2370 - RNA, 23 nt, Artificial Sequence
  Synthetic
ucuauagcaaaaaagaaaagaag

SEQ ID NO: 2371 - RNA, 24 nt, Artificial Sequence
  Synthetic
uucuauagcaaaaaagaaaagaag

SEQ ID NO: 2372 - RNA, 18 nt, Artificial Sequence
  Synthetic
gaaaaauuauuuuaaaau

SEQ ID NO: 2373 - RNA, 19 nt, Artificial Sequence
  Synthetic
agaaaaauuauuuuaaaau

SEQ ID NO: 2374 - RNA, 20 nt, Artificial Sequence
  Synthetic
uagaaaaauuauuuuaaaau

SEQ ID NO: 2375 - RNA, 21 nt, Artificial Sequence
  Synthetic
guagaaaaauuauuuuaaaau

SEQ ID NO: 2376 - RNA, 22 nt, Artificial Sequence
  Synthetic
aguagaaaaauuauuuuaaaau

SEQ ID NO: 2377 - RNA, 23 nt, Artificial Sequence
  Synthetic
aaguagaaaaauuauuuuaaaau

SEQ ID NO: 2378 - RNA, 24 nt, Artificial Sequence
  Synthetic
caaguagaaaaauuauuuuaaaau

SEQ ID NO: 2379 - RNA, 18 nt, Artificial Sequence
  Synthetic
ugugugcacaacuuuaaa

SEQ ID NO: 2380 - RNA, 19 nt, Artificial Sequence
  Synthetic
gugugugcacaacuuuaaa

SEQ ID NO: 2381 - RNA, 20 nt, Artificial Sequence
  Synthetic
ugugugugcacaacuuuaaa

SEQ ID NO: 2382 - RNA, 21 nt, Artificial Sequence
  Synthetic
augugugugcacaacuuuaaa

SEQ ID NO: 2383 - RNA, 22 nt, Artificial Sequence
  Synthetic
uaugugugugcacaacuuuaaa

SEQ ID NO: 2384 - RNA, 23 nt, Artificial Sequence
  Synthetic
guaugugugugcacaacuuuaaa

SEQ ID NO: 2385 - RNA, 24 nt, Artificial Sequence
  Synthetic
uguaugugugugcacaacuuuaaa

SEQ ID NO: 2386 - RNA, 18 nt, Artificial Sequence
  Synthetic
uauuuuacaauacaauaa

SEQ ID NO: 2387 - RNA, 19 nt, Artificial Sequence
  Synthetic
auauuuuacaauacaauaa

SEQ ID NO: 2388 - RNA, 21 nt, Artificial Sequence
  Synthetic
aaauauuuuacaauacaauaa

SEQ ID NO: 2389 - RNA, 22 nt, Artificial Sequence
  Synthetic
gaaauauuuuacaauacaauaa

SEQ ID NO: 2390 - RNA, 23 nt, Artificial Sequence
  Synthetic
ugaaauauuuuacaauacaauaa

SEQ ID NO: 2391 - RNA, 24 nt, Artificial Sequence
  Synthetic
uugaaauauuuuacaauacaauaa

SEQ ID NO: 2392 - RNA, 18 nt, Artificial Sequence
  Synthetic
augagguaaggcugcuaa

SEQ ID NO: 2393 - RNA, 19 nt, Artificial Sequence
  Synthetic
gaugagguaaggcugcuaa

SEQ ID NO: 2394 - RNA, 20 nt, Artificial Sequence
  Synthetic
agaugagguaaggcugcuaa

SEQ ID NO: 2395 - RNA, 21 nt, Artificial Sequence
  Synthetic
cagaugagguaaggcugcuaa

SEQ ID NO: 2396 - RNA, 22 nt, Artificial Sequence
  Synthetic
gcagaugagguaaggcugcuaa

SEQ ID NO: 2397 - RNA, 23 nt, Artificial Sequence
  Synthetic
ugcagaugagguaaggcugcuaa

SEQ ID NO: 2398 - RNA, 24 nt, Artificial Sequence
  Synthetic
uugcagaugagguaaggcugcuaa

SEQ ID NO: 2399 - RNA, 18 nt, Artificial Sequence
  Synthetic
guuggaucccuaugaaca

SEQ ID NO: 2400 - RNA, 19 nt, Artificial Sequence
  Synthetic
aguuggaucccuaugaaca

SEQ ID NO: 2401 - RNA, 20 nt, Artificial Sequence
  Synthetic
aaguuggaucccuaugaaca

SEQ ID NO: 2402 - RNA, 21 nt, Artificial Sequence
  Synthetic
aaaguuggaucccuaugaaca

SEQ ID NO: 2403 - RNA, 22 nt, Artificial Sequence
  Synthetic
aaaaguuggaucccuaugaaca

SEQ ID NO: 2404 - RNA, 23 nt, Artificial Sequence
  Synthetic
aaaaaguuggaucccuaugaaca

SEQ ID NO: 2405 - RNA, 24 nt, Artificial Sequence
  Synthetic
aaaaaaguuggaucccuaugaaca

SEQ ID NO: 2406 - RNA, 18 nt, Artificial Sequence
  Synthetic
uaaaauauuaaaauuuga

SEQ ID NO: 2407 - RNA, 19 nt, Artificial Sequence
  Synthetic
auaaaauauuaaaauuuga

SEQ ID NO: 2408 - RNA, 20 nt, Artificial Sequence
  Synthetic
gauaaaauauuaaaauuuga

SEQ ID NO: 2409 - RNA, 21 nt, Artificial Sequence
  Synthetic
ugauaaaauauuaaaauuuga

SEQ ID NO: 2410 - RNA, 22 nt, Artificial Sequence
  Synthetic
augauaaaauauuaaaauuuga

SEQ ID NO: 2411 - RNA, 23 nt, Artificial Sequence
  Synthetic
caugauaaaauauuaaaauuuga

SEQ ID NO: 2412 - RNA, 24 nt, Artificial Sequence
  Synthetic
acaugauaaaauauuaaaauuuga

SEQ ID NO: 2413 - RNA, 18 nt, Artificial Sequence
  Synthetic
uaacugaaaugauuuuga

SEQ ID NO: 2414 - RNA, 19 nt, Artificial Sequence
  Synthetic
cuaacugaaaugauuuuga

SEQ ID NO: 2415 - RNA, 20 nt, Artificial Sequence
  Synthetic
gcuaacugaaaugauuuuga

SEQ ID NO: 2416 - RNA, 21 nt, Artificial Sequence
  Synthetic
ugcuaacugaaaugauuuuga

SEQ ID NO: 2417 - RNA, 22 nt, Artificial Sequence
  Synthetic
cugcuaacugaaaugauuuuga

SEQ ID NO: 2418 - RNA, 23 nt, Artificial Sequence
  Synthetic
gcugcuaacugaaaugauuuuga

SEQ ID NO: 2419 - RNA, 24 nt, Artificial Sequence
  Synthetic
ggcugcuaacugaaaugauuuuga

SEQ ID NO: 2420 - RNA, 18 nt, Artificial Sequence
  Synthetic
uggagugaucaagaaaua

SEQ ID NO: 2421 - RNA, 19 nt, Artificial Sequence
  Synthetic
guggagugaucaagaaaua

SEQ ID NO: 2422 - RNA, 21 nt, Artificial Sequence
  Synthetic
caguggagugaucaagaaaua

SEQ ID NO: 2423 - RNA, 22 nt, Artificial Sequence
  Synthetic
acaguggagugaucaagaaaua

SEQ ID NO: 2424 - RNA, 23 nt, Artificial Sequence
  Synthetic
aacaguggagugaucaagaaaua

SEQ ID NO: 2425 - RNA, 24 nt, Artificial Sequence
  Synthetic
gaacaguggagugaucaagaaaua

SEQ ID NO: 2426 - RNA, 18 nt, Artificial Sequence
  Synthetic
auauuuuacaauacaaua

SEQ ID NO: 2427 - RNA, 19 nt, Artificial Sequence
  Synthetic
aauauuuuacaauacaaua

SEQ ID NO: 2428 - RNA, 21 nt, Artificial Sequence
  Synthetic
gaaauauuuuacaauacaaua

SEQ ID NO: 2429 - RNA, 22 nt, Artificial Sequence
  Synthetic
ugaaauauuuuacaauacaaua

SEQ ID NO: 2430 - RNA, 23 nt, Artificial Sequence
  Synthetic
uugaaauauuuuacaauacaaua

SEQ ID NO: 2431 - RNA, 24 nt, Artificial Sequence
  Synthetic
cuugaaauauuuuacaauacaaua

SEQ ID NO: 2432 - RNA, 18 nt, Artificial Sequence
  Synthetic
uucuuuucuuuuuugcua

SEQ ID NO: 2433 - RNA, 19 nt, Artificial Sequence
  Synthetic
cuucuuuucuuuuuugcua

SEQ ID NO: 2434 - RNA, 20 nt, Artificial Sequence
  Synthetic
ucuucuuuucuuuuuugcua

SEQ ID NO: 2435 - RNA, 21 nt, Artificial Sequence
  Synthetic
uucuucuuuucuuuuuugcua

SEQ ID NO: 2436 - RNA, 22 nt, Artificial Sequence
  Synthetic
cuucuucuuuucuuuuuugcua

SEQ ID NO: 2437 - RNA, 23 nt, Artificial Sequence
  Synthetic
ucuucuucuuuucuuuuuugcua

SEQ ID NO: 2438 - RNA, 24 nt, Artificial Sequence
  Synthetic
uucuucuucuuuucuuuuuugcua

SEQ ID NO: 2439 - RNA, 18 nt, Artificial Sequence
  Synthetic
uggaguacccuaacauac

SEQ ID NO: 2440 - RNA, 19 nt, Artificial Sequence
  Synthetic
auggaguacccuaacauac

SEQ ID NO: 2441 - RNA, 20 nt, Artificial Sequence
  Synthetic
aauggaguacccuaacauac

SEQ ID NO: 2442 - RNA, 21 nt, Artificial Sequence
  Synthetic
aaauggaguacccuaacauac

SEQ ID NO: 2443 - RNA, 22 nt, Artificial Sequence
  Synthetic
aaaauggaguacccuaacauac

SEQ ID NO: 2444 - RNA, 23 nt, Artificial Sequence
  Synthetic
uaaaauggaguacccuaacauac

SEQ ID NO: 2445 - RNA, 24 nt, Artificial Sequence
  Synthetic
uuaaaauggaguacccuaacauac

SEQ ID NO: 2446 - RNA, 18 nt, Artificial Sequence
  Synthetic
uuaaaauaauuuuucuac

SEQ ID NO: 2447 - RNA, 19 nt, Artificial Sequence
  Synthetic
uuuaaaauaauuuuucuac

SEQ ID NO: 2448 - RNA, 20 nt, Artificial Sequence
  Synthetic
uuuuaaaauaauuuuucuac

SEQ ID NO: 2449 - RNA, 21 nt, Artificial Sequence
  Synthetic
auuuuaaaauaauuuuucuac

SEQ ID NO: 2450 - RNA, 22 nt, Artificial Sequence
  Synthetic
uauuuuaaaauaauuuuucuac

SEQ ID NO: 2451 - RNA, 23 nt, Artificial Sequence
  Synthetic
uuauuuuaaaauaauuuuucuac

SEQ ID NO: 2452 - RNA, 24 nt, Artificial Sequence
  Synthetic
cuuauuuuaaaauaauuuuucuac

SEQ ID NO: 2453 - RNA, 18 nt, Artificial Sequence
  Synthetic
ggaguacccuaacauacc

SEQ ID NO: 2454 - RNA, 19 nt, Artificial Sequence
  Synthetic
uggaguacccuaacauacc

SEQ ID NO: 2455 - RNA, 21 nt, Artificial Sequence
  Synthetic
aauggaguacccuaacauacc

SEQ ID NO: 2456 - RNA, 22 nt, Artificial Sequence
  Synthetic
aaauggaguacccuaacauacc

SEQ ID NO: 2457 - RNA, 23 nt, Artificial Sequence
  Synthetic
aaaauggaguacccuaacauacc

SEQ ID NO: 2458 - RNA, 24 nt, Artificial Sequence
  Synthetic
uaaaauggaguacccuaacauacc

SEQ ID NO: 2459 - RNA, 18 nt, Artificial Sequence
  Synthetic
augaacaguggagugauc

SEQ ID NO: 2460 - RNA, 19 nt, Artificial Sequence
  Synthetic
uaugaacaguggagugauc

SEQ ID NO: 2461 - RNA, 20 nt, Artificial Sequence
  Synthetic
cuaugaacaguggagugauc

SEQ ID NO: 2462 - RNA, 21 nt, Artificial Sequence
  Synthetic
ccuaugaacaguggagugauc

SEQ ID NO: 2463 - RNA, 22 nt, Artificial Sequence
  Synthetic
cccuaugaacaguggagugauc

SEQ ID NO: 2464 - RNA, 23 nt, Artificial Sequence
  Synthetic
ucccuaugaacaguggagugauc

SEQ ID NO: 2465 - RNA, 24 nt, Artificial Sequence
  Synthetic
aucccuaugaacaguggagugauc

SEQ ID NO: 2466 - RNA, 18 nt, Artificial Sequence
  Synthetic
gaaaguauuuauuuuuuc

SEQ ID NO: 2467 - RNA, 19 nt, Artificial Sequence
  Synthetic
agaaaguauuuauuuuuuc

SEQ ID NO: 2468 - RNA, 21 nt, Artificial Sequence
  Synthetic
auagaaaguauuuauuuuuuc

SEQ ID NO: 2469 - RNA, 22 nt, Artificial Sequence
  Synthetic
uauagaaaguauuuauuuuuuc

SEQ ID NO: 2470 - RNA, 23 nt, Artificial Sequence
  Synthetic
cuauagaaaguauuuauuuuuuc

SEQ ID NO: 2471 - RNA, 24 nt, Artificial Sequence
  Synthetic
gcuauagaaaguauuuauuuuuuc

SEQ ID NO: 2472 - RNA, 18 nt, Artificial Sequence
  Synthetic
aaauauggaaaguugcag

SEQ ID NO: 2473 - RNA, 19 nt, Artificial Sequence
  Synthetic
gaaauauggaaaguugcag

SEQ ID NO: 2474 - RNA, 20 nt, Artificial Sequence
  Synthetic
agaaauauggaaaguugcag

SEQ ID NO: 2475 - RNA, 21 nt, Artificial Sequence
  Synthetic
aagaaauauggaaaguugcag

SEQ ID NO: 2476 - RNA, 22 nt, Artificial Sequence
  Synthetic
caagaaauauggaaaguugcag

SEQ ID NO: 2477 - RNA, 23 nt, Artificial Sequence
  Synthetic
ucaagaaauauggaaaguugcag

SEQ ID NO: 2478 - RNA, 24 nt, Artificial Sequence
  Synthetic
aucaagaaauauggaaaguugcag

SEQ ID NO: 2479 - RNA, 18 nt, Artificial Sequence
  Synthetic
augauaaaauauuaaaau

SEQ ID NO: 2480 - RNA, 19 nt, Artificial Sequence
  Synthetic
caugauaaaauauuaaaau

SEQ ID NO: 2481 - RNA, 20 nt, Artificial Sequence
  Synthetic
acaugauaaaauauuaaaau

SEQ ID NO: 2482 - RNA, 18 nt, Artificial Sequence
  Synthetic
guggagugaucaagaaau

SEQ ID NO: 2483 - RNA, 19 nt, Artificial Sequence
  Synthetic
aguggagugaucaagaaau

SEQ ID NO: 2484 - RNA, 20 nt, Artificial Sequence
  Synthetic
caguggagugaucaagaaau

SEQ ID NO: 2485 - RNA, 21 nt, Artificial Sequence
  Synthetic
acaguggagugaucaagaaau

SEQ ID NO: 2486 - RNA, 22 nt, Artificial Sequence
  Synthetic
aacaguggagugaucaagaaau

SEQ ID NO: 2487 - RNA, 23 nt, Artificial Sequence
  Synthetic
gaacaguggagugaucaagaaau

SEQ ID NO: 2488 - RNA, 24 nt, Artificial Sequence
  Synthetic
ugaacaguggagugaucaagaaau

SEQ ID NO: 2489 - RNA, 18 nt, Artificial Sequence
  Synthetic
aauauuuuacaauacaau

SEQ ID NO: 2490 - RNA, 19 nt, Artificial Sequence
  Synthetic
aaauauuuuacaauacaau

SEQ ID NO: 2491 - RNA, 20 nt, Artificial Sequence
  Synthetic
gaaauauuuuacaauacaau

SEQ ID NO: 2492 - RNA, 21 nt, Artificial Sequence
  Synthetic
ugaaauauuuuacaauacaau

SEQ ID NO: 2493 - RNA, 22 nt, Artificial Sequence
  Synthetic
uugaaauauuuuacaauacaau

SEQ ID NO: 2494 - RNA, 23 nt, Artificial Sequence
  Synthetic
cuugaaauauuuuacaauacaau

SEQ ID NO: 2495 - RNA, 24 nt, Artificial Sequence
  Synthetic
acuugaaauauuuuacaauacaau

SEQ ID NO: 2496 - RNA, 18 nt, Artificial Sequence
  Synthetic
gaaaaaaguuggaucccu

SEQ ID NO: 2497 - RNA, 19 nt, Artificial Sequence
  Synthetic
agaaaaaaguuggaucccu

SEQ ID NO: 2498 - RNA, 20 nt, Artificial Sequence
  Synthetic
uagaaaaaaguuggaucccu

SEQ ID NO: 2499 - RNA, 21 nt, Artificial Sequence
  Synthetic
uuagaaaaaaguuggaucccu

SEQ ID NO: 2500 - RNA, 22 nt, Artificial Sequence
  Synthetic
uuuagaaaaaaguuggaucccu

SEQ ID NO: 2501 - RNA, 23 nt, Artificial Sequence
  Synthetic
auuuagaaaaaaguuggaucccu

SEQ ID NO: 2502 - RNA, 24 nt, Artificial Sequence
  Synthetic
cauuuagaaaaaaguuggaucccu

SEQ ID NO: 2503 - RNA, 18 nt, Artificial Sequence
  Synthetic
uauuuuuucuggaacauu

SEQ ID NO: 2504 - RNA, 19 nt, Artificial Sequence
  Synthetic
uuauuuuuucuggaacauu

SEQ ID NO: 2505 - RNA, 20 nt, Artificial Sequence
  Synthetic
uuuauuuuuucuggaacauu

SEQ ID NO: 2506 - RNA, 21 nt, Artificial Sequence
  Synthetic
auuuauuuuuucuggaacauu

SEQ ID NO: 2507 - RNA, 22 nt, Artificial Sequence
  Synthetic
uauuuauuuuuucuggaacauu

SEQ ID NO: 2508 - RNA, 23 nt, Artificial Sequence
  Synthetic
guauuuauuuuuucuggaacauu

SEQ ID NO: 2509 - RNA, 24 nt, Artificial Sequence
  Synthetic
aguauuuauuuuuucuggaacauu

SEQ ID NO: 2510 - RNA, 18 nt, Artificial Sequence
  Synthetic
cugcuaacugaaaugauu

SEQ ID NO: 2511 - RNA, 19 nt, Artificial Sequence
  Synthetic
gcugcuaacugaaaugauu

SEQ ID NO: 2512 - RNA, 20 nt, Artificial Sequence
  Synthetic
ggcugcuaacugaaaugauu

SEQ ID NO: 2513 - RNA, 21 nt, Artificial Sequence
  Synthetic
aggcugcuaacugaaaugauu

SEQ ID NO: 2514 - RNA, 22 nt, Artificial Sequence
  Synthetic
aaggcugcuaacugaaaugauu

SEQ ID NO: 2515 - RNA, 23 nt, Artificial Sequence
  Synthetic
uaaggcugcuaacugaaaugauu

SEQ ID NO: 2516 - RNA, 24 nt, Artificial Sequence
  Synthetic
guaaggcugcuaacugaaaugauu

SEQ ID NO: 2517 - RNA, 18 nt, Artificial Sequence
  Synthetic
gauaaaauauuaaaauuu

SEQ ID NO: 2518 - RNA, 19 nt, Artificial Sequence
  Synthetic
ugauaaaauauuaaaauuu

SEQ ID NO: 2519 - RNA, 20 nt, Artificial Sequence
  Synthetic
augauaaaauauuaaaauuu

SEQ ID NO: 2520 - RNA, 18 nt, Artificial Sequence
  Synthetic
agaaaguauuuauuuuuu

SEQ ID NO: 2521 - RNA, 19 nt, Artificial Sequence
  Synthetic
uagaaaguauuuauuuuuu

SEQ ID NO: 2522 - RNA, 20 nt, Artificial Sequence
  Synthetic
auagaaaguauuuauuuuuu

SEQ ID NO: 2523 - RNA, 21 nt, Artificial Sequence
  Synthetic
uauagaaaguauuuauuuuuu

SEQ ID NO: 2524 - RNA, 22 nt, Artificial Sequence
  Synthetic
cuauagaaaguauuuauuuuuu

SEQ ID NO: 2525 - RNA, 23 nt, Artificial Sequence
  Synthetic
gcuauagaaaguauuuauuuuuu

SEQ ID NO: 2526 - RNA, 24 nt, Artificial Sequence
  Synthetic
ugcuauagaaaguauuuauuuuuu

SEQ ID NO: 2527 - RNA, 17 nt, Artificial Sequence
  Synthetic
gguaaggcugcuaacug

SEQ ID NO: 2528 - RNA, 20 nt, Artificial Sequence
  Synthetic
ugagguaaggcugcuaacug

SEQ ID NO: 2529 - RNA, 17 nt, Artificial Sequence
  Synthetic
gugaugaaggccaaaaa

SEQ ID NO: 2530 - RNA, 17 nt, Artificial Sequence
  Synthetic
ggugacuuccuacaaaa

SEQ ID NO: 2531 - RNA, 17 nt, Artificial Sequence
  Synthetic
gccauggggccugugca

SEQ ID NO: 2532 - RNA, 17 nt, Artificial Sequence
  Synthetic
gcauuccaaugugauga

SEQ ID NO: 2533 - RNA, 17 nt, Artificial Sequence
  Synthetic
guaauacuuccuugcac

SEQ ID NO: 2534 - RNA, 17 nt, Artificial Sequence
  Synthetic
gugacuuccuacaaaag

SEQ ID NO: 2535 - RNA, 17 nt, Artificial Sequence
  Synthetic
gccuucucuuuauugug

SEQ ID NO: 2536 - RNA, 17 nt, Artificial Sequence
  Synthetic
gcgauuuaucuaggcau

SEQ ID NO: 2537 - RNA, 17 nt, Artificial Sequence
  Synthetic
guacagccucucuuacu

SEQ ID NO: 2538 - RNA, 17 nt, Artificial Sequence
  Synthetic
gaaggccaaaaauggcu

SEQ ID NO: 2539 - RNA, 17 nt, Artificial Sequence
  Synthetic
gagaggcuguacugcuu

SEQ ID NO: 2540 - RNA, 20 nt, Artificial Sequence
  Synthetic
gauacagaauauaugugcca

SEQ ID NO: 2541 - RNA, 20 nt, Artificial Sequence
  Synthetic
gucuuguguugaaauucuca

SEQ ID NO: 2542 - RNA, 20 nt, Artificial Sequence
  Synthetic
guguccucacaauaaagaga

SEQ ID NO: 2543 - RNA, 20 nt, Artificial Sequence
  Synthetic
gcaguacagccucucuuacu

SEQ ID NO: 2544 - RNA, 20 nt, Artificial Sequence
  Synthetic
gaugaaggccaaaaauggcu

SEQ ID NO: 2545 - RNA, 20 nt, Artificial Sequence
  Synthetic
ggccaaaaauggcugggugu

SEQ ID NO: 2546 - RNA, 17 nt, Artificial Sequence
  Synthetic
uggugacuuccuacaaa

SEQ ID NO: 2547 - RNA, 17 nt, Artificial Sequence
  Synthetic
cuaugacccggauaaca

SEQ ID NO: 2548 - RNA, 17 nt, Artificial Sequence
  Synthetic
uuguguugaaauucuca

SEQ ID NO: 2549 - RNA, 17 nt, Artificial Sequence
  Synthetic
uaguuugauuuauaaga

SEQ ID NO: 2550 - RNA, 17 nt, Artificial Sequence
  Synthetic
uccucacaauaaagaga

SEQ ID NO: 2551 - RNA, 17 nt, Artificial Sequence
  Synthetic
aguacagccucucuuac

SEQ ID NO: 2552 - RNA, 17 nt, Artificial Sequence
  Synthetic
cauagcuuccuaugacc

SEQ ID NO: 2553 - RNA, 17 nt, Artificial Sequence
  Synthetic
ugaaggccaaaaauggc

SEQ ID NO: 2554 - RNA, 17 nt, Artificial Sequence
  Synthetic
uguuccuccuuguuauc

SEQ ID NO: 2555 - RNA, 17 nt, Artificial Sequence
  Synthetic
cuuguguugaaauucuc

SEQ ID NO: 2556 - RNA, 17 nt, Artificial Sequence
  Synthetic
auucuucccaguaagag

SEQ ID NO: 2557 - RNA, 17 nt, Artificial Sequence
  Synthetic
agacuuuucaucuuuag

SEQ ID NO: 2558 - RNA, 17 nt, Artificial Sequence
  Synthetic
ugacccggauaacaagg

SEQ ID NO: 2559 - RNA, 17 nt, Artificial Sequence
  Synthetic
uuuggccuucaucacau

SEQ ID NO: 2560 - RNA, 17 nt, Artificial Sequence
  Synthetic
cagaauauaugugccau

SEQ ID NO: 2561 - RNA, 17 nt, Artificial Sequence
  Synthetic
cuuguuauccgggucau

SEQ ID NO: 2562 - RNA, 17 nt, Artificial Sequence
  Synthetic
ucuaucgcgauuuaucu

SEQ ID NO: 2563 - RNA, 17 nt, Artificial Sequence
  Synthetic
caaaaauggcugggugu

SEQ ID NO: 2564 - RNA, 17 nt, Artificial Sequence
  Synthetic
cuacacccagccauuuu

SEQ ID NO: 2565 - RNA, 20 nt, Artificial Sequence
  Synthetic
aaugugaugaaggccaaaaa

SEQ ID NO: 2566 - RNA, 20 nt, Artificial Sequence
  Synthetic
uuuggugacuuccuacaaaa

SEQ ID NO: 2567 - RNA, 20 nt, Artificial Sequence
  Synthetic
cuuuggugacuuccuacaaa

SEQ ID NO: 2568 - RNA, 20 nt, Artificial Sequence
  Synthetic
uuccuaugacccggauaaca

SEQ ID NO: 2569 - RNA, 20 nt, Artificial Sequence
  Synthetic
acuuccuugcacaggcccca

SEQ ID NO: 2570 - RNA, 20 nt, Artificial Sequence
  Synthetic
ugugccauggggccugugca

SEQ ID NO: 2571 - RNA, 20 nt, Artificial Sequence
  Synthetic
ucugcauuccaaugugauga

SEQ ID NO: 2572 - RNA, 20 nt, Artificial Sequence
  Synthetic
aagguaauacuuccuugcac

SEQ ID NO: 2573 - RNA, 20 nt, Artificial Sequence
  Synthetic
agcaguacagccucucuuac

SEQ ID NO: 2574 - RNA, 20 nt, Artificial Sequence
  Synthetic
aaucauagcuuccuaugacc

SEQ ID NO: 2575 - RNA, 20 nt, Artificial Sequence
  Synthetic
ugaugaaggccaaaaauggc

SEQ ID NO: 2576 - RNA, 20 nt, Artificial Sequence
  Synthetic
agucuuguguugaaauucuc

SEQ ID NO: 2577 - RNA, 20 nt, Artificial Sequence
  Synthetic
uuggugacuuccuacaaaag

SEQ ID NO: 2578 - RNA, 20 nt, Artificial Sequence
  Synthetic
augauucuucccaguaagag

SEQ ID NO: 2579 - RNA, 20 nt, Artificial Sequence
  Synthetic
cuuaaaaugaguuuauauag

SEQ ID NO: 2580 - RNA, 20 nt, Artificial Sequence
  Synthetic
acaagacuuuucaucuuuag

SEQ ID NO: 2581 - RNA, 20 nt, Artificial Sequence
  Synthetic
cuaugacccggauaacaagg

SEQ ID NO: 2582 - RNA, 20 nt, Artificial Sequence
  Synthetic
uacagaauauaugugccaug

SEQ ID NO: 2583 - RNA, 20 nt, Artificial Sequence
  Synthetic
uaugccuucucuuuauugug

SEQ ID NO: 2584 - RNA, 20 nt, Artificial Sequence
  Synthetic
auuuuuggccuucaucacau

SEQ ID NO: 2585 - RNA, 20 nt, Artificial Sequence
  Synthetic
auacagaauauaugugccau

SEQ ID NO: 2586 - RNA, 20 nt, Artificial Sequence
  Synthetic
aucgcgauuuaucuaggcau

SEQ ID NO: 2587 - RNA, 20 nt, Artificial Sequence
  Synthetic
cuccuuguuauccgggucau

SEQ ID NO: 2588 - RNA, 20 nt, Artificial Sequence
  Synthetic
uaagagaggcuguacugcuu

SEQ ID NO: 2589 - RNA, 20 nt, Artificial Sequence
  Synthetic
cuccuacacccagccauuuu

SEQ ID NO: 2590 - RNA, 17 nt, Artificial Sequence
  Synthetic
guuccuccuuguuaucc

SEQ ID NO: 2591 - RNA, 20 nt, Artificial Sequence
  Synthetic
guuuaguuugauuuauaaga

SEQ ID NO: 2592 - RNA, 20 nt, Artificial Sequence
  Synthetic
gaguguuccuccuuguuauc

SEQ ID NO: 2593 - RNA, 17 nt, Artificial Sequence
  Synthetic
uccuugcacaggcccca

SEQ ID NO: 2594 - RNA, 17 nt, Artificial Sequence
  Synthetic
acagaauauaugugcca

SEQ ID NO: 2595 - RNA, 17 nt, Artificial Sequence
  Synthetic
aaaugaguuuauauaga

SEQ ID NO: 2596 - RNA, 17 nt, Artificial Sequence
  Synthetic
aaaaugaguuuauauag

SEQ ID NO: 2597 - RNA, 17 nt, Artificial Sequence
  Synthetic
agaauauaugugccaug

SEQ ID NO: 2598 - RNA, 17 nt, Artificial Sequence
  Synthetic
uguuuuuccccuuuugu

SEQ ID NO: 2599 - RNA, 20 nt, Artificial Sequence
  Synthetic
uuaaaaugaguuuauauaga

SEQ ID NO: 2600 - RNA, 20 nt, Artificial Sequence
  Synthetic
aguguuccuccuuguuaucc

SEQ ID NO: 2601 - RNA, 20 nt, Artificial Sequence
  Synthetic
cacucuaucgcgauuuaucu

SEQ ID NO: 2602 - RNA, 20 nt, Artificial Sequence
  Synthetic
cucuguuuuuccccuuuugu

SEQ ID NO: 2603 - RNA, 23 nt, Artificial Sequence
  Synthetic
gccuaugccuagauaaaucgcga

SEQ ID NO: 2604 - RNA, 18 nt, Artificial Sequence
  Synthetic
gaugaaggccaaaaaugg

SEQ ID NO: 2605 - RNA, 20 nt, Artificial Sequence
  Synthetic
gugaugaaggccaaaaaugg

SEQ ID NO: 2606 - RNA, 20 nt, Artificial Sequence
  Synthetic
gaaucauagcuuccuaugac

SEQ ID NO: 2607 - RNA, 23 nt, Artificial Sequence
  Synthetic
gaagaaucauagcuuccuaugac

SEQ ID NO: 2608 - RNA, 24 nt, Artificial Sequence
  Synthetic
ggaagaaucauagcuuccuaugac

SEQ ID NO: 2609 - RNA, 20 nt, Artificial Sequence
  Synthetic
guacagccucucuuacuggg

SEQ ID NO: 2610 - RNA, 23 nt, Artificial Sequence
  Synthetic
gcaguacagccucucuuacuggg

SEQ ID NO: 2611 - RNA, 23 nt, Artificial Sequence
  Synthetic
gccauuuuuggccuucaucacau

SEQ ID NO: 2612 - RNA, 18 nt, Artificial Sequence
  Synthetic
gucuuguguugaaauucu

SEQ ID NO: 2613 - RNA, 23 nt, Artificial Sequence
  Synthetic
gaaaagucuuguguugaaauucu

SEQ ID NO: 2614 - RNA, 18 nt, Artificial Sequence
  Synthetic
cuuuagaggagacuuaaa

SEQ ID NO: 2615 - RNA, 19 nt, Artificial Sequence
  Synthetic
ucuuuagaggagacuuaaa

SEQ ID NO: 2616 - RNA, 20 nt, Artificial Sequence
  Synthetic
aucuuuagaggagacuuaaa

SEQ ID NO: 2617 - RNA, 21 nt, Artificial Sequence
  Synthetic
caucuuuagaggagacuuaaa

SEQ ID NO: 2618 - RNA, 22 nt, Artificial Sequence
  Synthetic
ucaucuuuagaggagacuuaaa

SEQ ID NO: 2619 - RNA, 23 nt, Artificial Sequence
  Synthetic
uucaucuuuagaggagacuuaaa

SEQ ID NO: 2620 - RNA, 24 nt, Artificial Sequence
  Synthetic
uuucaucuuuagaggagacuuaaa

SEQ ID NO: 2621 - RNA, 18 nt, Artificial Sequence
  Synthetic
ugccuagauaaaucgcga

SEQ ID NO: 2622 - RNA, 19 nt, Artificial Sequence
  Synthetic
augccuagauaaaucgcga

SEQ ID NO: 2623 - RNA, 20 nt, Artificial Sequence
  Synthetic
uaugccuagauaaaucgcga

SEQ ID NO: 2624 - RNA, 21 nt, Artificial Sequence
  Synthetic
cuaugccuagauaaaucgcga

SEQ ID NO: 2625 - RNA, 22 nt, Artificial Sequence
  Synthetic
ccuaugccuagauaaaucgcga

SEQ ID NO: 2626 - RNA, 24 nt, Artificial Sequence
  Synthetic
agccuaugccuagauaaaucgcga

SEQ ID NO: 2627 - RNA, 18 nt, Artificial Sequence
  Synthetic
auuaaaacauguacgaua

SEQ ID NO: 2628 - RNA, 19 nt, Artificial Sequence
  Synthetic
cauuaaaacauguacgaua

SEQ ID NO: 2629 - RNA, 20 nt, Artificial Sequence
  Synthetic
acauuaaaacauguacgaua

SEQ ID NO: 2630 - RNA, 18 nt, Artificial Sequence
  Synthetic
uuaaaaugaguuuauaua

SEQ ID NO: 2631 - RNA, 19 nt, Artificial Sequence
  Synthetic
cuuaaaaugaguuuauaua

SEQ ID NO: 2632 - RNA, 20 nt, Artificial Sequence
  Synthetic
acuuaaaaugaguuuauaua

SEQ ID NO: 2633 - RNA, 19 nt, Artificial Sequence
  Synthetic
ugaugaaggccaaaaaugg

SEQ ID NO: 2634 - RNA, 21 nt, Artificial Sequence
  Synthetic
ugugaugaaggccaaaaaugg

SEQ ID NO: 2635 - RNA, 22 nt, Artificial Sequence
  Synthetic
augugaugaaggccaaaaaugg

SEQ ID NO: 2636 - RNA, 23 nt, Artificial Sequence
  Synthetic
aaugugaugaaggccaaaaaugg

SEQ ID NO: 2637 - RNA, 24 nt, Artificial Sequence
  Synthetic
caaugugaugaaggccaaaaaugg

SEQ ID NO: 2638 - RNA, 18 nt, Artificial Sequence
  Synthetic
uuucucauaaaauacccu

SEQ ID NO: 2639 - RNA, 19 nt, Artificial Sequence
  Synthetic
auuucucauaaaauacccu

SEQ ID NO: 2640 - RNA, 20 nt, Artificial Sequence
  Synthetic
uauuucucauaaaauacccu

SEQ ID NO: 2641 - RNA, 18 nt, Artificial Sequence
  Synthetic
aucauagcuuccuaugac

SEQ ID NO: 2642 - RNA, 19 nt, Artificial Sequence
  Synthetic
aaucauagcuuccuaugac

SEQ ID NO: 2643 - RNA, 21 nt, Artificial Sequence
  Synthetic
agaaucauagcuuccuaugac

SEQ ID NO: 2644 - RNA, 22 nt, Artificial Sequence
  Synthetic
aagaaucauagcuuccuaugac

SEQ ID NO: 2645 - RNA, 18 nt, Artificial Sequence
  Synthetic
acagccucucuuacuggg

SEQ ID NO: 2646 - RNA, 19 nt, Artificial Sequence
  Synthetic
uacagccucucuuacuggg

SEQ ID NO: 2647 - RNA, 21 nt, Artificial Sequence
  Synthetic
aguacagccucucuuacuggg

SEQ ID NO: 2648 - RNA, 22 nt, Artificial Sequence
  Synthetic
caguacagccucucuuacuggg

SEQ ID NO: 2649 - RNA, 24 nt, Artificial Sequence
  Synthetic
agcaguacagccucucuuacuggg

SEQ ID NO: 2650 - RNA, 18 nt, Artificial Sequence
  Synthetic
uuuuggccuucaucacau

SEQ ID NO: 2651 - RNA, 19 nt, Artificial Sequence
  Synthetic
uuuuuggccuucaucacau

SEQ ID NO: 2652 - RNA, 21 nt, Artificial Sequence
  Synthetic
cauuuuuggccuucaucacau

SEQ ID NO: 2653 - RNA, 22 nt, Artificial Sequence
  Synthetic
ccauuuuuggccuucaucacau

SEQ ID NO: 2654 - RNA, 24 nt, Artificial Sequence
  Synthetic
agccauuuuuggccuucaucacau

SEQ ID NO: 2655 - RNA, 19 nt, Artificial Sequence
  Synthetic
agucuuguguugaaauucu

SEQ ID NO: 2656 - RNA, 20 nt, Artificial Sequence
  Synthetic
aagucuuguguugaaauucu

SEQ ID NO: 2657 - RNA, 21 nt, Artificial Sequence
  Synthetic
aaagucuuguguugaaauucu

SEQ ID NO: 2658 - RNA, 22 nt, Artificial Sequence
  Synthetic
aaaagucuuguguugaaauucu

SEQ ID NO: 2659 - RNA, 24 nt, Artificial Sequence
  Synthetic
ugaaaagucuuguguugaaauucu

SEQ ID NO: 2660 - RNA, 21 nt, Artificial Sequence
  Synthetic
gacuuaaaaugaguuuauaua

SEQ ID NO: 2661 - RNA, 23 nt, Artificial Sequence
  Synthetic
gagacuuaaaaugaguuuauaua

SEQ ID NO: 2662 - RNA, 24 nt, Artificial Sequence
  Synthetic
ggagacuuaaaaugaguuuauaua

SEQ ID NO: 2663 - RNA, 19 nt, Artificial Sequence
  Synthetic
gaguguuccuccuuguuau

SEQ ID NO: 2664 - RNA, 23 nt, Artificial Sequence
  Synthetic
gauagaguguuccuccuuguuau

SEQ ID NO: 2665 - RNA, 22 nt, Artificial Sequence
  Synthetic
agacuuaaaaugaguuuauaua

SEQ ID NO: 2666 - RNA, 18 nt, Artificial Sequence
  Synthetic
aguguuccuccuuguuau

SEQ ID NO: 2667 - RNA, 20 nt, Artificial Sequence
  Synthetic
agaguguuccuccuuguuau

SEQ ID NO: 2668 - RNA, 21 nt, Artificial Sequence
  Synthetic
uagaguguuccuccuuguuau

SEQ ID NO: 2669 - RNA, 22 nt, Artificial Sequence
  Synthetic
auagaguguuccuccuuguuau

SEQ ID NO: 2670 - RNA, 24 nt, Artificial Sequence
  Synthetic
cgauagaguguuccuccuuguuau

SEQ ID NO: 2671 - RNA, 21 nt, Artificial Sequence
  Synthetic
uuauuucucauaaaauacccu

SEQ ID NO: 2672 - RNA, 22 nt, Artificial Sequence
  Synthetic
uuuauuucucauaaaauacccu

SEQ ID NO: 2673 - RNA, 23 nt, Artificial Sequence
  Synthetic
auuuauuucucauaaaauacccu

SEQ ID NO: 2674 - RNA, 24 nt, Artificial Sequence
  Synthetic
cauuuauuucucauaaaauacccu

SEQ ID NO: 2675 - RNA, 18 nt, Artificial Sequence
  Synthetic
ucacauuggaaugcagau

SEQ ID NO: 2676 - RNA, 19 nt, Artificial Sequence
  Synthetic
aucacauuggaaugcagau

SEQ ID NO: 2677 - RNA, 20 nt, Artificial Sequence
  Synthetic
caucacauuggaaugcagau

SEQ ID NO: 2678 - RNA, 21 nt, Artificial Sequence
  Synthetic
ucaucacauuggaaugcagau

SEQ ID NO: 2679 - RNA, 22 nt, Artificial Sequence
  Synthetic
uucaucacauuggaaugcagau

SEQ ID NO: 2680 - RNA, 23 nt, Artificial Sequence
  Synthetic
cuucaucacauuggaaugcagau

SEQ ID NO: 2681 - RNA, 24 nt, Artificial Sequence
  Synthetic
ccuucaucacauuggaaugcagau

SEQ ID NO: 2682 - RNA, 18 nt, Artificial Sequence
  Synthetic
ccuacaaaaggggaaaaa

SEQ ID NO: 2683 - RNA, 19 nt, Artificial Sequence
  Synthetic
uccuacaaaaggggaaaaa

SEQ ID NO: 2684 - RNA, 20 nt, Artificial Sequence
  Synthetic
uuccuacaaaaggggaaaaa

SEQ ID NO: 2685 - RNA, 21 nt, Artificial Sequence
  Synthetic
cuuccuacaaaaggggaaaaa

SEQ ID NO: 2686 - RNA, 22 nt, Artificial Sequence
  Synthetic
acuuccuacaaaaggggaaaaa

SEQ ID NO: 2687 - RNA, 23 nt, Artificial Sequence
  Synthetic
gacuuccuacaaaaggggaaaaa

SEQ ID NO: 2688 - RNA, 24 nt, Artificial Sequence
  Synthetic
ugacuuccuacaaaaggggaaaaa

SEQ ID NO: 2689 - RNA, 18 nt, Artificial Sequence
  Synthetic
uggugacuuccuacaaaa

SEQ ID NO: 2690 - RNA, 19 nt, Artificial Sequence
  Synthetic
uuggugacuuccuacaaaa

SEQ ID NO: 2691 - RNA, 21 nt, Artificial Sequence
  Synthetic
cuuuggugacuuccuacaaaa

SEQ ID NO: 2692 - RNA, 22 nt, Artificial Sequence
  Synthetic
gcuuuggugacuuccuacaaaa

SEQ ID NO: 2693 - RNA, 23 nt, Artificial Sequence
  Synthetic
ugcuuuggugacuuccuacaaaa

SEQ ID NO: 2694 - RNA, 24 nt, Artificial Sequence
  Synthetic
cugcuuuggugacuuccuacaaaa

SEQ ID NO: 2695 - RNA, 18 nt, Artificial Sequence
  Synthetic
uuggugacuuccuacaaa

SEQ ID NO: 2696 - RNA, 19 nt, Artificial Sequence
  Synthetic
uuuggugacuuccuacaaa

SEQ ID NO: 2697 - RNA, 21 nt, Artificial Sequence
  Synthetic
gcuuuggugacuuccuacaaa

SEQ ID NO: 2698 - RNA, 22 nt, Artificial Sequence
  Synthetic
ugcuuuggugacuuccuacaaa

SEQ ID NO: 2699 - RNA, 23 nt, Artificial Sequence
  Synthetic
cugcuuuggugacuuccuacaaa

SEQ ID NO: 2700 - RNA, 24 nt, Artificial Sequence
  Synthetic
acugcuuuggugacuuccuacaaa

SEQ ID NO: 2701 - RNA, 18 nt, Artificial Sequence
  Synthetic
caguguccucacaauaaa

SEQ ID NO: 2702 - RNA, 19 nt, Artificial Sequence
  Synthetic
gcaguguccucacaauaaa

SEQ ID NO: 2703 - RNA, 20 nt, Artificial Sequence
  Synthetic
agcaguguccucacaauaaa

SEQ ID NO: 2704 - RNA, 21 nt, Artificial Sequence
  Synthetic
gagcaguguccucacaauaaa

SEQ ID NO: 2705 - RNA, 22 nt, Artificial Sequence
  Synthetic
ggagcaguguccucacaauaaa

SEQ ID NO: 2706 - RNA, 23 nt, Artificial Sequence
  Synthetic
aggagcaguguccucacaauaaa

SEQ ID NO: 2707 - RNA, 24 nt, Artificial Sequence
  Synthetic
uaggagcaguguccucacaauaaa

SEQ ID NO: 2708 - RNA, 18 nt, Artificial Sequence
  Synthetic
uuuggugacuuccuacaa

SEQ ID NO: 2709 - RNA, 19 nt, Artificial Sequence
  Synthetic
cuuuggugacuuccuacaa

SEQ ID NO: 2710 - RNA, 20 nt, Artificial Sequence
  Synthetic
gcuuuggugacuuccuacaa

SEQ ID NO: 2711 - RNA, 21 nt, Artificial Sequence
  Synthetic
ugcuuuggugacuuccuacaa

SEQ ID NO: 2712 - RNA, 22 nt, Artificial Sequence
  Synthetic
cugcuuuggugacuuccuacaa

SEQ ID NO: 2713 - RNA, 23 nt, Artificial Sequence
  Synthetic
acugcuuuggugacuuccuacaa

SEQ ID NO: 2714 - RNA, 24 nt, Artificial Sequence
  Synthetic
uacugcuuuggugacuuccuacaa

SEQ ID NO: 2715 - RNA, 18 nt, Artificial Sequence
  Synthetic
uaugauucuucccaguaa

SEQ ID NO: 2716 - RNA, 19 nt, Artificial Sequence
  Synthetic
cuaugauucuucccaguaa

SEQ ID NO: 2717 - RNA, 20 nt, Artificial Sequence
  Synthetic
gcuaugauucuucccaguaa

SEQ ID NO: 2718 - RNA, 21 nt, Artificial Sequence
  Synthetic
agcuaugauucuucccaguaa

SEQ ID NO: 2719 - RNA, 22 nt, Artificial Sequence
  Synthetic
aagcuaugauucuucccaguaa

SEQ ID NO: 2720 - RNA, 23 nt, Artificial Sequence
  Synthetic
gaagcuaugauucuucccaguaa

SEQ ID NO: 2721 - RNA, 24 nt, Artificial Sequence
  Synthetic
ggaagcuaugauucuucccaguaa

SEQ ID NO: 2722 - RNA, 18 nt, Artificial Sequence
  Synthetic
uacaaaaggggaaaaaca

SEQ ID NO: 2723 - RNA, 19 nt, Artificial Sequence
  Synthetic
cuacaaaaggggaaaaaca

SEQ ID NO: 2724 - RNA, 20 nt, Artificial Sequence
  Synthetic
ccuacaaaaggggaaaaaca

SEQ ID NO: 2725 - RNA, 21 nt, Artificial Sequence
  Synthetic
uccuacaaaaggggaaaaaca

SEQ ID NO: 2726 - RNA, 22 nt, Artificial Sequence
  Synthetic
uuccuacaaaaggggaaaaaca

SEQ ID NO: 2727 - RNA, 23 nt, Artificial Sequence
  Synthetic
cuuccuacaaaaggggaaaaaca

SEQ ID NO: 2728 - RNA, 24 nt, Artificial Sequence
  Synthetic
acuuccuacaaaaggggaaaaaca

SEQ ID NO: 2729 - RNA, 18 nt, Artificial Sequence
  Synthetic
uacagaauauaugugcca

(The sequence listing continues in the following parts.)

What is claimed is:

1. A CRISPR/Cas system, comprising:
a) a gRNA molecule comprising a targeting domain that is complementary with a target sequence of a cystic fibrosis transmembrane conductance regulator (CFTR) gene or a sodium channel epithelial 1 alpha (SCNN1A) gene, wherein said target sequence of said CFTR gene is within intron 2 or intron 10 of said CFTR gene; and
b) a Cas9 molecule,
wherein said targeting domain that is complementary to said CFTR gene comprises or consists of a nucleotide sequence that is the same as, or differs by no more than 3 nucleotides from, a targeting domain sequence selected from the targeting domain sequences set forth in SEQ ID NOs: 15101-27265 and wherein said targeting domain that is complementary to said SCNN1A gene comprises or consists of a nucleotide sequence that is the same as, or differs by no more than 3 nucleotides from, a targeting domain sequence selected from the targeting domain sequences set forth in SEQ ID NOs: 497-654, 803-916, and 4176-15100.

2. The system of claim 1, wherein said targeting domain that is complementary to said CFTR gene comprises or consists of a nucleotide sequence that is the same as, or differs by no more than 3 nucleotides from, a targeting domain sequence selected from the targeting domain sequences set forth in SEQ ID NOs: 15101-27265.

3. The system of claim 1, wherein said targeting domain that is complementary to said SCNN1A gene comprises or consists of a nucleotide sequence that is the same as, or differs by no more than 3 nucleotides from, a targeting domain sequence selected from the targeting domain sequences set forth in SEQ ID NOs: 497-654, 803-916, and 4176-15100.

4. A gRNA molecule comprising a targeting domain that is complementary with a target sequence of a CFTR gene or a SCNN1A gene, wherein the target sequence of the CFTR gene is within intron 2 or intron 10 of the CFTR gene, wherein said targeting domain that is complementary to said CFTR gene comprises or consists of a nucleotide sequence that is the same as, or differs by no more than 3 nucleotides from, a targeting domain sequence selected from the targeting domain sequences set forth in SEQ ID NOs: 15101-27265 and wherein said targeting domain that is complementary to said SCNN1A gene comprises or consists of a nucleotide sequence that is the same as, or differs by no more than 3 nucleotides from, a targeting domain sequence selected from the targeting domain sequences set forth in SEQ ID NOs: 497-654, 803-916, and 4176-15100.

5. The gRNA molecule of claim 4, wherein said targeting domain that is complementary to said CFTR gene comprises or consists of a nucleotide sequence that is the same as, or differs by no more than 3 nucleotides from, a targeting domain sequence set forth in SEQ ID NOs: 15101-27265.

6. The gRNA molecule of claim 4, wherein said targeting domain that is complementary to said SCNN1A gene comprises or consists of a nucleotide sequence that is the same as, or differs by no more than 3 nucleotides from, a targeting domain sequence set forth in SEQ ID NOs: 497-654, 803-916, and 4176-15100.

7. A CRISPR/Cas system, comprising:
a) a gRNA molecule comprising a targeting domain that is complementary with a target sequence of a cystic fibrosis transmembrane conductance regulator (CFTR) gene or a sodium channel epithelial 1 alpha (SCNN1A) gene, wherein said target sequence of said CFTR gene is within intron 2 or intron 10 of said CFTR gene, wherein said targeting domain that is complementary to said SCNN1A gene comprises a nucleotide sequence that is the same as, or differs by no more than 3 nucleotides from, a targeting domain sequence selected from the targeting domain sequences set forth in SEQ ID NOs: 497-654, 803-916, and 4176-15100 and wherein said targeting domain that is complementary to said CFTR gene comprises a nucleotide sequence that is the same as, or differs by no more than 3 nucleotides from, a targeting domain sequence selected from the targeting domain sequences set forth in SEQ ID NOs: 15101-27265;
b) a Cas9 molecule; and
c) a cDNA donor template that alters said CFTR gene or SCNN1A gene, wherein said cDNA donor template that alters said CFTR gene comprises (a) contiguous coding sequence of exon 3 through exon 27 of said CFTR gene; or (b) contiguous coding sequence of exon 11 through exon 27 of said CFTR gene.

8. A composition comprising:
a) a gRNA molecule comprising a targeting domain that is complementary with a target sequence of a CFTR gene or a SCNN1A gene, wherein the target sequence of the CFTR gene is within intron 2 or intron 10 of the CFTR gene, wherein said targeting domain that is complementary to said SCNN1A gene comprises a nucleotide sequence that is the same as, or differs by no more than 3 nucleotides from, a targeting domain sequence selected from the targeting domain sequences set forth in SEQ ID NOs: 497-654, 803-916, and 4176-15100 and wherein said targeting domain that is complementary to said CFTR gene comprises a nucleotide sequence that is the same as, or differs by no more than 3 nucleotides from, a targeting domain sequence selected from the targeting domain sequences set forth in SEQ ID NOs: 15101-27265; and
b) a cDNA donor template that alters said CFTR gene or SCNN1A gene, wherein said cDNA donor template that alters said CFTR gene comprises (a) contiguous coding sequence of exon 3 through exon 27 of said CFTR gene; or (b) contiguous coding sequence of exon 11 through exon 27 of said CFTR gene.

9. A nucleic acid composition that comprises:
a) a first nucleotide sequence that encodes a gRNA molecule comprising a targeting domain that is complementary with a target sequence of a CFTR gene or a SCNN1A gene, wherein the target sequence of the CFTR gene is within intron 2 or intron 10 of the CFTR gene, wherein said targeting domain that is complementary to said SCNN1A gene comprises a nucleotide sequence that is the same as, or differs by no more than 3 nucleotides from, a targeting domain sequence selected from the targeting domain sequences set forth in SEQ ID NOs: 497-654, 803-916, and 4176-15100 and wherein said targeting domain that is complementary to said CFTR gene comprises a nucleotide sequence that is the same as, or differs by no more than 3 nucleotides from, a targeting domain sequence selected from the targeting domain sequences set forth in SEQ ID NOs: 15101-27265; and
b) a template nucleic acid comprising a cDNA donor template that alters said CFTR gene or SCNN1A gene, wherein said cDNA donor template that alters said CFTR gene comprises (a) contiguous coding sequence of exon 3 through exon 27 of said CFTR gene; or (b) contiguous coding sequence of exon 11 through exon 27 of said CFTR gene.

* * * * *